United States Patent 12,644,137 (MATERIALS AND METHODS FOR TREATMENT OF HEMOGLOBINOPATHIES) - sequence listing, part 7

SEQ ID NO: 133169 - DNA, 22 bp, Artificial Sequence
  Synthetic oligonucleotide; TTA chr11 5287069 5287090 5287074 5287069 -
taaatgctaactactctagaaa

SEQ ID NO: 133170 - DNA, 22 bp, Artificial Sequence
  Synthetic oligonucleotide; CTA chr11 5287060 5287081 5287065 5287060 -
actactctagaaatgtttgcta

SEQ ID NO: 133171 - DNA, 22 bp, Artificial Sequence
  Synthetic oligonucleotide; CTA chr11 5287056 5287077 5287061 5287056 -
ctctagaaatgtttgctagtat

SEQ ID NO: 133172 - DNA, 22 bp, Artificial Sequence
  Synthetic oligonucleotide; CTC chr11 5287053 5287074 5287058 5287053 -
tagaaatgtttgctagtatttt

SEQ ID NO: 133173 - DNA, 22 bp, Artificial Sequence
  Synthetic oligonucleotide; CTA chr11 5287051 5287072 5287056 5287051 -
gaaatgtttgctagtatttttt

SEQ ID NO: 133174 - DNA, 22 bp, Artificial Sequence
  Synthetic oligonucleotide; TTT chr11 5287042 5287063 5287047 5287042 -
gctagtattttttgtttaactg

SEQ ID NO: 133175 - DNA, 22 bp, Artificial Sequence
  Synthetic oligonucleotide; TTG chr11 5287041 5287062 5287046 5287041 -
ctagtattttttgtttaactgc

SEQ ID NO: 133176 - DNA, 22 bp, Artificial Sequence
  Synthetic oligonucleotide; CTA chr11 5287038 5287059 5287043 5287038 -
gtattttttgtttaactgcaat

SEQ ID NO: 133177 - DNA, 22 bp, Artificial Sequence
  Synthetic oligonucleotide; TTT chr11 5287032 5287053 5287037 5287032 -
tttgtttaactgcaatcattct

SEQ ID NO: 133178 - DNA, 22 bp, Artificial Sequence
  Synthetic oligonucleotide; TTT chr11 5287031 5287052 5287036 5287031 -
ttgtttaactgcaatcattctt

SEQ ID NO: 133179 - DNA, 22 bp, Artificial Sequence
  Synthetic oligonucleotide; TTT chr11 5287030 5287051 5287035 5287030 -
tgtttaactgcaatcattcttg

SEQ ID NO: 133180 - DNA, 22 bp, Artificial Sequence
  Synthetic oligonucleotide; TTT chr11 5287029 5287050 5287034 5287029 -
gtttaactgcaatcattcttgc

SEQ ID NO: 133181 - DNA, 22 bp, Artificial Sequence
  Synthetic oligonucleotide; TTG chr11 5287028 5287049 5287033 5287028 -
tttaactgcaatcattcttgct

SEQ ID NO: 133182 - DNA, 22 bp, Artificial Sequence
  Synthetic oligonucleotide; TTT chr11 5287025 5287046 5287030 5287025 -
aactgcaatcattcttgctgca

SEQ ID NO: 133183 - DNA, 22 bp, Artificial Sequence
  Synthetic oligonucleotide; TTA chr11 5287024 5287045 5287029 5287024 -
actgcaatcattcttgctgcag

SEQ ID NO: 133184 - DNA, 22 bp, Artificial Sequence
  Synthetic oligonucleotide; CTG chr11 5287020 5287041 5287025 5287020 -
caatcattcttgctgcaggtga

SEQ ID NO: 133185 - DNA, 22 bp, Artificial Sequence
  Synthetic oligonucleotide; TTC chr11 5287011 5287032 5287016 5287011 -
ttgctgcaggtgaaaactagtg

SEQ ID NO: 133186 - DNA, 22 bp, Artificial Sequence
  Synthetic oligonucleotide; CTT chr11 5287009 5287030 5287014 5287009 -
gctgcaggtgaaaactagtgtt

SEQ ID NO: 133187 - DNA, 22 bp, Artificial Sequence
  Synthetic oligonucleotide; TTG chr11 5287008 5287029 5287013 5287008 -
ctgcaggtgaaaactagtgttc

SEQ ID NO: 133188 - DNA, 22 bp, Artificial Sequence
  Synthetic oligonucleotide; CTG chr11 5287005 5287026 5287010 5287005 -
caggtgaaaactagtgttctgt

SEQ ID NO: 133189 - DNA, 22 bp, Artificial Sequence
  Synthetic oligonucleotide; CTA chr11 5286992 5287013 5286997 5286992 -
gtgttctgtactttatgcccat

SEQ ID NO: 133190 - DNA, 22 bp, Artificial Sequence
  Synthetic oligonucleotide; TTC chr11 5286986 5287007 5286991 5286986 -
tgtactttatgcccattcatct

SEQ ID NO: 133191 - DNA, 22 bp, Artificial Sequence
  Synthetic oligonucleotide; CTG chr11 5286984 5287005 5286989 5286984 -
tactttatgcccattcatcttt

SEQ ID NO: 133192 - DNA, 22 bp, Artificial Sequence
  Synthetic oligonucleotide; CTT chr11 5286979 5287000 5286984 5286979 -
tatgcccattcatctttaactg

SEQ ID NO: 133193 - DNA, 22 bp, Artificial Sequence
  Synthetic oligonucleotide; TTT chr11 5286978 5286999 5286983 5286978 -
atgcccattcatctttaactgt

SEQ ID NO: 133194 - DNA, 22 bp, Artificial Sequence
  Synthetic oligonucleotide; TTA chr11 5286977 5286998 5286982 5286977 -
tgcccattcatctttaactgta

SEQ ID NO: 133195 - DNA, 22 bp, Artificial Sequence
  Synthetic oligonucleotide; TTC chr11 5286968 5286989 5286973 5286968 -
atctttaactgtaataataaaa

SEQ ID NO: 133196 - DNA, 22 bp, Artificial Sequence
  Synthetic oligonucleotide; CTT chr11 5286963 5286984 5286968 5286963 -
taactgtaataataaaaataac

SEQ ID NO: 133197 - DNA, 22 bp, Artificial Sequence
  Synthetic oligonucleotide; TTT chr11 5286962 5286983 5286967 5286962 -
aactgtaataataaaaataact

SEQ ID NO: 133198 - DNA, 22 bp, Artificial Sequence
  Synthetic oligonucleotide; TTA chr11 5286961 5286982 5286966 5286961 -
actgtaataataaaaataactg

SEQ ID NO: 133199 - DNA, 22 bp, Artificial Sequence
  Synthetic oligonucleotide; CTG chr11 5286957 5286978 5286962 5286957 -
taataataaaaataactgacat

SEQ ID NO: 133200 - DNA, 22 bp, Artificial Sequence
  Synthetic oligonucleotide; CTG chr11 5286939 5286960 5286944 5286939 -
acatttattgaaggctatcaga

SEQ ID NO: 133201 - DNA, 22 bp, Artificial Sequence
  Synthetic oligonucleotide; TTT chr11 5286933 5286954 5286938 5286933 -
attgaaggctatcagagactgt

SEQ ID NO: 133202 - DNA, 22 bp, Artificial Sequence
  Synthetic oligonucleotide; TTA chr11 5286932 5286953 5286937 5286932 -
ttgaaggctatcagagactgta

SEQ ID NO: 133203 - DNA, 22 bp, Artificial Sequence
  Synthetic oligonucleotide; TTG chr11 5286929 5286950 5286934 5286929 -
aaggctatcagagactgtaatt

SEQ ID NO: 133204 - DNA, 22 bp, Artificial Sequence
  Synthetic oligonucleotide; CTA chr11 5286922 5286943 5286927 5286922 -
tcagagactgtaattagtgctt

SEQ ID NO: 133205 - DNA, 22 bp, Artificial Sequence
  Synthetic oligonucleotide; CTG chr11 5286912 5286933 5286917 5286912 -
taattagtgctttgcataatta

SEQ ID NO: 133206 - DNA, 22 bp, Artificial Sequence
  Synthetic oligonucleotide; TTA chr11 5286906 5286927 5286911 5286906 -
gtgctttgcataattaatcata

SEQ ID NO: 133207 - DNA, 22 bp, Artificial Sequence
  Synthetic oligonucleotide; CTT chr11 5286900 5286921 5286905 5286900 -
tgcataattaatcatatttaat

SEQ ID NO: 133208 - DNA, 22 bp, Artificial Sequence
  Synthetic oligonucleotide; TTT chr11 5286899 5286920 5286904 5286899 -
gcataattaatcatatttaata

SEQ ID NO: 133209 - DNA, 22 bp, Artificial Sequence
  Synthetic oligonucleotide; TTG chr11 5286898 5286919 5286903 5286898 -
cataattaatcatatttaatac

SEQ ID NO: 133210 - DNA, 22 bp, Artificial Sequence
  Synthetic oligonucleotide; TTA chr11 5286890 5286911 5286895 5286890 -
atcatatttaatactcttggat

SEQ ID NO: 133211 - DNA, 22 bp, Artificial Sequence
  Synthetic oligonucleotide; TTT chr11 5286881 5286902 5286886 5286881 -
aatactcttggattctttcagg

SEQ ID NO: 133212 - DNA, 22 bp, Artificial Sequence
  Synthetic oligonucleotide; TTA chr11 5286880 5286901 5286885 5286880 -
atactcttggattctttcaggt

SEQ ID NO: 133213 - DNA, 22 bp, Artificial Sequence
  Synthetic oligonucleotide; CTC chr11 5286874 5286895 5286879 5286874 -
ttggattctttcaggtagatac

SEQ ID NO: 133214 - DNA, 22 bp, Artificial Sequence
  Synthetic oligonucleotide; CTT chr11 5286872 5286893 5286877 5286872 -
ggattctttcaggtagatacta

SEQ ID NO: 133215 - DNA, 22 bp, Artificial Sequence
  Synthetic oligonucleotide; TTG chr11 5286871 5286892 5286876 5286871 -
gattctttcaggtagatactat

SEQ ID NO: 133216 - DNA, 22 bp, Artificial Sequence
  Synthetic oligonucleotide; TTC chr11 5286866 5286887 5286871 5286866 -
tttcaggtagatactattatta

SEQ ID NO: 133217 - DNA, 22 bp, Artificial Sequence
  Synthetic oligonucleotide; CTT chr11 5286864 5286885 5286869 5286864 -
tcaggtagatactattattatc

SEQ ID NO: 133218 - DNA, 22 bp, Artificial Sequence
  Synthetic oligonucleotide; TTT chr11 5286863 5286884 5286868 5286863 -
caggtagatactattattatcc

SEQ ID NO: 133219 - DNA, 22 bp, Artificial Sequence
  Synthetic oligonucleotide; TTC chr11 5286862 5286883 5286867 5286862 -
aggtagatactattattatccc

SEQ ID NO: 133220 - DNA, 22 bp, Artificial Sequence
  Synthetic oligonucleotide; CTA chr11 5286850 5286871 5286855 5286850 -
ttattatccccattttactaca

SEQ ID NO: 133221 - DNA, 22 bp, Artificial Sequence
  Synthetic oligonucleotide; TTA chr11 5286847 5286868 5286852 5286847 -
ttatccccattttactacagtt

SEQ ID NO: 133222 - DNA, 22 bp, Artificial Sequence
  Synthetic oligonucleotide; TTA chr11 5286844 5286865 5286849 5286844 -
tccccattttactacagttaaa

SEQ ID NO: 133223 - DNA, 22 bp, Artificial Sequence
  Synthetic oligonucleotide; TTT chr11 5286835 5286856 5286840 5286835 -
tactacagttaaaaaaactacc

SEQ ID NO: 133224 - DNA, 22 bp, Artificial Sequence
  Synthetic oligonucleotide; TTT chr11 5286834 5286855 5286839 5286834 -
actacagttaaaaaaactacct

SEQ ID NO: 133225 - DNA, 22 bp, Artificial Sequence
  Synthetic oligonucleotide; TTA chr11 5286833 5286854 5286838 5286833 -
ctacagttaaaaaaactacctc

SEQ ID NO: 133226 - DNA, 22 bp, Artificial Sequence
  Synthetic oligonucleotide; CTA chr11 5286830 5286851 5286835 5286830 -
cagttaaaaaaactacctctca

SEQ ID NO: 133227 - DNA, 22 bp, Artificial Sequence
  Synthetic oligonucleotide; TTA chr11 5286824 5286845 5286829 5286824 -
aaaaaactacctctcaacttgc

SEQ ID NO: 133228 - DNA, 22 bp, Artificial Sequence
  Synthetic oligonucleotide; CTA chr11 5286815 5286836 5286820 5286815 -
cctctcaacttgctcaagcata

SEQ ID NO: 133229 - DNA, 22 bp, Artificial Sequence
  Synthetic oligonucleotide; CTC chr11 5286811 5286832 5286816 5286811 -
tcaacttgctcaagcatacact

SEQ ID NO: 133230 - DNA, 22 bp, Artificial Sequence
  Synthetic oligonucleotide; CTC chr11 5286809 5286830 5286814 5286809 -
aacttgctcaagcatacactct

SEQ ID NO: 133231 - DNA, 22 bp, Artificial Sequence
  Synthetic oligonucleotide; CTT chr11 5286804 5286825 5286809 5286804 -
gctcaagcatacactctcacac

SEQ ID NO: 133232 - DNA, 22 bp, Artificial Sequence
  Synthetic oligonucleotide; TTG chr11 5286803 5286824 5286808 5286803 -
ctcaagcatacactctcacaca

SEQ ID NO: 133233 - DNA, 22 bp, Artificial Sequence
  Synthetic oligonucleotide; CTC chr11 5286800 5286821 5286805 5286800 -
aagcatacactctcacacacac

SEQ ID NO: 133234 - DNA, 22 bp, Artificial Sequence
  Synthetic oligonucleotide; CTC chr11 5286788 5286809 5286793 5286788 -
tcacacacacaaacataaacta

SEQ ID NO: 133235 - DNA, 22 bp, Artificial Sequence
  Synthetic oligonucleotide; CTC chr11 5286786 5286807 5286791 5286786 -
acacacacaaacataaactact

SEQ ID NO: 133236 - DNA, 22 bp, Artificial Sequence
  Synthetic oligonucleotide; CTA chr11 5286766 5286787 5286771 5286766 -
ctagcaaatagtagaattgaga

SEQ ID NO: 133237 - DNA, 22 bp, Artificial Sequence
  Synthetic oligonucleotide; CTA chr11 5286763 5286784 5286768 5286763 -
gcaaatagtagaattgagattt

SEQ ID NO: 133238 - DNA, 22 bp, Artificial Sequence
  Synthetic oligonucleotide; TTG chr11 5286747 5286768 5286752 5286747 -
agatttggtcctaattatgtct

SEQ ID NO: 133239 - DNA, 22 bp, Artificial Sequence
  Synthetic oligonucleotide; TTT chr11 5286741 5286762 5286746 5286741 -
ggtcctaattatgtctttgctc

SEQ ID NO: 133240 - DNA, 22 bp, Artificial Sequence
  Synthetic oligonucleotide; TTG chr11 5286740 5286761 5286745 5286740 -
gtcctaattatgtctttgctca

SEQ ID NO: 133241 - DNA, 22 bp, Artificial Sequence
  Synthetic oligonucleotide; CTA chr11 5286734 5286755 5286739 5286734 -
attatgtctttgctcactatcc

SEQ ID NO: 133242 - DNA, 22 bp, Artificial Sequence
  Synthetic oligonucleotide; TTA chr11 5286730 5286751 5286735 5286730 -
tgtctttgctcactatccaata

SEQ ID NO: 133243 - DNA, 22 bp, Artificial Sequence
  Synthetic oligonucleotide; CTT chr11 5286724 5286745 5286729 5286724 -
tgctcactatccaataaatatt

SEQ ID NO: 133244 - DNA, 22 bp, Artificial Sequence
  Synthetic oligonucleotide; TTT chr11 5286723 5286744 5286728 5286723 -
gctcactatccaataaatattt

SEQ ID NO: 133245 - DNA, 22 bp, Artificial Sequence
  Synthetic oligonucleotide; TTG chr11 5286722 5286743 5286727 5286722 -
ctcactatccaataaatattta

SEQ ID NO: 133246 - DNA, 22 bp, Artificial Sequence
  Synthetic oligonucleotide; CTC chr11 5286719 5286740 5286724 5286719 -
actatccaataaatatttattg

SEQ ID NO: 133247 - DNA, 22 bp, Artificial Sequence
  Synthetic oligonucleotide; CTA chr11 5286715 5286736 5286720 5286715 -
tccaataaatatttattgacat

SEQ ID NO: 133248 - DNA, 22 bp, Artificial Sequence
  Synthetic oligonucleotide; TTT chr11 5286701 5286722 5286706 5286701 -
attgacatgtacttcttggcag

SEQ ID NO: 133249 - DNA, 22 bp, Artificial Sequence
  Synthetic oligonucleotide; TTA chr11 5286700 5286721 5286705 5286700 -
ttgacatgtacttcttggcagt

SEQ ID NO: 133250 - DNA, 22 bp, Artificial Sequence
  Synthetic oligonucleotide; TTG chr11 5286697 5286718 5286702 5286697 -
acatgtacttcttggcagtctg

SEQ ID NO: 133251 - DNA, 22 bp, Artificial Sequence
  Synthetic oligonucleotide; CTT chr11 5286687 5286708 5286692 5286687 -
cttggcagtctgtatgctggat

SEQ ID NO: 133252 - DNA, 22 bp, Artificial Sequence
  Synthetic oligonucleotide; TTC chr11 5286686 5286707 5286691 5286686 -
ttggcagtctgtatgctggatg

SEQ ID NO: 133253 - DNA, 22 bp, Artificial Sequence
  Synthetic oligonucleotide; CTT chr11 5286684 5286705 5286689 5286684 -
ggcagtctgtatgctggatgct

SEQ ID NO: 133254 - DNA, 22 bp, Artificial Sequence
  Synthetic oligonucleotide; TTG chr11 5286683 5286704 5286688 5286683 -
gcagtctgtatgctggatgctg

SEQ ID NO: 133255 - DNA, 22 bp, Artificial Sequence
  Synthetic oligonucleotide; CTG chr11 5286675 5286696 5286680 5286675 -
tatgctggatgctggggataca

SEQ ID NO: 133256 - DNA, 22 bp, Artificial Sequence
  Synthetic oligonucleotide; CTG chr11 5286668 5286689 5286673 5286668 -
gatgctggggatacaaagatgt

SEQ ID NO: 133257 - DNA, 22 bp, Artificial Sequence
  Synthetic oligonucleotide; CTG chr11 5286661 5286682 5286666 5286661 -
gggatacaaagatgtttaaatt

SEQ ID NO: 133258 - DNA, 22 bp, Artificial Sequence
  Synthetic oligonucleotide; TTT chr11 5286644 5286665 5286649 5286644 -
aaatttaagctccagtctctgc

SEQ ID NO: 133259 - DNA, 22 bp, Artificial Sequence
  Synthetic oligonucleotide; TTA chr11 5286643 5286664 5286648 5286643 -
aatttaagctccagtctctgct

SEQ ID NO: 133260 - DNA, 22 bp, Artificial Sequence
  Synthetic oligonucleotide; TTT chr11 5286638 5286659 5286643 5286638 -
aagctccagtctctgcttccaa

SEQ ID NO: 133261 - DNA, 22 bp, Artificial Sequence
  Synthetic oligonucleotide; TTA chr11 5286637 5286658 5286642 5286637 -
agctccagtctctgcttccaaa

SEQ ID NO: 133262 - DNA, 22 bp, Artificial Sequence
  Synthetic oligonucleotide; CTC chr11 5286632 5286653 5286637 5286632 -
cagtctctgcttccaaaggcct

SEQ ID NO: 133263 - DNA, 22 bp, Artificial Sequence
  Synthetic oligonucleotide; CTC chr11 5286625 5286646 5286630 5286625 -
tgcttccaaaggcctcccaggc

SEQ ID NO: 133264 - DNA, 22 bp, Artificial Sequence
  Synthetic oligonucleotide; CTG chr11 5286623 5286644 5286628 5286623 -
cttccaaaggcctcccaggcca

SEQ ID NO: 133265 - DNA, 22 bp, Artificial Sequence
  Synthetic oligonucleotide; CTT chr11 5286620 5286641 5286625 5286620 -
ccaaaggcctcccaggccaagt

SEQ ID NO: 133266 - DNA, 22 bp, Artificial Sequence
  Synthetic oligonucleotide; TTC chr11 5286619 5286640 5286624 5286619 -
caaaggcctcccaggccaagtt

SEQ ID NO: 133267 - DNA, 22 bp, Artificial Sequence
  Synthetic oligonucleotide; CTC chr11 5286609 5286630 5286614 5286609 -
ccaggccaagttatccattcag

SEQ ID NO: 133268 - DNA, 22 bp, Artificial Sequence
  Synthetic oligonucleotide; TTA chr11 5286596 5286617 5286601 5286596 -
tccattcagaaagcatttttta

SEQ ID NO: 133269 - DNA, 22 bp, Artificial Sequence
  Synthetic oligonucleotide; TTC chr11 5286589 5286610 5286594 5286589 -
agaaagcattttttactctttg

SEQ ID NO: 133270 - DNA, 22 bp, Artificial Sequence
  Synthetic oligonucleotide; TTT chr11 5286578 5286599 5286583 5286578 -
tttactctttgcattccactgt

SEQ ID NO: 133271 - DNA, 22 bp, Artificial Sequence
  Synthetic oligonucleotide; TTT chr11 5286577 5286598 5286582 5286577 -
ttactctttgcattccactgtt

SEQ ID NO: 133272 - DNA, 22 bp, Artificial Sequence
  Synthetic oligonucleotide; TTT chr11 5286576 5286597 5286581 5286576 -
tactctttgcattccactgttt

SEQ ID NO: 133273 - DNA, 22 bp, Artificial Sequence
  Synthetic oligonucleotide; TTT chr11 5286575 5286596 5286580 5286575 -
actctttgcattccactgtttt

SEQ ID NO: 133274 - DNA, 22 bp, Artificial Sequence
  Synthetic oligonucleotide; TTA chr11 5286574 5286595 5286579 5286574 -
ctctttgcattccactgttttt

SEQ ID NO: 133275 - DNA, 22 bp, Artificial Sequence
  Synthetic oligonucleotide; CTC chr11 5286571 5286592 5286576 5286571 -
tttgcattccactgtttttcct

SEQ ID NO: 133276 - DNA, 22 bp, Artificial Sequence
  Synthetic oligonucleotide; CTT chr11 5286569 5286590 5286574 5286569 -
tgcattccactgtttttcctaa

SEQ ID NO: 133277 - DNA, 22 bp, Artificial Sequence
  Synthetic oligonucleotide; TTT chr11 5286568 5286589 5286573 5286568 -
gcattccactgtttttcctaag

SEQ ID NO: 133278 - DNA, 22 bp, Artificial Sequence
  Synthetic oligonucleotide; TTG chr11 5286567 5286588 5286572 5286567 -
cattccactgtttttcctaagt

SEQ ID NO: 133279 - DNA, 22 bp, Artificial Sequence
  Synthetic oligonucleotide; TTC chr11 5286562 5286583 5286567 5286562 -
cactgtttttcctaagtgacta

SEQ ID NO: 133280 - DNA, 22 bp, Artificial Sequence
  Synthetic oligonucleotide; CTG chr11 5286557 5286578 5286562 5286557 -
tttttcctaagtgactaaaaaa

SEQ ID NO: 133281 - DNA, 22 bp, Artificial Sequence
  Synthetic oligonucleotide; TTT chr11 5286554 5286575 5286559 5286554 -
ttcctaagtgactaaaaaatta

SEQ ID NO: 133282 - DNA, 22 bp, Artificial Sequence
  Synthetic oligonucleotide; TTT chr11 5286553 5286574 5286558 5286553 -
tcctaagtgactaaaaaattac

SEQ ID NO: 133283 - DNA, 22 bp, Artificial Sequence
  Synthetic oligonucleotide; TTT chr11 5286552 5286573 5286557 5286552 -
cctaagtgactaaaaaattaca

SEQ ID NO: 133284 - DNA, 22 bp, Artificial Sequence
  Synthetic oligonucleotide; TTC chr11 5286551 5286572 5286556 5286551 -
ctaagtgactaaaaaattacac

SEQ ID NO: 133285 - DNA, 22 bp, Artificial Sequence
  Synthetic oligonucleotide; CTA chr11 5286548 5286569 5286553 5286548 -
agtgactaaaaaattacacttt

SEQ ID NO: 133286 - DNA, 22 bp, Artificial Sequence
  Synthetic oligonucleotide; CTA chr11 5286540 5286561 5286545 5286540 -
aaaaattacactttattcgtct

SEQ ID NO: 133287 - DNA, 22 bp, Artificial Sequence
  Synthetic oligonucleotide; TTA chr11 5286532 5286553 5286537 5286532 -
cactttattcgtctgtgtcctg

SEQ ID NO: 133288 - DNA, 22 bp, Artificial Sequence
  Synthetic oligonucleotide; CTT chr11 5286527 5286548 5286532 5286527 -
tattcgtctgtgtcctgctctg

SEQ ID NO: 133289 - DNA, 22 bp, Artificial Sequence
  Synthetic oligonucleotide; TTT chr11 5286526 5286547 5286531 5286526 -
attcgtctgtgtcctgctctgg

SEQ ID NO: 133290 - DNA, 22 bp, Artificial Sequence
  Synthetic oligonucleotide; TTA chr11 5286525 5286546 5286530 5286525 -
ttcgtctgtgtcctgctctggg

SEQ ID NO: 133291 - DNA, 22 bp, Artificial Sequence
  Synthetic oligonucleotide; TTC chr11 5286522 5286543 5286527 5286522 -
gtctgtgtcctgctctgggatg

SEQ ID NO: 133292 - DNA, 22 bp, Artificial Sequence
  Synthetic oligonucleotide; CTG chr11 5286517 5286538 5286522 5286517 -
tgtcctgctctgggatgatagt

SEQ ID NO: 133293 - DNA, 22 bp, Artificial Sequence
  Synthetic oligonucleotide; CTG chr11 5286510 5286531 5286515 5286510 -
ctctgggatgatagtctgactt

SEQ ID NO: 133294 - DNA, 22 bp, Artificial Sequence
  Synthetic oligonucleotide; CTC chr11 5286507 5286528 5286512 5286507 -
tgggatgatagtctgactttcc

SEQ ID NO: 133295 - DNA, 22 bp, Artificial Sequence
  Synthetic oligonucleotide; CTG chr11 5286505 5286526 5286510 5286505 -
ggatgatagtctgactttccta

SEQ ID NO: 133296 - DNA, 22 bp, Artificial Sequence
  Synthetic oligonucleotide; CTG chr11 5286492 5286513 5286497 5286492 -
actttcctaacctgagcctaac

SEQ ID NO: 133297 - DNA, 22 bp, Artificial Sequence
  Synthetic oligonucleotide; CTT chr11 5286488 5286509 5286493 5286488 -
tcctaacctgagcctaacatcc

SEQ ID NO: 133298 - DNA, 22 bp, Artificial Sequence
  Synthetic oligonucleotide; TTT chr11 5286487 5286508 5286492 5286487 -
cctaacctgagcctaacatccc

SEQ ID NO: 133299 - DNA, 22 bp, Artificial Sequence
  Synthetic oligonucleotide; TTC chr11 5286486 5286507 5286491 5286486 -
ctaacctgagcctaacatccct

SEQ ID NO: 133300 - DNA, 22 bp, Artificial Sequence
  Synthetic oligonucleotide; CTA chr11 5286483 5286504 5286488 5286483 -
acctgagcctaacatccctgac

SEQ ID NO: 133301 - DNA, 22 bp, Artificial Sequence
  Synthetic oligonucleotide; CTG chr11 5286478 5286499 5286483 5286478 -
agcctaacatccctgacatcag

SEQ ID NO: 133302 - DNA, 22 bp, Artificial Sequence
  Synthetic oligonucleotide; CTA chr11 5286472 5286493 5286477 5286472 -
acatccctgacatcaggaaaga

SEQ ID NO: 133303 - DNA, 22 bp, Artificial Sequence
  Synthetic oligonucleotide; CTG chr11 5286463 5286484 5286468 5286463 -
acatcaggaaagactacaccat

SEQ ID NO: 133304 - DNA, 22 bp, Artificial Sequence
  Synthetic oligonucleotide; CTA chr11 5286447 5286468 5286452 5286447 -
caccatgtggagaaggggtggt

SEQ ID NO: 133305 - DNA, 22 bp, Artificial Sequence
  Synthetic oligonucleotide; TTT chr11 5286420 5286441 5286425 5286420 -
tgattgctgctgtcttcagtta

SEQ ID NO: 133306 - DNA, 22 bp, Artificial Sequence
  Synthetic oligonucleotide; TTT chr11 5286419 5286440 5286424 5286419 -
gattgctgctgtcttcagttag

SEQ ID NO: 133307 - DNA, 22 bp, Artificial Sequence
  Synthetic oligonucleotide; TTG chr11 5286418 5286439 5286423 5286418 -
attgctgctgtcttcagttaga

SEQ ID NO: 133308 - DNA, 22 bp, Artificial Sequence
  Synthetic oligonucleotide; TTG chr11 5286414 5286435 5286419 5286414 -
ctgctgtcttcagttagatggt

SEQ ID NO: 133309 - DNA, 22 bp, Artificial Sequence
  Synthetic oligonucleotide; CTG chr11 5286411 5286432 5286416 5286411 -
ctgtcttcagttagatggttaa

SEQ ID NO: 133310 - DNA, 22 bp, Artificial Sequence
  Synthetic oligonucleotide; CTG chr11 5286408 5286429 5286413 5286408 -
tcttcagttagatggttaactt

SEQ ID NO: 133311 - DNA, 22 bp, Artificial Sequence
  Synthetic oligonucleotide; CTT chr11 5286404 5286425 5286409 5286404 -
cagttagatggttaactttgtg

SEQ ID NO: 133312 - DNA, 22 bp, Artificial Sequence
  Synthetic oligonucleotide; TTC chr11 5286403 5286424 5286408 5286403 -
agttagatggttaactttgtga

SEQ ID NO: 133313 - DNA, 22 bp, Artificial Sequence
  Synthetic oligonucleotide; TTA chr11 5286398 5286419 5286403 5286398 -
gatggttaactttgtgaagttg

SEQ ID NO: 133314 - DNA, 22 bp, Artificial Sequence
  Synthetic oligonucleotide; TTA chr11 5286390 5286411 5286395 5286390 -
actttgtgaagttgaaaactgt

SEQ ID NO: 133315 - DNA, 22 bp, Artificial Sequence
  Synthetic oligonucleotide; CTT chr11 5286386 5286407 5286391 5286386 -
tgtgaagttgaaaactgtggct

SEQ ID NO: 133316 - DNA, 22 bp, Artificial Sequence
  Synthetic oligonucleotide; TTT chr11 5286385 5286406 5286390 5286385 -
gtgaagttgaaaactgtggctc

SEQ ID NO: 133317 - DNA, 22 bp, Artificial Sequence
  Synthetic oligonucleotide; TTG chr11 5286384 5286405 5286389 5286384 -
tgaagttgaaaactgtggctct

SEQ ID NO: 133318 - DNA, 22 bp, Artificial Sequence
  Synthetic oligonucleotide; TTG chr11 5286376 5286397 5286381 5286376 -
aaaactgtggctctctggttga

SEQ ID NO: 133319 - DNA, 22 bp, Artificial Sequence
  Synthetic oligonucleotide; CTG chr11 5286369 5286390 5286374 5286369 -
tggctctctggttgactgttag

SEQ ID NO: 133320 - DNA, 22 bp, Artificial Sequence
  Synthetic oligonucleotide; CTC chr11 5286363 5286384 5286368 5286363 -
tctggttgactgttagagttct

SEQ ID NO: 133321 - DNA, 22 bp, Artificial Sequence
  Synthetic oligonucleotide; CTC chr11 5286361 5286382 5286366 5286361 -
tggttgactgttagagttctgg

SEQ ID NO: 133322 - DNA, 22 bp, Artificial Sequence
  Synthetic oligonucleotide; CTG chr11 5286359 5286380 5286364 5286359 -
gttgactgttagagttctggca

SEQ ID NO: 133323 - DNA, 22 bp, Artificial Sequence
  Synthetic oligonucleotide; TTG chr11 5286355 5286376 5286360 5286355 -
actgttagagttctggcacttg

SEQ ID NO: 133324 - DNA, 22 bp, Artificial Sequence
  Synthetic oligonucleotide; CTG chr11 5286351 5286372 5286356 5286351 -
ttagagttctggcacttgtcac

SEQ ID NO: 133325 - DNA, 22 bp, Artificial Sequence
  Synthetic oligonucleotide; TTA chr11 5286348 5286369 5286353 5286348 -
gagttctggcacttgtcactat

SEQ ID NO: 133326 - DNA, 22 bp, Artificial Sequence
  Synthetic oligonucleotide; TTC chr11 5286342 5286363 5286347 5286342 -
tggcacttgtcactatgcctat

SEQ ID NO: 133327 - DNA, 22 bp, Artificial Sequence
  Synthetic oligonucleotide; CTG chr11 5286340 5286361 5286345 5286340 -
gcacttgtcactatgcctatta

SEQ ID NO: 133328 - DNA, 22 bp, Artificial Sequence
  Synthetic oligonucleotide; CTT chr11 5286334 5286355 5286339 5286334 -
gtcactatgcctattatttaac

SEQ ID NO: 133329 - DNA, 22 bp, Artificial Sequence
  Synthetic oligonucleotide; TTG chr11 5286333 5286354 5286338 5286333 -
tcactatgcctattatttaaca

SEQ ID NO: 133330 - DNA, 22 bp, Artificial Sequence
  Synthetic oligonucleotide; CTA chr11 5286327 5286348 5286332 5286327 -
tgcctattatttaacaaatgca

SEQ ID NO: 133331 - DNA, 22 bp, Artificial Sequence
  Synthetic oligonucleotide; CTA chr11 5286321 5286342 5286326 5286321 -
ttatttaacaaatgcatgaatg

SEQ ID NO: 133332 - DNA, 22 bp, Artificial Sequence
  Synthetic oligonucleotide; TTA chr11 5286318 5286339 5286323 5286318 -
tttaacaaatgcatgaatgctt

SEQ ID NO: 133333 - DNA, 22 bp, Artificial Sequence
  Synthetic oligonucleotide; TTT chr11 5286315 5286336 5286320 5286315 -
aacaaatgcatgaatgcttcag

SEQ ID NO: 133334 - DNA, 22 bp, Artificial Sequence
  Synthetic oligonucleotide; TTA chr11 5286314 5286335 5286319 5286314 -
acaaatgcatgaatgcttcaga

SEQ ID NO: 133335 - DNA, 22 bp, Artificial Sequence
  Synthetic oligonucleotide; CTT chr11 5286296 5286317 5286301 5286296 -
cagaatatgggaatattatctt

SEQ ID NO: 133336 - DNA, 22 bp, Artificial Sequence
  Synthetic oligonucleotide; TTC chr11 5286295 5286316 5286300 5286295 -
agaatatgggaatattatcttc

SEQ ID NO: 133337 - DNA, 22 bp, Artificial Sequence
  Synthetic oligonucleotide; TTA chr11 5286278 5286299 5286283 5286278 -
tcttctggaatagggaatcaag

SEQ ID NO: 133338 - DNA, 22 bp, Artificial Sequence
  Synthetic oligonucleotide; CTT chr11 5286274 5286295 5286279 5286274 -
ctggaatagggaatcaagttat

SEQ ID NO: 133339 - DNA, 22 bp, Artificial Sequence
  Synthetic oligonucleotide; TTC chr11 5286273 5286294 5286278 5286273 -
tggaatagggaatcaagttata

SEQ ID NO: 133340 - DNA, 22 bp, Artificial Sequence
  Synthetic oligonucleotide; CTG chr11 5286271 5286292 5286276 5286271 -
gaatagggaatcaagttatatt

SEQ ID NO: 133341 - DNA, 22 bp, Artificial Sequence
  Synthetic oligonucleotide; TTA chr11 5286253 5286274 5286258 5286253 -
tattatgtaacccaggattaga

SEQ ID NO: 133342 - DNA, 22 bp, Artificial Sequence
  Synthetic oligonucleotide; TTA chr11 5286248 5286269 5286253 5286248 -
tgtaacccaggattagaagatt

SEQ ID NO: 133343 - DNA, 22 bp, Artificial Sequence
  Synthetic oligonucleotide; TTA chr11 5286233 5286254 5286238 5286233 -
gaagattcttctgtgtgtaaga

SEQ ID NO: 133344 - DNA, 22 bp, Artificial Sequence
  Synthetic oligonucleotide; TTC chr11 5286225 5286246 5286230 5286225 -
ttctgtgtgtaagaatttcata

SEQ ID NO: 133345 - DNA, 22 bp, Artificial Sequence
  Synthetic oligonucleotide; CTT chr11 5286223 5286244 5286228 5286223 -
ctgtgtgtaagaatttcataaa

SEQ ID NO: 133346 - DNA, 22 bp, Artificial Sequence
  Synthetic oligonucleotide; TTC chr11 5286222 5286243 5286227 5286222 -
tgtgtgtaagaatttcataaac

SEQ ID NO: 133347 - DNA, 22 bp, Artificial Sequence
  Synthetic oligonucleotide; CTG chr11 5286220 5286241 5286225 5286220 -
tgtgtaagaatttcataaacat

SEQ ID NO: 133348 - DNA, 22 bp, Artificial Sequence
  Synthetic oligonucleotide; TTT chr11 5286207 5286228 5286212 5286207 -
cataaacattaagctgtctagc

SEQ ID NO: 133349 - DNA, 22 bp, Artificial Sequence
  Synthetic oligonucleotide; TTC chr11 5286206 5286227 5286211 5286206 -
ataaacattaagctgtctagca

SEQ ID NO: 133350 - DNA, 22 bp, Artificial Sequence
  Synthetic oligonucleotide; TTA chr11 5286196 5286217 5286201 5286196 -
agctgtctagcaaaagcaaggg

SEQ ID NO: 133351 - DNA, 22 bp, Artificial Sequence
  Synthetic oligonucleotide; CTG chr11 5286191 5286212 5286196 5286191 -
tctagcaaaagcaagggcttgg

SEQ ID NO: 133352 - DNA, 22 bp, Artificial Sequence
  Synthetic oligonucleotide; CTA chr11 5286187 5286208 5286192 5286187 -
gcaaaagcaagggcttggaaaa

SEQ ID NO: 133353 - DNA, 22 bp, Artificial Sequence
  Synthetic oligonucleotide; CTT chr11 5286171 5286192 5286176 5286171 -
ggaaaatctgtgagctcctcac

SEQ ID NO: 133354 - DNA, 22 bp, Artificial Sequence
  Synthetic oligonucleotide; TTG chr11 5286170 5286191 5286175 5286170 -
gaaaatctgtgagctcctcacc

SEQ ID NO: 133355 - DNA, 22 bp, Artificial Sequence
  Synthetic oligonucleotide; CTG chr11 5286161 5286182 5286166 5286161 -
tgagctcctcaccatatagaaa

SEQ ID NO: 133356 - DNA, 22 bp, Artificial Sequence
  Synthetic oligonucleotide; CTC chr11 5286154 5286175 5286159 5286154 -
ctcaccatatagaaagctttta

SEQ ID NO: 133357 - DNA, 22 bp, Artificial Sequence
  Synthetic oligonucleotide; CTC chr11 5286151 5286172 5286156 5286151 -
accatatagaaagcttttaacc

SEQ ID NO: 133358 - DNA, 22 bp, Artificial Sequence
  Synthetic oligonucleotide; CTT chr11 5286135 5286156 5286140 5286135 -
ttaacccatcattgaataaatc

SEQ ID NO: 133359 - DNA, 22 bp, Artificial Sequence
  Synthetic oligonucleotide; TTT chr11 5286134 5286155 5286139 5286134 -
taacccatcattgaataaatcc

SEQ ID NO: 133360 - DNA, 22 bp, Artificial Sequence
  Synthetic oligonucleotide; TTT chr11 5286133 5286154 5286138 5286133 -
aacccatcattgaataaatccc

SEQ ID NO: 133361 - DNA, 22 bp, Artificial Sequence
  Synthetic oligonucleotide; TTA chr11 5286132 5286153 5286137 5286132 -
acccatcattgaataaatccct

SEQ ID NO: 133362 - DNA, 22 bp, Artificial Sequence
  Synthetic oligonucleotide; TTG chr11 5286121 5286142 5286126 5286121 -
aataaatccctataggggattt

SEQ ID NO: 133363 - DNA, 22 bp, Artificial Sequence
  Synthetic oligonucleotide; CTA chr11 5286109 5286130 5286114 5286109 -
taggggatttctaccctgagca

SEQ ID NO: 133364 - DNA, 22 bp, Artificial Sequence
  Synthetic oligonucleotide; TTT chr11 5286099 5286120 5286104 5286099 -
ctaccctgagcaaaaggctggt

SEQ ID NO: 133365 - DNA, 22 bp, Artificial Sequence
  Synthetic oligonucleotide; TTC chr11 5286098 5286119 5286103 5286098 -
taccctgagcaaaaggctggtc

SEQ ID NO: 133366 - DNA, 22 bp, Artificial Sequence
  Synthetic oligonucleotide; CTA chr11 5286096 5286117 5286101 5286096 -
ccctgagcaaaaggctggtctt

SEQ ID NO: 133367 - DNA, 22 bp, Artificial Sequence
  Synthetic oligonucleotide; CTG chr11 5286091 5286112 5286096 5286091 -
agcaaaaggctggtcttgatta

SEQ ID NO: 133368 - DNA, 22 bp, Artificial Sequence
  Synthetic oligonucleotide; CTG chr11 5286079 5286100 5286084 5286079 -
gtcttgattaattcccaaactc

SEQ ID NO: 133369 - DNA, 22 bp, Artificial Sequence
  Synthetic oligonucleotide; CTT chr11 5286074 5286095 5286079 5286074 -
gattaattcccaaactcatata

SEQ ID NO: 133370 - DNA, 22 bp, Artificial Sequence
  Synthetic oligonucleotide; TTG chr11 5286073 5286094 5286078 5286073 -
attaattcccaaactcatatag

SEQ ID NO: 133371 - DNA, 22 bp, Artificial Sequence
  Synthetic oligonucleotide; TTA chr11 5286069 5286090 5286074 5286069 -
attcccaaactcatatagctct

SEQ ID NO: 133372 - DNA, 22 bp, Artificial Sequence
  Synthetic oligonucleotide; TTC chr11 5286065 5286086 5286070 5286065 -
ccaaactcatatagctctgaga

SEQ ID NO: 133373 - DNA, 22 bp, Artificial Sequence
  Synthetic oligonucleotide; CTC chr11 5286057 5286078 5286062 5286057 -
atatagctctgagaaagtctat

SEQ ID NO: 133374 - DNA, 22 bp, Artificial Sequence
  Synthetic oligonucleotide; CTC chr11 5286048 5286069 5286053 5286048 -
tgagaaagtctatgctgttaac

SEQ ID NO: 133375 - DNA, 22 bp, Artificial Sequence
  Synthetic oligonucleotide; CTG chr11 5286046 5286067 5286051 5286046 -
agaaagtctatgctgttaacgt

SEQ ID NO: 133376 - DNA, 22 bp, Artificial Sequence
  Synthetic oligonucleotide; CTA chr11 5286036 5286057 5286041 5286036 -
tgctgttaacgttttcttgtct

SEQ ID NO: 133377 - DNA, 22 bp, Artificial Sequence
  Synthetic oligonucleotide; CTG chr11 5286031 5286052 5286036 5286031 -
ttaacgttttcttgtctgctac

SEQ ID NO: 133378 - DNA, 22 bp, Artificial Sequence
  Synthetic oligonucleotide; TTA chr11 5286028 5286049 5286033 5286028 -
acgttttcttgtctgctacccc

SEQ ID NO: 133379 - DNA, 22 bp, Artificial Sequence
  Synthetic oligonucleotide; TTT chr11 5286022 5286043 5286027 5286022 -
tcttgtctgctaccccatcata

SEQ ID NO: 133380 - DNA, 22 bp, Artificial Sequence
  Synthetic oligonucleotide; TTT chr11 5286021 5286042 5286026 5286021 -
cttgtctgctaccccatcatat

SEQ ID NO: 133381 - DNA, 22 bp, Artificial Sequence
  Synthetic oligonucleotide; TTC chr11 5286020 5286041 5286025 5286020 -
ttgtctgctaccccatcatatg

SEQ ID NO: 133382 - DNA, 22 bp, Artificial Sequence
  Synthetic oligonucleotide; CTT chr11 5286018 5286039 5286023 5286018 -
gtctgctaccccatcatatgca

SEQ ID NO: 133383 - DNA, 22 bp, Artificial Sequence
  Synthetic oligonucleotide; TTG chr11 5286017 5286038 5286022 5286017 -
tctgctaccccatcatatgcac

SEQ ID NO: 133384 - DNA, 22 bp, Artificial Sequence
  Synthetic oligonucleotide; CTG chr11 5286013 5286034 5286018 5286013 -
ctaccccatcatatgcacaaca

SEQ ID NO: 133385 - DNA, 22 bp, Artificial Sequence
  Synthetic oligonucleotide; CTA chr11 5286010 5286031 5286015 5286010 -
ccccatcatatgcacaacaata

SEQ ID NO: 133386 - DNA, 22 bp, Artificial Sequence
  Synthetic oligonucleotide; CTA chr11 5285976 5285997 5285981 5285976 -
ggcatgactgaaggctctctca

SEQ ID NO: 133387 - DNA, 22 bp, Artificial Sequence
  Synthetic oligonucleotide; CTG chr11 5285966 5285987 5285971 5285966 -
aaggctctctcataattcttgg

SEQ ID NO: 133388 - DNA, 22 bp, Artificial Sequence
  Synthetic oligonucleotide; CTC chr11 5285959 5285980 5285964 5285959 -
tctcataattcttggttgcatg

SEQ ID NO: 133389 - DNA, 22 bp, Artificial Sequence
  Synthetic oligonucleotide; CTC chr11 5285957 5285978 5285962 5285957 -
tcataattcttggttgcatgaa

SEQ ID NO: 133390 - DNA, 22 bp, Artificial Sequence
  Synthetic oligonucleotide; CTC chr11 5285955 5285976 5285960 5285955 -
ataattcttggttgcatgaatc

SEQ ID NO: 133391 - DNA, 22 bp, Artificial Sequence
  Synthetic oligonucleotide; TTC chr11 5285948 5285969 5285953 5285948 -
ttggttgcatgaatcagattat

SEQ ID NO: 133392 - DNA, 22 bp, Artificial Sequence
  Synthetic oligonucleotide; CTT chr11 5285946 5285967 5285951 5285946 -
ggttgcatgaatcagattatca

SEQ ID NO: 133393 - DNA, 22 bp, Artificial Sequence
  Synthetic oligonucleotide; TTG chr11 5285945 5285966 5285950 5285945 -
gttgcatgaatcagattatcaa

SEQ ID NO: 133394 - DNA, 22 bp, Artificial Sequence
  Synthetic oligonucleotide; TTG chr11 5285941 5285962 5285946 5285941 -
catgaatcagattatcaacaga

SEQ ID NO: 133395 - DNA, 22 bp, Artificial Sequence
  Synthetic oligonucleotide; TTA chr11 5285927 5285948 5285932 5285927 -
tcaacagaaatgttgagacaaa

SEQ ID NO: 133396 - DNA, 22 bp, Artificial Sequence
  Synthetic oligonucleotide; TTG chr11 5285912 5285933 5285917 5285912 -
agacaaactatggggaagcagg

SEQ ID NO: 133397 - DNA, 22 bp, Artificial Sequence
  Synthetic oligonucleotide; CTA chr11 5285902 5285923 5285907 5285902 -
tggggaagcagggtatgaaaga

SEQ ID NO: 133398 - DNA, 22 bp, Artificial Sequence
  Synthetic oligonucleotide; CTC chr11 5285876 5285897 5285881 5285876 -
tgaatgaaatggaaaccgcaat

SEQ ID NO: 133399 - DNA, 22 bp, Artificial Sequence
  Synthetic oligonucleotide; CTG chr11 5285874 5285895 5285879 5285874 -
aatgaaatggaaaccgcaatgc

SEQ ID NO: 133400 - DNA, 22 bp, Artificial Sequence
  Synthetic oligonucleotide; CTT chr11 5285850 5285871 5285855 5285850 -
cctgcccattcagggctccagc

SEQ ID NO: 133401 - DNA, 22 bp, Artificial Sequence
  Synthetic oligonucleotide; TTC chr11 5285849 5285870 5285854 5285849 -
ctgcccattcagggctccagca

SEQ ID NO: 133402 - DNA, 22 bp, Artificial Sequence
  Synthetic oligonucleotide; CTG chr11 5285846 5285867 5285851 5285846 -
cccattcagggctccagcatgt

SEQ ID NO: 133403 - DNA, 22 bp, Artificial Sequence
  Synthetic oligonucleotide; TTC chr11 5285839 5285860 5285844 5285839 -
agggctccagcatgtagaaatc

SEQ ID NO: 133404 - DNA, 22 bp, Artificial Sequence
  Synthetic oligonucleotide; CTC chr11 5285832 5285853 5285837 5285832 -
cagcatgtagaaatctggggct

SEQ ID NO: 133405 - DNA, 22 bp, Artificial Sequence
  Synthetic oligonucleotide; CTG chr11 5285815 5285836 5285820 5285815 -
gggctttgtgaagactggctta

SEQ ID NO: 133406 - DNA, 22 bp, Artificial Sequence
  Synthetic oligonucleotide; CTT chr11 5285809 5285830 5285814 5285809 -
tgtgaagactggcttaaaatca

SEQ ID NO: 133407 - DNA, 22 bp, Artificial Sequence
  Synthetic oligonucleotide; TTT chr11 5285808 5285829 5285813 5285808 -
gtgaagactggcttaaaatcag

SEQ ID NO: 133408 - DNA, 22 bp, Artificial Sequence
  Synthetic oligonucleotide; TTG chr11 5285807 5285828 5285812 5285807 -
tgaagactggcttaaaatcaga

SEQ ID NO: 133409 - DNA, 22 bp, Artificial Sequence
  Synthetic oligonucleotide; CTG chr11 5285798 5285819 5285803 5285798 -
gcttaaaatcagaagccccatt

SEQ ID NO: 133410 - DNA, 22 bp, Artificial Sequence
  Synthetic oligonucleotide; CTT chr11 5285794 5285815 5285799 5285794 -
aaaatcagaagccccattggat

SEQ ID NO: 133411 - DNA, 22 bp, Artificial Sequence
  Synthetic oligonucleotide; TTA chr11 5285793 5285814 5285798 5285793 -
aaatcagaagccccattggata

SEQ ID NO: 133412 - DNA, 22 bp, Artificial Sequence
  Synthetic oligonucleotide; TTG chr11 5285775 5285796 5285780 5285775 -
gataagagtagggaagaaccta

SEQ ID NO: 133413 - DNA, 22 bp, Artificial Sequence
  Synthetic oligonucleotide; CTA chr11 5285753 5285774 5285758 5285753 -
gagcctacgctgagcaggtttc

SEQ ID NO: 133414 - DNA, 22 bp, Artificial Sequence
  Synthetic oligonucleotide; CTA chr11 5285746 5285767 5285751 5285746 -
cgctgagcaggtttccttcatg

SEQ ID NO: 133415 - DNA, 22 bp, Artificial Sequence
  Synthetic oligonucleotide; CTG chr11 5285741 5285762 5285746 5285741 -
agcaggtttccttcatgtgaca

SEQ ID NO: 133416 - DNA, 22 bp, Artificial Sequence
  Synthetic oligonucleotide; TTT chr11 5285732 5285753 5285737 5285732 -
ccttcatgtgacagggagcctc

SEQ ID NO: 133417 - DNA, 22 bp, Artificial Sequence
  Synthetic oligonucleotide; TTC chr11 5285731 5285752 5285736 5285731 -
cttcatgtgacagggagcctcc

SEQ ID NO: 133418 - DNA, 22 bp, Artificial Sequence
  Synthetic oligonucleotide; CTT chr11 5285728 5285749 5285733 5285728 -
catgtgacagggagcctcctgc

SEQ ID NO: 133419 - DNA, 22 bp, Artificial Sequence
  Synthetic oligonucleotide; TTC chr11 5285727 5285748 5285732 5285727 -
atgtgacagggagcctcctgcc

SEQ ID NO: 133420 - DNA, 22 bp, Artificial Sequence
  Synthetic oligonucleotide; CTC chr11 5285710 5285731 5285715 5285710 -
ctgccccgaacttccagggatc

SEQ ID NO: 133421 - DNA, 22 bp, Artificial Sequence
  Synthetic oligonucleotide; CTG chr11 5285707 5285728 5285712 5285707 -
ccccgaacttccagggatcctc

SEQ ID NO: 133422 - DNA, 22 bp, Artificial Sequence
  Synthetic oligonucleotide; CTT chr11 5285697 5285718 5285702 5285697 -
ccagggatcctctcttaagtgt

SEQ ID NO: 133423 - DNA, 22 bp, Artificial Sequence
  Synthetic oligonucleotide; TTC chr11 5285696 5285717 5285701 5285696 -
cagggatcctctcttaagtgtt

SEQ ID NO: 133424 - DNA, 22 bp, Artificial Sequence
  Synthetic oligonucleotide; CTC chr11 5285685 5285706 5285690 5285685 -
tcttaagtgtttcctgctggaa

SEQ ID NO: 133425 - DNA, 22 bp, Artificial Sequence
  Synthetic oligonucleotide; CTC chr11 5285683 5285704 5285688 5285683 -
ttaagtgtttcctgctggaatc

SEQ ID NO: 133426 - DNA, 22 bp, Artificial Sequence
  Synthetic oligonucleotide; CTT chr11 5285681 5285702 5285686 5285681 -
aagtgtttcctgctggaatctc

SEQ ID NO: 133427 - DNA, 22 bp, Artificial Sequence
  Synthetic oligonucleotide; TTA chr11 5285680 5285701 5285685 5285680 -
agtgtttcctgctggaatctcc

SEQ ID NO: 133428 - DNA, 22 bp, Artificial Sequence
  Synthetic oligonucleotide; TTT chr11 5285673 5285694 5285678 5285673 -
cctgctggaatctcctcacttc

SEQ ID NO: 133429 - DNA, 22 bp, Artificial Sequence
  Synthetic oligonucleotide; TTC chr11 5285672 5285693 5285677 5285672 -
ctgctggaatctcctcacttct

SEQ ID NO: 133430 - DNA, 22 bp, Artificial Sequence
  Synthetic oligonucleotide; CTG chr11 5285669 5285690 5285674 5285669 -
ctggaatctcctcacttctatc

SEQ ID NO: 133431 - DNA, 22 bp, Artificial Sequence
  Synthetic oligonucleotide; CTG chr11 5285666 5285687 5285671 5285666 -
gaatctcctcacttctatctgg

SEQ ID NO: 133432 - DNA, 22 bp, Artificial Sequence
  Synthetic oligonucleotide; CTC chr11 5285659 5285680 5285664 5285659 -
ctcacttctatctggaaatggt

SEQ ID NO: 133433 - DNA, 22 bp, Artificial Sequence
  Synthetic oligonucleotide; CTC chr11 5285656 5285677 5285661 5285656 -
acttctatctggaaatggtttc

SEQ ID NO: 133434 - DNA, 22 bp, Artificial Sequence
  Synthetic oligonucleotide; CTT chr11 5285652 5285673 5285657 5285652 -
ctatctggaaatggtttctcca

SEQ ID NO: 133435 - DNA, 22 bp, Artificial Sequence
  Synthetic oligonucleotide; TTC chr11 5285651 5285672 5285656 5285651 -
tatctggaaatggtttctccac

SEQ ID NO: 133436 - DNA, 22 bp, Artificial Sequence
  Synthetic oligonucleotide; CTA chr11 5285649 5285670 5285654 5285649 -
tctggaaatggtttctccacag

SEQ ID NO: 133437 - DNA, 22 bp, Artificial Sequence
  Synthetic oligonucleotide; CTG chr11 5285645 5285666 5285650 5285645 -
gaaatggtttctccacagtcca

SEQ ID NO: 133438 - DNA, 22 bp, Artificial Sequence
  Synthetic oligonucleotide; TTT chr11 5285635 5285656 5285640 5285635 -
ctccacagtccagcccctggct

SEQ ID NO: 133439 - DNA, 22 bp, Artificial Sequence
  Synthetic oligonucleotide; TTC chr11 5285634 5285655 5285639 5285634 -
tccacagtccagcccctggcta

SEQ ID NO: 133440 - DNA, 22 bp, Artificial Sequence
  Synthetic oligonucleotide; CTC chr11 5285632 5285653 5285637 5285632 -
cacagtccagcccctggctagt

SEQ ID NO: 133441 - DNA, 22 bp, Artificial Sequence
  Synthetic oligonucleotide; CTG chr11 5285616 5285637 5285621 5285616 -
gctagttgaaagagttacccat

SEQ ID NO: 133442 - DNA, 22 bp, Artificial Sequence
  Synthetic oligonucleotide; CTA chr11 5285612 5285633 5285617 5285612 -
gttgaaagagttacccatgcag

SEQ ID NO: 133443 - DNA, 22 bp, Artificial Sequence
  Synthetic oligonucleotide; TTG chr11 5285608 5285629 5285613 5285608 -
aaagagttacccatgcagaggc

SEQ ID NO: 133444 - DNA, 22 bp, Artificial Sequence
  Synthetic oligonucleotide; TTA chr11 5285599 5285620 5285604 5285599 -
cccatgcagaggccctcctagc

SEQ ID NO: 133445 - DNA, 22 bp, Artificial Sequence
  Synthetic oligonucleotide; CTC chr11 5285582 5285603 5285587 5285582 -
ctagcatccagagactagtgct

SEQ ID NO: 133446 - DNA, 22 bp, Artificial Sequence
  Synthetic oligonucleotide; CTA chr11 5285579 5285600 5285584 5285579 -
gcatccagagactagtgcttag

SEQ ID NO: 133447 - DNA, 22 bp, Artificial Sequence
  Synthetic oligonucleotide; CTA chr11 5285565 5285586 5285570 5285565 -
gtgcttagattcctactttcag

SEQ ID NO: 133448 - DNA, 22 bp, Artificial Sequence
  Synthetic oligonucleotide; CTT chr11 5285559 5285580 5285564 5285559 -
agattcctactttcagcgttgg

SEQ ID NO: 133449 - DNA, 22 bp, Artificial Sequence
  Synthetic oligonucleotide; TTA chr11 5285558 5285579 5285563 5285558 -
gattcctactttcagcgttgga

SEQ ID NO: 133450 - DNA, 22 bp, Artificial Sequence
  Synthetic oligonucleotide; TTC chr11 5285553 5285574 5285558 5285553 -
ctactttcagcgttggacaacc

SEQ ID NO: 133451 - DNA, 22 bp, Artificial Sequence
  Synthetic oligonucleotide; CTA chr11 5285550 5285571 5285555 5285550 -
ctttcagcgttggacaacctgg

SEQ ID NO: 133452 - DNA, 22 bp, Artificial Sequence
  Synthetic oligonucleotide; CTT chr11 5285547 5285568 5285552 5285547 -
tcagcgttggacaacctggatc

SEQ ID NO: 133453 - DNA, 22 bp, Artificial Sequence
  Synthetic oligonucleotide; TTT chr11 5285546 5285567 5285551 5285546 -
cagcgttggacaacctggatcc

SEQ ID NO: 133454 - DNA, 22 bp, Artificial Sequence
  Synthetic oligonucleotide; TTC chr11 5285545 5285566 5285550 5285545 -
agcgttggacaacctggatcca

SEQ ID NO: 133455 - DNA, 22 bp, Artificial Sequence
  Synthetic oligonucleotide; TTG chr11 5285538 5285559 5285543 5285538 -
gacaacctggatccacttgccc

SEQ ID NO: 133456 - DNA, 22 bp, Artificial Sequence
  Synthetic oligonucleotide; CTG chr11 5285529 5285550 5285534 5285529 -
gatccacttgcccagtgttctt

SEQ ID NO: 133457 - DNA, 22 bp, Artificial Sequence
  Synthetic oligonucleotide; CTT chr11 5285520 5285541 5285525 5285520 -
gcccagtgttcttccttagttc

SEQ ID NO: 133458 - DNA, 22 bp, Artificial Sequence
  Synthetic oligonucleotide; TTG chr11 5285519 5285540 5285524 5285519 -
cccagtgttcttccttagttcc

SEQ ID NO: 133459 - DNA, 22 bp, Artificial Sequence
  Synthetic oligonucleotide; TTC chr11 5285509 5285530 5285514 5285509 -
ttccttagttcctaccttcgac

SEQ ID NO: 133460 - DNA, 22 bp, Artificial Sequence
  Synthetic oligonucleotide; CTT chr11 5285507 5285528 5285512 5285507 -
ccttagttcctaccttcgacct

SEQ ID NO: 133461 - DNA, 22 bp, Artificial Sequence
  Synthetic oligonucleotide; TTC chr11 5285506 5285527 5285511 5285506 -
cttagttcctaccttcgacctt

SEQ ID NO: 133462 - DNA, 22 bp, Artificial Sequence
  Synthetic oligonucleotide; CTT chr11 5285503 5285524 5285508 5285503 -
agttcctaccttcgaccttgat

SEQ ID NO: 133463 - DNA, 22 bp, Artificial Sequence
  Synthetic oligonucleotide; TTA chr11 5285502 5285523 5285507 5285502 -
gttcctaccttcgaccttgatc

SEQ ID NO: 133464 - DNA, 22 bp, Artificial Sequence
  Synthetic oligonucleotide; TTC chr11 5285498 5285519 5285503 5285498 -
ctaccttcgaccttgatcctcc

SEQ ID NO: 133465 - DNA, 22 bp, Artificial Sequence
  Synthetic oligonucleotide; CTA chr11 5285495 5285516 5285500 5285495 -
ccttcgaccttgatcctccttt

SEQ ID NO: 133466 - DNA, 22 bp, Artificial Sequence
  Synthetic oligonucleotide; CTT chr11 5285491 5285512 5285496 5285491 -
cgaccttgatcctcctttatct

SEQ ID NO: 133467 - DNA, 22 bp, Artificial Sequence
  Synthetic oligonucleotide; TTC chr11 5285490 5285511 5285495 5285490 -
gaccttgatcctcctttatctt

SEQ ID NO: 133468 - DNA, 22 bp, Artificial Sequence
  Synthetic oligonucleotide; CTT chr11 5285484 5285505 5285489 5285484 -
gatcctcctttatcttcctgaa

SEQ ID NO: 133469 - DNA, 22 bp, Artificial Sequence
  Synthetic oligonucleotide; TTG chr11 5285483 5285504 5285488 5285483 -
atcctcctttatcttcctgaac

SEQ ID NO: 133470 - DNA, 22 bp, Artificial Sequence
  Synthetic oligonucleotide; CTC chr11 5285477 5285498 5285482 5285477 -
ctttatcttcctgaaccctgct

SEQ ID NO: 133471 - DNA, 22 bp, Artificial Sequence
  Synthetic oligonucleotide; CTT chr11 5285474 5285495 5285479 5285474 -
tatcttcctgaaccctgctgag

SEQ ID NO: 133472 - DNA, 22 bp, Artificial Sequence
  Synthetic oligonucleotide; TTT chr11 5285473 5285494 5285478 5285473 -
atcttcctgaaccctgctgaga

SEQ ID NO: 133473 - DNA, 22 bp, Artificial Sequence
  Synthetic oligonucleotide; TTA chr11 5285472 5285493 5285477 5285472 -
tcttcctgaaccctgctgagat

SEQ ID NO: 133474 - DNA, 22 bp, Artificial Sequence
  Synthetic oligonucleotide; CTT chr11 5285468 5285489 5285473 5285468 -
cctgaaccctgctgagatgatc

SEQ ID NO: 133475 - DNA, 22 bp, Artificial Sequence
  Synthetic oligonucleotide; TTC chr11 5285467 5285488 5285472 5285467 -
ctgaaccctgctgagatgatct

SEQ ID NO: 133476 - DNA, 22 bp, Artificial Sequence
  Synthetic oligonucleotide; CTG chr11 5285464 5285485 5285469 5285464 -
aaccctgctgagatgatctatg

SEQ ID NO: 133477 - DNA, 22 bp, Artificial Sequence
  Synthetic oligonucleotide; CTG chr11 5285457 5285478 5285462 5285457 -
ctgagatgatctatgtggggag

SEQ ID NO: 133478 - DNA, 22 bp, Artificial Sequence
  Synthetic oligonucleotide; CTG chr11 5285454 5285475 5285459 5285454 -
agatgatctatgtggggagaat

SEQ ID NO: 133479 - DNA, 22 bp, Artificial Sequence
  Synthetic oligonucleotide; CTA chr11 5285444 5285465 5285449 5285444 -
tgtggggagaatggcttctttg

SEQ ID NO: 133480 - DNA, 22 bp, Artificial Sequence
  Synthetic oligonucleotide; CTT chr11 5285427 5285448 5285432 5285427 -
ctttgagaaacatcttcttcgt

SEQ ID NO: 133481 - DNA, 22 bp, Artificial Sequence
  Synthetic oligonucleotide; TTC chr11 5285426 5285447 5285431 5285426 -
tttgagaaacatcttcttcgtt

SEQ ID NO: 133482 - DNA, 22 bp, Artificial Sequence
  Synthetic oligonucleotide; CTT chr11 5285424 5285445 5285429 5285424 -
tgagaaacatcttcttcgttag

SEQ ID NO: 133483 - DNA, 22 bp, Artificial Sequence
  Synthetic oligonucleotide; TTT chr11 5285423 5285444 5285428 5285423 -
gagaaacatcttcttcgttagt

SEQ ID NO: 133484 - DNA, 22 bp, Artificial Sequence
  Synthetic oligonucleotide; TTG chr11 5285422 5285443 5285427 5285422 -
agaaacatcttcttcgttagtg

SEQ ID NO: 133485 - DNA, 22 bp, Artificial Sequence
  Synthetic oligonucleotide; CTT chr11 5285411 5285432 5285416 5285411 -
cttcgttagtggcctgcccctc

SEQ ID NO: 133486 - DNA, 22 bp, Artificial Sequence
  Synthetic oligonucleotide; TTC chr11 5285410 5285431 5285415 5285410 -
ttcgttagtggcctgcccctca

SEQ ID NO: 133487 - DNA, 22 bp, Artificial Sequence
  Synthetic oligonucleotide; CTT chr11 5285408 5285429 5285413 5285408 -
cgttagtggcctgcccctcatt

SEQ ID NO: 133488 - DNA, 22 bp, Artificial Sequence
  Synthetic oligonucleotide; TTC chr11 5285407 5285428 5285412 5285407 -
gttagtggcctgcccctcattc

SEQ ID NO: 133489 - DNA, 22 bp, Artificial Sequence
  Synthetic oligonucleotide; TTA chr11 5285403 5285424 5285408 5285403 -
gtggcctgcccctcattcccac

SEQ ID NO: 133490 - DNA, 22 bp, Artificial Sequence
  Synthetic oligonucleotide; CTG chr11 5285395 5285416 5285400 5285395 -
cccctcattcccactttaatat

SEQ ID NO: 133491 - DNA, 22 bp, Artificial Sequence
  Synthetic oligonucleotide; CTC chr11 5285389 5285410 5285394 5285389 -
attcccactttaatatccagaa

SEQ ID NO: 133492 - DNA, 22 bp, Artificial Sequence
  Synthetic oligonucleotide; TTC chr11 5285385 5285406 5285390 5285385 -
ccactttaatatccagaatcac

SEQ ID NO: 133493 - DNA, 22 bp, Artificial Sequence
  Synthetic oligonucleotide; CTT chr11 5285379 5285400 5285384 5285379 -
taatatccagaatcactataag

SEQ ID NO: 133494 - DNA, 22 bp, Artificial Sequence
  Synthetic oligonucleotide; TTT chr11 5285378 5285399 5285383 5285378 -
aatatccagaatcactataaga

SEQ ID NO: 133495 - DNA, 22 bp, Artificial Sequence
  Synthetic oligonucleotide; TTA chr11 5285377 5285398 5285382 5285377 -
atatccagaatcactataagaa

SEQ ID NO: 133496 - DNA, 22 bp, Artificial Sequence
  Synthetic oligonucleotide; CTA chr11 5285361 5285382 5285366 5285361 -
taagaagaatataataagagga

SEQ ID NO: 133497 - DNA, 22 bp, Artificial Sequence
  Synthetic oligonucleotide; CTC chr11 5285332 5285353 5285337 5285332 -
ttattataggtaagggaaaatt

SEQ ID NO: 133498 - DNA, 22 bp, Artificial Sequence
  Synthetic oligonucleotide; CTT chr11 5285330 5285351 5285335 5285330 -
attataggtaagggaaaattaa

SEQ ID NO: 133499 - DNA, 22 bp, Artificial Sequence
  Synthetic oligonucleotide; TTA chr11 5285329 5285350 5285334 5285329 -
ttataggtaagggaaaattaag

SEQ ID NO: 133500 - DNA, 22 bp, Artificial Sequence
  Synthetic oligonucleotide; TTA chr11 5285326 5285347 5285331 5285326 -
taggtaagggaaaattaagagg

SEQ ID NO: 133501 - DNA, 22 bp, Artificial Sequence
  Synthetic oligonucleotide; TTA chr11 5285309 5285330 5285314 5285309 -
agaggcatacgtgatgggatga

SEQ ID NO: 133502 - DNA, 22 bp, Artificial Sequence
  Synthetic oligonucleotide; TTA chr11 5285263 5285284 5285268 5285263 -
atggacgataaaatctactact

SEQ ID NO: 133503 - DNA, 22 bp, Artificial Sequence
  Synthetic oligonucleotide; CTA chr11 5285246 5285267 5285251 5285246 -
ctactatttgttgagacctttt

SEQ ID NO: 133504 - DNA, 22 bp, Artificial Sequence
  Synthetic oligonucleotide; CTA chr11 5285243 5285264 5285248 5285243 -
ctatttgttgagaccttttata

SEQ ID NO: 133505 - DNA, 22 bp, Artificial Sequence
  Synthetic oligonucleotide; CTA chr11 5285240 5285261 5285245 5285240 -
tttgttgagaccttttatagtc

SEQ ID NO: 133506 - DNA, 22 bp, Artificial Sequence
  Synthetic oligonucleotide; TTT chr11 5285237 5285258 5285242 5285237 -
gttgagaccttttatagtctaa

SEQ ID NO: 133507 - DNA, 22 bp, Artificial Sequence
  Synthetic oligonucleotide; TTG chr11 5285236 5285257 5285241 5285236 -
ttgagaccttttatagtctaat

SEQ ID NO: 133508 - DNA, 22 bp, Artificial Sequence
  Synthetic oligonucleotide; TTG chr11 5285233 5285254 5285238 5285233 -
agaccttttatagtctaatcaa

SEQ ID NO: 133509 - DNA, 22 bp, Artificial Sequence
  Synthetic oligonucleotide; CTT chr11 5285226 5285247 5285231 5285226 -
ttatagtctaatcaattttgct

SEQ ID NO: 133510 - DNA, 22 bp, Artificial Sequence
  Synthetic oligonucleotide; TTT chr11 5285225 5285246 5285230 5285225 -
tatagtctaatcaattttgcta

SEQ ID NO: 133511 - DNA, 22 bp, Artificial Sequence
  Synthetic oligonucleotide; TTT chr11 5285224 5285245 5285229 5285224 -
atagtctaatcaattttgctat

SEQ ID NO: 133512 - DNA, 22 bp, Artificial Sequence
  Synthetic oligonucleotide; TTA chr11 5285223 5285244 5285228 5285223 -
tagtctaatcaattttgctatt

SEQ ID NO: 133513 - DNA, 22 bp, Artificial Sequence
  Synthetic oligonucleotide; CTA chr11 5285216 5285237 5285221 5285216 -
atcaattttgctattgttttcc

SEQ ID NO: 133514 - DNA, 22 bp, Artificial Sequence
  Synthetic oligonucleotide; TTT chr11 5285208 5285229 5285213 5285208 -
tgctattgttttccatcctcac

SEQ ID NO: 133515 - DNA, 22 bp, Artificial Sequence
  Synthetic oligonucleotide; TTT chr11 5285207 5285228 5285212 5285207 -
gctattgttttccatcctcacg

SEQ ID NO: 133516 - DNA, 22 bp, Artificial Sequence
  Synthetic oligonucleotide; TTG chr11 5285206 5285227 5285211 5285206 -
ctattgttttccatcctcacgc

SEQ ID NO: 133517 - DNA, 22 bp, Artificial Sequence
  Synthetic oligonucleotide; CTA chr11 5285203 5285224 5285208 5285203 -
ttgttttccatcctcacgctaa

SEQ ID NO: 133518 - DNA, 22 bp, Artificial Sequence
  Synthetic oligonucleotide; TTG chr11 5285200 5285221 5285205 5285200 -
ttttccatcctcacgctaactc

SEQ ID NO: 133519 - DNA, 22 bp, Artificial Sequence
  Synthetic oligonucleotide; TTT chr11 5285197 5285218 5285202 5285197 -
tccatcctcacgctaactccat

SEQ ID NO: 133520 - DNA, 22 bp, Artificial Sequence
  Synthetic oligonucleotide; TTT chr11 5285196 5285217 5285201 5285196 -
ccatcctcacgctaactccata

SEQ ID NO: 133521 - DNA, 22 bp, Artificial Sequence
  Synthetic oligonucleotide; TTC chr11 5285195 5285216 5285200 5285195 -
catcctcacgctaactccataa

SEQ ID NO: 133522 - DNA, 22 bp, Artificial Sequence
  Synthetic oligonucleotide; CTC chr11 5285188 5285209 5285193 5285188 -
acgctaactccataaaaaaaca

SEQ ID NO: 133523 - DNA, 22 bp, Artificial Sequence
  Synthetic oligonucleotide; CTA chr11 5285182 5285203 5285187 5285182 -
actccataaaaaaacactatta

SEQ ID NO: 133524 - DNA, 22 bp, Artificial Sequence
  Synthetic oligonucleotide; CTC chr11 5285178 5285199 5285183 5285178 -
cataaaaaaacactattattat

SEQ ID NO: 133525 - DNA, 22 bp, Artificial Sequence
  Synthetic oligonucleotide; CTA chr11 5285163 5285184 5285168 5285163 -
ttattatctttattttgccatg

SEQ ID NO: 133526 - DNA, 22 bp, Artificial Sequence
  Synthetic oligonucleotide; TTA chr11 5285160 5285181 5285165 5285160 -
ttatctttattttgccatgaca

SEQ ID NO: 133527 - DNA, 22 bp, Artificial Sequence
  Synthetic oligonucleotide; TTA chr11 5285157 5285178 5285162 5285157 -
tctttattttgccatgacaaga

SEQ ID NO: 133528 - DNA, 22 bp, Artificial Sequence
  Synthetic oligonucleotide; CTT chr11 5285153 5285174 5285158 5285153 -
tattttgccatgacaagactga

SEQ ID NO: 133529 - DNA, 22 bp, Artificial Sequence
  Synthetic oligonucleotide; TTT chr11 5285152 5285173 5285157 5285152 -
attttgccatgacaagactgag

SEQ ID NO: 133530 - DNA, 22 bp, Artificial Sequence
  Synthetic oligonucleotide; TTA chr11 5285151 5285172 5285156 5285151 -
ttttgccatgacaagactgagc

SEQ ID NO: 133531 - DNA, 22 bp, Artificial Sequence
  Synthetic oligonucleotide; TTT chr11 5285148 5285169 5285153 5285148 -
tgccatgacaagactgagctca

SEQ ID NO: 133532 - DNA, 22 bp, Artificial Sequence
  Synthetic oligonucleotide; TTT chr11 5285147 5285168 5285152 5285147 -
gccatgacaagactgagctcag

SEQ ID NO: 133533 - DNA, 22 bp, Artificial Sequence
  Synthetic oligonucleotide; TTG chr11 5285146 5285167 5285151 5285146 -
ccatgacaagactgagctcaga

SEQ ID NO: 133534 - DNA, 22 bp, Artificial Sequence
  Synthetic oligonucleotide; CTG chr11 5285132 5285153 5285137 5285132 -
agctcagaagagtcaagcattt

SEQ ID NO: 133535 - DNA, 22 bp, Artificial Sequence
  Synthetic oligonucleotide; CTC chr11 5285127 5285148 5285132 5285127 -
agaagagtcaagcatttgccta

SEQ ID NO: 133536 - DNA, 22 bp, Artificial Sequence
  Synthetic oligonucleotide; TTT chr11 5285110 5285131 5285115 5285110 -
gcctaaggtcggacatgtcaga

SEQ ID NO: 133537 - DNA, 22 bp, Artificial Sequence
  Synthetic oligonucleotide; TTG chr11 5285109 5285130 5285114 5285109 -
cctaaggtcggacatgtcagag

SEQ ID NO: 133538 - DNA, 22 bp, Artificial Sequence
  Synthetic oligonucleotide; CTA chr11 5285105 5285126 5285110 5285105 -
aggtcggacatgtcagaggcag

SEQ ID NO: 133539 - DNA, 22 bp, Artificial Sequence
  Synthetic oligonucleotide; CTA chr11 5285072 5285093 5285077 5285072 -
tgtgagactctgcagctactgc

SEQ ID NO: 133540 - DNA, 22 bp, Artificial Sequence
  Synthetic oligonucleotide; CTC chr11 5285062 5285083 5285067 5285062 -
tgcagctactgctcatgggccc

SEQ ID NO: 133541 - DNA, 22 bp, Artificial Sequence
  Synthetic oligonucleotide; CTG chr11 5285060 5285081 5285065 5285060 -
cagctactgctcatgggccctg

SEQ ID NO: 133542 - DNA, 22 bp, Artificial Sequence
  Synthetic oligonucleotide; CTA chr11 5285054 5285075 5285059 5285054 -
ctgctcatgggccctgtgctgc

SEQ ID NO: 133543 - DNA, 22 bp, Artificial Sequence
  Synthetic oligonucleotide; CTG chr11 5285051 5285072 5285056 5285051 -
ctcatgggccctgtgctgcact

SEQ ID NO: 133544 - DNA, 22 bp, Artificial Sequence
  Synthetic oligonucleotide; CTC chr11 5285048 5285069 5285053 5285048 -
atgggccctgtgctgcactgat

SEQ ID NO: 133545 - DNA, 22 bp, Artificial Sequence
  Synthetic oligonucleotide; CTG chr11 5285038 5285059 5285043 5285038 -
tgctgcactgatgaggaggatc

SEQ ID NO: 133546 - DNA, 22 bp, Artificial Sequence
  Synthetic oligonucleotide; CTG chr11 5285033 5285054 5285038 5285033 -
cactgatgaggaggatcagatg

SEQ ID NO: 133547 - DNA, 22 bp, Artificial Sequence
  Synthetic oligonucleotide; CTG chr11 5285028 5285049 5285033 5285028 -
atgaggaggatcagatggatgg

SEQ ID NO: 133548 - DNA, 22 bp, Artificial Sequence
  Synthetic oligonucleotide; TTC chr11 5284982 5285003 5284987 5284982 -
tgtggataaaggagacagccat

SEQ ID NO: 133549 - DNA, 22 bp, Artificial Sequence
  Synthetic oligonucleotide; CTG chr11 5284980 5285001 5284985 5284980 -
tggataaaggagacagccatga

SEQ ID NO: 133550 - DNA, 22 bp, Artificial Sequence
  Synthetic oligonucleotide; CTA chr11 5284949 5284970 5284954 5284949 -
tgactgtaaatttgggagcagg

SEQ ID NO: 133551 - DNA, 22 bp, Artificial Sequence
  Synthetic oligonucleotide; CTG chr11 5284943 5284964 5284948 5284943 -
taaatttgggagcaggagtctc

SEQ ID NO: 133552 - DNA, 22 bp, Artificial Sequence
  Synthetic oligonucleotide; TTT chr11 5284936 5284957 5284941 5284936 -
gggagcaggagtctctaaggac

SEQ ID NO: 133553 - DNA, 22 bp, Artificial Sequence
  Synthetic oligonucleotide; TTG chr11 5284935 5284956 5284940 5284935 -
ggagcaggagtctctaaggact

SEQ ID NO: 133554 - DNA, 22 bp, Artificial Sequence
  Synthetic oligonucleotide; CTC chr11 5284921 5284942 5284926 5284921 -
taaggacttggatttcaaggaa

SEQ ID NO: 133555 - DNA, 22 bp, Artificial Sequence
  Synthetic oligonucleotide; CTA chr11 5284919 5284940 5284924 5284919 -
aggacttggatttcaaggaatt

SEQ ID NO: 133556 - DNA, 22 bp, Artificial Sequence
  Synthetic oligonucleotide; CTT chr11 5284912 5284933 5284917 5284912 -
ggatttcaaggaattttgactc

SEQ ID NO: 133557 - DNA, 22 bp, Artificial Sequence
  Synthetic oligonucleotide; TTG chr11 5284911 5284932 5284916 5284911 -
gatttcaaggaattttgactca

SEQ ID NO: 133558 - DNA, 22 bp, Artificial Sequence
  Synthetic oligonucleotide; TTT chr11 5284906 5284927 5284911 5284906 -
caaggaattttgactcagcaaa

SEQ ID NO: 133559 - DNA, 22 bp, Artificial Sequence
  Synthetic oligonucleotide; TTC chr11 5284905 5284926 5284910 5284905 -
aaggaattttgactcagcaaac

SEQ ID NO: 133560 - DNA, 22 bp, Artificial Sequence
  Synthetic oligonucleotide; TTT chr11 5284896 5284917 5284901 5284896 -
tgactcagcaaacacaagaccc

SEQ ID NO: 133561 - DNA, 22 bp, Artificial Sequence
  Synthetic oligonucleotide; TTT chr11 5284895 5284916 5284900 5284895 -
gactcagcaaacacaagaccct

SEQ ID NO: 133562 - DNA, 22 bp, Artificial Sequence
  Synthetic oligonucleotide; TTG chr11 5284894 5284915 5284899 5284894 -
actcagcaaacacaagaccctc

SEQ ID NO: 133563 - DNA, 22 bp, Artificial Sequence
  Synthetic oligonucleotide; CTC chr11 5284890 5284911 5284895 5284890 -
agcaaacacaagaccctcacgg

SEQ ID NO: 133564 - DNA, 22 bp, Artificial Sequence
  Synthetic oligonucleotide; CTC chr11 5284872 5284893 5284877 5284872 -
acggtgactttgcgagctggtg

SEQ ID NO: 133565 - DNA, 22 bp, Artificial Sequence
  Synthetic oligonucleotide; CTT chr11 5284862 5284883 5284867 5284862 -
tgcgagctggtgtgccagatgt

SEQ ID NO: 133566 - DNA, 22 bp, Artificial Sequence
  Synthetic oligonucleotide; TTT chr11 5284861 5284882 5284866 5284861 -
gcgagctggtgtgccagatgtg

SEQ ID NO: 133567 - DNA, 22 bp, Artificial Sequence
  Synthetic oligonucleotide; TTG chr11 5284860 5284881 5284865 5284860 -
cgagctggtgtgccagatgtgt

SEQ ID NO: 133568 - DNA, 22 bp, Artificial Sequence
  Synthetic oligonucleotide; CTG chr11 5284853 5284874 5284858 5284853 -
gtgtgccagatgtgtctatcag

SEQ ID NO: 133569 - DNA, 22 bp, Artificial Sequence
  Synthetic oligonucleotide; CTA chr11 5284835 5284856 5284840 5284835 -
tcagaggttccagggagggtgg

SEQ ID NO: 133570 - DNA, 22 bp, Artificial Sequence
  Synthetic oligonucleotide; TTC chr11 5284825 5284846 5284830 5284825 -
cagggagggtggggtggggtca

SEQ ID NO: 133571 - DNA, 22 bp, Artificial Sequence
  Synthetic oligonucleotide; CTG chr11 5284797 5284818 5284802 5284797 -
gccaccagctatcagggcccag

SEQ ID NO: 133572 - DNA, 22 bp, Artificial Sequence
  Synthetic oligonucleotide; CTA chr11 5284786 5284807 5284791 5284786 -
tcagggcccagatgggttatag

SEQ ID NO: 133573 - DNA, 22 bp, Artificial Sequence
  Synthetic oligonucleotide; TTA chr11 5284767 5284788 5284772 5284767 -
taggctggcaggctcagatagg

SEQ ID NO: 133574 - DNA, 22 bp, Artificial Sequence
  Synthetic oligonucleotide; CTG chr11 5284760 5284781 5284765 5284760 -
gcaggctcagataggtggttag

SEQ ID NO: 133575 - DNA, 22 bp, Artificial Sequence
  Synthetic oligonucleotide; CTC chr11 5284752 5284773 5284757 5284752 -
agataggtggttaggtcaggtt

SEQ ID NO: 133576 - DNA, 22 bp, Artificial Sequence
  Synthetic oligonucleotide; TTA chr11 5284739 5284760 5284744 5284739 -
ggtcaggttggtggtgctgggt

SEQ ID NO: 133577 - DNA, 22 bp, Artificial Sequence
  Synthetic oligonucleotide; TTG chr11 5284729 5284750 5284734 5284729 -
gtggtgctgggtggagtccatg

SEQ ID NO: 133578 - DNA, 22 bp, Artificial Sequence
  Synthetic oligonucleotide; CTG chr11 5284720 5284741 5284725 5284720 -
ggtggagtccatgactcccagg

SEQ ID NO: 133579 - DNA, 22 bp, Artificial Sequence
  Synthetic oligonucleotide; CTC chr11 5284703 5284724 5284708 5284703 -
ccaggagccaggagagatagac

SEQ ID NO: 133580 - DNA, 22 bp, Artificial Sequence
  Synthetic oligonucleotide; TTT chr11 5284626 5284647 5284631 5284626 -
ttcattctactactacatggga

SEQ ID NO: 133581 - DNA, 22 bp, Artificial Sequence
  Synthetic oligonucleotide; TTT chr11 5284625 5284646 5284630 5284625 -
tcattctactactacatgggac

SEQ ID NO: 133582 - DNA, 22 bp, Artificial Sequence
  Synthetic oligonucleotide; TTT chr11 5284624 5284645 5284629 5284624 -
cattctactactacatgggact

SEQ ID NO: 133583 - DNA, 22 bp, Artificial Sequence
  Synthetic oligonucleotide; TTC chr11 5284623 5284644 5284628 5284623 -
attctactactacatgggactg

SEQ ID NO: 133584 - DNA, 22 bp, Artificial Sequence
  Synthetic oligonucleotide; TTC chr11 5284619 5284640 5284624 5284619 -
tactactacatgggactgctcc

SEQ ID NO: 133585 - DNA, 22 bp, Artificial Sequence
  Synthetic oligonucleotide; CTA chr11 5284617 5284638 5284622 5284617 -
ctactacatgggactgctcccc

SEQ ID NO: 133586 - DNA, 22 bp, Artificial Sequence
  Synthetic oligonucleotide; CTA chr11 5284614 5284635 5284619 5284614 -
ctacatgggactgctcccctat

SEQ ID NO: 133587 - DNA, 22 bp, Artificial Sequence
  Synthetic oligonucleotide; CTA chr11 5284611 5284632 5284616 5284611 -
catgggactgctcccctatacc

SEQ ID NO: 133588 - DNA, 22 bp, Artificial Sequence
  Synthetic oligonucleotide; CTG chr11 5284601 5284622 5284606 5284601 -
ctcccctatacccccagctagg

SEQ ID NO: 133589 - DNA, 22 bp, Artificial Sequence
  Synthetic oligonucleotide; CTC chr11 5284598 5284619 5284603 5284598 -
ccctatacccccagctaggggc

SEQ ID NO: 133590 - DNA, 22 bp, Artificial Sequence
  Synthetic oligonucleotide; CTA chr11 5284593 5284614 5284598 5284593 -
tacccccagctaggggcaagtg

SEQ ID NO: 133591 - DNA, 22 bp, Artificial Sequence
  Synthetic oligonucleotide; CTA chr11 5284581 5284602 5284586 5284581 -
ggggcaagtgccttgactccta

SEQ ID NO: 133592 - DNA, 22 bp, Artificial Sequence
  Synthetic oligonucleotide; CTT chr11 5284567 5284588 5284572 5284567 -
gactcctatgttttcaggatca

SEQ ID NO: 133593 - DNA, 22 bp, Artificial Sequence
  Synthetic oligonucleotide; TTG chr11 5284566 5284587 5284571 5284566 -
actcctatgttttcaggatcat

SEQ ID NO: 133594 - DNA, 22 bp, Artificial Sequence
  Synthetic oligonucleotide; CTC chr11 5284562 5284583 5284567 5284562 -
ctatgttttcaggatcatcatc

SEQ ID NO: 133595 - DNA, 22 bp, Artificial Sequence
  Synthetic oligonucleotide; CTA chr11 5284559 5284580 5284564 5284559 -
tgttttcaggatcatcatctat

SEQ ID NO: 133596 - DNA, 22 bp, Artificial Sequence
  Synthetic oligonucleotide; TTT chr11 5284554 5284575 5284559 5284554 -
tcaggatcatcatctataaagt

SEQ ID NO: 133597 - DNA, 22 bp, Artificial Sequence
  Synthetic oligonucleotide; TTT chr11 5284553 5284574 5284558 5284553 -
caggatcatcatctataaagta

SEQ ID NO: 133598 - DNA, 22 bp, Artificial Sequence
  Synthetic oligonucleotide; TTC chr11 5284552 5284573 5284557 5284552 -
aggatcatcatctataaagtaa

SEQ ID NO: 133599 - DNA, 22 bp, Artificial Sequence
  Synthetic oligonucleotide; CTA chr11 5284538 5284559 5284543 5284538 -
taaagtaagagtaataattgtg

SEQ ID NO: 133600 - DNA, 22 bp, Artificial Sequence
  Synthetic oligonucleotide; TTG chr11 5284518 5284539 5284523 5284518 -
tgtctatctcatagggttatta

SEQ ID NO: 133601 - DNA, 22 bp, Artificial Sequence
  Synthetic oligonucleotide; CTA chr11 5284512 5284533 5284517 5284512 -
tctcatagggttattatgagga

SEQ ID NO: 133602 - DNA, 22 bp, Artificial Sequence
  Synthetic oligonucleotide; CTC chr11 5284508 5284529 5284513 5284508 -
atagggttattatgaggatcaa

SEQ ID NO: 133603 - DNA, 22 bp, Artificial Sequence
  Synthetic oligonucleotide; TTA chr11 5284499 5284520 5284504 5284499 -
ttatgaggatcaaaggagatgc

SEQ ID NO: 133604 - DNA, 22 bp, Artificial Sequence
  Synthetic oligonucleotide; TTA chr11 5284496 5284517 5284501 5284496 -
tgaggatcaaaggagatgcaca

SEQ ID NO: 133605 - DNA, 22 bp, Artificial Sequence
  Synthetic oligonucleotide; CTC chr11 5284471 5284492 5284476 5284471 -
tctggaccagtggcctaacagt

SEQ ID NO: 133606 - DNA, 22 bp, Artificial Sequence
  Synthetic oligonucleotide; CTC chr11 5284469 5284490 5284474 5284469 -
tggaccagtggcctaacagttc

SEQ ID NO: 133607 - DNA, 22 bp, Artificial Sequence
  Synthetic oligonucleotide; CTG chr11 5284467 5284488 5284472 5284467 -
gaccagtggcctaacagttcag

SEQ ID NO: 133608 - DNA, 22 bp, Artificial Sequence
  Synthetic oligonucleotide; CTA chr11 5284454 5284475 5284459 5284454 -
acagttcaggacagagctatgg

SEQ ID NO: 133609 - DNA, 22 bp, Artificial Sequence
  Synthetic oligonucleotide; TTC chr11 5284447 5284468 5284452 5284447 -
aggacagagctatgggcttcct

SEQ ID NO: 133610 - DNA, 22 bp, Artificial Sequence
  Synthetic oligonucleotide; CTA chr11 5284435 5284456 5284440 5284435 -
tgggcttcctatgtatgggtca

SEQ ID NO: 133611 - DNA, 22 bp, Artificial Sequence
  Synthetic oligonucleotide; CTT chr11 5284428 5284449 5284433 5284428 -
cctatgtatgggtcagtggtct

SEQ ID NO: 133612 - DNA, 22 bp, Artificial Sequence
  Synthetic oligonucleotide; TTC chr11 5284427 5284448 5284432 5284427 -
ctatgtatgggtcagtggtctc

SEQ ID NO: 133613 - DNA, 22 bp, Artificial Sequence
  Synthetic oligonucleotide; CTA chr11 5284424 5284445 5284429 5284424 -
tgtatgggtcagtggtctcaat

SEQ ID NO: 133614 - DNA, 22 bp, Artificial Sequence
  Synthetic oligonucleotide; CTC chr11 5284405 5284426 5284410 5284405 -
aatgtagcaggcaagttccaga

SEQ ID NO: 133615 - DNA, 22 bp, Artificial Sequence
  Synthetic oligonucleotide; TTC chr11 5284387 5284408 5284392 5284387 -
cagaagatagcatcaaccactg

SEQ ID NO: 133616 - DNA, 22 bp, Artificial Sequence
  Synthetic oligonucleotide; CTG chr11 5284365 5284386 5284370 5284365 -
ttagagatatactgccagtctc

SEQ ID NO: 133617 - DNA, 22 bp, Artificial Sequence
  Synthetic oligonucleotide; TTA chr11 5284362 5284383 5284367 5284362 -
gagatatactgccagtctcaga

SEQ ID NO: 133618 - DNA, 22 bp, Artificial Sequence
  Synthetic oligonucleotide; CTG chr11 5284351 5284372 5284356 5284351 -
ccagtctcagagcctgatgtta

SEQ ID NO: 133619 - DNA, 22 bp, Artificial Sequence
  Synthetic oligonucleotide; CTC chr11 5284343 5284364 5284348 5284343 -
agagcctgatgttaatttagca

SEQ ID NO: 133620 - DNA, 22 bp, Artificial Sequence
  Synthetic oligonucleotide; CTG chr11 5284335 5284356 5284340 5284335 -
atgttaatttagcaatgggctg

SEQ ID NO: 133621 - DNA, 22 bp, Artificial Sequence
  Synthetic oligonucleotide; TTA chr11 5284329 5284350 5284334 5284329 -
atttagcaatgggctgggaccc

SEQ ID NO: 133622 - DNA, 22 bp, Artificial Sequence
  Synthetic oligonucleotide; TTT chr11 5284325 5284346 5284330 5284325 -
agcaatgggctgggaccctcct

SEQ ID NO: 133623 - DNA, 22 bp, Artificial Sequence
  Synthetic oligonucleotide; TTA chr11 5284324 5284345 5284329 5284324 -
gcaatgggctgggaccctcctc

SEQ ID NO: 133624 - DNA, 22 bp, Artificial Sequence
  Synthetic oligonucleotide; CTG chr11 5284313 5284334 5284318 5284313 -
ggaccctcctccagtagaacct

SEQ ID NO: 133625 - DNA, 22 bp, Artificial Sequence
  Synthetic oligonucleotide; CTC chr11 5284305 5284326 5284310 5284305 -
ctccagtagaaccttctaacca

SEQ ID NO: 133626 - DNA, 22 bp, Artificial Sequence
  Synthetic oligonucleotide; CTC chr11 5284302 5284323 5284307 5284302 -
cagtagaaccttctaaccagct

SEQ ID NO: 133627 - DNA, 22 bp, Artificial Sequence
  Synthetic oligonucleotide; CTT chr11 5284290 5284311 5284295 5284290 -
ctaaccagctgctgcagtcaaa

SEQ ID NO: 133628 - DNA, 22 bp, Artificial Sequence
  Synthetic oligonucleotide; TTC chr11 5284289 5284310 5284294 5284289 -
taaccagctgctgcagtcaaag

SEQ ID NO: 133629 - DNA, 22 bp, Artificial Sequence
  Synthetic oligonucleotide; CTA chr11 5284287 5284308 5284292 5284287 -
accagctgctgcagtcaaagtc

SEQ ID NO: 133630 - DNA, 22 bp, Artificial Sequence
  Synthetic oligonucleotide; CTG chr11 5284279 5284300 5284284 5284279 -
ctgcagtcaaagtcgaatgcag

SEQ ID NO: 133631 - DNA, 22 bp, Artificial Sequence
  Synthetic oligonucleotide; CTG chr11 5284276 5284297 5284281 5284276 -
cagtcaaagtcgaatgcagctg

SEQ ID NO: 133632 - DNA, 22 bp, Artificial Sequence
  Synthetic oligonucleotide; CTG chr11 5284254 5284275 5284259 5284254 -
gttagactttttttaatgaaag

SEQ ID NO: 133633 - DNA, 22 bp, Artificial Sequence
  Synthetic oligonucleotide; TTA chr11 5284250 5284271 5284255 5284250 -
gactttttttaatgaaagctta

SEQ ID NO: 133634 - DNA, 22 bp, Artificial Sequence
  Synthetic oligonucleotide; CTT chr11 5284245 5284266 5284250 5284245 -
tttttaatgaaagcttagcttt

SEQ ID NO: 133635 - DNA, 22 bp, Artificial Sequence
  Synthetic oligonucleotide; TTT chr11 5284244 5284265 5284249 5284244 -
ttttaatgaaagcttagctttc

SEQ ID NO: 133636 - DNA, 22 bp, Artificial Sequence
  Synthetic oligonucleotide; TTT chr11 5284243 5284264 5284248 5284243 -
tttaatgaaagcttagctttca

SEQ ID NO: 133637 - DNA, 22 bp, Artificial Sequence
  Synthetic oligonucleotide; TTT chr11 5284242 5284263 5284247 5284242 -
ttaatgaaagcttagctttcat

SEQ ID NO: 133638 - DNA, 22 bp, Artificial Sequence
  Synthetic oligonucleotide; TTT chr11 5284241 5284262 5284246 5284241 -
taatgaaagcttagctttcatt

SEQ ID NO: 133639 - DNA, 22 bp, Artificial Sequence
  Synthetic oligonucleotide; TTT chr11 5284240 5284261 5284245 5284240 -
aatgaaagcttagctttcatta

SEQ ID NO: 133640 - DNA, 22 bp, Artificial Sequence
  Synthetic oligonucleotide; TTA chr11 5284239 5284260 5284244 5284239 -
atgaaagcttagctttcattaa

SEQ ID NO: 133641 - DNA, 22 bp, Artificial Sequence
  Synthetic oligonucleotide; CTT chr11 5284229 5284250 5284234 5284229 -
agctttcattaaagattaagct

SEQ ID NO: 133642 - DNA, 22 bp, Artificial Sequence
  Synthetic oligonucleotide; TTA chr11 5284228 5284249 5284233 5284228 -
gctttcattaaagattaagctc

SEQ ID NO: 133643 - DNA, 22 bp, Artificial Sequence
  Synthetic oligonucleotide; CTT chr11 5284224 5284245 5284229 5284224 -
tcattaaagattaagctcctaa

SEQ ID NO: 133644 - DNA, 22 bp, Artificial Sequence
  Synthetic oligonucleotide; TTT chr11 5284223 5284244 5284228 5284223 -
cattaaagattaagctcctaag

SEQ ID NO: 133645 - DNA, 22 bp, Artificial Sequence
  Synthetic oligonucleotide; TTC chr11 5284222 5284243 5284227 5284222 -
attaaagattaagctcctaagc

SEQ ID NO: 133646 - DNA, 22 bp, Artificial Sequence
  Synthetic oligonucleotide; TTA chr11 5284218 5284239 5284223 5284218 -
aagattaagctcctaagcaggg

SEQ ID NO: 133647 - DNA, 22 bp, Artificial Sequence
  Synthetic oligonucleotide; TTA chr11 5284211 5284232 5284216 5284211 -
agctcctaagcagggcacagat

SEQ ID NO: 133648 - DNA, 22 bp, Artificial Sequence
  Synthetic oligonucleotide; CTC chr11 5284206 5284227 5284211 5284206 -
ctaagcagggcacagatgaaat

SEQ ID NO: 133649 - DNA, 22 bp, Artificial Sequence
  Synthetic oligonucleotide; CTA chr11 5284203 5284224 5284208 5284203 -
agcagggcacagatgaaattgt

SEQ ID NO: 133650 - DNA, 22 bp, Artificial Sequence
  Synthetic oligonucleotide; TTG chr11 5284182 5284203 5284187 5284182 -
tctaacagcaactttgccatct

SEQ ID NO: 133651 - DNA, 22 bp, Artificial Sequence
  Synthetic oligonucleotide; CTA chr11 5284178 5284199 5284183 5284178 -
acagcaactttgccatctaaaa

SEQ ID NO: 133652 - DNA, 22 bp, Artificial Sequence
  Synthetic oligonucleotide; CTT chr11 5284168 5284189 5284173 5284168 -
tgccatctaaaaaaatctgact

SEQ ID NO: 133653 - DNA, 22 bp, Artificial Sequence
  Synthetic oligonucleotide; TTT chr11 5284167 5284188 5284172 5284167 -
gccatctaaaaaaatctgactt

SEQ ID NO: 133654 - DNA, 22 bp, Artificial Sequence
  Synthetic oligonucleotide; TTG chr11 5284166 5284187 5284171 5284166 -
ccatctaaaaaaatctgacttc

SEQ ID NO: 133655 - DNA, 22 bp, Artificial Sequence
  Synthetic oligonucleotide; CTA chr11 5284159 5284180 5284164 5284159 -
aaaaaatctgacttcactggaa

SEQ ID NO: 133656 - DNA, 22 bp, Artificial Sequence
  Synthetic oligonucleotide; CTG chr11 5284149 5284170 5284154 5284149 -
acttcactggaaacatggaagc

SEQ ID NO: 133657 - DNA, 22 bp, Artificial Sequence
  Synthetic oligonucleotide; CTT chr11 5284145 5284166 5284150 5284145 -
cactggaaacatggaagcccaa

SEQ ID NO: 133658 - DNA, 22 bp, Artificial Sequence
  Synthetic oligonucleotide; TTC chr11 5284144 5284165 5284149 5284144 -
actggaaacatggaagcccaag

SEQ ID NO: 133659 - DNA, 22 bp, Artificial Sequence
  Synthetic oligonucleotide; CTG chr11 5284140 5284161 5284145 5284140 -
gaaacatggaagcccaaggttc

SEQ ID NO: 133660 - DNA, 22 bp, Artificial Sequence
  Synthetic oligonucleotide; TTC chr11 5284118 5284139 5284123 5284118 -
tgaacatgagaaatttttagga

SEQ ID NO: 133661 - DNA, 22 bp, Artificial Sequence
  Synthetic oligonucleotide; CTG chr11 5284116 5284137 5284121 5284116 -
aacatgagaaatttttaggaat

SEQ ID NO: 133662 - DNA, 22 bp, Artificial Sequence
  Synthetic oligonucleotide; TTT chr11 5284102 5284123 5284107 5284102 -
ttaggaatctgcacaggagttg

SEQ ID NO: 133663 - DNA, 22 bp, Artificial Sequence
  Synthetic oligonucleotide; TTT chr11 5284101 5284122 5284106 5284101 -
taggaatctgcacaggagttga

SEQ ID NO: 133664 - DNA, 22 bp, Artificial Sequence
  Synthetic oligonucleotide; TTT chr11 5284100 5284121 5284105 5284100 -
aggaatctgcacaggagttgag

SEQ ID NO: 133665 - DNA, 22 bp, Artificial Sequence
  Synthetic oligonucleotide; TTA chr11 5284099 5284120 5284104 5284099 -
ggaatctgcacaggagttgaga

SEQ ID NO: 133666 - DNA, 22 bp, Artificial Sequence
  Synthetic oligonucleotide; CTG chr11 5284091 5284112 5284096 5284091 -
cacaggagttgagagggaaaca

SEQ ID NO: 133667 - DNA, 22 bp, Artificial Sequence
  Synthetic oligonucleotide; TTG chr11 5284080 5284101 5284085 5284080 -
agagggaaacaagatggtgaag

SEQ ID NO: 133668 - DNA, 22 bp, Artificial Sequence
  Synthetic oligonucleotide; CTA chr11 5284052 5284073 5284057 5284052 -
gaaaccacatgagagacacgag

SEQ ID NO: 133669 - DNA, 22 bp, Artificial Sequence
  Synthetic oligonucleotide; TTT chr11 5284014 5284035 5284019 5284014 -
aggctggaggtaaatgaaagag

SEQ ID NO: 133670 - DNA, 22 bp, Artificial Sequence
  Synthetic oligonucleotide; TTA chr11 5284013 5284034 5284018 5284013 -
ggctggaggtaaatgaaagaga

SEQ ID NO: 133671 - DNA, 22 bp, Artificial Sequence
  Synthetic oligonucleotide; CTG chr11 5284008 5284029 5284013 5284008 -
gaggtaaatgaaagagaagtgg

SEQ ID NO: 133672 - DNA, 22 bp, Artificial Sequence
  Synthetic oligonucleotide; TTA chr11 5283980 5284001 5283985 5283980 -
atacttactgaaatctttctat

SEQ ID NO: 133673 - DNA, 22 bp, Artificial Sequence
  Synthetic oligonucleotide; CTT chr11 5283974 5283995 5283979 5283974 -
actgaaatctttctatatgtca

SEQ ID NO: 133674 - DNA, 22 bp, Artificial Sequence
  Synthetic oligonucleotide; TTA chr11 5283973 5283994 5283978 5283973 -
ctgaaatctttctatatgtcag

SEQ ID NO: 133675 - DNA, 22 bp, Artificial Sequence
  Synthetic oligonucleotide; CTG chr11 5283970 5283991 5283975 5283970 -
aaatctttctatatgtcaggtg

SEQ ID NO: 133676 - DNA, 22 bp, Artificial Sequence
  Synthetic oligonucleotide; CTT chr11 5283963 5283984 5283968 5283963 -
tctatatgtcaggtgccatttt

SEQ ID NO: 133677 - DNA, 22 bp, Artificial Sequence
  Synthetic oligonucleotide; TTT chr11 5283962 5283983 5283967 5283962 -
ctatatgtcaggtgccatttta

SEQ ID NO: 133678 - DNA, 22 bp, Artificial Sequence
  Synthetic oligonucleotide; TTC chr11 5283961 5283982 5283966 5283961 -
tatatgtcaggtgccattttat

SEQ ID NO: 133679 - DNA, 22 bp, Artificial Sequence
  Synthetic oligonucleotide; CTA chr11 5283959 5283980 5283964 5283959 -
tatgtcaggtgccattttatga

SEQ ID NO: 133680 - DNA, 22 bp, Artificial Sequence
  Synthetic oligonucleotide; TTT chr11 5283942 5283963 5283947 5283942 -
tatgatatttaataatctcatt

SEQ ID NO: 133681 - DNA, 22 bp, Artificial Sequence
  Synthetic oligonucleotide; TTT chr11 5283941 5283962 5283946 5283941 -
atgatatttaataatctcatta

SEQ ID NO: 133682 - DNA, 22 bp, Artificial Sequence
  Synthetic oligonucleotide; TTA chr11 5283940 5283961 5283945 5283940 -
tgatatttaataatctcattac

SEQ ID NO: 133683 - DNA, 22 bp, Artificial Sequence
  Synthetic oligonucleotide; TTT chr11 5283932 5283953 5283937 5283932 -
aataatctcattacatatggta

SEQ ID NO: 133684 - DNA, 22 bp, Artificial Sequence
  Synthetic oligonucleotide; TTA chr11 5283931 5283952 5283936 5283931 -
ataatctcattacatatggtaa

SEQ ID NO: 133685 - DNA, 22 bp, Artificial Sequence
  Synthetic oligonucleotide; CTC chr11 5283923 5283944 5283928 5283923 -
attacatatggtaattctgtga

SEQ ID NO: 133686 - DNA, 22 bp, Artificial Sequence
  Synthetic oligonucleotide; TTA chr11 5283919 5283940 5283924 5283919 -
catatggtaattctgtgagata

SEQ ID NO: 133687 - DNA, 22 bp, Artificial Sequence
  Synthetic oligonucleotide; TTC chr11 5283906 5283927 5283911 5283906 -
tgtgagatatgtattattgaac

SEQ ID NO: 133688 - DNA, 22 bp, Artificial Sequence
  Synthetic oligonucleotide; CTG chr11 5283904 5283925 5283909 5283904 -
tgagatatgtattattgaacat

SEQ ID NO: 133689 - DNA, 22 bp, Artificial Sequence
  Synthetic oligonucleotide; TTA chr11 5283890 5283911 5283895 5283890 -
ttgaacatactataattaatac

SEQ ID NO: 133690 - DNA, 22 bp, Artificial Sequence
  Synthetic oligonucleotide; TTG chr11 5283887 5283908 5283892 5283887 -
aacatactataattaatactaa

SEQ ID NO: 133691 - DNA, 22 bp, Artificial Sequence
  Synthetic oligonucleotide; CTA chr11 5283878 5283899 5283883 5283878 -
taattaatactaatgataagta

SEQ ID NO: 133692 - DNA, 22 bp, Artificial Sequence
  Synthetic oligonucleotide; TTA chr11 5283872 5283893 5283877 5283872 -
atactaatgataagtaacacct

SEQ ID NO: 133693 - DNA, 22 bp, Artificial Sequence
  Synthetic oligonucleotide; CTA chr11 5283866 5283887 5283871 5283866 -
atgataagtaacacctcttgag

SEQ ID NO: 133694 - DNA, 22 bp, Artificial Sequence
  Synthetic oligonucleotide; CTC chr11 5283849 5283870 5283854 5283849 -
ttgagtacttagtatatgctag

SEQ ID NO: 133695 - DNA, 22 bp, Artificial Sequence
  Synthetic oligonucleotide; CTT chr11 5283847 5283868 5283852 5283847 -
gagtacttagtatatgctagaa

SEQ ID NO: 133696 - DNA, 22 bp, Artificial Sequence
  Synthetic oligonucleotide; TTG chr11 5283846 5283867 5283851 5283846 -
agtacttagtatatgctagaat

SEQ ID NO: 133697 - DNA, 22 bp, Artificial Sequence
  Synthetic oligonucleotide; CTT chr11 5283839 5283860 5283844 5283839 -
agtatatgctagaatcaaattt

SEQ ID NO: 133698 - DNA, 22 bp, Artificial Sequence
  Synthetic oligonucleotide; TTA chr11 5283838 5283859 5283843 5283838 -
gtatatgctagaatcaaattta

SEQ ID NO: 133699 - DNA, 22 bp, Artificial Sequence
  Synthetic oligonucleotide; CTA chr11 5283828 5283849 5283833 5283828 -
gaatcaaatttaagtttatcat

SEQ ID NO: 133700 - DNA, 22 bp, Artificial Sequence
  Synthetic oligonucleotide; TTT chr11 5283817 5283838 5283822 5283817 -
aagtttatcatatgaggccggg

SEQ ID NO: 133701 - DNA, 22 bp, Artificial Sequence
  Synthetic oligonucleotide; TTA chr11 5283816 5283837 5283821 5283816 -
agtttatcatatgaggccgggc

SEQ ID NO: 133702 - DNA, 22 bp, Artificial Sequence
  Synthetic oligonucleotide; TTT chr11 5283811 5283832 5283816 5283811 -
atcatatgaggccgggcacggt

SEQ ID NO: 133703 - DNA, 22 bp, Artificial Sequence
  Synthetic oligonucleotide; TTA chr11 5283810 5283831 5283815 5283810 -
tcatatgaggccgggcacggtg

SEQ ID NO: 133704 - DNA, 22 bp, Artificial Sequence
  Synthetic oligonucleotide; CTC chr11 5283784 5283805 5283789 5283784 -
atatatgggattacatgcctgt

SEQ ID NO: 133705 - DNA, 22 bp, Artificial Sequence
  Synthetic oligonucleotide; TTA chr11 5283771 5283792 5283776 5283771 -
catgcctgtaatcccagcactt

SEQ ID NO: 133706 - DNA, 22 bp, Artificial Sequence
  Synthetic oligonucleotide; CTG chr11 5283763 5283784 5283768 5283763 -
taatcccagcactttgggaggc

SEQ ID NO: 133707 - DNA, 22 bp, Artificial Sequence
  Synthetic oligonucleotide; CTT chr11 5283749 5283770 5283754 5283749 -
tgggaggccaaggcaattggat

SEQ ID NO: 133708 - DNA, 22 bp, Artificial Sequence
  Synthetic oligonucleotide; TTT chr11 5283748 5283769 5283753 5283748 -
gggaggccaaggcaattggatc

SEQ ID NO: 133709 - DNA, 22 bp, Artificial Sequence
  Synthetic oligonucleotide; TTG chr11 5283747 5283768 5283752 5283747 -
ggaggccaaggcaattggatca

SEQ ID NO: 133710 - DNA, 22 bp, Artificial Sequence
  Synthetic oligonucleotide; TTG chr11 5283730 5283751 5283735 5283730 -
gatcacctgaggtcaggagttc

SEQ ID NO: 133711 - DNA, 22 bp, Artificial Sequence
  Synthetic oligonucleotide; CTG chr11 5283721 5283742 5283726 5283721 -
aggtcaggagttccagaccagc

SEQ ID NO: 133712 - DNA, 22 bp, Artificial Sequence
  Synthetic oligonucleotide; TTC chr11 5283708 5283729 5283713 5283708 -
cagaccagcctggccaacatgg

SEQ ID NO: 133713 - DNA, 22 bp, Artificial Sequence
  Synthetic oligonucleotide; CTG chr11 5283696 5283717 5283701 5283696 -
gccaacatggtgaaaccccttc

SEQ ID NO: 133714 - DNA, 22 bp, Artificial Sequence
  Synthetic oligonucleotide; CTT chr11 5283675 5283696 5283680 5283675 -
ctctactaaaaaatacaaaaaa

SEQ ID NO: 133715 - DNA, 22 bp, Artificial Sequence
  Synthetic oligonucleotide; TTC chr11 5283674 5283695 5283679 5283674 -
tctactaaaaaatacaaaaaat

SEQ ID NO: 133716 - DNA, 22 bp, Artificial Sequence
  Synthetic oligonucleotide; CTC chr11 5283672 5283693 5283677 5283672 -
tactaaaaaatacaaaaaatca

SEQ ID NO: 133717 - DNA, 22 bp, Artificial Sequence
  Synthetic oligonucleotide; CTA chr11 5283670 5283691 5283675 5283670 -
ctaaaaaatacaaaaaatcagc

SEQ ID NO: 133718 - DNA, 22 bp, Artificial Sequence
  Synthetic oligonucleotide; CTA chr11 5283667 5283688 5283672 5283667 -
aaaaatacaaaaaatcagccag

SEQ ID NO: 133719 - DNA, 22 bp, Artificial Sequence
  Synthetic oligonucleotide; CTA chr11 5283626 5283647 5283631 5283626 -
taatcccagctactcaggaggc

SEQ ID NO: 133720 - DNA, 22 bp, Artificial Sequence
  Synthetic oligonucleotide; CTA chr11 5283614 5283635 5283619 5283614 -
ctcaggaggctgaggcaggaga

SEQ ID NO: 133721 - DNA, 22 bp, Artificial Sequence
  Synthetic oligonucleotide; CTC chr11 5283611 5283632 5283616 5283611 -
aggaggctgaggcaggagaatc

SEQ ID NO: 133722 - DNA, 22 bp, Artificial Sequence
  Synthetic oligonucleotide; CTG chr11 5283602 5283623 5283607 5283602 -
aggcaggagaatcacttgaacc

SEQ ID NO: 133723 - DNA, 22 bp, Artificial Sequence
  Synthetic oligonucleotide; CTT chr11 5283585 5283606 5283590 5283585 -
gaacccaggaggtggaggttgc

SEQ ID NO: 133724 - DNA, 22 bp, Artificial Sequence
  Synthetic oligonucleotide; TTG chr11 5283584 5283605 5283589 5283584 -
aacccaggaggtggaggttgca

SEQ ID NO: 133725 - DNA, 22 bp, Artificial Sequence
  Synthetic oligonucleotide; TTG chr11 5283564 5283585 5283569 5283564 -
cagtgagctaagattgcaccac

SEQ ID NO: 133726 - DNA, 22 bp, Artificial Sequence
  Synthetic oligonucleotide; CTA chr11 5283554 5283575 5283559 5283554 -
agattgcaccactgcactccag

SEQ ID NO: 133727 - DNA, 22 bp, Artificial Sequence
  Synthetic oligonucleotide; TTG chr11 5283548 5283569 5283553 5283548 -
caccactgcactccagcctagg

SEQ ID NO: 133728 - DNA, 22 bp, Artificial Sequence
  Synthetic oligonucleotide; CTG chr11 5283540 5283561 5283545 5283540 -
cactccagcctaggcgacagag

SEQ ID NO: 133729 - DNA, 22 bp, Artificial Sequence
  Synthetic oligonucleotide; CTC chr11 5283535 5283556 5283540 5283535 -
cagcctaggcgacagagtgaga

SEQ ID NO: 133730 - DNA, 22 bp, Artificial Sequence
  Synthetic oligonucleotide; CTA chr11 5283528 5283549 5283533 5283528 -
ggcgacagagtgagactccatc

SEQ ID NO: 133731 - DNA, 22 bp, Artificial Sequence
  Synthetic oligonucleotide; CTC chr11 5283510 5283531 5283515 5283510 -
catctcaaaaaaaaaaaaagaa

SEQ ID NO: 133732 - DNA, 22 bp, Artificial Sequence
  Synthetic oligonucleotide; CTC chr11 5283504 5283525 5283509 5283504 -
aaaaaaaaaaaaagaagtttat

SEQ ID NO: 133733 - DNA, 22 bp, Artificial Sequence
  Synthetic oligonucleotide; TTT chr11 5283484 5283505 5283489 5283484 -
attatatgaattaacttagttt

SEQ ID NO: 133734 - DNA, 22 bp, Artificial Sequence
  Synthetic oligonucleotide; TTA chr11 5283483 5283504 5283488 5283483 -
ttatatgaattaacttagtttt

SEQ ID NO: 133735 - DNA, 22 bp, Artificial Sequence
  Synthetic oligonucleotide; TTA chr11 5283480 5283501 5283485 5283480 -
tatgaattaacttagttttact

SEQ ID NO: 133736 - DNA, 22 bp, Artificial Sequence
  Synthetic oligonucleotide; TTA chr11 5283471 5283492 5283476 5283471 -
acttagttttactcacaccaat

SEQ ID NO: 133737 - DNA, 22 bp, Artificial Sequence
  Synthetic oligonucleotide; CTT chr11 5283467 5283488 5283472 5283467 -
agttttactcacaccaatactc

SEQ ID NO: 133738 - DNA, 22 bp, Artificial Sequence
  Synthetic oligonucleotide; TTA chr11 5283466 5283487 5283471 5283466 -
gttttactcacaccaatactca

SEQ ID NO: 133739 - DNA, 22 bp, Artificial Sequence
  Synthetic oligonucleotide; TTT chr11 5283462 5283483 5283467 5283462 -
tactcacaccaatactcagaag

SEQ ID NO: 133740 - DNA, 22 bp, Artificial Sequence
  Synthetic oligonucleotide; TTT chr11 5283461 5283482 5283466 5283461 -
actcacaccaatactcagaagt

SEQ ID NO: 133741 - DNA, 22 bp, Artificial Sequence
  Synthetic oligonucleotide; TTA chr11 5283460 5283481 5283465 5283460 -
ctcacaccaatactcagaagta

SEQ ID NO: 133742 - DNA, 22 bp, Artificial Sequence
  Synthetic oligonucleotide; CTC chr11 5283457 5283478 5283462 5283457 -
acaccaatactcagaagtagat

SEQ ID NO: 133743 - DNA, 22 bp, Artificial Sequence
  Synthetic oligonucleotide; CTC chr11 5283445 5283466 5283450 5283445 -
agaagtagattattacctcatt

SEQ ID NO: 133744 - DNA, 22 bp, Artificial Sequence
  Synthetic oligonucleotide; TTA chr11 5283433 5283454 5283438 5283433 -
ttacctcatttattgatgagga

SEQ ID NO: 133745 - DNA, 22 bp, Artificial Sequence
  Synthetic oligonucleotide; TTA chr11 5283430 5283451 5283435 5283430 -
cctcatttattgatgaggagcc

SEQ ID NO: 133746 - DNA, 22 bp, Artificial Sequence
  Synthetic oligonucleotide; CTC chr11 5283426 5283447 5283431 5283426 -
atttattgatgaggagcccaat

SEQ ID NO: 133747 - DNA, 22 bp, Artificial Sequence
  Synthetic oligonucleotide; TTT chr11 5283422 5283443 5283427 5283422 -
attgatgaggagcccaatgtac

SEQ ID NO: 133748 - DNA, 22 bp, Artificial Sequence
  Synthetic oligonucleotide; TTA chr11 5283421 5283442 5283426 5283421 -
ttgatgaggagcccaatgtact

SEQ ID NO: 133749 - DNA, 22 bp, Artificial Sequence
  Synthetic oligonucleotide; TTG chr11 5283418 5283439 5283423 5283418 -
atgaggagcccaatgtacttgt

SEQ ID NO: 133750 - DNA, 22 bp, Artificial Sequence
  Synthetic oligonucleotide; CTT chr11 5283398 5283419 5283403 5283398 -
gtagtgtagatcaacttattga

SEQ ID NO: 133751 - DNA, 22 bp, Artificial Sequence
  Synthetic oligonucleotide; TTG chr11 5283397 5283418 5283402 5283397 -
tagtgtagatcaacttattgaa

SEQ ID NO: 133752 - DNA, 22 bp, Artificial Sequence
  Synthetic oligonucleotide; CTT chr11 5283381 5283402 5283386 5283381 -
attgaaagcacaagctaataag

SEQ ID NO: 133753 - DNA, 22 bp, Artificial Sequence
  Synthetic oligonucleotide; TTA chr11 5283380 5283401 5283385 5283380 -
ttgaaagcacaagctaataagt

SEQ ID NO: 133754 - DNA, 22 bp, Artificial Sequence
  Synthetic oligonucleotide; TTG chr11 5283377 5283398 5283382 5283377 -
aaagcacaagctaataagtaga

SEQ ID NO: 133755 - DNA, 22 bp, Artificial Sequence
  Synthetic oligonucleotide; CTA chr11 5283364 5283385 5283369 5283364 -
ataagtagacaattagtaatta

SEQ ID NO: 133756 - DNA, 22 bp, Artificial Sequence
  Synthetic oligonucleotide; TTA chr11 5283349 5283370 5283354 5283349 -
gtaattagaagtcagatggtct

SEQ ID NO: 133757 - DNA, 22 bp, Artificial Sequence
  Synthetic oligonucleotide; TTA chr11 5283342 5283363 5283347 5283342 -
gaagtcagatggtctgagctct

SEQ ID NO: 133758 - DNA, 22 bp, Artificial Sequence
  Synthetic oligonucleotide; CTG chr11 5283326 5283347 5283331 5283326 -
agctctcctactgtctacatta

SEQ ID NO: 133759 - DNA, 22 bp, Artificial Sequence
  Synthetic oligonucleotide; CTC chr11 5283321 5283342 5283326 5283321 -
tcctactgtctacattacatga

SEQ ID NO: 133760 - DNA, 22 bp, Artificial Sequence
  Synthetic oligonucleotide; CTC chr11 5283319 5283340 5283324 5283319 -
ctactgtctacattacatgagc

SEQ ID NO: 133761 - DNA, 22 bp, Artificial Sequence
  Synthetic oligonucleotide; CTA chr11 5283316 5283337 5283321 5283316 -
ctgtctacattacatgagctct

SEQ ID NO: 133762 - DNA, 22 bp, Artificial Sequence
  Synthetic oligonucleotide; CTG chr11 5283313 5283334 5283318 5283313 -
tctacattacatgagctcttat

SEQ ID NO: 133763 - DNA, 22 bp, Artificial Sequence
  Synthetic oligonucleotide; CTA chr11 5283309 5283330 5283314 5283309 -
cattacatgagctcttattaac

SEQ ID NO: 133764 - DNA, 22 bp, Artificial Sequence
  Synthetic oligonucleotide; TTA chr11 5283304 5283325 5283309 5283304 -
catgagctcttattaactgggg

SEQ ID NO: 133765 - DNA, 22 bp, Artificial Sequence
  Synthetic oligonucleotide; CTC chr11 5283295 5283316 5283300 5283295 -
ttattaactggggactcgaaaa

SEQ ID NO: 133766 - DNA, 22 bp, Artificial Sequence
  Synthetic oligonucleotide; CTT chr11 5283293 5283314 5283298 5283293 -
attaactggggactcgaaaatc

SEQ ID NO: 133767 - DNA, 22 bp, Artificial Sequence
  Synthetic oligonucleotide; TTA chr11 5283292 5283313 5283297 5283292 -
ttaactggggactcgaaaatca

SEQ ID NO: 133768 - DNA, 22 bp, Artificial Sequence
  Synthetic oligonucleotide; TTA chr11 5283289 5283310 5283294 5283289 -
actggggactcgaaaatcaaag

SEQ ID NO: 133769 - DNA, 22 bp, Artificial Sequence
  Synthetic oligonucleotide; CTG chr11 5283285 5283306 5283290 5283285 -
gggactcgaaaatcaaagacat

SEQ ID NO: 133770 - DNA, 22 bp, Artificial Sequence
  Synthetic oligonucleotide; CTC chr11 5283278 5283299 5283283 5283278 -
gaaaatcaaagacatgaaataa

SEQ ID NO: 133771 - DNA, 22 bp, Artificial Sequence
  Synthetic oligonucleotide; TTT chr11 5283253 5283274 5283258 5283253 -
gtccaagcttacagaaccacca

SEQ ID NO: 133772 - DNA, 22 bp, Artificial Sequence
  Synthetic oligonucleotide; TTG chr11 5283252 5283273 5283257 5283252 -
tccaagcttacagaaccaccaa

SEQ ID NO: 133773 - DNA, 22 bp, Artificial Sequence
  Synthetic oligonucleotide; CTT chr11 5283243 5283264 5283248 5283243 -
acagaaccaccaagtagtaagg

SEQ ID NO: 133774 - DNA, 22 bp, Artificial Sequence
  Synthetic oligonucleotide; TTA chr11 5283242 5283263 5283247 5283242 -
cagaaccaccaagtagtaaggc

SEQ ID NO: 133775 - DNA, 22 bp, Artificial Sequence
  Synthetic oligonucleotide; CTA chr11 5283218 5283239 5283223 5283218 -
ggatgtagacccagttctgcta

SEQ ID NO: 133776 - DNA, 22 bp, Artificial Sequence
  Synthetic oligonucleotide; TTC chr11 5283201 5283222 5283206 5283201 -
tgctacctctgaagacagtgtt

SEQ ID NO: 133777 - DNA, 22 bp, Artificial Sequence
  Synthetic oligonucleotide; CTG chr11 5283199 5283220 5283204 5283199 -
ctacctctgaagacagtgtttt

SEQ ID NO: 133778 - DNA, 22 bp, Artificial Sequence
  Synthetic oligonucleotide; CTA chr11 5283196 5283217 5283201 5283196 -
cctctgaagacagtgttttttc

SEQ ID NO: 133779 - DNA, 22 bp, Artificial Sequence
  Synthetic oligonucleotide; CTC chr11 5283192 5283213 5283197 5283192 -
tgaagacagtgttttttccaca

SEQ ID NO: 133780 - DNA, 22 bp, Artificial Sequence
  Synthetic oligonucleotide; CTG chr11 5283190 5283211 5283195 5283190 -
aagacagtgttttttccacagc

SEQ ID NO: 133781 - DNA, 22 bp, Artificial Sequence
  Synthetic oligonucleotide; TTT chr11 5283178 5283199 5283183 5283178 -
tttccacagcaaaacacaaact

SEQ ID NO: 133782 - DNA, 22 bp, Artificial Sequence
  Synthetic oligonucleotide; TTT chr11 5283177 5283198 5283182 5283177 -
ttccacagcaaaacacaaactc

SEQ ID NO: 133783 - DNA, 22 bp, Artificial Sequence
  Synthetic oligonucleotide; TTT chr11 5283176 5283197 5283181 5283176 -
tccacagcaaaacacaaactca

SEQ ID NO: 133784 - DNA, 22 bp, Artificial Sequence
  Synthetic oligonucleotide; TTT chr11 5283175 5283196 5283180 5283175 -
ccacagcaaaacacaaactcag

SEQ ID NO: 133785 - DNA, 22 bp, Artificial Sequence
  Synthetic oligonucleotide; TTC chr11 5283174 5283195 5283179 5283174 -
cacagcaaaacacaaactcaga

SEQ ID NO: 133786 - DNA, 22 bp, Artificial Sequence
  Synthetic oligonucleotide; CTC chr11 5283155 5283176 5283160 5283155 -
agatattgtggatgcgagaaat

SEQ ID NO: 133787 - DNA, 22 bp, Artificial Sequence
  Synthetic oligonucleotide; TTG chr11 5283147 5283168 5283152 5283147 -
tggatgcgagaaattagaagta

SEQ ID NO: 133788 - DNA, 22 bp, Artificial Sequence
  Synthetic oligonucleotide; TTA chr11 5283131 5283152 5283136 5283131 -
gaagtagatattcctgccctgt

SEQ ID NO: 133789 - DNA, 22 bp, Artificial Sequence
  Synthetic oligonucleotide; TTC chr11 5283118 5283139 5283123 5283118 -
ctgccctgtggcccttgcttct

SEQ ID NO: 133790 - DNA, 22 bp, Artificial Sequence
  Synthetic oligonucleotide; CTG chr11 5283115 5283136 5283120 5283115 -
ccctgtggcccttgcttcttac

SEQ ID NO: 133791 - DNA, 22 bp, Artificial Sequence
  Synthetic oligonucleotide; CTG chr11 5283110 5283131 5283115 5283110 -
tggcccttgcttcttactttta

SEQ ID NO: 133792 - DNA, 22 bp, Artificial Sequence
  Synthetic oligonucleotide; CTT chr11 5283102 5283123 5283107 5283102 -
gcttcttacttttacttcttgt

SEQ ID NO: 133793 - DNA, 22 bp, Artificial Sequence
  Synthetic oligonucleotide; TTG chr11 5283101 5283122 5283106 5283101 -
cttcttacttttacttcttgtc

SEQ ID NO: 133794 - DNA, 22 bp, Artificial Sequence
  Synthetic oligonucleotide; CTT chr11 5283098 5283119 5283103 5283098 -
cttacttttacttcttgtcgat

SEQ ID NO: 133795 - DNA, 22 bp, Artificial Sequence
  Synthetic oligonucleotide; TTC chr11 5283097 5283118 5283102 5283097 -
ttacttttacttcttgtcgatt

SEQ ID NO: 133796 - DNA, 22 bp, Artificial Sequence
  Synthetic oligonucleotide; CTT chr11 5283095 5283116 5283100 5283095 -
acttttacttcttgtcgattgg

SEQ ID NO: 133797 - DNA, 22 bp, Artificial Sequence
  Synthetic oligonucleotide; TTA chr11 5283094 5283115 5283099 5283094 -
cttttacttcttgtcgattgga

SEQ ID NO: 133798 - DNA, 22 bp, Artificial Sequence
  Synthetic oligonucleotide; CTT chr11 5283091 5283112 5283096 5283091 -
ttacttcttgtcgattggaagt

SEQ ID NO: 133799 - DNA, 22 bp, Artificial Sequence
  Synthetic oligonucleotide; TTT chr11 5283090 5283111 5283095 5283090 -
tacttcttgtcgattggaagtt

SEQ ID NO: 133800 - DNA, 22 bp, Artificial Sequence
  Synthetic oligonucleotide; TTT chr11 5283089 5283110 5283094 5283089 -
acttcttgtcgattggaagttg

SEQ ID NO: 133801 - DNA, 22 bp, Artificial Sequence
  Synthetic oligonucleotide; TTA chr11 5283088 5283109 5283093 5283088 -
cttcttgtcgattggaagttgt

SEQ ID NO: 133802 - DNA, 22 bp, Artificial Sequence
  Synthetic oligonucleotide; CTT chr11 5283085 5283106 5283090 5283085 -
cttgtcgattggaagttgtggt

SEQ ID NO: 133803 - DNA, 22 bp, Artificial Sequence
  Synthetic oligonucleotide; TTC chr11 5283084 5283105 5283089 5283084 -
ttgtcgattggaagttgtggtc

SEQ ID NO: 133804 - DNA, 22 bp, Artificial Sequence
  Synthetic oligonucleotide; CTT chr11 5283082 5283103 5283087 5283082 -
gtcgattggaagttgtggtcca

SEQ ID NO: 133805 - DNA, 22 bp, Artificial Sequence
  Synthetic oligonucleotide; TTG chr11 5283081 5283102 5283086 5283081 -
tcgattggaagttgtggtccaa

SEQ ID NO: 133806 - DNA, 22 bp, Artificial Sequence
  Synthetic oligonucleotide; TTG chr11 5283074 5283095 5283079 5283074 -
gaagttgtggtccaagccacag

SEQ ID NO: 133807 - DNA, 22 bp, Artificial Sequence
  Synthetic oligonucleotide; TTG chr11 5283067 5283088 5283072 5283067 -
tggtccaagccacagttgcaga

SEQ ID NO: 133808 - DNA, 22 bp, Artificial Sequence
  Synthetic oligonucleotide; TTG chr11 5283049 5283070 5283054 5283049 -
cagaccatacttcctcaaccat

SEQ ID NO: 133809 - DNA, 22 bp, Artificial Sequence
  Synthetic oligonucleotide; CTT chr11 5283037 5283058 5283042 5283037 -
cctcaaccataattgcatttct

SEQ ID NO: 133810 - DNA, 22 bp, Artificial Sequence
  Synthetic oligonucleotide; TTC chr11 5283036 5283057 5283041 5283036 -
ctcaaccataattgcatttctt

SEQ ID NO: 133811 - DNA, 22 bp, Artificial Sequence
  Synthetic oligonucleotide; CTC chr11 5283033 5283054 5283038 5283033 -
aaccataattgcatttcttcag

SEQ ID NO: 133812 - DNA, 22 bp, Artificial Sequence
  Synthetic oligonucleotide; TTG chr11 5283022 5283043 5283027 5283022 -
catttcttcaggaaagtttgag

SEQ ID NO: 133813 - DNA, 22 bp, Artificial Sequence
  Synthetic oligonucleotide; TTT chr11 5283017 5283038 5283022 5283017 -
cttcaggaaagtttgagggaga

SEQ ID NO: 133814 - DNA, 22 bp, Artificial Sequence
  Synthetic oligonucleotide; TTC chr11 5283016 5283037 5283021 5283016 -
ttcaggaaagtttgagggagaa

SEQ ID NO: 133815 - DNA, 22 bp, Artificial Sequence
  Synthetic oligonucleotide; CTT chr11 5283014 5283035 5283019 5283014 -
caggaaagtttgagggagaaaa

SEQ ID NO: 133816 - DNA, 22 bp, Artificial Sequence
  Synthetic oligonucleotide; TTC chr11 5283013 5283034 5283018 5283013 -
aggaaagtttgagggagaaaaa

SEQ ID NO: 133817 - DNA, 22 bp, Artificial Sequence
  Synthetic oligonucleotide; TTT chr11 5283003 5283024 5283008 5283003 -
gagggagaaaaaggtaaagaaa

SEQ ID NO: 133818 - DNA, 22 bp, Artificial Sequence
  Synthetic oligonucleotide; TTG chr11 5283002 5283023 5283007 5283002 -
agggagaaaaaggtaaagaaaa

SEQ ID NO: 133819 - DNA, 22 bp, Artificial Sequence
  Synthetic oligonucleotide; TTT chr11 5282976 5282997 5282981 5282976 -
agaaacaacttcagaataaaga

SEQ ID NO: 133820 - DNA, 22 bp, Artificial Sequence
  Synthetic oligonucleotide; TTA chr11 5282975 5282996 5282980 5282975 -
gaaacaacttcagaataaagag

SEQ ID NO: 133821 - DNA, 22 bp, Artificial Sequence
  Synthetic oligonucleotide; CTT chr11 5282965 5282986 5282970 5282965 -
cagaataaagagattttctctt

SEQ ID NO: 133822 - DNA, 22 bp, Artificial Sequence
  Synthetic oligonucleotide; TTC chr11 5282964 5282985 5282969 5282964 -
agaataaagagattttctcttg

SEQ ID NO: 133823 - DNA, 22 bp, Artificial Sequence
  Synthetic oligonucleotide; TTT chr11 5282949 5282970 5282954 5282949 -
tctcttgggttacagagattgt

SEQ ID NO: 133824 - DNA, 22 bp, Artificial Sequence
  Synthetic oligonucleotide; TTT chr11 5282948 5282969 5282953 5282948 -
ctcttgggttacagagattgtc

SEQ ID NO: 133825 - DNA, 22 bp, Artificial Sequence
  Synthetic oligonucleotide; TTC chr11 5282947 5282968 5282952 5282947 -
tcttgggttacagagattgtca

SEQ ID NO: 133826 - DNA, 22 bp, Artificial Sequence
  Synthetic oligonucleotide; CTC chr11 5282945 5282966 5282950 5282945 -
ttgggttacagagattgtcata

SEQ ID NO: 133827 - DNA, 22 bp, Artificial Sequence
  Synthetic oligonucleotide; CTT chr11 5282943 5282964 5282948 5282943 -
gggttacagagattgtcatatg

SEQ ID NO: 133828 - DNA, 22 bp, Artificial Sequence
  Synthetic oligonucleotide; TTG chr11 5282942 5282963 5282947 5282942 -
ggttacagagattgtcatatga

SEQ ID NO: 133829 - DNA, 22 bp, Artificial Sequence
  Synthetic oligonucleotide; TTA chr11 5282937 5282958 5282942 5282937 -
cagagattgtcatatgacaaat

SEQ ID NO: 133830 - DNA, 22 bp, Artificial Sequence
  Synthetic oligonucleotide; TTG chr11 5282928 5282949 5282933 5282928 -
tcatatgacaaattataagcag

SEQ ID NO: 133831 - DNA, 22 bp, Artificial Sequence
  Synthetic oligonucleotide; TTA chr11 5282913 5282934 5282918 5282913 -
taagcagacacttgagaaaact

SEQ ID NO: 133832 - DNA, 22 bp, Artificial Sequence
  Synthetic oligonucleotide; CTT chr11 5282900 5282921 5282905 5282900 -
gagaaaactgaaggcccatgcc

SEQ ID NO: 133833 - DNA, 22 bp, Artificial Sequence
  Synthetic oligonucleotide; TTG chr11 5282899 5282920 5282904 5282899 -
agaaaactgaaggcccatgcct

SEQ ID NO: 133834 - DNA, 22 bp, Artificial Sequence
  Synthetic oligonucleotide; CTG chr11 5282890 5282911 5282895 5282890 -
aaggcccatgcctgcccaaatt

SEQ ID NO: 133835 - DNA, 22 bp, Artificial Sequence
  Synthetic oligonucleotide; CTG chr11 5282876 5282897 5282881 5282876 -
cccaaattaccctttgacccct

SEQ ID NO: 133836 - DNA, 22 bp, Artificial Sequence
  Synthetic oligonucleotide; TTA chr11 5282867 5282888 5282872 5282867 -
ccctttgaccccttggtcaagc

SEQ ID NO: 133837 - DNA, 22 bp, Artificial Sequence
  Synthetic oligonucleotide; CTT chr11 5282862 5282883 5282867 5282862 -
tgaccccttggtcaagctgcaa

SEQ ID NO: 133838 - DNA, 22 bp, Artificial Sequence
  Synthetic oligonucleotide; TTT chr11 5282861 5282882 5282866 5282861 -
gaccccttggtcaagctgcaac

SEQ ID NO: 133839 - DNA, 22 bp, Artificial Sequence
  Synthetic oligonucleotide; TTG chr11 5282860 5282881 5282865 5282860 -
accccttggtcaagctgcaact

SEQ ID NO: 133840 - DNA, 22 bp, Artificial Sequence
  Synthetic oligonucleotide; CTT chr11 5282853 5282874 5282858 5282853 -
ggtcaagctgcaactttggtta

SEQ ID NO: 133841 - DNA, 22 bp, Artificial Sequence
  Synthetic oligonucleotide; TTG chr11 5282852 5282873 5282857 5282852 -
gtcaagctgcaactttggttaa

SEQ ID NO: 133842 - DNA, 22 bp, Artificial Sequence
  Synthetic oligonucleotide; CTG chr11 5282843 5282864 5282848 5282843 -
caactttggttaaagggagtgt

SEQ ID NO: 133843 - DNA, 22 bp, Artificial Sequence
  Synthetic oligonucleotide; CTT chr11 5282837 5282858 5282842 5282837 -
tggttaaagggagtgtttatgt

SEQ ID NO: 133844 - DNA, 22 bp, Artificial Sequence
  Synthetic oligonucleotide; TTT chr11 5282836 5282857 5282841 5282836 -
ggttaaagggagtgtttatgtg

SEQ ID NO: 133845 - DNA, 22 bp, Artificial Sequence
  Synthetic oligonucleotide; TTG chr11 5282835 5282856 5282840 5282835 -
gttaaagggagtgtttatgtgt

SEQ ID NO: 133846 - DNA, 22 bp, Artificial Sequence
  Synthetic oligonucleotide; TTA chr11 5282831 5282852 5282836 5282831 -
aagggagtgtttatgtgttata

SEQ ID NO: 133847 - DNA, 22 bp, Artificial Sequence
  Synthetic oligonucleotide; TTT chr11 5282819 5282840 5282824 5282819 -
atgtgttatagtgttcatttac

SEQ ID NO: 133848 - DNA, 22 bp, Artificial Sequence
  Synthetic oligonucleotide; TTA chr11 5282818 5282839 5282823 5282818 -
tgtgttatagtgttcatttact

SEQ ID NO: 133849 - DNA, 22 bp, Artificial Sequence
  Synthetic oligonucleotide; TTA chr11 5282811 5282832 5282816 5282811 -
tagtgttcatttactcttctgg

SEQ ID NO: 133850 - DNA, 22 bp, Artificial Sequence
  Synthetic oligonucleotide; TTC chr11 5282803 5282824 5282808 5282803 -
atttactcttctggtctaaccc

SEQ ID NO: 133851 - DNA, 22 bp, Artificial Sequence
  Synthetic oligonucleotide; TTT chr11 5282799 5282820 5282804 5282799 -
actcttctggtctaacccattg

SEQ ID NO: 133852 - DNA, 22 bp, Artificial Sequence
  Synthetic oligonucleotide; TTA chr11 5282798 5282819 5282803 5282798 -
ctcttctggtctaacccattgg

SEQ ID NO: 133853 - DNA, 22 bp, Artificial Sequence
  Synthetic oligonucleotide; CTC chr11 5282795 5282816 5282800 5282795 -
ttctggtctaacccattggctc

SEQ ID NO: 133854 - DNA, 22 bp, Artificial Sequence
  Synthetic oligonucleotide; CTT chr11 5282793 5282814 5282798 5282793 -
ctggtctaacccattggctccg

SEQ ID NO: 133855 - DNA, 22 bp, Artificial Sequence
  Synthetic oligonucleotide; TTC chr11 5282792 5282813 5282797 5282792 -
tggtctaacccattggctccgt

SEQ ID NO: 133856 - DNA, 22 bp, Artificial Sequence
  Synthetic oligonucleotide; CTG chr11 5282790 5282811 5282795 5282790 -
gtctaacccattggctccgtct

SEQ ID NO: 133857 - DNA, 22 bp, Artificial Sequence
  Synthetic oligonucleotide; CTA chr11 5282785 5282806 5282790 5282785 -
acccattggctccgtcttcatc

SEQ ID NO: 133858 - DNA, 22 bp, Artificial Sequence
  Synthetic oligonucleotide; TTG chr11 5282777 5282798 5282782 5282777 -
gctccgtcttcatcctgcagtg

SEQ ID NO: 133859 - DNA, 22 bp, Artificial Sequence
  Synthetic oligonucleotide; CTC chr11 5282773 5282794 5282778 5282773 -
cgtcttcatcctgcagtgacct

SEQ ID NO: 133860 - DNA, 22 bp, Artificial Sequence
  Synthetic oligonucleotide; CTT chr11 5282767 5282788 5282772 5282767 -
catcctgcagtgacctcagtgc

SEQ ID NO: 133861 - DNA, 22 bp, Artificial Sequence
  Synthetic oligonucleotide; TTC chr11 5282766 5282787 5282771 5282766 -
atcctgcagtgacctcagtgcc

SEQ ID NO: 133862 - DNA, 22 bp, Artificial Sequence
  Synthetic oligonucleotide; CTG chr11 5282760 5282781 5282765 5282760 -
cagtgacctcagtgcctcagaa

SEQ ID NO: 133863 - DNA, 22 bp, Artificial Sequence
  Synthetic oligonucleotide; CTC chr11 5282750 5282771 5282755 5282750 -
agtgcctcagaaacatacatat

SEQ ID NO: 133864 - DNA, 22 bp, Artificial Sequence
  Synthetic oligonucleotide; CTC chr11 5282742 5282763 5282747 5282742 -
agaaacatacatatgtttgtct

SEQ ID NO: 133865 - DNA, 22 bp, Artificial Sequence
  Synthetic oligonucleotide; TTT chr11 5282724 5282745 5282729 5282724 -
gtctagtttaagtttgtgtgaa

SEQ ID NO: 133866 - DNA, 22 bp, Artificial Sequence
  Synthetic oligonucleotide; TTG chr11 5282723 5282744 5282728 5282723 -
tctagtttaagtttgtgtgaaa

SEQ ID NO: 133867 - DNA, 22 bp, Artificial Sequence
  Synthetic oligonucleotide; CTA chr11 5282719 5282740 5282724 5282719 -
gtttaagtttgtgtgaaattct

SEQ ID NO: 133868 - DNA, 22 bp, Artificial Sequence
  Synthetic oligonucleotide; TTT chr11 5282715 5282736 5282720 5282715 -
aagtttgtgtgaaattctaact

SEQ ID NO: 133869 - DNA, 22 bp, Artificial Sequence
  Synthetic oligonucleotide; TTA chr11 5282714 5282735 5282719 5282714 -
agtttgtgtgaaattctaacta

SEQ ID NO: 133870 - DNA, 22 bp, Artificial Sequence
  Synthetic oligonucleotide; TTT chr11 5282709 5282730 5282714 5282709 -
gtgtgaaattctaactagcgtc

SEQ ID NO: 133871 - DNA, 22 bp, Artificial Sequence
  Synthetic oligonucleotide; TTG chr11 5282708 5282729 5282713 5282708 -
tgtgaaattctaactagcgtca

SEQ ID NO: 133872 - DNA, 22 bp, Artificial Sequence
  Synthetic oligonucleotide; TTC chr11 5282698 5282719 5282703 5282698 -
taactagcgtcaagaactgagg

SEQ ID NO: 133873 - DNA, 22 bp, Artificial Sequence
  Synthetic oligonucleotide; CTA chr11 5282696 5282717 5282701 5282696 -
actagcgtcaagaactgagggc

SEQ ID NO: 133874 - DNA, 22 bp, Artificial Sequence
  Synthetic oligonucleotide; CTA chr11 5282692 5282713 5282697 5282692 -
gcgtcaagaactgagggcccta

SEQ ID NO: 133875 - DNA, 22 bp, Artificial Sequence
  Synthetic oligonucleotide; CTG chr11 5282679 5282700 5282684 5282679 -
agggccctaaactatgctagga

SEQ ID NO: 133876 - DNA, 22 bp, Artificial Sequence
  Synthetic oligonucleotide; CTA chr11 5282670 5282691 5282675 5282670 -
aactatgctaggaatagtgctg

SEQ ID NO: 133877 - DNA, 22 bp, Artificial Sequence
  Synthetic oligonucleotide; CTA chr11 5282665 5282686 5282670 5282665 -
tgctaggaatagtgctgtggtg

SEQ ID NO: 133878 - DNA, 22 bp, Artificial Sequence
  Synthetic oligonucleotide; CTA chr11 5282660 5282681 5282665 5282660 -
ggaatagtgctgtggtgctgtg

SEQ ID NO: 133879 - DNA, 22 bp, Artificial Sequence
  Synthetic oligonucleotide; CTG chr11 5282648 5282669 5282653 5282648 -
tggtgctgtgataggtacacaa

SEQ ID NO: 133880 - DNA, 22 bp, Artificial Sequence
  Synthetic oligonucleotide; CTG chr11 5282640 5282661 5282645 5282640 -
tgataggtacacaagaaatgag

SEQ ID NO: 133881 - DNA, 22 bp, Artificial Sequence
  Synthetic oligonucleotide; CTG chr11 5282609 5282630 5282614 5282609 -
cagattctctgcatctcccttt

SEQ ID NO: 133882 - DNA, 22 bp, Artificial Sequence
  Synthetic oligonucleotide; TTC chr11 5282602 5282623 5282607 5282602 -
tctgcatctccctttgccgggt

SEQ ID NO: 133883 - DNA, 22 bp, Artificial Sequence
  Synthetic oligonucleotide; CTC chr11 5282600 5282621 5282605 5282600 -
tgcatctccctttgccgggtct

SEQ ID NO: 133884 - DNA, 22 bp, Artificial Sequence
  Synthetic oligonucleotide; CTG chr11 5282598 5282619 5282603 5282598 -
catctccctttgccgggtctga

SEQ ID NO: 133885 - DNA, 22 bp, Artificial Sequence
  Synthetic oligonucleotide; CTC chr11 5282592 5282613 5282597 5282592 -
cctttgccgggtctgacaacaa

SEQ ID NO: 133886 - DNA, 22 bp, Artificial Sequence
  Synthetic oligonucleotide; CTT chr11 5282588 5282609 5282593 5282588 -
tgccgggtctgacaacaaagtt

SEQ ID NO: 133887 - DNA, 22 bp, Artificial Sequence
  Synthetic oligonucleotide; TTT chr11 5282587 5282608 5282592 5282587 -
gccgggtctgacaacaaagttt

SEQ ID NO: 133888 - DNA, 22 bp, Artificial Sequence
  Synthetic oligonucleotide; TTG chr11 5282586 5282607 5282591 5282586 -
ccgggtctgacaacaaagtttc

SEQ ID NO: 133889 - DNA, 22 bp, Artificial Sequence
  Synthetic oligonucleotide; CTG chr11 5282577 5282598 5282582 5282577 -
acaacaaagtttccccaaattt

SEQ ID NO: 133890 - DNA, 22 bp, Artificial Sequence
  Synthetic oligonucleotide; TTT chr11 5282565 5282586 5282570 5282565 -
ccccaaattttaccaatgcaag

SEQ ID NO: 133891 - DNA, 22 bp, Artificial Sequence
  Synthetic oligonucleotide; TTC chr11 5282564 5282585 5282569 5282564 -
cccaaattttaccaatgcaagc

SEQ ID NO: 133892 - DNA, 22 bp, Artificial Sequence
  Synthetic oligonucleotide; TTT chr11 5282555 5282576 5282560 5282555 -
taccaatgcaagccatttctcc

SEQ ID NO: 133893 - DNA, 22 bp, Artificial Sequence
  Synthetic oligonucleotide; TTT chr11 5282554 5282575 5282559 5282554 -
accaatgcaagccatttctcca

SEQ ID NO: 133894 - DNA, 22 bp, Artificial Sequence
  Synthetic oligonucleotide; TTA chr11 5282553 5282574 5282558 5282553 -
ccaatgcaagccatttctccat

SEQ ID NO: 133895 - DNA, 22 bp, Artificial Sequence
  Synthetic oligonucleotide; TTT chr11 5282537 5282558 5282542 5282537 -
ctccatatgctaactactttaa

SEQ ID NO: 133896 - DNA, 22 bp, Artificial Sequence
  Synthetic oligonucleotide; TTC chr11 5282536 5282557 5282541 5282536 -
tccatatgctaactactttaaa

SEQ ID NO: 133897 - DNA, 22 bp, Artificial Sequence
  Synthetic oligonucleotide; CTC chr11 5282534 5282555 5282539 5282534 -
catatgctaactactttaaaat

SEQ ID NO: 133898 - DNA, 22 bp, Artificial Sequence
  Synthetic oligonucleotide; CTA chr11 5282525 5282546 5282530 5282525 -
actactttaaaatcatttgggg

SEQ ID NO: 133899 - DNA, 22 bp, Artificial Sequence
  Synthetic oligonucleotide; CTA chr11 5282521 5282542 5282526 5282521 -
ctttaaaatcatttggggcttc

SEQ ID NO: 133900 - DNA, 22 bp, Artificial Sequence
  Synthetic oligonucleotide; CTT chr11 5282518 5282539 5282523 5282518 -
taaaatcatttggggcttcaca

SEQ ID NO: 133901 - DNA, 22 bp, Artificial Sequence
  Synthetic oligonucleotide; TTT chr11 5282517 5282538 5282522 5282517 -
aaaatcatttggggcttcacat

SEQ ID NO: 133902 - DNA, 22 bp, Artificial Sequence
  Synthetic oligonucleotide; TTA chr11 5282516 5282537 5282521 5282516 -
aaatcatttggggcttcacatt

SEQ ID NO: 133903 - DNA, 22 bp, Artificial Sequence
  Synthetic oligonucleotide; TTT chr11 5282507 5282528 5282512 5282507 -
ggggcttcacattgtctttctc

SEQ ID NO: 133904 - DNA, 22 bp, Artificial Sequence
  Synthetic oligonucleotide; TTG chr11 5282506 5282527 5282511 5282506 -
gggcttcacattgtctttctca

SEQ ID NO: 133905 - DNA, 22 bp, Artificial Sequence
  Synthetic oligonucleotide; CTT chr11 5282500 5282521 5282505 5282500 -
cacattgtctttctcatctgta

SEQ ID NO: 133906 - DNA, 22 bp, Artificial Sequence
  Synthetic oligonucleotide; TTC chr11 5282499 5282520 5282504 5282499 -
acattgtctttctcatctgtaa

SEQ ID NO: 133907 - DNA, 22 bp, Artificial Sequence
  Synthetic oligonucleotide; TTG chr11 5282493 5282514 5282498 5282493 -
tctttctcatctgtaaaaagaa

SEQ ID NO: 133908 - DNA, 22 bp, Artificial Sequence
  Synthetic oligonucleotide; CTT chr11 5282489 5282510 5282494 5282489 -
tctcatctgtaaaaagaatgga

SEQ ID NO: 133909 - DNA, 22 bp, Artificial Sequence
  Synthetic oligonucleotide; TTT chr11 5282488 5282509 5282493 5282488 -
ctcatctgtaaaaagaatggaa

SEQ ID NO: 133910 - DNA, 22 bp, Artificial Sequence
  Synthetic oligonucleotide; TTC chr11 5282487 5282508 5282492 5282487 -
tcatctgtaaaaagaatggaag

SEQ ID NO: 133911 - DNA, 22 bp, Artificial Sequence
  Synthetic oligonucleotide; CTC chr11 5282485 5282506 5282490 5282485 -
atctgtaaaaagaatggaagaa

SEQ ID NO: 133912 - DNA, 22 bp, Artificial Sequence
  Synthetic oligonucleotide; CTG chr11 5282480 5282501 5282485 5282480 -
taaaaagaatggaagaactcat

SEQ ID NO: 133913 - DNA, 22 bp, Artificial Sequence
  Synthetic oligonucleotide; CTC chr11 5282460 5282481 5282465 5282460 -
attcctacagaactccctatgt

SEQ ID NO: 133914 - DNA, 22 bp, Artificial Sequence
  Synthetic oligonucleotide; TTC chr11 5282456 5282477 5282461 5282456 -
ctacagaactccctatgtcttc

SEQ ID NO: 133915 - DNA, 22 bp, Artificial Sequence
  Synthetic oligonucleotide; CTA chr11 5282453 5282474 5282458 5282453 -
cagaactccctatgtcttccct

SEQ ID NO: 133916 - DNA, 22 bp, Artificial Sequence
  Synthetic oligonucleotide; CTC chr11 5282445 5282466 5282450 5282445 -
cctatgtcttccctgatgggct

SEQ ID NO: 133917 - DNA, 22 bp, Artificial Sequence
  Synthetic oligonucleotide; CTA chr11 5282441 5282462 5282446 5282441 -
tgtcttccctgatgggctagag

SEQ ID NO: 133918 - DNA, 22 bp, Artificial Sequence
  Synthetic oligonucleotide; CTT chr11 5282435 5282456 5282440 5282435 -
ccctgatgggctagagttcctc

SEQ ID NO: 133919 - DNA, 22 bp, Artificial Sequence
  Synthetic oligonucleotide; TTC chr11 5282434 5282455 5282439 5282434 -
cctgatgggctagagttcctct

SEQ ID NO: 133920 - DNA, 22 bp, Artificial Sequence
  Synthetic oligonucleotide; CTG chr11 5282430 5282451 5282435 5282430 -
atgggctagagttcctctttct

SEQ ID NO: 133921 - DNA, 22 bp, Artificial Sequence
  Synthetic oligonucleotide; CTA chr11 5282422 5282443 5282427 5282422 -
gagttcctctttctcaaaaatt

SEQ ID NO: 133922 - DNA, 22 bp, Artificial Sequence
  Synthetic oligonucleotide; TTC chr11 5282416 5282437 5282421 5282416 -
ctctttctcaaaaattagccat

SEQ ID NO: 133923 - DNA, 22 bp, Artificial Sequence
  Synthetic oligonucleotide; CTC chr11 5282413 5282434 5282418 5282413 -
tttctcaaaaattagccattat

SEQ ID NO: 133924 - DNA, 22 bp, Artificial Sequence
  Synthetic oligonucleotide; CTT chr11 5282411 5282432 5282416 5282411 -
tctcaaaaattagccattattg

SEQ ID NO: 133925 - DNA, 22 bp, Artificial Sequence
  Synthetic oligonucleotide; TTT chr11 5282410 5282431 5282415 5282410 -
ctcaaaaattagccattattgt

SEQ ID NO: 133926 - DNA, 22 bp, Artificial Sequence
  Synthetic oligonucleotide; TTC chr11 5282409 5282430 5282414 5282409 -
tcaaaaattagccattattgta

SEQ ID NO: 133927 - DNA, 22 bp, Artificial Sequence
  Synthetic oligonucleotide; CTC chr11 5282407 5282428 5282412 5282407 -
aaaaattagccattattgtatt

SEQ ID NO: 133928 - DNA, 22 bp, Artificial Sequence
  Synthetic oligonucleotide; TTA chr11 5282399 5282420 5282404 5282399 -
gccattattgtatttccttcta

SEQ ID NO: 133929 - DNA, 22 bp, Artificial Sequence
  Synthetic oligonucleotide; TTA chr11 5282392 5282413 5282397 5282392 -
ttgtatttccttctaagccaaa

SEQ ID NO: 133930 - DNA, 22 bp, Artificial Sequence
  Synthetic oligonucleotide; TTG chr11 5282389 5282410 5282394 5282389 -
tatttccttctaagccaaagct

SEQ ID NO: 133931 - DNA, 22 bp, Artificial Sequence
  Synthetic oligonucleotide; TTT chr11 5282384 5282405 5282389 5282384 -
ccttctaagccaaagctcagag

SEQ ID NO: 133932 - DNA, 22 bp, Artificial Sequence
  Synthetic oligonucleotide; TTC chr11 5282383 5282404 5282388 5282383 -
cttctaagccaaagctcagagg

SEQ ID NO: 133933 - DNA, 22 bp, Artificial Sequence
  Synthetic oligonucleotide; CTT chr11 5282380 5282401 5282385 5282380 -
ctaagccaaagctcagaggtct

SEQ ID NO: 133934 - DNA, 22 bp, Artificial Sequence
  Synthetic oligonucleotide; TTC chr11 5282379 5282400 5282384 5282379 -
taagccaaagctcagaggtctt

SEQ ID NO: 133935 - DNA, 22 bp, Artificial Sequence
  Synthetic oligonucleotide; CTA chr11 5282377 5282398 5282382 5282377 -
agccaaagctcagaggtcttgt

SEQ ID NO: 133936 - DNA, 22 bp, Artificial Sequence
  Synthetic oligonucleotide; CTC chr11 5282366 5282387 5282371 5282366 -
agaggtcttgtattgcccagtg

SEQ ID NO: 133937 - DNA, 22 bp, Artificial Sequence
  Synthetic oligonucleotide; CTT chr11 5282357 5282378 5282362 5282357 -
gtattgcccagtgacatgcaca

SEQ ID NO: 133938 - DNA, 22 bp, Artificial Sequence
  Synthetic oligonucleotide; TTG chr11 5282356 5282377 5282361 5282356 -
tattgcccagtgacatgcacac

SEQ ID NO: 133939 - DNA, 22 bp, Artificial Sequence
  Synthetic oligonucleotide; TTG chr11 5282351 5282372 5282356 5282351 -
cccagtgacatgcacactggtc

SEQ ID NO: 133940 - DNA, 22 bp, Artificial Sequence
  Synthetic oligonucleotide; CTG chr11 5282332 5282353 5282337 5282332 -
gtcaaaagtaggctaagtagaa

SEQ ID NO: 133941 - DNA, 22 bp, Artificial Sequence
  Synthetic oligonucleotide; CTA chr11 5282317 5282338 5282322 5282317 -
agtagaagggtactttcacagg

SEQ ID NO: 133942 - DNA, 22 bp, Artificial Sequence
  Synthetic oligonucleotide; CTT chr11 5282302 5282323 5282307 5282302 -
tcacaggaacagagagcaaaag

SEQ ID NO: 133943 - DNA, 22 bp, Artificial Sequence
  Synthetic oligonucleotide; TTT chr11 5282301 5282322 5282306 5282301 -
cacaggaacagagagcaaaaga

SEQ ID NO: 133944 - DNA, 22 bp, Artificial Sequence
  Synthetic oligonucleotide; TTC chr11 5282300 5282321 5282305 5282300 -
acaggaacagagagcaaaagag

SEQ ID NO: 133945 - DNA, 22 bp, Artificial Sequence
  Synthetic oligonucleotide; TTA chr11 5282233 5282254 5282238 5282233 -
caacatgatggcttgttgtcta

SEQ ID NO: 133946 - DNA, 22 bp, Artificial Sequence
  Synthetic oligonucleotide; CTT chr11 5282219 5282240 5282224 5282219 -
gttgtctaaatatctcctaggg

SEQ ID NO: 133947 - DNA, 22 bp, Artificial Sequence
  Synthetic oligonucleotide; TTG chr11 5282218 5282239 5282223 5282218 -
ttgtctaaatatctcctaggga

SEQ ID NO: 133948 - DNA, 22 bp, Artificial Sequence
  Synthetic oligonucleotide; TTG chr11 5282215 5282236 5282220 5282215 -
tctaaatatctcctagggaatt

SEQ ID NO: 133949 - DNA, 22 bp, Artificial Sequence
  Synthetic oligonucleotide; CTA chr11 5282211 5282232 5282216 5282211 -
aatatctcctagggaattattg

SEQ ID NO: 133950 - DNA, 22 bp, Artificial Sequence
  Synthetic oligonucleotide; CTC chr11 5282203 5282224 5282208 5282203 -
ctagggaattattgtgagaggt

SEQ ID NO: 133951 - DNA, 22 bp, Artificial Sequence
  Synthetic oligonucleotide; CTA chr11 5282200 5282221 5282205 5282200 -
gggaattattgtgagaggtctg

SEQ ID NO: 133952 - DNA, 22 bp, Artificial Sequence
  Synthetic oligonucleotide; TTA chr11 5282192 5282213 5282197 5282192 -
ttgtgagaggtctgaatagtgt

SEQ ID NO: 133953 - DNA, 22 bp, Artificial Sequence
  Synthetic oligonucleotide; TTG chr11 5282189 5282210 5282194 5282189 -
tgagaggtctgaatagtgttgt

SEQ ID NO: 133954 - DNA, 22 bp, Artificial Sequence
  Synthetic oligonucleotide; CTG chr11 5282178 5282199 5282183 5282178 -
aatagtgttgtaaaataagctg

SEQ ID NO: 133955 - DNA, 22 bp, Artificial Sequence
  Synthetic oligonucleotide; TTG chr11 5282168 5282189 5282173 5282168 -
taaaataagctgaatctgctgc

SEQ ID NO: 133956 - DNA, 22 bp, Artificial Sequence
  Synthetic oligonucleotide; CTG chr11 5282156 5282177 5282161 5282156 -
aatctgctgccaacattaacag

SEQ ID NO: 133957 - DNA, 22 bp, Artificial Sequence
  Synthetic oligonucleotide; CTG chr11 5282150 5282171 5282155 5282150 -
ctgccaacattaacagtcaaga

SEQ ID NO: 133958 - DNA, 22 bp, Artificial Sequence
  Synthetic oligonucleotide; CTG chr11 5282147 5282168 5282152 5282147 -
ccaacattaacagtcaagaaat

SEQ ID NO: 133959 - DNA, 22 bp, Artificial Sequence
  Synthetic oligonucleotide; TTA chr11 5282138 5282159 5282143 5282138 -
acagtcaagaaatacctccgaa

SEQ ID NO: 133960 - DNA, 22 bp, Artificial Sequence
  Synthetic oligonucleotide; CTC chr11 5282120 5282141 5282125 5282120 -
cgaataactgtacctccaatta

SEQ ID NO: 133961 - DNA, 22 bp, Artificial Sequence
  Synthetic oligonucleotide; CTG chr11 5282110 5282131 5282115 5282110 -
tacctccaattattctttaagg

SEQ ID NO: 133962 - DNA, 22 bp, Artificial Sequence
  Synthetic oligonucleotide; CTC chr11 5282104 5282125 5282109 5282104 -
caattattctttaaggtagcat

SEQ ID NO: 133963 - DNA, 22 bp, Artificial Sequence
  Synthetic oligonucleotide; TTA chr11 5282098 5282119 5282103 5282098 -
ttctttaaggtagcatgcaact

SEQ ID NO: 133964 - DNA, 22 bp, Artificial Sequence
  Synthetic oligonucleotide; TTC chr11 5282095 5282116 5282100 5282095 -
tttaaggtagcatgcaactgta

SEQ ID NO: 133965 - DNA, 22 bp, Artificial Sequence
  Synthetic oligonucleotide; CTT chr11 5282093 5282114 5282098 5282093 -
taaggtagcatgcaactgtaat

SEQ ID NO: 133966 - DNA, 22 bp, Artificial Sequence
  Synthetic oligonucleotide; TTT chr11 5282092 5282113 5282097 5282092 -
aaggtagcatgcaactgtaata

SEQ ID NO: 133967 - DNA, 22 bp, Artificial Sequence
  Synthetic oligonucleotide; TTA chr11 5282091 5282112 5282096 5282091 -
aggtagcatgcaactgtaatag

SEQ ID NO: 133968 - DNA, 22 bp, Artificial Sequence
  Synthetic oligonucleotide; CTG chr11 5282075 5282096 5282080 5282075 -
taatagttgcatgtatatattt

SEQ ID NO: 133969 - DNA, 22 bp, Artificial Sequence
  Synthetic oligonucleotide; TTG chr11 5282066 5282087 5282071 5282066 -
catgtatatatttatcataata

SEQ ID NO: 133970 - DNA, 22 bp, Artificial Sequence
  Synthetic oligonucleotide; TTT chr11 5282053 5282074 5282058 5282053 -
atcataatactgtaacagaaaa

SEQ ID NO: 133971 - DNA, 22 bp, Artificial Sequence
  Synthetic oligonucleotide; TTA chr11 5282052 5282073 5282057 5282052 -
tcataatactgtaacagaaaac

SEQ ID NO: 133972 - DNA, 22 bp, Artificial Sequence
  Synthetic oligonucleotide; CTG chr11 5282041 5282062 5282046 5282041 -
taacagaaaacacttactgaat

SEQ ID NO: 133973 - DNA, 22 bp, Artificial Sequence
  Synthetic oligonucleotide; CTT chr11 5282026 5282047 5282031 5282026 -
actgaatatatactgtgtccct

SEQ ID NO: 133974 - DNA, 22 bp, Artificial Sequence
  Synthetic oligonucleotide; TTA chr11 5282025 5282046 5282030 5282025 -
ctgaatatatactgtgtcccta

SEQ ID NO: 133975 - DNA, 22 bp, Artificial Sequence
  Synthetic oligonucleotide; CTG chr11 5282022 5282043 5282027 5282022 -
aatatatactgtgtccctagtt

SEQ ID NO: 133976 - DNA, 22 bp, Artificial Sequence
  Synthetic oligonucleotide; CTG chr11 5282011 5282032 5282016 5282011 -
tgtccctagttctttacacaat

SEQ ID NO: 133977 - DNA, 22 bp, Artificial Sequence
  Synthetic oligonucleotide; CTA chr11 5282003 5282024 5282008 5282003 -
gttctttacacaataaactaat

SEQ ID NO: 133978 - DNA, 22 bp, Artificial Sequence
  Synthetic oligonucleotide; TTC chr11 5281999 5282020 5282004 5281999 -
tttacacaataaactaatctca

SEQ ID NO: 133979 - DNA, 22 bp, Artificial Sequence
  Synthetic oligonucleotide; CTT chr11 5281997 5282018 5282002 5281997 -
tacacaataaactaatctcatc

SEQ ID NO: 133980 - DNA, 22 bp, Artificial Sequence
  Synthetic oligonucleotide; TTT chr11 5281996 5282017 5282001 5281996 -
acacaataaactaatctcatcc

SEQ ID NO: 133981 - DNA, 22 bp, Artificial Sequence
  Synthetic oligonucleotide; TTA chr11 5281995 5282016 5282000 5281995 -
cacaataaactaatctcatcct

SEQ ID NO: 133982 - DNA, 22 bp, Artificial Sequence
  Synthetic oligonucleotide; CTA chr11 5281983 5282004 5281988 5281983 -
atctcatcctcataattctatt

SEQ ID NO: 133983 - DNA, 22 bp, Artificial Sequence
  Synthetic oligonucleotide; CTC chr11 5281978 5281999 5281983 5281978 -
atcctcataattctattagcta

SEQ ID NO: 133984 - DNA, 22 bp, Artificial Sequence
  Synthetic oligonucleotide; CTC chr11 5281972 5281993 5281977 5281972 -
ataattctattagctaatacat

SEQ ID NO: 133985 - DNA, 22 bp, Artificial Sequence
  Synthetic oligonucleotide; TTC chr11 5281965 5281986 5281970 5281965 -
tattagctaatacatattatca

SEQ ID NO: 133986 - DNA, 22 bp, Artificial Sequence
  Synthetic oligonucleotide; CTA chr11 5281963 5281984 5281968 5281963 -
ttagctaatacatattatcatc

SEQ ID NO: 133987 - DNA, 22 bp, Artificial Sequence
  Synthetic oligonucleotide; TTA chr11 5281960 5281981 5281965 5281960 -
gctaatacatattatcatccta

SEQ ID NO: 133988 - DNA, 22 bp, Artificial Sequence
  Synthetic oligonucleotide; CTA chr11 5281956 5281977 5281961 5281956 -
atacatattatcatcctatatt

SEQ ID NO: 133989 - DNA, 22 bp, Artificial Sequence
  Synthetic oligonucleotide; TTA chr11 5281946 5281967 5281951 5281946 -
tcatcctatatttcagagactt

SEQ ID NO: 133990 - DNA, 22 bp, Artificial Sequence
  Synthetic oligonucleotide; CTA chr11 5281938 5281959 5281943 5281938 -
tatttcagagacttcaagaagt

SEQ ID NO: 133991 - DNA, 22 bp, Artificial Sequence
  Synthetic oligonucleotide; TTT chr11 5281933 5281954 5281938 5281933 -
cagagacttcaagaagttaagc

SEQ ID NO: 133992 - DNA, 22 bp, Artificial Sequence
  Synthetic oligonucleotide; TTC chr11 5281932 5281953 5281937 5281932 -
agagacttcaagaagttaagca

SEQ ID NO: 133993 - DNA, 22 bp, Artificial Sequence
  Synthetic oligonucleotide; CTT chr11 5281924 5281945 5281929 5281924 -
caagaagttaagcaacttgctc

SEQ ID NO: 133994 - DNA, 22 bp, Artificial Sequence
  Synthetic oligonucleotide; TTC chr11 5281923 5281944 5281928 5281923 -
aagaagttaagcaacttgctca

SEQ ID NO: 133995 - DNA, 22 bp, Artificial Sequence
  Synthetic oligonucleotide; TTA chr11 5281914 5281935 5281919 5281914 -
agcaacttgctcaagatcatct

SEQ ID NO: 133996 - DNA, 22 bp, Artificial Sequence
  Synthetic oligonucleotide; CTT chr11 5281906 5281927 5281911 5281906 -
gctcaagatcatctaagaagta

SEQ ID NO: 133997 - DNA, 22 bp, Artificial Sequence
  Synthetic oligonucleotide; TTG chr11 5281905 5281926 5281910 5281905 -
ctcaagatcatctaagaagtag

SEQ ID NO: 133998 - DNA, 22 bp, Artificial Sequence
  Synthetic oligonucleotide; CTC chr11 5281902 5281923 5281907 5281902 -
aagatcatctaagaagtaggtg

SEQ ID NO: 133999 - DNA, 22 bp, Artificial Sequence
  Synthetic oligonucleotide; CTA chr11 5281891 5281912 5281896 5281891 -
agaagtaggtggtatttctggg

SEQ ID NO: 134000 - DNA, 22 bp, Artificial Sequence
  Synthetic oligonucleotide; TTT chr11 5281874 5281895 5281879 5281874 -
ctgggctcatttggcccctcct

SEQ ID NO: 134001 - DNA, 22 bp, Artificial Sequence
  Synthetic oligonucleotide; TTC chr11 5281873 5281894 5281878 5281873 -
tgggctcatttggcccctccta

SEQ ID NO: 134002 - DNA, 22 bp, Artificial Sequence
  Synthetic oligonucleotide; CTG chr11 5281871 5281892 5281876 5281871 -
ggctcatttggcccctcctaat

SEQ ID NO: 134003 - DNA, 22 bp, Artificial Sequence
  Synthetic oligonucleotide; CTC chr11 5281866 5281887 5281871 5281866 -
atttggcccctcctaatctctc

SEQ ID NO: 134004 - DNA, 22 bp, Artificial Sequence
  Synthetic oligonucleotide; TTT chr11 5281862 5281883 5281867 5281862 -
ggcccctcctaatctctcatgg

SEQ ID NO: 134005 - DNA, 22 bp, Artificial Sequence
  Synthetic oligonucleotide; TTG chr11 5281861 5281882 5281866 5281861 -
gcccctcctaatctctcatggc

SEQ ID NO: 134006 - DNA, 22 bp, Artificial Sequence
  Synthetic oligonucleotide; CTC chr11 5281854 5281875 5281859 5281854 -
ctaatctctcatggcaacatgg

SEQ ID NO: 134007 - DNA, 22 bp, Artificial Sequence
  Synthetic oligonucleotide; CTA chr11 5281851 5281872 5281856 5281851 -
atctctcatggcaacatggctg

SEQ ID NO: 134008 - DNA, 22 bp, Artificial Sequence
  Synthetic oligonucleotide; CTC chr11 5281846 5281867 5281851 5281846 -
tcatggcaacatggctgcctaa

SEQ ID NO: 134009 - DNA, 22 bp, Artificial Sequence
  Synthetic oligonucleotide; CTC chr11 5281844 5281865 5281849 5281844 -
atggcaacatggctgcctaaag

SEQ ID NO: 134010 - DNA, 22 bp, Artificial Sequence
  Synthetic oligonucleotide; CTG chr11 5281829 5281850 5281834 5281829 -
cctaaagtgttgattgccttaa

SEQ ID NO: 134011 - DNA, 22 bp, Artificial Sequence
  Synthetic oligonucleotide; CTA chr11 5281825 5281846 5281830 5281825 -
aagtgttgattgccttaattca

SEQ ID NO: 134012 - DNA, 22 bp, Artificial Sequence
  Synthetic oligonucleotide; TTG chr11 5281817 5281838 5281822 5281817 -
attgccttaattcatcagggat

SEQ ID NO: 134013 - DNA, 22 bp, Artificial Sequence
  Synthetic oligonucleotide; TTG chr11 5281813 5281834 5281818 5281813 -
ccttaattcatcagggatgggc

SEQ ID NO: 134014 - DNA, 22 bp, Artificial Sequence
  Synthetic oligonucleotide; CTT chr11 5281809 5281830 5281814 5281809 -
aattcatcagggatgggctcat

SEQ ID NO: 134015 - DNA, 22 bp, Artificial Sequence
  Synthetic oligonucleotide; TTA chr11 5281808 5281829 5281813 5281808 -
attcatcagggatgggctcata

SEQ ID NO: 134016 - DNA, 22 bp, Artificial Sequence
  Synthetic oligonucleotide; TTC chr11 5281804 5281825 5281809 5281804 -
atcagggatgggctcatactca

SEQ ID NO: 134017 - DNA, 22 bp, Artificial Sequence
  Synthetic oligonucleotide; CTC chr11 5281789 5281810 5281794 5281789 -
atactcactgcagaccttaact

SEQ ID NO: 134018 - DNA, 22 bp, Artificial Sequence
  Synthetic oligonucleotide; CTC chr11 5281783 5281804 5281788 5281783 -
actgcagaccttaactggcatc

SEQ ID NO: 134019 - DNA, 22 bp, Artificial Sequence
  Synthetic oligonucleotide; CTG chr11 5281779 5281800 5281784 5281779 -
cagaccttaactggcatcctct

SEQ ID NO: 134020 - DNA, 22 bp, Artificial Sequence
  Synthetic oligonucleotide; CTT chr11 5281771 5281792 5281776 5281771 -
aactggcatcctcttttcttat

SEQ ID NO: 134021 - DNA, 22 bp, Artificial Sequence
  Synthetic oligonucleotide; TTA chr11 5281770 5281791 5281775 5281770 -
actggcatcctcttttcttatg

SEQ ID NO: 134022 - DNA, 22 bp, Artificial Sequence
  Synthetic oligonucleotide; CTG chr11 5281766 5281787 5281771 5281766 -
gcatcctcttttcttatgtgat

SEQ ID NO: 134023 - DNA, 22 bp, Artificial Sequence
  Synthetic oligonucleotide; CTC chr11 5281758 5281779 5281763 5281758 -
ttttcttatgtgatctgcctga

SEQ ID NO: 134024 - DNA, 22 bp, Artificial Sequence
  Synthetic oligonucleotide; CTT chr11 5281756 5281777 5281761 5281756 -
ttcttatgtgatctgcctgacc

SEQ ID NO: 134025 - DNA, 22 bp, Artificial Sequence
  Synthetic oligonucleotide; TTT chr11 5281755 5281776 5281760 5281755 -
tcttatgtgatctgcctgaccc

SEQ ID NO: 134026 - DNA, 22 bp, Artificial Sequence
  Synthetic oligonucleotide; TTT chr11 5281754 5281775 5281759 5281754 -
cttatgtgatctgcctgaccct

SEQ ID NO: 134027 - DNA, 22 bp, Artificial Sequence
  Synthetic oligonucleotide; TTC chr11 5281753 5281774 5281758 5281753 -
ttatgtgatctgcctgacccta

SEQ ID NO: 134028 - DNA, 22 bp, Artificial Sequence
  Synthetic oligonucleotide; CTT chr11 5281751 5281772 5281756 5281751 -
atgtgatctgcctgaccctagt

SEQ ID NO: 134029 - DNA, 22 bp, Artificial Sequence
  Synthetic oligonucleotide; TTA chr11 5281750 5281771 5281755 5281750 -
tgtgatctgcctgaccctagta

SEQ ID NO: 134030 - DNA, 22 bp, Artificial Sequence
  Synthetic oligonucleotide; CTG chr11 5281741 5281762 5281746 5281741 -
cctgaccctagtagacttatga

SEQ ID NO: 134031 - DNA, 22 bp, Artificial Sequence
  Synthetic oligonucleotide; CTG chr11 5281737 5281758 5281742 5281737 -
accctagtagacttatgaaatt

SEQ ID NO: 134032 - DNA, 22 bp, Artificial Sequence
  Synthetic oligonucleotide; CTA chr11 5281731 5281752 5281736 5281731 -
gtagacttatgaaatttctgat

SEQ ID NO: 134033 - DNA, 22 bp, Artificial Sequence
  Synthetic oligonucleotide; CTT chr11 5281723 5281744 5281728 5281723 -
atgaaatttctgatgagaaagg

SEQ ID NO: 134034 - DNA, 22 bp, Artificial Sequence
  Synthetic oligonucleotide; TTA chr11 5281722 5281743 5281727 5281722 -
tgaaatttctgatgagaaagga

SEQ ID NO: 134035 - DNA, 22 bp, Artificial Sequence
  Synthetic oligonucleotide; TTT chr11 5281714 5281735 5281719 5281714 -
ctgatgagaaaggagagaggag

SEQ ID NO: 134036 - DNA, 22 bp, Artificial Sequence
  Synthetic oligonucleotide; TTC chr11 5281713 5281734 5281718 5281713 -
tgatgagaaaggagagaggaga

SEQ ID NO: 134037 - DNA, 22 bp, Artificial Sequence
  Synthetic oligonucleotide; CTG chr11 5281711 5281732 5281716 5281711 -
atgagaaaggagagaggagaaa

SEQ ID NO: 134038 - DNA, 22 bp, Artificial Sequence
  Synthetic oligonucleotide; CTG chr11 5281679 5281700 5281684 5281679 -
actgtgatgagtgatgaaggtg

SEQ ID NO: 134039 - DNA, 22 bp, Artificial Sequence
  Synthetic oligonucleotide; CTG chr11 5281675 5281696 5281680 5281675 -
tgatgagtgatgaaggtgcctt

SEQ ID NO: 134040 - DNA, 22 bp, Artificial Sequence
  Synthetic oligonucleotide; CTT chr11 5281653 5281674 5281658 5281653 -
ctcatctgggtaccagtggggc

SEQ ID NO: 134041 - DNA, 22 bp, Artificial Sequence
  Synthetic oligonucleotide; TTC chr11 5281652 5281673 5281657 5281652 -
tcatctgggtaccagtggggcc

SEQ ID NO: 134042 - DNA, 22 bp, Artificial Sequence
  Synthetic oligonucleotide; CTC chr11 5281650 5281671 5281655 5281650 -
atctgggtaccagtggggcctc

SEQ ID NO: 134043 - DNA, 22 bp, Artificial Sequence
  Synthetic oligonucleotide; CTG chr11 5281645 5281666 5281650 5281645 -
ggtaccagtggggcctctaaga

SEQ ID NO: 134044 - DNA, 22 bp, Artificial Sequence
  Synthetic oligonucleotide; CTC chr11 5281628 5281649 5281633 5281628 -
taagactaagtcactctgtctc

SEQ ID NO: 134045 - DNA, 22 bp, Artificial Sequence
  Synthetic oligonucleotide; CTA chr11 5281626 5281647 5281631 5281626 -
agactaagtcactctgtctcac

SEQ ID NO: 134046 - DNA, 22 bp, Artificial Sequence
  Synthetic oligonucleotide; CTA chr11 5281620 5281641 5281625 5281620 -
agtcactctgtctcactgtgtc

SEQ ID NO: 134047 - DNA, 22 bp, Artificial Sequence
  Synthetic oligonucleotide; CTC chr11 5281612 5281633 5281617 5281612 -
tgtctcactgtgtcttagccag

SEQ ID NO: 134048 - DNA, 22 bp, Artificial Sequence
  Synthetic oligonucleotide; CTG chr11 5281610 5281631 5281615 5281610 -
tctcactgtgtcttagccagtt

SEQ ID NO: 134049 - DNA, 22 bp, Artificial Sequence
  Synthetic oligonucleotide; CTC chr11 5281606 5281627 5281611 5281606 -
actgtgtcttagccagttcctt

SEQ ID NO: 134050 - DNA, 22 bp, Artificial Sequence
  Synthetic oligonucleotide; CTG chr11 5281602 5281623 5281607 5281602 -
tgtcttagccagttccttacag

SEQ ID NO: 134051 - DNA, 22 bp, Artificial Sequence
  Synthetic oligonucleotide; CTT chr11 5281596 5281617 5281601 5281596 -
agccagttccttacagcttgcc

SEQ ID NO: 134052 - DNA, 22 bp, Artificial Sequence
  Synthetic oligonucleotide; TTA chr11 5281595 5281616 5281600 5281595 -
gccagttccttacagcttgccc

SEQ ID NO: 134053 - DNA, 22 bp, Artificial Sequence
  Synthetic oligonucleotide; TTC chr11 5281587 5281608 5281592 5281587 -
cttacagcttgccctgatggga

SEQ ID NO: 134054 - DNA, 22 bp, Artificial Sequence
  Synthetic oligonucleotide; CTT chr11 5281584 5281605 5281589 5281584 -
acagcttgccctgatgggagat

SEQ ID NO: 134055 - DNA, 22 bp, Artificial Sequence
  Synthetic oligonucleotide; TTA chr11 5281583 5281604 5281588 5281583 -
cagcttgccctgatgggagata

SEQ ID NO: 134056 - DNA, 22 bp, Artificial Sequence
  Synthetic oligonucleotide; CTT chr11 5281577 5281598 5281582 5281577 -
gccctgatgggagatagagaat

SEQ ID NO: 134057 - DNA, 22 bp, Artificial Sequence
  Synthetic oligonucleotide; TTG chr11 5281576 5281597 5281581 5281576 -
ccctgatgggagatagagaatg

SEQ ID NO: 134058 - DNA, 22 bp, Artificial Sequence
  Synthetic oligonucleotide; CTG chr11 5281571 5281592 5281576 5281571 -
atgggagatagagaatgggtat

SEQ ID NO: 134059 - DNA, 22 bp, Artificial Sequence
  Synthetic oligonucleotide; CTC chr11 5281545 5281566 5281550 5281545 -
caacaaaaaaataaattttcat

SEQ ID NO: 134060 - DNA, 22 bp, Artificial Sequence
  Synthetic oligonucleotide; TTT chr11 5281527 5281548 5281532 5281527 -
tcatttctcaaggtccaactta

SEQ ID NO: 134061 - DNA, 22 bp, Artificial Sequence
  Synthetic oligonucleotide; TTT chr11 5281526 5281547 5281531 5281526 -
catttctcaaggtccaacttat

SEQ ID NO: 134062 - DNA, 22 bp, Artificial Sequence
  Synthetic oligonucleotide; TTC chr11 5281525 5281546 5281530 5281525 -
atttctcaaggtccaacttatg

SEQ ID NO: 134063 - DNA, 22 bp, Artificial Sequence
  Synthetic oligonucleotide; TTT chr11 5281521 5281542 5281526 5281521 -
ctcaaggtccaacttatgtttt

SEQ ID NO: 134064 - DNA, 22 bp, Artificial Sequence
  Synthetic oligonucleotide; TTC chr11 5281520 5281541 5281525 5281520 -
tcaaggtccaacttatgttttc

SEQ ID NO: 134065 - DNA, 22 bp, Artificial Sequence
  Synthetic oligonucleotide; CTC chr11 5281518 5281539 5281523 5281518 -
aaggtccaacttatgttttctt

SEQ ID NO: 134066 - DNA, 22 bp, Artificial Sequence
  Synthetic oligonucleotide; CTT chr11 5281506 5281527 5281511 5281506 -
atgttttcttaatttttaaaaa

SEQ ID NO: 134067 - DNA, 22 bp, Artificial Sequence
  Synthetic oligonucleotide; TTA chr11 5281505 5281526 5281510 5281505 -
tgttttcttaatttttaaaaaa

SEQ ID NO: 134068 - DNA, 22 bp, Artificial Sequence
  Synthetic oligonucleotide; TTT chr11 5281500 5281521 5281505 5281500 -
tcttaatttttaaaaaaatctt

SEQ ID NO: 134069 - DNA, 22 bp, Artificial Sequence
  Synthetic oligonucleotide; TTT chr11 5281499 5281520 5281504 5281499 -
cttaatttttaaaaaaatcttg

SEQ ID NO: 134070 - DNA, 22 bp, Artificial Sequence
  Synthetic oligonucleotide; TTC chr11 5281498 5281519 5281503 5281498 -
ttaatttttaaaaaaatcttga

SEQ ID NO: 134071 - DNA, 22 bp, Artificial Sequence
  Synthetic oligonucleotide; CTT chr11 5281496 5281517 5281501 5281496 -
aatttttaaaaaaatcttgacc

SEQ ID NO: 134072 - DNA, 22 bp, Artificial Sequence
  Synthetic oligonucleotide; TTA chr11 5281495 5281516 5281500 5281495 -
atttttaaaaaaatcttgacca

SEQ ID NO: 134073 - DNA, 22 bp, Artificial Sequence
  Synthetic oligonucleotide; TTT chr11 5281491 5281512 5281496 5281491 -
ttaaaaaaatcttgaccattct

SEQ ID NO: 134074 - DNA, 22 bp, Artificial Sequence
  Synthetic oligonucleotide; TTT chr11 5281490 5281511 5281495 5281490 -
taaaaaaatcttgaccattctc

SEQ ID NO: 134075 - DNA, 22 bp, Artificial Sequence
  Synthetic oligonucleotide; TTT chr11 5281489 5281510 5281494 5281489 -
aaaaaaatcttgaccattctcc

SEQ ID NO: 134076 - DNA, 22 bp, Artificial Sequence
  Synthetic oligonucleotide; TTA chr11 5281488 5281509 5281493 5281488 -
aaaaaatcttgaccattctcca

SEQ ID NO: 134077 - DNA, 22 bp, Artificial Sequence
  Synthetic oligonucleotide; CTT chr11 5281478 5281499 5281483 5281478 -
gaccattctccactctctaaaa

SEQ ID NO: 134078 - DNA, 22 bp, Artificial Sequence
  Synthetic oligonucleotide; TTG chr11 5281477 5281498 5281482 5281477 -
accattctccactctctaaaat

SEQ ID NO: 134079 - DNA, 22 bp, Artificial Sequence
  Synthetic oligonucleotide; TTC chr11 5281470 5281491 5281475 5281470 -
tccactctctaaaataatccac

SEQ ID NO: 134080 - DNA, 22 bp, Artificial Sequence
  Synthetic oligonucleotide; CTC chr11 5281468 5281489 5281473 5281468 -
cactctctaaaataatccacag

SEQ ID NO: 134081 - DNA, 22 bp, Artificial Sequence
  Synthetic oligonucleotide; CTC chr11 5281463 5281484 5281468 5281463 -
tctaaaataatccacagtgaga

SEQ ID NO: 134082 - DNA, 22 bp, Artificial Sequence
  Synthetic oligonucleotide; CTC chr11 5281461 5281482 5281466 5281461 -
taaaataatccacagtgagaga

SEQ ID NO: 134083 - DNA, 22 bp, Artificial Sequence
  Synthetic oligonucleotide; CTA chr11 5281459 5281480 5281464 5281459 -
aaataatccacagtgagagaaa

SEQ ID NO: 134084 - DNA, 22 bp, Artificial Sequence
  Synthetic oligonucleotide; TTC chr11 5281432 5281453 5281437 5281432 -
ttttcccccatcccataaatac

SEQ ID NO: 134085 - DNA, 22 bp, Artificial Sequence
  Synthetic oligonucleotide; CTT chr11 5281430 5281451 5281435 5281430 -
ttcccccatcccataaatacct

SEQ ID NO: 134086 - DNA, 22 bp, Artificial Sequence
  Synthetic oligonucleotide; TTT chr11 5281429 5281450 5281434 5281429 -
tcccccatcccataaatacctc

SEQ ID NO: 134087 - DNA, 22 bp, Artificial Sequence
  Synthetic oligonucleotide; TTT chr11 5281428 5281449 5281433 5281428 -
cccccatcccataaatacctct

SEQ ID NO: 134088 - DNA, 22 bp, Artificial Sequence
  Synthetic oligonucleotide; TTC chr11 5281427 5281448 5281432 5281427 -
ccccatcccataaatacctcta

SEQ ID NO: 134089 - DNA, 22 bp, Artificial Sequence
  Synthetic oligonucleotide; CTC chr11 5281407 5281428 5281412 5281407 -
tattaaatatggaaaatctggg

SEQ ID NO: 134090 - DNA, 22 bp, Artificial Sequence
  Synthetic oligonucleotide; CTA chr11 5281405 5281426 5281410 5281405 -
ttaaatatggaaaatctgggca

SEQ ID NO: 134091 - DNA, 22 bp, Artificial Sequence
  Synthetic oligonucleotide; TTA chr11 5281402 5281423 5281407 5281402 -
aatatggaaaatctgggcatgg

SEQ ID NO: 134092 - DNA, 22 bp, Artificial Sequence
  Synthetic oligonucleotide; CTG chr11 5281387 5281408 5281392 5281387 -
ggcatggtgtctcacacctgta

SEQ ID NO: 134093 - DNA, 22 bp, Artificial Sequence
  Synthetic oligonucleotide; CTC chr11 5281374 5281395 5281379 5281374 -
acacctgtaatcccagcacttt

SEQ ID NO: 134094 - DNA, 22 bp, Artificial Sequence
  Synthetic oligonucleotide; CTG chr11 5281367 5281388 5281372 5281367 -
taatcccagcactttgggaggc

SEQ ID NO: 134095 - DNA, 22 bp, Artificial Sequence
  Synthetic oligonucleotide; CTT chr11 5281353 5281374 5281358 5281353 -
tgggaggctgaggtgggtggac

SEQ ID NO: 134096 - DNA, 22 bp, Artificial Sequence
  Synthetic oligonucleotide; TTT chr11 5281352 5281373 5281357 5281352 -
gggaggctgaggtgggtggact

SEQ ID NO: 134097 - DNA, 22 bp, Artificial Sequence
  Synthetic oligonucleotide; TTG chr11 5281351 5281372 5281356 5281351 -
ggaggctgaggtgggtggactg

SEQ ID NO: 134098 - DNA, 22 bp, Artificial Sequence
  Synthetic oligonucleotide; CTG chr11 5281343 5281364 5281348 5281343 -
aggtgggtggactgcttggagc

SEQ ID NO: 134099 - DNA, 22 bp, Artificial Sequence
  Synthetic oligonucleotide; CTG chr11 5281329 5281350 5281334 5281329 -
cttggagctcaggagttcaaga

SEQ ID NO: 134100 - DNA, 22 bp, Artificial Sequence
  Synthetic oligonucleotide; CTT chr11 5281326 5281347 5281331 5281326 -
ggagctcaggagttcaagacca

SEQ ID NO: 134101 - DNA, 22 bp, Artificial Sequence
  Synthetic oligonucleotide; TTG chr11 5281325 5281346 5281330 5281325 -
gagctcaggagttcaagaccat

SEQ ID NO: 134102 - DNA, 22 bp, Artificial Sequence
  Synthetic oligonucleotide; CTC chr11 5281319 5281340 5281324 5281319 -
aggagttcaagaccatcttgga

SEQ ID NO: 134103 - DNA, 22 bp, Artificial Sequence
  Synthetic oligonucleotide; TTC chr11 5281311 5281332 5281316 5281311 -
aagaccatcttggacaacatgg

SEQ ID NO: 134104 - DNA, 22 bp, Artificial Sequence
  Synthetic oligonucleotide; CTT chr11 5281300 5281321 5281305 5281300 -
ggacaacatggtgataccctgc

SEQ ID NO: 134105 - DNA, 22 bp, Artificial Sequence
  Synthetic oligonucleotide; TTG chr11 5281299 5281320 5281304 5281299 -
gacaacatggtgataccctgcc

SEQ ID NO: 134106 - DNA, 22 bp, Artificial Sequence
  Synthetic oligonucleotide; CTG chr11 5281279 5281300 5281284 5281279 -
cctctacaaaaagtacaaaaat

SEQ ID NO: 134107 - DNA, 22 bp, Artificial Sequence
  Synthetic oligonucleotide; CTC chr11 5281275 5281296 5281280 5281275 -
tacaaaaagtacaaaaattagc

SEQ ID NO: 134108 - DNA, 22 bp, Artificial Sequence
  Synthetic oligonucleotide; CTA chr11 5281273 5281294 5281278 5281273 -
caaaaagtacaaaaattagcct

SEQ ID NO: 134109 - DNA, 22 bp, Artificial Sequence
  Synthetic oligonucleotide; TTA chr11 5281255 5281276 5281260 5281255 -
gcctggcatggtggtgtgcacc

SEQ ID NO: 134110 - DNA, 22 bp, Artificial Sequence
  Synthetic oligonucleotide; CTG chr11 5281250 5281271 5281255 5281250 -
gcatggtggtgtgcacctgtaa

SEQ ID NO: 134111 - DNA, 22 bp, Artificial Sequence
  Synthetic oligonucleotide; CTG chr11 5281231 5281252 5281236 5281231 -
taatcccagctattagggtggc

SEQ ID NO: 134112 - DNA, 22 bp, Artificial Sequence
  Synthetic oligonucleotide; CTA chr11 5281219 5281240 5281224 5281219 -
ttagggtggctgaggcaggaga

SEQ ID NO: 134113 - DNA, 22 bp, Artificial Sequence
  Synthetic oligonucleotide; TTA chr11 5281216 5281237 5281221 5281216 -
gggtggctgaggcaggagaatt

SEQ ID NO: 134114 - DNA, 22 bp, Artificial Sequence
  Synthetic oligonucleotide; CTG chr11 5281207 5281228 5281212 5281207 -
aggcaggagaattgcttgaacc

SEQ ID NO: 134115 - DNA, 22 bp, Artificial Sequence
  Synthetic oligonucleotide; TTG chr11 5281193 5281214 5281198 5281193 -
cttgaacccgggaggcggaggt

SEQ ID NO: 134116 - DNA, 22 bp, Artificial Sequence
  Synthetic oligonucleotide; CTT chr11 5281190 5281211 5281195 5281190 -
gaacccgggaggcggaggttgc

SEQ ID NO: 134117 - DNA, 22 bp, Artificial Sequence
  Synthetic oligonucleotide; TTG chr11 5281189 5281210 5281194 5281189 -
aacccgggaggcggaggttgca

SEQ ID NO: 134118 - DNA, 22 bp, Artificial Sequence
  Synthetic oligonucleotide; TTG chr11 5281169 5281190 5281174 5281169 -
cagtgagctgagatcgtgccac

SEQ ID NO: 134119 - DNA, 22 bp, Artificial Sequence
  Synthetic oligonucleotide; CTG chr11 5281159 5281180 5281164 5281159 -
agatcgtgccactgcactccag

SEQ ID NO: 134120 - DNA, 22 bp, Artificial Sequence
  Synthetic oligonucleotide; CTG chr11 5281145 5281166 5281150 5281145 -
cactccagcctgggggacagag

SEQ ID NO: 134121 - DNA, 22 bp, Artificial Sequence
  Synthetic oligonucleotide; CTC chr11 5281140 5281161 5281145 5281140 -
cagcctgggggacagagcacat

SEQ ID NO: 134122 - DNA, 22 bp, Artificial Sequence
  Synthetic oligonucleotide; CTG chr11 5281133 5281154 5281138 5281133 -
ggggacagagcacattataatt

SEQ ID NO: 134123 - DNA, 22 bp, Artificial Sequence
  Synthetic oligonucleotide; TTA chr11 5281116 5281137 5281121 5281116 -
taattaactgttattttttact

SEQ ID NO: 134124 - DNA, 22 bp, Artificial Sequence
  Synthetic oligonucleotide; TTA chr11 5281110 5281131 5281115 5281110 -
actgttattttttacttggact

SEQ ID NO: 134125 - DNA, 22 bp, Artificial Sequence
  Synthetic oligonucleotide; CTG chr11 5281106 5281127 5281111 5281106 -
ttattttttacttggactcttg

SEQ ID NO: 134126 - DNA, 22 bp, Artificial Sequence
  Synthetic oligonucleotide; TTA chr11 5281103 5281124 5281108 5281103 -
ttttttacttggactcttgtgg

SEQ ID NO: 134127 - DNA, 22 bp, Artificial Sequence
  Synthetic oligonucleotide; TTT chr11 5281100 5281121 5281105 5281100 -
tttacttggactcttgtgggga

SEQ ID NO: 134128 - DNA, 22 bp, Artificial Sequence
  Synthetic oligonucleotide; TTT chr11 5281099 5281120 5281104 5281099 -
ttacttggactcttgtggggaa

SEQ ID NO: 134129 - DNA, 22 bp, Artificial Sequence
  Synthetic oligonucleotide; TTT chr11 5281098 5281119 5281103 5281098 -
tacttggactcttgtggggaat

SEQ ID NO: 134130 - DNA, 22 bp, Artificial Sequence
  Synthetic oligonucleotide; TTT chr11 5281097 5281118 5281102 5281097 -
acttggactcttgtggggaata

SEQ ID NO: 134131 - DNA, 22 bp, Artificial Sequence
  Synthetic oligonucleotide; TTA chr11 5281096 5281117 5281101 5281096 -
cttggactcttgtggggaataa

SEQ ID NO: 134132 - DNA, 22 bp, Artificial Sequence
  Synthetic oligonucleotide; CTT chr11 5281093 5281114 5281098 5281093 -
ggactcttgtggggaataagat

SEQ ID NO: 134133 - DNA, 22 bp, Artificial Sequence
  Synthetic oligonucleotide; TTG chr11 5281092 5281113 5281097 5281092 -
gactcttgtggggaataagata

SEQ ID NO: 134134 - DNA, 22 bp, Artificial Sequence
  Synthetic oligonucleotide; CTC chr11 5281087 5281108 5281092 5281087 -
ttgtggggaataagatacatgt

SEQ ID NO: 134135 - DNA, 22 bp, Artificial Sequence
  Synthetic oligonucleotide; CTT chr11 5281085 5281106 5281090 5281085 -
gtggggaataagatacatgttt

SEQ ID NO: 134136 - DNA, 22 bp, Artificial Sequence
  Synthetic oligonucleotide; TTG chr11 5281084 5281105 5281089 5281084 -
tggggaataagatacatgtttt

SEQ ID NO: 134137 - DNA, 22 bp, Artificial Sequence
  Synthetic oligonucleotide; TTT chr11 5281063 5281084 5281068 5281063 -
tattcttatttatgattcaagc

SEQ ID NO: 134138 - DNA, 22 bp, Artificial Sequence
  Synthetic oligonucleotide; TTT chr11 5281062 5281083 5281067 5281062 -
attcttatttatgattcaagca

SEQ ID NO: 134139 - DNA, 22 bp, Artificial Sequence
  Synthetic oligonucleotide; TTA chr11 5281061 5281082 5281066 5281061 -
ttcttatttatgattcaagcac

SEQ ID NO: 134140 - DNA, 22 bp, Artificial Sequence
  Synthetic oligonucleotide; TTC chr11 5281058 5281079 5281063 5281058 -
ttatttatgattcaagcactga

SEQ ID NO: 134141 - DNA, 22 bp, Artificial Sequence
  Synthetic oligonucleotide; CTT chr11 5281056 5281077 5281061 5281056 -
atttatgattcaagcactgaaa

SEQ ID NO: 134142 - DNA, 22 bp, Artificial Sequence
  Synthetic oligonucleotide; TTA chr11 5281055 5281076 5281060 5281055 -
tttatgattcaagcactgaaaa

SEQ ID NO: 134143 - DNA, 22 bp, Artificial Sequence
  Synthetic oligonucleotide; TTT chr11 5281052 5281073 5281057 5281052 -
atgattcaagcactgaaaatag

SEQ ID NO: 134144 - DNA, 22 bp, Artificial Sequence
  Synthetic oligonucleotide; TTA chr11 5281051 5281072 5281056 5281051 -
tgattcaagcactgaaaatagt

SEQ ID NO: 134145 - DNA, 22 bp, Artificial Sequence
  Synthetic oligonucleotide; TTC chr11 5281045 5281066 5281050 5281045 -
aagcactgaaaatagtgtttag

SEQ ID NO: 134146 - DNA, 22 bp, Artificial Sequence
  Synthetic oligonucleotide; CTG chr11 5281037 5281058 5281042 5281037 -
aaaatagtgtttagcatccagc

SEQ ID NO: 134147 - DNA, 22 bp, Artificial Sequence
  Synthetic oligonucleotide; TTT chr11 5281025 5281046 5281030 5281025 -
agcatccagcaggtgcttcaaa

SEQ ID NO: 134148 - DNA, 22 bp, Artificial Sequence
  Synthetic oligonucleotide; TTA chr11 5281024 5281045 5281029 5281024 -
gcatccagcaggtgcttcaaaa

SEQ ID NO: 134149 - DNA, 22 bp, Artificial Sequence
  Synthetic oligonucleotide; CTT chr11 5281007 5281028 5281012 5281007 -
caaaaccatttgctgaatgatt

SEQ ID NO: 134150 - DNA, 22 bp, Artificial Sequence
  Synthetic oligonucleotide; TTC chr11 5281006 5281027 5281011 5281006 -
aaaaccatttgctgaatgatta

SEQ ID NO: 134151 - DNA, 22 bp, Artificial Sequence
  Synthetic oligonucleotide; TTT chr11 5280996 5281017 5281001 5280996 -
gctgaatgattactatactttt

SEQ ID NO: 134152 - DNA, 22 bp, Artificial Sequence
  Synthetic oligonucleotide; TTG chr11 5280995 5281016 5281000 5280995 -
ctgaatgattactatacttttt

SEQ ID NO: 134153 - DNA, 22 bp, Artificial Sequence
  Synthetic oligonucleotide; CTG chr11 5280992 5281013 5280997 5280992 -
aatgattactatactttttaca

SEQ ID NO: 134154 - DNA, 22 bp, Artificial Sequence
  Synthetic oligonucleotide; TTA chr11 5280984 5281005 5280989 5280984 -
ctatactttttacaagctcagc

SEQ ID NO: 134155 - DNA, 22 bp, Artificial Sequence
  Synthetic oligonucleotide; CTA chr11 5280981 5281002 5280986 5280981 -
tactttttacaagctcagctcc

SEQ ID NO: 134156 - DNA, 22 bp, Artificial Sequence
  Synthetic oligonucleotide; CTT chr11 5280976 5280997 5280981 5280976 -
tttacaagctcagctccctcta

SEQ ID NO: 134157 - DNA, 22 bp, Artificial Sequence
  Synthetic oligonucleotide; TTT chr11 5280975 5280996 5280980 5280975 -
ttacaagctcagctccctctat

SEQ ID NO: 134158 - DNA, 22 bp, Artificial Sequence
  Synthetic oligonucleotide; TTT chr11 5280974 5280995 5280979 5280974 -
tacaagctcagctccctctatc

SEQ ID NO: 134159 - DNA, 22 bp, Artificial Sequence
  Synthetic oligonucleotide; TTT chr11 5280973 5280994 5280978 5280973 -
acaagctcagctccctctatcc

SEQ ID NO: 134160 - DNA, 22 bp, Artificial Sequence
  Synthetic oligonucleotide; TTA chr11 5280972 5280993 5280977 5280972 -
caagctcagctccctctatccc

SEQ ID NO: 134161 - DNA, 22 bp, Artificial Sequence
  Synthetic oligonucleotide; CTC chr11 5280965 5280986 5280970 5280965 -
agctccctctatcccttccagc

SEQ ID NO: 134162 - DNA, 22 bp, Artificial Sequence
  Synthetic oligonucleotide; CTC chr11 5280960 5280981 5280965 5280960 -
cctctatcccttccagcatcct

SEQ ID NO: 134163 - DNA, 22 bp, Artificial Sequence
  Synthetic oligonucleotide; CTC chr11 5280956 5280977 5280961 5280956 -
tatcccttccagcatcctcatc

SEQ ID NO: 134164 - DNA, 22 bp, Artificial Sequence
  Synthetic oligonucleotide; CTA chr11 5280954 5280975 5280959 5280954 -
tcccttccagcatcctcatctc

SEQ ID NO: 134165 - DNA, 22 bp, Artificial Sequence
  Synthetic oligonucleotide; CTT chr11 5280948 5280969 5280953 5280948 -
ccagcatcctcatctctgatta

SEQ ID NO: 134166 - DNA, 22 bp, Artificial Sequence
  Synthetic oligonucleotide; TTC chr11 5280947 5280968 5280952 5280947 -
cagcatcctcatctctgattaa

SEQ ID NO: 134167 - DNA, 22 bp, Artificial Sequence
  Synthetic oligonucleotide; CTC chr11 5280937 5280958 5280942 5280937 -
atctctgattaaataagcttca

SEQ ID NO: 134168 - DNA, 22 bp, Artificial Sequence
  Synthetic oligonucleotide; CTC chr11 5280932 5280953 5280937 5280932 -
tgattaaataagcttcagtttt

SEQ ID NO: 134169 - DNA, 22 bp, Artificial Sequence
  Synthetic oligonucleotide; CTG chr11 5280930 5280951 5280935 5280930 -
attaaataagcttcagtttttc

SEQ ID NO: 134170 - DNA, 22 bp, Artificial Sequence
  Synthetic oligonucleotide; TTA chr11 5280926 5280947 5280931 5280926 -
aataagcttcagtttttcctta

SEQ ID NO: 134171 - DNA, 22 bp, Artificial Sequence
  Synthetic oligonucleotide; CTT chr11 5280917 5280938 5280922 5280917 -
cagtttttccttagttcctgtt

SEQ ID NO: 134172 - DNA, 22 bp, Artificial Sequence
  Synthetic oligonucleotide; TTC chr11 5280916 5280937 5280921 5280916 -
agtttttccttagttcctgtta

SEQ ID NO: 134173 - DNA, 22 bp, Artificial Sequence
  Synthetic oligonucleotide; TTT chr11 5280911 5280932 5280916 5280911 -
ttccttagttcctgttacattt

SEQ ID NO: 134174 - DNA, 22 bp, Artificial Sequence
  Synthetic oligonucleotide; TTT chr11 5280910 5280931 5280915 5280910 -
tccttagttcctgttacatttc

SEQ ID NO: 134175 - DNA, 22 bp, Artificial Sequence
  Synthetic oligonucleotide; TTT chr11 5280909 5280930 5280914 5280909 -
ccttagttcctgttacatttct

SEQ ID NO: 134176 - DNA, 22 bp, Artificial Sequence
  Synthetic oligonucleotide; TTC chr11 5280908 5280929 5280913 5280908 -
cttagttcctgttacatttctg

SEQ ID NO: 134177 - DNA, 22 bp, Artificial Sequence
  Synthetic oligonucleotide; CTT chr11 5280905 5280926 5280910 5280905 -
agttcctgttacatttctgtgt

SEQ ID NO: 134178 - DNA, 22 bp, Artificial Sequence
  Synthetic oligonucleotide; TTA chr11 5280904 5280925 5280909 5280904 -
gttcctgttacatttctgtgtg

SEQ ID NO: 134179 - DNA, 22 bp, Artificial Sequence
  Synthetic oligonucleotide; TTC chr11 5280900 5280921 5280905 5280900 -
ctgttacatttctgtgtgtctc

SEQ ID NO: 134180 - DNA, 22 bp, Artificial Sequence
  Synthetic oligonucleotide; CTG chr11 5280897 5280918 5280902 5280897 -
ttacatttctgtgtgtctccat

SEQ ID NO: 134181 - DNA, 22 bp, Artificial Sequence
  Synthetic oligonucleotide; TTA chr11 5280894 5280915 5280899 5280894 -
catttctgtgtgtctccattag

SEQ ID NO: 134182 - DNA, 22 bp, Artificial Sequence
  Synthetic oligonucleotide; TTT chr11 5280889 5280910 5280894 5280889 -
ctgtgtgtctccattagtgacc

SEQ ID NO: 134183 - DNA, 22 bp, Artificial Sequence
  Synthetic oligonucleotide; TTC chr11 5280888 5280909 5280893 5280888 -
tgtgtgtctccattagtgacct

SEQ ID NO: 134184 - DNA, 22 bp, Artificial Sequence
  Synthetic oligonucleotide; CTG chr11 5280886 5280907 5280891 5280886 -
tgtgtctccattagtgacctcc

SEQ ID NO: 134185 - DNA, 22 bp, Artificial Sequence
  Synthetic oligonucleotide; CTC chr11 5280878 5280899 5280883 5280878 -
cattagtgacctcccatagtcc

SEQ ID NO: 134186 - DNA, 22 bp, Artificial Sequence
  Synthetic oligonucleotide; TTA chr11 5280873 5280894 5280878 5280873 -
gtgacctcccatagtccaagca

SEQ ID NO: 134187 - DNA, 22 bp, Artificial Sequence
  Synthetic oligonucleotide; CTC chr11 5280865 5280886 5280870 5280865 -
ccatagtccaagcatgagcagt

SEQ ID NO: 134188 - DNA, 22 bp, Artificial Sequence
  Synthetic oligonucleotide; TTC chr11 5280841 5280862 5280846 5280841 -
tggccaggcccctgtcggggtc

SEQ ID NO: 134189 - DNA, 22 bp, Artificial Sequence
  Synthetic oligonucleotide; CTG chr11 5280839 5280860 5280844 5280839 -
gccaggcccctgtcggggtcag

SEQ ID NO: 134190 - DNA, 22 bp, Artificial Sequence
  Synthetic oligonucleotide; CTG chr11 5280827 5280848 5280832 5280827 -
tcggggtcagtgccccaccccc

SEQ ID NO: 134191 - DNA, 22 bp, Artificial Sequence
  Synthetic oligonucleotide; CTT chr11 5280800 5280821 5280805 5280800 -
ctggttctgtgtaaccttctaa

SEQ ID NO: 134192 - DNA, 22 bp, Artificial Sequence
  Synthetic oligonucleotide; TTC chr11 5280799 5280820 5280804 5280799 -
tggttctgtgtaaccttctaag

SEQ ID NO: 134193 - DNA, 22 bp, Artificial Sequence
  Synthetic oligonucleotide; CTG chr11 5280797 5280818 5280802 5280797 -
gttctgtgtaaccttctaagca

SEQ ID NO: 134194 - DNA, 22 bp, Artificial Sequence
  Synthetic oligonucleotide; TTC chr11 5280793 5280814 5280798 5280793 -
tgtgtaaccttctaagcaaacc

SEQ ID NO: 134195 - DNA, 22 bp, Artificial Sequence
  Synthetic oligonucleotide; CTG chr11 5280791 5280812 5280796 5280791 -
tgtaaccttctaagcaaacctt

SEQ ID NO: 134196 - DNA, 22 bp, Artificial Sequence
  Synthetic oligonucleotide; CTT chr11 5280782 5280803 5280787 5280782 -
ctaagcaaaccttctggctcaa

SEQ ID NO: 134197 - DNA, 22 bp, Artificial Sequence
  Synthetic oligonucleotide; TTC chr11 5280781 5280802 5280786 5280781 -
taagcaaaccttctggctcaag

SEQ ID NO: 134198 - DNA, 22 bp, Artificial Sequence
  Synthetic oligonucleotide; CTA chr11 5280779 5280800 5280784 5280779 -
agcaaaccttctggctcaagca

SEQ ID NO: 134199 - DNA, 22 bp, Artificial Sequence
  Synthetic oligonucleotide; CTT chr11 5280769 5280790 5280774 5280769 -
ctggctcaagcacagcaatgct

SEQ ID NO: 134200 - DNA, 22 bp, Artificial Sequence
  Synthetic oligonucleotide; TTC chr11 5280768 5280789 5280773 5280768 -
tggctcaagcacagcaatgctg

SEQ ID NO: 134201 - DNA, 22 bp, Artificial Sequence
  Synthetic oligonucleotide; CTG chr11 5280766 5280787 5280771 5280766 -
gctcaagcacagcaatgctgag

SEQ ID NO: 134202 - DNA, 22 bp, Artificial Sequence
  Synthetic oligonucleotide; CTC chr11 5280762 5280783 5280767 5280762 -
aagcacagcaatgctgagtcat

SEQ ID NO: 134203 - DNA, 22 bp, Artificial Sequence
  Synthetic oligonucleotide; CTG chr11 5280746 5280767 5280751 5280746 -
agtcatgatgagtcatgctgag

SEQ ID NO: 134204 - DNA, 22 bp, Artificial Sequence
  Synthetic oligonucleotide; CTG chr11 5280726 5280747 5280731 5280726 -
aggcttagggtgtgtgcccaga

SEQ ID NO: 134205 - DNA, 22 bp, Artificial Sequence
  Synthetic oligonucleotide; CTT chr11 5280720 5280741 5280725 5280720 -
agggtgtgtgcccagatgttct

SEQ ID NO: 134206 - DNA, 22 bp, Artificial Sequence
  Synthetic oligonucleotide; TTA chr11 5280719 5280740 5280724 5280719 -
gggtgtgtgcccagatgttctc

SEQ ID NO: 134207 - DNA, 22 bp, Artificial Sequence
  Synthetic oligonucleotide; TTC chr11 5280699 5280720 5280704 5280699 -
tcagcctagagtgatgactcct

SEQ ID NO: 134208 - DNA, 22 bp, Artificial Sequence
  Synthetic oligonucleotide; CTC chr11 5280697 5280718 5280702 5280697 -
agcctagagtgatgactcctat

SEQ ID NO: 134209 - DNA, 22 bp, Artificial Sequence
  Synthetic oligonucleotide; CTA chr11 5280691 5280712 5280696 5280691 -
gagtgatgactcctatctgggt

SEQ ID NO: 134210 - DNA, 22 bp, Artificial Sequence
  Synthetic oligonucleotide; CTC chr11 5280679 5280700 5280684 5280679 -
ctatctgggtccccagcaggat

SEQ ID NO: 134211 - DNA, 22 bp, Artificial Sequence
  Synthetic oligonucleotide; CTA chr11 5280676 5280697 5280681 5280676 -
tctgggtccccagcaggatgct

SEQ ID NO: 134212 - DNA, 22 bp, Artificial Sequence
  Synthetic oligonucleotide; CTG chr11 5280672 5280693 5280677 5280672 -
ggtccccagcaggatgcttaca

SEQ ID NO: 134213 - DNA, 22 bp, Artificial Sequence
  Synthetic oligonucleotide; CTT chr11 5280653 5280674 5280658 5280653 -
acagggcagatggcaaaaaaaa

SEQ ID NO: 134214 - DNA, 22 bp, Artificial Sequence
  Synthetic oligonucleotide; TTA chr11 5280652 5280673 5280657 5280652 -
cagggcagatggcaaaaaaaag

SEQ ID NO: 134215 - DNA, 22 bp, Artificial Sequence
  Synthetic oligonucleotide; CTG chr11 5280621 5280642 5280626 5280621 -
accacctgactaaaactccacc

SEQ ID NO: 134216 - DNA, 22 bp, Artificial Sequence
  Synthetic oligonucleotide; CTG chr11 5280613 5280634 5280618 5280613 -
actaaaactccacctcaaacgg

SEQ ID NO: 134217 - DNA, 22 bp, Artificial Sequence
  Synthetic oligonucleotide; CTA chr11 5280609 5280630 5280614 5280609 -
aaactccacctcaaacggcatc

SEQ ID NO: 134218 - DNA, 22 bp, Artificial Sequence
  Synthetic oligonucleotide; CTC chr11 5280603 5280624 5280608 5280603 -
cacctcaaacggcatcataaag

SEQ ID NO: 134219 - DNA, 22 bp, Artificial Sequence
  Synthetic oligonucleotide; CTC chr11 5280597 5280618 5280602 5280597 -
aaacggcatcataaagaaaatg

SEQ ID NO: 134220 - DNA, 22 bp, Artificial Sequence
  Synthetic oligonucleotide; CTG chr11 5280567 5280588 5280572 5280567 -
agacagaatgtgacatattcta

SEQ ID NO: 134221 - DNA, 22 bp, Artificial Sequence
  Synthetic oligonucleotide; TTC chr11 5280547 5280568 5280552 5280547 -
tagaatatattatttcctgaat

SEQ ID NO: 134222 - DNA, 22 bp, Artificial Sequence
  Synthetic oligonucleotide; CTA chr11 5280545 5280566 5280550 5280545 -
gaatatattatttcctgaatat

SEQ ID NO: 134223 - DNA, 22 bp, Artificial Sequence
  Synthetic oligonucleotide; TTA chr11 5280535 5280556 5280540 5280535 -
tttcctgaatatatatatatat

SEQ ID NO: 134224 - DNA, 22 bp, Artificial Sequence
  Synthetic oligonucleotide; TTT chr11 5280532 5280553 5280537 5280532 -
cctgaatatatatatatatata

SEQ ID NO: 134225 - DNA, 22 bp, Artificial Sequence
  Synthetic oligonucleotide; TTC chr11 5280531 5280552 5280536 5280531 -
ctgaatatatatatatatatac

SEQ ID NO: 134226 - DNA, 22 bp, Artificial Sequence
  Synthetic oligonucleotide; CTG chr11 5280528 5280549 5280533 5280528 -
aatatatatatatatatacaca

SEQ ID NO: 134227 - DNA, 22 bp, Artificial Sequence
  Synthetic oligonucleotide; TTT chr11 5280475 5280496 5280480 5280475 -
gttgttatcaattgccatagaa

SEQ ID NO: 134228 - DNA, 22 bp, Artificial Sequence
  Synthetic oligonucleotide; TTG chr11 5280474 5280495 5280479 5280474 -
ttgttatcaattgccatagaat

SEQ ID NO: 134229 - DNA, 22 bp, Artificial Sequence
  Synthetic oligonucleotide; TTG chr11 5280471 5280492 5280476 5280471 -
ttatcaattgccatagaatgat

SEQ ID NO: 134230 - DNA, 22 bp, Artificial Sequence
  Synthetic oligonucleotide; TTA chr11 5280468 5280489 5280473 5280468 -
tcaattgccatagaatgattag

SEQ ID NO: 134231 - DNA, 22 bp, Artificial Sequence
  Synthetic oligonucleotide; TTG chr11 5280461 5280482 5280466 5280461 -
ccatagaatgattagttattgt

SEQ ID NO: 134232 - DNA, 22 bp, Artificial Sequence
  Synthetic oligonucleotide; TTA chr11 5280447 5280468 5280452 5280447 -
gttattgtgaatcaaatattta

SEQ ID NO: 134233 - DNA, 22 bp, Artificial Sequence
  Synthetic oligonucleotide; TTA chr11 5280443 5280464 5280448 5280443 -
ttgtgaatcaaatatttatctt

SEQ ID NO: 134234 - DNA, 22 bp, Artificial Sequence
  Synthetic oligonucleotide; TTG chr11 5280440 5280461 5280445 5280440 -
tgaatcaaatatttatcttgca

SEQ ID NO: 134235 - DNA, 22 bp, Artificial Sequence
  Synthetic oligonucleotide; TTT chr11 5280426 5280447 5280431 5280426 -
atcttgcaggtggcctctatac

SEQ ID NO: 134236 - DNA, 22 bp, Artificial Sequence
  Synthetic oligonucleotide; TTA chr11 5280425 5280446 5280430 5280425 -
tcttgcaggtggcctctatacc

SEQ ID NO: 134237 - DNA, 22 bp, Artificial Sequence
  Synthetic oligonucleotide; CTT chr11 5280421 5280442 5280426 5280421 -
gcaggtggcctctatacctaga

SEQ ID NO: 134238 - DNA, 22 bp, Artificial Sequence
  Synthetic oligonucleotide; TTG chr11 5280420 5280441 5280425 5280420 -
caggtggcctctatacctagaa

SEQ ID NO: 134239 - DNA, 22 bp, Artificial Sequence
  Synthetic oligonucleotide; CTC chr11 5280409 5280430 5280414 5280409 -
tatacctagaagcggcagaatc

SEQ ID NO: 134240 - DNA, 22 bp, Artificial Sequence
  Synthetic oligonucleotide; CTA chr11 5280407 5280428 5280412 5280407 -
tacctagaagcggcagaatcag

SEQ ID NO: 134241 - DNA, 22 bp, Artificial Sequence
  Synthetic oligonucleotide; CTA chr11 5280401 5280422 5280406 5280401 -
gaagcggcagaatcaggcttta

SEQ ID NO: 134242 - DNA, 22 bp, Artificial Sequence
  Synthetic oligonucleotide; CTT chr11 5280381 5280402 5280386 5280381 -
tattaatacatgtgtatagatt

SEQ ID NO: 134243 - DNA, 22 bp, Artificial Sequence
  Synthetic oligonucleotide; TTT chr11 5280380 5280401 5280385 5280380 -
attaatacatgtgtatagattt

SEQ ID NO: 134244 - DNA, 22 bp, Artificial Sequence
  Synthetic oligonucleotide; TTA chr11 5280379 5280400 5280384 5280379 -
ttaatacatgtgtatagatttt

SEQ ID NO: 134245 - DNA, 22 bp, Artificial Sequence
  Synthetic oligonucleotide; TTA chr11 5280376 5280397 5280381 5280376 -
atacatgtgtatagatttttag

SEQ ID NO: 134246 - DNA, 22 bp, Artificial Sequence
  Synthetic oligonucleotide; TTT chr11 5280358 5280379 5280363 5280358 -
ttaggatctatacacatgtatt

SEQ ID NO: 134247 - DNA, 22 bp, Artificial Sequence
  Synthetic oligonucleotide; TTT chr11 5280357 5280378 5280362 5280357 -
taggatctatacacatgtatta

SEQ ID NO: 134248 - DNA, 22 bp, Artificial Sequence
  Synthetic oligonucleotide; TTT chr11 5280356 5280377 5280361 5280356 -
aggatctatacacatgtattaa

SEQ ID NO: 134249 - DNA, 22 bp, Artificial Sequence
  Synthetic oligonucleotide; TTA chr11 5280355 5280376 5280360 5280355 -
ggatctatacacatgtattaat

SEQ ID NO: 134250 - DNA, 22 bp, Artificial Sequence
  Synthetic oligonucleotide; CTA chr11 5280348 5280369 5280353 5280348 -
tacacatgtattaatatgaaac

SEQ ID NO: 134251 - DNA, 22 bp, Artificial Sequence
  Synthetic oligonucleotide; TTA chr11 5280335 5280356 5280340 5280335 -
atatgaaacaaggatatggaag

SEQ ID NO: 134252 - DNA, 22 bp, Artificial Sequence
  Synthetic oligonucleotide; CTT chr11 5280277 5280298 5280282 5280277 -
gtttgccattttaaggcacccc

SEQ ID NO: 134253 - DNA, 22 bp, Artificial Sequence
  Synthetic oligonucleotide; TTG chr11 5280276 5280297 5280281 5280276 -
tttgccattttaaggcacccct

SEQ ID NO: 134254 - DNA, 22 bp, Artificial Sequence
  Synthetic oligonucleotide; TTT chr11 5280273 5280294 5280278 5280273 -
gccattttaaggcacccctgga

SEQ ID NO: 134255 - DNA, 22 bp, Artificial Sequence
  Synthetic oligonucleotide; TTG chr11 5280272 5280293 5280277 5280272 -
ccattttaaggcacccctggac

SEQ ID NO: 134256 - DNA, 22 bp, Artificial Sequence
  Synthetic oligonucleotide; TTT chr11 5280266 5280287 5280271 5280266 -
taaggcacccctggacagctag

SEQ ID NO: 134257 - DNA, 22 bp, Artificial Sequence
  Synthetic oligonucleotide; TTT chr11 5280265 5280286 5280270 5280265 -
aaggcacccctggacagctagg

SEQ ID NO: 134258 - DNA, 22 bp, Artificial Sequence
  Synthetic oligonucleotide; TTA chr11 5280264 5280285 5280269 5280264 -
aggcacccctggacagctaggt

SEQ ID NO: 134259 - DNA, 22 bp, Artificial Sequence
  Synthetic oligonucleotide; CTG chr11 5280253 5280274 5280258 5280253 -
gacagctaggtggcaaaaggcc

SEQ ID NO: 134260 - DNA, 22 bp, Artificial Sequence
  Synthetic oligonucleotide; CTA chr11 5280245 5280266 5280250 5280245 -
ggtggcaaaaggcctgtgctgt

SEQ ID NO: 134261 - DNA, 22 bp, Artificial Sequence
  Synthetic oligonucleotide; CTG chr11 5280229 5280250 5280234 5280229 -
tgctgttagaggacacatgctc

SEQ ID NO: 134262 - DNA, 22 bp, Artificial Sequence
  Synthetic oligonucleotide; CTG chr11 5280224 5280245 5280229 5280224 -
ttagaggacacatgctcacata

SEQ ID NO: 134263 - DNA, 22 bp, Artificial Sequence
  Synthetic oligonucleotide; TTA chr11 5280221 5280242 5280226 5280221 -
gaggacacatgctcacatacgg

SEQ ID NO: 134264 - DNA, 22 bp, Artificial Sequence
  Synthetic oligonucleotide; CTC chr11 5280207 5280228 5280212 5280207 -
acatacggggtcagatctgact

SEQ ID NO: 134265 - DNA, 22 bp, Artificial Sequence
  Synthetic oligonucleotide; CTG chr11 5280188 5280209 5280193 5280188 -
acttggggtgctactgggaagc

SEQ ID NO: 134266 - DNA, 22 bp, Artificial Sequence
  Synthetic oligonucleotide; CTT chr11 5280184 5280205 5280189 5280184 -
ggggtgctactgggaagctctc

SEQ ID NO: 134267 - DNA, 22 bp, Artificial Sequence
  Synthetic oligonucleotide; TTG chr11 5280183 5280204 5280188 5280183 -
gggtgctactgggaagctctca

SEQ ID NO: 134268 - DNA, 22 bp, Artificial Sequence
  Synthetic oligonucleotide; CTA chr11 5280175 5280196 5280180 5280175 -
ctgggaagctctcatcttaagg

SEQ ID NO: 134269 - DNA, 22 bp, Artificial Sequence
  Synthetic oligonucleotide; CTG chr11 5280172 5280193 5280177 5280172 -
ggaagctctcatcttaaggata

SEQ ID NO: 134270 - DNA, 22 bp, Artificial Sequence
  Synthetic oligonucleotide; CTC chr11 5280164 5280185 5280169 5280164 -
tcatcttaaggatacatctcag

SEQ ID NO: 134271 - DNA, 22 bp, Artificial Sequence
  Synthetic oligonucleotide; CTC chr11 5280162 5280183 5280167 5280162 -
atcttaaggatacatctcaggc

SEQ ID NO: 134272 - DNA, 22 bp, Artificial Sequence
  Synthetic oligonucleotide; CTT chr11 5280157 5280178 5280162 5280157 -
aaggatacatctcaggccagtc

SEQ ID NO: 134273 - DNA, 22 bp, Artificial Sequence
  Synthetic oligonucleotide; TTA chr11 5280156 5280177 5280161 5280156 -
aggatacatctcaggccagtct

SEQ ID NO: 134274 - DNA, 22 bp, Artificial Sequence
  Synthetic oligonucleotide; CTC chr11 5280144 5280165 5280149 5280144 -
aggccagtcttggtgcattagg

SEQ ID NO: 134275 - DNA, 22 bp, Artificial Sequence
  Synthetic oligonucleotide; CTT chr11 5280133 5280154 5280138 5280133 -
ggtgcattaggaagatgtaggc

SEQ ID NO: 134276 - DNA, 22 bp, Artificial Sequence
  Synthetic oligonucleotide; TTG chr11 5280132 5280153 5280137 5280132 -
gtgcattaggaagatgtaggca

SEQ ID NO: 134277 - DNA, 22 bp, Artificial Sequence
  Synthetic oligonucleotide; TTA chr11 5280124 5280145 5280129 5280124 -
ggaagatgtaggcaactctgat

SEQ ID NO: 134278 - DNA, 22 bp, Artificial Sequence
  Synthetic oligonucleotide; CTC chr11 5280106 5280127 5280111 5280106 -
tgatcctgagaggaaagaaaca

SEQ ID NO: 134279 - DNA, 22 bp, Artificial Sequence
  Synthetic oligonucleotide; CTG chr11 5280104 5280125 5280109 5280104 -
atcctgagaggaaagaaacatt

SEQ ID NO: 134280 - DNA, 22 bp, Artificial Sequence
  Synthetic oligonucleotide; CTG chr11 5280098 5280119 5280103 5280098 -
agaggaaagaaacattcctcca

SEQ ID NO: 134281 - DNA, 22 bp, Artificial Sequence
  Synthetic oligonucleotide; TTC chr11 5280081 5280102 5280086 5280081 -
ctccaggagagctaaaagggtt

SEQ ID NO: 134282 - DNA, 22 bp, Artificial Sequence
  Synthetic oligonucleotide; CTC chr11 5280078 5280099 5280083 5280078 -
caggagagctaaaagggttcac

SEQ ID NO: 134283 - DNA, 22 bp, Artificial Sequence
  Synthetic oligonucleotide; CTA chr11 5280067 5280088 5280072 5280067 -
aaagggttcacctgtgtgggta

SEQ ID NO: 134284 - DNA, 22 bp, Artificial Sequence
  Synthetic oligonucleotide; TTC chr11 5280058 5280079 5280063 5280058 -
acctgtgtgggtaactgtgaag

SEQ ID NO: 134285 - DNA, 22 bp, Artificial Sequence
  Synthetic oligonucleotide; CTG chr11 5280053 5280074 5280058 5280053 -
tgtgggtaactgtgaaggacta

SEQ ID NO: 134286 - DNA, 22 bp, Artificial Sequence
  Synthetic oligonucleotide; CTG chr11 5280041 5280062 5280046 5280041 -
tgaaggactacaagaggatgaa

SEQ ID NO: 134287 - DNA, 22 bp, Artificial Sequence
  Synthetic oligonucleotide; CTA chr11 5280031 5280052 5280036 5280031 -
caagaggatgaaaaacaatgac

SEQ ID NO: 134288 - DNA, 22 bp, Artificial Sequence
  Synthetic oligonucleotide; CTT chr11 5279992 5280013 5279997 5279992 -
gtgggagaaaaaacaggaggtc

SEQ ID NO: 134289 - DNA, 22 bp, Artificial Sequence
  Synthetic oligonucleotide; TTG chr11 5279991 5280012 5279996 5279991 -
tgggagaaaaaacaggaggtca

SEQ ID NO: 134290 - DNA, 22 bp, Artificial Sequence
  Synthetic oligonucleotide; CTT chr11 5279951 5279972 5279956 5279951 -
ccagaagaatggctttgaagct

SEQ ID NO: 134291 - DNA, 22 bp, Artificial Sequence
  Synthetic oligonucleotide; TTC chr11 5279950 5279971 5279955 5279950 -
cagaagaatggctttgaagctg

SEQ ID NO: 134292 - DNA, 22 bp, Artificial Sequence
  Synthetic oligonucleotide; CTT chr11 5279936 5279957 5279941 5279936 -
tgaagctggcttctgtaggagt

SEQ ID NO: 134293 - DNA, 22 bp, Artificial Sequence
  Synthetic oligonucleotide; TTT chr11 5279935 5279956 5279940 5279935 -
gaagctggcttctgtaggagtt

SEQ ID NO: 134294 - DNA, 22 bp, Artificial Sequence
  Synthetic oligonucleotide; TTG chr11 5279934 5279955 5279939 5279934 -
aagctggcttctgtaggagttc

SEQ ID NO: 134295 - DNA, 22 bp, Artificial Sequence
  Synthetic oligonucleotide; CTG chr11 5279928 5279949 5279933 5279928 -
gcttctgtaggagttcacagtg

SEQ ID NO: 134296 - DNA, 22 bp, Artificial Sequence
  Synthetic oligonucleotide; CTT chr11 5279924 5279945 5279929 5279924 -
ctgtaggagttcacagtggcaa

SEQ ID NO: 134297 - DNA, 22 bp, Artificial Sequence
  Synthetic oligonucleotide; TTC chr11 5279923 5279944 5279928 5279923 -
tgtaggagttcacagtggcaaa

SEQ ID NO: 134298 - DNA, 22 bp, Artificial Sequence
  Synthetic oligonucleotide; CTG chr11 5279921 5279942 5279926 5279921 -
taggagttcacagtggcaaaga

SEQ ID NO: 134299 - DNA, 22 bp, Artificial Sequence
  Synthetic oligonucleotide; TTC chr11 5279912 5279933 5279917 5279912 -
acagtggcaaagatgtttcaga

SEQ ID NO: 134300 - DNA, 22 bp, Artificial Sequence
  Synthetic oligonucleotide; TTT chr11 5279894 5279915 5279899 5279894 -
cagaaatgtgacatgacttaag

SEQ ID NO: 134301 - DNA, 22 bp, Artificial Sequence
  Synthetic oligonucleotide; TTC chr11 5279893 5279914 5279898 5279893 -
agaaatgtgacatgacttaagg

SEQ ID NO: 134302 - DNA, 22 bp, Artificial Sequence
  Synthetic oligonucleotide; CTT chr11 5279875 5279896 5279880 5279875 -
aaggaactatacaaaaaggaac

SEQ ID NO: 134303 - DNA, 22 bp, Artificial Sequence
  Synthetic oligonucleotide; TTA chr11 5279874 5279895 5279879 5279874 -
aggaactatacaaaaaggaaca

SEQ ID NO: 134304 - DNA, 22 bp, Artificial Sequence
  Synthetic oligonucleotide; CTA chr11 5279866 5279887 5279871 5279866 -
tacaaaaaggaacaaatttaag

SEQ ID NO: 134305 - DNA, 22 bp, Artificial Sequence
  Synthetic oligonucleotide; TTT chr11 5279847 5279868 5279852 5279847 -
aaggagaggcagataaattagt

SEQ ID NO: 134306 - DNA, 22 bp, Artificial Sequence
  Synthetic oligonucleotide; TTA chr11 5279846 5279867 5279851 5279846 -
aggagaggcagataaattagtt

SEQ ID NO: 134307 - DNA, 22 bp, Artificial Sequence
  Synthetic oligonucleotide; TTA chr11 5279827 5279848 5279832 5279827 -
gttcaacagacatgcaaggaat

SEQ ID NO: 134308 - DNA, 22 bp, Artificial Sequence
  Synthetic oligonucleotide; TTC chr11 5279823 5279844 5279828 5279823 -
aacagacatgcaaggaattttc

SEQ ID NO: 134309 - DNA, 22 bp, Artificial Sequence
  Synthetic oligonucleotide; TTT chr11 5279803 5279824 5279808 5279803 -
tcagatgaatgttatgtctcca

SEQ ID NO: 134310 - DNA, 22 bp, Artificial Sequence
  Synthetic oligonucleotide; TTT chr11 5279802 5279823 5279807 5279802 -
cagatgaatgttatgtctccac

SEQ ID NO: 134311 - DNA, 22 bp, Artificial Sequence
  Synthetic oligonucleotide; TTC chr11 5279801 5279822 5279806 5279801 -
agatgaatgttatgtctccact

SEQ ID NO: 134312 - DNA, 22 bp, Artificial Sequence
  Synthetic oligonucleotide; TTA chr11 5279789 5279810 5279794 5279789 -
tgtctccactgagcttcttgag

SEQ ID NO: 134313 - DNA, 22 bp, Artificial Sequence
  Synthetic oligonucleotide; CTC chr11 5279783 5279804 5279788 5279783 -
cactgagcttcttgaggttagc

SEQ ID NO: 134314 - DNA, 22 bp, Artificial Sequence
  Synthetic oligonucleotide; CTG chr11 5279778 5279799 5279783 5279778 -
agcttcttgaggttagcagctg

SEQ ID NO: 134315 - DNA, 22 bp, Artificial Sequence
  Synthetic oligonucleotide; CTT chr11 5279773 5279794 5279778 5279773 -
cttgaggttagcagctgtgagg

SEQ ID NO: 134316 - DNA, 22 bp, Artificial Sequence
  Synthetic oligonucleotide; TTC chr11 5279772 5279793 5279777 5279772 -
ttgaggttagcagctgtgaggg

SEQ ID NO: 134317 - DNA, 22 bp, Artificial Sequence
  Synthetic oligonucleotide; CTT chr11 5279770 5279791 5279775 5279770 -
gaggttagcagctgtgagggtt

SEQ ID NO: 134318 - DNA, 22 bp, Artificial Sequence
  Synthetic oligonucleotide; TTG chr11 5279769 5279790 5279774 5279769 -
aggttagcagctgtgagggttt

SEQ ID NO: 134319 - DNA, 22 bp, Artificial Sequence
  Synthetic oligonucleotide; TTA chr11 5279763 5279784 5279768 5279763 -
gcagctgtgagggttttgcagg

SEQ ID NO: 134320 - DNA, 22 bp, Artificial Sequence
  Synthetic oligonucleotide; CTG chr11 5279756 5279777 5279761 5279756 -
tgagggttttgcaggcccagga

SEQ ID NO: 134321 - DNA, 22 bp, Artificial Sequence
  Synthetic oligonucleotide; TTT chr11 5279747 5279768 5279752 5279747 -
tgcaggcccaggacccattaca

SEQ ID NO: 134322 - DNA, 22 bp, Artificial Sequence
  Synthetic oligonucleotide; TTT chr11 5279746 5279767 5279751 5279746 -
gcaggcccaggacccattacag

SEQ ID NO: 134323 - DNA, 22 bp, Artificial Sequence
  Synthetic oligonucleotide; TTG chr11 5279745 5279766 5279750 5279745 -
caggcccaggacccattacagg

SEQ ID NO: 134324 - DNA, 22 bp, Artificial Sequence
  Synthetic oligonucleotide; TTA chr11 5279727 5279748 5279732 5279727 -
caggacctcacgtatacttgac

SEQ ID NO: 134325 - DNA, 22 bp, Artificial Sequence
  Synthetic oligonucleotide; CTC chr11 5279718 5279739 5279723 5279718 -
acgtatacttgacactgttttt

SEQ ID NO: 134326 - DNA, 22 bp, Artificial Sequence
  Synthetic oligonucleotide; CTT chr11 5279708 5279729 5279713 5279708 -
gacactgttttttgtattcatt

SEQ ID NO: 134327 - DNA, 22 bp, Artificial Sequence
  Synthetic oligonucleotide; TTG chr11 5279707 5279728 5279712 5279707 -
acactgttttttgtattcattt

SEQ ID NO: 134328 - DNA, 22 bp, Artificial Sequence
  Synthetic oligonucleotide; CTG chr11 5279701 5279722 5279706 5279701 -
ttttttgtattcatttgtgaat

SEQ ID NO: 134329 - DNA, 22 bp, Artificial Sequence
  Synthetic oligonucleotide; TTT chr11 5279698 5279719 5279703 5279698 -
tttgtattcatttgtgaatgaa

SEQ ID NO: 134330 - DNA, 22 bp, Artificial Sequence
  Synthetic oligonucleotide; TTT chr11 5279697 5279718 5279702 5279697 -
ttgtattcatttgtgaatgaat

SEQ ID NO: 134331 - DNA, 22 bp, Artificial Sequence
  Synthetic oligonucleotide; TTT chr11 5279696 5279717 5279701 5279696 -
tgtattcatttgtgaatgaatg

SEQ ID NO: 134332 - DNA, 22 bp, Artificial Sequence
  Synthetic oligonucleotide; TTT chr11 5279695 5279716 5279700 5279695 -
gtattcatttgtgaatgaatga

SEQ ID NO: 134333 - DNA, 22 bp, Artificial Sequence
  Synthetic oligonucleotide; TTG chr11 5279694 5279715 5279699 5279694 -
tattcatttgtgaatgaatgac

SEQ ID NO: 134334 - DNA, 22 bp, Artificial Sequence
  Synthetic oligonucleotide; TTC chr11 5279689 5279710 5279694 5279689 -
atttgtgaatgaatgacctctt

SEQ ID NO: 134335 - DNA, 22 bp, Artificial Sequence
  Synthetic oligonucleotide; TTT chr11 5279685 5279706 5279690 5279685 -
gtgaatgaatgacctcttgtca

SEQ ID NO: 134336 - DNA, 22 bp, Artificial Sequence
  Synthetic oligonucleotide; TTG chr11 5279684 5279705 5279689 5279684 -
tgaatgaatgacctcttgtcag

SEQ ID NO: 134337 - DNA, 22 bp, Artificial Sequence
  Synthetic oligonucleotide; CTC chr11 5279669 5279690 5279674 5279669 -
ttgtcagtctactcggtttcgc

SEQ ID NO: 134338 - DNA, 22 bp, Artificial Sequence
  Synthetic oligonucleotide; CTT chr11 5279667 5279688 5279672 5279667 -
gtcagtctactcggtttcgctg

SEQ ID NO: 134339 - DNA, 22 bp, Artificial Sequence
  Synthetic oligonucleotide; TTG chr11 5279666 5279687 5279671 5279666 -
tcagtctactcggtttcgctgt

SEQ ID NO: 134340 - DNA, 22 bp, Artificial Sequence
  Synthetic oligonucleotide; CTA chr11 5279658 5279679 5279663 5279658 -
ctcggtttcgctgtgaatgaat

SEQ ID NO: 134341 - DNA, 22 bp, Artificial Sequence
  Synthetic oligonucleotide; CTC chr11 5279655 5279676 5279660 5279655 -
ggtttcgctgtgaatgaatgat

SEQ ID NO: 134342 - DNA, 22 bp, Artificial Sequence
  Synthetic oligonucleotide; TTT chr11 5279650 5279671 5279655 5279650 -
cgctgtgaatgaatgatgtctt

SEQ ID NO: 134343 - DNA, 22 bp, Artificial Sequence
  Synthetic oligonucleotide; TTC chr11 5279649 5279670 5279654 5279649 -
gctgtgaatgaatgatgtcttg

SEQ ID NO: 134344 - DNA, 22 bp, Artificial Sequence
  Synthetic oligonucleotide; CTG chr11 5279645 5279666 5279650 5279645 -
tgaatgaatgatgtcttgtcag

SEQ ID NO: 134345 - DNA, 22 bp, Artificial Sequence
  Synthetic oligonucleotide; CTT chr11 5279628 5279649 5279633 5279628 -
gtcagcctacttggtttcgcta

SEQ ID NO: 134346 - DNA, 22 bp, Artificial Sequence
  Synthetic oligonucleotide; TTG chr11 5279627 5279648 5279632 5279627 -
tcagcctacttggtttcgctaa

SEQ ID NO: 134347 - DNA, 22 bp, Artificial Sequence
  Synthetic oligonucleotide; CTA chr11 5279619 5279640 5279624 5279619 -
cttggtttcgctaagagcacag

SEQ ID NO: 134348 - DNA, 22 bp, Artificial Sequence
  Synthetic oligonucleotide; CTT chr11 5279616 5279637 5279621 5279616 -
ggtttcgctaagagcacagaga

SEQ ID NO: 134349 - DNA, 22 bp, Artificial Sequence
  Synthetic oligonucleotide; TTG chr11 5279615 5279636 5279620 5279615 -
gtttcgctaagagcacagagag

SEQ ID NO: 134350 - DNA, 22 bp, Artificial Sequence
  Synthetic oligonucleotide; TTT chr11 5279611 5279632 5279616 5279611 -
cgctaagagcacagagagaaga

SEQ ID NO: 134351 - DNA, 22 bp, Artificial Sequence
  Synthetic oligonucleotide; TTC chr11 5279610 5279631 5279615 5279610 -
gctaagagcacagagagaagat

SEQ ID NO: 134352 - DNA, 22 bp, Artificial Sequence
  Synthetic oligonucleotide; CTA chr11 5279606 5279627 5279611 5279606 -
agagcacagagagaagatttag

SEQ ID NO: 134353 - DNA, 22 bp, Artificial Sequence
  Synthetic oligonucleotide; TTT chr11 5279586 5279607 5279591 5279586 -
agtgatgctatgtaaaaacttc

SEQ ID NO: 134354 - DNA, 22 bp, Artificial Sequence
  Synthetic oligonucleotide; TTA chr11 5279585 5279606 5279590 5279585 -
gtgatgctatgtaaaaacttcc

SEQ ID NO: 134355 - DNA, 22 bp, Artificial Sequence
  Synthetic oligonucleotide; CTA chr11 5279576 5279597 5279581 5279576 -
tgtaaaaacttcctttttggtt

SEQ ID NO: 134356 - DNA, 22 bp, Artificial Sequence
  Synthetic oligonucleotide; CTT chr11 5279565 5279586 5279570 5279565 -
cctttttggttcaagtgtatgt

SEQ ID NO: 134357 - DNA, 22 bp, Artificial Sequence
  Synthetic oligonucleotide; TTC chr11 5279564 5279585 5279569 5279564 -
ctttttggttcaagtgtatgtt

SEQ ID NO: 134358 - DNA, 22 bp, Artificial Sequence
  Synthetic oligonucleotide; CTT chr11 5279561 5279582 5279566 5279561 -
tttggttcaagtgtatgtttgt

SEQ ID NO: 134359 - DNA, 22 bp, Artificial Sequence
  Synthetic oligonucleotide; TTT chr11 5279560 5279581 5279565 5279560 -
ttggttcaagtgtatgtttgtg

SEQ ID NO: 134360 - DNA, 22 bp, Artificial Sequence
  Synthetic oligonucleotide; TTT chr11 5279559 5279580 5279564 5279559 -
tggttcaagtgtatgtttgtga

SEQ ID NO: 134361 - DNA, 22 bp, Artificial Sequence
  Synthetic oligonucleotide; TTT chr11 5279558 5279579 5279563 5279558 -
ggttcaagtgtatgtttgtgat

SEQ ID NO: 134362 - DNA, 22 bp, Artificial Sequence
  Synthetic oligonucleotide; TTG chr11 5279557 5279578 5279562 5279557 -
gttcaagtgtatgtttgtgata

SEQ ID NO: 134363 - DNA, 22 bp, Artificial Sequence
  Synthetic oligonucleotide; TTC chr11 5279553 5279574 5279558 5279553 -
aagtgtatgtttgtgatagaaa

SEQ ID NO: 134364 - DNA, 22 bp, Artificial Sequence
  Synthetic oligonucleotide; TTT chr11 5279541 5279562 5279546 5279541 -
gtgatagaaatgaagacaggct

SEQ ID NO: 134365 - DNA, 22 bp, Artificial Sequence
  Synthetic oligonucleotide; TTG chr11 5279540 5279561 5279545 5279540 -
tgatagaaatgaagacaggcta

SEQ ID NO: 134366 - DNA, 22 bp, Artificial Sequence
  Synthetic oligonucleotide; CTA chr11 5279518 5279539 5279523 5279518 -
catgatgcatatctaacataaa

SEQ ID NO: 134367 - DNA, 22 bp, Artificial Sequence
  Synthetic oligonucleotide; CTA chr11 5279503 5279524 5279508 5279503 -
acataaacacaaacattaagaa

SEQ ID NO: 134368 - DNA, 22 bp, Artificial Sequence
  Synthetic oligonucleotide; TTA chr11 5279485 5279506 5279490 5279485 -
agaaaggaaatcaacctgaaga

SEQ ID NO: 134369 - DNA, 22 bp, Artificial Sequence
  Synthetic oligonucleotide; CTG chr11 5279467 5279488 5279472 5279467 -
aagagtatttatacagataaca

SEQ ID NO: 134370 - DNA, 22 bp, Artificial Sequence
  Synthetic oligonucleotide; TTT chr11 5279457 5279478 5279462 5279457 -
atacagataacaaaatacagag

SEQ ID NO: 134371 - DNA, 22 bp, Artificial Sequence
  Synthetic oligonucleotide; TTA chr11 5279456 5279477 5279461 5279456 -
tacagataacaaaatacagaga

SEQ ID NO: 134372 - DNA, 22 bp, Artificial Sequence
  Synthetic oligonucleotide; TTA chr11 5279426 5279447 5279431 5279426 -
aatgtgtaataactgtggcaca

SEQ ID NO: 134373 - DNA, 22 bp, Artificial Sequence
  Synthetic oligonucleotide; CTG chr11 5279411 5279432 5279416 5279411 -
tggcacaggctggaatatgagc

SEQ ID NO: 134374 - DNA, 22 bp, Artificial Sequence
  Synthetic oligonucleotide; CTG chr11 5279399 5279420 5279404 5279399 -
gaatatgagccatttaaatcac

SEQ ID NO: 134375 - DNA, 22 bp, Artificial Sequence
  Synthetic oligonucleotide; TTT chr11 5279384 5279405 5279389 5279384 -
aaatcacaaattaattagaaaa

SEQ ID NO: 134376 - DNA, 22 bp, Artificial Sequence
  Synthetic oligonucleotide; TTA chr11 5279383 5279404 5279388 5279383 -
aatcacaaattaattagaaaaa

SEQ ID NO: 134377 - DNA, 22 bp, Artificial Sequence
  Synthetic oligonucleotide; TTA chr11 5279371 5279392 5279376 5279371 -
attagaaaaaaaacagtgggga

SEQ ID NO: 134378 - DNA, 22 bp, Artificial Sequence
  Synthetic oligonucleotide; TTA chr11 5279367 5279388 5279372 5279367 -
gaaaaaaaacagtggggaaaaa

SEQ ID NO: 134379 - DNA, 22 bp, Artificial Sequence
  Synthetic oligonucleotide; TTC chr11 5279341 5279362 5279346 5279341 -
catggatgggtctagaaagact

SEQ ID NO: 134380 - DNA, 22 bp, Artificial Sequence
  Synthetic oligonucleotide; CTA chr11 5279327 5279348 5279332 5279327 -
gaaagactagcattgttttagg

SEQ ID NO: 134381 - DNA, 22 bp, Artificial Sequence
  Synthetic oligonucleotide; CTA chr11 5279318 5279339 5279323 5279318 -
gcattgttttaggttgagtggc

SEQ ID NO: 134382 - DNA, 22 bp, Artificial Sequence
  Synthetic oligonucleotide; TTG chr11 5279312 5279333 5279317 5279312 -
ttttaggttgagtggcagtgtt

SEQ ID NO: 134383 - DNA, 22 bp, Artificial Sequence
  Synthetic oligonucleotide; TTT chr11 5279309 5279330 5279314 5279309 -
taggttgagtggcagtgtttaa

SEQ ID NO: 134384 - DNA, 22 bp, Artificial Sequence
  Synthetic oligonucleotide; TTT chr11 5279308 5279329 5279313 5279308 -
aggttgagtggcagtgtttaaa

SEQ ID NO: 134385 - DNA, 22 bp, Artificial Sequence
  Synthetic oligonucleotide; TTA chr11 5279307 5279328 5279312 5279307 -
ggttgagtggcagtgtttaaag

SEQ ID NO: 134386 - DNA, 22 bp, Artificial Sequence
  Synthetic oligonucleotide; TTG chr11 5279302 5279323 5279307 5279302 -
agtggcagtgtttaaagggtga

SEQ ID NO: 134387 - DNA, 22 bp, Artificial Sequence
  Synthetic oligonucleotide; TTT chr11 5279289 5279310 5279294 5279289 -
aaagggtgatatcagactaaac

SEQ ID NO: 134388 - DNA, 22 bp, Artificial Sequence
  Synthetic oligonucleotide; TTA chr11 5279288 5279309 5279293 5279288 -
aagggtgatatcagactaaact

SEQ ID NO: 134389 - DNA, 22 bp, Artificial Sequence
  Synthetic oligonucleotide; CTA chr11 5279270 5279291 5279275 5279270 -
aacttgaaatatgtggctaaat

SEQ ID NO: 134390 - DNA, 22 bp, Artificial Sequence
  Synthetic oligonucleotide; CTT chr11 5279265 5279286 5279270 5279265 -
gaaatatgtggctaaataacta

SEQ ID NO: 134391 - DNA, 22 bp, Artificial Sequence
  Synthetic oligonucleotide; TTG chr11 5279264 5279285 5279269 5279264 -
aaatatgtggctaaataactag

SEQ ID NO: 134392 - DNA, 22 bp, Artificial Sequence
  Synthetic oligonucleotide; CTA chr11 5279251 5279272 5279256 5279251 -
aataactagaatactctttatt

SEQ ID NO: 134393 - DNA, 22 bp, Artificial Sequence
  Synthetic oligonucleotide; CTA chr11 5279243 5279264 5279248 5279243 -
gaatactctttattttttcgta

SEQ ID NO: 134394 - DNA, 22 bp, Artificial Sequence
  Synthetic oligonucleotide; CTC chr11 5279235 5279256 5279240 5279235 -
tttattttttcgtatcatgaat

SEQ ID NO: 134395 - DNA, 22 bp, Artificial Sequence
  Synthetic oligonucleotide; CTT chr11 5279233 5279254 5279238 5279233 -
tattttttcgtatcatgaatag

SEQ ID NO: 134396 - DNA, 22 bp, Artificial Sequence
  Synthetic oligonucleotide; TTT chr11 5279232 5279253 5279237 5279232 -
attttttcgtatcatgaatagc

SEQ ID NO: 134397 - DNA, 22 bp, Artificial Sequence
  Synthetic oligonucleotide; TTA chr11 5279231 5279252 5279236 5279231 -
ttttttcgtatcatgaatagca

SEQ ID NO: 134398 - DNA, 22 bp, Artificial Sequence
  Synthetic oligonucleotide; TTT chr11 5279228 5279249 5279233 5279228 -
tttcgtatcatgaatagcagat

SEQ ID NO: 134399 - DNA, 22 bp, Artificial Sequence
  Synthetic oligonucleotide; TTT chr11 5279227 5279248 5279232 5279227 -
ttcgtatcatgaatagcagata

SEQ ID NO: 134400 - DNA, 22 bp, Artificial Sequence
  Synthetic oligonucleotide; TTT chr11 5279226 5279247 5279231 5279226 -
tcgtatcatgaatagcagatat

SEQ ID NO: 134401 - DNA, 22 bp, Artificial Sequence
  Synthetic oligonucleotide; TTT chr11 5279225 5279246 5279230 5279225 -
cgtatcatgaatagcagatata

SEQ ID NO: 134402 - DNA, 22 bp, Artificial Sequence
  Synthetic oligonucleotide; TTC chr11 5279224 5279245 5279229 5279224 -
gtatcatgaatagcagatatag

SEQ ID NO: 134403 - DNA, 22 bp, Artificial Sequence
  Synthetic oligonucleotide; CTT chr11 5279199 5279220 5279204 5279199 -
gatggccccatgcttggtttaa

SEQ ID NO: 134404 - DNA, 22 bp, Artificial Sequence
  Synthetic oligonucleotide; TTG chr11 5279198 5279219 5279203 5279198 -
atggccccatgcttggtttaac

SEQ ID NO: 134405 - DNA, 22 bp, Artificial Sequence
  Synthetic oligonucleotide; CTT chr11 5279184 5279205 5279189 5279184 -
ggtttaacatccttgctgttcc

SEQ ID NO: 134406 - DNA, 22 bp, Artificial Sequence
  Synthetic oligonucleotide; TTG chr11 5279183 5279204 5279188 5279183 -
gtttaacatccttgctgttcct

SEQ ID NO: 134407 - DNA, 22 bp, Artificial Sequence
  Synthetic oligonucleotide; TTT chr11 5279179 5279200 5279184 5279179 -
aacatccttgctgttcctgaca

SEQ ID NO: 134408 - DNA, 22 bp, Artificial Sequence
  Synthetic oligonucleotide; TTA chr11 5279178 5279199 5279183 5279178 -
acatccttgctgttcctgacat

SEQ ID NO: 134409 - DNA, 22 bp, Artificial Sequence
  Synthetic oligonucleotide; CTT chr11 5279170 5279191 5279175 5279170 -
gctgttcctgacatgaaatcct

SEQ ID NO: 134410 - DNA, 22 bp, Artificial Sequence
  Synthetic oligonucleotide; TTG chr11 5279169 5279190 5279174 5279169 -
ctgttcctgacatgaaatcctt

SEQ ID NO: 134411 - DNA, 22 bp, Artificial Sequence
  Synthetic oligonucleotide; CTG chr11 5279166 5279187 5279171 5279166 -
ttcctgacatgaaatccttaat

SEQ ID NO: 134412 - DNA, 22 bp, Artificial Sequence
  Synthetic oligonucleotide; TTC chr11 5279163 5279184 5279168 5279163 -
ctgacatgaaatccttaatttt

SEQ ID NO: 134413 - DNA, 22 bp, Artificial Sequence
  Synthetic oligonucleotide; CTG chr11 5279160 5279181 5279165 5279160 -
acatgaaatccttaatttttga

SEQ ID NO: 134414 - DNA, 22 bp, Artificial Sequence
  Synthetic oligonucleotide; CTT chr11 5279147 5279168 5279152 5279147 -
aatttttgacaaaggggctatt

SEQ ID NO: 134415 - DNA, 22 bp, Artificial Sequence
  Synthetic oligonucleotide; TTA chr11 5279146 5279167 5279151 5279146 -
atttttgacaaaggggctattc

SEQ ID NO: 134416 - DNA, 22 bp, Artificial Sequence
  Synthetic oligonucleotide; TTT chr11 5279142 5279163 5279147 5279142 -
ttgacaaaggggctattcattt

SEQ ID NO: 134417 - DNA, 22 bp, Artificial Sequence
  Synthetic oligonucleotide; TTT chr11 5279141 5279162 5279146 5279141 -
tgacaaaggggctattcatttt

SEQ ID NO: 134418 - DNA, 22 bp, Artificial Sequence
  Synthetic oligonucleotide; TTT chr11 5279140 5279161 5279145 5279140 -
gacaaaggggctattcattttc

SEQ ID NO: 134419 - DNA, 22 bp, Artificial Sequence
  Synthetic oligonucleotide; TTG chr11 5279139 5279160 5279144 5279139 -
acaaaggggctattcattttca

SEQ ID NO: 134420 - DNA, 22 bp, Artificial Sequence
  Synthetic oligonucleotide; CTA chr11 5279127 5279148 5279132 5279127 -
ttcattttcattttatattggg

SEQ ID NO: 134421 - DNA, 22 bp, Artificial Sequence
  Synthetic oligonucleotide; TTC chr11 5279124 5279145 5279129 5279124 -
attttcattttatattgggcct

SEQ ID NO: 134422 - DNA, 22 bp, Artificial Sequence
  Synthetic oligonucleotide; TTT chr11 5279120 5279141 5279125 5279120 -
tcattttatattgggcctagaa

SEQ ID NO: 134423 - DNA, 22 bp, Artificial Sequence
  Synthetic oligonucleotide; TTT chr11 5279119 5279140 5279124 5279119 -
cattttatattgggcctagaaa

SEQ ID NO: 134424 - DNA, 22 bp, Artificial Sequence
  Synthetic oligonucleotide; TTC chr11 5279118 5279139 5279123 5279118 -
attttatattgggcctagaaat

SEQ ID NO: 134425 - DNA, 22 bp, Artificial Sequence
  Synthetic oligonucleotide; TTT chr11 5279114 5279135 5279119 5279114 -
tatattgggcctagaaattatg

SEQ ID NO: 134426 - DNA, 22 bp, Artificial Sequence
  Synthetic oligonucleotide; TTT chr11 5279113 5279134 5279118 5279113 -
atattgggcctagaaattatgt

SEQ ID NO: 134427 - DNA, 22 bp, Artificial Sequence
  Synthetic oligonucleotide; TTA chr11 5279112 5279133 5279117 5279112 -
tattgggcctagaaattatgta

SEQ ID NO: 134428 - DNA, 22 bp, Artificial Sequence
  Synthetic oligonucleotide; TTG chr11 5279107 5279128 5279112 5279107 -
ggcctagaaattatgtagatgg

SEQ ID NO: 134429 - DNA, 22 bp, Artificial Sequence
  Synthetic oligonucleotide; CTA chr11 5279101 5279122 5279106 5279101 -
gaaattatgtagatggtcctga

SEQ ID NO: 134430 - DNA, 22 bp, Artificial Sequence
  Synthetic oligonucleotide; TTA chr11 5279094 5279115 5279099 5279094 -
tgtagatggtcctgaggaaaag

SEQ ID NO: 134431 - DNA, 22 bp, Artificial Sequence
  Synthetic oligonucleotide; CTG chr11 5279080 5279101 5279085 5279080 -
aggaaaagtttatagcttgtct

SEQ ID NO: 134432 - DNA, 22 bp, Artificial Sequence
  Synthetic oligonucleotide; TTT chr11 5279069 5279090 5279074 5279069 -
atagcttgtctatttctctctc

SEQ ID NO: 134433 - DNA, 22 bp, Artificial Sequence
  Synthetic oligonucleotide; TTA chr11 5279068 5279089 5279073 5279068 -
tagcttgtctatttctctctct

SEQ ID NO: 134434 - DNA, 22 bp, Artificial Sequence
  Synthetic oligonucleotide; CTT chr11 5279062 5279083 5279067 5279062 -
gtctatttctctctctaacata

SEQ ID NO: 134435 - DNA, 22 bp, Artificial Sequence
  Synthetic oligonucleotide; TTG chr11 5279061 5279082 5279066 5279061 -
tctatttctctctctaacatag

SEQ ID NO: 134436 - DNA, 22 bp, Artificial Sequence
  Synthetic oligonucleotide; CTA chr11 5279057 5279078 5279062 5279057 -
tttctctctctaacatagttgt

SEQ ID NO: 134437 - DNA, 22 bp, Artificial Sequence
  Synthetic oligonucleotide; TTT chr11 5279054 5279075 5279059 5279054 -
ctctctctaacatagttgtcag

SEQ ID NO: 134438 - DNA, 22 bp, Artificial Sequence
  Synthetic oligonucleotide; TTC chr11 5279053 5279074 5279058 5279053 -
tctctctaacatagttgtcagc

SEQ ID NO: 134439 - DNA, 22 bp, Artificial Sequence
  Synthetic oligonucleotide; CTC chr11 5279051 5279072 5279056 5279051 -
tctctaacatagttgtcagcac

SEQ ID NO: 134440 - DNA, 22 bp, Artificial Sequence
  Synthetic oligonucleotide; CTC chr11 5279049 5279070 5279054 5279049 -
tctaacatagttgtcagcacaa

SEQ ID NO: 134441 - DNA, 22 bp, Artificial Sequence
  Synthetic oligonucleotide; CTC chr11 5279047 5279068 5279052 5279047 -
taacatagttgtcagcacaatg

SEQ ID NO: 134442 - DNA, 22 bp, Artificial Sequence
  Synthetic oligonucleotide; CTA chr11 5279045 5279066 5279050 5279045 -
acatagttgtcagcacaatgcc

SEQ ID NO: 134443 - DNA, 22 bp, Artificial Sequence
  Synthetic oligonucleotide; TTG chr11 5279036 5279057 5279041 5279036 -
tcagcacaatgcctaggctata

SEQ ID NO: 134444 - DNA, 22 bp, Artificial Sequence
  Synthetic oligonucleotide; CTA chr11 5279021 5279042 5279026 5279021 -
ggctataggaagtactcaaagc

SEQ ID NO: 134445 - DNA, 22 bp, Artificial Sequence
  Synthetic oligonucleotide; CTA chr11 5279016 5279037 5279021 5279016 -
taggaagtactcaaagcttgtt

SEQ ID NO: 134446 - DNA, 22 bp, Artificial Sequence
  Synthetic oligonucleotide; CTC chr11 5279004 5279025 5279009 5279004 -
aaagcttgttaaattgaattct

SEQ ID NO: 134447 - DNA, 22 bp, Artificial Sequence
  Synthetic oligonucleotide; CTT chr11 5278997 5279018 5279002 5278997 -
gttaaattgaattctatccttc

SEQ ID NO: 134448 - DNA, 22 bp, Artificial Sequence
  Synthetic oligonucleotide; TTG chr11 5278996 5279017 5279001 5278996 -
ttaaattgaattctatccttct

SEQ ID NO: 134449 - DNA, 22 bp, Artificial Sequence
  Synthetic oligonucleotide; TTA chr11 5278993 5279014 5278998 5278993 -
aattgaattctatccttcttat

SEQ ID NO: 134450 - DNA, 22 bp, Artificial Sequence
  Synthetic oligonucleotide; TTG chr11 5278988 5279009 5278993 5278988 -
aattctatccttcttattcaat

SEQ ID NO: 134451 - DNA, 22 bp, Artificial Sequence
  Synthetic oligonucleotide; TTC chr11 5278983 5279004 5278988 5278983 -
tatccttcttattcaattctac

SEQ ID NO: 134452 - DNA, 22 bp, Artificial Sequence
  Synthetic oligonucleotide; CTA chr11 5278981 5279002 5278986 5278981 -
tccttcttattcaattctacac

SEQ ID NO: 134453 - DNA, 22 bp, Artificial Sequence
  Synthetic oligonucleotide; CTT chr11 5278976 5278997 5278981 5278976 -
cttattcaattctacacatgga

SEQ ID NO: 134454 - DNA, 22 bp, Artificial Sequence
  Synthetic oligonucleotide; TTC chr11 5278975 5278996 5278980 5278975 -
ttattcaattctacacatggag

SEQ ID NO: 134455 - DNA, 22 bp, Artificial Sequence
  Synthetic oligonucleotide; CTT chr11 5278973 5278994 5278978 5278973 -
attcaattctacacatggagga

SEQ ID NO: 134456 - DNA, 22 bp, Artificial Sequence
  Synthetic oligonucleotide; TTA chr11 5278972 5278993 5278977 5278972 -
ttcaattctacacatggaggaa

SEQ ID NO: 134457 - DNA, 22 bp, Artificial Sequence
  Synthetic oligonucleotide; TTC chr11 5278969 5278990 5278974 5278969 -
aattctacacatggaggaaaaa

SEQ ID NO: 134458 - DNA, 22 bp, Artificial Sequence
  Synthetic oligonucleotide; TTC chr11 5278964 5278985 5278969 5278964 -
tacacatggaggaaaaactcat

SEQ ID NO: 134459 - DNA, 22 bp, Artificial Sequence
  Synthetic oligonucleotide; CTA chr11 5278962 5278983 5278967 5278962 -
cacatggaggaaaaactcatca

SEQ ID NO: 134460 - DNA, 22 bp, Artificial Sequence
  Synthetic oligonucleotide; CTC chr11 5278944 5278965 5278949 5278944 -
atcagggatggaggcacgcctc

SEQ ID NO: 134461 - DNA, 22 bp, Artificial Sequence
  Synthetic oligonucleotide; CTC chr11 5278922 5278943 5278927 5278922 -
taaggaaggcaggtgtggctct

SEQ ID NO: 134462 - DNA, 22 bp, Artificial Sequence
  Synthetic oligonucleotide; CTA chr11 5278920 5278941 5278925 5278920 -
aggaaggcaggtgtggctctgc

SEQ ID NO: 134463 - DNA, 22 bp, Artificial Sequence
  Synthetic oligonucleotide; CTC chr11 5278901 5278922 5278906 5278901 -
tgcagtgtgattgggtacttgc

SEQ ID NO: 134464 - DNA, 22 bp, Artificial Sequence
  Synthetic oligonucleotide; CTG chr11 5278899 5278920 5278904 5278899 -
cagtgtgattgggtacttgcag

SEQ ID NO: 134465 - DNA, 22 bp, Artificial Sequence
  Synthetic oligonucleotide; TTG chr11 5278888 5278909 5278893 5278888 -
ggtacttgcaggacgaagggtg

SEQ ID NO: 134466 - DNA, 22 bp, Artificial Sequence
  Synthetic oligonucleotide; CTT chr11 5278881 5278902 5278886 5278881 -
gcaggacgaagggtggggtggg

SEQ ID NO: 134467 - DNA, 22 bp, Artificial Sequence
  Synthetic oligonucleotide; TTG chr11 5278880 5278901 5278885 5278880 -
caggacgaagggtggggtggga

SEQ ID NO: 134468 - DNA, 22 bp, Artificial Sequence
  Synthetic oligonucleotide; CTA chr11 5278851 5278872 5278856 5278851 -
accttccattcctagtgcagag

SEQ ID NO: 134469 - DNA, 22 bp, Artificial Sequence
  Synthetic oligonucleotide; CTT chr11 5278846 5278867 5278851 5278846 -
ccattcctagtgcagaggtcac

SEQ ID NO: 134470 - DNA, 22 bp, Artificial Sequence
  Synthetic oligonucleotide; TTC chr11 5278845 5278866 5278850 5278845 -
cattcctagtgcagaggtcaca

SEQ ID NO: 134471 - DNA, 22 bp, Artificial Sequence
  Synthetic oligonucleotide; TTC chr11 5278840 5278861 5278845 5278840 -
ctagtgcagaggtcacagccta

SEQ ID NO: 134472 - DNA, 22 bp, Artificial Sequence
  Synthetic oligonucleotide; CTA chr11 5278837 5278858 5278842 5278837 -
gtgcagaggtcacagcctaaac

SEQ ID NO: 134473 - DNA, 22 bp, Artificial Sequence
  Synthetic oligonucleotide; CTA chr11 5278818 5278839 5278823 5278818 -
aacatcaaattccttgaggtgc

SEQ ID NO: 134474 - DNA, 22 bp, Artificial Sequence
  Synthetic oligonucleotide; TTC chr11 5278806 5278827 5278811 5278806 -
cttgaggtgcggtggctcactc

SEQ ID NO: 134475 - DNA, 22 bp, Artificial Sequence
  Synthetic oligonucleotide; CTT chr11 5278803 5278824 5278808 5278803 -
gaggtgcggtggctcactcctg

SEQ ID NO: 134476 - DNA, 22 bp, Artificial Sequence
  Synthetic oligonucleotide; TTG chr11 5278802 5278823 5278807 5278802 -
aggtgcggtggctcactcctgt

SEQ ID NO: 134477 - DNA, 22 bp, Artificial Sequence
  Synthetic oligonucleotide; CTC chr11 5278788 5278809 5278793 5278788 -
actcctgtaatcacagcagttt

SEQ ID NO: 134478 - DNA, 22 bp, Artificial Sequence
  Synthetic oligonucleotide; CTC chr11 5278784 5278805 5278789 5278784 -
ctgtaatcacagcagtttggga

SEQ ID NO: 134479 - DNA, 22 bp, Artificial Sequence
  Synthetic oligonucleotide; CTG chr11 5278781 5278802 5278786 5278781 -
taatcacagcagtttgggacgc

SEQ ID NO: 134480 - DNA, 22 bp, Artificial Sequence
  Synthetic oligonucleotide; TTT chr11 5278766 5278787 5278771 5278766 -
gggacgccaaggtgggcagatc

SEQ ID NO: 134481 - DNA, 22 bp, Artificial Sequence
  Synthetic oligonucleotide; TTG chr11 5278765 5278786 5278770 5278765 -
ggacgccaaggtgggcagatca

SEQ ID NO: 134482 - DNA, 22 bp, Artificial Sequence
  Synthetic oligonucleotide; CTT chr11 5278740 5278761 5278745 5278740 -
gaggtcaggagttggacaccag

SEQ ID NO: 134483 - DNA, 22 bp, Artificial Sequence
  Synthetic oligonucleotide; TTG chr11 5278739 5278760 5278744 5278739 -
aggtcaggagttggacaccagc

SEQ ID NO: 134484 - DNA, 22 bp, Artificial Sequence
  Synthetic oligonucleotide; TTG chr11 5278726 5278747 5278731 5278726 -
gacaccagcccagccaacatag

SEQ ID NO: 134485 - DNA, 22 bp, Artificial Sequence
  Synthetic oligonucleotide; CTG chr11 5278695 5278716 5278700 5278695 -
gtctctgcttaaaaatataaaa

SEQ ID NO: 134486 - DNA, 22 bp, Artificial Sequence
  Synthetic oligonucleotide; CTC chr11 5278690 5278711 5278695 5278690 -
tgcttaaaaatataaaaattag

SEQ ID NO: 134487 - DNA, 22 bp, Artificial Sequence
  Synthetic oligonucleotide; CTG chr11 5278688 5278709 5278693 5278688 -
cttaaaaatataaaaattagct

SEQ ID NO: 134488 - DNA, 22 bp, Artificial Sequence
  Synthetic oligonucleotide; CTT chr11 5278685 5278706 5278690 5278685 -
aaaaatataaaaattagctgga

SEQ ID NO: 134489 - DNA, 22 bp, Artificial Sequence
  Synthetic oligonucleotide; TTA chr11 5278684 5278705 5278689 5278684 -
aaaatataaaaattagctggac

SEQ ID NO: 134490 - DNA, 22 bp, Artificial Sequence
  Synthetic oligonucleotide; TTA chr11 5278669 5278690 5278674 5278669 -
gctggacgtggtgacgggagcc

SEQ ID NO: 134491 - DNA, 22 bp, Artificial Sequence
  Synthetic oligonucleotide; CTG chr11 5278665 5278686 5278670 5278665 -
gacgtggtgacgggagcctgta

SEQ ID NO: 134492 - DNA, 22 bp, Artificial Sequence
  Synthetic oligonucleotide; CTG chr11 5278645 5278666 5278650 5278645 -
taatccaactacttgggaggct

SEQ ID NO: 134493 - DNA, 22 bp, Artificial Sequence
  Synthetic oligonucleotide; CTA chr11 5278634 5278655 5278639 5278634 -
cttgggaggctgaggcaggaga

SEQ ID NO: 134494 - DNA, 22 bp, Artificial Sequence
  Synthetic oligonucleotide; CTT chr11 5278631 5278652 5278636 5278631 -
gggaggctgaggcaggagaatc

SEQ ID NO: 134495 - DNA, 22 bp, Artificial Sequence
  Synthetic oligonucleotide; TTG chr11 5278630 5278651 5278635 5278630 -
ggaggctgaggcaggagaatcg

SEQ ID NO: 134496 - DNA, 22 bp, Artificial Sequence
  Synthetic oligonucleotide; CTG chr11 5278622 5278643 5278627 5278622 -
aggcaggagaatcgcttgaacc

SEQ ID NO: 134497 - DNA, 22 bp, Artificial Sequence
  Synthetic oligonucleotide; CTT chr11 5278605 5278626 5278610 5278605 -
gaaccggggaggtggagtttgc

SEQ ID NO: 134498 - DNA, 22 bp, Artificial Sequence
  Synthetic oligonucleotide; TTG chr11 5278604 5278625 5278609 5278604 -
aaccggggaggtggagtttgca

SEQ ID NO: 134499 - DNA, 22 bp, Artificial Sequence
  Synthetic oligonucleotide; TTT chr11 5278585 5278606 5278590 5278585 -
gcactgagcagagatcatgcca

SEQ ID NO: 134500 - DNA, 22 bp, Artificial Sequence
  Synthetic oligonucleotide; TTG chr11 5278584 5278605 5278589 5278584 -
cactgagcagagatcatgccat

SEQ ID NO: 134501 - DNA, 22 bp, Artificial Sequence
  Synthetic oligonucleotide; CTG chr11 5278579 5278600 5278584 5278579 -
agcagagatcatgccattgcac

SEQ ID NO: 134502 - DNA, 22 bp, Artificial Sequence
  Synthetic oligonucleotide; TTG chr11 5278560 5278581 5278565 5278560 -
cactccagcctccagagcgaga

SEQ ID NO: 134503 - DNA, 22 bp, Artificial Sequence
  Synthetic oligonucleotide; CTC chr11 5278555 5278576 5278560 5278555 -
cagcctccagagcgagactctg

SEQ ID NO: 134504 - DNA, 22 bp, Artificial Sequence
  Synthetic oligonucleotide; CTC chr11 5278548 5278569 5278553 5278548 -
cagagcgagactctgtctaaag

SEQ ID NO: 134505 - DNA, 22 bp, Artificial Sequence
  Synthetic oligonucleotide; CTC chr11 5278535 5278556 5278540 5278535 -
tgtctaaagaaaaacgaaaaca

SEQ ID NO: 134506 - DNA, 22 bp, Artificial Sequence
  Synthetic oligonucleotide; CTG chr11 5278533 5278554 5278538 5278533 -
tctaaagaaaaacgaaaacaaa

SEQ ID NO: 134507 - DNA, 22 bp, Artificial Sequence
  Synthetic oligonucleotide; CTA chr11 5278529 5278550 5278534 5278529 -
aagaaaaacgaaaacaaacaaa

SEQ ID NO: 134508 - DNA, 22 bp, Artificial Sequence
  Synthetic oligonucleotide; TTC chr11 5278478 5278499 5278483 5278478 -
cctgaccgaacagaattctgtc

SEQ ID NO: 134509 - DNA, 22 bp, Artificial Sequence
  Synthetic oligonucleotide; CTG chr11 5278474 5278495 5278479 5278474 -
accgaacagaattctgtctgat

SEQ ID NO: 134510 - DNA, 22 bp, Artificial Sequence
  Synthetic oligonucleotide; TTC chr11 5278460 5278481 5278465 5278460 -
tgtctgattgttctctgactta

SEQ ID NO: 134511 - DNA, 22 bp, Artificial Sequence
  Synthetic oligonucleotide; CTG chr11 5278458 5278479 5278463 5278458 -
tctgattgttctctgacttatc

SEQ ID NO: 134512 - DNA, 22 bp, Artificial Sequence
  Synthetic oligonucleotide; CTG chr11 5278454 5278475 5278459 5278454 -
attgttctctgacttatctacc

SEQ ID NO: 134513 - DNA, 22 bp, Artificial Sequence
  Synthetic oligonucleotide; TTG chr11 5278450 5278471 5278455 5278450 -
ttctctgacttatctaccattt

SEQ ID NO: 134514 - DNA, 22 bp, Artificial Sequence
  Synthetic oligonucleotide; TTC chr11 5278447 5278468 5278452 5278447 -
tctgacttatctaccattttcc

SEQ ID NO: 134515 - DNA, 22 bp, Artificial Sequence
  Synthetic oligonucleotide; CTC chr11 5278445 5278466 5278450 5278445 -
tgacttatctaccattttccct

SEQ ID NO: 134516 - DNA, 22 bp, Artificial Sequence
  Synthetic oligonucleotide; CTG chr11 5278443 5278464 5278448 5278443 -
acttatctaccattttccctcc

SEQ ID NO: 134517 - DNA, 22 bp, Artificial Sequence
  Synthetic oligonucleotide; CTT chr11 5278439 5278460 5278444 5278439 -
atctaccattttccctccttaa

SEQ ID NO: 134518 - DNA, 22 bp, Artificial Sequence
  Synthetic oligonucleotide; TTA chr11 5278438 5278459 5278443 5278438 -
tctaccattttccctccttaaa

SEQ ID NO: 134519 - DNA, 22 bp, Artificial Sequence
  Synthetic oligonucleotide; CTA chr11 5278434 5278455 5278439 5278434 -
ccattttccctccttaaagaaa

SEQ ID NO: 134520 - DNA, 22 bp, Artificial Sequence
  Synthetic oligonucleotide; TTT chr11 5278428 5278449 5278433 5278428 -
tccctccttaaagaaactgtga

SEQ ID NO: 134521 - DNA, 22 bp, Artificial Sequence
  Synthetic oligonucleotide; TTT chr11 5278427 5278448 5278432 5278427 -
ccctccttaaagaaactgtgaa

SEQ ID NO: 134522 - DNA, 22 bp, Artificial Sequence
  Synthetic oligonucleotide; TTC chr11 5278426 5278447 5278431 5278426 -
cctccttaaagaaactgtgaac

SEQ ID NO: 134523 - DNA, 22 bp, Artificial Sequence
  Synthetic oligonucleotide; CTC chr11 5278422 5278443 5278427 5278422 -
cttaaagaaactgtgaacttcc

SEQ ID NO: 134524 - DNA, 22 bp, Artificial Sequence
  Synthetic oligonucleotide; CTT chr11 5278419 5278440 5278424 5278419 -
aaagaaactgtgaacttccttc

SEQ ID NO: 134525 - DNA, 22 bp, Artificial Sequence
  Synthetic oligonucleotide; TTA chr11 5278418 5278439 5278423 5278418 -
aagaaactgtgaacttccttca

SEQ ID NO: 134526 - DNA, 22 bp, Artificial Sequence
  Synthetic oligonucleotide; CTG chr11 5278409 5278430 5278414 5278409 -
tgaacttccttcagctagaggg

SEQ ID NO: 134527 - DNA, 22 bp, Artificial Sequence
  Synthetic oligonucleotide; CTT chr11 5278402 5278423 5278407 5278402 -
ccttcagctagaggggcctggc

SEQ ID NO: 134528 - DNA, 22 bp, Artificial Sequence
  Synthetic oligonucleotide; TTC chr11 5278401 5278422 5278406 5278401 -
cttcagctagaggggcctggct

SEQ ID NO: 134529 - DNA, 22 bp, Artificial Sequence
  Synthetic oligonucleotide; CTT chr11 5278398 5278419 5278403 5278398 -
cagctagaggggcctggctcag

SEQ ID NO: 134530 - DNA, 22 bp, Artificial Sequence
  Synthetic oligonucleotide; TTC chr11 5278397 5278418 5278402 5278397 -
agctagaggggcctggctcaga

SEQ ID NO: 134531 - DNA, 22 bp, Artificial Sequence
  Synthetic oligonucleotide; CTA chr11 5278392 5278413 5278397 5278392 -
gaggggcctggctcagaagcct

SEQ ID NO: 134532 - DNA, 22 bp, Artificial Sequence
  Synthetic oligonucleotide; CTG chr11 5278382 5278403 5278387 5278382 -
gctcagaagcctctggtcagca

SEQ ID NO: 134533 - DNA, 22 bp, Artificial Sequence
  Synthetic oligonucleotide; CTC chr11 5278378 5278399 5278383 5278378 -
agaagcctctggtcagcatcca

SEQ ID NO: 134534 - DNA, 22 bp, Artificial Sequence
  Synthetic oligonucleotide; CTC chr11 5278369 5278390 5278374 5278369 -
tggtcagcatccaagaaatact

SEQ ID NO: 134535 - DNA, 22 bp, Artificial Sequence
  Synthetic oligonucleotide; CTG chr11 5278367 5278388 5278372 5278367 -
gtcagcatccaagaaatacttg

SEQ ID NO: 134536 - DNA, 22 bp, Artificial Sequence
  Synthetic oligonucleotide; CTT chr11 5278346 5278367 5278351 5278346 -
gatgtcactttggctaaaggta

SEQ ID NO: 134537 - DNA, 22 bp, Artificial Sequence
  Synthetic oligonucleotide; TTG chr11 5278345 5278366 5278350 5278345 -
atgtcactttggctaaaggtat

SEQ ID NO: 134538 - DNA, 22 bp, Artificial Sequence
  Synthetic oligonucleotide; CTT chr11 5278336 5278357 5278341 5278336 -
tggctaaaggtatgatgtgtag

SEQ ID NO: 134539 - DNA, 22 bp, Artificial Sequence
  Synthetic oligonucleotide; TTT chr11 5278335 5278356 5278340 5278335 -
ggctaaaggtatgatgtgtaga

SEQ ID NO: 134540 - DNA, 22 bp, Artificial Sequence
  Synthetic oligonucleotide; TTG chr11 5278334 5278355 5278339 5278334 -
gctaaaggtatgatgtgtagac

SEQ ID NO: 134541 - DNA, 22 bp, Artificial Sequence
  Synthetic oligonucleotide; CTA chr11 5278330 5278351 5278335 5278330 -
aaggtatgatgtgtagacaagc

SEQ ID NO: 134542 - DNA, 22 bp, Artificial Sequence
  Synthetic oligonucleotide; CTC chr11 5278306 5278327 5278311 5278306 -
cagagatggtttctcatttcca

SEQ ID NO: 134543 - DNA, 22 bp, Artificial Sequence
  Synthetic oligonucleotide; TTT chr11 5278294 5278315 5278299 5278294 -
ctcatttccatatccacccacc

SEQ ID NO: 134544 - DNA, 22 bp, Artificial Sequence
  Synthetic oligonucleotide; TTC chr11 5278293 5278314 5278298 5278293 -
tcatttccatatccacccaccc

SEQ ID NO: 134545 - DNA, 22 bp, Artificial Sequence
  Synthetic oligonucleotide; CTC chr11 5278291 5278312 5278296 5278291 -
atttccatatccacccacccag

SEQ ID NO: 134546 - DNA, 22 bp, Artificial Sequence
  Synthetic oligonucleotide; TTT chr11 5278287 5278308 5278292 5278287 -
ccatatccacccacccagcttt

SEQ ID NO: 134547 - DNA, 22 bp, Artificial Sequence
  Synthetic oligonucleotide; TTC chr11 5278286 5278307 5278291 5278286 -
catatccacccacccagctttc

SEQ ID NO: 134548 - DNA, 22 bp, Artificial Sequence
  Synthetic oligonucleotide; CTT chr11 5278266 5278287 5278271 5278266 -
tccaattttaaagccaattctg

SEQ ID NO: 134549 - DNA, 22 bp, Artificial Sequence
  Synthetic oligonucleotide; TTT chr11 5278265 5278286 5278270 5278265 -
ccaattttaaagccaattctga

SEQ ID NO: 134550 - DNA, 22 bp, Artificial Sequence
  Synthetic oligonucleotide; TTC chr11 5278264 5278285 5278269 5278264 -
caattttaaagccaattctgag

SEQ ID NO: 134551 - DNA, 22 bp, Artificial Sequence
  Synthetic oligonucleotide; TTT chr11 5278258 5278279 5278263 5278258 -
taaagccaattctgaggtagag

SEQ ID NO: 134552 - DNA, 22 bp, Artificial Sequence
  Synthetic oligonucleotide; TTT chr11 5278257 5278278 5278262 5278257 -
aaagccaattctgaggtagaga

SEQ ID NO: 134553 - DNA, 22 bp, Artificial Sequence
  Synthetic oligonucleotide; TTA chr11 5278256 5278277 5278261 5278256 -
aagccaattctgaggtagagac

SEQ ID NO: 134554 - DNA, 22 bp, Artificial Sequence
  Synthetic oligonucleotide; TTC chr11 5278246 5278267 5278251 5278246 -
tgaggtagagactgtgatgaac

SEQ ID NO: 134555 - DNA, 22 bp, Artificial Sequence
  Synthetic oligonucleotide; CTG chr11 5278244 5278265 5278249 5278244 -
aggtagagactgtgatgaacaa

SEQ ID NO: 134556 - DNA, 22 bp, Artificial Sequence
  Synthetic oligonucleotide; CTG chr11 5278232 5278253 5278237 5278232 -
tgatgaacaaacaccttgacaa

SEQ ID NO: 134557 - DNA, 22 bp, Artificial Sequence
  Synthetic oligonucleotide; CTT chr11 5278215 5278236 5278220 5278215 -
gacaaaattcaacccaaagact

SEQ ID NO: 134558 - DNA, 22 bp, Artificial Sequence
  Synthetic oligonucleotide; TTG chr11 5278214 5278235 5278219 5278214 -
acaaaattcaacccaaagactc

SEQ ID NO: 134559 - DNA, 22 bp, Artificial Sequence
  Synthetic oligonucleotide; TTC chr11 5278205 5278226 5278210 5278205 -
aacccaaagactcactttgcct

SEQ ID NO: 134560 - DNA, 22 bp, Artificial Sequence
  Synthetic oligonucleotide; CTC chr11 5278192 5278213 5278197 5278192 -
actttgcctagcttcaaaatcc

SEQ ID NO: 134561 - DNA, 22 bp, Artificial Sequence
  Synthetic oligonucleotide; CTT chr11 5278188 5278209 5278193 5278188 -
tgcctagcttcaaaatccttac

SEQ ID NO: 134562 - DNA, 22 bp, Artificial Sequence
  Synthetic oligonucleotide; TTT chr11 5278187 5278208 5278192 5278187 -
gcctagcttcaaaatccttact

SEQ ID NO: 134563 - DNA, 22 bp, Artificial Sequence
  Synthetic oligonucleotide; TTG chr11 5278186 5278207 5278191 5278186 -
cctagcttcaaaatccttactc

SEQ ID NO: 134564 - DNA, 22 bp, Artificial Sequence
  Synthetic oligonucleotide; CTA chr11 5278182 5278203 5278187 5278182 -
gcttcaaaatccttactctgac

SEQ ID NO: 134565 - DNA, 22 bp, Artificial Sequence
  Synthetic oligonucleotide; CTT chr11 5278178 5278199 5278183 5278178 -
caaaatccttactctgacatat

SEQ ID NO: 134566 - DNA, 22 bp, Artificial Sequence
  Synthetic oligonucleotide; TTC chr11 5278177 5278198 5278182 5278177 -
aaaatccttactctgacatata

SEQ ID NO: 134567 - DNA, 22 bp, Artificial Sequence
  Synthetic oligonucleotide; CTT chr11 5278168 5278189 5278173 5278168 -
actctgacatatactcacagcc

SEQ ID NO: 134568 - DNA, 22 bp, Artificial Sequence
  Synthetic oligonucleotide; TTA chr11 5278167 5278188 5278172 5278167 -
ctctgacatatactcacagcca

SEQ ID NO: 134569 - DNA, 22 bp, Artificial Sequence
  Synthetic oligonucleotide; CTC chr11 5278164 5278185 5278169 5278164 -
tgacatatactcacagccagaa

SEQ ID NO: 134570 - DNA, 22 bp, Artificial Sequence
  Synthetic oligonucleotide; CTG chr11 5278162 5278183 5278167 5278162 -
acatatactcacagccagaaat

SEQ ID NO: 134571 - DNA, 22 bp, Artificial Sequence
  Synthetic oligonucleotide; CTC chr11 5278152 5278173 5278157 5278152 -
acagccagaaattagcatgcac

SEQ ID NO: 134572 - DNA, 22 bp, Artificial Sequence
  Synthetic oligonucleotide; TTA chr11 5278138 5278159 5278143 5278138 -
gcatgcactagagtgtgcatga

SEQ ID NO: 134573 - DNA, 22 bp, Artificial Sequence
  Synthetic oligonucleotide; CTA chr11 5278128 5278149 5278133 5278128 -
gagtgtgcatgagtgcaacaca

SEQ ID NO: 134574 - DNA, 22 bp, Artificial Sequence
  Synthetic oligonucleotide; TTC chr11 5278091 5278112 5278096 5278091 -
catattctctgtcagaaaatcc

SEQ ID NO: 134575 - DNA, 22 bp, Artificial Sequence
  Synthetic oligonucleotide; TTC chr11 5278084 5278105 5278089 5278084 -
tctgtcagaaaatcctgttggt

SEQ ID NO: 134576 - DNA, 22 bp, Artificial Sequence
  Synthetic oligonucleotide; CTC chr11 5278082 5278103 5278087 5278082 -
tgtcagaaaatcctgttggttt

SEQ ID NO: 134577 - DNA, 22 bp, Artificial Sequence
  Synthetic oligonucleotide; CTG chr11 5278080 5278101 5278085 5278080 -
tcagaaaatcctgttggttttt

SEQ ID NO: 134578 - DNA, 22 bp, Artificial Sequence
  Synthetic oligonucleotide; CTG chr11 5278067 5278088 5278072 5278067 -
ttggtttttcgtgaaaggatgt

SEQ ID NO: 134579 - DNA, 22 bp, Artificial Sequence
  Synthetic oligonucleotide; TTG chr11 5278064 5278085 5278069 5278064 -
gtttttcgtgaaaggatgtttt

SEQ ID NO: 134580 - DNA, 22 bp, Artificial Sequence
  Synthetic oligonucleotide; TTT chr11 5278060 5278081 5278065 5278060 -
ttcgtgaaaggatgttttcaga

SEQ ID NO: 134581 - DNA, 22 bp, Artificial Sequence
  Synthetic oligonucleotide; TTT chr11 5278059 5278080 5278064 5278059 -
tcgtgaaaggatgttttcagag

SEQ ID NO: 134582 - DNA, 22 bp, Artificial Sequence
  Synthetic oligonucleotide; TTT chr11 5278058 5278079 5278063 5278058 -
cgtgaaaggatgttttcagagg

SEQ ID NO: 134583 - DNA, 22 bp, Artificial Sequence
  Synthetic oligonucleotide; TTC chr11 5278057 5278078 5278062 5278057 -
gtgaaaggatgttttcagaggc

SEQ ID NO: 134584 - DNA, 22 bp, Artificial Sequence
  Synthetic oligonucleotide; TTT chr11 5278043 5278064 5278048 5278043 -
tcagaggctgaccccttgcctt

SEQ ID NO: 134585 - DNA, 22 bp, Artificial Sequence
  Synthetic oligonucleotide; TTT chr11 5278042 5278063 5278047 5278042 -
cagaggctgaccccttgccttc

SEQ ID NO: 134586 - DNA, 22 bp, Artificial Sequence
  Synthetic oligonucleotide; TTC chr11 5278041 5278062 5278046 5278041 -
agaggctgaccccttgccttca

SEQ ID NO: 134587 - DNA, 22 bp, Artificial Sequence
  Synthetic oligonucleotide; CTG chr11 5278033 5278054 5278038 5278033 -
accccttgccttcacctccaat

SEQ ID NO: 134588 - DNA, 22 bp, Artificial Sequence
  Synthetic oligonucleotide; CTT chr11 5278026 5278047 5278031 5278026 -
gccttcacctccaatgctacca

SEQ ID NO: 134589 - DNA, 22 bp, Artificial Sequence
  Synthetic oligonucleotide; TTG chr11 5278025 5278046 5278030 5278025 -
ccttcacctccaatgctaccac

SEQ ID NO: 134590 - DNA, 22 bp, Artificial Sequence
  Synthetic oligonucleotide; CTT chr11 5278021 5278042 5278026 5278021 -
cacctccaatgctaccactctg

SEQ ID NO: 134591 - DNA, 22 bp, Artificial Sequence
  Synthetic oligonucleotide; TTC chr11 5278020 5278041 5278025 5278020 -
acctccaatgctaccactctgg

SEQ ID NO: 134592 - DNA, 22 bp, Artificial Sequence
  Synthetic oligonucleotide; CTC chr11 5278015 5278036 5278020 5278015 -
caatgctaccactctggtctaa

SEQ ID NO: 134593 - DNA, 22 bp, Artificial Sequence
  Synthetic oligonucleotide; CTA chr11 5278007 5278028 5278012 5278007 -
ccactctggtctaagtcactgt

SEQ ID NO: 134594 - DNA, 22 bp, Artificial Sequence
  Synthetic oligonucleotide; CTC chr11 5278001 5278022 5278006 5278001 -
tggtctaagtcactgtcaccac

SEQ ID NO: 134595 - DNA, 22 bp, Artificial Sequence
  Synthetic oligonucleotide; CTG chr11 5277999 5278020 5278004 5277999 -
gtctaagtcactgtcaccacca

SEQ ID NO: 134596 - DNA, 22 bp, Artificial Sequence
  Synthetic oligonucleotide; CTA chr11 5277994 5278015 5277999 5277994 -
agtcactgtcaccaccacctaa

SEQ ID NO: 134597 - DNA, 22 bp, Artificial Sequence
  Synthetic oligonucleotide; CTG chr11 5277986 5278007 5277991 5277986 -
tcaccaccacctaaattatagc

SEQ ID NO: 134598 - DNA, 22 bp, Artificial Sequence
  Synthetic oligonucleotide; CTA chr11 5277973 5277994 5277978 5277973 -
aattatagctgttgactcataa

SEQ ID NO: 134599 - DNA, 22 bp, Artificial Sequence
  Synthetic oligonucleotide; TTA chr11 5277968 5277989 5277973 5277968 -
tagctgttgactcataacaatc

SEQ ID NO: 134600 - DNA, 22 bp, Artificial Sequence
  Synthetic oligonucleotide; CTG chr11 5277962 5277983 5277967 5277962 -
ttgactcataacaatcttcctg

SEQ ID NO: 134601 - DNA, 22 bp, Artificial Sequence
  Synthetic oligonucleotide; TTG chr11 5277959 5277980 5277964 5277959 -
actcataacaatcttcctgctt

SEQ ID NO: 134602 - DNA, 22 bp, Artificial Sequence
  Synthetic oligonucleotide; CTC chr11 5277955 5277976 5277960 5277955 -
ataacaatcttcctgcttctac

SEQ ID NO: 134603 - DNA, 22 bp, Artificial Sequence
  Synthetic oligonucleotide; CTT chr11 5277944 5277965 5277949 5277944 -
cctgcttctaccactgccccac

SEQ ID NO: 134604 - DNA, 22 bp, Artificial Sequence
  Synthetic oligonucleotide; TTC chr11 5277943 5277964 5277948 5277943 -
ctgcttctaccactgccccact

SEQ ID NO: 134605 - DNA, 22 bp, Artificial Sequence
  Synthetic oligonucleotide; CTG chr11 5277940 5277961 5277945 5277940 -
cttctaccactgccccactaca

SEQ ID NO: 134606 - DNA, 22 bp, Artificial Sequence
  Synthetic oligonucleotide; CTT chr11 5277937 5277958 5277942 5277937 -
ctaccactgccccactacaatt

SEQ ID NO: 134607 - DNA, 22 bp, Artificial Sequence
  Synthetic oligonucleotide; TTC chr11 5277936 5277957 5277941 5277936 -
taccactgccccactacaattt

SEQ ID NO: 134608 - DNA, 22 bp, Artificial Sequence
  Synthetic oligonucleotide; CTA chr11 5277934 5277955 5277939 5277934 -
ccactgccccactacaatttct

SEQ ID NO: 134609 - DNA, 22 bp, Artificial Sequence
  Synthetic oligonucleotide; CTG chr11 5277928 5277949 5277933 5277928 -
ccccactacaatttcttcccaa

SEQ ID NO: 134610 - DNA, 22 bp, Artificial Sequence
  Synthetic oligonucleotide; CTA chr11 5277920 5277941 5277925 5277920 -
caatttcttcccaatatactat

SEQ ID NO: 134611 - DNA, 22 bp, Artificial Sequence
  Synthetic oligonucleotide; TTT chr11 5277914 5277935 5277919 5277914 -
cttcccaatatactatccaaat

SEQ ID NO: 134612 - DNA, 22 bp, Artificial Sequence
  Synthetic oligonucleotide; TTC chr11 5277913 5277934 5277918 5277913 -
ttcccaatatactatccaaatt

SEQ ID NO: 134613 - DNA, 22 bp, Artificial Sequence
  Synthetic oligonucleotide; CTT chr11 5277911 5277932 5277916 5277911 -
cccaatatactatccaaattag

SEQ ID NO: 134614 - DNA, 22 bp, Artificial Sequence
  Synthetic oligonucleotide; TTC chr11 5277910 5277931 5277915 5277910 -
ccaatatactatccaaattagt

SEQ ID NO: 134615 - DNA, 22 bp, Artificial Sequence
  Synthetic oligonucleotide; CTA chr11 5277899 5277920 5277904 5277899 -
tccaaattagtcttttcaaaat

SEQ ID NO: 134616 - DNA, 22 bp, Artificial Sequence
  Synthetic oligonucleotide; TTA chr11 5277890 5277911 5277895 5277890 -
gtcttttcaaaatgtaagtcat

SEQ ID NO: 134617 - DNA, 22 bp, Artificial Sequence
  Synthetic oligonucleotide; CTT chr11 5277885 5277906 5277890 5277885 -
ttcaaaatgtaagtcatatatg

SEQ ID NO: 134618 - DNA, 22 bp, Artificial Sequence
  Synthetic oligonucleotide; TTT chr11 5277884 5277905 5277889 5277884 -
tcaaaatgtaagtcatatatgg

SEQ ID NO: 134619 - DNA, 22 bp, Artificial Sequence
  Synthetic oligonucleotide; TTT chr11 5277883 5277904 5277888 5277883 -
caaaatgtaagtcatatatggt

SEQ ID NO: 134620 - DNA, 22 bp, Artificial Sequence
  Synthetic oligonucleotide; TTC chr11 5277882 5277903 5277887 5277882 -
aaaatgtaagtcatatatggtc

SEQ ID NO: 134621 - DNA, 22 bp, Artificial Sequence
  Synthetic oligonucleotide; CTC chr11 5277855 5277876 5277860 5277855 -
tttgttcaaagtcttctgatag

SEQ ID NO: 134622 - DNA, 22 bp, Artificial Sequence
  Synthetic oligonucleotide; CTT chr11 5277853 5277874 5277858 5277853 -
tgttcaaagtcttctgatagtt

SEQ ID NO: 134623 - DNA, 22 bp, Artificial Sequence
  Synthetic oligonucleotide; TTT chr11 5277852 5277873 5277857 5277852 -
gttcaaagtcttctgatagttt

SEQ ID NO: 134624 - DNA, 22 bp, Artificial Sequence
  Synthetic oligonucleotide; TTG chr11 5277851 5277872 5277856 5277851 -
ttcaaagtcttctgatagtttc

SEQ ID NO: 134625 - DNA, 22 bp, Artificial Sequence
  Synthetic oligonucleotide; TTC chr11 5277848 5277869 5277853 5277848 -
aaagtcttctgatagtttccta

SEQ ID NO: 134626 - DNA, 22 bp, Artificial Sequence
  Synthetic oligonucleotide; CTT chr11 5277840 5277861 5277845 5277840 -
ctgatagtttcctatatcattt

SEQ ID NO: 134627 - DNA, 22 bp, Artificial Sequence
  Synthetic oligonucleotide; TTC chr11 5277839 5277860 5277844 5277839 -
tgatagtttcctatatcattta

SEQ ID NO: 134628 - DNA, 22 bp, Artificial Sequence
  Synthetic oligonucleotide; CTG chr11 5277837 5277858 5277842 5277837 -
atagtttcctatatcatttata

SEQ ID NO: 134629 - DNA, 22 bp, Artificial Sequence
  Synthetic oligonucleotide; TTT chr11 5277830 5277851 5277835 5277830 -
cctatatcatttataataaaac

SEQ ID NO: 134630 - DNA, 22 bp, Artificial Sequence
  Synthetic oligonucleotide; TTC chr11 5277829 5277850 5277834 5277829 -
ctatatcatttataataaaacc

SEQ ID NO: 134631 - DNA, 22 bp, Artificial Sequence
  Synthetic oligonucleotide; CTA chr11 5277826 5277847 5277831 5277826 -
tatcatttataataaaaccaaa

SEQ ID NO: 134632 - DNA, 22 bp, Artificial Sequence
  Synthetic oligonucleotide; TTT chr11 5277818 5277839 5277823 5277818 -
ataataaaaccaaatccttaca

SEQ ID NO: 134633 - DNA, 22 bp, Artificial Sequence
  Synthetic oligonucleotide; TTA chr11 5277817 5277838 5277822 5277817 -
taataaaaccaaatccttacaa

SEQ ID NO: 134634 - DNA, 22 bp, Artificial Sequence
  Synthetic oligonucleotide; CTT chr11 5277799 5277820 5277804 5277799 -
acaattctctacaatagttgtt

SEQ ID NO: 134635 - DNA, 22 bp, Artificial Sequence
  Synthetic oligonucleotide; TTA chr11 5277798 5277819 5277803 5277798 -
caattctctacaatagttgttc

SEQ ID NO: 134636 - DNA, 22 bp, Artificial Sequence
  Synthetic oligonucleotide; TTC chr11 5277792 5277813 5277797 5277792 -
tctacaatagttgttcatgcat

SEQ ID NO: 134637 - DNA, 22 bp, Artificial Sequence
  Synthetic oligonucleotide; CTC chr11 5277790 5277811 5277795 5277790 -
tacaatagttgttcatgcatat

SEQ ID NO: 134638 - DNA, 22 bp, Artificial Sequence
  Synthetic oligonucleotide; CTA chr11 5277788 5277809 5277793 5277788 -
caatagttgttcatgcatatat

SEQ ID NO: 134639 - DNA, 22 bp, Artificial Sequence
  Synthetic oligonucleotide; TTG chr11 5277779 5277800 5277784 5277779 -
ttcatgcatatattatgtttat

SEQ ID NO: 134640 - DNA, 22 bp, Artificial Sequence
  Synthetic oligonucleotide; TTC chr11 5277776 5277797 5277781 5277776 -
atgcatatattatgtttattac

SEQ ID NO: 134641 - DNA, 22 bp, Artificial Sequence
  Synthetic oligonucleotide; TTA chr11 5277764 5277785 5277769 5277764 -
tgtttattacagatacatatat

SEQ ID NO: 134642 - DNA, 22 bp, Artificial Sequence
  Synthetic oligonucleotide; TTT chr11 5277759 5277780 5277764 5277759 -
attacagatacatatatatagc

SEQ ID NO: 134643 - DNA, 22 bp, Artificial Sequence
  Synthetic oligonucleotide; TTA chr11 5277758 5277779 5277763 5277758 -
ttacagatacatatatatagct

SEQ ID NO: 134644 - DNA, 22 bp, Artificial Sequence
  Synthetic oligonucleotide; TTA chr11 5277755 5277776 5277760 5277755 -
cagatacatatatatagctctc

SEQ ID NO: 134645 - DNA, 22 bp, Artificial Sequence
  Synthetic oligonucleotide; CTC chr11 5277735 5277756 5277740 5277735 -
tcatataaataaatatatatat

SEQ ID NO: 134646 - DNA, 22 bp, Artificial Sequence
  Synthetic oligonucleotide; CTC chr11 5277733 5277754 5277738 5277733 -
atataaataaatatatatattt

SEQ ID NO: 134647 - DNA, 22 bp, Artificial Sequence
  Synthetic oligonucleotide; TTT chr11 5277711 5277732 5277716 5277711 -
atgtgtatgtgtgtagagtgtt

SEQ ID NO: 134648 - DNA, 22 bp, Artificial Sequence
  Synthetic oligonucleotide; TTA chr11 5277710 5277731 5277715 5277710 -
tgtgtatgtgtgtagagtgttt

SEQ ID NO: 134649 - DNA, 22 bp, Artificial Sequence
  Synthetic oligonucleotide; TTT chr11 5277688 5277709 5277693 5277688 -
tttcttacaactctatgatgta

SEQ ID NO: 134650 - DNA, 22 bp, Artificial Sequence
  Synthetic oligonucleotide; TTT chr11 5277687 5277708 5277692 5277687 -
ttcttacaactctatgatgtag

SEQ ID NO: 134651 - DNA, 22 bp, Artificial Sequence
  Synthetic oligonucleotide; TTT chr11 5277686 5277707 5277691 5277686 -
tcttacaactctatgatgtagg

SEQ ID NO: 134652 - DNA, 22 bp, Artificial Sequence
  Synthetic oligonucleotide; TTT chr11 5277685 5277706 5277690 5277685 -
cttacaactctatgatgtaggt

SEQ ID NO: 134653 - DNA, 22 bp, Artificial Sequence
  Synthetic oligonucleotide; TTC chr11 5277684 5277705 5277689 5277684 -
ttacaactctatgatgtaggta

SEQ ID NO: 134654 - DNA, 22 bp, Artificial Sequence
  Synthetic oligonucleotide; CTT chr11 5277682 5277703 5277687 5277682 -
acaactctatgatgtaggtatt

SEQ ID NO: 134655 - DNA, 22 bp, Artificial Sequence
  Synthetic oligonucleotide; TTA chr11 5277681 5277702 5277686 5277681 -
caactctatgatgtaggtatta

SEQ ID NO: 134656 - DNA, 22 bp, Artificial Sequence
  Synthetic oligonucleotide; CTC chr11 5277675 5277696 5277680 5277675 -
tatgatgtaggtattattagtg

SEQ ID NO: 134657 - DNA, 22 bp, Artificial Sequence
  Synthetic oligonucleotide; CTA chr11 5277673 5277694 5277678 5277673 -
tgatgtaggtattattagtgtc

SEQ ID NO: 134658 - DNA, 22 bp, Artificial Sequence
  Synthetic oligonucleotide; TTA chr11 5277659 5277680 5277664 5277659 -
ttagtgtcccaaattttataat

SEQ ID NO: 134659 - DNA, 22 bp, Artificial Sequence
  Synthetic oligonucleotide; TTA chr11 5277656 5277677 5277661 5277656 -
gtgtcccaaattttataattta

SEQ ID NO: 134660 - DNA, 22 bp, Artificial Sequence
  Synthetic oligonucleotide; TTT chr11 5277643 5277664 5277648 5277643 -
tataatttaggacttctatgat

SEQ ID NO: 134661 - DNA, 22 bp, Artificial Sequence
  Synthetic oligonucleotide; TTT chr11 5277642 5277663 5277647 5277642 -
ataatttaggacttctatgatc

SEQ ID NO: 134662 - DNA, 22 bp, Artificial Sequence
  Synthetic oligonucleotide; TTA chr11 5277641 5277662 5277646 5277641 -
taatttaggacttctatgatct

SEQ ID NO: 134663 - DNA, 22 bp, Artificial Sequence
  Synthetic oligonucleotide; TTT chr11 5277635 5277656 5277640 5277635 -
aggacttctatgatctcatctt

SEQ ID NO: 134664 - DNA, 22 bp, Artificial Sequence
  Synthetic oligonucleotide; TTA chr11 5277634 5277655 5277639 5277634 -
ggacttctatgatctcatcttt

SEQ ID NO: 134665 - DNA, 22 bp, Artificial Sequence
  Synthetic oligonucleotide; CTT chr11 5277628 5277649 5277633 5277628 -
ctatgatctcatcttttattct

SEQ ID NO: 134666 - DNA, 22 bp, Artificial Sequence
  Synthetic oligonucleotide; TTC chr11 5277627 5277648 5277632 5277627 -
tatgatctcatcttttattctc

SEQ ID NO: 134667 - DNA, 22 bp, Artificial Sequence
  Synthetic oligonucleotide; CTA chr11 5277625 5277646 5277630 5277625 -
tgatctcatcttttattctccc

SEQ ID NO: 134668 - DNA, 22 bp, Artificial Sequence
  Synthetic oligonucleotide; CTC chr11 5277618 5277639 5277623 5277618 -
atcttttattctccccttcacc

SEQ ID NO: 134669 - DNA, 22 bp, Artificial Sequence
  Synthetic oligonucleotide; CTT chr11 5277613 5277634 5277618 5277613 -
ttattctccccttcaccgaatc

SEQ ID NO: 134670 - DNA, 22 bp, Artificial Sequence
  Synthetic oligonucleotide; TTT chr11 5277612 5277633 5277617 5277612 -
tattctccccttcaccgaatct

SEQ ID NO: 134671 - DNA, 22 bp, Artificial Sequence
  Synthetic oligonucleotide; TTT chr11 5277611 5277632 5277616 5277611 -
attctccccttcaccgaatctc

SEQ ID NO: 134672 - DNA, 22 bp, Artificial Sequence
  Synthetic oligonucleotide; TTA chr11 5277610 5277631 5277615 5277610 -
ttctccccttcaccgaatctca

SEQ ID NO: 134673 - DNA, 22 bp, Artificial Sequence
  Synthetic oligonucleotide; TTC chr11 5277607 5277628 5277612 5277607 -
tccccttcaccgaatctcatcc

SEQ ID NO: 134674 - DNA, 22 bp, Artificial Sequence
  Synthetic oligonucleotide; CTC chr11 5277605 5277626 5277610 5277605 -
cccttcaccgaatctcatccta

SEQ ID NO: 134675 - DNA, 22 bp, Artificial Sequence
  Synthetic oligonucleotide; CTT chr11 5277600 5277621 5277605 5277600 -
caccgaatctcatcctacattg

SEQ ID NO: 134676 - DNA, 22 bp, Artificial Sequence
  Synthetic oligonucleotide; TTC chr11 5277599 5277620 5277604 5277599 -
accgaatctcatcctacattgg

SEQ ID NO: 134677 - DNA, 22 bp, Artificial Sequence
  Synthetic oligonucleotide; CTC chr11 5277589 5277610 5277594 5277589 -
atcctacattggccttattgat

SEQ ID NO: 134678 - DNA, 22 bp, Artificial Sequence
  Synthetic oligonucleotide; CTA chr11 5277583 5277604 5277588 5277583 -
cattggccttattgatattcct

SEQ ID NO: 134679 - DNA, 22 bp, Artificial Sequence
  Synthetic oligonucleotide; TTG chr11 5277578 5277599 5277583 5277578 -
gccttattgatattccttgaaa

SEQ ID NO: 134680 - DNA, 22 bp, Artificial Sequence
  Synthetic oligonucleotide; CTT chr11 5277573 5277594 5277578 5277573 -
attgatattccttgaaaattct

SEQ ID NO: 134681 - DNA, 22 bp, Artificial Sequence
  Synthetic oligonucleotide; TTA chr11 5277572 5277593 5277577 5277572 -
ttgatattccttgaaaattcta

SEQ ID NO: 134682 - DNA, 22 bp, Artificial Sequence
  Synthetic oligonucleotide; TTG chr11 5277569 5277590 5277574 5277569 -
atattccttgaaaattctaagc

SEQ ID NO: 134683 - DNA, 22 bp, Artificial Sequence
  Synthetic oligonucleotide; TTC chr11 5277563 5277584 5277568 5277563 -
cttgaaaattctaagcatctta

SEQ ID NO: 134684 - DNA, 22 bp, Artificial Sequence
  Synthetic oligonucleotide; CTT chr11 5277560 5277581 5277565 5277560 -
gaaaattctaagcatcttacat

SEQ ID NO: 134685 - DNA, 22 bp, Artificial Sequence
  Synthetic oligonucleotide; TTG chr11 5277559 5277580 5277564 5277559 -
aaaattctaagcatcttacatc

SEQ ID NO: 134686 - DNA, 22 bp, Artificial Sequence
  Synthetic oligonucleotide; TTC chr11 5277552 5277573 5277557 5277552 -
taagcatcttacatctttaggg

SEQ ID NO: 134687 - DNA, 22 bp, Artificial Sequence
  Synthetic oligonucleotide; CTA chr11 5277550 5277571 5277555 5277550 -
agcatcttacatctttagggta

SEQ ID NO: 134688 - DNA, 22 bp, Artificial Sequence
  Synthetic oligonucleotide; CTT chr11 5277542 5277563 5277547 5277542 -
acatctttagggtatttacatt

SEQ ID NO: 134689 - DNA, 22 bp, Artificial Sequence
  Synthetic oligonucleotide; TTA chr11 5277541 5277562 5277546 5277541 -
catctttagggtatttacattt

SEQ ID NO: 134690 - DNA, 22 bp, Artificial Sequence
  Synthetic oligonucleotide; CTT chr11 5277535 5277556 5277540 5277535 -
tagggtatttacatttgccatt

SEQ ID NO: 134691 - DNA, 22 bp, Artificial Sequence
  Synthetic oligonucleotide; TTT chr11 5277534 5277555 5277539 5277534 -
agggtatttacatttgccattc

SEQ ID NO: 134692 - DNA, 22 bp, Artificial Sequence
  Synthetic oligonucleotide; TTA chr11 5277533 5277554 5277538 5277533 -
gggtatttacatttgccattcc

SEQ ID NO: 134693 - DNA, 22 bp, Artificial Sequence
  Synthetic oligonucleotide; TTT chr11 5277525 5277546 5277530 5277525 -
acatttgccattccctatgccc

SEQ ID NO: 134694 - DNA, 22 bp, Artificial Sequence
  Synthetic oligonucleotide; TTA chr11 5277524 5277545 5277529 5277524 -
catttgccattccctatgccct

SEQ ID NO: 134695 - DNA, 22 bp, Artificial Sequence
  Synthetic oligonucleotide; TTT chr11 5277519 5277540 5277524 5277519 -
gccattccctatgccctaaata

SEQ ID NO: 134696 - DNA, 22 bp, Artificial Sequence
  Synthetic oligonucleotide; TTG chr11 5277518 5277539 5277523 5277518 -
ccattccctatgccctaaatat

SEQ ID NO: 134697 - DNA, 22 bp, Artificial Sequence
  Synthetic oligonucleotide; TTC chr11 5277512 5277533 5277517 5277512 -
cctatgccctaaatatttaatc

SEQ ID NO: 134698 - DNA, 22 bp, Artificial Sequence
  Synthetic oligonucleotide; CTA chr11 5277508 5277529 5277513 5277508 -
tgccctaaatatttaatcatag

SEQ ID NO: 134699 - DNA, 22 bp, Artificial Sequence
  Synthetic oligonucleotide; CTA chr11 5277501 5277522 5277506 5277501 -
aatatttaatcatagtttcata

SEQ ID NO: 134700 - DNA, 22 bp, Artificial Sequence
  Synthetic oligonucleotide; TTT chr11 5277494 5277515 5277499 5277494 -
aatcatagtttcatataaatgg

SEQ ID NO: 134701 - DNA, 22 bp, Artificial Sequence
  Synthetic oligonucleotide; TTA chr11 5277493 5277514 5277498 5277493 -
atcatagtttcatataaatggg

SEQ ID NO: 134702 - DNA, 22 bp, Artificial Sequence
  Synthetic oligonucleotide; TTT chr11 5277483 5277504 5277488 5277483 -
catataaatgggttcctcatca

SEQ ID NO: 134703 - DNA, 22 bp, Artificial Sequence
  Synthetic oligonucleotide; TTC chr11 5277482 5277503 5277487 5277482 -
atataaatgggttcctcatcat

SEQ ID NO: 134704 - DNA, 22 bp, Artificial Sequence
  Synthetic oligonucleotide; TTC chr11 5277468 5277489 5277473 5277468 -
ctcatcatctatgggtactctc

SEQ ID NO: 134705 - DNA, 22 bp, Artificial Sequence
  Synthetic oligonucleotide; CTC chr11 5277465 5277486 5277470 5277465 -
atcatctatgggtactctctca

SEQ ID NO: 134706 - DNA, 22 bp, Artificial Sequence
  Synthetic oligonucleotide; CTA chr11 5277457 5277478 5277462 5277457 -
tgggtactctctcaggtgttaa

SEQ ID NO: 134707 - DNA, 22 bp, Artificial Sequence
  Synthetic oligonucleotide; CTC chr11 5277448 5277469 5277453 5277448 -
tctcaggtgttaactttatagt

SEQ ID NO: 134708 - DNA, 22 bp, Artificial Sequence
  Synthetic oligonucleotide; CTC chr11 5277446 5277467 5277451 5277446 -
tcaggtgttaactttatagtga

SEQ ID NO: 134709 - DNA, 22 bp, Artificial Sequence
  Synthetic oligonucleotide; CTC chr11 5277444 5277465 5277449 5277444 -
aggtgttaactttatagtgagg

SEQ ID NO: 134710 - DNA, 22 bp, Artificial Sequence
  Synthetic oligonucleotide; TTA chr11 5277436 5277457 5277441 5277436 -
actttatagtgaggactttcct

SEQ ID NO: 134711 - DNA, 22 bp, Artificial Sequence
  Synthetic oligonucleotide; CTT chr11 5277432 5277453 5277437 5277432 -
tatagtgaggactttcctgcca

SEQ ID NO: 134712 - DNA, 22 bp, Artificial Sequence
  Synthetic oligonucleotide; TTT chr11 5277431 5277452 5277436 5277431 -
atagtgaggactttcctgccat

SEQ ID NO: 134713 - DNA, 22 bp, Artificial Sequence
  Synthetic oligonucleotide; TTA chr11 5277430 5277451 5277435 5277430 -
tagtgaggactttcctgccata

SEQ ID NO: 134714 - DNA, 22 bp, Artificial Sequence
  Synthetic oligonucleotide; CTT chr11 5277418 5277439 5277423 5277418 -
tcctgccatactacttaaagta

SEQ ID NO: 134715 - DNA, 22 bp, Artificial Sequence
  Synthetic oligonucleotide; TTT chr11 5277417 5277438 5277422 5277417 -
cctgccatactacttaaagtag

SEQ ID NO: 134716 - DNA, 22 bp, Artificial Sequence
  Synthetic oligonucleotide; TTC chr11 5277416 5277437 5277421 5277416 -
ctgccatactacttaaagtagc

SEQ ID NO: 134717 - DNA, 22 bp, Artificial Sequence
  Synthetic oligonucleotide; CTG chr11 5277413 5277434 5277418 5277413 -
ccatactacttaaagtagcgat

SEQ ID NO: 134718 - DNA, 22 bp, Artificial Sequence
  Synthetic oligonucleotide; CTA chr11 5277405 5277426 5277410 5277405 -
cttaaagtagcgataccctttc

SEQ ID NO: 134719 - DNA, 22 bp, Artificial Sequence
  Synthetic oligonucleotide; CTT chr11 5277402 5277423 5277407 5277402 -
aaagtagcgataccctttcacc

SEQ ID NO: 134720 - DNA, 22 bp, Artificial Sequence
  Synthetic oligonucleotide; TTA chr11 5277401 5277422 5277406 5277401 -
aagtagcgataccctttcaccc

SEQ ID NO: 134721 - DNA, 22 bp, Artificial Sequence
  Synthetic oligonucleotide; CTT chr11 5277385 5277406 5277390 5277385 -
tcaccctgtcctaatcacactc

SEQ ID NO: 134722 - DNA, 22 bp, Artificial Sequence
  Synthetic oligonucleotide; TTT chr11 5277384 5277405 5277389 5277384 -
caccctgtcctaatcacactct

SEQ ID NO: 134723 - DNA, 22 bp, Artificial Sequence
  Synthetic oligonucleotide; TTC chr11 5277383 5277404 5277388 5277383 -
accctgtcctaatcacactctg

SEQ ID NO: 134724 - DNA, 22 bp, Artificial Sequence
  Synthetic oligonucleotide; CTG chr11 5277377 5277398 5277382 5277377 -
tcctaatcacactctggccttc

SEQ ID NO: 134725 - DNA, 22 bp, Artificial Sequence
  Synthetic oligonucleotide; CTA chr11 5277372 5277393 5277377 5277372 -
atcacactctggccttcatttc

SEQ ID NO: 134726 - DNA, 22 bp, Artificial Sequence
  Synthetic oligonucleotide; CTC chr11 5277363 5277384 5277368 5277363 -
tggccttcatttcagttttttt

SEQ ID NO: 134727 - DNA, 22 bp, Artificial Sequence
  Synthetic oligonucleotide; CTG chr11 5277361 5277382 5277366 5277361 -
gccttcatttcagttttttttt

SEQ ID NO: 134728 - DNA, 22 bp, Artificial Sequence
  Synthetic oligonucleotide; CTT chr11 5277356 5277377 5277361 5277356 -
catttcagttttttttttttct

SEQ ID NO: 134729 - DNA, 22 bp, Artificial Sequence
  Synthetic oligonucleotide; TTC chr11 5277355 5277376 5277360 5277355 -
atttcagttttttttttttctc

SEQ ID NO: 134730 - DNA, 22 bp, Artificial Sequence
  Synthetic oligonucleotide; TTT chr11 5277351 5277372 5277356 5277351 -
cagttttttttttttctccata

SEQ ID NO: 134731 - DNA, 22 bp, Artificial Sequence
  Synthetic oligonucleotide; TTC chr11 5277350 5277371 5277355 5277350 -
agttttttttttttctccatag

SEQ ID NO: 134732 - DNA, 22 bp, Artificial Sequence
  Synthetic oligonucleotide; TTT chr11 5277345 5277366 5277350 5277345 -
tttttttttctccatagcacct

SEQ ID NO: 134733 - DNA, 22 bp, Artificial Sequence
  Synthetic oligonucleotide; TTT chr11 5277344 5277365 5277349 5277344 -
ttttttttctccatagcaccta

SEQ ID NO: 134734 - DNA, 22 bp, Artificial Sequence
  Synthetic oligonucleotide; TTT chr11 5277343 5277364 5277348 5277343 -
tttttttctccatagcacctaa

SEQ ID NO: 134735 - DNA, 22 bp, Artificial Sequence
  Synthetic oligonucleotide; TTT chr11 5277342 5277363 5277347 5277342 -
ttttttctccatagcacctaat

SEQ ID NO: 134736 - DNA, 22 bp, Artificial Sequence
  Synthetic oligonucleotide; TTT chr11 5277341 5277362 5277346 5277341 -
tttttctccatagcacctaatc

SEQ ID NO: 134737 - DNA, 22 bp, Artificial Sequence
  Synthetic oligonucleotide; TTT chr11 5277340 5277361 5277345 5277340 -
ttttctccatagcacctaatct

SEQ ID NO: 134738 - DNA, 22 bp, Artificial Sequence
  Synthetic oligonucleotide; TTT chr11 5277339 5277360 5277344 5277339 -
tttctccatagcacctaatctc

SEQ ID NO: 134739 - DNA, 22 bp, Artificial Sequence
  Synthetic oligonucleotide; TTT chr11 5277338 5277359 5277343 5277338 -
ttctccatagcacctaatctca

SEQ ID NO: 134740 - DNA, 22 bp, Artificial Sequence
  Synthetic oligonucleotide; TTT chr11 5277337 5277358 5277342 5277337 -
tctccatagcacctaatctcat

SEQ ID NO: 134741 - DNA, 22 bp, Artificial Sequence
  Synthetic oligonucleotide; TTT chr11 5277336 5277357 5277341 5277336 -
ctccatagcacctaatctcatt

SEQ ID NO: 134742 - DNA, 22 bp, Artificial Sequence
  Synthetic oligonucleotide; TTC chr11 5277335 5277356 5277340 5277335 -
tccatagcacctaatctcattg

SEQ ID NO: 134743 - DNA, 22 bp, Artificial Sequence
  Synthetic oligonucleotide; CTC chr11 5277333 5277354 5277338 5277333 -
catagcacctaatctcattggt

SEQ ID NO: 134744 - DNA, 22 bp, Artificial Sequence
  Synthetic oligonucleotide; CTA chr11 5277322 5277343 5277327 5277322 -
atctcattggtatataacatgt

SEQ ID NO: 134745 - DNA, 22 bp, Artificial Sequence
  Synthetic oligonucleotide; CTC chr11 5277317 5277338 5277322 5277317 -
attggtatataacatgtttcat

SEQ ID NO: 134746 - DNA, 22 bp, Artificial Sequence
  Synthetic oligonucleotide; TTG chr11 5277313 5277334 5277318 5277313 -
gtatataacatgtttcatttgc

SEQ ID NO: 134747 - DNA, 22 bp, Artificial Sequence
  Synthetic oligonucleotide; TTT chr11 5277298 5277319 5277303 5277298 -
catttgcttatttaatgtcaag

SEQ ID NO: 134748 - DNA, 22 bp, Artificial Sequence
  Synthetic oligonucleotide; TTC chr11 5277297 5277318 5277302 5277297 -
atttgcttatttaatgtcaagc

SEQ ID NO: 134749 - DNA, 22 bp, Artificial Sequence
  Synthetic oligonucleotide; TTT chr11 5277293 5277314 5277298 5277293 -
gcttatttaatgtcaagctctt

SEQ ID NO: 134750 - DNA, 22 bp, Artificial Sequence
  Synthetic oligonucleotide; TTG chr11 5277292 5277313 5277297 5277292 -
cttatttaatgtcaagctcttt

SEQ ID NO: 134751 - DNA, 22 bp, Artificial Sequence
  Synthetic oligonucleotide; CTT chr11 5277289 5277310 5277294 5277289 -
atttaatgtcaagctctttcca

SEQ ID NO: 134752 - DNA, 22 bp, Artificial Sequence
  Synthetic oligonucleotide; TTA chr11 5277288 5277309 5277293 5277288 -
tttaatgtcaagctctttccac

SEQ ID NO: 134753 - DNA, 22 bp, Artificial Sequence
  Synthetic oligonucleotide; TTT chr11 5277285 5277306 5277290 5277285 -
aatgtcaagctctttccactat

SEQ ID NO: 134754 - DNA, 22 bp, Artificial Sequence
  Synthetic oligonucleotide; TTA chr11 5277284 5277305 5277289 5277284 -
atgtcaagctctttccactatc

SEQ ID NO: 134755 - DNA, 22 bp, Artificial Sequence
  Synthetic oligonucleotide; CTC chr11 5277273 5277294 5277278 5277273 -
tttccactatcaagtccatgaa

SEQ ID NO: 134756 - DNA, 22 bp, Artificial Sequence
  Synthetic oligonucleotide; CTT chr11 5277271 5277292 5277276 5277271 -
tccactatcaagtccatgaaaa

SEQ ID NO: 134757 - DNA, 22 bp, Artificial Sequence
  Synthetic oligonucleotide; TTT chr11 5277270 5277291 5277275 5277270 -
ccactatcaagtccatgaaaac

SEQ ID NO: 134758 - DNA, 22 bp, Artificial Sequence
  Synthetic oligonucleotide; TTC chr11 5277269 5277290 5277274 5277269 -
cactatcaagtccatgaaaaca

SEQ ID NO: 134759 - DNA, 22 bp, Artificial Sequence
  Synthetic oligonucleotide; CTA chr11 5277264 5277285 5277269 5277264 -
tcaagtccatgaaaacaggaac

SEQ ID NO: 134760 - DNA, 22 bp, Artificial Sequence
  Synthetic oligonucleotide; CTT chr11 5277240 5277261 5277245 5277240 -
tattcctctattctgtttttgt

SEQ ID NO: 134761 - DNA, 22 bp, Artificial Sequence
  Synthetic oligonucleotide; TTT chr11 5277239 5277260 5277244 5277239 -
attcctctattctgtttttgtg

SEQ ID NO: 134762 - DNA, 22 bp, Artificial Sequence
  Synthetic oligonucleotide; TTA chr11 5277238 5277259 5277243 5277238 -
ttcctctattctgtttttgtgc

SEQ ID NO: 134763 - DNA, 22 bp, Artificial Sequence
  Synthetic oligonucleotide; TTC chr11 5277235 5277256 5277240 5277235 -
ctctattctgtttttgtgctgt

SEQ ID NO: 134764 - DNA, 22 bp, Artificial Sequence
  Synthetic oligonucleotide; CTC chr11 5277232 5277253 5277237 5277232 -
tattctgtttttgtgctgtatt

SEQ ID NO: 134765 - DNA, 22 bp, Artificial Sequence
  Synthetic oligonucleotide; CTA chr11 5277230 5277251 5277235 5277230 -
ttctgtttttgtgctgtattct

SEQ ID NO: 134766 - DNA, 22 bp, Artificial Sequence
  Synthetic oligonucleotide; TTC chr11 5277227 5277248 5277232 5277227 -
tgtttttgtgctgtattcttag

SEQ ID NO: 134767 - DNA, 22 bp, Artificial Sequence
  Synthetic oligonucleotide; CTG chr11 5277225 5277246 5277230 5277225 -
tttttgtgctgtattcttagca

SEQ ID NO: 134768 - DNA, 22 bp, Artificial Sequence
  Synthetic oligonucleotide; TTT chr11 5277222 5277243 5277227 5277222 -
ttgtgctgtattcttagcaatt

SEQ ID NO: 134769 - DNA, 22 bp, Artificial Sequence
  Synthetic oligonucleotide; TTT chr11 5277221 5277242 5277226 5277221 -
tgtgctgtattcttagcaattt

SEQ ID NO: 134770 - DNA, 22 bp, Artificial Sequence
  Synthetic oligonucleotide; TTT chr11 5277220 5277241 5277225 5277220 -
gtgctgtattcttagcaatttt

SEQ ID NO: 134771 - DNA, 22 bp, Artificial Sequence
  Synthetic oligonucleotide; TTG chr11 5277219 5277240 5277224 5277219 -
tgctgtattcttagcaatttta

SEQ ID NO: 134772 - DNA, 22 bp, Artificial Sequence
  Synthetic oligonucleotide; CTG chr11 5277214 5277235 5277219 5277214 -
tattcttagcaattttacaatt

SEQ ID NO: 134773 - DNA, 22 bp, Artificial Sequence
  Synthetic oligonucleotide; TTC chr11 5277209 5277230 5277214 5277209 -
ttagcaattttacaattttgaa

SEQ ID NO: 134774 - DNA, 22 bp, Artificial Sequence
  Synthetic oligonucleotide; CTT chr11 5277207 5277228 5277212 5277207 -
agcaattttacaattttgaatg

SEQ ID NO: 134775 - DNA, 22 bp, Artificial Sequence
  Synthetic oligonucleotide; TTA chr11 5277206 5277227 5277211 5277206 -
gcaattttacaattttgaatga

SEQ ID NO: 134776 - DNA, 22 bp, Artificial Sequence
  Synthetic oligonucleotide; TTT chr11 5277199 5277220 5277204 5277199 -
tacaattttgaatgaatgaatg

SEQ ID NO: 134777 - DNA, 22 bp, Artificial Sequence
  Synthetic oligonucleotide; TTT chr11 5277198 5277219 5277203 5277198 -
acaattttgaatgaatgaatga

SEQ ID NO: 134778 - DNA, 22 bp, Artificial Sequence
  Synthetic oligonucleotide; TTA chr11 5277197 5277218 5277202 5277197 -
caattttgaatgaatgaatgag

SEQ ID NO: 134779 - DNA, 22 bp, Artificial Sequence
  Synthetic oligonucleotide; TTT chr11 5277191 5277212 5277196 5277191 -
tgaatgaatgaatgagcagtca

SEQ ID NO: 134780 - DNA, 22 bp, Artificial Sequence
  Synthetic oligonucleotide; TTT chr11 5277190 5277211 5277195 5277190 -
gaatgaatgaatgagcagtcaa

SEQ ID NO: 134781 - DNA, 22 bp, Artificial Sequence
  Synthetic oligonucleotide; TTG chr11 5277189 5277210 5277194 5277189 -
aatgaatgaatgagcagtcaaa

SEQ ID NO: 134782 - DNA, 22 bp, Artificial Sequence
  Synthetic oligonucleotide; CTA chr11 5277153 5277174 5277158 5277153 -
taattaaaaggatgtatgctga

SEQ ID NO: 134783 - DNA, 22 bp, Artificial Sequence
  Synthetic oligonucleotide; TTA chr11 5277147 5277168 5277152 5277147 -
aaaggatgtatgctgacacatc

SEQ ID NO: 134784 - DNA, 22 bp, Artificial Sequence
  Synthetic oligonucleotide; CTG chr11 5277132 5277153 5277137 5277132 -
acacatccactgctatgcacac

SEQ ID NO: 134785 - DNA, 22 bp, Artificial Sequence
  Synthetic oligonucleotide; CTG chr11 5277120 5277141 5277125 5277120 -
ctatgcacacacaaagaaatca

SEQ ID NO: 134786 - DNA, 22 bp, Artificial Sequence
  Synthetic oligonucleotide; CTA chr11 5277117 5277138 5277122 5277117 -
tgcacacacaaagaaatcagtg

SEQ ID NO: 134787 - DNA, 22 bp, Artificial Sequence
  Synthetic oligonucleotide; CTG chr11 5277084 5277105 5277089 5277084 -
gaagtgctaagcctgcatagag

SEQ ID NO: 134788 - DNA, 22 bp, Artificial Sequence
  Synthetic oligonucleotide; CTA chr11 5277075 5277096 5277080 5277075 -
agcctgcatagagctagttagc

SEQ ID NO: 134789 - DNA, 22 bp, Artificial Sequence
  Synthetic oligonucleotide; CTG chr11 5277069 5277090 5277074 5277069 -
catagagctagttagccctccg

SEQ ID NO: 134790 - DNA, 22 bp, Artificial Sequence
  Synthetic oligonucleotide; CTA chr11 5277059 5277080 5277064 5277059 -
gttagccctccgcaggcagagc

SEQ ID NO: 134791 - DNA, 22 bp, Artificial Sequence
  Synthetic oligonucleotide; TTA chr11 5277055 5277076 5277060 5277055 -
gccctccgcaggcagagccttg

SEQ ID NO: 134792 - DNA, 22 bp, Artificial Sequence
  Synthetic oligonucleotide; CTC chr11 5277049 5277070 5277054 5277049 -
cgcaggcagagccttgatggga

SEQ ID NO: 134793 - DNA, 22 bp, Artificial Sequence
  Synthetic oligonucleotide; CTT chr11 5277034 5277055 5277039 5277034 -
gatgggattactgagttctaga

SEQ ID NO: 134794 - DNA, 22 bp, Artificial Sequence
  Synthetic oligonucleotide; TTG chr11 5277033 5277054 5277038 5277033 -
atgggattactgagttctagaa

SEQ ID NO: 134795 - DNA, 22 bp, Artificial Sequence
  Synthetic oligonucleotide; TTA chr11 5277024 5277045 5277029 5277024 -
ctgagttctagaattggactca

SEQ ID NO: 134796 - DNA, 22 bp, Artificial Sequence
  Synthetic oligonucleotide; CTG chr11 5277021 5277042 5277026 5277021 -
agttctagaattggactcattt

SEQ ID NO: 134797 - DNA, 22 bp, Artificial Sequence
  Synthetic oligonucleotide; TTC chr11 5277016 5277037 5277021 5277016 -
tagaattggactcatttgtttt

SEQ ID NO: 134798 - DNA, 22 bp, Artificial Sequence
  Synthetic oligonucleotide; CTA chr11 5277014 5277035 5277019 5277014 -
gaattggactcatttgttttgt

SEQ ID NO: 134799 - DNA, 22 bp, Artificial Sequence
  Synthetic oligonucleotide; TTG chr11 5277008 5277029 5277013 5277008 -
gactcatttgttttgtaggctg

SEQ ID NO: 134800 - DNA, 22 bp, Artificial Sequence
  Synthetic oligonucleotide; CTC chr11 5277003 5277024 5277008 5277003 -
atttgttttgtaggctgagatt

SEQ ID NO: 134801 - DNA, 22 bp, Artificial Sequence
  Synthetic oligonucleotide; TTT chr11 5276999 5277020 5277004 5276999 -
gttttgtaggctgagatttgct

SEQ ID NO: 134802 - DNA, 22 bp, Artificial Sequence
  Synthetic oligonucleotide; TTG chr11 5276998 5277019 5277003 5276998 -
ttttgtaggctgagatttgctc

SEQ ID NO: 134803 - DNA, 22 bp, Artificial Sequence
  Synthetic oligonucleotide; TTT chr11 5276995 5277016 5277000 5276995 -
tgtaggctgagatttgctcttg

SEQ ID NO: 134804 - DNA, 22 bp, Artificial Sequence
  Synthetic oligonucleotide; TTT chr11 5276994 5277015 5276999 5276994 -
gtaggctgagatttgctcttga

SEQ ID NO: 134805 - DNA, 22 bp, Artificial Sequence
  Synthetic oligonucleotide; TTG chr11 5276993 5277014 5276998 5276993 -
taggctgagatttgctcttgaa

SEQ ID NO: 134806 - DNA, 22 bp, Artificial Sequence
  Synthetic oligonucleotide; CTG chr11 5276986 5277007 5276991 5276986 -
agatttgctcttgaaaacttgt

SEQ ID NO: 134807 - DNA, 22 bp, Artificial Sequence
  Synthetic oligonucleotide; TTT chr11 5276980 5277001 5276985 5276980 -
gctcttgaaaacttgttctgac

SEQ ID NO: 134808 - DNA, 22 bp, Artificial Sequence
  Synthetic oligonucleotide; TTG chr11 5276979 5277000 5276984 5276979 -
ctcttgaaaacttgttctgacc

SEQ ID NO: 134809 - DNA, 22 bp, Artificial Sequence
  Synthetic oligonucleotide; CTC chr11 5276976 5276997 5276981 5276976 -
ttgaaaacttgttctgaccaaa

SEQ ID NO: 134810 - DNA, 22 bp, Artificial Sequence
  Synthetic oligonucleotide; CTT chr11 5276974 5276995 5276979 5276974 -
gaaaacttgttctgaccaaaat

SEQ ID NO: 134811 - DNA, 22 bp, Artificial Sequence
  Synthetic oligonucleotide; TTG chr11 5276973 5276994 5276978 5276973 -
aaaacttgttctgaccaaaata

SEQ ID NO: 134812 - DNA, 22 bp, Artificial Sequence
  Synthetic oligonucleotide; CTT chr11 5276966 5276987 5276971 5276966 -
gttctgaccaaaataaaaggct

SEQ ID NO: 134813 - DNA, 22 bp, Artificial Sequence
  Synthetic oligonucleotide; TTG chr11 5276965 5276986 5276970 5276965 -
ttctgaccaaaataaaaggctc

SEQ ID NO: 134814 - DNA, 22 bp, Artificial Sequence
  Synthetic oligonucleotide; TTC chr11 5276962 5276983 5276967 5276962 -
tgaccaaaataaaaggctcaaa

SEQ ID NO: 134815 - DNA, 22 bp, Artificial Sequence
  Synthetic oligonucleotide; CTG chr11 5276960 5276981 5276965 5276960 -
accaaaataaaaggctcaaaag

SEQ ID NO: 134816 - DNA, 22 bp, Artificial Sequence
  Synthetic oligonucleotide; CTC chr11 5276943 5276964 5276948 5276943 -
aaaagatgaatatcgaaaccag

SEQ ID NO: 134817 - DNA, 22 bp, Artificial Sequence
  Synthetic oligonucleotide; TTT chr11 5276914 5276935 5276919 5276914 -
tttacactggaatttataacta

SEQ ID NO: 134818 - DNA, 22 bp, Artificial Sequence
  Synthetic oligonucleotide; TTT chr11 5276913 5276934 5276918 5276913 -
ttacactggaatttataactag

SEQ ID NO: 134819 - DNA, 22 bp, Artificial Sequence
  Synthetic oligonucleotide; TTT chr11 5276912 5276933 5276917 5276912 -
tacactggaatttataactaga

SEQ ID NO: 134820 - DNA, 22 bp, Artificial Sequence
  Synthetic oligonucleotide; TTT chr11 5276911 5276932 5276916 5276911 -
acactggaatttataactagag

SEQ ID NO: 134821 - DNA, 22 bp, Artificial Sequence
  Synthetic oligonucleotide; TTA chr11 5276910 5276931 5276915 5276910 -
cactggaatttataactagagc

SEQ ID NO: 134822 - DNA, 22 bp, Artificial Sequence
  Synthetic oligonucleotide; CTG chr11 5276905 5276926 5276910 5276905 -
gaatttataactagagcactca

SEQ ID NO: 134823 - DNA, 22 bp, Artificial Sequence
  Synthetic oligonucleotide; TTT chr11 5276899 5276920 5276904 5276899 -
ataactagagcactcatgttta

SEQ ID NO: 134824 - DNA, 22 bp, Artificial Sequence
  Synthetic oligonucleotide; TTA chr11 5276898 5276919 5276903 5276898 -
taactagagcactcatgtttat

SEQ ID NO: 134825 - DNA, 22 bp, Artificial Sequence
  Synthetic oligonucleotide; CTA chr11 5276892 5276913 5276897 5276892 -
gagcactcatgtttatgtaagc

SEQ ID NO: 134826 - DNA, 22 bp, Artificial Sequence
  Synthetic oligonucleotide; CTC chr11 5276884 5276905 5276889 5276884 -
atgtttatgtaagcaattaatt

SEQ ID NO: 134827 - DNA, 22 bp, Artificial Sequence
  Synthetic oligonucleotide; TTT chr11 5276878 5276899 5276883 5276878 -
atgtaagcaattaattgtttca

SEQ ID NO: 134828 - DNA, 22 bp, Artificial Sequence
  Synthetic oligonucleotide; TTA chr11 5276877 5276898 5276882 5276877 -
tgtaagcaattaattgtttcat

SEQ ID NO: 134829 - DNA, 22 bp, Artificial Sequence
  Synthetic oligonucleotide; TTA chr11 5276865 5276886 5276870 5276865 -
attgtttcatcagtcaggtaaa

SEQ ID NO: 134830 - DNA, 22 bp, Artificial Sequence
  Synthetic oligonucleotide; TTG chr11 5276861 5276882 5276866 5276861 -
tttcatcagtcaggtaaaagta

SEQ ID NO: 134831 - DNA, 22 bp, Artificial Sequence
  Synthetic oligonucleotide; TTT chr11 5276858 5276879 5276863 5276858 -
catcagtcaggtaaaagtaaag

SEQ ID NO: 134832 - DNA, 22 bp, Artificial Sequence
  Synthetic oligonucleotide; TTC chr11 5276857 5276878 5276862 5276857 -
atcagtcaggtaaaagtaaaga

SEQ ID NO: 134833 - DNA, 22 bp, Artificial Sequence
  Synthetic oligonucleotide; CTG chr11 5276828 5276849 5276833 5276828 -
tgccaaggcaggtagcctaatg

SEQ ID NO: 134834 - DNA, 22 bp, Artificial Sequence
  Synthetic oligonucleotide; CTA chr11 5276809 5276830 5276814 5276809 -
atgcaatatgccactaaagtaa

SEQ ID NO: 134835 - DNA, 22 bp, Artificial Sequence
  Synthetic oligonucleotide; CTA chr11 5276793 5276814 5276798 5276793 -
aagtaaacattatttcataggt

SEQ ID NO: 134836 - DNA, 22 bp, Artificial Sequence
  Synthetic oligonucleotide; TTA chr11 5276781 5276802 5276786 5276781 -
tttcataggtgtcagatatggc

SEQ ID NO: 134837 - DNA, 22 bp, Artificial Sequence
  Synthetic oligonucleotide; TTT chr11 5276778 5276799 5276783 5276778 -
cataggtgtcagatatggctta

SEQ ID NO: 134838 - DNA, 22 bp, Artificial Sequence
  Synthetic oligonucleotide; TTC chr11 5276777 5276798 5276782 5276777 -
ataggtgtcagatatggcttat

SEQ ID NO: 134839 - DNA, 22 bp, Artificial Sequence
  Synthetic oligonucleotide; CTT chr11 5276757 5276778 5276762 5276757 -
attcatccatcttcatgggaag

SEQ ID NO: 134840 - DNA, 22 bp, Artificial Sequence
  Synthetic oligonucleotide; TTA chr11 5276756 5276777 5276761 5276756 -
ttcatccatcttcatgggaagg

SEQ ID NO: 134841 - DNA, 22 bp, Artificial Sequence
  Synthetic oligonucleotide; TTC chr11 5276753 5276774 5276758 5276753 -
atccatcttcatgggaaggatg

SEQ ID NO: 134842 - DNA, 22 bp, Artificial Sequence
  Synthetic oligonucleotide; CTT chr11 5276744 5276765 5276749 5276744 -
catgggaaggatggccttggcc

SEQ ID NO: 134843 - DNA, 22 bp, Artificial Sequence
  Synthetic oligonucleotide; TTC chr11 5276743 5276764 5276748 5276743 -
atgggaaggatggccttggcct

SEQ ID NO: 134844 - DNA, 22 bp, Artificial Sequence
  Synthetic oligonucleotide; CTT chr11 5276726 5276747 5276731 5276726 -
ggcctggacatcagtgttatgt

SEQ ID NO: 134845 - DNA, 22 bp, Artificial Sequence
  Synthetic oligonucleotide; TTG chr11 5276725 5276746 5276730 5276725 -
gcctggacatcagtgttatgtg

SEQ ID NO: 134846 - DNA, 22 bp, Artificial Sequence
  Synthetic oligonucleotide; CTG chr11 5276720 5276741 5276725 5276720 -
gacatcagtgttatgtgaggtt

SEQ ID NO: 134847 - DNA, 22 bp, Artificial Sequence
  Synthetic oligonucleotide; TTA chr11 5276707 5276728 5276712 5276707 -
tgtgaggttcaaaacacctcta

SEQ ID NO: 134848 - DNA, 22 bp, Artificial Sequence
  Synthetic oligonucleotide; TTC chr11 5276697 5276718 5276702 5276697 -
aaaacacctctaggctataagg

SEQ ID NO: 134849 - DNA, 22 bp, Artificial Sequence
  Synthetic oligonucleotide; CTC chr11 5276687 5276708 5276692 5276687 -
taggctataaggcaacagagct

SEQ ID NO: 134850 - DNA, 22 bp, Artificial Sequence
  Synthetic oligonucleotide; CTA chr11 5276685 5276706 5276690 5276685 -
ggctataaggcaacagagctcc

SEQ ID NO: 134851 - DNA, 22 bp, Artificial Sequence
  Synthetic oligonucleotide; CTA chr11 5276680 5276701 5276685 5276680 -
taaggcaacagagctccttttt

SEQ ID NO: 134852 - DNA, 22 bp, Artificial Sequence
  Synthetic oligonucleotide; CTC chr11 5276664 5276685 5276669 5276664 -
cttttttttttttctgtgcttt

SEQ ID NO: 134853 - DNA, 22 bp, Artificial Sequence
  Synthetic oligonucleotide; CTT chr11 5276661 5276682 5276666 5276661 -
ttttttttttctgtgctttcct

SEQ ID NO: 134854 - DNA, 22 bp, Artificial Sequence
  Synthetic oligonucleotide; TTT chr11 5276660 5276681 5276665 5276660 -
tttttttttctgtgctttcctg

SEQ ID NO: 134855 - DNA, 22 bp, Artificial Sequence
  Synthetic oligonucleotide; TTT chr11 5276659 5276680 5276664 5276659 -
ttttttttctgtgctttcctgg

SEQ ID NO: 134856 - DNA, 22 bp, Artificial Sequence
  Synthetic oligonucleotide; TTT chr11 5276658 5276679 5276663 5276658 -
tttttttctgtgctttcctggc

SEQ ID NO: 134857 - DNA, 22 bp, Artificial Sequence
  Synthetic oligonucleotide; TTT chr11 5276657 5276678 5276662 5276657 -
ttttttctgtgctttcctggct

SEQ ID NO: 134858 - DNA, 22 bp, Artificial Sequence
  Synthetic oligonucleotide; TTT chr11 5276656 5276677 5276661 5276656 -
tttttctgtgctttcctggctg

SEQ ID NO: 134859 - DNA, 22 bp, Artificial Sequence
  Synthetic oligonucleotide; TTT chr11 5276655 5276676 5276660 5276655 -
ttttctgtgctttcctggctgt

SEQ ID NO: 134860 - DNA, 22 bp, Artificial Sequence
  Synthetic oligonucleotide; TTT chr11 5276654 5276675 5276659 5276654 -
tttctgtgctttcctggctgtc

SEQ ID NO: 134861 - DNA, 22 bp, Artificial Sequence
  Synthetic oligonucleotide; TTT chr11 5276653 5276674 5276658 5276653 -
ttctgtgctttcctggctgtcc

SEQ ID NO: 134862 - DNA, 22 bp, Artificial Sequence
  Synthetic oligonucleotide; TTT chr11 5276652 5276673 5276657 5276652 -
tctgtgctttcctggctgtcca

SEQ ID NO: 134863 - DNA, 22 bp, Artificial Sequence
  Synthetic oligonucleotide; TTT chr11 5276651 5276672 5276656 5276651 -
ctgtgctttcctggctgtccaa

SEQ ID NO: 134864 - DNA, 22 bp, Artificial Sequence
  Synthetic oligonucleotide; TTC chr11 5276650 5276671 5276655 5276650 -
tgtgctttcctggctgtccaaa

SEQ ID NO: 134865 - DNA, 22 bp, Artificial Sequence
  Synthetic oligonucleotide; CTG chr11 5276648 5276669 5276653 5276648 -
tgctttcctggctgtccaaatc

SEQ ID NO: 134866 - DNA, 22 bp, Artificial Sequence
  Synthetic oligonucleotide; CTT chr11 5276643 5276664 5276648 5276643 -
tcctggctgtccaaatctctaa

SEQ ID NO: 134867 - DNA, 22 bp, Artificial Sequence
  Synthetic oligonucleotide; TTT chr11 5276642 5276663 5276647 5276642 -
cctggctgtccaaatctctaat

SEQ ID NO: 134868 - DNA, 22 bp, Artificial Sequence
  Synthetic oligonucleotide; TTC chr11 5276641 5276662 5276646 5276641 -
ctggctgtccaaatctctaatg

SEQ ID NO: 134869 - DNA, 22 bp, Artificial Sequence
  Synthetic oligonucleotide; CTG chr11 5276638 5276659 5276643 5276638 -
gctgtccaaatctctaatgata

SEQ ID NO: 134870 - DNA, 22 bp, Artificial Sequence
  Synthetic oligonucleotide; CTG chr11 5276634 5276655 5276639 5276634 -
tccaaatctctaatgataagca

SEQ ID NO: 134871 - DNA, 22 bp, Artificial Sequence
  Synthetic oligonucleotide; CTC chr11 5276624 5276645 5276629 5276624 -
taatgataagcatacttctatt

SEQ ID NO: 134872 - DNA, 22 bp, Artificial Sequence
  Synthetic oligonucleotide; CTA chr11 5276622 5276643 5276627 5276622 -
atgataagcatacttctattca

SEQ ID NO: 134873 - DNA, 22 bp, Artificial Sequence
  Synthetic oligonucleotide; CTT chr11 5276607 5276628 5276612 5276607 -
ctattcaatgagaatattctgt

SEQ ID NO: 134874 - DNA, 22 bp, Artificial Sequence
  Synthetic oligonucleotide; TTC chr11 5276606 5276627 5276611 5276606 -
tattcaatgagaatattctgta

SEQ ID NO: 134875 - DNA, 22 bp, Artificial Sequence
  Synthetic oligonucleotide; CTA chr11 5276604 5276625 5276609 5276604 -
ttcaatgagaatattctgtaag

SEQ ID NO: 134876 - DNA, 22 bp, Artificial Sequence
  Synthetic oligonucleotide; TTC chr11 5276601 5276622 5276606 5276601 -
aatgagaatattctgtaagatt

SEQ ID NO: 134877 - DNA, 22 bp, Artificial Sequence
  Synthetic oligonucleotide; TTC chr11 5276588 5276609 5276593 5276588 -
tgtaagattatagttaagaatt

SEQ ID NO: 134878 - DNA, 22 bp, Artificial Sequence
  Synthetic oligonucleotide; CTG chr11 5276586 5276607 5276591 5276586 -
taagattatagttaagaattgt

SEQ ID NO: 134879 - DNA, 22 bp, Artificial Sequence
  Synthetic oligonucleotide; TTA chr11 5276578 5276599 5276583 5276578 -
tagttaagaattgtgggagcca

SEQ ID NO: 134880 - DNA, 22 bp, Artificial Sequence
  Synthetic oligonucleotide; TTA chr11 5276572 5276593 5276577 5276572 -
agaattgtgggagccattccgt

SEQ ID NO: 134881 - DNA, 22 bp, Artificial Sequence
  Synthetic oligonucleotide; TTG chr11 5276565 5276586 5276570 5276565 -
tgggagccattccgtctcttat

SEQ ID NO: 134882 - DNA, 22 bp, Artificial Sequence
  Synthetic oligonucleotide; TTC chr11 5276553 5276574 5276558 5276553 -
cgtctcttatagttaaatttga

SEQ ID NO: 134883 - DNA, 22 bp, Artificial Sequence
  Synthetic oligonucleotide; CTC chr11 5276547 5276568 5276552 5276547 -
ttatagttaaatttgagcttct

SEQ ID NO: 134884 - DNA, 22 bp, Artificial Sequence
  Synthetic oligonucleotide; CTT chr11 5276545 5276566 5276550 5276545 -
atagttaaatttgagcttcttt

SEQ ID NO: 134885 - DNA, 22 bp, Artificial Sequence
  Synthetic oligonucleotide; TTA chr11 5276544 5276565 5276549 5276544 -
tagttaaatttgagcttctttt

SEQ ID NO: 134886 - DNA, 22 bp, Artificial Sequence
  Synthetic oligonucleotide; TTA chr11 5276538 5276559 5276543 5276538 -
aatttgagcttcttttatgatc

SEQ ID NO: 134887 - DNA, 22 bp, Artificial Sequence
  Synthetic oligonucleotide; TTT chr11 5276533 5276554 5276538 5276533 -
gagcttcttttatgatcactgt

SEQ ID NO: 134888 - DNA, 22 bp, Artificial Sequence
  Synthetic oligonucleotide; TTG chr11 5276532 5276553 5276537 5276532 -
agcttcttttatgatcactgtt

SEQ ID NO: 134889 - DNA, 22 bp, Artificial Sequence
  Synthetic oligonucleotide; CTT chr11 5276527 5276548 5276532 5276527 -
cttttatgatcactgttttttt

SEQ ID NO: 134890 - DNA, 22 bp, Artificial Sequence
  Synthetic oligonucleotide; TTC chr11 5276526 5276547 5276531 5276526 -
ttttatgatcactgttttttta

SEQ ID NO: 134891 - DNA, 22 bp, Artificial Sequence
  Synthetic oligonucleotide; CTT chr11 5276524 5276545 5276529 5276524 -
ttatgatcactgtttttttaat

SEQ ID NO: 134892 - DNA, 22 bp, Artificial Sequence
  Synthetic oligonucleotide; TTT chr11 5276523 5276544 5276528 5276523 -
tatgatcactgtttttttaata

SEQ ID NO: 134893 - DNA, 22 bp, Artificial Sequence
  Synthetic oligonucleotide; TTT chr11 5276522 5276543 5276527 5276522 -
atgatcactgtttttttaatat

SEQ ID NO: 134894 - DNA, 22 bp, Artificial Sequence
  Synthetic oligonucleotide; TTA chr11 5276521 5276542 5276526 5276521 -
tgatcactgtttttttaatatg

SEQ ID NO: 134895 - DNA, 22 bp, Artificial Sequence
  Synthetic oligonucleotide; CTG chr11 5276512 5276533 5276517 5276512 -
tttttttaatatgctttaagtt

SEQ ID NO: 134896 - DNA, 22 bp, Artificial Sequence
  Synthetic oligonucleotide; TTT chr11 5276509 5276530 5276514 5276509 -
ttttaatatgctttaagttctg

SEQ ID NO: 134897 - DNA, 22 bp, Artificial Sequence
  Synthetic oligonucleotide; TTT chr11 5276508 5276529 5276513 5276508 -
tttaatatgctttaagttctgg

SEQ ID NO: 134898 - DNA, 22 bp, Artificial Sequence
  Synthetic oligonucleotide; TTT chr11 5276507 5276528 5276512 5276507 -
ttaatatgctttaagttctggg

SEQ ID NO: 134899 - DNA, 22 bp, Artificial Sequence
  Synthetic oligonucleotide; TTT chr11 5276506 5276527 5276511 5276506 -
taatatgctttaagttctgggg

SEQ ID NO: 134900 - DNA, 22 bp, Artificial Sequence
  Synthetic oligonucleotide; TTT chr11 5276505 5276526 5276510 5276505 -
aatatgctttaagttctggggt

SEQ ID NO: 134901 - DNA, 22 bp, Artificial Sequence
  Synthetic oligonucleotide; TTA chr11 5276504 5276525 5276509 5276504 -
atatgctttaagttctggggta

SEQ ID NO: 134902 - DNA, 22 bp, Artificial Sequence
  Synthetic oligonucleotide; CTT chr11 5276496 5276517 5276501 5276496 -
taagttctggggtacatgtgcc

SEQ ID NO: 134903 - DNA, 22 bp, Artificial Sequence
  Synthetic oligonucleotide; TTT chr11 5276495 5276516 5276500 5276495 -
aagttctggggtacatgtgcca

SEQ ID NO: 134904 - DNA, 22 bp, Artificial Sequence
  Synthetic oligonucleotide; TTA chr11 5276494 5276515 5276499 5276494 -
agttctggggtacatgtgccat

SEQ ID NO: 134905 - DNA, 22 bp, Artificial Sequence
  Synthetic oligonucleotide; TTC chr11 5276489 5276510 5276494 5276489 -
tggggtacatgtgccatggtgg

SEQ ID NO: 134906 - DNA, 22 bp, Artificial Sequence
  Synthetic oligonucleotide; CTG chr11 5276487 5276508 5276492 5276487 -
gggtacatgtgccatggtggtt

SEQ ID NO: 134907 - DNA, 22 bp, Artificial Sequence
  Synthetic oligonucleotide; TTT chr11 5276464 5276485 5276469 5276464 -
gctgcacccatcaacccgtcat

SEQ ID NO: 134908 - DNA, 22 bp, Artificial Sequence
  Synthetic oligonucleotide; TTG chr11 5276463 5276484 5276468 5276463 -
ctgcacccatcaacccgtcatc

SEQ ID NO: 134909 - DNA, 22 bp, Artificial Sequence
  Synthetic oligonucleotide; CTG chr11 5276460 5276481 5276465 5276460 -
cacccatcaacccgtcatctac

SEQ ID NO: 134910 - DNA, 22 bp, Artificial Sequence
  Synthetic oligonucleotide; CTA chr11 5276439 5276460 5276444 5276439 -
cattaggtatttctcctaatgc

SEQ ID NO: 134911 - DNA, 22 bp, Artificial Sequence
  Synthetic oligonucleotide; TTA chr11 5276434 5276455 5276439 5276434 -
ggtatttctcctaatgctatcc

SEQ ID NO: 134912 - DNA, 22 bp, Artificial Sequence
  Synthetic oligonucleotide; TTT chr11 5276427 5276448 5276432 5276427 -
ctcctaatgctatccttcccct

SEQ ID NO: 134913 - DNA, 22 bp, Artificial Sequence
  Synthetic oligonucleotide; TTC chr11 5276426 5276447 5276431 5276426 -
tcctaatgctatccttccccta

SEQ ID NO: 134914 - DNA, 22 bp, Artificial Sequence
  Synthetic oligonucleotide; CTC chr11 5276424 5276445 5276429 5276424 -
ctaatgctatccttcccctagc

SEQ ID NO: 134915 - DNA, 22 bp, Artificial Sequence
  Synthetic oligonucleotide; CTA chr11 5276421 5276442 5276426 5276421 -
atgctatccttcccctagcccc

SEQ ID NO: 134916 - DNA, 22 bp, Artificial Sequence
  Synthetic oligonucleotide; CTA chr11 5276415 5276436 5276420 5276415 -
tccttcccctagccccccaccc

SEQ ID NO: 134917 - DNA, 22 bp, Artificial Sequence
  Synthetic oligonucleotide; CTT chr11 5276410 5276431 5276415 5276410 -
cccctagccccccacccccaac

SEQ ID NO: 134918 - DNA, 22 bp, Artificial Sequence
  Synthetic oligonucleotide; TTC chr11 5276409 5276430 5276414 5276409 -
ccctagccccccacccccaaca

SEQ ID NO: 134919 - DNA, 22 bp, Artificial Sequence
  Synthetic oligonucleotide; CTA chr11 5276404 5276425 5276409 5276404 -
gccccccacccccaacaggccc

SEQ ID NO: 134920 - DNA, 22 bp, Artificial Sequence
  Synthetic oligonucleotide; TTC chr11 5276367 5276388 5276372 5276367 -
ccctccctgtgtccatggatca

SEQ ID NO: 134921 - DNA, 22 bp, Artificial Sequence
  Synthetic oligonucleotide; CTC chr11 5276362 5276383 5276367 5276362 -
cctgtgtccatggatcactggt

SEQ ID NO: 134922 - DNA, 22 bp, Artificial Sequence
  Synthetic oligonucleotide; CTG chr11 5276358 5276379 5276363 5276358 -
tgtccatggatcactggttttt

SEQ ID NO: 134923 - DNA, 22 bp, Artificial Sequence
  Synthetic oligonucleotide; CTG chr11 5276342 5276363 5276347 5276342 -
gtttttttttgttttttttttt

SEQ ID NO: 134924 - DNA, 22 bp, Artificial Sequence
  Synthetic oligonucleotide; TTT chr11 5276338 5276359 5276343 5276338 -
ttttttgttttttttttttttt

SEQ ID NO: 134925 - DNA, 22 bp, Artificial Sequence
  Synthetic oligonucleotide; TTT chr11 5276337 5276358 5276342 5276337 -
tttttgtttttttttttttttt

SEQ ID NO: 134926 - DNA, 22 bp, Artificial Sequence
  Synthetic oligonucleotide; TTT chr11 5276336 5276357 5276341 5276336 -
ttttgtttttttttttttttta

SEQ ID NO: 134927 - DNA, 22 bp, Artificial Sequence
  Synthetic oligonucleotide; TTT chr11 5276335 5276356 5276340 5276335 -
tttgttttttttttttttttaa

SEQ ID NO: 134928 - DNA, 22 bp, Artificial Sequence
  Synthetic oligonucleotide; TTT chr11 5276334 5276355 5276339 5276334 -
ttgttttttttttttttttaaa

SEQ ID NO: 134929 - DNA, 22 bp, Artificial Sequence
  Synthetic oligonucleotide; TTT chr11 5276333 5276354 5276338 5276333 -
tgttttttttttttttttaaag

SEQ ID NO: 134930 - DNA, 22 bp, Artificial Sequence
  Synthetic oligonucleotide; TTT chr11 5276332 5276353 5276337 5276332 -
gttttttttttttttttaaagt

SEQ ID NO: 134931 - DNA, 22 bp, Artificial Sequence
  Synthetic oligonucleotide; TTG chr11 5276331 5276352 5276336 5276331 -
ttttttttttttttttaaagtc

SEQ ID NO: 134932 - DNA, 22 bp, Artificial Sequence
  Synthetic oligonucleotide; TTT chr11 5276328 5276349 5276333 5276328 -
tttttttttttttaaagtctca

SEQ ID NO: 134933 - DNA, 22 bp, Artificial Sequence
  Synthetic oligonucleotide; TTT chr11 5276327 5276348 5276332 5276327 -
ttttttttttttaaagtctcag

SEQ ID NO: 134934 - DNA, 22 bp, Artificial Sequence
  Synthetic oligonucleotide; TTT chr11 5276326 5276347 5276331 5276326 -
tttttttttttaaagtctcagt

SEQ ID NO: 134935 - DNA, 22 bp, Artificial Sequence
  Synthetic oligonucleotide; TTT chr11 5276325 5276346 5276330 5276325 -
ttttttttttaaagtctcagtt

SEQ ID NO: 134936 - DNA, 22 bp, Artificial Sequence
  Synthetic oligonucleotide; TTT chr11 5276324 5276345 5276329 5276324 -
tttttttttaaagtctcagtta

SEQ ID NO: 134937 - DNA, 22 bp, Artificial Sequence
  Synthetic oligonucleotide; TTT chr11 5276323 5276344 5276328 5276323 -
ttttttttaaagtctcagttaa

SEQ ID NO: 134938 - DNA, 22 bp, Artificial Sequence
  Synthetic oligonucleotide; TTT chr11 5276322 5276343 5276327 5276322 -
tttttttaaagtctcagttaaa

SEQ ID NO: 134939 - DNA, 22 bp, Artificial Sequence
  Synthetic oligonucleotide; TTT chr11 5276321 5276342 5276326 5276321 -
ttttttaaagtctcagttaaat

SEQ ID NO: 134940 - DNA, 22 bp, Artificial Sequence
  Synthetic oligonucleotide; TTT chr11 5276320 5276341 5276325 5276320 -
tttttaaagtctcagttaaatt

SEQ ID NO: 134941 - DNA, 22 bp, Artificial Sequence
  Synthetic oligonucleotide; TTT chr11 5276319 5276340 5276324 5276319 -
ttttaaagtctcagttaaattt

SEQ ID NO: 134942 - DNA, 22 bp, Artificial Sequence
  Synthetic oligonucleotide; TTT chr11 5276318 5276339 5276323 5276318 -
tttaaagtctcagttaaatttt

SEQ ID NO: 134943 - DNA, 22 bp, Artificial Sequence
  Synthetic oligonucleotide; TTT chr11 5276317 5276338 5276322 5276317 -
ttaaagtctcagttaaattttt

SEQ ID NO: 134944 - DNA, 22 bp, Artificial Sequence
  Synthetic oligonucleotide; TTT chr11 5276316 5276337 5276321 5276316 -
taaagtctcagttaaatttttg

SEQ ID NO: 134945 - DNA, 22 bp, Artificial Sequence
  Synthetic oligonucleotide; TTT chr11 5276315 5276336 5276320 5276315 -
aaagtctcagttaaatttttgg

SEQ ID NO: 134946 - DNA, 22 bp, Artificial Sequence
  Synthetic oligonucleotide; TTA chr11 5276314 5276335 5276319 5276314 -
aagtctcagttaaatttttgga

SEQ ID NO: 134947 - DNA, 22 bp, Artificial Sequence
  Synthetic oligonucleotide; CTC chr11 5276307 5276328 5276312 5276307 -
agttaaatttttggaatgtaat

SEQ ID NO: 134948 - DNA, 22 bp, Artificial Sequence
  Synthetic oligonucleotide; TTA chr11 5276302 5276323 5276307 5276302 -
aatttttggaatgtaatttatt

SEQ ID NO: 134949 - DNA, 22 bp, Artificial Sequence
  Synthetic oligonucleotide; TTT chr11 5276297 5276318 5276302 5276297 -
ttggaatgtaatttattttcct

SEQ ID NO: 134950 - DNA, 22 bp, Artificial Sequence
  Synthetic oligonucleotide; TTT chr11 5276296 5276317 5276301 5276296 -
tggaatgtaatttattttcctg

SEQ ID NO: 134951 - DNA, 22 bp, Artificial Sequence
  Synthetic oligonucleotide; TTT chr11 5276295 5276316 5276300 5276295 -
ggaatgtaatttattttcctgg

SEQ ID NO: 134952 - DNA, 22 bp, Artificial Sequence
  Synthetic oligonucleotide; TTG chr11 5276294 5276315 5276299 5276294 -
gaatgtaatttattttcctggt

SEQ ID NO: 134953 - DNA, 22 bp, Artificial Sequence
  Synthetic oligonucleotide; TTT chr11 5276283 5276304 5276288 5276283 -
attttcctggtatcctaggact

SEQ ID NO: 134954 - DNA, 22 bp, Artificial Sequence
  Synthetic oligonucleotide; TTA chr11 5276282 5276303 5276287 5276282 -
ttttcctggtatcctaggactt

SEQ ID NO: 134955 - DNA, 22 bp, Artificial Sequence
  Synthetic oligonucleotide; TTT chr11 5276279 5276300 5276284 5276279 -
tcctggtatcctaggacttgca

SEQ ID NO: 134956 - DNA, 22 bp, Artificial Sequence
  Synthetic oligonucleotide; TTT chr11 5276278 5276299 5276283 5276278 -
cctggtatcctaggacttgcaa

SEQ ID NO: 134957 - DNA, 22 bp, Artificial Sequence
  Synthetic oligonucleotide; TTC chr11 5276277 5276298 5276282 5276277 -
ctggtatcctaggacttgcaag

SEQ ID NO: 134958 - DNA, 22 bp, Artificial Sequence
  Synthetic oligonucleotide; CTG chr11 5276274 5276295 5276279 5276274 -
gtatcctaggacttgcaagtta

SEQ ID NO: 134959 - DNA, 22 bp, Artificial Sequence
  Synthetic oligonucleotide; CTA chr11 5276266 5276287 5276271 5276266 -
ggacttgcaagttatctggtca

SEQ ID NO: 134960 - DNA, 22 bp, Artificial Sequence
  Synthetic oligonucleotide; CTT chr11 5276260 5276281 5276265 5276260 -
gcaagttatctggtcactttag

SEQ ID NO: 134961 - DNA, 22 bp, Artificial Sequence
  Synthetic oligonucleotide; TTG chr11 5276259 5276280 5276264 5276259 -
caagttatctggtcactttagc

SEQ ID NO: 134962 - DNA, 22 bp, Artificial Sequence
  Synthetic oligonucleotide; TTA chr11 5276252 5276273 5276257 5276252 -
tctggtcactttagccctcacg

SEQ ID NO: 134963 - DNA, 22 bp, Artificial Sequence
  Synthetic oligonucleotide; CTG chr11 5276248 5276269 5276253 5276248 -
gtcactttagccctcacgtttt

SEQ ID NO: 134964 - DNA, 22 bp, Artificial Sequence
  Synthetic oligonucleotide; CTT chr11 5276241 5276262 5276246 5276241 -
tagccctcacgttttgatgata

SEQ ID NO: 134965 - DNA, 22 bp, Artificial Sequence
  Synthetic oligonucleotide; TTT chr11 5276240 5276261 5276245 5276240 -
agccctcacgttttgatgataa

SEQ ID NO: 134966 - DNA, 22 bp, Artificial Sequence
  Synthetic oligonucleotide; TTA chr11 5276239 5276260 5276244 5276239 -
gccctcacgttttgatgataat

SEQ ID NO: 134967 - DNA, 22 bp, Artificial Sequence
  Synthetic oligonucleotide; CTC chr11 5276233 5276254 5276238 5276233 -
acgttttgatgataatcacata

SEQ ID NO: 134968 - DNA, 22 bp, Artificial Sequence
  Synthetic oligonucleotide; TTT chr11 5276227 5276248 5276232 5276227 -
tgatgataatcacatatttgta

SEQ ID NO: 134969 - DNA, 22 bp, Artificial Sequence
  Synthetic oligonucleotide; TTT chr11 5276226 5276247 5276231 5276226 -
gatgataatcacatatttgtaa

SEQ ID NO: 134970 - DNA, 22 bp, Artificial Sequence
  Synthetic oligonucleotide; TTG chr11 5276225 5276246 5276230 5276225 -
atgataatcacatatttgtaaa

SEQ ID NO: 134971 - DNA, 22 bp, Artificial Sequence
  Synthetic oligonucleotide; TTT chr11 5276208 5276229 5276213 5276208 -
gtaaacacaacacacacacaca

SEQ ID NO: 134972 - DNA, 22 bp, Artificial Sequence
  Synthetic oligonucleotide; TTG chr11 5276207 5276228 5276212 5276207 -
taaacacaacacacacacacac

SEQ ID NO: 134973 - DNA, 22 bp, Artificial Sequence
  Synthetic oligonucleotide; TTT chr11 5276125 5276146 5276130 5276125 -
atcgggcatttctgagcaacta

SEQ ID NO: 134974 - DNA, 22 bp, Artificial Sequence
  Synthetic oligonucleotide; TTA chr11 5276124 5276145 5276129 5276124 -
tcgggcatttctgagcaactaa

SEQ ID NO: 134975 - DNA, 22 bp, Artificial Sequence
  Synthetic oligonucleotide; TTT chr11 5276114 5276135 5276119 5276114 -
ctgagcaactaatcatgcagga

SEQ ID NO: 134976 - DNA, 22 bp, Artificial Sequence
  Synthetic oligonucleotide; TTC chr11 5276113 5276134 5276118 5276113 -
tgagcaactaatcatgcaggac

SEQ ID NO: 134977 - DNA, 22 bp, Artificial Sequence
  Synthetic oligonucleotide; CTG chr11 5276111 5276132 5276116 5276111 -
agcaactaatcatgcaggactc

SEQ ID NO: 134978 - DNA, 22 bp, Artificial Sequence
  Synthetic oligonucleotide; CTA chr11 5276103 5276124 5276108 5276103 -
atcatgcaggactctcaaacac

SEQ ID NO: 134979 - DNA, 22 bp, Artificial Sequence
  Synthetic oligonucleotide; CTC chr11 5276089 5276110 5276094 5276089 -
tcaaacactaacctatagcctt

SEQ ID NO: 134980 - DNA, 22 bp, Artificial Sequence
  Synthetic oligonucleotide; CTC chr11 5276087 5276108 5276092 5276087 -
aaacactaacctatagcctttt

SEQ ID NO: 134981 - DNA, 22 bp, Artificial Sequence
  Synthetic oligonucleotide; CTA chr11 5276079 5276100 5276084 5276079 -
acctatagccttttctatgtat

SEQ ID NO: 134982 - DNA, 22 bp, Artificial Sequence
  Synthetic oligonucleotide; CTA chr11 5276074 5276095 5276079 5276074 -
tagccttttctatgtatctact

SEQ ID NO: 134983 - DNA, 22 bp, Artificial Sequence
  Synthetic oligonucleotide; CTT chr11 5276067 5276088 5276072 5276067 -
ttctatgtatctacttgtgtag

SEQ ID NO: 134984 - DNA, 22 bp, Artificial Sequence
  Synthetic oligonucleotide; TTT chr11 5276066 5276087 5276071 5276066 -
tctatgtatctacttgtgtaga

SEQ ID NO: 134985 - DNA, 22 bp, Artificial Sequence
  Synthetic oligonucleotide; TTT chr11 5276065 5276086 5276070 5276065 -
ctatgtatctacttgtgtagaa

SEQ ID NO: 134986 - DNA, 22 bp, Artificial Sequence
  Synthetic oligonucleotide; TTC chr11 5276064 5276085 5276069 5276064 -
tatgtatctacttgtgtagaaa

SEQ ID NO: 134987 - DNA, 22 bp, Artificial Sequence
  Synthetic oligonucleotide; CTA chr11 5276062 5276083 5276067 5276062 -
tgtatctacttgtgtagaaacc

SEQ ID NO: 134988 - DNA, 22 bp, Artificial Sequence
  Synthetic oligonucleotide; CTA chr11 5276054 5276075 5276059 5276054 -
cttgtgtagaaaccaagcgtgg

SEQ ID NO: 134989 - DNA, 22 bp, Artificial Sequence
  Synthetic oligonucleotide; CTT chr11 5276051 5276072 5276056 5276051 -
gtgtagaaaccaagcgtgggga

SEQ ID NO: 134990 - DNA, 22 bp, Artificial Sequence
  Synthetic oligonucleotide; TTG chr11 5276050 5276071 5276055 5276050 -
tgtagaaaccaagcgtggggac

SEQ ID NO: 134991 - DNA, 22 bp, Artificial Sequence
  Synthetic oligonucleotide; CTG chr11 5276026 5276047 5276031 5276026 -
agaaggcaatagcaggagcatt

SEQ ID NO: 134992 - DNA, 22 bp, Artificial Sequence
  Synthetic oligonucleotide; TTC chr11 5276003 5276024 5276008 5276003 -
tgactctcactgcctttagcta

SEQ ID NO: 134993 - DNA, 22 bp, Artificial Sequence
  Synthetic oligonucleotide; CTG chr11 5276001 5276022 5276006 5276001 -
actctcactgcctttagctagg

SEQ ID NO: 134994 - DNA, 22 bp, Artificial Sequence
  Synthetic oligonucleotide; CTC chr11 5275997 5276018 5276002 5275997 -
tcactgcctttagctaggcccc

SEQ ID NO: 134995 - DNA, 22 bp, Artificial Sequence
  Synthetic oligonucleotide; CTC chr11 5275995 5276016 5276000 5275995 -
actgcctttagctaggcccctc

SEQ ID NO: 134996 - DNA, 22 bp, Artificial Sequence
  Synthetic oligonucleotide; CTG chr11 5275991 5276012 5275996 5275991 -
cctttagctaggcccctccctc

SEQ ID NO: 134997 - DNA, 22 bp, Artificial Sequence
  Synthetic oligonucleotide; CTT chr11 5275987 5276008 5275992 5275987 -
tagctaggcccctccctcatca

SEQ ID NO: 134998 - DNA, 22 bp, Artificial Sequence
  Synthetic oligonucleotide; TTT chr11 5275986 5276007 5275991 5275986 -
agctaggcccctccctcatcac

SEQ ID NO: 134999 - DNA, 22 bp, Artificial Sequence
  Synthetic oligonucleotide; TTA chr11 5275985 5276006 5275990 5275985 -
gctaggcccctccctcatcaca

SEQ ID NO: 135000 - DNA, 22 bp, Artificial Sequence
  Synthetic oligonucleotide; CTA chr11 5275981 5276002 5275986 5275981 -
ggcccctccctcatcacagctc

SEQ ID NO: 135001 - DNA, 22 bp, Artificial Sequence
  Synthetic oligonucleotide; CTC chr11 5275973 5275994 5275978 5275973 -
cctcatcacagctcagcatagt

SEQ ID NO: 135002 - DNA, 22 bp, Artificial Sequence
  Synthetic oligonucleotide; CTC chr11 5275969 5275990 5275974 5275969 -
atcacagctcagcatagtcctg

SEQ ID NO: 135003 - DNA, 22 bp, Artificial Sequence
  Synthetic oligonucleotide; CTC chr11 5275959 5275980 5275964 5275959 -
agcatagtcctgagctcttatc

SEQ ID NO: 135004 - DNA, 22 bp, Artificial Sequence
  Synthetic oligonucleotide; CTG chr11 5275947 5275968 5275952 5275947 -
agctcttatctatatccacaca

SEQ ID NO: 135005 - DNA, 22 bp, Artificial Sequence
  Synthetic oligonucleotide; CTC chr11 5275942 5275963 5275947 5275942 -
ttatctatatccacacacagtt

SEQ ID NO: 135006 - DNA, 22 bp, Artificial Sequence
  Synthetic oligonucleotide; CTT chr11 5275940 5275961 5275945 5275940 -
atctatatccacacacagtttc

SEQ ID NO: 135007 - DNA, 22 bp, Artificial Sequence
  Synthetic oligonucleotide; TTA chr11 5275939 5275960 5275944 5275939 -
tctatatccacacacagtttct

SEQ ID NO: 135008 - DNA, 22 bp, Artificial Sequence
  Synthetic oligonucleotide; CTA chr11 5275935 5275956 5275940 5275935 -
tatccacacacagtttctgacg

SEQ ID NO: 135009 - DNA, 22 bp, Artificial Sequence
  Synthetic oligonucleotide; TTT chr11 5275919 5275940 5275924 5275919 -
ctgacgctgcccagctatcacc

SEQ ID NO: 135010 - DNA, 22 bp, Artificial Sequence
  Synthetic oligonucleotide; TTC chr11 5275918 5275939 5275923 5275918 -
tgacgctgcccagctatcacca

SEQ ID NO: 135011 - DNA, 22 bp, Artificial Sequence
  Synthetic oligonucleotide; CTG chr11 5275916 5275937 5275921 5275916 -
acgctgcccagctatcaccatc

SEQ ID NO: 135012 - DNA, 22 bp, Artificial Sequence
  Synthetic oligonucleotide; CTG chr11 5275910 5275931 5275915 5275910 -
cccagctatcaccatcccaagt

SEQ ID NO: 135013 - DNA, 22 bp, Artificial Sequence
  Synthetic oligonucleotide; CTA chr11 5275902 5275923 5275907 5275902 -
tcaccatcccaagtctaaagaa

SEQ ID NO: 135014 - DNA, 22 bp, Artificial Sequence
  Synthetic oligonucleotide; CTA chr11 5275885 5275906 5275890 5275885 -
aagaaaaaaataatgggtttgc

SEQ ID NO: 135015 - DNA, 22 bp, Artificial Sequence
  Synthetic oligonucleotide; TTT chr11 5275865 5275886 5275870 5275865 -
gcccatctctgttgattagaaa

SEQ ID NO: 135016 - DNA, 22 bp, Artificial Sequence
  Synthetic oligonucleotide; TTG chr11 5275864 5275885 5275869 5275864 -
cccatctctgttgattagaaaa

SEQ ID NO: 135017 - DNA, 22 bp, Artificial Sequence
  Synthetic oligonucleotide; CTC chr11 5275856 5275877 5275861 5275856 -
tgttgattagaaaacaaaacaa

SEQ ID NO: 135018 - DNA, 22 bp, Artificial Sequence
  Synthetic oligonucleotide; CTG chr11 5275854 5275875 5275859 5275854 -
ttgattagaaaacaaaacaaaa

SEQ ID NO: 135019 - DNA, 22 bp, Artificial Sequence
  Synthetic oligonucleotide; TTG chr11 5275851 5275872 5275856 5275851 -
attagaaaacaaaacaaaataa

SEQ ID NO: 135020 - DNA, 22 bp, Artificial Sequence
  Synthetic oligonucleotide; TTA chr11 5275847 5275868 5275852 5275847 -
gaaaacaaaacaaaataaaata

SEQ ID NO: 135021 - DNA, 22 bp, Artificial Sequence
  Synthetic oligonucleotide; CTA chr11 5275817 5275838 5275822 5275817 -
agctcccagaaaacatgactaa

SEQ ID NO: 135022 - DNA, 22 bp, Artificial Sequence
  Synthetic oligonucleotide; CTC chr11 5275812 5275833 5275817 5275812 -
ccagaaaacatgactaaaccag

SEQ ID NO: 135023 - DNA, 22 bp, Artificial Sequence
  Synthetic oligonucleotide; CTA chr11 5275796 5275817 5275801 5275796 -
aaccagcaagaagaagaaaata

SEQ ID NO: 135024 - DNA, 22 bp, Artificial Sequence
  Synthetic oligonucleotide; CTG chr11 5275752 5275773 5275757 5275752 -
gtgacactagtgtctgaatgag

SEQ ID NO: 135025 - DNA, 22 bp, Artificial Sequence
  Synthetic oligonucleotide; CTA chr11 5275743 5275764 5275748 5275743 -
gtgtctgaatgaggcttgagta

SEQ ID NO: 135026 - DNA, 22 bp, Artificial Sequence
  Synthetic oligonucleotide; CTG chr11 5275736 5275757 5275741 5275736 -
aatgaggcttgagtacagaaaa

SEQ ID NO: 135027 - DNA, 22 bp, Artificial Sequence
  Synthetic oligonucleotide; CTT chr11 5275726 5275747 5275731 5275726 -
gagtacagaaaagaggctctag

SEQ ID NO: 135028 - DNA, 22 bp, Artificial Sequence
  Synthetic oligonucleotide; TTG chr11 5275725 5275746 5275730 5275725 -
agtacagaaaagaggctctagc

SEQ ID NO: 135029 - DNA, 22 bp, Artificial Sequence
  Synthetic oligonucleotide; CTC chr11 5275707 5275728 5275712 5275707 -
tagcagcatagtggtttagagg

SEQ ID NO: 135030 - DNA, 22 bp, Artificial Sequence
  Synthetic oligonucleotide; CTA chr11 5275705 5275726 5275710 5275705 -
gcagcatagtggtttagaggag

SEQ ID NO: 135031 - DNA, 22 bp, Artificial Sequence
  Synthetic oligonucleotide; TTT chr11 5275690 5275711 5275695 5275690 -
agaggagatgtttctttccttc

SEQ ID NO: 135032 - DNA, 22 bp, Artificial Sequence
  Synthetic oligonucleotide; TTA chr11 5275689 5275710 5275694 5275689 -
gaggagatgtttctttccttca

SEQ ID NO: 135033 - DNA, 22 bp, Artificial Sequence
  Synthetic oligonucleotide; TTT chr11 5275677 5275698 5275682 5275677 -
ctttccttcacagatgccttag

SEQ ID NO: 135034 - DNA, 22 bp, Artificial Sequence
  Synthetic oligonucleotide; TTC chr11 5275676 5275697 5275681 5275676 -
tttccttcacagatgccttagc

SEQ ID NO: 135035 - DNA, 22 bp, Artificial Sequence
  Synthetic oligonucleotide; CTT chr11 5275674 5275695 5275679 5275674 -
tccttcacagatgccttagcct

SEQ ID NO: 135036 - DNA, 22 bp, Artificial Sequence
  Synthetic oligonucleotide; TTT chr11 5275673 5275694 5275678 5275673 -
ccttcacagatgccttagcctc

SEQ ID NO: 135037 - DNA, 22 bp, Artificial Sequence
  Synthetic oligonucleotide; TTC chr11 5275672 5275693 5275677 5275672 -
cttcacagatgccttagcctca

SEQ ID NO: 135038 - DNA, 22 bp, Artificial Sequence
  Synthetic oligonucleotide; CTT chr11 5275669 5275690 5275674 5275669 -
cacagatgccttagcctcaata

SEQ ID NO: 135039 - DNA, 22 bp, Artificial Sequence
  Synthetic oligonucleotide; TTC chr11 5275668 5275689 5275673 5275668 -
acagatgccttagcctcaataa

SEQ ID NO: 135040 - DNA, 22 bp, Artificial Sequence
  Synthetic oligonucleotide; CTT chr11 5275657 5275678 5275662 5275657 -
agcctcaataagcttgcggttg

SEQ ID NO: 135041 - DNA, 22 bp, Artificial Sequence
  Synthetic oligonucleotide; TTA chr11 5275656 5275677 5275661 5275656 -
gcctcaataagcttgcggttgt

SEQ ID NO: 135042 - DNA, 22 bp, Artificial Sequence
  Synthetic oligonucleotide; CTC chr11 5275651 5275672 5275656 5275651 -
aataagcttgcggttgtggaag

SEQ ID NO: 135043 - DNA, 22 bp, Artificial Sequence
  Synthetic oligonucleotide; CTT chr11 5275642 5275663 5275647 5275642 -
gcggttgtggaagtttactttc

SEQ ID NO: 135044 - DNA, 22 bp, Artificial Sequence
  Synthetic oligonucleotide; TTG chr11 5275641 5275662 5275646 5275641 -
cggttgtggaagtttactttca

SEQ ID NO: 135045 - DNA, 22 bp, Artificial Sequence
  Synthetic oligonucleotide; TTG chr11 5275635 5275656 5275640 5275635 -
tggaagtttactttcagaacaa

SEQ ID NO: 135046 - DNA, 22 bp, Artificial Sequence
  Synthetic oligonucleotide; TTT chr11 5275626 5275647 5275631 5275626 -
actttcagaacaaactcctgtg

SEQ ID NO: 135047 - DNA, 22 bp, Artificial Sequence
  Synthetic oligonucleotide; TTA chr11 5275625 5275646 5275630 5275625 -
ctttcagaacaaactcctgtgg

SEQ ID NO: 135048 - DNA, 22 bp, Artificial Sequence
  Synthetic oligonucleotide; CTT chr11 5275622 5275643 5275627 5275622 -
tcagaacaaactcctgtggggc

SEQ ID NO: 135049 - DNA, 22 bp, Artificial Sequence
  Synthetic oligonucleotide; TTT chr11 5275621 5275642 5275626 5275621 -
cagaacaaactcctgtggggct

SEQ ID NO: 135050 - DNA, 22 bp, Artificial Sequence
  Synthetic oligonucleotide; TTC chr11 5275620 5275641 5275625 5275620 -
agaacaaactcctgtggggcta

SEQ ID NO: 135051 - DNA, 22 bp, Artificial Sequence
  Synthetic oligonucleotide; CTC chr11 5275609 5275630 5275614 5275609 -
ctgtggggctagaattattgat

SEQ ID NO: 135052 - DNA, 22 bp, Artificial Sequence
  Synthetic oligonucleotide; CTG chr11 5275606 5275627 5275611 5275606 -
tggggctagaattattgatggc

SEQ ID NO: 135053 - DNA, 22 bp, Artificial Sequence
  Synthetic oligonucleotide; CTA chr11 5275598 5275619 5275603 5275598 -
gaattattgatggctaaaagaa

SEQ ID NO: 135054 - DNA, 22 bp, Artificial Sequence
  Synthetic oligonucleotide; TTA chr11 5275592 5275613 5275597 5275592 -
ttgatggctaaaagaagcccgg

SEQ ID NO: 135055 - DNA, 22 bp, Artificial Sequence
  Synthetic oligonucleotide; TTG chr11 5275589 5275610 5275594 5275589 -
atggctaaaagaagcccggggg

SEQ ID NO: 135056 - DNA, 22 bp, Artificial Sequence
  Synthetic oligonucleotide; CTA chr11 5275582 5275603 5275587 5275582 -
aaagaagcccgggggagggaaa

SEQ ID NO: 135057 - DNA, 22 bp, Artificial Sequence
  Synthetic oligonucleotide; TTC chr11 5275552 5275573 5275557 5275552 -
agcatcctcacccttagtgaca

SEQ ID NO: 135058 - DNA, 22 bp, Artificial Sequence
  Synthetic oligonucleotide; CTC chr11 5275543 5275564 5275548 5275543 -
acccttagtgacacaaaacaga

SEQ ID NO: 135059 - DNA, 22 bp, Artificial Sequence
  Synthetic oligonucleotide; CTT chr11 5275537 5275558 5275542 5275537 -
agtgacacaaaacagagggggc

SEQ ID NO: 135060 - DNA, 22 bp, Artificial Sequence
  Synthetic oligonucleotide; TTA chr11 5275536 5275557 5275541 5275536 -
gtgacacaaaacagagggggcc

SEQ ID NO: 135061 - DNA, 22 bp, Artificial Sequence
  Synthetic oligonucleotide; CTG chr11 5275512 5275533 5275517 5275512 -
gttttccatatttcctcatgat

SEQ ID NO: 135062 - DNA, 22 bp, Artificial Sequence
  Synthetic oligonucleotide; TTT chr11 5275508 5275529 5275513 5275508 -
tccatatttcctcatgatggat

SEQ ID NO: 135063 - DNA, 22 bp, Artificial Sequence
  Synthetic oligonucleotide; TTT chr11 5275507 5275528 5275512 5275507 -
ccatatttcctcatgatggatg

SEQ ID NO: 135064 - DNA, 22 bp, Artificial Sequence
  Synthetic oligonucleotide; TTC chr11 5275506 5275527 5275511 5275506 -
catatttcctcatgatggatga

SEQ ID NO: 135065 - DNA, 22 bp, Artificial Sequence
  Synthetic oligonucleotide; TTT chr11 5275499 5275520 5275504 5275499 -
cctcatgatggatgatctcgtt

SEQ ID NO: 135066 - DNA, 22 bp, Artificial Sequence
  Synthetic oligonucleotide; TTC chr11 5275498 5275519 5275503 5275498 -
ctcatgatggatgatctcgtta

SEQ ID NO: 135067 - DNA, 22 bp, Artificial Sequence
  Synthetic oligonucleotide; CTC chr11 5275495 5275516 5275500 5275495 -
atgatggatgatctcgttaatg

SEQ ID NO: 135068 - DNA, 22 bp, Artificial Sequence
  Synthetic oligonucleotide; CTC chr11 5275480 5275501 5275485 5275480 -
gttaatgaaggtggtctgacga

SEQ ID NO: 135069 - DNA, 22 bp, Artificial Sequence
  Synthetic oligonucleotide; TTA chr11 5275476 5275497 5275481 5275476 -
atgaaggtggtctgacgagatc

SEQ ID NO: 135070 - DNA, 22 bp, Artificial Sequence
  Synthetic oligonucleotide; CTG chr11 5275462 5275483 5275467 5275462 -
acgagatcattgcttcttccat

SEQ ID NO: 135071 - DNA, 22 bp, Artificial Sequence
  Synthetic oligonucleotide; TTG chr11 5275450 5275471 5275455 5275450 -
cttcttccatttaagccttgct

SEQ ID NO: 135072 - DNA, 22 bp, Artificial Sequence
  Synthetic oligonucleotide; CTT chr11 5275447 5275468 5275452 5275447 -
cttccatttaagccttgctcac

SEQ ID NO: 135073 - DNA, 22 bp, Artificial Sequence
  Synthetic oligonucleotide; TTC chr11 5275446 5275467 5275451 5275446 -
ttccatttaagccttgctcact

SEQ ID NO: 135074 - DNA, 22 bp, Artificial Sequence
  Synthetic oligonucleotide; CTT chr11 5275444 5275465 5275449 5275444 -
ccatttaagccttgctcacttg

SEQ ID NO: 135075 - DNA, 22 bp, Artificial Sequence
  Synthetic oligonucleotide; TTC chr11 5275443 5275464 5275448 5275443 -
catttaagccttgctcacttgc

SEQ ID NO: 135076 - DNA, 22 bp, Artificial Sequence
  Synthetic oligonucleotide; TTT chr11 5275438 5275459 5275443 5275438 -
aagccttgctcacttgccaatc

SEQ ID NO: 135077 - DNA, 22 bp, Artificial Sequence
  Synthetic oligonucleotide; TTA chr11 5275437 5275458 5275442 5275437 -
agccttgctcacttgccaatcc

SEQ ID NO: 135078 - DNA, 22 bp, Artificial Sequence
  Synthetic oligonucleotide; CTT chr11 5275431 5275452 5275436 5275431 -
gctcacttgccaatcctcagtt

SEQ ID NO: 135079 - DNA, 22 bp, Artificial Sequence
  Synthetic oligonucleotide; TTG chr11 5275430 5275451 5275435 5275430 -
ctcacttgccaatcctcagttt

SEQ ID NO: 135080 - DNA, 22 bp, Artificial Sequence
  Synthetic oligonucleotide; CTC chr11 5275427 5275448 5275432 5275427 -
acttgccaatcctcagttttaa

SEQ ID NO: 135081 - DNA, 22 bp, Artificial Sequence
  Synthetic oligonucleotide; CTT chr11 5275423 5275444 5275428 5275423 -
gccaatcctcagttttaacctt

SEQ ID NO: 135082 - DNA, 22 bp, Artificial Sequence
  Synthetic oligonucleotide; TTG chr11 5275422 5275443 5275427 5275422 -
ccaatcctcagttttaaccttc

SEQ ID NO: 135083 - DNA, 22 bp, Artificial Sequence
  Synthetic oligonucleotide; CTC chr11 5275413 5275434 5275418 5275413 -
agttttaaccttctccagagaa

SEQ ID NO: 135084 - DNA, 22 bp, Artificial Sequence
  Synthetic oligonucleotide; TTT chr11 5275408 5275429 5275413 5275408 -
taaccttctccagagaaataca

SEQ ID NO: 135085 - DNA, 22 bp, Artificial Sequence
  Synthetic oligonucleotide; TTT chr11 5275407 5275428 5275412 5275407 -
aaccttctccagagaaatacac

SEQ ID NO: 135086 - DNA, 22 bp, Artificial Sequence
  Synthetic oligonucleotide; TTA chr11 5275406 5275427 5275411 5275406 -
accttctccagagaaatacaca

SEQ ID NO: 135087 - DNA, 22 bp, Artificial Sequence
  Synthetic oligonucleotide; CTT chr11 5275401 5275422 5275406 5275401 -
ctccagagaaatacacattttt

SEQ ID NO: 135088 - DNA, 22 bp, Artificial Sequence
  Synthetic oligonucleotide; TTC chr11 5275400 5275421 5275405 5275400 -
tccagagaaatacacatttttt

SEQ ID NO: 135089 - DNA, 22 bp, Artificial Sequence
  Synthetic oligonucleotide; CTC chr11 5275398 5275419 5275403 5275398 -
cagagaaatacacattttttat

SEQ ID NO: 135090 - DNA, 22 bp, Artificial Sequence
  Synthetic oligonucleotide; TTT chr11 5275381 5275402 5275386 5275381 -
tttattcaggaaacatactatg

SEQ ID NO: 135091 - DNA, 22 bp, Artificial Sequence
  Synthetic oligonucleotide; TTT chr11 5275380 5275401 5275385 5275380 -
ttattcaggaaacatactatgt

SEQ ID NO: 135092 - DNA, 22 bp, Artificial Sequence
  Synthetic oligonucleotide; TTT chr11 5275379 5275400 5275384 5275379 -
tattcaggaaacatactatgtt

SEQ ID NO: 135093 - DNA, 22 bp, Artificial Sequence
  Synthetic oligonucleotide; TTT chr11 5275378 5275399 5275383 5275378 -
attcaggaaacatactatgtta

SEQ ID NO: 135094 - DNA, 22 bp, Artificial Sequence
  Synthetic oligonucleotide; TTA chr11 5275377 5275398 5275382 5275377 -
ttcaggaaacatactatgttat

SEQ ID NO: 135095 - DNA, 22 bp, Artificial Sequence
  Synthetic oligonucleotide; TTC chr11 5275374 5275395 5275379 5275374 -
aggaaacatactatgttatagt

SEQ ID NO: 135096 - DNA, 22 bp, Artificial Sequence
  Synthetic oligonucleotide; CTA chr11 5275361 5275382 5275366 5275361 -
tgttatagtttcaatactaaat

SEQ ID NO: 135097 - DNA, 22 bp, Artificial Sequence
  Synthetic oligonucleotide; TTA chr11 5275356 5275377 5275361 5275356 -
tagtttcaatactaaataatca

SEQ ID NO: 135098 - DNA, 22 bp, Artificial Sequence
  Synthetic oligonucleotide; TTT chr11 5275350 5275371 5275355 5275350 -
caatactaaataatcaaagtac

SEQ ID NO: 135099 - DNA, 22 bp, Artificial Sequence
  Synthetic oligonucleotide; TTC chr11 5275349 5275370 5275354 5275349 -
aatactaaataatcaaagtact

SEQ ID NO: 135100 - DNA, 22 bp, Artificial Sequence
  Synthetic oligonucleotide; CTA chr11 5275342 5275363 5275347 5275342 -
aataatcaaagtactgaagata

SEQ ID NO: 135101 - DNA, 22 bp, Artificial Sequence
  Synthetic oligonucleotide; CTG chr11 5275326 5275347 5275331 5275326 -
aagatagcatgcataggcaaga

SEQ ID NO: 135102 - DNA, 22 bp, Artificial Sequence
  Synthetic oligonucleotide; CTT chr11 5275294 5275315 5275299 5275294 -
agctttatgttgctgttgtttc

SEQ ID NO: 135103 - DNA, 22 bp, Artificial Sequence
  Synthetic oligonucleotide; TTA chr11 5275293 5275314 5275298 5275293 -
gctttatgttgctgttgtttca

SEQ ID NO: 135104 - DNA, 22 bp, Artificial Sequence
  Synthetic oligonucleotide; CTT chr11 5275289 5275310 5275294 5275289 -
tatgttgctgttgtttcagaat

SEQ ID NO: 135105 - DNA, 22 bp, Artificial Sequence
  Synthetic oligonucleotide; TTT chr11 5275288 5275309 5275293 5275288 -
atgttgctgttgtttcagaatt

SEQ ID NO: 135106 - DNA, 22 bp, Artificial Sequence
  Synthetic oligonucleotide; TTA chr11 5275287 5275308 5275292 5275287 -
tgttgctgttgtttcagaattt

SEQ ID NO: 135107 - DNA, 22 bp, Artificial Sequence
  Synthetic oligonucleotide; TTG chr11 5275282 5275303 5275287 5275282 -
ctgttgtttcagaatttaaaaa

SEQ ID NO: 135108 - DNA, 22 bp, Artificial Sequence
  Synthetic oligonucleotide; CTG chr11 5275279 5275300 5275284 5275279 -
ttgtttcagaatttaaaaaaga

SEQ ID NO: 135109 - DNA, 22 bp, Artificial Sequence
  Synthetic oligonucleotide; TTG chr11 5275276 5275297 5275281 5275276 -
tttcagaatttaaaaaagatca

SEQ ID NO: 135110 - DNA, 22 bp, Artificial Sequence
  Synthetic oligonucleotide; TTT chr11 5275273 5275294 5275278 5275273 -
cagaatttaaaaaagatcacca

SEQ ID NO: 135111 - DNA, 22 bp, Artificial Sequence
  Synthetic oligonucleotide; TTC chr11 5275272 5275293 5275277 5275272 -
agaatttaaaaaagatcaccaa

SEQ ID NO: 135112 - DNA, 22 bp, Artificial Sequence
  Synthetic oligonucleotide; TTT chr11 5275265 5275286 5275270 5275265 -
aaaaaagatcaccaagtcaagg

SEQ ID NO: 135113 - DNA, 22 bp, Artificial Sequence
  Synthetic oligonucleotide; TTA chr11 5275264 5275285 5275269 5275264 -
aaaaagatcaccaagtcaagga

SEQ ID NO: 135114 - DNA, 22 bp, Artificial Sequence
  Synthetic oligonucleotide; CTT chr11 5275239 5275260 5275244 5275239 -
ctcagttctagcactagaggtg

SEQ ID NO: 135115 - DNA, 22 bp, Artificial Sequence
  Synthetic oligonucleotide; TTC chr11 5275238 5275259 5275243 5275238 -
tcagttctagcactagaggtgg

SEQ ID NO: 135116 - DNA, 22 bp, Artificial Sequence
  Synthetic oligonucleotide; CTC chr11 5275236 5275257 5275241 5275236 -
agttctagcactagaggtggaa

SEQ ID NO: 135117 - DNA, 22 bp, Artificial Sequence
  Synthetic oligonucleotide; TTC chr11 5275231 5275252 5275236 5275231 -
tagcactagaggtggaatctta

SEQ ID NO: 135118 - DNA, 22 bp, Artificial Sequence
  Synthetic oligonucleotide; CTA chr11 5275229 5275250 5275234 5275229 -
gcactagaggtggaatcttagc

SEQ ID NO: 135119 - DNA, 22 bp, Artificial Sequence
  Synthetic oligonucleotide; CTA chr11 5275223 5275244 5275228 5275223 -
gaggtggaatcttagcatataa

SEQ ID NO: 135120 - DNA, 22 bp, Artificial Sequence
  Synthetic oligonucleotide; CTT chr11 5275210 5275231 5275215 5275210 -
agcatataatcagaggtttttc

SEQ ID NO: 135121 - DNA, 22 bp, Artificial Sequence
  Synthetic oligonucleotide; TTA chr11 5275209 5275230 5275214 5275209 -
gcatataatcagaggtttttca

SEQ ID NO: 135122 - DNA, 22 bp, Artificial Sequence
  Synthetic oligonucleotide; TTT chr11 5275191 5275212 5275196 5275191 -
ttcaaaatttctagacataaga

SEQ ID NO: 135123 - DNA, 22 bp, Artificial Sequence
  Synthetic oligonucleotide; TTT chr11 5275190 5275211 5275195 5275190 -
tcaaaatttctagacataagat

SEQ ID NO: 135124 - DNA, 22 bp, Artificial Sequence
  Synthetic oligonucleotide; TTT chr11 5275189 5275210 5275194 5275189 -
caaaatttctagacataagatt

SEQ ID NO: 135125 - DNA, 22 bp, Artificial Sequence
  Synthetic oligonucleotide; TTC chr11 5275188 5275209 5275193 5275188 -
aaaatttctagacataagattc

SEQ ID NO: 135126 - DNA, 22 bp, Artificial Sequence
  Synthetic oligonucleotide; TTT chr11 5275181 5275202 5275186 5275181 -
ctagacataagattcaaagccc

SEQ ID NO: 135127 - DNA, 22 bp, Artificial Sequence
  Synthetic oligonucleotide; TTC chr11 5275180 5275201 5275185 5275180 -
tagacataagattcaaagccct

SEQ ID NO: 135128 - DNA, 22 bp, Artificial Sequence
  Synthetic oligonucleotide; CTA chr11 5275178 5275199 5275183 5275178 -
gacataagattcaaagccctgc

SEQ ID NO: 135129 - DNA, 22 bp, Artificial Sequence
  Synthetic oligonucleotide; TTC chr11 5275166 5275187 5275171 5275166 -
aaagccctgcacttaaaatagt

SEQ ID NO: 135130 - DNA, 22 bp, Artificial Sequence
  Synthetic oligonucleotide; CTG chr11 5275157 5275178 5275162 5275157 -
cacttaaaatagtctcatttga

SEQ ID NO: 135131 - DNA, 22 bp, Artificial Sequence
  Synthetic oligonucleotide; CTT chr11 5275152 5275173 5275157 5275152 -
aaaatagtctcatttgaattaa

SEQ ID NO: 135132 - DNA, 22 bp, Artificial Sequence
  Synthetic oligonucleotide; TTA chr11 5275151 5275172 5275156 5275151 -
aaatagtctcatttgaattaac

SEQ ID NO: 135133 - DNA, 22 bp, Artificial Sequence
  Synthetic oligonucleotide; CTC chr11 5275141 5275162 5275146 5275141 -
atttgaattaactctttatata

SEQ ID NO: 135134 - DNA, 22 bp, Artificial Sequence
  Synthetic oligonucleotide; TTT chr11 5275137 5275158 5275142 5275137 -
gaattaactctttatataaatt

SEQ ID NO: 135135 - DNA, 22 bp, Artificial Sequence
  Synthetic oligonucleotide; TTG chr11 5275136 5275157 5275141 5275136 -
aattaactctttatataaattg

SEQ ID NO: 135136 - DNA, 22 bp, Artificial Sequence
  Synthetic oligonucleotide; TTA chr11 5275131 5275152 5275136 5275131 -
actctttatataaattgaaagc

SEQ ID NO: 135137 - DNA, 22 bp, Artificial Sequence
  Synthetic oligonucleotide; CTC chr11 5275127 5275148 5275132 5275127 -
tttatataaattgaaagcacat

SEQ ID NO: 135138 - DNA, 22 bp, Artificial Sequence
  Synthetic oligonucleotide; CTT chr11 5275125 5275146 5275130 5275125 -
tatataaattgaaagcacattc

SEQ ID NO: 135139 - DNA, 22 bp, Artificial Sequence
  Synthetic oligonucleotide; TTT chr11 5275124 5275145 5275129 5275124 -
atataaattgaaagcacattct

SEQ ID NO: 135140 - DNA, 22 bp, Artificial Sequence
  Synthetic oligonucleotide; TTA chr11 5275123 5275144 5275128 5275123 -
tataaattgaaagcacattctg

SEQ ID NO: 135141 - DNA, 22 bp, Artificial Sequence
  Synthetic oligonucleotide; TTG chr11 5275114 5275135 5275119 5275114 -
aaagcacattctgaactacttc

SEQ ID NO: 135142 - DNA, 22 bp, Artificial Sequence
  Synthetic oligonucleotide; TTC chr11 5275103 5275124 5275108 5275103 -
tgaactacttcagagtattgtt

SEQ ID NO: 135143 - DNA, 22 bp, Artificial Sequence
  Synthetic oligonucleotide; CTG chr11 5275101 5275122 5275106 5275101 -
aactacttcagagtattgtttt

SEQ ID NO: 135144 - DNA, 22 bp, Artificial Sequence
  Synthetic oligonucleotide; CTA chr11 5275096 5275117 5275101 5275096 -
cttcagagtattgttttatttc

SEQ ID NO: 135145 - DNA, 22 bp, Artificial Sequence
  Synthetic oligonucleotide; CTT chr11 5275093 5275114 5275098 5275093 -
cagagtattgttttatttctat

SEQ ID NO: 135146 - DNA, 22 bp, Artificial Sequence
  Synthetic oligonucleotide; TTC chr11 5275092 5275113 5275097 5275092 -
agagtattgttttatttctatg

SEQ ID NO: 135147 - DNA, 22 bp, Artificial Sequence
  Synthetic oligonucleotide; TTG chr11 5275083 5275104 5275088 5275083 -
ttttatttctatgttcttagtt

SEQ ID NO: 135148 - DNA, 22 bp, Artificial Sequence
  Synthetic oligonucleotide; TTT chr11 5275080 5275101 5275085 5275080 -
tatttctatgttcttagttcat

SEQ ID NO: 135149 - DNA, 22 bp, Artificial Sequence
  Synthetic oligonucleotide; TTT chr11 5275079 5275100 5275084 5275079 -
atttctatgttcttagttcata

SEQ ID NO: 135150 - DNA, 22 bp, Artificial Sequence
  Synthetic oligonucleotide; TTA chr11 5275078 5275099 5275083 5275078 -
tttctatgttcttagttcataa

SEQ ID NO: 135151 - DNA, 22 bp, Artificial Sequence
  Synthetic oligonucleotide; TTT chr11 5275075 5275096 5275080 5275075 -
ctatgttcttagttcataaata

SEQ ID NO: 135152 - DNA, 22 bp, Artificial Sequence
  Synthetic oligonucleotide; TTC chr11 5275074 5275095 5275079 5275074 -
tatgttcttagttcataaatac

SEQ ID NO: 135153 - DNA, 22 bp, Artificial Sequence
  Synthetic oligonucleotide; CTA chr11 5275072 5275093 5275077 5275072 -
tgttcttagttcataaatacat

SEQ ID NO: 135154 - DNA, 22 bp, Artificial Sequence
  Synthetic oligonucleotide; TTC chr11 5275067 5275088 5275072 5275067 -
ttagttcataaatacattaggc

SEQ ID NO: 135155 - DNA, 22 bp, Artificial Sequence
  Synthetic oligonucleotide; CTT chr11 5275065 5275086 5275070 5275065 -
agttcataaatacattaggcaa

SEQ ID NO: 135156 - DNA, 22 bp, Artificial Sequence
  Synthetic oligonucleotide; TTA chr11 5275064 5275085 5275069 5275064 -
gttcataaatacattaggcaat

SEQ ID NO: 135157 - DNA, 22 bp, Artificial Sequence
  Synthetic oligonucleotide; TTC chr11 5275060 5275081 5275065 5275060 -
ataaatacattaggcaatgcaa

SEQ ID NO: 135158 - DNA, 22 bp, Artificial Sequence
  Synthetic oligonucleotide; TTA chr11 5275048 5275069 5275053 5275048 -
ggcaatgcaatttaattaaaaa

SEQ ID NO: 135159 - DNA, 22 bp, Artificial Sequence
  Synthetic oligonucleotide; TTT chr11 5275035 5275056 5275040 5275035 -
aattaaaaaaacccaagaattt

SEQ ID NO: 135160 - DNA, 22 bp, Artificial Sequence
  Synthetic oligonucleotide; TTA chr11 5275034 5275055 5275039 5275034 -
attaaaaaaacccaagaatttc

SEQ ID NO: 135161 - DNA, 22 bp, Artificial Sequence
  Synthetic oligonucleotide; TTA chr11 5275030 5275051 5275035 5275030 -
aaaaaacccaagaatttcttag

SEQ ID NO: 135162 - DNA, 22 bp, Artificial Sequence
  Synthetic oligonucleotide; TTT chr11 5275013 5275034 5275018 5275013 -
cttagaattttaatcatgaaaa

SEQ ID NO: 135163 - DNA, 22 bp, Artificial Sequence
  Synthetic oligonucleotide; TTC chr11 5275012 5275033 5275017 5275012 -
ttagaattttaatcatgaaaat

SEQ ID NO: 135164 - DNA, 22 bp, Artificial Sequence
  Synthetic oligonucleotide; CTT chr11 5275010 5275031 5275015 5275010 -
agaattttaatcatgaaaataa

SEQ ID NO: 135165 - DNA, 22 bp, Artificial Sequence
  Synthetic oligonucleotide; TTA chr11 5275009 5275030 5275014 5275009 -
gaattttaatcatgaaaataaa

SEQ ID NO: 135166 - DNA, 22 bp, Artificial Sequence
  Synthetic oligonucleotide; TTT chr11 5275003 5275024 5275008 5275003 -
taatcatgaaaataaatgaagg

SEQ ID NO: 135167 - DNA, 22 bp, Artificial Sequence
  Synthetic oligonucleotide; TTT chr11 5275002 5275023 5275007 5275002 -
aatcatgaaaataaatgaaggc

SEQ ID NO: 135168 - DNA, 22 bp, Artificial Sequence
  Synthetic oligonucleotide; TTA chr11 5275001 5275022 5275006 5275001 -
atcatgaaaataaatgaaggca

SEQ ID NO: 135169 - DNA, 22 bp, Artificial Sequence
  Synthetic oligonucleotide; CTT chr11 5274975 5274996 5274980 5274975 -
tacttactcaaggtcccaaaag

SEQ ID NO: 135170 - DNA, 22 bp, Artificial Sequence
  Synthetic oligonucleotide; TTT chr11 5274974 5274995 5274979 5274974 -
acttactcaaggtcccaaaagg

SEQ ID NO: 135171 - DNA, 22 bp, Artificial Sequence
  Synthetic oligonucleotide; TTA chr11 5274973 5274994 5274978 5274973 -
cttactcaaggtcccaaaaggt

SEQ ID NO: 135172 - DNA, 22 bp, Artificial Sequence
  Synthetic oligonucleotide; CTT chr11 5274970 5274991 5274975 5274970 -
actcaaggtcccaaaaggtcaa

SEQ ID NO: 135173 - DNA, 22 bp, Artificial Sequence
  Synthetic oligonucleotide; TTA chr11 5274969 5274990 5274974 5274969 -
ctcaaggtcccaaaaggtcaaa

SEQ ID NO: 135174 - DNA, 22 bp, Artificial Sequence
  Synthetic oligonucleotide; CTC chr11 5274966 5274987 5274971 5274966 -
aaggtcccaaaaggtcaaagaa

SEQ ID NO: 135175 - DNA, 22 bp, Artificial Sequence
  Synthetic oligonucleotide; CTA chr11 5274926 5274947 5274931 5274926 -
tatttcagcggaaaatgggata

SEQ ID NO: 135176 - DNA, 22 bp, Artificial Sequence
  Synthetic oligonucleotide; TTT chr11 5274921 5274942 5274926 5274921 -
cagcggaaaatgggatatttat

SEQ ID NO: 135177 - DNA, 22 bp, Artificial Sequence
  Synthetic oligonucleotide; TTC chr11 5274920 5274941 5274925 5274920 -
agcggaaaatgggatatttatg

SEQ ID NO: 135178 - DNA, 22 bp, Artificial Sequence
  Synthetic oligonucleotide; TTT chr11 5274901 5274922 5274906 5274901 -
atgagttttctaagttgacaga

SEQ ID NO: 135179 - DNA, 22 bp, Artificial Sequence
  Synthetic oligonucleotide; TTA chr11 5274900 5274921 5274905 5274900 -
tgagttttctaagttgacagac

SEQ ID NO: 135180 - DNA, 22 bp, Artificial Sequence
  Synthetic oligonucleotide; TTT chr11 5274893 5274914 5274898 5274893 -
tctaagttgacagactcaagtt

SEQ ID NO: 135181 - DNA, 22 bp, Artificial Sequence
  Synthetic oligonucleotide; TTT chr11 5274892 5274913 5274897 5274892 -
ctaagttgacagactcaagttt

SEQ ID NO: 135182 - DNA, 22 bp, Artificial Sequence
  Synthetic oligonucleotide; TTC chr11 5274891 5274912 5274896 5274891 -
taagttgacagactcaagtttt

SEQ ID NO: 135183 - DNA, 22 bp, Artificial Sequence
  Synthetic oligonucleotide; CTA chr11 5274889 5274910 5274894 5274889 -
agttgacagactcaagttttaa

SEQ ID NO: 135184 - DNA, 22 bp, Artificial Sequence
  Synthetic oligonucleotide; TTG chr11 5274884 5274905 5274889 5274884 -
acagactcaagttttaaccttc

SEQ ID NO: 135185 - DNA, 22 bp, Artificial Sequence
  Synthetic oligonucleotide; CTC chr11 5274876 5274897 5274881 5274876 -
aagttttaaccttcagtgccca

SEQ ID NO: 135186 - DNA, 22 bp, Artificial Sequence
  Synthetic oligonucleotide; TTT chr11 5274870 5274891 5274875 5274870 -
taaccttcagtgcccatcatgt

SEQ ID NO: 135187 - DNA, 22 bp, Artificial Sequence
  Synthetic oligonucleotide; TTT chr11 5274869 5274890 5274874 5274869 -
aaccttcagtgcccatcatgta

SEQ ID NO: 135188 - DNA, 22 bp, Artificial Sequence
  Synthetic oligonucleotide; TTA chr11 5274868 5274889 5274873 5274868 -
accttcagtgcccatcatgtag

SEQ ID NO: 135189 - DNA, 22 bp, Artificial Sequence
  Synthetic oligonucleotide; CTT chr11 5274863 5274884 5274868 5274863 -
cagtgcccatcatgtaggaaag

SEQ ID NO: 135190 - DNA, 22 bp, Artificial Sequence
  Synthetic oligonucleotide; TTC chr11 5274862 5274883 5274867 5274862 -
agtgcccatcatgtaggaaagt

SEQ ID NO: 135191 - DNA, 22 bp, Artificial Sequence
  Synthetic oligonucleotide; CTG chr11 5274828 5274849 5274833 5274828 -
gctgattctggctttctactcc

SEQ ID NO: 135192 - DNA, 22 bp, Artificial Sequence
  Synthetic oligonucleotide; CTG chr11 5274824 5274845 5274829 5274824 -
attctggctttctactcctttt

SEQ ID NO: 135193 - DNA, 22 bp, Artificial Sequence
  Synthetic oligonucleotide; TTC chr11 5274820 5274841 5274825 5274820 -
tggctttctactcctttttccc

SEQ ID NO: 135194 - DNA, 22 bp, Artificial Sequence
  Synthetic oligonucleotide; CTG chr11 5274818 5274839 5274823 5274818 -
gctttctactcctttttcccat

SEQ ID NO: 135195 - DNA, 22 bp, Artificial Sequence
  Synthetic oligonucleotide; CTT chr11 5274814 5274835 5274819 5274814 -
tctactcctttttcccattaaa

SEQ ID NO: 135196 - DNA, 22 bp, Artificial Sequence
  Synthetic oligonucleotide; TTT chr11 5274813 5274834 5274818 5274813 -
ctactcctttttcccattaaag

SEQ ID NO: 135197 - DNA, 22 bp, Artificial Sequence
  Synthetic oligonucleotide; TTC chr11 5274812 5274833 5274817 5274812 -
tactcctttttcccattaaaga

SEQ ID NO: 135198 - DNA, 22 bp, Artificial Sequence
  Synthetic oligonucleotide; CTA chr11 5274810 5274831 5274815 5274810 -
ctcctttttcccattaaagatc

SEQ ID NO: 135199 - DNA, 22 bp, Artificial Sequence
  Synthetic oligonucleotide; CTC chr11 5274807 5274828 5274812 5274807 -
ctttttcccattaaagatccct

SEQ ID NO: 135200 - DNA, 22 bp, Artificial Sequence
  Synthetic oligonucleotide; CTT chr11 5274804 5274825 5274809 5274804 -
tttcccattaaagatccctcct

SEQ ID NO: 135201 - DNA, 22 bp, Artificial Sequence
  Synthetic oligonucleotide; TTT chr11 5274803 5274824 5274808 5274803 -
ttcccattaaagatccctcctg

SEQ ID NO: 135202 - DNA, 22 bp, Artificial Sequence
  Synthetic oligonucleotide; TTT chr11 5274802 5274823 5274807 5274802 -
tcccattaaagatccctcctgc

SEQ ID NO: 135203 - DNA, 22 bp, Artificial Sequence
  Synthetic oligonucleotide; TTT chr11 5274801 5274822 5274806 5274801 -
cccattaaagatccctcctgct

SEQ ID NO: 135204 - DNA, 22 bp, Artificial Sequence
  Synthetic oligonucleotide; TTC chr11 5274800 5274821 5274805 5274800 -
ccattaaagatccctcctgctt

SEQ ID NO: 135205 - DNA, 22 bp, Artificial Sequence
  Synthetic oligonucleotide; TTA chr11 5274794 5274815 5274799 5274794 -
aagatccctcctgcttaattaa

SEQ ID NO: 135206 - DNA, 22 bp, Artificial Sequence
  Synthetic oligonucleotide; CTC chr11 5274784 5274805 5274789 5274784 -
ctgcttaattaacattcacaag

SEQ ID NO: 135207 - DNA, 22 bp, Artificial Sequence
  Synthetic oligonucleotide; CTG chr11 5274781 5274802 5274786 5274781 -
cttaattaacattcacaagtaa

SEQ ID NO: 135208 - DNA, 22 bp, Artificial Sequence
  Synthetic oligonucleotide; CTT chr11 5274778 5274799 5274783 5274778 -
aattaacattcacaagtaactc

SEQ ID NO: 135209 - DNA, 22 bp, Artificial Sequence
  Synthetic oligonucleotide; TTA chr11 5274777 5274798 5274782 5274777 -
attaacattcacaagtaactct

SEQ ID NO: 135210 - DNA, 22 bp, Artificial Sequence
  Synthetic oligonucleotide; TTA chr11 5274773 5274794 5274778 5274773 -
acattcacaagtaactctggtt

SEQ ID NO: 135211 - DNA, 22 bp, Artificial Sequence
  Synthetic oligonucleotide; TTC chr11 5274767 5274788 5274772 5274767 -
acaagtaactctggttgtactt

SEQ ID NO: 135212 - DNA, 22 bp, Artificial Sequence
  Synthetic oligonucleotide; CTC chr11 5274756 5274777 5274761 5274756 -
tggttgtactttaggcacagtg

SEQ ID NO: 135213 - DNA, 22 bp, Artificial Sequence
  Synthetic oligonucleotide; CTG chr11 5274754 5274775 5274759 5274754 -
gttgtactttaggcacagtggc

SEQ ID NO: 135214 - DNA, 22 bp, Artificial Sequence
  Synthetic oligonucleotide; TTG chr11 5274750 5274771 5274755 5274750 -
tactttaggcacagtggctccc

SEQ ID NO: 135215 - DNA, 22 bp, Artificial Sequence
  Synthetic oligonucleotide; CTT chr11 5274745 5274766 5274750 5274745 -
taggcacagtggctcccgaggt

SEQ ID NO: 135216 - DNA, 22 bp, Artificial Sequence
  Synthetic oligonucleotide; TTT chr11 5274744 5274765 5274749 5274744 -
aggcacagtggctcccgaggtc

SEQ ID NO: 135217 - DNA, 22 bp, Artificial Sequence
  Synthetic oligonucleotide; TTA chr11 5274743 5274764 5274748 5274743 -
ggcacagtggctcccgaggtca

SEQ ID NO: 135218 - DNA, 22 bp, Artificial Sequence
  Synthetic oligonucleotide; CTC chr11 5274730 5274751 5274735 5274730 -
ccgaggtcagtcacacaatagg

SEQ ID NO: 135219 - DNA, 22 bp, Artificial Sequence
  Synthetic oligonucleotide; CTG chr11 5274701 5274722 5274706 5274701 -
tgctccaagttgccagagagag

SEQ ID NO: 135220 - DNA, 22 bp, Artificial Sequence
  Synthetic oligonucleotide; CTC chr11 5274696 5274717 5274701 5274696 -
caagttgccagagagagagatt

SEQ ID NO: 135221 - DNA, 22 bp, Artificial Sequence
  Synthetic oligonucleotide; TTG chr11 5274689 5274710 5274694 5274689 -
ccagagagagagattactcttg

SEQ ID NO: 135222 - DNA, 22 bp, Artificial Sequence
  Synthetic oligonucleotide; TTA chr11 5274673 5274694 5274678 5274673 -
ctcttgagaatgagcctcagcc

SEQ ID NO: 135223 - DNA, 22 bp, Artificial Sequence
  Synthetic oligonucleotide; CTC chr11 5274670 5274691 5274675 5274670 -
ttgagaatgagcctcagccctg

SEQ ID NO: 135224 - DNA, 22 bp, Artificial Sequence
  Synthetic oligonucleotide; CTT chr11 5274668 5274689 5274673 5274668 -
gagaatgagcctcagccctggc

SEQ ID NO: 135225 - DNA, 22 bp, Artificial Sequence
  Synthetic oligonucleotide; TTG chr11 5274667 5274688 5274672 5274667 -
agaatgagcctcagccctggct

SEQ ID NO: 135226 - DNA, 22 bp, Artificial Sequence
  Synthetic oligonucleotide; CTC chr11 5274655 5274676 5274660 5274655 -
agccctggctcaaactcacctg

SEQ ID NO: 135227 - DNA, 22 bp, Artificial Sequence
  Synthetic oligonucleotide; CTG chr11 5274648 5274669 5274653 5274648 -
gctcaaactcacctgcaaactt

SEQ ID NO: 135228 - DNA, 22 bp, Artificial Sequence
  Synthetic oligonucleotide; CTC chr11 5274644 5274665 5274649 5274644 -
aaactcacctgcaaacttcgtg

SEQ ID NO: 135229 - DNA, 22 bp, Artificial Sequence
  Synthetic oligonucleotide; CTC chr11 5274638 5274659 5274643 5274638 -
acctgcaaacttcgtgagagat

SEQ ID NO: 135230 - DNA, 22 bp, Artificial Sequence
  Synthetic oligonucleotide; CTG chr11 5274633 5274654 5274638 5274633 -
caaacttcgtgagagatgaggc

SEQ ID NO: 135231 - DNA, 22 bp, Artificial Sequence
  Synthetic oligonucleotide; CTT chr11 5274626 5274647 5274631 5274626 -
cgtgagagatgaggcagaggta

SEQ ID NO: 135232 - DNA, 22 bp, Artificial Sequence
  Synthetic oligonucleotide; TTC chr11 5274625 5274646 5274630 5274625 -
gtgagagatgaggcagaggtac

SEQ ID NO: 135233 - DNA, 22 bp, Artificial Sequence
  Synthetic oligonucleotide; CTA chr11 5274599 5274620 5274604 5274599 -
cgaaagcaacagttagaagcta

SEQ ID NO: 135234 - DNA, 22 bp, Artificial Sequence
  Synthetic oligonucleotide; TTA chr11 5274584 5274605 5274589 5274584 -
gaagctaaatgatgagaacaca

SEQ ID NO: 135235 - DNA, 22 bp, Artificial Sequence
  Synthetic oligonucleotide; CTA chr11 5274577 5274598 5274582 5274577 -
aatgatgagaacacatggactc

SEQ ID NO: 135236 - DNA, 22 bp, Artificial Sequence
  Synthetic oligonucleotide; CTC chr11 5274555 5274576 5274560 5274555 -
atagagggaaacaacgcatact

SEQ ID NO: 135237 - DNA, 22 bp, Artificial Sequence
  Synthetic oligonucleotide; CTG chr11 5274532 5274553 5274537 5274532 -
gggcctatcagagggtggaggg

SEQ ID NO: 135238 - DNA, 22 bp, Artificial Sequence
  Synthetic oligonucleotide; CTA chr11 5274525 5274546 5274530 5274525 -
tcagagggtggagggtgagaga

SEQ ID NO: 135239 - DNA, 22 bp, Artificial Sequence
  Synthetic oligonucleotide; CTA chr11 5274478 5274499 5274483 5274478 -
atggatgctaagcgtaatacct

SEQ ID NO: 135240 - DNA, 22 bp, Artificial Sequence
  Synthetic oligonucleotide; CTA chr11 5274468 5274489 5274473 5274468 -
agcgtaatacctgagtgatgag

SEQ ID NO: 135241 - DNA, 22 bp, Artificial Sequence
  Synthetic oligonucleotide; CTG chr11 5274455 5274476 5274460 5274455 -
agtgatgagatcatctatacaa

SEQ ID NO: 135242 - DNA, 22 bp, Artificial Sequence
  Synthetic oligonucleotide; CTA chr11 5274438 5274459 5274443 5274438 -
tacaacaaacccccttgacatt

SEQ ID NO: 135243 - DNA, 22 bp, Artificial Sequence
  Synthetic oligonucleotide; CTT chr11 5274422 5274443 5274427 5274422 -
gacattcatttatctatgtaac

SEQ ID NO: 135244 - DNA, 22 bp, Artificial Sequence
  Synthetic oligonucleotide; TTG chr11 5274421 5274442 5274426 5274421 -
acattcatttatctatgtaaca

SEQ ID NO: 135245 - DNA, 22 bp, Artificial Sequence
  Synthetic oligonucleotide; TTC chr11 5274415 5274436 5274420 5274415 -
atttatctatgtaacaaacctg

SEQ ID NO: 135246 - DNA, 22 bp, Artificial Sequence
  Synthetic oligonucleotide; TTT chr11 5274411 5274432 5274416 5274411 -
atctatgtaacaaacctgcaca

SEQ ID NO: 135247 - DNA, 22 bp, Artificial Sequence
  Synthetic oligonucleotide; TTA chr11 5274410 5274431 5274415 5274410 -
tctatgtaacaaacctgcacat

SEQ ID NO: 135248 - DNA, 22 bp, Artificial Sequence
  Synthetic oligonucleotide; CTA chr11 5274406 5274427 5274411 5274406 -
tgtaacaaacctgcacatcctg

SEQ ID NO: 135249 - DNA, 22 bp, Artificial Sequence
  Synthetic oligonucleotide; CTG chr11 5274393 5274414 5274398 5274393 -
cacatcctgtacatgtacccct

SEQ ID NO: 135250 - DNA, 22 bp, Artificial Sequence
  Synthetic oligonucleotide; CTG chr11 5274384 5274405 5274389 5274384 -
tacatgtacccctgaacttaaa

SEQ ID NO: 135251 - DNA, 22 bp, Artificial Sequence
  Synthetic oligonucleotide; CTG chr11 5274370 5274391 5274375 5274370 -
aacttaaaataaaagttgaaaa

SEQ ID NO: 135252 - DNA, 22 bp, Artificial Sequence
  Synthetic oligonucleotide; CTT chr11 5274365 5274386 5274370 5274365 -
aaaataaaagttgaaaacaaga

SEQ ID NO: 135253 - DNA, 22 bp, Artificial Sequence
  Synthetic oligonucleotide; TTA chr11 5274364 5274385 5274369 5274364 -
aaataaaagttgaaaacaagaa

SEQ ID NO: 135254 - DNA, 22 bp, Artificial Sequence
  Synthetic oligonucleotide; TTG chr11 5274352 5274373 5274357 5274352 -
aaaacaagaaagcaacagtttg

SEQ ID NO: 135255 - DNA, 22 bp, Artificial Sequence
  Synthetic oligonucleotide; TTT chr11 5274331 5274352 5274336 5274331 -
gaacacttgttatggtctattc

SEQ ID NO: 135256 - DNA, 22 bp, Artificial Sequence
  Synthetic oligonucleotide; TTG chr11 5274330 5274351 5274335 5274330 -
aacacttgttatggtctattct

SEQ ID NO: 135257 - DNA, 22 bp, Artificial Sequence
  Synthetic oligonucleotide; CTT chr11 5274323 5274344 5274328 5274323 -
gttatggtctattctctcattc

SEQ ID NO: 135258 - DNA, 22 bp, Artificial Sequence
  Synthetic oligonucleotide; TTG chr11 5274322 5274343 5274327 5274322 -
ttatggtctattctctcattct

SEQ ID NO: 135259 - DNA, 22 bp, Artificial Sequence
  Synthetic oligonucleotide; TTA chr11 5274319 5274340 5274324 5274319 -
tggtctattctctcattcttta

SEQ ID NO: 135260 - DNA, 22 bp, Artificial Sequence
  Synthetic oligonucleotide; CTA chr11 5274312 5274333 5274317 5274312 -
ttctctcattctttacaattac

SEQ ID NO: 135261 - DNA, 22 bp, Artificial Sequence
  Synthetic oligonucleotide; TTC chr11 5274309 5274330 5274314 5274309 -
tctcattctttacaattacact

SEQ ID NO: 135262 - DNA, 22 bp, Artificial Sequence
  Synthetic oligonucleotide; CTC chr11 5274307 5274328 5274312 5274307 -
tcattctttacaattacactag

SEQ ID NO: 135263 - DNA, 22 bp, Artificial Sequence
  Synthetic oligonucleotide; CTC chr11 5274305 5274326 5274310 5274305 -
attctttacaattacactagaa

SEQ ID NO: 135264 - DNA, 22 bp, Artificial Sequence
  Synthetic oligonucleotide; TTC chr11 5274301 5274322 5274306 5274301 -
tttacaattacactagaaaata

SEQ ID NO: 135265 - DNA, 22 bp, Artificial Sequence
  Synthetic oligonucleotide; CTT chr11 5274299 5274320 5274304 5274299 -
tacaattacactagaaaatagc

SEQ ID NO: 135266 - DNA, 22 bp, Artificial Sequence
  Synthetic oligonucleotide; TTT chr11 5274298 5274319 5274303 5274298 -
acaattacactagaaaatagcc

SEQ ID NO: 135267 - DNA, 22 bp, Artificial Sequence
  Synthetic oligonucleotide; TTA chr11 5274297 5274318 5274302 5274297 -
caattacactagaaaatagcca

SEQ ID NO: 135268 - DNA, 22 bp, Artificial Sequence
  Synthetic oligonucleotide; TTA chr11 5274291 5274312 5274296 5274291 -
cactagaaaatagccacaggct

SEQ ID NO: 135269 - DNA, 22 bp, Artificial Sequence
  Synthetic oligonucleotide; CTA chr11 5274286 5274307 5274291 5274286 -
gaaaatagccacaggcttcctg

SEQ ID NO: 135270 - DNA, 22 bp, Artificial Sequence
  Synthetic oligonucleotide; CTT chr11 5274268 5274289 5274273 5274268 -
cctgcaaggcagccacagaatt

SEQ ID NO: 135271 - DNA, 22 bp, Artificial Sequence
  Synthetic oligonucleotide; TTC chr11 5274267 5274288 5274272 5274267 -
ctgcaaggcagccacagaattt

SEQ ID NO: 135272 - DNA, 22 bp, Artificial Sequence
  Synthetic oligonucleotide; CTG chr11 5274264 5274285 5274269 5274264 -
caaggcagccacagaatttatg

SEQ ID NO: 135273 - DNA, 22 bp, Artificial Sequence
  Synthetic oligonucleotide; TTT chr11 5274245 5274266 5274250 5274245 -
atgacttgtgatatccaagtca

SEQ ID NO: 135274 - DNA, 22 bp, Artificial Sequence
  Synthetic oligonucleotide; TTA chr11 5274244 5274265 5274249 5274244 -
tgacttgtgatatccaagtcat

SEQ ID NO: 135275 - DNA, 22 bp, Artificial Sequence
  Synthetic oligonucleotide; CTT chr11 5274238 5274259 5274243 5274238 -
gtgatatccaagtcattcctgg

SEQ ID NO: 135276 - DNA, 22 bp, Artificial Sequence
  Synthetic oligonucleotide; TTG chr11 5274237 5274258 5274242 5274237 -
tgatatccaagtcattcctgga

SEQ ID NO: 135277 - DNA, 22 bp, Artificial Sequence
  Synthetic oligonucleotide; TTC chr11 5274220 5274241 5274225 5274220 -
ctggataatgcaaaatctaaca

SEQ ID NO: 135278 - DNA, 22 bp, Artificial Sequence
  Synthetic oligonucleotide; CTG chr11 5274217 5274238 5274222 5274217 -
gataatgcaaaatctaacacaa

SEQ ID NO: 135279 - DNA, 22 bp, Artificial Sequence
  Synthetic oligonucleotide; CTA chr11 5274201 5274222 5274206 5274201 -
acacaaaatctagtagaatcat

SEQ ID NO: 135280 - DNA, 22 bp, Artificial Sequence
  Synthetic oligonucleotide; CTA chr11 5274189 5274210 5274194 5274189 -
gtagaatcatttgcttacatct

SEQ ID NO: 135281 - DNA, 22 bp, Artificial Sequence
  Synthetic oligonucleotide; TTT chr11 5274177 5274198 5274182 5274177 -
gcttacatctatttttgttctg

SEQ ID NO: 135282 - DNA, 22 bp, Artificial Sequence
  Synthetic oligonucleotide; TTG chr11 5274176 5274197 5274181 5274176 -
cttacatctatttttgttctga

SEQ ID NO: 135283 - DNA, 22 bp, Artificial Sequence
  Synthetic oligonucleotide; CTT chr11 5274173 5274194 5274178 5274173 -
acatctatttttgttctgagaa

SEQ ID NO: 135284 - DNA, 22 bp, Artificial Sequence
  Synthetic oligonucleotide; TTA chr11 5274172 5274193 5274177 5274172 -
catctatttttgttctgagaat

SEQ ID NO: 135285 - DNA, 22 bp, Artificial Sequence
  Synthetic oligonucleotide; CTA chr11 5274166 5274187 5274171 5274166 -
tttttgttctgagaatatagat

SEQ ID NO: 135286 - DNA, 22 bp, Artificial Sequence
  Synthetic oligonucleotide; TTT chr11 5274163 5274184 5274168 5274163 -
ttgttctgagaatatagattta

SEQ ID NO: 135287 - DNA, 22 bp, Artificial Sequence
  Synthetic oligonucleotide; TTT chr11 5274162 5274183 5274167 5274162 -
tgttctgagaatatagatttag

SEQ ID NO: 135288 - DNA, 22 bp, Artificial Sequence
  Synthetic oligonucleotide; TTT chr11 5274161 5274182 5274166 5274161 -
gttctgagaatatagatttaga

SEQ ID NO: 135289 - DNA, 22 bp, Artificial Sequence
  Synthetic oligonucleotide; TTG chr11 5274160 5274181 5274165 5274160 -
ttctgagaatatagatttagat

SEQ ID NO: 135290 - DNA, 22 bp, Artificial Sequence
  Synthetic oligonucleotide; TTC chr11 5274157 5274178 5274162 5274157 -
tgagaatatagatttagataca

SEQ ID NO: 135291 - DNA, 22 bp, Artificial Sequence
  Synthetic oligonucleotide; CTG chr11 5274155 5274176 5274160 5274155 -
agaatatagatttagatacata

SEQ ID NO: 135292 - DNA, 22 bp, Artificial Sequence
  Synthetic oligonucleotide; TTT chr11 5274142 5274163 5274147 5274142 -
agatacataatggaagcagaat

SEQ ID NO: 135293 - DNA, 22 bp, Artificial Sequence
  Synthetic oligonucleotide; TTA chr11 5274141 5274162 5274146 5274141 -
gatacataatggaagcagaata

SEQ ID NO: 135294 - DNA, 22 bp, Artificial Sequence
  Synthetic oligonucleotide; TTT chr11 5274115 5274136 5274120 5274115 -
aaaatctggctaatttagaatc

SEQ ID NO: 135295 - DNA, 22 bp, Artificial Sequence
  Synthetic oligonucleotide; TTA chr11 5274114 5274135 5274119 5274114 -
aaatctggctaatttagaatcc

SEQ ID NO: 135296 - DNA, 22 bp, Artificial Sequence
  Synthetic oligonucleotide; CTG chr11 5274107 5274128 5274112 5274107 -
gctaatttagaatcctaagcag

SEQ ID NO: 135297 - DNA, 22 bp, Artificial Sequence
  Synthetic oligonucleotide; CTA chr11 5274103 5274124 5274108 5274103 -
atttagaatcctaagcagctct

SEQ ID NO: 135298 - DNA, 22 bp, Artificial Sequence
  Synthetic oligonucleotide; TTT chr11 5274099 5274120 5274104 5274099 -
agaatcctaagcagctcttttc

SEQ ID NO: 135299 - DNA, 22 bp, Artificial Sequence
  Synthetic oligonucleotide; TTA chr11 5274098 5274119 5274103 5274098 -
gaatcctaagcagctcttttcc

SEQ ID NO: 135300 - DNA, 22 bp, Artificial Sequence
  Synthetic oligonucleotide; CTA chr11 5274090 5274111 5274095 5274090 -
agcagctcttttcctatcagtg

SEQ ID NO: 135301 - DNA, 22 bp, Artificial Sequence
  Synthetic oligonucleotide; CTC chr11 5274082 5274103 5274087 5274082 -
ttttcctatcagtggtttacaa

SEQ ID NO: 135302 - DNA, 22 bp, Artificial Sequence
  Synthetic oligonucleotide; CTT chr11 5274080 5274101 5274085 5274080 -
ttcctatcagtggtttacaagc

SEQ ID NO: 135303 - DNA, 22 bp, Artificial Sequence
  Synthetic oligonucleotide; TTT chr11 5274079 5274100 5274084 5274079 -
tcctatcagtggtttacaagcc

SEQ ID NO: 135304 - DNA, 22 bp, Artificial Sequence
  Synthetic oligonucleotide; TTT chr11 5274078 5274099 5274083 5274078 -
cctatcagtggtttacaagcct

SEQ ID NO: 135305 - DNA, 22 bp, Artificial Sequence
  Synthetic oligonucleotide; TTC chr11 5274077 5274098 5274082 5274077 -
ctatcagtggtttacaagcctt

SEQ ID NO: 135306 - DNA, 22 bp, Artificial Sequence
  Synthetic oligonucleotide; CTA chr11 5274074 5274095 5274079 5274074 -
tcagtggtttacaagccttgtt

SEQ ID NO: 135307 - DNA, 22 bp, Artificial Sequence
  Synthetic oligonucleotide; TTT chr11 5274064 5274085 5274069 5274064 -
acaagccttgtttatatttttc

SEQ ID NO: 135308 - DNA, 22 bp, Artificial Sequence
  Synthetic oligonucleotide; TTA chr11 5274063 5274084 5274068 5274063 -
caagccttgtttatatttttcc

SEQ ID NO: 135309 - DNA, 22 bp, Artificial Sequence
  Synthetic oligonucleotide; CTT chr11 5274055 5274076 5274060 5274055 -
gtttatatttttcctattttaa

SEQ ID NO: 135310 - DNA, 22 bp, Artificial Sequence
  Synthetic oligonucleotide; TTG chr11 5274054 5274075 5274059 5274054 -
tttatatttttcctattttaaa

SEQ ID NO: 135311 - DNA, 22 bp, Artificial Sequence
  Synthetic oligonucleotide; TTT chr11 5274051 5274072 5274056 5274051 -
atatttttcctattttaaaaat

SEQ ID NO: 135312 - DNA, 22 bp, Artificial Sequence
  Synthetic oligonucleotide; TTA chr11 5274050 5274071 5274055 5274050 -
tatttttcctattttaaaaata

SEQ ID NO: 135313 - DNA, 22 bp, Artificial Sequence
  Synthetic oligonucleotide; TTT chr11 5274045 5274066 5274050 5274045 -
ttcctattttaaaaataaaaat

SEQ ID NO: 135314 - DNA, 22 bp, Artificial Sequence
  Synthetic oligonucleotide; TTT chr11 5274044 5274065 5274049 5274044 -
tcctattttaaaaataaaaata

SEQ ID NO: 135315 - DNA, 22 bp, Artificial Sequence
  Synthetic oligonucleotide; TTT chr11 5274043 5274064 5274048 5274043 -
cctattttaaaaataaaaataa

SEQ ID NO: 135316 - DNA, 22 bp, Artificial Sequence
  Synthetic oligonucleotide; TTC chr11 5274042 5274063 5274047 5274042 -
ctattttaaaaataaaaataaa

SEQ ID NO: 135317 - DNA, 22 bp, Artificial Sequence
  Synthetic oligonucleotide; CTA chr11 5274039 5274060 5274044 5274039 -
ttttaaaaataaaaataaagta

SEQ ID NO: 135318 - DNA, 22 bp, Artificial Sequence
  Synthetic oligonucleotide; TTT chr11 5274036 5274057 5274041 5274036 -
taaaaataaaaataaagtaagt

SEQ ID NO: 135319 - DNA, 22 bp, Artificial Sequence
  Synthetic oligonucleotide; TTT chr11 5274035 5274056 5274040 5274035 -
aaaaataaaaataaagtaagtt

SEQ ID NO: 135320 - DNA, 22 bp, Artificial Sequence
  Synthetic oligonucleotide; TTA chr11 5274034 5274055 5274039 5274034 -
aaaataaaaataaagtaagtta

SEQ ID NO: 135321 - DNA, 22 bp, Artificial Sequence
  Synthetic oligonucleotide; TTA chr11 5274012 5274033 5274017 5274012 -
tttgtggtaaagaatattcatt

SEQ ID NO: 135322 - DNA, 22 bp, Artificial Sequence
  Synthetic oligonucleotide; TTT chr11 5274009 5274030 5274014 5274009 -
gtggtaaagaatattcattaaa

SEQ ID NO: 135323 - DNA, 22 bp, Artificial Sequence
  Synthetic oligonucleotide; TTG chr11 5274008 5274029 5274013 5274008 -
tggtaaagaatattcattaaag

SEQ ID NO: 135324 - DNA, 22 bp, Artificial Sequence
  Synthetic oligonucleotide; TTC chr11 5273993 5274014 5273998 5273993 -
attaaagtatttatttcttaga

SEQ ID NO: 135325 - DNA, 22 bp, Artificial Sequence
  Synthetic oligonucleotide; TTA chr11 5273989 5274010 5273994 5273989 -
aagtatttatttcttagataat

SEQ ID NO: 135326 - DNA, 22 bp, Artificial Sequence
  Synthetic oligonucleotide; TTT chr11 5273981 5274002 5273986 5273981 -
atttcttagataataccatgaa

SEQ ID NO: 135327 - DNA, 22 bp, Artificial Sequence
  Synthetic oligonucleotide; TTA chr11 5273980 5274001 5273985 5273980 -
tttcttagataataccatgaaa

SEQ ID NO: 135328 - DNA, 22 bp, Artificial Sequence
  Synthetic oligonucleotide; TTT chr11 5273977 5273998 5273982 5273977 -
cttagataataccatgaaaaac

SEQ ID NO: 135329 - DNA, 22 bp, Artificial Sequence
  Synthetic oligonucleotide; TTC chr11 5273976 5273997 5273981 5273976 -
ttagataataccatgaaaaaca

SEQ ID NO: 135330 - DNA, 22 bp, Artificial Sequence
  Synthetic oligonucleotide; CTT chr11 5273974 5273995 5273979 5273974 -
agataataccatgaaaaacatt

SEQ ID NO: 135331 - DNA, 22 bp, Artificial Sequence
  Synthetic oligonucleotide; TTA chr11 5273973 5273994 5273978 5273973 -
gataataccatgaaaaacattc

SEQ ID NO: 135332 - DNA, 22 bp, Artificial Sequence
  Synthetic oligonucleotide; TTC chr11 5273951 5273972 5273956 5273951 -
agtgaagtgaagggcctacttt

SEQ ID NO: 135333 - DNA, 22 bp, Artificial Sequence
  Synthetic oligonucleotide; CTA chr11 5273933 5273954 5273938 5273933 -
ctttacttaacaagaatctaat

SEQ ID NO: 135334 - DNA, 22 bp, Artificial Sequence
  Synthetic oligonucleotide; CTT chr11 5273930 5273951 5273935 5273930 -
tacttaacaagaatctaattta

SEQ ID NO: 135335 - DNA, 22 bp, Artificial Sequence
  Synthetic oligonucleotide; TTT chr11 5273929 5273950 5273934 5273929 -
acttaacaagaatctaatttat

SEQ ID NO: 135336 - DNA, 22 bp, Artificial Sequence
  Synthetic oligonucleotide; TTA chr11 5273928 5273949 5273933 5273928 -
cttaacaagaatctaatttata

SEQ ID NO: 135337 - DNA, 22 bp, Artificial Sequence
  Synthetic oligonucleotide; CTT chr11 5273925 5273946 5273930 5273925 -
aacaagaatctaatttatataa

SEQ ID NO: 135338 - DNA, 22 bp, Artificial Sequence
  Synthetic oligonucleotide; TTA chr11 5273924 5273945 5273929 5273924 -
acaagaatctaatttatataat

SEQ ID NO: 135339 - DNA, 22 bp, Artificial Sequence
  Synthetic oligonucleotide; CTA chr11 5273913 5273934 5273918 5273913 -
atttatataatttttcatacta

SEQ ID NO: 135340 - DNA, 22 bp, Artificial Sequence
  Synthetic oligonucleotide; TTT chr11 5273909 5273930 5273914 5273909 -
atataatttttcatactaatag

SEQ ID NO: 135341 - DNA, 22 bp, Artificial Sequence
  Synthetic oligonucleotide; TTA chr11 5273908 5273929 5273913 5273908 -
tataatttttcatactaatagc

SEQ ID NO: 135342 - DNA, 22 bp, Artificial Sequence
  Synthetic oligonucleotide; TTT chr11 5273900 5273921 5273905 5273900 -
ttcatactaatagcatctaaga

SEQ ID NO: 135343 - DNA, 22 bp, Artificial Sequence
  Synthetic oligonucleotide; TTT chr11 5273899 5273920 5273904 5273899 -
tcatactaatagcatctaagaa

SEQ ID NO: 135344 - DNA, 22 bp, Artificial Sequence
  Synthetic oligonucleotide; TTT chr11 5273898 5273919 5273903 5273898 -
catactaatagcatctaagaac

SEQ ID NO: 135345 - DNA, 22 bp, Artificial Sequence
  Synthetic oligonucleotide; TTC chr11 5273897 5273918 5273902 5273897 -
atactaatagcatctaagaaca

SEQ ID NO: 135346 - DNA, 22 bp, Artificial Sequence
  Synthetic oligonucleotide; CTA chr11 5273891 5273912 5273896 5273891 -
atagcatctaagaacagtacaa

SEQ ID NO: 135347 - DNA, 22 bp, Artificial Sequence
  Synthetic oligonucleotide; CTA chr11 5273881 5273902 5273886 5273881 -
agaacagtacaatatttgactc

SEQ ID NO: 135348 - DNA, 22 bp, Artificial Sequence
  Synthetic oligonucleotide; TTT chr11 5273864 5273885 5273869 5273864 -
gactcttcaggttaaacatatg

SEQ ID NO: 135349 - DNA, 22 bp, Artificial Sequence
  Synthetic oligonucleotide; TTG chr11 5273863 5273884 5273868 5273863 -
actcttcaggttaaacatatgt

SEQ ID NO: 135350 - DNA, 22 bp, Artificial Sequence
  Synthetic oligonucleotide; CTC chr11 5273859 5273880 5273864 5273859 -
ttcaggttaaacatatgtcata

SEQ ID NO: 135351 - DNA, 22 bp, Artificial Sequence
  Synthetic oligonucleotide; CTT chr11 5273857 5273878 5273862 5273857 -
caggttaaacatatgtcataaa

SEQ ID NO: 135352 - DNA, 22 bp, Artificial Sequence
  Synthetic oligonucleotide; TTC chr11 5273856 5273877 5273861 5273856 -
aggttaaacatatgtcataaat

SEQ ID NO: 135353 - DNA, 22 bp, Artificial Sequence
  Synthetic oligonucleotide; TTA chr11 5273850 5273871 5273855 5273850 -
aacatatgtcataaattagcca

SEQ ID NO: 135354 - DNA, 22 bp, Artificial Sequence
  Synthetic oligonucleotide; TTA chr11 5273832 5273853 5273837 5273832 -
gccagaaagatttaagaaaata

SEQ ID NO: 135355 - DNA, 22 bp, Artificial Sequence
  Synthetic oligonucleotide; TTT chr11 5273819 5273840 5273824 5273819 -
aagaaaatattggatgtttcct

SEQ ID NO: 135356 - DNA, 22 bp, Artificial Sequence
  Synthetic oligonucleotide; TTA chr11 5273818 5273839 5273823 5273818 -
agaaaatattggatgtttcctt

SEQ ID NO: 135357 - DNA, 22 bp, Artificial Sequence
  Synthetic oligonucleotide; TTG chr11 5273807 5273828 5273812 5273807 -
gatgtttccttgtttaaattag

SEQ ID NO: 135358 - DNA, 22 bp, Artificial Sequence
  Synthetic oligonucleotide; TTT chr11 5273800 5273821 5273805 5273800 -
ccttgtttaaattaggcatctt

SEQ ID NO: 135359 - DNA, 22 bp, Artificial Sequence
  Synthetic oligonucleotide; TTC chr11 5273799 5273820 5273804 5273799 -
cttgtttaaattaggcatctta

SEQ ID NO: 135360 - DNA, 22 bp, Artificial Sequence
  Synthetic oligonucleotide; CTT chr11 5273796 5273817 5273801 5273796 -
gtttaaattaggcatcttacag

SEQ ID NO: 135361 - DNA, 22 bp, Artificial Sequence
  Synthetic oligonucleotide; TTG chr11 5273795 5273816 5273800 5273795 -
tttaaattaggcatcttacagt

SEQ ID NO: 135362 - DNA, 22 bp, Artificial Sequence
  Synthetic oligonucleotide; TTT chr11 5273792 5273813 5273797 5273792 -
aaattaggcatcttacagtttt

SEQ ID NO: 135363 - DNA, 22 bp, Artificial Sequence
  Synthetic oligonucleotide; TTA chr11 5273791 5273812 5273796 5273791 -
aattaggcatcttacagttttt

SEQ ID NO: 135364 - DNA, 22 bp, Artificial Sequence
  Synthetic oligonucleotide; TTA chr11 5273786 5273807 5273791 5273786 -
ggcatcttacagtttttagaat

SEQ ID NO: 135365 - DNA, 22 bp, Artificial Sequence
  Synthetic oligonucleotide; CTT chr11 5273778 5273799 5273783 5273778 -
acagtttttagaatcctgcata

SEQ ID NO: 135366 - DNA, 22 bp, Artificial Sequence
  Synthetic oligonucleotide; TTA chr11 5273777 5273798 5273782 5273777 -
cagtttttagaatcctgcatag

SEQ ID NO: 135367 - DNA, 22 bp, Artificial Sequence
  Synthetic oligonucleotide; TTT chr11 5273771 5273792 5273776 5273771 -
ttagaatcctgcatagaactta

SEQ ID NO: 135368 - DNA, 22 bp, Artificial Sequence
  Synthetic oligonucleotide; TTT chr11 5273770 5273791 5273775 5273770 -
tagaatcctgcatagaacttaa

SEQ ID NO: 135369 - DNA, 22 bp, Artificial Sequence
  Synthetic oligonucleotide; TTT chr11 5273769 5273790 5273774 5273769 -
agaatcctgcatagaacttaag

SEQ ID NO: 135370 - DNA, 22 bp, Artificial Sequence
  Synthetic oligonucleotide; TTA chr11 5273768 5273789 5273773 5273768 -
gaatcctgcatagaacttaaga

SEQ ID NO: 135371 - DNA, 22 bp, Artificial Sequence
  Synthetic oligonucleotide; CTG chr11 5273760 5273781 5273765 5273760 -
catagaacttaagaaattacaa

SEQ ID NO: 135372 - DNA, 22 bp, Artificial Sequence
  Synthetic oligonucleotide; CTT chr11 5273750 5273771 5273755 5273750 -
aagaaattacaaatgctaaagc

SEQ ID NO: 135373 - DNA, 22 bp, Artificial Sequence
  Synthetic oligonucleotide; TTA chr11 5273749 5273770 5273754 5273749 -
agaaattacaaatgctaaagca

SEQ ID NO: 135374 - DNA, 22 bp, Artificial Sequence
  Synthetic oligonucleotide; TTA chr11 5273741 5273762 5273746 5273741 -
caaatgctaaagcaaacccaaa

SEQ ID NO: 135375 - DNA, 22 bp, Artificial Sequence
  Synthetic oligonucleotide; CTA chr11 5273732 5273753 5273737 5273732 -
aagcaaacccaaacaggcagga

SEQ ID NO: 135376 - DNA, 22 bp, Artificial Sequence
  Synthetic oligonucleotide; TTA chr11 5273706 5273727 5273711 5273706 -
atcttcatcgaatttgggtgtt

SEQ ID NO: 135377 - DNA, 22 bp, Artificial Sequence
  Synthetic oligonucleotide; CTT chr11 5273701 5273722 5273706 5273701 -
catcgaatttgggtgtttcttt

SEQ ID NO: 135378 - DNA, 22 bp, Artificial Sequence
  Synthetic oligonucleotide; TTC chr11 5273700 5273721 5273705 5273700 -
atcgaatttgggtgtttctttc

SEQ ID NO: 135379 - DNA, 22 bp, Artificial Sequence
  Synthetic oligonucleotide; TTT chr11 5273691 5273712 5273696 5273691 -
gggtgtttctttctaaaagtcc

SEQ ID NO: 135380 - DNA, 22 bp, Artificial Sequence
  Synthetic oligonucleotide; TTG chr11 5273690 5273711 5273695 5273690 -
ggtgtttctttctaaaagtcct

SEQ ID NO: 135381 - DNA, 22 bp, Artificial Sequence
  Synthetic oligonucleotide; TTT chr11 5273683 5273704 5273688 5273683 -
ctttctaaaagtcctttatact

SEQ ID NO: 135382 - DNA, 22 bp, Artificial Sequence
  Synthetic oligonucleotide; TTC chr11 5273682 5273703 5273687 5273682 -
tttctaaaagtcctttatactt

SEQ ID NO: 135383 - DNA, 22 bp, Artificial Sequence
  Synthetic oligonucleotide; CTT chr11 5273680 5273701 5273685 5273680 -
tctaaaagtcctttatacttaa

SEQ ID NO: 135384 - DNA, 22 bp, Artificial Sequence
  Synthetic oligonucleotide; TTT chr11 5273679 5273700 5273684 5273679 -
ctaaaagtcctttatacttaaa

SEQ ID NO: 135385 - DNA, 22 bp, Artificial Sequence
  Synthetic oligonucleotide; TTC chr11 5273678 5273699 5273683 5273678 -
taaaagtcctttatacttaaat

SEQ ID NO: 135386 - DNA, 22 bp, Artificial Sequence
  Synthetic oligonucleotide; CTA chr11 5273676 5273697 5273681 5273676 -
aaagtcctttatacttaaatgt

SEQ ID NO: 135387 - DNA, 22 bp, Artificial Sequence
  Synthetic oligonucleotide; CTT chr11 5273667 5273688 5273672 5273667 -
tatacttaaatgtcttaagaca

SEQ ID NO: 135388 - DNA, 22 bp, Artificial Sequence
  Synthetic oligonucleotide; TTT chr11 5273666 5273687 5273671 5273666 -
atacttaaatgtcttaagacat

SEQ ID NO: 135389 - DNA, 22 bp, Artificial Sequence
  Synthetic oligonucleotide; TTA chr11 5273665 5273686 5273670 5273665 -
tacttaaatgtcttaagacata

SEQ ID NO: 135390 - DNA, 22 bp, Artificial Sequence
  Synthetic oligonucleotide; CTT chr11 5273660 5273681 5273665 5273660 -
aaatgtcttaagacatacatag

SEQ ID NO: 135391 - DNA, 22 bp, Artificial Sequence
  Synthetic oligonucleotide; TTA chr11 5273659 5273680 5273664 5273659 -
aatgtcttaagacatacataga

SEQ ID NO: 135392 - DNA, 22 bp, Artificial Sequence
  Synthetic oligonucleotide; CTT chr11 5273651 5273672 5273656 5273651 -
aagacatacatagattttattt

SEQ ID NO: 135393 - DNA, 22 bp, Artificial Sequence
  Synthetic oligonucleotide; TTA chr11 5273650 5273671 5273655 5273650 -
agacatacatagattttatttt

SEQ ID NO: 135394 - DNA, 22 bp, Artificial Sequence
  Synthetic oligonucleotide; TTT chr11 5273634 5273655 5273639 5273634 -
tattttactaattttaattata

SEQ ID NO: 135395 - DNA, 22 bp, Artificial Sequence
  Synthetic oligonucleotide; TTT chr11 5273633 5273654 5273638 5273633 -
attttactaattttaattatat

SEQ ID NO: 135396 - DNA, 22 bp, Artificial Sequence
  Synthetic oligonucleotide; TTA chr11 5273632 5273653 5273637 5273632 -
ttttactaattttaattatata

SEQ ID NO: 135397 - DNA, 22 bp, Artificial Sequence
  Synthetic oligonucleotide; TTT chr11 5273629 5273650 5273634 5273629 -
tactaattttaattatatagac

SEQ ID NO: 135398 - DNA, 22 bp, Artificial Sequence
  Synthetic oligonucleotide; TTT chr11 5273628 5273649 5273633 5273628 -
actaattttaattatatagaca

SEQ ID NO: 135399 - DNA, 22 bp, Artificial Sequence
  Synthetic oligonucleotide; TTA chr11 5273627 5273648 5273632 5273627 -
ctaattttaattatatagacaa

SEQ ID NO: 135400 - DNA, 22 bp, Artificial Sequence
  Synthetic oligonucleotide; CTA chr11 5273624 5273645 5273629 5273624 -
attttaattatatagacaataa

SEQ ID NO: 135401 - DNA, 22 bp, Artificial Sequence
  Synthetic oligonucleotide; TTT chr11 5273620 5273641 5273625 5273620 -
taattatatagacaataaatga

SEQ ID NO: 135402 - DNA, 22 bp, Artificial Sequence
  Synthetic oligonucleotide; TTT chr11 5273619 5273640 5273624 5273619 -
aattatatagacaataaatgaa

SEQ ID NO: 135403 - DNA, 22 bp, Artificial Sequence
  Synthetic oligonucleotide; TTA chr11 5273618 5273639 5273623 5273618 -
attatatagacaataaatgaat

SEQ ID NO: 135404 - DNA, 22 bp, Artificial Sequence
  Synthetic oligonucleotide; TTA chr11 5273614 5273635 5273619 5273614 -
tatagacaataaatgaatattc

SEQ ID NO: 135405 - DNA, 22 bp, Artificial Sequence
  Synthetic oligonucleotide; TTC chr11 5273592 5273613 5273597 5273592 -
ttactgattactttttctgact

SEQ ID NO: 135406 - DNA, 22 bp, Artificial Sequence
  Synthetic oligonucleotide; CTT chr11 5273590 5273611 5273595 5273590 -
actgattactttttctgactgt

SEQ ID NO: 135407 - DNA, 22 bp, Artificial Sequence
  Synthetic oligonucleotide; TTA chr11 5273589 5273610 5273594 5273589 -
ctgattactttttctgactgtc

SEQ ID NO: 135408 - DNA, 22 bp, Artificial Sequence
  Synthetic oligonucleotide; CTG chr11 5273586 5273607 5273591 5273586 -
attactttttctgactgtctaa

SEQ ID NO: 135409 - DNA, 22 bp, Artificial Sequence
  Synthetic oligonucleotide; TTA chr11 5273582 5273603 5273587 5273582 -
ctttttctgactgtctaatctt

SEQ ID NO: 135410 - DNA, 22 bp, Artificial Sequence
  Synthetic oligonucleotide; CTT chr11 5273579 5273600 5273584 5273579 -
tttctgactgtctaatctttct

SEQ ID NO: 135411 - DNA, 22 bp, Artificial Sequence
  Synthetic oligonucleotide; TTT chr11 5273578 5273599 5273583 5273578 -
ttctgactgtctaatctttctg

SEQ ID NO: 135412 - DNA, 22 bp, Artificial Sequence
  Synthetic oligonucleotide; TTT chr11 5273577 5273598 5273582 5273577 -
tctgactgtctaatctttctga

SEQ ID NO: 135413 - DNA, 22 bp, Artificial Sequence
  Synthetic oligonucleotide; TTT chr11 5273576 5273597 5273581 5273576 -
ctgactgtctaatctttctgat

SEQ ID NO: 135414 - DNA, 22 bp, Artificial Sequence
  Synthetic oligonucleotide; TTC chr11 5273575 5273596 5273580 5273575 -
tgactgtctaatctttctgatc

SEQ ID NO: 135415 - DNA, 22 bp, Artificial Sequence
  Synthetic oligonucleotide; CTG chr11 5273573 5273594 5273578 5273573 -
actgtctaatctttctgatcta

SEQ ID NO: 135416 - DNA, 22 bp, Artificial Sequence
  Synthetic oligonucleotide; CTG chr11 5273569 5273590 5273574 5273569 -
tctaatctttctgatctatcct

SEQ ID NO: 135417 - DNA, 22 bp, Artificial Sequence
  Synthetic oligonucleotide; CTA chr11 5273565 5273586 5273570 5273565 -
atctttctgatctatcctggat

SEQ ID NO: 135418 - DNA, 22 bp, Artificial Sequence
  Synthetic oligonucleotide; CTT chr11 5273560 5273581 5273565 5273560 -
tctgatctatcctggatggcca

SEQ ID NO: 135419 - DNA, 22 bp, Artificial Sequence
  Synthetic oligonucleotide; TTT chr11 5273559 5273580 5273564 5273559 -
ctgatctatcctggatggccat

SEQ ID NO: 135420 - DNA, 22 bp, Artificial Sequence
  Synthetic oligonucleotide; TTC chr11 5273558 5273579 5273563 5273558 -
tgatctatcctggatggccata

SEQ ID NO: 135421 - DNA, 22 bp, Artificial Sequence
  Synthetic oligonucleotide; CTG chr11 5273556 5273577 5273561 5273556 -
atctatcctggatggccataac

SEQ ID NO: 135422 - DNA, 22 bp, Artificial Sequence
  Synthetic oligonucleotide; CTA chr11 5273551 5273572 5273556 5273551 -
tcctggatggccataacactta

SEQ ID NO: 135423 - DNA, 22 bp, Artificial Sequence
  Synthetic oligonucleotide; CTG chr11 5273546 5273567 5273551 5273546 -
gatggccataacacttatctct

SEQ ID NO: 135424 - DNA, 22 bp, Artificial Sequence
  Synthetic oligonucleotide; CTT chr11 5273530 5273551 5273535 5273530 -
atctctctgaactttgggcttt

SEQ ID NO: 135425 - DNA, 22 bp, Artificial Sequence
  Synthetic oligonucleotide; TTA chr11 5273529 5273550 5273534 5273529 -
tctctctgaactttgggctttt

SEQ ID NO: 135426 - DNA, 22 bp, Artificial Sequence
  Synthetic oligonucleotide; CTC chr11 5273525 5273546 5273530 5273525 -
tctgaactttgggcttttaata

SEQ ID NO: 135427 - DNA, 22 bp, Artificial Sequence
  Synthetic oligonucleotide; CTC chr11 5273523 5273544 5273528 5273523 -
tgaactttgggcttttaatata

SEQ ID NO: 135428 - DNA, 22 bp, Artificial Sequence
  Synthetic oligonucleotide; CTG chr11 5273521 5273542 5273526 5273521 -
aactttgggcttttaatatagg

SEQ ID NO: 135429 - DNA, 22 bp, Artificial Sequence
  Synthetic oligonucleotide; CTT chr11 5273516 5273537 5273521 5273516 -
tgggcttttaatataggaaaga

SEQ ID NO: 135430 - DNA, 22 bp, Artificial Sequence
  Synthetic oligonucleotide; TTT chr11 5273515 5273536 5273520 5273515 -
gggcttttaatataggaaagaa

SEQ ID NO: 135431 - DNA, 22 bp, Artificial Sequence
  Synthetic oligonucleotide; TTG chr11 5273514 5273535 5273519 5273514 -
ggcttttaatataggaaagaaa

SEQ ID NO: 135432 - DNA, 22 bp, Artificial Sequence
  Synthetic oligonucleotide; CTT chr11 5273509 5273530 5273514 5273509 -
ttaatataggaaagaaaagcaa

SEQ ID NO: 135433 - DNA, 22 bp, Artificial Sequence
  Synthetic oligonucleotide; TTT chr11 5273508 5273529 5273513 5273508 -
taatataggaaagaaaagcaat

SEQ ID NO: 135434 - DNA, 22 bp, Artificial Sequence
  Synthetic oligonucleotide; TTT chr11 5273507 5273528 5273512 5273507 -
aatataggaaagaaaagcaata

SEQ ID NO: 135435 - DNA, 22 bp, Artificial Sequence
  Synthetic oligonucleotide; TTA chr11 5273506 5273527 5273511 5273506 -
atataggaaagaaaagcaataa

SEQ ID NO: 135436 - DNA, 22 bp, Artificial Sequence
  Synthetic oligonucleotide; TTT chr11 5273477 5273498 5273482 5273477 -
ttcatggtatctcatatgataa

SEQ ID NO: 135437 - DNA, 22 bp, Artificial Sequence
  Synthetic oligonucleotide; TTT chr11 5273476 5273497 5273481 5273476 -
tcatggtatctcatatgataaa

SEQ ID NO: 135438 - DNA, 22 bp, Artificial Sequence
  Synthetic oligonucleotide; TTT chr11 5273475 5273496 5273480 5273475 -
catggtatctcatatgataaac

SEQ ID NO: 135439 - DNA, 22 bp, Artificial Sequence
  Synthetic oligonucleotide; TTC chr11 5273474 5273495 5273479 5273474 -
atggtatctcatatgataaaca

SEQ ID NO: 135440 - DNA, 22 bp, Artificial Sequence
  Synthetic oligonucleotide; CTC chr11 5273464 5273485 5273469 5273464 -
atatgataaacaaataaaatgc

SEQ ID NO: 135441 - DNA, 22 bp, Artificial Sequence
  Synthetic oligonucleotide; CTT chr11 5273440 5273461 5273445 5273440 -
aaaaatgagcaggtgaagcaat

SEQ ID NO: 135442 - DNA, 22 bp, Artificial Sequence
  Synthetic oligonucleotide; TTA chr11 5273439 5273460 5273444 5273439 -
aaaatgagcaggtgaagcaatt

SEQ ID NO: 135443 - DNA, 22 bp, Artificial Sequence
  Synthetic oligonucleotide; TTT chr11 5273416 5273437 5273421 5273416 -
atcttgaaccaacaagcatcga

SEQ ID NO: 135444 - DNA, 22 bp, Artificial Sequence
  Synthetic oligonucleotide; TTA chr11 5273415 5273436 5273420 5273415 -
tcttgaaccaacaagcatcgaa

SEQ ID NO: 135445 - DNA, 22 bp, Artificial Sequence
  Synthetic oligonucleotide; CTT chr11 5273411 5273432 5273416 5273411 -
gaaccaacaagcatcgaagcaa

SEQ ID NO: 135446 - DNA, 22 bp, Artificial Sequence
  Synthetic oligonucleotide; TTG chr11 5273410 5273431 5273415 5273410 -
aaccaacaagcatcgaagcaat

SEQ ID NO: 135447 - DNA, 22 bp, Artificial Sequence
  Synthetic oligonucleotide; CTG chr11 5273378 5273399 5273383 5273378 -
cccgcagcctacctgacttctg

SEQ ID NO: 135448 - DNA, 22 bp, Artificial Sequence
  Synthetic oligonucleotide; CTA chr11 5273367 5273388 5273372 5273367 -
cctgacttctgagtcaggattt

SEQ ID NO: 135449 - DNA, 22 bp, Artificial Sequence
  Synthetic oligonucleotide; CTG chr11 5273363 5273384 5273368 5273363 -
acttctgagtcaggatttataa

SEQ ID NO: 135450 - DNA, 22 bp, Artificial Sequence
  Synthetic oligonucleotide; CTT chr11 5273359 5273380 5273364 5273359 -
ctgagtcaggatttataagcct

SEQ ID NO: 135451 - DNA, 22 bp, Artificial Sequence
  Synthetic oligonucleotide; TTC chr11 5273358 5273379 5273363 5273358 -
tgagtcaggatttataagcctt

SEQ ID NO: 135452 - DNA, 22 bp, Artificial Sequence
  Synthetic oligonucleotide; CTG chr11 5273356 5273377 5273361 5273356 -
agtcaggatttataagccttgt

SEQ ID NO: 135453 - DNA, 22 bp, Artificial Sequence
  Synthetic oligonucleotide; TTT chr11 5273345 5273366 5273350 5273345 -
ataagccttgttactgagacac

SEQ ID NO: 135454 - DNA, 22 bp, Artificial Sequence
  Synthetic oligonucleotide; TTA chr11 5273344 5273365 5273349 5273344 -
taagccttgttactgagacaca

SEQ ID NO: 135455 - DNA, 22 bp, Artificial Sequence
  Synthetic oligonucleotide; CTT chr11 5273336 5273357 5273341 5273336 -
gttactgagacacaaacctggg

SEQ ID NO: 135456 - DNA, 22 bp, Artificial Sequence
  Synthetic oligonucleotide; TTG chr11 5273335 5273356 5273340 5273335 -
ttactgagacacaaacctgggc

SEQ ID NO: 135457 - DNA, 22 bp, Artificial Sequence
  Synthetic oligonucleotide; TTA chr11 5273332 5273353 5273337 5273332 -
ctgagacacaaacctgggcctt

SEQ ID NO: 135458 - DNA, 22 bp, Artificial Sequence
  Synthetic oligonucleotide; CTG chr11 5273329 5273350 5273334 5273329 -
agacacaaacctgggcctttca

SEQ ID NO: 135459 - DNA, 22 bp, Artificial Sequence
  Synthetic oligonucleotide; CTG chr11 5273316 5273337 5273321 5273316 -
ggcctttcaatgctataacctt

SEQ ID NO: 135460 - DNA, 22 bp, Artificial Sequence
  Synthetic oligonucleotide; CTT chr11 5273310 5273331 5273315 5273310 -
tcaatgctataacctttcttga

SEQ ID NO: 135461 - DNA, 22 bp, Artificial Sequence
  Synthetic oligonucleotide; TTT chr11 5273309 5273330 5273314 5273309 -
caatgctataacctttcttgaa

SEQ ID NO: 135462 - DNA, 22 bp, Artificial Sequence
  Synthetic oligonucleotide; TTC chr11 5273308 5273329 5273313 5273308 -
aatgctataacctttcttgaag

SEQ ID NO: 135463 - DNA, 22 bp, Artificial Sequence
  Synthetic oligonucleotide; CTA chr11 5273301 5273322 5273306 5273301 -
taacctttcttgaagctcctcc

SEQ ID NO: 135464 - DNA, 22 bp, Artificial Sequence
  Synthetic oligonucleotide; CTT chr11 5273294 5273315 5273299 5273294 -
tcttgaagctcctccctaccac

SEQ ID NO: 135465 - DNA, 22 bp, Artificial Sequence
  Synthetic oligonucleotide; TTT chr11 5273293 5273314 5273298 5273293 -
cttgaagctcctccctaccacc

SEQ ID NO: 135466 - DNA, 22 bp, Artificial Sequence
  Synthetic oligonucleotide; TTC chr11 5273292 5273313 5273297 5273292 -
ttgaagctcctccctaccacct

SEQ ID NO: 135467 - DNA, 22 bp, Artificial Sequence
  Synthetic oligonucleotide; CTT chr11 5273290 5273311 5273295 5273290 -
gaagctcctccctaccaccttt

SEQ ID NO: 135468 - DNA, 22 bp, Artificial Sequence
  Synthetic oligonucleotide; TTG chr11 5273289 5273310 5273294 5273289 -
aagctcctccctaccaccttta

SEQ ID NO: 135469 - DNA, 22 bp, Artificial Sequence
  Synthetic oligonucleotide; CTC chr11 5273283 5273304 5273288 5273283 -
ctccctaccacctttagccata

SEQ ID NO: 135470 - DNA, 22 bp, Artificial Sequence
  Synthetic oligonucleotide; CTC chr11 5273280 5273301 5273285 5273280 -
cctaccacctttagccataagg

SEQ ID NO: 135471 - DNA, 22 bp, Artificial Sequence
  Synthetic oligonucleotide; CTA chr11 5273276 5273297 5273281 5273276 -
ccacctttagccataaggaaac

SEQ ID NO: 135472 - DNA, 22 bp, Artificial Sequence
  Synthetic oligonucleotide; CTT chr11 5273269 5273290 5273274 5273269 -
tagccataaggaaacatggaat

SEQ ID NO: 135473 - DNA, 22 bp, Artificial Sequence
  Synthetic oligonucleotide; TTT chr11 5273268 5273289 5273273 5273268 -
agccataaggaaacatggaatg

SEQ ID NO: 135474 - DNA, 22 bp, Artificial Sequence
  Synthetic oligonucleotide; TTA chr11 5273267 5273288 5273272 5273267 -
gccataaggaaacatggaatgg

SEQ ID NO: 135475 - DNA, 22 bp, Artificial Sequence
  Synthetic oligonucleotide; CTG chr11 5273233 5273254 5273238 5273233 -
gatgcaagccaggtctggaacc

SEQ ID NO: 135476 - DNA, 22 bp, Artificial Sequence
  Synthetic oligonucleotide; CTG chr11 5273216 5273237 5273221 5273216 -
gaaccataggcagtaaggagag

SEQ ID NO: 135477 - DNA, 22 bp, Artificial Sequence
  Synthetic oligonucleotide; CTC chr11 5273178 5273199 5273183 5273178 -
tgcaactggctccgagggagca

SEQ ID NO: 135478 - DNA, 22 bp, Artificial Sequence
  Synthetic oligonucleotide; CTG chr11 5273176 5273197 5273181 5273176 -
caactggctccgagggagcagg

SEQ ID NO: 135479 - DNA, 22 bp, Artificial Sequence
  Synthetic oligonucleotide; CTG chr11 5273170 5273191 5273175 5273170 -
gctccgagggagcaggagagga

SEQ ID NO: 135480 - DNA, 22 bp, Artificial Sequence
  Synthetic oligonucleotide; CTC chr11 5273166 5273187 5273171 5273166 -
cgagggagcaggagaggatcaa

SEQ ID NO: 135481 - DNA, 22 bp, Artificial Sequence
  Synthetic oligonucleotide; CTC chr11 5273134 5273155 5273139 5273134 -
tgaatctaagagaagactggtg

SEQ ID NO: 135482 - DNA, 22 bp, Artificial Sequence
  Synthetic oligonucleotide; CTG chr11 5273132 5273153 5273137 5273132 -
aatctaagagaagactggtgtc

SEQ ID NO: 135483 - DNA, 22 bp, Artificial Sequence
  Synthetic oligonucleotide; CTA chr11 5273126 5273147 5273131 5273126 -
agagaagactggtgtccatact

SEQ ID NO: 135484 - DNA, 22 bp, Artificial Sequence
  Synthetic oligonucleotide; CTG chr11 5273115 5273136 5273120 5273115 -
gtgtccatactctgaatgggaa

SEQ ID NO: 135485 - DNA, 22 bp, Artificial Sequence
  Synthetic oligonucleotide; CTC chr11 5273103 5273124 5273108 5273103 -
tgaatgggaagaatgatgggat

SEQ ID NO: 135486 - DNA, 22 bp, Artificial Sequence
  Synthetic oligonucleotide; CTG chr11 5273101 5273122 5273106 5273101 -
aatgggaagaatgatgggatta

SEQ ID NO: 135487 - DNA, 22 bp, Artificial Sequence
  Synthetic oligonucleotide; TTA chr11 5273079 5273100 5273084 5273079 -
cccatagggcttgttttaggga

SEQ ID NO: 135488 - DNA, 22 bp, Artificial Sequence
  Synthetic oligonucleotide; CTT chr11 5273067 5273088 5273072 5273067 -
gttttagggagaaacctgttct

SEQ ID NO: 135489 - DNA, 22 bp, Artificial Sequence
  Synthetic oligonucleotide; TTG chr11 5273066 5273087 5273071 5273066 -
ttttagggagaaacctgttctc

SEQ ID NO: 135490 - DNA, 22 bp, Artificial Sequence
  Synthetic oligonucleotide; TTT chr11 5273063 5273084 5273068 5273063 -
tagggagaaacctgttctccaa

SEQ ID NO: 135491 - DNA, 22 bp, Artificial Sequence
  Synthetic oligonucleotide; TTT chr11 5273062 5273083 5273067 5273062 -
agggagaaacctgttctccaaa

SEQ ID NO: 135492 - DNA, 22 bp, Artificial Sequence
  Synthetic oligonucleotide; TTA chr11 5273061 5273082 5273066 5273061 -
gggagaaacctgttctccaaac

SEQ ID NO: 135493 - DNA, 22 bp, Artificial Sequence
  Synthetic oligonucleotide; CTG chr11 5273049 5273070 5273054 5273049 -
ttctccaaactcttggccttga

SEQ ID NO: 135494 - DNA, 22 bp, Artificial Sequence
  Synthetic oligonucleotide; TTC chr11 5273046 5273067 5273051 5273046 -
tccaaactcttggccttgagat

SEQ ID NO: 135495 - DNA, 22 bp, Artificial Sequence
  Synthetic oligonucleotide; CTC chr11 5273044 5273065 5273049 5273044 -
caaactcttggccttgagatac

SEQ ID NO: 135496 - DNA, 22 bp, Artificial Sequence
  Synthetic oligonucleotide; CTC chr11 5273037 5273058 5273042 5273037 -
ttggccttgagatacctggtcc

SEQ ID NO: 135497 - DNA, 22 bp, Artificial Sequence
  Synthetic oligonucleotide; CTT chr11 5273035 5273056 5273040 5273035 -
ggccttgagatacctggtcctt

SEQ ID NO: 135498 - DNA, 22 bp, Artificial Sequence
  Synthetic oligonucleotide; TTG chr11 5273034 5273055 5273039 5273034 -
gccttgagatacctggtcctta

SEQ ID NO: 135499 - DNA, 22 bp, Artificial Sequence
  Synthetic oligonucleotide; CTT chr11 5273029 5273050 5273034 5273029 -
gagatacctggtccttattcct

SEQ ID NO: 135500 - DNA, 22 bp, Artificial Sequence
  Synthetic oligonucleotide; TTG chr11 5273028 5273049 5273033 5273028 -
agatacctggtccttattcctt

SEQ ID NO: 135501 - DNA, 22 bp, Artificial Sequence
  Synthetic oligonucleotide; CTG chr11 5273019 5273040 5273024 5273019 -
gtccttattccttggactttgg

SEQ ID NO: 135502 - DNA, 22 bp, Artificial Sequence
  Synthetic oligonucleotide; CTT chr11 5273013 5273034 5273018 5273013 -
attccttggactttggcaatgt

SEQ ID NO: 135503 - DNA, 22 bp, Artificial Sequence
  Synthetic oligonucleotide; TTA chr11 5273012 5273033 5273017 5273012 -
ttccttggactttggcaatgtc

SEQ ID NO: 135504 - DNA, 22 bp, Artificial Sequence
  Synthetic oligonucleotide; TTC chr11 5273009 5273030 5273014 5273009 -
cttggactttggcaatgtctga

SEQ ID NO: 135505 - DNA, 22 bp, Artificial Sequence
  Synthetic oligonucleotide; CTT chr11 5273006 5273027 5273011 5273006 -
ggactttggcaatgtctgaccc

SEQ ID NO: 135506 - DNA, 22 bp, Artificial Sequence
  Synthetic oligonucleotide; TTG chr11 5273005 5273026 5273010 5273005 -
gactttggcaatgtctgaccct

SEQ ID NO: 135507 - DNA, 22 bp, Artificial Sequence
  Synthetic oligonucleotide; CTT chr11 5273000 5273021 5273005 5273000 -
tggcaatgtctgaccctcacat

SEQ ID NO: 135508 - DNA, 22 bp, Artificial Sequence
  Synthetic oligonucleotide; TTT chr11 5272999 5273020 5273004 5272999 -
ggcaatgtctgaccctcacatt

SEQ ID NO: 135509 - DNA, 22 bp, Artificial Sequence
  Synthetic oligonucleotide; TTG chr11 5272998 5273019 5273003 5272998 -
gcaatgtctgaccctcacattc

SEQ ID NO: 135510 - DNA, 22 bp, Artificial Sequence
  Synthetic oligonucleotide; CTG chr11 5272988 5273009 5272993 5272988 -
accctcacattcaagttctgag

SEQ ID NO: 135511 - DNA, 22 bp, Artificial Sequence
  Synthetic oligonucleotide; CTC chr11 5272982 5273003 5272987 5272982 -
acattcaagttctgaggaaggg

SEQ ID NO: 135512 - DNA, 22 bp, Artificial Sequence
  Synthetic oligonucleotide; TTC chr11 5272976 5272997 5272981 5272976 -
aagttctgaggaagggccactg

SEQ ID NO: 135513 - DNA, 22 bp, Artificial Sequence
  Synthetic oligonucleotide; TTC chr11 5272970 5272991 5272975 5272970 -
tgaggaagggccactgccttca

SEQ ID NO: 135514 - DNA, 22 bp, Artificial Sequence
  Synthetic oligonucleotide; CTG chr11 5272968 5272989 5272973 5272968 -
aggaagggccactgccttcata

SEQ ID NO: 135515 - DNA, 22 bp, Artificial Sequence
  Synthetic oligonucleotide; CTG chr11 5272954 5272975 5272959 5272954 -
ccttcatactgtggatctgtag

SEQ ID NO: 135516 - DNA, 22 bp, Artificial Sequence
  Synthetic oligonucleotide; CTT chr11 5272950 5272971 5272955 5272950 -
catactgtggatctgtagcaaa

SEQ ID NO: 135517 - DNA, 22 bp, Artificial Sequence
  Synthetic oligonucleotide; TTC chr11 5272949 5272970 5272954 5272949 -
atactgtggatctgtagcaaat

SEQ ID NO: 135518 - DNA, 22 bp, Artificial Sequence
  Synthetic oligonucleotide; CTG chr11 5272943 5272964 5272948 5272943 -
tggatctgtagcaaattccccc

SEQ ID NO: 135519 - DNA, 22 bp, Artificial Sequence
  Synthetic oligonucleotide; CTG chr11 5272935 5272956 5272940 5272935 -
tagcaaattccccctgaaaacc

SEQ ID NO: 135520 - DNA, 22 bp, Artificial Sequence
  Synthetic oligonucleotide; TTC chr11 5272925 5272946 5272930 5272925 -
cccctgaaaacccagagctgta

SEQ ID NO: 135521 - DNA, 22 bp, Artificial Sequence
  Synthetic oligonucleotide; CTG chr11 5272919 5272940 5272924 5272919 -
aaaacccagagctgtatcttaa

SEQ ID NO: 135522 - DNA, 22 bp, Artificial Sequence
  Synthetic oligonucleotide; CTG chr11 5272905 5272926 5272910 5272905 -
tatcttaattggttaaaaaaaa

SEQ ID NO: 135523 - DNA, 22 bp, Artificial Sequence
  Synthetic oligonucleotide; CTT chr11 5272899 5272920 5272904 5272899 -
aattggttaaaaaaaattatat

SEQ ID NO: 135524 - DNA, 22 bp, Artificial Sequence
  Synthetic oligonucleotide; TTA chr11 5272898 5272919 5272903 5272898 -
attggttaaaaaaaattatatt

SEQ ID NO: 135525 - DNA, 22 bp, Artificial Sequence
  Synthetic oligonucleotide; TTG chr11 5272894 5272915 5272899 5272894 -
gttaaaaaaaattatattatct

SEQ ID NO: 135526 - DNA, 22 bp, Artificial Sequence
  Synthetic oligonucleotide; TTA chr11 5272890 5272911 5272895 5272890 -
aaaaaaattatattatctcaac

SEQ ID NO: 135527 - DNA, 22 bp, Artificial Sequence
  Synthetic oligonucleotide; TTA chr11 5272880 5272901 5272885 5272880 -
tattatctcaacgactgttctt

SEQ ID NO: 135528 - DNA, 22 bp, Artificial Sequence
  Synthetic oligonucleotide; TTA chr11 5272875 5272896 5272880 5272875 -
tctcaacgactgttcttctctg

SEQ ID NO: 135529 - DNA, 22 bp, Artificial Sequence
  Synthetic oligonucleotide; CTC chr11 5272871 5272892 5272876 5272871 -
aacgactgttcttctctgagta

SEQ ID NO: 135530 - DNA, 22 bp, Artificial Sequence
  Synthetic oligonucleotide; CTG chr11 5272863 5272884 5272868 5272863 -
ttcttctctgagtagccaagct

SEQ ID NO: 135531 - DNA, 22 bp, Artificial Sequence
  Synthetic oligonucleotide; TTC chr11 5272860 5272881 5272865 5272860 -
ttctctgagtagccaagctcag

SEQ ID NO: 135532 - DNA, 22 bp, Artificial Sequence
  Synthetic oligonucleotide; CTT chr11 5272858 5272879 5272863 5272858 -
ctctgagtagccaagctcagct

SEQ ID NO: 135533 - DNA, 22 bp, Artificial Sequence
  Synthetic oligonucleotide; TTC chr11 5272857 5272878 5272862 5272857 -
tctgagtagccaagctcagctt

SEQ ID NO: 135534 - DNA, 22 bp, Artificial Sequence
  Synthetic oligonucleotide; CTC chr11 5272855 5272876 5272860 5272855 -
tgagtagccaagctcagcttgg

SEQ ID NO: 135535 - DNA, 22 bp, Artificial Sequence
  Synthetic oligonucleotide; CTG chr11 5272853 5272874 5272858 5272853 -
agtagccaagctcagcttggtt

SEQ ID NO: 135536 - DNA, 22 bp, Artificial Sequence
  Synthetic oligonucleotide; CTC chr11 5272840 5272861 5272845 5272840 -
agcttggttcaagctacaagca

SEQ ID NO: 135537 - DNA, 22 bp, Artificial Sequence
  Synthetic oligonucleotide; CTT chr11 5272835 5272856 5272840 5272835 -
ggttcaagctacaagcagctga

SEQ ID NO: 135538 - DNA, 22 bp, Artificial Sequence
  Synthetic oligonucleotide; TTG chr11 5272834 5272855 5272839 5272834 -
gttcaagctacaagcagctgag

SEQ ID NO: 135539 - DNA, 22 bp, Artificial Sequence
  Synthetic oligonucleotide; TTC chr11 5272830 5272851 5272835 5272830 -
aagctacaagcagctgagctgc

SEQ ID NO: 135540 - DNA, 22 bp, Artificial Sequence
  Synthetic oligonucleotide; CTA chr11 5272824 5272845 5272829 5272824 -
caagcagctgagctgctttttg

SEQ ID NO: 135541 - DNA, 22 bp, Artificial Sequence
  Synthetic oligonucleotide; CTG chr11 5272814 5272835 5272819 5272814 -
agctgctttttgtctagtcatt

SEQ ID NO: 135542 - DNA, 22 bp, Artificial Sequence
  Synthetic oligonucleotide; CTG chr11 5272809 5272830 5272814 5272809 -
ctttttgtctagtcattgttct

SEQ ID NO: 135543 - DNA, 22 bp, Artificial Sequence
  Synthetic oligonucleotide; CTT chr11 5272806 5272827 5272811 5272806 -
tttgtctagtcattgttctttt

SEQ ID NO: 135544 - DNA, 22 bp, Artificial Sequence
  Synthetic oligonucleotide; TTT chr11 5272805 5272826 5272810 5272805 -
ttgtctagtcattgttctttta

SEQ ID NO: 135545 - DNA, 22 bp, Artificial Sequence
  Synthetic oligonucleotide; TTT chr11 5272804 5272825 5272809 5272804 -
tgtctagtcattgttcttttat

SEQ ID NO: 135546 - DNA, 22 bp, Artificial Sequence
  Synthetic oligonucleotide; TTT chr11 5272803 5272824 5272808 5272803 -
gtctagtcattgttcttttatt

SEQ ID NO: 135547 - DNA, 22 bp, Artificial Sequence
  Synthetic oligonucleotide; TTG chr11 5272802 5272823 5272807 5272802 -
tctagtcattgttcttttattt

SEQ ID NO: 135548 - DNA, 22 bp, Artificial Sequence
  Synthetic oligonucleotide; CTA chr11 5272798 5272819 5272803 5272798 -
gtcattgttcttttatttcagt

SEQ ID NO: 135549 - DNA, 22 bp, Artificial Sequence
  Synthetic oligonucleotide; TTG chr11 5272791 5272812 5272796 5272791 -
ttcttttatttcagtggatcaa

SEQ ID NO: 135550 - DNA, 22 bp, Artificial Sequence
  Synthetic oligonucleotide; TTC chr11 5272788 5272809 5272793 5272788 -
ttttatttcagtggatcaaata

SEQ ID NO: 135551 - DNA, 22 bp, Artificial Sequence
  Synthetic oligonucleotide; CTT chr11 5272786 5272807 5272791 5272786 -
ttatttcagtggatcaaatacg

SEQ ID NO: 135552 - DNA, 22 bp, Artificial Sequence
  Synthetic oligonucleotide; TTT chr11 5272785 5272806 5272790 5272785 -
tatttcagtggatcaaatacgt

SEQ ID NO: 135553 - DNA, 22 bp, Artificial Sequence
  Synthetic oligonucleotide; TTT chr11 5272784 5272805 5272789 5272784 -
atttcagtggatcaaatacgtt

SEQ ID NO: 135554 - DNA, 22 bp, Artificial Sequence
  Synthetic oligonucleotide; TTA chr11 5272783 5272804 5272788 5272783 -
tttcagtggatcaaatacgttc

SEQ ID NO: 135555 - DNA, 22 bp, Artificial Sequence
  Synthetic oligonucleotide; TTT chr11 5272780 5272801 5272785 5272780 -
cagtggatcaaatacgttcttt

SEQ ID NO: 135556 - DNA, 22 bp, Artificial Sequence
  Synthetic oligonucleotide; TTC chr11 5272779 5272800 5272784 5272779 -
agtggatcaaatacgttctttc

SEQ ID NO: 135557 - DNA, 22 bp, Artificial Sequence
  Synthetic oligonucleotide; TTC chr11 5272761 5272782 5272766 5272761 -
tttccaaacctaggatcttgtc

SEQ ID NO: 135558 - DNA, 22 bp, Artificial Sequence
  Synthetic oligonucleotide; CTT chr11 5272759 5272780 5272764 5272759 -
tccaaacctaggatcttgtctt

SEQ ID NO: 135559 - DNA, 22 bp, Artificial Sequence
  Synthetic oligonucleotide; TTT chr11 5272758 5272779 5272763 5272758 -
ccaaacctaggatcttgtcttc

SEQ ID NO: 135560 - DNA, 22 bp, Artificial Sequence
  Synthetic oligonucleotide; TTC chr11 5272757 5272778 5272762 5272757 -
caaacctaggatcttgtcttcc

SEQ ID NO: 135561 - DNA, 22 bp, Artificial Sequence
  Synthetic oligonucleotide; CTA chr11 5272749 5272770 5272754 5272749 -
ggatcttgtcttcctaggctat

SEQ ID NO: 135562 - DNA, 22 bp, Artificial Sequence
  Synthetic oligonucleotide; CTT chr11 5272742 5272763 5272747 5272742 -
gtcttcctaggctatatatttt

SEQ ID NO: 135563 - DNA, 22 bp, Artificial Sequence
  Synthetic oligonucleotide; TTG chr11 5272741 5272762 5272746 5272741 -
tcttcctaggctatatattttg

SEQ ID NO: 135564 - DNA, 22 bp, Artificial Sequence
  Synthetic oligonucleotide; CTT chr11 5272737 5272758 5272742 5272737 -
cctaggctatatattttgtccc

SEQ ID NO: 135565 - DNA, 22 bp, Artificial Sequence
  Synthetic oligonucleotide; TTC chr11 5272736 5272757 5272741 5272736 -
ctaggctatatattttgtccca

SEQ ID NO: 135566 - DNA, 22 bp, Artificial Sequence
  Synthetic oligonucleotide; CTA chr11 5272733 5272754 5272738 5272733 -
ggctatatattttgtcccagga

SEQ ID NO: 135567 - DNA, 22 bp, Artificial Sequence
  Synthetic oligonucleotide; CTA chr11 5272728 5272749 5272733 5272728 -
tatattttgtcccaggaagtct

SEQ ID NO: 135568 - DNA, 22 bp, Artificial Sequence
  Synthetic oligonucleotide; TTT chr11 5272721 5272742 5272726 5272721 -
tgtcccaggaagtcttaatctg

SEQ ID NO: 135569 - DNA, 22 bp, Artificial Sequence
  Synthetic oligonucleotide; TTT chr11 5272720 5272741 5272725 5272720 -
gtcccaggaagtcttaatctgg

SEQ ID NO: 135570 - DNA, 22 bp, Artificial Sequence
  Synthetic oligonucleotide; TTG chr11 5272719 5272740 5272724 5272719 -
tcccaggaagtcttaatctggg

SEQ ID NO: 135571 - DNA, 22 bp, Artificial Sequence
  Synthetic oligonucleotide; CTT chr11 5272705 5272726 5272710 5272705 -
aatctggggtccacagaacact

SEQ ID NO: 135572 - DNA, 22 bp, Artificial Sequence
  Synthetic oligonucleotide; TTA chr11 5272704 5272725 5272709 5272704 -
atctggggtccacagaacacta

SEQ ID NO: 135573 - DNA, 22 bp, Artificial Sequence
  Synthetic oligonucleotide; CTG chr11 5272699 5272720 5272704 5272699 -
gggtccacagaacactaggggg

SEQ ID NO: 135574 - DNA, 22 bp, Artificial Sequence
  Synthetic oligonucleotide; CTA chr11 5272682 5272703 5272687 5272682 -
gggggctggtgaagtttataga

SEQ ID NO: 135575 - DNA, 22 bp, Artificial Sequence
  Synthetic oligonucleotide; CTG chr11 5272674 5272695 5272679 5272674 -
gtgaagtttatagaaaaaaaat

SEQ ID NO: 135576 - DNA, 22 bp, Artificial Sequence
  Synthetic oligonucleotide; TTT chr11 5272665 5272686 5272670 5272665 -
atagaaaaaaaatctgtatttt

SEQ ID NO: 135577 - DNA, 22 bp, Artificial Sequence
  Synthetic oligonucleotide; TTA chr11 5272664 5272685 5272669 5272664 -
tagaaaaaaaatctgtattttt

SEQ ID NO: 135578 - DNA, 22 bp, Artificial Sequence
  Synthetic oligonucleotide; CTG chr11 5272649 5272670 5272654 5272649 -
tatttttacttacatgtaactg

SEQ ID NO: 135579 - DNA, 22 bp, Artificial Sequence
  Synthetic oligonucleotide; TTT chr11 5272644 5272665 5272649 5272644 -
ttacttacatgtaactgaaatt

SEQ ID NO: 135580 - DNA, 22 bp, Artificial Sequence
  Synthetic oligonucleotide; TTT chr11 5272643 5272664 5272648 5272643 -
tacttacatgtaactgaaattt

SEQ ID NO: 135581 - DNA, 22 bp, Artificial Sequence
  Synthetic oligonucleotide; TTT chr11 5272642 5272663 5272647 5272642 -
acttacatgtaactgaaattta

SEQ ID NO: 135582 - DNA, 22 bp, Artificial Sequence
  Synthetic oligonucleotide; TTA chr11 5272641 5272662 5272646 5272641 -
cttacatgtaactgaaatttag

SEQ ID NO: 135583 - DNA, 22 bp, Artificial Sequence
  Synthetic oligonucleotide; CTT chr11 5272638 5272659 5272643 5272638 -
acatgtaactgaaatttagcat

SEQ ID NO: 135584 - DNA, 22 bp, Artificial Sequence
  Synthetic oligonucleotide; TTA chr11 5272637 5272658 5272642 5272637 -
catgtaactgaaatttagcatt

SEQ ID NO: 135585 - DNA, 22 bp, Artificial Sequence
  Synthetic oligonucleotide; CTG chr11 5272627 5272648 5272632 5272627 -
aaatttagcattttcttctact

SEQ ID NO: 135586 - DNA, 22 bp, Artificial Sequence
  Synthetic oligonucleotide; TTT chr11 5272621 5272642 5272626 5272621 -
agcattttcttctactttgaat

SEQ ID NO: 135587 - DNA, 22 bp, Artificial Sequence
  Synthetic oligonucleotide; TTA chr11 5272620 5272641 5272625 5272620 -
gcattttcttctactttgaatg

SEQ ID NO: 135588 - DNA, 22 bp, Artificial Sequence
  Synthetic oligonucleotide; TTT chr11 5272614 5272635 5272619 5272614 -
tcttctactttgaatgcaaagg

SEQ ID NO: 135589 - DNA, 22 bp, Artificial Sequence
  Synthetic oligonucleotide; TTT chr11 5272613 5272634 5272618 5272613 -
cttctactttgaatgcaaagga

SEQ ID NO: 135590 - DNA, 22 bp, Artificial Sequence
  Synthetic oligonucleotide; TTC chr11 5272612 5272633 5272617 5272612 -
ttctactttgaatgcaaaggac

SEQ ID NO: 135591 - DNA, 22 bp, Artificial Sequence
  Synthetic oligonucleotide; CTT chr11 5272610 5272631 5272615 5272610 -
ctactttgaatgcaaaggacaa

SEQ ID NO: 135592 - DNA, 22 bp, Artificial Sequence
  Synthetic oligonucleotide; TTC chr11 5272609 5272630 5272614 5272609 -
tactttgaatgcaaaggacaaa

SEQ ID NO: 135593 - DNA, 22 bp, Artificial Sequence
  Synthetic oligonucleotide; CTA chr11 5272607 5272628 5272612 5272607 -
ctttgaatgcaaaggacaaact

SEQ ID NO: 135594 - DNA, 22 bp, Artificial Sequence
  Synthetic oligonucleotide; CTT chr11 5272604 5272625 5272609 5272604 -
tgaatgcaaaggacaaactaga

SEQ ID NO: 135595 - DNA, 22 bp, Artificial Sequence
  Synthetic oligonucleotide; TTT chr11 5272603 5272624 5272608 5272603 -
gaatgcaaaggacaaactagaa

SEQ ID NO: 135596 - DNA, 22 bp, Artificial Sequence
  Synthetic oligonucleotide; TTG chr11 5272602 5272623 5272607 5272602 -
aatgcaaaggacaaactagaat

SEQ ID NO: 135597 - DNA, 22 bp, Artificial Sequence
  Synthetic oligonucleotide; CTA chr11 5272584 5272605 5272589 5272584 -
gaatgacatcatcagtacctat

SEQ ID NO: 135598 - DNA, 22 bp, Artificial Sequence
  Synthetic oligonucleotide; CTA chr11 5272563 5272584 5272568 5272563 -
ttgcatagttataaagagaaac

SEQ ID NO: 135599 - DNA, 22 bp, Artificial Sequence
  Synthetic oligonucleotide; TTG chr11 5272560 5272581 5272565 5272560 -
catagttataaagagaaaccac

SEQ ID NO: 135600 - DNA, 22 bp, Artificial Sequence
  Synthetic oligonucleotide; TTA chr11 5272552 5272573 5272557 5272552 -
taaagagaaaccacagatattt

SEQ ID NO: 135601 - DNA, 22 bp, Artificial Sequence
  Synthetic oligonucleotide; TTT chr11 5272530 5272551 5272535 5272530 -
tcatactacaccataggtattg

SEQ ID NO: 135602 - DNA, 22 bp, Artificial Sequence
  Synthetic oligonucleotide; TTT chr11 5272529 5272550 5272534 5272529 -
catactacaccataggtattgc

SEQ ID NO: 135603 - DNA, 22 bp, Artificial Sequence
  Synthetic oligonucleotide; TTC chr11 5272528 5272549 5272533 5272528 -
atactacaccataggtattgca

SEQ ID NO: 135604 - DNA, 22 bp, Artificial Sequence
  Synthetic oligonucleotide; CTA chr11 5272522 5272543 5272527 5272522 -
caccataggtattgcagatctt

SEQ ID NO: 135605 - DNA, 22 bp, Artificial Sequence
  Synthetic oligonucleotide; TTG chr11 5272508 5272529 5272513 5272508 -
cagatctttttgtttttgtttt

SEQ ID NO: 135606 - DNA, 22 bp, Artificial Sequence
  Synthetic oligonucleotide; CTT chr11 5272500 5272521 5272505 5272500 -
tttgtttttgtttttgtttgag

SEQ ID NO: 135607 - DNA, 22 bp, Artificial Sequence
  Synthetic oligonucleotide; TTT chr11 5272499 5272520 5272504 5272499 -
ttgtttttgtttttgtttgaga

SEQ ID NO: 135608 - DNA, 22 bp, Artificial Sequence
  Synthetic oligonucleotide; TTT chr11 5272498 5272519 5272503 5272498 -
tgtttttgtttttgtttgagat

SEQ ID NO: 135609 - DNA, 22 bp, Artificial Sequence
  Synthetic oligonucleotide; TTT chr11 5272497 5272518 5272502 5272497 -
gtttttgtttttgtttgagatg

SEQ ID NO: 135610 - DNA, 22 bp, Artificial Sequence
  Synthetic oligonucleotide; TTG chr11 5272496 5272517 5272501 5272496 -
tttttgtttttgtttgagatgg

SEQ ID NO: 135611 - DNA, 22 bp, Artificial Sequence
  Synthetic oligonucleotide; TTT chr11 5272493 5272514 5272498 5272493 -
ttgtttttgtttgagatggagt

SEQ ID NO: 135612 - DNA, 22 bp, Artificial Sequence
  Synthetic oligonucleotide; TTT chr11 5272492 5272513 5272497 5272492 -
tgtttttgtttgagatggagtt

SEQ ID NO: 135613 - DNA, 22 bp, Artificial Sequence
  Synthetic oligonucleotide; TTT chr11 5272491 5272512 5272496 5272491 -
gtttttgtttgagatggagttt

SEQ ID NO: 135614 - DNA, 22 bp, Artificial Sequence
  Synthetic oligonucleotide; TTG chr11 5272490 5272511 5272495 5272490 -
tttttgtttgagatggagtttc

SEQ ID NO: 135615 - DNA, 22 bp, Artificial Sequence
  Synthetic oligonucleotide; TTT chr11 5272487 5272508 5272492 5272487 -
ttgtttgagatggagtttcgct

SEQ ID NO: 135616 - DNA, 22 bp, Artificial Sequence
  Synthetic oligonucleotide; TTT chr11 5272486 5272507 5272491 5272486 -
tgtttgagatggagtttcgctc

SEQ ID NO: 135617 - DNA, 22 bp, Artificial Sequence
  Synthetic oligonucleotide; TTT chr11 5272485 5272506 5272490 5272485 -
gtttgagatggagtttcgctct

SEQ ID NO: 135618 - DNA, 22 bp, Artificial Sequence
  Synthetic oligonucleotide; TTG chr11 5272484 5272505 5272489 5272484 -
tttgagatggagtttcgctctt

SEQ ID NO: 135619 - DNA, 22 bp, Artificial Sequence
  Synthetic oligonucleotide; TTT chr11 5272481 5272502 5272486 5272481 -
gagatggagtttcgctcttatt

SEQ ID NO: 135620 - DNA, 22 bp, Artificial Sequence
  Synthetic oligonucleotide; TTG chr11 5272480 5272501 5272485 5272480 -
agatggagtttcgctcttattg

SEQ ID NO: 135621 - DNA, 22 bp, Artificial Sequence
  Synthetic oligonucleotide; TTT chr11 5272469 5272490 5272474 5272469 -
cgctcttattgcccaggctgga

SEQ ID NO: 135622 - DNA, 22 bp, Artificial Sequence
  Synthetic oligonucleotide; TTC chr11 5272468 5272489 5272473 5272468 -
gctcttattgcccaggctggag

SEQ ID NO: 135623 - DNA, 22 bp, Artificial Sequence
  Synthetic oligonucleotide; CTC chr11 5272464 5272485 5272469 5272464 -
ttattgcccaggctggagtgca

SEQ ID NO: 135624 - DNA, 22 bp, Artificial Sequence
  Synthetic oligonucleotide; CTT chr11 5272462 5272483 5272467 5272462 -
attgcccaggctggagtgcagt

SEQ ID NO: 135625 - DNA, 22 bp, Artificial Sequence
  Synthetic oligonucleotide; TTA chr11 5272461 5272482 5272466 5272461 -
ttgcccaggctggagtgcagtg

SEQ ID NO: 135626 - DNA, 22 bp, Artificial Sequence
  Synthetic oligonucleotide; TTG chr11 5272458 5272479 5272463 5272458 -
cccaggctggagtgcagtggca

SEQ ID NO: 135627 - DNA, 22 bp, Artificial Sequence
  Synthetic oligonucleotide; CTG chr11 5272449 5272470 5272454 5272449 -
gagtgcagtggcatgatttcgg

SEQ ID NO: 135628 - DNA, 22 bp, Artificial Sequence
  Synthetic oligonucleotide; TTT chr11 5272430 5272451 5272435 5272430 -
cggctcactgcaacctcccctt

SEQ ID NO: 135629 - DNA, 22 bp, Artificial Sequence
  Synthetic oligonucleotide; TTC chr11 5272429 5272450 5272434 5272429 -
ggctcactgcaacctccccttc

SEQ ID NO: 135630 - DNA, 22 bp, Artificial Sequence
  Synthetic oligonucleotide; CTC chr11 5272424 5272445 5272429 5272424 -
actgcaacctccccttcctgca

SEQ ID NO: 135631 - DNA, 22 bp, Artificial Sequence
  Synthetic oligonucleotide; CTG chr11 5272420 5272441 5272425 5272420 -
caacctccccttcctgcattca

SEQ ID NO: 135632 - DNA, 22 bp, Artificial Sequence
  Synthetic oligonucleotide; CTC chr11 5272413 5272434 5272418 5272413 -
cccttcctgcattcaagcaatt

SEQ ID NO: 135633 - DNA, 22 bp, Artificial Sequence
  Synthetic oligonucleotide; CTT chr11 5272408 5272429 5272413 5272408 -
cctgcattcaagcaattctcct

SEQ ID NO: 135634 - DNA, 22 bp, Artificial Sequence
  Synthetic oligonucleotide; TTC chr11 5272407 5272428 5272412 5272407 -
ctgcattcaagcaattctcctg

SEQ ID NO: 135635 - DNA, 22 bp, Artificial Sequence
  Synthetic oligonucleotide; CTG chr11 5272404 5272425 5272409 5272404 -
cattcaagcaattctcctgcct

SEQ ID NO: 135636 - DNA, 22 bp, Artificial Sequence
  Synthetic oligonucleotide; TTC chr11 5272399 5272420 5272404 5272399 -
aagcaattctcctgccttggcc

SEQ ID NO: 135637 - DNA, 22 bp, Artificial Sequence
  Synthetic oligonucleotide; TTC chr11 5272390 5272411 5272395 5272390 -
tcctgccttggcctcctgagta

SEQ ID NO: 135638 - DNA, 22 bp, Artificial Sequence
  Synthetic oligonucleotide; CTC chr11 5272388 5272409 5272393 5272388 -
ctgccttggcctcctgagtagc

SEQ ID NO: 135639 - DNA, 22 bp, Artificial Sequence
  Synthetic oligonucleotide; CTG chr11 5272385 5272406 5272390 5272385 -
ccttggcctcctgagtagctgg

SEQ ID NO: 135640 - DNA, 22 bp, Artificial Sequence
  Synthetic oligonucleotide; CTT chr11 5272381 5272402 5272386 5272381 -
ggcctcctgagtagctggggat

SEQ ID NO: 135641 - DNA, 22 bp, Artificial Sequence
  Synthetic oligonucleotide; TTG chr11 5272380 5272401 5272385 5272380 -
gcctcctgagtagctggggatt

SEQ ID NO: 135642 - DNA, 22 bp, Artificial Sequence
  Synthetic oligonucleotide; CTC chr11 5272375 5272396 5272380 5272375 -
ctgagtagctggggattacagg

SEQ ID NO: 135643 - DNA, 22 bp, Artificial Sequence
  Synthetic oligonucleotide; CTG chr11 5272372 5272393 5272377 5272372 -
agtagctggggattacaggcac

SEQ ID NO: 135644 - DNA, 22 bp, Artificial Sequence
  Synthetic oligonucleotide; CTG chr11 5272364 5272385 5272369 5272364 -
gggattacaggcacctgccacc

SEQ ID NO: 135645 - DNA, 22 bp, Artificial Sequence
  Synthetic oligonucleotide; TTA chr11 5272357 5272378 5272362 5272357 -
caggcacctgccaccatgccag

SEQ ID NO: 135646 - DNA, 22 bp, Artificial Sequence
  Synthetic oligonucleotide; CTG chr11 5272347 5272368 5272352 5272347 -
ccaccatgccagtctaattttt

SEQ ID NO: 135647 - DNA, 22 bp, Artificial Sequence
  Synthetic oligonucleotide; CTA chr11 5272331 5272352 5272336 5272331 -
atttttgtatttttagtagaga

SEQ ID NO: 135648 - DNA, 22 bp, Artificial Sequence
  Synthetic oligonucleotide; TTT chr11 5272327 5272348 5272332 5272327 -
ttgtatttttagtagagatggg

SEQ ID NO: 135649 - DNA, 22 bp, Artificial Sequence
  Synthetic oligonucleotide; TTT chr11 5272326 5272347 5272331 5272326 -
tgtatttttagtagagatgggg

SEQ ID NO: 135650 - DNA, 22 bp, Artificial Sequence
  Synthetic oligonucleotide; TTT chr11 5272325 5272346 5272330 5272325 -
gtatttttagtagagatggggt

SEQ ID NO: 135651 - DNA, 22 bp, Artificial Sequence
  Synthetic oligonucleotide; TTG chr11 5272324 5272345 5272329 5272324 -
tatttttagtagagatggggtt

SEQ ID NO: 135652 - DNA, 22 bp, Artificial Sequence
  Synthetic oligonucleotide; TTT chr11 5272319 5272340 5272324 5272319 -
ttagtagagatggggtttcgcc

SEQ ID NO: 135653 - DNA, 22 bp, Artificial Sequence
  Synthetic oligonucleotide; TTT chr11 5272318 5272339 5272323 5272318 -
tagtagagatggggtttcgcca

SEQ ID NO: 135654 - DNA, 22 bp, Artificial Sequence
  Synthetic oligonucleotide; TTT chr11 5272317 5272338 5272322 5272317 -
agtagagatggggtttcgccat

SEQ ID NO: 135655 - DNA, 22 bp, Artificial Sequence
  Synthetic oligonucleotide; TTA chr11 5272316 5272337 5272321 5272316 -
gtagagatggggtttcgccatg

SEQ ID NO: 135656 - DNA, 22 bp, Artificial Sequence
  Synthetic oligonucleotide; TTT chr11 5272301 5272322 5272306 5272301 -
cgccatgttggccaggctggtc

SEQ ID NO: 135657 - DNA, 22 bp, Artificial Sequence
  Synthetic oligonucleotide; TTC chr11 5272300 5272321 5272305 5272300 -
gccatgttggccaggctggtct

SEQ ID NO: 135658 - DNA, 22 bp, Artificial Sequence
  Synthetic oligonucleotide; TTG chr11 5272291 5272312 5272296 5272291 -
gccaggctggtcttgaactcct

SEQ ID NO: 135659 - DNA, 22 bp, Artificial Sequence
  Synthetic oligonucleotide; CTG chr11 5272282 5272303 5272287 5272282 -
gtcttgaactcctgacctcaga

SEQ ID NO: 135660 - DNA, 22 bp, Artificial Sequence
  Synthetic oligonucleotide; CTT chr11 5272277 5272298 5272282 5272277 -
gaactcctgacctcagatgatc

SEQ ID NO: 135661 - DNA, 22 bp, Artificial Sequence
  Synthetic oligonucleotide; TTG chr11 5272276 5272297 5272281 5272276 -
aactcctgacctcagatgatct

SEQ ID NO: 135662 - DNA, 22 bp, Artificial Sequence
  Synthetic oligonucleotide; CTC chr11 5272271 5272292 5272276 5272271 -
ctgacctcagatgatctgcccg

SEQ ID NO: 135663 - DNA, 22 bp, Artificial Sequence
  Synthetic oligonucleotide; CTG chr11 5272268 5272289 5272273 5272268 -
acctcagatgatctgcccgcct

SEQ ID NO: 135664 - DNA, 22 bp, Artificial Sequence
  Synthetic oligonucleotide; CTC chr11 5272263 5272284 5272268 5272263 -
agatgatctgcccgccttggcc

SEQ ID NO: 135665 - DNA, 22 bp, Artificial Sequence
  Synthetic oligonucleotide; CTG chr11 5272253 5272274 5272258 5272253 -
cccgccttggcctcctgaagtg

SEQ ID NO: 135666 - DNA, 22 bp, Artificial Sequence
  Synthetic oligonucleotide; CTT chr11 5272245 5272266 5272250 5272245 -
ggcctcctgaagtgctgggatt

SEQ ID NO: 135667 - DNA, 22 bp, Artificial Sequence
  Synthetic oligonucleotide; TTG chr11 5272244 5272265 5272249 5272244 -
gcctcctgaagtgctgggatta

SEQ ID NO: 135668 - DNA, 22 bp, Artificial Sequence
  Synthetic oligonucleotide; CTC chr11 5272239 5272260 5272244 5272239 -
ctgaagtgctgggattataggt

SEQ ID NO: 135669 - DNA, 22 bp, Artificial Sequence
  Synthetic oligonucleotide; CTG chr11 5272236 5272257 5272241 5272236 -
aagtgctgggattataggtgtg

SEQ ID NO: 135670 - DNA, 22 bp, Artificial Sequence
  Synthetic oligonucleotide; CTG chr11 5272228 5272249 5272233 5272228 -
ggattataggtgtgagccacca

SEQ ID NO: 135671 - DNA, 22 bp, Artificial Sequence
  Synthetic oligonucleotide; TTA chr11 5272222 5272243 5272227 5272222 -
taggtgtgagccaccacgcctg

SEQ ID NO: 135672 - DNA, 22 bp, Artificial Sequence
  Synthetic oligonucleotide; CTG chr11 5272200 5272221 5272205 5272200 -
gcccattgcagatatttttaat

SEQ ID NO: 135673 - DNA, 22 bp, Artificial Sequence
  Synthetic oligonucleotide; TTG chr11 5272192 5272213 5272197 5272192 -
cagatatttttaattcacattt

SEQ ID NO: 135674 - DNA, 22 bp, Artificial Sequence
  Synthetic oligonucleotide; TTT chr11 5272183 5272204 5272188 5272183 -
ttaattcacatttatctgcatc

SEQ ID NO: 135675 - DNA, 22 bp, Artificial Sequence
  Synthetic oligonucleotide; TTT chr11 5272182 5272203 5272187 5272182 -
taattcacatttatctgcatca

SEQ ID NO: 135676 - DNA, 22 bp, Artificial Sequence
  Synthetic oligonucleotide; TTT chr11 5272181 5272202 5272186 5272181 -
aattcacatttatctgcatcac

SEQ ID NO: 135677 - DNA, 22 bp, Artificial Sequence
  Synthetic oligonucleotide; TTA chr11 5272180 5272201 5272185 5272180 -
attcacatttatctgcatcact

SEQ ID NO: 135678 - DNA, 22 bp, Artificial Sequence
  Synthetic oligonucleotide; TTC chr11 5272176 5272197 5272181 5272176 -
acatttatctgcatcactactt

SEQ ID NO: 135679 - DNA, 22 bp, Artificial Sequence
  Synthetic oligonucleotide; TTT chr11 5272170 5272191 5272175 5272170 -
atctgcatcactacttggatct

SEQ ID NO: 135680 - DNA, 22 bp, Artificial Sequence
  Synthetic oligonucleotide; TTA chr11 5272169 5272190 5272174 5272169 -
tctgcatcactacttggatctt

SEQ ID NO: 135681 - DNA, 22 bp, Artificial Sequence
  Synthetic oligonucleotide; CTG chr11 5272165 5272186 5272170 5272165 -
catcactacttggatcttaagg

SEQ ID NO: 135682 - DNA, 22 bp, Artificial Sequence
  Synthetic oligonucleotide; CTA chr11 5272157 5272178 5272162 5272157 -
cttggatcttaaggtagctgta

SEQ ID NO: 135683 - DNA, 22 bp, Artificial Sequence
  Synthetic oligonucleotide; CTT chr11 5272154 5272175 5272159 5272154 -
ggatcttaaggtagctgtagac

SEQ ID NO: 135684 - DNA, 22 bp, Artificial Sequence
  Synthetic oligonucleotide; TTG chr11 5272153 5272174 5272158 5272153 -
gatcttaaggtagctgtagacc

SEQ ID NO: 135685 - DNA, 22 bp, Artificial Sequence
  Synthetic oligonucleotide; CTT chr11 5272147 5272168 5272152 5272147 -
aaggtagctgtagacccaatcc

SEQ ID NO: 135686 - DNA, 22 bp, Artificial Sequence
  Synthetic oligonucleotide; TTA chr11 5272146 5272167 5272151 5272146 -
aggtagctgtagacccaatcct

SEQ ID NO: 135687 - DNA, 22 bp, Artificial Sequence
  Synthetic oligonucleotide; CTG chr11 5272137 5272158 5272142 5272137 -
tagacccaatcctagatctaat

SEQ ID NO: 135688 - DNA, 22 bp, Artificial Sequence
  Synthetic oligonucleotide; CTA chr11 5272123 5272144 5272128 5272123 -
gatctaatgctttcataaagaa

SEQ ID NO: 135689 - DNA, 22 bp, Artificial Sequence
  Synthetic oligonucleotide; CTA chr11 5272117 5272138 5272122 5272117 -
atgctttcataaagaagcaaat

SEQ ID NO: 135690 - DNA, 22 bp, Artificial Sequence
  Synthetic oligonucleotide; CTT chr11 5272111 5272132 5272116 5272111 -
tcataaagaagcaaatataata

SEQ ID NO: 135691 - DNA, 22 bp, Artificial Sequence
  Synthetic oligonucleotide; TTT chr11 5272110 5272131 5272115 5272110 -
cataaagaagcaaatataataa

SEQ ID NO: 135692 - DNA, 22 bp, Artificial Sequence
  Synthetic oligonucleotide; TTC chr11 5272109 5272130 5272114 5272109 -
ataaagaagcaaatataataaa

SEQ ID NO: 135693 - DNA, 22 bp, Artificial Sequence
  Synthetic oligonucleotide; CTA chr11 5272082 5272103 5272087 5272082 -
taccacaaatgtaatgtttgat

SEQ ID NO: 135694 - DNA, 22 bp, Artificial Sequence
  Synthetic oligonucleotide; TTT chr11 5272063 5272084 5272068 5272063 -
gatgtctgataatgatatttca

SEQ ID NO: 135695 - DNA, 22 bp, Artificial Sequence
  Synthetic oligonucleotide; TTG chr11 5272062 5272083 5272067 5272062 -
atgtctgataatgatatttcag

SEQ ID NO: 135696 - DNA, 22 bp, Artificial Sequence
  Synthetic oligonucleotide; CTG chr11 5272055 5272076 5272060 5272055 -
ataatgatatttcagtgtaatt

SEQ ID NO: 135697 - DNA, 22 bp, Artificial Sequence
  Synthetic oligonucleotide; TTT chr11 5272043 5272064 5272048 5272043 -
cagtgtaattaaacttagcact

SEQ ID NO: 135698 - DNA, 22 bp, Artificial Sequence
  Synthetic oligonucleotide; TTC chr11 5272042 5272063 5272047 5272042 -
agtgtaattaaacttagcactc

SEQ ID NO: 135699 - DNA, 22 bp, Artificial Sequence
  Synthetic oligonucleotide; TTA chr11 5272032 5272053 5272037 5272032 -
aacttagcactcctatgtatat

SEQ ID NO: 135700 - DNA, 22 bp, Artificial Sequence
  Synthetic oligonucleotide; CTT chr11 5272027 5272048 5272032 5272027 -
agcactcctatgtatattattt

SEQ ID NO: 135701 - DNA, 22 bp, Artificial Sequence
  Synthetic oligonucleotide; TTA chr11 5272026 5272047 5272031 5272026 -
gcactcctatgtatattatttg

SEQ ID NO: 135702 - DNA, 22 bp, Artificial Sequence
  Synthetic oligonucleotide; CTC chr11 5272020 5272041 5272025 5272020 -
ctatgtatattatttgatgcaa

SEQ ID NO: 135703 - DNA, 22 bp, Artificial Sequence
  Synthetic oligonucleotide; CTA chr11 5272017 5272038 5272022 5272017 -
tgtatattatttgatgcaataa

SEQ ID NO: 135704 - DNA, 22 bp, Artificial Sequence
  Synthetic oligonucleotide; TTA chr11 5272008 5272029 5272013 5272008 -
tttgatgcaataaaaacatatt

SEQ ID NO: 135705 - DNA, 22 bp, Artificial Sequence
  Synthetic oligonucleotide; TTT chr11 5272005 5272026 5272010 5272005 -
gatgcaataaaaacatattttt

SEQ ID NO: 135706 - DNA, 22 bp, Artificial Sequence
  Synthetic oligonucleotide; TTG chr11 5272004 5272025 5272009 5272004 -
atgcaataaaaacatatttttt

SEQ ID NO: 135707 - DNA, 22 bp, Artificial Sequence
  Synthetic oligonucleotide; TTT chr11 5271985 5272006 5271990 5271985 -
ttttagcacttacagtctgcca

SEQ ID NO: 135708 - DNA, 22 bp, Artificial Sequence
  Synthetic oligonucleotide; TTT chr11 5271984 5272005 5271989 5271984 -
tttagcacttacagtctgccaa

SEQ ID NO: 135709 - DNA, 22 bp, Artificial Sequence
  Synthetic oligonucleotide; TTT chr11 5271983 5272004 5271988 5271983 -
ttagcacttacagtctgccaaa

SEQ ID NO: 135710 - DNA, 22 bp, Artificial Sequence
  Synthetic oligonucleotide; TTT chr11 5271982 5272003 5271987 5271982 -
tagcacttacagtctgccaaac

SEQ ID NO: 135711 - DNA, 22 bp, Artificial Sequence
  Synthetic oligonucleotide; TTT chr11 5271981 5272002 5271986 5271981 -
agcacttacagtctgccaaact

SEQ ID NO: 135712 - DNA, 22 bp, Artificial Sequence
  Synthetic oligonucleotide; TTA chr11 5271980 5272001 5271985 5271980 -
gcacttacagtctgccaaactg

SEQ ID NO: 135713 - DNA, 22 bp, Artificial Sequence
  Synthetic oligonucleotide; CTT chr11 5271974 5271995 5271979 5271974 -
acagtctgccaaactggcctgt

SEQ ID NO: 135714 - DNA, 22 bp, Artificial Sequence
  Synthetic oligonucleotide; TTA chr11 5271973 5271994 5271978 5271973 -
cagtctgccaaactggcctgtg

SEQ ID NO: 135715 - DNA, 22 bp, Artificial Sequence
  Synthetic oligonucleotide; CTG chr11 5271966 5271987 5271971 5271966 -
ccaaactggcctgtgacacaaa

SEQ ID NO: 135716 - DNA, 22 bp, Artificial Sequence
  Synthetic oligonucleotide; CTG chr11 5271958 5271979 5271963 5271958 -
gcctgtgacacaaaaaaagttt

SEQ ID NO: 135717 - DNA, 22 bp, Artificial Sequence
  Synthetic oligonucleotide; CTG chr11 5271953 5271974 5271958 5271953 -
tgacacaaaaaaagtttaggaa

SEQ ID NO: 135718 - DNA, 22 bp, Artificial Sequence
  Synthetic oligonucleotide; TTT chr11 5271936 5271957 5271941 5271936 -
aggaattcctggttttgtctgt

SEQ ID NO: 135719 - DNA, 22 bp, Artificial Sequence
  Synthetic oligonucleotide; TTA chr11 5271935 5271956 5271940 5271935 -
ggaattcctggttttgtctgtg

SEQ ID NO: 135720 - DNA, 22 bp, Artificial Sequence
  Synthetic oligonucleotide; TTC chr11 5271928 5271949 5271933 5271928 -
ctggttttgtctgtgttagcca

SEQ ID NO: 135721 - DNA, 22 bp, Artificial Sequence
  Synthetic oligonucleotide; CTG chr11 5271925 5271946 5271930 5271925 -
gttttgtctgtgttagccaatg

SEQ ID NO: 135722 - DNA, 22 bp, Artificial Sequence
  Synthetic oligonucleotide; TTT chr11 5271921 5271942 5271926 5271921 -
tgtctgtgttagccaatggtta

SEQ ID NO: 135723 - DNA, 22 bp, Artificial Sequence
  Synthetic oligonucleotide; TTT chr11 5271920 5271941 5271925 5271920 -
gtctgtgttagccaatggttag

SEQ ID NO: 135724 - DNA, 22 bp, Artificial Sequence
  Synthetic oligonucleotide; TTG chr11 5271919 5271940 5271924 5271919 -
tctgtgttagccaatggttaga

SEQ ID NO: 135725 - DNA, 22 bp, Artificial Sequence
  Synthetic oligonucleotide; CTG chr11 5271915 5271936 5271920 5271915 -
tgttagccaatggttagaatat

SEQ ID NO: 135726 - DNA, 22 bp, Artificial Sequence
  Synthetic oligonucleotide; TTA chr11 5271910 5271931 5271915 5271910 -
gccaatggttagaatatatgct

SEQ ID NO: 135727 - DNA, 22 bp, Artificial Sequence
  Synthetic oligonucleotide; TTA chr11 5271899 5271920 5271904 5271899 -
gaatatatgctcagaaagatac

SEQ ID NO: 135728 - DNA, 22 bp, Artificial Sequence
  Synthetic oligonucleotide; CTC chr11 5271887 5271908 5271892 5271887 -
agaaagataccattggttaata

SEQ ID NO: 135729 - DNA, 22 bp, Artificial Sequence
  Synthetic oligonucleotide; TTG chr11 5271872 5271893 5271877 5271872 -
gttaatagctaaaagaaaatgg

SEQ ID NO: 135730 - DNA, 22 bp, Artificial Sequence
  Synthetic oligonucleotide; TTA chr11 5271868 5271889 5271873 5271868 -
atagctaaaagaaaatggagta

SEQ ID NO: 135731 - DNA, 22 bp, Artificial Sequence
  Synthetic oligonucleotide; CTA chr11 5271861 5271882 5271866 5271861 -
aaagaaaatggagtagaaattc

SEQ ID NO: 135732 - DNA, 22 bp, Artificial Sequence
  Synthetic oligonucleotide; TTC chr11 5271839 5271860 5271844 5271839 -
agtggcctggaataataacaat

SEQ ID NO: 135733 - DNA, 22 bp, Artificial Sequence
  Synthetic oligonucleotide; CTG chr11 5271830 5271851 5271835 5271830 -
gaataataacaatttgggcagt

SEQ ID NO: 135734 - DNA, 22 bp, Artificial Sequence
  Synthetic oligonucleotide; TTT chr11 5271815 5271836 5271820 5271815 -
gggcagtcattaagtcaggtga

SEQ ID NO: 135735 - DNA, 22 bp, Artificial Sequence
  Synthetic oligonucleotide; TTG chr11 5271814 5271835 5271819 5271814 -
ggcagtcattaagtcaggtgaa

SEQ ID NO: 135736 - DNA, 22 bp, Artificial Sequence
  Synthetic oligonucleotide; TTA chr11 5271803 5271824 5271808 5271803 -
agtcaggtgaagacttctggaa

SEQ ID NO: 135737 - DNA, 22 bp, Artificial Sequence
  Synthetic oligonucleotide; CTT chr11 5271787 5271808 5271792 5271787 -
ctggaatcatgggagaaaagca

SEQ ID NO: 135738 - DNA, 22 bp, Artificial Sequence
  Synthetic oligonucleotide; TTC chr11 5271786 5271807 5271791 5271786 -
tggaatcatgggagaaaagcaa

SEQ ID NO: 135739 - DNA, 22 bp, Artificial Sequence
  Synthetic oligonucleotide; CTG chr11 5271784 5271805 5271789 5271784 -
gaatcatgggagaaaagcaagg

SEQ ID NO: 135740 - DNA, 22 bp, Artificial Sequence
  Synthetic oligonucleotide; TTC chr11 5271753 5271774 5271758 5271753 -
ttacttgccacaagtgtttttt

SEQ ID NO: 135741 - DNA, 22 bp, Artificial Sequence
  Synthetic oligonucleotide; CTT chr11 5271751 5271772 5271756 5271751 -
acttgccacaagtgtttttttt

SEQ ID NO: 135742 - DNA, 22 bp, Artificial Sequence
  Synthetic oligonucleotide; TTA chr11 5271750 5271771 5271755 5271750 -
cttgccacaagtgttttttttt

SEQ ID NO: 135743 - DNA, 22 bp, Artificial Sequence
  Synthetic oligonucleotide; CTT chr11 5271747 5271768 5271752 5271747 -
gccacaagtgtttttttttttt

SEQ ID NO: 135744 - DNA, 22 bp, Artificial Sequence
  Synthetic oligonucleotide; TTG chr11 5271746 5271767 5271751 5271746 -
ccacaagtgttttttttttttt

SEQ ID NO: 135745 - DNA, 22 bp, Artificial Sequence
  Synthetic oligonucleotide; TTT chr11 5271734 5271755 5271739 5271734 -
ttttttttttttttttttatca

SEQ ID NO: 135746 - DNA, 22 bp, Artificial Sequence
  Synthetic oligonucleotide; TTT chr11 5271733 5271754 5271738 5271733 -
tttttttttttttttttatcac

SEQ ID NO: 135747 - DNA, 22 bp, Artificial Sequence
  Synthetic oligonucleotide; TTT chr11 5271732 5271753 5271737 5271732 -
ttttttttttttttttatcaca

SEQ ID NO: 135748 - DNA, 22 bp, Artificial Sequence
  Synthetic oligonucleotide; TTT chr11 5271731 5271752 5271736 5271731 -
tttttttttttttttatcacaa

SEQ ID NO: 135749 - DNA, 22 bp, Artificial Sequence
  Synthetic oligonucleotide; TTT chr11 5271730 5271751 5271735 5271730 -
ttttttttttttttatcacaaa

SEQ ID NO: 135750 - DNA, 22 bp, Artificial Sequence
  Synthetic oligonucleotide; TTT chr11 5271729 5271750 5271734 5271729 -
tttttttttttttatcacaaac

SEQ ID NO: 135751 - DNA, 22 bp, Artificial Sequence
  Synthetic oligonucleotide; TTT chr11 5271728 5271749 5271733 5271728 -
ttttttttttttatcacaaaca

SEQ ID NO: 135752 - DNA, 22 bp, Artificial Sequence
  Synthetic oligonucleotide; TTT chr11 5271727 5271748 5271732 5271727 -
tttttttttttatcacaaacat

SEQ ID NO: 135753 - DNA, 22 bp, Artificial Sequence
  Synthetic oligonucleotide; TTT chr11 5271726 5271747 5271731 5271726 -
ttttttttttatcacaaacata

SEQ ID NO: 135754 - DNA, 22 bp, Artificial Sequence
  Synthetic oligonucleotide; TTT chr11 5271725 5271746 5271730 5271725 -
tttttttttatcacaaacataa

SEQ ID NO: 135755 - DNA, 22 bp, Artificial Sequence
  Synthetic oligonucleotide; TTT chr11 5271724 5271745 5271729 5271724 -
ttttttttatcacaaacataag

SEQ ID NO: 135756 - DNA, 22 bp, Artificial Sequence
  Synthetic oligonucleotide; TTT chr11 5271723 5271744 5271728 5271723 -
tttttttatcacaaacataaga

SEQ ID NO: 135757 - DNA, 22 bp, Artificial Sequence
  Synthetic oligonucleotide; TTT chr11 5271722 5271743 5271727 5271722 -
ttttttatcacaaacataagaa

SEQ ID NO: 135758 - DNA, 22 bp, Artificial Sequence
  Synthetic oligonucleotide; TTT chr11 5271721 5271742 5271726 5271721 -
tttttatcacaaacataagaaa

SEQ ID NO: 135759 - DNA, 22 bp, Artificial Sequence
  Synthetic oligonucleotide; TTT chr11 5271720 5271741 5271725 5271720 -
ttttatcacaaacataagaaaa

SEQ ID NO: 135760 - DNA, 22 bp, Artificial Sequence
  Synthetic oligonucleotide; TTT chr11 5271719 5271740 5271724 5271719 -
tttatcacaaacataagaaaat

SEQ ID NO: 135761 - DNA, 22 bp, Artificial Sequence
  Synthetic oligonucleotide; TTT chr11 5271718 5271739 5271723 5271718 -
ttatcacaaacataagaaaata

SEQ ID NO: 135762 - DNA, 22 bp, Artificial Sequence
  Synthetic oligonucleotide; TTT chr11 5271717 5271738 5271722 5271717 -
tatcacaaacataagaaaatat

SEQ ID NO: 135763 - DNA, 22 bp, Artificial Sequence
  Synthetic oligonucleotide; TTT chr11 5271716 5271737 5271721 5271716 -
atcacaaacataagaaaatata

SEQ ID NO: 135764 - DNA, 22 bp, Artificial Sequence
  Synthetic oligonucleotide; TTA chr11 5271715 5271736 5271720 5271715 -
tcacaaacataagaaaatataa

SEQ ID NO: 135765 - DNA, 22 bp, Artificial Sequence
  Synthetic oligonucleotide; TTA chr11 5271673 5271694 5271678 5271673 -
tagaagagagaaacgctcttag

SEQ ID NO: 135766 - DNA, 22 bp, Artificial Sequence
  Synthetic oligonucleotide; CTC chr11 5271655 5271676 5271660 5271655 -
ttagtaaacttggaatatggaa

SEQ ID NO: 135767 - DNA, 22 bp, Artificial Sequence
  Synthetic oligonucleotide; CTT chr11 5271653 5271674 5271658 5271653 -
agtaaacttggaatatggaatc

SEQ ID NO: 135768 - DNA, 22 bp, Artificial Sequence
  Synthetic oligonucleotide; TTA chr11 5271652 5271673 5271657 5271652 -
gtaaacttggaatatggaatcc

SEQ ID NO: 135769 - DNA, 22 bp, Artificial Sequence
  Synthetic oligonucleotide; CTT chr11 5271644 5271665 5271649 5271644 -
ggaatatggaatccccaaaggc

SEQ ID NO: 135770 - DNA, 22 bp, Artificial Sequence
  Synthetic oligonucleotide; TTG chr11 5271643 5271664 5271648 5271643 -
gaatatggaatccccaaaggca

SEQ ID NO: 135771 - DNA, 22 bp, Artificial Sequence
  Synthetic oligonucleotide; CTT chr11 5271618 5271639 5271623 5271618 -
gacttgggagacaggagccata

SEQ ID NO: 135772 - DNA, 22 bp, Artificial Sequence
  Synthetic oligonucleotide; TTG chr11 5271617 5271638 5271622 5271617 -
acttgggagacaggagccatac

SEQ ID NO: 135773 - DNA, 22 bp, Artificial Sequence
  Synthetic oligonucleotide; CTT chr11 5271613 5271634 5271618 5271613 -
gggagacaggagccatactgct

SEQ ID NO: 135774 - DNA, 22 bp, Artificial Sequence
  Synthetic oligonucleotide; TTG chr11 5271612 5271633 5271617 5271612 -
ggagacaggagccatactgcta

SEQ ID NO: 135775 - DNA, 22 bp, Artificial Sequence
  Synthetic oligonucleotide; CTG chr11 5271593 5271614 5271598 5271593 -
ctaagtgaaaaagacgaagaac

SEQ ID NO: 135776 - DNA, 22 bp, Artificial Sequence
  Synthetic oligonucleotide; CTA chr11 5271590 5271611 5271595 5271590 -
agtgaaaaagacgaagaacctc

SEQ ID NO: 135777 - DNA, 22 bp, Artificial Sequence
  Synthetic oligonucleotide; CTC chr11 5271568 5271589 5271573 5271568 -
tagggcctgaacatacaggaaa

SEQ ID NO: 135778 - DNA, 22 bp, Artificial Sequence
  Synthetic oligonucleotide; CTA chr11 5271566 5271587 5271571 5271566 -
gggcctgaacatacaggaaatt

SEQ ID NO: 135779 - DNA, 22 bp, Artificial Sequence
  Synthetic oligonucleotide; CTG chr11 5271559 5271580 5271564 5271559 -
aacatacaggaaattgtaggaa

SEQ ID NO: 135780 - DNA, 22 bp, Artificial Sequence
  Synthetic oligonucleotide; TTG chr11 5271543 5271564 5271548 5271543 -
taggaacagaaattcctagatc

SEQ ID NO: 135781 - DNA, 22 bp, Artificial Sequence
  Synthetic oligonucleotide; TTC chr11 5271528 5271549 5271533 5271528 -
ctagatctggtggggcaagggg

SEQ ID NO: 135782 - DNA, 22 bp, Artificial Sequence
  Synthetic oligonucleotide; CTA chr11 5271525 5271546 5271530 5271525 -
gatctggtggggcaaggggagc

SEQ ID NO: 135783 - DNA, 22 bp, Artificial Sequence
  Synthetic oligonucleotide; CTG chr11 5271519 5271540 5271524 5271519 -
gtggggcaaggggagccatagg

SEQ ID NO: 135784 - DNA, 22 bp, Artificial Sequence
  Synthetic oligonucleotide; CTG chr11 5271419 5271440 5271424 5271419 -
gcaaacatggtgaaatcccgtc

SEQ ID NO: 135785 - DNA, 22 bp, Artificial Sequence
  Synthetic oligonucleotide; CTC chr11 5271395 5271416 5271400 5271395 -
tactaaaaataaaaaaattagc

SEQ ID NO: 135786 - DNA, 22 bp, Artificial Sequence
  Synthetic oligonucleotide; CTA chr11 5271393 5271414 5271398 5271393 -
ctaaaaataaaaaaattagctg

SEQ ID NO: 135787 - DNA, 22 bp, Artificial Sequence
  Synthetic oligonucleotide; CTA chr11 5271390 5271411 5271395 5271390 -
aaaataaaaaaattagctgggc

SEQ ID NO: 135788 - DNA, 22 bp, Artificial Sequence
  Synthetic oligonucleotide; TTA chr11 5271375 5271396 5271380 5271375 -
gctgggcatggtggcatgcgcc

SEQ ID NO: 135789 - DNA, 22 bp, Artificial Sequence
  Synthetic oligonucleotide; CTG chr11 5271371 5271392 5271376 5271371 -
ggcatggtggcatgcgcctgta

SEQ ID NO: 135790 - DNA, 22 bp, Artificial Sequence
  Synthetic oligonucleotide; CTG chr11 5271351 5271372 5271356 5271351 -
tagtcccagctgctcgggaggc

SEQ ID NO: 135791 - DNA, 22 bp, Artificial Sequence
  Synthetic oligonucleotide; CTG chr11 5271339 5271360 5271344 5271339 -
ctcgggaggctgaggcaggaga

SEQ ID NO: 135792 - DNA, 22 bp, Artificial Sequence
  Synthetic oligonucleotide; CTC chr11 5271336 5271357 5271341 5271336 -
gggaggctgaggcaggagaatc

SEQ ID NO: 135793 - DNA, 22 bp, Artificial Sequence
  Synthetic oligonucleotide; CTG chr11 5271327 5271348 5271332 5271327 -
aggcaggagaatcgtttgaacc

SEQ ID NO: 135794 - DNA, 22 bp, Artificial Sequence
  Synthetic oligonucleotide; TTT chr11 5271310 5271331 5271315 5271310 -
gaacccaggaggcgaaggttgc

SEQ ID NO: 135795 - DNA, 22 bp, Artificial Sequence
  Synthetic oligonucleotide; TTG chr11 5271309 5271330 5271314 5271309 -
aacccaggaggcgaaggttgca

SEQ ID NO: 135796 - DNA, 22 bp, Artificial Sequence
  Synthetic oligonucleotide; TTG chr11 5271289 5271310 5271294 5271289 -
cagtgagctgagatagtgccat

SEQ ID NO: 135797 - DNA, 22 bp, Artificial Sequence
  Synthetic oligonucleotide; CTG chr11 5271279 5271300 5271284 5271279 -
agatagtgccattgcactccag

SEQ ID NO: 135798 - DNA, 22 bp, Artificial Sequence
  Synthetic oligonucleotide; TTG chr11 5271265 5271286 5271270 5271265 -
cactccagtctggcaacagagt

SEQ ID NO: 135799 - DNA, 22 bp, Artificial Sequence
  Synthetic oligonucleotide; CTC chr11 5271260 5271281 5271265 5271260 -
cagtctggcaacagagtgagac

SEQ ID NO: 135800 - DNA, 22 bp, Artificial Sequence
  Synthetic oligonucleotide; CTG chr11 5271253 5271274 5271258 5271253 -
gcaacagagtgagactccgtct

SEQ ID NO: 135801 - DNA, 22 bp, Artificial Sequence
  Synthetic oligonucleotide; CTC chr11 5271236 5271257 5271241 5271236 -
cgtctcaaaaaaaaaaaaaaaa

SEQ ID NO: 135802 - DNA, 22 bp, Artificial Sequence
  Synthetic oligonucleotide; CTC chr11 5271230 5271251 5271235 5271230 -
aaaaaaaaaaaaaaaagaaaga

SEQ ID NO: 135803 - DNA, 22 bp, Artificial Sequence
  Synthetic oligonucleotide; CTG chr11 5271146 5271167 5271151 5271146 -
ggctggggcaatgagattatgg

SEQ ID NO: 135804 - DNA, 22 bp, Artificial Sequence
  Synthetic oligonucleotide; CTG chr11 5271141 5271162 5271146 5271141 -
gggcaatgagattatggtgatg

SEQ ID NO: 135805 - DNA, 22 bp, Artificial Sequence
  Synthetic oligonucleotide; TTA chr11 5271127 5271148 5271132 5271127 -
tggtgatgtaagggacttttat

SEQ ID NO: 135806 - DNA, 22 bp, Artificial Sequence
  Synthetic oligonucleotide; CTT chr11 5271109 5271130 5271114 5271109 -
ttatagaattaacaatgctgga

SEQ ID NO: 135807 - DNA, 22 bp, Artificial Sequence
  Synthetic oligonucleotide; TTT chr11 5271108 5271129 5271113 5271108 -
tatagaattaacaatgctggaa

SEQ ID NO: 135808 - DNA, 22 bp, Artificial Sequence
  Synthetic oligonucleotide; TTT chr11 5271107 5271128 5271112 5271107 -
atagaattaacaatgctggaat

SEQ ID NO: 135809 - DNA, 22 bp, Artificial Sequence
  Synthetic oligonucleotide; TTA chr11 5271106 5271127 5271111 5271106 -
tagaattaacaatgctggaatt

SEQ ID NO: 135810 - DNA, 22 bp, Artificial Sequence
  Synthetic oligonucleotide; TTA chr11 5271098 5271119 5271103 5271098 -
acaatgctggaatttgtggaac

SEQ ID NO: 135811 - DNA, 22 bp, Artificial Sequence
  Synthetic oligonucleotide; CTG chr11 5271089 5271110 5271094 5271089 -
gaatttgtggaactctgcttct

SEQ ID NO: 135812 - DNA, 22 bp, Artificial Sequence
  Synthetic oligonucleotide; TTT chr11 5271083 5271104 5271088 5271083 -
gtggaactctgcttctattatt

SEQ ID NO: 135813 - DNA, 22 bp, Artificial Sequence
  Synthetic oligonucleotide; TTG chr11 5271082 5271103 5271087 5271082 -
tggaactctgcttctattattc

SEQ ID NO: 135814 - DNA, 22 bp, Artificial Sequence
  Synthetic oligonucleotide; CTC chr11 5271074 5271095 5271079 5271074 -
tgcttctattattcccccaatc

SEQ ID NO: 135815 - DNA, 22 bp, Artificial Sequence
  Synthetic oligonucleotide; CTG chr11 5271072 5271093 5271077 5271072 -
cttctattattcccccaatcat

SEQ ID NO: 135816 - DNA, 22 bp, Artificial Sequence
  Synthetic oligonucleotide; CTT chr11 5271069 5271090 5271074 5271069 -
ctattattcccccaatcattac

SEQ ID NO: 135817 - DNA, 22 bp, Artificial Sequence
  Synthetic oligonucleotide; TTC chr11 5271068 5271089 5271073 5271068 -
tattattcccccaatcattact

SEQ ID NO: 135818 - DNA, 22 bp, Artificial Sequence
  Synthetic oligonucleotide; CTA chr11 5271066 5271087 5271071 5271066 -
ttattcccccaatcattacttc

SEQ ID NO: 135819 - DNA, 22 bp, Artificial Sequence
  Synthetic oligonucleotide; TTA chr11 5271063 5271084 5271068 5271063 -
ttcccccaatcattacttctgt

SEQ ID NO: 135820 - DNA, 22 bp, Artificial Sequence
  Synthetic oligonucleotide; TTC chr11 5271060 5271081 5271065 5271060 -
ccccaatcattacttctgtcac

SEQ ID NO: 135821 - DNA, 22 bp, Artificial Sequence
  Synthetic oligonucleotide; TTA chr11 5271048 5271069 5271053 5271048 -
cttctgtcacattgatagttaa

SEQ ID NO: 135822 - DNA, 22 bp, Artificial Sequence
  Synthetic oligonucleotide; CTT chr11 5271045 5271066 5271050 5271045 -
ctgtcacattgatagttaaata

SEQ ID NO: 135823 - DNA, 22 bp, Artificial Sequence
  Synthetic oligonucleotide; TTC chr11 5271044 5271065 5271049 5271044 -
tgtcacattgatagttaaataa

SEQ ID NO: 135824 - DNA, 22 bp, Artificial Sequence
  Synthetic oligonucleotide; CTG chr11 5271042 5271063 5271047 5271042 -
tcacattgatagttaaataatt

SEQ ID NO: 135825 - DNA, 22 bp, Artificial Sequence
  Synthetic oligonucleotide; TTG chr11 5271034 5271055 5271039 5271034 -
atagttaaataatttctgtgaa

SEQ ID NO: 135826 - DNA, 22 bp, Artificial Sequence
  Synthetic oligonucleotide; TTA chr11 5271027 5271048 5271032 5271027 -
aataatttctgtgaatttattc

SEQ ID NO: 135827 - DNA, 22 bp, Artificial Sequence
  Synthetic oligonucleotide; TTT chr11 5271019 5271040 5271024 5271019 -
ctgtgaatttattccttgattc

SEQ ID NO: 135828 - DNA, 22 bp, Artificial Sequence
  Synthetic oligonucleotide; TTC chr11 5271018 5271039 5271023 5271018 -
tgtgaatttattccttgattct

SEQ ID NO: 135829 - DNA, 22 bp, Artificial Sequence
  Synthetic oligonucleotide; CTG chr11 5271016 5271037 5271021 5271016 -
tgaatttattccttgattctaa

SEQ ID NO: 135830 - DNA, 22 bp, Artificial Sequence
  Synthetic oligonucleotide; TTT chr11 5271009 5271030 5271014 5271009 -
attccttgattctaaaatatga

SEQ ID NO: 135831 - DNA, 22 bp, Artificial Sequence
  Synthetic oligonucleotide; TTA chr11 5271008 5271029 5271013 5271008 -
ttccttgattctaaaatatgag

SEQ ID NO: 135832 - DNA, 22 bp, Artificial Sequence
  Synthetic oligonucleotide; TTC chr11 5271005 5271026 5271010 5271005 -
cttgattctaaaatatgaggat

SEQ ID NO: 135833 - DNA, 22 bp, Artificial Sequence
  Synthetic oligonucleotide; CTT chr11 5271002 5271023 5271007 5271002 -
gattctaaaatatgaggataat

SEQ ID NO: 135834 - DNA, 22 bp, Artificial Sequence
  Synthetic oligonucleotide; TTG chr11 5271001 5271022 5271006 5271001 -
attctaaaatatgaggataatg

SEQ ID NO: 135835 - DNA, 22 bp, Artificial Sequence
  Synthetic oligonucleotide; TTC chr11 5270997 5271018 5271002 5270997 -
taaaatatgaggataatgacaa

SEQ ID NO: 135836 - DNA, 22 bp, Artificial Sequence
  Synthetic oligonucleotide; CTA chr11 5270995 5271016 5271000 5270995 -
aaatatgaggataatgacaatg

SEQ ID NO: 135837 - DNA, 22 bp, Artificial Sequence
  Synthetic oligonucleotide; TTA chr11 5270967 5270988 5270972 5270967 -
taagggcagattaagtgatata

SEQ ID NO: 135838 - DNA, 22 bp, Artificial Sequence
  Synthetic oligonucleotide; TTA chr11 5270954 5270975 5270959 5270954 -
agtgatatagcatgagcaatat

SEQ ID NO: 135839 - DNA, 22 bp, Artificial Sequence
  Synthetic oligonucleotide; TTC chr11 5270930 5270951 5270935 5270930 -
ttcaggcacatggatcgaattg

SEQ ID NO: 135840 - DNA, 22 bp, Artificial Sequence
  Synthetic oligonucleotide; CTT chr11 5270928 5270949 5270933 5270928 -
caggcacatggatcgaattgaa

SEQ ID NO: 135841 - DNA, 22 bp, Artificial Sequence
  Synthetic oligonucleotide; TTC chr11 5270927 5270948 5270932 5270927 -
aggcacatggatcgaattgaat

SEQ ID NO: 135842 - DNA, 22 bp, Artificial Sequence
  Synthetic oligonucleotide; TTG chr11 5270908 5270929 5270913 5270908 -
aatacactgtaaatcccaactt

SEQ ID NO: 135843 - DNA, 22 bp, Artificial Sequence
  Synthetic oligonucleotide; CTG chr11 5270899 5270920 5270904 5270899 -
taaatcccaacttccagtttca

SEQ ID NO: 135844 - DNA, 22 bp, Artificial Sequence
  Synthetic oligonucleotide; CTT chr11 5270886 5270907 5270891 5270886 -
ccagtttcagctctaccaagta

SEQ ID NO: 135845 - DNA, 22 bp, Artificial Sequence
  Synthetic oligonucleotide; TTC chr11 5270885 5270906 5270890 5270885 -
cagtttcagctctaccaagtaa

SEQ ID NO: 135846 - DNA, 22 bp, Artificial Sequence
  Synthetic oligonucleotide; TTT chr11 5270879 5270900 5270884 5270879 -
cagctctaccaagtaaagagct

SEQ ID NO: 135847 - DNA, 22 bp, Artificial Sequence
  Synthetic oligonucleotide; TTC chr11 5270878 5270899 5270883 5270878 -
agctctaccaagtaaagagcta

SEQ ID NO: 135848 - DNA, 22 bp, Artificial Sequence
  Synthetic oligonucleotide; CTC chr11 5270873 5270894 5270878 5270873 -
taccaagtaaagagctagcaag

SEQ ID NO: 135849 - DNA, 22 bp, Artificial Sequence
  Synthetic oligonucleotide; CTA chr11 5270871 5270892 5270876 5270871 -
ccaagtaaagagctagcaagtc

SEQ ID NO: 135850 - DNA, 22 bp, Artificial Sequence
  Synthetic oligonucleotide; CTA chr11 5270856 5270877 5270861 5270856 -
gcaagtcatcaaaatggggaca

SEQ ID NO: 135851 - DNA, 22 bp, Artificial Sequence
  Synthetic oligonucleotide; CTA chr11 5270811 5270832 5270816 5270811 -
gaggaataatataccctgactc

SEQ ID NO: 135852 - DNA, 22 bp, Artificial Sequence
  Synthetic oligonucleotide; CTG chr11 5270793 5270814 5270798 5270793 -
actcctagcctgattaatatat

SEQ ID NO: 135853 - DNA, 22 bp, Artificial Sequence
  Synthetic oligonucleotide; CTC chr11 5270789 5270810 5270794 5270789 -
ctagcctgattaatatatcgat

SEQ ID NO: 135854 - DNA, 22 bp, Artificial Sequence
  Synthetic oligonucleotide; CTA chr11 5270786 5270807 5270791 5270786 -
gcctgattaatatatcgattca

SEQ ID NO: 135855 - DNA, 22 bp, Artificial Sequence
  Synthetic oligonucleotide; CTG chr11 5270781 5270802 5270786 5270781 -
attaatatatcgattcactttt

SEQ ID NO: 135856 - DNA, 22 bp, Artificial Sequence
  Synthetic oligonucleotide; TTA chr11 5270777 5270798 5270782 5270777 -
atatatcgattcacttttttct

SEQ ID NO: 135857 - DNA, 22 bp, Artificial Sequence
  Synthetic oligonucleotide; TTC chr11 5270765 5270786 5270770 5270765 -
acttttttctctgtttgatgac

SEQ ID NO: 135858 - DNA, 22 bp, Artificial Sequence
  Synthetic oligonucleotide; CTT chr11 5270761 5270782 5270766 5270761 -
ttttctctgtttgatgacaaat

SEQ ID NO: 135859 - DNA, 22 bp, Artificial Sequence
  Synthetic oligonucleotide; TTT chr11 5270760 5270781 5270765 5270760 -
tttctctgtttgatgacaaatt

SEQ ID NO: 135860 - DNA, 22 bp, Artificial Sequence
  Synthetic oligonucleotide; TTT chr11 5270759 5270780 5270764 5270759 -
ttctctgtttgatgacaaattc

SEQ ID NO: 135861 - DNA, 22 bp, Artificial Sequence
  Synthetic oligonucleotide; TTT chr11 5270758 5270779 5270763 5270758 -
tctctgtttgatgacaaattct

SEQ ID NO: 135862 - DNA, 22 bp, Artificial Sequence
  Synthetic oligonucleotide; TTT chr11 5270757 5270778 5270762 5270757 -
ctctgtttgatgacaaattctg

SEQ ID NO: 135863 - DNA, 22 bp, Artificial Sequence
  Synthetic oligonucleotide; TTC chr11 5270756 5270777 5270761 5270756 -
tctgtttgatgacaaattctgg

SEQ ID NO: 135864 - DNA, 22 bp, Artificial Sequence
  Synthetic oligonucleotide; CTC chr11 5270754 5270775 5270759 5270754 -
tgtttgatgacaaattctggct

SEQ ID NO: 135865 - DNA, 22 bp, Artificial Sequence
  Synthetic oligonucleotide; CTG chr11 5270752 5270773 5270757 5270752 -
tttgatgacaaattctggcttt

SEQ ID NO: 135866 - DNA, 22 bp, Artificial Sequence
  Synthetic oligonucleotide; TTT chr11 5270749 5270770 5270754 5270749 -
gatgacaaattctggctttaaa

SEQ ID NO: 135867 - DNA, 22 bp, Artificial Sequence
  Synthetic oligonucleotide; TTG chr11 5270748 5270769 5270753 5270748 -
atgacaaattctggctttaaat

SEQ ID NO: 135868 - DNA, 22 bp, Artificial Sequence
  Synthetic oligonucleotide; TTC chr11 5270737 5270758 5270742 5270737 -
tggctttaaataattttaggat

SEQ ID NO: 135869 - DNA, 22 bp, Artificial Sequence
  Synthetic oligonucleotide; CTG chr11 5270735 5270756 5270740 5270735 -
gctttaaataattttaggattt

SEQ ID NO: 135870 - DNA, 22 bp, Artificial Sequence
  Synthetic oligonucleotide; CTT chr11 5270731 5270752 5270736 5270731 -
taaataattttaggattttagg

SEQ ID NO: 135871 - DNA, 22 bp, Artificial Sequence
  Synthetic oligonucleotide; TTT chr11 5270730 5270751 5270735 5270730 -
aaataattttaggattttaggc

SEQ ID NO: 135872 - DNA, 22 bp, Artificial Sequence
  Synthetic oligonucleotide; TTA chr11 5270729 5270750 5270734 5270729 -
aataattttaggattttaggct

SEQ ID NO: 135873 - DNA, 22 bp, Artificial Sequence
  Synthetic oligonucleotide; TTT chr11 5270721 5270742 5270726 5270721 -
taggattttaggcttctcagct

SEQ ID NO: 135874 - DNA, 22 bp, Artificial Sequence
  Synthetic oligonucleotide; TTT chr11 5270720 5270741 5270725 5270720 -
aggattttaggcttctcagctc

SEQ ID NO: 135875 - DNA, 22 bp, Artificial Sequence
  Synthetic oligonucleotide; TTA chr11 5270719 5270740 5270724 5270719 -
ggattttaggcttctcagctcc

SEQ ID NO: 135876 - DNA, 22 bp, Artificial Sequence
  Synthetic oligonucleotide; TTT chr11 5270713 5270734 5270718 5270713 -
taggcttctcagctcccttccc

SEQ ID NO: 135877 - DNA, 22 bp, Artificial Sequence
  Synthetic oligonucleotide; TTT chr11 5270712 5270733 5270717 5270712 -
aggcttctcagctcccttccca

SEQ ID NO: 135878 - DNA, 22 bp, Artificial Sequence
  Synthetic oligonucleotide; TTA chr11 5270711 5270732 5270716 5270711 -
ggcttctcagctcccttcccag

SEQ ID NO: 135879 - DNA, 22 bp, Artificial Sequence
  Synthetic oligonucleotide; CTT chr11 5270706 5270727 5270711 5270706 -
ctcagctcccttcccagtgaga

SEQ ID NO: 135880 - DNA, 22 bp, Artificial Sequence
  Synthetic oligonucleotide; TTC chr11 5270705 5270726 5270710 5270705 -
tcagctcccttcccagtgagaa

SEQ ID NO: 135881 - DNA, 22 bp, Artificial Sequence
  Synthetic oligonucleotide; CTC chr11 5270703 5270724 5270708 5270703 -
agctcccttcccagtgagaagt

SEQ ID NO: 135882 - DNA, 22 bp, Artificial Sequence
  Synthetic oligonucleotide; CTC chr11 5270698 5270719 5270703 5270698 -
ccttcccagtgagaagtataag

SEQ ID NO: 135883 - DNA, 22 bp, Artificial Sequence
  Synthetic oligonucleotide; CTT chr11 5270694 5270715 5270699 5270694 -
cccagtgagaagtataagcagg

SEQ ID NO: 135884 - DNA, 22 bp, Artificial Sequence
  Synthetic oligonucleotide; TTC chr11 5270693 5270714 5270698 5270693 -
ccagtgagaagtataagcagga

SEQ ID NO: 135885 - DNA, 22 bp, Artificial Sequence
  Synthetic oligonucleotide; CTC chr11 5270633 5270654 5270638 5270633 -
acaaagtagccaatgtcccctg

SEQ ID NO: 135886 - DNA, 22 bp, Artificial Sequence
  Synthetic oligonucleotide; CTG chr11 5270611 5270632 5270616 5270611 -
tggtcatagagaaatgaaaaga

SEQ ID NO: 135887 - DNA, 22 bp, Artificial Sequence
  Synthetic oligonucleotide; TTC chr11 5270579 5270600 5270584 5270579 -
tctggaagcactggatgtaatc

SEQ ID NO: 135888 - DNA, 22 bp, Artificial Sequence
  Synthetic oligonucleotide; CTC chr11 5270577 5270598 5270582 5270577 -
tggaagcactggatgtaatctt

SEQ ID NO: 135889 - DNA, 22 bp, Artificial Sequence
  Synthetic oligonucleotide; CTG chr11 5270575 5270596 5270580 5270575 -
gaagcactggatgtaatctttt

SEQ ID NO: 135890 - DNA, 22 bp, Artificial Sequence
  Synthetic oligonucleotide; CTG chr11 5270566 5270587 5270571 5270566 -
gatgtaatcttttctgtctgtc

SEQ ID NO: 135891 - DNA, 22 bp, Artificial Sequence
  Synthetic oligonucleotide; CTT chr11 5270555 5270576 5270560 5270555 -
ttctgtctgtcctctctaggga

SEQ ID NO: 135892 - DNA, 22 bp, Artificial Sequence
  Synthetic oligonucleotide; TTT chr11 5270554 5270575 5270559 5270554 -
tctgtctgtcctctctagggaa

SEQ ID NO: 135893 - DNA, 22 bp, Artificial Sequence
  Synthetic oligonucleotide; TTT chr11 5270553 5270574 5270558 5270553 -
ctgtctgtcctctctagggaat

SEQ ID NO: 135894 - DNA, 22 bp, Artificial Sequence
  Synthetic oligonucleotide; TTC chr11 5270552 5270573 5270557 5270552 -
tgtctgtcctctctagggaatc

SEQ ID NO: 135895 - DNA, 22 bp, Artificial Sequence
  Synthetic oligonucleotide; CTG chr11 5270550 5270571 5270555 5270550 -
tctgtcctctctagggaatcac

SEQ ID NO: 135896 - DNA, 22 bp, Artificial Sequence
  Synthetic oligonucleotide; CTG chr11 5270546 5270567 5270551 5270546 -
tcctctctagggaatcacccca

SEQ ID NO: 135897 - DNA, 22 bp, Artificial Sequence
  Synthetic oligonucleotide; CTC chr11 5270541 5270562 5270546 5270541 -
tctagggaatcaccccaaggta

SEQ ID NO: 135898 - DNA, 22 bp, Artificial Sequence
  Synthetic oligonucleotide; CTC chr11 5270539 5270560 5270544 5270539 -
tagggaatcaccccaaggtact

SEQ ID NO: 135899 - DNA, 22 bp, Artificial Sequence
  Synthetic oligonucleotide; CTA chr11 5270537 5270558 5270542 5270537 -
gggaatcaccccaaggtactgt

SEQ ID NO: 135900 - DNA, 22 bp, Artificial Sequence
  Synthetic oligonucleotide; CTG chr11 5270516 5270537 5270521 5270516 -
tactttgggattaaggctttag

SEQ ID NO: 135901 - DNA, 22 bp, Artificial Sequence
  Synthetic oligonucleotide; CTT chr11 5270511 5270532 5270516 5270511 -
tgggattaaggctttagtccca

SEQ ID NO: 135902 - DNA, 22 bp, Artificial Sequence
  Synthetic oligonucleotide; TTT chr11 5270510 5270531 5270515 5270510 -
gggattaaggctttagtcccac

SEQ ID NO: 135903 - DNA, 22 bp, Artificial Sequence
  Synthetic oligonucleotide; TTG chr11 5270509 5270530 5270514 5270509 -
ggattaaggctttagtcccact

SEQ ID NO: 135904 - DNA, 22 bp, Artificial Sequence
  Synthetic oligonucleotide; TTA chr11 5270503 5270524 5270508 5270503 -
aggctttagtcccactgtggac

SEQ ID NO: 135905 - DNA, 22 bp, Artificial Sequence
  Synthetic oligonucleotide; CTT chr11 5270497 5270518 5270502 5270497 -
tagtcccactgtggactacttg

SEQ ID NO: 135906 - DNA, 22 bp, Artificial Sequence
  Synthetic oligonucleotide; TTT chr11 5270496 5270517 5270501 5270496 -
agtcccactgtggactacttgc

SEQ ID NO: 135907 - DNA, 22 bp, Artificial Sequence
  Synthetic oligonucleotide; TTA chr11 5270495 5270516 5270500 5270495 -
gtcccactgtggactacttgct

SEQ ID NO: 135908 - DNA, 22 bp, Artificial Sequence
  Synthetic oligonucleotide; CTG chr11 5270486 5270507 5270491 5270486 -
tggactacttgctattctgttc

SEQ ID NO: 135909 - DNA, 22 bp, Artificial Sequence
  Synthetic oligonucleotide; CTA chr11 5270479 5270500 5270484 5270479 -
cttgctattctgttcagtttct

SEQ ID NO: 135910 - DNA, 22 bp, Artificial Sequence
  Synthetic oligonucleotide; CTT chr11 5270476 5270497 5270481 5270476 -
gctattctgttcagtttctaga

SEQ ID NO: 135911 - DNA, 22 bp, Artificial Sequence
  Synthetic oligonucleotide; TTG chr11 5270475 5270496 5270480 5270475 -
ctattctgttcagtttctagaa

SEQ ID NO: 135912 - DNA, 22 bp, Artificial Sequence
  Synthetic oligonucleotide; CTA chr11 5270472 5270493 5270477 5270472 -
ttctgttcagtttctagaagga

SEQ ID NO: 135913 - DNA, 22 bp, Artificial Sequence
  Synthetic oligonucleotide; TTC chr11 5270469 5270490 5270474 5270469 -
tgttcagtttctagaaggaact

SEQ ID NO: 135914 - DNA, 22 bp, Artificial Sequence
  Synthetic oligonucleotide; CTG chr11 5270467 5270488 5270472 5270467 -
ttcagtttctagaaggaactat

SEQ ID NO: 135915 - DNA, 22 bp, Artificial Sequence
  Synthetic oligonucleotide; TTC chr11 5270464 5270485 5270469 5270464 -
agtttctagaaggaactatgta

SEQ ID NO: 135916 - DNA, 22 bp, Artificial Sequence
  Synthetic oligonucleotide; TTT chr11 5270459 5270480 5270464 5270459 -
ctagaaggaactatgtacggtt

SEQ ID NO: 135917 - DNA, 22 bp, Artificial Sequence
  Synthetic oligonucleotide; TTC chr11 5270458 5270479 5270463 5270458 -
tagaaggaactatgtacggttt

SEQ ID NO: 135918 - DNA, 22 bp, Artificial Sequence
  Synthetic oligonucleotide; CTA chr11 5270456 5270477 5270461 5270456 -
gaaggaactatgtacggttttt

SEQ ID NO: 135919 - DNA, 22 bp, Artificial Sequence
  Synthetic oligonucleotide; CTA chr11 5270446 5270467 5270451 5270446 -
tgtacggtttttgtctccctag

SEQ ID NO: 135920 - DNA, 22 bp, Artificial Sequence
  Synthetic oligonucleotide; TTT chr11 5270436 5270457 5270441 5270436 -
ttgtctccctagagaaactaag

SEQ ID NO: 135921 - DNA, 22 bp, Artificial Sequence
  Synthetic oligonucleotide; TTT chr11 5270435 5270456 5270440 5270435 -
tgtctccctagagaaactaagg

SEQ ID NO: 135922 - DNA, 22 bp, Artificial Sequence
  Synthetic oligonucleotide; TTT chr11 5270434 5270455 5270439 5270434 -
gtctccctagagaaactaaggt

SEQ ID NO: 135923 - DNA, 22 bp, Artificial Sequence
  Synthetic oligonucleotide; TTG chr11 5270433 5270454 5270438 5270433 -
tctccctagagaaactaaggta

SEQ ID NO: 135924 - DNA, 22 bp, Artificial Sequence
  Synthetic oligonucleotide; CTC chr11 5270429 5270450 5270434 5270429 -
cctagagaaactaaggtacaga

SEQ ID NO: 135925 - DNA, 22 bp, Artificial Sequence
  Synthetic oligonucleotide; CTA chr11 5270425 5270446 5270430 5270425 -
gagaaactaaggtacagaagtt

SEQ ID NO: 135926 - DNA, 22 bp, Artificial Sequence
  Synthetic oligonucleotide; CTA chr11 5270416 5270437 5270421 5270416 -
aggtacagaagttttgtttaca

SEQ ID NO: 135927 - DNA, 22 bp, Artificial Sequence
  Synthetic oligonucleotide; TTT chr11 5270402 5270423 5270407 5270402 -
tgtttacaatgcactccttaag

SEQ ID NO: 135928 - DNA, 22 bp, Artificial Sequence
  Synthetic oligonucleotide; TTT chr11 5270401 5270422 5270406 5270401 -
gtttacaatgcactccttaaga

SEQ ID NO: 135929 - DNA, 22 bp, Artificial Sequence
  Synthetic oligonucleotide; TTG chr11 5270400 5270421 5270405 5270400 -
tttacaatgcactccttaagag

SEQ ID NO: 135930 - DNA, 22 bp, Artificial Sequence
  Synthetic oligonucleotide; TTT chr11 5270397 5270418 5270402 5270397 -
acaatgcactccttaagagagc

SEQ ID NO: 135931 - DNA, 22 bp, Artificial Sequence
  Synthetic oligonucleotide; TTA chr11 5270396 5270417 5270401 5270396 -
caatgcactccttaagagagct

SEQ ID NO: 135932 - DNA, 22 bp, Artificial Sequence
  Synthetic oligonucleotide; CTC chr11 5270386 5270407 5270391 5270386 -
cttaagagagctagaactgggt

SEQ ID NO: 135933 - DNA, 22 bp, Artificial Sequence
  Synthetic oligonucleotide; CTT chr11 5270383 5270404 5270388 5270383 -
aagagagctagaactgggtgag

SEQ ID NO: 135934 - DNA, 22 bp, Artificial Sequence
  Synthetic oligonucleotide; TTA chr11 5270382 5270403 5270387 5270382 -
agagagctagaactgggtgaga

SEQ ID NO: 135935 - DNA, 22 bp, Artificial Sequence
  Synthetic oligonucleotide; CTA chr11 5270373 5270394 5270378 5270373 -
gaactgggtgagattctgtttt

SEQ ID NO: 135936 - DNA, 22 bp, Artificial Sequence
  Synthetic oligonucleotide; CTG chr11 5270367 5270388 5270372 5270367 -
ggtgagattctgttttaacagc

SEQ ID NO: 135937 - DNA, 22 bp, Artificial Sequence
  Synthetic oligonucleotide; TTC chr11 5270357 5270378 5270362 5270357 -
tgttttaacagctttattttct

SEQ ID NO: 135938 - DNA, 22 bp, Artificial Sequence
  Synthetic oligonucleotide; CTG chr11 5270355 5270376 5270360 5270355 -
ttttaacagctttattttcttt

SEQ ID NO: 135939 - DNA, 22 bp, Artificial Sequence
  Synthetic oligonucleotide; TTT chr11 5270352 5270373 5270357 5270352 -
taacagctttattttcttttcc

SEQ ID NO: 135940 - DNA, 22 bp, Artificial Sequence
  Synthetic oligonucleotide; TTT chr11 5270351 5270372 5270356 5270351 -
aacagctttattttcttttcct

SEQ ID NO: 135941 - DNA, 22 bp, Artificial Sequence
  Synthetic oligonucleotide; TTA chr11 5270350 5270371 5270355 5270350 -
acagctttattttcttttcctt

SEQ ID NO: 135942 - DNA, 22 bp, Artificial Sequence
  Synthetic oligonucleotide; CTT chr11 5270343 5270364 5270348 5270343 -
tattttcttttccttggccctg

SEQ ID NO: 135943 - DNA, 22 bp, Artificial Sequence
  Synthetic oligonucleotide; TTT chr11 5270342 5270363 5270347 5270342 -
attttcttttccttggccctgt

SEQ ID NO: 135944 - DNA, 22 bp, Artificial Sequence
  Synthetic oligonucleotide; TTA chr11 5270341 5270362 5270346 5270341 -
ttttcttttccttggccctgtt

SEQ ID NO: 135945 - DNA, 22 bp, Artificial Sequence
  Synthetic oligonucleotide; TTT chr11 5270338 5270359 5270343 5270338 -
tcttttccttggccctgttttt

SEQ ID NO: 135946 - DNA, 22 bp, Artificial Sequence
  Synthetic oligonucleotide; TTT chr11 5270337 5270358 5270342 5270337 -
cttttccttggccctgtttttg

SEQ ID NO: 135947 - DNA, 22 bp, Artificial Sequence
  Synthetic oligonucleotide; TTC chr11 5270336 5270357 5270341 5270336 -
ttttccttggccctgtttttgt

SEQ ID NO: 135948 - DNA, 22 bp, Artificial Sequence
  Synthetic oligonucleotide; CTT chr11 5270334 5270355 5270339 5270334 -
ttccttggccctgtttttgtca

SEQ ID NO: 135949 - DNA, 22 bp, Artificial Sequence
  Synthetic oligonucleotide; TTT chr11 5270333 5270354 5270338 5270333 -
tccttggccctgtttttgtcac

SEQ ID NO: 135950 - DNA, 22 bp, Artificial Sequence
  Synthetic oligonucleotide; TTT chr11 5270332 5270353 5270337 5270332 -
ccttggccctgtttttgtcact

SEQ ID NO: 135951 - DNA, 22 bp, Artificial Sequence
  Synthetic oligonucleotide; TTC chr11 5270331 5270352 5270336 5270331 -
cttggccctgtttttgtcactg

SEQ ID NO: 135952 - DNA, 22 bp, Artificial Sequence
  Synthetic oligonucleotide; CTT chr11 5270328 5270349 5270333 5270328 -
ggccctgtttttgtcactgtca

SEQ ID NO: 135953 - DNA, 22 bp, Artificial Sequence
  Synthetic oligonucleotide; TTG chr11 5270327 5270348 5270332 5270327 -
gccctgtttttgtcactgtcac

SEQ ID NO: 135954 - DNA, 22 bp, Artificial Sequence
  Synthetic oligonucleotide; CTG chr11 5270321 5270342 5270326 5270321 -
tttttgtcactgtcaccacctt

SEQ ID NO: 135955 - DNA, 22 bp, Artificial Sequence
  Synthetic oligonucleotide; TTT chr11 5270318 5270339 5270323 5270318 -
ttgtcactgtcaccacctttaa

SEQ ID NO: 135956 - DNA, 22 bp, Artificial Sequence
  Synthetic oligonucleotide; TTT chr11 5270317 5270338 5270322 5270317 -
tgtcactgtcaccacctttaag

SEQ ID NO: 135957 - DNA, 22 bp, Artificial Sequence
  Synthetic oligonucleotide; TTT chr11 5270316 5270337 5270321 5270316 -
gtcactgtcaccacctttaagg

SEQ ID NO: 135958 - DNA, 22 bp, Artificial Sequence
  Synthetic oligonucleotide; TTG chr11 5270315 5270336 5270320 5270315 -
tcactgtcaccacctttaaggc

SEQ ID NO: 135959 - DNA, 22 bp, Artificial Sequence
  Synthetic oligonucleotide; CTG chr11 5270309 5270330 5270314 5270309 -
tcaccacctttaaggcaaatgt

SEQ ID NO: 135960 - DNA, 22 bp, Artificial Sequence
  Synthetic oligonucleotide; CTT chr11 5270299 5270320 5270304 5270299 -
taaggcaaatgttaaatgcgct

SEQ ID NO: 135961 - DNA, 22 bp, Artificial Sequence
  Synthetic oligonucleotide; TTT chr11 5270298 5270319 5270303 5270298 -
aaggcaaatgttaaatgcgctt

SEQ ID NO: 135962 - DNA, 22 bp, Artificial Sequence
  Synthetic oligonucleotide; TTA chr11 5270297 5270318 5270302 5270297 -
aggcaaatgttaaatgcgcttt

SEQ ID NO: 135963 - DNA, 22 bp, Artificial Sequence
  Synthetic oligonucleotide; TTA chr11 5270285 5270306 5270290 5270285 -
aatgcgctttggctgaaacttt

SEQ ID NO: 135964 - DNA, 22 bp, Artificial Sequence
  Synthetic oligonucleotide; CTT chr11 5270276 5270297 5270281 5270276 -
tggctgaaactttttttcctat

SEQ ID NO: 135965 - DNA, 22 bp, Artificial Sequence
  Synthetic oligonucleotide; TTT chr11 5270275 5270296 5270280 5270275 -
ggctgaaactttttttcctatt

SEQ ID NO: 135966 - DNA, 22 bp, Artificial Sequence
  Synthetic oligonucleotide; TTG chr11 5270274 5270295 5270279 5270274 -
gctgaaactttttttcctattt

SEQ ID NO: 135967 - DNA, 22 bp, Artificial Sequence
  Synthetic oligonucleotide; CTG chr11 5270270 5270291 5270275 5270270 -
aaactttttttcctattttgag

SEQ ID NO: 135968 - DNA, 22 bp, Artificial Sequence
  Synthetic oligonucleotide; CTT chr11 5270264 5270285 5270269 5270264 -
tttttcctattttgagatttgc

SEQ ID NO: 135969 - DNA, 22 bp, Artificial Sequence
  Synthetic oligonucleotide; TTT chr11 5270263 5270284 5270268 5270263 -
ttttcctattttgagatttgct

SEQ ID NO: 135970 - DNA, 22 bp, Artificial Sequence
  Synthetic oligonucleotide; TTT chr11 5270262 5270283 5270267 5270262 -
tttcctattttgagatttgctc

SEQ ID NO: 135971 - DNA, 22 bp, Artificial Sequence
  Synthetic oligonucleotide; TTT chr11 5270261 5270282 5270266 5270261 -
ttcctattttgagatttgctcc

SEQ ID NO: 135972 - DNA, 22 bp, Artificial Sequence
  Synthetic oligonucleotide; TTT chr11 5270260 5270281 5270265 5270260 -
tcctattttgagatttgctcct

SEQ ID NO: 135973 - DNA, 22 bp, Artificial Sequence
  Synthetic oligonucleotide; TTT chr11 5270259 5270280 5270264 5270259 -
cctattttgagatttgctcctt

SEQ ID NO: 135974 - DNA, 22 bp, Artificial Sequence
  Synthetic oligonucleotide; TTC chr11 5270258 5270279 5270263 5270258 -
ctattttgagatttgctccttt

SEQ ID NO: 135975 - DNA, 22 bp, Artificial Sequence
  Synthetic oligonucleotide; CTA chr11 5270255 5270276 5270260 5270255 -
ttttgagatttgctcctttata

SEQ ID NO: 135976 - DNA, 22 bp, Artificial Sequence
  Synthetic oligonucleotide; TTT chr11 5270252 5270273 5270257 5270252 -
tgagatttgctcctttatatga

SEQ ID NO: 135977 - DNA, 22 bp, Artificial Sequence
  Synthetic oligonucleotide; TTT chr11 5270251 5270272 5270256 5270251 -
gagatttgctcctttatatgag

SEQ ID NO: 135978 - DNA, 22 bp, Artificial Sequence
  Synthetic oligonucleotide; TTG chr11 5270250 5270271 5270255 5270250 -
agatttgctcctttatatgagg

SEQ ID NO: 135979 - DNA, 22 bp, Artificial Sequence
  Synthetic oligonucleotide; TTT chr11 5270244 5270265 5270249 5270244 -
gctcctttatatgaggctttct

SEQ ID NO: 135980 - DNA, 22 bp, Artificial Sequence
  Synthetic oligonucleotide; TTG chr11 5270243 5270264 5270248 5270243 -
ctcctttatatgaggctttctt

SEQ ID NO: 135981 - DNA, 22 bp, Artificial Sequence
  Synthetic oligonucleotide; CTC chr11 5270240 5270261 5270245 5270240 -
ctttatatgaggctttcttgga

SEQ ID NO: 135982 - DNA, 22 bp, Artificial Sequence
  Synthetic oligonucleotide; CTT chr11 5270237 5270258 5270242 5270237 -
tatatgaggctttcttggaaaa

SEQ ID NO: 135983 - DNA, 22 bp, Artificial Sequence
  Synthetic oligonucleotide; TTT chr11 5270236 5270257 5270241 5270236 -
atatgaggctttcttggaaaag

SEQ ID NO: 135984 - DNA, 22 bp, Artificial Sequence
  Synthetic oligonucleotide; TTA chr11 5270235 5270256 5270240 5270235 -
tatgaggctttcttggaaaagg

SEQ ID NO: 135985 - DNA, 22 bp, Artificial Sequence
  Synthetic oligonucleotide; CTT chr11 5270225 5270246 5270230 5270225 -
tcttggaaaaggagaatgggag

SEQ ID NO: 135986 - DNA, 22 bp, Artificial Sequence
  Synthetic oligonucleotide; TTT chr11 5270224 5270245 5270229 5270224 -
cttggaaaaggagaatgggaga

SEQ ID NO: 135987 - DNA, 22 bp, Artificial Sequence
  Synthetic oligonucleotide; TTC chr11 5270223 5270244 5270228 5270223 -
ttggaaaaggagaatgggagag

SEQ ID NO: 135988 - DNA, 22 bp, Artificial Sequence
  Synthetic oligonucleotide; CTT chr11 5270221 5270242 5270226 5270221 -
ggaaaaggagaatgggagagat

SEQ ID NO: 135989 - DNA, 22 bp, Artificial Sequence
  Synthetic oligonucleotide; TTG chr11 5270220 5270241 5270225 5270220 -
gaaaaggagaatgggagagatg

SEQ ID NO: 135990 - DNA, 22 bp, Artificial Sequence
  Synthetic oligonucleotide; TTT chr11 5270188 5270209 5270193 5270188 -
tggaagatgatgaagagggtaa

SEQ ID NO: 135991 - DNA, 22 bp, Artificial Sequence
  Synthetic oligonucleotide; TTT chr11 5270187 5270208 5270192 5270187 -
ggaagatgatgaagagggtaaa

SEQ ID NO: 135992 - DNA, 22 bp, Artificial Sequence
  Synthetic oligonucleotide; TTG chr11 5270186 5270207 5270191 5270186 -
gaagatgatgaagagggtaaaa

SEQ ID NO: 135993 - DNA, 22 bp, Artificial Sequence
  Synthetic oligonucleotide; TTT chr11 5270144 5270165 5270149 5270144 -
gtgttgcagatagatgaggagc

SEQ ID NO: 135994 - DNA, 22 bp, Artificial Sequence
  Synthetic oligonucleotide; TTG chr11 5270143 5270164 5270148 5270143 -
tgttgcagatagatgaggagcc

SEQ ID NO: 135995 - DNA, 22 bp, Artificial Sequence
  Synthetic oligonucleotide; TTG chr11 5270138 5270159 5270143 5270138 -
cagatagatgaggagccaacaa

SEQ ID NO: 135996 - DNA, 22 bp, Artificial Sequence
  Synthetic oligonucleotide; CTC chr11 5270105 5270126 5270110 5270105 -
aggatccagcacacattatcac

SEQ ID NO: 135997 - DNA, 22 bp, Artificial Sequence
  Synthetic oligonucleotide; TTA chr11 5270087 5270108 5270092 5270087 -
tcacaaacttagtgtccatcca

SEQ ID NO: 135998 - DNA, 22 bp, Artificial Sequence
  Synthetic oligonucleotide; CTT chr11 5270077 5270098 5270082 5270077 -
agtgtccatccatcactgctga

SEQ ID NO: 135999 - DNA, 22 bp, Artificial Sequence
  Synthetic oligonucleotide; TTA chr11 5270076 5270097 5270081 5270076 -
gtgtccatccatcactgctgac

SEQ ID NO: 136000 - DNA, 22 bp, Artificial Sequence
  Synthetic oligonucleotide; CTG chr11 5270059 5270080 5270064 5270059 -
ctgaccctctccggacctgact

SEQ ID NO: 136001 - DNA, 22 bp, Artificial Sequence
  Synthetic oligonucleotide; CTG chr11 5270056 5270077 5270061 5270056 -
accctctccggacctgactcca

SEQ ID NO: 136002 - DNA, 22 bp, Artificial Sequence
  Synthetic oligonucleotide; CTC chr11 5270050 5270071 5270055 5270050 -
tccggacctgactccacccctg

SEQ ID NO: 136003 - DNA, 22 bp, Artificial Sequence
  Synthetic oligonucleotide; CTC chr11 5270048 5270069 5270053 5270048 -
cggacctgactccacccctgag

SEQ ID NO: 136004 - DNA, 22 bp, Artificial Sequence
  Synthetic oligonucleotide; CTG chr11 5270040 5270061 5270045 5270040 -
actccacccctgagggacacag

SEQ ID NO: 136005 - DNA, 22 bp, Artificial Sequence
  Synthetic oligonucleotide; CTC chr11 5270036 5270057 5270041 5270036 -
cacccctgagggacacaggtca

SEQ ID NO: 136006 - DNA, 22 bp, Artificial Sequence
  Synthetic oligonucleotide; CTG chr11 5270028 5270049 5270033 5270028 -
agggacacaggtcagccttgac

SEQ ID NO: 136007 - DNA, 22 bp, Artificial Sequence
  Synthetic oligonucleotide; CTT chr11 5270009 5270030 5270014 5270009 -
gaccaatgacttttaagtacca

SEQ ID NO: 136008 - DNA, 22 bp, Artificial Sequence
  Synthetic oligonucleotide; TTG chr11 5270008 5270029 5270013 5270008 -
accaatgacttttaagtaccat

SEQ ID NO: 136009 - DNA, 22 bp, Artificial Sequence
  Synthetic oligonucleotide; CTT chr11 5269997 5270018 5270002 5269997 -
ttaagtaccatggagaacaggg

SEQ ID NO: 136010 - DNA, 22 bp, Artificial Sequence
  Synthetic oligonucleotide; TTT chr11 5269996 5270017 5270001 5269996 -
taagtaccatggagaacagggg

SEQ ID NO: 136011 - DNA, 22 bp, Artificial Sequence
  Synthetic oligonucleotide; TTT chr11 5269995 5270016 5270000 5269995 -
aagtaccatggagaacaggggg

SEQ ID NO: 136012 - DNA, 22 bp, Artificial Sequence
  Synthetic oligonucleotide; TTA chr11 5269994 5270015 5269999 5269994 -
agtaccatggagaacagggggc

SEQ ID NO: 136013 - DNA, 22 bp, Artificial Sequence
  Synthetic oligonucleotide; CTT chr11 5269964 5269985 5269969 5269964 -
cggcagtaaagaataaaaggcc

SEQ ID NO: 136014 - DNA, 22 bp, Artificial Sequence
  Synthetic oligonucleotide; TTC chr11 5269963 5269984 5269968 5269963 -
ggcagtaaagaataaaaggcca

SEQ ID NO: 136015 - DNA, 22 bp, Artificial Sequence
  Synthetic oligonucleotide; CTG chr11 5269915 5269936 5269920 5269915 -
cttccgacacagctgcaatcac

SEQ ID NO: 136016 - DNA, 22 bp, Artificial Sequence
  Synthetic oligonucleotide; CTT chr11 5269912 5269933 5269917 5269912 -
ccgacacagctgcaatcactag

SEQ ID NO: 136017 - DNA, 22 bp, Artificial Sequence
  Synthetic oligonucleotide; TTC chr11 5269911 5269932 5269916 5269911 -
cgacacagctgcaatcactagc

SEQ ID NO: 136018 - DNA, 22 bp, Artificial Sequence
  Synthetic oligonucleotide; CTG chr11 5269900 5269921 5269905 5269900 -
caatcactagcaagctctcagg

SEQ ID NO: 136019 - DNA, 22 bp, Artificial Sequence
  Synthetic oligonucleotide; CTA chr11 5269891 5269912 5269896 5269891 -
gcaagctctcaggcctggcatc

SEQ ID NO: 136020 - DNA, 22 bp, Artificial Sequence
  Synthetic oligonucleotide; CTC chr11 5269883 5269904 5269888 5269883 -
tcaggcctggcatcatggtgca

SEQ ID NO: 136021 - DNA, 22 bp, Artificial Sequence
  Synthetic oligonucleotide; CTC chr11 5269881 5269902 5269886 5269881 -
aggcctggcatcatggtgcatt

SEQ ID NO: 136022 - DNA, 22 bp, Artificial Sequence
  Synthetic oligonucleotide; CTG chr11 5269874 5269895 5269879 5269874 -
gcatcatggtgcattttactgc

SEQ ID NO: 136023 - DNA, 22 bp, Artificial Sequence
  Synthetic oligonucleotide; TTT chr11 5269858 5269879 5269863 5269858 -
tactgctgaggagaaggctgcc

SEQ ID NO: 136024 - DNA, 22 bp, Artificial Sequence
  Synthetic oligonucleotide; TTT chr11 5269857 5269878 5269862 5269857 -
actgctgaggagaaggctgccg

SEQ ID NO: 136025 - DNA, 22 bp, Artificial Sequence
  Synthetic oligonucleotide; TTA chr11 5269856 5269877 5269861 5269856 -
ctgctgaggagaaggctgccgt

SEQ ID NO: 136026 - DNA, 22 bp, Artificial Sequence
  Synthetic oligonucleotide; CTG chr11 5269853 5269874 5269858 5269853 -
ctgaggagaaggctgccgtcac

SEQ ID NO: 136027 - DNA, 22 bp, Artificial Sequence
  Synthetic oligonucleotide; CTG chr11 5269850 5269871 5269855 5269850 -
aggagaaggctgccgtcactag

SEQ ID NO: 136028 - DNA, 22 bp, Artificial Sequence
  Synthetic oligonucleotide; CTG chr11 5269838 5269859 5269843 5269838 -
ccgtcactagcctgtggagcaa

SEQ ID NO: 136029 - DNA, 22 bp, Artificial Sequence
  Synthetic oligonucleotide; CTA chr11 5269829 5269850 5269834 5269829 -
gcctgtggagcaagatgaatgt

SEQ ID NO: 136030 - DNA, 22 bp, Artificial Sequence
  Synthetic oligonucleotide; CTG chr11 5269824 5269845 5269829 5269824 -
tggagcaagatgaatgtggaag

SEQ ID NO: 136031 - DNA, 22 bp, Artificial Sequence
  Synthetic oligonucleotide; CTG chr11 5269796 5269817 5269801 5269796 -
gaggtgaagccttgggcaggta

SEQ ID NO: 136032 - DNA, 22 bp, Artificial Sequence
  Synthetic oligonucleotide; CTT chr11 5269783 5269804 5269788 5269783 -
gggcaggtaagcattggttctc

SEQ ID NO: 136033 - DNA, 22 bp, Artificial Sequence
  Synthetic oligonucleotide; TTG chr11 5269782 5269803 5269787 5269782 -
ggcaggtaagcattggttctca

SEQ ID NO: 136034 - DNA, 22 bp, Artificial Sequence
  Synthetic oligonucleotide; TTG chr11 5269767 5269788 5269772 5269767 -
gttctcaatgcatgggaatgaa

SEQ ID NO: 136035 - DNA, 22 bp, Artificial Sequence
  Synthetic oligonucleotide; TTC chr11 5269763 5269784 5269768 5269763 -
tcaatgcatgggaatgaagggt

SEQ ID NO: 136036 - DNA, 22 bp, Artificial Sequence
  Synthetic oligonucleotide; CTC chr11 5269761 5269782 5269766 5269761 -
aatgcatgggaatgaagggtga

SEQ ID NO: 136037 - DNA, 22 bp, Artificial Sequence
  Synthetic oligonucleotide; TTA chr11 5269733 5269754 5269738 5269733 -
ccctagcaagttgattgggaaa

SEQ ID NO: 136038 - DNA, 22 bp, Artificial Sequence
  Synthetic oligonucleotide; CTA chr11 5269728 5269749 5269733 5269728 -
gcaagttgattgggaaagtcct

SEQ ID NO: 136039 - DNA, 22 bp, Artificial Sequence
  Synthetic oligonucleotide; TTG chr11 5269720 5269741 5269725 5269720 -
attgggaaagtcctcaagattt

SEQ ID NO: 136040 - DNA, 22 bp, Artificial Sequence
  Synthetic oligonucleotide; TTG chr11 5269716 5269737 5269721 5269716 -
ggaaagtcctcaagattttttg

SEQ ID NO: 136041 - DNA, 22 bp, Artificial Sequence
  Synthetic oligonucleotide; CTC chr11 5269705 5269726 5269710 5269705 -
aagattttttgcatctctaatt

SEQ ID NO: 136042 - DNA, 22 bp, Artificial Sequence
  Synthetic oligonucleotide; TTT chr11 5269698 5269719 5269703 5269698 -
tttgcatctctaattttgtatc

SEQ ID NO: 136043 - DNA, 22 bp, Artificial Sequence
  Synthetic oligonucleotide; TTT chr11 5269697 5269718 5269702 5269697 -
ttgcatctctaattttgtatct

SEQ ID NO: 136044 - DNA, 22 bp, Artificial Sequence
  Synthetic oligonucleotide; TTT chr11 5269696 5269717 5269701 5269696 -
tgcatctctaattttgtatctg

SEQ ID NO: 136045 - DNA, 22 bp, Artificial Sequence
  Synthetic oligonucleotide; TTT chr11 5269695 5269716 5269700 5269695 -
gcatctctaattttgtatctga

SEQ ID NO: 136046 - DNA, 22 bp, Artificial Sequence
  Synthetic oligonucleotide; TTG chr11 5269694 5269715 5269699 5269694 -
catctctaattttgtatctgat

SEQ ID NO: 136047 - DNA, 22 bp, Artificial Sequence
  Synthetic oligonucleotide; CTC chr11 5269688 5269709 5269693 5269688 -
taattttgtatctgatatggtg

SEQ ID NO: 136048 - DNA, 22 bp, Artificial Sequence
  Synthetic oligonucleotide; CTA chr11 5269686 5269707 5269691 5269686 -
attttgtatctgatatggtgtc

SEQ ID NO: 136049 - DNA, 22 bp, Artificial Sequence
  Synthetic oligonucleotide; TTT chr11 5269682 5269703 5269687 5269682 -
tgtatctgatatggtgtcattt

SEQ ID NO: 136050 - DNA, 22 bp, Artificial Sequence
  Synthetic oligonucleotide; TTT chr11 5269681 5269702 5269686 5269681 -
gtatctgatatggtgtcatttc

SEQ ID NO: 136051 - DNA, 22 bp, Artificial Sequence
  Synthetic oligonucleotide; TTG chr11 5269680 5269701 5269685 5269680 -
tatctgatatggtgtcatttca

SEQ ID NO: 136052 - DNA, 22 bp, Artificial Sequence
  Synthetic oligonucleotide; CTG chr11 5269674 5269695 5269679 5269674 -
atatggtgtcatttcatagact

SEQ ID NO: 136053 - DNA, 22 bp, Artificial Sequence
  Synthetic oligonucleotide; TTT chr11 5269660 5269681 5269665 5269660 -
catagactcctcgttgtttacc

SEQ ID NO: 136054 - DNA, 22 bp, Artificial Sequence
  Synthetic oligonucleotide; TTC chr11 5269659 5269680 5269664 5269659 -
atagactcctcgttgtttaccc

SEQ ID NO: 136055 - DNA, 22 bp, Artificial Sequence
  Synthetic oligonucleotide; CTC chr11 5269651 5269672 5269656 5269651 -
ctcgttgtttacccctggaccc

SEQ ID NO: 136056 - DNA, 22 bp, Artificial Sequence
  Synthetic oligonucleotide; CTC chr11 5269648 5269669 5269653 5269648 -
gttgtttacccctggacccaga

SEQ ID NO: 136057 - DNA, 22 bp, Artificial Sequence
  Synthetic oligonucleotide; TTG chr11 5269644 5269665 5269649 5269644 -
tttacccctggacccagagatt

SEQ ID NO: 136058 - DNA, 22 bp, Artificial Sequence
  Synthetic oligonucleotide; TTT chr11 5269641 5269662 5269646 5269641 -
acccctggacccagagattttt

SEQ ID NO: 136059 - DNA, 22 bp, Artificial Sequence
  Synthetic oligonucleotide; TTA chr11 5269640 5269661 5269645 5269640 -
cccctggacccagagatttttt

SEQ ID NO: 136060 - DNA, 22 bp, Artificial Sequence
  Synthetic oligonucleotide; CTG chr11 5269634 5269655 5269639 5269634 -
gacccagagattttttgacagc

SEQ ID NO: 136061 - DNA, 22 bp, Artificial Sequence
  Synthetic oligonucleotide; TTT chr11 5269621 5269642 5269626 5269621 -
tttgacagctttggaaacctgt

SEQ ID NO: 136062 - DNA, 22 bp, Artificial Sequence
  Synthetic oligonucleotide; TTT chr11 5269620 5269641 5269625 5269620 -
ttgacagctttggaaacctgtc

SEQ ID NO: 136063 - DNA, 22 bp, Artificial Sequence
  Synthetic oligonucleotide; TTT chr11 5269619 5269640 5269624 5269619 -
tgacagctttggaaacctgtcg

SEQ ID NO: 136064 - DNA, 22 bp, Artificial Sequence
  Synthetic oligonucleotide; TTT chr11 5269618 5269639 5269623 5269618 -
gacagctttggaaacctgtcgt

SEQ ID NO: 136065 - DNA, 22 bp, Artificial Sequence
  Synthetic oligonucleotide; TTG chr11 5269617 5269638 5269622 5269617 -
acagctttggaaacctgtcgtc

SEQ ID NO: 136066 - DNA, 22 bp, Artificial Sequence
  Synthetic oligonucleotide; CTT chr11 5269610 5269631 5269615 5269610 -
tggaaacctgtcgtctccctct

SEQ ID NO: 136067 - DNA, 22 bp, Artificial Sequence
  Synthetic oligonucleotide; TTT chr11 5269609 5269630 5269614 5269609 -
ggaaacctgtcgtctccctctg

SEQ ID NO: 136068 - DNA, 22 bp, Artificial Sequence
  Synthetic oligonucleotide; TTG chr11 5269608 5269629 5269613 5269608 -
gaaacctgtcgtctccctctgc

SEQ ID NO: 136069 - DNA, 22 bp, Artificial Sequence
  Synthetic oligonucleotide; CTG chr11 5269600 5269621 5269605 5269600 -
tcgtctccctctgccatcctgg

SEQ ID NO: 136070 - DNA, 22 bp, Artificial Sequence
  Synthetic oligonucleotide; CTC chr11 5269593 5269614 5269598 5269593 -
cctctgccatcctgggcaaccc

SEQ ID NO: 136071 - DNA, 22 bp, Artificial Sequence
  Synthetic oligonucleotide; CTC chr11 5269589 5269610 5269594 5269589 -
tgccatcctgggcaaccccaag

SEQ ID NO: 136072 - DNA, 22 bp, Artificial Sequence
  Synthetic oligonucleotide; CTG chr11 5269587 5269608 5269592 5269587 -
ccatcctgggcaaccccaaggt

SEQ ID NO: 136073 - DNA, 22 bp, Artificial Sequence
  Synthetic oligonucleotide; CTG chr11 5269579 5269600 5269584 5269579 -
ggcaaccccaaggtcaaggccc

SEQ ID NO: 136074 - DNA, 22 bp, Artificial Sequence
  Synthetic oligonucleotide; CTG chr11 5269540 5269561 5269545 5269540 -
acttcctttggagatgctatta

SEQ ID NO: 136075 - DNA, 22 bp, Artificial Sequence
  Synthetic oligonucleotide; CTT chr11 5269536 5269557 5269541 5269536 -
cctttggagatgctattaaaaa

SEQ ID NO: 136076 - DNA, 22 bp, Artificial Sequence
  Synthetic oligonucleotide; TTC chr11 5269535 5269556 5269540 5269535 -
ctttggagatgctattaaaaac

SEQ ID NO: 136077 - DNA, 22 bp, Artificial Sequence
  Synthetic oligonucleotide; CTT chr11 5269532 5269553 5269537 5269532 -
tggagatgctattaaaaacatg

SEQ ID NO: 136078 - DNA, 22 bp, Artificial Sequence
  Synthetic oligonucleotide; TTT chr11 5269531 5269552 5269536 5269531 -
ggagatgctattaaaaacatgg

SEQ ID NO: 136079 - DNA, 22 bp, Artificial Sequence
  Synthetic oligonucleotide; TTG chr11 5269530 5269551 5269535 5269530 -
gagatgctattaaaaacatgga

SEQ ID NO: 136080 - DNA, 22 bp, Artificial Sequence
  Synthetic oligonucleotide; CTA chr11 5269521 5269542 5269526 5269521 -
ttaaaaacatggacaacctcaa

SEQ ID NO: 136081 - DNA, 22 bp, Artificial Sequence
  Synthetic oligonucleotide; TTA chr11 5269518 5269539 5269523 5269518 -
aaaacatggacaacctcaagcc

SEQ ID NO: 136082 - DNA, 22 bp, Artificial Sequence
  Synthetic oligonucleotide; CTC chr11 5269501 5269522 5269506 5269501 -
aagcccgcctttgctaagctga

SEQ ID NO: 136083 - DNA, 22 bp, Artificial Sequence
  Synthetic oligonucleotide; CTT chr11 5269490 5269511 5269495 5269490 -
tgctaagctgagtgagctgcac

SEQ ID NO: 136084 - DNA, 22 bp, Artificial Sequence
  Synthetic oligonucleotide; TTT chr11 5269489 5269510 5269494 5269489 -
gctaagctgagtgagctgcact

SEQ ID NO: 136085 - DNA, 22 bp, Artificial Sequence
  Synthetic oligonucleotide; TTG chr11 5269488 5269509 5269493 5269488 -
ctaagctgagtgagctgcactg

SEQ ID NO: 136086 - DNA, 22 bp, Artificial Sequence
  Synthetic oligonucleotide; CTA chr11 5269485 5269506 5269490 5269485 -
agctgagtgagctgcactgtga

SEQ ID NO: 136087 - DNA, 22 bp, Artificial Sequence
  Synthetic oligonucleotide; CTG chr11 5269480 5269501 5269485 5269480 -
agtgagctgcactgtgacaagc

SEQ ID NO: 136088 - DNA, 22 bp, Artificial Sequence
  Synthetic oligonucleotide; CTG chr11 5269471 5269492 5269476 5269471 -
cactgtgacaagctgcatgtgg

SEQ ID NO: 136089 - DNA, 22 bp, Artificial Sequence
  Synthetic oligonucleotide; CTG chr11 5269466 5269487 5269471 5269466 -
tgacaagctgcatgtggatcct

SEQ ID NO: 136090 - DNA, 22 bp, Artificial Sequence
  Synthetic oligonucleotide; CTG chr11 5269456 5269477 5269461 5269456 -
catgtggatcctgagaacttca

SEQ ID NO: 136091 - DNA, 22 bp, Artificial Sequence
  Synthetic oligonucleotide; CTG chr11 5269443 5269464 5269448 5269443 -
agaacttcaaggtgagttcagg

SEQ ID NO: 136092 - DNA, 22 bp, Artificial Sequence
  Synthetic oligonucleotide; CTT chr11 5269436 5269457 5269441 5269436 -
caaggtgagttcaggtgctggt

SEQ ID NO: 136093 - DNA, 22 bp, Artificial Sequence
  Synthetic oligonucleotide; TTC chr11 5269435 5269456 5269440 5269435 -
aaggtgagttcaggtgctggtg

SEQ ID NO: 136094 - DNA, 22 bp, Artificial Sequence
  Synthetic oligonucleotide; TTC chr11 5269424 5269445 5269429 5269424 -
aggtgctggtgatgtgattttt

SEQ ID NO: 136095 - DNA, 22 bp, Artificial Sequence
  Synthetic oligonucleotide; CTG chr11 5269416 5269437 5269421 5269416 -
gtgatgtgattttttggcttta

SEQ ID NO: 136096 - DNA, 22 bp, Artificial Sequence
  Synthetic oligonucleotide; TTT chr11 5269404 5269425 5269409 5269404 -
tttggctttatattttgacatt

SEQ ID NO: 136097 - DNA, 22 bp, Artificial Sequence
  Synthetic oligonucleotide; TTT chr11 5269403 5269424 5269408 5269403 -
ttggctttatattttgacatta

SEQ ID NO: 136098 - DNA, 22 bp, Artificial Sequence
  Synthetic oligonucleotide; TTT chr11 5269402 5269423 5269407 5269402 -
tggctttatattttgacattaa

SEQ ID NO: 136099 - DNA, 22 bp, Artificial Sequence
  Synthetic oligonucleotide; TTT chr11 5269401 5269422 5269406 5269401 -
ggctttatattttgacattaat

SEQ ID NO: 136100 - DNA, 22 bp, Artificial Sequence
  Synthetic oligonucleotide; TTG chr11 5269400 5269421 5269405 5269400 -
gctttatattttgacattaatt

SEQ ID NO: 136101 - DNA, 22 bp, Artificial Sequence
  Synthetic oligonucleotide; CTT chr11 5269396 5269417 5269401 5269396 -
tatattttgacattaattgaag

SEQ ID NO: 136102 - DNA, 22 bp, Artificial Sequence
  Synthetic oligonucleotide; TTT chr11 5269395 5269416 5269400 5269395 -
atattttgacattaattgaagc

SEQ ID NO: 136103 - DNA, 22 bp, Artificial Sequence
  Synthetic oligonucleotide; TTA chr11 5269394 5269415 5269399 5269394 -
tattttgacattaattgaagct

SEQ ID NO: 136104 - DNA, 22 bp, Artificial Sequence
  Synthetic oligonucleotide; TTT chr11 5269389 5269410 5269394 5269389 -
tgacattaattgaagctcataa

SEQ ID NO: 136105 - DNA, 22 bp, Artificial Sequence
  Synthetic oligonucleotide; TTT chr11 5269388 5269409 5269393 5269388 -
gacattaattgaagctcataat

SEQ ID NO: 136106 - DNA, 22 bp, Artificial Sequence
  Synthetic oligonucleotide; TTG chr11 5269387 5269408 5269392 5269387 -
acattaattgaagctcataatc

SEQ ID NO: 136107 - DNA, 22 bp, Artificial Sequence
  Synthetic oligonucleotide; TTA chr11 5269381 5269402 5269386 5269381 -
attgaagctcataatcttattg

SEQ ID NO: 136108 - DNA, 22 bp, Artificial Sequence
  Synthetic oligonucleotide; TTG chr11 5269377 5269398 5269382 5269377 -
aagctcataatcttattggaaa

SEQ ID NO: 136109 - DNA, 22 bp, Artificial Sequence
  Synthetic oligonucleotide; CTC chr11 5269371 5269392 5269376 5269371 -
ataatcttattggaaagaccaa

SEQ ID NO: 136110 - DNA, 22 bp, Artificial Sequence
  Synthetic oligonucleotide; CTT chr11 5269363 5269384 5269368 5269363 -
attggaaagaccaacaaagatc

SEQ ID NO: 136111 - DNA, 22 bp, Artificial Sequence
  Synthetic oligonucleotide; TTA chr11 5269362 5269383 5269367 5269362 -
ttggaaagaccaacaaagatct

SEQ ID NO: 136112 - DNA, 22 bp, Artificial Sequence
  Synthetic oligonucleotide; TTG chr11 5269359 5269380 5269364 5269359 -
gaaagaccaacaaagatctcag

SEQ ID NO: 136113 - DNA, 22 bp, Artificial Sequence
  Synthetic oligonucleotide; CTC chr11 5269339 5269360 5269344 5269339 -
agaaatcatgggtcgagcttga

SEQ ID NO: 136114 - DNA, 22 bp, Artificial Sequence
  Synthetic oligonucleotide; CTT chr11 5269319 5269340 5269324 5269319 -
gatgttagaacagcagacttct

SEQ ID NO: 136115 - DNA, 22 bp, Artificial Sequence
  Synthetic oligonucleotide; TTG chr11 5269318 5269339 5269323 5269318 -
atgttagaacagcagacttcta

SEQ ID NO: 136116 - DNA, 22 bp, Artificial Sequence
  Synthetic oligonucleotide; TTA chr11 5269312 5269333 5269317 5269312 -
gaacagcagacttctagtgagc

SEQ ID NO: 136117 - DNA, 22 bp, Artificial Sequence
  Synthetic oligonucleotide; CTT chr11 5269299 5269320 5269304 5269299 -
ctagtgagcataaccaaaactt

SEQ ID NO: 136118 - DNA, 22 bp, Artificial Sequence
  Synthetic oligonucleotide; TTC chr11 5269298 5269319 5269303 5269298 -
tagtgagcataaccaaaactta

SEQ ID NO: 136119 - DNA, 22 bp, Artificial Sequence
  Synthetic oligonucleotide; CTA chr11 5269296 5269317 5269301 5269296 -
gtgagcataaccaaaacttaca

SEQ ID NO: 136120 - DNA, 22 bp, Artificial Sequence
  Synthetic oligonucleotide; CTT chr11 5269277 5269298 5269282 5269277 -
acatgattcagaactagtgaca

SEQ ID NO: 136121 - DNA, 22 bp, Artificial Sequence
  Synthetic oligonucleotide; TTA chr11 5269276 5269297 5269281 5269276 -
catgattcagaactagtgacag

SEQ ID NO: 136122 - DNA, 22 bp, Artificial Sequence
  Synthetic oligonucleotide; TTC chr11 5269268 5269289 5269273 5269268 -
agaactagtgacagtaaaggac

SEQ ID NO: 136123 - DNA, 22 bp, Artificial Sequence
  Synthetic oligonucleotide; CTA chr11 5269261 5269282 5269266 5269261 -
gtgacagtaaaggactactaac

SEQ ID NO: 136124 - DNA, 22 bp, Artificial Sequence
  Synthetic oligonucleotide; CTA chr11 5269244 5269265 5269249 5269244 -
ctaacagcctgaattggcttaa

SEQ ID NO: 136125 - DNA, 22 bp, Artificial Sequence
  Synthetic oligonucleotide; CTA chr11 5269241 5269262 5269246 5269241 -
acagcctgaattggcttaactt

SEQ ID NO: 136126 - DNA, 22 bp, Artificial Sequence
  Synthetic oligonucleotide; CTG chr11 5269233 5269254 5269238 5269233 -
aattggcttaacttttcaggaa

SEQ ID NO: 136127 - DNA, 22 bp, Artificial Sequence
  Synthetic oligonucleotide; TTG chr11 5269228 5269249 5269233 5269228 -
gcttaacttttcaggaaatctt

SEQ ID NO: 136128 - DNA, 22 bp, Artificial Sequence
  Synthetic oligonucleotide; CTT chr11 5269224 5269245 5269229 5269224 -
aacttttcaggaaatcttgcca

SEQ ID NO: 136129 - DNA, 22 bp, Artificial Sequence
  Synthetic oligonucleotide; TTA chr11 5269223 5269244 5269228 5269223 -
acttttcaggaaatcttgccag

SEQ ID NO: 136130 - DNA, 22 bp, Artificial Sequence
  Synthetic oligonucleotide; CTT chr11 5269219 5269240 5269224 5269219 -
ttcaggaaatcttgccagaact

SEQ ID NO: 136131 - DNA, 22 bp, Artificial Sequence
  Synthetic oligonucleotide; TTT chr11 5269218 5269239 5269223 5269218 -
tcaggaaatcttgccagaactt

SEQ ID NO: 136132 - DNA, 22 bp, Artificial Sequence
  Synthetic oligonucleotide; TTT chr11 5269217 5269238 5269222 5269217 -
caggaaatcttgccagaacttg

SEQ ID NO: 136133 - DNA, 22 bp, Artificial Sequence
  Synthetic oligonucleotide; TTC chr11 5269216 5269237 5269221 5269216 -
aggaaatcttgccagaacttga

SEQ ID NO: 136134 - DNA, 22 bp, Artificial Sequence
  Synthetic oligonucleotide; CTT chr11 5269206 5269227 5269211 5269206 -
gccagaacttgatgtgtttatc

SEQ ID NO: 136135 - DNA, 22 bp, Artificial Sequence
  Synthetic oligonucleotide; TTG chr11 5269205 5269226 5269210 5269205 -
ccagaacttgatgtgtttatcc

SEQ ID NO: 136136 - DNA, 22 bp, Artificial Sequence
  Synthetic oligonucleotide; CTT chr11 5269196 5269217 5269201 5269196 -
gatgtgtttatcccagagaatt

SEQ ID NO: 136137 - DNA, 22 bp, Artificial Sequence
  Synthetic oligonucleotide; TTG chr11 5269195 5269216 5269200 5269195 -
atgtgtttatcccagagaattg

SEQ ID NO: 136138 - DNA, 22 bp, Artificial Sequence
  Synthetic oligonucleotide; TTT chr11 5269187 5269208 5269192 5269187 -
atcccagagaattgtattatag

SEQ ID NO: 136139 - DNA, 22 bp, Artificial Sequence
  Synthetic oligonucleotide; TTA chr11 5269186 5269207 5269191 5269186 -
tcccagagaattgtattataga

SEQ ID NO: 136140 - DNA, 22 bp, Artificial Sequence
  Synthetic oligonucleotide; TTG chr11 5269173 5269194 5269178 5269173 -
tattatagaattgtagacttgt

SEQ ID NO: 136141 - DNA, 22 bp, Artificial Sequence
  Synthetic oligonucleotide; TTA chr11 5269168 5269189 5269173 5269168 -
tagaattgtagacttgtgaaag

SEQ ID NO: 136142 - DNA, 22 bp, Artificial Sequence
  Synthetic oligonucleotide; TTG chr11 5269160 5269181 5269165 5269160 -
tagacttgtgaaagaagaatga

SEQ ID NO: 136143 - DNA, 22 bp, Artificial Sequence
  Synthetic oligonucleotide; CTT chr11 5269153 5269174 5269158 5269153 -
gtgaaagaagaatgaaatttgg

SEQ ID NO: 136144 - DNA, 22 bp, Artificial Sequence
  Synthetic oligonucleotide; TTG chr11 5269152 5269173 5269157 5269152 -
tgaaagaagaatgaaatttggc

SEQ ID NO: 136145 - DNA, 22 bp, Artificial Sequence
  Synthetic oligonucleotide; TTT chr11 5269133 5269154 5269138 5269133 -
ggcttttggtagatgaaagtcc

SEQ ID NO: 136146 - DNA, 22 bp, Artificial Sequence
  Synthetic oligonucleotide; TTG chr11 5269132 5269153 5269137 5269132 -
gcttttggtagatgaaagtcca

SEQ ID NO: 136147 - DNA, 22 bp, Artificial Sequence
  Synthetic oligonucleotide; CTT chr11 5269128 5269149 5269133 5269128 -
ttggtagatgaaagtccatttc

SEQ ID NO: 136148 - DNA, 22 bp, Artificial Sequence
  Synthetic oligonucleotide; TTT chr11 5269127 5269148 5269132 5269127 -
tggtagatgaaagtccatttca

SEQ ID NO: 136149 - DNA, 22 bp, Artificial Sequence
  Synthetic oligonucleotide; TTT chr11 5269126 5269147 5269131 5269126 -
ggtagatgaaagtccatttcaa

SEQ ID NO: 136150 - DNA, 22 bp, Artificial Sequence
  Synthetic oligonucleotide; TTG chr11 5269125 5269146 5269130 5269125 -
gtagatgaaagtccatttcaag

SEQ ID NO: 136151 - DNA, 22 bp, Artificial Sequence
  Synthetic oligonucleotide; TTT chr11 5269107 5269128 5269112 5269107 -
caaggaaatagaaatgccttat

SEQ ID NO: 136152 - DNA, 22 bp, Artificial Sequence
  Synthetic oligonucleotide; TTC chr11 5269106 5269127 5269111 5269106 -
aaggaaatagaaatgccttatt

SEQ ID NO: 136153 - DNA, 22 bp, Artificial Sequence
  Synthetic oligonucleotide; CTT chr11 5269087 5269108 5269092 5269087 -
attttatgtgggtcatgataat

SEQ ID NO: 136154 - DNA, 22 bp, Artificial Sequence
  Synthetic oligonucleotide; TTA chr11 5269086 5269107 5269091 5269086 -
ttttatgtgggtcatgataatt

SEQ ID NO: 136155 - DNA, 22 bp, Artificial Sequence
  Synthetic oligonucleotide; TTT chr11 5269083 5269104 5269088 5269083 -
tatgtgggtcatgataattgag

SEQ ID NO: 136156 - DNA, 22 bp, Artificial Sequence
  Synthetic oligonucleotide; TTT chr11 5269082 5269103 5269087 5269082 -
atgtgggtcatgataattgagg

SEQ ID NO: 136157 - DNA, 22 bp, Artificial Sequence
  Synthetic oligonucleotide; TTA chr11 5269081 5269102 5269086 5269081 -
tgtgggtcatgataattgaggt

SEQ ID NO: 136158 - DNA, 22 bp, Artificial Sequence
  Synthetic oligonucleotide; TTG chr11 5269063 5269084 5269068 5269063 -
aggtttagaaagagatttttgc

SEQ ID NO: 136159 - DNA, 22 bp, Artificial Sequence
  Synthetic oligonucleotide; TTT chr11 5269057 5269078 5269062 5269057 -
agaaagagatttttgcaaaaaa

SEQ ID NO: 136160 - DNA, 22 bp, Artificial Sequence
  Synthetic oligonucleotide; TTA chr11 5269056 5269077 5269061 5269056 -
gaaagagatttttgcaaaaaaa

SEQ ID NO: 136161 - DNA, 22 bp, Artificial Sequence
  Synthetic oligonucleotide; TTT chr11 5269045 5269066 5269050 5269045 -
ttgcaaaaaaaataaaagattt

SEQ ID NO: 136162 - DNA, 22 bp, Artificial Sequence
  Synthetic oligonucleotide; TTT chr11 5269044 5269065 5269049 5269044 -
tgcaaaaaaaataaaagatttg

SEQ ID NO: 136163 - DNA, 22 bp, Artificial Sequence
  Synthetic oligonucleotide; TTT chr11 5269043 5269064 5269048 5269043 -
gcaaaaaaaataaaagatttgc

SEQ ID NO: 136164 - DNA, 22 bp, Artificial Sequence
  Synthetic oligonucleotide; TTG chr11 5269042 5269063 5269047 5269042 -
caaaaaaaataaaagatttgct

SEQ ID NO: 136165 - DNA, 22 bp, Artificial Sequence
  Synthetic oligonucleotide; TTT chr11 5269023 5269044 5269028 5269023 -
gctcaaagaaaaataagacaca

SEQ ID NO: 136166 - DNA, 22 bp, Artificial Sequence
  Synthetic oligonucleotide; TTG chr11 5269022 5269043 5269027 5269022 -
ctcaaagaaaaataagacacat

SEQ ID NO: 136167 - DNA, 22 bp, Artificial Sequence
  Synthetic oligonucleotide; CTC chr11 5269019 5269040 5269024 5269019 -
aaagaaaaataagacacatttt

SEQ ID NO: 136168 - DNA, 22 bp, Artificial Sequence
  Synthetic oligonucleotide; TTT chr11 5268998 5269019 5269003 5268998 -
tctaaaatatgttaaatttccc

SEQ ID NO: 136169 - DNA, 22 bp, Artificial Sequence
  Synthetic oligonucleotide; TTT chr11 5268997 5269018 5269002 5268997 -
ctaaaatatgttaaatttccca

SEQ ID NO: 136170 - DNA, 22 bp, Artificial Sequence
  Synthetic oligonucleotide; TTC chr11 5268996 5269017 5269001 5268996 -
taaaatatgttaaatttcccat

SEQ ID NO: 136171 - DNA, 22 bp, Artificial Sequence
  Synthetic oligonucleotide; CTA chr11 5268994 5269015 5268999 5268994 -
aaatatgttaaatttcccatca

SEQ ID NO: 136172 - DNA, 22 bp, Artificial Sequence
  Synthetic oligonucleotide; TTA chr11 5268984 5269005 5268989 5268984 -
aatttcccatcagtattgtgac

SEQ ID NO: 136173 - DNA, 22 bp, Artificial Sequence
  Synthetic oligonucleotide; TTT chr11 5268979 5269000 5268984 5268979 -
cccatcagtattgtgaccaagt

SEQ ID NO: 136174 - DNA, 22 bp, Artificial Sequence
  Synthetic oligonucleotide; TTC chr11 5268978 5268999 5268983 5268978 -
ccatcagtattgtgaccaagtg

SEQ ID NO: 136175 - DNA, 22 bp, Artificial Sequence
  Synthetic oligonucleotide; TTG chr11 5268966 5268987 5268971 5268966 -
tgaccaagtgaaggcttgtttc

SEQ ID NO: 136176 - DNA, 22 bp, Artificial Sequence
  Synthetic oligonucleotide; CTT chr11 5268949 5268970 5268954 5268949 -
gtttccgaatttgttggggatt

SEQ ID NO: 136177 - DNA, 22 bp, Artificial Sequence
  Synthetic oligonucleotide; TTG chr11 5268948 5268969 5268953 5268948 -
tttccgaatttgttggggattt

SEQ ID NO: 136178 - DNA, 22 bp, Artificial Sequence
  Synthetic oligonucleotide; TTT chr11 5268945 5268966 5268950 5268945 -
ccgaatttgttggggattttaa

SEQ ID NO: 136179 - DNA, 22 bp, Artificial Sequence
  Synthetic oligonucleotide; TTC chr11 5268944 5268965 5268949 5268944 -
cgaatttgttggggattttaaa

SEQ ID NO: 136180 - DNA, 22 bp, Artificial Sequence
  Synthetic oligonucleotide; TTT chr11 5268937 5268958 5268942 5268937 -
gttggggattttaaactcccgc

SEQ ID NO: 136181 - DNA, 22 bp, Artificial Sequence
  Synthetic oligonucleotide; TTG chr11 5268936 5268957 5268941 5268936 -
ttggggattttaaactcccgct

SEQ ID NO: 136182 - DNA, 22 bp, Artificial Sequence
  Synthetic oligonucleotide; TTG chr11 5268933 5268954 5268938 5268933 -
gggattttaaactcccgctgag

SEQ ID NO: 136183 - DNA, 22 bp, Artificial Sequence
  Synthetic oligonucleotide; TTT chr11 5268926 5268947 5268931 5268926 -
taaactcccgctgagaactctt

SEQ ID NO: 136184 - DNA, 22 bp, Artificial Sequence
  Synthetic oligonucleotide; TTT chr11 5268925 5268946 5268930 5268925 -
aaactcccgctgagaactcttg

SEQ ID NO: 136185 - DNA, 22 bp, Artificial Sequence
  Synthetic oligonucleotide; TTA chr11 5268924 5268945 5268929 5268924 -
aactcccgctgagaactcttgc

SEQ ID NO: 136186 - DNA, 22 bp, Artificial Sequence
  Synthetic oligonucleotide; CTC chr11 5268919 5268940 5268924 5268919 -
ccgctgagaactcttgcagcac

SEQ ID NO: 136187 - DNA, 22 bp, Artificial Sequence
  Synthetic oligonucleotide; CTG chr11 5268913 5268934 5268918 5268913 -
agaactcttgcagcactcacat

SEQ ID NO: 136188 - DNA, 22 bp, Artificial Sequence
  Synthetic oligonucleotide; CTC chr11 5268906 5268927 5268911 5268906 -
ttgcagcactcacattctacat

SEQ ID NO: 136189 - DNA, 22 bp, Artificial Sequence
  Synthetic oligonucleotide; CTT chr11 5268904 5268925 5268909 5268904 -
gcagcactcacattctacattt

SEQ ID NO: 136190 - DNA, 22 bp, Artificial Sequence
  Synthetic oligonucleotide; TTG chr11 5268903 5268924 5268908 5268903 -
cagcactcacattctacattta

SEQ ID NO: 136191 - DNA, 22 bp, Artificial Sequence
  Synthetic oligonucleotide; CTC chr11 5268895 5268916 5268900 5268895 -
acattctacatttacaaaaatt

SEQ ID NO: 136192 - DNA, 22 bp, Artificial Sequence
  Synthetic oligonucleotide; TTC chr11 5268889 5268910 5268894 5268889 -
tacatttacaaaaattagacaa

SEQ ID NO: 136193 - DNA, 22 bp, Artificial Sequence
  Synthetic oligonucleotide; CTA chr11 5268887 5268908 5268892 5268887 -
catttacaaaaattagacaatt

SEQ ID NO: 136194 - DNA, 22 bp, Artificial Sequence
  Synthetic oligonucleotide; TTT chr11 5268882 5268903 5268887 5268882 -
acaaaaattagacaattgctta

SEQ ID NO: 136195 - DNA, 22 bp, Artificial Sequence
  Synthetic oligonucleotide; TTA chr11 5268881 5268902 5268886 5268881 -
caaaaattagacaattgcttaa

SEQ ID NO: 136196 - DNA, 22 bp, Artificial Sequence
  Synthetic oligonucleotide; TTA chr11 5268872 5268893 5268877 5268872 -
gacaattgcttaaagaaaaaca

SEQ ID NO: 136197 - DNA, 22 bp, Artificial Sequence
  Synthetic oligonucleotide; TTG chr11 5268864 5268885 5268869 5268864 -
cttaaagaaaaacagggagaga

SEQ ID NO: 136198 - DNA, 22 bp, Artificial Sequence
  Synthetic oligonucleotide; CTT chr11 5268861 5268882 5268866 5268861 -
aaagaaaaacagggagagaggg

SEQ ID NO: 136199 - DNA, 22 bp, Artificial Sequence
  Synthetic oligonucleotide; TTA chr11 5268860 5268881 5268865 5268860 -
aagaaaaacagggagagaggga

SEQ ID NO: 136200 - DNA, 22 bp, Artificial Sequence
  Synthetic oligonucleotide; CTG chr11 5268824 5268845 5268829 5268824 -
gtaaaatggggaagggggtgag

SEQ ID NO: 136201 - DNA, 22 bp, Artificial Sequence
  Synthetic oligonucleotide; TTG chr11 5268780 5268801 5268785 5268780 -
aatgtagggctcatagaataaa

SEQ ID NO: 136202 - DNA, 22 bp, Artificial Sequence
  Synthetic oligonucleotide; CTC chr11 5268768 5268789 5268773 5268768 -
atagaataaaattgaacctaag

SEQ ID NO: 136203 - DNA, 22 bp, Artificial Sequence
  Synthetic oligonucleotide; TTG chr11 5268754 5268775 5268759 5268754 -
aacctaagctcatctgaatttt

SEQ ID NO: 136204 - DNA, 22 bp, Artificial Sequence
  Synthetic oligonucleotide; CTA chr11 5268748 5268769 5268753 5268748 -
agctcatctgaattttttgggt

SEQ ID NO: 136205 - DNA, 22 bp, Artificial Sequence
  Synthetic oligonucleotide; CTC chr11 5268743 5268764 5268748 5268743 -
atctgaattttttgggtgggca

SEQ ID NO: 136206 - DNA, 22 bp, Artificial Sequence
  Synthetic oligonucleotide; CTG chr11 5268738 5268759 5268743 5268738 -
aattttttgggtgggcacaaac

SEQ ID NO: 136207 - DNA, 22 bp, Artificial Sequence
  Synthetic oligonucleotide; TTT chr11 5268733 5268754 5268738 5268733 -
tttgggtgggcacaaaccttgg

SEQ ID NO: 136208 - DNA, 22 bp, Artificial Sequence
  Synthetic oligonucleotide; TTT chr11 5268732 5268753 5268737 5268732 -
ttgggtgggcacaaaccttgga

SEQ ID NO: 136209 - DNA, 22 bp, Artificial Sequence
  Synthetic oligonucleotide; TTT chr11 5268731 5268752 5268736 5268731 -
tgggtgggcacaaaccttggaa

SEQ ID NO: 136210 - DNA, 22 bp, Artificial Sequence
  Synthetic oligonucleotide; TTT chr11 5268730 5268751 5268735 5268730 -
gggtgggcacaaaccttggaac

SEQ ID NO: 136211 - DNA, 22 bp, Artificial Sequence
  Synthetic oligonucleotide; TTG chr11 5268729 5268750 5268734 5268729 -
ggtgggcacaaaccttggaaca

SEQ ID NO: 136212 - DNA, 22 bp, Artificial Sequence
  Synthetic oligonucleotide; CTT chr11 5268713 5268734 5268718 5268713 -
ggaacagtttgaggtcagggtt

SEQ ID NO: 136213 - DNA, 22 bp, Artificial Sequence
  Synthetic oligonucleotide; TTG chr11 5268712 5268733 5268717 5268712 -
gaacagtttgaggtcagggttg

SEQ ID NO: 136214 - DNA, 22 bp, Artificial Sequence
  Synthetic oligonucleotide; TTT chr11 5268703 5268724 5268708 5268703 -
gaggtcagggttgtctaggaat

SEQ ID NO: 136215 - DNA, 22 bp, Artificial Sequence
  Synthetic oligonucleotide; TTG chr11 5268702 5268723 5268707 5268702 -
aggtcagggttgtctaggaatg

SEQ ID NO: 136216 - DNA, 22 bp, Artificial Sequence
  Synthetic oligonucleotide; TTG chr11 5268690 5268711 5268695 5268690 -
tctaggaatgtaggtataaagc

SEQ ID NO: 136217 - DNA, 22 bp, Artificial Sequence
  Synthetic oligonucleotide; CTA chr11 5268686 5268707 5268691 5268686 -
ggaatgtaggtataaagccgtt

SEQ ID NO: 136218 - DNA, 22 bp, Artificial Sequence
  Synthetic oligonucleotide; TTT chr11 5268663 5268684 5268668 5268663 -
ttgtttgtttgtttgttttttc

SEQ ID NO: 136219 - DNA, 22 bp, Artificial Sequence
  Synthetic oligonucleotide; TTT chr11 5268662 5268683 5268667 5268662 -
tgtttgtttgtttgttttttca

SEQ ID NO: 136220 - DNA, 22 bp, Artificial Sequence
  Synthetic oligonucleotide; TTT chr11 5268661 5268682 5268666 5268661 -
gtttgtttgtttgttttttcat

SEQ ID NO: 136221 - DNA, 22 bp, Artificial Sequence
  Synthetic oligonucleotide; TTG chr11 5268660 5268681 5268665 5268660 -
tttgtttgtttgttttttcatc

SEQ ID NO: 136222 - DNA, 22 bp, Artificial Sequence
  Synthetic oligonucleotide; TTT chr11 5268657 5268678 5268662 5268657 -
gtttgtttgttttttcatcaag

SEQ ID NO: 136223 - DNA, 22 bp, Artificial Sequence
  Synthetic oligonucleotide; TTG chr11 5268656 5268677 5268661 5268656 -
tttgtttgttttttcatcaagt

SEQ ID NO: 136224 - DNA, 22 bp, Artificial Sequence
  Synthetic oligonucleotide; TTT chr11 5268653 5268674 5268658 5268653 -
gtttgttttttcatcaagttgt

SEQ ID NO: 136225 - DNA, 22 bp, Artificial Sequence
  Synthetic oligonucleotide; TTG chr11 5268652 5268673 5268657 5268652 -
tttgttttttcatcaagttgtt

SEQ ID NO: 136226 - DNA, 22 bp, Artificial Sequence
  Synthetic oligonucleotide; TTT chr11 5268649 5268670 5268654 5268649 -
gttttttcatcaagttgttttc

SEQ ID NO: 136227 - DNA, 22 bp, Artificial Sequence
  Synthetic oligonucleotide; TTG chr11 5268648 5268669 5268653 5268648 -
ttttttcatcaagttgttttcg

SEQ ID NO: 136228 - DNA, 22 bp, Artificial Sequence
  Synthetic oligonucleotide; TTT chr11 5268645 5268666 5268650 5268645 -
tttcatcaagttgttttcggaa

SEQ ID NO: 136229 - DNA, 22 bp, Artificial Sequence
  Synthetic oligonucleotide; TTT chr11 5268644 5268665 5268649 5268644 -
ttcatcaagttgttttcggaaa

SEQ ID NO: 136230 - DNA, 22 bp, Artificial Sequence
  Synthetic oligonucleotide; TTT chr11 5268643 5268664 5268648 5268643 -
tcatcaagttgttttcggaaac

SEQ ID NO: 136231 - DNA, 22 bp, Artificial Sequence
  Synthetic oligonucleotide; TTT chr11 5268642 5268663 5268647 5268642 -
catcaagttgttttcggaaact

SEQ ID NO: 136232 - DNA, 22 bp, Artificial Sequence
  Synthetic oligonucleotide; TTC chr11 5268641 5268662 5268646 5268641 -
atcaagttgttttcggaaactt

SEQ ID NO: 136233 - DNA, 22 bp, Artificial Sequence
  Synthetic oligonucleotide; TTG chr11 5268632 5268653 5268637 5268632 -
ttttcggaaacttctactcaac

SEQ ID NO: 136234 - DNA, 22 bp, Artificial Sequence
  Synthetic oligonucleotide; TTT chr11 5268629 5268650 5268634 5268629 -
tcggaaacttctactcaacatg

SEQ ID NO: 136235 - DNA, 22 bp, Artificial Sequence
  Synthetic oligonucleotide; TTT chr11 5268628 5268649 5268633 5268628 -
cggaaacttctactcaacatgc

SEQ ID NO: 136236 - DNA, 22 bp, Artificial Sequence
  Synthetic oligonucleotide; TTC chr11 5268627 5268648 5268632 5268627 -
ggaaacttctactcaacatgcc

SEQ ID NO: 136237 - DNA, 22 bp, Artificial Sequence
  Synthetic oligonucleotide; CTT chr11 5268619 5268640 5268624 5268619 -
ctactcaacatgcctgtgtgtt

SEQ ID NO: 136238 - DNA, 22 bp, Artificial Sequence
  Synthetic oligonucleotide; TTC chr11 5268618 5268639 5268623 5268618 -
tactcaacatgcctgtgtgtta

SEQ ID NO: 136239 - DNA, 22 bp, Artificial Sequence
  Synthetic oligonucleotide; CTA chr11 5268616 5268637 5268621 5268616 -
ctcaacatgcctgtgtgttatt

SEQ ID NO: 136240 - DNA, 22 bp, Artificial Sequence
  Synthetic oligonucleotide; CTC chr11 5268613 5268634 5268618 5268613 -
aacatgcctgtgtgttattttg

SEQ ID NO: 136241 - DNA, 22 bp, Artificial Sequence
  Synthetic oligonucleotide; CTG chr11 5268603 5268624 5268608 5268603 -
tgtgttattttgtcttttgcct

SEQ ID NO: 136242 - DNA, 22 bp, Artificial Sequence
  Synthetic oligonucleotide; TTA chr11 5268596 5268617 5268601 5268596 -
ttttgtcttttgcctaacagct

SEQ ID NO: 136243 - DNA, 22 bp, Artificial Sequence
  Synthetic oligonucleotide; TTT chr11 5268593 5268614 5268598 5268593 -
tgtcttttgcctaacagctcct

SEQ ID NO: 136244 - DNA, 22 bp, Artificial Sequence
  Synthetic oligonucleotide; TTT chr11 5268592 5268613 5268597 5268592 -
gtcttttgcctaacagctcctg

SEQ ID NO: 136245 - DNA, 22 bp, Artificial Sequence
  Synthetic oligonucleotide; TTG chr11 5268591 5268612 5268596 5268591 -
tcttttgcctaacagctcctgg

SEQ ID NO: 136246 - DNA, 22 bp, Artificial Sequence
  Synthetic oligonucleotide; CTT chr11 5268587 5268608 5268592 5268587 -
ttgcctaacagctcctgggtaa

SEQ ID NO: 136247 - DNA, 22 bp, Artificial Sequence
  Synthetic oligonucleotide; TTT chr11 5268586 5268607 5268591 5268586 -
tgcctaacagctcctgggtaac

SEQ ID NO: 136248 - DNA, 22 bp, Artificial Sequence
  Synthetic oligonucleotide; TTT chr11 5268585 5268606 5268590 5268585 -
gcctaacagctcctgggtaacg

SEQ ID NO: 136249 - DNA, 22 bp, Artificial Sequence
  Synthetic oligonucleotide; TTG chr11 5268584 5268605 5268589 5268584 -
cctaacagctcctgggtaacgt

SEQ ID NO: 136250 - DNA, 22 bp, Artificial Sequence
  Synthetic oligonucleotide; CTA chr11 5268580 5268601 5268585 5268580 -
acagctcctgggtaacgtgatg

SEQ ID NO: 136251 - DNA, 22 bp, Artificial Sequence
  Synthetic oligonucleotide; CTC chr11 5268573 5268594 5268578 5268573 -
ctgggtaacgtgatggtgatta

SEQ ID NO: 136252 - DNA, 22 bp, Artificial Sequence
  Synthetic oligonucleotide; CTG chr11 5268570 5268591 5268575 5268570 -
ggtaacgtgatggtgattattc

SEQ ID NO: 136253 - DNA, 22 bp, Artificial Sequence
  Synthetic oligonucleotide; TTA chr11 5268551 5268572 5268556 5268551 -
ttctggctactcactttggcaa

SEQ ID NO: 136254 - DNA, 22 bp, Artificial Sequence
  Synthetic oligonucleotide; TTC chr11 5268548 5268569 5268553 5268548 -
tggctactcactttggcaagga

SEQ ID NO: 136255 - DNA, 22 bp, Artificial Sequence
  Synthetic oligonucleotide; CTG chr11 5268546 5268567 5268551 5268546 -
gctactcactttggcaaggagt

SEQ ID NO: 136256 - DNA, 22 bp, Artificial Sequence
  Synthetic oligonucleotide; CTA chr11 5268542 5268563 5268547 5268542 -
ctcactttggcaaggagttcac

SEQ ID NO: 136257 - DNA, 22 bp, Artificial Sequence
  Synthetic oligonucleotide; CTC chr11 5268539 5268560 5268544 5268539 -
actttggcaaggagttcacccc

SEQ ID NO: 136258 - DNA, 22 bp, Artificial Sequence
  Synthetic oligonucleotide; CTT chr11 5268535 5268556 5268540 5268535 -
tggcaaggagttcacccctgaa

SEQ ID NO: 136259 - DNA, 22 bp, Artificial Sequence
  Synthetic oligonucleotide; TTT chr11 5268534 5268555 5268539 5268534 -
ggcaaggagttcacccctgaag

SEQ ID NO: 136260 - DNA, 22 bp, Artificial Sequence
  Synthetic oligonucleotide; TTG chr11 5268533 5268554 5268538 5268533 -
gcaaggagttcacccctgaagt

SEQ ID NO: 136261 - DNA, 22 bp, Artificial Sequence
  Synthetic oligonucleotide; TTC chr11 5268522 5268543 5268527 5268522 -
acccctgaagtgcaggctgcct

SEQ ID NO: 136262 - DNA, 22 bp, Artificial Sequence
  Synthetic oligonucleotide; CTG chr11 5268515 5268536 5268520 5268515 -
aagtgcaggctgcctggcagaa

SEQ ID NO: 136263 - DNA, 22 bp, Artificial Sequence
  Synthetic oligonucleotide; CTG chr11 5268503 5268524 5268508 5268503 -
cctggcagaagctggtgtctgc

SEQ ID NO: 136264 - DNA, 22 bp, Artificial Sequence
  Synthetic oligonucleotide; CTG chr11 5268499 5268520 5268504 5268499 -
gcagaagctggtgtctgctgtc

SEQ ID NO: 136265 - DNA, 22 bp, Artificial Sequence
  Synthetic oligonucleotide; CTG chr11 5268489 5268510 5268494 5268489 -
gtgtctgctgtcgccattgccc

SEQ ID NO: 136266 - DNA, 22 bp, Artificial Sequence
  Synthetic oligonucleotide; CTG chr11 5268482 5268503 5268487 5268482 -
ctgtcgccattgccctggccca

SEQ ID NO: 136267 - DNA, 22 bp, Artificial Sequence
  Synthetic oligonucleotide; CTG chr11 5268479 5268500 5268484 5268479 -
tcgccattgccctggcccataa

SEQ ID NO: 136268 - DNA, 22 bp, Artificial Sequence
  Synthetic oligonucleotide; TTG chr11 5268470 5268491 5268475 5268470 -
ccctggcccataagtaccactg

SEQ ID NO: 136269 - DNA, 22 bp, Artificial Sequence
  Synthetic oligonucleotide; CTG chr11 5268465 5268486 5268470 5268465 -
gcccataagtaccactgagttc

SEQ ID NO: 136270 - DNA, 22 bp, Artificial Sequence
  Synthetic oligonucleotide; CTG chr11 5268448 5268469 5268453 5268448 -
agttctcttccagtttgcaggt

SEQ ID NO: 136271 - DNA, 22 bp, Artificial Sequence
  Synthetic oligonucleotide; TTC chr11 5268443 5268464 5268448 5268443 -
tcttccagtttgcaggtgttcc

SEQ ID NO: 136272 - DNA, 22 bp, Artificial Sequence
  Synthetic oligonucleotide; CTC chr11 5268441 5268462 5268446 5268441 -
ttccagtttgcaggtgttcctg

SEQ ID NO: 136273 - DNA, 22 bp, Artificial Sequence
  Synthetic oligonucleotide; CTT chr11 5268439 5268460 5268444 5268439 -
ccagtttgcaggtgttcctgtg

SEQ ID NO: 136274 - DNA, 22 bp, Artificial Sequence
  Synthetic oligonucleotide; TTC chr11 5268438 5268459 5268443 5268438 -
cagtttgcaggtgttcctgtga

SEQ ID NO: 136275 - DNA, 22 bp, Artificial Sequence
  Synthetic oligonucleotide; TTT chr11 5268432 5268453 5268437 5268432 -
gcaggtgttcctgtgaccctga

SEQ ID NO: 136276 - DNA, 22 bp, Artificial Sequence
  Synthetic oligonucleotide; TTG chr11 5268431 5268452 5268436 5268431 -
caggtgttcctgtgaccctgac

SEQ ID NO: 136277 - DNA, 22 bp, Artificial Sequence
  Synthetic oligonucleotide; TTC chr11 5268422 5268443 5268427 5268422 -
ctgtgaccctgacaccctcctt

SEQ ID NO: 136278 - DNA, 22 bp, Artificial Sequence
  Synthetic oligonucleotide; CTG chr11 5268419 5268440 5268424 5268419 -
tgaccctgacaccctccttctg

SEQ ID NO: 136279 - DNA, 22 bp, Artificial Sequence
  Synthetic oligonucleotide; CTG chr11 5268411 5268432 5268416 5268411 -
acaccctccttctgcacatggg

SEQ ID NO: 136280 - DNA, 22 bp, Artificial Sequence
  Synthetic oligonucleotide; CTC chr11 5268403 5268424 5268408 5268403 -
cttctgcacatggggactgggc

SEQ ID NO: 136281 - DNA, 22 bp, Artificial Sequence
  Synthetic oligonucleotide; CTT chr11 5268400 5268421 5268405 5268400 -
ctgcacatggggactgggcttg

SEQ ID NO: 136282 - DNA, 22 bp, Artificial Sequence
  Synthetic oligonucleotide; TTC chr11 5268399 5268420 5268404 5268399 -
tgcacatggggactgggcttgg

SEQ ID NO: 136283 - DNA, 22 bp, Artificial Sequence
  Synthetic oligonucleotide; CTG chr11 5268397 5268418 5268402 5268397 -
cacatggggactgggcttggcc

SEQ ID NO: 136284 - DNA, 22 bp, Artificial Sequence
  Synthetic oligonucleotide; CTG chr11 5268384 5268405 5268389 5268384 -
ggcttggccttgagagaaagcc

SEQ ID NO: 136285 - DNA, 22 bp, Artificial Sequence
  Synthetic oligonucleotide; CTT chr11 5268379 5268400 5268384 5268379 -
ggccttgagagaaagccttctg

SEQ ID NO: 136286 - DNA, 22 bp, Artificial Sequence
  Synthetic oligonucleotide; TTG chr11 5268378 5268399 5268383 5268378 -
gccttgagagaaagccttctgt

SEQ ID NO: 136287 - DNA, 22 bp, Artificial Sequence
  Synthetic oligonucleotide; CTT chr11 5268373 5268394 5268378 5268373 -
gagagaaagccttctgtttaat

SEQ ID NO: 136288 - DNA, 22 bp, Artificial Sequence
  Synthetic oligonucleotide; TTG chr11 5268372 5268393 5268377 5268372 -
agagaaagccttctgtttaata

SEQ ID NO: 136289 - DNA, 22 bp, Artificial Sequence
  Synthetic oligonucleotide; CTT chr11 5268360 5268381 5268365 5268360 -
ctgtttaataaagtacattttc

SEQ ID NO: 136290 - DNA, 22 bp, Artificial Sequence
  Synthetic oligonucleotide; TTC chr11 5268359 5268380 5268364 5268359 -
tgtttaataaagtacattttct

SEQ ID NO: 136291 - DNA, 22 bp, Artificial Sequence
  Synthetic oligonucleotide; CTG chr11 5268357 5268378 5268362 5268357 -
tttaataaagtacattttcttc

SEQ ID NO: 136292 - DNA, 22 bp, Artificial Sequence
  Synthetic oligonucleotide; TTT chr11 5268354 5268375 5268359 5268354 -
aataaagtacattttcttcagt

SEQ ID NO: 136293 - DNA, 22 bp, Artificial Sequence
  Synthetic oligonucleotide; TTA chr11 5268353 5268374 5268358 5268353 -
ataaagtacattttcttcagta

SEQ ID NO: 136294 - DNA, 22 bp, Artificial Sequence
  Synthetic oligonucleotide; TTT chr11 5268340 5268361 5268345 5268340 -
tcttcagtaatcaaaaattgca

SEQ ID NO: 136295 - DNA, 22 bp, Artificial Sequence
  Synthetic oligonucleotide; TTT chr11 5268339 5268360 5268344 5268339 -
cttcagtaatcaaaaattgcaa

SEQ ID NO: 136296 - DNA, 22 bp, Artificial Sequence
  Synthetic oligonucleotide; TTC chr11 5268338 5268359 5268343 5268338 -
ttcagtaatcaaaaattgcaat

SEQ ID NO: 136297 - DNA, 22 bp, Artificial Sequence
  Synthetic oligonucleotide; CTT chr11 5268336 5268357 5268341 5268336 -
cagtaatcaaaaattgcaattt

SEQ ID NO: 136298 - DNA, 22 bp, Artificial Sequence
  Synthetic oligonucleotide; TTC chr11 5268335 5268356 5268340 5268335 -
agtaatcaaaaattgcaatttt

SEQ ID NO: 136299 - DNA, 22 bp, Artificial Sequence
  Synthetic oligonucleotide; TTG chr11 5268320 5268341 5268325 5268320 -
caattttatcttctccatcttt

SEQ ID NO: 136300 - DNA, 22 bp, Artificial Sequence
  Synthetic oligonucleotide; TTT chr11 5268314 5268335 5268319 5268314 -
tatcttctccatcttttactct

SEQ ID NO: 136301 - DNA, 22 bp, Artificial Sequence
  Synthetic oligonucleotide; TTT chr11 5268313 5268334 5268318 5268313 -
atcttctccatcttttactctt

SEQ ID NO: 136302 - DNA, 22 bp, Artificial Sequence
  Synthetic oligonucleotide; TTA chr11 5268312 5268333 5268317 5268312 -
tcttctccatcttttactcttg

SEQ ID NO: 136303 - DNA, 22 bp, Artificial Sequence
  Synthetic oligonucleotide; CTT chr11 5268308 5268329 5268313 5268308 -
ctccatcttttactcttgtgtt

SEQ ID NO: 136304 - DNA, 22 bp, Artificial Sequence
  Synthetic oligonucleotide; TTC chr11 5268307 5268328 5268312 5268307 -
tccatcttttactcttgtgtta

SEQ ID NO: 136305 - DNA, 22 bp, Artificial Sequence
  Synthetic oligonucleotide; CTC chr11 5268305 5268326 5268310 5268305 -
catcttttactcttgtgttaaa

SEQ ID NO: 136306 - DNA, 22 bp, Artificial Sequence
  Synthetic oligonucleotide; CTT chr11 5268299 5268320 5268304 5268299 -
ttactcttgtgttaaaaggaaa

SEQ ID NO: 136307 - DNA, 22 bp, Artificial Sequence
  Synthetic oligonucleotide; TTT chr11 5268298 5268319 5268303 5268298 -
tactcttgtgttaaaaggaaaa

SEQ ID NO: 136308 - DNA, 22 bp, Artificial Sequence
  Synthetic oligonucleotide; TTT chr11 5268297 5268318 5268302 5268297 -
actcttgtgttaaaaggaaaaa

SEQ ID NO: 136309 - DNA, 22 bp, Artificial Sequence
  Synthetic oligonucleotide; TTA chr11 5268296 5268317 5268301 5268296 -
ctcttgtgttaaaaggaaaaag

SEQ ID NO: 136310 - DNA, 22 bp, Artificial Sequence
  Synthetic oligonucleotide; CTC chr11 5268293 5268314 5268298 5268293 -
ttgtgttaaaaggaaaaagtgt

SEQ ID NO: 136311 - DNA, 22 bp, Artificial Sequence
  Synthetic oligonucleotide; CTT chr11 5268291 5268312 5268296 5268291 -
gtgttaaaaggaaaaagtgttc

SEQ ID NO: 136312 - DNA, 22 bp, Artificial Sequence
  Synthetic oligonucleotide; TTG chr11 5268290 5268311 5268295 5268290 -
tgttaaaaggaaaaagtgttca

SEQ ID NO: 136313 - DNA, 22 bp, Artificial Sequence
  Synthetic oligonucleotide; TTA chr11 5268285 5268306 5268290 5268285 -
aaaggaaaaagtgttcatgggc

SEQ ID NO: 136314 - DNA, 22 bp, Artificial Sequence
  Synthetic oligonucleotide; TTC chr11 5268269 5268290 5268274 5268269 -
atgggctgagggatggagagaa

SEQ ID NO: 136315 - DNA, 22 bp, Artificial Sequence
  Synthetic oligonucleotide; CTG chr11 5268261 5268282 5268266 5268261 -
agggatggagagaaacatagga

SEQ ID NO: 136316 - DNA, 22 bp, Artificial Sequence
  Synthetic oligonucleotide; CTT chr11 5268225 5268246 5268230 5268225 -
ccttaagaaatgtatgggggct

SEQ ID NO: 136317 - DNA, 22 bp, Artificial Sequence
  Synthetic oligonucleotide; TTC chr11 5268224 5268245 5268229 5268224 -
cttaagaaatgtatgggggctt

SEQ ID NO: 136318 - DNA, 22 bp, Artificial Sequence
  Synthetic oligonucleotide; CTT chr11 5268221 5268242 5268226 5268221 -
aagaaatgtatgggggcttgta

SEQ ID NO: 136319 - DNA, 22 bp, Artificial Sequence
  Synthetic oligonucleotide; TTA chr11 5268220 5268241 5268225 5268220 -
agaaatgtatgggggcttgtaa

SEQ ID NO: 136320 - DNA, 22 bp, Artificial Sequence
  Synthetic oligonucleotide; CTT chr11 5268202 5268223 5268207 5268202 -
gtaaaattaatgtggatgttat

SEQ ID NO: 136321 - DNA, 22 bp, Artificial Sequence
  Synthetic oligonucleotide; TTG chr11 5268201 5268222 5268206 5268201 -
taaaattaatgtggatgttatg

SEQ ID NO: 136322 - DNA, 22 bp, Artificial Sequence
  Synthetic oligonucleotide; TTA chr11 5268193 5268214 5268198 5268193 -
atgtggatgttatgggagaatt

SEQ ID NO: 136323 - DNA, 22 bp, Artificial Sequence
  Synthetic oligonucleotide; TTA chr11 5268181 5268202 5268186 5268181 -
tgggagaattccaggattccaa

SEQ ID NO: 136324 - DNA, 22 bp, Artificial Sequence
  Synthetic oligonucleotide; TTC chr11 5268170 5268191 5268175 5268170 -
caggattccaaggaggatgata

SEQ ID NO: 136325 - DNA, 22 bp, Artificial Sequence
  Synthetic oligonucleotide; TTC chr11 5268162 5268183 5268167 5268162 -
caaggaggatgatatgatggag

SEQ ID NO: 136326 - DNA, 22 bp, Artificial Sequence
  Synthetic oligonucleotide; CTT chr11 5268131 5268152 5268136 5268131 -
tatcggggtgggaaaatggtta

SEQ ID NO: 136327 - DNA, 22 bp, Artificial Sequence
  Synthetic oligonucleotide; TTT chr11 5268130 5268151 5268135 5268130 -
atcggggtgggaaaatggttaa

SEQ ID NO: 136328 - DNA, 22 bp, Artificial Sequence
  Synthetic oligonucleotide; TTA chr11 5268129 5268150 5268134 5268129 -
tcggggtgggaaaatggttaat

SEQ ID NO: 136329 - DNA, 22 bp, Artificial Sequence
  Synthetic oligonucleotide; TTA chr11 5268109 5268130 5268114 5268109 -
attaagtggacagagactccta

SEQ ID NO: 136330 - DNA, 22 bp, Artificial Sequence
  Synthetic oligonucleotide; TTA chr11 5268105 5268126 5268110 5268105 -
agtggacagagactcctaggca

SEQ ID NO: 136331 - DNA, 22 bp, Artificial Sequence
  Synthetic oligonucleotide; CTC chr11 5268090 5268111 5268095 5268090 -
ctaggcagtttttactgcaccg

SEQ ID NO: 136332 - DNA, 22 bp, Artificial Sequence
  Synthetic oligonucleotide; CTA chr11 5268087 5268108 5268092 5268087 -
ggcagtttttactgcaccgggg

SEQ ID NO: 136333 - DNA, 22 bp, Artificial Sequence
  Synthetic oligonucleotide; TTT chr11 5268079 5268100 5268084 5268079 -
ttactgcaccggggaaagaagg

SEQ ID NO: 136334 - DNA, 22 bp, Artificial Sequence
  Synthetic oligonucleotide; TTT chr11 5268078 5268099 5268083 5268078 -
tactgcaccggggaaagaagga

SEQ ID NO: 136335 - DNA, 22 bp, Artificial Sequence
  Synthetic oligonucleotide; TTT chr11 5268077 5268098 5268082 5268077 -
actgcaccggggaaagaaggag

SEQ ID NO: 136336 - DNA, 22 bp, Artificial Sequence
  Synthetic oligonucleotide; TTA chr11 5268076 5268097 5268081 5268076 -
ctgcaccggggaaagaaggagc

SEQ ID NO: 136337 - DNA, 22 bp, Artificial Sequence
  Synthetic oligonucleotide; CTG chr11 5268073 5268094 5268078 5268073 -
caccggggaaagaaggagctgt

SEQ ID NO: 136338 - DNA, 22 bp, Artificial Sequence
  Synthetic oligonucleotide; CTG chr11 5268052 5268073 5268057 5268052 -
ttagtggtacctgagaaagcag

SEQ ID NO: 136339 - DNA, 22 bp, Artificial Sequence
  Synthetic oligonucleotide; TTA chr11 5268049 5268070 5268054 5268049 -
gtggtacctgagaaagcagatt

SEQ ID NO: 136340 - DNA, 22 bp, Artificial Sequence
  Synthetic oligonucleotide; CTG chr11 5268039 5268060 5268044 5268039 -
agaaagcagatttgtggtacat

SEQ ID NO: 136341 - DNA, 22 bp, Artificial Sequence
  Synthetic oligonucleotide; TTT chr11 5268026 5268047 5268031 5268026 -
gtggtacatgtcacttttcatt

SEQ ID NO: 136342 - DNA, 22 bp, Artificial Sequence
  Synthetic oligonucleotide; TTG chr11 5268025 5268046 5268030 5268025 -
tggtacatgtcacttttcatta

SEQ ID NO: 136343 - DNA, 22 bp, Artificial Sequence
  Synthetic oligonucleotide; CTT chr11 5268010 5268031 5268015 5268010 -
ttcattaaaaacaaaaacaaaa

SEQ ID NO: 136344 - DNA, 22 bp, Artificial Sequence
  Synthetic oligonucleotide; TTT chr11 5268009 5268030 5268014 5268009 -
tcattaaaaacaaaaacaaaac

SEQ ID NO: 136345 - DNA, 22 bp, Artificial Sequence
  Synthetic oligonucleotide; TTT chr11 5268008 5268029 5268013 5268008 -
cattaaaaacaaaaacaaaaca

SEQ ID NO: 136346 - DNA, 22 bp, Artificial Sequence
  Synthetic oligonucleotide; TTC chr11 5268007 5268028 5268012 5268007 -
attaaaaacaaaaacaaaacaa

SEQ ID NO: 136347 - DNA, 22 bp, Artificial Sequence
  Synthetic oligonucleotide; TTA chr11 5268003 5268024 5268008 5268003 -
aaaacaaaaacaaaacaaaaca

SEQ ID NO: 136348 - DNA, 22 bp, Artificial Sequence
  Synthetic oligonucleotide; CTT chr11 5267975 5267996 5267980 5267975 -
catagatatccaagatataggc

SEQ ID NO: 136349 - DNA, 22 bp, Artificial Sequence
  Synthetic oligonucleotide; TTC chr11 5267974 5267995 5267979 5267974 -
atagatatccaagatataggct

SEQ ID NO: 136350 - DNA, 22 bp, Artificial Sequence
  Synthetic oligonucleotide; CTA chr11 5267951 5267972 5267956 5267951 -
gaattactattttaatttactc

SEQ ID NO: 136351 - DNA, 22 bp, Artificial Sequence
  Synthetic oligonucleotide; TTA chr11 5267945 5267966 5267950 5267945 -
ctattttaatttactcttattt

SEQ ID NO: 136352 - DNA, 22 bp, Artificial Sequence
  Synthetic oligonucleotide; CTA chr11 5267942 5267963 5267947 5267942 -
ttttaatttactcttatttaca

SEQ ID NO: 136353 - DNA, 22 bp, Artificial Sequence
  Synthetic oligonucleotide; TTT chr11 5267939 5267960 5267944 5267939 -
taatttactcttatttacattt

SEQ ID NO: 136354 - DNA, 22 bp, Artificial Sequence
  Synthetic oligonucleotide; TTT chr11 5267938 5267959 5267943 5267938 -
aatttactcttatttacatttt

SEQ ID NO: 136355 - DNA, 22 bp, Artificial Sequence
  Synthetic oligonucleotide; TTA chr11 5267937 5267958 5267942 5267937 -
atttactcttatttacattttg

SEQ ID NO: 136356 - DNA, 22 bp, Artificial Sequence
  Synthetic oligonucleotide; TTT chr11 5267933 5267954 5267938 5267933 -
actcttatttacattttgaagt

SEQ ID NO: 136357 - DNA, 22 bp, Artificial Sequence
  Synthetic oligonucleotide; TTA chr11 5267932 5267953 5267937 5267932 -
ctcttatttacattttgaagta

SEQ ID NO: 136358 - DNA, 22 bp, Artificial Sequence
  Synthetic oligonucleotide; CTC chr11 5267929 5267950 5267934 5267929 -
ttatttacattttgaagtagct

SEQ ID NO: 136359 - DNA, 22 bp, Artificial Sequence
  Synthetic oligonucleotide; CTT chr11 5267927 5267948 5267932 5267927 -
atttacattttgaagtagctag

SEQ ID NO: 136360 - DNA, 22 bp, Artificial Sequence
  Synthetic oligonucleotide; TTA chr11 5267926 5267947 5267931 5267926 -
tttacattttgaagtagctagc

SEQ ID NO: 136361 - DNA, 22 bp, Artificial Sequence
  Synthetic oligonucleotide; TTT chr11 5267923 5267944 5267928 5267923 -
acattttgaagtagctagcttg

SEQ ID NO: 136362 - DNA, 22 bp, Artificial Sequence
  Synthetic oligonucleotide; TTA chr11 5267922 5267943 5267927 5267922 -
cattttgaagtagctagcttgt

SEQ ID NO: 136363 - DNA, 22 bp, Artificial Sequence
  Synthetic oligonucleotide; TTT chr11 5267917 5267938 5267922 5267917 -
tgaagtagctagcttgtcacat

SEQ ID NO: 136364 - DNA, 22 bp, Artificial Sequence
  Synthetic oligonucleotide; TTT chr11 5267916 5267937 5267921 5267916 -
gaagtagctagcttgtcacatg

SEQ ID NO: 136365 - DNA, 22 bp, Artificial Sequence
  Synthetic oligonucleotide; TTG chr11 5267915 5267936 5267920 5267915 -
aagtagctagcttgtcacatgt

SEQ ID NO: 136366 - DNA, 22 bp, Artificial Sequence
  Synthetic oligonucleotide; CTA chr11 5267906 5267927 5267911 5267906 -
gcttgtcacatgttttatgaaa

SEQ ID NO: 136367 - DNA, 22 bp, Artificial Sequence
  Synthetic oligonucleotide; CTT chr11 5267902 5267923 5267907 5267902 -
gtcacatgttttatgaaattga

SEQ ID NO: 136368 - DNA, 22 bp, Artificial Sequence
  Synthetic oligonucleotide; TTG chr11 5267901 5267922 5267906 5267901 -
tcacatgttttatgaaattgat

SEQ ID NO: 136369 - DNA, 22 bp, Artificial Sequence
  Synthetic oligonucleotide; TTT chr11 5267891 5267912 5267896 5267891 -
tatgaaattgatttggagataa

SEQ ID NO: 136370 - DNA, 22 bp, Artificial Sequence
  Synthetic oligonucleotide; TTT chr11 5267890 5267911 5267895 5267890 -
atgaaattgatttggagataag

SEQ ID NO: 136371 - DNA, 22 bp, Artificial Sequence
  Synthetic oligonucleotide; TTA chr11 5267889 5267910 5267894 5267889 -
tgaaattgatttggagataaga

SEQ ID NO: 136372 - DNA, 22 bp, Artificial Sequence
  Synthetic oligonucleotide; TTG chr11 5267881 5267902 5267886 5267881 -
atttggagataagatgagtgtg

SEQ ID NO: 136373 - DNA, 22 bp, Artificial Sequence
  Synthetic oligonucleotide; TTT chr11 5267877 5267898 5267882 5267877 -
ggagataagatgagtgtgtatc

SEQ ID NO: 136374 - DNA, 22 bp, Artificial Sequence
  Synthetic oligonucleotide; TTG chr11 5267876 5267897 5267881 5267876 -
gagataagatgagtgtgtatca

SEQ ID NO: 136375 - DNA, 22 bp, Artificial Sequence
  Synthetic oligonucleotide; CTG chr11 5267843 5267864 5267848 5267843 -
ctctttccatgaaggattccat

SEQ ID NO: 136376 - DNA, 22 bp, Artificial Sequence
  Synthetic oligonucleotide; CTC chr11 5267840 5267861 5267845 5267840 -
tttccatgaaggattccattat

SEQ ID NO: 136377 - DNA, 22 bp, Artificial Sequence
  Synthetic oligonucleotide; CTT chr11 5267838 5267859 5267843 5267838 -
tccatgaaggattccattattt

SEQ ID NO: 136378 - DNA, 22 bp, Artificial Sequence
  Synthetic oligonucleotide; TTT chr11 5267837 5267858 5267842 5267837 -
ccatgaaggattccattatttc

SEQ ID NO: 136379 - DNA, 22 bp, Artificial Sequence
  Synthetic oligonucleotide; TTC chr11 5267836 5267857 5267841 5267836 -
catgaaggattccattatttca

SEQ ID NO: 136380 - DNA, 22 bp, Artificial Sequence
  Synthetic oligonucleotide; TTC chr11 5267824 5267845 5267829 5267824 -
cattatttcatgggttagctga

SEQ ID NO: 136381 - DNA, 22 bp, Artificial Sequence
  Synthetic oligonucleotide; TTA chr11 5267819 5267840 5267824 5267819 -
tttcatgggttagctgaagcta

SEQ ID NO: 136382 - DNA, 22 bp, Artificial Sequence
  Synthetic oligonucleotide; TTT chr11 5267816 5267837 5267821 5267816 -
catgggttagctgaagctaaga

SEQ ID NO: 136383 - DNA, 22 bp, Artificial Sequence
  Synthetic oligonucleotide; TTC chr11 5267815 5267836 5267820 5267815 -
atgggttagctgaagctaagac

SEQ ID NO: 136384 - DNA, 22 bp, Artificial Sequence
  Synthetic oligonucleotide; TTA chr11 5267807 5267828 5267812 5267807 -
gctgaagctaagacacatgata

SEQ ID NO: 136385 - DNA, 22 bp, Artificial Sequence
  Synthetic oligonucleotide; CTG chr11 5267803 5267824 5267808 5267803 -
aagctaagacacatgatatcat

SEQ ID NO: 136386 - DNA, 22 bp, Artificial Sequence
  Synthetic oligonucleotide; CTA chr11 5267797 5267818 5267802 5267797 -
agacacatgatatcattgtgca

SEQ ID NO: 136387 - DNA, 22 bp, Artificial Sequence
  Synthetic oligonucleotide; TTG chr11 5267779 5267800 5267784 5267779 -
tgcattatcttctgatagaatg

SEQ ID NO: 136388 - DNA, 22 bp, Artificial Sequence
  Synthetic oligonucleotide; TTA chr11 5267772 5267793 5267777 5267772 -
tcttctgatagaatgtaacatg

SEQ ID NO: 136389 - DNA, 22 bp, Artificial Sequence
  Synthetic oligonucleotide; CTT chr11 5267768 5267789 5267773 5267768 -
ctgatagaatgtaacatgcact

SEQ ID NO: 136390 - DNA, 22 bp, Artificial Sequence
  Synthetic oligonucleotide; TTC chr11 5267767 5267788 5267772 5267767 -
tgatagaatgtaacatgcacta

SEQ ID NO: 136391 - DNA, 22 bp, Artificial Sequence
  Synthetic oligonucleotide; CTG chr11 5267765 5267786 5267770 5267765 -
atagaatgtaacatgcactaaa

SEQ ID NO: 136392 - DNA, 22 bp, Artificial Sequence
  Synthetic oligonucleotide; CTA chr11 5267745 5267766 5267750 5267745 -
aaataaagttagagttaggacc

SEQ ID NO: 136393 - DNA, 22 bp, Artificial Sequence
  Synthetic oligonucleotide; TTA chr11 5267734 5267755 5267739 5267734 -
gagttaggacctgagtgggaaa

SEQ ID NO: 136394 - DNA, 22 bp, Artificial Sequence
  Synthetic oligonucleotide; TTA chr11 5267728 5267749 5267733 5267728 -
ggacctgagtgggaaagttttt

SEQ ID NO: 136395 - DNA, 22 bp, Artificial Sequence
  Synthetic oligonucleotide; CTG chr11 5267721 5267742 5267726 5267721 -
agtgggaaagtttttggagagt

SEQ ID NO: 136396 - DNA, 22 bp, Artificial Sequence
  Synthetic oligonucleotide; TTT chr11 5267708 5267729 5267713 5267708 -
ttggagagtgtgatgaagactt

SEQ ID NO: 136397 - DNA, 22 bp, Artificial Sequence
  Synthetic oligonucleotide; TTT chr11 5267707 5267728 5267712 5267707 -
tggagagtgtgatgaagacttt

SEQ ID NO: 136398 - DNA, 22 bp, Artificial Sequence
  Synthetic oligonucleotide; TTT chr11 5267706 5267727 5267711 5267706 -
ggagagtgtgatgaagactttc

SEQ ID NO: 136399 - DNA, 22 bp, Artificial Sequence
  Synthetic oligonucleotide; TTG chr11 5267705 5267726 5267710 5267705 -
gagagtgtgatgaagactttcc

SEQ ID NO: 136400 - DNA, 22 bp, Artificial Sequence
  Synthetic oligonucleotide; CTT chr11 5267686 5267707 5267691 5267686 -
tccgtgggagatagaatactaa

SEQ ID NO: 136401 - DNA, 22 bp, Artificial Sequence
  Synthetic oligonucleotide; TTT chr11 5267685 5267706 5267690 5267685 -
ccgtgggagatagaatactaat

SEQ ID NO: 136402 - DNA, 22 bp, Artificial Sequence
  Synthetic oligonucleotide; TTC chr11 5267684 5267705 5267689 5267684 -
cgtgggagatagaatactaata

SEQ ID NO: 136403 - DNA, 22 bp, Artificial Sequence
  Synthetic oligonucleotide; CTA chr11 5267665 5267686 5267670 5267665 -
ataaaggcttaaattctaaaac

SEQ ID NO: 136404 - DNA, 22 bp, Artificial Sequence
  Synthetic oligonucleotide; CTT chr11 5267655 5267676 5267660 5267655 -
aaattctaaaaccagcaagcta

SEQ ID NO: 136405 - DNA, 22 bp, Artificial Sequence
  Synthetic oligonucleotide; TTA chr11 5267654 5267675 5267659 5267654 -
aattctaaaaccagcaagctag

SEQ ID NO: 136406 - DNA, 22 bp, Artificial Sequence
  Synthetic oligonucleotide; TTC chr11 5267649 5267670 5267654 5267649 -
taaaaccagcaagctagggctt

SEQ ID NO: 136407 - DNA, 22 bp, Artificial Sequence
  Synthetic oligonucleotide; CTA chr11 5267647 5267668 5267652 5267647 -
aaaccagcaagctagggcttcg

SEQ ID NO: 136408 - DNA, 22 bp, Artificial Sequence
  Synthetic oligonucleotide; CTA chr11 5267633 5267654 5267638 5267633 -
gggcttcgtgacttgcatgaaa

SEQ ID NO: 136409 - DNA, 22 bp, Artificial Sequence
  Synthetic oligonucleotide; CTT chr11 5267627 5267648 5267632 5267627 -
cgtgacttgcatgaaactggct

SEQ ID NO: 136410 - DNA, 22 bp, Artificial Sequence
  Synthetic oligonucleotide; TTC chr11 5267626 5267647 5267631 5267626 -
gtgacttgcatgaaactggctc

SEQ ID NO: 136411 - DNA, 22 bp, Artificial Sequence
  Synthetic oligonucleotide; CTT chr11 5267619 5267640 5267624 5267619 -
gcatgaaactggctctctggaa

SEQ ID NO: 136412 - DNA, 22 bp, Artificial Sequence
  Synthetic oligonucleotide; TTG chr11 5267618 5267639 5267623 5267618 -
catgaaactggctctctggaag

SEQ ID NO: 136413 - DNA, 22 bp, Artificial Sequence
  Synthetic oligonucleotide; CTG chr11 5267608 5267629 5267613 5267608 -
gctctctggaagtagaagggag

SEQ ID NO: 136414 - DNA, 22 bp, Artificial Sequence
  Synthetic oligonucleotide; CTC chr11 5267604 5267625 5267609 5267604 -
tctggaagtagaagggagagta

SEQ ID NO: 136415 - DNA, 22 bp, Artificial Sequence
  Synthetic oligonucleotide; CTC chr11 5267602 5267623 5267607 5267602 -
tggaagtagaagggagagtaag

SEQ ID NO: 136416 - DNA, 22 bp, Artificial Sequence
  Synthetic oligonucleotide; CTG chr11 5267600 5267621 5267605 5267600 -
gaagtagaagggagagtaagac

SEQ ID NO: 136417 - DNA, 22 bp, Artificial Sequence
  Synthetic oligonucleotide; CTA chr11 5267563 5267584 5267568 5267563 -
ggaaagaccagatagtacaggg

SEQ ID NO: 136418 - DNA, 22 bp, Artificial Sequence
  Synthetic oligonucleotide; CTG chr11 5267537 5267558 5267542 5267537 -
gctacaaaaatacaagctttta

SEQ ID NO: 136419 - DNA, 22 bp, Artificial Sequence
  Synthetic oligonucleotide; CTA chr11 5267533 5267554 5267538 5267533 -
caaaaatacaagcttttactat

SEQ ID NO: 136420 - DNA, 22 bp, Artificial Sequence
  Synthetic oligonucleotide; CTT chr11 5267518 5267539 5267523 5267518 -
ttactatgctattgcaatacta

SEQ ID NO: 136421 - DNA, 22 bp, Artificial Sequence
  Synthetic oligonucleotide; TTT chr11 5267517 5267538 5267522 5267517 -
tactatgctattgcaatactaa

SEQ ID NO: 136422 - DNA, 22 bp, Artificial Sequence
  Synthetic oligonucleotide; TTT chr11 5267516 5267537 5267521 5267516 -
actatgctattgcaatactaaa

SEQ ID NO: 136423 - DNA, 22 bp, Artificial Sequence
  Synthetic oligonucleotide; TTA chr11 5267515 5267536 5267520 5267515 -
ctatgctattgcaatactaaac

SEQ ID NO: 136424 - DNA, 22 bp, Artificial Sequence
  Synthetic oligonucleotide; CTA chr11 5267512 5267533 5267517 5267512 -
tgctattgcaatactaaacgat

SEQ ID NO: 136425 - DNA, 22 bp, Artificial Sequence
  Synthetic oligonucleotide; CTA chr11 5267507 5267528 5267512 5267507 -
ttgcaatactaaacgataagca

SEQ ID NO: 136426 - DNA, 22 bp, Artificial Sequence
  Synthetic oligonucleotide; TTG chr11 5267504 5267525 5267509 5267504 -
caatactaaacgataagcatta

SEQ ID NO: 136427 - DNA, 22 bp, Artificial Sequence
  Synthetic oligonucleotide; CTA chr11 5267496 5267517 5267501 5267496 -
aacgataagcattaggatgtta

SEQ ID NO: 136428 - DNA, 22 bp, Artificial Sequence
  Synthetic oligonucleotide; TTA chr11 5267482 5267503 5267487 5267482 -
ggatgttaagtgactcaggaaa

SEQ ID NO: 136429 - DNA, 22 bp, Artificial Sequence
  Synthetic oligonucleotide; TTA chr11 5267474 5267495 5267479 5267474 -
agtgactcaggaaataagattt

SEQ ID NO: 136430 - DNA, 22 bp, Artificial Sequence
  Synthetic oligonucleotide; CTC chr11 5267466 5267487 5267471 5267466 -
aggaaataagattttgggaaaa

SEQ ID NO: 136431 - DNA, 22 bp, Artificial Sequence
  Synthetic oligonucleotide; TTT chr11 5267452 5267473 5267457 5267452 -
tgggaaaaagtaatctgcttat

SEQ ID NO: 136432 - DNA, 22 bp, Artificial Sequence
  Synthetic oligonucleotide; TTT chr11 5267451 5267472 5267456 5267451 -
gggaaaaagtaatctgcttatg

SEQ ID NO: 136433 - DNA, 22 bp, Artificial Sequence
  Synthetic oligonucleotide; TTG chr11 5267450 5267471 5267455 5267450 -
ggaaaaagtaatctgcttatgt

SEQ ID NO: 136434 - DNA, 22 bp, Artificial Sequence
  Synthetic oligonucleotide; CTG chr11 5267435 5267456 5267440 5267435 -
cttatgtgcacaaaatggattc

SEQ ID NO: 136435 - DNA, 22 bp, Artificial Sequence
  Synthetic oligonucleotide; CTT chr11 5267432 5267453 5267437 5267432 -
atgtgcacaaaatggattcaag

SEQ ID NO: 136436 - DNA, 22 bp, Artificial Sequence
  Synthetic oligonucleotide; TTA chr11 5267431 5267452 5267436 5267431 -
tgtgcacaaaatggattcaagt

SEQ ID NO: 136437 - DNA, 22 bp, Artificial Sequence
  Synthetic oligonucleotide; TTC chr11 5267413 5267434 5267418 5267413 -
aagtttgcagataaaataaaat

SEQ ID NO: 136438 - DNA, 22 bp, Artificial Sequence
  Synthetic oligonucleotide; TTT chr11 5267407 5267428 5267412 5267407 -
gcagataaaataaaatatggat

SEQ ID NO: 136439 - DNA, 22 bp, Artificial Sequence
  Synthetic oligonucleotide; TTG chr11 5267406 5267427 5267411 5267406 -
cagataaaataaaatatggatg

SEQ ID NO: 136440 - DNA, 22 bp, Artificial Sequence
  Synthetic oligonucleotide; TTC chr11 5267377 5267398 5267382 5267377 -
aaggggacagatacaatggttc

SEQ ID NO: 136441 - DNA, 22 bp, Artificial Sequence
  Synthetic oligonucleotide; TTC chr11 5267355 5267376 5267360 5267355 -
aaacccaagaggagcagtgagt

SEQ ID NO: 136442 - DNA, 22 bp, Artificial Sequence
  Synthetic oligonucleotide; CTG chr11 5267330 5267351 5267335 5267330 -
tggaatttgaaggatggacaaa

SEQ ID NO: 136443 - DNA, 22 bp, Artificial Sequence
  Synthetic oligonucleotide; TTT chr11 5267322 5267343 5267327 5267322 -
gaaggatggacaaaggtggggt

SEQ ID NO: 136444 - DNA, 22 bp, Artificial Sequence
  Synthetic oligonucleotide; TTG chr11 5267321 5267342 5267326 5267321 -
aaggatggacaaaggtggggtg

SEQ ID NO: 136445 - DNA, 22 bp, Artificial Sequence
  Synthetic oligonucleotide; TTC chr11 5267282 5267303 5267287 5267282 -
gactgactgtgggagatgagaa

SEQ ID NO: 136446 - DNA, 22 bp, Artificial Sequence
  Synthetic oligonucleotide; CTG chr11 5267277 5267298 5267282 5267277 -
actgtgggagatgagaaggaag

SEQ ID NO: 136447 - DNA, 22 bp, Artificial Sequence
  Synthetic oligonucleotide; CTG chr11 5267273 5267294 5267278 5267273 -
tgggagatgagaaggaagaagg

SEQ ID NO: 136448 - DNA, 22 bp, Artificial Sequence
  Synthetic oligonucleotide; CTG chr11 5267235 5267256 5267240 5267235 -
aaagctcccagactggtgaaga

SEQ ID NO: 136449 - DNA, 22 bp, Artificial Sequence
  Synthetic oligonucleotide; CTC chr11 5267228 5267249 5267233 5267228 -
ccagactggtgaagataacagg

SEQ ID NO: 136450 - DNA, 22 bp, Artificial Sequence
  Synthetic oligonucleotide; CTG chr11 5267220 5267241 5267225 5267220 -
gtgaagataacaggaggaaacc

SEQ ID NO: 136451 - DNA, 22 bp, Artificial Sequence
  Synthetic oligonucleotide; CTG chr11 5267190 5267211 5267195 5267190 -
acctggtgactctcatgtgtga

SEQ ID NO: 136452 - DNA, 22 bp, Artificial Sequence
  Synthetic oligonucleotide; CTG chr11 5267185 5267206 5267190 5267185 -
gtgactctcatgtgtgaagggt

SEQ ID NO: 136453 - DNA, 22 bp, Artificial Sequence
  Synthetic oligonucleotide; CTC chr11 5267178 5267199 5267183 5267178 -
tcatgtgtgaagggtagaggga

SEQ ID NO: 136454 - DNA, 22 bp, Artificial Sequence
  Synthetic oligonucleotide; CTC chr11 5267176 5267197 5267181 5267176 -
atgtgtgaagggtagagggata

SEQ ID NO: 136455 - DNA, 22 bp, Artificial Sequence
  Synthetic oligonucleotide; TTA chr11 5267151 5267172 5267156 5267151 -
acagatttactttttaggaagt

SEQ ID NO: 136456 - DNA, 22 bp, Artificial Sequence
  Synthetic oligonucleotide; TTT chr11 5267143 5267164 5267148 5267143 -
actttttaggaagtgctagatt

SEQ ID NO: 136457 - DNA, 22 bp, Artificial Sequence
  Synthetic oligonucleotide; TTA chr11 5267142 5267163 5267147 5267142 -
ctttttaggaagtgctagattg

SEQ ID NO: 136458 - DNA, 22 bp, Artificial Sequence
  Synthetic oligonucleotide; CTT chr11 5267139 5267160 5267144 5267139 -
tttaggaagtgctagattggtc

SEQ ID NO: 136459 - DNA, 22 bp, Artificial Sequence
  Synthetic oligonucleotide; TTT chr11 5267138 5267159 5267143 5267138 -
ttaggaagtgctagattggtca

SEQ ID NO: 136460 - DNA, 22 bp, Artificial Sequence
  Synthetic oligonucleotide; TTT chr11 5267137 5267158 5267142 5267137 -
taggaagtgctagattggtcag

SEQ ID NO: 136461 - DNA, 22 bp, Artificial Sequence
  Synthetic oligonucleotide; TTT chr11 5267136 5267157 5267141 5267136 -
aggaagtgctagattggtcagg

SEQ ID NO: 136462 - DNA, 22 bp, Artificial Sequence
  Synthetic oligonucleotide; TTA chr11 5267135 5267156 5267140 5267135 -
ggaagtgctagattggtcaggg

SEQ ID NO: 136463 - DNA, 22 bp, Artificial Sequence
  Synthetic oligonucleotide; CTA chr11 5267125 5267146 5267130 5267125 -
gattggtcagggagttttgacc

SEQ ID NO: 136464 - DNA, 22 bp, Artificial Sequence
  Synthetic oligonucleotide; TTG chr11 5267120 5267141 5267125 5267120 -
gtcagggagttttgaccttcag

SEQ ID NO: 136465 - DNA, 22 bp, Artificial Sequence
  Synthetic oligonucleotide; TTT chr11 5267108 5267129 5267113 5267108 -
tgaccttcaggtcttgtgtctt

SEQ ID NO: 136466 - DNA, 22 bp, Artificial Sequence
  Synthetic oligonucleotide; TTT chr11 5267107 5267128 5267112 5267107 -
gaccttcaggtcttgtgtcttt

SEQ ID NO: 136467 - DNA, 22 bp, Artificial Sequence
  Synthetic oligonucleotide; TTG chr11 5267106 5267127 5267111 5267106 -
accttcaggtcttgtgtctttc

SEQ ID NO: 136468 - DNA, 22 bp, Artificial Sequence
  Synthetic oligonucleotide; CTT chr11 5267101 5267122 5267106 5267101 -
caggtcttgtgtctttcatatc

SEQ ID NO: 136469 - DNA, 22 bp, Artificial Sequence
  Synthetic oligonucleotide; TTC chr11 5267100 5267121 5267105 5267100 -
aggtcttgtgtctttcatatca

SEQ ID NO: 136470 - DNA, 22 bp, Artificial Sequence
  Synthetic oligonucleotide; CTT chr11 5267093 5267114 5267098 5267093 -
gtgtctttcatatcaaggaacc

SEQ ID NO: 136471 - DNA, 22 bp, Artificial Sequence
  Synthetic oligonucleotide; TTG chr11 5267092 5267113 5267097 5267092 -
tgtctttcatatcaaggaacct

SEQ ID NO: 136472 - DNA, 22 bp, Artificial Sequence
  Synthetic oligonucleotide; CTT chr11 5267086 5267107 5267091 5267086 -
tcatatcaaggaacctttgcat

SEQ ID NO: 136473 - DNA, 22 bp, Artificial Sequence
  Synthetic oligonucleotide; TTT chr11 5267085 5267106 5267090 5267085 -
catatcaaggaacctttgcatt

SEQ ID NO: 136474 - DNA, 22 bp, Artificial Sequence
  Synthetic oligonucleotide; TTC chr11 5267084 5267105 5267089 5267084 -
atatcaaggaacctttgcattt

SEQ ID NO: 136475 - DNA, 22 bp, Artificial Sequence
  Synthetic oligonucleotide; CTT chr11 5267069 5267090 5267074 5267069 -
tgcattttccaagttagagtgc

SEQ ID NO: 136476 - DNA, 22 bp, Artificial Sequence
  Synthetic oligonucleotide; TTT chr11 5267068 5267089 5267073 5267068 -
gcattttccaagttagagtgcc

SEQ ID NO: 136477 - DNA, 22 bp, Artificial Sequence
  Synthetic oligonucleotide; TTG chr11 5267067 5267088 5267072 5267067 -
cattttccaagttagagtgcca

SEQ ID NO: 136478 - DNA, 22 bp, Artificial Sequence
  Synthetic oligonucleotide; TTT chr11 5267062 5267083 5267067 5267062 -
tccaagttagagtgccatattt

SEQ ID NO: 136479 - DNA, 22 bp, Artificial Sequence
  Synthetic oligonucleotide; TTT chr11 5267061 5267082 5267066 5267061 -
ccaagttagagtgccatatttt

SEQ ID NO: 136480 - DNA, 22 bp, Artificial Sequence
  Synthetic oligonucleotide; TTC chr11 5267060 5267081 5267065 5267060 -
caagttagagtgccatattttg

SEQ ID NO: 136481 - DNA, 22 bp, Artificial Sequence
  Synthetic oligonucleotide; TTA chr11 5267053 5267074 5267058 5267053 -
gagtgccatattttggcaaata

SEQ ID NO: 136482 - DNA, 22 bp, Artificial Sequence
  Synthetic oligonucleotide; TTT chr11 5267040 5267061 5267045 5267040 -
tggcaaatataactttattagt

SEQ ID NO: 136483 - DNA, 22 bp, Artificial Sequence
  Synthetic oligonucleotide; TTT chr11 5267039 5267060 5267044 5267039 -
ggcaaatataactttattagta

SEQ ID NO: 136484 - DNA, 22 bp, Artificial Sequence
  Synthetic oligonucleotide; TTG chr11 5267038 5267059 5267043 5267038 -
gcaaatataactttattagtaa

SEQ ID NO: 136485 - DNA, 22 bp, Artificial Sequence
  Synthetic oligonucleotide; CTT chr11 5267025 5267046 5267030 5267025 -
tattagtaattttatagtgctc

SEQ ID NO: 136486 - DNA, 22 bp, Artificial Sequence
  Synthetic oligonucleotide; TTT chr11 5267024 5267045 5267029 5267024 -
attagtaattttatagtgctct

SEQ ID NO: 136487 - DNA, 22 bp, Artificial Sequence
  Synthetic oligonucleotide; TTA chr11 5267023 5267044 5267028 5267023 -
ttagtaattttatagtgctctc

SEQ ID NO: 136488 - DNA, 22 bp, Artificial Sequence
  Synthetic oligonucleotide; TTA chr11 5267020 5267041 5267025 5267020 -
gtaattttatagtgctctcaca

SEQ ID NO: 136489 - DNA, 22 bp, Artificial Sequence
  Synthetic oligonucleotide; TTT chr11 5267013 5267034 5267018 5267013 -
tatagtgctctcacattgatca

SEQ ID NO: 136490 - DNA, 22 bp, Artificial Sequence
  Synthetic oligonucleotide; TTT chr11 5267012 5267033 5267017 5267012 -
atagtgctctcacattgatcag

SEQ ID NO: 136491 - DNA, 22 bp, Artificial Sequence
  Synthetic oligonucleotide; TTA chr11 5267011 5267032 5267016 5267011 -
tagtgctctcacattgatcaga

SEQ ID NO: 136492 - DNA, 22 bp, Artificial Sequence
  Synthetic oligonucleotide; CTC chr11 5267003 5267024 5267008 5267003 -
tcacattgatcagactttttcc

SEQ ID NO: 136493 - DNA, 22 bp, Artificial Sequence
  Synthetic oligonucleotide; CTC chr11 5267001 5267022 5267006 5267001 -
acattgatcagactttttcctg

SEQ ID NO: 136494 - DNA, 22 bp, Artificial Sequence
  Synthetic oligonucleotide; TTG chr11 5266995 5267016 5267000 5266995 -
atcagactttttcctgtgaatt

SEQ ID NO: 136495 - DNA, 22 bp, Artificial Sequence
  Synthetic oligonucleotide; CTT chr11 5266986 5267007 5266991 5266986 -
tttcctgtgaattacttttgaa

SEQ ID NO: 136496 - DNA, 22 bp, Artificial Sequence
  Synthetic oligonucleotide; TTT chr11 5266985 5267006 5266990 5266985 -
ttcctgtgaattacttttgaat

SEQ ID NO: 136497 - DNA, 22 bp, Artificial Sequence
  Synthetic oligonucleotide; TTT chr11 5266984 5267005 5266989 5266984 -
tcctgtgaattacttttgaatt

SEQ ID NO: 136498 - DNA, 22 bp, Artificial Sequence
  Synthetic oligonucleotide; TTT chr11 5266983 5267004 5266988 5266983 -
cctgtgaattacttttgaattt

SEQ ID NO: 136499 - DNA, 22 bp, Artificial Sequence
  Synthetic oligonucleotide; TTC chr11 5266982 5267003 5266987 5266982 -
ctgtgaattacttttgaatttg

SEQ ID NO: 136500 - DNA, 22 bp, Artificial Sequence
  Synthetic oligonucleotide; CTG chr11 5266979 5267000 5266984 5266979 -
tgaattacttttgaatttggct

SEQ ID NO: 136501 - DNA, 22 bp, Artificial Sequence
  Synthetic oligonucleotide; TTA chr11 5266972 5266993 5266977 5266972 -
cttttgaatttggctgtatata

SEQ ID NO: 136502 - DNA, 22 bp, Artificial Sequence
  Synthetic oligonucleotide; CTT chr11 5266969 5266990 5266974 5266969 -
ttgaatttggctgtatatatcc

SEQ ID NO: 136503 - DNA, 22 bp, Artificial Sequence
  Synthetic oligonucleotide; TTT chr11 5266968 5266989 5266973 5266968 -
tgaatttggctgtatatatcca

SEQ ID NO: 136504 - DNA, 22 bp, Artificial Sequence
  Synthetic oligonucleotide; TTT chr11 5266967 5266988 5266972 5266967 -
gaatttggctgtatatatccag

SEQ ID NO: 136505 - DNA, 22 bp, Artificial Sequence
  Synthetic oligonucleotide; TTG chr11 5266966 5266987 5266971 5266966 -
aatttggctgtatatatccaga

SEQ ID NO: 136506 - DNA, 22 bp, Artificial Sequence
  Synthetic oligonucleotide; TTT chr11 5266961 5266982 5266966 5266961 -
ggctgtatatatccagaatatg

SEQ ID NO: 136507 - DNA, 22 bp, Artificial Sequence
  Synthetic oligonucleotide; TTG chr11 5266960 5266981 5266965 5266960 -
gctgtatatatccagaatatgg

SEQ ID NO: 136508 - DNA, 22 bp, Artificial Sequence
  Synthetic oligonucleotide; CTG chr11 5266956 5266977 5266961 5266956 -
tatatatccagaatatgggaga

SEQ ID NO: 136509 - DNA, 22 bp, Artificial Sequence
  Synthetic oligonucleotide; TTA chr11 5266920 5266941 5266925 5266920 -
ttgtagttgcaggctatcaaca

SEQ ID NO: 136510 - DNA, 22 bp, Artificial Sequence
  Synthetic oligonucleotide; TTG chr11 5266917 5266938 5266922 5266917 -
tagttgcaggctatcaacaata

SEQ ID NO: 136511 - DNA, 22 bp, Artificial Sequence
  Synthetic oligonucleotide; TTG chr11 5266911 5266932 5266916 5266911 -
caggctatcaacaatactggtc

SEQ ID NO: 136512 - DNA, 22 bp, Artificial Sequence
  Synthetic oligonucleotide; CTA chr11 5266904 5266925 5266909 5266904 -
tcaacaatactggtctctctga

SEQ ID NO: 136513 - DNA, 22 bp, Artificial Sequence
  Synthetic oligonucleotide; CTG chr11 5266892 5266913 5266897 5266892 -
gtctctctgagccttataacct

SEQ ID NO: 136514 - DNA, 22 bp, Artificial Sequence
  Synthetic oligonucleotide; CTC chr11 5266887 5266908 5266892 5266887 -
tctgagccttataacctttcaa

SEQ ID NO: 136515 - DNA, 22 bp, Artificial Sequence
  Synthetic oligonucleotide; CTC chr11 5266885 5266906 5266890 5266885 -
tgagccttataacctttcaata

SEQ ID NO: 136516 - DNA, 22 bp, Artificial Sequence
  Synthetic oligonucleotide; CTG chr11 5266883 5266904 5266888 5266883 -
agccttataacctttcaatatg

SEQ ID NO: 136517 - DNA, 22 bp, Artificial Sequence
  Synthetic oligonucleotide; CTT chr11 5266877 5266898 5266882 5266877 -
ataacctttcaatatgcccata

SEQ ID NO: 136518 - DNA, 22 bp, Artificial Sequence
  Synthetic oligonucleotide; TTA chr11 5266876 5266897 5266881 5266876 -
taacctttcaatatgcccataa

SEQ ID NO: 136519 - DNA, 22 bp, Artificial Sequence
  Synthetic oligonucleotide; CTT chr11 5266869 5266890 5266874 5266869 -
tcaatatgcccataaacagagt

SEQ ID NO: 136520 - DNA, 22 bp, Artificial Sequence
  Synthetic oligonucleotide; TTT chr11 5266868 5266889 5266873 5266868 -
caatatgcccataaacagagta

SEQ ID NO: 136521 - DNA, 22 bp, Artificial Sequence
  Synthetic oligonucleotide; TTC chr11 5266867 5266888 5266872 5266867 -
aatatgcccataaacagagtaa

SEQ ID NO: 136522 - DNA, 22 bp, Artificial Sequence
  Synthetic oligonucleotide; TTA chr11 5266835 5266856 5266840 5266835 -
ttcatggcactaaatattttca

SEQ ID NO: 136523 - DNA, 22 bp, Artificial Sequence
  Synthetic oligonucleotide; TTC chr11 5266832 5266853 5266837 5266832 -
atggcactaaatattttcacct

SEQ ID NO: 136524 - DNA, 22 bp, Artificial Sequence
  Synthetic oligonucleotide; CTA chr11 5266823 5266844 5266828 5266823 -
aatattttcacctagtcagtca

SEQ ID NO: 136525 - DNA, 22 bp, Artificial Sequence
  Synthetic oligonucleotide; TTT chr11 5266816 5266837 5266821 5266816 -
tcacctagtcagtcaacaaatg

SEQ ID NO: 136526 - DNA, 22 bp, Artificial Sequence
  Synthetic oligonucleotide; TTT chr11 5266815 5266836 5266820 5266815 -
cacctagtcagtcaacaaatgg

SEQ ID NO: 136527 - DNA, 22 bp, Artificial Sequence
  Synthetic oligonucleotide; TTC chr11 5266814 5266835 5266819 5266814 -
acctagtcagtcaacaaatggg

SEQ ID NO: 136528 - DNA, 22 bp, Artificial Sequence
  Synthetic oligonucleotide; CTA chr11 5266809 5266830 5266814 5266809 -
gtcagtcaacaaatgggagcaa

SEQ ID NO: 136529 - DNA, 22 bp, Artificial Sequence
  Synthetic oligonucleotide; TTT chr11 5266778 5266799 5266783 5266778 -
tttgatacatatttttatatat

SEQ ID NO: 136530 - DNA, 22 bp, Artificial Sequence
  Synthetic oligonucleotide; TTT chr11 5266777 5266798 5266782 5266777 -
ttgatacatatttttatatatt

SEQ ID NO: 136531 - DNA, 22 bp, Artificial Sequence
  Synthetic oligonucleotide; TTT chr11 5266776 5266797 5266781 5266776 -
tgatacatatttttatatattt

SEQ ID NO: 136532 - DNA, 22 bp, Artificial Sequence
  Synthetic oligonucleotide; TTT chr11 5266775 5266796 5266780 5266775 -
gatacatatttttatatattta

SEQ ID NO: 136533 - DNA, 22 bp, Artificial Sequence
  Synthetic oligonucleotide; TTG chr11 5266774 5266795 5266779 5266774 -
atacatatttttatatatttat

SEQ ID NO: 136534 - DNA, 22 bp, Artificial Sequence
  Synthetic oligonucleotide; TTT chr11 5266764 5266785 5266769 5266764 -
ttatatatttatggggtacatg

SEQ ID NO: 136535 - DNA, 22 bp, Artificial Sequence
  Synthetic oligonucleotide; TTT chr11 5266763 5266784 5266768 5266763 -
tatatatttatggggtacatgt

SEQ ID NO: 136536 - DNA, 22 bp, Artificial Sequence
  Synthetic oligonucleotide; TTT chr11 5266762 5266783 5266767 5266762 -
atatatttatggggtacatgtg

SEQ ID NO: 136537 - DNA, 22 bp, Artificial Sequence
  Synthetic oligonucleotide; TTA chr11 5266761 5266782 5266766 5266761 -
tatatttatggggtacatgtga

SEQ ID NO: 136538 - DNA, 22 bp, Artificial Sequence
  Synthetic oligonucleotide; TTT chr11 5266754 5266775 5266759 5266754 -
atggggtacatgtgatacttac

SEQ ID NO: 136539 - DNA, 22 bp, Artificial Sequence
  Synthetic oligonucleotide; TTA chr11 5266753 5266774 5266758 5266753 -
tggggtacatgtgatacttaca

SEQ ID NO: 136540 - DNA, 22 bp, Artificial Sequence
  Synthetic oligonucleotide; CTT chr11 5266734 5266755 5266739 5266734 -
acatgcctagaacatgtgatga

SEQ ID NO: 136541 - DNA, 22 bp, Artificial Sequence
  Synthetic oligonucleotide; TTA chr11 5266733 5266754 5266738 5266733 -
catgcctagaacatgtgatgat

SEQ ID NO: 136542 - DNA, 22 bp, Artificial Sequence
  Synthetic oligonucleotide; CTA chr11 5266725 5266746 5266730 5266725 -
gaacatgtgatgattaagtcta

SEQ ID NO: 136543 - DNA, 22 bp, Artificial Sequence
  Synthetic oligonucleotide; TTA chr11 5266709 5266730 5266714 5266709 -
agtctagatatttaggatatcc

SEQ ID NO: 136544 - DNA, 22 bp, Artificial Sequence
  Synthetic oligonucleotide; CTA chr11 5266703 5266724 5266708 5266703 -
gatatttaggatatccattgct

SEQ ID NO: 136545 - DNA, 22 bp, Artificial Sequence
  Synthetic oligonucleotide; TTT chr11 5266696 5266717 5266701 5266696 -
aggatatccattgctttgagca

SEQ ID NO: 136546 - DNA, 22 bp, Artificial Sequence
  Synthetic oligonucleotide; TTA chr11 5266695 5266716 5266700 5266695 -
ggatatccattgctttgagcat

SEQ ID NO: 136547 - DNA, 22 bp, Artificial Sequence
  Synthetic oligonucleotide; TTG chr11 5266683 5266704 5266688 5266683 -
ctttgagcatttatcatttcta

SEQ ID NO: 136548 - DNA, 22 bp, Artificial Sequence
  Synthetic oligonucleotide; CTT chr11 5266680 5266701 5266685 5266680 -
tgagcatttatcatttctatgt

SEQ ID NO: 136549 - DNA, 22 bp, Artificial Sequence
  Synthetic oligonucleotide; TTT chr11 5266679 5266700 5266684 5266679 -
gagcatttatcatttctatgta

SEQ ID NO: 136550 - DNA, 22 bp, Artificial Sequence
  Synthetic oligonucleotide; TTG chr11 5266678 5266699 5266683 5266678 -
agcatttatcatttctatgtat

SEQ ID NO: 136551 - DNA, 22 bp, Artificial Sequence
  Synthetic oligonucleotide; TTT chr11 5266671 5266692 5266676 5266671 -
atcatttctatgtattgagaaa

SEQ ID NO: 136552 - DNA, 22 bp, Artificial Sequence
  Synthetic oligonucleotide; TTA chr11 5266670 5266691 5266675 5266670 -
tcatttctatgtattgagaaaa

SEQ ID NO: 136553 - DNA, 22 bp, Artificial Sequence
  Synthetic oligonucleotide; TTT chr11 5266664 5266685 5266669 5266664 -
ctatgtattgagaaaatttcaa

SEQ ID NO: 136554 - DNA, 22 bp, Artificial Sequence
  Synthetic oligonucleotide; TTC chr11 5266663 5266684 5266668 5266663 -
tatgtattgagaaaatttcaaa

SEQ ID NO: 136555 - DNA, 22 bp, Artificial Sequence
  Synthetic oligonucleotide; CTA chr11 5266661 5266682 5266666 5266661 -
tgtattgagaaaatttcaaatc

SEQ ID NO: 136556 - DNA, 22 bp, Artificial Sequence
  Synthetic oligonucleotide; TTG chr11 5266654 5266675 5266659 5266654 -
agaaaatttcaaatcctcattt

SEQ ID NO: 136557 - DNA, 22 bp, Artificial Sequence
  Synthetic oligonucleotide; TTT chr11 5266645 5266666 5266650 5266645 -
caaatcctcatttctagccatt

SEQ ID NO: 136558 - DNA, 22 bp, Artificial Sequence
  Synthetic oligonucleotide; TTC chr11 5266644 5266665 5266649 5266644 -
aaatcctcatttctagccattt

SEQ ID NO: 136559 - DNA, 22 bp, Artificial Sequence
  Synthetic oligonucleotide; CTC chr11 5266636 5266657 5266641 5266636 -
atttctagccattttgaaatat

SEQ ID NO: 136560 - DNA, 22 bp, Artificial Sequence
  Synthetic oligonucleotide; TTT chr11 5266632 5266653 5266637 5266632 -
ctagccattttgaaatatataa

SEQ ID NO: 136561 - DNA, 22 bp, Artificial Sequence
  Synthetic oligonucleotide; TTC chr11 5266631 5266652 5266636 5266631 -
tagccattttgaaatatataat

SEQ ID NO: 136562 - DNA, 22 bp, Artificial Sequence
  Synthetic oligonucleotide; CTA chr11 5266629 5266650 5266634 5266629 -
gccattttgaaatatataataa

SEQ ID NO: 136563 - DNA, 22 bp, Artificial Sequence
  Synthetic oligonucleotide; TTT chr11 5266622 5266643 5266627 5266622 -
tgaaatatataataaatagtaa

SEQ ID NO: 136564 - DNA, 22 bp, Artificial Sequence
  Synthetic oligonucleotide; TTT chr11 5266621 5266642 5266626 5266621 -
gaaatatataataaatagtaat

SEQ ID NO: 136565 - DNA, 22 bp, Artificial Sequence
  Synthetic oligonucleotide; TTG chr11 5266620 5266641 5266625 5266620 -
aaatatataataaatagtaatt

SEQ ID NO: 136566 - DNA, 22 bp, Artificial Sequence
  Synthetic oligonucleotide; TTA chr11 5266597 5266618 5266602 5266597 -
actatagtcaccctactcaaat

SEQ ID NO: 136567 - DNA, 22 bp, Artificial Sequence
  Synthetic oligonucleotide; CTA chr11 5266593 5266614 5266598 5266593 -
tagtcaccctactcaaatatca

SEQ ID NO: 136568 - DNA, 22 bp, Artificial Sequence
  Synthetic oligonucleotide; CTA chr11 5266582 5266603 5266587 5266582 -
ctcaaatatcaaacattatggc

SEQ ID NO: 136569 - DNA, 22 bp, Artificial Sequence
  Synthetic oligonucleotide; CTC chr11 5266579 5266600 5266584 5266579 -
aaatatcaaacattatggctta

SEQ ID NO: 136570 - DNA, 22 bp, Artificial Sequence
  Synthetic oligonucleotide; TTA chr11 5266564 5266585 5266569 5266564 -
tggcttaatccttctatccaac

SEQ ID NO: 136571 - DNA, 22 bp, Artificial Sequence
  Synthetic oligonucleotide; CTT chr11 5266558 5266579 5266563 5266558 -
aatccttctatccaactgtgtt

SEQ ID NO: 136572 - DNA, 22 bp, Artificial Sequence
  Synthetic oligonucleotide; TTA chr11 5266557 5266578 5266562 5266557 -
atccttctatccaactgtgttt

SEQ ID NO: 136573 - DNA, 22 bp, Artificial Sequence
  Synthetic oligonucleotide; CTT chr11 5266551 5266572 5266556 5266551 -
ctatccaactgtgtttgtacct

SEQ ID NO: 136574 - DNA, 22 bp, Artificial Sequence
  Synthetic oligonucleotide; TTC chr11 5266550 5266571 5266555 5266550 -
tatccaactgtgtttgtaccta

SEQ ID NO: 136575 - DNA, 22 bp, Artificial Sequence
  Synthetic oligonucleotide; CTA chr11 5266548 5266569 5266553 5266548 -
tccaactgtgtttgtacctatt

SEQ ID NO: 136576 - DNA, 22 bp, Artificial Sequence
  Synthetic oligonucleotide; CTG chr11 5266540 5266561 5266545 5266540 -
tgtttgtacctattaaccaaca

SEQ ID NO: 136577 - DNA, 22 bp, Artificial Sequence
  Synthetic oligonucleotide; TTT chr11 5266535 5266556 5266540 5266535 -
gtacctattaaccaacatctct

SEQ ID NO: 136578 - DNA, 22 bp, Artificial Sequence
  Synthetic oligonucleotide; TTG chr11 5266534 5266555 5266539 5266534 -
tacctattaaccaacatctctt

SEQ ID NO: 136579 - DNA, 22 bp, Artificial Sequence
  Synthetic oligonucleotide; CTA chr11 5266528 5266549 5266533 5266528 -
ttaaccaacatctcttaaatcc

SEQ ID NO: 136580 - DNA, 22 bp, Artificial Sequence
  Synthetic oligonucleotide; TTA chr11 5266525 5266546 5266530 5266525 -
accaacatctcttaaatcccct

SEQ ID NO: 136581 - DNA, 22 bp, Artificial Sequence
  Synthetic oligonucleotide; CTC chr11 5266514 5266535 5266519 5266514 -
ttaaatcccctcccatacacac

SEQ ID NO: 136582 - DNA, 22 bp, Artificial Sequence
  Synthetic oligonucleotide; CTT chr11 5266512 5266533 5266517 5266512 -
aaatcccctcccatacacactc

SEQ ID NO: 136583 - DNA, 22 bp, Artificial Sequence
  Synthetic oligonucleotide; TTA chr11 5266511 5266532 5266516 5266511 -
aatcccctcccatacacactca

SEQ ID NO: 136584 - DNA, 22 bp, Artificial Sequence
  Synthetic oligonucleotide; CTC chr11 5266502 5266523 5266507 5266502 -
ccatacacactcacactttttc

SEQ ID NO: 136585 - DNA, 22 bp, Artificial Sequence
  Synthetic oligonucleotide; CTC chr11 5266490 5266511 5266495 5266490 -
acactttttccagcctctgata

SEQ ID NO: 136586 - DNA, 22 bp, Artificial Sequence
  Synthetic oligonucleotide; CTT chr11 5266484 5266505 5266489 5266484 -
tttccagcctctgataactatc

SEQ ID NO: 136587 - DNA, 22 bp, Artificial Sequence
  Synthetic oligonucleotide; TTT chr11 5266483 5266504 5266488 5266483 -
ttccagcctctgataactatca

SEQ ID NO: 136588 - DNA, 22 bp, Artificial Sequence
  Synthetic oligonucleotide; TTT chr11 5266482 5266503 5266487 5266482 -
tccagcctctgataactatcat

SEQ ID NO: 136589 - DNA, 22 bp, Artificial Sequence
  Synthetic oligonucleotide; TTT chr11 5266481 5266502 5266486 5266481 -
ccagcctctgataactatcatt

SEQ ID NO: 136590 - DNA, 22 bp, Artificial Sequence
  Synthetic oligonucleotide; TTC chr11 5266480 5266501 5266485 5266480 -
cagcctctgataactatcattc

SEQ ID NO: 136591 - DNA, 22 bp, Artificial Sequence
  Synthetic oligonucleotide; CTC chr11 5266473 5266494 5266478 5266473 -
tgataactatcattctactctc

SEQ ID NO: 136592 - DNA, 22 bp, Artificial Sequence
  Synthetic oligonucleotide; CTG chr11 5266471 5266492 5266476 5266471 -
ataactatcattctactctcta

SEQ ID NO: 136593 - DNA, 22 bp, Artificial Sequence
  Synthetic oligonucleotide; CTA chr11 5266464 5266485 5266469 5266464 -
tcattctactctctaccaccat

SEQ ID NO: 136594 - DNA, 22 bp, Artificial Sequence
  Synthetic oligonucleotide; TTC chr11 5266458 5266479 5266463 5266458 -
tactctctaccaccatgagacc

SEQ ID NO: 136595 - DNA, 22 bp, Artificial Sequence
  Synthetic oligonucleotide; CTA chr11 5266456 5266477 5266461 5266456 -
ctctctaccaccatgagaccca

SEQ ID NO: 136596 - DNA, 22 bp, Artificial Sequence
  Synthetic oligonucleotide; CTC chr11 5266453 5266474 5266458 5266453 -
tctaccaccatgagacccactt

SEQ ID NO: 136597 - DNA, 22 bp, Artificial Sequence
  Synthetic oligonucleotide; CTC chr11 5266451 5266472 5266456 5266451 -
taccaccatgagacccactttt

SEQ ID NO: 136598 - DNA, 22 bp, Artificial Sequence
  Synthetic oligonucleotide; CTA chr11 5266449 5266470 5266454 5266449 -
ccaccatgagacccactttttt

SEQ ID NO: 136599 - DNA, 22 bp, Artificial Sequence
  Synthetic oligonucleotide; CTT chr11 5266431 5266452 5266436 5266431 -
ttttagctcccacagatgaata

SEQ ID NO: 136600 - DNA, 22 bp, Artificial Sequence
  Synthetic oligonucleotide; TTT chr11 5266430 5266451 5266435 5266430 -
tttagctcccacagatgaataa

SEQ ID NO: 136601 - DNA, 22 bp, Artificial Sequence
  Synthetic oligonucleotide; TTT chr11 5266429 5266450 5266434 5266429 -
ttagctcccacagatgaataaa

SEQ ID NO: 136602 - DNA, 22 bp, Artificial Sequence
  Synthetic oligonucleotide; TTT chr11 5266428 5266449 5266433 5266428 -
tagctcccacagatgaataaaa

SEQ ID NO: 136603 - DNA, 22 bp, Artificial Sequence
  Synthetic oligonucleotide; TTT chr11 5266427 5266448 5266432 5266427 -
agctcccacagatgaataaaaa

SEQ ID NO: 136604 - DNA, 22 bp, Artificial Sequence
  Synthetic oligonucleotide; TTA chr11 5266426 5266447 5266431 5266426 -
gctcccacagatgaataaaaac

SEQ ID NO: 136605 - DNA, 22 bp, Artificial Sequence
  Synthetic oligonucleotide; CTC chr11 5266422 5266443 5266427 5266422 -
ccacagatgaataaaaacatgt

SEQ ID NO: 136606 - DNA, 22 bp, Artificial Sequence
  Synthetic oligonucleotide; TTT chr11 5266393 5266414 5266398 5266393 -
gactttctgtatctggcttatt

SEQ ID NO: 136607 - DNA, 22 bp, Artificial Sequence
  Synthetic oligonucleotide; TTG chr11 5266392 5266413 5266397 5266392 -
actttctgtatctggcttattt

SEQ ID NO: 136608 - DNA, 22 bp, Artificial Sequence
  Synthetic oligonucleotide; CTT chr11 5266388 5266409 5266393 5266388 -
tctgtatctggcttattttatt

SEQ ID NO: 136609 - DNA, 22 bp, Artificial Sequence
  Synthetic oligonucleotide; TTT chr11 5266387 5266408 5266392 5266387 -
ctgtatctggcttattttatta

SEQ ID NO: 136610 - DNA, 22 bp, Artificial Sequence
  Synthetic oligonucleotide; TTC chr11 5266386 5266407 5266391 5266386 -
tgtatctggcttattttattat

SEQ ID NO: 136611 - DNA, 22 bp, Artificial Sequence
  Synthetic oligonucleotide; CTG chr11 5266384 5266405 5266389 5266384 -
tatctggcttattttattatct

SEQ ID NO: 136612 - DNA, 22 bp, Artificial Sequence
  Synthetic oligonucleotide; CTG chr11 5266378 5266399 5266383 5266378 -
gcttattttattatctatctct

SEQ ID NO: 136613 - DNA, 22 bp, Artificial Sequence
  Synthetic oligonucleotide; CTT chr11 5266374 5266395 5266379 5266374 -
attttattatctatctctttgg

SEQ ID NO: 136614 - DNA, 22 bp, Artificial Sequence
  Synthetic oligonucleotide; TTA chr11 5266373 5266394 5266378 5266373 -
ttttattatctatctctttggc

SEQ ID NO: 136615 - DNA, 22 bp, Artificial Sequence
  Synthetic oligonucleotide; TTT chr11 5266370 5266391 5266375 5266370 -
tattatctatctctttggcata

SEQ ID NO: 136616 - DNA, 22 bp, Artificial Sequence
  Synthetic oligonucleotide; TTT chr11 5266369 5266390 5266374 5266369 -
attatctatctctttggcatac

SEQ ID NO: 136617 - DNA, 22 bp, Artificial Sequence
  Synthetic oligonucleotide; TTA chr11 5266368 5266389 5266373 5266368 -
ttatctatctctttggcatacc

SEQ ID NO: 136618 - DNA, 22 bp, Artificial Sequence
  Synthetic oligonucleotide; TTA chr11 5266365 5266386 5266370 5266365 -
tctatctctttggcataccaag

SEQ ID NO: 136619 - DNA, 22 bp, Artificial Sequence
  Synthetic oligonucleotide; CTA chr11 5266361 5266382 5266366 5266361 -
tctctttggcataccaagagtt

SEQ ID NO: 136620 - DNA, 22 bp, Artificial Sequence
  Synthetic oligonucleotide; CTC chr11 5266357 5266378 5266362 5266357 -
tttggcataccaagagtttgtt

SEQ ID NO: 136621 - DNA, 22 bp, Artificial Sequence
  Synthetic oligonucleotide; CTT chr11 5266355 5266376 5266360 5266355 -
tggcataccaagagtttgtttt

SEQ ID NO: 136622 - DNA, 22 bp, Artificial Sequence
  Synthetic oligonucleotide; TTT chr11 5266354 5266375 5266359 5266354 -
ggcataccaagagtttgttttt

SEQ ID NO: 136623 - DNA, 22 bp, Artificial Sequence
  Synthetic oligonucleotide; TTG chr11 5266353 5266374 5266358 5266353 -
gcataccaagagtttgtttttg

SEQ ID NO: 136624 - DNA, 22 bp, Artificial Sequence
  Synthetic oligonucleotide; TTT chr11 5266338 5266359 5266343 5266338 -
gtttttgttctgcttcagggct

SEQ ID NO: 136625 - DNA, 22 bp, Artificial Sequence
  Synthetic oligonucleotide; TTG chr11 5266337 5266358 5266342 5266337 -
tttttgttctgcttcagggctt

SEQ ID NO: 136626 - DNA, 22 bp, Artificial Sequence
  Synthetic oligonucleotide; TTT chr11 5266334 5266355 5266339 5266334 -
ttgttctgcttcagggctttca

SEQ ID NO: 136627 - DNA, 22 bp, Artificial Sequence
  Synthetic oligonucleotide; TTT chr11 5266333 5266354 5266338 5266333 -
tgttctgcttcagggctttcaa

SEQ ID NO: 136628 - DNA, 22 bp, Artificial Sequence
  Synthetic oligonucleotide; TTT chr11 5266332 5266353 5266337 5266332 -
gttctgcttcagggctttcaat

SEQ ID NO: 136629 - DNA, 22 bp, Artificial Sequence
  Synthetic oligonucleotide; TTG chr11 5266331 5266352 5266336 5266331 -
ttctgcttcagggctttcaatt

SEQ ID NO: 136630 - DNA, 22 bp, Artificial Sequence
  Synthetic oligonucleotide; TTC chr11 5266328 5266349 5266333 5266328 -
tgcttcagggctttcaattaac

SEQ ID NO: 136631 - DNA, 22 bp, Artificial Sequence
  Synthetic oligonucleotide; CTG chr11 5266326 5266347 5266331 5266326 -
cttcagggctttcaattaacat

SEQ ID NO: 136632 - DNA, 22 bp, Artificial Sequence
  Synthetic oligonucleotide; CTT chr11 5266323 5266344 5266328 5266323 -
cagggctttcaattaacataat

SEQ ID NO: 136633 - DNA, 22 bp, Artificial Sequence
  Synthetic oligonucleotide; TTC chr11 5266322 5266343 5266327 5266322 -
agggctttcaattaacataatg

SEQ ID NO: 136634 - DNA, 22 bp, Artificial Sequence
  Synthetic oligonucleotide; CTT chr11 5266315 5266336 5266320 5266315 -
tcaattaacataatgacctctg

SEQ ID NO: 136635 - DNA, 22 bp, Artificial Sequence
  Synthetic oligonucleotide; TTT chr11 5266314 5266335 5266319 5266314 -
caattaacataatgacctctgg

SEQ ID NO: 136636 - DNA, 22 bp, Artificial Sequence
  Synthetic oligonucleotide; TTC chr11 5266313 5266334 5266318 5266313 -
aattaacataatgacctctggt

SEQ ID NO: 136637 - DNA, 22 bp, Artificial Sequence
  Synthetic oligonucleotide; TTA chr11 5266308 5266329 5266313 5266308 -
acataatgacctctggttccat

SEQ ID NO: 136638 - DNA, 22 bp, Artificial Sequence
  Synthetic oligonucleotide; CTC chr11 5266295 5266316 5266300 5266295 -
tggttccatccatgttgctaca

SEQ ID NO: 136639 - DNA, 22 bp, Artificial Sequence
  Synthetic oligonucleotide; CTG chr11 5266293 5266314 5266298 5266293 -
gttccatccatgttgctacaaa

SEQ ID NO: 136640 - DNA, 22 bp, Artificial Sequence
  Synthetic oligonucleotide; TTC chr11 5266289 5266310 5266294 5266289 -
catccatgttgctacaaatgac

SEQ ID NO: 136641 - DNA, 22 bp, Artificial Sequence
  Synthetic oligonucleotide; TTG chr11 5266278 5266299 5266283 5266278 -
ctacaaatgacaagatttcatt

SEQ ID NO: 136642 - DNA, 22 bp, Artificial Sequence
  Synthetic oligonucleotide; CTA chr11 5266275 5266296 5266280 5266275 -
caaatgacaagatttcattctt

SEQ ID NO: 136643 - DNA, 22 bp, Artificial Sequence
  Synthetic oligonucleotide; TTT chr11 5266260 5266281 5266265 5266260 -
cattctttttcatggcaaaata

SEQ ID NO: 136644 - DNA, 22 bp, Artificial Sequence
  Synthetic oligonucleotide; TTC chr11 5266259 5266280 5266264 5266259 -
attctttttcatggcaaaatag

SEQ ID NO: 136645 - DNA, 22 bp, Artificial Sequence
  Synthetic oligonucleotide; TTC chr11 5266255 5266276 5266260 5266255 -
tttttcatggcaaaatagtact

SEQ ID NO: 136646 - DNA, 22 bp, Artificial Sequence
  Synthetic oligonucleotide; CTT chr11 5266253 5266274 5266258 5266253 -
tttcatggcaaaatagtactgt

SEQ ID NO: 136647 - DNA, 22 bp, Artificial Sequence
  Synthetic oligonucleotide; TTT chr11 5266252 5266273 5266257 5266252 -
ttcatggcaaaatagtactgtg

SEQ ID NO: 136648 - DNA, 22 bp, Artificial Sequence
  Synthetic oligonucleotide; TTT chr11 5266251 5266272 5266256 5266251 -
tcatggcaaaatagtactgtgc

SEQ ID NO: 136649 - DNA, 22 bp, Artificial Sequence
  Synthetic oligonucleotide; TTT chr11 5266250 5266271 5266255 5266250 -
catggcaaaatagtactgtgca

SEQ ID NO: 136650 - DNA, 22 bp, Artificial Sequence
  Synthetic oligonucleotide; TTC chr11 5266249 5266270 5266254 5266249 -
atggcaaaatagtactgtgcaa

SEQ ID NO: 136651 - DNA, 22 bp, Artificial Sequence
  Synthetic oligonucleotide; CTG chr11 5266232 5266253 5266237 5266232 -
tgcaaaaatacaattttttaat

SEQ ID NO: 136652 - DNA, 22 bp, Artificial Sequence
  Synthetic oligonucleotide; TTT chr11 5266216 5266237 5266221 5266216 -
tttaatccgttcatctgttgat

SEQ ID NO: 136653 - DNA, 22 bp, Artificial Sequence
  Synthetic oligonucleotide; TTT chr11 5266215 5266236 5266220 5266215 -
ttaatccgttcatctgttgata

SEQ ID NO: 136654 - DNA, 22 bp, Artificial Sequence
  Synthetic oligonucleotide; TTT chr11 5266214 5266235 5266219 5266214 -
taatccgttcatctgttgatag

SEQ ID NO: 136655 - DNA, 22 bp, Artificial Sequence
  Synthetic oligonucleotide; TTT chr11 5266213 5266234 5266218 5266213 -
aatccgttcatctgttgataga

SEQ ID NO: 136656 - DNA, 22 bp, Artificial Sequence
  Synthetic oligonucleotide; TTA chr11 5266212 5266233 5266217 5266212 -
atccgttcatctgttgatagac

SEQ ID NO: 136657 - DNA, 22 bp, Artificial Sequence
  Synthetic oligonucleotide; TTC chr11 5266204 5266225 5266209 5266204 -
atctgttgatagacacttaggt

SEQ ID NO: 136658 - DNA, 22 bp, Artificial Sequence
  Synthetic oligonucleotide; CTG chr11 5266199 5266220 5266204 5266199 -
ttgatagacacttaggttgatc

SEQ ID NO: 136659 - DNA, 22 bp, Artificial Sequence
  Synthetic oligonucleotide; TTG chr11 5266196 5266217 5266201 5266196 -
atagacacttaggttgatccca

SEQ ID NO: 136660 - DNA, 22 bp, Artificial Sequence
  Synthetic oligonucleotide; CTT chr11 5266186 5266207 5266191 5266186 -
aggttgatcccaaaccttaact

SEQ ID NO: 136661 - DNA, 22 bp, Artificial Sequence
  Synthetic oligonucleotide; TTA chr11 5266185 5266206 5266190 5266185 -
ggttgatcccaaaccttaacta

SEQ ID NO: 136662 - DNA, 22 bp, Artificial Sequence
  Synthetic oligonucleotide; TTG chr11 5266180 5266201 5266185 5266180 -
atcccaaaccttaactattgtg

SEQ ID NO: 136663 - DNA, 22 bp, Artificial Sequence
  Synthetic oligonucleotide; CTT chr11 5266168 5266189 5266173 5266168 -
aactattgtgaatagtgcttca

SEQ ID NO: 136664 - DNA, 22 bp, Artificial Sequence
  Synthetic oligonucleotide; TTA chr11 5266167 5266188 5266172 5266167 -
actattgtgaatagtgcttcaa

SEQ ID NO: 136665 - DNA, 22 bp, Artificial Sequence
  Synthetic oligonucleotide; CTA chr11 5266163 5266184 5266168 5266163 -
ttgtgaatagtgcttcaataaa

SEQ ID NO: 136666 - DNA, 22 bp, Artificial Sequence
  Synthetic oligonucleotide; TTG chr11 5266160 5266181 5266165 5266160 -
tgaatagtgcttcaataaacat

SEQ ID NO: 136667 - DNA, 22 bp, Artificial Sequence
  Synthetic oligonucleotide; CTT chr11 5266148 5266169 5266153 5266148 -
caataaacatgagtgtaatgtg

SEQ ID NO: 136668 - DNA, 22 bp, Artificial Sequence
  Synthetic oligonucleotide; TTC chr11 5266147 5266168 5266152 5266147 -
aataaacatgagtgtaatgtgt

SEQ ID NO: 136669 - DNA, 22 bp, Artificial Sequence
  Synthetic oligonucleotide; TTG chr11 5266119 5266140 5266124 5266119 -
gatatactgatttcctttcttt

SEQ ID NO: 136670 - DNA, 22 bp, Artificial Sequence
  Synthetic oligonucleotide; CTG chr11 5266110 5266131 5266115 5266110 -
atttcctttcttttggataaat

SEQ ID NO: 136671 - DNA, 22 bp, Artificial Sequence
  Synthetic oligonucleotide; TTT chr11 5266106 5266127 5266111 5266106 -
cctttcttttggataaataacc

SEQ ID NO: 136672 - DNA, 22 bp, Artificial Sequence
  Synthetic oligonucleotide; TTC chr11 5266105 5266126 5266110 5266105 -
ctttcttttggataaataacca

SEQ ID NO: 136673 - DNA, 22 bp, Artificial Sequence
  Synthetic oligonucleotide; CTT chr11 5266102 5266123 5266107 5266102 -
tcttttggataaataaccacta

SEQ ID NO: 136674 - DNA, 22 bp, Artificial Sequence
  Synthetic oligonucleotide; TTT chr11 5266101 5266122 5266106 5266101 -
cttttggataaataaccactag

SEQ ID NO: 136675 - DNA, 22 bp, Artificial Sequence
  Synthetic oligonucleotide; TTC chr11 5266100 5266121 5266105 5266100 -
ttttggataaataaccactagt

SEQ ID NO: 136676 - DNA, 22 bp, Artificial Sequence
  Synthetic oligonucleotide; CTT chr11 5266098 5266119 5266103 5266098 -
ttggataaataaccactagtga

SEQ ID NO: 136677 - DNA, 22 bp, Artificial Sequence
  Synthetic oligonucleotide; TTT chr11 5266097 5266118 5266102 5266097 -
tggataaataaccactagtgag

SEQ ID NO: 136678 - DNA, 22 bp, Artificial Sequence
  Synthetic oligonucleotide; TTT chr11 5266096 5266117 5266101 5266096 -
ggataaataaccactagtgaga

SEQ ID NO: 136679 - DNA, 22 bp, Artificial Sequence
  Synthetic oligonucleotide; TTG chr11 5266095 5266116 5266100 5266095 -
gataaataaccactagtgagat

SEQ ID NO: 136680 - DNA, 22 bp, Artificial Sequence
  Synthetic oligonucleotide; CTA chr11 5266080 5266101 5266085 5266080 -
gtgagattgctggattgtatga

SEQ ID NO: 136681 - DNA, 22 bp, Artificial Sequence
  Synthetic oligonucleotide; TTG chr11 5266071 5266092 5266076 5266071 -
ctggattgtatgatagttctgt

SEQ ID NO: 136682 - DNA, 22 bp, Artificial Sequence
  Synthetic oligonucleotide; CTG chr11 5266068 5266089 5266073 5266068 -
gattgtatgatagttctgtttt

SEQ ID NO: 136683 - DNA, 22 bp, Artificial Sequence
  Synthetic oligonucleotide; TTG chr11 5266063 5266084 5266068 5266063 -
tatgatagttctgtttttagtt

SEQ ID NO: 136684 - DNA, 22 bp, Artificial Sequence
  Synthetic oligonucleotide; TTC chr11 5266052 5266073 5266057 5266052 -
tgtttttagtttactgagaaat

SEQ ID NO: 136685 - DNA, 22 bp, Artificial Sequence
  Synthetic oligonucleotide; CTG chr11 5266050 5266071 5266055 5266050 -
tttttagtttactgagaaatct

SEQ ID NO: 136686 - DNA, 22 bp, Artificial Sequence
  Synthetic oligonucleotide; TTT chr11 5266047 5266068 5266052 5266047 -
ttagtttactgagaaatcttca

SEQ ID NO: 136687 - DNA, 22 bp, Artificial Sequence
  Synthetic oligonucleotide; TTT chr11 5266046 5266067 5266051 5266046 -
tagtttactgagaaatcttcat

SEQ ID NO: 136688 - DNA, 22 bp, Artificial Sequence
  Synthetic oligonucleotide; TTT chr11 5266045 5266066 5266050 5266045 -
agtttactgagaaatcttcata

SEQ ID NO: 136689 - DNA, 22 bp, Artificial Sequence
  Synthetic oligonucleotide; TTA chr11 5266044 5266065 5266049 5266044 -
gtttactgagaaatcttcatac

SEQ ID NO: 136690 - DNA, 22 bp, Artificial Sequence
  Synthetic oligonucleotide; TTT chr11 5266040 5266061 5266045 5266040 -
actgagaaatcttcatactgtt

SEQ ID NO: 136691 - DNA, 22 bp, Artificial Sequence
  Synthetic oligonucleotide; TTA chr11 5266039 5266060 5266044 5266039 -
ctgagaaatcttcatactgttt

SEQ ID NO: 136692 - DNA, 22 bp, Artificial Sequence
  Synthetic oligonucleotide; CTG chr11 5266036 5266057 5266041 5266036 -
agaaatcttcatactgttttcc

SEQ ID NO: 136693 - DNA, 22 bp, Artificial Sequence
  Synthetic oligonucleotide; CTT chr11 5266027 5266048 5266032 5266027 -
catactgttttccataatggtt

SEQ ID NO: 136694 - DNA, 22 bp, Artificial Sequence
  Synthetic oligonucleotide; TTC chr11 5266026 5266047 5266031 5266026 -
atactgttttccataatggttg

SEQ ID NO: 136695 - DNA, 22 bp, Artificial Sequence
  Synthetic oligonucleotide; CTG chr11 5266020 5266041 5266025 5266020 -
ttttccataatggttgtactat

SEQ ID NO: 136696 - DNA, 22 bp, Artificial Sequence
  Synthetic oligonucleotide; TTT chr11 5266017 5266038 5266022 5266017 -
tccataatggttgtactatttt

SEQ ID NO: 136697 - DNA, 22 bp, Artificial Sequence
  Synthetic oligonucleotide; TTT chr11 5266016 5266037 5266021 5266016 -
ccataatggttgtactatttta

SEQ ID NO: 136698 - DNA, 22 bp, Artificial Sequence
  Synthetic oligonucleotide; TTC chr11 5266015 5266036 5266020 5266015 -
cataatggttgtactattttac

SEQ ID NO: 136699 - DNA, 22 bp, Artificial Sequence
  Synthetic oligonucleotide; TTG chr11 5266004 5266025 5266009 5266004 -
tactattttacattcccaccaa

SEQ ID NO: 136700 - DNA, 22 bp, Artificial Sequence
  Synthetic oligonucleotide; CTA chr11 5265999 5266020 5266004 5265999 -
ttttacattcccaccaacagtg

SEQ ID NO: 136701 - DNA, 22 bp, Artificial Sequence
  Synthetic oligonucleotide; TTT chr11 5265996 5266017 5266001 5265996 -
tacattcccaccaacagtgtgt

SEQ ID NO: 136702 - DNA, 22 bp, Artificial Sequence
  Synthetic oligonucleotide; TTT chr11 5265995 5266016 5266000 5265995 -
acattcccaccaacagtgtgta

SEQ ID NO: 136703 - DNA, 22 bp, Artificial Sequence
  Synthetic oligonucleotide; TTA chr11 5265994 5266015 5265999 5265994 -
cattcccaccaacagtgtgtaa

SEQ ID NO: 136704 - DNA, 22 bp, Artificial Sequence
  Synthetic oligonucleotide; TTC chr11 5265989 5266010 5265994 5265989 -
ccaccaacagtgtgtaagaaag

SEQ ID NO: 136705 - DNA, 22 bp, Artificial Sequence
  Synthetic oligonucleotide; TTC chr11 5265962 5265983 5265967 5265962 -
ccttttctccatatcctcacaa

SEQ ID NO: 136706 - DNA, 22 bp, Artificial Sequence
  Synthetic oligonucleotide; CTT chr11 5265958 5265979 5265963 5265958 -
ttctccatatcctcacaaggat

SEQ ID NO: 136707 - DNA, 22 bp, Artificial Sequence
  Synthetic oligonucleotide; TTT chr11 5265957 5265978 5265962 5265957 -
tctccatatcctcacaaggatc

SEQ ID NO: 136708 - DNA, 22 bp, Artificial Sequence
  Synthetic oligonucleotide; TTT chr11 5265956 5265977 5265961 5265956 -
ctccatatcctcacaaggatct

SEQ ID NO: 136709 - DNA, 22 bp, Artificial Sequence
  Synthetic oligonucleotide; TTC chr11 5265955 5265976 5265960 5265955 -
tccatatcctcacaaggatctg

SEQ ID NO: 136710 - DNA, 22 bp, Artificial Sequence
  Synthetic oligonucleotide; CTC chr11 5265953 5265974 5265958 5265953 -
catatcctcacaaggatctgtt

SEQ ID NO: 136711 - DNA, 22 bp, Artificial Sequence
  Synthetic oligonucleotide; CTC chr11 5265944 5265965 5265949 5265944 -
acaaggatctgttattttttgt

SEQ ID NO: 136712 - DNA, 22 bp, Artificial Sequence
  Synthetic oligonucleotide; CTG chr11 5265933 5265954 5265938 5265933 -
ttattttttgtcttttttgtta

SEQ ID NO: 136713 - DNA, 22 bp, Artificial Sequence
  Synthetic oligonucleotide; TTA chr11 5265930 5265951 5265935 5265930 -
ttttttgtcttttttgttaata

SEQ ID NO: 136714 - DNA, 22 bp, Artificial Sequence
  Synthetic oligonucleotide; TTT chr11 5265927 5265948 5265932 5265927 -
tttgtcttttttgttaatagcc

SEQ ID NO: 136715 - DNA, 22 bp, Artificial Sequence
  Synthetic oligonucleotide; TTT chr11 5265926 5265947 5265931 5265926 -
ttgtcttttttgttaatagccg

SEQ ID NO: 136716 - DNA, 22 bp, Artificial Sequence
  Synthetic oligonucleotide; TTT chr11 5265925 5265946 5265930 5265925 -
tgtcttttttgttaatagccgt

SEQ ID NO: 136717 - DNA, 22 bp, Artificial Sequence
  Synthetic oligonucleotide; TTT chr11 5265924 5265945 5265929 5265924 -
gtcttttttgttaatagccgtt

SEQ ID NO: 136718 - DNA, 22 bp, Artificial Sequence
  Synthetic oligonucleotide; TTG chr11 5265923 5265944 5265928 5265923 -
tcttttttgttaatagccgttt

SEQ ID NO: 136719 - DNA, 22 bp, Artificial Sequence
  Synthetic oligonucleotide; CTT chr11 5265919 5265940 5265924 5265919 -
ttttgttaatagccgttttaac

SEQ ID NO: 136720 - DNA, 22 bp, Artificial Sequence
  Synthetic oligonucleotide; TTT chr11 5265918 5265939 5265923 5265918 -
tttgttaatagccgttttaact

SEQ ID NO: 136721 - DNA, 22 bp, Artificial Sequence
  Synthetic oligonucleotide; TTT chr11 5265917 5265938 5265922 5265917 -
ttgttaatagccgttttaacta

SEQ ID NO: 136722 - DNA, 22 bp, Artificial Sequence
  Synthetic oligonucleotide; TTT chr11 5265916 5265937 5265921 5265916 -
tgttaatagccgttttaactag

SEQ ID NO: 136723 - DNA, 22 bp, Artificial Sequence
  Synthetic oligonucleotide; TTT chr11 5265915 5265936 5265920 5265915 -
gttaatagccgttttaactaga

SEQ ID NO: 136724 - DNA, 22 bp, Artificial Sequence
  Synthetic oligonucleotide; TTG chr11 5265914 5265935 5265919 5265914 -
ttaatagccgttttaactagag

SEQ ID NO: 136725 - DNA, 22 bp, Artificial Sequence
  Synthetic oligonucleotide; TTA chr11 5265911 5265932 5265916 5265911 -
atagccgttttaactagagtaa

SEQ ID NO: 136726 - DNA, 22 bp, Artificial Sequence
  Synthetic oligonucleotide; TTT chr11 5265901 5265922 5265906 5265901 -
taactagagtaagtagatatct

SEQ ID NO: 136727 - DNA, 22 bp, Artificial Sequence
  Synthetic oligonucleotide; TTT chr11 5265900 5265921 5265905 5265900 -
aactagagtaagtagatatctc

SEQ ID NO: 136728 - DNA, 22 bp, Artificial Sequence
  Synthetic oligonucleotide; TTA chr11 5265899 5265920 5265904 5265899 -
actagagtaagtagatatctca

SEQ ID NO: 136729 - DNA, 22 bp, Artificial Sequence
  Synthetic oligonucleotide; CTA chr11 5265895 5265916 5265900 5265895 -
gagtaagtagatatctcattgt

SEQ ID NO: 136730 - DNA, 22 bp, Artificial Sequence
  Synthetic oligonucleotide; CTC chr11 5265878 5265899 5265883 5265878 -
attgtagttttgatttgcattt

SEQ ID NO: 136731 - DNA, 22 bp, Artificial Sequence
  Synthetic oligonucleotide; TTG chr11 5265874 5265895 5265879 5265874 -
tagttttgatttgcatttccct

SEQ ID NO: 136732 - DNA, 22 bp, Artificial Sequence
  Synthetic oligonucleotide; TTT chr11 5265868 5265889 5265873 5265868 -
tgatttgcatttccctgatcat

SEQ ID NO: 136733 - DNA, 22 bp, Artificial Sequence
  Synthetic oligonucleotide; TTT chr11 5265867 5265888 5265872 5265867 -
gatttgcatttccctgatcatt

SEQ ID NO: 136734 - DNA, 22 bp, Artificial Sequence
  Synthetic oligonucleotide; TTG chr11 5265866 5265887 5265871 5265866 -
atttgcatttccctgatcatta

SEQ ID NO: 136735 - DNA, 22 bp, Artificial Sequence
  Synthetic oligonucleotide; TTT chr11 5265862 5265883 5265867 5265862 -
gcatttccctgatcattagtga

SEQ ID NO: 136736 - DNA, 22 bp, Artificial Sequence
  Synthetic oligonucleotide; TTG chr11 5265861 5265882 5265866 5265861 -
catttccctgatcattagtgat

SEQ ID NO: 136737 - DNA, 22 bp, Artificial Sequence
  Synthetic oligonucleotide; TTT chr11 5265856 5265877 5265861 5265856 -
ccctgatcattagtgatgttga

SEQ ID NO: 136738 - DNA, 22 bp, Artificial Sequence
  Synthetic oligonucleotide; TTC chr11 5265855 5265876 5265860 5265855 -
cctgatcattagtgatgttgag

SEQ ID NO: 136739 - DNA, 22 bp, Artificial Sequence
  Synthetic oligonucleotide; CTG chr11 5265851 5265872 5265856 5265851 -
atcattagtgatgttgagaatt

SEQ ID NO: 136740 - DNA, 22 bp, Artificial Sequence
  Synthetic oligonucleotide; TTA chr11 5265844 5265865 5265849 5265844 -
gtgatgttgagaattttttcat

SEQ ID NO: 136741 - DNA, 22 bp, Artificial Sequence
  Synthetic oligonucleotide; TTG chr11 5265835 5265856 5265840 5265835 -
agaattttttcatatgtttgtt

SEQ ID NO: 136742 - DNA, 22 bp, Artificial Sequence
  Synthetic oligonucleotide; TTT chr11 5265828 5265849 5265833 5265828 -
tttcatatgtttgttggtcatt

SEQ ID NO: 136743 - DNA, 22 bp, Artificial Sequence
  Synthetic oligonucleotide; TTT chr11 5265827 5265848 5265832 5265827 -
ttcatatgtttgttggtcattt

SEQ ID NO: 136744 - DNA, 22 bp, Artificial Sequence
  Synthetic oligonucleotide; TTT chr11 5265826 5265847 5265831 5265826 -
tcatatgtttgttggtcatttg

SEQ ID NO: 136745 - DNA, 22 bp, Artificial Sequence
  Synthetic oligonucleotide; TTT chr11 5265825 5265846 5265830 5265825 -
catatgtttgttggtcatttgt

SEQ ID NO: 136746 - DNA, 22 bp, Artificial Sequence
  Synthetic oligonucleotide; TTC chr11 5265824 5265845 5265829 5265824 -
atatgtttgttggtcatttgta

SEQ ID NO: 136747 - DNA, 22 bp, Artificial Sequence
  Synthetic oligonucleotide; TTT chr11 5265816 5265837 5265821 5265816 -
gttggtcatttgtatatctttt

SEQ ID NO: 136748 - DNA, 22 bp, Artificial Sequence
  Synthetic oligonucleotide; TTG chr11 5265815 5265836 5265820 5265815 -
ttggtcatttgtatatcttttt

SEQ ID NO: 136749 - DNA, 22 bp, Artificial Sequence
  Synthetic oligonucleotide; TTG chr11 5265812 5265833 5265817 5265812 -
gtcatttgtatatctttttctg

SEQ ID NO: 136750 - DNA, 22 bp, Artificial Sequence
  Synthetic oligonucleotide; TTT chr11 5265805 5265826 5265810 5265805 -
gtatatctttttctgagaattg

SEQ ID NO: 136751 - DNA, 22 bp, Artificial Sequence
  Synthetic oligonucleotide; TTG chr11 5265804 5265825 5265809 5265804 -
tatatctttttctgagaattgt

SEQ ID NO: 136752 - DNA, 22 bp, Artificial Sequence
  Synthetic oligonucleotide; CTT chr11 5265796 5265817 5265801 5265796 -
tttctgagaattgtctgttcat

SEQ ID NO: 136753 - DNA, 22 bp, Artificial Sequence
  Synthetic oligonucleotide; TTT chr11 5265795 5265816 5265800 5265795 -
ttctgagaattgtctgttcatg

SEQ ID NO: 136754 - DNA, 22 bp, Artificial Sequence
  Synthetic oligonucleotide; TTT chr11 5265794 5265815 5265799 5265794 -
tctgagaattgtctgttcatgt

SEQ ID NO: 136755 - DNA, 22 bp, Artificial Sequence
  Synthetic oligonucleotide; TTT chr11 5265793 5265814 5265798 5265793 -
ctgagaattgtctgttcatgtc

SEQ ID NO: 136756 - DNA, 22 bp, Artificial Sequence
  Synthetic oligonucleotide; TTC chr11 5265792 5265813 5265797 5265792 -
tgagaattgtctgttcatgtcc

SEQ ID NO: 136757 - DNA, 22 bp, Artificial Sequence
  Synthetic oligonucleotide; CTG chr11 5265790 5265811 5265795 5265790 -
agaattgtctgttcatgtcctt

SEQ ID NO: 136758 - DNA, 22 bp, Artificial Sequence
  Synthetic oligonucleotide; TTG chr11 5265783 5265804 5265788 5265783 -
tctgttcatgtccttagcctac

SEQ ID NO: 136759 - DNA, 22 bp, Artificial Sequence
  Synthetic oligonucleotide; CTG chr11 5265779 5265800 5265784 5265779 -
ttcatgtccttagcctactttt

SEQ ID NO: 136760 - DNA, 22 bp, Artificial Sequence
  Synthetic oligonucleotide; TTC chr11 5265776 5265797 5265781 5265776 -
atgtccttagcctactttttat

SEQ ID NO: 136761 - DNA, 22 bp, Artificial Sequence
  Synthetic oligonucleotide; CTT chr11 5265768 5265789 5265773 5265768 -
agcctactttttattgggattg

SEQ ID NO: 136762 - DNA, 22 bp, Artificial Sequence
  Synthetic oligonucleotide; TTA chr11 5265767 5265788 5265772 5265767 -
gcctactttttattgggattgt

SEQ ID NO: 136763 - DNA, 22 bp, Artificial Sequence
  Synthetic oligonucleotide; CTA chr11 5265762 5265783 5265767 5265762 -
ctttttattgggattgtttgtt

SEQ ID NO: 136764 - DNA, 22 bp, Artificial Sequence
  Synthetic oligonucleotide; CTT chr11 5265759 5265780 5265764 5265759 -
tttattgggattgtttgttatt

SEQ ID NO: 136765 - DNA, 22 bp, Artificial Sequence
  Synthetic oligonucleotide; TTT chr11 5265758 5265779 5265763 5265758 -
ttattgggattgtttgttattt

SEQ ID NO: 136766 - DNA, 22 bp, Artificial Sequence
  Synthetic oligonucleotide; TTT chr11 5265757 5265778 5265762 5265757 -
tattgggattgtttgttatttt

SEQ ID NO: 136767 - DNA, 22 bp, Artificial Sequence
  Synthetic oligonucleotide; TTT chr11 5265756 5265777 5265761 5265756 -
attgggattgtttgttattttc

SEQ ID NO: 136768 - DNA, 22 bp, Artificial Sequence
  Synthetic oligonucleotide; TTA chr11 5265755 5265776 5265760 5265755 -
ttgggattgtttgttattttct

SEQ ID NO: 136769 - DNA, 22 bp, Artificial Sequence
  Synthetic oligonucleotide; TTG chr11 5265752 5265773 5265757 5265752 -
ggattgtttgttattttcttga

SEQ ID NO: 136770 - DNA, 22 bp, Artificial Sequence
  Synthetic oligonucleotide; TTG chr11 5265746 5265767 5265751 5265746 -
tttgttattttcttgataatct

SEQ ID NO: 136771 - DNA, 22 bp, Artificial Sequence
  Synthetic oligonucleotide; TTT chr11 5265743 5265764 5265748 5265743 -
gttattttcttgataatctatt

SEQ ID NO: 136772 - DNA, 22 bp, Artificial Sequence
  Synthetic oligonucleotide; TTG chr11 5265742 5265763 5265747 5265742 -
ttattttcttgataatctattt

SEQ ID NO: 136773 - DNA, 22 bp, Artificial Sequence
  Synthetic oligonucleotide; TTA chr11 5265739 5265760 5265744 5265739 -
ttttcttgataatctatttgtg

SEQ ID NO: 136774 - DNA, 22 bp, Artificial Sequence
  Synthetic oligonucleotide; TTT chr11 5265736 5265757 5265741 5265736 -
tcttgataatctatttgtgttc

SEQ ID NO: 136775 - DNA, 22 bp, Artificial Sequence
  Synthetic oligonucleotide; TTT chr11 5265735 5265756 5265740 5265735 -
cttgataatctatttgtgttca

SEQ ID NO: 136776 - DNA, 22 bp, Artificial Sequence
  Synthetic oligonucleotide; TTC chr11 5265734 5265755 5265739 5265734 -
ttgataatctatttgtgttcat

SEQ ID NO: 136777 - DNA, 22 bp, Artificial Sequence
  Synthetic oligonucleotide; CTT chr11 5265732 5265753 5265737 5265732 -
gataatctatttgtgttcattt

SEQ ID NO: 136778 - DNA, 22 bp, Artificial Sequence
  Synthetic oligonucleotide; TTG chr11 5265731 5265752 5265736 5265731 -
ataatctatttgtgttcatttt

SEQ ID NO: 136779 - DNA, 22 bp, Artificial Sequence
  Synthetic oligonucleotide; CTA chr11 5265723 5265744 5265728 5265723 -
tttgtgttcattttagagcctg

SEQ ID NO: 136780 - DNA, 22 bp, Artificial Sequence
  Synthetic oligonucleotide; TTT chr11 5265720 5265741 5265725 5265720 -
gtgttcattttagagcctggat

SEQ ID NO: 136781 - DNA, 22 bp, Artificial Sequence
  Synthetic oligonucleotide; TTG chr11 5265719 5265740 5265724 5265719 -
tgttcattttagagcctggata

SEQ ID NO: 136782 - DNA, 22 bp, Artificial Sequence
  Synthetic oligonucleotide; TTC chr11 5265714 5265735 5265719 5265714 -
attttagagcctggatattatt

SEQ ID NO: 136783 - DNA, 22 bp, Artificial Sequence
  Synthetic oligonucleotide; TTT chr11 5265710 5265731 5265715 5265710 -
tagagcctggatattattcttt

SEQ ID NO: 136784 - DNA, 22 bp, Artificial Sequence
  Synthetic oligonucleotide; TTT chr11 5265709 5265730 5265714 5265709 -
agagcctggatattattctttt

SEQ ID NO: 136785 - DNA, 22 bp, Artificial Sequence
  Synthetic oligonucleotide; TTA chr11 5265708 5265729 5265713 5265708 -
gagcctggatattattcttttg

SEQ ID NO: 136786 - DNA, 22 bp, Artificial Sequence
  Synthetic oligonucleotide; CTG chr11 5265701 5265722 5265706 5265701 -
gatattattcttttgtcagatg

SEQ ID NO: 136787 - DNA, 22 bp, Artificial Sequence
  Synthetic oligonucleotide; TTA chr11 5265694 5265715 5265699 5265694 -
ttcttttgtcagatgtatagat

SEQ ID NO: 136788 - DNA, 22 bp, Artificial Sequence
  Synthetic oligonucleotide; TTC chr11 5265691 5265712 5265696 5265691 -
ttttgtcagatgtatagattgt

SEQ ID NO: 136789 - DNA, 22 bp, Artificial Sequence
  Synthetic oligonucleotide; CTT chr11 5265689 5265710 5265694 5265689 -
ttgtcagatgtatagattgtga

SEQ ID NO: 136790 - DNA, 22 bp, Artificial Sequence
  Synthetic oligonucleotide; TTT chr11 5265688 5265709 5265693 5265688 -
tgtcagatgtatagattgtgaa

SEQ ID NO: 136791 - DNA, 22 bp, Artificial Sequence
  Synthetic oligonucleotide; TTT chr11 5265687 5265708 5265692 5265687 -
gtcagatgtatagattgtgaag

SEQ ID NO: 136792 - DNA, 22 bp, Artificial Sequence
  Synthetic oligonucleotide; TTG chr11 5265686 5265707 5265691 5265686 -
tcagatgtatagattgtgaaga

SEQ ID NO: 136793 - DNA, 22 bp, Artificial Sequence
  Synthetic oligonucleotide; TTG chr11 5265670 5265691 5265675 5265670 -
tgaagattttctcccactctgt

SEQ ID NO: 136794 - DNA, 22 bp, Artificial Sequence
  Synthetic oligonucleotide; TTT chr11 5265661 5265682 5265666 5265661 -
tctcccactctgtgggttgtct

SEQ ID NO: 136795 - DNA, 22 bp, Artificial Sequence
  Synthetic oligonucleotide; TTT chr11 5265660 5265681 5265665 5265660 -
ctcccactctgtgggttgtctg

SEQ ID NO: 136796 - DNA, 22 bp, Artificial Sequence
  Synthetic oligonucleotide; TTC chr11 5265659 5265680 5265664 5265659 -
tcccactctgtgggttgtctgt

SEQ ID NO: 136797 - DNA, 22 bp, Artificial Sequence
  Synthetic oligonucleotide; CTC chr11 5265657 5265678 5265662 5265657 -
ccactctgtgggttgtctgttt

SEQ ID NO: 136798 - DNA, 22 bp, Artificial Sequence
  Synthetic oligonucleotide; CTC chr11 5265651 5265672 5265656 5265651 -
tgtgggttgtctgtttattctg

SEQ ID NO: 136799 - DNA, 22 bp, Artificial Sequence
  Synthetic oligonucleotide; CTG chr11 5265649 5265670 5265654 5265649 -
tgggttgtctgtttattctgca

SEQ ID NO: 136800 - DNA, 22 bp, Artificial Sequence
  Synthetic oligonucleotide; TTG chr11 5265642 5265663 5265647 5265642 -
tctgtttattctgcagactctt

SEQ ID NO: 136801 - DNA, 22 bp, Artificial Sequence
  Synthetic oligonucleotide; CTG chr11 5265638 5265659 5265643 5265638 -
tttattctgcagactcttcctt

SEQ ID NO: 136802 - DNA, 22 bp, Artificial Sequence
  Synthetic oligonucleotide; TTT chr11 5265635 5265656 5265640 5265635 -
attctgcagactcttccttttg

SEQ ID NO: 136803 - DNA, 22 bp, Artificial Sequence
  Synthetic oligonucleotide; TTA chr11 5265634 5265655 5265639 5265634 -
ttctgcagactcttccttttgc

SEQ ID NO: 136804 - DNA, 22 bp, Artificial Sequence
  Synthetic oligonucleotide; TTC chr11 5265631 5265652 5265636 5265631 -
tgcagactcttccttttgccat

SEQ ID NO: 136805 - DNA, 22 bp, Artificial Sequence
  Synthetic oligonucleotide; CTG chr11 5265629 5265650 5265634 5265629 -
cagactcttccttttgccatgc

SEQ ID NO: 136806 - DNA, 22 bp, Artificial Sequence
  Synthetic oligonucleotide; CTC chr11 5265622 5265643 5265627 5265622 -
ttccttttgccatgcaaaagct

SEQ ID NO: 136807 - DNA, 22 bp, Artificial Sequence
  Synthetic oligonucleotide; CTT chr11 5265620 5265641 5265625 5265620 -
ccttttgccatgcaaaagctct

SEQ ID NO: 136808 - DNA, 22 bp, Artificial Sequence
  Synthetic oligonucleotide; TTC chr11 5265619 5265640 5265624 5265619 -
cttttgccatgcaaaagctctt

SEQ ID NO: 136809 - DNA, 22 bp, Artificial Sequence
  Synthetic oligonucleotide; CTT chr11 5265616 5265637 5265621 5265616 -
ttgccatgcaaaagctctttag

SEQ ID NO: 136810 - DNA, 22 bp, Artificial Sequence
  Synthetic oligonucleotide; TTT chr11 5265615 5265636 5265620 5265615 -
tgccatgcaaaagctctttagt

SEQ ID NO: 136811 - DNA, 22 bp, Artificial Sequence
  Synthetic oligonucleotide; TTT chr11 5265614 5265635 5265619 5265614 -
gccatgcaaaagctctttagtt

SEQ ID NO: 136812 - DNA, 22 bp, Artificial Sequence
  Synthetic oligonucleotide; TTG chr11 5265613 5265634 5265618 5265613 -
ccatgcaaaagctctttagttt

SEQ ID NO: 136813 - DNA, 22 bp, Artificial Sequence
  Synthetic oligonucleotide; CTC chr11 5265599 5265620 5265604 5265599 -
tttagtttaatttagtcccaga

SEQ ID NO: 136814 - DNA, 22 bp, Artificial Sequence
  Synthetic oligonucleotide; CTT chr11 5265597 5265618 5265602 5265597 -
tagtttaatttagtcccagata

SEQ ID NO: 136815 - DNA, 22 bp, Artificial Sequence
  Synthetic oligonucleotide; TTT chr11 5265596 5265617 5265601 5265596 -
agtttaatttagtcccagatat

SEQ ID NO: 136816 - DNA, 22 bp, Artificial Sequence
  Synthetic oligonucleotide; TTA chr11 5265595 5265616 5265600 5265595 -
gtttaatttagtcccagatatt

SEQ ID NO: 136817 - DNA, 22 bp, Artificial Sequence
  Synthetic oligonucleotide; TTT chr11 5265591 5265612 5265596 5265591 -
aatttagtcccagatattttct

SEQ ID NO: 136818 - DNA, 22 bp, Artificial Sequence
  Synthetic oligonucleotide; TTA chr11 5265590 5265611 5265595 5265590 -
atttagtcccagatattttctt

SEQ ID NO: 136819 - DNA, 22 bp, Artificial Sequence
  Synthetic oligonucleotide; TTT chr11 5265586 5265607 5265591 5265586 -
agtcccagatattttctttgtt

SEQ ID NO: 136820 - DNA, 22 bp, Artificial Sequence
  Synthetic oligonucleotide; TTA chr11 5265585 5265606 5265590 5265585 -
gtcccagatattttctttgttt

SEQ ID NO: 136821 - DNA, 22 bp, Artificial Sequence
  Synthetic oligonucleotide; TTT chr11 5265572 5265593 5265577 5265572 -
tctttgtttttatgtatttgca

SEQ ID NO: 136822 - DNA, 22 bp, Artificial Sequence
  Synthetic oligonucleotide; TTT chr11 5265571 5265592 5265576 5265571 -
ctttgtttttatgtatttgcat

SEQ ID NO: 136823 - DNA, 22 bp, Artificial Sequence
  Synthetic oligonucleotide; TTC chr11 5265570 5265591 5265575 5265570 -
tttgtttttatgtatttgcatt

SEQ ID NO: 136824 - DNA, 22 bp, Artificial Sequence
  Synthetic oligonucleotide; CTT chr11 5265568 5265589 5265573 5265568 -
tgtttttatgtatttgcatttg

SEQ ID NO: 136825 - DNA, 22 bp, Artificial Sequence
  Synthetic oligonucleotide; TTT chr11 5265567 5265588 5265572 5265567 -
gtttttatgtatttgcatttgt

SEQ ID NO: 136826 - DNA, 22 bp, Artificial Sequence
  Synthetic oligonucleotide; TTG chr11 5265566 5265587 5265571 5265566 -
tttttatgtatttgcatttgtg

SEQ ID NO: 136827 - DNA, 22 bp, Artificial Sequence
  Synthetic oligonucleotide; TTT chr11 5265563 5265584 5265568 5265563 -
ttatgtatttgcatttgtgttc

SEQ ID NO: 136828 - DNA, 22 bp, Artificial Sequence
  Synthetic oligonucleotide; TTT chr11 5265562 5265583 5265567 5265562 -
tatgtatttgcatttgtgttct

SEQ ID NO: 136829 - DNA, 22 bp, Artificial Sequence
  Synthetic oligonucleotide; TTT chr11 5265561 5265582 5265566 5265561 -
atgtatttgcatttgtgttctt

SEQ ID NO: 136830 - DNA, 22 bp, Artificial Sequence
  Synthetic oligonucleotide; TTA chr11 5265560 5265581 5265565 5265560 -
tgtatttgcatttgtgttcttg

SEQ ID NO: 136831 - DNA, 22 bp, Artificial Sequence
  Synthetic oligonucleotide; TTT chr11 5265553 5265574 5265558 5265553 -
gcatttgtgttcttggtcatga

SEQ ID NO: 136832 - DNA, 22 bp, Artificial Sequence
  Synthetic oligonucleotide; TTG chr11 5265552 5265573 5265557 5265552 -
catttgtgttcttggtcatgaa

SEQ ID NO: 136833 - DNA, 22 bp, Artificial Sequence
  Synthetic oligonucleotide; TTT chr11 5265547 5265568 5265552 5265547 -
gtgttcttggtcatgaaatcct

SEQ ID NO: 136834 - DNA, 22 bp, Artificial Sequence
  Synthetic oligonucleotide; TTG chr11 5265546 5265567 5265551 5265546 -
tgttcttggtcatgaaatcctt

SEQ ID NO: 136835 - DNA, 22 bp, Artificial Sequence
  Synthetic oligonucleotide; TTC chr11 5265541 5265562 5265546 5265541 -
ttggtcatgaaatcctttccta

SEQ ID NO: 136836 - DNA, 22 bp, Artificial Sequence
  Synthetic oligonucleotide; CTT chr11 5265539 5265560 5265544 5265539 -
ggtcatgaaatcctttcctaag

SEQ ID NO: 136837 - DNA, 22 bp, Artificial Sequence
  Synthetic oligonucleotide; TTG chr11 5265538 5265559 5265543 5265538 -
gtcatgaaatcctttcctaagc

SEQ ID NO: 136838 - DNA, 22 bp, Artificial Sequence
  Synthetic oligonucleotide; CTT chr11 5265524 5265545 5265529 5265524 -
tcctaagccaatgtgtagaagg

SEQ ID NO: 136839 - DNA, 22 bp, Artificial Sequence
  Synthetic oligonucleotide; TTT chr11 5265523 5265544 5265528 5265523 -
cctaagccaatgtgtagaaggg

SEQ ID NO: 136840 - DNA, 22 bp, Artificial Sequence
  Synthetic oligonucleotide; TTC chr11 5265522 5265543 5265527 5265522 -
ctaagccaatgtgtagaagggt

SEQ ID NO: 136841 - DNA, 22 bp, Artificial Sequence
  Synthetic oligonucleotide; CTA chr11 5265519 5265540 5265524 5265519 -
agccaatgtgtagaagggtttt

SEQ ID NO: 136842 - DNA, 22 bp, Artificial Sequence
  Synthetic oligonucleotide; TTT chr11 5265498 5265519 5265503 5265498 -
ttccgatgttattttctagaat

SEQ ID NO: 136843 - DNA, 22 bp, Artificial Sequence
  Synthetic oligonucleotide; TTT chr11 5265497 5265518 5265502 5265497 -
tccgatgttattttctagaatt

SEQ ID NO: 136844 - DNA, 22 bp, Artificial Sequence
  Synthetic oligonucleotide; TTT chr11 5265496 5265517 5265501 5265496 -
ccgatgttattttctagaattg

SEQ ID NO: 136845 - DNA, 22 bp, Artificial Sequence
  Synthetic oligonucleotide; TTC chr11 5265495 5265516 5265500 5265495 -
cgatgttattttctagaattgt

SEQ ID NO: 136846 - DNA, 22 bp, Artificial Sequence
  Synthetic oligonucleotide; TTA chr11 5265487 5265508 5265492 5265487 -
ttttctagaattgttacagttt

SEQ ID NO: 136847 - DNA, 22 bp, Artificial Sequence
  Synthetic oligonucleotide; TTT chr11 5265484 5265505 5265489 5265484 -
tctagaattgttacagtttcag

SEQ ID NO: 136848 - DNA, 22 bp, Artificial Sequence
  Synthetic oligonucleotide; TTT chr11 5265483 5265504 5265488 5265483 -
ctagaattgttacagtttcagg

SEQ ID NO: 136849 - DNA, 22 bp, Artificial Sequence
  Synthetic oligonucleotide; TTC chr11 5265482 5265503 5265487 5265482 -
tagaattgttacagtttcaggg

SEQ ID NO: 136850 - DNA, 22 bp, Artificial Sequence
  Synthetic oligonucleotide; CTA chr11 5265480 5265501 5265485 5265480 -
gaattgttacagtttcagggct

SEQ ID NO: 136851 - DNA, 22 bp, Artificial Sequence
  Synthetic oligonucleotide; TTG chr11 5265474 5265495 5265479 5265474 -
ttacagtttcagggcttagatt

SEQ ID NO: 136852 - DNA, 22 bp, Artificial Sequence
  Synthetic oligonucleotide; TTA chr11 5265471 5265492 5265476 5265471 -
cagtttcagggcttagatttaa

SEQ ID NO: 136853 - DNA, 22 bp, Artificial Sequence
  Synthetic oligonucleotide; TTT chr11 5265465 5265486 5265470 5265465 -
cagggcttagatttaagtcctt

SEQ ID NO: 136854 - DNA, 22 bp, Artificial Sequence
  Synthetic oligonucleotide; TTC chr11 5265464 5265485 5265469 5265464 -
agggcttagatttaagtccttg

SEQ ID NO: 136855 - DNA, 22 bp, Artificial Sequence
  Synthetic oligonucleotide; CTT chr11 5265457 5265478 5265462 5265457 -
agatttaagtccttgatccatc

SEQ ID NO: 136856 - DNA, 22 bp, Artificial Sequence
  Synthetic oligonucleotide; TTA chr11 5265456 5265477 5265461 5265456 -
gatttaagtccttgatccatct

SEQ ID NO: 136857 - DNA, 22 bp, Artificial Sequence
  Synthetic oligonucleotide; TTT chr11 5265451 5265472 5265456 5265451 -
aagtccttgatccatcttgagt

SEQ ID NO: 136858 - DNA, 22 bp, Artificial Sequence
  Synthetic oligonucleotide; TTA chr11 5265450 5265471 5265455 5265450 -
agtccttgatccatcttgagtt

SEQ ID NO: 136859 - DNA, 22 bp, Artificial Sequence
  Synthetic oligonucleotide; CTT chr11 5265443 5265464 5265448 5265443 -
gatccatcttgagttgattttt

SEQ ID NO: 136860 - DNA, 22 bp, Artificial Sequence
  Synthetic oligonucleotide; TTG chr11 5265442 5265463 5265447 5265442 -
atccatcttgagttgatttttg

SEQ ID NO: 136861 - DNA, 22 bp, Artificial Sequence
  Synthetic oligonucleotide; CTT chr11 5265433 5265454 5265438 5265433 -
gagttgatttttgtataaggtg

SEQ ID NO: 136862 - DNA, 22 bp, Artificial Sequence
  Synthetic oligonucleotide; TTG chr11 5265432 5265453 5265437 5265432 -
agttgatttttgtataaggtga

SEQ ID NO: 136863 - DNA, 22 bp, Artificial Sequence
  Synthetic oligonucleotide; TTG chr11 5265427 5265448 5265432 5265427 -
atttttgtataaggtgagagat

SEQ ID NO: 136864 - DNA, 22 bp, Artificial Sequence
  Synthetic oligonucleotide; TTT chr11 5265423 5265444 5265428 5265423 -
ttgtataaggtgagagatgaag

SEQ ID NO: 136865 - DNA, 22 bp, Artificial Sequence
  Synthetic oligonucleotide; TTT chr11 5265422 5265443 5265427 5265422 -
tgtataaggtgagagatgaaga

SEQ ID NO: 136866 - DNA, 22 bp, Artificial Sequence
  Synthetic oligonucleotide; TTT chr11 5265421 5265442 5265426 5265421 -
gtataaggtgagagatgaagat

SEQ ID NO: 136867 - DNA, 22 bp, Artificial Sequence
  Synthetic oligonucleotide; TTG chr11 5265420 5265441 5265425 5265420 -
tataaggtgagagatgaagatc

SEQ ID NO: 136868 - DNA, 22 bp, Artificial Sequence
  Synthetic oligonucleotide; TTT chr11 5265392 5265413 5265397 5265392 -
cattctcctacatgtagcttgc

SEQ ID NO: 136869 - DNA, 22 bp, Artificial Sequence
  Synthetic oligonucleotide; TTC chr11 5265391 5265412 5265396 5265391 -
attctcctacatgtagcttgcc

SEQ ID NO: 136870 - DNA, 22 bp, Artificial Sequence
  Synthetic oligonucleotide; TTC chr11 5265387 5265408 5265392 5265387 -
tcctacatgtagcttgccagct

SEQ ID NO: 136871 - DNA, 22 bp, Artificial Sequence
  Synthetic oligonucleotide; CTC chr11 5265385 5265406 5265390 5265385 -
ctacatgtagcttgccagctat

SEQ ID NO: 136872 - DNA, 22 bp, Artificial Sequence
  Synthetic oligonucleotide; CTA chr11 5265382 5265403 5265387 5265382 -
catgtagcttgccagctatccc

SEQ ID NO: 136873 - DNA, 22 bp, Artificial Sequence
  Synthetic oligonucleotide; CTT chr11 5265372 5265393 5265377 5265372 -
gccagctatccccgcaccattt

SEQ ID NO: 136874 - DNA, 22 bp, Artificial Sequence
  Synthetic oligonucleotide; TTG chr11 5265371 5265392 5265376 5265371 -
ccagctatccccgcaccatttg

SEQ ID NO: 136875 - DNA, 22 bp, Artificial Sequence
  Synthetic oligonucleotide; CTA chr11 5265364 5265385 5265369 5265364 -
tccccgcaccatttgttgaata

SEQ ID NO: 136876 - DNA, 22 bp, Artificial Sequence
  Synthetic oligonucleotide; TTT chr11 5265350 5265371 5265355 5265350 -
gttgaatagggtgccctttccc

SEQ ID NO: 136877 - DNA, 22 bp, Artificial Sequence
  Synthetic oligonucleotide; TTG chr11 5265349 5265370 5265354 5265349 -
ttgaatagggtgccctttcccc

SEQ ID NO: 136878 - DNA, 22 bp, Artificial Sequence
  Synthetic oligonucleotide; TTG chr11 5265346 5265367 5265351 5265346 -
aatagggtgccctttccccact

SEQ ID NO: 136879 - DNA, 22 bp, Artificial Sequence
  Synthetic oligonucleotide; CTT chr11 5265332 5265353 5265337 5265332 -
tccccactttatgtttttgttt

SEQ ID NO: 136880 - DNA, 22 bp, Artificial Sequence
  Synthetic oligonucleotide; TTT chr11 5265331 5265352 5265336 5265331 -
ccccactttatgtttttgtttg

SEQ ID NO: 136881 - DNA, 22 bp, Artificial Sequence
  Synthetic oligonucleotide; TTC chr11 5265330 5265351 5265335 5265330 -
cccactttatgtttttgtttgc

SEQ ID NO: 136882 - DNA, 22 bp, Artificial Sequence
  Synthetic oligonucleotide; CTT chr11 5265323 5265344 5265328 5265323 -
tatgtttttgtttgctttgtca

SEQ ID NO: 136883 - DNA, 22 bp, Artificial Sequence
  Synthetic oligonucleotide; TTT chr11 5265322 5265343 5265327 5265322 -
atgtttttgtttgctttgtcaa

SEQ ID NO: 136884 - DNA, 22 bp, Artificial Sequence
  Synthetic oligonucleotide; TTA chr11 5265321 5265342 5265326 5265321 -
tgtttttgtttgctttgtcaaa

SEQ ID NO: 136885 - DNA, 22 bp, Artificial Sequence
  Synthetic oligonucleotide; TTT chr11 5265316 5265337 5265321 5265316 -
ttgtttgctttgtcaaagatca

SEQ ID NO: 136886 - DNA, 22 bp, Artificial Sequence
  Synthetic oligonucleotide; TTT chr11 5265315 5265336 5265320 5265315 -
tgtttgctttgtcaaagatcag

SEQ ID NO: 136887 - DNA, 22 bp, Artificial Sequence
  Synthetic oligonucleotide; TTT chr11 5265314 5265335 5265319 5265314 -
gtttgctttgtcaaagatcagt

SEQ ID NO: 136888 - DNA, 22 bp, Artificial Sequence
  Synthetic oligonucleotide; TTG chr11 5265313 5265334 5265318 5265313 -
tttgctttgtcaaagatcagtt

SEQ ID NO: 136889 - DNA, 22 bp, Artificial Sequence
  Synthetic oligonucleotide; TTT chr11 5265310 5265331 5265315 5265310 -
gctttgtcaaagatcagttgga

SEQ ID NO: 136890 - DNA, 22 bp, Artificial Sequence
  Synthetic oligonucleotide; TTG chr11 5265309 5265330 5265314 5265309 -
ctttgtcaaagatcagttggat

SEQ ID NO: 136891 - DNA, 22 bp, Artificial Sequence
  Synthetic oligonucleotide; CTT chr11 5265306 5265327 5265311 5265306 -
tgtcaaagatcagttggatgta

SEQ ID NO: 136892 - DNA, 22 bp, Artificial Sequence
  Synthetic oligonucleotide; TTT chr11 5265305 5265326 5265310 5265305 -
gtcaaagatcagttggatgtaa

SEQ ID NO: 136893 - DNA, 22 bp, Artificial Sequence
  Synthetic oligonucleotide; TTG chr11 5265304 5265325 5265309 5265304 -
tcaaagatcagttggatgtaag

SEQ ID NO: 136894 - DNA, 22 bp, Artificial Sequence
  Synthetic oligonucleotide; TTG chr11 5265290 5265311 5265295 5265290 -
gatgtaagtatttgagtttatt

SEQ ID NO: 136895 - DNA, 22 bp, Artificial Sequence
  Synthetic oligonucleotide; TTT chr11 5265277 5265298 5265282 5265277 -
gagtttatttctgggttctcta

SEQ ID NO: 136896 - DNA, 22 bp, Artificial Sequence
  Synthetic oligonucleotide; TTG chr11 5265276 5265297 5265281 5265276 -
agtttatttctgggttctctat

SEQ ID NO: 136897 - DNA, 22 bp, Artificial Sequence
  Synthetic oligonucleotide; TTT chr11 5265271 5265292 5265276 5265271 -
atttctgggttctctattctgt

SEQ ID NO: 136898 - DNA, 22 bp, Artificial Sequence
  Synthetic oligonucleotide; TTA chr11 5265270 5265291 5265275 5265270 -
tttctgggttctctattctgtt

SEQ ID NO: 136899 - DNA, 22 bp, Artificial Sequence
  Synthetic oligonucleotide; TTT chr11 5265267 5265288 5265272 5265267 -
ctgggttctctattctgttcca

SEQ ID NO: 136900 - DNA, 22 bp, Artificial Sequence
  Synthetic oligonucleotide; TTC chr11 5265266 5265287 5265271 5265266 -
tgggttctctattctgttccat

SEQ ID NO: 136901 - DNA, 22 bp, Artificial Sequence
  Synthetic oligonucleotide; CTG chr11 5265264 5265285 5265269 5265264 -
ggttctctattctgttccattg

SEQ ID NO: 136902 - DNA, 22 bp, Artificial Sequence
  Synthetic oligonucleotide; TTC chr11 5265259 5265280 5265264 5265259 -
tctattctgttccattggtcga

SEQ ID NO: 136903 - DNA, 22 bp, Artificial Sequence
  Synthetic oligonucleotide; CTC chr11 5265257 5265278 5265262 5265257 -
tattctgttccattggtcgatg

SEQ ID NO: 136904 - DNA, 22 bp, Artificial Sequence
  Synthetic oligonucleotide; CTA chr11 5265255 5265276 5265260 5265255 -
ttctgttccattggtcgatgtg

SEQ ID NO: 136905 - DNA, 22 bp, Artificial Sequence
  Synthetic oligonucleotide; TTC chr11 5265252 5265273 5265257 5265252 -
tgttccattggtcgatgtgcct

SEQ ID NO: 136906 - DNA, 22 bp, Artificial Sequence
  Synthetic oligonucleotide; CTG chr11 5265250 5265271 5265255 5265250 -
ttccattggtcgatgtgcctat

SEQ ID NO: 136907 - DNA, 22 bp, Artificial Sequence
  Synthetic oligonucleotide; TTC chr11 5265247 5265268 5265252 5265247 -
cattggtcgatgtgcctatttg

SEQ ID NO: 136908 - DNA, 22 bp, Artificial Sequence
  Synthetic oligonucleotide; TTG chr11 5265242 5265263 5265247 5265242 -
gtcgatgtgcctatttgtacac

SEQ ID NO: 136909 - DNA, 22 bp, Artificial Sequence
  Synthetic oligonucleotide; CTA chr11 5265229 5265250 5265234 5265229 -
tttgtacaccagcatcatgctg

SEQ ID NO: 136910 - DNA, 22 bp, Artificial Sequence
  Synthetic oligonucleotide; TTT chr11 5265226 5265247 5265231 5265226 -
gtacaccagcatcatgctgttt

SEQ ID NO: 136911 - DNA, 22 bp, Artificial Sequence
  Synthetic oligonucleotide; TTG chr11 5265225 5265246 5265230 5265225 -
tacaccagcatcatgctgtttt

SEQ ID NO: 136912 - DNA, 22 bp, Artificial Sequence
  Synthetic oligonucleotide; CTG chr11 5265207 5265228 5265212 5265207 -
ttttggtgactatggccttatt

SEQ ID NO: 136913 - DNA, 22 bp, Artificial Sequence
  Synthetic oligonucleotide; TTT chr11 5265204 5265225 5265209 5265204 -
tggtgactatggccttattgta

SEQ ID NO: 136914 - DNA, 22 bp, Artificial Sequence
  Synthetic oligonucleotide; TTT chr11 5265203 5265224 5265208 5265203 -
ggtgactatggccttattgtat

SEQ ID NO: 136915 - DNA, 22 bp, Artificial Sequence
  Synthetic oligonucleotide; TTG chr11 5265202 5265223 5265207 5265202 -
gtgactatggccttattgtata

SEQ ID NO: 136916 - DNA, 22 bp, Artificial Sequence
  Synthetic oligonucleotide; CTA chr11 5265195 5265216 5265200 5265195 -
tggccttattgtatagtttgaa

SEQ ID NO: 136917 - DNA, 22 bp, Artificial Sequence
  Synthetic oligonucleotide; CTT chr11 5265188 5265209 5265193 5265188 -
attgtatagtttgaaatgaggt

SEQ ID NO: 136918 - DNA, 22 bp, Artificial Sequence
  Synthetic oligonucleotide; TTA chr11 5265187 5265208 5265192 5265187 -
ttgtatagtttgaaatgaggta

SEQ ID NO: 136919 - DNA, 22 bp, Artificial Sequence
  Synthetic oligonucleotide; TTG chr11 5265184 5265205 5265189 5265184 -
tatagtttgaaatgaggtaatg

SEQ ID NO: 136920 - DNA, 22 bp, Artificial Sequence
  Synthetic oligonucleotide; TTT chr11 5265176 5265197 5265181 5265176 -
gaaatgaggtaatgtaatgcct

SEQ ID NO: 136921 - DNA, 22 bp, Artificial Sequence
  Synthetic oligonucleotide; TTG chr11 5265175 5265196 5265180 5265175 -
aaatgaggtaatgtaatgcctt

SEQ ID NO: 136922 - DNA, 22 bp, Artificial Sequence
  Synthetic oligonucleotide; CTT chr11 5265153 5265174 5265158 5265153 -
cagatttgttcttttttttaga

SEQ ID NO: 136923 - DNA, 22 bp, Artificial Sequence
  Synthetic oligonucleotide; TTC chr11 5265152 5265173 5265157 5265152 -
agatttgttcttttttttagac

SEQ ID NO: 136924 - DNA, 22 bp, Artificial Sequence
  Synthetic oligonucleotide; TTT chr11 5265146 5265167 5265151 5265146 -
gttcttttttttagacttgctt

SEQ ID NO: 136925 - DNA, 22 bp, Artificial Sequence
  Synthetic oligonucleotide; TTG chr11 5265145 5265166 5265150 5265145 -
ttcttttttttagacttgcttg

SEQ ID NO: 136926 - DNA, 22 bp, Artificial Sequence
  Synthetic oligonucleotide; TTC chr11 5265142 5265163 5265147 5265142 -
ttttttttagacttgcttgttt

SEQ ID NO: 136927 - DNA, 22 bp, Artificial Sequence
  Synthetic oligonucleotide; CTT chr11 5265140 5265161 5265145 5265140 -
ttttttagacttgcttgtttat

SEQ ID NO: 136928 - DNA, 22 bp, Artificial Sequence
  Synthetic oligonucleotide; TTT chr11 5265139 5265160 5265144 5265139 -
tttttagacttgcttgtttatt

SEQ ID NO: 136929 - DNA, 22 bp, Artificial Sequence
  Synthetic oligonucleotide; TTT chr11 5265138 5265159 5265143 5265138 -
ttttagacttgcttgtttattg

SEQ ID NO: 136930 - DNA, 22 bp, Artificial Sequence
  Synthetic oligonucleotide; TTT chr11 5265137 5265158 5265142 5265137 -
tttagacttgcttgtttattgg

SEQ ID NO: 136931 - DNA, 22 bp, Artificial Sequence
  Synthetic oligonucleotide; TTT chr11 5265136 5265157 5265141 5265136 -
ttagacttgcttgtttattggg

SEQ ID NO: 136932 - DNA, 22 bp, Artificial Sequence
  Synthetic oligonucleotide; TTT chr11 5265135 5265156 5265140 5265135 -
tagacttgcttgtttattgggc

SEQ ID NO: 136933 - DNA, 22 bp, Artificial Sequence
  Synthetic oligonucleotide; TTT chr11 5265134 5265155 5265139 5265134 -
agacttgcttgtttattgggct

SEQ ID NO: 136934 - DNA, 22 bp, Artificial Sequence
  Synthetic oligonucleotide; TTA chr11 5265133 5265154 5265138 5265133 -
gacttgcttgtttattgggctc

SEQ ID NO: 136935 - DNA, 22 bp, Artificial Sequence
  Synthetic oligonucleotide; CTT chr11 5265128 5265149 5265133 5265128 -
gcttgtttattgggctcttttt

SEQ ID NO: 136936 - DNA, 22 bp, Artificial Sequence
  Synthetic oligonucleotide; TTG chr11 5265127 5265148 5265132 5265127 -
cttgtttattgggctctttttt

SEQ ID NO: 136937 - DNA, 22 bp, Artificial Sequence
  Synthetic oligonucleotide; CTT chr11 5265124 5265145 5265129 5265124 -
gtttattgggctcttttttggt

SEQ ID NO: 136938 - DNA, 22 bp, Artificial Sequence
  Synthetic oligonucleotide; TTG chr11 5265123 5265144 5265128 5265123 -
tttattgggctcttttttggtt

SEQ ID NO: 136939 - DNA, 22 bp, Artificial Sequence
  Synthetic oligonucleotide; TTT chr11 5265120 5265141 5265125 5265120 -
attgggctcttttttggttcca

SEQ ID NO: 136940 - DNA, 22 bp, Artificial Sequence
  Synthetic oligonucleotide; TTA chr11 5265119 5265140 5265124 5265119 -
ttgggctcttttttggttccat

SEQ ID NO: 136941 - DNA, 22 bp, Artificial Sequence
  Synthetic oligonucleotide; TTG chr11 5265116 5265137 5265121 5265116 -
ggctcttttttggttccataag

SEQ ID NO: 136942 - DNA, 22 bp, Artificial Sequence
  Synthetic oligonucleotide; CTC chr11 5265111 5265132 5265116 5265111 -
ttttttggttccataagaattt

SEQ ID NO: 136943 - DNA, 22 bp, Artificial Sequence
  Synthetic oligonucleotide; CTT chr11 5265109 5265130 5265114 5265109 -
ttttggttccataagaatttta

SEQ ID NO: 136944 - DNA, 22 bp, Artificial Sequence
  Synthetic oligonucleotide; TTT chr11 5265108 5265129 5265113 5265108 -
tttggttccataagaattttag

SEQ ID NO: 136945 - DNA, 22 bp, Artificial Sequence
  Synthetic oligonucleotide; TTT chr11 5265107 5265128 5265112 5265107 -
ttggttccataagaattttagg

SEQ ID NO: 136946 - DNA, 22 bp, Artificial Sequence
  Synthetic oligonucleotide; TTT chr11 5265106 5265127 5265111 5265106 -
tggttccataagaattttagga

SEQ ID NO: 136947 - DNA, 22 bp, Artificial Sequence
  Synthetic oligonucleotide; TTT chr11 5265105 5265126 5265110 5265105 -
ggttccataagaattttaggat

SEQ ID NO: 136948 - DNA, 22 bp, Artificial Sequence
  Synthetic oligonucleotide; TTG chr11 5265104 5265125 5265109 5265104 -
gttccataagaattttaggatt

SEQ ID NO: 136949 - DNA, 22 bp, Artificial Sequence
  Synthetic oligonucleotide; TTC chr11 5265100 5265121 5265105 5265100 -
cataagaattttaggattgttt

SEQ ID NO: 136950 - DNA, 22 bp, Artificial Sequence
  Synthetic oligonucleotide; TTT chr11 5265089 5265110 5265094 5265089 -
taggattgttttttctagttct

SEQ ID NO: 136951 - DNA, 22 bp, Artificial Sequence
  Synthetic oligonucleotide; TTT chr11 5265088 5265109 5265093 5265088 -
aggattgttttttctagttctg

SEQ ID NO: 136952 - DNA, 22 bp, Artificial Sequence
  Synthetic oligonucleotide; TTA chr11 5265087 5265108 5265092 5265087 -
ggattgttttttctagttctgt

SEQ ID NO: 136953 - DNA, 22 bp, Artificial Sequence
  Synthetic oligonucleotide; TTG chr11 5265081 5265102 5265086 5265081 -
ttttttctagttctgtgaagac

SEQ ID NO: 136954 - DNA, 22 bp, Artificial Sequence
  Synthetic oligonucleotide; TTT chr11 5265078 5265099 5265083 5265078 -
tttctagttctgtgaagactaa

SEQ ID NO: 136955 - DNA, 22 bp, Artificial Sequence
  Synthetic oligonucleotide; TTT chr11 5265077 5265098 5265082 5265077 -
ttctagttctgtgaagactaat

SEQ ID NO: 136956 - DNA, 22 bp, Artificial Sequence
  Synthetic oligonucleotide; TTT chr11 5265076 5265097 5265081 5265076 -
tctagttctgtgaagactaatg

SEQ ID NO: 136957 - DNA, 22 bp, Artificial Sequence
  Synthetic oligonucleotide; TTT chr11 5265075 5265096 5265080 5265075 -
ctagttctgtgaagactaatgg

SEQ ID NO: 136958 - DNA, 22 bp, Artificial Sequence
  Synthetic oligonucleotide; TTC chr11 5265074 5265095 5265079 5265074 -
tagttctgtgaagactaatggt

SEQ ID NO: 136959 - DNA, 22 bp, Artificial Sequence
  Synthetic oligonucleotide; CTA chr11 5265072 5265093 5265077 5265072 -
gttctgtgaagactaatggtgg

SEQ ID NO: 136960 - DNA, 22 bp, Artificial Sequence
  Synthetic oligonucleotide; TTC chr11 5265068 5265089 5265073 5265068 -
tgtgaagactaatggtggtatt

SEQ ID NO: 136961 - DNA, 22 bp, Artificial Sequence
  Synthetic oligonucleotide; CTG chr11 5265066 5265087 5265071 5265066 -
tgaagactaatggtggtatttt

SEQ ID NO: 136962 - DNA, 22 bp, Artificial Sequence
  Synthetic oligonucleotide; CTA chr11 5265057 5265078 5265062 5265057 -
atggtggtattttgatgggaat

SEQ ID NO: 136963 - DNA, 22 bp, Artificial Sequence
  Synthetic oligonucleotide; TTT chr11 5265045 5265066 5265050 5265045 -
tgatgggaattgcaatgaattt

SEQ ID NO: 136964 - DNA, 22 bp, Artificial Sequence
  Synthetic oligonucleotide; TTT chr11 5265044 5265065 5265049 5265044 -
gatgggaattgcaatgaatttg

SEQ ID NO: 136965 - DNA, 22 bp, Artificial Sequence
  Synthetic oligonucleotide; TTG chr11 5265043 5265064 5265048 5265043 -
atgggaattgcaatgaatttgt

SEQ ID NO: 136966 - DNA, 22 bp, Artificial Sequence
  Synthetic oligonucleotide; TTG chr11 5265033 5265054 5265038 5265033 -
caatgaatttgtaggttgcttc

SEQ ID NO: 136967 - DNA, 22 bp, Artificial Sequence
  Synthetic oligonucleotide; TTT chr11 5265023 5265044 5265028 5265023 -
gtaggttgcttctggcattatg

SEQ ID NO: 136968 - DNA, 22 bp, Artificial Sequence
  Synthetic oligonucleotide; TTG chr11 5265022 5265043 5265027 5265022 -
taggttgcttctggcattatgg

SEQ ID NO: 136969 - DNA, 22 bp, Artificial Sequence
  Synthetic oligonucleotide; TTG chr11 5265015 5265036 5265020 5265015 -
cttctggcattatggccatttt

SEQ ID NO: 136970 - DNA, 22 bp, Artificial Sequence
  Synthetic oligonucleotide; CTT chr11 5265012 5265033 5265017 5265012 -
ctggcattatggccattttcac

SEQ ID NO: 136971 - DNA, 22 bp, Artificial Sequence
  Synthetic oligonucleotide; TTC chr11 5265011 5265032 5265016 5265011 -
tggcattatggccattttcaca

SEQ ID NO: 136972 - DNA, 22 bp, Artificial Sequence
  Synthetic oligonucleotide; CTG chr11 5265009 5265030 5265014 5265009 -
gcattatggccattttcacaat

SEQ ID NO: 136973 - DNA, 22 bp, Artificial Sequence
  Synthetic oligonucleotide; TTA chr11 5265003 5265024 5265008 5265003 -
tggccattttcacaatattgat

SEQ ID NO: 136974 - DNA, 22 bp, Artificial Sequence
  Synthetic oligonucleotide; TTT chr11 5264994 5265015 5264999 5264994 -
tcacaatattgattctacccat

SEQ ID NO: 136975 - DNA, 22 bp, Artificial Sequence
  Synthetic oligonucleotide; TTT chr11 5264993 5265014 5264998 5264993 -
cacaatattgattctacccatc

SEQ ID NO: 136976 - DNA, 22 bp, Artificial Sequence
  Synthetic oligonucleotide; TTC chr11 5264992 5265013 5264997 5264992 -
acaatattgattctacccatct

SEQ ID NO: 136977 - DNA, 22 bp, Artificial Sequence
  Synthetic oligonucleotide; TTG chr11 5264983 5265004 5264988 5264983 -
attctacccatctatgagaatg

SEQ ID NO: 136978 - DNA, 22 bp, Artificial Sequence
  Synthetic oligonucleotide; TTC chr11 5264979 5265000 5264984 5264979 -
tacccatctatgagaatggcat

SEQ ID NO: 136979 - DNA, 22 bp, Artificial Sequence
  Synthetic oligonucleotide; CTA chr11 5264977 5264998 5264982 5264977 -
cccatctatgagaatggcatgt

SEQ ID NO: 136980 - DNA, 22 bp, Artificial Sequence
  Synthetic oligonucleotide; CTA chr11 5264969 5264990 5264974 5264969 -
tgagaatggcatgtgtttccat

SEQ ID NO: 136981 - DNA, 22 bp, Artificial Sequence
  Synthetic oligonucleotide; TTT chr11 5264951 5264972 5264956 5264951 -
ccatttgtttgtgtcttatatg

SEQ ID NO: 136982 - DNA, 22 bp, Artificial Sequence
  Synthetic oligonucleotide; TTC chr11 5264950 5264971 5264955 5264950 -
catttgtttgtgtcttatatga

SEQ ID NO: 136983 - DNA, 22 bp, Artificial Sequence
  Synthetic oligonucleotide; TTT chr11 5264945 5264966 5264950 5264945 -
gtttgtgtcttatatgattact

SEQ ID NO: 136984 - DNA, 22 bp, Artificial Sequence
  Synthetic oligonucleotide; TTG chr11 5264944 5264965 5264949 5264944 -
tttgtgtcttatatgattactt

SEQ ID NO: 136985 - DNA, 22 bp, Artificial Sequence
  Synthetic oligonucleotide; TTT chr11 5264941 5264962 5264946 5264941 -
gtgtcttatatgattactttca

SEQ ID NO: 136986 - DNA, 22 bp, Artificial Sequence
  Synthetic oligonucleotide; TTG chr11 5264940 5264961 5264945 5264940 -
tgtcttatatgattactttcag

SEQ ID NO: 136987 - DNA, 22 bp, Artificial Sequence
  Synthetic oligonucleotide; CTT chr11 5264934 5264955 5264939 5264934 -
atatgattactttcagccgtgt

SEQ ID NO: 136988 - DNA, 22 bp, Artificial Sequence
  Synthetic oligonucleotide; TTA chr11 5264933 5264954 5264938 5264933 -
tatgattactttcagccgtgtt

SEQ ID NO: 136989 - DNA, 22 bp, Artificial Sequence
  Synthetic oligonucleotide; TTA chr11 5264925 5264946 5264930 5264925 -
ctttcagccgtgttttgtagtt

SEQ ID NO: 136990 - DNA, 22 bp, Artificial Sequence
  Synthetic oligonucleotide; CTT chr11 5264922 5264943 5264927 5264922 -
tcagccgtgttttgtagttttc

SEQ ID NO: 136991 - DNA, 22 bp, Artificial Sequence
  Synthetic oligonucleotide; TTT chr11 5264921 5264942 5264926 5264921 -
cagccgtgttttgtagttttcc

SEQ ID NO: 136992 - DNA, 22 bp, Artificial Sequence
  Synthetic oligonucleotide; TTC chr11 5264920 5264941 5264925 5264920 -
agccgtgttttgtagttttcct

SEQ ID NO: 136993 - DNA, 22 bp, Artificial Sequence
  Synthetic oligonucleotide; TTT chr11 5264910 5264931 5264915 5264910 -
tgtagttttccttgtagatgtc

SEQ ID NO: 136994 - DNA, 22 bp, Artificial Sequence
  Synthetic oligonucleotide; TTT chr11 5264909 5264930 5264914 5264909 -
gtagttttccttgtagatgtct

SEQ ID NO: 136995 - DNA, 22 bp, Artificial Sequence
  Synthetic oligonucleotide; TTG chr11 5264908 5264929 5264913 5264908 -
tagttttccttgtagatgtctt

SEQ ID NO: 136996 - DNA, 22 bp, Artificial Sequence
  Synthetic oligonucleotide; TTT chr11 5264902 5264923 5264907 5264902 -
tccttgtagatgtctttcacct

SEQ ID NO: 136997 - DNA, 22 bp, Artificial Sequence
  Synthetic oligonucleotide; TTT chr11 5264901 5264922 5264906 5264901 -
ccttgtagatgtctttcacctc

SEQ ID NO: 136998 - DNA, 22 bp, Artificial Sequence
  Synthetic oligonucleotide; TTC chr11 5264900 5264921 5264905 5264900 -
cttgtagatgtctttcacctcc

SEQ ID NO: 136999 - DNA, 22 bp, Artificial Sequence
  Synthetic oligonucleotide; CTT chr11 5264897 5264918 5264902 5264897 -
gtagatgtctttcacctccttg

SEQ ID NO: 137000 - DNA, 22 bp, Artificial Sequence
  Synthetic oligonucleotide; TTG chr11 5264896 5264917 5264901 5264896 -
tagatgtctttcacctccttgg

SEQ ID NO: 137001 - DNA, 22 bp, Artificial Sequence
  Synthetic oligonucleotide; CTT chr11 5264886 5264907 5264891 5264886 -
tcacctccttggttaggtatat

SEQ ID NO: 137002 - DNA, 22 bp, Artificial Sequence
  Synthetic oligonucleotide; TTT chr11 5264885 5264906 5264890 5264885 -
cacctccttggttaggtatata

SEQ ID NO: 137003 - DNA, 22 bp, Artificial Sequence
  Synthetic oligonucleotide; TTC chr11 5264884 5264905 5264889 5264884 -
acctccttggttaggtatatat

SEQ ID NO: 137004 - DNA, 22 bp, Artificial Sequence
  Synthetic oligonucleotide; CTC chr11 5264879 5264900 5264884 5264879 -
cttggttaggtatatattccta

SEQ ID NO: 137005 - DNA, 22 bp, Artificial Sequence
  Synthetic oligonucleotide; CTT chr11 5264876 5264897 5264881 5264876 -
ggttaggtatatattcctaagt

SEQ ID NO: 137006 - DNA, 22 bp, Artificial Sequence
  Synthetic oligonucleotide; TTG chr11 5264875 5264896 5264880 5264875 -
gttaggtatatattcctaagtt

SEQ ID NO: 137007 - DNA, 22 bp, Artificial Sequence
  Synthetic oligonucleotide; TTA chr11 5264871 5264892 5264876 5264871 -
ggtatatattcctaagtttttg

SEQ ID NO: 137008 - DNA, 22 bp, Artificial Sequence
  Synthetic oligonucleotide; TTC chr11 5264860 5264881 5264865 5264860 -
ctaagtttttgttttgttttgt

SEQ ID NO: 137009 - DNA, 22 bp, Artificial Sequence
  Synthetic oligonucleotide; CTA chr11 5264857 5264878 5264862 5264857 -
agtttttgttttgttttgtttt

SEQ ID NO: 137010 - DNA, 22 bp, Artificial Sequence
  Synthetic oligonucleotide; TTT chr11 5264852 5264873 5264857 5264852 -
ttgttttgttttgttttgtttt

SEQ ID NO: 137011 - DNA, 22 bp, Artificial Sequence
  Synthetic oligonucleotide; TTT chr11 5264851 5264872 5264856 5264851 -
tgttttgttttgttttgttttt

SEQ ID NO: 137012 - DNA, 22 bp, Artificial Sequence
  Synthetic oligonucleotide; TTT chr11 5264850 5264871 5264855 5264850 -
gttttgttttgttttgtttttt

SEQ ID NO: 137013 - DNA, 22 bp, Artificial Sequence
  Synthetic oligonucleotide; TTG chr11 5264849 5264870 5264854 5264849 -
ttttgttttgttttgttttttg

SEQ ID NO: 137014 - DNA, 22 bp, Artificial Sequence
  Synthetic oligonucleotide; TTT chr11 5264846 5264867 5264851 5264846 -
tgttttgttttgttttttgcag

SEQ ID NO: 137015 - DNA, 22 bp, Artificial Sequence
  Synthetic oligonucleotide; TTT chr11 5264845 5264866 5264850 5264845 -
gttttgttttgttttttgcagc

SEQ ID NO: 137016 - DNA, 22 bp, Artificial Sequence
  Synthetic oligonucleotide; TTG chr11 5264844 5264865 5264849 5264844 -
ttttgttttgttttttgcagct

SEQ ID NO: 137017 - DNA, 22 bp, Artificial Sequence
  Synthetic oligonucleotide; TTT chr11 5264841 5264862 5264846 5264841 -
tgttttgttttttgcagctatt

SEQ ID NO: 137018 - DNA, 22 bp, Artificial Sequence
  Synthetic oligonucleotide; TTT chr11 5264840 5264861 5264845 5264840 -
gttttgttttttgcagctattg

SEQ ID NO: 137019 - DNA, 22 bp, Artificial Sequence
  Synthetic oligonucleotide; TTG chr11 5264839 5264860 5264844 5264839 -
ttttgttttttgcagctattgt

SEQ ID NO: 137020 - DNA, 22 bp, Artificial Sequence
  Synthetic oligonucleotide; TTT chr11 5264836 5264857 5264841 5264836 -
tgttttttgcagctattgtaaa

SEQ ID NO: 137021 - DNA, 22 bp, Artificial Sequence
  Synthetic oligonucleotide; TTT chr11 5264835 5264856 5264840 5264835 -
gttttttgcagctattgtaaaa

SEQ ID NO: 137022 - DNA, 22 bp, Artificial Sequence
  Synthetic oligonucleotide; TTG chr11 5264834 5264855 5264839 5264834 -
ttttttgcagctattgtaaaag

SEQ ID NO: 137023 - DNA, 22 bp, Artificial Sequence
  Synthetic oligonucleotide; TTT chr11 5264831 5264852 5264836 5264831 -
tttgcagctattgtaaaagggg

SEQ ID NO: 137024 - DNA, 22 bp, Artificial Sequence
  Synthetic oligonucleotide; TTT chr11 5264830 5264851 5264835 5264830 -
ttgcagctattgtaaaaggggt

SEQ ID NO: 137025 - DNA, 22 bp, Artificial Sequence
  Synthetic oligonucleotide; TTT chr11 5264829 5264850 5264834 5264829 -
tgcagctattgtaaaaggggtt

SEQ ID NO: 137026 - DNA, 22 bp, Artificial Sequence
  Synthetic oligonucleotide; TTT chr11 5264828 5264849 5264833 5264828 -
gcagctattgtaaaaggggttg

SEQ ID NO: 137027 - DNA, 22 bp, Artificial Sequence
  Synthetic oligonucleotide; TTG chr11 5264827 5264848 5264832 5264827 -
cagctattgtaaaaggggttga

SEQ ID NO: 137028 - DNA, 22 bp, Artificial Sequence
  Synthetic oligonucleotide; CTA chr11 5264821 5264842 5264826 5264821 -
ttgtaaaaggggttgagttctt

SEQ ID NO: 137029 - DNA, 22 bp, Artificial Sequence
  Synthetic oligonucleotide; TTG chr11 5264818 5264839 5264823 5264818 -
taaaaggggttgagttcttgat

SEQ ID NO: 137030 - DNA, 22 bp, Artificial Sequence
  Synthetic oligonucleotide; TTG chr11 5264806 5264827 5264811 5264806 -
agttcttgattttattctcagc

SEQ ID NO: 137031 - DNA, 22 bp, Artificial Sequence
  Synthetic oligonucleotide; TTC chr11 5264801 5264822 5264806 5264801 -
ttgattttattctcagcttggt

SEQ ID NO: 137032 - DNA, 22 bp, Artificial Sequence
  Synthetic oligonucleotide; CTT chr11 5264799 5264820 5264804 5264799 -
gattttattctcagcttggtca

SEQ ID NO: 137033 - DNA, 22 bp, Artificial Sequence
  Synthetic oligonucleotide; TTG chr11 5264798 5264819 5264803 5264798 -
attttattctcagcttggtcat

SEQ ID NO: 137034 - DNA, 22 bp, Artificial Sequence
  Synthetic oligonucleotide; TTT chr11 5264794 5264815 5264799 5264794 -
tattctcagcttggtcattgct

SEQ ID NO: 137035 - DNA, 22 bp, Artificial Sequence
  Synthetic oligonucleotide; TTT chr11 5264793 5264814 5264798 5264793 -
attctcagcttggtcattgctg

SEQ ID NO: 137036 - DNA, 22 bp, Artificial Sequence
  Synthetic oligonucleotide; TTA chr11 5264792 5264813 5264797 5264792 -
ttctcagcttggtcattgctgg

SEQ ID NO: 137037 - DNA, 22 bp, Artificial Sequence
  Synthetic oligonucleotide; TTC chr11 5264789 5264810 5264794 5264789 -
tcagcttggtcattgctggtat

SEQ ID NO: 137038 - DNA, 22 bp, Artificial Sequence
  Synthetic oligonucleotide; CTC chr11 5264787 5264808 5264792 5264787 -
agcttggtcattgctggtatgt

SEQ ID NO: 137039 - DNA, 22 bp, Artificial Sequence
  Synthetic oligonucleotide; CTT chr11 5264782 5264803 5264787 5264782 -
ggtcattgctggtatgtaagaa

SEQ ID NO: 137040 - DNA, 22 bp, Artificial Sequence
  Synthetic oligonucleotide; TTG chr11 5264781 5264802 5264786 5264781 -
gtcattgctggtatgtaagaaa

SEQ ID NO: 137041 - DNA, 22 bp, Artificial Sequence
  Synthetic oligonucleotide; TTG chr11 5264774 5264795 5264779 5264774 -
ctggtatgtaagaaagcaactc

SEQ ID NO: 137042 - DNA, 22 bp, Artificial Sequence
  Synthetic oligonucleotide; CTG chr11 5264771 5264792 5264776 5264771 -
gtatgtaagaaagcaactcatt

SEQ ID NO: 137043 - DNA, 22 bp, Artificial Sequence
  Synthetic oligonucleotide; CTC chr11 5264752 5264773 5264757 5264752 -
attggtgtacgttaattttgta

SEQ ID NO: 137044 - DNA, 22 bp, Artificial Sequence
  Synthetic oligonucleotide; TTG chr11 5264748 5264769 5264753 5264748 -
gtgtacgttaattttgtatcca

SEQ ID NO: 137045 - DNA, 22 bp, Artificial Sequence
  Synthetic oligonucleotide; TTA chr11 5264738 5264759 5264743 5264738 -
attttgtatccagaaactttgc

SEQ ID NO: 137046 - DNA, 22 bp, Artificial Sequence
  Synthetic oligonucleotide; TTT chr11 5264734 5264755 5264739 5264734 -
tgtatccagaaactttgctgaa

SEQ ID NO: 137047 - DNA, 22 bp, Artificial Sequence
  Synthetic oligonucleotide; TTT chr11 5264733 5264754 5264738 5264733 -
gtatccagaaactttgctgaat

SEQ ID NO: 137048 - DNA, 22 bp, Artificial Sequence
  Synthetic oligonucleotide; TTG chr11 5264732 5264753 5264737 5264732 -
tatccagaaactttgctgaatt

SEQ ID NO: 137049 - DNA, 22 bp, Artificial Sequence
  Synthetic oligonucleotide; CTT chr11 5264719 5264740 5264724 5264719 -
tgctgaattattttatcagttc

SEQ ID NO: 137050 - DNA, 22 bp, Artificial Sequence
  Synthetic oligonucleotide; TTT chr11 5264718 5264739 5264723 5264718 -
gctgaattattttatcagttct

SEQ ID NO: 137051 - DNA, 22 bp, Artificial Sequence
  Synthetic oligonucleotide; TTG chr11 5264717 5264738 5264722 5264717 -
ctgaattattttatcagttcta

SEQ ID NO: 137052 - DNA, 22 bp, Artificial Sequence
  Synthetic oligonucleotide; CTG chr11 5264714 5264735 5264719 5264714 -
aattattttatcagttctaggg

SEQ ID NO: 137053 - DNA, 22 bp, Artificial Sequence
  Synthetic oligonucleotide; TTA chr11 5264709 5264730 5264714 5264709 -
ttttatcagttctagggggttt

SEQ ID NO: 137054 - DNA, 22 bp, Artificial Sequence
  Synthetic oligonucleotide; TTT chr11 5264706 5264727 5264711 5264706 -
tatcagttctagggggttttgg

SEQ ID NO: 137055 - DNA, 22 bp, Artificial Sequence
  Synthetic oligonucleotide; TTT chr11 5264705 5264726 5264710 5264705 -
atcagttctagggggttttgga

SEQ ID NO: 137056 - DNA, 22 bp, Artificial Sequence
  Synthetic oligonucleotide; TTA chr11 5264704 5264725 5264709 5264704 -
tcagttctagggggttttggag

SEQ ID NO: 137057 - DNA, 22 bp, Artificial Sequence
  Synthetic oligonucleotide; TTC chr11 5264697 5264718 5264702 5264697 -
tagggggttttggaggagtctt

SEQ ID NO: 137058 - DNA, 22 bp, Artificial Sequence
  Synthetic oligonucleotide; CTA chr11 5264695 5264716 5264700 5264695 -
gggggttttggaggagtcttta

SEQ ID NO: 137059 - DNA, 22 bp, Artificial Sequence
  Synthetic oligonucleotide; TTT chr11 5264687 5264708 5264692 5264687 -
tggaggagtctttagagttttc

SEQ ID NO: 137060 - DNA, 22 bp, Artificial Sequence
  Synthetic oligonucleotide; TTT chr11 5264686 5264707 5264691 5264686 -
ggaggagtctttagagttttct

SEQ ID NO: 137061 - DNA, 22 bp, Artificial Sequence
  Synthetic oligonucleotide; TTG chr11 5264685 5264706 5264690 5264685 -
gaggagtctttagagttttcta

SEQ ID NO: 137062 - DNA, 22 bp, Artificial Sequence
  Synthetic oligonucleotide; CTT chr11 5264675 5264696 5264680 5264675 -
tagagttttctacatacacaat

SEQ ID NO: 137063 - DNA, 22 bp, Artificial Sequence
  Synthetic oligonucleotide; TTT chr11 5264674 5264695 5264679 5264674 -
agagttttctacatacacaatc

SEQ ID NO: 137064 - DNA, 22 bp, Artificial Sequence
  Synthetic oligonucleotide; TTA chr11 5264673 5264694 5264678 5264673 -
gagttttctacatacacaatca

SEQ ID NO: 137065 - DNA, 22 bp, Artificial Sequence
  Synthetic oligonucleotide; TTT chr11 5264667 5264688 5264672 5264667 -
tctacatacacaatcatatcat

SEQ ID NO: 137066 - DNA, 22 bp, Artificial Sequence
  Synthetic oligonucleotide; TTT chr11 5264666 5264687 5264671 5264666 -
ctacatacacaatcatatcatc

SEQ ID NO: 137067 - DNA, 22 bp, Artificial Sequence
  Synthetic oligonucleotide; TTC chr11 5264665 5264686 5264670 5264665 -
tacatacacaatcatatcatca

SEQ ID NO: 137068 - DNA, 22 bp, Artificial Sequence
  Synthetic oligonucleotide; CTA chr11 5264663 5264684 5264668 5264663 -
catacacaatcatatcatcagc

SEQ ID NO: 137069 - DNA, 22 bp, Artificial Sequence
  Synthetic oligonucleotide; TTT chr11 5264626 5264647 5264631 5264626 -
gactttctctttaacaatttgg

SEQ ID NO: 137070 - DNA, 22 bp, Artificial Sequence
  Synthetic oligonucleotide; TTG chr11 5264625 5264646 5264630 5264625 -
actttctctttaacaatttgga

SEQ ID NO: 137071 - DNA, 22 bp, Artificial Sequence
  Synthetic oligonucleotide; CTT chr11 5264621 5264642 5264626 5264621 -
tctctttaacaatttggatgtg

SEQ ID NO: 137072 - DNA, 22 bp, Artificial Sequence
  Synthetic oligonucleotide; TTT chr11 5264620 5264641 5264625 5264620 -
ctctttaacaatttggatgtgc

SEQ ID NO: 137073 - DNA, 22 bp, Artificial Sequence
  Synthetic oligonucleotide; TTC chr11 5264619 5264640 5264624 5264619 -
tctttaacaatttggatgtgct

SEQ ID NO: 137074 - DNA, 22 bp, Artificial Sequence
  Synthetic oligonucleotide; CTC chr11 5264617 5264638 5264622 5264617 -
tttaacaatttggatgtgcttt

SEQ ID NO: 137075 - DNA, 22 bp, Artificial Sequence
  Synthetic oligonucleotide; CTT chr11 5264615 5264636 5264620 5264615 -
taacaatttggatgtgctttac

SEQ ID NO: 137076 - DNA, 22 bp, Artificial Sequence
  Synthetic oligonucleotide; TTT chr11 5264614 5264635 5264619 5264614 -
aacaatttggatgtgctttact

SEQ ID NO: 137077 - DNA, 22 bp, Artificial Sequence
  Synthetic oligonucleotide; TTA chr11 5264613 5264634 5264618 5264613 -
acaatttggatgtgctttactt

SEQ ID NO: 137078 - DNA, 22 bp, Artificial Sequence
  Synthetic oligonucleotide; TTT chr11 5264606 5264627 5264611 5264606 -
ggatgtgctttacttgtttctc

SEQ ID NO: 137079 - DNA, 22 bp, Artificial Sequence
  Synthetic oligonucleotide; TTG chr11 5264605 5264626 5264610 5264605 -
gatgtgctttacttgtttctct

SEQ ID NO: 137080 - DNA, 22 bp, Artificial Sequence
  Synthetic oligonucleotide; CTT chr11 5264596 5264617 5264601 5264596 -
tacttgtttctcttgtctgatt

SEQ ID NO: 137081 - DNA, 22 bp, Artificial Sequence
  Synthetic oligonucleotide; TTT chr11 5264595 5264616 5264600 5264595 -
acttgtttctcttgtctgattg

SEQ ID NO: 137082 - DNA, 22 bp, Artificial Sequence
  Synthetic oligonucleotide; TTA chr11 5264594 5264615 5264599 5264594 -
cttgtttctcttgtctgattgc

SEQ ID NO: 137083 - DNA, 22 bp, Artificial Sequence
  Synthetic oligonucleotide; CTT chr11 5264591 5264612 5264596 5264591 -
gtttctcttgtctgattgctct

SEQ ID NO: 137084 - DNA, 22 bp, Artificial Sequence
  Synthetic oligonucleotide; TTG chr11 5264590 5264611 5264595 5264590 -
tttctcttgtctgattgctctt

SEQ ID NO: 137085 - DNA, 22 bp, Artificial Sequence
  Synthetic oligonucleotide; TTT chr11 5264587 5264608 5264592 5264587 -
ctcttgtctgattgctcttgct

SEQ ID NO: 137086 - DNA, 22 bp, Artificial Sequence
  Synthetic oligonucleotide; TTC chr11 5264586 5264607 5264591 5264586 -
tcttgtctgattgctcttgcta

SEQ ID NO: 137087 - DNA, 22 bp, Artificial Sequence
  Synthetic oligonucleotide; CTC chr11 5264584 5264605 5264589 5264584 -
ttgtctgattgctcttgctagg

SEQ ID NO: 137088 - DNA, 22 bp, Artificial Sequence
  Synthetic oligonucleotide; CTT chr11 5264582 5264603 5264587 5264582 -
gtctgattgctcttgctaggac

SEQ ID NO: 137089 - DNA, 22 bp, Artificial Sequence
  Synthetic oligonucleotide; TTG chr11 5264581 5264602 5264586 5264581 -
tctgattgctcttgctaggact

SEQ ID NO: 137090 - DNA, 22 bp, Artificial Sequence
  Synthetic oligonucleotide; CTG chr11 5264577 5264598 5264582 5264577 -
attgctcttgctaggacttcca

SEQ ID NO: 137091 - DNA, 22 bp, Artificial Sequence
  Synthetic oligonucleotide; TTG chr11 5264573 5264594 5264578 5264573 -
ctcttgctaggacttccagtaa

SEQ ID NO: 137092 - DNA, 22 bp, Artificial Sequence
  Synthetic oligonucleotide; CTC chr11 5264570 5264591 5264575 5264570 -
ttgctaggacttccagtaatat

SEQ ID NO: 137093 - DNA, 22 bp, Artificial Sequence
  Synthetic oligonucleotide; CTT chr11 5264568 5264589 5264573 5264568 -
gctaggacttccagtaatatgt

SEQ ID NO: 137094 - DNA, 22 bp, Artificial Sequence
  Synthetic oligonucleotide; TTG chr11 5264567 5264588 5264572 5264567 -
ctaggacttccagtaatatgtt

SEQ ID NO: 137095 - DNA, 22 bp, Artificial Sequence
  Synthetic oligonucleotide; CTA chr11 5264564 5264585 5264569 5264564 -
ggacttccagtaatatgttaaa

SEQ ID NO: 137096 - DNA, 22 bp, Artificial Sequence
  Synthetic oligonucleotide; CTT chr11 5264558 5264579 5264563 5264558 -
ccagtaatatgttaaagagaag

SEQ ID NO: 137097 - DNA, 22 bp, Artificial Sequence
  Synthetic oligonucleotide; TTC chr11 5264557 5264578 5264562 5264557 -
cagtaatatgttaaagagaagt

SEQ ID NO: 137098 - DNA, 22 bp, Artificial Sequence
  Synthetic oligonucleotide; TTA chr11 5264544 5264565 5264549 5264544 -
aagagaagtggtgagagtgggt

SEQ ID NO: 137099 - DNA, 22 bp, Artificial Sequence
  Synthetic oligonucleotide; CTT chr11 5264516 5264537 5264521 5264516 -
gtctcattccagttttcagaca

SEQ ID NO: 137100 - DNA, 22 bp, Artificial Sequence
  Synthetic oligonucleotide; TTG chr11 5264515 5264536 5264520 5264515 -
tctcattccagttttcagacag

SEQ ID NO: 137101 - DNA, 22 bp, Artificial Sequence
  Synthetic oligonucleotide; CTC chr11 5264511 5264532 5264516 5264511 -
attccagttttcagacagaatg

SEQ ID NO: 137102 - DNA, 22 bp, Artificial Sequence
  Synthetic oligonucleotide; TTC chr11 5264507 5264528 5264512 5264507 -
cagttttcagacagaatgcttt

SEQ ID NO: 137103 - DNA, 22 bp, Artificial Sequence
  Synthetic oligonucleotide; TTT chr11 5264501 5264522 5264506 5264501 -
tcagacagaatgcttttaactt

SEQ ID NO: 137104 - DNA, 22 bp, Artificial Sequence
  Synthetic oligonucleotide; TTT chr11 5264500 5264521 5264505 5264500 -
cagacagaatgcttttaacttt

SEQ ID NO: 137105 - DNA, 22 bp, Artificial Sequence
  Synthetic oligonucleotide; TTC chr11 5264499 5264520 5264504 5264499 -
agacagaatgcttttaactttt

SEQ ID NO: 137106 - DNA, 22 bp, Artificial Sequence
  Synthetic oligonucleotide; CTT chr11 5264486 5264507 5264491 5264486 -
ttaactttttcccattcaatat

SEQ ID NO: 137107 - DNA, 22 bp, Artificial Sequence
  Synthetic oligonucleotide; TTT chr11 5264485 5264506 5264490 5264485 -
taactttttcccattcaatata

SEQ ID NO: 137108 - DNA, 22 bp, Artificial Sequence
  Synthetic oligonucleotide; TTT chr11 5264484 5264505 5264489 5264484 -
aactttttcccattcaatataa

SEQ ID NO: 137109 - DNA, 22 bp, Artificial Sequence
  Synthetic oligonucleotide; TTA chr11 5264483 5264504 5264488 5264483 -
actttttcccattcaatataat

SEQ ID NO: 137110 - DNA, 22 bp, Artificial Sequence
  Synthetic oligonucleotide; CTT chr11 5264479 5264500 5264484 5264479 -
tttcccattcaatataatgttg

SEQ ID NO: 137111 - DNA, 22 bp, Artificial Sequence
  Synthetic oligonucleotide; TTT chr11 5264478 5264499 5264483 5264478 -
ttcccattcaatataatgttgg

SEQ ID NO: 137112 - DNA, 22 bp, Artificial Sequence
  Synthetic oligonucleotide; TTT chr11 5264477 5264498 5264482 5264477 -
tcccattcaatataatgttggc

SEQ ID NO: 137113 - DNA, 22 bp, Artificial Sequence
  Synthetic oligonucleotide; TTT chr11 5264476 5264497 5264481 5264476 -
cccattcaatataatgttggct

SEQ ID NO: 137114 - DNA, 22 bp, Artificial Sequence
  Synthetic oligonucleotide; TTC chr11 5264475 5264496 5264480 5264475 -
ccattcaatataatgttggctg

SEQ ID NO: 137115 - DNA, 22 bp, Artificial Sequence
  Synthetic oligonucleotide; TTC chr11 5264469 5264490 5264474 5264469 -
aatataatgttggctgtgtgtt

SEQ ID NO: 137116 - DNA, 22 bp, Artificial Sequence
  Synthetic oligonucleotide; TTG chr11 5264457 5264478 5264462 5264457 -
gctgtgtgtttaccatagctgg

SEQ ID NO: 137117 - DNA, 22 bp, Artificial Sequence
  Synthetic oligonucleotide; CTG chr11 5264453 5264474 5264458 5264453 -
tgtgtttaccatagctggcttt

SEQ ID NO: 137118 - DNA, 22 bp, Artificial Sequence
  Synthetic oligonucleotide; TTT chr11 5264446 5264467 5264451 5264446 -
accatagctggcttttattaca

SEQ ID NO: 137119 - DNA, 22 bp, Artificial Sequence
  Synthetic oligonucleotide; TTA chr11 5264445 5264466 5264450 5264445 -
ccatagctggcttttattacat

SEQ ID NO: 137120 - DNA, 22 bp, Artificial Sequence
  Synthetic oligonucleotide; CTG chr11 5264436 5264457 5264441 5264436 -
gcttttattacattgaggtatg

SEQ ID NO: 137121 - DNA, 22 bp, Artificial Sequence
  Synthetic oligonucleotide; CTT chr11 5264432 5264453 5264437 5264432 -
ttattacattgaggtatgtcct

SEQ ID NO: 137122 - DNA, 22 bp, Artificial Sequence
  Synthetic oligonucleotide; TTT chr11 5264431 5264452 5264436 5264431 -
tattacattgaggtatgtcctt

SEQ ID NO: 137123 - DNA, 22 bp, Artificial Sequence
  Synthetic oligonucleotide; TTT chr11 5264430 5264451 5264435 5264430 -
attacattgaggtatgtccttt

SEQ ID NO: 137124 - DNA, 22 bp, Artificial Sequence
  Synthetic oligonucleotide; TTA chr11 5264429 5264450 5264434 5264429 -
ttacattgaggtatgtcctttg

SEQ ID NO: 137125 - DNA, 22 bp, Artificial Sequence
  Synthetic oligonucleotide; TTA chr11 5264426 5264447 5264431 5264426 -
cattgaggtatgtcctttgtaa

SEQ ID NO: 137126 - DNA, 22 bp, Artificial Sequence
  Synthetic oligonucleotide; TTG chr11 5264421 5264442 5264426 5264421 -
aggtatgtcctttgtaaaccga

SEQ ID NO: 137127 - DNA, 22 bp, Artificial Sequence
  Synthetic oligonucleotide; CTT chr11 5264409 5264430 5264414 5264409 -
tgtaaaccgattttgctgagtt

SEQ ID NO: 137128 - DNA, 22 bp, Artificial Sequence
  Synthetic oligonucleotide; TTT chr11 5264408 5264429 5264413 5264408 -
gtaaaccgattttgctgagttt

SEQ ID NO: 137129 - DNA, 22 bp, Artificial Sequence
  Synthetic oligonucleotide; TTG chr11 5264407 5264428 5264412 5264407 -
taaaccgattttgctgagtttt

SEQ ID NO: 137130 - DNA, 22 bp, Artificial Sequence
  Synthetic oligonucleotide; TTT chr11 5264396 5264417 5264401 5264396 -
tgctgagttttagtcataaagt

SEQ ID NO: 137131 - DNA, 22 bp, Artificial Sequence
  Synthetic oligonucleotide; TTT chr11 5264395 5264416 5264400 5264395 -
gctgagttttagtcataaagtg

SEQ ID NO: 137132 - DNA, 22 bp, Artificial Sequence
  Synthetic oligonucleotide; TTG chr11 5264394 5264415 5264399 5264394 -
ctgagttttagtcataaagtga

SEQ ID NO: 137133 - DNA, 22 bp, Artificial Sequence
  Synthetic oligonucleotide; CTG chr11 5264391 5264412 5264396 5264391 -
agttttagtcataaagtgatgt

SEQ ID NO: 137134 - DNA, 22 bp, Artificial Sequence
  Synthetic oligonucleotide; TTT chr11 5264386 5264407 5264391 5264386 -
tagtcataaagtgatgttgaat

SEQ ID NO: 137135 - DNA, 22 bp, Artificial Sequence
  Synthetic oligonucleotide; TTT chr11 5264385 5264406 5264390 5264385 -
agtcataaagtgatgttgaatt

SEQ ID NO: 137136 - DNA, 22 bp, Artificial Sequence
  Synthetic oligonucleotide; TTA chr11 5264384 5264405 5264389 5264384 -
gtcataaagtgatgttgaattt

SEQ ID NO: 137137 - DNA, 22 bp, Artificial Sequence
  Synthetic oligonucleotide; TTG chr11 5264367 5264388 5264372 5264367 -
aattttgttgaatgcagtttct

SEQ ID NO: 137138 - DNA, 22 bp, Artificial Sequence
  Synthetic oligonucleotide; TTT chr11 5264362 5264383 5264367 5264362 -
tgttgaatgcagtttctgtggc

SEQ ID NO: 137139 - DNA, 22 bp, Artificial Sequence
  Synthetic oligonucleotide; TTT chr11 5264361 5264382 5264366 5264361 -
gttgaatgcagtttctgtggct

SEQ ID NO: 137140 - DNA, 22 bp, Artificial Sequence
  Synthetic oligonucleotide; TTG chr11 5264360 5264381 5264365 5264360 -
ttgaatgcagtttctgtggcta

SEQ ID NO: 137141 - DNA, 22 bp, Artificial Sequence
  Synthetic oligonucleotide; TTG chr11 5264357 5264378 5264362 5264357 -
aatgcagtttctgtggctattg

SEQ ID NO: 137142 - DNA, 22 bp, Artificial Sequence
  Synthetic oligonucleotide; TTT chr11 5264347 5264368 5264352 5264347 -
ctgtggctattgagataatcac

SEQ ID NO: 137143 - DNA, 22 bp, Artificial Sequence
  Synthetic oligonucleotide; TTC chr11 5264346 5264367 5264351 5264346 -
tgtggctattgagataatcaca

SEQ ID NO: 137144 - DNA, 22 bp, Artificial Sequence
  Synthetic oligonucleotide; CTG chr11 5264344 5264365 5264349 5264344 -
tggctattgagataatcacatg

SEQ ID NO: 137145 - DNA, 22 bp, Artificial Sequence
  Synthetic oligonucleotide; CTA chr11 5264338 5264359 5264343 5264338 -
ttgagataatcacatgattttt

SEQ ID NO: 137146 - DNA, 22 bp, Artificial Sequence
  Synthetic oligonucleotide; TTG chr11 5264335 5264356 5264340 5264335 -
agataatcacatgatttttgtt

SEQ ID NO: 137147 - DNA, 22 bp, Artificial Sequence
  Synthetic oligonucleotide; TTT chr11 5264318 5264339 5264323 5264318 -
ttgtttccaattctctttatgt

SEQ ID NO: 137148 - DNA, 22 bp, Artificial Sequence
  Synthetic oligonucleotide; TTT chr11 5264317 5264338 5264322 5264317 -
tgtttccaattctctttatgtt

SEQ ID NO: 137149 - DNA, 22 bp, Artificial Sequence
  Synthetic oligonucleotide; TTT chr11 5264316 5264337 5264321 5264316 -
gtttccaattctctttatgttg

SEQ ID NO: 137150 - DNA, 22 bp, Artificial Sequence
  Synthetic oligonucleotide; TTG chr11 5264315 5264336 5264320 5264315 -
tttccaattctctttatgttgt

SEQ ID NO: 137151 - DNA, 22 bp, Artificial Sequence
  Synthetic oligonucleotide; TTT chr11 5264312 5264333 5264317 5264312 -
ccaattctctttatgttgtgta

SEQ ID NO: 137152 - DNA, 22 bp, Artificial Sequence
  Synthetic oligonucleotide; TTC chr11 5264311 5264332 5264316 5264311 -
caattctctttatgttgtgtat

SEQ ID NO: 137153 - DNA, 22 bp, Artificial Sequence
  Synthetic oligonucleotide; TTC chr11 5264305 5264326 5264310 5264305 -
tctttatgttgtgtatcacact

SEQ ID NO: 137154 - DNA, 22 bp, Artificial Sequence
  Synthetic oligonucleotide; CTC chr11 5264303 5264324 5264308 5264303 -
tttatgttgtgtatcacactta

SEQ ID NO: 137155 - DNA, 22 bp, Artificial Sequence
  Synthetic oligonucleotide; CTT chr11 5264301 5264322 5264306 5264301 -
tatgttgtgtatcacacttatt

SEQ ID NO: 137156 - DNA, 22 bp, Artificial Sequence
  Synthetic oligonucleotide; TTT chr11 5264300 5264321 5264305 5264300 -
atgttgtgtatcacacttattg

SEQ ID NO: 137157 - DNA, 22 bp, Artificial Sequence
  Synthetic oligonucleotide; TTA chr11 5264299 5264320 5264304 5264299 -
tgttgtgtatcacacttattga

SEQ ID NO: 137158 - DNA, 22 bp, Artificial Sequence
  Synthetic oligonucleotide; TTG chr11 5264294 5264315 5264299 5264294 -
tgtatcacacttattgacttgc

SEQ ID NO: 137159 - DNA, 22 bp, Artificial Sequence
  Synthetic oligonucleotide; CTT chr11 5264282 5264303 5264287 5264282 -
attgacttgcgtatgttaaacc

SEQ ID NO: 137160 - DNA, 22 bp, Artificial Sequence
  Synthetic oligonucleotide; TTA chr11 5264281 5264302 5264286 5264281 -
ttgacttgcgtatgttaaacca

SEQ ID NO: 137161 - DNA, 22 bp, Artificial Sequence
  Synthetic oligonucleotide; TTG chr11 5264278 5264299 5264283 5264278 -
acttgcgtatgttaaaccatcc

SEQ ID NO: 137162 - DNA, 22 bp, Artificial Sequence
  Synthetic oligonucleotide; CTT chr11 5264274 5264295 5264279 5264274 -
gcgtatgttaaaccatccgtgc

SEQ ID NO: 137163 - DNA, 22 bp, Artificial Sequence
  Synthetic oligonucleotide; TTG chr11 5264273 5264294 5264278 5264273 -
cgtatgttaaaccatccgtgca

SEQ ID NO: 137164 - DNA, 22 bp, Artificial Sequence
  Synthetic oligonucleotide; TTA chr11 5264264 5264285 5264269 5264264 -
aaccatccgtgcatccctcgca

SEQ ID NO: 137165 - DNA, 22 bp, Artificial Sequence
  Synthetic oligonucleotide; CTC chr11 5264245 5264266 5264250 5264245 -
gcatgaaacccacttgatcatg

SEQ ID NO: 137166 - DNA, 22 bp, Artificial Sequence
  Synthetic oligonucleotide; CTT chr11 5264230 5264251 5264235 5264230 -
gatcatgggttttgatatgctg

SEQ ID NO: 137167 - DNA, 22 bp, Artificial Sequence
  Synthetic oligonucleotide; TTG chr11 5264229 5264250 5264234 5264229 -
atcatgggttttgatatgctgt

SEQ ID NO: 137168 - DNA, 22 bp, Artificial Sequence
  Synthetic oligonucleotide; TTT chr11 5264218 5264239 5264223 5264218 -
tgatatgctgtcggatgctatt

SEQ ID NO: 137169 - DNA, 22 bp, Artificial Sequence
  Synthetic oligonucleotide; TTT chr11 5264217 5264238 5264222 5264217 -
gatatgctgtcggatgctatta

SEQ ID NO: 137170 - DNA, 22 bp, Artificial Sequence
  Synthetic oligonucleotide; TTG chr11 5264216 5264237 5264221 5264216 -
atatgctgtcggatgctattag

SEQ ID NO: 137171 - DNA, 22 bp, Artificial Sequence
  Synthetic oligonucleotide; CTG chr11 5264208 5264229 5264213 5264208 -
tcggatgctattagctagtatt

SEQ ID NO: 137172 - DNA, 22 bp, Artificial Sequence
  Synthetic oligonucleotide; CTA chr11 5264198 5264219 5264203 5264198 -
ttagctagtattttgtcaagga

SEQ ID NO: 137173 - DNA, 22 bp, Artificial Sequence
  Synthetic oligonucleotide; TTA chr11 5264195 5264216 5264200 5264195 -
gctagtattttgtcaaggatgt

SEQ ID NO: 137174 - DNA, 22 bp, Artificial Sequence
  Synthetic oligonucleotide; CTA chr11 5264191 5264212 5264196 5264191 -
gtattttgtcaaggatgttggc

SEQ ID NO: 137175 - DNA, 22 bp, Artificial Sequence
  Synthetic oligonucleotide; TTT chr11 5264185 5264206 5264190 5264185 -
tgtcaaggatgttggcatctat

SEQ ID NO: 137176 - DNA, 22 bp, Artificial Sequence
  Synthetic oligonucleotide; TTT chr11 5264184 5264205 5264189 5264184 -
gtcaaggatgttggcatctatg

SEQ ID NO: 137177 - DNA, 22 bp, Artificial Sequence
  Synthetic oligonucleotide; TTG chr11 5264183 5264204 5264188 5264183 -
tcaaggatgttggcatctatgt

SEQ ID NO: 137178 - DNA, 22 bp, Artificial Sequence
  Synthetic oligonucleotide; TTG chr11 5264171 5264192 5264176 5264171 -
gcatctatgttcatcagggata

SEQ ID NO: 137179 - DNA, 22 bp, Artificial Sequence
  Synthetic oligonucleotide; CTA chr11 5264164 5264185 5264169 5264164 -
tgttcatcagggatattgatct

SEQ ID NO: 137180 - DNA, 22 bp, Artificial Sequence
  Synthetic oligonucleotide; TTC chr11 5264159 5264180 5264164 5264159 -
atcagggatattgatctgtagt

SEQ ID NO: 137181 - DNA, 22 bp, Artificial Sequence
  Synthetic oligonucleotide; TTG chr11 5264146 5264167 5264151 5264146 -
atctgtagtgtttttttttttt

SEQ ID NO: 137182 - DNA, 22 bp, Artificial Sequence
  Synthetic oligonucleotide; CTG chr11 5264141 5264162 5264146 5264141 -
tagtgttttttttttttggtta

SEQ ID NO: 137183 - DNA, 22 bp, Artificial Sequence
  Synthetic oligonucleotide; TTT chr11 5264133 5264154 5264138 5264133 -
tttttttttggttatgttcttt

SEQ ID NO: 137184 - DNA, 22 bp, Artificial Sequence
  Synthetic oligonucleotide; TTT chr11 5264132 5264153 5264137 5264132 -
ttttttttggttatgttctttc

SEQ ID NO: 137185 - DNA, 22 bp, Artificial Sequence
  Synthetic oligonucleotide; TTT chr11 5264131 5264152 5264136 5264131 -
tttttttggttatgttctttcc

SEQ ID NO: 137186 - DNA, 22 bp, Artificial Sequence
  Synthetic oligonucleotide; TTT chr11 5264130 5264151 5264135 5264130 -
ttttttggttatgttctttccc

SEQ ID NO: 137187 - DNA, 22 bp, Artificial Sequence
  Synthetic oligonucleotide; TTT chr11 5264129 5264150 5264134 5264129 -
tttttggttatgttctttccca

SEQ ID NO: 137188 - DNA, 22 bp, Artificial Sequence
  Synthetic oligonucleotide; TTT chr11 5264128 5264149 5264133 5264128 -
ttttggttatgttctttcccag

SEQ ID NO: 137189 - DNA, 22 bp, Artificial Sequence
  Synthetic oligonucleotide; TTT chr11 5264127 5264148 5264132 5264127 -
tttggttatgttctttcccagt

SEQ ID NO: 137190 - DNA, 22 bp, Artificial Sequence
  Synthetic oligonucleotide; TTT chr11 5264126 5264147 5264131 5264126 -
ttggttatgttctttcccagtt

SEQ ID NO: 137191 - DNA, 22 bp, Artificial Sequence
  Synthetic oligonucleotide; TTT chr11 5264125 5264146 5264130 5264125 -
tggttatgttctttcccagttt

SEQ ID NO: 137192 - DNA, 22 bp, Artificial Sequence
  Synthetic oligonucleotide; TTT chr11 5264124 5264145 5264129 5264124 -
ggttatgttctttcccagtttt

SEQ ID NO: 137193 - DNA, 22 bp, Artificial Sequence
  Synthetic oligonucleotide; TTG chr11 5264123 5264144 5264128 5264123 -
gttatgttctttcccagttttg

SEQ ID NO: 137194 - DNA, 22 bp, Artificial Sequence
  Synthetic oligonucleotide; TTA chr11 5264119 5264140 5264124 5264119 -
tgttctttcccagttttggtat

SEQ ID NO: 137195 - DNA, 22 bp, Artificial Sequence
  Synthetic oligonucleotide; TTC chr11 5264114 5264135 5264119 5264114 -
tttcccagttttggtattaagg

SEQ ID NO: 137196 - DNA, 22 bp, Artificial Sequence
  Synthetic oligonucleotide; CTT chr11 5264112 5264133 5264117 5264112 -
tcccagttttggtattaaggtg

SEQ ID NO: 137197 - DNA, 22 bp, Artificial Sequence
  Synthetic oligonucleotide; TTT chr11 5264111 5264132 5264116 5264111 -
cccagttttggtattaaggtga

SEQ ID NO: 137198 - DNA, 22 bp, Artificial Sequence
  Synthetic oligonucleotide; TTC chr11 5264110 5264131 5264115 5264110 -
ccagttttggtattaaggtgat

SEQ ID NO: 137199 - DNA, 22 bp, Artificial Sequence
  Synthetic oligonucleotide; TTT chr11 5264103 5264124 5264108 5264103 -
tggtattaaggtgatactggct

SEQ ID NO: 137200 - DNA, 22 bp, Artificial Sequence
  Synthetic oligonucleotide; TTT chr11 5264102 5264123 5264107 5264102 -
ggtattaaggtgatactggctt

SEQ ID NO: 137201 - DNA, 22 bp, Artificial Sequence
  Synthetic oligonucleotide; TTG chr11 5264101 5264122 5264106 5264101 -
gtattaaggtgatactggcttc

SEQ ID NO: 137202 - DNA, 22 bp, Artificial Sequence
  Synthetic oligonucleotide; TTA chr11 5264095 5264116 5264100 5264095 -
aggtgatactggcttcatagaa

SEQ ID NO: 137203 - DNA, 22 bp, Artificial Sequence
  Synthetic oligonucleotide; CTG chr11 5264084 5264105 5264089 5264084 -
gcttcatagaatgatttaggga

SEQ ID NO: 137204 - DNA, 22 bp, Artificial Sequence
  Synthetic oligonucleotide; CTT chr11 5264080 5264101 5264085 5264080 -
catagaatgatttagggaggat

SEQ ID NO: 137205 - DNA, 22 bp, Artificial Sequence
  Synthetic oligonucleotide; TTC chr11 5264079 5264100 5264084 5264079 -
atagaatgatttagggaggatt

SEQ ID NO: 137206 - DNA, 22 bp, Artificial Sequence
  Synthetic oligonucleotide; TTT chr11 5264067 5264088 5264072 5264067 -
agggaggattctctctttctct

SEQ ID NO: 137207 - DNA, 22 bp, Artificial Sequence
  Synthetic oligonucleotide; TTA chr11 5264066 5264087 5264071 5264066 -
gggaggattctctctttctcta

SEQ ID NO: 137208 - DNA, 22 bp, Artificial Sequence
  Synthetic oligonucleotide; TTC chr11 5264056 5264077 5264061 5264056 -
tctctttctctatcttgtagaa

SEQ ID NO: 137209 - DNA, 22 bp, Artificial Sequence
  Synthetic oligonucleotide; CTC chr11 5264054 5264075 5264059 5264054 -
tctttctctatcttgtagaata

SEQ ID NO: 137210 - DNA, 22 bp, Artificial Sequence
  Synthetic oligonucleotide; CTC chr11 5264052 5264073 5264057 5264052 -
tttctctatcttgtagaatact

SEQ ID NO: 137211 - DNA, 22 bp, Artificial Sequence
  Synthetic oligonucleotide; CTT chr11 5264050 5264071 5264055 5264050 -
tctctatcttgtagaatactgt

SEQ ID NO: 137212 - DNA, 22 bp, Artificial Sequence
  Synthetic oligonucleotide; TTT chr11 5264049 5264070 5264054 5264049 -
ctctatcttgtagaatactgtc

SEQ ID NO: 137213 - DNA, 22 bp, Artificial Sequence
  Synthetic oligonucleotide; TTC chr11 5264048 5264069 5264053 5264048 -
tctatcttgtagaatactgtca

SEQ ID NO: 137214 - DNA, 22 bp, Artificial Sequence
  Synthetic oligonucleotide; CTC chr11 5264046 5264067 5264051 5264046 -
tatcttgtagaatactgtcaat

SEQ ID NO: 137215 - DNA, 22 bp, Artificial Sequence
  Synthetic oligonucleotide; CTA chr11 5264044 5264065 5264049 5264044 -
tcttgtagaatactgtcaatag

SEQ ID NO: 137216 - DNA, 22 bp, Artificial Sequence
  Synthetic oligonucleotide; CTT chr11 5264040 5264061 5264045 5264040 -
gtagaatactgtcaataggatt

SEQ ID NO: 137217 - DNA, 22 bp, Artificial Sequence
  Synthetic oligonucleotide; TTG chr11 5264039 5264060 5264044 5264039 -
tagaatactgtcaataggattg

SEQ ID NO: 137218 - DNA, 22 bp, Artificial Sequence
  Synthetic oligonucleotide; CTG chr11 5264029 5264050 5264034 5264029 -
tcaataggattggtatcaattc

SEQ ID NO: 137219 - DNA, 22 bp, Artificial Sequence
  Synthetic oligonucleotide; TTG chr11 5264017 5264038 5264022 5264017 -
gtatcaattcttctttgaatgt

SEQ ID NO: 137220 - DNA, 22 bp, Artificial Sequence
  Synthetic oligonucleotide; TTC chr11 5264007 5264028 5264012 5264007 -
ttctttgaatgtctggtagaat

SEQ ID NO: 137221 - DNA, 22 bp, Artificial Sequence
  Synthetic oligonucleotide; CTT chr11 5264005 5264026 5264010 5264005 -
ctttgaatgtctggtagaattc

SEQ ID NO: 137222 - DNA, 22 bp, Artificial Sequence
  Synthetic oligonucleotide; TTC chr11 5264004 5264025 5264009 5264004 -
tttgaatgtctggtagaattca

SEQ ID NO: 137223 - DNA, 22 bp, Artificial Sequence
  Synthetic oligonucleotide; CTT chr11 5264002 5264023 5264007 5264002 -
tgaatgtctggtagaattcagc

SEQ ID NO: 137224 - DNA, 22 bp, Artificial Sequence
  Synthetic oligonucleotide; TTT chr11 5264001 5264022 5264006 5264001 -
gaatgtctggtagaattcagct

SEQ ID NO: 137225 - DNA, 22 bp, Artificial Sequence
  Synthetic oligonucleotide; TTG chr11 5264000 5264021 5264005 5264000 -
aatgtctggtagaattcagctg

SEQ ID NO: 137226 - DNA, 22 bp, Artificial Sequence
  Synthetic oligonucleotide; CTG chr11 5263992 5264013 5263997 5263992 -
gtagaattcagctgtgaatcta

SEQ ID NO: 137227 - DNA, 22 bp, Artificial Sequence
  Synthetic oligonucleotide; TTC chr11 5263983 5264004 5263988 5263983 -
agctgtgaatctatctggtcct

SEQ ID NO: 137228 - DNA, 22 bp, Artificial Sequence
  Synthetic oligonucleotide; CTG chr11 5263978 5263999 5263983 5263978 -
tgaatctatctggtcctggact

SEQ ID NO: 137229 - DNA, 22 bp, Artificial Sequence
  Synthetic oligonucleotide; CTA chr11 5263970 5263991 5263975 5263970 -
tctggtcctggacttttttgtt

SEQ ID NO: 137230 - DNA, 22 bp, Artificial Sequence
  Synthetic oligonucleotide; CTG chr11 5263966 5263987 5263971 5263966 -
gtcctggacttttttgttgttg

SEQ ID NO: 137231 - DNA, 22 bp, Artificial Sequence
  Synthetic oligonucleotide; CTG chr11 5263960 5263981 5263965 5263960 -
gacttttttgttgttggtaaat

SEQ ID NO: 137232 - DNA, 22 bp, Artificial Sequence
  Synthetic oligonucleotide; CTT chr11 5263955 5263976 5263960 5263955 -
ttttgttgttggtaaattttta

SEQ ID NO: 137233 - DNA, 22 bp, Artificial Sequence
  Synthetic oligonucleotide; TTT chr11 5263954 5263975 5263959 5263954 -
tttgttgttggtaaatttttat

SEQ ID NO: 137234 - DNA, 22 bp, Artificial Sequence
  Synthetic oligonucleotide; TTT chr11 5263953 5263974 5263958 5263953 -
ttgttgttggtaaatttttatt

SEQ ID NO: 137235 - DNA, 22 bp, Artificial Sequence
  Synthetic oligonucleotide; TTT chr11 5263952 5263973 5263957 5263952 -
tgttgttggtaaatttttatta

SEQ ID NO: 137236 - DNA, 22 bp, Artificial Sequence
  Synthetic oligonucleotide; TTT chr11 5263951 5263972 5263956 5263951 -
gttgttggtaaatttttattat

SEQ ID NO: 137237 - DNA, 22 bp, Artificial Sequence
  Synthetic oligonucleotide; TTG chr11 5263950 5263971 5263955 5263950 -
ttgttggtaaatttttattatc

SEQ ID NO: 137238 - DNA, 22 bp, Artificial Sequence
  Synthetic oligonucleotide; TTG chr11 5263947 5263968 5263952 5263947 -
ttggtaaatttttattatcatt

SEQ ID NO: 137239 - DNA, 22 bp, Artificial Sequence
  Synthetic oligonucleotide; TTG chr11 5263944 5263965 5263949 5263944 -
gtaaatttttattatcatttca

SEQ ID NO: 137240 - DNA, 22 bp, Artificial Sequence
  Synthetic oligonucleotide; TTT chr11 5263936 5263957 5263941 5263936 -
ttattatcatttcagtcttgct

SEQ ID NO: 137241 - DNA, 22 bp, Artificial Sequence
  Synthetic oligonucleotide; TTT chr11 5263935 5263956 5263940 5263935 -
tattatcatttcagtcttgctg

SEQ ID NO: 137242 - DNA, 22 bp, Artificial Sequence
  Synthetic oligonucleotide; TTT chr11 5263934 5263955 5263939 5263934 -
attatcatttcagtcttgctgc

SEQ ID NO: 137243 - DNA, 22 bp, Artificial Sequence
  Synthetic oligonucleotide; TTA chr11 5263933 5263954 5263938 5263933 -
ttatcatttcagtcttgctgct

SEQ ID NO: 137244 - DNA, 22 bp, Artificial Sequence
  Synthetic oligonucleotide; TTA chr11 5263930 5263951 5263935 5263930 -
tcatttcagtcttgctgcttat

SEQ ID NO: 137245 - DNA, 22 bp, Artificial Sequence
  Synthetic oligonucleotide; TTT chr11 5263924 5263945 5263929 5263924 -
cagtcttgctgcttattactgg

SEQ ID NO: 137246 - DNA, 22 bp, Artificial Sequence
  Synthetic oligonucleotide; TTC chr11 5263923 5263944 5263928 5263923 -
agtcttgctgcttattactggt

SEQ ID NO: 137247 - DNA, 22 bp, Artificial Sequence
  Synthetic oligonucleotide; CTT chr11 5263917 5263938 5263922 5263917 -
gctgcttattactggtctgttc

SEQ ID NO: 137248 - DNA, 22 bp, Artificial Sequence
  Synthetic oligonucleotide; TTG chr11 5263916 5263937 5263921 5263916 -
ctgcttattactggtctgttca

SEQ ID NO: 137249 - DNA, 22 bp, Artificial Sequence
  Synthetic oligonucleotide; CTG chr11 5263913 5263934 5263918 5263913 -
cttattactggtctgttcaggg

SEQ ID NO: 137250 - DNA, 22 bp, Artificial Sequence
  Synthetic oligonucleotide; CTT chr11 5263910 5263931 5263915 5263910 -
attactggtctgttcagggtat

SEQ ID NO: 137251 - DNA, 22 bp, Artificial Sequence
  Synthetic oligonucleotide; TTA chr11 5263909 5263930 5263914 5263909 -
ttactggtctgttcagggtatc

SEQ ID NO: 137252 - DNA, 22 bp, Artificial Sequence
  Synthetic oligonucleotide; TTA chr11 5263906 5263927 5263911 5263906 -
ctggtctgttcagggtatctaa

SEQ ID NO: 137253 - DNA, 22 bp, Artificial Sequence
  Synthetic oligonucleotide; CTG chr11 5263903 5263924 5263908 5263903 -
gtctgttcagggtatctaattc

SEQ ID NO: 137254 - DNA, 22 bp, Artificial Sequence
  Synthetic oligonucleotide; CTG chr11 5263898 5263919 5263903 5263898 -
ttcagggtatctaattcttcct

SEQ ID NO: 137255 - DNA, 22 bp, Artificial Sequence
  Synthetic oligonucleotide; TTC chr11 5263895 5263916 5263900 5263895 -
agggtatctaattcttcctgac

SEQ ID NO: 137256 - DNA, 22 bp, Artificial Sequence
  Synthetic oligonucleotide; CTA chr11 5263885 5263906 5263890 5263885 -
attcttcctgacttaagctaga

SEQ ID NO: 137257 - DNA, 22 bp, Artificial Sequence
  Synthetic oligonucleotide; TTC chr11 5263881 5263902 5263886 5263881 -
ttcctgacttaagctagagccc

SEQ ID NO: 137258 - DNA, 22 bp, Artificial Sequence
  Synthetic oligonucleotide; CTT chr11 5263879 5263900 5263884 5263879 -
cctgacttaagctagagccctg

SEQ ID NO: 137259 - DNA, 22 bp, Artificial Sequence
  Synthetic oligonucleotide; TTC chr11 5263878 5263899 5263883 5263878 -
ctgacttaagctagagccctgt

SEQ ID NO: 137260 - DNA, 22 bp, Artificial Sequence
  Synthetic oligonucleotide; CTG chr11 5263875 5263896 5263880 5263875 -
acttaagctagagccctgtatc

SEQ ID NO: 137261 - DNA, 22 bp, Artificial Sequence
  Synthetic oligonucleotide; CTT chr11 5263871 5263892 5263876 5263871 -
aagctagagccctgtatctttc

SEQ ID NO: 137262 - DNA, 22 bp, Artificial Sequence
  Synthetic oligonucleotide; TTA chr11 5263870 5263891 5263875 5263870 -
agctagagccctgtatctttcc

SEQ ID NO: 137263 - DNA, 22 bp, Artificial Sequence
  Synthetic oligonucleotide; CTA chr11 5263865 5263886 5263870 5263865 -
gagccctgtatctttccaggaa

SEQ ID NO: 137264 - DNA, 22 bp, Artificial Sequence
  Synthetic oligonucleotide; CTG chr11 5263857 5263878 5263862 5263857 -
tatctttccaggaattcgaacg

SEQ ID NO: 137265 - DNA, 22 bp, Artificial Sequence
  Synthetic oligonucleotide; CTT chr11 5263851 5263872 5263856 5263851 -
tccaggaattcgaacgtctcct

SEQ ID NO: 137266 - DNA, 22 bp, Artificial Sequence
  Synthetic oligonucleotide; TTT chr11 5263850 5263871 5263855 5263850 -
ccaggaattcgaacgtctcctt

SEQ ID NO: 137267 - DNA, 22 bp, Artificial Sequence
  Synthetic oligonucleotide; TTC chr11 5263849 5263870 5263854 5263849 -
caggaattcgaacgtctccttt

SEQ ID NO: 137268 - DNA, 22 bp, Artificial Sequence
  Synthetic oligonucleotide; TTC chr11 5263840 5263861 5263845 5263840 -
gaacgtctcctttaggttttct

SEQ ID NO: 137269 - DNA, 22 bp, Artificial Sequence
  Synthetic oligonucleotide; CTC chr11 5263831 5263852 5263836 5263831 -
ctttaggttttctagtttatgc

SEQ ID NO: 137270 - DNA, 22 bp, Artificial Sequence
  Synthetic oligonucleotide; CTT chr11 5263828 5263849 5263833 5263828 -
taggttttctagtttatgcatg

SEQ ID NO: 137271 - DNA, 22 bp, Artificial Sequence
  Synthetic oligonucleotide; TTT chr11 5263827 5263848 5263832 5263827 -
aggttttctagtttatgcatgt

SEQ ID NO: 137272 - DNA, 22 bp, Artificial Sequence
  Synthetic oligonucleotide; TTA chr11 5263826 5263847 5263831 5263826 -
ggttttctagtttatgcatgta

SEQ ID NO: 137273 - DNA, 22 bp, Artificial Sequence
  Synthetic oligonucleotide; TTT chr11 5263821 5263842 5263826 5263821 -
tctagtttatgcatgtaaaggt

SEQ ID NO: 137274 - DNA, 22 bp, Artificial Sequence
  Synthetic oligonucleotide; TTT chr11 5263820 5263841 5263825 5263820 -
ctagtttatgcatgtaaaggtg

SEQ ID NO: 137275 - DNA, 22 bp, Artificial Sequence
  Synthetic oligonucleotide; TTC chr11 5263819 5263840 5263824 5263819 -
tagtttatgcatgtaaaggtgt

SEQ ID NO: 137276 - DNA, 22 bp, Artificial Sequence
  Synthetic oligonucleotide; CTA chr11 5263817 5263838 5263822 5263817 -
gtttatgcatgtaaaggtgttc

SEQ ID NO: 137277 - DNA, 22 bp, Artificial Sequence
  Synthetic oligonucleotide; TTT chr11 5263813 5263834 5263818 5263813 -
atgcatgtaaaggtgttcatag

SEQ ID NO: 137278 - DNA, 22 bp, Artificial Sequence
  Synthetic oligonucleotide; TTA chr11 5263812 5263833 5263817 5263812 -
tgcatgtaaaggtgttcatagt

SEQ ID NO: 137279 - DNA, 22 bp, Artificial Sequence
  Synthetic oligonucleotide; TTC chr11 5263795 5263816 5263800 5263795 -
atagtagccttgaataatcttt

SEQ ID NO: 137280 - DNA, 22 bp, Artificial Sequence
  Synthetic oligonucleotide; CTT chr11 5263784 5263805 5263789 5263784 -
gaataatcttttgtatttctgt

SEQ ID NO: 137281 - DNA, 22 bp, Artificial Sequence
  Synthetic oligonucleotide; TTG chr11 5263783 5263804 5263788 5263783 -
aataatcttttgtatttctgtg

SEQ ID NO: 137282 - DNA, 22 bp, Artificial Sequence
  Synthetic oligonucleotide; CTT chr11 5263774 5263795 5263779 5263774 -
ttgtatttctgtggtatcagta

SEQ ID NO: 137283 - DNA, 22 bp, Artificial Sequence
  Synthetic oligonucleotide; TTT chr11 5263773 5263794 5263778 5263773 -
tgtatttctgtggtatcagtaa

SEQ ID NO: 137284 - DNA, 22 bp, Artificial Sequence
  Synthetic oligonucleotide; TTT chr11 5263772 5263793 5263777 5263772 -
gtatttctgtggtatcagtaat

SEQ ID NO: 137285 - DNA, 22 bp, Artificial Sequence
  Synthetic oligonucleotide; TTG chr11 5263771 5263792 5263776 5263771 -
tatttctgtggtatcagtaata

SEQ ID NO: 137286 - DNA, 22 bp, Artificial Sequence
  Synthetic oligonucleotide; TTT chr11 5263766 5263787 5263771 5263766 -
ctgtggtatcagtaatagtatc

SEQ ID NO: 137287 - DNA, 22 bp, Artificial Sequence
  Synthetic oligonucleotide; TTC chr11 5263765 5263786 5263770 5263765 -
tgtggtatcagtaatagtatct

SEQ ID NO: 137288 - DNA, 22 bp, Artificial Sequence
  Synthetic oligonucleotide; CTG chr11 5263763 5263784 5263768 5263763 -
tggtatcagtaatagtatctcc

SEQ ID NO: 137289 - DNA, 22 bp, Artificial Sequence
  Synthetic oligonucleotide; CTC chr11 5263742 5263763 5263747 5263742 -
ctgttttgtttctaattgagtt

SEQ ID NO: 137290 - DNA, 22 bp, Artificial Sequence
  Synthetic oligonucleotide; CTG chr11 5263739 5263760 5263744 5263739 -
ttttgtttctaattgagtttat

SEQ ID NO: 137291 - DNA, 22 bp, Artificial Sequence
  Synthetic oligonucleotide; TTT chr11 5263736 5263757 5263741 5263736 -
tgtttctaattgagtttatttg

SEQ ID NO: 137292 - DNA, 22 bp, Artificial Sequence
  Synthetic oligonucleotide; TTT chr11 5263735 5263756 5263740 5263735 -
gtttctaattgagtttatttgc

SEQ ID NO: 137293 - DNA, 22 bp, Artificial Sequence
  Synthetic oligonucleotide; TTG chr11 5263734 5263755 5263739 5263734 -
tttctaattgagtttatttgca

SEQ ID NO: 137294 - DNA, 22 bp, Artificial Sequence
  Synthetic oligonucleotide; TTT chr11 5263731 5263752 5263736 5263731 -
ctaattgagtttatttgcactt

SEQ ID NO: 137295 - DNA, 22 bp, Artificial Sequence
  Synthetic oligonucleotide; TTC chr11 5263730 5263751 5263735 5263730 -
taattgagtttatttgcacttc

SEQ ID NO: 137296 - DNA, 22 bp, Artificial Sequence
  Synthetic oligonucleotide; CTA chr11 5263728 5263749 5263733 5263728 -
attgagtttatttgcacttctc

SEQ ID NO: 137297 - DNA, 22 bp, Artificial Sequence
  Synthetic oligonucleotide; TTG chr11 5263724 5263745 5263729 5263724 -
agtttatttgcacttctctcct

SEQ ID NO: 137298 - DNA, 22 bp, Artificial Sequence
  Synthetic oligonucleotide; TTT chr11 5263719 5263740 5263724 5263719 -
atttgcacttctctcctctttt

SEQ ID NO: 137299 - DNA, 22 bp, Artificial Sequence
  Synthetic oligonucleotide; TTA chr11 5263718 5263739 5263723 5263718 -
tttgcacttctctcctcttttc

SEQ ID NO: 137300 - DNA, 22 bp, Artificial Sequence
  Synthetic oligonucleotide; TTT chr11 5263715 5263736 5263720 5263715 -
gcacttctctcctcttttcttg

SEQ ID NO: 137301 - DNA, 22 bp, Artificial Sequence
  Synthetic oligonucleotide; TTG chr11 5263714 5263735 5263719 5263714 -
cacttctctcctcttttcttgg

SEQ ID NO: 137302 - DNA, 22 bp, Artificial Sequence
  Synthetic oligonucleotide; CTT chr11 5263709 5263730 5263714 5263709 -
ctctcctcttttcttggttaat

SEQ ID NO: 137303 - DNA, 22 bp, Artificial Sequence
  Synthetic oligonucleotide; TTC chr11 5263708 5263729 5263713 5263708 -
tctcctcttttcttggttaatc

SEQ ID NO: 137304 - DNA, 22 bp, Artificial Sequence
  Synthetic oligonucleotide; CTC chr11 5263706 5263727 5263711 5263706 -
tcctcttttcttggttaatctt

SEQ ID NO: 137305 - DNA, 22 bp, Artificial Sequence
  Synthetic oligonucleotide; CTC chr11 5263704 5263725 5263709 5263704 -
ctcttttcttggttaatcttgc

SEQ ID NO: 137306 - DNA, 22 bp, Artificial Sequence
  Synthetic oligonucleotide; CTC chr11 5263701 5263722 5263706 5263701 -
ttttcttggttaatcttgctaa

SEQ ID NO: 137307 - DNA, 22 bp, Artificial Sequence
  Synthetic oligonucleotide; CTT chr11 5263699 5263720 5263704 5263699 -
ttcttggttaatcttgctaatg

SEQ ID NO: 137308 - DNA, 22 bp, Artificial Sequence
  Synthetic oligonucleotide; TTT chr11 5263698 5263719 5263703 5263698 -
tcttggttaatcttgctaatgg

SEQ ID NO: 137309 - DNA, 22 bp, Artificial Sequence
  Synthetic oligonucleotide; TTT chr11 5263697 5263718 5263702 5263697 -
cttggttaatcttgctaatggt

SEQ ID NO: 137310 - DNA, 22 bp, Artificial Sequence
  Synthetic oligonucleotide; TTC chr11 5263696 5263717 5263701 5263696 -
ttggttaatcttgctaatggtc

SEQ ID NO: 137311 - DNA, 22 bp, Artificial Sequence
  Synthetic oligonucleotide; CTT chr11 5263694 5263715 5263699 5263694 -
ggttaatcttgctaatggtcta

SEQ ID NO: 137312 - DNA, 22 bp, Artificial Sequence
  Synthetic oligonucleotide; TTG chr11 5263693 5263714 5263698 5263693 -
gttaatcttgctaatggtctat

SEQ ID NO: 137313 - DNA, 22 bp, Artificial Sequence
  Synthetic oligonucleotide; TTA chr11 5263689 5263710 5263694 5263689 -
atcttgctaatggtctatcagt

SEQ ID NO: 137314 - DNA, 22 bp, Artificial Sequence
  Synthetic oligonucleotide; CTT chr11 5263684 5263705 5263689 5263684 -
gctaatggtctatcagttttat

SEQ ID NO: 137315 - DNA, 22 bp, Artificial Sequence
  Synthetic oligonucleotide; TTG chr11 5263683 5263704 5263688 5263683 -
ctaatggtctatcagttttatt

SEQ ID NO: 137316 - DNA, 22 bp, Artificial Sequence
  Synthetic oligonucleotide; CTA chr11 5263680 5263701 5263685 5263680 -
atggtctatcagttttatttat

SEQ ID NO: 137317 - DNA, 22 bp, Artificial Sequence
  Synthetic oligonucleotide; CTA chr11 5263672 5263693 5263677 5263672 -
tcagttttatttatcttttcaa

SEQ ID NO: 137318 - DNA, 22 bp, Artificial Sequence
  Synthetic oligonucleotide; TTT chr11 5263665 5263686 5263670 5263665 -
tatttatcttttcaaagaacca

SEQ ID NO: 137319 - DNA, 22 bp, Artificial Sequence
  Synthetic oligonucleotide; TTT chr11 5263664 5263685 5263669 5263664 -
atttatcttttcaaagaaccag

SEQ ID NO: 137320 - DNA, 22 bp, Artificial Sequence
  Synthetic oligonucleotide; TTA chr11 5263663 5263684 5263668 5263663 -
tttatcttttcaaagaaccagc

SEQ ID NO: 137321 - DNA, 22 bp, Artificial Sequence
  Synthetic oligonucleotide; TTT chr11 5263660 5263681 5263665 5263660 -
atcttttcaaagaaccagcttt

SEQ ID NO: 137322 - DNA, 22 bp, Artificial Sequence
  Synthetic oligonucleotide; TTA chr11 5263659 5263680 5263664 5263659 -
tcttttcaaagaaccagctttt

SEQ ID NO: 137323 - DNA, 22 bp, Artificial Sequence
  Synthetic oligonucleotide; CTT chr11 5263655 5263676 5263660 5263655 -
ttcaaagaaccagctttttatt

SEQ ID NO: 137324 - DNA, 22 bp, Artificial Sequence
  Synthetic oligonucleotide; TTT chr11 5263654 5263675 5263659 5263654 -
tcaaagaaccagctttttattt

SEQ ID NO: 137325 - DNA, 22 bp, Artificial Sequence
  Synthetic oligonucleotide; TTT chr11 5263653 5263674 5263658 5263653 -
caaagaaccagctttttatttc

SEQ ID NO: 137326 - DNA, 22 bp, Artificial Sequence
  Synthetic oligonucleotide; TTC chr11 5263652 5263673 5263657 5263652 -
aaagaaccagctttttatttca

SEQ ID NO: 137327 - DNA, 22 bp, Artificial Sequence
  Synthetic oligonucleotide; CTT chr11 5263639 5263660 5263644 5263639 -
tttatttcatttagcttttgta

SEQ ID NO: 137328 - DNA, 22 bp, Artificial Sequence
  Synthetic oligonucleotide; TTT chr11 5263638 5263659 5263643 5263638 -
ttatttcatttagcttttgtat

SEQ ID NO: 137329 - DNA, 22 bp, Artificial Sequence
  Synthetic oligonucleotide; TTT chr11 5263637 5263658 5263642 5263637 -
tatttcatttagcttttgtatt

SEQ ID NO: 137330 - DNA, 22 bp, Artificial Sequence
  Synthetic oligonucleotide; TTT chr11 5263636 5263657 5263641 5263636 -
atttcatttagcttttgtattt

SEQ ID NO: 137331 - DNA, 22 bp, Artificial Sequence
  Synthetic oligonucleotide; TTA chr11 5263635 5263656 5263640 5263635 -
tttcatttagcttttgtatttt

SEQ ID NO: 137332 - DNA, 22 bp, Artificial Sequence
  Synthetic oligonucleotide; TTT chr11 5263632 5263653 5263637 5263632 -
catttagcttttgtattttttt

SEQ ID NO: 137333 - DNA, 22 bp, Artificial Sequence
  Synthetic oligonucleotide; TTC chr11 5263631 5263652 5263636 5263631 -
atttagcttttgtatttttttg

SEQ ID NO: 137334 - DNA, 22 bp, Artificial Sequence
  Synthetic oligonucleotide; TTT chr11 5263627 5263648 5263632 5263627 -
agcttttgtatttttttgcagt

SEQ ID NO: 137335 - DNA, 22 bp, Artificial Sequence
  Synthetic oligonucleotide; TTA chr11 5263626 5263647 5263631 5263626 -
gcttttgtatttttttgcagtt

SEQ ID NO: 137336 - DNA, 22 bp, Artificial Sequence
  Synthetic oligonucleotide; CTT chr11 5263622 5263643 5263627 5263622 -
ttgtatttttttgcagttgttt

SEQ ID NO: 137337 - DNA, 22 bp, Artificial Sequence
  Synthetic oligonucleotide; TTT chr11 5263621 5263642 5263626 5263621 -
tgtatttttttgcagttgtttt

SEQ ID NO: 137338 - DNA, 22 bp, Artificial Sequence
  Synthetic oligonucleotide; TTT chr11 5263620 5263641 5263625 5263620 -
gtatttttttgcagttgtttta

SEQ ID NO: 137339 - DNA, 22 bp, Artificial Sequence
  Synthetic oligonucleotide; TTG chr11 5263619 5263640 5263624 5263619 -
tatttttttgcagttgttttaa

SEQ ID NO: 137340 - DNA, 22 bp, Artificial Sequence
  Synthetic oligonucleotide; TTT chr11 5263614 5263635 5263619 5263614 -
ttttgcagttgttttaatttca

SEQ ID NO: 137341 - DNA, 22 bp, Artificial Sequence
  Synthetic oligonucleotide; TTT chr11 5263613 5263634 5263618 5263613 -
tttgcagttgttttaatttcat

SEQ ID NO: 137342 - DNA, 22 bp, Artificial Sequence
  Synthetic oligonucleotide; TTT chr11 5263612 5263633 5263617 5263612 -
ttgcagttgttttaatttcatt

SEQ ID NO: 137343 - DNA, 22 bp, Artificial Sequence
  Synthetic oligonucleotide; TTT chr11 5263611 5263632 5263616 5263611 -
tgcagttgttttaatttcattt

SEQ ID NO: 137344 - DNA, 22 bp, Artificial Sequence
  Synthetic oligonucleotide; TTT chr11 5263610 5263631 5263615 5263610 -
gcagttgttttaatttcattta

SEQ ID NO: 137345 - DNA, 22 bp, Artificial Sequence
  Synthetic oligonucleotide; TTG chr11 5263609 5263630 5263614 5263609 -
cagttgttttaatttcatttag

SEQ ID NO: 137346 - DNA, 22 bp, Artificial Sequence
  Synthetic oligonucleotide; TTG chr11 5263603 5263624 5263608 5263603 -
ttttaatttcatttagttctcc

SEQ ID NO: 137347 - DNA, 22 bp, Artificial Sequence
  Synthetic oligonucleotide; TTT chr11 5263600 5263621 5263605 5263600 -
taatttcatttagttctcctct

SEQ ID NO: 137348 - DNA, 22 bp, Artificial Sequence
  Synthetic oligonucleotide; TTT chr11 5263599 5263620 5263604 5263599 -
aatttcatttagttctcctctt

SEQ ID NO: 137349 - DNA, 22 bp, Artificial Sequence
  Synthetic oligonucleotide; TTA chr11 5263598 5263619 5263603 5263598 -
atttcatttagttctcctctta

SEQ ID NO: 137350 - DNA, 22 bp, Artificial Sequence
  Synthetic oligonucleotide; TTT chr11 5263594 5263615 5263599 5263594 -
catttagttctcctcttatctt

SEQ ID NO: 137351 - DNA, 22 bp, Artificial Sequence
  Synthetic oligonucleotide; TTC chr11 5263593 5263614 5263598 5263593 -
atttagttctcctcttatctta

SEQ ID NO: 137352 - DNA, 22 bp, Artificial Sequence
  Synthetic oligonucleotide; TTT chr11 5263589 5263610 5263594 5263589 -
agttctcctcttatcttagtta

SEQ ID NO: 137353 - DNA, 22 bp, Artificial Sequence
  Synthetic oligonucleotide; TTA chr11 5263588 5263609 5263593 5263588 -
gttctcctcttatcttagttat

SEQ ID NO: 137354 - DNA, 22 bp, Artificial Sequence
  Synthetic oligonucleotide; TTC chr11 5263584 5263605 5263589 5263584 -
tcctcttatcttagttattccc

SEQ ID NO: 137355 - DNA, 22 bp, Artificial Sequence
  Synthetic oligonucleotide; CTC chr11 5263582 5263603 5263587 5263582 -
ctcttatcttagttattccctt

SEQ ID NO: 137356 - DNA, 22 bp, Artificial Sequence
  Synthetic oligonucleotide; CTC chr11 5263579 5263600 5263584 5263579 -
ttatcttagttattccctttct

SEQ ID NO: 137357 - DNA, 22 bp, Artificial Sequence
  Synthetic oligonucleotide; CTT chr11 5263577 5263598 5263582 5263577 -
atcttagttattccctttcttt

SEQ ID NO: 137358 - DNA, 22 bp, Artificial Sequence
  Synthetic oligonucleotide; TTA chr11 5263576 5263597 5263581 5263576 -
tcttagttattccctttctttt

SEQ ID NO: 137359 - DNA, 22 bp, Artificial Sequence
  Synthetic oligonucleotide; CTT chr11 5263572 5263593 5263577 5263572 -
agttattccctttcttttgctg

SEQ ID NO: 137360 - DNA, 22 bp, Artificial Sequence
  Synthetic oligonucleotide; TTA chr11 5263571 5263592 5263576 5263571 -
gttattccctttcttttgctgg

SEQ ID NO: 137361 - DNA, 22 bp, Artificial Sequence
  Synthetic oligonucleotide; TTA chr11 5263567 5263588 5263572 5263567 -
ttccctttcttttgctgggttt

SEQ ID NO: 137362 - DNA, 22 bp, Artificial Sequence
  Synthetic oligonucleotide; TTC chr11 5263564 5263585 5263569 5263564 -
cctttcttttgctgggttttgg

SEQ ID NO: 137363 - DNA, 22 bp, Artificial Sequence
  Synthetic oligonucleotide; CTT chr11 5263560 5263581 5263565 5263560 -
tcttttgctgggttttggttct

SEQ ID NO: 137364 - DNA, 22 bp, Artificial Sequence
  Synthetic oligonucleotide; TTT chr11 5263559 5263580 5263564 5263559 -
cttttgctgggttttggttctg

SEQ ID NO: 137365 - DNA, 22 bp, Artificial Sequence
  Synthetic oligonucleotide; TTC chr11 5263558 5263579 5263563 5263558 -
ttttgctgggttttggttctgt

SEQ ID NO: 137366 - DNA, 22 bp, Artificial Sequence
  Synthetic oligonucleotide; CTT chr11 5263556 5263577 5263561 5263556 -
ttgctgggttttggttctgttt

SEQ ID NO: 137367 - DNA, 22 bp, Artificial Sequence
  Synthetic oligonucleotide; TTT chr11 5263555 5263576 5263560 5263555 -
tgctgggttttggttctgtttg

SEQ ID NO: 137368 - DNA, 22 bp, Artificial Sequence
  Synthetic oligonucleotide; TTT chr11 5263554 5263575 5263559 5263554 -
gctgggttttggttctgtttgt

SEQ ID NO: 137369 - DNA, 22 bp, Artificial Sequence
  Synthetic oligonucleotide; TTG chr11 5263553 5263574 5263558 5263553 -
ctgggttttggttctgtttgtt

SEQ ID NO: 137370 - DNA, 22 bp, Artificial Sequence
  Synthetic oligonucleotide; CTG chr11 5263550 5263571 5263555 5263550 -
ggttttggttctgtttgttttt

SEQ ID NO: 137371 - DNA, 22 bp, Artificial Sequence
  Synthetic oligonucleotide; TTT chr11 5263545 5263566 5263550 5263545 -
tggttctgtttgtttttgtttc

SEQ ID NO: 137372 - DNA, 22 bp, Artificial Sequence
  Synthetic oligonucleotide; TTT chr11 5263544 5263565 5263549 5263544 -
ggttctgtttgtttttgtttct

SEQ ID NO: 137373 - DNA, 22 bp, Artificial Sequence
  Synthetic oligonucleotide; TTG chr11 5263543 5263564 5263548 5263543 -
gttctgtttgtttttgtttctc

SEQ ID NO: 137374 - DNA, 22 bp, Artificial Sequence
  Synthetic oligonucleotide; TTC chr11 5263539 5263560 5263544 5263539 -
tgtttgtttttgtttctctagt

SEQ ID NO: 137375 - DNA, 22 bp, Artificial Sequence
  Synthetic oligonucleotide; CTG chr11 5263537 5263558 5263542 5263537 -
tttgtttttgtttctctagttt

SEQ ID NO: 137376 - DNA, 22 bp, Artificial Sequence
  Synthetic oligonucleotide; TTT chr11 5263534 5263555 5263539 5263534 -
gtttttgtttctctagtttctt

SEQ ID NO: 137377 - DNA, 22 bp, Artificial Sequence
  Synthetic oligonucleotide; TTG chr11 5263533 5263554 5263538 5263533 -
tttttgtttctctagtttcttg

SEQ ID NO: 137378 - DNA, 22 bp, Artificial Sequence
  Synthetic oligonucleotide; TTT chr11 5263530 5263551 5263535 5263530 -
ttgtttctctagtttcttgtgg

SEQ ID NO: 137379 - DNA, 22 bp, Artificial Sequence
  Synthetic oligonucleotide; TTT chr11 5263529 5263550 5263534 5263529 -
tgtttctctagtttcttgtggt

SEQ ID NO: 137380 - DNA, 22 bp, Artificial Sequence
  Synthetic oligonucleotide; TTT chr11 5263528 5263549 5263533 5263528 -
gtttctctagtttcttgtggtg

SEQ ID NO: 137381 - DNA, 22 bp, Artificial Sequence
  Synthetic oligonucleotide; TTG chr11 5263527 5263548 5263532 5263527 -
tttctctagtttcttgtggtgt

SEQ ID NO: 137382 - DNA, 22 bp, Artificial Sequence
  Synthetic oligonucleotide; TTT chr11 5263524 5263545 5263529 5263524 -
ctctagtttcttgtggtgtgac

SEQ ID NO: 137383 - DNA, 22 bp, Artificial Sequence
  Synthetic oligonucleotide; TTC chr11 5263523 5263544 5263528 5263523 -
tctagtttcttgtggtgtgacc

SEQ ID NO: 137384 - DNA, 22 bp, Artificial Sequence
  Synthetic oligonucleotide; CTC chr11 5263521 5263542 5263526 5263521 -
tagtttcttgtggtgtgacctt

SEQ ID NO: 137385 - DNA, 22 bp, Artificial Sequence
  Synthetic oligonucleotide; CTA chr11 5263519 5263540 5263524 5263519 -
gtttcttgtggtgtgaccttat

SEQ ID NO: 137386 - DNA, 22 bp, Artificial Sequence
  Synthetic oligonucleotide; TTT chr11 5263515 5263536 5263520 5263515 -
cttgtggtgtgaccttatattg

SEQ ID NO: 137387 - DNA, 22 bp, Artificial Sequence
  Synthetic oligonucleotide; TTC chr11 5263514 5263535 5263519 5263514 -
ttgtggtgtgaccttatattgt

SEQ ID NO: 137388 - DNA, 22 bp, Artificial Sequence
  Synthetic oligonucleotide; CTT chr11 5263512 5263533 5263517 5263512 -
gtggtgtgaccttatattgtct

SEQ ID NO: 137389 - DNA, 22 bp, Artificial Sequence
  Synthetic oligonucleotide; TTG chr11 5263511 5263532 5263516 5263511 -
tggtgtgaccttatattgtctg

SEQ ID NO: 137390 - DNA, 22 bp, Artificial Sequence
  Synthetic oligonucleotide; CTT chr11 5263499 5263520 5263504 5263499 -
atattgtctgtctgtcctcttt

SEQ ID NO: 137391 - DNA, 22 bp, Artificial Sequence
  Synthetic oligonucleotide; TTA chr11 5263498 5263519 5263503 5263498 -
tattgtctgtctgtcctctttc

SEQ ID NO: 137392 - DNA, 22 bp, Artificial Sequence
  Synthetic oligonucleotide; TTG chr11 5263493 5263514 5263498 5263493 -
tctgtctgtcctctttcagact

SEQ ID NO: 137393 - DNA, 22 bp, Artificial Sequence
  Synthetic oligonucleotide; CTG chr11 5263489 5263510 5263494 5263489 -
tctgtcctctttcagactcttt

SEQ ID NO: 137394 - DNA, 22 bp, Artificial Sequence
  Synthetic oligonucleotide; CTG chr11 5263485 5263506 5263490 5263485 -
tcctctttcagactctttgaca

SEQ ID NO: 137395 - DNA, 22 bp, Artificial Sequence
  Synthetic oligonucleotide; CTC chr11 5263480 5263501 5263485 5263480 -
tttcagactctttgacatcgac

SEQ ID NO: 137396 - DNA, 22 bp, Artificial Sequence
  Synthetic oligonucleotide; CTT chr11 5263478 5263499 5263483 5263478 -
tcagactctttgacatcgacat

SEQ ID NO: 137397 - DNA, 22 bp, Artificial Sequence
  Synthetic oligonucleotide; TTT chr11 5263477 5263498 5263482 5263477 -
cagactctttgacatcgacatt

SEQ ID NO: 137398 - DNA, 22 bp, Artificial Sequence
  Synthetic oligonucleotide; TTC chr11 5263476 5263497 5263481 5263476 -
agactctttgacatcgacattt

SEQ ID NO: 137399 - DNA, 22 bp, Artificial Sequence
  Synthetic oligonucleotide; CTC chr11 5263470 5263491 5263475 5263470 -
tttgacatcgacatttagggct

SEQ ID NO: 137400 - DNA, 22 bp, Artificial Sequence
  Synthetic oligonucleotide; CTT chr11 5263468 5263489 5263473 5263468 -
tgacatcgacatttagggctgt

SEQ ID NO: 137401 - DNA, 22 bp, Artificial Sequence
  Synthetic oligonucleotide; TTT chr11 5263467 5263488 5263472 5263467 -
gacatcgacatttagggctgtg

SEQ ID NO: 137402 - DNA, 22 bp, Artificial Sequence
  Synthetic oligonucleotide; TTG chr11 5263466 5263487 5263471 5263466 -
acatcgacatttagggctgtga

SEQ ID NO: 137403 - DNA, 22 bp, Artificial Sequence
  Synthetic oligonucleotide; TTT chr11 5263454 5263475 5263459 5263454 -
agggctgtgaactttcctttta

SEQ ID NO: 137404 - DNA, 22 bp, Artificial Sequence
  Synthetic oligonucleotide; TTA chr11 5263453 5263474 5263458 5263453 -
gggctgtgaactttccttttag

SEQ ID NO: 137405 - DNA, 22 bp, Artificial Sequence
  Synthetic oligonucleotide; CTG chr11 5263447 5263468 5263452 5263447 -
tgaactttccttttagcaccat

SEQ ID NO: 137406 - DNA, 22 bp, Artificial Sequence
  Synthetic oligonucleotide; CTT chr11 5263440 5263461 5263445 5263440 -
tccttttagcaccatctttgct

SEQ ID NO: 137407 - DNA, 22 bp, Artificial Sequence
  Synthetic oligonucleotide; TTT chr11 5263439 5263460 5263444 5263439 -
ccttttagcaccatctttgctg

SEQ ID NO: 137408 - DNA, 22 bp, Artificial Sequence
  Synthetic oligonucleotide; TTC chr11 5263438 5263459 5263443 5263438 -
cttttagcaccatctttgctgt

SEQ ID NO: 137409 - DNA, 22 bp, Artificial Sequence
  Synthetic oligonucleotide; CTT chr11 5263435 5263456 5263440 5263435 -
ttagcaccatctttgctgtatc

SEQ ID NO: 137410 - DNA, 22 bp, Artificial Sequence
  Synthetic oligonucleotide; TTT chr11 5263434 5263455 5263439 5263434 -
tagcaccatctttgctgtatcc

SEQ ID NO: 137411 - DNA, 22 bp, Artificial Sequence
  Synthetic oligonucleotide; TTT chr11 5263433 5263454 5263438 5263433 -
agcaccatctttgctgtatcct

SEQ ID NO: 137412 - DNA, 22 bp, Artificial Sequence
  Synthetic oligonucleotide; TTA chr11 5263432 5263453 5263437 5263432 -
gcaccatctttgctgtatccta

SEQ ID NO: 137413 - DNA, 22 bp, Artificial Sequence
  Synthetic oligonucleotide; CTT chr11 5263422 5263443 5263427 5263422 -
tgctgtatcctagaggttttga

SEQ ID NO: 137414 - DNA, 22 bp, Artificial Sequence
  Synthetic oligonucleotide; TTT chr11 5263421 5263442 5263426 5263421 -
gctgtatcctagaggttttgat

SEQ ID NO: 137415 - DNA, 22 bp, Artificial Sequence
  Synthetic oligonucleotide; TTG chr11 5263420 5263441 5263425 5263420 -
ctgtatcctagaggttttgata

SEQ ID NO: 137416 - DNA, 22 bp, Artificial Sequence
  Synthetic oligonucleotide; CTG chr11 5263417 5263438 5263422 5263417 -
tatcctagaggttttgataggt

SEQ ID NO: 137417 - DNA, 22 bp, Artificial Sequence
  Synthetic oligonucleotide; CTA chr11 5263410 5263431 5263415 5263410 -
gaggttttgataggttgtgtca

SEQ ID NO: 137418 - DNA, 22 bp, Artificial Sequence
  Synthetic oligonucleotide; TTT chr11 5263403 5263424 5263408 5263403 -
tgataggttgtgtcactattgt

SEQ ID NO: 137419 - DNA, 22 bp, Artificial Sequence
  Synthetic oligonucleotide; TTT chr11 5263402 5263423 5263407 5263402 -
gataggttgtgtcactattgtc

SEQ ID NO: 137420 - DNA, 22 bp, Artificial Sequence
  Synthetic oligonucleotide; TTG chr11 5263401 5263422 5263406 5263401 -
ataggttgtgtcactattgtcg

SEQ ID NO: 137421 - DNA, 22 bp, Artificial Sequence
  Synthetic oligonucleotide; TTG chr11 5263393 5263414 5263398 5263393 -
tgtcactattgtcggtcagttc

SEQ ID NO: 137422 - DNA, 22 bp, Artificial Sequence
  Synthetic oligonucleotide; CTA chr11 5263385 5263406 5263390 5263385 -
ttgtcggtcagttcaagtaatt

SEQ ID NO: 137423 - DNA, 22 bp, Artificial Sequence
  Synthetic oligonucleotide; TTG chr11 5263382 5263403 5263387 5263382 -
tcggtcagttcaagtaattttg

SEQ ID NO: 137424 - DNA, 22 bp, Artificial Sequence
  Synthetic oligonucleotide; TTC chr11 5263371 5263392 5263376 5263371 -
aagtaattttgttgttcttatt

SEQ ID NO: 137425 - DNA, 22 bp, Artificial Sequence
  Synthetic oligonucleotide; TTT chr11 5263362 5263383 5263367 5263362 -
tgttgttcttattatactttaa

SEQ ID NO: 137426 - DNA, 22 bp, Artificial Sequence
  Synthetic oligonucleotide; TTT chr11 5263361 5263382 5263366 5263361 -
gttgttcttattatactttaag

SEQ ID NO: 137427 - DNA, 22 bp, Artificial Sequence
  Synthetic oligonucleotide; TTG chr11 5263360 5263381 5263365 5263360 -
ttgttcttattatactttaagt

SEQ ID NO: 137428 - DNA, 22 bp, Artificial Sequence
  Synthetic oligonucleotide; TTG chr11 5263357 5263378 5263362 5263357 -
ttcttattatactttaagttct

SEQ ID NO: 137429 - DNA, 22 bp, Artificial Sequence
  Synthetic oligonucleotide; TTC chr11 5263354 5263375 5263359 5263354 -
ttattatactttaagttctggg

SEQ ID NO: 137430 - DNA, 22 bp, Artificial Sequence
  Synthetic oligonucleotide; CTT chr11 5263352 5263373 5263357 5263352 -
attatactttaagttctgggat

SEQ ID NO: 137431 - DNA, 22 bp, Artificial Sequence
  Synthetic oligonucleotide; TTA chr11 5263351 5263372 5263356 5263351 -
ttatactttaagttctgggata

SEQ ID NO: 137432 - DNA, 22 bp, Artificial Sequence
  Synthetic oligonucleotide; TTA chr11 5263348 5263369 5263353 5263348 -
tactttaagttctgggatacat

SEQ ID NO: 137433 - DNA, 22 bp, Artificial Sequence
  Synthetic oligonucleotide; CTT chr11 5263343 5263364 5263348 5263343 -
taagttctgggatacatgtgca

SEQ ID NO: 137434 - DNA, 22 bp, Artificial Sequence
  Synthetic oligonucleotide; TTT chr11 5263342 5263363 5263347 5263342 -
aagttctgggatacatgtgcag

SEQ ID NO: 137435 - DNA, 22 bp, Artificial Sequence
  Synthetic oligonucleotide; TTA chr11 5263341 5263362 5263346 5263341 -
agttctgggatacatgtgcaga

SEQ ID NO: 137436 - DNA, 22 bp, Artificial Sequence
  Synthetic oligonucleotide; TTC chr11 5263336 5263357 5263341 5263336 -
tgggatacatgtgcagaatgtg

SEQ ID NO: 137437 - DNA, 22 bp, Artificial Sequence
  Synthetic oligonucleotide; CTG chr11 5263334 5263355 5263339 5263334 -
ggatacatgtgcagaatgtgca

SEQ ID NO: 137438 - DNA, 22 bp, Artificial Sequence
  Synthetic oligonucleotide; TTT chr11 5263307 5263328 5263312 5263307 -
gttacataggtatagatgtgcc

SEQ ID NO: 137439 - DNA, 22 bp, Artificial Sequence
  Synthetic oligonucleotide; TTG chr11 5263306 5263327 5263311 5263306 -
ttacataggtatagatgtgcca

SEQ ID NO: 137440 - DNA, 22 bp, Artificial Sequence
  Synthetic oligonucleotide; TTA chr11 5263303 5263324 5263308 5263303 -
cataggtatagatgtgccatgg

SEQ ID NO: 137441 - DNA, 22 bp, Artificial Sequence
  Synthetic oligonucleotide; TTT chr11 5263275 5263296 5263280 5263275 -
gctgcacccatcaacctgtcat

SEQ ID NO: 137442 - DNA, 22 bp, Artificial Sequence
  Synthetic oligonucleotide; TTG chr11 5263274 5263295 5263279 5263274 -
ctgcacccatcaacctgtcatc

SEQ ID NO: 137443 - DNA, 22 bp, Artificial Sequence
  Synthetic oligonucleotide; CTG chr11 5263271 5263292 5263276 5263271 -
cacccatcaacctgtcatctac

SEQ ID NO: 137444 - DNA, 22 bp, Artificial Sequence
  Synthetic oligonucleotide; CTG chr11 5263257 5263278 5263262 5263257 -
tcatctacattaggtatttctt

SEQ ID NO: 137445 - DNA, 22 bp, Artificial Sequence
  Synthetic oligonucleotide; CTA chr11 5263250 5263271 5263255 5263250 -
cattaggtatttcttttaatgt

SEQ ID NO: 137446 - DNA, 22 bp, Artificial Sequence
  Synthetic oligonucleotide; TTA chr11 5263245 5263266 5263250 5263245 -
ggtatttcttttaatgttatcc

SEQ ID NO: 137447 - DNA, 22 bp, Artificial Sequence
  Synthetic oligonucleotide; TTT chr11 5263238 5263259 5263243 5263238 -
cttttaatgttatccctctcct

SEQ ID NO: 137448 - DNA, 22 bp, Artificial Sequence
  Synthetic oligonucleotide; TTC chr11 5263237 5263258 5263242 5263237 -
ttttaatgttatccctctccta

SEQ ID NO: 137449 - DNA, 22 bp, Artificial Sequence
  Synthetic oligonucleotide; CTT chr11 5263235 5263256 5263240 5263235 -
ttaatgttatccctctcctaac

SEQ ID NO: 137450 - DNA, 22 bp, Artificial Sequence
  Synthetic oligonucleotide; TTT chr11 5263234 5263255 5263239 5263234 -
taatgttatccctctcctaacc

SEQ ID NO: 137451 - DNA, 22 bp, Artificial Sequence
  Synthetic oligonucleotide; TTT chr11 5263233 5263254 5263238 5263233 -
aatgttatccctctcctaaccc

SEQ ID NO: 137452 - DNA, 22 bp, Artificial Sequence
  Synthetic oligonucleotide; TTA chr11 5263232 5263253 5263237 5263232 -
atgttatccctctcctaacccc

SEQ ID NO: 137453 - DNA, 22 bp, Artificial Sequence
  Synthetic oligonucleotide; TTA chr11 5263226 5263247 5263231 5263226 -
tccctctcctaaccccctcacc

SEQ ID NO: 137454 - DNA, 22 bp, Artificial Sequence
  Synthetic oligonucleotide; CTC chr11 5263220 5263241 5263225 5263220 -
tcctaaccccctcaccccccga

SEQ ID NO: 137455 - DNA, 22 bp, Artificial Sequence
  Synthetic oligonucleotide; CTC chr11 5263218 5263239 5263223 5263218 -
ctaaccccctcaccccccgaca

SEQ ID NO: 137456 - DNA, 22 bp, Artificial Sequence
  Synthetic oligonucleotide; CTA chr11 5263215 5263236 5263220 5263215 -
accccctcaccccccgacaggc

SEQ ID NO: 137457 - DNA, 22 bp, Artificial Sequence
  Synthetic oligonucleotide; CTC chr11 5263207 5263228 5263212 5263207 -
accccccgacaggccctggtgt

SEQ ID NO: 137458 - DNA, 22 bp, Artificial Sequence
  Synthetic oligonucleotide; CTG chr11 5263189 5263210 5263194 5263189 -
gtgtgtgatgttcccctccctg

SEQ ID NO: 137459 - DNA, 22 bp, Artificial Sequence
  Synthetic oligonucleotide; TTC chr11 5263176 5263197 5263181 5263176 -
ccctccctgtgtccatgtgttc

SEQ ID NO: 137460 - DNA, 22 bp, Artificial Sequence
  Synthetic oligonucleotide; CTC chr11 5263171 5263192 5263176 5263171 -
cctgtgtccatgtgttctcatt

SEQ ID NO: 137461 - DNA, 22 bp, Artificial Sequence
  Synthetic oligonucleotide; CTG chr11 5263167 5263188 5263172 5263167 -
tgtccatgtgttctcattgttc

SEQ ID NO: 137462 - DNA, 22 bp, Artificial Sequence
  Synthetic oligonucleotide; TTC chr11 5263154 5263175 5263159 5263154 -
tcattgttcaactcccacttat

SEQ ID NO: 137463 - DNA, 22 bp, Artificial Sequence
  Synthetic oligonucleotide; CTC chr11 5263152 5263173 5263157 5263152 -
attgttcaactcccacttatga

SEQ ID NO: 137464 - DNA, 22 bp, Artificial Sequence
  Synthetic oligonucleotide; TTG chr11 5263148 5263169 5263153 5263148 -
ttcaactcccacttatgagtga

SEQ ID NO: 137465 - DNA, 22 bp, Artificial Sequence
  Synthetic oligonucleotide; TTC chr11 5263145 5263166 5263150 5263145 -
aactcccacttatgagtgagaa

SEQ ID NO: 137466 - DNA, 22 bp, Artificial Sequence
  Synthetic oligonucleotide; CTC chr11 5263140 5263161 5263145 5263140 -
ccacttatgagtgagaacgtgt

SEQ ID NO: 137467 - DNA, 22 bp, Artificial Sequence
  Synthetic oligonucleotide; CTT chr11 5263134 5263155 5263139 5263134 -
atgagtgagaacgtgtggtgtt

SEQ ID NO: 137468 - DNA, 22 bp, Artificial Sequence
  Synthetic oligonucleotide; TTA chr11 5263133 5263154 5263138 5263133 -
tgagtgagaacgtgtggtgttt

SEQ ID NO: 137469 - DNA, 22 bp, Artificial Sequence
  Synthetic oligonucleotide; TTT chr11 5263111 5263132 5263116 5263111 -
ggtttctctgttcctgtgttag

SEQ ID NO: 137470 - DNA, 22 bp, Artificial Sequence
  Synthetic oligonucleotide; TTG chr11 5263110 5263131 5263115 5263110 -
gtttctctgttcctgtgttagt

SEQ ID NO: 137471 - DNA, 22 bp, Artificial Sequence
  Synthetic oligonucleotide; TTT chr11 5263106 5263127 5263111 5263106 -
ctctgttcctgtgttagtttgc

SEQ ID NO: 137472 - DNA, 22 bp, Artificial Sequence
  Synthetic oligonucleotide; TTC chr11 5263105 5263126 5263110 5263105 -
tctgttcctgtgttagtttgct

SEQ ID NO: 137473 - DNA, 22 bp, Artificial Sequence
  Synthetic oligonucleotide; CTC chr11 5263103 5263124 5263108 5263103 -
tgttcctgtgttagtttgctca

SEQ ID NO: 137474 - DNA, 22 bp, Artificial Sequence
  Synthetic oligonucleotide; CTG chr11 5263101 5263122 5263106 5263101 -
ttcctgtgttagtttgctcaga

SEQ ID NO: 137475 - DNA, 22 bp, Artificial Sequence
  Synthetic oligonucleotide; TTC chr11 5263098 5263119 5263103 5263098 -
ctgtgttagtttgctcagaatg

SEQ ID NO: 137476 - DNA, 22 bp, Artificial Sequence
  Synthetic oligonucleotide; CTG chr11 5263095 5263116 5263100 5263095 -
tgttagtttgctcagaatgatg

SEQ ID NO: 137477 - DNA, 22 bp, Artificial Sequence
  Synthetic oligonucleotide; TTA chr11 5263090 5263111 5263095 5263090 -
gtttgctcagaatgatggtttc

SEQ ID NO: 137478 - DNA, 22 bp, Artificial Sequence
  Synthetic oligonucleotide; TTT chr11 5263086 5263107 5263091 5263086 -
gctcagaatgatggtttccacc

SEQ ID NO: 137479 - DNA, 22 bp, Artificial Sequence
  Synthetic oligonucleotide; TTG chr11 5263085 5263106 5263090 5263085 -
ctcagaatgatggtttccacct

SEQ ID NO: 137480 - DNA, 22 bp, Artificial Sequence
  Synthetic oligonucleotide; CTC chr11 5263082 5263103 5263087 5263082 -
agaatgatggtttccaccttca

SEQ ID NO: 137481 - DNA, 22 bp, Artificial Sequence
  Synthetic oligonucleotide; TTT chr11 5263069 5263090 5263074 5263069 -
ccaccttcatccatgtccctgc

SEQ ID NO: 137482 - DNA, 22 bp, Artificial Sequence
  Synthetic oligonucleotide; TTC chr11 5263068 5263089 5263073 5263068 -
caccttcatccatgtccctgca

SEQ ID NO: 137483 - DNA, 22 bp, Artificial Sequence
  Synthetic oligonucleotide; CTT chr11 5263062 5263083 5263067 5263062 -
catccatgtccctgcaaagaca

SEQ ID NO: 137484 - DNA, 22 bp, Artificial Sequence
  Synthetic oligonucleotide; TTC chr11 5263061 5263082 5263066 5263061 -
atccatgtccctgcaaagacat

SEQ ID NO: 137485 - DNA, 22 bp, Artificial Sequence
  Synthetic oligonucleotide; CTG chr11 5263048 5263069 5263053 5263048 -
caaagacatgaactcatcattt

SEQ ID NO: 137486 - DNA, 22 bp, Artificial Sequence
  Synthetic oligonucleotide; CTC chr11 5263033 5263054 5263038 5263033 -
atcatttttatggctgcatagt

SEQ ID NO: 137487 - DNA, 22 bp, Artificial Sequence
  Synthetic oligonucleotide; TTT chr11 5263026 5263047 5263031 5263026 -
ttatggctgcatagtattccat

SEQ ID NO: 137488 - DNA, 22 bp, Artificial Sequence
  Synthetic oligonucleotide; TTT chr11 5263025 5263046 5263030 5263025 -
tatggctgcatagtattccatg

SEQ ID NO: 137489 - DNA, 22 bp, Artificial Sequence
  Synthetic oligonucleotide; TTT chr11 5263024 5263045 5263029 5263024 -
atggctgcatagtattccatgg

SEQ ID NO: 137490 - DNA, 22 bp, Artificial Sequence
  Synthetic oligonucleotide; TTA chr11 5263023 5263044 5263028 5263023 -
tggctgcatagtattccatggt

SEQ ID NO: 137491 - DNA, 22 bp, Artificial Sequence
  Synthetic oligonucleotide; CTG chr11 5263017 5263038 5263022 5263017 -
catagtattccatggtgtatat

SEQ ID NO: 137492 - DNA, 22 bp, Artificial Sequence
  Synthetic oligonucleotide; TTC chr11 5263007 5263028 5263012 5263007 -
catggtgtatatgtgccacatt

SEQ ID NO: 137493 - DNA, 22 bp, Artificial Sequence
  Synthetic oligonucleotide; TTT chr11 5262984 5263005 5262989 5262984 -
tctttatccattatatcgctga

SEQ ID NO: 137494 - DNA, 22 bp, Artificial Sequence
  Synthetic oligonucleotide; TTT chr11 5262983 5263004 5262988 5262983 -
ctttatccattatatcgctgat

SEQ ID NO: 137495 - DNA, 22 bp, Artificial Sequence
  Synthetic oligonucleotide; TTC chr11 5262982 5263003 5262987 5262982 -
tttatccattatatcgctgatg

SEQ ID NO: 137496 - DNA, 22 bp, Artificial Sequence
  Synthetic oligonucleotide; CTT chr11 5262980 5263001 5262985 5262980 -
tatccattatatcgctgatggc

SEQ ID NO: 137497 - DNA, 22 bp, Artificial Sequence
  Synthetic oligonucleotide; TTT chr11 5262979 5263000 5262984 5262979 -
atccattatatcgctgatggcc

SEQ ID NO: 137498 - DNA, 22 bp, Artificial Sequence
  Synthetic oligonucleotide; TTA chr11 5262978 5262999 5262983 5262978 -
tccattatatcgctgatggcca

SEQ ID NO: 137499 - DNA, 22 bp, Artificial Sequence
  Synthetic oligonucleotide; TTA chr11 5262971 5262992 5262976 5262971 -
tatcgctgatggccatttgggt

SEQ ID NO: 137500 - DNA, 22 bp, Artificial Sequence
  Synthetic oligonucleotide; CTG chr11 5262963 5262984 5262968 5262963 -
atggccatttgggttggttcca

SEQ ID NO: 137501 - DNA, 22 bp, Artificial Sequence
  Synthetic oligonucleotide; TTT chr11 5262953 5262974 5262958 5262953 -
gggttggttccaagtctttgct

SEQ ID NO: 137502 - DNA, 22 bp, Artificial Sequence
  Synthetic oligonucleotide; TTG chr11 5262952 5262973 5262957 5262952 -
ggttggttccaagtctttgcta

SEQ ID NO: 137503 - DNA, 22 bp, Artificial Sequence
  Synthetic oligonucleotide; TTG chr11 5262947 5262968 5262952 5262947 -
gttccaagtctttgctattgtg

SEQ ID NO: 137504 - DNA, 22 bp, Artificial Sequence
  Synthetic oligonucleotide; TTC chr11 5262943 5262964 5262948 5262943 -
caagtctttgctattgtgaata

SEQ ID NO: 137505 - DNA, 22 bp, Artificial Sequence
  Synthetic oligonucleotide; CTT chr11 5262935 5262956 5262940 5262935 -
tgctattgtgaatagtgccaca

SEQ ID NO: 137506 - DNA, 22 bp, Artificial Sequence
  Synthetic oligonucleotide; TTT chr11 5262934 5262955 5262939 5262934 -
gctattgtgaatagtgccacaa

SEQ ID NO: 137507 - DNA, 22 bp, Artificial Sequence
  Synthetic oligonucleotide; TTG chr11 5262933 5262954 5262938 5262933 -
ctattgtgaatagtgccacaat

SEQ ID NO: 137508 - DNA, 22 bp, Artificial Sequence
  Synthetic oligonucleotide; CTA chr11 5262930 5262951 5262935 5262930 -
ttgtgaatagtgccacaataaa

SEQ ID NO: 137509 - DNA, 22 bp, Artificial Sequence
  Synthetic oligonucleotide; TTG chr11 5262927 5262948 5262932 5262927 -
tgaatagtgccacaataaacat

SEQ ID NO: 137510 - DNA, 22 bp, Artificial Sequence
  Synthetic oligonucleotide; CTT chr11 5262888 5262909 5262893 5262888 -
tatagtagaatgatttctaatt

SEQ ID NO: 137511 - DNA, 22 bp, Artificial Sequence
  Synthetic oligonucleotide; TTT chr11 5262887 5262908 5262892 5262887 -
atagtagaatgatttctaattc

SEQ ID NO: 137512 - DNA, 22 bp, Artificial Sequence
  Synthetic oligonucleotide; TTA chr11 5262886 5262907 5262891 5262886 -
tagtagaatgatttctaattct

SEQ ID NO: 137513 - DNA, 22 bp, Artificial Sequence
  Synthetic oligonucleotide; TTT chr11 5262872 5262893 5262877 5262872 -
ctaattctttgggtatataccc

SEQ ID NO: 137514 - DNA, 22 bp, Artificial Sequence
  Synthetic oligonucleotide; TTC chr11 5262871 5262892 5262876 5262871 -
taattctttgggtatataccca

SEQ ID NO: 137515 - DNA, 22 bp, Artificial Sequence
  Synthetic oligonucleotide; CTA chr11 5262869 5262890 5262874 5262869 -
attctttgggtatatacccagt

SEQ ID NO: 137516 - DNA, 22 bp, Artificial Sequence
  Synthetic oligonucleotide; TTC chr11 5262865 5262886 5262870 5262865 -
tttgggtatatacccagtaatg

SEQ ID NO: 137517 - DNA, 22 bp, Artificial Sequence
  Synthetic oligonucleotide; CTT chr11 5262863 5262884 5262868 5262863 -
tgggtatatacccagtaatggg

SEQ ID NO: 137518 - DNA, 22 bp, Artificial Sequence
  Synthetic oligonucleotide; TTT chr11 5262862 5262883 5262867 5262862 -
gggtatatacccagtaatggga

SEQ ID NO: 137519 - DNA, 22 bp, Artificial Sequence
  Synthetic oligonucleotide; TTG chr11 5262861 5262882 5262866 5262861 -
ggtatatacccagtaatgggat

SEQ ID NO: 137520 - DNA, 22 bp, Artificial Sequence
  Synthetic oligonucleotide; TTG chr11 5262837 5262858 5262842 5262837 -
ctgggtcaaacagtatttctgg

SEQ ID NO: 137521 - DNA, 22 bp, Artificial Sequence
  Synthetic oligonucleotide; CTG chr11 5262834 5262855 5262839 5262834 -
ggtcaaacagtatttctggttc

SEQ ID NO: 137522 - DNA, 22 bp, Artificial Sequence
  Synthetic oligonucleotide; TTT chr11 5262819 5262840 5262824 5262819 -
ctggttctagatccttgaggaa

SEQ ID NO: 137523 - DNA, 22 bp, Artificial Sequence
  Synthetic oligonucleotide; TTC chr11 5262818 5262839 5262823 5262818 -
tggttctagatccttgaggaat

SEQ ID NO: 137524 - DNA, 22 bp, Artificial Sequence
  Synthetic oligonucleotide; CTG chr11 5262816 5262837 5262821 5262816 -
gttctagatccttgaggaatcg

SEQ ID NO: 137525 - DNA, 22 bp, Artificial Sequence
  Synthetic oligonucleotide; TTC chr11 5262812 5262833 5262817 5262812 -
tagatccttgaggaatcgccac

SEQ ID NO: 137526 - DNA, 22 bp, Artificial Sequence
  Synthetic oligonucleotide; CTA chr11 5262810 5262831 5262815 5262810 -
gatccttgaggaatcgccacac

SEQ ID NO: 137527 - DNA, 22 bp, Artificial Sequence
  Synthetic oligonucleotide; CTT chr11 5262803 5262824 5262808 5262803 -
gaggaatcgccacactgtcttc

SEQ ID NO: 137528 - DNA, 22 bp, Artificial Sequence
  Synthetic oligonucleotide; TTG chr11 5262802 5262823 5262807 5262802 -
aggaatcgccacactgtcttcc

SEQ ID NO: 137529 - DNA, 22 bp, Artificial Sequence
  Synthetic oligonucleotide; CTG chr11 5262786 5262807 5262791 5262786 -
tcttccacaatggttgaactaa

SEQ ID NO: 137530 - DNA, 22 bp, Artificial Sequence
  Synthetic oligonucleotide; CTT chr11 5262782 5262803 5262787 5262782 -
ccacaatggttgaactaattta

SEQ ID NO: 137531 - DNA, 22 bp, Artificial Sequence
  Synthetic oligonucleotide; TTC chr11 5262781 5262802 5262786 5262781 -
cacaatggttgaactaatttac

SEQ ID NO: 137532 - DNA, 22 bp, Artificial Sequence
  Synthetic oligonucleotide; TTG chr11 5262770 5262791 5262775 5262770 -
aactaatttacacacccatcaa

SEQ ID NO: 137533 - DNA, 22 bp, Artificial Sequence
  Synthetic oligonucleotide; CTA chr11 5262765 5262786 5262770 5262765 -
atttacacacccatcaacagtg

SEQ ID NO: 137534 - DNA, 22 bp, Artificial Sequence
  Synthetic oligonucleotide; TTT chr11 5262761 5262782 5262766 5262761 -
acacacccatcaacagtgtaaa

SEQ ID NO: 137535 - DNA, 22 bp, Artificial Sequence
  Synthetic oligonucleotide; TTA chr11 5262760 5262781 5262765 5262760 -
cacacccatcaacagtgtaaaa

SEQ ID NO: 137536 - DNA, 22 bp, Artificial Sequence
  Synthetic oligonucleotide; TTT chr11 5262735 5262756 5262740 5262735 -
ttcctattcttccacatcctct

SEQ ID NO: 137537 - DNA, 22 bp, Artificial Sequence
  Synthetic oligonucleotide; TTT chr11 5262734 5262755 5262739 5262734 -
tcctattcttccacatcctctc

SEQ ID NO: 137538 - DNA, 22 bp, Artificial Sequence
  Synthetic oligonucleotide; TTT chr11 5262733 5262754 5262738 5262733 -
cctattcttccacatcctctcc

SEQ ID NO: 137539 - DNA, 22 bp, Artificial Sequence
  Synthetic oligonucleotide; TTC chr11 5262732 5262753 5262737 5262732 -
ctattcttccacatcctctcca

SEQ ID NO: 137540 - DNA, 22 bp, Artificial Sequence
  Synthetic oligonucleotide; CTA chr11 5262729 5262750 5262734 5262729 -
ttcttccacatcctctccagca

SEQ ID NO: 137541 - DNA, 22 bp, Artificial Sequence
  Synthetic oligonucleotide; TTC chr11 5262726 5262747 5262731 5262726 -
ttccacatcctctccagcacct

SEQ ID NO: 137542 - DNA, 22 bp, Artificial Sequence
  Synthetic oligonucleotide; CTT chr11 5262724 5262745 5262729 5262724 -
ccacatcctctccagcaccttt

SEQ ID NO: 137543 - DNA, 22 bp, Artificial Sequence
  Synthetic oligonucleotide; TTC chr11 5262723 5262744 5262728 5262723 -
cacatcctctccagcacctttt

SEQ ID NO: 137544 - DNA, 22 bp, Artificial Sequence
  Synthetic oligonucleotide; CTC chr11 5262714 5262735 5262719 5262714 -
tccagcaccttttgtttcctga

SEQ ID NO: 137545 - DNA, 22 bp, Artificial Sequence
  Synthetic oligonucleotide; CTC chr11 5262712 5262733 5262717 5262712 -
cagcaccttttgtttcctgact

SEQ ID NO: 137546 - DNA, 22 bp, Artificial Sequence
  Synthetic oligonucleotide; CTT chr11 5262703 5262724 5262708 5262703 -
ttgtttcctgactttttaataa

SEQ ID NO: 137547 - DNA, 22 bp, Artificial Sequence
  Synthetic oligonucleotide; TTT chr11 5262702 5262723 5262707 5262702 -
tgtttcctgactttttaataat

SEQ ID NO: 137548 - DNA, 22 bp, Artificial Sequence
  Synthetic oligonucleotide; TTT chr11 5262701 5262722 5262706 5262701 -
gtttcctgactttttaataatt

SEQ ID NO: 137549 - DNA, 22 bp, Artificial Sequence
  Synthetic oligonucleotide; TTG chr11 5262700 5262721 5262705 5262700 -
tttcctgactttttaataattg

SEQ ID NO: 137550 - DNA, 22 bp, Artificial Sequence
  Synthetic oligonucleotide; TTT chr11 5262697 5262718 5262702 5262697 -
cctgactttttaataattgcca

SEQ ID NO: 137551 - DNA, 22 bp, Artificial Sequence
  Synthetic oligonucleotide; TTC chr11 5262696 5262717 5262701 5262696 -
ctgactttttaataattgccat

SEQ ID NO: 137552 - DNA, 22 bp, Artificial Sequence
  Synthetic oligonucleotide; CTG chr11 5262693 5262714 5262698 5262693 -
actttttaataattgccattct

SEQ ID NO: 137553 - DNA, 22 bp, Artificial Sequence
  Synthetic oligonucleotide; CTT chr11 5262689 5262710 5262694 5262689 -
tttaataattgccattctaact

SEQ ID NO: 137554 - DNA, 22 bp, Artificial Sequence
  Synthetic oligonucleotide; TTT chr11 5262688 5262709 5262693 5262688 -
ttaataattgccattctaactg

SEQ ID NO: 137555 - DNA, 22 bp, Artificial Sequence
  Synthetic oligonucleotide; TTT chr11 5262687 5262708 5262692 5262687 -
taataattgccattctaactgg

SEQ ID NO: 137556 - DNA, 22 bp, Artificial Sequence
  Synthetic oligonucleotide; TTT chr11 5262686 5262707 5262691 5262686 -
aataattgccattctaactggc

SEQ ID NO: 137557 - DNA, 22 bp, Artificial Sequence
  Synthetic oligonucleotide; TTA chr11 5262685 5262706 5262690 5262685 -
ataattgccattctaactggca

SEQ ID NO: 137558 - DNA, 22 bp, Artificial Sequence
  Synthetic oligonucleotide; TTG chr11 5262678 5262699 5262683 5262678 -
ccattctaactggcatgagatg

SEQ ID NO: 137559 - DNA, 22 bp, Artificial Sequence
  Synthetic oligonucleotide; TTC chr11 5262672 5262693 5262677 5262672 -
taactggcatgagatggtatct

SEQ ID NO: 137560 - DNA, 22 bp, Artificial Sequence
  Synthetic oligonucleotide; CTA chr11 5262670 5262691 5262675 5262670 -
actggcatgagatggtatctca

SEQ ID NO: 137561 - DNA, 22 bp, Artificial Sequence
  Synthetic oligonucleotide; CTG chr11 5262666 5262687 5262671 5262666 -
gcatgagatggtatctcattgt

SEQ ID NO: 137562 - DNA, 22 bp, Artificial Sequence
  Synthetic oligonucleotide; CTC chr11 5262649 5262670 5262654 5262649 -
attgtggttttgatttgcattt

SEQ ID NO: 137563 - DNA, 22 bp, Artificial Sequence
  Synthetic oligonucleotide; TTG chr11 5262645 5262666 5262650 5262645 -
tggttttgatttgcatttctct

SEQ ID NO: 137564 - DNA, 22 bp, Artificial Sequence
  Synthetic oligonucleotide; TTT chr11 5262639 5262660 5262644 5262639 -
tgatttgcatttctctaatgac

SEQ ID NO: 137565 - DNA, 22 bp, Artificial Sequence
  Synthetic oligonucleotide; TTT chr11 5262638 5262659 5262643 5262638 -
gatttgcatttctctaatgacc

SEQ ID NO: 137566 - DNA, 22 bp, Artificial Sequence
  Synthetic oligonucleotide; TTG chr11 5262637 5262658 5262642 5262637 -
atttgcatttctctaatgacca

SEQ ID NO: 137567 - DNA, 22 bp, Artificial Sequence
  Synthetic oligonucleotide; TTT chr11 5262633 5262654 5262638 5262633 -
gcatttctctaatgaccagtga

SEQ ID NO: 137568 - DNA, 22 bp, Artificial Sequence
  Synthetic oligonucleotide; TTG chr11 5262632 5262653 5262637 5262632 -
catttctctaatgaccagtgat

SEQ ID NO: 137569 - DNA, 22 bp, Artificial Sequence
  Synthetic oligonucleotide; TTT chr11 5262627 5262648 5262632 5262627 -
ctctaatgaccagtgatgatga

SEQ ID NO: 137570 - DNA, 22 bp, Artificial Sequence
  Synthetic oligonucleotide; TTC chr11 5262626 5262647 5262631 5262626 -
tctaatgaccagtgatgatgag

SEQ ID NO: 137571 - DNA, 22 bp, Artificial Sequence
  Synthetic oligonucleotide; CTC chr11 5262624 5262645 5262629 5262624 -
taatgaccagtgatgatgagct

SEQ ID NO: 137572 - DNA, 22 bp, Artificial Sequence
  Synthetic oligonucleotide; CTA chr11 5262622 5262643 5262627 5262622 -
atgaccagtgatgatgagcttc

SEQ ID NO: 137573 - DNA, 22 bp, Artificial Sequence
  Synthetic oligonucleotide; CTT chr11 5262601 5262622 5262606 5262601 -
cttttcatgtgtttcttggcca

SEQ ID NO: 137574 - DNA, 22 bp, Artificial Sequence
  Synthetic oligonucleotide; TTC chr11 5262600 5262621 5262605 5262600 -
ttttcatgtgtttcttggccac

SEQ ID NO: 137575 - DNA, 22 bp, Artificial Sequence
  Synthetic oligonucleotide; CTT chr11 5262598 5262619 5262603 5262598 -
ttcatgtgtttcttggccacat

SEQ ID NO: 137576 - DNA, 22 bp, Artificial Sequence
  Synthetic oligonucleotide; TTT chr11 5262597 5262618 5262602 5262597 -
tcatgtgtttcttggccacata

SEQ ID NO: 137577 - DNA, 22 bp, Artificial Sequence
  Synthetic oligonucleotide; TTT chr11 5262596 5262617 5262601 5262596 -
catgtgtttcttggccacataa

SEQ ID NO: 137578 - DNA, 22 bp, Artificial Sequence
  Synthetic oligonucleotide; TTC chr11 5262595 5262616 5262600 5262595 -
atgtgtttcttggccacataaa

SEQ ID NO: 137579 - DNA, 22 bp, Artificial Sequence
  Synthetic oligonucleotide; TTT chr11 5262587 5262608 5262592 5262587 -
cttggccacataaatgacttct

SEQ ID NO: 137580 - DNA, 22 bp, Artificial Sequence
  Synthetic oligonucleotide; TTC chr11 5262586 5262607 5262591 5262586 -
ttggccacataaatgacttctt

SEQ ID NO: 137581 - DNA, 22 bp, Artificial Sequence
  Synthetic oligonucleotide; CTT chr11 5262584 5262605 5262589 5262584 -
ggccacataaatgacttcttta

SEQ ID NO: 137582 - DNA, 22 bp, Artificial Sequence
  Synthetic oligonucleotide; TTG chr11 5262583 5262604 5262588 5262583 -
gccacataaatgacttctttag

SEQ ID NO: 137583 - DNA, 22 bp, Artificial Sequence
  Synthetic oligonucleotide; CTT chr11 5262567 5262588 5262572 5262567 -
ctttagagaagcatctgttcat

SEQ ID NO: 137584 - DNA, 22 bp, Artificial Sequence
  Synthetic oligonucleotide; TTC chr11 5262566 5262587 5262571 5262566 -
tttagagaagcatctgttcata

SEQ ID NO: 137585 - DNA, 22 bp, Artificial Sequence
  Synthetic oligonucleotide; CTT chr11 5262564 5262585 5262569 5262564 -
tagagaagcatctgttcatatc

SEQ ID NO: 137586 - DNA, 22 bp, Artificial Sequence
  Synthetic oligonucleotide; TTT chr11 5262563 5262584 5262568 5262563 -
agagaagcatctgttcatatcc

SEQ ID NO: 137587 - DNA, 22 bp, Artificial Sequence
  Synthetic oligonucleotide; TTA chr11 5262562 5262583 5262567 5262562 -
gagaagcatctgttcatatcct

SEQ ID NO: 137588 - DNA, 22 bp, Artificial Sequence
  Synthetic oligonucleotide; CTG chr11 5262550 5262571 5262555 5262550 -
ttcatatcctttgtccactttt

SEQ ID NO: 137589 - DNA, 22 bp, Artificial Sequence
  Synthetic oligonucleotide; TTC chr11 5262547 5262568 5262552 5262547 -
atatcctttgtccactttttga

SEQ ID NO: 137590 - DNA, 22 bp, Artificial Sequence
  Synthetic oligonucleotide; CTT chr11 5262539 5262560 5262544 5262539 -
tgtccactttttgatggggtcg

SEQ ID NO: 137591 - DNA, 22 bp, Artificial Sequence
  Synthetic oligonucleotide; TTT chr11 5262538 5262559 5262543 5262538 -
gtccactttttgatggggtcgt

SEQ ID NO: 137592 - DNA, 22 bp, Artificial Sequence
  Synthetic oligonucleotide; TTG chr11 5262537 5262558 5262542 5262537 -
tccactttttgatggggtcgtt

SEQ ID NO: 137593 - DNA, 22 bp, Artificial Sequence
  Synthetic oligonucleotide; CTT chr11 5262530 5262551 5262535 5262530 -
tttgatggggtcgttaggtttt

SEQ ID NO: 137594 - DNA, 22 bp, Artificial Sequence
  Synthetic oligonucleotide; TTT chr11 5262529 5262550 5262534 5262529 -
ttgatggggtcgttaggttttt

SEQ ID NO: 137595 - DNA, 22 bp, Artificial Sequence
  Synthetic oligonucleotide; TTT chr11 5262528 5262549 5262533 5262528 -
tgatggggtcgttaggtttttt

SEQ ID NO: 137596 - DNA, 22 bp, Artificial Sequence
  Synthetic oligonucleotide; TTT chr11 5262527 5262548 5262532 5262527 -
gatggggtcgttaggttttttc

SEQ ID NO: 137597 - DNA, 22 bp, Artificial Sequence
  Synthetic oligonucleotide; TTG chr11 5262526 5262547 5262531 5262526 -
atggggtcgttaggttttttct

SEQ ID NO: 137598 - DNA, 22 bp, Artificial Sequence
  Synthetic oligonucleotide; TTA chr11 5262514 5262535 5262519 5262514 -
ggttttttcttgtaaatttgtt

SEQ ID NO: 137599 - DNA, 22 bp, Artificial Sequence
  Synthetic oligonucleotide; TTT chr11 5262509 5262530 5262514 5262509 -
tttcttgtaaatttgttgaagt

SEQ ID NO: 137600 - DNA, 22 bp, Artificial Sequence
  Synthetic oligonucleotide; TTT chr11 5262508 5262529 5262513 5262508 -
ttcttgtaaatttgttgaagtt

SEQ ID NO: 137601 - DNA, 22 bp, Artificial Sequence
  Synthetic oligonucleotide; TTT chr11 5262507 5262528 5262512 5262507 -
tcttgtaaatttgttgaagttc

SEQ ID NO: 137602 - DNA, 22 bp, Artificial Sequence
  Synthetic oligonucleotide; TTT chr11 5262506 5262527 5262511 5262506 -
cttgtaaatttgttgaagttct

SEQ ID NO: 137603 - DNA, 22 bp, Artificial Sequence
  Synthetic oligonucleotide; TTC chr11 5262505 5262526 5262510 5262505 -
ttgtaaatttgttgaagttctt

SEQ ID NO: 137604 - DNA, 22 bp, Artificial Sequence
  Synthetic oligonucleotide; CTT chr11 5262503 5262524 5262508 5262503 -
gtaaatttgttgaagttctttg

SEQ ID NO: 137605 - DNA, 22 bp, Artificial Sequence
  Synthetic oligonucleotide; TTG chr11 5262502 5262523 5262507 5262502 -
taaatttgttgaagttctttgt

SEQ ID NO: 137606 - DNA, 22 bp, Artificial Sequence
  Synthetic oligonucleotide; TTT chr11 5262495 5262516 5262500 5262495 -
gttgaagttctttgtagatttt

SEQ ID NO: 137607 - DNA, 22 bp, Artificial Sequence
  Synthetic oligonucleotide; TTG chr11 5262494 5262515 5262499 5262494 -
ttgaagttctttgtagattttg

SEQ ID NO: 137608 - DNA, 22 bp, Artificial Sequence
  Synthetic oligonucleotide; TTG chr11 5262491 5262512 5262496 5262491 -
aagttctttgtagattttggat

SEQ ID NO: 137609 - DNA, 22 bp, Artificial Sequence
  Synthetic oligonucleotide; TTC chr11 5262485 5262506 5262490 5262485 -
tttgtagattttggatgttagc

SEQ ID NO: 137610 - DNA, 22 bp, Artificial Sequence
  Synthetic oligonucleotide; CTT chr11 5262483 5262504 5262488 5262483 -
tgtagattttggatgttagccc

SEQ ID NO: 137611 - DNA, 22 bp, Artificial Sequence
  Synthetic oligonucleotide; TTT chr11 5262482 5262503 5262487 5262482 -
gtagattttggatgttagccct

SEQ ID NO: 137612 - DNA, 22 bp, Artificial Sequence
  Synthetic oligonucleotide; TTG chr11 5262481 5262502 5262486 5262481 -
tagattttggatgttagccctt

SEQ ID NO: 137613 - DNA, 22 bp, Artificial Sequence
  Synthetic oligonucleotide; TTT chr11 5262474 5262495 5262479 5262474 -
tggatgttagccctttgtcaga

SEQ ID NO: 137614 - DNA, 22 bp, Artificial Sequence
  Synthetic oligonucleotide; TTT chr11 5262473 5262494 5262478 5262473 -
ggatgttagccctttgtcagat

SEQ ID NO: 137615 - DNA, 22 bp, Artificial Sequence
  Synthetic oligonucleotide; TTG chr11 5262472 5262493 5262477 5262472 -
gatgttagccctttgtcagatg

SEQ ID NO: 137616 - DNA, 22 bp, Artificial Sequence
  Synthetic oligonucleotide; TTA chr11 5262465 5262486 5262470 5262465 -
gccctttgtcagatggatagat

SEQ ID NO: 137617 - DNA, 22 bp, Artificial Sequence
  Synthetic oligonucleotide; CTT chr11 5262459 5262480 5262464 5262459 -
tgtcagatggatagattgcaaa

SEQ ID NO: 137618 - DNA, 22 bp, Artificial Sequence
  Synthetic oligonucleotide; TTT chr11 5262458 5262479 5262463 5262458 -
gtcagatggatagattgcaaaa

SEQ ID NO: 137619 - DNA, 22 bp, Artificial Sequence
  Synthetic oligonucleotide; TTG chr11 5262457 5262478 5262462 5262457 -
tcagatggatagattgcaaaaa

SEQ ID NO: 137620 - DNA, 22 bp, Artificial Sequence
  Synthetic oligonucleotide; TTG chr11 5262441 5262462 5262446 5262441 -
caaaaattttctcccattctgt

SEQ ID NO: 137621 - DNA, 22 bp, Artificial Sequence
  Synthetic oligonucleotide; TTT chr11 5262432 5262453 5262437 5262432 -
tctcccattctgtaggttgcct

SEQ ID NO: 137622 - DNA, 22 bp, Artificial Sequence
  Synthetic oligonucleotide; TTT chr11 5262431 5262452 5262436 5262431 -
ctcccattctgtaggttgcctg

SEQ ID NO: 137623 - DNA, 22 bp, Artificial Sequence
  Synthetic oligonucleotide; TTC chr11 5262430 5262451 5262435 5262430 -
tcccattctgtaggttgcctgt

SEQ ID NO: 137624 - DNA, 22 bp, Artificial Sequence
  Synthetic oligonucleotide; CTC chr11 5262428 5262449 5262433 5262428 -
ccattctgtaggttgcctgttc

SEQ ID NO: 137625 - DNA, 22 bp, Artificial Sequence
  Synthetic oligonucleotide; TTC chr11 5262422 5262443 5262427 5262422 -
tgtaggttgcctgttcactctg

SEQ ID NO: 137626 - DNA, 22 bp, Artificial Sequence
  Synthetic oligonucleotide; CTG chr11 5262420 5262441 5262425 5262420 -
taggttgcctgttcactctgat

SEQ ID NO: 137627 - DNA, 22 bp, Artificial Sequence
  Synthetic oligonucleotide; TTG chr11 5262413 5262434 5262418 5262413 -
cctgttcactctgatgatagtc

SEQ ID NO: 137628 - DNA, 22 bp, Artificial Sequence
  Synthetic oligonucleotide; CTG chr11 5262409 5262430 5262414 5262409 -
ttcactctgatgatagtctttt

SEQ ID NO: 137629 - DNA, 22 bp, Artificial Sequence
  Synthetic oligonucleotide; TTC chr11 5262406 5262427 5262411 5262406 -
actctgatgatagtcttttgct

SEQ ID NO: 137630 - DNA, 22 bp, Artificial Sequence
  Synthetic oligonucleotide; CTC chr11 5262402 5262423 5262407 5262402 -
tgatgatagtcttttgctgtgc

SEQ ID NO: 137631 - DNA, 22 bp, Artificial Sequence
  Synthetic oligonucleotide; CTG chr11 5262400 5262421 5262405 5262400 -
atgatagtcttttgctgtgcag

SEQ ID NO: 137632 - DNA, 22 bp, Artificial Sequence
  Synthetic oligonucleotide; CTT chr11 5262389 5262410 5262394 5262389 -
ttgctgtgcagaagctctttag

SEQ ID NO: 137633 - DNA, 22 bp, Artificial Sequence
  Synthetic oligonucleotide; TTT chr11 5262388 5262409 5262393 5262388 -
tgctgtgcagaagctctttagt

SEQ ID NO: 137634 - DNA, 22 bp, Artificial Sequence
  Synthetic oligonucleotide; TTT chr11 5262387 5262408 5262392 5262387 -
gctgtgcagaagctctttagtt

SEQ ID NO: 137635 - DNA, 22 bp, Artificial Sequence
  Synthetic oligonucleotide; TTG chr11 5262386 5262407 5262391 5262386 -
ctgtgcagaagctctttagttt

SEQ ID NO: 137636 - DNA, 22 bp, Artificial Sequence
  Synthetic oligonucleotide; CTG chr11 5262383 5262404 5262388 5262383 -
tgcagaagctctttagtttaat

SEQ ID NO: 137637 - DNA, 22 bp, Artificial Sequence
  Synthetic oligonucleotide; CTC chr11 5262372 5262393 5262377 5262372 -
tttagtttaattagatcccata

SEQ ID NO: 137638 - DNA, 22 bp, Artificial Sequence
  Synthetic oligonucleotide; CTT chr11 5262370 5262391 5262375 5262370 -
tagtttaattagatcccatatg

SEQ ID NO: 137639 - DNA, 22 bp, Artificial Sequence
  Synthetic oligonucleotide; TTT chr11 5262369 5262390 5262374 5262369 -
agtttaattagatcccatatgt

SEQ ID NO: 137640 - DNA, 22 bp, Artificial Sequence
  Synthetic oligonucleotide; TTA chr11 5262368 5262389 5262373 5262368 -
gtttaattagatcccatatgtc

SEQ ID NO: 137641 - DNA, 22 bp, Artificial Sequence
  Synthetic oligonucleotide; TTT chr11 5262364 5262385 5262369 5262364 -
aattagatcccatatgtcaatt

SEQ ID NO: 137642 - DNA, 22 bp, Artificial Sequence
  Synthetic oligonucleotide; TTA chr11 5262363 5262384 5262368 5262363 -
attagatcccatatgtcaattt

SEQ ID NO: 137643 - DNA, 22 bp, Artificial Sequence
  Synthetic oligonucleotide; TTA chr11 5262359 5262380 5262364 5262359 -
gatcccatatgtcaattttggc

SEQ ID NO: 137644 - DNA, 22 bp, Artificial Sequence
  Synthetic oligonucleotide; TTT chr11 5262341 5262362 5262346 5262341 -
tggcctttgttgtcattgcttt

SEQ ID NO: 137645 - DNA, 22 bp, Artificial Sequence
  Synthetic oligonucleotide; TTT chr11 5262340 5262361 5262345 5262340 -
ggcctttgttgtcattgctttt

SEQ ID NO: 137646 - DNA, 22 bp, Artificial Sequence
  Synthetic oligonucleotide; TTG chr11 5262339 5262360 5262344 5262339 -
gcctttgttgtcattgcttttg

SEQ ID NO: 137647 - DNA, 22 bp, Artificial Sequence
  Synthetic oligonucleotide; CTT chr11 5262334 5262355 5262339 5262334 -
tgttgtcattgcttttgatgtt

SEQ ID NO: 137648 - DNA, 22 bp, Artificial Sequence
  Synthetic oligonucleotide; TTT chr11 5262333 5262354 5262338 5262333 -
gttgtcattgcttttgatgttt

SEQ ID NO: 137649 - DNA, 22 bp, Artificial Sequence
  Synthetic oligonucleotide; TTG chr11 5262332 5262353 5262337 5262332 -
ttgtcattgcttttgatgtttt

SEQ ID NO: 137650 - DNA, 22 bp, Artificial Sequence
  Synthetic oligonucleotide; TTG chr11 5262329 5262350 5262334 5262329 -
tcattgcttttgatgttttagt

SEQ ID NO: 137651 - DNA, 22 bp, Artificial Sequence
  Synthetic oligonucleotide; TTG chr11 5262323 5262344 5262328 5262323 -
cttttgatgttttagtcgtgaa

SEQ ID NO: 137652 - DNA, 22 bp, Artificial Sequence
  Synthetic oligonucleotide; CTT chr11 5262320 5262341 5262325 5262320 -
ttgatgttttagtcgtgaattt

SEQ ID NO: 137653 - DNA, 22 bp, Artificial Sequence
  Synthetic oligonucleotide; TTT chr11 5262319 5262340 5262324 5262319 -
tgatgttttagtcgtgaatttt

SEQ ID NO: 137654 - DNA, 22 bp, Artificial Sequence
  Synthetic oligonucleotide; TTT chr11 5262318 5262339 5262323 5262318 -
gatgttttagtcgtgaattttt

SEQ ID NO: 137655 - DNA, 22 bp, Artificial Sequence
  Synthetic oligonucleotide; TTG chr11 5262317 5262338 5262322 5262317 -
atgttttagtcgtgaatttttg

SEQ ID NO: 137656 - DNA, 22 bp, Artificial Sequence
  Synthetic oligonucleotide; TTT chr11 5262311 5262332 5262316 5262311 -
tagtcgtgaatttttgcccatg

SEQ ID NO: 137657 - DNA, 22 bp, Artificial Sequence
  Synthetic oligonucleotide; TTT chr11 5262310 5262331 5262315 5262310 -
agtcgtgaatttttgcccatgc

SEQ ID NO: 137658 - DNA, 22 bp, Artificial Sequence
  Synthetic oligonucleotide; TTA chr11 5262309 5262330 5262314 5262309 -
gtcgtgaatttttgcccatgcc

SEQ ID NO: 137659 - DNA, 22 bp, Artificial Sequence
  Synthetic oligonucleotide; TTT chr11 5262298 5262319 5262303 5262298 -
ttgcccatgcctatgtcctgaa

SEQ ID NO: 137660 - DNA, 22 bp, Artificial Sequence
  Synthetic oligonucleotide; TTT chr11 5262297 5262318 5262302 5262297 -
tgcccatgcctatgtcctgaat

SEQ ID NO: 137661 - DNA, 22 bp, Artificial Sequence
  Synthetic oligonucleotide; TTT chr11 5262296 5262317 5262301 5262296 -
gcccatgcctatgtcctgaatg

SEQ ID NO: 137662 - DNA, 22 bp, Artificial Sequence
  Synthetic oligonucleotide; TTG chr11 5262295 5262316 5262300 5262295 -
cccatgcctatgtcctgaatgg

SEQ ID NO: 137663 - DNA, 22 bp, Artificial Sequence
  Synthetic oligonucleotide; CTA chr11 5262285 5262306 5262290 5262285 -
tgtcctgaatggtattgcctag

SEQ ID NO: 137664 - DNA, 22 bp, Artificial Sequence
  Synthetic oligonucleotide; CTG chr11 5262278 5262299 5262283 5262278 -
aatggtattgcctaggttatct

SEQ ID NO: 137665 - DNA, 22 bp, Artificial Sequence
  Synthetic oligonucleotide; TTG chr11 5262268 5262289 5262273 5262268 -
cctaggttatcttctaggattt

SEQ ID NO: 137666 - DNA, 22 bp, Artificial Sequence
  Synthetic oligonucleotide; CTA chr11 5262264 5262285 5262269 5262264 -
ggttatcttctaggatttttat

SEQ ID NO: 137667 - DNA, 22 bp, Artificial Sequence
  Synthetic oligonucleotide; TTA chr11 5262259 5262280 5262264 5262259 -
tcttctaggatttttatggttt

SEQ ID NO: 137668 - DNA, 22 bp, Artificial Sequence
  Synthetic oligonucleotide; CTT chr11 5262255 5262276 5262260 5262255 -
ctaggatttttatggttttagg

SEQ ID NO: 137669 - DNA, 22 bp, Artificial Sequence
  Synthetic oligonucleotide; TTC chr11 5262254 5262275 5262259 5262254 -
taggatttttatggttttaggt

SEQ ID NO: 137670 - DNA, 22 bp, Artificial Sequence
  Synthetic oligonucleotide; CTA chr11 5262252 5262273 5262257 5262252 -
ggatttttatggttttaggttg

SEQ ID NO: 137671 - DNA, 22 bp, Artificial Sequence
  Synthetic oligonucleotide; TTT chr11 5262246 5262267 5262251 5262246 -
ttatggttttaggttgcacatt

SEQ ID NO: 137672 - DNA, 22 bp, Artificial Sequence
  Synthetic oligonucleotide; TTT chr11 5262245 5262266 5262250 5262245 -
tatggttttaggttgcacattt

SEQ ID NO: 137673 - DNA, 22 bp, Artificial Sequence
  Synthetic oligonucleotide; TTT chr11 5262244 5262265 5262249 5262244 -
atggttttaggttgcacattta

SEQ ID NO: 137674 - DNA, 22 bp, Artificial Sequence
  Synthetic oligonucleotide; TTA chr11 5262243 5262264 5262248 5262243 -
tggttttaggttgcacatttaa

SEQ ID NO: 137675 - DNA, 22 bp, Artificial Sequence
  Synthetic oligonucleotide; TTT chr11 5262237 5262258 5262242 5262237 -
taggttgcacatttaagtcttt

SEQ ID NO: 137676 - DNA, 22 bp, Artificial Sequence
  Synthetic oligonucleotide; TTT chr11 5262236 5262257 5262241 5262236 -
aggttgcacatttaagtcttta

SEQ ID NO: 137677 - DNA, 22 bp, Artificial Sequence
  Synthetic oligonucleotide; TTA chr11 5262235 5262256 5262240 5262235 -
ggttgcacatttaagtctttaa

SEQ ID NO: 137678 - DNA, 22 bp, Artificial Sequence
  Synthetic oligonucleotide; TTG chr11 5262230 5262251 5262235 5262230 -
cacatttaagtctttaatccac

SEQ ID NO: 137679 - DNA, 22 bp, Artificial Sequence
  Synthetic oligonucleotide; TTT chr11 5262223 5262244 5262228 5262223 -
aagtctttaatccaccttgagt

SEQ ID NO: 137680 - DNA, 22 bp, Artificial Sequence
  Synthetic oligonucleotide; TTA chr11 5262222 5262243 5262227 5262222 -
agtctttaatccaccttgagtt

SEQ ID NO: 137681 - DNA, 22 bp, Artificial Sequence
  Synthetic oligonucleotide; CTT chr11 5262216 5262237 5262221 5262216 -
taatccaccttgagttaatttt

SEQ ID NO: 137682 - DNA, 22 bp, Artificial Sequence
  Synthetic oligonucleotide; TTT chr11 5262215 5262236 5262220 5262215 -
aatccaccttgagttaattttt

SEQ ID NO: 137683 - DNA, 22 bp, Artificial Sequence
  Synthetic oligonucleotide; TTA chr11 5262214 5262235 5262219 5262214 -
atccaccttgagttaatttttg

SEQ ID NO: 137684 - DNA, 22 bp, Artificial Sequence
  Synthetic oligonucleotide; CTT chr11 5262205 5262226 5262210 5262205 -
gagttaatttttgtataaggtg

SEQ ID NO: 137685 - DNA, 22 bp, Artificial Sequence
  Synthetic oligonucleotide; TTG chr11 5262204 5262225 5262209 5262204 -
agttaatttttgtataaggtgt

SEQ ID NO: 137686 - DNA, 22 bp, Artificial Sequence
  Synthetic oligonucleotide; TTA chr11 5262199 5262220 5262204 5262199 -
atttttgtataaggtgtaagga

SEQ ID NO: 137687 - DNA, 22 bp, Artificial Sequence
  Synthetic oligonucleotide; TTT chr11 5262195 5262216 5262200 5262195 -
ttgtataaggtgtaaggaaggg

SEQ ID NO: 137688 - DNA, 22 bp, Artificial Sequence
  Synthetic oligonucleotide; TTT chr11 5262194 5262215 5262199 5262194 -
tgtataaggtgtaaggaagggg

SEQ ID NO: 137689 - DNA, 22 bp, Artificial Sequence
  Synthetic oligonucleotide; TTT chr11 5262193 5262214 5262198 5262193 -
gtataaggtgtaaggaaggggt

SEQ ID NO: 137690 - DNA, 22 bp, Artificial Sequence
  Synthetic oligonucleotide; TTG chr11 5262192 5262213 5262197 5262192 -
tataaggtgtaaggaaggggta

SEQ ID NO: 137691 - DNA, 22 bp, Artificial Sequence
  Synthetic oligonucleotide; TTT chr11 5262164 5262185 5262169 5262164 -
cagttttatgcatattgctagc

SEQ ID NO: 137692 - DNA, 22 bp, Artificial Sequence
  Synthetic oligonucleotide; TTC chr11 5262163 5262184 5262168 5262163 -
agttttatgcatattgctagcc

SEQ ID NO: 137693 - DNA, 22 bp, Artificial Sequence
  Synthetic oligonucleotide; TTT chr11 5262158 5262179 5262163 5262158 -
tatgcatattgctagccagttt

SEQ ID NO: 137694 - DNA, 22 bp, Artificial Sequence
  Synthetic oligonucleotide; TTT chr11 5262157 5262178 5262162 5262157 -
atgcatattgctagccagtttt

SEQ ID NO: 137695 - DNA, 22 bp, Artificial Sequence
  Synthetic oligonucleotide; TTA chr11 5262156 5262177 5262161 5262156 -
tgcatattgctagccagttttt

SEQ ID NO: 137696 - DNA, 22 bp, Artificial Sequence
  Synthetic oligonucleotide; TTG chr11 5262147 5262168 5262152 5262147 -
ctagccagtttttccagcacca

SEQ ID NO: 137697 - DNA, 22 bp, Artificial Sequence
  Synthetic oligonucleotide; CTA chr11 5262144 5262165 5262149 5262144 -
gccagtttttccagcaccattt

SEQ ID NO: 137698 - DNA, 22 bp, Artificial Sequence
  Synthetic oligonucleotide; TTT chr11 5262136 5262157 5262141 5262136 -
ttccagcaccatttattaaata

SEQ ID NO: 137699 - DNA, 22 bp, Artificial Sequence
  Synthetic oligonucleotide; TTT chr11 5262135 5262156 5262140 5262135 -
tccagcaccatttattaaatag

SEQ ID NO: 137700 - DNA, 22 bp, Artificial Sequence
  Synthetic oligonucleotide; TTT chr11 5262134 5262155 5262139 5262134 -
ccagcaccatttattaaatagg

SEQ ID NO: 137701 - DNA, 22 bp, Artificial Sequence
  Synthetic oligonucleotide; TTC chr11 5262133 5262154 5262138 5262133 -
cagcaccatttattaaataggg

SEQ ID NO: 137702 - DNA, 22 bp, Artificial Sequence
  Synthetic oligonucleotide; TTT chr11 5262122 5262143 5262127 5262122 -
attaaatagggaattctttctc

SEQ ID NO: 137703 - DNA, 22 bp, Artificial Sequence
  Synthetic oligonucleotide; TTA chr11 5262121 5262142 5262126 5262121 -
ttaaatagggaattctttctcc

SEQ ID NO: 137704 - DNA, 22 bp, Artificial Sequence
  Synthetic oligonucleotide; TTA chr11 5262118 5262139 5262123 5262118 -
aatagggaattctttctccatt

SEQ ID NO: 137705 - DNA, 22 bp, Artificial Sequence
  Synthetic oligonucleotide; TTC chr11 5262106 5262127 5262111 5262106 -
tttctccattgcttttgtgatg

SEQ ID NO: 137706 - DNA, 22 bp, Artificial Sequence
  Synthetic oligonucleotide; CTT chr11 5262104 5262125 5262109 5262104 -
tctccattgcttttgtgatgtt

SEQ ID NO: 137707 - DNA, 22 bp, Artificial Sequence
  Synthetic oligonucleotide; TTT chr11 5262103 5262124 5262108 5262103 -
ctccattgcttttgtgatgttt

SEQ ID NO: 137708 - DNA, 22 bp, Artificial Sequence
  Synthetic oligonucleotide; TTC chr11 5262102 5262123 5262107 5262102 -
tccattgcttttgtgatgtttg

SEQ ID NO: 137709 - DNA, 22 bp, Artificial Sequence
  Synthetic oligonucleotide; CTC chr11 5262100 5262121 5262105 5262100 -
cattgcttttgtgatgtttgtc

SEQ ID NO: 137710 - DNA, 22 bp, Artificial Sequence
  Synthetic oligonucleotide; TTG chr11 5262095 5262116 5262100 5262095 -
cttttgtgatgtttgtcaaaga

SEQ ID NO: 137711 - DNA, 22 bp, Artificial Sequence
  Synthetic oligonucleotide; CTT chr11 5262092 5262113 5262097 5262092 -
ttgtgatgtttgtcaaagatca

SEQ ID NO: 137712 - DNA, 22 bp, Artificial Sequence
  Synthetic oligonucleotide; TTT chr11 5262091 5262112 5262096 5262091 -
tgtgatgtttgtcaaagatcag

SEQ ID NO: 137713 - DNA, 22 bp, Artificial Sequence
  Synthetic oligonucleotide; TTT chr11 5262090 5262111 5262095 5262090 -
gtgatgtttgtcaaagatcaga

SEQ ID NO: 137714 - DNA, 22 bp, Artificial Sequence
  Synthetic oligonucleotide; TTG chr11 5262089 5262110 5262094 5262089 -
tgatgtttgtcaaagatcagat

SEQ ID NO: 137715 - DNA, 22 bp, Artificial Sequence
  Synthetic oligonucleotide; TTT chr11 5262081 5262102 5262086 5262081 -
gtcaaagatcagatggtcgtag

SEQ ID NO: 137716 - DNA, 22 bp, Artificial Sequence
  Synthetic oligonucleotide; TTG chr11 5262080 5262101 5262085 5262080 -
tcaaagatcagatggtcgtaga

SEQ ID NO: 137717 - DNA, 22 bp, Artificial Sequence
  Synthetic oligonucleotide; TTA chr11 5262046 5262067 5262051 5262046 -
tttctgaggcttctgttctgtt

SEQ ID NO: 137718 - DNA, 22 bp, Artificial Sequence
  Synthetic oligonucleotide; TTT chr11 5262043 5262064 5262048 5262043 -
ctgaggcttctgttctgttcca

SEQ ID NO: 137719 - DNA, 22 bp, Artificial Sequence
  Synthetic oligonucleotide; TTC chr11 5262042 5262063 5262047 5262042 -
tgaggcttctgttctgttccac

SEQ ID NO: 137720 - DNA, 22 bp, Artificial Sequence
  Synthetic oligonucleotide; CTG chr11 5262040 5262061 5262045 5262040 -
aggcttctgttctgttccactg

SEQ ID NO: 137721 - DNA, 22 bp, Artificial Sequence
  Synthetic oligonucleotide; CTT chr11 5262034 5262055 5262039 5262034 -
ctgttctgttccactggtctat

SEQ ID NO: 137722 - DNA, 22 bp, Artificial Sequence
  Synthetic oligonucleotide; TTC chr11 5262033 5262054 5262038 5262033 -
tgttctgttccactggtctata

SEQ ID NO: 137723 - DNA, 22 bp, Artificial Sequence
  Synthetic oligonucleotide; CTG chr11 5262031 5262052 5262036 5262031 -
ttctgttccactggtctatata

SEQ ID NO: 137724 - DNA, 22 bp, Artificial Sequence
  Synthetic oligonucleotide; TTC chr11 5262028 5262049 5262033 5262028 -
tgttccactggtctatatatct

SEQ ID NO: 137725 - DNA, 22 bp, Artificial Sequence
  Synthetic oligonucleotide; CTG chr11 5262026 5262047 5262031 5262026 -
ttccactggtctatatatctgt

SEQ ID NO: 137726 - DNA, 22 bp, Artificial Sequence
  Synthetic oligonucleotide; TTC chr11 5262023 5262044 5262028 5262023 -
cactggtctatatatctgtttt

SEQ ID NO: 137727 - DNA, 22 bp, Artificial Sequence
  Synthetic oligonucleotide; CTG chr11 5262018 5262039 5262023 5262018 -
gtctatatatctgttttggtac

SEQ ID NO: 137728 - DNA, 22 bp, Artificial Sequence
  Synthetic oligonucleotide; CTA chr11 5262013 5262034 5262018 5262013 -
tatatctgttttggtaccagta

SEQ ID NO: 137729 - DNA, 22 bp, Artificial Sequence
  Synthetic oligonucleotide; CTG chr11 5262005 5262026 5262010 5262005 -
ttttggtaccagtaccatgctg

SEQ ID NO: 137730 - DNA, 22 bp, Artificial Sequence
  Synthetic oligonucleotide; TTT chr11 5262002 5262023 5262007 5262002 -
tggtaccagtaccatgctgttt

SEQ ID NO: 137731 - DNA, 22 bp, Artificial Sequence
  Synthetic oligonucleotide; TTT chr11 5262001 5262022 5262006 5262001 -
ggtaccagtaccatgctgtttt

SEQ ID NO: 137732 - DNA, 22 bp, Artificial Sequence
  Synthetic oligonucleotide; TTG chr11 5262000 5262021 5262005 5262000 -
gtaccagtaccatgctgttttt

SEQ ID NO: 137733 - DNA, 22 bp, Artificial Sequence
  Synthetic oligonucleotide; CTG chr11 5261983 5262004 5261988 5261983 -
tttttgttactgtagccttgta

SEQ ID NO: 137734 - DNA, 22 bp, Artificial Sequence
  Synthetic oligonucleotide; TTT chr11 5261980 5262001 5261985 5261980 -
ttgttactgtagccttgtagta

SEQ ID NO: 137735 - DNA, 22 bp, Artificial Sequence
  Synthetic oligonucleotide; TTT chr11 5261979 5262000 5261984 5261979 -
tgttactgtagccttgtagtat

SEQ ID NO: 137736 - DNA, 22 bp, Artificial Sequence
  Synthetic oligonucleotide; TTT chr11 5261978 5261999 5261983 5261978 -
gttactgtagccttgtagtata

SEQ ID NO: 137737 - DNA, 22 bp, Artificial Sequence
  Synthetic oligonucleotide; TTG chr11 5261977 5261998 5261982 5261977 -
ttactgtagccttgtagtatag

SEQ ID NO: 137738 - DNA, 22 bp, Artificial Sequence
  Synthetic oligonucleotide; TTA chr11 5261974 5261995 5261979 5261974 -
ctgtagccttgtagtatagttt

SEQ ID NO: 137739 - DNA, 22 bp, Artificial Sequence
  Synthetic oligonucleotide; CTG chr11 5261971 5261992 5261976 5261971 -
tagccttgtagtatagtttgaa

SEQ ID NO: 137740 - DNA, 22 bp, Artificial Sequence
  Synthetic oligonucleotide; CTT chr11 5261964 5261985 5261969 5261964 -
gtagtatagtttgaagtcaggt

SEQ ID NO: 137741 - DNA, 22 bp, Artificial Sequence
  Synthetic oligonucleotide; TTG chr11 5261963 5261984 5261968 5261963 -
tagtatagtttgaagtcaggta

SEQ ID NO: 137742 - DNA, 22 bp, Artificial Sequence
  Synthetic oligonucleotide; TTT chr11 5261952 5261973 5261957 5261952 -
gaagtcaggtagcatcatgcct

SEQ ID NO: 137743 - DNA, 22 bp, Artificial Sequence
  Synthetic oligonucleotide; TTG chr11 5261951 5261972 5261956 5261951 -
aagtcaggtagcatcatgcctc

SEQ ID NO: 137744 - DNA, 22 bp, Artificial Sequence
  Synthetic oligonucleotide; CTC chr11 5261929 5261950 5261934 5261929 -
cagctttgttctttttgtttag

SEQ ID NO: 137745 - DNA, 22 bp, Artificial Sequence
  Synthetic oligonucleotide; CTT chr11 5261923 5261944 5261928 5261923 -
tgttctttttgtttaggattgt

SEQ ID NO: 137746 - DNA, 22 bp, Artificial Sequence
  Synthetic oligonucleotide; TTT chr11 5261922 5261943 5261927 5261922 -
gttctttttgtttaggattgtc

SEQ ID NO: 137747 - DNA, 22 bp, Artificial Sequence
  Synthetic oligonucleotide; TTG chr11 5261921 5261942 5261926 5261921 -
ttctttttgtttaggattgtct

SEQ ID NO: 137748 - DNA, 22 bp, Artificial Sequence
  Synthetic oligonucleotide; TTC chr11 5261918 5261939 5261923 5261918 -
tttttgtttaggattgtcttgg

SEQ ID NO: 137749 - DNA, 22 bp, Artificial Sequence
  Synthetic oligonucleotide; CTT chr11 5261916 5261937 5261921 5261916 -
tttgtttaggattgtcttggct

SEQ ID NO: 137750 - DNA, 22 bp, Artificial Sequence
  Synthetic oligonucleotide; TTT chr11 5261915 5261936 5261920 5261915 -
ttgtttaggattgtcttggcta

SEQ ID NO: 137751 - DNA, 22 bp, Artificial Sequence
  Synthetic oligonucleotide; TTT chr11 5261914 5261935 5261919 5261914 -
tgtttaggattgtcttggctat

SEQ ID NO: 137752 - DNA, 22 bp, Artificial Sequence
  Synthetic oligonucleotide; TTT chr11 5261913 5261934 5261918 5261913 -
gtttaggattgtcttggctata

SEQ ID NO: 137753 - DNA, 22 bp, Artificial Sequence
  Synthetic oligonucleotide; TTG chr11 5261912 5261933 5261917 5261912 -
tttaggattgtcttggctatat

SEQ ID NO: 137754 - DNA, 22 bp, Artificial Sequence
  Synthetic oligonucleotide; TTT chr11 5261909 5261930 5261914 5261909 -
aggattgtcttggctatatggg

SEQ ID NO: 137755 - DNA, 22 bp, Artificial Sequence
  Synthetic oligonucleotide; TTA chr11 5261908 5261929 5261913 5261908 -
ggattgtcttggctatatgggc

SEQ ID NO: 137756 - DNA, 22 bp, Artificial Sequence
  Synthetic oligonucleotide; TTG chr11 5261902 5261923 5261907 5261902 -
tcttggctatatgggctctttt

SEQ ID NO: 137757 - DNA, 22 bp, Artificial Sequence
  Synthetic oligonucleotide; CTT chr11 5261898 5261919 5261903 5261898 -
ggctatatgggctcttttttga

SEQ ID NO: 137758 - DNA, 22 bp, Artificial Sequence
  Synthetic oligonucleotide; TTG chr11 5261897 5261918 5261902 5261897 -
gctatatgggctcttttttgat

SEQ ID NO: 137759 - DNA, 22 bp, Artificial Sequence
  Synthetic oligonucleotide; CTA chr11 5261893 5261914 5261898 5261893 -
tatgggctcttttttgattcca

SEQ ID NO: 137760 - DNA, 22 bp, Artificial Sequence
  Synthetic oligonucleotide; CTC chr11 5261884 5261905 5261889 5261884 -
ttttttgattccatatgacatt

SEQ ID NO: 137761 - DNA, 22 bp, Artificial Sequence
  Synthetic oligonucleotide; CTT chr11 5261882 5261903 5261887 5261882 -
ttttgattccatatgacattta

SEQ ID NO: 137762 - DNA, 22 bp, Artificial Sequence
  Synthetic oligonucleotide; TTT chr11 5261881 5261902 5261886 5261881 -
tttgattccatatgacatttaa

SEQ ID NO: 137763 - DNA, 22 bp, Artificial Sequence
  Synthetic oligonucleotide; TTT chr11 5261880 5261901 5261885 5261880 -
ttgattccatatgacatttaaa

SEQ ID NO: 137764 - DNA, 22 bp, Artificial Sequence
  Synthetic oligonucleotide; TTT chr11 5261879 5261900 5261884 5261879 -
tgattccatatgacatttaaag

SEQ ID NO: 137765 - DNA, 22 bp, Artificial Sequence
  Synthetic oligonucleotide; TTT chr11 5261878 5261899 5261883 5261878 -
gattccatatgacatttaaagt

SEQ ID NO: 137766 - DNA, 22 bp, Artificial Sequence
  Synthetic oligonucleotide; TTG chr11 5261877 5261898 5261882 5261877 -
attccatatgacatttaaagta

SEQ ID NO: 137767 - DNA, 22 bp, Artificial Sequence
  Synthetic oligonucleotide; TTC chr11 5261873 5261894 5261878 5261873 -
catatgacatttaaagtagttt

SEQ ID NO: 137768 - DNA, 22 bp, Artificial Sequence
  Synthetic oligonucleotide; TTT chr11 5261861 5261882 5261866 5261861 -
aaagtagttttttctaattctt

SEQ ID NO: 137769 - DNA, 22 bp, Artificial Sequence
  Synthetic oligonucleotide; TTA chr11 5261860 5261881 5261865 5261860 -
aagtagttttttctaattcttt

SEQ ID NO: 137770 - DNA, 22 bp, Artificial Sequence
  Synthetic oligonucleotide; TTT chr11 5261851 5261872 5261856 5261851 -
tttctaattctttgaaaaaagt

SEQ ID NO: 137771 - DNA, 22 bp, Artificial Sequence
  Synthetic oligonucleotide; TTT chr11 5261850 5261871 5261855 5261850 -
ttctaattctttgaaaaaagtc

SEQ ID NO: 137772 - DNA, 22 bp, Artificial Sequence
  Synthetic oligonucleotide; TTT chr11 5261849 5261870 5261854 5261849 -
tctaattctttgaaaaaagtca

SEQ ID NO: 137773 - DNA, 22 bp, Artificial Sequence
  Synthetic oligonucleotide; TTT chr11 5261848 5261869 5261853 5261848 -
ctaattctttgaaaaaagtcag

SEQ ID NO: 137774 - DNA, 22 bp, Artificial Sequence
  Synthetic oligonucleotide; TTC chr11 5261847 5261868 5261852 5261847 -
taattctttgaaaaaagtcagt

SEQ ID NO: 137775 - DNA, 22 bp, Artificial Sequence
  Synthetic oligonucleotide; CTA chr11 5261845 5261866 5261850 5261845 -
attctttgaaaaaagtcagtgg

SEQ ID NO: 137776 - DNA, 22 bp, Artificial Sequence
  Synthetic oligonucleotide; TTC chr11 5261841 5261862 5261846 5261841 -
tttgaaaaaagtcagtggtagc

SEQ ID NO: 137777 - DNA, 22 bp, Artificial Sequence
  Synthetic oligonucleotide; CTT chr11 5261839 5261860 5261844 5261839 -
tgaaaaaagtcagtggtagctt

SEQ ID NO: 137778 - DNA, 22 bp, Artificial Sequence
  Synthetic oligonucleotide; TTT chr11 5261838 5261859 5261843 5261838 -
gaaaaaagtcagtggtagcttg

SEQ ID NO: 137779 - DNA, 22 bp, Artificial Sequence
  Synthetic oligonucleotide; TTG chr11 5261837 5261858 5261842 5261837 -
aaaaaagtcagtggtagcttga

SEQ ID NO: 137780 - DNA, 22 bp, Artificial Sequence
  Synthetic oligonucleotide; CTT chr11 5261817 5261838 5261822 5261817 -
gatggggatagcattgaatcta

SEQ ID NO: 137781 - DNA, 22 bp, Artificial Sequence
  Synthetic oligonucleotide; TTG chr11 5261816 5261837 5261821 5261816 -
atggggatagcattgaatctat

SEQ ID NO: 137782 - DNA, 22 bp, Artificial Sequence
  Synthetic oligonucleotide; TTG chr11 5261801 5261822 5261806 5261801 -
aatctataaattactttgggca

SEQ ID NO: 137783 - DNA, 22 bp, Artificial Sequence
  Synthetic oligonucleotide; CTA chr11 5261795 5261816 5261800 5261795 -
taaattactttgggcagtatgg

SEQ ID NO: 137784 - DNA, 22 bp, Artificial Sequence
  Synthetic oligonucleotide; TTA chr11 5261788 5261809 5261793 5261788 -
ctttgggcagtatggccatttt

SEQ ID NO: 137785 - DNA, 22 bp, Artificial Sequence
  Synthetic oligonucleotide; CTT chr11 5261785 5261806 5261790 5261785 -
tgggcagtatggccattttaaa

SEQ ID NO: 137786 - DNA, 22 bp, Artificial Sequence
  Synthetic oligonucleotide; TTT chr11 5261784 5261805 5261789 5261784 -
gggcagtatggccattttaaag

SEQ ID NO: 137787 - DNA, 22 bp, Artificial Sequence
  Synthetic oligonucleotide; TTG chr11 5261783 5261804 5261788 5261783 -
ggcagtatggccattttaaaga

SEQ ID NO: 137788 - DNA, 22 bp, Artificial Sequence
  Synthetic oligonucleotide; TTT chr11 5261767 5261788 5261772 5261767 -
taaagatattgattctttctat

SEQ ID NO: 137789 - DNA, 22 bp, Artificial Sequence
  Synthetic oligonucleotide; TTT chr11 5261766 5261787 5261771 5261766 -
aaagatattgattctttctatc

SEQ ID NO: 137790 - DNA, 22 bp, Artificial Sequence
  Synthetic oligonucleotide; TTA chr11 5261765 5261786 5261770 5261765 -
aagatattgattctttctatct

SEQ ID NO: 137791 - DNA, 22 bp, Artificial Sequence
  Synthetic oligonucleotide; TTG chr11 5261756 5261777 5261761 5261756 -
attctttctatctatgagcatg

SEQ ID NO: 137792 - DNA, 22 bp, Artificial Sequence
  Synthetic oligonucleotide; TTC chr11 5261752 5261773 5261757 5261752 -
tttctatctatgagcatggaat

SEQ ID NO: 137793 - DNA, 22 bp, Artificial Sequence
  Synthetic oligonucleotide; CTT chr11 5261750 5261771 5261755 5261750 -
tctatctatgagcatggaatgt

SEQ ID NO: 137794 - DNA, 22 bp, Artificial Sequence
  Synthetic oligonucleotide; TTT chr11 5261749 5261770 5261754 5261749 -
ctatctatgagcatggaatgtt

SEQ ID NO: 137795 - DNA, 22 bp, Artificial Sequence
  Synthetic oligonucleotide; TTC chr11 5261748 5261769 5261753 5261748 -
tatctatgagcatggaatgttt

SEQ ID NO: 137796 - DNA, 22 bp, Artificial Sequence
  Synthetic oligonucleotide; CTA chr11 5261746 5261767 5261751 5261746 -
tctatgagcatggaatgttttt

SEQ ID NO: 137797 - DNA, 22 bp, Artificial Sequence
  Synthetic oligonucleotide; CTA chr11 5261742 5261763 5261747 5261742 -
tgagcatggaatgtttttccat

SEQ ID NO: 137798 - DNA, 22 bp, Artificial Sequence
  Synthetic oligonucleotide; TTT chr11 5261726 5261747 5261731 5261726 -
ttccatttgtttgtgtcctctc

SEQ ID NO: 137799 - DNA, 22 bp, Artificial Sequence
  Synthetic oligonucleotide; TTT chr11 5261725 5261746 5261730 5261725 -
tccatttgtttgtgtcctctct

SEQ ID NO: 137800 - DNA, 22 bp, Artificial Sequence
  Synthetic oligonucleotide; TTT chr11 5261724 5261745 5261729 5261724 -
ccatttgtttgtgtcctctctt

SEQ ID NO: 137801 - DNA, 22 bp, Artificial Sequence
  Synthetic oligonucleotide; TTC chr11 5261723 5261744 5261728 5261723 -
catttgtttgtgtcctctctta

SEQ ID NO: 137802 - DNA, 22 bp, Artificial Sequence
  Synthetic oligonucleotide; TTT chr11 5261718 5261739 5261723 5261718 -
gtttgtgtcctctcttatttcc

SEQ ID NO: 137803 - DNA, 22 bp, Artificial Sequence
  Synthetic oligonucleotide; TTG chr11 5261717 5261738 5261722 5261717 -
tttgtgtcctctcttatttcct

SEQ ID NO: 137804 - DNA, 22 bp, Artificial Sequence
  Synthetic oligonucleotide; TTT chr11 5261714 5261735 5261719 5261714 -
gtgtcctctcttatttccttga

SEQ ID NO: 137805 - DNA, 22 bp, Artificial Sequence
  Synthetic oligonucleotide; TTG chr11 5261713 5261734 5261718 5261713 -
tgtcctctcttatttccttgag

SEQ ID NO: 137806 - DNA, 22 bp, Artificial Sequence
  Synthetic oligonucleotide; CTC chr11 5261706 5261727 5261711 5261706 -
tcttatttccttgagcagtgag

SEQ ID NO: 137807 - DNA, 22 bp, Artificial Sequence
  Synthetic oligonucleotide; CTC chr11 5261704 5261725 5261709 5261704 -
ttatttccttgagcagtgagtg

SEQ ID NO: 137808 - DNA, 22 bp, Artificial Sequence
  Synthetic oligonucleotide; CTT chr11 5261702 5261723 5261707 5261702 -
atttccttgagcagtgagtggt

SEQ ID NO: 137809 - DNA, 22 bp, Artificial Sequence
  Synthetic oligonucleotide; TTA chr11 5261701 5261722 5261706 5261701 -
tttccttgagcagtgagtggtt

SEQ ID NO: 137810 - DNA, 22 bp, Artificial Sequence
  Synthetic oligonucleotide; TTT chr11 5261698 5261719 5261703 5261698 -
ccttgagcagtgagtggtttgt

SEQ ID NO: 137811 - DNA, 22 bp, Artificial Sequence
  Synthetic oligonucleotide; TTC chr11 5261697 5261718 5261702 5261697 -
cttgagcagtgagtggtttgta

SEQ ID NO: 137812 - DNA, 22 bp, Artificial Sequence
  Synthetic oligonucleotide; CTT chr11 5261694 5261715 5261699 5261694 -
gagcagtgagtggtttgtagct

SEQ ID NO: 137813 - DNA, 22 bp, Artificial Sequence
  Synthetic oligonucleotide; TTG chr11 5261693 5261714 5261698 5261693 -
agcagtgagtggtttgtagctc

SEQ ID NO: 137814 - DNA, 22 bp, Artificial Sequence
  Synthetic oligonucleotide; TTT chr11 5261678 5261699 5261683 5261678 -
gtagctctccttgaagaggttc

SEQ ID NO: 137815 - DNA, 22 bp, Artificial Sequence
  Synthetic oligonucleotide; TTG chr11 5261677 5261698 5261682 5261677 -
tagctctccttgaagaggttct

SEQ ID NO: 137816 - DNA, 22 bp, Artificial Sequence
  Synthetic oligonucleotide; CTC chr11 5261671 5261692 5261676 5261671 -
tccttgaagaggttcttcacat

SEQ ID NO: 137817 - DNA, 22 bp, Artificial Sequence
  Synthetic oligonucleotide; CTC chr11 5261669 5261690 5261674 5261669 -
cttgaagaggttcttcacatcc

SEQ ID NO: 137818 - DNA, 22 bp, Artificial Sequence
  Synthetic oligonucleotide; CTT chr11 5261666 5261687 5261671 5261666 -
gaagaggttcttcacatccctt

SEQ ID NO: 137819 - DNA, 22 bp, Artificial Sequence
  Synthetic oligonucleotide; TTG chr11 5261665 5261686 5261670 5261665 -
aagaggttcttcacatccctta

SEQ ID NO: 137820 - DNA, 22 bp, Artificial Sequence
  Synthetic oligonucleotide; TTC chr11 5261656 5261677 5261661 5261656 -
ttcacatcccttagaagttgta

SEQ ID NO: 137821 - DNA, 22 bp, Artificial Sequence
  Synthetic oligonucleotide; CTT chr11 5261654 5261675 5261659 5261654 -
cacatcccttagaagttgtatt

SEQ ID NO: 137822 - DNA, 22 bp, Artificial Sequence
  Synthetic oligonucleotide; TTC chr11 5261653 5261674 5261658 5261653 -
acatcccttagaagttgtattt

SEQ ID NO: 137823 - DNA, 22 bp, Artificial Sequence
  Synthetic oligonucleotide; CTT chr11 5261644 5261665 5261649 5261644 -
agaagttgtatttctaggtatt

SEQ ID NO: 137824 - DNA, 22 bp, Artificial Sequence
  Synthetic oligonucleotide; TTA chr11 5261643 5261664 5261648 5261643 -
gaagttgtatttctaggtattt

SEQ ID NO: 137825 - DNA, 22 bp, Artificial Sequence
  Synthetic oligonucleotide; TTG chr11 5261636 5261657 5261641 5261636 -
tatttctaggtattttatttta

SEQ ID NO: 137826 - DNA, 22 bp, Artificial Sequence
  Synthetic oligonucleotide; TTT chr11 5261631 5261652 5261636 5261631 -
ctaggtattttattttattctc

SEQ ID NO: 137827 - DNA, 22 bp, Artificial Sequence
  Synthetic oligonucleotide; TTC chr11 5261630 5261651 5261635 5261630 -
taggtattttattttattctct

SEQ ID NO: 137828 - DNA, 22 bp, Artificial Sequence
  Synthetic oligonucleotide; CTA chr11 5261628 5261649 5261633 5261628 -
ggtattttattttattctcttt

SEQ ID NO: 137829 - DNA, 22 bp, Artificial Sequence
  Synthetic oligonucleotide; TTT chr11 5261621 5261642 5261626 5261621 -
tattttattctctttgcagcaa

SEQ ID NO: 137830 - DNA, 22 bp, Artificial Sequence
  Synthetic oligonucleotide; TTT chr11 5261620 5261641 5261625 5261620 -
attttattctctttgcagcaat

SEQ ID NO: 137831 - DNA, 22 bp, Artificial Sequence
  Synthetic oligonucleotide; TTA chr11 5261619 5261640 5261624 5261619 -
ttttattctctttgcagcaatt

SEQ ID NO: 137832 - DNA, 22 bp, Artificial Sequence
  Synthetic oligonucleotide; TTT chr11 5261616 5261637 5261621 5261616 -
tattctctttgcagcaattgtg

SEQ ID NO: 137833 - DNA, 22 bp, Artificial Sequence
  Synthetic oligonucleotide; TTT chr11 5261615 5261636 5261620 5261615 -
attctctttgcagcaattgtga

SEQ ID NO: 137834 - DNA, 22 bp, Artificial Sequence
  Synthetic oligonucleotide; TTA chr11 5261614 5261635 5261619 5261614 -
ttctctttgcagcaattgtgaa

SEQ ID NO: 137835 - DNA, 22 bp, Artificial Sequence
  Synthetic oligonucleotide; TTC chr11 5261611 5261632 5261616 5261611 -
tctttgcagcaattgtgaatgg

SEQ ID NO: 137836 - DNA, 22 bp, Artificial Sequence
  Synthetic oligonucleotide; CTC chr11 5261609 5261630 5261614 5261609 -
tttgcagcaattgtgaatggga

SEQ ID NO: 137837 - DNA, 22 bp, Artificial Sequence
  Synthetic oligonucleotide; CTT chr11 5261607 5261628 5261612 5261607 -
tgcagcaattgtgaatgggagt

SEQ ID NO: 137838 - DNA, 22 bp, Artificial Sequence
  Synthetic oligonucleotide; TTT chr11 5261606 5261627 5261611 5261606 -
gcagcaattgtgaatgggagtt

SEQ ID NO: 137839 - DNA, 22 bp, Artificial Sequence
  Synthetic oligonucleotide; TTG chr11 5261605 5261626 5261610 5261605 -
cagcaattgtgaatgggagttc

SEQ ID NO: 137840 - DNA, 22 bp, Artificial Sequence
  Synthetic oligonucleotide; TTG chr11 5261596 5261617 5261601 5261596 -
tgaatgggagttcacccatgat

SEQ ID NO: 137841 - DNA, 22 bp, Artificial Sequence
  Synthetic oligonucleotide; TTC chr11 5261583 5261604 5261588 5261583 -
acccatgatttggctctctgct

SEQ ID NO: 137842 - DNA, 22 bp, Artificial Sequence
  Synthetic oligonucleotide; TTT chr11 5261572 5261593 5261577 5261572 -
ggctctctgcttgtctattatt

SEQ ID NO: 137843 - DNA, 22 bp, Artificial Sequence
  Synthetic oligonucleotide; TTG chr11 5261571 5261592 5261576 5261571 -
gctctctgcttgtctattattg

SEQ ID NO: 137844 - DNA, 22 bp, Artificial Sequence
  Synthetic oligonucleotide; CTC chr11 5261567 5261588 5261572 5261567 -
tctgcttgtctattattggtgt

SEQ ID NO: 137845 - DNA, 22 bp, Artificial Sequence
  Synthetic oligonucleotide; CTC chr11 5261565 5261586 5261570 5261565 -
tgcttgtctattattggtgtat

SEQ ID NO: 137846 - DNA, 22 bp, Artificial Sequence
  Synthetic oligonucleotide; CTG chr11 5261563 5261584 5261568 5261563 -
cttgtctattattggtgtatag

SEQ ID NO: 137847 - DNA, 22 bp, Artificial Sequence
  Synthetic oligonucleotide; CTT chr11 5261560 5261581 5261565 5261560 -
gtctattattggtgtataggaa

SEQ ID NO: 137848 - DNA, 22 bp, Artificial Sequence
  Synthetic oligonucleotide; TTG chr11 5261559 5261580 5261564 5261559 -
tctattattggtgtataggaac

SEQ ID NO: 137849 - DNA, 22 bp, Artificial Sequence
  Synthetic oligonucleotide; CTA chr11 5261555 5261576 5261560 5261555 -
ttattggtgtataggaacgctt

SEQ ID NO: 137850 - DNA, 22 bp, Artificial Sequence
  Synthetic oligonucleotide; TTA chr11 5261552 5261573 5261557 5261552 -
ttggtgtataggaacgcttgtg

SEQ ID NO: 137851 - DNA, 22 bp, Artificial Sequence
  Synthetic oligonucleotide; TTG chr11 5261549 5261570 5261554 5261549 -
gtgtataggaacgcttgtgatt

SEQ ID NO: 137852 - DNA, 22 bp, Artificial Sequence
  Synthetic oligonucleotide; CTT chr11 5261533 5261554 5261538 5261533 -
gtgatttctgcacactgatttt

SEQ ID NO: 137853 - DNA, 22 bp, Artificial Sequence
  Synthetic oligonucleotide; TTG chr11 5261532 5261553 5261537 5261532 -
tgatttctgcacactgattttg

SEQ ID NO: 137854 - DNA, 22 bp, Artificial Sequence
  Synthetic oligonucleotide; TTT chr11 5261526 5261547 5261531 5261526 -
ctgcacactgattttgtatctt

SEQ ID NO: 137855 - DNA, 22 bp, Artificial Sequence
  Synthetic oligonucleotide; TTC chr11 5261525 5261546 5261530 5261525 -
tgcacactgattttgtatcttg

SEQ ID NO: 137856 - DNA, 22 bp, Artificial Sequence
  Synthetic oligonucleotide; CTG chr11 5261523 5261544 5261528 5261523 -
cacactgattttgtatcttgag

SEQ ID NO: 137857 - DNA, 22 bp, Artificial Sequence
  Synthetic oligonucleotide; CTG chr11 5261516 5261537 5261521 5261516 -
attttgtatcttgagactttgc

SEQ ID NO: 137858 - DNA, 22 bp, Artificial Sequence
  Synthetic oligonucleotide; TTT chr11 5261512 5261533 5261517 5261512 -
tgtatcttgagactttgctgaa

SEQ ID NO: 137859 - DNA, 22 bp, Artificial Sequence
  Synthetic oligonucleotide; TTT chr11 5261511 5261532 5261516 5261511 -
gtatcttgagactttgctgaag

SEQ ID NO: 137860 - DNA, 22 bp, Artificial Sequence
  Synthetic oligonucleotide; TTG chr11 5261510 5261531 5261515 5261510 -
tatcttgagactttgctgaagc

SEQ ID NO: 137861 - DNA, 22 bp, Artificial Sequence
  Synthetic oligonucleotide; CTT chr11 5261504 5261525 5261509 5261504 -
gagactttgctgaagctgttta

SEQ ID NO: 137862 - DNA, 22 bp, Artificial Sequence
  Synthetic oligonucleotide; TTG chr11 5261503 5261524 5261508 5261503 -
agactttgctgaagctgtttat

SEQ ID NO: 137863 - DNA, 22 bp, Artificial Sequence
  Synthetic oligonucleotide; CTT chr11 5261497 5261518 5261502 5261497 -
tgctgaagctgtttatcagctt

SEQ ID NO: 137864 - DNA, 22 bp, Artificial Sequence
  Synthetic oligonucleotide; TTT chr11 5261496 5261517 5261501 5261496 -
gctgaagctgtttatcagctta

SEQ ID NO: 137865 - DNA, 22 bp, Artificial Sequence
  Synthetic oligonucleotide; TTG chr11 5261495 5261516 5261500 5261495 -
ctgaagctgtttatcagcttaa

SEQ ID NO: 137866 - DNA, 22 bp, Artificial Sequence
  Synthetic oligonucleotide; CTG chr11 5261492 5261513 5261497 5261492 -
aagctgtttatcagcttaagat

SEQ ID NO: 137867 - DNA, 22 bp, Artificial Sequence
  Synthetic oligonucleotide; CTG chr11 5261486 5261507 5261491 5261486 -
tttatcagcttaagattttggg

SEQ ID NO: 137868 - DNA, 22 bp, Artificial Sequence
  Synthetic oligonucleotide; TTT chr11 5261483 5261504 5261488 5261483 -
atcagcttaagattttgggctg

SEQ ID NO: 137869 - DNA, 22 bp, Artificial Sequence
  Synthetic oligonucleotide; TTA chr11 5261482 5261503 5261487 5261482 -
tcagcttaagattttgggctga

SEQ ID NO: 137870 - DNA, 22 bp, Artificial Sequence
  Synthetic oligonucleotide; CTT chr11 5261475 5261496 5261480 5261475 -
aagattttgggctgagatgaca

SEQ ID NO: 137871 - DNA, 22 bp, Artificial Sequence
  Synthetic oligonucleotide; TTA chr11 5261474 5261495 5261479 5261474 -
agattttgggctgagatgacag

SEQ ID NO: 137872 - DNA, 22 bp, Artificial Sequence
  Synthetic oligonucleotide; TTT chr11 5261468 5261489 5261473 5261468 -
tgggctgagatgacagggtctt

SEQ ID NO: 137873 - DNA, 22 bp, Artificial Sequence
  Synthetic oligonucleotide; TTT chr11 5261467 5261488 5261472 5261467 -
gggctgagatgacagggtcttc

SEQ ID NO: 137874 - DNA, 22 bp, Artificial Sequence
  Synthetic oligonucleotide; TTG chr11 5261466 5261487 5261471 5261466 -
ggctgagatgacagggtcttct

SEQ ID NO: 137875 - DNA, 22 bp, Artificial Sequence
  Synthetic oligonucleotide; CTG chr11 5261461 5261482 5261466 5261461 -
agatgacagggtcttctaaata

SEQ ID NO: 137876 - DNA, 22 bp, Artificial Sequence
  Synthetic oligonucleotide; CTT chr11 5261446 5261467 5261451 5261446 -
ctaaatatacaatcatgtcatc

SEQ ID NO: 137877 - DNA, 22 bp, Artificial Sequence
  Synthetic oligonucleotide; TTC chr11 5261445 5261466 5261450 5261445 -
taaatatacaatcatgtcatct

SEQ ID NO: 137878 - DNA, 22 bp, Artificial Sequence
  Synthetic oligonucleotide; CTA chr11 5261443 5261464 5261448 5261443 -
aatatacaatcatgtcatctgc

SEQ ID NO: 137879 - DNA, 22 bp, Artificial Sequence
  Synthetic oligonucleotide; CTG chr11 5261422 5261443 5261427 5261422 -
caaacagagacaatttgacttc

SEQ ID NO: 137880 - DNA, 22 bp, Artificial Sequence
  Synthetic oligonucleotide; TTT chr11 5261406 5261427 5261411 5261406 -
gacttcctctcttcctatttga

SEQ ID NO: 137881 - DNA, 22 bp, Artificial Sequence
  Synthetic oligonucleotide; TTG chr11 5261405 5261426 5261410 5261405 -
acttcctctcttcctatttgaa

SEQ ID NO: 137882 - DNA, 22 bp, Artificial Sequence
  Synthetic oligonucleotide; CTT chr11 5261401 5261422 5261406 5261401 -
cctctcttcctatttgaatatg

SEQ ID NO: 137883 - DNA, 22 bp, Artificial Sequence
  Synthetic oligonucleotide; TTC chr11 5261400 5261421 5261405 5261400 -
ctctcttcctatttgaatatgc

SEQ ID NO: 137884 - DNA, 22 bp, Artificial Sequence
  Synthetic oligonucleotide; CTC chr11 5261397 5261418 5261402 5261397 -
tcttcctatttgaatatgcttt

SEQ ID NO: 137885 - DNA, 22 bp, Artificial Sequence
  Synthetic oligonucleotide; CTC chr11 5261395 5261416 5261400 5261395 -
ttcctatttgaatatgctttat

SEQ ID NO: 137886 - DNA, 22 bp, Artificial Sequence
  Synthetic oligonucleotide; CTT chr11 5261393 5261414 5261398 5261393 -
cctatttgaatatgctttattt

SEQ ID NO: 137887 - DNA, 22 bp, Artificial Sequence
  Synthetic oligonucleotide; TTC chr11 5261392 5261413 5261397 5261392 -
ctatttgaatatgctttatttc

SEQ ID NO: 137888 - DNA, 22 bp, Artificial Sequence
  Synthetic oligonucleotide; CTA chr11 5261389 5261410 5261394 5261389 -
tttgaatatgctttatttcttt

SEQ ID NO: 137889 - DNA, 22 bp, Artificial Sequence
  Synthetic oligonucleotide; TTT chr11 5261386 5261407 5261391 5261386 -
gaatatgctttatttctttctc

SEQ ID NO: 137890 - DNA, 22 bp, Artificial Sequence
  Synthetic oligonucleotide; TTG chr11 5261385 5261406 5261390 5261385 -
aatatgctttatttctttctct

SEQ ID NO: 137891 - DNA, 22 bp, Artificial Sequence
  Synthetic oligonucleotide; CTT chr11 5261376 5261397 5261381 5261376 -
tatttctttctcttgcctgatt

SEQ ID NO: 137892 - DNA, 22 bp, Artificial Sequence
  Synthetic oligonucleotide; TTT chr11 5261375 5261396 5261380 5261375 -
atttctttctcttgcctgattg

SEQ ID NO: 137893 - DNA, 22 bp, Artificial Sequence
  Synthetic oligonucleotide; TTA chr11 5261374 5261395 5261379 5261374 -
tttctttctcttgcctgattgt

SEQ ID NO: 137894 - DNA, 22 bp, Artificial Sequence
  Synthetic oligonucleotide; TTT chr11 5261371 5261392 5261376 5261371 -
ctttctcttgcctgattgtcct

SEQ ID NO: 137895 - DNA, 22 bp, Artificial Sequence
  Synthetic oligonucleotide; TTC chr11 5261370 5261391 5261375 5261370 -
tttctcttgcctgattgtcctg

SEQ ID NO: 137896 - DNA, 22 bp, Artificial Sequence
  Synthetic oligonucleotide; CTT chr11 5261368 5261389 5261373 5261368 -
tctcttgcctgattgtcctggc

SEQ ID NO: 137897 - DNA, 22 bp, Artificial Sequence
  Synthetic oligonucleotide; TTT chr11 5261367 5261388 5261372 5261367 -
ctcttgcctgattgtcctggcg

SEQ ID NO: 137898 - DNA, 22 bp, Artificial Sequence
  Synthetic oligonucleotide; TTC chr11 5261366 5261387 5261371 5261366 -
tcttgcctgattgtcctggcga

SEQ ID NO: 137899 - DNA, 22 bp, Artificial Sequence
  Synthetic oligonucleotide; CTC chr11 5261364 5261385 5261369 5261364 -
ttgcctgattgtcctggcgaga

SEQ ID NO: 137900 - DNA, 22 bp, Artificial Sequence
  Synthetic oligonucleotide; CTT chr11 5261362 5261383 5261367 5261362 -
gcctgattgtcctggcgagaac

SEQ ID NO: 137901 - DNA, 22 bp, Artificial Sequence
  Synthetic oligonucleotide; TTG chr11 5261361 5261382 5261366 5261361 -
cctgattgtcctggcgagaact

SEQ ID NO: 137902 - DNA, 22 bp, Artificial Sequence
  Synthetic oligonucleotide; CTG chr11 5261357 5261378 5261362 5261357 -
attgtcctggcgagaacttcca

SEQ ID NO: 137903 - DNA, 22 bp, Artificial Sequence
  Synthetic oligonucleotide; TTG chr11 5261353 5261374 5261358 5261353 -
tcctggcgagaacttccaatac

SEQ ID NO: 137904 - DNA, 22 bp, Artificial Sequence
  Synthetic oligonucleotide; CTG chr11 5261348 5261369 5261353 5261348 -
gcgagaacttccaatactatgt

SEQ ID NO: 137905 - DNA, 22 bp, Artificial Sequence
  Synthetic oligonucleotide; CTT chr11 5261338 5261359 5261343 5261338 -
ccaatactatgttgagtaagag

SEQ ID NO: 137906 - DNA, 22 bp, Artificial Sequence
  Synthetic oligonucleotide; TTC chr11 5261337 5261358 5261342 5261337 -
caatactatgttgagtaagagt

SEQ ID NO: 137907 - DNA, 22 bp, Artificial Sequence
  Synthetic oligonucleotide; CTA chr11 5261329 5261350 5261334 5261329 -
tgttgagtaagagtggcgagag

SEQ ID NO: 137908 - DNA, 22 bp, Artificial Sequence
  Synthetic oligonucleotide; TTG chr11 5261324 5261345 5261329 5261324 -
agtaagagtggcgagagggcat

SEQ ID NO: 137909 - DNA, 22 bp, Artificial Sequence
  Synthetic oligonucleotide; CTT chr11 5261298 5261319 5261303 5261298 -
gtcttgtgccggttttcaaagc

SEQ ID NO: 137910 - DNA, 22 bp, Artificial Sequence
  Synthetic oligonucleotide; TTG chr11 5261297 5261318 5261302 5261297 -
tcttgtgccggttttcaaagca

SEQ ID NO: 137911 - DNA, 22 bp, Artificial Sequence
  Synthetic oligonucleotide; CTT chr11 5261293 5261314 5261298 5261293 -
gtgccggttttcaaagcaaatg

SEQ ID NO: 137912 - DNA, 22 bp, Artificial Sequence
  Synthetic oligonucleotide; TTG chr11 5261292 5261313 5261297 5261292 -
tgccggttttcaaagcaaatga

SEQ ID NO: 137913 - DNA, 22 bp, Artificial Sequence
  Synthetic oligonucleotide; TTT chr11 5261283 5261304 5261288 5261283 -
tcaaagcaaatgatttttaaat

SEQ ID NO: 137914 - DNA, 22 bp, Artificial Sequence
  Synthetic oligonucleotide; TTT chr11 5261282 5261303 5261287 5261282 -
caaagcaaatgatttttaaatt

SEQ ID NO: 137915 - DNA, 22 bp, Artificial Sequence
  Synthetic oligonucleotide; TTC chr11 5261281 5261302 5261286 5261281 -
aaagcaaatgatttttaaattt

SEQ ID NO: 137916 - DNA, 22 bp, Artificial Sequence
  Synthetic oligonucleotide; TTT chr11 5261267 5261288 5261272 5261267 -
ttaaatttccatcttgatttca

SEQ ID NO: 137917 - DNA, 22 bp, Artificial Sequence
  Synthetic oligonucleotide; TTT chr11 5261266 5261287 5261271 5261266 -
taaatttccatcttgatttcat

SEQ ID NO: 137918 - DNA, 22 bp, Artificial Sequence
  Synthetic oligonucleotide; TTT chr11 5261265 5261286 5261270 5261265 -
aaatttccatcttgatttcatt

SEQ ID NO: 137919 - DNA, 22 bp, Artificial Sequence
  Synthetic oligonucleotide; TTA chr11 5261264 5261285 5261269 5261264 -
aatttccatcttgatttcattg

SEQ ID NO: 137920 - DNA, 22 bp, Artificial Sequence
  Synthetic oligonucleotide; TTT chr11 5261259 5261280 5261264 5261259 -
ccatcttgatttcattgttgac

SEQ ID NO: 137921 - DNA, 22 bp, Artificial Sequence
  Synthetic oligonucleotide; TTC chr11 5261258 5261279 5261263 5261258 -
catcttgatttcattgttgacc

SEQ ID NO: 137922 - DNA, 22 bp, Artificial Sequence
  Synthetic oligonucleotide; CTT chr11 5261252 5261273 5261257 5261252 -
gatttcattgttgacccaatga

SEQ ID NO: 137923 - DNA, 22 bp, Artificial Sequence
  Synthetic oligonucleotide; TTG chr11 5261251 5261272 5261256 5261251 -
atttcattgttgacccaatgat

SEQ ID NO: 137924 - DNA, 22 bp, Artificial Sequence
  Synthetic oligonucleotide; TTT chr11 5261247 5261268 5261252 5261247 -
cattgttgacccaatgatcatt

SEQ ID NO: 137925 - DNA, 22 bp, Artificial Sequence
  Synthetic oligonucleotide; TTC chr11 5261246 5261267 5261251 5261246 -
attgttgacccaatgatcattc

SEQ ID NO: 137926 - DNA, 22 bp, Artificial Sequence
  Synthetic oligonucleotide; TTG chr11 5261242 5261263 5261247 5261242 -
ttgacccaatgatcattcagga

SEQ ID NO: 137927 - DNA, 22 bp, Artificial Sequence
  Synthetic oligonucleotide; TTG chr11 5261239 5261260 5261244 5261239 -
acccaatgatcattcaggagca

SEQ ID NO: 137928 - DNA, 22 bp, Artificial Sequence
  Synthetic oligonucleotide; TTC chr11 5261224 5261245 5261229 5261224 -
aggagcaggttatttaatttcc

SEQ ID NO: 137929 - DNA, 22 bp, Artificial Sequence
  Synthetic oligonucleotide; TTA chr11 5261212 5261233 5261217 5261212 -
tttaatttccctgtatttgcat

SEQ ID NO: 137930 - DNA, 22 bp, Artificial Sequence
  Synthetic oligonucleotide; TTT chr11 5261209 5261230 5261214 5261209 -
aatttccctgtatttgcatggt

SEQ ID NO: 137931 - DNA, 22 bp, Artificial Sequence
  Synthetic oligonucleotide; TTA chr11 5261208 5261229 5261213 5261208 -
atttccctgtatttgcatggtt

SEQ ID NO: 137932 - DNA, 22 bp, Artificial Sequence
  Synthetic oligonucleotide; TTT chr11 5261204 5261225 5261209 5261204 -
ccctgtatttgcatggttttga

SEQ ID NO: 137933 - DNA, 22 bp, Artificial Sequence
  Synthetic oligonucleotide; TTC chr11 5261203 5261224 5261208 5261203 -
cctgtatttgcatggttttgaa

SEQ ID NO: 137934 - DNA, 22 bp, Artificial Sequence
  Synthetic oligonucleotide; CTG chr11 5261199 5261220 5261204 5261199 -
tatttgcatggttttgaaggtt

SEQ ID NO: 137935 - DNA, 22 bp, Artificial Sequence
  Synthetic oligonucleotide; TTT chr11 5261194 5261215 5261199 5261194 -
gcatggttttgaaggttccttt

SEQ ID NO: 137936 - DNA, 22 bp, Artificial Sequence
  Synthetic oligonucleotide; TTG chr11 5261193 5261214 5261198 5261193 -
catggttttgaaggttcctttt

SEQ ID NO: 137937 - DNA, 22 bp, Artificial Sequence
  Synthetic oligonucleotide; TTT chr11 5261185 5261206 5261190 5261185 -
tgaaggttccttttgtagttga

SEQ ID NO: 137938 - DNA, 22 bp, Artificial Sequence
  Synthetic oligonucleotide; TTT chr11 5261184 5261205 5261189 5261184 -
gaaggttccttttgtagttgat

SEQ ID NO: 137939 - DNA, 22 bp, Artificial Sequence
  Synthetic oligonucleotide; TTG chr11 5261183 5261204 5261188 5261183 -
aaggttccttttgtagttgatt

SEQ ID NO: 137940 - DNA, 22 bp, Artificial Sequence
  Synthetic oligonucleotide; TTC chr11 5261176 5261197 5261181 5261176 -
cttttgtagttgatttccaatt

SEQ ID NO: 137941 - DNA, 22 bp, Artificial Sequence
  Synthetic oligonucleotide; CTT chr11 5261173 5261194 5261178 5261173 -
ttgtagttgatttccaatttta

SEQ ID NO: 137942 - DNA, 22 bp, Artificial Sequence
  Synthetic oligonucleotide; TTT chr11 5261172 5261193 5261177 5261172 -
tgtagttgatttccaattttat

SEQ ID NO: 137943 - DNA, 22 bp, Artificial Sequence
  Synthetic oligonucleotide; TTT chr11 5261171 5261192 5261176 5261171 -
gtagttgatttccaattttatt

SEQ ID NO: 137944 - DNA, 22 bp, Artificial Sequence
  Synthetic oligonucleotide; TTG chr11 5261170 5261191 5261175 5261170 -
tagttgatttccaattttattc

SEQ ID NO: 137945 - DNA, 22 bp, Artificial Sequence
  Synthetic oligonucleotide; TTG chr11 5261164 5261185 5261169 5261164 -
atttccaattttattctactgt

SEQ ID NO: 137946 - DNA, 22 bp, Artificial Sequence
  Synthetic oligonucleotide; TTT chr11 5261160 5261181 5261165 5261160 -
ccaattttattctactgtggtc

SEQ ID NO: 137947 - DNA, 22 bp, Artificial Sequence
  Synthetic oligonucleotide; TTC chr11 5261159 5261180 5261164 5261159 -
caattttattctactgtggtct

SEQ ID NO: 137948 - DNA, 22 bp, Artificial Sequence
  Synthetic oligonucleotide; TTT chr11 5261153 5261174 5261158 5261153 -
tattctactgtggtctgagaga

SEQ ID NO: 137949 - DNA, 22 bp, Artificial Sequence
  Synthetic oligonucleotide; TTT chr11 5261152 5261173 5261157 5261152 -
attctactgtggtctgagagag

SEQ ID NO: 137950 - DNA, 22 bp, Artificial Sequence
  Synthetic oligonucleotide; TTA chr11 5261151 5261172 5261156 5261151 -
ttctactgtggtctgagagagt

SEQ ID NO: 137951 - DNA, 22 bp, Artificial Sequence
  Synthetic oligonucleotide; TTC chr11 5261148 5261169 5261153 5261148 -
tactgtggtctgagagagtgct

SEQ ID NO: 137952 - DNA, 22 bp, Artificial Sequence
  Synthetic oligonucleotide; CTA chr11 5261146 5261167 5261151 5261146 -
ctgtggtctgagagagtgcttg

SEQ ID NO: 137953 - DNA, 22 bp, Artificial Sequence
  Synthetic oligonucleotide; CTG chr11 5261143 5261164 5261148 5261143 -
tggtctgagagagtgcttgata

SEQ ID NO: 137954 - DNA, 22 bp, Artificial Sequence
  Synthetic oligonucleotide; CTG chr11 5261136 5261157 5261141 5261136 -
agagagtgcttgatataatttc

SEQ ID NO: 137955 - DNA, 22 bp, Artificial Sequence
  Synthetic oligonucleotide; CTT chr11 5261125 5261146 5261130 5261125 -
gatataatttcaatttttaaaa

SEQ ID NO: 137956 - DNA, 22 bp, Artificial Sequence
  Synthetic oligonucleotide; TTG chr11 5261124 5261145 5261129 5261124 -
atataatttcaatttttaaaaa

SEQ ID NO: 137957 - DNA, 22 bp, Artificial Sequence
  Synthetic oligonucleotide; TTT chr11 5261115 5261136 5261120 5261115 -
caatttttaaaaatttattgag

SEQ ID NO: 137958 - DNA, 22 bp, Artificial Sequence
  Synthetic oligonucleotide; TTC chr11 5261114 5261135 5261119 5261114 -
aatttttaaaaatttattgagg

SEQ ID NO: 137959 - DNA, 22 bp, Artificial Sequence
  Synthetic oligonucleotide; TTT chr11 5261109 5261130 5261114 5261109 -
ttaaaaatttattgaggcttgt

SEQ ID NO: 137960 - DNA, 22 bp, Artificial Sequence
  Synthetic oligonucleotide; TTT chr11 5261108 5261129 5261113 5261108 -
taaaaatttattgaggcttgtt

SEQ ID NO: 137961 - DNA, 22 bp, Artificial Sequence
  Synthetic oligonucleotide; TTT chr11 5261107 5261128 5261112 5261107 -
aaaaatttattgaggcttgttt

SEQ ID NO: 137962 - DNA, 22 bp, Artificial Sequence
  Synthetic oligonucleotide; TTA chr11 5261106 5261127 5261111 5261106 -
aaaatttattgaggcttgtttt

SEQ ID NO: 137963 - DNA, 22 bp, Artificial Sequence
  Synthetic oligonucleotide; TTT chr11 5261099 5261120 5261104 5261099 -
attgaggcttgttttgtggcat

SEQ ID NO: 137964 - DNA, 22 bp, Artificial Sequence
  Synthetic oligonucleotide; TTA chr11 5261098 5261119 5261103 5261098 -
ttgaggcttgttttgtggcata

SEQ ID NO: 137965 - DNA, 22 bp, Artificial Sequence
  Synthetic oligonucleotide; TTG chr11 5261095 5261116 5261100 5261095 -
aggcttgttttgtggcatatca

SEQ ID NO: 137966 - DNA, 22 bp, Artificial Sequence
  Synthetic oligonucleotide; CTT chr11 5261089 5261110 5261094 5261089 -
gttttgtggcatatcatatggc

SEQ ID NO: 137967 - DNA, 22 bp, Artificial Sequence
  Synthetic oligonucleotide; TTG chr11 5261088 5261109 5261093 5261088 -
ttttgtggcatatcatatggcc

SEQ ID NO: 137968 - DNA, 22 bp, Artificial Sequence
  Synthetic oligonucleotide; TTT chr11 5261085 5261106 5261090 5261085 -
tgtggcatatcatatggcctat

SEQ ID NO: 137969 - DNA, 22 bp, Artificial Sequence
  Synthetic oligonucleotide; TTT chr11 5261084 5261105 5261089 5261084 -
gtggcatatcatatggcctatc

SEQ ID NO: 137970 - DNA, 22 bp, Artificial Sequence
  Synthetic oligonucleotide; TTG chr11 5261083 5261104 5261088 5261083 -
tggcatatcatatggcctatct

SEQ ID NO: 137971 - DNA, 22 bp, Artificial Sequence
  Synthetic oligonucleotide; CTA chr11 5261064 5261085 5261069 5261064 -
tcttggagaaagttccatgtgc

SEQ ID NO: 137972 - DNA, 22 bp, Artificial Sequence
  Synthetic oligonucleotide; CTT chr11 5261060 5261081 5261065 5261060 -
ggagaaagttccatgtgctgat

SEQ ID NO: 137973 - DNA, 22 bp, Artificial Sequence
  Synthetic oligonucleotide; TTG chr11 5261059 5261080 5261064 5261059 -
gagaaagttccatgtgctgatg

SEQ ID NO: 137974 - DNA, 22 bp, Artificial Sequence
  Synthetic oligonucleotide; TTC chr11 5261049 5261070 5261054 5261049 -
catgtgctgatgaatagaatgt

SEQ ID NO: 137975 - DNA, 22 bp, Artificial Sequence
  Synthetic oligonucleotide; CTG chr11 5261040 5261061 5261045 5261040 -
atgaatagaatgtgtattctgc

SEQ ID NO: 137976 - DNA, 22 bp, Artificial Sequence
  Synthetic oligonucleotide; TTC chr11 5261021 5261042 5261026 5261021 -
tgcagttgttgggtagaatgtc

SEQ ID NO: 137977 - DNA, 22 bp, Artificial Sequence
  Synthetic oligonucleotide; CTG chr11 5261019 5261040 5261024 5261019 -
cagttgttgggtagaatgtcct

SEQ ID NO: 137978 - DNA, 22 bp, Artificial Sequence
  Synthetic oligonucleotide; TTG chr11 5261013 5261034 5261018 5261013 -
ttgggtagaatgtcctgtaaat

SEQ ID NO: 137979 - DNA, 22 bp, Artificial Sequence
  Synthetic oligonucleotide; TTG chr11 5261010 5261031 5261015 5261010 -
ggtagaatgtcctgtaaatatc

SEQ ID NO: 137980 - DNA, 22 bp, Artificial Sequence
  Synthetic oligonucleotide; CTG chr11 5260996 5261017 5261001 5260996 -
taaatatctgttaagtccattt

SEQ ID NO: 137981 - DNA, 22 bp, Artificial Sequence
  Synthetic oligonucleotide; CTG chr11 5260986 5261007 5260991 5260986 -
ttaagtccatttgttctttaaa

SEQ ID NO: 137982 - DNA, 22 bp, Artificial Sequence
  Synthetic oligonucleotide; TTA chr11 5260983 5261004 5260988 5260983 -
agtccatttgttctttaaatcc

SEQ ID NO: 137983 - DNA, 22 bp, Artificial Sequence
  Synthetic oligonucleotide; TTT chr11 5260974 5260995 5260979 5260974 -
gttctttaaatccattgtttct

SEQ ID NO: 137984 - DNA, 22 bp, Artificial Sequence
  Synthetic oligonucleotide; TTG chr11 5260973 5260994 5260978 5260973 -
ttctttaaatccattgtttctt

SEQ ID NO: 137985 - DNA, 22 bp, Artificial Sequence
  Synthetic oligonucleotide; TTC chr11 5260970 5260991 5260975 5260970 -
tttaaatccattgtttctttgt

SEQ ID NO: 137986 - DNA, 22 bp, Artificial Sequence
  Synthetic oligonucleotide; CTT chr11 5260968 5260989 5260973 5260968 -
taaatccattgtttctttgtag

SEQ ID NO: 137987 - DNA, 22 bp, Artificial Sequence
  Synthetic oligonucleotide; TTT chr11 5260967 5260988 5260972 5260967 -
aaatccattgtttctttgtaga

SEQ ID NO: 137988 - DNA, 22 bp, Artificial Sequence
  Synthetic oligonucleotide; TTA chr11 5260966 5260987 5260971 5260966 -
aatccattgtttctttgtagac

SEQ ID NO: 137989 - DNA, 22 bp, Artificial Sequence
  Synthetic oligonucleotide; TTG chr11 5260957 5260978 5260962 5260957 -
tttctttgtagactgtcttgat

SEQ ID NO: 137990 - DNA, 22 bp, Artificial Sequence
  Synthetic oligonucleotide; TTT chr11 5260954 5260975 5260959 5260954 -
ctttgtagactgtcttgatgac

SEQ ID NO: 137991 - DNA, 22 bp, Artificial Sequence
  Synthetic oligonucleotide; TTC chr11 5260953 5260974 5260958 5260953 -
tttgtagactgtcttgatgacc

SEQ ID NO: 137992 - DNA, 22 bp, Artificial Sequence
  Synthetic oligonucleotide; CTT chr11 5260951 5260972 5260956 5260951 -
tgtagactgtcttgatgacctg

SEQ ID NO: 137993 - DNA, 22 bp, Artificial Sequence
  Synthetic oligonucleotide; TTT chr11 5260950 5260971 5260955 5260950 -
gtagactgtcttgatgacctgc

SEQ ID NO: 137994 - DNA, 22 bp, Artificial Sequence
  Synthetic oligonucleotide; TTG chr11 5260949 5260970 5260954 5260949 -
tagactgtcttgatgacctgcc

SEQ ID NO: 137995 - DNA, 22 bp, Artificial Sequence
  Synthetic oligonucleotide; CTG chr11 5260942 5260963 5260947 5260942 -
tcttgatgacctgcctagtgca

SEQ ID NO: 137996 - DNA, 22 bp, Artificial Sequence
  Synthetic oligonucleotide; CTT chr11 5260938 5260959 5260943 5260938 -
gatgacctgcctagtgcagtca

SEQ ID NO: 137997 - DNA, 22 bp, Artificial Sequence
  Synthetic oligonucleotide; TTG chr11 5260937 5260958 5260942 5260937 -
atgacctgcctagtgcagtcag

SEQ ID NO: 137998 - DNA, 22 bp, Artificial Sequence
  Synthetic oligonucleotide; CTG chr11 5260929 5260950 5260934 5260929 -
cctagtgcagtcagtggagtat

SEQ ID NO: 137999 - DNA, 22 bp, Artificial Sequence
  Synthetic oligonucleotide; CTA chr11 5260925 5260946 5260930 5260925 -
gtgcagtcagtggagtattgaa

SEQ ID NO: 138000 - DNA, 22 bp, Artificial Sequence
  Synthetic oligonucleotide; TTG chr11 5260905 5260926 5260910 5260905 -
aagtcccccactattattatgt

SEQ ID NO: 138001 - DNA, 22 bp, Artificial Sequence
  Synthetic oligonucleotide; CTA chr11 5260892 5260913 5260897 5260892 -
ttattatgttgctgtctagtct

SEQ ID NO: 138002 - DNA, 22 bp, Artificial Sequence
  Synthetic oligonucleotide; TTA chr11 5260889 5260910 5260894 5260889 -
ttatgttgctgtctagtctagt

SEQ ID NO: 138003 - DNA, 22 bp, Artificial Sequence
  Synthetic oligonucleotide; TTA chr11 5260886 5260907 5260891 5260886 -
tgttgctgtctagtctagtagt

SEQ ID NO: 138004 - DNA, 22 bp, Artificial Sequence
  Synthetic oligonucleotide; TTG chr11 5260881 5260902 5260886 5260881 -
ctgtctagtctagtagtaattg

SEQ ID NO: 138005 - DNA, 22 bp, Artificial Sequence
  Synthetic oligonucleotide; CTG chr11 5260878 5260899 5260883 5260878 -
tctagtctagtagtaattgttt

SEQ ID NO: 138006 - DNA, 22 bp, Artificial Sequence
  Synthetic oligonucleotide; CTA chr11 5260874 5260895 5260879 5260874 -
gtctagtagtaattgttttata

SEQ ID NO: 138007 - DNA, 22 bp, Artificial Sequence
  Synthetic oligonucleotide; CTA chr11 5260869 5260890 5260874 5260869 -
gtagtaattgttttataaattt

SEQ ID NO: 138008 - DNA, 22 bp, Artificial Sequence
  Synthetic oligonucleotide; TTG chr11 5260859 5260880 5260864 5260859 -
ttttataaatttgggatctcca

SEQ ID NO: 138009 - DNA, 22 bp, Artificial Sequence
  Synthetic oligonucleotide; TTT chr11 5260856 5260877 5260861 5260856 -
tataaatttgggatctccagta

SEQ ID NO: 138010 - DNA, 22 bp, Artificial Sequence
  Synthetic oligonucleotide; TTT chr11 5260855 5260876 5260860 5260855 -
ataaatttgggatctccagtat

SEQ ID NO: 138011 - DNA, 22 bp, Artificial Sequence
  Synthetic oligonucleotide; TTA chr11 5260854 5260875 5260859 5260854 -
taaatttgggatctccagtatt

SEQ ID NO: 138012 - DNA, 22 bp, Artificial Sequence
  Synthetic oligonucleotide; TTT chr11 5260847 5260868 5260852 5260847 -
gggatctccagtattagatgca

SEQ ID NO: 138013 - DNA, 22 bp, Artificial Sequence
  Synthetic oligonucleotide; TTG chr11 5260846 5260867 5260851 5260846 -
ggatctccagtattagatgcat

SEQ ID NO: 138014 - DNA, 22 bp, Artificial Sequence
  Synthetic oligonucleotide; CTC chr11 5260839 5260860 5260844 5260839 -
cagtattagatgcatatatatt

SEQ ID NO: 138015 - DNA, 22 bp, Artificial Sequence
  Synthetic oligonucleotide; TTA chr11 5260831 5260852 5260836 5260831 -
gatgcatatatattaagaattg

SEQ ID NO: 138016 - DNA, 22 bp, Artificial Sequence
  Synthetic oligonucleotide; TTA chr11 5260816 5260837 5260821 5260816 -
agaattgtaatattctcccatt

SEQ ID NO: 138017 - DNA, 22 bp, Artificial Sequence
  Synthetic oligonucleotide; TTG chr11 5260809 5260830 5260814 5260809 -
taatattctcccattggacaag

SEQ ID NO: 138018 - DNA, 22 bp, Artificial Sequence
  Synthetic oligonucleotide; TTC chr11 5260801 5260822 5260806 5260801 -
tcccattggacaagggctttta

SEQ ID NO: 138019 - DNA, 22 bp, Artificial Sequence
  Synthetic oligonucleotide; CTC chr11 5260799 5260820 5260804 5260799 -
ccattggacaagggcttttatc

SEQ ID NO: 138020 - DNA, 22 bp, Artificial Sequence
  Synthetic oligonucleotide; TTG chr11 5260793 5260814 5260798 5260793 -
gacaagggcttttatcattata

SEQ ID NO: 138021 - DNA, 22 bp, Artificial Sequence
  Synthetic oligonucleotide; CTT chr11 5260782 5260803 5260787 5260782 -
ttatcattatatgatgtccctc

SEQ ID NO: 138022 - DNA, 22 bp, Artificial Sequence
  Synthetic oligonucleotide; TTT chr11 5260781 5260802 5260786 5260781 -
tatcattatatgatgtccctct

SEQ ID NO: 138023 - DNA, 22 bp, Artificial Sequence
  Synthetic oligonucleotide; TTT chr11 5260780 5260801 5260785 5260780 -
atcattatatgatgtccctctt

SEQ ID NO: 138024 - DNA, 22 bp, Artificial Sequence
  Synthetic oligonucleotide; TTA chr11 5260779 5260800 5260784 5260779 -
tcattatatgatgtccctcttt

SEQ ID NO: 138025 - DNA, 22 bp, Artificial Sequence
  Synthetic oligonucleotide; TTA chr11 5260773 5260794 5260778 5260773 -
tatgatgtccctctttgtcttt

SEQ ID NO: 138026 - DNA, 22 bp, Artificial Sequence
  Synthetic oligonucleotide; CTC chr11 5260760 5260781 5260765 5260760 -
tttgtcttttttaactgctgtt

SEQ ID NO: 138027 - DNA, 22 bp, Artificial Sequence
  Synthetic oligonucleotide; CTT chr11 5260758 5260779 5260763 5260758 -
tgtcttttttaactgctgtttc

SEQ ID NO: 138028 - DNA, 22 bp, Artificial Sequence
  Synthetic oligonucleotide; TTT chr11 5260757 5260778 5260762 5260757 -
gtcttttttaactgctgtttct

SEQ ID NO: 138029 - DNA, 22 bp, Artificial Sequence
  Synthetic oligonucleotide; TTG chr11 5260756 5260777 5260761 5260756 -
tcttttttaactgctgtttctt

SEQ ID NO: 138030 - DNA, 22 bp, Artificial Sequence
  Synthetic oligonucleotide; CTT chr11 5260752 5260773 5260757 5260752 -
ttttaactgctgtttctttaaa

SEQ ID NO: 138031 - DNA, 22 bp, Artificial Sequence
  Synthetic oligonucleotide; TTT chr11 5260751 5260772 5260756 5260751 -
tttaactgctgtttctttaaag

SEQ ID NO: 138032 - DNA, 22 bp, Artificial Sequence
  Synthetic oligonucleotide; TTT chr11 5260750 5260771 5260755 5260750 -
ttaactgctgtttctttaaagt

SEQ ID NO: 138033 - DNA, 22 bp, Artificial Sequence
  Synthetic oligonucleotide; TTT chr11 5260749 5260770 5260754 5260749 -
taactgctgtttctttaaagtt

SEQ ID NO: 138034 - DNA, 22 bp, Artificial Sequence
  Synthetic oligonucleotide; TTT chr11 5260748 5260769 5260753 5260748 -
aactgctgtttctttaaagttt

SEQ ID NO: 138035 - DNA, 22 bp, Artificial Sequence
  Synthetic oligonucleotide; TTA chr11 5260747 5260768 5260752 5260747 -
actgctgtttctttaaagtttg

SEQ ID NO: 138036 - DNA, 22 bp, Artificial Sequence
  Synthetic oligonucleotide; CTG chr11 5260743 5260764 5260748 5260743 -
ctgtttctttaaagtttgtttt

SEQ ID NO: 138037 - DNA, 22 bp, Artificial Sequence
  Synthetic oligonucleotide; CTG chr11 5260740 5260761 5260745 5260740 -
tttctttaaagtttgttttgtc

SEQ ID NO: 138038 - DNA, 22 bp, Artificial Sequence
  Synthetic oligonucleotide; TTT chr11 5260737 5260758 5260742 5260737 -
ctttaaagtttgttttgtctga

SEQ ID NO: 138039 - DNA, 22 bp, Artificial Sequence
  Synthetic oligonucleotide; TTC chr11 5260736 5260757 5260741 5260736 -
tttaaagtttgttttgtctgac

SEQ ID NO: 138040 - DNA, 22 bp, Artificial Sequence
  Synthetic oligonucleotide; CTT chr11 5260734 5260755 5260739 5260734 -
taaagtttgttttgtctgacat

SEQ ID NO: 138041 - DNA, 22 bp, Artificial Sequence
  Synthetic oligonucleotide; TTT chr11 5260733 5260754 5260738 5260733 -
aaagtttgttttgtctgacata

SEQ ID NO: 138042 - DNA, 22 bp, Artificial Sequence
  Synthetic oligonucleotide; TTA chr11 5260732 5260753 5260737 5260732 -
aagtttgttttgtctgacataa

SEQ ID NO: 138043 - DNA, 22 bp, Artificial Sequence
  Synthetic oligonucleotide; TTT chr11 5260726 5260747 5260731 5260726 -
gttttgtctgacataagaatag

SEQ ID NO: 138044 - DNA, 22 bp, Artificial Sequence
  Synthetic oligonucleotide; TTG chr11 5260725 5260746 5260730 5260725 -
ttttgtctgacataagaatagc

SEQ ID NO: 138045 - DNA, 22 bp, Artificial Sequence
  Synthetic oligonucleotide; TTT chr11 5260722 5260743 5260727 5260722 -
tgtctgacataagaatagctgc

SEQ ID NO: 138046 - DNA, 22 bp, Artificial Sequence
  Synthetic oligonucleotide; TTT chr11 5260721 5260742 5260726 5260721 -
gtctgacataagaatagctgct

SEQ ID NO: 138047 - DNA, 22 bp, Artificial Sequence
  Synthetic oligonucleotide; TTG chr11 5260720 5260741 5260725 5260720 -
tctgacataagaatagctgctt

SEQ ID NO: 138048 - DNA, 22 bp, Artificial Sequence
  Synthetic oligonucleotide; CTG chr11 5260716 5260737 5260721 5260716 -
acataagaatagctgctttggc

SEQ ID NO: 138049 - DNA, 22 bp, Artificial Sequence
  Synthetic oligonucleotide; CTG chr11 5260701 5260722 5260706 5260701 -
ctttggctcgcttttggtgtcc

SEQ ID NO: 138050 - DNA, 22 bp, Artificial Sequence
  Synthetic oligonucleotide; CTT chr11 5260698 5260719 5260703 5260698 -
tggctcgcttttggtgtccatt

SEQ ID NO: 138051 - DNA, 22 bp, Artificial Sequence
  Synthetic oligonucleotide; TTT chr11 5260697 5260718 5260702 5260697 -
ggctcgcttttggtgtccattt

SEQ ID NO: 138052 - DNA, 22 bp, Artificial Sequence
  Synthetic oligonucleotide; TTG chr11 5260696 5260717 5260701 5260696 -
gctcgcttttggtgtccatttg

SEQ ID NO: 138053 - DNA, 22 bp, Artificial Sequence
  Synthetic oligonucleotide; CTC chr11 5260692 5260713 5260697 5260692 -
gcttttggtgtccatttgtgtg

SEQ ID NO: 138054 - DNA, 22 bp, Artificial Sequence
  Synthetic oligonucleotide; CTT chr11 5260688 5260709 5260693 5260688 -
ttggtgtccatttgtgtggaat

SEQ ID NO: 138055 - DNA, 22 bp, Artificial Sequence
  Synthetic oligonucleotide; TTT chr11 5260687 5260708 5260692 5260687 -
tggtgtccatttgtgtggaatg

SEQ ID NO: 138056 - DNA, 22 bp, Artificial Sequence
  Synthetic oligonucleotide; TTT chr11 5260686 5260707 5260691 5260686 -
ggtgtccatttgtgtggaatgt

SEQ ID NO: 138057 - DNA, 22 bp, Artificial Sequence
  Synthetic oligonucleotide; TTG chr11 5260685 5260706 5260690 5260685 -
gtgtccatttgtgtggaatgtc

SEQ ID NO: 138058 - DNA, 22 bp, Artificial Sequence
  Synthetic oligonucleotide; TTT chr11 5260675 5260696 5260680 5260675 -
gtgtggaatgtcattttccacc

SEQ ID NO: 138059 - DNA, 22 bp, Artificial Sequence
  Synthetic oligonucleotide; TTG chr11 5260674 5260695 5260679 5260674 -
tgtggaatgtcattttccaccc

SEQ ID NO: 138060 - DNA, 22 bp, Artificial Sequence
  Synthetic oligonucleotide; TTT chr11 5260659 5260680 5260664 5260659 -
tccacccctttaccttaagttt

SEQ ID NO: 138061 - DNA, 22 bp, Artificial Sequence
  Synthetic oligonucleotide; TTT chr11 5260658 5260679 5260663 5260658 -
ccacccctttaccttaagttta

SEQ ID NO: 138062 - DNA, 22 bp, Artificial Sequence
  Synthetic oligonucleotide; TTC chr11 5260657 5260678 5260662 5260657 -
cacccctttaccttaagtttat

SEQ ID NO: 138063 - DNA, 22 bp, Artificial Sequence
  Synthetic oligonucleotide; CTT chr11 5260649 5260670 5260654 5260649 -
taccttaagtttatgtgagtcc

SEQ ID NO: 138064 - DNA, 22 bp, Artificial Sequence
  Synthetic oligonucleotide; TTT chr11 5260648 5260669 5260653 5260648 -
accttaagtttatgtgagtcct

SEQ ID NO: 138065 - DNA, 22 bp, Artificial Sequence
  Synthetic oligonucleotide; TTA chr11 5260647 5260668 5260652 5260647 -
ccttaagtttatgtgagtcctt

SEQ ID NO: 138066 - DNA, 22 bp, Artificial Sequence
  Synthetic oligonucleotide; CTT chr11 5260643 5260664 5260648 5260643 -
aagtttatgtgagtccttatgt

SEQ ID NO: 138067 - DNA, 22 bp, Artificial Sequence
  Synthetic oligonucleotide; TTA chr11 5260642 5260663 5260647 5260642 -
agtttatgtgagtccttatgtg

SEQ ID NO: 138068 - DNA, 22 bp, Artificial Sequence
  Synthetic oligonucleotide; TTT chr11 5260637 5260658 5260642 5260637 -
atgtgagtccttatgtgttagg

SEQ ID NO: 138069 - DNA, 22 bp, Artificial Sequence
  Synthetic oligonucleotide; TTA chr11 5260636 5260657 5260641 5260636 -
tgtgagtccttatgtgttaggt

SEQ ID NO: 138070 - DNA, 22 bp, Artificial Sequence
  Synthetic oligonucleotide; CTT chr11 5260625 5260646 5260630 5260625 -
atgtgttaggtgagtctcctga

SEQ ID NO: 138071 - DNA, 22 bp, Artificial Sequence
  Synthetic oligonucleotide; TTA chr11 5260624 5260645 5260629 5260624 -
tgtgttaggtgagtctcctgaa

SEQ ID NO: 138072 - DNA, 22 bp, Artificial Sequence
  Synthetic oligonucleotide; TTA chr11 5260617 5260638 5260622 5260617 -
ggtgagtctcctgaaggcggca

SEQ ID NO: 138073 - DNA, 22 bp, Artificial Sequence
  Synthetic oligonucleotide; CTC chr11 5260607 5260628 5260612 5260607 -
ctgaaggcggcagataactggt

SEQ ID NO: 138074 - DNA, 22 bp, Artificial Sequence
  Synthetic oligonucleotide; CTG chr11 5260604 5260625 5260609 5260604 -
aaggcggcagataactggttgg

SEQ ID NO: 138075 - DNA, 22 bp, Artificial Sequence
  Synthetic oligonucleotide; CTG chr11 5260587 5260608 5260592 5260587 -
gttggtgaattcttattcattc

SEQ ID NO: 138076 - DNA, 22 bp, Artificial Sequence
  Synthetic oligonucleotide; TTG chr11 5260583 5260604 5260588 5260583 -
gtgaattcttattcattctgca

SEQ ID NO: 138077 - DNA, 22 bp, Artificial Sequence
  Synthetic oligonucleotide; TTC chr11 5260575 5260596 5260580 5260575 -
ttattcattctgcaattctgta

SEQ ID NO: 138078 - DNA, 22 bp, Artificial Sequence
  Synthetic oligonucleotide; CTT chr11 5260573 5260594 5260578 5260573 -
attcattctgcaattctgtatc

SEQ ID NO: 138079 - DNA, 22 bp, Artificial Sequence
  Synthetic oligonucleotide; TTA chr11 5260572 5260593 5260577 5260572 -
ttcattctgcaattctgtatct

SEQ ID NO: 138080 - DNA, 22 bp, Artificial Sequence
  Synthetic oligonucleotide; TTC chr11 5260569 5260590 5260574 5260569 -
attctgcaattctgtatctttt

SEQ ID NO: 138081 - DNA, 22 bp, Artificial Sequence
  Synthetic oligonucleotide; TTC chr11 5260565 5260586 5260570 5260565 -
tgcaattctgtatcttttaagt

SEQ ID NO: 138082 - DNA, 22 bp, Artificial Sequence
  Synthetic oligonucleotide; CTG chr11 5260563 5260584 5260568 5260563 -
caattctgtatcttttaagtgg

SEQ ID NO: 138083 - DNA, 22 bp, Artificial Sequence
  Synthetic oligonucleotide; TTC chr11 5260557 5260578 5260562 5260557 -
tgtatcttttaagtggagcatt

SEQ ID NO: 138084 - DNA, 22 bp, Artificial Sequence
  Synthetic oligonucleotide; CTG chr11 5260555 5260576 5260560 5260555 -
tatcttttaagtggagcattta

SEQ ID NO: 138085 - DNA, 22 bp, Artificial Sequence
  Synthetic oligonucleotide; CTT chr11 5260549 5260570 5260554 5260549 -
ttaagtggagcatttagtccat

SEQ ID NO: 138086 - DNA, 22 bp, Artificial Sequence
  Synthetic oligonucleotide; TTT chr11 5260548 5260569 5260553 5260548 -
taagtggagcatttagtccatt

SEQ ID NO: 138087 - DNA, 22 bp, Artificial Sequence
  Synthetic oligonucleotide; TTT chr11 5260547 5260568 5260552 5260547 -
aagtggagcatttagtccattt

SEQ ID NO: 138088 - DNA, 22 bp, Artificial Sequence
  Synthetic oligonucleotide; TTA chr11 5260546 5260567 5260551 5260546 -
agtggagcatttagtccattta

SEQ ID NO: 138089 - DNA, 22 bp, Artificial Sequence
  Synthetic oligonucleotide; TTT chr11 5260534 5260555 5260539 5260534 -
agtccatttacattcaacatca

SEQ ID NO: 138090 - DNA, 22 bp, Artificial Sequence
  Synthetic oligonucleotide; TTA chr11 5260533 5260554 5260538 5260533 -
gtccatttacattcaacatcag

SEQ ID NO: 138091 - DNA, 22 bp, Artificial Sequence
  Synthetic oligonucleotide; TTT chr11 5260525 5260546 5260530 5260525 -
acattcaacatcagtattgagg

SEQ ID NO: 138092 - DNA, 22 bp, Artificial Sequence
  Synthetic oligonucleotide; TTA chr11 5260524 5260545 5260529 5260524 -
cattcaacatcagtattgaggt

SEQ ID NO: 138093 - DNA, 22 bp, Artificial Sequence
  Synthetic oligonucleotide; TTC chr11 5260519 5260540 5260524 5260519 -
aacatcagtattgaggtgtgag

SEQ ID NO: 138094 - DNA, 22 bp, Artificial Sequence
  Synthetic oligonucleotide; TTG chr11 5260506 5260527 5260511 5260506 -
aggtgtgaggtactattccatt

SEQ ID NO: 138095 - DNA, 22 bp, Artificial Sequence
  Synthetic oligonucleotide; CTA chr11 5260491 5260512 5260496 5260491 -
ttccattcttcgtggtatttgt

SEQ ID NO: 138096 - DNA, 22 bp, Artificial Sequence
  Synthetic oligonucleotide; TTC chr11 5260488 5260509 5260493 5260488 -
cattcttcgtggtatttgttgc

SEQ ID NO: 138097 - DNA, 22 bp, Artificial Sequence
  Synthetic oligonucleotide; TTC chr11 5260483 5260504 5260488 5260483 -
ttcgtggtatttgttgcctgtg

SEQ ID NO: 138098 - DNA, 22 bp, Artificial Sequence
  Synthetic oligonucleotide; CTT chr11 5260481 5260502 5260486 5260481 -
cgtggtatttgttgcctgtgta

SEQ ID NO: 138099 - DNA, 22 bp, Artificial Sequence
  Synthetic oligonucleotide; TTC chr11 5260480 5260501 5260485 5260480 -
gtggtatttgttgcctgtgtat

SEQ ID NO: 138100 - DNA, 22 bp, Artificial Sequence
  Synthetic oligonucleotide; TTT chr11 5260471 5260492 5260476 5260471 -
gttgcctgtgtatctttttatc

SEQ ID NO: 138101 - DNA, 22 bp, Artificial Sequence
  Synthetic oligonucleotide; TTG chr11 5260470 5260491 5260475 5260470 -
ttgcctgtgtatctttttatct

SEQ ID NO: 138102 - DNA, 22 bp, Artificial Sequence
  Synthetic oligonucleotide; TTG chr11 5260467 5260488 5260472 5260467 -
cctgtgtatctttttatctgta

SEQ ID NO: 138103 - DNA, 22 bp, Artificial Sequence
  Synthetic oligonucleotide; CTG chr11 5260463 5260484 5260468 5260463 -
tgtatctttttatctgtatttt

SEQ ID NO: 138104 - DNA, 22 bp, Artificial Sequence
  Synthetic oligonucleotide; CTT chr11 5260455 5260476 5260460 5260455 -
tttatctgtatttttgttgtat

SEQ ID NO: 138105 - DNA, 22 bp, Artificial Sequence
  Synthetic oligonucleotide; TTT chr11 5260454 5260475 5260459 5260454 -
ttatctgtatttttgttgtata

SEQ ID NO: 138106 - DNA, 22 bp, Artificial Sequence
  Synthetic oligonucleotide; TTT chr11 5260453 5260474 5260458 5260453 -
tatctgtatttttgttgtatat

SEQ ID NO: 138107 - DNA, 22 bp, Artificial Sequence
  Synthetic oligonucleotide; TTT chr11 5260452 5260473 5260457 5260452 -
atctgtatttttgttgtatatg

SEQ ID NO: 138108 - DNA, 22 bp, Artificial Sequence
  Synthetic oligonucleotide; TTA chr11 5260451 5260472 5260456 5260451 -
tctgtatttttgttgtatatgt

SEQ ID NO: 138109 - DNA, 22 bp, Artificial Sequence
  Synthetic oligonucleotide; CTG chr11 5260447 5260468 5260452 5260447 -
tatttttgttgtatatgtccta

SEQ ID NO: 138110 - DNA, 22 bp, Artificial Sequence
  Synthetic oligonucleotide; TTT chr11 5260442 5260463 5260447 5260442 -
ttgttgtatatgtcctatggga

SEQ ID NO: 138111 - DNA, 22 bp, Artificial Sequence
  Synthetic oligonucleotide; TTT chr11 5260441 5260462 5260446 5260441 -
tgttgtatatgtcctatgggat

SEQ ID NO: 138112 - DNA, 22 bp, Artificial Sequence
  Synthetic oligonucleotide; TTT chr11 5260440 5260461 5260445 5260440 -
gttgtatatgtcctatgggatt

SEQ ID NO: 138113 - DNA, 22 bp, Artificial Sequence
  Synthetic oligonucleotide; TTG chr11 5260439 5260460 5260444 5260439 -
ttgtatatgtcctatgggattt

SEQ ID NO: 138114 - DNA, 22 bp, Artificial Sequence
  Synthetic oligonucleotide; TTG chr11 5260436 5260457 5260441 5260436 -
tatatgtcctatgggatttatg

SEQ ID NO: 138115 - DNA, 22 bp, Artificial Sequence
  Synthetic oligonucleotide; CTA chr11 5260425 5260446 5260430 5260425 -
tgggatttatgctttaaagagg

SEQ ID NO: 138116 - DNA, 22 bp, Artificial Sequence
  Synthetic oligonucleotide; TTT chr11 5260417 5260438 5260422 5260417 -
atgctttaaagaggttctgttt

SEQ ID NO: 138117 - DNA, 22 bp, Artificial Sequence
  Synthetic oligonucleotide; TTA chr11 5260416 5260437 5260421 5260416 -
tgctttaaagaggttctgtttt

SEQ ID NO: 138118 - DNA, 22 bp, Artificial Sequence
  Synthetic oligonucleotide; CTT chr11 5260411 5260432 5260416 5260411 -
taaagaggttctgttttgatgt

SEQ ID NO: 138119 - DNA, 22 bp, Artificial Sequence
  Synthetic oligonucleotide; TTT chr11 5260410 5260431 5260415 5260410 -
aaagaggttctgttttgatgtg

SEQ ID NO: 138120 - DNA, 22 bp, Artificial Sequence
  Synthetic oligonucleotide; TTA chr11 5260409 5260430 5260414 5260409 -
aagaggttctgttttgatgtgc

SEQ ID NO: 138121 - DNA, 22 bp, Artificial Sequence
  Synthetic oligonucleotide; TTC chr11 5260400 5260421 5260405 5260400 -
tgttttgatgtgcttccagggt

SEQ ID NO: 138122 - DNA, 22 bp, Artificial Sequence
  Synthetic oligonucleotide; CTG chr11 5260398 5260419 5260403 5260398 -
ttttgatgtgcttccagggttt

SEQ ID NO: 138123 - DNA, 22 bp, Artificial Sequence
  Synthetic oligonucleotide; TTT chr11 5260395 5260416 5260400 5260395 -
tgatgtgcttccagggtttatt

SEQ ID NO: 138124 - DNA, 22 bp, Artificial Sequence
  Synthetic oligonucleotide; TTT chr11 5260394 5260415 5260399 5260394 -
gatgtgcttccagggtttattt

SEQ ID NO: 138125 - DNA, 22 bp, Artificial Sequence
  Synthetic oligonucleotide; TTG chr11 5260393 5260414 5260398 5260393 -
atgtgcttccagggtttatttc

SEQ ID NO: 138126 - DNA, 22 bp, Artificial Sequence
  Synthetic oligonucleotide; CTT chr11 5260385 5260406 5260390 5260385 -
ccagggtttatttcaagattta

SEQ ID NO: 138127 - DNA, 22 bp, Artificial Sequence
  Synthetic oligonucleotide; TTC chr11 5260384 5260405 5260389 5260384 -
cagggtttatttcaagatttag

SEQ ID NO: 138128 - DNA, 22 bp, Artificial Sequence
  Synthetic oligonucleotide; TTT chr11 5260376 5260397 5260381 5260376 -
atttcaagatttagagctcctt

SEQ ID NO: 138129 - DNA, 22 bp, Artificial Sequence
  Synthetic oligonucleotide; TTA chr11 5260375 5260396 5260380 5260375 -
tttcaagatttagagctccttt

SEQ ID NO: 138130 - DNA, 22 bp, Artificial Sequence
  Synthetic oligonucleotide; TTT chr11 5260372 5260393 5260377 5260372 -
caagatttagagctccttttat

SEQ ID NO: 138131 - DNA, 22 bp, Artificial Sequence
  Synthetic oligonucleotide; TTC chr11 5260371 5260392 5260376 5260371 -
aagatttagagctccttttatc

SEQ ID NO: 138132 - DNA, 22 bp, Artificial Sequence
  Synthetic oligonucleotide; TTT chr11 5260364 5260385 5260369 5260364 -
agagctccttttatcagttctt

SEQ ID NO: 138133 - DNA, 22 bp, Artificial Sequence
  Synthetic oligonucleotide; TTA chr11 5260363 5260384 5260368 5260363 -
gagctccttttatcagttcttg

SEQ ID NO: 138134 - DNA, 22 bp, Artificial Sequence
  Synthetic oligonucleotide; CTC chr11 5260357 5260378 5260362 5260357 -
cttttatcagttcttgtagtgt

SEQ ID NO: 138135 - DNA, 22 bp, Artificial Sequence
  Synthetic oligonucleotide; CTT chr11 5260354 5260375 5260359 5260354 -
ttatcagttcttgtagtgttgg

SEQ ID NO: 138136 - DNA, 22 bp, Artificial Sequence
  Synthetic oligonucleotide; TTT chr11 5260353 5260374 5260358 5260353 -
tatcagttcttgtagtgttggc

SEQ ID NO: 138137 - DNA, 22 bp, Artificial Sequence
  Synthetic oligonucleotide; TTT chr11 5260352 5260373 5260357 5260352 -
atcagttcttgtagtgttggct

SEQ ID NO: 138138 - DNA, 22 bp, Artificial Sequence
  Synthetic oligonucleotide; TTA chr11 5260351 5260372 5260356 5260351 -
tcagttcttgtagtgttggctt

SEQ ID NO: 138139 - DNA, 22 bp, Artificial Sequence
  Synthetic oligonucleotide; TTC chr11 5260344 5260365 5260349 5260344 -
ttgtagtgttggcttggtagtg

SEQ ID NO: 138140 - DNA, 22 bp, Artificial Sequence
  Synthetic oligonucleotide; CTT chr11 5260342 5260363 5260347 5260342 -
gtagtgttggcttggtagtgcc

SEQ ID NO: 138141 - DNA, 22 bp, Artificial Sequence
  Synthetic oligonucleotide; TTG chr11 5260341 5260362 5260346 5260341 -
tagtgttggcttggtagtgccg

SEQ ID NO: 138142 - DNA, 22 bp, Artificial Sequence
  Synthetic oligonucleotide; TTG chr11 5260333 5260354 5260338 5260333 -
gcttggtagtgccgaattctct

SEQ ID NO: 138143 - DNA, 22 bp, Artificial Sequence
  Synthetic oligonucleotide; CTT chr11 5260329 5260350 5260334 5260329 -
ggtagtgccgaattctctcagc

SEQ ID NO: 138144 - DNA, 22 bp, Artificial Sequence
  Synthetic oligonucleotide; TTG chr11 5260328 5260349 5260333 5260328 -
gtagtgccgaattctctcagca

SEQ ID NO: 138145 - DNA, 22 bp, Artificial Sequence
  Synthetic oligonucleotide; TTC chr11 5260314 5260335 5260319 5260314 -
tctcagcatttgtttttctgaa

SEQ ID NO: 138146 - DNA, 22 bp, Artificial Sequence
  Synthetic oligonucleotide; CTC chr11 5260312 5260333 5260317 5260312 -
tcagcatttgtttttctgaaaa

SEQ ID NO: 138147 - DNA, 22 bp, Artificial Sequence
  Synthetic oligonucleotide; CTC chr11 5260310 5260331 5260315 5260310 -
agcatttgtttttctgaaaaac

SEQ ID NO: 138148 - DNA, 22 bp, Artificial Sequence
  Synthetic oligonucleotide; TTT chr11 5260303 5260324 5260308 5260303 -
gtttttctgaaaaacactgtgt

SEQ ID NO: 138149 - DNA, 22 bp, Artificial Sequence
  Synthetic oligonucleotide; TTG chr11 5260302 5260323 5260307 5260302 -
tttttctgaaaaacactgtgta

SEQ ID NO: 138150 - DNA, 22 bp, Artificial Sequence
  Synthetic oligonucleotide; TTT chr11 5260299 5260320 5260304 5260299 -
ttctgaaaaacactgtgtattt

SEQ ID NO: 138151 - DNA, 22 bp, Artificial Sequence
  Synthetic oligonucleotide; TTT chr11 5260298 5260319 5260303 5260298 -
tctgaaaaacactgtgtatttt

SEQ ID NO: 138152 - DNA, 22 bp, Artificial Sequence
  Synthetic oligonucleotide; TTT chr11 5260297 5260318 5260302 5260297 -
ctgaaaaacactgtgtattttc

SEQ ID NO: 138153 - DNA, 22 bp, Artificial Sequence
  Synthetic oligonucleotide; TTC chr11 5260296 5260317 5260301 5260296 -
tgaaaaacactgtgtattttct

SEQ ID NO: 138154 - DNA, 22 bp, Artificial Sequence
  Synthetic oligonucleotide; CTG chr11 5260294 5260315 5260299 5260294 -
aaaaacactgtgtattttcttc

SEQ ID NO: 138155 - DNA, 22 bp, Artificial Sequence
  Synthetic oligonucleotide; CTG chr11 5260284 5260305 5260289 5260284 -
tgtattttcttcatttgtgaag

SEQ ID NO: 138156 - DNA, 22 bp, Artificial Sequence
  Synthetic oligonucleotide; TTT chr11 5260277 5260298 5260282 5260277 -
tcttcatttgtgaagcttagtt

SEQ ID NO: 138157 - DNA, 22 bp, Artificial Sequence
  Synthetic oligonucleotide; TTT chr11 5260276 5260297 5260281 5260276 -
cttcatttgtgaagcttagttt

SEQ ID NO: 138158 - DNA, 22 bp, Artificial Sequence
  Synthetic oligonucleotide; TTC chr11 5260275 5260296 5260280 5260275 -
ttcatttgtgaagcttagtttc

SEQ ID NO: 138159 - DNA, 22 bp, Artificial Sequence
  Synthetic oligonucleotide; CTT chr11 5260273 5260294 5260278 5260273 -
catttgtgaagcttagtttcac

SEQ ID NO: 138160 - DNA, 22 bp, Artificial Sequence
  Synthetic oligonucleotide; TTC chr11 5260272 5260293 5260277 5260272 -
atttgtgaagcttagtttcact

SEQ ID NO: 138161 - DNA, 22 bp, Artificial Sequence
  Synthetic oligonucleotide; TTT chr11 5260268 5260289 5260273 5260268 -
gtgaagcttagtttcactggat

SEQ ID NO: 138162 - DNA, 22 bp, Artificial Sequence
  Synthetic oligonucleotide; TTG chr11 5260267 5260288 5260272 5260267 -
tgaagcttagtttcactggata

SEQ ID NO: 138163 - DNA, 22 bp, Artificial Sequence
  Synthetic oligonucleotide; CTT chr11 5260259 5260280 5260264 5260259 -
agtttcactggatataaaattc

SEQ ID NO: 138164 - DNA, 22 bp, Artificial Sequence
  Synthetic oligonucleotide; TTA chr11 5260258 5260279 5260263 5260258 -
gtttcactggatataaaattct

SEQ ID NO: 138165 - DNA, 22 bp, Artificial Sequence
  Synthetic oligonucleotide; TTT chr11 5260254 5260275 5260259 5260254 -
cactggatataaaattcttggc

SEQ ID NO: 138166 - DNA, 22 bp, Artificial Sequence
  Synthetic oligonucleotide; TTC chr11 5260253 5260274 5260258 5260253 -
actggatataaaattcttggct

SEQ ID NO: 138167 - DNA, 22 bp, Artificial Sequence
  Synthetic oligonucleotide; CTG chr11 5260249 5260270 5260254 5260249 -
gatataaaattcttggctgata

SEQ ID NO: 138168 - DNA, 22 bp, Artificial Sequence
  Synthetic oligonucleotide; TTC chr11 5260237 5260258 5260242 5260237 -
ttggctgataattgttttgttt

SEQ ID NO: 138169 - DNA, 22 bp, Artificial Sequence
  Synthetic oligonucleotide; CTT chr11 5260235 5260256 5260240 5260235 -
ggctgataattgttttgtttaa

SEQ ID NO: 138170 - DNA, 22 bp, Artificial Sequence
  Synthetic oligonucleotide; TTG chr11 5260234 5260255 5260239 5260234 -
gctgataattgttttgtttaag

SEQ ID NO: 138171 - DNA, 22 bp, Artificial Sequence
  Synthetic oligonucleotide; CTG chr11 5260230 5260251 5260235 5260230 -
ataattgttttgtttaagaagg

SEQ ID NO: 138172 - DNA, 22 bp, Artificial Sequence
  Synthetic oligonucleotide; TTG chr11 5260223 5260244 5260228 5260223 -
ttttgtttaagaaggctgaaga

SEQ ID NO: 138173 - DNA, 22 bp, Artificial Sequence
  Synthetic oligonucleotide; TTT chr11 5260220 5260241 5260225 5260220 -
tgtttaagaaggctgaagatag

SEQ ID NO: 138174 - DNA, 22 bp, Artificial Sequence
  Synthetic oligonucleotide; TTT chr11 5260219 5260240 5260224 5260219 -
gtttaagaaggctgaagatagg

SEQ ID NO: 138175 - DNA, 22 bp, Artificial Sequence
  Synthetic oligonucleotide; TTG chr11 5260218 5260239 5260223 5260218 -
tttaagaaggctgaagataggg

SEQ ID NO: 138176 - DNA, 22 bp, Artificial Sequence
  Synthetic oligonucleotide; TTT chr11 5260215 5260236 5260220 5260215 -
aagaaggctgaagatagggcca

SEQ ID NO: 138177 - DNA, 22 bp, Artificial Sequence
  Synthetic oligonucleotide; TTA chr11 5260214 5260235 5260219 5260214 -
agaaggctgaagatagggccat

SEQ ID NO: 138178 - DNA, 22 bp, Artificial Sequence
  Synthetic oligonucleotide; CTG chr11 5260205 5260226 5260210 5260205 -
aagatagggccatattcacttc

SEQ ID NO: 138179 - DNA, 22 bp, Artificial Sequence
  Synthetic oligonucleotide; TTC chr11 5260188 5260209 5260193 5260188 -
acttctagcttttacggtttct

SEQ ID NO: 138180 - DNA, 22 bp, Artificial Sequence
  Synthetic oligonucleotide; CTT chr11 5260184 5260205 5260189 5260184 -
ctagcttttacggtttctgctg

SEQ ID NO: 138181 - DNA, 22 bp, Artificial Sequence
  Synthetic oligonucleotide; TTC chr11 5260183 5260204 5260188 5260183 -
tagcttttacggtttctgctga

SEQ ID NO: 138182 - DNA, 22 bp, Artificial Sequence
  Synthetic oligonucleotide; CTA chr11 5260181 5260202 5260186 5260181 -
gcttttacggtttctgctgaga

SEQ ID NO: 138183 - DNA, 22 bp, Artificial Sequence
  Synthetic oligonucleotide; CTT chr11 5260177 5260198 5260182 5260177 -
ttacggtttctgctgagaaatc

SEQ ID NO: 138184 - DNA, 22 bp, Artificial Sequence
  Synthetic oligonucleotide; TTT chr11 5260176 5260197 5260181 5260176 -
tacggtttctgctgagaaatct

SEQ ID NO: 138185 - DNA, 22 bp, Artificial Sequence
  Synthetic oligonucleotide; TTT chr11 5260175 5260196 5260180 5260175 -
acggtttctgctgagaaatctg

SEQ ID NO: 138186 - DNA, 22 bp, Artificial Sequence
  Synthetic oligonucleotide; TTA chr11 5260174 5260195 5260179 5260174 -
cggtttctgctgagaaatctgc

SEQ ID NO: 138187 - DNA, 22 bp, Artificial Sequence
  Synthetic oligonucleotide; TTT chr11 5260168 5260189 5260173 5260168 -
ctgctgagaaatctgctgttaa

SEQ ID NO: 138188 - DNA, 22 bp, Artificial Sequence
  Synthetic oligonucleotide; TTC chr11 5260167 5260188 5260172 5260167 -
tgctgagaaatctgctgttaat

SEQ ID NO: 138189 - DNA, 22 bp, Artificial Sequence
  Synthetic oligonucleotide; CTG chr11 5260165 5260186 5260170 5260165 -
ctgagaaatctgctgttaatct

SEQ ID NO: 138190 - DNA, 22 bp, Artificial Sequence
  Synthetic oligonucleotide; CTG chr11 5260162 5260183 5260167 5260162 -
agaaatctgctgttaatctgat

SEQ ID NO: 138191 - DNA, 22 bp, Artificial Sequence
  Synthetic oligonucleotide; CTG chr11 5260153 5260174 5260158 5260153 -
ctgttaatctgataggttttct

SEQ ID NO: 138192 - DNA, 22 bp, Artificial Sequence
  Synthetic oligonucleotide; CTG chr11 5260150 5260171 5260155 5260150 -
ttaatctgataggttttctttc

SEQ ID NO: 138193 - DNA, 22 bp, Artificial Sequence
  Synthetic oligonucleotide; TTA chr11 5260147 5260168 5260152 5260147 -
atctgataggttttctttcata

SEQ ID NO: 138194 - DNA, 22 bp, Artificial Sequence
  Synthetic oligonucleotide; CTG chr11 5260142 5260163 5260147 5260142 -
ataggttttctttcataggtta

SEQ ID NO: 138195 - DNA, 22 bp, Artificial Sequence
  Synthetic oligonucleotide; TTT chr11 5260134 5260155 5260139 5260134 -
tctttcataggttacctggtag

SEQ ID NO: 138196 - DNA, 22 bp, Artificial Sequence
  Synthetic oligonucleotide; TTT chr11 5260133 5260154 5260138 5260133 -
ctttcataggttacctggtagt

SEQ ID NO: 138197 - DNA, 22 bp, Artificial Sequence
  Synthetic oligonucleotide; TTC chr11 5260132 5260153 5260137 5260132 -
tttcataggttacctggtagtt

SEQ ID NO: 138198 - DNA, 22 bp, Artificial Sequence
  Synthetic oligonucleotide; CTT chr11 5260130 5260151 5260135 5260130 -
tcataggttacctggtagtttc

SEQ ID NO: 138199 - DNA, 22 bp, Artificial Sequence
  Synthetic oligonucleotide; TTT chr11 5260129 5260150 5260134 5260129 -
cataggttacctggtagtttca

SEQ ID NO: 138200 - DNA, 22 bp, Artificial Sequence
  Synthetic oligonucleotide; TTC chr11 5260128 5260149 5260133 5260128 -
ataggttacctggtagtttcac

SEQ ID NO: 138201 - DNA, 22 bp, Artificial Sequence
  Synthetic oligonucleotide; TTA chr11 5260120 5260141 5260125 5260120 -
cctggtagtttcacctcacagc

SEQ ID NO: 138202 - DNA, 22 bp, Artificial Sequence
  Synthetic oligonucleotide; CTG chr11 5260116 5260137 5260121 5260116 -
gtagtttcacctcacagctctt

SEQ ID NO: 138203 - DNA, 22 bp, Artificial Sequence
  Synthetic oligonucleotide; TTT chr11 5260109 5260130 5260114 5260109 -
cacctcacagctcttaagattc

SEQ ID NO: 138204 - DNA, 22 bp, Artificial Sequence
  Synthetic oligonucleotide; TTC chr11 5260108 5260129 5260113 5260108 -
acctcacagctcttaagattct

SEQ ID NO: 138205 - DNA, 22 bp, Artificial Sequence
  Synthetic oligonucleotide; CTC chr11 5260103 5260124 5260108 5260103 -
acagctcttaagattctctttg

SEQ ID NO: 138206 - DNA, 22 bp, Artificial Sequence
  Synthetic oligonucleotide; CTC chr11 5260096 5260117 5260101 5260096 -
ttaagattctctttgtctttag

SEQ ID NO: 138207 - DNA, 22 bp, Artificial Sequence
  Synthetic oligonucleotide; CTT chr11 5260094 5260115 5260099 5260094 -
aagattctctttgtctttagat

SEQ ID NO: 138208 - DNA, 22 bp, Artificial Sequence
  Synthetic oligonucleotide; TTA chr11 5260093 5260114 5260098 5260093 -
agattctctttgtctttagata

SEQ ID NO: 138209 - DNA, 22 bp, Artificial Sequence
  Synthetic oligonucleotide; TTC chr11 5260087 5260108 5260092 5260087 -
tctttgtctttagataactttg

SEQ ID NO: 138210 - DNA, 22 bp, Artificial Sequence
  Synthetic oligonucleotide; CTC chr11 5260085 5260106 5260090 5260085 -
tttgtctttagataactttgga

SEQ ID NO: 138211 - DNA, 22 bp, Artificial Sequence
  Synthetic oligonucleotide; CTT chr11 5260083 5260104 5260088 5260083 -
tgtctttagataactttggata

SEQ ID NO: 138212 - DNA, 22 bp, Artificial Sequence
  Synthetic oligonucleotide; TTT chr11 5260082 5260103 5260087 5260082 -
gtctttagataactttggatac

SEQ ID NO: 138213 - DNA, 22 bp, Artificial Sequence
  Synthetic oligonucleotide; TTG chr11 5260081 5260102 5260086 5260081 -
tctttagataactttggatact

SEQ ID NO: 138214 - DNA, 22 bp, Artificial Sequence
  Synthetic oligonucleotide; CTT chr11 5260077 5260098 5260082 5260077 -
tagataactttggatactctga

SEQ ID NO: 138215 - DNA, 22 bp, Artificial Sequence
  Synthetic oligonucleotide; TTT chr11 5260076 5260097 5260081 5260076 -
agataactttggatactctgat

SEQ ID NO: 138216 - DNA, 22 bp, Artificial Sequence
  Synthetic oligonucleotide; TTA chr11 5260075 5260096 5260080 5260075 -
gataactttggatactctgatg

SEQ ID NO: 138217 - DNA, 22 bp, Artificial Sequence
  Synthetic oligonucleotide; CTT chr11 5260067 5260088 5260072 5260067 -
tggatactctgatgacaatgta

SEQ ID NO: 138218 - DNA, 22 bp, Artificial Sequence
  Synthetic oligonucleotide; TTT chr11 5260066 5260087 5260071 5260066 -
ggatactctgatgacaatgtac

SEQ ID NO: 138219 - DNA, 22 bp, Artificial Sequence
  Synthetic oligonucleotide; TTG chr11 5260065 5260086 5260070 5260065 -
gatactctgatgacaatgtacc

SEQ ID NO: 138220 - DNA, 22 bp, Artificial Sequence
  Synthetic oligonucleotide; CTC chr11 5260058 5260079 5260063 5260058 -
tgatgacaatgtacctaggcaa

SEQ ID NO: 138221 - DNA, 22 bp, Artificial Sequence
  Synthetic oligonucleotide; CTG chr11 5260056 5260077 5260061 5260056 -
atgacaatgtacctaggcaatg

SEQ ID NO: 138222 - DNA, 22 bp, Artificial Sequence
  Synthetic oligonucleotide; CTA chr11 5260041 5260062 5260046 5260041 -
ggcaatgatatttttgcaatga

SEQ ID NO: 138223 - DNA, 22 bp, Artificial Sequence
  Synthetic oligonucleotide; TTT chr11 5260028 5260049 5260033 5260028 -
ttgcaatgaatttcccaggtgt

SEQ ID NO: 138224 - DNA, 22 bp, Artificial Sequence
  Synthetic oligonucleotide; TTT chr11 5260027 5260048 5260032 5260027 -
tgcaatgaatttcccaggtgtt

SEQ ID NO: 138225 - DNA, 22 bp, Artificial Sequence
  Synthetic oligonucleotide; TTT chr11 5260026 5260047 5260031 5260026 -
gcaatgaatttcccaggtgttt

SEQ ID NO: 138226 - DNA, 22 bp, Artificial Sequence
  Synthetic oligonucleotide; TTG chr11 5260025 5260046 5260030 5260025 -
caatgaatttcccaggtgttta

SEQ ID NO: 138227 - DNA, 22 bp, Artificial Sequence
  Synthetic oligonucleotide; TTT chr11 5260015 5260036 5260020 5260015 -
cccaggtgtttattgagcttct

SEQ ID NO: 138228 - DNA, 22 bp, Artificial Sequence
  Synthetic oligonucleotide; TTC chr11 5260014 5260035 5260019 5260014 -
ccaggtgtttattgagcttctt

SEQ ID NO: 138229 - DNA, 22 bp, Artificial Sequence
  Synthetic oligonucleotide; TTT chr11 5260004 5260025 5260009 5260004 -
attgagcttcttgtatttggat

SEQ ID NO: 138230 - DNA, 22 bp, Artificial Sequence
  Synthetic oligonucleotide; TTA chr11 5260003 5260024 5260008 5260003 -
ttgagcttcttgtatttggata

SEQ ID NO: 138231 - DNA, 22 bp, Artificial Sequence
  Synthetic oligonucleotide; TTG chr11 5260000 5260021 5260005 5260000 -
agcttcttgtatttggatatct

SEQ ID NO: 138232 - DNA, 22 bp, Artificial Sequence
  Synthetic oligonucleotide; CTT chr11 5259995 5260016 5260000 5259995 -
cttgtatttggatatctaggtc

SEQ ID NO: 138233 - DNA, 22 bp, Artificial Sequence
  Synthetic oligonucleotide; TTC chr11 5259994 5260015 5259999 5259994 -
ttgtatttggatatctaggtct

SEQ ID NO: 138234 - DNA, 22 bp, Artificial Sequence
  Synthetic oligonucleotide; CTT chr11 5259992 5260013 5259997 5259992 -
gtatttggatatctaggtctct

SEQ ID NO: 138235 - DNA, 22 bp, Artificial Sequence
  Synthetic oligonucleotide; TTG chr11 5259991 5260012 5259996 5259991 -
tatttggatatctaggtctcta

SEQ ID NO: 138236 - DNA, 22 bp, Artificial Sequence
  Synthetic oligonucleotide; TTT chr11 5259986 5260007 5259991 5259986 -
ggatatctaggtctctagcaag

SEQ ID NO: 138237 - DNA, 22 bp, Artificial Sequence
  Synthetic oligonucleotide; TTG chr11 5259985 5260006 5259990 5259985 -
gatatctaggtctctagcaagg

SEQ ID NO: 138238 - DNA, 22 bp, Artificial Sequence
  Synthetic oligonucleotide; CTA chr11 5259977 5259998 5259982 5259977 -
ggtctctagcaaggtgggggaa

SEQ ID NO: 138239 - DNA, 22 bp, Artificial Sequence
  Synthetic oligonucleotide; CTC chr11 5259971 5259992 5259976 5259971 -
tagcaaggtgggggaagttttc

SEQ ID NO: 138240 - DNA, 22 bp, Artificial Sequence
  Synthetic oligonucleotide; CTA chr11 5259969 5259990 5259974 5259969 -
gcaaggtgggggaagttttcct

SEQ ID NO: 138241 - DNA, 22 bp, Artificial Sequence
  Synthetic oligonucleotide; TTT chr11 5259951 5259972 5259956 5259951 -
tccttgattatttccctggata

SEQ ID NO: 138242 - DNA, 22 bp, Artificial Sequence
  Synthetic oligonucleotide; TTT chr11 5259950 5259971 5259955 5259950 -
ccttgattatttccctggataa

SEQ ID NO: 138243 - DNA, 22 bp, Artificial Sequence
  Synthetic oligonucleotide; TTC chr11 5259949 5259970 5259954 5259949 -
cttgattatttccctggataag

SEQ ID NO: 138244 - DNA, 22 bp, Artificial Sequence
  Synthetic oligonucleotide; CTT chr11 5259946 5259967 5259951 5259946 -
gattatttccctggataagttt

SEQ ID NO: 138245 - DNA, 22 bp, Artificial Sequence
  Synthetic oligonucleotide; TTG chr11 5259945 5259966 5259950 5259945 -
attatttccctggataagtttt

SEQ ID NO: 138246 - DNA, 22 bp, Artificial Sequence
  Synthetic oligonucleotide; TTA chr11 5259941 5259962 5259946 5259941 -
tttccctggataagttttccaa

SEQ ID NO: 138247 - DNA, 22 bp, Artificial Sequence
  Synthetic oligonucleotide; TTT chr11 5259938 5259959 5259943 5259938 -
ccctggataagttttccaaact

SEQ ID NO: 138248 - DNA, 22 bp, Artificial Sequence
  Synthetic oligonucleotide; TTC chr11 5259937 5259958 5259942 5259937 -
cctggataagttttccaaactt

SEQ ID NO: 138249 - DNA, 22 bp, Artificial Sequence
  Synthetic oligonucleotide; CTG chr11 5259933 5259954 5259938 5259933 -
gataagttttccaaacttttag

SEQ ID NO: 138250 - DNA, 22 bp, Artificial Sequence
  Synthetic oligonucleotide; TTT chr11 5259924 5259945 5259929 5259924 -
tccaaacttttagatttctctt

SEQ ID NO: 138251 - DNA, 22 bp, Artificial Sequence
  Synthetic oligonucleotide; TTT chr11 5259923 5259944 5259928 5259923 -
ccaaacttttagatttctcttc

SEQ ID NO: 138252 - DNA, 22 bp, Artificial Sequence
  Synthetic oligonucleotide; TTC chr11 5259922 5259943 5259927 5259922 -
caaacttttagatttctcttct

SEQ ID NO: 138253 - DNA, 22 bp, Artificial Sequence
  Synthetic oligonucleotide; CTT chr11 5259915 5259936 5259920 5259915 -
ttagatttctcttctttctcag

SEQ ID NO: 138254 - DNA, 22 bp, Artificial Sequence
  Synthetic oligonucleotide; TTT chr11 5259914 5259935 5259919 5259914 -
tagatttctcttctttctcagg

SEQ ID NO: 138255 - DNA, 22 bp, Artificial Sequence
  Synthetic oligonucleotide; TTT chr11 5259913 5259934 5259918 5259913 -
agatttctcttctttctcagga

SEQ ID NO: 138256 - DNA, 22 bp, Artificial Sequence
  Synthetic oligonucleotide; TTA chr11 5259912 5259933 5259917 5259912 -
gatttctcttctttctcaggaa

SEQ ID NO: 138257 - DNA, 22 bp, Artificial Sequence
  Synthetic oligonucleotide; TTT chr11 5259907 5259928 5259912 5259907 -
ctcttctttctcaggaatgctg

SEQ ID NO: 138258 - DNA, 22 bp, Artificial Sequence
  Synthetic oligonucleotide; TTC chr11 5259906 5259927 5259911 5259906 -
tcttctttctcaggaatgctga

SEQ ID NO: 138259 - DNA, 22 bp, Artificial Sequence
  Synthetic oligonucleotide; CTC chr11 5259904 5259925 5259909 5259904 -
ttctttctcaggaatgctgatt

SEQ ID NO: 138260 - DNA, 22 bp, Artificial Sequence
  Synthetic oligonucleotide; CTT chr11 5259902 5259923 5259907 5259902 -
ctttctcaggaatgctgattat

SEQ ID NO: 138261 - DNA, 22 bp, Artificial Sequence
  Synthetic oligonucleotide; TTC chr11 5259901 5259922 5259906 5259901 -
tttctcaggaatgctgattatt

SEQ ID NO: 138262 - DNA, 22 bp, Artificial Sequence
  Synthetic oligonucleotide; CTT chr11 5259899 5259920 5259904 5259899 -
tctcaggaatgctgattattct

SEQ ID NO: 138263 - DNA, 22 bp, Artificial Sequence
  Synthetic oligonucleotide; TTT chr11 5259898 5259919 5259903 5259898 -
ctcaggaatgctgattattctt

SEQ ID NO: 138264 - DNA, 22 bp, Artificial Sequence
  Synthetic oligonucleotide; TTC chr11 5259897 5259918 5259902 5259897 -
tcaggaatgctgattattctta

SEQ ID NO: 138265 - DNA, 22 bp, Artificial Sequence
  Synthetic oligonucleotide; CTC chr11 5259895 5259916 5259900 5259895 -
aggaatgctgattattcttagg

SEQ ID NO: 138266 - DNA, 22 bp, Artificial Sequence
  Synthetic oligonucleotide; CTG chr11 5259885 5259906 5259890 5259885 -
attattcttaggtttgattgtt

SEQ ID NO: 138267 - DNA, 22 bp, Artificial Sequence
  Synthetic oligonucleotide; TTA chr11 5259881 5259902 5259886 5259881 -
ttcttaggtttgattgtttaac

SEQ ID NO: 138268 - DNA, 22 bp, Artificial Sequence
  Synthetic oligonucleotide; TTC chr11 5259878 5259899 5259883 5259878 -
ttaggtttgattgtttaacata

SEQ ID NO: 138269 - DNA, 22 bp, Artificial Sequence
  Synthetic oligonucleotide; CTT chr11 5259876 5259897 5259881 5259876 -
aggtttgattgtttaacataat

SEQ ID NO: 138270 - DNA, 22 bp, Artificial Sequence
  Synthetic oligonucleotide; TTA chr11 5259875 5259896 5259880 5259875 -
ggtttgattgtttaacataatc

SEQ ID NO: 138271 - DNA, 22 bp, Artificial Sequence
  Synthetic oligonucleotide; TTT chr11 5259870 5259891 5259875 5259870 -
gattgtttaacataatcccaga

SEQ ID NO: 138272 - DNA, 22 bp, Artificial Sequence
  Synthetic oligonucleotide; TTG chr11 5259869 5259890 5259874 5259869 -
attgtttaacataatcccagat

SEQ ID NO: 138273 - DNA, 22 bp, Artificial Sequence
  Synthetic oligonucleotide; TTG chr11 5259865 5259886 5259870 5259865 -
tttaacataatcccagatttct

SEQ ID NO: 138274 - DNA, 22 bp, Artificial Sequence
  Synthetic oligonucleotide; TTT chr11 5259862 5259883 5259867 5259862 -
aacataatcccagatttcttgg

SEQ ID NO: 138275 - DNA, 22 bp, Artificial Sequence
  Synthetic oligonucleotide; TTA chr11 5259861 5259882 5259866 5259861 -
acataatcccagatttcttgga

SEQ ID NO: 138276 - DNA, 22 bp, Artificial Sequence
  Synthetic oligonucleotide; TTT chr11 5259845 5259866 5259850 5259845 -
cttggaggctttgttcatattt

SEQ ID NO: 138277 - DNA, 22 bp, Artificial Sequence
  Synthetic oligonucleotide; TTC chr11 5259844 5259865 5259849 5259844 -
ttggaggctttgttcatatttt

SEQ ID NO: 138278 - DNA, 22 bp, Artificial Sequence
  Synthetic oligonucleotide; CTT chr11 5259842 5259863 5259847 5259842 -
ggaggctttgttcatattttct

SEQ ID NO: 138279 - DNA, 22 bp, Artificial Sequence
  Synthetic oligonucleotide; TTG chr11 5259841 5259862 5259846 5259841 -
gaggctttgttcatattttctt

SEQ ID NO: 138280 - DNA, 22 bp, Artificial Sequence
  Synthetic oligonucleotide; CTT chr11 5259834 5259855 5259839 5259834 -
tgttcatattttcttattcttt

SEQ ID NO: 138281 - DNA, 22 bp, Artificial Sequence
  Synthetic oligonucleotide; TTT chr11 5259833 5259854 5259838 5259833 -
gttcatattttcttattctttt

SEQ ID NO: 138282 - DNA, 22 bp, Artificial Sequence
  Synthetic oligonucleotide; TTG chr11 5259832 5259853 5259837 5259832 -
ttcatattttcttattcttttt

SEQ ID NO: 138283 - DNA, 22 bp, Artificial Sequence
  Synthetic oligonucleotide; TTC chr11 5259829 5259850 5259834 5259829 -
atattttcttattcttttttct

SEQ ID NO: 138284 - DNA, 22 bp, Artificial Sequence
  Synthetic oligonucleotide; TTT chr11 5259823 5259844 5259828 5259823 -
tcttattcttttttctttgtct

SEQ ID NO: 138285 - DNA, 22 bp, Artificial Sequence
  Synthetic oligonucleotide; TTT chr11 5259822 5259843 5259827 5259822 -
cttattcttttttctttgtctt

SEQ ID NO: 138286 - DNA, 22 bp, Artificial Sequence
  Synthetic oligonucleotide; TTC chr11 5259821 5259842 5259826 5259821 -
ttattcttttttctttgtcttt

SEQ ID NO: 138287 - DNA, 22 bp, Artificial Sequence
  Synthetic oligonucleotide; CTT chr11 5259819 5259840 5259824 5259819 -
attcttttttctttgtctttgt

SEQ ID NO: 138288 - DNA, 22 bp, Artificial Sequence
  Synthetic oligonucleotide; TTA chr11 5259818 5259839 5259823 5259818 -
ttcttttttctttgtctttgtt

SEQ ID NO: 138289 - DNA, 22 bp, Artificial Sequence
  Synthetic oligonucleotide; TTC chr11 5259815 5259836 5259820 5259815 -
ttttttctttgtctttgttgga

SEQ ID NO: 138290 - DNA, 22 bp, Artificial Sequence
  Synthetic oligonucleotide; CTT chr11 5259813 5259834 5259818 5259813 -
ttttctttgtctttgttggatt

SEQ ID NO: 138291 - DNA, 22 bp, Artificial Sequence
  Synthetic oligonucleotide; TTT chr11 5259812 5259833 5259817 5259812 -
tttctttgtctttgttggattg

SEQ ID NO: 138292 - DNA, 22 bp, Artificial Sequence
  Synthetic oligonucleotide; TTT chr11 5259811 5259832 5259816 5259811 -
ttctttgtctttgttggattgg

SEQ ID NO: 138293 - DNA, 22 bp, Artificial Sequence
  Synthetic oligonucleotide; TTT chr11 5259810 5259831 5259815 5259810 -
tctttgtctttgttggattggg

SEQ ID NO: 138294 - DNA, 22 bp, Artificial Sequence
  Synthetic oligonucleotide; TTT chr11 5259809 5259830 5259814 5259809 -
ctttgtctttgttggattgggt

SEQ ID NO: 138295 - DNA, 22 bp, Artificial Sequence
  Synthetic oligonucleotide; TTC chr11 5259808 5259829 5259813 5259808 -
tttgtctttgttggattgggtt

SEQ ID NO: 138296 - DNA, 22 bp, Artificial Sequence
  Synthetic oligonucleotide; CTT chr11 5259806 5259827 5259811 5259806 -
tgtctttgttggattgggttaa

SEQ ID NO: 138297 - DNA, 22 bp, Artificial Sequence
  Synthetic oligonucleotide; TTT chr11 5259805 5259826 5259810 5259805 -
gtctttgttggattgggttaat

SEQ ID NO: 138298 - DNA, 22 bp, Artificial Sequence
  Synthetic oligonucleotide; TTG chr11 5259804 5259825 5259809 5259804 -
tctttgttggattgggttaatt

SEQ ID NO: 138299 - DNA, 22 bp, Artificial Sequence
  Synthetic oligonucleotide; CTT chr11 5259800 5259821 5259805 5259800 -
tgttggattgggttaattcaaa

SEQ ID NO: 138300 - DNA, 22 bp, Artificial Sequence
  Synthetic oligonucleotide; TTT chr11 5259799 5259820 5259804 5259799 -
gttggattgggttaattcaaaa

SEQ ID NO: 138301 - DNA, 22 bp, Artificial Sequence
  Synthetic oligonucleotide; TTG chr11 5259798 5259819 5259803 5259798 -
ttggattgggttaattcaaaaa

SEQ ID NO: 138302 - DNA, 22 bp, Artificial Sequence
  Synthetic oligonucleotide; TTG chr11 5259795 5259816 5259800 5259795 -
gattgggttaattcaaaaactt

SEQ ID NO: 138303 - DNA, 22 bp, Artificial Sequence
  Synthetic oligonucleotide; TTG chr11 5259790 5259811 5259795 5259790 -
ggttaattcaaaaactttgtct

SEQ ID NO: 138304 - DNA, 22 bp, Artificial Sequence
  Synthetic oligonucleotide; TTA chr11 5259785 5259806 5259790 5259785 -
attcaaaaactttgtcttcaag

SEQ ID NO: 138305 - DNA, 22 bp, Artificial Sequence
  Synthetic oligonucleotide; TTC chr11 5259781 5259802 5259786 5259781 -
aaaaactttgtcttcaagctct

SEQ ID NO: 138306 - DNA, 22 bp, Artificial Sequence
  Synthetic oligonucleotide; CTT chr11 5259773 5259794 5259778 5259773 -
tgtcttcaagctctgaatttct

SEQ ID NO: 138307 - DNA, 22 bp, Artificial Sequence
  Synthetic oligonucleotide; TTT chr11 5259772 5259793 5259777 5259772 -
gtcttcaagctctgaatttctt

SEQ ID NO: 138308 - DNA, 22 bp, Artificial Sequence
  Synthetic oligonucleotide; TTG chr11 5259771 5259792 5259776 5259771 -
tcttcaagctctgaatttcttc

SEQ ID NO: 138309 - DNA, 22 bp, Artificial Sequence
  Synthetic oligonucleotide; CTT chr11 5259767 5259788 5259772 5259767 -
caagctctgaatttcttctgct

SEQ ID NO: 138310 - DNA, 22 bp, Artificial Sequence
  Synthetic oligonucleotide; TTC chr11 5259766 5259787 5259771 5259766 -
aagctctgaatttcttctgctt

SEQ ID NO: 138311 - DNA, 22 bp, Artificial Sequence
  Synthetic oligonucleotide; CTC chr11 5259760 5259781 5259765 5259760 -
tgaatttcttctgcttggattc

SEQ ID NO: 138312 - DNA, 22 bp, Artificial Sequence
  Synthetic oligonucleotide; CTG chr11 5259758 5259779 5259763 5259758 -
aatttcttctgcttggattcta

SEQ ID NO: 138313 - DNA, 22 bp, Artificial Sequence
  Synthetic oligonucleotide; TTT chr11 5259753 5259774 5259758 5259753 -
cttctgcttggattctattgct

SEQ ID NO: 138314 - DNA, 22 bp, Artificial Sequence
  Synthetic oligonucleotide; TTC chr11 5259752 5259773 5259757 5259752 -
ttctgcttggattctattgctg

SEQ ID NO: 138315 - DNA, 22 bp, Artificial Sequence
  Synthetic oligonucleotide; CTT chr11 5259750 5259771 5259755 5259750 -
ctgcttggattctattgctgag

SEQ ID NO: 138316 - DNA, 22 bp, Artificial Sequence
  Synthetic oligonucleotide; TTC chr11 5259749 5259770 5259754 5259749 -
tgcttggattctattgctgaga

SEQ ID NO: 138317 - DNA, 22 bp, Artificial Sequence
  Synthetic oligonucleotide; CTG chr11 5259747 5259768 5259752 5259747 -
cttggattctattgctgagact

SEQ ID NO: 138318 - DNA, 22 bp, Artificial Sequence
  Synthetic oligonucleotide; CTT chr11 5259744 5259765 5259749 5259744 -
ggattctattgctgagactttc

SEQ ID NO: 138319 - DNA, 22 bp, Artificial Sequence
  Synthetic oligonucleotide; TTG chr11 5259743 5259764 5259748 5259743 -
gattctattgctgagactttct

SEQ ID NO: 138320 - DNA, 22 bp, Artificial Sequence
  Synthetic oligonucleotide; TTC chr11 5259738 5259759 5259743 5259738 -
tattgctgagactttctagagc

SEQ ID NO: 138321 - DNA, 22 bp, Artificial Sequence
  Synthetic oligonucleotide; CTA chr11 5259736 5259757 5259741 5259736 -
ttgctgagactttctagagcat

SEQ ID NO: 138322 - DNA, 22 bp, Artificial Sequence
  Synthetic oligonucleotide; TTG chr11 5259733 5259754 5259738 5259733 -
ctgagactttctagagcatttt

SEQ ID NO: 138323 - DNA, 22 bp, Artificial Sequence
  Synthetic oligonucleotide; CTG chr11 5259730 5259751 5259735 5259730 -
agactttctagagcattttgca

SEQ ID NO: 138324 - DNA, 22 bp, Artificial Sequence
  Synthetic oligonucleotide; CTT chr11 5259724 5259745 5259729 5259724 -
tctagagcattttgcatttcta

SEQ ID NO: 138325 - DNA, 22 bp, Artificial Sequence
  Synthetic oligonucleotide; TTT chr11 5259723 5259744 5259728 5259723 -
ctagagcattttgcatttctat

SEQ ID NO: 138326 - DNA, 22 bp, Artificial Sequence
  Synthetic oligonucleotide; TTC chr11 5259722 5259743 5259727 5259722 -
tagagcattttgcatttctata

SEQ ID NO: 138327 - DNA, 22 bp, Artificial Sequence
  Synthetic oligonucleotide; CTA chr11 5259720 5259741 5259725 5259720 -
gagcattttgcatttctataag

SEQ ID NO: 138328 - DNA, 22 bp, Artificial Sequence
  Synthetic oligonucleotide; TTT chr11 5259712 5259733 5259717 5259712 -
tgcatttctataagtgcatcca

SEQ ID NO: 138329 - DNA, 22 bp, Artificial Sequence
  Synthetic oligonucleotide; TTT chr11 5259711 5259732 5259716 5259711 -
gcatttctataagtgcatccat

SEQ ID NO: 138330 - DNA, 22 bp, Artificial Sequence
  Synthetic oligonucleotide; TTG chr11 5259710 5259731 5259715 5259710 -
catttctataagtgcatccatt

SEQ ID NO: 138331 - DNA, 22 bp, Artificial Sequence
  Synthetic oligonucleotide; TTT chr11 5259705 5259726 5259710 5259705 -
ctataagtgcatccattcatcc

SEQ ID NO: 138332 - DNA, 22 bp, Artificial Sequence
  Synthetic oligonucleotide; TTC chr11 5259704 5259725 5259709 5259704 -
tataagtgcatccattcatcca

SEQ ID NO: 138333 - DNA, 22 bp, Artificial Sequence
  Synthetic oligonucleotide; CTA chr11 5259702 5259723 5259707 5259702 -
taagtgcatccattcatccatt

SEQ ID NO: 138334 - DNA, 22 bp, Artificial Sequence
  Synthetic oligonucleotide; TTC chr11 5259687 5259708 5259692 5259687 -
atccattgtttcctgaagtttt

SEQ ID NO: 138335 - DNA, 22 bp, Artificial Sequence
  Synthetic oligonucleotide; TTG chr11 5259679 5259700 5259684 5259679 -
tttcctgaagttttgaatgttt

SEQ ID NO: 138336 - DNA, 22 bp, Artificial Sequence
  Synthetic oligonucleotide; TTT chr11 5259676 5259697 5259681 5259676 -
cctgaagttttgaatgtttttt

SEQ ID NO: 138337 - DNA, 22 bp, Artificial Sequence
  Synthetic oligonucleotide; TTC chr11 5259675 5259696 5259680 5259675 -
ctgaagttttgaatgtttttta

SEQ ID NO: 138338 - DNA, 22 bp, Artificial Sequence
  Synthetic oligonucleotide; CTG chr11 5259672 5259693 5259677 5259672 -
aagttttgaatgttttttattt

SEQ ID NO: 138339 - DNA, 22 bp, Artificial Sequence
  Synthetic oligonucleotide; TTT chr11 5259666 5259687 5259671 5259666 -
tgaatgttttttatttatgcta

SEQ ID NO: 138340 - DNA, 22 bp, Artificial Sequence
  Synthetic oligonucleotide; TTT chr11 5259665 5259686 5259670 5259665 -
gaatgttttttatttatgctat

SEQ ID NO: 138341 - DNA, 22 bp, Artificial Sequence
  Synthetic oligonucleotide; TTG chr11 5259664 5259685 5259669 5259664 -
aatgttttttatttatgctatc

SEQ ID NO: 138342 - DNA, 22 bp, Artificial Sequence
  Synthetic oligonucleotide; TTT chr11 5259657 5259678 5259662 5259657 -
tttatttatgctatctctttaa

SEQ ID NO: 138343 - DNA, 22 bp, Artificial Sequence
  Synthetic oligonucleotide; TTT chr11 5259656 5259677 5259661 5259656 -
ttatttatgctatctctttaac

SEQ ID NO: 138344 - DNA, 22 bp, Artificial Sequence
  Synthetic oligonucleotide; TTT chr11 5259655 5259676 5259660 5259655 -
tatttatgctatctctttaact

SEQ ID NO: 138345 - DNA, 22 bp, Artificial Sequence
  Synthetic oligonucleotide; TTT chr11 5259654 5259675 5259659 5259654 -
atttatgctatctctttaactg

SEQ ID NO: 138346 - DNA, 22 bp, Artificial Sequence
  Synthetic oligonucleotide; TTA chr11 5259653 5259674 5259658 5259653 -
tttatgctatctctttaactga

SEQ ID NO: 138347 - DNA, 22 bp, Artificial Sequence
  Synthetic oligonucleotide; TTT chr11 5259650 5259671 5259655 5259650 -
atgctatctctttaactgaaga

SEQ ID NO: 138348 - DNA, 22 bp, Artificial Sequence
  Synthetic oligonucleotide; TTA chr11 5259649 5259670 5259654 5259649 -
tgctatctctttaactgaagat

SEQ ID NO: 138349 - DNA, 22 bp, Artificial Sequence
  Synthetic oligonucleotide; CTA chr11 5259644 5259665 5259649 5259644 -
tctctttaactgaagatttctc

SEQ ID NO: 138350 - DNA, 22 bp, Artificial Sequence
  Synthetic oligonucleotide; CTC chr11 5259640 5259661 5259645 5259640 -
tttaactgaagatttctcccct

SEQ ID NO: 138351 - DNA, 22 bp, Artificial Sequence
  Synthetic oligonucleotide; CTT chr11 5259638 5259659 5259643 5259638 -
taactgaagatttctcccctca

SEQ ID NO: 138352 - DNA, 22 bp, Artificial Sequence
  Synthetic oligonucleotide; TTT chr11 5259637 5259658 5259642 5259637 -
aactgaagatttctcccctcat

SEQ ID NO: 138353 - DNA, 22 bp, Artificial Sequence
  Synthetic oligonucleotide; TTA chr11 5259636 5259657 5259641 5259636 -
actgaagatttctcccctcatt

SEQ ID NO: 138354 - DNA, 22 bp, Artificial Sequence
  Synthetic oligonucleotide; CTG chr11 5259632 5259653 5259637 5259632 -
aagatttctcccctcatttctt

SEQ ID NO: 138355 - DNA, 22 bp, Artificial Sequence
  Synthetic oligonucleotide; TTT chr11 5259625 5259646 5259630 5259625 -
ctcccctcatttcttgtatcat

SEQ ID NO: 138356 - DNA, 22 bp, Artificial Sequence
  Synthetic oligonucleotide; TTC chr11 5259624 5259645 5259629 5259624 -
tcccctcatttcttgtatcata

SEQ ID NO: 138357 - DNA, 22 bp, Artificial Sequence
  Synthetic oligonucleotide; CTC chr11 5259622 5259643 5259627 5259622 -
ccctcatttcttgtatcatatt

SEQ ID NO: 138358 - DNA, 22 bp, Artificial Sequence
  Synthetic oligonucleotide; CTC chr11 5259617 5259638 5259622 5259617 -
atttcttgtatcatatttttgg

SEQ ID NO: 138359 - DNA, 22 bp, Artificial Sequence
  Synthetic oligonucleotide; TTT chr11 5259613 5259634 5259618 5259613 -
cttgtatcatatttttggtttt

SEQ ID NO: 138360 - DNA, 22 bp, Artificial Sequence
  Synthetic oligonucleotide; TTC chr11 5259612 5259633 5259617 5259612 -
ttgtatcatatttttggttttt

SEQ ID NO: 138361 - DNA, 22 bp, Artificial Sequence
  Synthetic oligonucleotide; CTT chr11 5259610 5259631 5259615 5259610 -
gtatcatatttttggttttttt

SEQ ID NO: 138362 - DNA, 22 bp, Artificial Sequence
  Synthetic oligonucleotide; TTG chr11 5259609 5259630 5259614 5259609 -
tatcatatttttggttttttta

SEQ ID NO: 138363 - DNA, 22 bp, Artificial Sequence
  Synthetic oligonucleotide; TTT chr11 5259599 5259620 5259604 5259599 -
ttggtttttttaaaattggact

SEQ ID NO: 138364 - DNA, 22 bp, Artificial Sequence
  Synthetic oligonucleotide; TTT chr11 5259598 5259619 5259603 5259598 -
tggtttttttaaaattggactt

SEQ ID NO: 138365 - DNA, 22 bp, Artificial Sequence
  Synthetic oligonucleotide; TTT chr11 5259597 5259618 5259602 5259597 -
ggtttttttaaaattggacttc

SEQ ID NO: 138366 - DNA, 22 bp, Artificial Sequence
  Synthetic oligonucleotide; TTG chr11 5259596 5259617 5259601 5259596 -
gtttttttaaaattggacttca

SEQ ID NO: 138367 - DNA, 22 bp, Artificial Sequence
  Synthetic oligonucleotide; TTT chr11 5259592 5259613 5259597 5259592 -
ttttaaaattggacttcacctt

SEQ ID NO: 138368 - DNA, 22 bp, Artificial Sequence
  Synthetic oligonucleotide; TTT chr11 5259591 5259612 5259596 5259591 -
tttaaaattggacttcaccttc

SEQ ID NO: 138369 - DNA, 22 bp, Artificial Sequence
  Synthetic oligonucleotide; TTT chr11 5259590 5259611 5259595 5259590 -
ttaaaattggacttcaccttcc

SEQ ID NO: 138370 - DNA, 22 bp, Artificial Sequence
  Synthetic oligonucleotide; TTT chr11 5259589 5259610 5259594 5259589 -
taaaattggacttcaccttcct

SEQ ID NO: 138371 - DNA, 22 bp, Artificial Sequence
  Synthetic oligonucleotide; TTT chr11 5259588 5259609 5259593 5259588 -
aaaattggacttcaccttcctc

SEQ ID NO: 138372 - DNA, 22 bp, Artificial Sequence
  Synthetic oligonucleotide; TTA chr11 5259587 5259608 5259592 5259587 -
aaattggacttcaccttcctcg

SEQ ID NO: 138373 - DNA, 22 bp, Artificial Sequence
  Synthetic oligonucleotide; TTG chr11 5259581 5259602 5259586 5259581 -
gacttcaccttcctcggatgcc

SEQ ID NO: 138374 - DNA, 22 bp, Artificial Sequence
  Synthetic oligonucleotide; CTT chr11 5259576 5259597 5259581 5259576 -
caccttcctcggatgcctcctt

SEQ ID NO: 138375 - DNA, 22 bp, Artificial Sequence
  Synthetic oligonucleotide; TTC chr11 5259575 5259596 5259580 5259575 -
accttcctcggatgcctccttg

SEQ ID NO: 138376 - DNA, 22 bp, Artificial Sequence
  Synthetic oligonucleotide; CTT chr11 5259570 5259591 5259575 5259570 -
cctcggatgcctccttgattag

SEQ ID NO: 138377 - DNA, 22 bp, Artificial Sequence
  Synthetic oligonucleotide; TTC chr11 5259569 5259590 5259574 5259569 -
ctcggatgcctccttgattagc

SEQ ID NO: 138378 - DNA, 22 bp, Artificial Sequence
  Synthetic oligonucleotide; CTC chr11 5259566 5259587 5259571 5259566 -
ggatgcctccttgattagctta

SEQ ID NO: 138379 - DNA, 22 bp, Artificial Sequence
  Synthetic oligonucleotide; CTC chr11 5259557 5259578 5259562 5259557 -
cttgattagcttaataactgac

SEQ ID NO: 138380 - DNA, 22 bp, Artificial Sequence
  Synthetic oligonucleotide; CTT chr11 5259554 5259575 5259559 5259554 -
gattagcttaataactgacctt

SEQ ID NO: 138381 - DNA, 22 bp, Artificial Sequence
  Synthetic oligonucleotide; TTG chr11 5259553 5259574 5259558 5259553 -
attagcttaataactgaccttc

SEQ ID NO: 138382 - DNA, 22 bp, Artificial Sequence
  Synthetic oligonucleotide; TTA chr11 5259549 5259570 5259554 5259549 -
gcttaataactgaccttctgaa

SEQ ID NO: 138383 - DNA, 22 bp, Artificial Sequence
  Synthetic oligonucleotide; CTT chr11 5259545 5259566 5259550 5259545 -
aataactgaccttctgaattat

SEQ ID NO: 138384 - DNA, 22 bp, Artificial Sequence
  Synthetic oligonucleotide; TTA chr11 5259544 5259565 5259549 5259544 -
ataactgaccttctgaattatt

SEQ ID NO: 138385 - DNA, 22 bp, Artificial Sequence
  Synthetic oligonucleotide; CTG chr11 5259537 5259558 5259542 5259537 -
accttctgaattatttttcagg

SEQ ID NO: 138386 - DNA, 22 bp, Artificial Sequence
  Synthetic oligonucleotide; CTT chr11 5259532 5259553 5259537 5259532 -
ctgaattatttttcaggtaaat

SEQ ID NO: 138387 - DNA, 22 bp, Artificial Sequence
  Synthetic oligonucleotide; TTC chr11 5259531 5259552 5259536 5259531 -
tgaattatttttcaggtaaatc

SEQ ID NO: 138388 - DNA, 22 bp, Artificial Sequence
  Synthetic oligonucleotide; CTG chr11 5259529 5259550 5259534 5259529 -
aattatttttcaggtaaatcag

SEQ ID NO: 138389 - DNA, 22 bp, Artificial Sequence
  Synthetic oligonucleotide; TTA chr11 5259524 5259545 5259529 5259524 -
tttttcaggtaaatcagggatt

SEQ ID NO: 138390 - DNA, 22 bp, Artificial Sequence
  Synthetic oligonucleotide; TTT chr11 5259521 5259542 5259526 5259521 -
ttcaggtaaatcagggatttct

SEQ ID NO: 138391 - DNA, 22 bp, Artificial Sequence
  Synthetic oligonucleotide; TTT chr11 5259520 5259541 5259525 5259520 -
tcaggtaaatcagggatttctt

SEQ ID NO: 138392 - DNA, 22 bp, Artificial Sequence
  Synthetic oligonucleotide; TTT chr11 5259519 5259540 5259524 5259519 -
caggtaaatcagggatttcttc

SEQ ID NO: 138393 - DNA, 22 bp, Artificial Sequence
  Synthetic oligonucleotide; TTC chr11 5259518 5259539 5259523 5259518 -
aggtaaatcagggatttcttct

SEQ ID NO: 138394 - DNA, 22 bp, Artificial Sequence
  Synthetic oligonucleotide; TTT chr11 5259501 5259522 5259506 5259501 -
cttcttggtttggatgcattgc

SEQ ID NO: 138395 - DNA, 22 bp, Artificial Sequence
  Synthetic oligonucleotide; TTC chr11 5259500 5259521 5259505 5259500 -
ttcttggtttggatgcattgct

SEQ ID NO: 138396 - DNA, 22 bp, Artificial Sequence
  Synthetic oligonucleotide; CTT chr11 5259498 5259519 5259503 5259498 -
cttggtttggatgcattgctgg

SEQ ID NO: 138397 - DNA, 22 bp, Artificial Sequence
  Synthetic oligonucleotide; TTC chr11 5259497 5259518 5259502 5259497 -
ttggtttggatgcattgctggt

SEQ ID NO: 138398 - DNA, 22 bp, Artificial Sequence
  Synthetic oligonucleotide; CTT chr11 5259495 5259516 5259500 5259495 -
ggtttggatgcattgctggtga

SEQ ID NO: 138399 - DNA, 22 bp, Artificial Sequence
  Synthetic oligonucleotide; TTG chr11 5259494 5259515 5259499 5259494 -
gtttggatgcattgctggtgag

SEQ ID NO: 138400 - DNA, 22 bp, Artificial Sequence
  Synthetic oligonucleotide; TTT chr11 5259490 5259511 5259495 5259490 -
ggatgcattgctggtgagctag

SEQ ID NO: 138401 - DNA, 22 bp, Artificial Sequence
  Synthetic oligonucleotide; TTG chr11 5259489 5259510 5259494 5259489 -
gatgcattgctggtgagctagt

SEQ ID NO: 138402 - DNA, 22 bp, Artificial Sequence
  Synthetic oligonucleotide; TTG chr11 5259480 5259501 5259485 5259480 -
ctggtgagctagtatgattttt

SEQ ID NO: 138403 - DNA, 22 bp, Artificial Sequence
  Synthetic oligonucleotide; CTG chr11 5259477 5259498 5259482 5259477 -
gtgagctagtatgattttttgg

SEQ ID NO: 138404 - DNA, 22 bp, Artificial Sequence
  Synthetic oligonucleotide; CTA chr11 5259469 5259490 5259474 5259469 -
gtatgattttttggggggtgtt

SEQ ID NO: 138405 - DNA, 22 bp, Artificial Sequence
  Synthetic oligonucleotide; TTT chr11 5259460 5259481 5259465 5259460 -
tttggggggtgttaaagaacct

SEQ ID NO: 138406 - DNA, 22 bp, Artificial Sequence
  Synthetic oligonucleotide; TTT chr11 5259459 5259480 5259464 5259459 -
ttggggggtgttaaagaacctt

SEQ ID NO: 138407 - DNA, 22 bp, Artificial Sequence
  Synthetic oligonucleotide; TTT chr11 5259458 5259479 5259463 5259458 -
tggggggtgttaaagaaccttg

SEQ ID NO: 138408 - DNA, 22 bp, Artificial Sequence
  Synthetic oligonucleotide; TTT chr11 5259457 5259478 5259462 5259457 -
ggggggtgttaaagaaccttgt

SEQ ID NO: 138409 - DNA, 22 bp, Artificial Sequence
  Synthetic oligonucleotide; TTG chr11 5259456 5259477 5259461 5259456 -
gggggtgttaaagaaccttgtt

SEQ ID NO: 138410 - DNA, 22 bp, Artificial Sequence
  Synthetic oligonucleotide; TTA chr11 5259446 5259467 5259451 5259446 -
aagaaccttgtttttcatatta

SEQ ID NO: 138411 - DNA, 22 bp, Artificial Sequence
  Synthetic oligonucleotide; CTT chr11 5259437 5259458 5259442 5259437 -
gtttttcatattaccagagtta

SEQ ID NO: 138412 - DNA, 22 bp, Artificial Sequence
  Synthetic oligonucleotide; TTG chr11 5259436 5259457 5259441 5259436 -
tttttcatattaccagagttag

SEQ ID NO: 138413 - DNA, 22 bp, Artificial Sequence
  Synthetic oligonucleotide; TTT chr11 5259433 5259454 5259438 5259433 -
ttcatattaccagagttagttt

SEQ ID NO: 138414 - DNA, 22 bp, Artificial Sequence
  Synthetic oligonucleotide; TTT chr11 5259432 5259453 5259437 5259432 -
tcatattaccagagttagtttt

SEQ ID NO: 138415 - DNA, 22 bp, Artificial Sequence
  Synthetic oligonucleotide; TTT chr11 5259431 5259452 5259436 5259431 -
catattaccagagttagttttc

SEQ ID NO: 138416 - DNA, 22 bp, Artificial Sequence
  Synthetic oligonucleotide; TTC chr11 5259430 5259451 5259435 5259430 -
atattaccagagttagttttct

SEQ ID NO: 138417 - DNA, 22 bp, Artificial Sequence
  Synthetic oligonucleotide; TTA chr11 5259424 5259445 5259429 5259424 -
ccagagttagttttctggttcc

SEQ ID NO: 138418 - DNA, 22 bp, Artificial Sequence
  Synthetic oligonucleotide; TTA chr11 5259415 5259436 5259420 5259415 -
gttttctggttccttctcactt

SEQ ID NO: 138419 - DNA, 22 bp, Artificial Sequence
  Synthetic oligonucleotide; TTT chr11 5259411 5259432 5259416 5259411 -
tctggttccttctcacttgggt

SEQ ID NO: 138420 - DNA, 22 bp, Artificial Sequence
  Synthetic oligonucleotide; TTT chr11 5259410 5259431 5259415 5259410 -
ctggttccttctcacttgggta

SEQ ID NO: 138421 - DNA, 22 bp, Artificial Sequence
  Synthetic oligonucleotide; TTC chr11 5259409 5259430 5259414 5259409 -
tggttccttctcacttgggtag

SEQ ID NO: 138422 - DNA, 22 bp, Artificial Sequence
  Synthetic oligonucleotide; CTG chr11 5259407 5259428 5259412 5259407 -
gttccttctcacttgggtaggc

SEQ ID NO: 138423 - DNA, 22 bp, Artificial Sequence
  Synthetic oligonucleotide; TTC chr11 5259403 5259424 5259408 5259403 -
cttctcacttgggtaggctctg

SEQ ID NO: 138424 - DNA, 22 bp, Artificial Sequence
  Synthetic oligonucleotide; CTT chr11 5259400 5259421 5259405 5259400 -
ctcacttgggtaggctctgtca

SEQ ID NO: 138425 - DNA, 22 bp, Artificial Sequence
  Synthetic oligonucleotide; TTC chr11 5259399 5259420 5259404 5259399 -
tcacttgggtaggctctgtcag

SEQ ID NO: 138426 - DNA, 22 bp, Artificial Sequence
  Synthetic oligonucleotide; CTC chr11 5259397 5259418 5259402 5259397 -
acttgggtaggctctgtcagag

SEQ ID NO: 138427 - DNA, 22 bp, Artificial Sequence
  Synthetic oligonucleotide; CTT chr11 5259393 5259414 5259398 5259393 -
gggtaggctctgtcagagggaa

SEQ ID NO: 138428 - DNA, 22 bp, Artificial Sequence
  Synthetic oligonucleotide; TTG chr11 5259392 5259413 5259397 5259392 -
ggtaggctctgtcagagggaaa

SEQ ID NO: 138429 - DNA, 22 bp, Artificial Sequence
  Synthetic oligonucleotide; CTC chr11 5259383 5259404 5259388 5259383 -
tgtcagagggaaagtctaggcc

SEQ ID NO: 138430 - DNA, 22 bp, Artificial Sequence
  Synthetic oligonucleotide; CTG chr11 5259381 5259402 5259386 5259381 -
tcagagggaaagtctaggcctc

SEQ ID NO: 138431 - DNA, 22 bp, Artificial Sequence
  Synthetic oligonucleotide; CTA chr11 5259365 5259386 5259370 5259365 -
ggcctcaaggctgagacttttg

SEQ ID NO: 138432 - DNA, 22 bp, Artificial Sequence
  Synthetic oligonucleotide; CTC chr11 5259359 5259380 5259364 5259359 -
aaggctgagacttttgtcccat

SEQ ID NO: 138433 - DNA, 22 bp, Artificial Sequence
  Synthetic oligonucleotide; CTG chr11 5259352 5259373 5259357 5259352 -
agacttttgtcccatgaggtgt

SEQ ID NO: 138434 - DNA, 22 bp, Artificial Sequence
  Synthetic oligonucleotide; CTT chr11 5259346 5259367 5259351 5259346 -
ttgtcccatgaggtgttccctt

SEQ ID NO: 138435 - DNA, 22 bp, Artificial Sequence
  Synthetic oligonucleotide; TTT chr11 5259345 5259366 5259350 5259345 -
tgtcccatgaggtgttcccttg

SEQ ID NO: 138436 - DNA, 22 bp, Artificial Sequence
  Synthetic oligonucleotide; TTT chr11 5259344 5259365 5259349 5259344 -
gtcccatgaggtgttcccttga

SEQ ID NO: 138437 - DNA, 22 bp, Artificial Sequence
  Synthetic oligonucleotide; TTG chr11 5259343 5259364 5259348 5259343 -
tcccatgaggtgttcccttgat

SEQ ID NO: 138438 - DNA, 22 bp, Artificial Sequence
  Synthetic oligonucleotide; TTC chr11 5259328 5259349 5259333 5259328 -
ccttgatgtagcacagtccccc

SEQ ID NO: 138439 - DNA, 22 bp, Artificial Sequence
  Synthetic oligonucleotide; CTT chr11 5259324 5259345 5259329 5259324 -
gatgtagcacagtccccctttt

SEQ ID NO: 138440 - DNA, 22 bp, Artificial Sequence
  Synthetic oligonucleotide; TTG chr11 5259323 5259344 5259328 5259323 -
atgtagcacagtcccccttttc

SEQ ID NO: 138441 - DNA, 22 bp, Artificial Sequence
  Synthetic oligonucleotide; CTT chr11 5259304 5259325 5259309 5259304 -
ttcctaggcgtggggcttcctg

SEQ ID NO: 138442 - DNA, 22 bp, Artificial Sequence
  Synthetic oligonucleotide; TTT chr11 5259303 5259324 5259308 5259303 -
tcctaggcgtggggcttcctga

SEQ ID NO: 138443 - DNA, 22 bp, Artificial Sequence
  Synthetic oligonucleotide; TTT chr11 5259302 5259323 5259307 5259302 -
cctaggcgtggggcttcctgag

SEQ ID NO: 138444 - DNA, 22 bp, Artificial Sequence
  Synthetic oligonucleotide; TTC chr11 5259301 5259322 5259306 5259301 -
ctaggcgtggggcttcctgaga

SEQ ID NO: 138445 - DNA, 22 bp, Artificial Sequence
  Synthetic oligonucleotide; CTA chr11 5259298 5259319 5259303 5259298 -
ggcgtggggcttcctgagagcc

SEQ ID NO: 138446 - DNA, 22 bp, Artificial Sequence
  Synthetic oligonucleotide; CTT chr11 5259286 5259307 5259291 5259286 -
cctgagagccgaactgtagtga

SEQ ID NO: 138447 - DNA, 22 bp, Artificial Sequence
  Synthetic oligonucleotide; TTC chr11 5259285 5259306 5259290 5259285 -
ctgagagccgaactgtagtgat

SEQ ID NO: 138448 - DNA, 22 bp, Artificial Sequence
  Synthetic oligonucleotide; CTG chr11 5259282 5259303 5259287 5259282 -
agagccgaactgtagtgattgt

SEQ ID NO: 138449 - DNA, 22 bp, Artificial Sequence
  Synthetic oligonucleotide; CTG chr11 5259270 5259291 5259275 5259270 -
tagtgattgttatctctcttct

SEQ ID NO: 138450 - DNA, 22 bp, Artificial Sequence
  Synthetic oligonucleotide; TTG chr11 5259261 5259282 5259266 5259261 -
ttatctctcttctggatctagc

SEQ ID NO: 138451 - DNA, 22 bp, Artificial Sequence
  Synthetic oligonucleotide; TTA chr11 5259258 5259279 5259263 5259258 -
tctctcttctggatctagccac

SEQ ID NO: 138452 - DNA, 22 bp, Artificial Sequence
  Synthetic oligonucleotide; CTC chr11 5259254 5259275 5259259 5259254 -
tcttctggatctagccacccat

SEQ ID NO: 138453 - DNA, 22 bp, Artificial Sequence
  Synthetic oligonucleotide; CTC chr11 5259252 5259273 5259257 5259252 -
ttctggatctagccacccatca

SEQ ID NO: 138454 - DNA, 22 bp, Artificial Sequence
  Synthetic oligonucleotide; CTT chr11 5259250 5259271 5259255 5259250 -
ctggatctagccacccatcagg

SEQ ID NO: 138455 - DNA, 22 bp, Artificial Sequence
  Synthetic oligonucleotide; TTC chr11 5259249 5259270 5259254 5259249 -
tggatctagccacccatcaggt

SEQ ID NO: 138456 - DNA, 22 bp, Artificial Sequence
  Synthetic oligonucleotide; CTG chr11 5259247 5259268 5259252 5259247 -
gatctagccacccatcaggtct

SEQ ID NO: 138457 - DNA, 22 bp, Artificial Sequence
  Synthetic oligonucleotide; CTA chr11 5259241 5259262 5259246 5259241 -
gccacccatcaggtctaccaga

SEQ ID NO: 138458 - DNA, 22 bp, Artificial Sequence
  Synthetic oligonucleotide; CTA chr11 5259224 5259245 5259229 5259224 -
ccagactccaggctggtactgg

SEQ ID NO: 138459 - DNA, 22 bp, Artificial Sequence
  Synthetic oligonucleotide; CTC chr11 5259216 5259237 5259221 5259216 -
caggctggtactggggtttgtc

SEQ ID NO: 138460 - DNA, 22 bp, Artificial Sequence
  Synthetic oligonucleotide; CTG chr11 5259209 5259230 5259214 5259209 -
gtactggggtttgtctgcacag

SEQ ID NO: 138461 - DNA, 22 bp, Artificial Sequence
  Synthetic oligonucleotide; CTG chr11 5259203 5259224 5259208 5259203 -
gggtttgtctgcacagagtctt

SEQ ID NO: 138462 - DNA, 22 bp, Artificial Sequence
  Synthetic oligonucleotide; TTT chr11 5259197 5259218 5259202 5259197 -
gtctgcacagagtcttgtgacg

SEQ ID NO: 138463 - DNA, 22 bp, Artificial Sequence
  Synthetic oligonucleotide; TTG chr11 5259196 5259217 5259201 5259196 -
tctgcacagagtcttgtgacgt

SEQ ID NO: 138464 - DNA, 22 bp, Artificial Sequence
  Synthetic oligonucleotide; CTG chr11 5259192 5259213 5259197 5259192 -
cacagagtcttgtgacgtgaac

SEQ ID NO: 138465 - DNA, 22 bp, Artificial Sequence
  Synthetic oligonucleotide; CTT chr11 5259181 5259202 5259186 5259181 -
gtgacgtgaaccatctgtgggt

SEQ ID NO: 138466 - DNA, 22 bp, Artificial Sequence
  Synthetic oligonucleotide; TTG chr11 5259180 5259201 5259185 5259180 -
tgacgtgaaccatctgtgggtc

SEQ ID NO: 138467 - DNA, 22 bp, Artificial Sequence
  Synthetic oligonucleotide; CTG chr11 5259164 5259185 5259169 5259164 -
tgggtctctcagccatagatac

SEQ ID NO: 138468 - DNA, 22 bp, Artificial Sequence
  Synthetic oligonucleotide; CTC chr11 5259156 5259177 5259161 5259156 -
tcagccatagatacaaccacct

SEQ ID NO: 138469 - DNA, 22 bp, Artificial Sequence
  Synthetic oligonucleotide; CTC chr11 5259154 5259175 5259159 5259154 -
agccatagatacaaccacctgc

SEQ ID NO: 138470 - DNA, 22 bp, Artificial Sequence
  Synthetic oligonucleotide; CTG chr11 5259133 5259154 5259138 5259133 -
ctccaatggaggtggcagagga

SEQ ID NO: 138471 - DNA, 22 bp, Artificial Sequence
  Synthetic oligonucleotide; CTC chr11 5259130 5259151 5259135 5259130 -
caatggaggtggcagaggatga

SEQ ID NO: 138472 - DNA, 22 bp, Artificial Sequence
  Synthetic oligonucleotide; CTC chr11 5259099 5259120 5259104 5259099 -
tgtgagggtccttacttttggt

SEQ ID NO: 138473 - DNA, 22 bp, Artificial Sequence
  Synthetic oligonucleotide; CTG chr11 5259097 5259118 5259102 5259097 -
tgagggtccttacttttggttg

SEQ ID NO: 138474 - DNA, 22 bp, Artificial Sequence
  Synthetic oligonucleotide; CTT chr11 5259086 5259107 5259091 5259086 -
acttttggttgttcaatgcact

SEQ ID NO: 138475 - DNA, 22 bp, Artificial Sequence
  Synthetic oligonucleotide; TTA chr11 5259085 5259106 5259090 5259085 -
cttttggttgttcaatgcacta

SEQ ID NO: 138476 - DNA, 22 bp, Artificial Sequence
  Synthetic oligonucleotide; CTT chr11 5259082 5259103 5259087 5259082 -
ttggttgttcaatgcactattt

SEQ ID NO: 138477 - DNA, 22 bp, Artificial Sequence
  Synthetic oligonucleotide; TTT chr11 5259081 5259102 5259086 5259081 -
tggttgttcaatgcactatttt

SEQ ID NO: 138478 - DNA, 22 bp, Artificial Sequence
  Synthetic oligonucleotide; TTT chr11 5259080 5259101 5259085 5259080 -
ggttgttcaatgcactattttt

SEQ ID NO: 138479 - DNA, 22 bp, Artificial Sequence
  Synthetic oligonucleotide; TTG chr11 5259079 5259100 5259084 5259079 -
gttgttcaatgcactatttttg

SEQ ID NO: 138480 - DNA, 22 bp, Artificial Sequence
  Synthetic oligonucleotide; TTG chr11 5259075 5259096 5259080 5259075 -
ttcaatgcactatttttgtgct

SEQ ID NO: 138481 - DNA, 22 bp, Artificial Sequence
  Synthetic oligonucleotide; TTC chr11 5259072 5259093 5259077 5259072 -
aatgcactatttttgtgctggt

SEQ ID NO: 138482 - DNA, 22 bp, Artificial Sequence
  Synthetic oligonucleotide; CTA chr11 5259063 5259084 5259068 5259063 -
tttttgtgctggttggcctcct

SEQ ID NO: 138483 - DNA, 22 bp, Artificial Sequence
  Synthetic oligonucleotide; TTT chr11 5259060 5259081 5259065 5259060 -
ttgtgctggttggcctcctgcc

SEQ ID NO: 138484 - DNA, 22 bp, Artificial Sequence
  Synthetic oligonucleotide; TTT chr11 5259059 5259080 5259064 5259059 -
tgtgctggttggcctcctgcca

SEQ ID NO: 138485 - DNA, 22 bp, Artificial Sequence
  Synthetic oligonucleotide; TTT chr11 5259058 5259079 5259063 5259058 -
gtgctggttggcctcctgccag

SEQ ID NO: 138486 - DNA, 22 bp, Artificial Sequence
  Synthetic oligonucleotide; TTG chr11 5259057 5259078 5259062 5259057 -
tgctggttggcctcctgccagg

SEQ ID NO: 138487 - DNA, 22 bp, Artificial Sequence
  Synthetic oligonucleotide; CTG chr11 5259052 5259073 5259057 5259052 -
gttggcctcctgccaggaggtg

SEQ ID NO: 138488 - DNA, 22 bp, Artificial Sequence
  Synthetic oligonucleotide; TTG chr11 5259048 5259069 5259053 5259048 -
gcctcctgccaggaggtggcac

SEQ ID NO: 138489 - DNA, 22 bp, Artificial Sequence
  Synthetic oligonucleotide; CTC chr11 5259043 5259064 5259048 5259043 -
ctgccaggaggtggcactttct

SEQ ID NO: 138490 - DNA, 22 bp, Artificial Sequence
  Synthetic oligonucleotide; CTG chr11 5259040 5259061 5259045 5259040 -
ccaggaggtggcactttctaga

SEQ ID NO: 138491 - DNA, 22 bp, Artificial Sequence
  Synthetic oligonucleotide; CTT chr11 5259024 5259045 5259029 5259024 -
tctagaaagcatcagcagaggc

SEQ ID NO: 138492 - DNA, 22 bp, Artificial Sequence
  Synthetic oligonucleotide; TTT chr11 5259023 5259044 5259028 5259023 -
ctagaaagcatcagcagaggca

SEQ ID NO: 138493 - DNA, 22 bp, Artificial Sequence
  Synthetic oligonucleotide; TTC chr11 5259022 5259043 5259027 5259022 -
tagaaagcatcagcagaggcag

SEQ ID NO: 138494 - DNA, 22 bp, Artificial Sequence
  Synthetic oligonucleotide; CTA chr11 5259020 5259041 5259025 5259020 -
gaaagcatcagcagaggcagtc

SEQ ID NO: 138495 - DNA, 22 bp, Artificial Sequence
  Synthetic oligonucleotide; CTG chr11 5258983 5259004 5258988 5258983 -
ggggggctggggcaccctagaa

SEQ ID NO: 138496 - DNA, 22 bp, Artificial Sequence
  Synthetic oligonucleotide; CTG chr11 5258974 5258995 5258979 5258974 -
gggcaccctagaactcccaaga

SEQ ID NO: 138497 - DNA, 22 bp, Artificial Sequence
  Synthetic oligonucleotide; CTA chr11 5258964 5258985 5258969 5258964 -
gaactcccaagaatatatgccc

SEQ ID NO: 138498 - DNA, 22 bp, Artificial Sequence
  Synthetic oligonucleotide; CTC chr11 5258958 5258979 5258963 5258958 -
ccaagaatatatgccctttgtc

SEQ ID NO: 138499 - DNA, 22 bp, Artificial Sequence
  Synthetic oligonucleotide; CTT chr11 5258940 5258961 5258945 5258940 -
tgtcttcagctaccagggtgag

SEQ ID NO: 138500 - DNA, 22 bp, Artificial Sequence
  Synthetic oligonucleotide; TTT chr11 5258939 5258960 5258944 5258939 -
gtcttcagctaccagggtgagt

SEQ ID NO: 138501 - DNA, 22 bp, Artificial Sequence
  Synthetic oligonucleotide; TTG chr11 5258938 5258959 5258943 5258938 -
tcttcagctaccagggtgagta

SEQ ID NO: 138502 - DNA, 22 bp, Artificial Sequence
  Synthetic oligonucleotide; CTT chr11 5258934 5258955 5258939 5258934 -
cagctaccagggtgagtaagga

SEQ ID NO: 138503 - DNA, 22 bp, Artificial Sequence
  Synthetic oligonucleotide; TTC chr11 5258933 5258954 5258938 5258933 -
agctaccagggtgagtaaggaa

SEQ ID NO: 138504 - DNA, 22 bp, Artificial Sequence
  Synthetic oligonucleotide; CTA chr11 5258928 5258949 5258933 5258928 -
ccagggtgagtaaggaaggacc

SEQ ID NO: 138505 - DNA, 22 bp, Artificial Sequence
  Synthetic oligonucleotide; CTA chr11 5258886 5258907 5258891 5258886 -
gtcgtgtctgagctcagagtct

SEQ ID NO: 138506 - DNA, 22 bp, Artificial Sequence
  Synthetic oligonucleotide; CTG chr11 5258876 5258897 5258881 5258876 -
agctcagagtctccttgggcag

SEQ ID NO: 138507 - DNA, 22 bp, Artificial Sequence
  Synthetic oligonucleotide; CTC chr11 5258871 5258892 5258876 5258871 -
agagtctccttgggcaggtctt

SEQ ID NO: 138508 - DNA, 22 bp, Artificial Sequence
  Synthetic oligonucleotide; CTC chr11 5258863 5258884 5258868 5258863 -
cttgggcaggtctttctgtggc

SEQ ID NO: 138509 - DNA, 22 bp, Artificial Sequence
  Synthetic oligonucleotide; CTT chr11 5258860 5258881 5258865 5258860 -
gggcaggtctttctgtggctac

SEQ ID NO: 138510 - DNA, 22 bp, Artificial Sequence
  Synthetic oligonucleotide; TTG chr11 5258859 5258880 5258864 5258859 -
ggcaggtctttctgtggctact

SEQ ID NO: 138511 - DNA, 22 bp, Artificial Sequence
  Synthetic oligonucleotide; CTT chr11 5258849 5258870 5258854 5258849 -
tctgtggctactgtgggaggat

SEQ ID NO: 138512 - DNA, 22 bp, Artificial Sequence
  Synthetic oligonucleotide; TTT chr11 5258848 5258869 5258853 5258848 -
ctgtggctactgtgggaggatg

SEQ ID NO: 138513 - DNA, 22 bp, Artificial Sequence
  Synthetic oligonucleotide; TTC chr11 5258847 5258868 5258852 5258847 -
tgtggctactgtgggaggatgg

SEQ ID NO: 138514 - DNA, 22 bp, Artificial Sequence
  Synthetic oligonucleotide; CTG chr11 5258845 5258866 5258850 5258845 -
tggctactgtgggaggatgggg

SEQ ID NO: 138515 - DNA, 22 bp, Artificial Sequence
  Synthetic oligonucleotide; CTA chr11 5258839 5258860 5258844 5258839 -
ctgtgggaggatgggggtgtag

SEQ ID NO: 138516 - DNA, 22 bp, Artificial Sequence
  Synthetic oligonucleotide; CTG chr11 5258836 5258857 5258841 5258836 -
tgggaggatgggggtgtagttt

SEQ ID NO: 138517 - DNA, 22 bp, Artificial Sequence
  Synthetic oligonucleotide; TTT chr11 5258814 5258835 5258819 5258814 -
ccaggtcaatggatttatgttc

SEQ ID NO: 138518 - DNA, 22 bp, Artificial Sequence
  Synthetic oligonucleotide; TTC chr11 5258813 5258834 5258818 5258813 -
caggtcaatggatttatgttcc

SEQ ID NO: 138519 - DNA, 22 bp, Artificial Sequence
  Synthetic oligonucleotide; TTT chr11 5258798 5258819 5258803 5258798 -
atgttcctaggacaattatggc

SEQ ID NO: 138520 - DNA, 22 bp, Artificial Sequence
  Synthetic oligonucleotide; TTA chr11 5258797 5258818 5258802 5258797 -
tgttcctaggacaattatggct

SEQ ID NO: 138521 - DNA, 22 bp, Artificial Sequence
  Synthetic oligonucleotide; TTC chr11 5258792 5258813 5258797 5258792 -
ctaggacaattatggctgcctc

SEQ ID NO: 138522 - DNA, 22 bp, Artificial Sequence
  Synthetic oligonucleotide; CTA chr11 5258789 5258810 5258794 5258789 -
ggacaattatggctgcctctgc

SEQ ID NO: 138523 - DNA, 22 bp, Artificial Sequence
  Synthetic oligonucleotide; TTA chr11 5258780 5258801 5258785 5258780 -
tggctgcctctgctgtgtcatg

SEQ ID NO: 138524 - DNA, 22 bp, Artificial Sequence
  Synthetic oligonucleotide; CTG chr11 5258774 5258795 5258779 5258774 -
cctctgctgtgtcatgcaggtc

SEQ ID NO: 138525 - DNA, 22 bp, Artificial Sequence
  Synthetic oligonucleotide; CTC chr11 5258770 5258791 5258775 5258770 -
tgctgtgtcatgcaggtcatca

SEQ ID NO: 138526 - DNA, 22 bp, Artificial Sequence
  Synthetic oligonucleotide; CTG chr11 5258768 5258789 5258773 5258768 -
ctgtgtcatgcaggtcatcagg

SEQ ID NO: 138527 - DNA, 22 bp, Artificial Sequence
  Synthetic oligonucleotide; CTG chr11 5258765 5258786 5258770 5258765 -
tgtcatgcaggtcatcaggaaa

SEQ ID NO: 138528 - DNA, 22 bp, Artificial Sequence
  Synthetic oligonucleotide; CTT chr11 5258714 5258735 5258719 5258714 -
gcccagctcccatgcaactcaa

SEQ ID NO: 138529 - DNA, 22 bp, Artificial Sequence
  Synthetic oligonucleotide; TTG chr11 5258713 5258734 5258718 5258713 -
cccagctcccatgcaactcaaa

SEQ ID NO: 138530 - DNA, 22 bp, Artificial Sequence
  Synthetic oligonucleotide; CTC chr11 5258705 5258726 5258710 5258705 -
ccatgcaactcaaaaggttggt

SEQ ID NO: 138531 - DNA, 22 bp, Artificial Sequence
  Synthetic oligonucleotide; CTC chr11 5258694 5258715 5258699 5258694 -
aaaaggttggtctcacttccag

SEQ ID NO: 138532 - DNA, 22 bp, Artificial Sequence
  Synthetic oligonucleotide; TTG chr11 5258685 5258706 5258690 5258685 -
gtctcacttccagcgtgcaccc

SEQ ID NO: 138533 - DNA, 22 bp, Artificial Sequence
  Synthetic oligonucleotide; CTC chr11 5258680 5258701 5258685 5258680 -
acttccagcgtgcaccctcccc

SEQ ID NO: 138534 - DNA, 22 bp, Artificial Sequence
  Synthetic oligonucleotide; CTT chr11 5258676 5258697 5258681 5258676 -
ccagcgtgcaccctcccccgca

SEQ ID NO: 138535 - DNA, 22 bp, Artificial Sequence
  Synthetic oligonucleotide; TTC chr11 5258675 5258696 5258680 5258675 -
cagcgtgcaccctcccccgcaa

SEQ ID NO: 138536 - DNA, 22 bp, Artificial Sequence
  Synthetic oligonucleotide; CTC chr11 5258661 5258682 5258666 5258661 -
ccccgcaacagcaccgaatctg

SEQ ID NO: 138537 - DNA, 22 bp, Artificial Sequence
  Synthetic oligonucleotide; CTG chr11 5258639 5258660 5258644 5258639 -
tttccatgcagtcagtgagcaa

SEQ ID NO: 138538 - DNA, 22 bp, Artificial Sequence
  Synthetic oligonucleotide; TTT chr11 5258636 5258657 5258641 5258636 -
ccatgcagtcagtgagcaaggc

SEQ ID NO: 138539 - DNA, 22 bp, Artificial Sequence
  Synthetic oligonucleotide; TTC chr11 5258635 5258656 5258640 5258635 -
catgcagtcagtgagcaaggct

SEQ ID NO: 138540 - DNA, 22 bp, Artificial Sequence
  Synthetic oligonucleotide; CTG chr11 5258612 5258633 5258617 5258612 -
agaacttgccccaggctaccag

SEQ ID NO: 138541 - DNA, 22 bp, Artificial Sequence
  Synthetic oligonucleotide; CTT chr11 5258605 5258626 5258610 5258605 -
gccccaggctaccagctgcgaa

SEQ ID NO: 138542 - DNA, 22 bp, Artificial Sequence
  Synthetic oligonucleotide; TTG chr11 5258604 5258625 5258609 5258604 -
ccccaggctaccagctgcgaaa

SEQ ID NO: 138543 - DNA, 22 bp, Artificial Sequence
  Synthetic oligonucleotide; CTA chr11 5258594 5258615 5258599 5258594 -
ccagctgcgaaaccaagtaggg

SEQ ID NO: 138544 - DNA, 22 bp, Artificial Sequence
  Synthetic oligonucleotide; CTG chr11 5258587 5258608 5258592 5258587 -
cgaaaccaagtagggctgtcct

SEQ ID NO: 138545 - DNA, 22 bp, Artificial Sequence
  Synthetic oligonucleotide; CTG chr11 5258569 5258590 5258574 5258569 -
tcctacttccctgccagtggag

SEQ ID NO: 138546 - DNA, 22 bp, Artificial Sequence
  Synthetic oligonucleotide; CTA chr11 5258564 5258585 5258569 5258564 -
cttccctgccagtggagtctgc

SEQ ID NO: 138547 - DNA, 22 bp, Artificial Sequence
  Synthetic oligonucleotide; CTT chr11 5258561 5258582 5258566 5258561 -
ccctgccagtggagtctgcaca

SEQ ID NO: 138548 - DNA, 22 bp, Artificial Sequence
  Synthetic oligonucleotide; TTC chr11 5258560 5258581 5258565 5258560 -
cctgccagtggagtctgcacac

SEQ ID NO: 138549 - DNA, 22 bp, Artificial Sequence
  Synthetic oligonucleotide; CTG chr11 5258556 5258577 5258561 5258556 -
ccagtggagtctgcacaccaaa

SEQ ID NO: 138550 - DNA, 22 bp, Artificial Sequence
  Synthetic oligonucleotide; CTG chr11 5258543 5258564 5258548 5258543 -
cacaccaaattcatgtcccccc

SEQ ID NO: 138551 - DNA, 22 bp, Artificial Sequence
  Synthetic oligonucleotide; TTC chr11 5258531 5258552 5258536 5258531 -
atgtccccccaccaaccccccc

SEQ ID NO: 138552 - DNA, 22 bp, Artificial Sequence
  Synthetic oligonucleotide; CTG chr11 5258505 5258526 5258510 5258505 -
cccagcccctagatctggccag

SEQ ID NO: 138553 - DNA, 22 bp, Artificial Sequence
  Synthetic oligonucleotide; CTA chr11 5258494 5258515 5258499 5258494 -
gatctggccaggtggagatttt

SEQ ID NO: 138554 - DNA, 22 bp, Artificial Sequence
  Synthetic oligonucleotide; CTG chr11 5258488 5258509 5258493 5258488 -
gccaggtggagattttcttttt

SEQ ID NO: 138555 - DNA, 22 bp, Artificial Sequence
  Synthetic oligonucleotide; TTT chr11 5258473 5258494 5258478 5258473 -
tctttttcctgtcatcttttcc

SEQ ID NO: 138556 - DNA, 22 bp, Artificial Sequence
  Synthetic oligonucleotide; TTT chr11 5258472 5258493 5258477 5258472 -
ctttttcctgtcatcttttccc

SEQ ID NO: 138557 - DNA, 22 bp, Artificial Sequence
  Synthetic oligonucleotide; TTC chr11 5258471 5258492 5258476 5258471 -
tttttcctgtcatcttttccca

SEQ ID NO: 138558 - DNA, 22 bp, Artificial Sequence
  Synthetic oligonucleotide; CTT chr11 5258469 5258490 5258474 5258469 -
tttcctgtcatcttttcccagt

SEQ ID NO: 138559 - DNA, 22 bp, Artificial Sequence
  Synthetic oligonucleotide; TTT chr11 5258468 5258489 5258473 5258468 -
ttcctgtcatcttttcccagtt

SEQ ID NO: 138560 - DNA, 22 bp, Artificial Sequence
  Synthetic oligonucleotide; TTT chr11 5258467 5258488 5258472 5258467 -
tcctgtcatcttttcccagttc

SEQ ID NO: 138561 - DNA, 22 bp, Artificial Sequence
  Synthetic oligonucleotide; TTT chr11 5258466 5258487 5258471 5258466 -
cctgtcatcttttcccagttcc

SEQ ID NO: 138562 - DNA, 22 bp, Artificial Sequence
  Synthetic oligonucleotide; TTC chr11 5258465 5258486 5258470 5258465 -
ctgtcatcttttcccagttcct

SEQ ID NO: 138563 - DNA, 22 bp, Artificial Sequence
  Synthetic oligonucleotide; CTG chr11 5258462 5258483 5258467 5258462 -
tcatcttttcccagttcctctg

SEQ ID NO: 138564 - DNA, 22 bp, Artificial Sequence
  Synthetic oligonucleotide; CTT chr11 5258455 5258476 5258460 5258455 -
ttcccagttcctctggcagccc

SEQ ID NO: 138565 - DNA, 22 bp, Artificial Sequence
  Synthetic oligonucleotide; TTT chr11 5258454 5258475 5258459 5258454 -
tcccagttcctctggcagccct

SEQ ID NO: 138566 - DNA, 22 bp, Artificial Sequence
  Synthetic oligonucleotide; TTT chr11 5258453 5258474 5258458 5258453 -
cccagttcctctggcagccctc

SEQ ID NO: 138567 - DNA, 22 bp, Artificial Sequence
  Synthetic oligonucleotide; TTC chr11 5258452 5258473 5258457 5258452 -
ccagttcctctggcagccctcc

SEQ ID NO: 138568 - DNA, 22 bp, Artificial Sequence
  Synthetic oligonucleotide; TTC chr11 5258445 5258466 5258450 5258445 -
ctctggcagccctcccaaatga

SEQ ID NO: 138569 - DNA, 22 bp, Artificial Sequence
  Synthetic oligonucleotide; CTC chr11 5258442 5258463 5258447 5258442 -
tggcagccctcccaaatgaccc

SEQ ID NO: 138570 - DNA, 22 bp, Artificial Sequence
  Synthetic oligonucleotide; CTG chr11 5258440 5258461 5258445 5258440 -
gcagccctcccaaatgacccct

SEQ ID NO: 138571 - DNA, 22 bp, Artificial Sequence
  Synthetic oligonucleotide; CTC chr11 5258431 5258452 5258436 5258431 -
ccaaatgacccctgtgaggcaa

SEQ ID NO: 138572 - DNA, 22 bp, Artificial Sequence
  Synthetic oligonucleotide; CTG chr11 5258417 5258438 5258422 5258417 -
tgaggcaaggcagaaatggctt

SEQ ID NO: 138573 - DNA, 22 bp, Artificial Sequence
  Synthetic oligonucleotide; CTT chr11 5258395 5258416 5258400 5258395 -
cctaggggacccagagagccca

SEQ ID NO: 138574 - DNA, 22 bp, Artificial Sequence
  Synthetic oligonucleotide; TTC chr11 5258394 5258415 5258399 5258394 -
ctaggggacccagagagcccac

SEQ ID NO: 138575 - DNA, 22 bp, Artificial Sequence
  Synthetic oligonucleotide; CTA chr11 5258391 5258412 5258396 5258391 -
ggggacccagagagcccacagg

SEQ ID NO: 138576 - DNA, 22 bp, Artificial Sequence
  Synthetic oligonucleotide; CTT chr11 5258365 5258386 5258370 5258365 -
ttcccgctgcttcctctacccc

SEQ ID NO: 138577 - DNA, 22 bp, Artificial Sequence
  Synthetic oligonucleotide; TTT chr11 5258364 5258385 5258369 5258364 -
tcccgctgcttcctctacccct

SEQ ID NO: 138578 - DNA, 22 bp, Artificial Sequence
  Synthetic oligonucleotide; TTT chr11 5258363 5258384 5258368 5258363 -
cccgctgcttcctctacccctg

SEQ ID NO: 138579 - DNA, 22 bp, Artificial Sequence
  Synthetic oligonucleotide; TTC chr11 5258362 5258383 5258367 5258362 -
ccgctgcttcctctacccctgt

SEQ ID NO: 138580 - DNA, 22 bp, Artificial Sequence
  Synthetic oligonucleotide; CTG chr11 5258356 5258377 5258361 5258356 -
cttcctctacccctgtattttg

SEQ ID NO: 138581 - DNA, 22 bp, Artificial Sequence
  Synthetic oligonucleotide; CTT chr11 5258353 5258374 5258358 5258353 -
cctctacccctgtattttgctt

SEQ ID NO: 138582 - DNA, 22 bp, Artificial Sequence
  Synthetic oligonucleotide; TTC chr11 5258352 5258373 5258357 5258352 -
ctctacccctgtattttgcttg

SEQ ID NO: 138583 - DNA, 22 bp, Artificial Sequence
  Synthetic oligonucleotide; CTC chr11 5258349 5258370 5258354 5258349 -
tacccctgtattttgcttggcc

SEQ ID NO: 138584 - DNA, 22 bp, Artificial Sequence
  Synthetic oligonucleotide; CTA chr11 5258347 5258368 5258352 5258347 -
cccctgtattttgcttggccct

SEQ ID NO: 138585 - DNA, 22 bp, Artificial Sequence
  Synthetic oligonucleotide; CTG chr11 5258341 5258362 5258346 5258341 -
tattttgcttggccctctaaat

SEQ ID NO: 138586 - DNA, 22 bp, Artificial Sequence
  Synthetic oligonucleotide; TTT chr11 5258336 5258357 5258341 5258336 -
tgcttggccctctaaattgact

SEQ ID NO: 138587 - DNA, 22 bp, Artificial Sequence
  Synthetic oligonucleotide; TTT chr11 5258335 5258356 5258340 5258335 -
gcttggccctctaaattgactc

SEQ ID NO: 138588 - DNA, 22 bp, Artificial Sequence
  Synthetic oligonucleotide; TTG chr11 5258334 5258355 5258339 5258334 -
cttggccctctaaattgactca

SEQ ID NO: 138589 - DNA, 22 bp, Artificial Sequence
  Synthetic oligonucleotide; CTT chr11 5258331 5258352 5258336 5258331 -
ggccctctaaattgactcagct

SEQ ID NO: 138590 - DNA, 22 bp, Artificial Sequence
  Synthetic oligonucleotide; TTG chr11 5258330 5258351 5258335 5258330 -
gccctctaaattgactcagctc

SEQ ID NO: 138591 - DNA, 22 bp, Artificial Sequence
  Synthetic oligonucleotide; CTC chr11 5258324 5258345 5258329 5258324 -
taaattgactcagctccaggta

SEQ ID NO: 138592 - DNA, 22 bp, Artificial Sequence
  Synthetic oligonucleotide; CTA chr11 5258322 5258343 5258327 5258322 -
aattgactcagctccaggtaag

SEQ ID NO: 138593 - DNA, 22 bp, Artificial Sequence
  Synthetic oligonucleotide; TTG chr11 5258317 5258338 5258322 5258317 -
actcagctccaggtaaggtcag

SEQ ID NO: 138594 - DNA, 22 bp, Artificial Sequence
  Synthetic oligonucleotide; CTC chr11 5258313 5258334 5258318 5258313 -
agctccaggtaaggtcagaatc

SEQ ID NO: 138595 - DNA, 22 bp, Artificial Sequence
  Synthetic oligonucleotide; CTC chr11 5258308 5258329 5258313 5258308 -
caggtaaggtcagaatcttctc

SEQ ID NO: 138596 - DNA, 22 bp, Artificial Sequence
  Synthetic oligonucleotide; CTT chr11 5258289 5258310 5258294 5258289 -
ctcctgtggtctagatcttcag

SEQ ID NO: 138597 - DNA, 22 bp, Artificial Sequence
  Synthetic oligonucleotide; TTC chr11 5258288 5258309 5258293 5258288 -
tcctgtggtctagatcttcagg

SEQ ID NO: 138598 - DNA, 22 bp, Artificial Sequence
  Synthetic oligonucleotide; CTC chr11 5258286 5258307 5258291 5258286 -
ctgtggtctagatcttcaggtt

SEQ ID NO: 138599 - DNA, 22 bp, Artificial Sequence
  Synthetic oligonucleotide; CTG chr11 5258283 5258304 5258288 5258283 -
tggtctagatcttcaggttccc

SEQ ID NO: 138600 - DNA, 22 bp, Artificial Sequence
  Synthetic oligonucleotide; CTA chr11 5258276 5258297 5258281 5258276 -
gatcttcaggttccccagtgag

SEQ ID NO: 138601 - DNA, 22 bp, Artificial Sequence
  Synthetic oligonucleotide; CTT chr11 5258270 5258291 5258275 5258270 -
caggttccccagtgaggatgtg

SEQ ID NO: 138602 - DNA, 22 bp, Artificial Sequence
  Synthetic oligonucleotide; TTC chr11 5258269 5258290 5258274 5258269 -
aggttccccagtgaggatgtgt

SEQ ID NO: 138603 - DNA, 22 bp, Artificial Sequence
  Synthetic oligonucleotide; TTC chr11 5258263 5258284 5258268 5258263 -
cccagtgaggatgtgtgtttgg

SEQ ID NO: 138604 - DNA, 22 bp, Artificial Sequence
  Synthetic oligonucleotide; TTT chr11 5258243 5258264 5258248 5258243 -
gggggtagacggtccccctttt

SEQ ID NO: 138605 - DNA, 22 bp, Artificial Sequence
  Synthetic oligonucleotide; TTG chr11 5258242 5258263 5258247 5258242 -
ggggtagacggtcccccttttc

SEQ ID NO: 138606 - DNA, 22 bp, Artificial Sequence
  Synthetic oligonucleotide; CTT chr11 5258223 5258244 5258228 5258223 -
ttccacttccacagtttgggca

SEQ ID NO: 138607 - DNA, 22 bp, Artificial Sequence
  Synthetic oligonucleotide; TTT chr11 5258222 5258243 5258227 5258222 -
tccacttccacagtttgggcac

SEQ ID NO: 138608 - DNA, 22 bp, Artificial Sequence
  Synthetic oligonucleotide; TTT chr11 5258221 5258242 5258226 5258221 -
ccacttccacagtttgggcact

SEQ ID NO: 138609 - DNA, 22 bp, Artificial Sequence
  Synthetic oligonucleotide; TTC chr11 5258220 5258241 5258225 5258220 -
cacttccacagtttgggcactc

SEQ ID NO: 138610 - DNA, 22 bp, Artificial Sequence
  Synthetic oligonucleotide; CTT chr11 5258215 5258236 5258220 5258215 -
ccacagtttgggcactcacaat

SEQ ID NO: 138611 - DNA, 22 bp, Artificial Sequence
  Synthetic oligonucleotide; TTC chr11 5258214 5258235 5258219 5258214 -
cacagtttgggcactcacaata

SEQ ID NO: 138612 - DNA, 22 bp, Artificial Sequence
  Synthetic oligonucleotide; TTT chr11 5258206 5258227 5258211 5258206 -
gggcactcacaatatttggggt

SEQ ID NO: 138613 - DNA, 22 bp, Artificial Sequence
  Synthetic oligonucleotide; TTG chr11 5258205 5258226 5258210 5258205 -
ggcactcacaatatttggggtg

SEQ ID NO: 138614 - DNA, 22 bp, Artificial Sequence
  Synthetic oligonucleotide; CTC chr11 5258198 5258219 5258203 5258198 -
acaatatttggggtgtttcccg

SEQ ID NO: 138615 - DNA, 22 bp, Artificial Sequence
  Synthetic oligonucleotide; TTT chr11 5258189 5258210 5258194 5258189 -
ggggtgtttcccgggtcctgca

SEQ ID NO: 138616 - DNA, 22 bp, Artificial Sequence
  Synthetic oligonucleotide; TTG chr11 5258188 5258209 5258193 5258188 -
gggtgtttcccgggtcctgcag

SEQ ID NO: 138617 - DNA, 22 bp, Artificial Sequence
  Synthetic oligonucleotide; TTT chr11 5258180 5258201 5258185 5258180 -
cccgggtcctgcaggagcaatc

SEQ ID NO: 138618 - DNA, 22 bp, Artificial Sequence
  Synthetic oligonucleotide; TTC chr11 5258179 5258200 5258184 5258179 -
ccgggtcctgcaggagcaatct

SEQ ID NO: 138619 - DNA, 22 bp, Artificial Sequence
  Synthetic oligonucleotide; CTG chr11 5258169 5258190 5258174 5258169 -
caggagcaatctgcttctttca

SEQ ID NO: 138620 - DNA, 22 bp, Artificial Sequence
  Synthetic oligonucleotide; CTG chr11 5258156 5258177 5258161 5258156 -
cttctttcagagggtgtgtgcg

SEQ ID NO: 138621 - DNA, 22 bp, Artificial Sequence
  Synthetic oligonucleotide; CTT chr11 5258153 5258174 5258158 5258153 -
ctttcagagggtgtgtgcgttc

SEQ ID NO: 138622 - DNA, 22 bp, Artificial Sequence
  Synthetic oligonucleotide; TTC chr11 5258152 5258173 5258157 5258152 -
tttcagagggtgtgtgcgttct

SEQ ID NO: 138623 - DNA, 22 bp, Artificial Sequence
  Synthetic oligonucleotide; CTT chr11 5258150 5258171 5258155 5258150 -
tcagagggtgtgtgcgttctct

SEQ ID NO: 138624 - DNA, 22 bp, Artificial Sequence
  Synthetic oligonucleotide; TTT chr11 5258149 5258170 5258154 5258149 -
cagagggtgtgtgcgttctctc

SEQ ID NO: 138625 - DNA, 22 bp, Artificial Sequence
  Synthetic oligonucleotide; TTC chr11 5258148 5258169 5258153 5258148 -
agagggtgtgtgcgttctctca

SEQ ID NO: 138626 - DNA, 22 bp, Artificial Sequence
  Synthetic oligonucleotide; TTC chr11 5258131 5258152 5258136 5258131 -
tctcagctttcttgatttattt

SEQ ID NO: 138627 - DNA, 22 bp, Artificial Sequence
  Synthetic oligonucleotide; CTC chr11 5258129 5258150 5258134 5258129 -
tcagctttcttgatttatttct

SEQ ID NO: 138628 - DNA, 22 bp, Artificial Sequence
  Synthetic oligonucleotide; CTC chr11 5258127 5258148 5258132 5258127 -
agctttcttgatttatttctgc

SEQ ID NO: 138629 - DNA, 22 bp, Artificial Sequence
  Synthetic oligonucleotide; CTT chr11 5258122 5258143 5258127 5258122 -
tcttgatttatttctgcaggtg

SEQ ID NO: 138630 - DNA, 22 bp, Artificial Sequence
  Synthetic oligonucleotide; TTT chr11 5258121 5258142 5258126 5258121 -
cttgatttatttctgcaggtgg

SEQ ID NO: 138631 - DNA, 22 bp, Artificial Sequence
  Synthetic oligonucleotide; TTC chr11 5258120 5258141 5258125 5258120 -
ttgatttatttctgcaggtggt

SEQ ID NO: 138632 - DNA, 22 bp, Artificial Sequence
  Synthetic oligonucleotide; CTT chr11 5258118 5258139 5258123 5258118 -
gatttatttctgcaggtggttc

SEQ ID NO: 138633 - DNA, 22 bp, Artificial Sequence
  Synthetic oligonucleotide; TTG chr11 5258117 5258138 5258122 5258117 -
atttatttctgcaggtggttct

SEQ ID NO: 138634 - DNA, 22 bp, Artificial Sequence
  Synthetic oligonucleotide; TTT chr11 5258113 5258134 5258118 5258113 -
atttctgcaggtggttctgcaa

SEQ ID NO: 138635 - DNA, 22 bp, Artificial Sequence
  Synthetic oligonucleotide; TTA chr11 5258112 5258133 5258117 5258112 -
tttctgcaggtggttctgcaaa

SEQ ID NO: 138636 - DNA, 22 bp, Artificial Sequence
  Synthetic oligonucleotide; TTT chr11 5258109 5258130 5258114 5258109 -
ctgcaggtggttctgcaaaaaa

SEQ ID NO: 138637 - DNA, 22 bp, Artificial Sequence
  Synthetic oligonucleotide; TTC chr11 5258108 5258129 5258113 5258108 -
tgcaggtggttctgcaaaaaaa

SEQ ID NO: 138638 - DNA, 22 bp, Artificial Sequence
  Synthetic oligonucleotide; CTG chr11 5258106 5258127 5258111 5258106 -
caggtggttctgcaaaaaaaat

SEQ ID NO: 138639 - DNA, 22 bp, Artificial Sequence
  Synthetic oligonucleotide; TTC chr11 5258096 5258117 5258101 5258096 -
tgcaaaaaaaattcctgatggg

SEQ ID NO: 138640 - DNA, 22 bp, Artificial Sequence
  Synthetic oligonucleotide; CTG chr11 5258094 5258115 5258099 5258094 -
caaaaaaaattcctgatgggag

SEQ ID NO: 138641 - DNA, 22 bp, Artificial Sequence
  Synthetic oligonucleotide; TTC chr11 5258082 5258103 5258087 5258082 -
ctgatgggagacttcacatgct

SEQ ID NO: 138642 - DNA, 22 bp, Artificial Sequence
  Synthetic oligonucleotide; CTG chr11 5258079 5258100 5258084 5258079 -
atgggagacttcacatgctgct

SEQ ID NO: 138643 - DNA, 22 bp, Artificial Sequence
  Synthetic oligonucleotide; CTT chr11 5258068 5258089 5258073 5258068 -
cacatgctgctctgtgcatccg

SEQ ID NO: 138644 - DNA, 22 bp, Artificial Sequence
  Synthetic oligonucleotide; TTC chr11 5258067 5258088 5258072 5258067 -
acatgctgctctgtgcatccga

SEQ ID NO: 138645 - DNA, 22 bp, Artificial Sequence
  Synthetic oligonucleotide; CTG chr11 5258059 5258080 5258064 5258059 -
ctctgtgcatccgagtgggagc

SEQ ID NO: 138646 - DNA, 22 bp, Artificial Sequence
  Synthetic oligonucleotide; CTC chr11 5258056 5258077 5258061 5258056 -
tgtgcatccgagtgggagctgc

SEQ ID NO: 138647 - DNA, 22 bp, Artificial Sequence
  Synthetic oligonucleotide; CTG chr11 5258054 5258075 5258059 5258054 -
tgcatccgagtgggagctgcaa

SEQ ID NO: 138648 - DNA, 22 bp, Artificial Sequence
  Synthetic oligonucleotide; CTG chr11 5258035 5258056 5258040 5258035 -
caatgtacttctgctgcctccc

SEQ ID NO: 138649 - DNA, 22 bp, Artificial Sequence
  Synthetic oligonucleotide; CTT chr11 5258025 5258046 5258030 5258025 -
ctgctgcctcccatctgccatc

SEQ ID NO: 138650 - DNA, 22 bp, Artificial Sequence
  Synthetic oligonucleotide; TTC chr11 5258024 5258045 5258029 5258024 -
tgctgcctcccatctgccatca

SEQ ID NO: 138651 - DNA, 22 bp, Artificial Sequence
  Synthetic oligonucleotide; CTG chr11 5258022 5258043 5258027 5258022 -
ctgcctcccatctgccatcacc

SEQ ID NO: 138652 - DNA, 22 bp, Artificial Sequence
  Synthetic oligonucleotide; CTG chr11 5258019 5258040 5258024 5258019 -
cctcccatctgccatcaccctc

SEQ ID NO: 138653 - DNA, 22 bp, Artificial Sequence
  Synthetic oligonucleotide; CTC chr11 5258015 5258036 5258020 5258015 -
ccatctgccatcaccctctaat

SEQ ID NO: 138654 - DNA, 22 bp, Artificial Sequence
  Synthetic oligonucleotide; CTG chr11 5258008 5258029 5258013 5258008 -
ccatcaccctctaatttgtcgg

SEQ ID NO: 138655 - DNA, 22 bp, Artificial Sequence
  Synthetic oligonucleotide; CTC chr11 5257997 5258018 5258002 5257997 -
taatttgtcggtaatatgcatt

SEQ ID NO: 138656 - DNA, 22 bp, Artificial Sequence
  Synthetic oligonucleotide; CTA chr11 5257995 5258016 5258000 5257995 -
atttgtcggtaatatgcatttt

SEQ ID NO: 138657 - DNA, 22 bp, Artificial Sequence
  Synthetic oligonucleotide; TTT chr11 5257991 5258012 5257996 5257991 -
gtcggtaatatgcatttttaat

SEQ ID NO: 138658 - DNA, 22 bp, Artificial Sequence
  Synthetic oligonucleotide; TTG chr11 5257990 5258011 5257995 5257990 -
tcggtaatatgcatttttaatc

SEQ ID NO: 138659 - DNA, 22 bp, Artificial Sequence
  Synthetic oligonucleotide; TTT chr11 5257974 5257995 5257979 5257974 -
ttaatcaatctttttttctctc

SEQ ID NO: 138660 - DNA, 22 bp, Artificial Sequence
  Synthetic oligonucleotide; TTT chr11 5257973 5257994 5257978 5257973 -
taatcaatctttttttctctct

SEQ ID NO: 138661 - DNA, 22 bp, Artificial Sequence
  Synthetic oligonucleotide; TTT chr11 5257972 5257993 5257977 5257972 -
aatcaatctttttttctctctc

SEQ ID NO: 138662 - DNA, 22 bp, Artificial Sequence
  Synthetic oligonucleotide; TTA chr11 5257971 5257992 5257976 5257971 -
atcaatctttttttctctctct

SEQ ID NO: 138663 - DNA, 22 bp, Artificial Sequence
  Synthetic oligonucleotide; CTT chr11 5257962 5257983 5257967 5257962 -
tttttctctctctctctttttc

SEQ ID NO: 138664 - DNA, 22 bp, Artificial Sequence
  Synthetic oligonucleotide; TTT chr11 5257961 5257982 5257966 5257961 -
ttttctctctctctctttttct

SEQ ID NO: 138665 - DNA, 22 bp, Artificial Sequence
  Synthetic oligonucleotide; TTT chr11 5257960 5257981 5257965 5257960 -
tttctctctctctctttttctt

SEQ ID NO: 138666 - DNA, 22 bp, Artificial Sequence
  Synthetic oligonucleotide; TTT chr11 5257959 5257980 5257964 5257959 -
ttctctctctctctttttcttc

SEQ ID NO: 138667 - DNA, 22 bp, Artificial Sequence
  Synthetic oligonucleotide; TTT chr11 5257958 5257979 5257963 5257958 -
tctctctctctctttttcttct

SEQ ID NO: 138668 - DNA, 22 bp, Artificial Sequence
  Synthetic oligonucleotide; TTT chr11 5257957 5257978 5257962 5257957 -
ctctctctctctttttcttctc

SEQ ID NO: 138669 - DNA, 22 bp, Artificial Sequence
  Synthetic oligonucleotide; TTC chr11 5257956 5257977 5257961 5257956 -
tctctctctctttttcttctcc

SEQ ID NO: 138670 - DNA, 22 bp, Artificial Sequence
  Synthetic oligonucleotide; CTC chr11 5257954 5257975 5257959 5257954 -
tctctctctttttcttctcccc

SEQ ID NO: 138671 - DNA, 22 bp, Artificial Sequence
  Synthetic oligonucleotide; CTC chr11 5257952 5257973 5257957 5257952 -
tctctctttttcttctccccca

SEQ ID NO: 138672 - DNA, 22 bp, Artificial Sequence
  Synthetic oligonucleotide; CTC chr11 5257950 5257971 5257955 5257950 -
tctctttttcttctcccccaaa

SEQ ID NO: 138673 - DNA, 22 bp, Artificial Sequence
  Synthetic oligonucleotide; CTC chr11 5257948 5257969 5257953 5257948 -
tctttttcttctcccccaaaac

SEQ ID NO: 138674 - DNA, 22 bp, Artificial Sequence
  Synthetic oligonucleotide; CTC chr11 5257946 5257967 5257951 5257946 -
tttttcttctcccccaaaacta

SEQ ID NO: 138675 - DNA, 22 bp, Artificial Sequence
  Synthetic oligonucleotide; CTT chr11 5257944 5257965 5257949 5257944 -
tttcttctcccccaaaactata

SEQ ID NO: 138676 - DNA, 22 bp, Artificial Sequence
  Synthetic oligonucleotide; TTT chr11 5257943 5257964 5257948 5257943 -
ttcttctcccccaaaactatac

SEQ ID NO: 138677 - DNA, 22 bp, Artificial Sequence
  Synthetic oligonucleotide; TTT chr11 5257942 5257963 5257947 5257942 -
tcttctcccccaaaactatact

SEQ ID NO: 138678 - DNA, 22 bp, Artificial Sequence
  Synthetic oligonucleotide; TTT chr11 5257941 5257962 5257946 5257941 -
cttctcccccaaaactatactg

SEQ ID NO: 138679 - DNA, 22 bp, Artificial Sequence
  Synthetic oligonucleotide; TTC chr11 5257940 5257961 5257945 5257940 -
ttctcccccaaaactatactgc

SEQ ID NO: 138680 - DNA, 22 bp, Artificial Sequence
  Synthetic oligonucleotide; CTT chr11 5257938 5257959 5257943 5257938 -
ctcccccaaaactatactgccc

SEQ ID NO: 138681 - DNA, 22 bp, Artificial Sequence
  Synthetic oligonucleotide; TTC chr11 5257937 5257958 5257942 5257937 -
tcccccaaaactatactgccct

SEQ ID NO: 138682 - DNA, 22 bp, Artificial Sequence
  Synthetic oligonucleotide; CTC chr11 5257935 5257956 5257940 5257935 -
ccccaaaactatactgcccttt

SEQ ID NO: 138683 - DNA, 22 bp, Artificial Sequence
  Synthetic oligonucleotide; CTA chr11 5257924 5257945 5257929 5257924 -
tactgccctttgatatcaagga

SEQ ID NO: 138684 - DNA, 22 bp, Artificial Sequence
  Synthetic oligonucleotide; CTG chr11 5257919 5257940 5257924 5257919 -
ccctttgatatcaaggaatcaa

SEQ ID NO: 138685 - DNA, 22 bp, Artificial Sequence
  Synthetic oligonucleotide; CTT chr11 5257914 5257935 5257919 5257914 -
tgatatcaaggaatcaaggacg

SEQ ID NO: 138686 - DNA, 22 bp, Artificial Sequence
  Synthetic oligonucleotide; TTT chr11 5257913 5257934 5257918 5257913 -
gatatcaaggaatcaaggacgt

SEQ ID NO: 138687 - DNA, 22 bp, Artificial Sequence
  Synthetic oligonucleotide; TTG chr11 5257912 5257933 5257917 5257912 -
atatcaaggaatcaaggacgtg

SEQ ID NO: 138688 - DNA, 22 bp, Artificial Sequence
  Synthetic oligonucleotide; TTG chr11 5257884 5257905 5257889 5257884 -
aggggtgggcagtggatacact

SEQ ID NO: 138689 - DNA, 22 bp, Artificial Sequence
  Synthetic oligonucleotide; CTC chr11 5257861 5257882 5257866 5257861 -
tttaccccttagggagctatat

SEQ ID NO: 138690 - DNA, 22 bp, Artificial Sequence
  Synthetic oligonucleotide; CTT chr11 5257859 5257880 5257864 5257859 -
taccccttagggagctatatct

SEQ ID NO: 138691 - DNA, 22 bp, Artificial Sequence
  Synthetic oligonucleotide; TTT chr11 5257858 5257879 5257863 5257858 -
accccttagggagctatatcta

SEQ ID NO: 138692 - DNA, 22 bp, Artificial Sequence
  Synthetic oligonucleotide; TTA chr11 5257857 5257878 5257862 5257857 -
ccccttagggagctatatctag

SEQ ID NO: 138693 - DNA, 22 bp, Artificial Sequence
  Synthetic oligonucleotide; CTT chr11 5257851 5257872 5257856 5257851 -
agggagctatatctagatttag

SEQ ID NO: 138694 - DNA, 22 bp, Artificial Sequence
  Synthetic oligonucleotide; TTA chr11 5257850 5257871 5257855 5257850 -
gggagctatatctagatttaga

SEQ ID NO: 138695 - DNA, 22 bp, Artificial Sequence
  Synthetic oligonucleotide; CTA chr11 5257842 5257863 5257847 5257842 -
tatctagatttagatattgcca

SEQ ID NO: 138696 - DNA, 22 bp, Artificial Sequence
  Synthetic oligonucleotide; CTA chr11 5257836 5257857 5257841 5257836 -
gatttagatattgccaattcaa

SEQ ID NO: 138697 - DNA, 22 bp, Artificial Sequence
  Synthetic oligonucleotide; TTT chr11 5257831 5257852 5257836 5257831 -
agatattgccaattcaagataa

SEQ ID NO: 138698 - DNA, 22 bp, Artificial Sequence
  Synthetic oligonucleotide; TTA chr11 5257830 5257851 5257835 5257830 -
gatattgccaattcaagataac

SEQ ID NO: 138699 - DNA, 22 bp, Artificial Sequence
  Synthetic oligonucleotide; TTG chr11 5257823 5257844 5257828 5257823 -
ccaattcaagataacttaattg

SEQ ID NO: 138700 - DNA, 22 bp, Artificial Sequence
  Synthetic oligonucleotide; TTC chr11 5257816 5257837 5257821 5257816 -
aagataacttaattgaaagcaa

SEQ ID NO: 138701 - DNA, 22 bp, Artificial Sequence
  Synthetic oligonucleotide; CTT chr11 5257806 5257827 5257811 5257806 -
aattgaaagcaaattcataatg

SEQ ID NO: 138702 - DNA, 22 bp, Artificial Sequence
  Synthetic oligonucleotide; TTA chr11 5257805 5257826 5257810 5257805 -
attgaaagcaaattcataatga

SEQ ID NO: 138703 - DNA, 22 bp, Artificial Sequence
  Synthetic oligonucleotide; TTG chr11 5257801 5257822 5257806 5257801 -
aaagcaaattcataatgaatac

SEQ ID NO: 138704 - DNA, 22 bp, Artificial Sequence
  Synthetic oligonucleotide; TTC chr11 5257790 5257811 5257795 5257790 -
ataatgaatacacacacacaca

SEQ ID NO: 138705 - DNA, 22 bp, Artificial Sequence
  Synthetic oligonucleotide; CTG chr11 5257758 5257779 5257763 5257758 -
catgacaagatttttaatagtt

SEQ ID NO: 138706 - DNA, 22 bp, Artificial Sequence
  Synthetic oligonucleotide; TTT chr11 5257745 5257766 5257750 5257745 -
ttaatagttgaaagaataacta

SEQ ID NO: 138707 - DNA, 22 bp, Artificial Sequence
  Synthetic oligonucleotide; TTT chr11 5257744 5257765 5257749 5257744 -
taatagttgaaagaataactaa

SEQ ID NO: 138708 - DNA, 22 bp, Artificial Sequence
  Synthetic oligonucleotide; TTT chr11 5257743 5257764 5257748 5257743 -
aatagttgaaagaataactaat

SEQ ID NO: 138709 - DNA, 22 bp, Artificial Sequence
  Synthetic oligonucleotide; TTA chr11 5257742 5257763 5257747 5257742 -
atagttgaaagaataactaata

SEQ ID NO: 138710 - DNA, 22 bp, Artificial Sequence
  Synthetic oligonucleotide; TTG chr11 5257735 5257756 5257740 5257735 -
aaagaataactaataattgtcc

SEQ ID NO: 138711 - DNA, 22 bp, Artificial Sequence
  Synthetic oligonucleotide; CTA chr11 5257723 5257744 5257728 5257723 -
ataattgtccacaggcaataag

SEQ ID NO: 138712 - DNA, 22 bp, Artificial Sequence
  Synthetic oligonucleotide; TTG chr11 5257716 5257737 5257721 5257716 -
tccacaggcaataagggctttt

SEQ ID NO: 138713 - DNA, 22 bp, Artificial Sequence
  Synthetic oligonucleotide; CTT chr11 5257696 5257717 5257701 5257696 -
tttaagcaaaacagttgtgata

SEQ ID NO: 138714 - DNA, 22 bp, Artificial Sequence
  Synthetic oligonucleotide; TTT chr11 5257695 5257716 5257700 5257695 -
ttaagcaaaacagttgtgataa

SEQ ID NO: 138715 - DNA, 22 bp, Artificial Sequence
  Synthetic oligonucleotide; TTT chr11 5257694 5257715 5257699 5257694 -
taagcaaaacagttgtgataaa

SEQ ID NO: 138716 - DNA, 22 bp, Artificial Sequence
  Synthetic oligonucleotide; TTT chr11 5257693 5257714 5257698 5257693 -
aagcaaaacagttgtgataaac

SEQ ID NO: 138717 - DNA, 22 bp, Artificial Sequence
  Synthetic oligonucleotide; TTA chr11 5257692 5257713 5257697 5257692 -
agcaaaacagttgtgataaaca

SEQ ID NO: 138718 - DNA, 22 bp, Artificial Sequence
  Synthetic oligonucleotide; TTG chr11 5257679 5257700 5257684 5257679 -
tgataaacaggtcattcttaga

SEQ ID NO: 138719 - DNA, 22 bp, Artificial Sequence
  Synthetic oligonucleotide; TTC chr11 5257662 5257683 5257667 5257662 -
ttagaatagtaatccagccaat

SEQ ID NO: 138720 - DNA, 22 bp, Artificial Sequence
  Synthetic oligonucleotide; CTT chr11 5257660 5257681 5257665 5257660 -
agaatagtaatccagccaatag

SEQ ID NO: 138721 - DNA, 22 bp, Artificial Sequence
  Synthetic oligonucleotide; TTA chr11 5257659 5257680 5257664 5257659 -
gaatagtaatccagccaatagt

SEQ ID NO: 138722 - DNA, 22 bp, Artificial Sequence
  Synthetic oligonucleotide; TTG chr11 5257629 5257650 5257634 5257629 -
cttagagattatgtcattacca

SEQ ID NO: 138723 - DNA, 22 bp, Artificial Sequence
  Synthetic oligonucleotide; CTT chr11 5257626 5257647 5257631 5257626 -
agagattatgtcattaccagag

SEQ ID NO: 138724 - DNA, 22 bp, Artificial Sequence
  Synthetic oligonucleotide; TTA chr11 5257625 5257646 5257630 5257625 -
gagattatgtcattaccagagt

SEQ ID NO: 138725 - DNA, 22 bp, Artificial Sequence
  Synthetic oligonucleotide; TTA chr11 5257618 5257639 5257623 5257618 -
tgtcattaccagagttaaaatt

SEQ ID NO: 138726 - DNA, 22 bp, Artificial Sequence
  Synthetic oligonucleotide; TTA chr11 5257610 5257631 5257615 5257610 -
ccagagttaaaattctataatg

SEQ ID NO: 138727 - DNA, 22 bp, Artificial Sequence
  Synthetic oligonucleotide; TTA chr11 5257601 5257622 5257606 5257601 -
aaattctataatggcttctcac

SEQ ID NO: 138728 - DNA, 22 bp, Artificial Sequence
  Synthetic oligonucleotide; TTC chr11 5257595 5257616 5257600 5257595 -
tataatggcttctcactcccta

SEQ ID NO: 138729 - DNA, 22 bp, Artificial Sequence
  Synthetic oligonucleotide; CTA chr11 5257593 5257614 5257598 5257593 -
taatggcttctcactccctacc

SEQ ID NO: 138730 - DNA, 22 bp, Artificial Sequence
  Synthetic oligonucleotide; CTT chr11 5257584 5257605 5257589 5257584 -
ctcactccctaccactgaggac

SEQ ID NO: 138731 - DNA, 22 bp, Artificial Sequence
  Synthetic oligonucleotide; TTC chr11 5257583 5257604 5257588 5257583 -
tcactccctaccactgaggaca

SEQ ID NO: 138732 - DNA, 22 bp, Artificial Sequence
  Synthetic oligonucleotide; CTC chr11 5257581 5257602 5257586 5257581 -
actccctaccactgaggacaag

SEQ ID NO: 138733 - DNA, 22 bp, Artificial Sequence
  Synthetic oligonucleotide; CTC chr11 5257577 5257598 5257582 5257577 -
cctaccactgaggacaagttta

SEQ ID NO: 138734 - DNA, 22 bp, Artificial Sequence
  Synthetic oligonucleotide; CTA chr11 5257573 5257594 5257578 5257573 -
ccactgaggacaagtttatgtc

SEQ ID NO: 138735 - DNA, 22 bp, Artificial Sequence
  Synthetic oligonucleotide; CTG chr11 5257567 5257588 5257572 5257567 -
aggacaagtttatgtccttagg

SEQ ID NO: 138736 - DNA, 22 bp, Artificial Sequence
  Synthetic oligonucleotide; TTT chr11 5257556 5257577 5257561 5257556 -
atgtccttaggtttatgcttcc

SEQ ID NO: 138737 - DNA, 22 bp, Artificial Sequence
  Synthetic oligonucleotide; TTA chr11 5257555 5257576 5257560 5257555 -
tgtccttaggtttatgcttccc

SEQ ID NO: 138738 - DNA, 22 bp, Artificial Sequence
  Synthetic oligonucleotide; CTT chr11 5257548 5257569 5257553 5257548 -
aggtttatgcttccctgaaaca

SEQ ID NO: 138739 - DNA, 22 bp, Artificial Sequence
  Synthetic oligonucleotide; TTA chr11 5257547 5257568 5257552 5257547 -
ggtttatgcttccctgaaacaa

SEQ ID NO: 138740 - DNA, 22 bp, Artificial Sequence
  Synthetic oligonucleotide; TTT chr11 5257542 5257563 5257547 5257542 -
atgcttccctgaaacaatacca

SEQ ID NO: 138741 - DNA, 22 bp, Artificial Sequence
  Synthetic oligonucleotide; TTA chr11 5257541 5257562 5257546 5257541 -
tgcttccctgaaacaataccac

SEQ ID NO: 138742 - DNA, 22 bp, Artificial Sequence
  Synthetic oligonucleotide; CTT chr11 5257536 5257557 5257541 5257536 -
ccctgaaacaataccacctgct

SEQ ID NO: 138743 - DNA, 22 bp, Artificial Sequence
  Synthetic oligonucleotide; TTC chr11 5257535 5257556 5257540 5257535 -
cctgaaacaataccacctgcta

SEQ ID NO: 138744 - DNA, 22 bp, Artificial Sequence
  Synthetic oligonucleotide; CTG chr11 5257531 5257552 5257536 5257531 -
aaacaataccacctgctattct

SEQ ID NO: 138745 - DNA, 22 bp, Artificial Sequence
  Synthetic oligonucleotide; CTG chr11 5257516 5257537 5257521 5257516 -
ctattctccactttacatatca

SEQ ID NO: 138746 - DNA, 22 bp, Artificial Sequence
  Synthetic oligonucleotide; CTA chr11 5257513 5257534 5257518 5257513 -
ttctccactttacatatcaacg

SEQ ID NO: 138747 - DNA, 22 bp, Artificial Sequence
  Synthetic oligonucleotide; TTC chr11 5257510 5257531 5257515 5257510 -
tccactttacatatcaacggca

SEQ ID NO: 138748 - DNA, 22 bp, Artificial Sequence
  Synthetic oligonucleotide; CTC chr11 5257508 5257529 5257513 5257508 -
cactttacatatcaacggcact

SEQ ID NO: 138749 - DNA, 22 bp, Artificial Sequence
  Synthetic oligonucleotide; CTT chr11 5257503 5257524 5257508 5257503 -
tacatatcaacggcactggttc

SEQ ID NO: 138750 - DNA, 22 bp, Artificial Sequence
  Synthetic oligonucleotide; TTT chr11 5257502 5257523 5257507 5257502 -
acatatcaacggcactggttct

SEQ ID NO: 138751 - DNA, 22 bp, Artificial Sequence
  Synthetic oligonucleotide; TTA chr11 5257501 5257522 5257506 5257501 -
catatcaacggcactggttctt

SEQ ID NO: 138752 - DNA, 22 bp, Artificial Sequence
  Synthetic oligonucleotide; CTG chr11 5257485 5257506 5257490 5257485 -
gttctttatctaactctctggc

SEQ ID NO: 138753 - DNA, 22 bp, Artificial Sequence
  Synthetic oligonucleotide; TTC chr11 5257481 5257502 5257486 5257481 -
tttatctaactctctggcacag

SEQ ID NO: 138754 - DNA, 22 bp, Artificial Sequence
  Synthetic oligonucleotide; CTT chr11 5257479 5257500 5257484 5257479 -
tatctaactctctggcacagca

SEQ ID NO: 138755 - DNA, 22 bp, Artificial Sequence
  Synthetic oligonucleotide; TTT chr11 5257478 5257499 5257483 5257478 -
atctaactctctggcacagcag

SEQ ID NO: 138756 - DNA, 22 bp, Artificial Sequence
  Synthetic oligonucleotide; TTA chr11 5257477 5257498 5257482 5257477 -
tctaactctctggcacagcagg

SEQ ID NO: 138757 - DNA, 22 bp, Artificial Sequence
  Synthetic oligonucleotide; CTA chr11 5257473 5257494 5257478 5257473 -
actctctggcacagcaggagtt

SEQ ID NO: 138758 - DNA, 22 bp, Artificial Sequence
  Synthetic oligonucleotide; CTC chr11 5257469 5257490 5257474 5257469 -
tctggcacagcaggagtttgtt

SEQ ID NO: 138759 - DNA, 22 bp, Artificial Sequence
  Synthetic oligonucleotide; CTC chr11 5257467 5257488 5257472 5257467 -
tggcacagcaggagtttgtttt

SEQ ID NO: 138760 - DNA, 22 bp, Artificial Sequence
  Synthetic oligonucleotide; CTG chr11 5257465 5257486 5257470 5257465 -
gcacagcaggagtttgttttct

SEQ ID NO: 138761 - DNA, 22 bp, Artificial Sequence
  Synthetic oligonucleotide; TTT chr11 5257450 5257471 5257455 5257450 -
gttttcttctgcttcagagctt

SEQ ID NO: 138762 - DNA, 22 bp, Artificial Sequence
  Synthetic oligonucleotide; TTG chr11 5257449 5257470 5257454 5257449 -
ttttcttctgcttcagagcttt

SEQ ID NO: 138763 - DNA, 22 bp, Artificial Sequence
  Synthetic oligonucleotide; TTT chr11 5257446 5257467 5257451 5257446 -
tcttctgcttcagagctttgaa

SEQ ID NO: 138764 - DNA, 22 bp, Artificial Sequence
  Synthetic oligonucleotide; TTT chr11 5257445 5257466 5257450 5257445 -
cttctgcttcagagctttgaat

SEQ ID NO: 138765 - DNA, 22 bp, Artificial Sequence
  Synthetic oligonucleotide; TTC chr11 5257444 5257465 5257449 5257444 -
ttctgcttcagagctttgaatt

SEQ ID NO: 138766 - DNA, 22 bp, Artificial Sequence
  Synthetic oligonucleotide; CTT chr11 5257442 5257463 5257447 5257442 -
ctgcttcagagctttgaattta

SEQ ID NO: 138767 - DNA, 22 bp, Artificial Sequence
  Synthetic oligonucleotide; TTC chr11 5257441 5257462 5257446 5257441 -
tgcttcagagctttgaatttac

SEQ ID NO: 138768 - DNA, 22 bp, Artificial Sequence
  Synthetic oligonucleotide; CTG chr11 5257439 5257460 5257444 5257439 -
cttcagagctttgaatttacta

SEQ ID NO: 138769 - DNA, 22 bp, Artificial Sequence
  Synthetic oligonucleotide; CTT chr11 5257436 5257457 5257441 5257436 -
cagagctttgaatttactattt

SEQ ID NO: 138770 - DNA, 22 bp, Artificial Sequence
  Synthetic oligonucleotide; TTC chr11 5257435 5257456 5257440 5257435 -
agagctttgaatttactatttc

SEQ ID NO: 138771 - DNA, 22 bp, Artificial Sequence
  Synthetic oligonucleotide; CTT chr11 5257428 5257449 5257433 5257428 -
tgaatttactatttcagcttct

SEQ ID NO: 138772 - DNA, 22 bp, Artificial Sequence
  Synthetic oligonucleotide; TTT chr11 5257427 5257448 5257432 5257427 -
gaatttactatttcagcttcta

SEQ ID NO: 138773 - DNA, 22 bp, Artificial Sequence
  Synthetic oligonucleotide; TTG chr11 5257426 5257447 5257431 5257426 -
aatttactatttcagcttctaa

SEQ ID NO: 138774 - DNA, 22 bp, Artificial Sequence
  Synthetic oligonucleotide; TTT chr11 5257421 5257442 5257426 5257421 -
actatttcagcttctaaacttt

SEQ ID NO: 138775 - DNA, 22 bp, Artificial Sequence
  Synthetic oligonucleotide; TTA chr11 5257420 5257441 5257425 5257420 -
ctatttcagcttctaaacttta

SEQ ID NO: 138776 - DNA, 22 bp, Artificial Sequence
  Synthetic oligonucleotide; CTA chr11 5257417 5257438 5257422 5257417 -
tttcagcttctaaactttattt

SEQ ID NO: 138777 - DNA, 22 bp, Artificial Sequence
  Synthetic oligonucleotide; TTT chr11 5257414 5257435 5257419 5257414 -
cagcttctaaactttatttggc

SEQ ID NO: 138778 - DNA, 22 bp, Artificial Sequence
  Synthetic oligonucleotide; TTC chr11 5257413 5257434 5257418 5257413 -
agcttctaaactttatttggca

SEQ ID NO: 138779 - DNA, 22 bp, Artificial Sequence
  Synthetic oligonucleotide; CTT chr11 5257408 5257429 5257413 5257408 -
ctaaactttatttggcaatgcc

SEQ ID NO: 138780 - DNA, 22 bp, Artificial Sequence
  Synthetic oligonucleotide; TTC chr11 5257407 5257428 5257412 5257407 -
taaactttatttggcaatgcct

SEQ ID NO: 138781 - DNA, 22 bp, Artificial Sequence
  Synthetic oligonucleotide; CTA chr11 5257405 5257426 5257410 5257405 -
aactttatttggcaatgccttc

SEQ ID NO: 138782 - DNA, 22 bp, Artificial Sequence
  Synthetic oligonucleotide; CTT chr11 5257400 5257421 5257405 5257400 -
tatttggcaatgccttcccatg

SEQ ID NO: 138783 - DNA, 22 bp, Artificial Sequence
  Synthetic oligonucleotide; TTT chr11 5257399 5257420 5257404 5257399 -
atttggcaatgccttcccatgg

SEQ ID NO: 138784 - DNA, 22 bp, Artificial Sequence
  Synthetic oligonucleotide; TTA chr11 5257398 5257419 5257403 5257398 -
tttggcaatgccttcccatggc

SEQ ID NO: 138785 - DNA, 22 bp, Artificial Sequence
  Synthetic oligonucleotide; TTT chr11 5257395 5257416 5257400 5257395 -
ggcaatgccttcccatggcaga

SEQ ID NO: 138786 - DNA, 22 bp, Artificial Sequence
  Synthetic oligonucleotide; TTG chr11 5257394 5257415 5257399 5257394 -
gcaatgccttcccatggcagat

SEQ ID NO: 138787 - DNA, 22 bp, Artificial Sequence
  Synthetic oligonucleotide; CTT chr11 5257384 5257405 5257389 5257384 -
cccatggcagattccttctgtc

SEQ ID NO: 138788 - DNA, 22 bp, Artificial Sequence
  Synthetic oligonucleotide; TTC chr11 5257383 5257404 5257388 5257383 -
ccatggcagattccttctgtca

SEQ ID NO: 138789 - DNA, 22 bp, Artificial Sequence
  Synthetic oligonucleotide; TTC chr11 5257370 5257391 5257375 5257370 -
cttctgtcattttgcctctgtt

SEQ ID NO: 138790 - DNA, 22 bp, Artificial Sequence
  Synthetic oligonucleotide; CTT chr11 5257367 5257388 5257372 5257367 -
ctgtcattttgcctctgttcga

SEQ ID NO: 138791 - DNA, 22 bp, Artificial Sequence
  Synthetic oligonucleotide; TTC chr11 5257366 5257387 5257371 5257366 -
tgtcattttgcctctgttcgaa

SEQ ID NO: 138792 - DNA, 22 bp, Artificial Sequence
  Synthetic oligonucleotide; CTG chr11 5257364 5257385 5257369 5257364 -
tcattttgcctctgttcgaata

SEQ ID NO: 138793 - DNA, 22 bp, Artificial Sequence
  Synthetic oligonucleotide; TTT chr11 5257358 5257379 5257363 5257358 -
tgcctctgttcgaatactttct

SEQ ID NO: 138794 - DNA, 22 bp, Artificial Sequence
  Synthetic oligonucleotide; TTT chr11 5257357 5257378 5257362 5257357 -
gcctctgttcgaatactttctc

SEQ ID NO: 138795 - DNA, 22 bp, Artificial Sequence
  Synthetic oligonucleotide; TTG chr11 5257356 5257377 5257361 5257356 -
cctctgttcgaatactttctcc

SEQ ID NO: 138796 - DNA, 22 bp, Artificial Sequence
  Synthetic oligonucleotide; CTC chr11 5257352 5257373 5257357 5257352 -
tgttcgaatactttctccttaa

SEQ ID NO: 138797 - DNA, 22 bp, Artificial Sequence
  Synthetic oligonucleotide; CTG chr11 5257350 5257371 5257355 5257350 -
ttcgaatactttctccttaatt

SEQ ID NO: 138798 - DNA, 22 bp, Artificial Sequence
  Synthetic oligonucleotide; TTC chr11 5257347 5257368 5257352 5257347 -
gaatactttctccttaatttca

SEQ ID NO: 138799 - DNA, 22 bp, Artificial Sequence
  Synthetic oligonucleotide; CTT chr11 5257339 5257360 5257344 5257339 -
tctccttaatttcattcttagt

SEQ ID NO: 138800 - DNA, 22 bp, Artificial Sequence
  Synthetic oligonucleotide; TTT chr11 5257338 5257359 5257343 5257338 -
ctccttaatttcattcttagtt

SEQ ID NO: 138801 - DNA, 22 bp, Artificial Sequence
  Synthetic oligonucleotide; TTC chr11 5257337 5257358 5257342 5257337 -
tccttaatttcattcttagtta

SEQ ID NO: 138802 - DNA, 22 bp, Artificial Sequence
  Synthetic oligonucleotide; CTC chr11 5257335 5257356 5257340 5257335 -
cttaatttcattcttagttaat

SEQ ID NO: 138803 - DNA, 22 bp, Artificial Sequence
  Synthetic oligonucleotide; CTT chr11 5257332 5257353 5257337 5257332 -
aatttcattcttagttaataat

SEQ ID NO: 138804 - DNA, 22 bp, Artificial Sequence
  Synthetic oligonucleotide; TTA chr11 5257331 5257352 5257336 5257331 -
atttcattcttagttaataata

SEQ ID NO: 138805 - DNA, 22 bp, Artificial Sequence
  Synthetic oligonucleotide; TTT chr11 5257327 5257348 5257332 5257327 -
cattcttagttaataatatctg

SEQ ID NO: 138806 - DNA, 22 bp, Artificial Sequence
  Synthetic oligonucleotide; TTC chr11 5257326 5257347 5257331 5257326 -
attcttagttaataatatctga

SEQ ID NO: 138807 - DNA, 22 bp, Artificial Sequence
  Synthetic oligonucleotide; TTC chr11 5257322 5257343 5257327 5257322 -
ttagttaataatatctgaaatt

SEQ ID NO: 138808 - DNA, 22 bp, Artificial Sequence
  Synthetic oligonucleotide; CTT chr11 5257320 5257341 5257325 5257320 -
agttaataatatctgaaattat

SEQ ID NO: 138809 - DNA, 22 bp, Artificial Sequence
  Synthetic oligonucleotide; TTA chr11 5257319 5257340 5257324 5257319 -
gttaataatatctgaaattatt

SEQ ID NO: 138810 - DNA, 22 bp, Artificial Sequence
  Synthetic oligonucleotide; TTA chr11 5257315 5257336 5257320 5257315 -
ataatatctgaaattattttgt

SEQ ID NO: 138811 - DNA, 22 bp, Artificial Sequence
  Synthetic oligonucleotide; CTG chr11 5257305 5257326 5257310 5257305 -
aaattattttgttgtttaactt

SEQ ID NO: 138812 - DNA, 22 bp, Artificial Sequence
  Synthetic oligonucleotide; TTA chr11 5257299 5257320 5257304 5257299 -
ttttgttgtttaacttaattat

SEQ ID NO: 138813 - DNA, 22 bp, Artificial Sequence
  Synthetic oligonucleotide; TTT chr11 5257296 5257317 5257301 5257296 -
tgttgtttaacttaattattaa

SEQ ID NO: 138814 - DNA, 22 bp, Artificial Sequence
  Synthetic oligonucleotide; TTT chr11 5257295 5257316 5257300 5257295 -
gttgtttaacttaattattaat

SEQ ID NO: 138815 - DNA, 22 bp, Artificial Sequence
  Synthetic oligonucleotide; TTG chr11 5257294 5257315 5257299 5257294 -
ttgtttaacttaattattaatt

SEQ ID NO: 138816 - DNA, 22 bp, Artificial Sequence
  Synthetic oligonucleotide; TTG chr11 5257291 5257312 5257296 5257291 -
tttaacttaattattaatttta

SEQ ID NO: 138817 - DNA, 22 bp, Artificial Sequence
  Synthetic oligonucleotide; TTT chr11 5257288 5257309 5257293 5257288 -
aacttaattattaattttatgt

SEQ ID NO: 138818 - DNA, 22 bp, Artificial Sequence
  Synthetic oligonucleotide; TTA chr11 5257287 5257308 5257292 5257287 -
acttaattattaattttatgta

SEQ ID NO: 138819 - DNA, 22 bp, Artificial Sequence
  Synthetic oligonucleotide; CTT chr11 5257283 5257304 5257288 5257283 -
aattattaattttatgtatgtt

SEQ ID NO: 138820 - DNA, 22 bp, Artificial Sequence
  Synthetic oligonucleotide; TTA chr11 5257282 5257303 5257287 5257282 -
attattaattttatgtatgttc

SEQ ID NO: 138821 - DNA, 22 bp, Artificial Sequence
  Synthetic oligonucleotide; TTA chr11 5257278 5257299 5257283 5257278 -
ttaattttatgtatgttctacc

SEQ ID NO: 138822 - DNA, 22 bp, Artificial Sequence
  Synthetic oligonucleotide; TTA chr11 5257275 5257296 5257280 5257275 -
attttatgtatgttctacctag

SEQ ID NO: 138823 - DNA, 22 bp, Artificial Sequence
  Synthetic oligonucleotide; TTT chr11 5257271 5257292 5257276 5257271 -
tatgtatgttctacctagatta

SEQ ID NO: 138824 - DNA, 22 bp, Artificial Sequence
  Synthetic oligonucleotide; TTT chr11 5257270 5257291 5257275 5257270 -
atgtatgttctacctagattat

SEQ ID NO: 138825 - DNA, 22 bp, Artificial Sequence
  Synthetic oligonucleotide; TTA chr11 5257269 5257290 5257274 5257269 -
tgtatgttctacctagattata

SEQ ID NO: 138826 - DNA, 22 bp, Artificial Sequence
  Synthetic oligonucleotide; TTC chr11 5257260 5257281 5257265 5257260 -
tacctagattataatcttcaga

SEQ ID NO: 138827 - DNA, 22 bp, Artificial Sequence
  Synthetic oligonucleotide; CTA chr11 5257258 5257279 5257263 5257258 -
cctagattataatcttcagagg

SEQ ID NO: 138828 - DNA, 22 bp, Artificial Sequence
  Synthetic oligonucleotide; CTA chr11 5257254 5257275 5257259 5257254 -
gattataatcttcagaggaaag

SEQ ID NO: 138829 - DNA, 22 bp, Artificial Sequence
  Synthetic oligonucleotide; TTA chr11 5257249 5257270 5257254 5257249 -
taatcttcagaggaaagtttta

SEQ ID NO: 138830 - DNA, 22 bp, Artificial Sequence
  Synthetic oligonucleotide; CTT chr11 5257242 5257263 5257247 5257242 -
cagaggaaagttttattctctg

SEQ ID NO: 138831 - DNA, 22 bp, Artificial Sequence
  Synthetic oligonucleotide; TTC chr11 5257241 5257262 5257246 5257241 -
agaggaaagttttattctctga

SEQ ID NO: 138832 - DNA, 22 bp, Artificial Sequence
  Synthetic oligonucleotide; TTT chr11 5257229 5257250 5257234 5257229 -
tattctctgacttatttaactt

SEQ ID NO: 138833 - DNA, 22 bp, Artificial Sequence
  Synthetic oligonucleotide; TTT chr11 5257228 5257249 5257233 5257228 -
attctctgacttatttaactta

SEQ ID NO: 138834 - DNA, 22 bp, Artificial Sequence
  Synthetic oligonucleotide; TTA chr11 5257227 5257248 5257232 5257227 -
ttctctgacttatttaacttaa

SEQ ID NO: 138835 - DNA, 22 bp, Artificial Sequence
  Synthetic oligonucleotide; TTC chr11 5257224 5257245 5257229 5257224 -
tctgacttatttaacttaaatg

SEQ ID NO: 138836 - DNA, 22 bp, Artificial Sequence
  Synthetic oligonucleotide; CTC chr11 5257222 5257243 5257227 5257222 -
tgacttatttaacttaaatgcc

SEQ ID NO: 138837 - DNA, 22 bp, Artificial Sequence
  Synthetic oligonucleotide; CTG chr11 5257220 5257241 5257225 5257220 -
acttatttaacttaaatgccca

SEQ ID NO: 138838 - DNA, 22 bp, Artificial Sequence
  Synthetic oligonucleotide; CTT chr11 5257216 5257237 5257221 5257216 -
atttaacttaaatgcccactac

SEQ ID NO: 138839 - DNA, 22 bp, Artificial Sequence
  Synthetic oligonucleotide; TTA chr11 5257215 5257236 5257220 5257215 -
tttaacttaaatgcccactact

SEQ ID NO: 138840 - DNA, 22 bp, Artificial Sequence
  Synthetic oligonucleotide; TTT chr11 5257212 5257233 5257217 5257212 -
aacttaaatgcccactacttta

SEQ ID NO: 138841 - DNA, 22 bp, Artificial Sequence
  Synthetic oligonucleotide; TTA chr11 5257211 5257232 5257216 5257211 -
acttaaatgcccactactttaa

SEQ ID NO: 138842 - DNA, 22 bp, Artificial Sequence
  Synthetic oligonucleotide; CTT chr11 5257207 5257228 5257212 5257207 -
aaatgcccactactttaaaaat

SEQ ID NO: 138843 - DNA, 22 bp, Artificial Sequence
  Synthetic oligonucleotide; TTA chr11 5257206 5257227 5257211 5257206 -
aatgcccactactttaaaaatt

SEQ ID NO: 138844 - DNA, 22 bp, Artificial Sequence
  Synthetic oligonucleotide; CTA chr11 5257195 5257216 5257200 5257195 -
ctttaaaaattatgacatttat

SEQ ID NO: 138845 - DNA, 22 bp, Artificial Sequence
  Synthetic oligonucleotide; CTT chr11 5257192 5257213 5257197 5257192 -
taaaaattatgacatttattta

SEQ ID NO: 138846 - DNA, 22 bp, Artificial Sequence
  Synthetic oligonucleotide; TTT chr11 5257191 5257212 5257196 5257191 -
aaaaattatgacatttatttaa

SEQ ID NO: 138847 - DNA, 22 bp, Artificial Sequence
  Synthetic oligonucleotide; TTA chr11 5257190 5257211 5257195 5257190 -
aaaattatgacatttatttaac

SEQ ID NO: 138848 - DNA, 22 bp, Artificial Sequence
  Synthetic oligonucleotide; TTA chr11 5257183 5257204 5257188 5257183 -
tgacatttatttaacagatatt

SEQ ID NO: 138849 - DNA, 22 bp, Artificial Sequence
  Synthetic oligonucleotide; TTT chr11 5257175 5257196 5257180 5257175 -
atttaacagatatttgctgaac

SEQ ID NO: 138850 - DNA, 22 bp, Artificial Sequence
  Synthetic oligonucleotide; TTA chr11 5257174 5257195 5257179 5257174 -
tttaacagatatttgctgaaca

SEQ ID NO: 138851 - DNA, 22 bp, Artificial Sequence
  Synthetic oligonucleotide; TTT chr11 5257171 5257192 5257176 5257171 -
aacagatatttgctgaacaaat

SEQ ID NO: 138852 - DNA, 22 bp, Artificial Sequence
  Synthetic oligonucleotide; TTA chr11 5257170 5257191 5257175 5257170 -
acagatatttgctgaacaaatg

SEQ ID NO: 138853 - DNA, 22 bp, Artificial Sequence
  Synthetic oligonucleotide; TTT chr11 5257160 5257181 5257165 5257160 -
gctgaacaaatgtttgaaaata

SEQ ID NO: 138854 - DNA, 22 bp, Artificial Sequence
  Synthetic oligonucleotide; TTG chr11 5257159 5257180 5257164 5257159 -
ctgaacaaatgtttgaaaatac

SEQ ID NO: 138855 - DNA, 22 bp, Artificial Sequence
  Synthetic oligonucleotide; CTG chr11 5257156 5257177 5257161 5257156 -
aacaaatgtttgaaaatacatg

SEQ ID NO: 138856 - DNA, 22 bp, Artificial Sequence
  Synthetic oligonucleotide; TTT chr11 5257145 5257166 5257150 5257145 -
gaaaatacatgggaaagaatgc

SEQ ID NO: 138857 - DNA, 22 bp, Artificial Sequence
  Synthetic oligonucleotide; TTG chr11 5257144 5257165 5257149 5257144 -
aaaatacatgggaaagaatgct

SEQ ID NO: 138858 - DNA, 22 bp, Artificial Sequence
  Synthetic oligonucleotide; CTT chr11 5257121 5257142 5257126 5257121 -
gaaaacacttgaaattgcttgt

SEQ ID NO: 138859 - DNA, 22 bp, Artificial Sequence
  Synthetic oligonucleotide; TTG chr11 5257120 5257141 5257125 5257120 -
aaaacacttgaaattgcttgtg

SEQ ID NO: 138860 - DNA, 22 bp, Artificial Sequence
  Synthetic oligonucleotide; CTT chr11 5257111 5257132 5257116 5257111 -
gaaattgcttgtgtaaagaaac

SEQ ID NO: 138861 - DNA, 22 bp, Artificial Sequence
  Synthetic oligonucleotide; TTG chr11 5257110 5257131 5257115 5257110 -
aaattgcttgtgtaaagaaaca

SEQ ID NO: 138862 - DNA, 22 bp, Artificial Sequence
  Synthetic oligonucleotide; TTG chr11 5257104 5257125 5257109 5257104 -
cttgtgtaaagaaacagtttta

SEQ ID NO: 138863 - DNA, 22 bp, Artificial Sequence
  Synthetic oligonucleotide; CTT chr11 5257101 5257122 5257106 5257101 -
gtgtaaagaaacagttttatca

SEQ ID NO: 138864 - DNA, 22 bp, Artificial Sequence
  Synthetic oligonucleotide; TTG chr11 5257100 5257121 5257105 5257100 -
tgtaaagaaacagttttatcag

SEQ ID NO: 138865 - DNA, 22 bp, Artificial Sequence
  Synthetic oligonucleotide; TTT chr11 5257084 5257105 5257089 5257084 -
tatcagttaggatttaatcaat

SEQ ID NO: 138866 - DNA, 22 bp, Artificial Sequence
  Synthetic oligonucleotide; TTT chr11 5257083 5257104 5257088 5257083 -
atcagttaggatttaatcaatg

SEQ ID NO: 138867 - DNA, 22 bp, Artificial Sequence
  Synthetic oligonucleotide; TTA chr11 5257082 5257103 5257087 5257082 -
tcagttaggatttaatcaatgt

SEQ ID NO: 138868 - DNA, 22 bp, Artificial Sequence
  Synthetic oligonucleotide; TTA chr11 5257075 5257096 5257080 5257075 -
ggatttaatcaatgtcagaagc

SEQ ID NO: 138869 - DNA, 22 bp, Artificial Sequence
  Synthetic oligonucleotide; TTT chr11 5257069 5257090 5257074 5257069 -
aatcaatgtcagaagcaatgat

SEQ ID NO: 138870 - DNA, 22 bp, Artificial Sequence
  Synthetic oligonucleotide; TTA chr11 5257068 5257089 5257073 5257068 -
atcaatgtcagaagcaatgata

SEQ ID NO: 138871 - DNA, 22 bp, Artificial Sequence
  Synthetic oligonucleotide; TTA chr11 5257018 5257039 5257023 5257018 -
tggataaggagaaatcaacaaa

SEQ ID NO: 138872 - DNA, 22 bp, Artificial Sequence
  Synthetic oligonucleotide; CTC chr11 5256993 5257014 5256998 5256993 -
ttaaaagatattgcctcaaaag

SEQ ID NO: 138873 - DNA, 22 bp, Artificial Sequence
  Synthetic oligonucleotide; CTT chr11 5256991 5257012 5256996 5256991 -
aaaagatattgcctcaaaagca

SEQ ID NO: 138874 - DNA, 22 bp, Artificial Sequence
  Synthetic oligonucleotide; TTA chr11 5256990 5257011 5256995 5256990 -
aaagatattgcctcaaaagcat

SEQ ID NO: 138875 - DNA, 22 bp, Artificial Sequence
  Synthetic oligonucleotide; TTG chr11 5256980 5257001 5256985 5256980 -
cctcaaaagcataagaggaaat

SEQ ID NO: 138876 - DNA, 22 bp, Artificial Sequence
  Synthetic oligonucleotide; CTC chr11 5256976 5256997 5256981 5256976 -
aaaagcataagaggaaataagg

SEQ ID NO: 138877 - DNA, 22 bp, Artificial Sequence
  Synthetic oligonucleotide; TTT chr11 5256950 5256971 5256955 5256950 -
atacatgacttttagaacactg

SEQ ID NO: 138878 - DNA, 22 bp, Artificial Sequence
  Synthetic oligonucleotide; TTA chr11 5256949 5256970 5256954 5256949 -
tacatgacttttagaacactgc

SEQ ID NO: 138879 - DNA, 22 bp, Artificial Sequence
  Synthetic oligonucleotide; CTT chr11 5256939 5256960 5256944 5256939 -
ttagaacactgccttggttttt

SEQ ID NO: 138880 - DNA, 22 bp, Artificial Sequence
  Synthetic oligonucleotide; TTT chr11 5256938 5256959 5256943 5256938 -
tagaacactgccttggtttttg

SEQ ID NO: 138881 - DNA, 22 bp, Artificial Sequence
  Synthetic oligonucleotide; TTT chr11 5256937 5256958 5256942 5256937 -
agaacactgccttggtttttgg

SEQ ID NO: 138882 - DNA, 22 bp, Artificial Sequence
  Synthetic oligonucleotide; TTA chr11 5256936 5256957 5256941 5256936 -
gaacactgccttggtttttgga

SEQ ID NO: 138883 - DNA, 22 bp, Artificial Sequence
  Synthetic oligonucleotide; CTG chr11 5256928 5256949 5256933 5256928 -
ccttggtttttggataaatggg

SEQ ID NO: 138884 - DNA, 22 bp, Artificial Sequence
  Synthetic oligonucleotide; CTT chr11 5256924 5256945 5256929 5256924 -
ggtttttggataaatggggaag

SEQ ID NO: 138885 - DNA, 22 bp, Artificial Sequence
  Synthetic oligonucleotide; TTG chr11 5256923 5256944 5256928 5256923 -
gtttttggataaatggggaagt

SEQ ID NO: 138886 - DNA, 22 bp, Artificial Sequence
  Synthetic oligonucleotide; TTT chr11 5256919 5256940 5256924 5256919 -
ttggataaatggggaagttgtt

SEQ ID NO: 138887 - DNA, 22 bp, Artificial Sequence
  Synthetic oligonucleotide; TTT chr11 5256918 5256939 5256923 5256918 -
tggataaatggggaagttgttt

SEQ ID NO: 138888 - DNA, 22 bp, Artificial Sequence
  Synthetic oligonucleotide; TTT chr11 5256917 5256938 5256922 5256917 -
ggataaatggggaagttgtttg

SEQ ID NO: 138889 - DNA, 22 bp, Artificial Sequence
  Synthetic oligonucleotide; TTG chr11 5256916 5256937 5256921 5256916 -
gataaatggggaagttgtttga

SEQ ID NO: 138890 - DNA, 22 bp, Artificial Sequence
  Synthetic oligonucleotide; TTG chr11 5256899 5256920 5256904 5256899 -
tttgaaaacaggagggatccta

SEQ ID NO: 138891 - DNA, 22 bp, Artificial Sequence
  Synthetic oligonucleotide; TTT chr11 5256896 5256917 5256901 5256896 -
gaaaacaggagggatcctagat

SEQ ID NO: 138892 - DNA, 22 bp, Artificial Sequence
  Synthetic oligonucleotide; TTG chr11 5256895 5256916 5256900 5256895 -
aaaacaggagggatcctagata

SEQ ID NO: 138893 - DNA, 22 bp, Artificial Sequence
  Synthetic oligonucleotide; CTA chr11 5256877 5256898 5256882 5256877 -
gatattccttagtctgaggagg

SEQ ID NO: 138894 - DNA, 22 bp, Artificial Sequence
  Synthetic oligonucleotide; TTC chr11 5256870 5256891 5256875 5256870 -
cttagtctgaggaggagcaatt

SEQ ID NO: 138895 - DNA, 22 bp, Artificial Sequence
  Synthetic oligonucleotide; CTT chr11 5256867 5256888 5256872 5256867 -
agtctgaggaggagcaattaag

SEQ ID NO: 138896 - DNA, 22 bp, Artificial Sequence
  Synthetic oligonucleotide; TTA chr11 5256866 5256887 5256871 5256866 -
gtctgaggaggagcaattaaga

SEQ ID NO: 138897 - DNA, 22 bp, Artificial Sequence
  Synthetic oligonucleotide; CTG chr11 5256861 5256882 5256866 5256861 -
aggaggagcaattaagattcac

SEQ ID NO: 138898 - DNA, 22 bp, Artificial Sequence
  Synthetic oligonucleotide; TTA chr11 5256847 5256868 5256852 5256847 -
agattcacttgtttagaggctg

SEQ ID NO: 138899 - DNA, 22 bp, Artificial Sequence
  Synthetic oligonucleotide; TTC chr11 5256841 5256862 5256846 5256841 -
acttgtttagaggctgggagtg

SEQ ID NO: 138900 - DNA, 22 bp, Artificial Sequence
  Synthetic oligonucleotide; CTT chr11 5256837 5256858 5256842 5256837 -
gtttagaggctgggagtggtgg

SEQ ID NO: 138901 - DNA, 22 bp, Artificial Sequence
  Synthetic oligonucleotide; TTG chr11 5256836 5256857 5256841 5256836 -
tttagaggctgggagtggtggc

SEQ ID NO: 138902 - DNA, 22 bp, Artificial Sequence
  Synthetic oligonucleotide; TTT chr11 5256833 5256854 5256838 5256833 -
agaggctgggagtggtggctca

SEQ ID NO: 138903 - DNA, 22 bp, Artificial Sequence
  Synthetic oligonucleotide; TTA chr11 5256832 5256853 5256837 5256832 -
gaggctgggagtggtggctcac

SEQ ID NO: 138904 - DNA, 22 bp, Artificial Sequence
  Synthetic oligonucleotide; CTG chr11 5256825 5256846 5256830 5256825 -
ggagtggtggctcacgcctgta

SEQ ID NO: 138905 - DNA, 22 bp, Artificial Sequence
  Synthetic oligonucleotide; CTC chr11 5256812 5256833 5256817 5256812 -
acgcctgtaatcccagaatttt

SEQ ID NO: 138906 - DNA, 22 bp, Artificial Sequence
  Synthetic oligonucleotide; CTG chr11 5256805 5256826 5256810 5256805 -
taatcccagaattttgggaggc

SEQ ID NO: 138907 - DNA, 22 bp, Artificial Sequence
  Synthetic oligonucleotide; TTT chr11 5256791 5256812 5256796 5256791 -
tgggaggccaaggcaggcagat

SEQ ID NO: 138908 - DNA, 22 bp, Artificial Sequence
  Synthetic oligonucleotide; TTT chr11 5256790 5256811 5256795 5256790 -
gggaggccaaggcaggcagatc

SEQ ID NO: 138909 - DNA, 22 bp, Artificial Sequence
  Synthetic oligonucleotide; TTG chr11 5256789 5256810 5256794 5256789 -
ggaggccaaggcaggcagatca

SEQ ID NO: 138910 - DNA, 22 bp, Artificial Sequence
  Synthetic oligonucleotide; CTG chr11 5256763 5256784 5256768 5256763 -
aggtcaagagttcaagaccaac

SEQ ID NO: 138911 - DNA, 22 bp, Artificial Sequence
  Synthetic oligonucleotide; TTC chr11 5256750 5256771 5256755 5256750 -
aagaccaacctggccaacatgg

SEQ ID NO: 138912 - DNA, 22 bp, Artificial Sequence
  Synthetic oligonucleotide; CTG chr11 5256738 5256759 5256743 5256738 -
gccaacatggtgaaatcccatc

SEQ ID NO: 138913 - DNA, 22 bp, Artificial Sequence
  Synthetic oligonucleotide; CTC chr11 5256714 5256735 5256719 5256714 -
tacaaaaatacaaaaattagac

SEQ ID NO: 138914 - DNA, 22 bp, Artificial Sequence
  Synthetic oligonucleotide; CTA chr11 5256712 5256733 5256717 5256712 -
caaaaatacaaaaattagacag

SEQ ID NO: 138915 - DNA, 22 bp, Artificial Sequence
  Synthetic oligonucleotide; TTA chr11 5256695 5256716 5256700 5256695 -
gacaggcatgatggcaagtgcc

SEQ ID NO: 138916 - DNA, 22 bp, Artificial Sequence
  Synthetic oligonucleotide; CTG chr11 5256671 5256692 5256676 5256671 -
taatcccagctacttgggaggc

SEQ ID NO: 138917 - DNA, 22 bp, Artificial Sequence
  Synthetic oligonucleotide; CTA chr11 5256659 5256680 5256664 5256659 -
cttgggaggctgaggaaggaga

SEQ ID NO: 138918 - DNA, 22 bp, Artificial Sequence
  Synthetic oligonucleotide; CTT chr11 5256656 5256677 5256661 5256656 -
gggaggctgaggaaggagaatt

SEQ ID NO: 138919 - DNA, 22 bp, Artificial Sequence
  Synthetic oligonucleotide; TTG chr11 5256655 5256676 5256660 5256655 -
ggaggctgaggaaggagaattg

SEQ ID NO: 138920 - DNA, 22 bp, Artificial Sequence
  Synthetic oligonucleotide; CTG chr11 5256647 5256668 5256652 5256647 -
aggaaggagaattgcttgaacc

SEQ ID NO: 138921 - DNA, 22 bp, Artificial Sequence
  Synthetic oligonucleotide; TTG chr11 5256633 5256654 5256638 5256633 -
cttgaacctggaaggcaggagt

SEQ ID NO: 138922 - DNA, 22 bp, Artificial Sequence
  Synthetic oligonucleotide; CTT chr11 5256630 5256651 5256635 5256630 -
gaacctggaaggcaggagttgc

SEQ ID NO: 138923 - DNA, 22 bp, Artificial Sequence
  Synthetic oligonucleotide; TTG chr11 5256629 5256650 5256634 5256629 -
aacctggaaggcaggagttgca

SEQ ID NO: 138924 - DNA, 22 bp, Artificial Sequence
  Synthetic oligonucleotide; CTG chr11 5256623 5256644 5256628 5256623 -
gaaggcaggagttgcagtgagc

SEQ ID NO: 138925 - DNA, 22 bp, Artificial Sequence
  Synthetic oligonucleotide; TTG chr11 5256609 5256630 5256614 5256609 -
cagtgagccgagatcataccac

SEQ ID NO: 138926 - DNA, 22 bp, Artificial Sequence
  Synthetic oligonucleotide; CTG chr11 5256585 5256606 5256590 5256585 -
cactccagcctgggtgacagaa

SEQ ID NO: 138927 - DNA, 22 bp, Artificial Sequence
  Synthetic oligonucleotide; CTC chr11 5256580 5256601 5256585 5256580 -
cagcctgggtgacagaacaaga

SEQ ID NO: 138928 - DNA, 22 bp, Artificial Sequence
  Synthetic oligonucleotide; CTG chr11 5256573 5256594 5256578 5256573 -
ggtgacagaacaagactctgtc

SEQ ID NO: 138929 - DNA, 22 bp, Artificial Sequence
  Synthetic oligonucleotide; CTC chr11 5256555 5256576 5256560 5256555 -
tgtctcaaaaaaaaaaaagaga

SEQ ID NO: 138930 - DNA, 22 bp, Artificial Sequence
  Synthetic oligonucleotide; CTG chr11 5256553 5256574 5256558 5256553 -
tctcaaaaaaaaaaaagagaga

SEQ ID NO: 138931 - DNA, 22 bp, Artificial Sequence
  Synthetic oligonucleotide; CTC chr11 5256549 5256570 5256554 5256549 -
aaaaaaaaaaaagagagattca

SEQ ID NO: 138932 - DNA, 22 bp, Artificial Sequence
  Synthetic oligonucleotide; TTC chr11 5256528 5256549 5256533 5256528 -
aaaagattcacttgtttaggcc

SEQ ID NO: 138933 - DNA, 22 bp, Artificial Sequence
  Synthetic oligonucleotide; TTC chr11 5256519 5256540 5256524 5256519 -
acttgtttaggccttagcgggc

SEQ ID NO: 138934 - DNA, 22 bp, Artificial Sequence
  Synthetic oligonucleotide; CTT chr11 5256515 5256536 5256520 5256515 -
gtttaggccttagcgggcttag

SEQ ID NO: 138935 - DNA, 22 bp, Artificial Sequence
  Synthetic oligonucleotide; TTG chr11 5256514 5256535 5256519 5256514 -
tttaggccttagcgggcttaga

SEQ ID NO: 138936 - DNA, 22 bp, Artificial Sequence
  Synthetic oligonucleotide; TTT chr11 5256511 5256532 5256516 5256511 -
aggccttagcgggcttagacac

SEQ ID NO: 138937 - DNA, 22 bp, Artificial Sequence
  Synthetic oligonucleotide; TTA chr11 5256510 5256531 5256515 5256510 -
ggccttagcgggcttagacacc

SEQ ID NO: 138938 - DNA, 22 bp, Artificial Sequence
  Synthetic oligonucleotide; CTT chr11 5256504 5256525 5256509 5256504 -
agcgggcttagacaccagtctc

SEQ ID NO: 138939 - DNA, 22 bp, Artificial Sequence
  Synthetic oligonucleotide; TTA chr11 5256503 5256524 5256508 5256503 -
gcgggcttagacaccagtctct

SEQ ID NO: 138940 - DNA, 22 bp, Artificial Sequence
  Synthetic oligonucleotide; CTT chr11 5256495 5256516 5256500 5256495 -
agacaccagtctctgacacatt

SEQ ID NO: 138941 - DNA, 22 bp, Artificial Sequence
  Synthetic oligonucleotide; TTA chr11 5256494 5256515 5256499 5256494 -
gacaccagtctctgacacattc

SEQ ID NO: 138942 - DNA, 22 bp, Artificial Sequence
  Synthetic oligonucleotide; CTC chr11 5256482 5256503 5256487 5256482 -
tgacacattcttaaaggtcagg

SEQ ID NO: 138943 - DNA, 22 bp, Artificial Sequence
  Synthetic oligonucleotide; CTG chr11 5256480 5256501 5256485 5256480 -
acacattcttaaaggtcaggct

SEQ ID NO: 138944 - DNA, 22 bp, Artificial Sequence
  Synthetic oligonucleotide; TTC chr11 5256472 5256493 5256477 5256472 -
ttaaaggtcaggctctacaaat

SEQ ID NO: 138945 - DNA, 22 bp, Artificial Sequence
  Synthetic oligonucleotide; CTT chr11 5256470 5256491 5256475 5256470 -
aaaggtcaggctctacaaatgg

SEQ ID NO: 138946 - DNA, 22 bp, Artificial Sequence
  Synthetic oligonucleotide; TTA chr11 5256469 5256490 5256474 5256469 -
aaggtcaggctctacaaatgga

SEQ ID NO: 138947 - DNA, 22 bp, Artificial Sequence
  Synthetic oligonucleotide; CTC chr11 5256457 5256478 5256462 5256457 -
tacaaatggaacccaaccagac

SEQ ID NO: 138948 - DNA, 22 bp, Artificial Sequence
  Synthetic oligonucleotide; CTA chr11 5256455 5256476 5256460 5256455 -
caaatggaacccaaccagactc

SEQ ID NO: 138949 - DNA, 22 bp, Artificial Sequence
  Synthetic oligonucleotide; CTC chr11 5256433 5256454 5256438 5256433 -
tcagatatggccaaagatctat

SEQ ID NO: 138950 - DNA, 22 bp, Artificial Sequence
  Synthetic oligonucleotide; CTC chr11 5256431 5256452 5256436 5256431 -
agatatggccaaagatctatac

SEQ ID NO: 138951 - DNA, 22 bp, Artificial Sequence
  Synthetic oligonucleotide; CTA chr11 5256412 5256433 5256417 5256412 -
tacacacccatctcacagatcc

SEQ ID NO: 138952 - DNA, 22 bp, Artificial Sequence
  Synthetic oligonucleotide; CTC chr11 5256398 5256419 5256403 5256398 -
acagatcccctatcttaaagag

SEQ ID NO: 138953 - DNA, 22 bp, Artificial Sequence
  Synthetic oligonucleotide; CTA chr11 5256386 5256407 5256391 5256386 -
tcttaaagagaccctaatttgg

SEQ ID NO: 138954 - DNA, 22 bp, Artificial Sequence
  Synthetic oligonucleotide; CTT chr11 5256382 5256403 5256387 5256382 -
aaagagaccctaatttgggttc

SEQ ID NO: 138955 - DNA, 22 bp, Artificial Sequence
  Synthetic oligonucleotide; TTA chr11 5256381 5256402 5256386 5256381 -
aagagaccctaatttgggttca

SEQ ID NO: 138956 - DNA, 22 bp, Artificial Sequence
  Synthetic oligonucleotide; CTA chr11 5256370 5256391 5256375 5256370 -
atttgggttcacctcagtctct

SEQ ID NO: 138957 - DNA, 22 bp, Artificial Sequence
  Synthetic oligonucleotide; TTT chr11 5256366 5256387 5256371 5256366 -
gggttcacctcagtctctataa

SEQ ID NO: 138958 - DNA, 22 bp, Artificial Sequence
  Synthetic oligonucleotide; TTG chr11 5256365 5256386 5256370 5256365 -
ggttcacctcagtctctataat

SEQ ID NO: 138959 - DNA, 22 bp, Artificial Sequence
  Synthetic oligonucleotide; TTC chr11 5256360 5256381 5256365 5256360 -
acctcagtctctataatctgta

SEQ ID NO: 138960 - DNA, 22 bp, Artificial Sequence
  Synthetic oligonucleotide; CTC chr11 5256355 5256376 5256360 5256355 -
agtctctataatctgtaccagc

SEQ ID NO: 138961 - DNA, 22 bp, Artificial Sequence
  Synthetic oligonucleotide; CTC chr11 5256349 5256370 5256354 5256349 -
tataatctgtaccagcatacca

SEQ ID NO: 138962 - DNA, 22 bp, Artificial Sequence
  Synthetic oligonucleotide; CTA chr11 5256347 5256368 5256352 5256347 -
taatctgtaccagcataccaat

SEQ ID NO: 138963 - DNA, 22 bp, Artificial Sequence
  Synthetic oligonucleotide; CTG chr11 5256340 5256361 5256345 5256340 -
taccagcataccaataaaaatc

SEQ ID NO: 138964 - DNA, 22 bp, Artificial Sequence
  Synthetic oligonucleotide; CTT chr11 5256316 5256337 5256321 5256316 -
tctcacccatccttagattgag

SEQ ID NO: 138965 - DNA, 22 bp, Artificial Sequence
  Synthetic oligonucleotide; TTT chr11 5256315 5256336 5256320 5256315 -
ctcacccatccttagattgaga

SEQ ID NO: 138966 - DNA, 22 bp, Artificial Sequence
  Synthetic oligonucleotide; TTC chr11 5256314 5256335 5256319 5256314 -
tcacccatccttagattgagag

SEQ ID NO: 138967 - DNA, 22 bp, Artificial Sequence
  Synthetic oligonucleotide; CTC chr11 5256312 5256333 5256317 5256312 -
acccatccttagattgagagaa

SEQ ID NO: 138968 - DNA, 22 bp, Artificial Sequence
  Synthetic oligonucleotide; CTT chr11 5256302 5256323 5256307 5256302 -
agattgagagaagtcacttatt

SEQ ID NO: 138969 - DNA, 22 bp, Artificial Sequence
  Synthetic oligonucleotide; TTA chr11 5256301 5256322 5256306 5256301 -
gattgagagaagtcacttatta

SEQ ID NO: 138970 - DNA, 22 bp, Artificial Sequence
  Synthetic oligonucleotide; TTG chr11 5256296 5256317 5256301 5256296 -
agagaagtcacttattattatg

SEQ ID NO: 138971 - DNA, 22 bp, Artificial Sequence
  Synthetic oligonucleotide; CTT chr11 5256283 5256304 5256288 5256283 -
attattatgtgagtaactggaa

SEQ ID NO: 138972 - DNA, 22 bp, Artificial Sequence
  Synthetic oligonucleotide; TTA chr11 5256282 5256303 5256287 5256282 -
ttattatgtgagtaactggaag

SEQ ID NO: 138973 - DNA, 22 bp, Artificial Sequence
  Synthetic oligonucleotide; TTA chr11 5256279 5256300 5256284 5256279 -
ttatgtgagtaactggaagata

SEQ ID NO: 138974 - DNA, 22 bp, Artificial Sequence
  Synthetic oligonucleotide; TTA chr11 5256276 5256297 5256281 5256276 -
tgtgagtaactggaagatactg

SEQ ID NO: 138975 - DNA, 22 bp, Artificial Sequence
  Synthetic oligonucleotide; CTG chr11 5256264 5256285 5256269 5256264 -
gaagatactgataagttgacaa

SEQ ID NO: 138976 - DNA, 22 bp, Artificial Sequence
  Synthetic oligonucleotide; CTG chr11 5256254 5256275 5256259 5256254 -
ataagttgacaaatctttttct

SEQ ID NO: 138977 - DNA, 22 bp, Artificial Sequence
  Synthetic oligonucleotide; TTG chr11 5256246 5256267 5256251 5256246 -
acaaatctttttctttcctttc

SEQ ID NO: 138978 - DNA, 22 bp, Artificial Sequence
  Synthetic oligonucleotide; CTT chr11 5256237 5256258 5256242 5256237 -
tttctttcctttcttattcaac

SEQ ID NO: 138979 - DNA, 22 bp, Artificial Sequence
  Synthetic oligonucleotide; TTT chr11 5256236 5256257 5256241 5256236 -
ttctttcctttcttattcaact

SEQ ID NO: 138980 - DNA, 22 bp, Artificial Sequence
  Synthetic oligonucleotide; TTT chr11 5256235 5256256 5256240 5256235 -
tctttcctttcttattcaactt

SEQ ID NO: 138981 - DNA, 22 bp, Artificial Sequence
  Synthetic oligonucleotide; TTT chr11 5256234 5256255 5256239 5256234 -
ctttcctttcttattcaacttt

SEQ ID NO: 138982 - DNA, 22 bp, Artificial Sequence
  Synthetic oligonucleotide; TTC chr11 5256233 5256254 5256238 5256233 -
tttcctttcttattcaactttt

SEQ ID NO: 138983 - DNA, 22 bp, Artificial Sequence
  Synthetic oligonucleotide; CTT chr11 5256231 5256252 5256236 5256231 -
tcctttcttattcaacttttat

SEQ ID NO: 138984 - DNA, 22 bp, Artificial Sequence
  Synthetic oligonucleotide; TTT chr11 5256230 5256251 5256235 5256230 -
cctttcttattcaacttttatt

SEQ ID NO: 138985 - DNA, 22 bp, Artificial Sequence
  Synthetic oligonucleotide; TTC chr11 5256229 5256250 5256234 5256229 -
ctttcttattcaacttttattt

SEQ ID NO: 138986 - DNA, 22 bp, Artificial Sequence
  Synthetic oligonucleotide; CTT chr11 5256226 5256247 5256231 5256226 -
tcttattcaacttttattttaa

SEQ ID NO: 138987 - DNA, 22 bp, Artificial Sequence
  Synthetic oligonucleotide; TTT chr11 5256225 5256246 5256230 5256225 -
cttattcaacttttattttaac

SEQ ID NO: 138988 - DNA, 22 bp, Artificial Sequence
  Synthetic oligonucleotide; TTC chr11 5256224 5256245 5256229 5256224 -
ttattcaacttttattttaact

SEQ ID NO: 138989 - DNA, 22 bp, Artificial Sequence
  Synthetic oligonucleotide; CTT chr11 5256222 5256243 5256227 5256222 -
attcaacttttattttaacttc

SEQ ID NO: 138990 - DNA, 22 bp, Artificial Sequence
  Synthetic oligonucleotide; TTA chr11 5256221 5256242 5256226 5256221 -
ttcaacttttattttaacttcc

SEQ ID NO: 138991 - DNA, 22 bp, Artificial Sequence
  Synthetic oligonucleotide; TTC chr11 5256218 5256239 5256223 5256218 -
aacttttattttaacttccaaa

SEQ ID NO: 138992 - DNA, 22 bp, Artificial Sequence
  Synthetic oligonucleotide; CTT chr11 5256213 5256234 5256218 5256213 -
ttattttaacttccaaagaaca

SEQ ID NO: 138993 - DNA, 22 bp, Artificial Sequence
  Synthetic oligonucleotide; TTT chr11 5256212 5256233 5256217 5256212 -
tattttaacttccaaagaacaa

SEQ ID NO: 138994 - DNA, 22 bp, Artificial Sequence
  Synthetic oligonucleotide; TTT chr11 5256211 5256232 5256216 5256211 -
attttaacttccaaagaacaag

SEQ ID NO: 138995 - DNA, 22 bp, Artificial Sequence
  Synthetic oligonucleotide; TTA chr11 5256210 5256231 5256215 5256210 -
ttttaacttccaaagaacaagt

SEQ ID NO: 138996 - DNA, 22 bp, Artificial Sequence
  Synthetic oligonucleotide; TTT chr11 5256207 5256228 5256212 5256207 -
taacttccaaagaacaagtgca

SEQ ID NO: 138997 - DNA, 22 bp, Artificial Sequence
  Synthetic oligonucleotide; TTT chr11 5256206 5256227 5256211 5256206 -
aacttccaaagaacaagtgcaa

SEQ ID NO: 138998 - DNA, 22 bp, Artificial Sequence
  Synthetic oligonucleotide; TTA chr11 5256205 5256226 5256210 5256205 -
acttccaaagaacaagtgcaat

SEQ ID NO: 138999 - DNA, 22 bp, Artificial Sequence
  Synthetic oligonucleotide; CTT chr11 5256201 5256222 5256206 5256201 -
ccaaagaacaagtgcaatatgt

SEQ ID NO: 139000 - DNA, 22 bp, Artificial Sequence
  Synthetic oligonucleotide; TTC chr11 5256200 5256221 5256205 5256200 -
caaagaacaagtgcaatatgtg

SEQ ID NO: 139001 - DNA, 22 bp, Artificial Sequence
  Synthetic oligonucleotide; CTT chr11 5256172 5256193 5256177 5256172 -
tgttgcgcaggtcaacatgtat

SEQ ID NO: 139002 - DNA, 22 bp, Artificial Sequence
  Synthetic oligonucleotide; TTT chr11 5256171 5256192 5256176 5256171 -
gttgcgcaggtcaacatgtatc

SEQ ID NO: 139003 - DNA, 22 bp, Artificial Sequence
  Synthetic oligonucleotide; TTG chr11 5256170 5256191 5256175 5256170 -
ttgcgcaggtcaacatgtatct

SEQ ID NO: 139004 - DNA, 22 bp, Artificial Sequence
  Synthetic oligonucleotide; TTG chr11 5256167 5256188 5256172 5256167 -
cgcaggtcaacatgtatctttc

SEQ ID NO: 139005 - DNA, 22 bp, Artificial Sequence
  Synthetic oligonucleotide; CTT chr11 5256147 5256168 5256152 5256147 -
tctggtcttttagccgcctaac

SEQ ID NO: 139006 - DNA, 22 bp, Artificial Sequence
  Synthetic oligonucleotide; TTT chr11 5256146 5256167 5256151 5256146 -
ctggtcttttagccgcctaaca

SEQ ID NO: 139007 - DNA, 22 bp, Artificial Sequence
  Synthetic oligonucleotide; TTC chr11 5256145 5256166 5256150 5256145 -
tggtcttttagccgcctaacac

SEQ ID NO: 139008 - DNA, 22 bp, Artificial Sequence
  Synthetic oligonucleotide; CTG chr11 5256143 5256164 5256148 5256143 -
gtcttttagccgcctaacactt

SEQ ID NO: 139009 - DNA, 22 bp, Artificial Sequence
  Synthetic oligonucleotide; CTT chr11 5256138 5256159 5256143 5256138 -
ttagccgcctaacactttgagc

SEQ ID NO: 139010 - DNA, 22 bp, Artificial Sequence
  Synthetic oligonucleotide; TTT chr11 5256137 5256158 5256142 5256137 -
tagccgcctaacactttgagca

SEQ ID NO: 139011 - DNA, 22 bp, Artificial Sequence
  Synthetic oligonucleotide; TTT chr11 5256136 5256157 5256141 5256136 -
agccgcctaacactttgagcag

SEQ ID NO: 139012 - DNA, 22 bp, Artificial Sequence
  Synthetic oligonucleotide; TTA chr11 5256135 5256156 5256140 5256135 -
gccgcctaacactttgagcaga

SEQ ID NO: 139013 - DNA, 22 bp, Artificial Sequence
  Synthetic oligonucleotide; CTA chr11 5256127 5256148 5256132 5256127 -
acactttgagcagatataagcc

SEQ ID NO: 139014 - DNA, 22 bp, Artificial Sequence
  Synthetic oligonucleotide; CTT chr11 5256121 5256142 5256126 5256121 -
tgagcagatataagccttacac

SEQ ID NO: 139015 - DNA, 22 bp, Artificial Sequence
  Synthetic oligonucleotide; TTT chr11 5256120 5256141 5256125 5256120 -
gagcagatataagccttacaca

SEQ ID NO: 139016 - DNA, 22 bp, Artificial Sequence
  Synthetic oligonucleotide; TTG chr11 5256119 5256140 5256124 5256119 -
agcagatataagccttacacag

SEQ ID NO: 139017 - DNA, 22 bp, Artificial Sequence
  Synthetic oligonucleotide; CTT chr11 5256103 5256124 5256108 5256103 -
acacaggattatgaagtctgaa

SEQ ID NO: 139018 - DNA, 22 bp, Artificial Sequence
  Synthetic oligonucleotide; TTA chr11 5256102 5256123 5256107 5256102 -
cacaggattatgaagtctgaaa

SEQ ID NO: 139019 - DNA, 22 bp, Artificial Sequence
  Synthetic oligonucleotide; TTA chr11 5256092 5256113 5256097 5256092 -
tgaagtctgaaaggattccacc

SEQ ID NO: 139020 - DNA, 22 bp, Artificial Sequence
  Synthetic oligonucleotide; CTG chr11 5256083 5256104 5256088 5256083 -
aaaggattccaccaatattatt

SEQ ID NO: 139021 - DNA, 22 bp, Artificial Sequence
  Synthetic oligonucleotide; TTC chr11 5256074 5256095 5256079 5256074 -
caccaatattattataattcct

SEQ ID NO: 139022 - DNA, 22 bp, Artificial Sequence
  Synthetic oligonucleotide; TTA chr11 5256063 5256084 5256068 5256063 -
ttataattcctatcaacctgat

SEQ ID NO: 139023 - DNA, 22 bp, Artificial Sequence
  Synthetic oligonucleotide; TTA chr11 5256060 5256081 5256065 5256060 -
taattcctatcaacctgatagg

SEQ ID NO: 139024 - DNA, 22 bp, Artificial Sequence
  Synthetic oligonucleotide; TTC chr11 5256054 5256075 5256059 5256054 -
ctatcaacctgataggttaggg

SEQ ID NO: 139025 - DNA, 22 bp, Artificial Sequence
  Synthetic oligonucleotide; CTA chr11 5256051 5256072 5256056 5256051 -
tcaacctgataggttaggggaa

SEQ ID NO: 139026 - DNA, 22 bp, Artificial Sequence
  Synthetic oligonucleotide; CTG chr11 5256043 5256064 5256048 5256043 -
ataggttaggggaaggtagagc

SEQ ID NO: 139027 - DNA, 22 bp, Artificial Sequence
  Synthetic oligonucleotide; TTA chr11 5256035 5256056 5256040 5256035 -
ggggaaggtagagctctcctcc

SEQ ID NO: 139028 - DNA, 22 bp, Artificial Sequence
  Synthetic oligonucleotide; CTC chr11 5256019 5256040 5256024 5256019 -
tcctccaataagccagatttcc

SEQ ID NO: 139029 - DNA, 22 bp, Artificial Sequence
  Synthetic oligonucleotide; CTC chr11 5256017 5256038 5256022 5256017 -
ctccaataagccagatttccag

SEQ ID NO: 139030 - DNA, 22 bp, Artificial Sequence
  Synthetic oligonucleotide; CTC chr11 5256014 5256035 5256019 5256014 -
caataagccagatttccagagt

SEQ ID NO: 139031 - DNA, 22 bp, Artificial Sequence
  Synthetic oligonucleotide; TTT chr11 5255999 5256020 5256004 5255999 -
ccagagtttctgacgtcataat

SEQ ID NO: 139032 - DNA, 22 bp, Artificial Sequence
  Synthetic oligonucleotide; TTC chr11 5255998 5256019 5256003 5255998 -
cagagtttctgacgtcataatc

SEQ ID NO: 139033 - DNA, 22 bp, Artificial Sequence
  Synthetic oligonucleotide; TTT chr11 5255990 5256011 5255995 5255990 -
ctgacgtcataatctaccaagg

SEQ ID NO: 139034 - DNA, 22 bp, Artificial Sequence
  Synthetic oligonucleotide; TTC chr11 5255989 5256010 5255994 5255989 -
tgacgtcataatctaccaaggt

SEQ ID NO: 139035 - DNA, 22 bp, Artificial Sequence
  Synthetic oligonucleotide; CTG chr11 5255987 5256008 5255992 5255987 -
acgtcataatctaccaaggtca

SEQ ID NO: 139036 - DNA, 22 bp, Artificial Sequence
  Synthetic oligonucleotide; CTA chr11 5255974 5255995 5255979 5255974 -
ccaaggtcatggatcgagttca

SEQ ID NO: 139037 - DNA, 22 bp, Artificial Sequence
  Synthetic oligonucleotide; TTC chr11 5255953 5255974 5255958 5255953 -
agagaaaaaacaaaagcaaaac

SEQ ID NO: 139038 - DNA, 22 bp, Artificial Sequence
  Synthetic oligonucleotide; CTA chr11 5255923 5255944 5255928 5255923 -
ccaaaaaataaaaatcccaaag

SEQ ID NO: 139039 - DNA, 22 bp, Artificial Sequence
  Synthetic oligonucleotide; CTT chr11 5255869 5255890 5255874 5255869 -
cctgccatgttaagtggccaat

SEQ ID NO: 139040 - DNA, 22 bp, Artificial Sequence
  Synthetic oligonucleotide; TTC chr11 5255868 5255889 5255873 5255868 -
ctgccatgttaagtggccaata

SEQ ID NO: 139041 - DNA, 22 bp, Artificial Sequence
  Synthetic oligonucleotide; CTG chr11 5255865 5255886 5255870 5255865 -
ccatgttaagtggccaatatgt

SEQ ID NO: 139042 - DNA, 22 bp, Artificial Sequence
  Synthetic oligonucleotide; TTA chr11 5255857 5255878 5255862 5255857 -
agtggccaatatgtcagaaaca

SEQ ID NO: 139043 - DNA, 22 bp, Artificial Sequence
  Synthetic oligonucleotide; CTG chr11 5255829 5255850 5255834 5255829 -
agttacagataaagatgtctaa

SEQ ID NO: 139044 - DNA, 22 bp, Artificial Sequence
  Synthetic oligonucleotide; TTA chr11 5255824 5255845 5255829 5255824 -
cagataaagatgtctaaactac

SEQ ID NO: 139045 - DNA, 22 bp, Artificial Sequence
  Synthetic oligonucleotide; CTA chr11 5255808 5255829 5255813 5255808 -
aactacagtgacatcccagctg

SEQ ID NO: 139046 - DNA, 22 bp, Artificial Sequence
  Synthetic oligonucleotide; CTA chr11 5255803 5255824 5255808 5255803 -
cagtgacatcccagctgtcaca

SEQ ID NO: 139047 - DNA, 22 bp, Artificial Sequence
  Synthetic oligonucleotide; CTG chr11 5255786 5255807 5255791 5255786 -
tcacagtgtgtggactattagt

SEQ ID NO: 139048 - DNA, 22 bp, Artificial Sequence
  Synthetic oligonucleotide; CTA chr11 5255769 5255790 5255774 5255769 -
ttagtcaataaaacagtccctg

SEQ ID NO: 139049 - DNA, 22 bp, Artificial Sequence
  Synthetic oligonucleotide; TTA chr11 5255766 5255787 5255771 5255766 -
gtcaataaaacagtccctgcct

SEQ ID NO: 139050 - DNA, 22 bp, Artificial Sequence
  Synthetic oligonucleotide; CTG chr11 5255747 5255768 5255752 5255747 -
cctcttaagagttgttttccat

SEQ ID NO: 139051 - DNA, 22 bp, Artificial Sequence
  Synthetic oligonucleotide; CTC chr11 5255743 5255764 5255748 5255743 -
ttaagagttgttttccatgcaa

SEQ ID NO: 139052 - DNA, 22 bp, Artificial Sequence
  Synthetic oligonucleotide; CTT chr11 5255741 5255762 5255746 5255741 -
aagagttgttttccatgcaaat

SEQ ID NO: 139053 - DNA, 22 bp, Artificial Sequence
  Synthetic oligonucleotide; TTA chr11 5255740 5255761 5255745 5255740 -
agagttgttttccatgcaaata

SEQ ID NO: 139054 - DNA, 22 bp, Artificial Sequence
  Synthetic oligonucleotide; TTG chr11 5255733 5255754 5255738 5255733 -
ttttccatgcaaatacatgtct

SEQ ID NO: 139055 - DNA, 22 bp, Artificial Sequence
  Synthetic oligonucleotide; TTT chr11 5255730 5255751 5255735 5255730 -
tccatgcaaatacatgtcttat

SEQ ID NO: 139056 - DNA, 22 bp, Artificial Sequence
  Synthetic oligonucleotide; TTT chr11 5255729 5255750 5255734 5255729 -
ccatgcaaatacatgtcttatg

SEQ ID NO: 139057 - DNA, 22 bp, Artificial Sequence
  Synthetic oligonucleotide; TTC chr11 5255728 5255749 5255733 5255728 -
catgcaaatacatgtcttatgt

SEQ ID NO: 139058 - DNA, 22 bp, Artificial Sequence
  Synthetic oligonucleotide; CTT chr11 5255710 5255731 5255715 5255710 -
atgtcttagaataagattccct

SEQ ID NO: 139059 - DNA, 22 bp, Artificial Sequence
  Synthetic oligonucleotide; TTA chr11 5255709 5255730 5255714 5255709 -
tgtcttagaataagattcccta

SEQ ID NO: 139060 - DNA, 22 bp, Artificial Sequence
  Synthetic oligonucleotide; CTT chr11 5255703 5255724 5255708 5255703 -
agaataagattccctaagaagt

SEQ ID NO: 139061 - DNA, 22 bp, Artificial Sequence
  Synthetic oligonucleotide; TTA chr11 5255702 5255723 5255707 5255702 -
gaataagattccctaagaagtg

SEQ ID NO: 139062 - DNA, 22 bp, Artificial Sequence
  Synthetic oligonucleotide; TTC chr11 5255691 5255712 5255696 5255691 -
cctaagaagtgaacctagcatt

SEQ ID NO: 139063 - DNA, 22 bp, Artificial Sequence
  Synthetic oligonucleotide; CTA chr11 5255687 5255708 5255692 5255687 -
agaagtgaacctagcatttata

SEQ ID NO: 139064 - DNA, 22 bp, Artificial Sequence
  Synthetic oligonucleotide; CTA chr11 5255674 5255695 5255679 5255674 -
gcatttatacaagataattaat

SEQ ID NO: 139065 - DNA, 22 bp, Artificial Sequence
  Synthetic oligonucleotide; TTT chr11 5255668 5255689 5255673 5255668 -
atacaagataattaattctaat

SEQ ID NO: 139066 - DNA, 22 bp, Artificial Sequence
  Synthetic oligonucleotide; TTA chr11 5255667 5255688 5255672 5255667 -
tacaagataattaattctaatc

SEQ ID NO: 139067 - DNA, 22 bp, Artificial Sequence
  Synthetic oligonucleotide; TTA chr11 5255654 5255675 5255659 5255654 -
attctaatccatagtatctggt

SEQ ID NO: 139068 - DNA, 22 bp, Artificial Sequence
  Synthetic oligonucleotide; TTC chr11 5255650 5255671 5255655 5255650 -
taatccatagtatctggtaaag

SEQ ID NO: 139069 - DNA, 22 bp, Artificial Sequence
  Synthetic oligonucleotide; CTA chr11 5255648 5255669 5255653 5255648 -
atccatagtatctggtaaagag

SEQ ID NO: 139070 - DNA, 22 bp, Artificial Sequence
  Synthetic oligonucleotide; CTG chr11 5255634 5255655 5255639 5255634 -
gtaaagagcattctaccatcat

SEQ ID NO: 139071 - DNA, 22 bp, Artificial Sequence
  Synthetic oligonucleotide; TTC chr11 5255621 5255642 5255626 5255621 -
taccatcatctttaccgagcat

SEQ ID NO: 139072 - DNA, 22 bp, Artificial Sequence
  Synthetic oligonucleotide; CTA chr11 5255619 5255640 5255624 5255619 -
ccatcatctttaccgagcatag

SEQ ID NO: 139073 - DNA, 22 bp, Artificial Sequence
  Synthetic oligonucleotide; CTT chr11 5255609 5255630 5255614 5255609 -
taccgagcatagaagagctaca

SEQ ID NO: 139074 - DNA, 22 bp, Artificial Sequence
  Synthetic oligonucleotide; TTT chr11 5255608 5255629 5255613 5255608 -
accgagcatagaagagctacac

SEQ ID NO: 139075 - DNA, 22 bp, Artificial Sequence
  Synthetic oligonucleotide; TTA chr11 5255607 5255628 5255612 5255607 -
ccgagcatagaagagctacacc

SEQ ID NO: 139076 - DNA, 22 bp, Artificial Sequence
  Synthetic oligonucleotide; CTA chr11 5255589 5255610 5255594 5255589 -
caccaaaaccctgggtcatcag

SEQ ID NO: 139077 - DNA, 22 bp, Artificial Sequence
  Synthetic oligonucleotide; CTG chr11 5255576 5255597 5255581 5255576 -
ggtcatcagccagcacatacac

SEQ ID NO: 139078 - DNA, 22 bp, Artificial Sequence
  Synthetic oligonucleotide; CTT chr11 5255552 5255573 5255557 5255552 -
atccagtgataaatacacatca

SEQ ID NO: 139079 - DNA, 22 bp, Artificial Sequence
  Synthetic oligonucleotide; TTA chr11 5255551 5255572 5255556 5255551 -
tccagtgataaatacacatcat

SEQ ID NO: 139080 - DNA, 22 bp, Artificial Sequence
  Synthetic oligonucleotide; CTA chr11 5255519 5255540 5255524 5255519 -
catacatacctgaatataaaaa

SEQ ID NO: 139081 - DNA, 22 bp, Artificial Sequence
  Synthetic oligonucleotide; CTG chr11 5255507 5255528 5255512 5255507 -
aatataaaaaaaatacttttgc

SEQ ID NO: 139082 - DNA, 22 bp, Artificial Sequence
  Synthetic oligonucleotide; CTT chr11 5255489 5255510 5255494 5255489 -
ttgctgagatgaaacaggcgtg

SEQ ID NO: 139083 - DNA, 22 bp, Artificial Sequence
  Synthetic oligonucleotide; TTT chr11 5255488 5255509 5255493 5255488 -
tgctgagatgaaacaggcgtga

SEQ ID NO: 139084 - DNA, 22 bp, Artificial Sequence
  Synthetic oligonucleotide; TTT chr11 5255487 5255508 5255492 5255487 -
gctgagatgaaacaggcgtgat

SEQ ID NO: 139085 - DNA, 22 bp, Artificial Sequence
  Synthetic oligonucleotide; TTG chr11 5255486 5255507 5255491 5255486 -
ctgagatgaaacaggcgtgatt

SEQ ID NO: 139086 - DNA, 22 bp, Artificial Sequence
  Synthetic oligonucleotide; CTG chr11 5255483 5255504 5255488 5255483 -
agatgaaacaggcgtgatttat

SEQ ID NO: 139087 - DNA, 22 bp, Artificial Sequence
  Synthetic oligonucleotide; TTT chr11 5255463 5255484 5255468 5255463 -
atttcaaataggtacggataag

SEQ ID NO: 139088 - DNA, 22 bp, Artificial Sequence
  Synthetic oligonucleotide; TTA chr11 5255462 5255483 5255467 5255462 -
tttcaaataggtacggataagt

SEQ ID NO: 139089 - DNA, 22 bp, Artificial Sequence
  Synthetic oligonucleotide; TTT chr11 5255459 5255480 5255464 5255459 -
caaataggtacggataagtaga

SEQ ID NO: 139090 - DNA, 22 bp, Artificial Sequence
  Synthetic oligonucleotide; TTC chr11 5255458 5255479 5255463 5255458 -
aaataggtacggataagtagat

SEQ ID NO: 139091 - DNA, 22 bp, Artificial Sequence
  Synthetic oligonucleotide; TTG chr11 5255432 5255453 5255437 5255432 -
aagtaaggattcagtcttatat

SEQ ID NO: 139092 - DNA, 22 bp, Artificial Sequence
  Synthetic oligonucleotide; TTC chr11 5255420 5255441 5255425 5255420 -
agtcttatattatattacataa

SEQ ID NO: 139093 - DNA, 22 bp, Artificial Sequence
  Synthetic oligonucleotide; CTT chr11 5255414 5255435 5255419 5255414 -
atattatattacataacattaa

SEQ ID NO: 139094 - DNA, 22 bp, Artificial Sequence
  Synthetic oligonucleotide; TTA chr11 5255413 5255434 5255418 5255413 -
tattatattacataacattaat

SEQ ID NO: 139095 - DNA, 22 bp, Artificial Sequence
  Synthetic oligonucleotide; TTA chr11 5255408 5255429 5255413 5255408 -
tattacataacattaatctatt

SEQ ID NO: 139096 - DNA, 22 bp, Artificial Sequence
  Synthetic oligonucleotide; TTA chr11 5255403 5255424 5255408 5255403 -
cataacattaatctattcctgc

SEQ ID NO: 139097 - DNA, 22 bp, Artificial Sequence
  Synthetic oligonucleotide; TTA chr11 5255393 5255414 5255398 5255393 -
atctattcctgcactgaaactg

SEQ ID NO: 139098 - DNA, 22 bp, Artificial Sequence
  Synthetic oligonucleotide; CTA chr11 5255388 5255409 5255393 5255388 -
ttcctgcactgaaactgttgct

SEQ ID NO: 139099 - DNA, 22 bp, Artificial Sequence
  Synthetic oligonucleotide; TTC chr11 5255385 5255406 5255390 5255385 -
ctgcactgaaactgttgcttta

SEQ ID NO: 139100 - DNA, 22 bp, Artificial Sequence
  Synthetic oligonucleotide; CTG chr11 5255382 5255403 5255387 5255382 -
cactgaaactgttgctttatag

SEQ ID NO: 139101 - DNA, 22 bp, Artificial Sequence
  Synthetic oligonucleotide; CTG chr11 5255377 5255398 5255382 5255377 -
aaactgttgctttataggattt

SEQ ID NO: 139102 - DNA, 22 bp, Artificial Sequence
  Synthetic oligonucleotide; CTG chr11 5255371 5255392 5255376 5255371 -
ttgctttataggatttttcact

SEQ ID NO: 139103 - DNA, 22 bp, Artificial Sequence
  Synthetic oligonucleotide; TTG chr11 5255368 5255389 5255373 5255368 -
ctttataggatttttcactaca

SEQ ID NO: 139104 - DNA, 22 bp, Artificial Sequence
  Synthetic oligonucleotide; CTT chr11 5255365 5255386 5255370 5255365 -
tataggatttttcactacacta

SEQ ID NO: 139105 - DNA, 22 bp, Artificial Sequence
  Synthetic oligonucleotide; TTT chr11 5255364 5255385 5255369 5255364 -
ataggatttttcactacactaa

SEQ ID NO: 139106 - DNA, 22 bp, Artificial Sequence
  Synthetic oligonucleotide; TTA chr11 5255363 5255384 5255368 5255363 -
taggatttttcactacactaat

SEQ ID NO: 139107 - DNA, 22 bp, Artificial Sequence
  Synthetic oligonucleotide; TTT chr11 5255355 5255376 5255360 5255355 -
ttcactacactaatgagaactt

SEQ ID NO: 139108 - DNA, 22 bp, Artificial Sequence
  Synthetic oligonucleotide; TTT chr11 5255354 5255375 5255359 5255354 -
tcactacactaatgagaactta

SEQ ID NO: 139109 - DNA, 22 bp, Artificial Sequence
  Synthetic oligonucleotide; TTT chr11 5255353 5255374 5255358 5255353 -
cactacactaatgagaacttaa

SEQ ID NO: 139110 - DNA, 22 bp, Artificial Sequence
  Synthetic oligonucleotide; TTC chr11 5255352 5255373 5255357 5255352 -
actacactaatgagaacttaag

SEQ ID NO: 139111 - DNA, 22 bp, Artificial Sequence
  Synthetic oligonucleotide; CTA chr11 5255348 5255369 5255353 5255348 -
cactaatgagaacttaagagat

SEQ ID NO: 139112 - DNA, 22 bp, Artificial Sequence
  Synthetic oligonucleotide; CTA chr11 5255343 5255364 5255348 5255343 -
atgagaacttaagagataatgg

SEQ ID NO: 139113 - DNA, 22 bp, Artificial Sequence
  Synthetic oligonucleotide; CTT chr11 5255333 5255354 5255338 5255333 -
aagagataatggcctaaaacca

SEQ ID NO: 139114 - DNA, 22 bp, Artificial Sequence
  Synthetic oligonucleotide; TTA chr11 5255332 5255353 5255337 5255332 -
agagataatggcctaaaaccac

SEQ ID NO: 139115 - DNA, 22 bp, Artificial Sequence
  Synthetic oligonucleotide; CTA chr11 5255317 5255338 5255322 5255317 -
aaaccacagagagtatattcaa

SEQ ID NO: 139116 - DNA, 22 bp, Artificial Sequence
  Synthetic oligonucleotide; TTC chr11 5255297 5255318 5255302 5255297 -
aaagataagtatagcacttctt

SEQ ID NO: 139117 - DNA, 22 bp, Artificial Sequence
  Synthetic oligonucleotide; CTT chr11 5255278 5255299 5255283 5255278 -
cttatttggaaaccaatgctta

SEQ ID NO: 139118 - DNA, 22 bp, Artificial Sequence
  Synthetic oligonucleotide; TTC chr11 5255277 5255298 5255282 5255277 -
ttatttggaaaccaatgcttac

SEQ ID NO: 139119 - DNA, 22 bp, Artificial Sequence
  Synthetic oligonucleotide; CTT chr11 5255275 5255296 5255280 5255275 -
atttggaaaccaatgcttacta

SEQ ID NO: 139120 - DNA, 22 bp, Artificial Sequence
  Synthetic oligonucleotide; TTA chr11 5255274 5255295 5255279 5255274 -
tttggaaaccaatgcttactaa

SEQ ID NO: 139121 - DNA, 22 bp, Artificial Sequence
  Synthetic oligonucleotide; TTT chr11 5255271 5255292 5255276 5255271 -
ggaaaccaatgcttactaaatg

SEQ ID NO: 139122 - DNA, 22 bp, Artificial Sequence
  Synthetic oligonucleotide; TTG chr11 5255270 5255291 5255275 5255270 -
gaaaccaatgcttactaaatga

SEQ ID NO: 139123 - DNA, 22 bp, Artificial Sequence
  Synthetic oligonucleotide; CTT chr11 5255257 5255278 5255262 5255257 -
actaaatgagactaagacgtgt

SEQ ID NO: 139124 - DNA, 22 bp, Artificial Sequence
  Synthetic oligonucleotide; TTA chr11 5255256 5255277 5255261 5255256 -
ctaaatgagactaagacgtgtc

SEQ ID NO: 139125 - DNA, 22 bp, Artificial Sequence
  Synthetic oligonucleotide; CTA chr11 5255253 5255274 5255258 5255253 -
aatgagactaagacgtgtccca

SEQ ID NO: 139126 - DNA, 22 bp, Artificial Sequence
  Synthetic oligonucleotide; CTA chr11 5255243 5255264 5255248 5255243 -
agacgtgtcccatcaaaaatcc

SEQ ID NO: 139127 - DNA, 22 bp, Artificial Sequence
  Synthetic oligonucleotide; CTG chr11 5255219 5255240 5255224 5255219 -
gacctatgcctaaaacacattt

SEQ ID NO: 139128 - DNA, 22 bp, Artificial Sequence
  Synthetic oligonucleotide; CTA chr11 5255213 5255234 5255218 5255213 -
tgcctaaaacacatttcacaat

SEQ ID NO: 139129 - DNA, 22 bp, Artificial Sequence
  Synthetic oligonucleotide; CTA chr11 5255207 5255228 5255212 5255207 -
aaacacatttcacaatccctga

SEQ ID NO: 139130 - DNA, 22 bp, Artificial Sequence
  Synthetic oligonucleotide; TTT chr11 5255197 5255218 5255202 5255197 -
cacaatccctgaacttttcaaa

SEQ ID NO: 139131 - DNA, 22 bp, Artificial Sequence
  Synthetic oligonucleotide; TTC chr11 5255196 5255217 5255201 5255196 -
acaatccctgaacttttcaaaa

SEQ ID NO: 139132 - DNA, 22 bp, Artificial Sequence
  Synthetic oligonucleotide; CTG chr11 5255186 5255207 5255191 5255186 -
aacttttcaaaaattggtacat

SEQ ID NO: 139133 - DNA, 22 bp, Artificial Sequence
  Synthetic oligonucleotide; CTT chr11 5255181 5255202 5255186 5255181 -
ttcaaaaattggtacatgcttt

SEQ ID NO: 139134 - DNA, 22 bp, Artificial Sequence
  Synthetic oligonucleotide; TTT chr11 5255180 5255201 5255185 5255180 -
tcaaaaattggtacatgcttta

SEQ ID NO: 139135 - DNA, 22 bp, Artificial Sequence
  Synthetic oligonucleotide; TTT chr11 5255179 5255200 5255184 5255179 -
caaaaattggtacatgctttaa

SEQ ID NO: 139136 - DNA, 22 bp, Artificial Sequence
  Synthetic oligonucleotide; TTC chr11 5255178 5255199 5255183 5255178 -
aaaaattggtacatgctttaac

SEQ ID NO: 139137 - DNA, 22 bp, Artificial Sequence
  Synthetic oligonucleotide; TTG chr11 5255170 5255191 5255175 5255170 -
gtacatgctttaactttaaact

SEQ ID NO: 139138 - DNA, 22 bp, Artificial Sequence
  Synthetic oligonucleotide; CTT chr11 5255160 5255181 5255165 5255160 -
taactttaaactacaggcctca

SEQ ID NO: 139139 - DNA, 22 bp, Artificial Sequence
  Synthetic oligonucleotide; TTT chr11 5255159 5255180 5255164 5255159 -
aactttaaactacaggcctcac

SEQ ID NO: 139140 - DNA, 22 bp, Artificial Sequence
  Synthetic oligonucleotide; TTA chr11 5255158 5255179 5255163 5255158 -
actttaaactacaggcctcact

SEQ ID NO: 139141 - DNA, 22 bp, Artificial Sequence
  Synthetic oligonucleotide; CTT chr11 5255154 5255175 5255159 5255154 -
taaactacaggcctcactggag

SEQ ID NO: 139142 - DNA, 22 bp, Artificial Sequence
  Synthetic oligonucleotide; TTT chr11 5255153 5255174 5255158 5255153 -
aaactacaggcctcactggagc

SEQ ID NO: 139143 - DNA, 22 bp, Artificial Sequence
  Synthetic oligonucleotide; TTA chr11 5255152 5255173 5255157 5255152 -
aactacaggcctcactggagct

SEQ ID NO: 139144 - DNA, 22 bp, Artificial Sequence
  Synthetic oligonucleotide; CTA chr11 5255147 5255168 5255152 5255147 -
caggcctcactggagctacaga

SEQ ID NO: 139145 - DNA, 22 bp, Artificial Sequence
  Synthetic oligonucleotide; CTC chr11 5255139 5255160 5255144 5255139 -
actggagctacagacaagaagg

SEQ ID NO: 139146 - DNA, 22 bp, Artificial Sequence
  Synthetic oligonucleotide; CTG chr11 5255135 5255156 5255140 5255135 -
gagctacagacaagaaggtgaa

SEQ ID NO: 139147 - DNA, 22 bp, Artificial Sequence
  Synthetic oligonucleotide; CTA chr11 5255129 5255150 5255134 5255129 -
cagacaagaaggtgaaaaacgg

SEQ ID NO: 139148 - DNA, 22 bp, Artificial Sequence
  Synthetic oligonucleotide; CTG chr11 5255104 5255125 5255109 5255104 -
acaaaagaagtcctggtatctt

SEQ ID NO: 139149 - DNA, 22 bp, Artificial Sequence
  Synthetic oligonucleotide; CTG chr11 5255089 5255110 5255094 5255089 -
gtatcttctatggtgggagaag

SEQ ID NO: 139150 - DNA, 22 bp, Artificial Sequence
  Synthetic oligonucleotide; CTT chr11 5255082 5255103 5255087 5255082 -
ctatggtgggagaagaaaacta

SEQ ID NO: 139151 - DNA, 22 bp, Artificial Sequence
  Synthetic oligonucleotide; TTC chr11 5255081 5255102 5255086 5255081 -
tatggtgggagaagaaaactag

SEQ ID NO: 139152 - DNA, 22 bp, Artificial Sequence
  Synthetic oligonucleotide; CTA chr11 5255079 5255100 5255084 5255079 -
tggtgggagaagaaaactagct

SEQ ID NO: 139153 - DNA, 22 bp, Artificial Sequence
  Synthetic oligonucleotide; CTA chr11 5255060 5255081 5255065 5255060 -
gctaaagggaagaataaattag

SEQ ID NO: 139154 - DNA, 22 bp, Artificial Sequence
  Synthetic oligonucleotide; CTA chr11 5255056 5255077 5255061 5255056 -
aagggaagaataaattagagaa

SEQ ID NO: 139155 - DNA, 22 bp, Artificial Sequence
  Synthetic oligonucleotide; TTA chr11 5255039 5255060 5255044 5255039 -
gagaaaaattggaatgactgaa

SEQ ID NO: 139156 - DNA, 22 bp, Artificial Sequence
  Synthetic oligonucleotide; TTG chr11 5255028 5255049 5255033 5255028 -
gaatgactgaatcggaacaagg

SEQ ID NO: 139157 - DNA, 22 bp, Artificial Sequence
  Synthetic oligonucleotide; CTG chr11 5255019 5255040 5255024 5255019 -
aatcggaacaaggcaaaggcta

SEQ ID NO: 139158 - DNA, 22 bp, Artificial Sequence
  Synthetic oligonucleotide; CTA chr11 5254997 5255018 5255002 5254997 -
taaaaaaaattaagcagcagta

SEQ ID NO: 139159 - DNA, 22 bp, Artificial Sequence
  Synthetic oligonucleotide; TTA chr11 5254985 5255006 5254990 5254985 -
agcagcagtatcctcttggggg

SEQ ID NO: 139160 - DNA, 22 bp, Artificial Sequence
  Synthetic oligonucleotide; CTC chr11 5254970 5254991 5254975 5254970 -
ttgggggccccttccccacact

SEQ ID NO: 139161 - DNA, 22 bp, Artificial Sequence
  Synthetic oligonucleotide; CTT chr11 5254968 5254989 5254973 5254968 -
gggggccccttccccacactat

SEQ ID NO: 139162 - DNA, 22 bp, Artificial Sequence
  Synthetic oligonucleotide; TTG chr11 5254967 5254988 5254972 5254967 -
ggggccccttccccacactatc

SEQ ID NO: 139163 - DNA, 22 bp, Artificial Sequence
  Synthetic oligonucleotide; CTT chr11 5254957 5254978 5254962 5254957 -
ccccacactatctcaatgcaaa

SEQ ID NO: 139164 - DNA, 22 bp, Artificial Sequence
  Synthetic oligonucleotide; TTC chr11 5254956 5254977 5254961 5254956 -
cccacactatctcaatgcaaat

SEQ ID NO: 139165 - DNA, 22 bp, Artificial Sequence
  Synthetic oligonucleotide; CTA chr11 5254947 5254968 5254952 5254947 -
tctcaatgcaaatatctgtctg

SEQ ID NO: 139166 - DNA, 22 bp, Artificial Sequence
  Synthetic oligonucleotide; CTC chr11 5254943 5254964 5254948 5254943 -
aatgcaaatatctgtctgaaac

SEQ ID NO: 139167 - DNA, 22 bp, Artificial Sequence
  Synthetic oligonucleotide; CTG chr11 5254929 5254950 5254934 5254929 -
tctgaaacggtccctggctaaa

SEQ ID NO: 139168 - DNA, 22 bp, Artificial Sequence
  Synthetic oligonucleotide; CTG chr11 5254925 5254946 5254930 5254925 -
aaacggtccctggctaaactcc

SEQ ID NO: 139169 - DNA, 22 bp, Artificial Sequence
  Synthetic oligonucleotide; CTG chr11 5254913 5254934 5254918 5254913 -
gctaaactccacccatgggttg

SEQ ID NO: 139170 - DNA, 22 bp, Artificial Sequence
  Synthetic oligonucleotide; CTA chr11 5254909 5254930 5254914 5254909 -
aactccacccatgggttggcca

SEQ ID NO: 139171 - DNA, 22 bp, Artificial Sequence
  Synthetic oligonucleotide; CTC chr11 5254904 5254925 5254909 5254904 -
cacccatgggttggccagcctt

SEQ ID NO: 139172 - DNA, 22 bp, Artificial Sequence
  Synthetic oligonucleotide; TTG chr11 5254891 5254912 5254896 5254891 -
gccagccttgccttgaccaata

SEQ ID NO: 139173 - DNA, 22 bp, Artificial Sequence
  Synthetic oligonucleotide; CTT chr11 5254882 5254903 5254887 5254882 -
gccttgaccaatagccttgaca

SEQ ID NO: 139174 - DNA, 22 bp, Artificial Sequence
  Synthetic oligonucleotide; TTG chr11 5254881 5254902 5254886 5254881 -
ccttgaccaatagccttgacaa

SEQ ID NO: 139175 - DNA, 22 bp, Artificial Sequence
  Synthetic oligonucleotide; CTT chr11 5254877 5254898 5254882 5254877 -
gaccaatagccttgacaaggca

SEQ ID NO: 139176 - DNA, 22 bp, Artificial Sequence
  Synthetic oligonucleotide; TTG chr11 5254876 5254897 5254881 5254876 -
accaatagccttgacaaggcaa

SEQ ID NO: 139177 - DNA, 22 bp, Artificial Sequence
  Synthetic oligonucleotide; CTT chr11 5254864 5254885 5254869 5254864 -
gacaaggcaaacttgaccaata

SEQ ID NO: 139178 - DNA, 22 bp, Artificial Sequence
  Synthetic oligonucleotide; TTG chr11 5254863 5254884 5254868 5254863 -
acaaggcaaacttgaccaatag

SEQ ID NO: 139179 - DNA, 22 bp, Artificial Sequence
  Synthetic oligonucleotide; CTT chr11 5254850 5254871 5254855 5254850 -
gaccaatagtcttagagtatcc

SEQ ID NO: 139180 - DNA, 22 bp, Artificial Sequence
  Synthetic oligonucleotide; TTG chr11 5254849 5254870 5254854 5254849 -
accaatagtcttagagtatcca

SEQ ID NO: 139181 - DNA, 22 bp, Artificial Sequence
  Synthetic oligonucleotide; CTT chr11 5254837 5254858 5254842 5254837 -
agagtatccagtgaggccaggg

SEQ ID NO: 139182 - DNA, 22 bp, Artificial Sequence
  Synthetic oligonucleotide; TTA chr11 5254836 5254857 5254841 5254836 -
gagtatccagtgaggccagggg

SEQ ID NO: 139183 - DNA, 22 bp, Artificial Sequence
  Synthetic oligonucleotide; CTG chr11 5254804 5254825 5254809 5254804 -
gctagggatgaagaataaaagg

SEQ ID NO: 139184 - DNA, 22 bp, Artificial Sequence
  Synthetic oligonucleotide; CTA chr11 5254800 5254821 5254805 5254800 -
gggatgaagaataaaaggaagc

SEQ ID NO: 139185 - DNA, 22 bp, Artificial Sequence
  Synthetic oligonucleotide; CTT chr11 5254772 5254793 5254777 5254772 -
cagcagttccacacactcgctt

SEQ ID NO: 139186 - DNA, 22 bp, Artificial Sequence
  Synthetic oligonucleotide; TTC chr11 5254771 5254792 5254776 5254771 -
agcagttccacacactcgcttc

SEQ ID NO: 139187 - DNA, 22 bp, Artificial Sequence
  Synthetic oligonucleotide; TTC chr11 5254763 5254784 5254768 5254763 -
cacacactcgcttctggaacgt

SEQ ID NO: 139188 - DNA, 22 bp, Artificial Sequence
  Synthetic oligonucleotide; CTC chr11 5254754 5254775 5254759 5254754 -
gcttctggaacgtctgaggtta

SEQ ID NO: 139189 - DNA, 22 bp, Artificial Sequence
  Synthetic oligonucleotide; CTT chr11 5254750 5254771 5254755 5254750 -
ctggaacgtctgaggttatcaa

SEQ ID NO: 139190 - DNA, 22 bp, Artificial Sequence
  Synthetic oligonucleotide; TTC chr11 5254749 5254770 5254754 5254749 -
tggaacgtctgaggttatcaat

SEQ ID NO: 139191 - DNA, 22 bp, Artificial Sequence
  Synthetic oligonucleotide; CTG chr11 5254747 5254768 5254752 5254747 -
gaacgtctgaggttatcaataa

SEQ ID NO: 139192 - DNA, 22 bp, Artificial Sequence
  Synthetic oligonucleotide; CTG chr11 5254738 5254759 5254743 5254738 -
aggttatcaataagctcctagt

SEQ ID NO: 139193 - DNA, 22 bp, Artificial Sequence
  Synthetic oligonucleotide; TTA chr11 5254732 5254753 5254737 5254732 -
tcaataagctcctagtccagac

SEQ ID NO: 139194 - DNA, 22 bp, Artificial Sequence
  Synthetic oligonucleotide; CTC chr11 5254721 5254742 5254726 5254721 -
ctagtccagacgccatgggtca

SEQ ID NO: 139195 - DNA, 22 bp, Artificial Sequence
  Synthetic oligonucleotide; CTA chr11 5254718 5254739 5254723 5254718 -
gtccagacgccatgggtcattt

SEQ ID NO: 139196 - DNA, 22 bp, Artificial Sequence
  Synthetic oligonucleotide; TTT chr11 5254696 5254717 5254701 5254696 -
cacagaggaggacaaggctact

SEQ ID NO: 139197 - DNA, 22 bp, Artificial Sequence
  Synthetic oligonucleotide; TTC chr11 5254695 5254716 5254700 5254695 -
acagaggaggacaaggctacta

SEQ ID NO: 139198 - DNA, 22 bp, Artificial Sequence
  Synthetic oligonucleotide; CTA chr11 5254676 5254697 5254681 5254676 -
ctatcacaagcctgtggggcaa

SEQ ID NO: 139199 - DNA, 22 bp, Artificial Sequence
  Synthetic oligonucleotide; CTA chr11 5254673 5254694 5254678 5254673 -
tcacaagcctgtggggcaaggt

SEQ ID NO: 139200 - DNA, 22 bp, Artificial Sequence
  Synthetic oligonucleotide; CTG chr11 5254662 5254683 5254667 5254662 -
tggggcaaggtgaatgtggaag

SEQ ID NO: 139201 - DNA, 22 bp, Artificial Sequence
  Synthetic oligonucleotide; CTG chr11 5254634 5254655 5254639 5254634 -
gaggagaaaccctgggaaggta

SEQ ID NO: 139202 - DNA, 22 bp, Artificial Sequence
  Synthetic oligonucleotide; CTG chr11 5254620 5254641 5254625 5254620 -
ggaaggtaggctctggtgacca

SEQ ID NO: 139203 - DNA, 22 bp, Artificial Sequence
  Synthetic oligonucleotide; CTC chr11 5254607 5254628 5254612 5254607 -
tggtgaccaggacaagggaggg

SEQ ID NO: 139204 - DNA, 22 bp, Artificial Sequence
  Synthetic oligonucleotide; CTG chr11 5254605 5254626 5254610 5254605 -
gtgaccaggacaagggagggaa

SEQ ID NO: 139205 - DNA, 22 bp, Artificial Sequence
  Synthetic oligonucleotide; CTG chr11 5254571 5254592 5254576 5254571 -
tgcctggcaaaagtccaggtcg

SEQ ID NO: 139206 - DNA, 22 bp, Artificial Sequence
  Synthetic oligonucleotide; CTG chr11 5254565 5254586 5254570 5254565 -
gcaaaagtccaggtcgcttctc

SEQ ID NO: 139207 - DNA, 22 bp, Artificial Sequence
  Synthetic oligonucleotide; CTT chr11 5254546 5254567 5254551 5254546 -
ctcaggatttgtggcaccttct

SEQ ID NO: 139208 - DNA, 22 bp, Artificial Sequence
  Synthetic oligonucleotide; TTC chr11 5254545 5254566 5254550 5254545 -
tcaggatttgtggcaccttctg

SEQ ID NO: 139209 - DNA, 22 bp, Artificial Sequence
  Synthetic oligonucleotide; CTC chr11 5254543 5254564 5254548 5254543 -
aggatttgtggcaccttctgac

SEQ ID NO: 139210 - DNA, 22 bp, Artificial Sequence
  Synthetic oligonucleotide; TTT chr11 5254536 5254557 5254541 5254536 -
gtggcaccttctgactgtcaaa

SEQ ID NO: 139211 - DNA, 22 bp, Artificial Sequence
  Synthetic oligonucleotide; TTG chr11 5254535 5254556 5254540 5254535 -
tggcaccttctgactgtcaaac

SEQ ID NO: 139212 - DNA, 22 bp, Artificial Sequence
  Synthetic oligonucleotide; CTT chr11 5254526 5254547 5254531 5254526 -
ctgactgtcaaactgttcttgt

SEQ ID NO: 139213 - DNA, 22 bp, Artificial Sequence
  Synthetic oligonucleotide; TTC chr11 5254525 5254546 5254530 5254525 -
tgactgtcaaactgttcttgtc

SEQ ID NO: 139214 - DNA, 22 bp, Artificial Sequence
  Synthetic oligonucleotide; CTG chr11 5254523 5254544 5254528 5254523 -
actgtcaaactgttcttgtcaa

SEQ ID NO: 139215 - DNA, 22 bp, Artificial Sequence
  Synthetic oligonucleotide; CTG chr11 5254519 5254540 5254524 5254519 -
tcaaactgttcttgtcaatctc

SEQ ID NO: 139216 - DNA, 22 bp, Artificial Sequence
  Synthetic oligonucleotide; CTG chr11 5254511 5254532 5254516 5254511 -
ttcttgtcaatctcacaggctc

SEQ ID NO: 139217 - DNA, 22 bp, Artificial Sequence
  Synthetic oligonucleotide; TTC chr11 5254508 5254529 5254513 5254508 -
ttgtcaatctcacaggctcctg

SEQ ID NO: 139218 - DNA, 22 bp, Artificial Sequence
  Synthetic oligonucleotide; CTT chr11 5254506 5254527 5254511 5254506 -
gtcaatctcacaggctcctggt

SEQ ID NO: 139219 - DNA, 22 bp, Artificial Sequence
  Synthetic oligonucleotide; TTG chr11 5254505 5254526 5254510 5254505 -
tcaatctcacaggctcctggtt

SEQ ID NO: 139220 - DNA, 22 bp, Artificial Sequence
  Synthetic oligonucleotide; CTC chr11 5254497 5254518 5254502 5254497 -
acaggctcctggttgtctaccc

SEQ ID NO: 139221 - DNA, 22 bp, Artificial Sequence
  Synthetic oligonucleotide; CTC chr11 5254489 5254510 5254494 5254489 -
ctggttgtctacccatggaccc

SEQ ID NO: 139222 - DNA, 22 bp, Artificial Sequence
  Synthetic oligonucleotide; CTG chr11 5254486 5254507 5254491 5254486 -
gttgtctacccatggacccaga

SEQ ID NO: 139223 - DNA, 22 bp, Artificial Sequence
  Synthetic oligonucleotide; TTG chr11 5254482 5254503 5254487 5254482 -
tctacccatggacccagaggtt

SEQ ID NO: 139224 - DNA, 22 bp, Artificial Sequence
  Synthetic oligonucleotide; CTA chr11 5254478 5254499 5254483 5254478 -
cccatggacccagaggttcttt

SEQ ID NO: 139225 - DNA, 22 bp, Artificial Sequence
  Synthetic oligonucleotide; TTC chr11 5254459 5254480 5254464 5254459 -
tttgacagctttggcaacctgt

SEQ ID NO: 139226 - DNA, 22 bp, Artificial Sequence
  Synthetic oligonucleotide; CTT chr11 5254457 5254478 5254462 5254457 -
tgacagctttggcaacctgtcc

SEQ ID NO: 139227 - DNA, 22 bp, Artificial Sequence
  Synthetic oligonucleotide; TTT chr11 5254456 5254477 5254461 5254456 -
gacagctttggcaacctgtcct

SEQ ID NO: 139228 - DNA, 22 bp, Artificial Sequence
  Synthetic oligonucleotide; TTG chr11 5254455 5254476 5254460 5254455 -
acagctttggcaacctgtcctc

SEQ ID NO: 139229 - DNA, 22 bp, Artificial Sequence
  Synthetic oligonucleotide; CTT chr11 5254448 5254469 5254453 5254448 -
tggcaacctgtcctctgcctct

SEQ ID NO: 139230 - DNA, 22 bp, Artificial Sequence
  Synthetic oligonucleotide; TTT chr11 5254447 5254468 5254452 5254447 -
ggcaacctgtcctctgcctctg

SEQ ID NO: 139231 - DNA, 22 bp, Artificial Sequence
  Synthetic oligonucleotide; TTG chr11 5254446 5254467 5254451 5254446 -
gcaacctgtcctctgcctctgc

SEQ ID NO: 139232 - DNA, 22 bp, Artificial Sequence
  Synthetic oligonucleotide; CTG chr11 5254438 5254459 5254443 5254438 -
tcctctgcctctgccatcatgg

SEQ ID NO: 139233 - DNA, 22 bp, Artificial Sequence
  Synthetic oligonucleotide; CTC chr11 5254433 5254454 5254438 5254433 -
tgcctctgccatcatgggcaac

SEQ ID NO: 139234 - DNA, 22 bp, Artificial Sequence
  Synthetic oligonucleotide; CTG chr11 5254431 5254452 5254436 5254431 -
cctctgccatcatgggcaaccc

SEQ ID NO: 139235 - DNA, 22 bp, Artificial Sequence
  Synthetic oligonucleotide; CTC chr11 5254427 5254448 5254432 5254427 -
tgccatcatgggcaaccccaaa

SEQ ID NO: 139236 - DNA, 22 bp, Artificial Sequence
  Synthetic oligonucleotide; CTG chr11 5254425 5254446 5254430 5254425 -
ccatcatgggcaaccccaaagt

SEQ ID NO: 139237 - DNA, 22 bp, Artificial Sequence
  Synthetic oligonucleotide; CTG chr11 5254378 5254399 5254383 5254378 -
acttccttgggagatgccataa

SEQ ID NO: 139238 - DNA, 22 bp, Artificial Sequence
  Synthetic oligonucleotide; CTT chr11 5254374 5254395 5254379 5254374 -
ccttgggagatgccataaagca

SEQ ID NO: 139239 - DNA, 22 bp, Artificial Sequence
  Synthetic oligonucleotide; TTC chr11 5254373 5254394 5254378 5254373 -
cttgggagatgccataaagcac

SEQ ID NO: 139240 - DNA, 22 bp, Artificial Sequence
  Synthetic oligonucleotide; CTT chr11 5254370 5254391 5254375 5254370 -
gggagatgccataaagcacctg

SEQ ID NO: 139241 - DNA, 22 bp, Artificial Sequence
  Synthetic oligonucleotide; TTG chr11 5254369 5254390 5254374 5254369 -
ggagatgccataaagcacctgg

SEQ ID NO: 139242 - DNA, 22 bp, Artificial Sequence
  Synthetic oligonucleotide; CTG chr11 5254348 5254369 5254353 5254348 -
gatgatctcaagggcacctttg

SEQ ID NO: 139243 - DNA, 22 bp, Artificial Sequence
  Synthetic oligonucleotide; CTC chr11 5254339 5254360 5254344 5254339 -
aagggcacctttgcccagctga

SEQ ID NO: 139244 - DNA, 22 bp, Artificial Sequence
  Synthetic oligonucleotide; CTT chr11 5254328 5254349 5254333 5254328 -
tgcccagctgagtgaactgcac

SEQ ID NO: 139245 - DNA, 22 bp, Artificial Sequence
  Synthetic oligonucleotide; TTT chr11 5254327 5254348 5254332 5254327 -
gcccagctgagtgaactgcact

SEQ ID NO: 139246 - DNA, 22 bp, Artificial Sequence
  Synthetic oligonucleotide; TTG chr11 5254326 5254347 5254331 5254326 -
cccagctgagtgaactgcactg

SEQ ID NO: 139247 - DNA, 22 bp, Artificial Sequence
  Synthetic oligonucleotide; CTG chr11 5254318 5254339 5254323 5254318 -
agtgaactgcactgtgacaagc

SEQ ID NO: 139248 - DNA, 22 bp, Artificial Sequence
  Synthetic oligonucleotide; CTG chr11 5254309 5254330 5254314 5254309 -
cactgtgacaagctgcatgtgg

SEQ ID NO: 139249 - DNA, 22 bp, Artificial Sequence
  Synthetic oligonucleotide; CTG chr11 5254304 5254325 5254309 5254304 -
tgacaagctgcatgtggatcct

SEQ ID NO: 139250 - DNA, 22 bp, Artificial Sequence
  Synthetic oligonucleotide; CTG chr11 5254294 5254315 5254299 5254294 -
catgtggatcctgagaacttca

SEQ ID NO: 139251 - DNA, 22 bp, Artificial Sequence
  Synthetic oligonucleotide; CTG chr11 5254281 5254302 5254286 5254281 -
agaacttcaaggtgagtccagg

SEQ ID NO: 139252 - DNA, 22 bp, Artificial Sequence
  Synthetic oligonucleotide; CTT chr11 5254274 5254295 5254279 5254274 -
caaggtgagtccaggagatgtt

SEQ ID NO: 139253 - DNA, 22 bp, Artificial Sequence
  Synthetic oligonucleotide; TTC chr11 5254273 5254294 5254278 5254273 -
aaggtgagtccaggagatgttt

SEQ ID NO: 139254 - DNA, 22 bp, Artificial Sequence
  Synthetic oligonucleotide; TTT chr11 5254251 5254272 5254256 5254251 -
cagcactgttgcctttagtctc

SEQ ID NO: 139255 - DNA, 22 bp, Artificial Sequence
  Synthetic oligonucleotide; TTC chr11 5254250 5254271 5254255 5254250 -
agcactgttgcctttagtctcg

SEQ ID NO: 139256 - DNA, 22 bp, Artificial Sequence
  Synthetic oligonucleotide; CTG chr11 5254243 5254264 5254248 5254243 -
ttgcctttagtctcgaggcaac

SEQ ID NO: 139257 - DNA, 22 bp, Artificial Sequence
  Synthetic oligonucleotide; TTG chr11 5254240 5254261 5254245 5254240 -
cctttagtctcgaggcaactta

SEQ ID NO: 139258 - DNA, 22 bp, Artificial Sequence
  Synthetic oligonucleotide; CTT chr11 5254236 5254257 5254241 5254236 -
tagtctcgaggcaacttagaca

SEQ ID NO: 139259 - DNA, 22 bp, Artificial Sequence
  Synthetic oligonucleotide; TTT chr11 5254235 5254256 5254240 5254235 -
agtctcgaggcaacttagacaa

SEQ ID NO: 139260 - DNA, 22 bp, Artificial Sequence
  Synthetic oligonucleotide; TTA chr11 5254234 5254255 5254239 5254234 -
gtctcgaggcaacttagacaac

SEQ ID NO: 139261 - DNA, 22 bp, Artificial Sequence
  Synthetic oligonucleotide; CTC chr11 5254229 5254250 5254234 5254229 -
gaggcaacttagacaactgagt

SEQ ID NO: 139262 - DNA, 22 bp, Artificial Sequence
  Synthetic oligonucleotide; CTT chr11 5254219 5254240 5254224 5254219 -
agacaactgagtattgatctga

SEQ ID NO: 139263 - DNA, 22 bp, Artificial Sequence
  Synthetic oligonucleotide; TTA chr11 5254218 5254239 5254223 5254218 -
gacaactgagtattgatctgag

SEQ ID NO: 139264 - DNA, 22 bp, Artificial Sequence
  Synthetic oligonucleotide; CTG chr11 5254210 5254231 5254215 5254210 -
agtattgatctgagcacagcag

SEQ ID NO: 139265 - DNA, 22 bp, Artificial Sequence
  Synthetic oligonucleotide; TTG chr11 5254203 5254224 5254208 5254203 -
atctgagcacagcagggtgtga

SEQ ID NO: 139266 - DNA, 22 bp, Artificial Sequence
  Synthetic oligonucleotide; CTG chr11 5254198 5254219 5254203 5254198 -
agcacagcagggtgtgagctgt

SEQ ID NO: 139267 - DNA, 22 bp, Artificial Sequence
  Synthetic oligonucleotide; CTG chr11 5254177 5254198 5254182 5254177 -
tttgaagatactggggttggga

SEQ ID NO: 139268 - DNA, 22 bp, Artificial Sequence
  Synthetic oligonucleotide; TTT chr11 5254174 5254195 5254179 5254174 -
gaagatactggggttgggagtg

SEQ ID NO: 139269 - DNA, 22 bp, Artificial Sequence
  Synthetic oligonucleotide; TTG chr11 5254173 5254194 5254178 5254173 -
aagatactggggttgggagtga

SEQ ID NO: 139270 - DNA, 22 bp, Artificial Sequence
  Synthetic oligonucleotide; CTG chr11 5254164 5254185 5254169 5254164 -
gggttgggagtgaagaaactgc

SEQ ID NO: 139271 - DNA, 22 bp, Artificial Sequence
  Synthetic oligonucleotide; TTG chr11 5254158 5254179 5254163 5254158 -
ggagtgaagaaactgcagagga

SEQ ID NO: 139272 - DNA, 22 bp, Artificial Sequence
  Synthetic oligonucleotide; CTG chr11 5254143 5254164 5254148 5254143 -
cagaggactaactgggctgaga

SEQ ID NO: 139273 - DNA, 22 bp, Artificial Sequence
  Synthetic oligonucleotide; CTA chr11 5254133 5254154 5254138 5254133 -
actgggctgagacccagtggca

SEQ ID NO: 139274 - DNA, 22 bp, Artificial Sequence
  Synthetic oligonucleotide; CTG chr11 5254129 5254150 5254134 5254129 -
ggctgagacccagtggcaatgt

SEQ ID NO: 139275 - DNA, 22 bp, Artificial Sequence
  Synthetic oligonucleotide; CTG chr11 5254124 5254145 5254129 5254124 -
agacccagtggcaatgttttag

SEQ ID NO: 139276 - DNA, 22 bp, Artificial Sequence
  Synthetic oligonucleotide; TTT chr11 5254105 5254126 5254110 5254105 -
tagggcctaaggagtgcctctg

SEQ ID NO: 139277 - DNA, 22 bp, Artificial Sequence
  Synthetic oligonucleotide; TTT chr11 5254104 5254125 5254109 5254104 -
agggcctaaggagtgcctctga

SEQ ID NO: 139278 - DNA, 22 bp, Artificial Sequence
  Synthetic oligonucleotide; TTA chr11 5254103 5254124 5254108 5254103 -
gggcctaaggagtgcctctgaa

SEQ ID NO: 139279 - DNA, 22 bp, Artificial Sequence
  Synthetic oligonucleotide; CTA chr11 5254096 5254117 5254101 5254096 -
aggagtgcctctgaaaatctag

SEQ ID NO: 139280 - DNA, 22 bp, Artificial Sequence
  Synthetic oligonucleotide; CTC chr11 5254085 5254106 5254090 5254085 -
tgaaaatctagatggacaactt

SEQ ID NO: 139281 - DNA, 22 bp, Artificial Sequence
  Synthetic oligonucleotide; CTG chr11 5254083 5254104 5254088 5254083 -
aaaatctagatggacaactttg

SEQ ID NO: 139282 - DNA, 22 bp, Artificial Sequence
  Synthetic oligonucleotide; CTA chr11 5254075 5254096 5254080 5254075 -
gatggacaactttgactttgag

SEQ ID NO: 139283 - DNA, 22 bp, Artificial Sequence
  Synthetic oligonucleotide; CTT chr11 5254063 5254084 5254068 5254063 -
tgactttgagaaaagagaggtg

SEQ ID NO: 139284 - DNA, 22 bp, Artificial Sequence
  Synthetic oligonucleotide; TTT chr11 5254062 5254083 5254067 5254062 -
gactttgagaaaagagaggtgg

SEQ ID NO: 139285 - DNA, 22 bp, Artificial Sequence
  Synthetic oligonucleotide; TTG chr11 5254061 5254082 5254066 5254061 -
actttgagaaaagagaggtgga

SEQ ID NO: 139286 - DNA, 22 bp, Artificial Sequence
  Synthetic oligonucleotide; CTT chr11 5254057 5254078 5254062 5254057 -
tgagaaaagagaggtggaaatg

SEQ ID NO: 139287 - DNA, 22 bp, Artificial Sequence
  Synthetic oligonucleotide; TTT chr11 5254056 5254077 5254061 5254056 -
gagaaaagagaggtggaaatga

SEQ ID NO: 139288 - DNA, 22 bp, Artificial Sequence
  Synthetic oligonucleotide; TTG chr11 5254055 5254076 5254060 5254055 -
agaaaagagaggtggaaatgag

SEQ ID NO: 139289 - DNA, 22 bp, Artificial Sequence
  Synthetic oligonucleotide; CTT chr11 5254022 5254043 5254027 5254022 -
ttctttattagatttcggtaga

SEQ ID NO: 139290 - DNA, 22 bp, Artificial Sequence
  Synthetic oligonucleotide; TTT chr11 5254021 5254042 5254026 5254021 -
tctttattagatttcggtagaa

SEQ ID NO: 139291 - DNA, 22 bp, Artificial Sequence
  Synthetic oligonucleotide; TTT chr11 5254020 5254041 5254025 5254020 -
ctttattagatttcggtagaaa

SEQ ID NO: 139292 - DNA, 22 bp, Artificial Sequence
  Synthetic oligonucleotide; TTC chr11 5254019 5254040 5254024 5254019 -
tttattagatttcggtagaaag

SEQ ID NO: 139293 - DNA, 22 bp, Artificial Sequence
  Synthetic oligonucleotide; CTT chr11 5254017 5254038 5254022 5254017 -
tattagatttcggtagaaagaa

SEQ ID NO: 139294 - DNA, 22 bp, Artificial Sequence
  Synthetic oligonucleotide; TTT chr11 5254016 5254037 5254021 5254016 -
attagatttcggtagaaagaac

SEQ ID NO: 139295 - DNA, 22 bp, Artificial Sequence
  Synthetic oligonucleotide; TTA chr11 5254015 5254036 5254020 5254015 -
ttagatttcggtagaaagaact

SEQ ID NO: 139296 - DNA, 22 bp, Artificial Sequence
  Synthetic oligonucleotide; TTA chr11 5254012 5254033 5254017 5254012 -
gatttcggtagaaagaactttc

SEQ ID NO: 139297 - DNA, 22 bp, Artificial Sequence
  Synthetic oligonucleotide; TTT chr11 5254007 5254028 5254012 5254007 -
cggtagaaagaactttcacctt

SEQ ID NO: 139298 - DNA, 22 bp, Artificial Sequence
  Synthetic oligonucleotide; TTC chr11 5254006 5254027 5254011 5254006 -
ggtagaaagaactttcaccttt

SEQ ID NO: 139299 - DNA, 22 bp, Artificial Sequence
  Synthetic oligonucleotide; CTT chr11 5253992 5254013 5253997 5253992 -
tcacctttcccctatttttgtt

SEQ ID NO: 139300 - DNA, 22 bp, Artificial Sequence
  Synthetic oligonucleotide; TTT chr11 5253991 5254012 5253996 5253991 -
cacctttcccctatttttgtta

SEQ ID NO: 139301 - DNA, 22 bp, Artificial Sequence
  Synthetic oligonucleotide; TTC chr11 5253990 5254011 5253995 5253990 -
acctttcccctatttttgttat

SEQ ID NO: 139302 - DNA, 22 bp, Artificial Sequence
  Synthetic oligonucleotide; CTT chr11 5253985 5254006 5253990 5253985 -
tcccctatttttgttattcgtt

SEQ ID NO: 139303 - DNA, 22 bp, Artificial Sequence
  Synthetic oligonucleotide; TTT chr11 5253984 5254005 5253989 5253984 -
cccctatttttgttattcgttt

SEQ ID NO: 139304 - DNA, 22 bp, Artificial Sequence
  Synthetic oligonucleotide; TTC chr11 5253983 5254004 5253988 5253983 -
ccctatttttgttattcgtttt

SEQ ID NO: 139305 - DNA, 22 bp, Artificial Sequence
  Synthetic oligonucleotide; CTA chr11 5253978 5253999 5253983 5253978 -
tttttgttattcgttttaaaac

SEQ ID NO: 139306 - DNA, 22 bp, Artificial Sequence
  Synthetic oligonucleotide; TTT chr11 5253975 5253996 5253980 5253975 -
ttgttattcgttttaaaacatc

SEQ ID NO: 139307 - DNA, 22 bp, Artificial Sequence
  Synthetic oligonucleotide; TTT chr11 5253974 5253995 5253979 5253974 -
tgttattcgttttaaaacatct

SEQ ID NO: 139308 - DNA, 22 bp, Artificial Sequence
  Synthetic oligonucleotide; TTT chr11 5253973 5253994 5253978 5253973 -
gttattcgttttaaaacatcta

SEQ ID NO: 139309 - DNA, 22 bp, Artificial Sequence
  Synthetic oligonucleotide; TTG chr11 5253972 5253993 5253977 5253972 -
ttattcgttttaaaacatctat

SEQ ID NO: 139310 - DNA, 22 bp, Artificial Sequence
  Synthetic oligonucleotide; TTA chr11 5253969 5253990 5253974 5253969 -
ttcgttttaaaacatctatctg

SEQ ID NO: 139311 - DNA, 22 bp, Artificial Sequence
  Synthetic oligonucleotide; TTC chr11 5253966 5253987 5253971 5253966 -
gttttaaaacatctatctggag

SEQ ID NO: 139312 - DNA, 22 bp, Artificial Sequence
  Synthetic oligonucleotide; TTT chr11 5253962 5253983 5253967 5253962 -
taaaacatctatctggaggcag

SEQ ID NO: 139313 - DNA, 22 bp, Artificial Sequence
  Synthetic oligonucleotide; TTT chr11 5253961 5253982 5253966 5253961 -
aaaacatctatctggaggcagg

SEQ ID NO: 139314 - DNA, 22 bp, Artificial Sequence
  Synthetic oligonucleotide; TTA chr11 5253960 5253981 5253965 5253960 -
aaacatctatctggaggcagga

SEQ ID NO: 139315 - DNA, 22 bp, Artificial Sequence
  Synthetic oligonucleotide; CTA chr11 5253951 5253972 5253956 5253951 -
tctggaggcaggacaagtatgg

SEQ ID NO: 139316 - DNA, 22 bp, Artificial Sequence
  Synthetic oligonucleotide; CTG chr11 5253947 5253968 5253952 5253947 -
gaggcaggacaagtatggtcat

SEQ ID NO: 139317 - DNA, 22 bp, Artificial Sequence
  Synthetic oligonucleotide; TTA chr11 5253923 5253944 5253928 5253923 -
aaaagatgcaggcagaaggcat

SEQ ID NO: 139318 - DNA, 22 bp, Artificial Sequence
  Synthetic oligonucleotide; TTG chr11 5253895 5253916 5253900 5253895 -
gctcagtcaaagtggggaactt

SEQ ID NO: 139319 - DNA, 22 bp, Artificial Sequence
  Synthetic oligonucleotide; CTC chr11 5253891 5253912 5253896 5253891 -
agtcaaagtggggaactttggt

SEQ ID NO: 139320 - DNA, 22 bp, Artificial Sequence
  Synthetic oligonucleotide; CTT chr11 5253873 5253894 5253878 5253873 -
tggtggccaaacatacattgct

SEQ ID NO: 139321 - DNA, 22 bp, Artificial Sequence
  Synthetic oligonucleotide; TTT chr11 5253872 5253893 5253877 5253872 -
ggtggccaaacatacattgcta

SEQ ID NO: 139322 - DNA, 22 bp, Artificial Sequence
  Synthetic oligonucleotide; TTG chr11 5253871 5253892 5253876 5253871 -
gtggccaaacatacattgctaa

SEQ ID NO: 139323 - DNA, 22 bp, Artificial Sequence
  Synthetic oligonucleotide; TTG chr11 5253853 5253874 5253858 5253853 -
ctaaggctattcctatatcagc

SEQ ID NO: 139324 - DNA, 22 bp, Artificial Sequence
  Synthetic oligonucleotide; CTA chr11 5253850 5253871 5253855 5253850 -
aggctattcctatatcagctgg

SEQ ID NO: 139325 - DNA, 22 bp, Artificial Sequence
  Synthetic oligonucleotide; CTA chr11 5253844 5253865 5253849 5253844 -
ttcctatatcagctggacacat

SEQ ID NO: 139326 - DNA, 22 bp, Artificial Sequence
  Synthetic oligonucleotide; TTC chr11 5253841 5253862 5253846 5253841 -
ctatatcagctggacacatata

SEQ ID NO: 139327 - DNA, 22 bp, Artificial Sequence
  Synthetic oligonucleotide; CTA chr11 5253838 5253859 5253843 5253838 -
tatcagctggacacatataaaa

SEQ ID NO: 139328 - DNA, 22 bp, Artificial Sequence
  Synthetic oligonucleotide; CTG chr11 5253829 5253850 5253834 5253829 -
gacacatataaaatgctgctaa

SEQ ID NO: 139329 - DNA, 22 bp, Artificial Sequence
  Synthetic oligonucleotide; CTG chr11 5253811 5253832 5253816 5253811 -
ctaatgcttcattacaaactta

SEQ ID NO: 139330 - DNA, 22 bp, Artificial Sequence
  Synthetic oligonucleotide; CTA chr11 5253808 5253829 5253813 5253808 -
atgcttcattacaaacttatat

SEQ ID NO: 139331 - DNA, 22 bp, Artificial Sequence
  Synthetic oligonucleotide; CTT chr11 5253802 5253823 5253807 5253802 -
cattacaaacttatatccttta

SEQ ID NO: 139332 - DNA, 22 bp, Artificial Sequence
  Synthetic oligonucleotide; TTC chr11 5253801 5253822 5253806 5253801 -
attacaaacttatatcctttaa

SEQ ID NO: 139333 - DNA, 22 bp, Artificial Sequence
  Synthetic oligonucleotide; TTA chr11 5253797 5253818 5253802 5253797 -
caaacttatatcctttaattcc

SEQ ID NO: 139334 - DNA, 22 bp, Artificial Sequence
  Synthetic oligonucleotide; CTT chr11 5253790 5253811 5253795 5253790 -
atatcctttaattccagatggg

SEQ ID NO: 139335 - DNA, 22 bp, Artificial Sequence
  Synthetic oligonucleotide; TTA chr11 5253789 5253810 5253794 5253789 -
tatcctttaattccagatgggg

SEQ ID NO: 139336 - DNA, 22 bp, Artificial Sequence
  Synthetic oligonucleotide; CTT chr11 5253782 5253803 5253787 5253782 -
taattccagatgggggcaaagt

SEQ ID NO: 139337 - DNA, 22 bp, Artificial Sequence
  Synthetic oligonucleotide; TTT chr11 5253781 5253802 5253786 5253781 -
aattccagatgggggcaaagta

SEQ ID NO: 139338 - DNA, 22 bp, Artificial Sequence
  Synthetic oligonucleotide; TTA chr11 5253780 5253801 5253785 5253780 -
attccagatgggggcaaagtat

SEQ ID NO: 139339 - DNA, 22 bp, Artificial Sequence
  Synthetic oligonucleotide; TTC chr11 5253776 5253797 5253781 5253776 -
cagatgggggcaaagtatgtcc

SEQ ID NO: 139340 - DNA, 22 bp, Artificial Sequence
  Synthetic oligonucleotide; TTG chr11 5253736 5253757 5253741 5253736 -
aaacatttgggctggagtagat

SEQ ID NO: 139341 - DNA, 22 bp, Artificial Sequence
  Synthetic oligonucleotide; TTT chr11 5253728 5253749 5253733 5253728 -
gggctggagtagattttgaaag

SEQ ID NO: 139342 - DNA, 22 bp, Artificial Sequence
  Synthetic oligonucleotide; TTG chr11 5253727 5253748 5253732 5253727 -
ggctggagtagattttgaaagt

SEQ ID NO: 139343 - DNA, 22 bp, Artificial Sequence
  Synthetic oligonucleotide; CTG chr11 5253722 5253743 5253727 5253722 -
gagtagattttgaaagtcagct

SEQ ID NO: 139344 - DNA, 22 bp, Artificial Sequence
  Synthetic oligonucleotide; TTT chr11 5253712 5253733 5253717 5253712 -
tgaaagtcagctctgtgtgtgt

SEQ ID NO: 139345 - DNA, 22 bp, Artificial Sequence
  Synthetic oligonucleotide; TTT chr11 5253711 5253732 5253716 5253711 -
gaaagtcagctctgtgtgtgtg

SEQ ID NO: 139346 - DNA, 22 bp, Artificial Sequence
  Synthetic oligonucleotide; TTG chr11 5253710 5253731 5253715 5253710 -
aaagtcagctctgtgtgtgtgt

SEQ ID NO: 139347 - DNA, 22 bp, Artificial Sequence
  Synthetic oligonucleotide; CTC chr11 5253699 5253720 5253704 5253699 -
tgtgtgtgtgtgtgtgtgtgtg

SEQ ID NO: 139348 - DNA, 22 bp, Artificial Sequence
  Synthetic oligonucleotide; CTG chr11 5253697 5253718 5253702 5253697 -
tgtgtgtgtgtgtgtgtgtgcg

SEQ ID NO: 139349 - DNA, 22 bp, Artificial Sequence
  Synthetic oligonucleotide; TTT chr11 5253664 5253685 5253669 5253664 -
gtgtgtgtgtgagagcgtgtgt

SEQ ID NO: 139350 - DNA, 22 bp, Artificial Sequence
  Synthetic oligonucleotide; TTG chr11 5253663 5253684 5253668 5253663 -
tgtgtgtgtgagagcgtgtgtt

SEQ ID NO: 139351 - DNA, 22 bp, Artificial Sequence
  Synthetic oligonucleotide; TTT chr11 5253640 5253661 5253645 5253640 -
cttttaacgttttcagcctaca

SEQ ID NO: 139352 - DNA, 22 bp, Artificial Sequence
  Synthetic oligonucleotide; TTC chr11 5253639 5253660 5253644 5253639 -
ttttaacgttttcagcctacag

SEQ ID NO: 139353 - DNA, 22 bp, Artificial Sequence
  Synthetic oligonucleotide; CTT chr11 5253637 5253658 5253642 5253637 -
ttaacgttttcagcctacagca

SEQ ID NO: 139354 - DNA, 22 bp, Artificial Sequence
  Synthetic oligonucleotide; TTT chr11 5253636 5253657 5253641 5253636 -
taacgttttcagcctacagcat

SEQ ID NO: 139355 - DNA, 22 bp, Artificial Sequence
  Synthetic oligonucleotide; TTT chr11 5253635 5253656 5253640 5253635 -
aacgttttcagcctacagcata

SEQ ID NO: 139356 - DNA, 22 bp, Artificial Sequence
  Synthetic oligonucleotide; TTA chr11 5253634 5253655 5253639 5253634 -
acgttttcagcctacagcatac

SEQ ID NO: 139357 - DNA, 22 bp, Artificial Sequence
  Synthetic oligonucleotide; TTT chr11 5253628 5253649 5253633 5253628 -
tcagcctacagcatacagggtt

SEQ ID NO: 139358 - DNA, 22 bp, Artificial Sequence
  Synthetic oligonucleotide; TTT chr11 5253627 5253648 5253632 5253627 -
cagcctacagcatacagggttc

SEQ ID NO: 139359 - DNA, 22 bp, Artificial Sequence
  Synthetic oligonucleotide; TTC chr11 5253626 5253647 5253631 5253626 -
agcctacagcatacagggttca

SEQ ID NO: 139360 - DNA, 22 bp, Artificial Sequence
  Synthetic oligonucleotide; CTA chr11 5253620 5253641 5253625 5253620 -
cagcatacagggttcatggtgg

SEQ ID NO: 139361 - DNA, 22 bp, Artificial Sequence
  Synthetic oligonucleotide; TTC chr11 5253605 5253626 5253610 5253605 -
atggtggcaagaagataacaag

SEQ ID NO: 139362 - DNA, 22 bp, Artificial Sequence
  Synthetic oligonucleotide; TTT chr11 5253579 5253600 5253584 5253579 -
aaattatggccagtgactagtg

SEQ ID NO: 139363 - DNA, 22 bp, Artificial Sequence
  Synthetic oligonucleotide; TTA chr11 5253578 5253599 5253583 5253578 -
aattatggccagtgactagtgc

SEQ ID NO: 139364 - DNA, 22 bp, Artificial Sequence
  Synthetic oligonucleotide; TTA chr11 5253573 5253594 5253578 5253573 -
tggccagtgactagtgctgcaa

SEQ ID NO: 139365 - DNA, 22 bp, Artificial Sequence
  Synthetic oligonucleotide; CTA chr11 5253560 5253581 5253565 5253560 -
gtgctgcaagaagaacaactac

SEQ ID NO: 139366 - DNA, 22 bp, Artificial Sequence
  Synthetic oligonucleotide; CTG chr11 5253554 5253575 5253559 5253554 -
caagaagaacaactacctgcat

SEQ ID NO: 139367 - DNA, 22 bp, Artificial Sequence
  Synthetic oligonucleotide; CTA chr11 5253539 5253560 5253544 5253539 -
cctgcatttaatgggaaagcaa

SEQ ID NO: 139368 - DNA, 22 bp, Artificial Sequence
  Synthetic oligonucleotide; CTG chr11 5253535 5253556 5253540 5253535 -
catttaatgggaaagcaaaatc

SEQ ID NO: 139369 - DNA, 22 bp, Artificial Sequence
  Synthetic oligonucleotide; TTT chr11 5253530 5253551 5253535 5253530 -
aatgggaaagcaaaatctcagg

SEQ ID NO: 139370 - DNA, 22 bp, Artificial Sequence
  Synthetic oligonucleotide; TTA chr11 5253529 5253550 5253534 5253529 -
atgggaaagcaaaatctcaggc

SEQ ID NO: 139371 - DNA, 22 bp, Artificial Sequence
  Synthetic oligonucleotide; CTC chr11 5253511 5253532 5253516 5253511 -
aggctttgagggaagttaacat

SEQ ID NO: 139372 - DNA, 22 bp, Artificial Sequence
  Synthetic oligonucleotide; CTT chr11 5253505 5253526 5253510 5253505 -
tgagggaagttaacataggctt

SEQ ID NO: 139373 - DNA, 22 bp, Artificial Sequence
  Synthetic oligonucleotide; TTT chr11 5253504 5253525 5253509 5253504 -
gagggaagttaacataggcttg

SEQ ID NO: 139374 - DNA, 22 bp, Artificial Sequence
  Synthetic oligonucleotide; TTG chr11 5253503 5253524 5253508 5253503 -
agggaagttaacataggcttga

SEQ ID NO: 139375 - DNA, 22 bp, Artificial Sequence
  Synthetic oligonucleotide; TTA chr11 5253493 5253514 5253498 5253493 -
acataggcttgattctgggtgg

SEQ ID NO: 139376 - DNA, 22 bp, Artificial Sequence
  Synthetic oligonucleotide; CTT chr11 5253483 5253504 5253488 5253483 -
gattctgggtggaagcttggtg

SEQ ID NO: 139377 - DNA, 22 bp, Artificial Sequence
  Synthetic oligonucleotide; TTG chr11 5253482 5253503 5253487 5253482 -
attctgggtggaagcttggtgt

SEQ ID NO: 139378 - DNA, 22 bp, Artificial Sequence
  Synthetic oligonucleotide; TTC chr11 5253478 5253499 5253483 5253478 -
tgggtggaagcttggtgtgtag

SEQ ID NO: 139379 - DNA, 22 bp, Artificial Sequence
  Synthetic oligonucleotide; CTG chr11 5253476 5253497 5253481 5253476 -
ggtggaagcttggtgtgtagtt

SEQ ID NO: 139380 - DNA, 22 bp, Artificial Sequence
  Synthetic oligonucleotide; CTT chr11 5253465 5253486 5253470 5253465 -
ggtgtgtagttatctggaggcc

SEQ ID NO: 139381 - DNA, 22 bp, Artificial Sequence
  Synthetic oligonucleotide; TTG chr11 5253464 5253485 5253469 5253464 -
gtgtgtagttatctggaggcca

SEQ ID NO: 139382 - DNA, 22 bp, Artificial Sequence
  Synthetic oligonucleotide; TTA chr11 5253453 5253474 5253458 5253453 -
tctggaggccaggctggagctc

SEQ ID NO: 139383 - DNA, 22 bp, Artificial Sequence
  Synthetic oligonucleotide; CTG chr11 5253449 5253470 5253454 5253449 -
gaggccaggctggagctctcag

SEQ ID NO: 139384 - DNA, 22 bp, Artificial Sequence
  Synthetic oligonucleotide; CTG chr11 5253437 5253458 5253442 5253437 -
gagctctcagctcactatgggt

SEQ ID NO: 139385 - DNA, 22 bp, Artificial Sequence
  Synthetic oligonucleotide; CTC chr11 5253431 5253452 5253436 5253431 -
tcagctcactatgggttcatct

SEQ ID NO: 139386 - DNA, 22 bp, Artificial Sequence
  Synthetic oligonucleotide; CTC chr11 5253429 5253450 5253434 5253429 -
agctcactatgggttcatcttt

SEQ ID NO: 139387 - DNA, 22 bp, Artificial Sequence
  Synthetic oligonucleotide; CTC chr11 5253424 5253445 5253429 5253424 -
actatgggttcatctttattgt

SEQ ID NO: 139388 - DNA, 22 bp, Artificial Sequence
  Synthetic oligonucleotide; CTA chr11 5253420 5253441 5253425 5253420 -
tgggttcatctttattgtctcc

SEQ ID NO: 139389 - DNA, 22 bp, Artificial Sequence
  Synthetic oligonucleotide; TTC chr11 5253413 5253434 5253418 5253413 -
atctttattgtctcctttcatc

SEQ ID NO: 139390 - DNA, 22 bp, Artificial Sequence
  Synthetic oligonucleotide; CTT chr11 5253408 5253429 5253413 5253408 -
tattgtctcctttcatctcaac

SEQ ID NO: 139391 - DNA, 22 bp, Artificial Sequence
  Synthetic oligonucleotide; TTT chr11 5253407 5253428 5253412 5253407 -
attgtctcctttcatctcaaca

SEQ ID NO: 139392 - DNA, 22 bp, Artificial Sequence
  Synthetic oligonucleotide; TTA chr11 5253406 5253427 5253411 5253406 -
ttgtctcctttcatctcaacag

SEQ ID NO: 139393 - DNA, 22 bp, Artificial Sequence
  Synthetic oligonucleotide; TTG chr11 5253403 5253424 5253408 5253403 -
tctcctttcatctcaacagctc

SEQ ID NO: 139394 - DNA, 22 bp, Artificial Sequence
  Synthetic oligonucleotide; CTC chr11 5253399 5253420 5253404 5253399 -
ctttcatctcaacagctcctgg

SEQ ID NO: 139395 - DNA, 22 bp, Artificial Sequence
  Synthetic oligonucleotide; CTT chr11 5253396 5253417 5253401 5253396 -
tcatctcaacagctcctgggaa

SEQ ID NO: 139396 - DNA, 22 bp, Artificial Sequence
  Synthetic oligonucleotide; TTT chr11 5253395 5253416 5253400 5253395 -
catctcaacagctcctgggaaa

SEQ ID NO: 139397 - DNA, 22 bp, Artificial Sequence
  Synthetic oligonucleotide; TTC chr11 5253394 5253415 5253399 5253394 -
atctcaacagctcctgggaaat

SEQ ID NO: 139398 - DNA, 22 bp, Artificial Sequence
  Synthetic oligonucleotide; CTC chr11 5253389 5253410 5253394 5253389 -
aacagctcctgggaaatgtgct

SEQ ID NO: 139399 - DNA, 22 bp, Artificial Sequence
  Synthetic oligonucleotide; CTC chr11 5253381 5253402 5253386 5253381 -
ctgggaaatgtgctggtgaccg

SEQ ID NO: 139400 - DNA, 22 bp, Artificial Sequence
  Synthetic oligonucleotide; CTG chr11 5253378 5253399 5253383 5253378 -
ggaaatgtgctggtgaccgttt

SEQ ID NO: 139401 - DNA, 22 bp, Artificial Sequence
  Synthetic oligonucleotide; CTG chr11 5253366 5253387 5253371 5253366 -
gtgaccgttttggcaatccatt

SEQ ID NO: 139402 - DNA, 22 bp, Artificial Sequence
  Synthetic oligonucleotide; TTT chr11 5253356 5253377 5253361 5253356 -
tggcaatccatttcggcaaaga

SEQ ID NO: 139403 - DNA, 22 bp, Artificial Sequence
  Synthetic oligonucleotide; TTT chr11 5253355 5253376 5253360 5253355 -
ggcaatccatttcggcaaagaa

SEQ ID NO: 139404 - DNA, 22 bp, Artificial Sequence
  Synthetic oligonucleotide; TTG chr11 5253354 5253375 5253359 5253354 -
gcaatccatttcggcaaagaat

SEQ ID NO: 139405 - DNA, 22 bp, Artificial Sequence
  Synthetic oligonucleotide; TTT chr11 5253343 5253364 5253348 5253343 -
cggcaaagaattcacccctgag

SEQ ID NO: 139406 - DNA, 22 bp, Artificial Sequence
  Synthetic oligonucleotide; TTC chr11 5253342 5253363 5253347 5253342 -
ggcaaagaattcacccctgagg

SEQ ID NO: 139407 - DNA, 22 bp, Artificial Sequence
  Synthetic oligonucleotide; TTC chr11 5253330 5253351 5253335 5253330 -
acccctgaggtgcaggcttcct

SEQ ID NO: 139408 - DNA, 22 bp, Artificial Sequence
  Synthetic oligonucleotide; CTG chr11 5253323 5253344 5253328 5253323 -
aggtgcaggcttcctggcagaa

SEQ ID NO: 139409 - DNA, 22 bp, Artificial Sequence
  Synthetic oligonucleotide; CTT chr11 5253311 5253332 5253316 5253311 -
cctggcagaagatggtgactgg

SEQ ID NO: 139410 - DNA, 22 bp, Artificial Sequence
  Synthetic oligonucleotide; TTC chr11 5253310 5253331 5253315 5253310 -
ctggcagaagatggtgactgga

SEQ ID NO: 139411 - DNA, 22 bp, Artificial Sequence
  Synthetic oligonucleotide; CTG chr11 5253307 5253328 5253312 5253307 -
gcagaagatggtgactggagtg

SEQ ID NO: 139412 - DNA, 22 bp, Artificial Sequence
  Synthetic oligonucleotide; CTG chr11 5253290 5253311 5253295 5253290 -
gagtggccagtgccctgtcctc

SEQ ID NO: 139413 - DNA, 22 bp, Artificial Sequence
  Synthetic oligonucleotide; CTG chr11 5253273 5253294 5253278 5253273 -
tcctccagataccactgagctc

SEQ ID NO: 139414 - DNA, 22 bp, Artificial Sequence
  Synthetic oligonucleotide; CTC chr11 5253268 5253289 5253273 5253268 -
cagataccactgagctcactgc

SEQ ID NO: 139415 - DNA, 22 bp, Artificial Sequence
  Synthetic oligonucleotide; CTG chr11 5253256 5253277 5253261 5253256 -
agctcactgcccatgatgcaga

SEQ ID NO: 139416 - DNA, 22 bp, Artificial Sequence
  Synthetic oligonucleotide; CTC chr11 5253251 5253272 5253256 5253251 -
actgcccatgatgcagagcttt

SEQ ID NO: 139417 - DNA, 22 bp, Artificial Sequence
  Synthetic oligonucleotide; CTG chr11 5253247 5253268 5253252 5253247 -
cccatgatgcagagctttcaag

SEQ ID NO: 139418 - DNA, 22 bp, Artificial Sequence
  Synthetic oligonucleotide; CTT chr11 5253230 5253251 5253235 5253230 -
tcaaggataggctttattctgc

SEQ ID NO: 139419 - DNA, 22 bp, Artificial Sequence
  Synthetic oligonucleotide; TTT chr11 5253229 5253250 5253234 5253229 -
caaggataggctttattctgca

SEQ ID NO: 139420 - DNA, 22 bp, Artificial Sequence
  Synthetic oligonucleotide; TTC chr11 5253228 5253249 5253233 5253228 -
aaggataggctttattctgcaa

SEQ ID NO: 139421 - DNA, 22 bp, Artificial Sequence
  Synthetic oligonucleotide; CTT chr11 5253216 5253237 5253221 5253216 -
tattctgcaagcaatcaaataa

SEQ ID NO: 139422 - DNA, 22 bp, Artificial Sequence
  Synthetic oligonucleotide; TTT chr11 5253215 5253236 5253220 5253215 -
attctgcaagcaatcaaataat

SEQ ID NO: 139423 - DNA, 22 bp, Artificial Sequence
  Synthetic oligonucleotide; TTA chr11 5253214 5253235 5253219 5253214 -
ttctgcaagcaatcaaataata

SEQ ID NO: 139424 - DNA, 22 bp, Artificial Sequence
  Synthetic oligonucleotide; TTC chr11 5253211 5253232 5253216 5253211 -
tgcaagcaatcaaataataaat

SEQ ID NO: 139425 - DNA, 22 bp, Artificial Sequence
  Synthetic oligonucleotide; CTG chr11 5253209 5253230 5253214 5253209 -
caagcaatcaaataataaatct

SEQ ID NO: 139426 - DNA, 22 bp, Artificial Sequence
  Synthetic oligonucleotide; CTA chr11 5253186 5253207 5253191 5253186 -
ttctgctaagagatcacacatg

SEQ ID NO: 139427 - DNA, 22 bp, Artificial Sequence
  Synthetic oligonucleotide; TTC chr11 5253183 5253204 5253188 5253183 -
tgctaagagatcacacatggtt

SEQ ID NO: 139428 - DNA, 22 bp, Artificial Sequence
  Synthetic oligonucleotide; CTG chr11 5253181 5253202 5253186 5253181 -
ctaagagatcacacatggttgt

SEQ ID NO: 139429 - DNA, 22 bp, Artificial Sequence
  Synthetic oligonucleotide; CTA chr11 5253178 5253199 5253183 5253178 -
agagatcacacatggttgtctt

SEQ ID NO: 139430 - DNA, 22 bp, Artificial Sequence
  Synthetic oligonucleotide; TTG chr11 5253160 5253181 5253165 5253160 -
tcttcagttctttttttatgtc

SEQ ID NO: 139431 - DNA, 22 bp, Artificial Sequence
  Synthetic oligonucleotide; CTT chr11 5253156 5253177 5253161 5253156 -
cagttctttttttatgtctttt

SEQ ID NO: 139432 - DNA, 22 bp, Artificial Sequence
  Synthetic oligonucleotide; TTC chr11 5253155 5253176 5253160 5253155 -
agttctttttttatgtcttttt

SEQ ID NO: 139433 - DNA, 22 bp, Artificial Sequence
  Synthetic oligonucleotide; TTC chr11 5253150 5253171 5253155 5253150 -
tttttttatgtctttttaaata

SEQ ID NO: 139434 - DNA, 22 bp, Artificial Sequence
  Synthetic oligonucleotide; CTT chr11 5253148 5253169 5253153 5253148 -
tttttatgtctttttaaatata

SEQ ID NO: 139435 - DNA, 22 bp, Artificial Sequence
  Synthetic oligonucleotide; TTT chr11 5253147 5253168 5253152 5253147 -
ttttatgtctttttaaatatat

SEQ ID NO: 139436 - DNA, 22 bp, Artificial Sequence
  Synthetic oligonucleotide; TTT chr11 5253146 5253167 5253151 5253146 -
tttatgtctttttaaatatatg

SEQ ID NO: 139437 - DNA, 22 bp, Artificial Sequence
  Synthetic oligonucleotide; TTT chr11 5253145 5253166 5253150 5253145 -
ttatgtctttttaaatatatga

SEQ ID NO: 139438 - DNA, 22 bp, Artificial Sequence
  Synthetic oligonucleotide; TTT chr11 5253144 5253165 5253149 5253144 -
tatgtctttttaaatatatgag

SEQ ID NO: 139439 - DNA, 22 bp, Artificial Sequence
  Synthetic oligonucleotide; TTT chr11 5253143 5253164 5253148 5253143 -
atgtctttttaaatatatgagc

SEQ ID NO: 139440 - DNA, 22 bp, Artificial Sequence
  Synthetic oligonucleotide; TTA chr11 5253142 5253163 5253147 5253142 -
tgtctttttaaatatatgagcc

SEQ ID NO: 139441 - DNA, 22 bp, Artificial Sequence
  Synthetic oligonucleotide; CTT chr11 5253136 5253157 5253141 5253136 -
tttaaatatatgagccacaaag

SEQ ID NO: 139442 - DNA, 22 bp, Artificial Sequence
  Synthetic oligonucleotide; TTT chr11 5253135 5253156 5253140 5253135 -
ttaaatatatgagccacaaagg

SEQ ID NO: 139443 - DNA, 22 bp, Artificial Sequence
  Synthetic oligonucleotide; TTT chr11 5253134 5253155 5253139 5253134 -
taaatatatgagccacaaaggg

SEQ ID NO: 139444 - DNA, 22 bp, Artificial Sequence
  Synthetic oligonucleotide; TTT chr11 5253133 5253154 5253138 5253133 -
aaatatatgagccacaaagggt

SEQ ID NO: 139445 - DNA, 22 bp, Artificial Sequence
  Synthetic oligonucleotide; TTA chr11 5253132 5253153 5253137 5253132 -
aatatatgagccacaaagggtt

SEQ ID NO: 139446 - DNA, 22 bp, Artificial Sequence
  Synthetic oligonucleotide; TTT chr11 5253109 5253130 5253114 5253109 -
tatgttgagggatgtgtttatg

SEQ ID NO: 139447 - DNA, 22 bp, Artificial Sequence
  Synthetic oligonucleotide; TTT chr11 5253108 5253129 5253113 5253108 -
atgttgagggatgtgtttatgt

SEQ ID NO: 139448 - DNA, 22 bp, Artificial Sequence
  Synthetic oligonucleotide; TTA chr11 5253107 5253128 5253112 5253107 -
tgttgagggatgtgtttatgtg

SEQ ID NO: 139449 - DNA, 22 bp, Artificial Sequence
  Synthetic oligonucleotide; TTG chr11 5253102 5253123 5253107 5253102 -
agggatgtgtttatgtgtattt

SEQ ID NO: 139450 - DNA, 22 bp, Artificial Sequence
  Synthetic oligonucleotide; TTT chr11 5253090 5253111 5253095 5253090 -
atgtgtatttatacatggctat

SEQ ID NO: 139451 - DNA, 22 bp, Artificial Sequence
  Synthetic oligonucleotide; TTA chr11 5253089 5253110 5253094 5253089 -
tgtgtatttatacatggctatg

SEQ ID NO: 139452 - DNA, 22 bp, Artificial Sequence
  Synthetic oligonucleotide; TTT chr11 5253080 5253101 5253085 5253080 -
atacatggctatgtgtgtttgt

SEQ ID NO: 139453 - DNA, 22 bp, Artificial Sequence
  Synthetic oligonucleotide; TTA chr11 5253079 5253100 5253084 5253079 -
tacatggctatgtgtgtttgtg

SEQ ID NO: 139454 - DNA, 22 bp, Artificial Sequence
  Synthetic oligonucleotide; CTA chr11 5253069 5253090 5253074 5253069 -
tgtgtgtttgtgtcatgtgcac

SEQ ID NO: 139455 - DNA, 22 bp, Artificial Sequence
  Synthetic oligonucleotide; TTT chr11 5253060 5253081 5253065 5253060 -
gtgtcatgtgcacactccacac

SEQ ID NO: 139456 - DNA, 22 bp, Artificial Sequence
  Synthetic oligonucleotide; TTG chr11 5253059 5253080 5253064 5253059 -
tgtcatgtgcacactccacact

SEQ ID NO: 139457 - DNA, 22 bp, Artificial Sequence
  Synthetic oligonucleotide; CTC chr11 5253043 5253064 5253048 5253043 -
cacacttttttgtttacgttag

SEQ ID NO: 139458 - DNA, 22 bp, Artificial Sequence
  Synthetic oligonucleotide; CTT chr11 5253036 5253057 5253041 5253036 -
ttttgtttacgttagatgtggg

SEQ ID NO: 139459 - DNA, 22 bp, Artificial Sequence
  Synthetic oligonucleotide; TTT chr11 5253035 5253056 5253040 5253035 -
tttgtttacgttagatgtgggt

SEQ ID NO: 139460 - DNA, 22 bp, Artificial Sequence
  Synthetic oligonucleotide; TTT chr11 5253034 5253055 5253039 5253034 -
ttgtttacgttagatgtgggtt

SEQ ID NO: 139461 - DNA, 22 bp, Artificial Sequence
  Synthetic oligonucleotide; TTT chr11 5253033 5253054 5253038 5253033 -
tgtttacgttagatgtgggttt

SEQ ID NO: 139462 - DNA, 22 bp, Artificial Sequence
  Synthetic oligonucleotide; TTT chr11 5253032 5253053 5253037 5253032 -
gtttacgttagatgtgggtttt

SEQ ID NO: 139463 - DNA, 22 bp, Artificial Sequence
  Synthetic oligonucleotide; TTG chr11 5253031 5253052 5253036 5253031 -
tttacgttagatgtgggttttg

SEQ ID NO: 139464 - DNA, 22 bp, Artificial Sequence
  Synthetic oligonucleotide; TTT chr11 5253028 5253049 5253033 5253028 -
acgttagatgtgggttttgatg

SEQ ID NO: 139465 - DNA, 22 bp, Artificial Sequence
  Synthetic oligonucleotide; TTA chr11 5253027 5253048 5253032 5253027 -
cgttagatgtgggttttgatga

SEQ ID NO: 139466 - DNA, 22 bp, Artificial Sequence
  Synthetic oligonucleotide; TTA chr11 5253022 5253043 5253027 5253022 -
gatgtgggttttgatgagcaaa

SEQ ID NO: 139467 - DNA, 22 bp, Artificial Sequence
  Synthetic oligonucleotide; TTT chr11 5253011 5253032 5253016 5253011 -
tgatgagcaaataaaagaacta

SEQ ID NO: 139468 - DNA, 22 bp, Artificial Sequence
  Synthetic oligonucleotide; TTT chr11 5253010 5253031 5253015 5253010 -
gatgagcaaataaaagaactag

SEQ ID NO: 139469 - DNA, 22 bp, Artificial Sequence
  Synthetic oligonucleotide; TTG chr11 5253009 5253030 5253014 5253009 -
atgagcaaataaaagaactagg

SEQ ID NO: 139470 - DNA, 22 bp, Artificial Sequence
  Synthetic oligonucleotide; CTA chr11 5252989 5253010 5252994 5252989 -
ggcaataaagaaacttgtacat

SEQ ID NO: 139471 - DNA, 22 bp, Artificial Sequence
  Synthetic oligonucleotide; CTT chr11 5252973 5252994 5252978 5252973 -
gtacatgggagttctgcaagtg

SEQ ID NO: 139472 - DNA, 22 bp, Artificial Sequence
  Synthetic oligonucleotide; TTG chr11 5252972 5252993 5252977 5252972 -
tacatgggagttctgcaagtgg

SEQ ID NO: 139473 - DNA, 22 bp, Artificial Sequence
  Synthetic oligonucleotide; TTC chr11 5252959 5252980 5252964 5252959 -
tgcaagtgggagtaaaaggtgc

SEQ ID NO: 139474 - DNA, 22 bp, Artificial Sequence
  Synthetic oligonucleotide; CTG chr11 5252957 5252978 5252962 5252957 -
caagtgggagtaaaaggtgcag

SEQ ID NO: 139475 - DNA, 22 bp, Artificial Sequence
  Synthetic oligonucleotide; CTG chr11 5252925 5252946 5252930 5252925 -
gttggaagaaagacctctatag

SEQ ID NO: 139476 - DNA, 22 bp, Artificial Sequence
  Synthetic oligonucleotide; TTG chr11 5252921 5252942 5252926 5252921 -
gaagaaagacctctataggaca

SEQ ID NO: 139477 - DNA, 22 bp, Artificial Sequence
  Synthetic oligonucleotide; CTC chr11 5252908 5252929 5252913 5252908 -
tataggacaggactcctcagaa

SEQ ID NO: 139478 - DNA, 22 bp, Artificial Sequence
  Synthetic oligonucleotide; CTA chr11 5252906 5252927 5252911 5252906 -
taggacaggactcctcagaaac

SEQ ID NO: 139479 - DNA, 22 bp, Artificial Sequence
  Synthetic oligonucleotide; CTC chr11 5252893 5252914 5252898 5252893 -
ctcagaaacagatgttttggaa

SEQ ID NO: 139480 - DNA, 22 bp, Artificial Sequence
  Synthetic oligonucleotide; CTC chr11 5252890 5252911 5252895 5252890 -
agaaacagatgttttggaagag

SEQ ID NO: 139481 - DNA, 22 bp, Artificial Sequence
  Synthetic oligonucleotide; TTT chr11 5252876 5252897 5252881 5252876 -
tggaagagatggggaaaggttc

SEQ ID NO: 139482 - DNA, 22 bp, Artificial Sequence
  Synthetic oligonucleotide; TTT chr11 5252875 5252896 5252880 5252875 -
ggaagagatggggaaaggttca

SEQ ID NO: 139483 - DNA, 22 bp, Artificial Sequence
  Synthetic oligonucleotide; TTG chr11 5252874 5252895 5252879 5252874 -
gaagagatggggaaaggttcag

SEQ ID NO: 139484 - DNA, 22 bp, Artificial Sequence
  Synthetic oligonucleotide; TTC chr11 5252854 5252875 5252859 5252854 -
agtgaagggggctgaaccccct

SEQ ID NO: 139485 - DNA, 22 bp, Artificial Sequence
  Synthetic oligonucleotide; CTG chr11 5252840 5252861 5252845 5252840 -
aacccccttccctggattgcag

SEQ ID NO: 139486 - DNA, 22 bp, Artificial Sequence
  Synthetic oligonucleotide; CTT chr11 5252831 5252852 5252836 5252831 -
ccctggattgcagcacagcagc

SEQ ID NO: 139487 - DNA, 22 bp, Artificial Sequence
  Synthetic oligonucleotide; TTC chr11 5252830 5252851 5252835 5252830 -
cctggattgcagcacagcagcg

SEQ ID NO: 139488 - DNA, 22 bp, Artificial Sequence
  Synthetic oligonucleotide; CTG chr11 5252826 5252847 5252831 5252826 -
gattgcagcacagcagcgagga

SEQ ID NO: 139489 - DNA, 22 bp, Artificial Sequence
  Synthetic oligonucleotide; TTG chr11 5252821 5252842 5252826 5252821 -
cagcacagcagcgaggaagggg

SEQ ID NO: 139490 - DNA, 22 bp, Artificial Sequence
  Synthetic oligonucleotide; CTC chr11 5252796 5252817 5252801 5252796 -
aacgaagaaaaagtgttccaag

SEQ ID NO: 139491 - DNA, 22 bp, Artificial Sequence
  Synthetic oligonucleotide; TTC chr11 5252778 5252799 5252783 5252778 -
caagctttaggaagtcaaggtt

SEQ ID NO: 139492 - DNA, 22 bp, Artificial Sequence
  Synthetic oligonucleotide; CTT chr11 5252771 5252792 5252776 5252771 -
taggaagtcaaggtttaggcag

SEQ ID NO: 139493 - DNA, 22 bp, Artificial Sequence
  Synthetic oligonucleotide; TTT chr11 5252770 5252791 5252775 5252770 -
aggaagtcaaggtttaggcagg

SEQ ID NO: 139494 - DNA, 22 bp, Artificial Sequence
  Synthetic oligonucleotide; TTA chr11 5252769 5252790 5252774 5252769 -
ggaagtcaaggtttaggcaggg

SEQ ID NO: 139495 - DNA, 22 bp, Artificial Sequence
  Synthetic oligonucleotide; TTT chr11 5252755 5252776 5252760 5252755 -
aggcagggatagccattctatt

SEQ ID NO: 139496 - DNA, 22 bp, Artificial Sequence
  Synthetic oligonucleotide; TTA chr11 5252754 5252775 5252759 5252754 -
ggcagggatagccattctattt

SEQ ID NO: 139497 - DNA, 22 bp, Artificial Sequence
  Synthetic oligonucleotide; TTC chr11 5252737 5252758 5252742 5252737 -
tattttattaggggcaatacta

SEQ ID NO: 139498 - DNA, 22 bp, Artificial Sequence
  Synthetic oligonucleotide; CTA chr11 5252735 5252756 5252740 5252735 -
ttttattaggggcaatactatt

SEQ ID NO: 139499 - DNA, 22 bp, Artificial Sequence
  Synthetic oligonucleotide; TTT chr11 5252732 5252753 5252737 5252732 -
tattaggggcaatactatttcc

SEQ ID NO: 139500 - DNA, 22 bp, Artificial Sequence
  Synthetic oligonucleotide; TTT chr11 5252731 5252752 5252736 5252731 -
attaggggcaatactatttcca

SEQ ID NO: 139501 - DNA, 22 bp, Artificial Sequence
  Synthetic oligonucleotide; TTA chr11 5252730 5252751 5252735 5252730 -
ttaggggcaatactatttccaa

SEQ ID NO: 139502 - DNA, 22 bp, Artificial Sequence
  Synthetic oligonucleotide; TTA chr11 5252727 5252748 5252732 5252727 -
ggggcaatactatttccaacgg

SEQ ID NO: 139503 - DNA, 22 bp, Artificial Sequence
  Synthetic oligonucleotide; CTA chr11 5252715 5252736 5252720 5252715 -
tttccaacggcatctggctttt

SEQ ID NO: 139504 - DNA, 22 bp, Artificial Sequence
  Synthetic oligonucleotide; TTT chr11 5252712 5252733 5252717 5252712 -
ccaacggcatctggcttttctc

SEQ ID NO: 139505 - DNA, 22 bp, Artificial Sequence
  Synthetic oligonucleotide; TTC chr11 5252711 5252732 5252716 5252711 -
caacggcatctggcttttctca

SEQ ID NO: 139506 - DNA, 22 bp, Artificial Sequence
  Synthetic oligonucleotide; CTG chr11 5252699 5252720 5252704 5252699 -
gcttttctcagcccttgtgagg

SEQ ID NO: 139507 - DNA, 22 bp, Artificial Sequence
  Synthetic oligonucleotide; CTT chr11 5252695 5252716 5252700 5252695 -
ttctcagcccttgtgaggctct

SEQ ID NO: 139508 - DNA, 22 bp, Artificial Sequence
  Synthetic oligonucleotide; TTT chr11 5252694 5252715 5252699 5252694 -
tctcagcccttgtgaggctcta

SEQ ID NO: 139509 - DNA, 22 bp, Artificial Sequence
  Synthetic oligonucleotide; TTT chr11 5252693 5252714 5252698 5252693 -
ctcagcccttgtgaggctctac

SEQ ID NO: 139510 - DNA, 22 bp, Artificial Sequence
  Synthetic oligonucleotide; TTC chr11 5252692 5252713 5252697 5252692 -
tcagcccttgtgaggctctaca

SEQ ID NO: 139511 - DNA, 22 bp, Artificial Sequence
  Synthetic oligonucleotide; CTC chr11 5252690 5252711 5252695 5252690 -
agcccttgtgaggctctacagg

SEQ ID NO: 139512 - DNA, 22 bp, Artificial Sequence
  Synthetic oligonucleotide; CTT chr11 5252683 5252704 5252688 5252683 -
gtgaggctctacagggaggttg

SEQ ID NO: 139513 - DNA, 22 bp, Artificial Sequence
  Synthetic oligonucleotide; TTG chr11 5252682 5252703 5252687 5252682 -
tgaggctctacagggaggttga

SEQ ID NO: 139514 - DNA, 22 bp, Artificial Sequence
  Synthetic oligonucleotide; CTC chr11 5252674 5252695 5252679 5252674 -
tacagggaggttgaggtgttag

SEQ ID NO: 139515 - DNA, 22 bp, Artificial Sequence
  Synthetic oligonucleotide; CTA chr11 5252672 5252693 5252677 5252672 -
cagggaggttgaggtgttagag

SEQ ID NO: 139516 - DNA, 22 bp, Artificial Sequence
  Synthetic oligonucleotide; TTG chr11 5252661 5252682 5252666 5252661 -
aggtgttagagatcagagcagg

SEQ ID NO: 139517 - DNA, 22 bp, Artificial Sequence
  Synthetic oligonucleotide; TTA chr11 5252653 5252674 5252658 5252653 -
gagatcagagcaggaaacaggt

SEQ ID NO: 139518 - DNA, 22 bp, Artificial Sequence
  Synthetic oligonucleotide; TTT chr11 5252629 5252650 5252634 5252629 -
ttctttccacggtaactacaat

SEQ ID NO: 139519 - DNA, 22 bp, Artificial Sequence
  Synthetic oligonucleotide; TTT chr11 5252628 5252649 5252633 5252628 -
tctttccacggtaactacaatg

SEQ ID NO: 139520 - DNA, 22 bp, Artificial Sequence
  Synthetic oligonucleotide; TTT chr11 5252627 5252648 5252632 5252627 -
ctttccacggtaactacaatga

SEQ ID NO: 139521 - DNA, 22 bp, Artificial Sequence
  Synthetic oligonucleotide; TTC chr11 5252626 5252647 5252631 5252626 -
tttccacggtaactacaatgaa

SEQ ID NO: 139522 - DNA, 22 bp, Artificial Sequence
  Synthetic oligonucleotide; CTT chr11 5252624 5252645 5252629 5252624 -
tccacggtaactacaatgaagt

SEQ ID NO: 139523 - DNA, 22 bp, Artificial Sequence
  Synthetic oligonucleotide; TTT chr11 5252623 5252644 5252628 5252623 -
ccacggtaactacaatgaagtg

SEQ ID NO: 139524 - DNA, 22 bp, Artificial Sequence
  Synthetic oligonucleotide; TTC chr11 5252622 5252643 5252627 5252622 -
cacggtaactacaatgaagtga

SEQ ID NO: 139525 - DNA, 22 bp, Artificial Sequence
  Synthetic oligonucleotide; CTA chr11 5252611 5252632 5252616 5252611 -
caatgaagtgatccttacttta

SEQ ID NO: 139526 - DNA, 22 bp, Artificial Sequence
  Synthetic oligonucleotide; CTT chr11 5252595 5252616 5252600 5252595 -
actttactaaggaacttttcat

SEQ ID NO: 139527 - DNA, 22 bp, Artificial Sequence
  Synthetic oligonucleotide; TTA chr11 5252594 5252615 5252599 5252594 -
ctttactaaggaacttttcatt

SEQ ID NO: 139528 - DNA, 22 bp, Artificial Sequence
  Synthetic oligonucleotide; CTT chr11 5252591 5252612 5252596 5252591 -
tactaaggaacttttcatttta

SEQ ID NO: 139529 - DNA, 22 bp, Artificial Sequence
  Synthetic oligonucleotide; TTT chr11 5252590 5252611 5252595 5252590 -
actaaggaacttttcattttaa

SEQ ID NO: 139530 - DNA, 22 bp, Artificial Sequence
  Synthetic oligonucleotide; TTA chr11 5252589 5252610 5252594 5252589 -
ctaaggaacttttcattttaag

SEQ ID NO: 139531 - DNA, 22 bp, Artificial Sequence
  Synthetic oligonucleotide; CTA chr11 5252586 5252607 5252591 5252586 -
aggaacttttcattttaagtgt

SEQ ID NO: 139532 - DNA, 22 bp, Artificial Sequence
  Synthetic oligonucleotide; CTT chr11 5252578 5252599 5252583 5252578 -
ttcattttaagtgttgacgcat

SEQ ID NO: 139533 - DNA, 22 bp, Artificial Sequence
  Synthetic oligonucleotide; TTT chr11 5252577 5252598 5252582 5252577 -
tcattttaagtgttgacgcatg

SEQ ID NO: 139534 - DNA, 22 bp, Artificial Sequence
  Synthetic oligonucleotide; TTT chr11 5252576 5252597 5252581 5252576 -
cattttaagtgttgacgcatgc

SEQ ID NO: 139535 - DNA, 22 bp, Artificial Sequence
  Synthetic oligonucleotide; TTC chr11 5252575 5252596 5252580 5252575 -
attttaagtgttgacgcatgcc

SEQ ID NO: 139536 - DNA, 22 bp, Artificial Sequence
  Synthetic oligonucleotide; TTT chr11 5252571 5252592 5252576 5252571 -
taagtgttgacgcatgcctaaa

SEQ ID NO: 139537 - DNA, 22 bp, Artificial Sequence
  Synthetic oligonucleotide; TTT chr11 5252570 5252591 5252575 5252570 -
aagtgttgacgcatgcctaaag

SEQ ID NO: 139538 - DNA, 22 bp, Artificial Sequence
  Synthetic oligonucleotide; TTA chr11 5252569 5252590 5252574 5252569 -
agtgttgacgcatgcctaaaga

SEQ ID NO: 139539 - DNA, 22 bp, Artificial Sequence
  Synthetic oligonucleotide; TTG chr11 5252562 5252583 5252567 5252562 -
acgcatgcctaaagaggtgaaa

SEQ ID NO: 139540 - DNA, 22 bp, Artificial Sequence
  Synthetic oligonucleotide; CTA chr11 5252551 5252572 5252556 5252551 -
aagaggtgaaattaatcccata

SEQ ID NO: 139541 - DNA, 22 bp, Artificial Sequence
  Synthetic oligonucleotide; TTA chr11 5252537 5252558 5252542 5252537 -
atcccatacccttaagtctaca

SEQ ID NO: 139542 - DNA, 22 bp, Artificial Sequence
  Synthetic oligonucleotide; CTT chr11 5252524 5252545 5252529 5252524 -
aagtctacagactggtcacagc

SEQ ID NO: 139543 - DNA, 22 bp, Artificial Sequence
  Synthetic oligonucleotide; TTA chr11 5252523 5252544 5252528 5252523 -
agtctacagactggtcacagca

SEQ ID NO: 139544 - DNA, 22 bp, Artificial Sequence
  Synthetic oligonucleotide; CTA chr11 5252517 5252538 5252522 5252517 -
cagactggtcacagcatttcaa

SEQ ID NO: 139545 - DNA, 22 bp, Artificial Sequence
  Synthetic oligonucleotide; CTG chr11 5252510 5252531 5252515 5252510 -
gtcacagcatttcaaggaggag

SEQ ID NO: 139546 - DNA, 22 bp, Artificial Sequence
  Synthetic oligonucleotide; TTT chr11 5252498 5252519 5252503 5252498 -
caaggaggagacctcattgtaa

SEQ ID NO: 139547 - DNA, 22 bp, Artificial Sequence
  Synthetic oligonucleotide; TTC chr11 5252497 5252518 5252502 5252497 -
aaggaggagacctcattgtaag

SEQ ID NO: 139548 - DNA, 22 bp, Artificial Sequence
  Synthetic oligonucleotide; CTC chr11 5252483 5252504 5252488 5252483 -
attgtaagcttctagggaggtg

SEQ ID NO: 139549 - DNA, 22 bp, Artificial Sequence
  Synthetic oligonucleotide; TTG chr11 5252479 5252500 5252484 5252479 -
taagcttctagggaggtgggga

SEQ ID NO: 139550 - DNA, 22 bp, Artificial Sequence
  Synthetic oligonucleotide; CTT chr11 5252472 5252493 5252477 5252472 -
ctagggaggtggggacttaggt

SEQ ID NO: 139551 - DNA, 22 bp, Artificial Sequence
  Synthetic oligonucleotide; TTC chr11 5252471 5252492 5252476 5252471 -
tagggaggtggggacttaggtg

SEQ ID NO: 139552 - DNA, 22 bp, Artificial Sequence
  Synthetic oligonucleotide; CTA chr11 5252469 5252490 5252474 5252469 -
gggaggtggggacttaggtgaa

SEQ ID NO: 139553 - DNA, 22 bp, Artificial Sequence
  Synthetic oligonucleotide; CTT chr11 5252454 5252475 5252459 5252454 -
aggtgaaggaaatgagccagca

SEQ ID NO: 139554 - DNA, 22 bp, Artificial Sequence
  Synthetic oligonucleotide; TTA chr11 5252453 5252474 5252458 5252453 -
ggtgaaggaaatgagccagcag

SEQ ID NO: 139555 - DNA, 22 bp, Artificial Sequence
  Synthetic oligonucleotide; CTC chr11 5252425 5252446 5252430 5252425 -
acaagtcagcatcagcgtgtca

SEQ ID NO: 139556 - DNA, 22 bp, Artificial Sequence
  Synthetic oligonucleotide; CTC chr11 5252397 5252418 5252402 5252397 -
agcagcagaacagcacggtcag

SEQ ID NO: 139557 - DNA, 22 bp, Artificial Sequence
  Synthetic oligonucleotide; TTT chr11 5252351 5252372 5252356 5252351 -
gtataacattaattgagaaggc

SEQ ID NO: 139558 - DNA, 22 bp, Artificial Sequence
  Synthetic oligonucleotide; TTG chr11 5252350 5252371 5252355 5252350 -
tataacattaattgagaaggca

SEQ ID NO: 139559 - DNA, 22 bp, Artificial Sequence
  Synthetic oligonucleotide; TTA chr11 5252340 5252361 5252345 5252340 -
attgagaaggcagattcactgg

SEQ ID NO: 139560 - DNA, 22 bp, Artificial Sequence
  Synthetic oligonucleotide; TTG chr11 5252336 5252357 5252341 5252336 -
agaaggcagattcactggagtt

SEQ ID NO: 139561 - DNA, 22 bp, Artificial Sequence
  Synthetic oligonucleotide; TTC chr11 5252323 5252344 5252328 5252323 -
actggagttcttatataattga

SEQ ID NO: 139562 - DNA, 22 bp, Artificial Sequence
  Synthetic oligonucleotide; CTG chr11 5252319 5252340 5252324 5252319 -
gagttcttatataattgaaagt

SEQ ID NO: 139563 - DNA, 22 bp, Artificial Sequence
  Synthetic oligonucleotide; TTC chr11 5252313 5252334 5252318 5252313 -
ttatataattgaaagttaatgc

SEQ ID NO: 139564 - DNA, 22 bp, Artificial Sequence
  Synthetic oligonucleotide; CTT chr11 5252311 5252332 5252316 5252311 -
atataattgaaagttaatgcac

SEQ ID NO: 139565 - DNA, 22 bp, Artificial Sequence
  Synthetic oligonucleotide; TTA chr11 5252310 5252331 5252315 5252310 -
tataattgaaagttaatgcacg

SEQ ID NO: 139566 - DNA, 22 bp, Artificial Sequence
  Synthetic oligonucleotide; TTG chr11 5252302 5252323 5252307 5252302 -
aaagttaatgcacgttaataag

SEQ ID NO: 139567 - DNA, 22 bp, Artificial Sequence
  Synthetic oligonucleotide; TTA chr11 5252295 5252316 5252300 5252295 -
atgcacgttaataagcaagagt

SEQ ID NO: 139568 - DNA, 22 bp, Artificial Sequence
  Synthetic oligonucleotide; TTA chr11 5252285 5252306 5252290 5252285 -
ataagcaagagtttagtttaat

SEQ ID NO: 139569 - DNA, 22 bp, Artificial Sequence
  Synthetic oligonucleotide; TTT chr11 5252271 5252292 5252276 5252271 -
agtttaatgtgatggtgttatg

SEQ ID NO: 139570 - DNA, 22 bp, Artificial Sequence
  Synthetic oligonucleotide; TTA chr11 5252270 5252291 5252275 5252270 -
gtttaatgtgatggtgttatga

SEQ ID NO: 139571 - DNA, 22 bp, Artificial Sequence
  Synthetic oligonucleotide; TTT chr11 5252266 5252287 5252271 5252266 -
aatgtgatggtgttatgaactt

SEQ ID NO: 139572 - DNA, 22 bp, Artificial Sequence
  Synthetic oligonucleotide; TTA chr11 5252265 5252286 5252270 5252265 -
atgtgatggtgttatgaactta

SEQ ID NO: 139573 - DNA, 22 bp, Artificial Sequence
  Synthetic oligonucleotide; TTA chr11 5252251 5252272 5252256 5252251 -
tgaacttaacgcttgtgtctcc

SEQ ID NO: 139574 - DNA, 22 bp, Artificial Sequence
  Synthetic oligonucleotide; CTT chr11 5252244 5252265 5252249 5252244 -
aacgcttgtgtctccagaaaat

SEQ ID NO: 139575 - DNA, 22 bp, Artificial Sequence
  Synthetic oligonucleotide; TTA chr11 5252243 5252264 5252248 5252243 -
acgcttgtgtctccagaaaatt

SEQ ID NO: 139576 - DNA, 22 bp, Artificial Sequence
  Synthetic oligonucleotide; CTT chr11 5252237 5252258 5252242 5252237 -
gtgtctccagaaaattcacatg

SEQ ID NO: 139577 - DNA, 22 bp, Artificial Sequence
  Synthetic oligonucleotide; TTG chr11 5252236 5252257 5252241 5252236 -
tgtctccagaaaattcacatgc

SEQ ID NO: 139578 - DNA, 22 bp, Artificial Sequence
  Synthetic oligonucleotide; CTC chr11 5252230 5252251 5252235 5252230 -
cagaaaattcacatgctgaatc

SEQ ID NO: 139579 - DNA, 22 bp, Artificial Sequence
  Synthetic oligonucleotide; TTC chr11 5252220 5252241 5252225 5252220 -
acatgctgaatccccaactccc

SEQ ID NO: 139580 - DNA, 22 bp, Artificial Sequence
  Synthetic oligonucleotide; CTG chr11 5252212 5252233 5252217 5252212 -
aatccccaactcccaattggct

SEQ ID NO: 139581 - DNA, 22 bp, Artificial Sequence
  Synthetic oligonucleotide; CTC chr11 5252200 5252221 5252205 5252200 -
ccaattggctccatttgtgggg

SEQ ID NO: 139582 - DNA, 22 bp, Artificial Sequence
  Synthetic oligonucleotide; TTG chr11 5252193 5252214 5252198 5252193 -
gctccatttgtgggggaggctt

SEQ ID NO: 139583 - DNA, 22 bp, Artificial Sequence
  Synthetic oligonucleotide; CTC chr11 5252189 5252210 5252194 5252189 -
catttgtgggggaggctttgga

SEQ ID NO: 139584 - DNA, 22 bp, Artificial Sequence
  Synthetic oligonucleotide; TTT chr11 5252184 5252205 5252189 5252184 -
gtgggggaggctttggaaaagt

SEQ ID NO: 139585 - DNA, 22 bp, Artificial Sequence
  Synthetic oligonucleotide; TTG chr11 5252183 5252204 5252188 5252183 -
tgggggaggctttggaaaagta

SEQ ID NO: 139586 - DNA, 22 bp, Artificial Sequence
  Synthetic oligonucleotide; CTT chr11 5252171 5252192 5252176 5252171 -
tggaaaagtaatcaggtttaga

SEQ ID NO: 139587 - DNA, 22 bp, Artificial Sequence
  Synthetic oligonucleotide; TTT chr11 5252170 5252191 5252175 5252170 -
ggaaaagtaatcaggtttagag

SEQ ID NO: 139588 - DNA, 22 bp, Artificial Sequence
  Synthetic oligonucleotide; TTG chr11 5252169 5252190 5252174 5252169 -
gaaaagtaatcaggtttagagg

SEQ ID NO: 139589 - DNA, 22 bp, Artificial Sequence
  Synthetic oligonucleotide; TTT chr11 5252152 5252173 5252157 5252152 -
agaggagctcatgagagcagat

SEQ ID NO: 139590 - DNA, 22 bp, Artificial Sequence
  Synthetic oligonucleotide; TTA chr11 5252151 5252172 5252156 5252151 -
gaggagctcatgagagcagatc

SEQ ID NO: 139591 - DNA, 22 bp, Artificial Sequence
  Synthetic oligonucleotide; CTC chr11 5252142 5252163 5252147 5252142 -
atgagagcagatccccatcata

SEQ ID NO: 139592 - DNA, 22 bp, Artificial Sequence
  Synthetic oligonucleotide; TTA chr11 5252114 5252135 5252119 5252114 -
ttttcctcatcagaagcagaga

SEQ ID NO: 139593 - DNA, 22 bp, Artificial Sequence
  Synthetic oligonucleotide; TTT chr11 5252111 5252132 5252116 5252111 -
tcctcatcagaagcagagagat

SEQ ID NO: 139594 - DNA, 22 bp, Artificial Sequence
  Synthetic oligonucleotide; TTT chr11 5252110 5252131 5252115 5252110 -
cctcatcagaagcagagagatt

SEQ ID NO: 139595 - DNA, 22 bp, Artificial Sequence
  Synthetic oligonucleotide; TTC chr11 5252109 5252130 5252114 5252109 -
ctcatcagaagcagagagatta

SEQ ID NO: 139596 - DNA, 22 bp, Artificial Sequence
  Synthetic oligonucleotide; CTC chr11 5252106 5252127 5252111 5252106 -
atcagaagcagagagattagcc

SEQ ID NO: 139597 - DNA, 22 bp, Artificial Sequence
  Synthetic oligonucleotide; TTA chr11 5252087 5252108 5252092 5252087 -
gccatttctcttccttctggtg

SEQ ID NO: 139598 - DNA, 22 bp, Artificial Sequence
  Synthetic oligonucleotide; TTT chr11 5252080 5252101 5252085 5252080 -
ctcttccttctggtgaggacac

SEQ ID NO: 139599 - DNA, 22 bp, Artificial Sequence
  Synthetic oligonucleotide; TTC chr11 5252079 5252100 5252084 5252079 -
tcttccttctggtgaggacaca

SEQ ID NO: 139600 - DNA, 22 bp, Artificial Sequence
  Synthetic oligonucleotide; CTC chr11 5252077 5252098 5252082 5252077 -
ttccttctggtgaggacacagt

SEQ ID NO: 139601 - DNA, 22 bp, Artificial Sequence
  Synthetic oligonucleotide; CTT chr11 5252075 5252096 5252080 5252075 -
ccttctggtgaggacacagtgg

SEQ ID NO: 139602 - DNA, 22 bp, Artificial Sequence
  Synthetic oligonucleotide; TTC chr11 5252074 5252095 5252079 5252074 -
cttctggtgaggacacagtggg

SEQ ID NO: 139603 - DNA, 22 bp, Artificial Sequence
  Synthetic oligonucleotide; CTT chr11 5252071 5252092 5252076 5252071 -
ctggtgaggacacagtgggaag

SEQ ID NO: 139604 - DNA, 22 bp, Artificial Sequence
  Synthetic oligonucleotide; TTC chr11 5252070 5252091 5252075 5252070 -
tggtgaggacacagtgggaagt

SEQ ID NO: 139605 - DNA, 22 bp, Artificial Sequence
  Synthetic oligonucleotide; CTG chr11 5252068 5252089 5252073 5252068 -
gtgaggacacagtgggaagtca

SEQ ID NO: 139606 - DNA, 22 bp, Artificial Sequence
  Synthetic oligonucleotide; CTG chr11 5252038 5252059 5252043 5252038 -
caacccaggaagagagccctga

SEQ ID NO: 139607 - DNA, 22 bp, Artificial Sequence
  Synthetic oligonucleotide; CTG chr11 5252017 5252038 5252022 5252017 -
accaggaaccagcagaaaagtg

SEQ ID NO: 139608 - DNA, 22 bp, Artificial Sequence
  Synthetic oligonucleotide; CTG chr11 5251982 5252003 5251987 5251982 -
ttgttgaagtcacccagtctat

SEQ ID NO: 139609 - DNA, 22 bp, Artificial Sequence
  Synthetic oligonucleotide; TTG chr11 5251979 5252000 5251984 5251979 -
ttgaagtcacccagtctatgct

SEQ ID NO: 139610 - DNA, 22 bp, Artificial Sequence
  Synthetic oligonucleotide; TTG chr11 5251976 5251997 5251981 5251976 -
aagtcacccagtctatgctatt

SEQ ID NO: 139611 - DNA, 22 bp, Artificial Sequence
  Synthetic oligonucleotide; CTA chr11 5251961 5251982 5251966 5251961 -
tgctattttgttatagcacctt

SEQ ID NO: 139612 - DNA, 22 bp, Artificial Sequence
  Synthetic oligonucleotide; CTA chr11 5251956 5251977 5251961 5251956 -
ttttgttatagcaccttgcact

SEQ ID NO: 139613 - DNA, 22 bp, Artificial Sequence
  Synthetic oligonucleotide; TTT chr11 5251953 5251974 5251958 5251953 -
tgttatagcaccttgcactaag

SEQ ID NO: 139614 - DNA, 22 bp, Artificial Sequence
  Synthetic oligonucleotide; TTT chr11 5251952 5251973 5251957 5251952 -
gttatagcaccttgcactaagt

SEQ ID NO: 139615 - DNA, 22 bp, Artificial Sequence
  Synthetic oligonucleotide; TTG chr11 5251951 5251972 5251956 5251951 -
ttatagcaccttgcactaagta

SEQ ID NO: 139616 - DNA, 22 bp, Artificial Sequence
  Synthetic oligonucleotide; TTA chr11 5251948 5251969 5251953 5251948 -
tagcaccttgcactaagtaagg

SEQ ID NO: 139617 - DNA, 22 bp, Artificial Sequence
  Synthetic oligonucleotide; CTT chr11 5251939 5251960 5251944 5251939 -
gcactaagtaaggcagatgaag

SEQ ID NO: 139618 - DNA, 22 bp, Artificial Sequence
  Synthetic oligonucleotide; TTG chr11 5251938 5251959 5251943 5251938 -
cactaagtaaggcagatgaaga

SEQ ID NO: 139619 - DNA, 22 bp, Artificial Sequence
  Synthetic oligonucleotide; CTA chr11 5251933 5251954 5251938 5251933 -
agtaaggcagatgaagaaagag

SEQ ID NO: 139620 - DNA, 22 bp, Artificial Sequence
  Synthetic oligonucleotide; CTT chr11 5251897 5251918 5251902 5251897 -
cggtgttcagtggattagaaac

SEQ ID NO: 139621 - DNA, 22 bp, Artificial Sequence
  Synthetic oligonucleotide; TTC chr11 5251896 5251917 5251901 5251896 -
ggtgttcagtggattagaaacc

SEQ ID NO: 139622 - DNA, 22 bp, Artificial Sequence
  Synthetic oligonucleotide; TTC chr11 5251889 5251910 5251894 5251889 -
agtggattagaaaccatgttta

SEQ ID NO: 139623 - DNA, 22 bp, Artificial Sequence
  Synthetic oligonucleotide; TTA chr11 5251880 5251901 5251885 5251880 -
gaaaccatgtttatctcaggtt

SEQ ID NO: 139624 - DNA, 22 bp, Artificial Sequence
  Synthetic oligonucleotide; TTT chr11 5251868 5251889 5251873 5251868 -
atctcaggtttacaaatctcca

SEQ ID NO: 139625 - DNA, 22 bp, Artificial Sequence
  Synthetic oligonucleotide; TTA chr11 5251867 5251888 5251872 5251867 -
tctcaggtttacaaatctccac

SEQ ID NO: 139626 - DNA, 22 bp, Artificial Sequence
  Synthetic oligonucleotide; CTC chr11 5251863 5251884 5251868 5251863 -
aggtttacaaatctccacttgt

SEQ ID NO: 139627 - DNA, 22 bp, Artificial Sequence
  Synthetic oligonucleotide; TTT chr11 5251857 5251878 5251862 5251857 -
acaaatctccacttgtcctctg

SEQ ID NO: 139628 - DNA, 22 bp, Artificial Sequence
  Synthetic oligonucleotide; TTA chr11 5251856 5251877 5251861 5251856 -
caaatctccacttgtcctctgt

SEQ ID NO: 139629 - DNA, 22 bp, Artificial Sequence
  Synthetic oligonucleotide; CTC chr11 5251848 5251869 5251853 5251848 -
cacttgtcctctgtgtttcaga

SEQ ID NO: 139630 - DNA, 22 bp, Artificial Sequence
  Synthetic oligonucleotide; CTT chr11 5251843 5251864 5251848 5251843 -
gtcctctgtgtttcagaataaa

SEQ ID NO: 139631 - DNA, 22 bp, Artificial Sequence
  Synthetic oligonucleotide; TTG chr11 5251842 5251863 5251847 5251842 -
tcctctgtgtttcagaataaaa

SEQ ID NO: 139632 - DNA, 22 bp, Artificial Sequence
  Synthetic oligonucleotide; CTC chr11 5251837 5251858 5251842 5251837 -
tgtgtttcagaataaaatacca

SEQ ID NO: 139633 - DNA, 22 bp, Artificial Sequence
  Synthetic oligonucleotide; CTG chr11 5251835 5251856 5251840 5251835 -
tgtttcagaataaaataccaac

SEQ ID NO: 139634 - DNA, 22 bp, Artificial Sequence
  Synthetic oligonucleotide; TTT chr11 5251830 5251851 5251835 5251830 -
cagaataaaataccaactctac

SEQ ID NO: 139635 - DNA, 22 bp, Artificial Sequence
  Synthetic oligonucleotide; TTC chr11 5251829 5251850 5251834 5251829 -
agaataaaataccaactctact

SEQ ID NO: 139636 - DNA, 22 bp, Artificial Sequence
  Synthetic oligonucleotide; CTC chr11 5251811 5251832 5251816 5251811 -
tactactctcatctgtaagatg

SEQ ID NO: 139637 - DNA, 22 bp, Artificial Sequence
  Synthetic oligonucleotide; CTA chr11 5251809 5251830 5251814 5251809 -
ctactctcatctgtaagatgca

SEQ ID NO: 139638 - DNA, 22 bp, Artificial Sequence
  Synthetic oligonucleotide; CTA chr11 5251806 5251827 5251811 5251806 -
ctctcatctgtaagatgcaaat

SEQ ID NO: 139639 - DNA, 22 bp, Artificial Sequence
  Synthetic oligonucleotide; CTC chr11 5251803 5251824 5251808 5251803 -
tcatctgtaagatgcaaatagt

SEQ ID NO: 139640 - DNA, 22 bp, Artificial Sequence
  Synthetic oligonucleotide; CTC chr11 5251801 5251822 5251806 5251801 -
atctgtaagatgcaaatagtaa

SEQ ID NO: 139641 - DNA, 22 bp, Artificial Sequence
  Synthetic oligonucleotide; CTG chr11 5251796 5251817 5251801 5251796 -
taagatgcaaatagtaagcctg

SEQ ID NO: 139642 - DNA, 22 bp, Artificial Sequence
  Synthetic oligonucleotide; CTG chr11 5251774 5251795 5251779 5251774 -
agcccttctgtctaactttgaa

SEQ ID NO: 139643 - DNA, 22 bp, Artificial Sequence
  Synthetic oligonucleotide; CTT chr11 5251767 5251788 5251772 5251767 -
ctgtctaactttgaattctatt

SEQ ID NO: 139644 - DNA, 22 bp, Artificial Sequence
  Synthetic oligonucleotide; TTC chr11 5251766 5251787 5251771 5251766 -
tgtctaactttgaattctattt

SEQ ID NO: 139645 - DNA, 22 bp, Artificial Sequence
  Synthetic oligonucleotide; CTG chr11 5251764 5251785 5251769 5251764 -
tctaactttgaattctattttt

SEQ ID NO: 139646 - DNA, 22 bp, Artificial Sequence
  Synthetic oligonucleotide; CTA chr11 5251760 5251781 5251765 5251760 -
actttgaattctattttttctt

SEQ ID NO: 139647 - DNA, 22 bp, Artificial Sequence
  Synthetic oligonucleotide; CTT chr11 5251756 5251777 5251761 5251756 -
tgaattctattttttcttcaac

SEQ ID NO: 139648 - DNA, 22 bp, Artificial Sequence
  Synthetic oligonucleotide; TTT chr11 5251755 5251776 5251760 5251755 -
gaattctattttttcttcaacg

SEQ ID NO: 139649 - DNA, 22 bp, Artificial Sequence
  Synthetic oligonucleotide; TTG chr11 5251754 5251775 5251759 5251754 -
aattctattttttcttcaacgt

SEQ ID NO: 139650 - DNA, 22 bp, Artificial Sequence
  Synthetic oligonucleotide; TTC chr11 5251749 5251770 5251754 5251749 -
tattttttcttcaacgtacttt

SEQ ID NO: 139651 - DNA, 22 bp, Artificial Sequence
  Synthetic oligonucleotide; CTA chr11 5251747 5251768 5251752 5251747 -
ttttttcttcaacgtactttag

SEQ ID NO: 139652 - DNA, 22 bp, Artificial Sequence
  Synthetic oligonucleotide; TTT chr11 5251744 5251765 5251749 5251744 -
tttcttcaacgtactttaggct

SEQ ID NO: 139653 - DNA, 22 bp, Artificial Sequence
  Synthetic oligonucleotide; TTT chr11 5251743 5251764 5251748 5251743 -
ttcttcaacgtactttaggctt

SEQ ID NO: 139654 - DNA, 22 bp, Artificial Sequence
  Synthetic oligonucleotide; TTT chr11 5251742 5251763 5251747 5251742 -
tcttcaacgtactttaggcttg

SEQ ID NO: 139655 - DNA, 22 bp, Artificial Sequence
  Synthetic oligonucleotide; TTT chr11 5251741 5251762 5251746 5251741 -
cttcaacgtactttaggcttgt

SEQ ID NO: 139656 - DNA, 22 bp, Artificial Sequence
  Synthetic oligonucleotide; TTC chr11 5251740 5251761 5251745 5251740 -
ttcaacgtactttaggcttgta

SEQ ID NO: 139657 - DNA, 22 bp, Artificial Sequence
  Synthetic oligonucleotide; CTT chr11 5251738 5251759 5251743 5251738 -
caacgtactttaggcttgtaat

SEQ ID NO: 139658 - DNA, 22 bp, Artificial Sequence
  Synthetic oligonucleotide; TTC chr11 5251737 5251758 5251742 5251737 -
aacgtactttaggcttgtaatg

SEQ ID NO: 139659 - DNA, 22 bp, Artificial Sequence
  Synthetic oligonucleotide; CTT chr11 5251728 5251749 5251733 5251728 -
taggcttgtaatgtgtttatat

SEQ ID NO: 139660 - DNA, 22 bp, Artificial Sequence
  Synthetic oligonucleotide; TTT chr11 5251727 5251748 5251732 5251727 -
aggcttgtaatgtgtttatata

SEQ ID NO: 139661 - DNA, 22 bp, Artificial Sequence
  Synthetic oligonucleotide; TTA chr11 5251726 5251747 5251731 5251726 -
ggcttgtaatgtgtttatatac

SEQ ID NO: 139662 - DNA, 22 bp, Artificial Sequence
  Synthetic oligonucleotide; CTT chr11 5251721 5251742 5251726 5251721 -
gtaatgtgtttatatacagtga

SEQ ID NO: 139663 - DNA, 22 bp, Artificial Sequence
  Synthetic oligonucleotide; TTG chr11 5251720 5251741 5251725 5251720 -
taatgtgtttatatacagtgaa

SEQ ID NO: 139664 - DNA, 22 bp, Artificial Sequence
  Synthetic oligonucleotide; TTT chr11 5251710 5251731 5251715 5251710 -
atatacagtgaaatgtcaagtt

SEQ ID NO: 139665 - DNA, 22 bp, Artificial Sequence
  Synthetic oligonucleotide; TTA chr11 5251709 5251730 5251714 5251709 -
tatacagtgaaatgtcaagttc

SEQ ID NO: 139666 - DNA, 22 bp, Artificial Sequence
  Synthetic oligonucleotide; TTC chr11 5251687 5251708 5251692 5251687 -
tttctttatatttctttctttc

SEQ ID NO: 139667 - DNA, 22 bp, Artificial Sequence
  Synthetic oligonucleotide; CTT chr11 5251685 5251706 5251690 5251685 -
tctttatatttctttctttctt

SEQ ID NO: 139668 - DNA, 22 bp, Artificial Sequence
  Synthetic oligonucleotide; TTT chr11 5251684 5251705 5251689 5251684 -
ctttatatttctttctttcttt

SEQ ID NO: 139669 - DNA, 22 bp, Artificial Sequence
  Synthetic oligonucleotide; TTC chr11 5251683 5251704 5251688 5251683 -
tttatatttctttctttctttt

SEQ ID NO: 139670 - DNA, 22 bp, Artificial Sequence
  Synthetic oligonucleotide; CTT chr11 5251681 5251702 5251686 5251681 -
tatatttctttctttctttttt

SEQ ID NO: 139671 - DNA, 22 bp, Artificial Sequence
  Synthetic oligonucleotide; TTT chr11 5251680 5251701 5251685 5251680 -
atatttctttctttcttttttt

SEQ ID NO: 139672 - DNA, 22 bp, Artificial Sequence
  Synthetic oligonucleotide; TTA chr11 5251679 5251700 5251684 5251679 -
tatttctttctttctttttttt

SEQ ID NO: 139673 - DNA, 22 bp, Artificial Sequence
  Synthetic oligonucleotide; TTT chr11 5251674 5251695 5251679 5251674 -
ctttctttcttttttttcctca

SEQ ID NO: 139674 - DNA, 22 bp, Artificial Sequence
  Synthetic oligonucleotide; TTC chr11 5251673 5251694 5251678 5251673 -
tttctttcttttttttcctcag

SEQ ID NO: 139675 - DNA, 22 bp, Artificial Sequence
  Synthetic oligonucleotide; CTT chr11 5251671 5251692 5251676 5251671 -
tctttcttttttttcctcagcc

SEQ ID NO: 139676 - DNA, 22 bp, Artificial Sequence
  Synthetic oligonucleotide; TTT chr11 5251670 5251691 5251675 5251670 -
ctttcttttttttcctcagcct

SEQ ID NO: 139677 - DNA, 22 bp, Artificial Sequence
  Synthetic oligonucleotide; TTC chr11 5251669 5251690 5251674 5251669 -
tttcttttttttcctcagcctc

SEQ ID NO: 139678 - DNA, 22 bp, Artificial Sequence
  Synthetic oligonucleotide; CTT chr11 5251667 5251688 5251672 5251667 -
tcttttttttcctcagcctcag

SEQ ID NO: 139679 - DNA, 22 bp, Artificial Sequence
  Synthetic oligonucleotide; TTT chr11 5251666 5251687 5251671 5251666 -
cttttttttcctcagcctcaga

SEQ ID NO: 139680 - DNA, 22 bp, Artificial Sequence
  Synthetic oligonucleotide; TTC chr11 5251665 5251686 5251670 5251665 -
ttttttttcctcagcctcagag

SEQ ID NO: 139681 - DNA, 22 bp, Artificial Sequence
  Synthetic oligonucleotide; CTT chr11 5251663 5251684 5251668 5251663 -
ttttttcctcagcctcagagtt

SEQ ID NO: 139682 - DNA, 22 bp, Artificial Sequence
  Synthetic oligonucleotide; TTT chr11 5251662 5251683 5251667 5251662 -
tttttcctcagcctcagagttt

SEQ ID NO: 139683 - DNA, 22 bp, Artificial Sequence
  Synthetic oligonucleotide; TTT chr11 5251661 5251682 5251666 5251661 -
ttttcctcagcctcagagtttt

SEQ ID NO: 139684 - DNA, 22 bp, Artificial Sequence
  Synthetic oligonucleotide; TTT chr11 5251660 5251681 5251665 5251660 -
tttcctcagcctcagagttttc

SEQ ID NO: 139685 - DNA, 22 bp, Artificial Sequence
  Synthetic oligonucleotide; TTT chr11 5251659 5251680 5251664 5251659 -
ttcctcagcctcagagttttcc

SEQ ID NO: 139686 - DNA, 22 bp, Artificial Sequence
  Synthetic oligonucleotide; TTT chr11 5251658 5251679 5251663 5251658 -
tcctcagcctcagagttttcca

SEQ ID NO: 139687 - DNA, 22 bp, Artificial Sequence
  Synthetic oligonucleotide; TTT chr11 5251657 5251678 5251662 5251657 -
cctcagcctcagagttttccac

SEQ ID NO: 139688 - DNA, 22 bp, Artificial Sequence
  Synthetic oligonucleotide; TTC chr11 5251656 5251677 5251661 5251656 -
ctcagcctcagagttttccaca

SEQ ID NO: 139689 - DNA, 22 bp, Artificial Sequence
  Synthetic oligonucleotide; CTC chr11 5251653 5251674 5251658 5251653 -
agcctcagagttttccacatgc

SEQ ID NO: 139690 - DNA, 22 bp, Artificial Sequence
  Synthetic oligonucleotide; CTC chr11 5251647 5251668 5251652 5251647 -
agagttttccacatgcccttcc

SEQ ID NO: 139691 - DNA, 22 bp, Artificial Sequence
  Synthetic oligonucleotide; TTT chr11 5251640 5251661 5251645 5251640 -
tccacatgcccttcctactttc

SEQ ID NO: 139692 - DNA, 22 bp, Artificial Sequence
  Synthetic oligonucleotide; TTT chr11 5251639 5251660 5251644 5251639 -
ccacatgcccttcctactttca

SEQ ID NO: 139693 - DNA, 22 bp, Artificial Sequence
  Synthetic oligonucleotide; TTC chr11 5251638 5251659 5251643 5251638 -
cacatgcccttcctactttcag

SEQ ID NO: 139694 - DNA, 22 bp, Artificial Sequence
  Synthetic oligonucleotide; CTT chr11 5251627 5251648 5251632 5251627 -
cctactttcaggaacttctttc

SEQ ID NO: 139695 - DNA, 22 bp, Artificial Sequence
  Synthetic oligonucleotide; TTC chr11 5251626 5251647 5251631 5251626 -
ctactttcaggaacttctttct

SEQ ID NO: 139696 - DNA, 22 bp, Artificial Sequence
  Synthetic oligonucleotide; CTA chr11 5251623 5251644 5251628 5251623 -
ctttcaggaacttctttctcca

SEQ ID NO: 139697 - DNA, 22 bp, Artificial Sequence
  Synthetic oligonucleotide; CTT chr11 5251620 5251641 5251625 5251620 -
tcaggaacttctttctccaaac

SEQ ID NO: 139698 - DNA, 22 bp, Artificial Sequence
  Synthetic oligonucleotide; TTT chr11 5251619 5251640 5251624 5251619 -
caggaacttctttctccaaacg

SEQ ID NO: 139699 - DNA, 22 bp, Artificial Sequence
  Synthetic oligonucleotide; TTC chr11 5251618 5251639 5251623 5251618 -
aggaacttctttctccaaacgt

SEQ ID NO: 139700 - DNA, 22 bp, Artificial Sequence
  Synthetic oligonucleotide; CTT chr11 5251610 5251631 5251615 5251610 -
ctttctccaaacgtcttctgcc

SEQ ID NO: 139701 - DNA, 22 bp, Artificial Sequence
  Synthetic oligonucleotide; TTC chr11 5251609 5251630 5251614 5251609 -
tttctccaaacgtcttctgcct

SEQ ID NO: 139702 - DNA, 22 bp, Artificial Sequence
  Synthetic oligonucleotide; CTT chr11 5251607 5251628 5251612 5251607 -
tctccaaacgtcttctgcctgg

SEQ ID NO: 139703 - DNA, 22 bp, Artificial Sequence
  Synthetic oligonucleotide; TTT chr11 5251606 5251627 5251611 5251606 -
ctccaaacgtcttctgcctggc

SEQ ID NO: 139704 - DNA, 22 bp, Artificial Sequence
  Synthetic oligonucleotide; TTC chr11 5251605 5251626 5251610 5251605 -
tccaaacgtcttctgcctggct

SEQ ID NO: 139705 - DNA, 22 bp, Artificial Sequence
  Synthetic oligonucleotide; CTC chr11 5251603 5251624 5251608 5251603 -
caaacgtcttctgcctggctcc

SEQ ID NO: 139706 - DNA, 22 bp, Artificial Sequence
  Synthetic oligonucleotide; CTT chr11 5251593 5251614 5251598 5251593 -
ctgcctggctccatcaaatcat

SEQ ID NO: 139707 - DNA, 22 bp, Artificial Sequence
  Synthetic oligonucleotide; TTC chr11 5251592 5251613 5251597 5251592 -
tgcctggctccatcaaatcata

SEQ ID NO: 139708 - DNA, 22 bp, Artificial Sequence
  Synthetic oligonucleotide; CTG chr11 5251590 5251611 5251595 5251590 -
cctggctccatcaaatcataaa

SEQ ID NO: 139709 - DNA, 22 bp, Artificial Sequence
  Synthetic oligonucleotide; CTG chr11 5251586 5251607 5251591 5251586 -
gctccatcaaatcataaaggac

SEQ ID NO: 139710 - DNA, 22 bp, Artificial Sequence
  Synthetic oligonucleotide; CTC chr11 5251582 5251603 5251587 5251582 -
catcaaatcataaaggacccac

SEQ ID NO: 139711 - DNA, 22 bp, Artificial Sequence
  Synthetic oligonucleotide; CTT chr11 5251558 5251579 5251563 5251558 -
caaatgccatcactcactacca

SEQ ID NO: 139712 - DNA, 22 bp, Artificial Sequence
  Synthetic oligonucleotide; TTC chr11 5251557 5251578 5251562 5251557 -
aaatgccatcactcactaccat

SEQ ID NO: 139713 - DNA, 22 bp, Artificial Sequence
  Synthetic oligonucleotide; CTC chr11 5251543 5251564 5251548 5251543 -
actaccatttcacaattcgcac

SEQ ID NO: 139714 - DNA, 22 bp, Artificial Sequence
  Synthetic oligonucleotide; CTA chr11 5251539 5251560 5251544 5251539 -
ccatttcacaattcgcactttc

SEQ ID NO: 139715 - DNA, 22 bp, Artificial Sequence
  Synthetic oligonucleotide; TTT chr11 5251533 5251554 5251538 5251533 -
cacaattcgcactttctttctt

SEQ ID NO: 139716 - DNA, 22 bp, Artificial Sequence
  Synthetic oligonucleotide; TTC chr11 5251532 5251553 5251537 5251532 -
acaattcgcactttctttcttt

SEQ ID NO: 139717 - DNA, 22 bp, Artificial Sequence
  Synthetic oligonucleotide; TTC chr11 5251525 5251546 5251530 5251525 -
gcactttctttctttgtccttt

SEQ ID NO: 139718 - DNA, 22 bp, Artificial Sequence
  Synthetic oligonucleotide; CTT chr11 5251519 5251540 5251524 5251519 -
tctttctttgtccttttttttt

SEQ ID NO: 139719 - DNA, 22 bp, Artificial Sequence
  Synthetic oligonucleotide; TTT chr11 5251518 5251539 5251523 5251518 -
ctttctttgtcctttttttttt

SEQ ID NO: 139720 - DNA, 22 bp, Artificial Sequence
  Synthetic oligonucleotide; TTC chr11 5251517 5251538 5251522 5251517 -
tttctttgtccttttttttttt

SEQ ID NO: 139721 - DNA, 22 bp, Artificial Sequence
  Synthetic oligonucleotide; CTT chr11 5251515 5251536 5251520 5251515 -
tctttgtcctttttttttttag

SEQ ID NO: 139722 - DNA, 22 bp, Artificial Sequence
  Synthetic oligonucleotide; TTT chr11 5251514 5251535 5251519 5251514 -
ctttgtcctttttttttttagt

SEQ ID NO: 139723 - DNA, 22 bp, Artificial Sequence
  Synthetic oligonucleotide; TTC chr11 5251513 5251534 5251518 5251513 -
tttgtcctttttttttttagta

SEQ ID NO: 139724 - DNA, 22 bp, Artificial Sequence
  Synthetic oligonucleotide; CTT chr11 5251511 5251532 5251516 5251511 -
tgtcctttttttttttagtaaa

SEQ ID NO: 139725 - DNA, 22 bp, Artificial Sequence
  Synthetic oligonucleotide; TTT chr11 5251510 5251531 5251515 5251510 -
gtcctttttttttttagtaaaa

SEQ ID NO: 139726 - DNA, 22 bp, Artificial Sequence
  Synthetic oligonucleotide; TTG chr11 5251509 5251530 5251514 5251509 -
tcctttttttttttagtaaaac

SEQ ID NO: 139727 - DNA, 22 bp, Artificial Sequence
  Synthetic oligonucleotide; CTT chr11 5251504 5251525 5251509 5251504 -
tttttttttagtaaaacaagtt

SEQ ID NO: 139728 - DNA, 22 bp, Artificial Sequence
  Synthetic oligonucleotide; TTT chr11 5251503 5251524 5251508 5251503 -
ttttttttagtaaaacaagttt

SEQ ID NO: 139729 - DNA, 22 bp, Artificial Sequence
  Synthetic oligonucleotide; TTT chr11 5251502 5251523 5251507 5251502 -
tttttttagtaaaacaagttta

SEQ ID NO: 139730 - DNA, 22 bp, Artificial Sequence
  Synthetic oligonucleotide; TTT chr11 5251501 5251522 5251506 5251501 -
ttttttagtaaaacaagtttat

SEQ ID NO: 139731 - DNA, 22 bp, Artificial Sequence
  Synthetic oligonucleotide; TTT chr11 5251500 5251521 5251505 5251500 -
tttttagtaaaacaagtttata

SEQ ID NO: 139732 - DNA, 22 bp, Artificial Sequence
  Synthetic oligonucleotide; TTT chr11 5251499 5251520 5251504 5251499 -
ttttagtaaaacaagtttataa

SEQ ID NO: 139733 - DNA, 22 bp, Artificial Sequence
  Synthetic oligonucleotide; TTT chr11 5251498 5251519 5251503 5251498 -
tttagtaaaacaagtttataaa

SEQ ID NO: 139734 - DNA, 22 bp, Artificial Sequence
  Synthetic oligonucleotide; TTT chr11 5251497 5251518 5251502 5251497 -
ttagtaaaacaagtttataaaa

SEQ ID NO: 139735 - DNA, 22 bp, Artificial Sequence
  Synthetic oligonucleotide; TTT chr11 5251496 5251517 5251501 5251496 -
tagtaaaacaagtttataaaaa

SEQ ID NO: 139736 - DNA, 22 bp, Artificial Sequence
  Synthetic oligonucleotide; TTT chr11 5251495 5251516 5251500 5251495 -
agtaaaacaagtttataaaaaa

SEQ ID NO: 139737 - DNA, 22 bp, Artificial Sequence
  Synthetic oligonucleotide; TTA chr11 5251494 5251515 5251499 5251494 -
gtaaaacaagtttataaaaaat

SEQ ID NO: 139738 - DNA, 22 bp, Artificial Sequence
  Synthetic oligonucleotide; TTT chr11 5251481 5251502 5251486 5251481 -
ataaaaaattgaaggaataaat

SEQ ID NO: 139739 - DNA, 22 bp, Artificial Sequence
  Synthetic oligonucleotide; TTA chr11 5251480 5251501 5251485 5251480 -
taaaaaattgaaggaataaatg

SEQ ID NO: 139740 - DNA, 22 bp, Artificial Sequence
  Synthetic oligonucleotide; TTG chr11 5251470 5251491 5251475 5251470 -
aaggaataaatgaatggctact

SEQ ID NO: 139741 - DNA, 22 bp, Artificial Sequence
  Synthetic oligonucleotide; CTA chr11 5251450 5251471 5251455 5251450 -
cttcataggcagagtagacgca

SEQ ID NO: 139742 - DNA, 22 bp, Artificial Sequence
  Synthetic oligonucleotide; CTT chr11 5251447 5251468 5251452 5251447 -
cataggcagagtagacgcaagg

SEQ ID NO: 139743 - DNA, 22 bp, Artificial Sequence
  Synthetic oligonucleotide; TTC chr11 5251446 5251467 5251451 5251446 -
ataggcagagtagacgcaaggg

SEQ ID NO: 139744 - DNA, 22 bp, Artificial Sequence
  Synthetic oligonucleotide; CTA chr11 5251421 5251442 5251426 5251421 -
ctggttgccgatttttattgtt

SEQ ID NO: 139745 - DNA, 22 bp, Artificial Sequence
  Synthetic oligonucleotide; CTG chr11 5251418 5251439 5251423 5251418 -
gttgccgatttttattgttatt

SEQ ID NO: 139746 - DNA, 22 bp, Artificial Sequence
  Synthetic oligonucleotide; TTG chr11 5251414 5251435 5251419 5251414 -
ccgatttttattgttatttttc

SEQ ID NO: 139747 - DNA, 22 bp, Artificial Sequence
  Synthetic oligonucleotide; TTT chr11 5251407 5251428 5251412 5251407 -
ttattgttatttttcaatagta

SEQ ID NO: 139748 - DNA, 22 bp, Artificial Sequence
  Synthetic oligonucleotide; TTT chr11 5251406 5251427 5251411 5251406 -
tattgttatttttcaatagtat

SEQ ID NO: 139749 - DNA, 22 bp, Artificial Sequence
  Synthetic oligonucleotide; TTT chr11 5251405 5251426 5251410 5251405 -
attgttatttttcaatagtatg

SEQ ID NO: 139750 - DNA, 22 bp, Artificial Sequence
  Synthetic oligonucleotide; TTA chr11 5251404 5251425 5251409 5251404 -
ttgttatttttcaatagtatgc

SEQ ID NO: 139751 - DNA, 22 bp, Artificial Sequence
  Synthetic oligonucleotide; TTG chr11 5251401 5251422 5251406 5251401 -
ttatttttcaatagtatgctaa

SEQ ID NO: 139752 - DNA, 22 bp, Artificial Sequence
  Synthetic oligonucleotide; TTA chr11 5251398 5251419 5251403 5251398 -
tttttcaatagtatgctaaaca

SEQ ID NO: 139753 - DNA, 22 bp, Artificial Sequence
  Synthetic oligonucleotide; TTT chr11 5251395 5251416 5251400 5251395 -
ttcaatagtatgctaaacaagg

SEQ ID NO: 139754 - DNA, 22 bp, Artificial Sequence
  Synthetic oligonucleotide; TTT chr11 5251394 5251415 5251399 5251394 -
tcaatagtatgctaaacaaggg

SEQ ID NO: 139755 - DNA, 22 bp, Artificial Sequence
  Synthetic oligonucleotide; TTT chr11 5251393 5251414 5251398 5251393 -
caatagtatgctaaacaagggg

SEQ ID NO: 139756 - DNA, 22 bp, Artificial Sequence
  Synthetic oligonucleotide; TTC chr11 5251392 5251413 5251397 5251392 -
aatagtatgctaaacaaggggt

SEQ ID NO: 139757 - DNA, 22 bp, Artificial Sequence
  Synthetic oligonucleotide; CTA chr11 5251380 5251401 5251385 5251380 -
aacaaggggtagattatttatg

SEQ ID NO: 139758 - DNA, 22 bp, Artificial Sequence
  Synthetic oligonucleotide; TTA chr11 5251364 5251385 5251369 5251364 -
tttatgctgcccatttttagac

SEQ ID NO: 139759 - DNA, 22 bp, Artificial Sequence
  Synthetic oligonucleotide; TTT chr11 5251361 5251382 5251366 5251361 -
atgctgcccatttttagaccat

SEQ ID NO: 139760 - DNA, 22 bp, Artificial Sequence
  Synthetic oligonucleotide; TTA chr11 5251360 5251381 5251365 5251360 -
tgctgcccatttttagaccata

SEQ ID NO: 139761 - DNA, 22 bp, Artificial Sequence
  Synthetic oligonucleotide; CTG chr11 5251355 5251376 5251360 5251355 -
cccatttttagaccataaaaga

SEQ ID NO: 139762 - DNA, 22 bp, Artificial Sequence
  Synthetic oligonucleotide; TTT chr11 5251348 5251369 5251353 5251348 -
ttagaccataaaagataacttc

SEQ ID NO: 139763 - DNA, 22 bp, Artificial Sequence
  Synthetic oligonucleotide; TTT chr11 5251347 5251368 5251352 5251347 -
tagaccataaaagataacttcc

SEQ ID NO: 139764 - DNA, 22 bp, Artificial Sequence
  Synthetic oligonucleotide; TTT chr11 5251346 5251367 5251351 5251346 -
agaccataaaagataacttcct

SEQ ID NO: 139765 - DNA, 22 bp, Artificial Sequence
  Synthetic oligonucleotide; TTA chr11 5251345 5251366 5251350 5251345 -
gaccataaaagataacttcctg

SEQ ID NO: 139766 - DNA, 22 bp, Artificial Sequence
  Synthetic oligonucleotide; CTT chr11 5251327 5251348 5251332 5251327 -
cctgatgttgccatggcatttt

SEQ ID NO: 139767 - DNA, 22 bp, Artificial Sequence
  Synthetic oligonucleotide; TTC chr11 5251326 5251347 5251331 5251326 -
ctgatgttgccatggcattttt

SEQ ID NO: 139768 - DNA, 22 bp, Artificial Sequence
  Synthetic oligonucleotide; CTG chr11 5251323 5251344 5251328 5251323 -
atgttgccatggcatttttttc

SEQ ID NO: 139769 - DNA, 22 bp, Artificial Sequence
  Synthetic oligonucleotide; TTG chr11 5251317 5251338 5251322 5251317 -
ccatggcatttttttcctttta

SEQ ID NO: 139770 - DNA, 22 bp, Artificial Sequence
  Synthetic oligonucleotide; TTT chr11 5251306 5251327 5251311 5251306 -
ttttccttttaattttatttca

SEQ ID NO: 139771 - DNA, 22 bp, Artificial Sequence
  Synthetic oligonucleotide; TTT chr11 5251305 5251326 5251310 5251305 -
tttccttttaattttatttcat

SEQ ID NO: 139772 - DNA, 22 bp, Artificial Sequence
  Synthetic oligonucleotide; TTT chr11 5251304 5251325 5251309 5251304 -
ttccttttaattttatttcatt

SEQ ID NO: 139773 - DNA, 22 bp, Artificial Sequence
  Synthetic oligonucleotide; TTT chr11 5251303 5251324 5251308 5251303 -
tccttttaattttatttcattt

SEQ ID NO: 139774 - DNA, 22 bp, Artificial Sequence
  Synthetic oligonucleotide; TTT chr11 5251302 5251323 5251307 5251302 -
ccttttaattttatttcatttc

SEQ ID NO: 139775 - DNA, 22 bp, Artificial Sequence
  Synthetic oligonucleotide; TTC chr11 5251301 5251322 5251306 5251301 -
cttttaattttatttcatttca

SEQ ID NO: 139776 - DNA, 22 bp, Artificial Sequence
  Synthetic oligonucleotide; CTT chr11 5251298 5251319 5251303 5251298 -
ttaattttatttcatttcattt

SEQ ID NO: 139777 - DNA, 22 bp, Artificial Sequence
  Synthetic oligonucleotide; TTT chr11 5251297 5251318 5251302 5251297 -
taattttatttcatttcatttt

SEQ ID NO: 139778 - DNA, 22 bp, Artificial Sequence
  Synthetic oligonucleotide; TTT chr11 5251296 5251317 5251301 5251296 -
aattttatttcatttcatttta

SEQ ID NO: 139779 - DNA, 22 bp, Artificial Sequence
  Synthetic oligonucleotide; TTA chr11 5251295 5251316 5251300 5251295 -
attttatttcatttcattttaa

SEQ ID NO: 139780 - DNA, 22 bp, Artificial Sequence
  Synthetic oligonucleotide; TTT chr11 5251291 5251312 5251296 5251291 -
tatttcatttcattttaatttc

SEQ ID NO: 139781 - DNA, 22 bp, Artificial Sequence
  Synthetic oligonucleotide; TTT chr11 5251290 5251311 5251295 5251290 -
atttcatttcattttaatttcg

SEQ ID NO: 139782 - DNA, 22 bp, Artificial Sequence
  Synthetic oligonucleotide; TTA chr11 5251289 5251310 5251294 5251289 -
tttcatttcattttaatttcga

SEQ ID NO: 139783 - DNA, 22 bp, Artificial Sequence
  Synthetic oligonucleotide; TTT chr11 5251286 5251307 5251291 5251286 -
catttcattttaatttcgaagg

SEQ ID NO: 139784 - DNA, 22 bp, Artificial Sequence
  Synthetic oligonucleotide; TTC chr11 5251285 5251306 5251290 5251285 -
atttcattttaatttcgaaggt

SEQ ID NO: 139785 - DNA, 22 bp, Artificial Sequence
  Synthetic oligonucleotide; TTT chr11 5251281 5251302 5251286 5251281 -
cattttaatttcgaaggtacat

SEQ ID NO: 139786 - DNA, 22 bp, Artificial Sequence
  Synthetic oligonucleotide; TTC chr11 5251280 5251301 5251285 5251280 -
attttaatttcgaaggtacatg

SEQ ID NO: 139787 - DNA, 22 bp, Artificial Sequence
  Synthetic oligonucleotide; TTT chr11 5251276 5251297 5251281 5251276 -
taatttcgaaggtacatgtgca

SEQ ID NO: 139788 - DNA, 22 bp, Artificial Sequence
  Synthetic oligonucleotide; TTT chr11 5251275 5251296 5251280 5251275 -
aatttcgaaggtacatgtgcag

SEQ ID NO: 139789 - DNA, 22 bp, Artificial Sequence
  Synthetic oligonucleotide; TTA chr11 5251274 5251295 5251279 5251274 -
atttcgaaggtacatgtgcagg

SEQ ID NO: 139790 - DNA, 22 bp, Artificial Sequence
  Synthetic oligonucleotide; TTT chr11 5251270 5251291 5251275 5251270 -
cgaaggtacatgtgcaggatgt

SEQ ID NO: 139791 - DNA, 22 bp, Artificial Sequence
  Synthetic oligonucleotide; TTC chr11 5251269 5251290 5251274 5251269 -
gaaggtacatgtgcaggatgtg

SEQ ID NO: 139792 - DNA, 22 bp, Artificial Sequence
  Synthetic oligonucleotide; CTT chr11 5251240 5251261 5251245 5251240 -
gttacatgggtaaatgtgtgtc

SEQ ID NO: 139793 - DNA, 22 bp, Artificial Sequence
  Synthetic oligonucleotide; TTG chr11 5251239 5251260 5251244 5251239 -
ttacatgggtaaatgtgtgtct

SEQ ID NO: 139794 - DNA, 22 bp, Artificial Sequence
  Synthetic oligonucleotide; TTA chr11 5251236 5251257 5251241 5251236 -
catgggtaaatgtgtgtctttc

SEQ ID NO: 139795 - DNA, 22 bp, Artificial Sequence
  Synthetic oligonucleotide; CTT chr11 5251216 5251237 5251221 5251216 -
tctggccttttagccatctgta

SEQ ID NO: 139796 - DNA, 22 bp, Artificial Sequence
  Synthetic oligonucleotide; TTT chr11 5251215 5251236 5251220 5251215 -
ctggccttttagccatctgtat

SEQ ID NO: 139797 - DNA, 22 bp, Artificial Sequence
  Synthetic oligonucleotide; TTC chr11 5251214 5251235 5251219 5251214 -
tggccttttagccatctgtatc

SEQ ID NO: 139798 - DNA, 22 bp, Artificial Sequence
  Synthetic oligonucleotide; CTG chr11 5251212 5251233 5251217 5251212 -
gccttttagccatctgtatcaa

SEQ ID NO: 139799 - DNA, 22 bp, Artificial Sequence
  Synthetic oligonucleotide; CTT chr11 5251207 5251228 5251212 5251207 -
ttagccatctgtatcaatgagc

SEQ ID NO: 139800 - DNA, 22 bp, Artificial Sequence
  Synthetic oligonucleotide; TTT chr11 5251206 5251227 5251211 5251206 -
tagccatctgtatcaatgagca

SEQ ID NO: 139801 - DNA, 22 bp, Artificial Sequence
  Synthetic oligonucleotide; TTT chr11 5251205 5251226 5251210 5251205 -
agccatctgtatcaatgagcag

SEQ ID NO: 139802 - DNA, 22 bp, Artificial Sequence
  Synthetic oligonucleotide; TTA chr11 5251204 5251225 5251209 5251204 -
gccatctgtatcaatgagcaga

SEQ ID NO: 139803 - DNA, 22 bp, Artificial Sequence
  Synthetic oligonucleotide; CTG chr11 5251196 5251217 5251201 5251196 -
tatcaatgagcagatataagct

SEQ ID NO: 139804 - DNA, 22 bp, Artificial Sequence
  Synthetic oligonucleotide; CTT chr11 5251173 5251194 5251178 5251173 -
tacacaggatcatgaaggatga

SEQ ID NO: 139805 - DNA, 22 bp, Artificial Sequence
  Synthetic oligonucleotide; TTT chr11 5251172 5251193 5251177 5251172 -
acacaggatcatgaaggatgaa

SEQ ID NO: 139806 - DNA, 22 bp, Artificial Sequence
  Synthetic oligonucleotide; TTA chr11 5251171 5251192 5251176 5251171 -
cacaggatcatgaaggatgaaa

SEQ ID NO: 139807 - DNA, 22 bp, Artificial Sequence
  Synthetic oligonucleotide; TTT chr11 5251143 5251164 5251148 5251143 -
caccaatattataataatttca

SEQ ID NO: 139808 - DNA, 22 bp, Artificial Sequence
  Synthetic oligonucleotide; TTC chr11 5251142 5251163 5251147 5251142 -
accaatattataataatttcaa

SEQ ID NO: 139809 - DNA, 22 bp, Artificial Sequence
  Synthetic oligonucleotide; TTA chr11 5251132 5251153 5251137 5251132 -
taataatttcaatcaacctgat

SEQ ID NO: 139810 - DNA, 22 bp, Artificial Sequence
  Synthetic oligonucleotide; TTT chr11 5251123 5251144 5251128 5251123 -
caatcaacctgatagcttaggg

SEQ ID NO: 139811 - DNA, 22 bp, Artificial Sequence
  Synthetic oligonucleotide; TTC chr11 5251122 5251143 5251127 5251122 -
aatcaacctgatagcttagggg

SEQ ID NO: 139812 - DNA, 22 bp, Artificial Sequence
  Synthetic oligonucleotide; CTG chr11 5251112 5251133 5251117 5251112 -
atagcttaggggataaactaat

SEQ ID NO: 139813 - DNA, 22 bp, Artificial Sequence
  Synthetic oligonucleotide; CTT chr11 5251105 5251126 5251110 5251105 -
aggggataaactaatttgaaga

SEQ ID NO: 139814 - DNA, 22 bp, Artificial Sequence
  Synthetic oligonucleotide; TTA chr11 5251104 5251125 5251109 5251104 -
ggggataaactaatttgaagat

SEQ ID NO: 139815 - DNA, 22 bp, Artificial Sequence
  Synthetic oligonucleotide; CTA chr11 5251092 5251113 5251097 5251092 -
atttgaagatacagcttgcctc

SEQ ID NO: 139816 - DNA, 22 bp, Artificial Sequence
  Synthetic oligonucleotide; TTT chr11 5251088 5251109 5251093 5251088 -
gaagatacagcttgcctccgat

SEQ ID NO: 139817 - DNA, 22 bp, Artificial Sequence
  Synthetic oligonucleotide; TTG chr11 5251087 5251108 5251092 5251087 -
aagatacagcttgcctccgata

SEQ ID NO: 139818 - DNA, 22 bp, Artificial Sequence
  Synthetic oligonucleotide; CTT chr11 5251075 5251096 5251080 5251075 -
gcctccgataagccagaattcc

SEQ ID NO: 139819 - DNA, 22 bp, Artificial Sequence
  Synthetic oligonucleotide; TTG chr11 5251074 5251095 5251079 5251074 -
cctccgataagccagaattcca

SEQ ID NO: 139820 - DNA, 22 bp, Artificial Sequence
  Synthetic oligonucleotide; CTC chr11 5251070 5251091 5251075 5251070 -
cgataagccagaattccagagc

SEQ ID NO: 139821 - DNA, 22 bp, Artificial Sequence
  Synthetic oligonucleotide; TTC chr11 5251054 5251075 5251059 5251054 -
cagagcttctggcattataatc

SEQ ID NO: 139822 - DNA, 22 bp, Artificial Sequence
  Synthetic oligonucleotide; CTT chr11 5251046 5251067 5251051 5251046 -
ctggcattataatctagcaagg

SEQ ID NO: 139823 - DNA, 22 bp, Artificial Sequence
  Synthetic oligonucleotide; TTC chr11 5251045 5251066 5251050 5251045 -
tggcattataatctagcaaggt

SEQ ID NO: 139824 - DNA, 22 bp, Artificial Sequence
  Synthetic oligonucleotide; CTG chr11 5251043 5251064 5251048 5251043 -
gcattataatctagcaaggtta

SEQ ID NO: 139825 - DNA, 22 bp, Artificial Sequence
  Synthetic oligonucleotide; TTA chr11 5251037 5251058 5251042 5251037 -
taatctagcaaggttagagatc

SEQ ID NO: 139826 - DNA, 22 bp, Artificial Sequence
  Synthetic oligonucleotide; CTA chr11 5251030 5251051 5251035 5251030 -
gcaaggttagagatcatggatc

SEQ ID NO: 139827 - DNA, 22 bp, Artificial Sequence
  Synthetic oligonucleotide; TTA chr11 5251021 5251042 5251026 5251021 -
gagatcatggatcactttcaga

SEQ ID NO: 139828 - DNA, 22 bp, Artificial Sequence
  Synthetic oligonucleotide; CTT chr11 5251004 5251025 5251009 5251004 -
tcagagaaaaacaaaaacaaac

SEQ ID NO: 139829 - DNA, 22 bp, Artificial Sequence
  Synthetic oligonucleotide; TTT chr11 5251003 5251024 5251008 5251003 -
cagagaaaaacaaaaacaaact

SEQ ID NO: 139830 - DNA, 22 bp, Artificial Sequence
  Synthetic oligonucleotide; TTC chr11 5251002 5251023 5251007 5251002 -
agagaaaaacaaaaacaaacta

SEQ ID NO: 139831 - DNA, 22 bp, Artificial Sequence
  Synthetic oligonucleotide; CTA chr11 5250980 5251001 5250985 5250980 -
accaaaagcaaaacagaaccaa

SEQ ID NO: 139832 - DNA, 22 bp, Artificial Sequence
  Synthetic oligonucleotide; CTT chr11 5250939 5250960 5250944 5250939 -
cctaccctgttaatggtccaat

SEQ ID NO: 139833 - DNA, 22 bp, Artificial Sequence
  Synthetic oligonucleotide; TTC chr11 5250938 5250959 5250943 5250938 -
ctaccctgttaatggtccaata

SEQ ID NO: 139834 - DNA, 22 bp, Artificial Sequence
  Synthetic oligonucleotide; CTA chr11 5250935 5250956 5250940 5250935 -
ccctgttaatggtccaatatgt

SEQ ID NO: 139835 - DNA, 22 bp, Artificial Sequence
  Synthetic oligonucleotide; CTG chr11 5250930 5250951 5250935 5250930 -
ttaatggtccaatatgtcagaa

SEQ ID NO: 139836 - DNA, 22 bp, Artificial Sequence
  Synthetic oligonucleotide; TTA chr11 5250927 5250948 5250932 5250927 -
atggtccaatatgtcagaaaca

SEQ ID NO: 139837 - DNA, 22 bp, Artificial Sequence
  Synthetic oligonucleotide; CTG chr11 5250899 5250920 5250904 5250899 -
tgttagaaataaagctgtctaa

SEQ ID NO: 139838 - DNA, 22 bp, Artificial Sequence
  Synthetic oligonucleotide; TTA chr11 5250894 5250915 5250899 5250894 -
gaaataaagctgtctaaagtac

SEQ ID NO: 139839 - DNA, 22 bp, Artificial Sequence
  Synthetic oligonucleotide; CTG chr11 5250882 5250903 5250887 5250882 -
tctaaagtacactaatattcga

SEQ ID NO: 139840 - DNA, 22 bp, Artificial Sequence
  Synthetic oligonucleotide; CTA chr11 5250878 5250899 5250883 5250878 -
aagtacactaatattcgagtta

SEQ ID NO: 139841 - DNA, 22 bp, Artificial Sequence
  Synthetic oligonucleotide; CTA chr11 5250868 5250889 5250873 5250868 -
atattcgagttataatagtgtg

SEQ ID NO: 139842 - DNA, 22 bp, Artificial Sequence
  Synthetic oligonucleotide; TTC chr11 5250862 5250883 5250867 5250862 -
gagttataatagtgtgtggact

SEQ ID NO: 139843 - DNA, 22 bp, Artificial Sequence
  Synthetic oligonucleotide; TTA chr11 5250856 5250877 5250861 5250856 -
taatagtgtgtggactattagt

SEQ ID NO: 139844 - DNA, 22 bp, Artificial Sequence
  Synthetic oligonucleotide; CTA chr11 5250839 5250860 5250844 5250839 -
ttagtcaataaaaacaaccctt

SEQ ID NO: 139845 - DNA, 22 bp, Artificial Sequence
  Synthetic oligonucleotide; TTA chr11 5250836 5250857 5250841 5250836 -
gtcaataaaaacaacccttgcc

SEQ ID NO: 139846 - DNA, 22 bp, Artificial Sequence
  Synthetic oligonucleotide; CTT chr11 5250817 5250838 5250822 5250817 -
gcctctttagagttgttttcca

SEQ ID NO: 139847 - DNA, 22 bp, Artificial Sequence
  Synthetic oligonucleotide; TTG chr11 5250816 5250837 5250821 5250816 -
cctctttagagttgttttccat

SEQ ID NO: 139848 - DNA, 22 bp, Artificial Sequence
  Synthetic oligonucleotide; CTC chr11 5250812 5250833 5250817 5250812 -
tttagagttgttttccatgtac

SEQ ID NO: 139849 - DNA, 22 bp, Artificial Sequence
  Synthetic oligonucleotide; CTT chr11 5250810 5250831 5250815 5250810 -
tagagttgttttccatgtacac

SEQ ID NO: 139850 - DNA, 22 bp, Artificial Sequence
  Synthetic oligonucleotide; TTT chr11 5250809 5250830 5250814 5250809 -
agagttgttttccatgtacacg

SEQ ID NO: 139851 - DNA, 22 bp, Artificial Sequence
  Synthetic oligonucleotide; TTA chr11 5250808 5250829 5250813 5250808 -
gagttgttttccatgtacacgc

SEQ ID NO: 139852 - DNA, 22 bp, Artificial Sequence
  Synthetic oligonucleotide; TTG chr11 5250802 5250823 5250807 5250802 -
ttttccatgtacacgcacatct

SEQ ID NO: 139853 - DNA, 22 bp, Artificial Sequence
  Synthetic oligonucleotide; TTT chr11 5250799 5250820 5250804 5250799 -
tccatgtacacgcacatcttat

SEQ ID NO: 139854 - DNA, 22 bp, Artificial Sequence
  Synthetic oligonucleotide; TTT chr11 5250798 5250819 5250803 5250798 -
ccatgtacacgcacatcttatg

SEQ ID NO: 139855 - DNA, 22 bp, Artificial Sequence
  Synthetic oligonucleotide; TTC chr11 5250797 5250818 5250802 5250797 -
catgtacacgcacatcttatgt

SEQ ID NO: 139856 - DNA, 22 bp, Artificial Sequence
  Synthetic oligonucleotide; CTT chr11 5250779 5250800 5250784 5250779 -
atgtcttagagtaagattccct

SEQ ID NO: 139857 - DNA, 22 bp, Artificial Sequence
  Synthetic oligonucleotide; TTA chr11 5250778 5250799 5250783 5250778 -
tgtcttagagtaagattccctg

SEQ ID NO: 139858 - DNA, 22 bp, Artificial Sequence
  Synthetic oligonucleotide; CTT chr11 5250772 5250793 5250777 5250772 -
agagtaagattccctgagaagt

SEQ ID NO: 139859 - DNA, 22 bp, Artificial Sequence
  Synthetic oligonucleotide; TTA chr11 5250771 5250792 5250776 5250771 -
gagtaagattccctgagaagtg

SEQ ID NO: 139860 - DNA, 22 bp, Artificial Sequence
  Synthetic oligonucleotide; TTC chr11 5250760 5250781 5250765 5250760 -
cctgagaagtgaacctagcatt

SEQ ID NO: 139861 - DNA, 22 bp, Artificial Sequence
  Synthetic oligonucleotide; CTG chr11 5250756 5250777 5250761 5250756 -
agaagtgaacctagcatttata

SEQ ID NO: 139862 - DNA, 22 bp, Artificial Sequence
  Synthetic oligonucleotide; CTA chr11 5250743 5250764 5250748 5250743 -
gcatttatacaagataattaat

SEQ ID NO: 139863 - DNA, 22 bp, Artificial Sequence
  Synthetic oligonucleotide; TTT chr11 5250737 5250758 5250742 5250737 -
atacaagataattaattctaat

SEQ ID NO: 139864 - DNA, 22 bp, Artificial Sequence
  Synthetic oligonucleotide; TTA chr11 5250736 5250757 5250741 5250736 -
tacaagataattaattctaatc

SEQ ID NO: 139865 - DNA, 22 bp, Artificial Sequence
  Synthetic oligonucleotide; TTA chr11 5250723 5250744 5250728 5250723 -
attctaatccacagtacctgcc

SEQ ID NO: 139866 - DNA, 22 bp, Artificial Sequence
  Synthetic oligonucleotide; TTC chr11 5250719 5250740 5250724 5250719 -
taatccacagtacctgccaaag

SEQ ID NO: 139867 - DNA, 22 bp, Artificial Sequence
  Synthetic oligonucleotide; CTA chr11 5250717 5250738 5250722 5250717 -
atccacagtacctgccaaagaa

SEQ ID NO: 139868 - DNA, 22 bp, Artificial Sequence
  Synthetic oligonucleotide; CTG chr11 5250703 5250724 5250708 5250703 -
ccaaagaacattctaccatcat

SEQ ID NO: 139869 - DNA, 22 bp, Artificial Sequence
  Synthetic oligonucleotide; TTC chr11 5250690 5250711 5250695 5250690 -
taccatcatctttactgagcat

SEQ ID NO: 139870 - DNA, 22 bp, Artificial Sequence
  Synthetic oligonucleotide; CTA chr11 5250688 5250709 5250693 5250688 -
ccatcatctttactgagcatag

SEQ ID NO: 139871 - DNA, 22 bp, Artificial Sequence
  Synthetic oligonucleotide; CTT chr11 5250678 5250699 5250683 5250678 -
tactgagcatagaagagctacg

SEQ ID NO: 139872 - DNA, 22 bp, Artificial Sequence
  Synthetic oligonucleotide; TTT chr11 5250677 5250698 5250682 5250677 -
actgagcatagaagagctacgc

SEQ ID NO: 139873 - DNA, 22 bp, Artificial Sequence
  Synthetic oligonucleotide; TTA chr11 5250676 5250697 5250681 5250676 -
ctgagcatagaagagctacgcc

SEQ ID NO: 139874 - DNA, 22 bp, Artificial Sequence
  Synthetic oligonucleotide; CTG chr11 5250673 5250694 5250678 5250673 -
agcatagaagagctacgccaaa

SEQ ID NO: 139875 - DNA, 22 bp, Artificial Sequence
  Synthetic oligonucleotide; CTA chr11 5250658 5250679 5250663 5250658 -
cgccaaaaccctgggtcatcag

SEQ ID NO: 139876 - DNA, 22 bp, Artificial Sequence
  Synthetic oligonucleotide; CTG chr11 5250645 5250666 5250650 5250645 -
ggtcatcagccagcacacacac

SEQ ID NO: 139877 - DNA, 22 bp, Artificial Sequence
  Synthetic oligonucleotide; CTT chr11 5250621 5250642 5250626 5250621 -
atccagtggtaaatacacatca

SEQ ID NO: 139878 - DNA, 22 bp, Artificial Sequence
  Synthetic oligonucleotide; TTA chr11 5250620 5250641 5250625 5250620 -
tccagtggtaaatacacatcat

SEQ ID NO: 139879 - DNA, 22 bp, Artificial Sequence
  Synthetic oligonucleotide; CTG chr11 5250595 5250616 5250600 5250595 -
gtgtatacatacatacctgaat

SEQ ID NO: 139880 - DNA, 22 bp, Artificial Sequence
  Synthetic oligonucleotide; CTG chr11 5250576 5250597 5250581 5250576 -
aatatggaatcaaatatttttc

SEQ ID NO: 139881 - DNA, 22 bp, Artificial Sequence
  Synthetic oligonucleotide; TTT chr11 5250557 5250578 5250562 5250557 -
ttctaagatgaaacagtcatga

SEQ ID NO: 139882 - DNA, 22 bp, Artificial Sequence
  Synthetic oligonucleotide; TTT chr11 5250556 5250577 5250561 5250556 -
tctaagatgaaacagtcatgat

SEQ ID NO: 139883 - DNA, 22 bp, Artificial Sequence
  Synthetic oligonucleotide; TTT chr11 5250555 5250576 5250560 5250555 -
ctaagatgaaacagtcatgatt

SEQ ID NO: 139884 - DNA, 22 bp, Artificial Sequence
  Synthetic oligonucleotide; TTC chr11 5250554 5250575 5250559 5250554 -
taagatgaaacagtcatgattt

SEQ ID NO: 139885 - DNA, 22 bp, Artificial Sequence
  Synthetic oligonucleotide; CTA chr11 5250552 5250573 5250557 5250552 -
agatgaaacagtcatgatttat

SEQ ID NO: 139886 - DNA, 22 bp, Artificial Sequence
  Synthetic oligonucleotide; TTT chr11 5250532 5250553 5250537 5250532 -
atttcaaataggtacggataag

SEQ ID NO: 139887 - DNA, 22 bp, Artificial Sequence
  Synthetic oligonucleotide; TTA chr11 5250531 5250552 5250536 5250531 -
tttcaaataggtacggataagt

SEQ ID NO: 139888 - DNA, 22 bp, Artificial Sequence
  Synthetic oligonucleotide; TTT chr11 5250528 5250549 5250533 5250528 -
caaataggtacggataagtaga

SEQ ID NO: 139889 - DNA, 22 bp, Artificial Sequence
  Synthetic oligonucleotide; TTC chr11 5250527 5250548 5250532 5250527 -
aaataggtacggataagtagat

SEQ ID NO: 139890 - DNA, 22 bp, Artificial Sequence
  Synthetic oligonucleotide; TTG chr11 5250501 5250522 5250506 5250501 -
aggtaagcattaggtcttatat

SEQ ID NO: 139891 - DNA, 22 bp, Artificial Sequence
  Synthetic oligonucleotide; TTA chr11 5250489 5250510 5250494 5250489 -
ggtcttatattatgtaacacta

SEQ ID NO: 139892 - DNA, 22 bp, Artificial Sequence
  Synthetic oligonucleotide; CTT chr11 5250483 5250504 5250488 5250483 -
atattatgtaacactaatctat

SEQ ID NO: 139893 - DNA, 22 bp, Artificial Sequence
  Synthetic oligonucleotide; TTA chr11 5250482 5250503 5250487 5250482 -
tattatgtaacactaatctatt

SEQ ID NO: 139894 - DNA, 22 bp, Artificial Sequence
  Synthetic oligonucleotide; TTA chr11 5250477 5250498 5250482 5250477 -
tgtaacactaatctattactgc

SEQ ID NO: 139895 - DNA, 22 bp, Artificial Sequence
  Synthetic oligonucleotide; CTA chr11 5250467 5250488 5250472 5250467 -
atctattactgcgctgaaactg

SEQ ID NO: 139896 - DNA, 22 bp, Artificial Sequence
  Synthetic oligonucleotide; CTA chr11 5250462 5250483 5250467 5250462 -
ttactgcgctgaaactgtggct

SEQ ID NO: 139897 - DNA, 22 bp, Artificial Sequence
  Synthetic oligonucleotide; TTA chr11 5250459 5250480 5250464 5250459 -
ctgcgctgaaactgtggcttta

SEQ ID NO: 139898 - DNA, 22 bp, Artificial Sequence
  Synthetic oligonucleotide; CTG chr11 5250456 5250477 5250461 5250456 -
cgctgaaactgtggctttatag

SEQ ID NO: 139899 - DNA, 22 bp, Artificial Sequence
  Synthetic oligonucleotide; CTG chr11 5250451 5250472 5250456 5250451 -
aaactgtggctttatagaaatt

SEQ ID NO: 139900 - DNA, 22 bp, Artificial Sequence
  Synthetic oligonucleotide; CTG chr11 5250445 5250466 5250450 5250445 -
tggctttatagaaattgttttc

SEQ ID NO: 139901 - DNA, 22 bp, Artificial Sequence
  Synthetic oligonucleotide; CTT chr11 5250439 5250460 5250444 5250439 -
tatagaaattgttttcactgca

SEQ ID NO: 139902 - DNA, 22 bp, Artificial Sequence
  Synthetic oligonucleotide; TTT chr11 5250438 5250459 5250443 5250438 -
atagaaattgttttcactgcac

SEQ ID NO: 139903 - DNA, 22 bp, Artificial Sequence
  Synthetic oligonucleotide; TTA chr11 5250437 5250458 5250442 5250437 -
tagaaattgttttcactgcact

SEQ ID NO: 139904 - DNA, 22 bp, Artificial Sequence
  Synthetic oligonucleotide; TTG chr11 5250428 5250449 5250433 5250428 -
ttttcactgcactattgagaaa

SEQ ID NO: 139905 - DNA, 22 bp, Artificial Sequence
  Synthetic oligonucleotide; TTT chr11 5250425 5250446 5250430 5250425 -
tcactgcactattgagaaatta

SEQ ID NO: 139906 - DNA, 22 bp, Artificial Sequence
  Synthetic oligonucleotide; TTT chr11 5250424 5250445 5250429 5250424 -
cactgcactattgagaaattaa

SEQ ID NO: 139907 - DNA, 22 bp, Artificial Sequence
  Synthetic oligonucleotide; TTC chr11 5250423 5250444 5250428 5250423 -
actgcactattgagaaattaag

SEQ ID NO: 139908 - DNA, 22 bp, Artificial Sequence
  Synthetic oligonucleotide; CTG chr11 5250419 5250440 5250424 5250419 -
cactattgagaaattaagagat

SEQ ID NO: 139909 - DNA, 22 bp, Artificial Sequence
  Synthetic oligonucleotide; CTA chr11 5250414 5250435 5250419 5250414 -
ttgagaaattaagagataatgg

SEQ ID NO: 139910 - DNA, 22 bp, Artificial Sequence
  Synthetic oligonucleotide; TTG chr11 5250411 5250432 5250416 5250411 -
agaaattaagagataatggcaa

SEQ ID NO: 139911 - DNA, 22 bp, Artificial Sequence
  Synthetic oligonucleotide; TTA chr11 5250403 5250424 5250408 5250403 -
agagataatggcaaaagtcaca

SEQ ID NO: 139912 - DNA, 22 bp, Artificial Sequence
  Synthetic oligonucleotide; TTC chr11 5250369 5250390 5250374 5250369 -
aaaaagaagtatagcacttttt

SEQ ID NO: 139913 - DNA, 22 bp, Artificial Sequence
  Synthetic oligonucleotide; CTT chr11 5250350 5250371 5250355 5250350 -
tttccttagaaaccactgctaa

SEQ ID NO: 139914 - DNA, 22 bp, Artificial Sequence
  Synthetic oligonucleotide; TTT chr11 5250349 5250370 5250354 5250349 -
ttccttagaaaccactgctaac

SEQ ID NO: 139915 - DNA, 22 bp, Artificial Sequence
  Synthetic oligonucleotide; TTT chr11 5250348 5250369 5250353 5250348 -
tccttagaaaccactgctaact

SEQ ID NO: 139916 - DNA, 22 bp, Artificial Sequence
  Synthetic oligonucleotide; TTT chr11 5250347 5250368 5250352 5250347 -
ccttagaaaccactgctaactg

SEQ ID NO: 139917 - DNA, 22 bp, Artificial Sequence
  Synthetic oligonucleotide; TTC chr11 5250346 5250367 5250351 5250346 -
cttagaaaccactgctaactga

SEQ ID NO: 139918 - DNA, 22 bp, Artificial Sequence
  Synthetic oligonucleotide; CTT chr11 5250343 5250364 5250348 5250343 -
agaaaccactgctaactgaaag

SEQ ID NO: 139919 - DNA, 22 bp, Artificial Sequence
  Synthetic oligonucleotide; TTA chr11 5250342 5250363 5250347 5250342 -
gaaaccactgctaactgaaaga

SEQ ID NO: 139920 - DNA, 22 bp, Artificial Sequence
  Synthetic oligonucleotide; CTG chr11 5250332 5250353 5250337 5250332 -
ctaactgaaagagactaagatt

SEQ ID NO: 139921 - DNA, 22 bp, Artificial Sequence
  Synthetic oligonucleotide; CTA chr11 5250329 5250350 5250334 5250329 -
actgaaagagactaagatttgt

SEQ ID NO: 139922 - DNA, 22 bp, Artificial Sequence
  Synthetic oligonucleotide; CTG chr11 5250325 5250346 5250330 5250325 -
aaagagactaagatttgtcccg

SEQ ID NO: 139923 - DNA, 22 bp, Artificial Sequence
  Synthetic oligonucleotide; CTA chr11 5250315 5250336 5250320 5250315 -
agatttgtcccgtcaaaaatcc

SEQ ID NO: 139924 - DNA, 22 bp, Artificial Sequence
  Synthetic oligonucleotide; TTT chr11 5250309 5250330 5250314 5250309 -
gtcccgtcaaaaatcctggacc

SEQ ID NO: 139925 - DNA, 22 bp, Artificial Sequence
  Synthetic oligonucleotide; TTG chr11 5250308 5250329 5250313 5250308 -
tcccgtcaaaaatcctggacct

SEQ ID NO: 139926 - DNA, 22 bp, Artificial Sequence
  Synthetic oligonucleotide; CTG chr11 5250291 5250312 5250296 5250291 -
gacctatgcctaaaacacattt

SEQ ID NO: 139927 - DNA, 22 bp, Artificial Sequence
  Synthetic oligonucleotide; CTA chr11 5250285 5250306 5250290 5250285 -
tgcctaaaacacatttcacaat

SEQ ID NO: 139928 - DNA, 22 bp, Artificial Sequence
  Synthetic oligonucleotide; CTA chr11 5250279 5250300 5250284 5250279 -
aaacacatttcacaatccctga

SEQ ID NO: 139929 - DNA, 22 bp, Artificial Sequence
  Synthetic oligonucleotide; TTT chr11 5250269 5250290 5250274 5250269 -
cacaatccctgaacttttcaaa

SEQ ID NO: 139930 - DNA, 22 bp, Artificial Sequence
  Synthetic oligonucleotide; TTC chr11 5250268 5250289 5250273 5250268 -
acaatccctgaacttttcaaaa

SEQ ID NO: 139931 - DNA, 22 bp, Artificial Sequence
  Synthetic oligonucleotide; CTG chr11 5250258 5250279 5250263 5250258 -
aacttttcaaaaattggtacat

SEQ ID NO: 139932 - DNA, 22 bp, Artificial Sequence
  Synthetic oligonucleotide; CTT chr11 5250253 5250274 5250258 5250253 -
ttcaaaaattggtacatgcttt

SEQ ID NO: 139933 - DNA, 22 bp, Artificial Sequence
  Synthetic oligonucleotide; TTT chr11 5250252 5250273 5250257 5250252 -
tcaaaaattggtacatgcttta

SEQ ID NO: 139934 - DNA, 22 bp, Artificial Sequence
  Synthetic oligonucleotide; TTT chr11 5250251 5250272 5250256 5250251 -
caaaaattggtacatgctttag

SEQ ID NO: 139935 - DNA, 22 bp, Artificial Sequence
  Synthetic oligonucleotide; TTC chr11 5250250 5250271 5250255 5250250 -
aaaaattggtacatgctttagc

SEQ ID NO: 139936 - DNA, 22 bp, Artificial Sequence
  Synthetic oligonucleotide; TTG chr11 5250242 5250263 5250247 5250242 -
gtacatgctttagctttaaact

SEQ ID NO: 139937 - DNA, 22 bp, Artificial Sequence
  Synthetic oligonucleotide; CTT chr11 5250232 5250253 5250237 5250232 -
tagctttaaactacaggcctca

SEQ ID NO: 139938 - DNA, 22 bp, Artificial Sequence
  Synthetic oligonucleotide; TTT chr11 5250231 5250252 5250236 5250231 -
agctttaaactacaggcctcac

SEQ ID NO: 139939 - DNA, 22 bp, Artificial Sequence
  Synthetic oligonucleotide; TTA chr11 5250230 5250251 5250235 5250230 -
gctttaaactacaggcctcact

SEQ ID NO: 139940 - DNA, 22 bp, Artificial Sequence
  Synthetic oligonucleotide; CTT chr11 5250226 5250247 5250231 5250226 -
taaactacaggcctcactggag

SEQ ID NO: 139941 - DNA, 22 bp, Artificial Sequence
  Synthetic oligonucleotide; TTT chr11 5250225 5250246 5250230 5250225 -
aaactacaggcctcactggagc

SEQ ID NO: 139942 - DNA, 22 bp, Artificial Sequence
  Synthetic oligonucleotide; TTA chr11 5250224 5250245 5250229 5250224 -
aactacaggcctcactggagct

SEQ ID NO: 139943 - DNA, 22 bp, Artificial Sequence
  Synthetic oligonucleotide; CTA chr11 5250219 5250240 5250224 5250219 -
caggcctcactggagctagaga

SEQ ID NO: 139944 - DNA, 22 bp, Artificial Sequence
  Synthetic oligonucleotide; CTC chr11 5250211 5250232 5250216 5250211 -
actggagctagagacaagaagg

SEQ ID NO: 139945 - DNA, 22 bp, Artificial Sequence
  Synthetic oligonucleotide; CTG chr11 5250207 5250228 5250212 5250207 -
gagctagagacaagaaggtaaa

SEQ ID NO: 139946 - DNA, 22 bp, Artificial Sequence
  Synthetic oligonucleotide; CTA chr11 5250201 5250222 5250206 5250201 -
gagacaagaaggtaaaaaacgg

SEQ ID NO: 139947 - DNA, 22 bp, Artificial Sequence
  Synthetic oligonucleotide; CTG chr11 5250176 5250197 5250181 5250176 -
acaaaagaagtcctggtatcct

SEQ ID NO: 139948 - DNA, 22 bp, Artificial Sequence
  Synthetic oligonucleotide; CTG chr11 5250161 5250182 5250166 5250161 -
gtatcctctatgatgggagaag

SEQ ID NO: 139949 - DNA, 22 bp, Artificial Sequence
  Synthetic oligonucleotide; CTC chr11 5250153 5250174 5250158 5250153 -
tatgatgggagaaggaaactag

SEQ ID NO: 139950 - DNA, 22 bp, Artificial Sequence
  Synthetic oligonucleotide; CTA chr11 5250151 5250172 5250156 5250151 -
tgatgggagaaggaaactagct

SEQ ID NO: 139951 - DNA, 22 bp, Artificial Sequence
  Synthetic oligonucleotide; CTA chr11 5250132 5250153 5250137 5250132 -
gctaaagggaagaataaattag

SEQ ID NO: 139952 - DNA, 22 bp, Artificial Sequence
  Synthetic oligonucleotide; CTA chr11 5250128 5250149 5250133 5250128 -
aagggaagaataaattagagaa

SEQ ID NO: 139953 - DNA, 22 bp, Artificial Sequence
  Synthetic oligonucleotide; TTA chr11 5250111 5250132 5250116 5250111 -
gagaaaaactggaatgactgaa

SEQ ID NO: 139954 - DNA, 22 bp, Artificial Sequence
  Synthetic oligonucleotide; CTG chr11 5250100 5250121 5250105 5250100 -
gaatgactgaatcggaacaagg

SEQ ID NO: 139955 - DNA, 22 bp, Artificial Sequence
  Synthetic oligonucleotide; CTG chr11 5250091 5250112 5250096 5250091 -
aatcggaacaaggcaaaggcta

SEQ ID NO: 139956 - DNA, 22 bp, Artificial Sequence
  Synthetic oligonucleotide; CTA chr11 5250069 5250090 5250074 5250069 -
taaaaaaaattagcagtatcct

SEQ ID NO: 139957 - DNA, 22 bp, Artificial Sequence
  Synthetic oligonucleotide; TTA chr11 5250057 5250078 5250062 5250057 -
gcagtatcctcttgggggcccc

SEQ ID NO: 139958 - DNA, 22 bp, Artificial Sequence
  Synthetic oligonucleotide; CTC chr11 5250046 5250067 5250051 5250046 -
ttgggggccccttccccacact

SEQ ID NO: 139959 - DNA, 22 bp, Artificial Sequence
  Synthetic oligonucleotide; CTT chr11 5250044 5250065 5250049 5250044 -
gggggccccttccccacactat

SEQ ID NO: 139960 - DNA, 22 bp, Artificial Sequence
  Synthetic oligonucleotide; TTG chr11 5250043 5250064 5250048 5250043 -
ggggccccttccccacactatc

SEQ ID NO: 139961 - DNA, 22 bp, Artificial Sequence
  Synthetic oligonucleotide; CTT chr11 5250033 5250054 5250038 5250033 -
ccccacactatctcaatgcaaa

SEQ ID NO: 139962 - DNA, 22 bp, Artificial Sequence
  Synthetic oligonucleotide; TTC chr11 5250032 5250053 5250037 5250032 -
cccacactatctcaatgcaaat

SEQ ID NO: 139963 - DNA, 22 bp, Artificial Sequence
  Synthetic oligonucleotide; CTA chr11 5250023 5250044 5250028 5250023 -
tctcaatgcaaatatctgtctg

SEQ ID NO: 139964 - DNA, 22 bp, Artificial Sequence
  Synthetic oligonucleotide; CTC chr11 5250019 5250040 5250024 5250019 -
aatgcaaatatctgtctgaaac

SEQ ID NO: 139965 - DNA, 22 bp, Artificial Sequence
  Synthetic oligonucleotide; CTG chr11 5250005 5250026 5250010 5250005 -
tctgaaacggtccctggctaaa

SEQ ID NO: 139966 - DNA, 22 bp, Artificial Sequence
  Synthetic oligonucleotide; CTG chr11 5250001 5250022 5250006 5250001 -
aaacggtccctggctaaactcc

SEQ ID NO: 139967 - DNA, 22 bp, Artificial Sequence
  Synthetic oligonucleotide; CTG chr11 5249989 5250010 5249994 5249989 -
gctaaactccacccatgggttg

SEQ ID NO: 139968 - DNA, 22 bp, Artificial Sequence
  Synthetic oligonucleotide; CTA chr11 5249985 5250006 5249990 5249985 -
aactccacccatgggttggcca

SEQ ID NO: 139969 - DNA, 22 bp, Artificial Sequence
  Synthetic oligonucleotide; CTC chr11 5249980 5250001 5249985 5249980 -
cacccatgggttggccagcctt

SEQ ID NO: 139970 - DNA, 22 bp, Artificial Sequence
  Synthetic oligonucleotide; TTG chr11 5249967 5249988 5249972 5249967 -
gccagccttgccttgaccaata

SEQ ID NO: 139971 - DNA, 22 bp, Artificial Sequence
  Synthetic oligonucleotide; CTT chr11 5249958 5249979 5249963 5249958 -
gccttgaccaatagccttgaca

SEQ ID NO: 139972 - DNA, 22 bp, Artificial Sequence
  Synthetic oligonucleotide; TTG chr11 5249957 5249978 5249962 5249957 -
ccttgaccaatagccttgacaa

SEQ ID NO: 139973 - DNA, 22 bp, Artificial Sequence
  Synthetic oligonucleotide; CTT chr11 5249953 5249974 5249958 5249953 -
gaccaatagccttgacaaggca

SEQ ID NO: 139974 - DNA, 22 bp, Artificial Sequence
  Synthetic oligonucleotide; TTG chr11 5249952 5249973 5249957 5249952 -
accaatagccttgacaaggcaa

SEQ ID NO: 139975 - DNA, 22 bp, Artificial Sequence
  Synthetic oligonucleotide; CTT chr11 5249940 5249961 5249945 5249940 -
gacaaggcaaacttgaccaata

SEQ ID NO: 139976 - DNA, 22 bp, Artificial Sequence
  Synthetic oligonucleotide; TTG chr11 5249939 5249960 5249944 5249939 -
acaaggcaaacttgaccaatag

SEQ ID NO: 139977 - DNA, 22 bp, Artificial Sequence
  Synthetic oligonucleotide; CTT chr11 5249926 5249947 5249931 5249926 -
gaccaatagtcttagagtatcc

SEQ ID NO: 139978 - DNA, 22 bp, Artificial Sequence
  Synthetic oligonucleotide; TTG chr11 5249925 5249946 5249930 5249925 -
accaatagtcttagagtatcca

SEQ ID NO: 139979 - DNA, 22 bp, Artificial Sequence
  Synthetic oligonucleotide; CTT chr11 5249913 5249934 5249918 5249913 -
agagtatccagtgaggccaggg

SEQ ID NO: 139980 - DNA, 22 bp, Artificial Sequence
  Synthetic oligonucleotide; TTA chr11 5249912 5249933 5249917 5249912 -
gagtatccagtgaggccagggg

SEQ ID NO: 139981 - DNA, 22 bp, Artificial Sequence
  Synthetic oligonucleotide; CTG chr11 5249880 5249901 5249885 5249880 -
gctagggatgaagaataaaagg

SEQ ID NO: 139982 - DNA, 22 bp, Artificial Sequence
  Synthetic oligonucleotide; CTA chr11 5249876 5249897 5249881 5249876 -
gggatgaagaataaaaggaagc

SEQ ID NO: 139983 - DNA, 22 bp, Artificial Sequence
  Synthetic oligonucleotide; CTT chr11 5249848 5249869 5249853 5249848 -
cagcagttccacacactcgctt

SEQ ID NO: 139984 - DNA, 22 bp, Artificial Sequence
  Synthetic oligonucleotide; TTC chr11 5249847 5249868 5249852 5249847 -
agcagttccacacactcgcttc

SEQ ID NO: 139985 - DNA, 22 bp, Artificial Sequence
  Synthetic oligonucleotide; TTC chr11 5249839 5249860 5249844 5249839 -
cacacactcgcttctggaacgt

SEQ ID NO: 139986 - DNA, 22 bp, Artificial Sequence
  Synthetic oligonucleotide; CTC chr11 5249830 5249851 5249835 5249830 -
gcttctggaacgtctgaggtta

SEQ ID NO: 139987 - DNA, 22 bp, Artificial Sequence
  Synthetic oligonucleotide; CTT chr11 5249826 5249847 5249831 5249826 -
ctggaacgtctgaggttatcaa

SEQ ID NO: 139988 - DNA, 22 bp, Artificial Sequence
  Synthetic oligonucleotide; TTC chr11 5249825 5249846 5249830 5249825 -
tggaacgtctgaggttatcaat

SEQ ID NO: 139989 - DNA, 22 bp, Artificial Sequence
  Synthetic oligonucleotide; CTG chr11 5249823 5249844 5249828 5249823 -
gaacgtctgaggttatcaataa

SEQ ID NO: 139990 - DNA, 22 bp, Artificial Sequence
  Synthetic oligonucleotide; CTG chr11 5249814 5249835 5249819 5249814 -
aggttatcaataagctcctagt

SEQ ID NO: 139991 - DNA, 22 bp, Artificial Sequence
  Synthetic oligonucleotide; TTA chr11 5249808 5249829 5249813 5249808 -
tcaataagctcctagtccagac

SEQ ID NO: 139992 - DNA, 22 bp, Artificial Sequence
  Synthetic oligonucleotide; CTC chr11 5249797 5249818 5249802 5249797 -
ctagtccagacgccatgggtca

SEQ ID NO: 139993 - DNA, 22 bp, Artificial Sequence
  Synthetic oligonucleotide; CTA chr11 5249794 5249815 5249799 5249794 -
gtccagacgccatgggtcattt

SEQ ID NO: 139994 - DNA, 22 bp, Artificial Sequence
  Synthetic oligonucleotide; TTT chr11 5249772 5249793 5249777 5249772 -
cacagaggaggacaaggctact

SEQ ID NO: 139995 - DNA, 22 bp, Artificial Sequence
  Synthetic oligonucleotide; TTC chr11 5249771 5249792 5249776 5249771 -
acagaggaggacaaggctacta

SEQ ID NO: 139996 - DNA, 22 bp, Artificial Sequence
  Synthetic oligonucleotide; CTA chr11 5249752 5249773 5249757 5249752 -
ctatcacaagcctgtggggcaa

SEQ ID NO: 139997 - DNA, 22 bp, Artificial Sequence
  Synthetic oligonucleotide; CTA chr11 5249749 5249770 5249754 5249749 -
tcacaagcctgtggggcaaggt

SEQ ID NO: 139998 - DNA, 22 bp, Artificial Sequence
  Synthetic oligonucleotide; CTG chr11 5249738 5249759 5249743 5249738 -
tggggcaaggtgaatgtggaag

SEQ ID NO: 139999 - DNA, 22 bp, Artificial Sequence
  Synthetic oligonucleotide; CTG chr11 5249710 5249731 5249715 5249710 -
gaggagaaaccctgggaaggta

SEQ ID NO: 140000 - DNA, 22 bp, Artificial Sequence
  Synthetic oligonucleotide; CTG chr11 5249696 5249717 5249701 5249696 -
ggaaggtaggctctggtgacca

SEQ ID NO: 140001 - DNA, 22 bp, Artificial Sequence
  Synthetic oligonucleotide; CTC chr11 5249683 5249704 5249688 5249683 -
tggtgaccaggacaagggaggg

SEQ ID NO: 140002 - DNA, 22 bp, Artificial Sequence
  Synthetic oligonucleotide; CTG chr11 5249681 5249702 5249686 5249681 -
gtgaccaggacaagggagggaa

SEQ ID NO: 140003 - DNA, 22 bp, Artificial Sequence
  Synthetic oligonucleotide; CTG chr11 5249647 5249668 5249652 5249647 -
tgcctggcaaaagtccaggtcg

SEQ ID NO: 140004 - DNA, 22 bp, Artificial Sequence
  Synthetic oligonucleotide; CTG chr11 5249641 5249662 5249646 5249641 -
gcaaaagtccaggtcgcttctc

SEQ ID NO: 140005 - DNA, 22 bp, Artificial Sequence
  Synthetic oligonucleotide; CTT chr11 5249622 5249643 5249627 5249622 -
ctcaggatttgtggcaccttct

SEQ ID NO: 140006 - DNA, 22 bp, Artificial Sequence
  Synthetic oligonucleotide; TTC chr11 5249621 5249642 5249626 5249621 -
tcaggatttgtggcaccttctg

SEQ ID NO: 140007 - DNA, 22 bp, Artificial Sequence
  Synthetic oligonucleotide; CTC chr11 5249619 5249640 5249624 5249619 -
aggatttgtggcaccttctgac

SEQ ID NO: 140008 - DNA, 22 bp, Artificial Sequence
  Synthetic oligonucleotide; TTT chr11 5249612 5249633 5249617 5249612 -
gtggcaccttctgactgtcaaa

SEQ ID NO: 140009 - DNA, 22 bp, Artificial Sequence
  Synthetic oligonucleotide; TTG chr11 5249611 5249632 5249616 5249611 -
tggcaccttctgactgtcaaac

SEQ ID NO: 140010 - DNA, 22 bp, Artificial Sequence
  Synthetic oligonucleotide; CTT chr11 5249602 5249623 5249607 5249602 -
ctgactgtcaaactgttcttgt

SEQ ID NO: 140011 - DNA, 22 bp, Artificial Sequence
  Synthetic oligonucleotide; TTC chr11 5249601 5249622 5249606 5249601 -
tgactgtcaaactgttcttgtc

SEQ ID NO: 140012 - DNA, 22 bp, Artificial Sequence
  Synthetic oligonucleotide; CTG chr11 5249599 5249620 5249604 5249599 -
actgtcaaactgttcttgtcaa

SEQ ID NO: 140013 - DNA, 22 bp, Artificial Sequence
  Synthetic oligonucleotide; CTG chr11 5249595 5249616 5249600 5249595 -
tcaaactgttcttgtcaatctc

SEQ ID NO: 140014 - DNA, 22 bp, Artificial Sequence
  Synthetic oligonucleotide; CTG chr11 5249587 5249608 5249592 5249587 -
ttcttgtcaatctcacaggctc

SEQ ID NO: 140015 - DNA, 22 bp, Artificial Sequence
  Synthetic oligonucleotide; TTC chr11 5249584 5249605 5249589 5249584 -
ttgtcaatctcacaggctcctg

SEQ ID NO: 140016 - DNA, 22 bp, Artificial Sequence
  Synthetic oligonucleotide; CTT chr11 5249582 5249603 5249587 5249582 -
gtcaatctcacaggctcctggt

SEQ ID NO: 140017 - DNA, 22 bp, Artificial Sequence
  Synthetic oligonucleotide; TTG chr11 5249581 5249602 5249586 5249581 -
tcaatctcacaggctcctggtt

SEQ ID NO: 140018 - DNA, 22 bp, Artificial Sequence
  Synthetic oligonucleotide; CTC chr11 5249573 5249594 5249578 5249573 -
acaggctcctggttgtctaccc

SEQ ID NO: 140019 - DNA, 22 bp, Artificial Sequence
  Synthetic oligonucleotide; CTC chr11 5249565 5249586 5249570 5249565 -
ctggttgtctacccatggaccc

SEQ ID NO: 140020 - DNA, 22 bp, Artificial Sequence
  Synthetic oligonucleotide; CTG chr11 5249562 5249583 5249567 5249562 -
gttgtctacccatggacccaga

SEQ ID NO: 140021 - DNA, 22 bp, Artificial Sequence
  Synthetic oligonucleotide; TTG chr11 5249558 5249579 5249563 5249558 -
tctacccatggacccagaggtt

SEQ ID NO: 140022 - DNA, 22 bp, Artificial Sequence
  Synthetic oligonucleotide; CTA chr11 5249554 5249575 5249559 5249554 -
cccatggacccagaggttcttt

SEQ ID NO: 140023 - DNA, 22 bp, Artificial Sequence
  Synthetic oligonucleotide; TTC chr11 5249535 5249556 5249540 5249535 -
tttgacagctttggcaacctgt

SEQ ID NO: 140024 - DNA, 22 bp, Artificial Sequence
  Synthetic oligonucleotide; CTT chr11 5249533 5249554 5249538 5249533 -
tgacagctttggcaacctgtcc

SEQ ID NO: 140025 - DNA, 22 bp, Artificial Sequence
  Synthetic oligonucleotide; TTT chr11 5249532 5249553 5249537 5249532 -
gacagctttggcaacctgtcct

SEQ ID NO: 140026 - DNA, 22 bp, Artificial Sequence
  Synthetic oligonucleotide; TTG chr11 5249531 5249552 5249536 5249531 -
acagctttggcaacctgtcctc

SEQ ID NO: 140027 - DNA, 22 bp, Artificial Sequence
  Synthetic oligonucleotide; CTT chr11 5249524 5249545 5249529 5249524 -
tggcaacctgtcctctgcctct

SEQ ID NO: 140028 - DNA, 22 bp, Artificial Sequence
  Synthetic oligonucleotide; TTT chr11 5249523 5249544 5249528 5249523 -
ggcaacctgtcctctgcctctg

SEQ ID NO: 140029 - DNA, 22 bp, Artificial Sequence
  Synthetic oligonucleotide; TTG chr11 5249522 5249543 5249527 5249522 -
gcaacctgtcctctgcctctgc

SEQ ID NO: 140030 - DNA, 22 bp, Artificial Sequence
  Synthetic oligonucleotide; CTG chr11 5249514 5249535 5249519 5249514 -
tcctctgcctctgccatcatgg

SEQ ID NO: 140031 - DNA, 22 bp, Artificial Sequence
  Synthetic oligonucleotide; CTC chr11 5249509 5249530 5249514 5249509 -
tgcctctgccatcatgggcaac

SEQ ID NO: 140032 - DNA, 22 bp, Artificial Sequence
  Synthetic oligonucleotide; CTG chr11 5249507 5249528 5249512 5249507 -
cctctgccatcatgggcaaccc

SEQ ID NO: 140033 - DNA, 22 bp, Artificial Sequence
  Synthetic oligonucleotide; CTC chr11 5249503 5249524 5249508 5249503 -
tgccatcatgggcaaccccaaa

SEQ ID NO: 140034 - DNA, 22 bp, Artificial Sequence
  Synthetic oligonucleotide; CTG chr11 5249501 5249522 5249506 5249501 -
ccatcatgggcaaccccaaagt

SEQ ID NO: 140035 - DNA, 22 bp, Artificial Sequence
  Synthetic oligonucleotide; CTG chr11 5249454 5249475 5249459 5249454 -
acttccttgggagatgccacaa

SEQ ID NO: 140036 - DNA, 22 bp, Artificial Sequence
  Synthetic oligonucleotide; CTT chr11 5249450 5249471 5249455 5249450 -
ccttgggagatgccacaaagca

SEQ ID NO: 140037 - DNA, 22 bp, Artificial Sequence
  Synthetic oligonucleotide; TTC chr11 5249449 5249470 5249454 5249449 -
cttgggagatgccacaaagcac

SEQ ID NO: 140038 - DNA, 22 bp, Artificial Sequence
  Synthetic oligonucleotide; CTT chr11 5249446 5249467 5249451 5249446 -
gggagatgccacaaagcacctg

SEQ ID NO: 140039 - DNA, 22 bp, Artificial Sequence
  Synthetic oligonucleotide; TTG chr11 5249445 5249466 5249450 5249445 -
ggagatgccacaaagcacctgg

SEQ ID NO: 140040 - DNA, 22 bp, Artificial Sequence
  Synthetic oligonucleotide; CTG chr11 5249424 5249445 5249429 5249424 -
gatgatctcaagggcacctttg

SEQ ID NO: 140041 - DNA, 22 bp, Artificial Sequence
  Synthetic oligonucleotide; CTC chr11 5249415 5249436 5249420 5249415 -
aagggcacctttgcccagctga

SEQ ID NO: 140042 - DNA, 22 bp, Artificial Sequence
  Synthetic oligonucleotide; CTT chr11 5249404 5249425 5249409 5249404 -
tgcccagctgagtgaactgcac

SEQ ID NO: 140043 - DNA, 22 bp, Artificial Sequence
  Synthetic oligonucleotide; TTT chr11 5249403 5249424 5249408 5249403 -
gcccagctgagtgaactgcact

SEQ ID NO: 140044 - DNA, 22 bp, Artificial Sequence
  Synthetic oligonucleotide; TTG chr11 5249402 5249423 5249407 5249402 -
cccagctgagtgaactgcactg

SEQ ID NO: 140045 - DNA, 22 bp, Artificial Sequence
  Synthetic oligonucleotide; CTG chr11 5249394 5249415 5249399 5249394 -
agtgaactgcactgtgacaagc

SEQ ID NO: 140046 - DNA, 22 bp, Artificial Sequence
  Synthetic oligonucleotide; CTG chr11 5249385 5249406 5249390 5249385 -
cactgtgacaagctgcatgtgg

SEQ ID NO: 140047 - DNA, 22 bp, Artificial Sequence
  Synthetic oligonucleotide; CTG chr11 5249380 5249401 5249385 5249380 -
tgacaagctgcatgtggatcct

SEQ ID NO: 140048 - DNA, 22 bp, Artificial Sequence
  Synthetic oligonucleotide; CTG chr11 5249370 5249391 5249375 5249370 -
catgtggatcctgagaacttca

SEQ ID NO: 140049 - DNA, 22 bp, Artificial Sequence
  Synthetic oligonucleotide; CTG chr11 5249357 5249378 5249362 5249357 -
agaacttcaaggtgagtccagg

SEQ ID NO: 140050 - DNA, 22 bp, Artificial Sequence
  Synthetic oligonucleotide; CTT chr11 5249350 5249371 5249355 5249350 -
caaggtgagtccaggagatgtt

SEQ ID NO: 140051 - DNA, 22 bp, Artificial Sequence
  Synthetic oligonucleotide; TTC chr11 5249349 5249370 5249354 5249349 -
aaggtgagtccaggagatgttt

SEQ ID NO: 140052 - DNA, 22 bp, Artificial Sequence
  Synthetic oligonucleotide; TTT chr11 5249327 5249348 5249332 5249327 -
cagccctgttgcctttagtctc

SEQ ID NO: 140053 - DNA, 22 bp, Artificial Sequence
  Synthetic oligonucleotide; TTC chr11 5249326 5249347 5249331 5249326 -
agccctgttgcctttagtctcg

SEQ ID NO: 140054 - DNA, 22 bp, Artificial Sequence
  Synthetic oligonucleotide; CTG chr11 5249319 5249340 5249324 5249319 -
ttgcctttagtctcgaggcaac

SEQ ID NO: 140055 - DNA, 22 bp, Artificial Sequence
  Synthetic oligonucleotide; TTG chr11 5249316 5249337 5249321 5249316 -
cctttagtctcgaggcaactta

SEQ ID NO: 140056 - DNA, 22 bp, Artificial Sequence
  Synthetic oligonucleotide; CTT chr11 5249312 5249333 5249317 5249312 -
tagtctcgaggcaacttagaca

SEQ ID NO: 140057 - DNA, 22 bp, Artificial Sequence
  Synthetic oligonucleotide; TTT chr11 5249311 5249332 5249316 5249311 -
agtctcgaggcaacttagacaa

SEQ ID NO: 140058 - DNA, 22 bp, Artificial Sequence
  Synthetic oligonucleotide; TTA chr11 5249310 5249331 5249315 5249310 -
gtctcgaggcaacttagacaac

SEQ ID NO: 140059 - DNA, 22 bp, Artificial Sequence
  Synthetic oligonucleotide; CTC chr11 5249305 5249326 5249310 5249305 -
gaggcaacttagacaacggagt

SEQ ID NO: 140060 - DNA, 22 bp, Artificial Sequence
  Synthetic oligonucleotide; CTT chr11 5249295 5249316 5249300 5249295 -
agacaacggagtattgatctga

SEQ ID NO: 140061 - DNA, 22 bp, Artificial Sequence
  Synthetic oligonucleotide; TTA chr11 5249294 5249315 5249299 5249294 -
gacaacggagtattgatctgag

SEQ ID NO: 140062 - DNA, 22 bp, Artificial Sequence
  Synthetic oligonucleotide; TTG chr11 5249279 5249300 5249284 5249279 -
atctgagcacagcagggtgtga

SEQ ID NO: 140063 - DNA, 22 bp, Artificial Sequence
  Synthetic oligonucleotide; CTG chr11 5249274 5249295 5249279 5249274 -
agcacagcagggtgtgagctgt

SEQ ID NO: 140064 - DNA, 22 bp, Artificial Sequence
  Synthetic oligonucleotide; CTG chr11 5249253 5249274 5249258 5249253 -
tttgaagatactggggttgggg

SEQ ID NO: 140065 - DNA, 22 bp, Artificial Sequence
  Synthetic oligonucleotide; TTT chr11 5249250 5249271 5249255 5249250 -
gaagatactggggttgggggtg

SEQ ID NO: 140066 - DNA, 22 bp, Artificial Sequence
  Synthetic oligonucleotide; TTG chr11 5249249 5249270 5249254 5249249 -
aagatactggggttgggggtga

SEQ ID NO: 140067 - DNA, 22 bp, Artificial Sequence
  Synthetic oligonucleotide; CTG chr11 5249240 5249261 5249245 5249240 -
gggttgggggtgaagaaactgc

SEQ ID NO: 140068 - DNA, 22 bp, Artificial Sequence
  Synthetic oligonucleotide; TTG chr11 5249234 5249255 5249239 5249234 -
ggggtgaagaaactgcagagga

SEQ ID NO: 140069 - DNA, 22 bp, Artificial Sequence
  Synthetic oligonucleotide; CTG chr11 5249219 5249240 5249224 5249219 -
cagaggactaactgggctgaga

SEQ ID NO: 140070 - DNA, 22 bp, Artificial Sequence
  Synthetic oligonucleotide; CTA chr11 5249209 5249230 5249214 5249209 -
actgggctgagacccagtggta

SEQ ID NO: 140071 - DNA, 22 bp, Artificial Sequence
  Synthetic oligonucleotide; CTG chr11 5249205 5249226 5249210 5249205 -
ggctgagacccagtggtaatgt

SEQ ID NO: 140072 - DNA, 22 bp, Artificial Sequence
  Synthetic oligonucleotide; CTG chr11 5249200 5249221 5249205 5249200 -
agacccagtggtaatgttttag

SEQ ID NO: 140073 - DNA, 22 bp, Artificial Sequence
  Synthetic oligonucleotide; TTT chr11 5249181 5249202 5249186 5249181 -
tagggcctaaggagtgcctcta

SEQ ID NO: 140074 - DNA, 22 bp, Artificial Sequence
  Synthetic oligonucleotide; TTT chr11 5249180 5249201 5249185 5249180 -
agggcctaaggagtgcctctaa

SEQ ID NO: 140075 - DNA, 22 bp, Artificial Sequence
  Synthetic oligonucleotide; TTA chr11 5249179 5249200 5249184 5249179 -
gggcctaaggagtgcctctaaa

SEQ ID NO: 140076 - DNA, 22 bp, Artificial Sequence
  Synthetic oligonucleotide; CTA chr11 5249172 5249193 5249177 5249172 -
aggagtgcctctaaaaatctag

SEQ ID NO: 140077 - DNA, 22 bp, Artificial Sequence
  Synthetic oligonucleotide; CTC chr11 5249161 5249182 5249166 5249161 -
taaaaatctagatggacaattt

SEQ ID NO: 140078 - DNA, 22 bp, Artificial Sequence
  Synthetic oligonucleotide; CTA chr11 5249159 5249180 5249164 5249159 -
aaaatctagatggacaattttg

SEQ ID NO: 140079 - DNA, 22 bp, Artificial Sequence
  Synthetic oligonucleotide; CTA chr11 5249151 5249172 5249156 5249151 -
gatggacaattttgactttgag

SEQ ID NO: 140080 - DNA, 22 bp, Artificial Sequence
  Synthetic oligonucleotide; TTT chr11 5249139 5249160 5249144 5249139 -
tgactttgagaaaagagaggtg

SEQ ID NO: 140081 - DNA, 22 bp, Artificial Sequence
  Synthetic oligonucleotide; TTT chr11 5249138 5249159 5249143 5249138 -
gactttgagaaaagagaggtgg

SEQ ID NO: 140082 - DNA, 22 bp, Artificial Sequence
  Synthetic oligonucleotide; TTG chr11 5249137 5249158 5249142 5249137 -
actttgagaaaagagaggtgga

SEQ ID NO: 140083 - DNA, 22 bp, Artificial Sequence
  Synthetic oligonucleotide; CTT chr11 5249133 5249154 5249138 5249133 -
tgagaaaagagaggtggaaatg

SEQ ID NO: 140084 - DNA, 22 bp, Artificial Sequence
  Synthetic oligonucleotide; TTT chr11 5249132 5249153 5249137 5249132 -
gagaaaagagaggtggaaatga

SEQ ID NO: 140085 - DNA, 22 bp, Artificial Sequence
  Synthetic oligonucleotide; TTG chr11 5249131 5249152 5249136 5249131 -
agaaaagagaggtggaaatgag

SEQ ID NO: 140086 - DNA, 22 bp, Artificial Sequence
  Synthetic oligonucleotide; CTT chr11 5249098 5249119 5249103 5249098 -
ttctttattagattccagtaga

SEQ ID NO: 140087 - DNA, 22 bp, Artificial Sequence
  Synthetic oligonucleotide; TTT chr11 5249097 5249118 5249102 5249097 -
tctttattagattccagtagaa

SEQ ID NO: 140088 - DNA, 22 bp, Artificial Sequence
  Synthetic oligonucleotide; TTT chr11 5249096 5249117 5249101 5249096 -
ctttattagattccagtagaaa

SEQ ID NO: 140089 - DNA, 22 bp, Artificial Sequence
  Synthetic oligonucleotide; TTC chr11 5249095 5249116 5249100 5249095 -
tttattagattccagtagaaag

SEQ ID NO: 140090 - DNA, 22 bp, Artificial Sequence
  Synthetic oligonucleotide; CTT chr11 5249093 5249114 5249098 5249093 -
tattagattccagtagaaagaa

SEQ ID NO: 140091 - DNA, 22 bp, Artificial Sequence
  Synthetic oligonucleotide; TTT chr11 5249092 5249113 5249097 5249092 -
attagattccagtagaaagaac

SEQ ID NO: 140092 - DNA, 22 bp, Artificial Sequence
  Synthetic oligonucleotide; TTA chr11 5249091 5249112 5249096 5249091 -
ttagattccagtagaaagaact

SEQ ID NO: 140093 - DNA, 22 bp, Artificial Sequence
  Synthetic oligonucleotide; TTA chr11 5249088 5249109 5249093 5249088 -
gattccagtagaaagaactttc

SEQ ID NO: 140094 - DNA, 22 bp, Artificial Sequence
  Synthetic oligonucleotide; TTC chr11 5249083 5249104 5249088 5249083 -
cagtagaaagaactttcatctt

SEQ ID NO: 140095 - DNA, 22 bp, Artificial Sequence
  Synthetic oligonucleotide; CTT chr11 5249068 5249089 5249073 5249068 -
tcatctttccctcatttttgtt

SEQ ID NO: 140096 - DNA, 22 bp, Artificial Sequence
  Synthetic oligonucleotide; TTT chr11 5249067 5249088 5249072 5249067 -
catctttccctcatttttgttg

SEQ ID NO: 140097 - DNA, 22 bp, Artificial Sequence
  Synthetic oligonucleotide; TTC chr11 5249066 5249087 5249071 5249066 -
atctttccctcatttttgttgt

SEQ ID NO: 140098 - DNA, 22 bp, Artificial Sequence
  Synthetic oligonucleotide; CTT chr11 5249061 5249082 5249066 5249061 -
tccctcatttttgttgttttaa

SEQ ID NO: 140099 - DNA, 22 bp, Artificial Sequence
  Synthetic oligonucleotide; TTT chr11 5249060 5249081 5249065 5249060 -
ccctcatttttgttgttttaaa

SEQ ID NO: 140100 - DNA, 22 bp, Artificial Sequence
  Synthetic oligonucleotide; TTC chr11 5249059 5249080 5249064 5249059 -
cctcatttttgttgttttaaaa

SEQ ID NO: 140101 - DNA, 22 bp, Artificial Sequence
  Synthetic oligonucleotide; CTC chr11 5249055 5249076 5249060 5249055 -
atttttgttgttttaaaacatc

SEQ ID NO: 140102 - DNA, 22 bp, Artificial Sequence
  Synthetic oligonucleotide; TTT chr11 5249051 5249072 5249056 5249051 -
ttgttgttttaaaacatctatc

SEQ ID NO: 140103 - DNA, 22 bp, Artificial Sequence
  Synthetic oligonucleotide; TTT chr11 5249050 5249071 5249055 5249050 -
tgttgttttaaaacatctatct

SEQ ID NO: 140104 - DNA, 22 bp, Artificial Sequence
  Synthetic oligonucleotide; TTT chr11 5249049 5249070 5249054 5249049 -
gttgttttaaaacatctatctg

SEQ ID NO: 140105 - DNA, 22 bp, Artificial Sequence
  Synthetic oligonucleotide; TTG chr11 5249048 5249069 5249053 5249048 -
ttgttttaaaacatctatctgg

SEQ ID NO: 140106 - DNA, 22 bp, Artificial Sequence
  Synthetic oligonucleotide; TTG chr11 5249045 5249066 5249050 5249045 -
ttttaaaacatctatctggagg

SEQ ID NO: 140107 - DNA, 22 bp, Artificial Sequence
  Synthetic oligonucleotide; TTT chr11 5249042 5249063 5249047 5249042 -
taaaacatctatctggaggcag

SEQ ID NO: 140108 - DNA, 22 bp, Artificial Sequence
  Synthetic oligonucleotide; TTT chr11 5249041 5249062 5249046 5249041 -
aaaacatctatctggaggcagg

SEQ ID NO: 140109 - DNA, 22 bp, Artificial Sequence
  Synthetic oligonucleotide; TTA chr11 5249040 5249061 5249045 5249040 -
aaacatctatctggaggcagga

SEQ ID NO: 140110 - DNA, 22 bp, Artificial Sequence
  Synthetic oligonucleotide; CTA chr11 5249031 5249052 5249036 5249031 -
tctggaggcaggacaagtatgg

SEQ ID NO: 140111 - DNA, 22 bp, Artificial Sequence
  Synthetic oligonucleotide; CTG chr11 5249027 5249048 5249032 5249027 -
gaggcaggacaagtatggtcgt

SEQ ID NO: 140112 - DNA, 22 bp, Artificial Sequence
  Synthetic oligonucleotide; TTA chr11 5249003 5249024 5249008 5249003 -
aaaagatgcaggcagaaggcat

SEQ ID NO: 140113 - DNA, 22 bp, Artificial Sequence
  Synthetic oligonucleotide; TTG chr11 5248975 5248996 5248980 5248975 -
gctcagtcaaagtggggaactt

SEQ ID NO: 140114 - DNA, 22 bp, Artificial Sequence
  Synthetic oligonucleotide; CTC chr11 5248971 5248992 5248976 5248971 -
agtcaaagtggggaactttggt

SEQ ID NO: 140115 - DNA, 22 bp, Artificial Sequence
  Synthetic oligonucleotide; CTT chr11 5248953 5248974 5248958 5248953 -
tggtggccaaacatacattgct

SEQ ID NO: 140116 - DNA, 22 bp, Artificial Sequence
  Synthetic oligonucleotide; TTT chr11 5248952 5248973 5248957 5248952 -
ggtggccaaacatacattgcta

SEQ ID NO: 140117 - DNA, 22 bp, Artificial Sequence
  Synthetic oligonucleotide; TTG chr11 5248951 5248972 5248956 5248951 -
gtggccaaacatacattgctaa

SEQ ID NO: 140118 - DNA, 22 bp, Artificial Sequence
  Synthetic oligonucleotide; TTG chr11 5248933 5248954 5248938 5248933 -
ctaaggctattcctatatcagc

SEQ ID NO: 140119 - DNA, 22 bp, Artificial Sequence
  Synthetic oligonucleotide; CTA chr11 5248930 5248951 5248935 5248930 -
aggctattcctatatcagctgg

SEQ ID NO: 140120 - DNA, 22 bp, Artificial Sequence
  Synthetic oligonucleotide; CTA chr11 5248924 5248945 5248929 5248924 -
ttcctatatcagctggacacat

SEQ ID NO: 140121 - DNA, 22 bp, Artificial Sequence
  Synthetic oligonucleotide; TTC chr11 5248921 5248942 5248926 5248921 -
ctatatcagctggacacatata

SEQ ID NO: 140122 - DNA, 22 bp, Artificial Sequence
  Synthetic oligonucleotide; CTA chr11 5248918 5248939 5248923 5248918 -
tatcagctggacacatataaaa

SEQ ID NO: 140123 - DNA, 22 bp, Artificial Sequence
  Synthetic oligonucleotide; CTG chr11 5248909 5248930 5248914 5248909 -
gacacatataaaatgctgctaa

SEQ ID NO: 140124 - DNA, 22 bp, Artificial Sequence
  Synthetic oligonucleotide; CTG chr11 5248891 5248912 5248896 5248891 -
ctaatgcttcattacaaactta

SEQ ID NO: 140125 - DNA, 22 bp, Artificial Sequence
  Synthetic oligonucleotide; CTA chr11 5248888 5248909 5248893 5248888 -
atgcttcattacaaacttatat

SEQ ID NO: 140126 - DNA, 22 bp, Artificial Sequence
  Synthetic oligonucleotide; CTT chr11 5248882 5248903 5248887 5248882 -
cattacaaacttatatccttta

SEQ ID NO: 140127 - DNA, 22 bp, Artificial Sequence
  Synthetic oligonucleotide; TTC chr11 5248881 5248902 5248886 5248881 -
attacaaacttatatcctttaa

SEQ ID NO: 140128 - DNA, 22 bp, Artificial Sequence
  Synthetic oligonucleotide; TTA chr11 5248877 5248898 5248882 5248877 -
caaacttatatcctttaattcc

SEQ ID NO: 140129 - DNA, 22 bp, Artificial Sequence
  Synthetic oligonucleotide; CTT chr11 5248870 5248891 5248875 5248870 -
atatcctttaattccagatggg

SEQ ID NO: 140130 - DNA, 22 bp, Artificial Sequence
  Synthetic oligonucleotide; TTA chr11 5248869 5248890 5248874 5248869 -
tatcctttaattccagatgggg

SEQ ID NO: 140131 - DNA, 22 bp, Artificial Sequence
  Synthetic oligonucleotide; CTT chr11 5248862 5248883 5248867 5248862 -
taattccagatgggggcaaagt

SEQ ID NO: 140132 - DNA, 22 bp, Artificial Sequence
  Synthetic oligonucleotide; TTT chr11 5248861 5248882 5248866 5248861 -
aattccagatgggggcaaagta

SEQ ID NO: 140133 - DNA, 22 bp, Artificial Sequence
  Synthetic oligonucleotide; TTA chr11 5248860 5248881 5248865 5248860 -
attccagatgggggcaaagtat

SEQ ID NO: 140134 - DNA, 22 bp, Artificial Sequence
  Synthetic oligonucleotide; TTC chr11 5248856 5248877 5248861 5248856 -
cagatgggggcaaagtatgtcc

SEQ ID NO: 140135 - DNA, 22 bp, Artificial Sequence
  Synthetic oligonucleotide; TTG chr11 5248816 5248837 5248821 5248816 -
aaacatttgggctggagtagat

SEQ ID NO: 140136 - DNA, 22 bp, Artificial Sequence
  Synthetic oligonucleotide; TTT chr11 5248808 5248829 5248813 5248808 -
gggctggagtagattttgaaag

SEQ ID NO: 140137 - DNA, 22 bp, Artificial Sequence
  Synthetic oligonucleotide; TTG chr11 5248807 5248828 5248812 5248807 -
ggctggagtagattttgaaagt

SEQ ID NO: 140138 - DNA, 22 bp, Artificial Sequence
  Synthetic oligonucleotide; CTG chr11 5248802 5248823 5248807 5248802 -
gagtagattttgaaagtcagct

SEQ ID NO: 140139 - DNA, 22 bp, Artificial Sequence
  Synthetic oligonucleotide; TTT chr11 5248792 5248813 5248797 5248792 -
tgaaagtcagctctgtgtgtgt

SEQ ID NO: 140140 - DNA, 22 bp, Artificial Sequence
  Synthetic oligonucleotide; TTT chr11 5248791 5248812 5248796 5248791 -
gaaagtcagctctgtgtgtgtg

SEQ ID NO: 140141 - DNA, 22 bp, Artificial Sequence
  Synthetic oligonucleotide; TTG chr11 5248790 5248811 5248795 5248790 -
aaagtcagctctgtgtgtgtgt

SEQ ID NO: 140142 - DNA, 22 bp, Artificial Sequence
  Synthetic oligonucleotide; CTC chr11 5248779 5248800 5248784 5248779 -
tgtgtgtgtgtgtgtgtgtgcg

SEQ ID NO: 140143 - DNA, 22 bp, Artificial Sequence
  Synthetic oligonucleotide; CTG chr11 5248777 5248798 5248782 5248777 -
tgtgtgtgtgtgtgtgtgcgcg

SEQ ID NO: 140144 - DNA, 22 bp, Artificial Sequence
  Synthetic oligonucleotide; TTT chr11 5248722 5248743 5248727 5248722 -
cttttaacgtcttcagcctaca

SEQ ID NO: 140145 - DNA, 22 bp, Artificial Sequence
  Synthetic oligonucleotide; TTC chr11 5248721 5248742 5248726 5248721 -
ttttaacgtcttcagcctacaa

SEQ ID NO: 140146 - DNA, 22 bp, Artificial Sequence
  Synthetic oligonucleotide; CTT chr11 5248719 5248740 5248724 5248719 -
ttaacgtcttcagcctacaaca

SEQ ID NO: 140147 - DNA, 22 bp, Artificial Sequence
  Synthetic oligonucleotide; TTT chr11 5248718 5248739 5248723 5248718 -
taacgtcttcagcctacaacat

SEQ ID NO: 140148 - DNA, 22 bp, Artificial Sequence
  Synthetic oligonucleotide; TTT chr11 5248717 5248738 5248722 5248717 -
aacgtcttcagcctacaacata

SEQ ID NO: 140149 - DNA, 22 bp, Artificial Sequence
  Synthetic oligonucleotide; TTA chr11 5248716 5248737 5248721 5248716 -
acgtcttcagcctacaacatac

SEQ ID NO: 140150 - DNA, 22 bp, Artificial Sequence
  Synthetic oligonucleotide; CTT chr11 5248709 5248730 5248714 5248709 -
cagcctacaacatacagggttc

SEQ ID NO: 140151 - DNA, 22 bp, Artificial Sequence
  Synthetic oligonucleotide; TTC chr11 5248708 5248729 5248713 5248708 -
agcctacaacatacagggttca

SEQ ID NO: 140152 - DNA, 22 bp, Artificial Sequence
  Synthetic oligonucleotide; CTA chr11 5248702 5248723 5248707 5248702 -
caacatacagggttcatggtgg

SEQ ID NO: 140153 - DNA, 22 bp, Artificial Sequence
  Synthetic oligonucleotide; TTC chr11 5248687 5248708 5248692 5248687 -
atggtggcaagaagatagcaag

SEQ ID NO: 140154 - DNA, 22 bp, Artificial Sequence
  Synthetic oligonucleotide; TTT chr11 5248661 5248682 5248666 5248661 -
aaattatggccagtgactagtg

SEQ ID NO: 140155 - DNA, 22 bp, Artificial Sequence
  Synthetic oligonucleotide; TTA chr11 5248660 5248681 5248665 5248660 -
aattatggccagtgactagtgc

SEQ ID NO: 140156 - DNA, 22 bp, Artificial Sequence
  Synthetic oligonucleotide; TTA chr11 5248655 5248676 5248660 5248655 -
tggccagtgactagtgcttgaa

SEQ ID NO: 140157 - DNA, 22 bp, Artificial Sequence
  Synthetic oligonucleotide; CTA chr11 5248642 5248663 5248647 5248642 -
gtgcttgaaggggaacaactac

SEQ ID NO: 140158 - DNA, 22 bp, Artificial Sequence
  Synthetic oligonucleotide; CTT chr11 5248636 5248657 5248641 5248636 -
gaaggggaacaactacctgcat

SEQ ID NO: 140159 - DNA, 22 bp, Artificial Sequence
  Synthetic oligonucleotide; TTG chr11 5248635 5248656 5248640 5248635 -
aaggggaacaactacctgcatt

SEQ ID NO: 140160 - DNA, 22 bp, Artificial Sequence
  Synthetic oligonucleotide; CTA chr11 5248621 5248642 5248626 5248621 -
cctgcatttaatgggaaggcaa

SEQ ID NO: 140161 - DNA, 22 bp, Artificial Sequence
  Synthetic oligonucleotide; CTG chr11 5248617 5248638 5248622 5248617 -
catttaatgggaaggcaaaatc

SEQ ID NO: 140162 - DNA, 22 bp, Artificial Sequence
  Synthetic oligonucleotide; TTT chr11 5248612 5248633 5248617 5248612 -
aatgggaaggcaaaatctcagg

SEQ ID NO: 140163 - DNA, 22 bp, Artificial Sequence
  Synthetic oligonucleotide; TTA chr11 5248611 5248632 5248616 5248611 -
atgggaaggcaaaatctcaggc

SEQ ID NO: 140164 - DNA, 22 bp, Artificial Sequence
  Synthetic oligonucleotide; CTC chr11 5248593 5248614 5248598 5248593 -
aggctttgagggaagttaacat

SEQ ID NO: 140165 - DNA, 22 bp, Artificial Sequence
  Synthetic oligonucleotide; CTT chr11 5248587 5248608 5248592 5248587 -
tgagggaagttaacataggctt

SEQ ID NO: 140166 - DNA, 22 bp, Artificial Sequence
  Synthetic oligonucleotide; TTT chr11 5248586 5248607 5248591 5248586 -
gagggaagttaacataggcttg

SEQ ID NO: 140167 - DNA, 22 bp, Artificial Sequence
  Synthetic oligonucleotide; TTG chr11 5248585 5248606 5248590 5248585 -
agggaagttaacataggcttga

SEQ ID NO: 140168 - DNA, 22 bp, Artificial Sequence
  Synthetic oligonucleotide; TTA chr11 5248575 5248596 5248580 5248575 -
acataggcttgattctgggtgg

SEQ ID NO: 140169 - DNA, 22 bp, Artificial Sequence
  Synthetic oligonucleotide; CTT chr11 5248565 5248586 5248570 5248565 -
gattctgggtggaagcttggtg

SEQ ID NO: 140170 - DNA, 22 bp, Artificial Sequence
  Synthetic oligonucleotide; TTG chr11 5248564 5248585 5248569 5248564 -
attctgggtggaagcttggtgt

SEQ ID NO: 140171 - DNA, 22 bp, Artificial Sequence
  Synthetic oligonucleotide; TTC chr11 5248560 5248581 5248565 5248560 -
tgggtggaagcttggtgtgtag

SEQ ID NO: 140172 - DNA, 22 bp, Artificial Sequence
  Synthetic oligonucleotide; CTG chr11 5248558 5248579 5248563 5248558 -
ggtggaagcttggtgtgtagtt

SEQ ID NO: 140173 - DNA, 22 bp, Artificial Sequence
  Synthetic oligonucleotide; CTT chr11 5248547 5248568 5248552 5248547 -
ggtgtgtagttatctggaggcc

SEQ ID NO: 140174 - DNA, 22 bp, Artificial Sequence
  Synthetic oligonucleotide; TTG chr11 5248546 5248567 5248551 5248546 -
gtgtgtagttatctggaggcca

SEQ ID NO: 140175 - DNA, 22 bp, Artificial Sequence
  Synthetic oligonucleotide; TTA chr11 5248535 5248556 5248540 5248535 -
tctggaggccaggctggagctc

SEQ ID NO: 140176 - DNA, 22 bp, Artificial Sequence
  Synthetic oligonucleotide; CTG chr11 5248531 5248552 5248536 5248531 -
gaggccaggctggagctctcag

SEQ ID NO: 140177 - DNA, 22 bp, Artificial Sequence
  Synthetic oligonucleotide; CTG chr11 5248519 5248540 5248524 5248519 -
gagctctcagctcactatgggt

SEQ ID NO: 140178 - DNA, 22 bp, Artificial Sequence
  Synthetic oligonucleotide; CTC chr11 5248513 5248534 5248518 5248513 -
tcagctcactatgggttcatct

SEQ ID NO: 140179 - DNA, 22 bp, Artificial Sequence
  Synthetic oligonucleotide; CTC chr11 5248511 5248532 5248516 5248511 -
agctcactatgggttcatcttt

SEQ ID NO: 140180 - DNA, 22 bp, Artificial Sequence
  Synthetic oligonucleotide; CTC chr11 5248506 5248527 5248511 5248506 -
actatgggttcatctttattgt

SEQ ID NO: 140181 - DNA, 22 bp, Artificial Sequence
  Synthetic oligonucleotide; CTA chr11 5248502 5248523 5248507 5248502 -
tgggttcatctttattgtctcc

SEQ ID NO: 140182 - DNA, 22 bp, Artificial Sequence
  Synthetic oligonucleotide; TTC chr11 5248495 5248516 5248500 5248495 -
atctttattgtctcctttcatc

SEQ ID NO: 140183 - DNA, 22 bp, Artificial Sequence
  Synthetic oligonucleotide; CTT chr11 5248490 5248511 5248495 5248490 -
tattgtctcctttcatctcaac

SEQ ID NO: 140184 - DNA, 22 bp, Artificial Sequence
  Synthetic oligonucleotide; TTT chr11 5248489 5248510 5248494 5248489 -
attgtctcctttcatctcaaca

SEQ ID NO: 140185 - DNA, 22 bp, Artificial Sequence
  Synthetic oligonucleotide; TTA chr11 5248488 5248509 5248493 5248488 -
ttgtctcctttcatctcaacag

SEQ ID NO: 140186 - DNA, 22 bp, Artificial Sequence
  Synthetic oligonucleotide; TTG chr11 5248485 5248506 5248490 5248485 -
tctcctttcatctcaacagctc

SEQ ID NO: 140187 - DNA, 22 bp, Artificial Sequence
  Synthetic oligonucleotide; CTC chr11 5248481 5248502 5248486 5248481 -
ctttcatctcaacagctcctgg

SEQ ID NO: 140188 - DNA, 22 bp, Artificial Sequence
  Synthetic oligonucleotide; CTT chr11 5248478 5248499 5248483 5248478 -
tcatctcaacagctcctgggaa

SEQ ID NO: 140189 - DNA, 22 bp, Artificial Sequence
  Synthetic oligonucleotide; TTT chr11 5248477 5248498 5248482 5248477 -
catctcaacagctcctgggaaa

SEQ ID NO: 140190 - DNA, 22 bp, Artificial Sequence
  Synthetic oligonucleotide; TTC chr11 5248476 5248497 5248481 5248476 -
atctcaacagctcctgggaaat

SEQ ID NO: 140191 - DNA, 22 bp, Artificial Sequence
  Synthetic oligonucleotide; CTC chr11 5248471 5248492 5248476 5248471 -
aacagctcctgggaaatgtgct

SEQ ID NO: 140192 - DNA, 22 bp, Artificial Sequence
  Synthetic oligonucleotide; CTC chr11 5248463 5248484 5248468 5248463 -
ctgggaaatgtgctggtgaccg

SEQ ID NO: 140193 - DNA, 22 bp, Artificial Sequence
  Synthetic oligonucleotide; CTG chr11 5248460 5248481 5248465 5248460 -
ggaaatgtgctggtgaccgttt

SEQ ID NO: 140194 - DNA, 22 bp, Artificial Sequence
  Synthetic oligonucleotide; CTG chr11 5248448 5248469 5248453 5248448 -
gtgaccgttttggcaatccatt

SEQ ID NO: 140195 - DNA, 22 bp, Artificial Sequence
  Synthetic oligonucleotide; TTT chr11 5248438 5248459 5248443 5248438 -
tggcaatccatttcggcaaaga

SEQ ID NO: 140196 - DNA, 22 bp, Artificial Sequence
  Synthetic oligonucleotide; TTT chr11 5248437 5248458 5248442 5248437 -
ggcaatccatttcggcaaagaa

SEQ ID NO: 140197 - DNA, 22 bp, Artificial Sequence
  Synthetic oligonucleotide; TTG chr11 5248436 5248457 5248441 5248436 -
gcaatccatttcggcaaagaat

SEQ ID NO: 140198 - DNA, 22 bp, Artificial Sequence
  Synthetic oligonucleotide; TTT chr11 5248425 5248446 5248430 5248425 -
cggcaaagaattcacccctgag

SEQ ID NO: 140199 - DNA, 22 bp, Artificial Sequence
  Synthetic oligonucleotide; TTC chr11 5248424 5248445 5248429 5248424 -
ggcaaagaattcacccctgagg

SEQ ID NO: 140200 - DNA, 22 bp, Artificial Sequence
  Synthetic oligonucleotide; TTC chr11 5248412 5248433 5248417 5248412 -
acccctgaggtgcaggcttcct

SEQ ID NO: 140201 - DNA, 22 bp, Artificial Sequence
  Synthetic oligonucleotide; CTG chr11 5248405 5248426 5248410 5248405 -
aggtgcaggcttcctggcagaa

SEQ ID NO: 140202 - DNA, 22 bp, Artificial Sequence
  Synthetic oligonucleotide; CTT chr11 5248393 5248414 5248398 5248393 -
cctggcagaagatggtgactgc

SEQ ID NO: 140203 - DNA, 22 bp, Artificial Sequence
  Synthetic oligonucleotide; TTC chr11 5248392 5248413 5248397 5248392 -
ctggcagaagatggtgactgca

SEQ ID NO: 140204 - DNA, 22 bp, Artificial Sequence
  Synthetic oligonucleotide; CTG chr11 5248389 5248410 5248394 5248389 -
gcagaagatggtgactgcagtg

SEQ ID NO: 140205 - DNA, 22 bp, Artificial Sequence
  Synthetic oligonucleotide; CTG chr11 5248372 5248393 5248377 5248372 -
cagtggccagtgccctgtcctc

SEQ ID NO: 140206 - DNA, 22 bp, Artificial Sequence
  Synthetic oligonucleotide; CTG chr11 5248355 5248376 5248360 5248355 -
tcctccagataccactgagctc

SEQ ID NO: 140207 - DNA, 22 bp, Artificial Sequence
  Synthetic oligonucleotide; CTC chr11 5248350 5248371 5248355 5248350 -
cagataccactgagctcactgc

SEQ ID NO: 140208 - DNA, 22 bp, Artificial Sequence
  Synthetic oligonucleotide; CTG chr11 5248338 5248359 5248343 5248338 -
agctcactgcccatgattcaga

SEQ ID NO: 140209 - DNA, 22 bp, Artificial Sequence
  Synthetic oligonucleotide; CTC chr11 5248333 5248354 5248338 5248333 -
actgcccatgattcagagcttt

SEQ ID NO: 140210 - DNA, 22 bp, Artificial Sequence
  Synthetic oligonucleotide; CTG chr11 5248329 5248350 5248334 5248329 -
cccatgattcagagctttcaag

SEQ ID NO: 140211 - DNA, 22 bp, Artificial Sequence
  Synthetic oligonucleotide; TTC chr11 5248319 5248340 5248324 5248319 -
agagctttcaaggataggcttt

SEQ ID NO: 140212 - DNA, 22 bp, Artificial Sequence
  Synthetic oligonucleotide; CTT chr11 5248312 5248333 5248317 5248312 -
tcaaggataggctttattctgc

SEQ ID NO: 140213 - DNA, 22 bp, Artificial Sequence
  Synthetic oligonucleotide; TTT chr11 5248311 5248332 5248316 5248311 -
caaggataggctttattctgca

SEQ ID NO: 140214 - DNA, 22 bp, Artificial Sequence
  Synthetic oligonucleotide; TTC chr11 5248310 5248331 5248315 5248310 -
aaggataggctttattctgcaa

SEQ ID NO: 140215 - DNA, 22 bp, Artificial Sequence
  Synthetic oligonucleotide; CTT chr11 5248298 5248319 5248303 5248298 -
tattctgcaagcaatacaaata

SEQ ID NO: 140216 - DNA, 22 bp, Artificial Sequence
  Synthetic oligonucleotide; TTT chr11 5248297 5248318 5248302 5248297 -
attctgcaagcaatacaaataa

SEQ ID NO: 140217 - DNA, 22 bp, Artificial Sequence
  Synthetic oligonucleotide; TTA chr11 5248296 5248317 5248301 5248296 -
ttctgcaagcaatacaaataat

SEQ ID NO: 140218 - DNA, 22 bp, Artificial Sequence
  Synthetic oligonucleotide; TTC chr11 5248293 5248314 5248298 5248293 -
tgcaagcaatacaaataataaa

SEQ ID NO: 140219 - DNA, 22 bp, Artificial Sequence
  Synthetic oligonucleotide; CTG chr11 5248291 5248312 5248296 5248291 -
caagcaatacaaataataaatc

SEQ ID NO: 140220 - DNA, 22 bp, Artificial Sequence
  Synthetic oligonucleotide; CTA chr11 5248267 5248288 5248272 5248267 -
ttctgctgagagatcacacatg

SEQ ID NO: 140221 - DNA, 22 bp, Artificial Sequence
  Synthetic oligonucleotide; TTC chr11 5248264 5248285 5248269 5248264 -
tgctgagagatcacacatgatt

SEQ ID NO: 140222 - DNA, 22 bp, Artificial Sequence
  Synthetic oligonucleotide; CTG chr11 5248262 5248283 5248267 5248262 -
ctgagagatcacacatgatttt

SEQ ID NO: 140223 - DNA, 22 bp, Artificial Sequence
  Synthetic oligonucleotide; CTG chr11 5248259 5248280 5248264 5248259 -
agagatcacacatgattttctt

SEQ ID NO: 140224 - DNA, 22 bp, Artificial Sequence
  Synthetic oligonucleotide; TTT chr11 5248241 5248262 5248246 5248241 -
tcttcagctcttttttttacat

SEQ ID NO: 140225 - DNA, 22 bp, Artificial Sequence
  Synthetic oligonucleotide; TTT chr11 5248240 5248261 5248245 5248240 -
cttcagctcttttttttacatc

SEQ ID NO: 140226 - DNA, 22 bp, Artificial Sequence
  Synthetic oligonucleotide; TTC chr11 5248239 5248260 5248244 5248239 -
ttcagctcttttttttacatct

SEQ ID NO: 140227 - DNA, 22 bp, Artificial Sequence
  Synthetic oligonucleotide; CTT chr11 5248237 5248258 5248242 5248237 -
cagctcttttttttacatcttt

SEQ ID NO: 140228 - DNA, 22 bp, Artificial Sequence
  Synthetic oligonucleotide; TTC chr11 5248236 5248257 5248241 5248236 -
agctcttttttttacatctttt

SEQ ID NO: 140229 - DNA, 22 bp, Artificial Sequence
  Synthetic oligonucleotide; CTC chr11 5248231 5248252 5248236 5248231 -
ttttttttacatctttttaaat

SEQ ID NO: 140230 - DNA, 22 bp, Artificial Sequence
  Synthetic oligonucleotide; CTT chr11 5248229 5248250 5248234 5248229 -
ttttttacatctttttaaatat

SEQ ID NO: 140231 - DNA, 22 bp, Artificial Sequence
  Synthetic oligonucleotide; TTT chr11 5248228 5248249 5248233 5248228 -
tttttacatctttttaaatata

SEQ ID NO: 140232 - DNA, 22 bp, Artificial Sequence
  Synthetic oligonucleotide; TTT chr11 5248227 5248248 5248232 5248227 -
ttttacatctttttaaatatat

SEQ ID NO: 140233 - DNA, 22 bp, Artificial Sequence
  Synthetic oligonucleotide; TTT chr11 5248226 5248247 5248231 5248226 -
tttacatctttttaaatatatg

SEQ ID NO: 140234 - DNA, 22 bp, Artificial Sequence
  Synthetic oligonucleotide; TTT chr11 5248225 5248246 5248230 5248225 -
ttacatctttttaaatatatga

SEQ ID NO: 140235 - DNA, 22 bp, Artificial Sequence
  Synthetic oligonucleotide; TTT chr11 5248224 5248245 5248229 5248224 -
tacatctttttaaatatatgag

SEQ ID NO: 140236 - DNA, 22 bp, Artificial Sequence
  Synthetic oligonucleotide; TTT chr11 5248223 5248244 5248228 5248223 -
acatctttttaaatatatgagc

SEQ ID NO: 140237 - DNA, 22 bp, Artificial Sequence
  Synthetic oligonucleotide; TTA chr11 5248222 5248243 5248227 5248222 -
catctttttaaatatatgagcc

SEQ ID NO: 140238 - DNA, 22 bp, Artificial Sequence
  Synthetic oligonucleotide; CTT chr11 5248216 5248237 5248221 5248216 -
tttaaatatatgagccacaaag

SEQ ID NO: 140239 - DNA, 22 bp, Artificial Sequence
  Synthetic oligonucleotide; TTT chr11 5248215 5248236 5248220 5248215 -
ttaaatatatgagccacaaagg

SEQ ID NO: 140240 - DNA, 22 bp, Artificial Sequence
  Synthetic oligonucleotide; TTT chr11 5248214 5248235 5248219 5248214 -
taaatatatgagccacaaaggg

SEQ ID NO: 140241 - DNA, 22 bp, Artificial Sequence
  Synthetic oligonucleotide; TTT chr11 5248213 5248234 5248218 5248213 -
aaatatatgagccacaaagggt

SEQ ID NO: 140242 - DNA, 22 bp, Artificial Sequence
  Synthetic oligonucleotide; TTA chr11 5248212 5248233 5248217 5248212 -
aatatatgagccacaaagggtt

SEQ ID NO: 140243 - DNA, 22 bp, Artificial Sequence
  Synthetic oligonucleotide; TTT chr11 5248189 5248210 5248194 5248189 -
atattgagggaagtgtgtatgt

SEQ ID NO: 140244 - DNA, 22 bp, Artificial Sequence
  Synthetic oligonucleotide; TTA chr11 5248188 5248209 5248193 5248188 -
tattgagggaagtgtgtatgtg

SEQ ID NO: 140245 - DNA, 22 bp, Artificial Sequence
  Synthetic oligonucleotide; TTG chr11 5248183 5248204 5248188 5248183 -
agggaagtgtgtatgtgtattt

SEQ ID NO: 140246 - DNA, 22 bp, Artificial Sequence
  Synthetic oligonucleotide; TTT chr11 5248161 5248182 5248166 5248161 -
ctgcatgcctgtttgtgtttgt

SEQ ID NO: 140247 - DNA, 22 bp, Artificial Sequence
  Synthetic oligonucleotide; TTC chr11 5248160 5248181 5248165 5248160 -
tgcatgcctgtttgtgtttgtg

SEQ ID NO: 140248 - DNA, 22 bp, Artificial Sequence
  Synthetic oligonucleotide; CTG chr11 5248158 5248179 5248163 5248158 -
catgcctgtttgtgtttgtggt

SEQ ID NO: 140249 - DNA, 22 bp, Artificial Sequence
  Synthetic oligonucleotide; CTG chr11 5248150 5248171 5248155 5248150 -
tttgtgtttgtggtgtgtgcat

SEQ ID NO: 140250 - DNA, 22 bp, Artificial Sequence
  Synthetic oligonucleotide; TTT chr11 5248147 5248168 5248152 5248147 -
gtgtttgtggtgtgtgcatgct

SEQ ID NO: 140251 - DNA, 22 bp, Artificial Sequence
  Synthetic oligonucleotide; TTG chr11 5248146 5248167 5248151 5248146 -
tgtttgtggtgtgtgcatgctc

SEQ ID NO: 140252 - DNA, 22 bp, Artificial Sequence
  Synthetic oligonucleotide; TTT chr11 5248141 5248162 5248146 5248141 -
gtggtgtgtgcatgctcctcat

SEQ ID NO: 140253 - DNA, 22 bp, Artificial Sequence
  Synthetic oligonucleotide; TTG chr11 5248140 5248161 5248145 5248140 -
tggtgtgtgcatgctcctcatt

SEQ ID NO: 140254 - DNA, 22 bp, Artificial Sequence
  Synthetic oligonucleotide; CTC chr11 5248124 5248145 5248129 5248124 -
ctcatttatttttatatgagat

SEQ ID NO: 140255 - DNA, 22 bp, Artificial Sequence
  Synthetic oligonucleotide; CTC chr11 5248121 5248142 5248126 5248121 -
atttatttttatatgagatgtg

SEQ ID NO: 140256 - DNA, 22 bp, Artificial Sequence
  Synthetic oligonucleotide; TTT chr11 5248117 5248138 5248122 5248117 -
atttttatatgagatgtgcatt

SEQ ID NO: 140257 - DNA, 22 bp, Artificial Sequence
  Synthetic oligonucleotide; TTA chr11 5248116 5248137 5248121 5248116 -
tttttatatgagatgtgcattt

SEQ ID NO: 140258 - DNA, 22 bp, Artificial Sequence
  Synthetic oligonucleotide; TTT chr11 5248113 5248134 5248118 5248113 -
ttatatgagatgtgcattttga

SEQ ID NO: 140259 - DNA, 22 bp, Artificial Sequence
  Synthetic oligonucleotide; TTT chr11 5248112 5248133 5248117 5248112 -
tatatgagatgtgcattttgat

SEQ ID NO: 140260 - DNA, 22 bp, Artificial Sequence
  Synthetic oligonucleotide; TTT chr11 5248111 5248132 5248116 5248111 -
atatgagatgtgcattttgatg

SEQ ID NO: 140261 - DNA, 22 bp, Artificial Sequence
  Synthetic oligonucleotide; TTA chr11 5248110 5248131 5248115 5248110 -
tatgagatgtgcattttgatga

SEQ ID NO: 140262 - DNA, 22 bp, Artificial Sequence
  Synthetic oligonucleotide; TTT chr11 5248094 5248115 5248099 5248094 -
tgatgagcaaataaaagcagta

SEQ ID NO: 140263 - DNA, 22 bp, Artificial Sequence
  Synthetic oligonucleotide; TTT chr11 5248093 5248114 5248098 5248093 -
gatgagcaaataaaagcagtaa

SEQ ID NO: 140264 - DNA, 22 bp, Artificial Sequence
  Synthetic oligonucleotide; TTG chr11 5248092 5248113 5248097 5248092 -
atgagcaaataaaagcagtaaa

SEQ ID NO: 140265 - DNA, 22 bp, Artificial Sequence
  Synthetic oligonucleotide; CTT chr11 5248063 5248084 5248068 5248063 -
gtacacgggagttctgcaagtg

SEQ ID NO: 140266 - DNA, 22 bp, Artificial Sequence
  Synthetic oligonucleotide; TTG chr11 5248062 5248083 5248067 5248062 -
tacacgggagttctgcaagtgg

SEQ ID NO: 140267 - DNA, 22 bp, Artificial Sequence
  Synthetic oligonucleotide; TTC chr11 5248049 5248070 5248054 5248049 -
tgcaagtgggagtaaatggtgt

SEQ ID NO: 140268 - DNA, 22 bp, Artificial Sequence
  Synthetic oligonucleotide; CTG chr11 5248047 5248068 5248052 5248047 -
caagtgggagtaaatggtgtag

SEQ ID NO: 140269 - DNA, 22 bp, Artificial Sequence
  Synthetic oligonucleotide; CTC chr11 5247998 5248019 5248003 5247998 -
tataggacaggacttctcagaa

SEQ ID NO: 140270 - DNA, 22 bp, Artificial Sequence
  Synthetic oligonucleotide; CTA chr11 5247996 5248017 5248001 5247996 -
taggacaggacttctcagaaac

SEQ ID NO: 140271 - DNA, 22 bp, Artificial Sequence
  Synthetic oligonucleotide; CTT chr11 5247983 5248004 5247988 5247983 -
ctcagaaacagatgttttggaa

SEQ ID NO: 140272 - DNA, 22 bp, Artificial Sequence
  Synthetic oligonucleotide; TTC chr11 5247982 5248003 5247987 5247982 -
tcagaaacagatgttttggaag

SEQ ID NO: 140273 - DNA, 22 bp, Artificial Sequence
  Synthetic oligonucleotide; CTC chr11 5247980 5248001 5247985 5247980 -
agaaacagatgttttggaagag

SEQ ID NO: 140274 - DNA, 22 bp, Artificial Sequence
  Synthetic oligonucleotide; TTT chr11 5247966 5247987 5247971 5247966 -
tggaagagatgggaaaaggttc

SEQ ID NO: 140275 - DNA, 22 bp, Artificial Sequence
  Synthetic oligonucleotide; TTT chr11 5247965 5247986 5247970 5247965 -
ggaagagatgggaaaaggttca

SEQ ID NO: 140276 - DNA, 22 bp, Artificial Sequence
  Synthetic oligonucleotide; TTG chr11 5247964 5247985 5247969 5247964 -
gaagagatgggaaaaggttcag

SEQ ID NO: 140277 - DNA, 22 bp, Artificial Sequence
  Synthetic oligonucleotide; TTC chr11 5247944 5247965 5247949 5247944 -
agtgaagacctgggggctggat

SEQ ID NO: 140278 - DNA, 22 bp, Artificial Sequence
  Synthetic oligonucleotide; CTG chr11 5247932 5247953 5247937 5247932 -
ggggctggattgattgcagctg

SEQ ID NO: 140279 - DNA, 22 bp, Artificial Sequence
  Synthetic oligonucleotide; CTG chr11 5247925 5247946 5247930 5247925 -
gattgattgcagctgagtagca

SEQ ID NO: 140280 - DNA, 22 bp, Artificial Sequence
  Synthetic oligonucleotide; TTG chr11 5247920 5247941 5247925 5247920 -
attgcagctgagtagcaaggat

SEQ ID NO: 140281 - DNA, 22 bp, Artificial Sequence
  Synthetic oligonucleotide; TTG chr11 5247916 5247937 5247921 5247916 -
cagctgagtagcaaggatggtt

SEQ ID NO: 140282 - DNA, 22 bp, Artificial Sequence
  Synthetic oligonucleotide; CTG chr11 5247910 5247931 5247915 5247910 -
agtagcaaggatggttcttaag

SEQ ID NO: 140283 - DNA, 22 bp, Artificial Sequence
  Synthetic oligonucleotide; TTC chr11 5247893 5247914 5247898 5247893 -
ttaaggaagggaaagtgttcca

SEQ ID NO: 140284 - DNA, 22 bp, Artificial Sequence
  Synthetic oligonucleotide; CTT chr11 5247891 5247912 5247896 5247891 -
aaggaagggaaagtgttccaag

SEQ ID NO: 140285 - DNA, 22 bp, Artificial Sequence
  Synthetic oligonucleotide; TTA chr11 5247890 5247911 5247895 5247890 -
aggaagggaaagtgttccaagc

SEQ ID NO: 140286 - DNA, 22 bp, Artificial Sequence
  Synthetic oligonucleotide; TTC chr11 5247873 5247894 5247878 5247873 -
caagctttaggaattcaaggtt

SEQ ID NO: 140287 - DNA, 22 bp, Artificial Sequence
  Synthetic oligonucleotide; CTT chr11 5247866 5247887 5247871 5247866 -
taggaattcaaggtttagtcag

SEQ ID NO: 140288 - DNA, 22 bp, Artificial Sequence
  Synthetic oligonucleotide; TTT chr11 5247865 5247886 5247870 5247865 -
aggaattcaaggtttagtcagg

SEQ ID NO: 140289 - DNA, 22 bp, Artificial Sequence
  Synthetic oligonucleotide; TTA chr11 5247864 5247885 5247869 5247864 -
ggaattcaaggtttagtcaggt

SEQ ID NO: 140290 - DNA, 22 bp, Artificial Sequence
  Synthetic oligonucleotide; TTC chr11 5247857 5247878 5247862 5247857 -
aaggtttagtcaggtgtagcaa

SEQ ID NO: 140291 - DNA, 22 bp, Artificial Sequence
  Synthetic oligonucleotide; TTT chr11 5247850 5247871 5247855 5247850 -
agtcaggtgtagcaattctatt

SEQ ID NO: 140292 - DNA, 22 bp, Artificial Sequence
  Synthetic oligonucleotide; TTA chr11 5247849 5247870 5247854 5247849 -
gtcaggtgtagcaattctattt

SEQ ID NO: 140293 - DNA, 22 bp, Artificial Sequence
  Synthetic oligonucleotide; TTC chr11 5247832 5247853 5247837 5247832 -
tattttattaggaggaatacta

SEQ ID NO: 140294 - DNA, 22 bp, Artificial Sequence
  Synthetic oligonucleotide; CTA chr11 5247830 5247851 5247835 5247830 -
ttttattaggaggaatactatt

SEQ ID NO: 140295 - DNA, 22 bp, Artificial Sequence
  Synthetic oligonucleotide; TTT chr11 5247827 5247848 5247832 5247827 -
tattaggaggaatactatttct

SEQ ID NO: 140296 - DNA, 22 bp, Artificial Sequence
  Synthetic oligonucleotide; TTT chr11 5247826 5247847 5247831 5247826 -
attaggaggaatactatttcta

SEQ ID NO: 140297 - DNA, 22 bp, Artificial Sequence
  Synthetic oligonucleotide; TTA chr11 5247825 5247846 5247830 5247825 -
ttaggaggaatactatttctaa

SEQ ID NO: 140298 - DNA, 22 bp, Artificial Sequence
  Synthetic oligonucleotide; TTA chr11 5247822 5247843 5247827 5247822 -
ggaggaatactatttctaatgg

SEQ ID NO: 140299 - DNA, 22 bp, Artificial Sequence
  Synthetic oligonucleotide; CTA chr11 5247810 5247831 5247815 5247810 -
tttctaatggcacttagctttt

SEQ ID NO: 140300 - DNA, 22 bp, Artificial Sequence
  Synthetic oligonucleotide; TTT chr11 5247807 5247828 5247812 5247807 -
ctaatggcacttagcttttcac

SEQ ID NO: 140301 - DNA, 22 bp, Artificial Sequence
  Synthetic oligonucleotide; TTC chr11 5247806 5247827 5247811 5247806 -
taatggcacttagcttttcaca

SEQ ID NO: 140302 - DNA, 22 bp, Artificial Sequence
  Synthetic oligonucleotide; CTA chr11 5247804 5247825 5247809 5247804 -
atggcacttagcttttcacagc

SEQ ID NO: 140303 - DNA, 22 bp, Artificial Sequence
  Synthetic oligonucleotide; CTT chr11 5247795 5247816 5247800 5247795 -
agcttttcacagcccttgtgga

SEQ ID NO: 140304 - DNA, 22 bp, Artificial Sequence
  Synthetic oligonucleotide; TTA chr11 5247794 5247815 5247799 5247794 -
gcttttcacagcccttgtggat

SEQ ID NO: 140305 - DNA, 22 bp, Artificial Sequence
  Synthetic oligonucleotide; CTT chr11 5247790 5247811 5247795 5247790 -
ttcacagcccttgtggatgcct

SEQ ID NO: 140306 - DNA, 22 bp, Artificial Sequence
  Synthetic oligonucleotide; TTT chr11 5247789 5247810 5247794 5247789 -
tcacagcccttgtggatgccta

SEQ ID NO: 140307 - DNA, 22 bp, Artificial Sequence
  Synthetic oligonucleotide; TTT chr11 5247788 5247809 5247793 5247788 -
cacagcccttgtggatgcctaa

SEQ ID NO: 140308 - DNA, 22 bp, Artificial Sequence
  Synthetic oligonucleotide; TTC chr11 5247787 5247808 5247792 5247787 -
acagcccttgtggatgcctaag

SEQ ID NO: 140309 - DNA, 22 bp, Artificial Sequence
  Synthetic oligonucleotide; CTT chr11 5247778 5247799 5247783 5247778 -
gtggatgcctaagaaagtgaaa

SEQ ID NO: 140310 - DNA, 22 bp, Artificial Sequence
  Synthetic oligonucleotide; TTG chr11 5247777 5247798 5247782 5247777 -
tggatgcctaagaaagtgaaat

SEQ ID NO: 140311 - DNA, 22 bp, Artificial Sequence
  Synthetic oligonucleotide; CTA chr11 5247767 5247788 5247772 5247767 -
agaaagtgaaattaatcccatg

SEQ ID NO: 140312 - DNA, 22 bp, Artificial Sequence
  Synthetic oligonucleotide; TTA chr11 5247753 5247774 5247758 5247753 -
atcccatgccctcaagtgtgca

SEQ ID NO: 140313 - DNA, 22 bp, Artificial Sequence
  Synthetic oligonucleotide; CTC chr11 5247740 5247761 5247745 5247740 -
aagtgtgcagattggtcacagc

SEQ ID NO: 140314 - DNA, 22 bp, Artificial Sequence
  Synthetic oligonucleotide; TTG chr11 5247726 5247747 5247731 5247726 -
gtcacagcatttcaagggagag

SEQ ID NO: 140315 - DNA, 22 bp, Artificial Sequence
  Synthetic oligonucleotide; TTT chr11 5247714 5247735 5247719 5247714 -
caagggagagacctcattgtaa

SEQ ID NO: 140316 - DNA, 22 bp, Artificial Sequence
  Synthetic oligonucleotide; TTC chr11 5247713 5247734 5247718 5247713 -
aagggagagacctcattgtaag

SEQ ID NO: 140317 - DNA, 22 bp, Artificial Sequence
  Synthetic oligonucleotide; CTC chr11 5247699 5247720 5247704 5247699 -
attgtaagactctgggggaggt

SEQ ID NO: 140318 - DNA, 22 bp, Artificial Sequence
  Synthetic oligonucleotide; TTG chr11 5247695 5247716 5247700 5247695 -
taagactctgggggaggtgggg

SEQ ID NO: 140319 - DNA, 22 bp, Artificial Sequence
  Synthetic oligonucleotide; CTC chr11 5247687 5247708 5247692 5247687 -
tgggggaggtggggacttaggt

SEQ ID NO: 140320 - DNA, 22 bp, Artificial Sequence
  Synthetic oligonucleotide; CTG chr11 5247685 5247706 5247690 5247685 -
ggggaggtggggacttaggtgt

SEQ ID NO: 140321 - DNA, 22 bp, Artificial Sequence
  Synthetic oligonucleotide; CTT chr11 5247669 5247690 5247674 5247669 -
aggtgtaagaaatgaatcagca

SEQ ID NO: 140322 - DNA, 22 bp, Artificial Sequence
  Synthetic oligonucleotide; TTA chr11 5247668 5247689 5247673 5247668 -
ggtgtaagaaatgaatcagcag

SEQ ID NO: 140323 - DNA, 22 bp, Artificial Sequence
  Synthetic oligonucleotide; CTC chr11 5247640 5247661 5247645 5247640 -
acaagtcagcatgagcatgtta

SEQ ID NO: 140324 - DNA, 22 bp, Artificial Sequence
  Synthetic oligonucleotide; TTA chr11 5247618 5247639 5247623 5247618 -
tgtctgagaaacagaccagcac

SEQ ID NO: 140325 - DNA, 22 bp, Artificial Sequence
  Synthetic oligonucleotide; CTG chr11 5247612 5247633 5247617 5247612 -
agaaacagaccagcactgtgag

SEQ ID NO: 140326 - DNA, 22 bp, Artificial Sequence
  Synthetic oligonucleotide; CTG chr11 5247594 5247615 5247599 5247594 -
tgagatcaaaatgtagtgggaa

SEQ ID NO: 140327 - DNA, 22 bp, Artificial Sequence
  Synthetic oligonucleotide; TTT chr11 5247566 5247587 5247571 5247566 -
gtacaacattaattggaaggct

SEQ ID NO: 140328 - DNA, 22 bp, Artificial Sequence
  Synthetic oligonucleotide; TTG chr11 5247565 5247586 5247570 5247565 -
tacaacattaattggaaggctt

SEQ ID NO: 140329 - DNA, 22 bp, Artificial Sequence
  Synthetic oligonucleotide; TTA chr11 5247555 5247576 5247560 5247555 -
attggaaggcttacttaatgga

SEQ ID NO: 140330 - DNA, 22 bp, Artificial Sequence
  Synthetic oligonucleotide; TTG chr11 5247551 5247572 5247556 5247551 -
gaaggcttacttaatggaattt

SEQ ID NO: 140331 - DNA, 22 bp, Artificial Sequence
  Synthetic oligonucleotide; CTT chr11 5247543 5247564 5247548 5247543 -
acttaatggaatttttgtatag

SEQ ID NO: 140332 - DNA, 22 bp, Artificial Sequence
  Synthetic oligonucleotide; TTA chr11 5247542 5247563 5247547 5247542 -
cttaatggaatttttgtatagt

SEQ ID NO: 140333 - DNA, 22 bp, Artificial Sequence
  Synthetic oligonucleotide; CTT chr11 5247539 5247560 5247544 5247539 -
aatggaatttttgtatagttgg

SEQ ID NO: 140334 - DNA, 22 bp, Artificial Sequence
  Synthetic oligonucleotide; TTA chr11 5247538 5247559 5247543 5247538 -
atggaatttttgtatagttgga

SEQ ID NO: 140335 - DNA, 22 bp, Artificial Sequence
  Synthetic oligonucleotide; TTT chr11 5247529 5247550 5247534 5247529 -
ttgtatagttggatgttagtgc

SEQ ID NO: 140336 - DNA, 22 bp, Artificial Sequence
  Synthetic oligonucleotide; TTT chr11 5247528 5247549 5247533 5247528 -
tgtatagttggatgttagtgca

SEQ ID NO: 140337 - DNA, 22 bp, Artificial Sequence
  Synthetic oligonucleotide; TTT chr11 5247527 5247548 5247532 5247527 -
gtatagttggatgttagtgcat

SEQ ID NO: 140338 - DNA, 22 bp, Artificial Sequence
  Synthetic oligonucleotide; TTG chr11 5247526 5247547 5247531 5247526 -
tatagttggatgttagtgcatc

SEQ ID NO: 140339 - DNA, 22 bp, Artificial Sequence
  Synthetic oligonucleotide; TTG chr11 5247518 5247539 5247523 5247518 -
gatgttagtgcatctctataag

SEQ ID NO: 140340 - DNA, 22 bp, Artificial Sequence
  Synthetic oligonucleotide; TTA chr11 5247511 5247532 5247516 5247511 -
gtgcatctctataagtaagagt

SEQ ID NO: 140341 - DNA, 22 bp, Artificial Sequence
  Synthetic oligonucleotide; CTC chr11 5247502 5247523 5247507 5247502 -
tataagtaagagtttaatatga

SEQ ID NO: 140342 - DNA, 22 bp, Artificial Sequence
  Synthetic oligonucleotide; CTA chr11 5247500 5247521 5247505 5247500 -
taagtaagagtttaatatgatg

SEQ ID NO: 140343 - DNA, 22 bp, Artificial Sequence
  Synthetic oligonucleotide; TTT chr11 5247487 5247508 5247492 5247487 -
aatatgatggtgttacggacct

SEQ ID NO: 140344 - DNA, 22 bp, Artificial Sequence
  Synthetic oligonucleotide; TTA chr11 5247486 5247507 5247491 5247486 -
atatgatggtgttacggaccta

SEQ ID NO: 140345 - DNA, 22 bp, Artificial Sequence
  Synthetic oligonucleotide; TTA chr11 5247472 5247493 5247477 5247472 -
cggacctaatgtttgtgtctcc

SEQ ID NO: 140346 - DNA, 22 bp, Artificial Sequence
  Synthetic oligonucleotide; CTA chr11 5247464 5247485 5247469 5247464 -
atgtttgtgtctcctcaaaatt

SEQ ID NO: 140347 - DNA, 22 bp, Artificial Sequence
  Synthetic oligonucleotide; TTT chr11 5247458 5247479 5247463 5247458 -
gtgtctcctcaaaattcacatg

SEQ ID NO: 140348 - DNA, 22 bp, Artificial Sequence
  Synthetic oligonucleotide; TTG chr11 5247457 5247478 5247462 5247457 -
tgtctcctcaaaattcacatgc

SEQ ID NO: 140349 - DNA, 22 bp, Artificial Sequence
  Synthetic oligonucleotide; CTC chr11 5247451 5247472 5247456 5247451 -
ctcaaaattcacatgctgaatc

SEQ ID NO: 140350 - DNA, 22 bp, Artificial Sequence
  Synthetic oligonucleotide; CTC chr11 5247448 5247469 5247453 5247448 -
aaaattcacatgctgaatcccc

SEQ ID NO: 140351 - DNA, 22 bp, Artificial Sequence
  Synthetic oligonucleotide; TTC chr11 5247441 5247462 5247446 5247441 -
acatgctgaatccccaactccc

SEQ ID NO: 140352 - DNA, 22 bp, Artificial Sequence
  Synthetic oligonucleotide; CTG chr11 5247433 5247454 5247438 5247433 -
aatccccaactcccaactgacc

SEQ ID NO: 140353 - DNA, 22 bp, Artificial Sequence
  Synthetic oligonucleotide; CTC chr11 5247421 5247442 5247426 5247421 -
ccaactgaccttatctgtgggg

SEQ ID NO: 140354 - DNA, 22 bp, Artificial Sequence
  Synthetic oligonucleotide; CTG chr11 5247414 5247435 5247419 5247414 -
accttatctgtgggggaggctt

SEQ ID NO: 140355 - DNA, 22 bp, Artificial Sequence
  Synthetic oligonucleotide; CTT chr11 5247409 5247430 5247414 5247409 -
atctgtgggggaggcttttgaa

SEQ ID NO: 140356 - DNA, 22 bp, Artificial Sequence
  Synthetic oligonucleotide; TTA chr11 5247408 5247429 5247413 5247408 -
tctgtgggggaggcttttgaaa

SEQ ID NO: 140357 - DNA, 22 bp, Artificial Sequence
  Synthetic oligonucleotide; CTG chr11 5247404 5247425 5247409 5247404 -
tgggggaggcttttgaaaagta

SEQ ID NO: 140358 - DNA, 22 bp, Artificial Sequence
  Synthetic oligonucleotide; CTT chr11 5247392 5247413 5247397 5247392 -
ttgaaaagtaattaggtttaga

SEQ ID NO: 140359 - DNA, 22 bp, Artificial Sequence
  Synthetic oligonucleotide; TTT chr11 5247391 5247412 5247396 5247391 -
tgaaaagtaattaggtttagat

SEQ ID NO: 140360 - DNA, 22 bp, Artificial Sequence
  Synthetic oligonucleotide; TTT chr11 5247390 5247411 5247395 5247390 -
gaaaagtaattaggtttagatg

SEQ ID NO: 140361 - DNA, 22 bp, Artificial Sequence
  Synthetic oligonucleotide; TTG chr11 5247389 5247410 5247394 5247389 -
aaaagtaattaggtttagatga

SEQ ID NO: 140362 - DNA, 22 bp, Artificial Sequence
  Synthetic oligonucleotide; TTA chr11 5247378 5247399 5247383 5247378 -
ggtttagatgagctcataagag

SEQ ID NO: 140363 - DNA, 22 bp, Artificial Sequence
  Synthetic oligonucleotide; TTT chr11 5247373 5247394 5247378 5247373 -
agatgagctcataagagcagat

SEQ ID NO: 140364 - DNA, 22 bp, Artificial Sequence
  Synthetic oligonucleotide; TTA chr11 5247372 5247393 5247377 5247372 -
gatgagctcataagagcagatc

SEQ ID NO: 140365 - DNA, 22 bp, Artificial Sequence
  Synthetic oligonucleotide; CTC chr11 5247363 5247384 5247368 5247363 -
ataagagcagatccccatcata

SEQ ID NO: 140366 - DNA, 22 bp, Artificial Sequence
  Synthetic oligonucleotide; TTA chr11 5247335 5247356 5247340 5247335 -
ttttccttatcagaagcagaga

SEQ ID NO: 140367 - DNA, 22 bp, Artificial Sequence
  Synthetic oligonucleotide; TTT chr11 5247332 5247353 5247337 5247332 -
tccttatcagaagcagagagac

SEQ ID NO: 140368 - DNA, 22 bp, Artificial Sequence
  Synthetic oligonucleotide; TTT chr11 5247331 5247352 5247336 5247331 -
ccttatcagaagcagagagaca

SEQ ID NO: 140369 - DNA, 22 bp, Artificial Sequence
  Synthetic oligonucleotide; TTC chr11 5247330 5247351 5247335 5247330 -
cttatcagaagcagagagacaa

SEQ ID NO: 140370 - DNA, 22 bp, Artificial Sequence
  Synthetic oligonucleotide; CTT chr11 5247327 5247348 5247332 5247327 -
atcagaagcagagagacaagcc

SEQ ID NO: 140371 - DNA, 22 bp, Artificial Sequence
  Synthetic oligonucleotide; TTA chr11 5247326 5247347 5247331 5247326 -
tcagaagcagagagacaagcca

SEQ ID NO: 140372 - DNA, 22 bp, Artificial Sequence
  Synthetic oligonucleotide; TTT chr11 5247301 5247322 5247306 5247301 -
ctctttcctcccggtgaggaca

SEQ ID NO: 140373 - DNA, 22 bp, Artificial Sequence
  Synthetic oligonucleotide; TTC chr11 5247300 5247321 5247305 5247300 -
tctttcctcccggtgaggacac

SEQ ID NO: 140374 - DNA, 22 bp, Artificial Sequence
  Synthetic oligonucleotide; CTC chr11 5247298 5247319 5247303 5247298 -
tttcctcccggtgaggacacag

SEQ ID NO: 140375 - DNA, 22 bp, Artificial Sequence
  Synthetic oligonucleotide; CTT chr11 5247296 5247317 5247301 5247296 -
tcctcccggtgaggacacagtg

SEQ ID NO: 140376 - DNA, 22 bp, Artificial Sequence
  Synthetic oligonucleotide; TTT chr11 5247295 5247316 5247300 5247295 -
cctcccggtgaggacacagtga

SEQ ID NO: 140377 - DNA, 22 bp, Artificial Sequence
  Synthetic oligonucleotide; TTC chr11 5247294 5247315 5247299 5247294 -
ctcccggtgaggacacagtgag

SEQ ID NO: 140378 - DNA, 22 bp, Artificial Sequence
  Synthetic oligonucleotide; CTC chr11 5247291 5247312 5247296 5247291 -
ccggtgaggacacagtgagaag

SEQ ID NO: 140379 - DNA, 22 bp, Artificial Sequence
  Synthetic oligonucleotide; CTG chr11 5247258 5247279 5247263 5247258 -
caatccaggaagagaaccctga

SEQ ID NO: 140380 - DNA, 22 bp, Artificial Sequence
  Synthetic oligonucleotide; CTG chr11 5247237 5247258 5247242 5247237 -
accacgagtcagccttcagaaa

SEQ ID NO: 140381 - DNA, 22 bp, Artificial Sequence
  Synthetic oligonucleotide; CTT chr11 5247221 5247242 5247226 5247221 -
cagaaatgtgagaaaaaactct

SEQ ID NO: 140382 - DNA, 22 bp, Artificial Sequence
  Synthetic oligonucleotide; TTC chr11 5247220 5247241 5247225 5247220 -
agaaatgtgagaaaaaactctg

SEQ ID NO: 140383 - DNA, 22 bp, Artificial Sequence
  Synthetic oligonucleotide; CTC chr11 5247200 5247221 5247205 5247200 -
tgttgttgaagccacccagtct

SEQ ID NO: 140384 - DNA, 22 bp, Artificial Sequence
  Synthetic oligonucleotide; CTG chr11 5247198 5247219 5247203 5247198 -
ttgttgaagccacccagtcttt

SEQ ID NO: 140385 - DNA, 22 bp, Artificial Sequence
  Synthetic oligonucleotide; TTG chr11 5247195 5247216 5247200 5247195 -
ttgaagccacccagtcttttgt

SEQ ID NO: 140386 - DNA, 22 bp, Artificial Sequence
  Synthetic oligonucleotide; TTG chr11 5247192 5247213 5247197 5247192 -
aagccacccagtcttttgtatt

SEQ ID NO: 140387 - DNA, 22 bp, Artificial Sequence
  Synthetic oligonucleotide; CTT chr11 5247177 5247198 5247182 5247177 -
ttgtattttgttatagcacctt

SEQ ID NO: 140388 - DNA, 22 bp, Artificial Sequence
  Synthetic oligonucleotide; TTT chr11 5247176 5247197 5247181 5247176 -
tgtattttgttatagcaccttg

SEQ ID NO: 140389 - DNA, 22 bp, Artificial Sequence
  Synthetic oligonucleotide; TTT chr11 5247175 5247196 5247180 5247175 -
gtattttgttatagcaccttgc

SEQ ID NO: 140390 - DNA, 22 bp, Artificial Sequence
  Synthetic oligonucleotide; TTG chr11 5247174 5247195 5247179 5247174 -
tattttgttatagcaccttgca

SEQ ID NO: 140391 - DNA, 22 bp, Artificial Sequence
  Synthetic oligonucleotide; TTT chr11 5247169 5247190 5247174 5247169 -
tgttatagcaccttgcactgag

SEQ ID NO: 140392 - DNA, 22 bp, Artificial Sequence
  Synthetic oligonucleotide; TTT chr11 5247168 5247189 5247173 5247168 -
gttatagcaccttgcactgagt

SEQ ID NO: 140393 - DNA, 22 bp, Artificial Sequence
  Synthetic oligonucleotide; TTG chr11 5247167 5247188 5247172 5247167 -
ttatagcaccttgcactgagta

SEQ ID NO: 140394 - DNA, 22 bp, Artificial Sequence
  Synthetic oligonucleotide; TTA chr11 5247164 5247185 5247169 5247164 -
tagcaccttgcactgagtaagg

SEQ ID NO: 140395 - DNA, 22 bp, Artificial Sequence
  Synthetic oligonucleotide; CTT chr11 5247155 5247176 5247160 5247155 -
gcactgagtaaggcagatgaag

SEQ ID NO: 140396 - DNA, 22 bp, Artificial Sequence
  Synthetic oligonucleotide; TTG chr11 5247154 5247175 5247159 5247154 -
cactgagtaaggcagatgaaga

SEQ ID NO: 140397 - DNA, 22 bp, Artificial Sequence
  Synthetic oligonucleotide; CTG chr11 5247149 5247170 5247154 5247149 -
agtaaggcagatgaagaaggag

SEQ ID NO: 140398 - DNA, 22 bp, Artificial Sequence
  Synthetic oligonucleotide; CTT chr11 5247113 5247134 5247118 5247113 -
gggttttgagtggactacagac

SEQ ID NO: 140399 - DNA, 22 bp, Artificial Sequence
  Synthetic oligonucleotide; TTG chr11 5247112 5247133 5247117 5247112 -
ggttttgagtggactacagacc

SEQ ID NO: 140400 - DNA, 22 bp, Artificial Sequence
  Synthetic oligonucleotide; TTT chr11 5247107 5247128 5247112 5247107 -
tgagtggactacagaccatgtt

SEQ ID NO: 140401 - DNA, 22 bp, Artificial Sequence
  Synthetic oligonucleotide; TTT chr11 5247106 5247127 5247111 5247106 -
gagtggactacagaccatgttt

SEQ ID NO: 140402 - DNA, 22 bp, Artificial Sequence
  Synthetic oligonucleotide; TTG chr11 5247105 5247126 5247110 5247105 -
agtggactacagaccatgttta

SEQ ID NO: 140403 - DNA, 22 bp, Artificial Sequence
  Synthetic oligonucleotide; CTA chr11 5247096 5247117 5247101 5247096 -
cagaccatgtttatctcaggtt

SEQ ID NO: 140404 - DNA, 22 bp, Artificial Sequence
  Synthetic oligonucleotide; TTT chr11 5247084 5247105 5247089 5247084 -
atctcaggtttgcaaagctccc

SEQ ID NO: 140405 - DNA, 22 bp, Artificial Sequence
  Synthetic oligonucleotide; TTA chr11 5247083 5247104 5247088 5247083 -
tctcaggtttgcaaagctcccc

SEQ ID NO: 140406 - DNA, 22 bp, Artificial Sequence
  Synthetic oligonucleotide; CTC chr11 5247079 5247100 5247084 5247079 -
aggtttgcaaagctcccctcgt

SEQ ID NO: 140407 - DNA, 22 bp, Artificial Sequence
  Synthetic oligonucleotide; TTT chr11 5247073 5247094 5247078 5247073 -
gcaaagctcccctcgtccccta

SEQ ID NO: 140408 - DNA, 22 bp, Artificial Sequence
  Synthetic oligonucleotide; TTG chr11 5247072 5247093 5247077 5247072 -
caaagctcccctcgtcccctat

SEQ ID NO: 140409 - DNA, 22 bp, Artificial Sequence
  Synthetic oligonucleotide; CTC chr11 5247064 5247085 5247069 5247064 -
ccctcgtcccctatgtttcagt

SEQ ID NO: 140410 - DNA, 22 bp, Artificial Sequence
  Synthetic oligonucleotide; CTC chr11 5247059 5247080 5247064 5247059 -
gtcccctatgtttcagtataaa

SEQ ID NO: 140411 - DNA, 22 bp, Artificial Sequence
  Synthetic oligonucleotide; CTA chr11 5247051 5247072 5247056 5247051 -
tgtttcagtataaaatacctac

SEQ ID NO: 140412 - DNA, 22 bp, Artificial Sequence
  Synthetic oligonucleotide; TTT chr11 5247046 5247067 5247051 5247046 -
cagtataaaatacctactctac

SEQ ID NO: 140413 - DNA, 22 bp, Artificial Sequence
  Synthetic oligonucleotide; TTC chr11 5247045 5247066 5247050 5247045 -
agtataaaatacctactctact

SEQ ID NO: 140414 - DNA, 22 bp, Artificial Sequence
  Synthetic oligonucleotide; CTA chr11 5247030 5247051 5247035 5247030 -
ctctactactctcatctataag

SEQ ID NO: 140415 - DNA, 22 bp, Artificial Sequence
  Synthetic oligonucleotide; CTC chr11 5247027 5247048 5247032 5247027 -
tactactctcatctataagacc

SEQ ID NO: 140416 - DNA, 22 bp, Artificial Sequence
  Synthetic oligonucleotide; CTA chr11 5247025 5247046 5247030 5247025 -
ctactctcatctataagaccca

SEQ ID NO: 140417 - DNA, 22 bp, Artificial Sequence
  Synthetic oligonucleotide; CTA chr11 5247022 5247043 5247027 5247022 -
ctctcatctataagacccaaat

SEQ ID NO: 140418 - DNA, 22 bp, Artificial Sequence
  Synthetic oligonucleotide; CTC chr11 5247019 5247040 5247024 5247019 -
tcatctataagacccaaataat

SEQ ID NO: 140419 - DNA, 22 bp, Artificial Sequence
  Synthetic oligonucleotide; CTC chr11 5247017 5247038 5247022 5247017 -
atctataagacccaaataataa

SEQ ID NO: 140420 - DNA, 22 bp, Artificial Sequence
  Synthetic oligonucleotide; CTA chr11 5247012 5247033 5247017 5247012 -
taagacccaaataataagcctg

SEQ ID NO: 140421 - DNA, 22 bp, Artificial Sequence
  Synthetic oligonucleotide; CTG chr11 5246990 5247011 5246995 5246990 -
cgcccttctctctaactttgat

SEQ ID NO: 140422 - DNA, 22 bp, Artificial Sequence
  Synthetic oligonucleotide; CTT chr11 5246983 5247004 5246988 5246983 -
ctctctaactttgatttctcct

SEQ ID NO: 140423 - DNA, 22 bp, Artificial Sequence
  Synthetic oligonucleotide; TTC chr11 5246982 5247003 5246987 5246982 -
tctctaactttgatttctccta

SEQ ID NO: 140424 - DNA, 22 bp, Artificial Sequence
  Synthetic oligonucleotide; CTC chr11 5246980 5247001 5246985 5246980 -
tctaactttgatttctcctatt

SEQ ID NO: 140425 - DNA, 22 bp, Artificial Sequence
  Synthetic oligonucleotide; CTC chr11 5246978 5246999 5246983 5246978 -
taactttgatttctcctatttt

SEQ ID NO: 140426 - DNA, 22 bp, Artificial Sequence
  Synthetic oligonucleotide; CTA chr11 5246976 5246997 5246981 5246976 -
actttgatttctcctattttta

SEQ ID NO: 140427 - DNA, 22 bp, Artificial Sequence
  Synthetic oligonucleotide; CTT chr11 5246972 5246993 5246977 5246972 -
tgatttctcctatttttacttc

SEQ ID NO: 140428 - DNA, 22 bp, Artificial Sequence
  Synthetic oligonucleotide; TTT chr11 5246971 5246992 5246976 5246971 -
gatttctcctatttttacttca

SEQ ID NO: 140429 - DNA, 22 bp, Artificial Sequence
  Synthetic oligonucleotide; TTG chr11 5246970 5246991 5246975 5246970 -
atttctcctatttttacttcaa

SEQ ID NO: 140430 - DNA, 22 bp, Artificial Sequence
  Synthetic oligonucleotide; TTT chr11 5246966 5246987 5246971 5246966 -
ctcctatttttacttcaacatg

SEQ ID NO: 140431 - DNA, 22 bp, Artificial Sequence
  Synthetic oligonucleotide; TTC chr11 5246965 5246986 5246970 5246965 -
tcctatttttacttcaacatgc

SEQ ID NO: 140432 - DNA, 22 bp, Artificial Sequence
  Synthetic oligonucleotide; CTC chr11 5246963 5246984 5246968 5246963 -
ctatttttacttcaacatgctt

SEQ ID NO: 140433 - DNA, 22 bp, Artificial Sequence
  Synthetic oligonucleotide; CTA chr11 5246960 5246981 5246965 5246960 -
tttttacttcaacatgctttac

SEQ ID NO: 140434 - DNA, 22 bp, Artificial Sequence
  Synthetic oligonucleotide; TTT chr11 5246957 5246978 5246962 5246957 -
ttacttcaacatgctttactct

SEQ ID NO: 140435 - DNA, 22 bp, Artificial Sequence
  Synthetic oligonucleotide; TTT chr11 5246956 5246977 5246961 5246956 -
tacttcaacatgctttactcta

SEQ ID NO: 140436 - DNA, 22 bp, Artificial Sequence
  Synthetic oligonucleotide; TTT chr11 5246955 5246976 5246960 5246955 -
acttcaacatgctttactctag

SEQ ID NO: 140437 - DNA, 22 bp, Artificial Sequence
  Synthetic oligonucleotide; TTA chr11 5246954 5246975 5246959 5246954 -
cttcaacatgctttactctagc

SEQ ID NO: 140438 - DNA, 22 bp, Artificial Sequence
  Synthetic oligonucleotide; CTT chr11 5246951 5246972 5246956 5246951 -
caacatgctttactctagcctt

SEQ ID NO: 140439 - DNA, 22 bp, Artificial Sequence
  Synthetic oligonucleotide; TTC chr11 5246950 5246971 5246955 5246950 -
aacatgctttactctagccttg

SEQ ID NO: 140440 - DNA, 22 bp, Artificial Sequence
  Synthetic oligonucleotide; CTT chr11 5246941 5246962 5246946 5246941 -
tactctagccttgtaatgtctt

SEQ ID NO: 140441 - DNA, 22 bp, Artificial Sequence
  Synthetic oligonucleotide; TTT chr11 5246940 5246961 5246945 5246940 -
actctagccttgtaatgtcttt

SEQ ID NO: 140442 - DNA, 22 bp, Artificial Sequence
  Synthetic oligonucleotide; TTA chr11 5246939 5246960 5246944 5246939 -
ctctagccttgtaatgtcttta

SEQ ID NO: 140443 - DNA, 22 bp, Artificial Sequence
  Synthetic oligonucleotide; CTC chr11 5246936 5246957 5246941 5246936 -
tagccttgtaatgtctttacat

SEQ ID NO: 140444 - DNA, 22 bp, Artificial Sequence
  Synthetic oligonucleotide; CTA chr11 5246934 5246955 5246939 5246934 -
gccttgtaatgtctttacatac

SEQ ID NO: 140445 - DNA, 22 bp, Artificial Sequence
  Synthetic oligonucleotide; CTT chr11 5246929 5246950 5246934 5246929 -
gtaatgtctttacatacagtga

SEQ ID NO: 140446 - DNA, 22 bp, Artificial Sequence
  Synthetic oligonucleotide; TTG chr11 5246928 5246949 5246933 5246928 -
taatgtctttacatacagtgaa

SEQ ID NO: 140447 - DNA, 22 bp, Artificial Sequence
  Synthetic oligonucleotide; CTT chr11 5246919 5246940 5246924 5246919 -
tacatacagtgaaatgtaaagt

SEQ ID NO: 140448 - DNA, 22 bp, Artificial Sequence
  Synthetic oligonucleotide; TTT chr11 5246918 5246939 5246923 5246918 -
acatacagtgaaatgtaaagtt

SEQ ID NO: 140449 - DNA, 22 bp, Artificial Sequence
  Synthetic oligonucleotide; TTA chr11 5246917 5246938 5246922 5246917 -
catacagtgaaatgtaaagttc

SEQ ID NO: 140450 - DNA, 22 bp, Artificial Sequence
  Synthetic oligonucleotide; TTC chr11 5246895 5246916 5246900 5246895 -
tttattctttttttctttcttt

SEQ ID NO: 140451 - DNA, 22 bp, Artificial Sequence
  Synthetic oligonucleotide; CTT chr11 5246893 5246914 5246898 5246893 -
tattctttttttctttctttct

SEQ ID NO: 140452 - DNA, 22 bp, Artificial Sequence
  Synthetic oligonucleotide; TTT chr11 5246892 5246913 5246897 5246892 -
attctttttttctttctttctt

SEQ ID NO: 140453 - DNA, 22 bp, Artificial Sequence
  Synthetic oligonucleotide; TTA chr11 5246891 5246912 5246896 5246891 -
ttctttttttctttctttcttt

SEQ ID NO: 140454 - DNA, 22 bp, Artificial Sequence
  Synthetic oligonucleotide; TTC chr11 5246888 5246909 5246893 5246888 -
tttttttctttctttctttttt

SEQ ID NO: 140455 - DNA, 22 bp, Artificial Sequence
  Synthetic oligonucleotide; CTT chr11 5246886 5246907 5246891 5246886 -
tttttctttctttcttttttct

SEQ ID NO: 140456 - DNA, 22 bp, Artificial Sequence
  Synthetic oligonucleotide; TTT chr11 5246885 5246906 5246890 5246885 -
ttttctttctttcttttttctc

SEQ ID NO: 140457 - DNA, 22 bp, Artificial Sequence
  Synthetic oligonucleotide; TTT chr11 5246884 5246905 5246889 5246884 -
tttctttctttcttttttctcc

SEQ ID NO: 140458 - DNA, 22 bp, Artificial Sequence
  Synthetic oligonucleotide; TTT chr11 5246883 5246904 5246888 5246883 -
ttctttctttcttttttctcct

SEQ ID NO: 140459 - DNA, 22 bp, Artificial Sequence
  Synthetic oligonucleotide; TTT chr11 5246882 5246903 5246887 5246882 -
tctttctttcttttttctcctc

SEQ ID NO: 140460 - DNA, 22 bp, Artificial Sequence
  Synthetic oligonucleotide; TTT chr11 5246881 5246902 5246886 5246881 -
ctttctttcttttttctcctca

SEQ ID NO: 140461 - DNA, 22 bp, Artificial Sequence
  Synthetic oligonucleotide; TTC chr11 5246880 5246901 5246885 5246880 -
tttctttcttttttctcctcag

SEQ ID NO: 140462 - DNA, 22 bp, Artificial Sequence
  Synthetic oligonucleotide; CTT chr11 5246878 5246899 5246883 5246878 -
tctttcttttttctcctcagcc

SEQ ID NO: 140463 - DNA, 22 bp, Artificial Sequence
  Synthetic oligonucleotide; TTT chr11 5246877 5246898 5246882 5246877 -
ctttcttttttctcctcagcct

SEQ ID NO: 140464 - DNA, 22 bp, Artificial Sequence
  Synthetic oligonucleotide; TTC chr11 5246876 5246897 5246881 5246876 -
tttcttttttctcctcagcctc

SEQ ID NO: 140465 - DNA, 22 bp, Artificial Sequence
  Synthetic oligonucleotide; CTT chr11 5246874 5246895 5246879 5246874 -
tcttttttctcctcagcctcag

SEQ ID NO: 140466 - DNA, 22 bp, Artificial Sequence
  Synthetic oligonucleotide; TTT chr11 5246873 5246894 5246878 5246873 -
cttttttctcctcagcctcaga

SEQ ID NO: 140467 - DNA, 22 bp, Artificial Sequence
  Synthetic oligonucleotide; TTC chr11 5246872 5246893 5246877 5246872 -
ttttttctcctcagcctcagaa

SEQ ID NO: 140468 - DNA, 22 bp, Artificial Sequence
  Synthetic oligonucleotide; CTT chr11 5246870 5246891 5246875 5246870 -
ttttctcctcagcctcagaatt

SEQ ID NO: 140469 - DNA, 22 bp, Artificial Sequence
  Synthetic oligonucleotide; TTT chr11 5246869 5246890 5246874 5246869 -
tttctcctcagcctcagaattt

SEQ ID NO: 140470 - DNA, 22 bp, Artificial Sequence
  Synthetic oligonucleotide; TTT chr11 5246868 5246889 5246873 5246868 -
ttctcctcagcctcagaatttg

SEQ ID NO: 140471 - DNA, 22 bp, Artificial Sequence
  Synthetic oligonucleotide; TTT chr11 5246867 5246888 5246872 5246867 -
tctcctcagcctcagaatttgg

SEQ ID NO: 140472 - DNA, 22 bp, Artificial Sequence
  Synthetic oligonucleotide; TTT chr11 5246866 5246887 5246871 5246866 -
ctcctcagcctcagaatttggc

SEQ ID NO: 140473 - DNA, 22 bp, Artificial Sequence
  Synthetic oligonucleotide; TTC chr11 5246865 5246886 5246870 5246865 -
tcctcagcctcagaatttggca

SEQ ID NO: 140474 - DNA, 22 bp, Artificial Sequence
  Synthetic oligonucleotide; CTC chr11 5246863 5246884 5246868 5246863 -
ctcagcctcagaatttggcaca

SEQ ID NO: 140475 - DNA, 22 bp, Artificial Sequence
  Synthetic oligonucleotide; CTC chr11 5246860 5246881 5246865 5246860 -
agcctcagaatttggcacatgc

SEQ ID NO: 140476 - DNA, 22 bp, Artificial Sequence
  Synthetic oligonucleotide; CTC chr11 5246854 5246875 5246859 5246854 -
agaatttggcacatgcccttcc

SEQ ID NO: 140477 - DNA, 22 bp, Artificial Sequence
  Synthetic oligonucleotide; TTT chr11 5246847 5246868 5246852 5246847 -
ggcacatgcccttccttctttc

SEQ ID NO: 140478 - DNA, 22 bp, Artificial Sequence
  Synthetic oligonucleotide; TTG chr11 5246846 5246867 5246851 5246846 -
gcacatgcccttccttctttca

SEQ ID NO: 140479 - DNA, 22 bp, Artificial Sequence
  Synthetic oligonucleotide; CTT chr11 5246834 5246855 5246839 5246834 -
ccttctttcaggaacttctcca

SEQ ID NO: 140480 - DNA, 22 bp, Artificial Sequence
  Synthetic oligonucleotide; TTC chr11 5246833 5246854 5246838 5246833 -
cttctttcaggaacttctccaa

SEQ ID NO: 140481 - DNA, 22 bp, Artificial Sequence
  Synthetic oligonucleotide; CTT chr11 5246830 5246851 5246835 5246830 -
ctttcaggaacttctccaacat

SEQ ID NO: 140482 - DNA, 22 bp, Artificial Sequence
  Synthetic oligonucleotide; TTC chr11 5246829 5246850 5246834 5246829 -
tttcaggaacttctccaacatc

SEQ ID NO: 140483 - DNA, 22 bp, Artificial Sequence
  Synthetic oligonucleotide; CTT chr11 5246827 5246848 5246832 5246827 -
tcaggaacttctccaacatctc

SEQ ID NO: 140484 - DNA, 22 bp, Artificial Sequence
  Synthetic oligonucleotide; TTT chr11 5246826 5246847 5246831 5246826 -
caggaacttctccaacatctct

SEQ ID NO: 140485 - DNA, 22 bp, Artificial Sequence
  Synthetic oligonucleotide; TTC chr11 5246825 5246846 5246830 5246825 -
aggaacttctccaacatctctg

SEQ ID NO: 140486 - DNA, 22 bp, Artificial Sequence
  Synthetic oligonucleotide; CTT chr11 5246817 5246838 5246822 5246817 -
ctccaacatctctgcctggctc

SEQ ID NO: 140487 - DNA, 22 bp, Artificial Sequence
  Synthetic oligonucleotide; TTC chr11 5246816 5246837 5246821 5246816 -
tccaacatctctgcctggctcc

SEQ ID NO: 140488 - DNA, 22 bp, Artificial Sequence
  Synthetic oligonucleotide; CTC chr11 5246814 5246835 5246819 5246814 -
caacatctctgcctggctccat

SEQ ID NO: 140489 - DNA, 22 bp, Artificial Sequence
  Synthetic oligonucleotide; CTC chr11 5246805 5246826 5246810 5246805 -
tgcctggctccatcatatcata

SEQ ID NO: 140490 - DNA, 22 bp, Artificial Sequence
  Synthetic oligonucleotide; CTG chr11 5246803 5246824 5246808 5246803 -
cctggctccatcatatcataaa

SEQ ID NO: 140491 - DNA, 22 bp, Artificial Sequence
  Synthetic oligonucleotide; CTG chr11 5246799 5246820 5246804 5246799 -
gctccatcatatcataaaggtc

SEQ ID NO: 140492 - DNA, 22 bp, Artificial Sequence
  Synthetic oligonucleotide; CTC chr11 5246795 5246816 5246800 5246795 -
catcatatcataaaggtcccac

SEQ ID NO: 140493 - DNA, 22 bp, Artificial Sequence
  Synthetic oligonucleotide; CTT chr11 5246771 5246792 5246776 5246771 -
caaatgcagtcactaccgtttc

SEQ ID NO: 140494 - DNA, 22 bp, Artificial Sequence
  Synthetic oligonucleotide; TTC chr11 5246770 5246791 5246775 5246770 -
aaatgcagtcactaccgtttca

SEQ ID NO: 140495 - DNA, 22 bp, Artificial Sequence
  Synthetic oligonucleotide; CTA chr11 5246756 5246777 5246761 5246756 -
ccgtttcagaatatgcactttc

SEQ ID NO: 140496 - DNA, 22 bp, Artificial Sequence
  Synthetic oligonucleotide; TTT chr11 5246750 5246771 5246755 5246750 -
cagaatatgcactttctttctt

SEQ ID NO: 140497 - DNA, 22 bp, Artificial Sequence
  Synthetic oligonucleotide; TTC chr11 5246749 5246770 5246754 5246749 -
agaatatgcactttctttcttt

SEQ ID NO: 140498 - DNA, 22 bp, Artificial Sequence
  Synthetic oligonucleotide; CTT chr11 5246736 5246757 5246741 5246736 -
tctttcttttttgttttttgtt

SEQ ID NO: 140499 - DNA, 22 bp, Artificial Sequence
  Synthetic oligonucleotide; TTT chr11 5246735 5246756 5246740 5246735 -
ctttcttttttgttttttgttt

SEQ ID NO: 140500 - DNA, 22 bp, Artificial Sequence
  Synthetic oligonucleotide; TTC chr11 5246734 5246755 5246739 5246734 -
tttcttttttgttttttgtttt

SEQ ID NO: 140501 - DNA, 22 bp, Artificial Sequence
  Synthetic oligonucleotide; CTT chr11 5246732 5246753 5246737 5246732 -
tcttttttgttttttgtttttt

SEQ ID NO: 140502 - DNA, 22 bp, Artificial Sequence
  Synthetic oligonucleotide; TTT chr11 5246731 5246752 5246736 5246731 -
cttttttgttttttgttttttt

SEQ ID NO: 140503 - DNA, 22 bp, Artificial Sequence
  Synthetic oligonucleotide; TTC chr11 5246730 5246751 5246735 5246730 -
ttttttgttttttgtttttttt

SEQ ID NO: 140504 - DNA, 22 bp, Artificial Sequence
  Synthetic oligonucleotide; CTT chr11 5246728 5246749 5246733 5246728 -
ttttgttttttgttttttttaa

SEQ ID NO: 140505 - DNA, 22 bp, Artificial Sequence
  Synthetic oligonucleotide; TTT chr11 5246727 5246748 5246732 5246727 -
tttgttttttgttttttttaag

SEQ ID NO: 140506 - DNA, 22 bp, Artificial Sequence
  Synthetic oligonucleotide; TTT chr11 5246726 5246747 5246731 5246726 -
ttgttttttgttttttttaagt

SEQ ID NO: 140507 - DNA, 22 bp, Artificial Sequence
  Synthetic oligonucleotide; TTT chr11 5246725 5246746 5246730 5246725 -
tgttttttgttttttttaagtc

SEQ ID NO: 140508 - DNA, 22 bp, Artificial Sequence
  Synthetic oligonucleotide; TTT chr11 5246724 5246745 5246729 5246724 -
gttttttgttttttttaagtca

SEQ ID NO: 140509 - DNA, 22 bp, Artificial Sequence
  Synthetic oligonucleotide; TTG chr11 5246723 5246744 5246728 5246723 -
ttttttgttttttttaagtcaa

SEQ ID NO: 140510 - DNA, 22 bp, Artificial Sequence
  Synthetic oligonucleotide; TTT chr11 5246720 5246741 5246725 5246720 -
tttgttttttttaagtcaaagc

SEQ ID NO: 140511 - DNA, 22 bp, Artificial Sequence
  Synthetic oligonucleotide; TTT chr11 5246719 5246740 5246724 5246719 -
ttgttttttttaagtcaaagca

SEQ ID NO: 140512 - DNA, 22 bp, Artificial Sequence
  Synthetic oligonucleotide; TTT chr11 5246718 5246739 5246723 5246718 -
tgttttttttaagtcaaagcaa

SEQ ID NO: 140513 - DNA, 22 bp, Artificial Sequence
  Synthetic oligonucleotide; TTT chr11 5246717 5246738 5246722 5246717 -
gttttttttaagtcaaagcaaa

SEQ ID NO: 140514 - DNA, 22 bp, Artificial Sequence
  Synthetic oligonucleotide; TTG chr11 5246716 5246737 5246721 5246716 -
ttttttttaagtcaaagcaaat

SEQ ID NO: 140515 - DNA, 22 bp, Artificial Sequence
  Synthetic oligonucleotide; TTT chr11 5246713 5246734 5246718 5246713 -
tttttaagtcaaagcaaatttc

SEQ ID NO: 140516 - DNA, 22 bp, Artificial Sequence
  Synthetic oligonucleotide; TTT chr11 5246712 5246733 5246717 5246712 -
ttttaagtcaaagcaaatttct

SEQ ID NO: 140517 - DNA, 22 bp, Artificial Sequence
  Synthetic oligonucleotide; TTT chr11 5246711 5246732 5246716 5246711 -
tttaagtcaaagcaaatttctt

SEQ ID NO: 140518 - DNA, 22 bp, Artificial Sequence
  Synthetic oligonucleotide; TTT chr11 5246710 5246731 5246715 5246710 -
ttaagtcaaagcaaatttcttg

SEQ ID NO: 140519 - DNA, 22 bp, Artificial Sequence
  Synthetic oligonucleotide; TTT chr11 5246709 5246730 5246714 5246709 -
taagtcaaagcaaatttcttga

SEQ ID NO: 140520 - DNA, 22 bp, Artificial Sequence
  Synthetic oligonucleotide; TTT chr11 5246708 5246729 5246713 5246708 -
aagtcaaagcaaatttcttgag

SEQ ID NO: 140521 - DNA, 22 bp, Artificial Sequence
  Synthetic oligonucleotide; TTA chr11 5246707 5246728 5246712 5246707 -
agtcaaagcaaatttcttgaga

SEQ ID NO: 140522 - DNA, 22 bp, Artificial Sequence
  Synthetic oligonucleotide; TTT chr11 5246692 5246713 5246697 5246692 -
cttgagagagtaaagaaataaa

SEQ ID NO: 140523 - DNA, 22 bp, Artificial Sequence
  Synthetic oligonucleotide; TTC chr11 5246691 5246712 5246696 5246691 -
ttgagagagtaaagaaataaac

SEQ ID NO: 140524 - DNA, 22 bp, Artificial Sequence
  Synthetic oligonucleotide; CTT chr11 5246689 5246710 5246694 5246689 -
gagagagtaaagaaataaacga

SEQ ID NO: 140525 - DNA, 22 bp, Artificial Sequence
  Synthetic oligonucleotide; TTG chr11 5246688 5246709 5246693 5246688 -
agagagtaaagaaataaacgaa

SEQ ID NO: 140526 - DNA, 22 bp, Artificial Sequence
  Synthetic oligonucleotide; CTA chr11 5246660 5246681 5246665 5246660 -
ctgcataggcagagcagccccg

SEQ ID NO: 140527 - DNA, 22 bp, Artificial Sequence
  Synthetic oligonucleotide; CTG chr11 5246657 5246678 5246662 5246657 -
cataggcagagcagccccgagg

SEQ ID NO: 140528 - DNA, 22 bp, Artificial Sequence
  Synthetic oligonucleotide; CTG chr11 5246628 5246649 5246633 5246628 -
gttgttccttttatggttattt

SEQ ID NO: 140529 - DNA, 22 bp, Artificial Sequence
  Synthetic oligonucleotide; TTG chr11 5246624 5246645 5246629 5246624 -
ttccttttatggttatttcttg

SEQ ID NO: 140530 - DNA, 22 bp, Artificial Sequence
  Synthetic oligonucleotide; TTC chr11 5246621 5246642 5246626 5246621 -
cttttatggttatttcttgatg

SEQ ID NO: 140531 - DNA, 22 bp, Artificial Sequence
  Synthetic oligonucleotide; CTT chr11 5246618 5246639 5246623 5246618 -
ttatggttatttcttgatgata

SEQ ID NO: 140532 - DNA, 22 bp, Artificial Sequence
  Synthetic oligonucleotide; TTT chr11 5246617 5246638 5246622 5246617 -
tatggttatttcttgatgatat

SEQ ID NO: 140533 - DNA, 22 bp, Artificial Sequence
  Synthetic oligonucleotide; TTT chr11 5246616 5246637 5246621 5246616 -
atggttatttcttgatgatatg

SEQ ID NO: 140534 - DNA, 22 bp, Artificial Sequence
  Synthetic oligonucleotide; TTA chr11 5246615 5246636 5246620 5246615 -
tggttatttcttgatgatatgt

SEQ ID NO: 140535 - DNA, 22 bp, Artificial Sequence
  Synthetic oligonucleotide; TTA chr11 5246609 5246630 5246614 5246609 -
tttcttgatgatatgttaaaca

SEQ ID NO: 140536 - DNA, 22 bp, Artificial Sequence
  Synthetic oligonucleotide; TTT chr11 5246606 5246627 5246611 5246606 -
cttgatgatatgttaaacaagt

SEQ ID NO: 140537 - DNA, 22 bp, Artificial Sequence
  Synthetic oligonucleotide; TTC chr11 5246605 5246626 5246610 5246605 -
ttgatgatatgttaaacaagtt

SEQ ID NO: 140538 - DNA, 22 bp, Artificial Sequence
  Synthetic oligonucleotide; CTT chr11 5246603 5246624 5246608 5246603 -
gatgatatgttaaacaagtttt

SEQ ID NO: 140539 - DNA, 22 bp, Artificial Sequence
  Synthetic oligonucleotide; TTG chr11 5246602 5246623 5246607 5246602 -
atgatatgttaaacaagttttg

SEQ ID NO: 140540 - DNA, 22 bp, Artificial Sequence
  Synthetic oligonucleotide; TTA chr11 5246591 5246612 5246596 5246591 -
aacaagttttggattatttatg

SEQ ID NO: 140541 - DNA, 22 bp, Artificial Sequence
  Synthetic oligonucleotide; TTT chr11 5246582 5246603 5246587 5246582 -
tggattatttatgccttctctt

SEQ ID NO: 140542 - DNA, 22 bp, Artificial Sequence
  Synthetic oligonucleotide; TTT chr11 5246581 5246602 5246586 5246581 -
ggattatttatgccttctcttt

SEQ ID NO: 140543 - DNA, 22 bp, Artificial Sequence
  Synthetic oligonucleotide; TTG chr11 5246580 5246601 5246585 5246580 -
gattatttatgccttctctttt

SEQ ID NO: 140544 - DNA, 22 bp, Artificial Sequence
  Synthetic oligonucleotide; TTA chr11 5246575 5246596 5246580 5246575 -
tttatgccttctctttttaggc

SEQ ID NO: 140545 - DNA, 22 bp, Artificial Sequence
  Synthetic oligonucleotide; TTT chr11 5246572 5246593 5246577 5246572 -
atgccttctctttttaggccat

SEQ ID NO: 140546 - DNA, 22 bp, Artificial Sequence
  Synthetic oligonucleotide; TTA chr11 5246571 5246592 5246576 5246571 -
tgccttctctttttaggccata

SEQ ID NO: 140547 - DNA, 22 bp, Artificial Sequence
  Synthetic oligonucleotide; CTT chr11 5246565 5246586 5246570 5246565 -
ctctttttaggccatatagggt

SEQ ID NO: 140548 - DNA, 22 bp, Artificial Sequence
  Synthetic oligonucleotide; TTC chr11 5246564 5246585 5246569 5246564 -
tctttttaggccatatagggta

SEQ ID NO: 140549 - DNA, 22 bp, Artificial Sequence
  Synthetic oligonucleotide; CTC chr11 5246562 5246583 5246567 5246562 -
tttttaggccatatagggtaac

SEQ ID NO: 140550 - DNA, 22 bp, Artificial Sequence
  Synthetic oligonucleotide; CTT chr11 5246560 5246581 5246565 5246560 -
tttaggccatatagggtaactt

SEQ ID NO: 140551 - DNA, 22 bp, Artificial Sequence
  Synthetic oligonucleotide; TTT chr11 5246559 5246580 5246564 5246559 -
ttaggccatatagggtaacttt

SEQ ID NO: 140552 - DNA, 22 bp, Artificial Sequence
  Synthetic oligonucleotide; TTT chr11 5246558 5246579 5246563 5246558 -
taggccatatagggtaactttc

SEQ ID NO: 140553 - DNA, 22 bp, Artificial Sequence
  Synthetic oligonucleotide; TTT chr11 5246557 5246578 5246562 5246557 -
aggccatatagggtaactttct

SEQ ID NO: 140554 - DNA, 22 bp, Artificial Sequence
  Synthetic oligonucleotide; TTA chr11 5246556 5246577 5246561 5246556 -
ggccatatagggtaactttctg

SEQ ID NO: 140555 - DNA, 22 bp, Artificial Sequence
  Synthetic oligonucleotide; CTT chr11 5246538 5246559 5246543 5246538 -
tctgacattgccatggcatttt

SEQ ID NO: 140556 - DNA, 22 bp, Artificial Sequence
  Synthetic oligonucleotide; TTT chr11 5246537 5246558 5246542 5246537 -
ctgacattgccatggcattttt

SEQ ID NO: 140557 - DNA, 22 bp, Artificial Sequence
  Synthetic oligonucleotide; TTC chr11 5246536 5246557 5246541 5246536 -
tgacattgccatggcatttttc

SEQ ID NO: 140558 - DNA, 22 bp, Artificial Sequence
  Synthetic oligonucleotide; CTG chr11 5246534 5246555 5246539 5246534 -
acattgccatggcatttttctt

SEQ ID NO: 140559 - DNA, 22 bp, Artificial Sequence
  Synthetic oligonucleotide; TTG chr11 5246528 5246549 5246533 5246528 -
ccatggcatttttcttttaatt

SEQ ID NO: 140560 - DNA, 22 bp, Artificial Sequence
  Synthetic oligonucleotide; TTT chr11 5246517 5246538 5246522 5246517 -
ttcttttaatttaatttactgt

SEQ ID NO: 140561 - DNA, 22 bp, Artificial Sequence
  Synthetic oligonucleotide; TTT chr11 5246516 5246537 5246521 5246516 -
tcttttaatttaatttactgtt

SEQ ID NO: 140562 - DNA, 22 bp, Artificial Sequence
  Synthetic oligonucleotide; TTT chr11 5246515 5246536 5246520 5246515 -
cttttaatttaatttactgtta

SEQ ID NO: 140563 - DNA, 22 bp, Artificial Sequence
  Synthetic oligonucleotide; TTC chr11 5246514 5246535 5246519 5246514 -
ttttaatttaatttactgttac

SEQ ID NO: 140564 - DNA, 22 bp, Artificial Sequence
  Synthetic oligonucleotide; CTT chr11 5246512 5246533 5246517 5246512 -
ttaatttaatttactgttacct

SEQ ID NO: 140565 - DNA, 22 bp, Artificial Sequence
  Synthetic oligonucleotide; TTT chr11 5246511 5246532 5246516 5246511 -
taatttaatttactgttacctt

SEQ ID NO: 140566 - DNA, 22 bp, Artificial Sequence
  Synthetic oligonucleotide; TTT chr11 5246510 5246531 5246515 5246510 -
aatttaatttactgttacctta

SEQ ID NO: 140567 - DNA, 22 bp, Artificial Sequence
  Synthetic oligonucleotide; TTA chr11 5246509 5246530 5246514 5246509 -
atttaatttactgttaccttaa

SEQ ID NO: 140568 - DNA, 22 bp, Artificial Sequence
  Synthetic oligonucleotide; TTT chr11 5246505 5246526 5246510 5246505 -
aatttactgttaccttaaattc

SEQ ID NO: 140569 - DNA, 22 bp, Artificial Sequence
  Synthetic oligonucleotide; TTA chr11 5246504 5246525 5246509 5246504 -
atttactgttaccttaaattca

SEQ ID NO: 140570 - DNA, 22 bp, Artificial Sequence
  Synthetic oligonucleotide; TTT chr11 5246500 5246521 5246505 5246500 -
actgttaccttaaattcagggg

SEQ ID NO: 140571 - DNA, 22 bp, Artificial Sequence
  Synthetic oligonucleotide; TTA chr11 5246499 5246520 5246504 5246499 -
ctgttaccttaaattcaggggt

SEQ ID NO: 140572 - DNA, 22 bp, Artificial Sequence
  Synthetic oligonucleotide; CTG chr11 5246496 5246517 5246501 5246496 -
ttaccttaaattcaggggtaca

SEQ ID NO: 140573 - DNA, 22 bp, Artificial Sequence
  Synthetic oligonucleotide; TTA chr11 5246493 5246514 5246498 5246493 -
ccttaaattcaggggtacacgt

SEQ ID NO: 140574 - DNA, 22 bp, Artificial Sequence
  Synthetic oligonucleotide; CTT chr11 5246489 5246510 5246494 5246489 -
aaattcaggggtacacgtacag

SEQ ID NO: 140575 - DNA, 22 bp, Artificial Sequence
  Synthetic oligonucleotide; TTA chr11 5246488 5246509 5246493 5246488 -
aattcaggggtacacgtacagg

SEQ ID NO: 140576 - DNA, 22 bp, Artificial Sequence
  Synthetic oligonucleotide; TTC chr11 5246483 5246504 5246488 5246483 -
aggggtacacgtacaggatatg

SEQ ID NO: 140577 - DNA, 22 bp, Artificial Sequence
  Synthetic oligonucleotide; TTT chr11 5246454 5246475 5246459 5246454 -
gttttataggtaaaagtgtgcc

SEQ ID NO: 140578 - DNA, 22 bp, Artificial Sequence
  Synthetic oligonucleotide; TTG chr11 5246453 5246474 5246458 5246453 -
ttttataggtaaaagtgtgcca

SEQ ID NO: 140579 - DNA, 22 bp, Artificial Sequence
  Synthetic oligonucleotide; TTT chr11 5246450 5246471 5246455 5246450 -
tataggtaaaagtgtgccatgg

SEQ ID NO: 140580 - DNA, 22 bp, Artificial Sequence
  Synthetic oligonucleotide; TTT chr11 5246449 5246470 5246454 5246449 -
ataggtaaaagtgtgccatggt

SEQ ID NO: 140581 - DNA, 22 bp, Artificial Sequence
  Synthetic oligonucleotide; TTA chr11 5246448 5246469 5246453 5246448 -
taggtaaaagtgtgccatggtt

SEQ ID NO: 140582 - DNA, 22 bp, Artificial Sequence
  Synthetic oligonucleotide; TTT chr11 5246425 5246446 5246430 5246425 -
taatgggttttttttttcttgt

SEQ ID NO: 140583 - DNA, 22 bp, Artificial Sequence
  Synthetic oligonucleotide; TTT chr11 5246424 5246445 5246429 5246424 -
aatgggttttttttttcttgta

SEQ ID NO: 140584 - DNA, 22 bp, Artificial Sequence
  Synthetic oligonucleotide; TTA chr11 5246423 5246444 5246428 5246423 -
atgggttttttttttcttgtaa

SEQ ID NO: 140585 - DNA, 22 bp, Artificial Sequence
  Synthetic oligonucleotide; TTT chr11 5246415 5246436 5246420 5246415 -
tttttttcttgtaaagttgttt

SEQ ID NO: 140586 - DNA, 22 bp, Artificial Sequence
  Synthetic oligonucleotide; TTT chr11 5246414 5246435 5246419 5246414 -
ttttttcttgtaaagttgttta

SEQ ID NO: 140587 - DNA, 22 bp, Artificial Sequence
  Synthetic oligonucleotide; TTT chr11 5246413 5246434 5246418 5246413 -
tttttcttgtaaagttgtttaa

SEQ ID NO: 140588 - DNA, 22 bp, Artificial Sequence
  Synthetic oligonucleotide; TTT chr11 5246412 5246433 5246417 5246412 -
ttttcttgtaaagttgtttaag

SEQ ID NO: 140589 - DNA, 22 bp, Artificial Sequence
  Synthetic oligonucleotide; TTT chr11 5246411 5246432 5246416 5246411 -
tttcttgtaaagttgtttaagt

SEQ ID NO: 140590 - DNA, 22 bp, Artificial Sequence
  Synthetic oligonucleotide; TTT chr11 5246410 5246431 5246415 5246410 -
ttcttgtaaagttgtttaagtt

SEQ ID NO: 140591 - DNA, 22 bp, Artificial Sequence
  Synthetic oligonucleotide; TTT chr11 5246409 5246430 5246414 5246409 -
tcttgtaaagttgtttaagttt

SEQ ID NO: 140592 - DNA, 22 bp, Artificial Sequence
  Synthetic oligonucleotide; TTT chr11 5246408 5246429 5246413 5246408 -
cttgtaaagttgtttaagtttc

SEQ ID NO: 140593 - DNA, 22 bp, Artificial Sequence
  Synthetic oligonucleotide; TTC chr11 5246407 5246428 5246412 5246407 -
ttgtaaagttgtttaagtttct

SEQ ID NO: 140594 - DNA, 22 bp, Artificial Sequence
  Synthetic oligonucleotide; CTT chr11 5246405 5246426 5246410 5246405 -
gtaaagttgtttaagtttcttg

SEQ ID NO: 140595 - DNA, 22 bp, Artificial Sequence
  Synthetic oligonucleotide; TTG chr11 5246404 5246425 5246409 5246404 -
taaagttgtttaagtttcttgt

SEQ ID NO: 140596 - DNA, 22 bp, Artificial Sequence
  Synthetic oligonucleotide; TTG chr11 5246396 5246417 5246401 5246396 -
tttaagtttcttgtttactctg

SEQ ID NO: 140597 - DNA, 22 bp, Artificial Sequence
  Synthetic oligonucleotide; TTT chr11 5246393 5246414 5246398 5246393 -
aagtttcttgtttactctggat

SEQ ID NO: 140598 - DNA, 22 bp, Artificial Sequence
  Synthetic oligonucleotide; TTA chr11 5246392 5246413 5246397 5246392 -
agtttcttgtttactctggata

SEQ ID NO: 140599 - DNA, 22 bp, Artificial Sequence
  Synthetic oligonucleotide; TTT chr11 5246387 5246408 5246392 5246387 -
cttgtttactctggatattagg

SEQ ID NO: 140600 - DNA, 22 bp, Artificial Sequence
  Synthetic oligonucleotide; TTC chr11 5246386 5246407 5246391 5246386 -
ttgtttactctggatattaggc

SEQ ID NO: 140601 - DNA, 22 bp, Artificial Sequence
  Synthetic oligonucleotide; CTT chr11 5246384 5246405 5246389 5246384 -
gtttactctggatattaggcct

SEQ ID NO: 140602 - DNA, 22 bp, Artificial Sequence
  Synthetic oligonucleotide; TTG chr11 5246383 5246404 5246388 5246383 -
tttactctggatattaggcctt

SEQ ID NO: 140603 - DNA, 22 bp, Artificial Sequence
  Synthetic oligonucleotide; TTT chr11 5246380 5246401 5246385 5246380 -
actctggatattaggcctttgt

SEQ ID NO: 140604 - DNA, 22 bp, Artificial Sequence
  Synthetic oligonucleotide; TTA chr11 5246379 5246400 5246384 5246379 -
ctctggatattaggcctttgtc

SEQ ID NO: 140605 - DNA, 22 bp, Artificial Sequence
  Synthetic oligonucleotide; CTC chr11 5246376 5246397 5246381 5246376 -
tggatattaggcctttgtcaga

SEQ ID NO: 140606 - DNA, 22 bp, Artificial Sequence
  Synthetic oligonucleotide; CTG chr11 5246374 5246395 5246379 5246374 -
gatattaggcctttgtcagaag

SEQ ID NO: 140607 - DNA, 22 bp, Artificial Sequence
  Synthetic oligonucleotide; TTA chr11 5246367 5246388 5246372 5246367 -
ggcctttgtcagaagaatagat

SEQ ID NO: 140608 - DNA, 22 bp, Artificial Sequence
  Synthetic oligonucleotide; CTT chr11 5246361 5246382 5246366 5246361 -
tgtcagaagaatagattggaaa

SEQ ID NO: 140609 - DNA, 22 bp, Artificial Sequence
  Synthetic oligonucleotide; TTT chr11 5246360 5246381 5246365 5246360 -
gtcagaagaatagattggaaaa

SEQ ID NO: 140610 - DNA, 22 bp, Artificial Sequence
  Synthetic oligonucleotide; TTG chr11 5246359 5246380 5246364 5246359 -
tcagaagaatagattggaaaat

SEQ ID NO: 140611 - DNA, 22 bp, Artificial Sequence
  Synthetic oligonucleotide; TTG chr11 5246343 5246364 5246348 5246343 -
gaaaatctttttcccattctgt

SEQ ID NO: 140612 - DNA, 22 bp, Artificial Sequence
  Synthetic oligonucleotide; CTT chr11 5246334 5246355 5246339 5246334 -
tttcccattctgtagattgtct

SEQ ID NO: 140613 - DNA, 22 bp, Artificial Sequence
  Synthetic oligonucleotide; TTT chr11 5246333 5246354 5246338 5246333 -
ttcccattctgtagattgtctt

SEQ ID NO: 140614 - DNA, 22 bp, Artificial Sequence
  Synthetic oligonucleotide; TTT chr11 5246332 5246353 5246337 5246332 -
tcccattctgtagattgtcttt

SEQ ID NO: 140615 - DNA, 22 bp, Artificial Sequence
  Synthetic oligonucleotide; TTT chr11 5246331 5246352 5246336 5246331 -
cccattctgtagattgtctttc

SEQ ID NO: 140616 - DNA, 22 bp, Artificial Sequence
  Synthetic oligonucleotide; TTC chr11 5246330 5246351 5246335 5246330 -
ccattctgtagattgtctttcg

SEQ ID NO: 140617 - DNA, 22 bp, Artificial Sequence
  Synthetic oligonucleotide; TTC chr11 5246324 5246345 5246329 5246324 -
tgtagattgtctttcgctctga

SEQ ID NO: 140618 - DNA, 22 bp, Artificial Sequence
  Synthetic oligonucleotide; CTG chr11 5246322 5246343 5246327 5246322 -
tagattgtctttcgctctgatg

SEQ ID NO: 140619 - DNA, 22 bp, Artificial Sequence
  Synthetic oligonucleotide; TTG chr11 5246315 5246336 5246320 5246315 -
tctttcgctctgatggtagttt

SEQ ID NO: 140620 - DNA, 22 bp, Artificial Sequence
  Synthetic oligonucleotide; CTT chr11 5246311 5246332 5246316 5246311 -
tcgctctgatggtagtttcttt

SEQ ID NO: 140621 - DNA, 22 bp, Artificial Sequence
  Synthetic oligonucleotide; TTT chr11 5246310 5246331 5246315 5246310 -
cgctctgatggtagtttctttt

SEQ ID NO: 140622 - DNA, 22 bp, Artificial Sequence
  Synthetic oligonucleotide; TTC chr11 5246309 5246330 5246314 5246309 -
gctctgatggtagtttcttttg

SEQ ID NO: 140623 - DNA, 22 bp, Artificial Sequence
  Synthetic oligonucleotide; CTC chr11 5246305 5246326 5246310 5246305 -
tgatggtagtttcttttgctga

SEQ ID NO: 140624 - DNA, 22 bp, Artificial Sequence
  Synthetic oligonucleotide; CTG chr11 5246303 5246324 5246308 5246303 -
atggtagtttcttttgctgagc

SEQ ID NO: 140625 - DNA, 22 bp, Artificial Sequence
  Synthetic oligonucleotide; TTT chr11 5246293 5246314 5246298 5246293 -
cttttgctgagcaggagctctt

SEQ ID NO: 140626 - DNA, 22 bp, Artificial Sequence
  Synthetic oligonucleotide; TTC chr11 5246292 5246313 5246297 5246292 -
ttttgctgagcaggagctcttt

SEQ ID NO: 140627 - DNA, 22 bp, Artificial Sequence
  Synthetic oligonucleotide; CTT chr11 5246290 5246311 5246295 5246290 -
ttgctgagcaggagctctttag

SEQ ID NO: 140628 - DNA, 22 bp, Artificial Sequence
  Synthetic oligonucleotide; TTT chr11 5246289 5246310 5246294 5246289 -
tgctgagcaggagctctttagt

SEQ ID NO: 140629 - DNA, 22 bp, Artificial Sequence
  Synthetic oligonucleotide; TTT chr11 5246288 5246309 5246293 5246288 -
gctgagcaggagctctttagtt

SEQ ID NO: 140630 - DNA, 22 bp, Artificial Sequence
  Synthetic oligonucleotide; TTG chr11 5246287 5246308 5246292 5246287 -
ctgagcaggagctctttagttt

SEQ ID NO: 140631 - DNA, 22 bp, Artificial Sequence
  Synthetic oligonucleotide; CTG chr11 5246284 5246305 5246289 5246284 -
agcaggagctctttagtttaat

SEQ ID NO: 140632 - DNA, 22 bp, Artificial Sequence
  Synthetic oligonucleotide; CTC chr11 5246273 5246294 5246278 5246273 -
tttagtttaattagattccatt

SEQ ID NO: 140633 - DNA, 22 bp, Artificial Sequence
  Synthetic oligonucleotide; CTT chr11 5246271 5246292 5246276 5246271 -
tagtttaattagattccattgg

SEQ ID NO: 140634 - DNA, 22 bp, Artificial Sequence
  Synthetic oligonucleotide; TTT chr11 5246270 5246291 5246275 5246270 -
agtttaattagattccattggt

SEQ ID NO: 140635 - DNA, 22 bp, Artificial Sequence
  Synthetic oligonucleotide; TTA chr11 5246269 5246290 5246274 5246269 -
gtttaattagattccattggtc

SEQ ID NO: 140636 - DNA, 22 bp, Artificial Sequence
  Synthetic oligonucleotide; TTT chr11 5246265 5246286 5246270 5246265 -
aattagattccattggtcaatt

SEQ ID NO: 140637 - DNA, 22 bp, Artificial Sequence
  Synthetic oligonucleotide; TTA chr11 5246264 5246285 5246269 5246264 -
attagattccattggtcaattt

SEQ ID NO: 140638 - DNA, 22 bp, Artificial Sequence
  Synthetic oligonucleotide; TTA chr11 5246260 5246281 5246265 5246260 -
gattccattggtcaatttttgc

SEQ ID NO: 140639 - DNA, 22 bp, Artificial Sequence
  Synthetic oligonucleotide; TTC chr11 5246255 5246276 5246260 5246255 -
cattggtcaatttttgcttttg

SEQ ID NO: 140640 - DNA, 22 bp, Artificial Sequence
  Synthetic oligonucleotide; TTG chr11 5246250 5246271 5246255 5246250 -
gtcaatttttgcttttgctgca

SEQ ID NO: 140641 - DNA, 22 bp, Artificial Sequence
  Synthetic oligonucleotide; TTT chr11 5246242 5246263 5246247 5246242 -
ttgcttttgctgcaattgcttt

SEQ ID NO: 140642 - DNA, 22 bp, Artificial Sequence
  Synthetic oligonucleotide; TTT chr11 5246241 5246262 5246246 5246241 -
tgcttttgctgcaattgctttt

SEQ ID NO: 140643 - DNA, 22 bp, Artificial Sequence
  Synthetic oligonucleotide; TTT chr11 5246240 5246261 5246245 5246240 -
gcttttgctgcaattgcttttc

SEQ ID NO: 140644 - DNA, 22 bp, Artificial Sequence
  Synthetic oligonucleotide; TTG chr11 5246239 5246260 5246244 5246239 -
cttttgctgcaattgcttttca

SEQ ID NO: 140645 - DNA, 22 bp, Artificial Sequence
  Synthetic oligonucleotide; CTT chr11 5246236 5246257 5246241 5246236 -
ttgctgcaattgcttttcacgc

SEQ ID NO: 140646 - DNA, 22 bp, Artificial Sequence
  Synthetic oligonucleotide; TTT chr11 5246235 5246256 5246240 5246235 -
tgctgcaattgcttttcacgct

SEQ ID NO: 140647 - DNA, 22 bp, Artificial Sequence
  Synthetic oligonucleotide; TTT chr11 5246234 5246255 5246239 5246234 -
gctgcaattgcttttcacgctt

SEQ ID NO: 140648 - DNA, 22 bp, Artificial Sequence
  Synthetic oligonucleotide; TTG chr11 5246233 5246254 5246238 5246233 -
ctgcaattgcttttcacgcttt

SEQ ID NO: 140649 - DNA, 22 bp, Artificial Sequence
  Synthetic oligonucleotide; CTG chr11 5246230 5246251 5246235 5246230 -
caattgcttttcacgctttcat

SEQ ID NO: 140650 - DNA, 22 bp, Artificial Sequence
  Synthetic oligonucleotide; TTG chr11 5246224 5246245 5246229 5246224 -
cttttcacgctttcatcatgaa

SEQ ID NO: 140651 - DNA, 22 bp, Artificial Sequence
  Synthetic oligonucleotide; CTT chr11 5246221 5246242 5246226 5246221 -
ttcacgctttcatcatgaaatc

SEQ ID NO: 140652 - DNA, 22 bp, Artificial Sequence
  Synthetic oligonucleotide; TTT chr11 5246220 5246241 5246225 5246220 -
tcacgctttcatcatgaaatct

SEQ ID NO: 140653 - DNA, 22 bp, Artificial Sequence
  Synthetic oligonucleotide; TTT chr11 5246219 5246240 5246224 5246219 -
cacgctttcatcatgaaatctg

SEQ ID NO: 140654 - DNA, 22 bp, Artificial Sequence
  Synthetic oligonucleotide; TTC chr11 5246218 5246239 5246223 5246218 -
acgctttcatcatgaaatctgt

SEQ ID NO: 140655 - DNA, 22 bp, Artificial Sequence
  Synthetic oligonucleotide; CTT chr11 5246212 5246233 5246217 5246212 -
tcatcatgaaatctgtgcccgt

SEQ ID NO: 140656 - DNA, 22 bp, Artificial Sequence
  Synthetic oligonucleotide; TTT chr11 5246211 5246232 5246216 5246211 -
catcatgaaatctgtgcccgtg

SEQ ID NO: 140657 - DNA, 22 bp, Artificial Sequence
  Synthetic oligonucleotide; TTC chr11 5246210 5246231 5246215 5246210 -
atcatgaaatctgtgcccgtgt

SEQ ID NO: 140658 - DNA, 22 bp, Artificial Sequence
  Synthetic oligonucleotide; CTG chr11 5246197 5246218 5246202 5246197 -
tgcccgtgtttatatcatgaat

SEQ ID NO: 140659 - DNA, 22 bp, Artificial Sequence
  Synthetic oligonucleotide; TTT chr11 5246186 5246207 5246191 5246186 -
atatcatgaatagtattgcctt

SEQ ID NO: 140660 - DNA, 22 bp, Artificial Sequence
  Synthetic oligonucleotide; TTA chr11 5246185 5246206 5246190 5246185 -
tatcatgaatagtattgccttg

SEQ ID NO: 140661 - DNA, 22 bp, Artificial Sequence
  Synthetic oligonucleotide; TTG chr11 5246168 5246189 5246173 5246168 -
ccttgatttttttctaggcttt

SEQ ID NO: 140662 - DNA, 22 bp, Artificial Sequence
  Synthetic oligonucleotide; CTT chr11 5246164 5246185 5246169 5246164 -
gatttttttctaggctttttat

SEQ ID NO: 140663 - DNA, 22 bp, Artificial Sequence
  Synthetic oligonucleotide; TTG chr11 5246163 5246184 5246168 5246163 -
atttttttctaggctttttata

SEQ ID NO: 140664 - DNA, 22 bp, Artificial Sequence
  Synthetic oligonucleotide; TTT chr11 5246159 5246180 5246164 5246159 -
ttttctaggctttttatagttt

SEQ ID NO: 140665 - DNA, 22 bp, Artificial Sequence
  Synthetic oligonucleotide; TTT chr11 5246158 5246179 5246163 5246158 -
tttctaggctttttatagtttg

SEQ ID NO: 140666 - DNA, 22 bp, Artificial Sequence
  Synthetic oligonucleotide; TTT chr11 5246157 5246178 5246162 5246157 -
ttctaggctttttatagtttgg

SEQ ID NO: 140667 - DNA, 22 bp, Artificial Sequence
  Synthetic oligonucleotide; TTT chr11 5246156 5246177 5246161 5246156 -
tctaggctttttatagtttggg

SEQ ID NO: 140668 - DNA, 22 bp, Artificial Sequence
  Synthetic oligonucleotide; TTT chr11 5246155 5246176 5246160 5246155 -
ctaggctttttatagtttgggg

SEQ ID NO: 140669 - DNA, 22 bp, Artificial Sequence
  Synthetic oligonucleotide; TTC chr11 5246154 5246175 5246159 5246154 -
taggctttttatagtttggggt

SEQ ID NO: 140670 - DNA, 22 bp, Artificial Sequence
  Synthetic oligonucleotide; CTA chr11 5246152 5246173 5246157 5246152 -
ggctttttatagtttggggttt

SEQ ID NO: 140671 - DNA, 22 bp, Artificial Sequence
  Synthetic oligonucleotide; CTT chr11 5246147 5246168 5246152 5246147 -
tttatagtttggggtttttcat

SEQ ID NO: 140672 - DNA, 22 bp, Artificial Sequence
  Synthetic oligonucleotide; TTT chr11 5246146 5246167 5246151 5246146 -
ttatagtttggggtttttcatt

SEQ ID NO: 140673 - DNA, 22 bp, Artificial Sequence
  Synthetic oligonucleotide; TTT chr11 5246145 5246166 5246150 5246145 -
tatagtttggggtttttcattt

SEQ ID NO: 140674 - DNA, 22 bp, Artificial Sequence
  Synthetic oligonucleotide; TTT chr11 5246144 5246165 5246149 5246144 -
atagtttggggtttttcattta

SEQ ID NO: 140675 - DNA, 22 bp, Artificial Sequence
  Synthetic oligonucleotide; TTA chr11 5246143 5246164 5246148 5246143 -
tagtttggggtttttcatttaa

SEQ ID NO: 140676 - DNA, 22 bp, Artificial Sequence
  Synthetic oligonucleotide; TTT chr11 5246137 5246158 5246142 5246137 -
ggggtttttcatttaagtctct

SEQ ID NO: 140677 - DNA, 22 bp, Artificial Sequence
  Synthetic oligonucleotide; TTG chr11 5246136 5246157 5246141 5246136 -
gggtttttcatttaagtctcta

SEQ ID NO: 140678 - DNA, 22 bp, Artificial Sequence
  Synthetic oligonucleotide; TTT chr11 5246130 5246151 5246135 5246130 -
ttcatttaagtctctaatccat

SEQ ID NO: 140679 - DNA, 22 bp, Artificial Sequence
  Synthetic oligonucleotide; TTT chr11 5246129 5246150 5246134 5246129 -
tcatttaagtctctaatccatc

SEQ ID NO: 140680 - DNA, 22 bp, Artificial Sequence
  Synthetic oligonucleotide; TTT chr11 5246128 5246149 5246133 5246128 -
catttaagtctctaatccatct

SEQ ID NO: 140681 - DNA, 22 bp, Artificial Sequence
  Synthetic oligonucleotide; TTC chr11 5246127 5246148 5246132 5246127 -
atttaagtctctaatccatctg

SEQ ID NO: 140682 - DNA, 22 bp, Artificial Sequence
  Synthetic oligonucleotide; TTT chr11 5246123 5246144 5246128 5246123 -
aagtctctaatccatctggagt

SEQ ID NO: 140683 - DNA, 22 bp, Artificial Sequence
  Synthetic oligonucleotide; TTA chr11 5246122 5246143 5246127 5246122 -
agtctctaatccatctggagtt

SEQ ID NO: 140684 - DNA, 22 bp, Artificial Sequence
  Synthetic oligonucleotide; CTC chr11 5246116 5246137 5246121 5246116 -
taatccatctggagttaatttt

SEQ ID NO: 140685 - DNA, 22 bp, Artificial Sequence
  Synthetic oligonucleotide; CTA chr11 5246114 5246135 5246119 5246114 -
atccatctggagttaattttgg

SEQ ID NO: 140686 - DNA, 22 bp, Artificial Sequence
  Synthetic oligonucleotide; CTG chr11 5246105 5246126 5246110 5246105 -
gagttaattttggataaggtat

SEQ ID NO: 140687 - DNA, 22 bp, Artificial Sequence
  Synthetic oligonucleotide; TTA chr11 5246099 5246120 5246104 5246099 -
attttggataaggtataaggaa

SEQ ID NO: 140688 - DNA, 22 bp, Artificial Sequence
  Synthetic oligonucleotide; TTT chr11 5246095 5246116 5246100 5246095 -
tggataaggtataaggaaggag

SEQ ID NO: 140689 - DNA, 22 bp, Artificial Sequence
  Synthetic oligonucleotide; TTT chr11 5246094 5246115 5246099 5246094 -
ggataaggtataaggaaggagt

SEQ ID NO: 140690 - DNA, 22 bp, Artificial Sequence
  Synthetic oligonucleotide; TTG chr11 5246093 5246114 5246098 5246093 -
gataaggtataaggaaggagtc

SEQ ID NO: 140691 - DNA, 22 bp, Artificial Sequence
  Synthetic oligonucleotide; TTT chr11 5246065 5246086 5246070 5246065 -
catttttcagcatatggctagc

SEQ ID NO: 140692 - DNA, 22 bp, Artificial Sequence
  Synthetic oligonucleotide; TTC chr11 5246064 5246085 5246069 5246064 -
atttttcagcatatggctagcc

SEQ ID NO: 140693 - DNA, 22 bp, Artificial Sequence
  Synthetic oligonucleotide; TTT chr11 5246060 5246081 5246065 5246060 -
ttcagcatatggctagccagtt

SEQ ID NO: 140694 - DNA, 22 bp, Artificial Sequence
  Synthetic oligonucleotide; TTT chr11 5246059 5246080 5246064 5246059 -
tcagcatatggctagccagttc

SEQ ID NO: 140695 - DNA, 22 bp, Artificial Sequence
  Synthetic oligonucleotide; TTT chr11 5246058 5246079 5246063 5246058 -
cagcatatggctagccagttct

SEQ ID NO: 140696 - DNA, 22 bp, Artificial Sequence
  Synthetic oligonucleotide; TTC chr11 5246057 5246078 5246062 5246057 -
agcatatggctagccagttctc

SEQ ID NO: 140697 - DNA, 22 bp, Artificial Sequence
  Synthetic oligonucleotide; CTA chr11 5246045 5246066 5246050 5246045 -
gccagttctcccccatcattta

SEQ ID NO: 140698 - DNA, 22 bp, Artificial Sequence
  Synthetic oligonucleotide; TTC chr11 5246037 5246058 5246042 5246037 -
tcccccatcatttattaaattg

SEQ ID NO: 140699 - DNA, 22 bp, Artificial Sequence
  Synthetic oligonucleotide; CTC chr11 5246035 5246056 5246040 5246035 -
ccccatcatttattaaattgaa

SEQ ID NO: 140700 - DNA, 22 bp, Artificial Sequence
  Synthetic oligonucleotide; TTT chr11 5246024 5246045 5246029 5246024 -
attaaattgaaaatcctttccc

SEQ ID NO: 140701 - DNA, 22 bp, Artificial Sequence
  Synthetic oligonucleotide; TTA chr11 5246023 5246044 5246028 5246023 -
ttaaattgaaaatcctttcccc

SEQ ID NO: 140702 - DNA, 22 bp, Artificial Sequence
  Synthetic oligonucleotide; TTA chr11 5246020 5246041 5246025 5246020 -
aattgaaaatcctttccccatt

SEQ ID NO: 140703 - DNA, 22 bp, Artificial Sequence
  Synthetic oligonucleotide; TTG chr11 5246015 5246036 5246020 5246015 -
aaaatcctttccccattgcttg

SEQ ID NO: 140704 - DNA, 22 bp, Artificial Sequence
  Synthetic oligonucleotide; CTT chr11 5246006 5246027 5246011 5246006 -
tccccattgcttgcttttgtca

SEQ ID NO: 140705 - DNA, 22 bp, Artificial Sequence
  Synthetic oligonucleotide; TTT chr11 5246005 5246026 5246010 5246005 -
ccccattgcttgcttttgtcag

SEQ ID NO: 140706 - DNA, 22 bp, Artificial Sequence
  Synthetic oligonucleotide; TTC chr11 5246004 5246025 5246009 5246004 -
cccattgcttgcttttgtcagg

SEQ ID NO: 140707 - DNA, 22 bp, Artificial Sequence
  Synthetic oligonucleotide; TTG chr11 5245997 5246018 5246002 5245997 -
cttgcttttgtcaggtttctaa

SEQ ID NO: 140708 - DNA, 22 bp, Artificial Sequence
  Synthetic oligonucleotide; CTT chr11 5245994 5246015 5245999 5245994 -
gcttttgtcaggtttctaaaag

SEQ ID NO: 140709 - DNA, 22 bp, Artificial Sequence
  Synthetic oligonucleotide; TTG chr11 5245993 5246014 5245998 5245993 -
cttttgtcaggtttctaaaaga

SEQ ID NO: 140710 - DNA, 22 bp, Artificial Sequence
  Synthetic oligonucleotide; CTT chr11 5245990 5246011 5245995 5245990 -
ttgtcaggtttctaaaagacca

SEQ ID NO: 140711 - DNA, 22 bp, Artificial Sequence
  Synthetic oligonucleotide; TTT chr11 5245989 5246010 5245994 5245989 -
tgtcaggtttctaaaagaccag

SEQ ID NO: 140712 - DNA, 22 bp, Artificial Sequence
  Synthetic oligonucleotide; TTT chr11 5245988 5246009 5245993 5245988 -
gtcaggtttctaaaagaccaga

SEQ ID NO: 140713 - DNA, 22 bp, Artificial Sequence
  Synthetic oligonucleotide; TTG chr11 5245987 5246008 5245992 5245987 -
tcaggtttctaaaagaccagat

SEQ ID NO: 140714 - DNA, 22 bp, Artificial Sequence
  Synthetic oligonucleotide; TTT chr11 5245979 5246000 5245984 5245979 -
ctaaaagaccagatggttgtag

SEQ ID NO: 140715 - DNA, 22 bp, Artificial Sequence
  Synthetic oligonucleotide; TTC chr11 5245978 5245999 5245983 5245978 -
taaaagaccagatggttgtagg

SEQ ID NO: 140716 - DNA, 22 bp, Artificial Sequence
  Synthetic oligonucleotide; CTA chr11 5245976 5245997 5245981 5245976 -
aaagaccagatggttgtaggta

SEQ ID NO: 140717 - DNA, 22 bp, Artificial Sequence
  Synthetic oligonucleotide; TTG chr11 5245960 5245981 5245965 5245960 -
taggtacaatatgcagtttctt

SEQ ID NO: 140718 - DNA, 22 bp, Artificial Sequence
  Synthetic oligonucleotide; TTT chr11 5245941 5245962 5245946 5245941 -
cttcaagtcatataataccatc

SEQ ID NO: 140719 - DNA, 22 bp, Artificial Sequence
  Synthetic oligonucleotide; TTC chr11 5245940 5245961 5245945 5245940 -
ttcaagtcatataataccatct

SEQ ID NO: 140720 - DNA, 22 bp, Artificial Sequence
  Synthetic oligonucleotide; CTT chr11 5245938 5245959 5245943 5245938 -
caagtcatataataccatctga

SEQ ID NO: 140721 - DNA, 22 bp, Artificial Sequence
  Synthetic oligonucleotide; TTC chr11 5245937 5245958 5245942 5245937 -
aagtcatataataccatctgaa

SEQ ID NO: 140722 - DNA, 22 bp, Artificial Sequence
  Synthetic oligonucleotide; CTG chr11 5245917 5245938 5245922 5245917 -
aaatctcttattaattcatttc

SEQ ID NO: 140723 - DNA, 22 bp, Artificial Sequence
  Synthetic oligonucleotide; CTC chr11 5245910 5245931 5245915 5245910 -
ttattaattcatttcttttagt

SEQ ID NO: 140724 - DNA, 22 bp, Artificial Sequence
  Synthetic oligonucleotide; CTT chr11 5245908 5245929 5245913 5245908 -
attaattcatttcttttagtat

SEQ ID NO: 140725 - DNA, 22 bp, Artificial Sequence
  Synthetic oligonucleotide; TTA chr11 5245907 5245928 5245912 5245907 -
ttaattcatttcttttagtatg

SEQ ID NO: 140726 - DNA, 22 bp, Artificial Sequence
  Synthetic oligonucleotide; TTA chr11 5245904 5245925 5245909 5245904 -
attcatttcttttagtatgtat

SEQ ID NO: 140727 - DNA, 22 bp, Artificial Sequence
  Synthetic oligonucleotide; TTC chr11 5245900 5245921 5245905 5245900 -
atttcttttagtatgtatgctg

SEQ ID NO: 140728 - DNA, 22 bp, Artificial Sequence
  Synthetic oligonucleotide; TTT chr11 5245896 5245917 5245901 5245896 -
cttttagtatgtatgctggtct

SEQ ID NO: 140729 - DNA, 22 bp, Artificial Sequence
  Synthetic oligonucleotide; TTC chr11 5245895 5245916 5245900 5245895 -
ttttagtatgtatgctggtctc

SEQ ID NO: 140730 - DNA, 22 bp, Artificial Sequence
  Synthetic oligonucleotide; CTT chr11 5245893 5245914 5245898 5245893 -
ttagtatgtatgctggtctcct

SEQ ID NO: 140731 - DNA, 22 bp, Artificial Sequence
  Synthetic oligonucleotide; TTT chr11 5245892 5245913 5245897 5245892 -
tagtatgtatgctggtctcctc

SEQ ID NO: 140732 - DNA, 22 bp, Artificial Sequence
  Synthetic oligonucleotide; TTT chr11 5245891 5245912 5245896 5245891 -
agtatgtatgctggtctcctct

SEQ ID NO: 140733 - DNA, 22 bp, Artificial Sequence
  Synthetic oligonucleotide; TTA chr11 5245890 5245911 5245895 5245890 -
gtatgtatgctggtctcctctg

SEQ ID NO: 140734 - DNA, 22 bp, Artificial Sequence
  Synthetic oligonucleotide; CTG chr11 5245878 5245899 5245883 5245878 -
gtctcctctgctcactatagtg

SEQ ID NO: 140735 - DNA, 22 bp, Artificial Sequence
  Synthetic oligonucleotide; CTC chr11 5245873 5245894 5245878 5245873 -
ctctgctcactatagtgagggc

SEQ ID NO: 140736 - DNA, 22 bp, Artificial Sequence
  Synthetic oligonucleotide; CTC chr11 5245870 5245891 5245875 5245870 -
tgctcactatagtgagggcacc

SEQ ID NO: 140737 - DNA, 22 bp, Artificial Sequence
  Synthetic oligonucleotide; CTG chr11 5245868 5245889 5245873 5245868 -
ctcactatagtgagggcaccat

SEQ ID NO: 140738 - DNA, 22 bp, Artificial Sequence
  Synthetic oligonucleotide; CTC chr11 5245865 5245886 5245870 5245865 -
actatagtgagggcaccattag

SEQ ID NO: 140739 - DNA, 22 bp, Artificial Sequence
  Synthetic oligonucleotide; CTA chr11 5245861 5245882 5245866 5245861 -
tagtgagggcaccattagccag

SEQ ID NO: 140740 - DNA, 22 bp, Artificial Sequence
  Synthetic oligonucleotide; TTA chr11 5245844 5245865 5245849 5245844 -
gccagagaatctgtctgtctag

SEQ ID NO: 140741 - DNA, 22 bp, Artificial Sequence
  Synthetic oligonucleotide; CTG chr11 5245831 5245852 5245836 5245831 -
tctgtctagttcatgtaagatt

SEQ ID NO: 140742 - DNA, 22 bp, Artificial Sequence
  Synthetic oligonucleotide; CTG chr11 5245827 5245848 5245832 5245827 -
tctagttcatgtaagattctca

SEQ ID NO: 140743 - DNA, 22 bp, Artificial Sequence
  Synthetic oligonucleotide; CTA chr11 5245823 5245844 5245828 5245823 -
gttcatgtaagattctcagaat

SEQ ID NO: 140744 - DNA, 22 bp, Artificial Sequence
  Synthetic oligonucleotide; TTC chr11 5245819 5245840 5245824 5245819 -
atgtaagattctcagaattaag

SEQ ID NO: 140745 - DNA, 22 bp, Artificial Sequence
  Synthetic oligonucleotide; TTC chr11 5245808 5245829 5245813 5245808 -
tcagaattaagaaaaatggatg

SEQ ID NO: 140746 - DNA, 22 bp, Artificial Sequence
  Synthetic oligonucleotide; CTC chr11 5245806 5245827 5245811 5245806 -
agaattaagaaaaatggatggc

SEQ ID NO: 140747 - DNA, 22 bp, Artificial Sequence
  Synthetic oligonucleotide; TTA chr11 5245799 5245820 5245804 5245799 -
agaaaaatggatggcatatgaa

SEQ ID NO: 140748 - DNA, 22 bp, Artificial Sequence
  Synthetic oligonucleotide; CTT chr11 5245769 5245790 5245774 5245769 -
catggatgacatatggaatcta

SEQ ID NO: 140749 - DNA, 22 bp, Artificial Sequence
  Synthetic oligonucleotide; TTC chr11 5245768 5245789 5245773 5245768 -
atggatgacatatggaatctaa

SEQ ID NO: 140750 - DNA, 22 bp, Artificial Sequence
  Synthetic oligonucleotide; CTA chr11 5245747 5245768 5245752 5245747 -
atatgtatttgttgaattaatg

SEQ ID NO: 140751 - DNA, 22 bp, Artificial Sequence
  Synthetic oligonucleotide; TTT chr11 5245737 5245758 5245742 5245737 -
gttgaattaatgcataagatgc

SEQ ID NO: 140752 - DNA, 22 bp, Artificial Sequence
  Synthetic oligonucleotide; TTG chr11 5245736 5245757 5245741 5245736 -
ttgaattaatgcataagatgca

SEQ ID NO: 140753 - DNA, 22 bp, Artificial Sequence
  Synthetic oligonucleotide; TTG chr11 5245733 5245754 5245738 5245733 -
aattaatgcataagatgcaaca

SEQ ID NO: 140754 - DNA, 22 bp, Artificial Sequence
  Synthetic oligonucleotide; TTA chr11 5245728 5245749 5245733 5245728 -
atgcataagatgcaacagagag

SEQ ID NO: 140755 - DNA, 22 bp, Artificial Sequence
  Synthetic oligonucleotide; TTG chr11 5245700 5245721 5245705 5245700 -
acaactgcaatgataacctggt

SEQ ID NO: 140756 - DNA, 22 bp, Artificial Sequence
  Synthetic oligonucleotide; CTG chr11 5245693 5245714 5245698 5245693 -
caatgataacctggtattgatg

SEQ ID NO: 140757 - DNA, 22 bp, Artificial Sequence
  Synthetic oligonucleotide; CTG chr11 5245680 5245701 5245685 5245680 -
gtattgatgatataagagtcta

SEQ ID NO: 140758 - DNA, 22 bp, Artificial Sequence
  Synthetic oligonucleotide; TTG chr11 5245674 5245695 5245679 5245674 -
atgatataagagtctatagatc

SEQ ID NO: 140759 - DNA, 22 bp, Artificial Sequence
  Synthetic oligonucleotide; CTA chr11 5245658 5245679 5245663 5245658 -
tagatcacagtagaagcaataa

SEQ ID NO: 140760 - DNA, 22 bp, Artificial Sequence
  Synthetic oligonucleotide; TTG chr11 5245620 5245641 5245625 5245620 -
gaaatggggaacagccacaaac

SEQ ID NO: 140761 - DNA, 22 bp, Artificial Sequence
  Synthetic oligonucleotide; CTT chr11 5245580 5245601 5245585 5245580 -
ccaggaaagtgactgcaggtca

SEQ ID NO: 140762 - DNA, 22 bp, Artificial Sequence
  Synthetic oligonucleotide; TTC chr11 5245579 5245600 5245584 5245579 -
caggaaagtgactgcaggtcac

SEQ ID NO: 140763 - DNA, 22 bp, Artificial Sequence
  Synthetic oligonucleotide; CTG chr11 5245565 5245586 5245570 5245565 -
caggtcacttttcctggagcgg

SEQ ID NO: 140764 - DNA, 22 bp, Artificial Sequence
  Synthetic oligonucleotide; CTT chr11 5245555 5245576 5245560 5245555 -
ttcctggagcgggtgagagaaa

SEQ ID NO: 140765 - DNA, 22 bp, Artificial Sequence
  Synthetic oligonucleotide; TTT chr11 5245554 5245575 5245559 5245554 -
tcctggagcgggtgagagaaaa

SEQ ID NO: 140766 - DNA, 22 bp, Artificial Sequence
  Synthetic oligonucleotide; TTT chr11 5245553 5245574 5245558 5245553 -
cctggagcgggtgagagaaaag

SEQ ID NO: 140767 - DNA, 22 bp, Artificial Sequence
  Synthetic oligonucleotide; TTC chr11 5245552 5245573 5245557 5245552 -
ctggagcgggtgagagaaaagt

SEQ ID NO: 140768 - DNA, 22 bp, Artificial Sequence
  Synthetic oligonucleotide; CTG chr11 5245549 5245570 5245554 5245549 -
gagcgggtgagagaaaagtgga

SEQ ID NO: 140769 - DNA, 22 bp, Artificial Sequence
  Synthetic oligonucleotide; TTA chr11 5245522 5245543 5245527 5245522 -
gcagtaactgctgaattcctgg

SEQ ID NO: 140770 - DNA, 22 bp, Artificial Sequence
  Synthetic oligonucleotide; CTG chr11 5245512 5245533 5245517 5245512 -
ctgaattcctggttggctgatg

SEQ ID NO: 140771 - DNA, 22 bp, Artificial Sequence
  Synthetic oligonucleotide; CTG chr11 5245509 5245530 5245514 5245509 -
aattcctggttggctgatggaa

SEQ ID NO: 140772 - DNA, 22 bp, Artificial Sequence
  Synthetic oligonucleotide; TTC chr11 5245504 5245525 5245509 5245504 -
ctggttggctgatggaaagatg

SEQ ID NO: 140773 - DNA, 22 bp, Artificial Sequence
  Synthetic oligonucleotide; CTG chr11 5245501 5245522 5245506 5245501 -
gttggctgatggaaagatgggg

SEQ ID NO: 140774 - DNA, 22 bp, Artificial Sequence
  Synthetic oligonucleotide; TTG chr11 5245497 5245518 5245502 5245497 -
gctgatggaaagatggggcagc

SEQ ID NO: 140775 - DNA, 22 bp, Artificial Sequence
  Synthetic oligonucleotide; CTG chr11 5245493 5245514 5245498 5245493 -
atggaaagatggggcagctgtt

SEQ ID NO: 140776 - DNA, 22 bp, Artificial Sequence
  Synthetic oligonucleotide; CTG chr11 5245473 5245494 5245478 5245473 -
ttcactggtacgcagggtttta

SEQ ID NO: 140777 - DNA, 22 bp, Artificial Sequence
  Synthetic oligonucleotide; TTC chr11 5245470 5245491 5245475 5245470 -
actggtacgcagggttttagat

SEQ ID NO: 140778 - DNA, 22 bp, Artificial Sequence
  Synthetic oligonucleotide; CTG chr11 5245466 5245487 5245471 5245466 -
gtacgcagggttttagatgtat

SEQ ID NO: 140779 - DNA, 22 bp, Artificial Sequence
  Synthetic oligonucleotide; TTT chr11 5245453 5245474 5245458 5245453 -
tagatgtatgtacctaaggata

SEQ ID NO: 140780 - DNA, 22 bp, Artificial Sequence
  Synthetic oligonucleotide; TTT chr11 5245452 5245473 5245457 5245452 -
agatgtatgtacctaaggatat

SEQ ID NO: 140781 - DNA, 22 bp, Artificial Sequence
  Synthetic oligonucleotide; TTA chr11 5245451 5245472 5245456 5245451 -
gatgtatgtacctaaggatatg

SEQ ID NO: 140782 - DNA, 22 bp, Artificial Sequence
  Synthetic oligonucleotide; CTA chr11 5245437 5245458 5245442 5245437 -
aggatatgaggtatggcaatga

SEQ ID NO: 140783 - DNA, 22 bp, Artificial Sequence
  Synthetic oligonucleotide; TTC chr11 5245405 5245426 5245410 5245405 -
ttttgggaatgagttttagggc

SEQ ID NO: 140784 - DNA, 22 bp, Artificial Sequence
  Synthetic oligonucleotide; CTT chr11 5245403 5245424 5245408 5245403 -
ttgggaatgagttttagggcca

SEQ ID NO: 140785 - DNA, 22 bp, Artificial Sequence
  Synthetic oligonucleotide; TTT chr11 5245402 5245423 5245407 5245402 -
tgggaatgagttttagggccat

SEQ ID NO: 140786 - DNA, 22 bp, Artificial Sequence
  Synthetic oligonucleotide; TTT chr11 5245401 5245422 5245406 5245401 -
gggaatgagttttagggccatt

SEQ ID NO: 140787 - DNA, 22 bp, Artificial Sequence
  Synthetic oligonucleotide; TTG chr11 5245400 5245421 5245405 5245400 -
ggaatgagttttagggccatta

SEQ ID NO: 140788 - DNA, 22 bp, Artificial Sequence
  Synthetic oligonucleotide; TTT chr11 5245389 5245410 5245394 5245389 -
tagggccattaaaggacatgac

SEQ ID NO: 140789 - DNA, 22 bp, Artificial Sequence
  Synthetic oligonucleotide; TTT chr11 5245388 5245409 5245393 5245388 -
agggccattaaaggacatgacc

SEQ ID NO: 140790 - DNA, 22 bp, Artificial Sequence
  Synthetic oligonucleotide; TTA chr11 5245387 5245408 5245392 5245387 -
gggccattaaaggacatgacct

SEQ ID NO: 140791 - DNA, 22 bp, Artificial Sequence
  Synthetic oligonucleotide; TTA chr11 5245378 5245399 5245383 5245378 -
aaggacatgacctgaagtttcc

SEQ ID NO: 140792 - DNA, 22 bp, Artificial Sequence
  Synthetic oligonucleotide; CTG chr11 5245364 5245385 5245369 5245364 -
aagtttcctctgaggccagtcc

SEQ ID NO: 140793 - DNA, 22 bp, Artificial Sequence
  Synthetic oligonucleotide; TTT chr11 5245358 5245379 5245363 5245358 -
cctctgaggccagtccccacaa

SEQ ID NO: 140794 - DNA, 22 bp, Artificial Sequence
  Synthetic oligonucleotide; TTC chr11 5245357 5245378 5245362 5245357 -
ctctgaggccagtccccacaac

SEQ ID NO: 140795 - DNA, 22 bp, Artificial Sequence
  Synthetic oligonucleotide; CTC chr11 5245354 5245375 5245359 5245354 -
tgaggccagtccccacaactca

SEQ ID NO: 140796 - DNA, 22 bp, Artificial Sequence
  Synthetic oligonucleotide; CTG chr11 5245352 5245373 5245357 5245352 -
aggccagtccccacaactcaat

SEQ ID NO: 140797 - DNA, 22 bp, Artificial Sequence
  Synthetic oligonucleotide; CTC chr11 5245333 5245354 5245338 5245333 -
aatataaatgtgtttcctgcat

SEQ ID NO: 140798 - DNA, 22 bp, Artificial Sequence
  Synthetic oligonucleotide; TTT chr11 5245318 5245339 5245323 5245318 -
cctgcatatagtcaaagttgcc

SEQ ID NO: 140799 - DNA, 22 bp, Artificial Sequence
  Synthetic oligonucleotide; TTC chr11 5245317 5245338 5245322 5245317 -
ctgcatatagtcaaagttgcca

SEQ ID NO: 140800 - DNA, 22 bp, Artificial Sequence
  Synthetic oligonucleotide; CTG chr11 5245314 5245335 5245319 5245314 -
catatagtcaaagttgccactt

SEQ ID NO: 140801 - DNA, 22 bp, Artificial Sequence
  Synthetic oligonucleotide; TTG chr11 5245298 5245319 5245303 5245298 -
ccacttctttttcttcatatca

SEQ ID NO: 140802 - DNA, 22 bp, Artificial Sequence
  Synthetic oligonucleotide; CTT chr11 5245292 5245313 5245297 5245292 -
ctttttcttcatatcatcgatc

SEQ ID NO: 140803 - DNA, 22 bp, Artificial Sequence
  Synthetic oligonucleotide; TTC chr11 5245291 5245312 5245296 5245291 -
tttttcttcatatcatcgatct

SEQ ID NO: 140804 - DNA, 22 bp, Artificial Sequence
  Synthetic oligonucleotide; CTT chr11 5245289 5245310 5245294 5245289 -
tttcttcatatcatcgatctct

SEQ ID NO: 140805 - DNA, 22 bp, Artificial Sequence
  Synthetic oligonucleotide; TTT chr11 5245288 5245309 5245293 5245288 -
ttcttcatatcatcgatctctg

SEQ ID NO: 140806 - DNA, 22 bp, Artificial Sequence
  Synthetic oligonucleotide; TTT chr11 5245287 5245308 5245292 5245287 -
tcttcatatcatcgatctctgc

SEQ ID NO: 140807 - DNA, 22 bp, Artificial Sequence
  Synthetic oligonucleotide; TTT chr11 5245286 5245307 5245291 5245286 -
cttcatatcatcgatctctgct

SEQ ID NO: 140808 - DNA, 22 bp, Artificial Sequence
  Synthetic oligonucleotide; TTC chr11 5245285 5245306 5245290 5245285 -
ttcatatcatcgatctctgctc

SEQ ID NO: 140809 - DNA, 22 bp, Artificial Sequence
  Synthetic oligonucleotide; CTT chr11 5245283 5245304 5245288 5245283 -
catatcatcgatctctgctctt

SEQ ID NO: 140810 - DNA, 22 bp, Artificial Sequence
  Synthetic oligonucleotide; TTC chr11 5245282 5245303 5245287 5245282 -
atatcatcgatctctgctctta

SEQ ID NO: 140811 - DNA, 22 bp, Artificial Sequence
  Synthetic oligonucleotide; CTC chr11 5245268 5245289 5245273 5245268 -
tgctcttaaagataatcttggt

SEQ ID NO: 140812 - DNA, 22 bp, Artificial Sequence
  Synthetic oligonucleotide; CTG chr11 5245266 5245287 5245271 5245266 -
ctcttaaagataatcttggttt

SEQ ID NO: 140813 - DNA, 22 bp, Artificial Sequence
  Synthetic oligonucleotide; CTC chr11 5245263 5245284 5245268 5245263 -
ttaaagataatcttggttttgc

SEQ ID NO: 140814 - DNA, 22 bp, Artificial Sequence
  Synthetic oligonucleotide; CTT chr11 5245261 5245282 5245266 5245261 -
aaagataatcttggttttgcct

SEQ ID NO: 140815 - DNA, 22 bp, Artificial Sequence
  Synthetic oligonucleotide; TTA chr11 5245260 5245281 5245265 5245260 -
aagataatcttggttttgcctc

SEQ ID NO: 140816 - DNA, 22 bp, Artificial Sequence
  Synthetic oligonucleotide; CTT chr11 5245249 5245270 5245254 5245249 -
ggttttgcctcaaactgtttgt

SEQ ID NO: 140817 - DNA, 22 bp, Artificial Sequence
  Synthetic oligonucleotide; TTG chr11 5245248 5245269 5245253 5245248 -
gttttgcctcaaactgtttgtc

SEQ ID NO: 140818 - DNA, 22 bp, Artificial Sequence
  Synthetic oligonucleotide; TTT chr11 5245244 5245265 5245249 5245244 -
tgcctcaaactgtttgtcacta

SEQ ID NO: 140819 - DNA, 22 bp, Artificial Sequence
  Synthetic oligonucleotide; TTT chr11 5245243 5245264 5245248 5245243 -
gcctcaaactgtttgtcactac

SEQ ID NO: 140820 - DNA, 22 bp, Artificial Sequence
  Synthetic oligonucleotide; TTG chr11 5245242 5245263 5245247 5245242 -
cctcaaactgtttgtcactaca

SEQ ID NO: 140821 - DNA, 22 bp, Artificial Sequence
  Synthetic oligonucleotide; CTC chr11 5245238 5245259 5245243 5245238 -
aaactgtttgtcactacaaact

SEQ ID NO: 140822 - DNA, 22 bp, Artificial Sequence
  Synthetic oligonucleotide; CTG chr11 5245232 5245253 5245237 5245232 -
tttgtcactacaaactttcccc

SEQ ID NO: 140823 - DNA, 22 bp, Artificial Sequence
  Synthetic oligonucleotide; TTT chr11 5245229 5245250 5245234 5245229 -
gtcactacaaactttccccatg

SEQ ID NO: 140824 - DNA, 22 bp, Artificial Sequence
  Synthetic oligonucleotide; TTG chr11 5245228 5245249 5245233 5245228 -
tcactacaaactttccccatgt

SEQ ID NO: 140825 - DNA, 22 bp, Artificial Sequence
  Synthetic oligonucleotide; CTA chr11 5245222 5245243 5245227 5245222 -
caaactttccccatgttcctaa

SEQ ID NO: 140826 - DNA, 22 bp, Artificial Sequence
  Synthetic oligonucleotide; CTT chr11 5245215 5245236 5245220 5245215 -
tccccatgttcctaagtaaaac

SEQ ID NO: 140827 - DNA, 22 bp, Artificial Sequence
  Synthetic oligonucleotide; TTT chr11 5245214 5245235 5245219 5245214 -
ccccatgttcctaagtaaaaca

SEQ ID NO: 140828 - DNA, 22 bp, Artificial Sequence
  Synthetic oligonucleotide; TTC chr11 5245213 5245234 5245218 5245213 -
cccatgttcctaagtaaaacag

SEQ ID NO: 140829 - DNA, 22 bp, Artificial Sequence
  Synthetic oligonucleotide; TTC chr11 5245204 5245225 5245209 5245204 -
ctaagtaaaacaggtaactgcc

SEQ ID NO: 140830 - DNA, 22 bp, Artificial Sequence
  Synthetic oligonucleotide; CTA chr11 5245201 5245222 5245206 5245201 -
agtaaaacaggtaactgcctct

SEQ ID NO: 140831 - DNA, 22 bp, Artificial Sequence
  Synthetic oligonucleotide; CTG chr11 5245184 5245205 5245189 5245184 -
cctctcaactatatcaagtaga

SEQ ID NO: 140832 - DNA, 22 bp, Artificial Sequence
  Synthetic oligonucleotide; CTC chr11 5245180 5245201 5245185 5245180 -
tcaactatatcaagtagactaa

SEQ ID NO: 140833 - DNA, 22 bp, Artificial Sequence
  Synthetic oligonucleotide; CTC chr11 5245178 5245199 5245183 5245178 -
aactatatcaagtagactaaaa

SEQ ID NO: 140834 - DNA, 22 bp, Artificial Sequence
  Synthetic oligonucleotide; CTA chr11 5245173 5245194 5245178 5245173 -
tatcaagtagactaaaatattg

SEQ ID NO: 140835 - DNA, 22 bp, Artificial Sequence
  Synthetic oligonucleotide; CTA chr11 5245159 5245180 5245164 5245159 -
aaatattgtgtctctaatatca

SEQ ID NO: 140836 - DNA, 22 bp, Artificial Sequence
  Synthetic oligonucleotide; TTG chr11 5245151 5245172 5245156 5245151 -
tgtctctaatatcagaaattca

SEQ ID NO: 140837 - DNA, 22 bp, Artificial Sequence
  Synthetic oligonucleotide; CTC chr11 5245145 5245166 5245150 5245145 -
taatatcagaaattcagcttta

SEQ ID NO: 140838 - DNA, 22 bp, Artificial Sequence
  Synthetic oligonucleotide; CTA chr11 5245143 5245164 5245148 5245143 -
atatcagaaattcagctttaat

SEQ ID NO: 140839 - DNA, 22 bp, Artificial Sequence
  Synthetic oligonucleotide; TTC chr11 5245130 5245151 5245135 5245130 -
agctttaatatattgggtttaa

SEQ ID NO: 140840 - DNA, 22 bp, Artificial Sequence
  Synthetic oligonucleotide; CTT chr11 5245125 5245146 5245130 5245125 -
taatatattgggtttaactctt

SEQ ID NO: 140841 - DNA, 22 bp, Artificial Sequence
  Synthetic oligonucleotide; TTT chr11 5245124 5245145 5245129 5245124 -
aatatattgggtttaactcttt

SEQ ID NO: 140842 - DNA, 22 bp, Artificial Sequence
  Synthetic oligonucleotide; TTA chr11 5245123 5245144 5245128 5245123 -
atatattgggtttaactctttg

SEQ ID NO: 140843 - DNA, 22 bp, Artificial Sequence
  Synthetic oligonucleotide; TTG chr11 5245115 5245136 5245120 5245115 -
ggtttaactctttgaaatttag

SEQ ID NO: 140844 - DNA, 22 bp, Artificial Sequence
  Synthetic oligonucleotide; TTT chr11 5245110 5245131 5245115 5245110 -
aactctttgaaatttagagtct

SEQ ID NO: 140845 - DNA, 22 bp, Artificial Sequence
  Synthetic oligonucleotide; TTA chr11 5245109 5245130 5245114 5245109 -
actctttgaaatttagagtctc

SEQ ID NO: 140846 - DNA, 22 bp, Artificial Sequence
  Synthetic oligonucleotide; CTC chr11 5245105 5245126 5245110 5245105 -
tttgaaatttagagtctccttg

SEQ ID NO: 140847 - DNA, 22 bp, Artificial Sequence
  Synthetic oligonucleotide; CTT chr11 5245103 5245124 5245108 5245103 -
tgaaatttagagtctccttgaa

SEQ ID NO: 140848 - DNA, 22 bp, Artificial Sequence
  Synthetic oligonucleotide; TTT chr11 5245102 5245123 5245107 5245102 -
gaaatttagagtctccttgaaa

SEQ ID NO: 140849 - DNA, 22 bp, Artificial Sequence
  Synthetic oligonucleotide; TTG chr11 5245101 5245122 5245106 5245101 -
aaatttagagtctccttgaaat

SEQ ID NO: 140850 - DNA, 22 bp, Artificial Sequence
  Synthetic oligonucleotide; TTT chr11 5245095 5245116 5245100 5245095 -
agagtctccttgaaatacacat

SEQ ID NO: 140851 - DNA, 22 bp, Artificial Sequence
  Synthetic oligonucleotide; TTA chr11 5245094 5245115 5245099 5245094 -
gagtctccttgaaatacacatg

SEQ ID NO: 140852 - DNA, 22 bp, Artificial Sequence
  Synthetic oligonucleotide; CTC chr11 5245087 5245108 5245092 5245087 -
cttgaaatacacatgggggtga

SEQ ID NO: 140853 - DNA, 22 bp, Artificial Sequence
  Synthetic oligonucleotide; CTT chr11 5245084 5245105 5245089 5245084 -
gaaatacacatgggggtgattt

SEQ ID NO: 140854 - DNA, 22 bp, Artificial Sequence
  Synthetic oligonucleotide; TTG chr11 5245083 5245104 5245088 5245083 -
aaatacacatgggggtgatttc

SEQ ID NO: 140855 - DNA, 22 bp, Artificial Sequence
  Synthetic oligonucleotide; TTT chr11 5245062 5245083 5245067 5245062 -
cctaaactttatttcttgtaag

SEQ ID NO: 140856 - DNA, 22 bp, Artificial Sequence
  Synthetic oligonucleotide; TTC chr11 5245061 5245082 5245066 5245061 -
ctaaactttatttcttgtaagg

SEQ ID NO: 140857 - DNA, 22 bp, Artificial Sequence
  Synthetic oligonucleotide; CTA chr11 5245058 5245079 5245063 5245058 -
aactttatttcttgtaaggatt

SEQ ID NO: 140858 - DNA, 22 bp, Artificial Sequence
  Synthetic oligonucleotide; CTT chr11 5245053 5245074 5245058 5245053 -
tatttcttgtaaggatttatct

SEQ ID NO: 140859 - DNA, 22 bp, Artificial Sequence
  Synthetic oligonucleotide; TTT chr11 5245052 5245073 5245057 5245052 -
atttcttgtaaggatttatctc

SEQ ID NO: 140860 - DNA, 22 bp, Artificial Sequence
  Synthetic oligonucleotide; TTA chr11 5245051 5245072 5245056 5245051 -
tttcttgtaaggatttatctca

SEQ ID NO: 140861 - DNA, 22 bp, Artificial Sequence
  Synthetic oligonucleotide; TTT chr11 5245048 5245069 5245053 5245048 -
cttgtaaggatttatctcaggg

SEQ ID NO: 140862 - DNA, 22 bp, Artificial Sequence
  Synthetic oligonucleotide; TTC chr11 5245047 5245068 5245052 5245047 -
ttgtaaggatttatctcagggg

SEQ ID NO: 140863 - DNA, 22 bp, Artificial Sequence
  Synthetic oligonucleotide; CTT chr11 5245045 5245066 5245050 5245045 -
gtaaggatttatctcaggggta

SEQ ID NO: 140864 - DNA, 22 bp, Artificial Sequence
  Synthetic oligonucleotide; TTG chr11 5245044 5245065 5245049 5245044 -
taaggatttatctcaggggtaa

SEQ ID NO: 140865 - DNA, 22 bp, Artificial Sequence
  Synthetic oligonucleotide; TTT chr11 5245035 5245056 5245040 5245035 -
atctcaggggtaacacacaaac

SEQ ID NO: 140866 - DNA, 22 bp, Artificial Sequence
  Synthetic oligonucleotide; TTA chr11 5245034 5245055 5245039 5245034 -
tctcaggggtaacacacaaacc

SEQ ID NO: 140867 - DNA, 22 bp, Artificial Sequence
  Synthetic oligonucleotide; CTC chr11 5245030 5245051 5245035 5245030 -
aggggtaacacacaaaccagca

SEQ ID NO: 140868 - DNA, 22 bp, Artificial Sequence
  Synthetic oligonucleotide; CTG chr11 5245003 5245024 5245008 5245003 -
aacctctaagtatgaggacagt

SEQ ID NO: 140869 - DNA, 22 bp, Artificial Sequence
  Synthetic oligonucleotide; CTC chr11 5244997 5245018 5245002 5244997 -
taagtatgaggacagtaagcct

SEQ ID NO: 140870 - DNA, 22 bp, Artificial Sequence
  Synthetic oligonucleotide; CTA chr11 5244995 5245016 5245000 5244995 -
agtatgaggacagtaagcctta

SEQ ID NO: 140871 - DNA, 22 bp, Artificial Sequence
  Synthetic oligonucleotide; CTT chr11 5244974 5244995 5244979 5244974 -
aagaatataaaataaactgttc

SEQ ID NO: 140872 - DNA, 22 bp, Artificial Sequence
  Synthetic oligonucleotide; TTA chr11 5244973 5244994 5244978 5244973 -
agaatataaaataaactgttct

SEQ ID NO: 140873 - DNA, 22 bp, Artificial Sequence
  Synthetic oligonucleotide; CTG chr11 5244955 5244976 5244960 5244955 -
ttcttctctctgccggtggaag

SEQ ID NO: 140874 - DNA, 22 bp, Artificial Sequence
  Synthetic oligonucleotide; TTC chr11 5244952 5244973 5244957 5244952 -
ttctctctgccggtggaagtgt

SEQ ID NO: 140875 - DNA, 22 bp, Artificial Sequence
  Synthetic oligonucleotide; CTT chr11 5244950 5244971 5244955 5244950 -
ctctctgccggtggaagtgtgc

SEQ ID NO: 140876 - DNA, 22 bp, Artificial Sequence
  Synthetic oligonucleotide; TTC chr11 5244949 5244970 5244954 5244949 -
tctctgccggtggaagtgtgcc

SEQ ID NO: 140877 - DNA, 22 bp, Artificial Sequence
  Synthetic oligonucleotide; CTC chr11 5244947 5244968 5244952 5244947 -
tctgccggtggaagtgtgccct

SEQ ID NO: 140878 - DNA, 22 bp, Artificial Sequence
  Synthetic oligonucleotide; CTC chr11 5244945 5244966 5244950 5244945 -
tgccggtggaagtgtgccctgt

SEQ ID NO: 140879 - DNA, 22 bp, Artificial Sequence
  Synthetic oligonucleotide; CTG chr11 5244943 5244964 5244948 5244943 -
ccggtggaagtgtgccctgtct

SEQ ID NO: 140880 - DNA, 22 bp, Artificial Sequence
  Synthetic oligonucleotide; CTG chr11 5244924 5244945 5244929 5244924 -
tctattcctgaaattgcttgtt

SEQ ID NO: 140881 - DNA, 22 bp, Artificial Sequence
  Synthetic oligonucleotide; CTA chr11 5244920 5244941 5244925 5244920 -
ttcctgaaattgcttgtttgag

SEQ ID NO: 140882 - DNA, 22 bp, Artificial Sequence
  Synthetic oligonucleotide; TTC chr11 5244917 5244938 5244922 5244917 -
ctgaaattgcttgtttgagacg

SEQ ID NO: 140883 - DNA, 22 bp, Artificial Sequence
  Synthetic oligonucleotide; CTG chr11 5244914 5244935 5244919 5244914 -
aaattgcttgtttgagacgcat

SEQ ID NO: 140884 - DNA, 22 bp, Artificial Sequence
  Synthetic oligonucleotide; TTG chr11 5244908 5244929 5244913 5244908 -
cttgtttgagacgcatgagacg

SEQ ID NO: 140885 - DNA, 22 bp, Artificial Sequence
  Synthetic oligonucleotide; CTT chr11 5244905 5244926 5244910 5244905 -
gtttgagacgcatgagacgtgc

SEQ ID NO: 140886 - DNA, 22 bp, Artificial Sequence
  Synthetic oligonucleotide; TTG chr11 5244904 5244925 5244909 5244904 -
tttgagacgcatgagacgtgca

SEQ ID NO: 140887 - DNA, 22 bp, Artificial Sequence
  Synthetic oligonucleotide; TTT chr11 5244901 5244922 5244906 5244901 -
gagacgcatgagacgtgcagca

SEQ ID NO: 140888 - DNA, 22 bp, Artificial Sequence
  Synthetic oligonucleotide; TTG chr11 5244900 5244921 5244905 5244900 -
agacgcatgagacgtgcagcac

SEQ ID NO: 140889 - DNA, 22 bp, Artificial Sequence
  Synthetic oligonucleotide; CTG chr11 5244856 5244877 5244861 5244856 -
tggaatattgtcagtgaagaat

SEQ ID NO: 140890 - DNA, 22 bp, Artificial Sequence
  Synthetic oligonucleotide; TTG chr11 5244846 5244867 5244851 5244846 -
tcagtgaagaatgtctttgcct

SEQ ID NO: 140891 - DNA, 22 bp, Artificial Sequence
  Synthetic oligonucleotide; CTT chr11 5244829 5244850 5244834 5244829 -
tgcctgattagatataaagaca

SEQ ID NO: 140892 - DNA, 22 bp, Artificial Sequence
  Synthetic oligonucleotide; TTT chr11 5244828 5244849 5244833 5244828 -
gcctgattagatataaagacaa

SEQ ID NO: 140893 - DNA, 22 bp, Artificial Sequence
  Synthetic oligonucleotide; TTG chr11 5244827 5244848 5244832 5244827 -
cctgattagatataaagacaag

SEQ ID NO: 140894 - DNA, 22 bp, Artificial Sequence
  Synthetic oligonucleotide; CTG chr11 5244823 5244844 5244828 5244823 -
attagatataaagacaagttaa

SEQ ID NO: 140895 - DNA, 22 bp, Artificial Sequence
  Synthetic oligonucleotide; TTA chr11 5244819 5244840 5244824 5244819 -
gatataaagacaagttaaacac

SEQ ID NO: 140896 - DNA, 22 bp, Artificial Sequence
  Synthetic oligonucleotide; TTA chr11 5244802 5244823 5244807 5244802 -
aacacagcattagactatagat

SEQ ID NO: 140897 - DNA, 22 bp, Artificial Sequence
  Synthetic oligonucleotide; TTA chr11 5244790 5244811 5244795 5244790 -
gactatagatcaagcctgtgcc

SEQ ID NO: 140898 - DNA, 22 bp, Artificial Sequence
  Synthetic oligonucleotide; CTA chr11 5244785 5244806 5244790 5244785 -
tagatcaagcctgtgccagaca

SEQ ID NO: 140899 - DNA, 22 bp, Artificial Sequence
  Synthetic oligonucleotide; CTG chr11 5244772 5244793 5244777 5244772 -
tgccagacacaaatgacctaat

SEQ ID NO: 140900 - DNA, 22 bp, Artificial Sequence
  Synthetic oligonucleotide; CTA chr11 5244752 5244773 5244757 5244752 -
atgcccagcacgggccacggaa

SEQ ID NO: 140901 - DNA, 22 bp, Artificial Sequence
  Synthetic oligonucleotide; CTC chr11 5244726 5244747 5244731 5244726 -
ctatcctcttgcttgaacagag

SEQ ID NO: 140902 - DNA, 22 bp, Artificial Sequence
  Synthetic oligonucleotide; CTA chr11 5244723 5244744 5244728 5244723 -
tcctcttgcttgaacagagcag

SEQ ID NO: 140903 - DNA, 22 bp, Artificial Sequence
  Synthetic oligonucleotide; CTC chr11 5244718 5244739 5244723 5244718 -
ttgcttgaacagagcagcacac

SEQ ID NO: 140904 - DNA, 22 bp, Artificial Sequence
  Synthetic oligonucleotide; CTT chr11 5244716 5244737 5244721 5244716 -
gcttgaacagagcagcacactt

SEQ ID NO: 140905 - DNA, 22 bp, Artificial Sequence
  Synthetic oligonucleotide; TTG chr11 5244715 5244736 5244720 5244715 -
cttgaacagagcagcacacttc

SEQ ID NO: 140906 - DNA, 22 bp, Artificial Sequence
  Synthetic oligonucleotide; CTT chr11 5244712 5244733 5244717 5244712 -
gaacagagcagcacacttctcc

SEQ ID NO: 140907 - DNA, 22 bp, Artificial Sequence
  Synthetic oligonucleotide; TTG chr11 5244711 5244732 5244716 5244711 -
aacagagcagcacacttctccc

SEQ ID NO: 140908 - DNA, 22 bp, Artificial Sequence
  Synthetic oligonucleotide; CTT chr11 5244694 5244715 5244699 5244694 -
ctcccccaacactattagatgt

SEQ ID NO: 140909 - DNA, 22 bp, Artificial Sequence
  Synthetic oligonucleotide; TTC chr11 5244693 5244714 5244698 5244693 -
tcccccaacactattagatgtt

SEQ ID NO: 140910 - DNA, 22 bp, Artificial Sequence
  Synthetic oligonucleotide; CTC chr11 5244691 5244712 5244696 5244691 -
ccccaacactattagatgttct

SEQ ID NO: 140911 - DNA, 22 bp, Artificial Sequence
  Synthetic oligonucleotide; CTA chr11 5244680 5244701 5244685 5244680 -
ttagatgttctggcataatttt

SEQ ID NO: 140912 - DNA, 22 bp, Artificial Sequence
  Synthetic oligonucleotide; TTA chr11 5244677 5244698 5244682 5244677 -
gatgttctggcataattttgta

SEQ ID NO: 140913 - DNA, 22 bp, Artificial Sequence
  Synthetic oligonucleotide; TTC chr11 5244670 5244691 5244675 5244670 -
tggcataattttgtagatatgt

SEQ ID NO: 140914 - DNA, 22 bp, Artificial Sequence
  Synthetic oligonucleotide; CTG chr11 5244668 5244689 5244673 5244668 -
gcataattttgtagatatgtag

SEQ ID NO: 140915 - DNA, 22 bp, Artificial Sequence
  Synthetic oligonucleotide; TTT chr11 5244659 5244680 5244664 5244659 -
tgtagatatgtaggatttgaca

SEQ ID NO: 140916 - DNA, 22 bp, Artificial Sequence
  Synthetic oligonucleotide; TTT chr11 5244658 5244679 5244663 5244658 -
gtagatatgtaggatttgacat

SEQ ID NO: 140917 - DNA, 22 bp, Artificial Sequence
  Synthetic oligonucleotide; TTG chr11 5244657 5244678 5244662 5244657 -
tagatatgtaggatttgacatg

SEQ ID NO: 140918 - DNA, 22 bp, Artificial Sequence
  Synthetic oligonucleotide; TTT chr11 5244641 5244662 5244646 5244641 -
gacatggactattgttcaatga

SEQ ID NO: 140919 - DNA, 22 bp, Artificial Sequence
  Synthetic oligonucleotide; TTG chr11 5244640 5244661 5244645 5244640 -
acatggactattgttcaatgat

SEQ ID NO: 140920 - DNA, 22 bp, Artificial Sequence
  Synthetic oligonucleotide; CTA chr11 5244630 5244651 5244635 5244630 -
ttgttcaatgattcagaggaaa

SEQ ID NO: 140921 - DNA, 22 bp, Artificial Sequence
  Synthetic oligonucleotide; TTG chr11 5244627 5244648 5244632 5244627 -
ttcaatgattcagaggaaatct

SEQ ID NO: 140922 - DNA, 22 bp, Artificial Sequence
  Synthetic oligonucleotide; TTC chr11 5244624 5244645 5244629 5244624 -
aatgattcagaggaaatctcct

SEQ ID NO: 140923 - DNA, 22 bp, Artificial Sequence
  Synthetic oligonucleotide; TTC chr11 5244616 5244637 5244621 5244616 -
agaggaaatctcctttgttcag

SEQ ID NO: 140924 - DNA, 22 bp, Artificial Sequence
  Synthetic oligonucleotide; CTC chr11 5244604 5244625 5244609 5244604 -
ctttgttcagataagtacactg

SEQ ID NO: 140925 - DNA, 22 bp, Artificial Sequence
  Synthetic oligonucleotide; CTT chr11 5244601 5244622 5244606 5244601 -
tgttcagataagtacactgact

SEQ ID NO: 140926 - DNA, 22 bp, Artificial Sequence
  Synthetic oligonucleotide; TTT chr11 5244600 5244621 5244605 5244600 -
gttcagataagtacactgacta

SEQ ID NO: 140927 - DNA, 22 bp, Artificial Sequence
  Synthetic oligonucleotide; TTG chr11 5244599 5244620 5244604 5244599 -
ttcagataagtacactgactac

SEQ ID NO: 140928 - DNA, 22 bp, Artificial Sequence
  Synthetic oligonucleotide; TTC chr11 5244596 5244617 5244601 5244596 -
agataagtacactgactactaa

SEQ ID NO: 140929 - DNA, 22 bp, Artificial Sequence
  Synthetic oligonucleotide; CTG chr11 5244582 5244603 5244587 5244582 -
actactaaatggattaaaaaac

SEQ ID NO: 140930 - DNA, 22 bp, Artificial Sequence
  Synthetic oligonucleotide; CTA chr11 5244578 5244599 5244583 5244578 -
ctaaatggattaaaaaacacag

SEQ ID NO: 140931 - DNA, 22 bp, Artificial Sequence
  Synthetic oligonucleotide; CTA chr11 5244575 5244596 5244580 5244575 -
aatggattaaaaaacacagtaa

SEQ ID NO: 140932 - DNA, 22 bp, Artificial Sequence
  Synthetic oligonucleotide; TTA chr11 5244566 5244587 5244571 5244566 -
aaaaacacagtaataaaaccca

SEQ ID NO: 140933 - DNA, 22 bp, Artificial Sequence
  Synthetic oligonucleotide; TTT chr11 5244540 5244561 5244545 5244540 -
tccccttacttccctagtttgt

SEQ ID NO: 140934 - DNA, 22 bp, Artificial Sequence
  Synthetic oligonucleotide; TTT chr11 5244539 5244560 5244544 5244539 -
ccccttacttccctagtttgtt

SEQ ID NO: 140935 - DNA, 22 bp, Artificial Sequence
  Synthetic oligonucleotide; TTC chr11 5244538 5244559 5244543 5244538 -
cccttacttccctagtttgttt

SEQ ID NO: 140936 - DNA, 22 bp, Artificial Sequence
  Synthetic oligonucleotide; CTT chr11 5244533 5244554 5244538 5244533 -
acttccctagtttgtttcttat

SEQ ID NO: 140937 - DNA, 22 bp, Artificial Sequence
  Synthetic oligonucleotide; TTA chr11 5244532 5244553 5244537 5244532 -
cttccctagtttgtttcttatt

SEQ ID NO: 140938 - DNA, 22 bp, Artificial Sequence
  Synthetic oligonucleotide; CTT chr11 5244529 5244550 5244534 5244529 -
ccctagtttgtttcttattctg

SEQ ID NO: 140939 - DNA, 22 bp, Artificial Sequence
  Synthetic oligonucleotide; TTC chr11 5244528 5244549 5244533 5244528 -
cctagtttgtttcttattctgc

SEQ ID NO: 140940 - DNA, 22 bp, Artificial Sequence
  Synthetic oligonucleotide; CTA chr11 5244524 5244545 5244529 5244524 -
gtttgtttcttattctgctttc

SEQ ID NO: 140941 - DNA, 22 bp, Artificial Sequence
  Synthetic oligonucleotide; TTT chr11 5244520 5244541 5244525 5244520 -
gtttcttattctgctttcttcc

SEQ ID NO: 140942 - DNA, 22 bp, Artificial Sequence
  Synthetic oligonucleotide; TTG chr11 5244519 5244540 5244524 5244519 -
tttcttattctgctttcttcca

SEQ ID NO: 140943 - DNA, 22 bp, Artificial Sequence
  Synthetic oligonucleotide; TTT chr11 5244516 5244537 5244521 5244516 -
cttattctgctttcttccaagt

SEQ ID NO: 140944 - DNA, 22 bp, Artificial Sequence
  Synthetic oligonucleotide; TTC chr11 5244515 5244536 5244520 5244515 -
ttattctgctttcttccaagtt

SEQ ID NO: 140945 - DNA, 22 bp, Artificial Sequence
  Synthetic oligonucleotide; CTT chr11 5244513 5244534 5244518 5244513 -
attctgctttcttccaagttga

SEQ ID NO: 140946 - DNA, 22 bp, Artificial Sequence
  Synthetic oligonucleotide; TTA chr11 5244512 5244533 5244517 5244512 -
ttctgctttcttccaagttgat

SEQ ID NO: 140947 - DNA, 22 bp, Artificial Sequence
  Synthetic oligonucleotide; TTC chr11 5244509 5244530 5244514 5244509 -
tgctttcttccaagttgatgct

SEQ ID NO: 140948 - DNA, 22 bp, Artificial Sequence
  Synthetic oligonucleotide; CTG chr11 5244507 5244528 5244512 5244507 -
ctttcttccaagttgatgctgg

SEQ ID NO: 140949 - DNA, 22 bp, Artificial Sequence
  Synthetic oligonucleotide; CTT chr11 5244504 5244525 5244509 5244504 -
tcttccaagttgatgctggata

SEQ ID NO: 140950 - DNA, 22 bp, Artificial Sequence
  Synthetic oligonucleotide; TTT chr11 5244503 5244524 5244508 5244503 -
cttccaagttgatgctggatag

SEQ ID NO: 140951 - DNA, 22 bp, Artificial Sequence
  Synthetic oligonucleotide; TTC chr11 5244502 5244523 5244507 5244502 -
ttccaagttgatgctggataga

SEQ ID NO: 140952 - DNA, 22 bp, Artificial Sequence
  Synthetic oligonucleotide; CTT chr11 5244500 5244521 5244505 5244500 -
ccaagttgatgctggatagagg

SEQ ID NO: 140953 - DNA, 22 bp, Artificial Sequence
  Synthetic oligonucleotide; TTC chr11 5244499 5244520 5244504 5244499 -
caagttgatgctggatagaggt

SEQ ID NO: 140954 - DNA, 22 bp, Artificial Sequence
  Synthetic oligonucleotide; TTG chr11 5244492 5244513 5244497 5244492 -
atgctggatagaggtgtttatt

SEQ ID NO: 140955 - DNA, 22 bp, Artificial Sequence
  Synthetic oligonucleotide; CTG chr11 5244486 5244507 5244491 5244486 -
gatagaggtgtttatttctatt

SEQ ID NO: 140956 - DNA, 22 bp, Artificial Sequence
  Synthetic oligonucleotide; TTT chr11 5244473 5244494 5244478 5244473 -
atttctattctaaaaagtgatg

SEQ ID NO: 140957 - DNA, 22 bp, Artificial Sequence
  Synthetic oligonucleotide; TTA chr11 5244472 5244493 5244477 5244472 -
tttctattctaaaaagtgatga

SEQ ID NO: 140958 - DNA, 22 bp, Artificial Sequence
  Synthetic oligonucleotide; TTT chr11 5244469 5244490 5244474 5244469 -
ctattctaaaaagtgatgaaat

SEQ ID NO: 140959 - DNA, 22 bp, Artificial Sequence
  Synthetic oligonucleotide; TTC chr11 5244468 5244489 5244473 5244468 -
tattctaaaaagtgatgaaatt

SEQ ID NO: 140960 - DNA, 22 bp, Artificial Sequence
  Synthetic oligonucleotide; CTA chr11 5244466 5244487 5244471 5244466 -
ttctaaaaagtgatgaaattgg

SEQ ID NO: 140961 - DNA, 22 bp, Artificial Sequence
  Synthetic oligonucleotide; TTC chr11 5244463 5244484 5244468 5244463 -
taaaaagtgatgaaattggccg

SEQ ID NO: 140962 - DNA, 22 bp, Artificial Sequence
  Synthetic oligonucleotide; CTA chr11 5244461 5244482 5244466 5244461 -
aaaagtgatgaaattggccggg

SEQ ID NO: 140963 - DNA, 22 bp, Artificial Sequence
  Synthetic oligonucleotide; TTG chr11 5244445 5244466 5244450 5244445 -
gccgggcgcggtggctcacacc

SEQ ID NO: 140964 - DNA, 22 bp, Artificial Sequence
  Synthetic oligonucleotide; CTC chr11 5244428 5244449 5244433 5244428 -
acacctgtaatcccagcacttt

SEQ ID NO: 140965 - DNA, 22 bp, Artificial Sequence
  Synthetic oligonucleotide; CTG chr11 5244421 5244442 5244426 5244421 -
taatcccagcactttgggaggc

SEQ ID NO: 140966 - DNA, 22 bp, Artificial Sequence
  Synthetic oligonucleotide; CTT chr11 5244407 5244428 5244412 5244407 -
tgggaggctgaggtgggcggat

SEQ ID NO: 140967 - DNA, 22 bp, Artificial Sequence
  Synthetic oligonucleotide; TTT chr11 5244406 5244427 5244411 5244406 -
gggaggctgaggtgggcggatc

SEQ ID NO: 140968 - DNA, 22 bp, Artificial Sequence
  Synthetic oligonucleotide; TTG chr11 5244405 5244426 5244410 5244405 -
ggaggctgaggtgggcggatca

SEQ ID NO: 140969 - DNA, 22 bp, Artificial Sequence
  Synthetic oligonucleotide; CTG chr11 5244397 5244418 5244402 5244397 -
aggtgggcggatcacgaggtca

SEQ ID NO: 140970 - DNA, 22 bp, Artificial Sequence
  Synthetic oligonucleotide; CTG chr11 5244356 5244377 5244361 5244356 -
gctaacatggtgaaaccccatc

SEQ ID NO: 140971 - DNA, 22 bp, Artificial Sequence
  Synthetic oligonucleotide; CTA chr11 5244352 5244373 5244357 5244352 -
acatggtgaaaccccatctcta

SEQ ID NO: 140972 - DNA, 22 bp, Artificial Sequence
  Synthetic oligonucleotide; CTC chr11 5244332 5244353 5244337 5244332 -
tactaaaaatacaaaaaattag

SEQ ID NO: 140973 - DNA, 22 bp, Artificial Sequence
  Synthetic oligonucleotide; CTA chr11 5244330 5244351 5244335 5244330 -
ctaaaaatacaaaaaattagcc

SEQ ID NO: 140974 - DNA, 22 bp, Artificial Sequence
  Synthetic oligonucleotide; CTA chr11 5244327 5244348 5244332 5244327 -
aaaatacaaaaaattagccaga

SEQ ID NO: 140975 - DNA, 22 bp, Artificial Sequence
  Synthetic oligonucleotide; TTA chr11 5244311 5244332 5244316 5244311 -
gccagagacagtggcgggtgcc

SEQ ID NO: 140976 - DNA, 22 bp, Artificial Sequence
  Synthetic oligonucleotide; CTG chr11 5244287 5244308 5244292 5244287 -
tagtcccagctactcgggaggc

SEQ ID NO: 140977 - DNA, 22 bp, Artificial Sequence
  Synthetic oligonucleotide; CTA chr11 5244275 5244296 5244280 5244275 -
ctcgggaggctgaggcaggaga

SEQ ID NO: 140978 - DNA, 22 bp, Artificial Sequence
  Synthetic oligonucleotide; CTC chr11 5244272 5244293 5244277 5244272 -
gggaggctgaggcaggagaatg

SEQ ID NO: 140979 - DNA, 22 bp, Artificial Sequence
  Synthetic oligonucleotide; CTG chr11 5244263 5244284 5244268 5244263 -
aggcaggagaatggcgtgaacc

SEQ ID NO: 140980 - DNA, 22 bp, Artificial Sequence
  Synthetic oligonucleotide; CTG chr11 5244239 5244260 5244244 5244239 -
ggaggcagagcttgcggtgagc

SEQ ID NO: 140981 - DNA, 22 bp, Artificial Sequence
  Synthetic oligonucleotide; CTT chr11 5244226 5244247 5244231 5244226 -
gcggtgagcagagatcgcgcca

SEQ ID NO: 140982 - DNA, 22 bp, Artificial Sequence
  Synthetic oligonucleotide; TTG chr11 5244225 5244246 5244230 5244225 -
cggtgagcagagatcgcgccac

SEQ ID NO: 140983 - DNA, 22 bp, Artificial Sequence
  Synthetic oligonucleotide; CTG chr11 5244201 5244222 5244206 5244201 -
cacactccagcctgggtgacaa

SEQ ID NO: 140984 - DNA, 22 bp, Artificial Sequence
  Synthetic oligonucleotide; CTC chr11 5244194 5244215 5244199 5244194 -
cagcctgggtgacaaagcgaga

SEQ ID NO: 140985 - DNA, 22 bp, Artificial Sequence
  Synthetic oligonucleotide; CTG chr11 5244187 5244208 5244192 5244187 -
ggtgacaaagcgagactccatc

SEQ ID NO: 140986 - DNA, 22 bp, Artificial Sequence
  Synthetic oligonucleotide; CTC chr11 5244169 5244190 5244174 5244169 -
catctcaaaaaaaaaaaaaaaa

SEQ ID NO: 140987 - DNA, 22 bp, Artificial Sequence
  Synthetic oligonucleotide; CTC chr11 5244163 5244184 5244168 5244163 -
aaaaaaaaaaaaaaaaaaaaga

SEQ ID NO: 140988 - DNA, 22 bp, Artificial Sequence
  Synthetic oligonucleotide; CTG chr11 5244112 5244133 5244117 5244112 -
atgaaattgtgtattcaatgta

SEQ ID NO: 140989 - DNA, 22 bp, Artificial Sequence
  Synthetic oligonucleotide; TTG chr11 5244103 5244124 5244108 5244103 -
tgtattcaatgtagtctcaaga

SEQ ID NO: 140990 - DNA, 22 bp, Artificial Sequence
  Synthetic oligonucleotide; TTC chr11 5244096 5244117 5244101 5244096 -
aatgtagtctcaagagaattga

SEQ ID NO: 140991 - DNA, 22 bp, Artificial Sequence
  Synthetic oligonucleotide; CTC chr11 5244085 5244106 5244090 5244085 -
aagagaattgaaaaccaagaaa

SEQ ID NO: 140992 - DNA, 22 bp, Artificial Sequence
  Synthetic oligonucleotide; TTG chr11 5244075 5244096 5244080 5244075 -
aaaaccaagaaaggctgtggct

SEQ ID NO: 140993 - DNA, 22 bp, Artificial Sequence
  Synthetic oligonucleotide; CTG chr11 5244058 5244079 5244063 5244058 -
tggcttcttccacataaagcct

SEQ ID NO: 140994 - DNA, 22 bp, Artificial Sequence
  Synthetic oligonucleotide; CTT chr11 5244052 5244073 5244057 5244052 -
cttccacataaagcctggatga

SEQ ID NO: 140995 - DNA, 22 bp, Artificial Sequence
  Synthetic oligonucleotide; TTC chr11 5244051 5244072 5244056 5244051 -
ttccacataaagcctggatgaa

SEQ ID NO: 140996 - DNA, 22 bp, Artificial Sequence
  Synthetic oligonucleotide; CTT chr11 5244049 5244070 5244054 5244049 -
ccacataaagcctggatgaata

SEQ ID NO: 140997 - DNA, 22 bp, Artificial Sequence
  Synthetic oligonucleotide; TTC chr11 5244048 5244069 5244053 5244048 -
cacataaagcctggatgaataa

SEQ ID NO: 140998 - DNA, 22 bp, Artificial Sequence
  Synthetic oligonucleotide; CTG chr11 5244035 5244056 5244040 5244035 -
gatgaataacaggataacacgt

SEQ ID NO: 140999 - DNA, 22 bp, Artificial Sequence
  Synthetic oligonucleotide; TTG chr11 5244011 5244032 5244016 5244011 -
ttacattgtcacaactcctgat

SEQ ID NO: 141000 - DNA, 22 bp, Artificial Sequence
  Synthetic oligonucleotide; TTA chr11 5244008 5244029 5244013 5244008 -
cattgtcacaactcctgatcca

SEQ ID NO: 141001 - DNA, 22 bp, Artificial Sequence
  Synthetic oligonucleotide; TTG chr11 5244003 5244024 5244008 5244003 -
tcacaactcctgatccaggaat

SEQ ID NO: 141002 - DNA, 22 bp, Artificial Sequence
  Synthetic oligonucleotide; CTC chr11 5243994 5244015 5243999 5243994 -
ctgatccaggaattgatggcta

SEQ ID NO: 141003 - DNA, 22 bp, Artificial Sequence
  Synthetic oligonucleotide; CTG chr11 5243991 5244012 5243996 5243991 -
atccaggaattgatggctaaga

SEQ ID NO: 141004 - DNA, 22 bp, Artificial Sequence
  Synthetic oligonucleotide; TTG chr11 5243979 5244000 5243984 5243979 -
atggctaagatattcgtaattc

SEQ ID NO: 141005 - DNA, 22 bp, Artificial Sequence
  Synthetic oligonucleotide; CTA chr11 5243972 5243993 5243977 5243972 -
agatattcgtaattcttatcct

SEQ ID NO: 141006 - DNA, 22 bp, Artificial Sequence
  Synthetic oligonucleotide; TTC chr11 5243964 5243985 5243969 5243964 -
gtaattcttatccttttcagtt

SEQ ID NO: 141007 - DNA, 22 bp, Artificial Sequence
  Synthetic oligonucleotide; TTC chr11 5243957 5243978 5243962 5243957 -
ttatccttttcagttgtaactt

SEQ ID NO: 141008 - DNA, 22 bp, Artificial Sequence
  Synthetic oligonucleotide; CTT chr11 5243955 5243976 5243960 5243955 -
atccttttcagttgtaacttat

SEQ ID NO: 141009 - DNA, 22 bp, Artificial Sequence
  Synthetic oligonucleotide; TTA chr11 5243954 5243975 5243959 5243954 -
tccttttcagttgtaacttatt

SEQ ID NO: 141010 - DNA, 22 bp, Artificial Sequence
  Synthetic oligonucleotide; CTT chr11 5243949 5243970 5243954 5243949 -
ttcagttgtaacttattcctat

SEQ ID NO: 141011 - DNA, 22 bp, Artificial Sequence
  Synthetic oligonucleotide; TTT chr11 5243948 5243969 5243953 5243948 -
tcagttgtaacttattcctatt

SEQ ID NO: 141012 - DNA, 22 bp, Artificial Sequence
  Synthetic oligonucleotide; TTT chr11 5243947 5243968 5243952 5243947 -
cagttgtaacttattcctattt

SEQ ID NO: 141013 - DNA, 22 bp, Artificial Sequence
  Synthetic oligonucleotide; TTC chr11 5243946 5243967 5243951 5243946 -
agttgtaacttattcctatttg

SEQ ID NO: 141014 - DNA, 22 bp, Artificial Sequence
  Synthetic oligonucleotide; TTG chr11 5243941 5243962 5243946 5243941 -
taacttattcctatttgtcagc

SEQ ID NO: 141015 - DNA, 22 bp, Artificial Sequence
  Synthetic oligonucleotide; CTT chr11 5243935 5243956 5243940 5243935 -
attcctatttgtcagcattcag

SEQ ID NO: 141016 - DNA, 22 bp, Artificial Sequence
  Synthetic oligonucleotide; TTA chr11 5243934 5243955 5243939 5243934 -
ttcctatttgtcagcattcagg

SEQ ID NO: 141017 - DNA, 22 bp, Artificial Sequence
  Synthetic oligonucleotide; TTC chr11 5243931 5243952 5243936 5243931 -
ctatttgtcagcattcaggtta

SEQ ID NO: 141018 - DNA, 22 bp, Artificial Sequence
  Synthetic oligonucleotide; CTA chr11 5243928 5243949 5243933 5243928 -
tttgtcagcattcaggttatta

SEQ ID NO: 141019 - DNA, 22 bp, Artificial Sequence
  Synthetic oligonucleotide; TTT chr11 5243925 5243946 5243930 5243925 -
gtcagcattcaggttattagcg

SEQ ID NO: 141020 - DNA, 22 bp, Artificial Sequence
  Synthetic oligonucleotide; TTG chr11 5243924 5243945 5243929 5243924 -
tcagcattcaggttattagcgg

SEQ ID NO: 141021 - DNA, 22 bp, Artificial Sequence
  Synthetic oligonucleotide; TTC chr11 5243915 5243936 5243920 5243915 -
aggttattagcggctgctggcg

SEQ ID NO: 141022 - DNA, 22 bp, Artificial Sequence
  Synthetic oligonucleotide; TTA chr11 5243909 5243930 5243914 5243909 -
ttagcggctgctggcgaagtcc

SEQ ID NO: 141023 - DNA, 22 bp, Artificial Sequence
  Synthetic oligonucleotide; TTA chr11 5243906 5243927 5243911 5243906 -
gcggctgctggcgaagtccttg

SEQ ID NO: 141024 - DNA, 22 bp, Artificial Sequence
  Synthetic oligonucleotide; CTG chr11 5243899 5243920 5243904 5243899 -
ctggcgaagtccttgagaaata

SEQ ID NO: 141025 - DNA, 22 bp, Artificial Sequence
  Synthetic oligonucleotide; CTG chr11 5243896 5243917 5243901 5243896 -
gcgaagtccttgagaaataaac

SEQ ID NO: 141026 - DNA, 22 bp, Artificial Sequence
  Synthetic oligonucleotide; CTT chr11 5243885 5243906 5243890 5243885 -
gagaaataaactgcacactgga

SEQ ID NO: 141027 - DNA, 22 bp, Artificial Sequence
  Synthetic oligonucleotide; TTG chr11 5243884 5243905 5243889 5243884 -
agaaataaactgcacactggat

SEQ ID NO: 141028 - DNA, 22 bp, Artificial Sequence
  Synthetic oligonucleotide; CTG chr11 5243872 5243893 5243877 5243872 -
cacactggatggtgggggtagt

SEQ ID NO: 141029 - DNA, 22 bp, Artificial Sequence
  Synthetic oligonucleotide; CTG chr11 5243865 5243886 5243870 5243865 -
gatggtgggggtagtgtaggaa

SEQ ID NO: 141030 - DNA, 22 bp, Artificial Sequence
  Synthetic oligonucleotide; TTT chr11 5243818 5243839 5243823 5243818 -
caaattaagcctgaacagcaaa

SEQ ID NO: 141031 - DNA, 22 bp, Artificial Sequence
  Synthetic oligonucleotide; TTC chr11 5243817 5243838 5243822 5243817 -
aaattaagcctgaacagcaaag

SEQ ID NO: 141032 - DNA, 22 bp, Artificial Sequence
  Synthetic oligonucleotide; TTA chr11 5243811 5243832 5243816 5243811 -
agcctgaacagcaaagttcccc

SEQ ID NO: 141033 - DNA, 22 bp, Artificial Sequence
  Synthetic oligonucleotide; CTG chr11 5243805 5243826 5243810 5243805 -
aacagcaaagttcccctgagaa

SEQ ID NO: 141034 - DNA, 22 bp, Artificial Sequence
  Synthetic oligonucleotide; TTC chr11 5243792 5243813 5243797 5243792 -
ccctgagaaggccacctggatt

SEQ ID NO: 141035 - DNA, 22 bp, Artificial Sequence
  Synthetic oligonucleotide; CTG chr11 5243787 5243808 5243792 5243787 -
agaaggccacctggattctatc

SEQ ID NO: 141036 - DNA, 22 bp, Artificial Sequence
  Synthetic oligonucleotide; CTG chr11 5243774 5243795 5243779 5243774 -
gattctatcagaaactcgaatg

SEQ ID NO: 141037 - DNA, 22 bp, Artificial Sequence
  Synthetic oligonucleotide; TTC chr11 5243769 5243790 5243774 5243769 -
tatcagaaactcgaatgtccat

SEQ ID NO: 141038 - DNA, 22 bp, Artificial Sequence
  Synthetic oligonucleotide; CTA chr11 5243767 5243788 5243772 5243767 -
tcagaaactcgaatgtccatct

SEQ ID NO: 141039 - DNA, 22 bp, Artificial Sequence
  Synthetic oligonucleotide; CTC chr11 5243757 5243778 5243762 5243757 -
gaatgtccatcttgcaaaactt

SEQ ID NO: 141040 - DNA, 22 bp, Artificial Sequence
  Synthetic oligonucleotide; CTT chr11 5243744 5243765 5243749 5243744 -
gcaaaacttccttgcccaaacc

SEQ ID NO: 141041 - DNA, 22 bp, Artificial Sequence
  Synthetic oligonucleotide; TTG chr11 5243743 5243764 5243748 5243743 -
caaaacttccttgcccaaaccc

SEQ ID NO: 141042 - DNA, 22 bp, Artificial Sequence
  Synthetic oligonucleotide; CTT chr11 5243735 5243756 5243740 5243735 -
ccttgcccaaaccccacccctg

SEQ ID NO: 141043 - DNA, 22 bp, Artificial Sequence
  Synthetic oligonucleotide; TTC chr11 5243734 5243755 5243739 5243734 -
cttgcccaaaccccacccctgg

SEQ ID NO: 141044 - DNA, 22 bp, Artificial Sequence
  Synthetic oligonucleotide; CTT chr11 5243731 5243752 5243736 5243731 -
gcccaaaccccacccctggagt

SEQ ID NO: 141045 - DNA, 22 bp, Artificial Sequence
  Synthetic oligonucleotide; TTG chr11 5243730 5243751 5243735 5243730 -
cccaaaccccacccctggagtc

SEQ ID NO: 141046 - DNA, 22 bp, Artificial Sequence
  Synthetic oligonucleotide; CTG chr11 5243713 5243734 5243718 5243713 -
gagtcacaacccacccttgacc

SEQ ID NO: 141047 - DNA, 22 bp, Artificial Sequence
  Synthetic oligonucleotide; CTT chr11 5243695 5243716 5243700 5243695 -
gaccaatagattcattttactg

SEQ ID NO: 141048 - DNA, 22 bp, Artificial Sequence
  Synthetic oligonucleotide; TTG chr11 5243694 5243715 5243699 5243694 -
accaatagattcattttactga

SEQ ID NO: 141049 - DNA, 22 bp, Artificial Sequence
  Synthetic oligonucleotide; TTC chr11 5243682 5243703 5243687 5243682 -
attttactgagggaggcaaagg

SEQ ID NO: 141050 - DNA, 22 bp, Artificial Sequence
  Synthetic oligonucleotide; TTT chr11 5243678 5243699 5243683 5243678 -
tactgagggaggcaaagggctg

SEQ ID NO: 141051 - DNA, 22 bp, Artificial Sequence
  Synthetic oligonucleotide; TTT chr11 5243677 5243698 5243682 5243677 -
actgagggaggcaaagggctgg

SEQ ID NO: 141052 - DNA, 22 bp, Artificial Sequence
  Synthetic oligonucleotide; TTA chr11 5243676 5243697 5243681 5243676 -
ctgagggaggcaaagggctggt

SEQ ID NO: 141053 - DNA, 22 bp, Artificial Sequence
  Synthetic oligonucleotide; CTG chr11 5243673 5243694 5243678 5243673 -
agggaggcaaagggctggtcaa

SEQ ID NO: 141054 - DNA, 22 bp, Artificial Sequence
  Synthetic oligonucleotide; CTG chr11 5243656 5243677 5243661 5243656 -
gtcaatagattcatttcactgg

SEQ ID NO: 141055 - DNA, 22 bp, Artificial Sequence
  Synthetic oligonucleotide; TTC chr11 5243644 5243665 5243649 5243644 -
atttcactgggagaggcaaagg

SEQ ID NO: 141056 - DNA, 22 bp, Artificial Sequence
  Synthetic oligonucleotide; TTT chr11 5243640 5243661 5243645 5243640 -
cactgggagaggcaaagggctg

SEQ ID NO: 141057 - DNA, 22 bp, Artificial Sequence
  Synthetic oligonucleotide; TTC chr11 5243639 5243660 5243644 5243639 -
actgggagaggcaaagggctgg

SEQ ID NO: 141058 - DNA, 22 bp, Artificial Sequence
  Synthetic oligonucleotide; CTG chr11 5243635 5243656 5243640 5243635 -
ggagaggcaaagggctgggggc

SEQ ID NO: 141059 - DNA, 22 bp, Artificial Sequence
  Synthetic oligonucleotide; CTG chr11 5243618 5243639 5243623 5243618 -
ggggccagagaggagaagtaaa

SEQ ID NO: 141060 - DNA, 22 bp, Artificial Sequence
  Synthetic oligonucleotide; CTT chr11 5243562 5243583 5243567 5243562 -
ctggctcatctgtgatcaccag

SEQ ID NO: 141061 - DNA, 22 bp, Artificial Sequence
  Synthetic oligonucleotide; TTC chr11 5243561 5243582 5243566 5243561 -
tggctcatctgtgatcaccagg

SEQ ID NO: 141062 - DNA, 22 bp, Artificial Sequence
  Synthetic oligonucleotide; CTG chr11 5243559 5243580 5243564 5243559 -
gctcatctgtgatcaccaggaa

SEQ ID NO: 141063 - DNA, 22 bp, Artificial Sequence
  Synthetic oligonucleotide; CTC chr11 5243555 5243576 5243560 5243555 -
atctgtgatcaccaggaaactc

SEQ ID NO: 141064 - DNA, 22 bp, Artificial Sequence
  Synthetic oligonucleotide; CTG chr11 5243550 5243571 5243555 5243550 -
tgatcaccaggaaactcccaga

SEQ ID NO: 141065 - DNA, 22 bp, Artificial Sequence
  Synthetic oligonucleotide; CTC chr11 5243533 5243554 5243538 5243533 -
ccagatctgacactgtagtgca

SEQ ID NO: 141066 - DNA, 22 bp, Artificial Sequence
  Synthetic oligonucleotide; CTG chr11 5243524 5243545 5243529 5243524 -
acactgtagtgcatttcactgc

SEQ ID NO: 141067 - DNA, 22 bp, Artificial Sequence
  Synthetic oligonucleotide; CTG chr11 5243518 5243539 5243523 5243518 -
tagtgcatttcactgctgacaa

SEQ ID NO: 141068 - DNA, 22 bp, Artificial Sequence
  Synthetic oligonucleotide; TTT chr11 5243508 5243529 5243513 5243508 -
cactgctgacaagaaggctgct

SEQ ID NO: 141069 - DNA, 22 bp, Artificial Sequence
  Synthetic oligonucleotide; TTC chr11 5243507 5243528 5243512 5243507 -
actgctgacaagaaggctgctg

SEQ ID NO: 141070 - DNA, 22 bp, Artificial Sequence
  Synthetic oligonucleotide; CTG chr11 5243503 5243524 5243508 5243503 -
ctgacaagaaggctgctgccac

SEQ ID NO: 141071 - DNA, 22 bp, Artificial Sequence
  Synthetic oligonucleotide; CTG chr11 5243500 5243521 5243505 5243500 -
acaagaaggctgctgccaccag

SEQ ID NO: 141072 - DNA, 22 bp, Artificial Sequence
  Synthetic oligonucleotide; CTG chr11 5243488 5243509 5243493 5243488 -
ctgccaccagcctgtgaagcaa

SEQ ID NO: 141073 - DNA, 22 bp, Artificial Sequence
  Synthetic oligonucleotide; CTG chr11 5243485 5243506 5243490 5243485 -
ccaccagcctgtgaagcaaggt

SEQ ID NO: 141074 - DNA, 22 bp, Artificial Sequence
  Synthetic oligonucleotide; CTG chr11 5243474 5243495 5243479 5243474 -
tgaagcaaggttaaggtgagaa

SEQ ID NO: 141075 - DNA, 22 bp, Artificial Sequence
  Synthetic oligonucleotide; TTA chr11 5243461 5243482 5243466 5243461 -
aggtgagaaggctggaggtgag

SEQ ID NO: 141076 - DNA, 22 bp, Artificial Sequence
  Synthetic oligonucleotide; CTG chr11 5243447 5243468 5243452 5243447 -
gaggtgagattctgggcaggta

SEQ ID NO: 141077 - DNA, 22 bp, Artificial Sequence
  Synthetic oligonucleotide; TTC chr11 5243435 5243456 5243440 5243435 -
tgggcaggtaggtactggaagc

SEQ ID NO: 141078 - DNA, 22 bp, Artificial Sequence
  Synthetic oligonucleotide; CTG chr11 5243433 5243454 5243438 5243433 -
ggcaggtaggtactggaagccg

SEQ ID NO: 141079 - DNA, 22 bp, Artificial Sequence
  Synthetic oligonucleotide; CTG chr11 5243418 5243439 5243423 5243418 -
gaagccgggacaaggtgcagaa

SEQ ID NO: 141080 - DNA, 22 bp, Artificial Sequence
  Synthetic oligonucleotide; TTT chr11 5243381 5243402 5243386 5243381 -
ctgaaagagggattagcccgtt

SEQ ID NO: 141081 - DNA, 22 bp, Artificial Sequence
  Synthetic oligonucleotide; TTC chr11 5243380 5243401 5243385 5243380 -
tgaaagagggattagcccgttg

SEQ ID NO: 141082 - DNA, 22 bp, Artificial Sequence
  Synthetic oligonucleotide; CTG chr11 5243378 5243399 5243383 5243378 -
aaagagggattagcccgttgtc

SEQ ID NO: 141083 - DNA, 22 bp, Artificial Sequence
  Synthetic oligonucleotide; TTA chr11 5243366 5243387 5243371 5243366 -
gcccgttgtcttacatagtctg

SEQ ID NO: 141084 - DNA, 22 bp, Artificial Sequence
  Synthetic oligonucleotide; TTG chr11 5243358 5243379 5243363 5243358 -
tcttacatagtctgactttgca

SEQ ID NO: 141085 - DNA, 22 bp, Artificial Sequence
  Synthetic oligonucleotide; CTT chr11 5243354 5243375 5243359 5243354 -
acatagtctgactttgcacctg

SEQ ID NO: 141086 - DNA, 22 bp, Artificial Sequence
  Synthetic oligonucleotide; TTA chr11 5243353 5243374 5243358 5243353 -
catagtctgactttgcacctgc

SEQ ID NO: 141087 - DNA, 22 bp, Artificial Sequence
  Synthetic oligonucleotide; CTG chr11 5243344 5243365 5243349 5243344 -
actttgcacctgctctgtgatt

SEQ ID NO: 141088 - DNA, 22 bp, Artificial Sequence
  Synthetic oligonucleotide; CTT chr11 5243340 5243361 5243345 5243340 -
tgcacctgctctgtgattatga

SEQ ID NO: 141089 - DNA, 22 bp, Artificial Sequence
  Synthetic oligonucleotide; TTT chr11 5243339 5243360 5243344 5243339 -
gcacctgctctgtgattatgac

SEQ ID NO: 141090 - DNA, 22 bp, Artificial Sequence
  Synthetic oligonucleotide; TTG chr11 5243338 5243359 5243343 5243338 -
cacctgctctgtgattatgact

SEQ ID NO: 141091 - DNA, 22 bp, Artificial Sequence
  Synthetic oligonucleotide; CTG chr11 5243332 5243353 5243337 5243332 -
ctctgtgattatgactatccca

SEQ ID NO: 141092 - DNA, 22 bp, Artificial Sequence
  Synthetic oligonucleotide; CTC chr11 5243329 5243350 5243334 5243329 -
tgtgattatgactatcccacag

SEQ ID NO: 141093 - DNA, 22 bp, Artificial Sequence
  Synthetic oligonucleotide; CTG chr11 5243327 5243348 5243332 5243327 -
tgattatgactatcccacagtc

SEQ ID NO: 141094 - DNA, 22 bp, Artificial Sequence
  Synthetic oligonucleotide; TTA chr11 5243321 5243342 5243326 5243321 -
tgactatcccacagtctcctgg

SEQ ID NO: 141095 - DNA, 22 bp, Artificial Sequence
  Synthetic oligonucleotide; CTA chr11 5243315 5243336 5243320 5243315 -
tcccacagtctcctggttgtct

SEQ ID NO: 141096 - DNA, 22 bp, Artificial Sequence
  Synthetic oligonucleotide; CTC chr11 5243303 5243324 5243308 5243303 -
ctggttgtctacccatggacct

SEQ ID NO: 141097 - DNA, 22 bp, Artificial Sequence
  Synthetic oligonucleotide; CTG chr11 5243300 5243321 5243305 5243300 -
gttgtctacccatggacctaga

SEQ ID NO: 141098 - DNA, 22 bp, Artificial Sequence
  Synthetic oligonucleotide; TTG chr11 5243296 5243317 5243301 5243296 -
tctacccatggacctagaggta

SEQ ID NO: 141099 - DNA, 22 bp, Artificial Sequence
  Synthetic oligonucleotide; CTA chr11 5243292 5243313 5243297 5243292 -
cccatggacctagaggtacttt

SEQ ID NO: 141100 - DNA, 22 bp, Artificial Sequence
  Synthetic oligonucleotide; CTA chr11 5243280 5243301 5243285 5243280 -
gaggtactttgaaagttttgga

SEQ ID NO: 141101 - DNA, 22 bp, Artificial Sequence
  Synthetic oligonucleotide; CTT chr11 5243271 5243292 5243276 5243271 -
tgaaagttttggatatctgggc

SEQ ID NO: 141102 - DNA, 22 bp, Artificial Sequence
  Synthetic oligonucleotide; TTT chr11 5243270 5243291 5243275 5243270 -
gaaagttttggatatctgggct

SEQ ID NO: 141103 - DNA, 22 bp, Artificial Sequence
  Synthetic oligonucleotide; TTG chr11 5243269 5243290 5243274 5243269 -
aaagttttggatatctgggctc

SEQ ID NO: 141104 - DNA, 22 bp, Artificial Sequence
  Synthetic oligonucleotide; TTT chr11 5243262 5243283 5243267 5243262 -
tggatatctgggctctgactgt

SEQ ID NO: 141105 - DNA, 22 bp, Artificial Sequence
  Synthetic oligonucleotide; TTT chr11 5243261 5243282 5243266 5243261 -
ggatatctgggctctgactgtg

SEQ ID NO: 141106 - DNA, 22 bp, Artificial Sequence
  Synthetic oligonucleotide; TTG chr11 5243260 5243281 5243265 5243260 -
gatatctgggctctgactgtgc

SEQ ID NO: 141107 - DNA, 22 bp, Artificial Sequence
  Synthetic oligonucleotide; CTG chr11 5243252 5243273 5243257 5243252 -
ggctctgactgtgcaataatgg

SEQ ID NO: 141108 - DNA, 22 bp, Artificial Sequence
  Synthetic oligonucleotide; CTC chr11 5243247 5243268 5243252 5243247 -
tgactgtgcaataatgggcaac

SEQ ID NO: 141109 - DNA, 22 bp, Artificial Sequence
  Synthetic oligonucleotide; CTG chr11 5243245 5243266 5243250 5243245 -
actgtgcaataatgggcaaccc

SEQ ID NO: 141110 - DNA, 22 bp, Artificial Sequence
  Synthetic oligonucleotide; CTG chr11 5243241 5243262 5243246 5243241 -
tgcaataatgggcaaccccaaa

SEQ ID NO: 141111 - DNA, 22 bp, Artificial Sequence
  Synthetic oligonucleotide; CTG chr11 5243192 5243213 5243197 5243192 -
atctccttcggaaaagctgtta

SEQ ID NO: 141112 - DNA, 22 bp, Artificial Sequence
  Synthetic oligonucleotide; CTC chr11 5243187 5243208 5243192 5243187 -
cttcggaaaagctgttatgctc

SEQ ID NO: 141113 - DNA, 22 bp, Artificial Sequence
  Synthetic oligonucleotide; CTT chr11 5243184 5243205 5243189 5243184 -
cggaaaagctgttatgctcacg

SEQ ID NO: 141114 - DNA, 22 bp, Artificial Sequence
  Synthetic oligonucleotide; TTC chr11 5243183 5243204 5243188 5243183 -
ggaaaagctgttatgctcacgg

SEQ ID NO: 141115 - DNA, 22 bp, Artificial Sequence
  Synthetic oligonucleotide; CTG chr11 5243173 5243194 5243178 5243173 -
ttatgctcacggatgacctcaa

SEQ ID NO: 141116 - DNA, 22 bp, Artificial Sequence
  Synthetic oligonucleotide; TTA chr11 5243170 5243191 5243175 5243170 -
tgctcacggatgacctcaaagg

SEQ ID NO: 141117 - DNA, 22 bp, Artificial Sequence
  Synthetic oligonucleotide; CTC chr11 5243165 5243186 5243170 5243165 -
acggatgacctcaaaggcacct

SEQ ID NO: 141118 - DNA, 22 bp, Artificial Sequence
  Synthetic oligonucleotide; CTC chr11 5243153 5243174 5243158 5243153 -
aaaggcacctttgctacactga

SEQ ID NO: 141119 - DNA, 22 bp, Artificial Sequence
  Synthetic oligonucleotide; CTT chr11 5243142 5243163 5243147 5243142 -
tgctacactgagtgacctgcac

SEQ ID NO: 141120 - DNA, 22 bp, Artificial Sequence
  Synthetic oligonucleotide; TTT chr11 5243141 5243162 5243146 5243141 -
gctacactgagtgacctgcact

SEQ ID NO: 141121 - DNA, 22 bp, Artificial Sequence
  Synthetic oligonucleotide; TTG chr11 5243140 5243161 5243145 5243140 -
ctacactgagtgacctgcactg

SEQ ID NO: 141122 - DNA, 22 bp, Artificial Sequence
  Synthetic oligonucleotide; CTA chr11 5243137 5243158 5243142 5243137 -
cactgagtgacctgcactgtaa

SEQ ID NO: 141123 - DNA, 22 bp, Artificial Sequence
  Synthetic oligonucleotide; CTG chr11 5243132 5243153 5243137 5243132 -
agtgacctgcactgtaacaagc

SEQ ID NO: 141124 - DNA, 22 bp, Artificial Sequence
  Synthetic oligonucleotide; CTG chr11 5243123 5243144 5243128 5243123 -
cactgtaacaagctgcacgtgg

SEQ ID NO: 141125 - DNA, 22 bp, Artificial Sequence
  Synthetic oligonucleotide; CTG chr11 5243118 5243139 5243123 5243118 -
taacaagctgcacgtggaccct

SEQ ID NO: 141126 - DNA, 22 bp, Artificial Sequence
  Synthetic oligonucleotide; CTG chr11 5243108 5243129 5243113 5243108 -
cacgtggaccctgagaacttcc

SEQ ID NO: 141127 - DNA, 22 bp, Artificial Sequence
  Synthetic oligonucleotide; CTG chr11 5243095 5243116 5243100 5243095 -
agaacttcctggtgagtagtaa

SEQ ID NO: 141128 - DNA, 22 bp, Artificial Sequence
  Synthetic oligonucleotide; CTT chr11 5243088 5243109 5243093 5243088 -
cctggtgagtagtaagtacact

SEQ ID NO: 141129 - DNA, 22 bp, Artificial Sequence
  Synthetic oligonucleotide; TTC chr11 5243087 5243108 5243092 5243087 -
ctggtgagtagtaagtacactc

SEQ ID NO: 141130 - DNA, 22 bp, Artificial Sequence
  Synthetic oligonucleotide; CTG chr11 5243084 5243105 5243089 5243084 -
gtgagtagtaagtacactcacg

SEQ ID NO: 141131 - DNA, 22 bp, Artificial Sequence
  Synthetic oligonucleotide; CTC chr11 5243065 5243086 5243070 5243065 -
acgctttcttctttacccttag

SEQ ID NO: 141132 - DNA, 22 bp, Artificial Sequence
  Synthetic oligonucleotide; CTT chr11 5243059 5243080 5243064 5243059 -
tcttctttacccttagatattt

SEQ ID NO: 141133 - DNA, 22 bp, Artificial Sequence
  Synthetic oligonucleotide; TTT chr11 5243058 5243079 5243063 5243058 -
cttctttacccttagatatttg

SEQ ID NO: 141134 - DNA, 22 bp, Artificial Sequence
  Synthetic oligonucleotide; TTC chr11 5243057 5243078 5243062 5243057 -
ttctttacccttagatatttgc

SEQ ID NO: 141135 - DNA, 22 bp, Artificial Sequence
  Synthetic oligonucleotide; CTT chr11 5243055 5243076 5243060 5243055 -
ctttacccttagatatttgcac

SEQ ID NO: 141136 - DNA, 22 bp, Artificial Sequence
  Synthetic oligonucleotide; TTC chr11 5243054 5243075 5243059 5243054 -
tttacccttagatatttgcact

SEQ ID NO: 141137 - DNA, 22 bp, Artificial Sequence
  Synthetic oligonucleotide; CTT chr11 5243052 5243073 5243057 5243052 -
tacccttagatatttgcactat

SEQ ID NO: 141138 - DNA, 22 bp, Artificial Sequence
  Synthetic oligonucleotide; TTT chr11 5243051 5243072 5243056 5243051 -
acccttagatatttgcactatg

SEQ ID NO: 141139 - DNA, 22 bp, Artificial Sequence
  Synthetic oligonucleotide; TTA chr11 5243050 5243071 5243055 5243050 -
cccttagatatttgcactatgg

SEQ ID NO: 141140 - DNA, 22 bp, Artificial Sequence
  Synthetic oligonucleotide; CTT chr11 5243045 5243066 5243050 5243045 -
agatatttgcactatgggtact

SEQ ID NO: 141141 - DNA, 22 bp, Artificial Sequence
  Synthetic oligonucleotide; TTA chr11 5243044 5243065 5243049 5243044 -
gatatttgcactatgggtactt

SEQ ID NO: 141142 - DNA, 22 bp, Artificial Sequence
  Synthetic oligonucleotide; TTT chr11 5243037 5243058 5243042 5243037 -
gcactatgggtacttttgaaag

SEQ ID NO: 141143 - DNA, 22 bp, Artificial Sequence
  Synthetic oligonucleotide; TTG chr11 5243036 5243057 5243041 5243036 -
cactatgggtacttttgaaagc

SEQ ID NO: 141144 - DNA, 22 bp, Artificial Sequence
  Synthetic oligonucleotide; CTA chr11 5243031 5243052 5243036 5243031 -
tgggtacttttgaaagcagagg

SEQ ID NO: 141145 - DNA, 22 bp, Artificial Sequence
  Synthetic oligonucleotide; CTT chr11 5243022 5243043 5243027 5243022 -
ttgaaagcagaggtggctttct

SEQ ID NO: 141146 - DNA, 22 bp, Artificial Sequence
  Synthetic oligonucleotide; TTT chr11 5243021 5243042 5243026 5243021 -
tgaaagcagaggtggctttctc

SEQ ID NO: 141147 - DNA, 22 bp, Artificial Sequence
  Synthetic oligonucleotide; TTT chr11 5243020 5243041 5243025 5243020 -
gaaagcagaggtggctttctct

SEQ ID NO: 141148 - DNA, 22 bp, Artificial Sequence
  Synthetic oligonucleotide; TTG chr11 5243019 5243040 5243024 5243019 -
aaagcagaggtggctttctctt

SEQ ID NO: 141149 - DNA, 22 bp, Artificial Sequence
  Synthetic oligonucleotide; CTT chr11 5243003 5243024 5243008 5243003 -
tctcttgtgttatgagtcagct

SEQ ID NO: 141150 - DNA, 22 bp, Artificial Sequence
  Synthetic oligonucleotide; TTT chr11 5243002 5243023 5243007 5243002 -
ctcttgtgttatgagtcagcta

SEQ ID NO: 141151 - DNA, 22 bp, Artificial Sequence
  Synthetic oligonucleotide; TTC chr11 5243001 5243022 5243006 5243001 -
tcttgtgttatgagtcagctat

SEQ ID NO: 141152 - DNA, 22 bp, Artificial Sequence
  Synthetic oligonucleotide; CTC chr11 5242999 5243020 5243004 5242999 -
ttgtgttatgagtcagctatgg

SEQ ID NO: 141153 - DNA, 22 bp, Artificial Sequence
  Synthetic oligonucleotide; CTT chr11 5242997 5243018 5243002 5242997 -
gtgttatgagtcagctatggga

SEQ ID NO: 141154 - DNA, 22 bp, Artificial Sequence
  Synthetic oligonucleotide; TTG chr11 5242996 5243017 5243001 5242996 -
tgttatgagtcagctatgggat

SEQ ID NO: 141155 - DNA, 22 bp, Artificial Sequence
  Synthetic oligonucleotide; TTA chr11 5242991 5243012 5242996 5242991 -
tgagtcagctatgggatatgat

SEQ ID NO: 141156 - DNA, 22 bp, Artificial Sequence
  Synthetic oligonucleotide; CTA chr11 5242980 5243001 5242985 5242980 -
tgggatatgatatttcagcagt

SEQ ID NO: 141157 - DNA, 22 bp, Artificial Sequence
  Synthetic oligonucleotide; TTT chr11 5242965 5242986 5242970 5242965 -
cagcagtgggattttgagagtt

SEQ ID NO: 141158 - DNA, 22 bp, Artificial Sequence
  Synthetic oligonucleotide; TTC chr11 5242964 5242985 5242969 5242964 -
agcagtgggattttgagagtta

SEQ ID NO: 141159 - DNA, 22 bp, Artificial Sequence
  Synthetic oligonucleotide; TTT chr11 5242951 5242972 5242956 5242951 -
tgagagttatgttgctgtaaat

SEQ ID NO: 141160 - DNA, 22 bp, Artificial Sequence
  Synthetic oligonucleotide; TTT chr11 5242950 5242971 5242955 5242950 -
gagagttatgttgctgtaaata

SEQ ID NO: 141161 - DNA, 22 bp, Artificial Sequence
  Synthetic oligonucleotide; TTG chr11 5242949 5242970 5242954 5242949 -
agagttatgttgctgtaaataa

SEQ ID NO: 141162 - DNA, 22 bp, Artificial Sequence
  Synthetic oligonucleotide; TTA chr11 5242942 5242963 5242947 5242942 -
tgttgctgtaaataacataact

SEQ ID NO: 141163 - DNA, 22 bp, Artificial Sequence
  Synthetic oligonucleotide; TTG chr11 5242937 5242958 5242942 5242937 -
ctgtaaataacataactaaaat

SEQ ID NO: 141164 - DNA, 22 bp, Artificial Sequence
  Synthetic oligonucleotide; CTG chr11 5242934 5242955 5242939 5242934 -
taaataacataactaaaatttg

SEQ ID NO: 141165 - DNA, 22 bp, Artificial Sequence
  Synthetic oligonucleotide; CTA chr11 5242919 5242940 5242924 5242919 -
aaatttggtagagcaaggacta

SEQ ID NO: 141166 - DNA, 22 bp, Artificial Sequence
  Synthetic oligonucleotide; TTT chr11 5242913 5242934 5242918 5242913 -
ggtagagcaaggactatgaata

SEQ ID NO: 141167 - DNA, 22 bp, Artificial Sequence
  Synthetic oligonucleotide; TTG chr11 5242912 5242933 5242917 5242912 -
gtagagcaaggactatgaataa

SEQ ID NO: 141168 - DNA, 22 bp, Artificial Sequence
  Synthetic oligonucleotide; CTA chr11 5242897 5242918 5242902 5242897 -
tgaataatggaaggccacttac

SEQ ID NO: 141169 - DNA, 22 bp, Artificial Sequence
  Synthetic oligonucleotide; CTT chr11 5242877 5242898 5242882 5242877 -
accatttgatagctctgaaaaa

SEQ ID NO: 141170 - DNA, 22 bp, Artificial Sequence
  Synthetic oligonucleotide; TTA chr11 5242876 5242897 5242881 5242876 -
ccatttgatagctctgaaaaac

SEQ ID NO: 141171 - DNA, 22 bp, Artificial Sequence
  Synthetic oligonucleotide; TTT chr11 5242870 5242891 5242875 5242870 -
gatagctctgaaaaacacatct

SEQ ID NO: 141172 - DNA, 22 bp, Artificial Sequence
  Synthetic oligonucleotide; TTG chr11 5242869 5242890 5242874 5242869 -
atagctctgaaaaacacatctt

SEQ ID NO: 141173 - DNA, 22 bp, Artificial Sequence
  Synthetic oligonucleotide; CTC chr11 5242862 5242883 5242867 5242862 -
tgaaaaacacatcttataaaaa

SEQ ID NO: 141174 - DNA, 22 bp, Artificial Sequence
  Synthetic oligonucleotide; CTG chr11 5242860 5242881 5242865 5242860 -
aaaaacacatcttataaaaaat

SEQ ID NO: 141175 - DNA, 22 bp, Artificial Sequence
  Synthetic oligonucleotide; CTT chr11 5242847 5242868 5242852 5242847 -
ataaaaaattctggccaaaatc

SEQ ID NO: 141176 - DNA, 22 bp, Artificial Sequence
  Synthetic oligonucleotide; TTA chr11 5242846 5242867 5242851 5242846 -
taaaaaattctggccaaaatca

SEQ ID NO: 141177 - DNA, 22 bp, Artificial Sequence
  Synthetic oligonucleotide; TTC chr11 5242836 5242857 5242841 5242836 -
tggccaaaatcaaactgagtgt

SEQ ID NO: 141178 - DNA, 22 bp, Artificial Sequence
  Synthetic oligonucleotide; CTG chr11 5242834 5242855 5242839 5242834 -
gccaaaatcaaactgagtgttt

SEQ ID NO: 141179 - DNA, 22 bp, Artificial Sequence
  Synthetic oligonucleotide; CTG chr11 5242819 5242840 5242824 5242819 -
agtgtttttggatgagggaaca

SEQ ID NO: 141180 - DNA, 22 bp, Artificial Sequence
  Synthetic oligonucleotide; TTT chr11 5242812 5242833 5242817 5242812 -
ttggatgagggaacagaagttg

SEQ ID NO: 141181 - DNA, 22 bp, Artificial Sequence
  Synthetic oligonucleotide; TTT chr11 5242811 5242832 5242816 5242811 -
tggatgagggaacagaagttga

SEQ ID NO: 141182 - DNA, 22 bp, Artificial Sequence
  Synthetic oligonucleotide; TTT chr11 5242810 5242831 5242815 5242810 -
ggatgagggaacagaagttgag

SEQ ID NO: 141183 - DNA, 22 bp, Artificial Sequence
  Synthetic oligonucleotide; TTG chr11 5242809 5242830 5242814 5242809 -
gatgagggaacagaagttgaga

SEQ ID NO: 141184 - DNA, 22 bp, Artificial Sequence
  Synthetic oligonucleotide; TTG chr11 5242790 5242811 5242795 5242790 -
agatagagaaaataacatcttt

SEQ ID NO: 141185 - DNA, 22 bp, Artificial Sequence
  Synthetic oligonucleotide; CTT chr11 5242769 5242790 5242774 5242769 -
tcctttggtcagcgaaattttc

SEQ ID NO: 141186 - DNA, 22 bp, Artificial Sequence
  Synthetic oligonucleotide; TTT chr11 5242768 5242789 5242773 5242768 -
cctttggtcagcgaaattttct

SEQ ID NO: 141187 - DNA, 22 bp, Artificial Sequence
  Synthetic oligonucleotide; TTC chr11 5242767 5242788 5242772 5242767 -
ctttggtcagcgaaattttcta

SEQ ID NO: 141188 - DNA, 22 bp, Artificial Sequence
  Synthetic oligonucleotide; CTT chr11 5242764 5242785 5242769 5242764 -
tggtcagcgaaattttctataa

SEQ ID NO: 141189 - DNA, 22 bp, Artificial Sequence
  Synthetic oligonucleotide; TTT chr11 5242763 5242784 5242768 5242763 -
ggtcagcgaaattttctataaa

SEQ ID NO: 141190 - DNA, 22 bp, Artificial Sequence
  Synthetic oligonucleotide; TTG chr11 5242762 5242783 5242767 5242762 -
gtcagcgaaattttctataaaa

SEQ ID NO: 141191 - DNA, 22 bp, Artificial Sequence
  Synthetic oligonucleotide; TTT chr11 5242749 5242770 5242754 5242749 -
tctataaaaattaatagtcact

SEQ ID NO: 141192 - DNA, 22 bp, Artificial Sequence
  Synthetic oligonucleotide; TTT chr11 5242748 5242769 5242753 5242748 -
ctataaaaattaatagtcactt

SEQ ID NO: 141193 - DNA, 22 bp, Artificial Sequence
  Synthetic oligonucleotide; TTC chr11 5242747 5242768 5242752 5242747 -
tataaaaattaatagtcacttt

SEQ ID NO: 141194 - DNA, 22 bp, Artificial Sequence
  Synthetic oligonucleotide; CTA chr11 5242745 5242766 5242750 5242745 -
taaaaattaatagtcacttttc

SEQ ID NO: 141195 - DNA, 22 bp, Artificial Sequence
  Synthetic oligonucleotide; TTA chr11 5242736 5242757 5242741 5242736 -
atagtcacttttctgcatagtc

SEQ ID NO: 141196 - DNA, 22 bp, Artificial Sequence
  Synthetic oligonucleotide; CTT chr11 5242726 5242747 5242731 5242726 -
ttctgcatagtcctggaggtta

SEQ ID NO: 141197 - DNA, 22 bp, Artificial Sequence
  Synthetic oligonucleotide; TTT chr11 5242725 5242746 5242730 5242725 -
tctgcatagtcctggaggttag

SEQ ID NO: 141198 - DNA, 22 bp, Artificial Sequence
  Synthetic oligonucleotide; TTT chr11 5242724 5242745 5242729 5242724 -
ctgcatagtcctggaggttaga

SEQ ID NO: 141199 - DNA, 22 bp, Artificial Sequence
  Synthetic oligonucleotide; TTC chr11 5242723 5242744 5242728 5242723 -
tgcatagtcctggaggttagaa

SEQ ID NO: 141200 - DNA, 22 bp, Artificial Sequence
  Synthetic oligonucleotide; CTG chr11 5242721 5242742 5242726 5242721 -
catagtcctggaggttagaaaa

SEQ ID NO: 141201 - DNA, 22 bp, Artificial Sequence
  Synthetic oligonucleotide; CTG chr11 5242711 5242732 5242716 5242711 -
gaggttagaaaaagatcaactg

SEQ ID NO: 141202 - DNA, 22 bp, Artificial Sequence
  Synthetic oligonucleotide; TTA chr11 5242704 5242725 5242709 5242704 -
gaaaaagatcaactgaacaaag

SEQ ID NO: 141203 - DNA, 22 bp, Artificial Sequence
  Synthetic oligonucleotide; CTG chr11 5242689 5242710 5242694 5242689 -
aacaaagtagtgggaagctgtt

SEQ ID NO: 141204 - DNA, 22 bp, Artificial Sequence
  Synthetic oligonucleotide; CTG chr11 5242669 5242690 5242674 5242669 -
ttaaaaagaggattgtttccct

SEQ ID NO: 141205 - DNA, 22 bp, Artificial Sequence
  Synthetic oligonucleotide; TTA chr11 5242666 5242687 5242671 5242666 -
aaaagaggattgtttccctccg

SEQ ID NO: 141206 - DNA, 22 bp, Artificial Sequence
  Synthetic oligonucleotide; TTG chr11 5242654 5242675 5242659 5242654 -
tttccctccgaatgatgatggt

SEQ ID NO: 141207 - DNA, 22 bp, Artificial Sequence
  Synthetic oligonucleotide; TTT chr11 5242651 5242672 5242656 5242651 -
ccctccgaatgatgatggtata

SEQ ID NO: 141208 - DNA, 22 bp, Artificial Sequence
  Synthetic oligonucleotide; TTC chr11 5242650 5242671 5242655 5242650 -
cctccgaatgatgatggtatac

SEQ ID NO: 141209 - DNA, 22 bp, Artificial Sequence
  Synthetic oligonucleotide; CTC chr11 5242646 5242667 5242651 5242646 -
cgaatgatgatggtatactttt

SEQ ID NO: 141210 - DNA, 22 bp, Artificial Sequence
  Synthetic oligonucleotide; CTT chr11 5242626 5242647 5242631 5242626 -
ttgtacgcatggtacaggattc

SEQ ID NO: 141211 - DNA, 22 bp, Artificial Sequence
  Synthetic oligonucleotide; TTT chr11 5242625 5242646 5242630 5242625 -
tgtacgcatggtacaggattct

SEQ ID NO: 141212 - DNA, 22 bp, Artificial Sequence
  Synthetic oligonucleotide; TTT chr11 5242624 5242645 5242629 5242624 -
gtacgcatggtacaggattctt

SEQ ID NO: 141213 - DNA, 22 bp, Artificial Sequence
  Synthetic oligonucleotide; TTG chr11 5242623 5242644 5242628 5242623 -
tacgcatggtacaggattcttt

SEQ ID NO: 141214 - DNA, 22 bp, Artificial Sequence
  Synthetic oligonucleotide; TTC chr11 5242604 5242625 5242609 5242604 -
tttgttatgagtgtttgggaaa

SEQ ID NO: 141215 - DNA, 22 bp, Artificial Sequence
  Synthetic oligonucleotide; CTT chr11 5242602 5242623 5242607 5242602 -
tgttatgagtgtttgggaaaat

SEQ ID NO: 141216 - DNA, 22 bp, Artificial Sequence
  Synthetic oligonucleotide; TTT chr11 5242601 5242622 5242606 5242601 -
gttatgagtgtttgggaaaatt

SEQ ID NO: 141217 - DNA, 22 bp, Artificial Sequence
  Synthetic oligonucleotide; TTG chr11 5242600 5242621 5242605 5242600 -
ttatgagtgtttgggaaaattg

SEQ ID NO: 141218 - DNA, 22 bp, Artificial Sequence
  Synthetic oligonucleotide; TTA chr11 5242597 5242618 5242602 5242597 -
tgagtgtttgggaaaattgtat

SEQ ID NO: 141219 - DNA, 22 bp, Artificial Sequence
  Synthetic oligonucleotide; TTT chr11 5242588 5242609 5242593 5242588 -
gggaaaattgtatgtatgtatg

SEQ ID NO: 141220 - DNA, 22 bp, Artificial Sequence
  Synthetic oligonucleotide; TTG chr11 5242587 5242608 5242592 5242587 -
ggaaaattgtatgtatgtatgt

SEQ ID NO: 141221 - DNA, 22 bp, Artificial Sequence
  Synthetic oligonucleotide; TTG chr11 5242578 5242599 5242583 5242578 -
tatgtatgtatgtatgtatgta

SEQ ID NO: 141222 - DNA, 22 bp, Artificial Sequence
  Synthetic oligonucleotide; CTG chr11 5242545 5242566 5242550 5242545 -
gggacttatcctatccattact

SEQ ID NO: 141223 - DNA, 22 bp, Artificial Sequence
  Synthetic oligonucleotide; CTT chr11 5242538 5242559 5242543 5242538 -
atcctatccattactgttcctt

SEQ ID NO: 141224 - DNA, 22 bp, Artificial Sequence
  Synthetic oligonucleotide; TTA chr11 5242537 5242558 5242542 5242537 -
tcctatccattactgttccttg

SEQ ID NO: 141225 - DNA, 22 bp, Artificial Sequence
  Synthetic oligonucleotide; CTA chr11 5242532 5242553 5242537 5242532 -
tccattactgttccttgaagta

SEQ ID NO: 141226 - DNA, 22 bp, Artificial Sequence
  Synthetic oligonucleotide; TTA chr11 5242525 5242546 5242530 5242525 -
ctgttccttgaagtactattat

SEQ ID NO: 141227 - DNA, 22 bp, Artificial Sequence
  Synthetic oligonucleotide; CTG chr11 5242522 5242543 5242527 5242522 -
ttccttgaagtactattatcct

SEQ ID NO: 141228 - DNA, 22 bp, Artificial Sequence
  Synthetic oligonucleotide; TTC chr11 5242519 5242540 5242524 5242519 -
cttgaagtactattatcctact

SEQ ID NO: 141229 - DNA, 22 bp, Artificial Sequence
  Synthetic oligonucleotide; CTT chr11 5242516 5242537 5242521 5242516 -
gaagtactattatcctactttt

SEQ ID NO: 141230 - DNA, 22 bp, Artificial Sequence
  Synthetic oligonucleotide; TTG chr11 5242515 5242536 5242520 5242515 -
aagtactattatcctacttttt

SEQ ID NO: 141231 - DNA, 22 bp, Artificial Sequence
  Synthetic oligonucleotide; CTA chr11 5242507 5242528 5242512 5242507 -
ttatcctactttttaaaaggac

SEQ ID NO: 141232 - DNA, 22 bp, Artificial Sequence
  Synthetic oligonucleotide; TTA chr11 5242504 5242525 5242509 5242504 -
tcctactttttaaaaggacgaa

SEQ ID NO: 141233 - DNA, 22 bp, Artificial Sequence
  Synthetic oligonucleotide; CTA chr11 5242499 5242520 5242504 5242499 -
ctttttaaaaggacgaagtctc

SEQ ID NO: 141234 - DNA, 22 bp, Artificial Sequence
  Synthetic oligonucleotide; CTT chr11 5242496 5242517 5242501 5242496 -
tttaaaaggacgaagtctctaa

SEQ ID NO: 141235 - DNA, 22 bp, Artificial Sequence
  Synthetic oligonucleotide; TTT chr11 5242495 5242516 5242500 5242495 -
ttaaaaggacgaagtctctaaa

SEQ ID NO: 141236 - DNA, 22 bp, Artificial Sequence
  Synthetic oligonucleotide; TTT chr11 5242494 5242515 5242499 5242494 -
taaaaggacgaagtctctaaaa

SEQ ID NO: 141237 - DNA, 22 bp, Artificial Sequence
  Synthetic oligonucleotide; TTT chr11 5242493 5242514 5242498 5242493 -
aaaaggacgaagtctctaaaaa

SEQ ID NO: 141238 - DNA, 22 bp, Artificial Sequence
  Synthetic oligonucleotide; TTA chr11 5242492 5242513 5242497 5242492 -
aaaggacgaagtctctaaaaaa

SEQ ID NO: 141239 - DNA, 22 bp, Artificial Sequence
  Synthetic oligonucleotide; CTC chr11 5242477 5242498 5242482 5242477 -
taaaaaaaaaatgaaacaatca

SEQ ID NO: 141240 - DNA, 22 bp, Artificial Sequence
  Synthetic oligonucleotide; CTA chr11 5242475 5242496 5242480 5242475 -
aaaaaaaaatgaaacaatcaca

SEQ ID NO: 141241 - DNA, 22 bp, Artificial Sequence
  Synthetic oligonucleotide; TTG chr11 5242445 5242466 5242450 5242445 -
gggtagtgagttggcatagcaa

SEQ ID NO: 141242 - DNA, 22 bp, Artificial Sequence
  Synthetic oligonucleotide; TTG chr11 5242432 5242453 5242437 5242432 -
gcatagcaagtaagagaaggat

SEQ ID NO: 141243 - DNA, 22 bp, Artificial Sequence
  Synthetic oligonucleotide; CTG chr11 5242384 5242405 5242389 5242384 -
ccagtcatattgaagctgatat

SEQ ID NO: 141244 - DNA, 22 bp, Artificial Sequence
  Synthetic oligonucleotide; TTG chr11 5242372 5242393 5242377 5242372 -
aagctgatatctagcccataat

SEQ ID NO: 141245 - DNA, 22 bp, Artificial Sequence
  Synthetic oligonucleotide; CTG chr11 5242366 5242387 5242371 5242366 -
atatctagcccataatggtgag

SEQ ID NO: 141246 - DNA, 22 bp, Artificial Sequence
  Synthetic oligonucleotide; CTA chr11 5242359 5242380 5242364 5242359 -
gcccataatggtgagagttgct

SEQ ID NO: 141247 - DNA, 22 bp, Artificial Sequence
  Synthetic oligonucleotide; TTG chr11 5242339 5242360 5242344 5242339 -
ctcaaactctggtgaaaaagga

SEQ ID NO: 141248 - DNA, 22 bp, Artificial Sequence
  Synthetic oligonucleotide; CTC chr11 5242336 5242357 5242341 5242336 -
aaactctggtgaaaaaggatgt

SEQ ID NO: 141249 - DNA, 22 bp, Artificial Sequence
  Synthetic oligonucleotide; CTC chr11 5242330 5242351 5242335 5242330 -
tggtgaaaaaggatgtaagtgt

SEQ ID NO: 141250 - DNA, 22 bp, Artificial Sequence
  Synthetic oligonucleotide; CTG chr11 5242328 5242349 5242333 5242328 -
gtgaaaaaggatgtaagtgtta

SEQ ID NO: 141251 - DNA, 22 bp, Artificial Sequence
  Synthetic oligonucleotide; TTA chr11 5242306 5242327 5242311 5242306 -
tatctatttactgcaagtccag

SEQ ID NO: 141252 - DNA, 22 bp, Artificial Sequence
  Synthetic oligonucleotide; CTA chr11 5242300 5242321 5242305 5242300 -
tttactgcaagtccagcttgag

SEQ ID NO: 141253 - DNA, 22 bp, Artificial Sequence
  Synthetic oligonucleotide; TTT chr11 5242297 5242318 5242302 5242297 -
actgcaagtccagcttgaggcc

SEQ ID NO: 141254 - DNA, 22 bp, Artificial Sequence
  Synthetic oligonucleotide; TTA chr11 5242296 5242317 5242301 5242296 -
ctgcaagtccagcttgaggcct

SEQ ID NO: 141255 - DNA, 22 bp, Artificial Sequence
  Synthetic oligonucleotide; CTG chr11 5242293 5242314 5242298 5242293 -
caagtccagcttgaggccttct

SEQ ID NO: 141256 - DNA, 22 bp, Artificial Sequence
  Synthetic oligonucleotide; CTT chr11 5242281 5242302 5242286 5242281 -
gaggccttctattcactatgta

SEQ ID NO: 141257 - DNA, 22 bp, Artificial Sequence
  Synthetic oligonucleotide; TTG chr11 5242280 5242301 5242285 5242280 -
aggccttctattcactatgtac

SEQ ID NO: 141258 - DNA, 22 bp, Artificial Sequence
  Synthetic oligonucleotide; CTT chr11 5242273 5242294 5242278 5242273 -
ctattcactatgtaccattttc

SEQ ID NO: 141259 - DNA, 22 bp, Artificial Sequence
  Synthetic oligonucleotide; TTC chr11 5242272 5242293 5242277 5242272 -
tattcactatgtaccattttct

SEQ ID NO: 141260 - DNA, 22 bp, Artificial Sequence
  Synthetic oligonucleotide; CTA chr11 5242270 5242291 5242275 5242270 -
ttcactatgtaccattttcttt

SEQ ID NO: 141261 - DNA, 22 bp, Artificial Sequence
  Synthetic oligonucleotide; TTC chr11 5242267 5242288 5242272 5242267 -
actatgtaccattttctttttt

SEQ ID NO: 141262 - DNA, 22 bp, Artificial Sequence
  Synthetic oligonucleotide; CTA chr11 5242263 5242284 5242268 5242263 -
tgtaccattttcttttttatct

SEQ ID NO: 141263 - DNA, 22 bp, Artificial Sequence
  Synthetic oligonucleotide; TTT chr11 5242253 5242274 5242258 5242253 -
tcttttttatcttcactccctc

SEQ ID NO: 141264 - DNA, 22 bp, Artificial Sequence
  Synthetic oligonucleotide; TTT chr11 5242252 5242273 5242257 5242252 -
cttttttatcttcactccctcc

SEQ ID NO: 141265 - DNA, 22 bp, Artificial Sequence
  Synthetic oligonucleotide; TTC chr11 5242251 5242272 5242256 5242251 -
ttttttatcttcactccctccc

SEQ ID NO: 141266 - DNA, 22 bp, Artificial Sequence
  Synthetic oligonucleotide; CTT chr11 5242249 5242270 5242254 5242249 -
ttttatcttcactccctcccca

SEQ ID NO: 141267 - DNA, 22 bp, Artificial Sequence
  Synthetic oligonucleotide; TTT chr11 5242248 5242269 5242253 5242248 -
tttatcttcactccctccccag

SEQ ID NO: 141268 - DNA, 22 bp, Artificial Sequence
  Synthetic oligonucleotide; TTT chr11 5242247 5242268 5242252 5242247 -
ttatcttcactccctccccagc

SEQ ID NO: 141269 - DNA, 22 bp, Artificial Sequence
  Synthetic oligonucleotide; TTT chr11 5242246 5242267 5242251 5242246 -
tatcttcactccctccccagct

SEQ ID NO: 141270 - DNA, 22 bp, Artificial Sequence
  Synthetic oligonucleotide; TTT chr11 5242245 5242266 5242250 5242245 -
atcttcactccctccccagctc

SEQ ID NO: 141271 - DNA, 22 bp, Artificial Sequence
  Synthetic oligonucleotide; TTA chr11 5242244 5242265 5242249 5242244 -
tcttcactccctccccagctct

SEQ ID NO: 141272 - DNA, 22 bp, Artificial Sequence
  Synthetic oligonucleotide; CTT chr11 5242240 5242261 5242245 5242240 -
cactccctccccagctcttagg

SEQ ID NO: 141273 - DNA, 22 bp, Artificial Sequence
  Synthetic oligonucleotide; TTC chr11 5242239 5242260 5242244 5242239 -
actccctccccagctcttaggc

SEQ ID NO: 141274 - DNA, 22 bp, Artificial Sequence
  Synthetic oligonucleotide; CTC chr11 5242235 5242256 5242240 5242235 -
cctccccagctcttaggcaacg

SEQ ID NO: 141275 - DNA, 22 bp, Artificial Sequence
  Synthetic oligonucleotide; CTC chr11 5242231 5242252 5242236 5242231 -
cccagctcttaggcaacgtgat

SEQ ID NO: 141276 - DNA, 22 bp, Artificial Sequence
  Synthetic oligonucleotide; CTC chr11 5242223 5242244 5242228 5242223 -
ttaggcaacgtgatattgattg

SEQ ID NO: 141277 - DNA, 22 bp, Artificial Sequence
  Synthetic oligonucleotide; CTT chr11 5242221 5242242 5242226 5242221 -
aggcaacgtgatattgattgtt

SEQ ID NO: 141278 - DNA, 22 bp, Artificial Sequence
  Synthetic oligonucleotide; TTA chr11 5242220 5242241 5242225 5242220 -
ggcaacgtgatattgattgttt

SEQ ID NO: 141279 - DNA, 22 bp, Artificial Sequence
  Synthetic oligonucleotide; TTG chr11 5242205 5242226 5242210 5242205 -
attgttttggcaacccacttca

SEQ ID NO: 141280 - DNA, 22 bp, Artificial Sequence
  Synthetic oligonucleotide; TTG chr11 5242201 5242222 5242206 5242201 -
ttttggcaacccacttcagcga

SEQ ID NO: 141281 - DNA, 22 bp, Artificial Sequence
  Synthetic oligonucleotide; TTT chr11 5242198 5242219 5242203 5242198 -
tggcaacccacttcagcgagga

SEQ ID NO: 141282 - DNA, 22 bp, Artificial Sequence
  Synthetic oligonucleotide; TTT chr11 5242197 5242218 5242202 5242197 -
ggcaacccacttcagcgaggat

SEQ ID NO: 141283 - DNA, 22 bp, Artificial Sequence
  Synthetic oligonucleotide; TTG chr11 5242196 5242217 5242201 5242196 -
gcaacccacttcagcgaggatt

SEQ ID NO: 141284 - DNA, 22 bp, Artificial Sequence
  Synthetic oligonucleotide; CTT chr11 5242185 5242206 5242190 5242185 -
cagcgaggattttaccctacag

SEQ ID NO: 141285 - DNA, 22 bp, Artificial Sequence
  Synthetic oligonucleotide; TTC chr11 5242184 5242205 5242189 5242184 -
agcgaggattttaccctacaga

SEQ ID NO: 141286 - DNA, 22 bp, Artificial Sequence
  Synthetic oligonucleotide; TTT chr11 5242173 5242194 5242178 5242173 -
taccctacagatacaggcttct

SEQ ID NO: 141287 - DNA, 22 bp, Artificial Sequence
  Synthetic oligonucleotide; TTT chr11 5242172 5242193 5242177 5242172 -
accctacagatacaggcttctt

SEQ ID NO: 141288 - DNA, 22 bp, Artificial Sequence
  Synthetic oligonucleotide; TTA chr11 5242171 5242192 5242176 5242171 -
ccctacagatacaggcttcttg

SEQ ID NO: 141289 - DNA, 22 bp, Artificial Sequence
  Synthetic oligonucleotide; CTA chr11 5242166 5242187 5242171 5242166 -
cagatacaggcttcttggcagt

SEQ ID NO: 141290 - DNA, 22 bp, Artificial Sequence
  Synthetic oligonucleotide; CTT chr11 5242153 5242174 5242158 5242153 -
cttggcagtaactaacaaatgc

SEQ ID NO: 141291 - DNA, 22 bp, Artificial Sequence
  Synthetic oligonucleotide; TTC chr11 5242152 5242173 5242157 5242152 -
ttggcagtaactaacaaatgct

SEQ ID NO: 141292 - DNA, 22 bp, Artificial Sequence
  Synthetic oligonucleotide; CTT chr11 5242150 5242171 5242155 5242150 -
ggcagtaactaacaaatgctgt

SEQ ID NO: 141293 - DNA, 22 bp, Artificial Sequence
  Synthetic oligonucleotide; TTG chr11 5242149 5242170 5242154 5242149 -
gcagtaactaacaaatgctgtg

SEQ ID NO: 141294 - DNA, 22 bp, Artificial Sequence
  Synthetic oligonucleotide; CTA chr11 5242139 5242160 5242144 5242139 -
acaaatgctgtggttaatgctg

SEQ ID NO: 141295 - DNA, 22 bp, Artificial Sequence
  Synthetic oligonucleotide; CTG chr11 5242129 5242150 5242134 5242129 -
tggttaatgctgtagcccacaa

SEQ ID NO: 141296 - DNA, 22 bp, Artificial Sequence
  Synthetic oligonucleotide; TTA chr11 5242123 5242144 5242128 5242123 -
atgctgtagcccacaagaccac

SEQ ID NO: 141297 - DNA, 22 bp, Artificial Sequence
  Synthetic oligonucleotide; CTG chr11 5242117 5242138 5242122 5242117 -
tagcccacaagaccactgagtt

SEQ ID NO: 141298 - DNA, 22 bp, Artificial Sequence
  Synthetic oligonucleotide; CTG chr11 5242099 5242120 5242104 5242099 -
agttccctgtccactatgtttg

SEQ ID NO: 141299 - DNA, 22 bp, Artificial Sequence
  Synthetic oligonucleotide; TTC chr11 5242094 5242115 5242099 5242094 -
cctgtccactatgtttgtacct

SEQ ID NO: 141300 - DNA, 22 bp, Artificial Sequence
  Synthetic oligonucleotide; CTG chr11 5242090 5242111 5242095 5242090 -
tccactatgtttgtacctatgg

SEQ ID NO: 141301 - DNA, 22 bp, Artificial Sequence
  Synthetic oligonucleotide; CTA chr11 5242083 5242104 5242088 5242083 -
tgtttgtacctatggtccacta

SEQ ID NO: 141302 - DNA, 22 bp, Artificial Sequence
  Synthetic oligonucleotide; TTT chr11 5242078 5242099 5242083 5242078 -
gtacctatggtccactatgttt

SEQ ID NO: 141303 - DNA, 22 bp, Artificial Sequence
  Synthetic oligonucleotide; TTG chr11 5242077 5242098 5242082 5242077 -
tacctatggtccactatgtttg

SEQ ID NO: 141304 - DNA, 22 bp, Artificial Sequence
  Synthetic oligonucleotide; CTA chr11 5242071 5242092 5242076 5242071 -
tggtccactatgtttgtaccta

SEQ ID NO: 141305 - DNA, 22 bp, Artificial Sequence
  Synthetic oligonucleotide; CTA chr11 5242061 5242082 5242066 5242061 -
tgtttgtacctatgtcccaaaa

SEQ ID NO: 141306 - DNA, 22 bp, Artificial Sequence
  Synthetic oligonucleotide; TTT chr11 5242056 5242077 5242061 5242056 -
gtacctatgtcccaaaatctca

SEQ ID NO: 141307 - DNA, 22 bp, Artificial Sequence
  Synthetic oligonucleotide; TTG chr11 5242055 5242076 5242060 5242055 -
tacctatgtcccaaaatctcat

SEQ ID NO: 141308 - DNA, 22 bp, Artificial Sequence
  Synthetic oligonucleotide; CTA chr11 5242049 5242070 5242054 5242049 -
tgtcccaaaatctcatctcctt

SEQ ID NO: 141309 - DNA, 22 bp, Artificial Sequence
  Synthetic oligonucleotide; CTC chr11 5242035 5242056 5242040 5242035 -
atctcctttagatgggggaggt

SEQ ID NO: 141310 - DNA, 22 bp, Artificial Sequence
  Synthetic oligonucleotide; CTC chr11 5242030 5242051 5242035 5242030 -
ctttagatgggggaggttgggg

SEQ ID NO: 141311 - DNA, 22 bp, Artificial Sequence
  Synthetic oligonucleotide; CTT chr11 5242027 5242048 5242032 5242027 -
tagatgggggaggttggggaga

SEQ ID NO: 141312 - DNA, 22 bp, Artificial Sequence
  Synthetic oligonucleotide; TTT chr11 5242026 5242047 5242031 5242026 -
agatgggggaggttggggagaa

SEQ ID NO: 141313 - DNA, 22 bp, Artificial Sequence
  Synthetic oligonucleotide; TTA chr11 5242025 5242046 5242030 5242025 -
gatgggggaggttggggagaag

SEQ ID NO: 141314 - DNA, 22 bp, Artificial Sequence
  Synthetic oligonucleotide; TTG chr11 5242011 5242032 5242016 5242011 -
gggagaagagcagtatcctgcc

SEQ ID NO: 141315 - DNA, 22 bp, Artificial Sequence
  Synthetic oligonucleotide; CTG chr11 5241991 5242012 5241996 5241991 -
cctgctgattcagttcctgcat

SEQ ID NO: 141316 - DNA, 22 bp, Artificial Sequence
  Synthetic oligonucleotide; CTG chr11 5241987 5242008 5241992 5241987 -
ctgattcagttcctgcatgata

SEQ ID NO: 141317 - DNA, 22 bp, Artificial Sequence
  Synthetic oligonucleotide; CTG chr11 5241984 5242005 5241989 5241984 -
attcagttcctgcatgataaaa

SEQ ID NO: 141318 - DNA, 22 bp, Artificial Sequence
  Synthetic oligonucleotide; TTC chr11 5241980 5242001 5241985 5241980 -
agttcctgcatgataaaaatag

SEQ ID NO: 141319 - DNA, 22 bp, Artificial Sequence
  Synthetic oligonucleotide; TTC chr11 5241975 5241996 5241980 5241975 -
ctgcatgataaaaatagaataa

SEQ ID NO: 141320 - DNA, 22 bp, Artificial Sequence
  Synthetic oligonucleotide; CTG chr11 5241972 5241993 5241977 5241972 -
catgataaaaatagaataaaga

SEQ ID NO: 141321 - DNA, 22 bp, Artificial Sequence
  Synthetic oligonucleotide; CTC chr11 5241941 5241962 5241946 5241941 -
tctaagaaatatcattgtactc

SEQ ID NO: 141322 - DNA, 22 bp, Artificial Sequence
  Synthetic oligonucleotide; CTC chr11 5241939 5241960 5241944 5241939 -
taagaaatatcattgtactctt

SEQ ID NO: 141323 - DNA, 22 bp, Artificial Sequence
  Synthetic oligonucleotide; CTA chr11 5241937 5241958 5241942 5241937 -
agaaatatcattgtactctttt

SEQ ID NO: 141324 - DNA, 22 bp, Artificial Sequence
  Synthetic oligonucleotide; TTG chr11 5241924 5241945 5241929 5241924 -
tactctttttctgtctttatat

SEQ ID NO: 141325 - DNA, 22 bp, Artificial Sequence
  Synthetic oligonucleotide; CTC chr11 5241919 5241940 5241924 5241919 -
tttttctgtctttatattttac

SEQ ID NO: 141326 - DNA, 22 bp, Artificial Sequence
  Synthetic oligonucleotide; CTT chr11 5241917 5241938 5241922 5241917 -
tttctgtctttatattttaccc

SEQ ID NO: 141327 - DNA, 22 bp, Artificial Sequence
  Synthetic oligonucleotide; TTT chr11 5241916 5241937 5241921 5241916 -
ttctgtctttatattttaccct

SEQ ID NO: 141328 - DNA, 22 bp, Artificial Sequence
  Synthetic oligonucleotide; TTT chr11 5241915 5241936 5241920 5241915 -
tctgtctttatattttaccctg

SEQ ID NO: 141329 - DNA, 22 bp, Artificial Sequence
  Synthetic oligonucleotide; TTT chr11 5241914 5241935 5241919 5241914 -
ctgtctttatattttaccctga

SEQ ID NO: 141330 - DNA, 22 bp, Artificial Sequence
  Synthetic oligonucleotide; TTC chr11 5241913 5241934 5241918 5241913 -
tgtctttatattttaccctgat

SEQ ID NO: 141331 - DNA, 22 bp, Artificial Sequence
  Synthetic oligonucleotide; CTG chr11 5241911 5241932 5241916 5241911 -
tctttatattttaccctgattc

SEQ ID NO: 141332 - DNA, 22 bp, Artificial Sequence
  Synthetic oligonucleotide; CTT chr11 5241907 5241928 5241912 5241907 -
tatattttaccctgattcagcc

SEQ ID NO: 141333 - DNA, 22 bp, Artificial Sequence
  Synthetic oligonucleotide; TTT chr11 5241906 5241927 5241911 5241906 -
atattttaccctgattcagcca

SEQ ID NO: 141334 - DNA, 22 bp, Artificial Sequence
  Synthetic oligonucleotide; TTA chr11 5241905 5241926 5241910 5241905 -
tattttaccctgattcagccaa

SEQ ID NO: 141335 - DNA, 22 bp, Artificial Sequence
  Synthetic oligonucleotide; TTT chr11 5241900 5241921 5241905 5241900 -
taccctgattcagccaaaagga

SEQ ID NO: 141336 - DNA, 22 bp, Artificial Sequence
  Synthetic oligonucleotide; TTT chr11 5241899 5241920 5241904 5241899 -
accctgattcagccaaaaggac

SEQ ID NO: 141337 - DNA, 22 bp, Artificial Sequence
  Synthetic oligonucleotide; TTA chr11 5241898 5241919 5241903 5241898 -
ccctgattcagccaaaaggacg

SEQ ID NO: 141338 - DNA, 22 bp, Artificial Sequence
  Synthetic oligonucleotide; CTG chr11 5241893 5241914 5241898 5241893 -
attcagccaaaaggacgcacta

SEQ ID NO: 141339 - DNA, 22 bp, Artificial Sequence
  Synthetic oligonucleotide; TTC chr11 5241889 5241910 5241894 5241889 -
agccaaaaggacgcactatttc

SEQ ID NO: 141340 - DNA, 22 bp, Artificial Sequence
  Synthetic oligonucleotide; CTA chr11 5241871 5241892 5241876 5241871 -
tttctgatggaaatgagaatgt

SEQ ID NO: 141341 - DNA, 22 bp, Artificial Sequence
  Synthetic oligonucleotide; TTT chr11 5241868 5241889 5241873 5241868 -
ctgatggaaatgagaatgttgg

SEQ ID NO: 141342 - DNA, 22 bp, Artificial Sequence
  Synthetic oligonucleotide; TTC chr11 5241867 5241888 5241872 5241867 -
tgatggaaatgagaatgttgga

SEQ ID NO: 141343 - DNA, 22 bp, Artificial Sequence
  Synthetic oligonucleotide; CTG chr11 5241865 5241886 5241870 5241865 -
atggaaatgagaatgttggaga

SEQ ID NO: 141344 - DNA, 22 bp, Artificial Sequence
  Synthetic oligonucleotide; TTG chr11 5241847 5241868 5241852 5241847 -
gagaatgggagtttaaggacag

SEQ ID NO: 141345 - DNA, 22 bp, Artificial Sequence
  Synthetic oligonucleotide; TTT chr11 5241833 5241854 5241838 5241833 -
aaggacagagaagatactttct

SEQ ID NO: 141346 - DNA, 22 bp, Artificial Sequence
  Synthetic oligonucleotide; TTA chr11 5241832 5241853 5241837 5241832 -
aggacagagaagatactttctt

SEQ ID NO: 141347 - DNA, 22 bp, Artificial Sequence
  Synthetic oligonucleotide; CTT chr11 5241814 5241835 5241819 5241814 -
tcttgcaatcctgcaagaaaag

SEQ ID NO: 141348 - DNA, 22 bp, Artificial Sequence
  Synthetic oligonucleotide; TTT chr11 5241813 5241834 5241818 5241813 -
cttgcaatcctgcaagaaaaga

SEQ ID NO: 141349 - DNA, 22 bp, Artificial Sequence
  Synthetic oligonucleotide; TTC chr11 5241812 5241833 5241817 5241812 -
ttgcaatcctgcaagaaaagag

SEQ ID NO: 141350 - DNA, 22 bp, Artificial Sequence
  Synthetic oligonucleotide; CTT chr11 5241810 5241831 5241815 5241810 -
gcaatcctgcaagaaaagagag

SEQ ID NO: 141351 - DNA, 22 bp, Artificial Sequence
  Synthetic oligonucleotide; TTG chr11 5241809 5241830 5241814 5241809 -
caatcctgcaagaaaagagaga

SEQ ID NO: 141352 - DNA, 22 bp, Artificial Sequence
  Synthetic oligonucleotide; CTG chr11 5241801 5241822 5241806 5241801 -
caagaaaagagagaactcgtgg

SEQ ID NO: 141353 - DNA, 22 bp, Artificial Sequence
  Synthetic oligonucleotide; CTC chr11 5241783 5241804 5241788 5241783 -
gtgggtggatttagtggggtag

SEQ ID NO: 141354 - DNA, 22 bp, Artificial Sequence
  Synthetic oligonucleotide; TTT chr11 5241771 5241792 5241776 5241771 -
agtggggtagttactcctagga

SEQ ID NO: 141355 - DNA, 22 bp, Artificial Sequence
  Synthetic oligonucleotide; TTA chr11 5241770 5241791 5241775 5241770 -
gtggggtagttactcctaggaa

SEQ ID NO: 141356 - DNA, 22 bp, Artificial Sequence
  Synthetic oligonucleotide; TTA chr11 5241758 5241779 5241763 5241758 -
ctcctaggaaggggaaatcgtc

SEQ ID NO: 141357 - DNA, 22 bp, Artificial Sequence
  Synthetic oligonucleotide; CTC chr11 5241755 5241776 5241760 5241755 -
ctaggaaggggaaatcgtctct

SEQ ID NO: 141358 - DNA, 22 bp, Artificial Sequence
  Synthetic oligonucleotide; CTA chr11 5241752 5241773 5241757 5241752 -
ggaaggggaaatcgtctctaga

SEQ ID NO: 141359 - DNA, 22 bp, Artificial Sequence
  Synthetic oligonucleotide; CTC chr11 5241734 5241755 5241739 5241734 -
tagaataagacaatgtttttac

SEQ ID NO: 141360 - DNA, 22 bp, Artificial Sequence
  Synthetic oligonucleotide; CTA chr11 5241732 5241753 5241737 5241732 -
gaataagacaatgtttttacag

SEQ ID NO: 141361 - DNA, 22 bp, Artificial Sequence
  Synthetic oligonucleotide; TTT chr11 5241716 5241737 5241721 5241716 -
ttacagaaagggaggtcaatgg

SEQ ID NO: 141362 - DNA, 22 bp, Artificial Sequence
  Synthetic oligonucleotide; TTT chr11 5241715 5241736 5241720 5241715 -
tacagaaagggaggtcaatgga

SEQ ID NO: 141363 - DNA, 22 bp, Artificial Sequence
  Synthetic oligonucleotide; TTT chr11 5241714 5241735 5241719 5241714 -
acagaaagggaggtcaatggag

SEQ ID NO: 141364 - DNA, 22 bp, Artificial Sequence
  Synthetic oligonucleotide; TTA chr11 5241713 5241734 5241718 5241713 -
cagaaagggaggtcaatggagg

SEQ ID NO: 141365 - DNA, 22 bp, Artificial Sequence
  Synthetic oligonucleotide; CTC chr11 5241686 5241707 5241691 5241686 -
tttggaggtgtaagaggattgt

SEQ ID NO: 141366 - DNA, 22 bp, Artificial Sequence
  Synthetic oligonucleotide; CTT chr11 5241684 5241705 5241689 5241684 -
tggaggtgtaagaggattgttg

SEQ ID NO: 141367 - DNA, 22 bp, Artificial Sequence
  Synthetic oligonucleotide; TTT chr11 5241683 5241704 5241688 5241683 -
ggaggtgtaagaggattgttgg

SEQ ID NO: 141368 - DNA, 22 bp, Artificial Sequence
  Synthetic oligonucleotide; TTG chr11 5241682 5241703 5241687 5241682 -
gaggtgtaagaggattgttggt

SEQ ID NO: 141369 - DNA, 22 bp, Artificial Sequence
  Synthetic oligonucleotide; TTG chr11 5241665 5241686 5241670 5241665 -
ttggtagtgtgtagaggtatgt

SEQ ID NO: 141370 - DNA, 22 bp, Artificial Sequence
  Synthetic oligonucleotide; TTG chr11 5241662 5241683 5241667 5241662 -
gtagtgtgtagaggtatgttag

SEQ ID NO: 141371 - DNA, 22 bp, Artificial Sequence
  Synthetic oligonucleotide; TTA chr11 5241641 5241662 5241646 5241641 -
ggactcaaattagaagttctgt

SEQ ID NO: 141372 - DNA, 22 bp, Artificial Sequence
  Synthetic oligonucleotide; CTC chr11 5241635 5241656 5241640 5241635 -
aaattagaagttctgtataggc

SEQ ID NO: 141373 - DNA, 22 bp, Artificial Sequence
  Synthetic oligonucleotide; TTA chr11 5241629 5241650 5241634 5241629 -
gaagttctgtataggctattat

SEQ ID NO: 141374 - DNA, 22 bp, Artificial Sequence
  Synthetic oligonucleotide; TTC chr11 5241622 5241643 5241627 5241622 -
tgtataggctattatttgtatg

SEQ ID NO: 141375 - DNA, 22 bp, Artificial Sequence
  Synthetic oligonucleotide; CTG chr11 5241620 5241641 5241625 5241620 -
tataggctattatttgtatgaa

SEQ ID NO: 141376 - DNA, 22 bp, Artificial Sequence
  Synthetic oligonucleotide; CTA chr11 5241611 5241632 5241616 5241611 -
ttatttgtatgaaactcaggat

SEQ ID NO: 141377 - DNA, 22 bp, Artificial Sequence
  Synthetic oligonucleotide; TTA chr11 5241608 5241629 5241613 5241608 -
tttgtatgaaactcaggatata

SEQ ID NO: 141378 - DNA, 22 bp, Artificial Sequence
  Synthetic oligonucleotide; TTT chr11 5241605 5241626 5241610 5241605 -
gtatgaaactcaggatatagct

SEQ ID NO: 141379 - DNA, 22 bp, Artificial Sequence
  Synthetic oligonucleotide; TTG chr11 5241604 5241625 5241609 5241604 -
tatgaaactcaggatatagctc

SEQ ID NO: 141380 - DNA, 22 bp, Artificial Sequence
  Synthetic oligonucleotide; CTC chr11 5241594 5241615 5241599 5241594 -
aggatatagctcatttggtgac

SEQ ID NO: 141381 - DNA, 22 bp, Artificial Sequence
  Synthetic oligonucleotide; CTC chr11 5241582 5241603 5241587 5241582 -
atttggtgactgcagttcactt

SEQ ID NO: 141382 - DNA, 22 bp, Artificial Sequence
  Synthetic oligonucleotide; TTT chr11 5241578 5241599 5241583 5241578 -
ggtgactgcagttcacttctac

SEQ ID NO: 141383 - DNA, 22 bp, Artificial Sequence
  Synthetic oligonucleotide; TTG chr11 5241577 5241598 5241582 5241577 -
gtgactgcagttcacttctact

SEQ ID NO: 141384 - DNA, 22 bp, Artificial Sequence
  Synthetic oligonucleotide; CTG chr11 5241570 5241591 5241575 5241570 -
cagttcacttctacttatttta

SEQ ID NO: 141385 - DNA, 22 bp, Artificial Sequence
  Synthetic oligonucleotide; TTC chr11 5241564 5241585 5241569 5241564 -
acttctacttattttaaacaac

SEQ ID NO: 141386 - DNA, 22 bp, Artificial Sequence
  Synthetic oligonucleotide; CTT chr11 5241560 5241581 5241565 5241560 -
ctacttattttaaacaacatat

SEQ ID NO: 141387 - DNA, 22 bp, Artificial Sequence
  Synthetic oligonucleotide; TTC chr11 5241559 5241580 5241564 5241559 -
tacttattttaaacaacatatt

SEQ ID NO: 141388 - DNA, 22 bp, Artificial Sequence
  Synthetic oligonucleotide; CTA chr11 5241557 5241578 5241562 5241557 -
cttattttaaacaacatatttt

SEQ ID NO: 141389 - DNA, 22 bp, Artificial Sequence
  Synthetic oligonucleotide; CTT chr11 5241554 5241575 5241559 5241554 -
attttaaacaacatatttttta

SEQ ID NO: 141390 - DNA, 22 bp, Artificial Sequence
  Synthetic oligonucleotide; TTA chr11 5241553 5241574 5241558 5241553 -
ttttaaacaacatattttttat

SEQ ID NO: 141391 - DNA, 22 bp, Artificial Sequence
  Synthetic oligonucleotide; TTT chr11 5241550 5241571 5241555 5241550 -
taaacaacatattttttattat

SEQ ID NO: 141392 - DNA, 22 bp, Artificial Sequence
  Synthetic oligonucleotide; TTT chr11 5241549 5241570 5241554 5241549 -
aaacaacatattttttattatt

SEQ ID NO: 141393 - DNA, 22 bp, Artificial Sequence
  Synthetic oligonucleotide; TTA chr11 5241548 5241569 5241553 5241548 -
aacaacatattttttattattt

SEQ ID NO: 141394 - DNA, 22 bp, Artificial Sequence
  Synthetic oligonucleotide; TTT chr11 5241536 5241557 5241541 5241536 -
tttattatttataatgaagtgg

SEQ ID NO: 141395 - DNA, 22 bp, Artificial Sequence
  Synthetic oligonucleotide; TTT chr11 5241535 5241556 5241540 5241535 -
ttattatttataatgaagtggg

SEQ ID NO: 141396 - DNA, 22 bp, Artificial Sequence
  Synthetic oligonucleotide; TTT chr11 5241534 5241555 5241539 5241534 -
tattatttataatgaagtgggg

SEQ ID NO: 141397 - DNA, 22 bp, Artificial Sequence
  Synthetic oligonucleotide; TTT chr11 5241533 5241554 5241538 5241533 -
attatttataatgaagtgggga

SEQ ID NO: 141398 - DNA, 22 bp, Artificial Sequence
  Synthetic oligonucleotide; TTA chr11 5241532 5241553 5241537 5241532 -
ttatttataatgaagtggggat

SEQ ID NO: 141399 - DNA, 22 bp, Artificial Sequence
  Synthetic oligonucleotide; TTA chr11 5241529 5241550 5241534 5241529 -
tttataatgaagtggggatggg

SEQ ID NO: 141400 - DNA, 22 bp, Artificial Sequence
  Synthetic oligonucleotide; TTT chr11 5241526 5241547 5241531 5241526 -
ataatgaagtggggatggggct

SEQ ID NO: 141401 - DNA, 22 bp, Artificial Sequence
  Synthetic oligonucleotide; TTA chr11 5241525 5241546 5241530 5241525 -
taatgaagtggggatggggctt

SEQ ID NO: 141402 - DNA, 22 bp, Artificial Sequence
  Synthetic oligonucleotide; CTT chr11 5241503 5241524 5241508 5241503 -
cctagagaccaatcaagggcca

SEQ ID NO: 141403 - DNA, 22 bp, Artificial Sequence
  Synthetic oligonucleotide; TTC chr11 5241502 5241523 5241507 5241502 -
ctagagaccaatcaagggccaa

SEQ ID NO: 141404 - DNA, 22 bp, Artificial Sequence
  Synthetic oligonucleotide; CTA chr11 5241499 5241520 5241504 5241499 -
gagaccaatcaagggccaaacc

SEQ ID NO: 141405 - DNA, 22 bp, Artificial Sequence
  Synthetic oligonucleotide; CTT chr11 5241475 5241496 5241480 5241475 -
gaactttctcttaacgtcttca

SEQ ID NO: 141406 - DNA, 22 bp, Artificial Sequence
  Synthetic oligonucleotide; TTG chr11 5241474 5241495 5241479 5241474 -
aactttctcttaacgtcttcaa

SEQ ID NO: 141407 - DNA, 22 bp, Artificial Sequence
  Synthetic oligonucleotide; CTT chr11 5241469 5241490 5241474 5241469 -
tctcttaacgtcttcaatggta

SEQ ID NO: 141408 - DNA, 22 bp, Artificial Sequence
  Synthetic oligonucleotide; TTT chr11 5241468 5241489 5241473 5241468 -
ctcttaacgtcttcaatggtat

SEQ ID NO: 141409 - DNA, 22 bp, Artificial Sequence
  Synthetic oligonucleotide; TTC chr11 5241467 5241488 5241472 5241467 -
tcttaacgtcttcaatggtatt

SEQ ID NO: 141410 - DNA, 22 bp, Artificial Sequence
  Synthetic oligonucleotide; CTC chr11 5241465 5241486 5241470 5241465 -
ttaacgtcttcaatggtattaa

SEQ ID NO: 141411 - DNA, 22 bp, Artificial Sequence
  Synthetic oligonucleotide; CTT chr11 5241463 5241484 5241468 5241463 -
aacgtcttcaatggtattaata

SEQ ID NO: 141412 - DNA, 22 bp, Artificial Sequence
  Synthetic oligonucleotide; TTA chr11 5241462 5241483 5241467 5241462 -
acgtcttcaatggtattaatag

SEQ ID NO: 141413 - DNA, 22 bp, Artificial Sequence
  Synthetic oligonucleotide; CTT chr11 5241455 5241476 5241460 5241455 -
caatggtattaatagagaatta

SEQ ID NO: 141414 - DNA, 22 bp, Artificial Sequence
  Synthetic oligonucleotide; TTC chr11 5241454 5241475 5241459 5241454 -
aatggtattaatagagaattat

SEQ ID NO: 141415 - DNA, 22 bp, Artificial Sequence
  Synthetic oligonucleotide; TTA chr11 5241444 5241465 5241449 5241444 -
atagagaattatctctaaggca

SEQ ID NO: 141416 - DNA, 22 bp, Artificial Sequence
  Synthetic oligonucleotide; TTA chr11 5241433 5241454 5241438 5241433 -
tctctaaggcatgtgaactggc

SEQ ID NO: 141417 - DNA, 22 bp, Artificial Sequence
  Synthetic oligonucleotide; CTC chr11 5241429 5241450 5241434 5241429 -
taaggcatgtgaactggctgtc

SEQ ID NO: 141418 - DNA, 22 bp, Artificial Sequence
  Synthetic oligonucleotide; CTA chr11 5241427 5241448 5241432 5241427 -
aggcatgtgaactggctgtctt

SEQ ID NO: 141419 - DNA, 22 bp, Artificial Sequence
  Synthetic oligonucleotide; CTG chr11 5241413 5241434 5241418 5241413 -
gctgtcttggttttcatctgta

SEQ ID NO: 141420 - DNA, 22 bp, Artificial Sequence
  Synthetic oligonucleotide; CTG chr11 5241409 5241430 5241414 5241409 -
tcttggttttcatctgtacttc

SEQ ID NO: 141421 - DNA, 22 bp, Artificial Sequence
  Synthetic oligonucleotide; CTT chr11 5241405 5241426 5241410 5241405 -
ggttttcatctgtacttcatct

SEQ ID NO: 141422 - DNA, 22 bp, Artificial Sequence
  Synthetic oligonucleotide; TTG chr11 5241404 5241425 5241409 5241404 -
gttttcatctgtacttcatctg

SEQ ID NO: 141423 - DNA, 22 bp, Artificial Sequence
  Synthetic oligonucleotide; TTT chr11 5241400 5241421 5241405 5241400 -
tcatctgtacttcatctgctac

SEQ ID NO: 141424 - DNA, 22 bp, Artificial Sequence
  Synthetic oligonucleotide; TTT chr11 5241399 5241420 5241404 5241399 -
catctgtacttcatctgctacc

SEQ ID NO: 141425 - DNA, 22 bp, Artificial Sequence
  Synthetic oligonucleotide; TTC chr11 5241398 5241419 5241403 5241398 -
atctgtacttcatctgctacct

SEQ ID NO: 141426 - DNA, 22 bp, Artificial Sequence
  Synthetic oligonucleotide; CTG chr11 5241393 5241414 5241398 5241393 -
tacttcatctgctacctctgtg

SEQ ID NO: 141427 - DNA, 22 bp, Artificial Sequence
  Synthetic oligonucleotide; CTT chr11 5241388 5241409 5241393 5241388 -
catctgctacctctgtgacctg

SEQ ID NO: 141428 - DNA, 22 bp, Artificial Sequence
  Synthetic oligonucleotide; TTC chr11 5241387 5241408 5241392 5241387 -
atctgctacctctgtgacctga

SEQ ID NO: 141429 - DNA, 22 bp, Artificial Sequence
  Synthetic oligonucleotide; CTG chr11 5241382 5241403 5241387 5241382 -
ctacctctgtgacctgaaacat

SEQ ID NO: 141430 - DNA, 22 bp, Artificial Sequence
  Synthetic oligonucleotide; CTA chr11 5241379 5241400 5241384 5241379 -
cctctgtgacctgaaacatatt

SEQ ID NO: 141431 - DNA, 22 bp, Artificial Sequence
  Synthetic oligonucleotide; CTC chr11 5241375 5241396 5241380 5241375 -
tgtgacctgaaacatatttata

SEQ ID NO: 141432 - DNA, 22 bp, Artificial Sequence
  Synthetic oligonucleotide; CTG chr11 5241373 5241394 5241378 5241373 -
tgacctgaaacatatttataat

SEQ ID NO: 141433 - DNA, 22 bp, Artificial Sequence
  Synthetic oligonucleotide; CTG chr11 5241366 5241387 5241371 5241366 -
aaacatatttataattccatta

SEQ ID NO: 141434 - DNA, 22 bp, Artificial Sequence
  Synthetic oligonucleotide; TTT chr11 5241356 5241377 5241361 5241356 -
ataattccattaagctgtgcat

SEQ ID NO: 141435 - DNA, 22 bp, Artificial Sequence
  Synthetic oligonucleotide; TTA chr11 5241355 5241376 5241360 5241355 -
taattccattaagctgtgcata

SEQ ID NO: 141436 - DNA, 22 bp, Artificial Sequence
  Synthetic oligonucleotide; TTC chr11 5241349 5241370 5241354 5241349 -
cattaagctgtgcatatgatag

SEQ ID NO: 141437 - DNA, 22 bp, Artificial Sequence
  Synthetic oligonucleotide; TTA chr11 5241344 5241365 5241349 5241344 -
agctgtgcatatgatagattta

SEQ ID NO: 141438 - DNA, 22 bp, Artificial Sequence
  Synthetic oligonucleotide; CTG chr11 5241339 5241360 5241344 5241339 -
tgcatatgatagatttatcata

SEQ ID NO: 141439 - DNA, 22 bp, Artificial Sequence
  Synthetic oligonucleotide; TTT chr11 5241323 5241344 5241328 5241323 -
atcatatgtattttccttaaag

SEQ ID NO: 141440 - DNA, 22 bp, Artificial Sequence
  Synthetic oligonucleotide; TTA chr11 5241322 5241343 5241327 5241322 -
tcatatgtattttccttaaagg

SEQ ID NO: 141441 - DNA, 22 bp, Artificial Sequence
  Synthetic oligonucleotide; TTT chr11 5241310 5241331 5241315 5241310 -
tccttaaaggatttttgtaaga

SEQ ID NO: 141442 - DNA, 22 bp, Artificial Sequence
  Synthetic oligonucleotide; TTT chr11 5241309 5241330 5241314 5241309 -
ccttaaaggatttttgtaagaa

SEQ ID NO: 141443 - DNA, 22 bp, Artificial Sequence
  Synthetic oligonucleotide; TTC chr11 5241308 5241329 5241313 5241308 -
cttaaaggatttttgtaagaac

SEQ ID NO: 141444 - DNA, 22 bp, Artificial Sequence
  Synthetic oligonucleotide; CTT chr11 5241305 5241326 5241310 5241305 -
aaaggatttttgtaagaactaa

SEQ ID NO: 141445 - DNA, 22 bp, Artificial Sequence
  Synthetic oligonucleotide; TTA chr11 5241304 5241325 5241309 5241304 -
aaggatttttgtaagaactaat

SEQ ID NO: 141446 - DNA, 22 bp, Artificial Sequence
  Synthetic oligonucleotide; TTT chr11 5241296 5241317 5241301 5241296 -
ttgtaagaactaattgaattga

SEQ ID NO: 141447 - DNA, 22 bp, Artificial Sequence
  Synthetic oligonucleotide; TTT chr11 5241295 5241316 5241300 5241295 -
tgtaagaactaattgaattgat

SEQ ID NO: 141448 - DNA, 22 bp, Artificial Sequence
  Synthetic oligonucleotide; TTT chr11 5241294 5241315 5241299 5241294 -
gtaagaactaattgaattgata

SEQ ID NO: 141449 - DNA, 22 bp, Artificial Sequence
  Synthetic oligonucleotide; TTG chr11 5241293 5241314 5241298 5241293 -
taagaactaattgaattgatac

SEQ ID NO: 141450 - DNA, 22 bp, Artificial Sequence
  Synthetic oligonucleotide; CTA chr11 5241284 5241305 5241289 5241284 -
attgaattgatacctgtaaagt

SEQ ID NO: 141451 - DNA, 22 bp, Artificial Sequence
  Synthetic oligonucleotide; TTG chr11 5241280 5241301 5241285 5241280 -
aattgatacctgtaaagtcttt

SEQ ID NO: 141452 - DNA, 22 bp, Artificial Sequence
  Synthetic oligonucleotide; TTG chr11 5241275 5241296 5241280 5241275 -
atacctgtaaagtctttatcac

SEQ ID NO: 141453 - DNA, 22 bp, Artificial Sequence
  Synthetic oligonucleotide; CTG chr11 5241268 5241289 5241273 5241268 -
taaagtctttatcacactaccc

SEQ ID NO: 141454 - DNA, 22 bp, Artificial Sequence
  Synthetic oligonucleotide; CTT chr11 5241259 5241280 5241264 5241259 -
tatcacactacccaataaataa

SEQ ID NO: 141455 - DNA, 22 bp, Artificial Sequence
  Synthetic oligonucleotide; TTT chr11 5241258 5241279 5241263 5241258 -
atcacactacccaataaataat

SEQ ID NO: 141456 - DNA, 22 bp, Artificial Sequence
  Synthetic oligonucleotide; TTA chr11 5241257 5241278 5241262 5241257 -
tcacactacccaataaataata

SEQ ID NO: 141457 - DNA, 22 bp, Artificial Sequence
  Synthetic oligonucleotide; CTA chr11 5241249 5241270 5241254 5241249 -
cccaataaataataaatctctt

SEQ ID NO: 141458 - DNA, 22 bp, Artificial Sequence
  Synthetic oligonucleotide; CTC chr11 5241229 5241250 5241234 5241229 -
tttgttcagctctctgtttcta

SEQ ID NO: 141459 - DNA, 22 bp, Artificial Sequence
  Synthetic oligonucleotide; CTT chr11 5241227 5241248 5241232 5241227 -
tgttcagctctctgtttctata

SEQ ID NO: 141460 - DNA, 22 bp, Artificial Sequence
  Synthetic oligonucleotide; TTT chr11 5241226 5241247 5241231 5241226 -
gttcagctctctgtttctataa

SEQ ID NO: 141461 - DNA, 22 bp, Artificial Sequence
  Synthetic oligonucleotide; TTG chr11 5241225 5241246 5241230 5241225 -
ttcagctctctgtttctataaa

SEQ ID NO: 141462 - DNA, 22 bp, Artificial Sequence
  Synthetic oligonucleotide; TTC chr11 5241222 5241243 5241227 5241222 -
agctctctgtttctataaatat

SEQ ID NO: 141463 - DNA, 22 bp, Artificial Sequence
  Synthetic oligonucleotide; CTC chr11 5241217 5241238 5241222 5241217 -
tctgtttctataaatatgtaca

SEQ ID NO: 141464 - DNA, 22 bp, Artificial Sequence
  Synthetic oligonucleotide; CTC chr11 5241215 5241236 5241220 5241215 -
tgtttctataaatatgtacaag

SEQ ID NO: 141465 - DNA, 22 bp, Artificial Sequence
  Synthetic oligonucleotide; CTG chr11 5241213 5241234 5241218 5241213 -
tttctataaatatgtacaagtt

SEQ ID NO: 141466 - DNA, 22 bp, Artificial Sequence
  Synthetic oligonucleotide; TTT chr11 5241210 5241231 5241215 5241210 -
ctataaatatgtacaagtttta

SEQ ID NO: 141467 - DNA, 22 bp, Artificial Sequence
  Synthetic oligonucleotide; TTC chr11 5241209 5241230 5241214 5241209 -
tataaatatgtacaagttttat

SEQ ID NO: 141468 - DNA, 22 bp, Artificial Sequence
  Synthetic oligonucleotide; CTA chr11 5241207 5241228 5241212 5241207 -
taaatatgtacaagttttattg

SEQ ID NO: 141469 - DNA, 22 bp, Artificial Sequence
  Synthetic oligonucleotide; TTT chr11 5241190 5241211 5241195 5241190 -
tattgtttttagtggtagtgat

SEQ ID NO: 141470 - DNA, 22 bp, Artificial Sequence
  Synthetic oligonucleotide; TTT chr11 5241189 5241210 5241194 5241189 -
attgtttttagtggtagtgatt

SEQ ID NO: 141471 - DNA, 22 bp, Artificial Sequence
  Synthetic oligonucleotide; TTA chr11 5241188 5241209 5241193 5241188 -
ttgtttttagtggtagtgattt

SEQ ID NO: 141472 - DNA, 22 bp, Artificial Sequence
  Synthetic oligonucleotide; TTG chr11 5241185 5241206 5241190 5241185 -
tttttagtggtagtgattttat

SEQ ID NO: 141473 - DNA, 22 bp, Artificial Sequence
  Synthetic oligonucleotide; TTT chr11 5241182 5241203 5241187 5241182 -
ttagtggtagtgattttattct

SEQ ID NO: 141474 - DNA, 22 bp, Artificial Sequence
  Synthetic oligonucleotide; TTT chr11 5241181 5241202 5241186 5241181 -
tagtggtagtgattttattctc

SEQ ID NO: 141475 - DNA, 22 bp, Artificial Sequence
  Synthetic oligonucleotide; TTT chr11 5241180 5241201 5241185 5241180 -
agtggtagtgattttattctct

SEQ ID NO: 141476 - DNA, 22 bp, Artificial Sequence
  Synthetic oligonucleotide; TTA chr11 5241179 5241200 5241184 5241179 -
gtggtagtgattttattctctt

SEQ ID NO: 141477 - DNA, 22 bp, Artificial Sequence
  Synthetic oligonucleotide; TTT chr11 5241166 5241187 5241171 5241166 -
tattctctttctatatatatac

SEQ ID NO: 141478 - DNA, 22 bp, Artificial Sequence
  Synthetic oligonucleotide; TTT chr11 5241165 5241186 5241170 5241165 -
attctctttctatatatataca

SEQ ID NO: 141479 - DNA, 22 bp, Artificial Sequence
  Synthetic oligonucleotide; TTA chr11 5241164 5241185 5241169 5241164 -
ttctctttctatatatatacac

SEQ ID NO: 141480 - DNA, 22 bp, Artificial Sequence
  Synthetic oligonucleotide; TTC chr11 5241161 5241182 5241166 5241161 -
tctttctatatatatacacaca

SEQ ID NO: 141481 - DNA, 22 bp, Artificial Sequence
  Synthetic oligonucleotide; CTC chr11 5241159 5241180 5241164 5241159 -
tttctatatatatacacacaca

SEQ ID NO: 141482 - DNA, 22 bp, Artificial Sequence
  Synthetic oligonucleotide; CTT chr11 5241157 5241178 5241162 5241157 -
tctatatatatacacacacatg

SEQ ID NO: 141483 - DNA, 22 bp, Artificial Sequence
  Synthetic oligonucleotide; TTT chr11 5241156 5241177 5241161 5241156 -
ctatatatatacacacacatgt

SEQ ID NO: 141484 - DNA, 22 bp, Artificial Sequence
  Synthetic oligonucleotide; TTC chr11 5241155 5241176 5241160 5241155 -
tatatatatacacacacatgtg

SEQ ID NO: 141485 - DNA, 22 bp, Artificial Sequence
  Synthetic oligonucleotide; CTA chr11 5241153 5241174 5241158 5241153 -
tatatatacacacacatgtgtg

SEQ ID NO: 141486 - DNA, 22 bp, Artificial Sequence
  Synthetic oligonucleotide; TTC chr11 5241126 5241147 5241131 5241126 -
ataaatatatacaatttttatg

SEQ ID NO: 141487 - DNA, 22 bp, Artificial Sequence
  Synthetic oligonucleotide; TTT chr11 5241109 5241130 5241114 5241109 -
ttatgaataaaaaattattagc

SEQ ID NO: 141488 - DNA, 22 bp, Artificial Sequence
  Synthetic oligonucleotide; TTT chr11 5241108 5241129 5241113 5241108 -
tatgaataaaaaattattagca

SEQ ID NO: 141489 - DNA, 22 bp, Artificial Sequence
  Synthetic oligonucleotide; TTT chr11 5241107 5241128 5241112 5241107 -
atgaataaaaaattattagcaa

SEQ ID NO: 141490 - DNA, 22 bp, Artificial Sequence
  Synthetic oligonucleotide; TTA chr11 5241106 5241127 5241111 5241106 -
tgaataaaaaattattagcaat

SEQ ID NO: 141491 - DNA, 22 bp, Artificial Sequence
  Synthetic oligonucleotide; TTA chr11 5241092 5241113 5241097 5241092 -
ttagcaatcaatattgaaaacc

SEQ ID NO: 141492 - DNA, 22 bp, Artificial Sequence
  Synthetic oligonucleotide; TTA chr11 5241089 5241110 5241094 5241089 -
gcaatcaatattgaaaaccact

SEQ ID NO: 141493 - DNA, 22 bp, Artificial Sequence
  Synthetic oligonucleotide; TTG chr11 5241076 5241097 5241081 5241076 -
aaaaccactgatttttgtttat

SEQ ID NO: 141494 - DNA, 22 bp, Artificial Sequence
  Synthetic oligonucleotide; CTG chr11 5241066 5241087 5241071 5241066 -
atttttgtttatgtgagcaaac

SEQ ID NO: 141495 - DNA, 22 bp, Artificial Sequence
  Synthetic oligonucleotide; TTT chr11 5241062 5241083 5241067 5241062 -
ttgtttatgtgagcaaacagca

SEQ ID NO: 141496 - DNA, 22 bp, Artificial Sequence
  Synthetic oligonucleotide; TTT chr11 5241061 5241082 5241066 5241061 -
tgtttatgtgagcaaacagcag

SEQ ID NO: 141497 - DNA, 22 bp, Artificial Sequence
  Synthetic oligonucleotide; TTT chr11 5241060 5241081 5241065 5241060 -
gtttatgtgagcaaacagcaga

SEQ ID NO: 141498 - DNA, 22 bp, Artificial Sequence
  Synthetic oligonucleotide; TTG chr11 5241059 5241080 5241064 5241059 -
tttatgtgagcaaacagcagat

SEQ ID NO: 141499 - DNA, 22 bp, Artificial Sequence
  Synthetic oligonucleotide; TTT chr11 5241056 5241077 5241061 5241056 -
atgtgagcaaacagcagattaa

SEQ ID NO: 141500 - DNA, 22 bp, Artificial Sequence
  Synthetic oligonucleotide; TTA chr11 5241055 5241076 5241060 5241055 -
tgtgagcaaacagcagattaaa

SEQ ID NO: 141501 - DNA, 22 bp, Artificial Sequence
  Synthetic oligonucleotide; TTA chr11 5241035 5241056 5241040 5241035 -
aaaggctgagatttaggaaaca

SEQ ID NO: 141502 - DNA, 22 bp, Artificial Sequence
  Synthetic oligonucleotide; CTG chr11 5241027 5241048 5241032 5241027 -
agatttaggaaacagcacgtta

SEQ ID NO: 141503 - DNA, 22 bp, Artificial Sequence
  Synthetic oligonucleotide; TTT chr11 5241021 5241042 5241026 5241021 -
aggaaacagcacgttaagtcaa

SEQ ID NO: 141504 - DNA, 22 bp, Artificial Sequence
  Synthetic oligonucleotide; TTA chr11 5241020 5241041 5241025 5241020 -
ggaaacagcacgttaagtcaag

SEQ ID NO: 141505 - DNA, 22 bp, Artificial Sequence
  Synthetic oligonucleotide; TTA chr11 5241005 5241026 5241010 5241005 -
agtcaagttgatagaggagaat

SEQ ID NO: 141506 - DNA, 22 bp, Artificial Sequence
  Synthetic oligonucleotide; TTG chr11 5240995 5241016 5241000 5240995 -
atagaggagaatatggacattt

SEQ ID NO: 141507 - DNA, 22 bp, Artificial Sequence
  Synthetic oligonucleotide; TTT chr11 5240973 5240994 5240978 5240973 -
aaaagaggcaggatgatataaa

SEQ ID NO: 141508 - DNA, 22 bp, Artificial Sequence
  Synthetic oligonucleotide; TTA chr11 5240972 5240993 5240977 5240972 -
aaagaggcaggatgatataaaa

SEQ ID NO: 141509 - DNA, 22 bp, Artificial Sequence
  Synthetic oligonucleotide; TTA chr11 5240947 5240968 5240952 5240947 -
gggaaactggatgcagagacca

SEQ ID NO: 141510 - DNA, 22 bp, Artificial Sequence
  Synthetic oligonucleotide; CTG chr11 5240938 5240959 5240943 5240938 -
gatgcagagaccagatgaagta

SEQ ID NO: 141511 - DNA, 22 bp, Artificial Sequence
  Synthetic oligonucleotide; CTA chr11 5240903 5240924 5240908 5240903 -
tcgttttgagcaaaaatcactg

SEQ ID NO: 141512 - DNA, 22 bp, Artificial Sequence
  Synthetic oligonucleotide; TTT chr11 5240897 5240918 5240902 5240897 -
tgagcaaaaatcactgaagttt

SEQ ID NO: 141513 - DNA, 22 bp, Artificial Sequence
  Synthetic oligonucleotide; TTT chr11 5240896 5240917 5240901 5240896 -
gagcaaaaatcactgaagtttc

SEQ ID NO: 141514 - DNA, 22 bp, Artificial Sequence
  Synthetic oligonucleotide; TTG chr11 5240895 5240916 5240900 5240895 -
agcaaaaatcactgaagtttct

SEQ ID NO: 141515 - DNA, 22 bp, Artificial Sequence
  Synthetic oligonucleotide; CTG chr11 5240881 5240902 5240886 5240881 -
aagtttcttgcatatgagagtg

SEQ ID NO: 141516 - DNA, 22 bp, Artificial Sequence
  Synthetic oligonucleotide; TTT chr11 5240875 5240896 5240880 5240875 -
cttgcatatgagagtgacataa

SEQ ID NO: 141517 - DNA, 22 bp, Artificial Sequence
  Synthetic oligonucleotide; TTC chr11 5240874 5240895 5240879 5240874 -
ttgcatatgagagtgacataat

SEQ ID NO: 141518 - DNA, 22 bp, Artificial Sequence
  Synthetic oligonucleotide; CTT chr11 5240872 5240893 5240877 5240872 -
gcatatgagagtgacataataa

SEQ ID NO: 141519 - DNA, 22 bp, Artificial Sequence
  Synthetic oligonucleotide; TTG chr11 5240871 5240892 5240876 5240871 -
catatgagagtgacataataaa

SEQ ID NO: 141520 - DNA, 22 bp, Artificial Sequence
  Synthetic oligonucleotide; TTG chr11 5240829 5240850 5240834 5240829 -
attcacatgtatatatatatat

SEQ ID NO: 141521 - DNA, 22 bp, Artificial Sequence
  Synthetic oligonucleotide; TTC chr11 5240825 5240846 5240830 5240825 -
acatgtatatatatatatagaa

SEQ ID NO: 141522 - DNA, 22 bp, Artificial Sequence
  Synthetic oligonucleotide; CTG chr11 5240800 5240821 5240805 5240800 -
attagacaaagtctaacttggg

SEQ ID NO: 141523 - DNA, 22 bp, Artificial Sequence
  Synthetic oligonucleotide; TTA chr11 5240796 5240817 5240801 5240796 -
gacaaagtctaacttgggtata

SEQ ID NO: 141524 - DNA, 22 bp, Artificial Sequence
  Synthetic oligonucleotide; CTA chr11 5240785 5240806 5240790 5240785 -
acttgggtatagtcagaggagc

SEQ ID NO: 141525 - DNA, 22 bp, Artificial Sequence
  Synthetic oligonucleotide; CTT chr11 5240781 5240802 5240786 5240781 -
gggtatagtcagaggagcttgc

SEQ ID NO: 141526 - DNA, 22 bp, Artificial Sequence
  Synthetic oligonucleotide; TTG chr11 5240780 5240801 5240785 5240780 -
ggtatagtcagaggagcttgct

SEQ ID NO: 141527 - DNA, 22 bp, Artificial Sequence
  Synthetic oligonucleotide; CTT chr11 5240761 5240782 5240766 5240761 -
gctgtaattatattgaggtgat

SEQ ID NO: 141528 - DNA, 22 bp, Artificial Sequence
  Synthetic oligonucleotide; TTG chr11 5240760 5240781 5240765 5240760 -
ctgtaattatattgaggtgatg

SEQ ID NO: 141529 - DNA, 22 bp, Artificial Sequence
  Synthetic oligonucleotide; CTG chr11 5240757 5240778 5240762 5240757 -
taattatattgaggtgatggat

SEQ ID NO: 141530 - DNA, 22 bp, Artificial Sequence
  Synthetic oligonucleotide; TTA chr11 5240751 5240772 5240756 5240751 -
tattgaggtgatggataaagaa

SEQ ID NO: 141531 - DNA, 22 bp, Artificial Sequence
  Synthetic oligonucleotide; TTG chr11 5240746 5240767 5240751 5240746 -
aggtgatggataaagaactgaa

SEQ ID NO: 141532 - DNA, 22 bp, Artificial Sequence
  Synthetic oligonucleotide; CTG chr11 5240726 5240747 5240731 5240726 -
aagttgatggaaacaatgaagt

SEQ ID NO: 141533 - DNA, 22 bp, Artificial Sequence
  Synthetic oligonucleotide; TTG chr11 5240720 5240741 5240725 5240720 -
atggaaacaatgaagttaagaa

SEQ ID NO: 141534 - DNA, 22 bp, Artificial Sequence
  Synthetic oligonucleotide; TTA chr11 5240702 5240723 5240707 5240702 -
agaaaaaaaatcgagtaagaga

SEQ ID NO: 141535 - DNA, 22 bp, Artificial Sequence
  Synthetic oligonucleotide; TTG chr11 5240674 5240695 5240679 5240674 -
tggcagtgattgcacagaactg

SEQ ID NO: 141536 - DNA, 22 bp, Artificial Sequence
  Synthetic oligonucleotide; TTG chr11 5240662 5240683 5240667 5240662 -
cacagaactggaaaacattgtg

SEQ ID NO: 141537 - DNA, 22 bp, Artificial Sequence
  Synthetic oligonucleotide; CTG chr11 5240652 5240673 5240657 5240652 -
gaaaacattgtgaaacagagag

SEQ ID NO: 141538 - DNA, 22 bp, Artificial Sequence
  Synthetic oligonucleotide; TTG chr11 5240642 5240663 5240647 5240642 -
tgaaacagagagtcagagatga

SEQ ID NO: 141539 - DNA, 22 bp, Artificial Sequence
  Synthetic oligonucleotide; CTA chr11 5240614 5240635 5240619 5240614 -
aaatccctgtctgtgaatgaaa

SEQ ID NO: 141540 - DNA, 22 bp, Artificial Sequence
  Synthetic oligonucleotide; CTG chr11 5240605 5240626 5240610 5240605 -
tctgtgaatgaaaagaaggaaa

SEQ ID NO: 141541 - DNA, 22 bp, Artificial Sequence
  Synthetic oligonucleotide; CTG chr11 5240601 5240622 5240606 5240601 -
tgaatgaaaagaaggaaattta

SEQ ID NO: 141542 - DNA, 22 bp, Artificial Sequence
  Synthetic oligonucleotide; TTT chr11 5240580 5240601 5240585 5240580 -
attgacagaacagcaaatgcct

SEQ ID NO: 141543 - DNA, 22 bp, Artificial Sequence
  Synthetic oligonucleotide; TTA chr11 5240579 5240600 5240584 5240579 -
ttgacagaacagcaaatgccta

SEQ ID NO: 141544 - DNA, 22 bp, Artificial Sequence
  Synthetic oligonucleotide; TTG chr11 5240576 5240597 5240581 5240576 -
acagaacagcaaatgcctacaa

SEQ ID NO: 141545 - DNA, 22 bp, Artificial Sequence
  Synthetic oligonucleotide; CTA chr11 5240557 5240578 5240562 5240557 -
caagccccctgtttggatctgg

SEQ ID NO: 141546 - DNA, 22 bp, Artificial Sequence
  Synthetic oligonucleotide; CTG chr11 5240546 5240567 5240551 5240546 -
tttggatctggcaatgaacgta

SEQ ID NO: 141547 - DNA, 22 bp, Artificial Sequence
  Synthetic oligonucleotide; TTT chr11 5240543 5240564 5240548 5240543 -
ggatctggcaatgaacgtagcc

SEQ ID NO: 141548 - DNA, 22 bp, Artificial Sequence
  Synthetic oligonucleotide; TTG chr11 5240542 5240563 5240547 5240542 -
gatctggcaatgaacgtagcca

SEQ ID NO: 141549 - DNA, 22 bp, Artificial Sequence
  Synthetic oligonucleotide; CTG chr11 5240536 5240557 5240541 5240536 -
gcaatgaacgtagccattctgt

SEQ ID NO: 141550 - DNA, 22 bp, Artificial Sequence
  Synthetic oligonucleotide; TTC chr11 5240517 5240538 5240522 5240517 -
tgtggcaatcacttcaaactcc

SEQ ID NO: 141551 - DNA, 22 bp, Artificial Sequence
  Synthetic oligonucleotide; CTG chr11 5240515 5240536 5240520 5240515 -
tggcaatcacttcaaactcctg

SEQ ID NO: 141552 - DNA, 22 bp, Artificial Sequence
  Synthetic oligonucleotide; CTT chr11 5240503 5240524 5240508 5240503 -
caaactcctgtacccaagaccc

SEQ ID NO: 141553 - DNA, 22 bp, Artificial Sequence
  Synthetic oligonucleotide; TTC chr11 5240502 5240523 5240507 5240502 -
aaactcctgtacccaagaccct

SEQ ID NO: 141554 - DNA, 22 bp, Artificial Sequence
  Synthetic oligonucleotide; CTC chr11 5240496 5240517 5240501 5240496 -
ctgtacccaagacccttaggaa

SEQ ID NO: 141555 - DNA, 22 bp, Artificial Sequence
  Synthetic oligonucleotide; CTG chr11 5240493 5240514 5240498 5240493 -
tacccaagacccttaggaagta

SEQ ID NO: 141556 - DNA, 22 bp, Artificial Sequence
  Synthetic oligonucleotide; CTT chr11 5240479 5240500 5240484 5240479 -
aggaagtatgtagcaccctcaa

SEQ ID NO: 141557 - DNA, 22 bp, Artificial Sequence
  Synthetic oligonucleotide; TTA chr11 5240478 5240499 5240483 5240478 -
ggaagtatgtagcaccctcaaa

SEQ ID NO: 141558 - DNA, 22 bp, Artificial Sequence
  Synthetic oligonucleotide; CTC chr11 5240459 5240480 5240464 5240459 -
aaacctaaaacctcaaagaaag

SEQ ID NO: 141559 - DNA, 22 bp, Artificial Sequence
  Synthetic oligonucleotide; CTA chr11 5240452 5240473 5240457 5240452 -
aaacctcaaagaaagaggtttt

SEQ ID NO: 141560 - DNA, 22 bp, Artificial Sequence
  Synthetic oligonucleotide; CTC chr11 5240445 5240466 5240450 5240445 -
aaagaaagaggttttagaagat

SEQ ID NO: 141561 - DNA, 22 bp, Artificial Sequence
  Synthetic oligonucleotide; TTT chr11 5240431 5240452 5240436 5240431 -
tagaagatataataccctttct

SEQ ID NO: 141562 - DNA, 22 bp, Artificial Sequence
  Synthetic oligonucleotide; TTT chr11 5240430 5240451 5240435 5240430 -
agaagatataataccctttctt

SEQ ID NO: 141563 - DNA, 22 bp, Artificial Sequence
  Synthetic oligonucleotide; TTA chr11 5240429 5240450 5240434 5240429 -
gaagatataataccctttcttc

SEQ ID NO: 141564 - DNA, 22 bp, Artificial Sequence
  Synthetic oligonucleotide; CTT chr11 5240412 5240433 5240417 5240412 -
tcttctccagtttcattaatcc

SEQ ID NO: 141565 - DNA, 22 bp, Artificial Sequence
  Synthetic oligonucleotide; TTT chr11 5240411 5240432 5240416 5240411 -
cttctccagtttcattaatccc

SEQ ID NO: 141566 - DNA, 22 bp, Artificial Sequence
  Synthetic oligonucleotide; TTC chr11 5240410 5240431 5240415 5240410 -
ttctccagtttcattaatccca

SEQ ID NO: 141567 - DNA, 22 bp, Artificial Sequence
  Synthetic oligonucleotide; CTT chr11 5240408 5240429 5240413 5240408 -
ctccagtttcattaatcccaaa

SEQ ID NO: 141568 - DNA, 22 bp, Artificial Sequence
  Synthetic oligonucleotide; TTC chr11 5240407 5240428 5240412 5240407 -
tccagtttcattaatcccaaaa

SEQ ID NO: 141569 - DNA, 22 bp, Artificial Sequence
  Synthetic oligonucleotide; CTC chr11 5240405 5240426 5240410 5240405 -
cagtttcattaatcccaaaacc

SEQ ID NO: 141570 - DNA, 22 bp, Artificial Sequence
  Synthetic oligonucleotide; TTT chr11 5240399 5240420 5240404 5240399 -
cattaatcccaaaacctctttc

SEQ ID NO: 141571 - DNA, 22 bp, Artificial Sequence
  Synthetic oligonucleotide; TTC chr11 5240398 5240419 5240403 5240398 -
attaatcccaaaacctctttct

SEQ ID NO: 141572 - DNA, 22 bp, Artificial Sequence
  Synthetic oligonucleotide; TTA chr11 5240394 5240415 5240399 5240394 -
atcccaaaacctctttctcaaa

SEQ ID NO: 141573 - DNA, 22 bp, Artificial Sequence
  Synthetic oligonucleotide; CTC chr11 5240381 5240402 5240386 5240381 -
tttctcaaagtatttcctctat

SEQ ID NO: 141574 - DNA, 22 bp, Artificial Sequence
  Synthetic oligonucleotide; CTT chr11 5240379 5240400 5240384 5240379 -
tctcaaagtatttcctctatgt

SEQ ID NO: 141575 - DNA, 22 bp, Artificial Sequence
  Synthetic oligonucleotide; TTT chr11 5240378 5240399 5240383 5240378 -
ctcaaagtatttcctctatgtg

SEQ ID NO: 141576 - DNA, 22 bp, Artificial Sequence
  Synthetic oligonucleotide; TTC chr11 5240377 5240398 5240382 5240377 -
tcaaagtatttcctctatgtgt

SEQ ID NO: 141577 - DNA, 22 bp, Artificial Sequence
  Synthetic oligonucleotide; CTC chr11 5240375 5240396 5240380 5240375 -
aaagtatttcctctatgtgtcc

SEQ ID NO: 141578 - DNA, 22 bp, Artificial Sequence
  Synthetic oligonucleotide; TTT chr11 5240366 5240387 5240371 5240366 -
cctctatgtgtccaccccaaag

SEQ ID NO: 141579 - DNA, 22 bp, Artificial Sequence
  Synthetic oligonucleotide; TTC chr11 5240365 5240386 5240370 5240365 -
ctctatgtgtccaccccaaaga

SEQ ID NO: 141580 - DNA, 22 bp, Artificial Sequence
  Synthetic oligonucleotide; CTC chr11 5240362 5240383 5240367 5240362 -
tatgtgtccaccccaaagagct

SEQ ID NO: 141581 - DNA, 22 bp, Artificial Sequence
  Synthetic oligonucleotide; CTA chr11 5240360 5240381 5240365 5240360 -
tgtgtccaccccaaagagctca

SEQ ID NO: 141582 - DNA, 22 bp, Artificial Sequence
  Synthetic oligonucleotide; CTC chr11 5240339 5240360 5240344 5240339 -
acctcaccatatctcttgagtg

SEQ ID NO: 141583 - DNA, 22 bp, Artificial Sequence
  Synthetic oligonucleotide; CTC chr11 5240334 5240355 5240339 5240334 -
accatatctcttgagtgggagc

SEQ ID NO: 141584 - DNA, 22 bp, Artificial Sequence
  Synthetic oligonucleotide; CTC chr11 5240324 5240345 5240329 5240324 -
ttgagtgggagcacatagatag

SEQ ID NO: 141585 - DNA, 22 bp, Artificial Sequence
  Synthetic oligonucleotide; CTT chr11 5240322 5240343 5240327 5240322 -
gagtgggagcacatagataggc

SEQ ID NO: 141586 - DNA, 22 bp, Artificial Sequence
  Synthetic oligonucleotide; TTG chr11 5240321 5240342 5240326 5240321 -
agtgggagcacatagataggcg

SEQ ID NO: 141587 - DNA, 22 bp, Artificial Sequence
  Synthetic oligonucleotide; CTA chr11 5240293 5240314 5240298 5240293 -
ccatctaacagcttctgaaatt

SEQ ID NO: 141588 - DNA, 22 bp, Artificial Sequence
  Synthetic oligonucleotide; CTA chr11 5240286 5240307 5240291 5240286 -
acagcttctgaaattcctttgt

SEQ ID NO: 141589 - DNA, 22 bp, Artificial Sequence
  Synthetic oligonucleotide; CTT chr11 5240279 5240300 5240284 5240279 -
ctgaaattcctttgtcatattt

SEQ ID NO: 141590 - DNA, 22 bp, Artificial Sequence
  Synthetic oligonucleotide; TTC chr11 5240278 5240299 5240283 5240278 -
tgaaattcctttgtcatatttt

SEQ ID NO: 141591 - DNA, 22 bp, Artificial Sequence
  Synthetic oligonucleotide; CTG chr11 5240276 5240297 5240281 5240276 -
aaattcctttgtcatatttttg

SEQ ID NO: 141592 - DNA, 22 bp, Artificial Sequence
  Synthetic oligonucleotide; TTC chr11 5240270 5240291 5240275 5240270 -
ctttgtcatatttttgagtccc

SEQ ID NO: 141593 - DNA, 22 bp, Artificial Sequence
  Synthetic oligonucleotide; CTT chr11 5240267 5240288 5240272 5240267 -
tgtcatatttttgagtccccac

SEQ ID NO: 141594 - DNA, 22 bp, Artificial Sequence
  Synthetic oligonucleotide; TTT chr11 5240266 5240287 5240271 5240266 -
gtcatatttttgagtccccact

SEQ ID NO: 141595 - DNA, 22 bp, Artificial Sequence
  Synthetic oligonucleotide; TTG chr11 5240265 5240286 5240270 5240265 -
tcatatttttgagtccccacta

SEQ ID NO: 141596 - DNA, 22 bp, Artificial Sequence
  Synthetic oligonucleotide; TTT chr11 5240257 5240278 5240262 5240257 -
ttgagtccccactaataaccca

SEQ ID NO: 141597 - DNA, 22 bp, Artificial Sequence
  Synthetic oligonucleotide; TTT chr11 5240256 5240277 5240261 5240256 -
tgagtccccactaataacccac

SEQ ID NO: 141598 - DNA, 22 bp, Artificial Sequence
  Synthetic oligonucleotide; TTT chr11 5240255 5240276 5240260 5240255 -
gagtccccactaataacccaca

SEQ ID NO: 141599 - DNA, 22 bp, Artificial Sequence
  Synthetic oligonucleotide; TTG chr11 5240254 5240275 5240259 5240254 -
agtccccactaataacccacaa

SEQ ID NO: 141600 - DNA, 22 bp, Artificial Sequence
  Synthetic oligonucleotide; CTA chr11 5240243 5240264 5240248 5240243 -
ataacccacaaagcagaataaa

SEQ ID NO: 141601 - DNA, 22 bp, Artificial Sequence
  Synthetic oligonucleotide; TTG chr11 5240212 5240233 5240217 5240212 -
ctcatgtacaataatcactcaa

SEQ ID NO: 141602 - DNA, 22 bp, Artificial Sequence
  Synthetic oligonucleotide; CTC chr11 5240209 5240230 5240214 5240209 -
atgtacaataatcactcaactg

SEQ ID NO: 141603 - DNA, 22 bp, Artificial Sequence
  Synthetic oligonucleotide; CTC chr11 5240192 5240213 5240197 5240192 -
aactgctgtcttgtagcataca

SEQ ID NO: 141604 - DNA, 22 bp, Artificial Sequence
  Synthetic oligonucleotide; CTG chr11 5240187 5240208 5240192 5240187 -
ctgtcttgtagcatacattaat

SEQ ID NO: 141605 - DNA, 22 bp, Artificial Sequence
  Synthetic oligonucleotide; CTG chr11 5240184 5240205 5240189 5240184 -
tcttgtagcatacattaattaa

SEQ ID NO: 141606 - DNA, 22 bp, Artificial Sequence
  Synthetic oligonucleotide; CTT chr11 5240180 5240201 5240185 5240180 -
gtagcatacattaattaagcac

SEQ ID NO: 141607 - DNA, 22 bp, Artificial Sequence
  Synthetic oligonucleotide; TTG chr11 5240179 5240200 5240184 5240179 -
tagcatacattaattaagcaca

SEQ ID NO: 141608 - DNA, 22 bp, Artificial Sequence
  Synthetic oligonucleotide; TTA chr11 5240167 5240188 5240172 5240167 -
attaagcacattctttgaataa

SEQ ID NO: 141609 - DNA, 22 bp, Artificial Sequence
  Synthetic oligonucleotide; TTA chr11 5240163 5240184 5240168 5240163 -
agcacattctttgaataattac

SEQ ID NO: 141610 - DNA, 22 bp, Artificial Sequence
  Synthetic oligonucleotide; TTC chr11 5240154 5240175 5240159 5240154 -
tttgaataattactgtgtccaa

SEQ ID NO: 141611 - DNA, 22 bp, Artificial Sequence
  Synthetic oligonucleotide; CTT chr11 5240152 5240173 5240157 5240152 -
tgaataattactgtgtccaaac

SEQ ID NO: 141612 - DNA, 22 bp, Artificial Sequence
  Synthetic oligonucleotide; TTT chr11 5240151 5240172 5240156 5240151 -
gaataattactgtgtccaaaca

SEQ ID NO: 141613 - DNA, 22 bp, Artificial Sequence
  Synthetic oligonucleotide; TTG chr11 5240150 5240171 5240155 5240150 -
aataattactgtgtccaaacaa

SEQ ID NO: 141614 - DNA, 22 bp, Artificial Sequence
  Synthetic oligonucleotide; TTA chr11 5240142 5240163 5240147 5240142 -
ctgtgtccaaacaatcacactt

SEQ ID NO: 141615 - DNA, 22 bp, Artificial Sequence
  Synthetic oligonucleotide; CTG chr11 5240139 5240160 5240144 5240139 -
tgtccaaacaatcacactttaa

SEQ ID NO: 141616 - DNA, 22 bp, Artificial Sequence
  Synthetic oligonucleotide; CTT chr11 5240120 5240141 5240125 5240120 -
taaaatctcacacttgtgctat

SEQ ID NO: 141617 - DNA, 22 bp, Artificial Sequence
  Synthetic oligonucleotide; TTT chr11 5240119 5240140 5240124 5240119 -
aaaatctcacacttgtgctatc

SEQ ID NO: 141618 - DNA, 22 bp, Artificial Sequence
  Synthetic oligonucleotide; TTA chr11 5240118 5240139 5240123 5240118 -
aaatctcacacttgtgctatcc

SEQ ID NO: 141619 - DNA, 22 bp, Artificial Sequence
  Synthetic oligonucleotide; CTC chr11 5240111 5240132 5240116 5240111 -
acacttgtgctatcccttgccc

SEQ ID NO: 141620 - DNA, 22 bp, Artificial Sequence
  Synthetic oligonucleotide; CTT chr11 5240105 5240126 5240110 5240105 -
gtgctatcccttgcccttctga

SEQ ID NO: 141621 - DNA, 22 bp, Artificial Sequence
  Synthetic oligonucleotide; TTG chr11 5240104 5240125 5240109 5240104 -
tgctatcccttgcccttctgaa

SEQ ID NO: 141622 - DNA, 22 bp, Artificial Sequence
  Synthetic oligonucleotide; CTA chr11 5240099 5240120 5240104 5240099 -
tcccttgcccttctgaatgtca

SEQ ID NO: 141623 - DNA, 22 bp, Artificial Sequence
  Synthetic oligonucleotide; CTT chr11 5240093 5240114 5240098 5240093 -
gcccttctgaatgtcactctgt

SEQ ID NO: 141624 - DNA, 22 bp, Artificial Sequence
  Synthetic oligonucleotide; TTG chr11 5240092 5240113 5240097 5240092 -
cccttctgaatgtcactctgta

SEQ ID NO: 141625 - DNA, 22 bp, Artificial Sequence
  Synthetic oligonucleotide; CTT chr11 5240087 5240108 5240092 5240087 -
ctgaatgtcactctgtatttta

SEQ ID NO: 141626 - DNA, 22 bp, Artificial Sequence
  Synthetic oligonucleotide; TTC chr11 5240086 5240107 5240091 5240086 -
tgaatgtcactctgtattttaa

SEQ ID NO: 141627 - DNA, 22 bp, Artificial Sequence
  Synthetic oligonucleotide; CTG chr11 5240084 5240105 5240089 5240084 -
aatgtcactctgtattttaaat

SEQ ID NO: 141628 - DNA, 22 bp, Artificial Sequence
  Synthetic oligonucleotide; CTC chr11 5240074 5240095 5240079 5240074 -
tgtattttaaatgaagagatga

SEQ ID NO: 141629 - DNA, 22 bp, Artificial Sequence
  Synthetic oligonucleotide; CTG chr11 5240072 5240093 5240077 5240072 -
tattttaaatgaagagatgagg

SEQ ID NO: 141630 - DNA, 22 bp, Artificial Sequence
  Synthetic oligonucleotide; TTT chr11 5240067 5240088 5240072 5240067 -
taaatgaagagatgagggttga

SEQ ID NO: 141631 - DNA, 22 bp, Artificial Sequence
  Synthetic oligonucleotide; TTT chr11 5240066 5240087 5240071 5240066 -
aaatgaagagatgagggttgaa

SEQ ID NO: 141632 - DNA, 22 bp, Artificial Sequence
  Synthetic oligonucleotide; TTA chr11 5240065 5240086 5240070 5240065 -
aatgaagagatgagggttgaat

SEQ ID NO: 141633 - DNA, 22 bp, Artificial Sequence
  Synthetic oligonucleotide; TTG chr11 5240046 5240067 5240051 5240046 -
aatttcctgtgttacttattgt

SEQ ID NO: 141634 - DNA, 22 bp, Artificial Sequence
  Synthetic oligonucleotide; TTT chr11 5240041 5240062 5240046 5240041 -
cctgtgttacttattgttcatt

SEQ ID NO: 141635 - DNA, 22 bp, Artificial Sequence
  Synthetic oligonucleotide; TTC chr11 5240040 5240061 5240045 5240040 -
ctgtgttacttattgttcattt

SEQ ID NO: 141636 - DNA, 22 bp, Artificial Sequence
  Synthetic oligonucleotide; CTG chr11 5240037 5240058 5240042 5240037 -
tgttacttattgttcatttctc

SEQ ID NO: 141637 - DNA, 22 bp, Artificial Sequence
  Synthetic oligonucleotide; TTA chr11 5240032 5240053 5240037 5240032 -
cttattgttcatttctcgatga

SEQ ID NO: 141638 - DNA, 22 bp, Artificial Sequence
  Synthetic oligonucleotide; CTT chr11 5240029 5240050 5240034 5240029 -
attgttcatttctcgatgagga

SEQ ID NO: 141639 - DNA, 22 bp, Artificial Sequence
  Synthetic oligonucleotide; TTA chr11 5240028 5240049 5240033 5240028 -
ttgttcatttctcgatgaggag

SEQ ID NO: 141640 - DNA, 22 bp, Artificial Sequence
  Synthetic oligonucleotide; TTG chr11 5240025 5240046 5240030 5240025 -
ttcatttctcgatgaggagttt

SEQ ID NO: 141641 - DNA, 22 bp, Artificial Sequence
  Synthetic oligonucleotide; TTC chr11 5240022 5240043 5240027 5240022 -
atttctcgatgaggagttttca

SEQ ID NO: 141642 - DNA, 22 bp, Artificial Sequence
  Synthetic oligonucleotide; TTT chr11 5240018 5240039 5240023 5240018 -
ctcgatgaggagttttcacatt

SEQ ID NO: 141643 - DNA, 22 bp, Artificial Sequence
  Synthetic oligonucleotide; TTC chr11 5240017 5240038 5240022 5240017 -
tcgatgaggagttttcacattc

SEQ ID NO: 141644 - DNA, 22 bp, Artificial Sequence
  Synthetic oligonucleotide; CTC chr11 5240015 5240036 5240020 5240015 -
gatgaggagttttcacattcac

SEQ ID NO: 141645 - DNA, 22 bp, Artificial Sequence
  Synthetic oligonucleotide; TTT chr11 5240003 5240024 5240008 5240003 -
tcacattcacctttagtggaaa

SEQ ID NO: 141646 - DNA, 22 bp, Artificial Sequence
  Synthetic oligonucleotide; TTT chr11 5240002 5240023 5240007 5240002 -
cacattcacctttagtggaaaa

SEQ ID NO: 141647 - DNA, 22 bp, Artificial Sequence
  Synthetic oligonucleotide; TTC chr11 5240001 5240022 5240006 5240001 -
acattcacctttagtggaaaac

SEQ ID NO: 141648 - DNA, 22 bp, Artificial Sequence
  Synthetic oligonucleotide; TTC chr11 5239995 5240016 5240000 5239995 -
acctttagtggaaaacacataa

SEQ ID NO: 141649 - DNA, 22 bp, Artificial Sequence
  Synthetic oligonucleotide; CTT chr11 5239990 5240011 5239995 5239990 -
tagtggaaaacacataagtaca

SEQ ID NO: 141650 - DNA, 22 bp, Artificial Sequence
  Synthetic oligonucleotide; TTT chr11 5239989 5240010 5239994 5239989 -
agtggaaaacacataagtacac

SEQ ID NO: 141651 - DNA, 22 bp, Artificial Sequence
  Synthetic oligonucleotide; TTA chr11 5239988 5240009 5239993 5239988 -
gtggaaaacacataagtacaca

SEQ ID NO: 141652 - DNA, 22 bp, Artificial Sequence
  Synthetic oligonucleotide; CTT chr11 5239962 5239983 5239967 5239962 -
acaggaaaaatataccaaactg

SEQ ID NO: 141653 - DNA, 22 bp, Artificial Sequence
  Synthetic oligonucleotide; TTA chr11 5239961 5239982 5239966 5239961 -
caggaaaaatataccaaactga

SEQ ID NO: 141654 - DNA, 22 bp, Artificial Sequence
  Synthetic oligonucleotide; CTG chr11 5239940 5239961 5239945 5239940 -
acatgtagcatgaatgcttgtg

SEQ ID NO: 141655 - DNA, 22 bp, Artificial Sequence
  Synthetic oligonucleotide; CTT chr11 5239921 5239942 5239926 5239921 -
gtgcatgtagtcatataaaatc

SEQ ID NO: 141656 - DNA, 22 bp, Artificial Sequence
  Synthetic oligonucleotide; TTG chr11 5239920 5239941 5239925 5239920 -
tgcatgtagtcatataaaatct

SEQ ID NO: 141657 - DNA, 22 bp, Artificial Sequence
  Synthetic oligonucleotide; CTT chr11 5239897 5239918 5239902 5239897 -
gtagcaatgtaaacattctctg

SEQ ID NO: 141658 - DNA, 22 bp, Artificial Sequence
  Synthetic oligonucleotide; TTG chr11 5239896 5239917 5239901 5239896 -
tagcaatgtaaacattctctga

SEQ ID NO: 141659 - DNA, 22 bp, Artificial Sequence
  Synthetic oligonucleotide; TTC chr11 5239879 5239900 5239884 5239879 -
tctgatatacacatacagatgt

SEQ ID NO: 141660 - DNA, 22 bp, Artificial Sequence
  Synthetic oligonucleotide; CTC chr11 5239877 5239898 5239882 5239877 -
tgatatacacatacagatgtgt

SEQ ID NO: 141661 - DNA, 22 bp, Artificial Sequence
  Synthetic oligonucleotide; CTG chr11 5239875 5239896 5239880 5239875 -
atatacacatacagatgtgtct

SEQ ID NO: 141662 - DNA, 22 bp, Artificial Sequence
  Synthetic oligonucleotide; CTA chr11 5239852 5239873 5239857 5239852 -
tatgtctacacaatttcttatg

SEQ ID NO: 141663 - DNA, 22 bp, Artificial Sequence
  Synthetic oligonucleotide; CTA chr11 5239844 5239865 5239849 5239844 -
cacaatttcttatgctccatga

SEQ ID NO: 141664 - DNA, 22 bp, Artificial Sequence
  Synthetic oligonucleotide; TTT chr11 5239836 5239857 5239841 5239836 -
cttatgctccatgaacaaacat

SEQ ID NO: 141665 - DNA, 22 bp, Artificial Sequence
  Synthetic oligonucleotide; TTC chr11 5239835 5239856 5239840 5239835 -
ttatgctccatgaacaaacatt

SEQ ID NO: 141666 - DNA, 22 bp, Artificial Sequence
  Synthetic oligonucleotide; CTT chr11 5239833 5239854 5239838 5239833 -
atgctccatgaacaaacattcc

SEQ ID NO: 141667 - DNA, 22 bp, Artificial Sequence
  Synthetic oligonucleotide; TTA chr11 5239832 5239853 5239837 5239832 -
tgctccatgaacaaacattcca

SEQ ID NO: 141668 - DNA, 22 bp, Artificial Sequence
  Synthetic oligonucleotide; CTC chr11 5239827 5239848 5239832 5239827 -
catgaacaaacattccatgcac

SEQ ID NO: 141669 - DNA, 22 bp, Artificial Sequence
  Synthetic oligonucleotide; TTC chr11 5239812 5239833 5239817 5239812 -
catgcacacataagaacacaca

SEQ ID NO: 141670 - DNA, 22 bp, Artificial Sequence
  Synthetic oligonucleotide; CTG chr11 5239787 5239808 5239792 5239787 -
ttacagatgcatacttgagtgc

SEQ ID NO: 141671 - DNA, 22 bp, Artificial Sequence
  Synthetic oligonucleotide; TTA chr11 5239784 5239805 5239789 5239784 -
cagatgcatacttgagtgcatt

SEQ ID NO: 141672 - DNA, 22 bp, Artificial Sequence
  Synthetic oligonucleotide; CTT chr11 5239771 5239792 5239776 5239771 -
gagtgcattgacaaaattaccc

SEQ ID NO: 141673 - DNA, 22 bp, Artificial Sequence
  Synthetic oligonucleotide; TTG chr11 5239770 5239791 5239775 5239770 -
agtgcattgacaaaattacccc

SEQ ID NO: 141674 - DNA, 22 bp, Artificial Sequence
  Synthetic oligonucleotide; TTG chr11 5239761 5239782 5239766 5239761 -
acaaaattaccccagtcaatct

SEQ ID NO: 141675 - DNA, 22 bp, Artificial Sequence
  Synthetic oligonucleotide; TTA chr11 5239752 5239773 5239757 5239752 -
ccccagtcaatctagagaattt

SEQ ID NO: 141676 - DNA, 22 bp, Artificial Sequence
  Synthetic oligonucleotide; CTA chr11 5239738 5239759 5239743 5239738 -
gagaatttggatttctgcattt

SEQ ID NO: 141677 - DNA, 22 bp, Artificial Sequence
  Synthetic oligonucleotide; TTT chr11 5239730 5239751 5239735 5239730 -
ggatttctgcatttgactctgt

SEQ ID NO: 141678 - DNA, 22 bp, Artificial Sequence
  Synthetic oligonucleotide; TTG chr11 5239729 5239750 5239734 5239729 -
gatttctgcatttgactctgtt

SEQ ID NO: 141679 - DNA, 22 bp, Artificial Sequence
  Synthetic oligonucleotide; TTT chr11 5239724 5239745 5239729 5239724 -
ctgcatttgactctgttagctt

SEQ ID NO: 141680 - DNA, 22 bp, Artificial Sequence
  Synthetic oligonucleotide; TTC chr11 5239723 5239744 5239728 5239723 -
tgcatttgactctgttagcttt

SEQ ID NO: 141681 - DNA, 22 bp, Artificial Sequence
  Synthetic oligonucleotide; CTG chr11 5239721 5239742 5239726 5239721 -
catttgactctgttagctttgt

SEQ ID NO: 141682 - DNA, 22 bp, Artificial Sequence
  Synthetic oligonucleotide; TTT chr11 5239716 5239737 5239721 5239716 -
gactctgttagctttgtacatg

SEQ ID NO: 141683 - DNA, 22 bp, Artificial Sequence
  Synthetic oligonucleotide; TTG chr11 5239715 5239736 5239720 5239715 -
actctgttagctttgtacatgc

SEQ ID NO: 141684 - DNA, 22 bp, Artificial Sequence
  Synthetic oligonucleotide; CTC chr11 5239711 5239732 5239716 5239711 -
tgttagctttgtacatgctgtt

SEQ ID NO: 141685 - DNA, 22 bp, Artificial Sequence
  Synthetic oligonucleotide; CTG chr11 5239709 5239730 5239714 5239709 -
ttagctttgtacatgctgttca

SEQ ID NO: 141686 - DNA, 22 bp, Artificial Sequence
  Synthetic oligonucleotide; TTA chr11 5239706 5239727 5239711 5239706 -
gctttgtacatgctgttcattt

SEQ ID NO: 141687 - DNA, 22 bp, Artificial Sequence
  Synthetic oligonucleotide; CTT chr11 5239702 5239723 5239707 5239702 -
tgtacatgctgttcatttactc

SEQ ID NO: 141688 - DNA, 22 bp, Artificial Sequence
  Synthetic oligonucleotide; TTT chr11 5239701 5239722 5239706 5239701 -
gtacatgctgttcatttactct

SEQ ID NO: 141689 - DNA, 22 bp, Artificial Sequence
  Synthetic oligonucleotide; TTG chr11 5239700 5239721 5239705 5239700 -
tacatgctgttcatttactctg

SEQ ID NO: 141690 - DNA, 22 bp, Artificial Sequence
  Synthetic oligonucleotide; CTG chr11 5239691 5239712 5239696 5239691 -
ttcatttactctgggtgatgtc

SEQ ID NO: 141691 - DNA, 22 bp, Artificial Sequence
  Synthetic oligonucleotide; TTC chr11 5239688 5239709 5239693 5239688 -
atttactctgggtgatgtcttt

SEQ ID NO: 141692 - DNA, 22 bp, Artificial Sequence
  Synthetic oligonucleotide; TTT chr11 5239684 5239705 5239689 5239684 -
actctgggtgatgtctttccct

SEQ ID NO: 141693 - DNA, 22 bp, Artificial Sequence
  Synthetic oligonucleotide; TTA chr11 5239683 5239704 5239688 5239683 -
ctctgggtgatgtctttccctc

SEQ ID NO: 141694 - DNA, 22 bp, Artificial Sequence
  Synthetic oligonucleotide; CTC chr11 5239680 5239701 5239685 5239680 -
tgggtgatgtctttccctcatt

SEQ ID NO: 141695 - DNA, 22 bp, Artificial Sequence
  Synthetic oligonucleotide; CTG chr11 5239678 5239699 5239683 5239678 -
ggtgatgtctttccctcatttt

SEQ ID NO: 141696 - DNA, 22 bp, Artificial Sequence
  Synthetic oligonucleotide; CTT chr11 5239667 5239688 5239672 5239667 -
tccctcattttgccttgtctat

SEQ ID NO: 141697 - DNA, 22 bp, Artificial Sequence
  Synthetic oligonucleotide; TTT chr11 5239666 5239687 5239671 5239666 -
ccctcattttgccttgtctatc

SEQ ID NO: 141698 - DNA, 22 bp, Artificial Sequence
  Synthetic oligonucleotide; TTC chr11 5239665 5239686 5239670 5239665 -
cctcattttgccttgtctatct

SEQ ID NO: 141699 - DNA, 22 bp, Artificial Sequence
  Synthetic oligonucleotide; CTC chr11 5239661 5239682 5239666 5239661 -
attttgccttgtctatcttgta

SEQ ID NO: 141700 - DNA, 22 bp, Artificial Sequence
  Synthetic oligonucleotide; TTT chr11 5239657 5239678 5239662 5239657 -
tgccttgtctatcttgtactca

SEQ ID NO: 141701 - DNA, 22 bp, Artificial Sequence
  Synthetic oligonucleotide; TTT chr11 5239656 5239677 5239661 5239656 -
gccttgtctatcttgtactcat

SEQ ID NO: 141702 - DNA, 22 bp, Artificial Sequence
  Synthetic oligonucleotide; TTG chr11 5239655 5239676 5239660 5239655 -
ccttgtctatcttgtactcata

SEQ ID NO: 141703 - DNA, 22 bp, Artificial Sequence
  Synthetic oligonucleotide; CTT chr11 5239651 5239672 5239656 5239651 -
gtctatcttgtactcatacttt

SEQ ID NO: 141704 - DNA, 22 bp, Artificial Sequence
  Synthetic oligonucleotide; TTG chr11 5239650 5239671 5239655 5239650 -
tctatcttgtactcatacttta

SEQ ID NO: 141705 - DNA, 22 bp, Artificial Sequence
  Synthetic oligonucleotide; CTA chr11 5239646 5239667 5239651 5239646 -
tcttgtactcatactttaagtc

SEQ ID NO: 141706 - DNA, 22 bp, Artificial Sequence
  Synthetic oligonucleotide; CTT chr11 5239642 5239663 5239647 5239642 -
gtactcatactttaagtcctaa

SEQ ID NO: 141707 - DNA, 22 bp, Artificial Sequence
  Synthetic oligonucleotide; TTG chr11 5239641 5239662 5239646 5239641 -
tactcatactttaagtcctaac

SEQ ID NO: 141708 - DNA, 22 bp, Artificial Sequence
  Synthetic oligonucleotide; CTC chr11 5239636 5239657 5239641 5239636 -
atactttaagtcctaacttata

SEQ ID NO: 141709 - DNA, 22 bp, Artificial Sequence
  Synthetic oligonucleotide; CTT chr11 5239630 5239651 5239635 5239630 -
taagtcctaacttatatgttat

SEQ ID NO: 141710 - DNA, 22 bp, Artificial Sequence
  Synthetic oligonucleotide; TTT chr11 5239629 5239650 5239634 5239629 -
aagtcctaacttatatgttatc

SEQ ID NO: 141711 - DNA, 22 bp, Artificial Sequence
  Synthetic oligonucleotide; TTA chr11 5239628 5239649 5239633 5239628 -
agtcctaacttatatgttatct

SEQ ID NO: 141712 - DNA, 22 bp, Artificial Sequence
  Synthetic oligonucleotide; CTA chr11 5239621 5239642 5239626 5239621 -
acttatatgttatctcaactaa

SEQ ID NO: 141713 - DNA, 22 bp, Artificial Sequence
  Synthetic oligonucleotide; CTT chr11 5239617 5239638 5239622 5239617 -
atatgttatctcaactaagaag

SEQ ID NO: 141714 - DNA, 22 bp, Artificial Sequence
  Synthetic oligonucleotide; TTA chr11 5239616 5239637 5239621 5239616 -
tatgttatctcaactaagaagc

SEQ ID NO: 141715 - DNA, 22 bp, Artificial Sequence
  Synthetic oligonucleotide; TTA chr11 5239609 5239630 5239614 5239609 -
tctcaactaagaagctattttt

SEQ ID NO: 141716 - DNA, 22 bp, Artificial Sequence
  Synthetic oligonucleotide; CTC chr11 5239605 5239626 5239610 5239605 -
aactaagaagctattttttttt

SEQ ID NO: 141717 - DNA, 22 bp, Artificial Sequence
  Synthetic oligonucleotide; CTA chr11 5239600 5239621 5239605 5239600 -
agaagctatttttttttaattt

SEQ ID NO: 141718 - DNA, 22 bp, Artificial Sequence
  Synthetic oligonucleotide; CTA chr11 5239592 5239613 5239597 5239592 -
tttttttttaattttaactggg

SEQ ID NO: 141719 - DNA, 22 bp, Artificial Sequence
  Synthetic oligonucleotide; TTT chr11 5239589 5239610 5239594 5239589 -
ttttttaattttaactgggctt

SEQ ID NO: 141720 - DNA, 22 bp, Artificial Sequence
  Synthetic oligonucleotide; TTT chr11 5239588 5239609 5239593 5239588 -
tttttaattttaactgggctta

SEQ ID NO: 141721 - DNA, 22 bp, Artificial Sequence
  Synthetic oligonucleotide; TTT chr11 5239587 5239608 5239592 5239587 -
ttttaattttaactgggcttaa

SEQ ID NO: 141722 - DNA, 22 bp, Artificial Sequence
  Synthetic oligonucleotide; TTT chr11 5239586 5239607 5239591 5239586 -
tttaattttaactgggcttaaa

SEQ ID NO: 141723 - DNA, 22 bp, Artificial Sequence
  Synthetic oligonucleotide; TTT chr11 5239585 5239606 5239590 5239585 -
ttaattttaactgggcttaaag

SEQ ID NO: 141724 - DNA, 22 bp, Artificial Sequence
  Synthetic oligonucleotide; TTT chr11 5239584 5239605 5239589 5239584 -
taattttaactgggcttaaagc

SEQ ID NO: 141725 - DNA, 22 bp, Artificial Sequence
  Synthetic oligonucleotide; TTT chr11 5239583 5239604 5239588 5239583 -
aattttaactgggcttaaagcc

SEQ ID NO: 141726 - DNA, 22 bp, Artificial Sequence
  Synthetic oligonucleotide; TTA chr11 5239582 5239603 5239587 5239582 -
attttaactgggcttaaagccc

SEQ ID NO: 141727 - DNA, 22 bp, Artificial Sequence
  Synthetic oligonucleotide; TTT chr11 5239578 5239599 5239583 5239578 -
taactgggcttaaagccctgtc

SEQ ID NO: 141728 - DNA, 22 bp, Artificial Sequence
  Synthetic oligonucleotide; TTT chr11 5239577 5239598 5239582 5239577 -
aactgggcttaaagccctgtct

SEQ ID NO: 141729 - DNA, 22 bp, Artificial Sequence
  Synthetic oligonucleotide; TTA chr11 5239576 5239597 5239581 5239576 -
actgggcttaaagccctgtcta

SEQ ID NO: 141730 - DNA, 22 bp, Artificial Sequence
  Synthetic oligonucleotide; CTG chr11 5239572 5239593 5239577 5239572 -
ggcttaaagccctgtctataaa

SEQ ID NO: 141731 - DNA, 22 bp, Artificial Sequence
  Synthetic oligonucleotide; CTT chr11 5239567 5239588 5239572 5239567 -
aaagccctgtctataaactctg

SEQ ID NO: 141732 - DNA, 22 bp, Artificial Sequence
  Synthetic oligonucleotide; TTA chr11 5239566 5239587 5239571 5239566 -
aagccctgtctataaactctgc

SEQ ID NO: 141733 - DNA, 22 bp, Artificial Sequence
  Synthetic oligonucleotide; CTG chr11 5239558 5239579 5239563 5239558 -
tctataaactctgctacaatta

SEQ ID NO: 141734 - DNA, 22 bp, Artificial Sequence
  Synthetic oligonucleotide; CTA chr11 5239554 5239575 5239559 5239554 -
taaactctgctacaattatggg

SEQ ID NO: 141735 - DNA, 22 bp, Artificial Sequence
  Synthetic oligonucleotide; CTC chr11 5239547 5239568 5239552 5239547 -
tgctacaattatgggctctttc

SEQ ID NO: 141736 - DNA, 22 bp, Artificial Sequence
  Synthetic oligonucleotide; CTG chr11 5239545 5239566 5239550 5239545 -
ctacaattatgggctctttctt

SEQ ID NO: 141737 - DNA, 22 bp, Artificial Sequence
  Synthetic oligonucleotide; CTA chr11 5239542 5239563 5239547 5239542 -
caattatgggctctttcttata

SEQ ID NO: 141738 - DNA, 22 bp, Artificial Sequence
  Synthetic oligonucleotide; TTA chr11 5239536 5239557 5239541 5239536 -
tgggctctttcttataatattt

SEQ ID NO: 141739 - DNA, 22 bp, Artificial Sequence
  Synthetic oligonucleotide; CTC chr11 5239529 5239550 5239534 5239529 -
tttcttataatatttagtgttt

SEQ ID NO: 141740 - DNA, 22 bp, Artificial Sequence
  Synthetic oligonucleotide; CTT chr11 5239527 5239548 5239532 5239527 -
tcttataatatttagtgttttt

SEQ ID NO: 141741 - DNA, 22 bp, Artificial Sequence
  Synthetic oligonucleotide; TTT chr11 5239526 5239547 5239531 5239526 -
cttataatatttagtgtttttc

SEQ ID NO: 141742 - DNA, 22 bp, Artificial Sequence
  Synthetic oligonucleotide; TTC chr11 5239525 5239546 5239530 5239525 -
ttataatatttagtgtttttcc

SEQ ID NO: 141743 - DNA, 22 bp, Artificial Sequence
  Synthetic oligonucleotide; CTT chr11 5239523 5239544 5239528 5239523 -
ataatatttagtgtttttccta

SEQ ID NO: 141744 - DNA, 22 bp, Artificial Sequence
  Synthetic oligonucleotide; TTA chr11 5239522 5239543 5239527 5239522 -
taatatttagtgtttttcctac

SEQ ID NO: 141745 - DNA, 22 bp, Artificial Sequence
  Synthetic oligonucleotide; TTT chr11 5239514 5239535 5239519 5239514 -
agtgtttttcctactaatgtac

SEQ ID NO: 141746 - DNA, 22 bp, Artificial Sequence
  Synthetic oligonucleotide; TTA chr11 5239513 5239534 5239518 5239513 -
gtgtttttcctactaatgtact

SEQ ID NO: 141747 - DNA, 22 bp, Artificial Sequence
  Synthetic oligonucleotide; TTT chr11 5239507 5239528 5239512 5239507 -
ttcctactaatgtacttaatct

SEQ ID NO: 141748 - DNA, 22 bp, Artificial Sequence
  Synthetic oligonucleotide; TTT chr11 5239506 5239527 5239511 5239506 -
tcctactaatgtacttaatctg

SEQ ID NO: 141749 - DNA, 22 bp, Artificial Sequence
  Synthetic oligonucleotide; TTT chr11 5239505 5239526 5239510 5239505 -
cctactaatgtacttaatctgc

SEQ ID NO: 141750 - DNA, 22 bp, Artificial Sequence
  Synthetic oligonucleotide; TTC chr11 5239504 5239525 5239509 5239504 -
ctactaatgtacttaatctgct

SEQ ID NO: 141751 - DNA, 22 bp, Artificial Sequence
  Synthetic oligonucleotide; CTA chr11 5239501 5239522 5239506 5239501 -
ctaatgtacttaatctgctcat

SEQ ID NO: 141752 - DNA, 22 bp, Artificial Sequence
  Synthetic oligonucleotide; CTA chr11 5239498 5239519 5239503 5239498 -
atgtacttaatctgctcattgt

SEQ ID NO: 141753 - DNA, 22 bp, Artificial Sequence
  Synthetic oligonucleotide; CTT chr11 5239490 5239511 5239495 5239490 -
aatctgctcattgtatattcct

SEQ ID NO: 141754 - DNA, 22 bp, Artificial Sequence
  Synthetic oligonucleotide; TTA chr11 5239489 5239510 5239494 5239489 -
atctgctcattgtatattccta

SEQ ID NO: 141755 - DNA, 22 bp, Artificial Sequence
  Synthetic oligonucleotide; CTG chr11 5239484 5239505 5239489 5239484 -
ctcattgtatattcctaccact

SEQ ID NO: 141756 - DNA, 22 bp, Artificial Sequence
  Synthetic oligonucleotide; CTC chr11 5239481 5239502 5239486 5239481 -
attgtatattcctaccactaaa

SEQ ID NO: 141757 - DNA, 22 bp, Artificial Sequence
  Synthetic oligonucleotide; TTG chr11 5239477 5239498 5239482 5239477 -
tatattcctaccactaaatttt

SEQ ID NO: 141758 - DNA, 22 bp, Artificial Sequence
  Synthetic oligonucleotide; TTC chr11 5239470 5239491 5239475 5239470 -
ctaccactaaattttaacctct

SEQ ID NO: 141759 - DNA, 22 bp, Artificial Sequence
  Synthetic oligonucleotide; CTA chr11 5239467 5239488 5239472 5239467 -
ccactaaattttaacctctttt

SEQ ID NO: 141760 - DNA, 22 bp, Artificial Sequence
  Synthetic oligonucleotide; CTA chr11 5239461 5239482 5239466 5239461 -
aattttaacctcttttatggta

SEQ ID NO: 141761 - DNA, 22 bp, Artificial Sequence
  Synthetic oligonucleotide; TTT chr11 5239456 5239477 5239461 5239456 -
taacctcttttatggtagagac

SEQ ID NO: 141762 - DNA, 22 bp, Artificial Sequence
  Synthetic oligonucleotide; TTT chr11 5239455 5239476 5239460 5239455 -
aacctcttttatggtagagaca

SEQ ID NO: 141763 - DNA, 22 bp, Artificial Sequence
  Synthetic oligonucleotide; TTA chr11 5239454 5239475 5239459 5239454 -
acctcttttatggtagagacat

SEQ ID NO: 141764 - DNA, 22 bp, Artificial Sequence
  Synthetic oligonucleotide; CTC chr11 5239449 5239470 5239454 5239449 -
ttttatggtagagacattgtct

SEQ ID NO: 141765 - DNA, 22 bp, Artificial Sequence
  Synthetic oligonucleotide; CTT chr11 5239447 5239468 5239452 5239447 -
ttatggtagagacattgtcttg

SEQ ID NO: 141766 - DNA, 22 bp, Artificial Sequence
  Synthetic oligonucleotide; TTT chr11 5239446 5239467 5239451 5239446 -
tatggtagagacattgtcttgt

SEQ ID NO: 141767 - DNA, 22 bp, Artificial Sequence
  Synthetic oligonucleotide; TTT chr11 5239445 5239466 5239450 5239445 -
atggtagagacattgtcttgta

SEQ ID NO: 141768 - DNA, 22 bp, Artificial Sequence
  Synthetic oligonucleotide; TTA chr11 5239444 5239465 5239449 5239444 -
tggtagagacattgtcttgtaa

SEQ ID NO: 141769 - DNA, 22 bp, Artificial Sequence
  Synthetic oligonucleotide; TTG chr11 5239430 5239451 5239435 5239430 -
tcttgtaaactcttatttccct

SEQ ID NO: 141770 - DNA, 22 bp, Artificial Sequence
  Synthetic oligonucleotide; CTT chr11 5239426 5239447 5239431 5239426 -
gtaaactcttatttccctagta

SEQ ID NO: 141771 - DNA, 22 bp, Artificial Sequence
  Synthetic oligonucleotide; TTG chr11 5239425 5239446 5239430 5239425 -
taaactcttatttccctagtat

SEQ ID NO: 141772 - DNA, 22 bp, Artificial Sequence
  Synthetic oligonucleotide; CTC chr11 5239418 5239439 5239423 5239418 -
ttatttccctagtatttggaga

SEQ ID NO: 141773 - DNA, 22 bp, Artificial Sequence
  Synthetic oligonucleotide; CTT chr11 5239416 5239437 5239421 5239416 -
atttccctagtatttggagatg

SEQ ID NO: 141774 - DNA, 22 bp, Artificial Sequence
  Synthetic oligonucleotide; TTA chr11 5239415 5239436 5239420 5239415 -
tttccctagtatttggagatga

SEQ ID NO: 141775 - DNA, 22 bp, Artificial Sequence
  Synthetic oligonucleotide; TTT chr11 5239412 5239433 5239417 5239412 -
ccctagtatttggagatgaaaa

SEQ ID NO: 141776 - DNA, 22 bp, Artificial Sequence
  Synthetic oligonucleotide; TTC chr11 5239411 5239432 5239416 5239411 -
cctagtatttggagatgaaaaa

SEQ ID NO: 141777 - DNA, 22 bp, Artificial Sequence
  Synthetic oligonucleotide; CTA chr11 5239407 5239428 5239412 5239407 -
gtatttggagatgaaaaaaaag

SEQ ID NO: 141778 - DNA, 22 bp, Artificial Sequence
  Synthetic oligonucleotide; TTT chr11 5239401 5239422 5239406 5239401 -
ggagatgaaaaaaaagattaaa

SEQ ID NO: 141779 - DNA, 22 bp, Artificial Sequence
  Synthetic oligonucleotide; TTG chr11 5239400 5239421 5239405 5239400 -
gagatgaaaaaaaagattaaat

SEQ ID NO: 141780 - DNA, 22 bp, Artificial Sequence
  Synthetic oligonucleotide; TTA chr11 5239381 5239402 5239386 5239381 -
aattatccaaaattagatctct

SEQ ID NO: 141781 - DNA, 22 bp, Artificial Sequence
  Synthetic oligonucleotide; TTA chr11 5239376 5239397 5239381 5239376 -
tccaaaattagatctctctttt

SEQ ID NO: 141782 - DNA, 22 bp, Artificial Sequence
  Synthetic oligonucleotide; TTA chr11 5239366 5239387 5239371 5239366 -
gatctctcttttctacattatg

SEQ ID NO: 141783 - DNA, 22 bp, Artificial Sequence
  Synthetic oligonucleotide; CTC chr11 5239360 5239381 5239365 5239360 -
tcttttctacattatgagtatt

SEQ ID NO: 141784 - DNA, 22 bp, Artificial Sequence
  Synthetic oligonucleotide; CTC chr11 5239358 5239379 5239363 5239358 -
ttttctacattatgagtattac

SEQ ID NO: 141785 - DNA, 22 bp, Artificial Sequence
  Synthetic oligonucleotide; CTT chr11 5239356 5239377 5239361 5239356 -
ttctacattatgagtattacac

SEQ ID NO: 141786 - DNA, 22 bp, Artificial Sequence
  Synthetic oligonucleotide; TTT chr11 5239355 5239376 5239360 5239355 -
tctacattatgagtattacact

SEQ ID NO: 141787 - DNA, 22 bp, Artificial Sequence
  Synthetic oligonucleotide; TTT chr11 5239354 5239375 5239359 5239354 -
ctacattatgagtattacacta

SEQ ID NO: 141788 - DNA, 22 bp, Artificial Sequence
  Synthetic oligonucleotide; TTC chr11 5239353 5239374 5239358 5239353 -
tacattatgagtattacactat

SEQ ID NO: 141789 - DNA, 22 bp, Artificial Sequence
  Synthetic oligonucleotide; CTA chr11 5239351 5239372 5239356 5239351 -
cattatgagtattacactatcc

SEQ ID NO: 141790 - DNA, 22 bp, Artificial Sequence
  Synthetic oligonucleotide; TTA chr11 5239346 5239367 5239351 5239346 -
tgagtattacactatccataga

SEQ ID NO: 141791 - DNA, 22 bp, Artificial Sequence
  Synthetic oligonucleotide; TTA chr11 5239337 5239358 5239342 5239337 -
cactatccatagagaagtttgt

SEQ ID NO: 141792 - DNA, 22 bp, Artificial Sequence
  Synthetic oligonucleotide; CTA chr11 5239332 5239353 5239337 5239332 -
tccatagagaagtttgtttgag

SEQ ID NO: 141793 - DNA, 22 bp, Artificial Sequence
  Synthetic oligonucleotide; TTT chr11 5239317 5239338 5239322 5239317 -
gtttgagacctaaactgaggaa

SEQ ID NO: 141794 - DNA, 22 bp, Artificial Sequence
  Synthetic oligonucleotide; TTG chr11 5239316 5239337 5239321 5239316 -
tttgagacctaaactgaggaac

SEQ ID NO: 141795 - DNA, 22 bp, Artificial Sequence
  Synthetic oligonucleotide; TTT chr11 5239313 5239334 5239318 5239313 -
gagacctaaactgaggaacctt

SEQ ID NO: 141796 - DNA, 22 bp, Artificial Sequence
  Synthetic oligonucleotide; TTG chr11 5239312 5239333 5239317 5239312 -
agacctaaactgaggaaccttt

SEQ ID NO: 141797 - DNA, 22 bp, Artificial Sequence
  Synthetic oligonucleotide; CTA chr11 5239305 5239326 5239310 5239305 -
aactgaggaacctttggttcta

SEQ ID NO: 141798 - DNA, 22 bp, Artificial Sequence
  Synthetic oligonucleotide; CTG chr11 5239300 5239321 5239305 5239300 -
aggaacctttggttctaaaatg

SEQ ID NO: 141799 - DNA, 22 bp, Artificial Sequence
  Synthetic oligonucleotide; CTT chr11 5239291 5239312 5239296 5239291 -
tggttctaaaatgactatgtga

SEQ ID NO: 141800 - DNA, 22 bp, Artificial Sequence
  Synthetic oligonucleotide; TTT chr11 5239290 5239311 5239295 5239290 -
ggttctaaaatgactatgtgat

SEQ ID NO: 141801 - DNA, 22 bp, Artificial Sequence
  Synthetic oligonucleotide; TTG chr11 5239289 5239310 5239294 5239289 -
gttctaaaatgactatgtgata

SEQ ID NO: 141802 - DNA, 22 bp, Artificial Sequence
  Synthetic oligonucleotide; TTC chr11 5239285 5239306 5239290 5239285 -
taaaatgactatgtgatatctt

SEQ ID NO: 141803 - DNA, 22 bp, Artificial Sequence
  Synthetic oligonucleotide; CTA chr11 5239283 5239304 5239288 5239283 -
aaatgactatgtgatatcttag

SEQ ID NO: 141804 - DNA, 22 bp, Artificial Sequence
  Synthetic oligonucleotide; CTA chr11 5239274 5239295 5239279 5239274 -
tgtgatatcttagtatttatag

SEQ ID NO: 141805 - DNA, 22 bp, Artificial Sequence
  Synthetic oligonucleotide; CTT chr11 5239263 5239284 5239268 5239263 -
agtatttataggtcatgaggtt

SEQ ID NO: 141806 - DNA, 22 bp, Artificial Sequence
  Synthetic oligonucleotide; TTA chr11 5239262 5239283 5239267 5239262 -
gtatttataggtcatgaggttc

SEQ ID NO: 141807 - DNA, 22 bp, Artificial Sequence
  Synthetic oligonucleotide; TTT chr11 5239256 5239277 5239261 5239256 -
ataggtcatgaggttccttcct

SEQ ID NO: 141808 - DNA, 22 bp, Artificial Sequence
  Synthetic oligonucleotide; TTA chr11 5239255 5239276 5239260 5239255 -
taggtcatgaggttccttcctc

SEQ ID NO: 141809 - DNA, 22 bp, Artificial Sequence
  Synthetic oligonucleotide; TTC chr11 5239240 5239261 5239245 5239240 -
cttcctctgcctctgctatagt

SEQ ID NO: 141810 - DNA, 22 bp, Artificial Sequence
  Synthetic oligonucleotide; CTT chr11 5239237 5239258 5239242 5239237 -
cctctgcctctgctatagtttg

SEQ ID NO: 141811 - DNA, 22 bp, Artificial Sequence
  Synthetic oligonucleotide; TTC chr11 5239236 5239257 5239241 5239236 -
ctctgcctctgctatagtttga

SEQ ID NO: 141812 - DNA, 22 bp, Artificial Sequence
  Synthetic oligonucleotide; CTC chr11 5239233 5239254 5239238 5239233 -
tgcctctgctatagtttgatta

SEQ ID NO: 141813 - DNA, 22 bp, Artificial Sequence
  Synthetic oligonucleotide; CTG chr11 5239231 5239252 5239236 5239231 -
cctctgctatagtttgattagt

SEQ ID NO: 141814 - DNA, 22 bp, Artificial Sequence
  Synthetic oligonucleotide; CTC chr11 5239227 5239248 5239232 5239227 -
tgctatagtttgattagtcaac

SEQ ID NO: 141815 - DNA, 22 bp, Artificial Sequence
  Synthetic oligonucleotide; CTG chr11 5239225 5239246 5239230 5239225 -
ctatagtttgattagtcaacaa

SEQ ID NO: 141816 - DNA, 22 bp, Artificial Sequence
  Synthetic oligonucleotide; CTA chr11 5239222 5239243 5239227 5239222 -
tagtttgattagtcaacaagca

SEQ ID NO: 141817 - DNA, 22 bp, Artificial Sequence
  Synthetic oligonucleotide; TTT chr11 5239216 5239237 5239221 5239216 -
gattagtcaacaagcatgtgtc

SEQ ID NO: 141818 - DNA, 22 bp, Artificial Sequence
  Synthetic oligonucleotide; TTG chr11 5239215 5239236 5239220 5239215 -
attagtcaacaagcatgtgtca

SEQ ID NO: 141819 - DNA, 22 bp, Artificial Sequence
  Synthetic oligonucleotide; TTA chr11 5239211 5239232 5239216 5239211 -
gtcaacaagcatgtgtcatgca

SEQ ID NO: 141820 - DNA, 22 bp, Artificial Sequence
  Synthetic oligonucleotide; TTT chr11 5239186 5239207 5239191 5239186 -
attcacatcagaatttcataca

SEQ ID NO: 141821 - DNA, 22 bp, Artificial Sequence
  Synthetic oligonucleotide; TTA chr11 5239185 5239206 5239190 5239185 -
ttcacatcagaatttcatacac

SEQ ID NO: 141822 - DNA, 22 bp, Artificial Sequence
  Synthetic oligonucleotide; TTC chr11 5239182 5239203 5239187 5239182 -
acatcagaatttcatacactaa

SEQ ID NO: 141823 - DNA, 22 bp, Artificial Sequence
  Synthetic oligonucleotide; TTT chr11 5239170 5239191 5239175 5239170 -
catacactaataagacatagta

SEQ ID NO: 141824 - DNA, 22 bp, Artificial Sequence
  Synthetic oligonucleotide; TTC chr11 5239169 5239190 5239174 5239169 -
atacactaataagacatagtat

SEQ ID NO: 141825 - DNA, 22 bp, Artificial Sequence
  Synthetic oligonucleotide; CTA chr11 5239161 5239182 5239166 5239161 -
ataagacatagtatcagaagtc

SEQ ID NO: 141826 - DNA, 22 bp, Artificial Sequence
  Synthetic oligonucleotide; TTT chr11 5239134 5239155 5239139 5239134 -
attagttatatcagttagggtc

SEQ ID NO: 141827 - DNA, 22 bp, Artificial Sequence
  Synthetic oligonucleotide; TTA chr11 5239133 5239154 5239138 5239133 -
ttagttatatcagttagggtcc

SEQ ID NO: 141828 - DNA, 22 bp, Artificial Sequence
  Synthetic oligonucleotide; TTA chr11 5239130 5239151 5239135 5239130 -
gttatatcagttagggtccatc

SEQ ID NO: 141829 - DNA, 22 bp, Artificial Sequence
  Synthetic oligonucleotide; TTA chr11 5239126 5239147 5239131 5239126 -
tatcagttagggtccatcaagg

SEQ ID NO: 141830 - DNA, 22 bp, Artificial Sequence
  Synthetic oligonucleotide; TTA chr11 5239117 5239138 5239122 5239117 -
gggtccatcaaggaaaggacaa

SEQ ID NO: 141831 - DNA, 22 bp, Artificial Sequence
  Synthetic oligonucleotide; TTA chr11 5239088 5239109 5239093 5239088 -
tcagttactcaacctagaatta

SEQ ID NO: 141832 - DNA, 22 bp, Artificial Sequence
  Synthetic oligonucleotide; TTA chr11 5239081 5239102 5239086 5239081 -
ctcaacctagaattaaatacag

SEQ ID NO: 141833 - DNA, 22 bp, Artificial Sequence
  Synthetic oligonucleotide; CTC chr11 5239078 5239099 5239083 5239078 -
aacctagaattaaatacagctc

SEQ ID NO: 141834 - DNA, 22 bp, Artificial Sequence
  Synthetic oligonucleotide; CTA chr11 5239072 5239093 5239077 5239072 -
gaattaaatacagctcttaata

SEQ ID NO: 141835 - DNA, 22 bp, Artificial Sequence
  Synthetic oligonucleotide; TTA chr11 5239066 5239087 5239071 5239066 -
aatacagctcttaatagttaat

SEQ ID NO: 141836 - DNA, 22 bp, Artificial Sequence
  Synthetic oligonucleotide; CTC chr11 5239056 5239077 5239061 5239056 -
ttaatagttaattatccttgta

SEQ ID NO: 141837 - DNA, 22 bp, Artificial Sequence
  Synthetic oligonucleotide; CTT chr11 5239054 5239075 5239059 5239054 -
aatagttaattatccttgtatt

SEQ ID NO: 141838 - DNA, 22 bp, Artificial Sequence
  Synthetic oligonucleotide; TTA chr11 5239053 5239074 5239058 5239053 -
atagttaattatccttgtattg

SEQ ID NO: 141839 - DNA, 22 bp, Artificial Sequence
  Synthetic oligonucleotide; TTA chr11 5239046 5239067 5239051 5239046 -
attatccttgtattggaagagc

SEQ ID NO: 141840 - DNA, 22 bp, Artificial Sequence
  Synthetic oligonucleotide; TTA chr11 5239042 5239063 5239047 5239042 -
tccttgtattggaagagctaaa

SEQ ID NO: 141841 - DNA, 22 bp, Artificial Sequence
  Synthetic oligonucleotide; CTT chr11 5239037 5239058 5239042 5239037 -
gtattggaagagctaaaatatc

SEQ ID NO: 141842 - DNA, 22 bp, Artificial Sequence
  Synthetic oligonucleotide; TTG chr11 5239036 5239057 5239041 5239036 -
tattggaagagctaaaatatca

SEQ ID NO: 141843 - DNA, 22 bp, Artificial Sequence
  Synthetic oligonucleotide; TTG chr11 5239031 5239052 5239036 5239031 -
gaagagctaaaatatcaaataa

SEQ ID NO: 141844 - DNA, 22 bp, Artificial Sequence
  Synthetic oligonucleotide; CTA chr11 5239022 5239043 5239027 5239022 -
aaatatcaaataaaggacagtg

SEQ ID NO: 141845 - DNA, 22 bp, Artificial Sequence
  Synthetic oligonucleotide; CTA chr11 5238990 5239011 5238995 5238990 -
gatgttagtaacatcagaaaac

SEQ ID NO: 141846 - DNA, 22 bp, Artificial Sequence
  Synthetic oligonucleotide; TTA chr11 5238983 5239004 5238988 5238983 -
gtaacatcagaaaacctcttcc

SEQ ID NO: 141847 - DNA, 22 bp, Artificial Sequence
  Synthetic oligonucleotide; CTC chr11 5238965 5238986 5238970 5238965 -
ttccgccattaggcctagaagg

SEQ ID NO: 141848 - DNA, 22 bp, Artificial Sequence
  Synthetic oligonucleotide; CTT chr11 5238963 5238984 5238968 5238963 -
ccgccattaggcctagaagggc

SEQ ID NO: 141849 - DNA, 22 bp, Artificial Sequence
  Synthetic oligonucleotide; TTC chr11 5238962 5238983 5238967 5238962 -
cgccattaggcctagaagggca

SEQ ID NO: 141850 - DNA, 22 bp, Artificial Sequence
  Synthetic oligonucleotide; TTA chr11 5238954 5238975 5238959 5238954 -
ggcctagaagggcagaaggaga

SEQ ID NO: 141851 - DNA, 22 bp, Artificial Sequence
  Synthetic oligonucleotide; CTA chr11 5238948 5238969 5238953 5238948 -
gaagggcagaaggagaaaatgt

SEQ ID NO: 141852 - DNA, 22 bp, Artificial Sequence
  Synthetic oligonucleotide; TTT chr11 5238924 5238945 5238929 5238924 -
ataccaccagagtccagaacca

SEQ ID NO: 141853 - DNA, 22 bp, Artificial Sequence
  Synthetic oligonucleotide; TTA chr11 5238923 5238944 5238928 5238923 -
taccaccagagtccagaaccag

SEQ ID NO: 141854 - DNA, 22 bp, Artificial Sequence
  Synthetic oligonucleotide; CTG chr11 5238878 5238899 5238883 5238878 -
gattcagtgagctagtgggtgc

SEQ ID NO: 141855 - DNA, 22 bp, Artificial Sequence
  Synthetic oligonucleotide; TTC chr11 5238873 5238894 5238878 5238873 -
agtgagctagtgggtgctcctt

SEQ ID NO: 141856 - DNA, 22 bp, Artificial Sequence
  Synthetic oligonucleotide; CTA chr11 5238864 5238885 5238869 5238864 -
gtgggtgctccttggagagagc

SEQ ID NO: 141857 - DNA, 22 bp, Artificial Sequence
  Synthetic oligonucleotide; CTC chr11 5238854 5238875 5238859 5238854 -
cttggagagagccagaactgtc

SEQ ID NO: 141858 - DNA, 22 bp, Artificial Sequence
  Synthetic oligonucleotide; CTT chr11 5238851 5238872 5238856 5238851 -
ggagagagccagaactgtctaa

SEQ ID NO: 141859 - DNA, 22 bp, Artificial Sequence
  Synthetic oligonucleotide; TTG chr11 5238850 5238871 5238855 5238850 -
gagagagccagaactgtctaat

SEQ ID NO: 141860 - DNA, 22 bp, Artificial Sequence
  Synthetic oligonucleotide; CTG chr11 5238834 5238855 5238839 5238834 -
tctaatgggggcatcaaagtat

SEQ ID NO: 141861 - DNA, 22 bp, Artificial Sequence
  Synthetic oligonucleotide; CTA chr11 5238830 5238851 5238835 5238830 -
atgggggcatcaaagtatcagc

SEQ ID NO: 141862 - DNA, 22 bp, Artificial Sequence
  Synthetic oligonucleotide; CTG chr11 5238784 5238805 5238789 5238784 -
tctgctgtaggagatccgttca

SEQ ID NO: 141863 - DNA, 22 bp, Artificial Sequence
  Synthetic oligonucleotide; CTG chr11 5238780 5238801 5238785 5238780 -
ctgtaggagatccgttcagaga

SEQ ID NO: 141864 - DNA, 22 bp, Artificial Sequence
  Synthetic oligonucleotide; CTG chr11 5238777 5238798 5238782 5238777 -
taggagatccgttcagagagag

SEQ ID NO: 141865 - DNA, 22 bp, Artificial Sequence
  Synthetic oligonucleotide; TTC chr11 5238763 5238784 5238768 5238763 -
agagagagagagagaccagaaa

SEQ ID NO: 141866 - DNA, 22 bp, Artificial Sequence
  Synthetic oligonucleotide; CTT chr11 5238734 5238755 5238739 5238734 -
gcttatgctttccctcagccag

SEQ ID NO: 141867 - DNA, 22 bp, Artificial Sequence
  Synthetic oligonucleotide; TTG chr11 5238733 5238754 5238738 5238733 -
cttatgctttccctcagccagt

SEQ ID NO: 141868 - DNA, 22 bp, Artificial Sequence
  Synthetic oligonucleotide; CTT chr11 5238730 5238751 5238735 5238730 -
atgctttccctcagccagtgtt

SEQ ID NO: 141869 - DNA, 22 bp, Artificial Sequence
  Synthetic oligonucleotide; TTA chr11 5238729 5238750 5238734 5238729 -
tgctttccctcagccagtgttt

SEQ ID NO: 141870 - DNA, 22 bp, Artificial Sequence
  Synthetic oligonucleotide; CTT chr11 5238724 5238745 5238729 5238724 -
tccctcagccagtgtttaccat

SEQ ID NO: 141871 - DNA, 22 bp, Artificial Sequence
  Synthetic oligonucleotide; TTT chr11 5238723 5238744 5238728 5238723 -
ccctcagccagtgtttaccatt

SEQ ID NO: 141872 - DNA, 22 bp, Artificial Sequence
  Synthetic oligonucleotide; TTC chr11 5238722 5238743 5238727 5238722 -
cctcagccagtgtttaccattg

SEQ ID NO: 141873 - DNA, 22 bp, Artificial Sequence
  Synthetic oligonucleotide; CTC chr11 5238718 5238739 5238723 5238718 -
agccagtgtttaccattgcaga

SEQ ID NO: 141874 - DNA, 22 bp, Artificial Sequence
  Synthetic oligonucleotide; TTT chr11 5238707 5238728 5238712 5238707 -
accattgcagaatgtacatgcg

SEQ ID NO: 141875 - DNA, 22 bp, Artificial Sequence
  Synthetic oligonucleotide; TTA chr11 5238706 5238727 5238711 5238706 -
ccattgcagaatgtacatgcga

SEQ ID NO: 141876 - DNA, 22 bp, Artificial Sequence
  Synthetic oligonucleotide; TTG chr11 5238700 5238721 5238705 5238700 -
cagaatgtacatgcgactgaaa

SEQ ID NO: 141877 - DNA, 22 bp, Artificial Sequence
  Synthetic oligonucleotide; CTG chr11 5238681 5238702 5238686 5238681 -
aaagggtgaggaaacctgggaa

SEQ ID NO: 141878 - DNA, 22 bp, Artificial Sequence
  Synthetic oligonucleotide; CTG chr11 5238663 5238684 5238668 5238663 -
ggaaatgtcagttcctcaaata

SEQ ID NO: 141879 - DNA, 22 bp, Artificial Sequence
  Synthetic oligonucleotide; TTC chr11 5238649 5238670 5238654 5238649 -
ctcaaatacagagaacactgag

SEQ ID NO: 141880 - DNA, 22 bp, Artificial Sequence
  Synthetic oligonucleotide; CTC chr11 5238646 5238667 5238651 5238646 -
aaatacagagaacactgaggga

SEQ ID NO: 141881 - DNA, 22 bp, Artificial Sequence
  Synthetic oligonucleotide; CTG chr11 5238629 5238650 5238634 5238629 -
agggaaggatgagaaataaatg

SEQ ID NO: 141882 - DNA, 22 bp, Artificial Sequence
  Synthetic oligonucleotide; TTG chr11 5238582 5238603 5238587 5238582 -
acagaaggaaactaggatgtgt

SEQ ID NO: 141883 - DNA, 22 bp, Artificial Sequence
  Synthetic oligonucleotide; CTA chr11 5238568 5238589 5238573 5238568 -
ggatgtgtccagtaaatgaata

SEQ ID NO: 141884 - DNA, 22 bp, Artificial Sequence
  Synthetic oligonucleotide; TTA chr11 5238542 5238563 5238547 5238542 -
cagtgtgcagtgattattgcaa

SEQ ID NO: 141885 - DNA, 22 bp, Artificial Sequence
  Synthetic oligonucleotide; TTA chr11 5238526 5238547 5238531 5238526 -
ttgcaatgattaatgtattgat

SEQ ID NO: 141886 - DNA, 22 bp, Artificial Sequence
  Synthetic oligonucleotide; TTG chr11 5238523 5238544 5238528 5238523 -
caatgattaatgtattgataag

SEQ ID NO: 141887 - DNA, 22 bp, Artificial Sequence
  Synthetic oligonucleotide; TTA chr11 5238514 5238535 5238519 5238514 -
atgtattgataagataatatga

SEQ ID NO: 141888 - DNA, 22 bp, Artificial Sequence
  Synthetic oligonucleotide; TTG chr11 5238506 5238527 5238511 5238506 -
ataagataatatgaaaacacag

SEQ ID NO: 141889 - DNA, 22 bp, Artificial Sequence
  Synthetic oligonucleotide; TTC chr11 5238479 5238500 5238484 5238479 -
aaacagcagtgaactgagatta

SEQ ID NO: 141890 - DNA, 22 bp, Artificial Sequence
  Synthetic oligonucleotide; CTG chr11 5238463 5238484 5238468 5238463 -
agattagaattgtggagagcac

SEQ ID NO: 141891 - DNA, 22 bp, Artificial Sequence
  Synthetic oligonucleotide; TTA chr11 5238457 5238478 5238462 5238457 -
gaattgtggagagcactggcat

SEQ ID NO: 141892 - DNA, 22 bp, Artificial Sequence
  Synthetic oligonucleotide; TTG chr11 5238451 5238472 5238456 5238451 -
tggagagcactggcatttaaga

SEQ ID NO: 141893 - DNA, 22 bp, Artificial Sequence
  Synthetic oligonucleotide; CTG chr11 5238439 5238460 5238444 5238439 -
gcatttaagaatgtcacactta

SEQ ID NO: 141894 - DNA, 22 bp, Artificial Sequence
  Synthetic oligonucleotide; TTT chr11 5238433 5238454 5238438 5238433 -
aagaatgtcacacttagaatgt

SEQ ID NO: 141895 - DNA, 22 bp, Artificial Sequence
  Synthetic oligonucleotide; TTA chr11 5238432 5238453 5238437 5238432 -
agaatgtcacacttagaatgtg

SEQ ID NO: 141896 - DNA, 22 bp, Artificial Sequence
  Synthetic oligonucleotide; CTT chr11 5238418 5238439 5238423 5238418 -
agaatgtgtctctaggcattgt

SEQ ID NO: 141897 - DNA, 22 bp, Artificial Sequence
  Synthetic oligonucleotide; TTA chr11 5238417 5238438 5238422 5238417 -
gaatgtgtctctaggcattgtt

SEQ ID NO: 141898 - DNA, 22 bp, Artificial Sequence
  Synthetic oligonucleotide; CTC chr11 5238406 5238427 5238411 5238406 -
taggcattgttctgtgcatata

SEQ ID NO: 141899 - DNA, 22 bp, Artificial Sequence
  Synthetic oligonucleotide; CTA chr11 5238404 5238425 5238409 5238404 -
ggcattgttctgtgcatatatc

SEQ ID NO: 141900 - DNA, 22 bp, Artificial Sequence
  Synthetic oligonucleotide; TTG chr11 5238397 5238418 5238402 5238397 -
ttctgtgcatatatcatctcaa

SEQ ID NO: 141901 - DNA, 22 bp, Artificial Sequence
  Synthetic oligonucleotide; TTC chr11 5238394 5238415 5238399 5238394 -
tgtgcatatatcatctcaatat

SEQ ID NO: 141902 - DNA, 22 bp, Artificial Sequence
  Synthetic oligonucleotide; CTG chr11 5238392 5238413 5238397 5238392 -
tgcatatatcatctcaatattc

SEQ ID NO: 141903 - DNA, 22 bp, Artificial Sequence
  Synthetic oligonucleotide; CTC chr11 5238377 5238398 5238382 5238377 -
aatattcattatctgaaaatta

SEQ ID NO: 141904 - DNA, 22 bp, Artificial Sequence
  Synthetic oligonucleotide; TTC chr11 5238370 5238391 5238375 5238370 -
attatctgaaaattatgaatta

SEQ ID NO: 141905 - DNA, 22 bp, Artificial Sequence
  Synthetic oligonucleotide; TTA chr11 5238366 5238387 5238371 5238366 -
tctgaaaattatgaattaggta

SEQ ID NO: 141906 - DNA, 22 bp, Artificial Sequence
  Synthetic oligonucleotide; CTG chr11 5238362 5238383 5238367 5238362 -
aaaattatgaattaggtacaaa

SEQ ID NO: 141907 - DNA, 22 bp, Artificial Sequence
  Synthetic oligonucleotide; TTA chr11 5238355 5238376 5238360 5238355 -
tgaattaggtacaaagctcaaa

SEQ ID NO: 141908 - DNA, 22 bp, Artificial Sequence
  Synthetic oligonucleotide; TTA chr11 5238348 5238369 5238353 5238348 -
ggtacaaagctcaaataattta

SEQ ID NO: 141909 - DNA, 22 bp, Artificial Sequence
  Synthetic oligonucleotide; CTC chr11 5238336 5238357 5238341 5238336 -
aaataatttattttttcaggtt

SEQ ID NO: 141910 - DNA, 22 bp, Artificial Sequence
  Synthetic oligonucleotide; TTT chr11 5238327 5238348 5238332 5238327 -
attttttcaggttagcaagaac

SEQ ID NO: 141911 - DNA, 22 bp, Artificial Sequence
  Synthetic oligonucleotide; TTA chr11 5238326 5238347 5238331 5238326 -
ttttttcaggttagcaagaact

SEQ ID NO: 141912 - DNA, 22 bp, Artificial Sequence
  Synthetic oligonucleotide; TTT chr11 5238323 5238344 5238328 5238323 -
tttcaggttagcaagaactttt

SEQ ID NO: 141913 - DNA, 22 bp, Artificial Sequence
  Synthetic oligonucleotide; TTT chr11 5238322 5238343 5238327 5238322 -
ttcaggttagcaagaacttttt

SEQ ID NO: 141914 - DNA, 22 bp, Artificial Sequence
  Synthetic oligonucleotide; TTT chr11 5238321 5238342 5238326 5238321 -
tcaggttagcaagaactttttt

SEQ ID NO: 141915 - DNA, 22 bp, Artificial Sequence
  Synthetic oligonucleotide; TTT chr11 5238320 5238341 5238325 5238320 -
caggttagcaagaacttttttt

SEQ ID NO: 141916 - DNA, 22 bp, Artificial Sequence
  Synthetic oligonucleotide; TTC chr11 5238319 5238340 5238324 5238319 -
aggttagcaagaactttttttt

SEQ ID NO: 141917 - DNA, 22 bp, Artificial Sequence
  Synthetic oligonucleotide; TTA chr11 5238313 5238334 5238318 5238313 -
gcaagaactttttttttttttt

SEQ ID NO: 141918 - DNA, 22 bp, Artificial Sequence
  Synthetic oligonucleotide; CTT chr11 5238303 5238324 5238308 5238303 -
tttttttttttttctgagatag

SEQ ID NO: 141919 - DNA, 22 bp, Artificial Sequence
  Synthetic oligonucleotide; TTT chr11 5238302 5238323 5238307 5238302 -
ttttttttttttctgagataga

SEQ ID NO: 141920 - DNA, 22 bp, Artificial Sequence
  Synthetic oligonucleotide; TTT chr11 5238301 5238322 5238306 5238301 -
tttttttttttctgagatagag

SEQ ID NO: 141921 - DNA, 22 bp, Artificial Sequence
  Synthetic oligonucleotide; TTT chr11 5238300 5238321 5238305 5238300 -
ttttttttttctgagatagagc

SEQ ID NO: 141922 - DNA, 22 bp, Artificial Sequence
  Synthetic oligonucleotide; TTT chr11 5238299 5238320 5238304 5238299 -
tttttttttctgagatagagca

SEQ ID NO: 141923 - DNA, 22 bp, Artificial Sequence
  Synthetic oligonucleotide; TTT chr11 5238298 5238319 5238303 5238298 -
ttttttttctgagatagagcat

SEQ ID NO: 141924 - DNA, 22 bp, Artificial Sequence
  Synthetic oligonucleotide; TTT chr11 5238297 5238318 5238302 5238297 -
tttttttctgagatagagcatt

SEQ ID NO: 141925 - DNA, 22 bp, Artificial Sequence
  Synthetic oligonucleotide; TTT chr11 5238296 5238317 5238301 5238296 -
ttttttctgagatagagcattg

SEQ ID NO: 141926 - DNA, 22 bp, Artificial Sequence
  Synthetic oligonucleotide; TTT chr11 5238295 5238316 5238300 5238295 -
tttttctgagatagagcattgc

SEQ ID NO: 141927 - DNA, 22 bp, Artificial Sequence
  Synthetic oligonucleotide; TTT chr11 5238294 5238315 5238299 5238294 -
ttttctgagatagagcattgct

SEQ ID NO: 141928 - DNA, 22 bp, Artificial Sequence
  Synthetic oligonucleotide; TTT chr11 5238293 5238314 5238298 5238293 -
tttctgagatagagcattgcta

SEQ ID NO: 141929 - DNA, 22 bp, Artificial Sequence
  Synthetic oligonucleotide; TTT chr11 5238292 5238313 5238297 5238292 -
ttctgagatagagcattgctat

SEQ ID NO: 141930 - DNA, 22 bp, Artificial Sequence
  Synthetic oligonucleotide; TTT chr11 5238291 5238312 5238296 5238291 -
tctgagatagagcattgctatg

SEQ ID NO: 141931 - DNA, 22 bp, Artificial Sequence
  Synthetic oligonucleotide; TTT chr11 5238290 5238311 5238295 5238290 -
ctgagatagagcattgctatgg

SEQ ID NO: 141932 - DNA, 22 bp, Artificial Sequence
  Synthetic oligonucleotide; TTC chr11 5238289 5238310 5238294 5238289 -
tgagatagagcattgctatggt

SEQ ID NO: 141933 - DNA, 22 bp, Artificial Sequence
  Synthetic oligonucleotide; CTG chr11 5238287 5238308 5238292 5238287 -
agatagagcattgctatggttg

SEQ ID NO: 141934 - DNA, 22 bp, Artificial Sequence
  Synthetic oligonucleotide; TTG chr11 5238274 5238295 5238279 5238274 -
ctatggttgcccaggctggagt

SEQ ID NO: 141935 - DNA, 22 bp, Artificial Sequence
  Synthetic oligonucleotide; CTA chr11 5238271 5238292 5238276 5238271 -
tggttgcccaggctggagtgca

SEQ ID NO: 141936 - DNA, 22 bp, Artificial Sequence
  Synthetic oligonucleotide; TTG chr11 5238265 5238286 5238270 5238265 -
cccaggctggagtgcaatggca

SEQ ID NO: 141937 - DNA, 22 bp, Artificial Sequence
  Synthetic oligonucleotide; CTG chr11 5238256 5238277 5238261 5238256 -
gagtgcaatggcatgatccagg

SEQ ID NO: 141938 - DNA, 22 bp, Artificial Sequence
  Synthetic oligonucleotide; CTC chr11 5238231 5238252 5238236 5238231 -
actgcaacatctgcctcccagg

SEQ ID NO: 141939 - DNA, 22 bp, Artificial Sequence
  Synthetic oligonucleotide; CTG chr11 5238227 5238248 5238232 5238227 -
caacatctgcctcccaggttca

SEQ ID NO: 141940 - DNA, 22 bp, Artificial Sequence
  Synthetic oligonucleotide; CTG chr11 5238218 5238239 5238223 5238218 -
cctcccaggttcaagcgattct

SEQ ID NO: 141941 - DNA, 22 bp, Artificial Sequence
  Synthetic oligonucleotide; CTC chr11 5238214 5238235 5238219 5238214 -
ccaggttcaagcgattctcctg

SEQ ID NO: 141942 - DNA, 22 bp, Artificial Sequence
  Synthetic oligonucleotide; TTC chr11 5238206 5238227 5238211 5238206 -
aagcgattctcctgcctcagcc

SEQ ID NO: 141943 - DNA, 22 bp, Artificial Sequence
  Synthetic oligonucleotide; TTC chr11 5238197 5238218 5238202 5238197 -
tcctgcctcagcctcccaagta

SEQ ID NO: 141944 - DNA, 22 bp, Artificial Sequence
  Synthetic oligonucleotide; CTC chr11 5238195 5238216 5238200 5238195 -
ctgcctcagcctcccaagtagc

SEQ ID NO: 141945 - DNA, 22 bp, Artificial Sequence
  Synthetic oligonucleotide; CTG chr11 5238192 5238213 5238197 5238192 -
cctcagcctcccaagtagctgg

SEQ ID NO: 141946 - DNA, 22 bp, Artificial Sequence
  Synthetic oligonucleotide; CTC chr11 5238188 5238209 5238193 5238188 -
agcctcccaagtagctggcact

SEQ ID NO: 141947 - DNA, 22 bp, Artificial Sequence
  Synthetic oligonucleotide; CTC chr11 5238182 5238203 5238187 5238182 -
ccaagtagctggcactacaggc

SEQ ID NO: 141948 - DNA, 22 bp, Artificial Sequence
  Synthetic oligonucleotide; CTG chr11 5238171 5238192 5238176 5238171 -
gcactacaggcatgtgccacca

SEQ ID NO: 141949 - DNA, 22 bp, Artificial Sequence
  Synthetic oligonucleotide; CTA chr11 5238165 5238186 5238170 5238165 -
caggcatgtgccaccaccatgc

SEQ ID NO: 141950 - DNA, 22 bp, Artificial Sequence
  Synthetic oligonucleotide; CTG chr11 5238140 5238161 5238145 5238140 -
gctaattttctatttttagtag

SEQ ID NO: 141951 - DNA, 22 bp, Artificial Sequence
  Synthetic oligonucleotide; CTA chr11 5238136 5238157 5238141 5238136 -
attttctatttttagtagatag

SEQ ID NO: 141952 - DNA, 22 bp, Artificial Sequence
  Synthetic oligonucleotide; TTT chr11 5238132 5238153 5238137 5238132 -
tctatttttagtagataggggg

SEQ ID NO: 141953 - DNA, 22 bp, Artificial Sequence
  Synthetic oligonucleotide; TTT chr11 5238131 5238152 5238136 5238131 -
ctatttttagtagatagggggt

SEQ ID NO: 141954 - DNA, 22 bp, Artificial Sequence
  Synthetic oligonucleotide; TTC chr11 5238130 5238151 5238135 5238130 -
tatttttagtagatagggggtt

SEQ ID NO: 141955 - DNA, 22 bp, Artificial Sequence
  Synthetic oligonucleotide; CTA chr11 5238128 5238149 5238133 5238128 -
tttttagtagatagggggtttc

SEQ ID NO: 141956 - DNA, 22 bp, Artificial Sequence
  Synthetic oligonucleotide; TTT chr11 5238125 5238146 5238130 5238125 -
ttagtagatagggggtttcacc

SEQ ID NO: 141957 - DNA, 22 bp, Artificial Sequence
  Synthetic oligonucleotide; TTT chr11 5238124 5238145 5238129 5238124 -
tagtagatagggggtttcacca

SEQ ID NO: 141958 - DNA, 22 bp, Artificial Sequence
  Synthetic oligonucleotide; TTT chr11 5238123 5238144 5238128 5238123 -
agtagatagggggtttcaccat

SEQ ID NO: 141959 - DNA, 22 bp, Artificial Sequence
  Synthetic oligonucleotide; TTA chr11 5238122 5238143 5238127 5238122 -
gtagatagggggtttcaccatg

SEQ ID NO: 141960 - DNA, 22 bp, Artificial Sequence
  Synthetic oligonucleotide; TTT chr11 5238107 5238128 5238112 5238107 -
caccatgttggtcaggctgatc

SEQ ID NO: 141961 - DNA, 22 bp, Artificial Sequence
  Synthetic oligonucleotide; TTC chr11 5238106 5238127 5238111 5238106 -
accatgttggtcaggctgatct

SEQ ID NO: 141962 - DNA, 22 bp, Artificial Sequence
  Synthetic oligonucleotide; TTG chr11 5238097 5238118 5238102 5238097 -
gtcaggctgatctcgaactcct

SEQ ID NO: 141963 - DNA, 22 bp, Artificial Sequence
  Synthetic oligonucleotide; CTG chr11 5238088 5238109 5238093 5238088 -
atctcgaactcctaacatcagg

SEQ ID NO: 141964 - DNA, 22 bp, Artificial Sequence
  Synthetic oligonucleotide; CTC chr11 5238083 5238104 5238088 5238083 -
gaactcctaacatcaggtgatc

SEQ ID NO: 141965 - DNA, 22 bp, Artificial Sequence
  Synthetic oligonucleotide; CTC chr11 5238077 5238098 5238082 5238077 -
ctaacatcaggtgatccaccct

SEQ ID NO: 141966 - DNA, 22 bp, Artificial Sequence
  Synthetic oligonucleotide; CTA chr11 5238074 5238095 5238079 5238074 -
acatcaggtgatccaccctcct

SEQ ID NO: 141967 - DNA, 22 bp, Artificial Sequence
  Synthetic oligonucleotide; CTC chr11 5238054 5238075 5238059 5238054 -
ctcggcctctgaaagtgctggg

SEQ ID NO: 141968 - DNA, 22 bp, Artificial Sequence
  Synthetic oligonucleotide; CTC chr11 5238051 5238072 5238056 5238051 -
ggcctctgaaagtgctgggatc

SEQ ID NO: 141969 - DNA, 22 bp, Artificial Sequence
  Synthetic oligonucleotide; CTC chr11 5238045 5238066 5238050 5238045 -
tgaaagtgctgggatcacaggc

SEQ ID NO: 141970 - DNA, 22 bp, Artificial Sequence
  Synthetic oligonucleotide; CTG chr11 5238043 5238064 5238048 5238043 -
aaagtgctgggatcacaggcgt

SEQ ID NO: 141971 - DNA, 22 bp, Artificial Sequence
  Synthetic oligonucleotide; CTG chr11 5238034 5238055 5238039 5238034 -
ggatcacaggcgtgagccacca

SEQ ID NO: 141972 - DNA, 22 bp, Artificial Sequence
  Synthetic oligonucleotide; TTT chr11 5237989 5238010 5237994 5237989 -
tgtagaaggatataacccatat

SEQ ID NO: 141973 - DNA, 22 bp, Artificial Sequence
  Synthetic oligonucleotide; TTT chr11 5237988 5238009 5237993 5237988 -
gtagaaggatataacccatatt

SEQ ID NO: 141974 - DNA, 22 bp, Artificial Sequence
  Synthetic oligonucleotide; TTG chr11 5237987 5238008 5237992 5237987 -
tagaaggatataacccatattt

SEQ ID NO: 141975 - DNA, 22 bp, Artificial Sequence
  Synthetic oligonucleotide; TTT chr11 5237965 5237986 5237970 5237965 -
ctctgaccctagagtccttagt

SEQ ID NO: 141976 - DNA, 22 bp, Artificial Sequence
  Synthetic oligonucleotide; TTC chr11 5237964 5237985 5237969 5237964 -
tctgaccctagagtccttagta

SEQ ID NO: 141977 - DNA, 22 bp, Artificial Sequence
  Synthetic oligonucleotide; CTC chr11 5237962 5237983 5237967 5237962 -
tgaccctagagtccttagtata

SEQ ID NO: 141978 - DNA, 22 bp, Artificial Sequence
  Synthetic oligonucleotide; CTG chr11 5237960 5237981 5237965 5237960 -
accctagagtccttagtatacc

SEQ ID NO: 141979 - DNA, 22 bp, Artificial Sequence
  Synthetic oligonucleotide; CTA chr11 5237954 5237975 5237959 5237954 -
gagtccttagtatacctcccat

SEQ ID NO: 141980 - DNA, 22 bp, Artificial Sequence
  Synthetic oligonucleotide; CTT chr11 5237946 5237967 5237951 5237946 -
agtatacctcccataccatgtg

SEQ ID NO: 141981 - DNA, 22 bp, Artificial Sequence
  Synthetic oligonucleotide; TTA chr11 5237945 5237966 5237950 5237945 -
gtatacctcccataccatgtgg

SEQ ID NO: 141982 - DNA, 22 bp, Artificial Sequence
  Synthetic oligonucleotide; CTC chr11 5237936 5237957 5237941 5237936 -
ccataccatgtggctcatcctc

SEQ ID NO: 141983 - DNA, 22 bp, Artificial Sequence
  Synthetic oligonucleotide; CTC chr11 5237920 5237941 5237925 5237920 -
atcctccttacatacatttccc

SEQ ID NO: 141984 - DNA, 22 bp, Artificial Sequence
  Synthetic oligonucleotide; CTC chr11 5237914 5237935 5237919 5237914 -
cttacatacatttcccatcttt

SEQ ID NO: 141985 - DNA, 22 bp, Artificial Sequence
  Synthetic oligonucleotide; CTT chr11 5237911 5237932 5237916 5237911 -
acatacatttcccatctttcac

SEQ ID NO: 141986 - DNA, 22 bp, Artificial Sequence
  Synthetic oligonucleotide; TTA chr11 5237910 5237931 5237915 5237910 -
catacatttcccatctttcacc

SEQ ID NO: 141987 - DNA, 22 bp, Artificial Sequence
  Synthetic oligonucleotide; TTT chr11 5237901 5237922 5237906 5237901 -
cccatctttcaccctacctttt

SEQ ID NO: 141988 - DNA, 22 bp, Artificial Sequence
  Synthetic oligonucleotide; TTC chr11 5237900 5237921 5237905 5237900 -
ccatctttcaccctaccttttc

SEQ ID NO: 141989 - DNA, 22 bp, Artificial Sequence
  Synthetic oligonucleotide; CTT chr11 5237893 5237914 5237898 5237893 -
tcaccctaccttttcctttttg

SEQ ID NO: 141990 - DNA, 22 bp, Artificial Sequence
  Synthetic oligonucleotide; TTT chr11 5237892 5237913 5237897 5237892 -
caccctaccttttcctttttgt

SEQ ID NO: 141991 - DNA, 22 bp, Artificial Sequence
  Synthetic oligonucleotide; TTC chr11 5237891 5237912 5237896 5237891 -
accctaccttttcctttttgtt

SEQ ID NO: 141992 - DNA, 22 bp, Artificial Sequence
  Synthetic oligonucleotide; CTA chr11 5237885 5237906 5237890 5237885 -
ccttttcctttttgtttcagct

SEQ ID NO: 141993 - DNA, 22 bp, Artificial Sequence
  Synthetic oligonucleotide; CTT chr11 5237881 5237902 5237886 5237881 -
ttcctttttgtttcagcttttc

SEQ ID NO: 141994 - DNA, 22 bp, Artificial Sequence
  Synthetic oligonucleotide; TTT chr11 5237880 5237901 5237885 5237880 -
tcctttttgtttcagcttttca

SEQ ID NO: 141995 - DNA, 22 bp, Artificial Sequence
  Synthetic oligonucleotide; TTT chr11 5237879 5237900 5237884 5237879 -
cctttttgtttcagcttttcac

SEQ ID NO: 141996 - DNA, 22 bp, Artificial Sequence
  Synthetic oligonucleotide; TTC chr11 5237878 5237899 5237883 5237878 -
ctttttgtttcagcttttcact

SEQ ID NO: 141997 - DNA, 22 bp, Artificial Sequence
  Synthetic oligonucleotide; CTT chr11 5237875 5237896 5237880 5237875 -
tttgtttcagcttttcactgtg

SEQ ID NO: 141998 - DNA, 22 bp, Artificial Sequence
  Synthetic oligonucleotide; TTT chr11 5237874 5237895 5237879 5237874 -
ttgtttcagcttttcactgtgt

SEQ ID NO: 141999 - DNA, 22 bp, Artificial Sequence
  Synthetic oligonucleotide; TTT chr11 5237873 5237894 5237878 5237873 -
tgtttcagcttttcactgtgtc

SEQ ID NO: 142000 - DNA, 22 bp, Artificial Sequence
  Synthetic oligonucleotide; TTT chr11 5237872 5237893 5237877 5237872 -
gtttcagcttttcactgtgtca

SEQ ID NO: 142001 - DNA, 22 bp, Artificial Sequence
  Synthetic oligonucleotide; TTG chr11 5237871 5237892 5237876 5237871 -
tttcagcttttcactgtgtcaa

SEQ ID NO: 142002 - DNA, 22 bp, Artificial Sequence
  Synthetic oligonucleotide; TTT chr11 5237868 5237889 5237873 5237868 -
cagcttttcactgtgtcaaaat

SEQ ID NO: 142003 - DNA, 22 bp, Artificial Sequence
  Synthetic oligonucleotide; TTC chr11 5237867 5237888 5237872 5237867 -
agcttttcactgtgtcaaaatc

SEQ ID NO: 142004 - DNA, 22 bp, Artificial Sequence
  Synthetic oligonucleotide; CTT chr11 5237862 5237883 5237867 5237862 -
ttcactgtgtcaaaatctagaa

SEQ ID NO: 142005 - DNA, 22 bp, Artificial Sequence
  Synthetic oligonucleotide; TTT chr11 5237861 5237882 5237866 5237861 -
tcactgtgtcaaaatctagaac

SEQ ID NO: 142006 - DNA, 22 bp, Artificial Sequence
  Synthetic oligonucleotide; TTT chr11 5237860 5237881 5237865 5237860 -
cactgtgtcaaaatctagaacc

SEQ ID NO: 142007 - DNA, 22 bp, Artificial Sequence
  Synthetic oligonucleotide; TTC chr11 5237859 5237880 5237864 5237859 -
actgtgtcaaaatctagaacct

SEQ ID NO: 142008 - DNA, 22 bp, Artificial Sequence
  Synthetic oligonucleotide; CTG chr11 5237855 5237876 5237860 5237855 -
tgtcaaaatctagaaccttatc

SEQ ID NO: 142009 - DNA, 22 bp, Artificial Sequence
  Synthetic oligonucleotide; CTA chr11 5237843 5237864 5237848 5237843 -
gaaccttatctcctacctgctc

SEQ ID NO: 142010 - DNA, 22 bp, Artificial Sequence
  Synthetic oligonucleotide; CTT chr11 5237836 5237857 5237841 5237836 -
atctcctacctgctctgaaacc

SEQ ID NO: 142011 - DNA, 22 bp, Artificial Sequence
  Synthetic oligonucleotide; TTA chr11 5237835 5237856 5237840 5237835 -
tctcctacctgctctgaaacca

SEQ ID NO: 142012 - DNA, 22 bp, Artificial Sequence
  Synthetic oligonucleotide; CTC chr11 5237831 5237852 5237836 5237831 -
ctacctgctctgaaaccaacag

SEQ ID NO: 142013 - DNA, 22 bp, Artificial Sequence
  Synthetic oligonucleotide; CTA chr11 5237828 5237849 5237833 5237828 -
cctgctctgaaaccaacagcaa

SEQ ID NO: 142014 - DNA, 22 bp, Artificial Sequence
  Synthetic oligonucleotide; CTG chr11 5237824 5237845 5237829 5237824 -
ctctgaaaccaacagcaagttg

SEQ ID NO: 142015 - DNA, 22 bp, Artificial Sequence
  Synthetic oligonucleotide; CTC chr11 5237821 5237842 5237826 5237821 -
tgaaaccaacagcaagttgact

SEQ ID NO: 142016 - DNA, 22 bp, Artificial Sequence
  Synthetic oligonucleotide; CTG chr11 5237819 5237840 5237824 5237819 -
aaaccaacagcaagttgacttc

SEQ ID NO: 142017 - DNA, 22 bp, Artificial Sequence
  Synthetic oligonucleotide; TTG chr11 5237802 5237823 5237807 5237802 -
acttccattctaacccacattg

SEQ ID NO: 142018 - DNA, 22 bp, Artificial Sequence
  Synthetic oligonucleotide; CTT chr11 5237798 5237819 5237803 5237798 -
ccattctaacccacattggcat

SEQ ID NO: 142019 - DNA, 22 bp, Artificial Sequence
  Synthetic oligonucleotide; TTC chr11 5237797 5237818 5237802 5237797 -
cattctaacccacattggcatt

SEQ ID NO: 142020 - DNA, 22 bp, Artificial Sequence
  Synthetic oligonucleotide; TTC chr11 5237792 5237813 5237797 5237792 -
taacccacattggcattacact

SEQ ID NO: 142021 - DNA, 22 bp, Artificial Sequence
  Synthetic oligonucleotide; CTA chr11 5237790 5237811 5237795 5237790 -
acccacattggcattacactaa

SEQ ID NO: 142022 - DNA, 22 bp, Artificial Sequence
  Synthetic oligonucleotide; TTG chr11 5237780 5237801 5237785 5237780 -
gcattacactaattaaaatcga

SEQ ID NO: 142023 - DNA, 22 bp, Artificial Sequence
  Synthetic oligonucleotide; TTA chr11 5237774 5237795 5237779 5237774 -
cactaattaaaatcgatactga

SEQ ID NO: 142024 - DNA, 22 bp, Artificial Sequence
  Synthetic oligonucleotide; CTA chr11 5237769 5237790 5237774 5237769 -
attaaaatcgatactgagttct

SEQ ID NO: 142025 - DNA, 22 bp, Artificial Sequence
  Synthetic oligonucleotide; TTA chr11 5237765 5237786 5237770 5237765 -
aaatcgatactgagttctaaaa

SEQ ID NO: 142026 - DNA, 22 bp, Artificial Sequence
  Synthetic oligonucleotide; CTG chr11 5237753 5237774 5237758 5237753 -
agttctaaaatcatcggggatt

SEQ ID NO: 142027 - DNA, 22 bp, Artificial Sequence
  Synthetic oligonucleotide; TTC chr11 5237748 5237769 5237753 5237748 -
taaaatcatcggggattttggg

SEQ ID NO: 142028 - DNA, 22 bp, Artificial Sequence
  Synthetic oligonucleotide; CTA chr11 5237746 5237767 5237751 5237746 -
aaatcatcggggattttgggga

SEQ ID NO: 142029 - DNA, 22 bp, Artificial Sequence
  Synthetic oligonucleotide; TTT chr11 5237730 5237751 5237735 5237730 -
tggggactatgtcttacttcat

SEQ ID NO: 142030 - DNA, 22 bp, Artificial Sequence
  Synthetic oligonucleotide; TTT chr11 5237729 5237750 5237734 5237729 -
ggggactatgtcttacttcata

SEQ ID NO: 142031 - DNA, 22 bp, Artificial Sequence
  Synthetic oligonucleotide; TTG chr11 5237728 5237749 5237733 5237728 -
gggactatgtcttacttcatac

SEQ ID NO: 142032 - DNA, 22 bp, Artificial Sequence
  Synthetic oligonucleotide; CTA chr11 5237721 5237742 5237726 5237721 -
tgtcttacttcatacttccttg

SEQ ID NO: 142033 - DNA, 22 bp, Artificial Sequence
  Synthetic oligonucleotide; CTT chr11 5237715 5237736 5237720 5237715 -
acttcatacttccttgagattt

SEQ ID NO: 142034 - DNA, 22 bp, Artificial Sequence
  Synthetic oligonucleotide; TTA chr11 5237714 5237735 5237719 5237714 -
cttcatacttccttgagatttc

SEQ ID NO: 142035 - DNA, 22 bp, Artificial Sequence
  Synthetic oligonucleotide; CTT chr11 5237711 5237732 5237716 5237711 -
catacttccttgagatttcaca

SEQ ID NO: 142036 - DNA, 22 bp, Artificial Sequence
  Synthetic oligonucleotide; TTC chr11 5237710 5237731 5237715 5237710 -
atacttccttgagatttcacat

SEQ ID NO: 142037 - DNA, 22 bp, Artificial Sequence
  Synthetic oligonucleotide; CTT chr11 5237704 5237725 5237709 5237704 -
ccttgagatttcacattaaatg

SEQ ID NO: 142038 - DNA, 22 bp, Artificial Sequence
  Synthetic oligonucleotide; TTC chr11 5237703 5237724 5237708 5237703 -
cttgagatttcacattaaatgt

SEQ ID NO: 142039 - DNA, 22 bp, Artificial Sequence
  Synthetic oligonucleotide; CTT chr11 5237700 5237721 5237705 5237700 -
gagatttcacattaaatgttgg

SEQ ID NO: 142040 - DNA, 22 bp, Artificial Sequence
  Synthetic oligonucleotide; TTG chr11 5237699 5237720 5237704 5237699 -
agatttcacattaaatgttggt

SEQ ID NO: 142041 - DNA, 22 bp, Artificial Sequence
  Synthetic oligonucleotide; TTT chr11 5237693 5237714 5237698 5237693 -
cacattaaatgttggtgttcat

SEQ ID NO: 142042 - DNA, 22 bp, Artificial Sequence
  Synthetic oligonucleotide; TTC chr11 5237692 5237713 5237697 5237692 -
acattaaatgttggtgttcatt

SEQ ID NO: 142043 - DNA, 22 bp, Artificial Sequence
  Synthetic oligonucleotide; TTA chr11 5237686 5237707 5237691 5237686 -
aatgttggtgttcattaaaggt

SEQ ID NO: 142044 - DNA, 22 bp, Artificial Sequence
  Synthetic oligonucleotide; TTG chr11 5237679 5237700 5237684 5237679 -
gtgttcattaaaggtccttcat

SEQ ID NO: 142045 - DNA, 22 bp, Artificial Sequence
  Synthetic oligonucleotide; TTC chr11 5237673 5237694 5237678 5237673 -
attaaaggtccttcatttaact

SEQ ID NO: 142046 - DNA, 22 bp, Artificial Sequence
  Synthetic oligonucleotide; TTA chr11 5237669 5237690 5237674 5237669 -
aaggtccttcatttaactttgt

SEQ ID NO: 142047 - DNA, 22 bp, Artificial Sequence
  Synthetic oligonucleotide; CTT chr11 5237660 5237681 5237665 5237660 -
catttaactttgtattcatcac

SEQ ID NO: 142048 - DNA, 22 bp, Artificial Sequence
  Synthetic oligonucleotide; TTC chr11 5237659 5237680 5237664 5237659 -
atttaactttgtattcatcaca

SEQ ID NO: 142049 - DNA, 22 bp, Artificial Sequence
  Synthetic oligonucleotide; TTT chr11 5237655 5237676 5237660 5237655 -
aactttgtattcatcacactct

SEQ ID NO: 142050 - DNA, 22 bp, Artificial Sequence
  Synthetic oligonucleotide; TTA chr11 5237654 5237675 5237659 5237654 -
actttgtattcatcacactctt

SEQ ID NO: 142051 - DNA, 22 bp, Artificial Sequence
  Synthetic oligonucleotide; CTT chr11 5237650 5237671 5237655 5237650 -
tgtattcatcacactcttggat

SEQ ID NO: 142052 - DNA, 22 bp, Artificial Sequence
  Synthetic oligonucleotide; TTT chr11 5237649 5237670 5237654 5237649 -
gtattcatcacactcttggatt

SEQ ID NO: 142053 - DNA, 22 bp, Artificial Sequence
  Synthetic oligonucleotide; TTG chr11 5237648 5237669 5237653 5237648 -
tattcatcacactcttggattc

SEQ ID NO: 142054 - DNA, 22 bp, Artificial Sequence
  Synthetic oligonucleotide; TTC chr11 5237643 5237664 5237648 5237643 -
atcacactcttggattcacagt

SEQ ID NO: 142055 - DNA, 22 bp, Artificial Sequence
  Synthetic oligonucleotide; CTC chr11 5237634 5237655 5237639 5237634 -
ttggattcacagttatatctaa

SEQ ID NO: 142056 - DNA, 22 bp, Artificial Sequence
  Synthetic oligonucleotide; CTT chr11 5237632 5237653 5237637 5237632 -
ggattcacagttatatctaaac

SEQ ID NO: 142057 - DNA, 22 bp, Artificial Sequence
  Synthetic oligonucleotide; TTG chr11 5237631 5237652 5237636 5237631 -
gattcacagttatatctaaact

SEQ ID NO: 142058 - DNA, 22 bp, Artificial Sequence
  Synthetic oligonucleotide; TTC chr11 5237626 5237647 5237631 5237626 -
acagttatatctaaactcttaa

SEQ ID NO: 142059 - DNA, 22 bp, Artificial Sequence
  Synthetic oligonucleotide; TTA chr11 5237619 5237640 5237624 5237619 -
tatctaaactcttaaatacagc

SEQ ID NO: 142060 - DNA, 22 bp, Artificial Sequence
  Synthetic oligonucleotide; CTA chr11 5237613 5237634 5237618 5237613 -
aactcttaaatacagcctgtat

SEQ ID NO: 142061 - DNA, 22 bp, Artificial Sequence
  Synthetic oligonucleotide; CTC chr11 5237608 5237629 5237613 5237608 -
ttaaatacagcctgtataatcc

SEQ ID NO: 142062 - DNA, 22 bp, Artificial Sequence
  Synthetic oligonucleotide; CTT chr11 5237606 5237627 5237611 5237606 -
aaatacagcctgtataatccca

SEQ ID NO: 142063 - DNA, 22 bp, Artificial Sequence
  Synthetic oligonucleotide; TTA chr11 5237605 5237626 5237610 5237605 -
aatacagcctgtataatcccaa

SEQ ID NO: 142064 - DNA, 22 bp, Artificial Sequence
  Synthetic oligonucleotide; CTG chr11 5237594 5237615 5237599 5237594 -
tataatcccaattcccaactct

SEQ ID NO: 142065 - DNA, 22 bp, Artificial Sequence
  Synthetic oligonucleotide; TTC chr11 5237580 5237601 5237585 5237580 -
ccaactctgatttctaacctct

SEQ ID NO: 142066 - DNA, 22 bp, Artificial Sequence
  Synthetic oligonucleotide; CTC chr11 5237573 5237594 5237578 5237573 -
tgatttctaacctctgacctcc

SEQ ID NO: 142067 - DNA, 22 bp, Artificial Sequence
  Synthetic oligonucleotide; CTG chr11 5237571 5237592 5237576 5237571 -
atttctaacctctgacctccaa

SEQ ID NO: 142068 - DNA, 22 bp, Artificial Sequence
  Synthetic oligonucleotide; TTT chr11 5237567 5237588 5237572 5237567 -
ctaacctctgacctccaacctc

SEQ ID NO: 142069 - DNA, 22 bp, Artificial Sequence
  Synthetic oligonucleotide; TTC chr11 5237566 5237587 5237571 5237566 -
taacctctgacctccaacctca

SEQ ID NO: 142070 - DNA, 22 bp, Artificial Sequence
  Synthetic oligonucleotide; CTA chr11 5237564 5237585 5237569 5237564 -
acctctgacctccaacctcagt

SEQ ID NO: 142071 - DNA, 22 bp, Artificial Sequence
  Synthetic oligonucleotide; CTC chr11 5237559 5237580 5237564 5237559 -
tgacctccaacctcagtgccaa

SEQ ID NO: 142072 - DNA, 22 bp, Artificial Sequence
  Synthetic oligonucleotide; CTG chr11 5237557 5237578 5237562 5237557 -
acctccaacctcagtgccaaac

SEQ ID NO: 142073 - DNA, 22 bp, Artificial Sequence
  Synthetic oligonucleotide; CTC chr11 5237552 5237573 5237557 5237552 -
caacctcagtgccaaacccata

SEQ ID NO: 142074 - DNA, 22 bp, Artificial Sequence
  Synthetic oligonucleotide; CTC chr11 5237545 5237566 5237550 5237545 -
agtgccaaacccatatatcaaa

SEQ ID NO: 142075 - DNA, 22 bp, Artificial Sequence
  Synthetic oligonucleotide; CTG chr11 5237513 5237534 5237518 5237513 -
ggcttatttatatagatgtcct

SEQ ID NO: 142076 - DNA, 22 bp, Artificial Sequence
  Synthetic oligonucleotide; CTT chr11 5237508 5237529 5237513 5237508 -
atttatatagatgtcctatagg

SEQ ID NO: 142077 - DNA, 22 bp, Artificial Sequence
  Synthetic oligonucleotide; TTA chr11 5237507 5237528 5237512 5237507 -
tttatatagatgtcctataggc

SEQ ID NO: 142078 - DNA, 22 bp, Artificial Sequence
  Synthetic oligonucleotide; TTT chr11 5237504 5237525 5237509 5237504 -
atatagatgtcctataggcacc

SEQ ID NO: 142079 - DNA, 22 bp, Artificial Sequence
  Synthetic oligonucleotide; TTA chr11 5237503 5237524 5237508 5237503 -
tatagatgtcctataggcacct

SEQ ID NO: 142080 - DNA, 22 bp, Artificial Sequence
  Synthetic oligonucleotide; CTA chr11 5237490 5237511 5237495 5237490 -
taggcacctcagactcagcatg

SEQ ID NO: 142081 - DNA, 22 bp, Artificial Sequence
  Synthetic oligonucleotide; CTC chr11 5237480 5237501 5237485 5237480 -
agactcagcatgggtatttcac

SEQ ID NO: 142082 - DNA, 22 bp, Artificial Sequence
  Synthetic oligonucleotide; CTC chr11 5237474 5237495 5237479 5237474 -
agcatgggtatttcacttgtta

SEQ ID NO: 142083 - DNA, 22 bp, Artificial Sequence
  Synthetic oligonucleotide; TTT chr11 5237461 5237482 5237466 5237461 -
cacttgttatactaaaactgtt

SEQ ID NO: 142084 - DNA, 22 bp, Artificial Sequence
  Synthetic oligonucleotide; TTC chr11 5237460 5237481 5237465 5237460 -
acttgttatactaaaactgttt

SEQ ID NO: 142085 - DNA, 22 bp, Artificial Sequence
  Synthetic oligonucleotide; CTT chr11 5237456 5237477 5237461 5237456 -
gttatactaaaactgtttctct

SEQ ID NO: 142086 - DNA, 22 bp, Artificial Sequence
  Synthetic oligonucleotide; TTG chr11 5237455 5237476 5237460 5237455 -
ttatactaaaactgtttctctt

SEQ ID NO: 142087 - DNA, 22 bp, Artificial Sequence
  Synthetic oligonucleotide; TTA chr11 5237452 5237473 5237457 5237452 -
tactaaaactgtttctcttcca

SEQ ID NO: 142088 - DNA, 22 bp, Artificial Sequence
  Synthetic oligonucleotide; CTA chr11 5237447 5237468 5237452 5237447 -
aaactgtttctcttccagtgtt

SEQ ID NO: 142089 - DNA, 22 bp, Artificial Sequence
  Synthetic oligonucleotide; CTG chr11 5237441 5237462 5237446 5237441 -
tttctcttccagtgttttccat

SEQ ID NO: 142090 - DNA, 22 bp, Artificial Sequence
  Synthetic oligonucleotide; TTT chr11 5237438 5237459 5237443 5237438 -
ctcttccagtgttttccatttt

SEQ ID NO: 142091 - DNA, 22 bp, Artificial Sequence
  Synthetic oligonucleotide; TTC chr11 5237437 5237458 5237442 5237437 -
tcttccagtgttttccatttta

SEQ ID NO: 142092 - DNA, 22 bp, Artificial Sequence
  Synthetic oligonucleotide; CTC chr11 5237435 5237456 5237440 5237435 -
ttccagtgttttccattttagt

SEQ ID NO: 142093 - DNA, 22 bp, Artificial Sequence
  Synthetic oligonucleotide; CTT chr11 5237433 5237454 5237438 5237433 -
ccagtgttttccattttagtca

SEQ ID NO: 142094 - DNA, 22 bp, Artificial Sequence
  Synthetic oligonucleotide; TTC chr11 5237432 5237453 5237437 5237432 -
cagtgttttccattttagtcat

SEQ ID NO: 142095 - DNA, 22 bp, Artificial Sequence
  Synthetic oligonucleotide; TTT chr11 5237424 5237445 5237429 5237424 -
tccattttagtcattagatagc

SEQ ID NO: 142096 - DNA, 22 bp, Artificial Sequence
  Synthetic oligonucleotide; TTT chr11 5237423 5237444 5237428 5237423 -
ccattttagtcattagatagct

SEQ ID NO: 142097 - DNA, 22 bp, Artificial Sequence
  Synthetic oligonucleotide; TTC chr11 5237422 5237443 5237427 5237422 -
cattttagtcattagatagcta

SEQ ID NO: 142098 - DNA, 22 bp, Artificial Sequence
  Synthetic oligonucleotide; TTT chr11 5237417 5237438 5237422 5237417 -
tagtcattagatagctacttgc

SEQ ID NO: 142099 - DNA, 22 bp, Artificial Sequence
  Synthetic oligonucleotide; TTT chr11 5237416 5237437 5237421 5237416 -
agtcattagatagctacttgcc

SEQ ID NO: 142100 - DNA, 22 bp, Artificial Sequence
  Synthetic oligonucleotide; TTA chr11 5237415 5237436 5237420 5237415 -
gtcattagatagctacttgccc

SEQ ID NO: 142101 - DNA, 22 bp, Artificial Sequence
  Synthetic oligonucleotide; TTA chr11 5237408 5237429 5237413 5237408 -
gatagctacttgcccattcacc

SEQ ID NO: 142102 - DNA, 22 bp, Artificial Sequence
  Synthetic oligonucleotide; CTA chr11 5237400 5237421 5237405 5237400 -
cttgcccattcaccaaggtcac

SEQ ID NO: 142103 - DNA, 22 bp, Artificial Sequence
  Synthetic oligonucleotide; CTT chr11 5237397 5237418 5237402 5237397 -
gcccattcaccaaggtcacaga

SEQ ID NO: 142104 - DNA, 22 bp, Artificial Sequence
  Synthetic oligonucleotide; TTG chr11 5237396 5237417 5237401 5237396 -
cccattcaccaaggtcacagat

SEQ ID NO: 142105 - DNA, 22 bp, Artificial Sequence
  Synthetic oligonucleotide; TTC chr11 5237389 5237410 5237394 5237389 -
accaaggtcacagattaaaatc

SEQ ID NO: 142106 - DNA, 22 bp, Artificial Sequence
  Synthetic oligonucleotide; TTA chr11 5237372 5237393 5237377 5237372 -
aaatcatttccctacctctaat

SEQ ID NO: 142107 - DNA, 22 bp, Artificial Sequence
  Synthetic oligonucleotide; TTT chr11 5237363 5237384 5237368 5237363 -
ccctacctctaatcaacagttc

SEQ ID NO: 142108 - DNA, 22 bp, Artificial Sequence
  Synthetic oligonucleotide; TTC chr11 5237362 5237383 5237367 5237362 -
cctacctctaatcaacagttcg

SEQ ID NO: 142109 - DNA, 22 bp, Artificial Sequence
  Synthetic oligonucleotide; CTA chr11 5237358 5237379 5237363 5237358 -
cctctaatcaacagttcgattc

SEQ ID NO: 142110 - DNA, 22 bp, Artificial Sequence
  Synthetic oligonucleotide; CTC chr11 5237354 5237375 5237359 5237354 -
taatcaacagttcgattctgct

SEQ ID NO: 142111 - DNA, 22 bp, Artificial Sequence
  Synthetic oligonucleotide; CTA chr11 5237352 5237373 5237357 5237352 -
atcaacagttcgattctgcttc

SEQ ID NO: 142112 - DNA, 22 bp, Artificial Sequence
  Synthetic oligonucleotide; TTC chr11 5237341 5237362 5237346 5237341 -
gattctgcttcaatttgtccct

SEQ ID NO: 142113 - DNA, 22 bp, Artificial Sequence
  Synthetic oligonucleotide; TTC chr11 5237336 5237357 5237341 5237336 -
tgcttcaatttgtccctatcta

SEQ ID NO: 142114 - DNA, 22 bp, Artificial Sequence
  Synthetic oligonucleotide; CTG chr11 5237334 5237355 5237339 5237334 -
cttcaatttgtccctatctatt

SEQ ID NO: 142115 - DNA, 22 bp, Artificial Sequence
  Synthetic oligonucleotide; CTT chr11 5237331 5237352 5237336 5237331 -
caatttgtccctatctattaat

SEQ ID NO: 142116 - DNA, 22 bp, Artificial Sequence
  Synthetic oligonucleotide; TTC chr11 5237330 5237351 5237335 5237330 -
aatttgtccctatctattaatc

SEQ ID NO: 142117 - DNA, 22 bp, Artificial Sequence
  Synthetic oligonucleotide; TTT chr11 5237325 5237346 5237330 5237325 -
gtccctatctattaatcaccac

SEQ ID NO: 142118 - DNA, 22 bp, Artificial Sequence
  Synthetic oligonucleotide; TTG chr11 5237324 5237345 5237329 5237324 -
tccctatctattaatcaccact

SEQ ID NO: 142119 - DNA, 22 bp, Artificial Sequence
  Synthetic oligonucleotide; CTA chr11 5237318 5237339 5237323 5237318 -
tctattaatcaccactcttact

SEQ ID NO: 142120 - DNA, 22 bp, Artificial Sequence
  Synthetic oligonucleotide; CTA chr11 5237314 5237335 5237319 5237314 -
ttaatcaccactcttactgccc

SEQ ID NO: 142121 - DNA, 22 bp, Artificial Sequence
  Synthetic oligonucleotide; TTA chr11 5237311 5237332 5237316 5237311 -
atcaccactcttactgcccagt

SEQ ID NO: 142122 - DNA, 22 bp, Artificial Sequence
  Synthetic oligonucleotide; CTC chr11 5237301 5237322 5237306 5237301 -
ttactgcccagtcaggtcctca

SEQ ID NO: 142123 - DNA, 22 bp, Artificial Sequence
  Synthetic oligonucleotide; CTT chr11 5237299 5237320 5237304 5237299 -
actgcccagtcaggtcctcatt

SEQ ID NO: 142124 - DNA, 22 bp, Artificial Sequence
  Synthetic oligonucleotide; TTA chr11 5237298 5237319 5237303 5237298 -
ctgcccagtcaggtcctcattg

SEQ ID NO: 142125 - DNA, 22 bp, Artificial Sequence
  Synthetic oligonucleotide; CTG chr11 5237295 5237316 5237300 5237295 -
cccagtcaggtcctcattgttt

SEQ ID NO: 142126 - DNA, 22 bp, Artificial Sequence
  Synthetic oligonucleotide; CTC chr11 5237280 5237301 5237285 5237280 -
attgtttcctgaacaagagtag

SEQ ID NO: 142127 - DNA, 22 bp, Artificial Sequence
  Synthetic oligonucleotide; TTG chr11 5237276 5237297 5237281 5237276 -
tttcctgaacaagagtagatgc

SEQ ID NO: 142128 - DNA, 22 bp, Artificial Sequence
  Synthetic oligonucleotide; TTT chr11 5237273 5237294 5237278 5237273 -
cctgaacaagagtagatgctat

SEQ ID NO: 142129 - DNA, 22 bp, Artificial Sequence
  Synthetic oligonucleotide; TTC chr11 5237272 5237293 5237277 5237272 -
ctgaacaagagtagatgctatt

SEQ ID NO: 142130 - DNA, 22 bp, Artificial Sequence
  Synthetic oligonucleotide; CTG chr11 5237269 5237290 5237274 5237269 -
aacaagagtagatgctattctt

SEQ ID NO: 142131 - DNA, 22 bp, Artificial Sequence
  Synthetic oligonucleotide; CTA chr11 5237252 5237273 5237257 5237252 -
ttctttccacttttagacctta

SEQ ID NO: 142132 - DNA, 22 bp, Artificial Sequence
  Synthetic oligonucleotide; TTC chr11 5237249 5237270 5237254 5237249 -
tttccacttttagaccttatcc

SEQ ID NO: 142133 - DNA, 22 bp, Artificial Sequence
  Synthetic oligonucleotide; CTT chr11 5237247 5237268 5237252 5237247 -
tccacttttagaccttatcctg

SEQ ID NO: 142134 - DNA, 22 bp, Artificial Sequence
  Synthetic oligonucleotide; TTT chr11 5237246 5237267 5237251 5237246 -
ccacttttagaccttatcctgg

SEQ ID NO: 142135 - DNA, 22 bp, Artificial Sequence
  Synthetic oligonucleotide; TTC chr11 5237245 5237266 5237250 5237245 -
cacttttagaccttatcctggc

SEQ ID NO: 142136 - DNA, 22 bp, Artificial Sequence
  Synthetic oligonucleotide; CTT chr11 5237240 5237261 5237245 5237240 -
ttagaccttatcctggctggat

SEQ ID NO: 142137 - DNA, 22 bp, Artificial Sequence
  Synthetic oligonucleotide; TTT chr11 5237239 5237260 5237244 5237239 -
tagaccttatcctggctggatg

SEQ ID NO: 142138 - DNA, 22 bp, Artificial Sequence
  Synthetic oligonucleotide; TTT chr11 5237238 5237259 5237243 5237238 -
agaccttatcctggctggatgc

SEQ ID NO: 142139 - DNA, 22 bp, Artificial Sequence
  Synthetic oligonucleotide; TTA chr11 5237237 5237258 5237242 5237237 -
gaccttatcctggctggatgcg

SEQ ID NO: 142140 - DNA, 22 bp, Artificial Sequence
  Synthetic oligonucleotide; CTT chr11 5237231 5237252 5237236 5237231 -
atcctggctggatgcggtggct

SEQ ID NO: 142141 - DNA, 22 bp, Artificial Sequence
  Synthetic oligonucleotide; TTA chr11 5237230 5237251 5237235 5237230 -
tcctggctggatgcggtggctc

SEQ ID NO: 142142 - DNA, 22 bp, Artificial Sequence
  Synthetic oligonucleotide; CTG chr11 5237225 5237246 5237230 5237225 -
gctggatgcggtggctcaggct

SEQ ID NO: 142143 - DNA, 22 bp, Artificial Sequence
  Synthetic oligonucleotide; CTG chr11 5237221 5237242 5237226 5237221 -
gatgcggtggctcaggcttgta

SEQ ID NO: 142144 - DNA, 22 bp, Artificial Sequence
  Synthetic oligonucleotide; CTC chr11 5237208 5237229 5237213 5237208 -
aggcttgtaaacccagcacttt

SEQ ID NO: 142145 - DNA, 22 bp, Artificial Sequence
  Synthetic oligonucleotide; CTT chr11 5237202 5237223 5237207 5237202 -
gtaaacccagcactttgggagg

SEQ ID NO: 142146 - DNA, 22 bp, Artificial Sequence
  Synthetic oligonucleotide; TTG chr11 5237201 5237222 5237206 5237201 -
taaacccagcactttgggaggc

SEQ ID NO: 142147 - DNA, 22 bp, Artificial Sequence
  Synthetic oligonucleotide; CTT chr11 5237187 5237208 5237192 5237187 -
tgggaggccaaggcaggcagat

SEQ ID NO: 142148 - DNA, 22 bp, Artificial Sequence
  Synthetic oligonucleotide; TTT chr11 5237186 5237207 5237191 5237186 -
gggaggccaaggcaggcagatc

SEQ ID NO: 142149 - DNA, 22 bp, Artificial Sequence
  Synthetic oligonucleotide; TTG chr11 5237185 5237206 5237190 5237185 -
ggaggccaaggcaggcagatca

SEQ ID NO: 142150 - DNA, 22 bp, Artificial Sequence
  Synthetic oligonucleotide; CTT chr11 5237160 5237181 5237165 5237160 -
gaggtcaggagttcaagaccag

SEQ ID NO: 142151 - DNA, 22 bp, Artificial Sequence
  Synthetic oligonucleotide; TTG chr11 5237159 5237180 5237164 5237159 -
aggtcaggagttcaagaccagc

SEQ ID NO: 142152 - DNA, 22 bp, Artificial Sequence
  Synthetic oligonucleotide; TTC chr11 5237146 5237167 5237151 5237146 -
aagaccagcctgaccaacatgg

SEQ ID NO: 142153 - DNA, 22 bp, Artificial Sequence
  Synthetic oligonucleotide; CTG chr11 5237134 5237155 5237139 5237134 -
accaacatggtgaaaccccatc

SEQ ID NO: 142154 - DNA, 22 bp, Artificial Sequence
  Synthetic oligonucleotide; CTC chr11 5237110 5237131 5237115 5237110 -
tactaaaaatacaaaatcagcc

SEQ ID NO: 142155 - DNA, 22 bp, Artificial Sequence
  Synthetic oligonucleotide; CTA chr11 5237108 5237129 5237113 5237108 -
ctaaaaatacaaaatcagccgg

SEQ ID NO: 142156 - DNA, 22 bp, Artificial Sequence
  Synthetic oligonucleotide; CTA chr11 5237105 5237126 5237110 5237105 -
aaaatacaaaatcagccgggcg

SEQ ID NO: 142157 - DNA, 22 bp, Artificial Sequence
  Synthetic oligonucleotide; CTG chr11 5237068 5237089 5237073 5237068 -
cagtcccagctattcaggtggc

SEQ ID NO: 142158 - DNA, 22 bp, Artificial Sequence
  Synthetic oligonucleotide; CTA chr11 5237056 5237077 5237061 5237056 -
ttcaggtggctgaggcaggaga

SEQ ID NO: 142159 - DNA, 22 bp, Artificial Sequence
  Synthetic oligonucleotide; TTC chr11 5237053 5237074 5237058 5237053 -
aggtggctgaggcaggagaatt

SEQ ID NO: 142160 - DNA, 22 bp, Artificial Sequence
  Synthetic oligonucleotide; CTG chr11 5237044 5237065 5237049 5237044 -
aggcaggagaattgcttgaacc

SEQ ID NO: 142161 - DNA, 22 bp, Artificial Sequence
  Synthetic oligonucleotide; TTG chr11 5237030 5237051 5237035 5237030 -
cttgaacccaggaggcagaggt

SEQ ID NO: 142162 - DNA, 22 bp, Artificial Sequence
  Synthetic oligonucleotide; CTT chr11 5237027 5237048 5237032 5237027 -
gaacccaggaggcagaggttgc

SEQ ID NO: 142163 - DNA, 22 bp, Artificial Sequence
  Synthetic oligonucleotide; TTG chr11 5237026 5237047 5237031 5237026 -
aacccaggaggcagaggttgcg

SEQ ID NO: 142164 - DNA, 22 bp, Artificial Sequence
  Synthetic oligonucleotide; TTG chr11 5237006 5237027 5237011 5237006 -
cggtgagcctagattgcaccat

SEQ ID NO: 142165 - DNA, 22 bp, Artificial Sequence
  Synthetic oligonucleotide; CTA chr11 5236995 5237016 5237000 5236995 -
gattgcaccattgcactctagc

SEQ ID NO: 142166 - DNA, 22 bp, Artificial Sequence
  Synthetic oligonucleotide; TTG chr11 5236990 5237011 5236995 5236990 -
caccattgcactctagcttggg

SEQ ID NO: 142167 - DNA, 22 bp, Artificial Sequence
  Synthetic oligonucleotide; TTG chr11 5236982 5237003 5236987 5236982 -
cactctagcttgggcaataggg

SEQ ID NO: 142168 - DNA, 22 bp, Artificial Sequence
  Synthetic oligonucleotide; CTC chr11 5236977 5236998 5236982 5236977 -
tagcttgggcaatagggatgaa

SEQ ID NO: 142169 - DNA, 22 bp, Artificial Sequence
  Synthetic oligonucleotide; CTA chr11 5236975 5236996 5236980 5236975 -
gcttgggcaatagggatgaaac

SEQ ID NO: 142170 - DNA, 22 bp, Artificial Sequence
  Synthetic oligonucleotide; CTT chr11 5236971 5236992 5236976 5236971 -
gggcaatagggatgaaactcca

SEQ ID NO: 142171 - DNA, 22 bp, Artificial Sequence
  Synthetic oligonucleotide; TTG chr11 5236970 5236991 5236975 5236970 -
ggcaatagggatgaaactccat

SEQ ID NO: 142172 - DNA, 22 bp, Artificial Sequence
  Synthetic oligonucleotide; CTC chr11 5236951 5236972 5236956 5236951 -
catctcagaagagaaaagaaaa

SEQ ID NO: 142173 - DNA, 22 bp, Artificial Sequence
  Synthetic oligonucleotide; CTC chr11 5236945 5236966 5236950 5236945 -
agaagagaaaagaaaaaaagac

SEQ ID NO: 142174 - DNA, 22 bp, Artificial Sequence
  Synthetic oligonucleotide; CTT chr11 5236920 5236941 5236925 5236920 -
attctgttatacaaatcctctc

SEQ ID NO: 142175 - DNA, 22 bp, Artificial Sequence
  Synthetic oligonucleotide; TTA chr11 5236919 5236940 5236924 5236919 -
ttctgttatacaaatcctctca

SEQ ID NO: 142176 - DNA, 22 bp, Artificial Sequence
  Synthetic oligonucleotide; TTC chr11 5236916 5236937 5236921 5236916 -
tgttatacaaatcctctcaatg

SEQ ID NO: 142177 - DNA, 22 bp, Artificial Sequence
  Synthetic oligonucleotide; CTG chr11 5236914 5236935 5236919 5236914 -
ttatacaaatcctctcaatgca

SEQ ID NO: 142178 - DNA, 22 bp, Artificial Sequence
  Synthetic oligonucleotide; TTA chr11 5236911 5236932 5236916 5236911 -
tacaaatcctctcaatgcaatc

SEQ ID NO: 142179 - DNA, 22 bp, Artificial Sequence
  Synthetic oligonucleotide; CTC chr11 5236900 5236921 5236905 5236900 -
tcaatgcaatccatatagaata

SEQ ID NO: 142180 - DNA, 22 bp, Artificial Sequence
  Synthetic oligonucleotide; CTC chr11 5236898 5236919 5236903 5236898 -
aatgcaatccatatagaataaa

SEQ ID NO: 142181 - DNA, 22 bp, Artificial Sequence
  Synthetic oligonucleotide; CTC chr11 5236860 5236881 5236865 5236860 -
ccaatgtgtaaaatcatttcag

SEQ ID NO: 142182 - DNA, 22 bp, Artificial Sequence
  Synthetic oligonucleotide; TTT chr11 5236841 5236862 5236846 5236841 -
caggtagaacagaattaaagtg

SEQ ID NO: 142183 - DNA, 22 bp, Artificial Sequence
  Synthetic oligonucleotide; TTC chr11 5236840 5236861 5236845 5236840 -
aggtagaacagaattaaagtga

SEQ ID NO: 142184 - DNA, 22 bp, Artificial Sequence
  Synthetic oligonucleotide; TTA chr11 5236824 5236845 5236829 5236824 -
aagtgaaaagccaagtctttgg

SEQ ID NO: 142185 - DNA, 22 bp, Artificial Sequence
  Synthetic oligonucleotide; CTT chr11 5236805 5236826 5236810 5236805 -
tggaattaacagacaaagatca

SEQ ID NO: 142186 - DNA, 22 bp, Artificial Sequence
  Synthetic oligonucleotide; TTT chr11 5236804 5236825 5236809 5236804 -
ggaattaacagacaaagatcaa

SEQ ID NO: 142187 - DNA, 22 bp, Artificial Sequence
  Synthetic oligonucleotide; TTG chr11 5236803 5236824 5236808 5236803 -
gaattaacagacaaagatcaaa

SEQ ID NO: 142188 - DNA, 22 bp, Artificial Sequence
  Synthetic oligonucleotide; TTA chr11 5236797 5236818 5236802 5236797 -
acagacaaagatcaaataacag

SEQ ID NO: 142189 - DNA, 22 bp, Artificial Sequence
  Synthetic oligonucleotide; CTC chr11 5236770 5236791 5236775 5236770 -
atggccttaagaatttacctaa

SEQ ID NO: 142190 - DNA, 22 bp, Artificial Sequence
  Synthetic oligonucleotide; CTT chr11 5236762 5236783 5236767 5236762 -
aagaatttacctaacatttttt

SEQ ID NO: 142191 - DNA, 22 bp, Artificial Sequence
  Synthetic oligonucleotide; TTA chr11 5236761 5236782 5236766 5236761 -
agaatttacctaacattttttt

SEQ ID NO: 142192 - DNA, 22 bp, Artificial Sequence
  Synthetic oligonucleotide; TTT chr11 5236754 5236775 5236759 5236754 -
acctaacattttttttagaatc

SEQ ID NO: 142193 - DNA, 22 bp, Artificial Sequence
  Synthetic oligonucleotide; TTA chr11 5236753 5236774 5236758 5236753 -
cctaacattttttttagaatca

SEQ ID NO: 142194 - DNA, 22 bp, Artificial Sequence
  Synthetic oligonucleotide; CTA chr11 5236749 5236770 5236754 5236749 -
acattttttttagaatcaattt

SEQ ID NO: 142195 - DNA, 22 bp, Artificial Sequence
  Synthetic oligonucleotide; TTT chr11 5236743 5236764 5236748 5236743 -
tttttagaatcaattttcttat

SEQ ID NO: 142196 - DNA, 22 bp, Artificial Sequence
  Synthetic oligonucleotide; TTT chr11 5236742 5236763 5236747 5236742 -
ttttagaatcaattttcttata

SEQ ID NO: 142197 - DNA, 22 bp, Artificial Sequence
  Synthetic oligonucleotide; TTT chr11 5236741 5236762 5236746 5236741 -
tttagaatcaattttcttatat

SEQ ID NO: 142198 - DNA, 22 bp, Artificial Sequence
  Synthetic oligonucleotide; TTT chr11 5236740 5236761 5236745 5236740 -
ttagaatcaattttcttatata

SEQ ID NO: 142199 - DNA, 22 bp, Artificial Sequence
  Synthetic oligonucleotide; TTT chr11 5236739 5236760 5236744 5236739 -
tagaatcaattttcttatatat

SEQ ID NO: 142200 - DNA, 22 bp, Artificial Sequence
  Synthetic oligonucleotide; TTT chr11 5236738 5236759 5236743 5236738 -
agaatcaattttcttatatatg

SEQ ID NO: 142201 - DNA, 22 bp, Artificial Sequence
  Synthetic oligonucleotide; TTA chr11 5236737 5236758 5236742 5236737 -
gaatcaattttcttatatatga

SEQ ID NO: 142202 - DNA, 22 bp, Artificial Sequence
  Synthetic oligonucleotide; TTT chr11 5236727 5236748 5236732 5236727 -
tcttatatatgaattggaaaca

SEQ ID NO: 142203 - DNA, 22 bp, Artificial Sequence
  Synthetic oligonucleotide; TTT chr11 5236726 5236747 5236731 5236726 -
cttatatatgaattggaaacat

SEQ ID NO: 142204 - DNA, 22 bp, Artificial Sequence
  Synthetic oligonucleotide; TTC chr11 5236725 5236746 5236730 5236725 -
ttatatatgaattggaaacata

SEQ ID NO: 142205 - DNA, 22 bp, Artificial Sequence
  Synthetic oligonucleotide; CTT chr11 5236723 5236744 5236728 5236723 -
atatatgaattggaaacataat

SEQ ID NO: 142206 - DNA, 22 bp, Artificial Sequence
  Synthetic oligonucleotide; TTA chr11 5236722 5236743 5236727 5236722 -
tatatgaattggaaacataatt

SEQ ID NO: 142207 - DNA, 22 bp, Artificial Sequence
  Synthetic oligonucleotide; TTG chr11 5236711 5236732 5236716 5236711 -
gaaacataattcctccctcaca

SEQ ID NO: 142208 - DNA, 22 bp, Artificial Sequence
  Synthetic oligonucleotide; TTC chr11 5236699 5236720 5236704 5236699 -
ctccctcacaaacacattctaa

SEQ ID NO: 142209 - DNA, 22 bp, Artificial Sequence
  Synthetic oligonucleotide; CTC chr11 5236696 5236717 5236701 5236696 -
cctcacaaacacattctaagat

SEQ ID NO: 142210 - DNA, 22 bp, Artificial Sequence
  Synthetic oligonucleotide; CTC chr11 5236692 5236713 5236697 5236692 -
acaaacacattctaagatttta

SEQ ID NO: 142211 - DNA, 22 bp, Artificial Sequence
  Synthetic oligonucleotide; TTC chr11 5236680 5236701 5236685 5236680 -
taagattttaaggagatattga

SEQ ID NO: 142212 - DNA, 22 bp, Artificial Sequence
  Synthetic oligonucleotide; CTA chr11 5236678 5236699 5236683 5236678 -
agattttaaggagatattgatg

SEQ ID NO: 142213 - DNA, 22 bp, Artificial Sequence
  Synthetic oligonucleotide; TTT chr11 5236672 5236693 5236677 5236672 -
taaggagatattgatgaagtac

SEQ ID NO: 142214 - DNA, 22 bp, Artificial Sequence
  Synthetic oligonucleotide; TTT chr11 5236671 5236692 5236676 5236671 -
aaggagatattgatgaagtaca

SEQ ID NO: 142215 - DNA, 22 bp, Artificial Sequence
  Synthetic oligonucleotide; TTA chr11 5236670 5236691 5236675 5236670 -
aggagatattgatgaagtacat

SEQ ID NO: 142216 - DNA, 22 bp, Artificial Sequence
  Synthetic oligonucleotide; TTG chr11 5236659 5236680 5236664 5236659 -
atgaagtacatcatctgtcatt

SEQ ID NO: 142217 - DNA, 22 bp, Artificial Sequence
  Synthetic oligonucleotide; CTG chr11 5236642 5236663 5236647 5236642 -
tcatttttaacaggtagtggta

SEQ ID NO: 142218 - DNA, 22 bp, Artificial Sequence
  Synthetic oligonucleotide; TTT chr11 5236636 5236657 5236641 5236636 -
ttaacaggtagtggtagtgatt

SEQ ID NO: 142219 - DNA, 22 bp, Artificial Sequence
  Synthetic oligonucleotide; TTT chr11 5236635 5236656 5236640 5236635 -
taacaggtagtggtagtgattc

SEQ ID NO: 142220 - DNA, 22 bp, Artificial Sequence
  Synthetic oligonucleotide; TTT chr11 5236634 5236655 5236639 5236634 -
aacaggtagtggtagtgattca

SEQ ID NO: 142221 - DNA, 22 bp, Artificial Sequence
  Synthetic oligonucleotide; TTA chr11 5236633 5236654 5236638 5236633 -
acaggtagtggtagtgattcac

SEQ ID NO: 142222 - DNA, 22 bp, Artificial Sequence
  Synthetic oligonucleotide; TTC chr11 5236613 5236634 5236618 5236613 -
acacagcacattatgatctgtt

SEQ ID NO: 142223 - DNA, 22 bp, Artificial Sequence
  Synthetic oligonucleotide; TTA chr11 5236600 5236621 5236605 5236600 -
tgatctgttcttgtatgttctg

SEQ ID NO: 142224 - DNA, 22 bp, Artificial Sequence
  Synthetic oligonucleotide; CTG chr11 5236593 5236614 5236598 5236593 -
ttcttgtatgttctgttccatt

SEQ ID NO: 142225 - DNA, 22 bp, Artificial Sequence
  Synthetic oligonucleotide; TTC chr11 5236590 5236611 5236595 5236590 -
ttgtatgttctgttccattctg

SEQ ID NO: 142226 - DNA, 22 bp, Artificial Sequence
  Synthetic oligonucleotide; CTT chr11 5236588 5236609 5236593 5236588 -
gtatgttctgttccattctgta

SEQ ID NO: 142227 - DNA, 22 bp, Artificial Sequence
  Synthetic oligonucleotide; TTG chr11 5236587 5236608 5236592 5236587 -
tatgttctgttccattctgtat

SEQ ID NO: 142228 - DNA, 22 bp, Artificial Sequence
  Synthetic oligonucleotide; TTC chr11 5236580 5236601 5236585 5236580 -
tgttccattctgtattcttgac

SEQ ID NO: 142229 - DNA, 22 bp, Artificial Sequence
  Synthetic oligonucleotide; CTG chr11 5236578 5236599 5236583 5236578 -
ttccattctgtattcttgacct

SEQ ID NO: 142230 - DNA, 22 bp, Artificial Sequence
  Synthetic oligonucleotide; TTC chr11 5236575 5236596 5236580 5236575 -
cattctgtattcttgacctggt

SEQ ID NO: 142231 - DNA, 22 bp, Artificial Sequence
  Synthetic oligonucleotide; TTC chr11 5236570 5236591 5236575 5236570 -
tgtattcttgacctggttgtat

SEQ ID NO: 142232 - DNA, 22 bp, Artificial Sequence
  Synthetic oligonucleotide; CTG chr11 5236568 5236589 5236573 5236568 -
tattcttgacctggttgtattc

SEQ ID NO: 142233 - DNA, 22 bp, Artificial Sequence
  Synthetic oligonucleotide; TTC chr11 5236563 5236584 5236568 5236563 -
ttgacctggttgtattctttct

SEQ ID NO: 142234 - DNA, 22 bp, Artificial Sequence
  Synthetic oligonucleotide; CTT chr11 5236561 5236582 5236566 5236561 -
gacctggttgtattctttctga

SEQ ID NO: 142235 - DNA, 22 bp, Artificial Sequence
  Synthetic oligonucleotide; TTG chr11 5236560 5236581 5236565 5236560 -
acctggttgtattctttctgag

SEQ ID NO: 142236 - DNA, 22 bp, Artificial Sequence
  Synthetic oligonucleotide; CTG chr11 5236555 5236576 5236560 5236555 -
gttgtattctttctgagctcca

SEQ ID NO: 142237 - DNA, 22 bp, Artificial Sequence
  Synthetic oligonucleotide; TTG chr11 5236551 5236572 5236556 5236551 -
tattctttctgagctccagatc

SEQ ID NO: 142238 - DNA, 22 bp, Artificial Sequence
  Synthetic oligonucleotide; TTC chr11 5236546 5236567 5236551 5236546 -
tttctgagctccagatccacat

SEQ ID NO: 142239 - DNA, 22 bp, Artificial Sequence
  Synthetic oligonucleotide; CTT chr11 5236544 5236565 5236549 5236544 -
tctgagctccagatccacatat

SEQ ID NO: 142240 - DNA, 22 bp, Artificial Sequence
  Synthetic oligonucleotide; TTT chr11 5236543 5236564 5236548 5236543 -
ctgagctccagatccacatatc

SEQ ID NO: 142241 - DNA, 22 bp, Artificial Sequence
  Synthetic oligonucleotide; TTC chr11 5236542 5236563 5236547 5236542 -
tgagctccagatccacatatct

SEQ ID NO: 142242 - DNA, 22 bp, Artificial Sequence
  Synthetic oligonucleotide; CTG chr11 5236540 5236561 5236545 5236540 -
agctccagatccacatatctaa

SEQ ID NO: 142243 - DNA, 22 bp, Artificial Sequence
  Synthetic oligonucleotide; CTC chr11 5236535 5236556 5236540 5236535 -
cagatccacatatctaagtaca

SEQ ID NO: 142244 - DNA, 22 bp, Artificial Sequence
  Synthetic oligonucleotide; CTA chr11 5236519 5236540 5236524 5236519 -
agtacatctttttgcattttac

SEQ ID NO: 142245 - DNA, 22 bp, Artificial Sequence
  Synthetic oligonucleotide; CTT chr11 5236509 5236530 5236514 5236509 -
tttgcattttacaagagtgcat

SEQ ID NO: 142246 - DNA, 22 bp, Artificial Sequence
  Synthetic oligonucleotide; TTT chr11 5236508 5236529 5236513 5236508 -
ttgcattttacaagagtgcata

SEQ ID NO: 142247 - DNA, 22 bp, Artificial Sequence
  Synthetic oligonucleotide; TTT chr11 5236507 5236528 5236512 5236507 -
tgcattttacaagagtgcatac

SEQ ID NO: 142248 - DNA, 22 bp, Artificial Sequence
  Synthetic oligonucleotide; TTT chr11 5236506 5236527 5236511 5236506 -
gcattttacaagagtgcataca

SEQ ID NO: 142249 - DNA, 22 bp, Artificial Sequence
  Synthetic oligonucleotide; TTG chr11 5236505 5236526 5236510 5236505 -
cattttacaagagtgcatacaa

SEQ ID NO: 142250 - DNA, 22 bp, Artificial Sequence
  Synthetic oligonucleotide; TTT chr11 5236500 5236521 5236505 5236500 -
tacaagagtgcatacaatacaa

SEQ ID NO: 142251 - DNA, 22 bp, Artificial Sequence
  Synthetic oligonucleotide; TTT chr11 5236499 5236520 5236504 5236499 -
acaagagtgcatacaatacaat

SEQ ID NO: 142252 - DNA, 22 bp, Artificial Sequence
  Synthetic oligonucleotide; TTA chr11 5236498 5236519 5236503 5236498 -
caagagtgcatacaatacaatg

SEQ ID NO: 142253 - DNA, 22 bp, Artificial Sequence
  Synthetic oligonucleotide; CTG chr11 5236464 5236485 5236469 5236464 -
tatttctgattttatcgtacca

SEQ ID NO: 142254 - DNA, 22 bp, Artificial Sequence
  Synthetic oligonucleotide; TTT chr11 5236459 5236480 5236464 5236459 -
ctgattttatcgtaccactaaa

SEQ ID NO: 142255 - DNA, 22 bp, Artificial Sequence
  Synthetic oligonucleotide; TTC chr11 5236458 5236479 5236463 5236458 -
tgattttatcgtaccactaaac

SEQ ID NO: 142256 - DNA, 22 bp, Artificial Sequence
  Synthetic oligonucleotide; CTG chr11 5236456 5236477 5236461 5236456 -
attttatcgtaccactaaactc

SEQ ID NO: 142257 - DNA, 22 bp, Artificial Sequence
  Synthetic oligonucleotide; TTT chr11 5236452 5236473 5236457 5236452 -
tatcgtaccactaaactcacaa

SEQ ID NO: 142258 - DNA, 22 bp, Artificial Sequence
  Synthetic oligonucleotide; TTT chr11 5236451 5236472 5236456 5236451 -
atcgtaccactaaactcacaaa

SEQ ID NO: 142259 - DNA, 22 bp, Artificial Sequence
  Synthetic oligonucleotide; TTA chr11 5236450 5236471 5236455 5236450 -
tcgtaccactaaactcacaaat

SEQ ID NO: 142260 - DNA, 22 bp, Artificial Sequence
  Synthetic oligonucleotide; CTA chr11 5236439 5236460 5236444 5236439 -
aactcacaaatgtggccctatt

SEQ ID NO: 142261 - DNA, 22 bp, Artificial Sequence
  Synthetic oligonucleotide; CTC chr11 5236434 5236455 5236439 5236434 -
acaaatgtggccctattcttgt

SEQ ID NO: 142262 - DNA, 22 bp, Artificial Sequence
  Synthetic oligonucleotide; CTA chr11 5236419 5236440 5236424 5236419 -
ttcttgtgttcacgactgacat

SEQ ID NO: 142263 - DNA, 22 bp, Artificial Sequence
  Synthetic oligonucleotide; TTC chr11 5236416 5236437 5236421 5236416 -
ttgtgttcacgactgacatcac

SEQ ID NO: 142264 - DNA, 22 bp, Artificial Sequence
  Synthetic oligonucleotide; CTT chr11 5236414 5236435 5236419 5236414 -
gtgttcacgactgacatcaccg

SEQ ID NO: 142265 - DNA, 22 bp, Artificial Sequence
  Synthetic oligonucleotide; TTG chr11 5236413 5236434 5236418 5236413 -
tgttcacgactgacatcaccgt

SEQ ID NO: 142266 - DNA, 22 bp, Artificial Sequence
  Synthetic oligonucleotide; TTC chr11 5236408 5236429 5236413 5236408 -
acgactgacatcaccgtcatgg

SEQ ID NO: 142267 - DNA, 22 bp, Artificial Sequence
  Synthetic oligonucleotide; CTG chr11 5236401 5236422 5236406 5236401 -
acatcaccgtcatggtccaagt

SEQ ID NO: 142268 - DNA, 22 bp, Artificial Sequence
  Synthetic oligonucleotide; CTG chr11 5236376 5236397 5236381 5236376 -
ataatagaaatggcattgtcac

SEQ ID NO: 142269 - DNA, 22 bp, Artificial Sequence
  Synthetic oligonucleotide; TTG chr11 5236358 5236379 5236363 5236358 -
tcactttcttccctactgcaac

SEQ ID NO: 142270 - DNA, 22 bp, Artificial Sequence
  Synthetic oligonucleotide; CTT chr11 5236352 5236373 5236357 5236352 -
tcttccctactgcaacagaagc

SEQ ID NO: 142271 - DNA, 22 bp, Artificial Sequence
  Synthetic oligonucleotide; TTT chr11 5236351 5236372 5236356 5236351 -
cttccctactgcaacagaagcc

SEQ ID NO: 142272 - DNA, 22 bp, Artificial Sequence
  Synthetic oligonucleotide; TTC chr11 5236350 5236371 5236355 5236350 -
ttccctactgcaacagaagccc

SEQ ID NO: 142273 - DNA, 22 bp, Artificial Sequence
  Synthetic oligonucleotide; CTT chr11 5236348 5236369 5236353 5236348 -
ccctactgcaacagaagcccag

SEQ ID NO: 142274 - DNA, 22 bp, Artificial Sequence
  Synthetic oligonucleotide; TTC chr11 5236347 5236368 5236352 5236347 -
cctactgcaacagaagcccagc

SEQ ID NO: 142275 - DNA, 22 bp, Artificial Sequence
  Synthetic oligonucleotide; CTA chr11 5236343 5236364 5236348 5236343 -
ctgcaacagaagcccagctatt

SEQ ID NO: 142276 - DNA, 22 bp, Artificial Sequence
  Synthetic oligonucleotide; CTG chr11 5236340 5236361 5236345 5236340 -
caacagaagcccagctatttgt

SEQ ID NO: 142277 - DNA, 22 bp, Artificial Sequence
  Synthetic oligonucleotide; CTA chr11 5236323 5236344 5236328 5236323 -
tttgtctcccattttctctact

SEQ ID NO: 142278 - DNA, 22 bp, Artificial Sequence
  Synthetic oligonucleotide; TTT chr11 5236320 5236341 5236325 5236320 -
gtctcccattttctctacttct

SEQ ID NO: 142279 - DNA, 22 bp, Artificial Sequence
  Synthetic oligonucleotide; TTG chr11 5236319 5236340 5236324 5236319 -
tctcccattttctctacttcta

SEQ ID NO: 142280 - DNA, 22 bp, Artificial Sequence
  Synthetic oligonucleotide; CTC chr11 5236315 5236336 5236320 5236315 -
ccattttctctacttctaaaat

SEQ ID NO: 142281 - DNA, 22 bp, Artificial Sequence
  Synthetic oligonucleotide; TTT chr11 5236309 5236330 5236314 5236309 -
tctctacttctaaaatacattt

SEQ ID NO: 142282 - DNA, 22 bp, Artificial Sequence
  Synthetic oligonucleotide; TTT chr11 5236308 5236329 5236313 5236308 -
ctctacttctaaaatacatttc

SEQ ID NO: 142283 - DNA, 22 bp, Artificial Sequence
  Synthetic oligonucleotide; TTC chr11 5236307 5236328 5236312 5236307 -
tctacttctaaaatacatttct

SEQ ID NO: 142284 - DNA, 22 bp, Artificial Sequence
  Synthetic oligonucleotide; CTC chr11 5236305 5236326 5236310 5236305 -
tacttctaaaatacatttcttc

SEQ ID NO: 142285 - DNA, 22 bp, Artificial Sequence
  Synthetic oligonucleotide; CTA chr11 5236303 5236324 5236308 5236303 -
cttctaaaatacatttcttcac

SEQ ID NO: 142286 - DNA, 22 bp, Artificial Sequence
  Synthetic oligonucleotide; CTT chr11 5236300 5236321 5236305 5236300 -
ctaaaatacatttcttcactaa

SEQ ID NO: 142287 - DNA, 22 bp, Artificial Sequence
  Synthetic oligonucleotide; TTC chr11 5236299 5236320 5236304 5236299 -
taaaatacatttcttcactaag

SEQ ID NO: 142288 - DNA, 22 bp, Artificial Sequence
  Synthetic oligonucleotide; CTA chr11 5236297 5236318 5236302 5236297 -
aaatacatttcttcactaagtg

SEQ ID NO: 142289 - DNA, 22 bp, Artificial Sequence
  Synthetic oligonucleotide; TTT chr11 5236287 5236308 5236292 5236287 -
cttcactaagtgagaataatct

SEQ ID NO: 142290 - DNA, 22 bp, Artificial Sequence
  Synthetic oligonucleotide; TTC chr11 5236286 5236307 5236291 5236286 -
ttcactaagtgagaataatctt

SEQ ID NO: 142291 - DNA, 22 bp, Artificial Sequence
  Synthetic oligonucleotide; CTT chr11 5236284 5236305 5236289 5236284 -
cactaagtgagaataatctttt

SEQ ID NO: 142292 - DNA, 22 bp, Artificial Sequence
  Synthetic oligonucleotide; TTC chr11 5236283 5236304 5236288 5236283 -
actaagtgagaataatctttta

SEQ ID NO: 142293 - DNA, 22 bp, Artificial Sequence
  Synthetic oligonucleotide; CTA chr11 5236279 5236300 5236284 5236279 -
agtgagaataatcttttaaaga

SEQ ID NO: 142294 - DNA, 22 bp, Artificial Sequence
  Synthetic oligonucleotide; CTT chr11 5236264 5236285 5236269 5236264 -
ttaaagacacaaatcaaaccat

SEQ ID NO: 142295 - DNA, 22 bp, Artificial Sequence
  Synthetic oligonucleotide; TTT chr11 5236263 5236284 5236268 5236263 -
taaagacacaaatcaaaccatg

SEQ ID NO: 142296 - DNA, 22 bp, Artificial Sequence
  Synthetic oligonucleotide; TTT chr11 5236262 5236283 5236267 5236262 -
aaagacacaaatcaaaccatgc

SEQ ID NO: 142297 - DNA, 22 bp, Artificial Sequence
  Synthetic oligonucleotide; TTA chr11 5236261 5236282 5236266 5236261 -
aagacacaaatcaaaccatgcc

SEQ ID NO: 142298 - DNA, 22 bp, Artificial Sequence
  Synthetic oligonucleotide; CTT chr11 5236231 5236252 5236236 5236231 -
tcttgaattattcaatatcttt

SEQ ID NO: 142299 - DNA, 22 bp, Artificial Sequence
  Synthetic oligonucleotide; TTT chr11 5236230 5236251 5236235 5236230 -
cttgaattattcaatatctttc

SEQ ID NO: 142300 - DNA, 22 bp, Artificial Sequence
  Synthetic oligonucleotide; TTC chr11 5236229 5236250 5236234 5236229 -
ttgaattattcaatatctttcg

SEQ ID NO: 142301 - DNA, 22 bp, Artificial Sequence
  Synthetic oligonucleotide; CTT chr11 5236227 5236248 5236232 5236227 -
gaattattcaatatctttcgtt

SEQ ID NO: 142302 - DNA, 22 bp, Artificial Sequence
  Synthetic oligonucleotide; TTG chr11 5236226 5236247 5236231 5236226 -
aattattcaatatctttcgttg

SEQ ID NO: 142303 - DNA, 22 bp, Artificial Sequence
  Synthetic oligonucleotide; TTA chr11 5236221 5236242 5236226 5236221 -
ttcaatatctttcgttggcttc

SEQ ID NO: 142304 - DNA, 22 bp, Artificial Sequence
  Synthetic oligonucleotide; TTC chr11 5236218 5236239 5236223 5236218 -
aatatctttcgttggcttccag

SEQ ID NO: 142305 - DNA, 22 bp, Artificial Sequence
  Synthetic oligonucleotide; CTT chr11 5236210 5236231 5236215 5236210 -
tcgttggcttccaggttacaga

SEQ ID NO: 142306 - DNA, 22 bp, Artificial Sequence
  Synthetic oligonucleotide; TTT chr11 5236209 5236230 5236214 5236209 -
cgttggcttccaggttacagaa

SEQ ID NO: 142307 - DNA, 22 bp, Artificial Sequence
  Synthetic oligonucleotide; TTC chr11 5236208 5236229 5236213 5236208 -
gttggcttccaggttacagaaa

SEQ ID NO: 142308 - DNA, 22 bp, Artificial Sequence
  Synthetic oligonucleotide; TTG chr11 5236204 5236225 5236209 5236204 -
gcttccaggttacagaaaaata

SEQ ID NO: 142309 - DNA, 22 bp, Artificial Sequence
  Synthetic oligonucleotide; CTT chr11 5236200 5236221 5236205 5236200 -
ccaggttacagaaaaataactt

SEQ ID NO: 142310 - DNA, 22 bp, Artificial Sequence
  Synthetic oligonucleotide; TTC chr11 5236199 5236220 5236204 5236199 -
caggttacagaaaaataacttg

SEQ ID NO: 142311 - DNA, 22 bp, Artificial Sequence
  Synthetic oligonucleotide; TTA chr11 5236192 5236213 5236197 5236192 -
cagaaaaataacttgtaacaaa

SEQ ID NO: 142312 - DNA, 22 bp, Artificial Sequence
  Synthetic oligonucleotide; CTT chr11 5236178 5236199 5236183 5236178 -
gtaacaaagtttaaaggtcatt

SEQ ID NO: 142313 - DNA, 22 bp, Artificial Sequence
  Synthetic oligonucleotide; TTG chr11 5236177 5236198 5236182 5236177 -
taacaaagtttaaaggtcattc

SEQ ID NO: 142314 - DNA, 22 bp, Artificial Sequence
  Synthetic oligonucleotide; TTT chr11 5236166 5236187 5236171 5236166 -
aaaggtcattcatggctcctct

SEQ ID NO: 142315 - DNA, 22 bp, Artificial Sequence
  Synthetic oligonucleotide; TTA chr11 5236165 5236186 5236170 5236165 -
aaggtcattcatggctcctctc

SEQ ID NO: 142316 - DNA, 22 bp, Artificial Sequence
  Synthetic oligonucleotide; TTC chr11 5236155 5236176 5236160 5236155 -
atggctcctctctaccctattt

SEQ ID NO: 142317 - DNA, 22 bp, Artificial Sequence
  Synthetic oligonucleotide; CTC chr11 5236148 5236169 5236153 5236148 -
ctctctaccctattttataaca

SEQ ID NO: 142318 - DNA, 22 bp, Artificial Sequence
  Synthetic oligonucleotide; CTC chr11 5236145 5236166 5236150 5236145 -
tctaccctattttataacattt

SEQ ID NO: 142319 - DNA, 22 bp, Artificial Sequence
  Synthetic oligonucleotide; CTC chr11 5236143 5236164 5236148 5236143 -
taccctattttataacatttcc

SEQ ID NO: 142320 - DNA, 22 bp, Artificial Sequence
  Synthetic oligonucleotide; CTA chr11 5236141 5236162 5236146 5236141 -
ccctattttataacatttcccc

SEQ ID NO: 142321 - DNA, 22 bp, Artificial Sequence
  Synthetic oligonucleotide; CTA chr11 5236136 5236157 5236141 5236136 -
ttttataacatttccccttgtg

SEQ ID NO: 142322 - DNA, 22 bp, Artificial Sequence
  Synthetic oligonucleotide; TTT chr11 5236133 5236154 5236138 5236133 -
tataacatttccccttgtgatc

SEQ ID NO: 142323 - DNA, 22 bp, Artificial Sequence
  Synthetic oligonucleotide; TTT chr11 5236132 5236153 5236137 5236132 -
ataacatttccccttgtgatca

SEQ ID NO: 142324 - DNA, 22 bp, Artificial Sequence
  Synthetic oligonucleotide; TTA chr11 5236131 5236152 5236136 5236131 -
taacatttccccttgtgatcag

SEQ ID NO: 142325 - DNA, 22 bp, Artificial Sequence
  Synthetic oligonucleotide; TTT chr11 5236123 5236144 5236128 5236123 -
ccccttgtgatcagaatctcag

SEQ ID NO: 142326 - DNA, 22 bp, Artificial Sequence
  Synthetic oligonucleotide; TTC chr11 5236122 5236143 5236127 5236122 -
cccttgtgatcagaatctcagg

SEQ ID NO: 142327 - DNA, 22 bp, Artificial Sequence
  Synthetic oligonucleotide; CTT chr11 5236117 5236138 5236122 5236117 -
gtgatcagaatctcaggcacat

SEQ ID NO: 142328 - DNA, 22 bp, Artificial Sequence
  Synthetic oligonucleotide; TTG chr11 5236116 5236137 5236121 5236116 -
tgatcagaatctcaggcacatc

SEQ ID NO: 142329 - DNA, 22 bp, Artificial Sequence
  Synthetic oligonucleotide; CTC chr11 5236103 5236124 5236108 5236103 -
aggcacatcatccatctttcta

SEQ ID NO: 142330 - DNA, 22 bp, Artificial Sequence
  Synthetic oligonucleotide; CTT chr11 5236085 5236106 5236090 5236085 -
tctatatacaaataaagtcata

SEQ ID NO: 142331 - DNA, 22 bp, Artificial Sequence
  Synthetic oligonucleotide; TTT chr11 5236084 5236105 5236089 5236084 -
ctatatacaaataaagtcatat

SEQ ID NO: 142332 - DNA, 22 bp, Artificial Sequence
  Synthetic oligonucleotide; TTC chr11 5236083 5236104 5236088 5236083 -
tatatacaaataaagtcatata

SEQ ID NO: 142333 - DNA, 22 bp, Artificial Sequence
  Synthetic oligonucleotide; CTA chr11 5236081 5236102 5236086 5236081 -
tatacaaataaagtcatatagt

SEQ ID NO: 142334 - DNA, 22 bp, Artificial Sequence
  Synthetic oligonucleotide; TTT chr11 5236057 5236078 5236062 5236057 -
gaactcacctctggttactttt

SEQ ID NO: 142335 - DNA, 22 bp, Artificial Sequence
  Synthetic oligonucleotide; TTG chr11 5236056 5236077 5236061 5236056 -
aactcacctctggttactttta

SEQ ID NO: 142336 - DNA, 22 bp, Artificial Sequence
  Synthetic oligonucleotide; CTC chr11 5236051 5236072 5236056 5236051 -
acctctggttacttttaatcaa

SEQ ID NO: 142337 - DNA, 22 bp, Artificial Sequence
  Synthetic oligonucleotide; CTC chr11 5236046 5236067 5236051 5236046 -
tggttacttttaatcaaccaaa

SEQ ID NO: 142338 - DNA, 22 bp, Artificial Sequence
  Synthetic oligonucleotide; CTG chr11 5236044 5236065 5236049 5236044 -
gttacttttaatcaaccaaatg

SEQ ID NO: 142339 - DNA, 22 bp, Artificial Sequence
  Synthetic oligonucleotide; TTA chr11 5236040 5236061 5236045 5236040 -
cttttaatcaaccaaatgctgt

SEQ ID NO: 142340 - DNA, 22 bp, Artificial Sequence
  Synthetic oligonucleotide; CTT chr11 5236037 5236058 5236042 5236037 -
ttaatcaaccaaatgctgtaaa

SEQ ID NO: 142341 - DNA, 22 bp, Artificial Sequence
  Synthetic oligonucleotide; TTT chr11 5236036 5236057 5236041 5236036 -
taatcaaccaaatgctgtaaaa

SEQ ID NO: 142342 - DNA, 22 bp, Artificial Sequence
  Synthetic oligonucleotide; TTT chr11 5236035 5236056 5236040 5236035 -
aatcaaccaaatgctgtaaaat

SEQ ID NO: 142343 - DNA, 22 bp, Artificial Sequence
  Synthetic oligonucleotide; TTA chr11 5236034 5236055 5236039 5236034 -
atcaaccaaatgctgtaaaatg

SEQ ID NO: 142344 - DNA, 22 bp, Artificial Sequence
  Synthetic oligonucleotide; CTG chr11 5236019 5236040 5236024 5236019 -
taaaatgcatttgtatcgctac

SEQ ID NO: 142345 - DNA, 22 bp, Artificial Sequence
  Synthetic oligonucleotide; TTT chr11 5236007 5236028 5236012 5236007 -
gtatcgctacgtgttaagcagt

SEQ ID NO: 142346 - DNA, 22 bp, Artificial Sequence
  Synthetic oligonucleotide; TTG chr11 5236006 5236027 5236011 5236006 -
tatcgctacgtgttaagcagta

SEQ ID NO: 142347 - DNA, 22 bp, Artificial Sequence
  Synthetic oligonucleotide; CTA chr11 5235998 5236019 5236003 5235998 -
cgtgttaagcagtagttgattc

SEQ ID NO: 142348 - DNA, 22 bp, Artificial Sequence
  Synthetic oligonucleotide; TTA chr11 5235991 5236012 5235996 5235991 -
agcagtagttgattcttttcat

SEQ ID NO: 142349 - DNA, 22 bp, Artificial Sequence
  Synthetic oligonucleotide; TTG chr11 5235980 5236001 5235985 5235980 -
attcttttcatttctgtgtaat

SEQ ID NO: 142350 - DNA, 22 bp, Artificial Sequence
  Synthetic oligonucleotide; TTC chr11 5235976 5235997 5235981 5235976 -
ttttcatttctgtgtaatattc

SEQ ID NO: 142351 - DNA, 22 bp, Artificial Sequence
  Synthetic oligonucleotide; CTT chr11 5235974 5235995 5235979 5235974 -
ttcatttctgtgtaatattcta

SEQ ID NO: 142352 - DNA, 22 bp, Artificial Sequence
  Synthetic oligonucleotide; TTT chr11 5235973 5235994 5235978 5235973 -
tcatttctgtgtaatattctat

SEQ ID NO: 142353 - DNA, 22 bp, Artificial Sequence
  Synthetic oligonucleotide; TTT chr11 5235972 5235993 5235977 5235972 -
catttctgtgtaatattctatt

SEQ ID NO: 142354 - DNA, 22 bp, Artificial Sequence
  Synthetic oligonucleotide; TTC chr11 5235971 5235992 5235976 5235971 -
atttctgtgtaatattctattc

SEQ ID NO: 142355 - DNA, 22 bp, Artificial Sequence
  Synthetic oligonucleotide; TTT chr11 5235967 5235988 5235972 5235967 -
ctgtgtaatattctattctttg

SEQ ID NO: 142356 - DNA, 22 bp, Artificial Sequence
  Synthetic oligonucleotide; TTC chr11 5235966 5235987 5235971 5235966 -
tgtgtaatattctattctttga

SEQ ID NO: 142357 - DNA, 22 bp, Artificial Sequence
  Synthetic oligonucleotide; CTG chr11 5235964 5235985 5235969 5235964 -
tgtaatattctattctttgact

SEQ ID NO: 142358 - DNA, 22 bp, Artificial Sequence
  Synthetic oligonucleotide; TTC chr11 5235954 5235975 5235959 5235954 -
tattctttgactataccgtaat

SEQ ID NO: 142359 - DNA, 22 bp, Artificial Sequence
  Synthetic oligonucleotide; CTA chr11 5235952 5235973 5235957 5235952 -
ttctttgactataccgtaattt

SEQ ID NO: 142360 - DNA, 22 bp, Artificial Sequence
  Synthetic oligonucleotide; TTC chr11 5235949 5235970 5235954 5235949 -
tttgactataccgtaatttatc

SEQ ID NO: 142361 - DNA, 22 bp, Artificial Sequence
  Synthetic oligonucleotide; CTT chr11 5235947 5235968 5235952 5235947 -
tgactataccgtaatttatcaa

SEQ ID NO: 142362 - DNA, 22 bp, Artificial Sequence
  Synthetic oligonucleotide; TTT chr11 5235946 5235967 5235951 5235946 -
gactataccgtaatttatcaat

SEQ ID NO: 142363 - DNA, 22 bp, Artificial Sequence
  Synthetic oligonucleotide; TTG chr11 5235945 5235966 5235950 5235945 -
actataccgtaatttatcaatt

SEQ ID NO: 142364 - DNA, 22 bp, Artificial Sequence
  Synthetic oligonucleotide; CTA chr11 5235941 5235962 5235946 5235941 -
taccgtaatttatcaattctac

SEQ ID NO: 142365 - DNA, 22 bp, Artificial Sequence
  Synthetic oligonucleotide; TTT chr11 5235930 5235951 5235935 5235930 -
atcaattctactgttggtaagc

SEQ ID NO: 142366 - DNA, 22 bp, Artificial Sequence
  Synthetic oligonucleotide; TTA chr11 5235929 5235950 5235934 5235929 -
tcaattctactgttggtaagca

SEQ ID NO: 142367 - DNA, 22 bp, Artificial Sequence
  Synthetic oligonucleotide; TTC chr11 5235922 5235943 5235927 5235922 -
tactgttggtaagcatttaagt

SEQ ID NO: 142368 - DNA, 22 bp, Artificial Sequence
  Synthetic oligonucleotide; CTA chr11 5235920 5235941 5235925 5235920 -
ctgttggtaagcatttaagtgg

SEQ ID NO: 142369 - DNA, 22 bp, Artificial Sequence
  Synthetic oligonucleotide; CTG chr11 5235917 5235938 5235922 5235917 -
ttggtaagcatttaagtggcta

SEQ ID NO: 142370 - DNA, 22 bp, Artificial Sequence
  Synthetic oligonucleotide; TTG chr11 5235914 5235935 5235919 5235914 -
gtaagcatttaagtggctaccg

SEQ ID NO: 142371 - DNA, 22 bp, Artificial Sequence
  Synthetic oligonucleotide; TTT chr11 5235904 5235925 5235909 5235904 -
aagtggctaccggtttgaggtt

SEQ ID NO: 142372 - DNA, 22 bp, Artificial Sequence
  Synthetic oligonucleotide; TTA chr11 5235903 5235924 5235908 5235903 -
agtggctaccggtttgaggttt

SEQ ID NO: 142373 - DNA, 22 bp, Artificial Sequence
  Synthetic oligonucleotide; CTA chr11 5235895 5235916 5235900 5235895 -
ccggtttgaggtttttatgatt

SEQ ID NO: 142374 - DNA, 22 bp, Artificial Sequence
  Synthetic oligonucleotide; TTT chr11 5235888 5235909 5235893 5235888 -
gaggtttttatgattattgctg

SEQ ID NO: 142375 - DNA, 22 bp, Artificial Sequence
  Synthetic oligonucleotide; TTG chr11 5235887 5235908 5235892 5235887 -
aggtttttatgattattgctgt

SEQ ID NO: 142376 - DNA, 22 bp, Artificial Sequence
  Synthetic oligonucleotide; TTT chr11 5235881 5235902 5235886 5235881 -
ttatgattattgctgtcataag

SEQ ID NO: 142377 - DNA, 22 bp, Artificial Sequence
  Synthetic oligonucleotide; TTT chr11 5235880 5235901 5235885 5235880 -
tatgattattgctgtcataagc

SEQ ID NO: 142378 - DNA, 22 bp, Artificial Sequence
  Synthetic oligonucleotide; TTT chr11 5235879 5235900 5235884 5235879 -
atgattattgctgtcataagca

SEQ ID NO: 142379 - DNA, 22 bp, Artificial Sequence
  Synthetic oligonucleotide; TTA chr11 5235878 5235899 5235883 5235878 -
tgattattgctgtcataagcat

SEQ ID NO: 142380 - DNA, 22 bp, Artificial Sequence
  Synthetic oligonucleotide; TTA chr11 5235872 5235893 5235877 5235872 -
ttgctgtcataagcatttctat

SEQ ID NO: 142381 - DNA, 22 bp, Artificial Sequence
  Synthetic oligonucleotide; TTG chr11 5235869 5235890 5235874 5235869 -
ctgtcataagcatttctataca

SEQ ID NO: 142382 - DNA, 22 bp, Artificial Sequence
  Synthetic oligonucleotide; CTG chr11 5235866 5235887 5235871 5235866 -
tcataagcatttctatacatgt

SEQ ID NO: 142383 - DNA, 22 bp, Artificial Sequence
  Synthetic oligonucleotide; TTT chr11 5235854 5235875 5235859 5235854 -
ctatacatgtctttggatacac

SEQ ID NO: 142384 - DNA, 22 bp, Artificial Sequence
  Synthetic oligonucleotide; TTC chr11 5235853 5235874 5235858 5235853 -
tatacatgtctttggatacaca

SEQ ID NO: 142385 - DNA, 22 bp, Artificial Sequence
  Synthetic oligonucleotide; CTA chr11 5235851 5235872 5235856 5235851 -
tacatgtctttggatacacaca

SEQ ID NO: 142386 - DNA, 22 bp, Artificial Sequence
  Synthetic oligonucleotide; CTT chr11 5235841 5235862 5235846 5235841 -
tggatacacacatgcatgtgtt

SEQ ID NO: 142387 - DNA, 22 bp, Artificial Sequence
  Synthetic oligonucleotide; TTT chr11 5235840 5235861 5235845 5235840 -
ggatacacacatgcatgtgttt

SEQ ID NO: 142388 - DNA, 22 bp, Artificial Sequence
  Synthetic oligonucleotide; TTG chr11 5235839 5235860 5235844 5235839 -
gatacacacatgcatgtgtttc

SEQ ID NO: 142389 - DNA, 22 bp, Artificial Sequence
  Synthetic oligonucleotide; TTT chr11 5235818 5235839 5235823 5235818 -
ctgaatatctaaaaatgtaatt

SEQ ID NO: 142390 - DNA, 22 bp, Artificial Sequence
  Synthetic oligonucleotide; TTC chr11 5235817 5235838 5235822 5235817 -
tgaatatctaaaaatgtaattg

SEQ ID NO: 142391 - DNA, 22 bp, Artificial Sequence
  Synthetic oligonucleotide; CTG chr11 5235815 5235836 5235820 5235815 -
aatatctaaaaatgtaattgct

SEQ ID NO: 142392 - DNA, 22 bp, Artificial Sequence
  Synthetic oligonucleotide; CTA chr11 5235807 5235828 5235812 5235807 -
aaaatgtaattgctaggtaata

SEQ ID NO: 142393 - DNA, 22 bp, Artificial Sequence
  Synthetic oligonucleotide; TTG chr11 5235795 5235816 5235800 5235795 -
ctaggtaatagacttatcaagc

SEQ ID NO: 142394 - DNA, 22 bp, Artificial Sequence
  Synthetic oligonucleotide; CTA chr11 5235792 5235813 5235797 5235792 -
ggtaatagacttatcaagcatc

SEQ ID NO: 142395 - DNA, 22 bp, Artificial Sequence
  Synthetic oligonucleotide; CTT chr11 5235780 5235801 5235785 5235780 -
atcaagcatccagcatttgtgg

SEQ ID NO: 142396 - DNA, 22 bp, Artificial Sequence
  Synthetic oligonucleotide; TTA chr11 5235779 5235800 5235784 5235779 -
tcaagcatccagcatttgtgga

SEQ ID NO: 142397 - DNA, 22 bp, Artificial Sequence
  Synthetic oligonucleotide; TTT chr11 5235762 5235783 5235767 5235762 -
gtggatactattaaaggttttc

SEQ ID NO: 142398 - DNA, 22 bp, Artificial Sequence
  Synthetic oligonucleotide; TTG chr11 5235761 5235782 5235766 5235761 -
tggatactattaaaggttttcc

SEQ ID NO: 142399 - DNA, 22 bp, Artificial Sequence
  Synthetic oligonucleotide; CTA chr11 5235752 5235773 5235757 5235752 -
ttaaaggttttccaaaggggtt

SEQ ID NO: 142400 - DNA, 22 bp, Artificial Sequence
  Synthetic oligonucleotide; TTA chr11 5235749 5235770 5235754 5235749 -
aaggttttccaaaggggttata

SEQ ID NO: 142401 - DNA, 22 bp, Artificial Sequence
  Synthetic oligonucleotide; TTT chr11 5235742 5235763 5235747 5235742 -
tccaaaggggttatactattgt

SEQ ID NO: 142402 - DNA, 22 bp, Artificial Sequence
  Synthetic oligonucleotide; TTT chr11 5235741 5235762 5235746 5235741 -
ccaaaggggttatactattgta

SEQ ID NO: 142403 - DNA, 22 bp, Artificial Sequence
  Synthetic oligonucleotide; TTC chr11 5235740 5235761 5235745 5235740 -
caaaggggttatactattgtac

SEQ ID NO: 142404 - DNA, 22 bp, Artificial Sequence
  Synthetic oligonucleotide; TTA chr11 5235729 5235750 5235734 5235729 -
tactattgtacagtgtcaccaa

SEQ ID NO: 142405 - DNA, 22 bp, Artificial Sequence
  Synthetic oligonucleotide; CTA chr11 5235724 5235745 5235729 5235724 -
ttgtacagtgtcaccaacagag

SEQ ID NO: 142406 - DNA, 22 bp, Artificial Sequence
  Synthetic oligonucleotide; TTG chr11 5235721 5235742 5235726 5235721 -
tacagtgtcaccaacagagttt

SEQ ID NO: 142407 - DNA, 22 bp, Artificial Sequence
  Synthetic oligonucleotide; TTT chr11 5235699 5235720 5235704 5235699 -
gagtttctattgatccatatca

SEQ ID NO: 142408 - DNA, 22 bp, Artificial Sequence
  Synthetic oligonucleotide; TTG chr11 5235698 5235719 5235703 5235698 -
agtttctattgatccatatcac

SEQ ID NO: 142409 - DNA, 22 bp, Artificial Sequence
  Synthetic oligonucleotide; TTT chr11 5235693 5235714 5235698 5235693 -
ctattgatccatatcaccacca

SEQ ID NO: 142410 - DNA, 22 bp, Artificial Sequence
  Synthetic oligonucleotide; TTC chr11 5235692 5235713 5235697 5235692 -
tattgatccatatcaccaccaa

SEQ ID NO: 142411 - DNA, 22 bp, Artificial Sequence
  Synthetic oligonucleotide; CTA chr11 5235690 5235711 5235695 5235690 -
ttgatccatatcaccaccaaaa

SEQ ID NO: 142412 - DNA, 22 bp, Artificial Sequence
  Synthetic oligonucleotide; TTG chr11 5235687 5235708 5235692 5235687 -
atccatatcaccaccaaaattt

SEQ ID NO: 142413 - DNA, 22 bp, Artificial Sequence
  Synthetic oligonucleotide; TTT chr11 5235665 5235686 5235670 5235665 -
gaactgtcagtcttatctcttc

SEQ ID NO: 142414 - DNA, 22 bp, Artificial Sequence
  Synthetic oligonucleotide; TTG chr11 5235664 5235685 5235669 5235664 -
aactgtcagtcttatctcttct

SEQ ID NO: 142415 - DNA, 22 bp, Artificial Sequence
  Synthetic oligonucleotide; CTG chr11 5235659 5235680 5235664 5235659 -
tcagtcttatctcttctcttgt

SEQ ID NO: 142416 - DNA, 22 bp, Artificial Sequence
  Synthetic oligonucleotide; CTT chr11 5235651 5235672 5235656 5235651 -
atctcttctcttgtctcttttt

SEQ ID NO: 142417 - DNA, 22 bp, Artificial Sequence
  Synthetic oligonucleotide; TTA chr11 5235650 5235671 5235655 5235650 -
tctcttctcttgtctctttttt

SEQ ID NO: 142418 - DNA, 22 bp, Artificial Sequence
  Synthetic oligonucleotide; CTC chr11 5235646 5235667 5235651 5235646 -
ttctcttgtctcttttttcctc

SEQ ID NO: 142419 - DNA, 22 bp, Artificial Sequence
  Synthetic oligonucleotide; CTT chr11 5235644 5235665 5235649 5235644 -
ctcttgtctcttttttcctctt

SEQ ID NO: 142420 - DNA, 22 bp, Artificial Sequence
  Synthetic oligonucleotide; TTC chr11 5235643 5235664 5235648 5235643 -
tcttgtctcttttttcctcttt

SEQ ID NO: 142421 - DNA, 22 bp, Artificial Sequence
  Synthetic oligonucleotide; CTC chr11 5235641 5235662 5235646 5235641 -
ttgtctcttttttcctcttttt

SEQ ID NO: 142422 - DNA, 22 bp, Artificial Sequence
  Synthetic oligonucleotide; CTT chr11 5235639 5235660 5235644 5235639 -
gtctcttttttcctcttttttt

SEQ ID NO: 142423 - DNA, 22 bp, Artificial Sequence
  Synthetic oligonucleotide; TTG chr11 5235638 5235659 5235643 5235638 -
tctcttttttcctctttttttt

SEQ ID NO: 142424 - DNA, 22 bp, Artificial Sequence
  Synthetic oligonucleotide; CTC chr11 5235634 5235655 5235639 5235634 -
ttttttcctcttttttttcctt

SEQ ID NO: 142425 - DNA, 22 bp, Artificial Sequence
  Synthetic oligonucleotide; CTT chr11 5235632 5235653 5235637 5235632 -
ttttcctcttttttttccttcc

SEQ ID NO: 142426 - DNA, 22 bp, Artificial Sequence
  Synthetic oligonucleotide; TTT chr11 5235631 5235652 5235636 5235631 -
tttcctcttttttttccttccc

SEQ ID NO: 142427 - DNA, 22 bp, Artificial Sequence
  Synthetic oligonucleotide; TTT chr11 5235630 5235651 5235635 5235630 -
ttcctcttttttttccttccct

SEQ ID NO: 142428 - DNA, 22 bp, Artificial Sequence
  Synthetic oligonucleotide; TTT chr11 5235629 5235650 5235634 5235629 -
tcctcttttttttccttccctt

SEQ ID NO: 142429 - DNA, 22 bp, Artificial Sequence
  Synthetic oligonucleotide; TTT chr11 5235628 5235649 5235633 5235628 -
cctcttttttttccttcccttc

SEQ ID NO: 142430 - DNA, 22 bp, Artificial Sequence
  Synthetic oligonucleotide; TTC chr11 5235627 5235648 5235632 5235627 -
ctcttttttttccttcccttcc

SEQ ID NO: 142431 - DNA, 22 bp, Artificial Sequence
  Synthetic oligonucleotide; CTC chr11 5235624 5235645 5235629 5235624 -
ttttttttccttcccttcccct

SEQ ID NO: 142432 - DNA, 22 bp, Artificial Sequence
  Synthetic oligonucleotide; CTT chr11 5235622 5235643 5235627 5235622 -
ttttttccttcccttcccctct

SEQ ID NO: 142433 - DNA, 22 bp, Artificial Sequence
  Synthetic oligonucleotide; TTT chr11 5235621 5235642 5235626 5235621 -
tttttccttcccttcccctctc

SEQ ID NO: 142434 - DNA, 22 bp, Artificial Sequence
  Synthetic oligonucleotide; TTT chr11 5235620 5235641 5235625 5235620 -
ttttccttcccttcccctctct

SEQ ID NO: 142435 - DNA, 22 bp, Artificial Sequence
  Synthetic oligonucleotide; TTT chr11 5235619 5235640 5235624 5235619 -
tttccttcccttcccctctctt

SEQ ID NO: 142436 - DNA, 22 bp, Artificial Sequence
  Synthetic oligonucleotide; TTT chr11 5235618 5235639 5235623 5235618 -
ttccttcccttcccctctcttc

SEQ ID NO: 142437 - DNA, 22 bp, Artificial Sequence
  Synthetic oligonucleotide; TTT chr11 5235617 5235638 5235622 5235617 -
tccttcccttcccctctcttcg

SEQ ID NO: 142438 - DNA, 22 bp, Artificial Sequence
  Synthetic oligonucleotide; TTT chr11 5235616 5235637 5235621 5235616 -
ccttcccttcccctctcttcgt

SEQ ID NO: 142439 - DNA, 22 bp, Artificial Sequence
  Synthetic oligonucleotide; TTC chr11 5235615 5235636 5235620 5235615 -
cttcccttcccctctcttcgtt

SEQ ID NO: 142440 - DNA, 22 bp, Artificial Sequence
  Synthetic oligonucleotide; CTT chr11 5235612 5235633 5235617 5235612 -
cccttcccctctcttcgtttct

SEQ ID NO: 142441 - DNA, 22 bp, Artificial Sequence
  Synthetic oligonucleotide; TTC chr11 5235611 5235632 5235616 5235611 -
ccttcccctctcttcgtttctt

SEQ ID NO: 142442 - DNA, 22 bp, Artificial Sequence
  Synthetic oligonucleotide; CTT chr11 5235607 5235628 5235612 5235607 -
cccctctcttcgtttcttttct

SEQ ID NO: 142443 - DNA, 22 bp, Artificial Sequence
  Synthetic oligonucleotide; TTC chr11 5235606 5235627 5235611 5235606 -
ccctctcttcgtttcttttctc

SEQ ID NO: 142444 - DNA, 22 bp, Artificial Sequence
  Synthetic oligonucleotide; CTC chr11 5235601 5235622 5235606 5235601 -
tcttcgtttcttttctctcctc

SEQ ID NO: 142445 - DNA, 22 bp, Artificial Sequence
  Synthetic oligonucleotide; CTC chr11 5235599 5235620 5235604 5235599 -
ttcgtttcttttctctcctctt

SEQ ID NO: 142446 - DNA, 22 bp, Artificial Sequence
  Synthetic oligonucleotide; CTT chr11 5235597 5235618 5235602 5235597 -
cgtttcttttctctcctcttct

SEQ ID NO: 142447 - DNA, 22 bp, Artificial Sequence
  Synthetic oligonucleotide; TTC chr11 5235596 5235617 5235601 5235596 -
gtttcttttctctcctcttctc

SEQ ID NO: 142448 - DNA, 22 bp, Artificial Sequence
  Synthetic oligonucleotide; TTT chr11 5235592 5235613 5235597 5235592 -
cttttctctcctcttctcttct

SEQ ID NO: 142449 - DNA, 22 bp, Artificial Sequence
  Synthetic oligonucleotide; TTC chr11 5235591 5235612 5235596 5235591 -
ttttctctcctcttctcttctt

SEQ ID NO: 142450 - DNA, 22 bp, Artificial Sequence
  Synthetic oligonucleotide; CTT chr11 5235589 5235610 5235594 5235589 -
ttctctcctcttctcttctttc

SEQ ID NO: 142451 - DNA, 22 bp, Artificial Sequence
  Synthetic oligonucleotide; TTT chr11 5235588 5235609 5235593 5235588 -
tctctcctcttctcttctttcc

SEQ ID NO: 142452 - DNA, 22 bp, Artificial Sequence
  Synthetic oligonucleotide; TTT chr11 5235587 5235608 5235592 5235587 -
ctctcctcttctcttctttcct

SEQ ID NO: 142453 - DNA, 22 bp, Artificial Sequence
  Synthetic oligonucleotide; TTC chr11 5235586 5235607 5235591 5235586 -
tctcctcttctcttctttcctc

SEQ ID NO: 142454 - DNA, 22 bp, Artificial Sequence
  Synthetic oligonucleotide; CTC chr11 5235584 5235605 5235589 5235584 -
tcctcttctcttctttcctctc

SEQ ID NO: 142455 - DNA, 22 bp, Artificial Sequence
  Synthetic oligonucleotide; CTC chr11 5235582 5235603 5235587 5235582 -
ctcttctcttctttcctctctt

SEQ ID NO: 142456 - DNA, 22 bp, Artificial Sequence
  Synthetic oligonucleotide; CTC chr11 5235579 5235600 5235584 5235579 -
ttctcttctttcctctcttccc

SEQ ID NO: 142457 - DNA, 22 bp, Artificial Sequence
  Synthetic oligonucleotide; CTT chr11 5235577 5235598 5235582 5235577 -
ctcttctttcctctcttccctt

SEQ ID NO: 142458 - DNA, 22 bp, Artificial Sequence
  Synthetic oligonucleotide; TTC chr11 5235576 5235597 5235581 5235576 -
tcttctttcctctcttcccttc

SEQ ID NO: 142459 - DNA, 22 bp, Artificial Sequence
  Synthetic oligonucleotide; CTC chr11 5235574 5235595 5235579 5235574 -
ttctttcctctcttcccttccc

SEQ ID NO: 142460 - DNA, 22 bp, Artificial Sequence
  Synthetic oligonucleotide; CTT chr11 5235572 5235593 5235577 5235572 -
ctttcctctcttcccttccctt

SEQ ID NO: 142461 - DNA, 22 bp, Artificial Sequence
  Synthetic oligonucleotide; TTC chr11 5235571 5235592 5235576 5235571 -
tttcctctcttcccttcccttt

SEQ ID NO: 142462 - DNA, 22 bp, Artificial Sequence
  Synthetic oligonucleotide; CTT chr11 5235569 5235590 5235574 5235569 -
tcctctcttcccttccctttct

SEQ ID NO: 142463 - DNA, 22 bp, Artificial Sequence
  Synthetic oligonucleotide; TTT chr11 5235568 5235589 5235573 5235568 -
cctctcttcccttccctttctc

SEQ ID NO: 142464 - DNA, 22 bp, Artificial Sequence
  Synthetic oligonucleotide; TTC chr11 5235567 5235588 5235572 5235567 -
ctctcttcccttccctttctct

SEQ ID NO: 142465 - DNA, 22 bp, Artificial Sequence
  Synthetic oligonucleotide; CTC chr11 5235564 5235585 5235569 5235564 -
tcttcccttccctttctctttc

SEQ ID NO: 142466 - DNA, 22 bp, Artificial Sequence
  Synthetic oligonucleotide; CTC chr11 5235562 5235583 5235567 5235562 -
ttcccttccctttctctttctc

SEQ ID NO: 142467 - DNA, 22 bp, Artificial Sequence
  Synthetic oligonucleotide; CTT chr11 5235560 5235581 5235565 5235560 -
cccttccctttctctttctctt

SEQ ID NO: 142468 - DNA, 22 bp, Artificial Sequence
  Synthetic oligonucleotide; TTC chr11 5235559 5235580 5235564 5235559 -
ccttccctttctctttctcttc

SEQ ID NO: 142469 - DNA, 22 bp, Artificial Sequence
  Synthetic oligonucleotide; CTT chr11 5235555 5235576 5235560 5235555 -
ccctttctctttctcttcccta

SEQ ID NO: 142470 - DNA, 22 bp, Artificial Sequence
  Synthetic oligonucleotide; TTC chr11 5235554 5235575 5235559 5235554 -
cctttctctttctcttccctat

SEQ ID NO: 142471 - DNA, 22 bp, Artificial Sequence
  Synthetic oligonucleotide; CTT chr11 5235550 5235571 5235555 5235550 -
tctctttctcttccctatccct

SEQ ID NO: 142472 - DNA, 22 bp, Artificial Sequence
  Synthetic oligonucleotide; TTT chr11 5235549 5235570 5235554 5235549 -
ctctttctcttccctatccctt

SEQ ID NO: 142473 - DNA, 22 bp, Artificial Sequence
  Synthetic oligonucleotide; TTC chr11 5235548 5235569 5235553 5235548 -
tctttctcttccctatcccttc

SEQ ID NO: 142474 - DNA, 22 bp, Artificial Sequence
  Synthetic oligonucleotide; CTC chr11 5235546 5235567 5235551 5235546 -
tttctcttccctatcccttctc

SEQ ID NO: 142475 - DNA, 22 bp, Artificial Sequence
  Synthetic oligonucleotide; CTT chr11 5235544 5235565 5235549 5235544 -
tctcttccctatcccttctcct

SEQ ID NO: 142476 - DNA, 22 bp, Artificial Sequence
  Synthetic oligonucleotide; TTT chr11 5235543 5235564 5235548 5235543 -
ctcttccctatcccttctcctc

SEQ ID NO: 142477 - DNA, 22 bp, Artificial Sequence
  Synthetic oligonucleotide; TTC chr11 5235542 5235563 5235547 5235542 -
tcttccctatcccttctcctct

SEQ ID NO: 142478 - DNA, 22 bp, Artificial Sequence
  Synthetic oligonucleotide; CTC chr11 5235540 5235561 5235545 5235540 -
ttccctatcccttctcctctcc

SEQ ID NO: 142479 - DNA, 22 bp, Artificial Sequence
  Synthetic oligonucleotide; CTT chr11 5235538 5235559 5235543 5235538 -
ccctatcccttctcctctcctc

SEQ ID NO: 142480 - DNA, 22 bp, Artificial Sequence
  Synthetic oligonucleotide; TTC chr11 5235537 5235558 5235542 5235537 -
cctatcccttctcctctcctct

SEQ ID NO: 142481 - DNA, 22 bp, Artificial Sequence
  Synthetic oligonucleotide; CTA chr11 5235533 5235554 5235538 5235533 -
tcccttctcctctcctctcccc

SEQ ID NO: 142482 - DNA, 22 bp, Artificial Sequence
  Synthetic oligonucleotide; CTT chr11 5235527 5235548 5235532 5235527 -
ctcctctcctctcccctccttt

SEQ ID NO: 142483 - DNA, 22 bp, Artificial Sequence
  Synthetic oligonucleotide; TTC chr11 5235526 5235547 5235531 5235526 -
tcctctcctctcccctcctttt

SEQ ID NO: 142484 - DNA, 22 bp, Artificial Sequence
  Synthetic oligonucleotide; CTC chr11 5235524 5235545 5235529 5235524 -
ctctcctctcccctcctttttt

SEQ ID NO: 142485 - DNA, 22 bp, Artificial Sequence
  Synthetic oligonucleotide; CTC chr11 5235521 5235542 5235526 5235521 -
tcctctcccctccttttttctc

SEQ ID NO: 142486 - DNA, 22 bp, Artificial Sequence
  Synthetic oligonucleotide; CTC chr11 5235519 5235540 5235524 5235519 -
ctctcccctccttttttctcct

SEQ ID NO: 142487 - DNA, 22 bp, Artificial Sequence
  Synthetic oligonucleotide; CTC chr11 5235516 5235537 5235521 5235516 -
tcccctccttttttctcctctc

SEQ ID NO: 142488 - DNA, 22 bp, Artificial Sequence
  Synthetic oligonucleotide; CTC chr11 5235514 5235535 5235519 5235514 -
ccctccttttttctcctctcct

SEQ ID NO: 142489 - DNA, 22 bp, Artificial Sequence
  Synthetic oligonucleotide; CTC chr11 5235509 5235530 5235514 5235509 -
cttttttctcctctcctctcca

SEQ ID NO: 142490 - DNA, 22 bp, Artificial Sequence
  Synthetic oligonucleotide; CTT chr11 5235506 5235527 5235511 5235506 -
ttttctcctctcctctccatta

SEQ ID NO: 142491 - DNA, 22 bp, Artificial Sequence
  Synthetic oligonucleotide; TTT chr11 5235505 5235526 5235510 5235505 -
tttctcctctcctctccattat

SEQ ID NO: 142492 - DNA, 22 bp, Artificial Sequence
  Synthetic oligonucleotide; TTT chr11 5235504 5235525 5235509 5235504 -
ttctcctctcctctccattatt

SEQ ID NO: 142493 - DNA, 22 bp, Artificial Sequence
  Synthetic oligonucleotide; TTT chr11 5235503 5235524 5235508 5235503 -
tctcctctcctctccattattt

SEQ ID NO: 142494 - DNA, 22 bp, Artificial Sequence
  Synthetic oligonucleotide; TTT chr11 5235502 5235523 5235507 5235502 -
ctcctctcctctccattattta

SEQ ID NO: 142495 - DNA, 22 bp, Artificial Sequence
  Synthetic oligonucleotide; TTC chr11 5235501 5235522 5235506 5235501 -
tcctctcctctccattatttat

SEQ ID NO: 142496 - DNA, 22 bp, Artificial Sequence
  Synthetic oligonucleotide; CTC chr11 5235499 5235520 5235504 5235499 -
ctctcctctccattatttattt

SEQ ID NO: 142497 - DNA, 22 bp, Artificial Sequence
  Synthetic oligonucleotide; CTC chr11 5235496 5235517 5235501 5235496 -
tcctctccattatttatttttc

SEQ ID NO: 142498 - DNA, 22 bp, Artificial Sequence
  Synthetic oligonucleotide; CTC chr11 5235494 5235515 5235499 5235494 -
ctctccattatttatttttcct

SEQ ID NO: 142499 - DNA, 22 bp, Artificial Sequence
  Synthetic oligonucleotide; CTC chr11 5235491 5235512 5235496 5235491 -
tccattatttatttttccttct

SEQ ID NO: 142500 - DNA, 22 bp, Artificial Sequence
  Synthetic oligonucleotide; CTC chr11 5235489 5235510 5235494 5235489 -
cattatttatttttccttcttc

SEQ ID NO: 142501 - DNA, 22 bp, Artificial Sequence
  Synthetic oligonucleotide; TTA chr11 5235484 5235505 5235489 5235484 -
tttatttttccttcttctcctc

SEQ ID NO: 142502 - DNA, 22 bp, Artificial Sequence
  Synthetic oligonucleotide; TTT chr11 5235481 5235502 5235486 5235481 -
atttttccttcttctcctccat

SEQ ID NO: 142503 - DNA, 22 bp, Artificial Sequence
  Synthetic oligonucleotide; TTA chr11 5235480 5235501 5235485 5235480 -
tttttccttcttctcctccatc

SEQ ID NO: 142504 - DNA, 22 bp, Artificial Sequence
  Synthetic oligonucleotide; TTT chr11 5235477 5235498 5235482 5235477 -
ttccttcttctcctccatccct

SEQ ID NO: 142505 - DNA, 22 bp, Artificial Sequence
  Synthetic oligonucleotide; TTT chr11 5235476 5235497 5235481 5235476 -
tccttcttctcctccatccctt

SEQ ID NO: 142506 - DNA, 22 bp, Artificial Sequence
  Synthetic oligonucleotide; TTT chr11 5235475 5235496 5235480 5235475 -
ccttcttctcctccatcccttc

SEQ ID NO: 142507 - DNA, 22 bp, Artificial Sequence
  Synthetic oligonucleotide; TTC chr11 5235474 5235495 5235479 5235474 -
cttcttctcctccatcccttcc

SEQ ID NO: 142508 - DNA, 22 bp, Artificial Sequence
  Synthetic oligonucleotide; CTT chr11 5235471 5235492 5235476 5235471 -
cttctcctccatcccttccatc

SEQ ID NO: 142509 - DNA, 22 bp, Artificial Sequence
  Synthetic oligonucleotide; TTC chr11 5235470 5235491 5235475 5235470 -
ttctcctccatcccttccatcc

SEQ ID NO: 142510 - DNA, 22 bp, Artificial Sequence
  Synthetic oligonucleotide; CTT chr11 5235468 5235489 5235473 5235468 -
ctcctccatcccttccatcctc

SEQ ID NO: 142511 - DNA, 22 bp, Artificial Sequence
  Synthetic oligonucleotide; TTC chr11 5235467 5235488 5235472 5235467 -
tcctccatcccttccatcctct

SEQ ID NO: 142512 - DNA, 22 bp, Artificial Sequence
  Synthetic oligonucleotide; CTC chr11 5235465 5235486 5235470 5235465 -
ctccatcccttccatcctctct

SEQ ID NO: 142513 - DNA, 22 bp, Artificial Sequence
  Synthetic oligonucleotide; CTC chr11 5235462 5235483 5235467 5235462 -
catcccttccatcctctctctt

SEQ ID NO: 142514 - DNA, 22 bp, Artificial Sequence
  Synthetic oligonucleotide; CTT chr11 5235454 5235475 5235459 5235454 -
ccatcctctctcttcccctctt

SEQ ID NO: 142515 - DNA, 22 bp, Artificial Sequence
  Synthetic oligonucleotide; TTC chr11 5235453 5235474 5235458 5235453 -
catcctctctcttcccctcttc

SEQ ID NO: 142516 - DNA, 22 bp, Artificial Sequence
  Synthetic oligonucleotide; CTC chr11 5235446 5235467 5235451 5235446 -
tctcttcccctcttccttcctt

SEQ ID NO: 142517 - DNA, 22 bp, Artificial Sequence
  Synthetic oligonucleotide; CTC chr11 5235444 5235465 5235449 5235444 -
tcttcccctcttccttccttcc

SEQ ID NO: 142518 - DNA, 22 bp, Artificial Sequence
  Synthetic oligonucleotide; CTC chr11 5235442 5235463 5235447 5235442 -
ttcccctcttccttccttcctt

SEQ ID NO: 142519 - DNA, 22 bp, Artificial Sequence
  Synthetic oligonucleotide; CTT chr11 5235440 5235461 5235445 5235440 -
cccctcttccttccttcctttc

SEQ ID NO: 142520 - DNA, 22 bp, Artificial Sequence
  Synthetic oligonucleotide; TTC chr11 5235439 5235460 5235444 5235439 -
ccctcttccttccttcctttct

SEQ ID NO: 142521 - DNA, 22 bp, Artificial Sequence
  Synthetic oligonucleotide; CTC chr11 5235434 5235455 5235439 5235434 -
ttccttccttcctttctccatt

SEQ ID NO: 142522 - DNA, 22 bp, Artificial Sequence
  Synthetic oligonucleotide; CTT chr11 5235432 5235453 5235437 5235432 -
ccttccttcctttctccatttc

SEQ ID NO: 142523 - DNA, 22 bp, Artificial Sequence
  Synthetic oligonucleotide; TTC chr11 5235431 5235452 5235436 5235431 -
cttccttcctttctccatttct

SEQ ID NO: 142524 - DNA, 22 bp, Artificial Sequence
  Synthetic oligonucleotide; CTT chr11 5235428 5235449 5235433 5235428 -
ccttcctttctccatttcttcc

SEQ ID NO: 142525 - DNA, 22 bp, Artificial Sequence
  Synthetic oligonucleotide; TTC chr11 5235427 5235448 5235432 5235427 -
cttcctttctccatttcttcct

SEQ ID NO: 142526 - DNA, 22 bp, Artificial Sequence
  Synthetic oligonucleotide; CTT chr11 5235424 5235445 5235429 5235424 -
cctttctccatttcttcctcct

SEQ ID NO: 142527 - DNA, 22 bp, Artificial Sequence
  Synthetic oligonucleotide; TTC chr11 5235423 5235444 5235428 5235423 -
ctttctccatttcttcctcctc

SEQ ID NO: 142528 - DNA, 22 bp, Artificial Sequence
  Synthetic oligonucleotide; CTT chr11 5235420 5235441 5235425 5235420 -
tctccatttcttcctcctcttt

SEQ ID NO: 142529 - DNA, 22 bp, Artificial Sequence
  Synthetic oligonucleotide; TTT chr11 5235419 5235440 5235424 5235419 -
ctccatttcttcctcctctttc

SEQ ID NO: 142530 - DNA, 22 bp, Artificial Sequence
  Synthetic oligonucleotide; TTC chr11 5235418 5235439 5235423 5235418 -
tccatttcttcctcctctttcc

SEQ ID NO: 142531 - DNA, 22 bp, Artificial Sequence
  Synthetic oligonucleotide; CTC chr11 5235416 5235437 5235421 5235416 -
catttcttcctcctctttcctt

SEQ ID NO: 142532 - DNA, 22 bp, Artificial Sequence
  Synthetic oligonucleotide; TTT chr11 5235411 5235432 5235416 5235411 -
cttcctcctctttccttcaatc

SEQ ID NO: 142533 - DNA, 22 bp, Artificial Sequence
  Synthetic oligonucleotide; TTC chr11 5235410 5235431 5235415 5235410 -
ttcctcctctttccttcaatcc

SEQ ID NO: 142534 - DNA, 22 bp, Artificial Sequence
  Synthetic oligonucleotide; CTT chr11 5235408 5235429 5235413 5235408 -
cctcctctttccttcaatcctt

SEQ ID NO: 142535 - DNA, 22 bp, Artificial Sequence
  Synthetic oligonucleotide; TTC chr11 5235407 5235428 5235412 5235407 -
ctcctctttccttcaatccttc

SEQ ID NO: 142536 - DNA, 22 bp, Artificial Sequence
  Synthetic oligonucleotide; CTC chr11 5235404 5235425 5235409 5235404 -
ctctttccttcaatccttcctt

SEQ ID NO: 142537 - DNA, 22 bp, Artificial Sequence
  Synthetic oligonucleotide; CTC chr11 5235401 5235422 5235406 5235401 -
tttccttcaatccttccttttg

SEQ ID NO: 142538 - DNA, 22 bp, Artificial Sequence
  Synthetic oligonucleotide; CTT chr11 5235399 5235420 5235404 5235399 -
tccttcaatccttccttttgga

SEQ ID NO: 142539 - DNA, 22 bp, Artificial Sequence
  Synthetic oligonucleotide; TTT chr11 5235398 5235419 5235403 5235398 -
ccttcaatccttccttttggat

SEQ ID NO: 142540 - DNA, 22 bp, Artificial Sequence
  Synthetic oligonucleotide; TTC chr11 5235397 5235418 5235402 5235397 -
cttcaatccttccttttggata

SEQ ID NO: 142541 - DNA, 22 bp, Artificial Sequence
  Synthetic oligonucleotide; CTT chr11 5235394 5235415 5235399 5235394 -
caatccttccttttggatatgc

SEQ ID NO: 142542 - DNA, 22 bp, Artificial Sequence
  Synthetic oligonucleotide; TTC chr11 5235393 5235414 5235398 5235393 -
aatccttccttttggatatgct

SEQ ID NO: 142543 - DNA, 22 bp, Artificial Sequence
  Synthetic oligonucleotide; CTT chr11 5235386 5235407 5235391 5235386 -
ccttttggatatgctcatgggt

SEQ ID NO: 142544 - DNA, 22 bp, Artificial Sequence
  Synthetic oligonucleotide; TTC chr11 5235385 5235406 5235390 5235385 -
cttttggatatgctcatgggtg

SEQ ID NO: 142545 - DNA, 22 bp, Artificial Sequence
  Synthetic oligonucleotide; CTT chr11 5235382 5235403 5235387 5235382 -
ttggatatgctcatgggtgtgt

SEQ ID NO: 142546 - DNA, 22 bp, Artificial Sequence
  Synthetic oligonucleotide; TTT chr11 5235381 5235402 5235386 5235381 -
tggatatgctcatgggtgtgta

SEQ ID NO: 142547 - DNA, 22 bp, Artificial Sequence
  Synthetic oligonucleotide; TTT chr11 5235380 5235401 5235385 5235380 -
ggatatgctcatgggtgtgtat

SEQ ID NO: 142548 - DNA, 22 bp, Artificial Sequence
  Synthetic oligonucleotide; TTG chr11 5235379 5235400 5235384 5235379 -
gatatgctcatgggtgtgtatt

SEQ ID NO: 142549 - DNA, 22 bp, Artificial Sequence
  Synthetic oligonucleotide; CTC chr11 5235370 5235391 5235375 5235370 -
atgggtgtgtatttgtctgcca

SEQ ID NO: 142550 - DNA, 22 bp, Artificial Sequence
  Synthetic oligonucleotide; TTT chr11 5235356 5235377 5235361 5235356 -
gtctgccattgtggcattattt

SEQ ID NO: 142551 - DNA, 22 bp, Artificial Sequence
  Synthetic oligonucleotide; TTG chr11 5235355 5235376 5235360 5235355 -
tctgccattgtggcattatttg

SEQ ID NO: 142552 - DNA, 22 bp, Artificial Sequence
  Synthetic oligonucleotide; CTG chr11 5235351 5235372 5235356 5235351 -
ccattgtggcattatttgaatt

SEQ ID NO: 142553 - DNA, 22 bp, Artificial Sequence
  Synthetic oligonucleotide; TTG chr11 5235345 5235366 5235350 5235345 -
tggcattatttgaattcagaaa

SEQ ID NO: 142554 - DNA, 22 bp, Artificial Sequence
  Synthetic oligonucleotide; TTA chr11 5235337 5235358 5235342 5235337 -
tttgaattcagaaaagagtgaa

SEQ ID NO: 142555 - DNA, 22 bp, Artificial Sequence
  Synthetic oligonucleotide; TTT chr11 5235334 5235355 5235339 5235334 -
gaattcagaaaagagtgaaaaa

SEQ ID NO: 142556 - DNA, 22 bp, Artificial Sequence
  Synthetic oligonucleotide; TTG chr11 5235333 5235354 5235338 5235333 -
aattcagaaaagagtgaaaaac

SEQ ID NO: 142557 - DNA, 22 bp, Artificial Sequence
  Synthetic oligonucleotide; TTC chr11 5235328 5235349 5235333 5235328 -
agaaaagagtgaaaaactactg

SEQ ID NO: 142558 - DNA, 22 bp, Artificial Sequence
  Synthetic oligonucleotide; CTA chr11 5235309 5235330 5235314 5235309 -
ctgggatcttcattcctgggtc

SEQ ID NO: 142559 - DNA, 22 bp, Artificial Sequence
  Synthetic oligonucleotide; CTG chr11 5235306 5235327 5235311 5235306 -
ggatcttcattcctgggtctaa

SEQ ID NO: 142560 - DNA, 22 bp, Artificial Sequence
  Synthetic oligonucleotide; CTT chr11 5235299 5235320 5235304 5235299 -
cattcctgggtctaattccaca

SEQ ID NO: 142561 - DNA, 22 bp, Artificial Sequence
  Synthetic oligonucleotide; TTC chr11 5235298 5235319 5235303 5235298 -
attcctgggtctaattccacat

SEQ ID NO: 142562 - DNA, 22 bp, Artificial Sequence
  Synthetic oligonucleotide; TTC chr11 5235294 5235315 5235299 5235294 -
ctgggtctaattccacattttt

SEQ ID NO: 142563 - DNA, 22 bp, Artificial Sequence
  Synthetic oligonucleotide; CTG chr11 5235291 5235312 5235296 5235291 -
ggtctaattccacatttttttt

SEQ ID NO: 142564 - DNA, 22 bp, Artificial Sequence
  Synthetic oligonucleotide; CTA chr11 5235285 5235306 5235290 5235285 -
attccacatttttttttaagaa

SEQ ID NO: 142565 - DNA, 22 bp, Artificial Sequence
  Synthetic oligonucleotide; TTC chr11 5235281 5235302 5235286 5235281 -
cacatttttttttaagaacaca

SEQ ID NO: 142566 - DNA, 22 bp, Artificial Sequence
  Synthetic oligonucleotide; TTT chr11 5235274 5235295 5235279 5235274 -
ttttttaagaacacatctgtaa

SEQ ID NO: 142567 - DNA, 22 bp, Artificial Sequence
  Synthetic oligonucleotide; TTT chr11 5235273 5235294 5235278 5235273 -
tttttaagaacacatctgtaaa

SEQ ID NO: 142568 - DNA, 22 bp, Artificial Sequence
  Synthetic oligonucleotide; TTT chr11 5235272 5235293 5235277 5235272 -
ttttaagaacacatctgtaaaa

SEQ ID NO: 142569 - DNA, 22 bp, Artificial Sequence
  Synthetic oligonucleotide; TTT chr11 5235271 5235292 5235276 5235271 -
tttaagaacacatctgtaaaaa

SEQ ID NO: 142570 - DNA, 22 bp, Artificial Sequence
  Synthetic oligonucleotide; TTT chr11 5235270 5235291 5235275 5235270 -
ttaagaacacatctgtaaaaat

SEQ ID NO: 142571 - DNA, 22 bp, Artificial Sequence
  Synthetic oligonucleotide; TTT chr11 5235269 5235290 5235274 5235269 -
taagaacacatctgtaaaaatg

SEQ ID NO: 142572 - DNA, 22 bp, Artificial Sequence
  Synthetic oligonucleotide; TTT chr11 5235268 5235289 5235273 5235268 -
aagaacacatctgtaaaaatgt

SEQ ID NO: 142573 - DNA, 22 bp, Artificial Sequence
  Synthetic oligonucleotide; TTA chr11 5235267 5235288 5235272 5235267 -
agaacacatctgtaaaaatgtt

SEQ ID NO: 142574 - DNA, 22 bp, Artificial Sequence
  Synthetic oligonucleotide; CTG chr11 5235255 5235276 5235260 5235255 -
taaaaatgttctgtactagcat

SEQ ID NO: 142575 - DNA, 22 bp, Artificial Sequence
  Synthetic oligonucleotide; TTC chr11 5235244 5235265 5235249 5235244 -
tgtactagcatattcccaggaa

SEQ ID NO: 142576 - DNA, 22 bp, Artificial Sequence
  Synthetic oligonucleotide; CTG chr11 5235242 5235263 5235247 5235242 -
tactagcatattcccaggaact

SEQ ID NO: 142577 - DNA, 22 bp, Artificial Sequence
  Synthetic oligonucleotide; CTA chr11 5235237 5235258 5235242 5235237 -
gcatattcccaggaacttcgtt

SEQ ID NO: 142578 - DNA, 22 bp, Artificial Sequence
  Synthetic oligonucleotide; TTC chr11 5235229 5235250 5235234 5235229 -
ccaggaacttcgttaaatttaa

SEQ ID NO: 142579 - DNA, 22 bp, Artificial Sequence
  Synthetic oligonucleotide; CTT chr11 5235219 5235240 5235224 5235219 -
cgttaaatttaatctggctgaa

SEQ ID NO: 142580 - DNA, 22 bp, Artificial Sequence
  Synthetic oligonucleotide; TTC chr11 5235218 5235239 5235223 5235218 -
gttaaatttaatctggctgaat

SEQ ID NO: 142581 - DNA, 22 bp, Artificial Sequence
  Synthetic oligonucleotide; TTA chr11 5235214 5235235 5235219 5235214 -
aatttaatctggctgaatatgg

SEQ ID NO: 142582 - DNA, 22 bp, Artificial Sequence
  Synthetic oligonucleotide; TTT chr11 5235209 5235230 5235214 5235209 -
aatctggctgaatatggtaaat

SEQ ID NO: 142583 - DNA, 22 bp, Artificial Sequence
  Synthetic oligonucleotide; TTA chr11 5235208 5235229 5235213 5235208 -
atctggctgaatatggtaaatc

SEQ ID NO: 142584 - DNA, 22 bp, Artificial Sequence
  Synthetic oligonucleotide; CTG chr11 5235203 5235224 5235208 5235203 -
gctgaatatggtaaatctactt

SEQ ID NO: 142585 - DNA, 22 bp, Artificial Sequence
  Synthetic oligonucleotide; CTG chr11 5235199 5235220 5235204 5235199 -
aatatggtaaatctacttttca

SEQ ID NO: 142586 - DNA, 22 bp, Artificial Sequence
  Synthetic oligonucleotide; CTA chr11 5235184 5235205 5235189 5235184 -
cttttcactttgcattctttct

SEQ ID NO: 142587 - DNA, 22 bp, Artificial Sequence
  Synthetic oligonucleotide; CTT chr11 5235181 5235202 5235186 5235181 -
ttcactttgcattctttcttta

SEQ ID NO: 142588 - DNA, 22 bp, Artificial Sequence
  Synthetic oligonucleotide; TTT chr11 5235180 5235201 5235185 5235180 -
tcactttgcattctttctttag

SEQ ID NO: 142589 - DNA, 22 bp, Artificial Sequence
  Synthetic oligonucleotide; TTT chr11 5235179 5235200 5235184 5235179 -
cactttgcattctttctttagt

SEQ ID NO: 142590 - DNA, 22 bp, Artificial Sequence
  Synthetic oligonucleotide; TTC chr11 5235178 5235199 5235183 5235178 -
actttgcattctttctttagtc

SEQ ID NO: 142591 - DNA, 22 bp, Artificial Sequence
  Synthetic oligonucleotide; CTT chr11 5235174 5235195 5235179 5235174 -
tgcattctttctttagtcatac

SEQ ID NO: 142592 - DNA, 22 bp, Artificial Sequence
  Synthetic oligonucleotide; TTT chr11 5235173 5235194 5235178 5235173 -
gcattctttctttagtcatacc

SEQ ID NO: 142593 - DNA, 22 bp, Artificial Sequence
  Synthetic oligonucleotide; TTG chr11 5235172 5235193 5235177 5235172 -
cattctttctttagtcatacca

SEQ ID NO: 142594 - DNA, 22 bp, Artificial Sequence
  Synthetic oligonucleotide; TTC chr11 5235167 5235188 5235172 5235167 -
tttctttagtcataccataatt

SEQ ID NO: 142595 - DNA, 22 bp, Artificial Sequence
  Synthetic oligonucleotide; CTT chr11 5235165 5235186 5235170 5235165 -
tctttagtcataccataatttt

SEQ ID NO: 142596 - DNA, 22 bp, Artificial Sequence
  Synthetic oligonucleotide; TTT chr11 5235164 5235185 5235169 5235164 -
ctttagtcataccataatttta

SEQ ID NO: 142597 - DNA, 22 bp, Artificial Sequence
  Synthetic oligonucleotide; TTC chr11 5235163 5235184 5235168 5235163 -
tttagtcataccataattttaa

SEQ ID NO: 142598 - DNA, 22 bp, Artificial Sequence
  Synthetic oligonucleotide; CTT chr11 5235161 5235182 5235166 5235161 -
tagtcataccataattttaaac

SEQ ID NO: 142599 - DNA, 22 bp, Artificial Sequence
  Synthetic oligonucleotide; TTT chr11 5235160 5235181 5235165 5235160 -
agtcataccataattttaaaca

SEQ ID NO: 142600 - DNA, 22 bp, Artificial Sequence
  Synthetic oligonucleotide; TTA chr11 5235159 5235180 5235164 5235159 -
gtcataccataattttaaacat

SEQ ID NO: 142601 - DNA, 22 bp, Artificial Sequence
  Synthetic oligonucleotide; TTT chr11 5235144 5235165 5235149 5235144 -
taaacattcaaaatatttgtat

SEQ ID NO: 142602 - DNA, 22 bp, Artificial Sequence
  Synthetic oligonucleotide; TTT chr11 5235143 5235164 5235148 5235143 -
aaacattcaaaatatttgtata

SEQ ID NO: 142603 - DNA, 22 bp, Artificial Sequence
  Synthetic oligonucleotide; TTA chr11 5235142 5235163 5235147 5235142 -
aacattcaaaatatttgtatat

SEQ ID NO: 142604 - DNA, 22 bp, Artificial Sequence
  Synthetic oligonucleotide; TTC chr11 5235135 5235156 5235140 5235135 -
aaaatatttgtatataatattt

SEQ ID NO: 142605 - DNA, 22 bp, Artificial Sequence
  Synthetic oligonucleotide; TTT chr11 5235126 5235147 5235131 5235126 -
gtatataatatttgattttatc

SEQ ID NO: 142606 - DNA, 22 bp, Artificial Sequence
  Synthetic oligonucleotide; TTG chr11 5235125 5235146 5235130 5235125 -
tatataatatttgattttatct

SEQ ID NO: 142607 - DNA, 22 bp, Artificial Sequence
  Synthetic oligonucleotide; TTT chr11 5235113 5235134 5235118 5235113 -
gattttatctgtcattaaaatg

SEQ ID NO: 142608 - DNA, 22 bp, Artificial Sequence
  Synthetic oligonucleotide; TTG chr11 5235112 5235133 5235117 5235112 -
attttatctgtcattaaaatgt

SEQ ID NO: 142609 - DNA, 22 bp, Artificial Sequence
  Synthetic oligonucleotide; TTT chr11 5235108 5235129 5235113 5235108 -
tatctgtcattaaaatgttaac

SEQ ID NO: 142610 - DNA, 22 bp, Artificial Sequence
  Synthetic oligonucleotide; TTT chr11 5235107 5235128 5235112 5235107 -
atctgtcattaaaatgttaacc

SEQ ID NO: 142611 - DNA, 22 bp, Artificial Sequence
  Synthetic oligonucleotide; TTA chr11 5235106 5235127 5235111 5235106 -
tctgtcattaaaatgttaacct

SEQ ID NO: 142612 - DNA, 22 bp, Artificial Sequence
  Synthetic oligonucleotide; CTG chr11 5235102 5235123 5235107 5235102 -
tcattaaaatgttaaccttaaa

SEQ ID NO: 142613 - DNA, 22 bp, Artificial Sequence
  Synthetic oligonucleotide; TTA chr11 5235096 5235117 5235101 5235096 -
aaatgttaaccttaaaattcat

SEQ ID NO: 142614 - DNA, 22 bp, Artificial Sequence
  Synthetic oligonucleotide; TTA chr11 5235088 5235109 5235093 5235088 -
accttaaaattcatgtttccag

SEQ ID NO: 142615 - DNA, 22 bp, Artificial Sequence
  Synthetic oligonucleotide; CTT chr11 5235083 5235104 5235088 5235083 -
aaaattcatgtttccagaacct

SEQ ID NO: 142616 - DNA, 22 bp, Artificial Sequence
  Synthetic oligonucleotide; TTA chr11 5235082 5235103 5235087 5235082 -
aaattcatgtttccagaaccta

SEQ ID NO: 142617 - DNA, 22 bp, Artificial Sequence
  Synthetic oligonucleotide; TTC chr11 5235076 5235097 5235081 5235076 -
atgtttccagaacctatttcaa

SEQ ID NO: 142618 - DNA, 22 bp, Artificial Sequence
  Synthetic oligonucleotide; TTT chr11 5235070 5235091 5235075 5235070 -
ccagaacctatttcaataactg

SEQ ID NO: 142619 - DNA, 22 bp, Artificial Sequence
  Synthetic oligonucleotide; TTC chr11 5235069 5235090 5235074 5235069 -
cagaacctatttcaataactgg

SEQ ID NO: 142620 - DNA, 22 bp, Artificial Sequence
  Synthetic oligonucleotide; CTA chr11 5235060 5235081 5235065 5235060 -
tttcaataactggtaaataaac

SEQ ID NO: 142621 - DNA, 22 bp, Artificial Sequence
  Synthetic oligonucleotide; TTT chr11 5235057 5235078 5235062 5235057 -
caataactggtaaataaacact

SEQ ID NO: 142622 - DNA, 22 bp, Artificial Sequence
  Synthetic oligonucleotide; TTC chr11 5235056 5235077 5235061 5235056 -
aataactggtaaataaacacta

SEQ ID NO: 142623 - DNA, 22 bp, Artificial Sequence
  Synthetic oligonucleotide; CTG chr11 5235048 5235069 5235053 5235048 -
gtaaataaacactattcatttt

SEQ ID NO: 142624 - DNA, 22 bp, Artificial Sequence
  Synthetic oligonucleotide; CTA chr11 5235034 5235055 5235039 5235034 -
ttcattttttaaatattctttt

SEQ ID NO: 142625 - DNA, 22 bp, Artificial Sequence
  Synthetic oligonucleotide; TTC chr11 5235031 5235052 5235036 5235031 -
attttttaaatattcttttaat

SEQ ID NO: 142626 - DNA, 22 bp, Artificial Sequence
  Synthetic oligonucleotide; TTT chr11 5235027 5235048 5235032 5235027 -
tttaaatattcttttaatggat

SEQ ID NO: 142627 - DNA, 22 bp, Artificial Sequence
  Synthetic oligonucleotide; TTT chr11 5235026 5235047 5235031 5235026 -
ttaaatattcttttaatggata

SEQ ID NO: 142628 - DNA, 22 bp, Artificial Sequence
  Synthetic oligonucleotide; TTT chr11 5235025 5235046 5235030 5235025 -
taaatattcttttaatggatat

SEQ ID NO: 142629 - DNA, 22 bp, Artificial Sequence
  Synthetic oligonucleotide; TTT chr11 5235024 5235045 5235029 5235024 -
aaatattcttttaatggatatt

SEQ ID NO: 142630 - DNA, 22 bp, Artificial Sequence
  Synthetic oligonucleotide; TTA chr11 5235023 5235044 5235028 5235023 -
aatattcttttaatggatattt

SEQ ID NO: 142631 - DNA, 22 bp, Artificial Sequence
  Synthetic oligonucleotide; TTC chr11 5235016 5235037 5235021 5235016 -
ttttaatggatatttatttcaa

SEQ ID NO: 142632 - DNA, 22 bp, Artificial Sequence
  Synthetic oligonucleotide; CTT chr11 5235014 5235035 5235019 5235014 -
ttaatggatatttatttcaata

SEQ ID NO: 142633 - DNA, 22 bp, Artificial Sequence
  Synthetic oligonucleotide; TTT chr11 5235013 5235034 5235018 5235013 -
taatggatatttatttcaatat

SEQ ID NO: 142634 - DNA, 22 bp, Artificial Sequence
  Synthetic oligonucleotide; TTT chr11 5235012 5235033 5235017 5235012 -
aatggatatttatttcaatata

SEQ ID NO: 142635 - DNA, 22 bp, Artificial Sequence
  Synthetic oligonucleotide; TTA chr11 5235011 5235032 5235016 5235011 -
atggatatttatttcaatataa

SEQ ID NO: 142636 - DNA, 22 bp, Artificial Sequence
  Synthetic oligonucleotide; TTT chr11 5235001 5235022 5235006 5235001 -
atttcaatataataaaaaatta

SEQ ID NO: 142637 - DNA, 22 bp, Artificial Sequence
  Synthetic oligonucleotide; TTA chr11 5235000 5235021 5235005 5235000 -
tttcaatataataaaaaattag

SEQ ID NO: 142638 - DNA, 22 bp, Artificial Sequence
  Synthetic oligonucleotide; TTT chr11 5234997 5235018 5235002 5234997 -
caatataataaaaaattagagt

SEQ ID NO: 142639 - DNA, 22 bp, Artificial Sequence
  Synthetic oligonucleotide; TTC chr11 5234996 5235017 5235001 5234996 -
aatataataaaaaattagagtt

SEQ ID NO: 142640 - DNA, 22 bp, Artificial Sequence
  Synthetic oligonucleotide; TTA chr11 5234979 5235000 5234984 5234979 -
gagttttattataggaagaatt

SEQ ID NO: 142641 - DNA, 22 bp, Artificial Sequence
  Synthetic oligonucleotide; TTT chr11 5234973 5234994 5234978 5234973 -
tattataggaagaatttaccaa

SEQ ID NO: 142642 - DNA, 22 bp, Artificial Sequence
  Synthetic oligonucleotide; TTT chr11 5234972 5234993 5234977 5234972 -
attataggaagaatttaccaaa

SEQ ID NO: 142643 - DNA, 22 bp, Artificial Sequence
  Synthetic oligonucleotide; TTA chr11 5234971 5234992 5234976 5234971 -
ttataggaagaatttaccaaaa

SEQ ID NO: 142644 - DNA, 22 bp, Artificial Sequence
  Synthetic oligonucleotide; TTA chr11 5234968 5234989 5234973 5234968 -
taggaagaatttaccaaaagaa

SEQ ID NO: 142645 - DNA, 22 bp, Artificial Sequence
  Synthetic oligonucleotide; TTT chr11 5234956 5234977 5234961 5234956 -
accaaaagaaggaggaagcaag

SEQ ID NO: 142646 - DNA, 22 bp, Artificial Sequence
  Synthetic oligonucleotide; TTA chr11 5234955 5234976 5234960 5234955 -
ccaaaagaaggaggaagcaagc

SEQ ID NO: 142647 - DNA, 22 bp, Artificial Sequence
  Synthetic oligonucleotide; TTT chr11 5234927 5234948 5234932 5234927 -
aaactgcagcaatagatttgtc

SEQ ID NO: 142648 - DNA, 22 bp, Artificial Sequence
  Synthetic oligonucleotide; TTA chr11 5234926 5234947 5234931 5234926 -
aactgcagcaatagatttgtcc

SEQ ID NO: 142649 - DNA, 22 bp, Artificial Sequence
  Synthetic oligonucleotide; CTG chr11 5234921 5234942 5234926 5234921 -
cagcaatagatttgtccattcc

SEQ ID NO: 142650 - DNA, 22 bp, Artificial Sequence
  Synthetic oligonucleotide; TTT chr11 5234908 5234929 5234913 5234908 -
gtccattccaacctctcaaaat

SEQ ID NO: 142651 - DNA, 22 bp, Artificial Sequence
  Synthetic oligonucleotide; TTG chr11 5234907 5234928 5234912 5234907 -
tccattccaacctctcaaaatt

SEQ ID NO: 142652 - DNA, 22 bp, Artificial Sequence
  Synthetic oligonucleotide; TTC chr11 5234900 5234921 5234905 5234900 -
caacctctcaaaattcccttgg

SEQ ID NO: 142653 - DNA, 22 bp, Artificial Sequence
  Synthetic oligonucleotide; CTC chr11 5234893 5234914 5234898 5234893 -
tcaaaattcccttggagacaaa

SEQ ID NO: 142654 - DNA, 22 bp, Artificial Sequence
  Synthetic oligonucleotide; CTC chr11 5234891 5234912 5234896 5234891 -
aaaattcccttggagacaaaaa

SEQ ID NO: 142655 - DNA, 22 bp, Artificial Sequence
  Synthetic oligonucleotide; TTC chr11 5234884 5234905 5234889 5234884 -
ccttggagacaaaaatctctag

SEQ ID NO: 142656 - DNA, 22 bp, Artificial Sequence
  Synthetic oligonucleotide; CTT chr11 5234880 5234901 5234885 5234880 -
ggagacaaaaatctctagaggc

SEQ ID NO: 142657 - DNA, 22 bp, Artificial Sequence
  Synthetic oligonucleotide; TTG chr11 5234879 5234900 5234884 5234879 -
gagacaaaaatctctagaggca

SEQ ID NO: 142658 - DNA, 22 bp, Artificial Sequence
  Synthetic oligonucleotide; CTC chr11 5234865 5234886 5234870 5234865 -
tagaggcaaagaagaactttat

SEQ ID NO: 142659 - DNA, 22 bp, Artificial Sequence
  Synthetic oligonucleotide; CTA chr11 5234863 5234884 5234868 5234863 -
gaggcaaagaagaactttatat

SEQ ID NO: 142660 - DNA, 22 bp, Artificial Sequence
  Synthetic oligonucleotide; CTT chr11 5234846 5234867 5234851 5234846 -
tatattgagtcaacttgttaaa

SEQ ID NO: 142661 - DNA, 22 bp, Artificial Sequence
  Synthetic oligonucleotide; TTT chr11 5234845 5234866 5234850 5234845 -
atattgagtcaacttgttaaaa

SEQ ID NO: 142662 - DNA, 22 bp, Artificial Sequence
  Synthetic oligonucleotide; TTA chr11 5234844 5234865 5234849 5234844 -
tattgagtcaacttgttaaaac

SEQ ID NO: 142663 - DNA, 22 bp, Artificial Sequence
  Synthetic oligonucleotide; TTG chr11 5234839 5234860 5234844 5234839 -
agtcaacttgttaaaacatctg

SEQ ID NO: 142664 - DNA, 22 bp, Artificial Sequence
  Synthetic oligonucleotide; CTT chr11 5234830 5234851 5234835 5234830 -
gttaaaacatctgcttttagat

SEQ ID NO: 142665 - DNA, 22 bp, Artificial Sequence
  Synthetic oligonucleotide; TTG chr11 5234829 5234850 5234834 5234829 -
ttaaaacatctgcttttagata

SEQ ID NO: 142666 - DNA, 22 bp, Artificial Sequence
  Synthetic oligonucleotide; TTA chr11 5234826 5234847 5234831 5234826 -
aaacatctgcttttagataagt

SEQ ID NO: 142667 - DNA, 22 bp, Artificial Sequence
  Synthetic oligonucleotide; CTG chr11 5234817 5234838 5234822 5234817 -
cttttagataagttttcttagt

SEQ ID NO: 142668 - DNA, 22 bp, Artificial Sequence
  Synthetic oligonucleotide; CTT chr11 5234814 5234835 5234819 5234814 -
ttagataagttttcttagtata

SEQ ID NO: 142669 - DNA, 22 bp, Artificial Sequence
  Synthetic oligonucleotide; TTT chr11 5234813 5234834 5234818 5234813 -
tagataagttttcttagtataa

SEQ ID NO: 142670 - DNA, 22 bp, Artificial Sequence
  Synthetic oligonucleotide; TTT chr11 5234812 5234833 5234817 5234812 -
agataagttttcttagtataaa

SEQ ID NO: 142671 - DNA, 22 bp, Artificial Sequence
  Synthetic oligonucleotide; TTA chr11 5234811 5234832 5234816 5234811 -
gataagttttcttagtataaag

SEQ ID NO: 142672 - DNA, 22 bp, Artificial Sequence
  Synthetic oligonucleotide; TTT chr11 5234802 5234823 5234807 5234802 -
tcttagtataaagtgacagaaa

SEQ ID NO: 142673 - DNA, 22 bp, Artificial Sequence
  Synthetic oligonucleotide; TTT chr11 5234801 5234822 5234806 5234801 -
cttagtataaagtgacagaaac

SEQ ID NO: 142674 - DNA, 22 bp, Artificial Sequence
  Synthetic oligonucleotide; TTC chr11 5234800 5234821 5234805 5234800 -
ttagtataaagtgacagaaaca

SEQ ID NO: 142675 - DNA, 22 bp, Artificial Sequence
  Synthetic oligonucleotide; CTT chr11 5234798 5234819 5234803 5234798 -
agtataaagtgacagaaacaaa

SEQ ID NO: 142676 - DNA, 22 bp, Artificial Sequence
  Synthetic oligonucleotide; TTA chr11 5234797 5234818 5234802 5234797 -
gtataaagtgacagaaacaaat

SEQ ID NO: 142677 - DNA, 22 bp, Artificial Sequence
  Synthetic oligonucleotide; TTA chr11 5234769 5234790 5234774 5234769 -
aactctaagatacattccacta

SEQ ID NO: 142678 - DNA, 22 bp, Artificial Sequence
  Synthetic oligonucleotide; CTC chr11 5234764 5234785 5234769 5234764 -
taagatacattccactatatta

SEQ ID NO: 142679 - DNA, 22 bp, Artificial Sequence
  Synthetic oligonucleotide; CTA chr11 5234762 5234783 5234767 5234762 -
agatacattccactatattagc

SEQ ID NO: 142680 - DNA, 22 bp, Artificial Sequence
  Synthetic oligonucleotide; TTC chr11 5234752 5234773 5234757 5234752 -
cactatattagcctaaaacact

SEQ ID NO: 142681 - DNA, 22 bp, Artificial Sequence
  Synthetic oligonucleotide; CTA chr11 5234747 5234768 5234752 5234747 -
tattagcctaaaacacttctgc

SEQ ID NO: 142682 - DNA, 22 bp, Artificial Sequence
  Synthetic oligonucleotide; TTA chr11 5234742 5234763 5234747 5234742 -
gcctaaaacacttctgcaaaaa

SEQ ID NO: 142683 - DNA, 22 bp, Artificial Sequence
  Synthetic oligonucleotide; CTA chr11 5234737 5234758 5234742 5234737 -
aaacacttctgcaaaaatgaaa

SEQ ID NO: 142684 - DNA, 22 bp, Artificial Sequence
  Synthetic oligonucleotide; CTT chr11 5234729 5234750 5234734 5234729 -
ctgcaaaaatgaaactaggagg

SEQ ID NO: 142685 - DNA, 22 bp, Artificial Sequence
  Synthetic oligonucleotide; TTC chr11 5234728 5234749 5234733 5234728 -
tgcaaaaatgaaactaggagga

SEQ ID NO: 142686 - DNA, 22 bp, Artificial Sequence
  Synthetic oligonucleotide; CTG chr11 5234726 5234747 5234731 5234726 -
caaaaatgaaactaggaggata

SEQ ID NO: 142687 - DNA, 22 bp, Artificial Sequence
  Synthetic oligonucleotide; CTA chr11 5234712 5234733 5234717 5234712 -
ggaggatatttttagaaacaac

SEQ ID NO: 142688 - DNA, 22 bp, Artificial Sequence
  Synthetic oligonucleotide; TTT chr11 5234701 5234722 5234706 5234701 -
ttagaaacaactgctgaaagag

SEQ ID NO: 142689 - DNA, 22 bp, Artificial Sequence
  Synthetic oligonucleotide; TTT chr11 5234700 5234721 5234705 5234700 -
tagaaacaactgctgaaagaga

SEQ ID NO: 142690 - DNA, 22 bp, Artificial Sequence
  Synthetic oligonucleotide; TTT chr11 5234699 5234720 5234704 5234699 -
agaaacaactgctgaaagagat

SEQ ID NO: 142691 - DNA, 22 bp, Artificial Sequence
  Synthetic oligonucleotide; TTA chr11 5234698 5234719 5234703 5234698 -
gaaacaactgctgaaagagatg

SEQ ID NO: 142692 - DNA, 22 bp, Artificial Sequence
  Synthetic oligonucleotide; CTG chr11 5234688 5234709 5234693 5234688 -
ctgaaagagatgcggtggggag

SEQ ID NO: 142693 - DNA, 22 bp, Artificial Sequence
  Synthetic oligonucleotide; CTG chr11 5234685 5234706 5234690 5234685 -
aaagagatgcggtggggagata

SEQ ID NO: 142694 - DNA, 22 bp, Artificial Sequence
  Synthetic oligonucleotide; TTT chr11 5234643 5234664 5234648 5234643 -
ctgagtcaagacacacatgaca

SEQ ID NO: 142695 - DNA, 22 bp, Artificial Sequence
  Synthetic oligonucleotide; TTC chr11 5234642 5234663 5234647 5234642 -
tgagtcaagacacacatgacag

SEQ ID NO: 142696 - DNA, 22 bp, Artificial Sequence
  Synthetic oligonucleotide; CTG chr11 5234640 5234661 5234645 5234640 -
agtcaagacacacatgacagaa

SEQ ID NO: 142697 - DNA, 22 bp, Artificial Sequence
  Synthetic oligonucleotide; CTC chr11 5234607 5234628 5234612 5234607 -
agggcaagttaagggaatagtg

SEQ ID NO: 142698 - DNA, 22 bp, Artificial Sequence
  Synthetic oligonucleotide; TTA chr11 5234596 5234617 5234601 5234596 -
agggaatagtggaatgaaggtt

SEQ ID NO: 142699 - DNA, 22 bp, Artificial Sequence
  Synthetic oligonucleotide; TTC chr11 5234573 5234594 5234578 5234573 -
atttttcattctcacaaactaa

SEQ ID NO: 142700 - DNA, 22 bp, Artificial Sequence
  Synthetic oligonucleotide; TTT chr11 5234569 5234590 5234574 5234569 -
ttcattctcacaaactaatgaa

SEQ ID NO: 142701 - DNA, 22 bp, Artificial Sequence
  Synthetic oligonucleotide; TTT chr11 5234568 5234589 5234573 5234568 -
tcattctcacaaactaatgaaa

SEQ ID NO: 142702 - DNA, 22 bp, Artificial Sequence
  Synthetic oligonucleotide; TTT chr11 5234567 5234588 5234572 5234567 -
cattctcacaaactaatgaaac

SEQ ID NO: 142703 - DNA, 22 bp, Artificial Sequence
  Synthetic oligonucleotide; TTC chr11 5234566 5234587 5234571 5234566 -
attctcacaaactaatgaaacc

SEQ ID NO: 142704 - DNA, 22 bp, Artificial Sequence
  Synthetic oligonucleotide; TTC chr11 5234562 5234583 5234567 5234562 -
tcacaaactaatgaaaccctgc

SEQ ID NO: 142705 - DNA, 22 bp, Artificial Sequence
  Synthetic oligonucleotide; CTC chr11 5234560 5234581 5234565 5234560 -
acaaactaatgaaaccctgctt

SEQ ID NO: 142706 - DNA, 22 bp, Artificial Sequence
  Synthetic oligonucleotide; CTA chr11 5234552 5234573 5234557 5234552 -
atgaaaccctgcttatcttaaa

SEQ ID NO: 142707 - DNA, 22 bp, Artificial Sequence
  Synthetic oligonucleotide; CTG chr11 5234541 5234562 5234546 5234541 -
cttatcttaaaccaacctgctc

SEQ ID NO: 142708 - DNA, 22 bp, Artificial Sequence
  Synthetic oligonucleotide; CTT chr11 5234538 5234559 5234543 5234538 -
atcttaaaccaacctgctcact

SEQ ID NO: 142709 - DNA, 22 bp, Artificial Sequence
  Synthetic oligonucleotide; TTA chr11 5234537 5234558 5234542 5234537 -
tcttaaaccaacctgctcactg

SEQ ID NO: 142710 - DNA, 22 bp, Artificial Sequence
  Synthetic oligonucleotide; CTT chr11 5234533 5234554 5234538 5234533 -
aaaccaacctgctcactggagc

SEQ ID NO: 142711 - DNA, 22 bp, Artificial Sequence
  Synthetic oligonucleotide; TTA chr11 5234532 5234553 5234537 5234532 -
aaccaacctgctcactggagca

SEQ ID NO: 142712 - DNA, 22 bp, Artificial Sequence
  Synthetic oligonucleotide; CTG chr11 5234522 5234543 5234527 5234522 -
ctcactggagcagggaggacag

SEQ ID NO: 142713 - DNA, 22 bp, Artificial Sequence
  Synthetic oligonucleotide; CTC chr11 5234519 5234540 5234524 5234519 -
actggagcagggaggacaggac

SEQ ID NO: 142714 - DNA, 22 bp, Artificial Sequence
  Synthetic oligonucleotide; CTG chr11 5234515 5234536 5234520 5234515 -
gagcagggaggacaggaccagc

SEQ ID NO: 142715 - DNA, 22 bp, Artificial Sequence
  Synthetic oligonucleotide; CTG chr11 5234468 5234489 5234473 5234468 -
ttgcttacactttcttctgaca

SEQ ID NO: 142716 - DNA, 22 bp, Artificial Sequence
  Synthetic oligonucleotide; TTG chr11 5234465 5234486 5234470 5234465 -
cttacactttcttctgacataa

SEQ ID NO: 142717 - DNA, 22 bp, Artificial Sequence
  Synthetic oligonucleotide; CTT chr11 5234462 5234483 5234467 5234462 -
acactttcttctgacataacag

SEQ ID NO: 142718 - DNA, 22 bp, Artificial Sequence
  Synthetic oligonucleotide; TTA chr11 5234461 5234482 5234466 5234461 -
cactttcttctgacataacagt

SEQ ID NO: 142719 - DNA, 22 bp, Artificial Sequence
  Synthetic oligonucleotide; CTT chr11 5234456 5234477 5234461 5234456 -
tcttctgacataacagtgttca

SEQ ID NO: 142720 - DNA, 22 bp, Artificial Sequence
  Synthetic oligonucleotide; TTT chr11 5234455 5234476 5234460 5234455 -
cttctgacataacagtgttcac

SEQ ID NO: 142721 - DNA, 22 bp, Artificial Sequence
  Synthetic oligonucleotide; TTC chr11 5234454 5234475 5234459 5234454 -
ttctgacataacagtgttcact

SEQ ID NO: 142722 - DNA, 22 bp, Artificial Sequence
  Synthetic oligonucleotide; CTT chr11 5234452 5234473 5234457 5234452 -
ctgacataacagtgttcactag

SEQ ID NO: 142723 - DNA, 22 bp, Artificial Sequence
  Synthetic oligonucleotide; TTC chr11 5234451 5234472 5234456 5234451 -
tgacataacagtgttcactagc

SEQ ID NO: 142724 - DNA, 22 bp, Artificial Sequence
  Synthetic oligonucleotide; CTG chr11 5234449 5234470 5234454 5234449 -
acataacagtgttcactagcaa

SEQ ID NO: 142725 - DNA, 22 bp, Artificial Sequence
  Synthetic oligonucleotide; TTC chr11 5234435 5234456 5234440 5234435 -
actagcaacctcaaacagacac

SEQ ID NO: 142726 - DNA, 22 bp, Artificial Sequence
  Synthetic oligonucleotide; CTA chr11 5234431 5234452 5234436 5234431 -
gcaacctcaaacagacaccatg

SEQ ID NO: 142727 - DNA, 22 bp, Artificial Sequence
  Synthetic oligonucleotide; CTC chr11 5234423 5234444 5234428 5234423 -
aaacagacaccatggtgcatct

SEQ ID NO: 142728 - DNA, 22 bp, Artificial Sequence
  Synthetic oligonucleotide; CTG chr11 5234400 5234421 5234405 5234400 -
actcctgaggagaagactgctg

SEQ ID NO: 142729 - DNA, 22 bp, Artificial Sequence
  Synthetic oligonucleotide; CTC chr11 5234396 5234417 5234401 5234396 -
ctgaggagaagactgctgtcaa

SEQ ID NO: 142730 - DNA, 22 bp, Artificial Sequence
  Synthetic oligonucleotide; CTG chr11 5234393 5234414 5234398 5234393 -
aggagaagactgctgtcaatgc

SEQ ID NO: 142731 - DNA, 22 bp, Artificial Sequence
  Synthetic oligonucleotide; CTG chr11 5234381 5234402 5234386 5234381 -
ctgtcaatgccctgtggggcaa

SEQ ID NO: 142732 - DNA, 22 bp, Artificial Sequence
  Synthetic oligonucleotide; CTG chr11 5234378 5234399 5234383 5234378 -
tcaatgccctgtggggcaaagt

SEQ ID NO: 142733 - DNA, 22 bp, Artificial Sequence
  Synthetic oligonucleotide; CTG chr11 5234367 5234388 5234372 5234367 -
tggggcaaagtgaacgtggatg

SEQ ID NO: 142734 - DNA, 22 bp, Artificial Sequence
  Synthetic oligonucleotide; TTG chr11 5234339 5234360 5234344 5234339 -
gtggtgaggccctgggcaggtt

SEQ ID NO: 142735 - DNA, 22 bp, Artificial Sequence
  Synthetic oligonucleotide; CTG chr11 5234325 5234346 5234330 5234325 -
ggcaggttggtatcaaggttat

SEQ ID NO: 142736 - DNA, 22 bp, Artificial Sequence
  Synthetic oligonucleotide; TTG chr11 5234316 5234337 5234321 5234316 -
gtatcaaggttataagagaggc

SEQ ID NO: 142737 - DNA, 22 bp, Artificial Sequence
  Synthetic oligonucleotide; TTA chr11 5234304 5234325 5234309 5234304 -
taagagaggctcaaggaggcaa

SEQ ID NO: 142738 - DNA, 22 bp, Artificial Sequence
  Synthetic oligonucleotide; CTC chr11 5234292 5234313 5234297 5234292 -
aaggaggcaaatggaaactggg

SEQ ID NO: 142739 - DNA, 22 bp, Artificial Sequence
  Synthetic oligonucleotide; CTG chr11 5234272 5234293 5234277 5234272 -
ggcatgtgtagacagagaagac

SEQ ID NO: 142740 - DNA, 22 bp, Artificial Sequence
  Synthetic oligonucleotide; CTC chr11 5234248 5234269 5234253 5234248 -
ttgggtttctgataggcactga

SEQ ID NO: 142741 - DNA, 22 bp, Artificial Sequence
  Synthetic oligonucleotide; CTT chr11 5234246 5234267 5234251 5234246 -
gggtttctgataggcactgact

SEQ ID NO: 142742 - DNA, 22 bp, Artificial Sequence
  Synthetic oligonucleotide; TTG chr11 5234245 5234266 5234250 5234245 -
ggtttctgataggcactgactc

SEQ ID NO: 142743 - DNA, 22 bp, Artificial Sequence
  Synthetic oligonucleotide; TTT chr11 5234240 5234261 5234245 5234240 -
ctgataggcactgactctctgt

SEQ ID NO: 142744 - DNA, 22 bp, Artificial Sequence
  Synthetic oligonucleotide; TTC chr11 5234239 5234260 5234244 5234239 -
tgataggcactgactctctgtc

SEQ ID NO: 142745 - DNA, 22 bp, Artificial Sequence
  Synthetic oligonucleotide; CTG chr11 5234237 5234258 5234242 5234237 -
ataggcactgactctctgtccc

SEQ ID NO: 142746 - DNA, 22 bp, Artificial Sequence
  Synthetic oligonucleotide; CTG chr11 5234227 5234248 5234232 5234227 -
actctctgtcccttgggctgtt

SEQ ID NO: 142747 - DNA, 22 bp, Artificial Sequence
  Synthetic oligonucleotide; CTC chr11 5234223 5234244 5234228 5234223 -
tctgtcccttgggctgttttcc

SEQ ID NO: 142748 - DNA, 22 bp, Artificial Sequence
  Synthetic oligonucleotide; CTC chr11 5234221 5234242 5234226 5234221 -
tgtcccttgggctgttttccta

SEQ ID NO: 142749 - DNA, 22 bp, Artificial Sequence
  Synthetic oligonucleotide; CTG chr11 5234219 5234240 5234224 5234219 -
tcccttgggctgttttcctacc

SEQ ID NO: 142750 - DNA, 22 bp, Artificial Sequence
  Synthetic oligonucleotide; CTT chr11 5234213 5234234 5234218 5234213 -
gggctgttttcctaccctcaga

SEQ ID NO: 142751 - DNA, 22 bp, Artificial Sequence
  Synthetic oligonucleotide; TTG chr11 5234212 5234233 5234217 5234212 -
ggctgttttcctaccctcagat

SEQ ID NO: 142752 - DNA, 22 bp, Artificial Sequence
  Synthetic oligonucleotide; CTG chr11 5234207 5234228 5234212 5234207 -
ttttcctaccctcagattactg

SEQ ID NO: 142753 - DNA, 22 bp, Artificial Sequence
  Synthetic oligonucleotide; TTT chr11 5234204 5234225 5234209 5234204 -
tcctaccctcagattactggtg

SEQ ID NO: 142754 - DNA, 22 bp, Artificial Sequence
  Synthetic oligonucleotide; TTT chr11 5234203 5234224 5234208 5234203 -
cctaccctcagattactggtgg

SEQ ID NO: 142755 - DNA, 22 bp, Artificial Sequence
  Synthetic oligonucleotide; TTC chr11 5234202 5234223 5234207 5234202 -
ctaccctcagattactggtggt

SEQ ID NO: 142756 - DNA, 22 bp, Artificial Sequence
  Synthetic oligonucleotide; CTA chr11 5234199 5234220 5234204 5234199 -
ccctcagattactggtggtcta

SEQ ID NO: 142757 - DNA, 22 bp, Artificial Sequence
  Synthetic oligonucleotide; CTC chr11 5234194 5234215 5234199 5234194 -
agattactggtggtctaccctt

SEQ ID NO: 142758 - DNA, 22 bp, Artificial Sequence
  Synthetic oligonucleotide; TTA chr11 5234188 5234209 5234193 5234188 -
ctggtggtctacccttggaccc

SEQ ID NO: 142759 - DNA, 22 bp, Artificial Sequence
  Synthetic oligonucleotide; CTG chr11 5234185 5234206 5234190 5234185 -
gtggtctacccttggacccaga

SEQ ID NO: 142760 - DNA, 22 bp, Artificial Sequence
  Synthetic oligonucleotide; CTA chr11 5234177 5234198 5234182 5234177 -
cccttggacccagaggttcttt

SEQ ID NO: 142761 - DNA, 22 bp, Artificial Sequence
  Synthetic oligonucleotide; CTT chr11 5234172 5234193 5234177 5234172 -
ggacccagaggttctttgagtc

SEQ ID NO: 142762 - DNA, 22 bp, Artificial Sequence
  Synthetic oligonucleotide; TTG chr11 5234171 5234192 5234176 5234171 -
gacccagaggttctttgagtcc

SEQ ID NO: 142763 - DNA, 22 bp, Artificial Sequence
  Synthetic oligonucleotide; TTC chr11 5234158 5234179 5234163 5234158 -
tttgagtcctttggggatctgt

SEQ ID NO: 142764 - DNA, 22 bp, Artificial Sequence
  Synthetic oligonucleotide; CTT chr11 5234156 5234177 5234161 5234156 -
tgagtcctttggggatctgtcc

SEQ ID NO: 142765 - DNA, 22 bp, Artificial Sequence
  Synthetic oligonucleotide; TTT chr11 5234155 5234176 5234160 5234155 -
gagtcctttggggatctgtcct

SEQ ID NO: 142766 - DNA, 22 bp, Artificial Sequence
  Synthetic oligonucleotide; TTG chr11 5234154 5234175 5234159 5234154 -
agtcctttggggatctgtcctc

SEQ ID NO: 142767 - DNA, 22 bp, Artificial Sequence
  Synthetic oligonucleotide; CTT chr11 5234147 5234168 5234152 5234147 -
tggggatctgtcctctcctgat

SEQ ID NO: 142768 - DNA, 22 bp, Artificial Sequence
  Synthetic oligonucleotide; TTT chr11 5234146 5234167 5234151 5234146 -
ggggatctgtcctctcctgatg

SEQ ID NO: 142769 - DNA, 22 bp, Artificial Sequence
  Synthetic oligonucleotide; TTG chr11 5234145 5234166 5234150 5234145 -
gggatctgtcctctcctgatgc

SEQ ID NO: 142770 - DNA, 22 bp, Artificial Sequence
  Synthetic oligonucleotide; CTG chr11 5234137 5234158 5234142 5234137 -
tcctctcctgatgctgttatgg

SEQ ID NO: 142771 - DNA, 22 bp, Artificial Sequence
  Synthetic oligonucleotide; CTC chr11 5234132 5234153 5234137 5234132 -
tcctgatgctgttatgggcaac

SEQ ID NO: 142772 - DNA, 22 bp, Artificial Sequence
  Synthetic oligonucleotide; CTC chr11 5234130 5234151 5234135 5234130 -
ctgatgctgttatgggcaaccc

SEQ ID NO: 142773 - DNA, 22 bp, Artificial Sequence
  Synthetic oligonucleotide; CTG chr11 5234127 5234148 5234132 5234127 -
atgctgttatgggcaaccctaa

SEQ ID NO: 142774 - DNA, 22 bp, Artificial Sequence
  Synthetic oligonucleotide; CTG chr11 5234121 5234142 5234126 5234121 -
ttatgggcaaccctaaggtgaa

SEQ ID NO: 142775 - DNA, 22 bp, Artificial Sequence
  Synthetic oligonucleotide; TTA chr11 5234118 5234139 5234123 5234118 -
tgggcaaccctaaggtgaaggc

SEQ ID NO: 142776 - DNA, 22 bp, Artificial Sequence
  Synthetic oligonucleotide; CTA chr11 5234106 5234127 5234111 5234106 -
aggtgaaggctcatggcaagaa

SEQ ID NO: 142777 - DNA, 22 bp, Artificial Sequence
  Synthetic oligonucleotide; CTC chr11 5234094 5234115 5234099 5234094 -
atggcaagaaggtgctaggtgc

SEQ ID NO: 142778 - DNA, 22 bp, Artificial Sequence
  Synthetic oligonucleotide; CTA chr11 5234077 5234098 5234082 5234077 -
ggtgcctttagtgatggcctgg

SEQ ID NO: 142779 - DNA, 22 bp, Artificial Sequence
  Synthetic oligonucleotide; CTT chr11 5234069 5234090 5234074 5234069 -
tagtgatggcctggctcacctg

SEQ ID NO: 142780 - DNA, 22 bp, Artificial Sequence
  Synthetic oligonucleotide; TTT chr11 5234068 5234089 5234073 5234068 -
agtgatggcctggctcacctgg

SEQ ID NO: 142781 - DNA, 22 bp, Artificial Sequence
  Synthetic oligonucleotide; TTA chr11 5234067 5234088 5234072 5234067 -
gtgatggcctggctcacctgga

SEQ ID NO: 142782 - DNA, 22 bp, Artificial Sequence
  Synthetic oligonucleotide; CTG chr11 5234056 5234077 5234061 5234056 -
gctcacctggacaacctcaagg

SEQ ID NO: 142783 - DNA, 22 bp, Artificial Sequence
  Synthetic oligonucleotide; CTC chr11 5234052 5234073 5234057 5234052 -
acctggacaacctcaagggcac

SEQ ID NO: 142784 - DNA, 22 bp, Artificial Sequence
  Synthetic oligonucleotide; CTG chr11 5234047 5234068 5234052 5234047 -
gacaacctcaagggcacttttt

SEQ ID NO: 142785 - DNA, 22 bp, Artificial Sequence
  Synthetic oligonucleotide; CTC chr11 5234038 5234059 5234043 5234038 -
aagggcactttttctcagctga

SEQ ID NO: 142786 - DNA, 22 bp, Artificial Sequence
  Synthetic oligonucleotide; CTT chr11 5234028 5234049 5234033 5234028 -
tttctcagctgagtgagctgca

SEQ ID NO: 142787 - DNA, 22 bp, Artificial Sequence
  Synthetic oligonucleotide; TTT chr11 5234027 5234048 5234032 5234027 -
ttctcagctgagtgagctgcac

SEQ ID NO: 142788 - DNA, 22 bp, Artificial Sequence
  Synthetic oligonucleotide; TTT chr11 5234026 5234047 5234031 5234026 -
tctcagctgagtgagctgcact

SEQ ID NO: 142789 - DNA, 22 bp, Artificial Sequence
  Synthetic oligonucleotide; TTT chr11 5234025 5234046 5234030 5234025 -
ctcagctgagtgagctgcactg

SEQ ID NO: 142790 - DNA, 22 bp, Artificial Sequence
  Synthetic oligonucleotide; TTC chr11 5234024 5234045 5234029 5234024 -
tcagctgagtgagctgcactgt

SEQ ID NO: 142791 - DNA, 22 bp, Artificial Sequence
  Synthetic oligonucleotide; CTC chr11 5234022 5234043 5234027 5234022 -
agctgagtgagctgcactgtga

SEQ ID NO: 142792 - DNA, 22 bp, Artificial Sequence
  Synthetic oligonucleotide; CTG chr11 5234017 5234038 5234022 5234017 -
agtgagctgcactgtgacaagc

SEQ ID NO: 142793 - DNA, 22 bp, Artificial Sequence
  Synthetic oligonucleotide; CTG chr11 5234008 5234029 5234013 5234008 -
cactgtgacaagctgcacgtgg

SEQ ID NO: 142794 - DNA, 22 bp, Artificial Sequence
  Synthetic oligonucleotide; CTG chr11 5234003 5234024 5234008 5234003 -
tgacaagctgcacgtggatcct

SEQ ID NO: 142795 - DNA, 22 bp, Artificial Sequence
  Synthetic oligonucleotide; CTG chr11 5233993 5234014 5233998 5233993 -
cacgtggatcctgagaacttca

SEQ ID NO: 142796 - DNA, 22 bp, Artificial Sequence
  Synthetic oligonucleotide; CTG chr11 5233980 5234001 5233985 5233980 -
agaacttcagggtgagtccagg

SEQ ID NO: 142797 - DNA, 22 bp, Artificial Sequence
  Synthetic oligonucleotide; CTT chr11 5233973 5233994 5233978 5233973 -
cagggtgagtccaggagatgct

SEQ ID NO: 142798 - DNA, 22 bp, Artificial Sequence
  Synthetic oligonucleotide; TTC chr11 5233972 5233993 5233977 5233972 -
agggtgagtccaggagatgctt

SEQ ID NO: 142799 - DNA, 22 bp, Artificial Sequence
  Synthetic oligonucleotide; CTT chr11 5233950 5233971 5233955 5233950 -
cacttttctctttttactttct

SEQ ID NO: 142800 - DNA, 22 bp, Artificial Sequence
  Synthetic oligonucleotide; TTC chr11 5233949 5233970 5233954 5233949 -
acttttctctttttactttcta

SEQ ID NO: 142801 - DNA, 22 bp, Artificial Sequence
  Synthetic oligonucleotide; CTT chr11 5233945 5233966 5233950 5233945 -
ttctctttttactttctaatct

SEQ ID NO: 142802 - DNA, 22 bp, Artificial Sequence
  Synthetic oligonucleotide; TTT chr11 5233944 5233965 5233949 5233944 -
tctctttttactttctaatctt

SEQ ID NO: 142803 - DNA, 22 bp, Artificial Sequence
  Synthetic oligonucleotide; TTT chr11 5233943 5233964 5233948 5233943 -
ctctttttactttctaatctta

SEQ ID NO: 142804 - DNA, 22 bp, Artificial Sequence
  Synthetic oligonucleotide; TTC chr11 5233942 5233963 5233947 5233942 -
tctttttactttctaatcttac

SEQ ID NO: 142805 - DNA, 22 bp, Artificial Sequence
  Synthetic oligonucleotide; CTC chr11 5233940 5233961 5233945 5233940 -
tttttactttctaatcttacat

SEQ ID NO: 142806 - DNA, 22 bp, Artificial Sequence
  Synthetic oligonucleotide; CTT chr11 5233938 5233959 5233943 5233938 -
tttactttctaatcttacattt

SEQ ID NO: 142807 - DNA, 22 bp, Artificial Sequence
  Synthetic oligonucleotide; TTT chr11 5233937 5233958 5233942 5233937 -
ttactttctaatcttacatttt

SEQ ID NO: 142808 - DNA, 22 bp, Artificial Sequence
  Synthetic oligonucleotide; TTT chr11 5233936 5233957 5233941 5233936 -
tactttctaatcttacattttg

SEQ ID NO: 142809 - DNA, 22 bp, Artificial Sequence
  Synthetic oligonucleotide; TTT chr11 5233935 5233956 5233940 5233935 -
actttctaatcttacattttgg

SEQ ID NO: 142810 - DNA, 22 bp, Artificial Sequence
  Synthetic oligonucleotide; TTA chr11 5233934 5233955 5233939 5233934 -
ctttctaatcttacattttggt

SEQ ID NO: 142811 - DNA, 22 bp, Artificial Sequence
  Synthetic oligonucleotide; CTT chr11 5233931 5233952 5233936 5233931 -
tctaatcttacattttggttct

SEQ ID NO: 142812 - DNA, 22 bp, Artificial Sequence
  Synthetic oligonucleotide; TTT chr11 5233930 5233951 5233935 5233930 -
ctaatcttacattttggttctt

SEQ ID NO: 142813 - DNA, 22 bp, Artificial Sequence
  Synthetic oligonucleotide; TTC chr11 5233929 5233950 5233934 5233929 -
taatcttacattttggttcttt

SEQ ID NO: 142814 - DNA, 22 bp, Artificial Sequence
  Synthetic oligonucleotide; CTA chr11 5233927 5233948 5233932 5233927 -
atcttacattttggttctttta

SEQ ID NO: 142815 - DNA, 22 bp, Artificial Sequence
  Synthetic oligonucleotide; CTT chr11 5233922 5233943 5233927 5233922 -
acattttggttcttttacctac

SEQ ID NO: 142816 - DNA, 22 bp, Artificial Sequence
  Synthetic oligonucleotide; TTA chr11 5233921 5233942 5233926 5233921 -
cattttggttcttttacctacc

SEQ ID NO: 142817 - DNA, 22 bp, Artificial Sequence
  Synthetic oligonucleotide; TTT chr11 5233916 5233937 5233921 5233916 -
tggttcttttacctacctgctc

SEQ ID NO: 142818 - DNA, 22 bp, Artificial Sequence
  Synthetic oligonucleotide; TTT chr11 5233915 5233936 5233920 5233915 -
ggttcttttacctacctgctct

SEQ ID NO: 142819 - DNA, 22 bp, Artificial Sequence
  Synthetic oligonucleotide; TTG chr11 5233914 5233935 5233919 5233914 -
gttcttttacctacctgctctt

SEQ ID NO: 142820 - DNA, 22 bp, Artificial Sequence
  Synthetic oligonucleotide; TTC chr11 5233910 5233931 5233915 5233910 -
ttttacctacctgctcttctcc

SEQ ID NO: 142821 - DNA, 22 bp, Artificial Sequence
  Synthetic oligonucleotide; CTT chr11 5233908 5233929 5233913 5233908 -
ttacctacctgctcttctccca

SEQ ID NO: 142822 - DNA, 22 bp, Artificial Sequence
  Synthetic oligonucleotide; TTT chr11 5233907 5233928 5233912 5233907 -
tacctacctgctcttctcccac

SEQ ID NO: 142823 - DNA, 22 bp, Artificial Sequence
  Synthetic oligonucleotide; TTT chr11 5233906 5233927 5233911 5233906 -
acctacctgctcttctcccaca

SEQ ID NO: 142824 - DNA, 22 bp, Artificial Sequence
  Synthetic oligonucleotide; TTA chr11 5233905 5233926 5233910 5233905 -
cctacctgctcttctcccacat

SEQ ID NO: 142825 - DNA, 22 bp, Artificial Sequence
  Synthetic oligonucleotide; CTA chr11 5233901 5233922 5233906 5233901 -
cctgctcttctcccacattttt

SEQ ID NO: 142826 - DNA, 22 bp, Artificial Sequence
  Synthetic oligonucleotide; CTG chr11 5233897 5233918 5233902 5233897 -
ctcttctcccacatttttgtca

SEQ ID NO: 142827 - DNA, 22 bp, Artificial Sequence
  Synthetic oligonucleotide; CTC chr11 5233894 5233915 5233899 5233894 -
ttctcccacatttttgtcattt

SEQ ID NO: 142828 - DNA, 22 bp, Artificial Sequence
  Synthetic oligonucleotide; CTT chr11 5233892 5233913 5233897 5233892 -
ctcccacatttttgtcatttta

SEQ ID NO: 142829 - DNA, 22 bp, Artificial Sequence
  Synthetic oligonucleotide; TTC chr11 5233891 5233912 5233896 5233891 -
tcccacatttttgtcattttac

SEQ ID NO: 142830 - DNA, 22 bp, Artificial Sequence
  Synthetic oligonucleotide; CTC chr11 5233889 5233910 5233894 5233889 -
ccacatttttgtcattttacta

SEQ ID NO: 142831 - DNA, 22 bp, Artificial Sequence
  Synthetic oligonucleotide; TTT chr11 5233881 5233902 5233886 5233881 -
ttgtcattttactatattttat

SEQ ID NO: 142832 - DNA, 22 bp, Artificial Sequence
  Synthetic oligonucleotide; TTT chr11 5233880 5233901 5233885 5233880 -
tgtcattttactatattttatc

SEQ ID NO: 142833 - DNA, 22 bp, Artificial Sequence
  Synthetic oligonucleotide; TTT chr11 5233879 5233900 5233884 5233879 -
gtcattttactatattttatca

SEQ ID NO: 142834 - DNA, 22 bp, Artificial Sequence
  Synthetic oligonucleotide; TTG chr11 5233878 5233899 5233883 5233878 -
tcattttactatattttatcat

SEQ ID NO: 142835 - DNA, 22 bp, Artificial Sequence
  Synthetic oligonucleotide; TTT chr11 5233872 5233893 5233877 5233872 -
tactatattttatcatttaatg

SEQ ID NO: 142836 - DNA, 22 bp, Artificial Sequence
  Synthetic oligonucleotide; TTT chr11 5233871 5233892 5233876 5233871 -
actatattttatcatttaatgc

SEQ ID NO: 142837 - DNA, 22 bp, Artificial Sequence
  Synthetic oligonucleotide; TTA chr11 5233870 5233891 5233875 5233870 -
ctatattttatcatttaatgct

SEQ ID NO: 142838 - DNA, 22 bp, Artificial Sequence
  Synthetic oligonucleotide; CTA chr11 5233867 5233888 5233872 5233867 -
tattttatcatttaatgcttct

SEQ ID NO: 142839 - DNA, 22 bp, Artificial Sequence
  Synthetic oligonucleotide; TTT chr11 5233862 5233883 5233867 5233862 -
tatcatttaatgcttctaaaat

SEQ ID NO: 142840 - DNA, 22 bp, Artificial Sequence
  Synthetic oligonucleotide; TTT chr11 5233861 5233882 5233866 5233861 -
atcatttaatgcttctaaaatt

SEQ ID NO: 142841 - DNA, 22 bp, Artificial Sequence
  Synthetic oligonucleotide; TTA chr11 5233860 5233881 5233865 5233860 -
tcatttaatgcttctaaaattt

SEQ ID NO: 142842 - DNA, 22 bp, Artificial Sequence
  Synthetic oligonucleotide; TTT chr11 5233854 5233875 5233859 5233854 -
aatgcttctaaaattttgttaa

SEQ ID NO: 142843 - DNA, 22 bp, Artificial Sequence
  Synthetic oligonucleotide; TTA chr11 5233853 5233874 5233858 5233853 -
atgcttctaaaattttgttaat

SEQ ID NO: 142844 - DNA, 22 bp, Artificial Sequence
  Synthetic oligonucleotide; CTT chr11 5233847 5233868 5233852 5233847 -
ctaaaattttgttaatttttta

SEQ ID NO: 142845 - DNA, 22 bp, Artificial Sequence
  Synthetic oligonucleotide; TTC chr11 5233846 5233867 5233851 5233846 -
taaaattttgttaattttttat

SEQ ID NO: 142846 - DNA, 22 bp, Artificial Sequence
  Synthetic oligonucleotide; CTA chr11 5233844 5233865 5233849 5233844 -
aaattttgttaattttttattt

SEQ ID NO: 142847 - DNA, 22 bp, Artificial Sequence
  Synthetic oligonucleotide; TTT chr11 5233838 5233859 5233843 5233838 -
tgttaattttttatttaaatat

SEQ ID NO: 142848 - DNA, 22 bp, Artificial Sequence
  Synthetic oligonucleotide; TTT chr11 5233837 5233858 5233842 5233837 -
gttaattttttatttaaatatt

SEQ ID NO: 142849 - DNA, 22 bp, Artificial Sequence
  Synthetic oligonucleotide; TTG chr11 5233836 5233857 5233841 5233836 -
ttaattttttatttaaatattc

SEQ ID NO: 142850 - DNA, 22 bp, Artificial Sequence
  Synthetic oligonucleotide; TTA chr11 5233833 5233854 5233838 5233833 -
attttttatttaaatattctgc

SEQ ID NO: 142851 - DNA, 22 bp, Artificial Sequence
  Synthetic oligonucleotide; TTT chr11 5233829 5233850 5233834 5233829 -
tttatttaaatattctgcattt

SEQ ID NO: 142852 - DNA, 22 bp, Artificial Sequence
  Synthetic oligonucleotide; TTT chr11 5233828 5233849 5233833 5233828 -
ttatttaaatattctgcatttt

SEQ ID NO: 142853 - DNA, 22 bp, Artificial Sequence
  Synthetic oligonucleotide; TTT chr11 5233827 5233848 5233832 5233827 -
tatttaaatattctgcattttt

SEQ ID NO: 142854 - DNA, 22 bp, Artificial Sequence
  Synthetic oligonucleotide; TTT chr11 5233826 5233847 5233831 5233826 -
atttaaatattctgcatttttt

SEQ ID NO: 142855 - DNA, 22 bp, Artificial Sequence
  Synthetic oligonucleotide; TTA chr11 5233825 5233846 5233830 5233825 -
tttaaatattctgcattttttc

SEQ ID NO: 142856 - DNA, 22 bp, Artificial Sequence
  Synthetic oligonucleotide; TTT chr11 5233822 5233843 5233827 5233822 -
aaatattctgcattttttcctt

SEQ ID NO: 142857 - DNA, 22 bp, Artificial Sequence
  Synthetic oligonucleotide; TTA chr11 5233821 5233842 5233826 5233821 -
aatattctgcattttttccttc

SEQ ID NO: 142858 - DNA, 22 bp, Artificial Sequence
  Synthetic oligonucleotide; TTC chr11 5233814 5233835 5233819 5233814 -
tgcattttttccttcctcacaa

SEQ ID NO: 142859 - DNA, 22 bp, Artificial Sequence
  Synthetic oligonucleotide; CTG chr11 5233812 5233833 5233817 5233812 -
cattttttccttcctcacaatc

SEQ ID NO: 142860 - DNA, 22 bp, Artificial Sequence
  Synthetic oligonucleotide; TTT chr11 5233807 5233828 5233812 5233807 -
tttccttcctcacaatcttgct

SEQ ID NO: 142861 - DNA, 22 bp, Artificial Sequence
  Synthetic oligonucleotide; TTT chr11 5233806 5233827 5233811 5233806 -
ttccttcctcacaatcttgcta

SEQ ID NO: 142862 - DNA, 22 bp, Artificial Sequence
  Synthetic oligonucleotide; TTT chr11 5233805 5233826 5233810 5233805 -
tccttcctcacaatcttgctat

SEQ ID NO: 142863 - DNA, 22 bp, Artificial Sequence
  Synthetic oligonucleotide; TTT chr11 5233804 5233825 5233809 5233804 -
ccttcctcacaatcttgctatt

SEQ ID NO: 142864 - DNA, 22 bp, Artificial Sequence
  Synthetic oligonucleotide; TTC chr11 5233803 5233824 5233808 5233803 -
cttcctcacaatcttgctattt

SEQ ID NO: 142865 - DNA, 22 bp, Artificial Sequence
  Synthetic oligonucleotide; CTT chr11 5233800 5233821 5233805 5233800 -
cctcacaatcttgctattttaa

SEQ ID NO: 142866 - DNA, 22 bp, Artificial Sequence
  Synthetic oligonucleotide; TTC chr11 5233799 5233820 5233804 5233799 -
ctcacaatcttgctattttaaa

SEQ ID NO: 142867 - DNA, 22 bp, Artificial Sequence
  Synthetic oligonucleotide; CTC chr11 5233796 5233817 5233801 5233796 -
acaatcttgctattttaaatta

SEQ ID NO: 142868 - DNA, 22 bp, Artificial Sequence
  Synthetic oligonucleotide; CTT chr11 5233788 5233809 5233793 5233788 -
gctattttaaattatttaatat

SEQ ID NO: 142869 - DNA, 22 bp, Artificial Sequence
  Synthetic oligonucleotide; TTG chr11 5233787 5233808 5233792 5233787 -
ctattttaaattatttaatatc

SEQ ID NO: 142870 - DNA, 22 bp, Artificial Sequence
  Synthetic oligonucleotide; CTA chr11 5233784 5233805 5233789 5233784 -
ttttaaattatttaatatcctg

SEQ ID NO: 142871 - DNA, 22 bp, Artificial Sequence
  Synthetic oligonucleotide; TTT chr11 5233781 5233802 5233786 5233781 -
taaattatttaatatcctgtct

SEQ ID NO: 142872 - DNA, 22 bp, Artificial Sequence
  Synthetic oligonucleotide; TTT chr11 5233780 5233801 5233785 5233780 -
aaattatttaatatcctgtctt

SEQ ID NO: 142873 - DNA, 22 bp, Artificial Sequence
  Synthetic oligonucleotide; TTA chr11 5233779 5233800 5233784 5233779 -
aattatttaatatcctgtcttt

SEQ ID NO: 142874 - DNA, 22 bp, Artificial Sequence
  Synthetic oligonucleotide; TTA chr11 5233774 5233795 5233779 5233774 -
tttaatatcctgtctttctctc

SEQ ID NO: 142875 - DNA, 22 bp, Artificial Sequence
  Synthetic oligonucleotide; TTT chr11 5233771 5233792 5233776 5233771 -
aatatcctgtctttctctccca

SEQ ID NO: 142876 - DNA, 22 bp, Artificial Sequence
  Synthetic oligonucleotide; TTA chr11 5233770 5233791 5233775 5233770 -
atatcctgtctttctctcccaa

SEQ ID NO: 142877 - DNA, 22 bp, Artificial Sequence
  Synthetic oligonucleotide; CTG chr11 5233762 5233783 5233767 5233762 -
tctttctctcccaaccccctcc

SEQ ID NO: 142878 - DNA, 22 bp, Artificial Sequence
  Synthetic oligonucleotide; CTT chr11 5233758 5233779 5233763 5233758 -
tctctcccaaccccctcccttc

SEQ ID NO: 142879 - DNA, 22 bp, Artificial Sequence
  Synthetic oligonucleotide; TTT chr11 5233757 5233778 5233762 5233757 -
ctctcccaaccccctcccttca

SEQ ID NO: 142880 - DNA, 22 bp, Artificial Sequence
  Synthetic oligonucleotide; TTC chr11 5233756 5233777 5233761 5233756 -
tctcccaaccccctcccttcat

SEQ ID NO: 142881 - DNA, 22 bp, Artificial Sequence
  Synthetic oligonucleotide; CTC chr11 5233754 5233775 5233759 5233754 -
tcccaaccccctcccttcattt

SEQ ID NO: 142882 - DNA, 22 bp, Artificial Sequence
  Synthetic oligonucleotide; CTC chr11 5233752 5233773 5233757 5233752 -
ccaaccccctcccttcattttt

SEQ ID NO: 142883 - DNA, 22 bp, Artificial Sequence
  Synthetic oligonucleotide; CTC chr11 5233741 5233762 5233746 5233741 -
ccttcatttttccttctctaac

SEQ ID NO: 142884 - DNA, 22 bp, Artificial Sequence
  Synthetic oligonucleotide; CTT chr11 5233737 5233758 5233742 5233737 -
catttttccttctctaacaaca

SEQ ID NO: 142885 - DNA, 22 bp, Artificial Sequence
  Synthetic oligonucleotide; TTC chr11 5233736 5233757 5233741 5233736 -
atttttccttctctaacaacaa

SEQ ID NO: 142886 - DNA, 22 bp, Artificial Sequence
  Synthetic oligonucleotide; TTT chr11 5233732 5233753 5233737 5233732 -
ttccttctctaacaacaactca

SEQ ID NO: 142887 - DNA, 22 bp, Artificial Sequence
  Synthetic oligonucleotide; TTT chr11 5233731 5233752 5233736 5233731 -
tccttctctaacaacaactcaa

SEQ ID NO: 142888 - DNA, 22 bp, Artificial Sequence
  Synthetic oligonucleotide; TTT chr11 5233730 5233751 5233735 5233730 -
ccttctctaacaacaactcaaa

SEQ ID NO: 142889 - DNA, 22 bp, Artificial Sequence
  Synthetic oligonucleotide; TTC chr11 5233729 5233750 5233734 5233729 -
cttctctaacaacaactcaaat

SEQ ID NO: 142890 - DNA, 22 bp, Artificial Sequence
  Synthetic oligonucleotide; CTT chr11 5233726 5233747 5233731 5233726 -
ctctaacaacaactcaaattat

SEQ ID NO: 142891 - DNA, 22 bp, Artificial Sequence
  Synthetic oligonucleotide; TTC chr11 5233725 5233746 5233730 5233725 -
tctaacaacaactcaaattatg

SEQ ID NO: 142892 - DNA, 22 bp, Artificial Sequence
  Synthetic oligonucleotide; CTC chr11 5233723 5233744 5233728 5233723 -
taacaacaactcaaattatgca

SEQ ID NO: 142893 - DNA, 22 bp, Artificial Sequence
  Synthetic oligonucleotide; CTA chr11 5233721 5233742 5233726 5233721 -
acaacaactcaaattatgcata

SEQ ID NO: 142894 - DNA, 22 bp, Artificial Sequence
  Synthetic oligonucleotide; CTC chr11 5233711 5233732 5233716 5233711 -
aaattatgcataccagctctca

SEQ ID NO: 142895 - DNA, 22 bp, Artificial Sequence
  Synthetic oligonucleotide; TTA chr11 5233705 5233726 5233710 5233705 -
tgcataccagctctcacctgct

SEQ ID NO: 142896 - DNA, 22 bp, Artificial Sequence
  Synthetic oligonucleotide; CTC chr11 5233692 5233713 5233697 5233692 -
tcacctgctaattctgcactta

SEQ ID NO: 142897 - DNA, 22 bp, Artificial Sequence
  Synthetic oligonucleotide; CTC chr11 5233690 5233711 5233695 5233690 -
acctgctaattctgcacttaga

SEQ ID NO: 142898 - DNA, 22 bp, Artificial Sequence
  Synthetic oligonucleotide; CTG chr11 5233685 5233706 5233690 5233685 -
ctaattctgcacttagaataat

SEQ ID NO: 142899 - DNA, 22 bp, Artificial Sequence
  Synthetic oligonucleotide; CTA chr11 5233682 5233703 5233687 5233682 -
attctgcacttagaataatcct

SEQ ID NO: 142900 - DNA, 22 bp, Artificial Sequence
  Synthetic oligonucleotide; TTC chr11 5233678 5233699 5233683 5233678 -
tgcacttagaataatccttttg

SEQ ID NO: 142901 - DNA, 22 bp, Artificial Sequence
  Synthetic oligonucleotide; CTG chr11 5233676 5233697 5233681 5233676 -
cacttagaataatccttttgtc

SEQ ID NO: 142902 - DNA, 22 bp, Artificial Sequence
  Synthetic oligonucleotide; CTT chr11 5233671 5233692 5233676 5233671 -
agaataatccttttgtctctcc

SEQ ID NO: 142903 - DNA, 22 bp, Artificial Sequence
  Synthetic oligonucleotide; TTA chr11 5233670 5233691 5233675 5233670 -
gaataatccttttgtctctcca

SEQ ID NO: 142904 - DNA, 22 bp, Artificial Sequence
  Synthetic oligonucleotide; CTT chr11 5233659 5233680 5233664 5233659 -
ttgtctctccacatgggtatgg

SEQ ID NO: 142905 - DNA, 22 bp, Artificial Sequence
  Synthetic oligonucleotide; TTT chr11 5233658 5233679 5233663 5233658 -
tgtctctccacatgggtatggg

SEQ ID NO: 142906 - DNA, 22 bp, Artificial Sequence
  Synthetic oligonucleotide; TTT chr11 5233657 5233678 5233662 5233657 -
gtctctccacatgggtatggga

SEQ ID NO: 142907 - DNA, 22 bp, Artificial Sequence
  Synthetic oligonucleotide; TTG chr11 5233656 5233677 5233661 5233656 -
tctctccacatgggtatgggag

SEQ ID NO: 142908 - DNA, 22 bp, Artificial Sequence
  Synthetic oligonucleotide; CTC chr11 5233652 5233673 5233657 5233652 -
tccacatgggtatgggagaggc

SEQ ID NO: 142909 - DNA, 22 bp, Artificial Sequence
  Synthetic oligonucleotide; CTC chr11 5233650 5233671 5233655 5233650 -
cacatgggtatgggagaggctc

SEQ ID NO: 142910 - DNA, 22 bp, Artificial Sequence
  Synthetic oligonucleotide; CTC chr11 5233628 5233649 5233633 5233628 -
caactcaaagatgagaggcata

SEQ ID NO: 142911 - DNA, 22 bp, Artificial Sequence
  Synthetic oligonucleotide; CTC chr11 5233622 5233643 5233627 5233622 -
aaagatgagaggcatagaatac

SEQ ID NO: 142912 - DNA, 22 bp, Artificial Sequence
  Synthetic oligonucleotide; CTG chr11 5233598 5233619 5233603 5233598 -
ttttagaggctataaatcattt

SEQ ID NO: 142913 - DNA, 22 bp, Artificial Sequence
  Synthetic oligonucleotide; TTT chr11 5233595 5233616 5233600 5233595 -
tagaggctataaatcattttac

SEQ ID NO: 142914 - DNA, 22 bp, Artificial Sequence
  Synthetic oligonucleotide; TTT chr11 5233594 5233615 5233599 5233594 -
agaggctataaatcattttaca

SEQ ID NO: 142915 - DNA, 22 bp, Artificial Sequence
  Synthetic oligonucleotide; TTA chr11 5233593 5233614 5233598 5233593 -
gaggctataaatcattttacaa

SEQ ID NO: 142916 - DNA, 22 bp, Artificial Sequence
  Synthetic oligonucleotide; CTA chr11 5233586 5233607 5233591 5233586 -
taaatcattttacaataaggaa

SEQ ID NO: 142917 - DNA, 22 bp, Artificial Sequence
  Synthetic oligonucleotide; TTT chr11 5233576 5233597 5233581 5233576 -
tacaataaggaataattggaat

SEQ ID NO: 142918 - DNA, 22 bp, Artificial Sequence
  Synthetic oligonucleotide; TTT chr11 5233575 5233596 5233580 5233575 -
acaataaggaataattggaatt

SEQ ID NO: 142919 - DNA, 22 bp, Artificial Sequence
  Synthetic oligonucleotide; TTA chr11 5233574 5233595 5233579 5233574 -
caataaggaataattggaattt

SEQ ID NO: 142920 - DNA, 22 bp, Artificial Sequence
  Synthetic oligonucleotide; TTG chr11 5233558 5233579 5233563 5233558 -
gaattttataaattctgtagta

SEQ ID NO: 142921 - DNA, 22 bp, Artificial Sequence
  Synthetic oligonucleotide; TTT chr11 5233552 5233573 5233557 5233552 -
tataaattctgtagtaaatgga

SEQ ID NO: 142922 - DNA, 22 bp, Artificial Sequence
  Synthetic oligonucleotide; TTT chr11 5233551 5233572 5233556 5233551 -
ataaattctgtagtaaatggaa

SEQ ID NO: 142923 - DNA, 22 bp, Artificial Sequence
  Synthetic oligonucleotide; TTA chr11 5233550 5233571 5233555 5233550 -
taaattctgtagtaaatggaat

SEQ ID NO: 142924 - DNA, 22 bp, Artificial Sequence
  Synthetic oligonucleotide; TTC chr11 5233543 5233564 5233548 5233543 -
tgtagtaaatggaatggaaagg

SEQ ID NO: 142925 - DNA, 22 bp, Artificial Sequence
  Synthetic oligonucleotide; CTG chr11 5233541 5233562 5233546 5233541 -
tagtaaatggaatggaaaggaa

SEQ ID NO: 142926 - DNA, 22 bp, Artificial Sequence
  Synthetic oligonucleotide; TTT chr11 5233508 5233529 5233513 5233508 -
gattatgaaagactaggcagtt

SEQ ID NO: 142927 - DNA, 22 bp, Artificial Sequence
  Synthetic oligonucleotide; TTG chr11 5233507 5233528 5233512 5233507 -
attatgaaagactaggcagtta

SEQ ID NO: 142928 - DNA, 22 bp, Artificial Sequence
  Synthetic oligonucleotide; TTA chr11 5233503 5233524 5233508 5233503 -
tgaaagactaggcagttacact

SEQ ID NO: 142929 - DNA, 22 bp, Artificial Sequence
  Synthetic oligonucleotide; CTA chr11 5233493 5233514 5233498 5233493 -
ggcagttacactggaggtgggg

SEQ ID NO: 142930 - DNA, 22 bp, Artificial Sequence
  Synthetic oligonucleotide; TTA chr11 5233485 5233506 5233490 5233485 -
cactggaggtggggcagaagtc

SEQ ID NO: 142931 - DNA, 22 bp, Artificial Sequence
  Synthetic oligonucleotide; CTG chr11 5233480 5233501 5233485 5233480 -
gaggtggggcagaagtcgttgc

SEQ ID NO: 142932 - DNA, 22 bp, Artificial Sequence
  Synthetic oligonucleotide; TTG chr11 5233459 5233480 5233464 5233459 -
ctaggagacagcccatcatcac

SEQ ID NO: 142933 - DNA, 22 bp, Artificial Sequence
  Synthetic oligonucleotide; CTA chr11 5233456 5233477 5233461 5233456 -
ggagacagcccatcatcacact

SEQ ID NO: 142934 - DNA, 22 bp, Artificial Sequence
  Synthetic oligonucleotide; CTG chr11 5233433 5233454 5233438 5233433 -
attaatcaattaatttgtatct

SEQ ID NO: 142935 - DNA, 22 bp, Artificial Sequence
  Synthetic oligonucleotide; TTA chr11 5233429 5233450 5233434 5233429 -
atcaattaatttgtatctatta

SEQ ID NO: 142936 - DNA, 22 bp, Artificial Sequence
  Synthetic oligonucleotide; TTA chr11 5233421 5233442 5233426 5233421 -
atttgtatctattaatctgttt

SEQ ID NO: 142937 - DNA, 22 bp, Artificial Sequence
  Synthetic oligonucleotide; TTT chr11 5233417 5233438 5233422 5233417 -
gtatctattaatctgtttatag

SEQ ID NO: 142938 - DNA, 22 bp, Artificial Sequence
  Synthetic oligonucleotide; TTG chr11 5233416 5233437 5233421 5233416 -
tatctattaatctgtttatagt

SEQ ID NO: 142939 - DNA, 22 bp, Artificial Sequence
  Synthetic oligonucleotide; CTA chr11 5233410 5233431 5233415 5233410 -
ttaatctgtttatagtaattaa

SEQ ID NO: 142940 - DNA, 22 bp, Artificial Sequence
  Synthetic oligonucleotide; TTA chr11 5233407 5233428 5233412 5233407 -
atctgtttatagtaattaattt

SEQ ID NO: 142941 - DNA, 22 bp, Artificial Sequence
  Synthetic oligonucleotide; CTG chr11 5233402 5233423 5233407 5233402 -
tttatagtaattaatttgtata

SEQ ID NO: 142942 - DNA, 22 bp, Artificial Sequence
  Synthetic oligonucleotide; TTT chr11 5233399 5233420 5233404 5233399 -
atagtaattaatttgtatatgc

SEQ ID NO: 142943 - DNA, 22 bp, Artificial Sequence
  Synthetic oligonucleotide; TTA chr11 5233398 5233419 5233403 5233398 -
tagtaattaatttgtatatgct

SEQ ID NO: 142944 - DNA, 22 bp, Artificial Sequence
  Synthetic oligonucleotide; TTA chr11 5233389 5233410 5233394 5233389 -
atttgtatatgctatatacaca

SEQ ID NO: 142945 - DNA, 22 bp, Artificial Sequence
  Synthetic oligonucleotide; TTT chr11 5233385 5233406 5233390 5233385 -
gtatatgctatatacacataca

SEQ ID NO: 142946 - DNA, 22 bp, Artificial Sequence
  Synthetic oligonucleotide; TTG chr11 5233384 5233405 5233389 5233384 -
tatatgctatatacacatacaa

SEQ ID NO: 142947 - DNA, 22 bp, Artificial Sequence
  Synthetic oligonucleotide; CTA chr11 5233375 5233396 5233380 5233375 -
tatacacatacaaaattaaaac

SEQ ID NO: 142948 - DNA, 22 bp, Artificial Sequence
  Synthetic oligonucleotide; TTA chr11 5233357 5233378 5233362 5233357 -
aaactaatttggaattaatttg

SEQ ID NO: 142949 - DNA, 22 bp, Artificial Sequence
  Synthetic oligonucleotide; CTA chr11 5233351 5233372 5233356 5233351 -
atttggaattaatttgtatata

SEQ ID NO: 142950 - DNA, 22 bp, Artificial Sequence
  Synthetic oligonucleotide; TTT chr11 5233347 5233368 5233352 5233347 -
ggaattaatttgtatatagtat

SEQ ID NO: 142951 - DNA, 22 bp, Artificial Sequence
  Synthetic oligonucleotide; TTG chr11 5233346 5233367 5233351 5233346 -
gaattaatttgtatatagtatt

SEQ ID NO: 142952 - DNA, 22 bp, Artificial Sequence
  Synthetic oligonucleotide; TTA chr11 5233340 5233361 5233345 5233340 -
atttgtatatagtattatacag

SEQ ID NO: 142953 - DNA, 22 bp, Artificial Sequence
  Synthetic oligonucleotide; TTT chr11 5233336 5233357 5233341 5233336 -
gtatatagtattatacagcata

SEQ ID NO: 142954 - DNA, 22 bp, Artificial Sequence
  Synthetic oligonucleotide; TTG chr11 5233335 5233356 5233340 5233335 -
tatatagtattatacagcatat

SEQ ID NO: 142955 - DNA, 22 bp, Artificial Sequence
  Synthetic oligonucleotide; TTA chr11 5233323 5233344 5233328 5233323 -
tacagcatatatagcatatatg

SEQ ID NO: 142956 - DNA, 22 bp, Artificial Sequence
  Synthetic oligonucleotide; CTA chr11 5233286 5233307 5233291 5233286 -
catgctagttaagtacatagag

SEQ ID NO: 142957 - DNA, 22 bp, Artificial Sequence
  Synthetic oligonucleotide; CTA chr11 5233279 5233300 5233284 5233279 -
gttaagtacatagaggatgtgt

SEQ ID NO: 142958 - DNA, 22 bp, Artificial Sequence
  Synthetic oligonucleotide; TTA chr11 5233275 5233296 5233280 5233275 -
agtacatagaggatgtgtgtgt

SEQ ID NO: 142959 - DNA, 22 bp, Artificial Sequence
  Synthetic oligonucleotide; TTA chr11 5233239 5233260 5233244 5233239 -
tatgtatgcattcatatatgta

SEQ ID NO: 142960 - DNA, 22 bp, Artificial Sequence
  Synthetic oligonucleotide; TTC chr11 5233226 5233247 5233231 5233226 -
atatatgtacttatttatgctg

SEQ ID NO: 142961 - DNA, 22 bp, Artificial Sequence
  Synthetic oligonucleotide; CTT chr11 5233214 5233235 5233219 5233214 -
atttatgctgatgggaataacc

SEQ ID NO: 142962 - DNA, 22 bp, Artificial Sequence
  Synthetic oligonucleotide; TTA chr11 5233213 5233234 5233218 5233213 -
tttatgctgatgggaataacct

SEQ ID NO: 142963 - DNA, 22 bp, Artificial Sequence
  Synthetic oligonucleotide; TTT chr11 5233210 5233231 5233215 5233210 -
atgctgatgggaataacctggg

SEQ ID NO: 142964 - DNA, 22 bp, Artificial Sequence
  Synthetic oligonucleotide; TTA chr11 5233209 5233230 5233214 5233209 -
tgctgatgggaataacctgggg

SEQ ID NO: 142965 - DNA, 22 bp, Artificial Sequence
  Synthetic oligonucleotide; CTG chr11 5233204 5233225 5233209 5233204 -
atgggaataacctggggatcag

SEQ ID NO: 142966 - DNA, 22 bp, Artificial Sequence
  Synthetic oligonucleotide; CTG chr11 5233190 5233211 5233195 5233190 -
gggatcagttttgtctaagatt

SEQ ID NO: 142967 - DNA, 22 bp, Artificial Sequence
  Synthetic oligonucleotide; TTT chr11 5233179 5233200 5233184 5233179 -
tgtctaagatttgggcagaaaa

SEQ ID NO: 142968 - DNA, 22 bp, Artificial Sequence
  Synthetic oligonucleotide; TTT chr11 5233178 5233199 5233183 5233178 -
gtctaagatttgggcagaaaaa

SEQ ID NO: 142969 - DNA, 22 bp, Artificial Sequence
  Synthetic oligonucleotide; TTG chr11 5233177 5233198 5233182 5233177 -
tctaagatttgggcagaaaaaa

SEQ ID NO: 142970 - DNA, 22 bp, Artificial Sequence
  Synthetic oligonucleotide; CTA chr11 5233173 5233194 5233178 5233173 -
agatttgggcagaaaaaaatgg

SEQ ID NO: 142971 - DNA, 22 bp, Artificial Sequence
  Synthetic oligonucleotide; TTT chr11 5233167 5233188 5233172 5233167 -
gggcagaaaaaaatgggtgttg

SEQ ID NO: 142972 - DNA, 22 bp, Artificial Sequence
  Synthetic oligonucleotide; TTG chr11 5233166 5233187 5233171 5233166 -
ggcagaaaaaaatgggtgttgg

SEQ ID NO: 142973 - DNA, 22 bp, Artificial Sequence
  Synthetic oligonucleotide; TTG chr11 5233145 5233166 5233150 5233145 -
gctcagtttctcagaagccagt

SEQ ID NO: 142974 - DNA, 22 bp, Artificial Sequence
  Synthetic oligonucleotide; CTC chr11 5233141 5233162 5233146 5233141 -
agtttctcagaagccagtcttt

SEQ ID NO: 142975 - DNA, 22 bp, Artificial Sequence
  Synthetic oligonucleotide; TTT chr11 5233136 5233157 5233141 5233136 -
ctcagaagccagtctttatttc

SEQ ID NO: 142976 - DNA, 22 bp, Artificial Sequence
  Synthetic oligonucleotide; TTC chr11 5233135 5233156 5233140 5233135 -
tcagaagccagtctttatttct

SEQ ID NO: 142977 - DNA, 22 bp, Artificial Sequence
  Synthetic oligonucleotide; CTC chr11 5233133 5233154 5233138 5233133 -
agaagccagtctttatttctct

SEQ ID NO: 142978 - DNA, 22 bp, Artificial Sequence
  Synthetic oligonucleotide; CTT chr11 5233120 5233141 5233125 5233120 -
tatttctctgttaaccatatgc

SEQ ID NO: 142979 - DNA, 22 bp, Artificial Sequence
  Synthetic oligonucleotide; TTT chr11 5233119 5233140 5233124 5233119 -
atttctctgttaaccatatgca

SEQ ID NO: 142980 - DNA, 22 bp, Artificial Sequence
  Synthetic oligonucleotide; TTA chr11 5233118 5233139 5233123 5233118 -
tttctctgttaaccatatgcat

SEQ ID NO: 142981 - DNA, 22 bp, Artificial Sequence
  Synthetic oligonucleotide; TTT chr11 5233115 5233136 5233120 5233115 -
ctctgttaaccatatgcatgta

SEQ ID NO: 142982 - DNA, 22 bp, Artificial Sequence
  Synthetic oligonucleotide; TTC chr11 5233114 5233135 5233119 5233114 -
tctgttaaccatatgcatgtat

SEQ ID NO: 142983 - DNA, 22 bp, Artificial Sequence
  Synthetic oligonucleotide; CTC chr11 5233112 5233133 5233117 5233112 -
tgttaaccatatgcatgtatct

SEQ ID NO: 142984 - DNA, 22 bp, Artificial Sequence
  Synthetic oligonucleotide; CTG chr11 5233110 5233131 5233115 5233110 -
ttaaccatatgcatgtatctgc

SEQ ID NO: 142985 - DNA, 22 bp, Artificial Sequence
  Synthetic oligonucleotide; TTA chr11 5233107 5233128 5233112 5233107 -
accatatgcatgtatctgccta

SEQ ID NO: 142986 - DNA, 22 bp, Artificial Sequence
  Synthetic oligonucleotide; CTG chr11 5233089 5233110 5233094 5233089 -
cctacctcttctccgcagctct

SEQ ID NO: 142987 - DNA, 22 bp, Artificial Sequence
  Synthetic oligonucleotide; CTA chr11 5233085 5233106 5233090 5233085 -
cctcttctccgcagctcttggg

SEQ ID NO: 142988 - DNA, 22 bp, Artificial Sequence
  Synthetic oligonucleotide; CTC chr11 5233081 5233102 5233086 5233081 -
ttctccgcagctcttgggcaat

SEQ ID NO: 142989 - DNA, 22 bp, Artificial Sequence
  Synthetic oligonucleotide; CTT chr11 5233079 5233100 5233084 5233079 -
ctccgcagctcttgggcaatgt

SEQ ID NO: 142990 - DNA, 22 bp, Artificial Sequence
  Synthetic oligonucleotide; TTC chr11 5233078 5233099 5233083 5233078 -
tccgcagctcttgggcaatgtg

SEQ ID NO: 142991 - DNA, 22 bp, Artificial Sequence
  Synthetic oligonucleotide; CTC chr11 5233076 5233097 5233081 5233076 -
cgcagctcttgggcaatgtgct

SEQ ID NO: 142992 - DNA, 22 bp, Artificial Sequence
  Synthetic oligonucleotide; CTC chr11 5233068 5233089 5233073 5233068 -
ttgggcaatgtgctggtgtgtg

SEQ ID NO: 142993 - DNA, 22 bp, Artificial Sequence
  Synthetic oligonucleotide; CTT chr11 5233066 5233087 5233071 5233066 -
gggcaatgtgctggtgtgtgtg

SEQ ID NO: 142994 - DNA, 22 bp, Artificial Sequence
  Synthetic oligonucleotide; TTG chr11 5233065 5233086 5233070 5233065 -
ggcaatgtgctggtgtgtgtgc

SEQ ID NO: 142995 - DNA, 22 bp, Artificial Sequence
  Synthetic oligonucleotide; CTG chr11 5233053 5233074 5233058 5233053 -
gtgtgtgtgctggcccgcaact

SEQ ID NO: 142996 - DNA, 22 bp, Artificial Sequence
  Synthetic oligonucleotide; CTG chr11 5233041 5233062 5233046 5233041 -
gcccgcaactttggcaaggaat

SEQ ID NO: 142997 - DNA, 22 bp, Artificial Sequence
  Synthetic oligonucleotide; CTT chr11 5233030 5233051 5233035 5233030 -
tggcaaggaattcaccccacaa

SEQ ID NO: 142998 - DNA, 22 bp, Artificial Sequence
  Synthetic oligonucleotide; TTT chr11 5233029 5233050 5233034 5233029 -
ggcaaggaattcaccccacaaa

SEQ ID NO: 142999 - DNA, 22 bp, Artificial Sequence
  Synthetic oligonucleotide; TTG chr11 5233028 5233049 5233033 5233028 -
gcaaggaattcaccccacaaat

SEQ ID NO: 143000 - DNA, 22 bp, Artificial Sequence
  Synthetic oligonucleotide; TTC chr11 5233017 5233038 5233022 5233017 -
accccacaaatgcaggctgcct

SEQ ID NO: 143001 - DNA, 22 bp, Artificial Sequence
  Synthetic oligonucleotide; CTG chr11 5232998 5233019 5233003 5232998 -
cctatcagaaggtggtggctgg

SEQ ID NO: 143002 - DNA, 22 bp, Artificial Sequence
  Synthetic oligonucleotide; CTA chr11 5232994 5233015 5232999 5232994 -
tcagaaggtggtggctggtgtg

SEQ ID NO: 143003 - DNA, 22 bp, Artificial Sequence
  Synthetic oligonucleotide; CTG chr11 5232977 5232998 5232982 5232977 -
gtgtggctaatgccctggctca

SEQ ID NO: 143004 - DNA, 22 bp, Artificial Sequence
  Synthetic oligonucleotide; CTA chr11 5232968 5232989 5232973 5232968 -
atgccctggctcacaagtacca

SEQ ID NO: 143005 - DNA, 22 bp, Artificial Sequence
  Synthetic oligonucleotide; CTG chr11 5232960 5232981 5232965 5232960 -
gctcacaagtaccattgagatc

SEQ ID NO: 143006 - DNA, 22 bp, Artificial Sequence
  Synthetic oligonucleotide; CTC chr11 5232956 5232977 5232961 5232956 -
acaagtaccattgagatcctgg

SEQ ID NO: 143007 - DNA, 22 bp, Artificial Sequence
  Synthetic oligonucleotide; TTG chr11 5232943 5232964 5232948 5232943 -
agatcctggactgtttcctgat

SEQ ID NO: 143008 - DNA, 22 bp, Artificial Sequence
  Synthetic oligonucleotide; CTG chr11 5232935 5232956 5232940 5232935 -
gactgtttcctgataaccataa

SEQ ID NO: 143009 - DNA, 22 bp, Artificial Sequence
  Synthetic oligonucleotide; CTG chr11 5232930 5232951 5232935 5232930 -
tttcctgataaccataagaaga

SEQ ID NO: 143010 - DNA, 22 bp, Artificial Sequence
  Synthetic oligonucleotide; TTT chr11 5232927 5232948 5232932 5232927 -
cctgataaccataagaagaccc

SEQ ID NO: 143011 - DNA, 22 bp, Artificial Sequence
  Synthetic oligonucleotide; TTC chr11 5232926 5232947 5232931 5232926 -
ctgataaccataagaagaccct

SEQ ID NO: 143012 - DNA, 22 bp, Artificial Sequence
  Synthetic oligonucleotide; CTG chr11 5232923 5232944 5232928 5232923 -
ataaccataagaagaccctatt

SEQ ID NO: 143013 - DNA, 22 bp, Artificial Sequence
  Synthetic oligonucleotide; CTA chr11 5232903 5232924 5232908 5232903 -
tttccctagattctattttctg

SEQ ID NO: 143014 - DNA, 22 bp, Artificial Sequence
  Synthetic oligonucleotide; TTT chr11 5232900 5232921 5232905 5232900 -
ccctagattctattttctgaac

SEQ ID NO: 143015 - DNA, 22 bp, Artificial Sequence
  Synthetic oligonucleotide; TTC chr11 5232899 5232920 5232904 5232899 -
cctagattctattttctgaact

SEQ ID NO: 143016 - DNA, 22 bp, Artificial Sequence
  Synthetic oligonucleotide; CTA chr11 5232895 5232916 5232900 5232895 -
gattctattttctgaacttggg

SEQ ID NO: 143017 - DNA, 22 bp, Artificial Sequence
  Synthetic oligonucleotide; TTC chr11 5232890 5232911 5232895 5232890 -
tattttctgaacttgggaacac

SEQ ID NO: 143018 - DNA, 22 bp, Artificial Sequence
  Synthetic oligonucleotide; CTA chr11 5232888 5232909 5232893 5232888 -
ttttctgaacttgggaacacaa

SEQ ID NO: 143019 - DNA, 22 bp, Artificial Sequence
  Synthetic oligonucleotide; TTT chr11 5232885 5232906 5232890 5232885 -
tctgaacttgggaacacaatgc

SEQ ID NO: 143020 - DNA, 22 bp, Artificial Sequence
  Synthetic oligonucleotide; TTT chr11 5232884 5232905 5232889 5232884 -
ctgaacttgggaacacaatgcc

SEQ ID NO: 143021 - DNA, 22 bp, Artificial Sequence
  Synthetic oligonucleotide; TTC chr11 5232883 5232904 5232888 5232883 -
tgaacttgggaacacaatgcct

SEQ ID NO: 143022 - DNA, 22 bp, Artificial Sequence
  Synthetic oligonucleotide; CTG chr11 5232881 5232902 5232886 5232881 -
aacttgggaacacaatgcctac

SEQ ID NO: 143023 - DNA, 22 bp, Artificial Sequence
  Synthetic oligonucleotide; CTT chr11 5232876 5232897 5232881 5232876 -
gggaacacaatgcctacttcaa

SEQ ID NO: 143024 - DNA, 22 bp, Artificial Sequence
  Synthetic oligonucleotide; TTG chr11 5232875 5232896 5232880 5232875 -
ggaacacaatgcctacttcaag

SEQ ID NO: 143025 - DNA, 22 bp, Artificial Sequence
  Synthetic oligonucleotide; CTA chr11 5232860 5232881 5232865 5232860 -
cttcaagggtatggcttctgcc

SEQ ID NO: 143026 - DNA, 22 bp, Artificial Sequence
  Synthetic oligonucleotide; CTT chr11 5232857 5232878 5232862 5232857 -
caagggtatggcttctgcctaa

SEQ ID NO: 143027 - DNA, 22 bp, Artificial Sequence
  Synthetic oligonucleotide; TTC chr11 5232856 5232877 5232861 5232856 -
aagggtatggcttctgcctaat

SEQ ID NO: 143028 - DNA, 22 bp, Artificial Sequence
  Synthetic oligonucleotide; CTT chr11 5232843 5232864 5232848 5232843 -
ctgcctaataaagaatgttcag

SEQ ID NO: 143029 - DNA, 22 bp, Artificial Sequence
  Synthetic oligonucleotide; TTC chr11 5232842 5232863 5232847 5232842 -
tgcctaataaagaatgttcagc

SEQ ID NO: 143030 - DNA, 22 bp, Artificial Sequence
  Synthetic oligonucleotide; CTG chr11 5232840 5232861 5232845 5232840 -
cctaataaagaatgttcagctc

SEQ ID NO: 143031 - DNA, 22 bp, Artificial Sequence
  Synthetic oligonucleotide; CTA chr11 5232836 5232857 5232841 5232836 -
ataaagaatgttcagctcaact

SEQ ID NO: 143032 - DNA, 22 bp, Artificial Sequence
  Synthetic oligonucleotide; TTC chr11 5232823 5232844 5232828 5232823 -
agctcaacttcctgattaattt

SEQ ID NO: 143033 - DNA, 22 bp, Artificial Sequence
  Synthetic oligonucleotide; CTC chr11 5232818 5232839 5232823 5232818 -
aacttcctgattaatttcactt

SEQ ID NO: 143034 - DNA, 22 bp, Artificial Sequence
  Synthetic oligonucleotide; CTT chr11 5232813 5232834 5232818 5232813 -
cctgattaatttcacttatttc

SEQ ID NO: 143035 - DNA, 22 bp, Artificial Sequence
  Synthetic oligonucleotide; TTC chr11 5232812 5232833 5232817 5232812 -
ctgattaatttcacttatttca

SEQ ID NO: 143036 - DNA, 22 bp, Artificial Sequence
  Synthetic oligonucleotide; CTG chr11 5232809 5232830 5232814 5232809 -
attaatttcacttatttcattt

SEQ ID NO: 143037 - DNA, 22 bp, Artificial Sequence
  Synthetic oligonucleotide; TTA chr11 5232805 5232826 5232810 5232805 -
atttcacttatttcattttttt

SEQ ID NO: 143038 - DNA, 22 bp, Artificial Sequence
  Synthetic oligonucleotide; TTT chr11 5232801 5232822 5232806 5232801 -
cacttatttcatttttttgtcc

SEQ ID NO: 143039 - DNA, 22 bp, Artificial Sequence
  Synthetic oligonucleotide; TTC chr11 5232800 5232821 5232805 5232800 -
acttatttcatttttttgtcca

SEQ ID NO: 143040 - DNA, 22 bp, Artificial Sequence
  Synthetic oligonucleotide; CTT chr11 5232796 5232817 5232801 5232796 -
atttcatttttttgtccaggtg

SEQ ID NO: 143041 - DNA, 22 bp, Artificial Sequence
  Synthetic oligonucleotide; TTA chr11 5232795 5232816 5232800 5232795 -
tttcatttttttgtccaggtgt

SEQ ID NO: 143042 - DNA, 22 bp, Artificial Sequence
  Synthetic oligonucleotide; TTT chr11 5232792 5232813 5232797 5232792 -
catttttttgtccaggtgtgta

SEQ ID NO: 143043 - DNA, 22 bp, Artificial Sequence
  Synthetic oligonucleotide; TTC chr11 5232791 5232812 5232796 5232791 -
atttttttgtccaggtgtgtaa

SEQ ID NO: 143044 - DNA, 22 bp, Artificial Sequence
  Synthetic oligonucleotide; TTT chr11 5232787 5232808 5232792 5232787 -
ttttgtccaggtgtgtaagaag

SEQ ID NO: 143045 - DNA, 22 bp, Artificial Sequence
  Synthetic oligonucleotide; TTT chr11 5232786 5232807 5232791 5232786 -
tttgtccaggtgtgtaagaagg

SEQ ID NO: 143046 - DNA, 22 bp, Artificial Sequence
  Synthetic oligonucleotide; TTT chr11 5232785 5232806 5232790 5232785 -
ttgtccaggtgtgtaagaaggt

SEQ ID NO: 143047 - DNA, 22 bp, Artificial Sequence
  Synthetic oligonucleotide; TTT chr11 5232784 5232805 5232789 5232784 -
tgtccaggtgtgtaagaaggtt

SEQ ID NO: 143048 - DNA, 22 bp, Artificial Sequence
  Synthetic oligonucleotide; TTT chr11 5232783 5232804 5232788 5232783 -
gtccaggtgtgtaagaaggttc

SEQ ID NO: 143049 - DNA, 22 bp, Artificial Sequence
  Synthetic oligonucleotide; TTG chr11 5232782 5232803 5232787 5232782 -
tccaggtgtgtaagaaggttcc

SEQ ID NO: 143050 - DNA, 22 bp, Artificial Sequence
  Synthetic oligonucleotide; TTC chr11 5232761 5232782 5232766 5232761 -
ctgaggctctacagatagggag

SEQ ID NO: 143051 - DNA, 22 bp, Artificial Sequence
  Synthetic oligonucleotide; CTG chr11 5232758 5232779 5232763 5232758 -
aggctctacagatagggagcac

SEQ ID NO: 143052 - DNA, 22 bp, Artificial Sequence
  Synthetic oligonucleotide; CTC chr11 5232752 5232773 5232757 5232752 -
tacagatagggagcacttgttt

SEQ ID NO: 143053 - DNA, 22 bp, Artificial Sequence
  Synthetic oligonucleotide; CTA chr11 5232750 5232771 5232755 5232750 -
cagatagggagcacttgtttat

SEQ ID NO: 143054 - DNA, 22 bp, Artificial Sequence
  Synthetic oligonucleotide; CTT chr11 5232734 5232755 5232739 5232734 -
gtttattttacaaagagtacat

SEQ ID NO: 143055 - DNA, 22 bp, Artificial Sequence
  Synthetic oligonucleotide; TTG chr11 5232733 5232754 5232738 5232733 -
tttattttacaaagagtacatg

SEQ ID NO: 143056 - DNA, 22 bp, Artificial Sequence
  Synthetic oligonucleotide; TTT chr11 5232730 5232751 5232735 5232730 -
attttacaaagagtacatggga

SEQ ID NO: 143057 - DNA, 22 bp, Artificial Sequence
  Synthetic oligonucleotide; TTA chr11 5232729 5232750 5232734 5232729 -
ttttacaaagagtacatgggaa

SEQ ID NO: 143058 - DNA, 22 bp, Artificial Sequence
  Synthetic oligonucleotide; TTT chr11 5232726 5232747 5232731 5232726 -
tacaaagagtacatgggaaaag

SEQ ID NO: 143059 - DNA, 22 bp, Artificial Sequence
  Synthetic oligonucleotide; TTT chr11 5232725 5232746 5232730 5232725 -
acaaagagtacatgggaaaaga

SEQ ID NO: 143060 - DNA, 22 bp, Artificial Sequence
  Synthetic oligonucleotide; TTA chr11 5232724 5232745 5232729 5232724 -
caaagagtacatgggaaaagag

SEQ ID NO: 143061 - DNA, 22 bp, Artificial Sequence
  Synthetic oligonucleotide; TTA chr11 5232674 5232695 5232679 5232674 -
atgggtgacacttctacctcca

SEQ ID NO: 143062 - DNA, 22 bp, Artificial Sequence
  Synthetic oligonucleotide; CTT chr11 5232661 5232682 5232666 5232661 -
ctacctccaaagagcagaaatt

SEQ ID NO: 143063 - DNA, 22 bp, Artificial Sequence
  Synthetic oligonucleotide; TTC chr11 5232660 5232681 5232665 5232660 -
tacctccaaagagcagaaatta

SEQ ID NO: 143064 - DNA, 22 bp, Artificial Sequence
  Synthetic oligonucleotide; CTA chr11 5232658 5232679 5232663 5232658 -
cctccaaagagcagaaattatc

SEQ ID NO: 143065 - DNA, 22 bp, Artificial Sequence
  Synthetic oligonucleotide; CTC chr11 5232654 5232675 5232659 5232654 -
caaagagcagaaattatcaaga

SEQ ID NO: 143066 - DNA, 22 bp, Artificial Sequence
  Synthetic oligonucleotide; TTA chr11 5232638 5232659 5232643 5232638 -
tcaagaactcttgatacaaaga

SEQ ID NO: 143067 - DNA, 22 bp, Artificial Sequence
  Synthetic oligonucleotide; CTC chr11 5232628 5232649 5232633 5232628 -
ttgatacaaagataatactggc

SEQ ID NO: 143068 - DNA, 22 bp, Artificial Sequence
  Synthetic oligonucleotide; CTT chr11 5232626 5232647 5232631 5232626 -
gatacaaagataatactggcac

SEQ ID NO: 143069 - DNA, 22 bp, Artificial Sequence
  Synthetic oligonucleotide; TTG chr11 5232625 5232646 5232630 5232625 -
atacaaagataatactggcact

SEQ ID NO: 143070 - DNA, 22 bp, Artificial Sequence
  Synthetic oligonucleotide; CTG chr11 5232608 5232629 5232613 5232608 -
gcactgcagaggttctagggaa

SEQ ID NO: 143071 - DNA, 22 bp, Artificial Sequence
  Synthetic oligonucleotide; CTG chr11 5232602 5232623 5232607 5232602 -
cagaggttctagggaagacctc

SEQ ID NO: 143072 - DNA, 22 bp, Artificial Sequence
  Synthetic oligonucleotide; TTC chr11 5232593 5232614 5232598 5232593 -
tagggaagacctcaaccctaag

SEQ ID NO: 143073 - DNA, 22 bp, Artificial Sequence
  Synthetic oligonucleotide; CTA chr11 5232591 5232612 5232596 5232591 -
gggaagacctcaaccctaagac

SEQ ID NO: 143074 - DNA, 22 bp, Artificial Sequence
  Synthetic oligonucleotide; CTC chr11 5232580 5232601 5232585 5232580 -
aaccctaagacatagcctcaag

SEQ ID NO: 143075 - DNA, 22 bp, Artificial Sequence
  Synthetic oligonucleotide; CTA chr11 5232573 5232594 5232578 5232573 -
agacatagcctcaagggtaatg

SEQ ID NO: 143076 - DNA, 22 bp, Artificial Sequence
  Synthetic oligonucleotide; CTC chr11 5232561 5232582 5232566 5232561 -
aagggtaatgctacgattaaac

SEQ ID NO: 143077 - DNA, 22 bp, Artificial Sequence
  Synthetic oligonucleotide; CTA chr11 5232548 5232569 5232553 5232548 -
cgattaaactccaacaattact

SEQ ID NO: 143078 - DNA, 22 bp, Artificial Sequence
  Synthetic oligonucleotide; TTA chr11 5232542 5232563 5232547 5232542 -
aactccaacaattactgagaaa

SEQ ID NO: 143079 - DNA, 22 bp, Artificial Sequence
  Synthetic oligonucleotide; CTC chr11 5232537 5232558 5232542 5232537 -
caacaattactgagaaaataat

SEQ ID NO: 143080 - DNA, 22 bp, Artificial Sequence
  Synthetic oligonucleotide; TTA chr11 5232528 5232549 5232533 5232528 -
ctgagaaaataatgtgctcaat

SEQ ID NO: 143081 - DNA, 22 bp, Artificial Sequence
  Synthetic oligonucleotide; CTG chr11 5232525 5232546 5232530 5232525 -
agaaaataatgtgctcaattaa

SEQ ID NO: 143082 - DNA, 22 bp, Artificial Sequence
  Synthetic oligonucleotide; CTC chr11 5232509 5232530 5232514 5232509 -
aattaaaggcataatgattact

SEQ ID NO: 143083 - DNA, 22 bp, Artificial Sequence
  Synthetic oligonucleotide; TTA chr11 5232504 5232525 5232509 5232504 -
aaggcataatgattactcaaga

SEQ ID NO: 143084 - DNA, 22 bp, Artificial Sequence
  Synthetic oligonucleotide; TTA chr11 5232489 5232510 5232494 5232489 -
ctcaagacaatgttatgttgtc

SEQ ID NO: 143085 - DNA, 22 bp, Artificial Sequence
  Synthetic oligonucleotide; CTC chr11 5232486 5232507 5232491 5232486 -
aagacaatgttatgttgtcttt

SEQ ID NO: 143086 - DNA, 22 bp, Artificial Sequence
  Synthetic oligonucleotide; TTA chr11 5232474 5232495 5232479 5232474 -
tgttgtctttcttcctccttcc

SEQ ID NO: 143087 - DNA, 22 bp, Artificial Sequence
  Synthetic oligonucleotide; TTG chr11 5232469 5232490 5232474 5232469 -
tctttcttcctccttcctttgc

SEQ ID NO: 143088 - DNA, 22 bp, Artificial Sequence
  Synthetic oligonucleotide; CTT chr11 5232465 5232486 5232470 5232465 -
tcttcctccttcctttgcctgc

SEQ ID NO: 143089 - DNA, 22 bp, Artificial Sequence
  Synthetic oligonucleotide; TTT chr11 5232464 5232485 5232469 5232464 -
cttcctccttcctttgcctgca

SEQ ID NO: 143090 - DNA, 22 bp, Artificial Sequence
  Synthetic oligonucleotide; TTC chr11 5232463 5232484 5232468 5232463 -
ttcctccttcctttgcctgcac

SEQ ID NO: 143091 - DNA, 22 bp, Artificial Sequence
  Synthetic oligonucleotide; CTT chr11 5232461 5232482 5232466 5232461 -
cctccttcctttgcctgcacat

SEQ ID NO: 143092 - DNA, 22 bp, Artificial Sequence
  Synthetic oligonucleotide; TTC chr11 5232460 5232481 5232465 5232460 -
ctccttcctttgcctgcacatt

SEQ ID NO: 143093 - DNA, 22 bp, Artificial Sequence
  Synthetic oligonucleotide; CTC chr11 5232457 5232478 5232462 5232457 -
cttcctttgcctgcacattgta

SEQ ID NO: 143094 - DNA, 22 bp, Artificial Sequence
  Synthetic oligonucleotide; CTT chr11 5232454 5232475 5232459 5232454 -
cctttgcctgcacattgtagcc

SEQ ID NO: 143095 - DNA, 22 bp, Artificial Sequence
  Synthetic oligonucleotide; TTC chr11 5232453 5232474 5232458 5232453 -
ctttgcctgcacattgtagccc

SEQ ID NO: 143096 - DNA, 22 bp, Artificial Sequence
  Synthetic oligonucleotide; CTT chr11 5232450 5232471 5232455 5232450 -
tgcctgcacattgtagcccata

SEQ ID NO: 143097 - DNA, 22 bp, Artificial Sequence
  Synthetic oligonucleotide; TTT chr11 5232449 5232470 5232454 5232449 -
gcctgcacattgtagcccataa

SEQ ID NO: 143098 - DNA, 22 bp, Artificial Sequence
  Synthetic oligonucleotide; TTG chr11 5232448 5232469 5232453 5232448 -
cctgcacattgtagcccataat

SEQ ID NO: 143099 - DNA, 22 bp, Artificial Sequence
  Synthetic oligonucleotide; CTG chr11 5232444 5232465 5232449 5232444 -
cacattgtagcccataatacta

SEQ ID NO: 143100 - DNA, 22 bp, Artificial Sequence
  Synthetic oligonucleotide; TTG chr11 5232437 5232458 5232442 5232437 -
tagcccataatactatacccca

SEQ ID NO: 143101 - DNA, 22 bp, Artificial Sequence
  Synthetic oligonucleotide; CTA chr11 5232422 5232443 5232427 5232422 -
taccccatcaagtgttcctgct

SEQ ID NO: 143102 - DNA, 22 bp, Artificial Sequence
  Synthetic oligonucleotide; TTC chr11 5232405 5232426 5232410 5232405 -
ctgctccaagaaatagcttcct

SEQ ID NO: 143103 - DNA, 22 bp, Artificial Sequence
  Synthetic oligonucleotide; CTG chr11 5232402 5232423 5232407 5232402 -
ctccaagaaatagcttcctcct

SEQ ID NO: 143104 - DNA, 22 bp, Artificial Sequence
  Synthetic oligonucleotide; CTC chr11 5232399 5232420 5232404 5232399 -
caagaaatagcttcctcctctt

SEQ ID NO: 143105 - DNA, 22 bp, Artificial Sequence
  Synthetic oligonucleotide; CTT chr11 5232386 5232407 5232391 5232386 -
cctcctcttacttgccccagaa

SEQ ID NO: 143106 - DNA, 22 bp, Artificial Sequence
  Synthetic oligonucleotide; TTC chr11 5232385 5232406 5232390 5232385 -
ctcctcttacttgccccagaac

SEQ ID NO: 143107 - DNA, 22 bp, Artificial Sequence
  Synthetic oligonucleotide; CTC chr11 5232382 5232403 5232387 5232382 -
ctcttacttgccccagaacatc

SEQ ID NO: 143108 - DNA, 22 bp, Artificial Sequence
  Synthetic oligonucleotide; CTC chr11 5232379 5232400 5232384 5232379 -
ttacttgccccagaacatctct

SEQ ID NO: 143109 - DNA, 22 bp, Artificial Sequence
  Synthetic oligonucleotide; CTT chr11 5232377 5232398 5232382 5232377 -
acttgccccagaacatctctgt

SEQ ID NO: 143110 - DNA, 22 bp, Artificial Sequence
  Synthetic oligonucleotide; TTA chr11 5232376 5232397 5232381 5232376 -
cttgccccagaacatctctgta

SEQ ID NO: 143111 - DNA, 22 bp, Artificial Sequence
  Synthetic oligonucleotide; CTT chr11 5232373 5232394 5232378 5232373 -
gccccagaacatctctgtaaag

SEQ ID NO: 143112 - DNA, 22 bp, Artificial Sequence
  Synthetic oligonucleotide; TTG chr11 5232372 5232393 5232377 5232372 -
ccccagaacatctctgtaaaga

SEQ ID NO: 143113 - DNA, 22 bp, Artificial Sequence
  Synthetic oligonucleotide; CTC chr11 5232358 5232379 5232363 5232358 -
tgtaaagaatttcctcttatct

SEQ ID NO: 143114 - DNA, 22 bp, Artificial Sequence
  Synthetic oligonucleotide; CTG chr11 5232356 5232377 5232361 5232356 -
taaagaatttcctcttatcttc

SEQ ID NO: 143115 - DNA, 22 bp, Artificial Sequence
  Synthetic oligonucleotide; TTT chr11 5232346 5232367 5232351 5232346 -
cctcttatcttcccatatttca

SEQ ID NO: 143116 - DNA, 22 bp, Artificial Sequence
  Synthetic oligonucleotide; TTC chr11 5232345 5232366 5232350 5232345 -
ctcttatcttcccatatttcag

SEQ ID NO: 143117 - DNA, 22 bp, Artificial Sequence
  Synthetic oligonucleotide; CTC chr11 5232342 5232363 5232347 5232342 -
ttatcttcccatatttcagtca

SEQ ID NO: 143118 - DNA, 22 bp, Artificial Sequence
  Synthetic oligonucleotide; CTT chr11 5232340 5232361 5232345 5232340 -
atcttcccatatttcagtcaag

SEQ ID NO: 143119 - DNA, 22 bp, Artificial Sequence
  Synthetic oligonucleotide; TTA chr11 5232339 5232360 5232344 5232339 -
tcttcccatatttcagtcaaga

SEQ ID NO: 143120 - DNA, 22 bp, Artificial Sequence
  Synthetic oligonucleotide; CTT chr11 5232335 5232356 5232340 5232335 -
cccatatttcagtcaagattca

SEQ ID NO: 143121 - DNA, 22 bp, Artificial Sequence
  Synthetic oligonucleotide; TTC chr11 5232334 5232355 5232339 5232334 -
ccatatttcagtcaagattcat

SEQ ID NO: 143122 - DNA, 22 bp, Artificial Sequence
  Synthetic oligonucleotide; TTT chr11 5232326 5232347 5232331 5232326 -
cagtcaagattcattgctcacg

SEQ ID NO: 143123 - DNA, 22 bp, Artificial Sequence
  Synthetic oligonucleotide; TTC chr11 5232325 5232346 5232330 5232325 -
agtcaagattcattgctcacgt

SEQ ID NO: 143124 - DNA, 22 bp, Artificial Sequence
  Synthetic oligonucleotide; TTC chr11 5232314 5232335 5232319 5232314 -
attgctcacgtattacttgtga

SEQ ID NO: 143125 - DNA, 22 bp, Artificial Sequence
  Synthetic oligonucleotide; TTG chr11 5232310 5232331 5232315 5232310 -
ctcacgtattacttgtgacctc

SEQ ID NO: 143126 - DNA, 22 bp, Artificial Sequence
  Synthetic oligonucleotide; CTC chr11 5232307 5232328 5232312 5232307 -
acgtattacttgtgacctctct

SEQ ID NO: 143127 - DNA, 22 bp, Artificial Sequence
  Synthetic oligonucleotide; TTA chr11 5232299 5232320 5232304 5232299 -
cttgtgacctctcttgacccca

SEQ ID NO: 143128 - DNA, 22 bp, Artificial Sequence
  Synthetic oligonucleotide; CTT chr11 5232296 5232317 5232301 5232296 -
gtgacctctcttgaccccagcc

SEQ ID NO: 143129 - DNA, 22 bp, Artificial Sequence
  Synthetic oligonucleotide; TTG chr11 5232295 5232316 5232300 5232295 -
tgacctctcttgaccccagcca

SEQ ID NO: 143130 - DNA, 22 bp, Artificial Sequence
  Synthetic oligonucleotide; CTC chr11 5232288 5232309 5232293 5232288 -
tcttgaccccagccacaataaa

SEQ ID NO: 143131 - DNA, 22 bp, Artificial Sequence
  Synthetic oligonucleotide; CTC chr11 5232286 5232307 5232291 5232286 -
ttgaccccagccacaataaact

SEQ ID NO: 143132 - DNA, 22 bp, Artificial Sequence
  Synthetic oligonucleotide; CTT chr11 5232284 5232305 5232289 5232284 -
gaccccagccacaataaacttc

SEQ ID NO: 143133 - DNA, 22 bp, Artificial Sequence
  Synthetic oligonucleotide; TTG chr11 5232283 5232304 5232288 5232283 -
accccagccacaataaacttct

SEQ ID NO: 143134 - DNA, 22 bp, Artificial Sequence
  Synthetic oligonucleotide; CTT chr11 5232263 5232284 5232268 5232263 -
ctctatactacccaaaaaatct

SEQ ID NO: 143135 - DNA, 22 bp, Artificial Sequence
  Synthetic oligonucleotide; TTC chr11 5232262 5232283 5232267 5232262 -
tctatactacccaaaaaatctt

SEQ ID NO: 143136 - DNA, 22 bp, Artificial Sequence
  Synthetic oligonucleotide; CTC chr11 5232260 5232281 5232265 5232260 -
tatactacccaaaaaatctttc

SEQ ID NO: 143137 - DNA, 22 bp, Artificial Sequence
  Synthetic oligonucleotide; CTA chr11 5232258 5232279 5232263 5232258 -
tactacccaaaaaatctttcca

SEQ ID NO: 143138 - DNA, 22 bp, Artificial Sequence
  Synthetic oligonucleotide; CTA chr11 5232253 5232274 5232258 5232253 -
cccaaaaaatctttccaaaccc

SEQ ID NO: 143139 - DNA, 22 bp, Artificial Sequence
  Synthetic oligonucleotide; CTT chr11 5232240 5232261 5232245 5232240 -
tccaaaccctcccccacaccat

SEQ ID NO: 143140 - DNA, 22 bp, Artificial Sequence
  Synthetic oligonucleotide; TTT chr11 5232239 5232260 5232244 5232239 -
ccaaaccctcccccacaccatt

SEQ ID NO: 143141 - DNA, 22 bp, Artificial Sequence
  Synthetic oligonucleotide; TTC chr11 5232238 5232259 5232243 5232238 -
caaaccctcccccacaccattt

SEQ ID NO: 143142 - DNA, 22 bp, Artificial Sequence
  Synthetic oligonucleotide; CTC chr11 5232229 5232250 5232234 5232229 -
ccccacaccattttttatattt

SEQ ID NO: 143143 - DNA, 22 bp, Artificial Sequence
  Synthetic oligonucleotide; TTT chr11 5232216 5232237 5232221 5232216 -
tttatatttttatatttttctt

SEQ ID NO: 143144 - DNA, 22 bp, Artificial Sequence
  Synthetic oligonucleotide; TTT chr11 5232215 5232236 5232220 5232215 -
ttatatttttatatttttctta

SEQ ID NO: 143145 - DNA, 22 bp, Artificial Sequence
  Synthetic oligonucleotide; TTT chr11 5232214 5232235 5232219 5232214 -
tatatttttatatttttcttat

SEQ ID NO: 143146 - DNA, 22 bp, Artificial Sequence
  Synthetic oligonucleotide; TTT chr11 5232213 5232234 5232218 5232213 -
atatttttatatttttcttatt

SEQ ID NO: 143147 - DNA, 22 bp, Artificial Sequence
  Synthetic oligonucleotide; TTA chr11 5232212 5232233 5232217 5232212 -
tatttttatatttttcttattt

SEQ ID NO: 143148 - DNA, 22 bp, Artificial Sequence
  Synthetic oligonucleotide; TTT chr11 5232207 5232228 5232212 5232207 -
ttatatttttcttatttatttc

SEQ ID NO: 143149 - DNA, 22 bp, Artificial Sequence
  Synthetic oligonucleotide; TTT chr11 5232206 5232227 5232211 5232206 -
tatatttttcttatttatttca

SEQ ID NO: 143150 - DNA, 22 bp, Artificial Sequence
  Synthetic oligonucleotide; TTT chr11 5232205 5232226 5232210 5232205 -
atatttttcttatttatttcat

SEQ ID NO: 143151 - DNA, 22 bp, Artificial Sequence
  Synthetic oligonucleotide; TTA chr11 5232204 5232225 5232209 5232204 -
tatttttcttatttatttcatg

SEQ ID NO: 143152 - DNA, 22 bp, Artificial Sequence
  Synthetic oligonucleotide; TTT chr11 5232199 5232220 5232204 5232199 -
ttcttatttatttcatgcacac

SEQ ID NO: 143153 - DNA, 22 bp, Artificial Sequence
  Synthetic oligonucleotide; TTT chr11 5232198 5232219 5232203 5232198 -
tcttatttatttcatgcacaca

SEQ ID NO: 143154 - DNA, 22 bp, Artificial Sequence
  Synthetic oligonucleotide; TTT chr11 5232197 5232218 5232202 5232197 -
cttatttatttcatgcacacac

SEQ ID NO: 143155 - DNA, 22 bp, Artificial Sequence
  Synthetic oligonucleotide; TTC chr11 5232196 5232217 5232201 5232196 -
ttatttatttcatgcacacaca

SEQ ID NO: 143156 - DNA, 22 bp, Artificial Sequence
  Synthetic oligonucleotide; CTT chr11 5232194 5232215 5232199 5232194 -
atttatttcatgcacacacaca

SEQ ID NO: 143157 - DNA, 22 bp, Artificial Sequence
  Synthetic oligonucleotide; TTA chr11 5232193 5232214 5232198 5232193 -
tttatttcatgcacacacacac

SEQ ID NO: 143158 - DNA, 22 bp, Artificial Sequence
  Synthetic oligonucleotide; TTT chr11 5232190 5232211 5232195 5232190 -
atttcatgcacacacacacact

SEQ ID NO: 143159 - DNA, 22 bp, Artificial Sequence
  Synthetic oligonucleotide; TTA chr11 5232189 5232210 5232194 5232189 -
tttcatgcacacacacacactc

SEQ ID NO: 143160 - DNA, 22 bp, Artificial Sequence
  Synthetic oligonucleotide; TTT chr11 5232186 5232207 5232191 5232186 -
catgcacacacacacactccgt

SEQ ID NO: 143161 - DNA, 22 bp, Artificial Sequence
  Synthetic oligonucleotide; TTC chr11 5232185 5232206 5232190 5232185 -
atgcacacacacacactccgtg

SEQ ID NO: 143162 - DNA, 22 bp, Artificial Sequence
  Synthetic oligonucleotide; CTC chr11 5232167 5232188 5232172 5232167 -
cgtgctttataagcaattctgc

SEQ ID NO: 143163 - DNA, 22 bp, Artificial Sequence
  Synthetic oligonucleotide; CTT chr11 5232160 5232181 5232165 5232160 -
tataagcaattctgcctattct

SEQ ID NO: 143164 - DNA, 22 bp, Artificial Sequence
  Synthetic oligonucleotide; TTT chr11 5232159 5232180 5232164 5232159 -
ataagcaattctgcctattctc

SEQ ID NO: 143165 - DNA, 22 bp, Artificial Sequence
  Synthetic oligonucleotide; TTA chr11 5232158 5232179 5232163 5232158 -
taagcaattctgcctattctct

SEQ ID NO: 143166 - DNA, 22 bp, Artificial Sequence
  Synthetic oligonucleotide; TTC chr11 5232148 5232169 5232153 5232148 -
tgcctattctctaccttcttac

SEQ ID NO: 143167 - DNA, 22 bp, Artificial Sequence
  Synthetic oligonucleotide; CTG chr11 5232146 5232167 5232151 5232146 -
cctattctctaccttcttacat

SEQ ID NO: 143168 - DNA, 22 bp, Artificial Sequence
  Synthetic oligonucleotide; CTA chr11 5232142 5232163 5232147 5232142 -
ttctctaccttcttacatgcct

SEQ ID NO: 143169 - DNA, 22 bp, Artificial Sequence
  Synthetic oligonucleotide; TTC chr11 5232139 5232160 5232144 5232139 -
tctaccttcttacatgcctact

SEQ ID NO: 143170 - DNA, 22 bp, Artificial Sequence
  Synthetic oligonucleotide; CTC chr11 5232137 5232158 5232142 5232137 -
taccttcttacatgcctactgt

SEQ ID NO: 143171 - DNA, 22 bp, Artificial Sequence
  Synthetic oligonucleotide; CTA chr11 5232135 5232156 5232140 5232135 -
ccttcttacatgcctactgtgc

SEQ ID NO: 143172 - DNA, 22 bp, Artificial Sequence
  Synthetic oligonucleotide; CTT chr11 5232131 5232152 5232136 5232131 -
cttacatgcctactgtgcctca

SEQ ID NO: 143173 - DNA, 22 bp, Artificial Sequence
  Synthetic oligonucleotide; TTC chr11 5232130 5232151 5232135 5232130 -
ttacatgcctactgtgcctcat

SEQ ID NO: 143174 - DNA, 22 bp, Artificial Sequence
  Synthetic oligonucleotide; CTT chr11 5232128 5232149 5232133 5232128 -
acatgcctactgtgcctcatat

SEQ ID NO: 143175 - DNA, 22 bp, Artificial Sequence
  Synthetic oligonucleotide; TTA chr11 5232127 5232148 5232132 5232127 -
catgcctactgtgcctcatatt

SEQ ID NO: 143176 - DNA, 22 bp, Artificial Sequence
  Synthetic oligonucleotide; CTA chr11 5232119 5232140 5232124 5232119 -
ctgtgcctcatattaaattcat

SEQ ID NO: 143177 - DNA, 22 bp, Artificial Sequence
  Synthetic oligonucleotide; CTG chr11 5232116 5232137 5232121 5232116 -
tgcctcatattaaattcatcaa

SEQ ID NO: 143178 - DNA, 22 bp, Artificial Sequence
  Synthetic oligonucleotide; CTC chr11 5232110 5232131 5232115 5232110 -
atattaaattcatcaatgggca

SEQ ID NO: 143179 - DNA, 22 bp, Artificial Sequence
  Synthetic oligonucleotide; TTA chr11 5232104 5232125 5232109 5232104 -
aattcatcaatgggcagaaaga

SEQ ID NO: 143180 - DNA, 22 bp, Artificial Sequence
  Synthetic oligonucleotide; TTC chr11 5232099 5232120 5232104 5232099 -
atcaatgggcagaaagaaaata

SEQ ID NO: 143181 - DNA, 22 bp, Artificial Sequence
  Synthetic oligonucleotide; TTT chr11 5232074 5232095 5232079 5232074 -
attcaagaaaacagtgaatgaa

SEQ ID NO: 143182 - DNA, 22 bp, Artificial Sequence
  Synthetic oligonucleotide; TTA chr11 5232073 5232094 5232078 5232073 -
ttcaagaaaacagtgaatgaat

SEQ ID NO: 143183 - DNA, 22 bp, Artificial Sequence
  Synthetic oligonucleotide; TTC chr11 5232070 5232091 5232075 5232070 -
aagaaaacagtgaatgaatgaa

SEQ ID NO: 143184 - DNA, 22 bp, Artificial Sequence
  Synthetic oligonucleotide; TTA chr11 5232014 5232035 5232019 5232014 -
ttccttgctttagaacttctgg

SEQ ID NO: 143185 - DNA, 22 bp, Artificial Sequence
  Synthetic oligonucleotide; TTC chr11 5232011 5232032 5232016 5232011 -
cttgctttagaacttctggaat

SEQ ID NO: 143186 - DNA, 22 bp, Artificial Sequence
  Synthetic oligonucleotide; CTT chr11 5232008 5232029 5232013 5232008 -
gctttagaacttctggaattag

SEQ ID NO: 143187 - DNA, 22 bp, Artificial Sequence
  Synthetic oligonucleotide; TTG chr11 5232007 5232028 5232012 5232007 -
ctttagaacttctggaattaga

SEQ ID NO: 143188 - DNA, 22 bp, Artificial Sequence
  Synthetic oligonucleotide; CTT chr11 5232004 5232025 5232009 5232004 -
tagaacttctggaattagagga

SEQ ID NO: 143189 - DNA, 22 bp, Artificial Sequence
  Synthetic oligonucleotide; TTT chr11 5232003 5232024 5232008 5232003 -
agaacttctggaattagaggac

SEQ ID NO: 143190 - DNA, 22 bp, Artificial Sequence
  Synthetic oligonucleotide; TTA chr11 5232002 5232023 5232007 5232002 -
gaacttctggaattagaggaca

SEQ ID NO: 143191 - DNA, 22 bp, Artificial Sequence
  Synthetic oligonucleotide; CTT chr11 5231996 5232017 5232001 5231996 -
ctggaattagaggacaatatta

SEQ ID NO: 143192 - DNA, 22 bp, Artificial Sequence
  Synthetic oligonucleotide; TTC chr11 5231995 5232016 5232000 5231995 -
tggaattagaggacaatattaa

SEQ ID NO: 143193 - DNA, 22 bp, Artificial Sequence
  Synthetic oligonucleotide; CTG chr11 5231993 5232014 5231998 5231993 -
gaattagaggacaatattaata

SEQ ID NO: 143194 - DNA, 22 bp, Artificial Sequence
  Synthetic oligonucleotide; TTA chr11 5231987 5232008 5231992 5231987 -
gaggacaatattaataatacca

SEQ ID NO: 143195 - DNA, 22 bp, Artificial Sequence
  Synthetic oligonucleotide; TTA chr11 5231974 5231995 5231979 5231974 -
ataataccatcgcacagtgttt

SEQ ID NO: 143196 - DNA, 22 bp, Artificial Sequence
  Synthetic oligonucleotide; TTT chr11 5231952 5231973 5231957 5231952 -
ctttgttgttaatgctacaaca

SEQ ID NO: 143197 - DNA, 22 bp, Artificial Sequence
  Synthetic oligonucleotide; TTC chr11 5231951 5231972 5231956 5231951 -
tttgttgttaatgctacaacat

SEQ ID NO: 143198 - DNA, 22 bp, Artificial Sequence
  Synthetic oligonucleotide; CTT chr11 5231949 5231970 5231954 5231949 -
tgttgttaatgctacaacatac

SEQ ID NO: 143199 - DNA, 22 bp, Artificial Sequence
  Synthetic oligonucleotide; TTT chr11 5231948 5231969 5231953 5231948 -
gttgttaatgctacaacataca

SEQ ID NO: 143200 - DNA, 22 bp, Artificial Sequence
  Synthetic oligonucleotide; TTG chr11 5231947 5231968 5231952 5231947 -
ttgttaatgctacaacatacaa

SEQ ID NO: 143201 - DNA, 22 bp, Artificial Sequence
  Synthetic oligonucleotide; TTG chr11 5231944 5231965 5231949 5231944 -
ttaatgctacaacatacaaaga

SEQ ID NO: 143202 - DNA, 22 bp, Artificial Sequence
  Synthetic oligonucleotide; TTA chr11 5231941 5231962 5231946 5231941 -
atgctacaacatacaaagagga

SEQ ID NO: 143203 - DNA, 22 bp, Artificial Sequence
  Synthetic oligonucleotide; CTA chr11 5231935 5231956 5231940 5231935 -
caacatacaaagaggaagcatg

SEQ ID NO: 143204 - DNA, 22 bp, Artificial Sequence
  Synthetic oligonucleotide; TTA chr11 5231892 5231913 5231897 5231892 -
tttcctttctgatcataggagt

SEQ ID NO: 143205 - DNA, 22 bp, Artificial Sequence
  Synthetic oligonucleotide; TTT chr11 5231889 5231910 5231894 5231889 -
cctttctgatcataggagtaat

SEQ ID NO: 143206 - DNA, 22 bp, Artificial Sequence
  Synthetic oligonucleotide; TTC chr11 5231888 5231909 5231893 5231888 -
ctttctgatcataggagtaata

SEQ ID NO: 143207 - DNA, 22 bp, Artificial Sequence
  Synthetic oligonucleotide; CTT chr11 5231885 5231906 5231890 5231885 -
tctgatcataggagtaatattt

SEQ ID NO: 143208 - DNA, 22 bp, Artificial Sequence
  Synthetic oligonucleotide; TTT chr11 5231884 5231905 5231889 5231884 -
ctgatcataggagtaatatttt

SEQ ID NO: 143209 - DNA, 22 bp, Artificial Sequence
  Synthetic oligonucleotide; TTC chr11 5231883 5231904 5231888 5231883 -
tgatcataggagtaatattttt

SEQ ID NO: 143210 - DNA, 22 bp, Artificial Sequence
  Synthetic oligonucleotide; CTG chr11 5231881 5231902 5231886 5231881 -
atcataggagtaatattttttt

SEQ ID NO: 143211 - DNA, 22 bp, Artificial Sequence
  Synthetic oligonucleotide; TTT chr11 5231863 5231884 5231868 5231863 -
ttttccttgagcaccatttttg

SEQ ID NO: 143212 - DNA, 22 bp, Artificial Sequence
  Synthetic oligonucleotide; TTT chr11 5231862 5231883 5231867 5231862 -
tttccttgagcaccatttttgc

SEQ ID NO: 143213 - DNA, 22 bp, Artificial Sequence
  Synthetic oligonucleotide; TTT chr11 5231861 5231882 5231866 5231861 -
ttccttgagcaccatttttgcc

SEQ ID NO: 143214 - DNA, 22 bp, Artificial Sequence
  Synthetic oligonucleotide; TTT chr11 5231860 5231881 5231865 5231860 -
tccttgagcaccatttttgcca

SEQ ID NO: 143215 - DNA, 22 bp, Artificial Sequence
  Synthetic oligonucleotide; TTT chr11 5231859 5231880 5231864 5231859 -
ccttgagcaccatttttgccat

SEQ ID NO: 143216 - DNA, 22 bp, Artificial Sequence
  Synthetic oligonucleotide; TTC chr11 5231858 5231879 5231863 5231858 -
cttgagcaccatttttgccata

SEQ ID NO: 143217 - DNA, 22 bp, Artificial Sequence
  Synthetic oligonucleotide; CTT chr11 5231855 5231876 5231860 5231855 -
gagcaccatttttgccataggt

SEQ ID NO: 143218 - DNA, 22 bp, Artificial Sequence
  Synthetic oligonucleotide; TTG chr11 5231854 5231875 5231859 5231854 -
agcaccatttttgccataggta

SEQ ID NO: 143219 - DNA, 22 bp, Artificial Sequence
  Synthetic oligonucleotide; TTT chr11 5231844 5231865 5231849 5231844 -
ttgccataggtaaaattagaag

SEQ ID NO: 143220 - DNA, 22 bp, Artificial Sequence
  Synthetic oligonucleotide; TTT chr11 5231843 5231864 5231848 5231843 -
tgccataggtaaaattagaagg

SEQ ID NO: 143221 - DNA, 22 bp, Artificial Sequence
  Synthetic oligonucleotide; TTT chr11 5231842 5231863 5231847 5231842 -
gccataggtaaaattagaagga

SEQ ID NO: 143222 - DNA, 22 bp, Artificial Sequence
  Synthetic oligonucleotide; TTG chr11 5231841 5231862 5231846 5231841 -
ccataggtaaaattagaaggat

SEQ ID NO: 143223 - DNA, 22 bp, Artificial Sequence
  Synthetic oligonucleotide; TTA chr11 5231826 5231847 5231831 5231826 -
gaaggatttttagaactttctc

SEQ ID NO: 143224 - DNA, 22 bp, Artificial Sequence
  Synthetic oligonucleotide; TTT chr11 5231817 5231838 5231822 5231817 -
ttagaactttctcagttgtata

SEQ ID NO: 143225 - DNA, 22 bp, Artificial Sequence
  Synthetic oligonucleotide; TTT chr11 5231816 5231837 5231821 5231816 -
tagaactttctcagttgtatac

SEQ ID NO: 143226 - DNA, 22 bp, Artificial Sequence
  Synthetic oligonucleotide; TTT chr11 5231815 5231836 5231820 5231815 -
agaactttctcagttgtataca

SEQ ID NO: 143227 - DNA, 22 bp, Artificial Sequence
  Synthetic oligonucleotide; TTA chr11 5231814 5231835 5231819 5231814 -
gaactttctcagttgtatacat

SEQ ID NO: 143228 - DNA, 22 bp, Artificial Sequence
  Synthetic oligonucleotide; CTT chr11 5231808 5231829 5231813 5231808 -
tctcagttgtatacatttttaa

SEQ ID NO: 143229 - DNA, 22 bp, Artificial Sequence
  Synthetic oligonucleotide; TTT chr11 5231807 5231828 5231812 5231807 -
ctcagttgtatacatttttaaa

SEQ ID NO: 143230 - DNA, 22 bp, Artificial Sequence
  Synthetic oligonucleotide; TTC chr11 5231806 5231827 5231811 5231806 -
tcagttgtatacatttttaaaa

SEQ ID NO: 143231 - DNA, 22 bp, Artificial Sequence
  Synthetic oligonucleotide; CTC chr11 5231804 5231825 5231809 5231804 -
agttgtatacatttttaaaaat

SEQ ID NO: 143232 - DNA, 22 bp, Artificial Sequence
  Synthetic oligonucleotide; TTG chr11 5231799 5231820 5231804 5231799 -
tatacatttttaaaaatctgta

SEQ ID NO: 143233 - DNA, 22 bp, Artificial Sequence
  Synthetic oligonucleotide; TTT chr11 5231790 5231811 5231795 5231790 -
ttaaaaatctgtattatatgca

SEQ ID NO: 143234 - DNA, 22 bp, Artificial Sequence
  Synthetic oligonucleotide; TTT chr11 5231789 5231810 5231794 5231789 -
taaaaatctgtattatatgcat

SEQ ID NO: 143235 - DNA, 22 bp, Artificial Sequence
  Synthetic oligonucleotide; TTT chr11 5231788 5231809 5231793 5231788 -
aaaaatctgtattatatgcatg

SEQ ID NO: 143236 - DNA, 22 bp, Artificial Sequence
  Synthetic oligonucleotide; TTA chr11 5231787 5231808 5231792 5231787 -
aaaatctgtattatatgcatgt

SEQ ID NO: 143237 - DNA, 22 bp, Artificial Sequence
  Synthetic oligonucleotide; CTG chr11 5231779 5231800 5231784 5231779 -
tattatatgcatgttgattaat

SEQ ID NO: 143238 - DNA, 22 bp, Artificial Sequence
  Synthetic oligonucleotide; TTA chr11 5231774 5231795 5231779 5231774 -
tatgcatgttgattaattttaa

SEQ ID NO: 143239 - DNA, 22 bp, Artificial Sequence
  Synthetic oligonucleotide; TTG chr11 5231763 5231784 5231768 5231763 -
attaattttaaacttacttgaa

SEQ ID NO: 143240 - DNA, 22 bp, Artificial Sequence
  Synthetic oligonucleotide; TTA chr11 5231759 5231780 5231764 5231759 -
attttaaacttacttgaatacc

SEQ ID NO: 143241 - DNA, 22 bp, Artificial Sequence
  Synthetic oligonucleotide; TTT chr11 5231755 5231776 5231760 5231755 -
taaacttacttgaatacctaaa

SEQ ID NO: 143242 - DNA, 22 bp, Artificial Sequence
  Synthetic oligonucleotide; TTT chr11 5231754 5231775 5231759 5231754 -
aaacttacttgaatacctaaac

SEQ ID NO: 143243 - DNA, 22 bp, Artificial Sequence
  Synthetic oligonucleotide; TTA chr11 5231753 5231774 5231758 5231753 -
aacttacttgaatacctaaaca

SEQ ID NO: 143244 - DNA, 22 bp, Artificial Sequence
  Synthetic oligonucleotide; CTT chr11 5231748 5231769 5231753 5231748 -
acttgaatacctaaacagaatc

SEQ ID NO: 143245 - DNA, 22 bp, Artificial Sequence
  Synthetic oligonucleotide; TTA chr11 5231747 5231768 5231752 5231747 -
cttgaatacctaaacagaatct

SEQ ID NO: 143246 - DNA, 22 bp, Artificial Sequence
  Synthetic oligonucleotide; CTT chr11 5231744 5231765 5231749 5231744 -
gaatacctaaacagaatctgtt

SEQ ID NO: 143247 - DNA, 22 bp, Artificial Sequence
  Synthetic oligonucleotide; TTG chr11 5231743 5231764 5231748 5231743 -
aatacctaaacagaatctgttg

SEQ ID NO: 143248 - DNA, 22 bp, Artificial Sequence
  Synthetic oligonucleotide; CTA chr11 5231735 5231756 5231740 5231735 -
aacagaatctgttgtttccttg

SEQ ID NO: 143249 - DNA, 22 bp, Artificial Sequence
  Synthetic oligonucleotide; CTG chr11 5231724 5231745 5231729 5231724 -
ttgtttccttgtgtttgaaagt

SEQ ID NO: 143250 - DNA, 22 bp, Artificial Sequence
  Synthetic oligonucleotide; TTG chr11 5231721 5231742 5231726 5231721 -
tttccttgtgtttgaaagtgct

SEQ ID NO: 143251 - DNA, 22 bp, Artificial Sequence
  Synthetic oligonucleotide; TTT chr11 5231718 5231739 5231723 5231718 -
ccttgtgtttgaaagtgctttc

SEQ ID NO: 143252 - DNA, 22 bp, Artificial Sequence
  Synthetic oligonucleotide; TTC chr11 5231717 5231738 5231722 5231717 -
cttgtgtttgaaagtgctttca

SEQ ID NO: 143253 - DNA, 22 bp, Artificial Sequence
  Synthetic oligonucleotide; CTT chr11 5231714 5231735 5231719 5231714 -
gtgtttgaaagtgctttcacag

SEQ ID NO: 143254 - DNA, 22 bp, Artificial Sequence
  Synthetic oligonucleotide; TTG chr11 5231713 5231734 5231718 5231713 -
tgtttgaaagtgctttcacagt

SEQ ID NO: 143255 - DNA, 22 bp, Artificial Sequence
  Synthetic oligonucleotide; TTT chr11 5231708 5231729 5231713 5231708 -
gaaagtgctttcacagtaactc

SEQ ID NO: 143256 - DNA, 22 bp, Artificial Sequence
  Synthetic oligonucleotide; TTG chr11 5231707 5231728 5231712 5231707 -
aaagtgctttcacagtaactct

SEQ ID NO: 143257 - DNA, 22 bp, Artificial Sequence
  Synthetic oligonucleotide; CTT chr11 5231698 5231719 5231703 5231698 -
tcacagtaactctgtctgtact

SEQ ID NO: 143258 - DNA, 22 bp, Artificial Sequence
  Synthetic oligonucleotide; TTT chr11 5231697 5231718 5231702 5231697 -
cacagtaactctgtctgtactg

SEQ ID NO: 143259 - DNA, 22 bp, Artificial Sequence
  Synthetic oligonucleotide; TTC chr11 5231696 5231717 5231701 5231696 -
acagtaactctgtctgtactgc

SEQ ID NO: 143260 - DNA, 22 bp, Artificial Sequence
  Synthetic oligonucleotide; CTC chr11 5231686 5231707 5231691 5231686 -
tgtctgtactgccagaatatac

SEQ ID NO: 143261 - DNA, 22 bp, Artificial Sequence
  Synthetic oligonucleotide; CTG chr11 5231684 5231705 5231689 5231684 -
tctgtactgccagaatatactg

SEQ ID NO: 143262 - DNA, 22 bp, Artificial Sequence
  Synthetic oligonucleotide; CTG chr11 5231680 5231701 5231685 5231680 -
tactgccagaatatactgacaa

SEQ ID NO: 143263 - DNA, 22 bp, Artificial Sequence
  Synthetic oligonucleotide; CTG chr11 5231675 5231696 5231680 5231675 -
ccagaatatactgacaatgtgt

SEQ ID NO: 143264 - DNA, 22 bp, Artificial Sequence
  Synthetic oligonucleotide; CTG chr11 5231662 5231683 5231667 5231662 -
acaatgtgttatagttaactgt

SEQ ID NO: 143265 - DNA, 22 bp, Artificial Sequence
  Synthetic oligonucleotide; TTA chr11 5231651 5231672 5231656 5231651 -
tagttaactgttttgatcacaa

SEQ ID NO: 143266 - DNA, 22 bp, Artificial Sequence
  Synthetic oligonucleotide; TTA chr11 5231645 5231666 5231650 5231645 -
actgttttgatcacaacatttt

SEQ ID NO: 143267 - DNA, 22 bp, Artificial Sequence
  Synthetic oligonucleotide; CTG chr11 5231641 5231662 5231646 5231641 -
ttttgatcacaacattttgaat

SEQ ID NO: 143268 - DNA, 22 bp, Artificial Sequence
  Synthetic oligonucleotide; TTT chr11 5231638 5231659 5231643 5231638 -
tgatcacaacattttgaattga

SEQ ID NO: 143269 - DNA, 22 bp, Artificial Sequence
  Synthetic oligonucleotide; TTT chr11 5231637 5231658 5231642 5231637 -
gatcacaacattttgaattgac

SEQ ID NO: 143270 - DNA, 22 bp, Artificial Sequence
  Synthetic oligonucleotide; TTG chr11 5231636 5231657 5231641 5231636 -
atcacaacattttgaattgact

SEQ ID NO: 143271 - DNA, 22 bp, Artificial Sequence
  Synthetic oligonucleotide; TTT chr11 5231624 5231645 5231629 5231624 -
tgaattgactggcagcagaagc

SEQ ID NO: 143272 - DNA, 22 bp, Artificial Sequence
  Synthetic oligonucleotide; TTT chr11 5231623 5231644 5231628 5231623 -
gaattgactggcagcagaagct

SEQ ID NO: 143273 - DNA, 22 bp, Artificial Sequence
  Synthetic oligonucleotide; TTG chr11 5231622 5231643 5231627 5231622 -
aattgactggcagcagaagctc

SEQ ID NO: 143274 - DNA, 22 bp, Artificial Sequence
  Synthetic oligonucleotide; TTG chr11 5231617 5231638 5231622 5231617 -
actggcagcagaagctctttta

SEQ ID NO: 143275 - DNA, 22 bp, Artificial Sequence
  Synthetic oligonucleotide; CTG chr11 5231613 5231634 5231618 5231613 -
gcagcagaagctcttttatatc

SEQ ID NO: 143276 - DNA, 22 bp, Artificial Sequence
  Synthetic oligonucleotide; CTC chr11 5231600 5231621 5231605 5231600 -
ttttatatccatgtgttttcct

SEQ ID NO: 143277 - DNA, 22 bp, Artificial Sequence
  Synthetic oligonucleotide; CTT chr11 5231598 5231619 5231603 5231598 -
ttatatccatgtgttttcctta

SEQ ID NO: 143278 - DNA, 22 bp, Artificial Sequence
  Synthetic oligonucleotide; TTT chr11 5231597 5231618 5231602 5231597 -
tatatccatgtgttttccttaa

SEQ ID NO: 143279 - DNA, 22 bp, Artificial Sequence
  Synthetic oligonucleotide; TTT chr11 5231596 5231617 5231601 5231596 -
atatccatgtgttttccttaag

SEQ ID NO: 143280 - DNA, 22 bp, Artificial Sequence
  Synthetic oligonucleotide; TTA chr11 5231595 5231616 5231600 5231595 -
tatccatgtgttttccttaagt

SEQ ID NO: 143281 - DNA, 22 bp, Artificial Sequence
  Synthetic oligonucleotide; TTT chr11 5231582 5231603 5231587 5231582 -
tccttaagtcattatacatagt

SEQ ID NO: 143282 - DNA, 22 bp, Artificial Sequence
  Synthetic oligonucleotide; TTT chr11 5231581 5231602 5231586 5231581 -
ccttaagtcattatacatagta

SEQ ID NO: 143283 - DNA, 22 bp, Artificial Sequence
  Synthetic oligonucleotide; TTC chr11 5231580 5231601 5231585 5231580 -
cttaagtcattatacatagtag

SEQ ID NO: 143284 - DNA, 22 bp, Artificial Sequence
  Synthetic oligonucleotide; CTT chr11 5231577 5231598 5231582 5231577 -
aagtcattatacatagtaggca

SEQ ID NO: 143285 - DNA, 22 bp, Artificial Sequence
  Synthetic oligonucleotide; TTA chr11 5231576 5231597 5231581 5231576 -
agtcattatacatagtaggcac

SEQ ID NO: 143286 - DNA, 22 bp, Artificial Sequence
  Synthetic oligonucleotide; TTA chr11 5231568 5231589 5231573 5231568 -
tacatagtaggcactgagaact

SEQ ID NO: 143287 - DNA, 22 bp, Artificial Sequence
  Synthetic oligonucleotide; CTG chr11 5231552 5231573 5231557 5231552 -
agaactctttatatctgaataa

SEQ ID NO: 143288 - DNA, 22 bp, Artificial Sequence
  Synthetic oligonucleotide; CTC chr11 5231545 5231566 5231550 5231545 -
tttatatctgaataagatattt

SEQ ID NO: 143289 - DNA, 22 bp, Artificial Sequence
  Synthetic oligonucleotide; CTT chr11 5231543 5231564 5231548 5231543 -
tatatctgaataagatatttag

SEQ ID NO: 143290 - DNA, 22 bp, Artificial Sequence
  Synthetic oligonucleotide; TTT chr11 5231542 5231563 5231547 5231542 -
atatctgaataagatatttagg

SEQ ID NO: 143291 - DNA, 22 bp, Artificial Sequence
  Synthetic oligonucleotide; TTA chr11 5231541 5231562 5231546 5231541 -
tatctgaataagatatttagga

SEQ ID NO: 143292 - DNA, 22 bp, Artificial Sequence
  Synthetic oligonucleotide; CTG chr11 5231535 5231556 5231540 5231535 -
aataagatatttaggaaccact

SEQ ID NO: 143293 - DNA, 22 bp, Artificial Sequence
  Synthetic oligonucleotide; TTT chr11 5231523 5231544 5231528 5231523 -
aggaaccactggtttacatatc

SEQ ID NO: 143294 - DNA, 22 bp, Artificial Sequence
  Synthetic oligonucleotide; TTA chr11 5231522 5231543 5231527 5231522 -
ggaaccactggtttacatatca

SEQ ID NO: 143295 - DNA, 22 bp, Artificial Sequence
  Synthetic oligonucleotide; CTG chr11 5231512 5231533 5231517 5231512 -
gtttacatatcagaagcagagc

SEQ ID NO: 143296 - DNA, 22 bp, Artificial Sequence
  Synthetic oligonucleotide; TTT chr11 5231508 5231529 5231513 5231508 -
acatatcagaagcagagctact

SEQ ID NO: 143297 - DNA, 22 bp, Artificial Sequence
  Synthetic oligonucleotide; TTA chr11 5231507 5231528 5231512 5231507 -
catatcagaagcagagctactc

SEQ ID NO: 143298 - DNA, 22 bp, Artificial Sequence
  Synthetic oligonucleotide; CTA chr11 5231488 5231509 5231493 5231488 -
ctcagggcattttggggaagat

SEQ ID NO: 143299 - DNA, 22 bp, Artificial Sequence
  Synthetic oligonucleotide; CTC chr11 5231485 5231506 5231490 5231485 -
agggcattttggggaagatcac

SEQ ID NO: 143300 - DNA, 22 bp, Artificial Sequence
  Synthetic oligonucleotide; TTT chr11 5231476 5231497 5231481 5231476 -
tggggaagatcactttcacatt

SEQ ID NO: 143301 - DNA, 22 bp, Artificial Sequence
  Synthetic oligonucleotide; TTT chr11 5231475 5231496 5231480 5231475 -
ggggaagatcactttcacattc

SEQ ID NO: 143302 - DNA, 22 bp, Artificial Sequence
  Synthetic oligonucleotide; TTG chr11 5231474 5231495 5231479 5231474 -
gggaagatcactttcacattcc

SEQ ID NO: 143303 - DNA, 22 bp, Artificial Sequence
  Synthetic oligonucleotide; CTT chr11 5231461 5231482 5231466 5231461 -
tcacattcctgagcatagggaa

SEQ ID NO: 143304 - DNA, 22 bp, Artificial Sequence
  Synthetic oligonucleotide; TTT chr11 5231460 5231481 5231465 5231460 -
cacattcctgagcatagggaag

SEQ ID NO: 143305 - DNA, 22 bp, Artificial Sequence
  Synthetic oligonucleotide; TTC chr11 5231459 5231480 5231464 5231459 -
acattcctgagcatagggaagt

SEQ ID NO: 143306 - DNA, 22 bp, Artificial Sequence
  Synthetic oligonucleotide; TTC chr11 5231453 5231474 5231458 5231453 -
ctgagcatagggaagttctcat

SEQ ID NO: 143307 - DNA, 22 bp, Artificial Sequence
  Synthetic oligonucleotide; CTG chr11 5231450 5231471 5231455 5231450 -
agcatagggaagttctcataag

SEQ ID NO: 143308 - DNA, 22 bp, Artificial Sequence
  Synthetic oligonucleotide; TTC chr11 5231435 5231456 5231440 5231435 -
tcataagagtaagatattaaaa

SEQ ID NO: 143309 - DNA, 22 bp, Artificial Sequence
  Synthetic oligonucleotide; CTC chr11 5231433 5231454 5231438 5231433 -
ataagagtaagatattaaaagg

SEQ ID NO: 143310 - DNA, 22 bp, Artificial Sequence
  Synthetic oligonucleotide; TTA chr11 5231416 5231437 5231421 5231416 -
aaaggagatacttgtgtggtat

SEQ ID NO: 143311 - DNA, 22 bp, Artificial Sequence
  Synthetic oligonucleotide; CTT chr11 5231403 5231424 5231408 5231403 -
gtgtggtattcgaaagacagta

SEQ ID NO: 143312 - DNA, 22 bp, Artificial Sequence
  Synthetic oligonucleotide; TTG chr11 5231402 5231423 5231407 5231402 -
tgtggtattcgaaagacagtaa

SEQ ID NO: 143313 - DNA, 22 bp, Artificial Sequence
  Synthetic oligonucleotide; TTC chr11 5231392 5231413 5231397 5231392 -
gaaagacagtaagagagattgt

SEQ ID NO: 143314 - DNA, 22 bp, Artificial Sequence
  Synthetic oligonucleotide; TTG chr11 5231371 5231392 5231376 5231371 -
tagaccttatgatcttgatagg

SEQ ID NO: 143315 - DNA, 22 bp, Artificial Sequence
  Synthetic oligonucleotide; CTT chr11 5231363 5231384 5231368 5231363 -
atgatcttgatagggaaaacaa

SEQ ID NO: 143316 - DNA, 22 bp, Artificial Sequence
  Synthetic oligonucleotide; TTA chr11 5231362 5231383 5231367 5231362 -
tgatcttgatagggaaaacaaa

SEQ ID NO: 143317 - DNA, 22 bp, Artificial Sequence
  Synthetic oligonucleotide; CTT chr11 5231355 5231376 5231360 5231355 -
gatagggaaaacaaactacatt

SEQ ID NO: 143318 - DNA, 22 bp, Artificial Sequence
  Synthetic oligonucleotide; TTG chr11 5231354 5231375 5231359 5231354 -
atagggaaaacaaactacattc

SEQ ID NO: 143319 - DNA, 22 bp, Artificial Sequence
  Synthetic oligonucleotide; CTA chr11 5231337 5231358 5231342 5231337 -
cattcctttctccaaaagtcaa

SEQ ID NO: 143320 - DNA, 22 bp, Artificial Sequence
  Synthetic oligonucleotide; TTC chr11 5231332 5231353 5231337 5231332 -
ctttctccaaaagtcaaaaaaa

SEQ ID NO: 143321 - DNA, 22 bp, Artificial Sequence
  Synthetic oligonucleotide; CTT chr11 5231329 5231350 5231334 5231329 -
tctccaaaagtcaaaaaaaaag

SEQ ID NO: 143322 - DNA, 22 bp, Artificial Sequence
  Synthetic oligonucleotide; TTT chr11 5231328 5231349 5231333 5231328 -
ctccaaaagtcaaaaaaaaaga

SEQ ID NO: 143323 - DNA, 22 bp, Artificial Sequence
  Synthetic oligonucleotide; TTC chr11 5231327 5231348 5231332 5231327 -
tccaaaagtcaaaaaaaaagag

SEQ ID NO: 143324 - DNA, 22 bp, Artificial Sequence
  Synthetic oligonucleotide; CTC chr11 5231325 5231346 5231330 5231325 -
caaaagtcaaaaaaaaagagca

SEQ ID NO: 143325 - DNA, 22 bp, Artificial Sequence
  Synthetic oligonucleotide; CTT chr11 5231293 5231314 5231298 5231293 -
actataccttctattcctacac

SEQ ID NO: 143326 - DNA, 22 bp, Artificial Sequence
  Synthetic oligonucleotide; TTA chr11 5231292 5231313 5231297 5231292 -
ctataccttctattcctacacc

SEQ ID NO: 143327 - DNA, 22 bp, Artificial Sequence
  Synthetic oligonucleotide; CTA chr11 5231289 5231310 5231294 5231289 -
taccttctattcctacaccatt

SEQ ID NO: 143328 - DNA, 22 bp, Artificial Sequence
  Synthetic oligonucleotide; CTT chr11 5231283 5231304 5231288 5231283 -
ctattcctacaccattagaagt

SEQ ID NO: 143329 - DNA, 22 bp, Artificial Sequence
  Synthetic oligonucleotide; TTC chr11 5231282 5231303 5231287 5231282 -
tattcctacaccattagaagta

SEQ ID NO: 143330 - DNA, 22 bp, Artificial Sequence
  Synthetic oligonucleotide; CTA chr11 5231280 5231301 5231285 5231280 -
ttcctacaccattagaagtagt

SEQ ID NO: 143331 - DNA, 22 bp, Artificial Sequence
  Synthetic oligonucleotide; TTC chr11 5231277 5231298 5231282 5231277 -
ctacaccattagaagtagtcag

SEQ ID NO: 143332 - DNA, 22 bp, Artificial Sequence
  Synthetic oligonucleotide; CTA chr11 5231274 5231295 5231279 5231274 -
caccattagaagtagtcagtga

SEQ ID NO: 143333 - DNA, 22 bp, Artificial Sequence
  Synthetic oligonucleotide; TTA chr11 5231266 5231287 5231271 5231266 -
gaagtagtcagtgagtctaggc

SEQ ID NO: 143334 - DNA, 22 bp, Artificial Sequence
  Synthetic oligonucleotide; CTA chr11 5231247 5231268 5231252 5231247 -
ggcaagatgttggccctaaaaa

SEQ ID NO: 143335 - DNA, 22 bp, Artificial Sequence
  Synthetic oligonucleotide; TTG chr11 5231235 5231256 5231240 5231235 -
gccctaaaaatccaaataccag

SEQ ID NO: 143336 - DNA, 22 bp, Artificial Sequence
  Synthetic oligonucleotide; CTA chr11 5231229 5231250 5231234 5231229 -
aaaatccaaataccagagaatt

SEQ ID NO: 143337 - DNA, 22 bp, Artificial Sequence
  Synthetic oligonucleotide; TTC chr11 5231206 5231227 5231211 5231206 -
atgagaacatcacctggatggg

SEQ ID NO: 143338 - DNA, 22 bp, Artificial Sequence
  Synthetic oligonucleotide; CTG chr11 5231190 5231211 5231195 5231190 -
gatgggacatgtgccgagcaca

SEQ ID NO: 143339 - DNA, 22 bp, Artificial Sequence
  Synthetic oligonucleotide; TTA chr11 5231160 5231181 5231165 5231160 -
ctatatgctaggcattgctatc

SEQ ID NO: 143340 - DNA, 22 bp, Artificial Sequence
  Synthetic oligonucleotide; CTA chr11 5231157 5231178 5231162 5231157 -
tatgctaggcattgctatcttc

SEQ ID NO: 143341 - DNA, 22 bp, Artificial Sequence
  Synthetic oligonucleotide; CTA chr11 5231150 5231171 5231155 5231150 -
ggcattgctatcttcatattga

SEQ ID NO: 143342 - DNA, 22 bp, Artificial Sequence
  Synthetic oligonucleotide; TTG chr11 5231143 5231164 5231148 5231143 -
ctatcttcatattgaagatgag

SEQ ID NO: 143343 - DNA, 22 bp, Artificial Sequence
  Synthetic oligonucleotide; CTA chr11 5231140 5231161 5231145 5231140 -
tcttcatattgaagatgaggag

SEQ ID NO: 143344 - DNA, 22 bp, Artificial Sequence
  Synthetic oligonucleotide; CTT chr11 5231136 5231157 5231141 5231136 -
catattgaagatgaggaggtca

SEQ ID NO: 143345 - DNA, 22 bp, Artificial Sequence
  Synthetic oligonucleotide; TTC chr11 5231135 5231156 5231140 5231135 -
atattgaagatgaggaggtcaa

SEQ ID NO: 143346 - DNA, 22 bp, Artificial Sequence
  Synthetic oligonucleotide; TTG chr11 5231129 5231150 5231134 5231129 -
aagatgaggaggtcaagagatg

SEQ ID NO: 143347 - DNA, 22 bp, Artificial Sequence
  Synthetic oligonucleotide; CTT chr11 5231096 5231117 5231101 5231096 -
ggcaccttgttgttatattaaa

SEQ ID NO: 143348 - DNA, 22 bp, Artificial Sequence
  Synthetic oligonucleotide; TTG chr11 5231095 5231116 5231100 5231095 -
gcaccttgttgttatattaaaa

SEQ ID NO: 143349 - DNA, 22 bp, Artificial Sequence
  Synthetic oligonucleotide; CTT chr11 5231088 5231109 5231093 5231088 -
gttgttatattaaaattatttg

SEQ ID NO: 143350 - DNA, 22 bp, Artificial Sequence
  Synthetic oligonucleotide; TTG chr11 5231087 5231108 5231092 5231087 -
ttgttatattaaaattatttgt

SEQ ID NO: 143351 - DNA, 22 bp, Artificial Sequence
  Synthetic oligonucleotide; TTG chr11 5231084 5231105 5231089 5231084 -
ttatattaaaattatttgttag

SEQ ID NO: 143352 - DNA, 22 bp, Artificial Sequence
  Synthetic oligonucleotide; TTA chr11 5231081 5231102 5231086 5231081 -
tattaaaattatttgttagagt

SEQ ID NO: 143353 - DNA, 22 bp, Artificial Sequence
  Synthetic oligonucleotide; TTA chr11 5231076 5231097 5231081 5231076 -
aaattatttgttagagtagagc

SEQ ID NO: 143354 - DNA, 22 bp, Artificial Sequence
  Synthetic oligonucleotide; TTA chr11 5231070 5231091 5231075 5231070 -
tttgttagagtagagcttttgt

SEQ ID NO: 143355 - DNA, 22 bp, Artificial Sequence
  Synthetic oligonucleotide; TTT chr11 5231067 5231088 5231072 5231067 -
gttagagtagagcttttgtaag

SEQ ID NO: 143356 - DNA, 22 bp, Artificial Sequence
  Synthetic oligonucleotide; TTG chr11 5231066 5231087 5231071 5231066 -
ttagagtagagcttttgtaaga

SEQ ID NO: 143357 - DNA, 22 bp, Artificial Sequence
  Synthetic oligonucleotide; TTA chr11 5231063 5231084 5231068 5231063 -
gagtagagcttttgtaagagtc

SEQ ID NO: 143358 - DNA, 22 bp, Artificial Sequence
  Synthetic oligonucleotide; CTT chr11 5231052 5231073 5231057 5231052 -
ttgtaagagtctaggagtgtgg

SEQ ID NO: 143359 - DNA, 22 bp, Artificial Sequence
  Synthetic oligonucleotide; TTT chr11 5231051 5231072 5231056 5231051 -
tgtaagagtctaggagtgtggg

SEQ ID NO: 143360 - DNA, 22 bp, Artificial Sequence
  Synthetic oligonucleotide; TTT chr11 5231050 5231071 5231055 5231050 -
gtaagagtctaggagtgtggga

SEQ ID NO: 143361 - DNA, 22 bp, Artificial Sequence
  Synthetic oligonucleotide; TTG chr11 5231049 5231070 5231054 5231049 -
taagagtctaggagtgtgggag

SEQ ID NO: 143362 - DNA, 22 bp, Artificial Sequence
  Synthetic oligonucleotide; CTA chr11 5231039 5231060 5231044 5231039 -
ggagtgtgggagctaaatgatg

SEQ ID NO: 143363 - DNA, 22 bp, Artificial Sequence
  Synthetic oligonucleotide; CTA chr11 5231024 5231045 5231029 5231024 -
aatgatgatacacatggacaca

SEQ ID NO: 143364 - DNA, 22 bp, Artificial Sequence
  Synthetic oligonucleotide; CTA chr11 5230973 5230994 5230978 5230973 -
cttgagggttgagggtgggaag

SEQ ID NO: 143365 - DNA, 22 bp, Artificial Sequence
  Synthetic oligonucleotide; CTT chr11 5230970 5230991 5230975 5230970 -
gagggttgagggtgggaagagg

SEQ ID NO: 143366 - DNA, 22 bp, Artificial Sequence
  Synthetic oligonucleotide; TTG chr11 5230969 5230990 5230974 5230969 -
agggttgagggtgggaagaggg

SEQ ID NO: 143367 - DNA, 22 bp, Artificial Sequence
  Synthetic oligonucleotide; TTG chr11 5230962 5230983 5230967 5230962 -
agggtgggaagagggagacgat

SEQ ID NO: 143368 - DNA, 22 bp, Artificial Sequence
  Synthetic oligonucleotide; CTA chr11 5230927 5230948 5230932 5230927 -
ttgggtattaagttcatcactg

SEQ ID NO: 143369 - DNA, 22 bp, Artificial Sequence
  Synthetic oligonucleotide; TTG chr11 5230924 5230945 5230929 5230924 -
ggtattaagttcatcactgagt

SEQ ID NO: 143370 - DNA, 22 bp, Artificial Sequence
  Synthetic oligonucleotide; TTA chr11 5230917 5230938 5230922 5230917 -
agttcatcactgagtgatgaaa

SEQ ID NO: 143371 - DNA, 22 bp, Artificial Sequence
  Synthetic oligonucleotide; TTC chr11 5230912 5230933 5230917 5230912 -
atcactgagtgatgaaataatc

SEQ ID NO: 143372 - DNA, 22 bp, Artificial Sequence
  Synthetic oligonucleotide; CTG chr11 5230905 5230926 5230910 5230905 -
agtgatgaaataatctgtacat

SEQ ID NO: 143373 - DNA, 22 bp, Artificial Sequence
  Synthetic oligonucleotide; CTG chr11 5230888 5230909 5230893 5230888 -
tacatcaagacccagtgatatg

SEQ ID NO: 143374 - DNA, 22 bp, Artificial Sequence
  Synthetic oligonucleotide; TTT chr11 5230860 5230881 5230865 5230860 -
acctatataacttgtacatgta

SEQ ID NO: 143375 - DNA, 22 bp, Artificial Sequence
  Synthetic oligonucleotide; TTA chr11 5230859 5230880 5230864 5230859 -
cctatataacttgtacatgtac

SEQ ID NO: 143376 - DNA, 22 bp, Artificial Sequence
  Synthetic oligonucleotide; CTA chr11 5230855 5230876 5230860 5230855 -
tataacttgtacatgtaccccc

SEQ ID NO: 143377 - DNA, 22 bp, Artificial Sequence
  Synthetic oligonucleotide; CTT chr11 5230847 5230868 5230852 5230847 -
gtacatgtacccccaaatttaa

SEQ ID NO: 143378 - DNA, 22 bp, Artificial Sequence
  Synthetic oligonucleotide; TTG chr11 5230846 5230867 5230851 5230846 -
tacatgtacccccaaatttaaa

SEQ ID NO: 143379 - DNA, 22 bp, Artificial Sequence
  Synthetic oligonucleotide; TTT chr11 5230827 5230848 5230832 5230827 -
aaaatgaaagttaaaacaaagt

SEQ ID NO: 143380 - DNA, 22 bp, Artificial Sequence
  Synthetic oligonucleotide; TTA chr11 5230826 5230847 5230831 5230826 -
aaatgaaagttaaaacaaagta

SEQ ID NO: 143381 - DNA, 22 bp, Artificial Sequence
  Synthetic oligonucleotide; TTA chr11 5230814 5230835 5230819 5230814 -
aaacaaagtataggaatggaat

SEQ ID NO: 143382 - DNA, 22 bp, Artificial Sequence
  Synthetic oligonucleotide; TTA chr11 5230790 5230811 5230795 5230790 -
attcctcaagatttggctttaa

SEQ ID NO: 143383 - DNA, 22 bp, Artificial Sequence
  Synthetic oligonucleotide; TTC chr11 5230786 5230807 5230791 5230786 -
ctcaagatttggctttaatttt

SEQ ID NO: 143384 - DNA, 22 bp, Artificial Sequence
  Synthetic oligonucleotide; CTC chr11 5230783 5230804 5230788 5230783 -
aagatttggctttaattttatt

SEQ ID NO: 143385 - DNA, 22 bp, Artificial Sequence
  Synthetic oligonucleotide; TTT chr11 5230776 5230797 5230781 5230776 -
ggctttaattttatttgataat

SEQ ID NO: 143386 - DNA, 22 bp, Artificial Sequence
  Synthetic oligonucleotide; TTG chr11 5230775 5230796 5230780 5230775 -
gctttaattttatttgataatt

SEQ ID NO: 143387 - DNA, 22 bp, Artificial Sequence
  Synthetic oligonucleotide; CTT chr11 5230771 5230792 5230776 5230771 -
taattttatttgataatttatc

SEQ ID NO: 143388 - DNA, 22 bp, Artificial Sequence
  Synthetic oligonucleotide; TTT chr11 5230770 5230791 5230775 5230770 -
aattttatttgataatttatca

SEQ ID NO: 143389 - DNA, 22 bp, Artificial Sequence
  Synthetic oligonucleotide; TTA chr11 5230769 5230790 5230774 5230769 -
attttatttgataatttatcaa

SEQ ID NO: 143390 - DNA, 22 bp, Artificial Sequence
  Synthetic oligonucleotide; TTT chr11 5230765 5230786 5230770 5230765 -
tatttgataatttatcaaatgg

SEQ ID NO: 143391 - DNA, 22 bp, Artificial Sequence
  Synthetic oligonucleotide; TTT chr11 5230764 5230785 5230769 5230764 -
atttgataatttatcaaatggt

SEQ ID NO: 143392 - DNA, 22 bp, Artificial Sequence
  Synthetic oligonucleotide; TTA chr11 5230763 5230784 5230768 5230763 -
tttgataatttatcaaatggtt

SEQ ID NO: 143393 - DNA, 22 bp, Artificial Sequence
  Synthetic oligonucleotide; TTT chr11 5230760 5230781 5230765 5230760 -
gataatttatcaaatggttgtt

SEQ ID NO: 143394 - DNA, 22 bp, Artificial Sequence
  Synthetic oligonucleotide; TTG chr11 5230759 5230780 5230764 5230759 -
ataatttatcaaatggttgttt

SEQ ID NO: 143395 - DNA, 22 bp, Artificial Sequence
  Synthetic oligonucleotide; TTT chr11 5230752 5230773 5230757 5230752 -
atcaaatggttgtttttctttt

SEQ ID NO: 143396 - DNA, 22 bp, Artificial Sequence
  Synthetic oligonucleotide; TTA chr11 5230751 5230772 5230756 5230751 -
tcaaatggttgtttttcttttc

SEQ ID NO: 143397 - DNA, 22 bp, Artificial Sequence
  Synthetic oligonucleotide; TTG chr11 5230740 5230761 5230745 5230740 -
tttttcttttctcactatggcg

SEQ ID NO: 143398 - DNA, 22 bp, Artificial Sequence
  Synthetic oligonucleotide; TTT chr11 5230737 5230758 5230742 5230737 -
ttcttttctcactatggcgttg

SEQ ID NO: 143399 - DNA, 22 bp, Artificial Sequence
  Synthetic oligonucleotide; TTT chr11 5230736 5230757 5230741 5230736 -
tcttttctcactatggcgttgc

SEQ ID NO: 143400 - DNA, 22 bp, Artificial Sequence
  Synthetic oligonucleotide; TTT chr11 5230735 5230756 5230740 5230735 -
cttttctcactatggcgttgct

SEQ ID NO: 143401 - DNA, 22 bp, Artificial Sequence
  Synthetic oligonucleotide; TTC chr11 5230734 5230755 5230739 5230734 -
ttttctcactatggcgttgctt

SEQ ID NO: 143402 - DNA, 22 bp, Artificial Sequence
  Synthetic oligonucleotide; CTT chr11 5230732 5230753 5230737 5230732 -
ttctcactatggcgttgcttta

SEQ ID NO: 143403 - DNA, 22 bp, Artificial Sequence
  Synthetic oligonucleotide; TTT chr11 5230731 5230752 5230736 5230731 -
tctcactatggcgttgctttat

SEQ ID NO: 143404 - DNA, 22 bp, Artificial Sequence
  Synthetic oligonucleotide; TTT chr11 5230730 5230751 5230735 5230730 -
ctcactatggcgttgctttata

SEQ ID NO: 143405 - DNA, 22 bp, Artificial Sequence
  Synthetic oligonucleotide; TTC chr11 5230729 5230750 5230734 5230729 -
tcactatggcgttgctttataa

SEQ ID NO: 143406 - DNA, 22 bp, Artificial Sequence
  Synthetic oligonucleotide; CTC chr11 5230727 5230748 5230732 5230727 -
actatggcgttgctttataaac

SEQ ID NO: 143407 - DNA, 22 bp, Artificial Sequence
  Synthetic oligonucleotide; CTA chr11 5230723 5230744 5230728 5230723 -
tggcgttgctttataaactatg

SEQ ID NO: 143408 - DNA, 22 bp, Artificial Sequence
  Synthetic oligonucleotide; TTG chr11 5230715 5230736 5230720 5230715 -
ctttataaactatgttcagtat

SEQ ID NO: 143409 - DNA, 22 bp, Artificial Sequence
  Synthetic oligonucleotide; CTT chr11 5230712 5230733 5230717 5230712 -
tataaactatgttcagtatgtc

SEQ ID NO: 143410 - DNA, 22 bp, Artificial Sequence
  Synthetic oligonucleotide; TTT chr11 5230711 5230732 5230716 5230711 -
ataaactatgttcagtatgtct

SEQ ID NO: 143411 - DNA, 22 bp, Artificial Sequence
  Synthetic oligonucleotide; TTA chr11 5230710 5230731 5230715 5230710 -
taaactatgttcagtatgtctg

SEQ ID NO: 143412 - DNA, 22 bp, Artificial Sequence
  Synthetic oligonucleotide; CTA chr11 5230703 5230724 5230708 5230703 -
tgttcagtatgtctgaatgaaa

SEQ ID NO: 143413 - DNA, 22 bp, Artificial Sequence
  Synthetic oligonucleotide; TTC chr11 5230698 5230719 5230703 5230698 -
agtatgtctgaatgaaagggtg

SEQ ID NO: 143414 - DNA, 22 bp, Artificial Sequence
  Synthetic oligonucleotide; CTG chr11 5230688 5230709 5230693 5230688 -
aatgaaagggtgtgtgtgtgtg

SEQ ID NO: 143415 - DNA, 22 bp, Artificial Sequence
  Synthetic oligonucleotide; TTT chr11 5230616 5230637 5230621 5230616 -
gagttcatgaaaatttttcaat

SEQ ID NO: 143416 - DNA, 22 bp, Artificial Sequence
  Synthetic oligonucleotide; TTG chr11 5230615 5230636 5230620 5230615 -
agttcatgaaaatttttcaata

SEQ ID NO: 143417 - DNA, 22 bp, Artificial Sequence
  Synthetic oligonucleotide; TTC chr11 5230610 5230631 5230615 5230610 -
atgaaaatttttcaataaaata

SEQ ID NO: 143418 - DNA, 22 bp, Artificial Sequence
  Synthetic oligonucleotide; TTT chr11 5230600 5230621 5230605 5230600 -
ttcaataaaataatttaatgtc

SEQ ID NO: 143419 - DNA, 22 bp, Artificial Sequence
  Synthetic oligonucleotide; TTT chr11 5230599 5230620 5230604 5230599 -
tcaataaaataatttaatgtca

SEQ ID NO: 143420 - DNA, 22 bp, Artificial Sequence
  Synthetic oligonucleotide; TTT chr11 5230598 5230619 5230603 5230598 -
caataaaataatttaatgtcag

SEQ ID NO: 143421 - DNA, 22 bp, Artificial Sequence
  Synthetic oligonucleotide; TTC chr11 5230597 5230618 5230602 5230597 -
aataaaataatttaatgtcagg

SEQ ID NO: 143422 - DNA, 22 bp, Artificial Sequence
  Synthetic oligonucleotide; TTT chr11 5230584 5230605 5230589 5230584 -
aatgtcaggagaattaagccta

SEQ ID NO: 143423 - DNA, 22 bp, Artificial Sequence
  Synthetic oligonucleotide; TTA chr11 5230583 5230604 5230588 5230583 -
atgtcaggagaattaagcctaa

SEQ ID NO: 143424 - DNA, 22 bp, Artificial Sequence
  Synthetic oligonucleotide; TTA chr11 5230568 5230589 5230573 5230568 -
agcctaatagtctcctaaatca

SEQ ID NO: 143425 - DNA, 22 bp, Artificial Sequence
  Synthetic oligonucleotide; CTA chr11 5230562 5230583 5230567 5230562 -
atagtctcctaaatcatccatc

SEQ ID NO: 143426 - DNA, 22 bp, Artificial Sequence
  Synthetic oligonucleotide; CTC chr11 5230554 5230575 5230559 5230554 -
ctaaatcatccatctcttgagc

SEQ ID NO: 143427 - DNA, 22 bp, Artificial Sequence
  Synthetic oligonucleotide; CTA chr11 5230551 5230572 5230556 5230551 -
aatcatccatctcttgagcttc

SEQ ID NO: 143428 - DNA, 22 bp, Artificial Sequence
  Synthetic oligonucleotide; CTC chr11 5230538 5230559 5230543 5230538 -
ttgagcttcagagcagtcctct

SEQ ID NO: 143429 - DNA, 22 bp, Artificial Sequence
  Synthetic oligonucleotide; CTT chr11 5230536 5230557 5230541 5230536 -
gagcttcagagcagtcctctga

SEQ ID NO: 143430 - DNA, 22 bp, Artificial Sequence
  Synthetic oligonucleotide; TTG chr11 5230535 5230556 5230540 5230535 -
agcttcagagcagtcctctgaa

SEQ ID NO: 143431 - DNA, 22 bp, Artificial Sequence
  Synthetic oligonucleotide; CTT chr11 5230530 5230551 5230535 5230530 -
cagagcagtcctctgaattaat

SEQ ID NO: 143432 - DNA, 22 bp, Artificial Sequence
  Synthetic oligonucleotide; TTC chr11 5230529 5230550 5230534 5230529 -
agagcagtcctctgaattaatg

SEQ ID NO: 143433 - DNA, 22 bp, Artificial Sequence
  Synthetic oligonucleotide; CTC chr11 5230517 5230538 5230522 5230517 -
tgaattaatgcctacatgtttg

SEQ ID NO: 143434 - DNA, 22 bp, Artificial Sequence
  Synthetic oligonucleotide; CTG chr11 5230515 5230536 5230520 5230515 -
aattaatgcctacatgtttgta

SEQ ID NO: 143435 - DNA, 22 bp, Artificial Sequence
  Synthetic oligonucleotide; TTA chr11 5230510 5230531 5230515 5230510 -
atgcctacatgtttgtaaaggg

SEQ ID NO: 143436 - DNA, 22 bp, Artificial Sequence
  Synthetic oligonucleotide; CTA chr11 5230503 5230524 5230508 5230503 -
catgtttgtaaagggtgttcag

SEQ ID NO: 143437 - DNA, 22 bp, Artificial Sequence
  Synthetic oligonucleotide; TTT chr11 5230496 5230517 5230501 5230496 -
gtaaagggtgttcagactgaag

SEQ ID NO: 143438 - DNA, 22 bp, Artificial Sequence
  Synthetic oligonucleotide; TTG chr11 5230495 5230516 5230500 5230495 -
taaagggtgttcagactgaagc

SEQ ID NO: 143439 - DNA, 22 bp, Artificial Sequence
  Synthetic oligonucleotide; TTC chr11 5230483 5230504 5230488 5230483 -
agactgaagccaagattctacc

SEQ ID NO: 143440 - DNA, 22 bp, Artificial Sequence
  Synthetic oligonucleotide; CTG chr11 5230477 5230498 5230482 5230477 -
aagccaagattctacctctaaa

SEQ ID NO: 143441 - DNA, 22 bp, Artificial Sequence
  Synthetic oligonucleotide; TTC chr11 5230465 5230486 5230470 5230465 -
tacctctaaagagatgcaatct

SEQ ID NO: 143442 - DNA, 22 bp, Artificial Sequence
  Synthetic oligonucleotide; CTA chr11 5230463 5230484 5230468 5230463 -
cctctaaagagatgcaatctca

SEQ ID NO: 143443 - DNA, 22 bp, Artificial Sequence
  Synthetic oligonucleotide; CTC chr11 5230459 5230480 5230464 5230459 -
taaagagatgcaatctcaaatt

SEQ ID NO: 143444 - DNA, 22 bp, Artificial Sequence
  Synthetic oligonucleotide; CTA chr11 5230457 5230478 5230462 5230457 -
aagagatgcaatctcaaattta

SEQ ID NO: 143445 - DNA, 22 bp, Artificial Sequence
  Synthetic oligonucleotide; CTC chr11 5230442 5230463 5230447 5230442 -
aaatttatctgaagactgtacc

SEQ ID NO: 143446 - DNA, 22 bp, Artificial Sequence
  Synthetic oligonucleotide; TTT chr11 5230436 5230457 5230441 5230436 -
atctgaagactgtacctctgct

SEQ ID NO: 143447 - DNA, 22 bp, Artificial Sequence
  Synthetic oligonucleotide; TTA chr11 5230435 5230456 5230440 5230435 -
tctgaagactgtacctctgctc

SEQ ID NO: 143448 - DNA, 22 bp, Artificial Sequence
  Synthetic oligonucleotide; CTG chr11 5230431 5230452 5230436 5230431 -
aagactgtacctctgctctcca

SEQ ID NO: 143449 - DNA, 22 bp, Artificial Sequence
  Synthetic oligonucleotide; CTG chr11 5230424 5230445 5230429 5230424 -
tacctctgctctccataaattg

SEQ ID NO: 143450 - DNA, 22 bp, Artificial Sequence
  Synthetic oligonucleotide; CTC chr11 5230418 5230439 5230423 5230418 -
tgctctccataaattgacacca

SEQ ID NO: 143451 - DNA, 22 bp, Artificial Sequence
  Synthetic oligonucleotide; CTG chr11 5230416 5230437 5230421 5230416 -
ctctccataaattgacaccatg

SEQ ID NO: 143452 - DNA, 22 bp, Artificial Sequence
  Synthetic oligonucleotide; CTC chr11 5230413 5230434 5230418 5230413 -
tccataaattgacaccatggcc

SEQ ID NO: 143453 - DNA, 22 bp, Artificial Sequence
  Synthetic oligonucleotide; CTC chr11 5230411 5230432 5230416 5230411 -
cataaattgacaccatggccca

SEQ ID NO: 143454 - DNA, 22 bp, Artificial Sequence
  Synthetic oligonucleotide; TTG chr11 5230402 5230423 5230407 5230402 -
acaccatggcccacttaatgag

SEQ ID NO: 143455 - DNA, 22 bp, Artificial Sequence
  Synthetic oligonucleotide; CTT chr11 5230386 5230407 5230391 5230386 -
aatgaggttaaaaaaaagctaa

SEQ ID NO: 143456 - DNA, 22 bp, Artificial Sequence
  Synthetic oligonucleotide; TTA chr11 5230385 5230406 5230390 5230385 -
atgaggttaaaaaaaagctaat

SEQ ID NO: 143457 - DNA, 22 bp, Artificial Sequence
  Synthetic oligonucleotide; TTA chr11 5230376 5230397 5230381 5230376 -
aaaaaaagctaattctgaatga

SEQ ID NO: 143458 - DNA, 22 bp, Artificial Sequence
  Synthetic oligonucleotide; CTA chr11 5230365 5230386 5230370 5230365 -
attctgaatgaaaatctgagcc

SEQ ID NO: 143459 - DNA, 22 bp, Artificial Sequence
  Synthetic oligonucleotide; TTC chr11 5230361 5230382 5230366 5230361 -
tgaatgaaaatctgagcccagt

SEQ ID NO: 143460 - DNA, 22 bp, Artificial Sequence
  Synthetic oligonucleotide; CTG chr11 5230359 5230380 5230364 5230359 -
aatgaaaatctgagcccagtgg

SEQ ID NO: 143461 - DNA, 22 bp, Artificial Sequence
  Synthetic oligonucleotide; CTG chr11 5230347 5230368 5230352 5230347 -
agcccagtggaggaaatattaa

SEQ ID NO: 143462 - DNA, 22 bp, Artificial Sequence
  Synthetic oligonucleotide; TTA chr11 5230326 5230347 5230331 5230326 -
atgaacaaggtgcagactgaaa

SEQ ID NO: 143463 - DNA, 22 bp, Artificial Sequence
  Synthetic oligonucleotide; CTG chr11 5230307 5230328 5230312 5230307 -
aaatataaatttttctgtaata

SEQ ID NO: 143464 - DNA, 22 bp, Artificial Sequence
  Synthetic oligonucleotide; TTT chr11 5230295 5230316 5230300 5230295 -
ttctgtaataattatgcatata

SEQ ID NO: 143465 - DNA, 22 bp, Artificial Sequence
  Synthetic oligonucleotide; TTT chr11 5230294 5230315 5230299 5230294 -
tctgtaataattatgcatatac

SEQ ID NO: 143466 - DNA, 22 bp, Artificial Sequence
  Synthetic oligonucleotide; TTT chr11 5230293 5230314 5230298 5230293 -
ctgtaataattatgcatatact

SEQ ID NO: 143467 - DNA, 22 bp, Artificial Sequence
  Synthetic oligonucleotide; TTC chr11 5230292 5230313 5230297 5230292 -
tgtaataattatgcatatactt

SEQ ID NO: 143468 - DNA, 22 bp, Artificial Sequence
  Synthetic oligonucleotide; CTG chr11 5230290 5230311 5230295 5230290 -
taataattatgcatatacttta

SEQ ID NO: 143469 - DNA, 22 bp, Artificial Sequence
  Synthetic oligonucleotide; TTA chr11 5230281 5230302 5230286 5230281 -
tgcatatactttagcaaagttc

SEQ ID NO: 143470 - DNA, 22 bp, Artificial Sequence
  Synthetic oligonucleotide; CTT chr11 5230270 5230291 5230275 5230270 -
tagcaaagttctgtctatgttg

SEQ ID NO: 143471 - DNA, 22 bp, Artificial Sequence
  Synthetic oligonucleotide; TTT chr11 5230269 5230290 5230274 5230269 -
agcaaagttctgtctatgttga

SEQ ID NO: 143472 - DNA, 22 bp, Artificial Sequence
  Synthetic oligonucleotide; TTA chr11 5230268 5230289 5230273 5230268 -
gcaaagttctgtctatgttgac

SEQ ID NO: 143473 - DNA, 22 bp, Artificial Sequence
  Synthetic oligonucleotide; TTC chr11 5230259 5230280 5230264 5230259 -
tgtctatgttgactttattgct

SEQ ID NO: 143474 - DNA, 22 bp, Artificial Sequence
  Synthetic oligonucleotide; CTG chr11 5230257 5230278 5230262 5230257 -
tctatgttgactttattgcttt

SEQ ID NO: 143475 - DNA, 22 bp, Artificial Sequence
  Synthetic oligonucleotide; CTA chr11 5230253 5230274 5230258 5230253 -
tgttgactttattgctttttgg

SEQ ID NO: 143476 - DNA, 22 bp, Artificial Sequence
  Synthetic oligonucleotide; TTG chr11 5230248 5230269 5230253 5230248 -
actttattgctttttggtaaga

SEQ ID NO: 143477 - DNA, 22 bp, Artificial Sequence
  Synthetic oligonucleotide; CTT chr11 5230244 5230265 5230249 5230244 -
tattgctttttggtaagaaata

SEQ ID NO: 143478 - DNA, 22 bp, Artificial Sequence
  Synthetic oligonucleotide; TTT chr11 5230243 5230264 5230248 5230243 -
attgctttttggtaagaaatac

SEQ ID NO: 143479 - DNA, 22 bp, Artificial Sequence
  Synthetic oligonucleotide; TTA chr11 5230242 5230263 5230247 5230242 -
ttgctttttggtaagaaataca

SEQ ID NO: 143480 - DNA, 22 bp, Artificial Sequence
  Synthetic oligonucleotide; TTG chr11 5230239 5230260 5230244 5230239 -
ctttttggtaagaaatacaact

SEQ ID NO: 143481 - DNA, 22 bp, Artificial Sequence
  Synthetic oligonucleotide; CTT chr11 5230236 5230257 5230241 5230236 -
tttggtaagaaatacaactttt

SEQ ID NO: 143482 - DNA, 22 bp, Artificial Sequence
  Synthetic oligonucleotide; TTT chr11 5230235 5230256 5230240 5230235 -
ttggtaagaaatacaacttttt

SEQ ID NO: 143483 - DNA, 22 bp, Artificial Sequence
  Synthetic oligonucleotide; TTT chr11 5230234 5230255 5230239 5230234 -
tggtaagaaatacaacttttta

SEQ ID NO: 143484 - DNA, 22 bp, Artificial Sequence
  Synthetic oligonucleotide; TTT chr11 5230233 5230254 5230238 5230233 -
ggtaagaaatacaactttttaa

SEQ ID NO: 143485 - DNA, 22 bp, Artificial Sequence
  Synthetic oligonucleotide; TTG chr11 5230232 5230253 5230237 5230232 -
gtaagaaatacaactttttaaa

SEQ ID NO: 143486 - DNA, 22 bp, Artificial Sequence
  Synthetic oligonucleotide; CTT chr11 5230216 5230237 5230221 5230216 -
tttaaagtgaactaaactatcc

SEQ ID NO: 143487 - DNA, 22 bp, Artificial Sequence
  Synthetic oligonucleotide; TTT chr11 5230215 5230236 5230220 5230215 -
ttaaagtgaactaaactatcct

SEQ ID NO: 143488 - DNA, 22 bp, Artificial Sequence
  Synthetic oligonucleotide; TTT chr11 5230214 5230235 5230219 5230214 -
taaagtgaactaaactatccta

SEQ ID NO: 143489 - DNA, 22 bp, Artificial Sequence
  Synthetic oligonucleotide; TTT chr11 5230213 5230234 5230218 5230213 -
aaagtgaactaaactatcctat

SEQ ID NO: 143490 - DNA, 22 bp, Artificial Sequence
  Synthetic oligonucleotide; TTA chr11 5230212 5230233 5230217 5230212 -
aagtgaactaaactatcctatt

SEQ ID NO: 143491 - DNA, 22 bp, Artificial Sequence
  Synthetic oligonucleotide; CTA chr11 5230202 5230223 5230207 5230202 -
aactatcctatttccaaactat

SEQ ID NO: 143492 - DNA, 22 bp, Artificial Sequence
  Synthetic oligonucleotide; CTA chr11 5230197 5230218 5230202 5230197 -
tcctatttccaaactattttgt

SEQ ID NO: 143493 - DNA, 22 bp, Artificial Sequence
  Synthetic oligonucleotide; CTA chr11 5230192 5230213 5230197 5230192 -
tttccaaactattttgtgtgtg

SEQ ID NO: 143494 - DNA, 22 bp, Artificial Sequence
  Synthetic oligonucleotide; TTT chr11 5230189 5230210 5230194 5230189 -
ccaaactattttgtgtgtgtgc

SEQ ID NO: 143495 - DNA, 22 bp, Artificial Sequence
  Synthetic oligonucleotide; TTC chr11 5230188 5230209 5230193 5230188 -
caaactattttgtgtgtgtgcg

SEQ ID NO: 143496 - DNA, 22 bp, Artificial Sequence
  Synthetic oligonucleotide; CTA chr11 5230181 5230202 5230186 5230181 -
ttttgtgtgtgtgcggtttgtt

SEQ ID NO: 143497 - DNA, 22 bp, Artificial Sequence
  Synthetic oligonucleotide; TTT chr11 5230178 5230199 5230183 5230178 -
tgtgtgtgtgcggtttgtttct

SEQ ID NO: 143498 - DNA, 22 bp, Artificial Sequence
  Synthetic oligonucleotide; TTT chr11 5230177 5230198 5230182 5230177 -
gtgtgtgtgcggtttgtttcta

SEQ ID NO: 143499 - DNA, 22 bp, Artificial Sequence
  Synthetic oligonucleotide; TTG chr11 5230176 5230197 5230181 5230176 -
tgtgtgtgcggtttgtttctat

SEQ ID NO: 143500 - DNA, 22 bp, Artificial Sequence
  Synthetic oligonucleotide; TTT chr11 5230162 5230183 5230167 5230162 -
gtttctatgggttctggttttc

SEQ ID NO: 143501 - DNA, 22 bp, Artificial Sequence
  Synthetic oligonucleotide; TTG chr11 5230161 5230182 5230166 5230161 -
tttctatgggttctggttttct

SEQ ID NO: 143502 - DNA, 22 bp, Artificial Sequence
  Synthetic oligonucleotide; TTT chr11 5230158 5230179 5230163 5230158 -
ctatgggttctggttttcttgg

SEQ ID NO: 143503 - DNA, 22 bp, Artificial Sequence
  Synthetic oligonucleotide; TTC chr11 5230157 5230178 5230162 5230157 -
tatgggttctggttttcttgga

SEQ ID NO: 143504 - DNA, 22 bp, Artificial Sequence
  Synthetic oligonucleotide; CTA chr11 5230155 5230176 5230160 5230155 -
tgggttctggttttcttggagc

SEQ ID NO: 143505 - DNA, 22 bp, Artificial Sequence
  Synthetic oligonucleotide; TTC chr11 5230148 5230169 5230153 5230148 -
tggttttcttggagcattttta

SEQ ID NO: 143506 - DNA, 22 bp, Artificial Sequence
  Synthetic oligonucleotide; CTG chr11 5230146 5230167 5230151 5230146 -
gttttcttggagcatttttatt

SEQ ID NO: 143507 - DNA, 22 bp, Artificial Sequence
  Synthetic oligonucleotide; TTT chr11 5230142 5230163 5230147 5230142 -
tcttggagcatttttatttcat

SEQ ID NO: 143508 - DNA, 22 bp, Artificial Sequence
  Synthetic oligonucleotide; TTT chr11 5230141 5230162 5230146 5230141 -
cttggagcatttttatttcatt

SEQ ID NO: 143509 - DNA, 22 bp, Artificial Sequence
  Synthetic oligonucleotide; TTC chr11 5230140 5230161 5230145 5230140 -
ttggagcatttttatttcattt

SEQ ID NO: 143510 - DNA, 22 bp, Artificial Sequence
  Synthetic oligonucleotide; CTT chr11 5230138 5230159 5230143 5230138 -
ggagcatttttatttcatttta

SEQ ID NO: 143511 - DNA, 22 bp, Artificial Sequence
  Synthetic oligonucleotide; TTG chr11 5230137 5230158 5230142 5230137 -
gagcatttttatttcattttaa

SEQ ID NO: 143512 - DNA, 22 bp, Artificial Sequence
  Synthetic oligonucleotide; TTT chr11 5230129 5230150 5230134 5230129 -
ttatttcattttaattaattaa

SEQ ID NO: 143513 - DNA, 22 bp, Artificial Sequence
  Synthetic oligonucleotide; TTT chr11 5230128 5230149 5230133 5230128 -
tatttcattttaattaattaat

SEQ ID NO: 143514 - DNA, 22 bp, Artificial Sequence
  Synthetic oligonucleotide; TTT chr11 5230127 5230148 5230132 5230127 -
atttcattttaattaattaatt

SEQ ID NO: 143515 - DNA, 22 bp, Artificial Sequence
  Synthetic oligonucleotide; TTA chr11 5230126 5230147 5230131 5230126 -
tttcattttaattaattaattc

SEQ ID NO: 143516 - DNA, 22 bp, Artificial Sequence
  Synthetic oligonucleotide; TTT chr11 5230123 5230144 5230128 5230123 -
cattttaattaattaattctga

SEQ ID NO: 143517 - DNA, 22 bp, Artificial Sequence
  Synthetic oligonucleotide; TTC chr11 5230122 5230143 5230127 5230122 -
attttaattaattaattctgag

SEQ ID NO: 143518 - DNA, 22 bp, Artificial Sequence
  Synthetic oligonucleotide; TTT chr11 5230118 5230139 5230123 5230118 -
taattaattaattctgagagct

SEQ ID NO: 143519 - DNA, 22 bp, Artificial Sequence
  Synthetic oligonucleotide; TTT chr11 5230117 5230138 5230122 5230117 -
aattaattaattctgagagctg

SEQ ID NO: 143520 - DNA, 22 bp, Artificial Sequence
  Synthetic oligonucleotide; TTA chr11 5230116 5230137 5230121 5230116 -
attaattaattctgagagctgc

SEQ ID NO: 143521 - DNA, 22 bp, Artificial Sequence
  Synthetic oligonucleotide; TTA chr11 5230112 5230133 5230117 5230112 -
attaattctgagagctgctgag

SEQ ID NO: 143522 - DNA, 22 bp, Artificial Sequence
  Synthetic oligonucleotide; TTA chr11 5230108 5230129 5230113 5230108 -
attctgagagctgctgagttgt

SEQ ID NO: 143523 - DNA, 22 bp, Artificial Sequence
  Synthetic oligonucleotide; TTC chr11 5230104 5230125 5230109 5230104 -
tgagagctgctgagttgtgttt

SEQ ID NO: 143524 - DNA, 22 bp, Artificial Sequence
  Synthetic oligonucleotide; CTG chr11 5230102 5230123 5230107 5230102 -
agagctgctgagttgtgtttac

SEQ ID NO: 143525 - DNA, 22 bp, Artificial Sequence
  Synthetic oligonucleotide; CTG chr11 5230095 5230116 5230100 5230095 -
ctgagttgtgtttactgagaga

SEQ ID NO: 143526 - DNA, 22 bp, Artificial Sequence
  Synthetic oligonucleotide; CTG chr11 5230092 5230113 5230097 5230092 -
agttgtgtttactgagagattg

SEQ ID NO: 143527 - DNA, 22 bp, Artificial Sequence
  Synthetic oligonucleotide; TTG chr11 5230087 5230108 5230092 5230087 -
tgtttactgagagattgtgtat

SEQ ID NO: 143528 - DNA, 22 bp, Artificial Sequence
  Synthetic oligonucleotide; TTT chr11 5230082 5230103 5230087 5230082 -
actgagagattgtgtatctgcg

SEQ ID NO: 143529 - DNA, 22 bp, Artificial Sequence
  Synthetic oligonucleotide; TTA chr11 5230081 5230102 5230086 5230081 -
ctgagagattgtgtatctgcga

SEQ ID NO: 143530 - DNA, 22 bp, Artificial Sequence
  Synthetic oligonucleotide; CTG chr11 5230078 5230099 5230083 5230078 -
agagattgtgtatctgcgagag

SEQ ID NO: 143531 - DNA, 22 bp, Artificial Sequence
  Synthetic oligonucleotide; TTG chr11 5230070 5230091 5230075 5230070 -
tgtatctgcgagagaagtctgt

SEQ ID NO: 143532 - DNA, 22 bp, Artificial Sequence
  Synthetic oligonucleotide; CTG chr11 5230062 5230083 5230067 5230062 -
cgagagaagtctgtagcaagta

SEQ ID NO: 143533 - DNA, 22 bp, Artificial Sequence
  Synthetic oligonucleotide; CTG chr11 5230049 5230070 5230054 5230049 -
tagcaagtagctagactgtgct

SEQ ID NO: 143534 - DNA, 22 bp, Artificial Sequence
  Synthetic oligonucleotide; CTA chr11 5230036 5230057 5230041 5230036 -
gactgtgcttgacctaggaaca

SEQ ID NO: 143535 - DNA, 22 bp, Artificial Sequence
  Synthetic oligonucleotide; CTG chr11 5230031 5230052 5230036 5230031 -
tgcttgacctaggaacatatac

SEQ ID NO: 143536 - DNA, 22 bp, Artificial Sequence
  Synthetic oligonucleotide; CTT chr11 5230026 5230047 5230031 5230026 -
gacctaggaacatatacagtag

SEQ ID NO: 143537 - DNA, 22 bp, Artificial Sequence
  Synthetic oligonucleotide; TTG chr11 5230025 5230046 5230030 5230025 -
acctaggaacatatacagtaga

SEQ ID NO: 143538 - DNA, 22 bp, Artificial Sequence
  Synthetic oligonucleotide; CTA chr11 5230020 5230041 5230025 5230020 -
ggaacatatacagtagattgct

SEQ ID NO: 143539 - DNA, 22 bp, Artificial Sequence
  Synthetic oligonucleotide; TTG chr11 5230000 5230021 5230005 5230000 -
ctaaaatgtctcacttggggaa

SEQ ID NO: 143540 - DNA, 22 bp, Artificial Sequence
  Synthetic oligonucleotide; CTA chr11 5229997 5230018 5230002 5229997 -
aaatgtctcacttggggaattt

SEQ ID NO: 143541 - DNA, 22 bp, Artificial Sequence
  Synthetic oligonucleotide; CTC chr11 5229988 5230009 5229993 5229988 -
acttggggaattttagactaaa

SEQ ID NO: 143542 - DNA, 22 bp, Artificial Sequence
  Synthetic oligonucleotide; CTT chr11 5229984 5230005 5229989 5229984 -
ggggaattttagactaaacagt

SEQ ID NO: 143543 - DNA, 22 bp, Artificial Sequence
  Synthetic oligonucleotide; TTG chr11 5229983 5230004 5229988 5229983 -
gggaattttagactaaacagta

SEQ ID NO: 143544 - DNA, 22 bp, Artificial Sequence
  Synthetic oligonucleotide; TTT chr11 5229975 5229996 5229980 5229975 -
tagactaaacagtagagcatgt

SEQ ID NO: 143545 - DNA, 22 bp, Artificial Sequence
  Synthetic oligonucleotide; TTT chr11 5229974 5229995 5229979 5229974 -
agactaaacagtagagcatgta

SEQ ID NO: 143546 - DNA, 22 bp, Artificial Sequence
  Synthetic oligonucleotide; TTA chr11 5229973 5229994 5229978 5229973 -
gactaaacagtagagcatgtat

SEQ ID NO: 143547 - DNA, 22 bp, Artificial Sequence
  Synthetic oligonucleotide; CTA chr11 5229968 5229989 5229973 5229968 -
aacagtagagcatgtataaaaa

SEQ ID NO: 143548 - DNA, 22 bp, Artificial Sequence
  Synthetic oligonucleotide; CTC chr11 5229941 5229962 5229946 5229941 -
tagtcaagtgctgcttttgaaa

SEQ ID NO: 143549 - DNA, 22 bp, Artificial Sequence
  Synthetic oligonucleotide; CTA chr11 5229939 5229960 5229944 5229939 -
gtcaagtgctgcttttgaaaca

SEQ ID NO: 143550 - DNA, 22 bp, Artificial Sequence
  Synthetic oligonucleotide; CTG chr11 5229928 5229949 5229933 5229928 -
cttttgaaacaaatgataaaac

SEQ ID NO: 143551 - DNA, 22 bp, Artificial Sequence
  Synthetic oligonucleotide; CTT chr11 5229925 5229946 5229930 5229925 -
ttgaaacaaatgataaaaccac

SEQ ID NO: 143552 - DNA, 22 bp, Artificial Sequence
  Synthetic oligonucleotide; TTT chr11 5229924 5229945 5229929 5229924 -
tgaaacaaatgataaaaccaca

SEQ ID NO: 143553 - DNA, 22 bp, Artificial Sequence
  Synthetic oligonucleotide; TTT chr11 5229923 5229944 5229928 5229923 -
gaaacaaatgataaaaccacac

SEQ ID NO: 143554 - DNA, 22 bp, Artificial Sequence
  Synthetic oligonucleotide; TTG chr11 5229922 5229943 5229927 5229922 -
aaacaaatgataaaaccacact

SEQ ID NO: 143555 - DNA, 22 bp, Artificial Sequence
  Synthetic oligonucleotide; CTC chr11 5229899 5229920 5229904 5229899 -
ccatagatgagtgtcatgattt

SEQ ID NO: 143556 - DNA, 22 bp, Artificial Sequence
  Synthetic oligonucleotide; TTT chr11 5229877 5229898 5229882 5229877 -
tcatggaggaagttaatattca

SEQ ID NO: 143557 - DNA, 22 bp, Artificial Sequence
  Synthetic oligonucleotide; TTT chr11 5229876 5229897 5229881 5229876 -
catggaggaagttaatattcat

SEQ ID NO: 143558 - DNA, 22 bp, Artificial Sequence
  Synthetic oligonucleotide; TTC chr11 5229875 5229896 5229880 5229875 -
atggaggaagttaatattcatc

SEQ ID NO: 143559 - DNA, 22 bp, Artificial Sequence
  Synthetic oligonucleotide; TTA chr11 5229862 5229883 5229867 5229862 -
atattcatcctctaagtatacc

SEQ ID NO: 143560 - DNA, 22 bp, Artificial Sequence
  Synthetic oligonucleotide; TTC chr11 5229856 5229877 5229861 5229856 -
atcctctaagtatacccagact

SEQ ID NO: 143561 - DNA, 22 bp, Artificial Sequence
  Synthetic oligonucleotide; CTC chr11 5229850 5229871 5229855 5229850 -
taagtatacccagactagggcc

SEQ ID NO: 143562 - DNA, 22 bp, Artificial Sequence
  Synthetic oligonucleotide; CTA chr11 5229848 5229869 5229853 5229848 -
agtatacccagactagggccat

SEQ ID NO: 143563 - DNA, 22 bp, Artificial Sequence
  Synthetic oligonucleotide; CTA chr11 5229833 5229854 5229838 5229833 -
gggccattctgatataaaacat

SEQ ID NO: 143564 - DNA, 22 bp, Artificial Sequence
  Synthetic oligonucleotide; TTC chr11 5229824 5229845 5229829 5229824 -
tgatataaaacattaggactta

SEQ ID NO: 143565 - DNA, 22 bp, Artificial Sequence
  Synthetic oligonucleotide; CTG chr11 5229822 5229843 5229827 5229822 -
atataaaacattaggacttaag

SEQ ID NO: 143566 - DNA, 22 bp, Artificial Sequence
  Synthetic oligonucleotide; TTA chr11 5229809 5229830 5229814 5229809 -
ggacttaagaaagattaataga

SEQ ID NO: 143567 - DNA, 22 bp, Artificial Sequence
  Synthetic oligonucleotide; CTT chr11 5229803 5229824 5229808 5229803 -
aagaaagattaatagactggag

SEQ ID NO: 143568 - DNA, 22 bp, Artificial Sequence
  Synthetic oligonucleotide; TTA chr11 5229802 5229823 5229807 5229802 -
agaaagattaatagactggagt

SEQ ID NO: 143569 - DNA, 22 bp, Artificial Sequence
  Synthetic oligonucleotide; TTA chr11 5229792 5229813 5229797 5229792 -
atagactggagtaaaggaaatg

SEQ ID NO: 143570 - DNA, 22 bp, Artificial Sequence
  Synthetic oligonucleotide; CTG chr11 5229784 5229805 5229789 5229784 -
gagtaaaggaaatggacctctg

SEQ ID NO: 143571 - DNA, 22 bp, Artificial Sequence
  Synthetic oligonucleotide; CTC chr11 5229764 5229785 5229769 5229764 -
tgtctctctcgctgtctctttt

SEQ ID NO: 143572 - DNA, 22 bp, Artificial Sequence
  Synthetic oligonucleotide; CTG chr11 5229762 5229783 5229767 5229762 -
tctctctcgctgtctctttttt

SEQ ID NO: 143573 - DNA, 22 bp, Artificial Sequence
  Synthetic oligonucleotide; CTC chr11 5229758 5229779 5229763 5229758 -
tctcgctgtctcttttttgagg

SEQ ID NO: 143574 - DNA, 22 bp, Artificial Sequence
  Synthetic oligonucleotide; CTC chr11 5229756 5229777 5229761 5229756 -
tcgctgtctcttttttgaggac

SEQ ID NO: 143575 - DNA, 22 bp, Artificial Sequence
  Synthetic oligonucleotide; CTC chr11 5229754 5229775 5229759 5229754 -
gctgtctcttttttgaggactt

SEQ ID NO: 143576 - DNA, 22 bp, Artificial Sequence
  Synthetic oligonucleotide; CTG chr11 5229750 5229771 5229755 5229750 -
tctcttttttgaggacttgtgt

SEQ ID NO: 143577 - DNA, 22 bp, Artificial Sequence
  Synthetic oligonucleotide; CTC chr11 5229746 5229767 5229751 5229746 -
ttttttgaggacttgtgtgtgt

SEQ ID NO: 143578 - DNA, 22 bp, Artificial Sequence
  Synthetic oligonucleotide; CTT chr11 5229744 5229765 5229749 5229744 -
ttttgaggacttgtgtgtgtgt

SEQ ID NO: 143579 - DNA, 22 bp, Artificial Sequence
  Synthetic oligonucleotide; TTT chr11 5229743 5229764 5229748 5229743 -
tttgaggacttgtgtgtgtgtg

SEQ ID NO: 143580 - DNA, 22 bp, Artificial Sequence
  Synthetic oligonucleotide; TTT chr11 5229742 5229763 5229747 5229742 -
ttgaggacttgtgtgtgtgtgt

SEQ ID NO: 143581 - DNA, 22 bp, Artificial Sequence
  Synthetic oligonucleotide; TTT chr11 5229741 5229762 5229746 5229741 -
tgaggacttgtgtgtgtgtgtg

SEQ ID NO: 143582 - DNA, 22 bp, Artificial Sequence
  Synthetic oligonucleotide; TTT chr11 5229740 5229761 5229745 5229740 -
gaggacttgtgtgtgtgtgtgt

SEQ ID NO: 143583 - DNA, 22 bp, Artificial Sequence
  Synthetic oligonucleotide; TTG chr11 5229739 5229760 5229744 5229739 -
aggacttgtgtgtgtgtgtgtg

SEQ ID NO: 143584 - DNA, 22 bp, Artificial Sequence
  Synthetic oligonucleotide; CTT chr11 5229732 5229753 5229737 5229732 -
gtgtgtgtgtgtgtgtgtgtgt

SEQ ID NO: 143585 - DNA, 22 bp, Artificial Sequence
  Synthetic oligonucleotide; TTG chr11 5229731 5229752 5229736 5229731 -
tgtgtgtgtgtgtgtgtgtgtg

SEQ ID NO: 143586 - DNA, 22 bp, Artificial Sequence
  Synthetic oligonucleotide; TTG chr11 5229696 5229717 5229701 5229696 -
tggtcagtggggctggaataaa

SEQ ID NO: 143587 - DNA, 22 bp, Artificial Sequence
  Synthetic oligonucleotide; CTG chr11 5229681 5229702 5229686 5229681 -
gaataaaagtagaatagacctg

SEQ ID NO: 143588 - DNA, 22 bp, Artificial Sequence
  Synthetic oligonucleotide; CTG chr11 5229659 5229680 5229664 5229659 -
cacctgctgtggcatccattca

SEQ ID NO: 143589 - DNA, 22 bp, Artificial Sequence
  Synthetic oligonucleotide; CTG chr11 5229653 5229674 5229658 5229653 -
ctgtggcatccattcacagagt

SEQ ID NO: 143590 - DNA, 22 bp, Artificial Sequence
  Synthetic oligonucleotide; CTG chr11 5229650 5229671 5229655 5229650 -
tggcatccattcacagagtaga

SEQ ID NO: 143591 - DNA, 22 bp, Artificial Sequence
  Synthetic oligonucleotide; TTC chr11 5229638 5229659 5229643 5229638 -
acagagtagaagcaagctcaca

SEQ ID NO: 143592 - DNA, 22 bp, Artificial Sequence
  Synthetic oligonucleotide; CTC chr11 5229619 5229640 5229624 5229619 -
acaatagtgaagatgtcagtaa

SEQ ID NO: 143593 - DNA, 22 bp, Artificial Sequence
  Synthetic oligonucleotide; CTT chr11 5229593 5229614 5229598 5229593 -
gaatagtttttcaggaactttg

SEQ ID NO: 143594 - DNA, 22 bp, Artificial Sequence
  Synthetic oligonucleotide; TTG chr11 5229592 5229613 5229597 5229592 -
aatagtttttcaggaactttga

SEQ ID NO: 143595 - DNA, 22 bp, Artificial Sequence
  Synthetic oligonucleotide; TTT chr11 5229584 5229605 5229589 5229584 -
ttcaggaactttgaatgctgat

SEQ ID NO: 143596 - DNA, 22 bp, Artificial Sequence
  Synthetic oligonucleotide; TTT chr11 5229583 5229604 5229588 5229583 -
tcaggaactttgaatgctgatt

SEQ ID NO: 143597 - DNA, 22 bp, Artificial Sequence
  Synthetic oligonucleotide; TTT chr11 5229582 5229603 5229587 5229582 -
caggaactttgaatgctgattt

SEQ ID NO: 143598 - DNA, 22 bp, Artificial Sequence
  Synthetic oligonucleotide; TTC chr11 5229581 5229602 5229586 5229581 -
aggaactttgaatgctgattta

SEQ ID NO: 143599 - DNA, 22 bp, Artificial Sequence
  Synthetic oligonucleotide; CTT chr11 5229573 5229594 5229578 5229573 -
tgaatgctgatttagatttgaa

SEQ ID NO: 143600 - DNA, 22 bp, Artificial Sequence
  Synthetic oligonucleotide; TTT chr11 5229572 5229593 5229577 5229572 -
gaatgctgatttagatttgaaa

SEQ ID NO: 143601 - DNA, 22 bp, Artificial Sequence
  Synthetic oligonucleotide; TTG chr11 5229571 5229592 5229576 5229571 -
aatgctgatttagatttgaaac

SEQ ID NO: 143602 - DNA, 22 bp, Artificial Sequence
  Synthetic oligonucleotide; CTG chr11 5229564 5229585 5229569 5229564 -
atttagatttgaaactgaggct

SEQ ID NO: 143603 - DNA, 22 bp, Artificial Sequence
  Synthetic oligonucleotide; TTT chr11 5229560 5229581 5229565 5229560 -
agatttgaaactgaggctctga

SEQ ID NO: 143604 - DNA, 22 bp, Artificial Sequence
  Synthetic oligonucleotide; TTA chr11 5229559 5229580 5229564 5229559 -
gatttgaaactgaggctctgac

SEQ ID NO: 143605 - DNA, 22 bp, Artificial Sequence
  Synthetic oligonucleotide; TTT chr11 5229554 5229575 5229559 5229554 -
gaaactgaggctctgaccataa

SEQ ID NO: 143606 - DNA, 22 bp, Artificial Sequence
  Synthetic oligonucleotide; TTG chr11 5229553 5229574 5229558 5229553 -
aaactgaggctctgaccataac

SEQ ID NO: 143607 - DNA, 22 bp, Artificial Sequence
  Synthetic oligonucleotide; CTG chr11 5229547 5229568 5229552 5229547 -
aggctctgaccataaccaaatt

SEQ ID NO: 143608 - DNA, 22 bp, Artificial Sequence
  Synthetic oligonucleotide; CTC chr11 5229541 5229562 5229546 5229541 -
tgaccataaccaaatttgcact

SEQ ID NO: 143609 - DNA, 22 bp, Artificial Sequence
  Synthetic oligonucleotide; CTG chr11 5229539 5229560 5229544 5229539 -
accataaccaaatttgcactat

SEQ ID NO: 143610 - DNA, 22 bp, Artificial Sequence
  Synthetic oligonucleotide; TTT chr11 5229524 5229545 5229529 5229524 -
gcactatttattgcttcttgaa

SEQ ID NO: 143611 - DNA, 22 bp, Artificial Sequence
  Synthetic oligonucleotide; TTG chr11 5229523 5229544 5229528 5229523 -
cactatttattgcttcttgaaa

SEQ ID NO: 143612 - DNA, 22 bp, Artificial Sequence
  Synthetic oligonucleotide; CTA chr11 5229518 5229539 5229523 5229518 -
tttattgcttcttgaaacttat

SEQ ID NO: 143613 - DNA, 22 bp, Artificial Sequence
  Synthetic oligonucleotide; TTT chr11 5229515 5229536 5229520 5229515 -
attgcttcttgaaacttatttg

SEQ ID NO: 143614 - DNA, 22 bp, Artificial Sequence
  Synthetic oligonucleotide; TTA chr11 5229514 5229535 5229519 5229514 -
ttgcttcttgaaacttatttgc

SEQ ID NO: 143615 - DNA, 22 bp, Artificial Sequence
  Synthetic oligonucleotide; TTG chr11 5229511 5229532 5229516 5229511 -
cttcttgaaacttatttgcctg

SEQ ID NO: 143616 - DNA, 22 bp, Artificial Sequence
  Synthetic oligonucleotide; CTT chr11 5229508 5229529 5229513 5229508 -
cttgaaacttatttgcctggta

SEQ ID NO: 143617 - DNA, 22 bp, Artificial Sequence
  Synthetic oligonucleotide; TTC chr11 5229507 5229528 5229512 5229507 -
ttgaaacttatttgcctggtat

SEQ ID NO: 143618 - DNA, 22 bp, Artificial Sequence
  Synthetic oligonucleotide; CTT chr11 5229505 5229526 5229510 5229505 -
gaaacttatttgcctggtatgc

SEQ ID NO: 143619 - DNA, 22 bp, Artificial Sequence
  Synthetic oligonucleotide; TTG chr11 5229504 5229525 5229509 5229504 -
aaacttatttgcctggtatgcc

SEQ ID NO: 143620 - DNA, 22 bp, Artificial Sequence
  Synthetic oligonucleotide; CTT chr11 5229498 5229519 5229503 5229498 -
atttgcctggtatgcctgggct

SEQ ID NO: 143621 - DNA, 22 bp, Artificial Sequence
  Synthetic oligonucleotide; TTA chr11 5229497 5229518 5229502 5229497 -
tttgcctggtatgcctgggctt

SEQ ID NO: 143622 - DNA, 22 bp, Artificial Sequence
  Synthetic oligonucleotide; TTT chr11 5229494 5229515 5229499 5229494 -
gcctggtatgcctgggcttttg

SEQ ID NO: 143623 - DNA, 22 bp, Artificial Sequence
  Synthetic oligonucleotide; TTG chr11 5229493 5229514 5229498 5229493 -
cctggtatgcctgggcttttga

SEQ ID NO: 143624 - DNA, 22 bp, Artificial Sequence
  Synthetic oligonucleotide; CTG chr11 5229489 5229510 5229494 5229489 -
gtatgcctgggcttttgatggt

SEQ ID NO: 143625 - DNA, 22 bp, Artificial Sequence
  Synthetic oligonucleotide; CTG chr11 5229480 5229501 5229485 5229480 -
ggcttttgatggtcttagtata

SEQ ID NO: 143626 - DNA, 22 bp, Artificial Sequence
  Synthetic oligonucleotide; CTT chr11 5229475 5229496 5229480 5229475 -
ttgatggtcttagtatagcttg

SEQ ID NO: 143627 - DNA, 22 bp, Artificial Sequence
  Synthetic oligonucleotide; TTT chr11 5229474 5229495 5229479 5229474 -
tgatggtcttagtatagcttgc

SEQ ID NO: 143628 - DNA, 22 bp, Artificial Sequence
  Synthetic oligonucleotide; TTT chr11 5229473 5229494 5229478 5229473 -
gatggtcttagtatagcttgca

SEQ ID NO: 143629 - DNA, 22 bp, Artificial Sequence
  Synthetic oligonucleotide; TTG chr11 5229472 5229493 5229477 5229472 -
atggtcttagtatagcttgcag

SEQ ID NO: 143630 - DNA, 22 bp, Artificial Sequence
  Synthetic oligonucleotide; CTT chr11 5229464 5229485 5229469 5229464 -
agtatagcttgcagccttgtcc

SEQ ID NO: 143631 - DNA, 22 bp, Artificial Sequence
  Synthetic oligonucleotide; TTA chr11 5229463 5229484 5229468 5229463 -
gtatagcttgcagccttgtccc

SEQ ID NO: 143632 - DNA, 22 bp, Artificial Sequence
  Synthetic oligonucleotide; CTT chr11 5229454 5229475 5229459 5229454 -
gcagccttgtccctgcagggta

SEQ ID NO: 143633 - DNA, 22 bp, Artificial Sequence
  Synthetic oligonucleotide; TTG chr11 5229453 5229474 5229458 5229453 -
cagccttgtccctgcagggtat

SEQ ID NO: 143634 - DNA, 22 bp, Artificial Sequence
  Synthetic oligonucleotide; CTT chr11 5229446 5229467 5229451 5229446 -
gtccctgcagggtattatgggt

SEQ ID NO: 143635 - DNA, 22 bp, Artificial Sequence
  Synthetic oligonucleotide; TTG chr11 5229445 5229466 5229450 5229445 -
tccctgcagggtattatgggta

SEQ ID NO: 143636 - DNA, 22 bp, Artificial Sequence
  Synthetic oligonucleotide; CTG chr11 5229439 5229460 5229444 5229439 -
cagggtattatgggtaatagaa

SEQ ID NO: 143637 - DNA, 22 bp, Artificial Sequence
  Synthetic oligonucleotide; TTA chr11 5229429 5229450 5229434 5229429 -
tgggtaatagaaagaaaagtct

SEQ ID NO: 143638 - DNA, 22 bp, Artificial Sequence
  Synthetic oligonucleotide; CTG chr11 5229406 5229427 5229411 5229406 -
cgttacactctagtcacactaa

SEQ ID NO: 143639 - DNA, 22 bp, Artificial Sequence
  Synthetic oligonucleotide; TTA chr11 5229401 5229422 5229406 5229401 -
cactctagtcacactaagtaac

SEQ ID NO: 143640 - DNA, 22 bp, Artificial Sequence
  Synthetic oligonucleotide; CTC chr11 5229396 5229417 5229401 5229396 -
tagtcacactaagtaactacca

SEQ ID NO: 143641 - DNA, 22 bp, Artificial Sequence
  Synthetic oligonucleotide; CTA chr11 5229394 5229415 5229399 5229394 -
gtcacactaagtaactaccatt

SEQ ID NO: 143642 - DNA, 22 bp, Artificial Sequence
  Synthetic oligonucleotide; CTA chr11 5229385 5229406 5229390 5229385 -
agtaactaccattggaaaagca

SEQ ID NO: 143643 - DNA, 22 bp, Artificial Sequence
  Synthetic oligonucleotide; CTA chr11 5229377 5229398 5229382 5229377 -
ccattggaaaagcaacccctgc

SEQ ID NO: 143644 - DNA, 22 bp, Artificial Sequence
  Synthetic oligonucleotide; TTG chr11 5229371 5229392 5229376 5229371 -
gaaaagcaacccctgccttgaa

SEQ ID NO: 143645 - DNA, 22 bp, Artificial Sequence
  Synthetic oligonucleotide; CTG chr11 5229356 5229377 5229361 5229356 -
ccttgaagccaggatgatggta

SEQ ID NO: 143646 - DNA, 22 bp, Artificial Sequence
  Synthetic oligonucleotide; CTT chr11 5229352 5229373 5229357 5229352 -
gaagccaggatgatggtatctg

SEQ ID NO: 143647 - DNA, 22 bp, Artificial Sequence
  Synthetic oligonucleotide; TTG chr11 5229351 5229372 5229356 5229351 -
aagccaggatgatggtatctgc

SEQ ID NO: 143648 - DNA, 22 bp, Artificial Sequence
  Synthetic oligonucleotide; CTG chr11 5229330 5229351 5229335 5229330 -
cagcagttgccaacacaagaga

SEQ ID NO: 143649 - DNA, 22 bp, Artificial Sequence
  Synthetic oligonucleotide; TTG chr11 5229321 5229342 5229326 5229321 -
ccaacacaagagaaggatccat

SEQ ID NO: 143650 - DNA, 22 bp, Artificial Sequence
  Synthetic oligonucleotide; TTC chr11 5229294 5229315 5229299 5229294 -
atcatttaaaaaagaaaacaaa

SEQ ID NO: 143651 - DNA, 22 bp, Artificial Sequence
  Synthetic oligonucleotide; TTT chr11 5229287 5229308 5229292 5229287 -
aaaaaagaaaacaaaatagaaa

SEQ ID NO: 143652 - DNA, 22 bp, Artificial Sequence
  Synthetic oligonucleotide; TTA chr11 5229286 5229307 5229291 5229286 -
aaaaagaaaacaaaatagaaaa

SEQ ID NO: 143653 - DNA, 22 bp, Artificial Sequence
  Synthetic oligonucleotide; CTA chr11 5229254 5229275 5229259 5229254 -
tttctgagcataagaagttgta

SEQ ID NO: 143654 - DNA, 22 bp, Artificial Sequence
  Synthetic oligonucleotide; TTT chr11 5229251 5229272 5229256 5229251 -
ctgagcataagaagttgtaggg

SEQ ID NO: 143655 - DNA, 22 bp, Artificial Sequence
  Synthetic oligonucleotide; TTC chr11 5229250 5229271 5229255 5229250 -
tgagcataagaagttgtagggt

SEQ ID NO: 143656 - DNA, 22 bp, Artificial Sequence
  Synthetic oligonucleotide; CTG chr11 5229248 5229269 5229253 5229248 -
agcataagaagttgtagggtaa

SEQ ID NO: 143657 - DNA, 22 bp, Artificial Sequence
  Synthetic oligonucleotide; TTG chr11 5229234 5229255 5229239 5229234 -
tagggtaagtctttaagaaggt

SEQ ID NO: 143658 - DNA, 22 bp, Artificial Sequence
  Synthetic oligonucleotide; CTT chr11 5229221 5229242 5229226 5229221 -
taagaaggtgacaatttctgcc

SEQ ID NO: 143659 - DNA, 22 bp, Artificial Sequence
  Synthetic oligonucleotide; TTT chr11 5229220 5229241 5229225 5229220 -
aagaaggtgacaatttctgcca

SEQ ID NO: 143660 - DNA, 22 bp, Artificial Sequence
  Synthetic oligonucleotide; TTA chr11 5229219 5229240 5229224 5229219 -
agaaggtgacaatttctgccaa

SEQ ID NO: 143661 - DNA, 22 bp, Artificial Sequence
  Synthetic oligonucleotide; TTT chr11 5229204 5229225 5229209 5229204 -
ctgccaatcaggatttcaaagc

SEQ ID NO: 143662 - DNA, 22 bp, Artificial Sequence
  Synthetic oligonucleotide; TTC chr11 5229203 5229224 5229208 5229203 -
tgccaatcaggatttcaaagct

SEQ ID NO: 143663 - DNA, 22 bp, Artificial Sequence
  Synthetic oligonucleotide; CTG chr11 5229201 5229222 5229206 5229201 -
ccaatcaggatttcaaagctct

SEQ ID NO: 143664 - DNA, 22 bp, Artificial Sequence
  Synthetic oligonucleotide; TTT chr11 5229188 5229209 5229193 5229188 -
caaagctcttgctttgacaatt

SEQ ID NO: 143665 - DNA, 22 bp, Artificial Sequence
  Synthetic oligonucleotide; TTC chr11 5229187 5229208 5229192 5229187 -
aaagctcttgctttgacaattt

SEQ ID NO: 143666 - DNA, 22 bp, Artificial Sequence
  Synthetic oligonucleotide; CTC chr11 5229180 5229201 5229185 5229180 -
ttgctttgacaattttggtctt

SEQ ID NO: 143667 - DNA, 22 bp, Artificial Sequence
  Synthetic oligonucleotide; CTT chr11 5229178 5229199 5229183 5229178 -
gctttgacaattttggtctttc

SEQ ID NO: 143668 - DNA, 22 bp, Artificial Sequence
  Synthetic oligonucleotide; TTG chr11 5229177 5229198 5229182 5229177 -
ctttgacaattttggtctttca

SEQ ID NO: 143669 - DNA, 22 bp, Artificial Sequence
  Synthetic oligonucleotide; CTT chr11 5229174 5229195 5229179 5229174 -
tgacaattttggtctttcagaa

SEQ ID NO: 143670 - DNA, 22 bp, Artificial Sequence
  Synthetic oligonucleotide; TTT chr11 5229173 5229194 5229178 5229173 -
gacaattttggtctttcagaat

SEQ ID NO: 143671 - DNA, 22 bp, Artificial Sequence
  Synthetic oligonucleotide; TTG chr11 5229172 5229193 5229177 5229172 -
acaattttggtctttcagaata

SEQ ID NO: 143672 - DNA, 22 bp, Artificial Sequence
  Synthetic oligonucleotide; TTT chr11 5229165 5229186 5229170 5229165 -
tggtctttcagaatactataaa

SEQ ID NO: 143673 - DNA, 22 bp, Artificial Sequence
  Synthetic oligonucleotide; TTT chr11 5229164 5229185 5229169 5229164 -
ggtctttcagaatactataaat

SEQ ID NO: 143674 - DNA, 22 bp, Artificial Sequence
  Synthetic oligonucleotide; TTG chr11 5229163 5229184 5229168 5229163 -
gtctttcagaatactataaata

SEQ ID NO: 143675 - DNA, 22 bp, Artificial Sequence
  Synthetic oligonucleotide; CTT chr11 5229158 5229179 5229163 5229158 -
tcagaatactataaatataacc

SEQ ID NO: 143676 - DNA, 22 bp, Artificial Sequence
  Synthetic oligonucleotide; TTT chr11 5229157 5229178 5229162 5229157 -
cagaatactataaatataacct

SEQ ID NO: 143677 - DNA, 22 bp, Artificial Sequence
  Synthetic oligonucleotide; TTC chr11 5229156 5229177 5229161 5229156 -
agaatactataaatataaccta

SEQ ID NO: 143678 - DNA, 22 bp, Artificial Sequence
  Synthetic oligonucleotide; CTA chr11 5229147 5229168 5229152 5229147 -
taaatataacctatattataat

SEQ ID NO: 143679 - DNA, 22 bp, Artificial Sequence
  Synthetic oligonucleotide; CTA chr11 5229134 5229155 5229139 5229134 -
tattataatttcataaagtctg

SEQ ID NO: 143680 - DNA, 22 bp, Artificial Sequence
  Synthetic oligonucleotide; TTA chr11 5229129 5229150 5229134 5229129 -
taatttcataaagtctgtgcat

SEQ ID NO: 143681 - DNA, 22 bp, Artificial Sequence
  Synthetic oligonucleotide; TTT chr11 5229123 5229144 5229128 5229123 -
cataaagtctgtgcattttctt

SEQ ID NO: 143682 - DNA, 22 bp, Artificial Sequence
  Synthetic oligonucleotide; TTC chr11 5229122 5229143 5229127 5229122 -
ataaagtctgtgcattttcttt

SEQ ID NO: 143683 - DNA, 22 bp, Artificial Sequence
  Synthetic oligonucleotide; CTG chr11 5229112 5229133 5229117 5229112 -
tgcattttctttgacccaggat

SEQ ID NO: 143684 - DNA, 22 bp, Artificial Sequence
  Synthetic oligonucleotide; TTT chr11 5229105 5229126 5229110 5229105 -
tctttgacccaggatatttgca

SEQ ID NO: 143685 - DNA, 22 bp, Artificial Sequence
  Synthetic oligonucleotide; TTT chr11 5229104 5229125 5229109 5229104 -
ctttgacccaggatatttgcaa

SEQ ID NO: 143686 - DNA, 22 bp, Artificial Sequence
  Synthetic oligonucleotide; TTC chr11 5229103 5229124 5229108 5229103 -
tttgacccaggatatttgcaaa

SEQ ID NO: 143687 - DNA, 22 bp, Artificial Sequence
  Synthetic oligonucleotide; CTT chr11 5229101 5229122 5229106 5229101 -
tgacccaggatatttgcaaaag

SEQ ID NO: 143688 - DNA, 22 bp, Artificial Sequence
  Synthetic oligonucleotide; TTT chr11 5229100 5229121 5229105 5229100 -
gacccaggatatttgcaaaaga

SEQ ID NO: 143689 - DNA, 22 bp, Artificial Sequence
  Synthetic oligonucleotide; TTG chr11 5229099 5229120 5229104 5229099 -
acccaggatatttgcaaaagac

SEQ ID NO: 143690 - DNA, 22 bp, Artificial Sequence
  Synthetic oligonucleotide; TTT chr11 5229086 5229107 5229091 5229086 -
gcaaaagacatattcaaacttc

SEQ ID NO: 143691 - DNA, 22 bp, Artificial Sequence
  Synthetic oligonucleotide; TTG chr11 5229085 5229106 5229090 5229085 -
caaaagacatattcaaacttcc

SEQ ID NO: 143692 - DNA, 22 bp, Artificial Sequence
  Synthetic oligonucleotide; TTC chr11 5229071 5229092 5229076 5229071 -
aaacttccgcagaacactttat

SEQ ID NO: 143693 - DNA, 22 bp, Artificial Sequence
  Synthetic oligonucleotide; CTT chr11 5229065 5229086 5229070 5229065 -
ccgcagaacactttatttcaca

SEQ ID NO: 143694 - DNA, 22 bp, Artificial Sequence
  Synthetic oligonucleotide; TTC chr11 5229064 5229085 5229069 5229064 -
cgcagaacactttatttcacat

SEQ ID NO: 143695 - DNA, 22 bp, Artificial Sequence
  Synthetic oligonucleotide; CTT chr11 5229052 5229073 5229057 5229052 -
tatttcacatatacatgcctct

SEQ ID NO: 143696 - DNA, 22 bp, Artificial Sequence
  Synthetic oligonucleotide; TTT chr11 5229051 5229072 5229056 5229051 -
atttcacatatacatgcctctt

SEQ ID NO: 143697 - DNA, 22 bp, Artificial Sequence
  Synthetic oligonucleotide; TTA chr11 5229050 5229071 5229055 5229050 -
tttcacatatacatgcctctta

SEQ ID NO: 143698 - DNA, 22 bp, Artificial Sequence
  Synthetic oligonucleotide; TTT chr11 5229047 5229068 5229052 5229047 -
cacatatacatgcctcttatat

SEQ ID NO: 143699 - DNA, 22 bp, Artificial Sequence
  Synthetic oligonucleotide; TTC chr11 5229046 5229067 5229051 5229046 -
acatatacatgcctcttatatc

SEQ ID NO: 143700 - DNA, 22 bp, Artificial Sequence
  Synthetic oligonucleotide; CTC chr11 5229031 5229052 5229036 5229031 -
ttatatcagggatgtgaaacag

SEQ ID NO: 143701 - DNA, 22 bp, Artificial Sequence
  Synthetic oligonucleotide; CTT chr11 5229029 5229050 5229034 5229029 -
atatcagggatgtgaaacaggg

SEQ ID NO: 143702 - DNA, 22 bp, Artificial Sequence
  Synthetic oligonucleotide; TTA chr11 5229028 5229049 5229033 5229028 -
tatcagggatgtgaaacagggt

SEQ ID NO: 143703 - DNA, 22 bp, Artificial Sequence
  Synthetic oligonucleotide; CTT chr11 5229003 5229024 5229008 5229003 -
gaaaactgtctaaatctaaaac

SEQ ID NO: 143704 - DNA, 22 bp, Artificial Sequence
  Synthetic oligonucleotide; TTG chr11 5229002 5229023 5229007 5229002 -
aaaactgtctaaatctaaaaca

SEQ ID NO: 143705 - DNA, 22 bp, Artificial Sequence
  Synthetic oligonucleotide; CTG chr11 5228995 5229016 5229000 5228995 -
tctaaatctaaaacaatgctaa

SEQ ID NO: 143706 - DNA, 22 bp, Artificial Sequence
  Synthetic oligonucleotide; CTA chr11 5228991 5229012 5228996 5228991 -
aatctaaaacaatgctaatgca

SEQ ID NO: 143707 - DNA, 22 bp, Artificial Sequence
  Synthetic oligonucleotide; CTA chr11 5228985 5229006 5228990 5228985 -
aaacaatgctaatgcaggttta

SEQ ID NO: 143708 - DNA, 22 bp, Artificial Sequence
  Synthetic oligonucleotide; CTA chr11 5228974 5228995 5228979 5228974 -
atgcaggtttaaatttaataaa

SEQ ID NO: 143709 - DNA, 22 bp, Artificial Sequence
  Synthetic oligonucleotide; TTT chr11 5228964 5228985 5228969 5228964 -
aaatttaataaaataaaatcca

SEQ ID NO: 143710 - DNA, 22 bp, Artificial Sequence
  Synthetic oligonucleotide; TTA chr11 5228963 5228984 5228968 5228963 -
aatttaataaaataaaatccaa

SEQ ID NO: 143711 - DNA, 22 bp, Artificial Sequence
  Synthetic oligonucleotide; TTT chr11 5228958 5228979 5228963 5228958 -
aataaaataaaatccaaaatct

SEQ ID NO: 143712 - DNA, 22 bp, Artificial Sequence
  Synthetic oligonucleotide; TTA chr11 5228957 5228978 5228962 5228957 -
ataaaataaaatccaaaatcta

SEQ ID NO: 143713 - DNA, 22 bp, Artificial Sequence
  Synthetic oligonucleotide; CTA chr11 5228935 5228956 5228940 5228935 -
acagccaagtcaaatctgcatg

SEQ ID NO: 143714 - DNA, 22 bp, Artificial Sequence
  Synthetic oligonucleotide; CTG chr11 5228917 5228938 5228922 5228917 -
catgttttaacatttaaaatat

SEQ ID NO: 143715 - DNA, 22 bp, Artificial Sequence
  Synthetic oligonucleotide; TTT chr11 5228910 5228931 5228915 5228910 -
taacatttaaaatattttaaag

SEQ ID NO: 143716 - DNA, 22 bp, Artificial Sequence
  Synthetic oligonucleotide; TTT chr11 5228909 5228930 5228914 5228909 -
aacatttaaaatattttaaaga

SEQ ID NO: 143717 - DNA, 22 bp, Artificial Sequence
  Synthetic oligonucleotide; TTA chr11 5228908 5228929 5228913 5228908 -
acatttaaaatattttaaagac

SEQ ID NO: 143718 - DNA, 22 bp, Artificial Sequence
  Synthetic oligonucleotide; TTT chr11 5228902 5228923 5228907 5228902 -
aaaatattttaaagacgtcttt

SEQ ID NO: 143719 - DNA, 22 bp, Artificial Sequence
  Synthetic oligonucleotide; TTA chr11 5228901 5228922 5228906 5228901 -
aaatattttaaagacgtctttt

SEQ ID NO: 143720 - DNA, 22 bp, Artificial Sequence
  Synthetic oligonucleotide; TTT chr11 5228893 5228914 5228898 5228893 -
taaagacgtcttttcccaggat

SEQ ID NO: 143721 - DNA, 22 bp, Artificial Sequence
  Synthetic oligonucleotide; TTT chr11 5228892 5228913 5228897 5228892 -
aaagacgtcttttcccaggatt

SEQ ID NO: 143722 - DNA, 22 bp, Artificial Sequence
  Synthetic oligonucleotide; TTA chr11 5228891 5228912 5228896 5228891 -
aagacgtcttttcccaggattc

SEQ ID NO: 143723 - DNA, 22 bp, Artificial Sequence
  Synthetic oligonucleotide; CTT chr11 5228881 5228902 5228886 5228881 -
ttcccaggattcaacatgtgaa

SEQ ID NO: 143724 - DNA, 22 bp, Artificial Sequence
  Synthetic oligonucleotide; TTT chr11 5228880 5228901 5228885 5228880 -
tcccaggattcaacatgtgaaa

SEQ ID NO: 143725 - DNA, 22 bp, Artificial Sequence
  Synthetic oligonucleotide; TTT chr11 5228879 5228900 5228884 5228879 -
cccaggattcaacatgtgaaat

SEQ ID NO: 143726 - DNA, 22 bp, Artificial Sequence
  Synthetic oligonucleotide; TTC chr11 5228878 5228899 5228883 5228878 -
ccaggattcaacatgtgaaatc

SEQ ID NO: 143727 - DNA, 22 bp, Artificial Sequence
  Synthetic oligonucleotide; TTC chr11 5228869 5228890 5228874 5228869 -
aacatgtgaaatcttttctcag

SEQ ID NO: 143728 - DNA, 22 bp, Artificial Sequence
  Synthetic oligonucleotide; CTT chr11 5228854 5228875 5228859 5228854 -
ttctcagggatacacgtgtgcc

SEQ ID NO: 143729 - DNA, 22 bp, Artificial Sequence
  Synthetic oligonucleotide; TTT chr11 5228853 5228874 5228858 5228853 -
tctcagggatacacgtgtgcct

SEQ ID NO: 143730 - DNA, 22 bp, Artificial Sequence
  Synthetic oligonucleotide; TTT chr11 5228852 5228873 5228857 5228852 -
ctcagggatacacgtgtgccta

SEQ ID NO: 143731 - DNA, 22 bp, Artificial Sequence
  Synthetic oligonucleotide; TTC chr11 5228851 5228872 5228856 5228851 -
tcagggatacacgtgtgcctag

SEQ ID NO: 143732 - DNA, 22 bp, Artificial Sequence
  Synthetic oligonucleotide; CTC chr11 5228849 5228870 5228854 5228849 -
agggatacacgtgtgcctagat

SEQ ID NO: 143733 - DNA, 22 bp, Artificial Sequence
  Synthetic oligonucleotide; CTA chr11 5228830 5228851 5228835 5228830 -
gatcctcattgctttagttttt

SEQ ID NO: 143734 - DNA, 22 bp, Artificial Sequence
  Synthetic oligonucleotide; CTC chr11 5228823 5228844 5228828 5228823 -
attgctttagttttttacagag

SEQ ID NO: 143735 - DNA, 22 bp, Artificial Sequence
  Synthetic oligonucleotide; TTG chr11 5228819 5228840 5228824 5228819 -
ctttagttttttacagaggaat

SEQ ID NO: 143736 - DNA, 22 bp, Artificial Sequence
  Synthetic oligonucleotide; CTT chr11 5228816 5228837 5228821 5228816 -
tagttttttacagaggaatgaa

SEQ ID NO: 143737 - DNA, 22 bp, Artificial Sequence
  Synthetic oligonucleotide; TTT chr11 5228815 5228836 5228820 5228815 -
agttttttacagaggaatgaat

SEQ ID NO: 143738 - DNA, 22 bp, Artificial Sequence
  Synthetic oligonucleotide; TTA chr11 5228814 5228835 5228819 5228814 -
gttttttacagaggaatgaata

SEQ ID NO: 143739 - DNA, 22 bp, Artificial Sequence
  Synthetic oligonucleotide; TTT chr11 5228810 5228831 5228815 5228810 -
tttacagaggaatgaatataaa

SEQ ID NO: 143740 - DNA, 22 bp, Artificial Sequence
  Synthetic oligonucleotide; TTT chr11 5228809 5228830 5228814 5228809 -
ttacagaggaatgaatataaaa

SEQ ID NO: 143741 - DNA, 22 bp, Artificial Sequence
  Synthetic oligonucleotide; TTT chr11 5228808 5228829 5228813 5228808 -
tacagaggaatgaatataaaaa

SEQ ID NO: 143742 - DNA, 22 bp, Artificial Sequence
  Synthetic oligonucleotide; TTT chr11 5228807 5228828 5228812 5228807 -
acagaggaatgaatataaaaag

SEQ ID NO: 143743 - DNA, 22 bp, Artificial Sequence
  Synthetic oligonucleotide; TTA chr11 5228806 5228827 5228811 5228806 -
cagaggaatgaatataaaaaga

SEQ ID NO: 143744 - DNA, 22 bp, Artificial Sequence
  Synthetic oligonucleotide; CTT chr11 5228776 5228797 5228781 5228776 -
aaattttatccctcttacctct

SEQ ID NO: 143745 - DNA, 22 bp, Artificial Sequence
  Synthetic oligonucleotide; TTA chr11 5228775 5228796 5228780 5228775 -
aattttatccctcttacctcta

SEQ ID NO: 143746 - DNA, 22 bp, Artificial Sequence
  Synthetic oligonucleotide; TTT chr11 5228770 5228791 5228775 5228770 -
tatccctcttacctctataatc

SEQ ID NO: 143747 - DNA, 22 bp, Artificial Sequence
  Synthetic oligonucleotide; TTT chr11 5228769 5228790 5228774 5228769 -
atccctcttacctctataatca

SEQ ID NO: 143748 - DNA, 22 bp, Artificial Sequence
  Synthetic oligonucleotide; TTA chr11 5228768 5228789 5228773 5228768 -
tccctcttacctctataatcat

SEQ ID NO: 143749 - DNA, 22 bp, Artificial Sequence
  Synthetic oligonucleotide; CTC chr11 5228762 5228783 5228767 5228762 -
ttacctctataatcatacatag

SEQ ID NO: 143750 - DNA, 22 bp, Artificial Sequence
  Synthetic oligonucleotide; CTT chr11 5228760 5228781 5228765 5228760 -
acctctataatcatacataggc

SEQ ID NO: 143751 - DNA, 22 bp, Artificial Sequence
  Synthetic oligonucleotide; TTA chr11 5228759 5228780 5228764 5228759 -
cctctataatcatacataggca

SEQ ID NO: 143752 - DNA, 22 bp, Artificial Sequence
  Synthetic oligonucleotide; CTC chr11 5228755 5228776 5228760 5228755 -
tataatcatacataggcataat

SEQ ID NO: 143753 - DNA, 22 bp, Artificial Sequence
  Synthetic oligonucleotide; CTA chr11 5228753 5228774 5228758 5228753 -
taatcatacataggcataattt

SEQ ID NO: 143754 - DNA, 22 bp, Artificial Sequence
  Synthetic oligonucleotide; TTT chr11 5228731 5228752 5228736 5228731 -
tttaacctaggctccagatagc

SEQ ID NO: 143755 - DNA, 22 bp, Artificial Sequence
  Synthetic oligonucleotide; TTT chr11 5228730 5228751 5228735 5228730 -
ttaacctaggctccagatagcc

SEQ ID NO: 143756 - DNA, 22 bp, Artificial Sequence
  Synthetic oligonucleotide; TTT chr11 5228729 5228750 5228734 5228729 -
taacctaggctccagatagcca

SEQ ID NO: 143757 - DNA, 22 bp, Artificial Sequence
  Synthetic oligonucleotide; TTT chr11 5228728 5228749 5228733 5228728 -
aacctaggctccagatagccat

SEQ ID NO: 143758 - DNA, 22 bp, Artificial Sequence
  Synthetic oligonucleotide; TTA chr11 5228727 5228748 5228732 5228727 -
acctaggctccagatagccata

SEQ ID NO: 143759 - DNA, 22 bp, Artificial Sequence
  Synthetic oligonucleotide; CTA chr11 5228722 5228743 5228727 5228722 -
ggctccagatagccatagaaga

SEQ ID NO: 143760 - DNA, 22 bp, Artificial Sequence
  Synthetic oligonucleotide; CTC chr11 5228717 5228738 5228722 5228717 -
cagatagccatagaagaaccaa

SEQ ID NO: 143761 - DNA, 22 bp, Artificial Sequence
  Synthetic oligonucleotide; CTT chr11 5228689 5228710 5228694 5228689 -
tctgcgtgtgtgagaataatca

SEQ ID NO: 143762 - DNA, 22 bp, Artificial Sequence
  Synthetic oligonucleotide; TTT chr11 5228688 5228709 5228693 5228688 -
ctgcgtgtgtgagaataatcag

SEQ ID NO: 143763 - DNA, 22 bp, Artificial Sequence
  Synthetic oligonucleotide; TTC chr11 5228687 5228708 5228692 5228687 -
tgcgtgtgtgagaataatcaga

SEQ ID NO: 143764 - DNA, 22 bp, Artificial Sequence
  Synthetic oligonucleotide; CTG chr11 5228685 5228706 5228690 5228685 -
cgtgtgtgagaataatcagagt

SEQ ID NO: 143765 - DNA, 22 bp, Artificial Sequence
  Synthetic oligonucleotide; TTT chr11 5228656 5228677 5228661 5228656 -
tttcacaagtacctgatgaggg

SEQ ID NO: 143766 - DNA, 22 bp, Artificial Sequence
  Synthetic oligonucleotide; TTT chr11 5228655 5228676 5228660 5228655 -
ttcacaagtacctgatgagggt

SEQ ID NO: 143767 - DNA, 22 bp, Artificial Sequence
  Synthetic oligonucleotide; TTT chr11 5228654 5228675 5228659 5228654 -
tcacaagtacctgatgagggtt

SEQ ID NO: 143768 - DNA, 22 bp, Artificial Sequence
  Synthetic oligonucleotide; TTT chr11 5228653 5228674 5228658 5228653 -
cacaagtacctgatgagggttg

SEQ ID NO: 143769 - DNA, 22 bp, Artificial Sequence
  Synthetic oligonucleotide; TTC chr11 5228652 5228673 5228657 5228652 -
acaagtacctgatgagggttga

SEQ ID NO: 143770 - DNA, 22 bp, Artificial Sequence
  Synthetic oligonucleotide; CTG chr11 5228641 5228662 5228646 5228641 -
atgagggttgagacaggtagaa

SEQ ID NO: 143771 - DNA, 22 bp, Artificial Sequence
  Synthetic oligonucleotide; TTG chr11 5228631 5228652 5228636 5228631 -
agacaggtagaaaaagtgagag

SEQ ID NO: 143772 - DNA, 22 bp, Artificial Sequence
  Synthetic oligonucleotide; CTC chr11 5228604 5228625 5228609 5228604 -
tatttatttagcaataatagag

SEQ ID NO: 143773 - DNA, 22 bp, Artificial Sequence
  Synthetic oligonucleotide; CTA chr11 5228602 5228623 5228607 5228602 -
tttatttagcaataatagagaa

SEQ ID NO: 143774 - DNA, 22 bp, Artificial Sequence
  Synthetic oligonucleotide; TTT chr11 5228599 5228620 5228604 5228599 -
atttagcaataatagagaaagc

SEQ ID NO: 143775 - DNA, 22 bp, Artificial Sequence
  Synthetic oligonucleotide; TTA chr11 5228598 5228619 5228603 5228598 -
tttagcaataatagagaaagca

SEQ ID NO: 143776 - DNA, 22 bp, Artificial Sequence
  Synthetic oligonucleotide; TTT chr11 5228595 5228616 5228600 5228595 -
agcaataatagagaaagcattt

SEQ ID NO: 143777 - DNA, 22 bp, Artificial Sequence
  Synthetic oligonucleotide; TTA chr11 5228594 5228615 5228599 5228594 -
gcaataatagagaaagcattta

SEQ ID NO: 143778 - DNA, 22 bp, Artificial Sequence
  Synthetic oligonucleotide; TTT chr11 5228573 5228594 5228578 5228573 -
aagagaataaagcaatggaaat

SEQ ID NO: 143779 - DNA, 22 bp, Artificial Sequence
  Synthetic oligonucleotide; TTA chr11 5228572 5228593 5228577 5228572 -
agagaataaagcaatggaaata

SEQ ID NO: 143780 - DNA, 22 bp, Artificial Sequence
  Synthetic oligonucleotide; TTT chr11 5228542 5228563 5228547 5228542 -
gtaaatttccttctgataacta

SEQ ID NO: 143781 - DNA, 22 bp, Artificial Sequence
  Synthetic oligonucleotide; TTG chr11 5228541 5228562 5228546 5228541 -
taaatttccttctgataactag

SEQ ID NO: 143782 - DNA, 22 bp, Artificial Sequence
  Synthetic oligonucleotide; TTT chr11 5228534 5228555 5228539 5228534 -
ccttctgataactagaaataga

SEQ ID NO: 143783 - DNA, 22 bp, Artificial Sequence
  Synthetic oligonucleotide; TTC chr11 5228533 5228554 5228538 5228533 -
cttctgataactagaaatagag

SEQ ID NO: 143784 - DNA, 22 bp, Artificial Sequence
  Synthetic oligonucleotide; CTT chr11 5228530 5228551 5228535 5228530 -
ctgataactagaaatagaggat

SEQ ID NO: 143785 - DNA, 22 bp, Artificial Sequence
  Synthetic oligonucleotide; TTC chr11 5228529 5228550 5228534 5228529 -
tgataactagaaatagaggatc

SEQ ID NO: 143786 - DNA, 22 bp, Artificial Sequence
  Synthetic oligonucleotide; CTG chr11 5228527 5228548 5228532 5228527 -
ataactagaaatagaggatcca

SEQ ID NO: 143787 - DNA, 22 bp, Artificial Sequence
  Synthetic oligonucleotide; CTA chr11 5228520 5228541 5228525 5228520 -
gaaatagaggatccagtttctt

SEQ ID NO: 143788 - DNA, 22 bp, Artificial Sequence
  Synthetic oligonucleotide; TTT chr11 5228501 5228522 5228506 5228501 -
cttttggttaacctaaatttta

SEQ ID NO: 143789 - DNA, 22 bp, Artificial Sequence
  Synthetic oligonucleotide; TTC chr11 5228500 5228521 5228505 5228500 -
ttttggttaacctaaattttat

SEQ ID NO: 143790 - DNA, 22 bp, Artificial Sequence
  Synthetic oligonucleotide; CTT chr11 5228498 5228519 5228503 5228498 -
ttggttaacctaaattttattt

SEQ ID NO: 143791 - DNA, 22 bp, Artificial Sequence
  Synthetic oligonucleotide; TTT chr11 5228497 5228518 5228502 5228497 -
tggttaacctaaattttatttc

SEQ ID NO: 143792 - DNA, 22 bp, Artificial Sequence
  Synthetic oligonucleotide; TTT chr11 5228496 5228517 5228501 5228496 -
ggttaacctaaattttatttca

SEQ ID NO: 143793 - DNA, 22 bp, Artificial Sequence
  Synthetic oligonucleotide; TTG chr11 5228495 5228516 5228500 5228495 -
gttaacctaaattttatttcat

SEQ ID NO: 143794 - DNA, 22 bp, Artificial Sequence
  Synthetic oligonucleotide; TTA chr11 5228491 5228512 5228496 5228491 -
acctaaattttatttcatttta

SEQ ID NO: 143795 - DNA, 22 bp, Artificial Sequence
  Synthetic oligonucleotide; CTA chr11 5228486 5228507 5228491 5228486 -
aattttatttcattttattgtt

SEQ ID NO: 143796 - DNA, 22 bp, Artificial Sequence
  Synthetic oligonucleotide; TTT chr11 5228481 5228502 5228486 5228481 -
tatttcattttattgttttatt

SEQ ID NO: 143797 - DNA, 22 bp, Artificial Sequence
  Synthetic oligonucleotide; TTT chr11 5228480 5228501 5228485 5228480 -
atttcattttattgttttattt

SEQ ID NO: 143798 - DNA, 22 bp, Artificial Sequence
  Synthetic oligonucleotide; TTA chr11 5228479 5228500 5228484 5228479 -
tttcattttattgttttatttt

SEQ ID NO: 143799 - DNA, 22 bp, Artificial Sequence
  Synthetic oligonucleotide; TTT chr11 5228476 5228497 5228481 5228476 -
cattttattgttttattttatt

SEQ ID NO: 143800 - DNA, 22 bp, Artificial Sequence
  Synthetic oligonucleotide; TTC chr11 5228475 5228496 5228480 5228475 -
attttattgttttattttattt

SEQ ID NO: 143801 - DNA, 22 bp, Artificial Sequence
  Synthetic oligonucleotide; TTT chr11 5228471 5228492 5228476 5228471 -
tattgttttattttattttatt

SEQ ID NO: 143802 - DNA, 22 bp, Artificial Sequence
  Synthetic oligonucleotide; TTT chr11 5228470 5228491 5228475 5228470 -
attgttttattttattttattt

SEQ ID NO: 143803 - DNA, 22 bp, Artificial Sequence
  Synthetic oligonucleotide; TTA chr11 5228469 5228490 5228474 5228469 -
ttgttttattttattttatttt

SEQ ID NO: 143804 - DNA, 22 bp, Artificial Sequence
  Synthetic oligonucleotide; TTG chr11 5228466 5228487 5228471 5228466 -
ttttattttattttattttatt

SEQ ID NO: 143805 - DNA, 22 bp, Artificial Sequence
  Synthetic oligonucleotide; TTT chr11 5228463 5228484 5228468 5228463 -
tattttattttattttatttta

SEQ ID NO: 143806 - DNA, 22 bp, Artificial Sequence
  Synthetic oligonucleotide; TTT chr11 5228462 5228483 5228467 5228462 -
attttattttattttattttat

SEQ ID NO: 143807 - DNA, 22 bp, Artificial Sequence
  Synthetic oligonucleotide; TTA chr11 5228461 5228482 5228466 5228461 -
ttttattttattttattttatt

SEQ ID NO: 143808 - DNA, 22 bp, Artificial Sequence
  Synthetic oligonucleotide; TTT chr11 5228458 5228479 5228463 5228458 -
tattttattttattttattttg

SEQ ID NO: 143809 - DNA, 22 bp, Artificial Sequence
  Synthetic oligonucleotide; TTT chr11 5228457 5228478 5228462 5228457 -
attttattttattttattttgt

SEQ ID NO: 143810 - DNA, 22 bp, Artificial Sequence
  Synthetic oligonucleotide; TTA chr11 5228456 5228477 5228461 5228456 -
ttttattttattttattttgtg

SEQ ID NO: 143811 - DNA, 22 bp, Artificial Sequence
  Synthetic oligonucleotide; TTT chr11 5228453 5228474 5228458 5228453 -
tattttattttattttgtgtaa

SEQ ID NO: 143812 - DNA, 22 bp, Artificial Sequence
  Synthetic oligonucleotide; TTT chr11 5228452 5228473 5228457 5228452 -
attttattttattttgtgtaat

SEQ ID NO: 143813 - DNA, 22 bp, Artificial Sequence
  Synthetic oligonucleotide; TTA chr11 5228451 5228472 5228456 5228451 -
ttttattttattttgtgtaatc

SEQ ID NO: 143814 - DNA, 22 bp, Artificial Sequence
  Synthetic oligonucleotide; TTT chr11 5228448 5228469 5228453 5228448 -
tattttattttgtgtaatcgta

SEQ ID NO: 143815 - DNA, 22 bp, Artificial Sequence
  Synthetic oligonucleotide; TTT chr11 5228447 5228468 5228452 5228447 -
attttattttgtgtaatcgtag

SEQ ID NO: 143816 - DNA, 22 bp, Artificial Sequence
  Synthetic oligonucleotide; TTA chr11 5228446 5228467 5228451 5228446 -
ttttattttgtgtaatcgtagt

SEQ ID NO: 143817 - DNA, 22 bp, Artificial Sequence
  Synthetic oligonucleotide; TTT chr11 5228443 5228464 5228448 5228443 -
tattttgtgtaatcgtagtttc

SEQ ID NO: 143818 - DNA, 22 bp, Artificial Sequence
  Synthetic oligonucleotide; TTT chr11 5228442 5228463 5228447 5228442 -
attttgtgtaatcgtagtttca

SEQ ID NO: 143819 - DNA, 22 bp, Artificial Sequence
  Synthetic oligonucleotide; TTA chr11 5228441 5228462 5228446 5228441 -
ttttgtgtaatcgtagtttcag

SEQ ID NO: 143820 - DNA, 22 bp, Artificial Sequence
  Synthetic oligonucleotide; TTT chr11 5228438 5228459 5228443 5228438 -
tgtgtaatcgtagtttcagagt

SEQ ID NO: 143821 - DNA, 22 bp, Artificial Sequence
  Synthetic oligonucleotide; TTT chr11 5228437 5228458 5228442 5228437 -
gtgtaatcgtagtttcagagtg

SEQ ID NO: 143822 - DNA, 22 bp, Artificial Sequence
  Synthetic oligonucleotide; TTG chr11 5228436 5228457 5228441 5228436 -
tgtaatcgtagtttcagagtgt

SEQ ID NO: 143823 - DNA, 22 bp, Artificial Sequence
  Synthetic oligonucleotide; TTT chr11 5228422 5228443 5228427 5228422 -
cagagtgttagagctgaaagga

SEQ ID NO: 143824 - DNA, 22 bp, Artificial Sequence
  Synthetic oligonucleotide; TTC chr11 5228421 5228442 5228426 5228421 -
agagtgttagagctgaaaggaa

SEQ ID NO: 143825 - DNA, 22 bp, Artificial Sequence
  Synthetic oligonucleotide; TTA chr11 5228412 5228433 5228417 5228412 -
gagctgaaaggaagaagtagga

SEQ ID NO: 143826 - DNA, 22 bp, Artificial Sequence
  Synthetic oligonucleotide; CTG chr11 5228406 5228427 5228411 5228406 -
aaaggaagaagtaggagaaaca

SEQ ID NO: 143827 - DNA, 22 bp, Artificial Sequence
  Synthetic oligonucleotide; CTT chr11 5228361 5228382 5228366 5228361 -
tccttactaaaccgacatgggt

SEQ ID NO: 143828 - DNA, 22 bp, Artificial Sequence
  Synthetic oligonucleotide; TTT chr11 5228360 5228381 5228365 5228360 -
ccttactaaaccgacatgggtt

SEQ ID NO: 143829 - DNA, 22 bp, Artificial Sequence
  Synthetic oligonucleotide; TTC chr11 5228359 5228380 5228364 5228359 -
cttactaaaccgacatgggttt

SEQ ID NO: 143830 - DNA, 22 bp, Artificial Sequence
  Synthetic oligonucleotide; CTT chr11 5228356 5228377 5228361 5228356 -
actaaaccgacatgggtttcca

SEQ ID NO: 143831 - DNA, 22 bp, Artificial Sequence
  Synthetic oligonucleotide; TTA chr11 5228355 5228376 5228360 5228355 -
ctaaaccgacatgggtttccag

SEQ ID NO: 143832 - DNA, 22 bp, Artificial Sequence
  Synthetic oligonucleotide; CTA chr11 5228352 5228373 5228357 5228352 -
aaccgacatgggtttccaggta

SEQ ID NO: 143833 - DNA, 22 bp, Artificial Sequence
  Synthetic oligonucleotide; TTT chr11 5228337 5228358 5228342 5228337 -
ccaggtaggggcaggattcagg

SEQ ID NO: 143834 - DNA, 22 bp, Artificial Sequence
  Synthetic oligonucleotide; TTC chr11 5228336 5228357 5228341 5228336 -
caggtaggggcaggattcagga

SEQ ID NO: 143835 - DNA, 22 bp, Artificial Sequence
  Synthetic oligonucleotide; TTC chr11 5228318 5228339 5228323 5228318 -
aggatgactgacagggccctta

SEQ ID NO: 143836 - DNA, 22 bp, Artificial Sequence
  Synthetic oligonucleotide; CTG chr11 5228308 5228329 5228313 5228308 -
acagggcccttagggaacactg

SEQ ID NO: 143837 - DNA, 22 bp, Artificial Sequence
  Synthetic oligonucleotide; CTT chr11 5228297 5228318 5228302 5228297 -
agggaacactgagaccctacgc

SEQ ID NO: 143838 - DNA, 22 bp, Artificial Sequence
  Synthetic oligonucleotide; TTA chr11 5228296 5228317 5228301 5228296 -
gggaacactgagaccctacgct

SEQ ID NO: 143839 - DNA, 22 bp, Artificial Sequence
  Synthetic oligonucleotide; CTG chr11 5228286 5228307 5228291 5228286 -
agaccctacgctgacctcataa

SEQ ID NO: 143840 - DNA, 22 bp, Artificial Sequence
  Synthetic oligonucleotide; CTA chr11 5228278 5228299 5228283 5228278 -
cgctgacctcataaatgcttgc

SEQ ID NO: 143841 - DNA, 22 bp, Artificial Sequence
  Synthetic oligonucleotide; CTG chr11 5228273 5228294 5228278 5228273 -
acctcataaatgcttgctacct

SEQ ID NO: 143842 - DNA, 22 bp, Artificial Sequence
  Synthetic oligonucleotide; CTC chr11 5228268 5228289 5228273 5228268 -
ataaatgcttgctacctttgct

SEQ ID NO: 143843 - DNA, 22 bp, Artificial Sequence
  Synthetic oligonucleotide; CTT chr11 5228258 5228279 5228263 5228258 -
gctacctttgctgttttaatta

SEQ ID NO: 143844 - DNA, 22 bp, Artificial Sequence
  Synthetic oligonucleotide; TTG chr11 5228257 5228278 5228262 5228257 -
ctacctttgctgttttaattac

SEQ ID NO: 143845 - DNA, 22 bp, Artificial Sequence
  Synthetic oligonucleotide; CTA chr11 5228254 5228275 5228259 5228254 -
cctttgctgttttaattacatc

SEQ ID NO: 143846 - DNA, 22 bp, Artificial Sequence
  Synthetic oligonucleotide; CTT chr11 5228250 5228271 5228255 5228250 -
tgctgttttaattacatctttt

SEQ ID NO: 143847 - DNA, 22 bp, Artificial Sequence
  Synthetic oligonucleotide; TTT chr11 5228249 5228270 5228254 5228249 -
gctgttttaattacatctttta

SEQ ID NO: 143848 - DNA, 22 bp, Artificial Sequence
  Synthetic oligonucleotide; TTG chr11 5228248 5228269 5228253 5228248 -
ctgttttaattacatcttttaa

SEQ ID NO: 143849 - DNA, 22 bp, Artificial Sequence
  Synthetic oligonucleotide; CTG chr11 5228245 5228266 5228250 5228245 -
ttttaattacatcttttaatag

SEQ ID NO: 143850 - DNA, 22 bp, Artificial Sequence
  Synthetic oligonucleotide; TTT chr11 5228242 5228263 5228247 5228242 -
taattacatcttttaatagcag

SEQ ID NO: 143851 - DNA, 22 bp, Artificial Sequence
  Synthetic oligonucleotide; TTT chr11 5228241 5228262 5228246 5228241 -
aattacatcttttaatagcagg

SEQ ID NO: 143852 - DNA, 22 bp, Artificial Sequence
  Synthetic oligonucleotide; TTA chr11 5228240 5228261 5228245 5228240 -
attacatcttttaatagcagga

SEQ ID NO: 143853 - DNA, 22 bp, Artificial Sequence
  Synthetic oligonucleotide; TTA chr11 5228236 5228257 5228241 5228236 -
catcttttaatagcaggaagca

SEQ ID NO: 143854 - DNA, 22 bp, Artificial Sequence
  Synthetic oligonucleotide; CTT chr11 5228230 5228251 5228235 5228230 -
ttaatagcaggaagcagaactc

SEQ ID NO: 143855 - DNA, 22 bp, Artificial Sequence
  Synthetic oligonucleotide; TTT chr11 5228229 5228250 5228234 5228229 -
taatagcaggaagcagaactct

SEQ ID NO: 143856 - DNA, 22 bp, Artificial Sequence
  Synthetic oligonucleotide; TTT chr11 5228228 5228249 5228233 5228228 -
aatagcaggaagcagaactctg

SEQ ID NO: 143857 - DNA, 22 bp, Artificial Sequence
  Synthetic oligonucleotide; TTA chr11 5228227 5228248 5228232 5228227 -
atagcaggaagcagaactctgc

SEQ ID NO: 143858 - DNA, 22 bp, Artificial Sequence
  Synthetic oligonucleotide; CTC chr11 5228208 5228229 5228213 5228208 -
tgcacttcaaaagtttttcctc

SEQ ID NO: 143859 - DNA, 22 bp, Artificial Sequence
  Synthetic oligonucleotide; CTG chr11 5228206 5228227 5228211 5228206 -
cacttcaaaagtttttcctcac

SEQ ID NO: 143860 - DNA, 22 bp, Artificial Sequence
  Synthetic oligonucleotide; CTT chr11 5228201 5228222 5228206 5228201 -
caaaagtttttcctcacctgag

SEQ ID NO: 143861 - DNA, 22 bp, Artificial Sequence
  Synthetic oligonucleotide; TTC chr11 5228200 5228221 5228205 5228200 -
aaaagtttttcctcacctgagg

SEQ ID NO: 143862 - DNA, 22 bp, Artificial Sequence
  Synthetic oligonucleotide; TTT chr11 5228192 5228213 5228197 5228192 -
ttcctcacctgaggagttaatt

SEQ ID NO: 143863 - DNA, 22 bp, Artificial Sequence
  Synthetic oligonucleotide; TTT chr11 5228191 5228212 5228196 5228191 -
tcctcacctgaggagttaattt

SEQ ID NO: 143864 - DNA, 22 bp, Artificial Sequence
  Synthetic oligonucleotide; TTT chr11 5228190 5228211 5228195 5228190 -
cctcacctgaggagttaattta

SEQ ID NO: 143865 - DNA, 22 bp, Artificial Sequence
  Synthetic oligonucleotide; TTC chr11 5228189 5228210 5228194 5228189 -
ctcacctgaggagttaatttag

SEQ ID NO: 143866 - DNA, 22 bp, Artificial Sequence
  Synthetic oligonucleotide; CTC chr11 5228186 5228207 5228191 5228186 -
acctgaggagttaatttagtac

SEQ ID NO: 143867 - DNA, 22 bp, Artificial Sequence
  Synthetic oligonucleotide; CTG chr11 5228181 5228202 5228186 5228181 -
aggagttaatttagtacaaggg

SEQ ID NO: 143868 - DNA, 22 bp, Artificial Sequence
  Synthetic oligonucleotide; TTA chr11 5228173 5228194 5228178 5228173 -
atttagtacaaggggaaaaagt

SEQ ID NO: 143869 - DNA, 22 bp, Artificial Sequence
  Synthetic oligonucleotide; TTT chr11 5228169 5228190 5228174 5228169 -
agtacaaggggaaaaagtacag

SEQ ID NO: 143870 - DNA, 22 bp, Artificial Sequence
  Synthetic oligonucleotide; TTA chr11 5228168 5228189 5228173 5228168 -
gtacaaggggaaaaagtacagg

SEQ ID NO: 143871 - DNA, 22 bp, Artificial Sequence
  Synthetic oligonucleotide; TTG chr11 5228120 5228141 5228125 5228120 -
ggaagctatagagaaagaagag

SEQ ID NO: 143872 - DNA, 22 bp, Artificial Sequence
  Synthetic oligonucleotide; CTA chr11 5228112 5228133 5228117 5228112 -
tagagaaagaagagtaaatttt

SEQ ID NO: 143873 - DNA, 22 bp, Artificial Sequence
  Synthetic oligonucleotide; TTT chr11 5228091 5228112 5228096 5228091 -
tagtaaaggaggtttaaacaaa

SEQ ID NO: 143874 - DNA, 22 bp, Artificial Sequence
  Synthetic oligonucleotide; TTT chr11 5228090 5228111 5228095 5228090 -
agtaaaggaggtttaaacaaac

SEQ ID NO: 143875 - DNA, 22 bp, Artificial Sequence
  Synthetic oligonucleotide; TTA chr11 5228089 5228110 5228094 5228089 -
gtaaaggaggtttaaacaaaca

SEQ ID NO: 143876 - DNA, 22 bp, Artificial Sequence
  Synthetic oligonucleotide; TTT chr11 5228076 5228097 5228081 5228076 -
aaacaaacaaaatataaagaga

SEQ ID NO: 143877 - DNA, 22 bp, Artificial Sequence
  Synthetic oligonucleotide; TTA chr11 5228075 5228096 5228080 5228075 -
aacaaacaaaatataaagagaa

SEQ ID NO: 143878 - DNA, 22 bp, Artificial Sequence
  Synthetic oligonucleotide; CTT chr11 5228043 5228064 5228048 5228043 -
gaatcaaggaaatgattttaaa

SEQ ID NO: 143879 - DNA, 22 bp, Artificial Sequence
  Synthetic oligonucleotide; TTG chr11 5228042 5228063 5228047 5228042 -
aatcaaggaaatgattttaaaa

SEQ ID NO: 143880 - DNA, 22 bp, Artificial Sequence
  Synthetic oligonucleotide; TTT chr11 5228025 5228046 5228030 5228025 -
taaaacgcagtattcttagtgg

SEQ ID NO: 143881 - DNA, 22 bp, Artificial Sequence
  Synthetic oligonucleotide; TTT chr11 5228024 5228045 5228029 5228024 -
aaaacgcagtattcttagtgga

SEQ ID NO: 143882 - DNA, 22 bp, Artificial Sequence
  Synthetic oligonucleotide; TTA chr11 5228023 5228044 5228028 5228023 -
aaacgcagtattcttagtggac

SEQ ID NO: 143883 - DNA, 22 bp, Artificial Sequence
  Synthetic oligonucleotide; TTC chr11 5228010 5228031 5228015 5228010 -
ttagtggactagaggaaaaaaa

SEQ ID NO: 143884 - DNA, 22 bp, Artificial Sequence
  Synthetic oligonucleotide; CTT chr11 5228008 5228029 5228013 5228008 -
agtggactagaggaaaaaaata

SEQ ID NO: 143885 - DNA, 22 bp, Artificial Sequence
  Synthetic oligonucleotide; TTA chr11 5228007 5228028 5228012 5228007 -
gtggactagaggaaaaaaataa

SEQ ID NO: 143886 - DNA, 22 bp, Artificial Sequence
  Synthetic oligonucleotide; CTA chr11 5227999 5228020 5228004 5227999 -
gaggaaaaaaataatctgagcc

SEQ ID NO: 143887 - DNA, 22 bp, Artificial Sequence
  Synthetic oligonucleotide; CTG chr11 5227981 5228002 5227986 5227981 -
agccaagtagaagaccttttcc

SEQ ID NO: 143888 - DNA, 22 bp, Artificial Sequence
  Synthetic oligonucleotide; CTT chr11 5227963 5227984 5227968 5227963 -
ttcccctcctacccctactttc

SEQ ID NO: 143889 - DNA, 22 bp, Artificial Sequence
  Synthetic oligonucleotide; TTT chr11 5227962 5227983 5227967 5227962 -
tcccctcctacccctactttct

SEQ ID NO: 143890 - DNA, 22 bp, Artificial Sequence
  Synthetic oligonucleotide; TTT chr11 5227961 5227982 5227966 5227961 -
cccctcctacccctactttcta

SEQ ID NO: 143891 - DNA, 22 bp, Artificial Sequence
  Synthetic oligonucleotide; TTC chr11 5227960 5227981 5227965 5227960 -
ccctcctacccctactttctaa

SEQ ID NO: 143892 - DNA, 22 bp, Artificial Sequence
  Synthetic oligonucleotide; CTC chr11 5227955 5227976 5227960 5227955 -
ctacccctactttctaagtcac

SEQ ID NO: 143893 - DNA, 22 bp, Artificial Sequence
  Synthetic oligonucleotide; CTA chr11 5227952 5227973 5227957 5227952 -
cccctactttctaagtcacaga

SEQ ID NO: 143894 - DNA, 22 bp, Artificial Sequence
  Synthetic oligonucleotide; CTA chr11 5227946 5227967 5227951 5227946 -
ctttctaagtcacagaggcttt

SEQ ID NO: 143895 - DNA, 22 bp, Artificial Sequence
  Synthetic oligonucleotide; CTT chr11 5227943 5227964 5227948 5227943 -
tctaagtcacagaggctttttg

SEQ ID NO: 143896 - DNA, 22 bp, Artificial Sequence
  Synthetic oligonucleotide; TTT chr11 5227942 5227963 5227947 5227942 -
ctaagtcacagaggctttttgt

SEQ ID NO: 143897 - DNA, 22 bp, Artificial Sequence
  Synthetic oligonucleotide; TTC chr11 5227941 5227962 5227946 5227941 -
taagtcacagaggctttttgtt

SEQ ID NO: 143898 - DNA, 22 bp, Artificial Sequence
  Synthetic oligonucleotide; CTA chr11 5227939 5227960 5227944 5227939 -
agtcacagaggctttttgttcc

SEQ ID NO: 143899 - DNA, 22 bp, Artificial Sequence
  Synthetic oligonucleotide; CTT chr11 5227925 5227946 5227930 5227925 -
tttgttcccccagacactcttg

SEQ ID NO: 143900 - DNA, 22 bp, Artificial Sequence
  Synthetic oligonucleotide; TTT chr11 5227924 5227945 5227929 5227924 -
ttgttcccccagacactcttgc

SEQ ID NO: 143901 - DNA, 22 bp, Artificial Sequence
  Synthetic oligonucleotide; TTT chr11 5227923 5227944 5227928 5227923 -
tgttcccccagacactcttgca

SEQ ID NO: 143902 - DNA, 22 bp, Artificial Sequence
  Synthetic oligonucleotide; TTT chr11 5227922 5227943 5227927 5227922 -
gttcccccagacactcttgcag

SEQ ID NO: 143903 - DNA, 22 bp, Artificial Sequence
  Synthetic oligonucleotide; TTG chr11 5227921 5227942 5227926 5227921 -
ttcccccagacactcttgcaga

SEQ ID NO: 143904 - DNA, 22 bp, Artificial Sequence
  Synthetic oligonucleotide; TTC chr11 5227918 5227939 5227923 5227918 -
ccccagacactcttgcagatta

SEQ ID NO: 143905 - DNA, 22 bp, Artificial Sequence
  Synthetic oligonucleotide; CTC chr11 5227906 5227927 5227911 5227906 -
ttgcagattagtccaggcagaa

SEQ ID NO: 143906 - DNA, 22 bp, Artificial Sequence
  Synthetic oligonucleotide; CTT chr11 5227904 5227925 5227909 5227904 -
gcagattagtccaggcagaaac

SEQ ID NO: 143907 - DNA, 22 bp, Artificial Sequence
  Synthetic oligonucleotide; TTG chr11 5227903 5227924 5227908 5227903 -
cagattagtccaggcagaaaca

SEQ ID NO: 143908 - DNA, 22 bp, Artificial Sequence
  Synthetic oligonucleotide; TTA chr11 5227896 5227917 5227901 5227896 -
gtccaggcagaaacagttagat

SEQ ID NO: 143909 - DNA, 22 bp, Artificial Sequence
  Synthetic oligonucleotide; TTA chr11 5227877 5227898 5227882 5227877 -
gatgtccccagttaacctccta

SEQ ID NO: 143910 - DNA, 22 bp, Artificial Sequence
  Synthetic oligonucleotide; TTA chr11 5227863 5227884 5227868 5227863 -
acctcctatttgacaccactga

SEQ ID NO: 143911 - DNA, 22 bp, Artificial Sequence
  Synthetic oligonucleotide; CTC chr11 5227858 5227879 5227863 5227858 -
ctatttgacaccactgattacc

SEQ ID NO: 143912 - DNA, 22 bp, Artificial Sequence
  Synthetic oligonucleotide; CTA chr11 5227855 5227876 5227860 5227855 -
tttgacaccactgattacccca

SEQ ID NO: 143913 - DNA, 22 bp, Artificial Sequence
  Synthetic oligonucleotide; TTT chr11 5227852 5227873 5227857 5227852 -
gacaccactgattaccccattg

SEQ ID NO: 143914 - DNA, 22 bp, Artificial Sequence
  Synthetic oligonucleotide; TTG chr11 5227851 5227872 5227856 5227851 -
acaccactgattaccccattga

SEQ ID NO: 143915 - DNA, 22 bp, Artificial Sequence
  Synthetic oligonucleotide; CTG chr11 5227842 5227863 5227847 5227842 -
attaccccattgatagtcacac

SEQ ID NO: 143916 - DNA, 22 bp, Artificial Sequence
  Synthetic oligonucleotide; TTA chr11 5227838 5227859 5227843 5227838 -
ccccattgatagtcacactttg

SEQ ID NO: 143917 - DNA, 22 bp, Artificial Sequence
  Synthetic oligonucleotide; TTG chr11 5227830 5227851 5227835 5227830 -
atagtcacactttgggttgtaa

SEQ ID NO: 143918 - DNA, 22 bp, Artificial Sequence
  Synthetic oligonucleotide; CTT chr11 5227818 5227839 5227823 5227818 -
tgggttgtaagtgactttttat

SEQ ID NO: 143919 - DNA, 22 bp, Artificial Sequence
  Synthetic oligonucleotide; TTT chr11 5227817 5227838 5227822 5227817 -
gggttgtaagtgactttttatt

SEQ ID NO: 143920 - DNA, 22 bp, Artificial Sequence
  Synthetic oligonucleotide; TTG chr11 5227816 5227837 5227821 5227816 -
ggttgtaagtgactttttattt

SEQ ID NO: 143921 - DNA, 22 bp, Artificial Sequence
  Synthetic oligonucleotide; TTG chr11 5227811 5227832 5227816 5227811 -
taagtgactttttatttatttg

SEQ ID NO: 143922 - DNA, 22 bp, Artificial Sequence
  Synthetic oligonucleotide; CTT chr11 5227801 5227822 5227806 5227801 -
tttatttatttgtatttttgac

SEQ ID NO: 143923 - DNA, 22 bp, Artificial Sequence
  Synthetic oligonucleotide; TTT chr11 5227800 5227821 5227805 5227800 -
ttatttatttgtatttttgact

SEQ ID NO: 143924 - DNA, 22 bp, Artificial Sequence
  Synthetic oligonucleotide; TTT chr11 5227799 5227820 5227804 5227799 -
tatttatttgtatttttgactg

SEQ ID NO: 143925 - DNA, 22 bp, Artificial Sequence
  Synthetic oligonucleotide; TTT chr11 5227798 5227819 5227803 5227798 -
atttatttgtatttttgactgc

SEQ ID NO: 143926 - DNA, 22 bp, Artificial Sequence
  Synthetic oligonucleotide; TTA chr11 5227797 5227818 5227802 5227797 -
tttatttgtatttttgactgca

SEQ ID NO: 143927 - DNA, 22 bp, Artificial Sequence
  Synthetic oligonucleotide; TTT chr11 5227794 5227815 5227799 5227794 -
atttgtatttttgactgcatta

SEQ ID NO: 143928 - DNA, 22 bp, Artificial Sequence
  Synthetic oligonucleotide; TTA chr11 5227793 5227814 5227798 5227793 -
tttgtatttttgactgcattaa

SEQ ID NO: 143929 - DNA, 22 bp, Artificial Sequence
  Synthetic oligonucleotide; TTT chr11 5227790 5227811 5227795 5227790 -
gtatttttgactgcattaagag

SEQ ID NO: 143930 - DNA, 22 bp, Artificial Sequence
  Synthetic oligonucleotide; TTG chr11 5227789 5227810 5227794 5227789 -
tatttttgactgcattaagagg

SEQ ID NO: 143931 - DNA, 22 bp, Artificial Sequence
  Synthetic oligonucleotide; TTT chr11 5227784 5227805 5227789 5227784 -
ttgactgcattaagaggtctct

SEQ ID NO: 143932 - DNA, 22 bp, Artificial Sequence
  Synthetic oligonucleotide; TTT chr11 5227783 5227804 5227788 5227783 -
tgactgcattaagaggtctcta

SEQ ID NO: 143933 - DNA, 22 bp, Artificial Sequence
  Synthetic oligonucleotide; TTT chr11 5227782 5227803 5227787 5227782 -
gactgcattaagaggtctctag

SEQ ID NO: 143934 - DNA, 22 bp, Artificial Sequence
  Synthetic oligonucleotide; TTG chr11 5227781 5227802 5227786 5227781 -
actgcattaagaggtctctagt

SEQ ID NO: 143935 - DNA, 22 bp, Artificial Sequence
  Synthetic oligonucleotide; CTG chr11 5227777 5227798 5227782 5227777 -
cattaagaggtctctagttttt

SEQ ID NO: 143936 - DNA, 22 bp, Artificial Sequence
  Synthetic oligonucleotide; TTA chr11 5227772 5227793 5227777 5227772 -
agaggtctctagttttttatct

SEQ ID NO: 143937 - DNA, 22 bp, Artificial Sequence
  Synthetic oligonucleotide; CTC chr11 5227763 5227784 5227768 5227763 -
tagttttttatctcttgtttcc

SEQ ID NO: 143938 - DNA, 22 bp, Artificial Sequence
  Synthetic oligonucleotide; CTA chr11 5227761 5227782 5227766 5227761 -
gttttttatctcttgtttccca

SEQ ID NO: 143939 - DNA, 22 bp, Artificial Sequence
  Synthetic oligonucleotide; TTT chr11 5227757 5227778 5227762 5227757 -
tttatctcttgtttcccaaaac

SEQ ID NO: 143940 - DNA, 22 bp, Artificial Sequence
  Synthetic oligonucleotide; TTT chr11 5227756 5227777 5227761 5227756 -
ttatctcttgtttcccaaaacc

SEQ ID NO: 143941 - DNA, 22 bp, Artificial Sequence
  Synthetic oligonucleotide; TTT chr11 5227755 5227776 5227760 5227755 -
tatctcttgtttcccaaaacct

SEQ ID NO: 143942 - DNA, 22 bp, Artificial Sequence
  Synthetic oligonucleotide; TTT chr11 5227754 5227775 5227759 5227754 -
atctcttgtttcccaaaaccta

SEQ ID NO: 143943 - DNA, 22 bp, Artificial Sequence
  Synthetic oligonucleotide; TTA chr11 5227753 5227774 5227758 5227753 -
tctcttgtttcccaaaacctaa

SEQ ID NO: 143944 - DNA, 22 bp, Artificial Sequence
  Synthetic oligonucleotide; CTC chr11 5227749 5227770 5227754 5227749 -
ttgtttcccaaaacctaataag

SEQ ID NO: 143945 - DNA, 22 bp, Artificial Sequence
  Synthetic oligonucleotide; CTT chr11 5227747 5227768 5227752 5227747 -
gtttcccaaaacctaataagta

SEQ ID NO: 143946 - DNA, 22 bp, Artificial Sequence
  Synthetic oligonucleotide; TTG chr11 5227746 5227767 5227751 5227746 -
tttcccaaaacctaataagtaa

SEQ ID NO: 143947 - DNA, 22 bp, Artificial Sequence
  Synthetic oligonucleotide; TTT chr11 5227743 5227764 5227748 5227743 -
cccaaaacctaataagtaacta

SEQ ID NO: 143948 - DNA, 22 bp, Artificial Sequence
  Synthetic oligonucleotide; TTC chr11 5227742 5227763 5227747 5227742 -
ccaaaacctaataagtaactaa

SEQ ID NO: 143949 - DNA, 22 bp, Artificial Sequence
  Synthetic oligonucleotide; CTA chr11 5227732 5227753 5227737 5227732 -
ataagtaactaatgcacagagc

SEQ ID NO: 143950 - DNA, 22 bp, Artificial Sequence
  Synthetic oligonucleotide; CTA chr11 5227721 5227742 5227726 5227721 -
atgcacagagcacattgatttg

SEQ ID NO: 143951 - DNA, 22 bp, Artificial Sequence
  Synthetic oligonucleotide; TTG chr11 5227704 5227725 5227709 5227704 -
atttgtatttattctattttta

SEQ ID NO: 143952 - DNA, 22 bp, Artificial Sequence
  Synthetic oligonucleotide; TTT chr11 5227700 5227721 5227705 5227700 -
gtatttattctatttttagaca

SEQ ID NO: 143953 - DNA, 22 bp, Artificial Sequence
  Synthetic oligonucleotide; TTG chr11 5227699 5227720 5227704 5227699 -
tatttattctatttttagacat

SEQ ID NO: 143954 - DNA, 22 bp, Artificial Sequence
  Synthetic oligonucleotide; TTT chr11 5227694 5227715 5227699 5227694 -
attctatttttagacataattt

SEQ ID NO: 143955 - DNA, 22 bp, Artificial Sequence
  Synthetic oligonucleotide; TTA chr11 5227693 5227714 5227698 5227693 -
ttctatttttagacataattta

SEQ ID NO: 143956 - DNA, 22 bp, Artificial Sequence
  Synthetic oligonucleotide; TTC chr11 5227690 5227711 5227695 5227690 -
tatttttagacataatttatta

SEQ ID NO: 143957 - DNA, 22 bp, Artificial Sequence
  Synthetic oligonucleotide; CTA chr11 5227688 5227709 5227693 5227688 -
tttttagacataatttattagc

SEQ ID NO: 143958 - DNA, 22 bp, Artificial Sequence
  Synthetic oligonucleotide; TTT chr11 5227685 5227706 5227690 5227685 -
ttagacataatttattagcatg

SEQ ID NO: 143959 - DNA, 22 bp, Artificial Sequence
  Synthetic oligonucleotide; TTT chr11 5227684 5227705 5227689 5227684 -
tagacataatttattagcatgc

SEQ ID NO: 143960 - DNA, 22 bp, Artificial Sequence
  Synthetic oligonucleotide; TTT chr11 5227683 5227704 5227688 5227683 -
agacataatttattagcatgca

SEQ ID NO: 143961 - DNA, 22 bp, Artificial Sequence
  Synthetic oligonucleotide; TTA chr11 5227682 5227703 5227687 5227682 -
gacataatttattagcatgcat

SEQ ID NO: 143962 - DNA, 22 bp, Artificial Sequence
  Synthetic oligonucleotide; TTT chr11 5227672 5227693 5227677 5227672 -
attagcatgcatgagcaaatta

SEQ ID NO: 143963 - DNA, 22 bp, Artificial Sequence
  Synthetic oligonucleotide; TTA chr11 5227671 5227692 5227676 5227671 -
ttagcatgcatgagcaaattaa

SEQ ID NO: 143964 - DNA, 22 bp, Artificial Sequence
  Synthetic oligonucleotide; TTA chr11 5227668 5227689 5227673 5227668 -
gcatgcatgagcaaattaagaa

SEQ ID NO: 143965 - DNA, 22 bp, Artificial Sequence
  Synthetic oligonucleotide; TTA chr11 5227650 5227671 5227655 5227650 -
agaaaaacaacaacaaatgaat

SEQ ID NO: 143966 - DNA, 22 bp, Artificial Sequence
  Synthetic oligonucleotide; TTT chr11 5227574 5227595 5227579 5227574 -
tttcttttcttaccagaaggtt

SEQ ID NO: 143967 - DNA, 22 bp, Artificial Sequence
  Synthetic oligonucleotide; TTT chr11 5227573 5227594 5227578 5227573 -
ttcttttcttaccagaaggttt

SEQ ID NO: 143968 - DNA, 22 bp, Artificial Sequence
  Synthetic oligonucleotide; TTT chr11 5227572 5227593 5227577 5227572 -
tcttttcttaccagaaggtttt

SEQ ID NO: 143969 - DNA, 22 bp, Artificial Sequence
  Synthetic oligonucleotide; TTT chr11 5227571 5227592 5227576 5227571 -
cttttcttaccagaaggtttta

SEQ ID NO: 143970 - DNA, 22 bp, Artificial Sequence
  Synthetic oligonucleotide; TTC chr11 5227570 5227591 5227575 5227570 -
ttttcttaccagaaggttttaa

SEQ ID NO: 143971 - DNA, 22 bp, Artificial Sequence
  Synthetic oligonucleotide; CTT chr11 5227568 5227589 5227573 5227568 -
ttcttaccagaaggttttaatc

SEQ ID NO: 143972 - DNA, 22 bp, Artificial Sequence
  Synthetic oligonucleotide; TTT chr11 5227567 5227588 5227572 5227567 -
tcttaccagaaggttttaatcc

SEQ ID NO: 143973 - DNA, 22 bp, Artificial Sequence
  Synthetic oligonucleotide; TTT chr11 5227566 5227587 5227571 5227566 -
cttaccagaaggttttaatcca

SEQ ID NO: 143974 - DNA, 22 bp, Artificial Sequence
  Synthetic oligonucleotide; TTC chr11 5227565 5227586 5227570 5227565 -
ttaccagaaggttttaatccaa

SEQ ID NO: 143975 - DNA, 22 bp, Artificial Sequence
  Synthetic oligonucleotide; CTT chr11 5227563 5227584 5227568 5227563 -
accagaaggttttaatccaaat

SEQ ID NO: 143976 - DNA, 22 bp, Artificial Sequence
  Synthetic oligonucleotide; TTA chr11 5227562 5227583 5227567 5227562 -
ccagaaggttttaatccaaata

SEQ ID NO: 143977 - DNA, 22 bp, Artificial Sequence
  Synthetic oligonucleotide; TTT chr11 5227551 5227572 5227556 5227551 -
taatccaaataaggagaagata

SEQ ID NO: 143978 - DNA, 22 bp, Artificial Sequence
  Synthetic oligonucleotide; TTT chr11 5227550 5227571 5227555 5227550 -
aatccaaataaggagaagatat

SEQ ID NO: 143979 - DNA, 22 bp, Artificial Sequence
  Synthetic oligonucleotide; TTA chr11 5227549 5227570 5227554 5227549 -
atccaaataaggagaagatatg

SEQ ID NO: 143980 - DNA, 22 bp, Artificial Sequence
  Synthetic oligonucleotide; CTT chr11 5227524 5227545 5227529 5227524 -
agaaccgaggtagagttttcat

SEQ ID NO: 143981 - DNA, 22 bp, Artificial Sequence
  Synthetic oligonucleotide; TTA chr11 5227523 5227544 5227528 5227523 -
gaaccgaggtagagttttcatc

SEQ ID NO: 143982 - DNA, 22 bp, Artificial Sequence
  Synthetic oligonucleotide; TTT chr11 5227506 5227527 5227511 5227506 -
tcatccattctgtcctgtaagt

SEQ ID NO: 143983 - DNA, 22 bp, Artificial Sequence
  Synthetic oligonucleotide; TTT chr11 5227505 5227526 5227510 5227505 -
catccattctgtcctgtaagta

SEQ ID NO: 143984 - DNA, 22 bp, Artificial Sequence
  Synthetic oligonucleotide; TTC chr11 5227504 5227525 5227509 5227504 -
atccattctgtcctgtaagtat

SEQ ID NO: 143985 - DNA, 22 bp, Artificial Sequence
  Synthetic oligonucleotide; TTC chr11 5227496 5227517 5227501 5227496 -
tgtcctgtaagtattttgcata

SEQ ID NO: 143986 - DNA, 22 bp, Artificial Sequence
  Synthetic oligonucleotide; CTG chr11 5227494 5227515 5227499 5227494 -
tcctgtaagtattttgcatatt

SEQ ID NO: 143987 - DNA, 22 bp, Artificial Sequence
  Synthetic oligonucleotide; CTG chr11 5227489 5227510 5227494 5227489 -
taagtattttgcatattctgga

SEQ ID NO: 143988 - DNA, 22 bp, Artificial Sequence
  Synthetic oligonucleotide; TTT chr11 5227480 5227501 5227485 5227480 -
tgcatattctggagacgcagga

SEQ ID NO: 143989 - DNA, 22 bp, Artificial Sequence
  Synthetic oligonucleotide; TTT chr11 5227479 5227500 5227484 5227479 -
gcatattctggagacgcaggaa

SEQ ID NO: 143990 - DNA, 22 bp, Artificial Sequence
  Synthetic oligonucleotide; TTG chr11 5227478 5227499 5227483 5227478 -
catattctggagacgcaggaag

SEQ ID NO: 143991 - DNA, 22 bp, Artificial Sequence
  Synthetic oligonucleotide; TTC chr11 5227471 5227492 5227476 5227471 -
tggagacgcaggaagagatcca

SEQ ID NO: 143992 - DNA, 22 bp, Artificial Sequence
  Synthetic oligonucleotide; CTG chr11 5227469 5227490 5227474 5227469 -
gagacgcaggaagagatccatc

SEQ ID NO: 143993 - DNA, 22 bp, Artificial Sequence
  Synthetic oligonucleotide; CTA chr11 5227445 5227466 5227450 5227445 -
catatcccaaagctgaattatg

SEQ ID NO: 143994 - DNA, 22 bp, Artificial Sequence
  Synthetic oligonucleotide; CTG chr11 5227430 5227451 5227435 5227430 -
aattatggtagacaaaactctt

SEQ ID NO: 143995 - DNA, 22 bp, Artificial Sequence
  Synthetic oligonucleotide; TTA chr11 5227425 5227446 5227430 5227425 -
tggtagacaaaactcttccact

SEQ ID NO: 143996 - DNA, 22 bp, Artificial Sequence
  Synthetic oligonucleotide; CTC chr11 5227410 5227431 5227415 5227410 -
ttccacttttagtgcatcaact

SEQ ID NO: 143997 - DNA, 22 bp, Artificial Sequence
  Synthetic oligonucleotide; CTT chr11 5227408 5227429 5227413 5227408 -
ccacttttagtgcatcaacttc

SEQ ID NO: 143998 - DNA, 22 bp, Artificial Sequence
  Synthetic oligonucleotide; TTC chr11 5227407 5227428 5227412 5227407 -
cacttttagtgcatcaacttct

SEQ ID NO: 143999 - DNA, 22 bp, Artificial Sequence
  Synthetic oligonucleotide; CTT chr11 5227402 5227423 5227407 5227402 -
ttagtgcatcaacttcttattt

SEQ ID NO: 144000 - DNA, 22 bp, Artificial Sequence
  Synthetic oligonucleotide; TTT chr11 5227401 5227422 5227406 5227401 -
tagtgcatcaacttcttatttg

SEQ ID NO: 144001 - DNA, 22 bp, Artificial Sequence
  Synthetic oligonucleotide; TTT chr11 5227400 5227421 5227405 5227400 -
agtgcatcaacttcttatttgt

SEQ ID NO: 144002 - DNA, 22 bp, Artificial Sequence
  Synthetic oligonucleotide; TTA chr11 5227399 5227420 5227404 5227399 -
gtgcatcaacttcttatttgtg

SEQ ID NO: 144003 - DNA, 22 bp, Artificial Sequence
  Synthetic oligonucleotide; CTT chr11 5227387 5227408 5227392 5227387 -
cttatttgtgtaataagaaaat

SEQ ID NO: 144004 - DNA, 22 bp, Artificial Sequence
  Synthetic oligonucleotide; TTC chr11 5227386 5227407 5227391 5227386 -
ttatttgtgtaataagaaaatt

SEQ ID NO: 144005 - DNA, 22 bp, Artificial Sequence
  Synthetic oligonucleotide; CTT chr11 5227384 5227405 5227389 5227384 -
atttgtgtaataagaaaattgg

SEQ ID NO: 144006 - DNA, 22 bp, Artificial Sequence
  Synthetic oligonucleotide; TTA chr11 5227383 5227404 5227388 5227383 -
tttgtgtaataagaaaattggg

SEQ ID NO: 144007 - DNA, 22 bp, Artificial Sequence
  Synthetic oligonucleotide; TTT chr11 5227380 5227401 5227385 5227380 -
gtgtaataagaaaattgggaaa

SEQ ID NO: 144008 - DNA, 22 bp, Artificial Sequence
  Synthetic oligonucleotide; TTG chr11 5227379 5227400 5227384 5227379 -
tgtaataagaaaattgggaaaa

SEQ ID NO: 144009 - DNA, 22 bp, Artificial Sequence
  Synthetic oligonucleotide; TTG chr11 5227363 5227384 5227368 5227363 -
ggaaaacgatcttcaatatgct

SEQ ID NO: 144010 - DNA, 22 bp, Artificial Sequence
  Synthetic oligonucleotide; CTT chr11 5227350 5227371 5227355 5227350 -
caatatgcttaccaagctgtga

SEQ ID NO: 144011 - DNA, 22 bp, Artificial Sequence
  Synthetic oligonucleotide; TTC chr11 5227349 5227370 5227354 5227349 -
aatatgcttaccaagctgtgat

SEQ ID NO: 144012 - DNA, 22 bp, Artificial Sequence
  Synthetic oligonucleotide; CTT chr11 5227340 5227361 5227345 5227340 -
accaagctgtgattccaaatat

SEQ ID NO: 144013 - DNA, 22 bp, Artificial Sequence
  Synthetic oligonucleotide; TTA chr11 5227339 5227360 5227344 5227339 -
ccaagctgtgattccaaatatt

SEQ ID NO: 144014 - DNA, 22 bp, Artificial Sequence
  Synthetic oligonucleotide; CTG chr11 5227331 5227352 5227336 5227331 -
tgattccaaatattacgtaaat

SEQ ID NO: 144015 - DNA, 22 bp, Artificial Sequence
  Synthetic oligonucleotide; TTC chr11 5227325 5227346 5227330 5227325 -
caaatattacgtaaatacactt

SEQ ID NO: 144016 - DNA, 22 bp, Artificial Sequence
  Synthetic oligonucleotide; TTA chr11 5227316 5227337 5227321 5227316 -
cgtaaatacacttgcaaaggag

SEQ ID NO: 144017 - DNA, 22 bp, Artificial Sequence
  Synthetic oligonucleotide; CTT chr11 5227303 5227324 5227308 5227303 -
gcaaaggaggatgtttttagta

SEQ ID NO: 144018 - DNA, 22 bp, Artificial Sequence
  Synthetic oligonucleotide; TTG chr11 5227302 5227323 5227307 5227302 -
caaaggaggatgtttttagtag

SEQ ID NO: 144019 - DNA, 22 bp, Artificial Sequence
  Synthetic oligonucleotide; TTT chr11 5227287 5227308 5227292 5227287 -
ttagtagcaatttgtactgatg

SEQ ID NO: 144020 - DNA, 22 bp, Artificial Sequence
  Synthetic oligonucleotide; TTT chr11 5227286 5227307 5227291 5227286 -
tagtagcaatttgtactgatgg

SEQ ID NO: 144021 - DNA, 22 bp, Artificial Sequence
  Synthetic oligonucleotide; TTT chr11 5227285 5227306 5227290 5227285 -
agtagcaatttgtactgatggt

SEQ ID NO: 144022 - DNA, 22 bp, Artificial Sequence
  Synthetic oligonucleotide; TTA chr11 5227284 5227305 5227289 5227284 -
gtagcaatttgtactgatggta

SEQ ID NO: 144023 - DNA, 22 bp, Artificial Sequence
  Synthetic oligonucleotide; TTT chr11 5227274 5227295 5227279 5227274 -
gtactgatggtatggggccaag

SEQ ID NO: 144024 - DNA, 22 bp, Artificial Sequence
  Synthetic oligonucleotide; TTG chr11 5227273 5227294 5227278 5227273 -
tactgatggtatggggccaaga

SEQ ID NO: 144025 - DNA, 22 bp, Artificial Sequence
  Synthetic oligonucleotide; CTG chr11 5227268 5227289 5227273 5227268 -
atggtatggggccaagagatat

SEQ ID NO: 144026 - DNA, 22 bp, Artificial Sequence
  Synthetic oligonucleotide; CTT chr11 5227241 5227262 5227246 5227241 -
agagggagggctgagggtttga

SEQ ID NO: 144027 - DNA, 22 bp, Artificial Sequence
  Synthetic oligonucleotide; TTA chr11 5227240 5227261 5227245 5227240 -
gagggagggctgagggtttgaa

SEQ ID NO: 144028 - DNA, 22 bp, Artificial Sequence
  Synthetic oligonucleotide; CTG chr11 5227228 5227249 5227233 5227228 -
agggtttgaagtccaactccta

SEQ ID NO: 144029 - DNA, 22 bp, Artificial Sequence
  Synthetic oligonucleotide; TTT chr11 5227221 5227242 5227226 5227221 -
gaagtccaactcctaagccagt

SEQ ID NO: 144030 - DNA, 22 bp, Artificial Sequence
  Synthetic oligonucleotide; TTG chr11 5227220 5227241 5227225 5227220 -
aagtccaactcctaagccagtg

SEQ ID NO: 144031 - DNA, 22 bp, Artificial Sequence
  Synthetic oligonucleotide; CTC chr11 5227209 5227230 5227214 5227209 -
ctaagccagtgccagaagagcc

SEQ ID NO: 144032 - DNA, 22 bp, Artificial Sequence
  Synthetic oligonucleotide; CTA chr11 5227206 5227227 5227211 5227206 -
agccagtgccagaagagccaag

SEQ ID NO: 144033 - DNA, 22 bp, Artificial Sequence
  Synthetic oligonucleotide; CTG chr11 5227170 5227191 5227175 5227170 -
tcatcacttagacctcaccctg

SEQ ID NO: 144034 - DNA, 22 bp, Artificial Sequence
  Synthetic oligonucleotide; CTT chr11 5227161 5227182 5227166 5227161 -
agacctcaccctgtggagccac

SEQ ID NO: 144035 - DNA, 22 bp, Artificial Sequence
  Synthetic oligonucleotide; TTA chr11 5227160 5227181 5227165 5227160 -
gacctcaccctgtggagccaca

SEQ ID NO: 144036 - DNA, 22 bp, Artificial Sequence
  Synthetic oligonucleotide; CTC chr11 5227154 5227175 5227159 5227154 -
accctgtggagccacaccctag

SEQ ID NO: 144037 - DNA, 22 bp, Artificial Sequence
  Synthetic oligonucleotide; CTG chr11 5227148 5227169 5227153 5227148 -
tggagccacaccctagggttgg

SEQ ID NO: 144038 - DNA, 22 bp, Artificial Sequence
  Synthetic oligonucleotide; CTA chr11 5227133 5227154 5227138 5227133 -
gggttggccaatctactcccag

SEQ ID NO: 144039 - DNA, 22 bp, Artificial Sequence
  Synthetic oligonucleotide; TTG chr11 5227127 5227148 5227132 5227127 -
gccaatctactcccaggagcag

SEQ ID NO: 144040 - DNA, 22 bp, Artificial Sequence
  Synthetic oligonucleotide; CTA chr11 5227118 5227139 5227123 5227118 -
ctcccaggagcagggagggcag

SEQ ID NO: 144041 - DNA, 22 bp, Artificial Sequence
  Synthetic oligonucleotide; CTC chr11 5227115 5227136 5227120 5227115 -
ccaggagcagggagggcaggag

SEQ ID NO: 144042 - DNA, 22 bp, Artificial Sequence
  Synthetic oligonucleotide; CTG chr11 5227084 5227105 5227089 5227084 -
ggcataaaagtcagggcagagc

SEQ ID NO: 144043 - DNA, 22 bp, Artificial Sequence
  Synthetic oligonucleotide; CTA chr11 5227056 5227077 5227061 5227056 -
ttgcttacatttgcttctgaca

SEQ ID NO: 144044 - DNA, 22 bp, Artificial Sequence
  Synthetic oligonucleotide; TTG chr11 5227053 5227074 5227058 5227053 -
cttacatttgcttctgacacaa

SEQ ID NO: 144045 - DNA, 22 bp, Artificial Sequence
  Synthetic oligonucleotide; CTT chr11 5227050 5227071 5227055 5227050 -
acatttgcttctgacacaactg

SEQ ID NO: 144046 - DNA, 22 bp, Artificial Sequence
  Synthetic oligonucleotide; TTA chr11 5227049 5227070 5227054 5227049 -
catttgcttctgacacaactgt

SEQ ID NO: 144047 - DNA, 22 bp, Artificial Sequence
  Synthetic oligonucleotide; TTT chr11 5227044 5227065 5227049 5227044 -
gcttctgacacaactgtgttca

SEQ ID NO: 144048 - DNA, 22 bp, Artificial Sequence
  Synthetic oligonucleotide; TTG chr11 5227043 5227064 5227048 5227043 -
cttctgacacaactgtgttcac

SEQ ID NO: 144049 - DNA, 22 bp, Artificial Sequence
  Synthetic oligonucleotide; CTT chr11 5227040 5227061 5227045 5227040 -
ctgacacaactgtgttcactag

SEQ ID NO: 144050 - DNA, 22 bp, Artificial Sequence
  Synthetic oligonucleotide; TTC chr11 5227039 5227060 5227044 5227039 -
tgacacaactgtgttcactagc

SEQ ID NO: 144051 - DNA, 22 bp, Artificial Sequence
  Synthetic oligonucleotide; CTG chr11 5227037 5227058 5227042 5227037 -
acacaactgtgttcactagcaa

SEQ ID NO: 144052 - DNA, 22 bp, Artificial Sequence
  Synthetic oligonucleotide; CTG chr11 5227028 5227049 5227033 5227028 -
tgttcactagcaacctcaaaca

SEQ ID NO: 144053 - DNA, 22 bp, Artificial Sequence
  Synthetic oligonucleotide; TTC chr11 5227023 5227044 5227028 5227023 -
actagcaacctcaaacagacac

SEQ ID NO: 144054 - DNA, 22 bp, Artificial Sequence
  Synthetic oligonucleotide; CTA chr11 5227019 5227040 5227024 5227019 -
gcaacctcaaacagacaccatg

SEQ ID NO: 144055 - DNA, 22 bp, Artificial Sequence
  Synthetic oligonucleotide; CTC chr11 5227011 5227032 5227016 5227011 -
aaacagacaccatggtgcatct

SEQ ID NO: 144056 - DNA, 22 bp, Artificial Sequence
  Synthetic oligonucleotide; CTG chr11 5226988 5227009 5226993 5226988 -
actcctgaggagaagtctgccg

SEQ ID NO: 144057 - DNA, 22 bp, Artificial Sequence
  Synthetic oligonucleotide; CTC chr11 5226984 5227005 5226989 5226984 -
ctgaggagaagtctgccgttac

SEQ ID NO: 144058 - DNA, 22 bp, Artificial Sequence
  Synthetic oligonucleotide; CTG chr11 5226981 5227002 5226986 5226981 -
aggagaagtctgccgttactgc

SEQ ID NO: 144059 - DNA, 22 bp, Artificial Sequence
  Synthetic oligonucleotide; CTG chr11 5226969 5226990 5226974 5226969 -
ccgttactgccctgtggggcaa

SEQ ID NO: 144060 - DNA, 22 bp, Artificial Sequence
  Synthetic oligonucleotide; TTA chr11 5226963 5226984 5226968 5226963 -
ctgccctgtggggcaaggtgaa

SEQ ID NO: 144061 - DNA, 22 bp, Artificial Sequence
  Synthetic oligonucleotide; CTG chr11 5226960 5226981 5226965 5226960 -
ccctgtggggcaaggtgaacgt

SEQ ID NO: 144062 - DNA, 22 bp, Artificial Sequence
  Synthetic oligonucleotide; CTG chr11 5226955 5226976 5226960 5226955 -
tggggcaaggtgaacgtggatg

SEQ ID NO: 144063 - DNA, 22 bp, Artificial Sequence
  Synthetic oligonucleotide; TTG chr11 5226927 5226948 5226932 5226927 -
gtggtgaggccctgggcaggtt

SEQ ID NO: 144064 - DNA, 22 bp, Artificial Sequence
  Synthetic oligonucleotide; CTG chr11 5226913 5226934 5226918 5226913 -
ggcaggttggtatcaaggttac

SEQ ID NO: 144065 - DNA, 22 bp, Artificial Sequence
  Synthetic oligonucleotide; TTG chr11 5226904 5226925 5226909 5226904 -
gtatcaaggttacaagacaggt

SEQ ID NO: 144066 - DNA, 22 bp, Artificial Sequence
  Synthetic oligonucleotide; TTA chr11 5226892 5226913 5226897 5226892 -
caagacaggtttaaggagacca

SEQ ID NO: 144067 - DNA, 22 bp, Artificial Sequence
  Synthetic oligonucleotide; TTT chr11 5226880 5226901 5226885 5226880 -
aaggagaccaatagaaactggg

SEQ ID NO: 144068 - DNA, 22 bp, Artificial Sequence
  Synthetic oligonucleotide; TTA chr11 5226879 5226900 5226884 5226879 -
aggagaccaatagaaactgggc

SEQ ID NO: 144069 - DNA, 22 bp, Artificial Sequence
  Synthetic oligonucleotide; CTG chr11 5226860 5226881 5226865 5226860 -
ggcatgtggagacagagaagac

SEQ ID NO: 144070 - DNA, 22 bp, Artificial Sequence
  Synthetic oligonucleotide; CTC chr11 5226836 5226857 5226841 5226836 -
ttgggtttctgataggcactga

SEQ ID NO: 144071 - DNA, 22 bp, Artificial Sequence
  Synthetic oligonucleotide; CTT chr11 5226834 5226855 5226839 5226834 -
gggtttctgataggcactgact

SEQ ID NO: 144072 - DNA, 22 bp, Artificial Sequence
  Synthetic oligonucleotide; TTG chr11 5226833 5226854 5226838 5226833 -
ggtttctgataggcactgactc

SEQ ID NO: 144073 - DNA, 22 bp, Artificial Sequence
  Synthetic oligonucleotide; TTT chr11 5226828 5226849 5226833 5226828 -
ctgataggcactgactctctct

SEQ ID NO: 144074 - DNA, 22 bp, Artificial Sequence
  Synthetic oligonucleotide; TTC chr11 5226827 5226848 5226832 5226827 -
tgataggcactgactctctctg

SEQ ID NO: 144075 - DNA, 22 bp, Artificial Sequence
  Synthetic oligonucleotide; CTG chr11 5226825 5226846 5226830 5226825 -
ataggcactgactctctctgcc

SEQ ID NO: 144076 - DNA, 22 bp, Artificial Sequence
  Synthetic oligonucleotide; CTG chr11 5226815 5226836 5226820 5226815 -
actctctctgcctattggtcta

SEQ ID NO: 144077 - DNA, 22 bp, Artificial Sequence
  Synthetic oligonucleotide; CTC chr11 5226811 5226832 5226816 5226811 -
tctctgcctattggtctatttt

SEQ ID NO: 144078 - DNA, 22 bp, Artificial Sequence
  Synthetic oligonucleotide; CTC chr11 5226809 5226830 5226814 5226809 -
tctgcctattggtctattttcc

SEQ ID NO: 144079 - DNA, 22 bp, Artificial Sequence
  Synthetic oligonucleotide; CTC chr11 5226807 5226828 5226812 5226807 -
tgcctattggtctattttccca

SEQ ID NO: 144080 - DNA, 22 bp, Artificial Sequence
  Synthetic oligonucleotide; CTG chr11 5226805 5226826 5226810 5226805 -
cctattggtctattttcccacc

SEQ ID NO: 144081 - DNA, 22 bp, Artificial Sequence
  Synthetic oligonucleotide; CTA chr11 5226801 5226822 5226806 5226801 -
ttggtctattttcccaccctta

SEQ ID NO: 144082 - DNA, 22 bp, Artificial Sequence
  Synthetic oligonucleotide; TTG chr11 5226798 5226819 5226803 5226798 -
gtctattttcccacccttaggc

SEQ ID NO: 144083 - DNA, 22 bp, Artificial Sequence
  Synthetic oligonucleotide; CTA chr11 5226793 5226814 5226798 5226793 -
ttttcccacccttaggctgctg

SEQ ID NO: 144084 - DNA, 22 bp, Artificial Sequence
  Synthetic oligonucleotide; TTT chr11 5226790 5226811 5226795 5226790 -
tcccacccttaggctgctggtg

SEQ ID NO: 144085 - DNA, 22 bp, Artificial Sequence
  Synthetic oligonucleotide; TTT chr11 5226789 5226810 5226794 5226789 -
cccacccttaggctgctggtgg

SEQ ID NO: 144086 - DNA, 22 bp, Artificial Sequence
  Synthetic oligonucleotide; TTC chr11 5226788 5226809 5226793 5226788 -
ccacccttaggctgctggtggt

SEQ ID NO: 144087 - DNA, 22 bp, Artificial Sequence
  Synthetic oligonucleotide; CTT chr11 5226780 5226801 5226785 5226780 -
aggctgctggtggtctaccctt

SEQ ID NO: 144088 - DNA, 22 bp, Artificial Sequence
  Synthetic oligonucleotide; TTA chr11 5226779 5226800 5226784 5226779 -
ggctgctggtggtctacccttg

SEQ ID NO: 144089 - DNA, 22 bp, Artificial Sequence
  Synthetic oligonucleotide; CTG chr11 5226774 5226795 5226779 5226774 -
ctggtggtctacccttggaccc

SEQ ID NO: 144090 - DNA, 22 bp, Artificial Sequence
  Synthetic oligonucleotide; CTG chr11 5226771 5226792 5226776 5226771 -
gtggtctacccttggacccaga

SEQ ID NO: 144091 - DNA, 22 bp, Artificial Sequence
  Synthetic oligonucleotide; CTA chr11 5226763 5226784 5226768 5226763 -
cccttggacccagaggttcttt

SEQ ID NO: 144092 - DNA, 22 bp, Artificial Sequence
  Synthetic oligonucleotide; CTT chr11 5226758 5226779 5226763 5226758 -
ggacccagaggttctttgagtc

SEQ ID NO: 144093 - DNA, 22 bp, Artificial Sequence
  Synthetic oligonucleotide; TTG chr11 5226757 5226778 5226762 5226757 -
gacccagaggttctttgagtcc

SEQ ID NO: 144094 - DNA, 22 bp, Artificial Sequence
  Synthetic oligonucleotide; TTC chr11 5226744 5226765 5226749 5226744 -
tttgagtcctttggggatctgt

SEQ ID NO: 144095 - DNA, 22 bp, Artificial Sequence
  Synthetic oligonucleotide; CTT chr11 5226742 5226763 5226747 5226742 -
tgagtcctttggggatctgtcc

SEQ ID NO: 144096 - DNA, 22 bp, Artificial Sequence
  Synthetic oligonucleotide; TTT chr11 5226741 5226762 5226746 5226741 -
gagtcctttggggatctgtcca

SEQ ID NO: 144097 - DNA, 22 bp, Artificial Sequence
  Synthetic oligonucleotide; TTG chr11 5226740 5226761 5226745 5226740 -
agtcctttggggatctgtccac

SEQ ID NO: 144098 - DNA, 22 bp, Artificial Sequence
  Synthetic oligonucleotide; CTT chr11 5226733 5226754 5226738 5226733 -
tggggatctgtccactcctgat

SEQ ID NO: 144099 - DNA, 22 bp, Artificial Sequence
  Synthetic oligonucleotide; TTT chr11 5226732 5226753 5226737 5226732 -
ggggatctgtccactcctgatg

SEQ ID NO: 144100 - DNA, 22 bp, Artificial Sequence
  Synthetic oligonucleotide; TTG chr11 5226731 5226752 5226736 5226731 -
gggatctgtccactcctgatgc

SEQ ID NO: 144101 - DNA, 22 bp, Artificial Sequence
  Synthetic oligonucleotide; CTG chr11 5226723 5226744 5226728 5226723 -
tccactcctgatgctgttatgg

SEQ ID NO: 144102 - DNA, 22 bp, Artificial Sequence
  Synthetic oligonucleotide; CTC chr11 5226716 5226737 5226721 5226716 -
ctgatgctgttatgggcaaccc

SEQ ID NO: 144103 - DNA, 22 bp, Artificial Sequence
  Synthetic oligonucleotide; CTG chr11 5226713 5226734 5226718 5226713 -
atgctgttatgggcaaccctaa

SEQ ID NO: 144104 - DNA, 22 bp, Artificial Sequence
  Synthetic oligonucleotide; CTG chr11 5226707 5226728 5226712 5226707 -
ttatgggcaaccctaaggtgaa

SEQ ID NO: 144105 - DNA, 22 bp, Artificial Sequence
  Synthetic oligonucleotide; TTA chr11 5226704 5226725 5226709 5226704 -
tgggcaaccctaaggtgaaggc

SEQ ID NO: 144106 - DNA, 22 bp, Artificial Sequence
  Synthetic oligonucleotide; CTA chr11 5226692 5226713 5226697 5226692 -
aggtgaaggctcatggcaagaa

SEQ ID NO: 144107 - DNA, 22 bp, Artificial Sequence
  Synthetic oligonucleotide; CTC chr11 5226680 5226701 5226685 5226680 -
atggcaagaaagtgctcggtgc

SEQ ID NO: 144108 - DNA, 22 bp, Artificial Sequence
  Synthetic oligonucleotide; CTC chr11 5226663 5226684 5226668 5226663 -
ggtgcctttagtgatggcctgg

SEQ ID NO: 144109 - DNA, 22 bp, Artificial Sequence
  Synthetic oligonucleotide; CTT chr11 5226655 5226676 5226660 5226655 -
tagtgatggcctggctcacctg

SEQ ID NO: 144110 - DNA, 22 bp, Artificial Sequence
  Synthetic oligonucleotide; TTT chr11 5226654 5226675 5226659 5226654 -
agtgatggcctggctcacctgg

SEQ ID NO: 144111 - DNA, 22 bp, Artificial Sequence
  Synthetic oligonucleotide; TTA chr11 5226653 5226674 5226658 5226653 -
gtgatggcctggctcacctgga

SEQ ID NO: 144112 - DNA, 22 bp, Artificial Sequence
  Synthetic oligonucleotide; CTG chr11 5226642 5226663 5226647 5226642 -
gctcacctggacaacctcaagg

SEQ ID NO: 144113 - DNA, 22 bp, Artificial Sequence
  Synthetic oligonucleotide; CTC chr11 5226638 5226659 5226643 5226638 -
acctggacaacctcaagggcac

SEQ ID NO: 144114 - DNA, 22 bp, Artificial Sequence
  Synthetic oligonucleotide; CTG chr11 5226633 5226654 5226638 5226633 -
gacaacctcaagggcacctttg

SEQ ID NO: 144115 - DNA, 22 bp, Artificial Sequence
  Synthetic oligonucleotide; CTC chr11 5226624 5226645 5226629 5226624 -
aagggcacctttgccacactga

SEQ ID NO: 144116 - DNA, 22 bp, Artificial Sequence
  Synthetic oligonucleotide; CTT chr11 5226613 5226634 5226618 5226613 -
tgccacactgagtgagctgcac

SEQ ID NO: 144117 - DNA, 22 bp, Artificial Sequence
  Synthetic oligonucleotide; TTT chr11 5226612 5226633 5226617 5226612 -
gccacactgagtgagctgcact

SEQ ID NO: 144118 - DNA, 22 bp, Artificial Sequence
  Synthetic oligonucleotide; TTG chr11 5226611 5226632 5226616 5226611 -
ccacactgagtgagctgcactg

SEQ ID NO: 144119 - DNA, 22 bp, Artificial Sequence
  Synthetic oligonucleotide; CTG chr11 5226603 5226624 5226608 5226603 -
agtgagctgcactgtgacaagc

SEQ ID NO: 144120 - DNA, 22 bp, Artificial Sequence
  Synthetic oligonucleotide; CTG chr11 5226594 5226615 5226599 5226594 -
cactgtgacaagctgcacgtgg

SEQ ID NO: 144121 - DNA, 22 bp, Artificial Sequence
  Synthetic oligonucleotide; CTG chr11 5226589 5226610 5226594 5226589 -
tgacaagctgcacgtggatcct

SEQ ID NO: 144122 - DNA, 22 bp, Artificial Sequence
  Synthetic oligonucleotide; CTG chr11 5226579 5226600 5226584 5226579 -
cacgtggatcctgagaacttca

SEQ ID NO: 144123 - DNA, 22 bp, Artificial Sequence
  Synthetic oligonucleotide; CTG chr11 5226566 5226587 5226571 5226566 -
agaacttcagggtgagtctatg

SEQ ID NO: 144124 - DNA, 22 bp, Artificial Sequence
  Synthetic oligonucleotide; CTT chr11 5226559 5226580 5226564 5226559 -
cagggtgagtctatgggacgct

SEQ ID NO: 144125 - DNA, 22 bp, Artificial Sequence
  Synthetic oligonucleotide; TTC chr11 5226558 5226579 5226563 5226558 -
agggtgagtctatgggacgctt

SEQ ID NO: 144126 - DNA, 22 bp, Artificial Sequence
  Synthetic oligonucleotide; CTA chr11 5226546 5226567 5226551 5226546 -
tgggacgcttgatgttttcttt

SEQ ID NO: 144127 - DNA, 22 bp, Artificial Sequence
  Synthetic oligonucleotide; CTT chr11 5226536 5226557 5226541 5226536 -
gatgttttctttccccttcttt

SEQ ID NO: 144128 - DNA, 22 bp, Artificial Sequence
  Synthetic oligonucleotide; TTG chr11 5226535 5226556 5226540 5226535 -
atgttttctttccccttctttt

SEQ ID NO: 144129 - DNA, 22 bp, Artificial Sequence
  Synthetic oligonucleotide; TTT chr11 5226529 5226550 5226534 5226529 -
tctttccccttcttttctatgg

SEQ ID NO: 144130 - DNA, 22 bp, Artificial Sequence
  Synthetic oligonucleotide; TTT chr11 5226528 5226549 5226533 5226528 -
ctttccccttcttttctatggt

SEQ ID NO: 144131 - DNA, 22 bp, Artificial Sequence
  Synthetic oligonucleotide; TTC chr11 5226527 5226548 5226532 5226527 -
tttccccttcttttctatggtt

SEQ ID NO: 144132 - DNA, 22 bp, Artificial Sequence
  Synthetic oligonucleotide; CTT chr11 5226525 5226546 5226530 5226525 -
tccccttcttttctatggttaa

SEQ ID NO: 144133 - DNA, 22 bp, Artificial Sequence
  Synthetic oligonucleotide; TTT chr11 5226524 5226545 5226529 5226524 -
ccccttcttttctatggttaag

SEQ ID NO: 144134 - DNA, 22 bp, Artificial Sequence
  Synthetic oligonucleotide; TTC chr11 5226523 5226544 5226528 5226523 -
cccttcttttctatggttaagt

SEQ ID NO: 144135 - DNA, 22 bp, Artificial Sequence
  Synthetic oligonucleotide; CTT chr11 5226518 5226539 5226523 5226518 -
cttttctatggttaagttcatg

SEQ ID NO: 144136 - DNA, 22 bp, Artificial Sequence
  Synthetic oligonucleotide; TTC chr11 5226517 5226538 5226522 5226517 -
ttttctatggttaagttcatgt

SEQ ID NO: 144137 - DNA, 22 bp, Artificial Sequence
  Synthetic oligonucleotide; CTT chr11 5226515 5226536 5226520 5226515 -
ttctatggttaagttcatgtca

SEQ ID NO: 144138 - DNA, 22 bp, Artificial Sequence
  Synthetic oligonucleotide; TTT chr11 5226514 5226535 5226519 5226514 -
tctatggttaagttcatgtcat

SEQ ID NO: 144139 - DNA, 22 bp, Artificial Sequence
  Synthetic oligonucleotide; TTT chr11 5226513 5226534 5226518 5226513 -
ctatggttaagttcatgtcata

SEQ ID NO: 144140 - DNA, 22 bp, Artificial Sequence
  Synthetic oligonucleotide; TTC chr11 5226512 5226533 5226517 5226512 -
tatggttaagttcatgtcatag

SEQ ID NO: 144141 - DNA, 22 bp, Artificial Sequence
  Synthetic oligonucleotide; CTA chr11 5226510 5226531 5226515 5226510 -
tggttaagttcatgtcatagga

SEQ ID NO: 144142 - DNA, 22 bp, Artificial Sequence
  Synthetic oligonucleotide; TTA chr11 5226504 5226525 5226509 5226504 -
agttcatgtcataggaagggga

SEQ ID NO: 144143 - DNA, 22 bp, Artificial Sequence
  Synthetic oligonucleotide; TTC chr11 5226499 5226520 5226504 5226499 -
atgtcataggaaggggataagt

SEQ ID NO: 144144 - DNA, 22 bp, Artificial Sequence
  Synthetic oligonucleotide; TTT chr11 5226462 5226483 5226467 5226462 -
agaatgggaaacagacgaatga

SEQ ID NO: 144145 - DNA, 22 bp, Artificial Sequence
  Synthetic oligonucleotide; TTA chr11 5226461 5226482 5226466 5226461 -
gaatgggaaacagacgaatgat

SEQ ID NO: 144146 - DNA, 22 bp, Artificial Sequence
  Synthetic oligonucleotide; TTG chr11 5226437 5226458 5226442 5226437 -
catcagtgtggaagtctcagga

SEQ ID NO: 144147 - DNA, 22 bp, Artificial Sequence
  Synthetic oligonucleotide; CTC chr11 5226419 5226440 5226424 5226419 -
aggatcgttttagtttctttta

SEQ ID NO: 144148 - DNA, 22 bp, Artificial Sequence
  Synthetic oligonucleotide; TTT chr11 5226409 5226430 5226414 5226409 -
tagtttcttttatttgctgttc

SEQ ID NO: 144149 - DNA, 22 bp, Artificial Sequence
  Synthetic oligonucleotide; TTT chr11 5226408 5226429 5226413 5226408 -
agtttcttttatttgctgttca

SEQ ID NO: 144150 - DNA, 22 bp, Artificial Sequence
  Synthetic oligonucleotide; TTA chr11 5226407 5226428 5226412 5226407 -
gtttcttttatttgctgttcat

SEQ ID NO: 144151 - DNA, 22 bp, Artificial Sequence
  Synthetic oligonucleotide; TTT chr11 5226403 5226424 5226408 5226403 -
cttttatttgctgttcataaca

SEQ ID NO: 144152 - DNA, 22 bp, Artificial Sequence
  Synthetic oligonucleotide; TTC chr11 5226402 5226423 5226407 5226402 -
ttttatttgctgttcataacaa

SEQ ID NO: 144153 - DNA, 22 bp, Artificial Sequence
  Synthetic oligonucleotide; CTT chr11 5226400 5226421 5226405 5226400 -
ttatttgctgttcataacaatt

SEQ ID NO: 144154 - DNA, 22 bp, Artificial Sequence
  Synthetic oligonucleotide; TTT chr11 5226399 5226420 5226404 5226399 -
tatttgctgttcataacaattg

SEQ ID NO: 144155 - DNA, 22 bp, Artificial Sequence
  Synthetic oligonucleotide; TTT chr11 5226398 5226419 5226403 5226398 -
atttgctgttcataacaattgt

SEQ ID NO: 144156 - DNA, 22 bp, Artificial Sequence
  Synthetic oligonucleotide; TTA chr11 5226397 5226418 5226402 5226397 -
tttgctgttcataacaattgtt

SEQ ID NO: 144157 - DNA, 22 bp, Artificial Sequence
  Synthetic oligonucleotide; TTT chr11 5226394 5226415 5226399 5226394 -
gctgttcataacaattgttttc

SEQ ID NO: 144158 - DNA, 22 bp, Artificial Sequence
  Synthetic oligonucleotide; TTG chr11 5226393 5226414 5226398 5226393 -
ctgttcataacaattgttttct

SEQ ID NO: 144159 - DNA, 22 bp, Artificial Sequence
  Synthetic oligonucleotide; CTG chr11 5226390 5226411 5226395 5226390 -
ttcataacaattgttttctttt

SEQ ID NO: 144160 - DNA, 22 bp, Artificial Sequence
  Synthetic oligonucleotide; TTC chr11 5226387 5226408 5226392 5226387 -
ataacaattgttttcttttgtt

SEQ ID NO: 144161 - DNA, 22 bp, Artificial Sequence
  Synthetic oligonucleotide; TTG chr11 5226377 5226398 5226382 5226377 -
ttttcttttgtttaattcttgc

SEQ ID NO: 144162 - DNA, 22 bp, Artificial Sequence
  Synthetic oligonucleotide; TTT chr11 5226374 5226395 5226379 5226374 -
tcttttgtttaattcttgcttt

SEQ ID NO: 144163 - DNA, 22 bp, Artificial Sequence
  Synthetic oligonucleotide; TTT chr11 5226373 5226394 5226378 5226373 -
cttttgtttaattcttgctttc

SEQ ID NO: 144164 - DNA, 22 bp, Artificial Sequence
  Synthetic oligonucleotide; TTC chr11 5226372 5226393 5226377 5226372 -
ttttgtttaattcttgctttct

SEQ ID NO: 144165 - DNA, 22 bp, Artificial Sequence
  Synthetic oligonucleotide; CTT chr11 5226370 5226391 5226375 5226370 -
ttgtttaattcttgctttcttt

SEQ ID NO: 144166 - DNA, 22 bp, Artificial Sequence
  Synthetic oligonucleotide; TTT chr11 5226369 5226390 5226374 5226369 -
tgtttaattcttgctttctttt

SEQ ID NO: 144167 - DNA, 22 bp, Artificial Sequence
  Synthetic oligonucleotide; TTT chr11 5226368 5226389 5226373 5226368 -
gtttaattcttgctttcttttt

SEQ ID NO: 144168 - DNA, 22 bp, Artificial Sequence
  Synthetic oligonucleotide; TTG chr11 5226367 5226388 5226372 5226367 -
tttaattcttgctttctttttt

SEQ ID NO: 144169 - DNA, 22 bp, Artificial Sequence
  Synthetic oligonucleotide; TTT chr11 5226364 5226385 5226369 5226364 -
aattcttgctttcttttttttt

SEQ ID NO: 144170 - DNA, 22 bp, Artificial Sequence
  Synthetic oligonucleotide; TTA chr11 5226363 5226384 5226368 5226363 -
attcttgctttctttttttttc

SEQ ID NO: 144171 - DNA, 22 bp, Artificial Sequence
  Synthetic oligonucleotide; TTC chr11 5226359 5226380 5226364 5226359 -
ttgctttctttttttttcttct

SEQ ID NO: 144172 - DNA, 22 bp, Artificial Sequence
  Synthetic oligonucleotide; CTT chr11 5226357 5226378 5226362 5226357 -
gctttctttttttttcttctcc

SEQ ID NO: 144173 - DNA, 22 bp, Artificial Sequence
  Synthetic oligonucleotide; TTG chr11 5226356 5226377 5226361 5226356 -
ctttctttttttttcttctccg

SEQ ID NO: 144174 - DNA, 22 bp, Artificial Sequence
  Synthetic oligonucleotide; CTT chr11 5226353 5226374 5226358 5226353 -
tctttttttttcttctccgcaa

SEQ ID NO: 144175 - DNA, 22 bp, Artificial Sequence
  Synthetic oligonucleotide; TTT chr11 5226352 5226373 5226357 5226352 -
ctttttttttcttctccgcaat

SEQ ID NO: 144176 - DNA, 22 bp, Artificial Sequence
  Synthetic oligonucleotide; TTC chr11 5226351 5226372 5226356 5226351 -
tttttttttcttctccgcaatt

SEQ ID NO: 144177 - DNA, 22 bp, Artificial Sequence
  Synthetic oligonucleotide; CTT chr11 5226349 5226370 5226354 5226349 -
tttttttcttctccgcaatttt

SEQ ID NO: 144178 - DNA, 22 bp, Artificial Sequence
  Synthetic oligonucleotide; TTT chr11 5226348 5226369 5226353 5226348 -
ttttttcttctccgcaattttt

SEQ ID NO: 144179 - DNA, 22 bp, Artificial Sequence
  Synthetic oligonucleotide; TTT chr11 5226347 5226368 5226352 5226347 -
tttttcttctccgcaattttta

SEQ ID NO: 144180 - DNA, 22 bp, Artificial Sequence
  Synthetic oligonucleotide; TTT chr11 5226346 5226367 5226351 5226346 -
ttttcttctccgcaatttttac

SEQ ID NO: 144181 - DNA, 22 bp, Artificial Sequence
  Synthetic oligonucleotide; TTT chr11 5226345 5226366 5226350 5226345 -
tttcttctccgcaatttttact

SEQ ID NO: 144182 - DNA, 22 bp, Artificial Sequence
  Synthetic oligonucleotide; TTT chr11 5226344 5226365 5226349 5226344 -
ttcttctccgcaatttttacta

SEQ ID NO: 144183 - DNA, 22 bp, Artificial Sequence
  Synthetic oligonucleotide; TTT chr11 5226343 5226364 5226348 5226343 -
tcttctccgcaatttttactat

SEQ ID NO: 144184 - DNA, 22 bp, Artificial Sequence
  Synthetic oligonucleotide; TTT chr11 5226342 5226363 5226347 5226342 -
cttctccgcaatttttactatt

SEQ ID NO: 144185 - DNA, 22 bp, Artificial Sequence
  Synthetic oligonucleotide; TTC chr11 5226341 5226362 5226346 5226341 -
ttctccgcaatttttactatta

SEQ ID NO: 144186 - DNA, 22 bp, Artificial Sequence
  Synthetic oligonucleotide; CTT chr11 5226339 5226360 5226344 5226339 -
ctccgcaatttttactattata

SEQ ID NO: 144187 - DNA, 22 bp, Artificial Sequence
  Synthetic oligonucleotide; TTC chr11 5226338 5226359 5226343 5226338 -
tccgcaatttttactattatac

SEQ ID NO: 144188 - DNA, 22 bp, Artificial Sequence
  Synthetic oligonucleotide; CTC chr11 5226336 5226357 5226341 5226336 -
cgcaatttttactattatactt

SEQ ID NO: 144189 - DNA, 22 bp, Artificial Sequence
  Synthetic oligonucleotide; TTT chr11 5226328 5226349 5226333 5226328 -
ttactattatacttaatgcctt

SEQ ID NO: 144190 - DNA, 22 bp, Artificial Sequence
  Synthetic oligonucleotide; TTT chr11 5226327 5226348 5226332 5226327 -
tactattatacttaatgcctta

SEQ ID NO: 144191 - DNA, 22 bp, Artificial Sequence
  Synthetic oligonucleotide; TTT chr11 5226326 5226347 5226331 5226326 -
actattatacttaatgccttaa

SEQ ID NO: 144192 - DNA, 22 bp, Artificial Sequence
  Synthetic oligonucleotide; TTA chr11 5226325 5226346 5226330 5226325 -
ctattatacttaatgccttaac

SEQ ID NO: 144193 - DNA, 22 bp, Artificial Sequence
  Synthetic oligonucleotide; CTA chr11 5226322 5226343 5226327 5226322 -
ttatacttaatgccttaacatt

SEQ ID NO: 144194 - DNA, 22 bp, Artificial Sequence
  Synthetic oligonucleotide; TTA chr11 5226319 5226340 5226324 5226319 -
tacttaatgccttaacattgtg

SEQ ID NO: 144195 - DNA, 22 bp, Artificial Sequence
  Synthetic oligonucleotide; CTT chr11 5226314 5226335 5226319 5226314 -
aatgccttaacattgtgtataa

SEQ ID NO: 144196 - DNA, 22 bp, Artificial Sequence
  Synthetic oligonucleotide; TTA chr11 5226313 5226334 5226318 5226313 -
atgccttaacattgtgtataac

SEQ ID NO: 144197 - DNA, 22 bp, Artificial Sequence
  Synthetic oligonucleotide; CTT chr11 5226306 5226327 5226311 5226306 -
aacattgtgtataacaaaagga

SEQ ID NO: 144198 - DNA, 22 bp, Artificial Sequence
  Synthetic oligonucleotide; TTA chr11 5226305 5226326 5226310 5226305 -
acattgtgtataacaaaaggaa

SEQ ID NO: 144199 - DNA, 22 bp, Artificial Sequence
  Synthetic oligonucleotide; TTG chr11 5226299 5226320 5226304 5226299 -
tgtataacaaaaggaaatatct

SEQ ID NO: 144200 - DNA, 22 bp, Artificial Sequence
  Synthetic oligonucleotide; CTC chr11 5226276 5226297 5226281 5226276 -
tgagatacattaagtaacttaa

SEQ ID NO: 144201 - DNA, 22 bp, Artificial Sequence
  Synthetic oligonucleotide; CTG chr11 5226274 5226295 5226279 5226274 -
agatacattaagtaacttaaaa

SEQ ID NO: 144202 - DNA, 22 bp, Artificial Sequence
  Synthetic oligonucleotide; TTA chr11 5226264 5226285 5226269 5226264 -
agtaacttaaaaaaaaacttta

SEQ ID NO: 144203 - DNA, 22 bp, Artificial Sequence
  Synthetic oligonucleotide; CTT chr11 5226256 5226277 5226261 5226256 -
aaaaaaaaactttacacagtct

SEQ ID NO: 144204 - DNA, 22 bp, Artificial Sequence
  Synthetic oligonucleotide; TTA chr11 5226255 5226276 5226260 5226255 -
aaaaaaaactttacacagtctg

SEQ ID NO: 144205 - DNA, 22 bp, Artificial Sequence
  Synthetic oligonucleotide; CTT chr11 5226244 5226265 5226249 5226244 -
tacacagtctgcctagtacatt

SEQ ID NO: 144206 - DNA, 22 bp, Artificial Sequence
  Synthetic oligonucleotide; TTT chr11 5226243 5226264 5226248 5226243 -
acacagtctgcctagtacatta

SEQ ID NO: 144207 - DNA, 22 bp, Artificial Sequence
  Synthetic oligonucleotide; TTA chr11 5226242 5226263 5226247 5226242 -
cacagtctgcctagtacattac

SEQ ID NO: 144208 - DNA, 22 bp, Artificial Sequence
  Synthetic oligonucleotide; CTG chr11 5226233 5226254 5226238 5226233 -
cctagtacattactatttggaa

SEQ ID NO: 144209 - DNA, 22 bp, Artificial Sequence
  Synthetic oligonucleotide; CTA chr11 5226229 5226250 5226234 5226229 -
gtacattactatttggaatata

SEQ ID NO: 144210 - DNA, 22 bp, Artificial Sequence
  Synthetic oligonucleotide; TTA chr11 5226221 5226242 5226226 5226221 -
ctatttggaatatatgtgtgct

SEQ ID NO: 144211 - DNA, 22 bp, Artificial Sequence
  Synthetic oligonucleotide; CTA chr11 5226218 5226239 5226223 5226218 -
tttggaatatatgtgtgcttat

SEQ ID NO: 144212 - DNA, 22 bp, Artificial Sequence
  Synthetic oligonucleotide; TTT chr11 5226215 5226236 5226220 5226215 -
ggaatatatgtgtgcttatttg

SEQ ID NO: 144213 - DNA, 22 bp, Artificial Sequence
  Synthetic oligonucleotide; TTG chr11 5226214 5226235 5226219 5226214 -
gaatatatgtgtgcttatttgc

SEQ ID NO: 144214 - DNA, 22 bp, Artificial Sequence
  Synthetic oligonucleotide; CTT chr11 5226198 5226219 5226203 5226198 -
atttgcatattcataatctccc

SEQ ID NO: 144215 - DNA, 22 bp, Artificial Sequence
  Synthetic oligonucleotide; TTA chr11 5226197 5226218 5226202 5226197 -
tttgcatattcataatctccct

SEQ ID NO: 144216 - DNA, 22 bp, Artificial Sequence
  Synthetic oligonucleotide; TTT chr11 5226194 5226215 5226199 5226194 -
gcatattcataatctccctact

SEQ ID NO: 144217 - DNA, 22 bp, Artificial Sequence
  Synthetic oligonucleotide; TTG chr11 5226193 5226214 5226198 5226193 -
catattcataatctccctactt

SEQ ID NO: 144218 - DNA, 22 bp, Artificial Sequence
  Synthetic oligonucleotide; TTC chr11 5226186 5226207 5226191 5226186 -
ataatctccctactttattttc

SEQ ID NO: 144219 - DNA, 22 bp, Artificial Sequence
  Synthetic oligonucleotide; CTC chr11 5226178 5226199 5226183 5226178 -
cctactttattttcttttattt

SEQ ID NO: 144220 - DNA, 22 bp, Artificial Sequence
  Synthetic oligonucleotide; CTA chr11 5226174 5226195 5226179 5226174 -
ctttattttcttttatttttaa

SEQ ID NO: 144221 - DNA, 22 bp, Artificial Sequence
  Synthetic oligonucleotide; CTT chr11 5226171 5226192 5226176 5226171 -
tattttcttttatttttaattg

SEQ ID NO: 144222 - DNA, 22 bp, Artificial Sequence
  Synthetic oligonucleotide; TTT chr11 5226170 5226191 5226175 5226170 -
attttcttttatttttaattga

SEQ ID NO: 144223 - DNA, 22 bp, Artificial Sequence
  Synthetic oligonucleotide; TTA chr11 5226169 5226190 5226174 5226169 -
ttttcttttatttttaattgat

SEQ ID NO: 144224 - DNA, 22 bp, Artificial Sequence
  Synthetic oligonucleotide; TTT chr11 5226166 5226187 5226171 5226166 -
tcttttatttttaattgataca

SEQ ID NO: 144225 - DNA, 22 bp, Artificial Sequence
  Synthetic oligonucleotide; TTT chr11 5226165 5226186 5226170 5226165 -
cttttatttttaattgatacat

SEQ ID NO: 144226 - DNA, 22 bp, Artificial Sequence
  Synthetic oligonucleotide; TTC chr11 5226164 5226185 5226169 5226164 -
ttttatttttaattgatacata

SEQ ID NO: 144227 - DNA, 22 bp, Artificial Sequence
  Synthetic oligonucleotide; CTT chr11 5226162 5226183 5226167 5226162 -
ttatttttaattgatacataat

SEQ ID NO: 144228 - DNA, 22 bp, Artificial Sequence
  Synthetic oligonucleotide; TTT chr11 5226161 5226182 5226166 5226161 -
tatttttaattgatacataatc

SEQ ID NO: 144229 - DNA, 22 bp, Artificial Sequence
  Synthetic oligonucleotide; TTT chr11 5226160 5226181 5226165 5226160 -
atttttaattgatacataatca

SEQ ID NO: 144230 - DNA, 22 bp, Artificial Sequence
  Synthetic oligonucleotide; TTA chr11 5226159 5226180 5226164 5226159 -
tttttaattgatacataatcat

SEQ ID NO: 144231 - DNA, 22 bp, Artificial Sequence
  Synthetic oligonucleotide; TTT chr11 5226156 5226177 5226161 5226156 -
ttaattgatacataatcattat

SEQ ID NO: 144232 - DNA, 22 bp, Artificial Sequence
  Synthetic oligonucleotide; TTT chr11 5226155 5226176 5226160 5226155 -
taattgatacataatcattata

SEQ ID NO: 144233 - DNA, 22 bp, Artificial Sequence
  Synthetic oligonucleotide; TTT chr11 5226154 5226175 5226159 5226154 -
aattgatacataatcattatac

SEQ ID NO: 144234 - DNA, 22 bp, Artificial Sequence
  Synthetic oligonucleotide; TTA chr11 5226153 5226174 5226158 5226153 -
attgatacataatcattataca

SEQ ID NO: 144235 - DNA, 22 bp, Artificial Sequence
  Synthetic oligonucleotide; TTG chr11 5226149 5226170 5226154 5226149 -
atacataatcattatacatatt

SEQ ID NO: 144236 - DNA, 22 bp, Artificial Sequence
  Synthetic oligonucleotide; TTA chr11 5226135 5226156 5226140 5226135 -
tacatatttatgggttaaagtg

SEQ ID NO: 144237 - DNA, 22 bp, Artificial Sequence
  Synthetic oligonucleotide; TTT chr11 5226126 5226147 5226131 5226126 -
atgggttaaagtgtaatgtttt

SEQ ID NO: 144238 - DNA, 22 bp, Artificial Sequence
  Synthetic oligonucleotide; TTA chr11 5226125 5226146 5226130 5226125 -
tgggttaaagtgtaatgtttta

SEQ ID NO: 144239 - DNA, 22 bp, Artificial Sequence
  Synthetic oligonucleotide; TTA chr11 5226118 5226139 5226123 5226118 -
aagtgtaatgttttaatatgtg

SEQ ID NO: 144240 - DNA, 22 bp, Artificial Sequence
  Synthetic oligonucleotide; TTT chr11 5226105 5226126 5226110 5226105 -
taatatgtgtacacatattgac

SEQ ID NO: 144241 - DNA, 22 bp, Artificial Sequence
  Synthetic oligonucleotide; TTT chr11 5226104 5226125 5226109 5226104 -
aatatgtgtacacatattgacc

SEQ ID NO: 144242 - DNA, 22 bp, Artificial Sequence
  Synthetic oligonucleotide; TTA chr11 5226103 5226124 5226108 5226103 -
atatgtgtacacatattgacca

SEQ ID NO: 144243 - DNA, 22 bp, Artificial Sequence
  Synthetic oligonucleotide; TTG chr11 5226085 5226106 5226090 5226085 -
accaaatcagggtaattttgca

SEQ ID NO: 144244 - DNA, 22 bp, Artificial Sequence
  Synthetic oligonucleotide; TTT chr11 5226067 5226088 5226072 5226067 -
tgcatttgtaattttaaaaaat

SEQ ID NO: 144245 - DNA, 22 bp, Artificial Sequence
  Synthetic oligonucleotide; TTT chr11 5226066 5226087 5226071 5226066 -
gcatttgtaattttaaaaaatg

SEQ ID NO: 144246 - DNA, 22 bp, Artificial Sequence
  Synthetic oligonucleotide; TTG chr11 5226065 5226086 5226070 5226065 -
catttgtaattttaaaaaatgc

SEQ ID NO: 144247 - DNA, 22 bp, Artificial Sequence
  Synthetic oligonucleotide; TTT chr11 5226060 5226081 5226065 5226060 -
gtaattttaaaaaatgctttct

SEQ ID NO: 144248 - DNA, 22 bp, Artificial Sequence
  Synthetic oligonucleotide; TTG chr11 5226059 5226080 5226064 5226059 -
taattttaaaaaatgctttctt

SEQ ID NO: 144249 - DNA, 22 bp, Artificial Sequence
  Synthetic oligonucleotide; TTT chr11 5226053 5226074 5226058 5226053 -
taaaaaatgctttcttctttta

SEQ ID NO: 144250 - DNA, 22 bp, Artificial Sequence
  Synthetic oligonucleotide; TTT chr11 5226052 5226073 5226057 5226052 -
aaaaaatgctttcttcttttaa

SEQ ID NO: 144251 - DNA, 22 bp, Artificial Sequence
  Synthetic oligonucleotide; TTA chr11 5226051 5226072 5226056 5226051 -
aaaaatgctttcttcttttaat

SEQ ID NO: 144252 - DNA, 22 bp, Artificial Sequence
  Synthetic oligonucleotide; CTT chr11 5226041 5226062 5226046 5226041 -
tcttcttttaatatactttttt

SEQ ID NO: 144253 - DNA, 22 bp, Artificial Sequence
  Synthetic oligonucleotide; TTT chr11 5226040 5226061 5226045 5226040 -
cttcttttaatatacttttttg

SEQ ID NO: 144254 - DNA, 22 bp, Artificial Sequence
  Synthetic oligonucleotide; TTC chr11 5226039 5226060 5226044 5226039 -
ttcttttaatatacttttttgt

SEQ ID NO: 144255 - DNA, 22 bp, Artificial Sequence
  Synthetic oligonucleotide; CTT chr11 5226037 5226058 5226042 5226037 -
cttttaatatacttttttgttt

SEQ ID NO: 144256 - DNA, 22 bp, Artificial Sequence
  Synthetic oligonucleotide; TTC chr11 5226036 5226057 5226041 5226036 -
ttttaatatacttttttgttta

SEQ ID NO: 144257 - DNA, 22 bp, Artificial Sequence
  Synthetic oligonucleotide; CTT chr11 5226034 5226055 5226039 5226034 -
ttaatatacttttttgtttatc

SEQ ID NO: 144258 - DNA, 22 bp, Artificial Sequence
  Synthetic oligonucleotide; TTT chr11 5226033 5226054 5226038 5226033 -
taatatacttttttgtttatct

SEQ ID NO: 144259 - DNA, 22 bp, Artificial Sequence
  Synthetic oligonucleotide; TTT chr11 5226032 5226053 5226037 5226032 -
aatatacttttttgtttatctt

SEQ ID NO: 144260 - DNA, 22 bp, Artificial Sequence
  Synthetic oligonucleotide; TTA chr11 5226031 5226052 5226036 5226031 -
atatacttttttgtttatctta

SEQ ID NO: 144261 - DNA, 22 bp, Artificial Sequence
  Synthetic oligonucleotide; CTT chr11 5226023 5226044 5226028 5226023 -
ttttgtttatcttatttctaat

SEQ ID NO: 144262 - DNA, 22 bp, Artificial Sequence
  Synthetic oligonucleotide; TTT chr11 5226022 5226043 5226027 5226022 -
tttgtttatcttatttctaata

SEQ ID NO: 144263 - DNA, 22 bp, Artificial Sequence
  Synthetic oligonucleotide; TTT chr11 5226021 5226042 5226026 5226021 -
ttgtttatcttatttctaatac

SEQ ID NO: 144264 - DNA, 22 bp, Artificial Sequence
  Synthetic oligonucleotide; TTT chr11 5226020 5226041 5226025 5226020 -
tgtttatcttatttctaatact

SEQ ID NO: 144265 - DNA, 22 bp, Artificial Sequence
  Synthetic oligonucleotide; TTT chr11 5226019 5226040 5226024 5226019 -
gtttatcttatttctaatactt

SEQ ID NO: 144266 - DNA, 22 bp, Artificial Sequence
  Synthetic oligonucleotide; TTG chr11 5226018 5226039 5226023 5226018 -
tttatcttatttctaatacttt

SEQ ID NO: 144267 - DNA, 22 bp, Artificial Sequence
  Synthetic oligonucleotide; TTT chr11 5226015 5226036 5226020 5226015 -
atcttatttctaatactttccc

SEQ ID NO: 144268 - DNA, 22 bp, Artificial Sequence
  Synthetic oligonucleotide; TTA chr11 5226014 5226035 5226019 5226014 -
tcttatttctaatactttccct

SEQ ID NO: 144269 - DNA, 22 bp, Artificial Sequence
  Synthetic oligonucleotide; CTT chr11 5226010 5226031 5226015 5226010 -
atttctaatactttccctaatc

SEQ ID NO: 144270 - DNA, 22 bp, Artificial Sequence
  Synthetic oligonucleotide; TTA chr11 5226009 5226030 5226014 5226009 -
tttctaatactttccctaatct

SEQ ID NO: 144271 - DNA, 22 bp, Artificial Sequence
  Synthetic oligonucleotide; TTT chr11 5226006 5226027 5226011 5226006 -
ctaatactttccctaatctctt

SEQ ID NO: 144272 - DNA, 22 bp, Artificial Sequence
  Synthetic oligonucleotide; TTC chr11 5226005 5226026 5226010 5226005 -
taatactttccctaatctcttt

SEQ ID NO: 144273 - DNA, 22 bp, Artificial Sequence
  Synthetic oligonucleotide; CTA chr11 5226003 5226024 5226008 5226003 -
atactttccctaatctctttct

SEQ ID NO: 144274 - DNA, 22 bp, Artificial Sequence
  Synthetic oligonucleotide; CTT chr11 5225997 5226018 5226002 5225997 -
tccctaatctctttctttcagg

SEQ ID NO: 144275 - DNA, 22 bp, Artificial Sequence
  Synthetic oligonucleotide; TTT chr11 5225996 5226017 5226001 5225996 -
ccctaatctctttctttcaggg

SEQ ID NO: 144276 - DNA, 22 bp, Artificial Sequence
  Synthetic oligonucleotide; TTC chr11 5225995 5226016 5226000 5225995 -
cctaatctctttctttcagggc

SEQ ID NO: 144277 - DNA, 22 bp, Artificial Sequence
  Synthetic oligonucleotide; CTA chr11 5225991 5226012 5225996 5225991 -
atctctttctttcagggcaata

SEQ ID NO: 144278 - DNA, 22 bp, Artificial Sequence
  Synthetic oligonucleotide; CTC chr11 5225986 5226007 5225991 5225986 -
tttctttcagggcaataatgat

SEQ ID NO: 144279 - DNA, 22 bp, Artificial Sequence
  Synthetic oligonucleotide; CTT chr11 5225984 5226005 5225989 5225984 -
tctttcagggcaataatgatac

SEQ ID NO: 144280 - DNA, 22 bp, Artificial Sequence
  Synthetic oligonucleotide; TTT chr11 5225983 5226004 5225988 5225983 -
ctttcagggcaataatgataca

SEQ ID NO: 144281 - DNA, 22 bp, Artificial Sequence
  Synthetic oligonucleotide; TTC chr11 5225982 5226003 5225987 5225982 -
tttcagggcaataatgatacaa

SEQ ID NO: 144282 - DNA, 22 bp, Artificial Sequence
  Synthetic oligonucleotide; CTT chr11 5225980 5226001 5225985 5225980 -
tcagggcaataatgatacaatg

SEQ ID NO: 144283 - DNA, 22 bp, Artificial Sequence
  Synthetic oligonucleotide; TTT chr11 5225979 5226000 5225984 5225979 -
cagggcaataatgatacaatgt

SEQ ID NO: 144284 - DNA, 22 bp, Artificial Sequence
  Synthetic oligonucleotide; TTC chr11 5225978 5225999 5225983 5225978 -
agggcaataatgatacaatgta

SEQ ID NO: 144285 - DNA, 22 bp, Artificial Sequence
  Synthetic oligonucleotide; CTC chr11 5225947 5225968 5225952 5225947 -
tttgcaccattctaaagaataa

SEQ ID NO: 144286 - DNA, 22 bp, Artificial Sequence
  Synthetic oligonucleotide; CTT chr11 5225945 5225966 5225950 5225945 -
tgcaccattctaaagaataaca

SEQ ID NO: 144287 - DNA, 22 bp, Artificial Sequence
  Synthetic oligonucleotide; TTT chr11 5225944 5225965 5225949 5225944 -
gcaccattctaaagaataacag

SEQ ID NO: 144288 - DNA, 22 bp, Artificial Sequence
  Synthetic oligonucleotide; TTG chr11 5225943 5225964 5225948 5225943 -
caccattctaaagaataacagt

SEQ ID NO: 144289 - DNA, 22 bp, Artificial Sequence
  Synthetic oligonucleotide; TTC chr11 5225935 5225956 5225940 5225935 -
taaagaataacagtgataattt

SEQ ID NO: 144290 - DNA, 22 bp, Artificial Sequence
  Synthetic oligonucleotide; CTA chr11 5225933 5225954 5225938 5225933 -
aagaataacagtgataatttct

SEQ ID NO: 144291 - DNA, 22 bp, Artificial Sequence
  Synthetic oligonucleotide; TTT chr11 5225913 5225934 5225918 5225913 -
ctgggttaaggcaatagcaata

SEQ ID NO: 144292 - DNA, 22 bp, Artificial Sequence
  Synthetic oligonucleotide; TTC chr11 5225912 5225933 5225917 5225912 -
tgggttaaggcaatagcaatat

SEQ ID NO: 144293 - DNA, 22 bp, Artificial Sequence
  Synthetic oligonucleotide; CTG chr11 5225910 5225931 5225915 5225910 -
ggttaaggcaatagcaatatct

SEQ ID NO: 144294 - DNA, 22 bp, Artificial Sequence
  Synthetic oligonucleotide; TTA chr11 5225905 5225926 5225910 5225905 -
aggcaatagcaatatctctgca

SEQ ID NO: 144295 - DNA, 22 bp, Artificial Sequence
  Synthetic oligonucleotide; CTC chr11 5225887 5225908 5225892 5225887 -
tgcatataaatatttctgcata

SEQ ID NO: 144296 - DNA, 22 bp, Artificial Sequence
  Synthetic oligonucleotide; CTG chr11 5225885 5225906 5225890 5225885 -
catataaatatttctgcatata

SEQ ID NO: 144297 - DNA, 22 bp, Artificial Sequence
  Synthetic oligonucleotide; TTT chr11 5225872 5225893 5225877 5225872 -
ctgcatataaattgtaactgat

SEQ ID NO: 144298 - DNA, 22 bp, Artificial Sequence
  Synthetic oligonucleotide; TTC chr11 5225871 5225892 5225876 5225871 -
tgcatataaattgtaactgatg

SEQ ID NO: 144299 - DNA, 22 bp, Artificial Sequence
  Synthetic oligonucleotide; CTG chr11 5225869 5225890 5225874 5225869 -
catataaattgtaactgatgta

SEQ ID NO: 144300 - DNA, 22 bp, Artificial Sequence
  Synthetic oligonucleotide; TTG chr11 5225858 5225879 5225863 5225858 -
taactgatgtaagaggtttcat

SEQ ID NO: 144301 - DNA, 22 bp, Artificial Sequence
  Synthetic oligonucleotide; CTG chr11 5225852 5225873 5225857 5225852 -
atgtaagaggtttcatattgct

SEQ ID NO: 144302 - DNA, 22 bp, Artificial Sequence
  Synthetic oligonucleotide; TTT chr11 5225839 5225860 5225844 5225839 -
catattgctaatagcagctaca

SEQ ID NO: 144303 - DNA, 22 bp, Artificial Sequence
  Synthetic oligonucleotide; TTC chr11 5225838 5225859 5225843 5225838 -
atattgctaatagcagctacaa

SEQ ID NO: 144304 - DNA, 22 bp, Artificial Sequence
  Synthetic oligonucleotide; TTG chr11 5225832 5225853 5225837 5225832 -
ctaatagcagctacaatccagc

SEQ ID NO: 144305 - DNA, 22 bp, Artificial Sequence
  Synthetic oligonucleotide; CTA chr11 5225829 5225850 5225834 5225829 -
atagcagctacaatccagctac

SEQ ID NO: 144306 - DNA, 22 bp, Artificial Sequence
  Synthetic oligonucleotide; CTA chr11 5225819 5225840 5225824 5225819 -
caatccagctaccattctgctt

SEQ ID NO: 144307 - DNA, 22 bp, Artificial Sequence
  Synthetic oligonucleotide; CTA chr11 5225808 5225829 5225813 5225808 -
ccattctgcttttattttatgg

SEQ ID NO: 144308 - DNA, 22 bp, Artificial Sequence
  Synthetic oligonucleotide; TTC chr11 5225802 5225823 5225807 5225802 -
tgcttttattttatggttggga

SEQ ID NO: 144309 - DNA, 22 bp, Artificial Sequence
  Synthetic oligonucleotide; CTG chr11 5225800 5225821 5225805 5225800 -
cttttattttatggttgggata

SEQ ID NO: 144310 - DNA, 22 bp, Artificial Sequence
  Synthetic oligonucleotide; CTT chr11 5225797 5225818 5225802 5225797 -
ttattttatggttgggataagg

SEQ ID NO: 144311 - DNA, 22 bp, Artificial Sequence
  Synthetic oligonucleotide; TTT chr11 5225796 5225817 5225801 5225796 -
tattttatggttgggataaggc

SEQ ID NO: 144312 - DNA, 22 bp, Artificial Sequence
  Synthetic oligonucleotide; TTT chr11 5225795 5225816 5225800 5225795 -
attttatggttgggataaggct

SEQ ID NO: 144313 - DNA, 22 bp, Artificial Sequence
  Synthetic oligonucleotide; TTA chr11 5225794 5225815 5225799 5225794 -
ttttatggttgggataaggctg

SEQ ID NO: 144314 - DNA, 22 bp, Artificial Sequence
  Synthetic oligonucleotide; TTT chr11 5225791 5225812 5225796 5225791 -
tatggttgggataaggctggat

SEQ ID NO: 144315 - DNA, 22 bp, Artificial Sequence
  Synthetic oligonucleotide; TTT chr11 5225790 5225811 5225795 5225790 -
atggttgggataaggctggatt

SEQ ID NO: 144316 - DNA, 22 bp, Artificial Sequence
  Synthetic oligonucleotide; TTA chr11 5225789 5225810 5225794 5225789 -
tggttgggataaggctggatta

SEQ ID NO: 144317 - DNA, 22 bp, Artificial Sequence
  Synthetic oligonucleotide; TTG chr11 5225783 5225804 5225788 5225783 -
ggataaggctggattattctga

SEQ ID NO: 144318 - DNA, 22 bp, Artificial Sequence
  Synthetic oligonucleotide; CTG chr11 5225772 5225793 5225777 5225772 -
gattattctgagtccaagctag

SEQ ID NO: 144319 - DNA, 22 bp, Artificial Sequence
  Synthetic oligonucleotide; TTA chr11 5225767 5225788 5225772 5225767 -
ttctgagtccaagctaggccct

SEQ ID NO: 144320 - DNA, 22 bp, Artificial Sequence
  Synthetic oligonucleotide; TTC chr11 5225764 5225785 5225769 5225764 -
tgagtccaagctaggccctttt

SEQ ID NO: 144321 - DNA, 22 bp, Artificial Sequence
  Synthetic oligonucleotide; CTG chr11 5225762 5225783 5225767 5225762 -
agtccaagctaggcccttttgc

SEQ ID NO: 144322 - DNA, 22 bp, Artificial Sequence
  Synthetic oligonucleotide; CTA chr11 5225751 5225772 5225756 5225751 -
ggcccttttgctaatcatgttc

SEQ ID NO: 144323 - DNA, 22 bp, Artificial Sequence
  Synthetic oligonucleotide; CTT chr11 5225744 5225765 5225749 5225744 -
ttgctaatcatgttcatacctc

SEQ ID NO: 144324 - DNA, 22 bp, Artificial Sequence
  Synthetic oligonucleotide; TTT chr11 5225743 5225764 5225748 5225743 -
tgctaatcatgttcatacctct

SEQ ID NO: 144325 - DNA, 22 bp, Artificial Sequence
  Synthetic oligonucleotide; TTT chr11 5225742 5225763 5225747 5225742 -
gctaatcatgttcatacctctt

SEQ ID NO: 144326 - DNA, 22 bp, Artificial Sequence
  Synthetic oligonucleotide; TTG chr11 5225741 5225762 5225746 5225741 -
ctaatcatgttcatacctctta

SEQ ID NO: 144327 - DNA, 22 bp, Artificial Sequence
  Synthetic oligonucleotide; CTA chr11 5225738 5225759 5225743 5225738 -
atcatgttcatacctcttatct

SEQ ID NO: 144328 - DNA, 22 bp, Artificial Sequence
  Synthetic oligonucleotide; TTC chr11 5225729 5225750 5225734 5225729 -
atacctcttatcttcctcccac

SEQ ID NO: 144329 - DNA, 22 bp, Artificial Sequence
  Synthetic oligonucleotide; CTC chr11 5225722 5225743 5225727 5225722 -
ttatcttcctcccacagctcct

SEQ ID NO: 144330 - DNA, 22 bp, Artificial Sequence
  Synthetic oligonucleotide; CTT chr11 5225720 5225741 5225725 5225720 -
atcttcctcccacagctcctgg

SEQ ID NO: 144331 - DNA, 22 bp, Artificial Sequence
  Synthetic oligonucleotide; TTA chr11 5225719 5225740 5225724 5225719 -
tcttcctcccacagctcctggg

SEQ ID NO: 144332 - DNA, 22 bp, Artificial Sequence
  Synthetic oligonucleotide; CTT chr11 5225715 5225736 5225720 5225715 -
cctcccacagctcctgggcaac

SEQ ID NO: 144333 - DNA, 22 bp, Artificial Sequence
  Synthetic oligonucleotide; TTC chr11 5225714 5225735 5225719 5225714 -
ctcccacagctcctgggcaacg

SEQ ID NO: 144334 - DNA, 22 bp, Artificial Sequence
  Synthetic oligonucleotide; CTC chr11 5225711 5225732 5225716 5225711 -
ccacagctcctgggcaacgtgc

SEQ ID NO: 144335 - DNA, 22 bp, Artificial Sequence
  Synthetic oligonucleotide; CTC chr11 5225702 5225723 5225707 5225702 -
ctgggcaacgtgctggtctgtg

SEQ ID NO: 144336 - DNA, 22 bp, Artificial Sequence
  Synthetic oligonucleotide; CTG chr11 5225699 5225720 5225704 5225699 -
ggcaacgtgctggtctgtgtgc

SEQ ID NO: 144337 - DNA, 22 bp, Artificial Sequence
  Synthetic oligonucleotide; CTG chr11 5225687 5225708 5225692 5225687 -
gtctgtgtgctggcccatcact

SEQ ID NO: 144338 - DNA, 22 bp, Artificial Sequence
  Synthetic oligonucleotide; CTG chr11 5225682 5225703 5225687 5225682 -
tgtgctggcccatcactttggc

SEQ ID NO: 144339 - DNA, 22 bp, Artificial Sequence
  Synthetic oligonucleotide; CTG chr11 5225675 5225696 5225680 5225675 -
gcccatcactttggcaaagaat

SEQ ID NO: 144340 - DNA, 22 bp, Artificial Sequence
  Synthetic oligonucleotide; CTT chr11 5225664 5225685 5225669 5225664 -
tggcaaagaattcaccccacca

SEQ ID NO: 144341 - DNA, 22 bp, Artificial Sequence
  Synthetic oligonucleotide; TTT chr11 5225663 5225684 5225668 5225663 -
ggcaaagaattcaccccaccag

SEQ ID NO: 144342 - DNA, 22 bp, Artificial Sequence
  Synthetic oligonucleotide; TTG chr11 5225662 5225683 5225667 5225662 -
gcaaagaattcaccccaccagt

SEQ ID NO: 144343 - DNA, 22 bp, Artificial Sequence
  Synthetic oligonucleotide; TTC chr11 5225651 5225672 5225656 5225651 -
accccaccagtgcaggctgcct

SEQ ID NO: 144344 - DNA, 22 bp, Artificial Sequence
  Synthetic oligonucleotide; CTG chr11 5225632 5225653 5225637 5225632 -
cctatcagaaagtggtggctgg

SEQ ID NO: 144345 - DNA, 22 bp, Artificial Sequence
  Synthetic oligonucleotide; CTA chr11 5225628 5225649 5225633 5225628 -
tcagaaagtggtggctggtgtg

SEQ ID NO: 144346 - DNA, 22 bp, Artificial Sequence
  Synthetic oligonucleotide; CTG chr11 5225611 5225632 5225616 5225611 -
gtgtggctaatgccctggccca

SEQ ID NO: 144347 - DNA, 22 bp, Artificial Sequence
  Synthetic oligonucleotide; CTA chr11 5225602 5225623 5225607 5225602 -
atgccctggcccacaagtatca

SEQ ID NO: 144348 - DNA, 22 bp, Artificial Sequence
  Synthetic oligonucleotide; CTG chr11 5225594 5225615 5225599 5225594 -
gcccacaagtatcactaagctc

SEQ ID NO: 144349 - DNA, 22 bp, Artificial Sequence
  Synthetic oligonucleotide; CTA chr11 5225577 5225598 5225582 5225577 -
agctcgctttcttgctgtccaa

SEQ ID NO: 144350 - DNA, 22 bp, Artificial Sequence
  Synthetic oligonucleotide; CTC chr11 5225572 5225593 5225577 5225572 -
gctttcttgctgtccaatttct

SEQ ID NO: 144351 - DNA, 22 bp, Artificial Sequence
  Synthetic oligonucleotide; CTT chr11 5225568 5225589 5225573 5225568 -
tcttgctgtccaatttctatta

SEQ ID NO: 144352 - DNA, 22 bp, Artificial Sequence
  Synthetic oligonucleotide; TTT chr11 5225567 5225588 5225572 5225567 -
cttgctgtccaatttctattaa

SEQ ID NO: 144353 - DNA, 22 bp, Artificial Sequence
  Synthetic oligonucleotide; TTC chr11 5225566 5225587 5225571 5225566 -
ttgctgtccaatttctattaaa

SEQ ID NO: 144354 - DNA, 22 bp, Artificial Sequence
  Synthetic oligonucleotide; CTT chr11 5225564 5225585 5225569 5225564 -
gctgtccaatttctattaaagg

SEQ ID NO: 144355 - DNA, 22 bp, Artificial Sequence
  Synthetic oligonucleotide; TTG chr11 5225563 5225584 5225568 5225563 -
ctgtccaatttctattaaaggt

SEQ ID NO: 144356 - DNA, 22 bp, Artificial Sequence
  Synthetic oligonucleotide; CTG chr11 5225560 5225581 5225565 5225560 -
tccaatttctattaaaggttcc

SEQ ID NO: 144357 - DNA, 22 bp, Artificial Sequence
  Synthetic oligonucleotide; TTT chr11 5225552 5225573 5225557 5225552 -
ctattaaaggttcctttgttcc

SEQ ID NO: 144358 - DNA, 22 bp, Artificial Sequence
  Synthetic oligonucleotide; TTC chr11 5225551 5225572 5225556 5225551 -
tattaaaggttcctttgttccc

SEQ ID NO: 144359 - DNA, 22 bp, Artificial Sequence
  Synthetic oligonucleotide; CTA chr11 5225549 5225570 5225554 5225549 -
ttaaaggttcctttgttcccta

SEQ ID NO: 144360 - DNA, 22 bp, Artificial Sequence
  Synthetic oligonucleotide; TTA chr11 5225546 5225567 5225551 5225546 -
aaggttcctttgttccctaagt

SEQ ID NO: 144361 - DNA, 22 bp, Artificial Sequence
  Synthetic oligonucleotide; TTC chr11 5225539 5225560 5225544 5225539 -
ctttgttccctaagtccaacta

SEQ ID NO: 144362 - DNA, 22 bp, Artificial Sequence
  Synthetic oligonucleotide; CTT chr11 5225536 5225557 5225541 5225536 -
tgttccctaagtccaactacta

SEQ ID NO: 144363 - DNA, 22 bp, Artificial Sequence
  Synthetic oligonucleotide; TTT chr11 5225535 5225556 5225540 5225535 -
gttccctaagtccaactactaa

SEQ ID NO: 144364 - DNA, 22 bp, Artificial Sequence
  Synthetic oligonucleotide; TTG chr11 5225534 5225555 5225539 5225534 -
ttccctaagtccaactactaaa

SEQ ID NO: 144365 - DNA, 22 bp, Artificial Sequence
  Synthetic oligonucleotide; TTC chr11 5225531 5225552 5225536 5225531 -
cctaagtccaactactaaactg

SEQ ID NO: 144366 - DNA, 22 bp, Artificial Sequence
  Synthetic oligonucleotide; CTA chr11 5225527 5225548 5225532 5225527 -
agtccaactactaaactggggg

SEQ ID NO: 144367 - DNA, 22 bp, Artificial Sequence
  Synthetic oligonucleotide; CTA chr11 5225517 5225538 5225522 5225517 -
ctaaactgggggatattatgaa

SEQ ID NO: 144368 - DNA, 22 bp, Artificial Sequence
  Synthetic oligonucleotide; CTA chr11 5225514 5225535 5225519 5225514 -
aactgggggatattatgaaggg

SEQ ID NO: 144369 - DNA, 22 bp, Artificial Sequence
  Synthetic oligonucleotide; CTG chr11 5225509 5225530 5225514 5225509 -
ggggatattatgaagggccttg

SEQ ID NO: 144370 - DNA, 22 bp, Artificial Sequence
  Synthetic oligonucleotide; TTA chr11 5225499 5225520 5225504 5225499 -
tgaagggccttgagcatctgga

SEQ ID NO: 144371 - DNA, 22 bp, Artificial Sequence
  Synthetic oligonucleotide; CTT chr11 5225488 5225509 5225493 5225488 -
gagcatctggattctgcctaat

SEQ ID NO: 144372 - DNA, 22 bp, Artificial Sequence
  Synthetic oligonucleotide; TTG chr11 5225487 5225508 5225492 5225487 -
agcatctggattctgcctaata

SEQ ID NO: 144373 - DNA, 22 bp, Artificial Sequence
  Synthetic oligonucleotide; CTG chr11 5225479 5225500 5225484 5225479 -
gattctgcctaataaaaaacat

SEQ ID NO: 144374 - DNA, 22 bp, Artificial Sequence
  Synthetic oligonucleotide; TTC chr11 5225474 5225495 5225479 5225474 -
tgcctaataaaaaacatttatt

SEQ ID NO: 144375 - DNA, 22 bp, Artificial Sequence
  Synthetic oligonucleotide; CTG chr11 5225472 5225493 5225477 5225472 -
cctaataaaaaacatttatttt

SEQ ID NO: 144376 - DNA, 22 bp, Artificial Sequence
  Synthetic oligonucleotide; CTA chr11 5225468 5225489 5225473 5225468 -
ataaaaaacatttattttcatt

SEQ ID NO: 144377 - DNA, 22 bp, Artificial Sequence
  Synthetic oligonucleotide; TTT chr11 5225455 5225476 5225460 5225455 -
attttcattgcaatgatgtatt

SEQ ID NO: 144378 - DNA, 22 bp, Artificial Sequence
  Synthetic oligonucleotide; TTA chr11 5225454 5225475 5225459 5225454 -
ttttcattgcaatgatgtattt

SEQ ID NO: 144379 - DNA, 22 bp, Artificial Sequence
  Synthetic oligonucleotide; TTT chr11 5225451 5225472 5225456 5225451 -
tcattgcaatgatgtatttaaa

SEQ ID NO: 144380 - DNA, 22 bp, Artificial Sequence
  Synthetic oligonucleotide; TTT chr11 5225450 5225471 5225455 5225450 -
cattgcaatgatgtatttaaat

SEQ ID NO: 144381 - DNA, 22 bp, Artificial Sequence
  Synthetic oligonucleotide; TTC chr11 5225449 5225470 5225454 5225449 -
attgcaatgatgtatttaaatt

SEQ ID NO: 144382 - DNA, 22 bp, Artificial Sequence
  Synthetic oligonucleotide; TTG chr11 5225445 5225466 5225450 5225445 -
caatgatgtatttaaattattt

SEQ ID NO: 144383 - DNA, 22 bp, Artificial Sequence
  Synthetic oligonucleotide; TTT chr11 5225432 5225453 5225437 5225432 -
aaattatttctgaatattttac

SEQ ID NO: 144384 - DNA, 22 bp, Artificial Sequence
  Synthetic oligonucleotide; TTA chr11 5225431 5225452 5225436 5225431 -
aattatttctgaatattttact

SEQ ID NO: 144385 - DNA, 22 bp, Artificial Sequence
  Synthetic oligonucleotide; TTA chr11 5225426 5225447 5225431 5225426 -
tttctgaatattttactaaaaa

SEQ ID NO: 144386 - DNA, 22 bp, Artificial Sequence
  Synthetic oligonucleotide; TTT chr11 5225423 5225444 5225428 5225423 -
ctgaatattttactaaaaaggg

SEQ ID NO: 144387 - DNA, 22 bp, Artificial Sequence
  Synthetic oligonucleotide; TTC chr11 5225422 5225443 5225427 5225422 -
tgaatattttactaaaaaggga

SEQ ID NO: 144388 - DNA, 22 bp, Artificial Sequence
  Synthetic oligonucleotide; CTG chr11 5225420 5225441 5225425 5225420 -
aatattttactaaaaagggaat

SEQ ID NO: 144389 - DNA, 22 bp, Artificial Sequence
  Synthetic oligonucleotide; TTT chr11 5225413 5225434 5225418 5225413 -
tactaaaaagggaatgtgggag

SEQ ID NO: 144390 - DNA, 22 bp, Artificial Sequence
  Synthetic oligonucleotide; TTT chr11 5225412 5225433 5225417 5225412 -
actaaaaagggaatgtgggagg

SEQ ID NO: 144391 - DNA, 22 bp, Artificial Sequence
  Synthetic oligonucleotide; TTA chr11 5225411 5225432 5225416 5225411 -
ctaaaaagggaatgtgggaggt

SEQ ID NO: 144392 - DNA, 22 bp, Artificial Sequence
  Synthetic oligonucleotide; CTA chr11 5225408 5225429 5225413 5225408 -
aaaagggaatgtgggaggtcag

SEQ ID NO: 144393 - DNA, 22 bp, Artificial Sequence
  Synthetic oligonucleotide; TTT chr11 5225379 5225400 5225384 5225379 -
aaaacataaagaaatgaagagc

SEQ ID NO: 144394 - DNA, 22 bp, Artificial Sequence
  Synthetic oligonucleotide; TTA chr11 5225378 5225399 5225383 5225378 -
aaacataaagaaatgaagagct

SEQ ID NO: 144395 - DNA, 22 bp, Artificial Sequence
  Synthetic oligonucleotide; CTA chr11 5225355 5225376 5225360 5225355 -
gttcaaaccttgggaaaataca

SEQ ID NO: 144396 - DNA, 22 bp, Artificial Sequence
  Synthetic oligonucleotide; TTC chr11 5225351 5225372 5225356 5225351 -
aaaccttgggaaaatacactat

SEQ ID NO: 144397 - DNA, 22 bp, Artificial Sequence
  Synthetic oligonucleotide; CTT chr11 5225344 5225365 5225349 5225344 -
gggaaaatacactatatcttaa

SEQ ID NO: 144398 - DNA, 22 bp, Artificial Sequence
  Synthetic oligonucleotide; TTG chr11 5225343 5225364 5225348 5225343 -
ggaaaatacactatatcttaaa

SEQ ID NO: 144399 - DNA, 22 bp, Artificial Sequence
  Synthetic oligonucleotide; CTA chr11 5225330 5225351 5225335 5225330 -
tatcttaaactccatgaaagaa

SEQ ID NO: 144400 - DNA, 22 bp, Artificial Sequence
  Synthetic oligonucleotide; CTT chr11 5225324 5225345 5225329 5225324 -
aaactccatgaaagaaggtgag

SEQ ID NO: 144401 - DNA, 22 bp, Artificial Sequence
  Synthetic oligonucleotide; TTA chr11 5225323 5225344 5225328 5225323 -
aactccatgaaagaaggtgagg

SEQ ID NO: 144402 - DNA, 22 bp, Artificial Sequence
  Synthetic oligonucleotide; CTC chr11 5225318 5225339 5225323 5225318 -
catgaaagaaggtgaggctgca

SEQ ID NO: 144403 - DNA, 22 bp, Artificial Sequence
  Synthetic oligonucleotide; CTG chr11 5225298 5225319 5225303 5225298 -
caaacagctaatgcacattggc

SEQ ID NO: 144404 - DNA, 22 bp, Artificial Sequence
  Synthetic oligonucleotide; CTA chr11 5225288 5225309 5225293 5225288 -
atgcacattggcaacagcccct

SEQ ID NO: 144405 - DNA, 22 bp, Artificial Sequence
  Synthetic oligonucleotide; TTG chr11 5225278 5225299 5225283 5225278 -
gcaacagcccctgatgcatatg

SEQ ID NO: 144406 - DNA, 22 bp, Artificial Sequence
  Synthetic oligonucleotide; CTG chr11 5225265 5225286 5225270 5225265 -
atgcatatgccttattcatccc

SEQ ID NO: 144407 - DNA, 22 bp, Artificial Sequence
  Synthetic oligonucleotide; CTT chr11 5225252 5225273 5225257 5225252 -
attcatccctcagaaaaggatt

SEQ ID NO: 144408 - DNA, 22 bp, Artificial Sequence
  Synthetic oligonucleotide; TTA chr11 5225251 5225272 5225256 5225251 -
ttcatccctcagaaaaggattc

SEQ ID NO: 144409 - DNA, 22 bp, Artificial Sequence
  Synthetic oligonucleotide; TTC chr11 5225248 5225269 5225253 5225248 -
atccctcagaaaaggattcaag

SEQ ID NO: 144410 - DNA, 22 bp, Artificial Sequence
  Synthetic oligonucleotide; CTC chr11 5225241 5225262 5225246 5225241 -
agaaaaggattcaagtagaggc

SEQ ID NO: 144411 - DNA, 22 bp, Artificial Sequence
  Synthetic oligonucleotide; TTC chr11 5225229 5225250 5225234 5225229 -
aagtagaggcttgatttggagg

SEQ ID NO: 144412 - DNA, 22 bp, Artificial Sequence
  Synthetic oligonucleotide; CTT chr11 5225217 5225238 5225222 5225217 -
gatttggaggttaaagttttgc

SEQ ID NO: 144413 - DNA, 22 bp, Artificial Sequence
  Synthetic oligonucleotide; TTG chr11 5225216 5225237 5225221 5225216 -
atttggaggttaaagttttgct

SEQ ID NO: 144414 - DNA, 22 bp, Artificial Sequence
  Synthetic oligonucleotide; TTT chr11 5225212 5225233 5225217 5225212 -
ggaggttaaagttttgctatgc

SEQ ID NO: 144415 - DNA, 22 bp, Artificial Sequence
  Synthetic oligonucleotide; TTG chr11 5225211 5225232 5225216 5225211 -
gaggttaaagttttgctatgct

SEQ ID NO: 144416 - DNA, 22 bp, Artificial Sequence
  Synthetic oligonucleotide; TTA chr11 5225204 5225225 5225209 5225204 -
aagttttgctatgctgtatttt

SEQ ID NO: 144417 - DNA, 22 bp, Artificial Sequence
  Synthetic oligonucleotide; TTT chr11 5225198 5225219 5225203 5225198 -
tgctatgctgtattttacatta

SEQ ID NO: 144418 - DNA, 22 bp, Artificial Sequence
  Synthetic oligonucleotide; TTT chr11 5225197 5225218 5225202 5225197 -
gctatgctgtattttacattac

SEQ ID NO: 144419 - DNA, 22 bp, Artificial Sequence
  Synthetic oligonucleotide; TTG chr11 5225196 5225217 5225201 5225196 -
ctatgctgtattttacattact

SEQ ID NO: 144420 - DNA, 22 bp, Artificial Sequence
  Synthetic oligonucleotide; CTA chr11 5225193 5225214 5225198 5225193 -
tgctgtattttacattacttat

SEQ ID NO: 144421 - DNA, 22 bp, Artificial Sequence
  Synthetic oligonucleotide; CTG chr11 5225188 5225209 5225193 5225188 -
tattttacattacttattgttt

SEQ ID NO: 144422 - DNA, 22 bp, Artificial Sequence
  Synthetic oligonucleotide; TTT chr11 5225183 5225204 5225188 5225183 -
tacattacttattgttttagct

SEQ ID NO: 144423 - DNA, 22 bp, Artificial Sequence
  Synthetic oligonucleotide; TTT chr11 5225182 5225203 5225187 5225182 -
acattacttattgttttagctg

SEQ ID NO: 144424 - DNA, 22 bp, Artificial Sequence
  Synthetic oligonucleotide; TTA chr11 5225181 5225202 5225186 5225181 -
cattacttattgttttagctgt

SEQ ID NO: 144425 - DNA, 22 bp, Artificial Sequence
  Synthetic oligonucleotide; TTA chr11 5225176 5225197 5225181 5225176 -
cttattgttttagctgtcctca

SEQ ID NO: 144426 - DNA, 22 bp, Artificial Sequence
  Synthetic oligonucleotide; CTT chr11 5225173 5225194 5225178 5225173 -
attgttttagctgtcctcatga

SEQ ID NO: 144427 - DNA, 22 bp, Artificial Sequence
  Synthetic oligonucleotide; TTA chr11 5225172 5225193 5225177 5225172 -
ttgttttagctgtcctcatgaa

SEQ ID NO: 144428 - DNA, 22 bp, Artificial Sequence
  Synthetic oligonucleotide; TTG chr11 5225169 5225190 5225174 5225169 -
ttttagctgtcctcatgaatgt

SEQ ID NO: 144429 - DNA, 22 bp, Artificial Sequence
  Synthetic oligonucleotide; TTT chr11 5225166 5225187 5225171 5225166 -
tagctgtcctcatgaatgtctt

SEQ ID NO: 144430 - DNA, 22 bp, Artificial Sequence
  Synthetic oligonucleotide; TTT chr11 5225165 5225186 5225170 5225165 -
agctgtcctcatgaatgtcttt

SEQ ID NO: 144431 - DNA, 22 bp, Artificial Sequence
  Synthetic oligonucleotide; TTA chr11 5225164 5225185 5225169 5225164 -
gctgtcctcatgaatgtctttt

SEQ ID NO: 144432 - DNA, 22 bp, Artificial Sequence
  Synthetic oligonucleotide; CTG chr11 5225160 5225181 5225165 5225160 -
tcctcatgaatgtcttttcact

SEQ ID NO: 144433 - DNA, 22 bp, Artificial Sequence
  Synthetic oligonucleotide; CTC chr11 5225155 5225176 5225160 5225155 -
atgaatgtcttttcactaccca

SEQ ID NO: 144434 - DNA, 22 bp, Artificial Sequence
  Synthetic oligonucleotide; CTT chr11 5225144 5225165 5225149 5225144 -
ttcactacccatttgcttatcc

SEQ ID NO: 144435 - DNA, 22 bp, Artificial Sequence
  Synthetic oligonucleotide; TTT chr11 5225143 5225164 5225148 5225143 -
tcactacccatttgcttatcct

SEQ ID NO: 144436 - DNA, 22 bp, Artificial Sequence
  Synthetic oligonucleotide; TTT chr11 5225142 5225163 5225147 5225142 -
cactacccatttgcttatcctg

SEQ ID NO: 144437 - DNA, 22 bp, Artificial Sequence
  Synthetic oligonucleotide; TTC chr11 5225141 5225162 5225146 5225141 -
actacccatttgcttatcctgc

SEQ ID NO: 144438 - DNA, 22 bp, Artificial Sequence
  Synthetic oligonucleotide; CTA chr11 5225137 5225158 5225142 5225137 -
cccatttgcttatcctgcatct

SEQ ID NO: 144439 - DNA, 22 bp, Artificial Sequence
  Synthetic oligonucleotide; TTT chr11 5225130 5225151 5225135 5225130 -
gcttatcctgcatctctcagcc

SEQ ID NO: 144440 - DNA, 22 bp, Artificial Sequence
  Synthetic oligonucleotide; TTG chr11 5225129 5225150 5225134 5225129 -
cttatcctgcatctctcagcct

SEQ ID NO: 144441 - DNA, 22 bp, Artificial Sequence
  Synthetic oligonucleotide; CTT chr11 5225126 5225147 5225131 5225126 -
atcctgcatctctcagccttga

SEQ ID NO: 144442 - DNA, 22 bp, Artificial Sequence
  Synthetic oligonucleotide; TTA chr11 5225125 5225146 5225130 5225125 -
tcctgcatctctcagccttgac

SEQ ID NO: 144443 - DNA, 22 bp, Artificial Sequence
  Synthetic oligonucleotide; CTG chr11 5225120 5225141 5225125 5225120 -
catctctcagccttgactccac

SEQ ID NO: 144444 - DNA, 22 bp, Artificial Sequence
  Synthetic oligonucleotide; CTC chr11 5225114 5225135 5225119 5225114 -
tcagccttgactccactcagtt

SEQ ID NO: 144445 - DNA, 22 bp, Artificial Sequence
  Synthetic oligonucleotide; CTC chr11 5225112 5225133 5225117 5225112 -
agccttgactccactcagttct

SEQ ID NO: 144446 - DNA, 22 bp, Artificial Sequence
  Synthetic oligonucleotide; CTT chr11 5225106 5225127 5225111 5225106 -
gactccactcagttctcttgct

SEQ ID NO: 144447 - DNA, 22 bp, Artificial Sequence
  Synthetic oligonucleotide; TTG chr11 5225105 5225126 5225110 5225105 -
actccactcagttctcttgctt

SEQ ID NO: 144448 - DNA, 22 bp, Artificial Sequence
  Synthetic oligonucleotide; CTC chr11 5225101 5225122 5225106 5225101 -
cactcagttctcttgcttagag

SEQ ID NO: 144449 - DNA, 22 bp, Artificial Sequence
  Synthetic oligonucleotide; CTC chr11 5225096 5225117 5225101 5225096 -
agttctcttgcttagagatacc

SEQ ID NO: 144450 - DNA, 22 bp, Artificial Sequence
  Synthetic oligonucleotide; TTC chr11 5225091 5225112 5225096 5225091 -
tcttgcttagagataccacctt

SEQ ID NO: 144451 - DNA, 22 bp, Artificial Sequence
  Synthetic oligonucleotide; CTC chr11 5225089 5225110 5225094 5225089 -
ttgcttagagataccacctttc

SEQ ID NO: 144452 - DNA, 22 bp, Artificial Sequence
  Synthetic oligonucleotide; CTT chr11 5225087 5225108 5225092 5225087 -
gcttagagataccacctttccc

SEQ ID NO: 144453 - DNA, 22 bp, Artificial Sequence
  Synthetic oligonucleotide; TTG chr11 5225086 5225107 5225091 5225086 -
cttagagataccacctttcccc

SEQ ID NO: 144454 - DNA, 22 bp, Artificial Sequence
  Synthetic oligonucleotide; CTT chr11 5225083 5225104 5225088 5225083 -
agagataccacctttcccctga

SEQ ID NO: 144455 - DNA, 22 bp, Artificial Sequence
  Synthetic oligonucleotide; TTA chr11 5225082 5225103 5225087 5225082 -
gagataccacctttcccctgaa

SEQ ID NO: 144456 - DNA, 22 bp, Artificial Sequence
  Synthetic oligonucleotide; CTT chr11 5225069 5225090 5225074 5225069 -
tcccctgaagtgttccttccat

SEQ ID NO: 144457 - DNA, 22 bp, Artificial Sequence
  Synthetic oligonucleotide; TTT chr11 5225068 5225089 5225073 5225068 -
cccctgaagtgttccttccatg

SEQ ID NO: 144458 - DNA, 22 bp, Artificial Sequence
  Synthetic oligonucleotide; TTC chr11 5225067 5225088 5225072 5225067 -
ccctgaagtgttccttccatgt

SEQ ID NO: 144459 - DNA, 22 bp, Artificial Sequence
  Synthetic oligonucleotide; CTG chr11 5225062 5225083 5225067 5225062 -
aagtgttccttccatgttttac

SEQ ID NO: 144460 - DNA, 22 bp, Artificial Sequence
  Synthetic oligonucleotide; TTC chr11 5225054 5225075 5225059 5225054 -
cttccatgttttacggcgagat

SEQ ID NO: 144461 - DNA, 22 bp, Artificial Sequence
  Synthetic oligonucleotide; CTT chr11 5225051 5225072 5225056 5225051 -
ccatgttttacggcgagatggt

SEQ ID NO: 144462 - DNA, 22 bp, Artificial Sequence
  Synthetic oligonucleotide; TTC chr11 5225050 5225071 5225055 5225050 -
catgttttacggcgagatggtt

SEQ ID NO: 144463 - DNA, 22 bp, Artificial Sequence
  Synthetic oligonucleotide; TTT chr11 5225043 5225064 5225048 5225043 -
tacggcgagatggtttctcctc

SEQ ID NO: 144464 - DNA, 22 bp, Artificial Sequence
  Synthetic oligonucleotide; TTT chr11 5225042 5225063 5225047 5225042 -
acggcgagatggtttctcctcg

SEQ ID NO: 144465 - DNA, 22 bp, Artificial Sequence
  Synthetic oligonucleotide; TTA chr11 5225041 5225062 5225046 5225041 -
cggcgagatggtttctcctcgc

SEQ ID NO: 144466 - DNA, 22 bp, Artificial Sequence
  Synthetic oligonucleotide; TTT chr11 5225027 5225048 5225032 5225027 -
ctcctcgcctggccactcagcc

SEQ ID NO: 144467 - DNA, 22 bp, Artificial Sequence
  Synthetic oligonucleotide; TTC chr11 5225026 5225047 5225031 5225026 -
tcctcgcctggccactcagcct

SEQ ID NO: 144468 - DNA, 22 bp, Artificial Sequence
  Synthetic oligonucleotide; CTC chr11 5225024 5225045 5225029 5225024 -
ctcgcctggccactcagcctta

SEQ ID NO: 144469 - DNA, 22 bp, Artificial Sequence
  Synthetic oligonucleotide; CTC chr11 5225021 5225042 5225026 5225021 -
gcctggccactcagccttagtt

SEQ ID NO: 144470 - DNA, 22 bp, Artificial Sequence
  Synthetic oligonucleotide; CTG chr11 5225016 5225037 5225021 5225016 -
gccactcagccttagttgtctc

SEQ ID NO: 144471 - DNA, 22 bp, Artificial Sequence
  Synthetic oligonucleotide; CTC chr11 5225009 5225030 5225014 5225009 -
agccttagttgtctctgttgtc

SEQ ID NO: 144472 - DNA, 22 bp, Artificial Sequence
  Synthetic oligonucleotide; CTT chr11 5225003 5225024 5225008 5225003 -
agttgtctctgttgtcttatag

SEQ ID NO: 144473 - DNA, 22 bp, Artificial Sequence
  Synthetic oligonucleotide; TTA chr11 5225002 5225023 5225007 5225002 -
gttgtctctgttgtcttataga

SEQ ID NO: 144474 - DNA, 22 bp, Artificial Sequence
  Synthetic oligonucleotide; TTG chr11 5224998 5225019 5225003 5224998 -
tctctgttgtcttatagaggtc

SEQ ID NO: 144475 - DNA, 22 bp, Artificial Sequence
  Synthetic oligonucleotide; CTC chr11 5224994 5225015 5224999 5224994 -
tgttgtcttatagaggtctact

SEQ ID NO: 144476 - DNA, 22 bp, Artificial Sequence
  Synthetic oligonucleotide; CTG chr11 5224992 5225013 5224997 5224992 -
ttgtcttatagaggtctacttg

SEQ ID NO: 144477 - DNA, 22 bp, Artificial Sequence
  Synthetic oligonucleotide; TTG chr11 5224989 5225010 5224994 5224989 -
tcttatagaggtctacttgaag

SEQ ID NO: 144478 - DNA, 22 bp, Artificial Sequence
  Synthetic oligonucleotide; CTT chr11 5224985 5225006 5224990 5224985 -
atagaggtctacttgaagaagg

SEQ ID NO: 144479 - DNA, 22 bp, Artificial Sequence
  Synthetic oligonucleotide; TTA chr11 5224984 5225005 5224989 5224984 -
tagaggtctacttgaagaagga

SEQ ID NO: 144480 - DNA, 22 bp, Artificial Sequence
  Synthetic oligonucleotide; CTA chr11 5224974 5224995 5224979 5224974 -
cttgaagaaggaaaaacagggg

SEQ ID NO: 144481 - DNA, 22 bp, Artificial Sequence
  Synthetic oligonucleotide; CTT chr11 5224971 5224992 5224976 5224971 -
gaagaaggaaaaacaggggtca

SEQ ID NO: 144482 - DNA, 22 bp, Artificial Sequence
  Synthetic oligonucleotide; TTG chr11 5224970 5224991 5224975 5224970 -
aagaaggaaaaacaggggtcat

SEQ ID NO: 144483 - DNA, 22 bp, Artificial Sequence
  Synthetic oligonucleotide; TTT chr11 5224943 5224964 5224948 5224943 -
gactgtcctgtgagcccttctt

SEQ ID NO: 144484 - DNA, 22 bp, Artificial Sequence
  Synthetic oligonucleotide; TTG chr11 5224942 5224963 5224947 5224942 -
actgtcctgtgagcccttcttc

SEQ ID NO: 144485 - DNA, 22 bp, Artificial Sequence
  Synthetic oligonucleotide; CTG chr11 5224938 5224959 5224943 5224938 -
tcctgtgagcccttcttccctg

SEQ ID NO: 144486 - DNA, 22 bp, Artificial Sequence
  Synthetic oligonucleotide; CTG chr11 5224933 5224954 5224938 5224933 -
tgagcccttcttccctgcctcc

SEQ ID NO: 144487 - DNA, 22 bp, Artificial Sequence
  Synthetic oligonucleotide; CTT chr11 5224924 5224945 5224929 5224924 -
cttccctgcctcccccactcac

SEQ ID NO: 144488 - DNA, 22 bp, Artificial Sequence
  Synthetic oligonucleotide; TTC chr11 5224923 5224944 5224928 5224923 -
ttccctgcctcccccactcaca

SEQ ID NO: 144489 - DNA, 22 bp, Artificial Sequence
  Synthetic oligonucleotide; CTT chr11 5224921 5224942 5224926 5224921 -
ccctgcctcccccactcacagt

SEQ ID NO: 144490 - DNA, 22 bp, Artificial Sequence
  Synthetic oligonucleotide; TTC chr11 5224920 5224941 5224925 5224920 -
cctgcctcccccactcacagtg

SEQ ID NO: 144491 - DNA, 22 bp, Artificial Sequence
  Synthetic oligonucleotide; CTG chr11 5224916 5224937 5224921 5224916 -
cctcccccactcacagtgaccc

SEQ ID NO: 144492 - DNA, 22 bp, Artificial Sequence
  Synthetic oligonucleotide; CTC chr11 5224912 5224933 5224917 5224912 -
ccccactcacagtgacccggaa

SEQ ID NO: 144493 - DNA, 22 bp, Artificial Sequence
  Synthetic oligonucleotide; CTC chr11 5224904 5224925 5224909 5224904 -
acagtgacccggaatctgcagt

SEQ ID NO: 144494 - DNA, 22 bp, Artificial Sequence
  Synthetic oligonucleotide; CTG chr11 5224886 5224907 5224891 5224886 -
cagtgctagtctcccggaacta

SEQ ID NO: 144495 - DNA, 22 bp, Artificial Sequence
  Synthetic oligonucleotide; CTA chr11 5224878 5224899 5224883 5224878 -
gtctcccggaactatcactctt

SEQ ID NO: 144496 - DNA, 22 bp, Artificial Sequence
  Synthetic oligonucleotide; CTC chr11 5224873 5224894 5224878 5224873 -
ccggaactatcactctttcaca

SEQ ID NO: 144497 - DNA, 22 bp, Artificial Sequence
  Synthetic oligonucleotide; CTA chr11 5224864 5224885 5224869 5224864 -
tcactctttcacagtctgcttt

SEQ ID NO: 144498 - DNA, 22 bp, Artificial Sequence
  Synthetic oligonucleotide; CTC chr11 5224858 5224879 5224863 5224858 -
tttcacagtctgctttggaagg

SEQ ID NO: 144499 - DNA, 22 bp, Artificial Sequence
  Synthetic oligonucleotide; CTT chr11 5224856 5224877 5224861 5224856 -
tcacagtctgctttggaaggac

SEQ ID NO: 144500 - DNA, 22 bp, Artificial Sequence
  Synthetic oligonucleotide; TTT chr11 5224855 5224876 5224860 5224855 -
cacagtctgctttggaaggact

SEQ ID NO: 144501 - DNA, 22 bp, Artificial Sequence
  Synthetic oligonucleotide; TTC chr11 5224854 5224875 5224859 5224854 -
acagtctgctttggaaggactg

SEQ ID NO: 144502 - DNA, 22 bp, Artificial Sequence
  Synthetic oligonucleotide; CTG chr11 5224846 5224867 5224851 5224846 -
ctttggaaggactgggcttagt

SEQ ID NO: 144503 - DNA, 22 bp, Artificial Sequence
  Synthetic oligonucleotide; CTT chr11 5224843 5224864 5224848 5224843 -
tggaaggactgggcttagtatg

SEQ ID NO: 144504 - DNA, 22 bp, Artificial Sequence
  Synthetic oligonucleotide; TTT chr11 5224842 5224863 5224847 5224842 -
ggaaggactgggcttagtatga

SEQ ID NO: 144505 - DNA, 22 bp, Artificial Sequence
  Synthetic oligonucleotide; TTG chr11 5224841 5224862 5224846 5224841 -
gaaggactgggcttagtatgaa

SEQ ID NO: 144506 - DNA, 22 bp, Artificial Sequence
  Synthetic oligonucleotide; CTG chr11 5224832 5224853 5224837 5224832 -
ggcttagtatgaaaagttagga

SEQ ID NO: 144507 - DNA, 22 bp, Artificial Sequence
  Synthetic oligonucleotide; CTT chr11 5224827 5224848 5224832 5224827 -
agtatgaaaagttaggactgag

SEQ ID NO: 144508 - DNA, 22 bp, Artificial Sequence
  Synthetic oligonucleotide; TTA chr11 5224826 5224847 5224831 5224826 -
gtatgaaaagttaggactgaga

SEQ ID NO: 144509 - DNA, 22 bp, Artificial Sequence
  Synthetic oligonucleotide; TTA chr11 5224813 5224834 5224818 5224813 -
ggactgagaagaatttgaaagg

SEQ ID NO: 144510 - DNA, 22 bp, Artificial Sequence
  Synthetic oligonucleotide; CTG chr11 5224807 5224828 5224812 5224807 -
agaagaatttgaaaggcggctt

SEQ ID NO: 144511 - DNA, 22 bp, Artificial Sequence
  Synthetic oligonucleotide; TTT chr11 5224797 5224818 5224802 5224797 -
gaaaggcggctttttgtagctt

SEQ ID NO: 144512 - DNA, 22 bp, Artificial Sequence
  Synthetic oligonucleotide; TTG chr11 5224796 5224817 5224801 5224796 -
aaaggcggctttttgtagcttg

SEQ ID NO: 144513 - DNA, 22 bp, Artificial Sequence
  Synthetic oligonucleotide; CTT chr11 5224785 5224806 5224790 5224785 -
tttgtagcttgatattcactac

SEQ ID NO: 144514 - DNA, 22 bp, Artificial Sequence
  Synthetic oligonucleotide; TTT chr11 5224784 5224805 5224789 5224784 -
ttgtagcttgatattcactact

SEQ ID NO: 144515 - DNA, 22 bp, Artificial Sequence
  Synthetic oligonucleotide; TTT chr11 5224783 5224804 5224788 5224783 -
tgtagcttgatattcactactg

SEQ ID NO: 144516 - DNA, 22 bp, Artificial Sequence
  Synthetic oligonucleotide; TTT chr11 5224782 5224803 5224787 5224782 -
gtagcttgatattcactactgt

SEQ ID NO: 144517 - DNA, 22 bp, Artificial Sequence
  Synthetic oligonucleotide; TTG chr11 5224781 5224802 5224786 5224781 -
tagcttgatattcactactgtc

SEQ ID NO: 144518 - DNA, 22 bp, Artificial Sequence
  Synthetic oligonucleotide; CTT chr11 5224775 5224796 5224780 5224775 -
gatattcactactgtcttatta

SEQ ID NO: 144519 - DNA, 22 bp, Artificial Sequence
  Synthetic oligonucleotide; TTG chr11 5224774 5224795 5224779 5224774 -
atattcactactgtcttattac

SEQ ID NO: 144520 - DNA, 22 bp, Artificial Sequence
  Synthetic oligonucleotide; TTC chr11 5224768 5224789 5224773 5224768 -
actactgtcttattaccctgtc

SEQ ID NO: 144521 - DNA, 22 bp, Artificial Sequence
  Synthetic oligonucleotide; CTA chr11 5224764 5224785 5224769 5224764 -
ctgtcttattaccctgtcatag

SEQ ID NO: 144522 - DNA, 22 bp, Artificial Sequence
  Synthetic oligonucleotide; CTG chr11 5224761 5224782 5224766 5224761 -
tcttattaccctgtcataggcc

SEQ ID NO: 144523 - DNA, 22 bp, Artificial Sequence
  Synthetic oligonucleotide; CTT chr11 5224757 5224778 5224762 5224757 -
attaccctgtcataggcccacc

SEQ ID NO: 144524 - DNA, 22 bp, Artificial Sequence
  Synthetic oligonucleotide; TTA chr11 5224756 5224777 5224761 5224756 -
ttaccctgtcataggcccaccc

SEQ ID NO: 144525 - DNA, 22 bp, Artificial Sequence
  Synthetic oligonucleotide; TTA chr11 5224753 5224774 5224758 5224753 -
ccctgtcataggcccaccccaa

SEQ ID NO: 144526 - DNA, 22 bp, Artificial Sequence
  Synthetic oligonucleotide; CTG chr11 5224748 5224769 5224753 5224748 -
tcataggcccaccccaaatgga

SEQ ID NO: 144527 - DNA, 22 bp, Artificial Sequence
  Synthetic oligonucleotide; TTC chr11 5224716 5224737 5224721 5224716 -
ttcctcaggatgtttaagatta

SEQ ID NO: 144528 - DNA, 22 bp, Artificial Sequence
  Synthetic oligonucleotide; CTT chr11 5224714 5224735 5224719 5224714 -
cctcaggatgtttaagattagc

SEQ ID NO: 144529 - DNA, 22 bp, Artificial Sequence
  Synthetic oligonucleotide; TTC chr11 5224713 5224734 5224718 5224713 -
ctcaggatgtttaagattagca

SEQ ID NO: 144530 - DNA, 22 bp, Artificial Sequence
  Synthetic oligonucleotide; CTC chr11 5224710 5224731 5224715 5224710 -
aggatgtttaagattagcattc

SEQ ID NO: 144531 - DNA, 22 bp, Artificial Sequence
  Synthetic oligonucleotide; TTT chr11 5224701 5224722 5224706 5224701 -
aagattagcattcaggaagaga

SEQ ID NO: 144532 - DNA, 22 bp, Artificial Sequence
  Synthetic oligonucleotide; TTA chr11 5224700 5224721 5224705 5224700 -
agattagcattcaggaagagat

SEQ ID NO: 144533 - DNA, 22 bp, Artificial Sequence
  Synthetic oligonucleotide; TTA chr11 5224694 5224715 5224699 5224694 -
gcattcaggaagagatcagagg

SEQ ID NO: 144534 - DNA, 22 bp, Artificial Sequence
  Synthetic oligonucleotide; TTC chr11 5224688 5224709 5224693 5224688 -
aggaagagatcagaggtctgct

SEQ ID NO: 144535 - DNA, 22 bp, Artificial Sequence
  Synthetic oligonucleotide; CTG chr11 5224668 5224689 5224673 5224668 -
ctggctcccttatcatgtccct

SEQ ID NO: 144536 - DNA, 22 bp, Artificial Sequence
  Synthetic oligonucleotide; CTG chr11 5224665 5224686 5224670 5224665 -
gctcccttatcatgtcccttat

SEQ ID NO: 144537 - DNA, 22 bp, Artificial Sequence
  Synthetic oligonucleotide; CTC chr11 5224661 5224682 5224666 5224661 -
ccttatcatgtcccttatggtg

SEQ ID NO: 144538 - DNA, 22 bp, Artificial Sequence
  Synthetic oligonucleotide; CTT chr11 5224657 5224678 5224662 5224657 -
atcatgtcccttatggtgcttc

SEQ ID NO: 144539 - DNA, 22 bp, Artificial Sequence
  Synthetic oligonucleotide; TTA chr11 5224656 5224677 5224661 5224656 -
tcatgtcccttatggtgcttct

SEQ ID NO: 144540 - DNA, 22 bp, Artificial Sequence
  Synthetic oligonucleotide; CTT chr11 5224645 5224666 5224650 5224645 -
atggtgcttctggctctgcagt

SEQ ID NO: 144541 - DNA, 22 bp, Artificial Sequence
  Synthetic oligonucleotide; TTA chr11 5224644 5224665 5224649 5224644 -
tggtgcttctggctctgcagtt

SEQ ID NO: 144542 - DNA, 22 bp, Artificial Sequence
  Synthetic oligonucleotide; CTT chr11 5224636 5224657 5224641 5224636 -
ctggctctgcagttattagcat

SEQ ID NO: 144543 - DNA, 22 bp, Artificial Sequence
  Synthetic oligonucleotide; TTC chr11 5224635 5224656 5224640 5224635 -
tggctctgcagttattagcata

SEQ ID NO: 144544 - DNA, 22 bp, Artificial Sequence
  Synthetic oligonucleotide; CTG chr11 5224633 5224654 5224638 5224633 -
gctctgcagttattagcatagt

SEQ ID NO: 144545 - DNA, 22 bp, Artificial Sequence
  Synthetic oligonucleotide; CTC chr11 5224629 5224650 5224634 5224629 -
tgcagttattagcatagtgtta

SEQ ID NO: 144546 - DNA, 22 bp, Artificial Sequence
  Synthetic oligonucleotide; CTG chr11 5224627 5224648 5224632 5224627 -
cagttattagcatagtgttacc

SEQ ID NO: 144547 - DNA, 22 bp, Artificial Sequence
  Synthetic oligonucleotide; TTA chr11 5224621 5224642 5224626 5224621 -
ttagcatagtgttaccatcaac

SEQ ID NO: 144548 - DNA, 22 bp, Artificial Sequence
  Synthetic oligonucleotide; TTA chr11 5224618 5224639 5224623 5224618 -
gcatagtgttaccatcaaccac

SEQ ID NO: 144549 - DNA, 22 bp, Artificial Sequence
  Synthetic oligonucleotide; TTA chr11 5224607 5224628 5224612 5224607 -
ccatcaaccaccttaacttcat

SEQ ID NO: 144550 - DNA, 22 bp, Artificial Sequence
  Synthetic oligonucleotide; CTT chr11 5224593 5224614 5224598 5224593 -
aacttcatttttcttattcaat

SEQ ID NO: 144551 - DNA, 22 bp, Artificial Sequence
  Synthetic oligonucleotide; TTA chr11 5224592 5224613 5224597 5224592 -
acttcatttttcttattcaata

SEQ ID NO: 144552 - DNA, 22 bp, Artificial Sequence
  Synthetic oligonucleotide; CTT chr11 5224588 5224609 5224593 5224588 -
catttttcttattcaataccta

SEQ ID NO: 144553 - DNA, 22 bp, Artificial Sequence
  Synthetic oligonucleotide; TTC chr11 5224587 5224608 5224592 5224587 -
atttttcttattcaatacctag

SEQ ID NO: 144554 - DNA, 22 bp, Artificial Sequence
  Synthetic oligonucleotide; TTT chr11 5224583 5224604 5224588 5224583 -
ttcttattcaatacctaggtag

SEQ ID NO: 144555 - DNA, 22 bp, Artificial Sequence
  Synthetic oligonucleotide; TTT chr11 5224582 5224603 5224587 5224582 -
tcttattcaatacctaggtagg

SEQ ID NO: 144556 - DNA, 22 bp, Artificial Sequence
  Synthetic oligonucleotide; TTT chr11 5224581 5224602 5224586 5224581 -
cttattcaatacctaggtaggt

SEQ ID NO: 144557 - DNA, 22 bp, Artificial Sequence
  Synthetic oligonucleotide; TTC chr11 5224580 5224601 5224585 5224580 -
ttattcaatacctaggtaggta

SEQ ID NO: 144558 - DNA, 22 bp, Artificial Sequence
  Synthetic oligonucleotide; CTT chr11 5224578 5224599 5224583 5224578 -
attcaatacctaggtaggtaga

SEQ ID NO: 144559 - DNA, 22 bp, Artificial Sequence
  Synthetic oligonucleotide; TTA chr11 5224577 5224598 5224582 5224577 -
ttcaatacctaggtaggtagat

SEQ ID NO: 144560 - DNA, 22 bp, Artificial Sequence
  Synthetic oligonucleotide; TTC chr11 5224574 5224595 5224579 5224574 -
aatacctaggtaggtagatgct

SEQ ID NO: 144561 - DNA, 22 bp, Artificial Sequence
  Synthetic oligonucleotide; CTA chr11 5224566 5224587 5224571 5224566 -
ggtaggtagatgctagattctg

SEQ ID NO: 144562 - DNA, 22 bp, Artificial Sequence
  Synthetic oligonucleotide; CTA chr11 5224551 5224572 5224556 5224551 -
gattctggaaataaaatatgag

SEQ ID NO: 144563 - DNA, 22 bp, Artificial Sequence
  Synthetic oligonucleotide; TTC chr11 5224546 5224567 5224551 5224546 -
tggaaataaaatatgagtctca

SEQ ID NO: 144564 - DNA, 22 bp, Artificial Sequence
  Synthetic oligonucleotide; CTG chr11 5224544 5224565 5224549 5224544 -
gaaataaaatatgagtctcaag

SEQ ID NO: 144565 - DNA, 22 bp, Artificial Sequence
  Synthetic oligonucleotide; CTC chr11 5224525 5224546 5224530 5224525 -
aagtggtccttgtcctctctcc

SEQ ID NO: 144566 - DNA, 22 bp, Artificial Sequence
  Synthetic oligonucleotide; CTT chr11 5224514 5224535 5224519 5224514 -
gtcctctctcccagtcaaattc

SEQ ID NO: 144567 - DNA, 22 bp, Artificial Sequence
  Synthetic oligonucleotide; TTG chr11 5224513 5224534 5224518 5224513 -
tcctctctcccagtcaaattct

SEQ ID NO: 144568 - DNA, 22 bp, Artificial Sequence
  Synthetic oligonucleotide; CTC chr11 5224508 5224529 5224513 5224508 -
tctcccagtcaaattctgaatc

SEQ ID NO: 144569 - DNA, 22 bp, Artificial Sequence
  Synthetic oligonucleotide; CTC chr11 5224506 5224527 5224511 5224506 -
tcccagtcaaattctgaatcta

SEQ ID NO: 144570 - DNA, 22 bp, Artificial Sequence
  Synthetic oligonucleotide; CTC chr11 5224504 5224525 5224509 5224504 -
ccagtcaaattctgaatctagt

SEQ ID NO: 144571 - DNA, 22 bp, Artificial Sequence
  Synthetic oligonucleotide; TTC chr11 5224492 5224513 5224497 5224492 -
tgaatctagttggcaagattct

SEQ ID NO: 144572 - DNA, 22 bp, Artificial Sequence
  Synthetic oligonucleotide; CTG chr11 5224490 5224511 5224495 5224490 -
aatctagttggcaagattctga

SEQ ID NO: 144573 - DNA, 22 bp, Artificial Sequence
  Synthetic oligonucleotide; CTA chr11 5224484 5224505 5224489 5224484 -
gttggcaagattctgaaatcaa

SEQ ID NO: 144574 - DNA, 22 bp, Artificial Sequence
  Synthetic oligonucleotide; TTG chr11 5224480 5224501 5224485 5224480 -
gcaagattctgaaatcaaggca

SEQ ID NO: 144575 - DNA, 22 bp, Artificial Sequence
  Synthetic oligonucleotide; TTC chr11 5224471 5224492 5224476 5224471 -
tgaaatcaaggcatataatcag

SEQ ID NO: 144576 - DNA, 22 bp, Artificial Sequence
  Synthetic oligonucleotide; CTG chr11 5224469 5224490 5224474 5224469 -
aaatcaaggcatataatcagta

SEQ ID NO: 144577 - DNA, 22 bp, Artificial Sequence
  Synthetic oligonucleotide; TTT chr11 5224413 5224434 5224418 5224413 -
tattatatgagagggtgaaacc

SEQ ID NO: 144578 - DNA, 22 bp, Artificial Sequence
  Synthetic oligonucleotide; TTT chr11 5224412 5224433 5224417 5224412 -
attatatgagagggtgaaaccc

SEQ ID NO: 144579 - DNA, 22 bp, Artificial Sequence
  Synthetic oligonucleotide; TTA chr11 5224411 5224432 5224416 5224411 -
ttatatgagagggtgaaaccct

SEQ ID NO: 144580 - DNA, 22 bp, Artificial Sequence
  Synthetic oligonucleotide; TTA chr11 5224408 5224429 5224413 5224408 -
tatgagagggtgaaaccctcaa

SEQ ID NO: 144581 - DNA, 22 bp, Artificial Sequence
  Synthetic oligonucleotide; CTC chr11 5224388 5224409 5224393 5224388 -
aaaatgaaatgaaatcagaccc

SEQ ID NO: 144582 - DNA, 22 bp, Artificial Sequence
  Synthetic oligonucleotide; CTT chr11 5224364 5224385 5224369 5224364 -
gtcttacaccataaacaaaaat

SEQ ID NO: 144583 - DNA, 22 bp, Artificial Sequence
  Synthetic oligonucleotide; TTG chr11 5224363 5224384 5224368 5224363 -
tcttacaccataaacaaaaata

SEQ ID NO: 144584 - DNA, 22 bp, Artificial Sequence
  Synthetic oligonucleotide; CTT chr11 5224359 5224380 5224364 5224359 -
acaccataaacaaaaataaatt

SEQ ID NO: 144585 - DNA, 22 bp, Artificial Sequence
  Synthetic oligonucleotide; TTA chr11 5224358 5224379 5224363 5224358 -
caccataaacaaaaataaattt

SEQ ID NO: 144586 - DNA, 22 bp, Artificial Sequence
  Synthetic oligonucleotide; TTT chr11 5224336 5224357 5224341 5224336 -
gaatgggttaaagaattaaact

SEQ ID NO: 144587 - DNA, 22 bp, Artificial Sequence
  Synthetic oligonucleotide; TTG chr11 5224335 5224356 5224340 5224335 -
aatgggttaaagaattaaacta

SEQ ID NO: 144588 - DNA, 22 bp, Artificial Sequence
  Synthetic oligonucleotide; TTA chr11 5224326 5224347 5224331 5224326 -
aagaattaaactaagacctaaa

SEQ ID NO: 144589 - DNA, 22 bp, Artificial Sequence
  Synthetic oligonucleotide; TTA chr11 5224318 5224339 5224323 5224318 -
aactaagacctaaaaccataaa

SEQ ID NO: 144590 - DNA, 22 bp, Artificial Sequence
  Synthetic oligonucleotide; CTA chr11 5224313 5224334 5224318 5224313 -
agacctaaaaccataaaaattt

SEQ ID NO: 144591 - DNA, 22 bp, Artificial Sequence
  Synthetic oligonucleotide; CTA chr11 5224306 5224327 5224311 5224306 -
aaaccataaaaatttttaaaga

SEQ ID NO: 144592 - DNA, 22 bp, Artificial Sequence
  Synthetic oligonucleotide; TTT chr11 5224291 5224312 5224296 5224291 -
ttaaagaaatcaaaagaagaaa

SEQ ID NO: 144593 - DNA, 22 bp, Artificial Sequence
  Synthetic oligonucleotide; TTT chr11 5224290 5224311 5224295 5224290 -
taaagaaatcaaaagaagaaaa

SEQ ID NO: 144594 - DNA, 22 bp, Artificial Sequence
  Synthetic oligonucleotide; TTT chr11 5224289 5224310 5224294 5224289 -
aaagaaatcaaaagaagaaaat

SEQ ID NO: 144595 - DNA, 22 bp, Artificial Sequence
  Synthetic oligonucleotide; TTA chr11 5224288 5224309 5224293 5224288 -
aagaaatcaaaagaagaaaatt

SEQ ID NO: 144596 - DNA, 22 bp, Artificial Sequence
  Synthetic oligonucleotide; TTC chr11 5224265 5224286 5224270 5224265 -
taatattcacgttgcagccgtt

SEQ ID NO: 144597 - DNA, 22 bp, Artificial Sequence
  Synthetic oligonucleotide; CTA chr11 5224263 5224284 5224268 5224263 -
atattcacgttgcagccgtttt

SEQ ID NO: 144598 - DNA, 22 bp, Artificial Sequence
  Synthetic oligonucleotide; TTC chr11 5224257 5224278 5224262 5224257 -
acgttgcagccgttttttgaat

SEQ ID NO: 144599 - DNA, 22 bp, Artificial Sequence
  Synthetic oligonucleotide; TTG chr11 5224251 5224272 5224256 5224251 -
cagccgttttttgaatttgata

SEQ ID NO: 144600 - DNA, 22 bp, Artificial Sequence
  Synthetic oligonucleotide; TTT chr11 5224242 5224263 5224247 5224242 -
tttgaatttgatatgagaagca

SEQ ID NO: 144601 - DNA, 22 bp, Artificial Sequence
  Synthetic oligonucleotide; TTT chr11 5224241 5224262 5224246 5224241 -
ttgaatttgatatgagaagcaa

SEQ ID NO: 144602 - DNA, 22 bp, Artificial Sequence
  Synthetic oligonucleotide; TTT chr11 5224240 5224261 5224245 5224240 -
tgaatttgatatgagaagcaaa

SEQ ID NO: 144603 - DNA, 22 bp, Artificial Sequence
  Synthetic oligonucleotide; TTT chr11 5224239 5224260 5224244 5224239 -
gaatttgatatgagaagcaaag

SEQ ID NO: 144604 - DNA, 22 bp, Artificial Sequence
  Synthetic oligonucleotide; TTG chr11 5224238 5224259 5224243 5224238 -
aatttgatatgagaagcaaagg

SEQ ID NO: 144605 - DNA, 22 bp, Artificial Sequence
  Synthetic oligonucleotide; TTT chr11 5224233 5224254 5224238 5224233 -
gatatgagaagcaaaggcaaca

SEQ ID NO: 144606 - DNA, 22 bp, Artificial Sequence
  Synthetic oligonucleotide; TTG chr11 5224232 5224253 5224237 5224232 -
atatgagaagcaaaggcaacaa

SEQ ID NO: 144607 - DNA, 22 bp, Artificial Sequence
  Synthetic oligonucleotide; CTA chr11 5224185 5224206 5224190 5224185 -
catcaaactaaaaaatttccac

SEQ ID NO: 144608 - DNA, 22 bp, Artificial Sequence
  Synthetic oligonucleotide; CTA chr11 5224175 5224196 5224180 5224175 -
aaaaatttccacacaaaaaaca

SEQ ID NO: 144609 - DNA, 22 bp, Artificial Sequence
  Synthetic oligonucleotide; TTT chr11 5224167 5224188 5224172 5224167 -
ccacacaaaaaacaaaacaatg

SEQ ID NO: 144610 - DNA, 22 bp, Artificial Sequence
  Synthetic oligonucleotide; TTC chr11 5224166 5224187 5224171 5224166 -
cacacaaaaaacaaaacaatga

SEQ ID NO: 144611 - DNA, 22 bp, Artificial Sequence
  Synthetic oligonucleotide; TTT chr11 5224110 5224131 5224115 5224110 -
gcaaaccaaatatttcttaaat

SEQ ID NO: 144612 - DNA, 22 bp, Artificial Sequence
  Synthetic oligonucleotide; TTG chr11 5224109 5224130 5224114 5224109 -
caaaccaaatatttcttaaata

SEQ ID NO: 144613 - DNA, 22 bp, Artificial Sequence
  Synthetic oligonucleotide; TTT chr11 5224095 5224116 5224100 5224095 -
cttaaatattttggttaatatc

SEQ ID NO: 144614 - DNA, 22 bp, Artificial Sequence
  Synthetic oligonucleotide; TTC chr11 5224094 5224115 5224099 5224094 -
ttaaatattttggttaatatcc

SEQ ID NO: 144615 - DNA, 22 bp, Artificial Sequence
  Synthetic oligonucleotide; CTT chr11 5224092 5224113 5224097 5224092 -
aaatattttggttaatatccaa

SEQ ID NO: 144616 - DNA, 22 bp, Artificial Sequence
  Synthetic oligonucleotide; TTA chr11 5224091 5224112 5224096 5224091 -
aatattttggttaatatccaaa

SEQ ID NO: 144617 - DNA, 22 bp, Artificial Sequence
  Synthetic oligonucleotide; TTT chr11 5224084 5224105 5224089 5224084 -
tggttaatatccaaaatatata

SEQ ID NO: 144618 - DNA, 22 bp, Artificial Sequence
  Synthetic oligonucleotide; TTT chr11 5224083 5224104 5224088 5224083 -
ggttaatatccaaaatatataa

SEQ ID NO: 144619 - DNA, 22 bp, Artificial Sequence
  Synthetic oligonucleotide; TTG chr11 5224082 5224103 5224087 5224082 -
gttaatatccaaaatatataag

SEQ ID NO: 144620 - DNA, 22 bp, Artificial Sequence
  Synthetic oligonucleotide; TTA chr11 5224078 5224099 5224083 5224078 -
atatccaaaatatataagaaac

SEQ ID NO: 144621 - DNA, 22 bp, Artificial Sequence
  Synthetic oligonucleotide; TTC chr11 5224045 5224066 5224050 5224045 -
aataacaaacaaaaaattaaaa

SEQ ID NO: 144622 - DNA, 22 bp, Artificial Sequence
  Synthetic oligonucleotide; TTA chr11 5224026 5224047 5224031 5224026 -
aaaataggaaaataaaaaaatt

SEQ ID NO: 144623 - DNA, 22 bp, Artificial Sequence
  Synthetic oligonucleotide; TTA chr11 5224003 5224024 5224008 5224003 -
aaaagaagaaaatcctgccatt

SEQ ID NO: 144624 - DNA, 22 bp, Artificial Sequence
  Synthetic oligonucleotide; CTG chr11 5223986 5224007 5223991 5223986 -
ccatttatggcagaattgatga

SEQ ID NO: 144625 - DNA, 22 bp, Artificial Sequence
  Synthetic oligonucleotide; TTT chr11 5223980 5224001 5223985 5223980 -
atggcagaattgatgaacctgg

SEQ ID NO: 144626 - DNA, 22 bp, Artificial Sequence
  Synthetic oligonucleotide; TTA chr11 5223979 5224000 5223984 5223979 -
tggcagaattgatgaacctgga

SEQ ID NO: 144627 - DNA, 22 bp, Artificial Sequence
  Synthetic oligonucleotide; TTG chr11 5223968 5223989 5223973 5223968 -
atgaacctggaggatgtaaaac

SEQ ID NO: 144628 - DNA, 22 bp, Artificial Sequence
  Synthetic oligonucleotide; CTG chr11 5223959 5223980 5223964 5223959 -
gaggatgtaaaactaagaaaaa

SEQ ID NO: 144629 - DNA, 22 bp, Artificial Sequence
  Synthetic oligonucleotide; CTA chr11 5223944 5223965 5223949 5223944 -
agaaaaataagcctgacacaaa

SEQ ID NO: 144630 - DNA, 22 bp, Artificial Sequence
  Synthetic oligonucleotide; CTG chr11 5223929 5223950 5223934 5223929 -
acacaaaaagacaaatactaca

SEQ ID NO: 144631 - DNA, 22 bp, Artificial Sequence
  Synthetic oligonucleotide; CTA chr11 5223909 5223930 5223914 5223909 -
cacaaccttgctcatatgtgaa

SEQ ID NO: 144632 - DNA, 22 bp, Artificial Sequence
  Synthetic oligonucleotide; CTT chr11 5223900 5223921 5223905 5223900 -
gctcatatgtgaaacataaaaa

SEQ ID NO: 144633 - DNA, 22 bp, Artificial Sequence
  Synthetic oligonucleotide; TTG chr11 5223899 5223920 5223904 5223899 -
ctcatatgtgaaacataaaaaa

SEQ ID NO: 144634 - DNA, 22 bp, Artificial Sequence
  Synthetic oligonucleotide; CTC chr11 5223896 5223917 5223901 5223896 -
atatgtgaaacataaaaaagtc

SEQ ID NO: 144635 - DNA, 22 bp, Artificial Sequence
  Synthetic oligonucleotide; CTC chr11 5223870 5223891 5223875 5223870 -
tcatggaaacagacagtagagg

SEQ ID NO: 144636 - DNA, 22 bp, Artificial Sequence
  Synthetic oligonucleotide; CTC chr11 5223868 5223889 5223873 5223868 -
atggaaacagacagtagaggta

SEQ ID NO: 144637 - DNA, 22 bp, Artificial Sequence
  Synthetic oligonucleotide; TTT chr11 5223840 5223861 5223845 5223840 -
ccaggggttgggggtgggagaa

SEQ ID NO: 144638 - DNA, 22 bp, Artificial Sequence
  Synthetic oligonucleotide; TTC chr11 5223839 5223860 5223844 5223839 -
caggggttgggggtgggagaat

SEQ ID NO: 144639 - DNA, 22 bp, Artificial Sequence
  Synthetic oligonucleotide; TTG chr11 5223830 5223851 5223835 5223830 -
ggggtgggagaatcaggaaact

SEQ ID NO: 144640 - DNA, 22 bp, Artificial Sequence
  Synthetic oligonucleotide; CTA chr11 5223807 5223828 5223812 5223807 -
ttactcaaagggtataaaattt

SEQ ID NO: 144641 - DNA, 22 bp, Artificial Sequence
  Synthetic oligonucleotide; TTA chr11 5223804 5223825 5223809 5223804 -
ctcaaagggtataaaatttcag

SEQ ID NO: 144642 - DNA, 22 bp, Artificial Sequence
  Synthetic oligonucleotide; CTC chr11 5223801 5223822 5223806 5223801 -
aaagggtataaaatttcagtta

SEQ ID NO: 144643 - DNA, 22 bp, Artificial Sequence
  Synthetic oligonucleotide; TTT chr11 5223785 5223806 5223790 5223785 -
cagttatgtgggatgaataaat

SEQ ID NO: 144644 - DNA, 22 bp, Artificial Sequence
  Synthetic oligonucleotide; TTC chr11 5223784 5223805 5223789 5223784 -
agttatgtgggatgaataaatt

SEQ ID NO: 144645 - DNA, 22 bp, Artificial Sequence
  Synthetic oligonucleotide; TTA chr11 5223779 5223800 5223784 5223779 -
tgtgggatgaataaattctaga

SEQ ID NO: 144646 - DNA, 22 bp, Artificial Sequence
  Synthetic oligonucleotide; TTC chr11 5223761 5223782 5223766 5223761 -
tagatatctaatgtacagcatc

SEQ ID NO: 144647 - DNA, 22 bp, Artificial Sequence
  Synthetic oligonucleotide; CTA chr11 5223759 5223780 5223764 5223759 -
gatatctaatgtacagcatcgt

SEQ ID NO: 144648 - DNA, 22 bp, Artificial Sequence
  Synthetic oligonucleotide; CTA chr11 5223751 5223772 5223756 5223751 -
atgtacagcatcgtgactgtag

SEQ ID NO: 144649 - DNA, 22 bp, Artificial Sequence
  Synthetic oligonucleotide; CTG chr11 5223732 5223753 5223737 5223732 -
tagttaattgtactgtaagtat

SEQ ID NO: 144650 - DNA, 22 bp, Artificial Sequence
  Synthetic oligonucleotide; TTA chr11 5223726 5223747 5223731 5223726 -
attgtactgtaagtatatttaa

SEQ ID NO: 144651 - DNA, 22 bp, Artificial Sequence
  Synthetic oligonucleotide; TTG chr11 5223722 5223743 5223727 5223722 -
tactgtaagtatatttaaaatt

SEQ ID NO: 144652 - DNA, 22 bp, Artificial Sequence
  Synthetic oligonucleotide; CTG chr11 5223717 5223738 5223722 5223717 -
taagtatatttaaaatttgcaa

SEQ ID NO: 144653 - DNA, 22 bp, Artificial Sequence
  Synthetic oligonucleotide; TTT chr11 5223706 5223727 5223711 5223706 -
aaaatttgcaaagagagtagat

SEQ ID NO: 144654 - DNA, 22 bp, Artificial Sequence
  Synthetic oligonucleotide; TTA chr11 5223705 5223726 5223710 5223705 -
aaatttgcaaagagagtagatt

SEQ ID NO: 144655 - DNA, 22 bp, Artificial Sequence
  Synthetic oligonucleotide; TTT chr11 5223699 5223720 5223704 5223699 -
gcaaagagagtagatttttttt

SEQ ID NO: 144656 - DNA, 22 bp, Artificial Sequence
  Synthetic oligonucleotide; TTG chr11 5223698 5223719 5223703 5223698 -
caaagagagtagattttttttt

SEQ ID NO: 144657 - DNA, 22 bp, Artificial Sequence
  Synthetic oligonucleotide; TTT chr11 5223682 5223703 5223687 5223682 -
ttttttttttttagatggagtt

SEQ ID NO: 144658 - DNA, 22 bp, Artificial Sequence
  Synthetic oligonucleotide; TTT chr11 5223681 5223702 5223686 5223681 -
tttttttttttagatggagttt

SEQ ID NO: 144659 - DNA, 22 bp, Artificial Sequence
  Synthetic oligonucleotide; TTT chr11 5223680 5223701 5223685 5223680 -
ttttttttttagatggagtttt

SEQ ID NO: 144660 - DNA, 22 bp, Artificial Sequence
  Synthetic oligonucleotide; TTT chr11 5223679 5223700 5223684 5223679 -
tttttttttagatggagttttg

SEQ ID NO: 144661 - DNA, 22 bp, Artificial Sequence
  Synthetic oligonucleotide; TTT chr11 5223678 5223699 5223683 5223678 -
ttttttttagatggagttttgc

SEQ ID NO: 144662 - DNA, 22 bp, Artificial Sequence
  Synthetic oligonucleotide; TTT chr11 5223677 5223698 5223682 5223677 -
tttttttagatggagttttgct

SEQ ID NO: 144663 - DNA, 22 bp, Artificial Sequence
  Synthetic oligonucleotide; TTT chr11 5223676 5223697 5223681 5223676 -
ttttttagatggagttttgctc

SEQ ID NO: 144664 - DNA, 22 bp, Artificial Sequence
  Synthetic oligonucleotide; TTT chr11 5223675 5223696 5223680 5223675 -
tttttagatggagttttgctct

SEQ ID NO: 144665 - DNA, 22 bp, Artificial Sequence
  Synthetic oligonucleotide; TTT chr11 5223674 5223695 5223679 5223674 -
ttttagatggagttttgctctt

SEQ ID NO: 144666 - DNA, 22 bp, Artificial Sequence
  Synthetic oligonucleotide; TTT chr11 5223673 5223694 5223678 5223673 -
tttagatggagttttgctcttg

SEQ ID NO: 144667 - DNA, 22 bp, Artificial Sequence
  Synthetic oligonucleotide; TTT chr11 5223672 5223693 5223677 5223672 -
ttagatggagttttgctcttgt

SEQ ID NO: 144668 - DNA, 22 bp, Artificial Sequence
  Synthetic oligonucleotide; TTT chr11 5223671 5223692 5223676 5223671 -
tagatggagttttgctcttgtt

SEQ ID NO: 144669 - DNA, 22 bp, Artificial Sequence
  Synthetic oligonucleotide; TTT chr11 5223670 5223691 5223675 5223670 -
agatggagttttgctcttgttg

SEQ ID NO: 144670 - DNA, 22 bp, Artificial Sequence
  Synthetic oligonucleotide; TTA chr11 5223669 5223690 5223674 5223669 -
gatggagttttgctcttgttgt

SEQ ID NO: 144671 - DNA, 22 bp, Artificial Sequence
  Synthetic oligonucleotide; TTT chr11 5223659 5223680 5223664 5223659 -
tgctcttgttgtccaggctgga

SEQ ID NO: 144672 - DNA, 22 bp, Artificial Sequence
  Synthetic oligonucleotide; TTT chr11 5223658 5223679 5223663 5223658 -
gctcttgttgtccaggctggag

SEQ ID NO: 144673 - DNA, 22 bp, Artificial Sequence
  Synthetic oligonucleotide; TTG chr11 5223657 5223678 5223662 5223657 -
ctcttgttgtccaggctggagt

SEQ ID NO: 144674 - DNA, 22 bp, Artificial Sequence
  Synthetic oligonucleotide; CTC chr11 5223654 5223675 5223659 5223654 -
ttgttgtccaggctggagtgca

SEQ ID NO: 144675 - DNA, 22 bp, Artificial Sequence
  Synthetic oligonucleotide; CTT chr11 5223652 5223673 5223657 5223652 -
gttgtccaggctggagtgcaat

SEQ ID NO: 144676 - DNA, 22 bp, Artificial Sequence
  Synthetic oligonucleotide; TTG chr11 5223651 5223672 5223656 5223651 -
ttgtccaggctggagtgcaatg

SEQ ID NO: 144677 - DNA, 22 bp, Artificial Sequence
  Synthetic oligonucleotide; TTG chr11 5223648 5223669 5223653 5223648 -
tccaggctggagtgcaatggca

SEQ ID NO: 144678 - DNA, 22 bp, Artificial Sequence
  Synthetic oligonucleotide; CTG chr11 5223639 5223660 5223644 5223639 -
gagtgcaatggcaagatcttgg

SEQ ID NO: 144679 - DNA, 22 bp, Artificial Sequence
  Synthetic oligonucleotide; CTT chr11 5223619 5223640 5223624 5223619 -
ggctcactgcaacctccgcctc

SEQ ID NO: 144680 - DNA, 22 bp, Artificial Sequence
  Synthetic oligonucleotide; TTG chr11 5223618 5223639 5223623 5223618 -
gctcactgcaacctccgcctcc

SEQ ID NO: 144681 - DNA, 22 bp, Artificial Sequence
  Synthetic oligonucleotide; CTC chr11 5223614 5223635 5223619 5223614 -
actgcaacctccgcctcctggg

SEQ ID NO: 144682 - DNA, 22 bp, Artificial Sequence
  Synthetic oligonucleotide; CTG chr11 5223610 5223631 5223615 5223610 -
caacctccgcctcctgggttca

SEQ ID NO: 144683 - DNA, 22 bp, Artificial Sequence
  Synthetic oligonucleotide; CTC chr11 5223603 5223624 5223608 5223603 -
cgcctcctgggttcaagcaaat

SEQ ID NO: 144684 - DNA, 22 bp, Artificial Sequence
  Synthetic oligonucleotide; CTC chr11 5223597 5223618 5223602 5223597 -
ctgggttcaagcaaatctcctg

SEQ ID NO: 144685 - DNA, 22 bp, Artificial Sequence
  Synthetic oligonucleotide; CTG chr11 5223594 5223615 5223599 5223594 -
ggttcaagcaaatctcctgcct

SEQ ID NO: 144686 - DNA, 22 bp, Artificial Sequence
  Synthetic oligonucleotide; TTC chr11 5223589 5223610 5223594 5223589 -
aagcaaatctcctgcctcagcc

SEQ ID NO: 144687 - DNA, 22 bp, Artificial Sequence
  Synthetic oligonucleotide; CTC chr11 5223578 5223599 5223583 5223578 -
ctgcctcagcctcccgagtagc

SEQ ID NO: 144688 - DNA, 22 bp, Artificial Sequence
  Synthetic oligonucleotide; CTG chr11 5223575 5223596 5223580 5223575 -
cctcagcctcccgagtagctgg

SEQ ID NO: 144689 - DNA, 22 bp, Artificial Sequence
  Synthetic oligonucleotide; CTC chr11 5223571 5223592 5223576 5223571 -
agcctcccgagtagctgggatt

SEQ ID NO: 144690 - DNA, 22 bp, Artificial Sequence
  Synthetic oligonucleotide; CTC chr11 5223565 5223586 5223570 5223565 -
ccgagtagctgggattacaggc

SEQ ID NO: 144691 - DNA, 22 bp, Artificial Sequence
  Synthetic oligonucleotide; CTG chr11 5223554 5223575 5223559 5223554 -
ggattacaggcatgcgacacca

SEQ ID NO: 144692 - DNA, 22 bp, Artificial Sequence
  Synthetic oligonucleotide; TTA chr11 5223548 5223569 5223553 5223548 -
caggcatgcgacaccatgccca

SEQ ID NO: 144693 - DNA, 22 bp, Artificial Sequence
  Synthetic oligonucleotide; CTA chr11 5223522 5223543 5223527 5223522 -
attttgtatttttagtagagac

SEQ ID NO: 144694 - DNA, 22 bp, Artificial Sequence
  Synthetic oligonucleotide; TTT chr11 5223518 5223539 5223523 5223518 -
tgtatttttagtagagacgggg

SEQ ID NO: 144695 - DNA, 22 bp, Artificial Sequence
  Synthetic oligonucleotide; TTT chr11 5223517 5223538 5223522 5223517 -
gtatttttagtagagacggggt

SEQ ID NO: 144696 - DNA, 22 bp, Artificial Sequence
  Synthetic oligonucleotide; TTG chr11 5223516 5223537 5223521 5223516 -
tatttttagtagagacggggtt

SEQ ID NO: 144697 - DNA, 22 bp, Artificial Sequence
  Synthetic oligonucleotide; TTT chr11 5223511 5223532 5223516 5223511 -
ttagtagagacggggtttctcc

SEQ ID NO: 144698 - DNA, 22 bp, Artificial Sequence
  Synthetic oligonucleotide; TTT chr11 5223510 5223531 5223515 5223510 -
tagtagagacggggtttctcca

SEQ ID NO: 144699 - DNA, 22 bp, Artificial Sequence
  Synthetic oligonucleotide; TTT chr11 5223509 5223530 5223514 5223509 -
agtagagacggggtttctccat

SEQ ID NO: 144700 - DNA, 22 bp, Artificial Sequence
  Synthetic oligonucleotide; TTA chr11 5223508 5223529 5223513 5223508 -
gtagagacggggtttctccatg

SEQ ID NO: 144701 - DNA, 22 bp, Artificial Sequence
  Synthetic oligonucleotide; TTT chr11 5223493 5223514 5223498 5223493 -
ctccatgttggtcaggctgatc

SEQ ID NO: 144702 - DNA, 22 bp, Artificial Sequence
  Synthetic oligonucleotide; TTC chr11 5223492 5223513 5223497 5223492 -
tccatgttggtcaggctgatcc

SEQ ID NO: 144703 - DNA, 22 bp, Artificial Sequence
  Synthetic oligonucleotide; CTC chr11 5223490 5223511 5223495 5223490 -
catgttggtcaggctgatccgc

SEQ ID NO: 144704 - DNA, 22 bp, Artificial Sequence
  Synthetic oligonucleotide; TTG chr11 5223483 5223504 5223488 5223483 -
gtcaggctgatccgcctgcctc

SEQ ID NO: 144705 - DNA, 22 bp, Artificial Sequence
  Synthetic oligonucleotide; CTG chr11 5223474 5223495 5223479 5223474 -
atccgcctgcctcggccaccca

SEQ ID NO: 144706 - DNA, 22 bp, Artificial Sequence
  Synthetic oligonucleotide; CTG chr11 5223465 5223486 5223470 5223465 -
cctcggccacccaaagggctgg

SEQ ID NO: 144707 - DNA, 22 bp, Artificial Sequence
  Synthetic oligonucleotide; CTC chr11 5223461 5223482 5223466 5223461 -
ggccacccaaagggctgggatt

SEQ ID NO: 144708 - DNA, 22 bp, Artificial Sequence
  Synthetic oligonucleotide; CTG chr11 5223444 5223465 5223449 5223444 -
ggattacaggcgtgagccaccg

SEQ ID NO: 144709 - DNA, 22 bp, Artificial Sequence
  Synthetic oligonucleotide; TTA chr11 5223438 5223459 5223443 5223438 -
caggcgtgagccaccgggcctg

SEQ ID NO: 144710 - DNA, 22 bp, Artificial Sequence
  Synthetic oligonucleotide; CTG chr11 5223416 5223437 5223421 5223416 -
gccgagagtagatcttaaaagc

SEQ ID NO: 144711 - DNA, 22 bp, Artificial Sequence
  Synthetic oligonucleotide; CTT chr11 5223400 5223421 5223405 5223400 -
aaaagcatttaccacaagaaaa

SEQ ID NO: 144712 - DNA, 22 bp, Artificial Sequence
  Synthetic oligonucleotide; TTA chr11 5223399 5223420 5223404 5223399 -
aaagcatttaccacaagaaaaa

SEQ ID NO: 144713 - DNA, 22 bp, Artificial Sequence
  Synthetic oligonucleotide; TTT chr11 5223390 5223411 5223395 5223390 -
accacaagaaaaaggtaactat

SEQ ID NO: 144714 - DNA, 22 bp, Artificial Sequence
  Synthetic oligonucleotide; TTA chr11 5223389 5223410 5223394 5223389 -
ccacaagaaaaaggtaactatg

SEQ ID NO: 144715 - DNA, 22 bp, Artificial Sequence
  Synthetic oligonucleotide; CTA chr11 5223369 5223390 5223374 5223369 -
tgtgagataatgggtatgttaa

SEQ ID NO: 144716 - DNA, 22 bp, Artificial Sequence
  Synthetic oligonucleotide; TTA chr11 5223348 5223369 5223353 5223348 -
attagcttgattgtggtaatca

SEQ ID NO: 144717 - DNA, 22 bp, Artificial Sequence
  Synthetic oligonucleotide; TTA chr11 5223344 5223365 5223349 5223344 -
gcttgattgtggtaatcatttc

SEQ ID NO: 144718 - DNA, 22 bp, Artificial Sequence
  Synthetic oligonucleotide; CTT chr11 5223340 5223361 5223345 5223340 -
gattgtggtaatcatttcacaa

SEQ ID NO: 144719 - DNA, 22 bp, Artificial Sequence
  Synthetic oligonucleotide; TTG chr11 5223339 5223360 5223344 5223339 -
attgtggtaatcatttcacaag

SEQ ID NO: 144720 - DNA, 22 bp, Artificial Sequence
  Synthetic oligonucleotide; TTG chr11 5223335 5223356 5223340 5223335 -
tggtaatcatttcacaaggtat

SEQ ID NO: 144721 - DNA, 22 bp, Artificial Sequence
  Synthetic oligonucleotide; TTT chr11 5223323 5223344 5223328 5223323 -
cacaaggtatacatatattaaa

SEQ ID NO: 144722 - DNA, 22 bp, Artificial Sequence
  Synthetic oligonucleotide; TTC chr11 5223322 5223343 5223327 5223322 -
acaaggtatacatatattaaaa

SEQ ID NO: 144723 - DNA, 22 bp, Artificial Sequence
  Synthetic oligonucleotide; TTA chr11 5223303 5223324 5223308 5223303 -
aaacatcatgttgtacacctta

SEQ ID NO: 144724 - DNA, 22 bp, Artificial Sequence
  Synthetic oligonucleotide; TTG chr11 5223290 5223311 5223295 5223290 -
tacaccttaaatatatacaatt

SEQ ID NO: 144725 - DNA, 22 bp, Artificial Sequence
  Synthetic oligonucleotide; CTT chr11 5223282 5223303 5223287 5223282 -
aaatatatacaatttttatttg

SEQ ID NO: 144726 - DNA, 22 bp, Artificial Sequence
  Synthetic oligonucleotide; TTA chr11 5223281 5223302 5223286 5223281 -
aatatatacaatttttatttgt

SEQ ID NO: 144727 - DNA, 22 bp, Artificial Sequence
  Synthetic oligonucleotide; TTT chr11 5223267 5223288 5223272 5223267 -
ttatttgtgaatgatacctcaa

SEQ ID NO: 144728 - DNA, 22 bp, Artificial Sequence
  Synthetic oligonucleotide; TTT chr11 5223266 5223287 5223271 5223266 -
tatttgtgaatgatacctcaat

SEQ ID NO: 144729 - DNA, 22 bp, Artificial Sequence
  Synthetic oligonucleotide; TTT chr11 5223265 5223286 5223270 5223265 -
atttgtgaatgatacctcaata

SEQ ID NO: 144730 - DNA, 22 bp, Artificial Sequence
  Synthetic oligonucleotide; TTA chr11 5223264 5223285 5223269 5223264 -
tttgtgaatgatacctcaataa

SEQ ID NO: 144731 - DNA, 22 bp, Artificial Sequence
  Synthetic oligonucleotide; TTT chr11 5223261 5223282 5223266 5223261 -
gtgaatgatacctcaataaagt

SEQ ID NO: 144732 - DNA, 22 bp, Artificial Sequence
  Synthetic oligonucleotide; TTG chr11 5223260 5223281 5223265 5223260 -
tgaatgatacctcaataaagtt

SEQ ID NO: 144733 - DNA, 22 bp, Artificial Sequence
  Synthetic oligonucleotide; CTC chr11 5223247 5223268 5223252 5223247 -
aataaagttgaagaataataaa

SEQ ID NO: 144734 - DNA, 22 bp, Artificial Sequence
  Synthetic oligonucleotide; TTG chr11 5223237 5223258 5223242 5223237 -
aagaataataaaaaagaataga

SEQ ID NO: 144735 - DNA, 22 bp, Artificial Sequence
  Synthetic oligonucleotide; TTA chr11 5223201 5223222 5223206 5223201 -
aaaaactaaaaaataaaaaaat

SEQ ID NO: 144736 - DNA, 22 bp, Artificial Sequence
  Synthetic oligonucleotide; CTA chr11 5223193 5223214 5223198 5223193 -
aaaaataaaaaaatgcatcttg

SEQ ID NO: 144737 - DNA, 22 bp, Artificial Sequence
  Synthetic oligonucleotide; CTT chr11 5223172 5223193 5223177 5223172 -
gatgattagaattgcattcttg

SEQ ID NO: 144738 - DNA, 22 bp, Artificial Sequence
  Synthetic oligonucleotide; TTG chr11 5223171 5223192 5223176 5223171 -
atgattagaattgcattcttga

SEQ ID NO: 144739 - DNA, 22 bp, Artificial Sequence
  Synthetic oligonucleotide; TTA chr11 5223164 5223185 5223169 5223164 -
gaattgcattcttgatttttca

SEQ ID NO: 144740 - DNA, 22 bp, Artificial Sequence
  Synthetic oligonucleotide; TTG chr11 5223158 5223179 5223163 5223158 -
cattcttgatttttcagataca

SEQ ID NO: 144741 - DNA, 22 bp, Artificial Sequence
  Synthetic oligonucleotide; TTC chr11 5223153 5223174 5223158 5223153 -
ttgatttttcagatacaaatat

SEQ ID NO: 144742 - DNA, 22 bp, Artificial Sequence
  Synthetic oligonucleotide; CTT chr11 5223151 5223172 5223156 5223151 -
gatttttcagatacaaatatcc

SEQ ID NO: 144743 - DNA, 22 bp, Artificial Sequence
  Synthetic oligonucleotide; TTG chr11 5223150 5223171 5223155 5223150 -
atttttcagatacaaatatcca

SEQ ID NO: 144744 - DNA, 22 bp, Artificial Sequence
  Synthetic oligonucleotide; TTT chr11 5223146 5223167 5223151 5223146 -
ttcagatacaaatatccatttg

SEQ ID NO: 144745 - DNA, 22 bp, Artificial Sequence
  Synthetic oligonucleotide; TTT chr11 5223145 5223166 5223150 5223145 -
tcagatacaaatatccatttga

SEQ ID NO: 144746 - DNA, 22 bp, Artificial Sequence
  Synthetic oligonucleotide; TTT chr11 5223144 5223165 5223149 5223144 -
cagatacaaatatccatttgac

SEQ ID NO: 144747 - DNA, 22 bp, Artificial Sequence
  Synthetic oligonucleotide; TTC chr11 5223143 5223164 5223148 5223143 -
agatacaaatatccatttgact

SEQ ID NO: 144748 - DNA, 22 bp, Artificial Sequence
  Synthetic oligonucleotide; TTT chr11 5223125 5223146 5223130 5223125 -
gactgtttactcttttccaaaa

SEQ ID NO: 144749 - DNA, 22 bp, Artificial Sequence
  Synthetic oligonucleotide; TTG chr11 5223124 5223145 5223129 5223124 -
actgtttactcttttccaaaac

SEQ ID NO: 144750 - DNA, 22 bp, Artificial Sequence
  Synthetic oligonucleotide; CTG chr11 5223120 5223141 5223125 5223120 -
tttactcttttccaaaacaata

SEQ ID NO: 144751 - DNA, 22 bp, Artificial Sequence
  Synthetic oligonucleotide; TTT chr11 5223117 5223138 5223122 5223117 -
actcttttccaaaacaatacaa

SEQ ID NO: 144752 - DNA, 22 bp, Artificial Sequence
  Synthetic oligonucleotide; TTA chr11 5223116 5223137 5223121 5223116 -
ctcttttccaaaacaatacaat

SEQ ID NO: 144753 - DNA, 22 bp, Artificial Sequence
  Synthetic oligonucleotide; CTC chr11 5223113 5223134 5223118 5223113 -
ttttccaaaacaatacaataaa

SEQ ID NO: 144754 - DNA, 22 bp, Artificial Sequence
  Synthetic oligonucleotide; CTT chr11 5223111 5223132 5223116 5223111 -
ttccaaaacaatacaataaatt

SEQ ID NO: 144755 - DNA, 22 bp, Artificial Sequence
  Synthetic oligonucleotide; TTT chr11 5223110 5223131 5223115 5223110 -
tccaaaacaatacaataaattt

SEQ ID NO: 144756 - DNA, 22 bp, Artificial Sequence
  Synthetic oligonucleotide; TTT chr11 5223109 5223130 5223114 5223109 -
ccaaaacaatacaataaatttt

SEQ ID NO: 144757 - DNA, 22 bp, Artificial Sequence
  Synthetic oligonucleotide; TTC chr11 5223108 5223129 5223113 5223108 -
caaaacaatacaataaatttta

SEQ ID NO: 144758 - DNA, 22 bp, Artificial Sequence
  Synthetic oligonucleotide; TTT chr11 5223088 5223109 5223093 5223088 -
tagcactttatcttcattttcc

SEQ ID NO: 144759 - DNA, 22 bp, Artificial Sequence
  Synthetic oligonucleotide; TTT chr11 5223087 5223108 5223092 5223087 -
agcactttatcttcattttccc

SEQ ID NO: 144760 - DNA, 22 bp, Artificial Sequence
  Synthetic oligonucleotide; TTA chr11 5223086 5223107 5223091 5223086 -
gcactttatcttcattttcccc

SEQ ID NO: 144761 - DNA, 22 bp, Artificial Sequence
  Synthetic oligonucleotide; CTT chr11 5223080 5223101 5223085 5223080 -
tatcttcattttccccttccca

SEQ ID NO: 144762 - DNA, 22 bp, Artificial Sequence
  Synthetic oligonucleotide; TTT chr11 5223079 5223100 5223084 5223079 -
atcttcattttccccttcccaa

SEQ ID NO: 144763 - DNA, 22 bp, Artificial Sequence
  Synthetic oligonucleotide; TTA chr11 5223078 5223099 5223083 5223078 -
tcttcattttccccttcccaat

SEQ ID NO: 144764 - DNA, 22 bp, Artificial Sequence
  Synthetic oligonucleotide; CTT chr11 5223074 5223095 5223079 5223074 -
cattttccccttcccaatctat

SEQ ID NO: 144765 - DNA, 22 bp, Artificial Sequence
  Synthetic oligonucleotide; TTC chr11 5223073 5223094 5223078 5223073 -
attttccccttcccaatctata

SEQ ID NO: 144766 - DNA, 22 bp, Artificial Sequence
  Synthetic oligonucleotide; TTT chr11 5223069 5223090 5223074 5223069 -
tccccttcccaatctataatta

SEQ ID NO: 144767 - DNA, 22 bp, Artificial Sequence
  Synthetic oligonucleotide; TTT chr11 5223068 5223089 5223073 5223068 -
ccccttcccaatctataattat

SEQ ID NO: 144768 - DNA, 22 bp, Artificial Sequence
  Synthetic oligonucleotide; TTC chr11 5223067 5223088 5223072 5223067 -
cccttcccaatctataattata

SEQ ID NO: 144769 - DNA, 22 bp, Artificial Sequence
  Synthetic oligonucleotide; CTT chr11 5223062 5223083 5223067 5223062 -
cccaatctataattatatatat

SEQ ID NO: 144770 - DNA, 22 bp, Artificial Sequence
  Synthetic oligonucleotide; TTC chr11 5223061 5223082 5223066 5223061 -
ccaatctataattatatatata

SEQ ID NO: 144771 - DNA, 22 bp, Artificial Sequence
  Synthetic oligonucleotide; CTA chr11 5223053 5223074 5223058 5223053 -
taattatatatatatatatttt

SEQ ID NO: 144772 - DNA, 22 bp, Artificial Sequence
  Synthetic oligonucleotide; TTA chr11 5223047 5223068 5223052 5223047 -
tatatatatatattttagatat

SEQ ID NO: 144773 - DNA, 22 bp, Artificial Sequence
  Synthetic oligonucleotide; TTT chr11 5223032 5223053 5223037 5223032 -
tagatattttgtatagttttac

SEQ ID NO: 144774 - DNA, 22 bp, Artificial Sequence
  Synthetic oligonucleotide; TTT chr11 5223031 5223052 5223036 5223031 -
agatattttgtatagttttact

SEQ ID NO: 144775 - DNA, 22 bp, Artificial Sequence
  Synthetic oligonucleotide; TTA chr11 5223030 5223051 5223035 5223030 -
gatattttgtatagttttactc

SEQ ID NO: 144776 - DNA, 22 bp, Artificial Sequence
  Synthetic oligonucleotide; TTT chr11 5223023 5223044 5223028 5223023 -
tgtatagttttactccctagat

SEQ ID NO: 144777 - DNA, 22 bp, Artificial Sequence
  Synthetic oligonucleotide; TTT chr11 5223022 5223043 5223027 5223022 -
gtatagttttactccctagatt

SEQ ID NO: 144778 - DNA, 22 bp, Artificial Sequence
  Synthetic oligonucleotide; TTG chr11 5223021 5223042 5223026 5223021 -
tatagttttactccctagattt

SEQ ID NO: 144779 - DNA, 22 bp, Artificial Sequence
  Synthetic oligonucleotide; TTT chr11 5223013 5223034 5223018 5223013 -
tactccctagattttctagtgt

SEQ ID NO: 144780 - DNA, 22 bp, Artificial Sequence
  Synthetic oligonucleotide; TTT chr11 5223012 5223033 5223017 5223012 -
actccctagattttctagtgtt

SEQ ID NO: 144781 - DNA, 22 bp, Artificial Sequence
  Synthetic oligonucleotide; TTA chr11 5223011 5223032 5223016 5223011 -
ctccctagattttctagtgtta

SEQ ID NO: 144782 - DNA, 22 bp, Artificial Sequence
  Synthetic oligonucleotide; CTC chr11 5223008 5223029 5223013 5223008 -
cctagattttctagtgttatta

SEQ ID NO: 144783 - DNA, 22 bp, Artificial Sequence
  Synthetic oligonucleotide; CTA chr11 5223004 5223025 5223009 5223004 -
gattttctagtgttattattaa

SEQ ID NO: 144784 - DNA, 22 bp, Artificial Sequence
  Synthetic oligonucleotide; TTT chr11 5222999 5223020 5223004 5222999 -
tctagtgttattattaaatagt

SEQ ID NO: 144785 - DNA, 22 bp, Artificial Sequence
  Synthetic oligonucleotide; TTT chr11 5222998 5223019 5223003 5222998 -
ctagtgttattattaaatagtg

SEQ ID NO: 144786 - DNA, 22 bp, Artificial Sequence
  Synthetic oligonucleotide; TTC chr11 5222997 5223018 5223002 5222997 -
tagtgttattattaaatagtga

SEQ ID NO: 144787 - DNA, 22 bp, Artificial Sequence
  Synthetic oligonucleotide; CTA chr11 5222995 5223016 5223000 5222995 -
gtgttattattaaatagtgaag

SEQ ID NO: 144788 - DNA, 22 bp, Artificial Sequence
  Synthetic oligonucleotide; TTA chr11 5222989 5223010 5222994 5222989 -
ttattaaatagtgaagaaatgt

SEQ ID NO: 144789 - DNA, 22 bp, Artificial Sequence
  Synthetic oligonucleotide; TTA chr11 5222986 5223007 5222991 5222986 -
ttaaatagtgaagaaatgttta

SEQ ID NO: 144790 - DNA, 22 bp, Artificial Sequence
  Synthetic oligonucleotide; TTA chr11 5222983 5223004 5222988 5222983 -
aatagtgaagaaatgtttacac

SEQ ID NO: 144791 - DNA, 22 bp, Artificial Sequence
  Synthetic oligonucleotide; TTT chr11 5222965 5222986 5222970 5222965 -
acacttatgtacaaaatgtttt

SEQ ID NO: 144792 - DNA, 22 bp, Artificial Sequence
  Synthetic oligonucleotide; TTA chr11 5222964 5222985 5222969 5222964 -
cacttatgtacaaaatgttttg

SEQ ID NO: 144793 - DNA, 22 bp, Artificial Sequence
  Synthetic oligonucleotide; CTT chr11 5222959 5222980 5222964 5222959 -
atgtacaaaatgttttgcatgc

SEQ ID NO: 144794 - DNA, 22 bp, Artificial Sequence
  Synthetic oligonucleotide; TTA chr11 5222958 5222979 5222963 5222958 -
tgtacaaaatgttttgcatgct

SEQ ID NO: 144795 - DNA, 22 bp, Artificial Sequence
  Synthetic oligonucleotide; TTT chr11 5222944 5222965 5222949 5222944 -
tgcatgcttttcttcatttcta

SEQ ID NO: 144796 - DNA, 22 bp, Artificial Sequence
  Synthetic oligonucleotide; TTT chr11 5222943 5222964 5222948 5222943 -
gcatgcttttcttcatttctaa

SEQ ID NO: 144797 - DNA, 22 bp, Artificial Sequence
  Synthetic oligonucleotide; TTG chr11 5222942 5222963 5222947 5222942 -
catgcttttcttcatttctaac

SEQ ID NO: 144798 - DNA, 22 bp, Artificial Sequence
  Synthetic oligonucleotide; CTT chr11 5222935 5222956 5222940 5222935 -
ttcttcatttctaacattctct

SEQ ID NO: 144799 - DNA, 22 bp, Artificial Sequence
  Synthetic oligonucleotide; TTT chr11 5222934 5222955 5222939 5222934 -
tcttcatttctaacattctctc

SEQ ID NO: 144800 - DNA, 22 bp, Artificial Sequence
  Synthetic oligonucleotide; TTT chr11 5222933 5222954 5222938 5222933 -
cttcatttctaacattctctct

SEQ ID NO: 144801 - DNA, 22 bp, Artificial Sequence
  Synthetic oligonucleotide; TTC chr11 5222932 5222953 5222937 5222932 -
ttcatttctaacattctctcta

SEQ ID NO: 144802 - DNA, 22 bp, Artificial Sequence
  Synthetic oligonucleotide; CTT chr11 5222930 5222951 5222935 5222930 -
catttctaacattctctctaag

SEQ ID NO: 144803 - DNA, 22 bp, Artificial Sequence
  Synthetic oligonucleotide; TTC chr11 5222929 5222950 5222934 5222929 -
atttctaacattctctctaagt

SEQ ID NO: 144804 - DNA, 22 bp, Artificial Sequence
  Synthetic oligonucleotide; TTT chr11 5222925 5222946 5222930 5222925 -
ctaacattctctctaagtttat

SEQ ID NO: 144805 - DNA, 22 bp, Artificial Sequence
  Synthetic oligonucleotide; TTC chr11 5222924 5222945 5222929 5222924 -
taacattctctctaagtttatt

SEQ ID NO: 144806 - DNA, 22 bp, Artificial Sequence
  Synthetic oligonucleotide; CTA chr11 5222922 5222943 5222927 5222922 -
acattctctctaagtttattct

SEQ ID NO: 144807 - DNA, 22 bp, Artificial Sequence
  Synthetic oligonucleotide; TTC chr11 5222916 5222937 5222921 5222916 -
tctctaagtttattctattttt

SEQ ID NO: 144808 - DNA, 22 bp, Artificial Sequence
  Synthetic oligonucleotide; CTC chr11 5222914 5222935 5222919 5222914 -
tctaagtttattctattttttt

SEQ ID NO: 144809 - DNA, 22 bp, Artificial Sequence
  Synthetic oligonucleotide; CTC chr11 5222912 5222933 5222917 5222912 -
taagtttattctatttttttct

SEQ ID NO: 144810 - DNA, 22 bp, Artificial Sequence
  Synthetic oligonucleotide; CTA chr11 5222910 5222931 5222915 5222910 -
agtttattctatttttttctga

SEQ ID NO: 144811 - DNA, 22 bp, Artificial Sequence
  Synthetic oligonucleotide; TTT chr11 5222905 5222926 5222910 5222905 -
attctatttttttctgattatc

SEQ ID NO: 144812 - DNA, 22 bp, Artificial Sequence
  Synthetic oligonucleotide; TTA chr11 5222904 5222925 5222909 5222904 -
ttctatttttttctgattatcc

SEQ ID NO: 144813 - DNA, 22 bp, Artificial Sequence
  Synthetic oligonucleotide; TTC chr11 5222901 5222922 5222906 5222901 -
tatttttttctgattatcctta

SEQ ID NO: 144814 - DNA, 22 bp, Artificial Sequence
  Synthetic oligonucleotide; CTA chr11 5222899 5222920 5222904 5222899 -
tttttttctgattatccttaat

SEQ ID NO: 144815 - DNA, 22 bp, Artificial Sequence
  Synthetic oligonucleotide; TTT chr11 5222896 5222917 5222901 5222896 -
ttttctgattatccttaatatt

SEQ ID NO: 144816 - DNA, 22 bp, Artificial Sequence
  Synthetic oligonucleotide; TTT chr11 5222895 5222916 5222900 5222895 -
tttctgattatccttaatatta

SEQ ID NO: 144817 - DNA, 22 bp, Artificial Sequence
  Synthetic oligonucleotide; TTT chr11 5222894 5222915 5222899 5222894 -
ttctgattatccttaatattat

SEQ ID NO: 144818 - DNA, 22 bp, Artificial Sequence
  Synthetic oligonucleotide; TTT chr11 5222893 5222914 5222898 5222893 -
tctgattatccttaatattatc

SEQ ID NO: 144819 - DNA, 22 bp, Artificial Sequence
  Synthetic oligonucleotide; TTT chr11 5222892 5222913 5222897 5222892 -
ctgattatccttaatattatct

SEQ ID NO: 144820 - DNA, 22 bp, Artificial Sequence
  Synthetic oligonucleotide; TTC chr11 5222891 5222912 5222896 5222891 -
tgattatccttaatattatctc

SEQ ID NO: 144821 - DNA, 22 bp, Artificial Sequence
  Synthetic oligonucleotide; CTG chr11 5222889 5222910 5222894 5222889 -
attatccttaatattatctctt

SEQ ID NO: 144822 - DNA, 22 bp, Artificial Sequence
  Synthetic oligonucleotide; TTA chr11 5222885 5222906 5222890 5222885 -
tccttaatattatctctttctg

SEQ ID NO: 144823 - DNA, 22 bp, Artificial Sequence
  Synthetic oligonucleotide; CTT chr11 5222880 5222901 5222885 5222880 -
aatattatctctttctgctgga

SEQ ID NO: 144824 - DNA, 22 bp, Artificial Sequence
  Synthetic oligonucleotide; TTA chr11 5222879 5222900 5222884 5222879 -
atattatctctttctgctggaa

SEQ ID NO: 144825 - DNA, 22 bp, Artificial Sequence
  Synthetic oligonucleotide; TTA chr11 5222873 5222894 5222878 5222873 -
tctctttctgctggaaatacat

SEQ ID NO: 144826 - DNA, 22 bp, Artificial Sequence
  Synthetic oligonucleotide; CTC chr11 5222869 5222890 5222874 5222869 -
tttctgctggaaatacattgtt

SEQ ID NO: 144827 - DNA, 22 bp, Artificial Sequence
  Synthetic oligonucleotide; CTT chr11 5222867 5222888 5222872 5222867 -
tctgctggaaatacattgttac

SEQ ID NO: 144828 - DNA, 22 bp, Artificial Sequence
  Synthetic oligonucleotide; TTT chr11 5222866 5222887 5222871 5222866 -
ctgctggaaatacattgttact

SEQ ID NO: 144829 - DNA, 22 bp, Artificial Sequence
  Synthetic oligonucleotide; TTC chr11 5222865 5222886 5222870 5222865 -
tgctggaaatacattgttactt

SEQ ID NO: 144830 - DNA, 22 bp, Artificial Sequence
  Synthetic oligonucleotide; CTG chr11 5222863 5222884 5222868 5222863 -
ctggaaatacattgttactttt

SEQ ID NO: 144831 - DNA, 22 bp, Artificial Sequence
  Synthetic oligonucleotide; CTG chr11 5222860 5222881 5222865 5222860 -
gaaatacattgttacttttggt

SEQ ID NO: 144832 - DNA, 22 bp, Artificial Sequence
  Synthetic oligonucleotide; TTG chr11 5222849 5222870 5222854 5222849 -
ttacttttggtttatctaaaaa

SEQ ID NO: 144833 - DNA, 22 bp, Artificial Sequence
  Synthetic oligonucleotide; TTA chr11 5222846 5222867 5222851 5222846 -
cttttggtttatctaaaaatgg

SEQ ID NO: 144834 - DNA, 22 bp, Artificial Sequence
  Synthetic oligonucleotide; CTT chr11 5222843 5222864 5222848 5222843 -
ttggtttatctaaaaatggctt

SEQ ID NO: 144835 - DNA, 22 bp, Artificial Sequence
  Synthetic oligonucleotide; TTT chr11 5222842 5222863 5222847 5222842 -
tggtttatctaaaaatggcttc

SEQ ID NO: 144836 - DNA, 22 bp, Artificial Sequence
  Synthetic oligonucleotide; TTT chr11 5222841 5222862 5222846 5222841 -
ggtttatctaaaaatggcttca

SEQ ID NO: 144837 - DNA, 22 bp, Artificial Sequence
  Synthetic oligonucleotide; TTG chr11 5222840 5222861 5222845 5222840 -
gtttatctaaaaatggcttcat

SEQ ID NO: 144838 - DNA, 22 bp, Artificial Sequence
  Synthetic oligonucleotide; TTT chr11 5222836 5222857 5222841 5222836 -
atctaaaaatggcttcattttc

SEQ ID NO: 144839 - DNA, 22 bp, Artificial Sequence
  Synthetic oligonucleotide; TTA chr11 5222835 5222856 5222840 5222835 -
tctaaaaatggcttcattttct

SEQ ID NO: 144840 - DNA, 22 bp, Artificial Sequence
  Synthetic oligonucleotide; CTA chr11 5222831 5222852 5222836 5222831 -
aaaatggcttcattttcttcat

SEQ ID NO: 144841 - DNA, 22 bp, Artificial Sequence
  Synthetic oligonucleotide; CTT chr11 5222821 5222842 5222826 5222821 -
cattttcttcattctaaaatca

SEQ ID NO: 144842 - DNA, 22 bp, Artificial Sequence
  Synthetic oligonucleotide; TTC chr11 5222820 5222841 5222825 5222820 -
attttcttcattctaaaatcat

SEQ ID NO: 144843 - DNA, 22 bp, Artificial Sequence
  Synthetic oligonucleotide; TTT chr11 5222816 5222837 5222821 5222816 -
tcttcattctaaaatcatgtta

SEQ ID NO: 144844 - DNA, 22 bp, Artificial Sequence
  Synthetic oligonucleotide; TTT chr11 5222815 5222836 5222820 5222815 -
cttcattctaaaatcatgttaa

SEQ ID NO: 144845 - DNA, 22 bp, Artificial Sequence
  Synthetic oligonucleotide; TTC chr11 5222814 5222835 5222819 5222814 -
ttcattctaaaatcatgttaaa

SEQ ID NO: 144846 - DNA, 22 bp, Artificial Sequence
  Synthetic oligonucleotide; CTT chr11 5222812 5222833 5222817 5222812 -
cattctaaaatcatgttaaatt

SEQ ID NO: 144847 - DNA, 22 bp, Artificial Sequence
  Synthetic oligonucleotide; TTC chr11 5222811 5222832 5222816 5222811 -
attctaaaatcatgttaaatta

SEQ ID NO: 144848 - DNA, 22 bp, Artificial Sequence
  Synthetic oligonucleotide; TTC chr11 5222807 5222828 5222812 5222807 -
taaaatcatgttaaattaatac

SEQ ID NO: 144849 - DNA, 22 bp, Artificial Sequence
  Synthetic oligonucleotide; CTA chr11 5222805 5222826 5222810 5222805 -
aaatcatgttaaattaatacca

SEQ ID NO: 144850 - DNA, 22 bp, Artificial Sequence
  Synthetic oligonucleotide; TTA chr11 5222794 5222815 5222799 5222794 -
aattaataccactcatgtgtaa

SEQ ID NO: 144851 - DNA, 22 bp, Artificial Sequence
  Synthetic oligonucleotide; TTA chr11 5222789 5222810 5222794 5222789 -
ataccactcatgtgtaagtaag

SEQ ID NO: 144852 - DNA, 22 bp, Artificial Sequence
  Synthetic oligonucleotide; CTC chr11 5222780 5222801 5222785 5222780 -
atgtgtaagtaagatagtggaa

SEQ ID NO: 144853 - DNA, 22 bp, Artificial Sequence
  Synthetic oligonucleotide; CTA chr11 5222737 5222758 5222742 5222737 -
aatctcactaaaatataataat

SEQ ID NO: 144854 - DNA, 22 bp, Artificial Sequence
  Synthetic oligonucleotide; CTC chr11 5222731 5222752 5222736 5222731 -
actaaaatataataatgtgata

SEQ ID NO: 144855 - DNA, 22 bp, Artificial Sequence
  Synthetic oligonucleotide; CTA chr11 5222727 5222748 5222732 5222727 -
aaatataataatgtgatatata

SEQ ID NO: 144856 - DNA, 22 bp, Artificial Sequence
  Synthetic oligonucleotide; CTT chr11 5222693 5222714 5222698 5222693 -
ttaaatttagcttggaaataaa

SEQ ID NO: 144857 - DNA, 22 bp, Artificial Sequence
  Synthetic oligonucleotide; TTT chr11 5222692 5222713 5222697 5222692 -
taaatttagcttggaaataaaa

SEQ ID NO: 144858 - DNA, 22 bp, Artificial Sequence
  Synthetic oligonucleotide; TTT chr11 5222691 5222712 5222696 5222691 -
aaatttagcttggaaataaaaa

SEQ ID NO: 144859 - DNA, 22 bp, Artificial Sequence
  Synthetic oligonucleotide; TTA chr11 5222690 5222711 5222695 5222690 -
aatttagcttggaaataaaaaa

SEQ ID NO: 144860 - DNA, 22 bp, Artificial Sequence
  Synthetic oligonucleotide; TTT chr11 5222685 5222706 5222690 5222685 -
agcttggaaataaaaaacaaac

SEQ ID NO: 144861 - DNA, 22 bp, Artificial Sequence
  Synthetic oligonucleotide; TTA chr11 5222684 5222705 5222689 5222684 -
gcttggaaataaaaaacaaaca

SEQ ID NO: 144862 - DNA, 22 bp, Artificial Sequence
  Synthetic oligonucleotide; CTT chr11 5222680 5222701 5222685 5222680 -
ggaaataaaaaacaaacagtaa

SEQ ID NO: 144863 - DNA, 22 bp, Artificial Sequence
  Synthetic oligonucleotide; TTG chr11 5222679 5222700 5222684 5222679 -
gaaataaaaaacaaacagtaat

SEQ ID NO: 144864 - DNA, 22 bp, Artificial Sequence
  Synthetic oligonucleotide; TTG chr11 5222655 5222676 5222660 5222655 -
aacaactatactttttgaaaag

SEQ ID NO: 144865 - DNA, 22 bp, Artificial Sequence
  Synthetic oligonucleotide; CTA chr11 5222647 5222668 5222652 5222647 -
tactttttgaaaagagtaaagt

SEQ ID NO: 144866 - DNA, 22 bp, Artificial Sequence
  Synthetic oligonucleotide; CTT chr11 5222642 5222663 5222647 5222642 -
tttgaaaagagtaaagtgaaat

SEQ ID NO: 144867 - DNA, 22 bp, Artificial Sequence
  Synthetic oligonucleotide; TTT chr11 5222641 5222662 5222646 5222641 -
ttgaaaagagtaaagtgaaatg

SEQ ID NO: 144868 - DNA, 22 bp, Artificial Sequence
  Synthetic oligonucleotide; TTT chr11 5222640 5222661 5222645 5222640 -
tgaaaagagtaaagtgaaatgc

SEQ ID NO: 144869 - DNA, 22 bp, Artificial Sequence
  Synthetic oligonucleotide; TTT chr11 5222639 5222660 5222644 5222639 -
gaaaagagtaaagtgaaatgct

SEQ ID NO: 144870 - DNA, 22 bp, Artificial Sequence
  Synthetic oligonucleotide; TTG chr11 5222638 5222659 5222643 5222638 -
aaaagagtaaagtgaaatgctt

SEQ ID NO: 144871 - DNA, 22 bp, Artificial Sequence
  Synthetic oligonucleotide; CTT chr11 5222616 5222637 5222621 5222616 -
aactgcatataccacaatcgat

SEQ ID NO: 144872 - DNA, 22 bp, Artificial Sequence
  Synthetic oligonucleotide; TTA chr11 5222615 5222636 5222620 5222615 -
actgcatataccacaatcgatt

SEQ ID NO: 144873 - DNA, 22 bp, Artificial Sequence
  Synthetic oligonucleotide; CTG chr11 5222611 5222632 5222616 5222611 -
catataccacaatcgattacac

SEQ ID NO: 144874 - DNA, 22 bp, Artificial Sequence
  Synthetic oligonucleotide; TTA chr11 5222592 5222613 5222597 5222592 -
cacaattaggtgtgaaggtaaa

SEQ ID NO: 144875 - DNA, 22 bp, Artificial Sequence
  Synthetic oligonucleotide; TTA chr11 5222584 5222605 5222589 5222584 -
ggtgtgaaggtaaaattcagtc

SEQ ID NO: 144876 - DNA, 22 bp, Artificial Sequence
  Synthetic oligonucleotide; TTC chr11 5222566 5222587 5222571 5222566 -
agtcacgaaaaaactagaataa

SEQ ID NO: 144877 - DNA, 22 bp, Artificial Sequence
  Synthetic oligonucleotide; CTA chr11 5222550 5222571 5222555 5222550 -
gaataaaaatatgggaagacat

SEQ ID NO: 144878 - DNA, 22 bp, Artificial Sequence
  Synthetic oligonucleotide; CTT chr11 5222516 5222537 5222521 5222516 -
agagataacactgttatttaat

SEQ ID NO: 144879 - DNA, 22 bp, Artificial Sequence
  Synthetic oligonucleotide; TTA chr11 5222515 5222536 5222520 5222515 -
gagataacactgttatttaatt

SEQ ID NO: 144880 - DNA, 22 bp, Artificial Sequence
  Synthetic oligonucleotide; CTG chr11 5222503 5222524 5222508 5222503 -
ttatttaattatcaacccaaag

SEQ ID NO: 144881 - DNA, 22 bp, Artificial Sequence
  Synthetic oligonucleotide; TTA chr11 5222500 5222521 5222505 5222500 -
tttaattatcaacccaaagtag

SEQ ID NO: 144882 - DNA, 22 bp, Artificial Sequence
  Synthetic oligonucleotide; TTT chr11 5222497 5222518 5222502 5222497 -
aattatcaacccaaagtagaaa

SEQ ID NO: 144883 - DNA, 22 bp, Artificial Sequence
  Synthetic oligonucleotide; TTA chr11 5222496 5222517 5222501 5222496 -
attatcaacccaaagtagaaac

SEQ ID NO: 144884 - DNA, 22 bp, Artificial Sequence
  Synthetic oligonucleotide; TTA chr11 5222492 5222513 5222497 5222492 -
tcaacccaaagtagaaactatc

SEQ ID NO: 144885 - DNA, 22 bp, Artificial Sequence
  Synthetic oligonucleotide; CTA chr11 5222472 5222493 5222477 5222472 -
tcaagggagaaataaattcagt

SEQ ID NO: 144886 - DNA, 22 bp, Artificial Sequence
  Synthetic oligonucleotide; TTC chr11 5222453 5222474 5222458 5222453 -
agtcaacaataaaagcatttaa

SEQ ID NO: 144887 - DNA, 22 bp, Artificial Sequence
  Synthetic oligonucleotide; TTT chr11 5222433 5222454 5222438 5222433 -
aagaagttattctaggctggga

SEQ ID NO: 144888 - DNA, 22 bp, Artificial Sequence
  Synthetic oligonucleotide; TTA chr11 5222432 5222453 5222437 5222432 -
agaagttattctaggctgggag

SEQ ID NO: 144889 - DNA, 22 bp, Artificial Sequence
  Synthetic oligonucleotide; TTA chr11 5222424 5222445 5222429 5222424 -
ttctaggctgggagcggtggct

SEQ ID NO: 144890 - DNA, 22 bp, Artificial Sequence
  Synthetic oligonucleotide; TTC chr11 5222421 5222442 5222426 5222421 -
taggctgggagcggtggctcac

SEQ ID NO: 144891 - DNA, 22 bp, Artificial Sequence
  Synthetic oligonucleotide; CTA chr11 5222419 5222440 5222424 5222419 -
ggctgggagcggtggctcacac

SEQ ID NO: 144892 - DNA, 22 bp, Artificial Sequence
  Synthetic oligonucleotide; CTG chr11 5222414 5222435 5222419 5222414 -
ggagcggtggctcacacctgca

SEQ ID NO: 144893 - DNA, 22 bp, Artificial Sequence
  Synthetic oligonucleotide; CTC chr11 5222401 5222422 5222406 5222401 -
acacctgcaattgcagcacttt

SEQ ID NO: 144894 - DNA, 22 bp, Artificial Sequence
  Synthetic oligonucleotide; CTG chr11 5222394 5222415 5222399 5222394 -
caattgcagcactttgggaggc

SEQ ID NO: 144895 - DNA, 22 bp, Artificial Sequence
  Synthetic oligonucleotide; TTG chr11 5222388 5222409 5222393 5222388 -
cagcactttgggaggcctagac

SEQ ID NO: 144896 - DNA, 22 bp, Artificial Sequence
  Synthetic oligonucleotide; CTT chr11 5222380 5222401 5222385 5222380 -
tgggaggcctagacaggcggat

SEQ ID NO: 144897 - DNA, 22 bp, Artificial Sequence
  Synthetic oligonucleotide; TTT chr11 5222379 5222400 5222384 5222379 -
gggaggcctagacaggcggatc

SEQ ID NO: 144898 - DNA, 22 bp, Artificial Sequence
  Synthetic oligonucleotide; TTG chr11 5222378 5222399 5222383 5222378 -
ggaggcctagacaggcggatca

SEQ ID NO: 144899 - DNA, 22 bp, Artificial Sequence
  Synthetic oligonucleotide; CTA chr11 5222369 5222390 5222374 5222369 -
gacaggcggatcacgacgtcag

SEQ ID NO: 144900 - DNA, 22 bp, Artificial Sequence
  Synthetic oligonucleotide; TTC chr11 5222341 5222362 5222346 5222341 -
aagatcagcctggccaacatag

SEQ ID NO: 144901 - DNA, 22 bp, Artificial Sequence
  Synthetic oligonucleotide; CTG chr11 5222329 5222350 5222334 5222329 -
gccaacatagtgaaacctcatc

SEQ ID NO: 144902 - DNA, 22 bp, Artificial Sequence
  Synthetic oligonucleotide; CTC chr11 5222310 5222331 5222315 5222310 -
atcgctactaaaaatataaaaa

SEQ ID NO: 144903 - DNA, 22 bp, Artificial Sequence
  Synthetic oligonucleotide; CTA chr11 5222303 5222324 5222308 5222303 -
ctaaaaatataaaaacttagcc

SEQ ID NO: 144904 - DNA, 22 bp, Artificial Sequence
  Synthetic oligonucleotide; CTA chr11 5222300 5222321 5222305 5222300 -
aaaatataaaaacttagcctgg

SEQ ID NO: 144905 - DNA, 22 bp, Artificial Sequence
  Synthetic oligonucleotide; CTT chr11 5222285 5222306 5222290 5222285 -
agcctggcgtggtggcaggcat

SEQ ID NO: 144906 - DNA, 22 bp, Artificial Sequence
  Synthetic oligonucleotide; TTA chr11 5222284 5222305 5222289 5222284 -
gcctggcgtggtggcaggcatg

SEQ ID NO: 144907 - DNA, 22 bp, Artificial Sequence
  Synthetic oligonucleotide; CTG chr11 5222279 5222300 5222284 5222279 -
gcgtggtggcaggcatgtgtaa

SEQ ID NO: 144908 - DNA, 22 bp, Artificial Sequence
  Synthetic oligonucleotide; TTT chr11 5222245 5222266 5222250 5222245 -
gggaggctgaggcaggagaatc

SEQ ID NO: 144909 - DNA, 22 bp, Artificial Sequence
  Synthetic oligonucleotide; TTG chr11 5222244 5222265 5222249 5222244 -
ggaggctgaggcaggagaatcg

SEQ ID NO: 144910 - DNA, 22 bp, Artificial Sequence
  Synthetic oligonucleotide; CTG chr11 5222236 5222257 5222241 5222236 -
aggcaggagaatcgcttgatcc

SEQ ID NO: 144911 - DNA, 22 bp, Artificial Sequence
  Synthetic oligonucleotide; CTT chr11 5222219 5222240 5222224 5222219 -
gatcctgggaggcagaggttgc

SEQ ID NO: 144912 - DNA, 22 bp, Artificial Sequence
  Synthetic oligonucleotide; TTG chr11 5222218 5222239 5222223 5222218 -
atcctgggaggcagaggttgca

SEQ ID NO: 144913 - DNA, 22 bp, Artificial Sequence
  Synthetic oligonucleotide; CTG chr11 5222212 5222233 5222217 5222212 -
ggaggcagaggttgcagtgagc

SEQ ID NO: 144914 - DNA, 22 bp, Artificial Sequence
  Synthetic oligonucleotide; TTG chr11 5222198 5222219 5222203 5222198 -
cagtgagccaagattgtgccac

SEQ ID NO: 144915 - DNA, 22 bp, Artificial Sequence
  Synthetic oligonucleotide; TTG chr11 5222182 5222203 5222187 5222182 -
tgccactgcattccagcccagg

SEQ ID NO: 144916 - DNA, 22 bp, Artificial Sequence
  Synthetic oligonucleotide; CTG chr11 5222174 5222195 5222179 5222174 -
cattccagcccaggtgacagca

SEQ ID NO: 144917 - DNA, 22 bp, Artificial Sequence
  Synthetic oligonucleotide; TTC chr11 5222169 5222190 5222174 5222169 -
cagcccaggtgacagcatgaga

SEQ ID NO: 144918 - DNA, 22 bp, Artificial Sequence
  Synthetic oligonucleotide; CTC chr11 5222144 5222165 5222149 5222144 -
cgtcacaaaaaaaaaagaaaaa

SEQ ID NO: 144919 - DNA, 22 bp, Artificial Sequence
  Synthetic oligonucleotide; CTC chr11 5222071 5222092 5222076 5222071 -
cagtctatagctcccatcgtga

SEQ ID NO: 144920 - DNA, 22 bp, Artificial Sequence
  Synthetic oligonucleotide; CTA chr11 5222064 5222085 5222069 5222064 -
tagctcccatcgtgagtgacgc

SEQ ID NO: 144921 - DNA, 22 bp, Artificial Sequence
  Synthetic oligonucleotide; CTC chr11 5222058 5222079 5222063 5222058 -
ccatcgtgagtgacgcagaaga

SEQ ID NO: 144922 - DNA, 22 bp, Artificial Sequence
  Synthetic oligonucleotide; TTT chr11 5222026 5222047 5222031 5222026 -
ctgcatttccaactgaggtacc

SEQ ID NO: 144923 - DNA, 22 bp, Artificial Sequence
  Synthetic oligonucleotide; TTC chr11 5222025 5222046 5222030 5222025 -
tgcatttccaactgaggtacca

SEQ ID NO: 144924 - DNA, 22 bp, Artificial Sequence
  Synthetic oligonucleotide; CTG chr11 5222023 5222044 5222028 5222023 -
catttccaactgaggtaccagg

SEQ ID NO: 144925 - DNA, 22 bp, Artificial Sequence
  Synthetic oligonucleotide; TTT chr11 5222018 5222039 5222023 5222018 -
ccaactgaggtaccaggttcat

SEQ ID NO: 144926 - DNA, 22 bp, Artificial Sequence
  Synthetic oligonucleotide; TTC chr11 5222017 5222038 5222022 5222017 -
caactgaggtaccaggttcatc

SEQ ID NO: 144927 - DNA, 22 bp, Artificial Sequence
  Synthetic oligonucleotide; CTG chr11 5222011 5222032 5222016 5222011 -
aggtaccaggttcatctcacag

SEQ ID NO: 144928 - DNA, 22 bp, Artificial Sequence
  Synthetic oligonucleotide; TTC chr11 5221998 5222019 5222003 5221998 -
atctcacagggaagtgccaggc

SEQ ID NO: 144929 - DNA, 22 bp, Artificial Sequence
  Synthetic oligonucleotide; CTC chr11 5221993 5222014 5221998 5221993 -
acagggaagtgccaggcagtgg

SEQ ID NO: 144930 - DNA, 22 bp, Artificial Sequence
  Synthetic oligonucleotide; CTG chr11 5221944 5221965 5221949 5221944 -
tgcatgagccaaagcagggcga

SEQ ID NO: 144931 - DNA, 22 bp, Artificial Sequence
  Synthetic oligonucleotide; CTC chr11 5221911 5221932 5221916 5221911 -
acccgggaagcacaaggggtca

SEQ ID NO: 144932 - DNA, 22 bp, Artificial Sequence
  Synthetic oligonucleotide; TTC chr11 5221881 5221902 5221886 5221881 -
cctttcctagtcaaagaaaagg

SEQ ID NO: 144933 - DNA, 22 bp, Artificial Sequence
  Synthetic oligonucleotide; CTT chr11 5221877 5221898 5221882 5221877 -
tcctagtcaaagaaaagggtga

SEQ ID NO: 144934 - DNA, 22 bp, Artificial Sequence
  Synthetic oligonucleotide; TTT chr11 5221876 5221897 5221881 5221876 -
cctagtcaaagaaaagggtgac

SEQ ID NO: 144935 - DNA, 22 bp, Artificial Sequence
  Synthetic oligonucleotide; TTC chr11 5221875 5221896 5221880 5221875 -
ctagtcaaagaaaagggtgaca

SEQ ID NO: 144936 - DNA, 22 bp, Artificial Sequence
  Synthetic oligonucleotide; CTA chr11 5221872 5221893 5221877 5221872 -
gtcaaagaaaagggtgacagat

SEQ ID NO: 144937 - DNA, 22 bp, Artificial Sequence
  Synthetic oligonucleotide; CTG chr11 5221842 5221863 5221847 5221842 -
gaaaatcgggtcactcccgccc

SEQ ID NO: 144938 - DNA, 22 bp, Artificial Sequence
  Synthetic oligonucleotide; CTC chr11 5221826 5221847 5221831 5221826 -
ccgccctaatactgcgctcttc

SEQ ID NO: 144939 - DNA, 22 bp, Artificial Sequence
  Synthetic oligonucleotide; CTA chr11 5221818 5221839 5221823 5221818 -
atactgcgctcttccaacaagc

SEQ ID NO: 144940 - DNA, 22 bp, Artificial Sequence
  Synthetic oligonucleotide; CTG chr11 5221812 5221833 5221817 5221812 -
cgctcttccaacaagcttaaca

SEQ ID NO: 144941 - DNA, 22 bp, Artificial Sequence
  Synthetic oligonucleotide; CTC chr11 5221807 5221828 5221812 5221807 -
ttccaacaagcttaacaaatgg

SEQ ID NO: 144942 - DNA, 22 bp, Artificial Sequence
  Synthetic oligonucleotide; CTT chr11 5221805 5221826 5221810 5221805 -
ccaacaagcttaacaaatggca

SEQ ID NO: 144943 - DNA, 22 bp, Artificial Sequence
  Synthetic oligonucleotide; TTC chr11 5221804 5221825 5221809 5221804 -
caacaagcttaacaaatggcac

SEQ ID NO: 144944 - DNA, 22 bp, Artificial Sequence
  Synthetic oligonucleotide; CTT chr11 5221794 5221815 5221799 5221794 -
aacaaatggcacaccaggagat

SEQ ID NO: 144945 - DNA, 22 bp, Artificial Sequence
  Synthetic oligonucleotide; TTA chr11 5221793 5221814 5221798 5221793 -
acaaatggcacaccaggagatt

SEQ ID NO: 144946 - DNA, 22 bp, Artificial Sequence
  Synthetic oligonucleotide; TTA chr11 5221770 5221791 5221775 5221770 -
tatcccatgcctggctcagagg

SEQ ID NO: 144947 - DNA, 22 bp, Artificial Sequence
  Synthetic oligonucleotide; CTG chr11 5221757 5221778 5221762 5221757 -
gctcagagggtcctacgcccat

SEQ ID NO: 144948 - DNA, 22 bp, Artificial Sequence
  Synthetic oligonucleotide; CTC chr11 5221753 5221774 5221758 5221753 -
agagggtcctacgcccatggag

SEQ ID NO: 144949 - DNA, 22 bp, Artificial Sequence
  Synthetic oligonucleotide; CTA chr11 5221742 5221763 5221747 5221742 -
cgcccatggagcctcgctcatt

SEQ ID NO: 144950 - DNA, 22 bp, Artificial Sequence
  Synthetic oligonucleotide; CTC chr11 5221727 5221748 5221732 5221727 -
gctcattgctagcacagcagtc

SEQ ID NO: 144951 - DNA, 22 bp, Artificial Sequence
  Synthetic oligonucleotide; CTC chr11 5221723 5221744 5221728 5221723 -
attgctagcacagcagtctgag

SEQ ID NO: 144952 - DNA, 22 bp, Artificial Sequence
  Synthetic oligonucleotide; TTG chr11 5221719 5221740 5221724 5221719 -
ctagcacagcagtctgaggtca

SEQ ID NO: 144953 - DNA, 22 bp, Artificial Sequence
  Synthetic oligonucleotide; CTA chr11 5221716 5221737 5221721 5221716 -
gcacagcagtctgaggtcaaac

SEQ ID NO: 144954 - DNA, 22 bp, Artificial Sequence
  Synthetic oligonucleotide; CTG chr11 5221703 5221724 5221708 5221703 -
aggtcaaactgcaaggtggcag

SEQ ID NO: 144955 - DNA, 22 bp, Artificial Sequence
  Synthetic oligonucleotide; CTG chr11 5221692 5221713 5221697 5221692 -
caaggtggcagtgaggctgggg

SEQ ID NO: 144956 - DNA, 22 bp, Artificial Sequence
  Synthetic oligonucleotide; CTG chr11 5221673 5221694 5221678 5221673 -
ggggaggggtgcccaccattgt

SEQ ID NO: 144957 - DNA, 22 bp, Artificial Sequence
  Synthetic oligonucleotide; TTG chr11 5221652 5221673 5221657 5221652 -
tccaggcttgagcaggtaaaca

SEQ ID NO: 144958 - DNA, 22 bp, Artificial Sequence
  Synthetic oligonucleotide; CTT chr11 5221643 5221664 5221648 5221643 -
gagcaggtaaacaaagccgcct

SEQ ID NO: 144959 - DNA, 22 bp, Artificial Sequence
  Synthetic oligonucleotide; TTG chr11 5221642 5221663 5221647 5221642 -
agcaggtaaacaaagccgcctg

SEQ ID NO: 144960 - DNA, 22 bp, Artificial Sequence
  Synthetic oligonucleotide; CTG chr11 5221620 5221641 5221625 5221620 -
gaagctcgaactgggtggagcc

SEQ ID NO: 144961 - DNA, 22 bp, Artificial Sequence
  Synthetic oligonucleotide; CTC chr11 5221613 5221634 5221618 5221613 -
gaactgggtggagcccaccaca

SEQ ID NO: 144962 - DNA, 22 bp, Artificial Sequence
  Synthetic oligonucleotide; CTG chr11 5221607 5221628 5221612 5221607 -
ggtggagcccaccacagctcaa

SEQ ID NO: 144963 - DNA, 22 bp, Artificial Sequence
  Synthetic oligonucleotide; CTC chr11 5221587 5221608 5221592 5221587 -
aaggaggcctgcctgcctctgt

SEQ ID NO: 144964 - DNA, 22 bp, Artificial Sequence
  Synthetic oligonucleotide; CTG chr11 5221576 5221597 5221581 5221576 -
cctgcctctgtaggctccacct

SEQ ID NO: 144965 - DNA, 22 bp, Artificial Sequence
  Synthetic oligonucleotide; CTG chr11 5221572 5221593 5221577 5221572 -
cctctgtaggctccacctctag

SEQ ID NO: 144966 - DNA, 22 bp, Artificial Sequence
  Synthetic oligonucleotide; CTC chr11 5221568 5221589 5221573 5221568 -
tgtaggctccacctctaggggc

SEQ ID NO: 144967 - DNA, 22 bp, Artificial Sequence
  Synthetic oligonucleotide; CTG chr11 5221566 5221587 5221571 5221566 -
taggctccacctctaggggcag

SEQ ID NO: 144968 - DNA, 22 bp, Artificial Sequence
  Synthetic oligonucleotide; CTC chr11 5221559 5221580 5221564 5221559 -
cacctctaggggcagggcacag

SEQ ID NO: 144969 - DNA, 22 bp, Artificial Sequence
  Synthetic oligonucleotide; CTC chr11 5221553 5221574 5221558 5221553 -
taggggcagggcacagacaaac

SEQ ID NO: 144970 - DNA, 22 bp, Artificial Sequence
  Synthetic oligonucleotide; CTA chr11 5221551 5221572 5221556 5221551 -
ggggcagggcacagacaaacaa

SEQ ID NO: 144971 - DNA, 22 bp, Artificial Sequence
  Synthetic oligonucleotide; CTC chr11 5221512 5221533 5221517 5221512 -
tgcagacttaaatgtccctgtc

SEQ ID NO: 144972 - DNA, 22 bp, Artificial Sequence
  Synthetic oligonucleotide; CTG chr11 5221510 5221531 5221515 5221510 -
cagacttaaatgtccctgtctg

SEQ ID NO: 144973 - DNA, 22 bp, Artificial Sequence
  Synthetic oligonucleotide; CTT chr11 5221503 5221524 5221508 5221503 -
aaatgtccctgtctgacagctt

SEQ ID NO: 144974 - DNA, 22 bp, Artificial Sequence
  Synthetic oligonucleotide; TTA chr11 5221502 5221523 5221507 5221502 -
aatgtccctgtctgacagcttt

SEQ ID NO: 144975 - DNA, 22 bp, Artificial Sequence
  Synthetic oligonucleotide; CTG chr11 5221492 5221513 5221497 5221492 -
tctgacagctttgaagagagta

SEQ ID NO: 144976 - DNA, 22 bp, Artificial Sequence
  Synthetic oligonucleotide; CTG chr11 5221488 5221509 5221493 5221488 -
acagctttgaagagagtagtgg

SEQ ID NO: 144977 - DNA, 22 bp, Artificial Sequence
  Synthetic oligonucleotide; CTT chr11 5221481 5221502 5221486 5221481 -
tgaagagagtagtggttctccc

SEQ ID NO: 144978 - DNA, 22 bp, Artificial Sequence
  Synthetic oligonucleotide; TTT chr11 5221480 5221501 5221485 5221480 -
gaagagagtagtggttctccca

SEQ ID NO: 144979 - DNA, 22 bp, Artificial Sequence
  Synthetic oligonucleotide; TTG chr11 5221479 5221500 5221484 5221479 -
aagagagtagtggttctcccag

SEQ ID NO: 144980 - DNA, 22 bp, Artificial Sequence
  Synthetic oligonucleotide; TTC chr11 5221463 5221484 5221468 5221463 -
tcccagcacatagcttcagatc

SEQ ID NO: 144981 - DNA, 22 bp, Artificial Sequence
  Synthetic oligonucleotide; CTC chr11 5221461 5221482 5221466 5221461 -
ccagcacatagcttcagatctg

SEQ ID NO: 144982 - DNA, 22 bp, Artificial Sequence
  Synthetic oligonucleotide; CTT chr11 5221447 5221468 5221452 5221447 -
cagatctgagaacaggcagact

SEQ ID NO: 144983 - DNA, 22 bp, Artificial Sequence
  Synthetic oligonucleotide; TTC chr11 5221446 5221467 5221451 5221446 -
agatctgagaacaggcagactg

SEQ ID NO: 144984 - DNA, 22 bp, Artificial Sequence
  Synthetic oligonucleotide; CTG chr11 5221439 5221460 5221444 5221439 -
agaacaggcagactgcctcctc

SEQ ID NO: 144985 - DNA, 22 bp, Artificial Sequence
  Synthetic oligonucleotide; CTG chr11 5221424 5221445 5221429 5221424 -
cctcctcaagtgggtccctgac

SEQ ID NO: 144986 - DNA, 22 bp, Artificial Sequence
  Synthetic oligonucleotide; CTC chr11 5221420 5221441 5221425 5221420 -
ctcaagtgggtccctgaccccc

SEQ ID NO: 144987 - DNA, 22 bp, Artificial Sequence
  Synthetic oligonucleotide; CTC chr11 5221417 5221438 5221422 5221417 -
aagtgggtccctgacccccgag

SEQ ID NO: 144988 - DNA, 22 bp, Artificial Sequence
  Synthetic oligonucleotide; CTG chr11 5221404 5221425 5221409 5221404 -
acccccgagtagcctaactggg

SEQ ID NO: 144989 - DNA, 22 bp, Artificial Sequence
  Synthetic oligonucleotide; CTA chr11 5221388 5221409 5221393 5221388 -
actgggaggcatcccccagtag

SEQ ID NO: 144990 - DNA, 22 bp, Artificial Sequence
  Synthetic oligonucleotide; CTG chr11 5221384 5221405 5221389 5221384 -
ggaggcatcccccagtaggggc

SEQ ID NO: 144991 - DNA, 22 bp, Artificial Sequence
  Synthetic oligonucleotide; CTG chr11 5221356 5221377 5221361 5221356 -
acacctcacatggctggtactc

SEQ ID NO: 144992 - DNA, 22 bp, Artificial Sequence
  Synthetic oligonucleotide; CTC chr11 5221349 5221370 5221354 5221349 -
acatggctggtactcctctaag

SEQ ID NO: 144993 - DNA, 22 bp, Artificial Sequence
  Synthetic oligonucleotide; CTG chr11 5221340 5221361 5221345 5221340 -
gtactcctctaagacaaaactt

SEQ ID NO: 144994 - DNA, 22 bp, Artificial Sequence
  Synthetic oligonucleotide; CTC chr11 5221334 5221355 5221339 5221334 -
ctctaagacaaaacttccagag

SEQ ID NO: 144995 - DNA, 22 bp, Artificial Sequence
  Synthetic oligonucleotide; CTC chr11 5221331 5221352 5221336 5221331 -
taagacaaaacttccagaggaa

SEQ ID NO: 144996 - DNA, 22 bp, Artificial Sequence
  Synthetic oligonucleotide; CTA chr11 5221329 5221350 5221334 5221329 -
agacaaaacttccagaggaatg

SEQ ID NO: 144997 - DNA, 22 bp, Artificial Sequence
  Synthetic oligonucleotide; CTT chr11 5221318 5221339 5221323 5221318 -
ccagaggaatgatcaggcagca

SEQ ID NO: 144998 - DNA, 22 bp, Artificial Sequence
  Synthetic oligonucleotide; TTC chr11 5221317 5221338 5221322 5221317 -
cagaggaatgatcaggcagcag

SEQ ID NO: 144999 - DNA, 22 bp, Artificial Sequence
  Synthetic oligonucleotide; TTT chr11 5221290 5221311 5221295 5221290 -
gcggttcaccaatatccactgt

SEQ ID NO: 145000 - DNA, 22 bp, Artificial Sequence
  Synthetic oligonucleotide; TTG chr11 5221289 5221310 5221294 5221289 -
cggttcaccaatatccactgtt

SEQ ID NO: 145001 - DNA, 22 bp, Artificial Sequence
  Synthetic oligonucleotide; TTC chr11 5221283 5221304 5221288 5221283 -
accaatatccactgttctgcag

SEQ ID NO: 145002 - DNA, 22 bp, Artificial Sequence
  Synthetic oligonucleotide; CTG chr11 5221269 5221290 5221274 5221269 -
ttctgcagccaccgctgttgat

SEQ ID NO: 145003 - DNA, 22 bp, Artificial Sequence
  Synthetic oligonucleotide; TTC chr11 5221266 5221287 5221271 5221266 -
tgcagccaccgctgttgatacc

SEQ ID NO: 145004 - DNA, 22 bp, Artificial Sequence
  Synthetic oligonucleotide; CTG chr11 5221264 5221285 5221269 5221264 -
cagccaccgctgttgataccca

SEQ ID NO: 145005 - DNA, 22 bp, Artificial Sequence
  Synthetic oligonucleotide; CTG chr11 5221252 5221273 5221257 5221252 -
ttgatacccaggaaaacagctt

SEQ ID NO: 145006 - DNA, 22 bp, Artificial Sequence
  Synthetic oligonucleotide; TTG chr11 5221249 5221270 5221254 5221249 -
atacccaggaaaacagcttctg

SEQ ID NO: 145007 - DNA, 22 bp, Artificial Sequence
  Synthetic oligonucleotide; CTT chr11 5221230 5221251 5221235 5221230 -
ctggagtggacctccagtaaac

SEQ ID NO: 145008 - DNA, 22 bp, Artificial Sequence
  Synthetic oligonucleotide; TTC chr11 5221229 5221250 5221234 5221229 -
tggagtggacctccagtaaact

SEQ ID NO: 145009 - DNA, 22 bp, Artificial Sequence
  Synthetic oligonucleotide; CTG chr11 5221227 5221248 5221232 5221227 -
gagtggacctccagtaaactcc

SEQ ID NO: 145010 - DNA, 22 bp, Artificial Sequence
  Synthetic oligonucleotide; CTC chr11 5221216 5221237 5221221 5221216 -
cagtaaactccaacagacctgc

SEQ ID NO: 145011 - DNA, 22 bp, Artificial Sequence
  Synthetic oligonucleotide; CTC chr11 5221206 5221227 5221211 5221206 -
caacagacctgcagctgagggt

SEQ ID NO: 145012 - DNA, 22 bp, Artificial Sequence
  Synthetic oligonucleotide; CTG chr11 5221195 5221216 5221200 5221195 -
cagctgagggtcctgactgtta

SEQ ID NO: 145013 - DNA, 22 bp, Artificial Sequence
  Synthetic oligonucleotide; CTG chr11 5221189 5221210 5221194 5221189 -
agggtcctgactgttagaagga

SEQ ID NO: 145014 - DNA, 22 bp, Artificial Sequence
  Synthetic oligonucleotide; CTG chr11 5221180 5221201 5221185 5221180 -
actgttagaaggaaaactaaca

SEQ ID NO: 145015 - DNA, 22 bp, Artificial Sequence
  Synthetic oligonucleotide; CTG chr11 5221176 5221197 5221181 5221176 -
ttagaaggaaaactaacaaaca

SEQ ID NO: 145016 - DNA, 22 bp, Artificial Sequence
  Synthetic oligonucleotide; TTA chr11 5221173 5221194 5221178 5221173 -
gaaggaaaactaacaaacagaa

SEQ ID NO: 145017 - DNA, 22 bp, Artificial Sequence
  Synthetic oligonucleotide; CTA chr11 5221161 5221182 5221166 5221161 -
acaaacagaaaggacatccaca

SEQ ID NO: 145018 - DNA, 22 bp, Artificial Sequence
  Synthetic oligonucleotide; CTG chr11 5221124 5221145 5221129 5221124 -
tacatcgccatcatcaaagacc

SEQ ID NO: 145019 - DNA, 22 bp, Artificial Sequence
  Synthetic oligonucleotide; CTG chr11 5221052 5221073 5221057 5221052 -
gacactctaaaaatgagagtgc

SEQ ID NO: 145020 - DNA, 22 bp, Artificial Sequence
  Synthetic oligonucleotide; CTC chr11 5221045 5221066 5221050 5221045 -
taaaaatgagagtgcctctcct

SEQ ID NO: 145021 - DNA, 22 bp, Artificial Sequence
  Synthetic oligonucleotide; CTA chr11 5221043 5221064 5221048 5221043 -
aaaatgagagtgcctctcctcc

SEQ ID NO: 145022 - DNA, 22 bp, Artificial Sequence
  Synthetic oligonucleotide; CTC chr11 5221027 5221048 5221032 5221027 -
tcctcctccaaagtaacgcagc

SEQ ID NO: 145023 - DNA, 22 bp, Artificial Sequence
  Synthetic oligonucleotide; CTC chr11 5221025 5221046 5221030 5221025 -
ctcctccaaagtaacgcagctc

SEQ ID NO: 145024 - DNA, 22 bp, Artificial Sequence
  Synthetic oligonucleotide; CTC chr11 5221022 5221043 5221027 5221022 -
ctccaaagtaacgcagctcctc

SEQ ID NO: 145025 - DNA, 22 bp, Artificial Sequence
  Synthetic oligonucleotide; CTC chr11 5221019 5221040 5221024 5221019 -
caaagtaacgcagctcctcacc

SEQ ID NO: 145026 - DNA, 22 bp, Artificial Sequence
  Synthetic oligonucleotide; CTC chr11 5221003 5221024 5221008 5221003 -
ctcaccagcaatggaacaaagc

SEQ ID NO: 145027 - DNA, 22 bp, Artificial Sequence
  Synthetic oligonucleotide; CTC chr11 5221000 5221021 5221005 5221000 -
accagcaatggaacaaagctgg

SEQ ID NO: 145028 - DNA, 22 bp, Artificial Sequence
  Synthetic oligonucleotide; CTG chr11 5220979 5221000 5220984 5220979 -
ggcagagaatgactttgacgag

SEQ ID NO: 145029 - DNA, 22 bp, Artificial Sequence
  Synthetic oligonucleotide; CTT chr11 5220964 5220985 5220969 5220964 -
tgacgagttgagagaggaaggc

SEQ ID NO: 145030 - DNA, 22 bp, Artificial Sequence
  Synthetic oligonucleotide; TTT chr11 5220963 5220984 5220968 5220963 -
gacgagttgagagaggaaggct

SEQ ID NO: 145031 - DNA, 22 bp, Artificial Sequence
  Synthetic oligonucleotide; TTG chr11 5220962 5220983 5220967 5220962 -
acgagttgagagaggaaggctt

SEQ ID NO: 145032 - DNA, 22 bp, Artificial Sequence
  Synthetic oligonucleotide; TTG chr11 5220954 5220975 5220959 5220954 -
agagaggaaggcttcagaagat

SEQ ID NO: 145033 - DNA, 22 bp, Artificial Sequence
  Synthetic oligonucleotide; CTT chr11 5220940 5220961 5220945 5220940 -
cagaagatcaaactactccaag

SEQ ID NO: 145034 - DNA, 22 bp, Artificial Sequence
  Synthetic oligonucleotide; TTC chr11 5220939 5220960 5220944 5220939 -
agaagatcaaactactccaagc

SEQ ID NO: 145035 - DNA, 22 bp, Artificial Sequence
  Synthetic oligonucleotide; CTA chr11 5220925 5220946 5220930 5220925 -
ctccaagctaaaggaggaagtt

SEQ ID NO: 145036 - DNA, 22 bp, Artificial Sequence
  Synthetic oligonucleotide; CTC chr11 5220922 5220943 5220927 5220922 -
caagctaaaggaggaagttcga

SEQ ID NO: 145037 - DNA, 22 bp, Artificial Sequence
  Synthetic oligonucleotide; CTA chr11 5220915 5220936 5220920 5220915 -
aaggaggaagttcgaacaaacg

SEQ ID NO: 145038 - DNA, 22 bp, Artificial Sequence
  Synthetic oligonucleotide; TTC chr11 5220902 5220923 5220907 5220902 -
gaacaaacggcaaagaagtaaa

SEQ ID NO: 145039 - DNA, 22 bp, Artificial Sequence
  Synthetic oligonucleotide; CTT chr11 5220874 5220895 5220879 5220874 -
tgaaaaaaaattagatgaatgg

SEQ ID NO: 145040 - DNA, 22 bp, Artificial Sequence
  Synthetic oligonucleotide; TTT chr11 5220873 5220894 5220878 5220873 -
gaaaaaaaattagatgaatgga

SEQ ID NO: 145041 - DNA, 22 bp, Artificial Sequence
  Synthetic oligonucleotide; TTG chr11 5220872 5220893 5220877 5220872 -
aaaaaaaattagatgaatggat

SEQ ID NO: 145042 - DNA, 22 bp, Artificial Sequence
  Synthetic oligonucleotide; TTA chr11 5220861 5220882 5220866 5220861 -
gatgaatggataactagaataa

SEQ ID NO: 145043 - DNA, 22 bp, Artificial Sequence
  Synthetic oligonucleotide; CTA chr11 5220845 5220866 5220850 5220845 -
gaataaccaatgcacagaagtc

SEQ ID NO: 145044 - DNA, 22 bp, Artificial Sequence
  Synthetic oligonucleotide; CTT chr11 5220820 5220841 5220825 5220820 -
aaaggacctgatggagctgaaa

SEQ ID NO: 145045 - DNA, 22 bp, Artificial Sequence
  Synthetic oligonucleotide; TTA chr11 5220819 5220840 5220824 5220819 -
aaggacctgatggagctgaaaa

SEQ ID NO: 145046 - DNA, 22 bp, Artificial Sequence
  Synthetic oligonucleotide; CTG chr11 5220810 5220831 5220815 5220810 -
atggagctgaaaaccaaggcag

SEQ ID NO: 145047 - DNA, 22 bp, Artificial Sequence
  Synthetic oligonucleotide; CTG chr11 5220801 5220822 5220806 5220801 -
aaaaccaaggcaggagaactac

SEQ ID NO: 145048 - DNA, 22 bp, Artificial Sequence
  Synthetic oligonucleotide; CTA chr11 5220780 5220801 5220785 5220780 -
cgtgacaaatacacaagcctca

SEQ ID NO: 145049 - DNA, 22 bp, Artificial Sequence
  Synthetic oligonucleotide; CTC chr11 5220759 5220780 5220764 5220759 -
agtaaccgatgagatcaactgg

SEQ ID NO: 145050 - DNA, 22 bp, Artificial Sequence
  Synthetic oligonucleotide; CTG chr11 5220738 5220759 5220743 5220738 -
gaagaaagggtatcaatgacga

SEQ ID NO: 145051 - DNA, 22 bp, Artificial Sequence
  Synthetic oligonucleotide; TTT chr11 5220678 5220699 5220683 5220678 -
agagaaaaaagaataaaaagaa

SEQ ID NO: 145052 - DNA, 22 bp, Artificial Sequence
  Synthetic oligonucleotide; TTA chr11 5220677 5220698 5220682 5220677 -
gagaaaaaagaataaaaagaaa

SEQ ID NO: 145053 - DNA, 22 bp, Artificial Sequence
  Synthetic oligonucleotide; CTC chr11 5220642 5220663 5220647 5220642 -
caagaaatatgggactatgtga

SEQ ID NO: 145054 - DNA, 22 bp, Artificial Sequence
  Synthetic oligonucleotide; CTA chr11 5220625 5220646 5220630 5220625 -
tgtgaaaagaccaaatctacat

SEQ ID NO: 145055 - DNA, 22 bp, Artificial Sequence
  Synthetic oligonucleotide; CTA chr11 5220606 5220627 5220611 5220606 -
catctaattggtgtagctgaaa

SEQ ID NO: 145056 - DNA, 22 bp, Artificial Sequence
  Synthetic oligonucleotide; CTA chr11 5220600 5220621 5220605 5220600 -
attggtgtagctgaaagtgatg

SEQ ID NO: 145057 - DNA, 22 bp, Artificial Sequence
  Synthetic oligonucleotide; TTG chr11 5220596 5220617 5220601 5220596 -
gtgtagctgaaagtgatgggga

SEQ ID NO: 145058 - DNA, 22 bp, Artificial Sequence
  Synthetic oligonucleotide; CTG chr11 5220587 5220608 5220592 5220587 -
aaagtgatggggagaatggaac

SEQ ID NO: 145059 - DNA, 22 bp, Artificial Sequence
  Synthetic oligonucleotide; TTG chr11 5220558 5220579 5220563 5220558 -
gaaaacactctgcaggatatta

SEQ ID NO: 145060 - DNA, 22 bp, Artificial Sequence
  Synthetic oligonucleotide; CTC chr11 5220548 5220569 5220553 5220548 -
tgcaggatattatccaggagaa

SEQ ID NO: 145061 - DNA, 22 bp, Artificial Sequence
  Synthetic oligonucleotide; CTG chr11 5220546 5220567 5220551 5220546 -
caggatattatccaggagaact

SEQ ID NO: 145062 - DNA, 22 bp, Artificial Sequence
  Synthetic oligonucleotide; TTA chr11 5220536 5220557 5220541 5220536 -
tccaggagaacttccccaatct

SEQ ID NO: 145063 - DNA, 22 bp, Artificial Sequence
  Synthetic oligonucleotide; CTT chr11 5220523 5220544 5220528 5220523 -
ccccaatctagcaaggcaagcc

SEQ ID NO: 145064 - DNA, 22 bp, Artificial Sequence
  Synthetic oligonucleotide; TTC chr11 5220522 5220543 5220527 5220522 -
cccaatctagcaaggcaagccc

SEQ ID NO: 145065 - DNA, 22 bp, Artificial Sequence
  Synthetic oligonucleotide; CTA chr11 5220513 5220534 5220518 5220513 -
gcaaggcaagcccaaattcaca

SEQ ID NO: 145066 - DNA, 22 bp, Artificial Sequence
  Synthetic oligonucleotide; TTC chr11 5220494 5220515 5220499 5220494 -
acattcaggaaatacagagaac

SEQ ID NO: 145067 - DNA, 22 bp, Artificial Sequence
  Synthetic oligonucleotide; TTC chr11 5220488 5220509 5220493 5220488 -
aggaaatacagagaacgccaca

SEQ ID NO: 145068 - DNA, 22 bp, Artificial Sequence
  Synthetic oligonucleotide; CTC chr11 5220457 5220478 5220462 5220457 -
ctagagaaaagcaactccaaga

SEQ ID NO: 145069 - DNA, 22 bp, Artificial Sequence
  Synthetic oligonucleotide; CTA chr11 5220454 5220475 5220459 5220454 -
gagaaaagcaactccaagacac

SEQ ID NO: 145070 - DNA, 22 bp, Artificial Sequence
  Synthetic oligonucleotide; CTC chr11 5220440 5220461 5220445 5220440 -
caagacacataactgtcagatt

SEQ ID NO: 145071 - DNA, 22 bp, Artificial Sequence
  Synthetic oligonucleotide; CTG chr11 5220425 5220446 5220430 5220425 -
tcagattcaccaaagttgaaat

SEQ ID NO: 145072 - DNA, 22 bp, Artificial Sequence
  Synthetic oligonucleotide; TTC chr11 5220417 5220438 5220422 5220417 -
accaaagttgaaatgaaggaaa

SEQ ID NO: 145073 - DNA, 22 bp, Artificial Sequence
  Synthetic oligonucleotide; TTG chr11 5220407 5220428 5220412 5220407 -
aaatgaaggaaaaaatgttaag

SEQ ID NO: 145074 - DNA, 22 bp, Artificial Sequence
  Synthetic oligonucleotide; TTA chr11 5220387 5220408 5220392 5220387 -
agggcagccagagagaaaggtc

SEQ ID NO: 145075 - DNA, 22 bp, Artificial Sequence
  Synthetic oligonucleotide; TTA chr11 5220359 5220380 5220364 5220359 -
cccacaaagggaagcccatcag

SEQ ID NO: 145076 - DNA, 22 bp, Artificial Sequence
  Synthetic oligonucleotide; CTA chr11 5220333 5220354 5220338 5220333 -
acagctgatctatcggcagaaa

SEQ ID NO: 145077 - DNA, 22 bp, Artificial Sequence
  Synthetic oligonucleotide; CTG chr11 5220326 5220347 5220331 5220326 -
atctatcggcagaaactctaca

SEQ ID NO: 145078 - DNA, 22 bp, Artificial Sequence
  Synthetic oligonucleotide; CTA chr11 5220321 5220342 5220326 5220321 -
tcggcagaaactctacaagcca

SEQ ID NO: 145079 - DNA, 22 bp, Artificial Sequence
  Synthetic oligonucleotide; CTC chr11 5220308 5220329 5220313 5220308 -
tacaagccagaagaaagtgggg

SEQ ID NO: 145080 - DNA, 22 bp, Artificial Sequence
  Synthetic oligonucleotide; CTA chr11 5220306 5220327 5220311 5220306 -
caagccagaagaaagtgggggc

SEQ ID NO: 145081 - DNA, 22 bp, Artificial Sequence
  Synthetic oligonucleotide; TTC chr11 5220276 5220297 5220281 5220276 -
aacattgttaaagaaaagaatt

SEQ ID NO: 145082 - DNA, 22 bp, Artificial Sequence
  Synthetic oligonucleotide; TTG chr11 5220269 5220290 5220274 5220269 -
ttaaagaaaagaattttcaacc

SEQ ID NO: 145083 - DNA, 22 bp, Artificial Sequence
  Synthetic oligonucleotide; TTA chr11 5220266 5220287 5220271 5220266 -
aagaaaagaattttcaacccag

SEQ ID NO: 145084 - DNA, 22 bp, Artificial Sequence
  Synthetic oligonucleotide; TTT chr11 5220253 5220274 5220258 5220253 -
tcaacccagaatttcatatcca

SEQ ID NO: 145085 - DNA, 22 bp, Artificial Sequence
  Synthetic oligonucleotide; TTT chr11 5220252 5220273 5220257 5220252 -
caacccagaatttcatatccag

SEQ ID NO: 145086 - DNA, 22 bp, Artificial Sequence
  Synthetic oligonucleotide; TTC chr11 5220251 5220272 5220256 5220251 -
aacccagaatttcatatccagc

SEQ ID NO: 145087 - DNA, 22 bp, Artificial Sequence
  Synthetic oligonucleotide; TTT chr11 5220239 5220260 5220244 5220239 -
catatccagccaaactaagctt

SEQ ID NO: 145088 - DNA, 22 bp, Artificial Sequence
  Synthetic oligonucleotide; TTC chr11 5220238 5220259 5220243 5220238 -
atatccagccaaactaagcttc

SEQ ID NO: 145089 - DNA, 22 bp, Artificial Sequence
  Synthetic oligonucleotide; CTA chr11 5220222 5220243 5220227 5220222 -
agcttcataagtgaaggagaaa

SEQ ID NO: 145090 - DNA, 22 bp, Artificial Sequence
  Synthetic oligonucleotide; CTT chr11 5220217 5220238 5220222 5220217 -
cataagtgaaggagaaataaaa

SEQ ID NO: 145091 - DNA, 22 bp, Artificial Sequence
  Synthetic oligonucleotide; TTC chr11 5220216 5220237 5220221 5220216 -
ataagtgaaggagaaataaaat

SEQ ID NO: 145092 - DNA, 22 bp, Artificial Sequence
  Synthetic oligonucleotide; CTT chr11 5220190 5220211 5220195 5220190 -
tacagacaagcaaatgctgaga

SEQ ID NO: 145093 - DNA, 22 bp, Artificial Sequence
  Synthetic oligonucleotide; TTT chr11 5220189 5220210 5220194 5220189 -
acagacaagcaaatgctgagag

SEQ ID NO: 145094 - DNA, 22 bp, Artificial Sequence
  Synthetic oligonucleotide; TTA chr11 5220188 5220209 5220193 5220188 -
cagacaagcaaatgctgagaga

SEQ ID NO: 145095 - DNA, 22 bp, Artificial Sequence
  Synthetic oligonucleotide; CTG chr11 5220171 5220192 5220176 5220171 -
agagattttgtcaccaccaggc

SEQ ID NO: 145096 - DNA, 22 bp, Artificial Sequence
  Synthetic oligonucleotide; TTT chr11 5220163 5220184 5220168 5220163 -
tgtcaccaccaggcctgcccta

SEQ ID NO: 145097 - DNA, 22 bp, Artificial Sequence
  Synthetic oligonucleotide; TTT chr11 5220162 5220183 5220167 5220162 -
gtcaccaccaggcctgccctac

SEQ ID NO: 145098 - DNA, 22 bp, Artificial Sequence
  Synthetic oligonucleotide; TTG chr11 5220161 5220182 5220166 5220161 -
tcaccaccaggcctgccctaca

SEQ ID NO: 145099 - DNA, 22 bp, Artificial Sequence
  Synthetic oligonucleotide; CTG chr11 5220146 5220167 5220151 5220146 -
ccctacaagagctcctgaagga

SEQ ID NO: 145100 - DNA, 22 bp, Artificial Sequence
  Synthetic oligonucleotide; CTA chr11 5220141 5220162 5220146 5220141 -
caagagctcctgaaggaagcac

SEQ ID NO: 145101 - DNA, 22 bp, Artificial Sequence
  Synthetic oligonucleotide; CTC chr11 5220132 5220153 5220137 5220132 -
ctgaaggaagcactaaacatgg

SEQ ID NO: 145102 - DNA, 22 bp, Artificial Sequence
  Synthetic oligonucleotide; CTG chr11 5220129 5220150 5220134 5220129 -
aaggaagcactaaacatggaaa

SEQ ID NO: 145103 - DNA, 22 bp, Artificial Sequence
  Synthetic oligonucleotide; CTA chr11 5220117 5220138 5220122 5220117 -
aacatggaaaggaacaactagt

SEQ ID NO: 145104 - DNA, 22 bp, Artificial Sequence
  Synthetic oligonucleotide; CTA chr11 5220097 5220118 5220102 5220097 -
gtatcagccactgcaaaaacat

SEQ ID NO: 145105 - DNA, 22 bp, Artificial Sequence
  Synthetic oligonucleotide; CTG chr11 5220084 5220105 5220089 5220084 -
caaaaacatgccaaattgtaaa

SEQ ID NO: 145106 - DNA, 22 bp, Artificial Sequence
  Synthetic oligonucleotide; TTG chr11 5220066 5220087 5220071 5220066 -
taaagaccatcaaggctaggaa

SEQ ID NO: 145107 - DNA, 22 bp, Artificial Sequence
  Synthetic oligonucleotide; CTA chr11 5220048 5220069 5220053 5220048 -
ggaagaaactgcatcaacgagc

SEQ ID NO: 145108 - DNA, 22 bp, Artificial Sequence
  Synthetic oligonucleotide; CTG chr11 5220037 5220058 5220042 5220037 -
catcaacgagcaaaataaccag

SEQ ID NO: 145109 - DNA, 22 bp, Artificial Sequence
  Synthetic oligonucleotide; CTA chr11 5220012 5220033 5220017 5220012 -
acatcataatgacaggatcaaa

SEQ ID NO: 145110 - DNA, 22 bp, Artificial Sequence
  Synthetic oligonucleotide; TTC chr11 5219987 5220008 5219992 5219987 -
atacataacaatactcacctta

SEQ ID NO: 145111 - DNA, 22 bp, Artificial Sequence
  Synthetic oligonucleotide; CTC chr11 5219971 5219992 5219976 5219971 -
accttaaatgtaaataggctaa

SEQ ID NO: 145112 - DNA, 22 bp, Artificial Sequence
  Synthetic oligonucleotide; CTT chr11 5219966 5219987 5219971 5219966 -
aaatgtaaataggctaaatgct

SEQ ID NO: 145113 - DNA, 22 bp, Artificial Sequence
  Synthetic oligonucleotide; TTA chr11 5219965 5219986 5219970 5219965 -
aatgtaaataggctaaatgctc

SEQ ID NO: 145114 - DNA, 22 bp, Artificial Sequence
  Synthetic oligonucleotide; CTA chr11 5219950 5219971 5219955 5219950 -
aatgctccaattaaaagacaca

SEQ ID NO: 145115 - DNA, 22 bp, Artificial Sequence
  Synthetic oligonucleotide; CTC chr11 5219943 5219964 5219948 5219943 -
caattaaaagacacagactggc

SEQ ID NO: 145116 - DNA, 22 bp, Artificial Sequence
  Synthetic oligonucleotide; TTA chr11 5219937 5219958 5219942 5219937 -
aaagacacagactggcaaattg

SEQ ID NO: 145117 - DNA, 22 bp, Artificial Sequence
  Synthetic oligonucleotide; CTG chr11 5219923 5219944 5219928 5219923 -
gcaaattggataaggagtcaag

SEQ ID NO: 145118 - DNA, 22 bp, Artificial Sequence
  Synthetic oligonucleotide; TTG chr11 5219915 5219936 5219920 5219915 -
gataaggagtcaagacccatct

SEQ ID NO: 145119 - DNA, 22 bp, Artificial Sequence
  Synthetic oligonucleotide; CTG chr11 5219892 5219913 5219897 5219892 -
tgttctgtattcaggaaaccca

SEQ ID NO: 145120 - DNA, 22 bp, Artificial Sequence
  Synthetic oligonucleotide; TTC chr11 5219887 5219908 5219892 5219887 -
tgtattcaggaaacccatctca

SEQ ID NO: 145121 - DNA, 22 bp, Artificial Sequence
  Synthetic oligonucleotide; CTG chr11 5219885 5219906 5219890 5219885 -
tattcaggaaacccatctcacg

SEQ ID NO: 145122 - DNA, 22 bp, Artificial Sequence
  Synthetic oligonucleotide; TTC chr11 5219880 5219901 5219885 5219880 -
aggaaacccatctcacgtgcag

SEQ ID NO: 145123 - DNA, 22 bp, Artificial Sequence
  Synthetic oligonucleotide; CTC chr11 5219866 5219887 5219871 5219866 -
acgtgcagagacacacataggc

SEQ ID NO: 145124 - DNA, 22 bp, Artificial Sequence
  Synthetic oligonucleotide; CTC chr11 5219842 5219863 5219847 5219842 -
gaaataaaaggatggaggaata

SEQ ID NO: 145125 - DNA, 22 bp, Artificial Sequence
  Synthetic oligonucleotide; CTA chr11 5219816 5219837 5219821 5219816 -
ccaagcaaatggaaaacaaaaa

SEQ ID NO: 145126 - DNA, 22 bp, Artificial Sequence
  Synthetic oligonucleotide; TTG chr11 5219781 5219802 5219786 5219781 -
caatcctagtctctgataaaac

SEQ ID NO: 145127 - DNA, 22 bp, Artificial Sequence
  Synthetic oligonucleotide; CTA chr11 5219773 5219794 5219778 5219773 -
gtctctgataaaacagatttta

SEQ ID NO: 145128 - DNA, 22 bp, Artificial Sequence
  Synthetic oligonucleotide; CTC chr11 5219768 5219789 5219773 5219768 -
tgataaaacagattttaaacca

SEQ ID NO: 145129 - DNA, 22 bp, Artificial Sequence
  Synthetic oligonucleotide; CTG chr11 5219766 5219787 5219771 5219766 -
ataaaacagattttaaaccaac

SEQ ID NO: 145130 - DNA, 22 bp, Artificial Sequence
  Synthetic oligonucleotide; TTT chr11 5219753 5219774 5219758 5219753 -
taaaccaacaaagatcaaaaga

SEQ ID NO: 145131 - DNA, 22 bp, Artificial Sequence
  Synthetic oligonucleotide; TTT chr11 5219752 5219773 5219757 5219752 -
aaaccaacaaagatcaaaagag

SEQ ID NO: 145132 - DNA, 22 bp, Artificial Sequence
  Synthetic oligonucleotide; TTA chr11 5219751 5219772 5219756 5219751 -
aaccaacaaagatcaaaagaga

SEQ ID NO: 145133 - DNA, 22 bp, Artificial Sequence
  Synthetic oligonucleotide; TTA chr11 5219714 5219735 5219719 5219714 -
cataatggcaaagggatctatt

SEQ ID NO: 145134 - DNA, 22 bp, Artificial Sequence
  Synthetic oligonucleotide; CTA chr11 5219694 5219715 5219699 5219694 -
ttcaagaagaagaactaactat

SEQ ID NO: 145135 - DNA, 22 bp, Artificial Sequence
  Synthetic oligonucleotide; TTC chr11 5219691 5219712 5219696 5219691 -
aagaagaagaactaactatact

SEQ ID NO: 145136 - DNA, 22 bp, Artificial Sequence
  Synthetic oligonucleotide; CTA chr11 5219677 5219698 5219682 5219677 -
actatactaaatatatatgcac

SEQ ID NO: 145137 - DNA, 22 bp, Artificial Sequence
  Synthetic oligonucleotide; CTA chr11 5219673 5219694 5219678 5219673 -
tactaaatatatatgcacccaa

SEQ ID NO: 145138 - DNA, 22 bp, Artificial Sequence
  Synthetic oligonucleotide; CTA chr11 5219668 5219689 5219673 5219668 -
aatatatatgcacccaatacag

SEQ ID NO: 145139 - DNA, 22 bp, Artificial Sequence
  Synthetic oligonucleotide; TTC chr11 5219632 5219653 5219637 5219632 -
ataaaacaagtcctgagtgacc

SEQ ID NO: 145140 - DNA, 22 bp, Artificial Sequence
  Synthetic oligonucleotide; CTG chr11 5219617 5219638 5219622 5219617 -
agtgacctacaaagagacttag

SEQ ID NO: 145141 - DNA, 22 bp, Artificial Sequence
  Synthetic oligonucleotide; CTA chr11 5219608 5219629 5219613 5219608 -
caaagagacttagatgcccaca

SEQ ID NO: 145142 - DNA, 22 bp, Artificial Sequence
  Synthetic oligonucleotide; CTT chr11 5219597 5219618 5219602 5219597 -
agatgcccacacaataataatg

SEQ ID NO: 145143 - DNA, 22 bp, Artificial Sequence
  Synthetic oligonucleotide; TTA chr11 5219596 5219617 5219601 5219596 -
gatgcccacacaataataatgg

SEQ ID NO: 145144 - DNA, 22 bp, Artificial Sequence
  Synthetic oligonucleotide; CTT chr11 5219567 5219588 5219572 5219567 -
taacaccccactgtcaacatta

SEQ ID NO: 145145 - DNA, 22 bp, Artificial Sequence
  Synthetic oligonucleotide; TTT chr11 5219566 5219587 5219571 5219566 -
aacaccccactgtcaacattag

SEQ ID NO: 145146 - DNA, 22 bp, Artificial Sequence
  Synthetic oligonucleotide; TTA chr11 5219565 5219586 5219570 5219565 -
acaccccactgtcaacattaga

SEQ ID NO: 145147 - DNA, 22 bp, Artificial Sequence
  Synthetic oligonucleotide; CTG chr11 5219554 5219575 5219559 5219554 -
tcaacattagacagatcaacga

SEQ ID NO: 145148 - DNA, 22 bp, Artificial Sequence
  Synthetic oligonucleotide; TTA chr11 5219545 5219566 5219550 5219545 -
gacagatcaacgagacagaaag

SEQ ID NO: 145149 - DNA, 22 bp, Artificial Sequence
  Synthetic oligonucleotide; TTA chr11 5219520 5219541 5219525 5219520 -
acaaggatatccaggaattgga

SEQ ID NO: 145150 - DNA, 22 bp, Artificial Sequence
  Synthetic oligonucleotide; TTG chr11 5219500 5219521 5219505 5219500 -
gactcagctctgcaccaagcag

SEQ ID NO: 145151 - DNA, 22 bp, Artificial Sequence
  Synthetic oligonucleotide; CTC chr11 5219495 5219516 5219500 5219495 -
agctctgcaccaagcagaccta

SEQ ID NO: 145152 - DNA, 22 bp, Artificial Sequence
  Synthetic oligonucleotide; CTC chr11 5219490 5219511 5219495 5219490 -
tgcaccaagcagacctaataga

SEQ ID NO: 145153 - DNA, 22 bp, Artificial Sequence
  Synthetic oligonucleotide; CTG chr11 5219488 5219509 5219493 5219488 -
caccaagcagacctaatagaca

SEQ ID NO: 145154 - DNA, 22 bp, Artificial Sequence
  Synthetic oligonucleotide; CTA chr11 5219473 5219494 5219478 5219473 -
atagacatctacagaactctcc

SEQ ID NO: 145155 - DNA, 22 bp, Artificial Sequence
  Synthetic oligonucleotide; CTA chr11 5219462 5219483 5219467 5219462 -
cagaactctccaccccaaatca

SEQ ID NO: 145156 - DNA, 22 bp, Artificial Sequence
  Synthetic oligonucleotide; CTC chr11 5219454 5219475 5219459 5219454 -
tccaccccaaatcaacagaata

SEQ ID NO: 145157 - DNA, 22 bp, Artificial Sequence
  Synthetic oligonucleotide; CTC chr11 5219452 5219473 5219457 5219452 -
caccccaaatcaacagaatata

SEQ ID NO: 145158 - DNA, 22 bp, Artificial Sequence
  Synthetic oligonucleotide; TTC chr11 5219425 5219446 5219430 5219425 -
ttttcagcaccacaccacacct

SEQ ID NO: 145159 - DNA, 22 bp, Artificial Sequence
  Synthetic oligonucleotide; CTT chr11 5219423 5219444 5219428 5219423 -
ttcagcaccacaccacacctat

SEQ ID NO: 145160 - DNA, 22 bp, Artificial Sequence
  Synthetic oligonucleotide; TTT chr11 5219422 5219443 5219427 5219422 -
tcagcaccacaccacacctatt

SEQ ID NO: 145161 - DNA, 22 bp, Artificial Sequence
  Synthetic oligonucleotide; TTT chr11 5219421 5219442 5219426 5219421 -
cagcaccacaccacacctattc

SEQ ID NO: 145162 - DNA, 22 bp, Artificial Sequence
  Synthetic oligonucleotide; TTC chr11 5219420 5219441 5219425 5219420 -
agcaccacaccacacctattcc

SEQ ID NO: 145163 - DNA, 22 bp, Artificial Sequence
  Synthetic oligonucleotide; CTA chr11 5219402 5219423 5219407 5219402 -
ttccaaaactgaccacatagtt

SEQ ID NO: 145164 - DNA, 22 bp, Artificial Sequence
  Synthetic oligonucleotide; TTC chr11 5219399 5219420 5219404 5219399 -
caaaactgaccacatagttgga

SEQ ID NO: 145165 - DNA, 22 bp, Artificial Sequence
  Synthetic oligonucleotide; CTG chr11 5219391 5219412 5219396 5219391 -
accacatagttggaagtaaagc

SEQ ID NO: 145166 - DNA, 22 bp, Artificial Sequence
  Synthetic oligonucleotide; TTG chr11 5219379 5219400 5219384 5219379 -
gaagtaaagctctcctcagcaa

SEQ ID NO: 145167 - DNA, 22 bp, Artificial Sequence
  Synthetic oligonucleotide; CTC chr11 5219367 5219388 5219372 5219367 -
tcctcagcaaatgtaaaagaac

SEQ ID NO: 145168 - DNA, 22 bp, Artificial Sequence
  Synthetic oligonucleotide; CTC chr11 5219365 5219386 5219370 5219365 -
ctcagcaaatgtaaaagaacag

SEQ ID NO: 145169 - DNA, 22 bp, Artificial Sequence
  Synthetic oligonucleotide; CTC chr11 5219362 5219383 5219367 5219362 -
agcaaatgtaaaagaacagaaa

SEQ ID NO: 145170 - DNA, 22 bp, Artificial Sequence
  Synthetic oligonucleotide; CTA chr11 5219337 5219358 5219342 5219337 -
taacaaactgtctctcagacca

SEQ ID NO: 145171 - DNA, 22 bp, Artificial Sequence
  Synthetic oligonucleotide; CTG chr11 5219327 5219348 5219332 5219327 -
tctctcagaccacagtgcaatc

SEQ ID NO: 145172 - DNA, 22 bp, Artificial Sequence
  Synthetic oligonucleotide; CTC chr11 5219323 5219344 5219328 5219323 -
tcagaccacagtgcaatcaaac

SEQ ID NO: 145173 - DNA, 22 bp, Artificial Sequence
  Synthetic oligonucleotide; CTC chr11 5219321 5219342 5219326 5219321 -
agaccacagtgcaatcaaacta

SEQ ID NO: 145174 - DNA, 22 bp, Artificial Sequence
  Synthetic oligonucleotide; CTA chr11 5219299 5219320 5219304 5219299 -
gaactcaggattaagaaactca

SEQ ID NO: 145175 - DNA, 22 bp, Artificial Sequence
  Synthetic oligonucleotide; CTC chr11 5219293 5219314 5219298 5219293 -
aggattaagaaactcactcaaa

SEQ ID NO: 145176 - DNA, 22 bp, Artificial Sequence
  Synthetic oligonucleotide; TTA chr11 5219286 5219307 5219291 5219286 -
agaaactcactcaaaaccactc

SEQ ID NO: 145177 - DNA, 22 bp, Artificial Sequence
  Synthetic oligonucleotide; CTC chr11 5219278 5219299 5219283 5219278 -
actcaaaaccactcagctacat

SEQ ID NO: 145178 - DNA, 22 bp, Artificial Sequence
  Synthetic oligonucleotide; CTC chr11 5219274 5219295 5219279 5219274 -
aaaaccactcagctacatggaa

SEQ ID NO: 145179 - DNA, 22 bp, Artificial Sequence
  Synthetic oligonucleotide; CTC chr11 5219264 5219285 5219269 5219264 -
agctacatggaaactgaacagc

SEQ ID NO: 145180 - DNA, 22 bp, Artificial Sequence
  Synthetic oligonucleotide; CTA chr11 5219259 5219280 5219264 5219259 -
catggaaactgaacagcctgct

SEQ ID NO: 145181 - DNA, 22 bp, Artificial Sequence
  Synthetic oligonucleotide; CTG chr11 5219248 5219269 5219253 5219248 -
aacagcctgctcctgaatgact

SEQ ID NO: 145182 - DNA, 22 bp, Artificial Sequence
  Synthetic oligonucleotide; CTG chr11 5219239 5219260 5219244 5219239 -
ctcctgaatgactactgggtac

SEQ ID NO: 145183 - DNA, 22 bp, Artificial Sequence
  Synthetic oligonucleotide; CTC chr11 5219236 5219257 5219241 5219236 -
ctgaatgactactgggtacata

SEQ ID NO: 145184 - DNA, 22 bp, Artificial Sequence
  Synthetic oligonucleotide; CTG chr11 5219233 5219254 5219238 5219233 -
aatgactactgggtacataaca

SEQ ID NO: 145185 - DNA, 22 bp, Artificial Sequence
  Synthetic oligonucleotide; CTA chr11 5219225 5219246 5219230 5219225 -
ctgggtacataacaaaatgaag

SEQ ID NO: 145186 - DNA, 22 bp, Artificial Sequence
  Synthetic oligonucleotide; CTG chr11 5219222 5219243 5219227 5219222 -
ggtacataacaaaatgaaggca

SEQ ID NO: 145187 - DNA, 22 bp, Artificial Sequence
  Synthetic oligonucleotide; TTC chr11 5219185 5219206 5219190 5219185 -
tttgaaaccaacgagaacaaag

SEQ ID NO: 145188 - DNA, 22 bp, Artificial Sequence
  Synthetic oligonucleotide; CTT chr11 5219183 5219204 5219188 5219183 -
tgaaaccaacgagaacaaagac

SEQ ID NO: 145189 - DNA, 22 bp, Artificial Sequence
  Synthetic oligonucleotide; TTT chr11 5219182 5219203 5219187 5219182 -
gaaaccaacgagaacaaagaca

SEQ ID NO: 145190 - DNA, 22 bp, Artificial Sequence
  Synthetic oligonucleotide; TTG chr11 5219181 5219202 5219186 5219181 -
aaaccaacgagaacaaagacac

SEQ ID NO: 145191 - DNA, 22 bp, Artificial Sequence
  Synthetic oligonucleotide; CTC chr11 5219143 5219164 5219148 5219143 -
tgagacacattcaaagcagtgt

SEQ ID NO: 145192 - DNA, 22 bp, Artificial Sequence
  Synthetic oligonucleotide; CTG chr11 5219141 5219162 5219146 5219141 -
agacacattcaaagcagtgtgt

SEQ ID NO: 145193 - DNA, 22 bp, Artificial Sequence
  Synthetic oligonucleotide; TTC chr11 5219131 5219152 5219136 5219131 -
aaagcagtgtgtagagggaaat

SEQ ID NO: 145194 - DNA, 22 bp, Artificial Sequence
  Synthetic oligonucleotide; TTT chr11 5219107 5219128 5219112 5219107 -
atagcactaaatgcccacaagg

SEQ ID NO: 145195 - DNA, 22 bp, Artificial Sequence
  Synthetic oligonucleotide; TTA chr11 5219106 5219127 5219111 5219106 -
tagcactaaatgcccacaaggg

SEQ ID NO: 145196 - DNA, 22 bp, Artificial Sequence
  Synthetic oligonucleotide; CTA chr11 5219098 5219119 5219103 5219098 -
aatgcccacaagggaaagcagg

SEQ ID NO: 145197 - DNA, 22 bp, Artificial Sequence
  Synthetic oligonucleotide; CTA chr11 5219067 5219088 5219072 5219067 -
aaattgacaccctaacatcaca

SEQ ID NO: 145198 - DNA, 22 bp, Artificial Sequence
  Synthetic oligonucleotide; TTG chr11 5219061 5219082 5219066 5219061 -
acaccctaacatcacaattaaa

SEQ ID NO: 145199 - DNA, 22 bp, Artificial Sequence
  Synthetic oligonucleotide; CTA chr11 5219053 5219074 5219058 5219053 -
acatcacaattaaaaaactaga

SEQ ID NO: 145200 - DNA, 22 bp, Artificial Sequence
  Synthetic oligonucleotide; TTA chr11 5219041 5219062 5219046 5219041 -
aaaaactagagaagcaggagca

SEQ ID NO: 145201 - DNA, 22 bp, Artificial Sequence
  Synthetic oligonucleotide; CTA chr11 5219033 5219054 5219038 5219033 -
gagaagcaggagcaaacacatt

SEQ ID NO: 145202 - DNA, 22 bp, Artificial Sequence
  Synthetic oligonucleotide; TTC chr11 5219010 5219031 5219015 5219010 -
aaaagctaacagaagacaagaa

SEQ ID NO: 145203 - DNA, 22 bp, Artificial Sequence
  Synthetic oligonucleotide; CTA chr11 5219002 5219023 5219007 5219002 -
acagaagacaagaaataactaa

SEQ ID NO: 145204 - DNA, 22 bp, Artificial Sequence
  Synthetic oligonucleotide; CTA chr11 5218981 5219002 5218986 5218981 -
agatcagagcagaagtgaagga

SEQ ID NO: 145205 - DNA, 22 bp, Artificial Sequence
  Synthetic oligonucleotide; CTT chr11 5218936 5218957 5218941 5218936 -
caaaaaaatcaatgaatccaga

SEQ ID NO: 145206 - DNA, 22 bp, Artificial Sequence
  Synthetic oligonucleotide; TTC chr11 5218935 5218956 5218940 5218935 -
aaaaaaatcaatgaatccagaa

SEQ ID NO: 145207 - DNA, 22 bp, Artificial Sequence
  Synthetic oligonucleotide; CTG chr11 5218909 5218930 5218914 5218909 -
tttttttgaaaagatcaacaaa

SEQ ID NO: 145208 - DNA, 22 bp, Artificial Sequence
  Synthetic oligonucleotide; TTT chr11 5218906 5218927 5218911 5218906 -
ttttgaaaagatcaacaaaatt

SEQ ID NO: 145209 - DNA, 22 bp, Artificial Sequence
  Synthetic oligonucleotide; TTT chr11 5218905 5218926 5218910 5218905 -
tttgaaaagatcaacaaaattg

SEQ ID NO: 145210 - DNA, 22 bp, Artificial Sequence
  Synthetic oligonucleotide; TTT chr11 5218904 5218925 5218909 5218904 -
ttgaaaagatcaacaaaattga

SEQ ID NO: 145211 - DNA, 22 bp, Artificial Sequence
  Synthetic oligonucleotide; TTT chr11 5218903 5218924 5218908 5218903 -
tgaaaagatcaacaaaattgat

SEQ ID NO: 145212 - DNA, 22 bp, Artificial Sequence
  Synthetic oligonucleotide; TTT chr11 5218902 5218923 5218907 5218902 -
gaaaagatcaacaaaattgata

SEQ ID NO: 145213 - DNA, 22 bp, Artificial Sequence
  Synthetic oligonucleotide; TTG chr11 5218901 5218922 5218906 5218901 -
aaaagatcaacaaaattgatag

SEQ ID NO: 145214 - DNA, 22 bp, Artificial Sequence
  Synthetic oligonucleotide; TTG chr11 5218883 5218904 5218888 5218883 -
atagactgctagcaagactaat

SEQ ID NO: 145215 - DNA, 22 bp, Artificial Sequence
  Synthetic oligonucleotide; CTG chr11 5218875 5218896 5218880 5218875 -
ctagcaagactaataaagaaga

SEQ ID NO: 145216 - DNA, 22 bp, Artificial Sequence
  Synthetic oligonucleotide; CTA chr11 5218872 5218893 5218877 5218872 -
gcaagactaataaagaagaaaa

SEQ ID NO: 145217 - DNA, 22 bp, Artificial Sequence
  Synthetic oligonucleotide; CTA chr11 5218863 5218884 5218868 5218863 -
ataaagaagaaaagagagaaga

SEQ ID NO: 145218 - DNA, 22 bp, Artificial Sequence
  Synthetic oligonucleotide; CTG chr11 5218798 5218819 5218803 5218798 -
atcccacagaaatacaaactac

SEQ ID NO: 145219 - DNA, 22 bp, Artificial Sequence
  Synthetic oligonucleotide; CTA chr11 5218777 5218798 5218782 5218777 -
ccgtcagagaatactataaaca

SEQ ID NO: 145220 - DNA, 22 bp, Artificial Sequence
  Synthetic oligonucleotide; CTA chr11 5218761 5218782 5218766 5218761 -
taaacacctctacgcaaataaa

SEQ ID NO: 145221 - DNA, 22 bp, Artificial Sequence
  Synthetic oligonucleotide; CTC chr11 5218751 5218772 5218756 5218751 -
tacgcaaataaactagaaaatc

SEQ ID NO: 145222 - DNA, 22 bp, Artificial Sequence
  Synthetic oligonucleotide; CTA chr11 5218749 5218770 5218754 5218749 -
cgcaaataaactagaaaatcta

SEQ ID NO: 145223 - DNA, 22 bp, Artificial Sequence
  Synthetic oligonucleotide; CTA chr11 5218736 5218757 5218741 5218736 -
gaaaatctagaagaaatggata

SEQ ID NO: 145224 - DNA, 22 bp, Artificial Sequence
  Synthetic oligonucleotide; CTA chr11 5218727 5218748 5218732 5218727 -
gaagaaatggataaattcctcg

SEQ ID NO: 145225 - DNA, 22 bp, Artificial Sequence
  Synthetic oligonucleotide; TTC chr11 5218709 5218730 5218714 5218709 -
ctcgacacatacactctgccaa

SEQ ID NO: 145226 - DNA, 22 bp, Artificial Sequence
  Synthetic oligonucleotide; CTC chr11 5218706 5218727 5218711 5218706 -
gacacatacactctgccaagac

SEQ ID NO: 145227 - DNA, 22 bp, Artificial Sequence
  Synthetic oligonucleotide; CTC chr11 5218693 5218714 5218698 5218693 -
tgccaagactaaaccaggaaga

SEQ ID NO: 145228 - DNA, 22 bp, Artificial Sequence
  Synthetic oligonucleotide; CTG chr11 5218691 5218712 5218696 5218691 -
ccaagactaaaccaggaagaag

SEQ ID NO: 145229 - DNA, 22 bp, Artificial Sequence
  Synthetic oligonucleotide; CTA chr11 5218682 5218703 5218687 5218682 -
aaccaggaagaagttgtatctc

SEQ ID NO: 145230 - DNA, 22 bp, Artificial Sequence
  Synthetic oligonucleotide; TTG chr11 5218666 5218687 5218671 5218666 -
tatctctgaatagaccaataac

SEQ ID NO: 145231 - DNA, 22 bp, Artificial Sequence
  Synthetic oligonucleotide; CTC chr11 5218660 5218681 5218665 5218660 -
tgaatagaccaataacaggctc

SEQ ID NO: 145232 - DNA, 22 bp, Artificial Sequence
  Synthetic oligonucleotide; CTG chr11 5218658 5218679 5218663 5218658 -
aatagaccaataacaggctctg

SEQ ID NO: 145233 - DNA, 22 bp, Artificial Sequence
  Synthetic oligonucleotide; CTC chr11 5218638 5218659 5218643 5218638 -
tgaaattgaggcaataattaat

SEQ ID NO: 145234 - DNA, 22 bp, Artificial Sequence
  Synthetic oligonucleotide; CTG chr11 5218636 5218657 5218641 5218636 -
aaattgaggcaataattaatag

SEQ ID NO: 145235 - DNA, 22 bp, Artificial Sequence
  Synthetic oligonucleotide; TTG chr11 5218630 5218651 5218635 5218630 -
aggcaataattaatagcttatc

SEQ ID NO: 145236 - DNA, 22 bp, Artificial Sequence
  Synthetic oligonucleotide; TTA chr11 5218618 5218639 5218623 5218618 -
atagcttatcaaccaaaaaaag

SEQ ID NO: 145237 - DNA, 22 bp, Artificial Sequence
  Synthetic oligonucleotide; CTT chr11 5218611 5218632 5218616 5218611 -
atcaaccaaaaaaagtccggga

SEQ ID NO: 145238 - DNA, 22 bp, Artificial Sequence
  Synthetic oligonucleotide; TTA chr11 5218610 5218631 5218615 5218610 -
tcaaccaaaaaaagtccgggac

SEQ ID NO: 145239 - DNA, 22 bp, Artificial Sequence
  Synthetic oligonucleotide; TTC chr11 5218577 5218598 5218582 5218577 -
atagccgaattctaccagaggt

SEQ ID NO: 145240 - DNA, 22 bp, Artificial Sequence
  Synthetic oligonucleotide; TTC chr11 5218565 5218586 5218570 5218565 -
taccagaggtacaaggaggagc

SEQ ID NO: 145241 - DNA, 22 bp, Artificial Sequence
  Synthetic oligonucleotide; CTA chr11 5218563 5218584 5218568 5218563 -
ccagaggtacaaggaggagctg

SEQ ID NO: 145242 - DNA, 22 bp, Artificial Sequence
  Synthetic oligonucleotide; CTG chr11 5218541 5218562 5218546 5218541 -
gtaccattccttctgaaactat

SEQ ID NO: 145243 - DNA, 22 bp, Artificial Sequence
  Synthetic oligonucleotide; TTC chr11 5218532 5218553 5218537 5218532 -
cttctgaaactattccaatcaa

SEQ ID NO: 145244 - DNA, 22 bp, Artificial Sequence
  Synthetic oligonucleotide; CTT chr11 5218529 5218550 5218534 5218529 -
ctgaaactattccaatcaatag

SEQ ID NO: 145245 - DNA, 22 bp, Artificial Sequence
  Synthetic oligonucleotide; TTC chr11 5218528 5218549 5218533 5218528 -
tgaaactattccaatcaataga

SEQ ID NO: 145246 - DNA, 22 bp, Artificial Sequence
  Synthetic oligonucleotide; CTG chr11 5218526 5218547 5218531 5218526 -
aaactattccaatcaatagaaa

SEQ ID NO: 145247 - DNA, 22 bp, Artificial Sequence
  Synthetic oligonucleotide; CTA chr11 5218520 5218541 5218525 5218520 -
ttccaatcaatagaaaaagagg

SEQ ID NO: 145248 - DNA, 22 bp, Artificial Sequence
  Synthetic oligonucleotide; TTC chr11 5218517 5218538 5218522 5218517 -
caatcaatagaaaaagagggaa

SEQ ID NO: 145249 - DNA, 22 bp, Artificial Sequence
  Synthetic oligonucleotide; CTC chr11 5218490 5218511 5218495 5218490 -
cctaactcattttatgaggcca

SEQ ID NO: 145250 - DNA, 22 bp, Artificial Sequence
  Synthetic oligonucleotide; CTA chr11 5218486 5218507 5218491 5218486 -
actcattttatgaggccagcat

SEQ ID NO: 145251 - DNA, 22 bp, Artificial Sequence
  Synthetic oligonucleotide; CTC chr11 5218482 5218503 5218487 5218482 -
attttatgaggccagcatcatc

SEQ ID NO: 145252 - DNA, 22 bp, Artificial Sequence
  Synthetic oligonucleotide; TTT chr11 5218478 5218499 5218483 5218478 -
tatgaggccagcatcatcctga

SEQ ID NO: 145253 - DNA, 22 bp, Artificial Sequence
  Synthetic oligonucleotide; TTT chr11 5218477 5218498 5218482 5218477 -
atgaggccagcatcatcctgat

SEQ ID NO: 145254 - DNA, 22 bp, Artificial Sequence
  Synthetic oligonucleotide; TTA chr11 5218476 5218497 5218481 5218476 -
tgaggccagcatcatcctgata

SEQ ID NO: 145255 - DNA, 22 bp, Artificial Sequence
  Synthetic oligonucleotide; CTG chr11 5218457 5218478 5218462 5218457 -
ataccaaagcctgacagagaca

SEQ ID NO: 145256 - DNA, 22 bp, Artificial Sequence
  Synthetic oligonucleotide; CTG chr11 5218444 5218465 5218449 5218444 -
acagagacacaacaaaaaaaga

SEQ ID NO: 145257 - DNA, 22 bp, Artificial Sequence
  Synthetic oligonucleotide; TTA chr11 5218414 5218435 5218419 5218414 -
caccaatatccttgatgaacat

SEQ ID NO: 145258 - DNA, 22 bp, Artificial Sequence
  Synthetic oligonucleotide; CTT chr11 5218401 5218422 5218406 5218401 -
gatgaacattgatgcaaaaatc

SEQ ID NO: 145259 - DNA, 22 bp, Artificial Sequence
  Synthetic oligonucleotide; TTG chr11 5218400 5218421 5218405 5218400 -
atgaacattgatgcaaaaatcc

SEQ ID NO: 145260 - DNA, 22 bp, Artificial Sequence
  Synthetic oligonucleotide; TTG chr11 5218390 5218411 5218395 5218390 -
atgcaaaaatcctcaataaaat

SEQ ID NO: 145261 - DNA, 22 bp, Artificial Sequence
  Synthetic oligonucleotide; CTC chr11 5218376 5218397 5218381 5218376 -
aataaaatactggcaaactgat

SEQ ID NO: 145262 - DNA, 22 bp, Artificial Sequence
  Synthetic oligonucleotide; CTG chr11 5218364 5218385 5218369 5218364 -
gcaaactgatccaccatgatca

SEQ ID NO: 145263 - DNA, 22 bp, Artificial Sequence
  Synthetic oligonucleotide; CTG chr11 5218356 5218377 5218361 5218356 -
atccaccatgatcaagtgggct

SEQ ID NO: 145264 - DNA, 22 bp, Artificial Sequence
  Synthetic oligonucleotide; CTT chr11 5218333 5218354 5218338 5218333 -
catccctgccatgcaaggctgg

SEQ ID NO: 145265 - DNA, 22 bp, Artificial Sequence
  Synthetic oligonucleotide; TTC chr11 5218332 5218353 5218337 5218332 -
atccctgccatgcaaggctggt

SEQ ID NO: 145266 - DNA, 22 bp, Artificial Sequence
  Synthetic oligonucleotide; CTG chr11 5218325 5218346 5218330 5218325 -
ccatgcaaggctggttcaacat

SEQ ID NO: 145267 - DNA, 22 bp, Artificial Sequence
  Synthetic oligonucleotide; CTG chr11 5218312 5218333 5218317 5218312 -
gttcaacatacgaaaatcaata

SEQ ID NO: 145268 - DNA, 22 bp, Artificial Sequence
  Synthetic oligonucleotide; TTC chr11 5218308 5218329 5218313 5218308 -
aacatacgaaaatcaataaaca

SEQ ID NO: 145269 - DNA, 22 bp, Artificial Sequence
  Synthetic oligonucleotide; TTA chr11 5218241 5218262 5218246 5218241 -
tctcaatagatgcagaaaaggc

SEQ ID NO: 145270 - DNA, 22 bp, Artificial Sequence
  Synthetic oligonucleotide; CTC chr11 5218237 5218258 5218242 5218237 -
aatagatgcagaaaaggccttt

SEQ ID NO: 145271 - DNA, 22 bp, Artificial Sequence
  Synthetic oligonucleotide; CTT chr11 5218216 5218237 5218221 5218216 -
tgacaaaattcaacaacgcttc

SEQ ID NO: 145272 - DNA, 22 bp, Artificial Sequence
  Synthetic oligonucleotide; TTT chr11 5218215 5218236 5218220 5218215 -
gacaaaattcaacaacgcttca

SEQ ID NO: 145273 - DNA, 22 bp, Artificial Sequence
  Synthetic oligonucleotide; TTG chr11 5218214 5218235 5218219 5218214 -
acaaaattcaacaacgcttcat

SEQ ID NO: 145274 - DNA, 22 bp, Artificial Sequence
  Synthetic oligonucleotide; TTC chr11 5218205 5218226 5218210 5218205 -
aacaacgcttcatgctaaaaac

SEQ ID NO: 145275 - DNA, 22 bp, Artificial Sequence
  Synthetic oligonucleotide; CTT chr11 5218195 5218216 5218200 5218195 -
catgctaaaaactctcaataaa

SEQ ID NO: 145276 - DNA, 22 bp, Artificial Sequence
  Synthetic oligonucleotide; TTC chr11 5218194 5218215 5218199 5218194 -
atgctaaaaactctcaataaat

SEQ ID NO: 145277 - DNA, 22 bp, Artificial Sequence
  Synthetic oligonucleotide; CTA chr11 5218188 5218209 5218193 5218188 -
aaaactctcaataaattaggta

SEQ ID NO: 145278 - DNA, 22 bp, Artificial Sequence
  Synthetic oligonucleotide; CTC chr11 5218181 5218202 5218186 5218181 -
tcaataaattaggtattgatgg

SEQ ID NO: 145279 - DNA, 22 bp, Artificial Sequence
  Synthetic oligonucleotide; CTC chr11 5218179 5218200 5218184 5218179 -
aataaattaggtattgatggga

SEQ ID NO: 145280 - DNA, 22 bp, Artificial Sequence
  Synthetic oligonucleotide; TTA chr11 5218170 5218191 5218175 5218170 -
ggtattgatgggacatatctca

SEQ ID NO: 145281 - DNA, 22 bp, Artificial Sequence
  Synthetic oligonucleotide; TTG chr11 5218163 5218184 5218168 5218163 -
atgggacatatctcaaaataat

SEQ ID NO: 145282 - DNA, 22 bp, Artificial Sequence
  Synthetic oligonucleotide; CTC chr11 5218149 5218170 5218154 5218149 -
aaaataataagagctatctatg

SEQ ID NO: 145283 - DNA, 22 bp, Artificial Sequence
  Synthetic oligonucleotide; CTA chr11 5218133 5218154 5218138 5218133 -
tctatgacaaacccacagccaa

SEQ ID NO: 145284 - DNA, 22 bp, Artificial Sequence
  Synthetic oligonucleotide; CTA chr11 5218129 5218150 5218134 5218129 -
tgacaaacccacagccaatatc

SEQ ID NO: 145285 - DNA, 22 bp, Artificial Sequence
  Synthetic oligonucleotide; CTG chr11 5218101 5218122 5218106 5218101 -
agtggacaaaaactggaagcat

SEQ ID NO: 145286 - DNA, 22 bp, Artificial Sequence
  Synthetic oligonucleotide; CTG chr11 5218086 5218107 5218091 5218086 -
gaagcattccctttgaaaactg

SEQ ID NO: 145287 - DNA, 22 bp, Artificial Sequence
  Synthetic oligonucleotide; TTC chr11 5218077 5218098 5218082 5218077 -
cctttgaaaactggcacaaggc

SEQ ID NO: 145288 - DNA, 22 bp, Artificial Sequence
  Synthetic oligonucleotide; CTT chr11 5218073 5218094 5218078 5218073 -
tgaaaactggcacaaggcaggg

SEQ ID NO: 145289 - DNA, 22 bp, Artificial Sequence
  Synthetic oligonucleotide; TTT chr11 5218072 5218093 5218077 5218072 -
gaaaactggcacaaggcaggga

SEQ ID NO: 145290 - DNA, 22 bp, Artificial Sequence
  Synthetic oligonucleotide; TTG chr11 5218071 5218092 5218076 5218071 -
aaaactggcacaaggcagggat

SEQ ID NO: 145291 - DNA, 22 bp, Artificial Sequence
  Synthetic oligonucleotide; CTG chr11 5218064 5218085 5218069 5218064 -
gcacaaggcagggatgccctct

SEQ ID NO: 145292 - DNA, 22 bp, Artificial Sequence
  Synthetic oligonucleotide; CTC chr11 5218043 5218064 5218048 5218043 -
tctcaccactcctattcaacat

SEQ ID NO: 145293 - DNA, 22 bp, Artificial Sequence
  Synthetic oligonucleotide; CTC chr11 5218041 5218062 5218046 5218041 -
tcaccactcctattcaacatag

SEQ ID NO: 145294 - DNA, 22 bp, Artificial Sequence
  Synthetic oligonucleotide; CTC chr11 5218039 5218060 5218044 5218039 -
accactcctattcaacatagtg

SEQ ID NO: 145295 - DNA, 22 bp, Artificial Sequence
  Synthetic oligonucleotide; CTC chr11 5218032 5218053 5218037 5218032 -
ctattcaacatagtgttgtaag

SEQ ID NO: 145296 - DNA, 22 bp, Artificial Sequence
  Synthetic oligonucleotide; CTA chr11 5218029 5218050 5218034 5218029 -
ttcaacatagtgttgtaagttc

SEQ ID NO: 145297 - DNA, 22 bp, Artificial Sequence
  Synthetic oligonucleotide; TTC chr11 5218026 5218047 5218031 5218026 -
aacatagtgttgtaagttctgg

SEQ ID NO: 145298 - DNA, 22 bp, Artificial Sequence
  Synthetic oligonucleotide; TTG chr11 5218014 5218035 5218019 5218014 -
taagttctggccagggcaatca

SEQ ID NO: 145299 - DNA, 22 bp, Artificial Sequence
  Synthetic oligonucleotide; TTC chr11 5218007 5218028 5218012 5218007 -
tggccagggcaatcaggcagga

SEQ ID NO: 145300 - DNA, 22 bp, Artificial Sequence
  Synthetic oligonucleotide; CTG chr11 5218005 5218026 5218010 5218005 -
gccagggcaatcaggcaggaga

SEQ ID NO: 145301 - DNA, 22 bp, Artificial Sequence
  Synthetic oligonucleotide; TTC chr11 5217965 5217986 5217970 5217965 -
aattaggaaaagaggaagtgaa

SEQ ID NO: 145302 - DNA, 22 bp, Artificial Sequence
  Synthetic oligonucleotide; TTA chr11 5217960 5217981 5217965 5217960 -
ggaaaagaggaagtgaaattgt

SEQ ID NO: 145303 - DNA, 22 bp, Artificial Sequence
  Synthetic oligonucleotide; TTG chr11 5217939 5217960 5217944 5217939 -
tccctgtttgcagatgacatga

SEQ ID NO: 145304 - DNA, 22 bp, Artificial Sequence
  Synthetic oligonucleotide; CTG chr11 5217933 5217954 5217938 5217933 -
tttgcagatgacatgattgtat

SEQ ID NO: 145305 - DNA, 22 bp, Artificial Sequence
  Synthetic oligonucleotide; TTT chr11 5217930 5217951 5217935 5217930 -
gcagatgacatgattgtatatc

SEQ ID NO: 145306 - DNA, 22 bp, Artificial Sequence
  Synthetic oligonucleotide; TTG chr11 5217929 5217950 5217934 5217929 -
cagatgacatgattgtatatct

SEQ ID NO: 145307 - DNA, 22 bp, Artificial Sequence
  Synthetic oligonucleotide; TTG chr11 5217914 5217935 5217919 5217914 -
tatatctagaaaaccccattgt

SEQ ID NO: 145308 - DNA, 22 bp, Artificial Sequence
  Synthetic oligonucleotide; CTA chr11 5217906 5217927 5217911 5217906 -
gaaaaccccattgtctcagccc

SEQ ID NO: 145309 - DNA, 22 bp, Artificial Sequence
  Synthetic oligonucleotide; TTG chr11 5217893 5217914 5217898 5217893 -
tctcagcccaaaatctccttaa

SEQ ID NO: 145310 - DNA, 22 bp, Artificial Sequence
  Synthetic oligonucleotide; CTC chr11 5217889 5217910 5217894 5217889 -
agcccaaaatctccttaagctg

SEQ ID NO: 145311 - DNA, 22 bp, Artificial Sequence
  Synthetic oligonucleotide; CTC chr11 5217876 5217897 5217881 5217876 -
cttaagctgataagcaacttca

SEQ ID NO: 145312 - DNA, 22 bp, Artificial Sequence
  Synthetic oligonucleotide; CTT chr11 5217873 5217894 5217878 5217873 -
aagctgataagcaacttcagca

SEQ ID NO: 145313 - DNA, 22 bp, Artificial Sequence
  Synthetic oligonucleotide; TTA chr11 5217872 5217893 5217877 5217872 -
agctgataagcaacttcagcaa

SEQ ID NO: 145314 - DNA, 22 bp, Artificial Sequence
  Synthetic oligonucleotide; CTG chr11 5217867 5217888 5217872 5217867 -
ataagcaacttcagcaaagtct

SEQ ID NO: 145315 - DNA, 22 bp, Artificial Sequence
  Synthetic oligonucleotide; CTT chr11 5217856 5217877 5217861 5217856 -
cagcaaagtctcaggatataaa

SEQ ID NO: 145316 - DNA, 22 bp, Artificial Sequence
  Synthetic oligonucleotide; TTC chr11 5217855 5217876 5217860 5217855 -
agcaaagtctcaggatataaaa

SEQ ID NO: 145317 - DNA, 22 bp, Artificial Sequence
  Synthetic oligonucleotide; CTC chr11 5217844 5217865 5217849 5217844 -
aggatataaaatcagtgtgcaa

SEQ ID NO: 145318 - DNA, 22 bp, Artificial Sequence
  Synthetic oligonucleotide; TTC chr11 5217807 5217828 5217812 5217807 -
ctatgcaccaataacagacaaa

SEQ ID NO: 145319 - DNA, 22 bp, Artificial Sequence
  Synthetic oligonucleotide; CTA chr11 5217804 5217825 5217809 5217804 -
tgcaccaataacagacaaacag

SEQ ID NO: 145320 - DNA, 22 bp, Artificial Sequence
  Synthetic oligonucleotide; CTC chr11 5217759 5217780 5217764 5217759 -
ccattcacaattgcttcaaaga

SEQ ID NO: 145321 - DNA, 22 bp, Artificial Sequence
  Synthetic oligonucleotide; TTC chr11 5217753 5217774 5217758 5217753 -
acaattgcttcaaagagaataa

SEQ ID NO: 145322 - DNA, 22 bp, Artificial Sequence
  Synthetic oligonucleotide; TTG chr11 5217746 5217767 5217751 5217746 -
cttcaaagagaataaaatacct

SEQ ID NO: 145323 - DNA, 22 bp, Artificial Sequence
  Synthetic oligonucleotide; CTT chr11 5217743 5217764 5217748 5217743 -
caaagagaataaaatacctagg

SEQ ID NO: 145324 - DNA, 22 bp, Artificial Sequence
  Synthetic oligonucleotide; TTC chr11 5217742 5217763 5217747 5217742 -
aaagagaataaaatacctagga

SEQ ID NO: 145325 - DNA, 22 bp, Artificial Sequence
  Synthetic oligonucleotide; CTA chr11 5217723 5217744 5217728 5217723 -
ggaatccaacttacaagggatg

SEQ ID NO: 145326 - DNA, 22 bp, Artificial Sequence
  Synthetic oligonucleotide; CTT chr11 5217711 5217732 5217716 5217711 -
acaagggatgtgaaggacctct

SEQ ID NO: 145327 - DNA, 22 bp, Artificial Sequence
  Synthetic oligonucleotide; TTA chr11 5217710 5217731 5217715 5217710 -
caagggatgtgaaggacctctt

SEQ ID NO: 145328 - DNA, 22 bp, Artificial Sequence
  Synthetic oligonucleotide; CTC chr11 5217690 5217711 5217695 5217690 -
ttcaaggagaactacaaaccac

SEQ ID NO: 145329 - DNA, 22 bp, Artificial Sequence
  Synthetic oligonucleotide; CTT chr11 5217688 5217709 5217693 5217688 -
caaggagaactacaaaccactg

SEQ ID NO: 145330 - DNA, 22 bp, Artificial Sequence
  Synthetic oligonucleotide; TTC chr11 5217687 5217708 5217692 5217687 -
aaggagaactacaaaccactgc

SEQ ID NO: 145331 - DNA, 22 bp, Artificial Sequence
  Synthetic oligonucleotide; CTA chr11 5217676 5217697 5217681 5217676 -
caaaccactgctcaatgaaata

SEQ ID NO: 145332 - DNA, 22 bp, Artificial Sequence
  Synthetic oligonucleotide; CTG chr11 5217666 5217687 5217671 5217666 -
ctcaatgaaataaaagaggata

SEQ ID NO: 145333 - DNA, 22 bp, Artificial Sequence
  Synthetic oligonucleotide; CTC chr11 5217663 5217684 5217668 5217663 -
aatgaaataaaagaggatacaa

SEQ ID NO: 145334 - DNA, 22 bp, Artificial Sequence
  Synthetic oligonucleotide; TTC chr11 5217623 5217644 5217628 5217623 -
catgctcatgggtaggaagaat

SEQ ID NO: 145335 - DNA, 22 bp, Artificial Sequence
  Synthetic oligonucleotide; CTC chr11 5217616 5217637 5217621 5217616 -
atgggtaggaagaatcaatatc

SEQ ID NO: 145336 - DNA, 22 bp, Artificial Sequence
  Synthetic oligonucleotide; CTG chr11 5217576 5217597 5217581 5217576 -
cccaaggtaatttatagattca

SEQ ID NO: 145337 - DNA, 22 bp, Artificial Sequence
  Synthetic oligonucleotide; TTT chr11 5217563 5217584 5217568 5217563 -
atagattcaatgccatccccat

SEQ ID NO: 145338 - DNA, 22 bp, Artificial Sequence
  Synthetic oligonucleotide; TTA chr11 5217562 5217583 5217567 5217562 -
tagattcaatgccatccccatc

SEQ ID NO: 145339 - DNA, 22 bp, Artificial Sequence
  Synthetic oligonucleotide; TTC chr11 5217555 5217576 5217560 5217555 -
aatgccatccccatcaagctac

SEQ ID NO: 145340 - DNA, 22 bp, Artificial Sequence
  Synthetic oligonucleotide; CTA chr11 5217534 5217555 5217539 5217534 -
ccaatgactttcttcacagaac

SEQ ID NO: 145341 - DNA, 22 bp, Artificial Sequence
  Synthetic oligonucleotide; CTT chr11 5217524 5217545 5217529 5217524 -
tcttcacagaactggaaaaaac

SEQ ID NO: 145342 - DNA, 22 bp, Artificial Sequence
  Synthetic oligonucleotide; TTT chr11 5217523 5217544 5217528 5217523 -
cttcacagaactggaaaaaact

SEQ ID NO: 145343 - DNA, 22 bp, Artificial Sequence
  Synthetic oligonucleotide; TTC chr11 5217522 5217543 5217527 5217522 -
ttcacagaactggaaaaaacta

SEQ ID NO: 145344 - DNA, 22 bp, Artificial Sequence
  Synthetic oligonucleotide; CTT chr11 5217520 5217541 5217525 5217520 -
cacagaactggaaaaaactact

SEQ ID NO: 145345 - DNA, 22 bp, Artificial Sequence
  Synthetic oligonucleotide; TTC chr11 5217519 5217540 5217524 5217519 -
acagaactggaaaaaactactt

SEQ ID NO: 145346 - DNA, 22 bp, Artificial Sequence
  Synthetic oligonucleotide; CTG chr11 5217510 5217531 5217515 5217510 -
gaaaaaactactttaaagttca

SEQ ID NO: 145347 - DNA, 22 bp, Artificial Sequence
  Synthetic oligonucleotide; CTA chr11 5217500 5217521 5217505 5217500 -
ctttaaagttcatatggaacca

SEQ ID NO: 145348 - DNA, 22 bp, Artificial Sequence
  Synthetic oligonucleotide; CTT chr11 5217497 5217518 5217502 5217497 -
taaagttcatatggaaccaaaa

SEQ ID NO: 145349 - DNA, 22 bp, Artificial Sequence
  Synthetic oligonucleotide; TTT chr11 5217496 5217517 5217501 5217496 -
aaagttcatatggaaccaaaaa

SEQ ID NO: 145350 - DNA, 22 bp, Artificial Sequence
  Synthetic oligonucleotide; TTA chr11 5217495 5217516 5217500 5217495 -
aagttcatatggaaccaaaaaa

SEQ ID NO: 145351 - DNA, 22 bp, Artificial Sequence
  Synthetic oligonucleotide; TTC chr11 5217489 5217510 5217494 5217489 -
atatggaaccaaaaaagagccc

SEQ ID NO: 145352 - DNA, 22 bp, Artificial Sequence
  Synthetic oligonucleotide; CTA chr11 5217447 5217468 5217452 5217447 -
agccaaaagaacaaagctggag

SEQ ID NO: 145353 - DNA, 22 bp, Artificial Sequence
  Synthetic oligonucleotide; CTG chr11 5217428 5217449 5217433 5217428 -
gaggcatcacgctacctgactt

SEQ ID NO: 145354 - DNA, 22 bp, Artificial Sequence
  Synthetic oligonucleotide; CTA chr11 5217414 5217435 5217419 5217414 -
cctgacttcaaactatactaca

SEQ ID NO: 145355 - DNA, 22 bp, Artificial Sequence
  Synthetic oligonucleotide; CTG chr11 5217410 5217431 5217415 5217410 -
acttcaaactatactacaatgc

SEQ ID NO: 145356 - DNA, 22 bp, Artificial Sequence
  Synthetic oligonucleotide; CTT chr11 5217406 5217427 5217411 5217406 -
caaactatactacaatgctacg

SEQ ID NO: 145357 - DNA, 22 bp, Artificial Sequence
  Synthetic oligonucleotide; TTC chr11 5217405 5217426 5217410 5217405 -
aaactatactacaatgctacgg

SEQ ID NO: 145358 - DNA, 22 bp, Artificial Sequence
  Synthetic oligonucleotide; CTA chr11 5217399 5217420 5217404 5217399 -
tactacaatgctacggtaacca

SEQ ID NO: 145359 - DNA, 22 bp, Artificial Sequence
  Synthetic oligonucleotide; CTA chr11 5217394 5217415 5217399 5217394 -
caatgctacggtaaccaaaaca

SEQ ID NO: 145360 - DNA, 22 bp, Artificial Sequence
  Synthetic oligonucleotide; CTA chr11 5217386 5217407 5217391 5217386 -
cggtaaccaaaacagcatggta

SEQ ID NO: 145361 - DNA, 22 bp, Artificial Sequence
  Synthetic oligonucleotide; CTG chr11 5217361 5217382 5217366 5217361 -
gtaccaaaacagagatctagac

SEQ ID NO: 145362 - DNA, 22 bp, Artificial Sequence
  Synthetic oligonucleotide; CTA chr11 5217342 5217363 5217347 5217342 -
gaccaatggaacagaacagagc

SEQ ID NO: 145363 - DNA, 22 bp, Artificial Sequence
  Synthetic oligonucleotide; CTC chr11 5217316 5217337 5217321 5217316 -
agaaataatgccgcatatctac

SEQ ID NO: 145364 - DNA, 22 bp, Artificial Sequence
  Synthetic oligonucleotide; CTA chr11 5217295 5217316 5217300 5217295 -
caactatctgatctttgacaaa

SEQ ID NO: 145365 - DNA, 22 bp, Artificial Sequence
  Synthetic oligonucleotide; CTA chr11 5217289 5217310 5217294 5217289 -
tctgatctttgacaaacctgag

SEQ ID NO: 145366 - DNA, 22 bp, Artificial Sequence
  Synthetic oligonucleotide; CTG chr11 5217285 5217306 5217290 5217285 -
atctttgacaaacctgagagaa

SEQ ID NO: 145367 - DNA, 22 bp, Artificial Sequence
  Synthetic oligonucleotide; CTT chr11 5217280 5217301 5217285 5217280 -
tgacaaacctgagagaaacaag

SEQ ID NO: 145368 - DNA, 22 bp, Artificial Sequence
  Synthetic oligonucleotide; TTT chr11 5217279 5217300 5217284 5217279 -
gacaaacctgagagaaacaagc

SEQ ID NO: 145369 - DNA, 22 bp, Artificial Sequence
  Synthetic oligonucleotide; TTG chr11 5217278 5217299 5217283 5217278 -
acaaacctgagagaaacaagca

SEQ ID NO: 145370 - DNA, 22 bp, Artificial Sequence
  Synthetic oligonucleotide; CTG chr11 5217269 5217290 5217274 5217269 -
agagaaacaagcaatggggaaa

SEQ ID NO: 145371 - DNA, 22 bp, Artificial Sequence
  Synthetic oligonucleotide; TTC chr11 5217241 5217262 5217246 5217241 -
cctatttaataaatggtgctgg

SEQ ID NO: 145372 - DNA, 22 bp, Artificial Sequence
  Synthetic oligonucleotide; CTA chr11 5217237 5217258 5217242 5217237 -
tttaataaatggtgctgggaaa

SEQ ID NO: 145373 - DNA, 22 bp, Artificial Sequence
  Synthetic oligonucleotide; TTT chr11 5217234 5217255 5217239 5217234 -
aataaatggtgctgggaaaact

SEQ ID NO: 145374 - DNA, 22 bp, Artificial Sequence
  Synthetic oligonucleotide; TTA chr11 5217233 5217254 5217238 5217233 -
ataaatggtgctgggaaaactg

SEQ ID NO: 145375 - DNA, 22 bp, Artificial Sequence
  Synthetic oligonucleotide; CTG chr11 5217220 5217241 5217225 5217220 -
ggaaaactggctagccatatgt

SEQ ID NO: 145376 - DNA, 22 bp, Artificial Sequence
  Synthetic oligonucleotide; CTG chr11 5217211 5217232 5217216 5217211 -
gctagccatatgtagaaagctg

SEQ ID NO: 145377 - DNA, 22 bp, Artificial Sequence
  Synthetic oligonucleotide; CTA chr11 5217207 5217228 5217212 5217207 -
gccatatgtagaaagctgaaac

SEQ ID NO: 145378 - DNA, 22 bp, Artificial Sequence
  Synthetic oligonucleotide; CTG chr11 5217189 5217210 5217194 5217189 -
aaactggatcccttccttacac

SEQ ID NO: 145379 - DNA, 22 bp, Artificial Sequence
  Synthetic oligonucleotide; CTG chr11 5217183 5217204 5217188 5217183 -
gatcccttccttacaccttata

SEQ ID NO: 145380 - DNA, 22 bp, Artificial Sequence
  Synthetic oligonucleotide; CTT chr11 5217175 5217196 5217180 5217175 -
ccttacaccttatacaaaaatt

SEQ ID NO: 145381 - DNA, 22 bp, Artificial Sequence
  Synthetic oligonucleotide; TTC chr11 5217174 5217195 5217179 5217174 -
cttacaccttatacaaaaatta

SEQ ID NO: 145382 - DNA, 22 bp, Artificial Sequence
  Synthetic oligonucleotide; CTT chr11 5217171 5217192 5217176 5217171 -
acaccttatacaaaaattaatt

SEQ ID NO: 145383 - DNA, 22 bp, Artificial Sequence
  Synthetic oligonucleotide; TTA chr11 5217170 5217191 5217175 5217170 -
caccttatacaaaaattaattc

SEQ ID NO: 145384 - DNA, 22 bp, Artificial Sequence
  Synthetic oligonucleotide; CTT chr11 5217164 5217185 5217169 5217164 -
atacaaaaattaattcaagatg

SEQ ID NO: 145385 - DNA, 22 bp, Artificial Sequence
  Synthetic oligonucleotide; TTA chr11 5217163 5217184 5217168 5217163 -
tacaaaaattaattcaagatgg

SEQ ID NO: 145386 - DNA, 22 bp, Artificial Sequence
  Synthetic oligonucleotide; TTA chr11 5217152 5217173 5217157 5217152 -
attcaagatggattaaagactt

SEQ ID NO: 145387 - DNA, 22 bp, Artificial Sequence
  Synthetic oligonucleotide; TTC chr11 5217148 5217169 5217153 5217148 -
aagatggattaaagacttacat

SEQ ID NO: 145388 - DNA, 22 bp, Artificial Sequence
  Synthetic oligonucleotide; TTA chr11 5217137 5217158 5217142 5217137 -
aagacttacatgttagacctaa

SEQ ID NO: 145389 - DNA, 22 bp, Artificial Sequence
  Synthetic oligonucleotide; CTT chr11 5217130 5217151 5217135 5217130 -
acatgttagacctaaaaccata

SEQ ID NO: 145390 - DNA, 22 bp, Artificial Sequence
  Synthetic oligonucleotide; TTA chr11 5217129 5217150 5217134 5217129 -
catgttagacctaaaaccataa

SEQ ID NO: 145391 - DNA, 22 bp, Artificial Sequence
  Synthetic oligonucleotide; TTA chr11 5217122 5217143 5217127 5217122 -
gacctaaaaccataaaaaccct

SEQ ID NO: 145392 - DNA, 22 bp, Artificial Sequence
  Synthetic oligonucleotide; CTA chr11 5217116 5217137 5217121 5217116 -
aaaccataaaaaccctagaaaa

SEQ ID NO: 145393 - DNA, 22 bp, Artificial Sequence
  Synthetic oligonucleotide; CTA chr11 5217099 5217120 5217104 5217099 -
gaaaaaaacctaggcaatacca

SEQ ID NO: 145394 - DNA, 22 bp, Artificial Sequence
  Synthetic oligonucleotide; CTA chr11 5217087 5217108 5217092 5217087 -
ggcaataccattcaggacatag

SEQ ID NO: 145395 - DNA, 22 bp, Artificial Sequence
  Synthetic oligonucleotide; TTC chr11 5217074 5217095 5217079 5217074 -
aggacataggcatgggcaagga

SEQ ID NO: 145396 - DNA, 22 bp, Artificial Sequence
  Synthetic oligonucleotide; CTT chr11 5217049 5217070 5217054 5217049 -
catgtctaaaacaccaaaagca

SEQ ID NO: 145397 - DNA, 22 bp, Artificial Sequence
  Synthetic oligonucleotide; TTC chr11 5217048 5217069 5217053 5217048 -
atgtctaaaacaccaaaagcaa

SEQ ID NO: 145398 - DNA, 22 bp, Artificial Sequence
  Synthetic oligonucleotide; CTA chr11 5217041 5217062 5217046 5217041 -
aaacaccaaaagcaatggcaac

SEQ ID NO: 145399 - DNA, 22 bp, Artificial Sequence
  Synthetic oligonucleotide; CTA chr11 5216991 5217012 5216996 5216991 -
attaaactaaagagcttctgca

SEQ ID NO: 145400 - DNA, 22 bp, Artificial Sequence
  Synthetic oligonucleotide; TTA chr11 5216987 5217008 5216992 5216987 -
aactaaagagcttctgcacagc

SEQ ID NO: 145401 - DNA, 22 bp, Artificial Sequence
  Synthetic oligonucleotide; CTA chr11 5216982 5217003 5216987 5216982 -
aagagcttctgcacagctaaag

SEQ ID NO: 145402 - DNA, 22 bp, Artificial Sequence
  Synthetic oligonucleotide; CTT chr11 5216974 5216995 5216979 5216974 -
ctgcacagctaaagaaactacc

SEQ ID NO: 145403 - DNA, 22 bp, Artificial Sequence
  Synthetic oligonucleotide; TTC chr11 5216973 5216994 5216978 5216973 -
tgcacagctaaagaaactacca

SEQ ID NO: 145404 - DNA, 22 bp, Artificial Sequence
  Synthetic oligonucleotide; CTG chr11 5216971 5216992 5216976 5216971 -
cacagctaaagaaactaccatc

SEQ ID NO: 145405 - DNA, 22 bp, Artificial Sequence
  Synthetic oligonucleotide; CTA chr11 5216963 5216984 5216968 5216963 -
aagaaactaccatcagagtgaa

SEQ ID NO: 145406 - DNA, 22 bp, Artificial Sequence
  Synthetic oligonucleotide; CTA chr11 5216954 5216975 5216959 5216954 -
ccatcagagtgaacaggcaacc

SEQ ID NO: 145407 - DNA, 22 bp, Artificial Sequence
  Synthetic oligonucleotide; CTA chr11 5216930 5216951 5216935 5216930 -
caaaatgggagaaaatttttgc

SEQ ID NO: 145408 - DNA, 22 bp, Artificial Sequence
  Synthetic oligonucleotide; TTT chr11 5216912 5216933 5216917 5216912 -
ttgcaatctactcatctgacaa

SEQ ID NO: 145409 - DNA, 22 bp, Artificial Sequence
  Synthetic oligonucleotide; TTT chr11 5216911 5216932 5216916 5216911 -
tgcaatctactcatctgacaaa

SEQ ID NO: 145410 - DNA, 22 bp, Artificial Sequence
  Synthetic oligonucleotide; TTT chr11 5216910 5216931 5216915 5216910 -
gcaatctactcatctgacaaag

SEQ ID NO: 145411 - DNA, 22 bp, Artificial Sequence
  Synthetic oligonucleotide; TTG chr11 5216909 5216930 5216914 5216909 -
caatctactcatctgacaaagg

SEQ ID NO: 145412 - DNA, 22 bp, Artificial Sequence
  Synthetic oligonucleotide; CTA chr11 5216902 5216923 5216907 5216902 -
ctcatctgacaaagggctaata

SEQ ID NO: 145413 - DNA, 22 bp, Artificial Sequence
  Synthetic oligonucleotide; CTC chr11 5216899 5216920 5216904 5216899 -
atctgacaaagggctaatatcc

SEQ ID NO: 145414 - DNA, 22 bp, Artificial Sequence
  Synthetic oligonucleotide; CTG chr11 5216894 5216915 5216899 5216894 -
acaaagggctaatatccagaat

SEQ ID NO: 145415 - DNA, 22 bp, Artificial Sequence
  Synthetic oligonucleotide; CTA chr11 5216883 5216904 5216888 5216883 -
atatccagaatctacaatgaac

SEQ ID NO: 145416 - DNA, 22 bp, Artificial Sequence
  Synthetic oligonucleotide; CTA chr11 5216869 5216890 5216874 5216869 -
caatgaactcaaacaaatttac

SEQ ID NO: 145417 - DNA, 22 bp, Artificial Sequence
  Synthetic oligonucleotide; CTC chr11 5216859 5216880 5216864 5216859 -
aaacaaatttacaagaaaaaac

SEQ ID NO: 145418 - DNA, 22 bp, Artificial Sequence
  Synthetic oligonucleotide; TTT chr11 5216849 5216870 5216854 5216849 -
acaagaaaaaacaaacaacccc

SEQ ID NO: 145419 - DNA, 22 bp, Artificial Sequence
  Synthetic oligonucleotide; TTA chr11 5216848 5216869 5216853 5216848 -
caagaaaaaacaaacaacccca

SEQ ID NO: 145420 - DNA, 22 bp, Artificial Sequence
  Synthetic oligonucleotide; CTT chr11 5216792 5216813 5216797 5216792 -
cgcaaaagaagacatttatgta

SEQ ID NO: 145421 - DNA, 22 bp, Artificial Sequence
  Synthetic oligonucleotide; TTC chr11 5216791 5216812 5216796 5216791 -
gcaaaagaagacatttatgtaa

SEQ ID NO: 145422 - DNA, 22 bp, Artificial Sequence
  Synthetic oligonucleotide; TTT chr11 5216775 5216796 5216780 5216775 -
atgtaatcaaaaaacacatgaa

SEQ ID NO: 145423 - DNA, 22 bp, Artificial Sequence
  Synthetic oligonucleotide; TTA chr11 5216774 5216795 5216779 5216774 -
tgtaatcaaaaaacacatgaaa

SEQ ID NO: 145424 - DNA, 22 bp, Artificial Sequence
  Synthetic oligonucleotide; CTC chr11 5216744 5216765 5216749 5216744 -
atcatcactagccatcagagaa

SEQ ID NO: 145425 - DNA, 22 bp, Artificial Sequence
  Synthetic oligonucleotide; CTA chr11 5216734 5216755 5216739 5216734 -
gccatcagagaaatgcaaatca

SEQ ID NO: 145426 - DNA, 22 bp, Artificial Sequence
  Synthetic oligonucleotide; CTC chr11 5216689 5216710 5216694 5216689 -
acaccagttagaatggcgatca

SEQ ID NO: 145427 - DNA, 22 bp, Artificial Sequence
  Synthetic oligonucleotide; TTA chr11 5216679 5216700 5216684 5216679 -
gaatggcgatcattaaaaagtc

SEQ ID NO: 145428 - DNA, 22 bp, Artificial Sequence
  Synthetic oligonucleotide; TTA chr11 5216664 5216685 5216669 5216664 -
aaaagtcaggaaacaacaggtg

SEQ ID NO: 145429 - DNA, 22 bp, Artificial Sequence
  Synthetic oligonucleotide; CTG chr11 5216639 5216660 5216644 5216639 -
gagaggatgtggagaaacagga

SEQ ID NO: 145430 - DNA, 22 bp, Artificial Sequence
  Synthetic oligonucleotide; CTT chr11 5216610 5216631 5216615 5216610 -
ttacactgttggtgggactgta

SEQ ID NO: 145431 - DNA, 22 bp, Artificial Sequence
  Synthetic oligonucleotide; TTT chr11 5216609 5216630 5216614 5216609 -
tacactgttggtgggactgtaa

SEQ ID NO: 145432 - DNA, 22 bp, Artificial Sequence
  Synthetic oligonucleotide; TTT chr11 5216608 5216629 5216613 5216608 -
acactgttggtgggactgtaaa

SEQ ID NO: 145433 - DNA, 22 bp, Artificial Sequence
  Synthetic oligonucleotide; TTA chr11 5216607 5216628 5216612 5216607 -
cactgttggtgggactgtaaac

SEQ ID NO: 145434 - DNA, 22 bp, Artificial Sequence
  Synthetic oligonucleotide; CTG chr11 5216602 5216623 5216607 5216602 -
ttggtgggactgtaaactagtt

SEQ ID NO: 145435 - DNA, 22 bp, Artificial Sequence
  Synthetic oligonucleotide; TTG chr11 5216599 5216620 5216604 5216599 -
gtgggactgtaaactagttcaa

SEQ ID NO: 145436 - DNA, 22 bp, Artificial Sequence
  Synthetic oligonucleotide; CTG chr11 5216590 5216611 5216595 5216590 -
taaactagttcaaccattgcgg

SEQ ID NO: 145437 - DNA, 22 bp, Artificial Sequence
  Synthetic oligonucleotide; CTA chr11 5216583 5216604 5216588 5216583 -
gttcaaccattgcggaagtcag

SEQ ID NO: 145438 - DNA, 22 bp, Artificial Sequence
  Synthetic oligonucleotide; TTC chr11 5216579 5216600 5216584 5216579 -
aaccattgcggaagtcagtgtg

SEQ ID NO: 145439 - DNA, 22 bp, Artificial Sequence
  Synthetic oligonucleotide; TTG chr11 5216571 5216592 5216576 5216571 -
cggaagtcagtgtggcaattcc

SEQ ID NO: 145440 - DNA, 22 bp, Artificial Sequence
  Synthetic oligonucleotide; TTC chr11 5216550 5216571 5216555 5216550 -
ctcaggaatctagaactagaaa

SEQ ID NO: 145441 - DNA, 22 bp, Artificial Sequence
  Synthetic oligonucleotide; CTC chr11 5216547 5216568 5216552 5216547 -
aggaatctagaactagaaatac

SEQ ID NO: 145442 - DNA, 22 bp, Artificial Sequence
  Synthetic oligonucleotide; CTA chr11 5216538 5216559 5216543 5216538 -
gaactagaaataccatttgacc

SEQ ID NO: 145443 - DNA, 22 bp, Artificial Sequence
  Synthetic oligonucleotide; CTA chr11 5216532 5216553 5216537 5216532 -
gaaataccatttgacccagcca

SEQ ID NO: 145444 - DNA, 22 bp, Artificial Sequence
  Synthetic oligonucleotide; TTT chr11 5216520 5216541 5216525 5216520 -
gacccagccatcccattactgg

SEQ ID NO: 145445 - DNA, 22 bp, Artificial Sequence
  Synthetic oligonucleotide; TTG chr11 5216519 5216540 5216524 5216519 -
acccagccatcccattactggg

SEQ ID NO: 145446 - DNA, 22 bp, Artificial Sequence
  Synthetic oligonucleotide; TTA chr11 5216502 5216523 5216507 5216502 -
ctgggtacatacccaaaggatt

SEQ ID NO: 145447 - DNA, 22 bp, Artificial Sequence
  Synthetic oligonucleotide; CTG chr11 5216499 5216520 5216504 5216499 -
ggtacatacccaaaggattata

SEQ ID NO: 145448 - DNA, 22 bp, Artificial Sequence
  Synthetic oligonucleotide; TTA chr11 5216479 5216500 5216484 5216479 -
taaatcatgctgctataaagac

SEQ ID NO: 145449 - DNA, 22 bp, Artificial Sequence
  Synthetic oligonucleotide; CTG chr11 5216467 5216488 5216472 5216467 -
ctataaagacacatgcacacgt

SEQ ID NO: 145450 - DNA, 22 bp, Artificial Sequence
  Synthetic oligonucleotide; CTA chr11 5216464 5216485 5216469 5216464 -
taaagacacatgcacacgtatg

SEQ ID NO: 145451 - DNA, 22 bp, Artificial Sequence
  Synthetic oligonucleotide; TTT chr11 5216439 5216460 5216444 5216439 -
attgcagcactattcacaatag

SEQ ID NO: 145452 - DNA, 22 bp, Artificial Sequence
  Synthetic oligonucleotide; TTA chr11 5216438 5216459 5216443 5216438 -
ttgcagcactattcacaatagc

SEQ ID NO: 145453 - DNA, 22 bp, Artificial Sequence
  Synthetic oligonucleotide; TTG chr11 5216435 5216456 5216440 5216435 -
cagcactattcacaatagcaaa

SEQ ID NO: 145454 - DNA, 22 bp, Artificial Sequence
  Synthetic oligonucleotide; CTA chr11 5216427 5216448 5216432 5216427 -
ttcacaatagcaaagacttgga

SEQ ID NO: 145455 - DNA, 22 bp, Artificial Sequence
  Synthetic oligonucleotide; TTC chr11 5216424 5216445 5216429 5216424 -
acaatagcaaagacttggaacc

SEQ ID NO: 145456 - DNA, 22 bp, Artificial Sequence
  Synthetic oligonucleotide; CTT chr11 5216408 5216429 5216413 5216408 -
ggaaccaacccaaatgtccaac

SEQ ID NO: 145457 - DNA, 22 bp, Artificial Sequence
  Synthetic oligonucleotide; TTG chr11 5216407 5216428 5216412 5216407 -
gaaccaacccaaatgtccaaca

SEQ ID NO: 145458 - DNA, 22 bp, Artificial Sequence
  Synthetic oligonucleotide; CTG chr11 5216374 5216395 5216379 5216374 -
gattaagaaaatgtggcacata

SEQ ID NO: 145459 - DNA, 22 bp, Artificial Sequence
  Synthetic oligonucleotide; TTA chr11 5216369 5216390 5216374 5216369 -
agaaaatgtggcacatatacac

SEQ ID NO: 145460 - DNA, 22 bp, Artificial Sequence
  Synthetic oligonucleotide; CTA chr11 5216335 5216356 5216340 5216335 -
tgcagccataaaaaatgatgag

SEQ ID NO: 145461 - DNA, 22 bp, Artificial Sequence
  Synthetic oligonucleotide; TTC chr11 5216310 5216331 5216315 5216310 -
atgtcctttgtagggacatgga

SEQ ID NO: 145462 - DNA, 22 bp, Artificial Sequence
  Synthetic oligonucleotide; CTT chr11 5216302 5216323 5216307 5216302 -
tgtagggacatggatgaagctg

SEQ ID NO: 145463 - DNA, 22 bp, Artificial Sequence
  Synthetic oligonucleotide; TTT chr11 5216301 5216322 5216306 5216301 -
gtagggacatggatgaagctgg

SEQ ID NO: 145464 - DNA, 22 bp, Artificial Sequence
  Synthetic oligonucleotide; TTG chr11 5216300 5216321 5216305 5216300 -
tagggacatggatgaagctgga

SEQ ID NO: 145465 - DNA, 22 bp, Artificial Sequence
  Synthetic oligonucleotide; CTG chr11 5216280 5216301 5216285 5216280 -
gaaactatcattctcagcaaac

SEQ ID NO: 145466 - DNA, 22 bp, Artificial Sequence
  Synthetic oligonucleotide; CTA chr11 5216273 5216294 5216278 5216273 -
tcattctcagcaaactatcaca

SEQ ID NO: 145467 - DNA, 22 bp, Artificial Sequence
  Synthetic oligonucleotide; TTC chr11 5216267 5216288 5216272 5216267 -
tcagcaaactatcacaaggaga

SEQ ID NO: 145468 - DNA, 22 bp, Artificial Sequence
  Synthetic oligonucleotide; CTC chr11 5216265 5216286 5216270 5216265 -
agcaaactatcacaaggagaat

SEQ ID NO: 145469 - DNA, 22 bp, Artificial Sequence
  Synthetic oligonucleotide; CTA chr11 5216256 5216277 5216261 5216256 -
tcacaaggagaataaaccaaac

SEQ ID NO: 145470 - DNA, 22 bp, Artificial Sequence
  Synthetic oligonucleotide; TTC chr11 5216223 5216244 5216228 5216223 -
tcactcataggtgggaattgaa

SEQ ID NO: 145471 - DNA, 22 bp, Artificial Sequence
  Synthetic oligonucleotide; CTC chr11 5216221 5216242 5216226 5216221 -
actcataggtgggaattgaaca

SEQ ID NO: 145472 - DNA, 22 bp, Artificial Sequence
  Synthetic oligonucleotide; CTC chr11 5216217 5216238 5216222 5216217 -
ataggtgggaattgaacaatga

SEQ ID NO: 145473 - DNA, 22 bp, Artificial Sequence
  Synthetic oligonucleotide; TTG chr11 5216203 5216224 5216208 5216203 -
aacaatgagaacacatggacac

SEQ ID NO: 145474 - DNA, 22 bp, Artificial Sequence
  Synthetic oligonucleotide; CTC chr11 5216160 5216181 5216165 5216160 -
tggggactgttatggggtgggg

SEQ ID NO: 145475 - DNA, 22 bp, Artificial Sequence
  Synthetic oligonucleotide; CTG chr11 5216158 5216179 5216163 5216158 -
gggactgttatggggtgggggg

SEQ ID NO: 145476 - DNA, 22 bp, Artificial Sequence
  Synthetic oligonucleotide; CTG chr11 5216151 5216172 5216156 5216151 -
ttatggggtggggggcaggggc

SEQ ID NO: 145477 - DNA, 22 bp, Artificial Sequence
  Synthetic oligonucleotide; TTA chr11 5216148 5216169 5216153 5216148 -
tggggtggggggcaggggcagg

SEQ ID NO: 145478 - DNA, 22 bp, Artificial Sequence
  Synthetic oligonucleotide; CTA chr11 5216116 5216137 5216121 5216116 -
ggagatatacctaatgctaaat

SEQ ID NO: 145479 - DNA, 22 bp, Artificial Sequence
  Synthetic oligonucleotide; CTA chr11 5216103 5216124 5216108 5216103 -
atgctaaatgacgagttaatgg

SEQ ID NO: 145480 - DNA, 22 bp, Artificial Sequence
  Synthetic oligonucleotide; CTA chr11 5216097 5216118 5216102 5216097 -
aatgacgagttaatgggtgcag

SEQ ID NO: 145481 - DNA, 22 bp, Artificial Sequence
  Synthetic oligonucleotide; TTA chr11 5216085 5216106 5216090 5216085 -
atgggtgcagcacaccaacatg

SEQ ID NO: 145482 - DNA, 22 bp, Artificial Sequence
  Synthetic oligonucleotide; CTG chr11 5216035 5216056 5216040 5216035 -
catgttgtgcacatgtacccta

SEQ ID NO: 145483 - DNA, 22 bp, Artificial Sequence
  Synthetic oligonucleotide; TTG chr11 5216028 5216049 5216033 5216028 -
tgcacatgtaccctaaaacttg

SEQ ID NO: 145484 - DNA, 22 bp, Artificial Sequence
  Synthetic oligonucleotide; CTA chr11 5216013 5216034 5216018 5216013 -
aaacttgaagtataataataaa

SEQ ID NO: 145485 - DNA, 22 bp, Artificial Sequence
  Synthetic oligonucleotide; CTT chr11 5216007 5216028 5216012 5216007 -
gaagtataataataaaaaaaag

SEQ ID NO: 145486 - DNA, 22 bp, Artificial Sequence
  Synthetic oligonucleotide; TTG chr11 5216006 5216027 5216011 5216006 -
aagtataataataaaaaaaagt

SEQ ID NO: 145487 - DNA, 22 bp, Artificial Sequence
  Synthetic oligonucleotide; TTA chr11 5215982 5216003 5215987 5215982 -
tcctattaaaactgatctcaca

SEQ ID NO: 145488 - DNA, 22 bp, Artificial Sequence
  Synthetic oligonucleotide; CTA chr11 5215977 5215998 5215982 5215977 -
ttaaaactgatctcacacatcc

SEQ ID NO: 145489 - DNA, 22 bp, Artificial Sequence
  Synthetic oligonucleotide; TTA chr11 5215974 5215995 5215979 5215974 -
aaactgatctcacacatccgta

SEQ ID NO: 145490 - DNA, 22 bp, Artificial Sequence
  Synthetic oligonucleotide; CTG chr11 5215968 5215989 5215973 5215968 -
atctcacacatccgtagagcca

SEQ ID NO: 145491 - DNA, 22 bp, Artificial Sequence
  Synthetic oligonucleotide; CTC chr11 5215963 5215984 5215968 5215963 -
acacatccgtagagccattatc

SEQ ID NO: 145492 - DNA, 22 bp, Artificial Sequence
  Synthetic oligonucleotide; TTA chr11 5215943 5215964 5215948 5215943 -
tcaagtctttctctttgaaata

SEQ ID NO: 145493 - DNA, 22 bp, Artificial Sequence
  Synthetic oligonucleotide; CTT chr11 5215934 5215955 5215939 5215934 -
tctctttgaaatagacagaaat

SEQ ID NO: 145494 - DNA, 22 bp, Artificial Sequence
  Synthetic oligonucleotide; TTT chr11 5215933 5215954 5215938 5215933 -
ctctttgaaatagacagaaatt

SEQ ID NO: 145495 - DNA, 22 bp, Artificial Sequence
  Synthetic oligonucleotide; TTC chr11 5215932 5215953 5215937 5215932 -
tctttgaaatagacagaaattt

SEQ ID NO: 145496 - DNA, 22 bp, Artificial Sequence
  Synthetic oligonucleotide; CTC chr11 5215930 5215951 5215935 5215930 -
tttgaaatagacagaaatttag

SEQ ID NO: 145497 - DNA, 22 bp, Artificial Sequence
  Synthetic oligonucleotide; CTT chr11 5215928 5215949 5215933 5215928 -
tgaaatagacagaaatttagtg

SEQ ID NO: 145498 - DNA, 22 bp, Artificial Sequence
  Synthetic oligonucleotide; TTT chr11 5215927 5215948 5215932 5215927 -
gaaatagacagaaatttagtgt

SEQ ID NO: 145499 - DNA, 22 bp, Artificial Sequence
  Synthetic oligonucleotide; TTG chr11 5215926 5215947 5215931 5215926 -
aaatagacagaaatttagtgtt

SEQ ID NO: 145500 - DNA, 22 bp, Artificial Sequence
  Synthetic oligonucleotide; TTT chr11 5215910 5215931 5215915 5215910 -
agtgttttctcagtcagttaac

SEQ ID NO: 145501 - DNA, 22 bp, Artificial Sequence
  Synthetic oligonucleotide; TTA chr11 5215909 5215930 5215914 5215909 -
gtgttttctcagtcagttaaca

SEQ ID NO: 145502 - DNA, 22 bp, Artificial Sequence
  Synthetic oligonucleotide; TTT chr11 5215903 5215924 5215908 5215903 -
tctcagtcagttaacattcctt

SEQ ID NO: 145503 - DNA, 22 bp, Artificial Sequence
  Synthetic oligonucleotide; TTT chr11 5215902 5215923 5215907 5215902 -
ctcagtcagttaacattccttc

SEQ ID NO: 145504 - DNA, 22 bp, Artificial Sequence
  Synthetic oligonucleotide; TTC chr11 5215901 5215922 5215906 5215901 -
tcagtcagttaacattccttca

SEQ ID NO: 145505 - DNA, 22 bp, Artificial Sequence
  Synthetic oligonucleotide; CTC chr11 5215899 5215920 5215904 5215899 -
agtcagttaacattccttcaac

SEQ ID NO: 145506 - DNA, 22 bp, Artificial Sequence
  Synthetic oligonucleotide; TTA chr11 5215890 5215911 5215895 5215890 -
acattccttcaactagattagt

SEQ ID NO: 145507 - DNA, 22 bp, Artificial Sequence
  Synthetic oligonucleotide; TTC chr11 5215884 5215905 5215889 5215884 -
cttcaactagattagttgtgac

SEQ ID NO: 145508 - DNA, 22 bp, Artificial Sequence
  Synthetic oligonucleotide; CTT chr11 5215881 5215902 5215886 5215881 -
caactagattagttgtgacaaa

SEQ ID NO: 145509 - DNA, 22 bp, Artificial Sequence
  Synthetic oligonucleotide; TTC chr11 5215880 5215901 5215885 5215880 -
aactagattagttgtgacaaaa

SEQ ID NO: 145510 - DNA, 22 bp, Artificial Sequence
  Synthetic oligonucleotide; CTA chr11 5215875 5215896 5215880 5215875 -
gattagttgtgacaaaatttca

SEQ ID NO: 145511 - DNA, 22 bp, Artificial Sequence
  Synthetic oligonucleotide; TTA chr11 5215870 5215891 5215875 5215870 -
gttgtgacaaaatttcaggcct

SEQ ID NO: 145512 - DNA, 22 bp, Artificial Sequence
  Synthetic oligonucleotide; TTG chr11 5215866 5215887 5215871 5215866 -
tgacaaaatttcaggccttgct

SEQ ID NO: 145513 - DNA, 22 bp, Artificial Sequence
  Synthetic oligonucleotide; TTT chr11 5215855 5215876 5215860 5215855 -
caggccttgctcaactctaacc

SEQ ID NO: 145514 - DNA, 22 bp, Artificial Sequence
  Synthetic oligonucleotide; TTC chr11 5215854 5215875 5215859 5215854 -
aggccttgctcaactctaacct

SEQ ID NO: 145515 - DNA, 22 bp, Artificial Sequence
  Synthetic oligonucleotide; CTT chr11 5215847 5215868 5215852 5215847 -
gctcaactctaacctcagtctc

SEQ ID NO: 145516 - DNA, 22 bp, Artificial Sequence
  Synthetic oligonucleotide; TTG chr11 5215846 5215867 5215851 5215846 -
ctcaactctaacctcagtctct

SEQ ID NO: 145517 - DNA, 22 bp, Artificial Sequence
  Synthetic oligonucleotide; CTC chr11 5215843 5215864 5215848 5215843 -
aactctaacctcagtctctcca

SEQ ID NO: 145518 - DNA, 22 bp, Artificial Sequence
  Synthetic oligonucleotide; CTC chr11 5215838 5215859 5215843 5215838 -
taacctcagtctctccatatat

SEQ ID NO: 145519 - DNA, 22 bp, Artificial Sequence
  Synthetic oligonucleotide; CTA chr11 5215836 5215857 5215841 5215836 -
acctcagtctctccatatattt

SEQ ID NO: 145520 - DNA, 22 bp, Artificial Sequence
  Synthetic oligonucleotide; CTC chr11 5215831 5215852 5215836 5215831 -
agtctctccatatatttctgag

SEQ ID NO: 145521 - DNA, 22 bp, Artificial Sequence
  Synthetic oligonucleotide; CTC chr11 5215825 5215846 5215830 5215825 -
tccatatatttctgagagtctt

SEQ ID NO: 145522 - DNA, 22 bp, Artificial Sequence
  Synthetic oligonucleotide; CTC chr11 5215823 5215844 5215828 5215823 -
catatatttctgagagtcttcc

SEQ ID NO: 145523 - DNA, 22 bp, Artificial Sequence
  Synthetic oligonucleotide; TTT chr11 5215814 5215835 5215819 5215814 -
ctgagagtcttccttcttattt

SEQ ID NO: 145524 - DNA, 22 bp, Artificial Sequence
  Synthetic oligonucleotide; TTC chr11 5215813 5215834 5215818 5215813 -
tgagagtcttccttcttatttg

SEQ ID NO: 145525 - DNA, 22 bp, Artificial Sequence
  Synthetic oligonucleotide; CTG chr11 5215811 5215832 5215816 5215811 -
agagtcttccttcttatttgtt

SEQ ID NO: 145526 - DNA, 22 bp, Artificial Sequence
  Synthetic oligonucleotide; CTT chr11 5215803 5215824 5215808 5215803 -
ccttcttatttgtttataagaa

SEQ ID NO: 145527 - DNA, 22 bp, Artificial Sequence
  Synthetic oligonucleotide; TTC chr11 5215802 5215823 5215807 5215802 -
cttcttatttgtttataagaat

SEQ ID NO: 145528 - DNA, 22 bp, Artificial Sequence
  Synthetic oligonucleotide; CTT chr11 5215799 5215820 5215804 5215799 -
cttatttgtttataagaattta

SEQ ID NO: 145529 - DNA, 22 bp, Artificial Sequence
  Synthetic oligonucleotide; TTC chr11 5215798 5215819 5215803 5215798 -
ttatttgtttataagaatttag

SEQ ID NO: 145530 - DNA, 22 bp, Artificial Sequence
  Synthetic oligonucleotide; CTT chr11 5215796 5215817 5215801 5215796 -
atttgtttataagaatttagta

SEQ ID NO: 145531 - DNA, 22 bp, Artificial Sequence
  Synthetic oligonucleotide; TTA chr11 5215795 5215816 5215800 5215795 -
tttgtttataagaatttagtaa

SEQ ID NO: 145532 - DNA, 22 bp, Artificial Sequence
  Synthetic oligonucleotide; TTT chr11 5215792 5215813 5215797 5215792 -
gtttataagaatttagtaaatg

SEQ ID NO: 145533 - DNA, 22 bp, Artificial Sequence
  Synthetic oligonucleotide; TTG chr11 5215791 5215812 5215796 5215791 -
tttataagaatttagtaaatgg

SEQ ID NO: 145534 - DNA, 22 bp, Artificial Sequence
  Synthetic oligonucleotide; TTT chr11 5215788 5215809 5215793 5215788 -
ataagaatttagtaaatggcaa

SEQ ID NO: 145535 - DNA, 22 bp, Artificial Sequence
  Synthetic oligonucleotide; TTA chr11 5215787 5215808 5215792 5215787 -
taagaatttagtaaatggcaat

SEQ ID NO: 145536 - DNA, 22 bp, Artificial Sequence
  Synthetic oligonucleotide; TTT chr11 5215778 5215799 5215783 5215778 -
agtaaatggcaatattgagaag

SEQ ID NO: 145537 - DNA, 22 bp, Artificial Sequence
  Synthetic oligonucleotide; TTA chr11 5215777 5215798 5215782 5215777 -
gtaaatggcaatattgagaagt

SEQ ID NO: 145538 - DNA, 22 bp, Artificial Sequence
  Synthetic oligonucleotide; TTG chr11 5215761 5215782 5215766 5215761 -
agaagtagaaaattttggagac

SEQ ID NO: 145539 - DNA, 22 bp, Artificial Sequence
  Synthetic oligonucleotide; TTT chr11 5215746 5215767 5215751 5215746 -
tggagacttgtttttcatgaac

SEQ ID NO: 145540 - DNA, 22 bp, Artificial Sequence
  Synthetic oligonucleotide; TTT chr11 5215745 5215766 5215750 5215745 -
ggagacttgtttttcatgaacc

SEQ ID NO: 145541 - DNA, 22 bp, Artificial Sequence
  Synthetic oligonucleotide; TTG chr11 5215744 5215765 5215749 5215744 -
gagacttgtttttcatgaacca

SEQ ID NO: 145542 - DNA, 22 bp, Artificial Sequence
  Synthetic oligonucleotide; CTT chr11 5215737 5215758 5215742 5215737 -
gtttttcatgaaccagaacaat

SEQ ID NO: 145543 - DNA, 22 bp, Artificial Sequence
  Synthetic oligonucleotide; TTG chr11 5215736 5215757 5215741 5215736 -
tttttcatgaaccagaacaatc

SEQ ID NO: 145544 - DNA, 22 bp, Artificial Sequence
  Synthetic oligonucleotide; TTT chr11 5215733 5215754 5215738 5215733 -
ttcatgaaccagaacaatctca

SEQ ID NO: 145545 - DNA, 22 bp, Artificial Sequence
  Synthetic oligonucleotide; TTT chr11 5215732 5215753 5215737 5215732 -
tcatgaaccagaacaatctcaa

SEQ ID NO: 145546 - DNA, 22 bp, Artificial Sequence
  Synthetic oligonucleotide; TTT chr11 5215731 5215752 5215736 5215731 -
catgaaccagaacaatctcaaa

SEQ ID NO: 145547 - DNA, 22 bp, Artificial Sequence
  Synthetic oligonucleotide; TTC chr11 5215730 5215751 5215735 5215730 -
atgaaccagaacaatctcaaag

SEQ ID NO: 145548 - DNA, 22 bp, Artificial Sequence
  Synthetic oligonucleotide; CTC chr11 5215712 5215733 5215717 5215712 -
aaagcagcaatactaaacagga

SEQ ID NO: 145549 - DNA, 22 bp, Artificial Sequence
  Synthetic oligonucleotide; CTA chr11 5215697 5215718 5215702 5215697 -
aacaggagccaagcctagaata

SEQ ID NO: 145550 - DNA, 22 bp, Artificial Sequence
  Synthetic oligonucleotide; CTA chr11 5215680 5215701 5215685 5215680 -
gaataaagttgaatttctggaa

SEQ ID NO: 145551 - DNA, 22 bp, Artificial Sequence
  Synthetic oligonucleotide; TTG chr11 5215669 5215690 5215674 5215669 -
aatttctggaatcaacaagcta

SEQ ID NO: 145552 - DNA, 22 bp, Artificial Sequence
  Synthetic oligonucleotide; TTT chr11 5215664 5215685 5215669 5215664 -
ctggaatcaacaagctagggga

SEQ ID NO: 145553 - DNA, 22 bp, Artificial Sequence
  Synthetic oligonucleotide; TTC chr11 5215663 5215684 5215668 5215663 -
tggaatcaacaagctaggggaa

SEQ ID NO: 145554 - DNA, 22 bp, Artificial Sequence
  Synthetic oligonucleotide; CTG chr11 5215661 5215682 5215666 5215661 -
gaatcaacaagctaggggaaag

SEQ ID NO: 145555 - DNA, 22 bp, Artificial Sequence
  Synthetic oligonucleotide; CTA chr11 5215647 5215668 5215652 5215647 -
ggggaaagtctcccattaagtc

SEQ ID NO: 145556 - DNA, 22 bp, Artificial Sequence
  Synthetic oligonucleotide; CTC chr11 5215635 5215656 5215640 5215635 -
ccattaagtcaaatatttgaca

SEQ ID NO: 145557 - DNA, 22 bp, Artificial Sequence
  Synthetic oligonucleotide; TTA chr11 5215629 5215650 5215634 5215629 -
agtcaaatatttgacaactggg

SEQ ID NO: 145558 - DNA, 22 bp, Artificial Sequence
  Synthetic oligonucleotide; TTT chr11 5215617 5215638 5215622 5215617 -
gacaactgggaggtcaagtcag

SEQ ID NO: 145559 - DNA, 22 bp, Artificial Sequence
  Synthetic oligonucleotide; TTG chr11 5215616 5215637 5215621 5215616 -
acaactgggaggtcaagtcaga

SEQ ID NO: 145560 - DNA, 22 bp, Artificial Sequence
  Synthetic oligonucleotide; CTG chr11 5215609 5215630 5215614 5215609 -
ggaggtcaagtcagaggtgaaa

SEQ ID NO: 145561 - DNA, 22 bp, Artificial Sequence
  Synthetic oligonucleotide; TTA chr11 5215579 5215600 5215584 5215579 -
aagataacaagaggtctgaaaa

SEQ ID NO: 145562 - DNA, 22 bp, Artificial Sequence
  Synthetic oligonucleotide; CTG chr11 5215561 5215582 5215566 5215561 -
aaaacaaagtgaccaattaaaa

SEQ ID NO: 145563 - DNA, 22 bp, Artificial Sequence
  Synthetic oligonucleotide; TTA chr11 5215542 5215563 5215547 5215542 -
aaataaaaagaaagagccaagc

SEQ ID NO: 145564 - DNA, 22 bp, Artificial Sequence
  Synthetic oligonucleotide; CTG chr11 5215518 5215539 5215523 5215518 -
ggcacagtggcttgcatctgta

SEQ ID NO: 145565 - DNA, 22 bp, Artificial Sequence
  Synthetic oligonucleotide; CTT chr11 5215505 5215526 5215510 5215505 -
gcatctgtagtcccagtaaccc

SEQ ID NO: 145566 - DNA, 22 bp, Artificial Sequence
  Synthetic oligonucleotide; TTG chr11 5215504 5215525 5215509 5215504 -
catctgtagtcccagtaaccca

SEQ ID NO: 145567 - DNA, 22 bp, Artificial Sequence
  Synthetic oligonucleotide; CTG chr11 5215498 5215519 5215503 5215498 -
tagtcccagtaacccaggaggc

SEQ ID NO: 145568 - DNA, 22 bp, Artificial Sequence
  Synthetic oligonucleotide; CTG chr11 5215474 5215495 5215479 5215474 -
aagtgataggatcacttgagcc

SEQ ID NO: 145569 - DNA, 22 bp, Artificial Sequence
  Synthetic oligonucleotide; CTT chr11 5215457 5215478 5215462 5215457 -
gagcccaggatttcagggttgc

SEQ ID NO: 145570 - DNA, 22 bp, Artificial Sequence
  Synthetic oligonucleotide; TTG chr11 5215456 5215477 5215461 5215456 -
agcccaggatttcagggttgca

SEQ ID NO: 145571 - DNA, 22 bp, Artificial Sequence
  Synthetic oligonucleotide; TTT chr11 5215444 5215465 5215449 5215444 -
cagggttgcagtgagcaataat

SEQ ID NO: 145572 - DNA, 22 bp, Artificial Sequence
  Synthetic oligonucleotide; TTC chr11 5215443 5215464 5215448 5215443 -
agggttgcagtgagcaataatg

SEQ ID NO: 145573 - DNA, 22 bp, Artificial Sequence
  Synthetic oligonucleotide; TTG chr11 5215436 5215457 5215441 5215436 -
cagtgagcaataatgacaccac

SEQ ID NO: 145574 - DNA, 22 bp, Artificial Sequence
  Synthetic oligonucleotide; CTG chr11 5215412 5215433 5215417 5215412 -
ctctctagccttggtgactgag

SEQ ID NO: 145575 - DNA, 22 bp, Artificial Sequence
  Synthetic oligonucleotide; CTC chr11 5215409 5215430 5215414 5215409 -
tctagccttggtgactgagatc

SEQ ID NO: 145576 - DNA, 22 bp, Artificial Sequence
  Synthetic oligonucleotide; CTC chr11 5215407 5215428 5215412 5215407 -
tagccttggtgactgagatcct

SEQ ID NO: 145577 - DNA, 22 bp, Artificial Sequence
  Synthetic oligonucleotide; CTA chr11 5215405 5215426 5215410 5215405 -
gccttggtgactgagatcctgt

SEQ ID NO: 145578 - DNA, 22 bp, Artificial Sequence
  Synthetic oligonucleotide; CTT chr11 5215400 5215421 5215405 5215400 -
ggtgactgagatcctgtctctg

SEQ ID NO: 145579 - DNA, 22 bp, Artificial Sequence
  Synthetic oligonucleotide; TTG chr11 5215399 5215420 5215404 5215399 -
gtgactgagatcctgtctctga

SEQ ID NO: 145580 - DNA, 22 bp, Artificial Sequence
  Synthetic oligonucleotide; CTG chr11 5215392 5215413 5215397 5215392 -
agatcctgtctctgaggaaaaa

SEQ ID NO: 145581 - DNA, 22 bp, Artificial Sequence
  Synthetic oligonucleotide; CTG chr11 5215384 5215405 5215389 5215384 -
tctctgaggaaaaacaaacaaa

SEQ ID NO: 145582 - DNA, 22 bp, Artificial Sequence
  Synthetic oligonucleotide; CTC chr11 5215380 5215401 5215385 5215380 -
tgaggaaaaacaaacaaacaag

SEQ ID NO: 145583 - DNA, 22 bp, Artificial Sequence
  Synthetic oligonucleotide; CTG chr11 5215378 5215399 5215383 5215378 -
aggaaaaacaaacaaacaagca

SEQ ID NO: 145584 - DNA, 22 bp, Artificial Sequence
  Synthetic oligonucleotide; TTA chr11 5215326 5215347 5215331 5215326 -
agaacatagaagttttgttacg

SEQ ID NO: 145585 - DNA, 22 bp, Artificial Sequence
  Synthetic oligonucleotide; TTT chr11 5215311 5215332 5215316 5215311 -
tgttacggtgatgatattctcc

SEQ ID NO: 145586 - DNA, 22 bp, Artificial Sequence
  Synthetic oligonucleotide; TTT chr11 5215310 5215331 5215315 5215310 -
gttacggtgatgatattctcca

SEQ ID NO: 145587 - DNA, 22 bp, Artificial Sequence
  Synthetic oligonucleotide; TTG chr11 5215309 5215330 5215314 5215309 -
ttacggtgatgatattctccaa

SEQ ID NO: 145588 - DNA, 22 bp, Artificial Sequence
  Synthetic oligonucleotide; TTA chr11 5215306 5215327 5215311 5215306 -
cggtgatgatattctccaacac

SEQ ID NO: 145589 - DNA, 22 bp, Artificial Sequence
  Synthetic oligonucleotide; TTC chr11 5215292 5215313 5215297 5215292 -
tccaacacaggtctgaacccct

SEQ ID NO: 145590 - DNA, 22 bp, Artificial Sequence
  Synthetic oligonucleotide; CTC chr11 5215290 5215311 5215295 5215290 -
caacacaggtctgaaccccttg

SEQ ID NO: 145591 - DNA, 22 bp, Artificial Sequence
  Synthetic oligonucleotide; CTG chr11 5215277 5215298 5215282 5215277 -
aaccccttgcagtgcctcgggg

SEQ ID NO: 145592 - DNA, 22 bp, Artificial Sequence
  Synthetic oligonucleotide; CTT chr11 5215269 5215290 5215274 5215269 -
gcagtgcctcggggctgtttct

SEQ ID NO: 145593 - DNA, 22 bp, Artificial Sequence
  Synthetic oligonucleotide; TTG chr11 5215268 5215289 5215273 5215268 -
cagtgcctcggggctgtttctc

SEQ ID NO: 145594 - DNA, 22 bp, Artificial Sequence
  Synthetic oligonucleotide; CTC chr11 5215259 5215280 5215264 5215259 -
ggggctgtttctccagtggatt

SEQ ID NO: 145595 - DNA, 22 bp, Artificial Sequence
  Synthetic oligonucleotide; CTG chr11 5215252 5215273 5215257 5215252 -
tttctccagtggattcttgggt

SEQ ID NO: 145596 - DNA, 22 bp, Artificial Sequence
  Synthetic oligonucleotide; TTT chr11 5215249 5215270 5215254 5215249 -
ctccagtggattcttgggttct

SEQ ID NO: 145597 - DNA, 22 bp, Artificial Sequence
  Synthetic oligonucleotide; TTC chr11 5215248 5215269 5215253 5215248 -
tccagtggattcttgggttctt

SEQ ID NO: 145598 - DNA, 22 bp, Artificial Sequence
  Synthetic oligonucleotide; CTC chr11 5215246 5215267 5215251 5215246 -
cagtggattcttgggttcttca

SEQ ID NO: 145599 - DNA, 22 bp, Artificial Sequence
  Synthetic oligonucleotide; TTC chr11 5215236 5215257 5215241 5215236 -
ttgggttcttcacatcttctca

SEQ ID NO: 145600 - DNA, 22 bp, Artificial Sequence
  Synthetic oligonucleotide; CTT chr11 5215234 5215255 5215239 5215234 -
gggttcttcacatcttctcaac

SEQ ID NO: 145601 - DNA, 22 bp, Artificial Sequence
  Synthetic oligonucleotide; TTG chr11 5215233 5215254 5215238 5215233 -
ggttcttcacatcttctcaact

SEQ ID NO: 145602 - DNA, 22 bp, Artificial Sequence
  Synthetic oligonucleotide; TTC chr11 5215228 5215249 5215233 5215228 -
ttcacatcttctcaactttgtg

SEQ ID NO: 145603 - DNA, 22 bp, Artificial Sequence
  Synthetic oligonucleotide; CTT chr11 5215226 5215247 5215231 5215226 -
cacatcttctcaactttgtgaa

SEQ ID NO: 145604 - DNA, 22 bp, Artificial Sequence
  Synthetic oligonucleotide; TTC chr11 5215225 5215246 5215230 5215225 -
acatcttctcaactttgtgaaa

SEQ ID NO: 145605 - DNA, 22 bp, Artificial Sequence
  Synthetic oligonucleotide; CTT chr11 5215218 5215239 5215223 5215218 -
ctcaactttgtgaaaagatatt

SEQ ID NO: 145606 - DNA, 22 bp, Artificial Sequence
  Synthetic oligonucleotide; TTC chr11 5215217 5215238 5215222 5215217 -
tcaactttgtgaaaagatattc

SEQ ID NO: 145607 - DNA, 22 bp, Artificial Sequence
  Synthetic oligonucleotide; CTC chr11 5215215 5215236 5215220 5215215 -
aactttgtgaaaagatattcat

SEQ ID NO: 145608 - DNA, 22 bp, Artificial Sequence
  Synthetic oligonucleotide; CTT chr11 5215210 5215231 5215215 5215210 -
tgtgaaaagatattcatccaaa

SEQ ID NO: 145609 - DNA, 22 bp, Artificial Sequence
  Synthetic oligonucleotide; TTT chr11 5215209 5215230 5215214 5215209 -
gtgaaaagatattcatccaaag

SEQ ID NO: 145610 - DNA, 22 bp, Artificial Sequence
  Synthetic oligonucleotide; TTG chr11 5215208 5215229 5215213 5215208 -
tgaaaagatattcatccaaagg

SEQ ID NO: 145611 - DNA, 22 bp, Artificial Sequence
  Synthetic oligonucleotide; TTC chr11 5215195 5215216 5215200 5215195 -
atccaaaggtctcacctgtctt

SEQ ID NO: 145612 - DNA, 22 bp, Artificial Sequence
  Synthetic oligonucleotide; CTC chr11 5215182 5215203 5215187 5215182 -
acctgtcttattcagagcttgg

SEQ ID NO: 145613 - DNA, 22 bp, Artificial Sequence
  Synthetic oligonucleotide; CTG chr11 5215177 5215198 5215182 5215177 -
tcttattcagagcttggatttt

SEQ ID NO: 145614 - DNA, 22 bp, Artificial Sequence
  Synthetic oligonucleotide; CTT chr11 5215173 5215194 5215178 5215173 -
attcagagcttggattttggac

SEQ ID NO: 145615 - DNA, 22 bp, Artificial Sequence
  Synthetic oligonucleotide; TTA chr11 5215172 5215193 5215177 5215172 -
ttcagagcttggattttggact

SEQ ID NO: 145616 - DNA, 22 bp, Artificial Sequence
  Synthetic oligonucleotide; TTC chr11 5215169 5215190 5215174 5215169 -
agagcttggattttggactagc

SEQ ID NO: 145617 - DNA, 22 bp, Artificial Sequence
  Synthetic oligonucleotide; CTT chr11 5215162 5215183 5215167 5215162 -
ggattttggactagctttttct

SEQ ID NO: 145618 - DNA, 22 bp, Artificial Sequence
  Synthetic oligonucleotide; TTG chr11 5215161 5215182 5215166 5215161 -
gattttggactagctttttcta

SEQ ID NO: 145619 - DNA, 22 bp, Artificial Sequence
  Synthetic oligonucleotide; TTT chr11 5215156 5215177 5215161 5215156 -
tggactagctttttctatttct

SEQ ID NO: 145620 - DNA, 22 bp, Artificial Sequence
  Synthetic oligonucleotide; TTT chr11 5215155 5215176 5215160 5215155 -
ggactagctttttctatttctt

SEQ ID NO: 145621 - DNA, 22 bp, Artificial Sequence
  Synthetic oligonucleotide; TTG chr11 5215154 5215175 5215159 5215154 -
gactagctttttctatttcttg

SEQ ID NO: 145622 - DNA, 22 bp, Artificial Sequence
  Synthetic oligonucleotide; CTA chr11 5215149 5215170 5215154 5215149 -
gctttttctatttcttgggatt

SEQ ID NO: 145623 - DNA, 22 bp, Artificial Sequence
  Synthetic oligonucleotide; CTT chr11 5215145 5215166 5215150 5215145 -
tttctatttcttgggattctct

SEQ ID NO: 145624 - DNA, 22 bp, Artificial Sequence
  Synthetic oligonucleotide; TTT chr11 5215144 5215165 5215149 5215144 -
ttctatttcttgggattctcta

SEQ ID NO: 145625 - DNA, 22 bp, Artificial Sequence
  Synthetic oligonucleotide; TTT chr11 5215143 5215164 5215148 5215143 -
tctatttcttgggattctctag

SEQ ID NO: 145626 - DNA, 22 bp, Artificial Sequence
  Synthetic oligonucleotide; TTT chr11 5215142 5215163 5215147 5215142 -
ctatttcttgggattctctaga

SEQ ID NO: 145627 - DNA, 22 bp, Artificial Sequence
  Synthetic oligonucleotide; TTC chr11 5215141 5215162 5215146 5215141 -
tatttcttgggattctctagag

SEQ ID NO: 145628 - DNA, 22 bp, Artificial Sequence
  Synthetic oligonucleotide; CTA chr11 5215139 5215160 5215144 5215139 -
tttcttgggattctctagagcc

SEQ ID NO: 145629 - DNA, 22 bp, Artificial Sequence
  Synthetic oligonucleotide; TTT chr11 5215136 5215157 5215141 5215136 -
cttgggattctctagagccata

SEQ ID NO: 145630 - DNA, 22 bp, Artificial Sequence
  Synthetic oligonucleotide; TTC chr11 5215135 5215156 5215140 5215135 -
ttgggattctctagagccatat

SEQ ID NO: 145631 - DNA, 22 bp, Artificial Sequence
  Synthetic oligonucleotide; CTT chr11 5215133 5215154 5215138 5215133 -
gggattctctagagccatatat

SEQ ID NO: 145632 - DNA, 22 bp, Artificial Sequence
  Synthetic oligonucleotide; TTG chr11 5215132 5215153 5215137 5215132 -
ggattctctagagccatatatt

SEQ ID NO: 145633 - DNA, 22 bp, Artificial Sequence
  Synthetic oligonucleotide; TTC chr11 5215126 5215147 5215131 5215126 -
tctagagccatatattcagata

SEQ ID NO: 145634 - DNA, 22 bp, Artificial Sequence
  Synthetic oligonucleotide; CTC chr11 5215124 5215145 5215129 5215124 -
tagagccatatattcagatata

SEQ ID NO: 145635 - DNA, 22 bp, Artificial Sequence
  Synthetic oligonucleotide; CTA chr11 5215122 5215143 5215127 5215122 -
gagccatatattcagatataac

SEQ ID NO: 145636 - DNA, 22 bp, Artificial Sequence
  Synthetic oligonucleotide; TTC chr11 5215109 5215130 5215114 5215109 -
agatataacacagatataacca

SEQ ID NO: 145637 - DNA, 22 bp, Artificial Sequence
  Synthetic oligonucleotide; CTT chr11 5215054 5215075 5215059 5215054 -
tgtattctggggagggggacat

SEQ ID NO: 145638 - DNA, 22 bp, Artificial Sequence
  Synthetic oligonucleotide; TTT chr11 5215053 5215074 5215058 5215053 -
gtattctggggagggggacata

SEQ ID NO: 145639 - DNA, 22 bp, Artificial Sequence
  Synthetic oligonucleotide; TTG chr11 5215052 5215073 5215057 5215052 -
tattctggggagggggacatag

SEQ ID NO: 145640 - DNA, 22 bp, Artificial Sequence
  Synthetic oligonucleotide; TTC chr11 5215047 5215068 5215052 5215047 -
tggggagggggacatagagttg

SEQ ID NO: 145641 - DNA, 22 bp, Artificial Sequence
  Synthetic oligonucleotide; CTG chr11 5215045 5215066 5215050 5215045 -
gggagggggacatagagttgag

SEQ ID NO: 145642 - DNA, 22 bp, Artificial Sequence
  Synthetic oligonucleotide; TTG chr11 5215025 5215046 5215030 5215025 -
agagaaatacaggaatttatag

SEQ ID NO: 145643 - DNA, 22 bp, Artificial Sequence
  Synthetic oligonucleotide; TTT chr11 5215007 5215028 5215012 5215007 -
ataggactctactcaaagagcc

SEQ ID NO: 145644 - DNA, 22 bp, Artificial Sequence
  Synthetic oligonucleotide; TTA chr11 5215006 5215027 5215011 5215006 -
taggactctactcaaagagccc

SEQ ID NO: 145645 - DNA, 22 bp, Artificial Sequence
  Synthetic oligonucleotide; CTC chr11 5214998 5215019 5215003 5214998 -
tactcaaagagccctcaaataa

SEQ ID NO: 145646 - DNA, 22 bp, Artificial Sequence
  Synthetic oligonucleotide; CTA chr11 5214996 5215017 5215001 5214996 -
ctcaaagagccctcaaataaag

SEQ ID NO: 145647 - DNA, 22 bp, Artificial Sequence
  Synthetic oligonucleotide; CTC chr11 5214993 5215014 5214998 5214993 -
aaagagccctcaaataaagtac

SEQ ID NO: 145648 - DNA, 22 bp, Artificial Sequence
  Synthetic oligonucleotide; CTC chr11 5214982 5215003 5214987 5214982 -
aaataaagtacggctagtcttc

SEQ ID NO: 145649 - DNA, 22 bp, Artificial Sequence
  Synthetic oligonucleotide; CTA chr11 5214966 5214987 5214971 5214966 -
gtcttctttgcctaagacaatg

SEQ ID NO: 145650 - DNA, 22 bp, Artificial Sequence
  Synthetic oligonucleotide; CTT chr11 5214961 5214982 5214966 5214961 -
ctttgcctaagacaatgagcag

SEQ ID NO: 145651 - DNA, 22 bp, Artificial Sequence
  Synthetic oligonucleotide; TTC chr11 5214960 5214981 5214965 5214960 -
tttgcctaagacaatgagcagt

SEQ ID NO: 145652 - DNA, 22 bp, Artificial Sequence
  Synthetic oligonucleotide; CTT chr11 5214958 5214979 5214963 5214958 -
tgcctaagacaatgagcagtcc

SEQ ID NO: 145653 - DNA, 22 bp, Artificial Sequence
  Synthetic oligonucleotide; TTT chr11 5214957 5214978 5214962 5214957 -
gcctaagacaatgagcagtcca

SEQ ID NO: 145654 - DNA, 22 bp, Artificial Sequence
  Synthetic oligonucleotide; TTG chr11 5214956 5214977 5214961 5214956 -
cctaagacaatgagcagtccag

SEQ ID NO: 145655 - DNA, 22 bp, Artificial Sequence
  Synthetic oligonucleotide; CTA chr11 5214952 5214973 5214957 5214952 -
agacaatgagcagtccaggaag

SEQ ID NO: 145656 - DNA, 22 bp, Artificial Sequence
  Synthetic oligonucleotide; TTA chr11 5214927 5214948 5214932 5214927 -
tccatttcttttagattttcta

SEQ ID NO: 145657 - DNA, 22 bp, Artificial Sequence
  Synthetic oligonucleotide; TTT chr11 5214920 5214941 5214925 5214920 -
cttttagattttctagtttatg

SEQ ID NO: 145658 - DNA, 22 bp, Artificial Sequence
  Synthetic oligonucleotide; TTC chr11 5214919 5214940 5214924 5214919 -
ttttagattttctagtttatgt

SEQ ID NO: 145659 - DNA, 22 bp, Artificial Sequence
  Synthetic oligonucleotide; CTT chr11 5214917 5214938 5214922 5214917 -
ttagattttctagtttatgtac

SEQ ID NO: 145660 - DNA, 22 bp, Artificial Sequence
  Synthetic oligonucleotide; TTT chr11 5214916 5214937 5214921 5214916 -
tagattttctagtttatgtaca

SEQ ID NO: 145661 - DNA, 22 bp, Artificial Sequence
  Synthetic oligonucleotide; TTT chr11 5214915 5214936 5214920 5214915 -
agattttctagtttatgtacat

SEQ ID NO: 145662 - DNA, 22 bp, Artificial Sequence
  Synthetic oligonucleotide; TTA chr11 5214914 5214935 5214919 5214914 -
gattttctagtttatgtacata

SEQ ID NO: 145663 - DNA, 22 bp, Artificial Sequence
  Synthetic oligonucleotide; TTT chr11 5214909 5214930 5214914 5214909 -
tctagtttatgtacatagagat

SEQ ID NO: 145664 - DNA, 22 bp, Artificial Sequence
  Synthetic oligonucleotide; TTT chr11 5214908 5214929 5214913 5214908 -
ctagtttatgtacatagagatg

SEQ ID NO: 145665 - DNA, 22 bp, Artificial Sequence
  Synthetic oligonucleotide; TTC chr11 5214907 5214928 5214912 5214907 -
tagtttatgtacatagagatgt

SEQ ID NO: 145666 - DNA, 22 bp, Artificial Sequence
  Synthetic oligonucleotide; CTA chr11 5214905 5214926 5214910 5214905 -
gtttatgtacatagagatgttc

SEQ ID NO: 145667 - DNA, 22 bp, Artificial Sequence
  Synthetic oligonucleotide; TTT chr11 5214901 5214922 5214906 5214901 -
atgtacatagagatgttcatag

SEQ ID NO: 145668 - DNA, 22 bp, Artificial Sequence
  Synthetic oligonucleotide; TTA chr11 5214900 5214921 5214905 5214900 -
tgtacatagagatgttcatagt

SEQ ID NO: 145669 - DNA, 22 bp, Artificial Sequence
  Synthetic oligonucleotide; TTC chr11 5214883 5214904 5214888 5214883 -
atagtagtttttgatgattatt

SEQ ID NO: 145670 - DNA, 22 bp, Artificial Sequence
  Synthetic oligonucleotide; TTT chr11 5214873 5214894 5214878 5214873 -
ttgatgattatttgtatttctg

SEQ ID NO: 145671 - DNA, 22 bp, Artificial Sequence
  Synthetic oligonucleotide; TTT chr11 5214872 5214893 5214877 5214872 -
tgatgattatttgtatttctgt

SEQ ID NO: 145672 - DNA, 22 bp, Artificial Sequence
  Synthetic oligonucleotide; TTT chr11 5214871 5214892 5214876 5214871 -
gatgattatttgtatttctgtg

SEQ ID NO: 145673 - DNA, 22 bp, Artificial Sequence
  Synthetic oligonucleotide; TTG chr11 5214870 5214891 5214875 5214870 -
atgattatttgtatttctgtgg

SEQ ID NO: 145674 - DNA, 22 bp, Artificial Sequence
  Synthetic oligonucleotide; TTA chr11 5214863 5214884 5214868 5214863 -
tttgtatttctgtggggtgagt

SEQ ID NO: 145675 - DNA, 22 bp, Artificial Sequence
  Synthetic oligonucleotide; TTT chr11 5214860 5214881 5214865 5214860 -
gtatttctgtggggtgagtgat

SEQ ID NO: 145676 - DNA, 22 bp, Artificial Sequence
  Synthetic oligonucleotide; TTG chr11 5214859 5214880 5214864 5214859 -
tatttctgtggggtgagtgata

SEQ ID NO: 145677 - DNA, 22 bp, Artificial Sequence
  Synthetic oligonucleotide; TTT chr11 5214854 5214875 5214859 5214854 -
ctgtggggtgagtgataatatt

SEQ ID NO: 145678 - DNA, 22 bp, Artificial Sequence
  Synthetic oligonucleotide; TTC chr11 5214853 5214874 5214858 5214853 -
tgtggggtgagtgataatattc

SEQ ID NO: 145679 - DNA, 22 bp, Artificial Sequence
  Synthetic oligonucleotide; CTG chr11 5214851 5214872 5214856 5214851 -
tggggtgagtgataatattccc

SEQ ID NO: 145680 - DNA, 22 bp, Artificial Sequence
  Synthetic oligonucleotide; TTC chr11 5214831 5214852 5214836 5214831 -
cctttttcatttctaactgtgc

SEQ ID NO: 145681 - DNA, 22 bp, Artificial Sequence
  Synthetic oligonucleotide; CTT chr11 5214827 5214848 5214832 5214827 -
tttcatttctaactgtgcttat

SEQ ID NO: 145682 - DNA, 22 bp, Artificial Sequence
  Synthetic oligonucleotide; TTT chr11 5214826 5214847 5214831 5214826 -
ttcatttctaactgtgcttatt

SEQ ID NO: 145683 - DNA, 22 bp, Artificial Sequence
  Synthetic oligonucleotide; TTT chr11 5214825 5214846 5214830 5214825 -
tcatttctaactgtgcttattt

SEQ ID NO: 145684 - DNA, 22 bp, Artificial Sequence
  Synthetic oligonucleotide; TTT chr11 5214824 5214845 5214829 5214824 -
catttctaactgtgcttatttg

SEQ ID NO: 145685 - DNA, 22 bp, Artificial Sequence
  Synthetic oligonucleotide; TTC chr11 5214823 5214844 5214828 5214823 -
atttctaactgtgcttatttgg

SEQ ID NO: 145686 - DNA, 22 bp, Artificial Sequence
  Synthetic oligonucleotide; TTT chr11 5214819 5214840 5214824 5214819 -
ctaactgtgcttatttggatct

SEQ ID NO: 145687 - DNA, 22 bp, Artificial Sequence
  Synthetic oligonucleotide; TTC chr11 5214818 5214839 5214823 5214818 -
taactgtgcttatttggatctt

SEQ ID NO: 145688 - DNA, 22 bp, Artificial Sequence
  Synthetic oligonucleotide; CTA chr11 5214816 5214837 5214821 5214816 -
actgtgcttatttggatcttct

SEQ ID NO: 145689 - DNA, 22 bp, Artificial Sequence
  Synthetic oligonucleotide; CTG chr11 5214812 5214833 5214817 5214812 -
tgcttatttggatcttctctct

SEQ ID NO: 145690 - DNA, 22 bp, Artificial Sequence
  Synthetic oligonucleotide; CTT chr11 5214807 5214828 5214812 5214807 -
atttggatcttctctcttgtct

SEQ ID NO: 145691 - DNA, 22 bp, Artificial Sequence
  Synthetic oligonucleotide; TTA chr11 5214806 5214827 5214811 5214806 -
tttggatcttctctcttgtctt

SEQ ID NO: 145692 - DNA, 22 bp, Artificial Sequence
  Synthetic oligonucleotide; TTT chr11 5214803 5214824 5214808 5214803 -
ggatcttctctcttgtcttctt

SEQ ID NO: 145693 - DNA, 22 bp, Artificial Sequence
  Synthetic oligonucleotide; TTG chr11 5214802 5214823 5214807 5214802 -
gatcttctctcttgtcttcttt

SEQ ID NO: 145694 - DNA, 22 bp, Artificial Sequence
  Synthetic oligonucleotide; CTT chr11 5214796 5214817 5214801 5214796 -
ctctcttgtcttctttattagt

SEQ ID NO: 145695 - DNA, 22 bp, Artificial Sequence
  Synthetic oligonucleotide; TTC chr11 5214795 5214816 5214800 5214795 -
tctcttgtcttctttattagtc

SEQ ID NO: 145696 - DNA, 22 bp, Artificial Sequence
  Synthetic oligonucleotide; CTC chr11 5214793 5214814 5214798 5214793 -
tcttgtcttctttattagtcta

SEQ ID NO: 145697 - DNA, 22 bp, Artificial Sequence
  Synthetic oligonucleotide; CTC chr11 5214791 5214812 5214796 5214791 -
ttgtcttctttattagtctagc

SEQ ID NO: 145698 - DNA, 22 bp, Artificial Sequence
  Synthetic oligonucleotide; CTT chr11 5214789 5214810 5214794 5214789 -
gtcttctttattagtctagcta

SEQ ID NO: 145699 - DNA, 22 bp, Artificial Sequence
  Synthetic oligonucleotide; TTG chr11 5214788 5214809 5214793 5214788 -
tcttctttattagtctagctag

SEQ ID NO: 145700 - DNA, 22 bp, Artificial Sequence
  Synthetic oligonucleotide; CTT chr11 5214784 5214805 5214789 5214784 -
ctttattagtctagctagtgat

SEQ ID NO: 145701 - DNA, 22 bp, Artificial Sequence
  Synthetic oligonucleotide; TTC chr11 5214783 5214804 5214788 5214783 -
tttattagtctagctagtgatc

SEQ ID NO: 145702 - DNA, 22 bp, Artificial Sequence
  Synthetic oligonucleotide; CTT chr11 5214781 5214802 5214786 5214781 -
tattagtctagctagtgatcta

SEQ ID NO: 145703 - DNA, 22 bp, Artificial Sequence
  Synthetic oligonucleotide; TTT chr11 5214780 5214801 5214785 5214780 -
attagtctagctagtgatctac

SEQ ID NO: 145704 - DNA, 22 bp, Artificial Sequence
  Synthetic oligonucleotide; TTA chr11 5214779 5214800 5214784 5214779 -
ttagtctagctagtgatctacc

SEQ ID NO: 145705 - DNA, 22 bp, Artificial Sequence
  Synthetic oligonucleotide; TTA chr11 5214776 5214797 5214781 5214776 -
gtctagctagtgatctacctta

SEQ ID NO: 145706 - DNA, 22 bp, Artificial Sequence
  Synthetic oligonucleotide; CTA chr11 5214771 5214792 5214776 5214771 -
gctagtgatctaccttattaat

SEQ ID NO: 145707 - DNA, 22 bp, Artificial Sequence
  Synthetic oligonucleotide; CTA chr11 5214767 5214788 5214772 5214767 -
gtgatctaccttattaattttt

SEQ ID NO: 145708 - DNA, 22 bp, Artificial Sequence
  Synthetic oligonucleotide; CTA chr11 5214759 5214780 5214764 5214759 -
ccttattaattttttcacaaaa

SEQ ID NO: 145709 - DNA, 22 bp, Artificial Sequence
  Synthetic oligonucleotide; CTT chr11 5214755 5214776 5214760 5214755 -
attaattttttcacaaaaccag

SEQ ID NO: 145710 - DNA, 22 bp, Artificial Sequence
  Synthetic oligonucleotide; TTA chr11 5214754 5214775 5214759 5214754 -
ttaattttttcacaaaaccagc

SEQ ID NO: 145711 - DNA, 22 bp, Artificial Sequence
  Synthetic oligonucleotide; TTA chr11 5214751 5214772 5214756 5214751 -
attttttcacaaaaccagctct

SEQ ID NO: 145712 - DNA, 22 bp, Artificial Sequence
  Synthetic oligonucleotide; TTT chr11 5214747 5214768 5214752 5214747 -
tttcacaaaaccagctcttgga

SEQ ID NO: 145713 - DNA, 22 bp, Artificial Sequence
  Synthetic oligonucleotide; TTT chr11 5214746 5214767 5214751 5214746 -
ttcacaaaaccagctcttggac

SEQ ID NO: 145714 - DNA, 22 bp, Artificial Sequence
  Synthetic oligonucleotide; TTT chr11 5214745 5214766 5214750 5214745 -
tcacaaaaccagctcttggact

SEQ ID NO: 145715 - DNA, 22 bp, Artificial Sequence
  Synthetic oligonucleotide; TTT chr11 5214744 5214765 5214749 5214744 -
cacaaaaccagctcttggactc

SEQ ID NO: 145716 - DNA, 22 bp, Artificial Sequence
  Synthetic oligonucleotide; TTC chr11 5214743 5214764 5214748 5214743 -
acaaaaccagctcttggactca

SEQ ID NO: 145717 - DNA, 22 bp, Artificial Sequence
  Synthetic oligonucleotide; CTC chr11 5214730 5214751 5214735 5214730 -
ttggactcattaatcttttgaa

SEQ ID NO: 145718 - DNA, 22 bp, Artificial Sequence
  Synthetic oligonucleotide; CTT chr11 5214728 5214749 5214733 5214728 -
ggactcattaatcttttgaatg

SEQ ID NO: 145719 - DNA, 22 bp, Artificial Sequence
  Synthetic oligonucleotide; TTG chr11 5214727 5214748 5214732 5214727 -
gactcattaatcttttgaatgg

SEQ ID NO: 145720 - DNA, 22 bp, Artificial Sequence
  Synthetic oligonucleotide; CTC chr11 5214722 5214743 5214727 5214722 -
attaatcttttgaatggtattt

SEQ ID NO: 145721 - DNA, 22 bp, Artificial Sequence
  Synthetic oligonucleotide; TTA chr11 5214718 5214739 5214723 5214718 -
atcttttgaatggtattttgtg

SEQ ID NO: 145722 - DNA, 22 bp, Artificial Sequence
  Synthetic oligonucleotide; CTT chr11 5214713 5214734 5214718 5214713 -
ttgaatggtattttgtgtttta

SEQ ID NO: 145723 - DNA, 22 bp, Artificial Sequence
  Synthetic oligonucleotide; TTT chr11 5214712 5214733 5214717 5214712 -
tgaatggtattttgtgttttaa

SEQ ID NO: 145724 - DNA, 22 bp, Artificial Sequence
  Synthetic oligonucleotide; TTT chr11 5214711 5214732 5214716 5214711 -
gaatggtattttgtgttttaat

SEQ ID NO: 145725 - DNA, 22 bp, Artificial Sequence
  Synthetic oligonucleotide; TTG chr11 5214710 5214731 5214715 5214710 -
aatggtattttgtgttttaata

SEQ ID NO: 145726 - DNA, 22 bp, Artificial Sequence
  Synthetic oligonucleotide; TTT chr11 5214700 5214721 5214705 5214700 -
tgtgttttaatatccttcagtt

SEQ ID NO: 145727 - DNA, 22 bp, Artificial Sequence
  Synthetic oligonucleotide; TTT chr11 5214699 5214720 5214704 5214699 -
gtgttttaatatccttcagtta

SEQ ID NO: 145728 - DNA, 22 bp, Artificial Sequence
  Synthetic oligonucleotide; TTG chr11 5214698 5214719 5214703 5214698 -
tgttttaatatccttcagttag

SEQ ID NO: 145729 - DNA, 22 bp, Artificial Sequence
  Synthetic oligonucleotide; TTT chr11 5214693 5214714 5214698 5214693 -
taatatccttcagttagctttg

SEQ ID NO: 145730 - DNA, 22 bp, Artificial Sequence
  Synthetic oligonucleotide; TTT chr11 5214692 5214713 5214697 5214692 -
aatatccttcagttagctttga

SEQ ID NO: 145731 - DNA, 22 bp, Artificial Sequence
  Synthetic oligonucleotide; TTA chr11 5214691 5214712 5214696 5214691 -
atatccttcagttagctttgat

SEQ ID NO: 145732 - DNA, 22 bp, Artificial Sequence
  Synthetic oligonucleotide; CTT chr11 5214683 5214704 5214688 5214683 -
cagttagctttgatcttgttta

SEQ ID NO: 145733 - DNA, 22 bp, Artificial Sequence
  Synthetic oligonucleotide; TTC chr11 5214682 5214703 5214687 5214682 -
agttagctttgatcttgtttat

SEQ ID NO: 145734 - DNA, 22 bp, Artificial Sequence
  Synthetic oligonucleotide; TTA chr11 5214677 5214698 5214682 5214677 -
gctttgatcttgtttatttctt

SEQ ID NO: 145735 - DNA, 22 bp, Artificial Sequence
  Synthetic oligonucleotide; CTT chr11 5214673 5214694 5214678 5214673 -
tgatcttgtttatttcttgtct

SEQ ID NO: 145736 - DNA, 22 bp, Artificial Sequence
  Synthetic oligonucleotide; TTT chr11 5214672 5214693 5214677 5214672 -
gatcttgtttatttcttgtctt

SEQ ID NO: 145737 - DNA, 22 bp, Artificial Sequence
  Synthetic oligonucleotide; TTG chr11 5214671 5214692 5214676 5214671 -
atcttgtttatttcttgtcttc

SEQ ID NO: 145738 - DNA, 22 bp, Artificial Sequence
  Synthetic oligonucleotide; CTT chr11 5214666 5214687 5214671 5214666 -
gtttatttcttgtcttctgcta

SEQ ID NO: 145739 - DNA, 22 bp, Artificial Sequence
  Synthetic oligonucleotide; TTG chr11 5214665 5214686 5214670 5214665 -
tttatttcttgtcttctgctag

SEQ ID NO: 145740 - DNA, 22 bp, Artificial Sequence
  Synthetic oligonucleotide; TTT chr11 5214662 5214683 5214667 5214662 -
atttcttgtcttctgctagatt

SEQ ID NO: 145741 - DNA, 22 bp, Artificial Sequence
  Synthetic oligonucleotide; TTA chr11 5214661 5214682 5214666 5214661 -
tttcttgtcttctgctagattt

SEQ ID NO: 145742 - DNA, 22 bp, Artificial Sequence
  Synthetic oligonucleotide; TTT chr11 5214658 5214679 5214663 5214658 -
cttgtcttctgctagatttagg

SEQ ID NO: 145743 - DNA, 22 bp, Artificial Sequence
  Synthetic oligonucleotide; TTC chr11 5214657 5214678 5214662 5214657 -
ttgtcttctgctagatttaggg

SEQ ID NO: 145744 - DNA, 22 bp, Artificial Sequence
  Synthetic oligonucleotide; CTT chr11 5214655 5214676 5214660 5214655 -
gtcttctgctagatttagggtt

SEQ ID NO: 145745 - DNA, 22 bp, Artificial Sequence
  Synthetic oligonucleotide; TTG chr11 5214654 5214675 5214659 5214654 -
tcttctgctagatttagggttg

SEQ ID NO: 145746 - DNA, 22 bp, Artificial Sequence
  Synthetic oligonucleotide; CTT chr11 5214650 5214671 5214655 5214650 -
ctgctagatttagggttggttt

SEQ ID NO: 145747 - DNA, 22 bp, Artificial Sequence
  Synthetic oligonucleotide; TTC chr11 5214649 5214670 5214654 5214649 -
tgctagatttagggttggtttg

SEQ ID NO: 145748 - DNA, 22 bp, Artificial Sequence
  Synthetic oligonucleotide; CTG chr11 5214647 5214668 5214652 5214647 -
ctagatttagggttggtttgct

SEQ ID NO: 145749 - DNA, 22 bp, Artificial Sequence
  Synthetic oligonucleotide; CTA chr11 5214644 5214665 5214649 5214644 -
gatttagggttggtttgctctt

SEQ ID NO: 145750 - DNA, 22 bp, Artificial Sequence
  Synthetic oligonucleotide; TTT chr11 5214639 5214660 5214644 5214639 -
agggttggtttgctcttggttc

SEQ ID NO: 145751 - DNA, 22 bp, Artificial Sequence
  Synthetic oligonucleotide; TTA chr11 5214638 5214659 5214643 5214638 -
gggttggtttgctcttggttct

SEQ ID NO: 145752 - DNA, 22 bp, Artificial Sequence
  Synthetic oligonucleotide; TTG chr11 5214632 5214653 5214637 5214632 -
gtttgctcttggttctctggtt

SEQ ID NO: 145753 - DNA, 22 bp, Artificial Sequence
  Synthetic oligonucleotide; TTT chr11 5214628 5214649 5214633 5214628 -
gctcttggttctctggttcttt

SEQ ID NO: 145754 - DNA, 22 bp, Artificial Sequence
  Synthetic oligonucleotide; TTG chr11 5214627 5214648 5214632 5214627 -
ctcttggttctctggttctttt

SEQ ID NO: 145755 - DNA, 22 bp, Artificial Sequence
  Synthetic oligonucleotide; CTC chr11 5214624 5214645 5214629 5214624 -
ttggttctctggttcttttagt

SEQ ID NO: 145756 - DNA, 22 bp, Artificial Sequence
  Synthetic oligonucleotide; CTT chr11 5214622 5214643 5214627 5214622 -
ggttctctggttcttttagttg

SEQ ID NO: 145757 - DNA, 22 bp, Artificial Sequence
  Synthetic oligonucleotide; TTG chr11 5214621 5214642 5214626 5214621 -
gttctctggttcttttagttgt

SEQ ID NO: 145758 - DNA, 22 bp, Artificial Sequence
  Synthetic oligonucleotide; TTC chr11 5214617 5214638 5214622 5214617 -
tctggttcttttagttgtgaca

SEQ ID NO: 145759 - DNA, 22 bp, Artificial Sequence
  Synthetic oligonucleotide; CTC chr11 5214615 5214636 5214620 5214615 -
tggttcttttagttgtgacatt

SEQ ID NO: 145760 - DNA, 22 bp, Artificial Sequence
  Synthetic oligonucleotide; CTG chr11 5214613 5214634 5214618 5214613 -
gttcttttagttgtgacattag

SEQ ID NO: 145761 - DNA, 22 bp, Artificial Sequence
  Synthetic oligonucleotide; TTC chr11 5214609 5214630 5214614 5214609 -
ttttagttgtgacattaggttg

SEQ ID NO: 145762 - DNA, 22 bp, Artificial Sequence
  Synthetic oligonucleotide; CTT chr11 5214607 5214628 5214612 5214607 -
ttagttgtgacattaggttgtt

SEQ ID NO: 145763 - DNA, 22 bp, Artificial Sequence
  Synthetic oligonucleotide; TTT chr11 5214606 5214627 5214611 5214606 -
tagttgtgacattaggttgtta

SEQ ID NO: 145764 - DNA, 22 bp, Artificial Sequence
  Synthetic oligonucleotide; TTT chr11 5214605 5214626 5214610 5214605 -
agttgtgacattaggttgttaa

SEQ ID NO: 145765 - DNA, 22 bp, Artificial Sequence
  Synthetic oligonucleotide; TTA chr11 5214604 5214625 5214609 5214604 -
gttgtgacattaggttgttaat

SEQ ID NO: 145766 - DNA, 22 bp, Artificial Sequence
  Synthetic oligonucleotide; TTG chr11 5214600 5214621 5214605 5214600 -
tgacattaggttgttaatttga

SEQ ID NO: 145767 - DNA, 22 bp, Artificial Sequence
  Synthetic oligonucleotide; TTA chr11 5214592 5214613 5214597 5214592 -
ggttgttaatttgagggcttta

SEQ ID NO: 145768 - DNA, 22 bp, Artificial Sequence
  Synthetic oligonucleotide; TTG chr11 5214587 5214608 5214592 5214587 -
ttaatttgagggctttaagact

SEQ ID NO: 145769 - DNA, 22 bp, Artificial Sequence
  Synthetic oligonucleotide; TTA chr11 5214584 5214605 5214589 5214584 -
atttgagggctttaagactttt

SEQ ID NO: 145770 - DNA, 22 bp, Artificial Sequence
  Synthetic oligonucleotide; TTT chr11 5214580 5214601 5214585 5214580 -
gagggctttaagactttttgat

SEQ ID NO: 145771 - DNA, 22 bp, Artificial Sequence
  Synthetic oligonucleotide; TTG chr11 5214579 5214600 5214584 5214579 -
agggctttaagactttttgatg

SEQ ID NO: 145772 - DNA, 22 bp, Artificial Sequence
  Synthetic oligonucleotide; CTT chr11 5214572 5214593 5214577 5214572 -
taagactttttgatgtgggcat

SEQ ID NO: 145773 - DNA, 22 bp, Artificial Sequence
  Synthetic oligonucleotide; TTT chr11 5214571 5214592 5214576 5214571 -
aagactttttgatgtgggcatt

SEQ ID NO: 145774 - DNA, 22 bp, Artificial Sequence
  Synthetic oligonucleotide; TTA chr11 5214570 5214591 5214575 5214570 -
agactttttgatgtgggcattt

SEQ ID NO: 145775 - DNA, 22 bp, Artificial Sequence
  Synthetic oligonucleotide; CTT chr11 5214564 5214585 5214569 5214564 -
tttgatgtgggcatttagtgta

SEQ ID NO: 145776 - DNA, 22 bp, Artificial Sequence
  Synthetic oligonucleotide; TTT chr11 5214563 5214584 5214568 5214563 -
ttgatgtgggcatttagtgtat

SEQ ID NO: 145777 - DNA, 22 bp, Artificial Sequence
  Synthetic oligonucleotide; TTT chr11 5214562 5214583 5214567 5214562 -
tgatgtgggcatttagtgtata

SEQ ID NO: 145778 - DNA, 22 bp, Artificial Sequence
  Synthetic oligonucleotide; TTT chr11 5214561 5214582 5214566 5214561 -
gatgtgggcatttagtgtataa

SEQ ID NO: 145779 - DNA, 22 bp, Artificial Sequence
  Synthetic oligonucleotide; TTG chr11 5214560 5214581 5214565 5214560 -
atgtgggcatttagtgtataaa

SEQ ID NO: 145780 - DNA, 22 bp, Artificial Sequence
  Synthetic oligonucleotide; TTT chr11 5214548 5214569 5214553 5214548 -
agtgtataaatttctctcttaa

SEQ ID NO: 145781 - DNA, 22 bp, Artificial Sequence
  Synthetic oligonucleotide; TTA chr11 5214547 5214568 5214552 5214547 -
gtgtataaatttctctcttaac

SEQ ID NO: 145782 - DNA, 22 bp, Artificial Sequence
  Synthetic oligonucleotide; TTT chr11 5214535 5214556 5214540 5214535 -
ctctcttaacactgtctaagct

SEQ ID NO: 145783 - DNA, 22 bp, Artificial Sequence
  Synthetic oligonucleotide; TTC chr11 5214534 5214555 5214539 5214534 -
tctcttaacactgtctaagctg

SEQ ID NO: 145784 - DNA, 22 bp, Artificial Sequence
  Synthetic oligonucleotide; CTC chr11 5214532 5214553 5214537 5214532 -
tcttaacactgtctaagctgtg

SEQ ID NO: 145785 - DNA, 22 bp, Artificial Sequence
  Synthetic oligonucleotide; CTC chr11 5214530 5214551 5214535 5214530 -
ttaacactgtctaagctgtgtc

SEQ ID NO: 145786 - DNA, 22 bp, Artificial Sequence
  Synthetic oligonucleotide; CTT chr11 5214528 5214549 5214533 5214528 -
aacactgtctaagctgtgtccc

SEQ ID NO: 145787 - DNA, 22 bp, Artificial Sequence
  Synthetic oligonucleotide; TTA chr11 5214527 5214548 5214532 5214527 -
acactgtctaagctgtgtccca

SEQ ID NO: 145788 - DNA, 22 bp, Artificial Sequence
  Synthetic oligonucleotide; CTG chr11 5214521 5214542 5214526 5214521 -
tctaagctgtgtcccagagatt

SEQ ID NO: 145789 - DNA, 22 bp, Artificial Sequence
  Synthetic oligonucleotide; CTA chr11 5214517 5214538 5214522 5214517 -
agctgtgtcccagagattccgg

SEQ ID NO: 145790 - DNA, 22 bp, Artificial Sequence
  Synthetic oligonucleotide; CTG chr11 5214512 5214533 5214517 5214512 -
tgtcccagagattccggtatat

SEQ ID NO: 145791 - DNA, 22 bp, Artificial Sequence
  Synthetic oligonucleotide; TTC chr11 5214498 5214519 5214503 5214498 -
cggtatattgtatctttgttct

SEQ ID NO: 145792 - DNA, 22 bp, Artificial Sequence
  Synthetic oligonucleotide; TTG chr11 5214488 5214509 5214493 5214488 -
tatctttgttctcattagtttc

SEQ ID NO: 145793 - DNA, 22 bp, Artificial Sequence
  Synthetic oligonucleotide; CTT chr11 5214482 5214503 5214487 5214482 -
tgttctcattagtttcaaagaa

SEQ ID NO: 145794 - DNA, 22 bp, Artificial Sequence
  Synthetic oligonucleotide; TTT chr11 5214481 5214502 5214486 5214481 -
gttctcattagtttcaaagaac

SEQ ID NO: 145795 - DNA, 22 bp, Artificial Sequence
  Synthetic oligonucleotide; TTG chr11 5214480 5214501 5214485 5214480 -
ttctcattagtttcaaagaact

SEQ ID NO: 145796 - DNA, 22 bp, Artificial Sequence
  Synthetic oligonucleotide; TTC chr11 5214477 5214498 5214482 5214477 -
tcattagtttcaaagaactatt

SEQ ID NO: 145797 - DNA, 22 bp, Artificial Sequence
  Synthetic oligonucleotide; CTC chr11 5214475 5214496 5214480 5214475 -
attagtttcaaagaactatttt

SEQ ID NO: 145798 - DNA, 22 bp, Artificial Sequence
  Synthetic oligonucleotide; TTA chr11 5214471 5214492 5214476 5214471 -
gtttcaaagaactattttattt

SEQ ID NO: 145799 - DNA, 22 bp, Artificial Sequence
  Synthetic oligonucleotide; TTT chr11 5214467 5214488 5214472 5214467 -
caaagaactattttatttttgc

SEQ ID NO: 145800 - DNA, 22 bp, Artificial Sequence
  Synthetic oligonucleotide; TTC chr11 5214466 5214487 5214471 5214466 -
aaagaactattttatttttgcc

SEQ ID NO: 145801 - DNA, 22 bp, Artificial Sequence
  Synthetic oligonucleotide; CTA chr11 5214457 5214478 5214462 5214457 -
ttttatttttgccttagttttc

SEQ ID NO: 145802 - DNA, 22 bp, Artificial Sequence
  Synthetic oligonucleotide; TTT chr11 5214454 5214475 5214459 5214454 -
tatttttgccttagttttcatt

SEQ ID NO: 145803 - DNA, 22 bp, Artificial Sequence
  Synthetic oligonucleotide; TTT chr11 5214453 5214474 5214458 5214453 -
atttttgccttagttttcatta

SEQ ID NO: 145804 - DNA, 22 bp, Artificial Sequence
  Synthetic oligonucleotide; TTA chr11 5214452 5214473 5214457 5214452 -
tttttgccttagttttcattat

SEQ ID NO: 145805 - DNA, 22 bp, Artificial Sequence
  Synthetic oligonucleotide; TTT chr11 5214449 5214470 5214454 5214449 -
ttgccttagttttcattattta

SEQ ID NO: 145806 - DNA, 22 bp, Artificial Sequence
  Synthetic oligonucleotide; TTT chr11 5214448 5214469 5214453 5214448 -
tgccttagttttcattatttac

SEQ ID NO: 145807 - DNA, 22 bp, Artificial Sequence
  Synthetic oligonucleotide; TTT chr11 5214447 5214468 5214452 5214447 -
gccttagttttcattatttacc

SEQ ID NO: 145808 - DNA, 22 bp, Artificial Sequence
  Synthetic oligonucleotide; TTG chr11 5214446 5214467 5214451 5214446 -
ccttagttttcattatttaccc

SEQ ID NO: 145809 - DNA, 22 bp, Artificial Sequence
  Synthetic oligonucleotide; CTT chr11 5214442 5214463 5214447 5214442 -
agttttcattatttacccaaaa

SEQ ID NO: 145810 - DNA, 22 bp, Artificial Sequence
  Synthetic oligonucleotide; TTA chr11 5214441 5214462 5214446 5214441 -
gttttcattatttacccaaaat

SEQ ID NO: 145811 - DNA, 22 bp, Artificial Sequence
  Synthetic oligonucleotide; TTT chr11 5214437 5214458 5214442 5214437 -
tcattatttacccaaaattcat

SEQ ID NO: 145812 - DNA, 22 bp, Artificial Sequence
  Synthetic oligonucleotide; TTT chr11 5214436 5214457 5214441 5214436 -
cattatttacccaaaattcatt

SEQ ID NO: 145813 - DNA, 22 bp, Artificial Sequence
  Synthetic oligonucleotide; TTC chr11 5214435 5214456 5214440 5214435 -
attatttacccaaaattcattc

SEQ ID NO: 145814 - DNA, 22 bp, Artificial Sequence
  Synthetic oligonucleotide; TTA chr11 5214431 5214452 5214436 5214431 -
tttacccaaaattcattcagga

SEQ ID NO: 145815 - DNA, 22 bp, Artificial Sequence
  Synthetic oligonucleotide; TTT chr11 5214428 5214449 5214433 5214428 -
acccaaaattcattcaggagca

SEQ ID NO: 145816 - DNA, 22 bp, Artificial Sequence
  Synthetic oligonucleotide; TTA chr11 5214427 5214448 5214432 5214427 -
cccaaaattcattcaggagcag

SEQ ID NO: 145817 - DNA, 22 bp, Artificial Sequence
  Synthetic oligonucleotide; TTC chr11 5214417 5214438 5214422 5214417 -
attcaggagcaggttgtttaat

SEQ ID NO: 145818 - DNA, 22 bp, Artificial Sequence
  Synthetic oligonucleotide; TTC chr11 5214413 5214434 5214418 5214413 -
aggagcaggttgtttaatttcc

SEQ ID NO: 145819 - DNA, 22 bp, Artificial Sequence
  Synthetic oligonucleotide; TTG chr11 5214401 5214422 5214406 5214401 -
tttaatttccatgtaattgcat

SEQ ID NO: 145820 - DNA, 22 bp, Artificial Sequence
  Synthetic oligonucleotide; TTT chr11 5214398 5214419 5214403 5214398 -
aatttccatgtaattgcatagt

SEQ ID NO: 145821 - DNA, 22 bp, Artificial Sequence
  Synthetic oligonucleotide; TTA chr11 5214397 5214418 5214402 5214397 -
atttccatgtaattgcatagtt

SEQ ID NO: 145822 - DNA, 22 bp, Artificial Sequence
  Synthetic oligonucleotide; TTT chr11 5214393 5214414 5214398 5214393 -
ccatgtaattgcatagttttca

SEQ ID NO: 145823 - DNA, 22 bp, Artificial Sequence
  Synthetic oligonucleotide; TTC chr11 5214392 5214413 5214397 5214392 -
catgtaattgcatagttttcag

SEQ ID NO: 145824 - DNA, 22 bp, Artificial Sequence
  Synthetic oligonucleotide; TTG chr11 5214382 5214403 5214387 5214382 -
catagttttcagctattcatta

SEQ ID NO: 145825 - DNA, 22 bp, Artificial Sequence
  Synthetic oligonucleotide; TTT chr11 5214374 5214395 5214379 5214374 -
tcagctattcattagtcttgaa

SEQ ID NO: 145826 - DNA, 22 bp, Artificial Sequence
  Synthetic oligonucleotide; TTT chr11 5214373 5214394 5214378 5214373 -
cagctattcattagtcttgaaa

SEQ ID NO: 145827 - DNA, 22 bp, Artificial Sequence
  Synthetic oligonucleotide; TTC chr11 5214372 5214393 5214377 5214372 -
agctattcattagtcttgaaat

SEQ ID NO: 145828 - DNA, 22 bp, Artificial Sequence
  Synthetic oligonucleotide; CTA chr11 5214367 5214388 5214372 5214367 -
ttcattagtcttgaaatctatt

SEQ ID NO: 145829 - DNA, 22 bp, Artificial Sequence
  Synthetic oligonucleotide; TTC chr11 5214364 5214385 5214369 5214364 -
attagtcttgaaatctattttt

SEQ ID NO: 145830 - DNA, 22 bp, Artificial Sequence
  Synthetic oligonucleotide; TTA chr11 5214360 5214381 5214365 5214360 -
gtcttgaaatctatttttattc

SEQ ID NO: 145831 - DNA, 22 bp, Artificial Sequence
  Synthetic oligonucleotide; CTT chr11 5214355 5214376 5214360 5214355 -
gaaatctatttttattcctctg

SEQ ID NO: 145832 - DNA, 22 bp, Artificial Sequence
  Synthetic oligonucleotide; TTG chr11 5214354 5214375 5214359 5214354 -
aaatctatttttattcctctgt

SEQ ID NO: 145833 - DNA, 22 bp, Artificial Sequence
  Synthetic oligonucleotide; CTA chr11 5214347 5214368 5214352 5214347 -
tttttattcctctgtggtctga

SEQ ID NO: 145834 - DNA, 22 bp, Artificial Sequence
  Synthetic oligonucleotide; TTT chr11 5214344 5214365 5214349 5214344 -
ttattcctctgtggtctgagag

SEQ ID NO: 145835 - DNA, 22 bp, Artificial Sequence
  Synthetic oligonucleotide; TTT chr11 5214343 5214364 5214348 5214343 -
tattcctctgtggtctgagagt

SEQ ID NO: 145836 - DNA, 22 bp, Artificial Sequence
  Synthetic oligonucleotide; TTT chr11 5214342 5214363 5214347 5214342 -
attcctctgtggtctgagagtg

SEQ ID NO: 145837 - DNA, 22 bp, Artificial Sequence
  Synthetic oligonucleotide; TTA chr11 5214341 5214362 5214346 5214341 -
ttcctctgtggtctgagagtga

SEQ ID NO: 145838 - DNA, 22 bp, Artificial Sequence
  Synthetic oligonucleotide; TTC chr11 5214338 5214359 5214343 5214338 -
ctctgtggtctgagagtgattg

SEQ ID NO: 145839 - DNA, 22 bp, Artificial Sequence
  Synthetic oligonucleotide; CTC chr11 5214335 5214356 5214340 5214335 -
tgtggtctgagagtgattgata

SEQ ID NO: 145840 - DNA, 22 bp, Artificial Sequence
  Synthetic oligonucleotide; CTG chr11 5214333 5214354 5214338 5214333 -
tggtctgagagtgattgatatg

SEQ ID NO: 145841 - DNA, 22 bp, Artificial Sequence
  Synthetic oligonucleotide; CTG chr11 5214326 5214347 5214331 5214326 -
agagtgattgatatgatttttt

SEQ ID NO: 145842 - DNA, 22 bp, Artificial Sequence
  Synthetic oligonucleotide; TTG chr11 5214316 5214337 5214321 5214316 -
atatgattttttttttgcattt

SEQ ID NO: 145843 - DNA, 22 bp, Artificial Sequence
  Synthetic oligonucleotide; TTT chr11 5214307 5214328 5214312 5214307 -
tttttttgcatttgctgaggat

SEQ ID NO: 145844 - DNA, 22 bp, Artificial Sequence
  Synthetic oligonucleotide; TTT chr11 5214306 5214327 5214311 5214306 -
ttttttgcatttgctgaggatt

SEQ ID NO: 145845 - DNA, 22 bp, Artificial Sequence
  Synthetic oligonucleotide; TTT chr11 5214305 5214326 5214310 5214305 -
tttttgcatttgctgaggattg

SEQ ID NO: 145846 - DNA, 22 bp, Artificial Sequence
  Synthetic oligonucleotide; TTT chr11 5214304 5214325 5214309 5214304 -
ttttgcatttgctgaggattgt

SEQ ID NO: 145847 - DNA, 22 bp, Artificial Sequence
  Synthetic oligonucleotide; TTT chr11 5214303 5214324 5214308 5214303 -
tttgcatttgctgaggattgtt

SEQ ID NO: 145848 - DNA, 22 bp, Artificial Sequence
  Synthetic oligonucleotide; TTT chr11 5214302 5214323 5214307 5214302 -
ttgcatttgctgaggattgttt

SEQ ID NO: 145849 - DNA, 22 bp, Artificial Sequence
  Synthetic oligonucleotide; TTT chr11 5214301 5214322 5214306 5214301 -
tgcatttgctgaggattgtttt

SEQ ID NO: 145850 - DNA, 22 bp, Artificial Sequence
  Synthetic oligonucleotide; TTT chr11 5214300 5214321 5214305 5214300 -
gcatttgctgaggattgtttta

SEQ ID NO: 145851 - DNA, 22 bp, Artificial Sequence
  Synthetic oligonucleotide; TTG chr11 5214299 5214320 5214304 5214299 -
catttgctgaggattgttttag

SEQ ID NO: 145852 - DNA, 22 bp, Artificial Sequence
  Synthetic oligonucleotide; TTT chr11 5214294 5214315 5214299 5214294 -
gctgaggattgttttaggtcct

SEQ ID NO: 145853 - DNA, 22 bp, Artificial Sequence
  Synthetic oligonucleotide; TTG chr11 5214293 5214314 5214298 5214293 -
ctgaggattgttttaggtcctc

SEQ ID NO: 145854 - DNA, 22 bp, Artificial Sequence
  Synthetic oligonucleotide; CTG chr11 5214290 5214311 5214295 5214290 -
aggattgttttaggtcctccca

SEQ ID NO: 145855 - DNA, 22 bp, Artificial Sequence
  Synthetic oligonucleotide; TTG chr11 5214283 5214304 5214288 5214283 -
ttttaggtcctcccaaggctga

SEQ ID NO: 145856 - DNA, 22 bp, Artificial Sequence
  Synthetic oligonucleotide; TTT chr11 5214280 5214301 5214285 5214280 -
taggtcctcccaaggctgaacc

SEQ ID NO: 145857 - DNA, 22 bp, Artificial Sequence
  Synthetic oligonucleotide; TTT chr11 5214279 5214300 5214284 5214279 -
aggtcctcccaaggctgaacca

SEQ ID NO: 145858 - DNA, 22 bp, Artificial Sequence
  Synthetic oligonucleotide; TTA chr11 5214278 5214299 5214283 5214278 -
ggtcctcccaaggctgaaccag

SEQ ID NO: 145859 - DNA, 22 bp, Artificial Sequence
  Synthetic oligonucleotide; CTC chr11 5214271 5214292 5214276 5214271 -
ccaaggctgaaccaggaagaaa

SEQ ID NO: 145860 - DNA, 22 bp, Artificial Sequence
  Synthetic oligonucleotide; CTG chr11 5214262 5214283 5214267 5214262 -
aaccaggaagaaatcaatttcc

SEQ ID NO: 145861 - DNA, 22 bp, Artificial Sequence
  Synthetic oligonucleotide; TTT chr11 5214242 5214263 5214247 5214242 -
cctgaagagatccatgatgagc

SEQ ID NO: 145862 - DNA, 22 bp, Artificial Sequence
  Synthetic oligonucleotide; TTC chr11 5214241 5214262 5214246 5214241 -
ctgaagagatccatgatgagct

SEQ ID NO: 145863 - DNA, 22 bp, Artificial Sequence
  Synthetic oligonucleotide; CTG chr11 5214238 5214259 5214243 5214238 -
aagagatccatgatgagctctg

SEQ ID NO: 145864 - DNA, 22 bp, Artificial Sequence
  Synthetic oligonucleotide; CTC chr11 5214218 5214239 5214223 5214218 -
tgaaaatgattcagtaataaat

SEQ ID NO: 145865 - DNA, 22 bp, Artificial Sequence
  Synthetic oligonucleotide; CTG chr11 5214216 5214237 5214221 5214216 -
aaaatgattcagtaataaatag

SEQ ID NO: 145866 - DNA, 22 bp, Artificial Sequence
  Synthetic oligonucleotide; TTC chr11 5214206 5214227 5214211 5214206 -
agtaataaatagcctatcaaac

SEQ ID NO: 145867 - DNA, 22 bp, Artificial Sequence
  Synthetic oligonucleotide; CTA chr11 5214190 5214211 5214195 5214190 -
tcaaacaaaaaaagccctggac

SEQ ID NO: 145868 - DNA, 22 bp, Artificial Sequence
  Synthetic oligonucleotide; CTG chr11 5214171 5214192 5214176 5214171 -
gacaatatgattcacaaccaaa

SEQ ID NO: 145869 - DNA, 22 bp, Artificial Sequence
  Synthetic oligonucleotide; TTC chr11 5214158 5214179 5214163 5214158 -
acaaccaaattctatcagatgc

SEQ ID NO: 145870 - DNA, 22 bp, Artificial Sequence
  Synthetic oligonucleotide; TTC chr11 5214146 5214167 5214151 5214146 -
tatcagatgcacaaagaagagt

SEQ ID NO: 145871 - DNA, 22 bp, Artificial Sequence
  Synthetic oligonucleotide; CTA chr11 5214144 5214165 5214149 5214144 -
tcagatgcacaaagaagagttg

SEQ ID NO: 145872 - DNA, 22 bp, Artificial Sequence
  Synthetic oligonucleotide; TTG chr11 5214122 5214143 5214127 5214122 -
gaaaaattcctactgaagctac

SEQ ID NO: 145873 - DNA, 22 bp, Artificial Sequence
  Synthetic oligonucleotide; TTC chr11 5214113 5214134 5214118 5214113 -
ctactgaagctactccaaaaaa

SEQ ID NO: 145874 - DNA, 22 bp, Artificial Sequence
  Synthetic oligonucleotide; CTA chr11 5214110 5214131 5214115 5214110 -
ctgaagctactccaaaaaattg

SEQ ID NO: 145875 - DNA, 22 bp, Artificial Sequence
  Synthetic oligonucleotide; CTG chr11 5214107 5214128 5214112 5214107 -
aagctactccaaaaaattgagg

SEQ ID NO: 145876 - DNA, 22 bp, Artificial Sequence
  Synthetic oligonucleotide; CTA chr11 5214101 5214122 5214106 5214101 -
ctccaaaaaattgagggggagg

SEQ ID NO: 145877 - DNA, 22 bp, Artificial Sequence
  Synthetic oligonucleotide; CTC chr11 5214098 5214119 5214103 5214098 -
caaaaaattgagggggagggat

SEQ ID NO: 145878 - DNA, 22 bp, Artificial Sequence
  Synthetic oligonucleotide; TTG chr11 5214088 5214109 5214093 5214088 -
agggggagggattcaacctcag

SEQ ID NO: 145879 - DNA, 22 bp, Artificial Sequence
  Synthetic oligonucleotide; TTC chr11 5214074 5214095 5214079 5214074 -
aacctcagctcattttatgagg

SEQ ID NO: 145880 - DNA, 22 bp, Artificial Sequence
  Synthetic oligonucleotide; CTC chr11 5214068 5214089 5214073 5214068 -
agctcattttatgaggccagca

SEQ ID NO: 145881 - DNA, 22 bp, Artificial Sequence
  Synthetic oligonucleotide; CTC chr11 5214063 5214084 5214068 5214063 -
attttatgaggccagcatcatc

SEQ ID NO: 145882 - DNA, 22 bp, Artificial Sequence
  Synthetic oligonucleotide; TTT chr11 5214059 5214080 5214064 5214059 -
tatgaggccagcatcatcctga

SEQ ID NO: 145883 - DNA, 22 bp, Artificial Sequence
  Synthetic oligonucleotide; TTT chr11 5214058 5214079 5214063 5214058 -
atgaggccagcatcatcctgat

SEQ ID NO: 145884 - DNA, 22 bp, Artificial Sequence
  Synthetic oligonucleotide; TTA chr11 5214057 5214078 5214062 5214057 -
tgaggccagcatcatcctgata

SEQ ID NO: 145885 - DNA, 22 bp, Artificial Sequence
  Synthetic oligonucleotide; CTG chr11 5214038 5214059 5214043 5214038 -
ataccaaaacctgatagacaca

SEQ ID NO: 145886 - DNA, 22 bp, Artificial Sequence
  Synthetic oligonucleotide; CTG chr11 5214025 5214046 5214030 5214025 -
atagacacacaacaacaaaaaa

SEQ ID NO: 145887 - DNA, 22 bp, Artificial Sequence
  Synthetic oligonucleotide; CTT chr11 5213994 5214015 5213999 5213994 -
caggccaatatccttgaacatt

SEQ ID NO: 145888 - DNA, 22 bp, Artificial Sequence
  Synthetic oligonucleotide; TTC chr11 5213993 5214014 5213998 5213993 -
aggccaatatccttgaacattg

SEQ ID NO: 145889 - DNA, 22 bp, Artificial Sequence
  Synthetic oligonucleotide; CTT chr11 5213979 5214000 5213984 5213979 -
gaacattgatgcaaaaatacta

SEQ ID NO: 145890 - DNA, 22 bp, Artificial Sequence
  Synthetic oligonucleotide; TTG chr11 5213978 5213999 5213983 5213978 -
aacattgatgcaaaaatactag

SEQ ID NO: 145891 - DNA, 22 bp, Artificial Sequence
  Synthetic oligonucleotide; TTG chr11 5213971 5213992 5213976 5213971 -
atgcaaaaatactagcaagcca

SEQ ID NO: 145892 - DNA, 22 bp, Artificial Sequence
  Synthetic oligonucleotide; CTA chr11 5213957 5213978 5213962 5213957 -
gcaagccaaatccagcaacaca

SEQ ID NO: 145893 - DNA, 22 bp, Artificial Sequence
  Synthetic oligonucleotide; CTA chr11 5213924 5213945 5213929 5213924 -
atccacctcaatcaagtaggct

SEQ ID NO: 145894 - DNA, 22 bp, Artificial Sequence
  Synthetic oligonucleotide; CTC chr11 5213915 5213936 5213920 5213915 -
aatcaagtaggctttatccctg

SEQ ID NO: 145895 - DNA, 22 bp, Artificial Sequence
  Synthetic oligonucleotide; CTT chr11 5213901 5213922 5213906 5213901 -
tatccctgagaagcaagattgg

SEQ ID NO: 145896 - DNA, 22 bp, Artificial Sequence
  Synthetic oligonucleotide; TTT chr11 5213900 5213921 5213905 5213900 -
atccctgagaagcaagattggt

SEQ ID NO: 145897 - DNA, 22 bp, Artificial Sequence
  Synthetic oligonucleotide; TTA chr11 5213899 5213920 5213904 5213899 -
tccctgagaagcaagattggtt

SEQ ID NO: 145898 - DNA, 22 bp, Artificial Sequence
  Synthetic oligonucleotide; CTG chr11 5213893 5213914 5213898 5213893 -
agaagcaagattggttcagcat

SEQ ID NO: 145899 - DNA, 22 bp, Artificial Sequence
  Synthetic oligonucleotide; TTG chr11 5213880 5213901 5213885 5213880 -
gttcagcatatacaaattgata

SEQ ID NO: 145900 - DNA, 22 bp, Artificial Sequence
  Synthetic oligonucleotide; TTC chr11 5213876 5213897 5213881 5213876 -
agcatatacaaattgataaatg

SEQ ID NO: 145901 - DNA, 22 bp, Artificial Sequence
  Synthetic oligonucleotide; TTG chr11 5213861 5213882 5213866 5213861 -
ataaatgtgattcatcatatat

SEQ ID NO: 145902 - DNA, 22 bp, Artificial Sequence
  Synthetic oligonucleotide; TTC chr11 5213848 5213869 5213853 5213848 -
atcatatatacagcactaaaaa

SEQ ID NO: 145903 - DNA, 22 bp, Artificial Sequence
  Synthetic oligonucleotide; CTA chr11 5213830 5213851 5213835 5213830 -
aaaacagaaaccacatgatcat

SEQ ID NO: 145904 - DNA, 22 bp, Artificial Sequence
  Synthetic oligonucleotide; TTT chr11 5213806 5213827 5213811 5213806 -
caatatgtgcaaaaaaagattt

SEQ ID NO: 145905 - DNA, 22 bp, Artificial Sequence
  Synthetic oligonucleotide; TTC chr11 5213805 5213826 5213810 5213805 -
aatatgtgcaaaaaaagatttt

SEQ ID NO: 145906 - DNA, 22 bp, Artificial Sequence
  Synthetic oligonucleotide; TTT chr11 5213784 5213805 5213789 5213784 -
tgataaaattcaacttcacttc

SEQ ID NO: 145907 - DNA, 22 bp, Artificial Sequence
  Synthetic oligonucleotide; TTT chr11 5213783 5213804 5213788 5213783 -
gataaaattcaacttcacttca

SEQ ID NO: 145908 - DNA, 22 bp, Artificial Sequence
  Synthetic oligonucleotide; TTG chr11 5213782 5213803 5213787 5213782 -
ataaaattcaacttcacttcat

SEQ ID NO: 145909 - DNA, 22 bp, Artificial Sequence
  Synthetic oligonucleotide; TTC chr11 5213773 5213794 5213778 5213773 -
aacttcacttcatgttaaaacc

SEQ ID NO: 145910 - DNA, 22 bp, Artificial Sequence
  Synthetic oligonucleotide; CTT chr11 5213768 5213789 5213773 5213768 -
cacttcatgttaaaacctctca

SEQ ID NO: 145911 - DNA, 22 bp, Artificial Sequence
  Synthetic oligonucleotide; TTC chr11 5213767 5213788 5213772 5213767 -
acttcatgttaaaacctctcaa

SEQ ID NO: 145912 - DNA, 22 bp, Artificial Sequence
  Synthetic oligonucleotide; CTT chr11 5213763 5213784 5213768 5213763 -
catgttaaaacctctcaacaaa

SEQ ID NO: 145913 - DNA, 22 bp, Artificial Sequence
  Synthetic oligonucleotide; TTC chr11 5213762 5213783 5213767 5213762 -
atgttaaaacctctcaacaaac

SEQ ID NO: 145914 - DNA, 22 bp, Artificial Sequence
  Synthetic oligonucleotide; TTA chr11 5213756 5213777 5213761 5213756 -
aaacctctcaacaaactagcta

SEQ ID NO: 145915 - DNA, 22 bp, Artificial Sequence
  Synthetic oligonucleotide; CTC chr11 5213749 5213770 5213754 5213749 -
tcaacaaactagctatttaagg

SEQ ID NO: 145916 - DNA, 22 bp, Artificial Sequence
  Synthetic oligonucleotide; CTC chr11 5213747 5213768 5213752 5213747 -
aacaaactagctatttaaggac

SEQ ID NO: 145917 - DNA, 22 bp, Artificial Sequence
  Synthetic oligonucleotide; CTA chr11 5213738 5213759 5213743 5213738 -
gctatttaaggacatgacctca

SEQ ID NO: 145918 - DNA, 22 bp, Artificial Sequence
  Synthetic oligonucleotide; CTA chr11 5213734 5213755 5213739 5213734 -
tttaaggacatgacctcaaaat

SEQ ID NO: 145919 - DNA, 22 bp, Artificial Sequence
  Synthetic oligonucleotide; TTT chr11 5213731 5213752 5213736 5213731 -
aaggacatgacctcaaaataat

SEQ ID NO: 145920 - DNA, 22 bp, Artificial Sequence
  Synthetic oligonucleotide; TTA chr11 5213730 5213751 5213735 5213730 -
aggacatgacctcaaaataata

SEQ ID NO: 145921 - DNA, 22 bp, Artificial Sequence
  Synthetic oligonucleotide; CTC chr11 5213717 5213738 5213722 5213717 -
aaaataatatgagccatctatg

SEQ ID NO: 145922 - DNA, 22 bp, Artificial Sequence
  Synthetic oligonucleotide; CTA chr11 5213697 5213718 5213702 5213697 -
tgacaaacccacagccaacatc

SEQ ID NO: 145923 - DNA, 22 bp, Artificial Sequence
  Synthetic oligonucleotide; CTG chr11 5213654 5213675 5213659 5213654 -
gaagcattcttcttgaaaactg

SEQ ID NO: 145924 - DNA, 22 bp, Artificial Sequence
  Synthetic oligonucleotide; TTC chr11 5213645 5213666 5213650 5213645 -
ttcttgaaaactggcacaagac

SEQ ID NO: 145925 - DNA, 22 bp, Artificial Sequence
  Synthetic oligonucleotide; CTT chr11 5213643 5213664 5213648 5213643 -
cttgaaaactggcacaagacaa

SEQ ID NO: 145926 - DNA, 22 bp, Artificial Sequence
  Synthetic oligonucleotide; TTC chr11 5213642 5213663 5213647 5213642 -
ttgaaaactggcacaagacaag

SEQ ID NO: 145927 - DNA, 22 bp, Artificial Sequence
  Synthetic oligonucleotide; CTT chr11 5213640 5213661 5213645 5213640 -
gaaaactggcacaagacaagga

SEQ ID NO: 145928 - DNA, 22 bp, Artificial Sequence
  Synthetic oligonucleotide; TTG chr11 5213639 5213660 5213644 5213639 -
aaaactggcacaagacaaggat

SEQ ID NO: 145929 - DNA, 22 bp, Artificial Sequence
  Synthetic oligonucleotide; CTG chr11 5213632 5213653 5213637 5213632 -
gcacaagacaaggatgccctct

SEQ ID NO: 145930 - DNA, 22 bp, Artificial Sequence
  Synthetic oligonucleotide; CTC chr11 5213611 5213632 5213616 5213611 -
tctcaccactgctattcagtat

SEQ ID NO: 145931 - DNA, 22 bp, Artificial Sequence
  Synthetic oligonucleotide; CTC chr11 5213609 5213630 5213614 5213609 -
tcaccactgctattcagtatag

SEQ ID NO: 145932 - DNA, 22 bp, Artificial Sequence
  Synthetic oligonucleotide; CTC chr11 5213607 5213628 5213612 5213607 -
accactgctattcagtatagta

SEQ ID NO: 145933 - DNA, 22 bp, Artificial Sequence
  Synthetic oligonucleotide; CTG chr11 5213600 5213621 5213605 5213600 -
ctattcagtatagtactggcag

SEQ ID NO: 145934 - DNA, 22 bp, Artificial Sequence
  Synthetic oligonucleotide; CTA chr11 5213597 5213618 5213602 5213597 -
ttcagtatagtactggcagtcc

SEQ ID NO: 145935 - DNA, 22 bp, Artificial Sequence
  Synthetic oligonucleotide; TTC chr11 5213594 5213615 5213599 5213594 -
agtatagtactggcagtcctgg

SEQ ID NO: 145936 - DNA, 22 bp, Artificial Sequence
  Synthetic oligonucleotide; CTG chr11 5213582 5213603 5213587 5213582 -
gcagtcctggccagagcaatca

SEQ ID NO: 145937 - DNA, 22 bp, Artificial Sequence
  Synthetic oligonucleotide; CTG chr11 5213573 5213594 5213578 5213573 -
gccagagcaatcaggcaagaga

SEQ ID NO: 145938 - DNA, 22 bp, Artificial Sequence
  Synthetic oligonucleotide; CTG chr11 5213501 5213522 5213506 5213501 -
ttttctgtatctagaaaacacc

SEQ ID NO: 145939 - DNA, 22 bp, Artificial Sequence
  Synthetic oligonucleotide; TTT chr11 5213498 5213519 5213503 5213498 -
tctgtatctagaaaacaccata

SEQ ID NO: 145940 - DNA, 22 bp, Artificial Sequence
  Synthetic oligonucleotide; TTT chr11 5213497 5213518 5213502 5213497 -
ctgtatctagaaaacaccatag

SEQ ID NO: 145941 - DNA, 22 bp, Artificial Sequence
  Synthetic oligonucleotide; TTC chr11 5213496 5213517 5213501 5213496 -
tgtatctagaaaacaccatagt

SEQ ID NO: 145942 - DNA, 22 bp, Artificial Sequence
  Synthetic oligonucleotide; CTG chr11 5213494 5213515 5213499 5213494 -
tatctagaaaacaccatagtca

SEQ ID NO: 145943 - DNA, 22 bp, Artificial Sequence
  Synthetic oligonucleotide; CTA chr11 5213488 5213509 5213493 5213488 -
gaaaacaccatagtcaaggccc

SEQ ID NO: 145944 - DNA, 22 bp, Artificial Sequence
  Synthetic oligonucleotide; CTC chr11 5213458 5213479 5213463 5213458 -
cttcagctgataacttcagcaa

SEQ ID NO: 145945 - DNA, 22 bp, Artificial Sequence
  Synthetic oligonucleotide; CTT chr11 5213455 5213476 5213460 5213455 -
cagctgataacttcagcaaagt

SEQ ID NO: 145946 - DNA, 22 bp, Artificial Sequence
  Synthetic oligonucleotide; TTC chr11 5213454 5213475 5213459 5213454 -
agctgataacttcagcaaagtt

SEQ ID NO: 145947 - DNA, 22 bp, Artificial Sequence
  Synthetic oligonucleotide; CTG chr11 5213449 5213470 5213454 5213449 -
ataacttcagcaaagtttcagg

SEQ ID NO: 145948 - DNA, 22 bp, Artificial Sequence
  Synthetic oligonucleotide; CTT chr11 5213442 5213463 5213447 5213442 -
cagcaaagtttcaggatataaa

SEQ ID NO: 145949 - DNA, 22 bp, Artificial Sequence
  Synthetic oligonucleotide; TTC chr11 5213441 5213462 5213446 5213441 -
agcaaagtttcaggatataaaa

SEQ ID NO: 145950 - DNA, 22 bp, Artificial Sequence
  Synthetic oligonucleotide; TTT chr11 5213431 5213452 5213436 5213431 -
caggatataaaatcaatgtaca

SEQ ID NO: 145951 - DNA, 22 bp, Artificial Sequence
  Synthetic oligonucleotide; TTC chr11 5213430 5213451 5213435 5213430 -
aggatataaaatcaatgtacaa

SEQ ID NO: 145952 - DNA, 22 bp, Artificial Sequence
  Synthetic oligonucleotide; CTA chr11 5213399 5213420 5213404 5213399 -
gcattcccatacatcaacaata

SEQ ID NO: 145953 - DNA, 22 bp, Artificial Sequence
  Synthetic oligonucleotide; TTC chr11 5213393 5213414 5213398 5213393 -
ccatacatcaacaatagccaag

SEQ ID NO: 145954 - DNA, 22 bp, Artificial Sequence
  Synthetic oligonucleotide; CTA chr11 5213367 5213388 5213372 5213367 -
gagccaaatcaggaagtcaatc

SEQ ID NO: 145955 - DNA, 22 bp, Artificial Sequence
  Synthetic oligonucleotide; TTT chr11 5213339 5213360 5213344 5213339 -
accgttgccacaaaaagaataa

SEQ ID NO: 145956 - DNA, 22 bp, Artificial Sequence
  Synthetic oligonucleotide; TTA chr11 5213338 5213359 5213343 5213338 -
ccgttgccacaaaaagaataaa

SEQ ID NO: 145957 - DNA, 22 bp, Artificial Sequence
  Synthetic oligonucleotide; TTG chr11 5213332 5213353 5213337 5213332 -
ccacaaaaagaataaaatacct

SEQ ID NO: 145958 - DNA, 22 bp, Artificial Sequence
  Synthetic oligonucleotide; CTA chr11 5213309 5213330 5213314 5213309 -
aggatatatctaaccaagcagt

SEQ ID NO: 145959 - DNA, 22 bp, Artificial Sequence
  Synthetic oligonucleotide; CTA chr11 5213297 5213318 5213302 5213297 -
accaagcagttgaaagatctct

SEQ ID NO: 145960 - DNA, 22 bp, Artificial Sequence
  Synthetic oligonucleotide; TTG chr11 5213285 5213306 5213290 5213285 -
aaagatctctacaatgagattt

SEQ ID NO: 145961 - DNA, 22 bp, Artificial Sequence
  Synthetic oligonucleotide; CTC chr11 5213276 5213297 5213281 5213276 -
tacaatgagatttacaaaacac

SEQ ID NO: 145962 - DNA, 22 bp, Artificial Sequence
  Synthetic oligonucleotide; CTA chr11 5213274 5213295 5213279 5213274 -
caatgagatttacaaaacactg

SEQ ID NO: 145963 - DNA, 22 bp, Artificial Sequence
  Synthetic oligonucleotide; TTT chr11 5213263 5213284 5213268 5213263 -
acaaaacactgctcaaagaaat

SEQ ID NO: 145964 - DNA, 22 bp, Artificial Sequence
  Synthetic oligonucleotide; TTA chr11 5213262 5213283 5213267 5213262 -
caaaacactgctcaaagaaatc

SEQ ID NO: 145965 - DNA, 22 bp, Artificial Sequence
  Synthetic oligonucleotide; CTG chr11 5213252 5213273 5213257 5213252 -
ctcaaagaaatcagagctgata

SEQ ID NO: 145966 - DNA, 22 bp, Artificial Sequence
  Synthetic oligonucleotide; CTC chr11 5213249 5213270 5213254 5213249 -
aaagaaatcagagctgatagaa

SEQ ID NO: 145967 - DNA, 22 bp, Artificial Sequence
  Synthetic oligonucleotide; CTG chr11 5213233 5213254 5213238 5213233 -
atagaaacaaatggaaaaactt

SEQ ID NO: 145968 - DNA, 22 bp, Artificial Sequence
  Synthetic oligonucleotide; CTT chr11 5213211 5213232 5213216 5213211 -
tccatgctcatggataaaaaga

SEQ ID NO: 145969 - DNA, 22 bp, Artificial Sequence
  Synthetic oligonucleotide; TTT chr11 5213210 5213231 5213215 5213210 -
ccatgctcatggataaaaagaa

SEQ ID NO: 145970 - DNA, 22 bp, Artificial Sequence
  Synthetic oligonucleotide; TTC chr11 5213209 5213230 5213214 5213209 -
catgctcatggataaaaagaat

SEQ ID NO: 145971 - DNA, 22 bp, Artificial Sequence
  Synthetic oligonucleotide; CTC chr11 5213202 5213223 5213207 5213202 -
atggataaaaagaatcaatatt

SEQ ID NO: 145972 - DNA, 22 bp, Artificial Sequence
  Synthetic oligonucleotide; TTG chr11 5213179 5213200 5213184 5213179 -
ttaaaatgtccatactgcctag

SEQ ID NO: 145973 - DNA, 22 bp, Artificial Sequence
  Synthetic oligonucleotide; TTA chr11 5213176 5213197 5213181 5213176 -
aaatgtccatactgcctagagc

SEQ ID NO: 145974 - DNA, 22 bp, Artificial Sequence
  Synthetic oligonucleotide; CTG chr11 5213162 5213183 5213167 5213162 -
cctagagcaatttacagtttca

SEQ ID NO: 145975 - DNA, 22 bp, Artificial Sequence
  Synthetic oligonucleotide; CTA chr11 5213158 5213179 5213163 5213158 -
gagcaatttacagtttcaaagc

SEQ ID NO: 145976 - DNA, 22 bp, Artificial Sequence
  Synthetic oligonucleotide; TTT chr11 5213149 5213170 5213154 5213149 -
acagtttcaaagctattcctat

SEQ ID NO: 145977 - DNA, 22 bp, Artificial Sequence
  Synthetic oligonucleotide; TTA chr11 5213148 5213169 5213153 5213148 -
cagtttcaaagctattcctatc

SEQ ID NO: 145978 - DNA, 22 bp, Artificial Sequence
  Synthetic oligonucleotide; TTT chr11 5213142 5213163 5213147 5213142 -
caaagctattcctatcaaacta

SEQ ID NO: 145979 - DNA, 22 bp, Artificial Sequence
  Synthetic oligonucleotide; TTC chr11 5213141 5213162 5213146 5213141 -
aaagctattcctatcaaactac

SEQ ID NO: 145980 - DNA, 22 bp, Artificial Sequence
  Synthetic oligonucleotide; CTA chr11 5213134 5213155 5213139 5213134 -
ttcctatcaaactaccaatgac

SEQ ID NO: 145981 - DNA, 22 bp, Artificial Sequence
  Synthetic oligonucleotide; TTC chr11 5213131 5213152 5213136 5213131 -
ctatcaaactaccaatgacatt

SEQ ID NO: 145982 - DNA, 22 bp, Artificial Sequence
  Synthetic oligonucleotide; CTA chr11 5213128 5213149 5213133 5213128 -
tcaaactaccaatgacattctt

SEQ ID NO: 145983 - DNA, 22 bp, Artificial Sequence
  Synthetic oligonucleotide; CTA chr11 5213120 5213141 5213125 5213120 -
ccaatgacattcttcacagaac

SEQ ID NO: 145984 - DNA, 22 bp, Artificial Sequence
  Synthetic oligonucleotide; TTC chr11 5213108 5213129 5213113 5213108 -
ttcacagaactagaaaaataca

SEQ ID NO: 145985 - DNA, 22 bp, Artificial Sequence
  Synthetic oligonucleotide; CTT chr11 5213106 5213127 5213111 5213106 -
cacagaactagaaaaatacact

SEQ ID NO: 145986 - DNA, 22 bp, Artificial Sequence
  Synthetic oligonucleotide; TTC chr11 5213105 5213126 5213110 5213105 -
acagaactagaaaaatacactt

SEQ ID NO: 145987 - DNA, 22 bp, Artificial Sequence
  Synthetic oligonucleotide; CTA chr11 5213096 5213117 5213101 5213096 -
gaaaaatacactttaaagttca

SEQ ID NO: 145988 - DNA, 22 bp, Artificial Sequence
  Synthetic oligonucleotide; CTT chr11 5213083 5213104 5213088 5213083 -
taaagttcatatggaacaacaa

SEQ ID NO: 145989 - DNA, 22 bp, Artificial Sequence
  Synthetic oligonucleotide; TTT chr11 5213082 5213103 5213087 5213082 -
aaagttcatatggaacaacaac

SEQ ID NO: 145990 - DNA, 22 bp, Artificial Sequence
  Synthetic oligonucleotide; TTA chr11 5213081 5213102 5213086 5213081 -
aagttcatatggaacaacaaca

SEQ ID NO: 145991 - DNA, 22 bp, Artificial Sequence
  Synthetic oligonucleotide; TTC chr11 5213075 5213096 5213080 5213075 -
atatggaacaacaacaaaaaaa

SEQ ID NO: 145992 - DNA, 22 bp, Artificial Sequence
  Synthetic oligonucleotide; CTA chr11 5213039 5213060 5213044 5213039 -
ggaaatcctaatactcacaggt

SEQ ID NO: 145993 - DNA, 22 bp, Artificial Sequence
  Synthetic oligonucleotide; CTA chr11 5213029 5213050 5213034 5213029 -
atactcacaggtgggaattgaa

SEQ ID NO: 145994 - DNA, 22 bp, Artificial Sequence
  Synthetic oligonucleotide; CTC chr11 5213023 5213044 5213028 5213023 -
acaggtgggaattgaaaaatga

SEQ ID NO: 145995 - DNA, 22 bp, Artificial Sequence
  Synthetic oligonucleotide; TTG chr11 5213009 5213030 5213014 5213009 -
aaaaatgagaacacttggacac

SEQ ID NO: 145996 - DNA, 22 bp, Artificial Sequence
  Synthetic oligonucleotide; CTT chr11 5212993 5213014 5212998 5212993 -
ggacacagggtggggaacatca

SEQ ID NO: 145997 - DNA, 22 bp, Artificial Sequence
  Synthetic oligonucleotide; TTG chr11 5212992 5213013 5212997 5212992 -
gacacagggtggggaacatcac

SEQ ID NO: 145998 - DNA, 22 bp, Artificial Sequence
  Synthetic oligonucleotide; CTG chr11 5212957 5212978 5212962 5212957 -
tcgtggggtggtaggagagagg

SEQ ID NO: 145999 - DNA, 22 bp, Artificial Sequence
  Synthetic oligonucleotide; TTA chr11 5212922 5212943 5212927 5212922 -
ggagatatatctaatgtaaatg

SEQ ID NO: 146000 - DNA, 22 bp, Artificial Sequence
  Synthetic oligonucleotide; CTA chr11 5212909 5212930 5212914 5212909 -
atgtaaatgacgagttaacggg

SEQ ID NO: 146001 - DNA, 22 bp, Artificial Sequence
  Synthetic oligonucleotide; TTA chr11 5212892 5212913 5212897 5212892 -
acgggtgcagcacaccaatatg

SEQ ID NO: 146002 - DNA, 22 bp, Artificial Sequence
  Synthetic oligonucleotide; CTG chr11 5212843 5212864 5212848 5212843 -
cacaggtaccgtagaacttaga

SEQ ID NO: 146003 - DNA, 22 bp, Artificial Sequence
  Synthetic oligonucleotide; CTT chr11 5212824 5212845 5212829 5212824 -
agagtacaaaaaaaaaaaaaga

SEQ ID NO: 146004 - DNA, 22 bp, Artificial Sequence
  Synthetic oligonucleotide; TTA chr11 5212823 5212844 5212828 5212823 -
gagtacaaaaaaaaaaaaagag

SEQ ID NO: 146005 - DNA, 22 bp, Artificial Sequence
  Synthetic oligonucleotide; CTG chr11 5212785 5212806 5212790 5212785 -
gagataatacattgcctaactt

SEQ ID NO: 146006 - DNA, 22 bp, Artificial Sequence
  Synthetic oligonucleotide; TTG chr11 5212771 5212792 5212776 5212771 -
cctaacttcaaaccataccaca

SEQ ID NO: 146007 - DNA, 22 bp, Artificial Sequence
  Synthetic oligonucleotide; CTA chr11 5212767 5212788 5212772 5212767 -
acttcaaaccataccacagggc

SEQ ID NO: 146008 - DNA, 22 bp, Artificial Sequence
  Synthetic oligonucleotide; CTT chr11 5212763 5212784 5212768 5212763 -
caaaccataccacagggctaca

SEQ ID NO: 146009 - DNA, 22 bp, Artificial Sequence
  Synthetic oligonucleotide; TTC chr11 5212762 5212783 5212767 5212762 -
aaaccataccacagggctacag

SEQ ID NO: 146010 - DNA, 22 bp, Artificial Sequence
  Synthetic oligonucleotide; CTA chr11 5212743 5212764 5212748 5212743 -
cagtaaccaaaacagtgtggta

SEQ ID NO: 146011 - DNA, 22 bp, Artificial Sequence
  Synthetic oligonucleotide; CTG chr11 5212718 5212739 5212723 5212718 -
ttacagaaaagacacacagaca

SEQ ID NO: 146012 - DNA, 22 bp, Artificial Sequence
  Synthetic oligonucleotide; TTA chr11 5212715 5212736 5212720 5212715 -
cagaaaagacacacagacaaat

SEQ ID NO: 146013 - DNA, 22 bp, Artificial Sequence
  Synthetic oligonucleotide; CTA chr11 5212653 5212674 5212658 5212653 -
caaccatctgatctttgacaaa

SEQ ID NO: 146014 - DNA, 22 bp, Artificial Sequence
  Synthetic oligonucleotide; CTG chr11 5212643 5212664 5212648 5212643 -
atctttgacaaagctgataaaa

SEQ ID NO: 146015 - DNA, 22 bp, Artificial Sequence
  Synthetic oligonucleotide; CTT chr11 5212638 5212659 5212643 5212638 -
tgacaaagctgataaaaacaag

SEQ ID NO: 146016 - DNA, 22 bp, Artificial Sequence
  Synthetic oligonucleotide; TTT chr11 5212637 5212658 5212642 5212637 -
gacaaagctgataaaaacaagc

SEQ ID NO: 146017 - DNA, 22 bp, Artificial Sequence
  Synthetic oligonucleotide; TTG chr11 5212636 5212657 5212641 5212636 -
acaaagctgataaaaacaagca

SEQ ID NO: 146018 - DNA, 22 bp, Artificial Sequence
  Synthetic oligonucleotide; CTG chr11 5212627 5212648 5212632 5212627 -
ataaaaacaagcaatgaggaaa

SEQ ID NO: 146019 - DNA, 22 bp, Artificial Sequence
  Synthetic oligonucleotide; CTA chr11 5212595 5212616 5212600 5212595 -
ttcaacaagtggtgttgggata

SEQ ID NO: 146020 - DNA, 22 bp, Artificial Sequence
  Synthetic oligonucleotide; TTC chr11 5212592 5212613 5212597 5212592 -
aacaagtggtgttgggataact

SEQ ID NO: 146021 - DNA, 22 bp, Artificial Sequence
  Synthetic oligonucleotide; TTG chr11 5212578 5212599 5212583 5212578 -
ggataactgactaaccgtatgt

SEQ ID NO: 146022 - DNA, 22 bp, Artificial Sequence
  Synthetic oligonucleotide; CTG chr11 5212569 5212590 5212574 5212569 -
actaaccgtatgtagaagattg

SEQ ID NO: 146023 - DNA, 22 bp, Artificial Sequence
  Synthetic oligonucleotide; CTA chr11 5212565 5212586 5212570 5212565 -
accgtatgtagaagattgaaac

SEQ ID NO: 146024 - DNA, 22 bp, Artificial Sequence
  Synthetic oligonucleotide; TTG chr11 5212547 5212568 5212552 5212547 -
aaaccagaccccgttctatatc

SEQ ID NO: 146025 - DNA, 22 bp, Artificial Sequence
  Synthetic oligonucleotide; TTC chr11 5212531 5212552 5212536 5212531 -
tatatcatatacacaaataaac

SEQ ID NO: 146026 - DNA, 22 bp, Artificial Sequence
  Synthetic oligonucleotide; CTA chr11 5212529 5212550 5212534 5212529 -
tatcatatacacaaataaactc

SEQ ID NO: 146027 - DNA, 22 bp, Artificial Sequence
  Synthetic oligonucleotide; CTC chr11 5212507 5212528 5212512 5212507 -
aagatggattagagacttaaat

SEQ ID NO: 146028 - DNA, 22 bp, Artificial Sequence
  Synthetic oligonucleotide; TTA chr11 5212496 5212517 5212501 5212496 -
gagacttaaatgcaaaacccaa

SEQ ID NO: 146029 - DNA, 22 bp, Artificial Sequence
  Synthetic oligonucleotide; CTT chr11 5212489 5212510 5212494 5212489 -
aaatgcaaaacccaaactataa

SEQ ID NO: 146030 - DNA, 22 bp, Artificial Sequence
  Synthetic oligonucleotide; TTA chr11 5212488 5212509 5212493 5212488 -
aatgcaaaacccaaactataaa

SEQ ID NO: 146031 - DNA, 22 bp, Artificial Sequence
  Synthetic oligonucleotide; CTA chr11 5212470 5212491 5212475 5212470 -
taaaaatgcttgaaagcaacct

SEQ ID NO: 146032 - DNA, 22 bp, Artificial Sequence
  Synthetic oligonucleotide; CTT chr11 5212459 5212480 5212464 5212459 -
gaaagcaacctaggcaatacca

SEQ ID NO: 146033 - DNA, 22 bp, Artificial Sequence
  Synthetic oligonucleotide; TTG chr11 5212458 5212479 5212463 5212458 -
aaagcaacctaggcaataccat

SEQ ID NO: 146034 - DNA, 22 bp, Artificial Sequence
  Synthetic oligonucleotide; CTA chr11 5212447 5212468 5212452 5212447 -
ggcaataccattccggacataa

SEQ ID NO: 146035 - DNA, 22 bp, Artificial Sequence
  Synthetic oligonucleotide; TTC chr11 5212434 5212455 5212439 5212434 -
cggacataagcaggggcaaaga

SEQ ID NO: 146036 - DNA, 22 bp, Artificial Sequence
  Synthetic oligonucleotide; TTT chr11 5212409 5212430 5212414 5212409 -
catgacaaagatgccaacagtc

SEQ ID NO: 146037 - DNA, 22 bp, Artificial Sequence
  Synthetic oligonucleotide; TTC chr11 5212408 5212429 5212413 5212408 -
atgacaaagatgccaacagtca

SEQ ID NO: 146038 - DNA, 22 bp, Artificial Sequence
  Synthetic oligonucleotide; TTG chr11 5212383 5212404 5212388 5212383 -
cagcaaaagcaaaaattgacaa

SEQ ID NO: 146039 - DNA, 22 bp, Artificial Sequence
  Synthetic oligonucleotide; TTG chr11 5212365 5212386 5212370 5212365 -
acaaataggatctaattaaaat

SEQ ID NO: 146040 - DNA, 22 bp, Artificial Sequence
  Synthetic oligonucleotide; CTA chr11 5212351 5212372 5212356 5212351 -
attaaaataaagtttctgcaca

SEQ ID NO: 146041 - DNA, 22 bp, Artificial Sequence
  Synthetic oligonucleotide; TTA chr11 5212347 5212368 5212352 5212347 -
aaataaagtttctgcacagcaa

SEQ ID NO: 146042 - DNA, 22 bp, Artificial Sequence
  Synthetic oligonucleotide; TTT chr11 5212336 5212357 5212341 5212336 -
ctgcacagcaaaagaaactatc

SEQ ID NO: 146043 - DNA, 22 bp, Artificial Sequence
  Synthetic oligonucleotide; TTC chr11 5212335 5212356 5212340 5212335 -
tgcacagcaaaagaaactatca

SEQ ID NO: 146044 - DNA, 22 bp, Artificial Sequence
  Synthetic oligonucleotide; CTG chr11 5212333 5212354 5212338 5212333 -
cacagcaaaagaaactatcaac

SEQ ID NO: 146045 - DNA, 22 bp, Artificial Sequence
  Synthetic oligonucleotide; CTA chr11 5212316 5212337 5212321 5212316 -
tcaactgagtaaacaacctata

SEQ ID NO: 146046 - DNA, 22 bp, Artificial Sequence
  Synthetic oligonucleotide; CTG chr11 5212309 5212330 5212314 5212309 -
agtaaacaacctatagaatggg

SEQ ID NO: 146047 - DNA, 22 bp, Artificial Sequence
  Synthetic oligonucleotide; CTA chr11 5212296 5212317 5212301 5212296 -
tagaatgggagaaaatttttgc

SEQ ID NO: 146048 - DNA, 22 bp, Artificial Sequence
  Synthetic oligonucleotide; TTT chr11 5212278 5212299 5212283 5212278 -
ttgcaaactatgcatccaacaa

SEQ ID NO: 146049 - DNA, 22 bp, Artificial Sequence
  Synthetic oligonucleotide; TTT chr11 5212277 5212298 5212282 5212277 -
tgcaaactatgcatccaacaaa

SEQ ID NO: 146050 - DNA, 22 bp, Artificial Sequence
  Synthetic oligonucleotide; TTT chr11 5212276 5212297 5212281 5212276 -
gcaaactatgcatccaacaaag

SEQ ID NO: 146051 - DNA, 22 bp, Artificial Sequence
  Synthetic oligonucleotide; TTG chr11 5212275 5212296 5212280 5212275 -
caaactatgcatccaacaaagg

SEQ ID NO: 146052 - DNA, 22 bp, Artificial Sequence
  Synthetic oligonucleotide; CTA chr11 5212268 5212289 5212273 5212268 -
tgcatccaacaaaggcctaata

SEQ ID NO: 146053 - DNA, 22 bp, Artificial Sequence
  Synthetic oligonucleotide; CTA chr11 5212249 5212270 5212254 5212249 -
atattcagaatctataaggaac

SEQ ID NO: 146054 - DNA, 22 bp, Artificial Sequence
  Synthetic oligonucleotide; TTC chr11 5212243 5212264 5212248 5212243 -
agaatctataaggaacttaaat

SEQ ID NO: 146055 - DNA, 22 bp, Artificial Sequence
  Synthetic oligonucleotide; CTA chr11 5212235 5212256 5212240 5212235 -
taaggaacttaaatgaatctac

SEQ ID NO: 146056 - DNA, 22 bp, Artificial Sequence
  Synthetic oligonucleotide; CTT chr11 5212225 5212246 5212230 5212225 -
aaatgaatctacaagaacaaaa

SEQ ID NO: 146057 - DNA, 22 bp, Artificial Sequence
  Synthetic oligonucleotide; TTA chr11 5212224 5212245 5212229 5212224 -
aatgaatctacaagaacaaaac

SEQ ID NO: 146058 - DNA, 22 bp, Artificial Sequence
  Synthetic oligonucleotide; CTA chr11 5212214 5212235 5212219 5212214 -
caagaacaaaacaaacaatgcc

SEQ ID NO: 146059 - DNA, 22 bp, Artificial Sequence
  Synthetic oligonucleotide; TTC chr11 5212155 5212176 5212160 5212155 -
aaaagaagacatacatgtggcc

SEQ ID NO: 146060 - DNA, 22 bp, Artificial Sequence
  Synthetic oligonucleotide; CTC chr11 5212111 5212132 5212116 5212111 -
agtgtcactgatcattagagaa

SEQ ID NO: 146061 - DNA, 22 bp, Artificial Sequence
  Synthetic oligonucleotide; CTG chr11 5212101 5212122 5212106 5212101 -
atcattagagaaatgccaatca

SEQ ID NO: 146062 - DNA, 22 bp, Artificial Sequence
  Synthetic oligonucleotide; TTA chr11 5212094 5212115 5212099 5212094 -
gagaaatgccaatcaaacccaa

SEQ ID NO: 146063 - DNA, 22 bp, Artificial Sequence
  Synthetic oligonucleotide; CTA chr11 5212060 5212081 5212065 5212060 -
tctcacatcacttaaaatatct

SEQ ID NO: 146064 - DNA, 22 bp, Artificial Sequence
  Synthetic oligonucleotide; CTC chr11 5212056 5212077 5212061 5212056 -
acatcacttaaaatatctataa

SEQ ID NO: 146065 - DNA, 22 bp, Artificial Sequence
  Synthetic oligonucleotide; CTT chr11 5212047 5212068 5212052 5212047 -
aaaatatctataattaaatagt

SEQ ID NO: 146066 - DNA, 22 bp, Artificial Sequence
  Synthetic oligonucleotide; TTA chr11 5212046 5212067 5212051 5212046 -
aaatatctataattaaatagtc

SEQ ID NO: 146067 - DNA, 22 bp, Artificial Sequence
  Synthetic oligonucleotide; CTA chr11 5212037 5212058 5212042 5212037 -
taattaaatagtcaaaaaataa

SEQ ID NO: 146068 - DNA, 22 bp, Artificial Sequence
  Synthetic oligonucleotide; TTA chr11 5212031 5212052 5212036 5212031 -
aatagtcaaaaaataacagatg

SEQ ID NO: 146069 - DNA, 22 bp, Artificial Sequence
  Synthetic oligonucleotide; TTG chr11 5211997 5212018 5212002 5211997 -
tggagaaaagggaatgtttata

SEQ ID NO: 146070 - DNA, 22 bp, Artificial Sequence
  Synthetic oligonucleotide; TTT chr11 5211978 5211999 5211983 5211978 -
atacaccattggtggcaatata

SEQ ID NO: 146071 - DNA, 22 bp, Artificial Sequence
  Synthetic oligonucleotide; TTA chr11 5211977 5211998 5211982 5211977 -
tacaccattggtggcaatataa

SEQ ID NO: 146072 - DNA, 22 bp, Artificial Sequence
  Synthetic oligonucleotide; TTG chr11 5211967 5211988 5211972 5211967 -
gtggcaatataaattagttcga

SEQ ID NO: 146073 - DNA, 22 bp, Artificial Sequence
  Synthetic oligonucleotide; TTA chr11 5211951 5211972 5211956 5211951 -
gttcgaccattgtagacagcag

SEQ ID NO: 146074 - DNA, 22 bp, Artificial Sequence
  Synthetic oligonucleotide; TTC chr11 5211947 5211968 5211952 5211947 -
gaccattgtagacagcagtgtg

SEQ ID NO: 146075 - DNA, 22 bp, Artificial Sequence
  Synthetic oligonucleotide; TTG chr11 5211939 5211960 5211944 5211939 -
tagacagcagtgtggcaattcc

SEQ ID NO: 146076 - DNA, 22 bp, Artificial Sequence
  Synthetic oligonucleotide; TTC chr11 5211918 5211939 5211923 5211918 -
cctaaagacctaaaaacagaaa

SEQ ID NO: 146077 - DNA, 22 bp, Artificial Sequence
  Synthetic oligonucleotide; CTA chr11 5211914 5211935 5211919 5211914 -
aagacctaaaaacagaaatacc

SEQ ID NO: 146078 - DNA, 22 bp, Artificial Sequence
  Synthetic oligonucleotide; CTA chr11 5211906 5211927 5211911 5211906 -
aaaacagaaataccatttaacc

SEQ ID NO: 146079 - DNA, 22 bp, Artificial Sequence
  Synthetic oligonucleotide; TTT chr11 5211888 5211909 5211893 5211888 -
aacccaacaatcctattattga

SEQ ID NO: 146080 - DNA, 22 bp, Artificial Sequence
  Synthetic oligonucleotide; TTA chr11 5211887 5211908 5211892 5211887 -
acccaacaatcctattattgag

SEQ ID NO: 146081 - DNA, 22 bp, Artificial Sequence
  Synthetic oligonucleotide; CTA chr11 5211873 5211894 5211878 5211873 -
ttattgagtatatacctaaagg

SEQ ID NO: 146082 - DNA, 22 bp, Artificial Sequence
  Synthetic oligonucleotide; TTA chr11 5211870 5211891 5211875 5211870 -
ttgagtatatacctaaaggaaa

SEQ ID NO: 146083 - DNA, 22 bp, Artificial Sequence
  Synthetic oligonucleotide; TTG chr11 5211867 5211888 5211872 5211867 -
agtatatacctaaaggaaaata

SEQ ID NO: 146084 - DNA, 22 bp, Artificial Sequence
  Synthetic oligonucleotide; CTA chr11 5211855 5211876 5211860 5211855 -
aaggaaaataaaccattctatc

SEQ ID NO: 146085 - DNA, 22 bp, Artificial Sequence
  Synthetic oligonucleotide; TTC chr11 5211837 5211858 5211842 5211837 -
tatcacaaagacacatgcacac

SEQ ID NO: 146086 - DNA, 22 bp, Artificial Sequence
  Synthetic oligonucleotide; CTA chr11 5211835 5211856 5211840 5211835 -
tcacaaagacacatgcacacct

SEQ ID NO: 146087 - DNA, 22 bp, Artificial Sequence
  Synthetic oligonucleotide; CTG chr11 5211812 5211833 5211817 5211812 -
tgtccattgcagcataatcaca

SEQ ID NO: 146088 - DNA, 22 bp, Artificial Sequence
  Synthetic oligonucleotide; TTG chr11 5211803 5211824 5211808 5211803 -
cagcataatcacaatagcaaag

SEQ ID NO: 146089 - DNA, 22 bp, Artificial Sequence
  Synthetic oligonucleotide; CTG chr11 5211765 5211786 5211770 5211765 -
aaggcccattagtggtataccg

SEQ ID NO: 146090 - DNA, 22 bp, Artificial Sequence
  Synthetic oligonucleotide; TTA chr11 5211754 5211775 5211759 5211754 -
gtggtataccgataaagaacat

SEQ ID NO: 146091 - DNA, 22 bp, Artificial Sequence
  Synthetic oligonucleotide; CTA chr11 5211708 5211729 5211713 5211708 -
tgtggccataaaaaagaatgag

SEQ ID NO: 146092 - DNA, 22 bp, Artificial Sequence
  Synthetic oligonucleotide; CTT chr11 5211675 5211696 5211680 5211675 -
tgcaggaacatggatggagccg

SEQ ID NO: 146093 - DNA, 22 bp, Artificial Sequence
  Synthetic oligonucleotide; TTT chr11 5211674 5211695 5211679 5211674 -
gcaggaacatggatggagccgg

SEQ ID NO: 146094 - DNA, 22 bp, Artificial Sequence
  Synthetic oligonucleotide; TTG chr11 5211673 5211694 5211678 5211673 -
caggaacatggatggagccgga

SEQ ID NO: 146095 - DNA, 22 bp, Artificial Sequence
  Synthetic oligonucleotide; TTA chr11 5211643 5211664 5211648 5211643 -
tccttaacaaactaatgtaaga

SEQ ID NO: 146096 - DNA, 22 bp, Artificial Sequence
  Synthetic oligonucleotide; CTT chr11 5211638 5211659 5211643 5211638 -
aacaaactaatgtaagaacaga

SEQ ID NO: 146097 - DNA, 22 bp, Artificial Sequence
  Synthetic oligonucleotide; TTA chr11 5211637 5211658 5211642 5211637 -
acaaactaatgtaagaacagaa

SEQ ID NO: 146098 - DNA, 22 bp, Artificial Sequence
  Synthetic oligonucleotide; CTA chr11 5211629 5211650 5211634 5211629 -
atgtaagaacagaaaaccaaat

SEQ ID NO: 146099 - DNA, 22 bp, Artificial Sequence
  Synthetic oligonucleotide; CTA chr11 5211603 5211624 5211608 5211603 -
catattatcacttacaagtagg

SEQ ID NO: 146100 - DNA, 22 bp, Artificial Sequence
  Synthetic oligonucleotide; TTA chr11 5211596 5211617 5211601 5211596 -
tcacttacaagtaggaactaaa

SEQ ID NO: 146101 - DNA, 22 bp, Artificial Sequence
  Synthetic oligonucleotide; CTT chr11 5211590 5211611 5211595 5211590 -
acaagtaggaactaaatgatga

SEQ ID NO: 146102 - DNA, 22 bp, Artificial Sequence
  Synthetic oligonucleotide; TTA chr11 5211589 5211610 5211594 5211589 -
caagtaggaactaaatgatgag

SEQ ID NO: 146103 - DNA, 22 bp, Artificial Sequence
  Synthetic oligonucleotide; CTA chr11 5211576 5211597 5211581 5211576 -
aatgatgagaaaacatgcacac

SEQ ID NO: 146104 - DNA, 22 bp, Artificial Sequence
  Synthetic oligonucleotide; CTG chr11 5211532 5211553 5211537 5211532 -
cagcctaattgagtttggaggg

SEQ ID NO: 146105 - DNA, 22 bp, Artificial Sequence
  Synthetic oligonucleotide; CTA chr11 5211525 5211546 5211530 5211525 -
attgagtttggagggtgggaac

SEQ ID NO: 146106 - DNA, 22 bp, Artificial Sequence
  Synthetic oligonucleotide; TTG chr11 5211521 5211542 5211526 5211521 -
agtttggagggtgggaacgggg

SEQ ID NO: 146107 - DNA, 22 bp, Artificial Sequence
  Synthetic oligonucleotide; TTT chr11 5211516 5211537 5211521 5211516 -
ggagggtgggaacggggagaag

SEQ ID NO: 146108 - DNA, 22 bp, Artificial Sequence
  Synthetic oligonucleotide; TTG chr11 5211515 5211536 5211520 5211515 -
gagggtgggaacggggagaaga

SEQ ID NO: 146109 - DNA, 22 bp, Artificial Sequence
  Synthetic oligonucleotide; CTA chr11 5211477 5211498 5211482 5211477 -
ttgagtactgggagatgaaata

SEQ ID NO: 146110 - DNA, 22 bp, Artificial Sequence
  Synthetic oligonucleotide; TTG chr11 5211474 5211495 5211479 5211474 -
agtactgggagatgaaataatc

SEQ ID NO: 146111 - DNA, 22 bp, Artificial Sequence
  Synthetic oligonucleotide; CTG chr11 5211467 5211488 5211472 5211467 -
ggagatgaaataatctgtacga

SEQ ID NO: 146112 - DNA, 22 bp, Artificial Sequence
  Synthetic oligonucleotide; CTG chr11 5211450 5211471 5211455 5211450 -
tacgacaaacccatgacatgtg

SEQ ID NO: 146113 - DNA, 22 bp, Artificial Sequence
  Synthetic oligonucleotide; TTT chr11 5211425 5211446 5211430 5211425 -
agctatgtaacaaaccatcgtg

SEQ ID NO: 146114 - DNA, 22 bp, Artificial Sequence
  Synthetic oligonucleotide; TTA chr11 5211424 5211445 5211429 5211424 -
gctatgtaacaaaccatcgtga

SEQ ID NO: 146115 - DNA, 22 bp, Artificial Sequence
  Synthetic oligonucleotide; CTA chr11 5211420 5211441 5211425 5211420 -
tgtaacaaaccatcgtgagtct

SEQ ID NO: 146116 - DNA, 22 bp, Artificial Sequence
  Synthetic oligonucleotide; CTT chr11 5211397 5211418 5211402 5211397 -
tagcagttctttcctcccattt

SEQ ID NO: 146117 - DNA, 22 bp, Artificial Sequence
  Synthetic oligonucleotide; TTT chr11 5211396 5211417 5211401 5211396 -
agcagttctttcctcccatttt

SEQ ID NO: 146118 - DNA, 22 bp, Artificial Sequence
  Synthetic oligonucleotide; TTA chr11 5211395 5211416 5211400 5211395 -
gcagttctttcctcccatttta

SEQ ID NO: 146119 - DNA, 22 bp, Artificial Sequence
  Synthetic oligonucleotide; TTC chr11 5211388 5211409 5211393 5211388 -
tttcctcccattttattcttcc

SEQ ID NO: 146120 - DNA, 22 bp, Artificial Sequence
  Synthetic oligonucleotide; CTT chr11 5211386 5211407 5211391 5211386 -
tcctcccattttattcttcctt

SEQ ID NO: 146121 - DNA, 22 bp, Artificial Sequence
  Synthetic oligonucleotide; TTT chr11 5211385 5211406 5211390 5211385 -
cctcccattttattcttccttg

SEQ ID NO: 146122 - DNA, 22 bp, Artificial Sequence
  Synthetic oligonucleotide; TTC chr11 5211384 5211405 5211389 5211384 -
ctcccattttattcttccttgc

SEQ ID NO: 146123 - DNA, 22 bp, Artificial Sequence
  Synthetic oligonucleotide; CTC chr11 5211381 5211402 5211386 5211381 -
ccattttattcttccttgctcc

SEQ ID NO: 146124 - DNA, 22 bp, Artificial Sequence
  Synthetic oligonucleotide; TTT chr11 5211375 5211396 5211380 5211375 -
tattcttccttgctcctctttc

SEQ ID NO: 146125 - DNA, 22 bp, Artificial Sequence
  Synthetic oligonucleotide; TTT chr11 5211374 5211395 5211379 5211374 -
attcttccttgctcctctttcc

SEQ ID NO: 146126 - DNA, 22 bp, Artificial Sequence
  Synthetic oligonucleotide; TTA chr11 5211373 5211394 5211378 5211373 -
ttcttccttgctcctctttcca

SEQ ID NO: 146127 - DNA, 22 bp, Artificial Sequence
  Synthetic oligonucleotide; TTC chr11 5211370 5211391 5211375 5211370 -
ttccttgctcctctttccacct

SEQ ID NO: 146128 - DNA, 22 bp, Artificial Sequence
  Synthetic oligonucleotide; CTT chr11 5211368 5211389 5211373 5211368 -
ccttgctcctctttccacctat

SEQ ID NO: 146129 - DNA, 22 bp, Artificial Sequence
  Synthetic oligonucleotide; TTC chr11 5211367 5211388 5211372 5211367 -
cttgctcctctttccacctatt

SEQ ID NO: 146130 - DNA, 22 bp, Artificial Sequence
  Synthetic oligonucleotide; CTT chr11 5211364 5211385 5211369 5211364 -
gctcctctttccacctattagt

SEQ ID NO: 146131 - DNA, 22 bp, Artificial Sequence
  Synthetic oligonucleotide; TTG chr11 5211363 5211384 5211368 5211363 -
ctcctctttccacctattagtc

SEQ ID NO: 146132 - DNA, 22 bp, Artificial Sequence
  Synthetic oligonucleotide; CTC chr11 5211360 5211381 5211365 5211360 -
ctctttccacctattagtcaca

SEQ ID NO: 146133 - DNA, 22 bp, Artificial Sequence
  Synthetic oligonucleotide; CTC chr11 5211357 5211378 5211362 5211357 -
tttccacctattagtcacatat

SEQ ID NO: 146134 - DNA, 22 bp, Artificial Sequence
  Synthetic oligonucleotide; CTT chr11 5211355 5211376 5211360 5211355 -
tccacctattagtcacatatct

SEQ ID NO: 146135 - DNA, 22 bp, Artificial Sequence
  Synthetic oligonucleotide; TTT chr11 5211354 5211375 5211359 5211354 -
ccacctattagtcacatatctt

SEQ ID NO: 146136 - DNA, 22 bp, Artificial Sequence
  Synthetic oligonucleotide; TTC chr11 5211353 5211374 5211358 5211353 -
cacctattagtcacatatcttt

SEQ ID NO: 146137 - DNA, 22 bp, Artificial Sequence
  Synthetic oligonucleotide; CTA chr11 5211347 5211368 5211352 5211347 -
ttagtcacatatctttttatag

SEQ ID NO: 146138 - DNA, 22 bp, Artificial Sequence
  Synthetic oligonucleotide; TTA chr11 5211344 5211365 5211349 5211344 -
gtcacatatctttttatagtta

SEQ ID NO: 146139 - DNA, 22 bp, Artificial Sequence
  Synthetic oligonucleotide; CTT chr11 5211332 5211353 5211337 5211332 -
tttatagttataatcagcttgt

SEQ ID NO: 146140 - DNA, 22 bp, Artificial Sequence
  Synthetic oligonucleotide; TTT chr11 5211331 5211352 5211336 5211331 -
ttatagttataatcagcttgtt

SEQ ID NO: 146141 - DNA, 22 bp, Artificial Sequence
  Synthetic oligonucleotide; TTT chr11 5211330 5211351 5211335 5211330 -
tatagttataatcagcttgttt

SEQ ID NO: 146142 - DNA, 22 bp, Artificial Sequence
  Synthetic oligonucleotide; TTT chr11 5211329 5211350 5211334 5211329 -
atagttataatcagcttgtttt

SEQ ID NO: 146143 - DNA, 22 bp, Artificial Sequence
  Synthetic oligonucleotide; TTA chr11 5211328 5211349 5211333 5211328 -
tagttataatcagcttgttttt

SEQ ID NO: 146144 - DNA, 22 bp, Artificial Sequence
  Synthetic oligonucleotide; TTA chr11 5211322 5211343 5211327 5211322 -
taatcagcttgtttttaagtct

SEQ ID NO: 146145 - DNA, 22 bp, Artificial Sequence
  Synthetic oligonucleotide; CTT chr11 5211312 5211333 5211317 5211312 -
gtttttaagtctaacaaaatgt

SEQ ID NO: 146146 - DNA, 22 bp, Artificial Sequence
  Synthetic oligonucleotide; TTG chr11 5211311 5211332 5211316 5211311 -
tttttaagtctaacaaaatgtt

SEQ ID NO: 146147 - DNA, 22 bp, Artificial Sequence
  Synthetic oligonucleotide; TTT chr11 5211308 5211329 5211313 5211308 -
ttaagtctaacaaaatgttgtt

SEQ ID NO: 146148 - DNA, 22 bp, Artificial Sequence
  Synthetic oligonucleotide; TTT chr11 5211307 5211328 5211312 5211307 -
taagtctaacaaaatgttgttt

SEQ ID NO: 146149 - DNA, 22 bp, Artificial Sequence
  Synthetic oligonucleotide; TTT chr11 5211306 5211327 5211311 5211306 -
aagtctaacaaaatgttgtttt

SEQ ID NO: 146150 - DNA, 22 bp, Artificial Sequence
  Synthetic oligonucleotide; TTA chr11 5211305 5211326 5211310 5211305 -
agtctaacaaaatgttgtttta

SEQ ID NO: 146151 - DNA, 22 bp, Artificial Sequence
  Synthetic oligonucleotide; CTA chr11 5211299 5211320 5211304 5211299 -
acaaaatgttgttttatgcgca

SEQ ID NO: 146152 - DNA, 22 bp, Artificial Sequence
  Synthetic oligonucleotide; TTG chr11 5211288 5211309 5211293 5211288 -
ttttatgcgcattatgaaagta

SEQ ID NO: 146153 - DNA, 22 bp, Artificial Sequence
  Synthetic oligonucleotide; TTT chr11 5211285 5211306 5211290 5211285 -
tatgcgcattatgaaagtaatt

SEQ ID NO: 146154 - DNA, 22 bp, Artificial Sequence
  Synthetic oligonucleotide; TTT chr11 5211284 5211305 5211289 5211284 -
atgcgcattatgaaagtaattt

SEQ ID NO: 146155 - DNA, 22 bp, Artificial Sequence
  Synthetic oligonucleotide; TTA chr11 5211283 5211304 5211288 5211283 -
tgcgcattatgaaagtaattta

SEQ ID NO: 146156 - DNA, 22 bp, Artificial Sequence
  Synthetic oligonucleotide; TTA chr11 5211274 5211295 5211279 5211274 -
tgaaagtaatttaatgattctc

SEQ ID NO: 146157 - DNA, 22 bp, Artificial Sequence
  Synthetic oligonucleotide; TTT chr11 5211262 5211283 5211267 5211262 -
aatgattctctgtccttctttg

SEQ ID NO: 146158 - DNA, 22 bp, Artificial Sequence
  Synthetic oligonucleotide; TTA chr11 5211261 5211282 5211266 5211261 -
atgattctctgtccttctttgt

SEQ ID NO: 146159 - DNA, 22 bp, Artificial Sequence
  Synthetic oligonucleotide; TTC chr11 5211254 5211275 5211259 5211254 -
tctgtccttctttgtaatttga

SEQ ID NO: 146160 - DNA, 22 bp, Artificial Sequence
  Synthetic oligonucleotide; CTC chr11 5211252 5211273 5211257 5211252 -
tgtccttctttgtaatttgatt

SEQ ID NO: 146161 - DNA, 22 bp, Artificial Sequence
  Synthetic oligonucleotide; CTG chr11 5211250 5211271 5211255 5211250 -
tccttctttgtaatttgatttt

SEQ ID NO: 146162 - DNA, 22 bp, Artificial Sequence
  Synthetic oligonucleotide; CTT chr11 5211245 5211266 5211250 5211245 -
ctttgtaatttgattttatgca

SEQ ID NO: 146163 - DNA, 22 bp, Artificial Sequence
  Synthetic oligonucleotide; TTC chr11 5211244 5211265 5211249 5211244 -
tttgtaatttgattttatgcaa

SEQ ID NO: 146164 - DNA, 22 bp, Artificial Sequence
  Synthetic oligonucleotide; CTT chr11 5211242 5211263 5211247 5211242 -
tgtaatttgattttatgcaaca

SEQ ID NO: 146165 - DNA, 22 bp, Artificial Sequence
  Synthetic oligonucleotide; TTT chr11 5211241 5211262 5211246 5211241 -
gtaatttgattttatgcaacaa

SEQ ID NO: 146166 - DNA, 22 bp, Artificial Sequence
  Synthetic oligonucleotide; TTG chr11 5211240 5211261 5211245 5211240 -
taatttgattttatgcaacaag

SEQ ID NO: 146167 - DNA, 22 bp, Artificial Sequence
  Synthetic oligonucleotide; TTT chr11 5211234 5211255 5211239 5211234 -
gattttatgcaacaagcattta

SEQ ID NO: 146168 - DNA, 22 bp, Artificial Sequence
  Synthetic oligonucleotide; TTG chr11 5211233 5211254 5211238 5211233 -
attttatgcaacaagcatttat

SEQ ID NO: 146169 - DNA, 22 bp, Artificial Sequence
  Synthetic oligonucleotide; TTT chr11 5211229 5211250 5211234 5211229 -
tatgcaacaagcatttattgtg

SEQ ID NO: 146170 - DNA, 22 bp, Artificial Sequence
  Synthetic oligonucleotide; TTT chr11 5211228 5211249 5211233 5211228 -
atgcaacaagcatttattgtgt

SEQ ID NO: 146171 - DNA, 22 bp, Artificial Sequence
  Synthetic oligonucleotide; TTA chr11 5211227 5211248 5211232 5211227 -
tgcaacaagcatttattgtgtt

SEQ ID NO: 146172 - DNA, 22 bp, Artificial Sequence
  Synthetic oligonucleotide; TTT chr11 5211213 5211234 5211218 5211213 -
attgtgttcctatatagtaaat

SEQ ID NO: 146173 - DNA, 22 bp, Artificial Sequence
  Synthetic oligonucleotide; TTA chr11 5211212 5211233 5211217 5211212 -
ttgtgttcctatatagtaaata

SEQ ID NO: 146174 - DNA, 22 bp, Artificial Sequence
  Synthetic oligonucleotide; TTG chr11 5211209 5211230 5211214 5211209 -
tgttcctatatagtaaatataa

SEQ ID NO: 146175 - DNA, 22 bp, Artificial Sequence
  Synthetic oligonucleotide; TTC chr11 5211204 5211225 5211209 5211204 -
ctatatagtaaatataaaaact

SEQ ID NO: 146176 - DNA, 22 bp, Artificial Sequence
  Synthetic oligonucleotide; CTA chr11 5211201 5211222 5211206 5211201 -
tatagtaaatataaaaactgta

SEQ ID NO: 146177 - DNA, 22 bp, Artificial Sequence
  Synthetic oligonucleotide; CTG chr11 5211181 5211202 5211186 5211181 -
tatatatgttggaggtaaaaaa

SEQ ID NO: 146178 - DNA, 22 bp, Artificial Sequence
  Synthetic oligonucleotide; TTG chr11 5211170 5211191 5211175 5211170 -
gaggtaaaaaataatgacaatg

SEQ ID NO: 146179 - DNA, 22 bp, Artificial Sequence
  Synthetic oligonucleotide; TTT chr11 5211142 5211163 5211147 5211142 -
ttgccctcaaaataatgtgagc

SEQ ID NO: 146180 - DNA, 22 bp, Artificial Sequence
  Synthetic oligonucleotide; TTT chr11 5211141 5211162 5211146 5211141 -
tgccctcaaaataatgtgagca

SEQ ID NO: 146181 - DNA, 22 bp, Artificial Sequence
  Synthetic oligonucleotide; TTT chr11 5211140 5211161 5211145 5211140 -
gccctcaaaataatgtgagcaa

SEQ ID NO: 146182 - DNA, 22 bp, Artificial Sequence
  Synthetic oligonucleotide; TTG chr11 5211139 5211160 5211144 5211139 -
ccctcaaaataatgtgagcaat

SEQ ID NO: 146183 - DNA, 22 bp, Artificial Sequence
  Synthetic oligonucleotide; CTC chr11 5211134 5211155 5211139 5211134 -
aaaataatgtgagcaatttagt

SEQ ID NO: 146184 - DNA, 22 bp, Artificial Sequence
  Synthetic oligonucleotide; TTT chr11 5211115 5211136 5211120 5211115 -
agtcctatggctcctatttgtt

SEQ ID NO: 146185 - DNA, 22 bp, Artificial Sequence
  Synthetic oligonucleotide; TTA chr11 5211114 5211135 5211119 5211114 -
gtcctatggctcctatttgtta

SEQ ID NO: 146186 - DNA, 22 bp, Artificial Sequence
  Synthetic oligonucleotide; CTA chr11 5211108 5211129 5211113 5211108 -
tggctcctatttgttaaagaca

SEQ ID NO: 146187 - DNA, 22 bp, Artificial Sequence
  Synthetic oligonucleotide; CTC chr11 5211102 5211123 5211107 5211102 -
ctatttgttaaagacattcagt

SEQ ID NO: 146188 - DNA, 22 bp, Artificial Sequence
  Synthetic oligonucleotide; CTA chr11 5211099 5211120 5211104 5211099 -
tttgttaaagacattcagttac

SEQ ID NO: 146189 - DNA, 22 bp, Artificial Sequence
  Synthetic oligonucleotide; TTT chr11 5211096 5211117 5211101 5211096 -
gttaaagacattcagttacttc

SEQ ID NO: 146190 - DNA, 22 bp, Artificial Sequence
  Synthetic oligonucleotide; TTG chr11 5211095 5211116 5211100 5211095 -
ttaaagacattcagttacttct

SEQ ID NO: 146191 - DNA, 22 bp, Artificial Sequence
  Synthetic oligonucleotide; TTA chr11 5211092 5211113 5211097 5211092 -
aagacattcagttacttctgac

SEQ ID NO: 146192 - DNA, 22 bp, Artificial Sequence
  Synthetic oligonucleotide; TTC chr11 5211083 5211104 5211088 5211083 -
agttacttctgacaacctgaat

SEQ ID NO: 146193 - DNA, 22 bp, Artificial Sequence
  Synthetic oligonucleotide; TTA chr11 5211078 5211099 5211083 5211078 -
cttctgacaacctgaattgtta

SEQ ID NO: 146194 - DNA, 22 bp, Artificial Sequence
  Synthetic oligonucleotide; CTT chr11 5211075 5211096 5211080 5211075 -
ctgacaacctgaattgttaatt

SEQ ID NO: 146195 - DNA, 22 bp, Artificial Sequence
  Synthetic oligonucleotide; TTC chr11 5211074 5211095 5211079 5211074 -
tgacaacctgaattgttaattt

SEQ ID NO: 146196 - DNA, 22 bp, Artificial Sequence
  Synthetic oligonucleotide; CTG chr11 5211072 5211093 5211077 5211072 -
acaacctgaattgttaatttct

SEQ ID NO: 146197 - DNA, 22 bp, Artificial Sequence
  Synthetic oligonucleotide; CTG chr11 5211064 5211085 5211069 5211064 -
aattgttaatttctttctttct

SEQ ID NO: 146198 - DNA, 22 bp, Artificial Sequence
  Synthetic oligonucleotide; TTG chr11 5211059 5211080 5211064 5211059 -
ttaatttctttctttctagctc

SEQ ID NO: 146199 - DNA, 22 bp, Artificial Sequence
  Synthetic oligonucleotide; TTA chr11 5211056 5211077 5211061 5211056 -
atttctttctttctagctctct

SEQ ID NO: 146200 - DNA, 22 bp, Artificial Sequence
  Synthetic oligonucleotide; TTT chr11 5211052 5211073 5211057 5211052 -
ctttctttctagctctcttttt

SEQ ID NO: 146201 - DNA, 22 bp, Artificial Sequence
  Synthetic oligonucleotide; TTC chr11 5211051 5211072 5211056 5211051 -
tttctttctagctctctttttt

SEQ ID NO: 146202 - DNA, 22 bp, Artificial Sequence
  Synthetic oligonucleotide; CTT chr11 5211049 5211070 5211054 5211049 -
tctttctagctctctttttttt

SEQ ID NO: 146203 - DNA, 22 bp, Artificial Sequence
  Synthetic oligonucleotide; TTT chr11 5211048 5211069 5211053 5211048 -
ctttctagctctcttttttttt

SEQ ID NO: 146204 - DNA, 22 bp, Artificial Sequence
  Synthetic oligonucleotide; TTC chr11 5211047 5211068 5211052 5211047 -
tttctagctctctttttttttt

SEQ ID NO: 146205 - DNA, 22 bp, Artificial Sequence
  Synthetic oligonucleotide; CTT chr11 5211045 5211066 5211050 5211045 -
tctagctctctttttttttttt

SEQ ID NO: 146206 - DNA, 22 bp, Artificial Sequence
  Synthetic oligonucleotide; TTT chr11 5211044 5211065 5211049 5211044 -
ctagctctcttttttttttttt

SEQ ID NO: 146207 - DNA, 22 bp, Artificial Sequence
  Synthetic oligonucleotide; TTC chr11 5211043 5211064 5211048 5211043 -
tagctctctttttttttttttt

SEQ ID NO: 146208 - DNA, 22 bp, Artificial Sequence
  Synthetic oligonucleotide; CTA chr11 5211041 5211062 5211046 5211041 -
gctctcttttttttttttttga

SEQ ID NO: 146209 - DNA, 22 bp, Artificial Sequence
  Synthetic oligonucleotide; CTC chr11 5211037 5211058 5211042 5211037 -
tcttttttttttttttgacagg

SEQ ID NO: 146210 - DNA, 22 bp, Artificial Sequence
  Synthetic oligonucleotide; CTC chr11 5211035 5211056 5211040 5211035 -
ttttttttttttttgacagggt

SEQ ID NO: 146211 - DNA, 22 bp, Artificial Sequence
  Synthetic oligonucleotide; CTT chr11 5211033 5211054 5211038 5211033 -
ttttttttttttgacagggtct

SEQ ID NO: 146212 - DNA, 22 bp, Artificial Sequence
  Synthetic oligonucleotide; TTT chr11 5211032 5211053 5211037 5211032 -
tttttttttttgacagggtctc

SEQ ID NO: 146213 - DNA, 22 bp, Artificial Sequence
  Synthetic oligonucleotide; TTT chr11 5211031 5211052 5211036 5211031 -
ttttttttttgacagggtctcg

SEQ ID NO: 146214 - DNA, 22 bp, Artificial Sequence
  Synthetic oligonucleotide; TTT chr11 5211030 5211051 5211035 5211030 -
tttttttttgacagggtctcgc

SEQ ID NO: 146215 - DNA, 22 bp, Artificial Sequence
  Synthetic oligonucleotide; TTT chr11 5211029 5211050 5211034 5211029 -
ttttttttgacagggtctcgct

SEQ ID NO: 146216 - DNA, 22 bp, Artificial Sequence
  Synthetic oligonucleotide; TTT chr11 5211028 5211049 5211033 5211028 -
tttttttgacagggtctcgctg

SEQ ID NO: 146217 - DNA, 22 bp, Artificial Sequence
  Synthetic oligonucleotide; TTT chr11 5211027 5211048 5211032 5211027 -
ttttttgacagggtctcgctgt

SEQ ID NO: 146218 - DNA, 22 bp, Artificial Sequence
  Synthetic oligonucleotide; TTT chr11 5211026 5211047 5211031 5211026 -
tttttgacagggtctcgctgtg

SEQ ID NO: 146219 - DNA, 22 bp, Artificial Sequence
  Synthetic oligonucleotide; TTT chr11 5211025 5211046 5211030 5211025 -
ttttgacagggtctcgctgtgt

SEQ ID NO: 146220 - DNA, 22 bp, Artificial Sequence
  Synthetic oligonucleotide; TTT chr11 5211024 5211045 5211029 5211024 -
tttgacagggtctcgctgtgtt

SEQ ID NO: 146221 - DNA, 22 bp, Artificial Sequence
  Synthetic oligonucleotide; TTT chr11 5211023 5211044 5211028 5211023 -
ttgacagggtctcgctgtgttg

SEQ ID NO: 146222 - DNA, 22 bp, Artificial Sequence
  Synthetic oligonucleotide; TTT chr11 5211022 5211043 5211027 5211022 -
tgacagggtctcgctgtgttgc

SEQ ID NO: 146223 - DNA, 22 bp, Artificial Sequence
  Synthetic oligonucleotide; TTT chr11 5211021 5211042 5211026 5211021 -
gacagggtctcgctgtgttgcc

SEQ ID NO: 146224 - DNA, 22 bp, Artificial Sequence
  Synthetic oligonucleotide; TTG chr11 5211020 5211041 5211025 5211020 -
acagggtctcgctgtgttgccc

SEQ ID NO: 146225 - DNA, 22 bp, Artificial Sequence
  Synthetic oligonucleotide; CTC chr11 5211010 5211031 5211015 5211010 -
gctgtgttgcccaggttggagt

SEQ ID NO: 146226 - DNA, 22 bp, Artificial Sequence
  Synthetic oligonucleotide; CTG chr11 5211006 5211027 5211011 5211006 -
tgttgcccaggttggagtgcag

SEQ ID NO: 146227 - DNA, 22 bp, Artificial Sequence
  Synthetic oligonucleotide; TTG chr11 5211001 5211022 5211006 5211001 -
cccaggttggagtgcagtggta

SEQ ID NO: 146228 - DNA, 22 bp, Artificial Sequence
  Synthetic oligonucleotide; TTG chr11 5210992 5211013 5210997 5210992 -
gagtgcagtggtacaatctttg

SEQ ID NO: 146229 - DNA, 22 bp, Artificial Sequence
  Synthetic oligonucleotide; CTT chr11 5210972 5210993 5210977 5210972 -
tgctcactgcaatctccccctc

SEQ ID NO: 146230 - DNA, 22 bp, Artificial Sequence
  Synthetic oligonucleotide; TTT chr11 5210971 5210992 5210976 5210971 -
gctcactgcaatctccccctcc

SEQ ID NO: 146231 - DNA, 22 bp, Artificial Sequence
  Synthetic oligonucleotide; TTG chr11 5210970 5210991 5210975 5210970 -
ctcactgcaatctccccctcct

SEQ ID NO: 146232 - DNA, 22 bp, Artificial Sequence
  Synthetic oligonucleotide; CTC chr11 5210967 5210988 5210972 5210967 -
actgcaatctccccctccttgg

SEQ ID NO: 146233 - DNA, 22 bp, Artificial Sequence
  Synthetic oligonucleotide; CTG chr11 5210963 5210984 5210968 5210963 -
caatctccccctccttggctca

SEQ ID NO: 146234 - DNA, 22 bp, Artificial Sequence
  Synthetic oligonucleotide; CTC chr11 5210956 5210977 5210961 5210956 -
cccctccttggctcaagatatc

SEQ ID NO: 146235 - DNA, 22 bp, Artificial Sequence
  Synthetic oligonucleotide; CTC chr11 5210950 5210971 5210955 5210950 -
cttggctcaagatatccttcca

SEQ ID NO: 146236 - DNA, 22 bp, Artificial Sequence
  Synthetic oligonucleotide; CTT chr11 5210947 5210968 5210952 5210947 -
ggctcaagatatccttccacct

SEQ ID NO: 146237 - DNA, 22 bp, Artificial Sequence
  Synthetic oligonucleotide; TTG chr11 5210946 5210967 5210951 5210946 -
gctcaagatatccttccacctc

SEQ ID NO: 146238 - DNA, 22 bp, Artificial Sequence
  Synthetic oligonucleotide; CTC chr11 5210942 5210963 5210947 5210942 -
aagatatccttccacctcagcc

SEQ ID NO: 146239 - DNA, 22 bp, Artificial Sequence
  Synthetic oligonucleotide; CTT chr11 5210931 5210952 5210936 5210931 -
ccacctcagcctcccaagtagc

SEQ ID NO: 146240 - DNA, 22 bp, Artificial Sequence
  Synthetic oligonucleotide; TTC chr11 5210930 5210951 5210935 5210930 -
cacctcagcctcccaagtagct

SEQ ID NO: 146241 - DNA, 22 bp, Artificial Sequence
  Synthetic oligonucleotide; CTC chr11 5210924 5210945 5210929 5210924 -
agcctcccaagtagctgggact

SEQ ID NO: 146242 - DNA, 22 bp, Artificial Sequence
  Synthetic oligonucleotide; CTC chr11 5210918 5210939 5210923 5210918 -
ccaagtagctgggactacaggc

SEQ ID NO: 146243 - DNA, 22 bp, Artificial Sequence
  Synthetic oligonucleotide; CTG chr11 5210907 5210928 5210912 5210907 -
ggactacaggcacgtaacacca

SEQ ID NO: 146244 - DNA, 22 bp, Artificial Sequence
  Synthetic oligonucleotide; CTA chr11 5210901 5210922 5210906 5210901 -
caggcacgtaacaccatattcg

SEQ ID NO: 146245 - DNA, 22 bp, Artificial Sequence
  Synthetic oligonucleotide; TTC chr11 5210880 5210901 5210885 5210880 -
ggctactttttaaaattttttg

SEQ ID NO: 146246 - DNA, 22 bp, Artificial Sequence
  Synthetic oligonucleotide; CTA chr11 5210875 5210896 5210880 5210875 -
ctttttaaaattttttgtagag

SEQ ID NO: 146247 - DNA, 22 bp, Artificial Sequence
  Synthetic oligonucleotide; CTT chr11 5210872 5210893 5210877 5210872 -
tttaaaattttttgtagagagg

SEQ ID NO: 146248 - DNA, 22 bp, Artificial Sequence
  Synthetic oligonucleotide; TTT chr11 5210871 5210892 5210876 5210871 -
ttaaaattttttgtagagaggg

SEQ ID NO: 146249 - DNA, 22 bp, Artificial Sequence
  Synthetic oligonucleotide; TTT chr11 5210870 5210891 5210875 5210870 -
taaaattttttgtagagagggg

SEQ ID NO: 146250 - DNA, 22 bp, Artificial Sequence
  Synthetic oligonucleotide; TTT chr11 5210869 5210890 5210874 5210869 -
aaaattttttgtagagaggggt

SEQ ID NO: 146251 - DNA, 22 bp, Artificial Sequence
  Synthetic oligonucleotide; TTA chr11 5210868 5210889 5210873 5210868 -
aaattttttgtagagaggggtt

SEQ ID NO: 146252 - DNA, 22 bp, Artificial Sequence
  Synthetic oligonucleotide; TTT chr11 5210862 5210883 5210867 5210862 -
tttgtagagaggggtttctcca

SEQ ID NO: 146253 - DNA, 22 bp, Artificial Sequence
  Synthetic oligonucleotide; TTT chr11 5210861 5210882 5210866 5210861 -
ttgtagagaggggtttctccat

SEQ ID NO: 146254 - DNA, 22 bp, Artificial Sequence
  Synthetic oligonucleotide; TTT chr11 5210860 5210881 5210865 5210860 -
tgtagagaggggtttctccatg

SEQ ID NO: 146255 - DNA, 22 bp, Artificial Sequence
  Synthetic oligonucleotide; TTT chr11 5210859 5210880 5210864 5210859 -
gtagagaggggtttctccatgt

SEQ ID NO: 146256 - DNA, 22 bp, Artificial Sequence
  Synthetic oligonucleotide; TTG chr11 5210858 5210879 5210863 5210858 -
tagagaggggtttctccatgtt

SEQ ID NO: 146257 - DNA, 22 bp, Artificial Sequence
  Synthetic oligonucleotide; TTT chr11 5210845 5210866 5210850 5210845 -
ctccatgttgcccaagctggtc

SEQ ID NO: 146258 - DNA, 22 bp, Artificial Sequence
  Synthetic oligonucleotide; TTC chr11 5210844 5210865 5210849 5210844 -
tccatgttgcccaagctggtct

SEQ ID NO: 146259 - DNA, 22 bp, Artificial Sequence
  Synthetic oligonucleotide; CTC chr11 5210842 5210863 5210847 5210842 -
catgttgcccaagctggtctcc

SEQ ID NO: 146260 - DNA, 22 bp, Artificial Sequence
  Synthetic oligonucleotide; TTG chr11 5210835 5210856 5210840 5210835 -
cccaagctggtctccaactcct

SEQ ID NO: 146261 - DNA, 22 bp, Artificial Sequence
  Synthetic oligonucleotide; CTG chr11 5210826 5210847 5210831 5210826 -
gtctccaactcctgagctcaaa

SEQ ID NO: 146262 - DNA, 22 bp, Artificial Sequence
  Synthetic oligonucleotide; CTC chr11 5210821 5210842 5210826 5210821 -
caactcctgagctcaaatcgtt

SEQ ID NO: 146263 - DNA, 22 bp, Artificial Sequence
  Synthetic oligonucleotide; CTC chr11 5210815 5210836 5210820 5210815 -
ctgagctcaaatcgttctccct

SEQ ID NO: 146264 - DNA, 22 bp, Artificial Sequence
  Synthetic oligonucleotide; CTG chr11 5210812 5210833 5210817 5210812 -
agctcaaatcgttctccctccg

SEQ ID NO: 146265 - DNA, 22 bp, Artificial Sequence
  Synthetic oligonucleotide; CTC chr11 5210807 5210828 5210812 5210807 -
aaatcgttctccctccggcctc

SEQ ID NO: 146266 - DNA, 22 bp, Artificial Sequence
  Synthetic oligonucleotide; TTC chr11 5210798 5210819 5210803 5210798 -
tccctccggcctcggctgtgat

SEQ ID NO: 146267 - DNA, 22 bp, Artificial Sequence
  Synthetic oligonucleotide; CTC chr11 5210796 5210817 5210801 5210796 -
cctccggcctcggctgtgatta

SEQ ID NO: 146268 - DNA, 22 bp, Artificial Sequence
  Synthetic oligonucleotide; CTC chr11 5210792 5210813 5210797 5210792 -
cggcctcggctgtgattacagg

SEQ ID NO: 146269 - DNA, 22 bp, Artificial Sequence
  Synthetic oligonucleotide; CTC chr11 5210785 5210806 5210790 5210785 -
ggctgtgattacaggtgtgagc

SEQ ID NO: 146270 - DNA, 22 bp, Artificial Sequence
  Synthetic oligonucleotide; CTG chr11 5210780 5210801 5210785 5210780 -
tgattacaggtgtgagccactg

SEQ ID NO: 146271 - DNA, 22 bp, Artificial Sequence
  Synthetic oligonucleotide; TTA chr11 5210774 5210795 5210779 5210774 -
caggtgtgagccactgtgcttg

SEQ ID NO: 146272 - DNA, 22 bp, Artificial Sequence
  Synthetic oligonucleotide; CTG chr11 5210758 5210779 5210763 5210758 -
tgcttggcccagacaacatgaa

SEQ ID NO: 146273 - DNA, 22 bp, Artificial Sequence
  Synthetic oligonucleotide; CTT chr11 5210753 5210774 5210758 5210753 -
ggcccagacaacatgaactgtt

SEQ ID NO: 146274 - DNA, 22 bp, Artificial Sequence
  Synthetic oligonucleotide; TTG chr11 5210752 5210773 5210757 5210752 -
gcccagacaacatgaactgtta

SEQ ID NO: 146275 - DNA, 22 bp, Artificial Sequence
  Synthetic oligonucleotide; CTG chr11 5210733 5210754 5210738 5210733 -
ttactgttattttctaatcctt

SEQ ID NO: 146276 - DNA, 22 bp, Artificial Sequence
  Synthetic oligonucleotide; TTA chr11 5210730 5210751 5210735 5210730 -
ctgttattttctaatccttcga

SEQ ID NO: 146277 - DNA, 22 bp, Artificial Sequence
  Synthetic oligonucleotide; CTG chr11 5210727 5210748 5210732 5210727 -
ttattttctaatccttcgagga

SEQ ID NO: 146278 - DNA, 22 bp, Artificial Sequence
  Synthetic oligonucleotide; TTA chr11 5210724 5210745 5210729 5210724 -
ttttctaatccttcgaggaact

SEQ ID NO: 146279 - DNA, 22 bp, Artificial Sequence
  Synthetic oligonucleotide; TTT chr11 5210721 5210742 5210726 5210721 -
tctaatccttcgaggaactcaa

SEQ ID NO: 146280 - DNA, 22 bp, Artificial Sequence
  Synthetic oligonucleotide; TTT chr11 5210720 5210741 5210725 5210720 -
ctaatccttcgaggaactcaag

SEQ ID NO: 146281 - DNA, 22 bp, Artificial Sequence
  Synthetic oligonucleotide; TTC chr11 5210719 5210740 5210724 5210719 -
taatccttcgaggaactcaagt

SEQ ID NO: 146282 - DNA, 22 bp, Artificial Sequence
  Synthetic oligonucleotide; CTA chr11 5210717 5210738 5210722 5210717 -
atccttcgaggaactcaagtcc

SEQ ID NO: 146283 - DNA, 22 bp, Artificial Sequence
  Synthetic oligonucleotide; CTT chr11 5210711 5210732 5210716 5210711 -
cgaggaactcaagtcctatctt

SEQ ID NO: 146284 - DNA, 22 bp, Artificial Sequence
  Synthetic oligonucleotide; TTC chr11 5210710 5210731 5210715 5210710 -
gaggaactcaagtcctatcttg

SEQ ID NO: 146285 - DNA, 22 bp, Artificial Sequence
  Synthetic oligonucleotide; CTC chr11 5210701 5210722 5210706 5210701 -
aagtcctatcttgaaaactaat

SEQ ID NO: 146286 - DNA, 22 bp, Artificial Sequence
  Synthetic oligonucleotide; CTA chr11 5210693 5210714 5210698 5210693 -
tcttgaaaactaattcaaaagg

SEQ ID NO: 146287 - DNA, 22 bp, Artificial Sequence
  Synthetic oligonucleotide; CTT chr11 5210689 5210710 5210694 5210689 -
gaaaactaattcaaaaggtact

SEQ ID NO: 146288 - DNA, 22 bp, Artificial Sequence
  Synthetic oligonucleotide; TTG chr11 5210688 5210709 5210693 5210688 -
aaaactaattcaaaaggtacta

SEQ ID NO: 146289 - DNA, 22 bp, Artificial Sequence
  Synthetic oligonucleotide; CTA chr11 5210681 5210702 5210686 5210681 -
attcaaaaggtactaacgagat

SEQ ID NO: 146290 - DNA, 22 bp, Artificial Sequence
  Synthetic oligonucleotide; TTC chr11 5210677 5210698 5210682 5210677 -
aaaaggtactaacgagattagg

SEQ ID NO: 146291 - DNA, 22 bp, Artificial Sequence
  Synthetic oligonucleotide; CTA chr11 5210666 5210687 5210671 5210666 -
acgagattaggaagtgccccga

SEQ ID NO: 146292 - DNA, 22 bp, Artificial Sequence
  Synthetic oligonucleotide; TTA chr11 5210657 5210678 5210662 5210657 -
ggaagtgccccgagagagtgca

SEQ ID NO: 146293 - DNA, 22 bp, Artificial Sequence
  Synthetic oligonucleotide; CTG chr11 5210609 5210630 5210614 5210609 -
ggtttgctttgttagtgaagga

SEQ ID NO: 146294 - DNA, 22 bp, Artificial Sequence
  Synthetic oligonucleotide; TTT chr11 5210604 5210625 5210609 5210604 -
gctttgttagtgaaggaataaa

SEQ ID NO: 146295 - DNA, 22 bp, Artificial Sequence
  Synthetic oligonucleotide; TTG chr11 5210603 5210624 5210608 5210603 -
ctttgttagtgaaggaataaaa

SEQ ID NO: 146296 - DNA, 22 bp, Artificial Sequence
  Synthetic oligonucleotide; CTT chr11 5210600 5210621 5210605 5210600 -
tgttagtgaaggaataaaatgc

SEQ ID NO: 146297 - DNA, 22 bp, Artificial Sequence
  Synthetic oligonucleotide; TTT chr11 5210599 5210620 5210604 5210599 -
gttagtgaaggaataaaatgca

SEQ ID NO: 146298 - DNA, 22 bp, Artificial Sequence
  Synthetic oligonucleotide; TTG chr11 5210598 5210619 5210603 5210598 -
ttagtgaaggaataaaatgcat

SEQ ID NO: 146299 - DNA, 22 bp, Artificial Sequence
  Synthetic oligonucleotide; TTA chr11 5210595 5210616 5210600 5210595 -
gtgaaggaataaaatgcatcag

SEQ ID NO: 146300 - DNA, 22 bp, Artificial Sequence
  Synthetic oligonucleotide; CTT chr11 5210561 5210582 5210566 5210561 -
ctcagcctctgataggccctga

SEQ ID NO: 146301 - DNA, 22 bp, Artificial Sequence
  Synthetic oligonucleotide; TTC chr11 5210560 5210581 5210565 5210560 -
tcagcctctgataggccctgag

SEQ ID NO: 146302 - DNA, 22 bp, Artificial Sequence
  Synthetic oligonucleotide; CTC chr11 5210558 5210579 5210563 5210558 -
agcctctgataggccctgagct

SEQ ID NO: 146303 - DNA, 22 bp, Artificial Sequence
  Synthetic oligonucleotide; CTC chr11 5210552 5210573 5210557 5210552 -
tgataggccctgagctgggagc

SEQ ID NO: 146304 - DNA, 22 bp, Artificial Sequence
  Synthetic oligonucleotide; CTG chr11 5210550 5210571 5210555 5210550 -
ataggccctgagctgggagctg

SEQ ID NO: 146305 - DNA, 22 bp, Artificial Sequence
  Synthetic oligonucleotide; CTG chr11 5210540 5210561 5210545 5210540 -
agctgggagctgctaagccatc

SEQ ID NO: 146306 - DNA, 22 bp, Artificial Sequence
  Synthetic oligonucleotide; CTG chr11 5210535 5210556 5210540 5210535 -
ggagctgctaagccatcctgca

SEQ ID NO: 146307 - DNA, 22 bp, Artificial Sequence
  Synthetic oligonucleotide; CTG chr11 5210528 5210549 5210533 5210528 -
ctaagccatcctgcagagcaag

SEQ ID NO: 146308 - DNA, 22 bp, Artificial Sequence
  Synthetic oligonucleotide; CTA chr11 5210525 5210546 5210530 5210525 -
agccatcctgcagagcaagtgg

SEQ ID NO: 146309 - DNA, 22 bp, Artificial Sequence
  Synthetic oligonucleotide; CTG chr11 5210515 5210536 5210520 5210515 -
cagagcaagtgggagaaacaga

SEQ ID NO: 146310 - DNA, 22 bp, Artificial Sequence
  Synthetic oligonucleotide; TTA chr11 5210485 5210506 5210490 5210485 -
ggtcagacttggcagattctgc

SEQ ID NO: 146311 - DNA, 22 bp, Artificial Sequence
  Synthetic oligonucleotide; CTT chr11 5210475 5210496 5210480 5210475 -
ggcagattctgctcctttttcc

SEQ ID NO: 146312 - DNA, 22 bp, Artificial Sequence
  Synthetic oligonucleotide; TTG chr11 5210474 5210495 5210479 5210474 -
gcagattctgctcctttttccc

SEQ ID NO: 146313 - DNA, 22 bp, Artificial Sequence
  Synthetic oligonucleotide; TTC chr11 5210466 5210487 5210471 5210466 -
tgctcctttttcccttcccttt

SEQ ID NO: 146314 - DNA, 22 bp, Artificial Sequence
  Synthetic oligonucleotide; CTG chr11 5210464 5210485 5210469 5210464 -
ctcctttttcccttcccttttc

SEQ ID NO: 146315 - DNA, 22 bp, Artificial Sequence
  Synthetic oligonucleotide; CTC chr11 5210461 5210482 5210466 5210461 -
ctttttcccttcccttttcccc

SEQ ID NO: 146316 - DNA, 22 bp, Artificial Sequence
  Synthetic oligonucleotide; CTT chr11 5210458 5210479 5210463 5210458 -
tttcccttcccttttccccatc

SEQ ID NO: 146317 - DNA, 22 bp, Artificial Sequence
  Synthetic oligonucleotide; TTT chr11 5210457 5210478 5210462 5210457 -
ttcccttcccttttccccatcc

SEQ ID NO: 146318 - DNA, 22 bp, Artificial Sequence
  Synthetic oligonucleotide; TTT chr11 5210456 5210477 5210461 5210456 -
tcccttcccttttccccatcca

SEQ ID NO: 146319 - DNA, 22 bp, Artificial Sequence
  Synthetic oligonucleotide; TTT chr11 5210455 5210476 5210460 5210455 -
cccttcccttttccccatccac

SEQ ID NO: 146320 - DNA, 22 bp, Artificial Sequence
  Synthetic oligonucleotide; TTC chr11 5210454 5210475 5210459 5210454 -
ccttcccttttccccatccact

SEQ ID NO: 146321 - DNA, 22 bp, Artificial Sequence
  Synthetic oligonucleotide; CTT chr11 5210450 5210471 5210455 5210450 -
cccttttccccatccacttgct

SEQ ID NO: 146322 - DNA, 22 bp, Artificial Sequence
  Synthetic oligonucleotide; TTC chr11 5210449 5210470 5210454 5210449 -
ccttttccccatccacttgctc

SEQ ID NO: 146323 - DNA, 22 bp, Artificial Sequence
  Synthetic oligonucleotide; CTT chr11 5210445 5210466 5210450 5210445 -
ttccccatccacttgctcattc

SEQ ID NO: 146324 - DNA, 22 bp, Artificial Sequence
  Synthetic oligonucleotide; TTT chr11 5210444 5210465 5210449 5210444 -
tccccatccacttgctcattct

SEQ ID NO: 146325 - DNA, 22 bp, Artificial Sequence
  Synthetic oligonucleotide; TTT chr11 5210443 5210464 5210448 5210443 -
ccccatccacttgctcattctg

SEQ ID NO: 146326 - DNA, 22 bp, Artificial Sequence
  Synthetic oligonucleotide; TTC chr11 5210442 5210463 5210447 5210442 -
cccatccacttgctcattctgg

SEQ ID NO: 146327 - DNA, 22 bp, Artificial Sequence
  Synthetic oligonucleotide; CTT chr11 5210431 5210452 5210436 5210431 -
gctcattctggatggcaggatt

SEQ ID NO: 146328 - DNA, 22 bp, Artificial Sequence
  Synthetic oligonucleotide; TTG chr11 5210430 5210451 5210435 5210430 -
ctcattctggatggcaggatta

SEQ ID NO: 146329 - DNA, 22 bp, Artificial Sequence
  Synthetic oligonucleotide; CTC chr11 5210427 5210448 5210432 5210427 -
attctggatggcaggattaggc

SEQ ID NO: 146330 - DNA, 22 bp, Artificial Sequence
  Synthetic oligonucleotide; TTC chr11 5210423 5210444 5210428 5210423 -
tggatggcaggattaggcttta

SEQ ID NO: 146331 - DNA, 22 bp, Artificial Sequence
  Synthetic oligonucleotide; CTG chr11 5210421 5210442 5210426 5210421 -
gatggcaggattaggctttata

SEQ ID NO: 146332 - DNA, 22 bp, Artificial Sequence
  Synthetic oligonucleotide; TTA chr11 5210408 5210429 5210413 5210408 -
ggctttatatttccctaccata

SEQ ID NO: 146333 - DNA, 22 bp, Artificial Sequence
  Synthetic oligonucleotide; CTT chr11 5210403 5210424 5210408 5210403 -
tatatttccctaccatattagc

SEQ ID NO: 146334 - DNA, 22 bp, Artificial Sequence
  Synthetic oligonucleotide; TTT chr11 5210402 5210423 5210407 5210402 -
atatttccctaccatattagct

SEQ ID NO: 146335 - DNA, 22 bp, Artificial Sequence
  Synthetic oligonucleotide; TTA chr11 5210401 5210422 5210406 5210401 -
tatttccctaccatattagctt

SEQ ID NO: 146336 - DNA, 22 bp, Artificial Sequence
  Synthetic oligonucleotide; TTT chr11 5210396 5210417 5210401 5210396 -
ccctaccatattagcttgtgca

SEQ ID NO: 146337 - DNA, 22 bp, Artificial Sequence
  Synthetic oligonucleotide; TTC chr11 5210395 5210416 5210400 5210395 -
cctaccatattagcttgtgcac

SEQ ID NO: 146338 - DNA, 22 bp, Artificial Sequence
  Synthetic oligonucleotide; CTA chr11 5210391 5210412 5210396 5210391 -
ccatattagcttgtgcacttaa

SEQ ID NO: 146339 - DNA, 22 bp, Artificial Sequence
  Synthetic oligonucleotide; TTA chr11 5210383 5210404 5210388 5210383 -
gcttgtgcacttaaaggaagtt

SEQ ID NO: 146340 - DNA, 22 bp, Artificial Sequence
  Synthetic oligonucleotide; CTT chr11 5210379 5210400 5210384 5210379 -
gtgcacttaaaggaagtttaga

SEQ ID NO: 146341 - DNA, 22 bp, Artificial Sequence
  Synthetic oligonucleotide; TTG chr11 5210378 5210399 5210383 5210378 -
tgcacttaaaggaagtttagat

SEQ ID NO: 146342 - DNA, 22 bp, Artificial Sequence
  Synthetic oligonucleotide; CTT chr11 5210371 5210392 5210376 5210371 -
aaaggaagtttagatagccttg

SEQ ID NO: 146343 - DNA, 22 bp, Artificial Sequence
  Synthetic oligonucleotide; TTA chr11 5210370 5210391 5210375 5210370 -
aaggaagtttagatagccttga

SEQ ID NO: 146344 - DNA, 22 bp, Artificial Sequence
  Synthetic oligonucleotide; TTT chr11 5210360 5210381 5210365 5210360 -
agatagccttgactccatgggg

SEQ ID NO: 146345 - DNA, 22 bp, Artificial Sequence
  Synthetic oligonucleotide; TTA chr11 5210359 5210380 5210364 5210359 -
gatagccttgactccatgggga

SEQ ID NO: 146346 - DNA, 22 bp, Artificial Sequence
  Synthetic oligonucleotide; CTT chr11 5210350 5210371 5210355 5210350 -
gactccatggggaaaaggaaaa

SEQ ID NO: 146347 - DNA, 22 bp, Artificial Sequence
  Synthetic oligonucleotide; TTG chr11 5210349 5210370 5210354 5210349 -
actccatggggaaaaggaaaaa

SEQ ID NO: 146348 - DNA, 22 bp, Artificial Sequence
  Synthetic oligonucleotide; CTC chr11 5210345 5210366 5210350 5210345 -
catggggaaaaggaaaaagtac

SEQ ID NO: 146349 - DNA, 22 bp, Artificial Sequence
  Synthetic oligonucleotide; TTT chr11 5210319 5210340 5210324 5210319 -
agtggggtgtgggactgttgga

SEQ ID NO: 146350 - DNA, 22 bp, Artificial Sequence
  Synthetic oligonucleotide; TTA chr11 5210318 5210339 5210323 5210318 -
gtggggtgtgggactgttggat

SEQ ID NO: 146351 - DNA, 22 bp, Artificial Sequence
  Synthetic oligonucleotide; CTG chr11 5210302 5210323 5210307 5210302 -
ttggattattagatgtcttgca

SEQ ID NO: 146352 - DNA, 22 bp, Artificial Sequence
  Synthetic oligonucleotide; TTG chr11 5210299 5210320 5210304 5210299 -
gattattagatgtcttgcattt

SEQ ID NO: 146353 - DNA, 22 bp, Artificial Sequence
  Synthetic oligonucleotide; TTA chr11 5210294 5210315 5210299 5210294 -
ttagatgtcttgcatttctctc

SEQ ID NO: 146354 - DNA, 22 bp, Artificial Sequence
  Synthetic oligonucleotide; TTA chr11 5210291 5210312 5210296 5210291 -
gatgtcttgcatttctctcatt

SEQ ID NO: 146355 - DNA, 22 bp, Artificial Sequence
  Synthetic oligonucleotide; CTT chr11 5210283 5210304 5210288 5210283 -
gcatttctctcattctgttcca

SEQ ID NO: 146356 - DNA, 22 bp, Artificial Sequence
  Synthetic oligonucleotide; TTG chr11 5210282 5210303 5210287 5210282 -
catttctctcattctgttccag

SEQ ID NO: 146357 - DNA, 22 bp, Artificial Sequence
  Synthetic oligonucleotide; TTT chr11 5210277 5210298 5210282 5210277 -
ctctcattctgttccagttgag

SEQ ID NO: 146358 - DNA, 22 bp, Artificial Sequence
  Synthetic oligonucleotide; TTC chr11 5210276 5210297 5210281 5210276 -
tctcattctgttccagttgagg

SEQ ID NO: 146359 - DNA, 22 bp, Artificial Sequence
  Synthetic oligonucleotide; CTC chr11 5210274 5210295 5210279 5210274 -
tcattctgttccagttgaggcc

SEQ ID NO: 146360 - DNA, 22 bp, Artificial Sequence
  Synthetic oligonucleotide; CTC chr11 5210272 5210293 5210277 5210272 -
attctgttccagttgaggccag

SEQ ID NO: 146361 - DNA, 22 bp, Artificial Sequence
  Synthetic oligonucleotide; TTC chr11 5210268 5210289 5210273 5210268 -
tgttccagttgaggccagcttg

SEQ ID NO: 146362 - DNA, 22 bp, Artificial Sequence
  Synthetic oligonucleotide; CTG chr11 5210266 5210287 5210271 5210266 -
ttccagttgaggccagcttgct

SEQ ID NO: 146363 - DNA, 22 bp, Artificial Sequence
  Synthetic oligonucleotide; TTC chr11 5210263 5210284 5210268 5210263 -
cagttgaggccagcttgcttcc

SEQ ID NO: 146364 - DNA, 22 bp, Artificial Sequence
  Synthetic oligonucleotide; TTG chr11 5210257 5210278 5210262 5210257 -
aggccagcttgcttcccactag

SEQ ID NO: 146365 - DNA, 22 bp, Artificial Sequence
  Synthetic oligonucleotide; CTT chr11 5210247 5210268 5210252 5210247 -
gcttcccactagaagaataact

SEQ ID NO: 146366 - DNA, 22 bp, Artificial Sequence
  Synthetic oligonucleotide; TTG chr11 5210246 5210267 5210251 5210246 -
cttcccactagaagaataactg

SEQ ID NO: 146367 - DNA, 22 bp, Artificial Sequence
  Synthetic oligonucleotide; CTT chr11 5210243 5210264 5210248 5210243 -
cccactagaagaataactgttc

SEQ ID NO: 146368 - DNA, 22 bp, Artificial Sequence
  Synthetic oligonucleotide; TTC chr11 5210242 5210263 5210247 5210242 -
ccactagaagaataactgttct

SEQ ID NO: 146369 - DNA, 22 bp, Artificial Sequence
  Synthetic oligonucleotide; CTA chr11 5210236 5210257 5210241 5210236 -
gaagaataactgttctctttat

SEQ ID NO: 146370 - DNA, 22 bp, Artificial Sequence
  Synthetic oligonucleotide; CTG chr11 5210224 5210245 5210229 5210224 -
ttctctttatacaattcctagt

SEQ ID NO: 146371 - DNA, 22 bp, Artificial Sequence
  Synthetic oligonucleotide; TTC chr11 5210221 5210242 5210226 5210221 -
tctttatacaattcctagtcaa

SEQ ID NO: 146372 - DNA, 22 bp, Artificial Sequence
  Synthetic oligonucleotide; CTC chr11 5210219 5210240 5210224 5210219 -
tttatacaattcctagtcaagt

SEQ ID NO: 146373 - DNA, 22 bp, Artificial Sequence
  Synthetic oligonucleotide; CTT chr11 5210217 5210238 5210222 5210217 -
tatacaattcctagtcaagtag

SEQ ID NO: 146374 - DNA, 22 bp, Artificial Sequence
  Synthetic oligonucleotide; TTT chr11 5210216 5210237 5210221 5210216 -
atacaattcctagtcaagtagg

SEQ ID NO: 146375 - DNA, 22 bp, Artificial Sequence
  Synthetic oligonucleotide; TTA chr11 5210215 5210236 5210220 5210215 -
tacaattcctagtcaagtaggg

SEQ ID NO: 146376 - DNA, 22 bp, Artificial Sequence
  Synthetic oligonucleotide; TTC chr11 5210207 5210228 5210212 5210207 -
ctagtcaagtaggggcaaaaag

SEQ ID NO: 146377 - DNA, 22 bp, Artificial Sequence
  Synthetic oligonucleotide; CTA chr11 5210204 5210225 5210209 5210204 -
gtcaagtaggggcaaaaagtat

SEQ ID NO: 146378 - DNA, 22 bp, Artificial Sequence
  Synthetic oligonucleotide; TTT chr11 5210180 5210201 5210185 5210180 -
tcatttattattgtttttctgg

SEQ ID NO: 146379 - DNA, 22 bp, Artificial Sequence
  Synthetic oligonucleotide; TTT chr11 5210179 5210200 5210184 5210179 -
catttattattgtttttctggg

SEQ ID NO: 146380 - DNA, 22 bp, Artificial Sequence
  Synthetic oligonucleotide; TTC chr11 5210178 5210199 5210183 5210178 -
atttattattgtttttctggga

SEQ ID NO: 146381 - DNA, 22 bp, Artificial Sequence
  Synthetic oligonucleotide; TTT chr11 5210174 5210195 5210179 5210174 -
attattgtttttctgggatgta

SEQ ID NO: 146382 - DNA, 22 bp, Artificial Sequence
  Synthetic oligonucleotide; TTA chr11 5210173 5210194 5210178 5210173 -
ttattgtttttctgggatgtag

SEQ ID NO: 146383 - DNA, 22 bp, Artificial Sequence
  Synthetic oligonucleotide; TTA chr11 5210170 5210191 5210175 5210170 -
ttgtttttctgggatgtagcca

SEQ ID NO: 146384 - DNA, 22 bp, Artificial Sequence
  Synthetic oligonucleotide; TTG chr11 5210167 5210188 5210172 5210167 -
tttttctgggatgtagccagga

SEQ ID NO: 146385 - DNA, 22 bp, Artificial Sequence
  Synthetic oligonucleotide; TTT chr11 5210164 5210185 5210169 5210164 -
ttctgggatgtagccaggagca

SEQ ID NO: 146386 - DNA, 22 bp, Artificial Sequence
  Synthetic oligonucleotide; TTT chr11 5210163 5210184 5210168 5210163 -
tctgggatgtagccaggagcaa

SEQ ID NO: 146387 - DNA, 22 bp, Artificial Sequence
  Synthetic oligonucleotide; TTT chr11 5210162 5210183 5210167 5210162 -
ctgggatgtagccaggagcaat

SEQ ID NO: 146388 - DNA, 22 bp, Artificial Sequence
  Synthetic oligonucleotide; TTC chr11 5210161 5210182 5210166 5210161 -
tgggatgtagccaggagcaatt

SEQ ID NO: 146389 - DNA, 22 bp, Artificial Sequence
  Synthetic oligonucleotide; CTG chr11 5210159 5210180 5210164 5210159 -
ggatgtagccaggagcaattta

SEQ ID NO: 146390 - DNA, 22 bp, Artificial Sequence
  Synthetic oligonucleotide; TTT chr11 5210138 5210159 5210143 5210138 -
aaacttgctggagtgcaatttc

SEQ ID NO: 146391 - DNA, 22 bp, Artificial Sequence
  Synthetic oligonucleotide; TTA chr11 5210137 5210158 5210142 5210137 -
aacttgctggagtgcaatttct

SEQ ID NO: 146392 - DNA, 22 bp, Artificial Sequence
  Synthetic oligonucleotide; CTT chr11 5210132 5210153 5210137 5210132 -
gctggagtgcaatttcttcaac

SEQ ID NO: 146393 - DNA, 22 bp, Artificial Sequence
  Synthetic oligonucleotide; TTG chr11 5210131 5210152 5210136 5210131 -
ctggagtgcaatttcttcaact

SEQ ID NO: 146394 - DNA, 22 bp, Artificial Sequence
  Synthetic oligonucleotide; CTG chr11 5210128 5210149 5210133 5210128 -
gagtgcaatttcttcaactaca

SEQ ID NO: 146395 - DNA, 22 bp, Artificial Sequence
  Synthetic oligonucleotide; TTT chr11 5210117 5210138 5210122 5210117 -
cttcaactacaaatgagaataa

SEQ ID NO: 146396 - DNA, 22 bp, Artificial Sequence
  Synthetic oligonucleotide; TTC chr11 5210116 5210137 5210121 5210116 -
ttcaactacaaatgagaataat

SEQ ID NO: 146397 - DNA, 22 bp, Artificial Sequence
  Synthetic oligonucleotide; CTT chr11 5210114 5210135 5210119 5210114 -
caactacaaatgagaataataa

SEQ ID NO: 146398 - DNA, 22 bp, Artificial Sequence
  Synthetic oligonucleotide; TTC chr11 5210113 5210134 5210118 5210113 -
aactacaaatgagaataataat

SEQ ID NO: 146399 - DNA, 22 bp, Artificial Sequence
  Synthetic oligonucleotide; CTA chr11 5210108 5210129 5210113 5210108 -
caaatgagaataataataacag

SEQ ID NO: 146400 - DNA, 22 bp, Artificial Sequence
  Synthetic oligonucleotide; CTA chr11 5210081 5210102 5210086 5210081 -
cgaactaattgtaataatacag

SEQ ID NO: 146401 - DNA, 22 bp, Artificial Sequence
  Synthetic oligonucleotide; CTA chr11 5210074 5210095 5210079 5210074 -
attgtaataatacagaactaaa

SEQ ID NO: 146402 - DNA, 22 bp, Artificial Sequence
  Synthetic oligonucleotide; TTG chr11 5210070 5210091 5210075 5210070 -
taataatacagaactaaatgta

SEQ ID NO: 146403 - DNA, 22 bp, Artificial Sequence
  Synthetic oligonucleotide; CTA chr11 5210054 5210075 5210059 5210054 -
aatgtaaatatacaaaggataa

SEQ ID NO: 146404 - DNA, 22 bp, Artificial Sequence
  Synthetic oligonucleotide; TTC chr11 5210028 5210049 5210033 5210028 -
aaaatctgggcacatgcaggct

SEQ ID NO: 146405 - DNA, 22 bp, Artificial Sequence
  Synthetic oligonucleotide; CTG chr11 5210020 5210041 5210025 5210020 -
ggcacatgcaggctgctataag

SEQ ID NO: 146406 - DNA, 22 bp, Artificial Sequence
  Synthetic oligonucleotide; CTG chr11 5210005 5210026 5210010 5210005 -
ctataagagaaaacatctatga

SEQ ID NO: 146407 - DNA, 22 bp, Artificial Sequence
  Synthetic oligonucleotide; CTA chr11 5210002 5210023 5210007 5210002 -
taagagaaaacatctatgatat

SEQ ID NO: 146408 - DNA, 22 bp, Artificial Sequence
  Synthetic oligonucleotide; CTA chr11 5209986 5210007 5209991 5209986 -
tgatattataggttgaccaaat

SEQ ID NO: 146409 - DNA, 22 bp, Artificial Sequence
  Synthetic oligonucleotide; TTA chr11 5209978 5209999 5209983 5209978 -
taggttgaccaaatgacattaa

SEQ ID NO: 146410 - DNA, 22 bp, Artificial Sequence
  Synthetic oligonucleotide; TTG chr11 5209971 5209992 5209976 5209971 -
accaaatgacattaaattatag

SEQ ID NO: 146411 - DNA, 22 bp, Artificial Sequence
  Synthetic oligonucleotide; TTA chr11 5209957 5209978 5209962 5209957 -
aattatagtggggaggtaaaca

SEQ ID NO: 146412 - DNA, 22 bp, Artificial Sequence
  Synthetic oligonucleotide; TTA chr11 5209952 5209973 5209957 5209952 -
tagtggggaggtaaacaggttg

SEQ ID NO: 146413 - DNA, 22 bp, Artificial Sequence
  Synthetic oligonucleotide; TTG chr11 5209930 5209951 5209935 5209930 -
gcagtgtattttaaagttgaac

SEQ ID NO: 146414 - DNA, 22 bp, Artificial Sequence
  Synthetic oligonucleotide; TTT chr11 5209919 5209940 5209924 5209919 -
taaagttgaacatatgcatatt

SEQ ID NO: 146415 - DNA, 22 bp, Artificial Sequence
  Synthetic oligonucleotide; TTT chr11 5209918 5209939 5209923 5209918 -
aaagttgaacatatgcatattt

SEQ ID NO: 146416 - DNA, 22 bp, Artificial Sequence
  Synthetic oligonucleotide; TTA chr11 5209917 5209938 5209922 5209917 -
aagttgaacatatgcatatttt

SEQ ID NO: 146417 - DNA, 22 bp, Artificial Sequence
  Synthetic oligonucleotide; TTG chr11 5209911 5209932 5209916 5209911 -
aacatatgcatattttatgacc

SEQ ID NO: 146418 - DNA, 22 bp, Artificial Sequence
  Synthetic oligonucleotide; TTT chr11 5209896 5209917 5209901 5209896 -
tatgacctagcaatttacagaa

SEQ ID NO: 146419 - DNA, 22 bp, Artificial Sequence
  Synthetic oligonucleotide; TTT chr11 5209895 5209916 5209900 5209895 -
atgacctagcaatttacagaat

SEQ ID NO: 146420 - DNA, 22 bp, Artificial Sequence
  Synthetic oligonucleotide; TTA chr11 5209894 5209915 5209899 5209894 -
tgacctagcaatttacagaata

SEQ ID NO: 146421 - DNA, 22 bp, Artificial Sequence
  Synthetic oligonucleotide; CTA chr11 5209887 5209908 5209892 5209887 -
gcaatttacagaatatatatac

SEQ ID NO: 146422 - DNA, 22 bp, Artificial Sequence
  Synthetic oligonucleotide; TTT chr11 5209880 5209901 5209885 5209880 -
acagaatatatatacaaaaata

SEQ ID NO: 146423 - DNA, 22 bp, Artificial Sequence
  Synthetic oligonucleotide; TTA chr11 5209879 5209900 5209884 5209879 -
cagaatatatatacaaaaatat

SEQ ID NO: 146424 - DNA, 22 bp, Artificial Sequence
  Synthetic oligonucleotide; CTT chr11 5209846 5209867 5209851 5209846 -
catagcagcaatttatattata

SEQ ID NO: 146425 - DNA, 22 bp, Artificial Sequence
  Synthetic oligonucleotide; TTC chr11 5209845 5209866 5209850 5209845 -
atagcagcaatttatattatag

SEQ ID NO: 146426 - DNA, 22 bp, Artificial Sequence
  Synthetic oligonucleotide; TTT chr11 5209832 5209853 5209837 5209832 -
atattatagccaaaagctagaa

SEQ ID NO: 146427 - DNA, 22 bp, Artificial Sequence
  Synthetic oligonucleotide; TTA chr11 5209831 5209852 5209836 5209831 -
tattatagccaaaagctagaag

SEQ ID NO: 146428 - DNA, 22 bp, Artificial Sequence
  Synthetic oligonucleotide; TTA chr11 5209826 5209847 5209831 5209826 -
tagccaaaagctagaaggtact

SEQ ID NO: 146429 - DNA, 22 bp, Artificial Sequence
  Synthetic oligonucleotide; CTA chr11 5209813 5209834 5209818 5209813 -
gaaggtactcaaatatctatca

SEQ ID NO: 146430 - DNA, 22 bp, Artificial Sequence
  Synthetic oligonucleotide; CTC chr11 5209803 5209824 5209808 5209803 -
aaatatctatcaactgtggagt

SEQ ID NO: 146431 - DNA, 22 bp, Artificial Sequence
  Synthetic oligonucleotide; CTA chr11 5209794 5209815 5209799 5209794 -
tcaactgtggagtcaataaata

SEQ ID NO: 146432 - DNA, 22 bp, Artificial Sequence
  Synthetic oligonucleotide; CTG chr11 5209787 5209808 5209792 5209787 -
tggagtcaataaatatattgtg

SEQ ID NO: 146433 - DNA, 22 bp, Artificial Sequence
  Synthetic oligonucleotide; TTG chr11 5209767 5209788 5209772 5209767 -
tggtatatacataaaatagaat

SEQ ID NO: 146434 - DNA, 22 bp, Artificial Sequence
  Synthetic oligonucleotide; TTC chr11 5209738 5209759 5209743 5209738 -
agaaatgaaaaatcaactacag

SEQ ID NO: 146435 - DNA, 22 bp, Artificial Sequence
  Synthetic oligonucleotide; CTA chr11 5209719 5209740 5209724 5209719 -
cagtcatacactagtatgaatg

SEQ ID NO: 146436 - DNA, 22 bp, Artificial Sequence
  Synthetic oligonucleotide; CTA chr11 5209706 5209727 5209711 5209706 -
gtatgaatgcaattcacaaaca

SEQ ID NO: 146437 - DNA, 22 bp, Artificial Sequence
  Synthetic oligonucleotide; TTC chr11 5209691 5209712 5209696 5209691 -
acaaacataatattgaataaag

SEQ ID NO: 146438 - DNA, 22 bp, Artificial Sequence
  Synthetic oligonucleotide; TTG chr11 5209676 5209697 5209681 5209676 -
aataaagtcagacataagcaac

SEQ ID NO: 146439 - DNA, 22 bp, Artificial Sequence
  Synthetic oligonucleotide; TTC chr11 5209642 5209663 5209647 5209642 -
aatgtatacacacttttaaaaa

SEQ ID NO: 146440 - DNA, 22 bp, Artificial Sequence
  Synthetic oligonucleotide; CTT chr11 5209627 5209648 5209632 5209627 -
ttaaaaaaagggacatgagtca

SEQ ID NO: 146441 - DNA, 22 bp, Artificial Sequence
  Synthetic oligonucleotide; TTT chr11 5209626 5209647 5209631 5209626 -
taaaaaaagggacatgagtcaa

SEQ ID NO: 146442 - DNA, 22 bp, Artificial Sequence
  Synthetic oligonucleotide; TTT chr11 5209625 5209646 5209630 5209625 -
aaaaaaagggacatgagtcaat

SEQ ID NO: 146443 - DNA, 22 bp, Artificial Sequence
  Synthetic oligonucleotide; TTA chr11 5209624 5209645 5209629 5209624 -
aaaaaagggacatgagtcaatc

SEQ ID NO: 146444 - DNA, 22 bp, Artificial Sequence
  Synthetic oligonucleotide; TTA chr11 5209585 5209606 5209590 5209585 -
tatcaggataattattaacttt

SEQ ID NO: 146445 - DNA, 22 bp, Artificial Sequence
  Synthetic oligonucleotide; TTA chr11 5209571 5209592 5209576 5209571 -
ttaactttggagacaattagtg

SEQ ID NO: 146446 - DNA, 22 bp, Artificial Sequence
  Synthetic oligonucleotide; TTA chr11 5209568 5209589 5209573 5209568 -
actttggagacaattagtggaa

SEQ ID NO: 146447 - DNA, 22 bp, Artificial Sequence
  Synthetic oligonucleotide; CTT chr11 5209564 5209585 5209569 5209564 -
tggagacaattagtggaatgat

SEQ ID NO: 146448 - DNA, 22 bp, Artificial Sequence
  Synthetic oligonucleotide; TTT chr11 5209563 5209584 5209568 5209563 -
ggagacaattagtggaatgata

SEQ ID NO: 146449 - DNA, 22 bp, Artificial Sequence
  Synthetic oligonucleotide; TTG chr11 5209562 5209583 5209567 5209562 -
gagacaattagtggaatgataa

SEQ ID NO: 146450 - DNA, 22 bp, Artificial Sequence
  Synthetic oligonucleotide; TTA chr11 5209552 5209573 5209557 5209552 -
gtggaatgataaagagtgagca

SEQ ID NO: 146451 - DNA, 22 bp, Artificial Sequence
  Synthetic oligonucleotide; TTT chr11 5209523 5209544 5209528 5209523 -
actctttaatttcctatcttat

SEQ ID NO: 146452 - DNA, 22 bp, Artificial Sequence
  Synthetic oligonucleotide; TTA chr11 5209522 5209543 5209527 5209522 -
ctctttaatttcctatcttatt

SEQ ID NO: 146453 - DNA, 22 bp, Artificial Sequence
  Synthetic oligonucleotide; CTC chr11 5209519 5209540 5209524 5209519 -
tttaatttcctatcttattagt

SEQ ID NO: 146454 - DNA, 22 bp, Artificial Sequence
  Synthetic oligonucleotide; CTT chr11 5209517 5209538 5209522 5209517 -
taatttcctatcttattagttg

SEQ ID NO: 146455 - DNA, 22 bp, Artificial Sequence
  Synthetic oligonucleotide; TTT chr11 5209516 5209537 5209521 5209516 -
aatttcctatcttattagttgt

SEQ ID NO: 146456 - DNA, 22 bp, Artificial Sequence
  Synthetic oligonucleotide; TTA chr11 5209515 5209536 5209520 5209515 -
atttcctatcttattagttgtt

SEQ ID NO: 146457 - DNA, 22 bp, Artificial Sequence
  Synthetic oligonucleotide; TTT chr11 5209511 5209532 5209516 5209511 -
cctatcttattagttgttacat

SEQ ID NO: 146458 - DNA, 22 bp, Artificial Sequence
  Synthetic oligonucleotide; TTC chr11 5209510 5209531 5209515 5209510 -
ctatcttattagttgttacatg

SEQ ID NO: 146459 - DNA, 22 bp, Artificial Sequence
  Synthetic oligonucleotide; CTA chr11 5209507 5209528 5209512 5209507 -
tcttattagttgttacatgggt

SEQ ID NO: 146460 - DNA, 22 bp, Artificial Sequence
  Synthetic oligonucleotide; CTT chr11 5209503 5209524 5209508 5209503 -
attagttgttacatgggtgtgt

SEQ ID NO: 146461 - DNA, 22 bp, Artificial Sequence
  Synthetic oligonucleotide; TTA chr11 5209502 5209523 5209507 5209502 -
ttagttgttacatgggtgtgtt

SEQ ID NO: 146462 - DNA, 22 bp, Artificial Sequence
  Synthetic oligonucleotide; TTA chr11 5209499 5209520 5209504 5209499 -
gttgttacatgggtgtgttcac

SEQ ID NO: 146463 - DNA, 22 bp, Artificial Sequence
  Synthetic oligonucleotide; TTG chr11 5209495 5209516 5209500 5209495 -
ttacatgggtgtgttcaccttc

SEQ ID NO: 146464 - DNA, 22 bp, Artificial Sequence
  Synthetic oligonucleotide; TTA chr11 5209492 5209513 5209497 5209492 -
catgggtgtgttcaccttccaa

SEQ ID NO: 146465 - DNA, 22 bp, Artificial Sequence
  Synthetic oligonucleotide; TTC chr11 5209479 5209500 5209484 5209479 -
accttccaaaagttaattcagc

SEQ ID NO: 146466 - DNA, 22 bp, Artificial Sequence
  Synthetic oligonucleotide; CTT chr11 5209474 5209495 5209479 5209474 -
ccaaaagttaattcagctgtgc

SEQ ID NO: 146467 - DNA, 22 bp, Artificial Sequence
  Synthetic oligonucleotide; TTC chr11 5209473 5209494 5209478 5209473 -
caaaagttaattcagctgtgca

SEQ ID NO: 146468 - DNA, 22 bp, Artificial Sequence
  Synthetic oligonucleotide; TTA chr11 5209464 5209485 5209469 5209464 -
attcagctgtgcatgtataatt

SEQ ID NO: 146469 - DNA, 22 bp, Artificial Sequence
  Synthetic oligonucleotide; TTC chr11 5209460 5209481 5209465 5209460 -
agctgtgcatgtataatttgtg

SEQ ID NO: 146470 - DNA, 22 bp, Artificial Sequence
  Synthetic oligonucleotide; CTG chr11 5209455 5209476 5209460 5209455 -
tgcatgtataatttgtgtactt

SEQ ID NO: 146471 - DNA, 22 bp, Artificial Sequence
  Synthetic oligonucleotide; TTT chr11 5209441 5209462 5209446 5209441 -
gtgtacttttatatatgcatgc

SEQ ID NO: 146472 - DNA, 22 bp, Artificial Sequence
  Synthetic oligonucleotide; TTG chr11 5209440 5209461 5209445 5209440 -
tgtacttttatatatgcatgct

SEQ ID NO: 146473 - DNA, 22 bp, Artificial Sequence
  Synthetic oligonucleotide; CTT chr11 5209433 5209454 5209438 5209433 -
ttatatatgcatgctgtactta

SEQ ID NO: 146474 - DNA, 22 bp, Artificial Sequence
  Synthetic oligonucleotide; TTT chr11 5209432 5209453 5209437 5209432 -
tatatatgcatgctgtacttaa

SEQ ID NO: 146475 - DNA, 22 bp, Artificial Sequence
  Synthetic oligonucleotide; TTT chr11 5209431 5209452 5209436 5209431 -
atatatgcatgctgtacttaaa

SEQ ID NO: 146476 - DNA, 22 bp, Artificial Sequence
  Synthetic oligonucleotide; TTA chr11 5209430 5209451 5209435 5209430 -
tatatgcatgctgtacttaaaa

SEQ ID NO: 146477 - DNA, 22 bp, Artificial Sequence
  Synthetic oligonucleotide; CTG chr11 5209417 5209438 5209422 5209417 -
tacttaaaatattaaaataaaa

SEQ ID NO: 146478 - DNA, 22 bp, Artificial Sequence
  Synthetic oligonucleotide; CTT chr11 5209412 5209433 5209417 5209412 -
aaaatattaaaataaaaactaa

SEQ ID NO: 146479 - DNA, 22 bp, Artificial Sequence
  Synthetic oligonucleotide; TTA chr11 5209411 5209432 5209416 5209411 -
aaatattaaaataaaaactaaa

SEQ ID NO: 146480 - DNA, 22 bp, Artificial Sequence
  Synthetic oligonucleotide; TTA chr11 5209403 5209424 5209408 5209403 -
aaataaaaactaaatttagaaa

SEQ ID NO: 146481 - DNA, 22 bp, Artificial Sequence
  Synthetic oligonucleotide; CTA chr11 5209391 5209412 5209396 5209391 -
aatttagaaactaaacaatgga

SEQ ID NO: 146482 - DNA, 22 bp, Artificial Sequence
  Synthetic oligonucleotide; TTT chr11 5209386 5209407 5209391 5209386 -
agaaactaaacaatggaaaaaa

SEQ ID NO: 146483 - DNA, 22 bp, Artificial Sequence
  Synthetic oligonucleotide; TTA chr11 5209385 5209406 5209390 5209385 -
gaaactaaacaatggaaaaaag

SEQ ID NO: 146484 - DNA, 22 bp, Artificial Sequence
  Synthetic oligonucleotide; CTA chr11 5209378 5209399 5209383 5209378 -
aacaatggaaaaaagtcagacc

SEQ ID NO: 146485 - DNA, 22 bp, Artificial Sequence
  Synthetic oligonucleotide; TTT chr11 5209352 5209373 5209357 5209352 -
ctttgcatttcaagaagtgcat

SEQ ID NO: 146486 - DNA, 22 bp, Artificial Sequence
  Synthetic oligonucleotide; TTC chr11 5209351 5209372 5209356 5209351 -
tttgcatttcaagaagtgcata

SEQ ID NO: 146487 - DNA, 22 bp, Artificial Sequence
  Synthetic oligonucleotide; CTT chr11 5209349 5209370 5209354 5209349 -
tgcatttcaagaagtgcatact

SEQ ID NO: 146488 - DNA, 22 bp, Artificial Sequence
  Synthetic oligonucleotide; TTT chr11 5209348 5209369 5209353 5209348 -
gcatttcaagaagtgcatacta

SEQ ID NO: 146489 - DNA, 22 bp, Artificial Sequence
  Synthetic oligonucleotide; TTG chr11 5209347 5209368 5209352 5209347 -
catttcaagaagtgcatactaa

SEQ ID NO: 146490 - DNA, 22 bp, Artificial Sequence
  Synthetic oligonucleotide; TTT chr11 5209342 5209363 5209347 5209342 -
caagaagtgcatactaactgag

SEQ ID NO: 146491 - DNA, 22 bp, Artificial Sequence
  Synthetic oligonucleotide; TTC chr11 5209341 5209362 5209346 5209341 -
aagaagtgcatactaactgaga

SEQ ID NO: 146492 - DNA, 22 bp, Artificial Sequence
  Synthetic oligonucleotide; CTA chr11 5209326 5209347 5209331 5209326 -
actgagatattacattcttaaa

SEQ ID NO: 146493 - DNA, 22 bp, Artificial Sequence
  Synthetic oligonucleotide; CTG chr11 5209322 5209343 5209327 5209322 -
agatattacattcttaaatggc

SEQ ID NO: 146494 - DNA, 22 bp, Artificial Sequence
  Synthetic oligonucleotide; TTA chr11 5209314 5209335 5209319 5209314 -
cattcttaaatggctttagtca

SEQ ID NO: 146495 - DNA, 22 bp, Artificial Sequence
  Synthetic oligonucleotide; TTC chr11 5209309 5209330 5209314 5209309 -
ttaaatggctttagtcaattag

SEQ ID NO: 146496 - DNA, 22 bp, Artificial Sequence
  Synthetic oligonucleotide; CTT chr11 5209307 5209328 5209312 5209307 -
aaatggctttagtcaattaggc

SEQ ID NO: 146497 - DNA, 22 bp, Artificial Sequence
  Synthetic oligonucleotide; TTA chr11 5209306 5209327 5209311 5209306 -
aatggctttagtcaattaggct

SEQ ID NO: 146498 - DNA, 22 bp, Artificial Sequence
  Synthetic oligonucleotide; CTT chr11 5209298 5209319 5209303 5209298 -
tagtcaattaggctttaaattt

SEQ ID NO: 146499 - DNA, 22 bp, Artificial Sequence
  Synthetic oligonucleotide; TTT chr11 5209297 5209318 5209302 5209297 -
agtcaattaggctttaaatttc

SEQ ID NO: 146500 - DNA, 22 bp, Artificial Sequence
  Synthetic oligonucleotide; TTA chr11 5209296 5209317 5209301 5209296 -
gtcaattaggctttaaatttca

SEQ ID NO: 146501 - DNA, 22 bp, Artificial Sequence
  Synthetic oligonucleotide; TTA chr11 5209288 5209309 5209293 5209288 -
ggctttaaatttcaccactata

SEQ ID NO: 146502 - DNA, 22 bp, Artificial Sequence
  Synthetic oligonucleotide; CTT chr11 5209283 5209304 5209288 5209283 -
taaatttcaccactatataaac

SEQ ID NO: 146503 - DNA, 22 bp, Artificial Sequence
  Synthetic oligonucleotide; TTT chr11 5209282 5209303 5209287 5209282 -
aaatttcaccactatataaaca

SEQ ID NO: 146504 - DNA, 22 bp, Artificial Sequence
  Synthetic oligonucleotide; TTA chr11 5209281 5209302 5209286 5209281 -
aatttcaccactatataaacat

SEQ ID NO: 146505 - DNA, 22 bp, Artificial Sequence
  Synthetic oligonucleotide; TTT chr11 5209276 5209297 5209281 5209276 -
caccactatataaacatttgct

SEQ ID NO: 146506 - DNA, 22 bp, Artificial Sequence
  Synthetic oligonucleotide; TTC chr11 5209275 5209296 5209280 5209275 -
accactatataaacatttgctt

SEQ ID NO: 146507 - DNA, 22 bp, Artificial Sequence
  Synthetic oligonucleotide; CTA chr11 5209268 5209289 5209273 5209268 -
tataaacatttgcttctaaatc

SEQ ID NO: 146508 - DNA, 22 bp, Artificial Sequence
  Synthetic oligonucleotide; TTT chr11 5209257 5209278 5209262 5209257 -
gcttctaaatctaggtagactg

SEQ ID NO: 146509 - DNA, 22 bp, Artificial Sequence
  Synthetic oligonucleotide; TTG chr11 5209256 5209277 5209261 5209256 -
cttctaaatctaggtagactgt

SEQ ID NO: 146510 - DNA, 22 bp, Artificial Sequence
  Synthetic oligonucleotide; CTT chr11 5209253 5209274 5209258 5209253 -
ctaaatctaggtagactgtctt

SEQ ID NO: 146511 - DNA, 22 bp, Artificial Sequence
  Synthetic oligonucleotide; TTC chr11 5209252 5209273 5209257 5209252 -
taaatctaggtagactgtctta

SEQ ID NO: 146512 - DNA, 22 bp, Artificial Sequence
  Synthetic oligonucleotide; CTA chr11 5209250 5209271 5209255 5209250 -
aatctaggtagactgtcttaac

SEQ ID NO: 146513 - DNA, 22 bp, Artificial Sequence
  Synthetic oligonucleotide; CTA chr11 5209244 5209265 5209249 5209244 -
ggtagactgtcttaacttcctg

SEQ ID NO: 146514 - DNA, 22 bp, Artificial Sequence
  Synthetic oligonucleotide; CTG chr11 5209235 5209256 5209240 5209235 -
tcttaacttcctgaagaagagg

SEQ ID NO: 146515 - DNA, 22 bp, Artificial Sequence
  Synthetic oligonucleotide; CTT chr11 5209231 5209252 5209236 5209231 -
aacttcctgaagaagagggaag

SEQ ID NO: 146516 - DNA, 22 bp, Artificial Sequence
  Synthetic oligonucleotide; TTA chr11 5209230 5209251 5209235 5209230 -
acttcctgaagaagagggaaga

SEQ ID NO: 146517 - DNA, 22 bp, Artificial Sequence
  Synthetic oligonucleotide; CTT chr11 5209226 5209247 5209231 5209226 -
cctgaagaagagggaagaaata

SEQ ID NO: 146518 - DNA, 22 bp, Artificial Sequence
  Synthetic oligonucleotide; TTC chr11 5209225 5209246 5209230 5209225 -
ctgaagaagagggaagaaataa

SEQ ID NO: 146519 - DNA, 22 bp, Artificial Sequence
  Synthetic oligonucleotide; CTG chr11 5209222 5209243 5209227 5209222 -
aagaagagggaagaaataatga

SEQ ID NO: 146520 - DNA, 22 bp, Artificial Sequence
  Synthetic oligonucleotide; CTA chr11 5209174 5209195 5209179 5209174 -
gaggagggaaataaaaagccta

SEQ ID NO: 146521 - DNA, 22 bp, Artificial Sequence
  Synthetic oligonucleotide; CTA chr11 5209152 5209173 5209157 5209152 -
ggaaagcaacatgaaaagatgg

SEQ ID NO: 146522 - DNA, 22 bp, Artificial Sequence
  Synthetic oligonucleotide; CTC chr11 5209125 5209146 5209130 5209125 -
tctggtacatcctgtgcttcct

SEQ ID NO: 146523 - DNA, 22 bp, Artificial Sequence
  Synthetic oligonucleotide; CTC chr11 5209123 5209144 5209128 5209123 -
tggtacatcctgtgcttcctga

SEQ ID NO: 146524 - DNA, 22 bp, Artificial Sequence
  Synthetic oligonucleotide; CTG chr11 5209121 5209142 5209126 5209121 -
gtacatcctgtgcttcctgaga

SEQ ID NO: 146525 - DNA, 22 bp, Artificial Sequence
  Synthetic oligonucleotide; CTG chr11 5209111 5209132 5209116 5209111 -
tgcttcctgagatgttgttatt

SEQ ID NO: 146526 - DNA, 22 bp, Artificial Sequence
  Synthetic oligonucleotide; CTT chr11 5209106 5209127 5209111 5209106 -
cctgagatgttgttattcgtct

SEQ ID NO: 146527 - DNA, 22 bp, Artificial Sequence
  Synthetic oligonucleotide; TTC chr11 5209105 5209126 5209110 5209105 -
ctgagatgttgttattcgtctt

SEQ ID NO: 146528 - DNA, 22 bp, Artificial Sequence
  Synthetic oligonucleotide; CTG chr11 5209102 5209123 5209107 5209102 -
agatgttgttattcgtctttta

SEQ ID NO: 146529 - DNA, 22 bp, Artificial Sequence
  Synthetic oligonucleotide; TTG chr11 5209094 5209115 5209099 5209094 -
ttattcgtcttttacacacact

SEQ ID NO: 146530 - DNA, 22 bp, Artificial Sequence
  Synthetic oligonucleotide; TTA chr11 5209091 5209112 5209096 5209091 -
ttcgtcttttacacacactgtc

SEQ ID NO: 146531 - DNA, 22 bp, Artificial Sequence
  Synthetic oligonucleotide; TTC chr11 5209088 5209109 5209093 5209088 -
gtcttttacacacactgtcttg

SEQ ID NO: 146532 - DNA, 22 bp, Artificial Sequence
  Synthetic oligonucleotide; CTT chr11 5209083 5209104 5209088 5209083 -
ttacacacactgtcttgggatg

SEQ ID NO: 146533 - DNA, 22 bp, Artificial Sequence
  Synthetic oligonucleotide; TTT chr11 5209082 5209103 5209087 5209082 -
tacacacactgtcttgggatgg

SEQ ID NO: 146534 - DNA, 22 bp, Artificial Sequence
  Synthetic oligonucleotide; TTT chr11 5209081 5209102 5209086 5209081 -
acacacactgtcttgggatggg

SEQ ID NO: 146535 - DNA, 22 bp, Artificial Sequence
  Synthetic oligonucleotide; TTA chr11 5209080 5209101 5209085 5209080 -
cacacactgtcttgggatgggc

SEQ ID NO: 146536 - DNA, 22 bp, Artificial Sequence
  Synthetic oligonucleotide; CTG chr11 5209071 5209092 5209076 5209071 -
tcttgggatgggcattaaggtg

SEQ ID NO: 146537 - DNA, 22 bp, Artificial Sequence
  Synthetic oligonucleotide; CTT chr11 5209067 5209088 5209072 5209067 -
gggatgggcattaaggtgttgt

SEQ ID NO: 146538 - DNA, 22 bp, Artificial Sequence
  Synthetic oligonucleotide; TTG chr11 5209066 5209087 5209071 5209066 -
ggatgggcattaaggtgttgta

SEQ ID NO: 146539 - DNA, 22 bp, Artificial Sequence
  Synthetic oligonucleotide; TTA chr11 5209054 5209075 5209059 5209054 -
aggtgttgtagctactcagcta

SEQ ID NO: 146540 - DNA, 22 bp, Artificial Sequence
  Synthetic oligonucleotide; TTG chr11 5209046 5209067 5209051 5209046 -
tagctactcagctagtaagtag

SEQ ID NO: 146541 - DNA, 22 bp, Artificial Sequence
  Synthetic oligonucleotide; CTA chr11 5209040 5209061 5209045 5209040 -
ctcagctagtaagtagctgagc

SEQ ID NO: 146542 - DNA, 22 bp, Artificial Sequence
  Synthetic oligonucleotide; CTC chr11 5209037 5209058 5209042 5209037 -
agctagtaagtagctgagctaa

SEQ ID NO: 146543 - DNA, 22 bp, Artificial Sequence
  Synthetic oligonucleotide; CTA chr11 5209032 5209053 5209037 5209032 -
gtaagtagctgagctaagattc

SEQ ID NO: 146544 - DNA, 22 bp, Artificial Sequence
  Synthetic oligonucleotide; CTG chr11 5209021 5209042 5209026 5209021 -
agctaagattctttcaattcca

SEQ ID NO: 146545 - DNA, 22 bp, Artificial Sequence
  Synthetic oligonucleotide; CTA chr11 5209016 5209037 5209021 5209016 -
agattctttcaattccaaagtc

SEQ ID NO: 146546 - DNA, 22 bp, Artificial Sequence
  Synthetic oligonucleotide; TTC chr11 5209010 5209031 5209015 5209010 -
tttcaattccaaagtcagcagt

SEQ ID NO: 146547 - DNA, 22 bp, Artificial Sequence
  Synthetic oligonucleotide; CTT chr11 5209008 5209029 5209013 5209008 -
tcaattccaaagtcagcagtgt

SEQ ID NO: 146548 - DNA, 22 bp, Artificial Sequence
  Synthetic oligonucleotide; TTT chr11 5209007 5209028 5209012 5209007 -
caattccaaagtcagcagtgtc

SEQ ID NO: 146549 - DNA, 22 bp, Artificial Sequence
  Synthetic oligonucleotide; TTC chr11 5209006 5209027 5209011 5209006 -
aattccaaagtcagcagtgtct

SEQ ID NO: 146550 - DNA, 22 bp, Artificial Sequence
  Synthetic oligonucleotide; TTC chr11 5209001 5209022 5209006 5209001 -
caaagtcagcagtgtcttcact

SEQ ID NO: 146551 - DNA, 22 bp, Artificial Sequence
  Synthetic oligonucleotide; CTT chr11 5208983 5209004 5208988 5208983 -
cactacatggtactatgtcaag

SEQ ID NO: 146552 - DNA, 22 bp, Artificial Sequence
  Synthetic oligonucleotide; TTC chr11 5208982 5209003 5208987 5208982 -
actacatggtactatgtcaaga

SEQ ID NO: 146553 - DNA, 22 bp, Artificial Sequence
  Synthetic oligonucleotide; CTA chr11 5208978 5208999 5208983 5208978 -
catggtactatgtcaagaaaga

SEQ ID NO: 146554 - DNA, 22 bp, Artificial Sequence
  Synthetic oligonucleotide; CTA chr11 5208968 5208989 5208973 5208968 -
tgtcaagaaagagaaactccac

SEQ ID NO: 146555 - DNA, 22 bp, Artificial Sequence
  Synthetic oligonucleotide; CTC chr11 5208949 5208970 5208954 5208949 -
cactaaaaagaacttcattgct

SEQ ID NO: 146556 - DNA, 22 bp, Artificial Sequence
  Synthetic oligonucleotide; CTA chr11 5208944 5208965 5208949 5208944 -
aaaagaacttcattgctctctg

SEQ ID NO: 146557 - DNA, 22 bp, Artificial Sequence
  Synthetic oligonucleotide; CTT chr11 5208934 5208955 5208939 5208934 -
cattgctctctgttagggatac

SEQ ID NO: 146558 - DNA, 22 bp, Artificial Sequence
  Synthetic oligonucleotide; TTC chr11 5208933 5208954 5208938 5208933 -
attgctctctgttagggataca

SEQ ID NO: 146559 - DNA, 22 bp, Artificial Sequence
  Synthetic oligonucleotide; TTG chr11 5208929 5208950 5208934 5208929 -
ctctctgttagggatacattaa

SEQ ID NO: 146560 - DNA, 22 bp, Artificial Sequence
  Synthetic oligonucleotide; CTC chr11 5208926 5208947 5208931 5208926 -
tctgttagggatacattaacat

SEQ ID NO: 146561 - DNA, 22 bp, Artificial Sequence
  Synthetic oligonucleotide; CTC chr11 5208924 5208945 5208929 5208924 -
tgttagggatacattaacattt

SEQ ID NO: 146562 - DNA, 22 bp, Artificial Sequence
  Synthetic oligonucleotide; CTG chr11 5208922 5208943 5208927 5208922 -
ttagggatacattaacattttg

SEQ ID NO: 146563 - DNA, 22 bp, Artificial Sequence
  Synthetic oligonucleotide; TTA chr11 5208919 5208940 5208924 5208919 -
gggatacattaacattttggga

SEQ ID NO: 146564 - DNA, 22 bp, Artificial Sequence
  Synthetic oligonucleotide; TTA chr11 5208908 5208929 5208913 5208908 -
acattttgggacatgaaaaaaa

SEQ ID NO: 146565 - DNA, 22 bp, Artificial Sequence
  Synthetic oligonucleotide; TTT chr11 5208902 5208923 5208907 5208902 -
tgggacatgaaaaaaaaatgtt

SEQ ID NO: 146566 - DNA, 22 bp, Artificial Sequence
  Synthetic oligonucleotide; TTT chr11 5208901 5208922 5208906 5208901 -
gggacatgaaaaaaaaatgtta

SEQ ID NO: 146567 - DNA, 22 bp, Artificial Sequence
  Synthetic oligonucleotide; TTG chr11 5208900 5208921 5208905 5208900 -
ggacatgaaaaaaaaatgttac

SEQ ID NO: 146568 - DNA, 22 bp, Artificial Sequence
  Synthetic oligonucleotide; TTA chr11 5208879 5208900 5208884 5208879 -
caatagcttacaggtcacctcc

SEQ ID NO: 146569 - DNA, 22 bp, Artificial Sequence
  Synthetic oligonucleotide; CTT chr11 5208870 5208891 5208875 5208870 -
acaggtcacctccacttatatg

SEQ ID NO: 146570 - DNA, 22 bp, Artificial Sequence
  Synthetic oligonucleotide; TTA chr11 5208869 5208890 5208874 5208869 -
caggtcacctccacttatatga

SEQ ID NO: 146571 - DNA, 22 bp, Artificial Sequence
  Synthetic oligonucleotide; CTC chr11 5208858 5208879 5208863 5208858 -
cacttatatgacctatggacct

SEQ ID NO: 146572 - DNA, 22 bp, Artificial Sequence
  Synthetic oligonucleotide; CTT chr11 5208853 5208874 5208858 5208853 -
atatgacctatggacctcttaa

SEQ ID NO: 146573 - DNA, 22 bp, Artificial Sequence
  Synthetic oligonucleotide; TTA chr11 5208852 5208873 5208857 5208852 -
tatgacctatggacctcttaaa

SEQ ID NO: 146574 - DNA, 22 bp, Artificial Sequence
  Synthetic oligonucleotide; CTA chr11 5208843 5208864 5208848 5208843 -
tggacctcttaaactcagcgag

SEQ ID NO: 146575 - DNA, 22 bp, Artificial Sequence
  Synthetic oligonucleotide; CTC chr11 5208835 5208856 5208840 5208835 -
ttaaactcagcgagttgaaaag

SEQ ID NO: 146576 - DNA, 22 bp, Artificial Sequence
  Synthetic oligonucleotide; CTT chr11 5208833 5208854 5208838 5208833 -
aaactcagcgagttgaaaagat

SEQ ID NO: 146577 - DNA, 22 bp, Artificial Sequence
  Synthetic oligonucleotide; TTA chr11 5208832 5208853 5208837 5208832 -
aactcagcgagttgaaaagata

SEQ ID NO: 146578 - DNA, 22 bp, Artificial Sequence
  Synthetic oligonucleotide; CTC chr11 5208827 5208848 5208832 5208827 -
agcgagttgaaaagatagtaaa

SEQ ID NO: 146579 - DNA, 22 bp, Artificial Sequence
  Synthetic oligonucleotide; TTG chr11 5208818 5208839 5208823 5208818 -
aaaagatagtaaattatcctcc

SEQ ID NO: 146580 - DNA, 22 bp, Artificial Sequence
  Synthetic oligonucleotide; TTA chr11 5208802 5208823 5208807 5208802 -
tcctccacttctttcagtttcc

SEQ ID NO: 146581 - DNA, 22 bp, Artificial Sequence
  Synthetic oligonucleotide; CTC chr11 5208797 5208818 5208802 5208797 -
cacttctttcagtttcctctaa

SEQ ID NO: 146582 - DNA, 22 bp, Artificial Sequence
  Synthetic oligonucleotide; CTT chr11 5208792 5208813 5208797 5208792 -
ctttcagtttcctctaatgctt

SEQ ID NO: 146583 - DNA, 22 bp, Artificial Sequence
  Synthetic oligonucleotide; TTC chr11 5208791 5208812 5208796 5208791 -
tttcagtttcctctaatgcttc

SEQ ID NO: 146584 - DNA, 22 bp, Artificial Sequence
  Synthetic oligonucleotide; CTT chr11 5208789 5208810 5208794 5208789 -
tcagtttcctctaatgcttcca

SEQ ID NO: 146585 - DNA, 22 bp, Artificial Sequence
  Synthetic oligonucleotide; TTT chr11 5208788 5208809 5208793 5208788 -
cagtttcctctaatgcttccaa

SEQ ID NO: 146586 - DNA, 22 bp, Artificial Sequence
  Synthetic oligonucleotide; TTC chr11 5208787 5208808 5208792 5208787 -
agtttcctctaatgcttccaaa

SEQ ID NO: 146587 - DNA, 22 bp, Artificial Sequence
  Synthetic oligonucleotide; TTT chr11 5208782 5208803 5208787 5208782 -
cctctaatgcttccaaacttga

SEQ ID NO: 146588 - DNA, 22 bp, Artificial Sequence
  Synthetic oligonucleotide; TTC chr11 5208781 5208802 5208786 5208781 -
ctctaatgcttccaaacttgat

SEQ ID NO: 146589 - DNA, 22 bp, Artificial Sequence
  Synthetic oligonucleotide; CTC chr11 5208778 5208799 5208783 5208778 -
taatgcttccaaacttgatgaa

SEQ ID NO: 146590 - DNA, 22 bp, Artificial Sequence
  Synthetic oligonucleotide; CTA chr11 5208776 5208797 5208781 5208776 -
atgcttccaaacttgatgaatg

SEQ ID NO: 146591 - DNA, 22 bp, Artificial Sequence
  Synthetic oligonucleotide; CTT chr11 5208770 5208791 5208775 5208770 -
ccaaacttgatgaatggttcac

SEQ ID NO: 146592 - DNA, 22 bp, Artificial Sequence
  Synthetic oligonucleotide; TTC chr11 5208769 5208790 5208774 5208769 -
caaacttgatgaatggttcact

SEQ ID NO: 146593 - DNA, 22 bp, Artificial Sequence
  Synthetic oligonucleotide; CTT chr11 5208762 5208783 5208767 5208762 -
gatgaatggttcactcagattt

SEQ ID NO: 146594 - DNA, 22 bp, Artificial Sequence
  Synthetic oligonucleotide; TTG chr11 5208761 5208782 5208766 5208761 -
atgaatggttcactcagatttc

SEQ ID NO: 146595 - DNA, 22 bp, Artificial Sequence
  Synthetic oligonucleotide; TTC chr11 5208750 5208771 5208755 5208750 -
actcagatttccaagacaaaat

SEQ ID NO: 146596 - DNA, 22 bp, Artificial Sequence
  Synthetic oligonucleotide; CTC chr11 5208746 5208767 5208751 5208746 -
agatttccaagacaaaattttg

SEQ ID NO: 146597 - DNA, 22 bp, Artificial Sequence
  Synthetic oligonucleotide; TTT chr11 5208740 5208761 5208745 5208740 -
ccaagacaaaattttgtcaatc

SEQ ID NO: 146598 - DNA, 22 bp, Artificial Sequence
  Synthetic oligonucleotide; TTC chr11 5208739 5208760 5208744 5208739 -
caagacaaaattttgtcaatca

SEQ ID NO: 146599 - DNA, 22 bp, Artificial Sequence
  Synthetic oligonucleotide; TTT chr11 5208726 5208747 5208731 5208726 -
tgtcaatcatttttgcctttac

SEQ ID NO: 146600 - DNA, 22 bp, Artificial Sequence
  Synthetic oligonucleotide; TTT chr11 5208725 5208746 5208730 5208725 -
gtcaatcatttttgcctttact

SEQ ID NO: 146601 - DNA, 22 bp, Artificial Sequence
  Synthetic oligonucleotide; TTG chr11 5208724 5208745 5208729 5208724 -
tcaatcatttttgcctttactc

SEQ ID NO: 146602 - DNA, 22 bp, Artificial Sequence
  Synthetic oligonucleotide; TTT chr11 5208714 5208735 5208719 5208714 -
ttgcctttactctccactctct

SEQ ID NO: 146603 - DNA, 22 bp, Artificial Sequence
  Synthetic oligonucleotide; TTT chr11 5208713 5208734 5208718 5208713 -
tgcctttactctccactctctt

SEQ ID NO: 146604 - DNA, 22 bp, Artificial Sequence
  Synthetic oligonucleotide; TTT chr11 5208712 5208733 5208717 5208712 -
gcctttactctccactctcttc

SEQ ID NO: 146605 - DNA, 22 bp, Artificial Sequence
  Synthetic oligonucleotide; TTG chr11 5208711 5208732 5208716 5208711 -
cctttactctccactctcttct

SEQ ID NO: 146606 - DNA, 22 bp, Artificial Sequence
  Synthetic oligonucleotide; CTT chr11 5208707 5208728 5208712 5208707 -
tactctccactctcttctatcc

SEQ ID NO: 146607 - DNA, 22 bp, Artificial Sequence
  Synthetic oligonucleotide; TTT chr11 5208706 5208727 5208711 5208706 -
actctccactctcttctatccc

SEQ ID NO: 146608 - DNA, 22 bp, Artificial Sequence
  Synthetic oligonucleotide; TTA chr11 5208705 5208726 5208710 5208705 -
ctctccactctcttctatccct

SEQ ID NO: 146609 - DNA, 22 bp, Artificial Sequence
  Synthetic oligonucleotide; CTC chr11 5208702 5208723 5208707 5208702 -
tccactctcttctatcccttat

SEQ ID NO: 146610 - DNA, 22 bp, Artificial Sequence
  Synthetic oligonucleotide; CTC chr11 5208700 5208721 5208705 5208700 -
cactctcttctatcccttatat

SEQ ID NO: 146611 - DNA, 22 bp, Artificial Sequence
  Synthetic oligonucleotide; CTC chr11 5208695 5208716 5208700 5208695 -
tcttctatcccttatatatatt

SEQ ID NO: 146612 - DNA, 22 bp, Artificial Sequence
  Synthetic oligonucleotide; CTC chr11 5208693 5208714 5208698 5208693 -
ttctatcccttatatatattta

SEQ ID NO: 146613 - DNA, 22 bp, Artificial Sequence
  Synthetic oligonucleotide; CTT chr11 5208691 5208712 5208696 5208691 -
ctatcccttatatatatttaat

SEQ ID NO: 146614 - DNA, 22 bp, Artificial Sequence
  Synthetic oligonucleotide; TTC chr11 5208690 5208711 5208695 5208690 -
tatcccttatatatatttaata

SEQ ID NO: 146615 - DNA, 22 bp, Artificial Sequence
  Synthetic oligonucleotide; CTA chr11 5208688 5208709 5208693 5208688 -
tcccttatatatatttaataat

SEQ ID NO: 146616 - DNA, 22 bp, Artificial Sequence
  Synthetic oligonucleotide; CTT chr11 5208682 5208703 5208687 5208682 -
atatatatttaataatcaattt

SEQ ID NO: 146617 - DNA, 22 bp, Artificial Sequence
  Synthetic oligonucleotide; TTA chr11 5208681 5208702 5208686 5208681 -
tatatatttaataatcaatttc

SEQ ID NO: 146618 - DNA, 22 bp, Artificial Sequence
  Synthetic oligonucleotide; TTT chr11 5208672 5208693 5208677 5208672 -
aataatcaatttctcacaacta

SEQ ID NO: 146619 - DNA, 22 bp, Artificial Sequence
  Synthetic oligonucleotide; TTA chr11 5208671 5208692 5208676 5208671 -
ataatcaatttctcacaactag

SEQ ID NO: 146620 - DNA, 22 bp, Artificial Sequence
  Synthetic oligonucleotide; TTT chr11 5208660 5208681 5208665 5208660 -
ctcacaactagaattattatca

SEQ ID NO: 146621 - DNA, 22 bp, Artificial Sequence
  Synthetic oligonucleotide; TTC chr11 5208659 5208680 5208664 5208659 -
tcacaactagaattattatcat

SEQ ID NO: 146622 - DNA, 22 bp, Artificial Sequence
  Synthetic oligonucleotide; CTC chr11 5208657 5208678 5208662 5208657 -
acaactagaattattatcataa

SEQ ID NO: 146623 - DNA, 22 bp, Artificial Sequence
  Synthetic oligonucleotide; CTA chr11 5208650 5208671 5208655 5208650 -
gaattattatcataaatactga

SEQ ID NO: 146624 - DNA, 22 bp, Artificial Sequence
  Synthetic oligonucleotide; TTA chr11 5208644 5208665 5208649 5208644 -
ttatcataaatactgatagctt

SEQ ID NO: 146625 - DNA, 22 bp, Artificial Sequence
  Synthetic oligonucleotide; TTA chr11 5208641 5208662 5208646 5208641 -
tcataaatactgatagcttttg

SEQ ID NO: 146626 - DNA, 22 bp, Artificial Sequence
  Synthetic oligonucleotide; CTG chr11 5208629 5208650 5208634 5208629 -
atagcttttgagtggcagataa

SEQ ID NO: 146627 - DNA, 22 bp, Artificial Sequence
  Synthetic oligonucleotide; CTT chr11 5208622 5208643 5208627 5208622 -
ttgagtggcagataatgagccg

SEQ ID NO: 146628 - DNA, 22 bp, Artificial Sequence
  Synthetic oligonucleotide; TTT chr11 5208621 5208642 5208626 5208621 -
tgagtggcagataatgagccgt

SEQ ID NO: 146629 - DNA, 22 bp, Artificial Sequence
  Synthetic oligonucleotide; TTT chr11 5208620 5208641 5208625 5208620 -
gagtggcagataatgagccgtt

SEQ ID NO: 146630 - DNA, 22 bp, Artificial Sequence
  Synthetic oligonucleotide; TTG chr11 5208619 5208640 5208624 5208619 -
agtggcagataatgagccgttt

SEQ ID NO: 146631 - DNA, 22 bp, Artificial Sequence
  Synthetic oligonucleotide; TTT chr11 5208597 5208618 5208602 5208597 -
ttatatattatcatcataccaa

SEQ ID NO: 146632 - DNA, 22 bp, Artificial Sequence
  Synthetic oligonucleotide; TTT chr11 5208596 5208617 5208601 5208596 -
tatatattatcatcataccaac

SEQ ID NO: 146633 - DNA, 22 bp, Artificial Sequence
  Synthetic oligonucleotide; TTT chr11 5208595 5208616 5208600 5208595 -
atatattatcatcataccaaca

SEQ ID NO: 146634 - DNA, 22 bp, Artificial Sequence
  Synthetic oligonucleotide; TTA chr11 5208594 5208615 5208599 5208594 -
tatattatcatcataccaacaa

SEQ ID NO: 146635 - DNA, 22 bp, Artificial Sequence
  Synthetic oligonucleotide; TTA chr11 5208587 5208608 5208592 5208587 -
tcatcataccaacaatattttt

SEQ ID NO: 146636 - DNA, 22 bp, Artificial Sequence
  Synthetic oligonucleotide; TTT chr11 5208567 5208588 5208572 5208567 -
ttaaaaattgtgcagctaagtg

SEQ ID NO: 146637 - DNA, 22 bp, Artificial Sequence
  Synthetic oligonucleotide; TTT chr11 5208566 5208587 5208571 5208566 -
taaaaattgtgcagctaagtgt

SEQ ID NO: 146638 - DNA, 22 bp, Artificial Sequence
  Synthetic oligonucleotide; TTT chr11 5208565 5208586 5208570 5208565 -
aaaaattgtgcagctaagtgtt

SEQ ID NO: 146639 - DNA, 22 bp, Artificial Sequence
  Synthetic oligonucleotide; TTA chr11 5208564 5208585 5208569 5208564 -
aaaattgtgcagctaagtgttg

SEQ ID NO: 146640 - DNA, 22 bp, Artificial Sequence
  Synthetic oligonucleotide; TTG chr11 5208557 5208578 5208562 5208557 -
tgcagctaagtgttgagctaaa

SEQ ID NO: 146641 - DNA, 22 bp, Artificial Sequence
  Synthetic oligonucleotide; CTA chr11 5208549 5208570 5208554 5208549 -
agtgttgagctaaaaattatat

SEQ ID NO: 146642 - DNA, 22 bp, Artificial Sequence
  Synthetic oligonucleotide; TTG chr11 5208542 5208563 5208547 5208542 -
agctaaaaattatatacctaag

SEQ ID NO: 146643 - DNA, 22 bp, Artificial Sequence
  Synthetic oligonucleotide; CTA chr11 5208537 5208558 5208542 5208537 -
aaaattatatacctaagaaatg

SEQ ID NO: 146644 - DNA, 22 bp, Artificial Sequence
  Synthetic oligonucleotide; TTA chr11 5208530 5208551 5208535 5208530 -
tatacctaagaaatgacaaaac

SEQ ID NO: 146645 - DNA, 22 bp, Artificial Sequence
  Synthetic oligonucleotide; CTA chr11 5208522 5208543 5208527 5208522 -
agaaatgacaaaaccaagattt

SEQ ID NO: 146646 - DNA, 22 bp, Artificial Sequence
  Synthetic oligonucleotide; TTT chr11 5208500 5208521 5208505 5208500 -
gaaaccagttctcactgaccag

SEQ ID NO: 146647 - DNA, 22 bp, Artificial Sequence
  Synthetic oligonucleotide; TTG chr11 5208499 5208520 5208504 5208499 -
aaaccagttctcactgaccaga

SEQ ID NO: 146648 - DNA, 22 bp, Artificial Sequence
  Synthetic oligonucleotide; TTC chr11 5208489 5208510 5208494 5208489 -
tcactgaccagaagatcattct

SEQ ID NO: 146649 - DNA, 22 bp, Artificial Sequence
  Synthetic oligonucleotide; CTC chr11 5208487 5208508 5208492 5208487 -
actgaccagaagatcattcttt

SEQ ID NO: 146650 - DNA, 22 bp, Artificial Sequence
  Synthetic oligonucleotide; CTG chr11 5208483 5208504 5208488 5208483 -
accagaagatcattctttcagc

SEQ ID NO: 146651 - DNA, 22 bp, Artificial Sequence
  Synthetic oligonucleotide; TTC chr11 5208468 5208489 5208473 5208468 -
tttcagctaaggagctaattac

SEQ ID NO: 146652 - DNA, 22 bp, Artificial Sequence
  Synthetic oligonucleotide; CTT chr11 5208466 5208487 5208471 5208466 -
tcagctaaggagctaattactg

SEQ ID NO: 146653 - DNA, 22 bp, Artificial Sequence
  Synthetic oligonucleotide; TTT chr11 5208465 5208486 5208470 5208465 -
cagctaaggagctaattactgc

SEQ ID NO: 146654 - DNA, 22 bp, Artificial Sequence
  Synthetic oligonucleotide; TTC chr11 5208464 5208485 5208469 5208464 -
agctaaggagctaattactgcg

SEQ ID NO: 146655 - DNA, 22 bp, Artificial Sequence
  Synthetic oligonucleotide; CTA chr11 5208459 5208480 5208464 5208459 -
aggagctaattactgcgttcct

SEQ ID NO: 146656 - DNA, 22 bp, Artificial Sequence
  Synthetic oligonucleotide; CTA chr11 5208451 5208472 5208456 5208451 -
attactgcgttccttcatagtt

SEQ ID NO: 146657 - DNA, 22 bp, Artificial Sequence
  Synthetic oligonucleotide; TTA chr11 5208447 5208468 5208452 5208447 -
ctgcgttccttcatagtttttt

SEQ ID NO: 146658 - DNA, 22 bp, Artificial Sequence
  Synthetic oligonucleotide; CTG chr11 5208444 5208465 5208449 5208444 -
cgttccttcatagttttttttt

SEQ ID NO: 146659 - DNA, 22 bp, Artificial Sequence
  Synthetic oligonucleotide; TTC chr11 5208439 5208460 5208444 5208439 -
cttcatagtttttttttttcct

SEQ ID NO: 146660 - DNA, 22 bp, Artificial Sequence
  Synthetic oligonucleotide; CTT chr11 5208436 5208457 5208441 5208436 -
catagtttttttttttcctctc

SEQ ID NO: 146661 - DNA, 22 bp, Artificial Sequence
  Synthetic oligonucleotide; TTC chr11 5208435 5208456 5208440 5208435 -
atagtttttttttttcctctca

SEQ ID NO: 146662 - DNA, 22 bp, Artificial Sequence
  Synthetic oligonucleotide; TTT chr11 5208428 5208449 5208433 5208428 -
ttttttttcctctcaggtattc

SEQ ID NO: 146663 - DNA, 22 bp, Artificial Sequence
  Synthetic oligonucleotide; TTT chr11 5208427 5208448 5208432 5208427 -
tttttttcctctcaggtattcc

SEQ ID NO: 146664 - DNA, 22 bp, Artificial Sequence
  Synthetic oligonucleotide; TTT chr11 5208426 5208447 5208431 5208426 -
ttttttcctctcaggtattccc

SEQ ID NO: 146665 - DNA, 22 bp, Artificial Sequence
  Synthetic oligonucleotide; TTT chr11 5208425 5208446 5208430 5208425 -
tttttcctctcaggtattccct

SEQ ID NO: 146666 - DNA, 22 bp, Artificial Sequence
  Synthetic oligonucleotide; TTT chr11 5208424 5208445 5208429 5208424 -
ttttcctctcaggtattccctg

SEQ ID NO: 146667 - DNA, 22 bp, Artificial Sequence
  Synthetic oligonucleotide; TTT chr11 5208423 5208444 5208428 5208423 -
tttcctctcaggtattccctga

SEQ ID NO: 146668 - DNA, 22 bp, Artificial Sequence
  Synthetic oligonucleotide; TTT chr11 5208422 5208443 5208427 5208422 -
ttcctctcaggtattccctgaa

SEQ ID NO: 146669 - DNA, 22 bp, Artificial Sequence
  Synthetic oligonucleotide; TTT chr11 5208421 5208442 5208426 5208421 -
tcctctcaggtattccctgaaa

SEQ ID NO: 146670 - DNA, 22 bp, Artificial Sequence
  Synthetic oligonucleotide; TTT chr11 5208420 5208441 5208425 5208420 -
cctctcaggtattccctgaaat

SEQ ID NO: 146671 - DNA, 22 bp, Artificial Sequence
  Synthetic oligonucleotide; TTC chr11 5208419 5208440 5208424 5208419 -
ctctcaggtattccctgaaata

SEQ ID NO: 146672 - DNA, 22 bp, Artificial Sequence
  Synthetic oligonucleotide; CTC chr11 5208416 5208437 5208421 5208416 -
tcaggtattccctgaaatatgc

SEQ ID NO: 146673 - DNA, 22 bp, Artificial Sequence
  Synthetic oligonucleotide; CTC chr11 5208414 5208435 5208419 5208414 -
aggtattccctgaaatatgcat

SEQ ID NO: 146674 - DNA, 22 bp, Artificial Sequence
  Synthetic oligonucleotide; TTC chr11 5208406 5208427 5208411 5208406 -
cctgaaatatgcattttcttgg

SEQ ID NO: 146675 - DNA, 22 bp, Artificial Sequence
  Synthetic oligonucleotide; CTG chr11 5208402 5208423 5208407 5208402 -
aaatatgcattttcttggtcct

SEQ ID NO: 146676 - DNA, 22 bp, Artificial Sequence
  Synthetic oligonucleotide; TTT chr11 5208390 5208411 5208395 5208390 -
tcttggtcctactctactcaaa

SEQ ID NO: 146677 - DNA, 22 bp, Artificial Sequence
  Synthetic oligonucleotide; TTT chr11 5208389 5208410 5208394 5208389 -
cttggtcctactctactcaaat

SEQ ID NO: 146678 - DNA, 22 bp, Artificial Sequence
  Synthetic oligonucleotide; TTC chr11 5208388 5208409 5208393 5208388 -
ttggtcctactctactcaaatt

SEQ ID NO: 146679 - DNA, 22 bp, Artificial Sequence
  Synthetic oligonucleotide; CTT chr11 5208386 5208407 5208391 5208386 -
ggtcctactctactcaaatttc

SEQ ID NO: 146680 - DNA, 22 bp, Artificial Sequence
  Synthetic oligonucleotide; TTG chr11 5208385 5208406 5208390 5208385 -
gtcctactctactcaaatttca

SEQ ID NO: 146681 - DNA, 22 bp, Artificial Sequence
  Synthetic oligonucleotide; CTA chr11 5208379 5208400 5208384 5208379 -
ctctactcaaatttcaaaccac

SEQ ID NO: 146682 - DNA, 22 bp, Artificial Sequence
  Synthetic oligonucleotide; CTC chr11 5208376 5208397 5208381 5208376 -
tactcaaatttcaaaccactat

SEQ ID NO: 146683 - DNA, 22 bp, Artificial Sequence
  Synthetic oligonucleotide; CTA chr11 5208374 5208395 5208379 5208374 -
ctcaaatttcaaaccactatta

SEQ ID NO: 146684 - DNA, 22 bp, Artificial Sequence
  Synthetic oligonucleotide; CTC chr11 5208371 5208392 5208376 5208371 -
aaatttcaaaccactattattt

SEQ ID NO: 146685 - DNA, 22 bp, Artificial Sequence
  Synthetic oligonucleotide; TTT chr11 5208365 5208386 5208370 5208365 -
caaaccactattatttcatgcc

SEQ ID NO: 146686 - DNA, 22 bp, Artificial Sequence
  Synthetic oligonucleotide; TTC chr11 5208364 5208385 5208369 5208364 -
aaaccactattatttcatgccc

SEQ ID NO: 146687 - DNA, 22 bp, Artificial Sequence
  Synthetic oligonucleotide; CTA chr11 5208355 5208376 5208360 5208355 -
ttatttcatgcccttcaataac

SEQ ID NO: 146688 - DNA, 22 bp, Artificial Sequence
  Synthetic oligonucleotide; TTA chr11 5208352 5208373 5208357 5208352 -
tttcatgcccttcaataacttc

SEQ ID NO: 146689 - DNA, 22 bp, Artificial Sequence
  Synthetic oligonucleotide; TTT chr11 5208349 5208370 5208354 5208349 -
catgcccttcaataacttctaa

SEQ ID NO: 146690 - DNA, 22 bp, Artificial Sequence
  Synthetic oligonucleotide; TTC chr11 5208348 5208369 5208353 5208348 -
atgcccttcaataacttctaac

SEQ ID NO: 146691 - DNA, 22 bp, Artificial Sequence
  Synthetic oligonucleotide; CTT chr11 5208340 5208361 5208345 5208340 -
caataacttctaaccggttcta

SEQ ID NO: 146692 - DNA, 22 bp, Artificial Sequence
  Synthetic oligonucleotide; TTC chr11 5208339 5208360 5208344 5208339 -
aataacttctaaccggttctat

SEQ ID NO: 146693 - DNA, 22 bp, Artificial Sequence
  Synthetic oligonucleotide; CTT chr11 5208331 5208352 5208336 5208331 -
ctaaccggttctattttcctat

SEQ ID NO: 146694 - DNA, 22 bp, Artificial Sequence
  Synthetic oligonucleotide; TTC chr11 5208330 5208351 5208335 5208330 -
taaccggttctattttcctatt

SEQ ID NO: 146695 - DNA, 22 bp, Artificial Sequence
  Synthetic oligonucleotide; CTA chr11 5208328 5208349 5208333 5208328 -
accggttctattttcctatttg

SEQ ID NO: 146696 - DNA, 22 bp, Artificial Sequence
  Synthetic oligonucleotide; TTC chr11 5208320 5208341 5208325 5208320 -
tattttcctatttgtgtcttgc

SEQ ID NO: 146697 - DNA, 22 bp, Artificial Sequence
  Synthetic oligonucleotide; CTA chr11 5208318 5208339 5208323 5208318 -
ttttcctatttgtgtcttgcaa

SEQ ID NO: 146698 - DNA, 22 bp, Artificial Sequence
  Synthetic oligonucleotide; TTT chr11 5208315 5208336 5208320 5208315 -
tcctatttgtgtcttgcaacat

SEQ ID NO: 146699 - DNA, 22 bp, Artificial Sequence
  Synthetic oligonucleotide; TTT chr11 5208314 5208335 5208319 5208314 -
cctatttgtgtcttgcaacatg

SEQ ID NO: 146700 - DNA, 22 bp, Artificial Sequence
  Synthetic oligonucleotide; TTC chr11 5208313 5208334 5208318 5208313 -
ctatttgtgtcttgcaacatgg

SEQ ID NO: 146701 - DNA, 22 bp, Artificial Sequence
  Synthetic oligonucleotide; CTA chr11 5208310 5208331 5208315 5208310 -
tttgtgtcttgcaacatgggat

SEQ ID NO: 146702 - DNA, 22 bp, Artificial Sequence
  Synthetic oligonucleotide; TTT chr11 5208307 5208328 5208312 5208307 -
gtgtcttgcaacatgggataat

SEQ ID NO: 146703 - DNA, 22 bp, Artificial Sequence
  Synthetic oligonucleotide; TTG chr11 5208306 5208327 5208311 5208306 -
tgtcttgcaacatgggataata

SEQ ID NO: 146704 - DNA, 22 bp, Artificial Sequence
  Synthetic oligonucleotide; CTT chr11 5208300 5208321 5208305 5208300 -
gcaacatgggataataggttct

SEQ ID NO: 146705 - DNA, 22 bp, Artificial Sequence
  Synthetic oligonucleotide; TTG chr11 5208299 5208320 5208304 5208299 -
caacatgggataataggttctg

SEQ ID NO: 146706 - DNA, 22 bp, Artificial Sequence
  Synthetic oligonucleotide; TTC chr11 5208279 5208300 5208284 5208279 -
tggcatgagacagcccgggctc

SEQ ID NO: 146707 - DNA, 22 bp, Artificial Sequence
  Synthetic oligonucleotide; CTG chr11 5208277 5208298 5208282 5208277 -
gcatgagacagcccgggctcta

SEQ ID NO: 146708 - DNA, 22 bp, Artificial Sequence
  Synthetic oligonucleotide; CTC chr11 5208257 5208278 5208262 5208257 -
tactctcaggtccataagttaa

SEQ ID NO: 146709 - DNA, 22 bp, Artificial Sequence
  Synthetic oligonucleotide; CTA chr11 5208255 5208276 5208260 5208255 -
ctctcaggtccataagttaata

SEQ ID NO: 146710 - DNA, 22 bp, Artificial Sequence
  Synthetic oligonucleotide; CTC chr11 5208252 5208273 5208257 5208252 -
tcaggtccataagttaatagct

SEQ ID NO: 146711 - DNA, 22 bp, Artificial Sequence
  Synthetic oligonucleotide; CTC chr11 5208250 5208271 5208255 5208250 -
aggtccataagttaatagcttt

SEQ ID NO: 146712 - DNA, 22 bp, Artificial Sequence
  Synthetic oligonucleotide; TTA chr11 5208236 5208257 5208241 5208236 -
atagctttgttttgaggataag

SEQ ID NO: 146713 - DNA, 22 bp, Artificial Sequence
  Synthetic oligonucleotide; CTT chr11 5208229 5208250 5208234 5208229 -
tgttttgaggataagttacttc

SEQ ID NO: 146714 - DNA, 22 bp, Artificial Sequence
  Synthetic oligonucleotide; TTT chr11 5208228 5208249 5208233 5208228 -
gttttgaggataagttacttct

SEQ ID NO: 146715 - DNA, 22 bp, Artificial Sequence
  Synthetic oligonucleotide; TTG chr11 5208227 5208248 5208232 5208227 -
ttttgaggataagttacttctc

SEQ ID NO: 146716 - DNA, 22 bp, Artificial Sequence
  Synthetic oligonucleotide; TTT chr11 5208224 5208245 5208229 5208224 -
tgaggataagttacttctctat

SEQ ID NO: 146717 - DNA, 22 bp, Artificial Sequence
  Synthetic oligonucleotide; TTT chr11 5208223 5208244 5208228 5208223 -
gaggataagttacttctctatg

SEQ ID NO: 146718 - DNA, 22 bp, Artificial Sequence
  Synthetic oligonucleotide; TTG chr11 5208222 5208243 5208227 5208222 -
aggataagttacttctctatgc

SEQ ID NO: 146719 - DNA, 22 bp, Artificial Sequence
  Synthetic oligonucleotide; TTA chr11 5208211 5208232 5208216 5208211 -
cttctctatgccttacattcct

SEQ ID NO: 146720 - DNA, 22 bp, Artificial Sequence
  Synthetic oligonucleotide; CTT chr11 5208208 5208229 5208213 5208208 -
ctctatgccttacattcctcaa

SEQ ID NO: 146721 - DNA, 22 bp, Artificial Sequence
  Synthetic oligonucleotide; TTC chr11 5208207 5208228 5208212 5208207 -
tctatgccttacattcctcaat

SEQ ID NO: 146722 - DNA, 22 bp, Artificial Sequence
  Synthetic oligonucleotide; CTC chr11 5208205 5208226 5208210 5208205 -
tatgccttacattcctcaataa

SEQ ID NO: 146723 - DNA, 22 bp, Artificial Sequence
  Synthetic oligonucleotide; CTA chr11 5208203 5208224 5208208 5208203 -
tgccttacattcctcaataata

SEQ ID NO: 146724 - DNA, 22 bp, Artificial Sequence
  Synthetic oligonucleotide; CTT chr11 5208197 5208218 5208202 5208197 -
acattcctcaataataaattaa

SEQ ID NO: 146725 - DNA, 22 bp, Artificial Sequence
  Synthetic oligonucleotide; TTA chr11 5208196 5208217 5208201 5208196 -
cattcctcaataataaattaag

SEQ ID NO: 146726 - DNA, 22 bp, Artificial Sequence
  Synthetic oligonucleotide; TTC chr11 5208191 5208212 5208196 5208191 -
ctcaataataaattaagagcta

SEQ ID NO: 146727 - DNA, 22 bp, Artificial Sequence
  Synthetic oligonucleotide; CTC chr11 5208188 5208209 5208193 5208188 -
aataataaattaagagctataa

SEQ ID NO: 146728 - DNA, 22 bp, Artificial Sequence
  Synthetic oligonucleotide; TTA chr11 5208176 5208197 5208181 5208176 -
agagctataatggaatctactt

SEQ ID NO: 146729 - DNA, 22 bp, Artificial Sequence
  Synthetic oligonucleotide; CTA chr11 5208169 5208190 5208174 5208169 -
taatggaatctactttataaat

SEQ ID NO: 146730 - DNA, 22 bp, Artificial Sequence
  Synthetic oligonucleotide; CTA chr11 5208157 5208178 5208162 5208157 -
ctttataaatttcttatagtga

SEQ ID NO: 146731 - DNA, 22 bp, Artificial Sequence
  Synthetic oligonucleotide; CTT chr11 5208154 5208175 5208159 5208154 -
tataaatttcttatagtgagta

SEQ ID NO: 146732 - DNA, 22 bp, Artificial Sequence
  Synthetic oligonucleotide; TTT chr11 5208153 5208174 5208158 5208153 -
ataaatttcttatagtgagtaa

SEQ ID NO: 146733 - DNA, 22 bp, Artificial Sequence
  Synthetic oligonucleotide; TTA chr11 5208152 5208173 5208157 5208152 -
taaatttcttatagtgagtaaa

SEQ ID NO: 146734 - DNA, 22 bp, Artificial Sequence
  Synthetic oligonucleotide; TTT chr11 5208145 5208166 5208150 5208145 -
cttatagtgagtaaattaacat

SEQ ID NO: 146735 - DNA, 22 bp, Artificial Sequence
  Synthetic oligonucleotide; TTC chr11 5208144 5208165 5208149 5208144 -
ttatagtgagtaaattaacata

SEQ ID NO: 146736 - DNA, 22 bp, Artificial Sequence
  Synthetic oligonucleotide; CTT chr11 5208142 5208163 5208147 5208142 -
atagtgagtaaattaacataaa

SEQ ID NO: 146737 - DNA, 22 bp, Artificial Sequence
  Synthetic oligonucleotide; TTA chr11 5208141 5208162 5208146 5208141 -
tagtgagtaaattaacataaat

SEQ ID NO: 146738 - DNA, 22 bp, Artificial Sequence
  Synthetic oligonucleotide; TTA chr11 5208127 5208148 5208132 5208127 -
acataaattccttcgaaaaatg

SEQ ID NO: 146739 - DNA, 22 bp, Artificial Sequence
  Synthetic oligonucleotide; TTC chr11 5208117 5208138 5208122 5208117 -
cttcgaaaaatgacaaaccaaa

SEQ ID NO: 146740 - DNA, 22 bp, Artificial Sequence
  Synthetic oligonucleotide; CTT chr11 5208114 5208135 5208119 5208114 -
cgaaaaatgacaaaccaaataa

SEQ ID NO: 146741 - DNA, 22 bp, Artificial Sequence
  Synthetic oligonucleotide; TTC chr11 5208113 5208134 5208118 5208113 -
gaaaaatgacaaaccaaataag

SEQ ID NO: 146742 - DNA, 22 bp, Artificial Sequence
  Synthetic oligonucleotide; TTC chr11 5208088 5208109 5208093 5208088 -
ccagtaaatattaactttttat

SEQ ID NO: 146743 - DNA, 22 bp, Artificial Sequence
  Synthetic oligonucleotide; TTA chr11 5208075 5208096 5208080 5208075 -
actttttatcatgatgatcatg

SEQ ID NO: 146744 - DNA, 22 bp, Artificial Sequence
  Synthetic oligonucleotide; CTT chr11 5208071 5208092 5208076 5208071 -
tttatcatgatgatcatggtga

SEQ ID NO: 146745 - DNA, 22 bp, Artificial Sequence
  Synthetic oligonucleotide; TTT chr11 5208070 5208091 5208075 5208070 -
ttatcatgatgatcatggtgat

SEQ ID NO: 146746 - DNA, 22 bp, Artificial Sequence
  Synthetic oligonucleotide; TTT chr11 5208069 5208090 5208074 5208069 -
tatcatgatgatcatggtgata

SEQ ID NO: 146747 - DNA, 22 bp, Artificial Sequence
  Synthetic oligonucleotide; TTT chr11 5208068 5208089 5208073 5208068 -
atcatgatgatcatggtgatat

SEQ ID NO: 146748 - DNA, 22 bp, Artificial Sequence
  Synthetic oligonucleotide; TTA chr11 5208067 5208088 5208072 5208067 -
tcatgatgatcatggtgatatt

SEQ ID NO: 146749 - DNA, 22 bp, Artificial Sequence
  Synthetic oligonucleotide; TTA chr11 5208044 5208065 5208049 5208044 -
ataataaaactaaaattataat

SEQ ID NO: 146750 - DNA, 22 bp, Artificial Sequence
  Synthetic oligonucleotide; CTA chr11 5208032 5208053 5208037 5208032 -
aaattataatttttttcttcac

SEQ ID NO: 146751 - DNA, 22 bp, Artificial Sequence
  Synthetic oligonucleotide; TTA chr11 5208026 5208047 5208031 5208026 -
taatttttttcttcacctatag

SEQ ID NO: 146752 - DNA, 22 bp, Artificial Sequence
  Synthetic oligonucleotide; TTT chr11 5208020 5208041 5208025 5208020 -
ttttcttcacctatagccacag

SEQ ID NO: 146753 - DNA, 22 bp, Artificial Sequence
  Synthetic oligonucleotide; TTT chr11 5208019 5208040 5208024 5208019 -
tttcttcacctatagccacagt

SEQ ID NO: 146754 - DNA, 22 bp, Artificial Sequence
  Synthetic oligonucleotide; TTT chr11 5208018 5208039 5208023 5208018 -
ttcttcacctatagccacagtc

SEQ ID NO: 146755 - DNA, 22 bp, Artificial Sequence
  Synthetic oligonucleotide; TTT chr11 5208017 5208038 5208022 5208017 -
tcttcacctatagccacagtca

SEQ ID NO: 146756 - DNA, 22 bp, Artificial Sequence
  Synthetic oligonucleotide; TTT chr11 5208016 5208037 5208021 5208016 -
cttcacctatagccacagtcag

SEQ ID NO: 146757 - DNA, 22 bp, Artificial Sequence
  Synthetic oligonucleotide; TTC chr11 5208015 5208036 5208020 5208015 -
ttcacctatagccacagtcagc

SEQ ID NO: 146758 - DNA, 22 bp, Artificial Sequence
  Synthetic oligonucleotide; CTT chr11 5208013 5208034 5208018 5208013 -
cacctatagccacagtcagctt

SEQ ID NO: 146759 - DNA, 22 bp, Artificial Sequence
  Synthetic oligonucleotide; TTC chr11 5208012 5208033 5208017 5208012 -
acctatagccacagtcagcttc

SEQ ID NO: 146760 - DNA, 22 bp, Artificial Sequence
  Synthetic oligonucleotide; CTA chr11 5208007 5208028 5208012 5208007 -
tagccacagtcagcttctcaaa

SEQ ID NO: 146761 - DNA, 22 bp, Artificial Sequence
  Synthetic oligonucleotide; CTT chr11 5207991 5208012 5207996 5207991 -
ctcaaagacaaatatgattatg

SEQ ID NO: 146762 - DNA, 22 bp, Artificial Sequence
  Synthetic oligonucleotide; TTC chr11 5207990 5208011 5207995 5207990 -
tcaaagacaaatatgattatgc

SEQ ID NO: 146763 - DNA, 22 bp, Artificial Sequence
  Synthetic oligonucleotide; CTC chr11 5207988 5208009 5207993 5207988 -
aaagacaaatatgattatgcct

SEQ ID NO: 146764 - DNA, 22 bp, Artificial Sequence
  Synthetic oligonucleotide; TTA chr11 5207971 5207992 5207976 5207971 -
tgcctcacctttttatgatcta

SEQ ID NO: 146765 - DNA, 22 bp, Artificial Sequence
  Synthetic oligonucleotide; CTC chr11 5207965 5207986 5207970 5207965 -
acctttttatgatctaatagct

SEQ ID NO: 146766 - DNA, 22 bp, Artificial Sequence
  Synthetic oligonucleotide; CTT chr11 5207960 5207981 5207965 5207960 -
tttatgatctaatagctactaa

SEQ ID NO: 146767 - DNA, 22 bp, Artificial Sequence
  Synthetic oligonucleotide; TTT chr11 5207959 5207980 5207964 5207959 -
ttatgatctaatagctactaat

SEQ ID NO: 146768 - DNA, 22 bp, Artificial Sequence
  Synthetic oligonucleotide; TTT chr11 5207958 5207979 5207963 5207958 -
tatgatctaatagctactaatt

SEQ ID NO: 146769 - DNA, 22 bp, Artificial Sequence
  Synthetic oligonucleotide; TTT chr11 5207957 5207978 5207962 5207957 -
atgatctaatagctactaattt

SEQ ID NO: 146770 - DNA, 22 bp, Artificial Sequence
  Synthetic oligonucleotide; TTA chr11 5207956 5207977 5207961 5207956 -
tgatctaatagctactaatttc

SEQ ID NO: 146771 - DNA, 22 bp, Artificial Sequence
  Synthetic oligonucleotide; CTA chr11 5207949 5207970 5207954 5207949 -
atagctactaatttctccacgc

SEQ ID NO: 146772 - DNA, 22 bp, Artificial Sequence
  Synthetic oligonucleotide; CTA chr11 5207942 5207963 5207947 5207942 -
ctaatttctccacgctgacgtt

SEQ ID NO: 146773 - DNA, 22 bp, Artificial Sequence
  Synthetic oligonucleotide; CTA chr11 5207939 5207960 5207944 5207939 -
atttctccacgctgacgtttac

SEQ ID NO: 146774 - DNA, 22 bp, Artificial Sequence
  Synthetic oligonucleotide; TTT chr11 5207935 5207956 5207940 5207935 -
ctccacgctgacgtttaccaca

SEQ ID NO: 146775 - DNA, 22 bp, Artificial Sequence
  Synthetic oligonucleotide; TTC chr11 5207934 5207955 5207939 5207934 -
tccacgctgacgtttaccacag

SEQ ID NO: 146776 - DNA, 22 bp, Artificial Sequence
  Synthetic oligonucleotide; CTC chr11 5207932 5207953 5207937 5207932 -
cacgctgacgtttaccacagaa

SEQ ID NO: 146777 - DNA, 22 bp, Artificial Sequence
  Synthetic oligonucleotide; CTG chr11 5207925 5207946 5207930 5207925 -
acgtttaccacagaacctggac

SEQ ID NO: 146778 - DNA, 22 bp, Artificial Sequence
  Synthetic oligonucleotide; TTT chr11 5207919 5207940 5207924 5207919 -
accacagaacctggacataggt

SEQ ID NO: 146779 - DNA, 22 bp, Artificial Sequence
  Synthetic oligonucleotide; TTA chr11 5207918 5207939 5207923 5207918 -
ccacagaacctggacataggtg

SEQ ID NO: 146780 - DNA, 22 bp, Artificial Sequence
  Synthetic oligonucleotide; CTG chr11 5207906 5207927 5207911 5207906 -
gacataggtgttgcacacacta

SEQ ID NO: 146781 - DNA, 22 bp, Artificial Sequence
  Synthetic oligonucleotide; TTG chr11 5207893 5207914 5207898 5207893 -
cacacactatgatctctaataa

SEQ ID NO: 146782 - DNA, 22 bp, Artificial Sequence
  Synthetic oligonucleotide; CTA chr11 5207884 5207905 5207889 5207884 -
tgatctctaataaataaataaa

SEQ ID NO: 146783 - DNA, 22 bp, Artificial Sequence
  Synthetic oligonucleotide; CTC chr11 5207877 5207898 5207882 5207877 -
taataaataaataaaataaata

SEQ ID NO: 146784 - DNA, 22 bp, Artificial Sequence
  Synthetic oligonucleotide; CTA chr11 5207875 5207896 5207880 5207875 -
ataaataaataaaataaataaa

SEQ ID NO: 146785 - DNA, 22 bp, Artificial Sequence
  Synthetic oligonucleotide; TTG chr11 5207817 5207838 5207822 5207817 -
agtgaatatgttatatgctacg

SEQ ID NO: 146786 - DNA, 22 bp, Artificial Sequence
  Synthetic oligonucleotide; TTA chr11 5207804 5207825 5207809 5207804 -
tatgctacggcaccagtggtct

SEQ ID NO: 146787 - DNA, 22 bp, Artificial Sequence
  Synthetic oligonucleotide; CTA chr11 5207797 5207818 5207802 5207797 -
cggcaccagtggtctttctggg

SEQ ID NO: 146788 - DNA, 22 bp, Artificial Sequence
  Synthetic oligonucleotide; CTT chr11 5207781 5207802 5207786 5207781 -
tctgggtattgtacacttgccc

SEQ ID NO: 146789 - DNA, 22 bp, Artificial Sequence
  Synthetic oligonucleotide; TTT chr11 5207780 5207801 5207785 5207780 -
ctgggtattgtacacttgcccc

SEQ ID NO: 146790 - DNA, 22 bp, Artificial Sequence
  Synthetic oligonucleotide; TTC chr11 5207779 5207800 5207784 5207779 -
tgggtattgtacacttgcccca

SEQ ID NO: 146791 - DNA, 22 bp, Artificial Sequence
  Synthetic oligonucleotide; CTG chr11 5207777 5207798 5207782 5207777 -
ggtattgtacacttgccccatt

SEQ ID NO: 146792 - DNA, 22 bp, Artificial Sequence
  Synthetic oligonucleotide; TTG chr11 5207770 5207791 5207775 5207770 -
tacacttgccccattctaggac

SEQ ID NO: 146793 - DNA, 22 bp, Artificial Sequence
  Synthetic oligonucleotide; CTT chr11 5207763 5207784 5207768 5207763 -
gccccattctaggacaatggtt

SEQ ID NO: 146794 - DNA, 22 bp, Artificial Sequence
  Synthetic oligonucleotide; TTG chr11 5207762 5207783 5207767 5207762 -
ccccattctaggacaatggttc

SEQ ID NO: 146795 - DNA, 22 bp, Artificial Sequence
  Synthetic oligonucleotide; TTC chr11 5207754 5207775 5207759 5207754 -
taggacaatggttccttctgat

SEQ ID NO: 146796 - DNA, 22 bp, Artificial Sequence
  Synthetic oligonucleotide; CTA chr11 5207752 5207773 5207757 5207752 -
ggacaatggttccttctgatta

SEQ ID NO: 146797 - DNA, 22 bp, Artificial Sequence
  Synthetic oligonucleotide; TTC chr11 5207740 5207761 5207745 5207740 -
cttctgattagttaccttttcc

SEQ ID NO: 146798 - DNA, 22 bp, Artificial Sequence
  Synthetic oligonucleotide; CTT chr11 5207737 5207758 5207742 5207737 -
ctgattagttaccttttccagt

SEQ ID NO: 146799 - DNA, 22 bp, Artificial Sequence
  Synthetic oligonucleotide; TTC chr11 5207736 5207757 5207741 5207736 -
tgattagttaccttttccagtc

SEQ ID NO: 146800 - DNA, 22 bp, Artificial Sequence
  Synthetic oligonucleotide; CTG chr11 5207734 5207755 5207739 5207734 -
attagttaccttttccagtctg

SEQ ID NO: 146801 - DNA, 22 bp, Artificial Sequence
  Synthetic oligonucleotide; TTA chr11 5207730 5207751 5207735 5207730 -
gttaccttttccagtctgagag

SEQ ID NO: 146802 - DNA, 22 bp, Artificial Sequence
  Synthetic oligonucleotide; TTA chr11 5207726 5207747 5207731 5207726 -
ccttttccagtctgagagacat

SEQ ID NO: 146803 - DNA, 22 bp, Artificial Sequence
  Synthetic oligonucleotide; CTT chr11 5207722 5207743 5207727 5207722 -
ttccagtctgagagacatgcct

SEQ ID NO: 146804 - DNA, 22 bp, Artificial Sequence
  Synthetic oligonucleotide; TTT chr11 5207721 5207742 5207726 5207721 -
tccagtctgagagacatgcctg

SEQ ID NO: 146805 - DNA, 22 bp, Artificial Sequence
  Synthetic oligonucleotide; TTT chr11 5207720 5207741 5207725 5207720 -
ccagtctgagagacatgcctgg

SEQ ID NO: 146806 - DNA, 22 bp, Artificial Sequence
  Synthetic oligonucleotide; TTC chr11 5207719 5207740 5207724 5207719 -
cagtctgagagacatgcctggc

SEQ ID NO: 146807 - DNA, 22 bp, Artificial Sequence
  Synthetic oligonucleotide; CTG chr11 5207712 5207733 5207717 5207712 -
agagacatgcctggctcacacc

SEQ ID NO: 146808 - DNA, 22 bp, Artificial Sequence
  Synthetic oligonucleotide; CTG chr11 5207699 5207720 5207704 5207699 -
gctcacacctgatttgtaaggc

SEQ ID NO: 146809 - DNA, 22 bp, Artificial Sequence
  Synthetic oligonucleotide; CTC chr11 5207695 5207716 5207700 5207695 -
acacctgatttgtaaggcaatg

SEQ ID NO: 146810 - DNA, 22 bp, Artificial Sequence
  Synthetic oligonucleotide; CTG chr11 5207688 5207709 5207693 5207688 -
atttgtaaggcaatggagatgg

SEQ ID NO: 146811 - DNA, 22 bp, Artificial Sequence
  Synthetic oligonucleotide; TTT chr11 5207684 5207705 5207689 5207684 -
gtaaggcaatggagatggagac

SEQ ID NO: 146812 - DNA, 22 bp, Artificial Sequence
  Synthetic oligonucleotide; TTG chr11 5207683 5207704 5207688 5207683 -
taaggcaatggagatggagaca

SEQ ID NO: 146813 - DNA, 22 bp, Artificial Sequence
  Synthetic oligonucleotide; CTC chr11 5207658 5207679 5207663 5207658 -
ttatatccaaaagtacatagct

SEQ ID NO: 146814 - DNA, 22 bp, Artificial Sequence
  Synthetic oligonucleotide; CTT chr11 5207656 5207677 5207661 5207656 -
atatccaaaagtacatagctcc

SEQ ID NO: 146815 - DNA, 22 bp, Artificial Sequence
  Synthetic oligonucleotide; TTA chr11 5207655 5207676 5207660 5207655 -
tatccaaaagtacatagctccg

SEQ ID NO: 146816 - DNA, 22 bp, Artificial Sequence
  Synthetic oligonucleotide; CTC chr11 5207635 5207656 5207640 5207635 -
cggtagcttagataataaacct

SEQ ID NO: 146817 - DNA, 22 bp, Artificial Sequence
  Synthetic oligonucleotide; CTT chr11 5207626 5207647 5207631 5207626 -
agataataaacctttgtcacct

SEQ ID NO: 146818 - DNA, 22 bp, Artificial Sequence
  Synthetic oligonucleotide; TTA chr11 5207625 5207646 5207630 5207625 -
gataataaacctttgtcacctc

SEQ ID NO: 146819 - DNA, 22 bp, Artificial Sequence
  Synthetic oligonucleotide; CTT chr11 5207612 5207633 5207617 5207612 -
tgtcacctctagagaattctaa

SEQ ID NO: 146820 - DNA, 22 bp, Artificial Sequence
  Synthetic oligonucleotide; TTT chr11 5207611 5207632 5207616 5207611 -
gtcacctctagagaattctaaa

SEQ ID NO: 146821 - DNA, 22 bp, Artificial Sequence
  Synthetic oligonucleotide; TTG chr11 5207610 5207631 5207615 5207610 -
tcacctctagagaattctaaaa

SEQ ID NO: 146822 - DNA, 22 bp, Artificial Sequence
  Synthetic oligonucleotide; CTC chr11 5207603 5207624 5207608 5207603 -
tagagaattctaaaaatccaca

SEQ ID NO: 146823 - DNA, 22 bp, Artificial Sequence
  Synthetic oligonucleotide; CTA chr11 5207601 5207622 5207606 5207601 -
gagaattctaaaaatccacaga

SEQ ID NO: 146824 - DNA, 22 bp, Artificial Sequence
  Synthetic oligonucleotide; TTC chr11 5207593 5207614 5207598 5207593 -
taaaaatccacagatttagaaa

SEQ ID NO: 146825 - DNA, 22 bp, Artificial Sequence
  Synthetic oligonucleotide; CTA chr11 5207591 5207612 5207596 5207591 -
aaaatccacagatttagaaatt

SEQ ID NO: 146826 - DNA, 22 bp, Artificial Sequence
  Synthetic oligonucleotide; TTT chr11 5207576 5207597 5207581 5207576 -
agaaattctaggaatccaagaa

SEQ ID NO: 146827 - DNA, 22 bp, Artificial Sequence
  Synthetic oligonucleotide; TTA chr11 5207575 5207596 5207580 5207575 -
gaaattctaggaatccaagaaa

SEQ ID NO: 146828 - DNA, 22 bp, Artificial Sequence
  Synthetic oligonucleotide; TTC chr11 5207568 5207589 5207573 5207568 -
taggaatccaagaaattacaat

SEQ ID NO: 146829 - DNA, 22 bp, Artificial Sequence
  Synthetic oligonucleotide; CTA chr11 5207566 5207587 5207571 5207566 -
ggaatccaagaaattacaattt

SEQ ID NO: 146830 - DNA, 22 bp, Artificial Sequence
  Synthetic oligonucleotide; TTA chr11 5207550 5207571 5207555 5207550 -
caattttagatctactacaatt

SEQ ID NO: 146831 - DNA, 22 bp, Artificial Sequence
  Synthetic oligonucleotide; TTT chr11 5207544 5207565 5207549 5207544 -
tagatctactacaatttcacaa

SEQ ID NO: 146832 - DNA, 22 bp, Artificial Sequence
  Synthetic oligonucleotide; TTT chr11 5207543 5207564 5207548 5207543 -
agatctactacaatttcacaat

SEQ ID NO: 146833 - DNA, 22 bp, Artificial Sequence
  Synthetic oligonucleotide; TTA chr11 5207542 5207563 5207547 5207542 -
gatctactacaatttcacaata

SEQ ID NO: 146834 - DNA, 22 bp, Artificial Sequence
  Synthetic oligonucleotide; CTA chr11 5207536 5207557 5207541 5207536 -
ctacaatttcacaatataacaa

SEQ ID NO: 146835 - DNA, 22 bp, Artificial Sequence
  Synthetic oligonucleotide; CTA chr11 5207533 5207554 5207538 5207533 -
caatttcacaatataacaataa

SEQ ID NO: 146836 - DNA, 22 bp, Artificial Sequence
  Synthetic oligonucleotide; TTT chr11 5207527 5207548 5207532 5207527 -
cacaatataacaataaccaata

SEQ ID NO: 146837 - DNA, 22 bp, Artificial Sequence
  Synthetic oligonucleotide; TTC chr11 5207526 5207547 5207531 5207526 -
acaatataacaataaccaataa

SEQ ID NO: 146838 - DNA, 22 bp, Artificial Sequence
  Synthetic oligonucleotide; TTT chr11 5207492 5207513 5207497 5207492 -
tatttacataaataaaagatgg

SEQ ID NO: 146839 - DNA, 22 bp, Artificial Sequence
  Synthetic oligonucleotide; TTT chr11 5207491 5207512 5207496 5207491 -
atttacataaataaaagatggg

SEQ ID NO: 146840 - DNA, 22 bp, Artificial Sequence
  Synthetic oligonucleotide; TTA chr11 5207490 5207511 5207495 5207490 -
tttacataaataaaagatgggt

SEQ ID NO: 146841 - DNA, 22 bp, Artificial Sequence
  Synthetic oligonucleotide; TTT chr11 5207487 5207508 5207492 5207487 -
acataaataaaagatgggtttg

SEQ ID NO: 146842 - DNA, 22 bp, Artificial Sequence
  Synthetic oligonucleotide; TTA chr11 5207486 5207507 5207491 5207486 -
cataaataaaagatgggtttgt

SEQ ID NO: 146843 - DNA, 22 bp, Artificial Sequence
  Synthetic oligonucleotide; TTT chr11 5207466 5207487 5207471 5207466 -
gtcacacaatttaaaaatctag

SEQ ID NO: 146844 - DNA, 22 bp, Artificial Sequence
  Synthetic oligonucleotide; TTG chr11 5207465 5207486 5207470 5207465 -
tcacacaatttaaaaatctagg

SEQ ID NO: 146845 - DNA, 22 bp, Artificial Sequence
  Synthetic oligonucleotide; TTT chr11 5207454 5207475 5207459 5207454 -
aaaaatctagggtcgaaagcca

SEQ ID NO: 146846 - DNA, 22 bp, Artificial Sequence
  Synthetic oligonucleotide; TTA chr11 5207453 5207474 5207458 5207453 -
aaaatctagggtcgaaagccac

SEQ ID NO: 146847 - DNA, 22 bp, Artificial Sequence
  Synthetic oligonucleotide; CTA chr11 5207445 5207466 5207450 5207445 -
gggtcgaaagccacagcaaagg

SEQ ID NO: 146848 - DNA, 22 bp, Artificial Sequence
  Synthetic oligonucleotide; CTC chr11 5207416 5207437 5207421 5207416 -
ctggcactatatcacaatagat

SEQ ID NO: 146849 - DNA, 22 bp, Artificial Sequence
  Synthetic oligonucleotide; CTG chr11 5207413 5207434 5207418 5207413 -
gcactatatcacaatagatgac

SEQ ID NO: 146850 - DNA, 22 bp, Artificial Sequence
  Synthetic oligonucleotide; CTA chr11 5207407 5207428 5207412 5207407 -
tatcacaatagatgacacctgc

SEQ ID NO: 146851 - DNA, 22 bp, Artificial Sequence
  Synthetic oligonucleotide; CTG chr11 5207386 5207407 5207391 5207386 -
catagagaaagcaaagtggtca

SEQ ID NO: 146852 - DNA, 22 bp, Artificial Sequence
  Synthetic oligonucleotide; TTA chr11 5207359 5207380 5207364 5207359 -
gtcactgattgcctcaaataat

SEQ ID NO: 146853 - DNA, 22 bp, Artificial Sequence
  Synthetic oligonucleotide; CTG chr11 5207352 5207373 5207357 5207352 -
attgcctcaaataatccctgtg

SEQ ID NO: 146854 - DNA, 22 bp, Artificial Sequence
  Synthetic oligonucleotide; TTG chr11 5207348 5207369 5207353 5207348 -
cctcaaataatccctgtgggga

SEQ ID NO: 146855 - DNA, 22 bp, Artificial Sequence
  Synthetic oligonucleotide; CTC chr11 5207344 5207365 5207349 5207344 -
aaataatccctgtggggatgtc

SEQ ID NO: 146856 - DNA, 22 bp, Artificial Sequence
  Synthetic oligonucleotide; CTG chr11 5207332 5207353 5207337 5207332 -
tggggatgtctactcttttgta

SEQ ID NO: 146857 - DNA, 22 bp, Artificial Sequence
  Synthetic oligonucleotide; CTA chr11 5207320 5207341 5207325 5207320 -
ctcttttgtattccatcagctt

SEQ ID NO: 146858 - DNA, 22 bp, Artificial Sequence
  Synthetic oligonucleotide; CTC chr11 5207317 5207338 5207322 5207317 -
ttttgtattccatcagcttttt

SEQ ID NO: 146859 - DNA, 22 bp, Artificial Sequence
  Synthetic oligonucleotide; CTT chr11 5207315 5207336 5207320 5207315 -
ttgtattccatcagcttttttc

SEQ ID NO: 146860 - DNA, 22 bp, Artificial Sequence
  Synthetic oligonucleotide; TTT chr11 5207314 5207335 5207319 5207314 -
tgtattccatcagcttttttcc

SEQ ID NO: 146861 - DNA, 22 bp, Artificial Sequence
  Synthetic oligonucleotide; TTT chr11 5207313 5207334 5207318 5207313 -
gtattccatcagcttttttccc

SEQ ID NO: 146862 - DNA, 22 bp, Artificial Sequence
  Synthetic oligonucleotide; TTG chr11 5207312 5207333 5207317 5207312 -
tattccatcagcttttttccca

SEQ ID NO: 146863 - DNA, 22 bp, Artificial Sequence
  Synthetic oligonucleotide; TTC chr11 5207307 5207328 5207312 5207307 -
catcagcttttttcccagtaac

SEQ ID NO: 146864 - DNA, 22 bp, Artificial Sequence
  Synthetic oligonucleotide; CTT chr11 5207298 5207319 5207303 5207298 -
ttttcccagtaacaacacatcc

SEQ ID NO: 146865 - DNA, 22 bp, Artificial Sequence
  Synthetic oligonucleotide; TTT chr11 5207297 5207318 5207302 5207297 -
tttcccagtaacaacacatcct

SEQ ID NO: 146866 - DNA, 22 bp, Artificial Sequence
  Synthetic oligonucleotide; TTT chr11 5207296 5207317 5207301 5207296 -
ttcccagtaacaacacatccta

SEQ ID NO: 146867 - DNA, 22 bp, Artificial Sequence
  Synthetic oligonucleotide; TTT chr11 5207295 5207316 5207300 5207295 -
tcccagtaacaacacatcctag

SEQ ID NO: 146868 - DNA, 22 bp, Artificial Sequence
  Synthetic oligonucleotide; TTT chr11 5207294 5207315 5207299 5207294 -
cccagtaacaacacatcctagc

SEQ ID NO: 146869 - DNA, 22 bp, Artificial Sequence
  Synthetic oligonucleotide; TTC chr11 5207293 5207314 5207298 5207293 -
ccagtaacaacacatcctagca

SEQ ID NO: 146870 - DNA, 22 bp, Artificial Sequence
  Synthetic oligonucleotide; CTA chr11 5207274 5207295 5207279 5207274 -
gcaataatatcctgacgagttt

SEQ ID NO: 146871 - DNA, 22 bp, Artificial Sequence
  Synthetic oligonucleotide; CTG chr11 5207260 5207281 5207265 5207260 -
acgagtttctataaaaaaaaaa

SEQ ID NO: 146872 - DNA, 22 bp, Artificial Sequence
  Synthetic oligonucleotide; TTT chr11 5207252 5207273 5207257 5207252 -
ctataaaaaaaaaaaactcccc

SEQ ID NO: 146873 - DNA, 22 bp, Artificial Sequence
  Synthetic oligonucleotide; TTC chr11 5207251 5207272 5207256 5207251 -
tataaaaaaaaaaaactcccct

SEQ ID NO: 146874 - DNA, 22 bp, Artificial Sequence
  Synthetic oligonucleotide; CTA chr11 5207249 5207270 5207254 5207249 -
taaaaaaaaaaaactcccctcc

SEQ ID NO: 146875 - DNA, 22 bp, Artificial Sequence
  Synthetic oligonucleotide; CTC chr11 5207233 5207254 5207238 5207233 -
ccctcctaagatacagtatctt

SEQ ID NO: 146876 - DNA, 22 bp, Artificial Sequence
  Synthetic oligonucleotide; CTC chr11 5207228 5207249 5207233 5207228 -
ctaagatacagtatctttgtgg

SEQ ID NO: 146877 - DNA, 22 bp, Artificial Sequence
  Synthetic oligonucleotide; CTA chr11 5207225 5207246 5207230 5207225 -
agatacagtatctttgtggttg

SEQ ID NO: 146878 - DNA, 22 bp, Artificial Sequence
  Synthetic oligonucleotide; CTT chr11 5207211 5207232 5207216 5207211 -
tgtggttgcatccccagccatc

SEQ ID NO: 146879 - DNA, 22 bp, Artificial Sequence
  Synthetic oligonucleotide; TTT chr11 5207210 5207231 5207215 5207210 -
gtggttgcatccccagccatcc

SEQ ID NO: 146880 - DNA, 22 bp, Artificial Sequence
  Synthetic oligonucleotide; TTG chr11 5207209 5207230 5207214 5207209 -
tggttgcatccccagccatccc

SEQ ID NO: 146881 - DNA, 22 bp, Artificial Sequence
  Synthetic oligonucleotide; TTG chr11 5207203 5207224 5207208 5207203 -
catccccagccatccctcattt

SEQ ID NO: 146882 - DNA, 22 bp, Artificial Sequence
  Synthetic oligonucleotide; CTC chr11 5207185 5207206 5207190 5207185 -
atttggttgaggttggaatttc

SEQ ID NO: 146883 - DNA, 22 bp, Artificial Sequence
  Synthetic oligonucleotide; TTT chr11 5207181 5207202 5207186 5207181 -
ggttgaggttggaatttcaatg

SEQ ID NO: 146884 - DNA, 22 bp, Artificial Sequence
  Synthetic oligonucleotide; TTG chr11 5207180 5207201 5207185 5207180 -
gttgaggttggaatttcaatgg

SEQ ID NO: 146885 - DNA, 22 bp, Artificial Sequence
  Synthetic oligonucleotide; TTG chr11 5207176 5207197 5207181 5207176 -
aggttggaatttcaatgggtgg

SEQ ID NO: 146886 - DNA, 22 bp, Artificial Sequence
  Synthetic oligonucleotide; TTG chr11 5207170 5207191 5207175 5207170 -
gaatttcaatgggtgggttgaa

SEQ ID NO: 146887 - DNA, 22 bp, Artificial Sequence
  Synthetic oligonucleotide; TTT chr11 5207164 5207185 5207169 5207164 -
caatgggtgggttgaatttttc

SEQ ID NO: 146888 - DNA, 22 bp, Artificial Sequence
  Synthetic oligonucleotide; TTC chr11 5207163 5207184 5207168 5207163 -
aatgggtgggttgaatttttcc

SEQ ID NO: 146889 - DNA, 22 bp, Artificial Sequence
  Synthetic oligonucleotide; TTG chr11 5207150 5207171 5207155 5207150 -
aatttttccctaaacaaacttg

SEQ ID NO: 146890 - DNA, 22 bp, Artificial Sequence
  Synthetic oligonucleotide; TTT chr11 5207145 5207166 5207150 5207145 -
ttccctaaacaaacttgccatg

SEQ ID NO: 146891 - DNA, 22 bp, Artificial Sequence
  Synthetic oligonucleotide; TTT chr11 5207144 5207165 5207149 5207144 -
tccctaaacaaacttgccatgg

SEQ ID NO: 146892 - DNA, 22 bp, Artificial Sequence
  Synthetic oligonucleotide; TTT chr11 5207143 5207164 5207148 5207143 -
ccctaaacaaacttgccatggt

SEQ ID NO: 146893 - DNA, 22 bp, Artificial Sequence
  Synthetic oligonucleotide; TTC chr11 5207142 5207163 5207147 5207142 -
cctaaacaaacttgccatggta

SEQ ID NO: 146894 - DNA, 22 bp, Artificial Sequence
  Synthetic oligonucleotide; CTA chr11 5207138 5207159 5207143 5207138 -
aacaaacttgccatggtaaaat

SEQ ID NO: 146895 - DNA, 22 bp, Artificial Sequence
  Synthetic oligonucleotide; CTT chr11 5207129 5207150 5207134 5207129 -
gccatggtaaaatcaaggctag

SEQ ID NO: 146896 - DNA, 22 bp, Artificial Sequence
  Synthetic oligonucleotide; TTG chr11 5207128 5207149 5207133 5207128 -
ccatggtaaaatcaaggctagc

SEQ ID NO: 146897 - DNA, 22 bp, Artificial Sequence
  Synthetic oligonucleotide; CTA chr11 5207108 5207129 5207113 5207108 -
gcattactgttcacacaaggca

SEQ ID NO: 146898 - DNA, 22 bp, Artificial Sequence
  Synthetic oligonucleotide; TTA chr11 5207102 5207123 5207107 5207102 -
ctgttcacacaaggcactgtgc

SEQ ID NO: 146899 - DNA, 22 bp, Artificial Sequence
  Synthetic oligonucleotide; CTG chr11 5207099 5207120 5207104 5207099 -
ttcacacaaggcactgtgctaa

SEQ ID NO: 146900 - DNA, 22 bp, Artificial Sequence
  Synthetic oligonucleotide; TTC chr11 5207096 5207117 5207101 5207096 -
acacaaggcactgtgctaagat

SEQ ID NO: 146901 - DNA, 22 bp, Artificial Sequence
  Synthetic oligonucleotide; CTG chr11 5207083 5207104 5207088 5207083 -
tgctaagatccccatccttata

SEQ ID NO: 146902 - DNA, 22 bp, Artificial Sequence
  Synthetic oligonucleotide; CTA chr11 5207078 5207099 5207083 5207078 -
agatccccatccttatagcaat

SEQ ID NO: 146903 - DNA, 22 bp, Artificial Sequence
  Synthetic oligonucleotide; CTT chr11 5207064 5207085 5207069 5207064 -
atagcaatgggagggctcatag

SEQ ID NO: 146904 - DNA, 22 bp, Artificial Sequence
  Synthetic oligonucleotide; TTA chr11 5207063 5207084 5207068 5207063 -
tagcaatgggagggctcatagg

SEQ ID NO: 146905 - DNA, 22 bp, Artificial Sequence
  Synthetic oligonucleotide; CTC chr11 5207046 5207067 5207051 5207046 -
ataggcaagtcatgtcatgcag

SEQ ID NO: 146906 - DNA, 22 bp, Artificial Sequence
  Synthetic oligonucleotide; TTT chr11 5207015 5207036 5207020 5207015 -
catcatcccttcttgtctttgg

SEQ ID NO: 146907 - DNA, 22 bp, Artificial Sequence
  Synthetic oligonucleotide; TTC chr11 5207014 5207035 5207019 5207014 -
atcatcccttcttgtctttggg

SEQ ID NO: 146908 - DNA, 22 bp, Artificial Sequence
  Synthetic oligonucleotide; CTT chr11 5207004 5207025 5207009 5207004 -
cttgtctttggggacttgggtc

SEQ ID NO: 146909 - DNA, 22 bp, Artificial Sequence
  Synthetic oligonucleotide; TTC chr11 5207003 5207024 5207008 5207003 -
ttgtctttggggacttgggtct

SEQ ID NO: 146910 - DNA, 22 bp, Artificial Sequence
  Synthetic oligonucleotide; CTT chr11 5207001 5207022 5207006 5207001 -
gtctttggggacttgggtctct

SEQ ID NO: 146911 - DNA, 22 bp, Artificial Sequence
  Synthetic oligonucleotide; TTG chr11 5207000 5207021 5207005 5207000 -
tctttggggacttgggtctctc

SEQ ID NO: 146912 - DNA, 22 bp, Artificial Sequence
  Synthetic oligonucleotide; CTT chr11 5206996 5207017 5207001 5206996 -
tggggacttgggtctctccggt

SEQ ID NO: 146913 - DNA, 22 bp, Artificial Sequence
  Synthetic oligonucleotide; TTT chr11 5206995 5207016 5207000 5206995 -
ggggacttgggtctctccggtt

SEQ ID NO: 146914 - DNA, 22 bp, Artificial Sequence
  Synthetic oligonucleotide; TTG chr11 5206994 5207015 5206999 5206994 -
gggacttgggtctctccggttg

SEQ ID NO: 146915 - DNA, 22 bp, Artificial Sequence
  Synthetic oligonucleotide; CTT chr11 5206987 5207008 5206992 5206987 -
gggtctctccggttgtatagga

SEQ ID NO: 146916 - DNA, 22 bp, Artificial Sequence
  Synthetic oligonucleotide; TTG chr11 5206986 5207007 5206991 5206986 -
ggtctctccggttgtataggag

SEQ ID NO: 146917 - DNA, 22 bp, Artificial Sequence
  Synthetic oligonucleotide; CTC chr11 5206980 5207001 5206985 5206980 -
tccggttgtataggagatttcg

SEQ ID NO: 146918 - DNA, 22 bp, Artificial Sequence
  Synthetic oligonucleotide; CTC chr11 5206978 5206999 5206983 5206978 -
cggttgtataggagatttcgcc

SEQ ID NO: 146919 - DNA, 22 bp, Artificial Sequence
  Synthetic oligonucleotide; TTG chr11 5206972 5206993 5206977 5206972 -
tataggagatttcgccaggcat

SEQ ID NO: 146920 - DNA, 22 bp, Artificial Sequence
  Synthetic oligonucleotide; TTT chr11 5206960 5206981 5206965 5206960 -
cgccaggcatttgaatccttca

SEQ ID NO: 146921 - DNA, 22 bp, Artificial Sequence
  Synthetic oligonucleotide; TTC chr11 5206959 5206980 5206964 5206959 -
gccaggcatttgaatccttcac

SEQ ID NO: 146922 - DNA, 22 bp, Artificial Sequence
  Synthetic oligonucleotide; TTT chr11 5206948 5206969 5206953 5206948 -
gaatccttcactgctagtcatc

SEQ ID NO: 146923 - DNA, 22 bp, Artificial Sequence
  Synthetic oligonucleotide; TTG chr11 5206947 5206968 5206952 5206947 -
aatccttcactgctagtcatcc

SEQ ID NO: 146924 - DNA, 22 bp, Artificial Sequence
  Synthetic oligonucleotide; CTT chr11 5206940 5206961 5206945 5206940 -
cactgctagtcatcctggactc

SEQ ID NO: 146925 - DNA, 22 bp, Artificial Sequence
  Synthetic oligonucleotide; TTC chr11 5206939 5206960 5206944 5206939 -
actgctagtcatcctggactct

SEQ ID NO: 146926 - DNA, 22 bp, Artificial Sequence
  Synthetic oligonucleotide; CTG chr11 5206935 5206956 5206940 5206935 -
ctagtcatcctggactctgtgg

SEQ ID NO: 146927 - DNA, 22 bp, Artificial Sequence
  Synthetic oligonucleotide; CTA chr11 5206932 5206953 5206937 5206932 -
gtcatcctggactctgtggtgt

SEQ ID NO: 146928 - DNA, 22 bp, Artificial Sequence
  Synthetic oligonucleotide; CTG chr11 5206923 5206944 5206928 5206923 -
gactctgtggtgtacaatatcc

SEQ ID NO: 146929 - DNA, 22 bp, Artificial Sequence
  Synthetic oligonucleotide; CTC chr11 5206918 5206939 5206923 5206918 -
tgtggtgtacaatatccatctc

SEQ ID NO: 146930 - DNA, 22 bp, Artificial Sequence
  Synthetic oligonucleotide; CTG chr11 5206916 5206937 5206921 5206916 -
tggtgtacaatatccatctctc

SEQ ID NO: 146931 - DNA, 22 bp, Artificial Sequence
  Synthetic oligonucleotide; CTC chr11 5206896 5206917 5206901 5206896 -
tcctatgttctgaggtcagaat

SEQ ID NO: 146932 - DNA, 22 bp, Artificial Sequence
  Synthetic oligonucleotide; CTC chr11 5206894 5206915 5206899 5206894 -
ctatgttctgaggtcagaatga

SEQ ID NO: 146933 - DNA, 22 bp, Artificial Sequence
  Synthetic oligonucleotide; CTA chr11 5206891 5206912 5206896 5206891 -
tgttctgaggtcagaatgacct

SEQ ID NO: 146934 - DNA, 22 bp, Artificial Sequence
  Synthetic oligonucleotide; TTC chr11 5206886 5206907 5206891 5206886 -
tgaggtcagaatgacctctctc

SEQ ID NO: 146935 - DNA, 22 bp, Artificial Sequence
  Synthetic oligonucleotide; CTG chr11 5206884 5206905 5206889 5206884 -
aggtcagaatgacctctctctt

SEQ ID NO: 146936 - DNA, 22 bp, Artificial Sequence
  Synthetic oligonucleotide; CTC chr11 5206868 5206889 5206873 5206868 -
tctcttaaccagttgtctgggc

SEQ ID NO: 146937 - DNA, 22 bp, Artificial Sequence
  Synthetic oligonucleotide; CTC chr11 5206866 5206887 5206871 5206866 -
tcttaaccagttgtctgggccc

SEQ ID NO: 146938 - DNA, 22 bp, Artificial Sequence
  Synthetic oligonucleotide; CTC chr11 5206864 5206885 5206869 5206864 -
ttaaccagttgtctgggcccag

SEQ ID NO: 146939 - DNA, 22 bp, Artificial Sequence
  Synthetic oligonucleotide; CTT chr11 5206862 5206883 5206867 5206862 -
aaccagttgtctgggcccaggc

SEQ ID NO: 146940 - DNA, 22 bp, Artificial Sequence
  Synthetic oligonucleotide; TTA chr11 5206861 5206882 5206866 5206861 -
accagttgtctgggcccaggct

SEQ ID NO: 146941 - DNA, 22 bp, Artificial Sequence
  Synthetic oligonucleotide; TTG chr11 5206853 5206874 5206858 5206853 -
tctgggcccaggctccattatt

SEQ ID NO: 146942 - DNA, 22 bp, Artificial Sequence
  Synthetic oligonucleotide; CTG chr11 5206849 5206870 5206854 5206849 -
ggcccaggctccattattgata

SEQ ID NO: 146943 - DNA, 22 bp, Artificial Sequence
  Synthetic oligonucleotide; CTC chr11 5206838 5206859 5206843 5206838 -
cattattgatatagtcatgatc

SEQ ID NO: 146944 - DNA, 22 bp, Artificial Sequence
  Synthetic oligonucleotide; TTA chr11 5206833 5206854 5206838 5206833 -
ttgatatagtcatgatctcctc

SEQ ID NO: 146945 - DNA, 22 bp, Artificial Sequence
  Synthetic oligonucleotide; TTG chr11 5206830 5206851 5206835 5206830 -
atatagtcatgatctcctctgt

SEQ ID NO: 146946 - DNA, 22 bp, Artificial Sequence
  Synthetic oligonucleotide; CTC chr11 5206814 5206835 5206819 5206814 -
ctctgttggggatgaagtaggc

SEQ ID NO: 146947 - DNA, 22 bp, Artificial Sequence
  Synthetic oligonucleotide; CTC chr11 5206811 5206832 5206816 5206811 -
tgttggggatgaagtaggcaaa

SEQ ID NO: 146948 - DNA, 22 bp, Artificial Sequence
  Synthetic oligonucleotide; CTG chr11 5206809 5206830 5206814 5206809 -
ttggggatgaagtaggcaaatt

SEQ ID NO: 146949 - DNA, 22 bp, Artificial Sequence
  Synthetic oligonucleotide; TTG chr11 5206806 5206827 5206811 5206806 -
gggatgaagtaggcaaatttga

SEQ ID NO: 146950 - DNA, 22 bp, Artificial Sequence
  Synthetic oligonucleotide; TTT chr11 5206786 5206807 5206791 5206786 -
gaggcactaatttacttctcac

SEQ ID NO: 146951 - DNA, 22 bp, Artificial Sequence
  Synthetic oligonucleotide; TTG chr11 5206785 5206806 5206790 5206785 -
aggcactaatttacttctcaca

SEQ ID NO: 146952 - DNA, 22 bp, Artificial Sequence
  Synthetic oligonucleotide; CTA chr11 5206777 5206798 5206782 5206777 -
atttacttctcacattcttttc

SEQ ID NO: 146953 - DNA, 22 bp, Artificial Sequence
  Synthetic oligonucleotide; TTT chr11 5206773 5206794 5206778 5206773 -
acttctcacattcttttcttga

SEQ ID NO: 146954 - DNA, 22 bp, Artificial Sequence
  Synthetic oligonucleotide; TTA chr11 5206772 5206793 5206777 5206772 -
cttctcacattcttttcttgaa

SEQ ID NO: 146955 - DNA, 22 bp, Artificial Sequence
  Synthetic oligonucleotide; CTT chr11 5206769 5206790 5206774 5206769 -
ctcacattcttttcttgaacag

SEQ ID NO: 146956 - DNA, 22 bp, Artificial Sequence
  Synthetic oligonucleotide; TTC chr11 5206768 5206789 5206773 5206768 -
tcacattcttttcttgaacaga

SEQ ID NO: 146957 - DNA, 22 bp, Artificial Sequence
  Synthetic oligonucleotide; CTC chr11 5206766 5206787 5206771 5206766 -
acattcttttcttgaacagaaa

SEQ ID NO: 146958 - DNA, 22 bp, Artificial Sequence
  Synthetic oligonucleotide; TTC chr11 5206760 5206781 5206765 5206760 -
ttttcttgaacagaaagataga

SEQ ID NO: 146959 - DNA, 22 bp, Artificial Sequence
  Synthetic oligonucleotide; CTT chr11 5206758 5206779 5206763 5206758 -
ttcttgaacagaaagatagaac

SEQ ID NO: 146960 - DNA, 22 bp, Artificial Sequence
  Synthetic oligonucleotide; TTT chr11 5206757 5206778 5206762 5206757 -
tcttgaacagaaagatagaact

SEQ ID NO: 146961 - DNA, 22 bp, Artificial Sequence
  Synthetic oligonucleotide; TTT chr11 5206756 5206777 5206761 5206756 -
cttgaacagaaagatagaactg

SEQ ID NO: 146962 - DNA, 22 bp, Artificial Sequence
  Synthetic oligonucleotide; TTC chr11 5206755 5206776 5206760 5206755 -
ttgaacagaaagatagaactgg

SEQ ID NO: 146963 - DNA, 22 bp, Artificial Sequence
  Synthetic oligonucleotide; CTT chr11 5206753 5206774 5206758 5206753 -
gaacagaaagatagaactggaa

SEQ ID NO: 146964 - DNA, 22 bp, Artificial Sequence
  Synthetic oligonucleotide; TTG chr11 5206752 5206773 5206757 5206752 -
aacagaaagatagaactggaaa

SEQ ID NO: 146965 - DNA, 22 bp, Artificial Sequence
  Synthetic oligonucleotide; CTG chr11 5206734 5206755 5206739 5206734 -
gaaattaatagtagtatataaa

SEQ ID NO: 146966 - DNA, 22 bp, Artificial Sequence
  Synthetic oligonucleotide; TTA chr11 5206727 5206748 5206732 5206727 -
atagtagtatataaattcaaaa

SEQ ID NO: 146967 - DNA, 22 bp, Artificial Sequence
  Synthetic oligonucleotide; TTC chr11 5206709 5206730 5206714 5206709 -
aaaattttagctttaataacat

SEQ ID NO: 146968 - DNA, 22 bp, Artificial Sequence
  Synthetic oligonucleotide; TTT chr11 5206702 5206723 5206707 5206702 -
tagctttaataacatttaatca

SEQ ID NO: 146969 - DNA, 22 bp, Artificial Sequence
  Synthetic oligonucleotide; TTT chr11 5206701 5206722 5206706 5206701 -
agctttaataacatttaatcag

SEQ ID NO: 146970 - DNA, 22 bp, Artificial Sequence
  Synthetic oligonucleotide; TTA chr11 5206700 5206721 5206705 5206700 -
gctttaataacatttaatcaga

SEQ ID NO: 146971 - DNA, 22 bp, Artificial Sequence
  Synthetic oligonucleotide; CTT chr11 5206696 5206717 5206701 5206696 -
taataacatttaatcagacata

SEQ ID NO: 146972 - DNA, 22 bp, Artificial Sequence
  Synthetic oligonucleotide; TTT chr11 5206695 5206716 5206700 5206695 -
aataacatttaatcagacataa

SEQ ID NO: 146973 - DNA, 22 bp, Artificial Sequence
  Synthetic oligonucleotide; TTA chr11 5206694 5206715 5206699 5206694 -
ataacatttaatcagacataaa

SEQ ID NO: 146974 - DNA, 22 bp, Artificial Sequence
  Synthetic oligonucleotide; TTT chr11 5206685 5206706 5206690 5206685 -
aatcagacataaataattatgg

SEQ ID NO: 146975 - DNA, 22 bp, Artificial Sequence
  Synthetic oligonucleotide; TTA chr11 5206684 5206705 5206689 5206684 -
atcagacataaataattatggt

SEQ ID NO: 146976 - DNA, 22 bp, Artificial Sequence
  Synthetic oligonucleotide; TTA chr11 5206666 5206687 5206671 5206666 -
tggtaatgtgaatttcaataaa

SEQ ID NO: 146977 - DNA, 22 bp, Artificial Sequence
  Synthetic oligonucleotide; TTT chr11 5206651 5206672 5206656 5206651 -
caataaataaattttagttcta

SEQ ID NO: 146978 - DNA, 22 bp, Artificial Sequence
  Synthetic oligonucleotide; TTC chr11 5206650 5206671 5206655 5206650 -
aataaataaattttagttctaa

SEQ ID NO: 146979 - DNA, 22 bp, Artificial Sequence
  Synthetic oligonucleotide; TTT chr11 5206637 5206658 5206642 5206637 -
tagttctaatataagtgtaact

SEQ ID NO: 146980 - DNA, 22 bp, Artificial Sequence
  Synthetic oligonucleotide; TTT chr11 5206636 5206657 5206641 5206636 -
agttctaatataagtgtaactg

SEQ ID NO: 146981 - DNA, 22 bp, Artificial Sequence
  Synthetic oligonucleotide; TTA chr11 5206635 5206656 5206640 5206635 -
gttctaatataagtgtaactgt

SEQ ID NO: 146982 - DNA, 22 bp, Artificial Sequence
  Synthetic oligonucleotide; TTC chr11 5206631 5206652 5206636 5206631 -
taatataagtgtaactgtgtaa

SEQ ID NO: 146983 - DNA, 22 bp, Artificial Sequence
  Synthetic oligonucleotide; CTA chr11 5206629 5206650 5206634 5206629 -
atataagtgtaactgtgtaata

SEQ ID NO: 146984 - DNA, 22 bp, Artificial Sequence
  Synthetic oligonucleotide; CTG chr11 5206614 5206635 5206619 5206614 -
tgtaatattcatactttttctg

SEQ ID NO: 146985 - DNA, 22 bp, Artificial Sequence
  Synthetic oligonucleotide; TTC chr11 5206604 5206625 5206609 5206604 -
atactttttctgaaggctttac

SEQ ID NO: 146986 - DNA, 22 bp, Artificial Sequence
  Synthetic oligonucleotide; CTT chr11 5206598 5206619 5206603 5206598 -
tttctgaaggctttactaattt

SEQ ID NO: 146987 - DNA, 22 bp, Artificial Sequence
  Synthetic oligonucleotide; TTT chr11 5206597 5206618 5206602 5206597 -
ttctgaaggctttactaatttg

SEQ ID NO: 146988 - DNA, 22 bp, Artificial Sequence
  Synthetic oligonucleotide; TTT chr11 5206596 5206617 5206601 5206596 -
tctgaaggctttactaatttga

SEQ ID NO: 146989 - DNA, 22 bp, Artificial Sequence
  Synthetic oligonucleotide; TTT chr11 5206595 5206616 5206600 5206595 -
ctgaaggctttactaatttgat

SEQ ID NO: 146990 - DNA, 22 bp, Artificial Sequence
  Synthetic oligonucleotide; TTC chr11 5206594 5206615 5206599 5206594 -
tgaaggctttactaatttgata

SEQ ID NO: 146991 - DNA, 22 bp, Artificial Sequence
  Synthetic oligonucleotide; CTG chr11 5206592 5206613 5206597 5206592 -
aaggctttactaatttgatatg

SEQ ID NO: 146992 - DNA, 22 bp, Artificial Sequence
  Synthetic oligonucleotide; CTT chr11 5206585 5206606 5206590 5206585 -
tactaatttgatatggcattac

SEQ ID NO: 146993 - DNA, 22 bp, Artificial Sequence
  Synthetic oligonucleotide; TTT chr11 5206584 5206605 5206589 5206584 -
actaatttgatatggcattact

SEQ ID NO: 146994 - DNA, 22 bp, Artificial Sequence
  Synthetic oligonucleotide; TTA chr11 5206583 5206604 5206588 5206583 -
ctaatttgatatggcattactt

SEQ ID NO: 146995 - DNA, 22 bp, Artificial Sequence
  Synthetic oligonucleotide; CTA chr11 5206580 5206601 5206585 5206580 -
atttgatatggcattacttttt

SEQ ID NO: 146996 - DNA, 22 bp, Artificial Sequence
  Synthetic oligonucleotide; TTT chr11 5206576 5206597 5206581 5206576 -
gatatggcattacttttttatt

SEQ ID NO: 146997 - DNA, 22 bp, Artificial Sequence
  Synthetic oligonucleotide; TTG chr11 5206575 5206596 5206580 5206575 -
atatggcattacttttttattg

SEQ ID NO: 146998 - DNA, 22 bp, Artificial Sequence
  Synthetic oligonucleotide; TTA chr11 5206564 5206585 5206569 5206564 -
cttttttattgctgccaaaact

SEQ ID NO: 146999 - DNA, 22 bp, Artificial Sequence
  Synthetic oligonucleotide; CTT chr11 5206561 5206582 5206566 5206561 -
ttttattgctgccaaaactatt

SEQ ID NO: 147000 - DNA, 22 bp, Artificial Sequence
  Synthetic oligonucleotide; TTT chr11 5206560 5206581 5206565 5206560 -
tttattgctgccaaaactattc

SEQ ID NO: 147001 - DNA, 22 bp, Artificial Sequence
  Synthetic oligonucleotide; TTT chr11 5206559 5206580 5206564 5206559 -
ttattgctgccaaaactattct

SEQ ID NO: 147002 - DNA, 22 bp, Artificial Sequence
  Synthetic oligonucleotide; TTT chr11 5206558 5206579 5206563 5206558 -
tattgctgccaaaactattctt

SEQ ID NO: 147003 - DNA, 22 bp, Artificial Sequence
  Synthetic oligonucleotide; TTT chr11 5206557 5206578 5206562 5206557 -
attgctgccaaaactattctta

SEQ ID NO: 147004 - DNA, 22 bp, Artificial Sequence
  Synthetic oligonucleotide; TTA chr11 5206556 5206577 5206561 5206556 -
ttgctgccaaaactattcttat

SEQ ID NO: 147005 - DNA, 22 bp, Artificial Sequence
  Synthetic oligonucleotide; TTG chr11 5206553 5206574 5206558 5206553 -
ctgccaaaactattcttattcc

SEQ ID NO: 147006 - DNA, 22 bp, Artificial Sequence
  Synthetic oligonucleotide; CTG chr11 5206550 5206571 5206555 5206550 -
ccaaaactattcttattccact

SEQ ID NO: 147007 - DNA, 22 bp, Artificial Sequence
  Synthetic oligonucleotide; CTA chr11 5206541 5206562 5206546 5206541 -
ttcttattccactgtgtggtga

SEQ ID NO: 147008 - DNA, 22 bp, Artificial Sequence
  Synthetic oligonucleotide; TTC chr11 5206538 5206559 5206543 5206538 -
ttattccactgtgtggtgatga

SEQ ID NO: 147009 - DNA, 22 bp, Artificial Sequence
  Synthetic oligonucleotide; CTT chr11 5206536 5206557 5206541 5206536 -
attccactgtgtggtgatgaga

SEQ ID NO: 147010 - DNA, 22 bp, Artificial Sequence
  Synthetic oligonucleotide; TTA chr11 5206535 5206556 5206540 5206535 -
ttccactgtgtggtgatgagaa

SEQ ID NO: 147011 - DNA, 22 bp, Artificial Sequence
  Synthetic oligonucleotide; TTC chr11 5206532 5206553 5206537 5206532 -
cactgtgtggtgatgagaaagt

SEQ ID NO: 147012 - DNA, 22 bp, Artificial Sequence
  Synthetic oligonucleotide; CTG chr11 5206527 5206548 5206532 5206527 -
tgtggtgatgagaaagtgagag

SEQ ID NO: 147013 - DNA, 22 bp, Artificial Sequence
  Synthetic oligonucleotide; TTC chr11 5206499 5206520 5206504 5206499 -
tggagatggtgattatagatag

SEQ ID NO: 147014 - DNA, 22 bp, Artificial Sequence
  Synthetic oligonucleotide; CTG chr11 5206497 5206518 5206502 5206497 -
gagatggtgattatagatagct

SEQ ID NO: 147015 - DNA, 22 bp, Artificial Sequence
  Synthetic oligonucleotide; TTA chr11 5206484 5206505 5206489 5206484 -
tagatagcttccctgaagccat

SEQ ID NO: 147016 - DNA, 22 bp, Artificial Sequence
  Synthetic oligonucleotide; CTT chr11 5206474 5206495 5206479 5206474 -
ccctgaagccatagtaaccccc

SEQ ID NO: 147017 - DNA, 22 bp, Artificial Sequence
  Synthetic oligonucleotide; TTC chr11 5206473 5206494 5206478 5206473 -
cctgaagccatagtaaccccct

SEQ ID NO: 147018 - DNA, 22 bp, Artificial Sequence
  Synthetic oligonucleotide; CTG chr11 5206469 5206490 5206474 5206469 -
aagccatagtaaccccctggag

SEQ ID NO: 147019 - DNA, 22 bp, Artificial Sequence
  Synthetic oligonucleotide; CTG chr11 5206450 5206471 5206455 5206450 -
gagaaaaattggacctggagtc

SEQ ID NO: 147020 - DNA, 22 bp, Artificial Sequence
  Synthetic oligonucleotide; TTG chr11 5206439 5206460 5206444 5206439 -
gacctggagtctagcagcctag

SEQ ID NO: 147021 - DNA, 22 bp, Artificial Sequence
  Synthetic oligonucleotide; CTG chr11 5206433 5206454 5206438 5206433 -
gagtctagcagcctaggtatgg

SEQ ID NO: 147022 - DNA, 22 bp, Artificial Sequence
  Synthetic oligonucleotide; CTA chr11 5206426 5206447 5206431 5206426 -
gcagcctaggtatgggtactcg

SEQ ID NO: 147023 - DNA, 22 bp, Artificial Sequence
  Synthetic oligonucleotide; CTA chr11 5206418 5206439 5206423 5206418 -
ggtatgggtactcgatttctta

SEQ ID NO: 147024 - DNA, 22 bp, Artificial Sequence
  Synthetic oligonucleotide; CTC chr11 5206405 5206426 5206410 5206405 -
gatttcttagaaagcctttaca

SEQ ID NO: 147025 - DNA, 22 bp, Artificial Sequence
  Synthetic oligonucleotide; TTT chr11 5206400 5206421 5206405 5206400 -
cttagaaagcctttacaatttc

SEQ ID NO: 147026 - DNA, 22 bp, Artificial Sequence
  Synthetic oligonucleotide; TTC chr11 5206399 5206420 5206404 5206399 -
ttagaaagcctttacaatttcc

SEQ ID NO: 147027 - DNA, 22 bp, Artificial Sequence
  Synthetic oligonucleotide; CTT chr11 5206397 5206418 5206402 5206397 -
agaaagcctttacaatttcctt

SEQ ID NO: 147028 - DNA, 22 bp, Artificial Sequence
  Synthetic oligonucleotide; TTA chr11 5206396 5206417 5206401 5206396 -
gaaagcctttacaatttccttt

SEQ ID NO: 147029 - DNA, 22 bp, Artificial Sequence
  Synthetic oligonucleotide; CTT chr11 5206387 5206408 5206392 5206387 -
tacaatttcctttatcttaaaa

SEQ ID NO: 147030 - DNA, 22 bp, Artificial Sequence
  Synthetic oligonucleotide; TTT chr11 5206386 5206407 5206391 5206386 -
acaatttcctttatcttaaaaa

SEQ ID NO: 147031 - DNA, 22 bp, Artificial Sequence
  Synthetic oligonucleotide; TTA chr11 5206385 5206406 5206390 5206385 -
caatttcctttatcttaaaaat

SEQ ID NO: 147032 - DNA, 22 bp, Artificial Sequence
  Synthetic oligonucleotide; TTT chr11 5206379 5206400 5206384 5206379 -
cctttatcttaaaaataagggt

SEQ ID NO: 147033 - DNA, 22 bp, Artificial Sequence
  Synthetic oligonucleotide; TTC chr11 5206378 5206399 5206383 5206378 -
ctttatcttaaaaataagggta

SEQ ID NO: 147034 - DNA, 22 bp, Artificial Sequence
  Synthetic oligonucleotide; CTT chr11 5206375 5206396 5206380 5206375 -
tatcttaaaaataagggtattg

SEQ ID NO: 147035 - DNA, 22 bp, Artificial Sequence
  Synthetic oligonucleotide; TTT chr11 5206374 5206395 5206379 5206374 -
atcttaaaaataagggtattga

SEQ ID NO: 147036 - DNA, 22 bp, Artificial Sequence
  Synthetic oligonucleotide; TTA chr11 5206373 5206394 5206378 5206373 -
tcttaaaaataagggtattgaa

SEQ ID NO: 147037 - DNA, 22 bp, Artificial Sequence
  Synthetic oligonucleotide; CTT chr11 5206369 5206390 5206374 5206369 -
aaaaataagggtattgaagtag

SEQ ID NO: 147038 - DNA, 22 bp, Artificial Sequence
  Synthetic oligonucleotide; TTA chr11 5206368 5206389 5206373 5206368 -
aaaataagggtattgaagtaga

SEQ ID NO: 147039 - DNA, 22 bp, Artificial Sequence
  Synthetic oligonucleotide; TTG chr11 5206353 5206374 5206358 5206353 -
aagtagaattctagaattttca

SEQ ID NO: 147040 - DNA, 22 bp, Artificial Sequence
  Synthetic oligonucleotide; TTC chr11 5206342 5206363 5206347 5206342 -
tagaattttcagaggacaactt

SEQ ID NO: 147041 - DNA, 22 bp, Artificial Sequence
  Synthetic oligonucleotide; CTA chr11 5206340 5206361 5206345 5206340 -
gaattttcagaggacaacttaa

SEQ ID NO: 147042 - DNA, 22 bp, Artificial Sequence
  Synthetic oligonucleotide; TTT chr11 5206334 5206355 5206339 5206334 -
tcagaggacaacttaaaatatg

SEQ ID NO: 147043 - DNA, 22 bp, Artificial Sequence
  Synthetic oligonucleotide; TTT chr11 5206333 5206354 5206338 5206333 -
cagaggacaacttaaaatatgt

SEQ ID NO: 147044 - DNA, 22 bp, Artificial Sequence
  Synthetic oligonucleotide; TTC chr11 5206332 5206353 5206337 5206332 -
agaggacaacttaaaatatgtg

SEQ ID NO: 147045 - DNA, 22 bp, Artificial Sequence
  Synthetic oligonucleotide; CTT chr11 5206320 5206341 5206325 5206320 -
aaaatatgtgtaatagttttaa

SEQ ID NO: 147046 - DNA, 22 bp, Artificial Sequence
  Synthetic oligonucleotide; TTA chr11 5206319 5206340 5206324 5206319 -
aaatatgtgtaatagttttaat

SEQ ID NO: 147047 - DNA, 22 bp, Artificial Sequence
  Synthetic oligonucleotide; TTT chr11 5206301 5206322 5206306 5206301 -
taattatttatcctcataaatt

SEQ ID NO: 147048 - DNA, 22 bp, Artificial Sequence
  Synthetic oligonucleotide; TTT chr11 5206300 5206321 5206305 5206300 -
aattatttatcctcataaattt

SEQ ID NO: 147049 - DNA, 22 bp, Artificial Sequence
  Synthetic oligonucleotide; TTA chr11 5206299 5206320 5206304 5206299 -
attatttatcctcataaattta

SEQ ID NO: 147050 - DNA, 22 bp, Artificial Sequence
  Synthetic oligonucleotide; TTA chr11 5206295 5206316 5206300 5206295 -
tttatcctcataaatttaactg

SEQ ID NO: 147051 - DNA, 22 bp, Artificial Sequence
  Synthetic oligonucleotide; TTT chr11 5206292 5206313 5206297 5206292 -
atcctcataaatttaactgttc

SEQ ID NO: 147052 - DNA, 22 bp, Artificial Sequence
  Synthetic oligonucleotide; TTA chr11 5206291 5206312 5206296 5206291 -
tcctcataaatttaactgttca

SEQ ID NO: 147053 - DNA, 22 bp, Artificial Sequence
  Synthetic oligonucleotide; CTC chr11 5206286 5206307 5206291 5206286 -
ataaatttaactgttcatttta

SEQ ID NO: 147054 - DNA, 22 bp, Artificial Sequence
  Synthetic oligonucleotide; TTT chr11 5206278 5206299 5206283 5206278 -
aactgttcattttaatatattt

SEQ ID NO: 147055 - DNA, 22 bp, Artificial Sequence
  Synthetic oligonucleotide; TTA chr11 5206277 5206298 5206282 5206277 -
actgttcattttaatatattta

SEQ ID NO: 147056 - DNA, 22 bp, Artificial Sequence
  Synthetic oligonucleotide; CTG chr11 5206273 5206294 5206278 5206273 -
ttcattttaatatatttaagga

SEQ ID NO: 147057 - DNA, 22 bp, Artificial Sequence
  Synthetic oligonucleotide; TTC chr11 5206270 5206291 5206275 5206270 -
attttaatatatttaaggatga

SEQ ID NO: 147058 - DNA, 22 bp, Artificial Sequence
  Synthetic oligonucleotide; TTT chr11 5206266 5206287 5206271 5206266 -
taatatatttaaggatgaattt

SEQ ID NO: 147059 - DNA, 22 bp, Artificial Sequence
  Synthetic oligonucleotide; TTT chr11 5206265 5206286 5206270 5206265 -
aatatatttaaggatgaatttt

SEQ ID NO: 147060 - DNA, 22 bp, Artificial Sequence
  Synthetic oligonucleotide; TTA chr11 5206264 5206285 5206269 5206264 -
atatatttaaggatgaattttt

SEQ ID NO: 147061 - DNA, 22 bp, Artificial Sequence
  Synthetic oligonucleotide; TTT chr11 5206256 5206277 5206261 5206256 -
aaggatgaattttttaaaaagt

SEQ ID NO: 147062 - DNA, 22 bp, Artificial Sequence
  Synthetic oligonucleotide; TTA chr11 5206255 5206276 5206260 5206255 -
aggatgaattttttaaaaagtt

SEQ ID NO: 147063 - DNA, 22 bp, Artificial Sequence
  Synthetic oligonucleotide; TTT chr11 5206244 5206265 5206249 5206244 -
tttaaaaagttgatttcataaa

SEQ ID NO: 147064 - DNA, 22 bp, Artificial Sequence
  Synthetic oligonucleotide; TTT chr11 5206243 5206264 5206248 5206243 -
ttaaaaagttgatttcataaaa

SEQ ID NO: 147065 - DNA, 22 bp, Artificial Sequence
  Synthetic oligonucleotide; TTT chr11 5206242 5206263 5206247 5206242 -
taaaaagttgatttcataaaaa

SEQ ID NO: 147066 - DNA, 22 bp, Artificial Sequence
  Synthetic oligonucleotide; TTT chr11 5206241 5206262 5206246 5206241 -
aaaaagttgatttcataaaaac

SEQ ID NO: 147067 - DNA, 22 bp, Artificial Sequence
  Synthetic oligonucleotide; TTA chr11 5206240 5206261 5206245 5206240 -
aaaagttgatttcataaaaacg

SEQ ID NO: 147068 - DNA, 22 bp, Artificial Sequence
  Synthetic oligonucleotide; TTG chr11 5206232 5206253 5206237 5206232 -
atttcataaaaacgggaataga

SEQ ID NO: 147069 - DNA, 22 bp, Artificial Sequence
  Synthetic oligonucleotide; TTT chr11 5206228 5206249 5206233 5206228 -
cataaaaacgggaatagaaaga

SEQ ID NO: 147070 - DNA, 22 bp, Artificial Sequence
  Synthetic oligonucleotide; TTC chr11 5206227 5206248 5206232 5206227 -
ataaaaacgggaatagaaagat

SEQ ID NO: 147071 - DNA, 22 bp, Artificial Sequence
  Synthetic oligonucleotide; TTC chr11 5206200 5206221 5206205 5206200 -
cataggctgactgagagtgtag

SEQ ID NO: 147072 - DNA, 22 bp, Artificial Sequence
  Synthetic oligonucleotide; CTG chr11 5206191 5206212 5206196 5206191 -
actgagagtgtagaggagggat

SEQ ID NO: 147073 - DNA, 22 bp, Artificial Sequence
  Synthetic oligonucleotide; CTG chr11 5206187 5206208 5206192 5206187 -
agagtgtagaggagggatggga

SEQ ID NO: 147074 - DNA, 22 bp, Artificial Sequence
  Synthetic oligonucleotide; TTG chr11 5206151 5206172 5206156 5206151 -
atcttcagttagactagaggaa

SEQ ID NO: 147075 - DNA, 22 bp, Artificial Sequence
  Synthetic oligonucleotide; CTT chr11 5206146 5206167 5206151 5206146 -
cagttagactagaggaataagt

SEQ ID NO: 147076 - DNA, 22 bp, Artificial Sequence
  Synthetic oligonucleotide; TTC chr11 5206145 5206166 5206150 5206145 -
agttagactagaggaataagtt

SEQ ID NO: 147077 - DNA, 22 bp, Artificial Sequence
  Synthetic oligonucleotide; TTA chr11 5206140 5206161 5206145 5206140 -
gactagaggaataagttttagt

SEQ ID NO: 147078 - DNA, 22 bp, Artificial Sequence
  Synthetic oligonucleotide; CTA chr11 5206135 5206156 5206140 5206135 -
gaggaataagttttagtgatct

SEQ ID NO: 147079 - DNA, 22 bp, Artificial Sequence
  Synthetic oligonucleotide; TTT chr11 5206122 5206143 5206127 5206122 -
tagtgatctctcacactgcata

SEQ ID NO: 147080 - DNA, 22 bp, Artificial Sequence
  Synthetic oligonucleotide; TTT chr11 5206121 5206142 5206126 5206121 -
agtgatctctcacactgcatag

SEQ ID NO: 147081 - DNA, 22 bp, Artificial Sequence
  Synthetic oligonucleotide; TTA chr11 5206120 5206141 5206125 5206120 -
gtgatctctcacactgcatagt

SEQ ID NO: 147082 - DNA, 22 bp, Artificial Sequence
  Synthetic oligonucleotide; CTC chr11 5206112 5206133 5206117 5206112 -
tcacactgcatagtgaacacag

SEQ ID NO: 147083 - DNA, 22 bp, Artificial Sequence
  Synthetic oligonucleotide; CTC chr11 5206110 5206131 5206115 5206110 -
acactgcatagtgaacacagtt

SEQ ID NO: 147084 - DNA, 22 bp, Artificial Sequence
  Synthetic oligonucleotide; CTG chr11 5206104 5206125 5206109 5206104 -
catagtgaacacagttaataat

SEQ ID NO: 147085 - DNA, 22 bp, Artificial Sequence
  Synthetic oligonucleotide; TTA chr11 5206087 5206108 5206092 5206087 -
ataatatattatgtatttaaat

SEQ ID NO: 147086 - DNA, 22 bp, Artificial Sequence
  Synthetic oligonucleotide; TTA chr11 5206076 5206097 5206081 5206076 -
tgtatttaaattaaaaattgct

SEQ ID NO: 147087 - DNA, 22 bp, Artificial Sequence
  Synthetic oligonucleotide; TTT chr11 5206069 5206090 5206074 5206069 -
aaattaaaaattgctaaaaaat

SEQ ID NO: 147088 - DNA, 22 bp, Artificial Sequence
  Synthetic oligonucleotide; TTA chr11 5206068 5206089 5206073 5206068 -
aattaaaaattgctaaaaaata

SEQ ID NO: 147089 - DNA, 22 bp, Artificial Sequence
  Synthetic oligonucleotide; TTA chr11 5206063 5206084 5206068 5206063 -
aaaattgctaaaaaataaatat

SEQ ID NO: 147090 - DNA, 22 bp, Artificial Sequence
  Synthetic oligonucleotide; TTG chr11 5206056 5206077 5206061 5206056 -
ctaaaaaataaatattttatgt

SEQ ID NO: 147091 - DNA, 22 bp, Artificial Sequence
  Synthetic oligonucleotide; CTA chr11 5206053 5206074 5206058 5206053 -
aaaaataaatattttatgttct

SEQ ID NO: 147092 - DNA, 22 bp, Artificial Sequence
  Synthetic oligonucleotide; TTT chr11 5206039 5206060 5206044 5206039 -
tatgttctcaccacaaaaaaag

SEQ ID NO: 147093 - DNA, 22 bp, Artificial Sequence
  Synthetic oligonucleotide; TTT chr11 5206038 5206059 5206043 5206038 -
atgttctcaccacaaaaaaagt

SEQ ID NO: 147094 - DNA, 22 bp, Artificial Sequence
  Synthetic oligonucleotide; TTA chr11 5206037 5206058 5206042 5206037 -
tgttctcaccacaaaaaaagtt

SEQ ID NO: 147095 - DNA, 22 bp, Artificial Sequence
  Synthetic oligonucleotide; TTC chr11 5206032 5206053 5206037 5206032 -
tcaccacaaaaaaagttggaag

SEQ ID NO: 147096 - DNA, 22 bp, Artificial Sequence
  Synthetic oligonucleotide; CTC chr11 5206030 5206051 5206035 5206030 -
accacaaaaaaagttggaaggt

SEQ ID NO: 147097 - DNA, 22 bp, Artificial Sequence
  Synthetic oligonucleotide; TTG chr11 5206014 5206035 5206019 5206014 -
gaaggtgattcatatgctaatt

SEQ ID NO: 147098 - DNA, 22 bp, Artificial Sequence
  Synthetic oligonucleotide; TTC chr11 5206003 5206024 5206008 5206003 -
atatgctaattagcttgataga

SEQ ID NO: 147099 - DNA, 22 bp, Artificial Sequence
  Synthetic oligonucleotide; CTA chr11 5205995 5206016 5206000 5205995 -
attagcttgatagactctctct

SEQ ID NO: 147100 - DNA, 22 bp, Artificial Sequence
  Synthetic oligonucleotide; TTA chr11 5205991 5206012 5205996 5205991 -
gcttgatagactctctctacaa

SEQ ID NO: 147101 - DNA, 22 bp, Artificial Sequence
  Synthetic oligonucleotide; CTT chr11 5205987 5206008 5205992 5205987 -
gatagactctctctacaatgta

SEQ ID NO: 147102 - DNA, 22 bp, Artificial Sequence
  Synthetic oligonucleotide; TTG chr11 5205986 5206007 5205991 5205986 -
atagactctctctacaatgtat

SEQ ID NO: 147103 - DNA, 22 bp, Artificial Sequence
  Synthetic oligonucleotide; CTC chr11 5205978 5205999 5205983 5205978 -
tctctacaatgtatatatagat

SEQ ID NO: 147104 - DNA, 22 bp, Artificial Sequence
  Synthetic oligonucleotide; CTC chr11 5205976 5205997 5205981 5205976 -
tctacaatgtatatatagatca

SEQ ID NO: 147105 - DNA, 22 bp, Artificial Sequence
  Synthetic oligonucleotide; CTC chr11 5205974 5205995 5205979 5205974 -
tacaatgtatatatagatcaaa

SEQ ID NO: 147106 - DNA, 22 bp, Artificial Sequence
  Synthetic oligonucleotide; CTA chr11 5205972 5205993 5205977 5205972 -
caatgtatatatagatcaaaca

SEQ ID NO: 147107 - DNA, 22 bp, Artificial Sequence
  Synthetic oligonucleotide; TTG chr11 5205942 5205963 5205947 5205942 -
tatcccataacatattatatat

SEQ ID NO: 147108 - DNA, 22 bp, Artificial Sequence
  Synthetic oligonucleotide; TTA chr11 5205925 5205946 5205930 5205925 -
tatatattatatatttatatta

SEQ ID NO: 147109 - DNA, 22 bp, Artificial Sequence
  Synthetic oligonucleotide; TTA chr11 5205916 5205937 5205921 5205916 -
tatatttatattatatattatt

SEQ ID NO: 147110 - DNA, 22 bp, Artificial Sequence
  Synthetic oligonucleotide; TTT chr11 5205909 5205930 5205914 5205909 -
atattatatattattattgtat

SEQ ID NO: 147111 - DNA, 22 bp, Artificial Sequence
  Synthetic oligonucleotide; TTA chr11 5205908 5205929 5205913 5205908 -
tattatatattattattgtatc

SEQ ID NO: 147112 - DNA, 22 bp, Artificial Sequence
  Synthetic oligonucleotide; TTA chr11 5205903 5205924 5205908 5205903 -
tatattattattgtatccatta

SEQ ID NO: 147113 - DNA, 22 bp, Artificial Sequence
  Synthetic oligonucleotide; TTA chr11 5205896 5205917 5205901 5205896 -
ttattgtatccattaatatatg

SEQ ID NO: 147114 - DNA, 22 bp, Artificial Sequence
  Synthetic oligonucleotide; TTA chr11 5205893 5205914 5205898 5205893 -
ttgtatccattaatatatgcac

SEQ ID NO: 147115 - DNA, 22 bp, Artificial Sequence
  Synthetic oligonucleotide; TTG chr11 5205890 5205911 5205895 5205890 -
tatccattaatatatgcactta

SEQ ID NO: 147116 - DNA, 22 bp, Artificial Sequence
  Synthetic oligonucleotide; TTA chr11 5205881 5205902 5205886 5205881 -
atatatgcacttattatttgcc

SEQ ID NO: 147117 - DNA, 22 bp, Artificial Sequence
  Synthetic oligonucleotide; CTT chr11 5205869 5205890 5205874 5205869 -
attatttgccaggcaaataaaa

SEQ ID NO: 147118 - DNA, 22 bp, Artificial Sequence
  Synthetic oligonucleotide; TTA chr11 5205868 5205889 5205873 5205868 -
ttatttgccaggcaaataaaaa

SEQ ID NO: 147119 - DNA, 22 bp, Artificial Sequence
  Synthetic oligonucleotide; TTA chr11 5205865 5205886 5205870 5205865 -
tttgccaggcaaataaaaaatg

SEQ ID NO: 147120 - DNA, 22 bp, Artificial Sequence
  Synthetic oligonucleotide; TTT chr11 5205862 5205883 5205867 5205862 -
gccaggcaaataaaaaatgttt

SEQ ID NO: 147121 - DNA, 22 bp, Artificial Sequence
  Synthetic oligonucleotide; TTG chr11 5205861 5205882 5205866 5205861 -
ccaggcaaataaaaaatgtttt

SEQ ID NO: 147122 - DNA, 22 bp, Artificial Sequence
  Synthetic oligonucleotide; TTT chr11 5205840 5205861 5205845 5205840 -
ttaaaatataaatttatttgta

SEQ ID NO: 147123 - DNA, 22 bp, Artificial Sequence
  Synthetic oligonucleotide; TTT chr11 5205839 5205860 5205844 5205839 -
taaaatataaatttatttgtaa

SEQ ID NO: 147124 - DNA, 22 bp, Artificial Sequence
  Synthetic oligonucleotide; TTT chr11 5205838 5205859 5205843 5205838 -
aaaatataaatttatttgtaac

SEQ ID NO: 147125 - DNA, 22 bp, Artificial Sequence
  Synthetic oligonucleotide; TTA chr11 5205837 5205858 5205842 5205837 -
aaatataaatttatttgtaacc

SEQ ID NO: 147126 - DNA, 22 bp, Artificial Sequence
  Synthetic oligonucleotide; TTT chr11 5205825 5205846 5205830 5205825 -
atttgtaacctccttttacttt

SEQ ID NO: 147127 - DNA, 22 bp, Artificial Sequence
  Synthetic oligonucleotide; TTA chr11 5205824 5205845 5205829 5205824 -
tttgtaacctccttttactttt

SEQ ID NO: 147128 - DNA, 22 bp, Artificial Sequence
  Synthetic oligonucleotide; TTT chr11 5205821 5205842 5205826 5205821 -
gtaacctccttttacttttctg

SEQ ID NO: 147129 - DNA, 22 bp, Artificial Sequence
  Synthetic oligonucleotide; TTG chr11 5205820 5205841 5205825 5205820 -
taacctccttttacttttctgc

SEQ ID NO: 147130 - DNA, 22 bp, Artificial Sequence
  Synthetic oligonucleotide; CTC chr11 5205813 5205834 5205818 5205813 -
cttttacttttctgcttggttt

SEQ ID NO: 147131 - DNA, 22 bp, Artificial Sequence
  Synthetic oligonucleotide; CTT chr11 5205810 5205831 5205815 5205810 -
ttacttttctgcttggttttct

SEQ ID NO: 147132 - DNA, 22 bp, Artificial Sequence
  Synthetic oligonucleotide; TTT chr11 5205809 5205830 5205814 5205809 -
tacttttctgcttggttttctt

SEQ ID NO: 147133 - DNA, 22 bp, Artificial Sequence
  Synthetic oligonucleotide; TTT chr11 5205808 5205829 5205813 5205808 -
acttttctgcttggttttcttc

SEQ ID NO: 147134 - DNA, 22 bp, Artificial Sequence
  Synthetic oligonucleotide; TTA chr11 5205807 5205828 5205812 5205807 -
cttttctgcttggttttcttct

SEQ ID NO: 147135 - DNA, 22 bp, Artificial Sequence
  Synthetic oligonucleotide; CTT chr11 5205804 5205825 5205809 5205804 -
ttctgcttggttttcttctttc

SEQ ID NO: 147136 - DNA, 22 bp, Artificial Sequence
  Synthetic oligonucleotide; TTT chr11 5205803 5205824 5205808 5205803 -
tctgcttggttttcttctttca

SEQ ID NO: 147137 - DNA, 22 bp, Artificial Sequence
  Synthetic oligonucleotide; TTT chr11 5205802 5205823 5205807 5205802 -
ctgcttggttttcttctttcat

SEQ ID NO: 147138 - DNA, 22 bp, Artificial Sequence
  Synthetic oligonucleotide; TTC chr11 5205801 5205822 5205806 5205801 -
tgcttggttttcttctttcatt

SEQ ID NO: 147139 - DNA, 22 bp, Artificial Sequence
  Synthetic oligonucleotide; CTG chr11 5205799 5205820 5205804 5205799 -
cttggttttcttctttcattca

SEQ ID NO: 147140 - DNA, 22 bp, Artificial Sequence
  Synthetic oligonucleotide; CTT chr11 5205796 5205817 5205801 5205796 -
ggttttcttctttcattcagtg

SEQ ID NO: 147141 - DNA, 22 bp, Artificial Sequence
  Synthetic oligonucleotide; TTG chr11 5205795 5205816 5205800 5205795 -
gttttcttctttcattcagtgt

SEQ ID NO: 147142 - DNA, 22 bp, Artificial Sequence
  Synthetic oligonucleotide; TTT chr11 5205791 5205812 5205796 5205791 -
tcttctttcattcagtgtttac

SEQ ID NO: 147143 - DNA, 22 bp, Artificial Sequence
  Synthetic oligonucleotide; TTT chr11 5205790 5205811 5205795 5205790 -
cttctttcattcagtgtttacc

SEQ ID NO: 147144 - DNA, 22 bp, Artificial Sequence
  Synthetic oligonucleotide; TTC chr11 5205789 5205810 5205794 5205789 -
ttctttcattcagtgtttacca

SEQ ID NO: 147145 - DNA, 22 bp, Artificial Sequence
  Synthetic oligonucleotide; CTT chr11 5205787 5205808 5205792 5205787 -
ctttcattcagtgtttaccagt

SEQ ID NO: 147146 - DNA, 22 bp, Artificial Sequence
  Synthetic oligonucleotide; TTC chr11 5205786 5205807 5205791 5205786 -
tttcattcagtgtttaccagtt

SEQ ID NO: 147147 - DNA, 22 bp, Artificial Sequence
  Synthetic oligonucleotide; CTT chr11 5205784 5205805 5205789 5205784 -
tcattcagtgtttaccagtttc

SEQ ID NO: 147148 - DNA, 22 bp, Artificial Sequence
  Synthetic oligonucleotide; TTT chr11 5205783 5205804 5205788 5205783 -
cattcagtgtttaccagtttct

SEQ ID NO: 147149 - DNA, 22 bp, Artificial Sequence
  Synthetic oligonucleotide; TTC chr11 5205782 5205803 5205787 5205782 -
attcagtgtttaccagtttctt

SEQ ID NO: 147150 - DNA, 22 bp, Artificial Sequence
  Synthetic oligonucleotide; TTC chr11 5205778 5205799 5205783 5205778 -
agtgtttaccagtttcttatag

SEQ ID NO: 147151 - DNA, 22 bp, Artificial Sequence
  Synthetic oligonucleotide; TTT chr11 5205771 5205792 5205776 5205771 -
accagtttcttatagttaattt

SEQ ID NO: 147152 - DNA, 22 bp, Artificial Sequence
  Synthetic oligonucleotide; TTA chr11 5205770 5205791 5205775 5205770 -
ccagtttcttatagttaatttt

SEQ ID NO: 147153 - DNA, 22 bp, Artificial Sequence
  Synthetic oligonucleotide; TTT chr11 5205763 5205784 5205768 5205763 -
cttatagttaattttattttaa

SEQ ID NO: 147154 - DNA, 22 bp, Artificial Sequence
  Synthetic oligonucleotide; TTC chr11 5205762 5205783 5205767 5205762 -
ttatagttaattttattttaag

SEQ ID NO: 147155 - DNA, 22 bp, Artificial Sequence
  Synthetic oligonucleotide; CTT chr11 5205760 5205781 5205765 5205760 -
atagttaattttattttaagct

SEQ ID NO: 147156 - DNA, 22 bp, Artificial Sequence
  Synthetic oligonucleotide; TTA chr11 5205759 5205780 5205764 5205759 -
tagttaattttattttaagctg

SEQ ID NO: 147157 - DNA, 22 bp, Artificial Sequence
  Synthetic oligonucleotide; TTA chr11 5205753 5205774 5205758 5205753 -
attttattttaagctgtctcac

SEQ ID NO: 147158 - DNA, 22 bp, Artificial Sequence
  Synthetic oligonucleotide; TTT chr11 5205749 5205770 5205754 5205749 -
tattttaagctgtctcacattt

SEQ ID NO: 147159 - DNA, 22 bp, Artificial Sequence
  Synthetic oligonucleotide; TTT chr11 5205748 5205769 5205753 5205748 -
attttaagctgtctcacatttt

SEQ ID NO: 147160 - DNA, 22 bp, Artificial Sequence
  Synthetic oligonucleotide; TTA chr11 5205747 5205768 5205752 5205747 -
ttttaagctgtctcacattttc

SEQ ID NO: 147161 - DNA, 22 bp, Artificial Sequence
  Synthetic oligonucleotide; TTT chr11 5205744 5205765 5205749 5205744 -
taagctgtctcacattttctga

SEQ ID NO: 147162 - DNA, 22 bp, Artificial Sequence
  Synthetic oligonucleotide; TTT chr11 5205743 5205764 5205748 5205743 -
aagctgtctcacattttctgaa

SEQ ID NO: 147163 - DNA, 22 bp, Artificial Sequence
  Synthetic oligonucleotide; TTA chr11 5205742 5205763 5205747 5205742 -
agctgtctcacattttctgaag

SEQ ID NO: 147164 - DNA, 22 bp, Artificial Sequence
  Synthetic oligonucleotide; CTG chr11 5205737 5205758 5205742 5205737 -
tctcacattttctgaagaaaag

SEQ ID NO: 147165 - DNA, 22 bp, Artificial Sequence
  Synthetic oligonucleotide; CTC chr11 5205733 5205754 5205738 5205733 -
acattttctgaagaaaagggaa

SEQ ID NO: 147166 - DNA, 22 bp, Artificial Sequence
  Synthetic oligonucleotide; TTT chr11 5205727 5205748 5205732 5205727 -
tctgaagaaaagggaacatatt

SEQ ID NO: 147167 - DNA, 22 bp, Artificial Sequence
  Synthetic oligonucleotide; TTT chr11 5205726 5205747 5205731 5205726 -
ctgaagaaaagggaacatatta

SEQ ID NO: 147168 - DNA, 22 bp, Artificial Sequence
  Synthetic oligonucleotide; TTC chr11 5205725 5205746 5205730 5205725 -
tgaagaaaagggaacatattaa

SEQ ID NO: 147169 - DNA, 22 bp, Artificial Sequence
  Synthetic oligonucleotide; CTG chr11 5205723 5205744 5205728 5205723 -
aagaaaagggaacatattaaag

SEQ ID NO: 147170 - DNA, 22 bp, Artificial Sequence
  Synthetic oligonucleotide; TTA chr11 5205704 5205725 5205709 5205704 -
aagccaacaaaacaaatacact

SEQ ID NO: 147171 - DNA, 22 bp, Artificial Sequence
  Synthetic oligonucleotide; CTA chr11 5205681 5205702 5205686 5205681 -
tcttgcatgagatgatttatgt

SEQ ID NO: 147172 - DNA, 22 bp, Artificial Sequence
  Synthetic oligonucleotide; CTT chr11 5205677 5205698 5205682 5205677 -
gcatgagatgatttatgtcatg

SEQ ID NO: 147173 - DNA, 22 bp, Artificial Sequence
  Synthetic oligonucleotide; TTG chr11 5205676 5205697 5205681 5205676 -
catgagatgatttatgtcatgg

SEQ ID NO: 147174 - DNA, 22 bp, Artificial Sequence
  Synthetic oligonucleotide; TTT chr11 5205663 5205684 5205668 5205663 -
atgtcatggtacaatcaaatgc

SEQ ID NO: 147175 - DNA, 22 bp, Artificial Sequence
  Synthetic oligonucleotide; TTA chr11 5205662 5205683 5205667 5205662 -
tgtcatggtacaatcaaatgct

SEQ ID NO: 147176 - DNA, 22 bp, Artificial Sequence
  Synthetic oligonucleotide; CTA chr11 5205639 5205660 5205644 5205639 -
taaatcttataaaaacttctca

SEQ ID NO: 147177 - DNA, 22 bp, Artificial Sequence
  Synthetic oligonucleotide; CTT chr11 5205631 5205652 5205636 5205631 -
ataaaaacttctcaaatggtta

SEQ ID NO: 147178 - DNA, 22 bp, Artificial Sequence
  Synthetic oligonucleotide; TTA chr11 5205630 5205651 5205635 5205630 -
taaaaacttctcaaatggttag

SEQ ID NO: 147179 - DNA, 22 bp, Artificial Sequence
  Synthetic oligonucleotide; CTT chr11 5205621 5205642 5205626 5205621 -
ctcaaatggttagatggctaca

SEQ ID NO: 147180 - DNA, 22 bp, Artificial Sequence
  Synthetic oligonucleotide; TTC chr11 5205620 5205641 5205625 5205620 -
tcaaatggttagatggctacag

SEQ ID NO: 147181 - DNA, 22 bp, Artificial Sequence
  Synthetic oligonucleotide; CTC chr11 5205618 5205639 5205623 5205618 -
aaatggttagatggctacagtt

SEQ ID NO: 147182 - DNA, 22 bp, Artificial Sequence
  Synthetic oligonucleotide; TTA chr11 5205609 5205630 5205614 5205609 -
gatggctacagttgaacagatg

SEQ ID NO: 147183 - DNA, 22 bp, Artificial Sequence
  Synthetic oligonucleotide; CTA chr11 5205601 5205622 5205606 5205601 -
cagttgaacagatggaccatgt

SEQ ID NO: 147184 - DNA, 22 bp, Artificial Sequence
  Synthetic oligonucleotide; TTG chr11 5205595 5205616 5205600 5205595 -
aacagatggaccatgtcatata

SEQ ID NO: 147185 - DNA, 22 bp, Artificial Sequence
  Synthetic oligonucleotide; TTT chr11 5205570 5205591 5205575 5205570 -
tttataatgcttctaaggtatg

SEQ ID NO: 147186 - DNA, 22 bp, Artificial Sequence
  Synthetic oligonucleotide; TTT chr11 5205569 5205590 5205574 5205569 -
ttataatgcttctaaggtatgg

SEQ ID NO: 147187 - DNA, 22 bp, Artificial Sequence
  Synthetic oligonucleotide; TTT chr11 5205568 5205589 5205573 5205568 -
tataatgcttctaaggtatggc

SEQ ID NO: 147188 - DNA, 22 bp, Artificial Sequence
  Synthetic oligonucleotide; TTT chr11 5205567 5205588 5205572 5205567 -
ataatgcttctaaggtatggct

SEQ ID NO: 147189 - DNA, 22 bp, Artificial Sequence
  Synthetic oligonucleotide; TTA chr11 5205566 5205587 5205571 5205566 -
taatgcttctaaggtatggcta

SEQ ID NO: 147190 - DNA, 22 bp, Artificial Sequence
  Synthetic oligonucleotide; CTT chr11 5205558 5205579 5205563 5205558 -
ctaaggtatggctaatttttaa

SEQ ID NO: 147191 - DNA, 22 bp, Artificial Sequence
  Synthetic oligonucleotide; TTC chr11 5205557 5205578 5205562 5205557 -
taaggtatggctaatttttaaa

SEQ ID NO: 147192 - DNA, 22 bp, Artificial Sequence
  Synthetic oligonucleotide; CTA chr11 5205555 5205576 5205560 5205555 -
aggtatggctaatttttaaaaa

SEQ ID NO: 147193 - DNA, 22 bp, Artificial Sequence
  Synthetic oligonucleotide; CTA chr11 5205544 5205565 5205549 5205544 -
atttttaaaaaatattttagta

SEQ ID NO: 147194 - DNA, 22 bp, Artificial Sequence
  Synthetic oligonucleotide; TTT chr11 5205540 5205561 5205545 5205540 -
ttaaaaaatattttagtaatga

SEQ ID NO: 147195 - DNA, 22 bp, Artificial Sequence
  Synthetic oligonucleotide; TTT chr11 5205539 5205560 5205544 5205539 -
taaaaaatattttagtaatgat

SEQ ID NO: 147196 - DNA, 22 bp, Artificial Sequence
  Synthetic oligonucleotide; TTT chr11 5205538 5205559 5205543 5205538 -
aaaaaatattttagtaatgatg

SEQ ID NO: 147197 - DNA, 22 bp, Artificial Sequence
  Synthetic oligonucleotide; TTA chr11 5205537 5205558 5205542 5205537 -
aaaaatattttagtaatgatgg

SEQ ID NO: 147198 - DNA, 22 bp, Artificial Sequence
  Synthetic oligonucleotide; TTT chr11 5205527 5205548 5205532 5205527 -
tagtaatgatgggaatattatt

SEQ ID NO: 147199 - DNA, 22 bp, Artificial Sequence
  Synthetic oligonucleotide; TTT chr11 5205526 5205547 5205531 5205526 -
agtaatgatgggaatattattt

SEQ ID NO: 147200 - DNA, 22 bp, Artificial Sequence
  Synthetic oligonucleotide; TTA chr11 5205525 5205546 5205530 5205525 -
gtaatgatgggaatattattta

SEQ ID NO: 147201 - DNA, 22 bp, Artificial Sequence
  Synthetic oligonucleotide; TTA chr11 5205507 5205528 5205512 5205507 -
tttatagaaatcttataaaata

SEQ ID NO: 147202 - DNA, 22 bp, Artificial Sequence
  Synthetic oligonucleotide; TTT chr11 5205504 5205525 5205509 5205504 -
atagaaatcttataaaatatat

SEQ ID NO: 147203 - DNA, 22 bp, Artificial Sequence
  Synthetic oligonucleotide; TTA chr11 5205503 5205524 5205508 5205503 -
tagaaatcttataaaatatata

SEQ ID NO: 147204 - DNA, 22 bp, Artificial Sequence
  Synthetic oligonucleotide; CTT chr11 5205493 5205514 5205498 5205493 -
ataaaatatataatgaaatatg

SEQ ID NO: 147205 - DNA, 22 bp, Artificial Sequence
  Synthetic oligonucleotide; TTA chr11 5205492 5205513 5205497 5205492 -
taaaatatataatgaaatatgt

SEQ ID NO: 147206 - DNA, 22 bp, Artificial Sequence
  Synthetic oligonucleotide; CTA chr11 5205459 5205480 5205464 5205459 -
gataaatgtgtatatacataat

SEQ ID NO: 147207 - DNA, 22 bp, Artificial Sequence
  Synthetic oligonucleotide; TTT chr11 5205429 5205450 5205434 5205429 -
attacataatatataatatata

SEQ ID NO: 147208 - DNA, 22 bp, Artificial Sequence
  Synthetic oligonucleotide; TTA chr11 5205428 5205449 5205433 5205428 -
ttacataatatataatatataa

SEQ ID NO: 147209 - DNA, 22 bp, Artificial Sequence
  Synthetic oligonucleotide; TTA chr11 5205425 5205446 5205430 5205425 -
cataatatataatatataatgt

SEQ ID NO: 147210 - DNA, 22 bp, Artificial Sequence
  Synthetic oligonucleotide; TTT chr11 5205397 5205418 5205402 5205397 -
atatattacatgcattatatat

SEQ ID NO: 147211 - DNA, 22 bp, Artificial Sequence
  Synthetic oligonucleotide; TTA chr11 5205396 5205417 5205401 5205396 -
tatattacatgcattatatatt

SEQ ID NO: 147212 - DNA, 22 bp, Artificial Sequence
  Synthetic oligonucleotide; TTA chr11 5205389 5205410 5205394 5205389 -
catgcattatatattaaatata

SEQ ID NO: 147213 - DNA, 22 bp, Artificial Sequence
  Synthetic oligonucleotide; TTA chr11 5205380 5205401 5205385 5205380 -
tatattaaatataatacatttt

SEQ ID NO: 147214 - DNA, 22 bp, Artificial Sequence
  Synthetic oligonucleotide; TTA chr11 5205373 5205394 5205378 5205373 -
aatataatacattttatatatt

SEQ ID NO: 147215 - DNA, 22 bp, Artificial Sequence
  Synthetic oligonucleotide; TTT chr11 5205359 5205380 5205364 5205359 -
tatatattatatattaaaatat

SEQ ID NO: 147216 - DNA, 22 bp, Artificial Sequence
  Synthetic oligonucleotide; TTT chr11 5205358 5205379 5205363 5205358 -
atatattatatattaaaatatg

SEQ ID NO: 147217 - DNA, 22 bp, Artificial Sequence
  Synthetic oligonucleotide; TTA chr11 5205357 5205378 5205362 5205357 -
tatattatatattaaaatatgt

SEQ ID NO: 147218 - DNA, 22 bp, Artificial Sequence
  Synthetic oligonucleotide; TTA chr11 5205350 5205371 5205355 5205350 -
tatattaaaatatgtaataata

SEQ ID NO: 147219 - DNA, 22 bp, Artificial Sequence
  Synthetic oligonucleotide; TTA chr11 5205343 5205364 5205348 5205343 -
aaatatgtaataatatgttatt

SEQ ID NO: 147220 - DNA, 22 bp, Artificial Sequence
  Synthetic oligonucleotide; TTA chr11 5205323 5205344 5205328 5205323 -
ttaaatatatacaataatctat

SEQ ID NO: 147221 - DNA, 22 bp, Artificial Sequence
  Synthetic oligonucleotide; TTA chr11 5205320 5205341 5205325 5205320 -
aatatatacaataatctattac

SEQ ID NO: 147222 - DNA, 22 bp, Artificial Sequence
  Synthetic oligonucleotide; CTA chr11 5205302 5205323 5205307 5205302 -
ttacattttatgcttatataat

SEQ ID NO: 147223 - DNA, 22 bp, Artificial Sequence
  Synthetic oligonucleotide; TTA chr11 5205299 5205320 5205304 5205299 -
cattttatgcttatataatata

SEQ ID NO: 147224 - DNA, 22 bp, Artificial Sequence
  Synthetic oligonucleotide; TTT chr11 5205294 5205315 5205299 5205294 -
tatgcttatataatatataata

SEQ ID NO: 147225 - DNA, 22 bp, Artificial Sequence
  Synthetic oligonucleotide; TTT chr11 5205293 5205314 5205298 5205293 -
atgcttatataatatataataa

SEQ ID NO: 147226 - DNA, 22 bp, Artificial Sequence
  Synthetic oligonucleotide; TTA chr11 5205292 5205313 5205297 5205292 -
tgcttatataatatataataaa

SEQ ID NO: 147227 - DNA, 22 bp, Artificial Sequence
  Synthetic oligonucleotide; CTT chr11 5205287 5205308 5205292 5205287 -
atataatatataataaatatat

SEQ ID NO: 147228 - DNA, 22 bp, Artificial Sequence
  Synthetic oligonucleotide; TTA chr11 5205286 5205307 5205291 5205286 -
tataatatataataaatatata

SEQ ID NO: 147229 - DNA, 22 bp, Artificial Sequence
  Synthetic oligonucleotide; CTA chr11 5205243 5205264 5205248 5205243 -
tatatttgtatctatatatgtt

SEQ ID NO: 147230 - DNA, 22 bp, Artificial Sequence
  Synthetic oligonucleotide; TTT chr11 5205236 5205257 5205241 5205236 -
gtatctatatatgtttataaag

SEQ ID NO: 147231 - DNA, 22 bp, Artificial Sequence
  Synthetic oligonucleotide; TTG chr11 5205235 5205256 5205240 5205235 -
tatctatatatgtttataaagt

SEQ ID NO: 147232 - DNA, 22 bp, Artificial Sequence
  Synthetic oligonucleotide; CTA chr11 5205229 5205250 5205234 5205229 -
tatatgtttataaagtcattcc

SEQ ID NO: 147233 - DNA, 22 bp, Artificial Sequence
  Synthetic oligonucleotide; TTT chr11 5205220 5205241 5205225 5205220 -
ataaagtcattcctctaattag

SEQ ID NO: 147234 - DNA, 22 bp, Artificial Sequence
  Synthetic oligonucleotide; TTA chr11 5205219 5205240 5205224 5205219 -
taaagtcattcctctaattagg

SEQ ID NO: 147235 - DNA, 22 bp, Artificial Sequence
  Synthetic oligonucleotide; TTC chr11 5205208 5205229 5205213 5205208 -
ctctaattaggtcataaccatt

SEQ ID NO: 147236 - DNA, 22 bp, Artificial Sequence
  Synthetic oligonucleotide; CTC chr11 5205205 5205226 5205210 5205205 -
taattaggtcataaccattcag

SEQ ID NO: 147237 - DNA, 22 bp, Artificial Sequence
  Synthetic oligonucleotide; CTA chr11 5205203 5205224 5205208 5205203 -
attaggtcataaccattcaggt

SEQ ID NO: 147238 - DNA, 22 bp, Artificial Sequence
  Synthetic oligonucleotide; TTA chr11 5205199 5205220 5205204 5205199 -
ggtcataaccattcaggtaaac

SEQ ID NO: 147239 - DNA, 22 bp, Artificial Sequence
  Synthetic oligonucleotide; TTC chr11 5205185 5205206 5205190 5205185 -
aggtaaactggaaatttaagcc

SEQ ID NO: 147240 - DNA, 22 bp, Artificial Sequence
  Synthetic oligonucleotide; CTG chr11 5205175 5205196 5205180 5205175 -
gaaatttaagcctacttcaggt

SEQ ID NO: 147241 - DNA, 22 bp, Artificial Sequence
  Synthetic oligonucleotide; TTT chr11 5205168 5205189 5205173 5205168 -
aagcctacttcaggtttgtggt

SEQ ID NO: 147242 - DNA, 22 bp, Artificial Sequence
  Synthetic oligonucleotide; TTA chr11 5205167 5205188 5205172 5205167 -
agcctacttcaggtttgtggta

SEQ ID NO: 147243 - DNA, 22 bp, Artificial Sequence
  Synthetic oligonucleotide; CTA chr11 5205161 5205182 5205166 5205161 -
cttcaggtttgtggtaaataga

SEQ ID NO: 147244 - DNA, 22 bp, Artificial Sequence
  Synthetic oligonucleotide; CTT chr11 5205158 5205179 5205163 5205158 -
caggtttgtggtaaatagattc

SEQ ID NO: 147245 - DNA, 22 bp, Artificial Sequence
  Synthetic oligonucleotide; TTC chr11 5205157 5205178 5205162 5205157 -
aggtttgtggtaaatagattct

SEQ ID NO: 147246 - DNA, 22 bp, Artificial Sequence
  Synthetic oligonucleotide; TTT chr11 5205151 5205172 5205156 5205151 -
gtggtaaatagattctctctga

SEQ ID NO: 147247 - DNA, 22 bp, Artificial Sequence
  Synthetic oligonucleotide; TTG chr11 5205150 5205171 5205155 5205150 -
tggtaaatagattctctctgaa

SEQ ID NO: 147248 - DNA, 22 bp, Artificial Sequence
  Synthetic oligonucleotide; TTC chr11 5205136 5205157 5205141 5205136 -
tctctgaactagcatattcaga

SEQ ID NO: 147249 - DNA, 22 bp, Artificial Sequence
  Synthetic oligonucleotide; CTC chr11 5205134 5205155 5205139 5205134 -
tctgaactagcatattcagaat

SEQ ID NO: 147250 - DNA, 22 bp, Artificial Sequence
  Synthetic oligonucleotide; CTC chr11 5205132 5205153 5205137 5205132 -
tgaactagcatattcagaatca

SEQ ID NO: 147251 - DNA, 22 bp, Artificial Sequence
  Synthetic oligonucleotide; CTG chr11 5205130 5205151 5205135 5205130 -
aactagcatattcagaatcatt

SEQ ID NO: 147252 - DNA, 22 bp, Artificial Sequence
  Synthetic oligonucleotide; CTA chr11 5205125 5205146 5205130 5205125 -
gcatattcagaatcattaaaca

SEQ ID NO: 147253 - DNA, 22 bp, Artificial Sequence
  Synthetic oligonucleotide; TTC chr11 5205117 5205138 5205122 5205117 -
agaatcattaaacagtcagttc

SEQ ID NO: 147254 - DNA, 22 bp, Artificial Sequence
  Synthetic oligonucleotide; TTA chr11 5205107 5205128 5205112 5205107 -
aacagtcagttctttggacaag

SEQ ID NO: 147255 - DNA, 22 bp, Artificial Sequence
  Synthetic oligonucleotide; TTC chr11 5205095 5205116 5205100 5205095 -
tttggacaagtcttatagaatg

SEQ ID NO: 147256 - DNA, 22 bp, Artificial Sequence
  Synthetic oligonucleotide; CTT chr11 5205093 5205114 5205098 5205093 -
tggacaagtcttatagaatgtt

SEQ ID NO: 147257 - DNA, 22 bp, Artificial Sequence
  Synthetic oligonucleotide; TTT chr11 5205092 5205113 5205097 5205092 -
ggacaagtcttatagaatgttc

SEQ ID NO: 147258 - DNA, 22 bp, Artificial Sequence
  Synthetic oligonucleotide; TTG chr11 5205091 5205112 5205096 5205091 -
gacaagtcttatagaatgttct

SEQ ID NO: 147259 - DNA, 22 bp, Artificial Sequence
  Synthetic oligonucleotide; CTT chr11 5205081 5205102 5205086 5205081 -
atagaatgttcttacctcttca

SEQ ID NO: 147260 - DNA, 22 bp, Artificial Sequence
  Synthetic oligonucleotide; TTA chr11 5205080 5205101 5205085 5205080 -
tagaatgttcttacctcttcag

SEQ ID NO: 147261 - DNA, 22 bp, Artificial Sequence
  Synthetic oligonucleotide; TTC chr11 5205070 5205091 5205075 5205070 -
ttacctcttcagccatcccaag

SEQ ID NO: 147262 - DNA, 22 bp, Artificial Sequence
  Synthetic oligonucleotide; CTT chr11 5205068 5205089 5205073 5205068 -
acctcttcagccatcccaagac

SEQ ID NO: 147263 - DNA, 22 bp, Artificial Sequence
  Synthetic oligonucleotide; TTA chr11 5205067 5205088 5205072 5205067 -
cctcttcagccatcccaagact

SEQ ID NO: 147264 - DNA, 22 bp, Artificial Sequence
  Synthetic oligonucleotide; CTC chr11 5205063 5205084 5205068 5205063 -
ttcagccatcccaagactcttg

SEQ ID NO: 147265 - DNA, 22 bp, Artificial Sequence
  Synthetic oligonucleotide; CTT chr11 5205061 5205082 5205066 5205061 -
cagccatcccaagactcttgag

SEQ ID NO: 147266 - DNA, 22 bp, Artificial Sequence
  Synthetic oligonucleotide; TTC chr11 5205060 5205081 5205065 5205060 -
agccatcccaagactcttgagg

SEQ ID NO: 147267 - DNA, 22 bp, Artificial Sequence
  Synthetic oligonucleotide; CTC chr11 5205044 5205065 5205049 5205044 -
ttgagggcctgacctcgcttac

SEQ ID NO: 147268 - DNA, 22 bp, Artificial Sequence
  Synthetic oligonucleotide; CTT chr11 5205042 5205063 5205047 5205042 -
gagggcctgacctcgcttacac

SEQ ID NO: 147269 - DNA, 22 bp, Artificial Sequence
  Synthetic oligonucleotide; TTG chr11 5205041 5205062 5205046 5205041 -
agggcctgacctcgcttacact

SEQ ID NO: 147270 - DNA, 22 bp, Artificial Sequence
  Synthetic oligonucleotide; CTG chr11 5205033 5205054 5205038 5205033 -
acctcgcttacactaaagcaga

SEQ ID NO: 147271 - DNA, 22 bp, Artificial Sequence
  Synthetic oligonucleotide; CTC chr11 5205028 5205049 5205033 5205028 -
gcttacactaaagcagatctgc

SEQ ID NO: 147272 - DNA, 22 bp, Artificial Sequence
  Synthetic oligonucleotide; CTT chr11 5205024 5205045 5205029 5205024 -
acactaaagcagatctgcctta

SEQ ID NO: 147273 - DNA, 22 bp, Artificial Sequence
  Synthetic oligonucleotide; TTA chr11 5205023 5205044 5205028 5205023 -
cactaaagcagatctgccttat

SEQ ID NO: 147274 - DNA, 22 bp, Artificial Sequence
  Synthetic oligonucleotide; CTA chr11 5205018 5205039 5205023 5205018 -
aagcagatctgccttatgcatc

SEQ ID NO: 147275 - DNA, 22 bp, Artificial Sequence
  Synthetic oligonucleotide; CTG chr11 5205007 5205028 5205012 5205007 -
ccttatgcatcactgaagtagg

SEQ ID NO: 147276 - DNA, 22 bp, Artificial Sequence
  Synthetic oligonucleotide; CTT chr11 5205003 5205024 5205008 5205003 -
atgcatcactgaagtagggagg

SEQ ID NO: 147277 - DNA, 22 bp, Artificial Sequence
  Synthetic oligonucleotide; TTA chr11 5205002 5205023 5205007 5205002 -
tgcatcactgaagtagggaggg

SEQ ID NO: 147278 - DNA, 22 bp, Artificial Sequence
  Synthetic oligonucleotide; CTG chr11 5204992 5205013 5204997 5204992 -
aagtagggagggaagaaagttt

SEQ ID NO: 147279 - DNA, 22 bp, Artificial Sequence
  Synthetic oligonucleotide; TTT chr11 5204970 5204991 5204975 5204970 -
gatgaactacttctgaccccta

SEQ ID NO: 147280 - DNA, 22 bp, Artificial Sequence
  Synthetic oligonucleotide; TTG chr11 5204969 5204990 5204974 5204969 -
atgaactacttctgacccctag

SEQ ID NO: 147281 - DNA, 22 bp, Artificial Sequence
  Synthetic oligonucleotide; CTA chr11 5204961 5204982 5204966 5204961 -
cttctgacccctagtggtgtcc

SEQ ID NO: 147282 - DNA, 22 bp, Artificial Sequence
  Synthetic oligonucleotide; CTT chr11 5204958 5204979 5204963 5204958 -
ctgacccctagtggtgtccaga

SEQ ID NO: 147283 - DNA, 22 bp, Artificial Sequence
  Synthetic oligonucleotide; TTC chr11 5204957 5204978 5204962 5204957 -
tgacccctagtggtgtccagaa

SEQ ID NO: 147284 - DNA, 22 bp, Artificial Sequence
  Synthetic oligonucleotide; CTG chr11 5204955 5204976 5204960 5204955 -
acccctagtggtgtccagaaaa

SEQ ID NO: 147285 - DNA, 22 bp, Artificial Sequence
  Synthetic oligonucleotide; CTA chr11 5204948 5204969 5204953 5204948 -
gtggtgtccagaaaagaccatt

SEQ ID NO: 147286 - DNA, 22 bp, Artificial Sequence
  Synthetic oligonucleotide; TTA chr11 5204925 5204946 5204930 5204925 -
aaggaatgacctttaaaggatg

SEQ ID NO: 147287 - DNA, 22 bp, Artificial Sequence
  Synthetic oligonucleotide; CTT chr11 5204912 5204933 5204917 5204912 -
taaaggatggacatacaatttt

SEQ ID NO: 147288 - DNA, 22 bp, Artificial Sequence
  Synthetic oligonucleotide; TTT chr11 5204911 5204932 5204916 5204911 -
aaaggatggacatacaattttt

SEQ ID NO: 147289 - DNA, 22 bp, Artificial Sequence
  Synthetic oligonucleotide; TTA chr11 5204910 5204931 5204915 5204910 -
aaggatggacatacaatttttt

SEQ ID NO: 147290 - DNA, 22 bp, Artificial Sequence
  Synthetic oligonucleotide; TTT chr11 5204891 5204912 5204896 5204891 -
tttgtccaaggcaggacatgtg

SEQ ID NO: 147291 - DNA, 22 bp, Artificial Sequence
  Synthetic oligonucleotide; TTT chr11 5204890 5204911 5204895 5204890 -
ttgtccaaggcaggacatgtgt

SEQ ID NO: 147292 - DNA, 22 bp, Artificial Sequence
  Synthetic oligonucleotide; TTT chr11 5204889 5204910 5204894 5204889 -
tgtccaaggcaggacatgtgtg

SEQ ID NO: 147293 - DNA, 22 bp, Artificial Sequence
  Synthetic oligonucleotide; TTT chr11 5204888 5204909 5204893 5204888 -
gtccaaggcaggacatgtgtgg

SEQ ID NO: 147294 - DNA, 22 bp, Artificial Sequence
  Synthetic oligonucleotide; TTG chr11 5204887 5204908 5204892 5204887 -
tccaaggcaggacatgtgtggg

SEQ ID NO: 147295 - DNA, 22 bp, Artificial Sequence
  Synthetic oligonucleotide; CTT chr11 5204859 5204880 5204864 5204859 -
tcagtaattatgttctaagaac

SEQ ID NO: 147296 - DNA, 22 bp, Artificial Sequence
  Synthetic oligonucleotide; TTT chr11 5204858 5204879 5204863 5204858 -
cagtaattatgttctaagaaca

SEQ ID NO: 147297 - DNA, 22 bp, Artificial Sequence
  Synthetic oligonucleotide; TTC chr11 5204857 5204878 5204862 5204857 -
agtaattatgttctaagaacag

SEQ ID NO: 147298 - DNA, 22 bp, Artificial Sequence
  Synthetic oligonucleotide; TTA chr11 5204849 5204870 5204854 5204849 -
tgttctaagaacagcaaaaact

SEQ ID NO: 147299 - DNA, 22 bp, Artificial Sequence
  Synthetic oligonucleotide; TTC chr11 5204844 5204865 5204849 5204844 -
taagaacagcaaaaactccact

SEQ ID NO: 147300 - DNA, 22 bp, Artificial Sequence
  Synthetic oligonucleotide; CTA chr11 5204842 5204863 5204847 5204842 -
agaacagcaaaaactccactgc

SEQ ID NO: 147301 - DNA, 22 bp, Artificial Sequence
  Synthetic oligonucleotide; CTC chr11 5204826 5204847 5204831 5204826 -
cactgccttggcaaataggaat

SEQ ID NO: 147302 - DNA, 22 bp, Artificial Sequence
  Synthetic oligonucleotide; CTG chr11 5204821 5204842 5204826 5204821 -
ccttggcaaataggaatgtttt

SEQ ID NO: 147303 - DNA, 22 bp, Artificial Sequence
  Synthetic oligonucleotide; CTT chr11 5204817 5204838 5204822 5204817 -
ggcaaataggaatgttttagtt

SEQ ID NO: 147304 - DNA, 22 bp, Artificial Sequence
  Synthetic oligonucleotide; TTG chr11 5204816 5204837 5204821 5204816 -
gcaaataggaatgttttagttc

SEQ ID NO: 147305 - DNA, 22 bp, Artificial Sequence
  Synthetic oligonucleotide; TTT chr11 5204800 5204821 5204805 5204800 -
tagttctatagaattataaaga

SEQ ID NO: 147306 - DNA, 22 bp, Artificial Sequence
  Synthetic oligonucleotide; TTT chr11 5204799 5204820 5204804 5204799 -
agttctatagaattataaagaa

SEQ ID NO: 147307 - DNA, 22 bp, Artificial Sequence
  Synthetic oligonucleotide; TTA chr11 5204798 5204819 5204803 5204798 -
gttctatagaattataaagaag

SEQ ID NO: 147308 - DNA, 22 bp, Artificial Sequence
  Synthetic oligonucleotide; TTC chr11 5204794 5204815 5204799 5204794 -
tatagaattataaagaagctgt

SEQ ID NO: 147309 - DNA, 22 bp, Artificial Sequence
  Synthetic oligonucleotide; CTA chr11 5204792 5204813 5204797 5204792 -
tagaattataaagaagctgtct

SEQ ID NO: 147310 - DNA, 22 bp, Artificial Sequence
  Synthetic oligonucleotide; TTA chr11 5204784 5204805 5204789 5204784 -
taaagaagctgtcttttaaaca

SEQ ID NO: 147311 - DNA, 22 bp, Artificial Sequence
  Synthetic oligonucleotide; CTG chr11 5204773 5204794 5204778 5204773 -
tcttttaaacacaatatacttt

SEQ ID NO: 147312 - DNA, 22 bp, Artificial Sequence
  Synthetic oligonucleotide; CTT chr11 5204769 5204790 5204774 5204769 -
ttaaacacaatatactttctct

SEQ ID NO: 147313 - DNA, 22 bp, Artificial Sequence
  Synthetic oligonucleotide; TTT chr11 5204768 5204789 5204773 5204768 -
taaacacaatatactttctcta

SEQ ID NO: 147314 - DNA, 22 bp, Artificial Sequence
  Synthetic oligonucleotide; TTT chr11 5204767 5204788 5204772 5204767 -
aaacacaatatactttctctat

SEQ ID NO: 147315 - DNA, 22 bp, Artificial Sequence
  Synthetic oligonucleotide; TTA chr11 5204766 5204787 5204771 5204766 -
aacacaatatactttctctatg

SEQ ID NO: 147316 - DNA, 22 bp, Artificial Sequence
  Synthetic oligonucleotide; CTT chr11 5204752 5204773 5204757 5204752 -
tctctatgtctttggaacaatg

SEQ ID NO: 147317 - DNA, 22 bp, Artificial Sequence
  Synthetic oligonucleotide; TTT chr11 5204751 5204772 5204756 5204751 -
ctctatgtctttggaacaatga

SEQ ID NO: 147318 - DNA, 22 bp, Artificial Sequence
  Synthetic oligonucleotide; TTC chr11 5204750 5204771 5204755 5204750 -
tctatgtctttggaacaatgac

SEQ ID NO: 147319 - DNA, 22 bp, Artificial Sequence
  Synthetic oligonucleotide; CTC chr11 5204748 5204769 5204753 5204748 -
tatgtctttggaacaatgacta

SEQ ID NO: 147320 - DNA, 22 bp, Artificial Sequence
  Synthetic oligonucleotide; CTA chr11 5204746 5204767 5204751 5204746 -
tgtctttggaacaatgactatt

SEQ ID NO: 147321 - DNA, 22 bp, Artificial Sequence
  Synthetic oligonucleotide; CTT chr11 5204740 5204761 5204745 5204740 -
tggaacaatgactattggtcat

SEQ ID NO: 147322 - DNA, 22 bp, Artificial Sequence
  Synthetic oligonucleotide; TTT chr11 5204739 5204760 5204744 5204739 -
ggaacaatgactattggtcatt

SEQ ID NO: 147323 - DNA, 22 bp, Artificial Sequence
  Synthetic oligonucleotide; TTG chr11 5204738 5204759 5204743 5204738 -
gaacaatgactattggtcatta

SEQ ID NO: 147324 - DNA, 22 bp, Artificial Sequence
  Synthetic oligonucleotide; CTA chr11 5204726 5204747 5204731 5204726 -
ttggtcattaccctattttaaa

SEQ ID NO: 147325 - DNA, 22 bp, Artificial Sequence
  Synthetic oligonucleotide; TTG chr11 5204723 5204744 5204728 5204723 -
gtcattaccctattttaaagta

SEQ ID NO: 147326 - DNA, 22 bp, Artificial Sequence
  Synthetic oligonucleotide; TTA chr11 5204716 5204737 5204721 5204716 -
ccctattttaaagtaagcaagt

SEQ ID NO: 147327 - DNA, 22 bp, Artificial Sequence
  Synthetic oligonucleotide; CTA chr11 5204711 5204732 5204716 5204711 -
ttttaaagtaagcaagtaatca

SEQ ID NO: 147328 - DNA, 22 bp, Artificial Sequence
  Synthetic oligonucleotide; TTT chr11 5204708 5204729 5204713 5204708 -
taaagtaagcaagtaatcacac

SEQ ID NO: 147329 - DNA, 22 bp, Artificial Sequence
  Synthetic oligonucleotide; TTT chr11 5204707 5204728 5204712 5204707 -
aaagtaagcaagtaatcacaca

SEQ ID NO: 147330 - DNA, 22 bp, Artificial Sequence
  Synthetic oligonucleotide; TTA chr11 5204706 5204727 5204711 5204706 -
aagtaagcaagtaatcacacag

SEQ ID NO: 147331 - DNA, 22 bp, Artificial Sequence
  Synthetic oligonucleotide; TTA chr11 5204677 5204698 5204682 5204677 -
ttctgaaaagacagaaaaaaaa

SEQ ID NO: 147332 - DNA, 22 bp, Artificial Sequence
  Synthetic oligonucleotide; TTC chr11 5204674 5204695 5204679 5204674 -
tgaaaagacagaaaaaaaaaaa

SEQ ID NO: 147333 - DNA, 22 bp, Artificial Sequence
  Synthetic oligonucleotide; CTG chr11 5204672 5204693 5204677 5204672 -
aaaagacagaaaaaaaaaaaaa

SEQ ID NO: 147334 - DNA, 22 bp, Artificial Sequence
  Synthetic oligonucleotide; TTT chr11 5204638 5204659 5204643 5204638 -
ctgcatatgtaggtcagtttta

SEQ ID NO: 147335 - DNA, 22 bp, Artificial Sequence
  Synthetic oligonucleotide; TTC chr11 5204637 5204658 5204642 5204637 -
tgcatatgtaggtcagttttaa

SEQ ID NO: 147336 - DNA, 22 bp, Artificial Sequence
  Synthetic oligonucleotide; CTG chr11 5204635 5204656 5204640 5204635 -
catatgtaggtcagttttaatc

SEQ ID NO: 147337 - DNA, 22 bp, Artificial Sequence
  Synthetic oligonucleotide; TTT chr11 5204618 5204639 5204623 5204618 -
taatcagagggcatcagaaaag

SEQ ID NO: 147338 - DNA, 22 bp, Artificial Sequence
  Synthetic oligonucleotide; TTT chr11 5204617 5204638 5204622 5204617 -
aatcagagggcatcagaaaaga

SEQ ID NO: 147339 - DNA, 22 bp, Artificial Sequence
  Synthetic oligonucleotide; TTA chr11 5204616 5204637 5204621 5204616 -
atcagagggcatcagaaaagac

SEQ ID NO: 147340 - DNA, 22 bp, Artificial Sequence
  Synthetic oligonucleotide; CTC chr11 5204592 5204613 5204597 5204592 -
ctgaaagaatgacctggttatt

SEQ ID NO: 147341 - DNA, 22 bp, Artificial Sequence
  Synthetic oligonucleotide; CTG chr11 5204589 5204610 5204594 5204589 -
aaagaatgacctggttattata

SEQ ID NO: 147342 - DNA, 22 bp, Artificial Sequence
  Synthetic oligonucleotide; CTG chr11 5204576 5204597 5204581 5204576 -
gttattataatcacagatttgc

SEQ ID NO: 147343 - DNA, 22 bp, Artificial Sequence
  Synthetic oligonucleotide; TTA chr11 5204572 5204593 5204577 5204572 -
ttataatcacagatttgctttc

SEQ ID NO: 147344 - DNA, 22 bp, Artificial Sequence
  Synthetic oligonucleotide; TTA chr11 5204569 5204590 5204574 5204569 -
taatcacagatttgctttccaa

SEQ ID NO: 147345 - DNA, 22 bp, Artificial Sequence
  Synthetic oligonucleotide; TTT chr11 5204556 5204577 5204561 5204556 -
gctttccaagtcaacattccag

SEQ ID NO: 147346 - DNA, 22 bp, Artificial Sequence
  Synthetic oligonucleotide; TTG chr11 5204555 5204576 5204560 5204555 -
ctttccaagtcaacattccaga

SEQ ID NO: 147347 - DNA, 22 bp, Artificial Sequence
  Synthetic oligonucleotide; CTT chr11 5204552 5204573 5204557 5204552 -
tccaagtcaacattccagacag

SEQ ID NO: 147348 - DNA, 22 bp, Artificial Sequence
  Synthetic oligonucleotide; TTT chr11 5204551 5204572 5204556 5204551 -
ccaagtcaacattccagacagt

SEQ ID NO: 147349 - DNA, 22 bp, Artificial Sequence
  Synthetic oligonucleotide; TTC chr11 5204550 5204571 5204555 5204550 -
caagtcaacattccagacagtg

SEQ ID NO: 147350 - DNA, 22 bp, Artificial Sequence
  Synthetic oligonucleotide; TTC chr11 5204537 5204558 5204542 5204537 -
cagacagtgctcagaggggata

SEQ ID NO: 147351 - DNA, 22 bp, Artificial Sequence
  Synthetic oligonucleotide; CTC chr11 5204525 5204546 5204530 5204525 -
agaggggatacgaaaacccttt

SEQ ID NO: 147352 - DNA, 22 bp, Artificial Sequence
  Synthetic oligonucleotide; CTT chr11 5204504 5204525 5204509 5204504 -
ttatttctccagactcaaattc

SEQ ID NO: 147353 - DNA, 22 bp, Artificial Sequence
  Synthetic oligonucleotide; TTT chr11 5204503 5204524 5204508 5204503 -
tatttctccagactcaaattca

SEQ ID NO: 147354 - DNA, 22 bp, Artificial Sequence
  Synthetic oligonucleotide; TTT chr11 5204502 5204523 5204507 5204502 -
atttctccagactcaaattcac

SEQ ID NO: 147355 - DNA, 22 bp, Artificial Sequence
  Synthetic oligonucleotide; TTA chr11 5204501 5204522 5204506 5204501 -
tttctccagactcaaattcact

SEQ ID NO: 147356 - DNA, 22 bp, Artificial Sequence
  Synthetic oligonucleotide; TTT chr11 5204498 5204519 5204503 5204498 -
ctccagactcaaattcactgct

SEQ ID NO: 147357 - DNA, 22 bp, Artificial Sequence
  Synthetic oligonucleotide; TTC chr11 5204497 5204518 5204502 5204497 -
tccagactcaaattcactgcta

SEQ ID NO: 147358 - DNA, 22 bp, Artificial Sequence
  Synthetic oligonucleotide; CTC chr11 5204495 5204516 5204500 5204495 -
cagactcaaattcactgctatt

SEQ ID NO: 147359 - DNA, 22 bp, Artificial Sequence
  Synthetic oligonucleotide; CTC chr11 5204488 5204509 5204493 5204488 -
aaattcactgctatttgtcttc

SEQ ID NO: 147360 - DNA, 22 bp, Artificial Sequence
  Synthetic oligonucleotide; TTC chr11 5204482 5204503 5204487 5204482 -
actgctatttgtcttctctatt

SEQ ID NO: 147361 - DNA, 22 bp, Artificial Sequence
  Synthetic oligonucleotide; CTG chr11 5204478 5204499 5204483 5204478 -
ctatttgtcttctctatttatt

SEQ ID NO: 147362 - DNA, 22 bp, Artificial Sequence
  Synthetic oligonucleotide; CTA chr11 5204475 5204496 5204480 5204475 -
tttgtcttctctatttatttta

SEQ ID NO: 147363 - DNA, 22 bp, Artificial Sequence
  Synthetic oligonucleotide; TTT chr11 5204472 5204493 5204477 5204472 -
gtcttctctatttattttatta

SEQ ID NO: 147364 - DNA, 22 bp, Artificial Sequence
  Synthetic oligonucleotide; TTG chr11 5204471 5204492 5204476 5204471 -
tcttctctatttattttattat

SEQ ID NO: 147365 - DNA, 22 bp, Artificial Sequence
  Synthetic oligonucleotide; CTT chr11 5204467 5204488 5204472 5204467 -
ctctatttattttattataggc

SEQ ID NO: 147366 - DNA, 22 bp, Artificial Sequence
  Synthetic oligonucleotide; TTC chr11 5204466 5204487 5204471 5204466 -
tctatttattttattataggca

SEQ ID NO: 147367 - DNA, 22 bp, Artificial Sequence
  Synthetic oligonucleotide; CTC chr11 5204464 5204485 5204469 5204464 -
tatttattttattataggcatt

SEQ ID NO: 147368 - DNA, 22 bp, Artificial Sequence
  Synthetic oligonucleotide; CTA chr11 5204462 5204483 5204467 5204462 -
tttattttattataggcattgt

SEQ ID NO: 147369 - DNA, 22 bp, Artificial Sequence
  Synthetic oligonucleotide; TTT chr11 5204459 5204480 5204464 5204459 -
attttattataggcattgttct

SEQ ID NO: 147370 - DNA, 22 bp, Artificial Sequence
  Synthetic oligonucleotide; TTA chr11 5204458 5204479 5204463 5204458 -
ttttattataggcattgttctg

SEQ ID NO: 147371 - DNA, 22 bp, Artificial Sequence
  Synthetic oligonucleotide; TTT chr11 5204455 5204476 5204460 5204455 -
tattataggcattgttctggtt

SEQ ID NO: 147372 - DNA, 22 bp, Artificial Sequence
  Synthetic oligonucleotide; TTT chr11 5204454 5204475 5204459 5204454 -
attataggcattgttctggttg

SEQ ID NO: 147373 - DNA, 22 bp, Artificial Sequence
  Synthetic oligonucleotide; TTA chr11 5204453 5204474 5204458 5204453 -
ttataggcattgttctggttgc

SEQ ID NO: 147374 - DNA, 22 bp, Artificial Sequence
  Synthetic oligonucleotide; TTA chr11 5204450 5204471 5204455 5204450 -
taggcattgttctggttgctgg

SEQ ID NO: 147375 - DNA, 22 bp, Artificial Sequence
  Synthetic oligonucleotide; TTG chr11 5204441 5204462 5204446 5204441 -
ttctggttgctgggaactcaga

SEQ ID NO: 147376 - DNA, 22 bp, Artificial Sequence
  Synthetic oligonucleotide; TTC chr11 5204438 5204459 5204443 5204438 -
tggttgctgggaactcagactg

SEQ ID NO: 147377 - DNA, 22 bp, Artificial Sequence
  Synthetic oligonucleotide; CTG chr11 5204436 5204457 5204441 5204436 -
gttgctgggaactcagactgag

SEQ ID NO: 147378 - DNA, 22 bp, Artificial Sequence
  Synthetic oligonucleotide; TTG chr11 5204432 5204453 5204437 5204432 -
ctgggaactcagactgagatac

SEQ ID NO: 147379 - DNA, 22 bp, Artificial Sequence
  Synthetic oligonucleotide; CTG chr11 5204429 5204450 5204434 5204429 -
ggaactcagactgagataccat

SEQ ID NO: 147380 - DNA, 22 bp, Artificial Sequence
  Synthetic oligonucleotide; CTC chr11 5204422 5204443 5204427 5204422 -
agactgagataccatacactga

SEQ ID NO: 147381 - DNA, 22 bp, Artificial Sequence
  Synthetic oligonucleotide; CTG chr11 5204416 5204437 5204421 5204416 -
agataccatacactgactctca

SEQ ID NO: 147382 - DNA, 22 bp, Artificial Sequence
  Synthetic oligonucleotide; CTG chr11 5204401 5204422 5204406 5204401 -
actctcagatagcataacacaa

SEQ ID NO: 147383 - DNA, 22 bp, Artificial Sequence
  Synthetic oligonucleotide; CTC chr11 5204397 5204418 5204402 5204397 -
tcagatagcataacacaacatg

SEQ ID NO: 147384 - DNA, 22 bp, Artificial Sequence
  Synthetic oligonucleotide; CTC chr11 5204395 5204416 5204400 5204395 -
agatagcataacacaacatgat

SEQ ID NO: 147385 - DNA, 22 bp, Artificial Sequence
  Synthetic oligonucleotide; CTT chr11 5204368 5204389 5204373 5204368 -
ggaaaactgtaaatctttttgt

SEQ ID NO: 147386 - DNA, 22 bp, Artificial Sequence
  Synthetic oligonucleotide; TTG chr11 5204367 5204388 5204372 5204367 -
gaaaactgtaaatctttttgtt

SEQ ID NO: 147387 - DNA, 22 bp, Artificial Sequence
  Synthetic oligonucleotide; CTG chr11 5204359 5204380 5204364 5204359 -
taaatctttttgttttttaaat

SEQ ID NO: 147388 - DNA, 22 bp, Artificial Sequence
  Synthetic oligonucleotide; CTT chr11 5204351 5204372 5204356 5204351 -
tttgttttttaaatacaggtgg

SEQ ID NO: 147389 - DNA, 22 bp, Artificial Sequence
  Synthetic oligonucleotide; TTT chr11 5204350 5204371 5204355 5204350 -
ttgttttttaaatacaggtgga

SEQ ID NO: 147390 - DNA, 22 bp, Artificial Sequence
  Synthetic oligonucleotide; TTT chr11 5204349 5204370 5204354 5204349 -
tgttttttaaatacaggtggag

SEQ ID NO: 147391 - DNA, 22 bp, Artificial Sequence
  Synthetic oligonucleotide; TTT chr11 5204348 5204369 5204353 5204348 -
gttttttaaatacaggtggagc

SEQ ID NO: 147392 - DNA, 22 bp, Artificial Sequence
  Synthetic oligonucleotide; TTG chr11 5204347 5204368 5204352 5204347 -
ttttttaaatacaggtggagca

SEQ ID NO: 147393 - DNA, 22 bp, Artificial Sequence
  Synthetic oligonucleotide; TTT chr11 5204344 5204365 5204349 5204344 -
tttaaatacaggtggagcatct

SEQ ID NO: 147394 - DNA, 22 bp, Artificial Sequence
  Synthetic oligonucleotide; TTT chr11 5204343 5204364 5204348 5204343 -
ttaaatacaggtggagcatctg

SEQ ID NO: 147395 - DNA, 22 bp, Artificial Sequence
  Synthetic oligonucleotide; TTT chr11 5204342 5204363 5204347 5204342 -
taaatacaggtggagcatctgg

SEQ ID NO: 147396 - DNA, 22 bp, Artificial Sequence
  Synthetic oligonucleotide; TTT chr11 5204341 5204362 5204346 5204341 -
aaatacaggtggagcatctggc

SEQ ID NO: 147397 - DNA, 22 bp, Artificial Sequence
  Synthetic oligonucleotide; TTA chr11 5204340 5204361 5204345 5204340 -
aatacaggtggagcatctggca

SEQ ID NO: 147398 - DNA, 22 bp, Artificial Sequence
  Synthetic oligonucleotide; CTG chr11 5204321 5204342 5204326 5204321 -
gcacacctgacatattgatctt

SEQ ID NO: 147399 - DNA, 22 bp, Artificial Sequence
  Synthetic oligonucleotide; CTG chr11 5204312 5204333 5204317 5204312 -
acatattgatcttgtttttctt

SEQ ID NO: 147400 - DNA, 22 bp, Artificial Sequence
  Synthetic oligonucleotide; TTG chr11 5204304 5204325 5204309 5204304 -
atcttgtttttctttaaatctt

SEQ ID NO: 147401 - DNA, 22 bp, Artificial Sequence
  Synthetic oligonucleotide; CTT chr11 5204299 5204320 5204304 5204299 -
gtttttctttaaatcttcattt

SEQ ID NO: 147402 - DNA, 22 bp, Artificial Sequence
  Synthetic oligonucleotide; TTG chr11 5204298 5204319 5204303 5204298 -
tttttctttaaatcttcattta

SEQ ID NO: 147403 - DNA, 22 bp, Artificial Sequence
  Synthetic oligonucleotide; TTT chr11 5204295 5204316 5204300 5204295 -
ttctttaaatcttcatttattt

SEQ ID NO: 147404 - DNA, 22 bp, Artificial Sequence
  Synthetic oligonucleotide; TTT chr11 5204294 5204315 5204299 5204294 -
tctttaaatcttcatttattta

SEQ ID NO: 147405 - DNA, 22 bp, Artificial Sequence
  Synthetic oligonucleotide; TTT chr11 5204293 5204314 5204298 5204293 -
ctttaaatcttcatttatttac

SEQ ID NO: 147406 - DNA, 22 bp, Artificial Sequence
  Synthetic oligonucleotide; TTC chr11 5204292 5204313 5204297 5204292 -
tttaaatcttcatttatttacc

SEQ ID NO: 147407 - DNA, 22 bp, Artificial Sequence
  Synthetic oligonucleotide; CTT chr11 5204290 5204311 5204295 5204290 -
taaatcttcatttatttacctt

SEQ ID NO: 147408 - DNA, 22 bp, Artificial Sequence
  Synthetic oligonucleotide; TTT chr11 5204289 5204310 5204294 5204289 -
aaatcttcatttatttacctta

SEQ ID NO: 147409 - DNA, 22 bp, Artificial Sequence
  Synthetic oligonucleotide; TTA chr11 5204288 5204309 5204293 5204288 -
aatcttcatttatttaccttat

SEQ ID NO: 147410 - DNA, 22 bp, Artificial Sequence
  Synthetic oligonucleotide; CTT chr11 5204282 5204303 5204287 5204282 -
catttatttaccttatcaaaac

SEQ ID NO: 147411 - DNA, 22 bp, Artificial Sequence
  Synthetic oligonucleotide; TTC chr11 5204281 5204302 5204286 5204281 -
atttatttaccttatcaaaact

SEQ ID NO: 147412 - DNA, 22 bp, Artificial Sequence
  Synthetic oligonucleotide; TTT chr11 5204277 5204298 5204282 5204277 -
atttaccttatcaaaactatgc

SEQ ID NO: 147413 - DNA, 22 bp, Artificial Sequence
  Synthetic oligonucleotide; TTA chr11 5204276 5204297 5204281 5204276 -
tttaccttatcaaaactatgct

SEQ ID NO: 147414 - DNA, 22 bp, Artificial Sequence
  Synthetic oligonucleotide; TTT chr11 5204273 5204294 5204278 5204273 -
accttatcaaaactatgctctt

SEQ ID NO: 147415 - DNA, 22 bp, Artificial Sequence
  Synthetic oligonucleotide; TTA chr11 5204272 5204293 5204277 5204272 -
ccttatcaaaactatgctcttt

SEQ ID NO: 147416 - DNA, 22 bp, Artificial Sequence
  Synthetic oligonucleotide; CTT chr11 5204268 5204289 5204273 5204268 -
atcaaaactatgctctttcatc

SEQ ID NO: 147417 - DNA, 22 bp, Artificial Sequence
  Synthetic oligonucleotide; TTA chr11 5204267 5204288 5204272 5204267 -
tcaaaactatgctctttcatcc

SEQ ID NO: 147418 - DNA, 22 bp, Artificial Sequence
  Synthetic oligonucleotide; CTA chr11 5204258 5204279 5204263 5204258 -
tgctctttcatcctacctttca

SEQ ID NO: 147419 - DNA, 22 bp, Artificial Sequence
  Synthetic oligonucleotide; CTC chr11 5204253 5204274 5204258 5204253 -
tttcatcctacctttcaaaaca

SEQ ID NO: 147420 - DNA, 22 bp, Artificial Sequence
  Synthetic oligonucleotide; CTT chr11 5204251 5204272 5204256 5204251 -
tcatcctacctttcaaaacata

SEQ ID NO: 147421 - DNA, 22 bp, Artificial Sequence
  Synthetic oligonucleotide; TTT chr11 5204250 5204271 5204255 5204250 -
catcctacctttcaaaacatat

SEQ ID NO: 147422 - DNA, 22 bp, Artificial Sequence
  Synthetic oligonucleotide; TTC chr11 5204249 5204270 5204254 5204249 -
atcctacctttcaaaacatatt

SEQ ID NO: 147423 - DNA, 22 bp, Artificial Sequence
  Synthetic oligonucleotide; CTA chr11 5204243 5204264 5204248 5204243 -
cctttcaaaacatattttaaaa

SEQ ID NO: 147424 - DNA, 22 bp, Artificial Sequence
  Synthetic oligonucleotide; CTT chr11 5204239 5204260 5204244 5204239 -
tcaaaacatattttaaaaaatc

SEQ ID NO: 147425 - DNA, 22 bp, Artificial Sequence
  Synthetic oligonucleotide; TTT chr11 5204238 5204259 5204243 5204238 -
caaaacatattttaaaaaatcc

SEQ ID NO: 147426 - DNA, 22 bp, Artificial Sequence
  Synthetic oligonucleotide; TTC chr11 5204237 5204258 5204242 5204237 -
aaaacatattttaaaaaatcct

SEQ ID NO: 147427 - DNA, 22 bp, Artificial Sequence
  Synthetic oligonucleotide; TTT chr11 5204226 5204247 5204231 5204226 -
taaaaaatcctccaacatgtat

SEQ ID NO: 147428 - DNA, 22 bp, Artificial Sequence
  Synthetic oligonucleotide; TTT chr11 5204225 5204246 5204230 5204225 -
aaaaaatcctccaacatgtatt

SEQ ID NO: 147429 - DNA, 22 bp, Artificial Sequence
  Synthetic oligonucleotide; TTA chr11 5204224 5204245 5204229 5204224 -
aaaaatcctccaacatgtattt

SEQ ID NO: 147430 - DNA, 22 bp, Artificial Sequence
  Synthetic oligonucleotide; CTC chr11 5204214 5204235 5204219 5204214 -
caacatgtattttgctctggta

SEQ ID NO: 147431 - DNA, 22 bp, Artificial Sequence
  Synthetic oligonucleotide; TTT chr11 5204202 5204223 5204207 5204202 -
tgctctggtaatcccaaaaggc

SEQ ID NO: 147432 - DNA, 22 bp, Artificial Sequence
  Synthetic oligonucleotide; TTT chr11 5204201 5204222 5204206 5204201 -
gctctggtaatcccaaaaggct

SEQ ID NO: 147433 - DNA, 22 bp, Artificial Sequence
  Synthetic oligonucleotide; TTG chr11 5204200 5204221 5204205 5204200 -
ctctggtaatcccaaaaggctg

SEQ ID NO: 147434 - DNA, 22 bp, Artificial Sequence
  Synthetic oligonucleotide; CTC chr11 5204197 5204218 5204202 5204197 -
tggtaatcccaaaaggctgata

SEQ ID NO: 147435 - DNA, 22 bp, Artificial Sequence
  Synthetic oligonucleotide; CTG chr11 5204195 5204216 5204200 5204195 -
gtaatcccaaaaggctgatagt

SEQ ID NO: 147436 - DNA, 22 bp, Artificial Sequence
  Synthetic oligonucleotide; CTG chr11 5204178 5204199 5204183 5204178 -
atagtctctatggtggcaacat

SEQ ID NO: 147437 - DNA, 22 bp, Artificial Sequence
  Synthetic oligonucleotide; CTC chr11 5204170 5204191 5204175 5204170 -
tatggtggcaacatggataata

SEQ ID NO: 147438 - DNA, 22 bp, Artificial Sequence
  Synthetic oligonucleotide; CTA chr11 5204168 5204189 5204173 5204168 -
tggtggcaacatggataatact

SEQ ID NO: 147439 - DNA, 22 bp, Artificial Sequence
  Synthetic oligonucleotide; CTG chr11 5204145 5204166 5204150 5204145 -
ttccccatctagatggtctcat

SEQ ID NO: 147440 - DNA, 22 bp, Artificial Sequence
  Synthetic oligonucleotide; TTC chr11 5204142 5204163 5204147 5204142 -
cccatctagatggtctcatttc

SEQ ID NO: 147441 - DNA, 22 bp, Artificial Sequence
  Synthetic oligonucleotide; CTA chr11 5204134 5204155 5204139 5204134 -
gatggtctcatttcttctgtat

SEQ ID NO: 147442 - DNA, 22 bp, Artificial Sequence
  Synthetic oligonucleotide; CTC chr11 5204125 5204146 5204130 5204125 -
atttcttctgtatctagtctga

SEQ ID NO: 147443 - DNA, 22 bp, Artificial Sequence
  Synthetic oligonucleotide; TTT chr11 5204121 5204142 5204126 5204121 -
cttctgtatctagtctgaagaa

SEQ ID NO: 147444 - DNA, 22 bp, Artificial Sequence
  Synthetic oligonucleotide; TTC chr11 5204120 5204141 5204125 5204120 -
ttctgtatctagtctgaagaag

SEQ ID NO: 147445 - DNA, 22 bp, Artificial Sequence
  Synthetic oligonucleotide; CTT chr11 5204118 5204139 5204123 5204118 -
ctgtatctagtctgaagaagcc

SEQ ID NO: 147446 - DNA, 22 bp, Artificial Sequence
  Synthetic oligonucleotide; TTC chr11 5204117 5204138 5204122 5204117 -
tgtatctagtctgaagaagcct

SEQ ID NO: 147447 - DNA, 22 bp, Artificial Sequence
  Synthetic oligonucleotide; CTG chr11 5204115 5204136 5204120 5204115 -
tatctagtctgaagaagcctga

SEQ ID NO: 147448 - DNA, 22 bp, Artificial Sequence
  Synthetic oligonucleotide; CTA chr11 5204109 5204130 5204114 5204109 -
gtctgaagaagcctgaatgaaa

SEQ ID NO: 147449 - DNA, 22 bp, Artificial Sequence
  Synthetic oligonucleotide; CTG chr11 5204104 5204125 5204109 5204104 -
aagaagcctgaatgaaagtaga

SEQ ID NO: 147450 - DNA, 22 bp, Artificial Sequence
  Synthetic oligonucleotide; CTG chr11 5204094 5204115 5204099 5204094 -
aatgaaagtagatttttaagct

SEQ ID NO: 147451 - DNA, 22 bp, Artificial Sequence
  Synthetic oligonucleotide; TTT chr11 5204079 5204100 5204084 5204079 -
ttaagctttgtagctagtctga

SEQ ID NO: 147452 - DNA, 22 bp, Artificial Sequence
  Synthetic oligonucleotide; TTT chr11 5204078 5204099 5204083 5204078 -
taagctttgtagctagtctgaa

SEQ ID NO: 147453 - DNA, 22 bp, Artificial Sequence
  Synthetic oligonucleotide; TTT chr11 5204077 5204098 5204082 5204077 -
aagctttgtagctagtctgaag

SEQ ID NO: 147454 - DNA, 22 bp, Artificial Sequence
  Synthetic oligonucleotide; TTA chr11 5204076 5204097 5204081 5204076 -
agctttgtagctagtctgaagc

SEQ ID NO: 147455 - DNA, 22 bp, Artificial Sequence
  Synthetic oligonucleotide; CTT chr11 5204071 5204092 5204076 5204071 -
tgtagctagtctgaagcctttg

SEQ ID NO: 147456 - DNA, 22 bp, Artificial Sequence
  Synthetic oligonucleotide; TTT chr11 5204070 5204091 5204075 5204070 -
gtagctagtctgaagcctttgt

SEQ ID NO: 147457 - DNA, 22 bp, Artificial Sequence
  Synthetic oligonucleotide; TTG chr11 5204069 5204090 5204074 5204069 -
tagctagtctgaagcctttgta

SEQ ID NO: 147458 - DNA, 22 bp, Artificial Sequence
  Synthetic oligonucleotide; CTA chr11 5204063 5204084 5204068 5204063 -
gtctgaagcctttgtagtcagt

SEQ ID NO: 147459 - DNA, 22 bp, Artificial Sequence
  Synthetic oligonucleotide; CTG chr11 5204058 5204079 5204063 5204058 -
aagcctttgtagtcagtctgaa

SEQ ID NO: 147460 - DNA, 22 bp, Artificial Sequence
  Synthetic oligonucleotide; CTT chr11 5204051 5204072 5204056 5204051 -
tgtagtcagtctgaagaaacct

SEQ ID NO: 147461 - DNA, 22 bp, Artificial Sequence
  Synthetic oligonucleotide; TTT chr11 5204050 5204071 5204055 5204050 -
gtagtcagtctgaagaaacctg

SEQ ID NO: 147462 - DNA, 22 bp, Artificial Sequence
  Synthetic oligonucleotide; TTG chr11 5204049 5204070 5204054 5204049 -
tagtcagtctgaagaaacctgc

SEQ ID NO: 147463 - DNA, 22 bp, Artificial Sequence
  Synthetic oligonucleotide; CTG chr11 5204038 5204059 5204043 5204038 -
aagaaacctgcatgaaaataga

SEQ ID NO: 147464 - DNA, 22 bp, Artificial Sequence
  Synthetic oligonucleotide; CTG chr11 5204028 5204049 5204033 5204028 -
catgaaaatagatttttttttt

SEQ ID NO: 147465 - DNA, 22 bp, Artificial Sequence
  Synthetic oligonucleotide; TTT chr11 5204013 5204034 5204018 5204013 -
tttttttcctttgggacagagt

SEQ ID NO: 147466 - DNA, 22 bp, Artificial Sequence
  Synthetic oligonucleotide; TTT chr11 5204012 5204033 5204017 5204012 -
ttttttcctttgggacagagtc

SEQ ID NO: 147467 - DNA, 22 bp, Artificial Sequence
  Synthetic oligonucleotide; TTT chr11 5204011 5204032 5204016 5204011 -
tttttcctttgggacagagtct

SEQ ID NO: 147468 - DNA, 22 bp, Artificial Sequence
  Synthetic oligonucleotide; TTT chr11 5204010 5204031 5204015 5204010 -
ttttcctttgggacagagtctt

SEQ ID NO: 147469 - DNA, 22 bp, Artificial Sequence
  Synthetic oligonucleotide; TTT chr11 5204009 5204030 5204014 5204009 -
tttcctttgggacagagtcttg

SEQ ID NO: 147470 - DNA, 22 bp, Artificial Sequence
  Synthetic oligonucleotide; TTT chr11 5204008 5204029 5204013 5204008 -
ttcctttgggacagagtcttgc

SEQ ID NO: 147471 - DNA, 22 bp, Artificial Sequence
  Synthetic oligonucleotide; TTT chr11 5204007 5204028 5204012 5204007 -
tcctttgggacagagtcttgct

SEQ ID NO: 147472 - DNA, 22 bp, Artificial Sequence
  Synthetic oligonucleotide; TTT chr11 5204006 5204027 5204011 5204006 -
cctttgggacagagtcttgctc

SEQ ID NO: 147473 - DNA, 22 bp, Artificial Sequence
  Synthetic oligonucleotide; TTC chr11 5204005 5204026 5204010 5204005 -
ctttgggacagagtcttgctct

SEQ ID NO: 147474 - DNA, 22 bp, Artificial Sequence
  Synthetic oligonucleotide; CTT chr11 5204002 5204023 5204007 5204002 -
tgggacagagtcttgctctgtc

SEQ ID NO: 147475 - DNA, 22 bp, Artificial Sequence
  Synthetic oligonucleotide; TTT chr11 5204001 5204022 5204006 5204001 -
gggacagagtcttgctctgtcg

SEQ ID NO: 147476 - DNA, 22 bp, Artificial Sequence
  Synthetic oligonucleotide; TTG chr11 5204000 5204021 5204005 5204000 -
ggacagagtcttgctctgtcgc

SEQ ID NO: 147477 - DNA, 22 bp, Artificial Sequence
  Synthetic oligonucleotide; CTT chr11 5203988 5204009 5203993 5203988 -
gctctgtcgcccagactggagt

SEQ ID NO: 147478 - DNA, 22 bp, Artificial Sequence
  Synthetic oligonucleotide; TTG chr11 5203987 5204008 5203992 5203987 -
ctctgtcgcccagactggagtg

SEQ ID NO: 147479 - DNA, 22 bp, Artificial Sequence
  Synthetic oligonucleotide; CTC chr11 5203984 5204005 5203989 5203984 -
tgtcgcccagactggagtgcaa

SEQ ID NO: 147480 - DNA, 22 bp, Artificial Sequence
  Synthetic oligonucleotide; CTG chr11 5203982 5204003 5203987 5203982 -
tcgcccagactggagtgcaatg

SEQ ID NO: 147481 - DNA, 22 bp, Artificial Sequence
  Synthetic oligonucleotide; CTG chr11 5203970 5203991 5203975 5203970 -
gagtgcaatggcgcgatctcgg

SEQ ID NO: 147482 - DNA, 22 bp, Artificial Sequence
  Synthetic oligonucleotide; CTC chr11 5203950 5203971 5203955 5203950 -
ggctcactgcaacttccacctc

SEQ ID NO: 147483 - DNA, 22 bp, Artificial Sequence
  Synthetic oligonucleotide; CTC chr11 5203945 5203966 5203950 5203945 -
actgcaacttccacctcccagg

SEQ ID NO: 147484 - DNA, 22 bp, Artificial Sequence
  Synthetic oligonucleotide; CTG chr11 5203941 5203962 5203946 5203941 -
caacttccacctcccaggatca

SEQ ID NO: 147485 - DNA, 22 bp, Artificial Sequence
  Synthetic oligonucleotide; CTT chr11 5203935 5203956 5203940 5203935 -
ccacctcccaggatcaagcaat

SEQ ID NO: 147486 - DNA, 22 bp, Artificial Sequence
  Synthetic oligonucleotide; TTC chr11 5203934 5203955 5203939 5203934 -
cacctcccaggatcaagcaatt

SEQ ID NO: 147487 - DNA, 22 bp, Artificial Sequence
  Synthetic oligonucleotide; CTC chr11 5203928 5203949 5203933 5203928 -
ccaggatcaagcaattctcctg

SEQ ID NO: 147488 - DNA, 22 bp, Artificial Sequence
  Synthetic oligonucleotide; TTC chr11 5203911 5203932 5203916 5203911 -
tcctgcctcagtctcccaagta

SEQ ID NO: 147489 - DNA, 22 bp, Artificial Sequence
  Synthetic oligonucleotide; CTC chr11 5203909 5203930 5203914 5203909 -
ctgcctcagtctcccaagtaac

SEQ ID NO: 147490 - DNA, 22 bp, Artificial Sequence
  Synthetic oligonucleotide; CTG chr11 5203906 5203927 5203911 5203906 -
cctcagtctcccaagtaactgg

SEQ ID NO: 147491 - DNA, 22 bp, Artificial Sequence
  Synthetic oligonucleotide; CTC chr11 5203902 5203923 5203907 5203902 -
agtctcccaagtaactgggatt

SEQ ID NO: 147492 - DNA, 22 bp, Artificial Sequence
  Synthetic oligonucleotide; CTC chr11 5203896 5203917 5203901 5203896 -
ccaagtaactgggattacagga

SEQ ID NO: 147493 - DNA, 22 bp, Artificial Sequence
  Synthetic oligonucleotide; CTG chr11 5203885 5203906 5203890 5203885 -
ggattacaggagcacactgcca

SEQ ID NO: 147494 - DNA, 22 bp, Artificial Sequence
  Synthetic oligonucleotide; TTA chr11 5203879 5203900 5203884 5203879 -
caggagcacactgccatgccca

SEQ ID NO: 147495 - DNA, 22 bp, Artificial Sequence
  Synthetic oligonucleotide; CTG chr11 5203866 5203887 5203871 5203866 -
ccatgcccagctaattattttt

SEQ ID NO: 147496 - DNA, 22 bp, Artificial Sequence
  Synthetic oligonucleotide; CTA chr11 5203853 5203874 5203858 5203853 -
attatttttgtgttttagtaga

SEQ ID NO: 147497 - DNA, 22 bp, Artificial Sequence
  Synthetic oligonucleotide; TTA chr11 5203849 5203870 5203854 5203849 -
tttttgtgttttagtagagaca

SEQ ID NO: 147498 - DNA, 22 bp, Artificial Sequence
  Synthetic oligonucleotide; TTT chr11 5203846 5203867 5203851 5203846 -
ttgtgttttagtagagacaggg

SEQ ID NO: 147499 - DNA, 22 bp, Artificial Sequence
  Synthetic oligonucleotide; TTT chr11 5203845 5203866 5203850 5203845 -
tgtgttttagtagagacagggt

SEQ ID NO: 147500 - DNA, 22 bp, Artificial Sequence
  Synthetic oligonucleotide; TTT chr11 5203844 5203865 5203849 5203844 -
gtgttttagtagagacagggtt

SEQ ID NO: 147501 - DNA, 22 bp, Artificial Sequence
  Synthetic oligonucleotide; TTG chr11 5203843 5203864 5203848 5203843 -
tgttttagtagagacagggttt

SEQ ID NO: 147502 - DNA, 22 bp, Artificial Sequence
  Synthetic oligonucleotide; TTT chr11 5203838 5203859 5203843 5203838 -
tagtagagacagggtttcacca

SEQ ID NO: 147503 - DNA, 22 bp, Artificial Sequence
  Synthetic oligonucleotide; TTT chr11 5203837 5203858 5203842 5203837 -
agtagagacagggtttcaccat

SEQ ID NO: 147504 - DNA, 22 bp, Artificial Sequence
  Synthetic oligonucleotide; TTA chr11 5203836 5203857 5203841 5203836 -
gtagagacagggtttcaccatt

SEQ ID NO: 147505 - DNA, 22 bp, Artificial Sequence
  Synthetic oligonucleotide; TTT chr11 5203821 5203842 5203826 5203821 -
caccattttgcccaggttggtc

SEQ ID NO: 147506 - DNA, 22 bp, Artificial Sequence
  Synthetic oligonucleotide; TTC chr11 5203820 5203841 5203825 5203820 -
accattttgcccaggttggtct

SEQ ID NO: 147507 - DNA, 22 bp, Artificial Sequence
  Synthetic oligonucleotide; TTT chr11 5203813 5203834 5203818 5203813 -
tgcccaggttggtctccaactc

SEQ ID NO: 147508 - DNA, 22 bp, Artificial Sequence
  Synthetic oligonucleotide; TTT chr11 5203812 5203833 5203817 5203812 -
gcccaggttggtctccaactcc

SEQ ID NO: 147509 - DNA, 22 bp, Artificial Sequence
  Synthetic oligonucleotide; TTG chr11 5203811 5203832 5203816 5203811 -
cccaggttggtctccaactcct

SEQ ID NO: 147510 - DNA, 22 bp, Artificial Sequence
  Synthetic oligonucleotide; TTG chr11 5203802 5203823 5203807 5203802 -
gtctccaactcctgagctcagc

SEQ ID NO: 147511 - DNA, 22 bp, Artificial Sequence
  Synthetic oligonucleotide; CTC chr11 5203797 5203818 5203802 5203797 -
caactcctgagctcagccaatc

SEQ ID NO: 147512 - DNA, 22 bp, Artificial Sequence
  Synthetic oligonucleotide; CTC chr11 5203791 5203812 5203796 5203791 -
ctgagctcagccaatccacctg

SEQ ID NO: 147513 - DNA, 22 bp, Artificial Sequence
  Synthetic oligonucleotide; CTG chr11 5203788 5203809 5203793 5203788 -
agctcagccaatccacctgcct

SEQ ID NO: 147514 - DNA, 22 bp, Artificial Sequence
  Synthetic oligonucleotide; CTC chr11 5203783 5203804 5203788 5203783 -
agccaatccacctgcctcggcc

SEQ ID NO: 147515 - DNA, 22 bp, Artificial Sequence
  Synthetic oligonucleotide; CTG chr11 5203769 5203790 5203774 5203769 -
cctcggcctcccaaagtgctag

SEQ ID NO: 147516 - DNA, 22 bp, Artificial Sequence
  Synthetic oligonucleotide; CTC chr11 5203765 5203786 5203770 5203765 -
ggcctcccaaagtgctaggatt

SEQ ID NO: 147517 - DNA, 22 bp, Artificial Sequence
  Synthetic oligonucleotide; CTC chr11 5203759 5203780 5203764 5203759 -
ccaaagtgctaggattacaggc

SEQ ID NO: 147518 - DNA, 22 bp, Artificial Sequence
  Synthetic oligonucleotide; CTA chr11 5203748 5203769 5203753 5203748 -
ggattacaggcgtgagccacca

SEQ ID NO: 147519 - DNA, 22 bp, Artificial Sequence
  Synthetic oligonucleotide; TTA chr11 5203742 5203763 5203747 5203742 -
caggcgtgagccaccaagcctg

SEQ ID NO: 147520 - DNA, 22 bp, Artificial Sequence
  Synthetic oligonucleotide; CTG chr11 5203720 5203741 5203725 5203720 -
gctgaaagtagatacttttaac

SEQ ID NO: 147521 - DNA, 22 bp, Artificial Sequence
  Synthetic oligonucleotide; CTG chr11 5203716 5203737 5203721 5203716 -
aaagtagatacttttaacacat

SEQ ID NO: 147522 - DNA, 22 bp, Artificial Sequence
  Synthetic oligonucleotide; CTT chr11 5203703 5203724 5203708 5203703 -
ttaacacatacctacattcaca

SEQ ID NO: 147523 - DNA, 22 bp, Artificial Sequence
  Synthetic oligonucleotide; TTT chr11 5203702 5203723 5203707 5203702 -
taacacatacctacattcacag

SEQ ID NO: 147524 - DNA, 22 bp, Artificial Sequence
  Synthetic oligonucleotide; TTT chr11 5203701 5203722 5203706 5203701 -
aacacatacctacattcacaga

SEQ ID NO: 147525 - DNA, 22 bp, Artificial Sequence
  Synthetic oligonucleotide; TTA chr11 5203700 5203721 5203705 5203700 -
acacatacctacattcacagaa

SEQ ID NO: 147526 - DNA, 22 bp, Artificial Sequence
  Synthetic oligonucleotide; CTA chr11 5203689 5203710 5203694 5203689 -
cattcacagaatattaaatctt

SEQ ID NO: 147527 - DNA, 22 bp, Artificial Sequence
  Synthetic oligonucleotide; TTC chr11 5203684 5203705 5203689 5203684 -
acagaatattaaatcttttgtg

SEQ ID NO: 147528 - DNA, 22 bp, Artificial Sequence
  Synthetic oligonucleotide; TTA chr11 5203673 5203694 5203678 5203673 -
aatcttttgtgatcaatcccag

SEQ ID NO: 147529 - DNA, 22 bp, Artificial Sequence
  Synthetic oligonucleotide; CTT chr11 5203667 5203688 5203672 5203667 -
ttgtgatcaatcccagatcctt

SEQ ID NO: 147530 - DNA, 22 bp, Artificial Sequence
  Synthetic oligonucleotide; TTT chr11 5203666 5203687 5203671 5203666 -
tgtgatcaatcccagatccttg

SEQ ID NO: 147531 - DNA, 22 bp, Artificial Sequence
  Synthetic oligonucleotide; TTT chr11 5203665 5203686 5203670 5203665 -
gtgatcaatcccagatccttga

SEQ ID NO: 147532 - DNA, 22 bp, Artificial Sequence
  Synthetic oligonucleotide; TTG chr11 5203664 5203685 5203669 5203664 -
tgatcaatcccagatccttgac

SEQ ID NO: 147533 - DNA, 22 bp, Artificial Sequence
  Synthetic oligonucleotide; CTT chr11 5203645 5203666 5203650 5203645 -
gacgatatgtctgagtcaggct

SEQ ID NO: 147534 - DNA, 22 bp, Artificial Sequence
  Synthetic oligonucleotide; TTG chr11 5203644 5203665 5203649 5203644 -
acgatatgtctgagtcaggctg

SEQ ID NO: 147535 - DNA, 22 bp, Artificial Sequence
  Synthetic oligonucleotide; CTG chr11 5203632 5203653 5203637 5203632 -
agtcaggctggaaatgagagaa

SEQ ID NO: 147536 - DNA, 22 bp, Artificial Sequence
  Synthetic oligonucleotide; CTG chr11 5203622 5203643 5203627 5203622 -
gaaatgagagaaatcatgtttg

SEQ ID NO: 147537 - DNA, 22 bp, Artificial Sequence
  Synthetic oligonucleotide; TTT chr11 5203601 5203622 5203606 5203601 -
gaaattggagtgttgtattcaa

SEQ ID NO: 147538 - DNA, 22 bp, Artificial Sequence
  Synthetic oligonucleotide; TTG chr11 5203600 5203621 5203605 5203600 -
aaattggagtgttgtattcaag

SEQ ID NO: 147539 - DNA, 22 bp, Artificial Sequence
  Synthetic oligonucleotide; TTG chr11 5203594 5203615 5203599 5203594 -
gagtgttgtattcaaggtcagc

SEQ ID NO: 147540 - DNA, 22 bp, Artificial Sequence
  Synthetic oligonucleotide; TTG chr11 5203586 5203607 5203591 5203586 -
tattcaaggtcagcaagatccc

SEQ ID NO: 147541 - DNA, 22 bp, Artificial Sequence
  Synthetic oligonucleotide; TTC chr11 5203581 5203602 5203586 5203581 -
aaggtcagcaagatccctggag

SEQ ID NO: 147542 - DNA, 22 bp, Artificial Sequence
  Synthetic oligonucleotide; CTG chr11 5203562 5203583 5203567 5203562 -
gagcagcatctgttttataaac

SEQ ID NO: 147543 - DNA, 22 bp, Artificial Sequence
  Synthetic oligonucleotide; CTG chr11 5203550 5203571 5203555 5203550 -
ttttataaaccattcaaacttg

SEQ ID NO: 147544 - DNA, 22 bp, Artificial Sequence
  Synthetic oligonucleotide; TTT chr11 5203547 5203568 5203552 5203547 -
tataaaccattcaaacttggta

SEQ ID NO: 147545 - DNA, 22 bp, Artificial Sequence
  Synthetic oligonucleotide; TTT chr11 5203546 5203567 5203551 5203546 -
ataaaccattcaaacttggtat

SEQ ID NO: 147546 - DNA, 22 bp, Artificial Sequence
  Synthetic oligonucleotide; TTA chr11 5203545 5203566 5203550 5203545 -
taaaccattcaaacttggtata

SEQ ID NO: 147547 - DNA, 22 bp, Artificial Sequence
  Synthetic oligonucleotide; TTC chr11 5203535 5203556 5203540 5203535 -
aaacttggtatatgatgactca

SEQ ID NO: 147548 - DNA, 22 bp, Artificial Sequence
  Synthetic oligonucleotide; CTT chr11 5203529 5203550 5203534 5203529 -
ggtatatgatgactcaattggt

SEQ ID NO: 147549 - DNA, 22 bp, Artificial Sequence
  Synthetic oligonucleotide; TTG chr11 5203528 5203549 5203533 5203528 -
gtatatgatgactcaattggtg

SEQ ID NO: 147550 - DNA, 22 bp, Artificial Sequence
  Synthetic oligonucleotide; CTC chr11 5203514 5203535 5203519 5203514 -
aattggtggccaaaggtcagaa

SEQ ID NO: 147551 - DNA, 22 bp, Artificial Sequence
  Synthetic oligonucleotide; TTG chr11 5203509 5203530 5203514 5203509 -
gtggccaaaggtcagaaaagac

SEQ ID NO: 147552 - DNA, 22 bp, Artificial Sequence
  Synthetic oligonucleotide; CTA chr11 5203485 5203506 5203490 5203485 -
agtgtacacagatgattttaca

SEQ ID NO: 147553 - DNA, 22 bp, Artificial Sequence
  Synthetic oligonucleotide; TTT chr11 5203467 5203488 5203472 5203467 -
tacacacactttgataggagtg

SEQ ID NO: 147554 - DNA, 22 bp, Artificial Sequence
  Synthetic oligonucleotide; TTT chr11 5203466 5203487 5203471 5203466 -
acacacactttgataggagtgt

SEQ ID NO: 147555 - DNA, 22 bp, Artificial Sequence
  Synthetic oligonucleotide; TTA chr11 5203465 5203486 5203470 5203465 -
cacacactttgataggagtgtt

SEQ ID NO: 147556 - DNA, 22 bp, Artificial Sequence
  Synthetic oligonucleotide; CTT chr11 5203456 5203477 5203461 5203456 -
tgataggagtgttcacattcat

SEQ ID NO: 147557 - DNA, 22 bp, Artificial Sequence
  Synthetic oligonucleotide; TTT chr11 5203455 5203476 5203460 5203455 -
gataggagtgttcacattcata

SEQ ID NO: 147558 - DNA, 22 bp, Artificial Sequence
  Synthetic oligonucleotide; TTG chr11 5203454 5203475 5203459 5203454 -
ataggagtgttcacattcatat

SEQ ID NO: 147559 - DNA, 22 bp, Artificial Sequence
  Synthetic oligonucleotide; TTC chr11 5203442 5203463 5203447 5203442 -
acattcatattatctttatatc

SEQ ID NO: 147560 - DNA, 22 bp, Artificial Sequence
  Synthetic oligonucleotide; TTC chr11 5203436 5203457 5203441 5203436 -
atattatctttatatctctgtg

SEQ ID NO: 147561 - DNA, 22 bp, Artificial Sequence
  Synthetic oligonucleotide; TTA chr11 5203430 5203451 5203435 5203430 -
tctttatatctctgtgattgtc

SEQ ID NO: 147562 - DNA, 22 bp, Artificial Sequence
  Synthetic oligonucleotide; CTT chr11 5203426 5203447 5203431 5203426 -
tatatctctgtgattgtctagc

SEQ ID NO: 147563 - DNA, 22 bp, Artificial Sequence
  Synthetic oligonucleotide; TTT chr11 5203425 5203446 5203430 5203425 -
atatctctgtgattgtctagct

SEQ ID NO: 147564 - DNA, 22 bp, Artificial Sequence
  Synthetic oligonucleotide; TTA chr11 5203424 5203445 5203429 5203424 -
tatctctgtgattgtctagctc

SEQ ID NO: 147565 - DNA, 22 bp, Artificial Sequence
  Synthetic oligonucleotide; CTC chr11 5203418 5203439 5203423 5203418 -
tgtgattgtctagctcttattt

SEQ ID NO: 147566 - DNA, 22 bp, Artificial Sequence
  Synthetic oligonucleotide; CTG chr11 5203416 5203437 5203421 5203416 -
tgattgtctagctcttatttca

SEQ ID NO: 147567 - DNA, 22 bp, Artificial Sequence
  Synthetic oligonucleotide; TTG chr11 5203410 5203431 5203415 5203410 -
tctagctcttatttcatagaat

SEQ ID NO: 147568 - DNA, 22 bp, Artificial Sequence
  Synthetic oligonucleotide; CTA chr11 5203406 5203427 5203411 5203406 -
gctcttatttcatagaataatt

SEQ ID NO: 147569 - DNA, 22 bp, Artificial Sequence
  Synthetic oligonucleotide; CTC chr11 5203402 5203423 5203407 5203402 -
ttatttcatagaataattaatt

SEQ ID NO: 147570 - DNA, 22 bp, Artificial Sequence
  Synthetic oligonucleotide; CTT chr11 5203400 5203421 5203405 5203400 -
atttcatagaataattaattaa

SEQ ID NO: 147571 - DNA, 22 bp, Artificial Sequence
  Synthetic oligonucleotide; TTA chr11 5203399 5203420 5203404 5203399 -
tttcatagaataattaattaaa

SEQ ID NO: 147572 - DNA, 22 bp, Artificial Sequence
  Synthetic oligonucleotide; TTT chr11 5203396 5203417 5203401 5203396 -
catagaataattaattaaaaat

SEQ ID NO: 147573 - DNA, 22 bp, Artificial Sequence
  Synthetic oligonucleotide; TTC chr11 5203395 5203416 5203400 5203395 -
atagaataattaattaaaaatt

SEQ ID NO: 147574 - DNA, 22 bp, Artificial Sequence
  Synthetic oligonucleotide; TTA chr11 5203383 5203404 5203388 5203383 -
attaaaaattatttgataagtg

SEQ ID NO: 147575 - DNA, 22 bp, Artificial Sequence
  Synthetic oligonucleotide; TTA chr11 5203379 5203400 5203384 5203379 -
aaaattatttgataagtgccca

SEQ ID NO: 147576 - DNA, 22 bp, Artificial Sequence
  Synthetic oligonucleotide; TTA chr11 5203372 5203393 5203377 5203372 -
tttgataagtgcccattctatg

SEQ ID NO: 147577 - DNA, 22 bp, Artificial Sequence
  Synthetic oligonucleotide; TTT chr11 5203369 5203390 5203374 5203369 -
gataagtgcccattctatgcta

SEQ ID NO: 147578 - DNA, 22 bp, Artificial Sequence
  Synthetic oligonucleotide; TTG chr11 5203368 5203389 5203373 5203368 -
ataagtgcccattctatgctaa

SEQ ID NO: 147579 - DNA, 22 bp, Artificial Sequence
  Synthetic oligonucleotide; TTC chr11 5203354 5203375 5203359 5203354 -
tatgctaacccttatttttcat

SEQ ID NO: 147580 - DNA, 22 bp, Artificial Sequence
  Synthetic oligonucleotide; CTA chr11 5203352 5203373 5203357 5203352 -
tgctaacccttatttttcatat

SEQ ID NO: 147581 - DNA, 22 bp, Artificial Sequence
  Synthetic oligonucleotide; CTA chr11 5203347 5203368 5203352 5203347 -
acccttatttttcatattcttg

SEQ ID NO: 147582 - DNA, 22 bp, Artificial Sequence
  Synthetic oligonucleotide; CTT chr11 5203341 5203362 5203346 5203341 -
atttttcatattcttgagcaaa

SEQ ID NO: 147583 - DNA, 22 bp, Artificial Sequence
  Synthetic oligonucleotide; TTA chr11 5203340 5203361 5203345 5203340 -
tttttcatattcttgagcaaaa

SEQ ID NO: 147584 - DNA, 22 bp, Artificial Sequence
  Synthetic oligonucleotide; TTT chr11 5203337 5203358 5203342 5203337 -
ttcatattcttgagcaaaaaac

SEQ ID NO: 147585 - DNA, 22 bp, Artificial Sequence
  Synthetic oligonucleotide; TTT chr11 5203336 5203357 5203341 5203336 -
tcatattcttgagcaaaaaaca

SEQ ID NO: 147586 - DNA, 22 bp, Artificial Sequence
  Synthetic oligonucleotide; TTT chr11 5203335 5203356 5203340 5203335 -
catattcttgagcaaaaaacag

SEQ ID NO: 147587 - DNA, 22 bp, Artificial Sequence
  Synthetic oligonucleotide; TTC chr11 5203334 5203355 5203339 5203334 -
atattcttgagcaaaaaacaga

SEQ ID NO: 147588 - DNA, 22 bp, Artificial Sequence
  Synthetic oligonucleotide; TTC chr11 5203328 5203349 5203333 5203328 -
ttgagcaaaaaacagatatggt

SEQ ID NO: 147589 - DNA, 22 bp, Artificial Sequence
  Synthetic oligonucleotide; CTT chr11 5203326 5203347 5203331 5203326 -
gagcaaaaaacagatatggttc

SEQ ID NO: 147590 - DNA, 22 bp, Artificial Sequence
  Synthetic oligonucleotide; TTG chr11 5203325 5203346 5203330 5203325 -
agcaaaaaacagatatggttcc

SEQ ID NO: 147591 - DNA, 22 bp, Artificial Sequence
  Synthetic oligonucleotide; TTC chr11 5203304 5203325 5203309 5203304 -
ctaatcttctacagcctctaat

SEQ ID NO: 147592 - DNA, 22 bp, Artificial Sequence
  Synthetic oligonucleotide; CTA chr11 5203301 5203322 5203306 5203301 -
atcttctacagcctctaatgaa

SEQ ID NO: 147593 - DNA, 22 bp, Artificial Sequence
  Synthetic oligonucleotide; CTT chr11 5203296 5203317 5203301 5203296 -
ctacagcctctaatgaatctaa

SEQ ID NO: 147594 - DNA, 22 bp, Artificial Sequence
  Synthetic oligonucleotide; TTC chr11 5203295 5203316 5203300 5203295 -
tacagcctctaatgaatctaat

SEQ ID NO: 147595 - DNA, 22 bp, Artificial Sequence
  Synthetic oligonucleotide; CTA chr11 5203293 5203314 5203298 5203293 -
cagcctctaatgaatctaatgg

SEQ ID NO: 147596 - DNA, 22 bp, Artificial Sequence
  Synthetic oligonucleotide; CTC chr11 5203286 5203307 5203291 5203286 -
taatgaatctaatggaaattca

SEQ ID NO: 147597 - DNA, 22 bp, Artificial Sequence
  Synthetic oligonucleotide; CTA chr11 5203284 5203305 5203289 5203284 -
atgaatctaatggaaattcagt

SEQ ID NO: 147598 - DNA, 22 bp, Artificial Sequence
  Synthetic oligonucleotide; CTA chr11 5203275 5203296 5203280 5203275 -
atggaaattcagtgtataataa

SEQ ID NO: 147599 - DNA, 22 bp, Artificial Sequence
  Synthetic oligonucleotide; TTC chr11 5203265 5203286 5203270 5203265 -
agtgtataataagtggtataaa

SEQ ID NO: 147600 - DNA, 22 bp, Artificial Sequence
  Synthetic oligonucleotide; CTA chr11 5203234 5203255 5203239 5203234 -
gtatactgtgatgagagtaagt

SEQ ID NO: 147601 - DNA, 22 bp, Artificial Sequence
  Synthetic oligonucleotide; CTG chr11 5203226 5203247 5203231 5203226 -
tgatgagagtaagttagttaag

SEQ ID NO: 147602 - DNA, 22 bp, Artificial Sequence
  Synthetic oligonucleotide; TTA chr11 5203210 5203231 5203215 5203210 -
gttaagggggttgaagaaatga

SEQ ID NO: 147603 - DNA, 22 bp, Artificial Sequence
  Synthetic oligonucleotide; TTA chr11 5203206 5203227 5203211 5203206 -
agggggttgaagaaatgagata

SEQ ID NO: 147604 - DNA, 22 bp, Artificial Sequence
  Synthetic oligonucleotide; TTG chr11 5203197 5203218 5203202 5203197 -
aagaaatgagataatctaggtg

SEQ ID NO: 147605 - DNA, 22 bp, Artificial Sequence
  Synthetic oligonucleotide; CTA chr11 5203179 5203200 5203184 5203179 -
ggtggggagcagtattagaaaa

SEQ ID NO: 147606 - DNA, 22 bp, Artificial Sequence
  Synthetic oligonucleotide; TTA chr11 5203162 5203183 5203167 5203162 -
gaaaaatccccctgaggaagta

SEQ ID NO: 147607 - DNA, 22 bp, Artificial Sequence
  Synthetic oligonucleotide; CTG chr11 5203148 5203169 5203153 5203148 -
aggaagtaatcattttaactca

SEQ ID NO: 147608 - DNA, 22 bp, Artificial Sequence
  Synthetic oligonucleotide; TTT chr11 5203133 5203154 5203138 5203133 -
taactcaaaagttaatggtgaa

SEQ ID NO: 147609 - DNA, 22 bp, Artificial Sequence
  Synthetic oligonucleotide; TTT chr11 5203132 5203153 5203137 5203132 -
aactcaaaagttaatggtgaaa

SEQ ID NO: 147610 - DNA, 22 bp, Artificial Sequence
  Synthetic oligonucleotide; TTA chr11 5203131 5203152 5203136 5203131 -
actcaaaagttaatggtgaaag

SEQ ID NO: 147611 - DNA, 22 bp, Artificial Sequence
  Synthetic oligonucleotide; CTC chr11 5203127 5203148 5203132 5203127 -
aaaagttaatggtgaaaggaat

SEQ ID NO: 147612 - DNA, 22 bp, Artificial Sequence
  Synthetic oligonucleotide; TTA chr11 5203119 5203140 5203124 5203119 -
atggtgaaaggaattgctgtgc

SEQ ID NO: 147613 - DNA, 22 bp, Artificial Sequence
  Synthetic oligonucleotide; TTG chr11 5203103 5203124 5203108 5203103 -
ctgtgcaaatacttggggtaga

SEQ ID NO: 147614 - DNA, 22 bp, Artificial Sequence
  Synthetic oligonucleotide; CTG chr11 5203100 5203121 5203105 5203100 -
tgcaaatacttggggtagataa

SEQ ID NO: 147615 - DNA, 22 bp, Artificial Sequence
  Synthetic oligonucleotide; CTT chr11 5203089 5203110 5203094 5203089 -
ggggtagataattcggagcaca

SEQ ID NO: 147616 - DNA, 22 bp, Artificial Sequence
  Synthetic oligonucleotide; TTG chr11 5203088 5203109 5203093 5203088 -
gggtagataattcggagcacag

SEQ ID NO: 147617 - DNA, 22 bp, Artificial Sequence
  Synthetic oligonucleotide; TTC chr11 5203075 5203096 5203080 5203075 -
ggagcacagagaagaccatggg

SEQ ID NO: 147618 - DNA, 22 bp, Artificial Sequence
  Synthetic oligonucleotide; CTG chr11 5203042 5203063 5203047 5203042 -
agacatgcatgtacttagcttg

SEQ ID NO: 147619 - DNA, 22 bp, Artificial Sequence
  Synthetic oligonucleotide; CTT chr11 5203026 5203047 5203031 5203026 -
agcttgttttgaggaagataaa

SEQ ID NO: 147620 - DNA, 22 bp, Artificial Sequence
  Synthetic oligonucleotide; TTA chr11 5203025 5203046 5203030 5203025 -
gcttgttttgaggaagataaag

SEQ ID NO: 147621 - DNA, 22 bp, Artificial Sequence
  Synthetic oligonucleotide; CTT chr11 5203021 5203042 5203026 5203021 -
gttttgaggaagataaagatac

SEQ ID NO: 147622 - DNA, 22 bp, Artificial Sequence
  Synthetic oligonucleotide; TTG chr11 5203020 5203041 5203025 5203020 -
ttttgaggaagataaagatacc

SEQ ID NO: 147623 - DNA, 22 bp, Artificial Sequence
  Synthetic oligonucleotide; TTT chr11 5203017 5203038 5203022 5203017 -
tgaggaagataaagatacctaa

SEQ ID NO: 147624 - DNA, 22 bp, Artificial Sequence
  Synthetic oligonucleotide; TTT chr11 5203016 5203037 5203021 5203016 -
gaggaagataaagatacctaaa

SEQ ID NO: 147625 - DNA, 22 bp, Artificial Sequence
  Synthetic oligonucleotide; TTG chr11 5203015 5203036 5203020 5203015 -
aggaagataaagatacctaaat

SEQ ID NO: 147626 - DNA, 22 bp, Artificial Sequence
  Synthetic oligonucleotide; CTA chr11 5202996 5203017 5203001 5202996 -
aatattaaggagtgtaggcagt

SEQ ID NO: 147627 - DNA, 22 bp, Artificial Sequence
  Synthetic oligonucleotide; TTA chr11 5202989 5203010 5202994 5202989 -
aggagtgtaggcagtagtggtc

SEQ ID NO: 147628 - DNA, 22 bp, Artificial Sequence
  Synthetic oligonucleotide; CTA chr11 5202965 5202986 5202970 5202965 -
aagatgtaatagaagaggcagg

SEQ ID NO: 147629 - DNA, 22 bp, Artificial Sequence
  Synthetic oligonucleotide; TTA chr11 5202931 5202952 5202936 5202931 -
tacaaggctttttgactatgat

SEQ ID NO: 147630 - DNA, 22 bp, Artificial Sequence
  Synthetic oligonucleotide; CTT chr11 5202921 5202942 5202926 5202921 -
tttgactatgataaagaatttg

SEQ ID NO: 147631 - DNA, 22 bp, Artificial Sequence
  Synthetic oligonucleotide; TTT chr11 5202920 5202941 5202925 5202920 -
ttgactatgataaagaatttgt

SEQ ID NO: 147632 - DNA, 22 bp, Artificial Sequence
  Synthetic oligonucleotide; TTT chr11 5202919 5202940 5202924 5202919 -
tgactatgataaagaatttgta

SEQ ID NO: 147633 - DNA, 22 bp, Artificial Sequence
  Synthetic oligonucleotide; TTT chr11 5202918 5202939 5202923 5202918 -
gactatgataaagaatttgtat

SEQ ID NO: 147634 - DNA, 22 bp, Artificial Sequence
  Synthetic oligonucleotide; TTG chr11 5202917 5202938 5202922 5202917 -
actatgataaagaatttgtatt

SEQ ID NO: 147635 - DNA, 22 bp, Artificial Sequence
  Synthetic oligonucleotide; CTA chr11 5202913 5202934 5202918 5202913 -
tgataaagaatttgtattttac

SEQ ID NO: 147636 - DNA, 22 bp, Artificial Sequence
  Synthetic oligonucleotide; TTT chr11 5202900 5202921 5202905 5202900 -
gtattttacattacgagcaatg

SEQ ID NO: 147637 - DNA, 22 bp, Artificial Sequence
  Synthetic oligonucleotide; TTG chr11 5202899 5202920 5202904 5202899 -
tattttacattacgagcaatgg

SEQ ID NO: 147638 - DNA, 22 bp, Artificial Sequence
  Synthetic oligonucleotide; TTT chr11 5202894 5202915 5202899 5202894 -
tacattacgagcaatgggtaag

SEQ ID NO: 147639 - DNA, 22 bp, Artificial Sequence
  Synthetic oligonucleotide; TTT chr11 5202893 5202914 5202898 5202893 -
acattacgagcaatgggtaagt

SEQ ID NO: 147640 - DNA, 22 bp, Artificial Sequence
  Synthetic oligonucleotide; TTA chr11 5202892 5202913 5202897 5202892 -
cattacgagcaatgggtaagtg

SEQ ID NO: 147641 - DNA, 22 bp, Artificial Sequence
  Synthetic oligonucleotide; TTA chr11 5202887 5202908 5202892 5202887 -
cgagcaatgggtaagtgaccat

SEQ ID NO: 147642 - DNA, 22 bp, Artificial Sequence
  Synthetic oligonucleotide; TTT chr11 5202855 5202876 5202860 5202855 -
tttcaacaaaggtttgtgtgat

SEQ ID NO: 147643 - DNA, 22 bp, Artificial Sequence
  Synthetic oligonucleotide; TTT chr11 5202854 5202875 5202859 5202854 -
ttcaacaaaggtttgtgtgatt

SEQ ID NO: 147644 - DNA, 22 bp, Artificial Sequence
  Synthetic oligonucleotide; TTT chr11 5202853 5202874 5202858 5202853 -
tcaacaaaggtttgtgtgattt

SEQ ID NO: 147645 - DNA, 22 bp, Artificial Sequence
  Synthetic oligonucleotide; TTT chr11 5202852 5202873 5202857 5202852 -
caacaaaggtttgtgtgattta

SEQ ID NO: 147646 - DNA, 22 bp, Artificial Sequence
  Synthetic oligonucleotide; TTC chr11 5202851 5202872 5202856 5202851 -
aacaaaggtttgtgtgatttag

SEQ ID NO: 147647 - DNA, 22 bp, Artificial Sequence
  Synthetic oligonucleotide; TTT chr11 5202840 5202861 5202845 5202840 -
gtgtgatttagtagatgtttgt

SEQ ID NO: 147648 - DNA, 22 bp, Artificial Sequence
  Synthetic oligonucleotide; TTG chr11 5202839 5202860 5202844 5202839 -
tgtgatttagtagatgtttgta

SEQ ID NO: 147649 - DNA, 22 bp, Artificial Sequence
  Synthetic oligonucleotide; TTT chr11 5202831 5202852 5202836 5202831 -
agtagatgtttgtagaaaagca

SEQ ID NO: 147650 - DNA, 22 bp, Artificial Sequence
  Synthetic oligonucleotide; TTA chr11 5202830 5202851 5202835 5202830 -
gtagatgtttgtagaaaagcaa

SEQ ID NO: 147651 - DNA, 22 bp, Artificial Sequence
  Synthetic oligonucleotide; TTT chr11 5202820 5202841 5202825 5202820 -
gtagaaaagcaatttggtttcc

SEQ ID NO: 147652 - DNA, 22 bp, Artificial Sequence
  Synthetic oligonucleotide; TTG chr11 5202819 5202840 5202824 5202819 -
tagaaaagcaatttggtttccc

SEQ ID NO: 147653 - DNA, 22 bp, Artificial Sequence
  Synthetic oligonucleotide; TTT chr11 5202805 5202826 5202810 5202805 -
ggtttccctggagataatacat

SEQ ID NO: 147654 - DNA, 22 bp, Artificial Sequence
  Synthetic oligonucleotide; TTG chr11 5202804 5202825 5202809 5202804 -
gtttccctggagataatacatt

SEQ ID NO: 147655 - DNA, 22 bp, Artificial Sequence
  Synthetic oligonucleotide; TTT chr11 5202800 5202821 5202805 5202800 -
ccctggagataatacatttttt

SEQ ID NO: 147656 - DNA, 22 bp, Artificial Sequence
  Synthetic oligonucleotide; TTC chr11 5202799 5202820 5202804 5202799 -
cctggagataatacatttttta

SEQ ID NO: 147657 - DNA, 22 bp, Artificial Sequence
  Synthetic oligonucleotide; CTG chr11 5202795 5202816 5202800 5202795 -
gagataatacattttttagagg

SEQ ID NO: 147658 - DNA, 22 bp, Artificial Sequence
  Synthetic oligonucleotide; TTT chr11 5202781 5202802 5202786 5202781 -
tttagaggacaaacagataaat

SEQ ID NO: 147659 - DNA, 22 bp, Artificial Sequence
  Synthetic oligonucleotide; TTT chr11 5202780 5202801 5202785 5202780 -
ttagaggacaaacagataaatc

SEQ ID NO: 147660 - DNA, 22 bp, Artificial Sequence
  Synthetic oligonucleotide; TTT chr11 5202779 5202800 5202784 5202779 -
tagaggacaaacagataaatca

SEQ ID NO: 147661 - DNA, 22 bp, Artificial Sequence
  Synthetic oligonucleotide; TTT chr11 5202778 5202799 5202783 5202778 -
agaggacaaacagataaatcat

SEQ ID NO: 147662 - DNA, 22 bp, Artificial Sequence
  Synthetic oligonucleotide; TTA chr11 5202777 5202798 5202782 5202777 -
gaggacaaacagataaatcatg

SEQ ID NO: 147663 - DNA, 22 bp, Artificial Sequence
  Synthetic oligonucleotide; TTA chr11 5202749 5202770 5202754 5202749 -
gctagtaataatattaaattat

SEQ ID NO: 147664 - DNA, 22 bp, Artificial Sequence
  Synthetic oligonucleotide; CTA chr11 5202745 5202766 5202750 5202745 -
gtaataatattaaattattatt

SEQ ID NO: 147665 - DNA, 22 bp, Artificial Sequence
  Synthetic oligonucleotide; TTA chr11 5202733 5202754 5202738 5202733 -
aattattattaatttaataaat

SEQ ID NO: 147666 - DNA, 22 bp, Artificial Sequence
  Synthetic oligonucleotide; TTA chr11 5202728 5202749 5202733 5202728 -
ttattaatttaataaattatca

SEQ ID NO: 147667 - DNA, 22 bp, Artificial Sequence
  Synthetic oligonucleotide; TTA chr11 5202725 5202746 5202730 5202725 -
ttaatttaataaattatcatag

SEQ ID NO: 147668 - DNA, 22 bp, Artificial Sequence
  Synthetic oligonucleotide; TTA chr11 5202722 5202743 5202727 5202722 -
atttaataaattatcatagtag

SEQ ID NO: 147669 - DNA, 22 bp, Artificial Sequence
  Synthetic oligonucleotide; TTT chr11 5202718 5202739 5202723 5202718 -
aataaattatcatagtagccag

SEQ ID NO: 147670 - DNA, 22 bp, Artificial Sequence
  Synthetic oligonucleotide; TTA chr11 5202717 5202738 5202722 5202717 -
ataaattatcatagtagccagg

SEQ ID NO: 147671 - DNA, 22 bp, Artificial Sequence
  Synthetic oligonucleotide; TTA chr11 5202709 5202730 5202714 5202709 -
tcatagtagccagggaaacaat

SEQ ID NO: 147672 - DNA, 22 bp, Artificial Sequence
  Synthetic oligonucleotide; TTA chr11 5202680 5202701 5202685 5202680 -
taaaccaagacgggcaatgtgt

SEQ ID NO: 147673 - DNA, 22 bp, Artificial Sequence
  Synthetic oligonucleotide; CTA chr11 5202645 5202666 5202650 5202645 -
tctgggatgtgtttctggtaga

SEQ ID NO: 147674 - DNA, 22 bp, Artificial Sequence
  Synthetic oligonucleotide; CTG chr11 5202641 5202662 5202646 5202641 -
ggatgtgtttctggtagaaatg

SEQ ID NO: 147675 - DNA, 22 bp, Artificial Sequence
  Synthetic oligonucleotide; TTT chr11 5202631 5202652 5202636 5202631 -
ctggtagaaatggtagaaattg

SEQ ID NO: 147676 - DNA, 22 bp, Artificial Sequence
  Synthetic oligonucleotide; TTC chr11 5202630 5202651 5202635 5202630 -
tggtagaaatggtagaaattga

SEQ ID NO: 147677 - DNA, 22 bp, Artificial Sequence
  Synthetic oligonucleotide; CTG chr11 5202628 5202649 5202633 5202628 -
gtagaaatggtagaaattgatg

SEQ ID NO: 147678 - DNA, 22 bp, Artificial Sequence
  Synthetic oligonucleotide; TTG chr11 5202609 5202630 5202614 5202609 -
atgaaagatttgatggagagag

SEQ ID NO: 147679 - DNA, 22 bp, Artificial Sequence
  Synthetic oligonucleotide; TTT chr11 5202598 5202619 5202603 5202598 -
gatggagagaggaaagggaagg

SEQ ID NO: 147680 - DNA, 22 bp, Artificial Sequence
  Synthetic oligonucleotide; TTG chr11 5202597 5202618 5202602 5202597 -
atggagagaggaaagggaagga

SEQ ID NO: 147681 - DNA, 22 bp, Artificial Sequence
  Synthetic oligonucleotide; TTT chr11 5202555 5202576 5202560 5202555 -
taaaaatgactcaagacttgtc

SEQ ID NO: 147682 - DNA, 22 bp, Artificial Sequence
  Synthetic oligonucleotide; TTT chr11 5202554 5202575 5202559 5202554 -
aaaaatgactcaagacttgtct

SEQ ID NO: 147683 - DNA, 22 bp, Artificial Sequence
  Synthetic oligonucleotide; TTA chr11 5202553 5202574 5202558 5202553 -
aaaatgactcaagacttgtctt

SEQ ID NO: 147684 - DNA, 22 bp, Artificial Sequence
  Synthetic oligonucleotide; CTC chr11 5202543 5202564 5202548 5202543 -
aagacttgtcttatgcaattgt

SEQ ID NO: 147685 - DNA, 22 bp, Artificial Sequence
  Synthetic oligonucleotide; CTT chr11 5202536 5202557 5202541 5202536 -
gtcttatgcaattgtgttattg

SEQ ID NO: 147686 - DNA, 22 bp, Artificial Sequence
  Synthetic oligonucleotide; TTG chr11 5202535 5202556 5202540 5202535 -
tcttatgcaattgtgttattgg

SEQ ID NO: 147687 - DNA, 22 bp, Artificial Sequence
  Synthetic oligonucleotide; CTT chr11 5202531 5202552 5202536 5202531 -
atgcaattgtgttattggtgga

SEQ ID NO: 147688 - DNA, 22 bp, Artificial Sequence
  Synthetic oligonucleotide; TTA chr11 5202530 5202551 5202535 5202530 -
tgcaattgtgttattggtggag

SEQ ID NO: 147689 - DNA, 22 bp, Artificial Sequence
  Synthetic oligonucleotide; TTG chr11 5202522 5202543 5202527 5202522 -
tgttattggtggagtcacttta

SEQ ID NO: 147690 - DNA, 22 bp, Artificial Sequence
  Synthetic oligonucleotide; TTA chr11 5202517 5202538 5202522 5202517 -
ttggtggagtcactttataata

SEQ ID NO: 147691 - DNA, 22 bp, Artificial Sequence
  Synthetic oligonucleotide; TTG chr11 5202514 5202535 5202519 5202514 -
gtggagtcactttataatatta

SEQ ID NO: 147692 - DNA, 22 bp, Artificial Sequence
  Synthetic oligonucleotide; CTT chr11 5202502 5202523 5202507 5202502 -
tataatattaggagaaaaggga

SEQ ID NO: 147693 - DNA, 22 bp, Artificial Sequence
  Synthetic oligonucleotide; TTT chr11 5202501 5202522 5202506 5202501 -
ataatattaggagaaaagggac

SEQ ID NO: 147694 - DNA, 22 bp, Artificial Sequence
  Synthetic oligonucleotide; TTA chr11 5202500 5202521 5202505 5202500 -
taatattaggagaaaagggaca

SEQ ID NO: 147695 - DNA, 22 bp, Artificial Sequence
  Synthetic oligonucleotide; TTA chr11 5202492 5202513 5202497 5202492 -
ggagaaaagggacagaaaatag

SEQ ID NO: 147696 - DNA, 22 bp, Artificial Sequence
  Synthetic oligonucleotide; TTT chr11 5202466 5202487 5202471 5202466 -
tggggggaaaatcaagtacttt

SEQ ID NO: 147697 - DNA, 22 bp, Artificial Sequence
  Synthetic oligonucleotide; TTT chr11 5202465 5202486 5202470 5202465 -
ggggggaaaatcaagtacttta

SEQ ID NO: 147698 - DNA, 22 bp, Artificial Sequence
  Synthetic oligonucleotide; TTG chr11 5202464 5202485 5202469 5202464 -
gggggaaaatcaagtactttat

SEQ ID NO: 147699 - DNA, 22 bp, Artificial Sequence
  Synthetic oligonucleotide; CTT chr11 5202445 5202466 5202450 5202445 -
tattggcatcattcttatttta

SEQ ID NO: 147700 - DNA, 22 bp, Artificial Sequence
  Synthetic oligonucleotide; TTT chr11 5202444 5202465 5202449 5202444 -
attggcatcattcttattttaa

SEQ ID NO: 147701 - DNA, 22 bp, Artificial Sequence
  Synthetic oligonucleotide; TTA chr11 5202443 5202464 5202448 5202443 -
ttggcatcattcttattttaag

SEQ ID NO: 147702 - DNA, 22 bp, Artificial Sequence
  Synthetic oligonucleotide; TTG chr11 5202440 5202461 5202445 5202440 -
gcatcattcttattttaagatt

SEQ ID NO: 147703 - DNA, 22 bp, Artificial Sequence
  Synthetic oligonucleotide; TTC chr11 5202431 5202452 5202436 5202431 -
ttattttaagattaaacactca

SEQ ID NO: 147704 - DNA, 22 bp, Artificial Sequence
  Synthetic oligonucleotide; CTT chr11 5202429 5202450 5202434 5202429 -
attttaagattaaacactcaga

SEQ ID NO: 147705 - DNA, 22 bp, Artificial Sequence
  Synthetic oligonucleotide; TTA chr11 5202428 5202449 5202433 5202428 -
ttttaagattaaacactcagat

SEQ ID NO: 147706 - DNA, 22 bp, Artificial Sequence
  Synthetic oligonucleotide; TTT chr11 5202425 5202446 5202430 5202425 -
taagattaaacactcagatgaa

SEQ ID NO: 147707 - DNA, 22 bp, Artificial Sequence
  Synthetic oligonucleotide; TTT chr11 5202424 5202445 5202429 5202424 -
aagattaaacactcagatgaat

SEQ ID NO: 147708 - DNA, 22 bp, Artificial Sequence
  Synthetic oligonucleotide; TTA chr11 5202423 5202444 5202428 5202423 -
agattaaacactcagatgaata

SEQ ID NO: 147709 - DNA, 22 bp, Artificial Sequence
  Synthetic oligonucleotide; TTA chr11 5202417 5202438 5202422 5202417 -
aacactcagatgaatatattaa

SEQ ID NO: 147710 - DNA, 22 bp, Artificial Sequence
  Synthetic oligonucleotide; CTC chr11 5202410 5202431 5202415 5202410 -
agatgaatatattaaatagcca

SEQ ID NO: 147711 - DNA, 22 bp, Artificial Sequence
  Synthetic oligonucleotide; TTA chr11 5202396 5202417 5202401 5202396 -
aatagccagttgtattcatgaa

SEQ ID NO: 147712 - DNA, 22 bp, Artificial Sequence
  Synthetic oligonucleotide; TTG chr11 5202384 5202405 5202389 5202384 -
tattcatgaatttgagctctca

SEQ ID NO: 147713 - DNA, 22 bp, Artificial Sequence
  Synthetic oligonucleotide; TTC chr11 5202379 5202400 5202384 5202379 -
atgaatttgagctctcaggagt

SEQ ID NO: 147714 - DNA, 22 bp, Artificial Sequence
  Synthetic oligonucleotide; TTT chr11 5202371 5202392 5202376 5202371 -
gagctctcaggagtggtcagga

SEQ ID NO: 147715 - DNA, 22 bp, Artificial Sequence
  Synthetic oligonucleotide; TTG chr11 5202370 5202391 5202375 5202370 -
agctctcaggagtggtcaggaa

SEQ ID NO: 147716 - DNA, 22 bp, Artificial Sequence
  Synthetic oligonucleotide; CTC chr11 5202365 5202386 5202370 5202365 -
tcaggagtggtcaggaatcaga

SEQ ID NO: 147717 - DNA, 22 bp, Artificial Sequence
  Synthetic oligonucleotide; CTC chr11 5202363 5202384 5202368 5202363 -
aggagtggtcaggaatcagagg

SEQ ID NO: 147718 - DNA, 22 bp, Artificial Sequence
  Synthetic oligonucleotide; TTA chr11 5202330 5202351 5202335 5202330 -
gtttcaaataataagaaaaagt

SEQ ID NO: 147719 - DNA, 22 bp, Artificial Sequence
  Synthetic oligonucleotide; TTT chr11 5202326 5202347 5202331 5202326 -
caaataataagaaaaagttgac

SEQ ID NO: 147720 - DNA, 22 bp, Artificial Sequence
  Synthetic oligonucleotide; TTC chr11 5202325 5202346 5202330 5202325 -
aaataataagaaaaagttgaca

SEQ ID NO: 147721 - DNA, 22 bp, Artificial Sequence
  Synthetic oligonucleotide; TTG chr11 5202306 5202327 5202311 5202306 -
acatagtctgcacattaaggaa

SEQ ID NO: 147722 - DNA, 22 bp, Artificial Sequence
  Synthetic oligonucleotide; CTG chr11 5202296 5202317 5202301 5202296 -
cacattaaggaactgagaattt

SEQ ID NO: 147723 - DNA, 22 bp, Artificial Sequence
  Synthetic oligonucleotide; TTA chr11 5202289 5202310 5202294 5202289 -
aggaactgagaatttagtttgt

SEQ ID NO: 147724 - DNA, 22 bp, Artificial Sequence
  Synthetic oligonucleotide; CTG chr11 5202281 5202302 5202286 5202281 -
agaatttagtttgtaacagaga

SEQ ID NO: 147725 - DNA, 22 bp, Artificial Sequence
  Synthetic oligonucleotide; TTT chr11 5202274 5202295 5202279 5202274 -
agtttgtaacagagatattagt

SEQ ID NO: 147726 - DNA, 22 bp, Artificial Sequence
  Synthetic oligonucleotide; TTA chr11 5202273 5202294 5202278 5202273 -
gtttgtaacagagatattagtt

SEQ ID NO: 147727 - DNA, 22 bp, Artificial Sequence
  Synthetic oligonucleotide; TTT chr11 5202269 5202290 5202274 5202269 -
gtaacagagatattagttaaat

SEQ ID NO: 147728 - DNA, 22 bp, Artificial Sequence
  Synthetic oligonucleotide; TTG chr11 5202268 5202289 5202273 5202268 -
taacagagatattagttaaata

SEQ ID NO: 147729 - DNA, 22 bp, Artificial Sequence
  Synthetic oligonucleotide; TTA chr11 5202254 5202275 5202259 5202254 -
gttaaatatttagtttaaatat

SEQ ID NO: 147730 - DNA, 22 bp, Artificial Sequence
  Synthetic oligonucleotide; TTA chr11 5202250 5202271 5202255 5202250 -
aatatttagtttaaatattagt

SEQ ID NO: 147731 - DNA, 22 bp, Artificial Sequence
  Synthetic oligonucleotide; TTT chr11 5202243 5202264 5202248 5202243 -
agtttaaatattagttaaatat

SEQ ID NO: 147732 - DNA, 22 bp, Artificial Sequence
  Synthetic oligonucleotide; TTA chr11 5202242 5202263 5202247 5202242 -
gtttaaatattagttaaatatt

SEQ ID NO: 147733 - DNA, 22 bp, Artificial Sequence
  Synthetic oligonucleotide; TTT chr11 5202238 5202259 5202243 5202238 -
aaatattagttaaatatttagc

SEQ ID NO: 147734 - DNA, 22 bp, Artificial Sequence
  Synthetic oligonucleotide; TTA chr11 5202237 5202258 5202242 5202237 -
aatattagttaaatatttagct

SEQ ID NO: 147735 - DNA, 22 bp, Artificial Sequence
  Synthetic oligonucleotide; TTA chr11 5202230 5202251 5202235 5202230 -
gttaaatatttagctaataaat

SEQ ID NO: 147736 - DNA, 22 bp, Artificial Sequence
  Synthetic oligonucleotide; TTA chr11 5202226 5202247 5202231 5202226 -
aatatttagctaataaatacaa

SEQ ID NO: 147737 - DNA, 22 bp, Artificial Sequence
  Synthetic oligonucleotide; TTT chr11 5202219 5202240 5202224 5202219 -
agctaataaatacaaaattata

SEQ ID NO: 147738 - DNA, 22 bp, Artificial Sequence
  Synthetic oligonucleotide; TTA chr11 5202218 5202239 5202223 5202218 -
gctaataaatacaaaattataa

SEQ ID NO: 147739 - DNA, 22 bp, Artificial Sequence
  Synthetic oligonucleotide; CTA chr11 5202214 5202235 5202219 5202214 -
ataaatacaaaattataagttt

SEQ ID NO: 147740 - DNA, 22 bp, Artificial Sequence
  Synthetic oligonucleotide; TTA chr11 5202199 5202220 5202204 5202199 -
taagttttatttaaaattgaaa

SEQ ID NO: 147741 - DNA, 22 bp, Artificial Sequence
  Synthetic oligonucleotide; TTT chr11 5202192 5202213 5202197 5202192 -
tatttaaaattgaaacatgata

SEQ ID NO: 147742 - DNA, 22 bp, Artificial Sequence
  Synthetic oligonucleotide; TTT chr11 5202191 5202212 5202196 5202191 -
atttaaaattgaaacatgatac

SEQ ID NO: 147743 - DNA, 22 bp, Artificial Sequence
  Synthetic oligonucleotide; TTA chr11 5202190 5202211 5202195 5202190 -
tttaaaattgaaacatgatacc

SEQ ID NO: 147744 - DNA, 22 bp, Artificial Sequence
  Synthetic oligonucleotide; TTT chr11 5202187 5202208 5202192 5202187 -
aaaattgaaacatgataccaaa

SEQ ID NO: 147745 - DNA, 22 bp, Artificial Sequence
  Synthetic oligonucleotide; TTA chr11 5202186 5202207 5202191 5202186 -
aaattgaaacatgataccaaaa

SEQ ID NO: 147746 - DNA, 22 bp, Artificial Sequence
  Synthetic oligonucleotide; TTG chr11 5202180 5202201 5202185 5202180 -
aaacatgataccaaaataatag

SEQ ID NO: 147747 - DNA, 22 bp, Artificial Sequence
  Synthetic oligonucleotide; TTT chr11 5202142 5202163 5202147 5202142 -
gtcttaagaaacttcttgaaaa

SEQ ID NO: 147748 - DNA, 22 bp, Artificial Sequence
  Synthetic oligonucleotide; TTG chr11 5202141 5202162 5202146 5202141 -
tcttaagaaacttcttgaaaag

SEQ ID NO: 147749 - DNA, 22 bp, Artificial Sequence
  Synthetic oligonucleotide; CTT chr11 5202137 5202158 5202142 5202137 -
aagaaacttcttgaaaagtgat

SEQ ID NO: 147750 - DNA, 22 bp, Artificial Sequence
  Synthetic oligonucleotide; TTA chr11 5202136 5202157 5202141 5202136 -
agaaacttcttgaaaagtgatt

SEQ ID NO: 147751 - DNA, 22 bp, Artificial Sequence
  Synthetic oligonucleotide; CTT chr11 5202128 5202149 5202133 5202128 -
cttgaaaagtgattgttgagtt

SEQ ID NO: 147752 - DNA, 22 bp, Artificial Sequence
  Synthetic oligonucleotide; TTC chr11 5202127 5202148 5202132 5202127 -
ttgaaaagtgattgttgagttg

SEQ ID NO: 147753 - DNA, 22 bp, Artificial Sequence
  Synthetic oligonucleotide; CTT chr11 5202125 5202146 5202130 5202125 -
gaaaagtgattgttgagttgca

SEQ ID NO: 147754 - DNA, 22 bp, Artificial Sequence
  Synthetic oligonucleotide; TTG chr11 5202124 5202145 5202129 5202124 -
aaaagtgattgttgagttgcaa

SEQ ID NO: 147755 - DNA, 22 bp, Artificial Sequence
  Synthetic oligonucleotide; TTG chr11 5202113 5202134 5202118 5202113 -
ttgagttgcaagatcgttttaa

SEQ ID NO: 147756 - DNA, 22 bp, Artificial Sequence
  Synthetic oligonucleotide; TTG chr11 5202110 5202131 5202115 5202110 -
agttgcaagatcgttttaaaaa

SEQ ID NO: 147757 - DNA, 22 bp, Artificial Sequence
  Synthetic oligonucleotide; TTG chr11 5202105 5202126 5202110 5202105 -
caagatcgttttaaaaagggta

SEQ ID NO: 147758 - DNA, 22 bp, Artificial Sequence
  Synthetic oligonucleotide; TTT chr11 5202094 5202115 5202099 5202094 -
taaaaagggtaggaagaaattg

SEQ ID NO: 147759 - DNA, 22 bp, Artificial Sequence
  Synthetic oligonucleotide; TTT chr11 5202093 5202114 5202098 5202093 -
aaaaagggtaggaagaaattga

SEQ ID NO: 147760 - DNA, 22 bp, Artificial Sequence
  Synthetic oligonucleotide; TTA chr11 5202092 5202113 5202097 5202092 -
aaaagggtaggaagaaattgag

SEQ ID NO: 147761 - DNA, 22 bp, Artificial Sequence
  Synthetic oligonucleotide; TTG chr11 5202072 5202093 5202077 5202072 -
aggaaaagatgatgaataattt

SEQ ID NO: 147762 - DNA, 22 bp, Artificial Sequence
  Synthetic oligonucleotide; TTT chr11 5202050 5202071 5202055 5202050 -
aggcagatagaacatttcgaga

SEQ ID NO: 147763 - DNA, 22 bp, Artificial Sequence
  Synthetic oligonucleotide; TTA chr11 5202049 5202070 5202054 5202049 -
ggcagatagaacatttcgagaa

SEQ ID NO: 147764 - DNA, 22 bp, Artificial Sequence
  Synthetic oligonucleotide; TTT chr11 5202033 5202054 5202038 5202033 -
cgagaaaaattttacgaaagaa

SEQ ID NO: 147765 - DNA, 22 bp, Artificial Sequence
  Synthetic oligonucleotide; TTC chr11 5202032 5202053 5202037 5202032 -
gagaaaaattttacgaaagaag

SEQ ID NO: 147766 - DNA, 22 bp, Artificial Sequence
  Synthetic oligonucleotide; TTT chr11 5202021 5202042 5202026 5202021 -
tacgaaagaagagaaattcgat

SEQ ID NO: 147767 - DNA, 22 bp, Artificial Sequence
  Synthetic oligonucleotide; TTT chr11 5202020 5202041 5202025 5202020 -
acgaaagaagagaaattcgatt

SEQ ID NO: 147768 - DNA, 22 bp, Artificial Sequence
  Synthetic oligonucleotide; TTA chr11 5202019 5202040 5202024 5202019 -
cgaaagaagagaaattcgattt

SEQ ID NO: 147769 - DNA, 22 bp, Artificial Sequence
  Synthetic oligonucleotide; TTC chr11 5202002 5202023 5202007 5202002 -
gatttagagaaatgaaagaaga

SEQ ID NO: 147770 - DNA, 22 bp, Artificial Sequence
  Synthetic oligonucleotide; TTT chr11 5201997 5202018 5202002 5201997 -
agagaaatgaaagaagatacgt

SEQ ID NO: 147771 - DNA, 22 bp, Artificial Sequence
  Synthetic oligonucleotide; TTA chr11 5201996 5202017 5202001 5201996 -
gagaaatgaaagaagatacgta

SEQ ID NO: 147772 - DNA, 22 bp, Artificial Sequence
  Synthetic oligonucleotide; TTC chr11 5201971 5201992 5201976 5201971 -
aaaagactgaaaaatcctctgc

SEQ ID NO: 147773 - DNA, 22 bp, Artificial Sequence
  Synthetic oligonucleotide; CTG chr11 5201962 5201983 5201967 5201962 -
aaaaatcctctgcaagaaacga

SEQ ID NO: 147774 - DNA, 22 bp, Artificial Sequence
  Synthetic oligonucleotide; CTC chr11 5201952 5201973 5201957 5201952 -
tgcaagaaacgaagaaacttca

SEQ ID NO: 147775 - DNA, 22 bp, Artificial Sequence
  Synthetic oligonucleotide; CTG chr11 5201950 5201971 5201955 5201950 -
caagaaacgaagaaacttcaag

SEQ ID NO: 147776 - DNA, 22 bp, Artificial Sequence
  Synthetic oligonucleotide; CTT chr11 5201932 5201953 5201937 5201932 -
caagcattctatggagaaaaaa

SEQ ID NO: 147777 - DNA, 22 bp, Artificial Sequence
  Synthetic oligonucleotide; TTC chr11 5201931 5201952 5201936 5201931 -
aagcattctatggagaaaaaag

SEQ ID NO: 147778 - DNA, 22 bp, Artificial Sequence
  Synthetic oligonucleotide; TTC chr11 5201923 5201944 5201928 5201923 -
tatggagaaaaaagtattaaaa

SEQ ID NO: 147779 - DNA, 22 bp, Artificial Sequence
  Synthetic oligonucleotide; CTA chr11 5201921 5201942 5201926 5201921 -
tggagaaaaaagtattaaaaat

SEQ ID NO: 147780 - DNA, 22 bp, Artificial Sequence
  Synthetic oligonucleotide; TTA chr11 5201904 5201925 5201909 5201904 -
aaaatagtgagctaagttattc

SEQ ID NO: 147781 - DNA, 22 bp, Artificial Sequence
  Synthetic oligonucleotide; CTA chr11 5201890 5201911 5201895 5201890 -
agttattcaatgctgagaagga

SEQ ID NO: 147782 - DNA, 22 bp, Artificial Sequence
  Synthetic oligonucleotide; TTA chr11 5201885 5201906 5201890 5201885 -
ttcaatgctgagaaggagtcag

SEQ ID NO: 147783 - DNA, 22 bp, Artificial Sequence
  Synthetic oligonucleotide; TTC chr11 5201882 5201903 5201887 5201882 -
aatgctgagaaggagtcagggc

SEQ ID NO: 147784 - DNA, 22 bp, Artificial Sequence
  Synthetic oligonucleotide; CTG chr11 5201875 5201896 5201880 5201875 -
agaaggagtcagggcaagaaaa

SEQ ID NO: 147785 - DNA, 22 bp, Artificial Sequence
  Synthetic oligonucleotide; TTA chr11 5201843 5201864 5201848 5201843 -
gactgctagaagacgtcagtgt

SEQ ID NO: 147786 - DNA, 22 bp, Artificial Sequence
  Synthetic oligonucleotide; CTG chr11 5201838 5201859 5201843 5201838 -
ctagaagacgtcagtgtagtat

SEQ ID NO: 147787 - DNA, 22 bp, Artificial Sequence
  Synthetic oligonucleotide; CTA chr11 5201835 5201856 5201840 5201835 -
gaagacgtcagtgtagtataga

SEQ ID NO: 147788 - DNA, 22 bp, Artificial Sequence
  Synthetic oligonucleotide; TTG chr11 5201803 5201824 5201808 5201803 -
agaagaaagtctgtggaactgt

SEQ ID NO: 147789 - DNA, 22 bp, Artificial Sequence
  Synthetic oligonucleotide; CTG chr11 5201790 5201811 5201795 5201790 -
tggaactgtgttgtgaggctaa

SEQ ID NO: 147790 - DNA, 22 bp, Artificial Sequence
  Synthetic oligonucleotide; CTG chr11 5201782 5201803 5201787 5201782 -
tgttgtgaggctaataagacaa

SEQ ID NO: 147791 - DNA, 22 bp, Artificial Sequence
  Synthetic oligonucleotide; TTG chr11 5201777 5201798 5201782 5201777 -
tgaggctaataagacaaagctg

SEQ ID NO: 147792 - DNA, 22 bp, Artificial Sequence
  Synthetic oligonucleotide; CTA chr11 5201769 5201790 5201774 5201769 -
ataagacaaagctgaaaagtag

SEQ ID NO: 147793 - DNA, 22 bp, Artificial Sequence
  Synthetic oligonucleotide; CTG chr11 5201755 5201776 5201760 5201755 -
aaaagtaggacataaagggcag

SEQ ID NO: 147794 - DNA, 22 bp, Artificial Sequence
  Synthetic oligonucleotide; CTG chr11 5201723 5201744 5201728 5201723 -
aagttactttaacatctcgaag

SEQ ID NO: 147795 - DNA, 22 bp, Artificial Sequence
  Synthetic oligonucleotide; TTA chr11 5201717 5201738 5201722 5201717 -
ctttaacatctcgaagttactc

SEQ ID NO: 147796 - DNA, 22 bp, Artificial Sequence
  Synthetic oligonucleotide; CTT chr11 5201714 5201735 5201719 5201714 -
taacatctcgaagttactcaat

SEQ ID NO: 147797 - DNA, 22 bp, Artificial Sequence
  Synthetic oligonucleotide; TTT chr11 5201713 5201734 5201718 5201713 -
aacatctcgaagttactcaatc

SEQ ID NO: 147798 - DNA, 22 bp, Artificial Sequence
  Synthetic oligonucleotide; TTA chr11 5201712 5201733 5201717 5201712 -
acatctcgaagttactcaatca

SEQ ID NO: 147799 - DNA, 22 bp, Artificial Sequence
  Synthetic oligonucleotide; CTC chr11 5201705 5201726 5201710 5201705 -
gaagttactcaatcaaacatga

SEQ ID NO: 147800 - DNA, 22 bp, Artificial Sequence
  Synthetic oligonucleotide; TTA chr11 5201698 5201719 5201703 5201698 -
ctcaatcaaacatgaaagtatg

SEQ ID NO: 147801 - DNA, 22 bp, Artificial Sequence
  Synthetic oligonucleotide; CTC chr11 5201695 5201716 5201700 5201695 -
aatcaaacatgaaagtatggac

SEQ ID NO: 147802 - DNA, 22 bp, Artificial Sequence
  Synthetic oligonucleotide; CTT chr11 5201671 5201692 5201676 5201671 -
ttgaacatctgtttacattatt

SEQ ID NO: 147803 - DNA, 22 bp, Artificial Sequence
  Synthetic oligonucleotide; TTT chr11 5201670 5201691 5201675 5201670 -
tgaacatctgtttacattatta

SEQ ID NO: 147804 - DNA, 22 bp, Artificial Sequence
  Synthetic oligonucleotide; TTT chr11 5201669 5201690 5201674 5201669 -
gaacatctgtttacattattag

SEQ ID NO: 147805 - DNA, 22 bp, Artificial Sequence
  Synthetic oligonucleotide; TTG chr11 5201668 5201689 5201673 5201668 -
aacatctgtttacattattaga

SEQ ID NO: 147806 - DNA, 22 bp, Artificial Sequence
  Synthetic oligonucleotide; CTG chr11 5201660 5201681 5201665 5201660 -
tttacattattagagctttaaa

SEQ ID NO: 147807 - DNA, 22 bp, Artificial Sequence
  Synthetic oligonucleotide; TTT chr11 5201657 5201678 5201662 5201657 -
acattattagagctttaaaaaa

SEQ ID NO: 147808 - DNA, 22 bp, Artificial Sequence
  Synthetic oligonucleotide; TTA chr11 5201656 5201677 5201661 5201656 -
cattattagagctttaaaaaaa

SEQ ID NO: 147809 - DNA, 22 bp, Artificial Sequence
  Synthetic oligonucleotide; TTA chr11 5201651 5201672 5201656 5201651 -
ttagagctttaaaaaaacttat

SEQ ID NO: 147810 - DNA, 22 bp, Artificial Sequence
  Synthetic oligonucleotide; TTA chr11 5201648 5201669 5201653 5201648 -
gagctttaaaaaaacttatgat

SEQ ID NO: 147811 - DNA, 22 bp, Artificial Sequence
  Synthetic oligonucleotide; CTT chr11 5201642 5201663 5201647 5201642 -
taaaaaaacttatgatgattct

SEQ ID NO: 147812 - DNA, 22 bp, Artificial Sequence
  Synthetic oligonucleotide; TTT chr11 5201641 5201662 5201646 5201641 -
aaaaaaacttatgatgattctc

SEQ ID NO: 147813 - DNA, 22 bp, Artificial Sequence
  Synthetic oligonucleotide; TTA chr11 5201640 5201661 5201645 5201640 -
aaaaaacttatgatgattctca

SEQ ID NO: 147814 - DNA, 22 bp, Artificial Sequence
  Synthetic oligonucleotide; CTT chr11 5201631 5201652 5201636 5201631 -
atgatgattctcaggtctggaa

SEQ ID NO: 147815 - DNA, 22 bp, Artificial Sequence
  Synthetic oligonucleotide; TTA chr11 5201630 5201651 5201635 5201630 -
tgatgattctcaggtctggaac

SEQ ID NO: 147816 - DNA, 22 bp, Artificial Sequence
  Synthetic oligonucleotide; TTC chr11 5201621 5201642 5201626 5201621 -
tcaggtctggaacttaaagcag

SEQ ID NO: 147817 - DNA, 22 bp, Artificial Sequence
  Synthetic oligonucleotide; CTC chr11 5201619 5201640 5201624 5201619 -
aggtctggaacttaaagcaggc

SEQ ID NO: 147818 - DNA, 22 bp, Artificial Sequence
  Synthetic oligonucleotide; CTG chr11 5201612 5201633 5201617 5201612 -
gaacttaaagcaggcaaacaat

SEQ ID NO: 147819 - DNA, 22 bp, Artificial Sequence
  Synthetic oligonucleotide; CTT chr11 5201606 5201627 5201611 5201606 -
aaagcaggcaaacaatgtaaag

SEQ ID NO: 147820 - DNA, 22 bp, Artificial Sequence
  Synthetic oligonucleotide; TTA chr11 5201605 5201626 5201610 5201605 -
aagcaggcaaacaatgtaaaga

SEQ ID NO: 147821 - DNA, 22 bp, Artificial Sequence
  Synthetic oligonucleotide; TTG chr11 5201571 5201592 5201576 5201571 -
attctgctaccatgaggctttt

SEQ ID NO: 147822 - DNA, 22 bp, Artificial Sequence
  Synthetic oligonucleotide; TTC chr11 5201567 5201588 5201572 5201567 -
tgctaccatgaggcttttgaaa

SEQ ID NO: 147823 - DNA, 22 bp, Artificial Sequence
  Synthetic oligonucleotide; CTG chr11 5201565 5201586 5201570 5201565 -
ctaccatgaggcttttgaaatt

SEQ ID NO: 147824 - DNA, 22 bp, Artificial Sequence
  Synthetic oligonucleotide; CTA chr11 5201562 5201583 5201567 5201562 -
ccatgaggcttttgaaattata

SEQ ID NO: 147825 - DNA, 22 bp, Artificial Sequence
  Synthetic oligonucleotide; CTT chr11 5201551 5201572 5201556 5201551 -
ttgaaattataagcttgcttgt

SEQ ID NO: 147826 - DNA, 22 bp, Artificial Sequence
  Synthetic oligonucleotide; TTT chr11 5201550 5201571 5201555 5201550 -
tgaaattataagcttgcttgtt

SEQ ID NO: 147827 - DNA, 22 bp, Artificial Sequence
  Synthetic oligonucleotide; TTT chr11 5201549 5201570 5201554 5201549 -
gaaattataagcttgcttgttt

SEQ ID NO: 147828 - DNA, 22 bp, Artificial Sequence
  Synthetic oligonucleotide; TTG chr11 5201548 5201569 5201553 5201548 -
aaattataagcttgcttgtttg

SEQ ID NO: 147829 - DNA, 22 bp, Artificial Sequence
  Synthetic oligonucleotide; TTA chr11 5201542 5201563 5201547 5201542 -
taagcttgcttgtttgagcctg

SEQ ID NO: 147830 - DNA, 22 bp, Artificial Sequence
  Synthetic oligonucleotide; CTT chr11 5201535 5201556 5201540 5201535 -
gcttgtttgagcctggctttgt

SEQ ID NO: 147831 - DNA, 22 bp, Artificial Sequence
  Synthetic oligonucleotide; TTG chr11 5201534 5201555 5201539 5201534 -
cttgtttgagcctggctttgtg

SEQ ID NO: 147832 - DNA, 22 bp, Artificial Sequence
  Synthetic oligonucleotide; CTT chr11 5201531 5201552 5201536 5201531 -
gtttgagcctggctttgtgatc

SEQ ID NO: 147833 - DNA, 22 bp, Artificial Sequence
  Synthetic oligonucleotide; TTG chr11 5201530 5201551 5201535 5201530 -
tttgagcctggctttgtgatct

SEQ ID NO: 147834 - DNA, 22 bp, Artificial Sequence
  Synthetic oligonucleotide; TTT chr11 5201527 5201548 5201532 5201527 -
gagcctggctttgtgatctgta

SEQ ID NO: 147835 - DNA, 22 bp, Artificial Sequence
  Synthetic oligonucleotide; TTG chr11 5201526 5201547 5201531 5201526 -
agcctggctttgtgatctgtag

SEQ ID NO: 147836 - DNA, 22 bp, Artificial Sequence
  Synthetic oligonucleotide; CTG chr11 5201520 5201541 5201525 5201520 -
gctttgtgatctgtagaactgc

SEQ ID NO: 147837 - DNA, 22 bp, Artificial Sequence
  Synthetic oligonucleotide; CTT chr11 5201516 5201537 5201521 5201516 -
tgtgatctgtagaactgcaggt

SEQ ID NO: 147838 - DNA, 22 bp, Artificial Sequence
  Synthetic oligonucleotide; TTT chr11 5201515 5201536 5201520 5201515 -
gtgatctgtagaactgcaggtt

SEQ ID NO: 147839 - DNA, 22 bp, Artificial Sequence
  Synthetic oligonucleotide; TTG chr11 5201514 5201535 5201519 5201514 -
tgatctgtagaactgcaggttc

SEQ ID NO: 147840 - DNA, 22 bp, Artificial Sequence
  Synthetic oligonucleotide; CTG chr11 5201507 5201528 5201512 5201507 -
tagaactgcaggttctaagaaa

SEQ ID NO: 147841 - DNA, 22 bp, Artificial Sequence
  Synthetic oligonucleotide; CTG chr11 5201499 5201520 5201504 5201499 -
caggttctaagaaagaaaacac

SEQ ID NO: 147842 - DNA, 22 bp, Artificial Sequence
  Synthetic oligonucleotide; TTC chr11 5201492 5201513 5201497 5201492 -
taagaaagaaaacacaattggc

SEQ ID NO: 147843 - DNA, 22 bp, Artificial Sequence
  Synthetic oligonucleotide; CTA chr11 5201490 5201511 5201495 5201490 -
agaaagaaaacacaattggcca

SEQ ID NO: 147844 - DNA, 22 bp, Artificial Sequence
  Synthetic oligonucleotide; TTG chr11 5201472 5201493 5201477 5201472 -
gccaatacattgaataaatgta

SEQ ID NO: 147845 - DNA, 22 bp, Artificial Sequence
  Synthetic oligonucleotide; TTG chr11 5201460 5201481 5201465 5201460 -
aataaatgtatattgaataaat

SEQ ID NO: 147846 - DNA, 22 bp, Artificial Sequence
  Synthetic oligonucleotide; TTG chr11 5201445 5201466 5201450 5201445 -
aataaatagttaatcagctcat

SEQ ID NO: 147847 - DNA, 22 bp, Artificial Sequence
  Synthetic oligonucleotide; TTA chr11 5201433 5201454 5201438 5201433 -
atcagctcattaactgaataaa

SEQ ID NO: 147848 - DNA, 22 bp, Artificial Sequence
  Synthetic oligonucleotide; CTC chr11 5201425 5201446 5201430 5201425 -
attaactgaataaataaaggaa

SEQ ID NO: 147849 - DNA, 22 bp, Artificial Sequence
  Synthetic oligonucleotide; TTA chr11 5201421 5201442 5201426 5201421 -
actgaataaataaaggaatggg

SEQ ID NO: 147850 - DNA, 22 bp, Artificial Sequence
  Synthetic oligonucleotide; CTG chr11 5201417 5201438 5201422 5201417 -
aataaataaaggaatgggaagc

SEQ ID NO: 147851 - DNA, 22 bp, Artificial Sequence
  Synthetic oligonucleotide; CTG chr11 5201391 5201412 5201396 5201391 -
agctgctatcaaaggctcagtg

SEQ ID NO: 147852 - DNA, 22 bp, Artificial Sequence
  Synthetic oligonucleotide; CTG chr11 5201386 5201407 5201391 5201386 -
ctatcaaaggctcagtgtcttc

SEQ ID NO: 147853 - DNA, 22 bp, Artificial Sequence
  Synthetic oligonucleotide; CTA chr11 5201383 5201404 5201388 5201383 -
tcaaaggctcagtgtcttcaat

SEQ ID NO: 147854 - DNA, 22 bp, Artificial Sequence
  Synthetic oligonucleotide; CTC chr11 5201373 5201394 5201378 5201373 -
agtgtcttcaatctaattctct

SEQ ID NO: 147855 - DNA, 22 bp, Artificial Sequence
  Synthetic oligonucleotide; CTT chr11 5201365 5201386 5201370 5201365 -
caatctaattctctacatcaca

SEQ ID NO: 147856 - DNA, 22 bp, Artificial Sequence
  Synthetic oligonucleotide; TTC chr11 5201364 5201385 5201369 5201364 -
aatctaattctctacatcacaa

SEQ ID NO: 147857 - DNA, 22 bp, Artificial Sequence
  Synthetic oligonucleotide; CTA chr11 5201358 5201379 5201363 5201358 -
attctctacatcacaaaggcac

SEQ ID NO: 147858 - DNA, 22 bp, Artificial Sequence
  Synthetic oligonucleotide; TTC chr11 5201354 5201375 5201359 5201354 -
tctacatcacaaaggcacaaat

SEQ ID NO: 147859 - DNA, 22 bp, Artificial Sequence
  Synthetic oligonucleotide; CTC chr11 5201352 5201373 5201357 5201352 -
tacatcacaaaggcacaaatga

SEQ ID NO: 147860 - DNA, 22 bp, Artificial Sequence
  Synthetic oligonucleotide; CTA chr11 5201350 5201371 5201355 5201350 -
catcacaaaggcacaaatgagt

SEQ ID NO: 147861 - DNA, 22 bp, Artificial Sequence
  Synthetic oligonucleotide; TTG chr11 5201326 5201347 5201331 5201326 -
aacatctcaagaggccagagct

SEQ ID NO: 147862 - DNA, 22 bp, Artificial Sequence
  Synthetic oligonucleotide; CTC chr11 5201318 5201339 5201323 5201318 -
aagaggccagagctccagtgag

SEQ ID NO: 147863 - DNA, 22 bp, Artificial Sequence
  Synthetic oligonucleotide; CTC chr11 5201303 5201324 5201308 5201303 -
cagtgagaaatcatttacccaa

SEQ ID NO: 147864 - DNA, 22 bp, Artificial Sequence
  Synthetic oligonucleotide; TTT chr11 5201287 5201308 5201292 5201287 -
acccaaggtctcatgcataaat

SEQ ID NO: 147865 - DNA, 22 bp, Artificial Sequence
  Synthetic oligonucleotide; TTA chr11 5201286 5201307 5201291 5201286 -
cccaaggtctcatgcataaata

SEQ ID NO: 147866 - DNA, 22 bp, Artificial Sequence
  Synthetic oligonucleotide; CTC chr11 5201275 5201296 5201280 5201275 -
atgcataaatattcctgtctgc

SEQ ID NO: 147867 - DNA, 22 bp, Artificial Sequence
  Synthetic oligonucleotide; TTC chr11 5201261 5201282 5201266 5201261 -
ctgtctgcttatcaccaatgaa

SEQ ID NO: 147868 - DNA, 22 bp, Artificial Sequence
  Synthetic oligonucleotide; CTG chr11 5201258 5201279 5201263 5201258 -
tctgcttatcaccaatgaagaa

SEQ ID NO: 147869 - DNA, 22 bp, Artificial Sequence
  Synthetic oligonucleotide; CTG chr11 5201254 5201275 5201259 5201254 -
cttatcaccaatgaagaaaaag

SEQ ID NO: 147870 - DNA, 22 bp, Artificial Sequence
  Synthetic oligonucleotide; CTT chr11 5201251 5201272 5201256 5201251 -
atcaccaatgaagaaaaagtaa

SEQ ID NO: 147871 - DNA, 22 bp, Artificial Sequence
  Synthetic oligonucleotide; TTA chr11 5201250 5201271 5201255 5201250 -
tcaccaatgaagaaaaagtaat

SEQ ID NO: 147872 - DNA, 22 bp, Artificial Sequence
  Synthetic oligonucleotide; TTG chr11 5201226 5201247 5201231 5201226 -
ctggctacgtcatctggagggg

SEQ ID NO: 147873 - DNA, 22 bp, Artificial Sequence
  Synthetic oligonucleotide; CTG chr11 5201223 5201244 5201228 5201223 -
gctacgtcatctggagggggag

SEQ ID NO: 147874 - DNA, 22 bp, Artificial Sequence
  Synthetic oligonucleotide; CTA chr11 5201219 5201240 5201224 5201219 -
cgtcatctggagggggagaaaa

SEQ ID NO: 147875 - DNA, 22 bp, Artificial Sequence
  Synthetic oligonucleotide; CTG chr11 5201210 5201231 5201215 5201210 -
gagggggagaaaacaggagtat

SEQ ID NO: 147876 - DNA, 22 bp, Artificial Sequence
  Synthetic oligonucleotide; CTT chr11 5201185 5201206 5201190 5201185 -
cattaaatagtatttggagaaa

SEQ ID NO: 147877 - DNA, 22 bp, Artificial Sequence
  Synthetic oligonucleotide; TTC chr11 5201184 5201205 5201189 5201184 -
attaaatagtatttggagaaaa

SEQ ID NO: 147878 - DNA, 22 bp, Artificial Sequence
  Synthetic oligonucleotide; TTA chr11 5201180 5201201 5201185 5201180 -
aatagtatttggagaaaaaata

SEQ ID NO: 147879 - DNA, 22 bp, Artificial Sequence
  Synthetic oligonucleotide; TTT chr11 5201170 5201191 5201175 5201170 -
ggagaaaaaatatacttggaga

SEQ ID NO: 147880 - DNA, 22 bp, Artificial Sequence
  Synthetic oligonucleotide; TTG chr11 5201169 5201190 5201174 5201169 -
gagaaaaaatatacttggagac

SEQ ID NO: 147881 - DNA, 22 bp, Artificial Sequence
  Synthetic oligonucleotide; CTT chr11 5201153 5201174 5201158 5201153 -
ggagacggcacaaaatggaaaa

SEQ ID NO: 147882 - DNA, 22 bp, Artificial Sequence
  Synthetic oligonucleotide; TTG chr11 5201152 5201173 5201157 5201152 -
gagacggcacaaaatggaaaat

SEQ ID NO: 147883 - DNA, 22 bp, Artificial Sequence
  Synthetic oligonucleotide; CTA chr11 5201114 5201135 5201119 5201114 -
tttaatagacttatgatattta

SEQ ID NO: 147884 - DNA, 22 bp, Artificial Sequence
  Synthetic oligonucleotide; TTT chr11 5201111 5201132 5201116 5201111 -
aatagacttatgatatttaaag

SEQ ID NO: 147885 - DNA, 22 bp, Artificial Sequence
  Synthetic oligonucleotide; TTA chr11 5201110 5201131 5201115 5201110 -
atagacttatgatatttaaagc

SEQ ID NO: 147886 - DNA, 22 bp, Artificial Sequence
  Synthetic oligonucleotide; CTT chr11 5201102 5201123 5201107 5201102 -
atgatatttaaagcccaaagat

SEQ ID NO: 147887 - DNA, 22 bp, Artificial Sequence
  Synthetic oligonucleotide; TTA chr11 5201101 5201122 5201106 5201101 -
tgatatttaaagcccaaagatt

SEQ ID NO: 147888 - DNA, 22 bp, Artificial Sequence
  Synthetic oligonucleotide; TTT chr11 5201093 5201114 5201098 5201093 -
aaagcccaaagattactcttca

SEQ ID NO: 147889 - DNA, 22 bp, Artificial Sequence
  Synthetic oligonucleotide; TTA chr11 5201092 5201113 5201097 5201092 -
aagcccaaagattactcttcac

SEQ ID NO: 147890 - DNA, 22 bp, Artificial Sequence
  Synthetic oligonucleotide; TTA chr11 5201078 5201099 5201083 5201078 -
ctcttcacttcgaatgtttaat

SEQ ID NO: 147891 - DNA, 22 bp, Artificial Sequence
  Synthetic oligonucleotide; CTC chr11 5201075 5201096 5201080 5201075 -
ttcacttcgaatgtttaatgaa

SEQ ID NO: 147892 - DNA, 22 bp, Artificial Sequence
  Synthetic oligonucleotide; CTT chr11 5201073 5201094 5201078 5201073 -
cacttcgaatgtttaatgaatt

SEQ ID NO: 147893 - DNA, 22 bp, Artificial Sequence
  Synthetic oligonucleotide; TTC chr11 5201072 5201093 5201077 5201072 -
acttcgaatgtttaatgaattg

SEQ ID NO: 147894 - DNA, 22 bp, Artificial Sequence
  Synthetic oligonucleotide; CTT chr11 5201068 5201089 5201073 5201068 -
cgaatgtttaatgaattggaga

SEQ ID NO: 147895 - DNA, 22 bp, Artificial Sequence
  Synthetic oligonucleotide; TTC chr11 5201067 5201088 5201072 5201067 -
gaatgtttaatgaattggagag

SEQ ID NO: 147896 - DNA, 22 bp, Artificial Sequence
  Synthetic oligonucleotide; TTT chr11 5201059 5201080 5201064 5201059 -
aatgaattggagagaagaaaat

SEQ ID NO: 147897 - DNA, 22 bp, Artificial Sequence
  Synthetic oligonucleotide; TTA chr11 5201058 5201079 5201063 5201058 -
atgaattggagagaagaaaata

SEQ ID NO: 147898 - DNA, 22 bp, Artificial Sequence
  Synthetic oligonucleotide; TTG chr11 5201050 5201071 5201055 5201050 -
gagagaagaaaataatttttca

SEQ ID NO: 147899 - DNA, 22 bp, Artificial Sequence
  Synthetic oligonucleotide; TTT chr11 5201032 5201053 5201037 5201032 -
ttcaagaacctcggctctttac

SEQ ID NO: 147900 - DNA, 22 bp, Artificial Sequence
  Synthetic oligonucleotide; TTT chr11 5201031 5201052 5201036 5201031 -
tcaagaacctcggctctttact

SEQ ID NO: 147901 - DNA, 22 bp, Artificial Sequence
  Synthetic oligonucleotide; TTT chr11 5201030 5201051 5201035 5201030 -
caagaacctcggctctttactg

SEQ ID NO: 147902 - DNA, 22 bp, Artificial Sequence
  Synthetic oligonucleotide; TTC chr11 5201029 5201050 5201034 5201029 -
aagaacctcggctctttactgg

SEQ ID NO: 147903 - DNA, 22 bp, Artificial Sequence
  Synthetic oligonucleotide; CTC chr11 5201020 5201041 5201025 5201020 -
ggctctttactggtataaaatt

SEQ ID NO: 147904 - DNA, 22 bp, Artificial Sequence
  Synthetic oligonucleotide; CTC chr11 5201015 5201036 5201020 5201015 -
tttactggtataaaatttttac

SEQ ID NO: 147905 - DNA, 22 bp, Artificial Sequence
  Synthetic oligonucleotide; CTT chr11 5201013 5201034 5201018 5201013 -
tactggtataaaatttttacca

SEQ ID NO: 147906 - DNA, 22 bp, Artificial Sequence
  Synthetic oligonucleotide; TTT chr11 5201012 5201033 5201017 5201012 -
actggtataaaatttttaccac

SEQ ID NO: 147907 - DNA, 22 bp, Artificial Sequence
  Synthetic oligonucleotide; TTA chr11 5201011 5201032 5201016 5201011 -
ctggtataaaatttttaccact

SEQ ID NO: 147908 - DNA, 22 bp, Artificial Sequence
  Synthetic oligonucleotide; CTG chr11 5201008 5201029 5201013 5201008 -
gtataaaatttttaccactatc

SEQ ID NO: 147909 - DNA, 22 bp, Artificial Sequence
  Synthetic oligonucleotide; TTT chr11 5200997 5201018 5201002 5200997 -
ttaccactatccttgggaaaat

SEQ ID NO: 147910 - DNA, 22 bp, Artificial Sequence
  Synthetic oligonucleotide; TTT chr11 5200996 5201017 5201001 5200996 -
taccactatccttgggaaaatg

SEQ ID NO: 147911 - DNA, 22 bp, Artificial Sequence
  Synthetic oligonucleotide; TTT chr11 5200995 5201016 5201000 5200995 -
accactatccttgggaaaatgt

SEQ ID NO: 147912 - DNA, 22 bp, Artificial Sequence
  Synthetic oligonucleotide; TTA chr11 5200994 5201015 5200999 5200994 -
ccactatccttgggaaaatgtc

SEQ ID NO: 147913 - DNA, 22 bp, Artificial Sequence
  Synthetic oligonucleotide; CTA chr11 5200988 5201009 5200993 5200988 -
tccttgggaaaatgtctaagca

SEQ ID NO: 147914 - DNA, 22 bp, Artificial Sequence
  Synthetic oligonucleotide; CTT chr11 5200983 5201004 5200988 5200983 -
gggaaaatgtctaagcaacgta

SEQ ID NO: 147915 - DNA, 22 bp, Artificial Sequence
  Synthetic oligonucleotide; TTG chr11 5200982 5201003 5200987 5200982 -
ggaaaatgtctaagcaacgtat

SEQ ID NO: 147916 - DNA, 22 bp, Artificial Sequence
  Synthetic oligonucleotide; CTA chr11 5200970 5200991 5200975 5200970 -
agcaacgtatttttttaaaact

SEQ ID NO: 147917 - DNA, 22 bp, Artificial Sequence
  Synthetic oligonucleotide; TTT chr11 5200958 5200979 5200963 5200958 -
ttttaaaactagccttctcctt

SEQ ID NO: 147918 - DNA, 22 bp, Artificial Sequence
  Synthetic oligonucleotide; TTT chr11 5200957 5200978 5200962 5200957 -
tttaaaactagccttctccttt

SEQ ID NO: 147919 - DNA, 22 bp, Artificial Sequence
  Synthetic oligonucleotide; TTT chr11 5200956 5200977 5200961 5200956 -
ttaaaactagccttctcctttt

SEQ ID NO: 147920 - DNA, 22 bp, Artificial Sequence
  Synthetic oligonucleotide; TTT chr11 5200955 5200976 5200960 5200955 -
taaaactagccttctcctttta

SEQ ID NO: 147921 - DNA, 22 bp, Artificial Sequence
  Synthetic oligonucleotide; TTT chr11 5200954 5200975 5200959 5200954 -
aaaactagccttctccttttac

SEQ ID NO: 147922 - DNA, 22 bp, Artificial Sequence
  Synthetic oligonucleotide; TTA chr11 5200953 5200974 5200958 5200953 -
aaactagccttctccttttact

SEQ ID NO: 147923 - DNA, 22 bp, Artificial Sequence
  Synthetic oligonucleotide; CTA chr11 5200947 5200968 5200952 5200947 -
gccttctccttttactaatctc

SEQ ID NO: 147924 - DNA, 22 bp, Artificial Sequence
  Synthetic oligonucleotide; CTT chr11 5200942 5200963 5200947 5200942 -
ctccttttactaatctcttcct

SEQ ID NO: 147925 - DNA, 22 bp, Artificial Sequence
  Synthetic oligonucleotide; TTC chr11 5200941 5200962 5200946 5200941 -
tccttttactaatctcttcctt

SEQ ID NO: 147926 - DNA, 22 bp, Artificial Sequence
  Synthetic oligonucleotide; CTC chr11 5200939 5200960 5200944 5200939 -
cttttactaatctcttccttat

SEQ ID NO: 147927 - DNA, 22 bp, Artificial Sequence
  Synthetic oligonucleotide; CTT chr11 5200936 5200957 5200941 5200936 -
ttactaatctcttccttatttg

SEQ ID NO: 147928 - DNA, 22 bp, Artificial Sequence
  Synthetic oligonucleotide; TTT chr11 5200935 5200956 5200940 5200935 -
tactaatctcttccttatttgt

SEQ ID NO: 147929 - DNA, 22 bp, Artificial Sequence
  Synthetic oligonucleotide; TTT chr11 5200934 5200955 5200939 5200934 -
actaatctcttccttatttgtt

SEQ ID NO: 147930 - DNA, 22 bp, Artificial Sequence
  Synthetic oligonucleotide; TTA chr11 5200933 5200954 5200938 5200933 -
ctaatctcttccttatttgttt

SEQ ID NO: 147931 - DNA, 22 bp, Artificial Sequence
  Synthetic oligonucleotide; CTA chr11 5200930 5200951 5200935 5200930 -
atctcttccttatttgtttttg

SEQ ID NO: 147932 - DNA, 22 bp, Artificial Sequence
  Synthetic oligonucleotide; CTC chr11 5200925 5200946 5200930 5200925 -
ttccttatttgtttttgcttat

SEQ ID NO: 147933 - DNA, 22 bp, Artificial Sequence
  Synthetic oligonucleotide; CTT chr11 5200923 5200944 5200928 5200923 -
ccttatttgtttttgcttatgg

SEQ ID NO: 147934 - DNA, 22 bp, Artificial Sequence
  Synthetic oligonucleotide; TTC chr11 5200922 5200943 5200927 5200922 -
cttatttgtttttgcttatggc

SEQ ID NO: 147935 - DNA, 22 bp, Artificial Sequence
  Synthetic oligonucleotide; CTT chr11 5200919 5200940 5200924 5200919 -
atttgtttttgcttatggcttc

SEQ ID NO: 147936 - DNA, 22 bp, Artificial Sequence
  Synthetic oligonucleotide; TTA chr11 5200918 5200939 5200923 5200918 -
tttgtttttgcttatggcttct

SEQ ID NO: 147937 - DNA, 22 bp, Artificial Sequence
  Synthetic oligonucleotide; TTT chr11 5200915 5200936 5200920 5200915 -
gtttttgcttatggcttctaag

SEQ ID NO: 147938 - DNA, 22 bp, Artificial Sequence
  Synthetic oligonucleotide; TTG chr11 5200914 5200935 5200919 5200914 -
tttttgcttatggcttctaagg

SEQ ID NO: 147939 - DNA, 22 bp, Artificial Sequence
  Synthetic oligonucleotide; TTT chr11 5200911 5200932 5200916 5200911 -
ttgcttatggcttctaaggata

SEQ ID NO: 147940 - DNA, 22 bp, Artificial Sequence
  Synthetic oligonucleotide; TTT chr11 5200910 5200931 5200915 5200910 -
tgcttatggcttctaaggatat

SEQ ID NO: 147941 - DNA, 22 bp, Artificial Sequence
  Synthetic oligonucleotide; TTT chr11 5200909 5200930 5200914 5200909 -
gcttatggcttctaaggatatg

SEQ ID NO: 147942 - DNA, 22 bp, Artificial Sequence
  Synthetic oligonucleotide; TTG chr11 5200908 5200929 5200913 5200908 -
cttatggcttctaaggatatgt

SEQ ID NO: 147943 - DNA, 22 bp, Artificial Sequence
  Synthetic oligonucleotide; CTT chr11 5200905 5200926 5200910 5200905 -
atggcttctaaggatatgttca

SEQ ID NO: 147944 - DNA, 22 bp, Artificial Sequence
  Synthetic oligonucleotide; TTA chr11 5200904 5200925 5200909 5200904 -
tggcttctaaggatatgttcac

SEQ ID NO: 147945 - DNA, 22 bp, Artificial Sequence
  Synthetic oligonucleotide; CTT chr11 5200898 5200919 5200903 5200898 -
ctaaggatatgttcacatccag

SEQ ID NO: 147946 - DNA, 22 bp, Artificial Sequence
  Synthetic oligonucleotide; TTC chr11 5200897 5200918 5200902 5200897 -
taaggatatgttcacatccaga

SEQ ID NO: 147947 - DNA, 22 bp, Artificial Sequence
  Synthetic oligonucleotide; CTA chr11 5200895 5200916 5200900 5200895 -
aggatatgttcacatccagaca

SEQ ID NO: 147948 - DNA, 22 bp, Artificial Sequence
  Synthetic oligonucleotide; TTC chr11 5200884 5200905 5200889 5200884 -
acatccagacagtgaaaaaata

SEQ ID NO: 147949 - DNA, 22 bp, Artificial Sequence
  Synthetic oligonucleotide; CTT chr11 5200855 5200876 5200860 5200855 -
ttaaatgacatcaaaagaagac

SEQ ID NO: 147950 - DNA, 22 bp, Artificial Sequence
  Synthetic oligonucleotide; TTT chr11 5200854 5200875 5200859 5200854 -
taaatgacatcaaaagaagacc

SEQ ID NO: 147951 - DNA, 22 bp, Artificial Sequence
  Synthetic oligonucleotide; TTT chr11 5200853 5200874 5200858 5200853 -
aaatgacatcaaaagaagacca

SEQ ID NO: 147952 - DNA, 22 bp, Artificial Sequence
  Synthetic oligonucleotide; TTA chr11 5200852 5200873 5200857 5200852 -
aatgacatcaaaagaagaccat

SEQ ID NO: 147953 - DNA, 22 bp, Artificial Sequence
  Synthetic oligonucleotide; TTT chr11 5200828 5200849 5200833 5200828 -
tctcaaaggcaatggatactat

SEQ ID NO: 147954 - DNA, 22 bp, Artificial Sequence
  Synthetic oligonucleotide; TTT chr11 5200827 5200848 5200832 5200827 -
ctcaaaggcaatggatactatg

SEQ ID NO: 147955 - DNA, 22 bp, Artificial Sequence
  Synthetic oligonucleotide; TTC chr11 5200826 5200847 5200831 5200826 -
tcaaaggcaatggatactatgt

SEQ ID NO: 147956 - DNA, 22 bp, Artificial Sequence
  Synthetic oligonucleotide; CTC chr11 5200824 5200845 5200829 5200824 -
aaaggcaatggatactatgtct

SEQ ID NO: 147957 - DNA, 22 bp, Artificial Sequence
  Synthetic oligonucleotide; CTA chr11 5200807 5200828 5200812 5200807 -
tgtctcaaagaaacagaatttc

SEQ ID NO: 147958 - DNA, 22 bp, Artificial Sequence
  Synthetic oligonucleotide; CTC chr11 5200801 5200822 5200806 5200801 -
aaagaaacagaatttctcagct

SEQ ID NO: 147959 - DNA, 22 bp, Artificial Sequence
  Synthetic oligonucleotide; TTT chr11 5200786 5200807 5200791 5200786 -
ctcagctgttttttttaagtca

SEQ ID NO: 147960 - DNA, 22 bp, Artificial Sequence
  Synthetic oligonucleotide; TTC chr11 5200785 5200806 5200790 5200785 -
tcagctgttttttttaagtcag

SEQ ID NO: 147961 - DNA, 22 bp, Artificial Sequence
  Synthetic oligonucleotide; CTC chr11 5200783 5200804 5200788 5200783 -
agctgttttttttaagtcagta

SEQ ID NO: 147962 - DNA, 22 bp, Artificial Sequence
  Synthetic oligonucleotide; CTG chr11 5200778 5200799 5200783 5200778 -
ttttttttaagtcagtaagttt

SEQ ID NO: 147963 - DNA, 22 bp, Artificial Sequence
  Synthetic oligonucleotide; TTT chr11 5200775 5200796 5200780 5200775 -
tttttaagtcagtaagttttag

SEQ ID NO: 147964 - DNA, 22 bp, Artificial Sequence
  Synthetic oligonucleotide; TTT chr11 5200774 5200795 5200779 5200774 -
ttttaagtcagtaagttttagg

SEQ ID NO: 147965 - DNA, 22 bp, Artificial Sequence
  Synthetic oligonucleotide; TTT chr11 5200773 5200794 5200778 5200773 -
tttaagtcagtaagttttaggg

SEQ ID NO: 147966 - DNA, 22 bp, Artificial Sequence
  Synthetic oligonucleotide; TTT chr11 5200772 5200793 5200777 5200772 -
ttaagtcagtaagttttagggt

SEQ ID NO: 147967 - DNA, 22 bp, Artificial Sequence
  Synthetic oligonucleotide; TTT chr11 5200771 5200792 5200776 5200771 -
taagtcagtaagttttagggta

SEQ ID NO: 147968 - DNA, 22 bp, Artificial Sequence
  Synthetic oligonucleotide; TTT chr11 5200770 5200791 5200775 5200770 -
aagtcagtaagttttagggtat

SEQ ID NO: 147969 - DNA, 22 bp, Artificial Sequence
  Synthetic oligonucleotide; TTA chr11 5200769 5200790 5200774 5200769 -
agtcagtaagttttagggtatt

SEQ ID NO: 147970 - DNA, 22 bp, Artificial Sequence
  Synthetic oligonucleotide; TTT chr11 5200756 5200777 5200761 5200756 -
tagggtatttcatttacttaga

SEQ ID NO: 147971 - DNA, 22 bp, Artificial Sequence
  Synthetic oligonucleotide; TTT chr11 5200755 5200776 5200760 5200755 -
agggtatttcatttacttagaa

SEQ ID NO: 147972 - DNA, 22 bp, Artificial Sequence
  Synthetic oligonucleotide; TTA chr11 5200754 5200775 5200759 5200754 -
gggtatttcatttacttagaaa

SEQ ID NO: 147973 - DNA, 22 bp, Artificial Sequence
  Synthetic oligonucleotide; TTT chr11 5200746 5200767 5200751 5200746 -
catttacttagaaatttcattg

SEQ ID NO: 147974 - DNA, 22 bp, Artificial Sequence
  Synthetic oligonucleotide; TTC chr11 5200745 5200766 5200750 5200745 -
atttacttagaaatttcattgt

SEQ ID NO: 147975 - DNA, 22 bp, Artificial Sequence
  Synthetic oligonucleotide; TTT chr11 5200741 5200762 5200746 5200741 -
acttagaaatttcattgtattc

SEQ ID NO: 147976 - DNA, 22 bp, Artificial Sequence
  Synthetic oligonucleotide; TTA chr11 5200740 5200761 5200745 5200740 -
cttagaaatttcattgtattca

SEQ ID NO: 147977 - DNA, 22 bp, Artificial Sequence
  Synthetic oligonucleotide; CTT chr11 5200737 5200758 5200742 5200737 -
agaaatttcattgtattcaggt

SEQ ID NO: 147978 - DNA, 22 bp, Artificial Sequence
  Synthetic oligonucleotide; TTA chr11 5200736 5200757 5200741 5200736 -
gaaatttcattgtattcaggtg

SEQ ID NO: 147979 - DNA, 22 bp, Artificial Sequence
  Synthetic oligonucleotide; TTT chr11 5200729 5200750 5200734 5200729 -
cattgtattcaggtgaaattga

SEQ ID NO: 147980 - DNA, 22 bp, Artificial Sequence
  Synthetic oligonucleotide; TTC chr11 5200728 5200749 5200733 5200728 -
attgtattcaggtgaaattgaa

SEQ ID NO: 147981 - DNA, 22 bp, Artificial Sequence
  Synthetic oligonucleotide; TTG chr11 5200724 5200745 5200729 5200724 -
tattcaggtgaaattgaaacat

SEQ ID NO: 147982 - DNA, 22 bp, Artificial Sequence
  Synthetic oligonucleotide; TTC chr11 5200719 5200740 5200724 5200719 -
aggtgaaattgaaacatttcct

SEQ ID NO: 147983 - DNA, 22 bp, Artificial Sequence
  Synthetic oligonucleotide; TTG chr11 5200708 5200729 5200713 5200708 -
aaacatttcctttgaaaaaata

SEQ ID NO: 147984 - DNA, 22 bp, Artificial Sequence
  Synthetic oligonucleotide; TTT chr11 5200700 5200721 5200705 5200700 -
cctttgaaaaaatactctcaca

SEQ ID NO: 147985 - DNA, 22 bp, Artificial Sequence
  Synthetic oligonucleotide; TTC chr11 5200699 5200720 5200704 5200699 -
ctttgaaaaaatactctcacat

SEQ ID NO: 147986 - DNA, 22 bp, Artificial Sequence
  Synthetic oligonucleotide; CTT chr11 5200696 5200717 5200701 5200696 -
tgaaaaaatactctcacatgtt

SEQ ID NO: 147987 - DNA, 22 bp, Artificial Sequence
  Synthetic oligonucleotide; TTT chr11 5200695 5200716 5200700 5200695 -
gaaaaaatactctcacatgttt

SEQ ID NO: 147988 - DNA, 22 bp, Artificial Sequence
  Synthetic oligonucleotide; TTG chr11 5200694 5200715 5200699 5200694 -
aaaaaatactctcacatgtttc

SEQ ID NO: 147989 - DNA, 22 bp, Artificial Sequence
  Synthetic oligonucleotide; CTC chr11 5200683 5200704 5200688 5200683 -
tcacatgtttctcagttccaga

SEQ ID NO: 147990 - DNA, 22 bp, Artificial Sequence
  Synthetic oligonucleotide; CTC chr11 5200681 5200702 5200686 5200681 -
acatgtttctcagttccagaat

SEQ ID NO: 147991 - DNA, 22 bp, Artificial Sequence
  Synthetic oligonucleotide; TTT chr11 5200673 5200694 5200678 5200673 -
ctcagttccagaatgattactt

SEQ ID NO: 147992 - DNA, 22 bp, Artificial Sequence
  Synthetic oligonucleotide; TTC chr11 5200672 5200693 5200677 5200672 -
tcagttccagaatgattacttc

SEQ ID NO: 147993 - DNA, 22 bp, Artificial Sequence
  Synthetic oligonucleotide; CTC chr11 5200670 5200691 5200675 5200670 -
agttccagaatgattacttcag

SEQ ID NO: 147994 - DNA, 22 bp, Artificial Sequence
  Synthetic oligonucleotide; TTC chr11 5200665 5200686 5200670 5200665 -
cagaatgattacttcagtaagc

SEQ ID NO: 147995 - DNA, 22 bp, Artificial Sequence
  Synthetic oligonucleotide; TTA chr11 5200654 5200675 5200659 5200654 -
cttcagtaagccctagcaccag

SEQ ID NO: 147996 - DNA, 22 bp, Artificial Sequence
  Synthetic oligonucleotide; CTT chr11 5200651 5200672 5200656 5200651 -
cagtaagccctagcaccagcac

SEQ ID NO: 147997 - DNA, 22 bp, Artificial Sequence
  Synthetic oligonucleotide; TTC chr11 5200650 5200671 5200655 5200650 -
agtaagccctagcaccagcacg

SEQ ID NO: 147998 - DNA, 22 bp, Artificial Sequence
  Synthetic oligonucleotide; CTA chr11 5200639 5200660 5200644 5200639 -
gcaccagcacgaattcttcctt

SEQ ID NO: 147999 - DNA, 22 bp, Artificial Sequence
  Synthetic oligonucleotide; TTC chr11 5200623 5200644 5200628 5200623 -
ttcctttcttctcactggattt

SEQ ID NO: 148000 - DNA, 22 bp, Artificial Sequence
  Synthetic oligonucleotide; CTT chr11 5200621 5200642 5200626 5200621 -
cctttcttctcactggattttc

SEQ ID NO: 148001 - DNA, 22 bp, Artificial Sequence
  Synthetic oligonucleotide; TTC chr11 5200620 5200641 5200625 5200620 -
ctttcttctcactggattttct

SEQ ID NO: 148002 - DNA, 22 bp, Artificial Sequence
  Synthetic oligonucleotide; CTT chr11 5200617 5200638 5200622 5200617 -
tcttctcactggattttctggc

SEQ ID NO: 148003 - DNA, 22 bp, Artificial Sequence
  Synthetic oligonucleotide; TTT chr11 5200616 5200637 5200621 5200616 -
cttctcactggattttctggca

SEQ ID NO: 148004 - DNA, 22 bp, Artificial Sequence
  Synthetic oligonucleotide; TTC chr11 5200615 5200636 5200620 5200615 -
ttctcactggattttctggcat

SEQ ID NO: 148005 - DNA, 22 bp, Artificial Sequence
  Synthetic oligonucleotide; CTT chr11 5200613 5200634 5200618 5200613 -
ctcactggattttctggcatgg

SEQ ID NO: 148006 - DNA, 22 bp, Artificial Sequence
  Synthetic oligonucleotide; TTC chr11 5200612 5200633 5200617 5200612 -
tcactggattttctggcatgga

SEQ ID NO: 148007 - DNA, 22 bp, Artificial Sequence
  Synthetic oligonucleotide; CTC chr11 5200610 5200631 5200615 5200610 -
actggattttctggcatggagc

SEQ ID NO: 148008 - DNA, 22 bp, Artificial Sequence
  Synthetic oligonucleotide; CTG chr11 5200606 5200627 5200611 5200606 -
gattttctggcatggagcagca

SEQ ID NO: 148009 - DNA, 22 bp, Artificial Sequence
  Synthetic oligonucleotide; TTT chr11 5200601 5200622 5200606 5200601 -
tctggcatggagcagcaatacc

SEQ ID NO: 148010 - DNA, 22 bp, Artificial Sequence
  Synthetic oligonucleotide; TTT chr11 5200600 5200621 5200605 5200600 -
ctggcatggagcagcaataccc

SEQ ID NO: 148011 - DNA, 22 bp, Artificial Sequence
  Synthetic oligonucleotide; TTC chr11 5200599 5200620 5200604 5200599 -
tggcatggagcagcaatacccc

SEQ ID NO: 148012 - DNA, 22 bp, Artificial Sequence
  Synthetic oligonucleotide; CTG chr11 5200597 5200618 5200602 5200597 -
gcatggagcagcaatacccctg

SEQ ID NO: 148013 - DNA, 22 bp, Artificial Sequence
  Synthetic oligonucleotide; CTG chr11 5200575 5200596 5200580 5200575 -
gctttccatccccttctcctca

SEQ ID NO: 148014 - DNA, 22 bp, Artificial Sequence
  Synthetic oligonucleotide; CTT chr11 5200571 5200592 5200576 5200571 -
tccatccccttctcctcaatct

SEQ ID NO: 148015 - DNA, 22 bp, Artificial Sequence
  Synthetic oligonucleotide; TTT chr11 5200570 5200591 5200575 5200570 -
ccatccccttctcctcaatcta

SEQ ID NO: 148016 - DNA, 22 bp, Artificial Sequence
  Synthetic oligonucleotide; TTC chr11 5200569 5200590 5200574 5200569 -
catccccttctcctcaatctat

SEQ ID NO: 148017 - DNA, 22 bp, Artificial Sequence
  Synthetic oligonucleotide; CTT chr11 5200560 5200581 5200565 5200560 -
ctcctcaatctatgccatggtg

SEQ ID NO: 148018 - DNA, 22 bp, Artificial Sequence
  Synthetic oligonucleotide; TTC chr11 5200559 5200580 5200564 5200559 -
tcctcaatctatgccatggtgc

SEQ ID NO: 148019 - DNA, 22 bp, Artificial Sequence
  Synthetic oligonucleotide; CTC chr11 5200557 5200578 5200562 5200557 -
ctcaatctatgccatggtgctt

SEQ ID NO: 148020 - DNA, 22 bp, Artificial Sequence
  Synthetic oligonucleotide; CTC chr11 5200554 5200575 5200559 5200554 -
aatctatgccatggtgcttttg

SEQ ID NO: 148021 - DNA, 22 bp, Artificial Sequence
  Synthetic oligonucleotide; CTA chr11 5200548 5200569 5200553 5200548 -
tgccatggtgcttttgggcaat

SEQ ID NO: 148022 - DNA, 22 bp, Artificial Sequence
  Synthetic oligonucleotide; CTT chr11 5200535 5200556 5200540 5200535 -
ttgggcaattgcatggttctcc

SEQ ID NO: 148023 - DNA, 22 bp, Artificial Sequence
  Synthetic oligonucleotide; TTT chr11 5200534 5200555 5200539 5200534 -
tgggcaattgcatggttctcca

SEQ ID NO: 148024 - DNA, 22 bp, Artificial Sequence
  Synthetic oligonucleotide; TTT chr11 5200533 5200554 5200538 5200533 -
gggcaattgcatggttctccat

SEQ ID NO: 148025 - DNA, 22 bp, Artificial Sequence
  Synthetic oligonucleotide; TTG chr11 5200532 5200553 5200537 5200532 -
ggcaattgcatggttctccatg

SEQ ID NO: 148026 - DNA, 22 bp, Artificial Sequence
  Synthetic oligonucleotide; TTG chr11 5200524 5200545 5200529 5200524 -
catggttctccatgtgatatgg

SEQ ID NO: 148027 - DNA, 22 bp, Artificial Sequence
  Synthetic oligonucleotide; TTC chr11 5200516 5200537 5200521 5200516 -
tccatgtgatatggactgagcc

SEQ ID NO: 148028 - DNA, 22 bp, Artificial Sequence
  Synthetic oligonucleotide; CTC chr11 5200514 5200535 5200519 5200514 -
catgtgatatggactgagccaa

SEQ ID NO: 148029 - DNA, 22 bp, Artificial Sequence
  Synthetic oligonucleotide; CTG chr11 5200498 5200519 5200503 5200498 -
agccaagcctgcaccagcctat

SEQ ID NO: 148030 - DNA, 22 bp, Artificial Sequence
  Synthetic oligonucleotide; CTG chr11 5200487 5200508 5200492 5200487 -
caccagcctatgttttacttcc

SEQ ID NO: 148031 - DNA, 22 bp, Artificial Sequence
  Synthetic oligonucleotide; CTA chr11 5200477 5200498 5200482 5200477 -
tgttttacttcctgtccatgct

SEQ ID NO: 148032 - DNA, 22 bp, Artificial Sequence
  Synthetic oligonucleotide; TTT chr11 5200472 5200493 5200477 5200472 -
tacttcctgtccatgctggccc

SEQ ID NO: 148033 - DNA, 22 bp, Artificial Sequence
  Synthetic oligonucleotide; TTT chr11 5200471 5200492 5200476 5200471 -
acttcctgtccatgctggccct

SEQ ID NO: 148034 - DNA, 22 bp, Artificial Sequence
  Synthetic oligonucleotide; TTA chr11 5200470 5200491 5200475 5200470 -
cttcctgtccatgctggccctc

SEQ ID NO: 148035 - DNA, 22 bp, Artificial Sequence
  Synthetic oligonucleotide; CTT chr11 5200467 5200488 5200472 5200467 -
cctgtccatgctggccctcact

SEQ ID NO: 148036 - DNA, 22 bp, Artificial Sequence
  Synthetic oligonucleotide; TTC chr11 5200466 5200487 5200471 5200466 -
ctgtccatgctggccctcactg

SEQ ID NO: 148037 - DNA, 22 bp, Artificial Sequence
  Synthetic oligonucleotide; CTG chr11 5200463 5200484 5200468 5200463 -
tccatgctggccctcactgacc

SEQ ID NO: 148038 - DNA, 22 bp, Artificial Sequence
  Synthetic oligonucleotide; CTG chr11 5200454 5200475 5200459 5200454 -
gccctcactgacctgtgcatgg

SEQ ID NO: 148039 - DNA, 22 bp, Artificial Sequence
  Synthetic oligonucleotide; CTC chr11 5200448 5200469 5200453 5200448 -
actgacctgtgcatggggctgt

SEQ ID NO: 148040 - DNA, 22 bp, Artificial Sequence
  Synthetic oligonucleotide; CTG chr11 5200444 5200465 5200449 5200444 -
acctgtgcatggggctgtccac

SEQ ID NO: 148041 - DNA, 22 bp, Artificial Sequence
  Synthetic oligonucleotide; CTG chr11 5200439 5200460 5200444 5200439 -
tgcatggggctgtccactgtgt

SEQ ID NO: 148042 - DNA, 22 bp, Artificial Sequence
  Synthetic oligonucleotide; CTG chr11 5200427 5200448 5200432 5200427 -
tccactgtgtacacagtgctgg

SEQ ID NO: 148043 - DNA, 22 bp, Artificial Sequence
  Synthetic oligonucleotide; CTG chr11 5200420 5200441 5200425 5200420 -
tgtacacagtgctggggatcct

SEQ ID NO: 148044 - DNA, 22 bp, Artificial Sequence
  Synthetic oligonucleotide; CTG chr11 5200406 5200427 5200411 5200406 -
gggatcctgtgggggatcattc

SEQ ID NO: 148045 - DNA, 22 bp, Artificial Sequence
  Synthetic oligonucleotide; CTG chr11 5200397 5200418 5200402 5200397 -
tgggggatcattcgagagatca

SEQ ID NO: 148046 - DNA, 22 bp, Artificial Sequence
  Synthetic oligonucleotide; TTC chr11 5200384 5200405 5200389 5200384 -
gagagatcagcttggattcctg

SEQ ID NO: 148047 - DNA, 22 bp, Artificial Sequence
  Synthetic oligonucleotide; CTT chr11 5200371 5200392 5200376 5200371 -
ggattcctgcattgcccagtcc

SEQ ID NO: 148048 - DNA, 22 bp, Artificial Sequence
  Synthetic oligonucleotide; TTG chr11 5200370 5200391 5200375 5200370 -
gattcctgcattgcccagtcct

SEQ ID NO: 148049 - DNA, 22 bp, Artificial Sequence
  Synthetic oligonucleotide; TTC chr11 5200365 5200386 5200370 5200365 -
ctgcattgcccagtcctatttc

SEQ ID NO: 148050 - DNA, 22 bp, Artificial Sequence
  Synthetic oligonucleotide; CTG chr11 5200362 5200383 5200367 5200362 -
cattgcccagtcctatttcatc

SEQ ID NO: 148051 - DNA, 22 bp, Artificial Sequence
  Synthetic oligonucleotide; TTG chr11 5200357 5200378 5200362 5200357 -
cccagtcctatttcatccatgg

SEQ ID NO: 148052 - DNA, 22 bp, Artificial Sequence
  Synthetic oligonucleotide; CTA chr11 5200347 5200368 5200352 5200347 -
tttcatccatggtctgtccttc

SEQ ID NO: 148053 - DNA, 22 bp, Artificial Sequence
  Synthetic oligonucleotide; TTT chr11 5200344 5200365 5200349 5200344 -
catccatggtctgtccttcatg

SEQ ID NO: 148054 - DNA, 22 bp, Artificial Sequence
  Synthetic oligonucleotide; TTC chr11 5200343 5200364 5200348 5200343 -
atccatggtctgtccttcatgg

SEQ ID NO: 148055 - DNA, 22 bp, Artificial Sequence
  Synthetic oligonucleotide; CTG chr11 5200331 5200352 5200336 5200331 -
tccttcatggagtcctctgtcc

SEQ ID NO: 148056 - DNA, 22 bp, Artificial Sequence
  Synthetic oligonucleotide; CTT chr11 5200326 5200347 5200331 5200326 -
catggagtcctctgtcctcctc

SEQ ID NO: 148057 - DNA, 22 bp, Artificial Sequence
  Synthetic oligonucleotide; TTC chr11 5200325 5200346 5200330 5200325 -
atggagtcctctgtcctcctca

SEQ ID NO: 148058 - DNA, 22 bp, Artificial Sequence
  Synthetic oligonucleotide; CTC chr11 5200314 5200335 5200319 5200314 -
tgtcctcctcactatggccttt

SEQ ID NO: 148059 - DNA, 22 bp, Artificial Sequence
  Synthetic oligonucleotide; CTG chr11 5200312 5200333 5200317 5200312 -
tcctcctcactatggcctttga

SEQ ID NO: 148060 - DNA, 22 bp, Artificial Sequence
  Synthetic oligonucleotide; CTC chr11 5200307 5200328 5200312 5200307 -
ctcactatggcctttgaccggt

SEQ ID NO: 148061 - DNA, 22 bp, Artificial Sequence
  Synthetic oligonucleotide; CTC chr11 5200304 5200325 5200309 5200304 -
actatggcctttgaccggtaca

SEQ ID NO: 148062 - DNA, 22 bp, Artificial Sequence
  Synthetic oligonucleotide; CTA chr11 5200300 5200321 5200305 5200300 -
tggcctttgaccggtacattgc

SEQ ID NO: 148063 - DNA, 22 bp, Artificial Sequence
  Synthetic oligonucleotide; CTT chr11 5200293 5200314 5200298 5200293 -
tgaccggtacattgcaatttgc

SEQ ID NO: 148064 - DNA, 22 bp, Artificial Sequence
  Synthetic oligonucleotide; TTT chr11 5200292 5200313 5200297 5200292 -
gaccggtacattgcaatttgca

SEQ ID NO: 148065 - DNA, 22 bp, Artificial Sequence
  Synthetic oligonucleotide; TTG chr11 5200291 5200312 5200296 5200291 -
accggtacattgcaatttgcaa

SEQ ID NO: 148066 - DNA, 22 bp, Artificial Sequence
  Synthetic oligonucleotide; TTG chr11 5200279 5200300 5200284 5200279 -
caatttgcaatccactacgtta

SEQ ID NO: 148067 - DNA, 22 bp, Artificial Sequence
  Synthetic oligonucleotide; TTT chr11 5200273 5200294 5200278 5200273 -
gcaatccactacgttattcctc

SEQ ID NO: 148068 - DNA, 22 bp, Artificial Sequence
  Synthetic oligonucleotide; TTG chr11 5200272 5200293 5200277 5200272 -
caatccactacgttattcctcc

SEQ ID NO: 148069 - DNA, 22 bp, Artificial Sequence
  Synthetic oligonucleotide; CTA chr11 5200262 5200283 5200267 5200262 -
cgttattcctccatcctgacta

SEQ ID NO: 148070 - DNA, 22 bp, Artificial Sequence
  Synthetic oligonucleotide; TTA chr11 5200257 5200278 5200262 5200257 -
ttcctccatcctgactaattcc

SEQ ID NO: 148071 - DNA, 22 bp, Artificial Sequence
  Synthetic oligonucleotide; TTC chr11 5200254 5200275 5200259 5200254 -
ctccatcctgactaattccaga

SEQ ID NO: 148072 - DNA, 22 bp, Artificial Sequence
  Synthetic oligonucleotide; CTC chr11 5200251 5200272 5200256 5200251 -
catcctgactaattccagaatt

SEQ ID NO: 148073 - DNA, 22 bp, Artificial Sequence
  Synthetic oligonucleotide; CTG chr11 5200244 5200265 5200249 5200244 -
actaattccagaattatcaaaa

SEQ ID NO: 148074 - DNA, 22 bp, Artificial Sequence
  Synthetic oligonucleotide; CTA chr11 5200240 5200261 5200245 5200240 -
attccagaattatcaaaattgg

SEQ ID NO: 148075 - DNA, 22 bp, Artificial Sequence
  Synthetic oligonucleotide; TTC chr11 5200236 5200257 5200241 5200236 -
cagaattatcaaaattgggctc

SEQ ID NO: 148076 - DNA, 22 bp, Artificial Sequence
  Synthetic oligonucleotide; TTA chr11 5200228 5200249 5200233 5200228 -
tcaaaattgggctcactataat

SEQ ID NO: 148077 - DNA, 22 bp, Artificial Sequence
  Synthetic oligonucleotide; TTG chr11 5200219 5200240 5200224 5200219 -
ggctcactataataggtaggag

SEQ ID NO: 148078 - DNA, 22 bp, Artificial Sequence
  Synthetic oligonucleotide; CTC chr11 5200214 5200235 5200219 5200214 -
actataataggtaggagttttt

SEQ ID NO: 148079 - DNA, 22 bp, Artificial Sequence
  Synthetic oligonucleotide; CTA chr11 5200210 5200231 5200215 5200210 -
taataggtaggagttttttctt

SEQ ID NO: 148080 - DNA, 22 bp, Artificial Sequence
  Synthetic oligonucleotide; TTT chr11 5200194 5200215 5200199 5200194 -
tttctttattacaccccccatc

SEQ ID NO: 148081 - DNA, 22 bp, Artificial Sequence
  Synthetic oligonucleotide; TTT chr11 5200193 5200214 5200198 5200193 -
ttctttattacaccccccatca

SEQ ID NO: 148082 - DNA, 22 bp, Artificial Sequence
  Synthetic oligonucleotide; TTT chr11 5200192 5200213 5200197 5200192 -
tctttattacaccccccatcat

SEQ ID NO: 148083 - DNA, 22 bp, Artificial Sequence
  Synthetic oligonucleotide; TTT chr11 5200191 5200212 5200196 5200191 -
ctttattacaccccccatcatc

SEQ ID NO: 148084 - DNA, 22 bp, Artificial Sequence
  Synthetic oligonucleotide; TTC chr11 5200190 5200211 5200195 5200190 -
tttattacaccccccatcatct

SEQ ID NO: 148085 - DNA, 22 bp, Artificial Sequence
  Synthetic oligonucleotide; CTT chr11 5200188 5200209 5200193 5200188 -
tattacaccccccatcatctgt

SEQ ID NO: 148086 - DNA, 22 bp, Artificial Sequence
  Synthetic oligonucleotide; TTT chr11 5200187 5200208 5200192 5200187 -
attacaccccccatcatctgtc

SEQ ID NO: 148087 - DNA, 22 bp, Artificial Sequence
  Synthetic oligonucleotide; TTA chr11 5200186 5200207 5200191 5200186 -
ttacaccccccatcatctgtct

SEQ ID NO: 148088 - DNA, 22 bp, Artificial Sequence
  Synthetic oligonucleotide; TTA chr11 5200183 5200204 5200188 5200183 -
caccccccatcatctgtctgaa

SEQ ID NO: 148089 - DNA, 22 bp, Artificial Sequence
  Synthetic oligonucleotide; CTG chr11 5200167 5200188 5200172 5200167 -
tctgaaattttttaattactgt

SEQ ID NO: 148090 - DNA, 22 bp, Artificial Sequence
  Synthetic oligonucleotide; CTG chr11 5200163 5200184 5200168 5200163 -
aaattttttaattactgtcatt

SEQ ID NO: 148091 - DNA, 22 bp, Artificial Sequence
  Synthetic oligonucleotide; TTT chr11 5200157 5200178 5200162 5200157 -
tttaattactgtcatttccaca

SEQ ID NO: 148092 - DNA, 22 bp, Artificial Sequence
  Synthetic oligonucleotide; TTT chr11 5200156 5200177 5200161 5200156 -
ttaattactgtcatttccacat

SEQ ID NO: 148093 - DNA, 22 bp, Artificial Sequence
  Synthetic oligonucleotide; TTT chr11 5200155 5200176 5200160 5200155 -
taattactgtcatttccacatc

SEQ ID NO: 148094 - DNA, 22 bp, Artificial Sequence
  Synthetic oligonucleotide; TTT chr11 5200154 5200175 5200159 5200154 -
aattactgtcatttccacatcc

SEQ ID NO: 148095 - DNA, 22 bp, Artificial Sequence
  Synthetic oligonucleotide; TTA chr11 5200153 5200174 5200158 5200153 -
attactgtcatttccacatcct

SEQ ID NO: 148096 - DNA, 22 bp, Artificial Sequence
  Synthetic oligonucleotide; TTA chr11 5200149 5200170 5200154 5200149 -
ctgtcatttccacatcctttct

SEQ ID NO: 148097 - DNA, 22 bp, Artificial Sequence
  Synthetic oligonucleotide; CTG chr11 5200146 5200167 5200151 5200146 -
tcatttccacatcctttctcac

SEQ ID NO: 148098 - DNA, 22 bp, Artificial Sequence
  Synthetic oligonucleotide; TTT chr11 5200140 5200161 5200145 5200140 -
ccacatcctttctcactctttc

SEQ ID NO: 148099 - DNA, 22 bp, Artificial Sequence
  Synthetic oligonucleotide; TTC chr11 5200139 5200160 5200144 5200139 -
cacatcctttctcactctttct

SEQ ID NO: 148100 - DNA, 22 bp, Artificial Sequence
  Synthetic oligonucleotide; CTT chr11 5200130 5200151 5200135 5200130 -
tctcactctttctgcctgcacc

SEQ ID NO: 148101 - DNA, 22 bp, Artificial Sequence
  Synthetic oligonucleotide; TTT chr11 5200129 5200150 5200134 5200129 -
ctcactctttctgcctgcacca

SEQ ID NO: 148102 - DNA, 22 bp, Artificial Sequence
  Synthetic oligonucleotide; TTC chr11 5200128 5200149 5200133 5200128 -
tcactctttctgcctgcaccag

SEQ ID NO: 148103 - DNA, 22 bp, Artificial Sequence
  Synthetic oligonucleotide; CTC chr11 5200126 5200147 5200131 5200126 -
actctttctgcctgcaccagga

SEQ ID NO: 148104 - DNA, 22 bp, Artificial Sequence
  Synthetic oligonucleotide; CTC chr11 5200122 5200143 5200127 5200122 -
tttctgcctgcaccaggatctt

SEQ ID NO: 148105 - DNA, 22 bp, Artificial Sequence
  Synthetic oligonucleotide; CTT chr11 5200120 5200141 5200125 5200120 -
tctgcctgcaccaggatcttct

SEQ ID NO: 148106 - DNA, 22 bp, Artificial Sequence
  Synthetic oligonucleotide; TTT chr11 5200119 5200140 5200124 5200119 -
ctgcctgcaccaggatcttctc

SEQ ID NO: 148107 - DNA, 22 bp, Artificial Sequence
  Synthetic oligonucleotide; TTC chr11 5200118 5200139 5200123 5200118 -
tgcctgcaccaggatcttctcc

SEQ ID NO: 148108 - DNA, 22 bp, Artificial Sequence
  Synthetic oligonucleotide; CTG chr11 5200116 5200137 5200121 5200116 -
cctgcaccaggatcttctccgc

SEQ ID NO: 148109 - DNA, 22 bp, Artificial Sequence
  Synthetic oligonucleotide; CTG chr11 5200112 5200133 5200117 5200112 -
caccaggatcttctccgcttag

SEQ ID NO: 148110 - DNA, 22 bp, Artificial Sequence
  Synthetic oligonucleotide; CTT chr11 5200100 5200121 5200105 5200100 -
ctccgcttagcctgttcagaca

SEQ ID NO: 148111 - DNA, 22 bp, Artificial Sequence
  Synthetic oligonucleotide; TTC chr11 5200099 5200120 5200104 5200099 -
tccgcttagcctgttcagacat

SEQ ID NO: 148112 - DNA, 22 bp, Artificial Sequence
  Synthetic oligonucleotide; CTC chr11 5200097 5200118 5200102 5200097 -
cgcttagcctgttcagacatcc

SEQ ID NO: 148113 - DNA, 22 bp, Artificial Sequence
  Synthetic oligonucleotide; CTT chr11 5200092 5200113 5200097 5200092 -
agcctgttcagacatccgattc

SEQ ID NO: 148114 - DNA, 22 bp, Artificial Sequence
  Synthetic oligonucleotide; TTA chr11 5200091 5200112 5200096 5200091 -
gcctgttcagacatccgattca

SEQ ID NO: 148115 - DNA, 22 bp, Artificial Sequence
  Synthetic oligonucleotide; CTG chr11 5200086 5200107 5200091 5200086 -
ttcagacatccgattcaatagt

SEQ ID NO: 148116 - DNA, 22 bp, Artificial Sequence
  Synthetic oligonucleotide; TTC chr11 5200083 5200104 5200088 5200083 -
agacatccgattcaatagttac

SEQ ID NO: 148117 - DNA, 22 bp, Artificial Sequence
  Synthetic oligonucleotide; TTC chr11 5200070 5200091 5200075 5200070 -
aatagttactatgccctgatgc

SEQ ID NO: 148118 - DNA, 22 bp, Artificial Sequence
  Synthetic oligonucleotide; TTA chr11 5200062 5200083 5200067 5200062 -
ctatgccctgatgctggttatt

SEQ ID NO: 148119 - DNA, 22 bp, Artificial Sequence
  Synthetic oligonucleotide; CTA chr11 5200059 5200080 5200064 5200059 -
tgccctgatgctggttatttgc

SEQ ID NO: 148120 - DNA, 22 bp, Artificial Sequence
  Synthetic oligonucleotide; CTG chr11 5200052 5200073 5200057 5200052 -
atgctggttatttgcatactgt

SEQ ID NO: 148121 - DNA, 22 bp, Artificial Sequence
  Synthetic oligonucleotide; CTG chr11 5200046 5200067 5200051 5200046 -
gttatttgcatactgttgttgg

SEQ ID NO: 148122 - DNA, 22 bp, Artificial Sequence
  Synthetic oligonucleotide; TTA chr11 5200042 5200063 5200047 5200042 -
tttgcatactgttgttggatgc

SEQ ID NO: 148123 - DNA, 22 bp, Artificial Sequence
  Synthetic oligonucleotide; TTT chr11 5200039 5200060 5200044 5200039 -
gcatactgttgttggatgctat

SEQ ID NO: 148124 - DNA, 22 bp, Artificial Sequence
  Synthetic oligonucleotide; TTG chr11 5200038 5200059 5200043 5200038 -
catactgttgttggatgctata

SEQ ID NO: 148125 - DNA, 22 bp, Artificial Sequence
  Synthetic oligonucleotide; CTG chr11 5200031 5200052 5200036 5200031 -
ttgttggatgctatactcatcc

SEQ ID NO: 148126 - DNA, 22 bp, Artificial Sequence
  Synthetic oligonucleotide; TTG chr11 5200028 5200049 5200033 5200028 -
ttggatgctatactcatccttt

SEQ ID NO: 148127 - DNA, 22 bp, Artificial Sequence
  Synthetic oligonucleotide; TTG chr11 5200025 5200046 5200030 5200025 -
gatgctatactcatccttttct

SEQ ID NO: 148128 - DNA, 22 bp, Artificial Sequence
  Synthetic oligonucleotide; CTA chr11 5200018 5200039 5200023 5200018 -
tactcatccttttctcctacat

SEQ ID NO: 148129 - DNA, 22 bp, Artificial Sequence
  Synthetic oligonucleotide; CTC chr11 5200013 5200034 5200018 5200013 -
atccttttctcctacatcctga

SEQ ID NO: 148130 - DNA, 22 bp, Artificial Sequence
  Synthetic oligonucleotide; CTT chr11 5200007 5200028 5200012 5200007 -
ttctcctacatcctgattctta

SEQ ID NO: 148131 - DNA, 22 bp, Artificial Sequence
  Synthetic oligonucleotide; TTT chr11 5200006 5200027 5200011 5200006 -
tctcctacatcctgattcttaa

SEQ ID NO: 148132 - DNA, 22 bp, Artificial Sequence
  Synthetic oligonucleotide; TTT chr11 5200005 5200026 5200010 5200005 -
ctcctacatcctgattcttaag

SEQ ID NO: 148133 - DNA, 22 bp, Artificial Sequence
  Synthetic oligonucleotide; TTC chr11 5200004 5200025 5200009 5200004 -
tcctacatcctgattcttaagt

SEQ ID NO: 148134 - DNA, 22 bp, Artificial Sequence
  Synthetic oligonucleotide; CTC chr11 5200002 5200023 5200007 5200002 -
ctacatcctgattcttaagtca

SEQ ID NO: 148135 - DNA, 22 bp, Artificial Sequence
  Synthetic oligonucleotide; CTA chr11 5199999 5200020 5200004 5199999 -
catcctgattcttaagtcagtc

SEQ ID NO: 148136 - DNA, 22 bp, Artificial Sequence
  Synthetic oligonucleotide; CTG chr11 5199992 5200013 5199997 5199992 -
attcttaagtcagtcctggcag

SEQ ID NO: 148137 - DNA, 22 bp, Artificial Sequence
  Synthetic oligonucleotide; TTC chr11 5199988 5200009 5199993 5199988 -
ttaagtcagtcctggcagttgc

SEQ ID NO: 148138 - DNA, 22 bp, Artificial Sequence
  Synthetic oligonucleotide; CTT chr11 5199986 5200007 5199991 5199986 -
aagtcagtcctggcagttgcct

SEQ ID NO: 148139 - DNA, 22 bp, Artificial Sequence
  Synthetic oligonucleotide; TTA chr11 5199985 5200006 5199990 5199985 -
agtcagtcctggcagttgcctc

SEQ ID NO: 148140 - DNA, 22 bp, Artificial Sequence
  Synthetic oligonucleotide; CTG chr11 5199974 5199995 5199979 5199974 -
gcagttgcctctcaggaagaga

SEQ ID NO: 148141 - DNA, 22 bp, Artificial Sequence
  Synthetic oligonucleotide; TTG chr11 5199967 5199988 5199972 5199967 -
cctctcaggaagagaggcataa

SEQ ID NO: 148142 - DNA, 22 bp, Artificial Sequence
  Synthetic oligonucleotide; CTC chr11 5199963 5199984 5199968 5199963 -
tcaggaagagaggcataaatta

SEQ ID NO: 148143 - DNA, 22 bp, Artificial Sequence
  Synthetic oligonucleotide; CTC chr11 5199961 5199982 5199966 5199961 -
aggaagagaggcataaattatt

SEQ ID NO: 148144 - DNA, 22 bp, Artificial Sequence
  Synthetic oligonucleotide; TTA chr11 5199941 5199962 5199946 5199941 -
tttcagacctgcatctcccaca

SEQ ID NO: 148145 - DNA, 22 bp, Artificial Sequence
  Synthetic oligonucleotide; TTT chr11 5199938 5199959 5199943 5199938 -
cagacctgcatctcccacatct

SEQ ID NO: 148146 - DNA, 22 bp, Artificial Sequence
  Synthetic oligonucleotide; TTC chr11 5199937 5199958 5199942 5199937 -
agacctgcatctcccacatctg

SEQ ID NO: 148147 - DNA, 22 bp, Artificial Sequence
  Synthetic oligonucleotide; CTG chr11 5199930 5199951 5199935 5199930 -
catctcccacatctgtgctgtc

SEQ ID NO: 148148 - DNA, 22 bp, Artificial Sequence
  Synthetic oligonucleotide; CTC chr11 5199924 5199945 5199929 5199924 -
ccacatctgtgctgtccttgtg

SEQ ID NO: 148149 - DNA, 22 bp, Artificial Sequence
  Synthetic oligonucleotide; CTG chr11 5199915 5199936 5199920 5199915 -
tgctgtccttgtgttctacatc

SEQ ID NO: 148150 - DNA, 22 bp, Artificial Sequence
  Synthetic oligonucleotide; CTG chr11 5199910 5199931 5199915 5199910 -
tccttgtgttctacatccctat

SEQ ID NO: 148151 - DNA, 22 bp, Artificial Sequence
  Synthetic oligonucleotide; CTT chr11 5199905 5199926 5199910 5199905 -
gtgttctacatccctatcatta

SEQ ID NO: 148152 - DNA, 22 bp, Artificial Sequence
  Synthetic oligonucleotide; TTG chr11 5199904 5199925 5199909 5199904 -
tgttctacatccctatcattag

SEQ ID NO: 148153 - DNA, 22 bp, Artificial Sequence
  Synthetic oligonucleotide; TTC chr11 5199899 5199920 5199904 5199899 -
tacatccctatcattagcctca

SEQ ID NO: 148154 - DNA, 22 bp, Artificial Sequence
  Synthetic oligonucleotide; CTA chr11 5199897 5199918 5199902 5199897 -
catccctatcattagcctcaca

SEQ ID NO: 148155 - DNA, 22 bp, Artificial Sequence
  Synthetic oligonucleotide; CTA chr11 5199889 5199910 5199894 5199889 -
tcattagcctcacaatggtgca

SEQ ID NO: 148156 - DNA, 22 bp, Artificial Sequence
  Synthetic oligonucleotide; TTA chr11 5199883 5199904 5199888 5199883 -
gcctcacaatggtgcaccgttt

SEQ ID NO: 148157 - DNA, 22 bp, Artificial Sequence
  Synthetic oligonucleotide; CTC chr11 5199878 5199899 5199883 5199878 -
acaatggtgcaccgttttggca

SEQ ID NO: 148158 - DNA, 22 bp, Artificial Sequence
  Synthetic oligonucleotide; TTT chr11 5199861 5199882 5199866 5199861 -
tggcaagcacctttcccccgtg

SEQ ID NO: 148159 - DNA, 22 bp, Artificial Sequence
  Synthetic oligonucleotide; TTT chr11 5199860 5199881 5199865 5199860 -
ggcaagcacctttcccccgtgg

SEQ ID NO: 148160 - DNA, 22 bp, Artificial Sequence
  Synthetic oligonucleotide; TTG chr11 5199859 5199880 5199864 5199859 -
gcaagcacctttcccccgtggc

SEQ ID NO: 148161 - DNA, 22 bp, Artificial Sequence
  Synthetic oligonucleotide; CTT chr11 5199848 5199869 5199853 5199848 -
tcccccgtggcccacgttctca

SEQ ID NO: 148162 - DNA, 22 bp, Artificial Sequence
  Synthetic oligonucleotide; TTT chr11 5199847 5199868 5199852 5199847 -
cccccgtggcccacgttctcat

SEQ ID NO: 148163 - DNA, 22 bp, Artificial Sequence
  Synthetic oligonucleotide; TTC chr11 5199846 5199867 5199851 5199846 -
ccccgtggcccacgttctcatt

SEQ ID NO: 148164 - DNA, 22 bp, Artificial Sequence
  Synthetic oligonucleotide; TTC chr11 5199829 5199850 5199834 5199829 -
tcattggcaacatctacatcct

SEQ ID NO: 148165 - DNA, 22 bp, Artificial Sequence
  Synthetic oligonucleotide; CTC chr11 5199827 5199848 5199832 5199827 -
attggcaacatctacatccttt

SEQ ID NO: 148166 - DNA, 22 bp, Artificial Sequence
  Synthetic oligonucleotide; TTG chr11 5199823 5199844 5199828 5199823 -
gcaacatctacatccttttccc

SEQ ID NO: 148167 - DNA, 22 bp, Artificial Sequence
  Synthetic oligonucleotide; CTA chr11 5199813 5199834 5199818 5199813 -
catccttttcccacctttaatg

SEQ ID NO: 148168 - DNA, 22 bp, Artificial Sequence
  Synthetic oligonucleotide; CTT chr11 5199806 5199827 5199811 5199806 -
ttcccacctttaatgaatccca

SEQ ID NO: 148169 - DNA, 22 bp, Artificial Sequence
  Synthetic oligonucleotide; TTT chr11 5199805 5199826 5199810 5199805 -
tcccacctttaatgaatcccat

SEQ ID NO: 148170 - DNA, 22 bp, Artificial Sequence
  Synthetic oligonucleotide; TTT chr11 5199804 5199825 5199809 5199804 -
cccacctttaatgaatcccatc

SEQ ID NO: 148171 - DNA, 22 bp, Artificial Sequence
  Synthetic oligonucleotide; TTC chr11 5199803 5199824 5199808 5199803 -
ccacctttaatgaatcccatca

SEQ ID NO: 148172 - DNA, 22 bp, Artificial Sequence
  Synthetic oligonucleotide; CTT chr11 5199796 5199817 5199801 5199796 -
taatgaatcccatcatctacag

SEQ ID NO: 148173 - DNA, 22 bp, Artificial Sequence
  Synthetic oligonucleotide; TTT chr11 5199795 5199816 5199800 5199795 -
aatgaatcccatcatctacagt

SEQ ID NO: 148174 - DNA, 22 bp, Artificial Sequence
  Synthetic oligonucleotide; TTA chr11 5199794 5199815 5199799 5199794 -
atgaatcccatcatctacagtg

SEQ ID NO: 148175 - DNA, 22 bp, Artificial Sequence
  Synthetic oligonucleotide; CTA chr11 5199777 5199798 5199782 5199777 -
cagtgtcaagacccaacagatt

SEQ ID NO: 148176 - DNA, 22 bp, Artificial Sequence
  Synthetic oligonucleotide; TTC chr11 5199754 5199775 5199759 5199754 -
ataccagaatgcttagactctt

SEQ ID NO: 148177 - DNA, 22 bp, Artificial Sequence
  Synthetic oligonucleotide; CTT chr11 5199740 5199761 5199745 5199740 -
agactcttttctctgaaaagat

SEQ ID NO: 148178 - DNA, 22 bp, Artificial Sequence
  Synthetic oligonucleotide; TTA chr11 5199739 5199760 5199744 5199739 -
gactcttttctctgaaaagata

SEQ ID NO: 148179 - DNA, 22 bp, Artificial Sequence
  Synthetic oligonucleotide; CTC chr11 5199734 5199755 5199739 5199734 -
ttttctctgaaaagatattgag

SEQ ID NO: 148180 - DNA, 22 bp, Artificial Sequence
  Synthetic oligonucleotide; CTT chr11 5199732 5199753 5199737 5199732 -
ttctctgaaaagatattgagag

SEQ ID NO: 148181 - DNA, 22 bp, Artificial Sequence
  Synthetic oligonucleotide; TTT chr11 5199731 5199752 5199736 5199731 -
tctctgaaaagatattgagaga

SEQ ID NO: 148182 - DNA, 22 bp, Artificial Sequence
  Synthetic oligonucleotide; TTT chr11 5199730 5199751 5199735 5199730 -
ctctgaaaagatattgagagat

SEQ ID NO: 148183 - DNA, 22 bp, Artificial Sequence
  Synthetic oligonucleotide; TTC chr11 5199729 5199750 5199734 5199729 -
tctgaaaagatattgagagata

SEQ ID NO: 148184 - DNA, 22 bp, Artificial Sequence
  Synthetic oligonucleotide; CTC chr11 5199727 5199748 5199732 5199727 -
tgaaaagatattgagagatatt

SEQ ID NO: 148185 - DNA, 22 bp, Artificial Sequence
  Synthetic oligonucleotide; CTG chr11 5199725 5199746 5199730 5199725 -
aaaagatattgagagatattga

SEQ ID NO: 148186 - DNA, 22 bp, Artificial Sequence
  Synthetic oligonucleotide; TTG chr11 5199714 5199735 5199719 5199714 -
agagatattgagatgtattgcc

SEQ ID NO: 148187 - DNA, 22 bp, Artificial Sequence
  Synthetic oligonucleotide; TTG chr11 5199704 5199725 5199709 5199704 -
agatgtattgcctaaaaaaaag

SEQ ID NO: 148188 - DNA, 22 bp, Artificial Sequence
  Synthetic oligonucleotide; TTG chr11 5199694 5199715 5199699 5199694 -
cctaaaaaaaagaaagaaaagc

SEQ ID NO: 148189 - DNA, 22 bp, Artificial Sequence
  Synthetic oligonucleotide; CTA chr11 5199690 5199711 5199695 5199690 -
aaaaaaagaaagaaaagcagca

SEQ ID NO: 148190 - DNA, 22 bp, Artificial Sequence
  Synthetic oligonucleotide; TTA chr11 5199625 5199646 5199630 5199625 -
ttaaaattgtagatttactctg

SEQ ID NO: 148191 - DNA, 22 bp, Artificial Sequence
  Synthetic oligonucleotide; TTA chr11 5199622 5199643 5199627 5199622 -
aaattgtagatttactctgagt

SEQ ID NO: 148192 - DNA, 22 bp, Artificial Sequence
  Synthetic oligonucleotide; TTG chr11 5199616 5199637 5199621 5199616 -
tagatttactctgagtccatga

SEQ ID NO: 148193 - DNA, 22 bp, Artificial Sequence
  Synthetic oligonucleotide; TTT chr11 5199609 5199630 5199614 5199609 -
actctgagtccatgacaaatga

SEQ ID NO: 148194 - DNA, 22 bp, Artificial Sequence
  Synthetic oligonucleotide; TTA chr11 5199608 5199629 5199613 5199608 -
ctctgagtccatgacaaatgac

SEQ ID NO: 148195 - DNA, 22 bp, Artificial Sequence
  Synthetic oligonucleotide; CTC chr11 5199605 5199626 5199610 5199605 -
tgagtccatgacaaatgacctt

SEQ ID NO: 148196 - DNA, 22 bp, Artificial Sequence
  Synthetic oligonucleotide; CTG chr11 5199603 5199624 5199608 5199603 -
agtccatgacaaatgaccttaa

SEQ ID NO: 148197 - DNA, 22 bp, Artificial Sequence
  Synthetic oligonucleotide; CTT chr11 5199583 5199604 5199588 5199583 -
aaaaaatatttaaatatagtca

SEQ ID NO: 148198 - DNA, 22 bp, Artificial Sequence
  Synthetic oligonucleotide; TTA chr11 5199582 5199603 5199587 5199582 -
aaaaatatttaaatatagtcag

SEQ ID NO: 148199 - DNA, 22 bp, Artificial Sequence
  Synthetic oligonucleotide; TTT chr11 5199572 5199593 5199577 5199572 -
aaatatagtcagagaatcaaca

SEQ ID NO: 148200 - DNA, 22 bp, Artificial Sequence
  Synthetic oligonucleotide; TTA chr11 5199571 5199592 5199576 5199571 -
aatatagtcagagaatcaacaa

SEQ ID NO: 148201 - DNA, 22 bp, Artificial Sequence
  Synthetic oligonucleotide; TTC chr11 5199541 5199562 5199546 5199541 -
cattgtgtcagcctggacacat

SEQ ID NO: 148202 - DNA, 22 bp, Artificial Sequence
  Synthetic oligonucleotide; TTG chr11 5199536 5199557 5199541 5199536 -
tgtcagcctggacacatgtagg

SEQ ID NO: 148203 - DNA, 22 bp, Artificial Sequence
  Synthetic oligonucleotide; CTG chr11 5199526 5199547 5199531 5199526 -
gacacatgtaggtcactctatc

SEQ ID NO: 148204 - DNA, 22 bp, Artificial Sequence
  Synthetic oligonucleotide; CTC chr11 5199508 5199529 5199513 5199508 -
tatcagtctgaccatatttaag

SEQ ID NO: 148205 - DNA, 22 bp, Artificial Sequence
  Synthetic oligonucleotide; CTA chr11 5199506 5199527 5199511 5199506 -
tcagtctgaccatatttaagaa

SEQ ID NO: 148206 - DNA, 22 bp, Artificial Sequence
  Synthetic oligonucleotide; CTG chr11 5199498 5199519 5199503 5199498 -
accatatttaagaaagaggaaa

SEQ ID NO: 148207 - DNA, 22 bp, Artificial Sequence
  Synthetic oligonucleotide; TTT chr11 5199489 5199510 5199494 5199489 -
aagaaagaggaaaaaattgttt

SEQ ID NO: 148208 - DNA, 22 bp, Artificial Sequence
  Synthetic oligonucleotide; TTA chr11 5199488 5199509 5199493 5199488 -
agaaagaggaaaaaattgttta

SEQ ID NO: 148209 - DNA, 22 bp, Artificial Sequence
  Synthetic oligonucleotide; TTG chr11 5199470 5199491 5199475 5199470 -
tttatttgcctgaaatgtactt

SEQ ID NO: 148210 - DNA, 22 bp, Artificial Sequence
  Synthetic oligonucleotide; TTT chr11 5199467 5199488 5199472 5199467 -
atttgcctgaaatgtacttttg

SEQ ID NO: 148211 - DNA, 22 bp, Artificial Sequence
  Synthetic oligonucleotide; TTA chr11 5199466 5199487 5199471 5199466 -
tttgcctgaaatgtacttttga

SEQ ID NO: 148212 - DNA, 22 bp, Artificial Sequence
  Synthetic oligonucleotide; TTT chr11 5199463 5199484 5199468 5199463 -
gcctgaaatgtacttttgagca

SEQ ID NO: 148213 - DNA, 22 bp, Artificial Sequence
  Synthetic oligonucleotide; TTG chr11 5199462 5199483 5199467 5199462 -
cctgaaatgtacttttgagcat

SEQ ID NO: 148214 - DNA, 22 bp, Artificial Sequence
  Synthetic oligonucleotide; CTG chr11 5199458 5199479 5199463 5199458 -
aaatgtacttttgagcatttcc

SEQ ID NO: 148215 - DNA, 22 bp, Artificial Sequence
  Synthetic oligonucleotide; CTT chr11 5199448 5199469 5199453 5199448 -
ttgagcatttcctttgctgtaa

SEQ ID NO: 148216 - DNA, 22 bp, Artificial Sequence
  Synthetic oligonucleotide; TTT chr11 5199447 5199468 5199452 5199447 -
tgagcatttcctttgctgtaaa

SEQ ID NO: 148217 - DNA, 22 bp, Artificial Sequence
  Synthetic oligonucleotide; TTT chr11 5199446 5199467 5199451 5199446 -
gagcatttcctttgctgtaaaa

SEQ ID NO: 148218 - DNA, 22 bp, Artificial Sequence
  Synthetic oligonucleotide; TTG chr11 5199445 5199466 5199450 5199445 -
agcatttcctttgctgtaaaac

SEQ ID NO: 148219 - DNA, 22 bp, Artificial Sequence
  Synthetic oligonucleotide; TTT chr11 5199438 5199459 5199443 5199438 -
cctttgctgtaaaacaaagctg

SEQ ID NO: 148220 - DNA, 22 bp, Artificial Sequence
  Synthetic oligonucleotide; TTC chr11 5199437 5199458 5199442 5199437 -
ctttgctgtaaaacaaagctgg

SEQ ID NO: 148221 - DNA, 22 bp, Artificial Sequence
  Synthetic oligonucleotide; CTT chr11 5199434 5199455 5199439 5199434 -
tgctgtaaaacaaagctggatt

SEQ ID NO: 148222 - DNA, 22 bp, Artificial Sequence
  Synthetic oligonucleotide; TTT chr11 5199433 5199454 5199438 5199433 -
gctgtaaaacaaagctggatta

SEQ ID NO: 148223 - DNA, 22 bp, Artificial Sequence
  Synthetic oligonucleotide; TTG chr11 5199432 5199453 5199437 5199432 -
ctgtaaaacaaagctggattaa

SEQ ID NO: 148224 - DNA, 22 bp, Artificial Sequence
  Synthetic oligonucleotide; CTG chr11 5199429 5199450 5199434 5199429 -
taaaacaaagctggattaaaaa

SEQ ID NO: 148225 - DNA, 22 bp, Artificial Sequence
  Synthetic oligonucleotide; CTG chr11 5199416 5199437 5199421 5199416 -
gattaaaaacctaggttttcaa

SEQ ID NO: 148226 - DNA, 22 bp, Artificial Sequence
  Synthetic oligonucleotide; TTA chr11 5199411 5199432 5199416 5199411 -
aaaacctaggttttcaagtttc

SEQ ID NO: 148227 - DNA, 22 bp, Artificial Sequence
  Synthetic oligonucleotide; CTA chr11 5199403 5199424 5199408 5199403 -
ggttttcaagtttcaaagtaga

SEQ ID NO: 148228 - DNA, 22 bp, Artificial Sequence
  Synthetic oligonucleotide; TTT chr11 5199398 5199419 5199403 5199398 -
tcaagtttcaaagtagaaaact

SEQ ID NO: 148229 - DNA, 22 bp, Artificial Sequence
  Synthetic oligonucleotide; TTT chr11 5199397 5199418 5199402 5199397 -
caagtttcaaagtagaaaactt

SEQ ID NO: 148230 - DNA, 22 bp, Artificial Sequence
  Synthetic oligonucleotide; TTC chr11 5199396 5199417 5199401 5199396 -
aagtttcaaagtagaaaacttg

SEQ ID NO: 148231 - DNA, 22 bp, Artificial Sequence
  Synthetic oligonucleotide; TTT chr11 5199390 5199411 5199395 5199390 -
caaagtagaaaacttgaagttt

SEQ ID NO: 148232 - DNA, 22 bp, Artificial Sequence
  Synthetic oligonucleotide; TTC chr11 5199389 5199410 5199394 5199389 -
aaagtagaaaacttgaagtttc

SEQ ID NO: 148233 - DNA, 22 bp, Artificial Sequence
  Synthetic oligonucleotide; CTT chr11 5199375 5199396 5199380 5199375 -
gaagtttctttcattctctgag

SEQ ID NO: 148234 - DNA, 22 bp, Artificial Sequence
  Synthetic oligonucleotide; TTG chr11 5199374 5199395 5199379 5199374 -
aagtttctttcattctctgagg

SEQ ID NO: 148235 - DNA, 22 bp, Artificial Sequence
  Synthetic oligonucleotide; TTT chr11 5199368 5199389 5199373 5199368 -
ctttcattctctgaggtttact

SEQ ID NO: 148236 - DNA, 22 bp, Artificial Sequence
  Synthetic oligonucleotide; TTC chr11 5199367 5199388 5199372 5199367 -
tttcattctctgaggtttactt

SEQ ID NO: 148237 - DNA, 22 bp, Artificial Sequence
  Synthetic oligonucleotide; CTT chr11 5199365 5199386 5199370 5199365 -
tcattctctgaggtttacttaa

SEQ ID NO: 148238 - DNA, 22 bp, Artificial Sequence
  Synthetic oligonucleotide; TTT chr11 5199364 5199385 5199369 5199364 -
cattctctgaggtttacttaat

SEQ ID NO: 148239 - DNA, 22 bp, Artificial Sequence
  Synthetic oligonucleotide; TTC chr11 5199363 5199384 5199368 5199363 -
attctctgaggtttacttaatt

SEQ ID NO: 148240 - DNA, 22 bp, Artificial Sequence
  Synthetic oligonucleotide; TTC chr11 5199359 5199380 5199364 5199359 -
tctgaggtttacttaattaacc

SEQ ID NO: 148241 - DNA, 22 bp, Artificial Sequence
  Synthetic oligonucleotide; CTC chr11 5199357 5199378 5199362 5199357 -
tgaggtttacttaattaacctt

SEQ ID NO: 148242 - DNA, 22 bp, Artificial Sequence
  Synthetic oligonucleotide; CTG chr11 5199355 5199376 5199360 5199355 -
aggtttacttaattaaccttca

SEQ ID NO: 148243 - DNA, 22 bp, Artificial Sequence
  Synthetic oligonucleotide; TTT chr11 5199349 5199370 5199354 5199349 -
acttaattaaccttcaaaatgg

SEQ ID NO: 148244 - DNA, 22 bp, Artificial Sequence
  Synthetic oligonucleotide; TTA chr11 5199348 5199369 5199353 5199348 -
cttaattaaccttcaaaatgga

SEQ ID NO: 148245 - DNA, 22 bp, Artificial Sequence
  Synthetic oligonucleotide; CTT chr11 5199345 5199366 5199350 5199345 -
aattaaccttcaaaatggagac

SEQ ID NO: 148246 - DNA, 22 bp, Artificial Sequence
  Synthetic oligonucleotide; TTA chr11 5199344 5199365 5199349 5199344 -
attaaccttcaaaatggagact

SEQ ID NO: 148247 - DNA, 22 bp, Artificial Sequence
  Synthetic oligonucleotide; TTA chr11 5199340 5199361 5199345 5199340 -
accttcaaaatggagactatag

SEQ ID NO: 148248 - DNA, 22 bp, Artificial Sequence
  Synthetic oligonucleotide; CTT chr11 5199335 5199356 5199340 5199335 -
caaaatggagactatagccaac

SEQ ID NO: 148249 - DNA, 22 bp, Artificial Sequence
  Synthetic oligonucleotide; TTC chr11 5199334 5199355 5199339 5199334 -
aaaatggagactatagccaact

SEQ ID NO: 148250 - DNA, 22 bp, Artificial Sequence
  Synthetic oligonucleotide; CTA chr11 5199321 5199342 5199326 5199321 -
tagccaactcacaggaatgttg

SEQ ID NO: 148251 - DNA, 22 bp, Artificial Sequence
  Synthetic oligonucleotide; CTC chr11 5199311 5199332 5199316 5199311 -
acaggaatgttgtgatatctgt

SEQ ID NO: 148252 - DNA, 22 bp, Artificial Sequence
  Synthetic oligonucleotide; TTG chr11 5199299 5199320 5199304 5199299 -
tgatatctgtatggaccagaat

SEQ ID NO: 148253 - DNA, 22 bp, Artificial Sequence
  Synthetic oligonucleotide; CTG chr11 5199290 5199311 5199295 5199290 -
tatggaccagaattgtccaagg

SEQ ID NO: 148254 - DNA, 22 bp, Artificial Sequence
  Synthetic oligonucleotide; TTG chr11 5199275 5199296 5199280 5199275 -
tccaagggaacttttctaaact

SEQ ID NO: 148255 - DNA, 22 bp, Artificial Sequence
  Synthetic oligonucleotide; CTT chr11 5199262 5199283 5199267 5199262 -
ttctaaactgatggcgatgttc

SEQ ID NO: 148256 - DNA, 22 bp, Artificial Sequence
  Synthetic oligonucleotide; TTT chr11 5199261 5199282 5199266 5199261 -
tctaaactgatggcgatgttct

SEQ ID NO: 148257 - DNA, 22 bp, Artificial Sequence
  Synthetic oligonucleotide; TTT chr11 5199260 5199281 5199265 5199260 -
ctaaactgatggcgatgttcta

SEQ ID NO: 148258 - DNA, 22 bp, Artificial Sequence
  Synthetic oligonucleotide; TTC chr11 5199259 5199280 5199264 5199259 -
taaactgatggcgatgttctat

SEQ ID NO: 148259 - DNA, 22 bp, Artificial Sequence
  Synthetic oligonucleotide; CTA chr11 5199257 5199278 5199262 5199257 -
aactgatggcgatgttctataa

SEQ ID NO: 148260 - DNA, 22 bp, Artificial Sequence
  Synthetic oligonucleotide; CTG chr11 5199252 5199273 5199257 5199252 -
atggcgatgttctataaaatac

SEQ ID NO: 148261 - DNA, 22 bp, Artificial Sequence
  Synthetic oligonucleotide; TTC chr11 5199240 5199261 5199245 5199240 -
tataaaataccataaaatggct

SEQ ID NO: 148262 - DNA, 22 bp, Artificial Sequence
  Synthetic oligonucleotide; CTA chr11 5199238 5199259 5199243 5199238 -
taaaataccataaaatggctaa

SEQ ID NO: 148263 - DNA, 22 bp, Artificial Sequence
  Synthetic oligonucleotide; CTA chr11 5199217 5199238 5199222 5199217 -
aagtggaatatatggctcctgt

SEQ ID NO: 148264 - DNA, 22 bp, Artificial Sequence
  Synthetic oligonucleotide; CTC chr11 5199199 5199220 5199204 5199199 -
ctgtgcgcttgaaatgatggta

SEQ ID NO: 148265 - DNA, 22 bp, Artificial Sequence
  Synthetic oligonucleotide; CTG chr11 5199196 5199217 5199201 5199196 -
tgcgcttgaaatgatggtagtg

SEQ ID NO: 148266 - DNA, 22 bp, Artificial Sequence
  Synthetic oligonucleotide; CTT chr11 5199189 5199210 5199194 5199189 -
gaaatgatggtagtgtaattga

SEQ ID NO: 148267 - DNA, 22 bp, Artificial Sequence
  Synthetic oligonucleotide; TTG chr11 5199188 5199209 5199193 5199188 -
aaatgatggtagtgtaattgaa

SEQ ID NO: 148268 - DNA, 22 bp, Artificial Sequence
  Synthetic oligonucleotide; TTG chr11 5199168 5199189 5199173 5199168 -
aacaactgcatttacaatttca

SEQ ID NO: 148269 - DNA, 22 bp, Artificial Sequence
  Synthetic oligonucleotide; CTG chr11 5199160 5199181 5199165 5199160 -
catttacaatttcagttacttt

SEQ ID NO: 148270 - DNA, 22 bp, Artificial Sequence
  Synthetic oligonucleotide; TTT chr11 5199155 5199176 5199160 5199155 -
acaatttcagttactttaagtt

SEQ ID NO: 148271 - DNA, 22 bp, Artificial Sequence
  Synthetic oligonucleotide; TTA chr11 5199154 5199175 5199159 5199154 -
caatttcagttactttaagtta

SEQ ID NO: 148272 - DNA, 22 bp, Artificial Sequence
  Synthetic oligonucleotide; TTT chr11 5199148 5199169 5199153 5199148 -
cagttactttaagttaatttat

SEQ ID NO: 148273 - DNA, 22 bp, Artificial Sequence
  Synthetic oligonucleotide; TTC chr11 5199147 5199168 5199152 5199147 -
agttactttaagttaatttata

SEQ ID NO: 148274 - DNA, 22 bp, Artificial Sequence
  Synthetic oligonucleotide; TTA chr11 5199142 5199163 5199147 5199142 -
ctttaagttaatttatatttaa

SEQ ID NO: 148275 - DNA, 22 bp, Artificial Sequence
  Synthetic oligonucleotide; CTT chr11 5199139 5199160 5199144 5199139 -
taagttaatttatatttaaatg

SEQ ID NO: 148276 - DNA, 22 bp, Artificial Sequence
  Synthetic oligonucleotide; TTT chr11 5199138 5199159 5199143 5199138 -
aagttaatttatatttaaatgt

SEQ ID NO: 148277 - DNA, 22 bp, Artificial Sequence
  Synthetic oligonucleotide; TTA chr11 5199137 5199158 5199142 5199137 -
agttaatttatatttaaatgtt

SEQ ID NO: 148278 - DNA, 22 bp, Artificial Sequence
  Synthetic oligonucleotide; TTA chr11 5199132 5199153 5199137 5199132 -
atttatatttaaatgtttaatg

SEQ ID NO: 148279 - DNA, 22 bp, Artificial Sequence
  Synthetic oligonucleotide; TTT chr11 5199128 5199149 5199133 5199128 -
atatttaaatgtttaatgtcct

SEQ ID NO: 148280 - DNA, 22 bp, Artificial Sequence
  Synthetic oligonucleotide; TTA chr11 5199127 5199148 5199132 5199127 -
tatttaaatgtttaatgtcctt

SEQ ID NO: 148281 - DNA, 22 bp, Artificial Sequence
  Synthetic oligonucleotide; TTT chr11 5199122 5199143 5199127 5199122 -
aaatgtttaatgtccttgtatt

SEQ ID NO: 148282 - DNA, 22 bp, Artificial Sequence
  Synthetic oligonucleotide; TTA chr11 5199121 5199142 5199126 5199121 -
aatgtttaatgtccttgtattg

SEQ ID NO: 148283 - DNA, 22 bp, Artificial Sequence
  Synthetic oligonucleotide; TTT chr11 5199114 5199135 5199119 5199114 -
aatgtccttgtattggacagtt

SEQ ID NO: 148284 - DNA, 22 bp, Artificial Sequence
  Synthetic oligonucleotide; TTA chr11 5199113 5199134 5199118 5199113 -
atgtccttgtattggacagttc

SEQ ID NO: 148285 - DNA, 22 bp, Artificial Sequence
  Synthetic oligonucleotide; CTT chr11 5199105 5199126 5199110 5199105 -
gtattggacagttcagttcagc

SEQ ID NO: 148286 - DNA, 22 bp, Artificial Sequence
  Synthetic oligonucleotide; TTG chr11 5199104 5199125 5199109 5199104 -
tattggacagttcagttcagca

SEQ ID NO: 148287 - DNA, 22 bp, Artificial Sequence
  Synthetic oligonucleotide; TTG chr11 5199099 5199120 5199104 5199099 -
gacagttcagttcagcagccac

SEQ ID NO: 148288 - DNA, 22 bp, Artificial Sequence
  Synthetic oligonucleotide; TTC chr11 5199091 5199112 5199096 5199091 -
agttcagcagccactatattgg

SEQ ID NO: 148289 - DNA, 22 bp, Artificial Sequence
  Synthetic oligonucleotide; TTC chr11 5199086 5199107 5199091 5199086 -
agcagccactatattggacagg

SEQ ID NO: 148290 - DNA, 22 bp, Artificial Sequence
  Synthetic oligonucleotide; CTA chr11 5199075 5199096 5199080 5199075 -
tattggacagggaagctacagt

SEQ ID NO: 148291 - DNA, 22 bp, Artificial Sequence
  Synthetic oligonucleotide; TTG chr11 5199070 5199091 5199075 5199070 -
gacagggaagctacagttcata

SEQ ID NO: 148292 - DNA, 22 bp, Artificial Sequence
  Synthetic oligonucleotide; CTA chr11 5199057 5199078 5199062 5199057 -
cagttcataaagaggacacaaa

SEQ ID NO: 148293 - DNA, 22 bp, Artificial Sequence
  Synthetic oligonucleotide; TTC chr11 5199051 5199072 5199056 5199051 -
ataaagaggacacaaagaaata

SEQ ID NO: 148294 - DNA, 22 bp, Artificial Sequence
  Synthetic oligonucleotide; CTT chr11 5199023 5199044 5199028 5199023 -
tggattcaacttctaccatgtc

SEQ ID NO: 148295 - DNA, 22 bp, Artificial Sequence
  Synthetic oligonucleotide; TTT chr11 5199022 5199043 5199027 5199022 -
ggattcaacttctaccatgtct

SEQ ID NO: 148296 - DNA, 22 bp, Artificial Sequence
  Synthetic oligonucleotide; TTG chr11 5199021 5199042 5199026 5199021 -
gattcaacttctaccatgtcta

SEQ ID NO: 148297 - DNA, 22 bp, Artificial Sequence
  Synthetic oligonucleotide; TTC chr11 5199016 5199037 5199021 5199016 -
aacttctaccatgtctaattta

SEQ ID NO: 148298 - DNA, 22 bp, Artificial Sequence
  Synthetic oligonucleotide; CTT chr11 5199011 5199032 5199016 5199011 -
ctaccatgtctaatttaaatta

SEQ ID NO: 148299 - DNA, 22 bp, Artificial Sequence
  Synthetic oligonucleotide; TTC chr11 5199010 5199031 5199015 5199010 -
taccatgtctaatttaaattag

SEQ ID NO: 148300 - DNA, 22 bp, Artificial Sequence
  Synthetic oligonucleotide; CTA chr11 5199008 5199029 5199013 5199008 -
ccatgtctaatttaaattagaa

SEQ ID NO: 148301 - DNA, 22 bp, Artificial Sequence
  Synthetic oligonucleotide; CTA chr11 5198999 5199020 5199004 5198999 -
atttaaattagaatccttattt

SEQ ID NO: 148302 - DNA, 22 bp, Artificial Sequence
  Synthetic oligonucleotide; TTT chr11 5198995 5199016 5199000 5198995 -
aaattagaatccttatttttta

SEQ ID NO: 148303 - DNA, 22 bp, Artificial Sequence
  Synthetic oligonucleotide; TTA chr11 5198994 5199015 5198999 5198994 -
aattagaatccttattttttag

SEQ ID NO: 148304 - DNA, 22 bp, Artificial Sequence
  Synthetic oligonucleotide; TTA chr11 5198989 5199010 5198994 5198989 -
gaatccttattttttagatttt

SEQ ID NO: 148305 - DNA, 22 bp, Artificial Sequence
  Synthetic oligonucleotide; CTT chr11 5198981 5199002 5198986 5198981 -
attttttagattttatatgtgg

SEQ ID NO: 148306 - DNA, 22 bp, Artificial Sequence
  Synthetic oligonucleotide; TTA chr11 5198980 5199001 5198985 5198980 -
ttttttagattttatatgtgga

SEQ ID NO: 148307 - DNA, 22 bp, Artificial Sequence
  Synthetic oligonucleotide; TTT chr11 5198977 5198998 5198982 5198977 -
tttagattttatatgtggactc

SEQ ID NO: 148308 - DNA, 22 bp, Artificial Sequence
  Synthetic oligonucleotide; TTT chr11 5198976 5198997 5198981 5198976 -
ttagattttatatgtggactcc

SEQ ID NO: 148309 - DNA, 22 bp, Artificial Sequence
  Synthetic oligonucleotide; TTT chr11 5198975 5198996 5198980 5198975 -
tagattttatatgtggactcca

SEQ ID NO: 148310 - DNA, 22 bp, Artificial Sequence
  Synthetic oligonucleotide; TTT chr11 5198974 5198995 5198979 5198974 -
agattttatatgtggactccac

SEQ ID NO: 148311 - DNA, 22 bp, Artificial Sequence
  Synthetic oligonucleotide; TTA chr11 5198973 5198994 5198978 5198973 -
gattttatatgtggactccact

SEQ ID NO: 148312 - DNA, 22 bp, Artificial Sequence
  Synthetic oligonucleotide; TTT chr11 5198968 5198989 5198973 5198968 -
tatatgtggactccactgctac

SEQ ID NO: 148313 - DNA, 22 bp, Artificial Sequence
  Synthetic oligonucleotide; TTT chr11 5198967 5198988 5198972 5198967 -
atatgtggactccactgctaca

SEQ ID NO: 148314 - DNA, 22 bp, Artificial Sequence
  Synthetic oligonucleotide; TTA chr11 5198966 5198987 5198971 5198966 -
tatgtggactccactgctacaa

SEQ ID NO: 148315 - DNA, 22 bp, Artificial Sequence
  Synthetic oligonucleotide; CTC chr11 5198955 5198976 5198960 5198955 -
cactgctacaaggctggaagca

SEQ ID NO: 148316 - DNA, 22 bp, Artificial Sequence
  Synthetic oligonucleotide; CTG chr11 5198950 5198971 5198955 5198950 -
ctacaaggctggaagcagattt

SEQ ID NO: 148317 - DNA, 22 bp, Artificial Sequence
  Synthetic oligonucleotide; CTA chr11 5198947 5198968 5198952 5198947 -
caaggctggaagcagattttgc

SEQ ID NO: 148318 - DNA, 22 bp, Artificial Sequence
  Synthetic oligonucleotide; CTG chr11 5198939 5198960 5198944 5198939 -
gaagcagattttgctctagatc

SEQ ID NO: 148319 - DNA, 22 bp, Artificial Sequence
  Synthetic oligonucleotide; TTT chr11 5198928 5198949 5198933 5198928 -
tgctctagatcttttgctttta

SEQ ID NO: 148320 - DNA, 22 bp, Artificial Sequence
  Synthetic oligonucleotide; TTT chr11 5198927 5198948 5198932 5198927 -
gctctagatcttttgcttttat

SEQ ID NO: 148321 - DNA, 22 bp, Artificial Sequence
  Synthetic oligonucleotide; TTG chr11 5198926 5198947 5198931 5198926 -
ctctagatcttttgcttttata

SEQ ID NO: 148322 - DNA, 22 bp, Artificial Sequence
  Synthetic oligonucleotide; CTC chr11 5198923 5198944 5198928 5198923 -
tagatcttttgcttttatatct

SEQ ID NO: 148323 - DNA, 22 bp, Artificial Sequence
  Synthetic oligonucleotide; CTA chr11 5198921 5198942 5198926 5198921 -
gatcttttgcttttatatctaa

SEQ ID NO: 148324 - DNA, 22 bp, Artificial Sequence
  Synthetic oligonucleotide; CTT chr11 5198915 5198936 5198920 5198915 -
ttgcttttatatctaagtgggg

SEQ ID NO: 148325 - DNA, 22 bp, Artificial Sequence
  Synthetic oligonucleotide; TTT chr11 5198914 5198935 5198919 5198914 -
tgcttttatatctaagtggggg

SEQ ID NO: 148326 - DNA, 22 bp, Artificial Sequence
  Synthetic oligonucleotide; TTT chr11 5198913 5198934 5198918 5198913 -
gcttttatatctaagtggggga

SEQ ID NO: 148327 - DNA, 22 bp, Artificial Sequence
  Synthetic oligonucleotide; TTG chr11 5198912 5198933 5198917 5198912 -
cttttatatctaagtgggggat

SEQ ID NO: 148328 - DNA, 22 bp, Artificial Sequence
  Synthetic oligonucleotide; CTT chr11 5198909 5198930 5198914 5198909 -
ttatatctaagtgggggatctt

SEQ ID NO: 148329 - DNA, 22 bp, Artificial Sequence
  Synthetic oligonucleotide; TTT chr11 5198908 5198929 5198913 5198908 -
tatatctaagtgggggatcttc

SEQ ID NO: 148330 - DNA, 22 bp, Artificial Sequence
  Synthetic oligonucleotide; TTT chr11 5198907 5198928 5198912 5198907 -
atatctaagtgggggatcttct

SEQ ID NO: 148331 - DNA, 22 bp, Artificial Sequence
  Synthetic oligonucleotide; TTA chr11 5198906 5198927 5198911 5198906 -
tatctaagtgggggatcttctg

SEQ ID NO: 148332 - DNA, 22 bp, Artificial Sequence
  Synthetic oligonucleotide; CTA chr11 5198900 5198921 5198905 5198900 -
agtgggggatcttctgaacaga

SEQ ID NO: 148333 - DNA, 22 bp, Artificial Sequence
  Synthetic oligonucleotide; CTT chr11 5198887 5198908 5198892 5198887 -
ctgaacagatgagactgtccgc

SEQ ID NO: 148334 - DNA, 22 bp, Artificial Sequence
  Synthetic oligonucleotide; TTC chr11 5198886 5198907 5198891 5198886 -
tgaacagatgagactgtccgct

SEQ ID NO: 148335 - DNA, 22 bp, Artificial Sequence
  Synthetic oligonucleotide; CTG chr11 5198884 5198905 5198889 5198884 -
aacagatgagactgtccgctac

SEQ ID NO: 148336 - DNA, 22 bp, Artificial Sequence
  Synthetic oligonucleotide; CTG chr11 5198870 5198891 5198875 5198870 -
tccgctaccgacttattctgag

SEQ ID NO: 148337 - DNA, 22 bp, Artificial Sequence
  Synthetic oligonucleotide; CTA chr11 5198863 5198884 5198868 5198863 -
ccgacttattctgagtttaaaa

SEQ ID NO: 148338 - DNA, 22 bp, Artificial Sequence
  Synthetic oligonucleotide; CTT chr11 5198856 5198877 5198861 5198856 -
attctgagtttaaaagaaaaaa

SEQ ID NO: 148339 - DNA, 22 bp, Artificial Sequence
  Synthetic oligonucleotide; TTA chr11 5198855 5198876 5198860 5198855 -
ttctgagtttaaaagaaaaaag

SEQ ID NO: 148340 - DNA, 22 bp, Artificial Sequence
  Synthetic oligonucleotide; TTC chr11 5198852 5198873 5198857 5198852 -
tgagtttaaaagaaaaaagata

SEQ ID NO: 148341 - DNA, 22 bp, Artificial Sequence
  Synthetic oligonucleotide; CTG chr11 5198850 5198871 5198855 5198850 -
agtttaaaagaaaaaagataaa

SEQ ID NO: 148342 - DNA, 22 bp, Artificial Sequence
  Synthetic oligonucleotide; TTT chr11 5198845 5198866 5198850 5198845 -
aaaagaaaaaagataaaagaac

SEQ ID NO: 148343 - DNA, 22 bp, Artificial Sequence
  Synthetic oligonucleotide; TTA chr11 5198844 5198865 5198849 5198844 -
aaagaaaaaagataaaagaaca

SEQ ID NO: 148344 - DNA, 22 bp, Artificial Sequence
  Synthetic oligonucleotide; TTC chr11 5198811 5198832 5198816 5198811 -
ttttctaagtaagctagtgcag

SEQ ID NO: 148345 - DNA, 22 bp, Artificial Sequence
  Synthetic oligonucleotide; CTT chr11 5198809 5198830 5198814 5198809 -
ttctaagtaagctagtgcagct

SEQ ID NO: 148346 - DNA, 22 bp, Artificial Sequence
  Synthetic oligonucleotide; TTT chr11 5198808 5198829 5198813 5198808 -
tctaagtaagctagtgcagctt

SEQ ID NO: 148347 - DNA, 22 bp, Artificial Sequence
  Synthetic oligonucleotide; TTT chr11 5198807 5198828 5198812 5198807 -
ctaagtaagctagtgcagcttt

SEQ ID NO: 148348 - DNA, 22 bp, Artificial Sequence
  Synthetic oligonucleotide; TTC chr11 5198806 5198827 5198811 5198806 -
taagtaagctagtgcagctttc

SEQ ID NO: 148349 - DNA, 22 bp, Artificial Sequence
  Synthetic oligonucleotide; CTA chr11 5198804 5198825 5198809 5198804 -
agtaagctagtgcagctttcca

SEQ ID NO: 148350 - DNA, 22 bp, Artificial Sequence
  Synthetic oligonucleotide; CTA chr11 5198795 5198816 5198800 5198795 -
gtgcagctttccaaagaaggaa

SEQ ID NO: 148351 - DNA, 22 bp, Artificial Sequence
  Synthetic oligonucleotide; CTT chr11 5198786 5198807 5198791 5198786 -
tccaaagaaggaaagaaaggaa

SEQ ID NO: 148352 - DNA, 22 bp, Artificial Sequence
  Synthetic oligonucleotide; TTT chr11 5198785 5198806 5198790 5198785 -
ccaaagaaggaaagaaaggaag

SEQ ID NO: 148353 - DNA, 22 bp, Artificial Sequence
  Synthetic oligonucleotide; TTC chr11 5198784 5198805 5198789 5198784 -
caaagaaggaaagaaaggaagg

SEQ ID NO: 148354 - DNA, 22 bp, Artificial Sequence
  Synthetic oligonucleotide; CTA chr11 5198744 5198765 5198749 5198744 -
tgcatggataacaagaaaataa

SEQ ID NO: 148355 - DNA, 22 bp, Artificial Sequence
  Synthetic oligonucleotide; TTG chr11 5198719 5198740 5198724 5198719 -
ttttaatcttcctatattctat

SEQ ID NO: 148356 - DNA, 22 bp, Artificial Sequence
  Synthetic oligonucleotide; TTT chr11 5198716 5198737 5198721 5198716 -
taatcttcctatattctattag

SEQ ID NO: 148357 - DNA, 22 bp, Artificial Sequence
  Synthetic oligonucleotide; TTT chr11 5198715 5198736 5198720 5198715 -
aatcttcctatattctattagg

SEQ ID NO: 148358 - DNA, 22 bp, Artificial Sequence
  Synthetic oligonucleotide; TTA chr11 5198714 5198735 5198719 5198714 -
atcttcctatattctattaggt

SEQ ID NO: 148359 - DNA, 22 bp, Artificial Sequence
  Synthetic oligonucleotide; CTT chr11 5198709 5198730 5198714 5198709 -
cctatattctattaggtatcta

SEQ ID NO: 148360 - DNA, 22 bp, Artificial Sequence
  Synthetic oligonucleotide; TTC chr11 5198708 5198729 5198713 5198708 -
ctatattctattaggtatctaa

SEQ ID NO: 148361 - DNA, 22 bp, Artificial Sequence
  Synthetic oligonucleotide; CTA chr11 5198705 5198726 5198710 5198705 -
tattctattaggtatctaagaa

SEQ ID NO: 148362 - DNA, 22 bp, Artificial Sequence
  Synthetic oligonucleotide; TTC chr11 5198700 5198721 5198705 5198700 -
tattaggtatctaagaaggtaa

SEQ ID NO: 148363 - DNA, 22 bp, Artificial Sequence
  Synthetic oligonucleotide; CTA chr11 5198698 5198719 5198703 5198698 -
ttaggtatctaagaaggtaagt

SEQ ID NO: 148364 - DNA, 22 bp, Artificial Sequence
  Synthetic oligonucleotide; TTA chr11 5198695 5198716 5198700 5198695 -
ggtatctaagaaggtaagtgtt

SEQ ID NO: 148365 - DNA, 22 bp, Artificial Sequence
  Synthetic oligonucleotide; CTA chr11 5198687 5198708 5198692 5198687 -
agaaggtaagtgttaaaattgg

SEQ ID NO: 148366 - DNA, 22 bp, Artificial Sequence
  Synthetic oligonucleotide; TTA chr11 5198672 5198693 5198677 5198672 -
aaattggacaaattaatgcata

SEQ ID NO: 148367 - DNA, 22 bp, Artificial Sequence
  Synthetic oligonucleotide; TTG chr11 5198666 5198687 5198671 5198666 -
gacaaattaatgcataagagtc

SEQ ID NO: 148368 - DNA, 22 bp, Artificial Sequence
  Synthetic oligonucleotide; TTA chr11 5198657 5198678 5198662 5198657 -
atgcataagagtcattttacac

SEQ ID NO: 148369 - DNA, 22 bp, Artificial Sequence
  Synthetic oligonucleotide; TTT chr11 5198640 5198661 5198645 5198640 -
tacaccaaaaagcaaatattta

SEQ ID NO: 148370 - DNA, 22 bp, Artificial Sequence
  Synthetic oligonucleotide; TTT chr11 5198639 5198660 5198644 5198639 -
acaccaaaaagcaaatatttat

SEQ ID NO: 148371 - DNA, 22 bp, Artificial Sequence
  Synthetic oligonucleotide; TTA chr11 5198638 5198659 5198643 5198638 -
caccaaaaagcaaatatttatt

SEQ ID NO: 148372 - DNA, 22 bp, Artificial Sequence
  Synthetic oligonucleotide; TTT chr11 5198619 5198640 5198624 5198619 -
atttttatttttagatatcaac

SEQ ID NO: 148373 - DNA, 22 bp, Artificial Sequence
  Synthetic oligonucleotide; TTA chr11 5198618 5198639 5198623 5198618 -
tttttatttttagatatcaact

SEQ ID NO: 148374 - DNA, 22 bp, Artificial Sequence
  Synthetic oligonucleotide; TTT chr11 5198615 5198636 5198620 5198615 -
ttatttttagatatcaactaaa

SEQ ID NO: 148375 - DNA, 22 bp, Artificial Sequence
  Synthetic oligonucleotide; TTT chr11 5198614 5198635 5198619 5198614 -
tatttttagatatcaactaaaa

SEQ ID NO: 148376 - DNA, 22 bp, Artificial Sequence
  Synthetic oligonucleotide; TTT chr11 5198613 5198634 5198618 5198613 -
atttttagatatcaactaaaac

SEQ ID NO: 148377 - DNA, 22 bp, Artificial Sequence
  Synthetic oligonucleotide; TTA chr11 5198612 5198633 5198617 5198612 -
tttttagatatcaactaaaaca

SEQ ID NO: 148378 - DNA, 22 bp, Artificial Sequence
  Synthetic oligonucleotide; TTT chr11 5198609 5198630 5198614 5198609 -
ttagatatcaactaaaacaacc

SEQ ID NO: 148379 - DNA, 22 bp, Artificial Sequence
  Synthetic oligonucleotide; TTT chr11 5198608 5198629 5198613 5198608 -
tagatatcaactaaaacaacca

SEQ ID NO: 148380 - DNA, 22 bp, Artificial Sequence
  Synthetic oligonucleotide; TTT chr11 5198607 5198628 5198612 5198607 -
agatatcaactaaaacaaccag

SEQ ID NO: 148381 - DNA, 22 bp, Artificial Sequence
  Synthetic oligonucleotide; TTA chr11 5198606 5198627 5198611 5198606 -
gatatcaactaaaacaaccaga

SEQ ID NO: 148382 - DNA, 22 bp, Artificial Sequence
  Synthetic oligonucleotide; CTA chr11 5198595 5198616 5198600 5198595 -
aaacaaccagatttgtcttcct

SEQ ID NO: 148383 - DNA, 22 bp, Artificial Sequence
  Synthetic oligonucleotide; TTT chr11 5198581 5198602 5198586 5198581 -
gtcttcctgtaattatgccttc

SEQ ID NO: 148384 - DNA, 22 bp, Artificial Sequence
  Synthetic oligonucleotide; TTG chr11 5198580 5198601 5198585 5198580 -
tcttcctgtaattatgccttcc

SEQ ID NO: 148385 - DNA, 22 bp, Artificial Sequence
  Synthetic oligonucleotide; CTT chr11 5198576 5198597 5198581 5198576 -
cctgtaattatgccttcctttc

SEQ ID NO: 148386 - DNA, 22 bp, Artificial Sequence
  Synthetic oligonucleotide; TTC chr11 5198575 5198596 5198580 5198575 -
ctgtaattatgccttcctttcc

SEQ ID NO: 148387 - DNA, 22 bp, Artificial Sequence
  Synthetic oligonucleotide; CTG chr11 5198572 5198593 5198577 5198572 -
taattatgccttcctttccttt

SEQ ID NO: 148388 - DNA, 22 bp, Artificial Sequence
  Synthetic oligonucleotide; TTA chr11 5198566 5198587 5198571 5198566 -
tgccttcctttcctttcacttt

SEQ ID NO: 148389 - DNA, 22 bp, Artificial Sequence
  Synthetic oligonucleotide; CTT chr11 5198560 5198581 5198565 5198560 -
cctttcctttcactttggactt

SEQ ID NO: 148390 - DNA, 22 bp, Artificial Sequence
  Synthetic oligonucleotide; TTC chr11 5198559 5198580 5198564 5198559 -
ctttcctttcactttggacttc

SEQ ID NO: 148391 - DNA, 22 bp, Artificial Sequence
  Synthetic oligonucleotide; CTT chr11 5198556 5198577 5198561 5198556 -
tcctttcactttggacttcatt

SEQ ID NO: 148392 - DNA, 22 bp, Artificial Sequence
  Synthetic oligonucleotide; TTT chr11 5198555 5198576 5198560 5198555 -
cctttcactttggacttcattc

SEQ ID NO: 148393 - DNA, 22 bp, Artificial Sequence
  Synthetic oligonucleotide; TTC chr11 5198554 5198575 5198559 5198554 -
ctttcactttggacttcattca

SEQ ID NO: 148394 - DNA, 22 bp, Artificial Sequence
  Synthetic oligonucleotide; CTT chr11 5198551 5198572 5198556 5198551 -
tcactttggacttcattcaata

SEQ ID NO: 148395 - DNA, 22 bp, Artificial Sequence
  Synthetic oligonucleotide; TTT chr11 5198550 5198571 5198555 5198550 -
cactttggacttcattcaataa

SEQ ID NO: 148396 - DNA, 22 bp, Artificial Sequence
  Synthetic oligonucleotide; TTC chr11 5198549 5198570 5198554 5198549 -
actttggacttcattcaataac

SEQ ID NO: 148397 - DNA, 22 bp, Artificial Sequence
  Synthetic oligonucleotide; CTT chr11 5198545 5198566 5198550 5198545 -
tggacttcattcaataacatag

SEQ ID NO: 148398 - DNA, 22 bp, Artificial Sequence
  Synthetic oligonucleotide; TTT chr11 5198544 5198565 5198549 5198544 -
ggacttcattcaataacatagc

SEQ ID NO: 148399 - DNA, 22 bp, Artificial Sequence
  Synthetic oligonucleotide; TTG chr11 5198543 5198564 5198548 5198543 -
gacttcattcaataacatagcc

SEQ ID NO: 148400 - DNA, 22 bp, Artificial Sequence
  Synthetic oligonucleotide; CTT chr11 5198538 5198559 5198543 5198538 -
cattcaataacatagcctctgt

SEQ ID NO: 148401 - DNA, 22 bp, Artificial Sequence
  Synthetic oligonucleotide; TTC chr11 5198537 5198558 5198542 5198537 -
attcaataacatagcctctgtc

SEQ ID NO: 148402 - DNA, 22 bp, Artificial Sequence
  Synthetic oligonucleotide; TTC chr11 5198533 5198554 5198538 5198533 -
aataacatagcctctgtctact

SEQ ID NO: 148403 - DNA, 22 bp, Artificial Sequence
  Synthetic oligonucleotide; CTC chr11 5198519 5198540 5198524 5198519 -
tgtctacttatttgactcagag

SEQ ID NO: 148404 - DNA, 22 bp, Artificial Sequence
  Synthetic oligonucleotide; CTG chr11 5198517 5198538 5198522 5198517 -
tctacttatttgactcagaggg

SEQ ID NO: 148405 - DNA, 22 bp, Artificial Sequence
  Synthetic oligonucleotide; CTA chr11 5198513 5198534 5198518 5198513 -
cttatttgactcagagggaaac

SEQ ID NO: 148406 - DNA, 22 bp, Artificial Sequence
  Synthetic oligonucleotide; CTT chr11 5198510 5198531 5198515 5198510 -
atttgactcagagggaaacaaa

SEQ ID NO: 148407 - DNA, 22 bp, Artificial Sequence
  Synthetic oligonucleotide; TTA chr11 5198509 5198530 5198514 5198509 -
tttgactcagagggaaacaaaa

SEQ ID NO: 148408 - DNA, 22 bp, Artificial Sequence
  Synthetic oligonucleotide; TTT chr11 5198506 5198527 5198511 5198506 -
gactcagagggaaacaaaaata

SEQ ID NO: 148409 - DNA, 22 bp, Artificial Sequence
  Synthetic oligonucleotide; TTG chr11 5198505 5198526 5198510 5198505 -
actcagagggaaacaaaaatac

SEQ ID NO: 148410 - DNA, 22 bp, Artificial Sequence
  Synthetic oligonucleotide; CTC chr11 5198501 5198522 5198506 5198501 -
agagggaaacaaaaatacaggc

SEQ ID NO: 148411 - DNA, 22 bp, Artificial Sequence
  Synthetic oligonucleotide; CTT chr11 5198477 5198498 5198482 5198477 -
tggtttctaatagcttaagcct

SEQ ID NO: 148412 - DNA, 22 bp, Artificial Sequence
  Synthetic oligonucleotide; TTT chr11 5198476 5198497 5198481 5198476 -
ggtttctaatagcttaagcctc

SEQ ID NO: 148413 - DNA, 22 bp, Artificial Sequence
  Synthetic oligonucleotide; TTG chr11 5198475 5198496 5198480 5198475 -
gtttctaatagcttaagcctca

SEQ ID NO: 148414 - DNA, 22 bp, Artificial Sequence
  Synthetic oligonucleotide; TTT chr11 5198471 5198492 5198476 5198471 -
ctaatagcttaagcctcaaagt

SEQ ID NO: 148415 - DNA, 22 bp, Artificial Sequence
  Synthetic oligonucleotide; TTC chr11 5198470 5198491 5198475 5198470 -
taatagcttaagcctcaaagtg

SEQ ID NO: 148416 - DNA, 22 bp, Artificial Sequence
  Synthetic oligonucleotide; CTA chr11 5198468 5198489 5198473 5198468 -
atagcttaagcctcaaagtgag

SEQ ID NO: 148417 - DNA, 22 bp, Artificial Sequence
  Synthetic oligonucleotide; CTT chr11 5198461 5198482 5198466 5198461 -
aagcctcaaagtgaggaaattg

SEQ ID NO: 148418 - DNA, 22 bp, Artificial Sequence
  Synthetic oligonucleotide; TTA chr11 5198460 5198481 5198465 5198460 -
agcctcaaagtgaggaaattgt

SEQ ID NO: 148419 - DNA, 22 bp, Artificial Sequence
  Synthetic oligonucleotide; CTC chr11 5198454 5198475 5198459 5198454 -
aaagtgaggaaattgtttctgg

SEQ ID NO: 148420 - DNA, 22 bp, Artificial Sequence
  Synthetic oligonucleotide; TTG chr11 5198439 5198460 5198444 5198439 -
tttctggacagagtaaagtatc

SEQ ID NO: 148421 - DNA, 22 bp, Artificial Sequence
  Synthetic oligonucleotide; TTT chr11 5198436 5198457 5198441 5198436 -
ctggacagagtaaagtatctgg

SEQ ID NO: 148422 - DNA, 22 bp, Artificial Sequence
  Synthetic oligonucleotide; TTC chr11 5198435 5198456 5198440 5198435 -
tggacagagtaaagtatctggt

SEQ ID NO: 148423 - DNA, 22 bp, Artificial Sequence
  Synthetic oligonucleotide; CTG chr11 5198433 5198454 5198438 5198433 -
gacagagtaaagtatctggtta

SEQ ID NO: 148424 - DNA, 22 bp, Artificial Sequence
  Synthetic oligonucleotide; CTG chr11 5198415 5198436 5198420 5198415 -
gttagaaagataagtgtaaaat

SEQ ID NO: 148425 - DNA, 22 bp, Artificial Sequence
  Synthetic oligonucleotide; TTA chr11 5198411 5198432 5198416 5198411 -
gaaagataagtgtaaaattatt

SEQ ID NO: 148426 - DNA, 22 bp, Artificial Sequence
  Synthetic oligonucleotide; TTA chr11 5198391 5198412 5198396 5198391 -
ttcctagaacaataaattaggt

SEQ ID NO: 148427 - DNA, 22 bp, Artificial Sequence
  Synthetic oligonucleotide; TTC chr11 5198388 5198409 5198393 5198388 -
ctagaacaataaattaggtctt

SEQ ID NO: 148428 - DNA, 22 bp, Artificial Sequence
  Synthetic oligonucleotide; CTA chr11 5198385 5198406 5198390 5198385 -
gaacaataaattaggtcttctg

SEQ ID NO: 148429 - DNA, 22 bp, Artificial Sequence
  Synthetic oligonucleotide; TTA chr11 5198372 5198393 5198377 5198372 -
ggtcttctgggttacagtataa

SEQ ID NO: 148430 - DNA, 22 bp, Artificial Sequence
  Synthetic oligonucleotide; CTT chr11 5198366 5198387 5198371 5198366 -
ctgggttacagtataaggttaa

SEQ ID NO: 148431 - DNA, 22 bp, Artificial Sequence
  Synthetic oligonucleotide; TTC chr11 5198365 5198386 5198370 5198365 -
tgggttacagtataaggttaat

SEQ ID NO: 148432 - DNA, 22 bp, Artificial Sequence
  Synthetic oligonucleotide; CTG chr11 5198363 5198384 5198368 5198363 -
ggttacagtataaggttaattt

SEQ ID NO: 148433 - DNA, 22 bp, Artificial Sequence
  Synthetic oligonucleotide; TTA chr11 5198358 5198379 5198363 5198358 -
cagtataaggttaatttgaagg

SEQ ID NO: 148434 - DNA, 22 bp, Artificial Sequence
  Synthetic oligonucleotide; TTA chr11 5198345 5198366 5198350 5198345 -
atttgaaggataaaggagtgaa

SEQ ID NO: 148435 - DNA, 22 bp, Artificial Sequence
  Synthetic oligonucleotide; TTT chr11 5198341 5198362 5198346 5198341 -
gaaggataaaggagtgaatttc

SEQ ID NO: 148436 - DNA, 22 bp, Artificial Sequence
  Synthetic oligonucleotide; TTG chr11 5198340 5198361 5198345 5198340 -
aaggataaaggagtgaatttcc

SEQ ID NO: 148437 - DNA, 22 bp, Artificial Sequence
  Synthetic oligonucleotide; TTT chr11 5198320 5198341 5198325 5198320 -
cctgatgtcaaagaggatctag

SEQ ID NO: 148438 - DNA, 22 bp, Artificial Sequence
  Synthetic oligonucleotide; TTC chr11 5198319 5198340 5198324 5198319 -
ctgatgtcaaagaggatctagt

SEQ ID NO: 148439 - DNA, 22 bp, Artificial Sequence
  Synthetic oligonucleotide; CTG chr11 5198316 5198337 5198321 5198316 -
atgtcaaagaggatctagtgca

SEQ ID NO: 148440 - DNA, 22 bp, Artificial Sequence
  Synthetic oligonucleotide; CTA chr11 5198299 5198320 5198304 5198299 -
gtgcatcttctggtatagctat

SEQ ID NO: 148441 - DNA, 22 bp, Artificial Sequence
  Synthetic oligonucleotide; CTT chr11 5198290 5198311 5198295 5198290 -
ctggtatagctatcagaagtga

SEQ ID NO: 148442 - DNA, 22 bp, Artificial Sequence
  Synthetic oligonucleotide; TTC chr11 5198289 5198310 5198294 5198289 -
tggtatagctatcagaagtgaa

SEQ ID NO: 148443 - DNA, 22 bp, Artificial Sequence
  Synthetic oligonucleotide; CTG chr11 5198287 5198308 5198292 5198287 -
gtatagctatcagaagtgaaaa

SEQ ID NO: 148444 - DNA, 22 bp, Artificial Sequence
  Synthetic oligonucleotide; CTA chr11 5198278 5198299 5198283 5198278 -
tcagaagtgaaaactgtgaggt

SEQ ID NO: 148445 - DNA, 22 bp, Artificial Sequence
  Synthetic oligonucleotide; CTG chr11 5198262 5198283 5198267 5198262 -
tgaggtaggttctagaggggaa

SEQ ID NO: 148446 - DNA, 22 bp, Artificial Sequence
  Synthetic oligonucleotide; TTC chr11 5198250 5198271 5198255 5198250 -
tagaggggaaaatgtcaatata

SEQ ID NO: 148447 - DNA, 22 bp, Artificial Sequence
  Synthetic oligonucleotide; CTA chr11 5198248 5198269 5198253 5198248 -
gaggggaaaatgtcaatatata

SEQ ID NO: 148448 - DNA, 22 bp, Artificial Sequence
  Synthetic oligonucleotide; TTT chr11 5198221 5198242 5198226 5198221 -
tttactatataatcatagtagc

SEQ ID NO: 148449 - DNA, 22 bp, Artificial Sequence
  Synthetic oligonucleotide; TTT chr11 5198220 5198241 5198225 5198220 -
ttactatataatcatagtagct

SEQ ID NO: 148450 - DNA, 22 bp, Artificial Sequence
  Synthetic oligonucleotide; TTT chr11 5198219 5198240 5198224 5198219 -
tactatataatcatagtagctg

SEQ ID NO: 148451 - DNA, 22 bp, Artificial Sequence
  Synthetic oligonucleotide; TTT chr11 5198218 5198239 5198223 5198218 -
actatataatcatagtagctgc

SEQ ID NO: 148452 - DNA, 22 bp, Artificial Sequence
  Synthetic oligonucleotide; TTA chr11 5198217 5198238 5198222 5198217 -
ctatataatcatagtagctgcc

SEQ ID NO: 148453 - DNA, 22 bp, Artificial Sequence
  Synthetic oligonucleotide; CTA chr11 5198214 5198235 5198219 5198214 -
tataatcatagtagctgccgag

SEQ ID NO: 148454 - DNA, 22 bp, Artificial Sequence
  Synthetic oligonucleotide; CTG chr11 5198197 5198218 5198202 5198197 -
ccgaggcgggcggatcatgagg

SEQ ID NO: 148455 - DNA, 22 bp, Artificial Sequence
  Synthetic oligonucleotide; CTG chr11 5198153 5198174 5198158 5198153 -
gccagcaatggtgaaaccccgt

SEQ ID NO: 148456 - DNA, 22 bp, Artificial Sequence
  Synthetic oligonucleotide; CTC chr11 5198128 5198149 5198133 5198128 -
tactaaaaaaacacaagaaagt

SEQ ID NO: 148457 - DNA, 22 bp, Artificial Sequence
  Synthetic oligonucleotide; CTA chr11 5198126 5198147 5198131 5198126 -
ctaaaaaaacacaagaaagtat

SEQ ID NO: 148458 - DNA, 22 bp, Artificial Sequence
  Synthetic oligonucleotide; CTA chr11 5198123 5198144 5198128 5198123 -
aaaaaacacaagaaagtatcca

SEQ ID NO: 148459 - DNA, 22 bp, Artificial Sequence
  Synthetic oligonucleotide; CTG chr11 5198081 5198102 5198086 5198081 -
tagtcccaggtactcgggaggc

SEQ ID NO: 148460 - DNA, 22 bp, Artificial Sequence
  Synthetic oligonucleotide; CTC chr11 5198066 5198087 5198071 5198066 -
gggaggctgagacaggagaatg

SEQ ID NO: 148461 - DNA, 22 bp, Artificial Sequence
  Synthetic oligonucleotide; CTG chr11 5198057 5198078 5198062 5198057 -
agacaggagaatggcgtgaacc

SEQ ID NO: 148462 - DNA, 22 bp, Artificial Sequence
  Synthetic oligonucleotide; CTT chr11 5198020 5198041 5198025 5198020 -
gcagtgagtcgagatcacgcca

SEQ ID NO: 148463 - DNA, 22 bp, Artificial Sequence
  Synthetic oligonucleotide; TTG chr11 5198019 5198040 5198024 5198019 -
cagtgagtcgagatcacgccac

SEQ ID NO: 148464 - DNA, 22 bp, Artificial Sequence
  Synthetic oligonucleotide; CTG chr11 5197995 5198016 5198000 5197995 -
cactccagcctgggcgacagag

SEQ ID NO: 148465 - DNA, 22 bp, Artificial Sequence
  Synthetic oligonucleotide; CTC chr11 5197990 5198011 5197995 5197990 -
cagcctgggcgacagagagaga

SEQ ID NO: 148466 - DNA, 22 bp, Artificial Sequence
  Synthetic oligonucleotide; CTG chr11 5197983 5198004 5197988 5197983 -
ggcgacagagagagactctgtc

SEQ ID NO: 148467 - DNA, 22 bp, Artificial Sequence
  Synthetic oligonucleotide; CTC chr11 5197965 5197986 5197970 5197965 -
tgtctcaaaaaaaaaaaaaaaa

SEQ ID NO: 148468 - DNA, 22 bp, Artificial Sequence
  Synthetic oligonucleotide; CTG chr11 5197963 5197984 5197968 5197963 -
tctcaaaaaaaaaaaaaaaaag

SEQ ID NO: 148469 - DNA, 22 bp, Artificial Sequence
  Synthetic oligonucleotide; CTC chr11 5197959 5197980 5197964 5197959 -
aaaaaaaaaaaaaaaaagagaa

SEQ ID NO: 148470 - DNA, 22 bp, Artificial Sequence
  Synthetic oligonucleotide; TTG chr11 5197921 5197942 5197926 5197921 -
atatgaatgtcaggtggtagta

SEQ ID NO: 148471 - DNA, 22 bp, Artificial Sequence
  Synthetic oligonucleotide; CTG chr11 5197896 5197917 5197901 5197896 -
ctccaggttccctaatgataat

SEQ ID NO: 148472 - DNA, 22 bp, Artificial Sequence
  Synthetic oligonucleotide; CTC chr11 5197893 5197914 5197898 5197893 -
caggttccctaatgataataaa

SEQ ID NO: 148473 - DNA, 22 bp, Artificial Sequence
  Synthetic oligonucleotide; TTC chr11 5197886 5197907 5197891 5197886 -
cctaatgataataaatgtctgc

SEQ ID NO: 148474 - DNA, 22 bp, Artificial Sequence
  Synthetic oligonucleotide; CTA chr11 5197882 5197903 5197887 5197882 -
atgataataaatgtctgcatgg

SEQ ID NO: 148475 - DNA, 22 bp, Artificial Sequence
  Synthetic oligonucleotide; CTG chr11 5197865 5197886 5197870 5197865 -
catggtccctcctggccgactg

SEQ ID NO: 148476 - DNA, 22 bp, Artificial Sequence
  Synthetic oligonucleotide; CTC chr11 5197854 5197875 5197859 5197854 -
ctggccgactggaatgtggcca

SEQ ID NO: 148477 - DNA, 22 bp, Artificial Sequence
  Synthetic oligonucleotide; CTG chr11 5197851 5197872 5197856 5197851 -
gccgactggaatgtggccaatc

SEQ ID NO: 148478 - DNA, 22 bp, Artificial Sequence
  Synthetic oligonucleotide; CTG chr11 5197843 5197864 5197848 5197843 -
gaatgtggccaatctgacaaga

SEQ ID NO: 148479 - DNA, 22 bp, Artificial Sequence
  Synthetic oligonucleotide; CTG chr11 5197827 5197848 5197832 5197827 -
acaagattcctatgccccagtt

SEQ ID NO: 148480 - DNA, 22 bp, Artificial Sequence
  Synthetic oligonucleotide; TTC chr11 5197818 5197839 5197823 5197818 -
ctatgccccagttttataatga

SEQ ID NO: 148481 - DNA, 22 bp, Artificial Sequence
  Synthetic oligonucleotide; CTA chr11 5197815 5197836 5197820 5197815 -
tgccccagttttataatgaaaa

SEQ ID NO: 148482 - DNA, 22 bp, Artificial Sequence
  Synthetic oligonucleotide; TTT chr11 5197804 5197825 5197809 5197804 -
tataatgaaaagagaagttagc

SEQ ID NO: 148483 - DNA, 22 bp, Artificial Sequence
  Synthetic oligonucleotide; TTT chr11 5197803 5197824 5197808 5197803 -
ataatgaaaagagaagttagct

SEQ ID NO: 148484 - DNA, 22 bp, Artificial Sequence
  Synthetic oligonucleotide; TTA chr11 5197802 5197823 5197807 5197802 -
taatgaaaagagaagttagctg

SEQ ID NO: 148485 - DNA, 22 bp, Artificial Sequence
  Synthetic oligonucleotide; TTA chr11 5197784 5197805 5197789 5197784 -
gctgctgaatctgtagaggtca

SEQ ID NO: 148486 - DNA, 22 bp, Artificial Sequence
  Synthetic oligonucleotide; CTG chr11 5197780 5197801 5197785 5197780 -
ctgaatctgtagaggtcatgtg

SEQ ID NO: 148487 - DNA, 22 bp, Artificial Sequence
  Synthetic oligonucleotide; CTG chr11 5197777 5197798 5197782 5197777 -
aatctgtagaggtcatgtgaat

SEQ ID NO: 148488 - DNA, 22 bp, Artificial Sequence
  Synthetic oligonucleotide; CTG chr11 5197771 5197792 5197776 5197771 -
tagaggtcatgtgaatgtctca

SEQ ID NO: 148489 - DNA, 22 bp, Artificial Sequence
  Synthetic oligonucleotide; CTC chr11 5197750 5197771 5197755 5197750 -
atagatttctcaatggccaaag

SEQ ID NO: 148490 - DNA, 22 bp, Artificial Sequence
  Synthetic oligonucleotide; TTT chr11 5197742 5197763 5197747 5197742 -
ctcaatggccaaagaagcttcc

SEQ ID NO: 148491 - DNA, 22 bp, Artificial Sequence
  Synthetic oligonucleotide; TTC chr11 5197741 5197762 5197746 5197741 -
tcaatggccaaagaagcttcct

SEQ ID NO: 148492 - DNA, 22 bp, Artificial Sequence
  Synthetic oligonucleotide; CTC chr11 5197739 5197760 5197744 5197739 -
aatggccaaagaagcttccttc

SEQ ID NO: 148493 - DNA, 22 bp, Artificial Sequence
  Synthetic oligonucleotide; CTT chr11 5197722 5197743 5197727 5197722 -
ccttctaatgctttgaaagtga

SEQ ID NO: 148494 - DNA, 22 bp, Artificial Sequence
  Synthetic oligonucleotide; TTC chr11 5197721 5197742 5197726 5197721 -
cttctaatgctttgaaagtgaa

SEQ ID NO: 148495 - DNA, 22 bp, Artificial Sequence
  Synthetic oligonucleotide; CTT chr11 5197718 5197739 5197723 5197718 -
ctaatgctttgaaagtgaataa

SEQ ID NO: 148496 - DNA, 22 bp, Artificial Sequence
  Synthetic oligonucleotide; TTC chr11 5197717 5197738 5197722 5197717 -
taatgctttgaaagtgaataag

SEQ ID NO: 148497 - DNA, 22 bp, Artificial Sequence
  Synthetic oligonucleotide; CTA chr11 5197715 5197736 5197720 5197715 -
atgctttgaaagtgaataagca

SEQ ID NO: 148498 - DNA, 22 bp, Artificial Sequence
  Synthetic oligonucleotide; CTT chr11 5197709 5197730 5197714 5197709 -
tgaaagtgaataagcatccacc

SEQ ID NO: 148499 - DNA, 22 bp, Artificial Sequence
  Synthetic oligonucleotide; TTT chr11 5197708 5197729 5197713 5197708 -
gaaagtgaataagcatccaccc

SEQ ID NO: 148500 - DNA, 22 bp, Artificial Sequence
  Synthetic oligonucleotide; TTG chr11 5197707 5197728 5197712 5197707 -
aaagtgaataagcatccaccct

SEQ ID NO: 148501 - DNA, 22 bp, Artificial Sequence
  Synthetic oligonucleotide; CTC chr11 5197684 5197705 5197689 5197684 -
ccatacgccggagagctgacac

SEQ ID NO: 148502 - DNA, 22 bp, Artificial Sequence
  Synthetic oligonucleotide; CTG chr11 5197666 5197687 5197671 5197666 -
acacaacactggggaagcagag

SEQ ID NO: 148503 - DNA, 22 bp, Artificial Sequence
  Synthetic oligonucleotide; CTG chr11 5197655 5197676 5197660 5197655 -
gggaagcagagaattcttcaac

SEQ ID NO: 148504 - DNA, 22 bp, Artificial Sequence
  Synthetic oligonucleotide; TTC chr11 5197639 5197660 5197644 5197639 -
ttcaacaactgacaatatgttt

SEQ ID NO: 148505 - DNA, 22 bp, Artificial Sequence
  Synthetic oligonucleotide; CTT chr11 5197637 5197658 5197642 5197637 -
caacaactgacaatatgttttc

SEQ ID NO: 148506 - DNA, 22 bp, Artificial Sequence
  Synthetic oligonucleotide; TTC chr11 5197636 5197657 5197641 5197636 -
aacaactgacaatatgttttcc

SEQ ID NO: 148507 - DNA, 22 bp, Artificial Sequence
  Synthetic oligonucleotide; CTG chr11 5197628 5197649 5197633 5197628 -
acaatatgttttccaccagcca

SEQ ID NO: 148508 - DNA, 22 bp, Artificial Sequence
  Synthetic oligonucleotide; TTT chr11 5197617 5197638 5197622 5197617 -
tccaccagccactcatagggaa

SEQ ID NO: 148509 - DNA, 22 bp, Artificial Sequence
  Synthetic oligonucleotide; TTT chr11 5197616 5197637 5197621 5197616 -
ccaccagccactcatagggaag

SEQ ID NO: 148510 - DNA, 22 bp, Artificial Sequence
  Synthetic oligonucleotide; TTC chr11 5197615 5197636 5197620 5197615 -
caccagccactcatagggaagc

SEQ ID NO: 148511 - DNA, 22 bp, Artificial Sequence
  Synthetic oligonucleotide; CTC chr11 5197603 5197624 5197608 5197603 -
atagggaagcatcagaatgaat

SEQ ID NO: 148512 - DNA, 22 bp, Artificial Sequence
  Synthetic oligonucleotide; TTT chr11 5197579 5197600 5197584 5197579 -
atatttattatttgaacaatat

SEQ ID NO: 148513 - DNA, 22 bp, Artificial Sequence
  Synthetic oligonucleotide; TTA chr11 5197578 5197599 5197583 5197578 -
tatttattatttgaacaatatt

SEQ ID NO: 148514 - DNA, 22 bp, Artificial Sequence
  Synthetic oligonucleotide; TTT chr11 5197573 5197594 5197578 5197573 -
attatttgaacaatattacatg

SEQ ID NO: 148515 - DNA, 22 bp, Artificial Sequence
  Synthetic oligonucleotide; TTA chr11 5197572 5197593 5197577 5197572 -
ttatttgaacaatattacatgt

SEQ ID NO: 148516 - DNA, 22 bp, Artificial Sequence
  Synthetic oligonucleotide; TTA chr11 5197569 5197590 5197574 5197569 -
tttgaacaatattacatgtctg

SEQ ID NO: 148517 - DNA, 22 bp, Artificial Sequence
  Synthetic oligonucleotide; TTT chr11 5197566 5197587 5197571 5197566 -
gaacaatattacatgtctgaca

SEQ ID NO: 148518 - DNA, 22 bp, Artificial Sequence
  Synthetic oligonucleotide; TTG chr11 5197565 5197586 5197570 5197565 -
aacaatattacatgtctgacac

SEQ ID NO: 148519 - DNA, 22 bp, Artificial Sequence
  Synthetic oligonucleotide; TTA chr11 5197555 5197576 5197560 5197555 -
catgtctgacacaactgagttg

SEQ ID NO: 148520 - DNA, 22 bp, Artificial Sequence
  Synthetic oligonucleotide; CTG chr11 5197547 5197568 5197552 5197547 -
acacaactgagttgttggtttg

SEQ ID NO: 148521 - DNA, 22 bp, Artificial Sequence
  Synthetic oligonucleotide; CTG chr11 5197538 5197559 5197543 5197538 -
agttgttggtttgagagttatg

SEQ ID NO: 148522 - DNA, 22 bp, Artificial Sequence
  Synthetic oligonucleotide; TTG chr11 5197533 5197554 5197538 5197533 -
ttggtttgagagttatgtttaa

SEQ ID NO: 148523 - DNA, 22 bp, Artificial Sequence
  Synthetic oligonucleotide; TTG chr11 5197530 5197551 5197535 5197530 -
gtttgagagttatgtttaacag

SEQ ID NO: 148524 - DNA, 22 bp, Artificial Sequence
  Synthetic oligonucleotide; TTT chr11 5197526 5197547 5197531 5197526 -
gagagttatgtttaacagggag

SEQ ID NO: 148525 - DNA, 22 bp, Artificial Sequence
  Synthetic oligonucleotide; TTG chr11 5197525 5197546 5197530 5197525 -
agagttatgtttaacagggaga

SEQ ID NO: 148526 - DNA, 22 bp, Artificial Sequence
  Synthetic oligonucleotide; TTA chr11 5197518 5197539 5197523 5197518 -
tgtttaacagggagagtaggaa

SEQ ID NO: 148527 - DNA, 22 bp, Artificial Sequence
  Synthetic oligonucleotide; TTT chr11 5197513 5197534 5197518 5197513 -
aacagggagagtaggaaggctc

SEQ ID NO: 148528 - DNA, 22 bp, Artificial Sequence
  Synthetic oligonucleotide; TTA chr11 5197512 5197533 5197517 5197512 -
acagggagagtaggaaggctca

SEQ ID NO: 148529 - DNA, 22 bp, Artificial Sequence
  Synthetic oligonucleotide; CTC chr11 5197491 5197512 5197496 5197491 -
atctgaagacttcatactatga

SEQ ID NO: 148530 - DNA, 22 bp, Artificial Sequence
  Synthetic oligonucleotide; CTG chr11 5197486 5197507 5197491 5197486 -
aagacttcatactatgagtgtt

SEQ ID NO: 148531 - DNA, 22 bp, Artificial Sequence
  Synthetic oligonucleotide; CTT chr11 5197479 5197500 5197484 5197479 -
catactatgagtgtttgtgctt

SEQ ID NO: 148532 - DNA, 22 bp, Artificial Sequence
  Synthetic oligonucleotide; TTC chr11 5197478 5197499 5197483 5197478 -
atactatgagtgtttgtgcttc

SEQ ID NO: 148533 - DNA, 22 bp, Artificial Sequence
  Synthetic oligonucleotide; CTA chr11 5197472 5197493 5197477 5197472 -
tgagtgtttgtgcttcagatta

SEQ ID NO: 148534 - DNA, 22 bp, Artificial Sequence
  Synthetic oligonucleotide; TTT chr11 5197463 5197484 5197468 5197463 -
gtgcttcagattaggcaaccta

SEQ ID NO: 148535 - DNA, 22 bp, Artificial Sequence
  Synthetic oligonucleotide; TTG chr11 5197462 5197483 5197467 5197462 -
tgcttcagattaggcaacctat

SEQ ID NO: 148536 - DNA, 22 bp, Artificial Sequence
  Synthetic oligonucleotide; CTT chr11 5197457 5197478 5197462 5197457 -
cagattaggcaacctatagaat

SEQ ID NO: 148537 - DNA, 22 bp, Artificial Sequence
  Synthetic oligonucleotide; TTC chr11 5197456 5197477 5197461 5197456 -
agattaggcaacctatagaatg

SEQ ID NO: 148538 - DNA, 22 bp, Artificial Sequence
  Synthetic oligonucleotide; TTA chr11 5197450 5197471 5197455 5197450 -
ggcaacctatagaatgtgaacc

SEQ ID NO: 148539 - DNA, 22 bp, Artificial Sequence
  Synthetic oligonucleotide; CTA chr11 5197441 5197462 5197446 5197441 -
tagaatgtgaaccaaaatagtt

SEQ ID NO: 148540 - DNA, 22 bp, Artificial Sequence
  Synthetic oligonucleotide; TTT chr11 5197418 5197439 5197423 5197418 -
gaaataatggccgtgacaaaac

SEQ ID NO: 148541 - DNA, 22 bp, Artificial Sequence
  Synthetic oligonucleotide; TTG chr11 5197417 5197438 5197422 5197417 -
aaataatggccgtgacaaaaca

SEQ ID NO: 148542 - DNA, 22 bp, Artificial Sequence
  Synthetic oligonucleotide; TTA chr11 5197391 5197412 5197396 5197391 -
ataaaaaatacctaagagtatc

SEQ ID NO: 148543 - DNA, 22 bp, Artificial Sequence
  Synthetic oligonucleotide; CTA chr11 5197377 5197398 5197382 5197377 -
agagtatcctcagaaatcattg

SEQ ID NO: 148544 - DNA, 22 bp, Artificial Sequence
  Synthetic oligonucleotide; CTC chr11 5197366 5197387 5197371 5197366 -
agaaatcattgcttattttaga

SEQ ID NO: 148545 - DNA, 22 bp, Artificial Sequence
  Synthetic oligonucleotide; TTG chr11 5197355 5197376 5197360 5197355 -
cttattttagagctatataatt

SEQ ID NO: 148546 - DNA, 22 bp, Artificial Sequence
  Synthetic oligonucleotide; CTT chr11 5197352 5197373 5197357 5197352 -
attttagagctatataattgta

SEQ ID NO: 148547 - DNA, 22 bp, Artificial Sequence
  Synthetic oligonucleotide; TTA chr11 5197351 5197372 5197356 5197351 -
ttttagagctatataattgtac

SEQ ID NO: 148548 - DNA, 22 bp, Artificial Sequence
  Synthetic oligonucleotide; TTT chr11 5197348 5197369 5197353 5197348 -
tagagctatataattgtactat

SEQ ID NO: 148549 - DNA, 22 bp, Artificial Sequence
  Synthetic oligonucleotide; TTT chr11 5197347 5197368 5197352 5197347 -
agagctatataattgtactatg

SEQ ID NO: 148550 - DNA, 22 bp, Artificial Sequence
  Synthetic oligonucleotide; TTA chr11 5197346 5197367 5197351 5197346 -
gagctatataattgtactatga

SEQ ID NO: 148551 - DNA, 22 bp, Artificial Sequence
  Synthetic oligonucleotide; CTA chr11 5197340 5197361 5197345 5197340 -
tataattgtactatgatgataa

SEQ ID NO: 148552 - DNA, 22 bp, Artificial Sequence
  Synthetic oligonucleotide; TTG chr11 5197332 5197353 5197337 5197332 -
tactatgatgataagatttatg

SEQ ID NO: 148553 - DNA, 22 bp, Artificial Sequence
  Synthetic oligonucleotide; CTA chr11 5197327 5197348 5197332 5197327 -
tgatgataagatttatgaagaa

SEQ ID NO: 148554 - DNA, 22 bp, Artificial Sequence
  Synthetic oligonucleotide; TTT chr11 5197313 5197334 5197318 5197313 -
atgaagaacttcagaatcttta

SEQ ID NO: 148555 - DNA, 22 bp, Artificial Sequence
  Synthetic oligonucleotide; TTA chr11 5197312 5197333 5197317 5197312 -
tgaagaacttcagaatctttac

SEQ ID NO: 148556 - DNA, 22 bp, Artificial Sequence
  Synthetic oligonucleotide; CTT chr11 5197302 5197323 5197307 5197302 -
cagaatctttacaattcagcca

SEQ ID NO: 148557 - DNA, 22 bp, Artificial Sequence
  Synthetic oligonucleotide; TTC chr11 5197301 5197322 5197306 5197301 -
agaatctttacaattcagccaa

SEQ ID NO: 148558 - DNA, 22 bp, Artificial Sequence
  Synthetic oligonucleotide; CTT chr11 5197293 5197314 5197298 5197293 -
tacaattcagccaaagggagga

SEQ ID NO: 148559 - DNA, 22 bp, Artificial Sequence
  Synthetic oligonucleotide; TTT chr11 5197292 5197313 5197297 5197292 -
acaattcagccaaagggaggaa

SEQ ID NO: 148560 - DNA, 22 bp, Artificial Sequence
  Synthetic oligonucleotide; TTA chr11 5197291 5197312 5197296 5197291 -
caattcagccaaagggaggaaa

SEQ ID NO: 148561 - DNA, 22 bp, Artificial Sequence
  Synthetic oligonucleotide; TTC chr11 5197285 5197306 5197290 5197285 -
agccaaagggaggaaaatcagt

SEQ ID NO: 148562 - DNA, 22 bp, Artificial Sequence
  Synthetic oligonucleotide; CTT chr11 5197228 5197249 5197233 5197228 -
tatatgattactgggctttata

SEQ ID NO: 148563 - DNA, 22 bp, Artificial Sequence
  Synthetic oligonucleotide; TTT chr11 5197227 5197248 5197232 5197227 -
atatgattactgggctttatac

SEQ ID NO: 148564 - DNA, 22 bp, Artificial Sequence
  Synthetic oligonucleotide; TTA chr11 5197226 5197247 5197231 5197226 -
tatgattactgggctttataca

SEQ ID NO: 148565 - DNA, 22 bp, Artificial Sequence
  Synthetic oligonucleotide; TTA chr11 5197218 5197239 5197223 5197218 -
ctgggctttatacagaaagaaa

SEQ ID NO: 148566 - DNA, 22 bp, Artificial Sequence
  Synthetic oligonucleotide; CTG chr11 5197215 5197236 5197220 5197215 -
ggctttatacagaaagaaacag

SEQ ID NO: 148567 - DNA, 22 bp, Artificial Sequence
  Synthetic oligonucleotide; CTT chr11 5197210 5197231 5197215 5197210 -
tatacagaaagaaacaggttta

SEQ ID NO: 148568 - DNA, 22 bp, Artificial Sequence
  Synthetic oligonucleotide; TTT chr11 5197209 5197230 5197214 5197209 -
atacagaaagaaacaggtttag

SEQ ID NO: 148569 - DNA, 22 bp, Artificial Sequence
  Synthetic oligonucleotide; TTA chr11 5197208 5197229 5197213 5197208 -
tacagaaagaaacaggtttaga

SEQ ID NO: 148570 - DNA, 22 bp, Artificial Sequence
  Synthetic oligonucleotide; TTT chr11 5197189 5197210 5197194 5197189 -
agaacattagtagtttagattg

SEQ ID NO: 148571 - DNA, 22 bp, Artificial Sequence
  Synthetic oligonucleotide; TTA chr11 5197188 5197209 5197193 5197188 -
gaacattagtagtttagattgt

SEQ ID NO: 148572 - DNA, 22 bp, Artificial Sequence
  Synthetic oligonucleotide; TTA chr11 5197180 5197201 5197185 5197180 -
gtagtttagattgtttgttttg

SEQ ID NO: 148573 - DNA, 22 bp, Artificial Sequence
  Synthetic oligonucleotide; TTT chr11 5197173 5197194 5197178 5197173 -
agattgtttgttttgcaaaggc

SEQ ID NO: 148574 - DNA, 22 bp, Artificial Sequence
  Synthetic oligonucleotide; TTA chr11 5197172 5197193 5197177 5197172 -
gattgtttgttttgcaaaggcc

SEQ ID NO: 148575 - DNA, 22 bp, Artificial Sequence
  Synthetic oligonucleotide; TTG chr11 5197167 5197188 5197172 5197167 -
tttgttttgcaaaggcctctat

SEQ ID NO: 148576 - DNA, 22 bp, Artificial Sequence
  Synthetic oligonucleotide; TTT chr11 5197164 5197185 5197169 5197164 -
gttttgcaaaggcctctatctg

SEQ ID NO: 148577 - DNA, 22 bp, Artificial Sequence
  Synthetic oligonucleotide; TTG chr11 5197163 5197184 5197168 5197163 -
ttttgcaaaggcctctatctgg

SEQ ID NO: 148578 - DNA, 22 bp, Artificial Sequence
  Synthetic oligonucleotide; TTT chr11 5197160 5197181 5197165 5197160 -
tgcaaaggcctctatctggaag

SEQ ID NO: 148579 - DNA, 22 bp, Artificial Sequence
  Synthetic oligonucleotide; TTT chr11 5197159 5197180 5197164 5197159 -
gcaaaggcctctatctggaagc

SEQ ID NO: 148580 - DNA, 22 bp, Artificial Sequence
  Synthetic oligonucleotide; TTG chr11 5197158 5197179 5197163 5197158 -
caaaggcctctatctggaagca

SEQ ID NO: 148581 - DNA, 22 bp, Artificial Sequence
  Synthetic oligonucleotide; CTC chr11 5197148 5197169 5197153 5197148 -
tatctggaagcaattacttaaa

SEQ ID NO: 148582 - DNA, 22 bp, Artificial Sequence
  Synthetic oligonucleotide; CTA chr11 5197146 5197167 5197151 5197146 -
tctggaagcaattacttaaaaa

SEQ ID NO: 148583 - DNA, 22 bp, Artificial Sequence
  Synthetic oligonucleotide; CTG chr11 5197142 5197163 5197147 5197142 -
gaagcaattacttaaaaaaata

SEQ ID NO: 148584 - DNA, 22 bp, Artificial Sequence
  Synthetic oligonucleotide; TTA chr11 5197132 5197153 5197137 5197132 -
cttaaaaaaataactaaacctc

SEQ ID NO: 148585 - DNA, 22 bp, Artificial Sequence
  Synthetic oligonucleotide; CTT chr11 5197129 5197150 5197134 5197129 -
aaaaaaataactaaacctctcc

SEQ ID NO: 148586 - DNA, 22 bp, Artificial Sequence
  Synthetic oligonucleotide; TTA chr11 5197128 5197149 5197133 5197128 -
aaaaaataactaaacctctcct

SEQ ID NO: 148587 - DNA, 22 bp, Artificial Sequence
  Synthetic oligonucleotide; CTA chr11 5197116 5197137 5197121 5197116 -
aacctctcctgaggaagaaaag

SEQ ID NO: 148588 - DNA, 22 bp, Artificial Sequence
  Synthetic oligonucleotide; CTC chr11 5197110 5197131 5197115 5197110 -
tcctgaggaagaaaaggcaatt

SEQ ID NO: 148589 - DNA, 22 bp, Artificial Sequence
  Synthetic oligonucleotide; CTC chr11 5197108 5197129 5197113 5197108 -
ctgaggaagaaaaggcaatttc

SEQ ID NO: 148590 - DNA, 22 bp, Artificial Sequence
  Synthetic oligonucleotide; CTG chr11 5197105 5197126 5197110 5197105 -
aggaagaaaaggcaatttcaga

SEQ ID NO: 148591 - DNA, 22 bp, Artificial Sequence
  Synthetic oligonucleotide; TTT chr11 5197087 5197108 5197092 5197087 -
cagagacatcagcccaggtcct

SEQ ID NO: 148592 - DNA, 22 bp, Artificial Sequence
  Synthetic oligonucleotide; TTC chr11 5197086 5197107 5197091 5197086 -
agagacatcagcccaggtcctg

SEQ ID NO: 148593 - DNA, 22 bp, Artificial Sequence
  Synthetic oligonucleotide; CTG chr11 5197064 5197085 5197069 5197064 -
aaaggaagagcagatggagaca

SEQ ID NO: 148594 - DNA, 22 bp, Artificial Sequence
  Synthetic oligonucleotide; TTT chr11 5197030 5197051 5197035 5197030 -
aaaacactgtctgttttgaaaa

SEQ ID NO: 148595 - DNA, 22 bp, Artificial Sequence
  Synthetic oligonucleotide; TTA chr11 5197029 5197050 5197034 5197029 -
aaacactgtctgttttgaaaag

SEQ ID NO: 148596 - DNA, 22 bp, Artificial Sequence
  Synthetic oligonucleotide; CTG chr11 5197021 5197042 5197026 5197021 -
tctgttttgaaaagctacatag

SEQ ID NO: 148597 - DNA, 22 bp, Artificial Sequence
  Synthetic oligonucleotide; CTG chr11 5197017 5197038 5197022 5197017 -
ttttgaaaagctacatagtagc

SEQ ID NO: 148598 - DNA, 22 bp, Artificial Sequence
  Synthetic oligonucleotide; TTT chr11 5197014 5197035 5197019 5197014 -
tgaaaagctacatagtagccag

SEQ ID NO: 148599 - DNA, 22 bp, Artificial Sequence
  Synthetic oligonucleotide; TTT chr11 5197013 5197034 5197018 5197013 -
gaaaagctacatagtagccagg

SEQ ID NO: 148600 - DNA, 22 bp, Artificial Sequence
  Synthetic oligonucleotide; TTG chr11 5197012 5197033 5197017 5197012 -
aaaagctacatagtagccaggt

SEQ ID NO: 148601 - DNA, 22 bp, Artificial Sequence
  Synthetic oligonucleotide; CTA chr11 5197004 5197025 5197009 5197004 -
catagtagccaggtggagacat

SEQ ID NO: 148602 - DNA, 22 bp, Artificial Sequence
  Synthetic oligonucleotide; TTT chr11 5196980 5197001 5196985 5196980 -
ttccatatatctcaaaaagcca

SEQ ID NO: 148603 - DNA, 22 bp, Artificial Sequence
  Synthetic oligonucleotide; TTT chr11 5196979 5197000 5196984 5196979 -
tccatatatctcaaaaagccag

SEQ ID NO: 148604 - DNA, 22 bp, Artificial Sequence
  Synthetic oligonucleotide; TTT chr11 5196978 5196999 5196983 5196978 -
ccatatatctcaaaaagccagc

SEQ ID NO: 148605 - DNA, 22 bp, Artificial Sequence
  Synthetic oligonucleotide; TTC chr11 5196977 5196998 5196982 5196977 -
catatatctcaaaaagccagct

SEQ ID NO: 148606 - DNA, 22 bp, Artificial Sequence
  Synthetic oligonucleotide; CTC chr11 5196967 5196988 5196972 5196967 -
aaaaagccagcttctaaggaaa

SEQ ID NO: 148607 - DNA, 22 bp, Artificial Sequence
  Synthetic oligonucleotide; CTT chr11 5196954 5196975 5196959 5196954 -
ctaaggaaacttgttttccatg

SEQ ID NO: 148608 - DNA, 22 bp, Artificial Sequence
  Synthetic oligonucleotide; TTC chr11 5196953 5196974 5196958 5196953 -
taaggaaacttgttttccatga

SEQ ID NO: 148609 - DNA, 22 bp, Artificial Sequence
  Synthetic oligonucleotide; CTA chr11 5196951 5196972 5196956 5196951 -
aggaaacttgttttccatgaat

SEQ ID NO: 148610 - DNA, 22 bp, Artificial Sequence
  Synthetic oligonucleotide; CTT chr11 5196942 5196963 5196947 5196942 -
gttttccatgaattaggcaaca

SEQ ID NO: 148611 - DNA, 22 bp, Artificial Sequence
  Synthetic oligonucleotide; TTG chr11 5196941 5196962 5196946 5196941 -
ttttccatgaattaggcaacaa

SEQ ID NO: 148612 - DNA, 22 bp, Artificial Sequence
  Synthetic oligonucleotide; TTT chr11 5196938 5196959 5196943 5196938 -
tccatgaattaggcaacaacag

SEQ ID NO: 148613 - DNA, 22 bp, Artificial Sequence
  Synthetic oligonucleotide; TTT chr11 5196937 5196958 5196942 5196937 -
ccatgaattaggcaacaacagc

SEQ ID NO: 148614 - DNA, 22 bp, Artificial Sequence
  Synthetic oligonucleotide; TTC chr11 5196936 5196957 5196941 5196936 -
catgaattaggcaacaacagct

SEQ ID NO: 148615 - DNA, 22 bp, Artificial Sequence
  Synthetic oligonucleotide; TTA chr11 5196927 5196948 5196932 5196927 -
ggcaacaacagctgaaactgtt

SEQ ID NO: 148616 - DNA, 22 bp, Artificial Sequence
  Synthetic oligonucleotide; CTG chr11 5196913 5196934 5196918 5196913 -
aaactgttgttgatgtggtagc

SEQ ID NO: 148617 - DNA, 22 bp, Artificial Sequence
  Synthetic oligonucleotide; CTG chr11 5196907 5196928 5196912 5196907 -
ttgttgatgtggtagcctgcag

SEQ ID NO: 148618 - DNA, 22 bp, Artificial Sequence
  Synthetic oligonucleotide; TTG chr11 5196904 5196925 5196909 5196904 -
ttgatgtggtagcctgcagagc

SEQ ID NO: 148619 - DNA, 22 bp, Artificial Sequence
  Synthetic oligonucleotide; TTG chr11 5196901 5196922 5196906 5196901 -
atgtggtagcctgcagagccag

SEQ ID NO: 148620 - DNA, 22 bp, Artificial Sequence
  Synthetic oligonucleotide; CTG chr11 5196888 5196909 5196893 5196888 -
cagagccagtgagaagcagtta

SEQ ID NO: 148621 - DNA, 22 bp, Artificial Sequence
  Synthetic oligonucleotide; TTA chr11 5196866 5196887 5196871 5196866 -
tcagattcctttgtaaggcctg

SEQ ID NO: 148622 - DNA, 22 bp, Artificial Sequence
  Synthetic oligonucleotide; TTC chr11 5196858 5196879 5196863 5196858 -
ctttgtaaggcctgcaaggcta

SEQ ID NO: 148623 - DNA, 22 bp, Artificial Sequence
  Synthetic oligonucleotide; CTT chr11 5196855 5196876 5196860 5196855 -
tgtaaggcctgcaaggctacta

SEQ ID NO: 148624 - DNA, 22 bp, Artificial Sequence
  Synthetic oligonucleotide; TTT chr11 5196854 5196875 5196859 5196854 -
gtaaggcctgcaaggctactat

SEQ ID NO: 148625 - DNA, 22 bp, Artificial Sequence
  Synthetic oligonucleotide; TTG chr11 5196853 5196874 5196858 5196853 -
taaggcctgcaaggctactatc

SEQ ID NO: 148626 - DNA, 22 bp, Artificial Sequence
  Synthetic oligonucleotide; CTG chr11 5196844 5196865 5196849 5196844 -
caaggctactatccagcgtcac

SEQ ID NO: 148627 - DNA, 22 bp, Artificial Sequence
  Synthetic oligonucleotide; CTA chr11 5196836 5196857 5196841 5196836 -
ctatccagcgtcactgagaaac

SEQ ID NO: 148628 - DNA, 22 bp, Artificial Sequence
  Synthetic oligonucleotide; CTA chr11 5196833 5196854 5196838 5196833 -
tccagcgtcactgagaaacgtt

SEQ ID NO: 148629 - DNA, 22 bp, Artificial Sequence
  Synthetic oligonucleotide; CTG chr11 5196820 5196841 5196825 5196820 -
agaaacgttacgaaaacagcca

SEQ ID NO: 148630 - DNA, 22 bp, Artificial Sequence
  Synthetic oligonucleotide; TTA chr11 5196810 5196831 5196815 5196810 -
cgaaaacagccacagtgatgtt

SEQ ID NO: 148631 - DNA, 22 bp, Artificial Sequence
  Synthetic oligonucleotide; TTA chr11 5196787 5196808 5196792 5196787 -
gggaaacacagttctcttttgc

SEQ ID NO: 148632 - DNA, 22 bp, Artificial Sequence
  Synthetic oligonucleotide; TTC chr11 5196773 5196794 5196778 5196773 -
tcttttgcctttttttttttaa

SEQ ID NO: 148633 - DNA, 22 bp, Artificial Sequence
  Synthetic oligonucleotide; CTC chr11 5196771 5196792 5196776 5196771 -
ttttgcctttttttttttaata

SEQ ID NO: 148634 - DNA, 22 bp, Artificial Sequence
  Synthetic oligonucleotide; CTT chr11 5196769 5196790 5196774 5196769 -
ttgcctttttttttttaatagg

SEQ ID NO: 148635 - DNA, 22 bp, Artificial Sequence
  Synthetic oligonucleotide; TTT chr11 5196768 5196789 5196773 5196768 -
tgcctttttttttttaataggt

SEQ ID NO: 148636 - DNA, 22 bp, Artificial Sequence
  Synthetic oligonucleotide; TTT chr11 5196767 5196788 5196772 5196767 -
gcctttttttttttaataggta

SEQ ID NO: 148637 - DNA, 22 bp, Artificial Sequence
  Synthetic oligonucleotide; TTG chr11 5196766 5196787 5196771 5196766 -
cctttttttttttaataggtag

SEQ ID NO: 148638 - DNA, 22 bp, Artificial Sequence
  Synthetic oligonucleotide; CTT chr11 5196762 5196783 5196767 5196762 -
tttttttttaataggtagactg

SEQ ID NO: 148639 - DNA, 22 bp, Artificial Sequence
  Synthetic oligonucleotide; TTT chr11 5196761 5196782 5196766 5196761 -
ttttttttaataggtagactgt

SEQ ID NO: 148640 - DNA, 22 bp, Artificial Sequence
  Synthetic oligonucleotide; TTT chr11 5196760 5196781 5196765 5196760 -
tttttttaataggtagactgtc

SEQ ID NO: 148641 - DNA, 22 bp, Artificial Sequence
  Synthetic oligonucleotide; TTT chr11 5196759 5196780 5196764 5196759 -
ttttttaataggtagactgtca

SEQ ID NO: 148642 - DNA, 22 bp, Artificial Sequence
  Synthetic oligonucleotide; TTT chr11 5196758 5196779 5196763 5196758 -
tttttaataggtagactgtcat

SEQ ID NO: 148643 - DNA, 22 bp, Artificial Sequence
  Synthetic oligonucleotide; TTT chr11 5196757 5196778 5196762 5196757 -
ttttaataggtagactgtcata

SEQ ID NO: 148644 - DNA, 22 bp, Artificial Sequence
  Synthetic oligonucleotide; TTT chr11 5196756 5196777 5196761 5196756 -
tttaataggtagactgtcatat

SEQ ID NO: 148645 - DNA, 22 bp, Artificial Sequence
  Synthetic oligonucleotide; TTT chr11 5196755 5196776 5196760 5196755 -
ttaataggtagactgtcatatc

SEQ ID NO: 148646 - DNA, 22 bp, Artificial Sequence
  Synthetic oligonucleotide; TTT chr11 5196754 5196775 5196759 5196754 -
taataggtagactgtcatatca

SEQ ID NO: 148647 - DNA, 22 bp, Artificial Sequence
  Synthetic oligonucleotide; TTT chr11 5196753 5196774 5196758 5196753 -
aataggtagactgtcatatcat

SEQ ID NO: 148648 - DNA, 22 bp, Artificial Sequence
  Synthetic oligonucleotide; TTA chr11 5196752 5196773 5196757 5196752 -
ataggtagactgtcatatcatt

SEQ ID NO: 148649 - DNA, 22 bp, Artificial Sequence
  Synthetic oligonucleotide; CTG chr11 5196740 5196761 5196745 5196740 -
tcatatcattgtaactgctgcc

SEQ ID NO: 148650 - DNA, 22 bp, Artificial Sequence
  Synthetic oligonucleotide; TTG chr11 5196729 5196750 5196734 5196729 -
taactgctgccttaaatgaagt

SEQ ID NO: 148651 - DNA, 22 bp, Artificial Sequence
  Synthetic oligonucleotide; CTG chr11 5196723 5196744 5196728 5196723 -
ctgccttaaatgaagtcacggt

SEQ ID NO: 148652 - DNA, 22 bp, Artificial Sequence
  Synthetic oligonucleotide; CTG chr11 5196720 5196741 5196725 5196720 -
ccttaaatgaagtcacggttat

SEQ ID NO: 148653 - DNA, 22 bp, Artificial Sequence
  Synthetic oligonucleotide; CTT chr11 5196716 5196737 5196721 5196716 -
aaatgaagtcacggttattata

SEQ ID NO: 148654 - DNA, 22 bp, Artificial Sequence
  Synthetic oligonucleotide; TTA chr11 5196715 5196736 5196720 5196715 -
aatgaagtcacggttattataa

SEQ ID NO: 148655 - DNA, 22 bp, Artificial Sequence
  Synthetic oligonucleotide; TTA chr11 5196699 5196720 5196704 5196699 -
ttataataaggagaaaacaaaa

SEQ ID NO: 148656 - DNA, 22 bp, Artificial Sequence
  Synthetic oligonucleotide; TTA chr11 5196696 5196717 5196701 5196696 -
taataaggagaaaacaaaaata

SEQ ID NO: 148657 - DNA, 22 bp, Artificial Sequence
  Synthetic oligonucleotide; TTG chr11 5196671 5196692 5196676 5196671 -
ccgagaacaaggtgacaaaagt

SEQ ID NO: 148658 - DNA, 22 bp, Artificial Sequence
  Synthetic oligonucleotide; TTC chr11 5196642 5196663 5196647 5196642 -
agaaaatcagaaagtctagtcc

SEQ ID NO: 148659 - DNA, 22 bp, Artificial Sequence
  Synthetic oligonucleotide; CTA chr11 5196624 5196645 5196629 5196624 -
gtccattcaattgctattcatt

SEQ ID NO: 148660 - DNA, 22 bp, Artificial Sequence
  Synthetic oligonucleotide; TTC chr11 5196616 5196637 5196621 5196616 -
aattgctattcatttaactctt

SEQ ID NO: 148661 - DNA, 22 bp, Artificial Sequence
  Synthetic oligonucleotide; TTG chr11 5196611 5196632 5196616 5196611 -
ctattcatttaactcttacacc

SEQ ID NO: 148662 - DNA, 22 bp, Artificial Sequence
  Synthetic oligonucleotide; CTA chr11 5196608 5196629 5196613 5196608 -
ttcatttaactcttacaccgaa

SEQ ID NO: 148663 - DNA, 22 bp, Artificial Sequence
  Synthetic oligonucleotide; TTC chr11 5196605 5196626 5196610 5196605 -
atttaactcttacaccgaaaag

SEQ ID NO: 148664 - DNA, 22 bp, Artificial Sequence
  Synthetic oligonucleotide; TTT chr11 5196601 5196622 5196606 5196601 -
aactcttacaccgaaaagctaa

SEQ ID NO: 148665 - DNA, 22 bp, Artificial Sequence
  Synthetic oligonucleotide; TTA chr11 5196600 5196621 5196605 5196600 -
actcttacaccgaaaagctaag

SEQ ID NO: 148666 - DNA, 22 bp, Artificial Sequence
  Synthetic oligonucleotide; CTC chr11 5196596 5196617 5196601 5196596 -
ttacaccgaaaagctaaggtcc

SEQ ID NO: 148667 - DNA, 22 bp, Artificial Sequence
  Synthetic oligonucleotide; CTT chr11 5196594 5196615 5196599 5196594 -
acaccgaaaagctaaggtccag

SEQ ID NO: 148668 - DNA, 22 bp, Artificial Sequence
  Synthetic oligonucleotide; TTA chr11 5196593 5196614 5196598 5196593 -
caccgaaaagctaaggtccagt

SEQ ID NO: 148669 - DNA, 22 bp, Artificial Sequence
  Synthetic oligonucleotide; CTA chr11 5196580 5196601 5196585 5196580 -
aggtccagtgggagaaatcagt

SEQ ID NO: 148670 - DNA, 22 bp, Artificial Sequence
  Synthetic oligonucleotide; TTC chr11 5196553 5196574 5196558 5196553 -
ttagaagtgagaggacatgatt

SEQ ID NO: 148671 - DNA, 22 bp, Artificial Sequence
  Synthetic oligonucleotide; CTT chr11 5196551 5196572 5196556 5196551 -
agaagtgagaggacatgattca

SEQ ID NO: 148672 - DNA, 22 bp, Artificial Sequence
  Synthetic oligonucleotide; TTA chr11 5196550 5196571 5196555 5196550 -
gaagtgagaggacatgattcag

SEQ ID NO: 148673 - DNA, 22 bp, Artificial Sequence
  Synthetic oligonucleotide; TTC chr11 5196530 5196551 5196535 5196530 -
aggattagaaatgtgtttttag

SEQ ID NO: 148674 - DNA, 22 bp, Artificial Sequence
  Synthetic oligonucleotide; TTA chr11 5196523 5196544 5196528 5196523 -
gaaatgtgtttttagtaaaaat

SEQ ID NO: 148675 - DNA, 22 bp, Artificial Sequence
  Synthetic oligonucleotide; TTT chr11 5196512 5196533 5196517 5196512 -
ttagtaaaaatgatctgctaat

SEQ ID NO: 148676 - DNA, 22 bp, Artificial Sequence
  Synthetic oligonucleotide; TTT chr11 5196511 5196532 5196516 5196511 -
tagtaaaaatgatctgctaata

SEQ ID NO: 148677 - DNA, 22 bp, Artificial Sequence
  Synthetic oligonucleotide; TTT chr11 5196510 5196531 5196515 5196510 -
agtaaaaatgatctgctaataa

SEQ ID NO: 148678 - DNA, 22 bp, Artificial Sequence
  Synthetic oligonucleotide; TTA chr11 5196509 5196530 5196514 5196509 -
gtaaaaatgatctgctaataat

SEQ ID NO: 148679 - DNA, 22 bp, Artificial Sequence
  Synthetic oligonucleotide; CTG chr11 5196495 5196516 5196500 5196495 -
ctaataataaatccacaggcag

SEQ ID NO: 148680 - DNA, 22 bp, Artificial Sequence
  Synthetic oligonucleotide; CTA chr11 5196492 5196513 5196497 5196492 -
ataataaatccacaggcagatg

SEQ ID NO: 148681 - DNA, 22 bp, Artificial Sequence
  Synthetic oligonucleotide; TTC chr11 5196467 5196488 5196472 5196467 -
actgtacaccagcagtcttcaa

SEQ ID NO: 148682 - DNA, 22 bp, Artificial Sequence
  Synthetic oligonucleotide; CTG chr11 5196463 5196484 5196468 5196463 -
tacaccagcagtcttcaatgtt

SEQ ID NO: 148683 - DNA, 22 bp, Artificial Sequence
  Synthetic oligonucleotide; CTT chr11 5196448 5196469 5196453 5196448 -
caatgtttttggtaccagggac

SEQ ID NO: 148684 - DNA, 22 bp, Artificial Sequence
  Synthetic oligonucleotide; TTC chr11 5196447 5196468 5196452 5196447 -
aatgtttttggtaccagggact

SEQ ID NO: 148685 - DNA, 22 bp, Artificial Sequence
  Synthetic oligonucleotide; TTT chr11 5196440 5196461 5196445 5196440 -
ttggtaccagggactgcttttg

SEQ ID NO: 148686 - DNA, 22 bp, Artificial Sequence
  Synthetic oligonucleotide; TTT chr11 5196439 5196460 5196444 5196439 -
tggtaccagggactgcttttgt

SEQ ID NO: 148687 - DNA, 22 bp, Artificial Sequence
  Synthetic oligonucleotide; TTT chr11 5196438 5196459 5196443 5196438 -
ggtaccagggactgcttttgtg

SEQ ID NO: 148688 - DNA, 22 bp, Artificial Sequence
  Synthetic oligonucleotide; TTG chr11 5196437 5196458 5196442 5196437 -
gtaccagggactgcttttgtgg

SEQ ID NO: 148689 - DNA, 22 bp, Artificial Sequence
  Synthetic oligonucleotide; CTG chr11 5196424 5196445 5196429 5196424 -
cttttgtggaagacaaggtgca

SEQ ID NO: 148690 - DNA, 22 bp, Artificial Sequence
  Synthetic oligonucleotide; CTT chr11 5196421 5196442 5196426 5196421 -
ttgtggaagacaaggtgcagga

SEQ ID NO: 148691 - DNA, 22 bp, Artificial Sequence
  Synthetic oligonucleotide; TTT chr11 5196420 5196441 5196425 5196420 -
tgtggaagacaaggtgcaggag

SEQ ID NO: 148692 - DNA, 22 bp, Artificial Sequence
  Synthetic oligonucleotide; TTT chr11 5196419 5196440 5196424 5196419 -
gtggaagacaaggtgcaggagg

SEQ ID NO: 148693 - DNA, 22 bp, Artificial Sequence
  Synthetic oligonucleotide; TTG chr11 5196418 5196439 5196423 5196418 -
tggaagacaaggtgcaggaggg

SEQ ID NO: 148694 - DNA, 22 bp, Artificial Sequence
  Synthetic oligonucleotide; TTT chr11 5196388 5196409 5196393 5196388 -
caggatgaaactgttccacctc

SEQ ID NO: 148695 - DNA, 22 bp, Artificial Sequence
  Synthetic oligonucleotide; TTC chr11 5196387 5196408 5196392 5196387 -
aggatgaaactgttccacctca

SEQ ID NO: 148696 - DNA, 22 bp, Artificial Sequence
  Synthetic oligonucleotide; CTG chr11 5196375 5196396 5196380 5196375 -
ttccacctcagagcattaggca

SEQ ID NO: 148697 - DNA, 22 bp, Artificial Sequence
  Synthetic oligonucleotide; TTC chr11 5196372 5196393 5196377 5196372 -
cacctcagagcattaggcatta

SEQ ID NO: 148698 - DNA, 22 bp, Artificial Sequence
  Synthetic oligonucleotide; CTC chr11 5196366 5196387 5196371 5196366 -
agagcattaggcattagattct

SEQ ID NO: 148699 - DNA, 22 bp, Artificial Sequence
  Synthetic oligonucleotide; TTA chr11 5196357 5196378 5196362 5196357 -
ggcattagattctcataagaag

SEQ ID NO: 148700 - DNA, 22 bp, Artificial Sequence
  Synthetic oligonucleotide; TTA chr11 5196350 5196371 5196355 5196350 -
gattctcataagaagccgcaac

SEQ ID NO: 148701 - DNA, 22 bp, Artificial Sequence
  Synthetic oligonucleotide; TTC chr11 5196345 5196366 5196350 5196345 -
tcataagaagccgcaacctaga

SEQ ID NO: 148702 - DNA, 22 bp, Artificial Sequence
  Synthetic oligonucleotide; CTC chr11 5196343 5196364 5196348 5196343 -
ataagaagccgcaacctagatc

SEQ ID NO: 148703 - DNA, 22 bp, Artificial Sequence
  Synthetic oligonucleotide; CTA chr11 5196325 5196346 5196330 5196325 -
gatcccttgcatgcctctatga

SEQ ID NO: 148704 - DNA, 22 bp, Artificial Sequence
  Synthetic oligonucleotide; CTT chr11 5196317 5196338 5196322 5196317 -
gcatgcctctatgagaatctaa

SEQ ID NO: 148705 - DNA, 22 bp, Artificial Sequence
  Synthetic oligonucleotide; TTG chr11 5196316 5196337 5196321 5196316 -
catgcctctatgagaatctaat

SEQ ID NO: 148706 - DNA, 22 bp, Artificial Sequence
  Synthetic oligonucleotide; CTC chr11 5196308 5196329 5196313 5196308 -
tatgagaatctaatgccgccac

SEQ ID NO: 148707 - DNA, 22 bp, Artificial Sequence
  Synthetic oligonucleotide; CTA chr11 5196306 5196327 5196311 5196306 -
tgagaatctaatgccgccactg

SEQ ID NO: 148708 - DNA, 22 bp, Artificial Sequence
  Synthetic oligonucleotide; CTA chr11 5196296 5196317 5196301 5196296 -
atgccgccactgccgatgtgac

SEQ ID NO: 148709 - DNA, 22 bp, Artificial Sequence
  Synthetic oligonucleotide; CTG chr11 5196284 5196305 5196289 5196284 -
ccgatgtgacaggaggaggagc

SEQ ID NO: 148710 - DNA, 22 bp, Artificial Sequence
  Synthetic oligonucleotide; CTC chr11 5196260 5196281 5196265 5196260 -
aggcagtaatgcttgctcatcc

SEQ ID NO: 148711 - DNA, 22 bp, Artificial Sequence
  Synthetic oligonucleotide; CTT chr11 5196246 5196267 5196251 5196246 -
gctcatccccctgctgtgagac

SEQ ID NO: 148712 - DNA, 22 bp, Artificial Sequence
  Synthetic oligonucleotide; TTG chr11 5196245 5196266 5196250 5196245 -
ctcatccccctgctgtgagacc

SEQ ID NO: 148713 - DNA, 22 bp, Artificial Sequence
  Synthetic oligonucleotide; CTC chr11 5196242 5196263 5196247 5196242 -
atccccctgctgtgagaccagg

SEQ ID NO: 148714 - DNA, 22 bp, Artificial Sequence
  Synthetic oligonucleotide; CTG chr11 5196233 5196254 5196238 5196233 -
ctgtgagaccaggttcctagca

SEQ ID NO: 148715 - DNA, 22 bp, Artificial Sequence
  Synthetic oligonucleotide; CTG chr11 5196230 5196251 5196235 5196230 -
tgagaccaggttcctagcaggc

SEQ ID NO: 148716 - DNA, 22 bp, Artificial Sequence
  Synthetic oligonucleotide; TTC chr11 5196217 5196238 5196222 5196217 -
ctagcaggccacggaccagtac

SEQ ID NO: 148717 - DNA, 22 bp, Artificial Sequence
  Synthetic oligonucleotide; CTA chr11 5196214 5196235 5196219 5196214 -
gcaggccacggaccagtactgg

SEQ ID NO: 148718 - DNA, 22 bp, Artificial Sequence
  Synthetic oligonucleotide; CTG chr11 5196193 5196214 5196198 5196193 -
gtaagtggccaggactgctcta

SEQ ID NO: 148719 - DNA, 22 bp, Artificial Sequence
  Synthetic oligonucleotide; CTG chr11 5196176 5196197 5196181 5196176 -
ctctacactatacctccctatt

SEQ ID NO: 148720 - DNA, 22 bp, Artificial Sequence
  Synthetic oligonucleotide; CTC chr11 5196173 5196194 5196178 5196173 -
tacactatacctccctattttc

SEQ ID NO: 148721 - DNA, 22 bp, Artificial Sequence
  Synthetic oligonucleotide; CTA chr11 5196171 5196192 5196176 5196171 -
cactatacctccctattttcct

SEQ ID NO: 148722 - DNA, 22 bp, Artificial Sequence
  Synthetic oligonucleotide; CTA chr11 5196166 5196187 5196171 5196166 -
tacctccctattttcctaggct

SEQ ID NO: 148723 - DNA, 22 bp, Artificial Sequence
  Synthetic oligonucleotide; CTC chr11 5196160 5196181 5196165 5196160 -
cctattttcctaggcttatcaa

SEQ ID NO: 148724 - DNA, 22 bp, Artificial Sequence
  Synthetic oligonucleotide; CTA chr11 5196156 5196177 5196161 5196156 -
ttttcctaggcttatcaaaatc

SEQ ID NO: 148725 - DNA, 22 bp, Artificial Sequence
  Synthetic oligonucleotide; TTT chr11 5196153 5196174 5196158 5196153 -
tcctaggcttatcaaaatcgta

SEQ ID NO: 148726 - DNA, 22 bp, Artificial Sequence
  Synthetic oligonucleotide; TTT chr11 5196152 5196173 5196157 5196152 -
cctaggcttatcaaaatcgtat

SEQ ID NO: 148727 - DNA, 22 bp, Artificial Sequence
  Synthetic oligonucleotide; TTC chr11 5196151 5196172 5196156 5196151 -
ctaggcttatcaaaatcgtatt

SEQ ID NO: 148728 - DNA, 22 bp, Artificial Sequence
  Synthetic oligonucleotide; CTA chr11 5196148 5196169 5196153 5196148 -
ggcttatcaaaatcgtattgtt

SEQ ID NO: 148729 - DNA, 22 bp, Artificial Sequence
  Synthetic oligonucleotide; CTT chr11 5196143 5196164 5196148 5196143 -
atcaaaatcgtattgttaaaca

SEQ ID NO: 148730 - DNA, 22 bp, Artificial Sequence
  Synthetic oligonucleotide; TTA chr11 5196142 5196163 5196147 5196142 -
tcaaaatcgtattgttaaacag

SEQ ID NO: 148731 - DNA, 22 bp, Artificial Sequence
  Synthetic oligonucleotide; TTG chr11 5196128 5196149 5196133 5196128 -
ttaaacagacttaagagatgtt

SEQ ID NO: 148732 - DNA, 22 bp, Artificial Sequence
  Synthetic oligonucleotide; TTA chr11 5196125 5196146 5196130 5196125 -
aacagacttaagagatgttcta

SEQ ID NO: 148733 - DNA, 22 bp, Artificial Sequence
  Synthetic oligonucleotide; CTT chr11 5196116 5196137 5196121 5196116 -
aagagatgttctacttgaggtt

SEQ ID NO: 148734 - DNA, 22 bp, Artificial Sequence
  Synthetic oligonucleotide; TTA chr11 5196115 5196136 5196120 5196115 -
agagatgttctacttgaggttg

SEQ ID NO: 148735 - DNA, 22 bp, Artificial Sequence
  Synthetic oligonucleotide; TTC chr11 5196105 5196126 5196110 5196105 -
tacttgaggttgtgtctccatt

SEQ ID NO: 148736 - DNA, 22 bp, Artificial Sequence
  Synthetic oligonucleotide; CTA chr11 5196103 5196124 5196108 5196103 -
cttgaggttgtgtctccattcc

SEQ ID NO: 148737 - DNA, 22 bp, Artificial Sequence
  Synthetic oligonucleotide; CTT chr11 5196100 5196121 5196105 5196100 -
gaggttgtgtctccattcccta

SEQ ID NO: 148738 - DNA, 22 bp, Artificial Sequence
  Synthetic oligonucleotide; TTG chr11 5196099 5196120 5196104 5196099 -
aggttgtgtctccattccctag

SEQ ID NO: 148739 - DNA, 22 bp, Artificial Sequence
  Synthetic oligonucleotide; TTG chr11 5196093 5196114 5196098 5196093 -
tgtctccattccctaggatatt

SEQ ID NO: 148740 - DNA, 22 bp, Artificial Sequence
  Synthetic oligonucleotide; CTC chr11 5196087 5196108 5196092 5196087 -
cattccctaggatatttgttac

SEQ ID NO: 148741 - DNA, 22 bp, Artificial Sequence
  Synthetic oligonucleotide; TTC chr11 5196082 5196103 5196087 5196082 -
cctaggatatttgttaccatta

SEQ ID NO: 148742 - DNA, 22 bp, Artificial Sequence
  Synthetic oligonucleotide; CTA chr11 5196078 5196099 5196083 5196078 -
ggatatttgttaccattacttg

SEQ ID NO: 148743 - DNA, 22 bp, Artificial Sequence
  Synthetic oligonucleotide; TTT chr11 5196070 5196091 5196075 5196070 -
gttaccattacttgcagaagat

SEQ ID NO: 148744 - DNA, 22 bp, Artificial Sequence
  Synthetic oligonucleotide; TTG chr11 5196069 5196090 5196074 5196069 -
ttaccattacttgcagaagata

SEQ ID NO: 148745 - DNA, 22 bp, Artificial Sequence
  Synthetic oligonucleotide; TTA chr11 5196066 5196087 5196071 5196066 -
ccattacttgcagaagataatt

SEQ ID NO: 148746 - DNA, 22 bp, Artificial Sequence
  Synthetic oligonucleotide; TTA chr11 5196060 5196081 5196065 5196060 -
cttgcagaagataattgctaga

SEQ ID NO: 148747 - DNA, 22 bp, Artificial Sequence
  Synthetic oligonucleotide; CTT chr11 5196057 5196078 5196062 5196057 -
gcagaagataattgctagagta

SEQ ID NO: 148748 - DNA, 22 bp, Artificial Sequence
  Synthetic oligonucleotide; TTG chr11 5196056 5196077 5196061 5196056 -
cagaagataattgctagagtag

SEQ ID NO: 148749 - DNA, 22 bp, Artificial Sequence
  Synthetic oligonucleotide; TTG chr11 5196043 5196064 5196048 5196043 -
ctagagtagtgaatagaggcct

SEQ ID NO: 148750 - DNA, 22 bp, Artificial Sequence
  Synthetic oligonucleotide; CTA chr11 5196040 5196061 5196045 5196040 -
gagtagtgaatagaggcctcca

SEQ ID NO: 148751 - DNA, 22 bp, Artificial Sequence
  Synthetic oligonucleotide; CTC chr11 5196020 5196041 5196025 5196020 -
cagatgaaggaaataaaaatag

SEQ ID NO: 148752 - DNA, 22 bp, Artificial Sequence
  Synthetic oligonucleotide; TTT chr11 5195991 5196012 5195996 5195991 -
tcccagaagtctcttgcagaaa

SEQ ID NO: 148753 - DNA, 22 bp, Artificial Sequence
  Synthetic oligonucleotide; TTT chr11 5195990 5196011 5195995 5195990 -
cccagaagtctcttgcagaaac

SEQ ID NO: 148754 - DNA, 22 bp, Artificial Sequence
  Synthetic oligonucleotide; TTC chr11 5195989 5196010 5195994 5195989 -
ccagaagtctcttgcagaaact

SEQ ID NO: 148755 - DNA, 22 bp, Artificial Sequence
  Synthetic oligonucleotide; CTC chr11 5195978 5195999 5195983 5195978 -
ttgcagaaacttaaaaattaat

SEQ ID NO: 148756 - DNA, 22 bp, Artificial Sequence
  Synthetic oligonucleotide; CTT chr11 5195976 5195997 5195981 5195976 -
gcagaaacttaaaaattaatgc

SEQ ID NO: 148757 - DNA, 22 bp, Artificial Sequence
  Synthetic oligonucleotide; TTG chr11 5195975 5195996 5195980 5195975 -
cagaaacttaaaaattaatgcc

SEQ ID NO: 148758 - DNA, 22 bp, Artificial Sequence
  Synthetic oligonucleotide; CTT chr11 5195966 5195987 5195971 5195966 -
aaaaattaatgccaacctagcc

SEQ ID NO: 148759 - DNA, 22 bp, Artificial Sequence
  Synthetic oligonucleotide; TTA chr11 5195965 5195986 5195970 5195965 -
aaaattaatgccaacctagcca

SEQ ID NO: 148760 - DNA, 22 bp, Artificial Sequence
  Synthetic oligonucleotide; TTA chr11 5195958 5195979 5195963 5195958 -
atgccaacctagccaagaacac

SEQ ID NO: 148761 - DNA, 22 bp, Artificial Sequence
  Synthetic oligonucleotide; CTA chr11 5195947 5195968 5195952 5195947 -
gccaagaacacccctgcagtag

SEQ ID NO: 148762 - DNA, 22 bp, Artificial Sequence
  Synthetic oligonucleotide; CTG chr11 5195931 5195952 5195936 5195931 -
cagtaggagtcgatgtcctaaa

SEQ ID NO: 148763 - DNA, 22 bp, Artificial Sequence
  Synthetic oligonucleotide; CTA chr11 5195911 5195932 5195916 5195911 -
aagcttttccagtaaaagtgtg

SEQ ID NO: 148764 - DNA, 22 bp, Artificial Sequence
  Synthetic oligonucleotide; CTT chr11 5195905 5195926 5195910 5195905 -
ttccagtaaaagtgtggtttct

SEQ ID NO: 148765 - DNA, 22 bp, Artificial Sequence
  Synthetic oligonucleotide; TTT chr11 5195904 5195925 5195909 5195904 -
tccagtaaaagtgtggtttctg

SEQ ID NO: 148766 - DNA, 22 bp, Artificial Sequence
  Synthetic oligonucleotide; TTT chr11 5195903 5195924 5195908 5195903 -
ccagtaaaagtgtggtttctgc

SEQ ID NO: 148767 - DNA, 22 bp, Artificial Sequence
  Synthetic oligonucleotide; TTC chr11 5195902 5195923 5195907 5195902 -
cagtaaaagtgtggtttctgcc

SEQ ID NO: 148768 - DNA, 22 bp, Artificial Sequence
  Synthetic oligonucleotide; TTT chr11 5195885 5195906 5195890 5195885 -
ctgcccctgcagtcttggcacc

SEQ ID NO: 148769 - DNA, 22 bp, Artificial Sequence
  Synthetic oligonucleotide; TTC chr11 5195884 5195905 5195889 5195884 -
tgcccctgcagtcttggcacca

SEQ ID NO: 148770 - DNA, 22 bp, Artificial Sequence
  Synthetic oligonucleotide; CTG chr11 5195882 5195903 5195887 5195882 -
cccctgcagtcttggcaccatg

SEQ ID NO: 148771 - DNA, 22 bp, Artificial Sequence
  Synthetic oligonucleotide; CTG chr11 5195876 5195897 5195881 5195876 -
cagtcttggcaccatgtaatgg

SEQ ID NO: 148772 - DNA, 22 bp, Artificial Sequence
  Synthetic oligonucleotide; CTT chr11 5195869 5195890 5195874 5195869 -
ggcaccatgtaatggcacatag

SEQ ID NO: 148773 - DNA, 22 bp, Artificial Sequence
  Synthetic oligonucleotide; TTG chr11 5195868 5195889 5195873 5195868 -
gcaccatgtaatggcacataga

SEQ ID NO: 148774 - DNA, 22 bp, Artificial Sequence
  Synthetic oligonucleotide; CTT chr11 5195834 5195855 5195839 5195834 -
tcaggttgcagccagaactgag

SEQ ID NO: 148775 - DNA, 22 bp, Artificial Sequence
  Synthetic oligonucleotide; TTT chr11 5195833 5195854 5195838 5195833 -
caggttgcagccagaactgagg

SEQ ID NO: 148776 - DNA, 22 bp, Artificial Sequence
  Synthetic oligonucleotide; TTC chr11 5195832 5195853 5195837 5195832 -
aggttgcagccagaactgagga

SEQ ID NO: 148777 - DNA, 22 bp, Artificial Sequence
  Synthetic oligonucleotide; TTG chr11 5195826 5195847 5195831 5195826 -
cagccagaactgaggaatcaat

SEQ ID NO: 148778 - DNA, 22 bp, Artificial Sequence
  Synthetic oligonucleotide; CTG chr11 5195814 5195835 5195819 5195814 -
aggaatcaatcggtgtttagct

SEQ ID NO: 148779 - DNA, 22 bp, Artificial Sequence
  Synthetic oligonucleotide; TTT chr11 5195796 5195817 5195801 5195796 -
agcttttgagatgctggtaatg

SEQ ID NO: 148780 - DNA, 22 bp, Artificial Sequence
  Synthetic oligonucleotide; TTA chr11 5195795 5195816 5195800 5195795 -
gcttttgagatgctggtaatgt

SEQ ID NO: 148781 - DNA, 22 bp, Artificial Sequence
  Synthetic oligonucleotide; CTT chr11 5195791 5195812 5195796 5195791 -
ttgagatgctggtaatgttctc

SEQ ID NO: 148782 - DNA, 22 bp, Artificial Sequence
  Synthetic oligonucleotide; TTT chr11 5195790 5195811 5195795 5195790 -
tgagatgctggtaatgttctct

SEQ ID NO: 148783 - DNA, 22 bp, Artificial Sequence
  Synthetic oligonucleotide; TTT chr11 5195789 5195810 5195794 5195789 -
gagatgctggtaatgttctctt

SEQ ID NO: 148784 - DNA, 22 bp, Artificial Sequence
  Synthetic oligonucleotide; TTG chr11 5195788 5195809 5195793 5195788 -
agatgctggtaatgttctcttt

SEQ ID NO: 148785 - DNA, 22 bp, Artificial Sequence
  Synthetic oligonucleotide; CTG chr11 5195780 5195801 5195785 5195780 -
gtaatgttctctttcttggtct

SEQ ID NO: 148786 - DNA, 22 bp, Artificial Sequence
  Synthetic oligonucleotide; TTC chr11 5195771 5195792 5195776 5195771 -
tctttcttggtctgagtgtttg

SEQ ID NO: 148787 - DNA, 22 bp, Artificial Sequence
  Synthetic oligonucleotide; CTC chr11 5195769 5195790 5195774 5195769 -
tttcttggtctgagtgtttgtt

SEQ ID NO: 148788 - DNA, 22 bp, Artificial Sequence
  Synthetic oligonucleotide; CTT chr11 5195767 5195788 5195772 5195767 -
tcttggtctgagtgtttgttaa

SEQ ID NO: 148789 - DNA, 22 bp, Artificial Sequence
  Synthetic oligonucleotide; TTT chr11 5195766 5195787 5195771 5195766 -
cttggtctgagtgtttgttaaa

SEQ ID NO: 148790 - DNA, 22 bp, Artificial Sequence
  Synthetic oligonucleotide; TTC chr11 5195765 5195786 5195770 5195765 -
ttggtctgagtgtttgttaaaa

SEQ ID NO: 148791 - DNA, 22 bp, Artificial Sequence
  Synthetic oligonucleotide; CTT chr11 5195763 5195784 5195768 5195763 -
ggtctgagtgtttgttaaaagc

SEQ ID NO: 148792 - DNA, 22 bp, Artificial Sequence
  Synthetic oligonucleotide; TTG chr11 5195762 5195783 5195767 5195762 -
gtctgagtgtttgttaaaagct

SEQ ID NO: 148793 - DNA, 22 bp, Artificial Sequence
  Synthetic oligonucleotide; CTG chr11 5195757 5195778 5195762 5195757 -
agtgtttgttaaaagcttttgc

SEQ ID NO: 148794 - DNA, 22 bp, Artificial Sequence
  Synthetic oligonucleotide; TTT chr11 5195750 5195771 5195755 5195750 -
gttaaaagcttttgctaatttt

SEQ ID NO: 148795 - DNA, 22 bp, Artificial Sequence
  Synthetic oligonucleotide; TTG chr11 5195749 5195770 5195754 5195749 -
ttaaaagcttttgctaattttg

SEQ ID NO: 148796 - DNA, 22 bp, Artificial Sequence
  Synthetic oligonucleotide; TTA chr11 5195746 5195767 5195751 5195746 -
aaagcttttgctaattttgtgt

SEQ ID NO: 148797 - DNA, 22 bp, Artificial Sequence
  Synthetic oligonucleotide; CTT chr11 5195739 5195760 5195744 5195739 -
ttgctaattttgtgtcaattta

SEQ ID NO: 148798 - DNA, 22 bp, Artificial Sequence
  Synthetic oligonucleotide; TTT chr11 5195738 5195759 5195743 5195738 -
tgctaattttgtgtcaatttaa

SEQ ID NO: 148799 - DNA, 22 bp, Artificial Sequence
  Synthetic oligonucleotide; TTT chr11 5195737 5195758 5195742 5195737 -
gctaattttgtgtcaatttaac

SEQ ID NO: 148800 - DNA, 22 bp, Artificial Sequence
  Synthetic oligonucleotide; TTG chr11 5195736 5195757 5195741 5195736 -
ctaattttgtgtcaatttaaca

SEQ ID NO: 148801 - DNA, 22 bp, Artificial Sequence
  Synthetic oligonucleotide; CTA chr11 5195733 5195754 5195738 5195733 -
attttgtgtcaatttaacaaac

SEQ ID NO: 148802 - DNA, 22 bp, Artificial Sequence
  Synthetic oligonucleotide; TTT chr11 5195729 5195750 5195734 5195729 -
tgtgtcaatttaacaaactgta

SEQ ID NO: 148803 - DNA, 22 bp, Artificial Sequence
  Synthetic oligonucleotide; TTT chr11 5195728 5195749 5195733 5195728 -
gtgtcaatttaacaaactgtac

SEQ ID NO: 148804 - DNA, 22 bp, Artificial Sequence
  Synthetic oligonucleotide; TTG chr11 5195727 5195748 5195732 5195727 -
tgtcaatttaacaaactgtact

SEQ ID NO: 148805 - DNA, 22 bp, Artificial Sequence
  Synthetic oligonucleotide; TTT chr11 5195718 5195739 5195723 5195718 -
aacaaactgtacttttatttat

SEQ ID NO: 148806 - DNA, 22 bp, Artificial Sequence
  Synthetic oligonucleotide; TTA chr11 5195717 5195738 5195722 5195717 -
acaaactgtacttttatttatg

SEQ ID NO: 148807 - DNA, 22 bp, Artificial Sequence
  Synthetic oligonucleotide; CTG chr11 5195709 5195730 5195714 5195709 -
tacttttatttatgtatttttc

SEQ ID NO: 148808 - DNA, 22 bp, Artificial Sequence
  Synthetic oligonucleotide; CTT chr11 5195704 5195725 5195709 5195704 -
ttatttatgtatttttctgtac

SEQ ID NO: 148809 - DNA, 22 bp, Artificial Sequence
  Synthetic oligonucleotide; TTT chr11 5195703 5195724 5195708 5195703 -
tatttatgtatttttctgtact

SEQ ID NO: 148810 - DNA, 22 bp, Artificial Sequence
  Synthetic oligonucleotide; TTT chr11 5195702 5195723 5195707 5195702 -
atttatgtatttttctgtactg

SEQ ID NO: 148811 - DNA, 22 bp, Artificial Sequence
  Synthetic oligonucleotide; TTA chr11 5195701 5195722 5195706 5195701 -
tttatgtatttttctgtactga

SEQ ID NO: 148812 - DNA, 22 bp, Artificial Sequence
  Synthetic oligonucleotide; TTT chr11 5195698 5195719 5195703 5195698 -
atgtatttttctgtactgaata

SEQ ID NO: 148813 - DNA, 22 bp, Artificial Sequence
  Synthetic oligonucleotide; TTA chr11 5195697 5195718 5195702 5195697 -
tgtatttttctgtactgaataa

SEQ ID NO: 148814 - DNA, 22 bp, Artificial Sequence
  Synthetic oligonucleotide; TTT chr11 5195690 5195711 5195695 5195690 -
ttctgtactgaataataaaata

SEQ ID NO: 148815 - DNA, 22 bp, Artificial Sequence
  Synthetic oligonucleotide; TTT chr11 5195689 5195710 5195694 5195689 -
tctgtactgaataataaaatat

SEQ ID NO: 148816 - DNA, 22 bp, Artificial Sequence
  Synthetic oligonucleotide; TTT chr11 5195688 5195709 5195693 5195688 -
ctgtactgaataataaaatata

SEQ ID NO: 148817 - DNA, 22 bp, Artificial Sequence
  Synthetic oligonucleotide; TTC chr11 5195687 5195708 5195692 5195687 -
tgtactgaataataaaatataa

SEQ ID NO: 148818 - DNA, 22 bp, Artificial Sequence
  Synthetic oligonucleotide; CTG chr11 5195685 5195706 5195690 5195685 -
tactgaataataaaatataaat

SEQ ID NO: 148819 - DNA, 22 bp, Artificial Sequence
  Synthetic oligonucleotide; CTG chr11 5195680 5195701 5195685 5195680 -
aataataaaatataaatttaag

SEQ ID NO: 148820 - DNA, 22 bp, Artificial Sequence
  Synthetic oligonucleotide; TTT chr11 5195661 5195682 5195666 5195661 -
aagaaatatgagtgaaagtgtc

SEQ ID NO: 148821 - DNA, 22 bp, Artificial Sequence
  Synthetic oligonucleotide; TTA chr11 5195660 5195681 5195665 5195660 -
agaaatatgagtgaaagtgtca

SEQ ID NO: 148822 - DNA, 22 bp, Artificial Sequence
  Synthetic oligonucleotide; TTT chr11 5195634 5195655 5195639 5195634 -
acatataaacctggcagactga

SEQ ID NO: 148823 - DNA, 22 bp, Artificial Sequence
  Synthetic oligonucleotide; TTA chr11 5195633 5195654 5195638 5195633 -
catataaacctggcagactgaa

SEQ ID NO: 148824 - DNA, 22 bp, Artificial Sequence
  Synthetic oligonucleotide; CTG chr11 5195621 5195642 5195626 5195621 -
gcagactgaatatgtgttcatt

SEQ ID NO: 148825 - DNA, 22 bp, Artificial Sequence
  Synthetic oligonucleotide; CTG chr11 5195613 5195634 5195618 5195613 -
aatatgtgttcatttctgctac

SEQ ID NO: 148826 - DNA, 22 bp, Artificial Sequence
  Synthetic oligonucleotide; TTC chr11 5195602 5195623 5195607 5195602 -
atttctgctactttctctaatc

SEQ ID NO: 148827 - DNA, 22 bp, Artificial Sequence
  Synthetic oligonucleotide; TTT chr11 5195598 5195619 5195603 5195598 -
ctgctactttctctaatccact

SEQ ID NO: 148828 - DNA, 22 bp, Artificial Sequence
  Synthetic oligonucleotide; TTC chr11 5195597 5195618 5195602 5195597 -
tgctactttctctaatccacta

SEQ ID NO: 148829 - DNA, 22 bp, Artificial Sequence
  Synthetic oligonucleotide; CTG chr11 5195595 5195616 5195600 5195595 -
ctactttctctaatccactaaa

SEQ ID NO: 148830 - DNA, 22 bp, Artificial Sequence
  Synthetic oligonucleotide; CTA chr11 5195592 5195613 5195597 5195592 -
ctttctctaatccactaaagct

SEQ ID NO: 148831 - DNA, 22 bp, Artificial Sequence
  Synthetic oligonucleotide; CTT chr11 5195589 5195610 5195594 5195589 -
tctctaatccactaaagctata

SEQ ID NO: 148832 - DNA, 22 bp, Artificial Sequence
  Synthetic oligonucleotide; TTT chr11 5195588 5195609 5195593 5195588 -
ctctaatccactaaagctatag

SEQ ID NO: 148833 - DNA, 22 bp, Artificial Sequence
  Synthetic oligonucleotide; TTC chr11 5195587 5195608 5195592 5195587 -
tctaatccactaaagctataga

SEQ ID NO: 148834 - DNA, 22 bp, Artificial Sequence
  Synthetic oligonucleotide; CTC chr11 5195585 5195606 5195590 5195585 -
taatccactaaagctatagatg

SEQ ID NO: 148835 - DNA, 22 bp, Artificial Sequence
  Synthetic oligonucleotide; CTA chr11 5195583 5195604 5195588 5195583 -
atccactaaagctatagatgta

SEQ ID NO: 148836 - DNA, 22 bp, Artificial Sequence
  Synthetic oligonucleotide; CTA chr11 5195575 5195596 5195580 5195575 -
aagctatagatgtacacagaga

SEQ ID NO: 148837 - DNA, 22 bp, Artificial Sequence
  Synthetic oligonucleotide; CTA chr11 5195569 5195590 5195574 5195569 -
tagatgtacacagagacactgt

SEQ ID NO: 148838 - DNA, 22 bp, Artificial Sequence
  Synthetic oligonucleotide; CTG chr11 5195548 5195569 5195553 5195548 -
tgaagaaaatagcacaatatgt

SEQ ID NO: 148839 - DNA, 22 bp, Artificial Sequence
  Synthetic oligonucleotide; TTG chr11 5195514 5195535 5195519 5195514 -
ataagtatatacatttaaatat

SEQ ID NO: 148840 - DNA, 22 bp, Artificial Sequence
  Synthetic oligonucleotide; TTT chr11 5195498 5195519 5195503 5195498 -
aaatatgattttttaaaaaaca

SEQ ID NO: 148841 - DNA, 22 bp, Artificial Sequence
  Synthetic oligonucleotide; TTA chr11 5195497 5195518 5195502 5195497 -
aatatgattttttaaaaaacag

SEQ ID NO: 148842 - DNA, 22 bp, Artificial Sequence
  Synthetic oligonucleotide; TTT chr11 5195487 5195508 5195492 5195487 -
tttaaaaaacagaacaggataa

SEQ ID NO: 148843 - DNA, 22 bp, Artificial Sequence
  Synthetic oligonucleotide; TTT chr11 5195486 5195507 5195491 5195486 -
ttaaaaaacagaacaggataat

SEQ ID NO: 148844 - DNA, 22 bp, Artificial Sequence
  Synthetic oligonucleotide; TTT chr11 5195485 5195506 5195490 5195485 -
taaaaaacagaacaggataatc

SEQ ID NO: 148845 - DNA, 22 bp, Artificial Sequence
  Synthetic oligonucleotide; TTT chr11 5195484 5195505 5195489 5195484 -
aaaaaacagaacaggataatct

SEQ ID NO: 148846 - DNA, 22 bp, Artificial Sequence
  Synthetic oligonucleotide; TTA chr11 5195483 5195504 5195488 5195483 -
aaaaacagaacaggataatctg

SEQ ID NO: 148847 - DNA, 22 bp, Artificial Sequence
  Synthetic oligonucleotide; CTG chr11 5195461 5195482 5195466 5195461 -
aaatctatatgtctacagaaaa

SEQ ID NO: 148848 - DNA, 22 bp, Artificial Sequence
  Synthetic oligonucleotide; CTA chr11 5195454 5195475 5195459 5195454 -
tatgtctacagaaaaggatacc

SEQ ID NO: 148849 - DNA, 22 bp, Artificial Sequence
  Synthetic oligonucleotide; CTA chr11 5195446 5195467 5195451 5195446 -
cagaaaaggataccaatgagaa

SEQ ID NO: 148850 - DNA, 22 bp, Artificial Sequence
  Synthetic oligonucleotide; TTA chr11 5195415 5195436 5195420 5195415 -
tctgcaaagagcattttctgga

SEQ ID NO: 148851 - DNA, 22 bp, Artificial Sequence
  Synthetic oligonucleotide; CTG chr11 5195411 5195432 5195416 5195411 -
caaagagcattttctggaaaaa

SEQ ID NO: 148852 - DNA, 22 bp, Artificial Sequence
  Synthetic oligonucleotide; TTT chr11 5195399 5195420 5195404 5195399 -
tctggaaaaacacagaaattac

SEQ ID NO: 148853 - DNA, 22 bp, Artificial Sequence
  Synthetic oligonucleotide; TTT chr11 5195398 5195419 5195403 5195398 -
ctggaaaaacacagaaattact

SEQ ID NO: 148854 - DNA, 22 bp, Artificial Sequence
  Synthetic oligonucleotide; TTC chr11 5195397 5195418 5195402 5195397 -
tggaaaaacacagaaattactt

SEQ ID NO: 148855 - DNA, 22 bp, Artificial Sequence
  Synthetic oligonucleotide; CTG chr11 5195395 5195416 5195400 5195395 -
gaaaaacacagaaattacttat

SEQ ID NO: 148856 - DNA, 22 bp, Artificial Sequence
  Synthetic oligonucleotide; TTA chr11 5195378 5195399 5195383 5195378 -
cttataaagcattcgtgagggg

SEQ ID NO: 148857 - DNA, 22 bp, Artificial Sequence
  Synthetic oligonucleotide; CTT chr11 5195375 5195396 5195380 5195375 -
ataaagcattcgtgaggggtag

SEQ ID NO: 148858 - DNA, 22 bp, Artificial Sequence
  Synthetic oligonucleotide; TTA chr11 5195374 5195395 5195379 5195374 -
taaagcattcgtgaggggtagg

SEQ ID NO: 148859 - DNA, 22 bp, Artificial Sequence
  Synthetic oligonucleotide; TTC chr11 5195364 5195385 5195369 5195364 -
gtgaggggtagggctaaaaatg

SEQ ID NO: 148860 - DNA, 22 bp, Artificial Sequence
  Synthetic oligonucleotide; CTA chr11 5195348 5195369 5195353 5195348 -
aaaatggtagaaaaggtgaata

SEQ ID NO: 148861 - DNA, 22 bp, Artificial Sequence
  Synthetic oligonucleotide; CTG chr11 5195322 5195343 5195327 5195322 -
tttaaggttgcctaaaagatag

SEQ ID NO: 148862 - DNA, 22 bp, Artificial Sequence
  Synthetic oligonucleotide; TTT chr11 5195319 5195340 5195324 5195319 -
aaggttgcctaaaagatagcca

SEQ ID NO: 148863 - DNA, 22 bp, Artificial Sequence
  Synthetic oligonucleotide; TTA chr11 5195318 5195339 5195323 5195318 -
aggttgcctaaaagatagccag

SEQ ID NO: 148864 - DNA, 22 bp, Artificial Sequence
  Synthetic oligonucleotide; TTG chr11 5195312 5195333 5195317 5195312 -
cctaaaagatagccaggtactc

SEQ ID NO: 148865 - DNA, 22 bp, Artificial Sequence
  Synthetic oligonucleotide; CTA chr11 5195308 5195329 5195313 5195308 -
aaagatagccaggtactcattt

SEQ ID NO: 148866 - DNA, 22 bp, Artificial Sequence
  Synthetic oligonucleotide; CTC chr11 5195290 5195311 5195295 5195290 -
atttctctttagttctggcaaa

SEQ ID NO: 148867 - DNA, 22 bp, Artificial Sequence
  Synthetic oligonucleotide; TTT chr11 5195286 5195307 5195291 5195286 -
ctctttagttctggcaaaatga

SEQ ID NO: 148868 - DNA, 22 bp, Artificial Sequence
  Synthetic oligonucleotide; TTC chr11 5195285 5195306 5195290 5195285 -
tctttagttctggcaaaatgat

SEQ ID NO: 148869 - DNA, 22 bp, Artificial Sequence
  Synthetic oligonucleotide; CTC chr11 5195283 5195304 5195288 5195283 -
tttagttctggcaaaatgatta

SEQ ID NO: 148870 - DNA, 22 bp, Artificial Sequence
  Synthetic oligonucleotide; CTT chr11 5195281 5195302 5195286 5195281 -
tagttctggcaaaatgattagt

SEQ ID NO: 148871 - DNA, 22 bp, Artificial Sequence
  Synthetic oligonucleotide; TTT chr11 5195280 5195301 5195285 5195280 -
agttctggcaaaatgattagtg

SEQ ID NO: 148872 - DNA, 22 bp, Artificial Sequence
  Synthetic oligonucleotide; TTA chr11 5195279 5195300 5195284 5195279 -
gttctggcaaaatgattagtgt

SEQ ID NO: 148873 - DNA, 22 bp, Artificial Sequence
  Synthetic oligonucleotide; TTC chr11 5195275 5195296 5195280 5195275 -
tggcaaaatgattagtgtctgt

SEQ ID NO: 148874 - DNA, 22 bp, Artificial Sequence
  Synthetic oligonucleotide; CTG chr11 5195273 5195294 5195278 5195273 -
gcaaaatgattagtgtctgtag

SEQ ID NO: 148875 - DNA, 22 bp, Artificial Sequence
  Synthetic oligonucleotide; TTA chr11 5195261 5195282 5195266 5195261 -
gtgtctgtagtaaccaaatcaa

SEQ ID NO: 148876 - DNA, 22 bp, Artificial Sequence
  Synthetic oligonucleotide; CTG chr11 5195254 5195275 5195259 5195254 -
tagtaaccaaatcaatgatgat

SEQ ID NO: 148877 - DNA, 22 bp, Artificial Sequence
  Synthetic oligonucleotide; CTG chr11 5195222 5195243 5195227 5195222 -
ggaaattcagtgcaaaggatgc

SEQ ID NO: 148878 - DNA, 22 bp, Artificial Sequence
  Synthetic oligonucleotide; TTC chr11 5195214 5195235 5195219 5195214 -
agtgcaaaggatgccaggacta

SEQ ID NO: 148879 - DNA, 22 bp, Artificial Sequence
  Synthetic oligonucleotide; CTA chr11 5195192 5195213 5195197 5195192 -
aggtgtaatatatgaaacagag

SEQ ID NO: 148880 - DNA, 22 bp, Artificial Sequence
  Synthetic oligonucleotide; TTA chr11 5195164 5195185 5195169 5195164 -
tgcaaaagaatacatattgaat

SEQ ID NO: 148881 - DNA, 22 bp, Artificial Sequence
  Synthetic oligonucleotide; TTG chr11 5195145 5195166 5195150 5195145 -
aatgatgataaactgtctcaag

SEQ ID NO: 148882 - DNA, 22 bp, Artificial Sequence
  Synthetic oligonucleotide; CTG chr11 5195130 5195151 5195135 5195130 -
tctcaagagaaaggactaatag

SEQ ID NO: 148883 - DNA, 22 bp, Artificial Sequence
  Synthetic oligonucleotide; CTC chr11 5195126 5195147 5195131 5195126 -
aagagaaaggactaatagatat

SEQ ID NO: 148884 - DNA, 22 bp, Artificial Sequence
  Synthetic oligonucleotide; CTA chr11 5195112 5195133 5195117 5195112 -
atagatattggcatttgagtat

SEQ ID NO: 148885 - DNA, 22 bp, Artificial Sequence
  Synthetic oligonucleotide; TTG chr11 5195102 5195123 5195107 5195102 -
gcatttgagtattcgcttactg

SEQ ID NO: 148886 - DNA, 22 bp, Artificial Sequence
  Synthetic oligonucleotide; TTT chr11 5195096 5195117 5195101 5195096 -
gagtattcgcttactggattag

SEQ ID NO: 148887 - DNA, 22 bp, Artificial Sequence
  Synthetic oligonucleotide; TTG chr11 5195095 5195116 5195100 5195095 -
agtattcgcttactggattagc

SEQ ID NO: 148888 - DNA, 22 bp, Artificial Sequence
  Synthetic oligonucleotide; TTC chr11 5195088 5195109 5195093 5195088 -
gcttactggattagctaggctt

SEQ ID NO: 148889 - DNA, 22 bp, Artificial Sequence
  Synthetic oligonucleotide; CTT chr11 5195084 5195105 5195089 5195084 -
actggattagctaggcttcttt

SEQ ID NO: 148890 - DNA, 22 bp, Artificial Sequence
  Synthetic oligonucleotide; TTA chr11 5195083 5195104 5195088 5195083 -
ctggattagctaggcttctttc

SEQ ID NO: 148891 - DNA, 22 bp, Artificial Sequence
  Synthetic oligonucleotide; CTG chr11 5195080 5195101 5195085 5195080 -
gattagctaggcttctttctga

SEQ ID NO: 148892 - DNA, 22 bp, Artificial Sequence
  Synthetic oligonucleotide; TTA chr11 5195075 5195096 5195080 5195075 -
gctaggcttctttctgatcagc

SEQ ID NO: 148893 - DNA, 22 bp, Artificial Sequence
  Synthetic oligonucleotide; CTA chr11 5195071 5195092 5195076 5195071 -
ggcttctttctgatcagccttc

SEQ ID NO: 148894 - DNA, 22 bp, Artificial Sequence
  Synthetic oligonucleotide; CTT chr11 5195066 5195087 5195071 5195066 -
ctttctgatcagccttcaaagt

SEQ ID NO: 148895 - DNA, 22 bp, Artificial Sequence
  Synthetic oligonucleotide; TTC chr11 5195065 5195086 5195070 5195065 -
tttctgatcagccttcaaagta

SEQ ID NO: 148896 - DNA, 22 bp, Artificial Sequence
  Synthetic oligonucleotide; CTT chr11 5195063 5195084 5195068 5195063 -
tctgatcagccttcaaagtaac

SEQ ID NO: 148897 - DNA, 22 bp, Artificial Sequence
  Synthetic oligonucleotide; TTT chr11 5195062 5195083 5195067 5195062 -
ctgatcagccttcaaagtaact

SEQ ID NO: 148898 - DNA, 22 bp, Artificial Sequence
  Synthetic oligonucleotide; TTC chr11 5195061 5195082 5195066 5195061 -
tgatcagccttcaaagtaactg

SEQ ID NO: 148899 - DNA, 22 bp, Artificial Sequence
  Synthetic oligonucleotide; CTG chr11 5195059 5195080 5195064 5195059 -
atcagccttcaaagtaactggc

SEQ ID NO: 148900 - DNA, 22 bp, Artificial Sequence
  Synthetic oligonucleotide; CTT chr11 5195050 5195071 5195055 5195050 -
caaagtaactggccagataact

SEQ ID NO: 148901 - DNA, 22 bp, Artificial Sequence
  Synthetic oligonucleotide; TTC chr11 5195049 5195070 5195054 5195049 -
aaagtaactggccagataacta

SEQ ID NO: 148902 - DNA, 22 bp, Artificial Sequence
  Synthetic oligonucleotide; CTG chr11 5195039 5195060 5195044 5195039 -
gccagataactaattgtaccgt

SEQ ID NO: 148903 - DNA, 22 bp, Artificial Sequence
  Synthetic oligonucleotide; CTA chr11 5195027 5195048 5195032 5195027 -
attgtaccgtgttcatagaaat

SEQ ID NO: 148904 - DNA, 22 bp, Artificial Sequence
  Synthetic oligonucleotide; TTG chr11 5195023 5195044 5195028 5195023 -
taccgtgttcatagaaatcccc

SEQ ID NO: 148905 - DNA, 22 bp, Artificial Sequence
  Synthetic oligonucleotide; TTC chr11 5195013 5195034 5195018 5195013 -
atagaaatccccactatactct

SEQ ID NO: 148906 - DNA, 22 bp, Artificial Sequence
  Synthetic oligonucleotide; CTA chr11 5194997 5195018 5195002 5194997 -
tactctttttaaaattatttta

SEQ ID NO: 148907 - DNA, 22 bp, Artificial Sequence
  Synthetic oligonucleotide; CTC chr11 5194992 5195013 5194997 5194992 -
tttttaaaattattttatttta

SEQ ID NO: 148908 - DNA, 22 bp, Artificial Sequence
  Synthetic oligonucleotide; CTT chr11 5194990 5195011 5194995 5194990 -
tttaaaattattttattttatt

SEQ ID NO: 148909 - DNA, 22 bp, Artificial Sequence
  Synthetic oligonucleotide; TTT chr11 5194989 5195010 5194994 5194989 -
ttaaaattattttattttatta

SEQ ID NO: 148910 - DNA, 22 bp, Artificial Sequence
  Synthetic oligonucleotide; TTT chr11 5194988 5195009 5194993 5194988 -
taaaattattttattttattat

SEQ ID NO: 148911 - DNA, 22 bp, Artificial Sequence
  Synthetic oligonucleotide; TTT chr11 5194987 5195008 5194992 5194987 -
aaaattattttattttattatt

SEQ ID NO: 148912 - DNA, 22 bp, Artificial Sequence
  Synthetic oligonucleotide; TTA chr11 5194986 5195007 5194991 5194986 -
aaattattttattttattatta

SEQ ID NO: 148913 - DNA, 22 bp, Artificial Sequence
  Synthetic oligonucleotide; TTA chr11 5194980 5195001 5194985 5194980 -
ttttattttattattattatac

SEQ ID NO: 148914 - DNA, 22 bp, Artificial Sequence
  Synthetic oligonucleotide; TTT chr11 5194977 5194998 5194982 5194977 -
tattttattattattatacttt

SEQ ID NO: 148915 - DNA, 22 bp, Artificial Sequence
  Synthetic oligonucleotide; TTT chr11 5194976 5194997 5194981 5194976 -
attttattattattatacttta

SEQ ID NO: 148916 - DNA, 22 bp, Artificial Sequence
  Synthetic oligonucleotide; TTA chr11 5194975 5194996 5194980 5194975 -
ttttattattattatactttaa

SEQ ID NO: 148917 - DNA, 22 bp, Artificial Sequence
  Synthetic oligonucleotide; TTT chr11 5194972 5194993 5194977 5194972 -
tattattattatactttaagtt

SEQ ID NO: 148918 - DNA, 22 bp, Artificial Sequence
  Synthetic oligonucleotide; TTT chr11 5194971 5194992 5194976 5194971 -
attattattatactttaagttt

SEQ ID NO: 148919 - DNA, 22 bp, Artificial Sequence
  Synthetic oligonucleotide; TTA chr11 5194970 5194991 5194975 5194970 -
ttattattatactttaagtttt

SEQ ID NO: 148920 - DNA, 22 bp, Artificial Sequence
  Synthetic oligonucleotide; TTA chr11 5194967 5194988 5194972 5194967 -
ttattatactttaagttttagg

SEQ ID NO: 148921 - DNA, 22 bp, Artificial Sequence
  Synthetic oligonucleotide; TTA chr11 5194964 5194985 5194969 5194964 -
ttatactttaagttttagggta

SEQ ID NO: 148922 - DNA, 22 bp, Artificial Sequence
  Synthetic oligonucleotide; TTA chr11 5194961 5194982 5194966 5194961 -
tactttaagttttagggtacat

SEQ ID NO: 148923 - DNA, 22 bp, Artificial Sequence
  Synthetic oligonucleotide; CTT chr11 5194956 5194977 5194961 5194956 -
taagttttagggtacatgtgca

SEQ ID NO: 148924 - DNA, 22 bp, Artificial Sequence
  Synthetic oligonucleotide; TTT chr11 5194955 5194976 5194960 5194955 -
aagttttagggtacatgtgcac

SEQ ID NO: 148925 - DNA, 22 bp, Artificial Sequence
  Synthetic oligonucleotide; TTA chr11 5194954 5194975 5194959 5194954 -
agttttagggtacatgtgcaca

SEQ ID NO: 148926 - DNA, 22 bp, Artificial Sequence
  Synthetic oligonucleotide; TTT chr11 5194949 5194970 5194954 5194949 -
tagggtacatgtgcacaatgtg

SEQ ID NO: 148927 - DNA, 22 bp, Artificial Sequence
  Synthetic oligonucleotide; TTT chr11 5194948 5194969 5194953 5194948 -
agggtacatgtgcacaatgtgc

SEQ ID NO: 148928 - DNA, 22 bp, Artificial Sequence
  Synthetic oligonucleotide; TTA chr11 5194947 5194968 5194952 5194947 -
gggtacatgtgcacaatgtgca

SEQ ID NO: 148929 - DNA, 22 bp, Artificial Sequence
  Synthetic oligonucleotide; TTA chr11 5194920 5194941 5194925 5194920 -
gttacatatgtatacatgtgcc

SEQ ID NO: 148930 - DNA, 22 bp, Artificial Sequence
  Synthetic oligonucleotide; TTA chr11 5194916 5194937 5194921 5194916 -
catatgtatacatgtgccatgc

SEQ ID NO: 148931 - DNA, 22 bp, Artificial Sequence
  Synthetic oligonucleotide; CTG chr11 5194892 5194913 5194897 5194892 -
gtgtgcttcacccattaactca

SEQ ID NO: 148932 - DNA, 22 bp, Artificial Sequence
  Synthetic oligonucleotide; CTT chr11 5194884 5194905 5194889 5194884 -
cacccattaactcatcatttag

SEQ ID NO: 148933 - DNA, 22 bp, Artificial Sequence
  Synthetic oligonucleotide; TTC chr11 5194883 5194904 5194888 5194883 -
acccattaactcatcatttagc

SEQ ID NO: 148934 - DNA, 22 bp, Artificial Sequence
  Synthetic oligonucleotide; TTA chr11 5194875 5194896 5194880 5194875 -
actcatcatttagcattaggta

SEQ ID NO: 148935 - DNA, 22 bp, Artificial Sequence
  Synthetic oligonucleotide; CTC chr11 5194871 5194892 5194876 5194871 -
atcatttagcattaggtatatc

SEQ ID NO: 148936 - DNA, 22 bp, Artificial Sequence
  Synthetic oligonucleotide; TTT chr11 5194864 5194885 5194869 5194864 -
agcattaggtatatctcctaat

SEQ ID NO: 148937 - DNA, 22 bp, Artificial Sequence
  Synthetic oligonucleotide; TTA chr11 5194863 5194884 5194868 5194863 -
gcattaggtatatctcctaatg

SEQ ID NO: 148938 - DNA, 22 bp, Artificial Sequence
  Synthetic oligonucleotide; TTA chr11 5194857 5194878 5194862 5194857 -
ggtatatctcctaatgctatcc

SEQ ID NO: 148939 - DNA, 22 bp, Artificial Sequence
  Synthetic oligonucleotide; CTC chr11 5194847 5194868 5194852 5194847 -
ctaatgctatccctcctccctc

SEQ ID NO: 148940 - DNA, 22 bp, Artificial Sequence
  Synthetic oligonucleotide; CTA chr11 5194844 5194865 5194849 5194844 -
atgctatccctcctccctcccc

SEQ ID NO: 148941 - DNA, 22 bp, Artificial Sequence
  Synthetic oligonucleotide; CTA chr11 5194838 5194859 5194843 5194838 -
tccctcctccctccccccaccc

SEQ ID NO: 148942 - DNA, 22 bp, Artificial Sequence
  Synthetic oligonucleotide; CTC chr11 5194832 5194853 5194837 5194832 -
ctccctccccccaccccacaac

SEQ ID NO: 148943 - DNA, 22 bp, Artificial Sequence
  Synthetic oligonucleotide; CTC chr11 5194829 5194850 5194834 5194829 -
cctccccccaccccacaacagt

SEQ ID NO: 148944 - DNA, 22 bp, Artificial Sequence
  Synthetic oligonucleotide; CTC chr11 5194825 5194846 5194830 5194825 -
cccccaccccacaacagtcccc

SEQ ID NO: 148945 - DNA, 22 bp, Artificial Sequence
  Synthetic oligonucleotide; TTC chr11 5194789 5194810 5194794 5194789 -
cccttcctgtgtccatgtgttc

SEQ ID NO: 148946 - DNA, 22 bp, Artificial Sequence
  Synthetic oligonucleotide; CTT chr11 5194784 5194805 5194789 5194784 -
cctgtgtccatgtgttctcatt

SEQ ID NO: 148947 - DNA, 22 bp, Artificial Sequence
  Synthetic oligonucleotide; TTC chr11 5194783 5194804 5194788 5194783 -
ctgtgtccatgtgttctcattg

SEQ ID NO: 148948 - DNA, 22 bp, Artificial Sequence
  Synthetic oligonucleotide; CTG chr11 5194780 5194801 5194785 5194780 -
tgtccatgtgttctcattgttc

SEQ ID NO: 148949 - DNA, 22 bp, Artificial Sequence
  Synthetic oligonucleotide; TTC chr11 5194767 5194788 5194772 5194767 -
tcattgttcaattcccacctat

SEQ ID NO: 148950 - DNA, 22 bp, Artificial Sequence
  Synthetic oligonucleotide; CTC chr11 5194765 5194786 5194770 5194765 -
attgttcaattcccacctatga

SEQ ID NO: 148951 - DNA, 22 bp, Artificial Sequence
  Synthetic oligonucleotide; TTG chr11 5194761 5194782 5194766 5194761 -
ttcaattcccacctatgagtga

SEQ ID NO: 148952 - DNA, 22 bp, Artificial Sequence
  Synthetic oligonucleotide; TTC chr11 5194758 5194779 5194763 5194758 -
aattcccacctatgagtgagaa

SEQ ID NO: 148953 - DNA, 22 bp, Artificial Sequence
  Synthetic oligonucleotide; TTC chr11 5194753 5194774 5194758 5194753 -
ccacctatgagtgagaacatgc

SEQ ID NO: 148954 - DNA, 22 bp, Artificial Sequence
  Synthetic oligonucleotide; CTA chr11 5194746 5194767 5194751 5194746 -
tgagtgagaacatgcagtgttt

SEQ ID NO: 148955 - DNA, 22 bp, Artificial Sequence
  Synthetic oligonucleotide; TTT chr11 5194724 5194745 5194729 5194724 -
ggtttttcgtccttgcgatagt

SEQ ID NO: 148956 - DNA, 22 bp, Artificial Sequence
  Synthetic oligonucleotide; TTG chr11 5194723 5194744 5194728 5194723 -
gtttttcgtccttgcgatagtt

SEQ ID NO: 148957 - DNA, 22 bp, Artificial Sequence
  Synthetic oligonucleotide; TTT chr11 5194719 5194740 5194724 5194719 -
ttcgtccttgcgatagtttact

SEQ ID NO: 148958 - DNA, 22 bp, Artificial Sequence
  Synthetic oligonucleotide; TTT chr11 5194718 5194739 5194723 5194718 -
tcgtccttgcgatagtttactg

SEQ ID NO: 148959 - DNA, 22 bp, Artificial Sequence
  Synthetic oligonucleotide; TTT chr11 5194717 5194738 5194722 5194717 -
cgtccttgcgatagtttactga

SEQ ID NO: 148960 - DNA, 22 bp, Artificial Sequence
  Synthetic oligonucleotide; TTC chr11 5194716 5194737 5194721 5194716 -
gtccttgcgatagtttactgag

SEQ ID NO: 148961 - DNA, 22 bp, Artificial Sequence
  Synthetic oligonucleotide; CTT chr11 5194710 5194731 5194715 5194710 -
gcgatagtttactgagaatgat

SEQ ID NO: 148962 - DNA, 22 bp, Artificial Sequence
  Synthetic oligonucleotide; TTG chr11 5194709 5194730 5194714 5194709 -
cgatagtttactgagaatgatg

SEQ ID NO: 148963 - DNA, 22 bp, Artificial Sequence
  Synthetic oligonucleotide; TTT chr11 5194700 5194721 5194705 5194700 -
actgagaatgatgatttccaat

SEQ ID NO: 148964 - DNA, 22 bp, Artificial Sequence
  Synthetic oligonucleotide; TTA chr11 5194699 5194720 5194704 5194699 -
ctgagaatgatgatttccaatt

SEQ ID NO: 148965 - DNA, 22 bp, Artificial Sequence
  Synthetic oligonucleotide; CTG chr11 5194696 5194717 5194701 5194696 -
agaatgatgatttccaatttca

SEQ ID NO: 148966 - DNA, 22 bp, Artificial Sequence
  Synthetic oligonucleotide; TTT chr11 5194683 5194704 5194688 5194683 -
ccaatttcatccatgtccctac

SEQ ID NO: 148967 - DNA, 22 bp, Artificial Sequence
  Synthetic oligonucleotide; TTC chr11 5194682 5194703 5194687 5194682 -
caatttcatccatgtccctaca

SEQ ID NO: 148968 - DNA, 22 bp, Artificial Sequence
  Synthetic oligonucleotide; TTT chr11 5194676 5194697 5194681 5194676 -
catccatgtccctacaaaggac

SEQ ID NO: 148969 - DNA, 22 bp, Artificial Sequence
  Synthetic oligonucleotide; TTC chr11 5194675 5194696 5194680 5194675 -
atccatgtccctacaaaggaca

SEQ ID NO: 148970 - DNA, 22 bp, Artificial Sequence
  Synthetic oligonucleotide; CTA chr11 5194662 5194683 5194667 5194662 -
caaaggacatgaactcatcctt

SEQ ID NO: 148971 - DNA, 22 bp, Artificial Sequence
  Synthetic oligonucleotide; CTC chr11 5194646 5194667 5194651 5194646 -
atccttttttatggctgcatag

SEQ ID NO: 148972 - DNA, 22 bp, Artificial Sequence
  Synthetic oligonucleotide; CTT chr11 5194640 5194661 5194645 5194640 -
ttttatggctgcatagtattcc

SEQ ID NO: 148973 - DNA, 22 bp, Artificial Sequence
  Synthetic oligonucleotide; TTT chr11 5194639 5194660 5194644 5194639 -
tttatggctgcatagtattcca

SEQ ID NO: 148974 - DNA, 22 bp, Artificial Sequence
  Synthetic oligonucleotide; TTT chr11 5194638 5194659 5194643 5194638 -
ttatggctgcatagtattccat

SEQ ID NO: 148975 - DNA, 22 bp, Artificial Sequence
  Synthetic oligonucleotide; TTT chr11 5194637 5194658 5194642 5194637 -
tatggctgcatagtattccatg

SEQ ID NO: 148976 - DNA, 22 bp, Artificial Sequence
  Synthetic oligonucleotide; TTT chr11 5194636 5194657 5194641 5194636 -
atggctgcatagtattccatgg

SEQ ID NO: 148977 - DNA, 22 bp, Artificial Sequence
  Synthetic oligonucleotide; TTA chr11 5194635 5194656 5194640 5194635 -
tggctgcatagtattccatggt

SEQ ID NO: 148978 - DNA, 22 bp, Artificial Sequence
  Synthetic oligonucleotide; CTG chr11 5194629 5194650 5194634 5194629 -
catagtattccatggtgtgtat

SEQ ID NO: 148979 - DNA, 22 bp, Artificial Sequence
  Synthetic oligonucleotide; TTC chr11 5194619 5194640 5194624 5194619 -
catggtgtgtatgtgccacatt

SEQ ID NO: 148980 - DNA, 22 bp, Artificial Sequence
  Synthetic oligonucleotide; TTT chr11 5194596 5194617 5194601 5194596 -
tcttaatccagtctatcattgt

SEQ ID NO: 148981 - DNA, 22 bp, Artificial Sequence
  Synthetic oligonucleotide; TTT chr11 5194595 5194616 5194600 5194595 -
cttaatccagtctatcattgtt

SEQ ID NO: 148982 - DNA, 22 bp, Artificial Sequence
  Synthetic oligonucleotide; TTC chr11 5194594 5194615 5194599 5194594 -
ttaatccagtctatcattgttg

SEQ ID NO: 148983 - DNA, 22 bp, Artificial Sequence
  Synthetic oligonucleotide; CTT chr11 5194592 5194613 5194597 5194592 -
aatccagtctatcattgttgga

SEQ ID NO: 148984 - DNA, 22 bp, Artificial Sequence
  Synthetic oligonucleotide; TTA chr11 5194591 5194612 5194596 5194591 -
atccagtctatcattgttggac

SEQ ID NO: 148985 - DNA, 22 bp, Artificial Sequence
  Synthetic oligonucleotide; CTA chr11 5194581 5194602 5194586 5194581 -
tcattgttggacatttgggttg

SEQ ID NO: 148986 - DNA, 22 bp, Artificial Sequence
  Synthetic oligonucleotide; TTG chr11 5194575 5194596 5194580 5194575 -
ttggacatttgggttggttcca

SEQ ID NO: 148987 - DNA, 22 bp, Artificial Sequence
  Synthetic oligonucleotide; TTG chr11 5194572 5194593 5194577 5194572 -
gacatttgggttggttccaagt

SEQ ID NO: 148988 - DNA, 22 bp, Artificial Sequence
  Synthetic oligonucleotide; TTT chr11 5194565 5194586 5194570 5194565 -
gggttggttccaagtctttgct

SEQ ID NO: 148989 - DNA, 22 bp, Artificial Sequence
  Synthetic oligonucleotide; TTG chr11 5194564 5194585 5194569 5194564 -
ggttggttccaagtctttgcta

SEQ ID NO: 148990 - DNA, 22 bp, Artificial Sequence
  Synthetic oligonucleotide; TTG chr11 5194559 5194580 5194564 5194559 -
gttccaagtctttgctattgtg

SEQ ID NO: 148991 - DNA, 22 bp, Artificial Sequence
  Synthetic oligonucleotide; TTC chr11 5194555 5194576 5194560 5194555 -
caagtctttgctattgtgaata

SEQ ID NO: 148992 - DNA, 22 bp, Artificial Sequence
  Synthetic oligonucleotide; CTT chr11 5194547 5194568 5194552 5194547 -
tgctattgtgaatagtgccgca

SEQ ID NO: 148993 - DNA, 22 bp, Artificial Sequence
  Synthetic oligonucleotide; TTT chr11 5194546 5194567 5194551 5194546 -
gctattgtgaatagtgccgcaa

SEQ ID NO: 148994 - DNA, 22 bp, Artificial Sequence
  Synthetic oligonucleotide; TTG chr11 5194545 5194566 5194550 5194545 -
ctattgtgaatagtgccgcaat

SEQ ID NO: 148995 - DNA, 22 bp, Artificial Sequence
  Synthetic oligonucleotide; CTA chr11 5194542 5194563 5194547 5194542 -
ttgtgaatagtgccgcaataaa

SEQ ID NO: 148996 - DNA, 22 bp, Artificial Sequence
  Synthetic oligonucleotide; TTG chr11 5194539 5194560 5194544 5194539 -
tgaatagtgccgcaataaattg

SEQ ID NO: 148997 - DNA, 22 bp, Artificial Sequence
  Synthetic oligonucleotide; TTG chr11 5194517 5194538 5194522 5194517 -
catttacaaacctttagctaga

SEQ ID NO: 148998 - DNA, 22 bp, Artificial Sequence
  Synthetic oligonucleotide; TTT chr11 5194512 5194533 5194517 5194512 -
acaaacctttagctagacatga

SEQ ID NO: 148999 - DNA, 22 bp, Artificial Sequence
  Synthetic oligonucleotide; TTA chr11 5194511 5194532 5194516 5194511 -
caaacctttagctagacatgaa

SEQ ID NO: 149000 - DNA, 22 bp, Artificial Sequence
  Synthetic oligonucleotide; CTT chr11 5194503 5194524 5194508 5194503 -
tagctagacatgaaagttctcc

SEQ ID NO: 149001 - DNA, 22 bp, Artificial Sequence
  Synthetic oligonucleotide; TTT chr11 5194502 5194523 5194507 5194502 -
agctagacatgaaagttctcca

SEQ ID NO: 149002 - DNA, 22 bp, Artificial Sequence
  Synthetic oligonucleotide; TTA chr11 5194501 5194522 5194506 5194501 -
gctagacatgaaagttctccag

SEQ ID NO: 149003 - DNA, 22 bp, Artificial Sequence
  Synthetic oligonucleotide; CTA chr11 5194497 5194518 5194502 5194497 -
gacatgaaagttctccagttcc

SEQ ID NO: 149004 - DNA, 22 bp, Artificial Sequence
  Synthetic oligonucleotide; TTC chr11 5194484 5194505 5194489 5194484 -
tccagttccatatttcatggtg

SEQ ID NO: 149005 - DNA, 22 bp, Artificial Sequence
  Synthetic oligonucleotide; CTC chr11 5194482 5194503 5194487 5194482 -
cagttccatatttcatggtgag

SEQ ID NO: 149006 - DNA, 22 bp, Artificial Sequence
  Synthetic oligonucleotide; TTC chr11 5194476 5194497 5194481 5194476 -
catatttcatggtgaggaacaa

SEQ ID NO: 149007 - DNA, 22 bp, Artificial Sequence
  Synthetic oligonucleotide; TTT chr11 5194469 5194490 5194474 5194469 -
catggtgaggaacaaagaatat

SEQ ID NO: 149008 - DNA, 22 bp, Artificial Sequence
  Synthetic oligonucleotide; TTC chr11 5194468 5194489 5194473 5194468 -
atggtgaggaacaaagaatatg

SEQ ID NO: 149009 - DNA, 22 bp, Artificial Sequence
  Synthetic oligonucleotide; CTA chr11 5194430 5194451 5194435 5194430 -
tattctttgttcctcaccatga

SEQ ID NO: 149010 - DNA, 22 bp, Artificial Sequence
  Synthetic oligonucleotide; TTC chr11 5194425 5194446 5194430 5194425 -
tttgttcctcaccatgaaatat

SEQ ID NO: 149011 - DNA, 22 bp, Artificial Sequence
  Synthetic oligonucleotide; CTT chr11 5194423 5194444 5194428 5194423 -
tgttcctcaccatgaaatatgg

SEQ ID NO: 149012 - DNA, 22 bp, Artificial Sequence
  Synthetic oligonucleotide; TTT chr11 5194422 5194443 5194427 5194422 -
gttcctcaccatgaaatatgga

SEQ ID NO: 149013 - DNA, 22 bp, Artificial Sequence
  Synthetic oligonucleotide; TTG chr11 5194421 5194442 5194426 5194421 -
ttcctcaccatgaaatatggaa

SEQ ID NO: 149014 - DNA, 22 bp, Artificial Sequence
  Synthetic oligonucleotide; TTC chr11 5194418 5194439 5194423 5194418 -
ctcaccatgaaatatggaactg

SEQ ID NO: 149015 - DNA, 22 bp, Artificial Sequence
  Synthetic oligonucleotide; CTC chr11 5194415 5194436 5194420 5194415 -
accatgaaatatggaactggag

SEQ ID NO: 149016 - DNA, 22 bp, Artificial Sequence
  Synthetic oligonucleotide; CTG chr11 5194396 5194417 5194401 5194396 -
gagaactttcatgtctagctaa

SEQ ID NO: 149017 - DNA, 22 bp, Artificial Sequence
  Synthetic oligonucleotide; CTT chr11 5194388 5194409 5194393 5194388 -
tcatgtctagctaaaggtttgt

SEQ ID NO: 149018 - DNA, 22 bp, Artificial Sequence
  Synthetic oligonucleotide; TTT chr11 5194387 5194408 5194392 5194387 -
catgtctagctaaaggtttgta

SEQ ID NO: 149019 - DNA, 22 bp, Artificial Sequence
  Synthetic oligonucleotide; TTC chr11 5194386 5194407 5194391 5194386 -
atgtctagctaaaggtttgtaa

SEQ ID NO: 149020 - DNA, 22 bp, Artificial Sequence
  Synthetic oligonucleotide; CTA chr11 5194379 5194400 5194384 5194379 -
gctaaaggtttgtaaatgcacc

SEQ ID NO: 149021 - DNA, 22 bp, Artificial Sequence
  Synthetic oligonucleotide; CTA chr11 5194375 5194396 5194380 5194375 -
aaggtttgtaaatgcaccaatc

SEQ ID NO: 149022 - DNA, 22 bp, Artificial Sequence
  Synthetic oligonucleotide; TTT chr11 5194368 5194389 5194373 5194368 -
gtaaatgcaccaatcagcaatc

SEQ ID NO: 149023 - DNA, 22 bp, Artificial Sequence
  Synthetic oligonucleotide; TTG chr11 5194367 5194388 5194372 5194367 -
taaatgcaccaatcagcaatct

SEQ ID NO: 149024 - DNA, 22 bp, Artificial Sequence
  Synthetic oligonucleotide; CTG chr11 5194344 5194365 5194349 5194344 -
tgtctaactcaaggtttgtaaa

SEQ ID NO: 149025 - DNA, 22 bp, Artificial Sequence
  Synthetic oligonucleotide; CTA chr11 5194338 5194359 5194343 5194338 -
actcaaggtttgtaaatgcacc

SEQ ID NO: 149026 - DNA, 22 bp, Artificial Sequence
  Synthetic oligonucleotide; CTC chr11 5194334 5194355 5194339 5194334 -
aaggtttgtaaatgcaccaatc

SEQ ID NO: 149027 - DNA, 22 bp, Artificial Sequence
  Synthetic oligonucleotide; TTT chr11 5194327 5194348 5194332 5194327 -
gtaaatgcaccaatcagtgctc

SEQ ID NO: 149028 - DNA, 22 bp, Artificial Sequence
  Synthetic oligonucleotide; TTG chr11 5194326 5194347 5194331 5194326 -
taaatgcaccaatcagtgctct

SEQ ID NO: 149029 - DNA, 22 bp, Artificial Sequence
  Synthetic oligonucleotide; CTC chr11 5194305 5194326 5194310 5194305 -
tgtgtctagctaatctagtggg

SEQ ID NO: 149030 - DNA, 22 bp, Artificial Sequence
  Synthetic oligonucleotide; CTG chr11 5194303 5194324 5194308 5194303 -
tgtctagctaatctagtgggga

SEQ ID NO: 149031 - DNA, 22 bp, Artificial Sequence
  Synthetic oligonucleotide; CTA chr11 5194297 5194318 5194302 5194297 -
gctaatctagtggggacttgga

SEQ ID NO: 149032 - DNA, 22 bp, Artificial Sequence
  Synthetic oligonucleotide; CTA chr11 5194293 5194314 5194298 5194293 -
atctagtggggacttggagaac

SEQ ID NO: 149033 - DNA, 22 bp, Artificial Sequence
  Synthetic oligonucleotide; CTA chr11 5194288 5194309 5194293 5194288 -
gtggggacttggagaacttttg

SEQ ID NO: 149034 - DNA, 22 bp, Artificial Sequence
  Synthetic oligonucleotide; CTT chr11 5194278 5194299 5194283 5194278 -
ggagaacttttgtgtctagcta

SEQ ID NO: 149035 - DNA, 22 bp, Artificial Sequence
  Synthetic oligonucleotide; TTG chr11 5194277 5194298 5194282 5194277 -
gagaacttttgtgtctagctaa

SEQ ID NO: 149036 - DNA, 22 bp, Artificial Sequence
  Synthetic oligonucleotide; CTT chr11 5194269 5194290 5194274 5194269 -
ttgtgtctagctaaaggattgt

SEQ ID NO: 149037 - DNA, 22 bp, Artificial Sequence
  Synthetic oligonucleotide; TTT chr11 5194268 5194289 5194273 5194268 -
tgtgtctagctaaaggattgta

SEQ ID NO: 149038 - DNA, 22 bp, Artificial Sequence
  Synthetic oligonucleotide; TTT chr11 5194267 5194288 5194272 5194267 -
gtgtctagctaaaggattgtaa

SEQ ID NO: 149039 - DNA, 22 bp, Artificial Sequence
  Synthetic oligonucleotide; TTG chr11 5194266 5194287 5194271 5194266 -
tgtctagctaaaggattgtaaa

SEQ ID NO: 149040 - DNA, 22 bp, Artificial Sequence
  Synthetic oligonucleotide; CTA chr11 5194260 5194281 5194265 5194260 -
gctaaaggattgtaaatgcact

SEQ ID NO: 149041 - DNA, 22 bp, Artificial Sequence
  Synthetic oligonucleotide; CTA chr11 5194256 5194277 5194261 5194256 -
aaggattgtaaatgcactaatc

SEQ ID NO: 149042 - DNA, 22 bp, Artificial Sequence
  Synthetic oligonucleotide; TTG chr11 5194248 5194269 5194253 5194248 -
taaatgcactaatcagcactct

SEQ ID NO: 149043 - DNA, 22 bp, Artificial Sequence
  Synthetic oligonucleotide; CTA chr11 5194237 5194258 5194242 5194237 -
atcagcactctgtgtctagctc

SEQ ID NO: 149044 - DNA, 22 bp, Artificial Sequence
  Synthetic oligonucleotide; CTC chr11 5194227 5194248 5194232 5194227 -
tgtgtctagctcaaggtttgta

SEQ ID NO: 149045 - DNA, 22 bp, Artificial Sequence
  Synthetic oligonucleotide; CTG chr11 5194225 5194246 5194230 5194225 -
tgtctagctcaaggtttgtaaa

SEQ ID NO: 149046 - DNA, 22 bp, Artificial Sequence
  Synthetic oligonucleotide; CTA chr11 5194219 5194240 5194224 5194219 -
gctcaaggtttgtaaatgcacc

SEQ ID NO: 149047 - DNA, 22 bp, Artificial Sequence
  Synthetic oligonucleotide; CTC chr11 5194215 5194236 5194220 5194215 -
aaggtttgtaaatgcaccaatc

SEQ ID NO: 149048 - DNA, 22 bp, Artificial Sequence
  Synthetic oligonucleotide; TTT chr11 5194208 5194229 5194213 5194208 -
gtaaatgcaccaatcagcactc

SEQ ID NO: 149049 - DNA, 22 bp, Artificial Sequence
  Synthetic oligonucleotide; TTG chr11 5194207 5194228 5194212 5194207 -
taaatgcaccaatcagcactct

SEQ ID NO: 149050 - DNA, 22 bp, Artificial Sequence
  Synthetic oligonucleotide; CTC chr11 5194186 5194207 5194191 5194186 -
tgccaaaacggaccaaccagct

SEQ ID NO: 149051 - DNA, 22 bp, Artificial Sequence
  Synthetic oligonucleotide; CTG chr11 5194184 5194205 5194189 5194184 -
ccaaaacggaccaaccagctct

SEQ ID NO: 149052 - DNA, 22 bp, Artificial Sequence
  Synthetic oligonucleotide; CTC chr11 5194163 5194184 5194168 5194163 -
tctgtaaaatgggccaatcagc

SEQ ID NO: 149053 - DNA, 22 bp, Artificial Sequence
  Synthetic oligonucleotide; CTC chr11 5194161 5194182 5194166 5194161 -
tgtaaaatgggccaatcagctc

SEQ ID NO: 149054 - DNA, 22 bp, Artificial Sequence
  Synthetic oligonucleotide; CTG chr11 5194159 5194180 5194164 5194159 -
taaaatgggccaatcagctctc

SEQ ID NO: 149055 - DNA, 22 bp, Artificial Sequence
  Synthetic oligonucleotide; CTC chr11 5194139 5194160 5194144 5194139 -
tctgtaaaatggaccaatcagc

SEQ ID NO: 149056 - DNA, 22 bp, Artificial Sequence
  Synthetic oligonucleotide; CTC chr11 5194137 5194158 5194142 5194137 -
tgtaaaatggaccaatcagcag

SEQ ID NO: 149057 - DNA, 22 bp, Artificial Sequence
  Synthetic oligonucleotide; CTG chr11 5194135 5194156 5194140 5194135 -
taaaatggaccaatcagcagga

SEQ ID NO: 149058 - DNA, 22 bp, Artificial Sequence
  Synthetic oligonucleotide; CTG chr11 5194076 5194097 5194081 5194076 -
ccggagccagctgtgacaactg

SEQ ID NO: 149059 - DNA, 22 bp, Artificial Sequence
  Synthetic oligonucleotide; CTG chr11 5194063 5194084 5194068 5194063 -
tgacaactgacttgggttccct

SEQ ID NO: 149060 - DNA, 22 bp, Artificial Sequence
  Synthetic oligonucleotide; CTG chr11 5194054 5194075 5194059 5194054 -
acttgggttccctaccatgctg

SEQ ID NO: 149061 - DNA, 22 bp, Artificial Sequence
  Synthetic oligonucleotide; CTT chr11 5194050 5194071 5194055 5194050 -
gggttccctaccatgctgtgga

SEQ ID NO: 149062 - DNA, 22 bp, Artificial Sequence
  Synthetic oligonucleotide; TTG chr11 5194049 5194070 5194054 5194049 -
ggttccctaccatgctgtggaa

SEQ ID NO: 149063 - DNA, 22 bp, Artificial Sequence
  Synthetic oligonucleotide; TTC chr11 5194044 5194065 5194049 5194044 -
cctaccatgctgtggaagcttt

SEQ ID NO: 149064 - DNA, 22 bp, Artificial Sequence
  Synthetic oligonucleotide; CTA chr11 5194040 5194061 5194045 5194040 -
ccatgctgtggaagctttgttc

SEQ ID NO: 149065 - DNA, 22 bp, Artificial Sequence
  Synthetic oligonucleotide; CTG chr11 5194032 5194053 5194037 5194032 -
tggaagctttgttcttttattc

SEQ ID NO: 149066 - DNA, 22 bp, Artificial Sequence
  Synthetic oligonucleotide; CTT chr11 5194023 5194044 5194028 5194023 -
tgttcttttattcttcacaata

SEQ ID NO: 149067 - DNA, 22 bp, Artificial Sequence
  Synthetic oligonucleotide; TTT chr11 5194022 5194043 5194027 5194022 -
gttcttttattcttcacaataa

SEQ ID NO: 149068 - DNA, 22 bp, Artificial Sequence
  Synthetic oligonucleotide; TTG chr11 5194021 5194042 5194026 5194021 -
ttcttttattcttcacaataaa

SEQ ID NO: 149069 - DNA, 22 bp, Artificial Sequence
  Synthetic oligonucleotide; TTC chr11 5194018 5194039 5194023 5194018 -
ttttattcttcacaataaatct

SEQ ID NO: 149070 - DNA, 22 bp, Artificial Sequence
  Synthetic oligonucleotide; CTT chr11 5194016 5194037 5194021 5194016 -
ttattcttcacaataaatctta

SEQ ID NO: 149071 - DNA, 22 bp, Artificial Sequence
  Synthetic oligonucleotide; TTT chr11 5194015 5194036 5194020 5194015 -
tattcttcacaataaatcttac

SEQ ID NO: 149072 - DNA, 22 bp, Artificial Sequence
  Synthetic oligonucleotide; TTT chr11 5194014 5194035 5194019 5194014 -
attcttcacaataaatcttact

SEQ ID NO: 149073 - DNA, 22 bp, Artificial Sequence
  Synthetic oligonucleotide; TTA chr11 5194013 5194034 5194018 5194013 -
ttcttcacaataaatcttactg

SEQ ID NO: 149074 - DNA, 22 bp, Artificial Sequence
  Synthetic oligonucleotide; TTC chr11 5194010 5194031 5194015 5194010 -
ttcacaataaatcttactgctg

SEQ ID NO: 149075 - DNA, 22 bp, Artificial Sequence
  Synthetic oligonucleotide; CTT chr11 5194008 5194029 5194013 5194008 -
cacaataaatcttactgctgct

SEQ ID NO: 149076 - DNA, 22 bp, Artificial Sequence
  Synthetic oligonucleotide; TTC chr11 5194007 5194028 5194012 5194007 -
acaataaatcttactgctgctc

SEQ ID NO: 149077 - DNA, 22 bp, Artificial Sequence
  Synthetic oligonucleotide; CTT chr11 5193995 5194016 5194000 5193995 -
actgctgctcactctttggatc

SEQ ID NO: 149078 - DNA, 22 bp, Artificial Sequence
  Synthetic oligonucleotide; TTA chr11 5193994 5194015 5193999 5193994 -
ctgctgctcactctttggatcc

SEQ ID NO: 149079 - DNA, 22 bp, Artificial Sequence
  Synthetic oligonucleotide; CTG chr11 5193991 5194012 5193996 5193991 -
ctgctcactctttggatccgcg

SEQ ID NO: 149080 - DNA, 22 bp, Artificial Sequence
  Synthetic oligonucleotide; CTG chr11 5193988 5194009 5193993 5193988 -
ctcactctttggatccgcgctg

SEQ ID NO: 149081 - DNA, 22 bp, Artificial Sequence
  Synthetic oligonucleotide; CTC chr11 5193985 5194006 5193990 5193985 -
actctttggatccgcgctgcct

SEQ ID NO: 149082 - DNA, 22 bp, Artificial Sequence
  Synthetic oligonucleotide; CTC chr11 5193981 5194002 5193986 5193981 -
tttggatccgcgctgcctttat

SEQ ID NO: 149083 - DNA, 22 bp, Artificial Sequence
  Synthetic oligonucleotide; CTT chr11 5193979 5194000 5193984 5193979 -
tggatccgcgctgcctttatga

SEQ ID NO: 149084 - DNA, 22 bp, Artificial Sequence
  Synthetic oligonucleotide; TTT chr11 5193978 5193999 5193983 5193978 -
ggatccgcgctgcctttatgag

SEQ ID NO: 149085 - DNA, 22 bp, Artificial Sequence
  Synthetic oligonucleotide; TTG chr11 5193977 5193998 5193982 5193977 -
gatccgcgctgcctttatgagc

SEQ ID NO: 149086 - DNA, 22 bp, Artificial Sequence
  Synthetic oligonucleotide; CTG chr11 5193966 5193987 5193971 5193966 -
cctttatgagctgtaacactca

SEQ ID NO: 149087 - DNA, 22 bp, Artificial Sequence
  Synthetic oligonucleotide; CTT chr11 5193962 5193983 5193967 5193962 -
tatgagctgtaacactcactgc

SEQ ID NO: 149088 - DNA, 22 bp, Artificial Sequence
  Synthetic oligonucleotide; TTT chr11 5193961 5193982 5193966 5193961 -
atgagctgtaacactcactgcg

SEQ ID NO: 149089 - DNA, 22 bp, Artificial Sequence
  Synthetic oligonucleotide; TTA chr11 5193960 5193981 5193965 5193960 -
tgagctgtaacactcactgcga

SEQ ID NO: 149090 - DNA, 22 bp, Artificial Sequence
  Synthetic oligonucleotide; CTG chr11 5193953 5193974 5193958 5193953 -
taacactcactgcgaaggtctg

SEQ ID NO: 149091 - DNA, 22 bp, Artificial Sequence
  Synthetic oligonucleotide; CTC chr11 5193945 5193966 5193950 5193945 -
actgcgaaggtctgcggcttca

SEQ ID NO: 149092 - DNA, 22 bp, Artificial Sequence
  Synthetic oligonucleotide; CTG chr11 5193941 5193962 5193946 5193941 -
cgaaggtctgcggcttcacttc

SEQ ID NO: 149093 - DNA, 22 bp, Artificial Sequence
  Synthetic oligonucleotide; CTG chr11 5193931 5193952 5193936 5193931 -
cggcttcacttctgaagccagc

SEQ ID NO: 149094 - DNA, 22 bp, Artificial Sequence
  Synthetic oligonucleotide; CTT chr11 5193925 5193946 5193930 5193925 -
cacttctgaagccagcaagacc

SEQ ID NO: 149095 - DNA, 22 bp, Artificial Sequence
  Synthetic oligonucleotide; TTC chr11 5193924 5193945 5193929 5193924 -
acttctgaagccagcaagacca

SEQ ID NO: 149096 - DNA, 22 bp, Artificial Sequence
  Synthetic oligonucleotide; CTT chr11 5193920 5193941 5193925 5193920 -
ctgaagccagcaagaccacgaa

SEQ ID NO: 149097 - DNA, 22 bp, Artificial Sequence
  Synthetic oligonucleotide; TTC chr11 5193919 5193940 5193924 5193919 -
tgaagccagcaagaccacgaac

SEQ ID NO: 149098 - DNA, 22 bp, Artificial Sequence
  Synthetic oligonucleotide; CTG chr11 5193917 5193938 5193922 5193917 -
aagccagcaagaccacgaaccc

SEQ ID NO: 149099 - DNA, 22 bp, Artificial Sequence
  Synthetic oligonucleotide; CTC chr11 5193851 5193872 5193856 5193851 -
catacgctccgcctttaagagc

SEQ ID NO: 149100 - DNA, 22 bp, Artificial Sequence
  Synthetic oligonucleotide; CTC chr11 5193842 5193863 5193847 5193842 -
cgcctttaagagctgtaacact

SEQ ID NO: 149101 - DNA, 22 bp, Artificial Sequence
  Synthetic oligonucleotide; CTT chr11 5193836 5193857 5193841 5193836 -
taagagctgtaacactccccgt

SEQ ID NO: 149102 - DNA, 22 bp, Artificial Sequence
  Synthetic oligonucleotide; TTT chr11 5193835 5193856 5193840 5193835 -
aagagctgtaacactccccgtg

SEQ ID NO: 149103 - DNA, 22 bp, Artificial Sequence
  Synthetic oligonucleotide; TTA chr11 5193834 5193855 5193839 5193834 -
agagctgtaacactccccgtgg

SEQ ID NO: 149104 - DNA, 22 bp, Artificial Sequence
  Synthetic oligonucleotide; CTG chr11 5193827 5193848 5193832 5193827 -
taacactccccgtgggggtctg

SEQ ID NO: 149105 - DNA, 22 bp, Artificial Sequence
  Synthetic oligonucleotide; CTC chr11 5193819 5193840 5193824 5193819 -
cccgtgggggtctgcagcttca

SEQ ID NO: 149106 - DNA, 22 bp, Artificial Sequence
  Synthetic oligonucleotide; CTG chr11 5193805 5193826 5193810 5193805 -
cagcttcactcctggagccagc

SEQ ID NO: 149107 - DNA, 22 bp, Artificial Sequence
  Synthetic oligonucleotide; CTT chr11 5193799 5193820 5193804 5193799 -
cactcctggagccagcaagacc

SEQ ID NO: 149108 - DNA, 22 bp, Artificial Sequence
  Synthetic oligonucleotide; TTC chr11 5193798 5193819 5193803 5193798 -
actcctggagccagcaagaccg

SEQ ID NO: 149109 - DNA, 22 bp, Artificial Sequence
  Synthetic oligonucleotide; CTC chr11 5193794 5193815 5193799 5193794 -
ctggagccagcaagaccgtgaa

SEQ ID NO: 149110 - DNA, 22 bp, Artificial Sequence
  Synthetic oligonucleotide; CTG chr11 5193791 5193812 5193796 5193791 -
gagccagcaagaccgtgaacac

SEQ ID NO: 149111 - DNA, 22 bp, Artificial Sequence
  Synthetic oligonucleotide; CTC chr11 5193751 5193772 5193756 5193751 -
tggacacatctgaagtaacaaa

SEQ ID NO: 149112 - DNA, 22 bp, Artificial Sequence
  Synthetic oligonucleotide; CTG chr11 5193749 5193770 5193754 5193749 -
gacacatctgaagtaacaaact

SEQ ID NO: 149113 - DNA, 22 bp, Artificial Sequence
  Synthetic oligonucleotide; CTG chr11 5193739 5193760 5193744 5193739 -
aagtaacaaactttggacacac

SEQ ID NO: 149114 - DNA, 22 bp, Artificial Sequence
  Synthetic oligonucleotide; CTT chr11 5193726 5193747 5193731 5193726 -
tggacacaccatcctttgaaca

SEQ ID NO: 149115 - DNA, 22 bp, Artificial Sequence
  Synthetic oligonucleotide; TTT chr11 5193725 5193746 5193730 5193725 -
ggacacaccatcctttgaacac

SEQ ID NO: 149116 - DNA, 22 bp, Artificial Sequence
  Synthetic oligonucleotide; TTG chr11 5193724 5193745 5193729 5193724 -
gacacaccatcctttgaacaca

SEQ ID NO: 149117 - DNA, 22 bp, Artificial Sequence
  Synthetic oligonucleotide; CTT chr11 5193710 5193731 5193715 5193710 -
tgaacacaccatctttaagaat

SEQ ID NO: 149118 - DNA, 22 bp, Artificial Sequence
  Synthetic oligonucleotide; TTT chr11 5193709 5193730 5193714 5193709 -
gaacacaccatctttaagaatt

SEQ ID NO: 149119 - DNA, 22 bp, Artificial Sequence
  Synthetic oligonucleotide; TTG chr11 5193708 5193729 5193713 5193708 -
aacacaccatctttaagaattg

SEQ ID NO: 149120 - DNA, 22 bp, Artificial Sequence
  Synthetic oligonucleotide; CTT chr11 5193695 5193716 5193700 5193695 -
taagaattgtaacactcaccac

SEQ ID NO: 149121 - DNA, 22 bp, Artificial Sequence
  Synthetic oligonucleotide; TTT chr11 5193694 5193715 5193699 5193694 -
aagaattgtaacactcaccacg

SEQ ID NO: 149122 - DNA, 22 bp, Artificial Sequence
  Synthetic oligonucleotide; TTA chr11 5193693 5193714 5193698 5193693 -
agaattgtaacactcaccacga

SEQ ID NO: 149123 - DNA, 22 bp, Artificial Sequence
  Synthetic oligonucleotide; TTG chr11 5193686 5193707 5193691 5193686 -
taacactcaccacgagggttcg

SEQ ID NO: 149124 - DNA, 22 bp, Artificial Sequence
  Synthetic oligonucleotide; CTC chr11 5193678 5193699 5193683 5193678 -
accacgagggttcgcggcttca

SEQ ID NO: 149125 - DNA, 22 bp, Artificial Sequence
  Synthetic oligonucleotide; TTC chr11 5193665 5193686 5193670 5193665 -
gcggcttcattctttaagtcag

SEQ ID NO: 149126 - DNA, 22 bp, Artificial Sequence
  Synthetic oligonucleotide; CTT chr11 5193658 5193679 5193663 5193658 -
cattctttaagtcagcgagacc

SEQ ID NO: 149127 - DNA, 22 bp, Artificial Sequence
  Synthetic oligonucleotide; TTC chr11 5193657 5193678 5193662 5193657 -
attctttaagtcagcgagacca

SEQ ID NO: 149128 - DNA, 22 bp, Artificial Sequence
  Synthetic oligonucleotide; TTC chr11 5193653 5193674 5193658 5193653 -
tttaagtcagcgagaccaagaa

SEQ ID NO: 149129 - DNA, 22 bp, Artificial Sequence
  Synthetic oligonucleotide; CTT chr11 5193651 5193672 5193656 5193651 -
taagtcagcgagaccaagaacc

SEQ ID NO: 149130 - DNA, 22 bp, Artificial Sequence
  Synthetic oligonucleotide; TTT chr11 5193650 5193671 5193655 5193650 -
aagtcagcgagaccaagaaccc

SEQ ID NO: 149131 - DNA, 22 bp, Artificial Sequence
  Synthetic oligonucleotide; TTA chr11 5193649 5193670 5193654 5193649 -
agtcagcgagaccaagaaccca

SEQ ID NO: 149132 - DNA, 22 bp, Artificial Sequence
  Synthetic oligonucleotide; TTC chr11 5193620 5193641 5193625 5193620 -
cggacacagaaggatggacaaa

SEQ ID NO: 149133 - DNA, 22 bp, Artificial Sequence
  Synthetic oligonucleotide; TTA chr11 5193593 5193614 5193598 5193593 -
tcaggaatgcaattaagtccac

SEQ ID NO: 149134 - DNA, 22 bp, Artificial Sequence
  Synthetic oligonucleotide; TTA chr11 5193578 5193599 5193583 5193578 -
agtccaccaacacaaaaattac

SEQ ID NO: 149135 - DNA, 22 bp, Artificial Sequence
  Synthetic oligonucleotide; TTA chr11 5193557 5193578 5193562 5193557 -
catacctagaatcaattttaat

SEQ ID NO: 149136 - DNA, 22 bp, Artificial Sequence
  Synthetic oligonucleotide; CTA chr11 5193549 5193570 5193554 5193549 -
gaatcaattttaataaagaaaa

SEQ ID NO: 149137 - DNA, 22 bp, Artificial Sequence
  Synthetic oligonucleotide; TTT chr11 5193539 5193560 5193544 5193539 -
taataaagaaaacttatttgga

SEQ ID NO: 149138 - DNA, 22 bp, Artificial Sequence
  Synthetic oligonucleotide; TTT chr11 5193538 5193559 5193543 5193538 -
aataaagaaaacttatttggag

SEQ ID NO: 149139 - DNA, 22 bp, Artificial Sequence
  Synthetic oligonucleotide; TTA chr11 5193537 5193558 5193542 5193537 -
ataaagaaaacttatttggagc

SEQ ID NO: 149140 - DNA, 22 bp, Artificial Sequence
  Synthetic oligonucleotide; CTT chr11 5193524 5193545 5193529 5193524 -
atttggagcacagcttattcag

SEQ ID NO: 149141 - DNA, 22 bp, Artificial Sequence
  Synthetic oligonucleotide; TTA chr11 5193523 5193544 5193528 5193523 -
tttggagcacagcttattcagg

SEQ ID NO: 149142 - DNA, 22 bp, Artificial Sequence
  Synthetic oligonucleotide; TTT chr11 5193520 5193541 5193525 5193520 -
ggagcacagcttattcagggca

SEQ ID NO: 149143 - DNA, 22 bp, Artificial Sequence
  Synthetic oligonucleotide; TTG chr11 5193519 5193540 5193524 5193519 -
gagcacagcttattcagggcag

SEQ ID NO: 149144 - DNA, 22 bp, Artificial Sequence
  Synthetic oligonucleotide; CTT chr11 5193508 5193529 5193513 5193508 -
attcagggcagaaaataaaagc

SEQ ID NO: 149145 - DNA, 22 bp, Artificial Sequence
  Synthetic oligonucleotide; TTA chr11 5193507 5193528 5193512 5193507 -
ttcagggcagaaaataaaagct

SEQ ID NO: 149146 - DNA, 22 bp, Artificial Sequence
  Synthetic oligonucleotide; TTC chr11 5193504 5193525 5193509 5193504 -
agggcagaaaataaaagctaat

SEQ ID NO: 149147 - DNA, 22 bp, Artificial Sequence
  Synthetic oligonucleotide; CTA chr11 5193484 5193505 5193489 5193484 -
ataataaaagaggtgcataata

SEQ ID NO: 149148 - DNA, 22 bp, Artificial Sequence
  Synthetic oligonucleotide; TTC chr11 5193455 5193476 5193460 5193455 -
ttaattaaataaccactcattt

SEQ ID NO: 149149 - DNA, 22 bp, Artificial Sequence
  Synthetic oligonucleotide; CTT chr11 5193453 5193474 5193458 5193453 -
aattaaataaccactcatttta

SEQ ID NO: 149150 - DNA, 22 bp, Artificial Sequence
  Synthetic oligonucleotide; TTA chr11 5193452 5193473 5193457 5193452 -
attaaataaccactcattttag

SEQ ID NO: 149151 - DNA, 22 bp, Artificial Sequence
  Synthetic oligonucleotide; TTA chr11 5193448 5193469 5193453 5193448 -
aataaccactcattttagatcc

SEQ ID NO: 149152 - DNA, 22 bp, Artificial Sequence
  Synthetic oligonucleotide; CTC chr11 5193437 5193458 5193442 5193437 -
attttagatccttgatatttga

SEQ ID NO: 149153 - DNA, 22 bp, Artificial Sequence
  Synthetic oligonucleotide; TTT chr11 5193433 5193454 5193438 5193433 -
tagatccttgatatttgaacag

SEQ ID NO: 149154 - DNA, 22 bp, Artificial Sequence
  Synthetic oligonucleotide; TTT chr11 5193432 5193453 5193437 5193432 -
agatccttgatatttgaacaga

SEQ ID NO: 149155 - DNA, 22 bp, Artificial Sequence
  Synthetic oligonucleotide; TTA chr11 5193431 5193452 5193436 5193431 -
gatccttgatatttgaacagaa

SEQ ID NO: 149156 - DNA, 22 bp, Artificial Sequence
  Synthetic oligonucleotide; CTT chr11 5193424 5193445 5193429 5193424 -
gatatttgaacagaatagtata

SEQ ID NO: 149157 - DNA, 22 bp, Artificial Sequence
  Synthetic oligonucleotide; TTG chr11 5193423 5193444 5193428 5193423 -
atatttgaacagaatagtataa

SEQ ID NO: 149158 - DNA, 22 bp, Artificial Sequence
  Synthetic oligonucleotide; TTT chr11 5193417 5193438 5193422 5193417 -
gaacagaatagtataaaaaata

SEQ ID NO: 149159 - DNA, 22 bp, Artificial Sequence
  Synthetic oligonucleotide; TTG chr11 5193416 5193437 5193421 5193416 -
aacagaatagtataaaaaatag

SEQ ID NO: 149160 - DNA, 22 bp, Artificial Sequence
  Synthetic oligonucleotide; TTT chr11 5193314 5193335 5193319 5193314 -
aagagtgcagaaaaaaaggaca

SEQ ID NO: 149161 - DNA, 22 bp, Artificial Sequence
  Synthetic oligonucleotide; TTA chr11 5193313 5193334 5193318 5193313 -
agagtgcagaaaaaaaggacaa

SEQ ID NO: 149162 - DNA, 22 bp, Artificial Sequence
  Synthetic oligonucleotide; CTC chr11 5193239 5193260 5193244 5193239 -
caaaatcttaactggagttcag

SEQ ID NO: 149163 - DNA, 22 bp, Artificial Sequence
  Synthetic oligonucleotide; CTT chr11 5193230 5193251 5193235 5193230 -
aactggagttcaggagagagtg

SEQ ID NO: 149164 - DNA, 22 bp, Artificial Sequence
  Synthetic oligonucleotide; TTA chr11 5193229 5193250 5193234 5193229 -
actggagttcaggagagagtga

SEQ ID NO: 149165 - DNA, 22 bp, Artificial Sequence
  Synthetic oligonucleotide; CTG chr11 5193225 5193246 5193230 5193225 -
gagttcaggagagagtgaaaat

SEQ ID NO: 149166 - DNA, 22 bp, Artificial Sequence
  Synthetic oligonucleotide; TTC chr11 5193219 5193240 5193224 5193219 -
aggagagagtgaaaatagaaca

SEQ ID NO: 149167 - DNA, 22 bp, Artificial Sequence
  Synthetic oligonucleotide; CTT chr11 5193183 5193204 5193188 5193183 -
actagagatcaatacaagacaa

SEQ ID NO: 149168 - DNA, 22 bp, Artificial Sequence
  Synthetic oligonucleotide; TTA chr11 5193182 5193203 5193187 5193182 -
ctagagatcaatacaagacaat

SEQ ID NO: 149169 - DNA, 22 bp, Artificial Sequence
  Synthetic oligonucleotide; CTA chr11 5193179 5193200 5193184 5193179 -
gagatcaatacaagacaatttt

SEQ ID NO: 149170 - DNA, 22 bp, Artificial Sequence
  Synthetic oligonucleotide; TTT chr11 5193158 5193179 5193163 5193158 -
tctgaacaaaagaacacagcag

SEQ ID NO: 149171 - DNA, 22 bp, Artificial Sequence
  Synthetic oligonucleotide; TTT chr11 5193157 5193178 5193162 5193157 -
ctgaacaaaagaacacagcagt

SEQ ID NO: 149172 - DNA, 22 bp, Artificial Sequence
  Synthetic oligonucleotide; TTC chr11 5193156 5193177 5193161 5193156 -
tgaacaaaagaacacagcagtt

SEQ ID NO: 149173 - DNA, 22 bp, Artificial Sequence
  Synthetic oligonucleotide; CTG chr11 5193154 5193175 5193159 5193154 -
aacaaaagaacacagcagttga

SEQ ID NO: 149174 - DNA, 22 bp, Artificial Sequence
  Synthetic oligonucleotide; TTG chr11 5193133 5193154 5193138 5193133 -
aaattgagagtatccacaaaat

SEQ ID NO: 149175 - DNA, 22 bp, Artificial Sequence
  Synthetic oligonucleotide; TTG chr11 5193127 5193148 5193132 5193127 -
agagtatccacaaaatacccag

SEQ ID NO: 149176 - DNA, 22 bp, Artificial Sequence
  Synthetic oligonucleotide; TTC chr11 5193079 5193100 5193084 5193079 -
atggtaagttaagagaatgaaa

SEQ ID NO: 149177 - DNA, 22 bp, Artificial Sequence
  Synthetic oligonucleotide; TTA chr11 5193068 5193089 5193073 5193068 -
agagaatgaaaaaaacaagcca

SEQ ID NO: 149178 - DNA, 22 bp, Artificial Sequence
  Synthetic oligonucleotide; TTT chr11 5193032 5193053 5193037 5193032 -
gcaaaacatattatctgataaa

SEQ ID NO: 149179 - DNA, 22 bp, Artificial Sequence
  Synthetic oligonucleotide; TTG chr11 5193031 5193052 5193036 5193031 -
caaaacatattatctgataaag

SEQ ID NO: 149180 - DNA, 22 bp, Artificial Sequence
  Synthetic oligonucleotide; TTA chr11 5193019 5193040 5193024 5193019 -
tctgataaaggacttgtataca

SEQ ID NO: 149181 - DNA, 22 bp, Artificial Sequence
  Synthetic oligonucleotide; CTG chr11 5193015 5193036 5193020 5193015 -
ataaaggacttgtatacatatt

SEQ ID NO: 149182 - DNA, 22 bp, Artificial Sequence
  Synthetic oligonucleotide; CTT chr11 5193004 5193025 5193009 5193004 -
gtatacatattatacaaagaac

SEQ ID NO: 149183 - DNA, 22 bp, Artificial Sequence
  Synthetic oligonucleotide; TTG chr11 5193003 5193024 5193008 5193003 -
tatacatattatacaaagaact

SEQ ID NO: 149184 - DNA, 22 bp, Artificial Sequence
  Synthetic oligonucleotide; TTA chr11 5192992 5193013 5192997 5192992 -
tacaaagaacttttaaaattct

SEQ ID NO: 149185 - DNA, 22 bp, Artificial Sequence
  Synthetic oligonucleotide; CTT chr11 5192980 5193001 5192985 5192980 -
ttaaaattctacaataaaaaac

SEQ ID NO: 149186 - DNA, 22 bp, Artificial Sequence
  Synthetic oligonucleotide; TTT chr11 5192979 5193000 5192984 5192979 -
taaaattctacaataaaaaaca

SEQ ID NO: 149187 - DNA, 22 bp, Artificial Sequence
  Synthetic oligonucleotide; TTT chr11 5192978 5192999 5192983 5192978 -
aaaattctacaataaaaaacaa

SEQ ID NO: 149188 - DNA, 22 bp, Artificial Sequence
  Synthetic oligonucleotide; TTA chr11 5192977 5192998 5192982 5192977 -
aaattctacaataaaaaacaaa

SEQ ID NO: 149189 - DNA, 22 bp, Artificial Sequence
  Synthetic oligonucleotide; TTC chr11 5192971 5192992 5192976 5192971 -
tacaataaaaaacaaacaatcc

SEQ ID NO: 149190 - DNA, 22 bp, Artificial Sequence
  Synthetic oligonucleotide; CTA chr11 5192969 5192990 5192974 5192969 -
caataaaaaacaaacaatccaa

SEQ ID NO: 149191 - DNA, 22 bp, Artificial Sequence
  Synthetic oligonucleotide; TTG chr11 5192944 5192965 5192949 5192944 -
caaagtgggcaaaagatctgaa

SEQ ID NO: 149192 - DNA, 22 bp, Artificial Sequence
  Synthetic oligonucleotide; CTG chr11 5192924 5192945 5192929 5192924 -
aacagacactttaccaaagaag

SEQ ID NO: 149193 - DNA, 22 bp, Artificial Sequence
  Synthetic oligonucleotide; CTT chr11 5192913 5192934 5192918 5192913 -
taccaaagaagatatatagatt

SEQ ID NO: 149194 - DNA, 22 bp, Artificial Sequence
  Synthetic oligonucleotide; TTT chr11 5192912 5192933 5192917 5192912 -
accaaagaagatatatagattg

SEQ ID NO: 149195 - DNA, 22 bp, Artificial Sequence
  Synthetic oligonucleotide; TTA chr11 5192911 5192932 5192916 5192911 -
ccaaagaagatatatagattgc

SEQ ID NO: 149196 - DNA, 22 bp, Artificial Sequence
  Synthetic oligonucleotide; TTG chr11 5192890 5192911 5192895 5192890 -
caataagcacatgaaaatatac

SEQ ID NO: 149197 - DNA, 22 bp, Artificial Sequence
  Synthetic oligonucleotide; CTC chr11 5192866 5192887 5192871 5192866 -
agtaacacatgtcattaagaaa

SEQ ID NO: 149198 - DNA, 22 bp, Artificial Sequence
  Synthetic oligonucleotide; TTA chr11 5192849 5192870 5192854 5192849 -
agaaactgcacattaaaacaag

SEQ ID NO: 149199 - DNA, 22 bp, Artificial Sequence
  Synthetic oligonucleotide; CTG chr11 5192841 5192862 5192846 5192841 -
cacattaaaacaagaagatacc

SEQ ID NO: 149200 - DNA, 22 bp, Artificial Sequence
  Synthetic oligonucleotide; TTA chr11 5192834 5192855 5192839 5192834 -
aaacaagaagataccaaccact

SEQ ID NO: 149201 - DNA, 22 bp, Artificial Sequence
  Synthetic oligonucleotide; CTA chr11 5192811 5192832 5192816 5192811 -
cacacatattagaaggccaaat

SEQ ID NO: 149202 - DNA, 22 bp, Artificial Sequence
  Synthetic oligonucleotide; TTA chr11 5192800 5192821 5192805 5192800 -
gaaggccaaattccaaaatact

SEQ ID NO: 149203 - DNA, 22 bp, Artificial Sequence
  Synthetic oligonucleotide; TTC chr11 5192787 5192808 5192792 5192787 -
caaaatactgacatccaccaaa

SEQ ID NO: 149204 - DNA, 22 bp, Artificial Sequence
  Synthetic oligonucleotide; CTG chr11 5192777 5192798 5192782 5192777 -
acatccaccaaacactggcaac

SEQ ID NO: 149205 - DNA, 22 bp, Artificial Sequence
  Synthetic oligonucleotide; CTG chr11 5192760 5192781 5192765 5192760 -
gcaacgaagtggagcaacagta

SEQ ID NO: 149206 - DNA, 22 bp, Artificial Sequence
  Synthetic oligonucleotide; CTC chr11 5192734 5192755 5192739 5192734 -
tcacttattgcttgtagggatg

SEQ ID NO: 149207 - DNA, 22 bp, Artificial Sequence
  Synthetic oligonucleotide; CTC chr11 5192732 5192753 5192737 5192732 -
acttattgcttgtagggatgag

SEQ ID NO: 149208 - DNA, 22 bp, Artificial Sequence
  Synthetic oligonucleotide; CTT chr11 5192728 5192749 5192733 5192728 -
attgcttgtagggatgagaaat

SEQ ID NO: 149209 - DNA, 22 bp, Artificial Sequence
  Synthetic oligonucleotide; TTA chr11 5192727 5192748 5192732 5192727 -
ttgcttgtagggatgagaaata

SEQ ID NO: 149210 - DNA, 22 bp, Artificial Sequence
  Synthetic oligonucleotide; TTG chr11 5192724 5192745 5192729 5192724 -
cttgtagggatgagaaatagtg

SEQ ID NO: 149211 - DNA, 22 bp, Artificial Sequence
  Synthetic oligonucleotide; CTT chr11 5192721 5192742 5192726 5192721 -
gtagggatgagaaatagtgcag

SEQ ID NO: 149212 - DNA, 22 bp, Artificial Sequence
  Synthetic oligonucleotide; TTG chr11 5192720 5192741 5192725 5192720 -
tagggatgagaaatagtgcagc

SEQ ID NO: 149213 - DNA, 22 bp, Artificial Sequence
  Synthetic oligonucleotide; TTG chr11 5192691 5192712 5192696 5192691 -
gaagacagtttacagtttctta

SEQ ID NO: 149214 - DNA, 22 bp, Artificial Sequence
  Synthetic oligonucleotide; TTT chr11 5192680 5192701 5192685 5192680 -
acagtttcttacaaaactagtc

SEQ ID NO: 149215 - DNA, 22 bp, Artificial Sequence
  Synthetic oligonucleotide; TTA chr11 5192679 5192700 5192684 5192679 -
cagtttcttacaaaactagtct

SEQ ID NO: 149216 - DNA, 22 bp, Artificial Sequence
  Synthetic oligonucleotide; TTT chr11 5192673 5192694 5192678 5192673 -
cttacaaaactagtcttttcat

SEQ ID NO: 149217 - DNA, 22 bp, Artificial Sequence
  Synthetic oligonucleotide; TTC chr11 5192672 5192693 5192677 5192672 -
ttacaaaactagtcttttcatg

SEQ ID NO: 149218 - DNA, 22 bp, Artificial Sequence
  Synthetic oligonucleotide; CTT chr11 5192670 5192691 5192675 5192670 -
acaaaactagtcttttcatgtg

SEQ ID NO: 149219 - DNA, 22 bp, Artificial Sequence
  Synthetic oligonucleotide; TTA chr11 5192669 5192690 5192674 5192669 -
caaaactagtcttttcatgtga

SEQ ID NO: 149220 - DNA, 22 bp, Artificial Sequence
  Synthetic oligonucleotide; CTA chr11 5192661 5192682 5192666 5192661 -
gtcttttcatgtgacccaacaa

SEQ ID NO: 149221 - DNA, 22 bp, Artificial Sequence
  Synthetic oligonucleotide; CTT chr11 5192656 5192677 5192661 5192656 -
ttcatgtgacccaacaatcaca

SEQ ID NO: 149222 - DNA, 22 bp, Artificial Sequence
  Synthetic oligonucleotide; TTT chr11 5192655 5192676 5192660 5192655 -
tcatgtgacccaacaatcacac

SEQ ID NO: 149223 - DNA, 22 bp, Artificial Sequence
  Synthetic oligonucleotide; TTT chr11 5192654 5192675 5192659 5192654 -
catgtgacccaacaatcacact

SEQ ID NO: 149224 - DNA, 22 bp, Artificial Sequence
  Synthetic oligonucleotide; TTC chr11 5192653 5192674 5192658 5192653 -
atgtgacccaacaatcacactc

SEQ ID NO: 149225 - DNA, 22 bp, Artificial Sequence
  Synthetic oligonucleotide; CTC chr11 5192631 5192652 5192636 5192631 -
ctatgtatttacccaaatgagt

SEQ ID NO: 149226 - DNA, 22 bp, Artificial Sequence
  Synthetic oligonucleotide; CTA chr11 5192628 5192649 5192633 5192628 -
tgtatttacccaaatgagtcaa

SEQ ID NO: 149227 - DNA, 22 bp, Artificial Sequence
  Synthetic oligonucleotide; TTT chr11 5192621 5192642 5192626 5192621 -
acccaaatgagtcaaaaattta

SEQ ID NO: 149228 - DNA, 22 bp, Artificial Sequence
  Synthetic oligonucleotide; TTA chr11 5192620 5192641 5192625 5192620 -
cccaaatgagtcaaaaatttat

SEQ ID NO: 149229 - DNA, 22 bp, Artificial Sequence
  Synthetic oligonucleotide; TTT chr11 5192600 5192621 5192605 5192600 -
atgtccacacacagacatgaac

SEQ ID NO: 149230 - DNA, 22 bp, Artificial Sequence
  Synthetic oligonucleotide; TTA chr11 5192599 5192620 5192604 5192599 -
tgtccacacacagacatgaact

SEQ ID NO: 149231 - DNA, 22 bp, Artificial Sequence
  Synthetic oligonucleotide; CTA chr11 5192576 5192597 5192581 5192576 -
accaaggtttataggaacttta

SEQ ID NO: 149232 - DNA, 22 bp, Artificial Sequence
  Synthetic oligonucleotide; TTT chr11 5192566 5192587 5192571 5192566 -
ataggaactttactcataattg

SEQ ID NO: 149233 - DNA, 22 bp, Artificial Sequence
  Synthetic oligonucleotide; TTA chr11 5192565 5192586 5192570 5192565 -
taggaactttactcataattgc

SEQ ID NO: 149234 - DNA, 22 bp, Artificial Sequence
  Synthetic oligonucleotide; CTT chr11 5192556 5192577 5192561 5192556 -
tactcataattgccaaaagttg

SEQ ID NO: 149235 - DNA, 22 bp, Artificial Sequence
  Synthetic oligonucleotide; TTT chr11 5192555 5192576 5192560 5192555 -
actcataattgccaaaagttga

SEQ ID NO: 149236 - DNA, 22 bp, Artificial Sequence
  Synthetic oligonucleotide; TTA chr11 5192554 5192575 5192559 5192554 -
ctcataattgccaaaagttgaa

SEQ ID NO: 149237 - DNA, 22 bp, Artificial Sequence
  Synthetic oligonucleotide; CTC chr11 5192551 5192572 5192556 5192551 -
ataattgccaaaagttgaaagt

SEQ ID NO: 149238 - DNA, 22 bp, Artificial Sequence
  Synthetic oligonucleotide; TTG chr11 5192544 5192565 5192549 5192544 -
ccaaaagttgaaagtaaccaag

SEQ ID NO: 149239 - DNA, 22 bp, Artificial Sequence
  Synthetic oligonucleotide; TTG chr11 5192534 5192555 5192539 5192534 -
aaagtaaccaagatgaatggat

SEQ ID NO: 149240 - DNA, 22 bp, Artificial Sequence
  Synthetic oligonucleotide; CTG chr11 5192506 5192527 5192511 5192506 -
tggaacatccataggatagaat

SEQ ID NO: 149241 - DNA, 22 bp, Artificial Sequence
  Synthetic oligonucleotide; TTA chr11 5192480 5192501 5192485 5192480 -
ttcagtgatataaataaaggtc

SEQ ID NO: 149242 - DNA, 22 bp, Artificial Sequence
  Synthetic oligonucleotide; TTC chr11 5192477 5192498 5192482 5192477 -
agtgatataaataaaggtctat

SEQ ID NO: 149243 - DNA, 22 bp, Artificial Sequence
  Synthetic oligonucleotide; CTA chr11 5192456 5192477 5192461 5192456 -
tcaagctgtgaaaagacataaa

SEQ ID NO: 149244 - DNA, 22 bp, Artificial Sequence
  Synthetic oligonucleotide; CTG chr11 5192448 5192469 5192453 5192448 -
tgaaaagacataaagagcttta

SEQ ID NO: 149245 - DNA, 22 bp, Artificial Sequence
  Synthetic oligonucleotide; CTT chr11 5192428 5192449 5192433 5192428 -
taattgtatattgcttaattca

SEQ ID NO: 149246 - DNA, 22 bp, Artificial Sequence
  Synthetic oligonucleotide; TTT chr11 5192427 5192448 5192432 5192427 -
aattgtatattgcttaattcat

SEQ ID NO: 149247 - DNA, 22 bp, Artificial Sequence
  Synthetic oligonucleotide; TTA chr11 5192426 5192447 5192431 5192426 -
attgtatattgcttaattcatt

SEQ ID NO: 149248 - DNA, 22 bp, Artificial Sequence
  Synthetic oligonucleotide; TTG chr11 5192422 5192443 5192427 5192422 -
tatattgcttaattcattttct

SEQ ID NO: 149249 - DNA, 22 bp, Artificial Sequence
  Synthetic oligonucleotide; TTG chr11 5192415 5192436 5192420 5192415 -
cttaattcattttctttaatta

SEQ ID NO: 149250 - DNA, 22 bp, Artificial Sequence
  Synthetic oligonucleotide; CTT chr11 5192412 5192433 5192417 5192412 -
aattcattttctttaattatag

SEQ ID NO: 149251 - DNA, 22 bp, Artificial Sequence
  Synthetic oligonucleotide; TTA chr11 5192411 5192432 5192416 5192411 -
attcattttctttaattatagt

SEQ ID NO: 149252 - DNA, 22 bp, Artificial Sequence
  Synthetic oligonucleotide; TTC chr11 5192407 5192428 5192412 5192407 -
attttctttaattatagtcatc

SEQ ID NO: 149253 - DNA, 22 bp, Artificial Sequence
  Synthetic oligonucleotide; TTT chr11 5192403 5192424 5192408 5192403 -
tctttaattatagtcatcattc

SEQ ID NO: 149254 - DNA, 22 bp, Artificial Sequence
  Synthetic oligonucleotide; TTT chr11 5192402 5192423 5192407 5192402 -
ctttaattatagtcatcattct

SEQ ID NO: 149255 - DNA, 22 bp, Artificial Sequence
  Synthetic oligonucleotide; TTC chr11 5192401 5192422 5192406 5192401 -
tttaattatagtcatcattctc

SEQ ID NO: 149256 - DNA, 22 bp, Artificial Sequence
  Synthetic oligonucleotide; CTT chr11 5192399 5192420 5192404 5192399 -
taattatagtcatcattctcta

SEQ ID NO: 149257 - DNA, 22 bp, Artificial Sequence
  Synthetic oligonucleotide; TTT chr11 5192398 5192419 5192403 5192398 -
aattatagtcatcattctctac

SEQ ID NO: 149258 - DNA, 22 bp, Artificial Sequence
  Synthetic oligonucleotide; TTA chr11 5192397 5192418 5192402 5192397 -
attatagtcatcattctctaca

SEQ ID NO: 149259 - DNA, 22 bp, Artificial Sequence
  Synthetic oligonucleotide; TTA chr11 5192393 5192414 5192398 5192393 -
tagtcatcattctctacatatt

SEQ ID NO: 149260 - DNA, 22 bp, Artificial Sequence
  Synthetic oligonucleotide; TTC chr11 5192381 5192402 5192386 5192381 -
tctacatattactccattaacc

SEQ ID NO: 149261 - DNA, 22 bp, Artificial Sequence
  Synthetic oligonucleotide; CTC chr11 5192379 5192400 5192384 5192379 -
tacatattactccattaaccta

SEQ ID NO: 149262 - DNA, 22 bp, Artificial Sequence
  Synthetic oligonucleotide; CTA chr11 5192377 5192398 5192382 5192377 -
catattactccattaacctatt

SEQ ID NO: 149263 - DNA, 22 bp, Artificial Sequence
  Synthetic oligonucleotide; TTA chr11 5192370 5192391 5192375 5192370 -
ctccattaacctattttatctt

SEQ ID NO: 149264 - DNA, 22 bp, Artificial Sequence
  Synthetic oligonucleotide; CTC chr11 5192367 5192388 5192372 5192367 -
cattaacctattttatcttgct

SEQ ID NO: 149265 - DNA, 22 bp, Artificial Sequence
  Synthetic oligonucleotide; TTA chr11 5192362 5192383 5192367 5192362 -
acctattttatcttgctgttga

SEQ ID NO: 149266 - DNA, 22 bp, Artificial Sequence
  Synthetic oligonucleotide; CTA chr11 5192357 5192378 5192362 5192357 -
ttttatcttgctgttgagaaac

SEQ ID NO: 149267 - DNA, 22 bp, Artificial Sequence
  Synthetic oligonucleotide; TTT chr11 5192354 5192375 5192359 5192354 -
tatcttgctgttgagaaacttc

SEQ ID NO: 149268 - DNA, 22 bp, Artificial Sequence
  Synthetic oligonucleotide; TTT chr11 5192353 5192374 5192358 5192353 -
atcttgctgttgagaaacttcc

SEQ ID NO: 149269 - DNA, 22 bp, Artificial Sequence
  Synthetic oligonucleotide; TTA chr11 5192352 5192373 5192357 5192352 -
tcttgctgttgagaaacttcca

SEQ ID NO: 149270 - DNA, 22 bp, Artificial Sequence
  Synthetic oligonucleotide; CTT chr11 5192348 5192369 5192353 5192348 -
gctgttgagaaacttccattcc

SEQ ID NO: 149271 - DNA, 22 bp, Artificial Sequence
  Synthetic oligonucleotide; TTG chr11 5192347 5192368 5192352 5192347 -
ctgttgagaaacttccattcct

SEQ ID NO: 149272 - DNA, 22 bp, Artificial Sequence
  Synthetic oligonucleotide; CTG chr11 5192344 5192365 5192349 5192344 -
ttgagaaacttccattcctata

SEQ ID NO: 149273 - DNA, 22 bp, Artificial Sequence
  Synthetic oligonucleotide; TTG chr11 5192341 5192362 5192346 5192341 -
agaaacttccattcctatagtc

SEQ ID NO: 149274 - DNA, 22 bp, Artificial Sequence
  Synthetic oligonucleotide; CTT chr11 5192333 5192354 5192338 5192333 -
ccattcctatagtctttcatat

SEQ ID NO: 149275 - DNA, 22 bp, Artificial Sequence
  Synthetic oligonucleotide; TTC chr11 5192332 5192353 5192337 5192332 -
cattcctatagtctttcatatc

SEQ ID NO: 149276 - DNA, 22 bp, Artificial Sequence
  Synthetic oligonucleotide; TTC chr11 5192327 5192348 5192332 5192327 -
ctatagtctttcatatccttct

SEQ ID NO: 149277 - DNA, 22 bp, Artificial Sequence
  Synthetic oligonucleotide; CTA chr11 5192324 5192345 5192329 5192324 -
tagtctttcatatccttctgtt

SEQ ID NO: 149278 - DNA, 22 bp, Artificial Sequence
  Synthetic oligonucleotide; CTT chr11 5192317 5192338 5192322 5192317 -
tcatatccttctgttctgatta

SEQ ID NO: 149279 - DNA, 22 bp, Artificial Sequence
  Synthetic oligonucleotide; TTT chr11 5192316 5192337 5192321 5192316 -
catatccttctgttctgattat

SEQ ID NO: 149280 - DNA, 22 bp, Artificial Sequence
  Synthetic oligonucleotide; TTC chr11 5192315 5192336 5192320 5192315 -
atatccttctgttctgattatt

SEQ ID NO: 149281 - DNA, 22 bp, Artificial Sequence
  Synthetic oligonucleotide; CTT chr11 5192307 5192328 5192312 5192307 -
ctgttctgattattattcctca

SEQ ID NO: 149282 - DNA, 22 bp, Artificial Sequence
  Synthetic oligonucleotide; TTC chr11 5192306 5192327 5192311 5192306 -
tgttctgattattattcctcaa

SEQ ID NO: 149283 - DNA, 22 bp, Artificial Sequence
  Synthetic oligonucleotide; CTG chr11 5192304 5192325 5192309 5192304 -
ttctgattattattcctcaaac

SEQ ID NO: 149284 - DNA, 22 bp, Artificial Sequence
  Synthetic oligonucleotide; TTC chr11 5192301 5192322 5192306 5192301 -
tgattattattcctcaaacaaa

SEQ ID NO: 149285 - DNA, 22 bp, Artificial Sequence
  Synthetic oligonucleotide; CTG chr11 5192299 5192320 5192304 5192299 -
attattattcctcaaacaaata

SEQ ID NO: 149286 - DNA, 22 bp, Artificial Sequence
  Synthetic oligonucleotide; TTA chr11 5192295 5192316 5192300 5192295 -
ttattcctcaaacaaatataga

SEQ ID NO: 149287 - DNA, 22 bp, Artificial Sequence
  Synthetic oligonucleotide; TTA chr11 5192292 5192313 5192297 5192292 -
ttcctcaaacaaatatagatat

SEQ ID NO: 149288 - DNA, 22 bp, Artificial Sequence
  Synthetic oligonucleotide; TTC chr11 5192289 5192310 5192294 5192289 -
ctcaaacaaatatagatattca

SEQ ID NO: 149289 - DNA, 22 bp, Artificial Sequence
  Synthetic oligonucleotide; CTC chr11 5192286 5192307 5192291 5192286 -
aaacaaatatagatattcaata

SEQ ID NO: 149290 - DNA, 22 bp, Artificial Sequence
  Synthetic oligonucleotide; TTC chr11 5192268 5192289 5192273 5192268 -
aataatagacaaatagtgaata

SEQ ID NO: 149291 - DNA, 22 bp, Artificial Sequence
  Synthetic oligonucleotide; TTC chr11 5192231 5192252 5192236 5192231 -
tttgacttagtttcagacagct

SEQ ID NO: 149292 - DNA, 22 bp, Artificial Sequence
  Synthetic oligonucleotide; CTT chr11 5192229 5192250 5192234 5192229 -
tgacttagtttcagacagctat

SEQ ID NO: 149293 - DNA, 22 bp, Artificial Sequence
  Synthetic oligonucleotide; TTT chr11 5192228 5192249 5192233 5192228 -
gacttagtttcagacagctatt

SEQ ID NO: 149294 - DNA, 22 bp, Artificial Sequence
  Synthetic oligonucleotide; TTG chr11 5192227 5192248 5192232 5192227 -
acttagtttcagacagctattg

SEQ ID NO: 149295 - DNA, 22 bp, Artificial Sequence
  Synthetic oligonucleotide; CTT chr11 5192223 5192244 5192228 5192223 -
agtttcagacagctattgcata

SEQ ID NO: 149296 - DNA, 22 bp, Artificial Sequence
  Synthetic oligonucleotide; TTA chr11 5192222 5192243 5192227 5192222 -
gtttcagacagctattgcatag

SEQ ID NO: 149297 - DNA, 22 bp, Artificial Sequence
  Synthetic oligonucleotide; TTT chr11 5192218 5192239 5192223 5192218 -
cagacagctattgcatagaatg

SEQ ID NO: 149298 - DNA, 22 bp, Artificial Sequence
  Synthetic oligonucleotide; TTC chr11 5192217 5192238 5192222 5192217 -
agacagctattgcatagaatga

SEQ ID NO: 149299 - DNA, 22 bp, Artificial Sequence
  Synthetic oligonucleotide; CTA chr11 5192208 5192229 5192213 5192208 -
ttgcatagaatgaaatagatta

SEQ ID NO: 149300 - DNA, 22 bp, Artificial Sequence
  Synthetic oligonucleotide; TTG chr11 5192205 5192226 5192210 5192205 -
catagaatgaaatagattaata

SEQ ID NO: 149301 - DNA, 22 bp, Artificial Sequence
  Synthetic oligonucleotide; TTA chr11 5192186 5192207 5192191 5192186 -
atatttaataacaggtaatgtt

SEQ ID NO: 149302 - DNA, 22 bp, Artificial Sequence
  Synthetic oligonucleotide; TTT chr11 5192180 5192201 5192185 5192180 -
aataacaggtaatgttatgatt

SEQ ID NO: 149303 - DNA, 22 bp, Artificial Sequence
  Synthetic oligonucleotide; TTA chr11 5192179 5192200 5192184 5192179 -
ataacaggtaatgttatgattt

SEQ ID NO: 149304 - DNA, 22 bp, Artificial Sequence
  Synthetic oligonucleotide; TTA chr11 5192163 5192184 5192168 5192163 -
tgatttattaaaaataagatga

SEQ ID NO: 149305 - DNA, 22 bp, Artificial Sequence
  Synthetic oligonucleotide; TTT chr11 5192157 5192178 5192162 5192157 -
attaaaaataagatgataaata

SEQ ID NO: 149306 - DNA, 22 bp, Artificial Sequence
  Synthetic oligonucleotide; TTA chr11 5192156 5192177 5192161 5192156 -
ttaaaaataagatgataaataa

SEQ ID NO: 149307 - DNA, 22 bp, Artificial Sequence
  Synthetic oligonucleotide; TTA chr11 5192153 5192174 5192158 5192153 -
aaaataagatgataaataaaag

SEQ ID NO: 149308 - DNA, 22 bp, Artificial Sequence
  Synthetic oligonucleotide; TTT chr11 5192127 5192148 5192132 5192127 -
agtatcttcccatggagataac

SEQ ID NO: 149309 - DNA, 22 bp, Artificial Sequence
  Synthetic oligonucleotide; TTA chr11 5192126 5192147 5192131 5192126 -
gtatcttcccatggagataaca

SEQ ID NO: 149310 - DNA, 22 bp, Artificial Sequence
  Synthetic oligonucleotide; CTT chr11 5192119 5192140 5192124 5192119 -
cccatggagataacacacttag

SEQ ID NO: 149311 - DNA, 22 bp, Artificial Sequence
  Synthetic oligonucleotide; TTC chr11 5192118 5192139 5192123 5192118 -
ccatggagataacacacttaga

SEQ ID NO: 149312 - DNA, 22 bp, Artificial Sequence
  Synthetic oligonucleotide; CTT chr11 5192099 5192120 5192104 5192099 -
agatacaggtttcatgtcactt

SEQ ID NO: 149313 - DNA, 22 bp, Artificial Sequence
  Synthetic oligonucleotide; TTA chr11 5192098 5192119 5192103 5192098 -
gatacaggtttcatgtcacttt

SEQ ID NO: 149314 - DNA, 22 bp, Artificial Sequence
  Synthetic oligonucleotide; TTT chr11 5192087 5192108 5192092 5192087 -
catgtcactttggacatgagta

SEQ ID NO: 149315 - DNA, 22 bp, Artificial Sequence
  Synthetic oligonucleotide; TTC chr11 5192086 5192107 5192091 5192086 -
atgtcactttggacatgagtaa

SEQ ID NO: 149316 - DNA, 22 bp, Artificial Sequence
  Synthetic oligonucleotide; CTT chr11 5192077 5192098 5192082 5192077 -
tggacatgagtaaagaggagta

SEQ ID NO: 149317 - DNA, 22 bp, Artificial Sequence
  Synthetic oligonucleotide; TTT chr11 5192076 5192097 5192081 5192076 -
ggacatgagtaaagaggagtaa

SEQ ID NO: 149318 - DNA, 22 bp, Artificial Sequence
  Synthetic oligonucleotide; TTG chr11 5192075 5192096 5192080 5192075 -
gacatgagtaaagaggagtaaa

SEQ ID NO: 149319 - DNA, 22 bp, Artificial Sequence
  Synthetic oligonucleotide; TTA chr11 5192046 5192067 5192051 5192046 -
actcccaaatcttgatcacatt

SEQ ID NO: 149320 - DNA, 22 bp, Artificial Sequence
  Synthetic oligonucleotide; CTC chr11 5192042 5192063 5192047 5192042 -
ccaaatcttgatcacattgagt

SEQ ID NO: 149321 - DNA, 22 bp, Artificial Sequence
  Synthetic oligonucleotide; CTT chr11 5192033 5192054 5192038 5192033 -
gatcacattgagtatcaaagga

SEQ ID NO: 149322 - DNA, 22 bp, Artificial Sequence
  Synthetic oligonucleotide; TTG chr11 5192032 5192053 5192037 5192032 -
atcacattgagtatcaaaggaa

SEQ ID NO: 149323 - DNA, 22 bp, Artificial Sequence
  Synthetic oligonucleotide; TTG chr11 5192023 5192044 5192028 5192023 -
agtatcaaaggaaggaagaaga

SEQ ID NO: 149324 - DNA, 22 bp, Artificial Sequence
  Synthetic oligonucleotide; TTA chr11 5191993 5192014 5191998 5191993 -
ttaatggtggcattaaatatca

SEQ ID NO: 149325 - DNA, 22 bp, Artificial Sequence
  Synthetic oligonucleotide; TTA chr11 5191990 5192011 5191995 5191990 -
atggtggcattaaatatcattt

SEQ ID NO: 149326 - DNA, 22 bp, Artificial Sequence
  Synthetic oligonucleotide; TTA chr11 5191978 5191999 5191983 5191978 -
aatatcatttattattggatgt

SEQ ID NO: 149327 - DNA, 22 bp, Artificial Sequence
  Synthetic oligonucleotide; TTT chr11 5191968 5191989 5191973 5191968 -
attattggatgtgttattggca

SEQ ID NO: 149328 - DNA, 22 bp, Artificial Sequence
  Synthetic oligonucleotide; TTA chr11 5191967 5191988 5191972 5191967 -
ttattggatgtgttattggcat

SEQ ID NO: 149329 - DNA, 22 bp, Artificial Sequence
  Synthetic oligonucleotide; TTA chr11 5191964 5191985 5191969 5191964 -
ttggatgtgttattggcattgt

SEQ ID NO: 149330 - DNA, 22 bp, Artificial Sequence
  Synthetic oligonucleotide; TTG chr11 5191961 5191982 5191966 5191961 -
gatgtgttattggcattgtatt

SEQ ID NO: 149331 - DNA, 22 bp, Artificial Sequence
  Synthetic oligonucleotide; TTA chr11 5191952 5191973 5191957 5191952 -
ttggcattgtattggcatgttt

SEQ ID NO: 149332 - DNA, 22 bp, Artificial Sequence
  Synthetic oligonucleotide; TTG chr11 5191949 5191970 5191954 5191949 -
gcattgtattggcatgttttca

SEQ ID NO: 149333 - DNA, 22 bp, Artificial Sequence
  Synthetic oligonucleotide; TTG chr11 5191943 5191964 5191948 5191943 -
tattggcatgttttcacactgc

SEQ ID NO: 149334 - DNA, 22 bp, Artificial Sequence
  Synthetic oligonucleotide; TTG chr11 5191938 5191959 5191943 5191938 -
gcatgttttcacactgctgtaa

SEQ ID NO: 149335 - DNA, 22 bp, Artificial Sequence
  Synthetic oligonucleotide; TTT chr11 5191930 5191951 5191935 5191930 -
tcacactgctgtaaaaaaatac

SEQ ID NO: 149336 - DNA, 22 bp, Artificial Sequence
  Synthetic oligonucleotide; TTT chr11 5191929 5191950 5191934 5191929 -
cacactgctgtaaaaaaatacc

SEQ ID NO: 149337 - DNA, 22 bp, Artificial Sequence
  Synthetic oligonucleotide; TTC chr11 5191928 5191949 5191933 5191928 -
acactgctgtaaaaaaatacct

SEQ ID NO: 149338 - DNA, 22 bp, Artificial Sequence
  Synthetic oligonucleotide; CTG chr11 5191922 5191943 5191927 5191922 -
ctgtaaaaaaatacctgagact

SEQ ID NO: 149339 - DNA, 22 bp, Artificial Sequence
  Synthetic oligonucleotide; CTG chr11 5191919 5191940 5191924 5191919 -
taaaaaaatacctgagactggg

SEQ ID NO: 149340 - DNA, 22 bp, Artificial Sequence
  Synthetic oligonucleotide; CTG chr11 5191905 5191926 5191910 5191905 -
agactgggtaatttataaagaa

SEQ ID NO: 149341 - DNA, 22 bp, Artificial Sequence
  Synthetic oligonucleotide; CTG chr11 5191899 5191920 5191904 5191899 -
ggtaatttataaagaacagagg

SEQ ID NO: 149342 - DNA, 22 bp, Artificial Sequence
  Synthetic oligonucleotide; TTT chr11 5191891 5191912 5191896 5191891 -
ataaagaacagaggtttaattg

SEQ ID NO: 149343 - DNA, 22 bp, Artificial Sequence
  Synthetic oligonucleotide; TTA chr11 5191890 5191911 5191895 5191890 -
taaagaacagaggtttaattgg

SEQ ID NO: 149344 - DNA, 22 bp, Artificial Sequence
  Synthetic oligonucleotide; TTT chr11 5191874 5191895 5191879 5191874 -
aattggctcaaagttcttcagg

SEQ ID NO: 149345 - DNA, 22 bp, Artificial Sequence
  Synthetic oligonucleotide; TTA chr11 5191873 5191894 5191878 5191873 -
attggctcaaagttcttcaggc

SEQ ID NO: 149346 - DNA, 22 bp, Artificial Sequence
  Synthetic oligonucleotide; TTG chr11 5191869 5191890 5191874 5191869 -
gctcaaagttcttcaggctgta

SEQ ID NO: 149347 - DNA, 22 bp, Artificial Sequence
  Synthetic oligonucleotide; CTC chr11 5191865 5191886 5191870 5191865 -
aaagttcttcaggctgtacaag

SEQ ID NO: 149348 - DNA, 22 bp, Artificial Sequence
  Synthetic oligonucleotide; TTC chr11 5191858 5191879 5191863 5191858 -
ttcaggctgtacaagaagcatg

SEQ ID NO: 149349 - DNA, 22 bp, Artificial Sequence
  Synthetic oligonucleotide; CTT chr11 5191856 5191877 5191861 5191856 -
caggctgtacaagaagcatggc

SEQ ID NO: 149350 - DNA, 22 bp, Artificial Sequence
  Synthetic oligonucleotide; TTC chr11 5191855 5191876 5191860 5191855 -
aggctgtacaagaagcatggca

SEQ ID NO: 149351 - DNA, 22 bp, Artificial Sequence
  Synthetic oligonucleotide; CTG chr11 5191849 5191870 5191854 5191849 -
tacaagaagcatggcagcatct

SEQ ID NO: 149352 - DNA, 22 bp, Artificial Sequence
  Synthetic oligonucleotide; CTG chr11 5191826 5191847 5191831 5191826 -
ctcagcttctagggagacctca

SEQ ID NO: 149353 - DNA, 22 bp, Artificial Sequence
  Synthetic oligonucleotide; CTC chr11 5191823 5191844 5191828 5191823 -
agcttctagggagacctcaaga

SEQ ID NO: 149354 - DNA, 22 bp, Artificial Sequence
  Synthetic oligonucleotide; CTT chr11 5191818 5191839 5191823 5191818 -
ctagggagacctcaagaaactt

SEQ ID NO: 149355 - DNA, 22 bp, Artificial Sequence
  Synthetic oligonucleotide; TTC chr11 5191817 5191838 5191822 5191817 -
tagggagacctcaagaaactta

SEQ ID NO: 149356 - DNA, 22 bp, Artificial Sequence
  Synthetic oligonucleotide; CTA chr11 5191815 5191836 5191820 5191815 -
gggagacctcaagaaacttaca

SEQ ID NO: 149357 - DNA, 22 bp, Artificial Sequence
  Synthetic oligonucleotide; CTC chr11 5191805 5191826 5191810 5191805 -
aagaaacttacaatcatggcag

SEQ ID NO: 149358 - DNA, 22 bp, Artificial Sequence
  Synthetic oligonucleotide; CTT chr11 5191796 5191817 5191801 5191796 -
acaatcatggcagaagacaaag

SEQ ID NO: 149359 - DNA, 22 bp, Artificial Sequence
  Synthetic oligonucleotide; TTA chr11 5191795 5191816 5191800 5191795 -
caatcatggcagaagacaaagc

SEQ ID NO: 149360 - DNA, 22 bp, Artificial Sequence
  Synthetic oligonucleotide; CTT chr11 5191758 5191779 5191763 5191758 -
cacatggccaggacagggagaa

SEQ ID NO: 149361 - DNA, 22 bp, Artificial Sequence
  Synthetic oligonucleotide; TTC chr11 5191757 5191778 5191762 5191757 -
acatggccaggacagggagaag

SEQ ID NO: 149362 - DNA, 22 bp, Artificial Sequence
  Synthetic oligonucleotide; CTA chr11 5191718 5191739 5191723 5191718 -
cacactttcaaacaaccagcct

SEQ ID NO: 149363 - DNA, 22 bp, Artificial Sequence
  Synthetic oligonucleotide; CTT chr11 5191711 5191732 5191716 5191711 -
tcaaacaaccagcctcttgaga

SEQ ID NO: 149364 - DNA, 22 bp, Artificial Sequence
  Synthetic oligonucleotide; TTT chr11 5191710 5191731 5191715 5191710 -
caaacaaccagcctcttgagaa

SEQ ID NO: 149365 - DNA, 22 bp, Artificial Sequence
  Synthetic oligonucleotide; TTC chr11 5191709 5191730 5191714 5191709 -
aaacaaccagcctcttgagaac

SEQ ID NO: 149366 - DNA, 22 bp, Artificial Sequence
  Synthetic oligonucleotide; CTC chr11 5191695 5191716 5191700 5191695 -
ttgagaactcactatacagtac

SEQ ID NO: 149367 - DNA, 22 bp, Artificial Sequence
  Synthetic oligonucleotide; CTT chr11 5191693 5191714 5191698 5191693 -
gagaactcactatacagtacca

SEQ ID NO: 149368 - DNA, 22 bp, Artificial Sequence
  Synthetic oligonucleotide; TTG chr11 5191692 5191713 5191697 5191692 -
agaactcactatacagtaccaa

SEQ ID NO: 149369 - DNA, 22 bp, Artificial Sequence
  Synthetic oligonucleotide; CTC chr11 5191685 5191706 5191690 5191685 -
actatacagtaccaagggggat

SEQ ID NO: 149370 - DNA, 22 bp, Artificial Sequence
  Synthetic oligonucleotide; CTA chr11 5191681 5191702 5191686 5191681 -
tacagtaccaagggggatggta

SEQ ID NO: 149371 - DNA, 22 bp, Artificial Sequence
  Synthetic oligonucleotide; CTA chr11 5191656 5191677 5191661 5191656 -
aatcgctgatgagaactctgcc

SEQ ID NO: 149372 - DNA, 22 bp, Artificial Sequence
  Synthetic oligonucleotide; CTG chr11 5191648 5191669 5191653 5191648 -
atgagaactctgccaccatgat

SEQ ID NO: 149373 - DNA, 22 bp, Artificial Sequence
  Synthetic oligonucleotide; CTC chr11 5191638 5191659 5191643 5191638 -
tgccaccatgattgaattacct

SEQ ID NO: 149374 - DNA, 22 bp, Artificial Sequence
  Synthetic oligonucleotide; CTG chr11 5191636 5191657 5191641 5191636 -
ccaccatgattgaattacctcc

SEQ ID NO: 149375 - DNA, 22 bp, Artificial Sequence
  Synthetic oligonucleotide; TTG chr11 5191624 5191645 5191629 5191624 -
aattacctcccacaaggcccca

SEQ ID NO: 149376 - DNA, 22 bp, Artificial Sequence
  Synthetic oligonucleotide; TTA chr11 5191619 5191640 5191624 5191619 -
cctcccacaaggccccacctcc

SEQ ID NO: 149377 - DNA, 22 bp, Artificial Sequence
  Synthetic oligonucleotide; CTC chr11 5191615 5191636 5191620 5191615 -
ccacaaggccccacctccaacg

SEQ ID NO: 149378 - DNA, 22 bp, Artificial Sequence
  Synthetic oligonucleotide; CTC chr11 5191598 5191619 5191603 5191598 -
caacgctggtgattataattta

SEQ ID NO: 149379 - DNA, 22 bp, Artificial Sequence
  Synthetic oligonucleotide; CTG chr11 5191590 5191611 5191595 5191590 -
gtgattataatttaacatgata

SEQ ID NO: 149380 - DNA, 22 bp, Artificial Sequence
  Synthetic oligonucleotide; TTA chr11 5191583 5191604 5191588 5191583 -
taatttaacatgatatttgggt

SEQ ID NO: 149381 - DNA, 22 bp, Artificial Sequence
  Synthetic oligonucleotide; TTT chr11 5191577 5191598 5191582 5191577 -
aacatgatatttgggtggtgac

SEQ ID NO: 149382 - DNA, 22 bp, Artificial Sequence
  Synthetic oligonucleotide; TTA chr11 5191576 5191597 5191581 5191576 -
acatgatatttgggtggtgaca

SEQ ID NO: 149383 - DNA, 22 bp, Artificial Sequence
  Synthetic oligonucleotide; TTT chr11 5191565 5191586 5191570 5191565 -
gggtggtgacacagatccaaac

SEQ ID NO: 149384 - DNA, 22 bp, Artificial Sequence
  Synthetic oligonucleotide; TTG chr11 5191564 5191585 5191569 5191564 -
ggtggtgacacagatccaaacc

SEQ ID NO: 149385 - DNA, 22 bp, Artificial Sequence
  Synthetic oligonucleotide; CTT chr11 5191534 5191555 5191539 5191534 -
ccacctctggccccttccaaat

SEQ ID NO: 149386 - DNA, 22 bp, Artificial Sequence
  Synthetic oligonucleotide; TTC chr11 5191533 5191554 5191538 5191533 -
cacctctggccccttccaaatc

SEQ ID NO: 149387 - DNA, 22 bp, Artificial Sequence
  Synthetic oligonucleotide; CTC chr11 5191527 5191548 5191532 5191527 -
tggccccttccaaatctcatgt

SEQ ID NO: 149388 - DNA, 22 bp, Artificial Sequence
  Synthetic oligonucleotide; CTG chr11 5191525 5191546 5191530 5191525 -
gccccttccaaatctcatgttc

SEQ ID NO: 149389 - DNA, 22 bp, Artificial Sequence
  Synthetic oligonucleotide; CTT chr11 5191518 5191539 5191523 5191518 -
ccaaatctcatgttcttctcac

SEQ ID NO: 149390 - DNA, 22 bp, Artificial Sequence
  Synthetic oligonucleotide; TTC chr11 5191517 5191538 5191522 5191517 -
caaatctcatgttcttctcaca

SEQ ID NO: 149391 - DNA, 22 bp, Artificial Sequence
  Synthetic oligonucleotide; CTC chr11 5191509 5191530 5191514 5191509 -
atgttcttctcacatcacaaaa

SEQ ID NO: 149392 - DNA, 22 bp, Artificial Sequence
  Synthetic oligonucleotide; TTC chr11 5191503 5191524 5191508 5191503 -
ttctcacatcacaaaatacaat

SEQ ID NO: 149393 - DNA, 22 bp, Artificial Sequence
  Synthetic oligonucleotide; CTT chr11 5191501 5191522 5191506 5191501 -
ctcacatcacaaaatacaatca

SEQ ID NO: 149394 - DNA, 22 bp, Artificial Sequence
  Synthetic oligonucleotide; TTC chr11 5191500 5191521 5191505 5191500 -
tcacatcacaaaatacaatcat

SEQ ID NO: 149395 - DNA, 22 bp, Artificial Sequence
  Synthetic oligonucleotide; CTC chr11 5191498 5191519 5191503 5191498 -
acatcacaaaatacaatcatta

SEQ ID NO: 149396 - DNA, 22 bp, Artificial Sequence
  Synthetic oligonucleotide; TTA chr11 5191476 5191497 5191481 5191476 -
cttcccaacagtcctacaaagt

SEQ ID NO: 149397 - DNA, 22 bp, Artificial Sequence
  Synthetic oligonucleotide; CTT chr11 5191473 5191494 5191478 5191473 -
cccaacagtcctacaaagtctt

SEQ ID NO: 149398 - DNA, 22 bp, Artificial Sequence
  Synthetic oligonucleotide; TTC chr11 5191472 5191493 5191477 5191472 -
ccaacagtcctacaaagtctta

SEQ ID NO: 149399 - DNA, 22 bp, Artificial Sequence
  Synthetic oligonucleotide; CTA chr11 5191460 5191481 5191465 5191460 -
caaagtcttaactcattccagc

SEQ ID NO: 149400 - DNA, 22 bp, Artificial Sequence
  Synthetic oligonucleotide; CTT chr11 5191451 5191472 5191456 5191451 -
aactcattccagcattaactca

SEQ ID NO: 149401 - DNA, 22 bp, Artificial Sequence
  Synthetic oligonucleotide; TTA chr11 5191450 5191471 5191455 5191450 -
actcattccagcattaactcaa

SEQ ID NO: 149402 - DNA, 22 bp, Artificial Sequence
  Synthetic oligonucleotide; CTC chr11 5191446 5191467 5191451 5191446 -
attccagcattaactcaaaagt

SEQ ID NO: 149403 - DNA, 22 bp, Artificial Sequence
  Synthetic oligonucleotide; TTC chr11 5191442 5191463 5191447 5191442 -
cagcattaactcaaaagtccaa

SEQ ID NO: 149404 - DNA, 22 bp, Artificial Sequence
  Synthetic oligonucleotide; TTA chr11 5191434 5191455 5191439 5191434 -
actcaaaagtccaaagtccaaa

SEQ ID NO: 149405 - DNA, 22 bp, Artificial Sequence
  Synthetic oligonucleotide; CTC chr11 5191430 5191451 5191435 5191430 -
aaaagtccaaagtccaaagtct

SEQ ID NO: 149406 - DNA, 22 bp, Artificial Sequence
  Synthetic oligonucleotide; CTT chr11 5191407 5191428 5191412 5191407 -
atccaagacaaggcaagtccct

SEQ ID NO: 149407 - DNA, 22 bp, Artificial Sequence
  Synthetic oligonucleotide; TTA chr11 5191406 5191427 5191411 5191406 -
tccaagacaaggcaagtccctt

SEQ ID NO: 149408 - DNA, 22 bp, Artificial Sequence
  Synthetic oligonucleotide; CTT chr11 5191384 5191405 5191389 5191384 -
caacctatgagcctgtaaaatc

SEQ ID NO: 149409 - DNA, 22 bp, Artificial Sequence
  Synthetic oligonucleotide; TTC chr11 5191383 5191404 5191388 5191383 -
aacctatgagcctgtaaaatca

SEQ ID NO: 149410 - DNA, 22 bp, Artificial Sequence
  Synthetic oligonucleotide; CTA chr11 5191377 5191398 5191382 5191377 -
tgagcctgtaaaatcaaaaaca

SEQ ID NO: 149411 - DNA, 22 bp, Artificial Sequence
  Synthetic oligonucleotide; CTG chr11 5191369 5191390 5191374 5191369 -
taaaatcaaaaacaagttagtt

SEQ ID NO: 149412 - DNA, 22 bp, Artificial Sequence
  Synthetic oligonucleotide; TTA chr11 5191350 5191371 5191355 5191350 -
gttacttccaagacataatgga

SEQ ID NO: 149413 - DNA, 22 bp, Artificial Sequence
  Synthetic oligonucleotide; TTA chr11 5191346 5191367 5191351 5191346 -
cttccaagacataatggaggta

SEQ ID NO: 149414 - DNA, 22 bp, Artificial Sequence
  Synthetic oligonucleotide; CTT chr11 5191343 5191364 5191348 5191343 -
ccaagacataatggaggtactg

SEQ ID NO: 149415 - DNA, 22 bp, Artificial Sequence
  Synthetic oligonucleotide; TTC chr11 5191342 5191363 5191347 5191342 -
caagacataatggaggtactgg

SEQ ID NO: 149416 - DNA, 22 bp, Artificial Sequence
  Synthetic oligonucleotide; CTG chr11 5191321 5191342 5191326 5191321 -
gcattgggtacaaattcccatt

SEQ ID NO: 149417 - DNA, 22 bp, Artificial Sequence
  Synthetic oligonucleotide; TTG chr11 5191315 5191336 5191320 5191315 -
ggtacaaattcccattccaaaa

SEQ ID NO: 149418 - DNA, 22 bp, Artificial Sequence
  Synthetic oligonucleotide; TTC chr11 5191304 5191325 5191309 5191304 -
ccattccaaaagagagaaatgc

SEQ ID NO: 149419 - DNA, 22 bp, Artificial Sequence
  Synthetic oligonucleotide; TTC chr11 5191298 5191319 5191303 5191298 -
caaaagagagaaatgcaccaaa

SEQ ID NO: 149420 - DNA, 22 bp, Artificial Sequence
  Synthetic oligonucleotide; CTA chr11 5191264 5191285 5191269 5191264 -
aagatcccacacgagtagaaaa

SEQ ID NO: 149421 - DNA, 22 bp, Artificial Sequence
  Synthetic oligonucleotide; TTA chr11 5191223 5191244 5191228 5191223 -
caccttgatatggtttggcagt

SEQ ID NO: 149422 - DNA, 22 bp, Artificial Sequence
  Synthetic oligonucleotide; CTT chr11 5191217 5191238 5191222 5191217 -
gatatggtttggcagttttccc

SEQ ID NO: 149423 - DNA, 22 bp, Artificial Sequence
  Synthetic oligonucleotide; TTG chr11 5191216 5191237 5191221 5191216 -
atatggtttggcagttttccca

SEQ ID NO: 149424 - DNA, 22 bp, Artificial Sequence
  Synthetic oligonucleotide; TTT chr11 5191207 5191228 5191212 5191207 -
ggcagttttcccacccaaattt

SEQ ID NO: 149425 - DNA, 22 bp, Artificial Sequence
  Synthetic oligonucleotide; TTG chr11 5191206 5191227 5191211 5191206 -
gcagttttcccacccaaatttc

SEQ ID NO: 149426 - DNA, 22 bp, Artificial Sequence
  Synthetic oligonucleotide; TTT chr11 5191199 5191220 5191204 5191199 -
tcccacccaaatttcttcttga

SEQ ID NO: 149427 - DNA, 22 bp, Artificial Sequence
  Synthetic oligonucleotide; TTT chr11 5191198 5191219 5191203 5191198 -
cccacccaaatttcttcttgaa

SEQ ID NO: 149428 - DNA, 22 bp, Artificial Sequence
  Synthetic oligonucleotide; TTC chr11 5191197 5191218 5191202 5191197 -
ccacccaaatttcttcttgaat

SEQ ID NO: 149429 - DNA, 22 bp, Artificial Sequence
  Synthetic oligonucleotide; TTT chr11 5191185 5191206 5191190 5191185 -
cttcttgaatagtaggtcccat

SEQ ID NO: 149430 - DNA, 22 bp, Artificial Sequence
  Synthetic oligonucleotide; TTC chr11 5191184 5191205 5191189 5191184 -
ttcttgaatagtaggtcccata

SEQ ID NO: 149431 - DNA, 22 bp, Artificial Sequence
  Synthetic oligonucleotide; CTT chr11 5191182 5191203 5191187 5191182 -
cttgaatagtaggtcccataat

SEQ ID NO: 149432 - DNA, 22 bp, Artificial Sequence
  Synthetic oligonucleotide; TTC chr11 5191181 5191202 5191186 5191181 -
ttgaatagtaggtcccataatc

SEQ ID NO: 149433 - DNA, 22 bp, Artificial Sequence
  Synthetic oligonucleotide; CTT chr11 5191179 5191200 5191184 5191179 -
gaatagtaggtcccataatccc

SEQ ID NO: 149434 - DNA, 22 bp, Artificial Sequence
  Synthetic oligonucleotide; TTG chr11 5191178 5191199 5191183 5191178 -
aatagtaggtcccataatccct

SEQ ID NO: 149435 - DNA, 22 bp, Artificial Sequence
  Synthetic oligonucleotide; CTG chr11 5191155 5191176 5191160 5191155 -
cctgtcatggaaggaacacact

SEQ ID NO: 149436 - DNA, 22 bp, Artificial Sequence
  Synthetic oligonucleotide; CTG chr11 5191151 5191172 5191156 5191151 -
tcatggaaggaacacactggga

SEQ ID NO: 149437 - DNA, 22 bp, Artificial Sequence
  Synthetic oligonucleotide; CTG chr11 5191132 5191153 5191137 5191132 -
ggatgtaattgaatcatggggg

SEQ ID NO: 149438 - DNA, 22 bp, Artificial Sequence
  Synthetic oligonucleotide; TTG chr11 5191121 5191142 5191126 5191121 -
aatcatgggggtaggtttttca

SEQ ID NO: 149439 - DNA, 22 bp, Artificial Sequence
  Synthetic oligonucleotide; TTT chr11 5191103 5191124 5191108 5191103 -
ttcacatgctgttctcatgata

SEQ ID NO: 149440 - DNA, 22 bp, Artificial Sequence
  Synthetic oligonucleotide; TTT chr11 5191102 5191123 5191107 5191102 -
tcacatgctgttctcatgatag

SEQ ID NO: 149441 - DNA, 22 bp, Artificial Sequence
  Synthetic oligonucleotide; TTT chr11 5191101 5191122 5191106 5191101 -
cacatgctgttctcatgatagt

SEQ ID NO: 149442 - DNA, 22 bp, Artificial Sequence
  Synthetic oligonucleotide; TTC chr11 5191100 5191121 5191105 5191100 -
acatgctgttctcatgatagtg

SEQ ID NO: 149443 - DNA, 22 bp, Artificial Sequence
  Synthetic oligonucleotide; CTG chr11 5191092 5191113 5191097 5191092 -
ttctcatgatagtgagtaagtc

SEQ ID NO: 149444 - DNA, 22 bp, Artificial Sequence
  Synthetic oligonucleotide; TTC chr11 5191089 5191110 5191094 5191089 -
tcatgatagtgagtaagtctca

SEQ ID NO: 149445 - DNA, 22 bp, Artificial Sequence
  Synthetic oligonucleotide; CTC chr11 5191087 5191108 5191092 5191087 -
atgatagtgagtaagtctcaca

SEQ ID NO: 149446 - DNA, 22 bp, Artificial Sequence
  Synthetic oligonucleotide; CTC chr11 5191068 5191089 5191073 5191068 -
acaagatctgatggttttataa

SEQ ID NO: 149447 - DNA, 22 bp, Artificial Sequence
  Synthetic oligonucleotide; CTG chr11 5191058 5191079 5191063 5191058 -
atggttttataaagggcatttc

SEQ ID NO: 149448 - DNA, 22 bp, Artificial Sequence
  Synthetic oligonucleotide; TTT chr11 5191051 5191072 5191056 5191051 -
tataaagggcatttcccttgca

SEQ ID NO: 149449 - DNA, 22 bp, Artificial Sequence
  Synthetic oligonucleotide; TTT chr11 5191050 5191071 5191055 5191050 -
ataaagggcatttcccttgcac

SEQ ID NO: 149450 - DNA, 22 bp, Artificial Sequence
  Synthetic oligonucleotide; TTA chr11 5191049 5191070 5191054 5191049 -
taaagggcatttcccttgcaca

SEQ ID NO: 149451 - DNA, 22 bp, Artificial Sequence
  Synthetic oligonucleotide; TTT chr11 5191037 5191058 5191042 5191037 -
cccttgcacatgctctcttgcc

SEQ ID NO: 149452 - DNA, 22 bp, Artificial Sequence
  Synthetic oligonucleotide; TTC chr11 5191036 5191057 5191041 5191036 -
ccttgcacatgctctcttgcct

SEQ ID NO: 149453 - DNA, 22 bp, Artificial Sequence
  Synthetic oligonucleotide; CTT chr11 5191032 5191053 5191037 5191032 -
gcacatgctctcttgcctgcca

SEQ ID NO: 149454 - DNA, 22 bp, Artificial Sequence
  Synthetic oligonucleotide; TTG chr11 5191031 5191052 5191036 5191031 -
cacatgctctcttgcctgccac

SEQ ID NO: 149455 - DNA, 22 bp, Artificial Sequence
  Synthetic oligonucleotide; CTC chr11 5191022 5191043 5191027 5191022 -
tcttgcctgccaccatgtcaga

SEQ ID NO: 149456 - DNA, 22 bp, Artificial Sequence
  Synthetic oligonucleotide; CTC chr11 5191020 5191041 5191025 5191020 -
ttgcctgccaccatgtcagatg

SEQ ID NO: 149457 - DNA, 22 bp, Artificial Sequence
  Synthetic oligonucleotide; CTT chr11 5191018 5191039 5191023 5191018 -
gcctgccaccatgtcagatgtg

SEQ ID NO: 149458 - DNA, 22 bp, Artificial Sequence
  Synthetic oligonucleotide; TTG chr11 5191017 5191038 5191022 5191017 -
cctgccaccatgtcagatgtga

SEQ ID NO: 149459 - DNA, 22 bp, Artificial Sequence
  Synthetic oligonucleotide; CTG chr11 5191013 5191034 5191018 5191013 -
ccaccatgtcagatgtgacttt

SEQ ID NO: 149460 - DNA, 22 bp, Artificial Sequence
  Synthetic oligonucleotide; CTT chr11 5190992 5191013 5190997 5190992 -
tgctcctccttcaccttccacc

SEQ ID NO: 149461 - DNA, 22 bp, Artificial Sequence
  Synthetic oligonucleotide; TTT chr11 5190991 5191012 5190996 5190991 -
gctcctccttcaccttccacca

SEQ ID NO: 149462 - DNA, 22 bp, Artificial Sequence
  Synthetic oligonucleotide; TTG chr11 5190990 5191011 5190995 5190990 -
ctcctccttcaccttccaccat

SEQ ID NO: 149463 - DNA, 22 bp, Artificial Sequence
  Synthetic oligonucleotide; CTC chr11 5190987 5191008 5190992 5190987 -
ctccttcaccttccaccatgat

SEQ ID NO: 149464 - DNA, 22 bp, Artificial Sequence
  Synthetic oligonucleotide; CTC chr11 5190984 5191005 5190989 5190984 -
cttcaccttccaccatgattgt

SEQ ID NO: 149465 - DNA, 22 bp, Artificial Sequence
  Synthetic oligonucleotide; CTT chr11 5190981 5191002 5190986 5190981 -
caccttccaccatgattgtaag

SEQ ID NO: 149466 - DNA, 22 bp, Artificial Sequence
  Synthetic oligonucleotide; TTC chr11 5190980 5191001 5190985 5190980 -
accttccaccatgattgtaagg

SEQ ID NO: 149467 - DNA, 22 bp, Artificial Sequence
  Synthetic oligonucleotide; CTT chr11 5190975 5190996 5190980 5190975 -
ccaccatgattgtaaggcctcc

SEQ ID NO: 149468 - DNA, 22 bp, Artificial Sequence
  Synthetic oligonucleotide; TTC chr11 5190974 5190995 5190979 5190974 -
caccatgattgtaaggcctccc

SEQ ID NO: 149469 - DNA, 22 bp, Artificial Sequence
  Synthetic oligonucleotide; TTG chr11 5190963 5190984 5190968 5190963 -
taaggcctccccagcaatgtgg

SEQ ID NO: 149470 - DNA, 22 bp, Artificial Sequence
  Synthetic oligonucleotide; CTC chr11 5190954 5190975 5190959 5190954 -
cccagcaatgtggatctatgag

SEQ ID NO: 149471 - DNA, 22 bp, Artificial Sequence
  Synthetic oligonucleotide; CTA chr11 5190936 5190957 5190941 5190936 -
tgagtccattaaatctcttttt

SEQ ID NO: 149472 - DNA, 22 bp, Artificial Sequence
  Synthetic oligonucleotide; TTA chr11 5190925 5190946 5190930 5190925 -
aatctctttttctttataaatt

SEQ ID NO: 149473 - DNA, 22 bp, Artificial Sequence
  Synthetic oligonucleotide; CTC chr11 5190919 5190940 5190924 5190919 -
tttttctttataaattacccag

SEQ ID NO: 149474 - DNA, 22 bp, Artificial Sequence
  Synthetic oligonucleotide; CTT chr11 5190917 5190938 5190922 5190917 -
tttctttataaattacccagtc

SEQ ID NO: 149475 - DNA, 22 bp, Artificial Sequence
  Synthetic oligonucleotide; TTT chr11 5190916 5190937 5190921 5190916 -
ttctttataaattacccagtct

SEQ ID NO: 149476 - DNA, 22 bp, Artificial Sequence
  Synthetic oligonucleotide; TTT chr11 5190915 5190936 5190920 5190915 -
tctttataaattacccagtctc

SEQ ID NO: 149477 - DNA, 22 bp, Artificial Sequence
  Synthetic oligonucleotide; TTT chr11 5190914 5190935 5190919 5190914 -
ctttataaattacccagtctcg

SEQ ID NO: 149478 - DNA, 22 bp, Artificial Sequence
  Synthetic oligonucleotide; TTC chr11 5190913 5190934 5190918 5190913 -
tttataaattacccagtctcgg

SEQ ID NO: 149479 - DNA, 22 bp, Artificial Sequence
  Synthetic oligonucleotide; CTT chr11 5190911 5190932 5190916 5190911 -
tataaattacccagtctcgggt

SEQ ID NO: 149480 - DNA, 22 bp, Artificial Sequence
  Synthetic oligonucleotide; TTT chr11 5190910 5190931 5190915 5190910 -
ataaattacccagtctcgggta

SEQ ID NO: 149481 - DNA, 22 bp, Artificial Sequence
  Synthetic oligonucleotide; TTA chr11 5190909 5190930 5190914 5190909 -
taaattacccagtctcgggtat

SEQ ID NO: 149482 - DNA, 22 bp, Artificial Sequence
  Synthetic oligonucleotide; TTA chr11 5190902 5190923 5190907 5190902 -
cccagtctcgggtatttcttca

SEQ ID NO: 149483 - DNA, 22 bp, Artificial Sequence
  Synthetic oligonucleotide; CTC chr11 5190893 5190914 5190898 5190893 -
gggtatttcttcatagcagttt

SEQ ID NO: 149484 - DNA, 22 bp, Artificial Sequence
  Synthetic oligonucleotide; TTT chr11 5190885 5190906 5190890 5190885 -
cttcatagcagtttaaaacgga

SEQ ID NO: 149485 - DNA, 22 bp, Artificial Sequence
  Synthetic oligonucleotide; TTC chr11 5190884 5190905 5190889 5190884 -
ttcatagcagtttaaaacggac

SEQ ID NO: 149486 - DNA, 22 bp, Artificial Sequence
  Synthetic oligonucleotide; CTT chr11 5190882 5190903 5190887 5190882 -
catagcagtttaaaacggacaa

SEQ ID NO: 149487 - DNA, 22 bp, Artificial Sequence
  Synthetic oligonucleotide; TTC chr11 5190881 5190902 5190886 5190881 -
atagcagtttaaaacggacaaa

SEQ ID NO: 149488 - DNA, 22 bp, Artificial Sequence
  Synthetic oligonucleotide; TTT chr11 5190871 5190892 5190876 5190871 -
aaaacggacaaatacacacctt

SEQ ID NO: 149489 - DNA, 22 bp, Artificial Sequence
  Synthetic oligonucleotide; TTA chr11 5190870 5190891 5190875 5190870 -
aaacggacaaatacacacctta

SEQ ID NO: 149490 - DNA, 22 bp, Artificial Sequence
  Synthetic oligonucleotide; CTT chr11 5190849 5190870 5190854 5190849 -
aacactccaaaataatctcctt

SEQ ID NO: 149491 - DNA, 22 bp, Artificial Sequence
  Synthetic oligonucleotide; TTA chr11 5190848 5190869 5190853 5190848 -
acactccaaaataatctccttt

SEQ ID NO: 149492 - DNA, 22 bp, Artificial Sequence
  Synthetic oligonucleotide; CTC chr11 5190842 5190863 5190847 5190842 -
caaaataatctcctttgacccc

SEQ ID NO: 149493 - DNA, 22 bp, Artificial Sequence
  Synthetic oligonucleotide; CTC chr11 5190830 5190851 5190835 5190830 -
ctttgaccccatgtctcatatc

SEQ ID NO: 149494 - DNA, 22 bp, Artificial Sequence
  Synthetic oligonucleotide; CTT chr11 5190827 5190848 5190832 5190827 -
tgaccccatgtctcatatcagg

SEQ ID NO: 149495 - DNA, 22 bp, Artificial Sequence
  Synthetic oligonucleotide; TTT chr11 5190826 5190847 5190831 5190826 -
gaccccatgtctcatatcaggg

SEQ ID NO: 149496 - DNA, 22 bp, Artificial Sequence
  Synthetic oligonucleotide; TTG chr11 5190825 5190846 5190830 5190825 -
accccatgtctcatatcaggga

SEQ ID NO: 149497 - DNA, 22 bp, Artificial Sequence
  Synthetic oligonucleotide; CTC chr11 5190813 5190834 5190818 5190813 -
atatcagggacacactgatgca

SEQ ID NO: 149498 - DNA, 22 bp, Artificial Sequence
  Synthetic oligonucleotide; CTG chr11 5190796 5190817 5190801 5190796 -
atgcaagaggtgggctcccaag

SEQ ID NO: 149499 - DNA, 22 bp, Artificial Sequence
  Synthetic oligonucleotide; CTC chr11 5190779 5190800 5190784 5190779 -
ccaaggccttgggcagttccac

SEQ ID NO: 149500 - DNA, 22 bp, Artificial Sequence
  Synthetic oligonucleotide; CTT chr11 5190769 5190790 5190774 5190769 -
gggcagttccacccctattgct

SEQ ID NO: 149501 - DNA, 22 bp, Artificial Sequence
  Synthetic oligonucleotide; TTG chr11 5190768 5190789 5190773 5190768 -
ggcagttccacccctattgctt

SEQ ID NO: 149502 - DNA, 22 bp, Artificial Sequence
  Synthetic oligonucleotide; TTC chr11 5190760 5190781 5190765 5190760 -
cacccctattgctttgcacagt

SEQ ID NO: 149503 - DNA, 22 bp, Artificial Sequence
  Synthetic oligonucleotide; CTA chr11 5190752 5190773 5190757 5190752 -
ttgctttgcacagtttagcccc

SEQ ID NO: 149504 - DNA, 22 bp, Artificial Sequence
  Synthetic oligonucleotide; TTG chr11 5190749 5190770 5190754 5190749 -
ctttgcacagtttagcccctgc

SEQ ID NO: 149505 - DNA, 22 bp, Artificial Sequence
  Synthetic oligonucleotide; CTT chr11 5190746 5190767 5190751 5190746 -
tgcacagtttagcccctgctgc

SEQ ID NO: 149506 - DNA, 22 bp, Artificial Sequence
  Synthetic oligonucleotide; TTT chr11 5190745 5190766 5190750 5190745 -
gcacagtttagcccctgctgct

SEQ ID NO: 149507 - DNA, 22 bp, Artificial Sequence
  Synthetic oligonucleotide; TTG chr11 5190744 5190765 5190749 5190744 -
cacagtttagcccctgctgctg

SEQ ID NO: 149508 - DNA, 22 bp, Artificial Sequence
  Synthetic oligonucleotide; TTT chr11 5190736 5190757 5190741 5190736 -
agcccctgctgctgctcttaag

SEQ ID NO: 149509 - DNA, 22 bp, Artificial Sequence
  Synthetic oligonucleotide; TTA chr11 5190735 5190756 5190740 5190735 -
gcccctgctgctgctcttaaga

SEQ ID NO: 149510 - DNA, 22 bp, Artificial Sequence
  Synthetic oligonucleotide; CTG chr11 5190728 5190749 5190733 5190728 -
ctgctgctcttaagagattgta

SEQ ID NO: 149511 - DNA, 22 bp, Artificial Sequence
  Synthetic oligonucleotide; CTG chr11 5190725 5190746 5190730 5190725 -
ctgctcttaagagattgtattg

SEQ ID NO: 149512 - DNA, 22 bp, Artificial Sequence
  Synthetic oligonucleotide; CTG chr11 5190722 5190743 5190727 5190722 -
ctcttaagagattgtattgagt

SEQ ID NO: 149513 - DNA, 22 bp, Artificial Sequence
  Synthetic oligonucleotide; CTC chr11 5190719 5190740 5190724 5190719 -
ttaagagattgtattgagtgtt

SEQ ID NO: 149514 - DNA, 22 bp, Artificial Sequence
  Synthetic oligonucleotide; CTT chr11 5190717 5190738 5190722 5190717 -
aagagattgtattgagtgtttg

SEQ ID NO: 149515 - DNA, 22 bp, Artificial Sequence
  Synthetic oligonucleotide; TTA chr11 5190716 5190737 5190721 5190716 -
agagattgtattgagtgtttgc

SEQ ID NO: 149516 - DNA, 22 bp, Artificial Sequence
  Synthetic oligonucleotide; TTG chr11 5190708 5190729 5190713 5190708 -
tattgagtgtttgcagcttttc

SEQ ID NO: 149517 - DNA, 22 bp, Artificial Sequence
  Synthetic oligonucleotide; TTG chr11 5190703 5190724 5190708 5190703 -
agtgtttgcagcttttctaggt

SEQ ID NO: 149518 - DNA, 22 bp, Artificial Sequence
  Synthetic oligonucleotide; TTT chr11 5190696 5190717 5190701 5190696 -
gcagcttttctaggtgcacggt

SEQ ID NO: 149519 - DNA, 22 bp, Artificial Sequence
  Synthetic oligonucleotide; TTG chr11 5190695 5190716 5190700 5190695 -
cagcttttctaggtgcacggtg

SEQ ID NO: 149520 - DNA, 22 bp, Artificial Sequence
  Synthetic oligonucleotide; CTT chr11 5190689 5190710 5190694 5190689 -
ttctaggtgcacggtgcaaact

SEQ ID NO: 149521 - DNA, 22 bp, Artificial Sequence
  Synthetic oligonucleotide; TTT chr11 5190688 5190709 5190693 5190688 -
tctaggtgcacggtgcaaactg

SEQ ID NO: 149522 - DNA, 22 bp, Artificial Sequence
  Synthetic oligonucleotide; TTT chr11 5190687 5190708 5190692 5190687 -
ctaggtgcacggtgcaaactgt

SEQ ID NO: 149523 - DNA, 22 bp, Artificial Sequence
  Synthetic oligonucleotide; TTC chr11 5190686 5190707 5190691 5190686 -
taggtgcacggtgcaaactgtc

SEQ ID NO: 149524 - DNA, 22 bp, Artificial Sequence
  Synthetic oligonucleotide; CTA chr11 5190684 5190705 5190689 5190684 -
ggtgcacggtgcaaactgtcag

SEQ ID NO: 149525 - DNA, 22 bp, Artificial Sequence
  Synthetic oligonucleotide; CTG chr11 5190666 5190687 5190671 5190666 -
tcagtggatctaccattctggg

SEQ ID NO: 149526 - DNA, 22 bp, Artificial Sequence
  Synthetic oligonucleotide; CTA chr11 5190654 5190675 5190659 5190654 -
ccattctggggtctggaggacg

SEQ ID NO: 149527 - DNA, 22 bp, Artificial Sequence
  Synthetic oligonucleotide; TTC chr11 5190648 5190669 5190653 5190648 -
tggggtctggaggacggtggcc

SEQ ID NO: 149528 - DNA, 22 bp, Artificial Sequence
  Synthetic oligonucleotide; CTG chr11 5190646 5190667 5190651 5190646 -
gggtctggaggacggtggccct

SEQ ID NO: 149529 - DNA, 22 bp, Artificial Sequence
  Synthetic oligonucleotide; CTG chr11 5190639 5190660 5190644 5190639 -
gaggacggtggcccttttctca

SEQ ID NO: 149530 - DNA, 22 bp, Artificial Sequence
  Synthetic oligonucleotide; CTT chr11 5190623 5190644 5190628 5190623 -
ttctcatagctctgctaggcag

SEQ ID NO: 149531 - DNA, 22 bp, Artificial Sequence
  Synthetic oligonucleotide; TTT chr11 5190622 5190643 5190627 5190622 -
tctcatagctctgctaggcagt

SEQ ID NO: 149532 - DNA, 22 bp, Artificial Sequence
  Synthetic oligonucleotide; TTT chr11 5190621 5190642 5190626 5190621 -
ctcatagctctgctaggcagtg

SEQ ID NO: 149533 - DNA, 22 bp, Artificial Sequence
  Synthetic oligonucleotide; TTC chr11 5190620 5190641 5190625 5190620 -
tcatagctctgctaggcagtgc

SEQ ID NO: 149534 - DNA, 22 bp, Artificial Sequence
  Synthetic oligonucleotide; CTC chr11 5190618 5190639 5190623 5190618 -
atagctctgctaggcagtgccc

SEQ ID NO: 149535 - DNA, 22 bp, Artificial Sequence
  Synthetic oligonucleotide; CTC chr11 5190611 5190632 5190616 5190611 -
tgctaggcagtgccccagtgga

SEQ ID NO: 149536 - DNA, 22 bp, Artificial Sequence
  Synthetic oligonucleotide; CTG chr11 5190609 5190630 5190614 5190609 -
ctaggcagtgccccagtggaga

SEQ ID NO: 149537 - DNA, 22 bp, Artificial Sequence
  Synthetic oligonucleotide; CTA chr11 5190606 5190627 5190611 5190606 -
ggcagtgccccagtggagactc

SEQ ID NO: 149538 - DNA, 22 bp, Artificial Sequence
  Synthetic oligonucleotide; CTC chr11 5190584 5190605 5190589 5190584 -
tgtgagggggttccaacctcat

SEQ ID NO: 149539 - DNA, 22 bp, Artificial Sequence
  Synthetic oligonucleotide; CTG chr11 5190582 5190603 5190587 5190582 -
tgagggggttccaacctcatat

SEQ ID NO: 149540 - DNA, 22 bp, Artificial Sequence
  Synthetic oligonucleotide; TTC chr11 5190571 5190592 5190576 5190571 -
caacctcatatttttcctccac

SEQ ID NO: 149541 - DNA, 22 bp, Artificial Sequence
  Synthetic oligonucleotide; CTC chr11 5190564 5190585 5190569 5190564 -
atatttttcctccacattgccc

SEQ ID NO: 149542 - DNA, 22 bp, Artificial Sequence
  Synthetic oligonucleotide; TTT chr11 5190558 5190579 5190563 5190558 -
ttcctccacattgccctattag

SEQ ID NO: 149543 - DNA, 22 bp, Artificial Sequence
  Synthetic oligonucleotide; TTT chr11 5190557 5190578 5190562 5190557 -
tcctccacattgccctattaga

SEQ ID NO: 149544 - DNA, 22 bp, Artificial Sequence
  Synthetic oligonucleotide; TTT chr11 5190556 5190577 5190561 5190556 -
cctccacattgccctattagag

SEQ ID NO: 149545 - DNA, 22 bp, Artificial Sequence
  Synthetic oligonucleotide; TTC chr11 5190555 5190576 5190560 5190555 -
ctccacattgccctattagagg

SEQ ID NO: 149546 - DNA, 22 bp, Artificial Sequence
  Synthetic oligonucleotide; CTC chr11 5190552 5190573 5190557 5190552 -
cacattgccctattagaggttc

SEQ ID NO: 149547 - DNA, 22 bp, Artificial Sequence
  Synthetic oligonucleotide; TTG chr11 5190545 5190566 5190550 5190545 -
ccctattagaggttcttcatga

SEQ ID NO: 149548 - DNA, 22 bp, Artificial Sequence
  Synthetic oligonucleotide; CTA chr11 5190540 5190561 5190545 5190540 -
ttagaggttcttcatgagggtt

SEQ ID NO: 149549 - DNA, 22 bp, Artificial Sequence
  Synthetic oligonucleotide; TTA chr11 5190537 5190558 5190542 5190537 -
gaggttcttcatgagggttctg

SEQ ID NO: 149550 - DNA, 22 bp, Artificial Sequence
  Synthetic oligonucleotide; TTC chr11 5190530 5190551 5190535 5190530 -
ttcatgagggttctgcccctgc

SEQ ID NO: 149551 - DNA, 22 bp, Artificial Sequence
  Synthetic oligonucleotide; CTT chr11 5190528 5190549 5190533 5190528 -
catgagggttctgcccctgcag

SEQ ID NO: 149552 - DNA, 22 bp, Artificial Sequence
  Synthetic oligonucleotide; TTC chr11 5190527 5190548 5190532 5190527 -
atgagggttctgcccctgcagg

SEQ ID NO: 149553 - DNA, 22 bp, Artificial Sequence
  Synthetic oligonucleotide; TTC chr11 5190517 5190538 5190522 5190517 -
tgcccctgcaggaggcttctgc

SEQ ID NO: 149554 - DNA, 22 bp, Artificial Sequence
  Synthetic oligonucleotide; CTG chr11 5190515 5190536 5190520 5190515 -
cccctgcaggaggcttctgcct

SEQ ID NO: 149555 - DNA, 22 bp, Artificial Sequence
  Synthetic oligonucleotide; CTG chr11 5190509 5190530 5190514 5190509 -
caggaggcttctgcctgaacac

SEQ ID NO: 149556 - DNA, 22 bp, Artificial Sequence
  Synthetic oligonucleotide; CTT chr11 5190499 5190520 5190504 5190499 -
ctgcctgaacactcaggctttt

SEQ ID NO: 149557 - DNA, 22 bp, Artificial Sequence
  Synthetic oligonucleotide; TTC chr11 5190498 5190519 5190503 5190498 -
tgcctgaacactcaggcttttc

SEQ ID NO: 149558 - DNA, 22 bp, Artificial Sequence
  Synthetic oligonucleotide; CTG chr11 5190496 5190517 5190501 5190496 -
cctgaacactcaggcttttcta

SEQ ID NO: 149559 - DNA, 22 bp, Artificial Sequence
  Synthetic oligonucleotide; CTG chr11 5190492 5190513 5190497 5190492 -
aacactcaggcttttctacaca

SEQ ID NO: 149560 - DNA, 22 bp, Artificial Sequence
  Synthetic oligonucleotide; CTC chr11 5190485 5190506 5190490 5190485 -
aggcttttctacacatcctctg

SEQ ID NO: 149561 - DNA, 22 bp, Artificial Sequence
  Synthetic oligonucleotide; CTT chr11 5190479 5190500 5190484 5190479 -
ttctacacatcctctgaaatct

SEQ ID NO: 149562 - DNA, 22 bp, Artificial Sequence
  Synthetic oligonucleotide; TTT chr11 5190478 5190499 5190483 5190478 -
tctacacatcctctgaaatcta

SEQ ID NO: 149563 - DNA, 22 bp, Artificial Sequence
  Synthetic oligonucleotide; TTT chr11 5190477 5190498 5190482 5190477 -
ctacacatcctctgaaatctag

SEQ ID NO: 149564 - DNA, 22 bp, Artificial Sequence
  Synthetic oligonucleotide; TTC chr11 5190476 5190497 5190481 5190476 -
tacacatcctctgaaatctagg

SEQ ID NO: 149565 - DNA, 22 bp, Artificial Sequence
  Synthetic oligonucleotide; CTA chr11 5190474 5190495 5190479 5190474 -
cacatcctctgaaatctaggtg

SEQ ID NO: 149566 - DNA, 22 bp, Artificial Sequence
  Synthetic oligonucleotide; CTC chr11 5190465 5190486 5190470 5190465 -
tgaaatctaggtggaggcttac

SEQ ID NO: 149567 - DNA, 22 bp, Artificial Sequence
  Synthetic oligonucleotide; CTG chr11 5190463 5190484 5190468 5190463 -
aaatctaggtggaggcttacaa

SEQ ID NO: 149568 - DNA, 22 bp, Artificial Sequence
  Synthetic oligonucleotide; CTA chr11 5190456 5190477 5190461 5190456 -
ggtggaggcttacaagcctcaa

SEQ ID NO: 149569 - DNA, 22 bp, Artificial Sequence
  Synthetic oligonucleotide; CTT chr11 5190445 5190466 5190450 5190445 -
acaagcctcaactttttgacct

SEQ ID NO: 149570 - DNA, 22 bp, Artificial Sequence
  Synthetic oligonucleotide; TTA chr11 5190444 5190465 5190449 5190444 -
caagcctcaactttttgacctt

SEQ ID NO: 149571 - DNA, 22 bp, Artificial Sequence
  Synthetic oligonucleotide; CTC chr11 5190436 5190457 5190441 5190436 -
aactttttgacctttgcacact

SEQ ID NO: 149572 - DNA, 22 bp, Artificial Sequence
  Synthetic oligonucleotide; CTT chr11 5190431 5190452 5190436 5190431 -
tttgacctttgcacactcccag

SEQ ID NO: 149573 - DNA, 22 bp, Artificial Sequence
  Synthetic oligonucleotide; TTT chr11 5190430 5190451 5190435 5190430 -
ttgacctttgcacactcccaga

SEQ ID NO: 149574 - DNA, 22 bp, Artificial Sequence
  Synthetic oligonucleotide; TTT chr11 5190429 5190450 5190434 5190429 -
tgacctttgcacactcccagat

SEQ ID NO: 149575 - DNA, 22 bp, Artificial Sequence
  Synthetic oligonucleotide; TTT chr11 5190428 5190449 5190433 5190428 -
gacctttgcacactcccagatt

SEQ ID NO: 149576 - DNA, 22 bp, Artificial Sequence
  Synthetic oligonucleotide; TTG chr11 5190427 5190448 5190432 5190427 -
acctttgcacactcccagattt

SEQ ID NO: 149577 - DNA, 22 bp, Artificial Sequence
  Synthetic oligonucleotide; CTT chr11 5190422 5190443 5190427 5190422 -
tgcacactcccagatttatcac

SEQ ID NO: 149578 - DNA, 22 bp, Artificial Sequence
  Synthetic oligonucleotide; TTT chr11 5190421 5190442 5190426 5190421 -
gcacactcccagatttatcacc

SEQ ID NO: 149579 - DNA, 22 bp, Artificial Sequence
  Synthetic oligonucleotide; TTG chr11 5190420 5190441 5190425 5190420 -
cacactcccagatttatcacca

SEQ ID NO: 149580 - DNA, 22 bp, Artificial Sequence
  Synthetic oligonucleotide; CTC chr11 5190413 5190434 5190418 5190413 -
ccagatttatcaccatgtggaa

SEQ ID NO: 149581 - DNA, 22 bp, Artificial Sequence
  Synthetic oligonucleotide; TTT chr11 5190405 5190426 5190410 5190405 -
atcaccatgtggaagcctccaa

SEQ ID NO: 149582 - DNA, 22 bp, Artificial Sequence
  Synthetic oligonucleotide; TTA chr11 5190404 5190425 5190409 5190404 -
tcaccatgtggaagcctccaag

SEQ ID NO: 149583 - DNA, 22 bp, Artificial Sequence
  Synthetic oligonucleotide; CTC chr11 5190386 5190407 5190391 5190386 -
caaggcttatgtcttgcaccct

SEQ ID NO: 149584 - DNA, 22 bp, Artificial Sequence
  Synthetic oligonucleotide; CTT chr11 5190378 5190399 5190383 5190378 -
atgtcttgcaccctctgaagca

SEQ ID NO: 149585 - DNA, 22 bp, Artificial Sequence
  Synthetic oligonucleotide; TTA chr11 5190377 5190398 5190382 5190377 -
tgtcttgcaccctctgaagcag

SEQ ID NO: 149586 - DNA, 22 bp, Artificial Sequence
  Synthetic oligonucleotide; CTT chr11 5190371 5190392 5190376 5190371 -
gcaccctctgaagcagtggcct

SEQ ID NO: 149587 - DNA, 22 bp, Artificial Sequence
  Synthetic oligonucleotide; TTG chr11 5190370 5190391 5190375 5190370 -
caccctctgaagcagtggcctt

SEQ ID NO: 149588 - DNA, 22 bp, Artificial Sequence
  Synthetic oligonucleotide; CTC chr11 5190363 5190384 5190368 5190363 -
tgaagcagtggccttagctgtt

SEQ ID NO: 149589 - DNA, 22 bp, Artificial Sequence
  Synthetic oligonucleotide; CTG chr11 5190361 5190382 5190366 5190361 -
aagcagtggccttagctgttct

SEQ ID NO: 149590 - DNA, 22 bp, Artificial Sequence
  Synthetic oligonucleotide; CTT chr11 5190348 5190369 5190353 5190348 -
agctgttcttgggcccctttga

SEQ ID NO: 149591 - DNA, 22 bp, Artificial Sequence
  Synthetic oligonucleotide; TTA chr11 5190347 5190368 5190352 5190347 -
gctgttcttgggcccctttgag

SEQ ID NO: 149592 - DNA, 22 bp, Artificial Sequence
  Synthetic oligonucleotide; CTG chr11 5190343 5190364 5190348 5190343 -
ttcttgggcccctttgagccac

SEQ ID NO: 149593 - DNA, 22 bp, Artificial Sequence
  Synthetic oligonucleotide; TTC chr11 5190340 5190361 5190345 5190340 -
ttgggcccctttgagccacagc

SEQ ID NO: 149594 - DNA, 22 bp, Artificial Sequence
  Synthetic oligonucleotide; CTT chr11 5190338 5190359 5190343 5190338 -
gggcccctttgagccacagctg

SEQ ID NO: 149595 - DNA, 22 bp, Artificial Sequence
  Synthetic oligonucleotide; TTG chr11 5190337 5190358 5190342 5190337 -
ggcccctttgagccacagctgg

SEQ ID NO: 149596 - DNA, 22 bp, Artificial Sequence
  Synthetic oligonucleotide; CTT chr11 5190329 5190350 5190334 5190329 -
tgagccacagctggtgctggag

SEQ ID NO: 149597 - DNA, 22 bp, Artificial Sequence
  Synthetic oligonucleotide; TTT chr11 5190328 5190349 5190333 5190328 -
gagccacagctggtgctggagc

SEQ ID NO: 149598 - DNA, 22 bp, Artificial Sequence
  Synthetic oligonucleotide; TTG chr11 5190327 5190348 5190332 5190327 -
agccacagctggtgctggagca

SEQ ID NO: 149599 - DNA, 22 bp, Artificial Sequence
  Synthetic oligonucleotide; CTG chr11 5190316 5190337 5190321 5190316 -
gtgctggagcagccaggatgca

SEQ ID NO: 149600 - DNA, 22 bp, Artificial Sequence
  Synthetic oligonucleotide; CTG chr11 5190310 5190331 5190315 5190310 -
gagcagccaggatgcaaggaac

SEQ ID NO: 149601 - DNA, 22 bp, Artificial Sequence
  Synthetic oligonucleotide; CTG chr11 5190279 5190300 5190284 5190279 -
aagctgctcaaggcagcagggt

SEQ ID NO: 149602 - DNA, 22 bp, Artificial Sequence
  Synthetic oligonucleotide; CTG chr11 5190273 5190294 5190278 5190273 -
ctcaaggcagcagggtcctgaa

SEQ ID NO: 149603 - DNA, 22 bp, Artificial Sequence
  Synthetic oligonucleotide; CTC chr11 5190270 5190291 5190275 5190270 -
aaggcagcagggtcctgaatct

SEQ ID NO: 149604 - DNA, 22 bp, Artificial Sequence
  Synthetic oligonucleotide; CTG chr11 5190253 5190274 5190258 5190253 -
aatctcacccacaaaatcattc

SEQ ID NO: 149605 - DNA, 22 bp, Artificial Sequence
  Synthetic oligonucleotide; CTC chr11 5190247 5190268 5190252 5190247 -
acccacaaaatcattcagtact

SEQ ID NO: 149606 - DNA, 22 bp, Artificial Sequence
  Synthetic oligonucleotide; TTC chr11 5190231 5190252 5190236 5190231 -
agtactcctaggccaccaggcc

SEQ ID NO: 149607 - DNA, 22 bp, Artificial Sequence
  Synthetic oligonucleotide; CTC chr11 5190224 5190245 5190229 5190224 -
ctaggccaccaggcctgtgatg

SEQ ID NO: 149608 - DNA, 22 bp, Artificial Sequence
  Synthetic oligonucleotide; CTA chr11 5190221 5190242 5190226 5190221 -
ggccaccaggcctgtgatgtga

SEQ ID NO: 149609 - DNA, 22 bp, Artificial Sequence
  Synthetic oligonucleotide; CTG chr11 5190207 5190228 5190212 5190207 -
tgatgtgaggggctgctacaag

SEQ ID NO: 149610 - DNA, 22 bp, Artificial Sequence
  Synthetic oligonucleotide; CTG chr11 5190192 5190213 5190197 5190192 -
ctacaagggtctctgaaatgtc

SEQ ID NO: 149611 - DNA, 22 bp, Artificial Sequence
  Synthetic oligonucleotide; CTA chr11 5190189 5190210 5190194 5190189 -
caagggtctctgaaatgtcttt

SEQ ID NO: 149612 - DNA, 22 bp, Artificial Sequence
  Synthetic oligonucleotide; CTC chr11 5190179 5190200 5190184 5190179 -
tgaaatgtctttgaggcattct

SEQ ID NO: 149613 - DNA, 22 bp, Artificial Sequence
  Synthetic oligonucleotide; CTG chr11 5190177 5190198 5190182 5190177 -
aaatgtctttgaggcattctcc

SEQ ID NO: 149614 - DNA, 22 bp, Artificial Sequence
  Synthetic oligonucleotide; CTT chr11 5190168 5190189 5190173 5190168 -
tgaggcattctcccctttattt

SEQ ID NO: 149615 - DNA, 22 bp, Artificial Sequence
  Synthetic oligonucleotide; TTT chr11 5190167 5190188 5190172 5190167 -
gaggcattctcccctttatttt

SEQ ID NO: 149616 - DNA, 22 bp, Artificial Sequence
  Synthetic oligonucleotide; TTG chr11 5190166 5190187 5190171 5190166 -
aggcattctcccctttattttg

SEQ ID NO: 149617 - DNA, 22 bp, Artificial Sequence
  Synthetic oligonucleotide; TTC chr11 5190158 5190179 5190163 5190158 -
tcccctttattttggctattag

SEQ ID NO: 149618 - DNA, 22 bp, Artificial Sequence
  Synthetic oligonucleotide; CTC chr11 5190156 5190177 5190161 5190156 -
ccctttattttggctattagaa

SEQ ID NO: 149619 - DNA, 22 bp, Artificial Sequence
  Synthetic oligonucleotide; CTT chr11 5190151 5190172 5190156 5190151 -
tattttggctattagaactcgg

SEQ ID NO: 149620 - DNA, 22 bp, Artificial Sequence
  Synthetic oligonucleotide; TTT chr11 5190150 5190171 5190155 5190150 -
attttggctattagaactcggc

SEQ ID NO: 149621 - DNA, 22 bp, Artificial Sequence
  Synthetic oligonucleotide; TTA chr11 5190149 5190170 5190154 5190149 -
ttttggctattagaactcggct

SEQ ID NO: 149622 - DNA, 22 bp, Artificial Sequence
  Synthetic oligonucleotide; TTT chr11 5190146 5190167 5190151 5190146 -
tggctattagaactcggctcct

SEQ ID NO: 149623 - DNA, 22 bp, Artificial Sequence
  Synthetic oligonucleotide; TTT chr11 5190145 5190166 5190150 5190145 -
ggctattagaactcggctcctc

SEQ ID NO: 149624 - DNA, 22 bp, Artificial Sequence
  Synthetic oligonucleotide; TTG chr11 5190144 5190165 5190149 5190144 -
gctattagaactcggctcctct

SEQ ID NO: 149625 - DNA, 22 bp, Artificial Sequence
  Synthetic oligonucleotide; CTA chr11 5190140 5190161 5190145 5190140 -
ttagaactcggctcctcttcat

SEQ ID NO: 149626 - DNA, 22 bp, Artificial Sequence
  Synthetic oligonucleotide; TTA chr11 5190137 5190158 5190142 5190137 -
gaactcggctcctcttcattta

SEQ ID NO: 149627 - DNA, 22 bp, Artificial Sequence
  Synthetic oligonucleotide; CTC chr11 5190131 5190152 5190136 5190131 -
ggctcctcttcatttatgcaaa

SEQ ID NO: 149628 - DNA, 22 bp, Artificial Sequence
  Synthetic oligonucleotide; CTC chr11 5190126 5190147 5190131 5190126 -
ctcttcatttatgcaaatttct

SEQ ID NO: 149629 - DNA, 22 bp, Artificial Sequence
  Synthetic oligonucleotide; CTC chr11 5190123 5190144 5190128 5190123 -
ttcatttatgcaaatttctaca

SEQ ID NO: 149630 - DNA, 22 bp, Artificial Sequence
  Synthetic oligonucleotide; CTT chr11 5190121 5190142 5190126 5190121 -
catttatgcaaatttctacagc

SEQ ID NO: 149631 - DNA, 22 bp, Artificial Sequence
  Synthetic oligonucleotide; TTC chr11 5190120 5190141 5190125 5190120 -
atttatgcaaatttctacagcc

SEQ ID NO: 149632 - DNA, 22 bp, Artificial Sequence
  Synthetic oligonucleotide; TTT chr11 5190116 5190137 5190121 5190116 -
atgcaaatttctacagcctgct

SEQ ID NO: 149633 - DNA, 22 bp, Artificial Sequence
  Synthetic oligonucleotide; TTA chr11 5190115 5190136 5190120 5190115 -
tgcaaatttctacagcctgctt

SEQ ID NO: 149634 - DNA, 22 bp, Artificial Sequence
  Synthetic oligonucleotide; TTT chr11 5190106 5190127 5190111 5190106 -
ctacagcctgcttgaattgctc

SEQ ID NO: 149635 - DNA, 22 bp, Artificial Sequence
  Synthetic oligonucleotide; TTC chr11 5190105 5190126 5190110 5190105 -
tacagcctgcttgaattgctcc

SEQ ID NO: 149636 - DNA, 22 bp, Artificial Sequence
  Synthetic oligonucleotide; CTA chr11 5190103 5190124 5190108 5190103 -
cagcctgcttgaattgctcctt

SEQ ID NO: 149637 - DNA, 22 bp, Artificial Sequence
  Synthetic oligonucleotide; CTG chr11 5190096 5190117 5190101 5190096 -
cttgaattgctcctttgaaaat

SEQ ID NO: 149638 - DNA, 22 bp, Artificial Sequence
  Synthetic oligonucleotide; CTT chr11 5190093 5190114 5190098 5190093 -
gaattgctcctttgaaaatgag

SEQ ID NO: 149639 - DNA, 22 bp, Artificial Sequence
  Synthetic oligonucleotide; TTG chr11 5190092 5190113 5190097 5190092 -
aattgctcctttgaaaatgagc

SEQ ID NO: 149640 - DNA, 22 bp, Artificial Sequence
  Synthetic oligonucleotide; TTG chr11 5190087 5190108 5190092 5190087 -
ctcctttgaaaatgagcttctg

SEQ ID NO: 149641 - DNA, 22 bp, Artificial Sequence
  Synthetic oligonucleotide; CTC chr11 5190084 5190105 5190089 5190084 -
ctttgaaaatgagcttctgttt

SEQ ID NO: 149642 - DNA, 22 bp, Artificial Sequence
  Synthetic oligonucleotide; CTT chr11 5190081 5190102 5190086 5190081 -
tgaaaatgagcttctgttttct

SEQ ID NO: 149643 - DNA, 22 bp, Artificial Sequence
  Synthetic oligonucleotide; TTT chr11 5190080 5190101 5190085 5190080 -
gaaaatgagcttctgttttcta

SEQ ID NO: 149644 - DNA, 22 bp, Artificial Sequence
  Synthetic oligonucleotide; TTG chr11 5190079 5190100 5190084 5190079 -
aaaatgagcttctgttttctac

SEQ ID NO: 149645 - DNA, 22 bp, Artificial Sequence
  Synthetic oligonucleotide; CTT chr11 5190068 5190089 5190073 5190068 -
ctgttttctaccacatggccga

SEQ ID NO: 149646 - DNA, 22 bp, Artificial Sequence
  Synthetic oligonucleotide; TTC chr11 5190067 5190088 5190072 5190067 -
tgttttctaccacatggccgag

SEQ ID NO: 149647 - DNA, 22 bp, Artificial Sequence
  Synthetic oligonucleotide; CTG chr11 5190065 5190086 5190070 5190065 -
ttttctaccacatggccgagca

SEQ ID NO: 149648 - DNA, 22 bp, Artificial Sequence
  Synthetic oligonucleotide; TTT chr11 5190062 5190083 5190067 5190062 -
tctaccacatggccgagcagat

SEQ ID NO: 149649 - DNA, 22 bp, Artificial Sequence
  Synthetic oligonucleotide; TTT chr11 5190061 5190082 5190066 5190061 -
ctaccacatggccgagcagata

SEQ ID NO: 149650 - DNA, 22 bp, Artificial Sequence
  Synthetic oligonucleotide; TTC chr11 5190060 5190081 5190065 5190060 -
taccacatggccgagcagataa

SEQ ID NO: 149651 - DNA, 22 bp, Artificial Sequence
  Synthetic oligonucleotide; CTA chr11 5190058 5190079 5190063 5190058 -
ccacatggccgagcagataatt

SEQ ID NO: 149652 - DNA, 22 bp, Artificial Sequence
  Synthetic oligonucleotide; TTT chr11 5190035 5190056 5190040 5190035 -
tccaaacttttatgctctgctt

SEQ ID NO: 149653 - DNA, 22 bp, Artificial Sequence
  Synthetic oligonucleotide; TTT chr11 5190034 5190055 5190039 5190034 -
ccaaacttttatgctctgcttc

SEQ ID NO: 149654 - DNA, 22 bp, Artificial Sequence
  Synthetic oligonucleotide; TTC chr11 5190033 5190054 5190038 5190033 -
caaacttttatgctctgcttcc

SEQ ID NO: 149655 - DNA, 22 bp, Artificial Sequence
  Synthetic oligonucleotide; CTT chr11 5190026 5190047 5190031 5190026 -
ttatgctctgcttcccttttaa

SEQ ID NO: 149656 - DNA, 22 bp, Artificial Sequence
  Synthetic oligonucleotide; TTT chr11 5190025 5190046 5190030 5190025 -
tatgctctgcttcccttttaaa

SEQ ID NO: 149657 - DNA, 22 bp, Artificial Sequence
  Synthetic oligonucleotide; TTT chr11 5190024 5190045 5190029 5190024 -
atgctctgcttcccttttaaat

SEQ ID NO: 149658 - DNA, 22 bp, Artificial Sequence
  Synthetic oligonucleotide; TTA chr11 5190023 5190044 5190028 5190023 -
tgctctgcttcccttttaaata

SEQ ID NO: 149659 - DNA, 22 bp, Artificial Sequence
  Synthetic oligonucleotide; CTC chr11 5190018 5190039 5190023 5190018 -
tgcttcccttttaaatataagt

SEQ ID NO: 149660 - DNA, 22 bp, Artificial Sequence
  Synthetic oligonucleotide; CTG chr11 5190016 5190037 5190021 5190016 -
cttcccttttaaatataagttc

SEQ ID NO: 149661 - DNA, 22 bp, Artificial Sequence
  Synthetic oligonucleotide; CTT chr11 5190013 5190034 5190018 5190013 -
cccttttaaatataagttctga

SEQ ID NO: 149662 - DNA, 22 bp, Artificial Sequence
  Synthetic oligonucleotide; TTC chr11 5190012 5190033 5190017 5190012 -
ccttttaaatataagttctgat

SEQ ID NO: 149663 - DNA, 22 bp, Artificial Sequence
  Synthetic oligonucleotide; CTT chr11 5190008 5190029 5190013 5190008 -
ttaaatataagttctgatttta

SEQ ID NO: 149664 - DNA, 22 bp, Artificial Sequence
  Synthetic oligonucleotide; TTT chr11 5190007 5190028 5190012 5190007 -
taaatataagttctgattttat

SEQ ID NO: 149665 - DNA, 22 bp, Artificial Sequence
  Synthetic oligonucleotide; TTT chr11 5190006 5190027 5190011 5190006 -
aaatataagttctgattttatg

SEQ ID NO: 149666 - DNA, 22 bp, Artificial Sequence
  Synthetic oligonucleotide; TTA chr11 5190005 5190026 5190010 5190005 -
aatataagttctgattttatgt

SEQ ID NO: 149667 - DNA, 22 bp, Artificial Sequence
  Synthetic oligonucleotide; TTC chr11 5189994 5190015 5189999 5189994 -
tgattttatgttatttctttgc

SEQ ID NO: 149668 - DNA, 22 bp, Artificial Sequence
  Synthetic oligonucleotide; CTG chr11 5189992 5190013 5189997 5189992 -
attttatgttatttctttgctc

SEQ ID NO: 149669 - DNA, 22 bp, Artificial Sequence
  Synthetic oligonucleotide; TTT chr11 5189988 5190009 5189993 5189988 -
tatgttatttctttgctcacac

SEQ ID NO: 149670 - DNA, 22 bp, Artificial Sequence
  Synthetic oligonucleotide; TTT chr11 5189987 5190008 5189992 5189987 -
atgttatttctttgctcacaca

SEQ ID NO: 149671 - DNA, 22 bp, Artificial Sequence
  Synthetic oligonucleotide; TTA chr11 5189986 5190007 5189991 5189986 -
tgttatttctttgctcacacat

SEQ ID NO: 149672 - DNA, 22 bp, Artificial Sequence
  Synthetic oligonucleotide; TTA chr11 5189981 5190002 5189986 5189981 -
tttctttgctcacacatatgag

SEQ ID NO: 149673 - DNA, 22 bp, Artificial Sequence
  Synthetic oligonucleotide; TTT chr11 5189978 5189999 5189983 5189978 -
ctttgctcacacatatgagcat

SEQ ID NO: 149674 - DNA, 22 bp, Artificial Sequence
  Synthetic oligonucleotide; TTC chr11 5189977 5189998 5189982 5189977 -
tttgctcacacatatgagcata

SEQ ID NO: 149675 - DNA, 22 bp, Artificial Sequence
  Synthetic oligonucleotide; CTT chr11 5189975 5189996 5189980 5189975 -
tgctcacacatatgagcatagg

SEQ ID NO: 149676 - DNA, 22 bp, Artificial Sequence
  Synthetic oligonucleotide; TTT chr11 5189974 5189995 5189979 5189974 -
gctcacacatatgagcataggt

SEQ ID NO: 149677 - DNA, 22 bp, Artificial Sequence
  Synthetic oligonucleotide; TTG chr11 5189973 5189994 5189978 5189973 -
ctcacacatatgagcataggtt

SEQ ID NO: 149678 - DNA, 22 bp, Artificial Sequence
  Synthetic oligonucleotide; CTC chr11 5189970 5189991 5189975 5189970 -
acacatatgagcataggttgtt

SEQ ID NO: 149679 - DNA, 22 bp, Artificial Sequence
  Synthetic oligonucleotide; TTG chr11 5189950 5189971 5189955 5189950 -
ttagaagcagccaggacacatc

SEQ ID NO: 149680 - DNA, 22 bp, Artificial Sequence
  Synthetic oligonucleotide; TTA chr11 5189947 5189968 5189952 5189947 -
gaagcagccaggacacatcttg

SEQ ID NO: 149681 - DNA, 22 bp, Artificial Sequence
  Synthetic oligonucleotide; CTT chr11 5189926 5189947 5189931 5189926 -
gaacaccttgctgcttagaaac

SEQ ID NO: 149682 - DNA, 22 bp, Artificial Sequence
  Synthetic oligonucleotide; TTG chr11 5189925 5189946 5189930 5189925 -
aacaccttgctgcttagaaact

SEQ ID NO: 149683 - DNA, 22 bp, Artificial Sequence
  Synthetic oligonucleotide; CTT chr11 5189917 5189938 5189922 5189917 -
gctgcttagaaacttctgtcac

SEQ ID NO: 149684 - DNA, 22 bp, Artificial Sequence
  Synthetic oligonucleotide; TTG chr11 5189916 5189937 5189921 5189916 -
ctgcttagaaacttctgtcaca

SEQ ID NO: 149685 - DNA, 22 bp, Artificial Sequence
  Synthetic oligonucleotide; CTG chr11 5189913 5189934 5189918 5189913 -
cttagaaacttctgtcacataa

SEQ ID NO: 149686 - DNA, 22 bp, Artificial Sequence
  Synthetic oligonucleotide; CTT chr11 5189910 5189931 5189915 5189910 -
agaaacttctgtcacataactt

SEQ ID NO: 149687 - DNA, 22 bp, Artificial Sequence
  Synthetic oligonucleotide; TTA chr11 5189909 5189930 5189914 5189909 -
gaaacttctgtcacataactta

SEQ ID NO: 149688 - DNA, 22 bp, Artificial Sequence
  Synthetic oligonucleotide; CTT chr11 5189902 5189923 5189907 5189902 -
ctgtcacataacttaaataata

SEQ ID NO: 149689 - DNA, 22 bp, Artificial Sequence
  Synthetic oligonucleotide; TTC chr11 5189901 5189922 5189906 5189901 -
tgtcacataacttaaataatat

SEQ ID NO: 149690 - DNA, 22 bp, Artificial Sequence
  Synthetic oligonucleotide; CTG chr11 5189899 5189920 5189904 5189899 -
tcacataacttaaataatatta

SEQ ID NO: 149691 - DNA, 22 bp, Artificial Sequence
  Synthetic oligonucleotide; CTT chr11 5189888 5189909 5189893 5189888 -
aaataatattatcaacttcgaa

SEQ ID NO: 149692 - DNA, 22 bp, Artificial Sequence
  Synthetic oligonucleotide; TTA chr11 5189887 5189908 5189892 5189887 -
aataatattatcaacttcgaat

SEQ ID NO: 149693 - DNA, 22 bp, Artificial Sequence
  Synthetic oligonucleotide; TTA chr11 5189877 5189898 5189882 5189877 -
tcaacttcgaatttccacagat

SEQ ID NO: 149694 - DNA, 22 bp, Artificial Sequence
  Synthetic oligonucleotide; CTT chr11 5189870 5189891 5189875 5189870 -
cgaatttccacagattctctaa

SEQ ID NO: 149695 - DNA, 22 bp, Artificial Sequence
  Synthetic oligonucleotide; TTC chr11 5189869 5189890 5189874 5189869 -
gaatttccacagattctctaag

SEQ ID NO: 149696 - DNA, 22 bp, Artificial Sequence
  Synthetic oligonucleotide; TTT chr11 5189863 5189884 5189868 5189863 -
ccacagattctctaaggtagag

SEQ ID NO: 149697 - DNA, 22 bp, Artificial Sequence
  Synthetic oligonucleotide; TTC chr11 5189862 5189883 5189867 5189862 -
cacagattctctaaggtagagg

SEQ ID NO: 149698 - DNA, 22 bp, Artificial Sequence
  Synthetic oligonucleotide; TTC chr11 5189853 5189874 5189858 5189853 -
tctaaggtagaggcacagtgca

SEQ ID NO: 149699 - DNA, 22 bp, Artificial Sequence
  Synthetic oligonucleotide; CTC chr11 5189851 5189872 5189856 5189851 -
taaggtagaggcacagtgcagt

SEQ ID NO: 149700 - DNA, 22 bp, Artificial Sequence
  Synthetic oligonucleotide; CTA chr11 5189849 5189870 5189854 5189849 -
aggtagaggcacagtgcagtca

SEQ ID NO: 149701 - DNA, 22 bp, Artificial Sequence
  Synthetic oligonucleotide; CTC chr11 5189822 5189843 5189827 5189822 -
tttgctaatgtataacaaaagt

SEQ ID NO: 149702 - DNA, 22 bp, Artificial Sequence
  Synthetic oligonucleotide; CTT chr11 5189820 5189841 5189825 5189820 -
tgctaatgtataacaaaagtga

SEQ ID NO: 149703 - DNA, 22 bp, Artificial Sequence
  Synthetic oligonucleotide; TTT chr11 5189819 5189840 5189824 5189819 -
gctaatgtataacaaaagtgac

SEQ ID NO: 149704 - DNA, 22 bp, Artificial Sequence
  Synthetic oligonucleotide; TTG chr11 5189818 5189839 5189823 5189818 -
ctaatgtataacaaaagtgacc

SEQ ID NO: 149705 - DNA, 22 bp, Artificial Sequence
  Synthetic oligonucleotide; CTA chr11 5189815 5189836 5189820 5189815 -
atgtataacaaaagtgaccttt

SEQ ID NO: 149706 - DNA, 22 bp, Artificial Sequence
  Synthetic oligonucleotide; CTT chr11 5189794 5189815 5189799 5189794 -
tgctccagtttccaataaattc

SEQ ID NO: 149707 - DNA, 22 bp, Artificial Sequence
  Synthetic oligonucleotide; TTT chr11 5189793 5189814 5189798 5189793 -
gctccagtttccaataaattca

SEQ ID NO: 149708 - DNA, 22 bp, Artificial Sequence
  Synthetic oligonucleotide; TTG chr11 5189792 5189813 5189797 5189792 -
ctccagtttccaataaattcat

SEQ ID NO: 149709 - DNA, 22 bp, Artificial Sequence
  Synthetic oligonucleotide; CTC chr11 5189789 5189810 5189794 5189789 -
cagtttccaataaattcatttc

SEQ ID NO: 149710 - DNA, 22 bp, Artificial Sequence
  Synthetic oligonucleotide; TTT chr11 5189783 5189804 5189788 5189783 -
ccaataaattcatttccatctg

SEQ ID NO: 149711 - DNA, 22 bp, Artificial Sequence
  Synthetic oligonucleotide; TTC chr11 5189782 5189803 5189787 5189782 -
caataaattcatttccatctga

SEQ ID NO: 149712 - DNA, 22 bp, Artificial Sequence
  Synthetic oligonucleotide; TTC chr11 5189772 5189793 5189777 5189772 -
atttccatctgagaccacctca

SEQ ID NO: 149713 - DNA, 22 bp, Artificial Sequence
  Synthetic oligonucleotide; TTT chr11 5189768 5189789 5189773 5189768 -
ccatctgagaccacctcagcct

SEQ ID NO: 149714 - DNA, 22 bp, Artificial Sequence
  Synthetic oligonucleotide; TTC chr11 5189767 5189788 5189772 5189767 -
catctgagaccacctcagcctg

SEQ ID NO: 149715 - DNA, 22 bp, Artificial Sequence
  Synthetic oligonucleotide; CTG chr11 5189761 5189782 5189766 5189761 -
agaccacctcagcctggacttc

SEQ ID NO: 149716 - DNA, 22 bp, Artificial Sequence
  Synthetic oligonucleotide; CTC chr11 5189751 5189772 5189756 5189751 -
agcctggacttcattgtccata

SEQ ID NO: 149717 - DNA, 22 bp, Artificial Sequence
  Synthetic oligonucleotide; CTG chr11 5189745 5189766 5189750 5189745 -
gacttcattgtccatatcacta

SEQ ID NO: 149718 - DNA, 22 bp, Artificial Sequence
  Synthetic oligonucleotide; CTT chr11 5189740 5189761 5189745 5189740 -
cattgtccatatcactatcaga

SEQ ID NO: 149719 - DNA, 22 bp, Artificial Sequence
  Synthetic oligonucleotide; TTC chr11 5189739 5189760 5189744 5189739 -
attgtccatatcactatcagaa

SEQ ID NO: 149720 - DNA, 22 bp, Artificial Sequence
  Synthetic oligonucleotide; TTG chr11 5189735 5189756 5189740 5189735 -
tccatatcactatcagaatttt

SEQ ID NO: 149721 - DNA, 22 bp, Artificial Sequence
  Synthetic oligonucleotide; CTA chr11 5189723 5189744 5189728 5189723 -
tcagaattttggtcacaaccat

SEQ ID NO: 149722 - DNA, 22 bp, Artificial Sequence
  Synthetic oligonucleotide; TTT chr11 5189714 5189735 5189719 5189714 -
tggtcacaaccattccacaagt

SEQ ID NO: 149723 - DNA, 22 bp, Artificial Sequence
  Synthetic oligonucleotide; TTT chr11 5189713 5189734 5189718 5189713 -
ggtcacaaccattccacaagtc

SEQ ID NO: 149724 - DNA, 22 bp, Artificial Sequence
  Synthetic oligonucleotide; TTG chr11 5189712 5189733 5189717 5189712 -
gtcacaaccattccacaagtct

SEQ ID NO: 149725 - DNA, 22 bp, Artificial Sequence
  Synthetic oligonucleotide; TTC chr11 5189699 5189720 5189704 5189699 -
cacaagtctctagaaagttcca

SEQ ID NO: 149726 - DNA, 22 bp, Artificial Sequence
  Synthetic oligonucleotide; CTC chr11 5189689 5189710 5189694 5189689 -
tagaaagttccaaattctccct

SEQ ID NO: 149727 - DNA, 22 bp, Artificial Sequence
  Synthetic oligonucleotide; CTA chr11 5189687 5189708 5189692 5189687 -
gaaagttccaaattctccctca

SEQ ID NO: 149728 - DNA, 22 bp, Artificial Sequence
  Synthetic oligonucleotide; TTC chr11 5189679 5189700 5189684 5189679 -
caaattctccctcatctccctg

SEQ ID NO: 149729 - DNA, 22 bp, Artificial Sequence
  Synthetic oligonucleotide; TTC chr11 5189672 5189693 5189677 5189672 -
tccctcatctccctgtcttctt

SEQ ID NO: 149730 - DNA, 22 bp, Artificial Sequence
  Synthetic oligonucleotide; CTC chr11 5189670 5189691 5189675 5189670 -
cctcatctccctgtcttcttct

SEQ ID NO: 149731 - DNA, 22 bp, Artificial Sequence
  Synthetic oligonucleotide; CTC chr11 5189666 5189687 5189671 5189666 -
atctccctgtcttcttctgagc

SEQ ID NO: 149732 - DNA, 22 bp, Artificial Sequence
  Synthetic oligonucleotide; CTC chr11 5189661 5189682 5189666 5189661 -
cctgtcttcttctgagccgtcc

SEQ ID NO: 149733 - DNA, 22 bp, Artificial Sequence
  Synthetic oligonucleotide; CTG chr11 5189657 5189678 5189662 5189657 -
tcttcttctgagccgtccacac

SEQ ID NO: 149734 - DNA, 22 bp, Artificial Sequence
  Synthetic oligonucleotide; CTT chr11 5189653 5189674 5189658 5189653 -
cttctgagccgtccacactctt

SEQ ID NO: 149735 - DNA, 22 bp, Artificial Sequence
  Synthetic oligonucleotide; TTC chr11 5189652 5189673 5189657 5189652 -
ttctgagccgtccacactcttc

SEQ ID NO: 149736 - DNA, 22 bp, Artificial Sequence
  Synthetic oligonucleotide; CTT chr11 5189650 5189671 5189655 5189650 -
ctgagccgtccacactcttcca

SEQ ID NO: 149737 - DNA, 22 bp, Artificial Sequence
  Synthetic oligonucleotide; TTC chr11 5189649 5189670 5189654 5189649 -
tgagccgtccacactcttccaa

SEQ ID NO: 149738 - DNA, 22 bp, Artificial Sequence
  Synthetic oligonucleotide; CTG chr11 5189647 5189668 5189652 5189647 -
agccgtccacactcttccaact

SEQ ID NO: 149739 - DNA, 22 bp, Artificial Sequence
  Synthetic oligonucleotide; CTC chr11 5189633 5189654 5189638 5189633 -
ttccaacttctgcctgttatcc

SEQ ID NO: 149740 - DNA, 22 bp, Artificial Sequence
  Synthetic oligonucleotide; CTT chr11 5189631 5189652 5189636 5189631 -
ccaacttctgcctgttatccaa

SEQ ID NO: 149741 - DNA, 22 bp, Artificial Sequence
  Synthetic oligonucleotide; TTC chr11 5189630 5189651 5189635 5189630 -
caacttctgcctgttatccaat

SEQ ID NO: 149742 - DNA, 22 bp, Artificial Sequence
  Synthetic oligonucleotide; CTT chr11 5189624 5189645 5189629 5189624 -
ctgcctgttatccaatgccaaa

SEQ ID NO: 149743 - DNA, 22 bp, Artificial Sequence
  Synthetic oligonucleotide; TTC chr11 5189623 5189644 5189628 5189623 -
tgcctgttatccaatgccaaag

SEQ ID NO: 149744 - DNA, 22 bp, Artificial Sequence
  Synthetic oligonucleotide; CTG chr11 5189621 5189642 5189626 5189621 -
cctgttatccaatgccaaagtt

SEQ ID NO: 149745 - DNA, 22 bp, Artificial Sequence
  Synthetic oligonucleotide; CTG chr11 5189617 5189638 5189622 5189617 -
ttatccaatgccaaagttgctt

SEQ ID NO: 149746 - DNA, 22 bp, Artificial Sequence
  Synthetic oligonucleotide; TTA chr11 5189614 5189635 5189619 5189614 -
tccaatgccaaagttgcttcca

SEQ ID NO: 149747 - DNA, 22 bp, Artificial Sequence
  Synthetic oligonucleotide; TTG chr11 5189598 5189619 5189603 5189598 -
cttccacattttcatgtatctt

SEQ ID NO: 149748 - DNA, 22 bp, Artificial Sequence
  Synthetic oligonucleotide; CTT chr11 5189595 5189616 5189600 5189595 -
ccacattttcatgtatctttat

SEQ ID NO: 149749 - DNA, 22 bp, Artificial Sequence
  Synthetic oligonucleotide; TTC chr11 5189594 5189615 5189599 5189594 -
cacattttcatgtatctttata

SEQ ID NO: 149750 - DNA, 22 bp, Artificial Sequence
  Synthetic oligonucleotide; TTT chr11 5189587 5189608 5189592 5189587 -
tcatgtatctttatagcagtac

SEQ ID NO: 149751 - DNA, 22 bp, Artificial Sequence
  Synthetic oligonucleotide; TTT chr11 5189586 5189607 5189591 5189586 -
catgtatctttatagcagtacc

SEQ ID NO: 149752 - DNA, 22 bp, Artificial Sequence
  Synthetic oligonucleotide; TTC chr11 5189585 5189606 5189590 5189585 -
atgtatctttatagcagtaccc

SEQ ID NO: 149753 - DNA, 22 bp, Artificial Sequence
  Synthetic oligonucleotide; CTT chr11 5189576 5189597 5189581 5189576 -
tatagcagtaccccacttttgg

SEQ ID NO: 149754 - DNA, 22 bp, Artificial Sequence
  Synthetic oligonucleotide; TTT chr11 5189575 5189596 5189580 5189575 -
atagcagtaccccacttttggt

SEQ ID NO: 149755 - DNA, 22 bp, Artificial Sequence
  Synthetic oligonucleotide; TTA chr11 5189574 5189595 5189579 5189574 -
tagcagtaccccacttttggta

SEQ ID NO: 149756 - DNA, 22 bp, Artificial Sequence
  Synthetic oligonucleotide; CTT chr11 5189558 5189579 5189563 5189558 -
ttggtaccaattttctgtactg

SEQ ID NO: 149757 - DNA, 22 bp, Artificial Sequence
  Synthetic oligonucleotide; TTT chr11 5189557 5189578 5189562 5189557 -
tggtaccaattttctgtactgg

SEQ ID NO: 149758 - DNA, 22 bp, Artificial Sequence
  Synthetic oligonucleotide; TTT chr11 5189556 5189577 5189561 5189556 -
ggtaccaattttctgtactggt

SEQ ID NO: 149759 - DNA, 22 bp, Artificial Sequence
  Synthetic oligonucleotide; TTG chr11 5189555 5189576 5189560 5189555 -
gtaccaattttctgtactggtc

SEQ ID NO: 149760 - DNA, 22 bp, Artificial Sequence
  Synthetic oligonucleotide; TTT chr11 5189545 5189566 5189550 5189545 -
tctgtactggtccattctcatc

SEQ ID NO: 149761 - DNA, 22 bp, Artificial Sequence
  Synthetic oligonucleotide; TTT chr11 5189544 5189565 5189549 5189544 -
ctgtactggtccattctcatct

SEQ ID NO: 149762 - DNA, 22 bp, Artificial Sequence
  Synthetic oligonucleotide; TTC chr11 5189543 5189564 5189548 5189543 -
tgtactggtccattctcatctt

SEQ ID NO: 149763 - DNA, 22 bp, Artificial Sequence
  Synthetic oligonucleotide; CTG chr11 5189541 5189562 5189546 5189541 -
tactggtccattctcatcttgc

SEQ ID NO: 149764 - DNA, 22 bp, Artificial Sequence
  Synthetic oligonucleotide; CTG chr11 5189536 5189557 5189541 5189536 -
gtccattctcatcttgctataa

SEQ ID NO: 149765 - DNA, 22 bp, Artificial Sequence
  Synthetic oligonucleotide; TTC chr11 5189528 5189549 5189533 5189528 -
tcatcttgctataaggaaatac

SEQ ID NO: 149766 - DNA, 22 bp, Artificial Sequence
  Synthetic oligonucleotide; CTC chr11 5189526 5189547 5189531 5189526 -
atcttgctataaggaaatacct

SEQ ID NO: 149767 - DNA, 22 bp, Artificial Sequence
  Synthetic oligonucleotide; CTT chr11 5189521 5189542 5189526 5189521 -
gctataaggaaatacctgagac

SEQ ID NO: 149768 - DNA, 22 bp, Artificial Sequence
  Synthetic oligonucleotide; TTG chr11 5189520 5189541 5189525 5189520 -
ctataaggaaatacctgagact

SEQ ID NO: 149769 - DNA, 22 bp, Artificial Sequence
  Synthetic oligonucleotide; CTA chr11 5189517 5189538 5189522 5189517 -
taaggaaatacctgagactggg

SEQ ID NO: 149770 - DNA, 22 bp, Artificial Sequence
  Synthetic oligonucleotide; CTG chr11 5189503 5189524 5189508 5189503 -
agactgggtaaatggtgaagaa

SEQ ID NO: 149771 - DNA, 22 bp, Artificial Sequence
  Synthetic oligonucleotide; CTG chr11 5189497 5189518 5189502 5189497 -
ggtaaatggtgaagaacagaga

SEQ ID NO: 149772 - DNA, 22 bp, Artificial Sequence
  Synthetic oligonucleotide; TTT chr11 5189472 5189493 5189477 5189472 -
aattggctcacagttctaaagg

SEQ ID NO: 149773 - DNA, 22 bp, Artificial Sequence
  Synthetic oligonucleotide; TTA chr11 5189471 5189492 5189476 5189471 -
attggctcacagttctaaaggc

SEQ ID NO: 149774 - DNA, 22 bp, Artificial Sequence
  Synthetic oligonucleotide; TTG chr11 5189467 5189488 5189472 5189467 -
gctcacagttctaaaggctgta

SEQ ID NO: 149775 - DNA, 22 bp, Artificial Sequence
  Synthetic oligonucleotide; CTC chr11 5189463 5189484 5189468 5189463 -
acagttctaaaggctgtacagg

SEQ ID NO: 149776 - DNA, 22 bp, Artificial Sequence
  Synthetic oligonucleotide; TTC chr11 5189456 5189477 5189461 5189456 -
taaaggctgtacaggaagcatg

SEQ ID NO: 149777 - DNA, 22 bp, Artificial Sequence
  Synthetic oligonucleotide; CTA chr11 5189454 5189475 5189459 5189454 -
aaggctgtacaggaagcatggc

SEQ ID NO: 149778 - DNA, 22 bp, Artificial Sequence
  Synthetic oligonucleotide; CTG chr11 5189447 5189468 5189452 5189447 -
tacaggaagcatggcaacgtct

SEQ ID NO: 149779 - DNA, 22 bp, Artificial Sequence
  Synthetic oligonucleotide; CTG chr11 5189424 5189445 5189429 5189424 -
ctcagcttctagggaggtttca

SEQ ID NO: 149780 - DNA, 22 bp, Artificial Sequence
  Synthetic oligonucleotide; CTC chr11 5189421 5189442 5189426 5189421 -
agcttctagggaggtttcagga

SEQ ID NO: 149781 - DNA, 22 bp, Artificial Sequence
  Synthetic oligonucleotide; CTT chr11 5189416 5189437 5189421 5189416 -
ctagggaggtttcaggaaactt

SEQ ID NO: 149782 - DNA, 22 bp, Artificial Sequence
  Synthetic oligonucleotide; TTC chr11 5189415 5189436 5189420 5189415 -
tagggaggtttcaggaaactta

SEQ ID NO: 149783 - DNA, 22 bp, Artificial Sequence
  Synthetic oligonucleotide; CTA chr11 5189413 5189434 5189418 5189413 -
gggaggtttcaggaaacttata

SEQ ID NO: 149784 - DNA, 22 bp, Artificial Sequence
  Synthetic oligonucleotide; TTT chr11 5189404 5189425 5189409 5189404 -
caggaaacttataatcatggca

SEQ ID NO: 149785 - DNA, 22 bp, Artificial Sequence
  Synthetic oligonucleotide; TTC chr11 5189403 5189424 5189408 5189403 -
aggaaacttataatcatggcag

SEQ ID NO: 149786 - DNA, 22 bp, Artificial Sequence
  Synthetic oligonucleotide; CTT chr11 5189394 5189415 5189399 5189394 -
ataatcatggcagagagaaaaa

SEQ ID NO: 149787 - DNA, 22 bp, Artificial Sequence
  Synthetic oligonucleotide; TTA chr11 5189393 5189414 5189398 5189393 -
taatcatggcagagagaaaaac

SEQ ID NO: 149788 - DNA, 22 bp, Artificial Sequence
  Synthetic oligonucleotide; CTT chr11 5189356 5189377 5189361 5189356 -
cacatggctggagcaggaagaa

SEQ ID NO: 149789 - DNA, 22 bp, Artificial Sequence
  Synthetic oligonucleotide; TTC chr11 5189355 5189376 5189360 5189355 -
acatggctggagcaggaagaag

SEQ ID NO: 149790 - DNA, 22 bp, Artificial Sequence
  Synthetic oligonucleotide; CTG chr11 5189346 5189367 5189351 5189346 -
gagcaggaagaagaggcaggga

SEQ ID NO: 149791 - DNA, 22 bp, Artificial Sequence
  Synthetic oligonucleotide; CTC chr11 5189303 5189324 5189308 5189303 -
atgagaactcacccactatacg

SEQ ID NO: 149792 - DNA, 22 bp, Artificial Sequence
  Synthetic oligonucleotide; CTC chr11 5189293 5189314 5189298 5189293 -
acccactatacgtaccaaaagg

SEQ ID NO: 149793 - DNA, 22 bp, Artificial Sequence
  Synthetic oligonucleotide; CTA chr11 5189285 5189306 5189290 5189285 -
tacgtaccaaaagggactgata

SEQ ID NO: 149794 - DNA, 22 bp, Artificial Sequence
  Synthetic oligonucleotide; CTG chr11 5189266 5189287 5189271 5189266 -
atattaagctatttatgataac

SEQ ID NO: 149795 - DNA, 22 bp, Artificial Sequence
  Synthetic oligonucleotide; TTA chr11 5189260 5189281 5189265 5189260 -
agctatttatgataactctgct

SEQ ID NO: 149796 - DNA, 22 bp, Artificial Sequence
  Synthetic oligonucleotide; CTA chr11 5189255 5189276 5189260 5189255 -
tttatgataactctgctcctat

SEQ ID NO: 149797 - DNA, 22 bp, Artificial Sequence
  Synthetic oligonucleotide; TTT chr11 5189252 5189273 5189257 5189252 -
atgataactctgctcctatgat

SEQ ID NO: 149798 - DNA, 22 bp, Artificial Sequence
  Synthetic oligonucleotide; TTA chr11 5189251 5189272 5189256 5189251 -
tgataactctgctcctatgatc

SEQ ID NO: 149799 - DNA, 22 bp, Artificial Sequence
  Synthetic oligonucleotide; CTC chr11 5189242 5189263 5189247 5189242 -
tgctcctatgatccaatcactt

SEQ ID NO: 149800 - DNA, 22 bp, Artificial Sequence
  Synthetic oligonucleotide; CTG chr11 5189240 5189261 5189245 5189240 -
ctcctatgatccaatcacttcc

SEQ ID NO: 149801 - DNA, 22 bp, Artificial Sequence
  Synthetic oligonucleotide; CTC chr11 5189237 5189258 5189242 5189237 -
ctatgatccaatcacttcccac

SEQ ID NO: 149802 - DNA, 22 bp, Artificial Sequence
  Synthetic oligonucleotide; CTA chr11 5189234 5189255 5189239 5189234 -
tgatccaatcacttcccaccag

SEQ ID NO: 149803 - DNA, 22 bp, Artificial Sequence
  Synthetic oligonucleotide; CTT chr11 5189220 5189241 5189225 5189220 -
cccaccaggccccatcttcaac

SEQ ID NO: 149804 - DNA, 22 bp, Artificial Sequence
  Synthetic oligonucleotide; TTC chr11 5189219 5189240 5189224 5189219 -
ccaccaggccccatcttcaaca

SEQ ID NO: 149805 - DNA, 22 bp, Artificial Sequence
  Synthetic oligonucleotide; CTT chr11 5189202 5189223 5189207 5189202 -
caacactggggattacagctga

SEQ ID NO: 149806 - DNA, 22 bp, Artificial Sequence
  Synthetic oligonucleotide; TTC chr11 5189201 5189222 5189206 5189201 -
aacactggggattacagctgaa

SEQ ID NO: 149807 - DNA, 22 bp, Artificial Sequence
  Synthetic oligonucleotide; CTG chr11 5189194 5189215 5189199 5189194 -
gggattacagctgaacatgaga

SEQ ID NO: 149808 - DNA, 22 bp, Artificial Sequence
  Synthetic oligonucleotide; TTA chr11 5189187 5189208 5189192 5189187 -
cagctgaacatgagattagggt

SEQ ID NO: 149809 - DNA, 22 bp, Artificial Sequence
  Synthetic oligonucleotide; CTG chr11 5189181 5189202 5189186 5189181 -
aacatgagattagggtggagac

SEQ ID NO: 149810 - DNA, 22 bp, Artificial Sequence
  Synthetic oligonucleotide; TTA chr11 5189169 5189190 5189174 5189169 -
gggtggagacacagatccaaac

SEQ ID NO: 149811 - DNA, 22 bp, Artificial Sequence
  Synthetic oligonucleotide; TTA chr11 5189129 5189150 5189134 5189129 -
ctcttgtgattaaacacaattc

SEQ ID NO: 149812 - DNA, 22 bp, Artificial Sequence
  Synthetic oligonucleotide; CTC chr11 5189126 5189147 5189131 5189126 -
ttgtgattaaacacaattcaac

SEQ ID NO: 149813 - DNA, 22 bp, Artificial Sequence
  Synthetic oligonucleotide; CTT chr11 5189124 5189145 5189129 5189124 -
gtgattaaacacaattcaacaa

SEQ ID NO: 149814 - DNA, 22 bp, Artificial Sequence
  Synthetic oligonucleotide; TTG chr11 5189123 5189144 5189128 5189123 -
tgattaaacacaattcaacaaa

SEQ ID NO: 149815 - DNA, 22 bp, Artificial Sequence
  Synthetic oligonucleotide; TTA chr11 5189117 5189138 5189122 5189117 -
aacacaattcaacaaaatacat

SEQ ID NO: 149816 - DNA, 22 bp, Artificial Sequence
  Synthetic oligonucleotide; TTC chr11 5189107 5189128 5189112 5189107 -
aacaaaatacataaaatgtaag

SEQ ID NO: 149817 - DNA, 22 bp, Artificial Sequence
  Synthetic oligonucleotide; TTA chr11 5189057 5189078 5189062 5189057 -
aactttgtttctttaatacaag

SEQ ID NO: 149818 - DNA, 22 bp, Artificial Sequence
  Synthetic oligonucleotide; CTT chr11 5189052 5189073 5189057 5189052 -
tgtttctttaatacaagcagtc

SEQ ID NO: 149819 - DNA, 22 bp, Artificial Sequence
  Synthetic oligonucleotide; TTT chr11 5189051 5189072 5189056 5189051 -
gtttctttaatacaagcagtcg

SEQ ID NO: 149820 - DNA, 22 bp, Artificial Sequence
  Synthetic oligonucleotide; TTG chr11 5189050 5189071 5189055 5189050 -
tttctttaatacaagcagtcgt

SEQ ID NO: 149821 - DNA, 22 bp, Artificial Sequence
  Synthetic oligonucleotide; TTT chr11 5189047 5189068 5189052 5189047 -
ctttaatacaagcagtcgtatt

SEQ ID NO: 149822 - DNA, 22 bp, Artificial Sequence
  Synthetic oligonucleotide; TTC chr11 5189046 5189067 5189051 5189046 -
tttaatacaagcagtcgtattg

SEQ ID NO: 149823 - DNA, 22 bp, Artificial Sequence
  Synthetic oligonucleotide; CTT chr11 5189044 5189065 5189049 5189044 -
taatacaagcagtcgtattggc

SEQ ID NO: 149824 - DNA, 22 bp, Artificial Sequence
  Synthetic oligonucleotide; TTT chr11 5189043 5189064 5189048 5189043 -
aatacaagcagtcgtattggct

SEQ ID NO: 149825 - DNA, 22 bp, Artificial Sequence
  Synthetic oligonucleotide; TTA chr11 5189042 5189063 5189047 5189042 -
atacaagcagtcgtattggctt

SEQ ID NO: 149826 - DNA, 22 bp, Artificial Sequence
  Synthetic oligonucleotide; TTG chr11 5189024 5189045 5189029 5189024 -
gcttctatacaagtttatctct

SEQ ID NO: 149827 - DNA, 22 bp, Artificial Sequence
  Synthetic oligonucleotide; CTT chr11 5189020 5189041 5189025 5189020 -
ctatacaagtttatctctgcac

SEQ ID NO: 149828 - DNA, 22 bp, Artificial Sequence
  Synthetic oligonucleotide; TTC chr11 5189019 5189040 5189024 5189019 -
tatacaagtttatctctgcacg

SEQ ID NO: 149829 - DNA, 22 bp, Artificial Sequence
  Synthetic oligonucleotide; CTA chr11 5189017 5189038 5189022 5189017 -
tacaagtttatctctgcacgac

SEQ ID NO: 149830 - DNA, 22 bp, Artificial Sequence
  Synthetic oligonucleotide; TTT chr11 5189008 5189029 5189013 5189008 -
atctctgcacgacacacatatt

SEQ ID NO: 149831 - DNA, 22 bp, Artificial Sequence
  Synthetic oligonucleotide; TTA chr11 5189007 5189028 5189012 5189007 -
tctctgcacgacacacatatta

SEQ ID NO: 149832 - DNA, 22 bp, Artificial Sequence
  Synthetic oligonucleotide; CTC chr11 5189003 5189024 5189008 5189003 -
tgcacgacacacatattatgat

SEQ ID NO: 149833 - DNA, 22 bp, Artificial Sequence
  Synthetic oligonucleotide; CTG chr11 5189001 5189022 5189006 5189001 -
cacgacacacatattatgatgt

SEQ ID NO: 149834 - DNA, 22 bp, Artificial Sequence
  Synthetic oligonucleotide; TTA chr11 5188985 5189006 5188990 5188985 -
tgatgtattagaaggaagataa

SEQ ID NO: 149835 - DNA, 22 bp, Artificial Sequence
  Synthetic oligonucleotide; TTA chr11 5188975 5188996 5188980 5188975 -
gaaggaagataaatgtcatcaa

SEQ ID NO: 149836 - DNA, 22 bp, Artificial Sequence
  Synthetic oligonucleotide; CTT chr11 5188948 5188969 5188953 5188948 -
attaaggcaggtcctggtgtat

SEQ ID NO: 149837 - DNA, 22 bp, Artificial Sequence
  Synthetic oligonucleotide; TTA chr11 5188947 5188968 5188952 5188947 -
ttaaggcaggtcctggtgtatc

SEQ ID NO: 149838 - DNA, 22 bp, Artificial Sequence
  Synthetic oligonucleotide; TTA chr11 5188944 5188965 5188949 5188944 -
aggcaggtcctggtgtatcctt

SEQ ID NO: 149839 - DNA, 22 bp, Artificial Sequence
  Synthetic oligonucleotide; CTG chr11 5188932 5188953 5188937 5188932 -
gtgtatccttccttaaagaaaa

SEQ ID NO: 149840 - DNA, 22 bp, Artificial Sequence
  Synthetic oligonucleotide; CTT chr11 5188922 5188943 5188927 5188922 -
ccttaaagaaaagtatctaata

SEQ ID NO: 149841 - DNA, 22 bp, Artificial Sequence
  Synthetic oligonucleotide; TTC chr11 5188921 5188942 5188926 5188921 -
cttaaagaaaagtatctaataa

SEQ ID NO: 149842 - DNA, 22 bp, Artificial Sequence
  Synthetic oligonucleotide; CTT chr11 5188918 5188939 5188923 5188918 -
aaagaaaagtatctaataacct

SEQ ID NO: 149843 - DNA, 22 bp, Artificial Sequence
  Synthetic oligonucleotide; TTA chr11 5188917 5188938 5188922 5188917 -
aagaaaagtatctaataacctt

SEQ ID NO: 149844 - DNA, 22 bp, Artificial Sequence
  Synthetic oligonucleotide; CTA chr11 5188903 5188924 5188908 5188903 -
ataaccttacgttagctaaacg

SEQ ID NO: 149845 - DNA, 22 bp, Artificial Sequence
  Synthetic oligonucleotide; CTT chr11 5188895 5188916 5188900 5188895 -
acgttagctaaacgaagagata

SEQ ID NO: 149846 - DNA, 22 bp, Artificial Sequence
  Synthetic oligonucleotide; TTA chr11 5188894 5188915 5188899 5188894 -
cgttagctaaacgaagagataa

SEQ ID NO: 149847 - DNA, 22 bp, Artificial Sequence
  Synthetic oligonucleotide; TTA chr11 5188889 5188910 5188894 5188889 -
gctaaacgaagagataatatat

SEQ ID NO: 149848 - DNA, 22 bp, Artificial Sequence
  Synthetic oligonucleotide; CTA chr11 5188885 5188906 5188890 5188885 -
aacgaagagataatatattagt

SEQ ID NO: 149849 - DNA, 22 bp, Artificial Sequence
  Synthetic oligonucleotide; TTA chr11 5188865 5188886 5188870 5188865 -
gtaattcttcccagataaagat

SEQ ID NO: 149850 - DNA, 22 bp, Artificial Sequence
  Synthetic oligonucleotide; TTC chr11 5188858 5188879 5188863 5188858 -
ttcccagataaagatcatctct

SEQ ID NO: 149851 - DNA, 22 bp, Artificial Sequence
  Synthetic oligonucleotide; CTT chr11 5188856 5188877 5188861 5188856 -
cccagataaagatcatctctaa

SEQ ID NO: 149852 - DNA, 22 bp, Artificial Sequence
  Synthetic oligonucleotide; TTC chr11 5188855 5188876 5188860 5188855 -
ccagataaagatcatctctaaa

SEQ ID NO: 149853 - DNA, 22 bp, Artificial Sequence
  Synthetic oligonucleotide; CTC chr11 5188837 5188858 5188842 5188837 -
taaagtaattcacaaactccac

SEQ ID NO: 149854 - DNA, 22 bp, Artificial Sequence
  Synthetic oligonucleotide; CTA chr11 5188835 5188856 5188840 5188835 -
aagtaattcacaaactccacct

SEQ ID NO: 149855 - DNA, 22 bp, Artificial Sequence
  Synthetic oligonucleotide; TTC chr11 5188826 5188847 5188831 5188826 -
acaaactccacctggaaagaag

SEQ ID NO: 149856 - DNA, 22 bp, Artificial Sequence
  Synthetic oligonucleotide; CTC chr11 5188818 5188839 5188823 5188818 -
cacctggaaagaagagtggcta

SEQ ID NO: 149857 - DNA, 22 bp, Artificial Sequence
  Synthetic oligonucleotide; CTG chr11 5188812 5188833 5188817 5188812 -
gaaagaagagtggctattgctc

SEQ ID NO: 149858 - DNA, 22 bp, Artificial Sequence
  Synthetic oligonucleotide; CTA chr11 5188796 5188817 5188801 5188796 -
ttgctcaagctattcttcaatg

SEQ ID NO: 149859 - DNA, 22 bp, Artificial Sequence
  Synthetic oligonucleotide; TTG chr11 5188793 5188814 5188798 5188793 -
ctcaagctattcttcaatgtgg

SEQ ID NO: 149860 - DNA, 22 bp, Artificial Sequence
  Synthetic oligonucleotide; CTC chr11 5188790 5188811 5188795 5188790 -
aagctattcttcaatgtggcag

SEQ ID NO: 149861 - DNA, 22 bp, Artificial Sequence
  Synthetic oligonucleotide; CTA chr11 5188784 5188805 5188789 5188784 -
ttcttcaatgtggcaggggaaa

SEQ ID NO: 149862 - DNA, 22 bp, Artificial Sequence
  Synthetic oligonucleotide; TTC chr11 5188781 5188802 5188786 5188781 -
ttcaatgtggcaggggaaaaat

SEQ ID NO: 149863 - DNA, 22 bp, Artificial Sequence
  Synthetic oligonucleotide; CTT chr11 5188779 5188800 5188784 5188779 -
caatgtggcaggggaaaaatct

SEQ ID NO: 149864 - DNA, 22 bp, Artificial Sequence
  Synthetic oligonucleotide; TTC chr11 5188778 5188799 5188783 5188778 -
aatgtggcaggggaaaaatctt

SEQ ID NO: 149865 - DNA, 22 bp, Artificial Sequence
  Synthetic oligonucleotide; CTT chr11 5188756 5188777 5188761 5188756 -
tgaaaaagctacaagactctgc

SEQ ID NO: 149866 - DNA, 22 bp, Artificial Sequence
  Synthetic oligonucleotide; TTT chr11 5188755 5188776 5188760 5188755 -
gaaaaagctacaagactctgca

SEQ ID NO: 149867 - DNA, 22 bp, Artificial Sequence
  Synthetic oligonucleotide; TTG chr11 5188754 5188775 5188759 5188754 -
aaaaagctacaagactctgcaa

SEQ ID NO: 149868 - DNA, 22 bp, Artificial Sequence
  Synthetic oligonucleotide; CTA chr11 5188745 5188766 5188750 5188745 -
caagactctgcaaatattgatt

SEQ ID NO: 149869 - DNA, 22 bp, Artificial Sequence
  Synthetic oligonucleotide; CTC chr11 5188737 5188758 5188742 5188737 -
tgcaaatattgattccaaccac

SEQ ID NO: 149870 - DNA, 22 bp, Artificial Sequence
  Synthetic oligonucleotide; CTG chr11 5188735 5188756 5188740 5188735 -
caaatattgattccaaccactg

SEQ ID NO: 149871 - DNA, 22 bp, Artificial Sequence
  Synthetic oligonucleotide; TTG chr11 5188726 5188747 5188731 5188726 -
attccaaccactgagaaactct

SEQ ID NO: 149872 - DNA, 22 bp, Artificial Sequence
  Synthetic oligonucleotide; TTC chr11 5188722 5188743 5188727 5188722 -
caaccactgagaaactctacag

SEQ ID NO: 149873 - DNA, 22 bp, Artificial Sequence
  Synthetic oligonucleotide; CTG chr11 5188713 5188734 5188718 5188713 -
agaaactctacagcagggatgt

SEQ ID NO: 149874 - DNA, 22 bp, Artificial Sequence
  Synthetic oligonucleotide; CTC chr11 5188705 5188726 5188710 5188705 -
tacagcagggatgtccaatctt

SEQ ID NO: 149875 - DNA, 22 bp, Artificial Sequence
  Synthetic oligonucleotide; CTA chr11 5188703 5188724 5188708 5188703 -
cagcagggatgtccaatctttt

SEQ ID NO: 149876 - DNA, 22 bp, Artificial Sequence
  Synthetic oligonucleotide; CTT chr11 5188683 5188704 5188688 5188683 -
ttggcttccctgggccacacat

SEQ ID NO: 149877 - DNA, 22 bp, Artificial Sequence
  Synthetic oligonucleotide; TTT chr11 5188682 5188703 5188687 5188682 -
tggcttccctgggccacacata

SEQ ID NO: 149878 - DNA, 22 bp, Artificial Sequence
  Synthetic oligonucleotide; TTT chr11 5188681 5188702 5188686 5188681 -
ggcttccctgggccacacataa

SEQ ID NO: 149879 - DNA, 22 bp, Artificial Sequence
  Synthetic oligonucleotide; TTG chr11 5188680 5188701 5188685 5188680 -
gcttccctgggccacacataaa

SEQ ID NO: 149880 - DNA, 22 bp, Artificial Sequence
  Synthetic oligonucleotide; CTT chr11 5188676 5188697 5188681 5188676 -
ccctgggccacacataaaatat

SEQ ID NO: 149881 - DNA, 22 bp, Artificial Sequence
  Synthetic oligonucleotide; TTC chr11 5188675 5188696 5188680 5188675 -
cctgggccacacataaaatata

SEQ ID NO: 149882 - DNA, 22 bp, Artificial Sequence
  Synthetic oligonucleotide; CTG chr11 5188671 5188692 5188676 5188671 -
ggccacacataaaatatactaa

SEQ ID NO: 149883 - DNA, 22 bp, Artificial Sequence
  Synthetic oligonucleotide; CTA chr11 5188650 5188671 5188655 5188650 -
acactaatgacagctcatgagc

SEQ ID NO: 149884 - DNA, 22 bp, Artificial Sequence
  Synthetic oligonucleotide; CTA chr11 5188644 5188665 5188649 5188644 -
atgacagctcatgagccaaaaa

SEQ ID NO: 149885 - DNA, 22 bp, Artificial Sequence
  Synthetic oligonucleotide; CTC chr11 5188634 5188655 5188639 5188634 -
atgagccaaaaaaaaaaaaaaa

SEQ ID NO: 149886 - DNA, 22 bp, Artificial Sequence
  Synthetic oligonucleotide; CTC chr11 5188588 5188609 5188593 5188588 -
ataatgttttaagaaagttgtg

SEQ ID NO: 149887 - DNA, 22 bp, Artificial Sequence
  Synthetic oligonucleotide; TTT chr11 5188579 5188600 5188584 5188579 -
taagaaagttgtgttggatagc

SEQ ID NO: 149888 - DNA, 22 bp, Artificial Sequence
  Synthetic oligonucleotide; TTT chr11 5188578 5188599 5188583 5188578 -
aagaaagttgtgttggatagca

SEQ ID NO: 149889 - DNA, 22 bp, Artificial Sequence
  Synthetic oligonucleotide; TTA chr11 5188577 5188598 5188582 5188577 -
agaaagttgtgttggatagcat

SEQ ID NO: 149890 - DNA, 22 bp, Artificial Sequence
  Synthetic oligonucleotide; TTG chr11 5188568 5188589 5188573 5188568 -
tgttggatagcattcaaagcca

SEQ ID NO: 149891 - DNA, 22 bp, Artificial Sequence
  Synthetic oligonucleotide; TTG chr11 5188563 5188584 5188568 5188563 -
gatagcattcaaagccatcttg

SEQ ID NO: 149892 - DNA, 22 bp, Artificial Sequence
  Synthetic oligonucleotide; TTC chr11 5188553 5188574 5188558 5188553 -
aaagccatcttgggatgcatgc

SEQ ID NO: 149893 - DNA, 22 bp, Artificial Sequence
  Synthetic oligonucleotide; CTT chr11 5188542 5188563 5188547 5188542 -
gggatgcatgcagcccacgggc

SEQ ID NO: 149894 - DNA, 22 bp, Artificial Sequence
  Synthetic oligonucleotide; TTG chr11 5188541 5188562 5188546 5188541 -
ggatgcatgcagcccacgggcc

SEQ ID NO: 149895 - DNA, 22 bp, Artificial Sequence
  Synthetic oligonucleotide; TTG chr11 5188511 5188532 5188516 5188511 -
gacaagcttgctctacagccta

SEQ ID NO: 149896 - DNA, 22 bp, Artificial Sequence
  Synthetic oligonucleotide; CTT chr11 5188502 5188523 5188507 5188502 -
gctctacagcctacaaacaagg

SEQ ID NO: 149897 - DNA, 22 bp, Artificial Sequence
  Synthetic oligonucleotide; TTG chr11 5188501 5188522 5188506 5188501 -
ctctacagcctacaaacaagga

SEQ ID NO: 149898 - DNA, 22 bp, Artificial Sequence
  Synthetic oligonucleotide; CTC chr11 5188498 5188519 5188503 5188498 -
tacagcctacaaacaaggaaga

SEQ ID NO: 149899 - DNA, 22 bp, Artificial Sequence
  Synthetic oligonucleotide; CTA chr11 5188496 5188517 5188501 5188496 -
cagcctacaaacaaggaagaaa

SEQ ID NO: 149900 - DNA, 22 bp, Artificial Sequence
  Synthetic oligonucleotide; CTA chr11 5188489 5188510 5188494 5188489 -
caaacaaggaagaaataaatta

SEQ ID NO: 149901 - DNA, 22 bp, Artificial Sequence
  Synthetic oligonucleotide; TTA chr11 5188467 5188488 5188472 5188467 -
atatttctgttctcttttctgg

SEQ ID NO: 149902 - DNA, 22 bp, Artificial Sequence
  Synthetic oligonucleotide; TTT chr11 5188461 5188482 5188466 5188461 -
ctgttctcttttctggcaccaa

SEQ ID NO: 149903 - DNA, 22 bp, Artificial Sequence
  Synthetic oligonucleotide; TTC chr11 5188460 5188481 5188465 5188460 -
tgttctcttttctggcaccaac

SEQ ID NO: 149904 - DNA, 22 bp, Artificial Sequence
  Synthetic oligonucleotide; CTG chr11 5188458 5188479 5188463 5188458 -
ttctcttttctggcaccaactc

SEQ ID NO: 149905 - DNA, 22 bp, Artificial Sequence
  Synthetic oligonucleotide; TTC chr11 5188455 5188476 5188460 5188455 -
tcttttctggcaccaactccca

SEQ ID NO: 149906 - DNA, 22 bp, Artificial Sequence
  Synthetic oligonucleotide; CTC chr11 5188453 5188474 5188458 5188453 -
ttttctggcaccaactcccagc

SEQ ID NO: 149907 - DNA, 22 bp, Artificial Sequence
  Synthetic oligonucleotide; CTT chr11 5188451 5188472 5188456 5188451 -
ttctggcaccaactcccagctt

SEQ ID NO: 149908 - DNA, 22 bp, Artificial Sequence
  Synthetic oligonucleotide; TTT chr11 5188450 5188471 5188455 5188450 -
tctggcaccaactcccagcttt

SEQ ID NO: 149909 - DNA, 22 bp, Artificial Sequence
  Synthetic oligonucleotide; TTT chr11 5188449 5188470 5188454 5188449 -
ctggcaccaactcccagcttta

SEQ ID NO: 149910 - DNA, 22 bp, Artificial Sequence
  Synthetic oligonucleotide; TTC chr11 5188448 5188469 5188453 5188448 -
tggcaccaactcccagctttac

SEQ ID NO: 149911 - DNA, 22 bp, Artificial Sequence
  Synthetic oligonucleotide; CTG chr11 5188446 5188467 5188451 5188446 -
gcaccaactcccagctttacta

SEQ ID NO: 149912 - DNA, 22 bp, Artificial Sequence
  Synthetic oligonucleotide; CTC chr11 5188436 5188457 5188441 5188436 -
ccagctttactagcaccaactc

SEQ ID NO: 149913 - DNA, 22 bp, Artificial Sequence
  Synthetic oligonucleotide; CTT chr11 5188429 5188450 5188434 5188429 -
tactagcaccaactcccagctt

SEQ ID NO: 149914 - DNA, 22 bp, Artificial Sequence
  Synthetic oligonucleotide; TTT chr11 5188428 5188449 5188433 5188428 -
actagcaccaactcccagcttt

SEQ ID NO: 149915 - DNA, 22 bp, Artificial Sequence
  Synthetic oligonucleotide; TTA chr11 5188427 5188448 5188432 5188427 -
ctagcaccaactcccagcttta

SEQ ID NO: 149916 - DNA, 22 bp, Artificial Sequence
  Synthetic oligonucleotide; CTA chr11 5188424 5188445 5188429 5188424 -
gcaccaactcccagctttacta

SEQ ID NO: 149917 - DNA, 22 bp, Artificial Sequence
  Synthetic oligonucleotide; CTC chr11 5188414 5188435 5188419 5188414 -
ccagctttactaacttacaaat

SEQ ID NO: 149918 - DNA, 22 bp, Artificial Sequence
  Synthetic oligonucleotide; CTT chr11 5188407 5188428 5188412 5188407 -
tactaacttacaaatgagaaga

SEQ ID NO: 149919 - DNA, 22 bp, Artificial Sequence
  Synthetic oligonucleotide; TTT chr11 5188406 5188427 5188411 5188406 -
actaacttacaaatgagaagaa

SEQ ID NO: 149920 - DNA, 22 bp, Artificial Sequence
  Synthetic oligonucleotide; TTA chr11 5188405 5188426 5188410 5188405 -
ctaacttacaaatgagaagaaa

SEQ ID NO: 149921 - DNA, 22 bp, Artificial Sequence
  Synthetic oligonucleotide; CTA chr11 5188402 5188423 5188407 5188402 -
acttacaaatgagaagaaacca

SEQ ID NO: 149922 - DNA, 22 bp, Artificial Sequence
  Synthetic oligonucleotide; CTT chr11 5188398 5188419 5188403 5188398 -
acaaatgagaagaaaccaggtg

SEQ ID NO: 149923 - DNA, 22 bp, Artificial Sequence
  Synthetic oligonucleotide; TTA chr11 5188397 5188418 5188402 5188397 -
caaatgagaagaaaccaggtgt

SEQ ID NO: 149924 - DNA, 22 bp, Artificial Sequence
  Synthetic oligonucleotide; TTA chr11 5188368 5188389 5188373 5188368 -
tgccaaattacttgttcgaaga

SEQ ID NO: 149925 - DNA, 22 bp, Artificial Sequence
  Synthetic oligonucleotide; TTA chr11 5188358 5188379 5188363 5188358 -
cttgttcgaagaaaggatcatc

SEQ ID NO: 149926 - DNA, 22 bp, Artificial Sequence
  Synthetic oligonucleotide; CTT chr11 5188355 5188376 5188360 5188355 -
gttcgaagaaaggatcatctgg

SEQ ID NO: 149927 - DNA, 22 bp, Artificial Sequence
  Synthetic oligonucleotide; TTG chr11 5188354 5188375 5188359 5188354 -
ttcgaagaaaggatcatctgga

SEQ ID NO: 149928 - DNA, 22 bp, Artificial Sequence
  Synthetic oligonucleotide; TTC chr11 5188351 5188372 5188356 5188351 -
gaagaaaggatcatctggaatt

SEQ ID NO: 149929 - DNA, 22 bp, Artificial Sequence
  Synthetic oligonucleotide; CTG chr11 5188334 5188355 5188339 5188334 -
gaattcttttcttggatttcct

SEQ ID NO: 149930 - DNA, 22 bp, Artificial Sequence
  Synthetic oligonucleotide; TTC chr11 5188328 5188349 5188333 5188328 -
ttttcttggatttcctccactc

SEQ ID NO: 149931 - DNA, 22 bp, Artificial Sequence
  Synthetic oligonucleotide; CTT chr11 5188326 5188347 5188331 5188326 -
ttcttggatttcctccactcaa

SEQ ID NO: 149932 - DNA, 22 bp, Artificial Sequence
  Synthetic oligonucleotide; TTT chr11 5188325 5188346 5188330 5188325 -
tcttggatttcctccactcaag

SEQ ID NO: 149933 - DNA, 22 bp, Artificial Sequence
  Synthetic oligonucleotide; TTT chr11 5188324 5188345 5188329 5188324 -
cttggatttcctccactcaagt

SEQ ID NO: 149934 - DNA, 22 bp, Artificial Sequence
  Synthetic oligonucleotide; TTC chr11 5188323 5188344 5188328 5188323 -
ttggatttcctccactcaagtc

SEQ ID NO: 149935 - DNA, 22 bp, Artificial Sequence
  Synthetic oligonucleotide; CTT chr11 5188321 5188342 5188326 5188321 -
ggatttcctccactcaagtccc

SEQ ID NO: 149936 - DNA, 22 bp, Artificial Sequence
  Synthetic oligonucleotide; TTG chr11 5188320 5188341 5188325 5188320 -
gatttcctccactcaagtccca

SEQ ID NO: 149937 - DNA, 22 bp, Artificial Sequence
  Synthetic oligonucleotide; TTT chr11 5188315 5188336 5188320 5188315 -
cctccactcaagtcccatagta

SEQ ID NO: 149938 - DNA, 22 bp, Artificial Sequence
  Synthetic oligonucleotide; TTC chr11 5188314 5188335 5188319 5188314 -
ctccactcaagtcccatagtaa

SEQ ID NO: 149939 - DNA, 22 bp, Artificial Sequence
  Synthetic oligonucleotide; CTC chr11 5188311 5188332 5188316 5188311 -
cactcaagtcccatagtaagat

SEQ ID NO: 149940 - DNA, 22 bp, Artificial Sequence
  Synthetic oligonucleotide; CTC chr11 5188306 5188327 5188311 5188306 -
aagtcccatagtaagataaagg

SEQ ID NO: 149941 - DNA, 22 bp, Artificial Sequence
  Synthetic oligonucleotide; CTT chr11 5188281 5188302 5188286 5188281 -
tcatttaattgtatctttttca

SEQ ID NO: 149942 - DNA, 22 bp, Artificial Sequence
  Synthetic oligonucleotide; TTT chr11 5188280 5188301 5188285 5188280 -
catttaattgtatctttttcat

SEQ ID NO: 149943 - DNA, 22 bp, Artificial Sequence
  Synthetic oligonucleotide; TTC chr11 5188279 5188300 5188284 5188279 -
atttaattgtatctttttcatt

SEQ ID NO: 149944 - DNA, 22 bp, Artificial Sequence
  Synthetic oligonucleotide; TTT chr11 5188275 5188296 5188280 5188275 -
aattgtatctttttcatttttt

SEQ ID NO: 149945 - DNA, 22 bp, Artificial Sequence
  Synthetic oligonucleotide; TTA chr11 5188274 5188295 5188279 5188274 -
attgtatctttttcattttttg

SEQ ID NO: 149946 - DNA, 22 bp, Artificial Sequence
  Synthetic oligonucleotide; TTG chr11 5188270 5188291 5188275 5188270 -
tatctttttcattttttggctg

SEQ ID NO: 149947 - DNA, 22 bp, Artificial Sequence
  Synthetic oligonucleotide; CTT chr11 5188264 5188285 5188269 5188264 -
tttcattttttggctgaagcac

SEQ ID NO: 149948 - DNA, 22 bp, Artificial Sequence
  Synthetic oligonucleotide; TTT chr11 5188263 5188284 5188268 5188263 -
ttcattttttggctgaagcact

SEQ ID NO: 149949 - DNA, 22 bp, Artificial Sequence
  Synthetic oligonucleotide; TTT chr11 5188262 5188283 5188267 5188262 -
tcattttttggctgaagcacta

SEQ ID NO: 149950 - DNA, 22 bp, Artificial Sequence
  Synthetic oligonucleotide; TTT chr11 5188261 5188282 5188266 5188261 -
cattttttggctgaagcactag

SEQ ID NO: 149951 - DNA, 22 bp, Artificial Sequence
  Synthetic oligonucleotide; TTC chr11 5188260 5188281 5188265 5188260 -
attttttggctgaagcactagc

SEQ ID NO: 149952 - DNA, 22 bp, Artificial Sequence
  Synthetic oligonucleotide; TTT chr11 5188256 5188277 5188261 5188256 -
tttggctgaagcactagcatcc

SEQ ID NO: 149953 - DNA, 22 bp, Artificial Sequence
  Synthetic oligonucleotide; TTT chr11 5188255 5188276 5188260 5188255 -
ttggctgaagcactagcatcca

SEQ ID NO: 149954 - DNA, 22 bp, Artificial Sequence
  Synthetic oligonucleotide; TTT chr11 5188254 5188275 5188259 5188254 -
tggctgaagcactagcatccag

SEQ ID NO: 149955 - DNA, 22 bp, Artificial Sequence
  Synthetic oligonucleotide; TTT chr11 5188253 5188274 5188258 5188253 -
ggctgaagcactagcatccagg

SEQ ID NO: 149956 - DNA, 22 bp, Artificial Sequence
  Synthetic oligonucleotide; TTG chr11 5188252 5188273 5188257 5188252 -
gctgaagcactagcatccagga

SEQ ID NO: 149957 - DNA, 22 bp, Artificial Sequence
  Synthetic oligonucleotide; CTG chr11 5188248 5188269 5188253 5188248 -
aagcactagcatccaggacact

SEQ ID NO: 149958 - DNA, 22 bp, Artificial Sequence
  Synthetic oligonucleotide; CTA chr11 5188240 5188261 5188245 5188240 -
gcatccaggacactaatttacc

SEQ ID NO: 149959 - DNA, 22 bp, Artificial Sequence
  Synthetic oligonucleotide; CTA chr11 5188225 5188246 5188230 5188225 -
atttacctatagaacaattatc

SEQ ID NO: 149960 - DNA, 22 bp, Artificial Sequence
  Synthetic oligonucleotide; TTT chr11 5188221 5188242 5188226 5188221 -
acctatagaacaattatctaga

SEQ ID NO: 149961 - DNA, 22 bp, Artificial Sequence
  Synthetic oligonucleotide; TTA chr11 5188220 5188241 5188225 5188220 -
cctatagaacaattatctagac

SEQ ID NO: 149962 - DNA, 22 bp, Artificial Sequence
  Synthetic oligonucleotide; CTA chr11 5188216 5188237 5188221 5188216 -
tagaacaattatctagactcaa

SEQ ID NO: 149963 - DNA, 22 bp, Artificial Sequence
  Synthetic oligonucleotide; TTA chr11 5188205 5188226 5188210 5188205 -
tctagactcaattagaagtatc

SEQ ID NO: 149964 - DNA, 22 bp, Artificial Sequence
  Synthetic oligonucleotide; CTA chr11 5188201 5188222 5188206 5188201 -
gactcaattagaagtatcttac

SEQ ID NO: 149965 - DNA, 22 bp, Artificial Sequence
  Synthetic oligonucleotide; CTC chr11 5188196 5188217 5188201 5188196 -
aattagaagtatcttacatatt

SEQ ID NO: 149966 - DNA, 22 bp, Artificial Sequence
  Synthetic oligonucleotide; TTA chr11 5188191 5188212 5188196 5188191 -
gaagtatcttacatattgaagc

SEQ ID NO: 149967 - DNA, 22 bp, Artificial Sequence
  Synthetic oligonucleotide; CTT chr11 5188181 5188202 5188186 5188181 -
acatattgaagcagagttagag

SEQ ID NO: 149968 - DNA, 22 bp, Artificial Sequence
  Synthetic oligonucleotide; TTA chr11 5188180 5188201 5188185 5188180 -
catattgaagcagagttagagc

SEQ ID NO: 149969 - DNA, 22 bp, Artificial Sequence
  Synthetic oligonucleotide; TTG chr11 5188173 5188194 5188178 5188173 -
aagcagagttagagctaaaatc

SEQ ID NO: 149970 - DNA, 22 bp, Artificial Sequence
  Synthetic oligonucleotide; TTA chr11 5188162 5188183 5188167 5188162 -
gagctaaaatctcaagcaatcc

SEQ ID NO: 149971 - DNA, 22 bp, Artificial Sequence
  Synthetic oligonucleotide; CTA chr11 5188156 5188177 5188161 5188156 -
aaatctcaagcaatccaacatc

SEQ ID NO: 149972 - DNA, 22 bp, Artificial Sequence
  Synthetic oligonucleotide; CTC chr11 5188149 5188170 5188154 5188149 -
aagcaatccaacatccttaatt

SEQ ID NO: 149973 - DNA, 22 bp, Artificial Sequence
  Synthetic oligonucleotide; CTT chr11 5188131 5188152 5188136 5188131 -
aatttacagatactaaatcagt

SEQ ID NO: 149974 - DNA, 22 bp, Artificial Sequence
  Synthetic oligonucleotide; TTA chr11 5188130 5188151 5188135 5188130 -
atttacagatactaaatcagta

SEQ ID NO: 149975 - DNA, 22 bp, Artificial Sequence
  Synthetic oligonucleotide; TTT chr11 5188126 5188147 5188131 5188126 -
acagatactaaatcagtagcca

SEQ ID NO: 149976 - DNA, 22 bp, Artificial Sequence
  Synthetic oligonucleotide; TTA chr11 5188125 5188146 5188130 5188125 -
cagatactaaatcagtagccaa

SEQ ID NO: 149977 - DNA, 22 bp, Artificial Sequence
  Synthetic oligonucleotide; CTA chr11 5188116 5188137 5188121 5188116 -
aatcagtagccaaagccatttt

SEQ ID NO: 149978 - DNA, 22 bp, Artificial Sequence
  Synthetic oligonucleotide; TTT chr11 5188095 5188116 5188100 5188095 -
ttactgctattttggttaacag

SEQ ID NO: 149979 - DNA, 22 bp, Artificial Sequence
  Synthetic oligonucleotide; TTT chr11 5188094 5188115 5188099 5188094 -
tactgctattttggttaacagg

SEQ ID NO: 149980 - DNA, 22 bp, Artificial Sequence
  Synthetic oligonucleotide; TTT chr11 5188093 5188114 5188098 5188093 -
actgctattttggttaacaggg

SEQ ID NO: 149981 - DNA, 22 bp, Artificial Sequence
  Synthetic oligonucleotide; TTA chr11 5188092 5188113 5188097 5188092 -
ctgctattttggttaacagggc

SEQ ID NO: 149982 - DNA, 22 bp, Artificial Sequence
  Synthetic oligonucleotide; CTG chr11 5188089 5188110 5188094 5188089 -
ctattttggttaacagggccac

SEQ ID NO: 149983 - DNA, 22 bp, Artificial Sequence
  Synthetic oligonucleotide; CTA chr11 5188086 5188107 5188091 5188086 -
ttttggttaacagggccacaat

SEQ ID NO: 149984 - DNA, 22 bp, Artificial Sequence
  Synthetic oligonucleotide; TTT chr11 5188083 5188104 5188088 5188083 -
tggttaacagggccacaatcat

SEQ ID NO: 149985 - DNA, 22 bp, Artificial Sequence
  Synthetic oligonucleotide; TTT chr11 5188082 5188103 5188087 5188082 -
ggttaacagggccacaatcatt

SEQ ID NO: 149986 - DNA, 22 bp, Artificial Sequence
  Synthetic oligonucleotide; TTG chr11 5188081 5188102 5188086 5188081 -
gttaacagggccacaatcattt

SEQ ID NO: 149987 - DNA, 22 bp, Artificial Sequence
  Synthetic oligonucleotide; TTA chr11 5188077 5188098 5188082 5188077 -
acagggccacaatcatttatcc

SEQ ID NO: 149988 - DNA, 22 bp, Artificial Sequence
  Synthetic oligonucleotide; TTT chr11 5188059 5188080 5188064 5188059 -
atccatttccttgaaatccata

SEQ ID NO: 149989 - DNA, 22 bp, Artificial Sequence
  Synthetic oligonucleotide; TTA chr11 5188058 5188079 5188063 5188058 -
tccatttccttgaaatccatag

SEQ ID NO: 149990 - DNA, 22 bp, Artificial Sequence
  Synthetic oligonucleotide; TTT chr11 5188051 5188072 5188056 5188051 -
ccttgaaatccatagaaattta

SEQ ID NO: 149991 - DNA, 22 bp, Artificial Sequence
  Synthetic oligonucleotide; TTC chr11 5188050 5188071 5188055 5188050 -
cttgaaatccatagaaatttaa

SEQ ID NO: 149992 - DNA, 22 bp, Artificial Sequence
  Synthetic oligonucleotide; CTT chr11 5188047 5188068 5188052 5188047 -
gaaatccatagaaatttaaaaa

SEQ ID NO: 149993 - DNA, 22 bp, Artificial Sequence
  Synthetic oligonucleotide; TTG chr11 5188046 5188067 5188051 5188046 -
aaatccatagaaatttaaaaac

SEQ ID NO: 149994 - DNA, 22 bp, Artificial Sequence
  Synthetic oligonucleotide; TTT chr11 5188030 5188051 5188035 5188030 -
aaaaactgagtcttttaacagc

SEQ ID NO: 149995 - DNA, 22 bp, Artificial Sequence
  Synthetic oligonucleotide; TTA chr11 5188029 5188050 5188034 5188029 -
aaaactgagtcttttaacagca

SEQ ID NO: 149996 - DNA, 22 bp, Artificial Sequence
  Synthetic oligonucleotide; CTG chr11 5188022 5188043 5188027 5188022 -
agtcttttaacagcacaatctg

SEQ ID NO: 149997 - DNA, 22 bp, Artificial Sequence
  Synthetic oligonucleotide; CTT chr11 5188016 5188037 5188021 5188016 -
ttaacagcacaatctgctctaa

SEQ ID NO: 149998 - DNA, 22 bp, Artificial Sequence
  Synthetic oligonucleotide; TTT chr11 5188015 5188036 5188020 5188015 -
taacagcacaatctgctctaaa

SEQ ID NO: 149999 - DNA, 22 bp, Artificial Sequence
  Synthetic oligonucleotide; TTT chr11 5188014 5188035 5188019 5188014 -
aacagcacaatctgctctaaag

SEQ ID NO: 150000 - DNA, 22 bp, Artificial Sequence
  Synthetic oligonucleotide; TTA chr11 5188013 5188034 5188018 5188013 -
acagcacaatctgctctaaagt

SEQ ID NO: 150001 - DNA, 22 bp, Artificial Sequence
  Synthetic oligonucleotide; CTG chr11 5188000 5188021 5188005 5188000 -
ctctaaagtgatggcaatttct

SEQ ID NO: 150002 - DNA, 22 bp, Artificial Sequence
  Synthetic oligonucleotide; CTC chr11 5187997 5188018 5188002 5187997 -
taaagtgatggcaatttctgac

SEQ ID NO: 150003 - DNA, 22 bp, Artificial Sequence
  Synthetic oligonucleotide; CTA chr11 5187995 5188016 5188000 5187995 -
aagtgatggcaatttctgacat

SEQ ID NO: 150004 - DNA, 22 bp, Artificial Sequence
  Synthetic oligonucleotide; TTT chr11 5187980 5188001 5187985 5187980 -
ctgacatgaacttatgtgagaa

SEQ ID NO: 150005 - DNA, 22 bp, Artificial Sequence
  Synthetic oligonucleotide; TTC chr11 5187979 5188000 5187984 5187979 -
tgacatgaacttatgtgagaat

SEQ ID NO: 150006 - DNA, 22 bp, Artificial Sequence
  Synthetic oligonucleotide; CTG chr11 5187977 5187998 5187982 5187977 -
acatgaacttatgtgagaattt

SEQ ID NO: 150007 - DNA, 22 bp, Artificial Sequence
  Synthetic oligonucleotide; CTT chr11 5187967 5187988 5187972 5187967 -
atgtgagaatttttataatctt

SEQ ID NO: 150008 - DNA, 22 bp, Artificial Sequence
  Synthetic oligonucleotide; TTA chr11 5187966 5187987 5187971 5187966 -
tgtgagaatttttataatcttt

SEQ ID NO: 150009 - DNA, 22 bp, Artificial Sequence
  Synthetic oligonucleotide; TTT chr11 5187955 5187976 5187960 5187955 -
ttataatctttatttattctac

SEQ ID NO: 150010 - DNA, 22 bp, Artificial Sequence
  Synthetic oligonucleotide; TTT chr11 5187954 5187975 5187959 5187954 -
tataatctttatttattctaca

SEQ ID NO: 150011 - DNA, 22 bp, Artificial Sequence
  Synthetic oligonucleotide; TTT chr11 5187953 5187974 5187958 5187953 -
ataatctttatttattctacat

SEQ ID NO: 150012 - DNA, 22 bp, Artificial Sequence
  Synthetic oligonucleotide; TTA chr11 5187952 5187973 5187957 5187952 -
taatctttatttattctacata

SEQ ID NO: 150013 - DNA, 22 bp, Artificial Sequence
  Synthetic oligonucleotide; CTT chr11 5187945 5187966 5187950 5187945 -
tatttattctacataatactta

SEQ ID NO: 150014 - DNA, 22 bp, Artificial Sequence
  Synthetic oligonucleotide; TTT chr11 5187944 5187965 5187949 5187944 -
atttattctacataatacttac

SEQ ID NO: 150015 - DNA, 22 bp, Artificial Sequence
  Synthetic oligonucleotide; TTA chr11 5187943 5187964 5187948 5187943 -
tttattctacataatacttaca

SEQ ID NO: 150016 - DNA, 22 bp, Artificial Sequence
  Synthetic oligonucleotide; TTT chr11 5187940 5187961 5187945 5187940 -
attctacataatacttacatgt

SEQ ID NO: 150017 - DNA, 22 bp, Artificial Sequence
  Synthetic oligonucleotide; TTA chr11 5187939 5187960 5187944 5187939 -
ttctacataatacttacatgtt

SEQ ID NO: 150018 - DNA, 22 bp, Artificial Sequence
  Synthetic oligonucleotide; TTC chr11 5187936 5187957 5187941 5187936 -
tacataatacttacatgttccc

SEQ ID NO: 150019 - DNA, 22 bp, Artificial Sequence
  Synthetic oligonucleotide; CTA chr11 5187934 5187955 5187939 5187934 -
cataatacttacatgttccctg

SEQ ID NO: 150020 - DNA, 22 bp, Artificial Sequence
  Synthetic oligonucleotide; CTT chr11 5187924 5187945 5187929 5187924 -
acatgttccctgcaaaaatatc

SEQ ID NO: 150021 - DNA, 22 bp, Artificial Sequence
  Synthetic oligonucleotide; TTA chr11 5187923 5187944 5187928 5187923 -
catgttccctgcaaaaatatct

SEQ ID NO: 150022 - DNA, 22 bp, Artificial Sequence
  Synthetic oligonucleotide; TTC chr11 5187916 5187937 5187921 5187916 -
cctgcaaaaatatctaggtata

SEQ ID NO: 150023 - DNA, 22 bp, Artificial Sequence
  Synthetic oligonucleotide; CTG chr11 5187912 5187933 5187917 5187912 -
caaaaatatctaggtatattag

SEQ ID NO: 150024 - DNA, 22 bp, Artificial Sequence
  Synthetic oligonucleotide; CTA chr11 5187900 5187921 5187905 5187900 -
ggtatattagataatcatatag

SEQ ID NO: 150025 - DNA, 22 bp, Artificial Sequence
  Synthetic oligonucleotide; TTA chr11 5187891 5187912 5187896 5187891 -
gataatcatatagatatatgat

SEQ ID NO: 150026 - DNA, 22 bp, Artificial Sequence
  Synthetic oligonucleotide; TTA chr11 5187867 5187888 5187872 5187867 -
ttaagggcataccgagattcca

SEQ ID NO: 150027 - DNA, 22 bp, Artificial Sequence
  Synthetic oligonucleotide; TTA chr11 5187864 5187885 5187869 5187864 -
agggcataccgagattccaatg

SEQ ID NO: 150028 - DNA, 22 bp, Artificial Sequence
  Synthetic oligonucleotide; TTC chr11 5187847 5187868 5187852 5187847 -
caatgatattgttacttgatgt

SEQ ID NO: 150029 - DNA, 22 bp, Artificial Sequence
  Synthetic oligonucleotide; TTG chr11 5187836 5187857 5187841 5187836 -
ttacttgatgtcaataatatta

SEQ ID NO: 150030 - DNA, 22 bp, Artificial Sequence
  Synthetic oligonucleotide; TTA chr11 5187833 5187854 5187838 5187833 -
cttgatgtcaataatattatat

SEQ ID NO: 150031 - DNA, 22 bp, Artificial Sequence
  Synthetic oligonucleotide; CTT chr11 5187830 5187851 5187835 5187830 -
gatgtcaataatattatataac

SEQ ID NO: 150032 - DNA, 22 bp, Artificial Sequence
  Synthetic oligonucleotide; TTG chr11 5187829 5187850 5187834 5187829 -
atgtcaataatattatataaca

SEQ ID NO: 150033 - DNA, 22 bp, Artificial Sequence
  Synthetic oligonucleotide; TTA chr11 5187814 5187835 5187819 5187814 -
tataacattcataaaaattgga

SEQ ID NO: 150034 - DNA, 22 bp, Artificial Sequence
  Synthetic oligonucleotide; TTC chr11 5187804 5187825 5187809 5187804 -
ataaaaattggaaaattatttt

SEQ ID NO: 150035 - DNA, 22 bp, Artificial Sequence
  Synthetic oligonucleotide; TTG chr11 5187794 5187815 5187799 5187794 -
gaaaattatttttctaaagcat

SEQ ID NO: 150036 - DNA, 22 bp, Artificial Sequence
  Synthetic oligonucleotide; TTA chr11 5187786 5187807 5187791 5187786 -
tttttctaaagcatgtggctca

SEQ ID NO: 150037 - DNA, 22 bp, Artificial Sequence
  Synthetic oligonucleotide; TTT chr11 5187783 5187804 5187788 5187783 -
ttctaaagcatgtggctcaaag

SEQ ID NO: 150038 - DNA, 22 bp, Artificial Sequence
  Synthetic oligonucleotide; TTT chr11 5187782 5187803 5187787 5187782 -
tctaaagcatgtggctcaaaga

SEQ ID NO: 150039 - DNA, 22 bp, Artificial Sequence
  Synthetic oligonucleotide; TTT chr11 5187781 5187802 5187786 5187781 -
ctaaagcatgtggctcaaagac

SEQ ID NO: 150040 - DNA, 22 bp, Artificial Sequence
  Synthetic oligonucleotide; TTC chr11 5187780 5187801 5187785 5187780 -
taaagcatgtggctcaaagact

SEQ ID NO: 150041 - DNA, 22 bp, Artificial Sequence
  Synthetic oligonucleotide; CTA chr11 5187778 5187799 5187783 5187778 -
aagcatgtggctcaaagactgt

SEQ ID NO: 150042 - DNA, 22 bp, Artificial Sequence
  Synthetic oligonucleotide; CTC chr11 5187765 5187786 5187770 5187765 -
aaagactgtagacttctataag

SEQ ID NO: 150043 - DNA, 22 bp, Artificial Sequence
  Synthetic oligonucleotide; CTG chr11 5187757 5187778 5187762 5187757 -
tagacttctataagaaaactaa

SEQ ID NO: 150044 - DNA, 22 bp, Artificial Sequence
  Synthetic oligonucleotide; CTT chr11 5187750 5187771 5187755 5187750 -
ctataagaaaactaaacatatt

SEQ ID NO: 150045 - DNA, 22 bp, Artificial Sequence
  Synthetic oligonucleotide; TTC chr11 5187749 5187770 5187754 5187749 -
tataagaaaactaaacatatta

SEQ ID NO: 150046 - DNA, 22 bp, Artificial Sequence
  Synthetic oligonucleotide; CTA chr11 5187747 5187768 5187752 5187747 -
taagaaaactaaacatattaaa

SEQ ID NO: 150047 - DNA, 22 bp, Artificial Sequence
  Synthetic oligonucleotide; CTA chr11 5187736 5187757 5187741 5187736 -
aacatattaaattaaacatatc

SEQ ID NO: 150048 - DNA, 22 bp, Artificial Sequence
  Synthetic oligonucleotide; TTA chr11 5187727 5187748 5187732 5187727 -
aattaaacatatcaataactat

SEQ ID NO: 150049 - DNA, 22 bp, Artificial Sequence
  Synthetic oligonucleotide; TTA chr11 5187722 5187743 5187727 5187722 -
aacatatcaataactattattt

SEQ ID NO: 150050 - DNA, 22 bp, Artificial Sequence
  Synthetic oligonucleotide; CTA chr11 5187706 5187727 5187711 5187706 -
ttatttcatctgcatagaatat

SEQ ID NO: 150051 - DNA, 22 bp, Artificial Sequence
  Synthetic oligonucleotide; TTA chr11 5187703 5187724 5187708 5187703 -
tttcatctgcatagaatattgc

SEQ ID NO: 150052 - DNA, 22 bp, Artificial Sequence
  Synthetic oligonucleotide; TTT chr11 5187700 5187721 5187705 5187700 -
catctgcatagaatattgctga

SEQ ID NO: 150053 - DNA, 22 bp, Artificial Sequence
  Synthetic oligonucleotide; TTC chr11 5187699 5187720 5187704 5187699 -
atctgcatagaatattgctgaa

SEQ ID NO: 150054 - DNA, 22 bp, Artificial Sequence
  Synthetic oligonucleotide; CTG chr11 5187694 5187715 5187699 5187694 -
catagaatattgctgaaggtgt

SEQ ID NO: 150055 - DNA, 22 bp, Artificial Sequence
  Synthetic oligonucleotide; TTG chr11 5187682 5187703 5187687 5187682 -
ctgaaggtgtgttttaaagtag

SEQ ID NO: 150056 - DNA, 22 bp, Artificial Sequence
  Synthetic oligonucleotide; CTG chr11 5187679 5187700 5187684 5187679 -
aaggtgtgttttaaagtagtaa

SEQ ID NO: 150057 - DNA, 22 bp, Artificial Sequence
  Synthetic oligonucleotide; TTT chr11 5187668 5187689 5187673 5187668 -
taaagtagtaacatggtacttg

SEQ ID NO: 150058 - DNA, 22 bp, Artificial Sequence
  Synthetic oligonucleotide; TTT chr11 5187667 5187688 5187672 5187667 -
aaagtagtaacatggtacttgt

SEQ ID NO: 150059 - DNA, 22 bp, Artificial Sequence
  Synthetic oligonucleotide; TTA chr11 5187666 5187687 5187671 5187666 -
aagtagtaacatggtacttgta

SEQ ID NO: 150060 - DNA, 22 bp, Artificial Sequence
  Synthetic oligonucleotide; CTT chr11 5187647 5187668 5187652 5187647 -
gtatcacagcagccgtagtttg

SEQ ID NO: 150061 - DNA, 22 bp, Artificial Sequence
  Synthetic oligonucleotide; TTG chr11 5187646 5187667 5187651 5187646 -
tatcacagcagccgtagtttgg

SEQ ID NO: 150062 - DNA, 22 bp, Artificial Sequence
  Synthetic oligonucleotide; TTT chr11 5187626 5187647 5187631 5187626 -
ggatcactgccctcttgcatat

SEQ ID NO: 150063 - DNA, 22 bp, Artificial Sequence
  Synthetic oligonucleotide; TTG chr11 5187625 5187646 5187630 5187625 -
gatcactgccctcttgcatatt

SEQ ID NO: 150064 - DNA, 22 bp, Artificial Sequence
  Synthetic oligonucleotide; CTG chr11 5187617 5187638 5187622 5187617 -
ccctcttgcatattatatttat

SEQ ID NO: 150065 - DNA, 22 bp, Artificial Sequence
  Synthetic oligonucleotide; CTC chr11 5187612 5187633 5187617 5187612 -
ttgcatattatatttatcagaa

SEQ ID NO: 150066 - DNA, 22 bp, Artificial Sequence
  Synthetic oligonucleotide; CTT chr11 5187610 5187631 5187615 5187610 -
gcatattatatttatcagaaat

SEQ ID NO: 150067 - DNA, 22 bp, Artificial Sequence
  Synthetic oligonucleotide; TTG chr11 5187609 5187630 5187614 5187609 -
catattatatttatcagaaatc

SEQ ID NO: 150068 - DNA, 22 bp, Artificial Sequence
  Synthetic oligonucleotide; TTA chr11 5187602 5187623 5187607 5187602 -
tatttatcagaaatcattattt

SEQ ID NO: 150069 - DNA, 22 bp, Artificial Sequence
  Synthetic oligonucleotide; TTT chr11 5187597 5187618 5187602 5187597 -
atcagaaatcattatttactga

SEQ ID NO: 150070 - DNA, 22 bp, Artificial Sequence
  Synthetic oligonucleotide; TTA chr11 5187596 5187617 5187601 5187596 -
tcagaaatcattatttactgaa

SEQ ID NO: 150071 - DNA, 22 bp, Artificial Sequence
  Synthetic oligonucleotide; TTA chr11 5187583 5187604 5187588 5187583 -
tttactgaaaacatttgctcaa

SEQ ID NO: 150072 - DNA, 22 bp, Artificial Sequence
  Synthetic oligonucleotide; TTT chr11 5187580 5187601 5187585 5187580 -
actgaaaacatttgctcaaaaa

SEQ ID NO: 150073 - DNA, 22 bp, Artificial Sequence
  Synthetic oligonucleotide; TTA chr11 5187579 5187600 5187584 5187579 -
ctgaaaacatttgctcaaaaaa

SEQ ID NO: 150074 - DNA, 22 bp, Artificial Sequence
  Synthetic oligonucleotide; CTG chr11 5187576 5187597 5187581 5187576 -
aaaacatttgctcaaaaaaaaa

SEQ ID NO: 150075 - DNA, 22 bp, Artificial Sequence
  Synthetic oligonucleotide; TTT chr11 5187567 5187588 5187572 5187567 -
gctcaaaaaaaaattcttcaag

SEQ ID NO: 150076 - DNA, 22 bp, Artificial Sequence
  Synthetic oligonucleotide; TTG chr11 5187566 5187587 5187571 5187566 -
ctcaaaaaaaaattcttcaagt

SEQ ID NO: 150077 - DNA, 22 bp, Artificial Sequence
  Synthetic oligonucleotide; CTC chr11 5187563 5187584 5187568 5187563 -
aaaaaaaaattcttcaagtttt

SEQ ID NO: 150078 - DNA, 22 bp, Artificial Sequence
  Synthetic oligonucleotide; TTC chr11 5187551 5187572 5187556 5187551 -
ttcaagttttagagtccccaga

SEQ ID NO: 150079 - DNA, 22 bp, Artificial Sequence
  Synthetic oligonucleotide; CTT chr11 5187549 5187570 5187554 5187549 -
caagttttagagtccccagatt

SEQ ID NO: 150080 - DNA, 22 bp, Artificial Sequence
  Synthetic oligonucleotide; TTC chr11 5187548 5187569 5187553 5187548 -
aagttttagagtccccagattt

SEQ ID NO: 150081 - DNA, 22 bp, Artificial Sequence
  Synthetic oligonucleotide; TTT chr11 5187542 5187563 5187547 5187542 -
tagagtccccagatttaaaaac

SEQ ID NO: 150082 - DNA, 22 bp, Artificial Sequence
  Synthetic oligonucleotide; TTT chr11 5187541 5187562 5187546 5187541 -
agagtccccagatttaaaaaca

SEQ ID NO: 150083 - DNA, 22 bp, Artificial Sequence
  Synthetic oligonucleotide; TTA chr11 5187540 5187561 5187545 5187540 -
gagtccccagatttaaaaacat

SEQ ID NO: 150084 - DNA, 22 bp, Artificial Sequence
  Synthetic oligonucleotide; TTT chr11 5187526 5187547 5187531 5187526 -
aaaaacattataataagttatc

SEQ ID NO: 150085 - DNA, 22 bp, Artificial Sequence
  Synthetic oligonucleotide; TTA chr11 5187525 5187546 5187530 5187525 -
aaaacattataataagttatca

SEQ ID NO: 150086 - DNA, 22 bp, Artificial Sequence
  Synthetic oligonucleotide; TTA chr11 5187516 5187537 5187521 5187516 -
taataagttatcagcagagtat

SEQ ID NO: 150087 - DNA, 22 bp, Artificial Sequence
  Synthetic oligonucleotide; TTA chr11 5187506 5187527 5187511 5187506 -
tcagcagagtatacctcttgga

SEQ ID NO: 150088 - DNA, 22 bp, Artificial Sequence
  Synthetic oligonucleotide; CTC chr11 5187489 5187510 5187494 5187489 -
ttggattctattctttgttctt

SEQ ID NO: 150089 - DNA, 22 bp, Artificial Sequence
  Synthetic oligonucleotide; CTT chr11 5187487 5187508 5187492 5187487 -
ggattctattctttgttcttcc

SEQ ID NO: 150090 - DNA, 22 bp, Artificial Sequence
  Synthetic oligonucleotide; TTG chr11 5187486 5187507 5187491 5187486 -
gattctattctttgttcttcct

SEQ ID NO: 150091 - DNA, 22 bp, Artificial Sequence
  Synthetic oligonucleotide; TTC chr11 5187481 5187502 5187486 5187481 -
tattctttgttcttcctgtcac

SEQ ID NO: 150092 - DNA, 22 bp, Artificial Sequence
  Synthetic oligonucleotide; CTA chr11 5187479 5187500 5187484 5187479 -
ttctttgttcttcctgtcacta

SEQ ID NO: 150093 - DNA, 22 bp, Artificial Sequence
  Synthetic oligonucleotide; TTC chr11 5187476 5187497 5187481 5187476 -
tttgttcttcctgtcactatca

SEQ ID NO: 150094 - DNA, 22 bp, Artificial Sequence
  Synthetic oligonucleotide; CTT chr11 5187474 5187495 5187479 5187474 -
tgttcttcctgtcactatcagg

SEQ ID NO: 150095 - DNA, 22 bp, Artificial Sequence
  Synthetic oligonucleotide; TTT chr11 5187473 5187494 5187478 5187473 -
gttcttcctgtcactatcaggt

SEQ ID NO: 150096 - DNA, 22 bp, Artificial Sequence
  Synthetic oligonucleotide; TTG chr11 5187472 5187493 5187477 5187472 -
ttcttcctgtcactatcaggta

SEQ ID NO: 150097 - DNA, 22 bp, Artificial Sequence
  Synthetic oligonucleotide; TTC chr11 5187469 5187490 5187474 5187469 -
ttcctgtcactatcaggtagtc

SEQ ID NO: 150098 - DNA, 22 bp, Artificial Sequence
  Synthetic oligonucleotide; CTT chr11 5187467 5187488 5187472 5187467 -
cctgtcactatcaggtagtcag

SEQ ID NO: 150099 - DNA, 22 bp, Artificial Sequence
  Synthetic oligonucleotide; TTC chr11 5187466 5187487 5187471 5187466 -
ctgtcactatcaggtagtcaga

SEQ ID NO: 150100 - DNA, 22 bp, Artificial Sequence
  Synthetic oligonucleotide; CTG chr11 5187463 5187484 5187468 5187463 -
tcactatcaggtagtcagatgc

SEQ ID NO: 150101 - DNA, 22 bp, Artificial Sequence
  Synthetic oligonucleotide; CTA chr11 5187457 5187478 5187462 5187457 -
tcaggtagtcagatgcagacat

SEQ ID NO: 150102 - DNA, 22 bp, Artificial Sequence
  Synthetic oligonucleotide; TTT chr11 5187429 5187450 5187434 5187429 -
ctgttgtcccctaaattctcct

SEQ ID NO: 150103 - DNA, 22 bp, Artificial Sequence
  Synthetic oligonucleotide; TTC chr11 5187428 5187449 5187433 5187428 -
tgttgtcccctaaattctcctt

SEQ ID NO: 150104 - DNA, 22 bp, Artificial Sequence
  Synthetic oligonucleotide; CTG chr11 5187426 5187447 5187431 5187426 -
ttgtcccctaaattctccttgt

SEQ ID NO: 150105 - DNA, 22 bp, Artificial Sequence
  Synthetic oligonucleotide; TTG chr11 5187423 5187444 5187428 5187423 -
tcccctaaattctccttgtcct

SEQ ID NO: 150106 - DNA, 22 bp, Artificial Sequence
  Synthetic oligonucleotide; CTA chr11 5187416 5187437 5187421 5187416 -
aattctccttgtcctttctcca

SEQ ID NO: 150107 - DNA, 22 bp, Artificial Sequence
  Synthetic oligonucleotide; TTC chr11 5187411 5187432 5187416 5187411 -
tccttgtcctttctccatctct

SEQ ID NO: 150108 - DNA, 22 bp, Artificial Sequence
  Synthetic oligonucleotide; CTC chr11 5187409 5187430 5187414 5187409 -
cttgtcctttctccatctcttt

SEQ ID NO: 150109 - DNA, 22 bp, Artificial Sequence
  Synthetic oligonucleotide; CTT chr11 5187406 5187427 5187411 5187406 -
gtcctttctccatctctttttc

SEQ ID NO: 150110 - DNA, 22 bp, Artificial Sequence
  Synthetic oligonucleotide; TTG chr11 5187405 5187426 5187410 5187405 -
tcctttctccatctctttttct

SEQ ID NO: 150111 - DNA, 22 bp, Artificial Sequence
  Synthetic oligonucleotide; CTT chr11 5187400 5187421 5187405 5187400 -
tctccatctctttttctataat

SEQ ID NO: 150112 - DNA, 22 bp, Artificial Sequence
  Synthetic oligonucleotide; TTT chr11 5187399 5187420 5187404 5187399 -
ctccatctctttttctataata

SEQ ID NO: 150113 - DNA, 22 bp, Artificial Sequence
  Synthetic oligonucleotide; TTC chr11 5187398 5187419 5187403 5187398 -
tccatctctttttctataatat

SEQ ID NO: 150114 - DNA, 22 bp, Artificial Sequence
  Synthetic oligonucleotide; CTC chr11 5187396 5187417 5187401 5187396 -
catctctttttctataatatcc

SEQ ID NO: 150115 - DNA, 22 bp, Artificial Sequence
  Synthetic oligonucleotide; CTC chr11 5187390 5187411 5187395 5187390 -
tttttctataatatcctttgat

SEQ ID NO: 150116 - DNA, 22 bp, Artificial Sequence
  Synthetic oligonucleotide; CTT chr11 5187388 5187409 5187393 5187388 -
tttctataatatcctttgattc

SEQ ID NO: 150117 - DNA, 22 bp, Artificial Sequence
  Synthetic oligonucleotide; TTT chr11 5187387 5187408 5187392 5187387 -
ttctataatatcctttgattcc

SEQ ID NO: 150118 - DNA, 22 bp, Artificial Sequence
  Synthetic oligonucleotide; TTT chr11 5187386 5187407 5187391 5187386 -
tctataatatcctttgattcct

SEQ ID NO: 150119 - DNA, 22 bp, Artificial Sequence
  Synthetic oligonucleotide; TTT chr11 5187385 5187406 5187390 5187385 -
ctataatatcctttgattcctt

SEQ ID NO: 150120 - DNA, 22 bp, Artificial Sequence
  Synthetic oligonucleotide; TTC chr11 5187384 5187405 5187389 5187384 -
tataatatcctttgattccttt

SEQ ID NO: 150121 - DNA, 22 bp, Artificial Sequence
  Synthetic oligonucleotide; CTA chr11 5187382 5187403 5187387 5187382 -
taatatcctttgattcctttaa

SEQ ID NO: 150122 - DNA, 22 bp, Artificial Sequence
  Synthetic oligonucleotide; CTT chr11 5187372 5187393 5187377 5187372 -
tgattcctttaatttcttttcc

SEQ ID NO: 150123 - DNA, 22 bp, Artificial Sequence
  Synthetic oligonucleotide; TTT chr11 5187371 5187392 5187376 5187371 -
gattcctttaatttcttttcca

SEQ ID NO: 150124 - DNA, 22 bp, Artificial Sequence
  Synthetic oligonucleotide; TTG chr11 5187370 5187391 5187375 5187370 -
attcctttaatttcttttccaa

SEQ ID NO: 150125 - DNA, 22 bp, Artificial Sequence
  Synthetic oligonucleotide; TTC chr11 5187366 5187387 5187371 5187366 -
ctttaatttcttttccaaggat

SEQ ID NO: 150126 - DNA, 22 bp, Artificial Sequence
  Synthetic oligonucleotide; CTT chr11 5187363 5187384 5187368 5187363 -
taatttcttttccaaggatagg

SEQ ID NO: 150127 - DNA, 22 bp, Artificial Sequence
  Synthetic oligonucleotide; TTT chr11 5187362 5187383 5187367 5187362 -
aatttcttttccaaggataggt

SEQ ID NO: 150128 - DNA, 22 bp, Artificial Sequence
  Synthetic oligonucleotide; TTA chr11 5187361 5187382 5187366 5187361 -
atttcttttccaaggataggtg

SEQ ID NO: 150129 - DNA, 22 bp, Artificial Sequence
  Synthetic oligonucleotide; TTT chr11 5187357 5187378 5187362 5187357 -
cttttccaaggataggtgggaa

SEQ ID NO: 150130 - DNA, 22 bp, Artificial Sequence
  Synthetic oligonucleotide; TTC chr11 5187356 5187377 5187361 5187356 -
ttttccaaggataggtgggaag

SEQ ID NO: 150131 - DNA, 22 bp, Artificial Sequence
  Synthetic oligonucleotide; CTT chr11 5187354 5187375 5187359 5187354 -
ttccaaggataggtgggaagat

SEQ ID NO: 150132 - DNA, 22 bp, Artificial Sequence
  Synthetic oligonucleotide; TTT chr11 5187353 5187374 5187358 5187353 -
tccaaggataggtgggaagata

SEQ ID NO: 150133 - DNA, 22 bp, Artificial Sequence
  Synthetic oligonucleotide; TTT chr11 5187352 5187373 5187357 5187352 -
ccaaggataggtgggaagataa

SEQ ID NO: 150134 - DNA, 22 bp, Artificial Sequence
  Synthetic oligonucleotide; TTC chr11 5187351 5187372 5187356 5187351 -
caaggataggtgggaagataag

SEQ ID NO: 150135 - DNA, 22 bp, Artificial Sequence
  Synthetic oligonucleotide; CTG chr11 5187324 5187345 5187329 5187324 -
tcctttctttaatgtctaaaaa

SEQ ID NO: 150136 - DNA, 22 bp, Artificial Sequence
  Synthetic oligonucleotide; CTT chr11 5187319 5187340 5187324 5187319 -
tctttaatgtctaaaaaagcaa

SEQ ID NO: 150137 - DNA, 22 bp, Artificial Sequence
  Synthetic oligonucleotide; TTT chr11 5187318 5187339 5187323 5187318 -
ctttaatgtctaaaaaagcaag

SEQ ID NO: 150138 - DNA, 22 bp, Artificial Sequence
  Synthetic oligonucleotide; TTC chr11 5187317 5187338 5187322 5187317 -
tttaatgtctaaaaaagcaagg

SEQ ID NO: 150139 - DNA, 22 bp, Artificial Sequence
  Synthetic oligonucleotide; CTT chr11 5187315 5187336 5187320 5187315 -
taatgtctaaaaaagcaaggtg

SEQ ID NO: 150140 - DNA, 22 bp, Artificial Sequence
  Synthetic oligonucleotide; TTT chr11 5187314 5187335 5187319 5187314 -
aatgtctaaaaaagcaaggtga

SEQ ID NO: 150141 - DNA, 22 bp, Artificial Sequence
  Synthetic oligonucleotide; TTA chr11 5187313 5187334 5187318 5187313 -
atgtctaaaaaagcaaggtgaa

SEQ ID NO: 150142 - DNA, 22 bp, Artificial Sequence
  Synthetic oligonucleotide; CTA chr11 5187306 5187327 5187311 5187306 -
aaaaagcaaggtgaagccatcc

SEQ ID NO: 150143 - DNA, 22 bp, Artificial Sequence
  Synthetic oligonucleotide; TTT chr11 5187279 5187300 5187284 5187279 -
accctcactatggtttcaagac

SEQ ID NO: 150144 - DNA, 22 bp, Artificial Sequence
  Synthetic oligonucleotide; TTA chr11 5187278 5187299 5187283 5187278 -
ccctcactatggtttcaagacc

SEQ ID NO: 150145 - DNA, 22 bp, Artificial Sequence
  Synthetic oligonucleotide; CTC chr11 5187273 5187294 5187278 5187273 -
actatggtttcaagacctttga

SEQ ID NO: 150146 - DNA, 22 bp, Artificial Sequence
  Synthetic oligonucleotide; CTA chr11 5187269 5187290 5187274 5187269 -
tggtttcaagacctttgaatgg

SEQ ID NO: 150147 - DNA, 22 bp, Artificial Sequence
  Synthetic oligonucleotide; TTT chr11 5187263 5187284 5187268 5187263 -
caagacctttgaatggaaagca

SEQ ID NO: 150148 - DNA, 22 bp, Artificial Sequence
  Synthetic oligonucleotide; TTC chr11 5187262 5187283 5187267 5187262 -
aagacctttgaatggaaagcac

SEQ ID NO: 150149 - DNA, 22 bp, Artificial Sequence
  Synthetic oligonucleotide; CTT chr11 5187254 5187275 5187259 5187254 -
tgaatggaaagcacttgaaatg

SEQ ID NO: 150150 - DNA, 22 bp, Artificial Sequence
  Synthetic oligonucleotide; TTT chr11 5187253 5187274 5187258 5187253 -
gaatggaaagcacttgaaatgc

SEQ ID NO: 150151 - DNA, 22 bp, Artificial Sequence
  Synthetic oligonucleotide; TTG chr11 5187252 5187273 5187257 5187252 -
aatggaaagcacttgaaatgca

SEQ ID NO: 150152 - DNA, 22 bp, Artificial Sequence
  Synthetic oligonucleotide; CTT chr11 5187238 5187259 5187243 5187238 -
gaaatgcatgtgataattctta

SEQ ID NO: 150153 - DNA, 22 bp, Artificial Sequence
  Synthetic oligonucleotide; TTG chr11 5187237 5187258 5187242 5187237 -
aaatgcatgtgataattcttat

SEQ ID NO: 150154 - DNA, 22 bp, Artificial Sequence
  Synthetic oligonucleotide; TTC chr11 5187219 5187240 5187224 5187219 -
ttatatctcccaccatatagca

SEQ ID NO: 150155 - DNA, 22 bp, Artificial Sequence
  Synthetic oligonucleotide; CTT chr11 5187217 5187238 5187222 5187217 -
atatctcccaccatatagcact

SEQ ID NO: 150156 - DNA, 22 bp, Artificial Sequence
  Synthetic oligonucleotide; TTA chr11 5187216 5187237 5187221 5187216 -
tatctcccaccatatagcactc

SEQ ID NO: 150157 - DNA, 22 bp, Artificial Sequence
  Synthetic oligonucleotide; CTC chr11 5187210 5187231 5187215 5187210 -
ccaccatatagcactcacactt

SEQ ID NO: 150158 - DNA, 22 bp, Artificial Sequence
  Synthetic oligonucleotide; CTC chr11 5187194 5187215 5187199 5187194 -
acacttacgtaataaaatatga

SEQ ID NO: 150159 - DNA, 22 bp, Artificial Sequence
  Synthetic oligonucleotide; CTT chr11 5187188 5187209 5187193 5187188 -
acgtaataaaatatgacctctc

SEQ ID NO: 150160 - DNA, 22 bp, Artificial Sequence
  Synthetic oligonucleotide; TTA chr11 5187187 5187208 5187192 5187187 -
cgtaataaaatatgacctctct

SEQ ID NO: 150161 - DNA, 22 bp, Artificial Sequence
  Synthetic oligonucleotide; CTC chr11 5187168 5187189 5187173 5187168 -
tcttagccagtgagaactaaga

SEQ ID NO: 150162 - DNA, 22 bp, Artificial Sequence
  Synthetic oligonucleotide; CTC chr11 5187166 5187187 5187171 5187166 -
ttagccagtgagaactaagatg

SEQ ID NO: 150163 - DNA, 22 bp, Artificial Sequence
  Synthetic oligonucleotide; CTT chr11 5187164 5187185 5187169 5187164 -
agccagtgagaactaagatgcc

SEQ ID NO: 150164 - DNA, 22 bp, Artificial Sequence
  Synthetic oligonucleotide; TTA chr11 5187163 5187184 5187168 5187163 -
gccagtgagaactaagatgcct

SEQ ID NO: 150165 - DNA, 22 bp, Artificial Sequence
  Synthetic oligonucleotide; CTA chr11 5187149 5187170 5187154 5187149 -
agatgcctagatgactgattgg

SEQ ID NO: 150166 - DNA, 22 bp, Artificial Sequence
  Synthetic oligonucleotide; CTA chr11 5187140 5187161 5187145 5187140 -
gatgactgattggaggacctgg

SEQ ID NO: 150167 - DNA, 22 bp, Artificial Sequence
  Synthetic oligonucleotide; CTG chr11 5187132 5187153 5187137 5187132 -
attggaggacctgggcacttgc

SEQ ID NO: 150168 - DNA, 22 bp, Artificial Sequence
  Synthetic oligonucleotide; TTG chr11 5187128 5187149 5187133 5187128 -
gaggacctgggcacttgcctag

SEQ ID NO: 150169 - DNA, 22 bp, Artificial Sequence
  Synthetic oligonucleotide; CTG chr11 5187119 5187140 5187124 5187119 -
ggcacttgcctagcatccaatc

SEQ ID NO: 150170 - DNA, 22 bp, Artificial Sequence
  Synthetic oligonucleotide; CTT chr11 5187112 5187133 5187117 5187112 -
gcctagcatccaatcaagatca

SEQ ID NO: 150171 - DNA, 22 bp, Artificial Sequence
  Synthetic oligonucleotide; TTG chr11 5187111 5187132 5187116 5187111 -
cctagcatccaatcaagatcat

SEQ ID NO: 150172 - DNA, 22 bp, Artificial Sequence
  Synthetic oligonucleotide; CTA chr11 5187107 5187128 5187112 5187107 -
gcatccaatcaagatcatccag

SEQ ID NO: 150173 - DNA, 22 bp, Artificial Sequence
  Synthetic oligonucleotide; CTG chr11 5187072 5187093 5187077 5187072 -
atgtcaaacatcatatttatag

SEQ ID NO: 150174 - DNA, 22 bp, Artificial Sequence
  Synthetic oligonucleotide; TTT chr11 5187054 5187075 5187059 5187054 -
atagggaagttttactattttt

SEQ ID NO: 150175 - DNA, 22 bp, Artificial Sequence
  Synthetic oligonucleotide; TTA chr11 5187053 5187074 5187058 5187053 -
tagggaagttttactatttttt

SEQ ID NO: 150176 - DNA, 22 bp, Artificial Sequence
  Synthetic oligonucleotide; TTT chr11 5187042 5187063 5187047 5187042 -
tactatttttttttactaagtt

SEQ ID NO: 150177 - DNA, 22 bp, Artificial Sequence
  Synthetic oligonucleotide; TTT chr11 5187041 5187062 5187046 5187041 -
actatttttttttactaagttt

SEQ ID NO: 150178 - DNA, 22 bp, Artificial Sequence
  Synthetic oligonucleotide; TTA chr11 5187040 5187061 5187045 5187040 -
ctatttttttttactaagtttt

SEQ ID NO: 150179 - DNA, 22 bp, Artificial Sequence
  Synthetic oligonucleotide; CTA chr11 5187037 5187058 5187042 5187037 -
tttttttttactaagttttact

SEQ ID NO: 150180 - DNA, 22 bp, Artificial Sequence
  Synthetic oligonucleotide; TTT chr11 5187034 5187055 5187039 5187034 -
ttttttactaagttttactact

SEQ ID NO: 150181 - DNA, 22 bp, Artificial Sequence
  Synthetic oligonucleotide; TTT chr11 5187033 5187054 5187038 5187033 -
tttttactaagttttactacta

SEQ ID NO: 150182 - DNA, 22 bp, Artificial Sequence
  Synthetic oligonucleotide; TTT chr11 5187032 5187053 5187037 5187032 -
ttttactaagttttactactat

SEQ ID NO: 150183 - DNA, 22 bp, Artificial Sequence
  Synthetic oligonucleotide; TTT chr11 5187031 5187052 5187036 5187031 -
tttactaagttttactactata

SEQ ID NO: 150184 - DNA, 22 bp, Artificial Sequence
  Synthetic oligonucleotide; TTT chr11 5187030 5187051 5187035 5187030 -
ttactaagttttactactatag

SEQ ID NO: 150185 - DNA, 22 bp, Artificial Sequence
  Synthetic oligonucleotide; TTT chr11 5187029 5187050 5187034 5187029 -
tactaagttttactactatagg

SEQ ID NO: 150186 - DNA, 22 bp, Artificial Sequence
  Synthetic oligonucleotide; TTT chr11 5187028 5187049 5187033 5187028 -
actaagttttactactataggt

SEQ ID NO: 150187 - DNA, 22 bp, Artificial Sequence
  Synthetic oligonucleotide; TTA chr11 5187027 5187048 5187032 5187027 -
ctaagttttactactataggtg

SEQ ID NO: 150188 - DNA, 22 bp, Artificial Sequence
  Synthetic oligonucleotide; CTA chr11 5187024 5187045 5187029 5187024 -
agttttactactataggtgaaa

SEQ ID NO: 150189 - DNA, 22 bp, Artificial Sequence
  Synthetic oligonucleotide; TTT chr11 5187019 5187040 5187024 5187019 -
tactactataggtgaaaaaagc

SEQ ID NO: 150190 - DNA, 22 bp, Artificial Sequence
  Synthetic oligonucleotide; TTT chr11 5187018 5187039 5187023 5187018 -
actactataggtgaaaaaagct

SEQ ID NO: 150191 - DNA, 22 bp, Artificial Sequence
  Synthetic oligonucleotide; TTA chr11 5187017 5187038 5187022 5187017 -
ctactataggtgaaaaaagctt

SEQ ID NO: 150192 - DNA, 22 bp, Artificial Sequence
  Synthetic oligonucleotide; CTA chr11 5187014 5187035 5187019 5187014 -
ctataggtgaaaaaagcttcta

SEQ ID NO: 150193 - DNA, 22 bp, Artificial Sequence
  Synthetic oligonucleotide; CTA chr11 5187011 5187032 5187016 5187011 -
taggtgaaaaaagcttctaggg

SEQ ID NO: 150194 - DNA, 22 bp, Artificial Sequence
  Synthetic oligonucleotide; CTT chr11 5186995 5187016 5187000 5186995 -
ctagggattctttgaaaaatat

SEQ ID NO: 150195 - DNA, 22 bp, Artificial Sequence
  Synthetic oligonucleotide; TTC chr11 5186994 5187015 5186999 5186994 -
tagggattctttgaaaaatatc

SEQ ID NO: 150196 - DNA, 22 bp, Artificial Sequence
  Synthetic oligonucleotide; CTA chr11 5186992 5187013 5186997 5186992 -
gggattctttgaaaaatatcag

SEQ ID NO: 150197 - DNA, 22 bp, Artificial Sequence
  Synthetic oligonucleotide; TTC chr11 5186985 5187006 5186990 5186985 -
tttgaaaaatatcagaaaatca

SEQ ID NO: 150198 - DNA, 22 bp, Artificial Sequence
  Synthetic oligonucleotide; CTT chr11 5186983 5187004 5186988 5186983 -
tgaaaaatatcagaaaatcaca

SEQ ID NO: 150199 - DNA, 22 bp, Artificial Sequence
  Synthetic oligonucleotide; TTT chr11 5186982 5187003 5186987 5186982 -
gaaaaatatcagaaaatcacag

SEQ ID NO: 150200 - DNA, 22 bp, Artificial Sequence
  Synthetic oligonucleotide; TTG chr11 5186981 5187002 5186986 5186981 -
aaaaatatcagaaaatcacaga

SEQ ID NO: 150201 - DNA, 22 bp, Artificial Sequence
  Synthetic oligonucleotide; CTC chr11 5186945 5186966 5186950 5186945 -
cacttgagagaataaggaaaca

SEQ ID NO: 150202 - DNA, 22 bp, Artificial Sequence
  Synthetic oligonucleotide; CTT chr11 5186940 5186961 5186945 5186940 -
gagagaataaggaaacatctct

SEQ ID NO: 150203 - DNA, 22 bp, Artificial Sequence
  Synthetic oligonucleotide; TTG chr11 5186939 5186960 5186944 5186939 -
agagaataaggaaacatctctc

SEQ ID NO: 150204 - DNA, 22 bp, Artificial Sequence
  Synthetic oligonucleotide; CTC chr11 5186919 5186940 5186924 5186919 -
tctccataaatctggcttatca

SEQ ID NO: 150205 - DNA, 22 bp, Artificial Sequence
  Synthetic oligonucleotide; CTC chr11 5186917 5186938 5186922 5186917 -
tccataaatctggcttatcagt

SEQ ID NO: 150206 - DNA, 22 bp, Artificial Sequence
  Synthetic oligonucleotide; CTC chr11 5186915 5186936 5186920 5186915 -
cataaatctggcttatcagtgt

SEQ ID NO: 150207 - DNA, 22 bp, Artificial Sequence
  Synthetic oligonucleotide; CTG chr11 5186905 5186926 5186910 5186905 -
gcttatcagtgtgaagccagtt

SEQ ID NO: 150208 - DNA, 22 bp, Artificial Sequence
  Synthetic oligonucleotide; CTT chr11 5186901 5186922 5186906 5186901 -
atcagtgtgaagccagttttta

SEQ ID NO: 150209 - DNA, 22 bp, Artificial Sequence
  Synthetic oligonucleotide; TTA chr11 5186900 5186921 5186905 5186900 -
tcagtgtgaagccagtttttaa

SEQ ID NO: 150210 - DNA, 22 bp, Artificial Sequence
  Synthetic oligonucleotide; TTT chr11 5186882 5186903 5186887 5186882 -
ttaattccatgaatatcatggt

SEQ ID NO: 150211 - DNA, 22 bp, Artificial Sequence
  Synthetic oligonucleotide; TTT chr11 5186881 5186902 5186886 5186881 -
taattccatgaatatcatggta

SEQ ID NO: 150212 - DNA, 22 bp, Artificial Sequence
  Synthetic oligonucleotide; TTT chr11 5186880 5186901 5186885 5186880 -
aattccatgaatatcatggtat

SEQ ID NO: 150213 - DNA, 22 bp, Artificial Sequence
  Synthetic oligonucleotide; TTA chr11 5186879 5186900 5186884 5186879 -
attccatgaatatcatggtatt

SEQ ID NO: 150214 - DNA, 22 bp, Artificial Sequence
  Synthetic oligonucleotide; TTC chr11 5186875 5186896 5186880 5186875 -
catgaatatcatggtatttgtt

SEQ ID NO: 150215 - DNA, 22 bp, Artificial Sequence
  Synthetic oligonucleotide; TTT chr11 5186856 5186877 5186861 5186856 -
gtttctatctttttatcttcat

SEQ ID NO: 150216 - DNA, 22 bp, Artificial Sequence
  Synthetic oligonucleotide; TTG chr11 5186855 5186876 5186860 5186855 -
tttctatctttttatcttcatc

SEQ ID NO: 150217 - DNA, 22 bp, Artificial Sequence
  Synthetic oligonucleotide; TTT chr11 5186852 5186873 5186857 5186852 -
ctatctttttatcttcatctgt

SEQ ID NO: 150218 - DNA, 22 bp, Artificial Sequence
  Synthetic oligonucleotide; TTC chr11 5186851 5186872 5186856 5186851 -
tatctttttatcttcatctgta

SEQ ID NO: 150219 - DNA, 22 bp, Artificial Sequence
  Synthetic oligonucleotide; CTA chr11 5186849 5186870 5186854 5186849 -
tctttttatcttcatctgtatt

SEQ ID NO: 150220 - DNA, 22 bp, Artificial Sequence
  Synthetic oligonucleotide; CTT chr11 5186845 5186866 5186850 5186845 -
tttatcttcatctgtattcctc

SEQ ID NO: 150221 - DNA, 22 bp, Artificial Sequence
  Synthetic oligonucleotide; TTT chr11 5186844 5186865 5186849 5186844 -
ttatcttcatctgtattcctca

SEQ ID NO: 150222 - DNA, 22 bp, Artificial Sequence
  Synthetic oligonucleotide; TTT chr11 5186843 5186864 5186848 5186843 -
tatcttcatctgtattcctcat

SEQ ID NO: 150223 - DNA, 22 bp, Artificial Sequence
  Synthetic oligonucleotide; TTT chr11 5186842 5186863 5186847 5186842 -
atcttcatctgtattcctcatt

SEQ ID NO: 150224 - DNA, 22 bp, Artificial Sequence
  Synthetic oligonucleotide; TTA chr11 5186841 5186862 5186846 5186841 -
tcttcatctgtattcctcatta

SEQ ID NO: 150225 - DNA, 22 bp, Artificial Sequence
  Synthetic oligonucleotide; CTT chr11 5186837 5186858 5186842 5186837 -
catctgtattcctcattaaagt

SEQ ID NO: 150226 - DNA, 22 bp, Artificial Sequence
  Synthetic oligonucleotide; TTC chr11 5186836 5186857 5186841 5186836 -
atctgtattcctcattaaagta

SEQ ID NO: 150227 - DNA, 22 bp, Artificial Sequence
  Synthetic oligonucleotide; CTG chr11 5186831 5186852 5186836 5186831 -
tattcctcattaaagtatcctt

SEQ ID NO: 150228 - DNA, 22 bp, Artificial Sequence
  Synthetic oligonucleotide; TTC chr11 5186826 5186847 5186831 5186826 -
ctcattaaagtatccttcaaga

SEQ ID NO: 150229 - DNA, 22 bp, Artificial Sequence
  Synthetic oligonucleotide; CTC chr11 5186823 5186844 5186828 5186823 -
attaaagtatccttcaagagaa

SEQ ID NO: 150230 - DNA, 22 bp, Artificial Sequence
  Synthetic oligonucleotide; TTA chr11 5186819 5186840 5186824 5186819 -
aagtatccttcaagagaatggg

SEQ ID NO: 150231 - DNA, 22 bp, Artificial Sequence
  Synthetic oligonucleotide; CTT chr11 5186809 5186830 5186814 5186809 -
caagagaatgggatatctacag

SEQ ID NO: 150232 - DNA, 22 bp, Artificial Sequence
  Synthetic oligonucleotide; TTC chr11 5186808 5186829 5186813 5186808 -
aagagaatgggatatctacagt

SEQ ID NO: 150233 - DNA, 22 bp, Artificial Sequence
  Synthetic oligonucleotide; CTA chr11 5186790 5186811 5186795 5186790 -
cagtagctaatataatttcttg

SEQ ID NO: 150234 - DNA, 22 bp, Artificial Sequence
  Synthetic oligonucleotide; CTA chr11 5186781 5186802 5186786 5186781 -
atataatttcttggcccttcag

SEQ ID NO: 150235 - DNA, 22 bp, Artificial Sequence
  Synthetic oligonucleotide; TTT chr11 5186772 5186793 5186777 5186772 -
cttggcccttcagattctgacc

SEQ ID NO: 150236 - DNA, 22 bp, Artificial Sequence
  Synthetic oligonucleotide; TTC chr11 5186771 5186792 5186776 5186771 -
ttggcccttcagattctgaccc

SEQ ID NO: 150237 - DNA, 22 bp, Artificial Sequence
  Synthetic oligonucleotide; CTT chr11 5186769 5186790 5186774 5186769 -
ggcccttcagattctgacccat

SEQ ID NO: 150238 - DNA, 22 bp, Artificial Sequence
  Synthetic oligonucleotide; TTG chr11 5186768 5186789 5186773 5186768 -
gcccttcagattctgacccatt

SEQ ID NO: 150239 - DNA, 22 bp, Artificial Sequence
  Synthetic oligonucleotide; CTT chr11 5186762 5186783 5186767 5186762 -
cagattctgacccatttaccat

SEQ ID NO: 150240 - DNA, 22 bp, Artificial Sequence
  Synthetic oligonucleotide; TTC chr11 5186761 5186782 5186766 5186761 -
agattctgacccatttaccatg

SEQ ID NO: 150241 - DNA, 22 bp, Artificial Sequence
  Synthetic oligonucleotide; TTC chr11 5186755 5186776 5186760 5186755 -
tgacccatttaccatgtgacca

SEQ ID NO: 150242 - DNA, 22 bp, Artificial Sequence
  Synthetic oligonucleotide; CTG chr11 5186753 5186774 5186758 5186753 -
acccatttaccatgtgaccaag

SEQ ID NO: 150243 - DNA, 22 bp, Artificial Sequence
  Synthetic oligonucleotide; TTT chr11 5186745 5186766 5186750 5186745 -
accatgtgaccaagaaaaagca

SEQ ID NO: 150244 - DNA, 22 bp, Artificial Sequence
  Synthetic oligonucleotide; TTA chr11 5186744 5186765 5186749 5186744 -
ccatgtgaccaagaaaaagcag

SEQ ID NO: 150245 - DNA, 22 bp, Artificial Sequence
  Synthetic oligonucleotide; CTT chr11 5186704 5186725 5186709 5186704 -
aaaaattaaagggaaataaaat

SEQ ID NO: 150246 - DNA, 22 bp, Artificial Sequence
  Synthetic oligonucleotide; TTA chr11 5186703 5186724 5186708 5186703 -
aaaattaaagggaaataaaatg

SEQ ID NO: 150247 - DNA, 22 bp, Artificial Sequence
  Synthetic oligonucleotide; TTA chr11 5186696 5186717 5186701 5186696 -
aagggaaataaaatgagagaat

SEQ ID NO: 150248 - DNA, 22 bp, Artificial Sequence
  Synthetic oligonucleotide; TTA chr11 5186672 5186693 5186677 5186672 -
acttttaggtgccatctaagat

SEQ ID NO: 150249 - DNA, 22 bp, Artificial Sequence
  Synthetic oligonucleotide; CTT chr11 5186668 5186689 5186673 5186668 -
ttaggtgccatctaagatgtgt

SEQ ID NO: 150250 - DNA, 22 bp, Artificial Sequence
  Synthetic oligonucleotide; TTT chr11 5186667 5186688 5186672 5186667 -
taggtgccatctaagatgtgta

SEQ ID NO: 150251 - DNA, 22 bp, Artificial Sequence
  Synthetic oligonucleotide; TTT chr11 5186666 5186687 5186671 5186666 -
aggtgccatctaagatgtgtaa

SEQ ID NO: 150252 - DNA, 22 bp, Artificial Sequence
  Synthetic oligonucleotide; TTA chr11 5186665 5186686 5186670 5186665 -
ggtgccatctaagatgtgtaaa

SEQ ID NO: 150253 - DNA, 22 bp, Artificial Sequence
  Synthetic oligonucleotide; CTA chr11 5186654 5186675 5186659 5186654 -
agatgtgtaaagtccttctccc

SEQ ID NO: 150254 - DNA, 22 bp, Artificial Sequence
  Synthetic oligonucleotide; CTT chr11 5186637 5186658 5186642 5186637 -
ctcccacatgtctcctttgcaa

SEQ ID NO: 150255 - DNA, 22 bp, Artificial Sequence
  Synthetic oligonucleotide; TTC chr11 5186636 5186657 5186641 5186636 -
tcccacatgtctcctttgcaac

SEQ ID NO: 150256 - DNA, 22 bp, Artificial Sequence
  Synthetic oligonucleotide; CTC chr11 5186634 5186655 5186639 5186634 -
ccacatgtctcctttgcaacct

SEQ ID NO: 150257 - DNA, 22 bp, Artificial Sequence
  Synthetic oligonucleotide; CTC chr11 5186623 5186644 5186628 5186623 -
ctttgcaacctatatttgccaa

SEQ ID NO: 150258 - DNA, 22 bp, Artificial Sequence
  Synthetic oligonucleotide; CTT chr11 5186620 5186641 5186625 5186620 -
tgcaacctatatttgccaatgg

SEQ ID NO: 150259 - DNA, 22 bp, Artificial Sequence
  Synthetic oligonucleotide; TTT chr11 5186619 5186640 5186624 5186619 -
gcaacctatatttgccaatggc

SEQ ID NO: 150260 - DNA, 22 bp, Artificial Sequence
  Synthetic oligonucleotide; TTG chr11 5186618 5186639 5186623 5186618 -
caacctatatttgccaatggct

SEQ ID NO: 150261 - DNA, 22 bp, Artificial Sequence
  Synthetic oligonucleotide; CTA chr11 5186611 5186632 5186616 5186611 -
tatttgccaatggctcattgga

SEQ ID NO: 150262 - DNA, 22 bp, Artificial Sequence
  Synthetic oligonucleotide; TTT chr11 5186606 5186627 5186611 5186606 -
gccaatggctcattggaaacaa

SEQ ID NO: 150263 - DNA, 22 bp, Artificial Sequence
  Synthetic oligonucleotide; TTG chr11 5186605 5186626 5186610 5186605 -
ccaatggctcattggaaacaat

SEQ ID NO: 150264 - DNA, 22 bp, Artificial Sequence
  Synthetic oligonucleotide; CTC chr11 5186595 5186616 5186600 5186595 -
attggaaacaatatatgacagg

SEQ ID NO: 150265 - DNA, 22 bp, Artificial Sequence
  Synthetic oligonucleotide; TTG chr11 5186591 5186612 5186596 5186591 -
gaaacaatatatgacagggaca

SEQ ID NO: 150266 - DNA, 22 bp, Artificial Sequence
  Synthetic oligonucleotide; CTG chr11 5186560 5186581 5186565 5186560 -
gacatgtagatgtatgtattaa

SEQ ID NO: 150267 - DNA, 22 bp, Artificial Sequence
  Synthetic oligonucleotide; TTA chr11 5186539 5186560 5186544 5186539 -
acttaggtgtcagagagtggtg

SEQ ID NO: 150268 - DNA, 22 bp, Artificial Sequence
  Synthetic oligonucleotide; CTT chr11 5186535 5186556 5186540 5186535 -
aggtgtcagagagtggtggctg

SEQ ID NO: 150269 - DNA, 22 bp, Artificial Sequence
  Synthetic oligonucleotide; TTA chr11 5186534 5186555 5186539 5186534 -
ggtgtcagagagtggtggctga

SEQ ID NO: 150270 - DNA, 22 bp, Artificial Sequence
  Synthetic oligonucleotide; CTG chr11 5186513 5186534 5186518 5186513 -
aagaaaaaaaatgcacaaatta

SEQ ID NO: 150271 - DNA, 22 bp, Artificial Sequence
  Synthetic oligonucleotide; TTA chr11 5186491 5186512 5186496 5186491 -
taatgaaagagaatgcagtatg

SEQ ID NO: 150272 - DNA, 22 bp, Artificial Sequence
  Synthetic oligonucleotide; TTT chr11 5186466 5186487 5186471 5186466 -
ctccctgtggactatgtaccag

SEQ ID NO: 150273 - DNA, 22 bp, Artificial Sequence
  Synthetic oligonucleotide; TTC chr11 5186465 5186486 5186470 5186465 -
tccctgtggactatgtaccaga

SEQ ID NO: 150274 - DNA, 22 bp, Artificial Sequence
  Synthetic oligonucleotide; CTC chr11 5186463 5186484 5186468 5186463 -
cctgtggactatgtaccagaag

SEQ ID NO: 150275 - DNA, 22 bp, Artificial Sequence
  Synthetic oligonucleotide; CTG chr11 5186459 5186480 5186464 5186459 -
tggactatgtaccagaagcagc

SEQ ID NO: 150276 - DNA, 22 bp, Artificial Sequence
  Synthetic oligonucleotide; CTA chr11 5186452 5186473 5186457 5186452 -
tgtaccagaagcagctctgtgt

SEQ ID NO: 150277 - DNA, 22 bp, Artificial Sequence
  Synthetic oligonucleotide; CTC chr11 5186435 5186456 5186440 5186435 -
tgtgtcatctccttccatggga

SEQ ID NO: 150278 - DNA, 22 bp, Artificial Sequence
  Synthetic oligonucleotide; CTG chr11 5186433 5186454 5186438 5186433 -
tgtcatctccttccatgggagg

SEQ ID NO: 150279 - DNA, 22 bp, Artificial Sequence
  Synthetic oligonucleotide; CTC chr11 5186424 5186445 5186429 5186424 -
cttccatgggaggagtaaaatt

SEQ ID NO: 150280 - DNA, 22 bp, Artificial Sequence
  Synthetic oligonucleotide; CTT chr11 5186421 5186442 5186426 5186421 -
ccatgggaggagtaaaattcgt

SEQ ID NO: 150281 - DNA, 22 bp, Artificial Sequence
  Synthetic oligonucleotide; TTC chr11 5186420 5186441 5186425 5186420 -
catgggaggagtaaaattcgtc

SEQ ID NO: 150282 - DNA, 22 bp, Artificial Sequence
  Synthetic oligonucleotide; TTC chr11 5186401 5186422 5186406 5186401 -
gtcctcttaagctgaaaacctt

SEQ ID NO: 150283 - DNA, 22 bp, Artificial Sequence
  Synthetic oligonucleotide; CTC chr11 5186395 5186416 5186400 5186395 -
ttaagctgaaaaccttgggccc

SEQ ID NO: 150284 - DNA, 22 bp, Artificial Sequence
  Synthetic oligonucleotide; CTT chr11 5186393 5186414 5186398 5186393 -
aagctgaaaaccttgggcccaa

SEQ ID NO: 150285 - DNA, 22 bp, Artificial Sequence
  Synthetic oligonucleotide; TTA chr11 5186392 5186413 5186397 5186392 -
agctgaaaaccttgggcccaag

SEQ ID NO: 150286 - DNA, 22 bp, Artificial Sequence
  Synthetic oligonucleotide; CTG chr11 5186387 5186408 5186392 5186387 -
aaaaccttgggcccaagacatg

SEQ ID NO: 150287 - DNA, 22 bp, Artificial Sequence
  Synthetic oligonucleotide; CTT chr11 5186379 5186400 5186384 5186379 -
gggcccaagacatgctttaaaa

SEQ ID NO: 150288 - DNA, 22 bp, Artificial Sequence
  Synthetic oligonucleotide; TTG chr11 5186378 5186399 5186383 5186378 -
ggcccaagacatgctttaaaag

SEQ ID NO: 150289 - DNA, 22 bp, Artificial Sequence
  Synthetic oligonucleotide; CTT chr11 5186362 5186383 5186367 5186362 -
taaaagaagtataaatagttcc

SEQ ID NO: 150290 - DNA, 22 bp, Artificial Sequence
  Synthetic oligonucleotide; TTT chr11 5186361 5186382 5186366 5186361 -
aaaagaagtataaatagttcca

SEQ ID NO: 150291 - DNA, 22 bp, Artificial Sequence
  Synthetic oligonucleotide; TTA chr11 5186360 5186381 5186365 5186360 -
aaagaagtataaatagttccag

SEQ ID NO: 150292 - DNA, 22 bp, Artificial Sequence
  Synthetic oligonucleotide; TTC chr11 5186341 5186362 5186346 5186341 -
cagatttcctaatctctttgca

SEQ ID NO: 150293 - DNA, 22 bp, Artificial Sequence
  Synthetic oligonucleotide; TTT chr11 5186334 5186355 5186339 5186334 -
cctaatctctttgcatttattt

SEQ ID NO: 150294 - DNA, 22 bp, Artificial Sequence
  Synthetic oligonucleotide; TTC chr11 5186333 5186354 5186338 5186333 -
ctaatctctttgcatttatttt

SEQ ID NO: 150295 - DNA, 22 bp, Artificial Sequence
  Synthetic oligonucleotide; CTA chr11 5186330 5186351 5186335 5186330 -
atctctttgcatttattttgtc

SEQ ID NO: 150296 - DNA, 22 bp, Artificial Sequence
  Synthetic oligonucleotide; CTC chr11 5186325 5186346 5186330 5186325 -
tttgcatttattttgtctcctc

SEQ ID NO: 150297 - DNA, 22 bp, Artificial Sequence
  Synthetic oligonucleotide; CTT chr11 5186323 5186344 5186328 5186323 -
tgcatttattttgtctcctctc

SEQ ID NO: 150298 - DNA, 22 bp, Artificial Sequence
  Synthetic oligonucleotide; TTT chr11 5186322 5186343 5186327 5186322 -
gcatttattttgtctcctctca

SEQ ID NO: 150299 - DNA, 22 bp, Artificial Sequence
  Synthetic oligonucleotide; TTG chr11 5186321 5186342 5186326 5186321 -
catttattttgtctcctctcaa

SEQ ID NO: 150300 - DNA, 22 bp, Artificial Sequence
  Synthetic oligonucleotide; TTT chr11 5186316 5186337 5186321 5186316 -
attttgtctcctctcaacctgc

SEQ ID NO: 150301 - DNA, 22 bp, Artificial Sequence
  Synthetic oligonucleotide; TTA chr11 5186315 5186336 5186320 5186315 -
ttttgtctcctctcaacctgct

SEQ ID NO: 150302 - DNA, 22 bp, Artificial Sequence
  Synthetic oligonucleotide; TTT chr11 5186312 5186333 5186317 5186312 -
tgtctcctctcaacctgctaaa

SEQ ID NO: 150303 - DNA, 22 bp, Artificial Sequence
  Synthetic oligonucleotide; TTT chr11 5186311 5186332 5186316 5186311 -
gtctcctctcaacctgctaaat

SEQ ID NO: 150304 - DNA, 22 bp, Artificial Sequence
  Synthetic oligonucleotide; TTG chr11 5186310 5186331 5186315 5186310 -
tctcctctcaacctgctaaata

SEQ ID NO: 150305 - DNA, 22 bp, Artificial Sequence
  Synthetic oligonucleotide; CTC chr11 5186306 5186327 5186311 5186306 -
ctctcaacctgctaaatatctt

SEQ ID NO: 150306 - DNA, 22 bp, Artificial Sequence
  Synthetic oligonucleotide; CTC chr11 5186303 5186324 5186308 5186303 -
tcaacctgctaaatatcttcag

SEQ ID NO: 150307 - DNA, 22 bp, Artificial Sequence
  Synthetic oligonucleotide; CTC chr11 5186301 5186322 5186306 5186301 -
aacctgctaaatatcttcagga

SEQ ID NO: 150308 - DNA, 22 bp, Artificial Sequence
  Synthetic oligonucleotide; CTG chr11 5186295 5186316 5186300 5186295 -
ctaaatatcttcaggattctag

SEQ ID NO: 150309 - DNA, 22 bp, Artificial Sequence
  Synthetic oligonucleotide; CTA chr11 5186292 5186313 5186297 5186292 -
aatatcttcaggattctagaaa

SEQ ID NO: 150310 - DNA, 22 bp, Artificial Sequence
  Synthetic oligonucleotide; CTT chr11 5186284 5186305 5186289 5186284 -
caggattctagaaaatgcaagt

SEQ ID NO: 150311 - DNA, 22 bp, Artificial Sequence
  Synthetic oligonucleotide; TTC chr11 5186283 5186304 5186288 5186283 -
aggattctagaaaatgcaagta

SEQ ID NO: 150312 - DNA, 22 bp, Artificial Sequence
  Synthetic oligonucleotide; TTC chr11 5186276 5186297 5186281 5186276 -
tagaaaatgcaagtaagtaaac

SEQ ID NO: 150313 - DNA, 22 bp, Artificial Sequence
  Synthetic oligonucleotide; CTA chr11 5186274 5186295 5186279 5186274 -
gaaaatgcaagtaagtaaactg

SEQ ID NO: 150314 - DNA, 22 bp, Artificial Sequence
  Synthetic oligonucleotide; CTG chr11 5186252 5186273 5186257 5186252 -
agttatgctcaatgaaaacttg

SEQ ID NO: 150315 - DNA, 22 bp, Artificial Sequence
  Synthetic oligonucleotide; TTA chr11 5186247 5186268 5186252 5186247 -
tgctcaatgaaaacttgtagaa

SEQ ID NO: 150316 - DNA, 22 bp, Artificial Sequence
  Synthetic oligonucleotide; CTC chr11 5186242 5186263 5186247 5186242 -
aatgaaaacttgtagaaaataa

SEQ ID NO: 150317 - DNA, 22 bp, Artificial Sequence
  Synthetic oligonucleotide; CTT chr11 5186231 5186252 5186236 5186231 -
gtagaaaataacaccagaaaaa

SEQ ID NO: 150318 - DNA, 22 bp, Artificial Sequence
  Synthetic oligonucleotide; TTG chr11 5186230 5186251 5186235 5186230 -
tagaaaataacaccagaaaaaa

SEQ ID NO: 150319 - DNA, 22 bp, Artificial Sequence
  Synthetic oligonucleotide; CTG chr11 5186192 5186213 5186197 5186192 -
cagaagcagctcattcttccga

SEQ ID NO: 150320 - DNA, 22 bp, Artificial Sequence
  Synthetic oligonucleotide; CTC chr11 5186180 5186201 5186185 5186180 -
attcttccgataacttaatcat

SEQ ID NO: 150321 - DNA, 22 bp, Artificial Sequence
  Synthetic oligonucleotide; TTC chr11 5186176 5186197 5186181 5186176 -
ttccgataacttaatcatctaa

SEQ ID NO: 150322 - DNA, 22 bp, Artificial Sequence
  Synthetic oligonucleotide; CTT chr11 5186174 5186195 5186179 5186174 -
ccgataacttaatcatctaaca

SEQ ID NO: 150323 - DNA, 22 bp, Artificial Sequence
  Synthetic oligonucleotide; TTC chr11 5186173 5186194 5186178 5186173 -
cgataacttaatcatctaacat

SEQ ID NO: 150324 - DNA, 22 bp, Artificial Sequence
  Synthetic oligonucleotide; CTT chr11 5186164 5186185 5186169 5186164 -
aatcatctaacattttccttga

SEQ ID NO: 150325 - DNA, 22 bp, Artificial Sequence
  Synthetic oligonucleotide; TTA chr11 5186163 5186184 5186168 5186163 -
atcatctaacattttccttgat

SEQ ID NO: 150326 - DNA, 22 bp, Artificial Sequence
  Synthetic oligonucleotide; CTA chr11 5186155 5186176 5186160 5186155 -
acattttccttgatttttgacc

SEQ ID NO: 150327 - DNA, 22 bp, Artificial Sequence
  Synthetic oligonucleotide; TTT chr11 5186149 5186170 5186154 5186149 -
tccttgatttttgacccatgga

SEQ ID NO: 150328 - DNA, 22 bp, Artificial Sequence
  Synthetic oligonucleotide; TTT chr11 5186148 5186169 5186153 5186148 -
ccttgatttttgacccatggaa

SEQ ID NO: 150329 - DNA, 22 bp, Artificial Sequence
  Synthetic oligonucleotide; TTC chr11 5186147 5186168 5186152 5186147 -
cttgatttttgacccatggaat

SEQ ID NO: 150330 - DNA, 22 bp, Artificial Sequence
  Synthetic oligonucleotide; CTT chr11 5186144 5186165 5186149 5186144 -
gatttttgacccatggaatact

SEQ ID NO: 150331 - DNA, 22 bp, Artificial Sequence
  Synthetic oligonucleotide; TTG chr11 5186143 5186164 5186148 5186143 -
atttttgacccatggaatacta

SEQ ID NO: 150332 - DNA, 22 bp, Artificial Sequence
  Synthetic oligonucleotide; TTT chr11 5186139 5186160 5186144 5186139 -
ttgacccatggaatactagact

SEQ ID NO: 150333 - DNA, 22 bp, Artificial Sequence
  Synthetic oligonucleotide; TTT chr11 5186138 5186159 5186143 5186138 -
tgacccatggaatactagactt

SEQ ID NO: 150334 - DNA, 22 bp, Artificial Sequence
  Synthetic oligonucleotide; TTT chr11 5186137 5186158 5186142 5186137 -
gacccatggaatactagacttg

SEQ ID NO: 150335 - DNA, 22 bp, Artificial Sequence
  Synthetic oligonucleotide; TTG chr11 5186136 5186157 5186141 5186136 -
acccatggaatactagacttgg

SEQ ID NO: 150336 - DNA, 22 bp, Artificial Sequence
  Synthetic oligonucleotide; CTA chr11 5186121 5186142 5186126 5186121 -
gacttggctttagctggagttg

SEQ ID NO: 150337 - DNA, 22 bp, Artificial Sequence
  Synthetic oligonucleotide; CTT chr11 5186116 5186137 5186121 5186116 -
ggctttagctggagttgatttg

SEQ ID NO: 150338 - DNA, 22 bp, Artificial Sequence
  Synthetic oligonucleotide; TTG chr11 5186115 5186136 5186120 5186115 -
gctttagctggagttgatttgc

SEQ ID NO: 150339 - DNA, 22 bp, Artificial Sequence
  Synthetic oligonucleotide; CTT chr11 5186111 5186132 5186116 5186111 -
tagctggagttgatttgcaatt

SEQ ID NO: 150340 - DNA, 22 bp, Artificial Sequence
  Synthetic oligonucleotide; TTT chr11 5186110 5186131 5186115 5186110 -
agctggagttgatttgcaattg

SEQ ID NO: 150341 - DNA, 22 bp, Artificial Sequence
  Synthetic oligonucleotide; TTA chr11 5186109 5186130 5186114 5186109 -
gctggagttgatttgcaattgt

SEQ ID NO: 150342 - DNA, 22 bp, Artificial Sequence
  Synthetic oligonucleotide; CTG chr11 5186105 5186126 5186110 5186105 -
gagttgatttgcaattgtagta

SEQ ID NO: 150343 - DNA, 22 bp, Artificial Sequence
  Synthetic oligonucleotide; TTG chr11 5186099 5186120 5186104 5186099 -
atttgcaattgtagtatttttt

SEQ ID NO: 150344 - DNA, 22 bp, Artificial Sequence
  Synthetic oligonucleotide; TTT chr11 5186095 5186116 5186100 5186095 -
gcaattgtagtattttttgtgt

SEQ ID NO: 150345 - DNA, 22 bp, Artificial Sequence
  Synthetic oligonucleotide; TTG chr11 5186094 5186115 5186099 5186094 -
caattgtagtattttttgtgtt

SEQ ID NO: 150346 - DNA, 22 bp, Artificial Sequence
  Synthetic oligonucleotide; TTG chr11 5186088 5186109 5186093 5186088 -
tagtattttttgtgttcttgta

SEQ ID NO: 150347 - DNA, 22 bp, Artificial Sequence
  Synthetic oligonucleotide; TTT chr11 5186080 5186101 5186085 5186080 -
tttgtgttcttgtattaagtaa

SEQ ID NO: 150348 - DNA, 22 bp, Artificial Sequence
  Synthetic oligonucleotide; TTT chr11 5186079 5186100 5186084 5186079 -
ttgtgttcttgtattaagtaag

SEQ ID NO: 150349 - DNA, 22 bp, Artificial Sequence
  Synthetic oligonucleotide; TTT chr11 5186078 5186099 5186083 5186078 -
tgtgttcttgtattaagtaagt

SEQ ID NO: 150350 - DNA, 22 bp, Artificial Sequence
  Synthetic oligonucleotide; TTT chr11 5186077 5186098 5186082 5186077 -
gtgttcttgtattaagtaagtc

SEQ ID NO: 150351 - DNA, 22 bp, Artificial Sequence
  Synthetic oligonucleotide; TTG chr11 5186076 5186097 5186081 5186076 -
tgttcttgtattaagtaagtca

SEQ ID NO: 150352 - DNA, 22 bp, Artificial Sequence
  Synthetic oligonucleotide; TTC chr11 5186071 5186092 5186076 5186071 -
ttgtattaagtaagtcattttc

SEQ ID NO: 150353 - DNA, 22 bp, Artificial Sequence
  Synthetic oligonucleotide; CTT chr11 5186069 5186090 5186074 5186069 -
gtattaagtaagtcattttcaa

SEQ ID NO: 150354 - DNA, 22 bp, Artificial Sequence
  Synthetic oligonucleotide; TTG chr11 5186068 5186089 5186073 5186068 -
tattaagtaagtcattttcaaa

SEQ ID NO: 150355 - DNA, 22 bp, Artificial Sequence
  Synthetic oligonucleotide; TTA chr11 5186063 5186084 5186068 5186063 -
agtaagtcattttcaaaaagaa

SEQ ID NO: 150356 - DNA, 22 bp, Artificial Sequence
  Synthetic oligonucleotide; TTT chr11 5186051 5186072 5186056 5186051 -
tcaaaaagaatattttagtttt

SEQ ID NO: 150357 - DNA, 22 bp, Artificial Sequence
  Synthetic oligonucleotide; TTT chr11 5186050 5186071 5186055 5186050 -
caaaaagaatattttagttttc

SEQ ID NO: 150358 - DNA, 22 bp, Artificial Sequence
  Synthetic oligonucleotide; TTC chr11 5186049 5186070 5186054 5186049 -
aaaaagaatattttagttttct

SEQ ID NO: 150359 - DNA, 22 bp, Artificial Sequence
  Synthetic oligonucleotide; TTT chr11 5186036 5186057 5186041 5186036 -
tagttttctcttagaatatgtt

SEQ ID NO: 150360 - DNA, 22 bp, Artificial Sequence
  Synthetic oligonucleotide; TTT chr11 5186035 5186056 5186040 5186035 -
agttttctcttagaatatgttt

SEQ ID NO: 150361 - DNA, 22 bp, Artificial Sequence
  Synthetic oligonucleotide; TTA chr11 5186034 5186055 5186039 5186034 -
gttttctcttagaatatgttta

SEQ ID NO: 150362 - DNA, 22 bp, Artificial Sequence
  Synthetic oligonucleotide; TTT chr11 5186030 5186051 5186035 5186030 -
tctcttagaatatgtttaaata

SEQ ID NO: 150363 - DNA, 22 bp, Artificial Sequence
  Synthetic oligonucleotide; TTT chr11 5186029 5186050 5186034 5186029 -
ctcttagaatatgtttaaataa

SEQ ID NO: 150364 - DNA, 22 bp, Artificial Sequence
  Synthetic oligonucleotide; TTC chr11 5186028 5186049 5186033 5186028 -
tcttagaatatgtttaaataat

SEQ ID NO: 150365 - DNA, 22 bp, Artificial Sequence
  Synthetic oligonucleotide; CTC chr11 5186026 5186047 5186031 5186026 -
ttagaatatgtttaaataatgc

SEQ ID NO: 150366 - DNA, 22 bp, Artificial Sequence
  Synthetic oligonucleotide; CTT chr11 5186024 5186045 5186029 5186024 -
agaatatgtttaaataatgctc

SEQ ID NO: 150367 - DNA, 22 bp, Artificial Sequence
  Synthetic oligonucleotide; TTA chr11 5186023 5186044 5186028 5186023 -
gaatatgtttaaataatgctca

SEQ ID NO: 150368 - DNA, 22 bp, Artificial Sequence
  Synthetic oligonucleotide; TTT chr11 5186013 5186034 5186018 5186013 -
aaataatgctcattttctttga

SEQ ID NO: 150369 - DNA, 22 bp, Artificial Sequence
  Synthetic oligonucleotide; TTA chr11 5186012 5186033 5186017 5186012 -
aataatgctcattttctttgat

SEQ ID NO: 150370 - DNA, 22 bp, Artificial Sequence
  Synthetic oligonucleotide; CTC chr11 5186002 5186023 5186007 5186002 -
attttctttgatatgcagattt

SEQ ID NO: 150371 - DNA, 22 bp, Artificial Sequence
  Synthetic oligonucleotide; TTT chr11 5185998 5186019 5186003 5185998 -
tctttgatatgcagatttgaat

SEQ ID NO: 150372 - DNA, 22 bp, Artificial Sequence
  Synthetic oligonucleotide; TTT chr11 5185997 5186018 5186002 5185997 -
ctttgatatgcagatttgaatg

SEQ ID NO: 150373 - DNA, 22 bp, Artificial Sequence
  Synthetic oligonucleotide; TTC chr11 5185996 5186017 5186001 5185996 -
tttgatatgcagatttgaatgt

SEQ ID NO: 150374 - DNA, 22 bp, Artificial Sequence
  Synthetic oligonucleotide; CTT chr11 5185994 5186015 5185999 5185994 -
tgatatgcagatttgaatgttg

SEQ ID NO: 150375 - DNA, 22 bp, Artificial Sequence
  Synthetic oligonucleotide; TTT chr11 5185993 5186014 5185998 5185993 -
gatatgcagatttgaatgttgt

SEQ ID NO: 150376 - DNA, 22 bp, Artificial Sequence
  Synthetic oligonucleotide; TTG chr11 5185992 5186013 5185997 5185992 -
atatgcagatttgaatgttgta

SEQ ID NO: 150377 - DNA, 22 bp, Artificial Sequence
  Synthetic oligonucleotide; TTT chr11 5185980 5186001 5185985 5185980 -
gaatgttgtacaaagattcaat

SEQ ID NO: 150378 - DNA, 22 bp, Artificial Sequence
  Synthetic oligonucleotide; TTG chr11 5185979 5186000 5185984 5185979 -
aatgttgtacaaagattcaatg

SEQ ID NO: 150379 - DNA, 22 bp, Artificial Sequence
  Synthetic oligonucleotide; TTG chr11 5185972 5185993 5185977 5185972 -
tacaaagattcaatgaatttat

SEQ ID NO: 150380 - DNA, 22 bp, Artificial Sequence
  Synthetic oligonucleotide; TTC chr11 5185961 5185982 5185966 5185961 -
aatgaatttatattctagtagt

SEQ ID NO: 150381 - DNA, 22 bp, Artificial Sequence
  Synthetic oligonucleotide; TTT chr11 5185952 5185973 5185957 5185952 -
atattctagtagttaaaacaag

SEQ ID NO: 150382 - DNA, 22 bp, Artificial Sequence
  Synthetic oligonucleotide; TTA chr11 5185951 5185972 5185956 5185951 -
tattctagtagttaaaacaagg

SEQ ID NO: 150383 - DNA, 22 bp, Artificial Sequence
  Synthetic oligonucleotide; TTC chr11 5185946 5185967 5185951 5185946 -
tagtagttaaaacaaggctcag

SEQ ID NO: 150384 - DNA, 22 bp, Artificial Sequence
  Synthetic oligonucleotide; CTA chr11 5185944 5185965 5185949 5185944 -
gtagttaaaacaaggctcagta

SEQ ID NO: 150385 - DNA, 22 bp, Artificial Sequence
  Synthetic oligonucleotide; TTA chr11 5185937 5185958 5185942 5185937 -
aaacaaggctcagtaataaaaa

SEQ ID NO: 150386 - DNA, 22 bp, Artificial Sequence
  Synthetic oligonucleotide; CTC chr11 5185926 5185947 5185931 5185926 -
agtaataaaaaattttagtagt

SEQ ID NO: 150387 - DNA, 22 bp, Artificial Sequence
  Synthetic oligonucleotide; TTT chr11 5185911 5185932 5185916 5185911 -
tagtagtttaatgtgtgtgtgt

SEQ ID NO: 150388 - DNA, 22 bp, Artificial Sequence
  Synthetic oligonucleotide; TTT chr11 5185910 5185931 5185915 5185910 -
agtagtttaatgtgtgtgtgtg

SEQ ID NO: 150389 - DNA, 22 bp, Artificial Sequence
  Synthetic oligonucleotide; TTA chr11 5185909 5185930 5185914 5185909 -
gtagtttaatgtgtgtgtgtgt

SEQ ID NO: 150390 - DNA, 22 bp, Artificial Sequence
  Synthetic oligonucleotide; TTT chr11 5185902 5185923 5185907 5185902 -
aatgtgtgtgtgtgtgtgcatc

SEQ ID NO: 150391 - DNA, 22 bp, Artificial Sequence
  Synthetic oligonucleotide; TTA chr11 5185901 5185922 5185906 5185901 -
atgtgtgtgtgtgtgtgcatcg

SEQ ID NO: 150392 - DNA, 22 bp, Artificial Sequence
  Synthetic oligonucleotide; TTC chr11 5185876 5185897 5185881 5185876 -
tgtagtttattgactattactc

SEQ ID NO: 150393 - DNA, 22 bp, Artificial Sequence
  Synthetic oligonucleotide; CTG chr11 5185874 5185895 5185879 5185874 -
tagtttattgactattactcat

SEQ ID NO: 150394 - DNA, 22 bp, Artificial Sequence
  Synthetic oligonucleotide; TTT chr11 5185868 5185889 5185873 5185868 -
attgactattactcatcaggta

SEQ ID NO: 150395 - DNA, 22 bp, Artificial Sequence
  Synthetic oligonucleotide; TTA chr11 5185867 5185888 5185872 5185867 -
ttgactattactcatcaggtaa

SEQ ID NO: 150396 - DNA, 22 bp, Artificial Sequence
  Synthetic oligonucleotide; TTG chr11 5185864 5185885 5185869 5185864 -
actattactcatcaggtaatag

SEQ ID NO: 150397 - DNA, 22 bp, Artificial Sequence
  Synthetic oligonucleotide; CTA chr11 5185860 5185881 5185865 5185860 -
ttactcatcaggtaatagtcta

SEQ ID NO: 150398 - DNA, 22 bp, Artificial Sequence
  Synthetic oligonucleotide; TTA chr11 5185857 5185878 5185862 5185857 -
ctcatcaggtaatagtctaggc

SEQ ID NO: 150399 - DNA, 22 bp, Artificial Sequence
  Synthetic oligonucleotide; CTC chr11 5185854 5185875 5185859 5185854 -
atcaggtaatagtctaggcaca

SEQ ID NO: 150400 - DNA, 22 bp, Artificial Sequence
  Synthetic oligonucleotide; CTA chr11 5185838 5185859 5185843 5185838 -
ggcacagattaagaagctggca

SEQ ID NO: 150401 - DNA, 22 bp, Artificial Sequence
  Synthetic oligonucleotide; TTA chr11 5185827 5185848 5185832 5185827 -
agaagctggcactccaaaattt

SEQ ID NO: 150402 - DNA, 22 bp, Artificial Sequence
  Synthetic oligonucleotide; CTG chr11 5185819 5185840 5185824 5185819 -
gcactccaaaatttttaactct

SEQ ID NO: 150403 - DNA, 22 bp, Artificial Sequence
  Synthetic oligonucleotide; CTC chr11 5185813 5185834 5185818 5185813 -
caaaatttttaactctcttccc

SEQ ID NO: 150404 - DNA, 22 bp, Artificial Sequence
  Synthetic oligonucleotide; TTT chr11 5185805 5185826 5185810 5185805 -
ttaactctcttccctatgtaac

SEQ ID NO: 150405 - DNA, 22 bp, Artificial Sequence
  Synthetic oligonucleotide; TTT chr11 5185804 5185825 5185809 5185804 -
taactctcttccctatgtaaca

SEQ ID NO: 150406 - DNA, 22 bp, Artificial Sequence
  Synthetic oligonucleotide; TTT chr11 5185803 5185824 5185808 5185803 -
aactctcttccctatgtaacaa

SEQ ID NO: 150407 - DNA, 22 bp, Artificial Sequence
  Synthetic oligonucleotide; TTA chr11 5185802 5185823 5185807 5185802 -
actctcttccctatgtaacaaa

SEQ ID NO: 150408 - DNA, 22 bp, Artificial Sequence
  Synthetic oligonucleotide; CTC chr11 5185798 5185819 5185803 5185798 -
tcttccctatgtaacaaagata

SEQ ID NO: 150409 - DNA, 22 bp, Artificial Sequence
  Synthetic oligonucleotide; CTC chr11 5185796 5185817 5185801 5185796 -
ttccctatgtaacaaagatatt

SEQ ID NO: 150410 - DNA, 22 bp, Artificial Sequence
  Synthetic oligonucleotide; CTT chr11 5185794 5185815 5185799 5185794 -
ccctatgtaacaaagatattat

SEQ ID NO: 150411 - DNA, 22 bp, Artificial Sequence
  Synthetic oligonucleotide; TTC chr11 5185793 5185814 5185798 5185793 -
cctatgtaacaaagatattata

SEQ ID NO: 150412 - DNA, 22 bp, Artificial Sequence
  Synthetic oligonucleotide; CTA chr11 5185789 5185810 5185794 5185789 -
tgtaacaaagatattatactgg

SEQ ID NO: 150413 - DNA, 22 bp, Artificial Sequence
  Synthetic oligonucleotide; TTA chr11 5185773 5185794 5185778 5185773 -
tactggtgatggggcaaaaata

SEQ ID NO: 150414 - DNA, 22 bp, Artificial Sequence
  Synthetic oligonucleotide; CTG chr11 5185768 5185789 5185773 5185768 -
gtgatggggcaaaaataaaact

SEQ ID NO: 150415 - DNA, 22 bp, Artificial Sequence
  Synthetic oligonucleotide; CTC chr11 5185745 5185766 5185750 5185745 -
catttcaaaattcatgtgtctg

SEQ ID NO: 150416 - DNA, 22 bp, Artificial Sequence
  Synthetic oligonucleotide; TTT chr11 5185740 5185761 5185745 5185740 -
caaaattcatgtgtctgtcacc

SEQ ID NO: 150417 - DNA, 22 bp, Artificial Sequence
  Synthetic oligonucleotide; TTC chr11 5185739 5185760 5185744 5185739 -
aaaattcatgtgtctgtcacca

SEQ ID NO: 150418 - DNA, 22 bp, Artificial Sequence
  Synthetic oligonucleotide; TTC chr11 5185732 5185753 5185737 5185732 -
atgtgtctgtcaccatgctgaa

SEQ ID NO: 150419 - DNA, 22 bp, Artificial Sequence
  Synthetic oligonucleotide; CTG chr11 5185723 5185744 5185728 5185723 -
tcaccatgctgaactatttgca

SEQ ID NO: 150420 - DNA, 22 bp, Artificial Sequence
  Synthetic oligonucleotide; CTG chr11 5185712 5185733 5185717 5185712 -
aactatttgcaccttataaaag

SEQ ID NO: 150421 - DNA, 22 bp, Artificial Sequence
  Synthetic oligonucleotide; CTA chr11 5185707 5185728 5185712 5185707 -
tttgcaccttataaaagtaaat

SEQ ID NO: 150422 - DNA, 22 bp, Artificial Sequence
  Synthetic oligonucleotide; TTT chr11 5185704 5185725 5185709 5185704 -
gcaccttataaaagtaaatgac

SEQ ID NO: 150423 - DNA, 22 bp, Artificial Sequence
  Synthetic oligonucleotide; TTG chr11 5185703 5185724 5185708 5185703 -
caccttataaaagtaaatgaca

SEQ ID NO: 150424 - DNA, 22 bp, Artificial Sequence
  Synthetic oligonucleotide; CTT chr11 5185697 5185718 5185702 5185697 -
ataaaagtaaatgacagataca

SEQ ID NO: 150425 - DNA, 22 bp, Artificial Sequence
  Synthetic oligonucleotide; TTA chr11 5185696 5185717 5185701 5185696 -
taaaagtaaatgacagatacag

SEQ ID NO: 150426 - DNA, 22 bp, Artificial Sequence
  Synthetic oligonucleotide; TTA chr11 5185663 5185684 5185668 5185663 -
ccaattgataccatgtgcccag

SEQ ID NO: 150427 - DNA, 22 bp, Artificial Sequence
  Synthetic oligonucleotide; TTG chr11 5185656 5185677 5185661 5185656 -
ataccatgtgcccagtataaga

SEQ ID NO: 150428 - DNA, 22 bp, Artificial Sequence
  Synthetic oligonucleotide; TTT chr11 5185629 5185650 5185634 5185629 -
attaaaaaaaaatttattccta

SEQ ID NO: 150429 - DNA, 22 bp, Artificial Sequence
  Synthetic oligonucleotide; TTA chr11 5185628 5185649 5185633 5185628 -
ttaaaaaaaaatttattcctag

SEQ ID NO: 150430 - DNA, 22 bp, Artificial Sequence
  Synthetic oligonucleotide; TTA chr11 5185625 5185646 5185630 5185625 -
aaaaaaaatttattcctagtat

SEQ ID NO: 150431 - DNA, 22 bp, Artificial Sequence
  Synthetic oligonucleotide; TTT chr11 5185614 5185635 5185619 5185614 -
attcctagtatttatggatact

SEQ ID NO: 150432 - DNA, 22 bp, Artificial Sequence
  Synthetic oligonucleotide; TTA chr11 5185613 5185634 5185618 5185613 -
ttcctagtatttatggatactc

SEQ ID NO: 150433 - DNA, 22 bp, Artificial Sequence
  Synthetic oligonucleotide; TTC chr11 5185610 5185631 5185615 5185610 -
ctagtatttatggatactctaa

SEQ ID NO: 150434 - DNA, 22 bp, Artificial Sequence
  Synthetic oligonucleotide; CTA chr11 5185607 5185628 5185612 5185607 -
gtatttatggatactctaaatc

SEQ ID NO: 150435 - DNA, 22 bp, Artificial Sequence
  Synthetic oligonucleotide; TTT chr11 5185601 5185622 5185606 5185601 -
atggatactctaaatcaattca

SEQ ID NO: 150436 - DNA, 22 bp, Artificial Sequence
  Synthetic oligonucleotide; TTA chr11 5185600 5185621 5185605 5185600 -
tggatactctaaatcaattcaa

SEQ ID NO: 150437 - DNA, 22 bp, Artificial Sequence
  Synthetic oligonucleotide; CTC chr11 5185591 5185612 5185596 5185591 -
taaatcaattcaatctcagttt

SEQ ID NO: 150438 - DNA, 22 bp, Artificial Sequence
  Synthetic oligonucleotide; CTA chr11 5185589 5185610 5185594 5185589 -
aatcaattcaatctcagtttga

SEQ ID NO: 150439 - DNA, 22 bp, Artificial Sequence
  Synthetic oligonucleotide; TTC chr11 5185580 5185601 5185585 5185580 -
aatctcagtttgatggataata

SEQ ID NO: 150440 - DNA, 22 bp, Artificial Sequence
  Synthetic oligonucleotide; CTC chr11 5185574 5185595 5185579 5185574 -
agtttgatggataataagcctg

SEQ ID NO: 150441 - DNA, 22 bp, Artificial Sequence
  Synthetic oligonucleotide; TTT chr11 5185569 5185590 5185574 5185569 -
gatggataataagcctgaagtc

SEQ ID NO: 150442 - DNA, 22 bp, Artificial Sequence
  Synthetic oligonucleotide; TTG chr11 5185568 5185589 5185573 5185568 -
atggataataagcctgaagtcc

SEQ ID NO: 150443 - DNA, 22 bp, Artificial Sequence
  Synthetic oligonucleotide; CTG chr11 5185552 5185573 5185557 5185552 -
aagtcctgaaagttaaacttat

SEQ ID NO: 150444 - DNA, 22 bp, Artificial Sequence
  Synthetic oligonucleotide; CTG chr11 5185544 5185565 5185549 5185544 -
aaagttaaacttattccagttg

SEQ ID NO: 150445 - DNA, 22 bp, Artificial Sequence
  Synthetic oligonucleotide; TTA chr11 5185537 5185558 5185542 5185537 -
aacttattccagttgacaataa

SEQ ID NO: 150446 - DNA, 22 bp, Artificial Sequence
  Synthetic oligonucleotide; CTT chr11 5185532 5185553 5185537 5185532 -
attccagttgacaataattttg

SEQ ID NO: 150447 - DNA, 22 bp, Artificial Sequence
  Synthetic oligonucleotide; TTA chr11 5185531 5185552 5185536 5185531 -
ttccagttgacaataattttgg

SEQ ID NO: 150448 - DNA, 22 bp, Artificial Sequence
  Synthetic oligonucleotide; TTC chr11 5185528 5185549 5185533 5185528 -
cagttgacaataattttggtct

SEQ ID NO: 150449 - DNA, 22 bp, Artificial Sequence
  Synthetic oligonucleotide; TTG chr11 5185522 5185543 5185527 5185522 -
acaataattttggtcttaattg

SEQ ID NO: 150450 - DNA, 22 bp, Artificial Sequence
  Synthetic oligonucleotide; TTT chr11 5185512 5185533 5185517 5185512 -
tggtcttaattgctacaatttt

SEQ ID NO: 150451 - DNA, 22 bp, Artificial Sequence
  Synthetic oligonucleotide; TTT chr11 5185511 5185532 5185516 5185511 -
ggtcttaattgctacaattttg

SEQ ID NO: 150452 - DNA, 22 bp, Artificial Sequence
  Synthetic oligonucleotide; TTG chr11 5185510 5185531 5185515 5185510 -
gtcttaattgctacaattttgt

SEQ ID NO: 150453 - DNA, 22 bp, Artificial Sequence
  Synthetic oligonucleotide; CTT chr11 5185505 5185526 5185510 5185505 -
aattgctacaattttgttagtg

SEQ ID NO: 150454 - DNA, 22 bp, Artificial Sequence
  Synthetic oligonucleotide; TTA chr11 5185504 5185525 5185509 5185504 -
attgctacaattttgttagtgt

SEQ ID NO: 150455 - DNA, 22 bp, Artificial Sequence
  Synthetic oligonucleotide; TTG chr11 5185500 5185521 5185505 5185500 -
ctacaattttgttagtgtcctg

SEQ ID NO: 150456 - DNA, 22 bp, Artificial Sequence
  Synthetic oligonucleotide; CTA chr11 5185497 5185518 5185502 5185497 -
caattttgttagtgtcctgatg

SEQ ID NO: 150457 - DNA, 22 bp, Artificial Sequence
  Synthetic oligonucleotide; TTT chr11 5185491 5185512 5185496 5185491 -
tgttagtgtcctgatgtcatct

SEQ ID NO: 150458 - DNA, 22 bp, Artificial Sequence
  Synthetic oligonucleotide; TTT chr11 5185490 5185511 5185495 5185490 -
gttagtgtcctgatgtcatcta

SEQ ID NO: 150459 - DNA, 22 bp, Artificial Sequence
  Synthetic oligonucleotide; TTG chr11 5185489 5185510 5185494 5185489 -
ttagtgtcctgatgtcatctat

SEQ ID NO: 150460 - DNA, 22 bp, Artificial Sequence
  Synthetic oligonucleotide; TTA chr11 5185486 5185507 5185491 5185486 -
gtgtcctgatgtcatctattgt

SEQ ID NO: 150461 - DNA, 22 bp, Artificial Sequence
  Synthetic oligonucleotide; CTG chr11 5185478 5185499 5185483 5185478 -
atgtcatctattgttgggatag

SEQ ID NO: 150462 - DNA, 22 bp, Artificial Sequence
  Synthetic oligonucleotide; CTA chr11 5185468 5185489 5185473 5185468 -
ttgttgggatagagatataaat

SEQ ID NO: 150463 - DNA, 22 bp, Artificial Sequence
  Synthetic oligonucleotide; TTG chr11 5185465 5185486 5185470 5185465 -
ttgggatagagatataaatgac

SEQ ID NO: 150464 - DNA, 22 bp, Artificial Sequence
  Synthetic oligonucleotide; TTG chr11 5185462 5185483 5185467 5185462 -
ggatagagatataaatgactta

SEQ ID NO: 150465 - DNA, 22 bp, Artificial Sequence
  Synthetic oligonucleotide; CTT chr11 5185441 5185462 5185446 5185441 -
atgtagctaccttcctaagaca

SEQ ID NO: 150466 - DNA, 22 bp, Artificial Sequence
  Synthetic oligonucleotide; TTA chr11 5185440 5185461 5185445 5185440 -
tgtagctaccttcctaagacac

SEQ ID NO: 150467 - DNA, 22 bp, Artificial Sequence
  Synthetic oligonucleotide; CTA chr11 5185432 5185453 5185437 5185432 -
ccttcctaagacactgacttca

SEQ ID NO: 150468 - DNA, 22 bp, Artificial Sequence
  Synthetic oligonucleotide; CTT chr11 5185428 5185449 5185433 5185428 -
cctaagacactgacttcagaaa

SEQ ID NO: 150469 - DNA, 22 bp, Artificial Sequence
  Synthetic oligonucleotide; TTC chr11 5185427 5185448 5185432 5185427 -
ctaagacactgacttcagaaaa

SEQ ID NO: 150470 - DNA, 22 bp, Artificial Sequence
  Synthetic oligonucleotide; CTA chr11 5185424 5185445 5185429 5185424 -
agacactgacttcagaaaagac

SEQ ID NO: 150471 - DNA, 22 bp, Artificial Sequence
  Synthetic oligonucleotide; CTG chr11 5185416 5185437 5185421 5185416 -
acttcagaaaagactcacattt

SEQ ID NO: 150472 - DNA, 22 bp, Artificial Sequence
  Synthetic oligonucleotide; CTT chr11 5185412 5185433 5185417 5185412 -
cagaaaagactcacattttaaa

SEQ ID NO: 150473 - DNA, 22 bp, Artificial Sequence
  Synthetic oligonucleotide; TTC chr11 5185411 5185432 5185416 5185411 -
agaaaagactcacattttaaat

SEQ ID NO: 150474 - DNA, 22 bp, Artificial Sequence
  Synthetic oligonucleotide; CTC chr11 5185400 5185421 5185405 5185400 -
acattttaaatttatgcttatt

SEQ ID NO: 150475 - DNA, 22 bp, Artificial Sequence
  Synthetic oligonucleotide; TTT chr11 5185394 5185415 5185399 5185394 -
taaatttatgcttattgttagg

SEQ ID NO: 150476 - DNA, 22 bp, Artificial Sequence
  Synthetic oligonucleotide; TTT chr11 5185393 5185414 5185398 5185393 -
aaatttatgcttattgttaggt

SEQ ID NO: 150477 - DNA, 22 bp, Artificial Sequence
  Synthetic oligonucleotide; TTA chr11 5185392 5185413 5185397 5185392 -
aatttatgcttattgttaggta

SEQ ID NO: 150478 - DNA, 22 bp, Artificial Sequence
  Synthetic oligonucleotide; TTT chr11 5185387 5185408 5185392 5185387 -
atgcttattgttaggtatttta

SEQ ID NO: 150479 - DNA, 22 bp, Artificial Sequence
  Synthetic oligonucleotide; TTA chr11 5185386 5185407 5185391 5185386 -
tgcttattgttaggtattttac

SEQ ID NO: 150480 - DNA, 22 bp, Artificial Sequence
  Synthetic oligonucleotide; CTT chr11 5185381 5185402 5185386 5185381 -
attgttaggtattttacaagca

SEQ ID NO: 150481 - DNA, 22 bp, Artificial Sequence
  Synthetic oligonucleotide; TTA chr11 5185380 5185401 5185385 5185380 -
ttgttaggtattttacaagcaa

SEQ ID NO: 150482 - DNA, 22 bp, Artificial Sequence
  Synthetic oligonucleotide; TTG chr11 5185377 5185398 5185382 5185377 -
ttaggtattttacaagcaagag

SEQ ID NO: 150483 - DNA, 22 bp, Artificial Sequence
  Synthetic oligonucleotide; TTA chr11 5185374 5185395 5185379 5185374 -
ggtattttacaagcaagagaac

SEQ ID NO: 150484 - DNA, 22 bp, Artificial Sequence
  Synthetic oligonucleotide; TTT chr11 5185367 5185388 5185372 5185367 -
tacaagcaagagaactaaagtt

SEQ ID NO: 150485 - DNA, 22 bp, Artificial Sequence
  Synthetic oligonucleotide; TTT chr11 5185366 5185387 5185371 5185366 -
acaagcaagagaactaaagttt

SEQ ID NO: 150486 - DNA, 22 bp, Artificial Sequence
  Synthetic oligonucleotide; TTA chr11 5185365 5185386 5185370 5185365 -
caagcaagagaactaaagttta

SEQ ID NO: 150487 - DNA, 22 bp, Artificial Sequence
  Synthetic oligonucleotide; CTA chr11 5185350 5185371 5185355 5185350 -
aagtttaaattaaatgacgtgt

SEQ ID NO: 150488 - DNA, 22 bp, Artificial Sequence
  Synthetic oligonucleotide; TTT chr11 5185344 5185365 5185349 5185344 -
aaattaaatgacgtgtccaggg

SEQ ID NO: 150489 - DNA, 22 bp, Artificial Sequence
  Synthetic oligonucleotide; TTA chr11 5185343 5185364 5185348 5185343 -
aattaaatgacgtgtccagggt

SEQ ID NO: 150490 - DNA, 22 bp, Artificial Sequence
  Synthetic oligonucleotide; TTA chr11 5185338 5185359 5185343 5185338 -
aatgacgtgtccagggtcatag

SEQ ID NO: 150491 - DNA, 22 bp, Artificial Sequence
  Synthetic oligonucleotide; TTT chr11 5185300 5185321 5185305 5185300 -
agccagtatttaaatacaacta

SEQ ID NO: 150492 - DNA, 22 bp, Artificial Sequence
  Synthetic oligonucleotide; TTA chr11 5185299 5185320 5185304 5185299 -
gccagtatttaaatacaactat

SEQ ID NO: 150493 - DNA, 22 bp, Artificial Sequence
  Synthetic oligonucleotide; TTT chr11 5185289 5185310 5185294 5185289 -
aaatacaactatatatgtcctt

SEQ ID NO: 150494 - DNA, 22 bp, Artificial Sequence
  Synthetic oligonucleotide; TTA chr11 5185288 5185309 5185293 5185288 -
aatacaactatatatgtcctta

SEQ ID NO: 150495 - DNA, 22 bp, Artificial Sequence
  Synthetic oligonucleotide; CTA chr11 5185278 5185299 5185283 5185278 -
tatatgtccttagagctatact

SEQ ID NO: 150496 - DNA, 22 bp, Artificial Sequence
  Synthetic oligonucleotide; CTT chr11 5185267 5185288 5185272 5185267 -
agagctatactgtttctattac

SEQ ID NO: 150497 - DNA, 22 bp, Artificial Sequence
  Synthetic oligonucleotide; TTA chr11 5185266 5185287 5185271 5185266 -
gagctatactgtttctattaca

SEQ ID NO: 150498 - DNA, 22 bp, Artificial Sequence
  Synthetic oligonucleotide; CTA chr11 5185260 5185281 5185265 5185260 -
tactgtttctattacaccacac

SEQ ID NO: 150499 - DNA, 22 bp, Artificial Sequence
  Synthetic oligonucleotide; CTG chr11 5185255 5185276 5185260 5185255 -
tttctattacaccacactatct

SEQ ID NO: 150500 - DNA, 22 bp, Artificial Sequence
  Synthetic oligonucleotide; TTT chr11 5185252 5185273 5185257 5185252 -
ctattacaccacactatctttg

SEQ ID NO: 150501 - DNA, 22 bp, Artificial Sequence
  Synthetic oligonucleotide; TTC chr11 5185251 5185272 5185256 5185251 -
tattacaccacactatctttgc

SEQ ID NO: 150502 - DNA, 22 bp, Artificial Sequence
  Synthetic oligonucleotide; CTA chr11 5185249 5185270 5185254 5185249 -
ttacaccacactatctttgctc

SEQ ID NO: 150503 - DNA, 22 bp, Artificial Sequence
  Synthetic oligonucleotide; TTA chr11 5185246 5185267 5185251 5185246 -
caccacactatctttgctccgt

SEQ ID NO: 150504 - DNA, 22 bp, Artificial Sequence
  Synthetic oligonucleotide; CTA chr11 5185236 5185257 5185241 5185236 -
tctttgctccgtggatacattc

SEQ ID NO: 150505 - DNA, 22 bp, Artificial Sequence
  Synthetic oligonucleotide; CTT chr11 5185232 5185253 5185237 5185232 -
tgctccgtggatacattcatga

SEQ ID NO: 150506 - DNA, 22 bp, Artificial Sequence
  Synthetic oligonucleotide; TTT chr11 5185231 5185252 5185236 5185231 -
gctccgtggatacattcatgat

SEQ ID NO: 150507 - DNA, 22 bp, Artificial Sequence
  Synthetic oligonucleotide; TTG chr11 5185230 5185251 5185235 5185230 -
ctccgtggatacattcatgatt

SEQ ID NO: 150508 - DNA, 22 bp, Artificial Sequence
  Synthetic oligonucleotide; CTC chr11 5185227 5185248 5185232 5185227 -
cgtggatacattcatgattcag

SEQ ID NO: 150509 - DNA, 22 bp, Artificial Sequence
  Synthetic oligonucleotide; TTC chr11 5185214 5185235 5185219 5185214 -
atgattcagtcagaatatgctg

SEQ ID NO: 150510 - DNA, 22 bp, Artificial Sequence
  Synthetic oligonucleotide; TTC chr11 5185207 5185228 5185212 5185207 -
agtcagaatatgctgtcagaaa

SEQ ID NO: 150511 - DNA, 22 bp, Artificial Sequence
  Synthetic oligonucleotide; CTG chr11 5185192 5185213 5185197 5185192 -
tcagaaatatcctagaataatg

SEQ ID NO: 150512 - DNA, 22 bp, Artificial Sequence
  Synthetic oligonucleotide; CTA chr11 5185178 5185199 5185183 5185178 -
gaataatgctacaaggaaccca

SEQ ID NO: 150513 - DNA, 22 bp, Artificial Sequence
  Synthetic oligonucleotide; CTA chr11 5185167 5185188 5185172 5185167 -
caaggaacccaggcctataatt

SEQ ID NO: 150514 - DNA, 22 bp, Artificial Sequence
  Synthetic oligonucleotide; CTA chr11 5185150 5185171 5185155 5185150 -
taatttgggtcatcacatatga

SEQ ID NO: 150515 - DNA, 22 bp, Artificial Sequence
  Synthetic oligonucleotide; TTT chr11 5185144 5185165 5185149 5185144 -
gggtcatcacatatgacaatgt

SEQ ID NO: 150516 - DNA, 22 bp, Artificial Sequence
  Synthetic oligonucleotide; TTG chr11 5185143 5185164 5185148 5185143 -
ggtcatcacatatgacaatgtt

SEQ ID NO: 150517 - DNA, 22 bp, Artificial Sequence
  Synthetic oligonucleotide; TTT chr11 5185120 5185141 5185125 5185120 -
taggaaaaacaaaaaaacaaac

SEQ ID NO: 150518 - DNA, 22 bp, Artificial Sequence
  Synthetic oligonucleotide; TTT chr11 5185119 5185140 5185124 5185119 -
aggaaaaacaaaaaaacaaaca

SEQ ID NO: 150519 - DNA, 22 bp, Artificial Sequence
  Synthetic oligonucleotide; TTA chr11 5185118 5185139 5185123 5185118 -
ggaaaaacaaaaaaacaaacaa

SEQ ID NO: 150520 - DNA, 22 bp, Artificial Sequence
  Synthetic oligonucleotide; TTT chr11 5185090 5185111 5185095 5185090 -
aaaaaccataggtatcacaaaa

SEQ ID NO: 150521 - DNA, 22 bp, Artificial Sequence
  Synthetic oligonucleotide; TTA chr11 5185089 5185110 5185094 5185089 -
aaaaccataggtatcacaaaag

SEQ ID NO: 150522 - DNA, 22 bp, Artificial Sequence
  Synthetic oligonucleotide; TTT chr11 5185050 5185071 5185055 5185050 -
aaaggccagaaaatctgttttc

SEQ ID NO: 150523 - DNA, 22 bp, Artificial Sequence
  Synthetic oligonucleotide; TTA chr11 5185049 5185070 5185054 5185049 -
aaggccagaaaatctgttttct

SEQ ID NO: 150524 - DNA, 22 bp, Artificial Sequence
  Synthetic oligonucleotide; CTG chr11 5185033 5185054 5185038 5185033 -
ttttctttcccccttatcttca

SEQ ID NO: 150525 - DNA, 22 bp, Artificial Sequence
  Synthetic oligonucleotide; TTT chr11 5185030 5185051 5185035 5185030 -
tctttcccccttatcttcattc

SEQ ID NO: 150526 - DNA, 22 bp, Artificial Sequence
  Synthetic oligonucleotide; TTT chr11 5185029 5185050 5185034 5185029 -
ctttcccccttatcttcattcc

SEQ ID NO: 150527 - DNA, 22 bp, Artificial Sequence
  Synthetic oligonucleotide; TTC chr11 5185028 5185049 5185033 5185028 -
tttcccccttatcttcattcct

SEQ ID NO: 150528 - DNA, 22 bp, Artificial Sequence
  Synthetic oligonucleotide; CTT chr11 5185026 5185047 5185031 5185026 -
tcccccttatcttcattcctgt

SEQ ID NO: 150529 - DNA, 22 bp, Artificial Sequence
  Synthetic oligonucleotide; TTT chr11 5185025 5185046 5185030 5185025 -
cccccttatcttcattcctgta

SEQ ID NO: 150530 - DNA, 22 bp, Artificial Sequence
  Synthetic oligonucleotide; TTC chr11 5185024 5185045 5185029 5185024 -
ccccttatcttcattcctgtat

SEQ ID NO: 150531 - DNA, 22 bp, Artificial Sequence
  Synthetic oligonucleotide; CTT chr11 5185018 5185039 5185023 5185018 -
atcttcattcctgtattttttt

SEQ ID NO: 150532 - DNA, 22 bp, Artificial Sequence
  Synthetic oligonucleotide; TTA chr11 5185017 5185038 5185022 5185017 -
tcttcattcctgtatttttttt

SEQ ID NO: 150533 - DNA, 22 bp, Artificial Sequence
  Synthetic oligonucleotide; CTT chr11 5185013 5185034 5185018 5185013 -
cattcctgtatttttttttcac

SEQ ID NO: 150534 - DNA, 22 bp, Artificial Sequence
  Synthetic oligonucleotide; TTC chr11 5185012 5185033 5185017 5185012 -
attcctgtatttttttttcact

SEQ ID NO: 150535 - DNA, 22 bp, Artificial Sequence
  Synthetic oligonucleotide; TTC chr11 5185008 5185029 5185013 5185008 -
ctgtatttttttttcacttaga

SEQ ID NO: 150536 - DNA, 22 bp, Artificial Sequence
  Synthetic oligonucleotide; CTG chr11 5185005 5185026 5185010 5185005 -
tatttttttttcacttagattc

SEQ ID NO: 150537 - DNA, 22 bp, Artificial Sequence
  Synthetic oligonucleotide; TTT chr11 5185000 5185021 5185005 5185000 -
ttttttcacttagattcttctc

SEQ ID NO: 150538 - DNA, 22 bp, Artificial Sequence
  Synthetic oligonucleotide; TTT chr11 5184999 5185020 5185004 5184999 -
tttttcacttagattcttctct

SEQ ID NO: 150539 - DNA, 22 bp, Artificial Sequence
  Synthetic oligonucleotide; TTT chr11 5184998 5185019 5185003 5184998 -
ttttcacttagattcttctctc

SEQ ID NO: 150540 - DNA, 22 bp, Artificial Sequence
  Synthetic oligonucleotide; TTT chr11 5184997 5185018 5185002 5184997 -
tttcacttagattcttctctcc

SEQ ID NO: 150541 - DNA, 22 bp, Artificial Sequence
  Synthetic oligonucleotide; TTT chr11 5184996 5185017 5185001 5184996 -
ttcacttagattcttctctccc

SEQ ID NO: 150542 - DNA, 22 bp, Artificial Sequence
  Synthetic oligonucleotide; TTT chr11 5184995 5185016 5185000 5184995 -
tcacttagattcttctctccca

SEQ ID NO: 150543 - DNA, 22 bp, Artificial Sequence
  Synthetic oligonucleotide; TTT chr11 5184994 5185015 5184999 5184994 -
cacttagattcttctctcccat

SEQ ID NO: 150544 - DNA, 22 bp, Artificial Sequence
  Synthetic oligonucleotide; TTC chr11 5184993 5185014 5184998 5184993 -
acttagattcttctctcccatc

SEQ ID NO: 150545 - DNA, 22 bp, Artificial Sequence
  Synthetic oligonucleotide; CTT chr11 5184989 5185010 5184994 5184989 -
agattcttctctcccatcccta

SEQ ID NO: 150546 - DNA, 22 bp, Artificial Sequence
  Synthetic oligonucleotide; TTA chr11 5184988 5185009 5184993 5184988 -
gattcttctctcccatccctaa

SEQ ID NO: 150547 - DNA, 22 bp, Artificial Sequence
  Synthetic oligonucleotide; TTC chr11 5184983 5185004 5184988 5184983 -
ttctctcccatccctaatgtcc

SEQ ID NO: 150548 - DNA, 22 bp, Artificial Sequence
  Synthetic oligonucleotide; CTT chr11 5184981 5185002 5184986 5184981 -
ctctcccatccctaatgtcctg

SEQ ID NO: 150549 - DNA, 22 bp, Artificial Sequence
  Synthetic oligonucleotide; TTC chr11 5184980 5185001 5184985 5184980 -
tctcccatccctaatgtcctga

SEQ ID NO: 150550 - DNA, 22 bp, Artificial Sequence
  Synthetic oligonucleotide; CTC chr11 5184978 5184999 5184983 5184978 -
tcccatccctaatgtcctgatg

SEQ ID NO: 150551 - DNA, 22 bp, Artificial Sequence
  Synthetic oligonucleotide; CTC chr11 5184976 5184997 5184981 5184976 -
ccatccctaatgtcctgatgaa

SEQ ID NO: 150552 - DNA, 22 bp, Artificial Sequence
  Synthetic oligonucleotide; CTA chr11 5184967 5184988 5184972 5184967 -
atgtcctgatgaagccccagtc

SEQ ID NO: 150553 - DNA, 22 bp, Artificial Sequence
  Synthetic oligonucleotide; CTG chr11 5184959 5184980 5184964 5184959 -
atgaagccccagtcactgtaac

SEQ ID NO: 150554 - DNA, 22 bp, Artificial Sequence
  Synthetic oligonucleotide; CTG chr11 5184941 5184962 5184946 5184941 -
taaccctcacttctataactac

SEQ ID NO: 150555 - DNA, 22 bp, Artificial Sequence
  Synthetic oligonucleotide; CTC chr11 5184933 5184954 5184938 5184933 -
acttctataactacgcttcact

SEQ ID NO: 150556 - DNA, 22 bp, Artificial Sequence
  Synthetic oligonucleotide; CTT chr11 5184929 5184950 5184934 5184929 -
ctataactacgcttcactcaca

SEQ ID NO: 150557 - DNA, 22 bp, Artificial Sequence
  Synthetic oligonucleotide; TTC chr11 5184928 5184949 5184933 5184928 -
tataactacgcttcactcacat

SEQ ID NO: 150558 - DNA, 22 bp, Artificial Sequence
  Synthetic oligonucleotide; CTA chr11 5184926 5184947 5184931 5184926 -
taactacgcttcactcacatgc

SEQ ID NO: 150559 - DNA, 22 bp, Artificial Sequence
  Synthetic oligonucleotide; CTA chr11 5184920 5184941 5184925 5184920 -
cgcttcactcacatgcatggct

SEQ ID NO: 150560 - DNA, 22 bp, Artificial Sequence
  Synthetic oligonucleotide; CTT chr11 5184915 5184936 5184920 5184915 -
cactcacatgcatggctctggc

SEQ ID NO: 150561 - DNA, 22 bp, Artificial Sequence
  Synthetic oligonucleotide; TTC chr11 5184914 5184935 5184919 5184914 -
actcacatgcatggctctggcc

SEQ ID NO: 150562 - DNA, 22 bp, Artificial Sequence
  Synthetic oligonucleotide; CTC chr11 5184910 5184931 5184915 5184910 -
acatgcatggctctggcctaga

SEQ ID NO: 150563 - DNA, 22 bp, Artificial Sequence
  Synthetic oligonucleotide; CTC chr11 5184897 5184918 5184902 5184897 -
tggcctagaactgtgtcaggaa

SEQ ID NO: 150564 - DNA, 22 bp, Artificial Sequence
  Synthetic oligonucleotide; CTG chr11 5184895 5184916 5184900 5184895 -
gcctagaactgtgtcaggaatg

SEQ ID NO: 150565 - DNA, 22 bp, Artificial Sequence
  Synthetic oligonucleotide; CTA chr11 5184890 5184911 5184895 5184890 -
gaactgtgtcaggaatgcttca

SEQ ID NO: 150566 - DNA, 22 bp, Artificial Sequence
  Synthetic oligonucleotide; CTG chr11 5184884 5184905 5184889 5184884 -
tgtcaggaatgcttcaaaatta

SEQ ID NO: 150567 - DNA, 22 bp, Artificial Sequence
  Synthetic oligonucleotide; CTT chr11 5184870 5184891 5184875 5184870 -
caaaattattctttcctttctc

SEQ ID NO: 150568 - DNA, 22 bp, Artificial Sequence
  Synthetic oligonucleotide; TTC chr11 5184869 5184890 5184874 5184869 -
aaaattattctttcctttctct

SEQ ID NO: 150569 - DNA, 22 bp, Artificial Sequence
  Synthetic oligonucleotide; TTA chr11 5184862 5184883 5184867 5184862 -
ttctttcctttctctgaaacat

SEQ ID NO: 150570 - DNA, 22 bp, Artificial Sequence
  Synthetic oligonucleotide; TTC chr11 5184859 5184880 5184864 5184859 -
tttcctttctctgaaacatcaa

SEQ ID NO: 150571 - DNA, 22 bp, Artificial Sequence
  Synthetic oligonucleotide; CTT chr11 5184857 5184878 5184862 5184857 -
tcctttctctgaaacatcaaca

SEQ ID NO: 150572 - DNA, 22 bp, Artificial Sequence
  Synthetic oligonucleotide; TTT chr11 5184856 5184877 5184861 5184856 -
cctttctctgaaacatcaacag

SEQ ID NO: 150573 - DNA, 22 bp, Artificial Sequence
  Synthetic oligonucleotide; TTC chr11 5184855 5184876 5184860 5184855 -
ctttctctgaaacatcaacagt

SEQ ID NO: 150574 - DNA, 22 bp, Artificial Sequence
  Synthetic oligonucleotide; CTT chr11 5184852 5184873 5184857 5184852 -
tctctgaaacatcaacagttta

SEQ ID NO: 150575 - DNA, 22 bp, Artificial Sequence
  Synthetic oligonucleotide; TTT chr11 5184851 5184872 5184856 5184851 -
ctctgaaacatcaacagtttac

SEQ ID NO: 150576 - DNA, 22 bp, Artificial Sequence
  Synthetic oligonucleotide; TTC chr11 5184850 5184871 5184855 5184850 -
tctgaaacatcaacagtttact

SEQ ID NO: 150577 - DNA, 22 bp, Artificial Sequence
  Synthetic oligonucleotide; CTC chr11 5184848 5184869 5184853 5184848 -
tgaaacatcaacagtttactta

SEQ ID NO: 150578 - DNA, 22 bp, Artificial Sequence
  Synthetic oligonucleotide; CTG chr11 5184846 5184867 5184851 5184846 -
aaacatcaacagtttacttaaa

SEQ ID NO: 150579 - DNA, 22 bp, Artificial Sequence
  Synthetic oligonucleotide; TTT chr11 5184831 5184852 5184836 5184831 -
acttaaaatattctaacaatgt

SEQ ID NO: 150580 - DNA, 22 bp, Artificial Sequence
  Synthetic oligonucleotide; TTA chr11 5184830 5184851 5184835 5184830 -
cttaaaatattctaacaatgtg

SEQ ID NO: 150581 - DNA, 22 bp, Artificial Sequence
  Synthetic oligonucleotide; CTT chr11 5184827 5184848 5184832 5184827 -
aaaatattctaacaatgtgaga

SEQ ID NO: 150582 - DNA, 22 bp, Artificial Sequence
  Synthetic oligonucleotide; TTA chr11 5184826 5184847 5184831 5184826 -
aaatattctaacaatgtgagat

SEQ ID NO: 150583 - DNA, 22 bp, Artificial Sequence
  Synthetic oligonucleotide; TTC chr11 5184818 5184839 5184823 5184818 -
taacaatgtgagatatatatta

SEQ ID NO: 150584 - DNA, 22 bp, Artificial Sequence
  Synthetic oligonucleotide; CTA chr11 5184816 5184837 5184821 5184816 -
acaatgtgagatatatattaaa

SEQ ID NO: 150585 - DNA, 22 bp, Artificial Sequence
  Synthetic oligonucleotide; TTA chr11 5184796 5184817 5184801 5184796 -
aatagtaaaacaattagtttat

SEQ ID NO: 150586 - DNA, 22 bp, Artificial Sequence
  Synthetic oligonucleotide; TTA chr11 5184780 5184801 5184785 5184780 -
gtttatgtaaataaagtagatc

SEQ ID NO: 150587 - DNA, 22 bp, Artificial Sequence
  Synthetic oligonucleotide; TTT chr11 5184776 5184797 5184781 5184776 -
atgtaaataaagtagatccaca

SEQ ID NO: 150588 - DNA, 22 bp, Artificial Sequence
  Synthetic oligonucleotide; TTA chr11 5184775 5184796 5184780 5184775 -
tgtaaataaagtagatccacag

SEQ ID NO: 150589 - DNA, 22 bp, Artificial Sequence
  Synthetic oligonucleotide; TTA chr11 5184748 5184769 5184753 5184748 -
aataacttcaaattttatctta

SEQ ID NO: 150590 - DNA, 22 bp, Artificial Sequence
  Synthetic oligonucleotide; CTT chr11 5184740 5184761 5184745 5184740 -
caaattttatcttaatattttt

SEQ ID NO: 150591 - DNA, 22 bp, Artificial Sequence
  Synthetic oligonucleotide; TTC chr11 5184739 5184760 5184744 5184739 -
aaattttatcttaatattttta

SEQ ID NO: 150592 - DNA, 22 bp, Artificial Sequence
  Synthetic oligonucleotide; TTT chr11 5184733 5184754 5184738 5184733 -
tatcttaatatttttaaagaac

SEQ ID NO: 150593 - DNA, 22 bp, Artificial Sequence
  Synthetic oligonucleotide; TTT chr11 5184732 5184753 5184737 5184732 -
atcttaatatttttaaagaacc

SEQ ID NO: 150594 - DNA, 22 bp, Artificial Sequence
  Synthetic oligonucleotide; TTA chr11 5184731 5184752 5184736 5184731 -
tcttaatatttttaaagaacct

SEQ ID NO: 150595 - DNA, 22 bp, Artificial Sequence
  Synthetic oligonucleotide; CTT chr11 5184727 5184748 5184732 5184727 -
aatatttttaaagaacctcatt

SEQ ID NO: 150596 - DNA, 22 bp, Artificial Sequence
  Synthetic oligonucleotide; TTA chr11 5184726 5184747 5184731 5184726 -
atatttttaaagaacctcattc

SEQ ID NO: 150597 - DNA, 22 bp, Artificial Sequence
  Synthetic oligonucleotide; TTT chr11 5184720 5184741 5184725 5184720 -
ttaaagaacctcattccaactt

SEQ ID NO: 150598 - DNA, 22 bp, Artificial Sequence
  Synthetic oligonucleotide; TTT chr11 5184719 5184740 5184724 5184719 -
taaagaacctcattccaactta

SEQ ID NO: 150599 - DNA, 22 bp, Artificial Sequence
  Synthetic oligonucleotide; TTT chr11 5184718 5184739 5184723 5184718 -
aaagaacctcattccaacttaa

SEQ ID NO: 150600 - DNA, 22 bp, Artificial Sequence
  Synthetic oligonucleotide; TTA chr11 5184717 5184738 5184722 5184717 -
aagaacctcattccaacttaaa

SEQ ID NO: 150601 - DNA, 22 bp, Artificial Sequence
  Synthetic oligonucleotide; CTC chr11 5184708 5184729 5184713 5184708 -
attccaacttaaagcaagggta

SEQ ID NO: 150602 - DNA, 22 bp, Artificial Sequence
  Synthetic oligonucleotide; TTC chr11 5184704 5184725 5184709 5184704 -
caacttaaagcaagggtaaatt

SEQ ID NO: 150603 - DNA, 22 bp, Artificial Sequence
  Synthetic oligonucleotide; CTT chr11 5184698 5184719 5184703 5184698 -
aaagcaagggtaaattgctcag

SEQ ID NO: 150604 - DNA, 22 bp, Artificial Sequence
  Synthetic oligonucleotide; TTA chr11 5184697 5184718 5184702 5184697 -
aagcaagggtaaattgctcagc

SEQ ID NO: 150605 - DNA, 22 bp, Artificial Sequence
  Synthetic oligonucleotide; TTG chr11 5184681 5184702 5184686 5184681 -
ctcagctgtgtgggtattttaa

SEQ ID NO: 150606 - DNA, 22 bp, Artificial Sequence
  Synthetic oligonucleotide; CTC chr11 5184678 5184699 5184683 5184678 -
agctgtgtgggtattttaaatt

SEQ ID NO: 150607 - DNA, 22 bp, Artificial Sequence
  Synthetic oligonucleotide; CTG chr11 5184673 5184694 5184678 5184673 -
tgtgggtattttaaattctaaa

SEQ ID NO: 150608 - DNA, 22 bp, Artificial Sequence
  Synthetic oligonucleotide; TTT chr11 5184662 5184683 5184667 5184662 -
taaattctaaactgtaactcaa

SEQ ID NO: 150609 - DNA, 22 bp, Artificial Sequence
  Synthetic oligonucleotide; TTT chr11 5184661 5184682 5184666 5184661 -
aaattctaaactgtaactcaaa

SEQ ID NO: 150610 - DNA, 22 bp, Artificial Sequence
  Synthetic oligonucleotide; TTA chr11 5184660 5184681 5184665 5184660 -
aattctaaactgtaactcaaaa

SEQ ID NO: 150611 - DNA, 22 bp, Artificial Sequence
  Synthetic oligonucleotide; TTC chr11 5184655 5184676 5184660 5184655 -
taaactgtaactcaaaaaatgg

SEQ ID NO: 150612 - DNA, 22 bp, Artificial Sequence
  Synthetic oligonucleotide; CTA chr11 5184653 5184674 5184658 5184653 -
aactgtaactcaaaaaatggga

SEQ ID NO: 150613 - DNA, 22 bp, Artificial Sequence
  Synthetic oligonucleotide; CTG chr11 5184648 5184669 5184653 5184648 -
taactcaaaaaatgggacccaa

SEQ ID NO: 150614 - DNA, 22 bp, Artificial Sequence
  Synthetic oligonucleotide; CTC chr11 5184642 5184663 5184647 5184642 -
aaaaaatgggacccaaacattt

SEQ ID NO: 150615 - DNA, 22 bp, Artificial Sequence
  Synthetic oligonucleotide; TTT chr11 5184620 5184641 5184625 5184620 -
ccatcatataaaatttgagacc

SEQ ID NO: 150616 - DNA, 22 bp, Artificial Sequence
  Synthetic oligonucleotide; TTC chr11 5184619 5184640 5184624 5184619 -
catcatataaaatttgagacca

SEQ ID NO: 150617 - DNA, 22 bp, Artificial Sequence
  Synthetic oligonucleotide; TTT chr11 5184604 5184625 5184609 5184604 -
gagaccagaatatttagcactt

SEQ ID NO: 150618 - DNA, 22 bp, Artificial Sequence
  Synthetic oligonucleotide; TTG chr11 5184603 5184624 5184608 5184603 -
agaccagaatatttagcactta

SEQ ID NO: 150619 - DNA, 22 bp, Artificial Sequence
  Synthetic oligonucleotide; TTT chr11 5184589 5184610 5184594 5184589 -
agcacttagcaaaaacaaaagt

SEQ ID NO: 150620 - DNA, 22 bp, Artificial Sequence
  Synthetic oligonucleotide; TTA chr11 5184588 5184609 5184593 5184588 -
gcacttagcaaaaacaaaagta

SEQ ID NO: 150621 - DNA, 22 bp, Artificial Sequence
  Synthetic oligonucleotide; CTT chr11 5184582 5184603 5184587 5184582 -
agcaaaaacaaaagtaaaggta

SEQ ID NO: 150622 - DNA, 22 bp, Artificial Sequence
  Synthetic oligonucleotide; TTA chr11 5184581 5184602 5184586 5184581 -
gcaaaaacaaaagtaaaggtag

SEQ ID NO: 150623 - DNA, 22 bp, Artificial Sequence
  Synthetic oligonucleotide; CTA chr11 5184552 5184573 5184557 5184552 -
tgctatacaatgatcagtatat

SEQ ID NO: 150624 - DNA, 22 bp, Artificial Sequence
  Synthetic oligonucleotide; CTA chr11 5184547 5184568 5184552 5184547 -
tacaatgatcagtatattgaac

SEQ ID NO: 150625 - DNA, 22 bp, Artificial Sequence
  Synthetic oligonucleotide; TTG chr11 5184528 5184549 5184533 5184528 -
aactgtaatggaatcaagagat

SEQ ID NO: 150626 - DNA, 22 bp, Artificial Sequence
  Synthetic oligonucleotide; CTG chr11 5184523 5184544 5184528 5184523 -
taatggaatcaagagatggggg

SEQ ID NO: 150627 - DNA, 22 bp, Artificial Sequence
  Synthetic oligonucleotide; TTT chr11 5184490 5184511 5184495 5184490 -
cttaagcccctgtgccacctca

SEQ ID NO: 150628 - DNA, 22 bp, Artificial Sequence
  Synthetic oligonucleotide; TTC chr11 5184489 5184510 5184494 5184489 -
ttaagcccctgtgccacctcaa

SEQ ID NO: 150629 - DNA, 22 bp, Artificial Sequence
  Synthetic oligonucleotide; CTT chr11 5184487 5184508 5184492 5184487 -
aagcccctgtgccacctcaaaa

SEQ ID NO: 150630 - DNA, 22 bp, Artificial Sequence
  Synthetic oligonucleotide; TTA chr11 5184486 5184507 5184491 5184486 -
agcccctgtgccacctcaaaaa

SEQ ID NO: 150631 - DNA, 22 bp, Artificial Sequence
  Synthetic oligonucleotide; CTG chr11 5184478 5184499 5184483 5184478 -
tgccacctcaaaaaacaagaac

SEQ ID NO: 150632 - DNA, 22 bp, Artificial Sequence
  Synthetic oligonucleotide; CTC chr11 5184469 5184490 5184474 5184469 -
aaaaaacaagaactttagccag

SEQ ID NO: 150633 - DNA, 22 bp, Artificial Sequence
  Synthetic oligonucleotide; CTT chr11 5184454 5184475 5184459 5184454 -
tagccagcttttacttgagaaa

SEQ ID NO: 150634 - DNA, 22 bp, Artificial Sequence
  Synthetic oligonucleotide; TTT chr11 5184453 5184474 5184458 5184453 -
agccagcttttacttgagaaag

SEQ ID NO: 150635 - DNA, 22 bp, Artificial Sequence
  Synthetic oligonucleotide; TTA chr11 5184452 5184473 5184457 5184452 -
gccagcttttacttgagaaagg

SEQ ID NO: 150636 - DNA, 22 bp, Artificial Sequence
  Synthetic oligonucleotide; CTT chr11 5184444 5184465 5184449 5184444 -
ttacttgagaaagggaacttag

SEQ ID NO: 150637 - DNA, 22 bp, Artificial Sequence
  Synthetic oligonucleotide; TTT chr11 5184443 5184464 5184448 5184443 -
tacttgagaaagggaacttaga

SEQ ID NO: 150638 - DNA, 22 bp, Artificial Sequence
  Synthetic oligonucleotide; TTT chr11 5184442 5184463 5184447 5184442 -
acttgagaaagggaacttagag

SEQ ID NO: 150639 - DNA, 22 bp, Artificial Sequence
  Synthetic oligonucleotide; TTA chr11 5184441 5184462 5184446 5184441 -
cttgagaaagggaacttagaga

SEQ ID NO: 150640 - DNA, 22 bp, Artificial Sequence
  Synthetic oligonucleotide; CTT chr11 5184438 5184459 5184443 5184438 -
gagaaagggaacttagagagta

SEQ ID NO: 150641 - DNA, 22 bp, Artificial Sequence
  Synthetic oligonucleotide; TTG chr11 5184437 5184458 5184442 5184437 -
agaaagggaacttagagagtat

SEQ ID NO: 150642 - DNA, 22 bp, Artificial Sequence
  Synthetic oligonucleotide; CTT chr11 5184424 5184445 5184429 5184424 -
agagagtatagaagccacctgt

SEQ ID NO: 150643 - DNA, 22 bp, Artificial Sequence
  Synthetic oligonucleotide; TTA chr11 5184423 5184444 5184428 5184423 -
gagagtatagaagccacctgtc

SEQ ID NO: 150644 - DNA, 22 bp, Artificial Sequence
  Synthetic oligonucleotide; CTG chr11 5184403 5184424 5184408 5184403 -
tcattcacatattattatctat

SEQ ID NO: 150645 - DNA, 22 bp, Artificial Sequence
  Synthetic oligonucleotide; TTC chr11 5184397 5184418 5184402 5184397 -
acatattattatctatgtttat

SEQ ID NO: 150646 - DNA, 22 bp, Artificial Sequence
  Synthetic oligonucleotide; TTA chr11 5184389 5184410 5184394 5184389 -
ttatctatgtttatacccatgc

SEQ ID NO: 150647 - DNA, 22 bp, Artificial Sequence
  Synthetic oligonucleotide; TTA chr11 5184386 5184407 5184391 5184386 -
tctatgtttatacccatgcatc

SEQ ID NO: 150648 - DNA, 22 bp, Artificial Sequence
  Synthetic oligonucleotide; CTA chr11 5184382 5184403 5184387 5184382 -
tgtttatacccatgcatctatc

SEQ ID NO: 150649 - DNA, 22 bp, Artificial Sequence
  Synthetic oligonucleotide; TTT chr11 5184377 5184398 5184382 5184377 -
atacccatgcatctatctatct

SEQ ID NO: 150650 - DNA, 22 bp, Artificial Sequence
  Synthetic oligonucleotide; TTA chr11 5184376 5184397 5184381 5184376 -
tacccatgcatctatctatcta

SEQ ID NO: 150651 - DNA, 22 bp, Artificial Sequence
  Synthetic oligonucleotide; CTA chr11 5184362 5184383 5184367 5184362 -
tctatctatctatctatctatc

SEQ ID NO: 150652 - DNA, 22 bp, Artificial Sequence
  Synthetic oligonucleotide; CTA chr11 5184358 5184379 5184363 5184358 -
tctatctatctatctatctatc

SEQ ID NO: 150653 - DNA, 22 bp, Artificial Sequence
  Synthetic oligonucleotide; CTA chr11 5184354 5184375 5184359 5184354 -
tctatctatctatctatctatc

SEQ ID NO: 150654 - DNA, 22 bp, Artificial Sequence
  Synthetic oligonucleotide; CTA chr11 5184350 5184371 5184355 5184350 -
tctatctatctatctatctatc

SEQ ID NO: 150655 - DNA, 22 bp, Artificial Sequence
  Synthetic oligonucleotide; CTA chr11 5184346 5184367 5184351 5184346 -
tctatctatctatctatctatc

SEQ ID NO: 150656 - DNA, 22 bp, Artificial Sequence
  Synthetic oligonucleotide; CTA chr11 5184342 5184363 5184347 5184342 -
tctatctatctatctatctatc

SEQ ID NO: 150657 - DNA, 22 bp, Artificial Sequence
  Synthetic oligonucleotide; CTA chr11 5184338 5184359 5184343 5184338 -
tctatctatctatctatctatc

SEQ ID NO: 150658 - DNA, 22 bp, Artificial Sequence
  Synthetic oligonucleotide; CTA chr11 5184334 5184355 5184339 5184334 -
tctatctatctatctatctttc

SEQ ID NO: 150659 - DNA, 22 bp, Artificial Sequence
  Synthetic oligonucleotide; CTA chr11 5184330 5184351 5184335 5184330 -
tctatctatctatctttctagc

SEQ ID NO: 150660 - DNA, 22 bp, Artificial Sequence
  Synthetic oligonucleotide; CTA chr11 5184326 5184347 5184331 5184326 -
tctatctatctttctagctagc

SEQ ID NO: 150661 - DNA, 22 bp, Artificial Sequence
  Synthetic oligonucleotide; CTA chr11 5184322 5184343 5184327 5184322 -
tctatctttctagctagctagc

SEQ ID NO: 150662 - DNA, 22 bp, Artificial Sequence
  Synthetic oligonucleotide; CTA chr11 5184318 5184339 5184323 5184318 -
tctttctagctagctagctagc

SEQ ID NO: 150663 - DNA, 22 bp, Artificial Sequence
  Synthetic oligonucleotide; CTT chr11 5184314 5184335 5184319 5184314 -
tctagctagctagctagctagc

SEQ ID NO: 150664 - DNA, 22 bp, Artificial Sequence
  Synthetic oligonucleotide; TTT chr11 5184313 5184334 5184318 5184313 -
ctagctagctagctagctagct

SEQ ID NO: 150665 - DNA, 22 bp, Artificial Sequence
  Synthetic oligonucleotide; TTC chr11 5184312 5184333 5184317 5184312 -
tagctagctagctagctagcta

SEQ ID NO: 150666 - DNA, 22 bp, Artificial Sequence
  Synthetic oligonucleotide; CTA chr11 5184310 5184331 5184315 5184310 -
gctagctagctagctagctagc

SEQ ID NO: 150667 - DNA, 22 bp, Artificial Sequence
  Synthetic oligonucleotide; CTA chr11 5184306 5184327 5184311 5184306 -
gctagctagctagctagctagc

SEQ ID NO: 150668 - DNA, 22 bp, Artificial Sequence
  Synthetic oligonucleotide; CTA chr11 5184302 5184323 5184307 5184302 -
gctagctagctagctagctatc

SEQ ID NO: 150669 - DNA, 22 bp, Artificial Sequence
  Synthetic oligonucleotide; CTA chr11 5184298 5184319 5184303 5184298 -
gctagctagctagctatctacc

SEQ ID NO: 150670 - DNA, 22 bp, Artificial Sequence
  Synthetic oligonucleotide; CTA chr11 5184294 5184315 5184299 5184294 -
gctagctagctatctacctatc

SEQ ID NO: 150671 - DNA, 22 bp, Artificial Sequence
  Synthetic oligonucleotide; CTA chr11 5184290 5184311 5184295 5184290 -
gctagctatctacctatctaat

SEQ ID NO: 150672 - DNA, 22 bp, Artificial Sequence
  Synthetic oligonucleotide; CTA chr11 5184286 5184307 5184291 5184286 -
gctatctacctatctaatctat

SEQ ID NO: 150673 - DNA, 22 bp, Artificial Sequence
  Synthetic oligonucleotide; CTA chr11 5184282 5184303 5184287 5184282 -
tctacctatctaatctatctct

SEQ ID NO: 150674 - DNA, 22 bp, Artificial Sequence
  Synthetic oligonucleotide; CTA chr11 5184278 5184299 5184283 5184278 -
cctatctaatctatctctgtat

SEQ ID NO: 150675 - DNA, 22 bp, Artificial Sequence
  Synthetic oligonucleotide; CTA chr11 5184274 5184295 5184279 5184274 -
tctaatctatctctgtatatgt

SEQ ID NO: 150676 - DNA, 22 bp, Artificial Sequence
  Synthetic oligonucleotide; CTA chr11 5184270 5184291 5184275 5184270 -
atctatctctgtatatgtcacc

SEQ ID NO: 150677 - DNA, 22 bp, Artificial Sequence
  Synthetic oligonucleotide; CTA chr11 5184265 5184286 5184270 5184265 -
tctctgtatatgtcacctaccc

SEQ ID NO: 150678 - DNA, 22 bp, Artificial Sequence
  Synthetic oligonucleotide; CTC chr11 5184261 5184282 5184266 5184261 -
tgtatatgtcacctaccctggt

SEQ ID NO: 150679 - DNA, 22 bp, Artificial Sequence
  Synthetic oligonucleotide; CTG chr11 5184259 5184280 5184264 5184259 -
tatatgtcacctaccctggtgt

SEQ ID NO: 150680 - DNA, 22 bp, Artificial Sequence
  Synthetic oligonucleotide; CTA chr11 5184246 5184267 5184251 5184246 -
ccctggtgttgcatctcctaat

SEQ ID NO: 150681 - DNA, 22 bp, Artificial Sequence
  Synthetic oligonucleotide; CTG chr11 5184241 5184262 5184246 5184241 -
gtgttgcatctcctaatcttat

SEQ ID NO: 150682 - DNA, 22 bp, Artificial Sequence
  Synthetic oligonucleotide; TTG chr11 5184235 5184256 5184240 5184235 -
catctcctaatcttattttcca

SEQ ID NO: 150683 - DNA, 22 bp, Artificial Sequence
  Synthetic oligonucleotide; CTC chr11 5184229 5184250 5184234 5184229 -
ctaatcttattttccactcaat

SEQ ID NO: 150684 - DNA, 22 bp, Artificial Sequence
  Synthetic oligonucleotide; CTA chr11 5184226 5184247 5184231 5184226 -
atcttattttccactcaatatt

SEQ ID NO: 150685 - DNA, 22 bp, Artificial Sequence
  Synthetic oligonucleotide; CTT chr11 5184221 5184242 5184226 5184221 -
attttccactcaatattaaact

SEQ ID NO: 150686 - DNA, 22 bp, Artificial Sequence
  Synthetic oligonucleotide; TTA chr11 5184220 5184241 5184225 5184220 -
ttttccactcaatattaaactt

SEQ ID NO: 150687 - DNA, 22 bp, Artificial Sequence
  Synthetic oligonucleotide; TTT chr11 5184217 5184238 5184222 5184217 -
tccactcaatattaaacttgct

SEQ ID NO: 150688 - DNA, 22 bp, Artificial Sequence
  Synthetic oligonucleotide; TTT chr11 5184216 5184237 5184221 5184216 -
ccactcaatattaaacttgctt

SEQ ID NO: 150689 - DNA, 22 bp, Artificial Sequence
  Synthetic oligonucleotide; TTC chr11 5184215 5184236 5184220 5184215 -
cactcaatattaaacttgcttc

SEQ ID NO: 150690 - DNA, 22 bp, Artificial Sequence
  Synthetic oligonucleotide; CTC chr11 5184210 5184231 5184215 5184210 -
aatattaaacttgcttctatcc

SEQ ID NO: 150691 - DNA, 22 bp, Artificial Sequence
  Synthetic oligonucleotide; TTA chr11 5184203 5184224 5184208 5184203 -
aacttgcttctatccacatttt

SEQ ID NO: 150692 - DNA, 22 bp, Artificial Sequence
  Synthetic oligonucleotide; CTT chr11 5184198 5184219 5184203 5184198 -
gcttctatccacattttttaga

SEQ ID NO: 150693 - DNA, 22 bp, Artificial Sequence
  Synthetic oligonucleotide; TTG chr11 5184197 5184218 5184202 5184197 -
cttctatccacattttttagaa

SEQ ID NO: 150694 - DNA, 22 bp, Artificial Sequence
  Synthetic oligonucleotide; CTT chr11 5184194 5184215 5184199 5184194 -
ctatccacattttttagaacta

SEQ ID NO: 150695 - DNA, 22 bp, Artificial Sequence
  Synthetic oligonucleotide; TTC chr11 5184193 5184214 5184198 5184193 -
tatccacattttttagaactag

SEQ ID NO: 150696 - DNA, 22 bp, Artificial Sequence
  Synthetic oligonucleotide; CTA chr11 5184191 5184212 5184196 5184191 -
tccacattttttagaactagta

SEQ ID NO: 150697 - DNA, 22 bp, Artificial Sequence
  Synthetic oligonucleotide; TTT chr11 5184182 5184203 5184187 5184182 -
tttagaactagtaattagtaat

SEQ ID NO: 150698 - DNA, 22 bp, Artificial Sequence
  Synthetic oligonucleotide; TTT chr11 5184181 5184202 5184186 5184181 -
ttagaactagtaattagtaata

SEQ ID NO: 150699 - DNA, 22 bp, Artificial Sequence
  Synthetic oligonucleotide; TTT chr11 5184180 5184201 5184185 5184180 -
tagaactagtaattagtaataa

SEQ ID NO: 150700 - DNA, 22 bp, Artificial Sequence
  Synthetic oligonucleotide; TTT chr11 5184179 5184200 5184184 5184179 -
agaactagtaattagtaataac

SEQ ID NO: 150701 - DNA, 22 bp, Artificial Sequence
  Synthetic oligonucleotide; TTA chr11 5184178 5184199 5184183 5184178 -
gaactagtaattagtaataaca

SEQ ID NO: 150702 - DNA, 22 bp, Artificial Sequence
  Synthetic oligonucleotide; CTA chr11 5184172 5184193 5184177 5184172 -
gtaattagtaataacaagtaat

SEQ ID NO: 150703 - DNA, 22 bp, Artificial Sequence
  Synthetic oligonucleotide; TTA chr11 5184165 5184186 5184170 5184165 -
gtaataacaagtaatatattga

SEQ ID NO: 150704 - DNA, 22 bp, Artificial Sequence
  Synthetic oligonucleotide; TTG chr11 5184144 5184165 5184149 5184144 -
aagtaatatagactcctgtttt

SEQ ID NO: 150705 - DNA, 22 bp, Artificial Sequence
  Synthetic oligonucleotide; CTC chr11 5184129 5184150 5184134 5184129 -
ctgttttataatgtgaaaacat

SEQ ID NO: 150706 - DNA, 22 bp, Artificial Sequence
  Synthetic oligonucleotide; CTG chr11 5184126 5184147 5184131 5184126 -
ttttataatgtgaaaacattaa

SEQ ID NO: 150707 - DNA, 22 bp, Artificial Sequence
  Synthetic oligonucleotide; TTT chr11 5184123 5184144 5184128 5184123 -
tataatgtgaaaacattaaatt

SEQ ID NO: 150708 - DNA, 22 bp, Artificial Sequence
  Synthetic oligonucleotide; TTT chr11 5184122 5184143 5184127 5184122 -
ataatgtgaaaacattaaatta

SEQ ID NO: 150709 - DNA, 22 bp, Artificial Sequence
  Synthetic oligonucleotide; TTA chr11 5184121 5184142 5184126 5184121 -
taatgtgaaaacattaaattac

SEQ ID NO: 150710 - DNA, 22 bp, Artificial Sequence
  Synthetic oligonucleotide; TTA chr11 5184105 5184126 5184110 5184105 -
aattacttgctgctgtggtggt

SEQ ID NO: 150711 - DNA, 22 bp, Artificial Sequence
  Synthetic oligonucleotide; TTA chr11 5184100 5184121 5184105 5184100 -
cttgctgctgtggtggtactta

SEQ ID NO: 150712 - DNA, 22 bp, Artificial Sequence
  Synthetic oligonucleotide; CTT chr11 5184097 5184118 5184102 5184097 -
gctgctgtggtggtacttagat

SEQ ID NO: 150713 - DNA, 22 bp, Artificial Sequence
  Synthetic oligonucleotide; TTG chr11 5184096 5184117 5184101 5184096 -
ctgctgtggtggtacttagata

SEQ ID NO: 150714 - DNA, 22 bp, Artificial Sequence
  Synthetic oligonucleotide; CTG chr11 5184093 5184114 5184098 5184093 -
ctgtggtggtacttagatatac

SEQ ID NO: 150715 - DNA, 22 bp, Artificial Sequence
  Synthetic oligonucleotide; CTG chr11 5184090 5184111 5184095 5184090 -
tggtggtacttagatatacaat

SEQ ID NO: 150716 - DNA, 22 bp, Artificial Sequence
  Synthetic oligonucleotide; CTT chr11 5184079 5184100 5184084 5184079 -
agatatacaatgtgtaaactat

SEQ ID NO: 150717 - DNA, 22 bp, Artificial Sequence
  Synthetic oligonucleotide; TTA chr11 5184078 5184099 5184083 5184078 -
gatatacaatgtgtaaactatt

SEQ ID NO: 150718 - DNA, 22 bp, Artificial Sequence
  Synthetic oligonucleotide; CTA chr11 5184058 5184079 5184063 5184058 -
ttaattattgtctcaatttcag

SEQ ID NO: 150719 - DNA, 22 bp, Artificial Sequence
  Synthetic oligonucleotide; TTA chr11 5184055 5184076 5184060 5184055 -
attattgtctcaatttcagagc

SEQ ID NO: 150720 - DNA, 22 bp, Artificial Sequence
  Synthetic oligonucleotide; TTA chr11 5184051 5184072 5184056 5184051 -
ttgtctcaatttcagagcctat

SEQ ID NO: 150721 - DNA, 22 bp, Artificial Sequence
  Synthetic oligonucleotide; TTG chr11 5184048 5184069 5184053 5184048 -
tctcaatttcagagcctattat

SEQ ID NO: 150722 - DNA, 22 bp, Artificial Sequence
  Synthetic oligonucleotide; CTC chr11 5184044 5184065 5184049 5184044 -
aatttcagagcctattatttgt

SEQ ID NO: 150723 - DNA, 22 bp, Artificial Sequence
  Synthetic oligonucleotide; TTT chr11 5184039 5184060 5184044 5184039 -
cagagcctattatttgtctatt

SEQ ID NO: 150724 - DNA, 22 bp, Artificial Sequence
  Synthetic oligonucleotide; TTC chr11 5184038 5184059 5184043 5184038 -
agagcctattatttgtctatta

SEQ ID NO: 150725 - DNA, 22 bp, Artificial Sequence
  Synthetic oligonucleotide; CTA chr11 5184030 5184051 5184035 5184030 -
ttatttgtctattaagagattc

SEQ ID NO: 150726 - DNA, 22 bp, Artificial Sequence
  Synthetic oligonucleotide; TTA chr11 5184027 5184048 5184032 5184027 -
tttgtctattaagagattcaat

SEQ ID NO: 150727 - DNA, 22 bp, Artificial Sequence
  Synthetic oligonucleotide; TTT chr11 5184024 5184045 5184029 5184024 -
gtctattaagagattcaatttc

SEQ ID NO: 150728 - DNA, 22 bp, Artificial Sequence
  Synthetic oligonucleotide; TTG chr11 5184023 5184044 5184028 5184023 -
tctattaagagattcaatttct

SEQ ID NO: 150729 - DNA, 22 bp, Artificial Sequence
  Synthetic oligonucleotide; CTA chr11 5184019 5184040 5184024 5184019 -
ttaagagattcaatttctccct

SEQ ID NO: 150730 - DNA, 22 bp, Artificial Sequence
  Synthetic oligonucleotide; TTA chr11 5184016 5184037 5184021 5184016 -
agagattcaatttctccctggt

SEQ ID NO: 150731 - DNA, 22 bp, Artificial Sequence
  Synthetic oligonucleotide; TTC chr11 5184008 5184029 5184013 5184008 -
aatttctccctggtttagtctt

SEQ ID NO: 150732 - DNA, 22 bp, Artificial Sequence
  Synthetic oligonucleotide; TTT chr11 5184003 5184024 5184008 5184003 -
ctccctggtttagtcttgggag

SEQ ID NO: 150733 - DNA, 22 bp, Artificial Sequence
  Synthetic oligonucleotide; TTC chr11 5184002 5184023 5184007 5184002 -
tccctggtttagtcttgggagg

SEQ ID NO: 150734 - DNA, 22 bp, Artificial Sequence
  Synthetic oligonucleotide; CTC chr11 5184000 5184021 5184005 5184000 -
cctggtttagtcttgggagggt

SEQ ID NO: 150735 - DNA, 22 bp, Artificial Sequence
  Synthetic oligonucleotide; CTG chr11 5183996 5184017 5184001 5183996 -
gtttagtcttgggagggtgtat

SEQ ID NO: 150736 - DNA, 22 bp, Artificial Sequence
  Synthetic oligonucleotide; TTT chr11 5183992 5184013 5183997 5183992 -
agtcttgggagggtgtatgtgt

SEQ ID NO: 150737 - DNA, 22 bp, Artificial Sequence
  Synthetic oligonucleotide; TTA chr11 5183991 5184012 5183996 5183991 -
gtcttgggagggtgtatgtgtc

SEQ ID NO: 150738 - DNA, 22 bp, Artificial Sequence
  Synthetic oligonucleotide; CTT chr11 5183986 5184007 5183991 5183986 -
gggagggtgtatgtgtcgagga

SEQ ID NO: 150739 - DNA, 22 bp, Artificial Sequence
  Synthetic oligonucleotide; TTG chr11 5183985 5184006 5183990 5183985 -
ggagggtgtatgtgtcgaggaa

SEQ ID NO: 150740 - DNA, 22 bp, Artificial Sequence
  Synthetic oligonucleotide; TTT chr11 5183960 5183981 5183965 5183960 -
atccatttctactagattttct

SEQ ID NO: 150741 - DNA, 22 bp, Artificial Sequence
  Synthetic oligonucleotide; TTA chr11 5183959 5183980 5183964 5183959 -
tccatttctactagattttcta

SEQ ID NO: 150742 - DNA, 22 bp, Artificial Sequence
  Synthetic oligonucleotide; TTT chr11 5183952 5183973 5183957 5183952 -
ctactagattttctagtttatt

SEQ ID NO: 150743 - DNA, 22 bp, Artificial Sequence
  Synthetic oligonucleotide; TTC chr11 5183951 5183972 5183956 5183951 -
tactagattttctagtttattt

SEQ ID NO: 150744 - DNA, 22 bp, Artificial Sequence
  Synthetic oligonucleotide; CTA chr11 5183949 5183970 5183954 5183949 -
ctagattttctagtttatttgc

SEQ ID NO: 150745 - DNA, 22 bp, Artificial Sequence
  Synthetic oligonucleotide; CTA chr11 5183946 5183967 5183951 5183946 -
gattttctagtttatttgcgta

SEQ ID NO: 150746 - DNA, 22 bp, Artificial Sequence
  Synthetic oligonucleotide; TTT chr11 5183941 5183962 5183946 5183941 -
tctagtttatttgcgtagaggt

SEQ ID NO: 150747 - DNA, 22 bp, Artificial Sequence
  Synthetic oligonucleotide; TTT chr11 5183940 5183961 5183945 5183940 -
ctagtttatttgcgtagaggtg

SEQ ID NO: 150748 - DNA, 22 bp, Artificial Sequence
  Synthetic oligonucleotide; TTC chr11 5183939 5183960 5183944 5183939 -
tagtttatttgcgtagaggtgt

SEQ ID NO: 150749 - DNA, 22 bp, Artificial Sequence
  Synthetic oligonucleotide; CTA chr11 5183937 5183958 5183942 5183937 -
gtttatttgcgtagaggtgttt

SEQ ID NO: 150750 - DNA, 22 bp, Artificial Sequence
  Synthetic oligonucleotide; TTT chr11 5183933 5183954 5183938 5183933 -
atttgcgtagaggtgtttatag

SEQ ID NO: 150751 - DNA, 22 bp, Artificial Sequence
  Synthetic oligonucleotide; TTA chr11 5183932 5183953 5183937 5183932 -
tttgcgtagaggtgtttatagt

SEQ ID NO: 150752 - DNA, 22 bp, Artificial Sequence
  Synthetic oligonucleotide; TTT chr11 5183929 5183950 5183934 5183929 -
gcgtagaggtgtttatagtatt

SEQ ID NO: 150753 - DNA, 22 bp, Artificial Sequence
  Synthetic oligonucleotide; TTG chr11 5183928 5183949 5183933 5183928 -
cgtagaggtgtttatagtattc

SEQ ID NO: 150754 - DNA, 22 bp, Artificial Sequence
  Synthetic oligonucleotide; TTT chr11 5183915 5183936 5183920 5183915 -
atagtattctctgatggtagtt

SEQ ID NO: 150755 - DNA, 22 bp, Artificial Sequence
  Synthetic oligonucleotide; TTA chr11 5183914 5183935 5183919 5183914 -
tagtattctctgatggtagttt

SEQ ID NO: 150756 - DNA, 22 bp, Artificial Sequence
  Synthetic oligonucleotide; TTC chr11 5183906 5183927 5183911 5183906 -
tctgatggtagtttgtatgtct

SEQ ID NO: 150757 - DNA, 22 bp, Artificial Sequence
  Synthetic oligonucleotide; CTC chr11 5183904 5183925 5183909 5183904 -
tgatggtagtttgtatgtctgt

SEQ ID NO: 150758 - DNA, 22 bp, Artificial Sequence
  Synthetic oligonucleotide; CTG chr11 5183902 5183923 5183907 5183902 -
atggtagtttgtatgtctgtgg

SEQ ID NO: 150759 - DNA, 22 bp, Artificial Sequence
  Synthetic oligonucleotide; TTT chr11 5183892 5183913 5183897 5183892 -
gtatgtctgtgggattggtggt

SEQ ID NO: 150760 - DNA, 22 bp, Artificial Sequence
  Synthetic oligonucleotide; TTG chr11 5183891 5183912 5183896 5183891 -
tatgtctgtgggattggtggtg

SEQ ID NO: 150761 - DNA, 22 bp, Artificial Sequence
  Synthetic oligonucleotide; CTG chr11 5183883 5183904 5183888 5183883 -
tgggattggtggtgatatcccc

SEQ ID NO: 150762 - DNA, 22 bp, Artificial Sequence
  Synthetic oligonucleotide; TTG chr11 5183875 5183896 5183880 5183875 -
gtggtgatatcccctttatcat

SEQ ID NO: 150763 - DNA, 22 bp, Artificial Sequence
  Synthetic oligonucleotide; CTT chr11 5183859 5183880 5183864 5183859 -
tatcatttcttattgcatctat

SEQ ID NO: 150764 - DNA, 22 bp, Artificial Sequence
  Synthetic oligonucleotide; TTT chr11 5183858 5183879 5183863 5183858 -
atcatttcttattgcatctatt

SEQ ID NO: 150765 - DNA, 22 bp, Artificial Sequence
  Synthetic oligonucleotide; TTA chr11 5183857 5183878 5183862 5183857 -
tcatttcttattgcatctattt

SEQ ID NO: 150766 - DNA, 22 bp, Artificial Sequence
  Synthetic oligonucleotide; TTT chr11 5183851 5183872 5183856 5183851 -
cttattgcatctatttgagtct

SEQ ID NO: 150767 - DNA, 22 bp, Artificial Sequence
  Synthetic oligonucleotide; TTC chr11 5183850 5183871 5183855 5183850 -
ttattgcatctatttgagtctt

SEQ ID NO: 150768 - DNA, 22 bp, Artificial Sequence
  Synthetic oligonucleotide; CTT chr11 5183848 5183869 5183853 5183848 -
attgcatctatttgagtcttct

SEQ ID NO: 150769 - DNA, 22 bp, Artificial Sequence
  Synthetic oligonucleotide; TTA chr11 5183847 5183868 5183852 5183847 -
ttgcatctatttgagtcttctc

SEQ ID NO: 150770 - DNA, 22 bp, Artificial Sequence
  Synthetic oligonucleotide; TTG chr11 5183844 5183865 5183849 5183844 -
catctatttgagtcttctctct

SEQ ID NO: 150771 - DNA, 22 bp, Artificial Sequence
  Synthetic oligonucleotide; CTA chr11 5183838 5183859 5183843 5183838 -
tttgagtcttctctcttttctt

SEQ ID NO: 150772 - DNA, 22 bp, Artificial Sequence
  Synthetic oligonucleotide; TTT chr11 5183835 5183856 5183840 5183835 -
gagtcttctctcttttcttctt

SEQ ID NO: 150773 - DNA, 22 bp, Artificial Sequence
  Synthetic oligonucleotide; TTG chr11 5183834 5183855 5183839 5183834 -
agtcttctctcttttcttcttt

SEQ ID NO: 150774 - DNA, 22 bp, Artificial Sequence
  Synthetic oligonucleotide; CTT chr11 5183828 5183849 5183833 5183828 -
ctctcttttcttctttattagt

SEQ ID NO: 150775 - DNA, 22 bp, Artificial Sequence
  Synthetic oligonucleotide; TTC chr11 5183827 5183848 5183832 5183827 -
tctcttttcttctttattagtc

SEQ ID NO: 150776 - DNA, 22 bp, Artificial Sequence
  Synthetic oligonucleotide; CTC chr11 5183825 5183846 5183830 5183825 -
tcttttcttctttattagtctt

SEQ ID NO: 150777 - DNA, 22 bp, Artificial Sequence
  Synthetic oligonucleotide; CTC chr11 5183823 5183844 5183828 5183823 -
ttttcttctttattagtcttgc

SEQ ID NO: 150778 - DNA, 22 bp, Artificial Sequence
  Synthetic oligonucleotide; CTT chr11 5183821 5183842 5183826 5183821 -
ttcttctttattagtcttgcta

SEQ ID NO: 150779 - DNA, 22 bp, Artificial Sequence
  Synthetic oligonucleotide; TTT chr11 5183820 5183841 5183825 5183820 -
tcttctttattagtcttgctag

SEQ ID NO: 150780 - DNA, 22 bp, Artificial Sequence
  Synthetic oligonucleotide; TTT chr11 5183819 5183840 5183824 5183819 -
cttctttattagtcttgctagc

SEQ ID NO: 150781 - DNA, 22 bp, Artificial Sequence
  Synthetic oligonucleotide; TTC chr11 5183818 5183839 5183823 5183818 -
ttctttattagtcttgctagca

SEQ ID NO: 150782 - DNA, 22 bp, Artificial Sequence
  Synthetic oligonucleotide; CTT chr11 5183816 5183837 5183821 5183816 -
ctttattagtcttgctagcagt

SEQ ID NO: 150783 - DNA, 22 bp, Artificial Sequence
  Synthetic oligonucleotide; TTC chr11 5183815 5183836 5183820 5183815 -
tttattagtcttgctagcagtc

SEQ ID NO: 150784 - DNA, 22 bp, Artificial Sequence
  Synthetic oligonucleotide; CTT chr11 5183813 5183834 5183818 5183813 -
tattagtcttgctagcagtcta

SEQ ID NO: 150785 - DNA, 22 bp, Artificial Sequence
  Synthetic oligonucleotide; TTT chr11 5183812 5183833 5183817 5183812 -
attagtcttgctagcagtctat

SEQ ID NO: 150786 - DNA, 22 bp, Artificial Sequence
  Synthetic oligonucleotide; TTA chr11 5183811 5183832 5183816 5183811 -
ttagtcttgctagcagtctatc

SEQ ID NO: 150787 - DNA, 22 bp, Artificial Sequence
  Synthetic oligonucleotide; TTA chr11 5183808 5183829 5183813 5183808 -
gtcttgctagcagtctatcaat

SEQ ID NO: 150788 - DNA, 22 bp, Artificial Sequence
  Synthetic oligonucleotide; CTT chr11 5183803 5183824 5183808 5183803 -
gctagcagtctatcaattttgt

SEQ ID NO: 150789 - DNA, 22 bp, Artificial Sequence
  Synthetic oligonucleotide; TTG chr11 5183802 5183823 5183807 5183802 -
ctagcagtctatcaattttgtt

SEQ ID NO: 150790 - DNA, 22 bp, Artificial Sequence
  Synthetic oligonucleotide; CTA chr11 5183799 5183820 5183804 5183799 -
gcagtctatcaattttgttgat

SEQ ID NO: 150791 - DNA, 22 bp, Artificial Sequence
  Synthetic oligonucleotide; CTA chr11 5183791 5183812 5183796 5183791 -
tcaattttgttgatcttttcaa

SEQ ID NO: 150792 - DNA, 22 bp, Artificial Sequence
  Synthetic oligonucleotide; TTT chr11 5183784 5183805 5183789 5183784 -
tgttgatcttttcaaaaaacca

SEQ ID NO: 150793 - DNA, 22 bp, Artificial Sequence
  Synthetic oligonucleotide; TTT chr11 5183783 5183804 5183788 5183783 -
gttgatcttttcaaaaaaccag

SEQ ID NO: 150794 - DNA, 22 bp, Artificial Sequence
  Synthetic oligonucleotide; TTG chr11 5183782 5183803 5183787 5183782 -
ttgatcttttcaaaaaaccagc

SEQ ID NO: 150795 - DNA, 22 bp, Artificial Sequence
  Synthetic oligonucleotide; TTG chr11 5183779 5183800 5183784 5183779 -
atcttttcaaaaaaccagctcc

SEQ ID NO: 150796 - DNA, 22 bp, Artificial Sequence
  Synthetic oligonucleotide; CTT chr11 5183774 5183795 5183779 5183774 -
ttcaaaaaaccagctcctggat

SEQ ID NO: 150797 - DNA, 22 bp, Artificial Sequence
  Synthetic oligonucleotide; TTT chr11 5183773 5183794 5183778 5183773 -
tcaaaaaaccagctcctggatt

SEQ ID NO: 150798 - DNA, 22 bp, Artificial Sequence
  Synthetic oligonucleotide; TTT chr11 5183772 5183793 5183777 5183772 -
caaaaaaccagctcctggattc

SEQ ID NO: 150799 - DNA, 22 bp, Artificial Sequence
  Synthetic oligonucleotide; TTC chr11 5183771 5183792 5183776 5183771 -
aaaaaaccagctcctggattca

SEQ ID NO: 150800 - DNA, 22 bp, Artificial Sequence
  Synthetic oligonucleotide; CTC chr11 5183758 5183779 5183763 5183758 -
ctggattcattgatttttttaa

SEQ ID NO: 150801 - DNA, 22 bp, Artificial Sequence
  Synthetic oligonucleotide; CTG chr11 5183755 5183776 5183760 5183755 -
gattcattgatttttttaaggg

SEQ ID NO: 150802 - DNA, 22 bp, Artificial Sequence
  Synthetic oligonucleotide; TTC chr11 5183750 5183771 5183755 5183750 -
attgatttttttaagggttttt

SEQ ID NO: 150803 - DNA, 22 bp, Artificial Sequence
  Synthetic oligonucleotide; TTG chr11 5183746 5183767 5183751 5183746 -
atttttttaagggttttttgtg

SEQ ID NO: 150804 - DNA, 22 bp, Artificial Sequence
  Synthetic oligonucleotide; TTT chr11 5183742 5183763 5183747 5183742 -
ttttaagggttttttgtgtctc

SEQ ID NO: 150805 - DNA, 22 bp, Artificial Sequence
  Synthetic oligonucleotide; TTT chr11 5183741 5183762 5183746 5183741 -
tttaagggttttttgtgtctca

SEQ ID NO: 150806 - DNA, 22 bp, Artificial Sequence
  Synthetic oligonucleotide; TTT chr11 5183740 5183761 5183745 5183740 -
ttaagggttttttgtgtctcaa

SEQ ID NO: 150807 - DNA, 22 bp, Artificial Sequence
  Synthetic oligonucleotide; TTT chr11 5183739 5183760 5183744 5183739 -
taagggttttttgtgtctcaat

SEQ ID NO: 150808 - DNA, 22 bp, Artificial Sequence
  Synthetic oligonucleotide; TTT chr11 5183738 5183759 5183743 5183738 -
aagggttttttgtgtctcaatc

SEQ ID NO: 150809 - DNA, 22 bp, Artificial Sequence
  Synthetic oligonucleotide; TTA chr11 5183737 5183758 5183742 5183737 -
agggttttttgtgtctcaatct

SEQ ID NO: 150810 - DNA, 22 bp, Artificial Sequence
  Synthetic oligonucleotide; TTT chr11 5183730 5183751 5183735 5183730 -
tttgtgtctcaatctccttcac

SEQ ID NO: 150811 - DNA, 22 bp, Artificial Sequence
  Synthetic oligonucleotide; TTT chr11 5183729 5183750 5183734 5183729 -
ttgtgtctcaatctccttcact

SEQ ID NO: 150812 - DNA, 22 bp, Artificial Sequence
  Synthetic oligonucleotide; TTT chr11 5183728 5183749 5183733 5183728 -
tgtgtctcaatctccttcactt

SEQ ID NO: 150813 - DNA, 22 bp, Artificial Sequence
  Synthetic oligonucleotide; TTT chr11 5183727 5183748 5183732 5183727 -
gtgtctcaatctccttcacttc

SEQ ID NO: 150814 - DNA, 22 bp, Artificial Sequence
  Synthetic oligonucleotide; TTG chr11 5183726 5183747 5183731 5183726 -
tgtctcaatctccttcacttct

SEQ ID NO: 150815 - DNA, 22 bp, Artificial Sequence
  Synthetic oligonucleotide; CTC chr11 5183720 5183741 5183725 5183720 -
aatctccttcacttctgctctg

SEQ ID NO: 150816 - DNA, 22 bp, Artificial Sequence
  Synthetic oligonucleotide; CTC chr11 5183714 5183735 5183719 5183714 -
cttcacttctgctctgatctta

SEQ ID NO: 150817 - DNA, 22 bp, Artificial Sequence
  Synthetic oligonucleotide; CTT chr11 5183711 5183732 5183716 5183711 -
cacttctgctctgatcttactt

SEQ ID NO: 150818 - DNA, 22 bp, Artificial Sequence
  Synthetic oligonucleotide; TTC chr11 5183710 5183731 5183715 5183710 -
acttctgctctgatcttactta

SEQ ID NO: 150819 - DNA, 22 bp, Artificial Sequence
  Synthetic oligonucleotide; CTT chr11 5183706 5183727 5183711 5183706 -
ctgctctgatcttacttatttc

SEQ ID NO: 150820 - DNA, 22 bp, Artificial Sequence
  Synthetic oligonucleotide; TTC chr11 5183705 5183726 5183710 5183705 -
tgctctgatcttacttatttct

SEQ ID NO: 150821 - DNA, 22 bp, Artificial Sequence
  Synthetic oligonucleotide; CTG chr11 5183703 5183724 5183708 5183703 -
ctctgatcttacttatttcttg

SEQ ID NO: 150822 - DNA, 22 bp, Artificial Sequence
  Synthetic oligonucleotide; CTC chr11 5183700 5183721 5183705 5183700 -
tgatcttacttatttcttgcct

SEQ ID NO: 150823 - DNA, 22 bp, Artificial Sequence
  Synthetic oligonucleotide; CTG chr11 5183698 5183719 5183703 5183698 -
atcttacttatttcttgccttc

SEQ ID NO: 150824 - DNA, 22 bp, Artificial Sequence
  Synthetic oligonucleotide; CTT chr11 5183693 5183714 5183698 5183693 -
acttatttcttgccttccgcta

SEQ ID NO: 150825 - DNA, 22 bp, Artificial Sequence
  Synthetic oligonucleotide; TTA chr11 5183692 5183713 5183697 5183692 -
cttatttcttgccttccgctag

SEQ ID NO: 150826 - DNA, 22 bp, Artificial Sequence
  Synthetic oligonucleotide; CTT chr11 5183689 5183710 5183694 5183689 -
atttcttgccttccgctagctt

SEQ ID NO: 150827 - DNA, 22 bp, Artificial Sequence
  Synthetic oligonucleotide; TTA chr11 5183688 5183709 5183693 5183688 -
tttcttgccttccgctagcttt

SEQ ID NO: 150828 - DNA, 22 bp, Artificial Sequence
  Synthetic oligonucleotide; TTT chr11 5183685 5183706 5183690 5183685 -
cttgccttccgctagcttttga

SEQ ID NO: 150829 - DNA, 22 bp, Artificial Sequence
  Synthetic oligonucleotide; TTC chr11 5183684 5183705 5183689 5183684 -
ttgccttccgctagcttttgaa

SEQ ID NO: 150830 - DNA, 22 bp, Artificial Sequence
  Synthetic oligonucleotide; CTT chr11 5183682 5183703 5183687 5183682 -
gccttccgctagcttttgaaag

SEQ ID NO: 150831 - DNA, 22 bp, Artificial Sequence
  Synthetic oligonucleotide; TTG chr11 5183681 5183702 5183686 5183681 -
ccttccgctagcttttgaaagt

SEQ ID NO: 150832 - DNA, 22 bp, Artificial Sequence
  Synthetic oligonucleotide; CTT chr11 5183677 5183698 5183682 5183677 -
ccgctagcttttgaaagtgttt

SEQ ID NO: 150833 - DNA, 22 bp, Artificial Sequence
  Synthetic oligonucleotide; TTC chr11 5183676 5183697 5183681 5183676 -
cgctagcttttgaaagtgtttg

SEQ ID NO: 150834 - DNA, 22 bp, Artificial Sequence
  Synthetic oligonucleotide; CTA chr11 5183671 5183692 5183676 5183671 -
gcttttgaaagtgtttgctctt

SEQ ID NO: 150835 - DNA, 22 bp, Artificial Sequence
  Synthetic oligonucleotide; CTT chr11 5183667 5183688 5183672 5183667 -
ttgaaagtgtttgctcttgctt

SEQ ID NO: 150836 - DNA, 22 bp, Artificial Sequence
  Synthetic oligonucleotide; TTT chr11 5183666 5183687 5183671 5183666 -
tgaaagtgtttgctcttgcttc

SEQ ID NO: 150837 - DNA, 22 bp, Artificial Sequence
  Synthetic oligonucleotide; TTT chr11 5183665 5183686 5183670 5183665 -
gaaagtgtttgctcttgcttct

SEQ ID NO: 150838 - DNA, 22 bp, Artificial Sequence
  Synthetic oligonucleotide; TTG chr11 5183664 5183685 5183669 5183664 -
aaagtgtttgctcttgcttctc

SEQ ID NO: 150839 - DNA, 22 bp, Artificial Sequence
  Synthetic oligonucleotide; TTT chr11 5183655 5183676 5183660 5183655 -
gctcttgcttctctagttcttt

SEQ ID NO: 150840 - DNA, 22 bp, Artificial Sequence
  Synthetic oligonucleotide; TTG chr11 5183654 5183675 5183659 5183654 -
ctcttgcttctctagttctttt

SEQ ID NO: 150841 - DNA, 22 bp, Artificial Sequence
  Synthetic oligonucleotide; CTC chr11 5183651 5183672 5183656 5183651 -
ttgcttctctagttcttttaat

SEQ ID NO: 150842 - DNA, 22 bp, Artificial Sequence
  Synthetic oligonucleotide; CTT chr11 5183649 5183670 5183654 5183649 -
gcttctctagttcttttaattg

SEQ ID NO: 150843 - DNA, 22 bp, Artificial Sequence
  Synthetic oligonucleotide; TTG chr11 5183648 5183669 5183653 5183648 -
cttctctagttcttttaattgt

SEQ ID NO: 150844 - DNA, 22 bp, Artificial Sequence
  Synthetic oligonucleotide; CTT chr11 5183645 5183666 5183650 5183645 -
ctctagttcttttaattgtgat

SEQ ID NO: 150845 - DNA, 22 bp, Artificial Sequence
  Synthetic oligonucleotide; TTC chr11 5183644 5183665 5183649 5183644 -
tctagttcttttaattgtgatg

SEQ ID NO: 150846 - DNA, 22 bp, Artificial Sequence
  Synthetic oligonucleotide; CTC chr11 5183642 5183663 5183647 5183642 -
tagttcttttaattgtgatgtt

SEQ ID NO: 150847 - DNA, 22 bp, Artificial Sequence
  Synthetic oligonucleotide; CTA chr11 5183640 5183661 5183645 5183640 -
gttcttttaattgtgatgttag

SEQ ID NO: 150848 - DNA, 22 bp, Artificial Sequence
  Synthetic oligonucleotide; TTC chr11 5183636 5183657 5183641 5183636 -
ttttaattgtgatgttagggtg

SEQ ID NO: 150849 - DNA, 22 bp, Artificial Sequence
  Synthetic oligonucleotide; CTT chr11 5183634 5183655 5183639 5183634 -
ttaattgtgatgttagggtgtc

SEQ ID NO: 150850 - DNA, 22 bp, Artificial Sequence
  Synthetic oligonucleotide; TTT chr11 5183633 5183654 5183638 5183633 -
taattgtgatgttagggtgtca

SEQ ID NO: 150851 - DNA, 22 bp, Artificial Sequence
  Synthetic oligonucleotide; TTT chr11 5183632 5183653 5183637 5183632 -
aattgtgatgttagggtgtcaa

SEQ ID NO: 150852 - DNA, 22 bp, Artificial Sequence
  Synthetic oligonucleotide; TTA chr11 5183631 5183652 5183636 5183631 -
attgtgatgttagggtgtcaat

SEQ ID NO: 150853 - DNA, 22 bp, Artificial Sequence
  Synthetic oligonucleotide; TTG chr11 5183627 5183648 5183632 5183627 -
tgatgttagggtgtcaatttta

SEQ ID NO: 150854 - DNA, 22 bp, Artificial Sequence
  Synthetic oligonucleotide; TTA chr11 5183619 5183640 5183624 5183619 -
gggtgtcaattttagatctttc

SEQ ID NO: 150855 - DNA, 22 bp, Artificial Sequence
  Synthetic oligonucleotide; TTT chr11 5183607 5183628 5183612 5183607 -
tagatctttcctgctttctttt

SEQ ID NO: 150856 - DNA, 22 bp, Artificial Sequence
  Synthetic oligonucleotide; TTT chr11 5183606 5183627 5183611 5183606 -
agatctttcctgctttcttttg

SEQ ID NO: 150857 - DNA, 22 bp, Artificial Sequence
  Synthetic oligonucleotide; TTA chr11 5183605 5183626 5183610 5183605 -
gatctttcctgctttcttttgt

SEQ ID NO: 150858 - DNA, 22 bp, Artificial Sequence
  Synthetic oligonucleotide; CTT chr11 5183599 5183620 5183604 5183599 -
tcctgctttcttttgtgggcat

SEQ ID NO: 150859 - DNA, 22 bp, Artificial Sequence
  Synthetic oligonucleotide; TTT chr11 5183598 5183619 5183603 5183598 -
cctgctttcttttgtgggcatt

SEQ ID NO: 150860 - DNA, 22 bp, Artificial Sequence
  Synthetic oligonucleotide; TTC chr11 5183597 5183618 5183602 5183597 -
ctgctttcttttgtgggcattt

SEQ ID NO: 150861 - DNA, 22 bp, Artificial Sequence
  Synthetic oligonucleotide; CTG chr11 5183594 5183615 5183599 5183594 -
ctttcttttgtgggcatttagt

SEQ ID NO: 150862 - DNA, 22 bp, Artificial Sequence
  Synthetic oligonucleotide; CTT chr11 5183591 5183612 5183596 5183591 -
tcttttgtgggcatttagtgct

SEQ ID NO: 150863 - DNA, 22 bp, Artificial Sequence
  Synthetic oligonucleotide; TTT chr11 5183590 5183611 5183595 5183590 -
cttttgtgggcatttagtgcta

SEQ ID NO: 150864 - DNA, 22 bp, Artificial Sequence
  Synthetic oligonucleotide; TTC chr11 5183589 5183610 5183594 5183589 -
ttttgtgggcatttagtgctat

SEQ ID NO: 150865 - DNA, 22 bp, Artificial Sequence
  Synthetic oligonucleotide; CTT chr11 5183587 5183608 5183592 5183587 -
ttgtgggcatttagtgctataa

SEQ ID NO: 150866 - DNA, 22 bp, Artificial Sequence
  Synthetic oligonucleotide; TTT chr11 5183586 5183607 5183591 5183586 -
tgtgggcatttagtgctataaa

SEQ ID NO: 150867 - DNA, 22 bp, Artificial Sequence
  Synthetic oligonucleotide; TTT chr11 5183585 5183606 5183590 5183585 -
gtgggcatttagtgctataaat

SEQ ID NO: 150868 - DNA, 22 bp, Artificial Sequence
  Synthetic oligonucleotide; TTG chr11 5183584 5183605 5183589 5183584 -
tgggcatttagtgctataaatt

SEQ ID NO: 150869 - DNA, 22 bp, Artificial Sequence
  Synthetic oligonucleotide; TTT chr11 5183575 5183596 5183580 5183575 -
agtgctataaatttccctctac

SEQ ID NO: 150870 - DNA, 22 bp, Artificial Sequence
  Synthetic oligonucleotide; TTA chr11 5183574 5183595 5183579 5183574 -
gtgctataaatttccctctaca

SEQ ID NO: 150871 - DNA, 22 bp, Artificial Sequence
  Synthetic oligonucleotide; CTA chr11 5183568 5183589 5183573 5183568 -
taaatttccctctacacactgc

SEQ ID NO: 150872 - DNA, 22 bp, Artificial Sequence
  Synthetic oligonucleotide; TTT chr11 5183561 5183582 5183566 5183561 -
ccctctacacactgctttaaat

SEQ ID NO: 150873 - DNA, 22 bp, Artificial Sequence
  Synthetic oligonucleotide; TTC chr11 5183560 5183581 5183565 5183560 -
cctctacacactgctttaaatg

SEQ ID NO: 150874 - DNA, 22 bp, Artificial Sequence
  Synthetic oligonucleotide; CTC chr11 5183556 5183577 5183561 5183556 -
tacacactgctttaaatgtgtc

SEQ ID NO: 150875 - DNA, 22 bp, Artificial Sequence
  Synthetic oligonucleotide; CTA chr11 5183554 5183575 5183559 5183554 -
cacactgctttaaatgtgtccc

SEQ ID NO: 150876 - DNA, 22 bp, Artificial Sequence
  Synthetic oligonucleotide; CTG chr11 5183547 5183568 5183552 5183547 -
ctttaaatgtgtcccagagatt

SEQ ID NO: 150877 - DNA, 22 bp, Artificial Sequence
  Synthetic oligonucleotide; CTT chr11 5183544 5183565 5183549 5183544 -
taaatgtgtcccagagattctg

SEQ ID NO: 150878 - DNA, 22 bp, Artificial Sequence
  Synthetic oligonucleotide; TTT chr11 5183543 5183564 5183548 5183543 -
aaatgtgtcccagagattctgt

SEQ ID NO: 150879 - DNA, 22 bp, Artificial Sequence
  Synthetic oligonucleotide; TTA chr11 5183542 5183563 5183547 5183542 -
aatgtgtcccagagattctgtt

SEQ ID NO: 150880 - DNA, 22 bp, Artificial Sequence
  Synthetic oligonucleotide; TTC chr11 5183524 5183545 5183529 5183524 -
tgttttgttgtatctttattct

SEQ ID NO: 150881 - DNA, 22 bp, Artificial Sequence
  Synthetic oligonucleotide; CTG chr11 5183522 5183543 5183527 5183522 -
ttttgttgtatctttattctcg

SEQ ID NO: 150882 - DNA, 22 bp, Artificial Sequence
  Synthetic oligonucleotide; TTT chr11 5183519 5183540 5183524 5183519 -
tgttgtatctttattctcgttg

SEQ ID NO: 150883 - DNA, 22 bp, Artificial Sequence
  Synthetic oligonucleotide; TTT chr11 5183518 5183539 5183523 5183518 -
gttgtatctttattctcgttgg

SEQ ID NO: 150884 - DNA, 22 bp, Artificial Sequence
  Synthetic oligonucleotide; TTG chr11 5183517 5183538 5183522 5183517 -
ttgtatctttattctcgttggt

SEQ ID NO: 150885 - DNA, 22 bp, Artificial Sequence
  Synthetic oligonucleotide; TTG chr11 5183514 5183535 5183519 5183514 -
tatctttattctcgttggtttc

SEQ ID NO: 150886 - DNA, 22 bp, Artificial Sequence
  Synthetic oligonucleotide; CTT chr11 5183508 5183529 5183513 5183508 -
tattctcgttggtttcaaagaa

SEQ ID NO: 150887 - DNA, 22 bp, Artificial Sequence
  Synthetic oligonucleotide; TTT chr11 5183507 5183528 5183512 5183507 -
attctcgttggtttcaaagaac

SEQ ID NO: 150888 - DNA, 22 bp, Artificial Sequence
  Synthetic oligonucleotide; TTA chr11 5183506 5183527 5183511 5183506 -
ttctcgttggtttcaaagaaca

SEQ ID NO: 150889 - DNA, 22 bp, Artificial Sequence
  Synthetic oligonucleotide; TTC chr11 5183503 5183524 5183508 5183503 -
tcgttggtttcaaagaacatct

SEQ ID NO: 150890 - DNA, 22 bp, Artificial Sequence
  Synthetic oligonucleotide; CTC chr11 5183501 5183522 5183506 5183501 -
gttggtttcaaagaacatcttt

SEQ ID NO: 150891 - DNA, 22 bp, Artificial Sequence
  Synthetic oligonucleotide; TTG chr11 5183497 5183518 5183502 5183497 -
gtttcaaagaacatctttattt

SEQ ID NO: 150892 - DNA, 22 bp, Artificial Sequence
  Synthetic oligonucleotide; TTT chr11 5183493 5183514 5183498 5183493 -
caaagaacatctttatttctgc

SEQ ID NO: 150893 - DNA, 22 bp, Artificial Sequence
  Synthetic oligonucleotide; TTC chr11 5183492 5183513 5183497 5183492 -
aaagaacatctttatttctgcc

SEQ ID NO: 150894 - DNA, 22 bp, Artificial Sequence
  Synthetic oligonucleotide; CTT chr11 5183480 5183501 5183485 5183480 -
tatttctgccttcattttgtta

SEQ ID NO: 150895 - DNA, 22 bp, Artificial Sequence
  Synthetic oligonucleotide; TTT chr11 5183479 5183500 5183484 5183479 -
atttctgccttcattttgttat

SEQ ID NO: 150896 - DNA, 22 bp, Artificial Sequence
  Synthetic oligonucleotide; TTA chr11 5183478 5183499 5183483 5183478 -
tttctgccttcattttgttatg

SEQ ID NO: 150897 - DNA, 22 bp, Artificial Sequence
  Synthetic oligonucleotide; TTT chr11 5183475 5183496 5183480 5183475 -
ctgccttcattttgttatgtac

SEQ ID NO: 150898 - DNA, 22 bp, Artificial Sequence
  Synthetic oligonucleotide; TTC chr11 5183474 5183495 5183479 5183474 -
tgccttcattttgttatgtacc

SEQ ID NO: 150899 - DNA, 22 bp, Artificial Sequence
  Synthetic oligonucleotide; CTG chr11 5183472 5183493 5183477 5183472 -
ccttcattttgttatgtaccca

SEQ ID NO: 150900 - DNA, 22 bp, Artificial Sequence
  Synthetic oligonucleotide; CTT chr11 5183468 5183489 5183473 5183468 -
cattttgttatgtacccagtag

SEQ ID NO: 150901 - DNA, 22 bp, Artificial Sequence
  Synthetic oligonucleotide; TTC chr11 5183467 5183488 5183472 5183467 -
attttgttatgtacccagtagt

SEQ ID NO: 150902 - DNA, 22 bp, Artificial Sequence
  Synthetic oligonucleotide; TTT chr11 5183463 5183484 5183468 5183463 -
tgttatgtacccagtagtcatt

SEQ ID NO: 150903 - DNA, 22 bp, Artificial Sequence
  Synthetic oligonucleotide; TTT chr11 5183462 5183483 5183467 5183462 -
gttatgtacccagtagtcattc

SEQ ID NO: 150904 - DNA, 22 bp, Artificial Sequence
  Synthetic oligonucleotide; TTG chr11 5183461 5183482 5183466 5183461 -
ttatgtacccagtagtcattca

SEQ ID NO: 150905 - DNA, 22 bp, Artificial Sequence
  Synthetic oligonucleotide; TTA chr11 5183458 5183479 5183463 5183458 -
tgtacccagtagtcattcagga

SEQ ID NO: 150906 - DNA, 22 bp, Artificial Sequence
  Synthetic oligonucleotide; TTC chr11 5183440 5183461 5183445 5183440 -
aggagcaggctgttcagtttcc

SEQ ID NO: 150907 - DNA, 22 bp, Artificial Sequence
  Synthetic oligonucleotide; CTG chr11 5183428 5183449 5183433 5183428 -
ttcagtttccatgtagttgagt

SEQ ID NO: 150908 - DNA, 22 bp, Artificial Sequence
  Synthetic oligonucleotide; TTC chr11 5183425 5183446 5183430 5183425 -
agtttccatgtagttgagtggt

SEQ ID NO: 150909 - DNA, 22 bp, Artificial Sequence
  Synthetic oligonucleotide; TTT chr11 5183420 5183441 5183425 5183420 -
ccatgtagttgagtggttttga

SEQ ID NO: 150910 - DNA, 22 bp, Artificial Sequence
  Synthetic oligonucleotide; TTC chr11 5183419 5183440 5183424 5183419 -
catgtagttgagtggttttgag

SEQ ID NO: 150911 - DNA, 22 bp, Artificial Sequence
  Synthetic oligonucleotide; TTG chr11 5183409 5183430 5183414 5183409 -
agtggttttgagtgagtttctt

SEQ ID NO: 150912 - DNA, 22 bp, Artificial Sequence
  Synthetic oligonucleotide; TTT chr11 5183401 5183422 5183406 5183401 -
tgagtgagtttcttaatcctga

SEQ ID NO: 150913 - DNA, 22 bp, Artificial Sequence
  Synthetic oligonucleotide; TTT chr11 5183400 5183421 5183405 5183400 -
gagtgagtttcttaatcctgag

SEQ ID NO: 150914 - DNA, 22 bp, Artificial Sequence
  Synthetic oligonucleotide; TTG chr11 5183399 5183420 5183404 5183399 -
agtgagtttcttaatcctgagt

SEQ ID NO: 150915 - DNA, 22 bp, Artificial Sequence
  Synthetic oligonucleotide; TTT chr11 5183390 5183411 5183395 5183390 -
cttaatcctgagttctagtttg

SEQ ID NO: 150916 - DNA, 22 bp, Artificial Sequence
  Synthetic oligonucleotide; TTC chr11 5183389 5183410 5183394 5183389 -
ttaatcctgagttctagtttga

SEQ ID NO: 150917 - DNA, 22 bp, Artificial Sequence
  Synthetic oligonucleotide; CTT chr11 5183387 5183408 5183392 5183387 -
aatcctgagttctagtttgatt

SEQ ID NO: 150918 - DNA, 22 bp, Artificial Sequence
  Synthetic oligonucleotide; TTA chr11 5183386 5183407 5183391 5183386 -
atcctgagttctagtttgattg

SEQ ID NO: 150919 - DNA, 22 bp, Artificial Sequence
  Synthetic oligonucleotide; CTG chr11 5183380 5183401 5183385 5183380 -
agttctagtttgattgcactgt

SEQ ID NO: 150920 - DNA, 22 bp, Artificial Sequence
  Synthetic oligonucleotide; TTC chr11 5183375 5183396 5183380 5183375 -
tagtttgattgcactgtggtct

SEQ ID NO: 150921 - DNA, 22 bp, Artificial Sequence
  Synthetic oligonucleotide; CTA chr11 5183373 5183394 5183378 5183373 -
gtttgattgcactgtggtctga

SEQ ID NO: 150922 - DNA, 22 bp, Artificial Sequence
  Synthetic oligonucleotide; TTT chr11 5183369 5183390 5183374 5183369 -
gattgcactgtggtctgagaga

SEQ ID NO: 150923 - DNA, 22 bp, Artificial Sequence
  Synthetic oligonucleotide; TTG chr11 5183368 5183389 5183373 5183368 -
attgcactgtggtctgagagac

SEQ ID NO: 150924 - DNA, 22 bp, Artificial Sequence
  Synthetic oligonucleotide; TTG chr11 5183364 5183385 5183369 5183364 -
cactgtggtctgagagacagtt

SEQ ID NO: 150925 - DNA, 22 bp, Artificial Sequence
  Synthetic oligonucleotide; CTG chr11 5183359 5183380 5183364 5183359 -
tggtctgagagacagtttgtta

SEQ ID NO: 150926 - DNA, 22 bp, Artificial Sequence
  Synthetic oligonucleotide; CTG chr11 5183352 5183373 5183357 5183352 -
agagacagtttgttattgtttc

SEQ ID NO: 150927 - DNA, 22 bp, Artificial Sequence
  Synthetic oligonucleotide; TTT chr11 5183341 5183362 5183346 5183341 -
gttattgtttctgttcttttac

SEQ ID NO: 150928 - DNA, 22 bp, Artificial Sequence
  Synthetic oligonucleotide; TTG chr11 5183340 5183361 5183345 5183340 -
ttattgtttctgttcttttacg

SEQ ID NO: 150929 - DNA, 22 bp, Artificial Sequence
  Synthetic oligonucleotide; TTA chr11 5183337 5183358 5183342 5183337 -
ttgtttctgttcttttacgttt

SEQ ID NO: 150930 - DNA, 22 bp, Artificial Sequence
  Synthetic oligonucleotide; TTG chr11 5183334 5183355 5183339 5183334 -
tttctgttcttttacgtttgct

SEQ ID NO: 150931 - DNA, 22 bp, Artificial Sequence
  Synthetic oligonucleotide; TTT chr11 5183331 5183352 5183336 5183331 -
ctgttcttttacgtttgctgag

SEQ ID NO: 150932 - DNA, 22 bp, Artificial Sequence
  Synthetic oligonucleotide; TTC chr11 5183330 5183351 5183335 5183330 -
tgttcttttacgtttgctgagg

SEQ ID NO: 150933 - DNA, 22 bp, Artificial Sequence
  Synthetic oligonucleotide; CTG chr11 5183328 5183349 5183333 5183328 -
ttcttttacgtttgctgaggag

SEQ ID NO: 150934 - DNA, 22 bp, Artificial Sequence
  Synthetic oligonucleotide; TTC chr11 5183325 5183346 5183330 5183325 -
ttttacgtttgctgaggagtgc

SEQ ID NO: 150935 - DNA, 22 bp, Artificial Sequence
  Synthetic oligonucleotide; CTT chr11 5183323 5183344 5183328 5183323 -
ttacgtttgctgaggagtgctt

SEQ ID NO: 150936 - DNA, 22 bp, Artificial Sequence
  Synthetic oligonucleotide; TTT chr11 5183322 5183343 5183327 5183322 -
tacgtttgctgaggagtgcttc

SEQ ID NO: 150937 - DNA, 22 bp, Artificial Sequence
  Synthetic oligonucleotide; TTT chr11 5183321 5183342 5183326 5183321 -
acgtttgctgaggagtgcttca

SEQ ID NO: 150938 - DNA, 22 bp, Artificial Sequence
  Synthetic oligonucleotide; TTA chr11 5183320 5183341 5183325 5183320 -
cgtttgctgaggagtgcttcac

SEQ ID NO: 150939 - DNA, 22 bp, Artificial Sequence
  Synthetic oligonucleotide; TTT chr11 5183315 5183336 5183320 5183315 -
gctgaggagtgcttcacttcca

SEQ ID NO: 150940 - DNA, 22 bp, Artificial Sequence
  Synthetic oligonucleotide; TTG chr11 5183314 5183335 5183319 5183314 -
ctgaggagtgcttcacttccaa

SEQ ID NO: 150941 - DNA, 22 bp, Artificial Sequence
  Synthetic oligonucleotide; CTG chr11 5183311 5183332 5183316 5183311 -
aggagtgcttcacttccaacta

SEQ ID NO: 150942 - DNA, 22 bp, Artificial Sequence
  Synthetic oligonucleotide; CTT chr11 5183301 5183322 5183306 5183301 -
cacttccaactatgtggtcaac

SEQ ID NO: 150943 - DNA, 22 bp, Artificial Sequence
  Synthetic oligonucleotide; TTC chr11 5183300 5183321 5183305 5183300 -
acttccaactatgtggtcaact

SEQ ID NO: 150944 - DNA, 22 bp, Artificial Sequence
  Synthetic oligonucleotide; CTT chr11 5183296 5183317 5183301 5183296 -
ccaactatgtggtcaactggaa

SEQ ID NO: 150945 - DNA, 22 bp, Artificial Sequence
  Synthetic oligonucleotide; TTC chr11 5183295 5183316 5183300 5183295 -
caactatgtggtcaactggaat

SEQ ID NO: 150946 - DNA, 22 bp, Artificial Sequence
  Synthetic oligonucleotide; CTA chr11 5183289 5183310 5183294 5183289 -
tgtggtcaactggaataggtgt

SEQ ID NO: 150947 - DNA, 22 bp, Artificial Sequence
  Synthetic oligonucleotide; CTG chr11 5183277 5183298 5183282 5183277 -
gaataggtgtggtgtggtgctg

SEQ ID NO: 150948 - DNA, 22 bp, Artificial Sequence
  Synthetic oligonucleotide; CTG chr11 5183255 5183276 5183260 5183255 -
agaagaatgtatattctattga

SEQ ID NO: 150949 - DNA, 22 bp, Artificial Sequence
  Synthetic oligonucleotide; TTC chr11 5183239 5183260 5183244 5183239 -
tattgatttgggatggagagtt

SEQ ID NO: 150950 - DNA, 22 bp, Artificial Sequence
  Synthetic oligonucleotide; CTA chr11 5183237 5183258 5183242 5183237 -
ttgatttgggatggagagttct

SEQ ID NO: 150951 - DNA, 22 bp, Artificial Sequence
  Synthetic oligonucleotide; TTG chr11 5183234 5183255 5183239 5183234 -
atttgggatggagagttctgta

SEQ ID NO: 150952 - DNA, 22 bp, Artificial Sequence
  Synthetic oligonucleotide; TTT chr11 5183230 5183251 5183235 5183230 -
gggatggagagttctgtagatg

SEQ ID NO: 150953 - DNA, 22 bp, Artificial Sequence
  Synthetic oligonucleotide; TTG chr11 5183229 5183250 5183234 5183229 -
ggatggagagttctgtagatgt

SEQ ID NO: 150954 - DNA, 22 bp, Artificial Sequence
  Synthetic oligonucleotide; TTC chr11 5183216 5183237 5183221 5183216 -
tgtagatgtctattaggtctgc

SEQ ID NO: 150955 - DNA, 22 bp, Artificial Sequence
  Synthetic oligonucleotide; CTG chr11 5183214 5183235 5183219 5183214 -
tagatgtctattaggtctgctt

SEQ ID NO: 150956 - DNA, 22 bp, Artificial Sequence
  Synthetic oligonucleotide; CTA chr11 5183204 5183225 5183209 5183204 -
ttaggtctgcttggtgcagagc

SEQ ID NO: 150957 - DNA, 22 bp, Artificial Sequence
  Synthetic oligonucleotide; TTA chr11 5183201 5183222 5183206 5183201 -
ggtctgcttggtgcagagctga

SEQ ID NO: 150958 - DNA, 22 bp, Artificial Sequence
  Synthetic oligonucleotide; CTG chr11 5183195 5183216 5183200 5183195 -
cttggtgcagagctgaattcaa

SEQ ID NO: 150959 - DNA, 22 bp, Artificial Sequence
  Synthetic oligonucleotide; CTT chr11 5183192 5183213 5183197 5183192 -
ggtgcagagctgaattcaattc

SEQ ID NO: 150960 - DNA, 22 bp, Artificial Sequence
  Synthetic oligonucleotide; TTG chr11 5183191 5183212 5183196 5183191 -
gtgcagagctgaattcaattcc

SEQ ID NO: 150961 - DNA, 22 bp, Artificial Sequence
  Synthetic oligonucleotide; CTG chr11 5183180 5183201 5183185 5183180 -
aattcaattcctggatatcctt

SEQ ID NO: 150962 - DNA, 22 bp, Artificial Sequence
  Synthetic oligonucleotide; TTC chr11 5183175 5183196 5183180 5183175 -
aattcctggatatccttgttaa

SEQ ID NO: 150963 - DNA, 22 bp, Artificial Sequence
  Synthetic oligonucleotide; TTC chr11 5183170 5183191 5183175 5183170 -
ctggatatccttgttaactttc

SEQ ID NO: 150964 - DNA, 22 bp, Artificial Sequence
  Synthetic oligonucleotide; CTG chr11 5183167 5183188 5183172 5183167 -
gatatccttgttaactttctgt

SEQ ID NO: 150965 - DNA, 22 bp, Artificial Sequence
  Synthetic oligonucleotide; CTT chr11 5183158 5183179 5183163 5183158 -
gttaactttctgtctcgttgat

SEQ ID NO: 150966 - DNA, 22 bp, Artificial Sequence
  Synthetic oligonucleotide; TTG chr11 5183157 5183178 5183162 5183157 -
ttaactttctgtctcgttgatc

SEQ ID NO: 150967 - DNA, 22 bp, Artificial Sequence
  Synthetic oligonucleotide; TTA chr11 5183154 5183175 5183159 5183154 -
actttctgtctcgttgatctgt

SEQ ID NO: 150968 - DNA, 22 bp, Artificial Sequence
  Synthetic oligonucleotide; CTT chr11 5183150 5183171 5183155 5183150 -
tctgtctcgttgatctgtctaa

SEQ ID NO: 150969 - DNA, 22 bp, Artificial Sequence
  Synthetic oligonucleotide; TTT chr11 5183149 5183170 5183154 5183149 -
ctgtctcgttgatctgtctaat

SEQ ID NO: 150970 - DNA, 22 bp, Artificial Sequence
  Synthetic oligonucleotide; TTC chr11 5183148 5183169 5183153 5183148 -
tgtctcgttgatctgtctaatg

SEQ ID NO: 150971 - DNA, 22 bp, Artificial Sequence
  Synthetic oligonucleotide; CTG chr11 5183146 5183167 5183151 5183146 -
tctcgttgatctgtctaatgtt

SEQ ID NO: 150972 - DNA, 22 bp, Artificial Sequence
  Synthetic oligonucleotide; CTC chr11 5183142 5183163 5183147 5183142 -
gttgatctgtctaatgttgaca

SEQ ID NO: 150973 - DNA, 22 bp, Artificial Sequence
  Synthetic oligonucleotide; TTG chr11 5183138 5183159 5183143 5183138 -
atctgtctaatgttgacagtgg

SEQ ID NO: 150974 - DNA, 22 bp, Artificial Sequence
  Synthetic oligonucleotide; CTG chr11 5183133 5183154 5183138 5183133 -
tctaatgttgacagtggggtgt

SEQ ID NO: 150975 - DNA, 22 bp, Artificial Sequence
  Synthetic oligonucleotide; CTA chr11 5183129 5183150 5183134 5183129 -
atgttgacagtggggtgttaaa

SEQ ID NO: 150976 - DNA, 22 bp, Artificial Sequence
  Synthetic oligonucleotide; TTG chr11 5183123 5183144 5183128 5183123 -
acagtggggtgttaaagtctcc

SEQ ID NO: 150977 - DNA, 22 bp, Artificial Sequence
  Synthetic oligonucleotide; TTA chr11 5183109 5183130 5183114 5183109 -
aagtctcccattattattgtgt

SEQ ID NO: 150978 - DNA, 22 bp, Artificial Sequence
  Synthetic oligonucleotide; CTC chr11 5183102 5183123 5183107 5183102 -
ccattattattgtgtgggagtc

SEQ ID NO: 150979 - DNA, 22 bp, Artificial Sequence
  Synthetic oligonucleotide; TTA chr11 5183096 5183117 5183101 5183096 -
ttattgtgtgggagtctaagtc

SEQ ID NO: 150980 - DNA, 22 bp, Artificial Sequence
  Synthetic oligonucleotide; TTA chr11 5183093 5183114 5183098 5183093 -
ttgtgtgggagtctaagtctct

SEQ ID NO: 150981 - DNA, 22 bp, Artificial Sequence
  Synthetic oligonucleotide; TTG chr11 5183090 5183111 5183095 5183090 -
tgtgggagtctaagtctctttg

SEQ ID NO: 150982 - DNA, 22 bp, Artificial Sequence
  Synthetic oligonucleotide; CTA chr11 5183078 5183099 5183083 5183078 -
agtctctttgtaggtctctaag

SEQ ID NO: 150983 - DNA, 22 bp, Artificial Sequence
  Synthetic oligonucleotide; CTC chr11 5183072 5183093 5183077 5183072 -
tttgtaggtctctaaggacttg

SEQ ID NO: 150984 - DNA, 22 bp, Artificial Sequence
  Synthetic oligonucleotide; CTT chr11 5183070 5183091 5183075 5183070 -
tgtaggtctctaaggacttgct

SEQ ID NO: 150985 - DNA, 22 bp, Artificial Sequence
  Synthetic oligonucleotide; TTT chr11 5183069 5183090 5183074 5183069 -
gtaggtctctaaggacttgctt

SEQ ID NO: 150986 - DNA, 22 bp, Artificial Sequence
  Synthetic oligonucleotide; TTG chr11 5183068 5183089 5183073 5183068 -
taggtctctaaggacttgcttt

SEQ ID NO: 150987 - DNA, 22 bp, Artificial Sequence
  Synthetic oligonucleotide; CTC chr11 5183060 5183081 5183065 5183060 -
taaggacttgctttatgaatct

SEQ ID NO: 150988 - DNA, 22 bp, Artificial Sequence
  Synthetic oligonucleotide; CTA chr11 5183058 5183079 5183063 5183058 -
aggacttgctttatgaatctgg

SEQ ID NO: 150989 - DNA, 22 bp, Artificial Sequence
  Synthetic oligonucleotide; CTT chr11 5183051 5183072 5183056 5183051 -
gctttatgaatctgggtgctgc

SEQ ID NO: 150990 - DNA, 22 bp, Artificial Sequence
  Synthetic oligonucleotide; TTG chr11 5183050 5183071 5183055 5183050 -
ctttatgaatctgggtgctgct

SEQ ID NO: 150991 - DNA, 22 bp, Artificial Sequence
  Synthetic oligonucleotide; CTT chr11 5183047 5183068 5183052 5183047 -
tatgaatctgggtgctgctgta

SEQ ID NO: 150992 - DNA, 22 bp, Artificial Sequence
  Synthetic oligonucleotide; TTT chr11 5183046 5183067 5183051 5183046 -
atgaatctgggtgctgctgtat

SEQ ID NO: 150993 - DNA, 22 bp, Artificial Sequence
  Synthetic oligonucleotide; TTA chr11 5183045 5183066 5183050 5183045 -
tgaatctgggtgctgctgtatt

SEQ ID NO: 150994 - DNA, 22 bp, Artificial Sequence
  Synthetic oligonucleotide; CTG chr11 5183037 5183058 5183042 5183037 -
ggtgctgctgtattgggtgcat

SEQ ID NO: 150995 - DNA, 22 bp, Artificial Sequence
  Synthetic oligonucleotide; CTG chr11 5183030 5183051 5183035 5183030 -
ctgtattgggtgcatatatatt

SEQ ID NO: 150996 - DNA, 22 bp, Artificial Sequence
  Synthetic oligonucleotide; CTG chr11 5183027 5183048 5183032 5183027 -
tattgggtgcatatatatttag

SEQ ID NO: 150997 - DNA, 22 bp, Artificial Sequence
  Synthetic oligonucleotide; TTG chr11 5183022 5183043 5183027 5183022 -
ggtgcatatatatttaggatag

SEQ ID NO: 150998 - DNA, 22 bp, Artificial Sequence
  Synthetic oligonucleotide; TTT chr11 5183007 5183028 5183012 5183007 -
aggatagttagctcttcttgtt

SEQ ID NO: 150999 - DNA, 22 bp, Artificial Sequence
  Synthetic oligonucleotide; TTA chr11 5183006 5183027 5183011 5183006 -
ggatagttagctcttcttgttg

SEQ ID NO: 151000 - DNA, 22 bp, Artificial Sequence
  Synthetic oligonucleotide; TTA chr11 5182997 5183018 5183002 5182997 -
gctcttcttgttgaattgatcc

SEQ ID NO: 151001 - DNA, 22 bp, Artificial Sequence
  Synthetic oligonucleotide; CTC chr11 5182993 5183014 5182998 5182993 -
ttcttgttgaattgatcccttt

SEQ ID NO: 151002 - DNA, 22 bp, Artificial Sequence
  Synthetic oligonucleotide; CTT chr11 5182991 5183012 5182996 5182991 -
cttgttgaattgatccctttac

SEQ ID NO: 151003 - DNA, 22 bp, Artificial Sequence
  Synthetic oligonucleotide; TTC chr11 5182990 5183011 5182995 5182990 -
ttgttgaattgatccctttacc

SEQ ID NO: 151004 - DNA, 22 bp, Artificial Sequence
  Synthetic oligonucleotide; CTT chr11 5182988 5183009 5182993 5182988 -
gttgaattgatccctttaccag

SEQ ID NO: 151005 - DNA, 22 bp, Artificial Sequence
  Synthetic oligonucleotide; TTG chr11 5182987 5183008 5182992 5182987 -
ttgaattgatccctttaccagt

SEQ ID NO: 151006 - DNA, 22 bp, Artificial Sequence
  Synthetic oligonucleotide; TTG chr11 5182984 5183005 5182989 5182984 -
aattgatccctttaccagtatg

SEQ ID NO: 151007 - DNA, 22 bp, Artificial Sequence
  Synthetic oligonucleotide; TTG chr11 5182979 5183000 5182984 5182979 -
atccctttaccagtatgtaatg

SEQ ID NO: 151008 - DNA, 22 bp, Artificial Sequence
  Synthetic oligonucleotide; CTT chr11 5182972 5182993 5182977 5182972 -
taccagtatgtaatggccttct

SEQ ID NO: 151009 - DNA, 22 bp, Artificial Sequence
  Synthetic oligonucleotide; TTT chr11 5182971 5182992 5182976 5182971 -
accagtatgtaatggccttctt

SEQ ID NO: 151010 - DNA, 22 bp, Artificial Sequence
  Synthetic oligonucleotide; TTA chr11 5182970 5182991 5182975 5182970 -
ccagtatgtaatggccttcttt

SEQ ID NO: 151011 - DNA, 22 bp, Artificial Sequence
  Synthetic oligonucleotide; CTT chr11 5182952 5182973 5182957 5182952 -
ctttgtctcttttgatctttgt

SEQ ID NO: 151012 - DNA, 22 bp, Artificial Sequence
  Synthetic oligonucleotide; TTC chr11 5182951 5182972 5182956 5182951 -
tttgtctcttttgatctttgtt

SEQ ID NO: 151013 - DNA, 22 bp, Artificial Sequence
  Synthetic oligonucleotide; CTT chr11 5182949 5182970 5182954 5182949 -
tgtctcttttgatctttgttgg

SEQ ID NO: 151014 - DNA, 22 bp, Artificial Sequence
  Synthetic oligonucleotide; TTT chr11 5182948 5182969 5182953 5182948 -
gtctcttttgatctttgttggt

SEQ ID NO: 151015 - DNA, 22 bp, Artificial Sequence
  Synthetic oligonucleotide; TTG chr11 5182947 5182968 5182952 5182947 -
tctcttttgatctttgttggtt

SEQ ID NO: 151016 - DNA, 22 bp, Artificial Sequence
  Synthetic oligonucleotide; CTC chr11 5182943 5182964 5182948 5182943 -
ttttgatctttgttggtttaaa

SEQ ID NO: 151017 - DNA, 22 bp, Artificial Sequence
  Synthetic oligonucleotide; CTT chr11 5182941 5182962 5182946 5182941 -
ttgatctttgttggtttaaagt

SEQ ID NO: 151018 - DNA, 22 bp, Artificial Sequence
  Synthetic oligonucleotide; TTT chr11 5182940 5182961 5182945 5182940 -
tgatctttgttggtttaaagtc

SEQ ID NO: 151019 - DNA, 22 bp, Artificial Sequence
  Synthetic oligonucleotide; TTT chr11 5182939 5182960 5182944 5182939 -
gatctttgttggtttaaagtct

SEQ ID NO: 151020 - DNA, 22 bp, Artificial Sequence
  Synthetic oligonucleotide; TTG chr11 5182938 5182959 5182943 5182938 -
atctttgttggtttaaagtctg

SEQ ID NO: 151021 - DNA, 22 bp, Artificial Sequence
  Synthetic oligonucleotide; CTT chr11 5182933 5182954 5182938 5182933 -
tgttggtttaaagtctgtttta

SEQ ID NO: 151022 - DNA, 22 bp, Artificial Sequence
  Synthetic oligonucleotide; TTT chr11 5182932 5182953 5182937 5182932 -
gttggtttaaagtctgttttat

SEQ ID NO: 151023 - DNA, 22 bp, Artificial Sequence
  Synthetic oligonucleotide; TTG chr11 5182931 5182952 5182936 5182931 -
ttggtttaaagtctgttttatc

SEQ ID NO: 151024 - DNA, 22 bp, Artificial Sequence
  Synthetic oligonucleotide; TTG chr11 5182928 5182949 5182933 5182928 -
gtttaaagtctgttttatcaga

SEQ ID NO: 151025 - DNA, 22 bp, Artificial Sequence
  Synthetic oligonucleotide; TTT chr11 5182924 5182945 5182929 5182924 -
aaagtctgttttatcagagact

SEQ ID NO: 151026 - DNA, 22 bp, Artificial Sequence
  Synthetic oligonucleotide; TTA chr11 5182923 5182944 5182928 5182923 -
aagtctgttttatcagagacta

SEQ ID NO: 151027 - DNA, 22 bp, Artificial Sequence
  Synthetic oligonucleotide; CTG chr11 5182916 5182937 5182921 5182916 -
ttttatcagagactaagattgc

SEQ ID NO: 151028 - DNA, 22 bp, Artificial Sequence
  Synthetic oligonucleotide; TTT chr11 5182913 5182934 5182918 5182913 -
tatcagagactaagattgcaaa

SEQ ID NO: 151029 - DNA, 22 bp, Artificial Sequence
  Synthetic oligonucleotide; TTT chr11 5182912 5182933 5182917 5182912 -
atcagagactaagattgcaaac

SEQ ID NO: 151030 - DNA, 22 bp, Artificial Sequence
  Synthetic oligonucleotide; TTA chr11 5182911 5182932 5182916 5182911 -
tcagagactaagattgcaaacc

SEQ ID NO: 151031 - DNA, 22 bp, Artificial Sequence
  Synthetic oligonucleotide; CTA chr11 5182901 5182922 5182906 5182901 -
agattgcaaaccctgccttttt

SEQ ID NO: 151032 - DNA, 22 bp, Artificial Sequence
  Synthetic oligonucleotide; TTG chr11 5182895 5182916 5182900 5182895 -
caaaccctgccttttttttgtt

SEQ ID NO: 151033 - DNA, 22 bp, Artificial Sequence
  Synthetic oligonucleotide; CTG chr11 5182886 5182907 5182891 5182886 -
ccttttttttgttttccatttg

SEQ ID NO: 151034 - DNA, 22 bp, Artificial Sequence
  Synthetic oligonucleotide; CTT chr11 5182882 5182903 5182887 5182882 -
ttttttgttttccatttgcttg

SEQ ID NO: 151035 - DNA, 22 bp, Artificial Sequence
  Synthetic oligonucleotide; TTT chr11 5182881 5182902 5182886 5182881 -
tttttgttttccatttgcttgg

SEQ ID NO: 151036 - DNA, 22 bp, Artificial Sequence
  Synthetic oligonucleotide; TTT chr11 5182880 5182901 5182885 5182880 -
ttttgttttccatttgcttggt

SEQ ID NO: 151037 - DNA, 22 bp, Artificial Sequence
  Synthetic oligonucleotide; TTT chr11 5182879 5182900 5182884 5182879 -
tttgttttccatttgcttggta

SEQ ID NO: 151038 - DNA, 22 bp, Artificial Sequence
  Synthetic oligonucleotide; TTT chr11 5182878 5182899 5182883 5182878 -
ttgttttccatttgcttggtag

SEQ ID NO: 151039 - DNA, 22 bp, Artificial Sequence
  Synthetic oligonucleotide; TTT chr11 5182877 5182898 5182882 5182877 -
tgttttccatttgcttggtaga

SEQ ID NO: 151040 - DNA, 22 bp, Artificial Sequence
  Synthetic oligonucleotide; TTT chr11 5182876 5182897 5182881 5182876 -
gttttccatttgcttggtagat

SEQ ID NO: 151041 - DNA, 22 bp, Artificial Sequence
  Synthetic oligonucleotide; TTG chr11 5182875 5182896 5182880 5182875 -
ttttccatttgcttggtagatc

SEQ ID NO: 151042 - DNA, 22 bp, Artificial Sequence
  Synthetic oligonucleotide; TTT chr11 5182872 5182893 5182877 5182872 -
tccatttgcttggtagatcttc

SEQ ID NO: 151043 - DNA, 22 bp, Artificial Sequence
  Synthetic oligonucleotide; TTT chr11 5182871 5182892 5182876 5182871 -
ccatttgcttggtagatcttcc

SEQ ID NO: 151044 - DNA, 22 bp, Artificial Sequence
  Synthetic oligonucleotide; TTC chr11 5182870 5182891 5182875 5182870 -
catttgcttggtagatcttcct

SEQ ID NO: 151045 - DNA, 22 bp, Artificial Sequence
  Synthetic oligonucleotide; TTT chr11 5182865 5182886 5182870 5182865 -
gcttggtagatcttcctccatc

SEQ ID NO: 151046 - DNA, 22 bp, Artificial Sequence
  Synthetic oligonucleotide; TTG chr11 5182864 5182885 5182869 5182864 -
cttggtagatcttcctccatcc

SEQ ID NO: 151047 - DNA, 22 bp, Artificial Sequence
  Synthetic oligonucleotide; CTT chr11 5182861 5182882 5182866 5182861 -
ggtagatcttcctccatccctt

SEQ ID NO: 151048 - DNA, 22 bp, Artificial Sequence
  Synthetic oligonucleotide; TTG chr11 5182860 5182881 5182865 5182860 -
gtagatcttcctccatcccttt

SEQ ID NO: 151049 - DNA, 22 bp, Artificial Sequence
  Synthetic oligonucleotide; CTT chr11 5182851 5182872 5182856 5182851 -
cctccatccctttattttgagc

SEQ ID NO: 151050 - DNA, 22 bp, Artificial Sequence
  Synthetic oligonucleotide; TTC chr11 5182850 5182871 5182855 5182850 -
ctccatccctttattttgagcc

SEQ ID NO: 151051 - DNA, 22 bp, Artificial Sequence
  Synthetic oligonucleotide; CTC chr11 5182847 5182868 5182852 5182847 -
catccctttattttgagcctat

SEQ ID NO: 151052 - DNA, 22 bp, Artificial Sequence
  Synthetic oligonucleotide; CTT chr11 5182839 5182860 5182844 5182839 -
tattttgagcctatgtgtgtct

SEQ ID NO: 151053 - DNA, 22 bp, Artificial Sequence
  Synthetic oligonucleotide; TTT chr11 5182838 5182859 5182843 5182838 -
attttgagcctatgtgtgtctc

SEQ ID NO: 151054 - DNA, 22 bp, Artificial Sequence
  Synthetic oligonucleotide; TTA chr11 5182837 5182858 5182842 5182837 -
ttttgagcctatgtgtgtctct

SEQ ID NO: 151055 - DNA, 22 bp, Artificial Sequence
  Synthetic oligonucleotide; TTT chr11 5182834 5182855 5182839 5182834 -
tgagcctatgtgtgtctctcca

SEQ ID NO: 151056 - DNA, 22 bp, Artificial Sequence
  Synthetic oligonucleotide; TTT chr11 5182833 5182854 5182838 5182833 -
gagcctatgtgtgtctctccac

SEQ ID NO: 151057 - DNA, 22 bp, Artificial Sequence
  Synthetic oligonucleotide; TTG chr11 5182832 5182853 5182837 5182832 -
agcctatgtgtgtctctccaca

SEQ ID NO: 151058 - DNA, 22 bp, Artificial Sequence
  Synthetic oligonucleotide; CTA chr11 5182826 5182847 5182831 5182826 -
tgtgtgtctctccacatgagat

SEQ ID NO: 151059 - DNA, 22 bp, Artificial Sequence
  Synthetic oligonucleotide; CTC chr11 5182816 5182837 5182821 5182816 -
tccacatgagattggtttcctg

SEQ ID NO: 151060 - DNA, 22 bp, Artificial Sequence
  Synthetic oligonucleotide; CTC chr11 5182814 5182835 5182819 5182814 -
cacatgagattggtttcctgaa

SEQ ID NO: 151061 - DNA, 22 bp, Artificial Sequence
  Synthetic oligonucleotide; TTG chr11 5182802 5182823 5182807 5182802 -
gtttcctgaatacagcacactg

SEQ ID NO: 151062 - DNA, 22 bp, Artificial Sequence
  Synthetic oligonucleotide; TTT chr11 5182798 5182819 5182803 5182798 -
cctgaatacagcacactgatag

SEQ ID NO: 151063 - DNA, 22 bp, Artificial Sequence
  Synthetic oligonucleotide; TTC chr11 5182797 5182818 5182802 5182797 -
ctgaatacagcacactgatagg

SEQ ID NO: 151064 - DNA, 22 bp, Artificial Sequence
  Synthetic oligonucleotide; CTG chr11 5182794 5182815 5182799 5182794 -
aatacagcacactgataggtct

SEQ ID NO: 151065 - DNA, 22 bp, Artificial Sequence
  Synthetic oligonucleotide; CTG chr11 5182780 5182801 5182785 5182780 -
ataggtcttgactctttatcca

SEQ ID NO: 151066 - DNA, 22 bp, Artificial Sequence
  Synthetic oligonucleotide; CTT chr11 5182771 5182792 5182776 5182771 -
gactctttatccaatttgccag

SEQ ID NO: 151067 - DNA, 22 bp, Artificial Sequence
  Synthetic oligonucleotide; TTG chr11 5182770 5182791 5182775 5182770 -
actctttatccaatttgccagt

SEQ ID NO: 151068 - DNA, 22 bp, Artificial Sequence
  Synthetic oligonucleotide; CTC chr11 5182766 5182787 5182771 5182766 -
tttatccaatttgccagtctgt

SEQ ID NO: 151069 - DNA, 22 bp, Artificial Sequence
  Synthetic oligonucleotide; CTT chr11 5182764 5182785 5182769 5182764 -
tatccaatttgccagtctgtgt

SEQ ID NO: 151070 - DNA, 22 bp, Artificial Sequence
  Synthetic oligonucleotide; TTT chr11 5182763 5182784 5182768 5182763 -
atccaatttgccagtctgtgtc

SEQ ID NO: 151071 - DNA, 22 bp, Artificial Sequence
  Synthetic oligonucleotide; TTA chr11 5182762 5182783 5182767 5182762 -
tccaatttgccagtctgtgtct

SEQ ID NO: 151072 - DNA, 22 bp, Artificial Sequence
  Synthetic oligonucleotide; TTT chr11 5182754 5182775 5182759 5182754 -
gccagtctgtgtcttttaattg

SEQ ID NO: 151073 - DNA, 22 bp, Artificial Sequence
  Synthetic oligonucleotide; TTG chr11 5182753 5182774 5182758 5182753 -
ccagtctgtgtcttttaattgg

SEQ ID NO: 151074 - DNA, 22 bp, Artificial Sequence
  Synthetic oligonucleotide; CTG chr11 5182745 5182766 5182750 5182745 -
tgtcttttaattggagcattta

SEQ ID NO: 151075 - DNA, 22 bp, Artificial Sequence
  Synthetic oligonucleotide; CTT chr11 5182739 5182760 5182744 5182739 -
ttaattggagcatttagctcat

SEQ ID NO: 151076 - DNA, 22 bp, Artificial Sequence
  Synthetic oligonucleotide; TTT chr11 5182738 5182759 5182743 5182738 -
taattggagcatttagctcatt

SEQ ID NO: 151077 - DNA, 22 bp, Artificial Sequence
  Synthetic oligonucleotide; TTT chr11 5182737 5182758 5182742 5182737 -
aattggagcatttagctcattt

SEQ ID NO: 151078 - DNA, 22 bp, Artificial Sequence
  Synthetic oligonucleotide; TTA chr11 5182736 5182757 5182741 5182736 -
attggagcatttagctcattta

SEQ ID NO: 151079 - DNA, 22 bp, Artificial Sequence
  Synthetic oligonucleotide; TTG chr11 5182732 5182753 5182737 5182732 -
gagcatttagctcatttacatt

SEQ ID NO: 151080 - DNA, 22 bp, Artificial Sequence
  Synthetic oligonucleotide; TTT chr11 5182724 5182745 5182729 5182724 -
agctcatttacatttaaggtta

SEQ ID NO: 151081 - DNA, 22 bp, Artificial Sequence
  Synthetic oligonucleotide; TTA chr11 5182723 5182744 5182728 5182723 -
gctcatttacatttaaggttaa

SEQ ID NO: 151082 - DNA, 22 bp, Artificial Sequence
  Synthetic oligonucleotide; CTC chr11 5182719 5182740 5182724 5182719 -
atttacatttaaggttaatatt

SEQ ID NO: 151083 - DNA, 22 bp, Artificial Sequence
  Synthetic oligonucleotide; TTT chr11 5182715 5182736 5182720 5182715 -
acatttaaggttaatattgtta

SEQ ID NO: 151084 - DNA, 22 bp, Artificial Sequence
  Synthetic oligonucleotide; TTA chr11 5182714 5182735 5182719 5182714 -
catttaaggttaatattgttat

SEQ ID NO: 151085 - DNA, 22 bp, Artificial Sequence
  Synthetic oligonucleotide; TTT chr11 5182709 5182730 5182714 5182709 -
aaggttaatattgttatgtgag

SEQ ID NO: 151086 - DNA, 22 bp, Artificial Sequence
  Synthetic oligonucleotide; TTA chr11 5182708 5182729 5182713 5182708 -
aggttaatattgttatgtgaga

SEQ ID NO: 151087 - DNA, 22 bp, Artificial Sequence
  Synthetic oligonucleotide; TTA chr11 5182702 5182723 5182707 5182702 -
atattgttatgtgagaatttga

SEQ ID NO: 151088 - DNA, 22 bp, Artificial Sequence
  Synthetic oligonucleotide; TTG chr11 5182696 5182717 5182701 5182696 -
ttatgtgagaatttgatcctgt

SEQ ID NO: 151089 - DNA, 22 bp, Artificial Sequence
  Synthetic oligonucleotide; TTA chr11 5182693 5182714 5182698 5182693 -
tgtgagaatttgatcctgtcat

SEQ ID NO: 151090 - DNA, 22 bp, Artificial Sequence
  Synthetic oligonucleotide; TTT chr11 5182682 5182703 5182687 5182682 -
gatcctgtcattatgatgttag

SEQ ID NO: 151091 - DNA, 22 bp, Artificial Sequence
  Synthetic oligonucleotide; TTG chr11 5182681 5182702 5182686 5182681 -
atcctgtcattatgatgttagc

SEQ ID NO: 151092 - DNA, 22 bp, Artificial Sequence
  Synthetic oligonucleotide; CTG chr11 5182675 5182696 5182680 5182675 -
tcattatgatgttagctggtta

SEQ ID NO: 151093 - DNA, 22 bp, Artificial Sequence
  Synthetic oligonucleotide; TTA chr11 5182669 5182690 5182674 5182669 -
tgatgttagctggttattttgc

SEQ ID NO: 151094 - DNA, 22 bp, Artificial Sequence
  Synthetic oligonucleotide; TTA chr11 5182661 5182682 5182666 5182661 -
gctggttattttgcttgctagt

SEQ ID NO: 151095 - DNA, 22 bp, Artificial Sequence
  Synthetic oligonucleotide; CTG chr11 5182657 5182678 5182662 5182657 -
gttattttgcttgctagttgat

SEQ ID NO: 151096 - DNA, 22 bp, Artificial Sequence
  Synthetic oligonucleotide; TTA chr11 5182653 5182674 5182658 5182653 -
ttttgcttgctagttgatgcag

SEQ ID NO: 151097 - DNA, 22 bp, Artificial Sequence
  Synthetic oligonucleotide; TTT chr11 5182650 5182671 5182655 5182650 -
tgcttgctagttgatgcagttt

SEQ ID NO: 151098 - DNA, 22 bp, Artificial Sequence
  Synthetic oligonucleotide; TTT chr11 5182649 5182670 5182654 5182649 -
gcttgctagttgatgcagtttc

SEQ ID NO: 151099 - DNA, 22 bp, Artificial Sequence
  Synthetic oligonucleotide; TTG chr11 5182648 5182669 5182653 5182648 -
cttgctagttgatgcagtttct

SEQ ID NO: 151100 - DNA, 22 bp, Artificial Sequence
  Synthetic oligonucleotide; CTT chr11 5182645 5182666 5182650 5182645 -
gctagttgatgcagtttctccc

SEQ ID NO: 151101 - DNA, 22 bp, Artificial Sequence
  Synthetic oligonucleotide; TTG chr11 5182644 5182665 5182649 5182644 -
ctagttgatgcagtttctccct

SEQ ID NO: 151102 - DNA, 22 bp, Artificial Sequence
  Synthetic oligonucleotide; CTA chr11 5182641 5182662 5182646 5182641 -
gttgatgcagtttctccctagc

SEQ ID NO: 151103 - DNA, 22 bp, Artificial Sequence
  Synthetic oligonucleotide; TTG chr11 5182637 5182658 5182642 5182637 -
atgcagtttctccctagccttg

SEQ ID NO: 151104 - DNA, 22 bp, Artificial Sequence
  Synthetic oligonucleotide; TTT chr11 5182628 5182649 5182633 5182628 -
ctccctagccttgatggtcttt

SEQ ID NO: 151105 - DNA, 22 bp, Artificial Sequence
  Synthetic oligonucleotide; TTC chr11 5182627 5182648 5182632 5182627 -
tccctagccttgatggtcttta

SEQ ID NO: 151106 - DNA, 22 bp, Artificial Sequence
  Synthetic oligonucleotide; CTC chr11 5182625 5182646 5182630 5182625 -
cctagccttgatggtctttaca

SEQ ID NO: 151107 - DNA, 22 bp, Artificial Sequence
  Synthetic oligonucleotide; CTA chr11 5182621 5182642 5182626 5182621 -
gccttgatggtctttacaattt

SEQ ID NO: 151108 - DNA, 22 bp, Artificial Sequence
  Synthetic oligonucleotide; CTT chr11 5182616 5182637 5182621 5182616 -
gatggtctttacaatttggcat

SEQ ID NO: 151109 - DNA, 22 bp, Artificial Sequence
  Synthetic oligonucleotide; TTG chr11 5182615 5182636 5182620 5182615 -
atggtctttacaatttggcatg

SEQ ID NO: 151110 - DNA, 22 bp, Artificial Sequence
  Synthetic oligonucleotide; CTT chr11 5182607 5182628 5182612 5182607 -
tacaatttggcatgtttttgca

SEQ ID NO: 151111 - DNA, 22 bp, Artificial Sequence
  Synthetic oligonucleotide; TTT chr11 5182606 5182627 5182611 5182606 -
acaatttggcatgtttttgcag

SEQ ID NO: 151112 - DNA, 22 bp, Artificial Sequence
  Synthetic oligonucleotide; TTA chr11 5182605 5182626 5182610 5182605 -
caatttggcatgtttttgcagt

SEQ ID NO: 151113 - DNA, 22 bp, Artificial Sequence
  Synthetic oligonucleotide; TTT chr11 5182599 5182620 5182604 5182599 -
ggcatgtttttgcagtggctgg

SEQ ID NO: 151114 - DNA, 22 bp, Artificial Sequence
  Synthetic oligonucleotide; TTG chr11 5182598 5182619 5182603 5182598 -
gcatgtttttgcagtggctggt

SEQ ID NO: 151115 - DNA, 22 bp, Artificial Sequence
  Synthetic oligonucleotide; TTT chr11 5182590 5182611 5182595 5182590 -
ttgcagtggctggtactggttg

SEQ ID NO: 151116 - DNA, 22 bp, Artificial Sequence
  Synthetic oligonucleotide; TTT chr11 5182589 5182610 5182594 5182589 -
tgcagtggctggtactggttgt

SEQ ID NO: 151117 - DNA, 22 bp, Artificial Sequence
  Synthetic oligonucleotide; TTT chr11 5182588 5182609 5182593 5182588 -
gcagtggctggtactggttgtt

SEQ ID NO: 151118 - DNA, 22 bp, Artificial Sequence
  Synthetic oligonucleotide; TTG chr11 5182587 5182608 5182592 5182587 -
cagtggctggtactggttgttt

SEQ ID NO: 151119 - DNA, 22 bp, Artificial Sequence
  Synthetic oligonucleotide; CTG chr11 5182578 5182599 5182583 5182578 -
gtactggttgtttctttccatg

SEQ ID NO: 151120 - DNA, 22 bp, Artificial Sequence
  Synthetic oligonucleotide; CTG chr11 5182572 5182593 5182577 5182572 -
gttgtttctttccatgtttact

SEQ ID NO: 151121 - DNA, 22 bp, Artificial Sequence
  Synthetic oligonucleotide; TTG chr11 5182568 5182589 5182573 5182568 -
tttctttccatgtttactgctt

SEQ ID NO: 151122 - DNA, 22 bp, Artificial Sequence
  Synthetic oligonucleotide; TTT chr11 5182565 5182586 5182570 5182565 -
ctttccatgtttactgcttcct

SEQ ID NO: 151123 - DNA, 22 bp, Artificial Sequence
  Synthetic oligonucleotide; TTC chr11 5182564 5182585 5182569 5182564 -
tttccatgtttactgcttcctt

SEQ ID NO: 151124 - DNA, 22 bp, Artificial Sequence
  Synthetic oligonucleotide; CTT chr11 5182562 5182583 5182567 5182562 -
tccatgtttactgcttccttca

SEQ ID NO: 151125 - DNA, 22 bp, Artificial Sequence
  Synthetic oligonucleotide; TTT chr11 5182561 5182582 5182566 5182561 -
ccatgtttactgcttccttcag

SEQ ID NO: 151126 - DNA, 22 bp, Artificial Sequence
  Synthetic oligonucleotide; TTC chr11 5182560 5182581 5182565 5182560 -
catgtttactgcttccttcagg

SEQ ID NO: 151127 - DNA, 22 bp, Artificial Sequence
  Synthetic oligonucleotide; TTT chr11 5182553 5182574 5182558 5182553 -
actgcttccttcaggagctctt

SEQ ID NO: 151128 - DNA, 22 bp, Artificial Sequence
  Synthetic oligonucleotide; TTA chr11 5182552 5182573 5182557 5182552 -
ctgcttccttcaggagctcttt

SEQ ID NO: 151129 - DNA, 22 bp, Artificial Sequence
  Synthetic oligonucleotide; CTG chr11 5182549 5182570 5182554 5182549 -
cttccttcaggagctcttttag

SEQ ID NO: 151130 - DNA, 22 bp, Artificial Sequence
  Synthetic oligonucleotide; CTT chr11 5182546 5182567 5182551 5182546 -
ccttcaggagctcttttagggc

SEQ ID NO: 151131 - DNA, 22 bp, Artificial Sequence
  Synthetic oligonucleotide; TTC chr11 5182545 5182566 5182550 5182545 -
cttcaggagctcttttagggca

SEQ ID NO: 151132 - DNA, 22 bp, Artificial Sequence
  Synthetic oligonucleotide; CTT chr11 5182542 5182563 5182547 5182542 -
caggagctcttttagggcaggc

SEQ ID NO: 151133 - DNA, 22 bp, Artificial Sequence
  Synthetic oligonucleotide; TTC chr11 5182541 5182562 5182546 5182541 -
aggagctcttttagggcaggcc

SEQ ID NO: 151134 - DNA, 22 bp, Artificial Sequence
  Synthetic oligonucleotide; CTC chr11 5182533 5182554 5182538 5182533 -
ttttagggcaggcctggtggtg

SEQ ID NO: 151135 - DNA, 22 bp, Artificial Sequence
  Synthetic oligonucleotide; CTT chr11 5182531 5182552 5182536 5182531 -
ttagggcaggcctggtggtgac

SEQ ID NO: 151136 - DNA, 22 bp, Artificial Sequence
  Synthetic oligonucleotide; TTT chr11 5182530 5182551 5182535 5182530 -
tagggcaggcctggtggtgaca

SEQ ID NO: 151137 - DNA, 22 bp, Artificial Sequence
  Synthetic oligonucleotide; TTT chr11 5182529 5182550 5182534 5182529 -
agggcaggcctggtggtgacaa

SEQ ID NO: 151138 - DNA, 22 bp, Artificial Sequence
  Synthetic oligonucleotide; TTA chr11 5182528 5182549 5182533 5182528 -
gggcaggcctggtggtgacaaa

SEQ ID NO: 151139 - DNA, 22 bp, Artificial Sequence
  Synthetic oligonucleotide; CTG chr11 5182517 5182538 5182522 5182517 -
gtggtgacaaaatcagcaattg

SEQ ID NO: 151140 - DNA, 22 bp, Artificial Sequence
  Synthetic oligonucleotide; TTG chr11 5182495 5182516 5182500 5182495 -
cttgtctgtaaagtattttatt

SEQ ID NO: 151141 - DNA, 22 bp, Artificial Sequence
  Synthetic oligonucleotide; CTT chr11 5182492 5182513 5182497 5182492 -
gtctgtaaagtattttatttct

SEQ ID NO: 151142 - DNA, 22 bp, Artificial Sequence
  Synthetic oligonucleotide; TTG chr11 5182491 5182512 5182496 5182491 -
tctgtaaagtattttatttctc

SEQ ID NO: 151143 - DNA, 22 bp, Artificial Sequence
  Synthetic oligonucleotide; CTG chr11 5182487 5182508 5182492 5182487 -
taaagtattttatttctccttc

SEQ ID NO: 151144 - DNA, 22 bp, Artificial Sequence
  Synthetic oligonucleotide; TTT chr11 5182477 5182498 5182482 5182477 -
tatttctccttcacttatgaag

SEQ ID NO: 151145 - DNA, 22 bp, Artificial Sequence
  Synthetic oligonucleotide; TTT chr11 5182476 5182497 5182481 5182476 -
atttctccttcacttatgaagc

SEQ ID NO: 151146 - DNA, 22 bp, Artificial Sequence
  Synthetic oligonucleotide; TTA chr11 5182475 5182496 5182480 5182475 -
tttctccttcacttatgaagct

SEQ ID NO: 151147 - DNA, 22 bp, Artificial Sequence
  Synthetic oligonucleotide; TTT chr11 5182472 5182493 5182477 5182472 -
ctccttcacttatgaagcttac

SEQ ID NO: 151148 - DNA, 22 bp, Artificial Sequence
  Synthetic oligonucleotide; TTC chr11 5182471 5182492 5182476 5182471 -
tccttcacttatgaagcttacc

SEQ ID NO: 151149 - DNA, 22 bp, Artificial Sequence
  Synthetic oligonucleotide; CTC chr11 5182469 5182490 5182474 5182469 -
cttcacttatgaagcttaccaa

SEQ ID NO: 151150 - DNA, 22 bp, Artificial Sequence
  Synthetic oligonucleotide; CTT chr11 5182466 5182487 5182471 5182466 -
cacttatgaagcttaccaacca

SEQ ID NO: 151151 - DNA, 22 bp, Artificial Sequence
  Synthetic oligonucleotide; TTC chr11 5182465 5182486 5182470 5182465 -
acttatgaagcttaccaaccaa

SEQ ID NO: 151152 - DNA, 22 bp, Artificial Sequence
  Synthetic oligonucleotide; CTT chr11 5182461 5182482 5182466 5182461 -
atgaagcttaccaaccaaaaaa

SEQ ID NO: 151153 - DNA, 22 bp, Artificial Sequence
  Synthetic oligonucleotide; TTA chr11 5182460 5182481 5182465 5182460 -
tgaagcttaccaaccaaaaaaa

SEQ ID NO: 151154 - DNA, 22 bp, Artificial Sequence
  Synthetic oligonucleotide; CTT chr11 5182452 5182473 5182457 5182452 -
accaaccaaaaaaagtccagga

SEQ ID NO: 151155 - DNA, 22 bp, Artificial Sequence
  Synthetic oligonucleotide; TTA chr11 5182451 5182472 5182456 5182451 -
ccaaccaaaaaaagtccaggac

SEQ ID NO: 151156 - DNA, 22 bp, Artificial Sequence
  Synthetic oligonucleotide; TTC chr11 5182418 5182439 5182423 5182418 -
acagccgaattctaccagaggt

SEQ ID NO: 151157 - DNA, 22 bp, Artificial Sequence
  Synthetic oligonucleotide; TTC chr11 5182406 5182427 5182411 5182406 -
taccagaggtacaaggaggagc

SEQ ID NO: 151158 - DNA, 22 bp, Artificial Sequence
  Synthetic oligonucleotide; CTA chr11 5182404 5182425 5182409 5182404 -
ccagaggtacaaggaggagctg

SEQ ID NO: 151159 - DNA, 22 bp, Artificial Sequence
  Synthetic oligonucleotide; CTG chr11 5182382 5182403 5182387 5182382 -
gtaccattccttctgaaactat

SEQ ID NO: 151160 - DNA, 22 bp, Artificial Sequence
  Synthetic oligonucleotide; TTC chr11 5182373 5182394 5182378 5182373 -
cttctgaaactattccaatcaa

SEQ ID NO: 151161 - DNA, 22 bp, Artificial Sequence
  Synthetic oligonucleotide; CTT chr11 5182370 5182391 5182375 5182370 -
ctgaaactattccaatcaatag

SEQ ID NO: 151162 - DNA, 22 bp, Artificial Sequence
  Synthetic oligonucleotide; TTC chr11 5182369 5182390 5182374 5182369 -
tgaaactattccaatcaataga

SEQ ID NO: 151163 - DNA, 22 bp, Artificial Sequence
  Synthetic oligonucleotide; CTG chr11 5182367 5182388 5182372 5182367 -
aaactattccaatcaatagaaa

SEQ ID NO: 151164 - DNA, 22 bp, Artificial Sequence
  Synthetic oligonucleotide; CTA chr11 5182361 5182382 5182366 5182361 -
ttccaatcaatagaaaaagagg

SEQ ID NO: 151165 - DNA, 22 bp, Artificial Sequence
  Synthetic oligonucleotide; TTC chr11 5182358 5182379 5182363 5182358 -
caatcaatagaaaaagagggaa

SEQ ID NO: 151166 - DNA, 22 bp, Artificial Sequence
  Synthetic oligonucleotide; CTC chr11 5182331 5182352 5182336 5182331 -
cctaactcattttatgaggcca

SEQ ID NO: 151167 - DNA, 22 bp, Artificial Sequence
  Synthetic oligonucleotide; CTA chr11 5182327 5182348 5182332 5182327 -
actcattttatgaggccagcat

SEQ ID NO: 151168 - DNA, 22 bp, Artificial Sequence
  Synthetic oligonucleotide; CTC chr11 5182323 5182344 5182328 5182323 -
attttatgaggccagcatcatc

SEQ ID NO: 151169 - DNA, 22 bp, Artificial Sequence
  Synthetic oligonucleotide; TTT chr11 5182319 5182340 5182324 5182319 -
tatgaggccagcatcatcttga

SEQ ID NO: 151170 - DNA, 22 bp, Artificial Sequence
  Synthetic oligonucleotide; TTT chr11 5182318 5182339 5182323 5182318 -
atgaggccagcatcatcttgat

SEQ ID NO: 151171 - DNA, 22 bp, Artificial Sequence
  Synthetic oligonucleotide; TTA chr11 5182317 5182338 5182322 5182317 -
tgaggccagcatcatcttgata

SEQ ID NO: 151172 - DNA, 22 bp, Artificial Sequence
  Synthetic oligonucleotide; CTT chr11 5182299 5182320 5182304 5182299 -
gataccaaagcctagcagacac

SEQ ID NO: 151173 - DNA, 22 bp, Artificial Sequence
  Synthetic oligonucleotide; TTG chr11 5182298 5182319 5182303 5182298 -
ataccaaagcctagcagacaca

SEQ ID NO: 151174 - DNA, 22 bp, Artificial Sequence
  Synthetic oligonucleotide; CTA chr11 5182285 5182306 5182290 5182285 -
gcagacacacaacaaaaaaaga

SEQ ID NO: 151175 - DNA, 22 bp, Artificial Sequence
  Synthetic oligonucleotide; TTT chr11 5182257 5182278 5182262 5182257 -
tacaccaatatccctgatgaac

SEQ ID NO: 151176 - DNA, 22 bp, Artificial Sequence
  Synthetic oligonucleotide; TTT chr11 5182256 5182277 5182261 5182256 -
acaccaatatccctgatgaaca

SEQ ID NO: 151177 - DNA, 22 bp, Artificial Sequence
  Synthetic oligonucleotide; TTA chr11 5182255 5182276 5182260 5182255 -
caccaatatccctgatgaacat

SEQ ID NO: 151178 - DNA, 22 bp, Artificial Sequence
  Synthetic oligonucleotide; CTG chr11 5182241 5182262 5182246 5182241 -
atgaacatcgatgcaaaaatcc

SEQ ID NO: 151179 - DNA, 22 bp, Artificial Sequence
  Synthetic oligonucleotide; CTC chr11 5182217 5182238 5182222 5182217 -
agtaaaatactggcaaaccaaa

SEQ ID NO: 151180 - DNA, 22 bp, Artificial Sequence
  Synthetic oligonucleotide; CTG chr11 5182205 5182226 5182210 5182205 -
gcaaaccaaatccaggagcaca

SEQ ID NO: 151181 - DNA, 22 bp, Artificial Sequence
  Synthetic oligonucleotide; CTT chr11 5182172 5182193 5182177 5182172 -
atccaccatgatcaagtgggct

SEQ ID NO: 151182 - DNA, 22 bp, Artificial Sequence
  Synthetic oligonucleotide; TTA chr11 5182171 5182192 5182176 5182171 -
tccaccatgatcaagtgggctt

SEQ ID NO: 151183 - DNA, 22 bp, Artificial Sequence
  Synthetic oligonucleotide; CTT chr11 5182149 5182170 5182154 5182149 -
catccctgggatgcagggctgg

SEQ ID NO: 151184 - DNA, 22 bp, Artificial Sequence
  Synthetic oligonucleotide; TTC chr11 5182148 5182169 5182153 5182148 -
atccctgggatgcagggctggt

SEQ ID NO: 151185 - DNA, 22 bp, Artificial Sequence
  Synthetic oligonucleotide; CTG chr11 5182141 5182162 5182146 5182141 -
ggatgcagggctggttcaacat

SEQ ID NO: 151186 - DNA, 22 bp, Artificial Sequence
  Synthetic oligonucleotide; CTG chr11 5182128 5182149 5182133 5182128 -
gttcaacatatgcaaatcaata

SEQ ID NO: 151187 - DNA, 22 bp, Artificial Sequence
  Synthetic oligonucleotide; TTC chr11 5182124 5182145 5182129 5182124 -
aacatatgcaaatcaataaaca

SEQ ID NO: 151188 - DNA, 22 bp, Artificial Sequence
  Synthetic oligonucleotide; TTA chr11 5182057 5182078 5182062 5182057 -
tctcaatagatgcagaaaaggc

SEQ ID NO: 151189 - DNA, 22 bp, Artificial Sequence
  Synthetic oligonucleotide; CTC chr11 5182053 5182074 5182058 5182053 -
aatagatgcagaaaaggccttt

SEQ ID NO: 151190 - DNA, 22 bp, Artificial Sequence
  Synthetic oligonucleotide; CTT chr11 5182032 5182053 5182037 5182032 -
tgacaaaattcaacaatgcttc

SEQ ID NO: 151191 - DNA, 22 bp, Artificial Sequence
  Synthetic oligonucleotide; TTT chr11 5182031 5182052 5182036 5182031 -
gacaaaattcaacaatgcttca

SEQ ID NO: 151192 - DNA, 22 bp, Artificial Sequence
  Synthetic oligonucleotide; TTG chr11 5182030 5182051 5182035 5182030 -
acaaaattcaacaatgcttcat

SEQ ID NO: 151193 - DNA, 22 bp, Artificial Sequence
  Synthetic oligonucleotide; TTC chr11 5182021 5182042 5182026 5182021 -
aacaatgcttcatactaaaaac

SEQ ID NO: 151194 - DNA, 22 bp, Artificial Sequence
  Synthetic oligonucleotide; CTT chr11 5182011 5182032 5182016 5182011 -
catactaaaaactctcaataaa

SEQ ID NO: 151195 - DNA, 22 bp, Artificial Sequence
  Synthetic oligonucleotide; TTC chr11 5182010 5182031 5182015 5182010 -
atactaaaaactctcaataaat

SEQ ID NO: 151196 - DNA, 22 bp, Artificial Sequence
  Synthetic oligonucleotide; CTA chr11 5182004 5182025 5182009 5182004 -
aaaactctcaataaattaggta

SEQ ID NO: 151197 - DNA, 22 bp, Artificial Sequence
  Synthetic oligonucleotide; CTC chr11 5181997 5182018 5182002 5181997 -
tcaataaattaggtatcgatgg

SEQ ID NO: 151198 - DNA, 22 bp, Artificial Sequence
  Synthetic oligonucleotide; CTC chr11 5181995 5182016 5182000 5181995 -
aataaattaggtatcgatggga

SEQ ID NO: 151199 - DNA, 22 bp, Artificial Sequence
  Synthetic oligonucleotide; TTA chr11 5181986 5182007 5181991 5181986 -
ggtatcgatgggacatatctca

SEQ ID NO: 151200 - DNA, 22 bp, Artificial Sequence
  Synthetic oligonucleotide; CTC chr11 5181965 5181986 5181970 5181965 -
aaaataataagagctatctatg

SEQ ID NO: 151201 - DNA, 22 bp, Artificial Sequence
  Synthetic oligonucleotide; CTA chr11 5181949 5181970 5181954 5181949 -
tctatgacaaacccacagccaa

SEQ ID NO: 151202 - DNA, 22 bp, Artificial Sequence
  Synthetic oligonucleotide; CTA chr11 5181945 5181966 5181950 5181945 -
tgacaaacccacagccaatatc

SEQ ID NO: 151203 - DNA, 22 bp, Artificial Sequence
  Synthetic oligonucleotide; CTG chr11 5181917 5181938 5181922 5181917 -
aatggacaaaaactggaagcat

SEQ ID NO: 151204 - DNA, 22 bp, Artificial Sequence
  Synthetic oligonucleotide; CTG chr11 5181902 5181923 5181907 5181902 -
gaagcattccctttgaaaactg

SEQ ID NO: 151205 - DNA, 22 bp, Artificial Sequence
  Synthetic oligonucleotide; TTC chr11 5181893 5181914 5181898 5181893 -
cctttgaaaactggcacaagac

SEQ ID NO: 151206 - DNA, 22 bp, Artificial Sequence
  Synthetic oligonucleotide; CTT chr11 5181889 5181910 5181894 5181889 -
tgaaaactggcacaagacaggg

SEQ ID NO: 151207 - DNA, 22 bp, Artificial Sequence
  Synthetic oligonucleotide; TTT chr11 5181888 5181909 5181893 5181888 -
gaaaactggcacaagacaggga

SEQ ID NO: 151208 - DNA, 22 bp, Artificial Sequence
  Synthetic oligonucleotide; TTG chr11 5181887 5181908 5181892 5181887 -
aaaactggcacaagacagggat

SEQ ID NO: 151209 - DNA, 22 bp, Artificial Sequence
  Synthetic oligonucleotide; CTG chr11 5181880 5181901 5181885 5181880 -
gcacaagacagggatgccctct

SEQ ID NO: 151210 - DNA, 22 bp, Artificial Sequence
  Synthetic oligonucleotide; CTC chr11 5181859 5181880 5181864 5181859 -
tctcaccactcctattcaacat

SEQ ID NO: 151211 - DNA, 22 bp, Artificial Sequence
  Synthetic oligonucleotide; CTC chr11 5181857 5181878 5181862 5181857 -
tcaccactcctattcaacatag

SEQ ID NO: 151212 - DNA, 22 bp, Artificial Sequence
  Synthetic oligonucleotide; CTC chr11 5181855 5181876 5181860 5181855 -
accactcctattcaacatagtg

SEQ ID NO: 151213 - DNA, 22 bp, Artificial Sequence
  Synthetic oligonucleotide; CTC chr11 5181848 5181869 5181853 5181848 -
ctattcaacatagtgttggaag

SEQ ID NO: 151214 - DNA, 22 bp, Artificial Sequence
  Synthetic oligonucleotide; CTA chr11 5181845 5181866 5181850 5181845 -
ttcaacatagtgttggaagttc

SEQ ID NO: 151215 - DNA, 22 bp, Artificial Sequence
  Synthetic oligonucleotide; TTC chr11 5181842 5181863 5181847 5181842 -
aacatagtgttggaagttctgg

SEQ ID NO: 151216 - DNA, 22 bp, Artificial Sequence
  Synthetic oligonucleotide; TTG chr11 5181830 5181851 5181835 5181830 -
gaagttctggccagggcaatca

SEQ ID NO: 151217 - DNA, 22 bp, Artificial Sequence
  Synthetic oligonucleotide; TTC chr11 5181823 5181844 5181828 5181823 -
tggccagggcaatcaggcaaga

SEQ ID NO: 151218 - DNA, 22 bp, Artificial Sequence
  Synthetic oligonucleotide; CTG chr11 5181821 5181842 5181826 5181821 -
gccagggcaatcaggcaagaga

SEQ ID NO: 151219 - DNA, 22 bp, Artificial Sequence
  Synthetic oligonucleotide; TTC chr11 5181781 5181802 5181786 5181781 -
aattaggaaaagaggaagtgaa

SEQ ID NO: 151220 - DNA, 22 bp, Artificial Sequence
  Synthetic oligonucleotide; TTA chr11 5181776 5181797 5181781 5181776 -
ggaaaagaggaagtgaaattgt

SEQ ID NO: 151221 - DNA, 22 bp, Artificial Sequence
  Synthetic oligonucleotide; TTG chr11 5181755 5181776 5181760 5181755 -
tccctgtttgcagatgacgtga

SEQ ID NO: 151222 - DNA, 22 bp, Artificial Sequence
  Synthetic oligonucleotide; CTG chr11 5181749 5181770 5181754 5181749 -
tttgcagatgacgtgattgtat

SEQ ID NO: 151223 - DNA, 22 bp, Artificial Sequence
  Synthetic oligonucleotide; TTT chr11 5181746 5181767 5181751 5181746 -
gcagatgacgtgattgtatatc

SEQ ID NO: 151224 - DNA, 22 bp, Artificial Sequence
  Synthetic oligonucleotide; TTG chr11 5181745 5181766 5181750 5181745 -
cagatgacgtgattgtatatct

SEQ ID NO: 151225 - DNA, 22 bp, Artificial Sequence
  Synthetic oligonucleotide; TTG chr11 5181730 5181751 5181735 5181730 -
tatatctagaaaaccccatcgt

SEQ ID NO: 151226 - DNA, 22 bp, Artificial Sequence
  Synthetic oligonucleotide; CTA chr11 5181722 5181743 5181727 5181722 -
gaaaaccccatcgtctcagccc

SEQ ID NO: 151227 - DNA, 22 bp, Artificial Sequence
  Synthetic oligonucleotide; CTC chr11 5181705 5181726 5181710 5181705 -
agcccaaaatctccttaagctg

SEQ ID NO: 151228 - DNA, 22 bp, Artificial Sequence
  Synthetic oligonucleotide; CTC chr11 5181692 5181713 5181697 5181692 -
cttaagctgataagcaacttca

SEQ ID NO: 151229 - DNA, 22 bp, Artificial Sequence
  Synthetic oligonucleotide; CTT chr11 5181689 5181710 5181694 5181689 -
aagctgataagcaacttcagaa

SEQ ID NO: 151230 - DNA, 22 bp, Artificial Sequence
  Synthetic oligonucleotide; TTA chr11 5181688 5181709 5181693 5181688 -
agctgataagcaacttcagaaa

SEQ ID NO: 151231 - DNA, 22 bp, Artificial Sequence
  Synthetic oligonucleotide; CTG chr11 5181683 5181704 5181688 5181683 -
ataagcaacttcagaaaagtct

SEQ ID NO: 151232 - DNA, 22 bp, Artificial Sequence
  Synthetic oligonucleotide; CTT chr11 5181672 5181693 5181677 5181672 -
cagaaaagtctcagcatacaaa

SEQ ID NO: 151233 - DNA, 22 bp, Artificial Sequence
  Synthetic oligonucleotide; TTC chr11 5181671 5181692 5181676 5181671 -
agaaaagtctcagcatacaaaa

SEQ ID NO: 151234 - DNA, 22 bp, Artificial Sequence
  Synthetic oligonucleotide; CTC chr11 5181660 5181681 5181665 5181660 -
agcatacaaaatcaatgtgcaa

SEQ ID NO: 151235 - DNA, 22 bp, Artificial Sequence
  Synthetic oligonucleotide; TTC chr11 5181623 5181644 5181628 5181623 -
ctatacaccaataacagacaaa

SEQ ID NO: 151236 - DNA, 22 bp, Artificial Sequence
  Synthetic oligonucleotide; CTA chr11 5181620 5181641 5181625 5181620 -
tacaccaataacagacaaacag

SEQ ID NO: 151237 - DNA, 22 bp, Artificial Sequence
  Synthetic oligonucleotide; CTC chr11 5181575 5181596 5181580 5181575 -
ccattcacaattgcctcaaaga

SEQ ID NO: 151238 - DNA, 22 bp, Artificial Sequence
  Synthetic oligonucleotide; TTC chr11 5181569 5181590 5181574 5181569 -
acaattgcctcaaagagaataa

SEQ ID NO: 151239 - DNA, 22 bp, Artificial Sequence
  Synthetic oligonucleotide; TTG chr11 5181562 5181583 5181567 5181562 -
cctcaaagagaataaaatacct

SEQ ID NO: 151240 - DNA, 22 bp, Artificial Sequence
  Synthetic oligonucleotide; CTC chr11 5181558 5181579 5181563 5181558 -
aaagagaataaaatacctagga

SEQ ID NO: 151241 - DNA, 22 bp, Artificial Sequence
  Synthetic oligonucleotide; CTA chr11 5181539 5181560 5181544 5181539 -
ggaatccaacttacaagggatg

SEQ ID NO: 151242 - DNA, 22 bp, Artificial Sequence
  Synthetic oligonucleotide; CTT chr11 5181527 5181548 5181532 5181527 -
acaagggatgtgaaggacctct

SEQ ID NO: 151243 - DNA, 22 bp, Artificial Sequence
  Synthetic oligonucleotide; TTA chr11 5181526 5181547 5181531 5181526 -
caagggatgtgaaggacctctt

SEQ ID NO: 151244 - DNA, 22 bp, Artificial Sequence
  Synthetic oligonucleotide; CTC chr11 5181506 5181527 5181511 5181506 -
ttcaaggagaacaacaaaacac

SEQ ID NO: 151245 - DNA, 22 bp, Artificial Sequence
  Synthetic oligonucleotide; CTT chr11 5181504 5181525 5181509 5181504 -
caaggagaacaacaaaacactg

SEQ ID NO: 151246 - DNA, 22 bp, Artificial Sequence
  Synthetic oligonucleotide; TTC chr11 5181503 5181524 5181508 5181503 -
aaggagaacaacaaaacactgc

SEQ ID NO: 151247 - DNA, 22 bp, Artificial Sequence
  Synthetic oligonucleotide; CTG chr11 5181482 5181503 5181487 5181482 -
ctcaacgaaataaaagaggata

SEQ ID NO: 151248 - DNA, 22 bp, Artificial Sequence
  Synthetic oligonucleotide; CTC chr11 5181479 5181500 5181484 5181479 -
aacgaaataaaagaggatacaa

SEQ ID NO: 151249 - DNA, 22 bp, Artificial Sequence
  Synthetic oligonucleotide; TTC chr11 5181439 5181460 5181444 5181439 -
catgctcatggataggaagaat

SEQ ID NO: 151250 - DNA, 22 bp, Artificial Sequence
  Synthetic oligonucleotide; CTC chr11 5181432 5181453 5181437 5181432 -
atggataggaagaatcaatatc

SEQ ID NO: 151251 - DNA, 22 bp, Artificial Sequence
  Synthetic oligonucleotide; CTT chr11 5181396 5181417 5181401 5181396 -
actgcccaaggtaatttataga

SEQ ID NO: 151252 - DNA, 22 bp, Artificial Sequence
  Synthetic oligonucleotide; TTA chr11 5181395 5181416 5181400 5181395 -
ctgcccaaggtaatttatagat

SEQ ID NO: 151253 - DNA, 22 bp, Artificial Sequence
  Synthetic oligonucleotide; CTG chr11 5181392 5181413 5181397 5181392 -
cccaaggtaatttatagattca

SEQ ID NO: 151254 - DNA, 22 bp, Artificial Sequence
  Synthetic oligonucleotide; TTT chr11 5181379 5181400 5181384 5181379 -
atagattcaatgccatccccat

SEQ ID NO: 151255 - DNA, 22 bp, Artificial Sequence
  Synthetic oligonucleotide; TTA chr11 5181378 5181399 5181383 5181378 -
tagattcaatgccatccccatc

SEQ ID NO: 151256 - DNA, 22 bp, Artificial Sequence
  Synthetic oligonucleotide; TTC chr11 5181371 5181392 5181376 5181371 -
aatgccatccccatcaagctac

SEQ ID NO: 151257 - DNA, 22 bp, Artificial Sequence
  Synthetic oligonucleotide; CTA chr11 5181350 5181371 5181355 5181350 -
ccaatgactttcttcacagaat

SEQ ID NO: 151258 - DNA, 22 bp, Artificial Sequence
  Synthetic oligonucleotide; CTT chr11 5181340 5181361 5181345 5181340 -
tcttcacagaattggaaaaaac

SEQ ID NO: 151259 - DNA, 22 bp, Artificial Sequence
  Synthetic oligonucleotide; TTT chr11 5181339 5181360 5181344 5181339 -
cttcacagaattggaaaaaact

SEQ ID NO: 151260 - DNA, 22 bp, Artificial Sequence
  Synthetic oligonucleotide; TTC chr11 5181338 5181359 5181343 5181338 -
ttcacagaattggaaaaaacta

SEQ ID NO: 151261 - DNA, 22 bp, Artificial Sequence
  Synthetic oligonucleotide; CTT chr11 5181336 5181357 5181341 5181336 -
cacagaattggaaaaaactact

SEQ ID NO: 151262 - DNA, 22 bp, Artificial Sequence
  Synthetic oligonucleotide; TTC chr11 5181335 5181356 5181340 5181335 -
acagaattggaaaaaactactt

SEQ ID NO: 151263 - DNA, 22 bp, Artificial Sequence
  Synthetic oligonucleotide; TTG chr11 5181326 5181347 5181331 5181326 -
gaaaaaactactttaaagttca

SEQ ID NO: 151264 - DNA, 22 bp, Artificial Sequence
  Synthetic oligonucleotide; CTA chr11 5181316 5181337 5181321 5181316 -
ctttaaagttcatatggaacca

SEQ ID NO: 151265 - DNA, 22 bp, Artificial Sequence
  Synthetic oligonucleotide; CTT chr11 5181313 5181334 5181318 5181313 -
taaagttcatatggaaccaaaa

SEQ ID NO: 151266 - DNA, 22 bp, Artificial Sequence
  Synthetic oligonucleotide; TTT chr11 5181312 5181333 5181317 5181312 -
aaagttcatatggaaccaaaaa

SEQ ID NO: 151267 - DNA, 22 bp, Artificial Sequence
  Synthetic oligonucleotide; TTA chr11 5181311 5181332 5181316 5181311 -
aagttcatatggaaccaaaaaa

SEQ ID NO: 151268 - DNA, 22 bp, Artificial Sequence
  Synthetic oligonucleotide; TTC chr11 5181305 5181326 5181310 5181305 -
atatggaaccaaaaaagagccc

SEQ ID NO: 151269 - DNA, 22 bp, Artificial Sequence
  Synthetic oligonucleotide; TTG chr11 5181277 5181298 5181282 5181277 -
acaagtcaatcctaagccaaaa

SEQ ID NO: 151270 - DNA, 22 bp, Artificial Sequence
  Synthetic oligonucleotide; CTA chr11 5181263 5181284 5181268 5181263 -
agccaaaagaacaaagctagag

SEQ ID NO: 151271 - DNA, 22 bp, Artificial Sequence
  Synthetic oligonucleotide; CTA chr11 5181244 5181265 5181249 5181244 -
gaggcatcatgctacctgactt

SEQ ID NO: 151272 - DNA, 22 bp, Artificial Sequence
  Synthetic oligonucleotide; CTA chr11 5181230 5181251 5181235 5181230 -
cctgacttcaaactatactaca

SEQ ID NO: 151273 - DNA, 22 bp, Artificial Sequence
  Synthetic oligonucleotide; CTG chr11 5181226 5181247 5181231 5181226 -
acttcaaactatactacaaggt

SEQ ID NO: 151274 - DNA, 22 bp, Artificial Sequence
  Synthetic oligonucleotide; CTT chr11 5181222 5181243 5181227 5181222 -
caaactatactacaaggtacag

SEQ ID NO: 151275 - DNA, 22 bp, Artificial Sequence
  Synthetic oligonucleotide; TTC chr11 5181221 5181242 5181226 5181221 -
aaactatactacaaggtacagt

SEQ ID NO: 151276 - DNA, 22 bp, Artificial Sequence
  Synthetic oligonucleotide; CTA chr11 5181215 5181236 5181220 5181215 -
tactacaaggtacagtaaccaa

SEQ ID NO: 151277 - DNA, 22 bp, Artificial Sequence
  Synthetic oligonucleotide; CTA chr11 5181210 5181231 5181215 5181210 -
caaggtacagtaaccaaaacaa

SEQ ID NO: 151278 - DNA, 22 bp, Artificial Sequence
  Synthetic oligonucleotide; CTG chr11 5181178 5181199 5181183 5181178 -
gtaccaaaacagagatgtagac

SEQ ID NO: 151279 - DNA, 22 bp, Artificial Sequence
  Synthetic oligonucleotide; CTC chr11 5181135 5181156 5181140 5181135 -
tcagaaataataccacacatcc

SEQ ID NO: 151280 - DNA, 22 bp, Artificial Sequence
  Synthetic oligonucleotide; CTC chr11 5181133 5181154 5181138 5181133 -
agaaataataccacacatccac

SEQ ID NO: 151281 - DNA, 22 bp, Artificial Sequence
  Synthetic oligonucleotide; CTA chr11 5181106 5181127 5181111 5181106 -
tctgatctttgacaaacctgac

SEQ ID NO: 151282 - DNA, 22 bp, Artificial Sequence
  Synthetic oligonucleotide; CTG chr11 5181102 5181123 5181107 5181102 -
atctttgacaaacctgacaaaa

SEQ ID NO: 151283 - DNA, 22 bp, Artificial Sequence
  Synthetic oligonucleotide; CTT chr11 5181097 5181118 5181102 5181097 -
tgacaaacctgacaaaaacaag

SEQ ID NO: 151284 - DNA, 22 bp, Artificial Sequence
  Synthetic oligonucleotide; TTT chr11 5181096 5181117 5181101 5181096 -
gacaaacctgacaaaaacaagc

SEQ ID NO: 151285 - DNA, 22 bp, Artificial Sequence
  Synthetic oligonucleotide; TTG chr11 5181095 5181116 5181100 5181095 -
acaaacctgacaaaaacaagca

SEQ ID NO: 151286 - DNA, 22 bp, Artificial Sequence
  Synthetic oligonucleotide; CTG chr11 5181086 5181107 5181091 5181086 -
acaaaaacaagcaatggggaaa

SEQ ID NO: 151287 - DNA, 22 bp, Artificial Sequence
  Synthetic oligonucleotide; TTC chr11 5181058 5181079 5181063 5181058 -
cctatttaataaatgatgctgg

SEQ ID NO: 151288 - DNA, 22 bp, Artificial Sequence
  Synthetic oligonucleotide; CTA chr11 5181054 5181075 5181059 5181054 -
tttaataaatgatgctgggaaa

SEQ ID NO: 151289 - DNA, 22 bp, Artificial Sequence
  Synthetic oligonucleotide; TTT chr11 5181051 5181072 5181056 5181051 -
aataaatgatgctgggaaaact

SEQ ID NO: 151290 - DNA, 22 bp, Artificial Sequence
  Synthetic oligonucleotide; TTA chr11 5181050 5181071 5181055 5181050 -
ataaatgatgctgggaaaactg

SEQ ID NO: 151291 - DNA, 22 bp, Artificial Sequence
  Synthetic oligonucleotide; CTG chr11 5181037 5181058 5181042 5181037 -
ggaaaactggctagccatatgt

SEQ ID NO: 151292 - DNA, 22 bp, Artificial Sequence
  Synthetic oligonucleotide; CTG chr11 5181028 5181049 5181033 5181028 -
gctagccatatgtagaaagctg

SEQ ID NO: 151293 - DNA, 22 bp, Artificial Sequence
  Synthetic oligonucleotide; CTA chr11 5181024 5181045 5181029 5181024 -
gccatatgtagaaagctgaaac

SEQ ID NO: 151294 - DNA, 22 bp, Artificial Sequence
  Synthetic oligonucleotide; CTG chr11 5181006 5181027 5181011 5181006 -
aaactggatcccttccttacac

SEQ ID NO: 151295 - DNA, 22 bp, Artificial Sequence
  Synthetic oligonucleotide; CTG chr11 5181000 5181021 5181005 5181000 -
gatcccttccttacaccttata

SEQ ID NO: 151296 - DNA, 22 bp, Artificial Sequence
  Synthetic oligonucleotide; CTT chr11 5180992 5181013 5180997 5180992 -
ccttacaccttatacaaaaatt

SEQ ID NO: 151297 - DNA, 22 bp, Artificial Sequence
  Synthetic oligonucleotide; TTC chr11 5180991 5181012 5180996 5180991 -
cttacaccttatacaaaaatta

SEQ ID NO: 151298 - DNA, 22 bp, Artificial Sequence
  Synthetic oligonucleotide; CTT chr11 5180988 5181009 5180993 5180988 -
acaccttatacaaaaattattt

SEQ ID NO: 151299 - DNA, 22 bp, Artificial Sequence
  Synthetic oligonucleotide; TTA chr11 5180987 5181008 5180992 5180987 -
caccttatacaaaaattatttc

SEQ ID NO: 151300 - DNA, 22 bp, Artificial Sequence
  Synthetic oligonucleotide; CTT chr11 5180981 5181002 5180986 5180981 -
atacaaaaattatttcaagatg

SEQ ID NO: 151301 - DNA, 22 bp, Artificial Sequence
  Synthetic oligonucleotide; TTA chr11 5180980 5181001 5180985 5180980 -
tacaaaaattatttcaagatgg

SEQ ID NO: 151302 - DNA, 22 bp, Artificial Sequence
  Synthetic oligonucleotide; TTA chr11 5180969 5180990 5180974 5180969 -
tttcaagatggattaaagactt

SEQ ID NO: 151303 - DNA, 22 bp, Artificial Sequence
  Synthetic oligonucleotide; TTT chr11 5180966 5180987 5180971 5180966 -
caagatggattaaagacttaca

SEQ ID NO: 151304 - DNA, 22 bp, Artificial Sequence
  Synthetic oligonucleotide; TTC chr11 5180965 5180986 5180970 5180965 -
aagatggattaaagacttacat

SEQ ID NO: 151305 - DNA, 22 bp, Artificial Sequence
  Synthetic oligonucleotide; TTA chr11 5180954 5180975 5180959 5180954 -
aagacttacatgttagacctaa

SEQ ID NO: 151306 - DNA, 22 bp, Artificial Sequence
  Synthetic oligonucleotide; CTT chr11 5180947 5180968 5180952 5180947 -
acatgttagacctaaaaccata

SEQ ID NO: 151307 - DNA, 22 bp, Artificial Sequence
  Synthetic oligonucleotide; TTA chr11 5180946 5180967 5180951 5180946 -
catgttagacctaaaaccataa

SEQ ID NO: 151308 - DNA, 22 bp, Artificial Sequence
  Synthetic oligonucleotide; TTA chr11 5180939 5180960 5180944 5180939 -
gacctaaaaccataaaaacctt

SEQ ID NO: 151309 - DNA, 22 bp, Artificial Sequence
  Synthetic oligonucleotide; CTA chr11 5180933 5180954 5180938 5180933 -
aaaccataaaaaccttagaaga

SEQ ID NO: 151310 - DNA, 22 bp, Artificial Sequence
  Synthetic oligonucleotide; CTT chr11 5180917 5180938 5180922 5180917 -
agaagaaaacctaagcaatacc

SEQ ID NO: 151311 - DNA, 22 bp, Artificial Sequence
  Synthetic oligonucleotide; TTA chr11 5180916 5180937 5180921 5180916 -
gaagaaaacctaagcaatacca

SEQ ID NO: 151312 - DNA, 22 bp, Artificial Sequence
  Synthetic oligonucleotide; CTA chr11 5180904 5180925 5180909 5180904 -
agcaataccattcaggacatag

SEQ ID NO: 151313 - DNA, 22 bp, Artificial Sequence
  Synthetic oligonucleotide; TTC chr11 5180891 5180912 5180896 5180891 -
aggacataggcatgggcaagga

SEQ ID NO: 151314 - DNA, 22 bp, Artificial Sequence
  Synthetic oligonucleotide; CTT chr11 5180866 5180887 5180871 5180866 -
catgtctaaaacaccaaaagca

SEQ ID NO: 151315 - DNA, 22 bp, Artificial Sequence
  Synthetic oligonucleotide; TTC chr11 5180865 5180886 5180870 5180865 -
atgtctaaaacaccaaaagcaa

SEQ ID NO: 151316 - DNA, 22 bp, Artificial Sequence
  Synthetic oligonucleotide; CTA chr11 5180858 5180879 5180863 5180858 -
aaacaccaaaagcaatggcaac

SEQ ID NO: 151317 - DNA, 22 bp, Artificial Sequence
  Synthetic oligonucleotide; CTA chr11 5180808 5180829 5180813 5180808 -
attaaactaaagagcttctgca

SEQ ID NO: 151318 - DNA, 22 bp, Artificial Sequence
  Synthetic oligonucleotide; TTA chr11 5180804 5180825 5180809 5180804 -
aactaaagagcttctgcacagc

SEQ ID NO: 151319 - DNA, 22 bp, Artificial Sequence
  Synthetic oligonucleotide; CTA chr11 5180799 5180820 5180804 5180799 -
aagagcttctgcacagcaaaag

SEQ ID NO: 151320 - DNA, 22 bp, Artificial Sequence
  Synthetic oligonucleotide; CTT chr11 5180791 5180812 5180796 5180791 -
ctgcacagcaaaagaaactacc

SEQ ID NO: 151321 - DNA, 22 bp, Artificial Sequence
  Synthetic oligonucleotide; TTC chr11 5180790 5180811 5180795 5180790 -
tgcacagcaaaagaaactacca

SEQ ID NO: 151322 - DNA, 22 bp, Artificial Sequence
  Synthetic oligonucleotide; CTG chr11 5180788 5180809 5180793 5180788 -
cacagcaaaagaaactaccatc

SEQ ID NO: 151323 - DNA, 22 bp, Artificial Sequence
  Synthetic oligonucleotide; CTA chr11 5180771 5180792 5180776 5180771 -
ccatcagagtgaacaggcaacc

SEQ ID NO: 151324 - DNA, 22 bp, Artificial Sequence
  Synthetic oligonucleotide; CTA chr11 5180747 5180768 5180752 5180747 -
cacaatgggagaaaatttttgc

SEQ ID NO: 151325 - DNA, 22 bp, Artificial Sequence
  Synthetic oligonucleotide; TTT chr11 5180729 5180750 5180734 5180729 -
ttgcaatctactcatctgacaa

SEQ ID NO: 151326 - DNA, 22 bp, Artificial Sequence
  Synthetic oligonucleotide; TTT chr11 5180728 5180749 5180733 5180728 -
tgcaatctactcatctgacaaa

SEQ ID NO: 151327 - DNA, 22 bp, Artificial Sequence
  Synthetic oligonucleotide; TTT chr11 5180727 5180748 5180732 5180727 -
gcaatctactcatctgacaaag

SEQ ID NO: 151328 - DNA, 22 bp, Artificial Sequence
  Synthetic oligonucleotide; TTG chr11 5180726 5180747 5180731 5180726 -
caatctactcatctgacaaagg

SEQ ID NO: 151329 - DNA, 22 bp, Artificial Sequence
  Synthetic oligonucleotide; CTA chr11 5180719 5180740 5180724 5180719 -
ctcatctgacaaagggctaata

SEQ ID NO: 151330 - DNA, 22 bp, Artificial Sequence
  Synthetic oligonucleotide; CTC chr11 5180716 5180737 5180721 5180716 -
atctgacaaagggctaatatcc

SEQ ID NO: 151331 - DNA, 22 bp, Artificial Sequence
  Synthetic oligonucleotide; CTG chr11 5180711 5180732 5180716 5180711 -
acaaagggctaatatccagaat

SEQ ID NO: 151332 - DNA, 22 bp, Artificial Sequence
  Synthetic oligonucleotide; CTA chr11 5180700 5180721 5180705 5180700 -
atatccagaatctacaatgaac

SEQ ID NO: 151333 - DNA, 22 bp, Artificial Sequence
  Synthetic oligonucleotide; CTA chr11 5180686 5180707 5180691 5180686 -
caatgaactcaaacaaatttac

SEQ ID NO: 151334 - DNA, 22 bp, Artificial Sequence
  Synthetic oligonucleotide; CTC chr11 5180676 5180697 5180681 5180676 -
aaacaaatttacaagaaaaaaa

SEQ ID NO: 151335 - DNA, 22 bp, Artificial Sequence
  Synthetic oligonucleotide; TTT chr11 5180666 5180687 5180671 5180666 -
acaagaaaaaaacaaacaactg

SEQ ID NO: 151336 - DNA, 22 bp, Artificial Sequence
  Synthetic oligonucleotide; TTA chr11 5180665 5180686 5180670 5180665 -
caagaaaaaaacaaacaactgc

SEQ ID NO: 151337 - DNA, 22 bp, Artificial Sequence
  Synthetic oligonucleotide; CTG chr11 5180644 5180665 5180649 5180644 -
catcaacaagggggtgaaggat

SEQ ID NO: 151338 - DNA, 22 bp, Artificial Sequence
  Synthetic oligonucleotide; CTT chr11 5180608 5180629 5180613 5180608 -
ctcaaaagaagacatttatgca

SEQ ID NO: 151339 - DNA, 22 bp, Artificial Sequence
  Synthetic oligonucleotide; TTC chr11 5180607 5180628 5180612 5180607 -
tcaaaagaagacatttatgcag

SEQ ID NO: 151340 - DNA, 22 bp, Artificial Sequence
  Synthetic oligonucleotide; CTC chr11 5180605 5180626 5180610 5180605 -
aaaagaagacatttatgcagcc

SEQ ID NO: 151341 - DNA, 22 bp, Artificial Sequence
  Synthetic oligonucleotide; TTT chr11 5180591 5180612 5180596 5180591 -
atgcagccaaaaaacacatgaa

SEQ ID NO: 151342 - DNA, 22 bp, Artificial Sequence
  Synthetic oligonucleotide; TTA chr11 5180590 5180611 5180595 5180590 -
tgcagccaaaaaacacatgaaa

SEQ ID NO: 151343 - DNA, 22 bp, Artificial Sequence
  Synthetic oligonucleotide; CTC chr11 5180560 5180581 5180565 5180560 -
atcatcactggccatcagagaa

SEQ ID NO: 151344 - DNA, 22 bp, Artificial Sequence
  Synthetic oligonucleotide; CTG chr11 5180550 5180571 5180555 5180550 -
gccatcagagaaatgcaaatca

SEQ ID NO: 151345 - DNA, 22 bp, Artificial Sequence
  Synthetic oligonucleotide; CTC chr11 5180505 5180526 5180510 5180505 -
acaccagttagaatggtgatca

SEQ ID NO: 151346 - DNA, 22 bp, Artificial Sequence
  Synthetic oligonucleotide; TTA chr11 5180495 5180516 5180500 5180495 -
gaatggtgatcattaaaaagtc

SEQ ID NO: 151347 - DNA, 22 bp, Artificial Sequence
  Synthetic oligonucleotide; TTA chr11 5180480 5180501 5180485 5180480 -
aaaagtcaggaaaccacaggtg

SEQ ID NO: 151348 - DNA, 22 bp, Artificial Sequence
  Synthetic oligonucleotide; CTG chr11 5180455 5180476 5180460 5180455 -
gagaggatgtggagaaatagga

SEQ ID NO: 151349 - DNA, 22 bp, Artificial Sequence
  Synthetic oligonucleotide; CTT chr11 5180427 5180448 5180432 5180427 -
ttacactgttggtgggactata

SEQ ID NO: 151350 - DNA, 22 bp, Artificial Sequence
  Synthetic oligonucleotide; TTT chr11 5180426 5180447 5180431 5180426 -
tacactgttggtgggactataa

SEQ ID NO: 151351 - DNA, 22 bp, Artificial Sequence
  Synthetic oligonucleotide; TTT chr11 5180425 5180446 5180430 5180425 -
acactgttggtgggactataaa

SEQ ID NO: 151352 - DNA, 22 bp, Artificial Sequence
  Synthetic oligonucleotide; TTA chr11 5180424 5180445 5180429 5180424 -
cactgttggtgggactataaac

SEQ ID NO: 151353 - DNA, 22 bp, Artificial Sequence
  Synthetic oligonucleotide; CTG chr11 5180419 5180440 5180424 5180419 -
ttggtgggactataaactagtt

SEQ ID NO: 151354 - DNA, 22 bp, Artificial Sequence
  Synthetic oligonucleotide; TTG chr11 5180416 5180437 5180421 5180416 -
gtgggactataaactagttcaa

SEQ ID NO: 151355 - DNA, 22 bp, Artificial Sequence
  Synthetic oligonucleotide; CTA chr11 5180407 5180428 5180412 5180407 -
taaactagttcaaccattgtgg

SEQ ID NO: 151356 - DNA, 22 bp, Artificial Sequence
  Synthetic oligonucleotide; CTA chr11 5180400 5180421 5180405 5180400 -
gttcaaccattgtggaagtcag

SEQ ID NO: 151357 - DNA, 22 bp, Artificial Sequence
  Synthetic oligonucleotide; TTC chr11 5180396 5180417 5180401 5180396 -
aaccattgtggaagtcagtgtg

SEQ ID NO: 151358 - DNA, 22 bp, Artificial Sequence
  Synthetic oligonucleotide; TTG chr11 5180388 5180409 5180393 5180388 -
tggaagtcagtgtggcaattcc

SEQ ID NO: 151359 - DNA, 22 bp, Artificial Sequence
  Synthetic oligonucleotide; TTC chr11 5180367 5180388 5180372 5180367 -
ctcagggatctagaactagaaa

SEQ ID NO: 151360 - DNA, 22 bp, Artificial Sequence
  Synthetic oligonucleotide; CTC chr11 5180364 5180385 5180369 5180364 -
agggatctagaactagaaatac

SEQ ID NO: 151361 - DNA, 22 bp, Artificial Sequence
  Synthetic oligonucleotide; CTA chr11 5180355 5180376 5180360 5180355 -
gaactagaaataccatttgacc

SEQ ID NO: 151362 - DNA, 22 bp, Artificial Sequence
  Synthetic oligonucleotide; CTA chr11 5180349 5180370 5180354 5180349 -
gaaataccatttgacccagcca

SEQ ID NO: 151363 - DNA, 22 bp, Artificial Sequence
  Synthetic oligonucleotide; TTT chr11 5180337 5180358 5180342 5180337 -
gacccagccatcctattactgg

SEQ ID NO: 151364 - DNA, 22 bp, Artificial Sequence
  Synthetic oligonucleotide; TTG chr11 5180336 5180357 5180341 5180336 -
acccagccatcctattactggg

SEQ ID NO: 151365 - DNA, 22 bp, Artificial Sequence
  Synthetic oligonucleotide; CTA chr11 5180322 5180343 5180327 5180322 -
ttactgggtatatacccaaagg

SEQ ID NO: 151366 - DNA, 22 bp, Artificial Sequence
  Synthetic oligonucleotide; TTA chr11 5180319 5180340 5180324 5180319 -
ctgggtatatacccaaaggaat

SEQ ID NO: 151367 - DNA, 22 bp, Artificial Sequence
  Synthetic oligonucleotide; CTG chr11 5180316 5180337 5180321 5180316 -
ggtatatacccaaaggaatgta

SEQ ID NO: 151368 - DNA, 22 bp, Artificial Sequence
  Synthetic oligonucleotide; CTG chr11 5180284 5180305 5180289 5180284 -
ctataaagacacatgcacacgt

SEQ ID NO: 151369 - DNA, 22 bp, Artificial Sequence
  Synthetic oligonucleotide; CTA chr11 5180281 5180302 5180286 5180281 -
taaagacacatgcacacgtatg

SEQ ID NO: 151370 - DNA, 22 bp, Artificial Sequence
  Synthetic oligonucleotide; TTT chr11 5180256 5180277 5180261 5180256 -
attgtggcactattcacaatag

SEQ ID NO: 151371 - DNA, 22 bp, Artificial Sequence
  Synthetic oligonucleotide; TTA chr11 5180255 5180276 5180260 5180255 -
ttgtggcactattcacaatagc

SEQ ID NO: 151372 - DNA, 22 bp, Artificial Sequence
  Synthetic oligonucleotide; TTG chr11 5180252 5180273 5180257 5180252 -
tggcactattcacaatagcaaa

SEQ ID NO: 151373 - DNA, 22 bp, Artificial Sequence
  Synthetic oligonucleotide; CTA chr11 5180244 5180265 5180249 5180244 -
ttcacaatagcaaagacttgga

SEQ ID NO: 151374 - DNA, 22 bp, Artificial Sequence
  Synthetic oligonucleotide; TTC chr11 5180241 5180262 5180246 5180241 -
acaatagcaaagacttggaacc

SEQ ID NO: 151375 - DNA, 22 bp, Artificial Sequence
  Synthetic oligonucleotide; CTT chr11 5180225 5180246 5180230 5180225 -
ggaaccaacccaaatgtccaac

SEQ ID NO: 151376 - DNA, 22 bp, Artificial Sequence
  Synthetic oligonucleotide; TTG chr11 5180224 5180245 5180229 5180224 -
gaaccaacccaaatgtccaaca

SEQ ID NO: 151377 - DNA, 22 bp, Artificial Sequence
  Synthetic oligonucleotide; CTG chr11 5180191 5180212 5180196 5180191 -
gattaagaaaatgtggcacata

SEQ ID NO: 151378 - DNA, 22 bp, Artificial Sequence
  Synthetic oligonucleotide; TTA chr11 5180186 5180207 5180191 5180186 -
agaaaatgtggcacatatacat

SEQ ID NO: 151379 - DNA, 22 bp, Artificial Sequence
  Synthetic oligonucleotide; CTA chr11 5180152 5180173 5180157 5180152 -
tgcagccataaaaaatgatgag

SEQ ID NO: 151380 - DNA, 22 bp, Artificial Sequence
  Synthetic oligonucleotide; TTC chr11 5180127 5180148 5180132 5180127 -
atgtcctttgtagggacatgga

SEQ ID NO: 151381 - DNA, 22 bp, Artificial Sequence
  Synthetic oligonucleotide; CTT chr11 5180119 5180140 5180124 5180119 -
tgtagggacatggatgaaactg

SEQ ID NO: 151382 - DNA, 22 bp, Artificial Sequence
  Synthetic oligonucleotide; TTT chr11 5180118 5180139 5180123 5180118 -
gtagggacatggatgaaactgg

SEQ ID NO: 151383 - DNA, 22 bp, Artificial Sequence
  Synthetic oligonucleotide; TTG chr11 5180117 5180138 5180122 5180117 -
tagggacatggatgaaactgga

SEQ ID NO: 151384 - DNA, 22 bp, Artificial Sequence
  Synthetic oligonucleotide; CTG chr11 5180097 5180118 5180102 5180097 -
gaaaccatcattctgagcaaag

SEQ ID NO: 151385 - DNA, 22 bp, Artificial Sequence
  Synthetic oligonucleotide; TTC chr11 5180084 5180105 5180089 5180084 -
tgagcaaagtatcgcaaggacg

SEQ ID NO: 151386 - DNA, 22 bp, Artificial Sequence
  Synthetic oligonucleotide; CTG chr11 5180082 5180103 5180087 5180082 -
agcaaagtatcgcaaggacgaa

SEQ ID NO: 151387 - DNA, 22 bp, Artificial Sequence
  Synthetic oligonucleotide; TTC chr11 5180040 5180061 5180045 5180040 -
tcactcataggtgggagttgaa

SEQ ID NO: 151388 - DNA, 22 bp, Artificial Sequence
  Synthetic oligonucleotide; CTC chr11 5180038 5180059 5180043 5180038 -
actcataggtgggagttgaaca

SEQ ID NO: 151389 - DNA, 22 bp, Artificial Sequence
  Synthetic oligonucleotide; CTC chr11 5180034 5180055 5180039 5180034 -
ataggtgggagttgaacaatga

SEQ ID NO: 151390 - DNA, 22 bp, Artificial Sequence
  Synthetic oligonucleotide; TTG chr11 5180020 5180041 5180025 5180020 -
aacaatgagaacatttggacac

SEQ ID NO: 151391 - DNA, 22 bp, Artificial Sequence
  Synthetic oligonucleotide; TTT chr11 5180004 5180025 5180009 5180004 -
ggacacagtgaggggaacatca

SEQ ID NO: 151392 - DNA, 22 bp, Artificial Sequence
  Synthetic oligonucleotide; TTG chr11 5180003 5180024 5180008 5180003 -
gacacagtgaggggaacatcac

SEQ ID NO: 151393 - DNA, 22 bp, Artificial Sequence
  Synthetic oligonucleotide; CTG chr11 5179968 5179989 5179973 5179968 -
ttgtggggtgggggccgggggg

SEQ ID NO: 151394 - DNA, 22 bp, Artificial Sequence
  Synthetic oligonucleotide; TTG chr11 5179965 5179986 5179970 5179965 -
tggggtgggggccggggggagg

SEQ ID NO: 151395 - DNA, 22 bp, Artificial Sequence
  Synthetic oligonucleotide; TTA chr11 5179933 5179954 5179938 5179933 -
ggagatatacctaatgtaaatg

SEQ ID NO: 151396 - DNA, 22 bp, Artificial Sequence
  Synthetic oligonucleotide; CTA chr11 5179920 5179941 5179925 5179920 -
atgtaaatgacgagttaatggg

SEQ ID NO: 151397 - DNA, 22 bp, Artificial Sequence
  Synthetic oligonucleotide; TTA chr11 5179903 5179924 5179908 5179903 -
atgggtgcagcacaccaacatg

SEQ ID NO: 151398 - DNA, 22 bp, Artificial Sequence
  Synthetic oligonucleotide; CTG chr11 5179853 5179874 5179858 5179853 -
catgttgtgcacatgtacccta

SEQ ID NO: 151399 - DNA, 22 bp, Artificial Sequence
  Synthetic oligonucleotide; TTG chr11 5179846 5179867 5179851 5179846 -
tgcacatgtaccctagaactta

SEQ ID NO: 151400 - DNA, 22 bp, Artificial Sequence
  Synthetic oligonucleotide; CTA chr11 5179831 5179852 5179836 5179831 -
gaacttaaagtataataaacat

SEQ ID NO: 151401 - DNA, 22 bp, Artificial Sequence
  Synthetic oligonucleotide; CTT chr11 5179825 5179846 5179830 5179825 -
aaagtataataaacatatatat

SEQ ID NO: 151402 - DNA, 22 bp, Artificial Sequence
  Synthetic oligonucleotide; TTA chr11 5179824 5179845 5179829 5179824 -
aagtataataaacatatatata

SEQ ID NO: 151403 - DNA, 22 bp, Artificial Sequence
  Synthetic oligonucleotide; TTG chr11 5179784 5179805 5179789 5179784 -
tctcattttcaatcagtgactg

SEQ ID NO: 151404 - DNA, 22 bp, Artificial Sequence
  Synthetic oligonucleotide; CTC chr11 5179780 5179801 5179785 5179780 -
attttcaatcagtgactgaagt

SEQ ID NO: 151405 - DNA, 22 bp, Artificial Sequence
  Synthetic oligonucleotide; TTT chr11 5179776 5179797 5179781 5179776 -
tcaatcagtgactgaagtggaa

SEQ ID NO: 151406 - DNA, 22 bp, Artificial Sequence
  Synthetic oligonucleotide; TTT chr11 5179775 5179796 5179780 5179775 -
caatcagtgactgaagtggaaa

SEQ ID NO: 151407 - DNA, 22 bp, Artificial Sequence
  Synthetic oligonucleotide; TTC chr11 5179774 5179795 5179779 5179774 -
aatcagtgactgaagtggaaag

SEQ ID NO: 151408 - DNA, 22 bp, Artificial Sequence
  Synthetic oligonucleotide; CTG chr11 5179762 5179783 5179767 5179762 -
aagtggaaagaaacaaaatatt

SEQ ID NO: 151409 - DNA, 22 bp, Artificial Sequence
  Synthetic oligonucleotide; TTT chr11 5179739 5179760 5179744 5179739 -
tattctttaccacctatgaggc

SEQ ID NO: 151410 - DNA, 22 bp, Artificial Sequence
  Synthetic oligonucleotide; TTT chr11 5179738 5179759 5179743 5179738 -
attctttaccacctatgaggca

SEQ ID NO: 151411 - DNA, 22 bp, Artificial Sequence
  Synthetic oligonucleotide; TTA chr11 5179737 5179758 5179742 5179737 -
ttctttaccacctatgaggcat

SEQ ID NO: 151412 - DNA, 22 bp, Artificial Sequence
  Synthetic oligonucleotide; TTC chr11 5179734 5179755 5179739 5179734 -
tttaccacctatgaggcatata

SEQ ID NO: 151413 - DNA, 22 bp, Artificial Sequence
  Synthetic oligonucleotide; CTT chr11 5179732 5179753 5179737 5179732 -
taccacctatgaggcatatact

SEQ ID NO: 151414 - DNA, 22 bp, Artificial Sequence
  Synthetic oligonucleotide; TTT chr11 5179731 5179752 5179736 5179731 -
accacctatgaggcatatactt

SEQ ID NO: 151415 - DNA, 22 bp, Artificial Sequence
  Synthetic oligonucleotide; TTA chr11 5179730 5179751 5179735 5179730 -
ccacctatgaggcatatacttt

SEQ ID NO: 151416 - DNA, 22 bp, Artificial Sequence
  Synthetic oligonucleotide; CTA chr11 5179723 5179744 5179728 5179723 -
tgaggcatatactttttttttt

SEQ ID NO: 151417 - DNA, 22 bp, Artificial Sequence
  Synthetic oligonucleotide; CTT chr11 5179709 5179730 5179714 5179709 -
ttttttttgagagggagtctcg

SEQ ID NO: 151418 - DNA, 22 bp, Artificial Sequence
  Synthetic oligonucleotide; TTT chr11 5179708 5179729 5179713 5179708 -
tttttttgagagggagtctcgc

SEQ ID NO: 151419 - DNA, 22 bp, Artificial Sequence
  Synthetic oligonucleotide; TTT chr11 5179707 5179728 5179712 5179707 -
ttttttgagagggagtctcgct

SEQ ID NO: 151420 - DNA, 22 bp, Artificial Sequence
  Synthetic oligonucleotide; TTT chr11 5179706 5179727 5179711 5179706 -
tttttgagagggagtctcgctc

SEQ ID NO: 151421 - DNA, 22 bp, Artificial Sequence
  Synthetic oligonucleotide; TTT chr11 5179705 5179726 5179710 5179705 -
ttttgagagggagtctcgctct

SEQ ID NO: 151422 - DNA, 22 bp, Artificial Sequence
  Synthetic oligonucleotide; TTT chr11 5179704 5179725 5179709 5179704 -
tttgagagggagtctcgctctg

SEQ ID NO: 151423 - DNA, 22 bp, Artificial Sequence
  Synthetic oligonucleotide; TTT chr11 5179703 5179724 5179708 5179703 -
ttgagagggagtctcgctctgt

SEQ ID NO: 151424 - DNA, 22 bp, Artificial Sequence
  Synthetic oligonucleotide; TTT chr11 5179702 5179723 5179707 5179702 -
tgagagggagtctcgctctgtc

SEQ ID NO: 151425 - DNA, 22 bp, Artificial Sequence
  Synthetic oligonucleotide; TTT chr11 5179701 5179722 5179706 5179701 -
gagagggagtctcgctctgtca

SEQ ID NO: 151426 - DNA, 22 bp, Artificial Sequence
  Synthetic oligonucleotide; TTG chr11 5179700 5179721 5179705 5179700 -
agagggagtctcgctctgtcac

SEQ ID NO: 151427 - DNA, 22 bp, Artificial Sequence
  Synthetic oligonucleotide; CTC chr11 5179688 5179709 5179693 5179688 -
gctctgtcacctaggctggagt

SEQ ID NO: 151428 - DNA, 22 bp, Artificial Sequence
  Synthetic oligonucleotide; CTC chr11 5179684 5179705 5179689 5179684 -
tgtcacctaggctggagtgcag

SEQ ID NO: 151429 - DNA, 22 bp, Artificial Sequence
  Synthetic oligonucleotide; CTG chr11 5179682 5179703 5179687 5179682 -
tcacctaggctggagtgcagtt

SEQ ID NO: 151430 - DNA, 22 bp, Artificial Sequence
  Synthetic oligonucleotide; CTA chr11 5179675 5179696 5179680 5179675 -
ggctggagtgcagttgcgcgat

SEQ ID NO: 151431 - DNA, 22 bp, Artificial Sequence
  Synthetic oligonucleotide; CTG chr11 5179670 5179691 5179675 5179670 -
gagtgcagttgcgcgatctctg

SEQ ID NO: 151432 - DNA, 22 bp, Artificial Sequence
  Synthetic oligonucleotide; TTG chr11 5179659 5179680 5179664 5179659 -
cgcgatctctgctcactgaaac

SEQ ID NO: 151433 - DNA, 22 bp, Artificial Sequence
  Synthetic oligonucleotide; CTC chr11 5179650 5179671 5179655 5179650 -
tgctcactgaaacttctgcctc

SEQ ID NO: 151434 - DNA, 22 bp, Artificial Sequence
  Synthetic oligonucleotide; CTG chr11 5179648 5179669 5179653 5179648 -
ctcactgaaacttctgcctccc

SEQ ID NO: 151435 - DNA, 22 bp, Artificial Sequence
  Synthetic oligonucleotide; CTC chr11 5179645 5179666 5179650 5179645 -
actgaaacttctgcctcccagg

SEQ ID NO: 151436 - DNA, 22 bp, Artificial Sequence
  Synthetic oligonucleotide; CTG chr11 5179641 5179662 5179646 5179641 -
aaacttctgcctcccaggttca

SEQ ID NO: 151437 - DNA, 22 bp, Artificial Sequence
  Synthetic oligonucleotide; CTT chr11 5179635 5179656 5179640 5179635 -
ctgcctcccaggttcaagcgat

SEQ ID NO: 151438 - DNA, 22 bp, Artificial Sequence
  Synthetic oligonucleotide; TTC chr11 5179634 5179655 5179639 5179634 -
tgcctcccaggttcaagcgatt

SEQ ID NO: 151439 - DNA, 22 bp, Artificial Sequence
  Synthetic oligonucleotide; CTG chr11 5179632 5179653 5179637 5179632 -
cctcccaggttcaagcgattct

SEQ ID NO: 151440 - DNA, 22 bp, Artificial Sequence
  Synthetic oligonucleotide; CTC chr11 5179628 5179649 5179633 5179628 -
ccaggttcaagcgattctcctg

SEQ ID NO: 151441 - DNA, 22 bp, Artificial Sequence
  Synthetic oligonucleotide; TTC chr11 5179620 5179641 5179625 5179620 -
aagcgattctcctgcctcagcc

SEQ ID NO: 151442 - DNA, 22 bp, Artificial Sequence
  Synthetic oligonucleotide; TTC chr11 5179611 5179632 5179616 5179611 -
tcctgcctcagcctcttgagta

SEQ ID NO: 151443 - DNA, 22 bp, Artificial Sequence
  Synthetic oligonucleotide; CTC chr11 5179609 5179630 5179614 5179609 -
ctgcctcagcctcttgagtagc

SEQ ID NO: 151444 - DNA, 22 bp, Artificial Sequence
  Synthetic oligonucleotide; CTG chr11 5179606 5179627 5179611 5179606 -
cctcagcctcttgagtagctgg

SEQ ID NO: 151445 - DNA, 22 bp, Artificial Sequence
  Synthetic oligonucleotide; CTC chr11 5179602 5179623 5179607 5179602 -
agcctcttgagtagctgggatt

SEQ ID NO: 151446 - DNA, 22 bp, Artificial Sequence
  Synthetic oligonucleotide; CTC chr11 5179596 5179617 5179601 5179596 -
ttgagtagctgggattaaaggt

SEQ ID NO: 151447 - DNA, 22 bp, Artificial Sequence
  Synthetic oligonucleotide; CTT chr11 5179594 5179615 5179599 5179594 -
gagtagctgggattaaaggtgc

SEQ ID NO: 151448 - DNA, 22 bp, Artificial Sequence
  Synthetic oligonucleotide; TTG chr11 5179593 5179614 5179598 5179593 -
agtagctgggattaaaggtgca

SEQ ID NO: 151449 - DNA, 22 bp, Artificial Sequence
  Synthetic oligonucleotide; CTG chr11 5179585 5179606 5179590 5179585 -
ggattaaaggtgcacaccacta

SEQ ID NO: 151450 - DNA, 22 bp, Artificial Sequence
  Synthetic oligonucleotide; TTA chr11 5179579 5179600 5179584 5179579 -
aaggtgcacaccactatgccca

SEQ ID NO: 151451 - DNA, 22 bp, Artificial Sequence
  Synthetic oligonucleotide; CTA chr11 5179563 5179584 5179568 5179563 -
tgcccagctaatttttgtattt

SEQ ID NO: 151452 - DNA, 22 bp, Artificial Sequence
  Synthetic oligonucleotide; CTA chr11 5179553 5179574 5179558 5179553 -
atttttgtatttttagtagaga

SEQ ID NO: 151453 - DNA, 22 bp, Artificial Sequence
  Synthetic oligonucleotide; TTT chr11 5179549 5179570 5179554 5179549 -
ttgtatttttagtagagacggg

SEQ ID NO: 151454 - DNA, 22 bp, Artificial Sequence
  Synthetic oligonucleotide; TTT chr11 5179548 5179569 5179553 5179548 -
tgtatttttagtagagacgggg

SEQ ID NO: 151455 - DNA, 22 bp, Artificial Sequence
  Synthetic oligonucleotide; TTT chr11 5179547 5179568 5179552 5179547 -
gtatttttagtagagacggggt

SEQ ID NO: 151456 - DNA, 22 bp, Artificial Sequence
  Synthetic oligonucleotide; TTG chr11 5179546 5179567 5179551 5179546 -
tatttttagtagagacggggtt

SEQ ID NO: 151457 - DNA, 22 bp, Artificial Sequence
  Synthetic oligonucleotide; TTT chr11 5179541 5179562 5179546 5179541 -
ttagtagagacggggtttcatt

SEQ ID NO: 151458 - DNA, 22 bp, Artificial Sequence
  Synthetic oligonucleotide; TTT chr11 5179540 5179561 5179545 5179540 -
tagtagagacggggtttcattg

SEQ ID NO: 151459 - DNA, 22 bp, Artificial Sequence
  Synthetic oligonucleotide; TTT chr11 5179539 5179560 5179544 5179539 -
agtagagacggggtttcattgt

SEQ ID NO: 151460 - DNA, 22 bp, Artificial Sequence
  Synthetic oligonucleotide; TTA chr11 5179538 5179559 5179543 5179538 -
gtagagacggggtttcattgtt

SEQ ID NO: 151461 - DNA, 22 bp, Artificial Sequence
  Synthetic oligonucleotide; TTT chr11 5179523 5179544 5179528 5179523 -
cattgttttggtcaagctggtc

SEQ ID NO: 151462 - DNA, 22 bp, Artificial Sequence
  Synthetic oligonucleotide; TTC chr11 5179522 5179543 5179527 5179522 -
attgttttggtcaagctggtct

SEQ ID NO: 151463 - DNA, 22 bp, Artificial Sequence
  Synthetic oligonucleotide; TTG chr11 5179518 5179539 5179523 5179518 -
ttttggtcaagctggtctggaa

SEQ ID NO: 151464 - DNA, 22 bp, Artificial Sequence
  Synthetic oligonucleotide; TTT chr11 5179515 5179536 5179520 5179515 -
tggtcaagctggtctggaactc

SEQ ID NO: 151465 - DNA, 22 bp, Artificial Sequence
  Synthetic oligonucleotide; TTT chr11 5179514 5179535 5179519 5179514 -
ggtcaagctggtctggaactcc

SEQ ID NO: 151466 - DNA, 22 bp, Artificial Sequence
  Synthetic oligonucleotide; TTG chr11 5179513 5179534 5179518 5179513 -
gtcaagctggtctggaactcct

SEQ ID NO: 151467 - DNA, 22 bp, Artificial Sequence
  Synthetic oligonucleotide; CTG chr11 5179504 5179525 5179509 5179504 -
gtctggaactcctgaccttgtg

SEQ ID NO: 151468 - DNA, 22 bp, Artificial Sequence
  Synthetic oligonucleotide; CTG chr11 5179499 5179520 5179504 5179499 -
gaactcctgaccttgtgatcta

SEQ ID NO: 151469 - DNA, 22 bp, Artificial Sequence
  Synthetic oligonucleotide; CTC chr11 5179493 5179514 5179498 5179493 -
ctgaccttgtgatctacccgcc

SEQ ID NO: 151470 - DNA, 22 bp, Artificial Sequence
  Synthetic oligonucleotide; CTG chr11 5179490 5179511 5179495 5179490 -
accttgtgatctacccgcctca

SEQ ID NO: 151471 - DNA, 22 bp, Artificial Sequence
  Synthetic oligonucleotide; CTT chr11 5179485 5179506 5179490 5179485 -
gtgatctacccgcctcagcctc

SEQ ID NO: 151472 - DNA, 22 bp, Artificial Sequence
  Synthetic oligonucleotide; TTG chr11 5179484 5179505 5179489 5179484 -
tgatctacccgcctcagcctct

SEQ ID NO: 151473 - DNA, 22 bp, Artificial Sequence
  Synthetic oligonucleotide; CTA chr11 5179477 5179498 5179482 5179477 -
cccgcctcagcctctcaaagtg

SEQ ID NO: 151474 - DNA, 22 bp, Artificial Sequence
  Synthetic oligonucleotide; CTC chr11 5179469 5179490 5179474 5179469 -
agcctctcaaagtgctgggatt

SEQ ID NO: 151475 - DNA, 22 bp, Artificial Sequence
  Synthetic oligonucleotide; CTC chr11 5179463 5179484 5179468 5179463 -
tcaaagtgctgggattacaggt

SEQ ID NO: 151476 - DNA, 22 bp, Artificial Sequence
  Synthetic oligonucleotide; CTC chr11 5179461 5179482 5179466 5179461 -
aaagtgctgggattacaggtgt

SEQ ID NO: 151477 - DNA, 22 bp, Artificial Sequence
  Synthetic oligonucleotide; CTG chr11 5179452 5179473 5179457 5179452 -
ggattacaggtgtgagccaccg

SEQ ID NO: 151478 - DNA, 22 bp, Artificial Sequence
  Synthetic oligonucleotide; TTA chr11 5179446 5179467 5179451 5179446 -
caggtgtgagccaccgtgccag

SEQ ID NO: 151479 - DNA, 22 bp, Artificial Sequence
  Synthetic oligonucleotide; CTG chr11 5179420 5179441 5179425 5179420 -
gcatatagatttaaaaacccag

SEQ ID NO: 151480 - DNA, 22 bp, Artificial Sequence
  Synthetic oligonucleotide; TTT chr11 5179408 5179429 5179413 5179408 -
aaaaacccagctccgtctgcca

SEQ ID NO: 151481 - DNA, 22 bp, Artificial Sequence
  Synthetic oligonucleotide; TTA chr11 5179407 5179428 5179412 5179407 -
aaaacccagctccgtctgccat

SEQ ID NO: 151482 - DNA, 22 bp, Artificial Sequence
  Synthetic oligonucleotide; CTC chr11 5179395 5179416 5179400 5179395 -
cgtctgccattgcaaatatcta

SEQ ID NO: 151483 - DNA, 22 bp, Artificial Sequence
  Synthetic oligonucleotide; CTG chr11 5179389 5179410 5179394 5179389 -
ccattgcaaatatctaaagttt

SEQ ID NO: 151484 - DNA, 22 bp, Artificial Sequence
  Synthetic oligonucleotide; TTG chr11 5179383 5179404 5179388 5179383 -
caaatatctaaagtttataatg

SEQ ID NO: 151485 - DNA, 22 bp, Artificial Sequence
  Synthetic oligonucleotide; CTA chr11 5179373 5179394 5179378 5179373 -
aagtttataatgttttatccta

SEQ ID NO: 151486 - DNA, 22 bp, Artificial Sequence
  Synthetic oligonucleotide; TTT chr11 5179367 5179388 5179372 5179367 -
ataatgttttatcctatatttt

SEQ ID NO: 151487 - DNA, 22 bp, Artificial Sequence
  Synthetic oligonucleotide; TTA chr11 5179366 5179387 5179371 5179366 -
taatgttttatcctatattttt

SEQ ID NO: 151488 - DNA, 22 bp, Artificial Sequence
  Synthetic oligonucleotide; TTT chr11 5179358 5179379 5179363 5179358 -
tatcctatatttttgagaaata

SEQ ID NO: 151489 - DNA, 22 bp, Artificial Sequence
  Synthetic oligonucleotide; TTT chr11 5179357 5179378 5179362 5179357 -
atcctatatttttgagaaatag

SEQ ID NO: 151490 - DNA, 22 bp, Artificial Sequence
  Synthetic oligonucleotide; TTA chr11 5179356 5179377 5179361 5179356 -
tcctatatttttgagaaataga

SEQ ID NO: 151491 - DNA, 22 bp, Artificial Sequence
  Synthetic oligonucleotide; CTA chr11 5179351 5179372 5179356 5179351 -
tatttttgagaaatagattaat

SEQ ID NO: 151492 - DNA, 22 bp, Artificial Sequence
  Synthetic oligonucleotide; TTT chr11 5179346 5179367 5179351 5179346 -
ttgagaaatagattaattggca

SEQ ID NO: 151493 - DNA, 22 bp, Artificial Sequence
  Synthetic oligonucleotide; TTT chr11 5179345 5179366 5179350 5179345 -
tgagaaatagattaattggcag

SEQ ID NO: 151494 - DNA, 22 bp, Artificial Sequence
  Synthetic oligonucleotide; TTT chr11 5179344 5179365 5179349 5179344 -
gagaaatagattaattggcaga

SEQ ID NO: 151495 - DNA, 22 bp, Artificial Sequence
  Synthetic oligonucleotide; TTG chr11 5179343 5179364 5179348 5179343 -
agaaatagattaattggcagaa

SEQ ID NO: 151496 - DNA, 22 bp, Artificial Sequence
  Synthetic oligonucleotide; TTA chr11 5179331 5179352 5179336 5179331 -
attggcagaacaatttaatttg

SEQ ID NO: 151497 - DNA, 22 bp, Artificial Sequence
  Synthetic oligonucleotide; TTG chr11 5179327 5179348 5179332 5179327 -
gcagaacaatttaatttgctgt

SEQ ID NO: 151498 - DNA, 22 bp, Artificial Sequence
  Synthetic oligonucleotide; TTT chr11 5179315 5179336 5179320 5179315 -
aatttgctgtatgtcttcaatg

SEQ ID NO: 151499 - DNA, 22 bp, Artificial Sequence
  Synthetic oligonucleotide; TTA chr11 5179314 5179335 5179319 5179314 -
atttgctgtatgtcttcaatgg

SEQ ID NO: 151500 - DNA, 22 bp, Artificial Sequence
  Synthetic oligonucleotide; TTT chr11 5179310 5179331 5179315 5179310 -
gctgtatgtcttcaatggctag

SEQ ID NO: 151501 - DNA, 22 bp, Artificial Sequence
  Synthetic oligonucleotide; TTG chr11 5179309 5179330 5179314 5179309 -
ctgtatgtcttcaatggctagc

SEQ ID NO: 151502 - DNA, 22 bp, Artificial Sequence
  Synthetic oligonucleotide; CTG chr11 5179306 5179327 5179311 5179306 -
tatgtcttcaatggctagcata

SEQ ID NO: 151503 - DNA, 22 bp, Artificial Sequence
  Synthetic oligonucleotide; CTT chr11 5179298 5179319 5179303 5179298 -
caatggctagcatatggcttaa

SEQ ID NO: 151504 - DNA, 22 bp, Artificial Sequence
  Synthetic oligonucleotide; TTC chr11 5179297 5179318 5179302 5179297 -
aatggctagcatatggcttaac

SEQ ID NO: 151505 - DNA, 22 bp, Artificial Sequence
  Synthetic oligonucleotide; CTA chr11 5179289 5179310 5179294 5179289 -
gcatatggcttaacaataagtt

SEQ ID NO: 151506 - DNA, 22 bp, Artificial Sequence
  Synthetic oligonucleotide; CTT chr11 5179278 5179299 5179283 5179278 -
aacaataagttaaggccaatca

SEQ ID NO: 151507 - DNA, 22 bp, Artificial Sequence
  Synthetic oligonucleotide; TTA chr11 5179277 5179298 5179282 5179277 -
acaataagttaaggccaatcaa

SEQ ID NO: 151508 - DNA, 22 bp, Artificial Sequence
  Synthetic oligonucleotide; TTA chr11 5179266 5179287 5179271 5179266 -
aggccaatcaatgtggaagaag

SEQ ID NO: 151509 - DNA, 22 bp, Artificial Sequence
  Synthetic oligonucleotide; CTA chr11 5179232 5179253 5179237 5179232 -
tattgcttgaaatctattttgt

SEQ ID NO: 151510 - DNA, 22 bp, Artificial Sequence
  Synthetic oligonucleotide; TTG chr11 5179227 5179248 5179232 5179227 -
cttgaaatctattttgtcagac

SEQ ID NO: 151511 - DNA, 22 bp, Artificial Sequence
  Synthetic oligonucleotide; CTT chr11 5179224 5179245 5179229 5179224 -
gaaatctattttgtcagactta

SEQ ID NO: 151512 - DNA, 22 bp, Artificial Sequence
  Synthetic oligonucleotide; TTG chr11 5179223 5179244 5179228 5179223 -
aaatctattttgtcagacttaa

SEQ ID NO: 151513 - DNA, 22 bp, Artificial Sequence
  Synthetic oligonucleotide; CTA chr11 5179216 5179237 5179221 5179216 -
ttttgtcagacttaattccctc

SEQ ID NO: 151514 - DNA, 22 bp, Artificial Sequence
  Synthetic oligonucleotide; TTT chr11 5179213 5179234 5179218 5179213 -
tgtcagacttaattccctccca

SEQ ID NO: 151515 - DNA, 22 bp, Artificial Sequence
  Synthetic oligonucleotide; TTT chr11 5179212 5179233 5179217 5179212 -
gtcagacttaattccctcccat

SEQ ID NO: 151516 - DNA, 22 bp, Artificial Sequence
  Synthetic oligonucleotide; TTG chr11 5179211 5179232 5179216 5179211 -
tcagacttaattccctcccatt

SEQ ID NO: 151517 - DNA, 22 bp, Artificial Sequence
  Synthetic oligonucleotide; CTT chr11 5179203 5179224 5179208 5179203 -
aattccctcccatttctgtaag

SEQ ID NO: 151518 - DNA, 22 bp, Artificial Sequence
  Synthetic oligonucleotide; TTA chr11 5179202 5179223 5179207 5179202 -
attccctcccatttctgtaagc

SEQ ID NO: 151519 - DNA, 22 bp, Artificial Sequence
  Synthetic oligonucleotide; TTC chr11 5179198 5179219 5179203 5179198 -
cctcccatttctgtaagcagca

SEQ ID NO: 151520 - DNA, 22 bp, Artificial Sequence
  Synthetic oligonucleotide; CTC chr11 5179194 5179215 5179199 5179194 -
ccatttctgtaagcagcacaac

SEQ ID NO: 151521 - DNA, 22 bp, Artificial Sequence
  Synthetic oligonucleotide; TTT chr11 5179188 5179209 5179193 5179188 -
ctgtaagcagcacaactaaatt

SEQ ID NO: 151522 - DNA, 22 bp, Artificial Sequence
  Synthetic oligonucleotide; TTC chr11 5179187 5179208 5179192 5179187 -
tgtaagcagcacaactaaattt

SEQ ID NO: 151523 - DNA, 22 bp, Artificial Sequence
  Synthetic oligonucleotide; CTG chr11 5179185 5179206 5179190 5179185 -
taagcagcacaactaaatttca

SEQ ID NO: 151524 - DNA, 22 bp, Artificial Sequence
  Synthetic oligonucleotide; CTA chr11 5179170 5179191 5179175 5179170 -
aatttcataactctctattttc

SEQ ID NO: 151525 - DNA, 22 bp, Artificial Sequence
  Synthetic oligonucleotide; TTT chr11 5179165 5179186 5179170 5179165 -
cataactctctattttccttag

SEQ ID NO: 151526 - DNA, 22 bp, Artificial Sequence
  Synthetic oligonucleotide; TTC chr11 5179164 5179185 5179169 5179164 -
ataactctctattttccttagg

SEQ ID NO: 151527 - DNA, 22 bp, Artificial Sequence
  Synthetic oligonucleotide; CTC chr11 5179157 5179178 5179162 5179157 -
tctattttccttagggatatga

SEQ ID NO: 151528 - DNA, 22 bp, Artificial Sequence
  Synthetic oligonucleotide; CTC chr11 5179155 5179176 5179160 5179155 -
tattttccttagggatatgatc

SEQ ID NO: 151529 - DNA, 22 bp, Artificial Sequence
  Synthetic oligonucleotide; CTA chr11 5179153 5179174 5179158 5179153 -
ttttccttagggatatgatcag

SEQ ID NO: 151530 - DNA, 22 bp, Artificial Sequence
  Synthetic oligonucleotide; TTT chr11 5179150 5179171 5179155 5179150 -
tccttagggatatgatcagtaa

SEQ ID NO: 151531 - DNA, 22 bp, Artificial Sequence
  Synthetic oligonucleotide; TTT chr11 5179149 5179170 5179154 5179149 -
ccttagggatatgatcagtaaa

SEQ ID NO: 151532 - DNA, 22 bp, Artificial Sequence
  Synthetic oligonucleotide; TTC chr11 5179148 5179169 5179153 5179148 -
cttagggatatgatcagtaaaa

SEQ ID NO: 151533 - DNA, 22 bp, Artificial Sequence
  Synthetic oligonucleotide; CTT chr11 5179145 5179166 5179150 5179145 -
agggatatgatcagtaaaaaat

SEQ ID NO: 151534 - DNA, 22 bp, Artificial Sequence
  Synthetic oligonucleotide; TTA chr11 5179144 5179165 5179149 5179144 -
gggatatgatcagtaaaaaatt

SEQ ID NO: 151535 - DNA, 22 bp, Artificial Sequence
  Synthetic oligonucleotide; TTT chr11 5179121 5179142 5179126 5179121 -
gatgctgcgttttatatctagt

SEQ ID NO: 151536 - DNA, 22 bp, Artificial Sequence
  Synthetic oligonucleotide; TTG chr11 5179120 5179141 5179125 5179120 -
atgctgcgttttatatctagtt

SEQ ID NO: 151537 - DNA, 22 bp, Artificial Sequence
  Synthetic oligonucleotide; CTG chr11 5179114 5179135 5179119 5179114 -
cgttttatatctagttttacct

SEQ ID NO: 151538 - DNA, 22 bp, Artificial Sequence
  Synthetic oligonucleotide; TTT chr11 5179109 5179130 5179114 5179109 -
tatatctagttttaccttgata

SEQ ID NO: 151539 - DNA, 22 bp, Artificial Sequence
  Synthetic oligonucleotide; TTT chr11 5179108 5179129 5179113 5179108 -
atatctagttttaccttgatag

SEQ ID NO: 151540 - DNA, 22 bp, Artificial Sequence
  Synthetic oligonucleotide; TTA chr11 5179107 5179128 5179112 5179107 -
tatctagttttaccttgatagg

SEQ ID NO: 151541 - DNA, 22 bp, Artificial Sequence
  Synthetic oligonucleotide; CTA chr11 5179101 5179122 5179106 5179101 -
gttttaccttgataggcagcat

SEQ ID NO: 151542 - DNA, 22 bp, Artificial Sequence
  Synthetic oligonucleotide; TTT chr11 5179097 5179118 5179102 5179097 -
taccttgataggcagcattgga

SEQ ID NO: 151543 - DNA, 22 bp, Artificial Sequence
  Synthetic oligonucleotide; TTT chr11 5179096 5179117 5179101 5179096 -
accttgataggcagcattggat

SEQ ID NO: 151544 - DNA, 22 bp, Artificial Sequence
  Synthetic oligonucleotide; TTA chr11 5179095 5179116 5179100 5179095 -
ccttgataggcagcattggatg

SEQ ID NO: 151545 - DNA, 22 bp, Artificial Sequence
  Synthetic oligonucleotide; CTT chr11 5179091 5179112 5179096 5179091 -
gataggcagcattggatggtag

SEQ ID NO: 151546 - DNA, 22 bp, Artificial Sequence
  Synthetic oligonucleotide; TTG chr11 5179090 5179111 5179095 5179090 -
ataggcagcattggatggtagt

SEQ ID NO: 151547 - DNA, 22 bp, Artificial Sequence
  Synthetic oligonucleotide; TTG chr11 5179077 5179098 5179082 5179077 -
gatggtagtaaagatcaaagct

SEQ ID NO: 151548 - DNA, 22 bp, Artificial Sequence
  Synthetic oligonucleotide; CTT chr11 5179054 5179075 5179059 5179054 -
tcagatttatcctgccttactt

SEQ ID NO: 151549 - DNA, 22 bp, Artificial Sequence
  Synthetic oligonucleotide; TTT chr11 5179053 5179074 5179058 5179053 -
cagatttatcctgccttacttt

SEQ ID NO: 151550 - DNA, 22 bp, Artificial Sequence
  Synthetic oligonucleotide; TTC chr11 5179052 5179073 5179057 5179052 -
agatttatcctgccttacttta

SEQ ID NO: 151551 - DNA, 22 bp, Artificial Sequence
  Synthetic oligonucleotide; TTT chr11 5179046 5179067 5179051 5179046 -
atcctgccttactttaaatcca

SEQ ID NO: 151552 - DNA, 22 bp, Artificial Sequence
  Synthetic oligonucleotide; TTA chr11 5179045 5179066 5179050 5179045 -
tcctgccttactttaaatccag

SEQ ID NO: 151553 - DNA, 22 bp, Artificial Sequence
  Synthetic oligonucleotide; CTG chr11 5179040 5179061 5179045 5179040 -
ccttactttaaatccagtaggg

SEQ ID NO: 151554 - DNA, 22 bp, Artificial Sequence
  Synthetic oligonucleotide; CTT chr11 5179036 5179057 5179041 5179036 -
actttaaatccagtagggccta

SEQ ID NO: 151555 - DNA, 22 bp, Artificial Sequence
  Synthetic oligonucleotide; TTA chr11 5179035 5179056 5179040 5179035 -
ctttaaatccagtagggcctag

SEQ ID NO: 151556 - DNA, 22 bp, Artificial Sequence
  Synthetic oligonucleotide; CTT chr11 5179032 5179053 5179037 5179032 -
taaatccagtagggcctagggt

SEQ ID NO: 151557 - DNA, 22 bp, Artificial Sequence
  Synthetic oligonucleotide; TTT chr11 5179031 5179052 5179036 5179031 -
aaatccagtagggcctagggta

SEQ ID NO: 151558 - DNA, 22 bp, Artificial Sequence
  Synthetic oligonucleotide; TTA chr11 5179030 5179051 5179035 5179030 -
aatccagtagggcctagggtaa

SEQ ID NO: 151559 - DNA, 22 bp, Artificial Sequence
  Synthetic oligonucleotide; CTA chr11 5179014 5179035 5179019 5179014 -
gggtaagaggctgaaagtctgt

SEQ ID NO: 151560 - DNA, 22 bp, Artificial Sequence
  Synthetic oligonucleotide; CTG chr11 5179001 5179022 5179006 5179001 -
aaagtctgtgggttttttttac

SEQ ID NO: 151561 - DNA, 22 bp, Artificial Sequence
  Synthetic oligonucleotide; CTG chr11 5178993 5179014 5178998 5178993 -
tgggttttttttacatctgtag

SEQ ID NO: 151562 - DNA, 22 bp, Artificial Sequence
  Synthetic oligonucleotide; TTT chr11 5178986 5179007 5178991 5178986 -
tttttacatctgtagaaataat

SEQ ID NO: 151563 - DNA, 22 bp, Artificial Sequence
  Synthetic oligonucleotide; TTT chr11 5178985 5179006 5178990 5178985 -
ttttacatctgtagaaataata

SEQ ID NO: 151564 - DNA, 22 bp, Artificial Sequence
  Synthetic oligonucleotide; TTT chr11 5178984 5179005 5178989 5178984 -
tttacatctgtagaaataatag

SEQ ID NO: 151565 - DNA, 22 bp, Artificial Sequence
  Synthetic oligonucleotide; TTT chr11 5178983 5179004 5178988 5178983 -
ttacatctgtagaaataatagt

SEQ ID NO: 151566 - DNA, 22 bp, Artificial Sequence
  Synthetic oligonucleotide; TTT chr11 5178982 5179003 5178987 5178982 -
tacatctgtagaaataatagta

SEQ ID NO: 151567 - DNA, 22 bp, Artificial Sequence
  Synthetic oligonucleotide; TTT chr11 5178981 5179002 5178986 5178981 -
acatctgtagaaataatagtat

SEQ ID NO: 151568 - DNA, 22 bp, Artificial Sequence
  Synthetic oligonucleotide; TTA chr11 5178980 5179001 5178985 5178980 -
catctgtagaaataatagtatt

SEQ ID NO: 151569 - DNA, 22 bp, Artificial Sequence
  Synthetic oligonucleotide; CTG chr11 5178974 5178995 5178979 5178974 -
tagaaataatagtatttatata

SEQ ID NO: 151570 - DNA, 22 bp, Artificial Sequence
  Synthetic oligonucleotide; TTT chr11 5178957 5178978 5178962 5178957 -
atataatggttatttaaagggc

SEQ ID NO: 151571 - DNA, 22 bp, Artificial Sequence
  Synthetic oligonucleotide; TTA chr11 5178956 5178977 5178961 5178956 -
tataatggttatttaaagggct

SEQ ID NO: 151572 - DNA, 22 bp, Artificial Sequence
  Synthetic oligonucleotide; TTA chr11 5178945 5178966 5178950 5178945 -
tttaaagggcttttcaataggt

SEQ ID NO: 151573 - DNA, 22 bp, Artificial Sequence
  Synthetic oligonucleotide; TTT chr11 5178942 5178963 5178947 5178942 -
aaagggcttttcaataggttat

SEQ ID NO: 151574 - DNA, 22 bp, Artificial Sequence
  Synthetic oligonucleotide; TTA chr11 5178941 5178962 5178946 5178941 -
aagggcttttcaataggttatt

SEQ ID NO: 151575 - DNA, 22 bp, Artificial Sequence
  Synthetic oligonucleotide; CTT chr11 5178933 5178954 5178938 5178933 -
ttcaataggttattgtgaagat

SEQ ID NO: 151576 - DNA, 22 bp, Artificial Sequence
  Synthetic oligonucleotide; TTT chr11 5178932 5178953 5178937 5178932 -
tcaataggttattgtgaagatt

SEQ ID NO: 151577 - DNA, 22 bp, Artificial Sequence
  Synthetic oligonucleotide; TTT chr11 5178931 5178952 5178936 5178931 -
caataggttattgtgaagattt

SEQ ID NO: 151578 - DNA, 22 bp, Artificial Sequence
  Synthetic oligonucleotide; TTC chr11 5178930 5178951 5178935 5178930 -
aataggttattgtgaagattta

SEQ ID NO: 151579 - DNA, 22 bp, Artificial Sequence
  Synthetic oligonucleotide; TTA chr11 5178921 5178942 5178926 5178921 -
ttgtgaagatttaataagttaa

SEQ ID NO: 151580 - DNA, 22 bp, Artificial Sequence
  Synthetic oligonucleotide; TTG chr11 5178918 5178939 5178923 5178918 -
tgaagatttaataagttaatat

SEQ ID NO: 151581 - DNA, 22 bp, Artificial Sequence
  Synthetic oligonucleotide; TTT chr11 5178909 5178930 5178914 5178909 -
aataagttaatatttgtaaagt

SEQ ID NO: 151582 - DNA, 22 bp, Artificial Sequence
  Synthetic oligonucleotide; TTA chr11 5178908 5178929 5178913 5178908 -
ataagttaatatttgtaaagta

SEQ ID NO: 151583 - DNA, 22 bp, Artificial Sequence
  Synthetic oligonucleotide; TTA chr11 5178900 5178921 5178905 5178900 -
atatttgtaaagtagtatgaca

SEQ ID NO: 151584 - DNA, 22 bp, Artificial Sequence
  Synthetic oligonucleotide; TTT chr11 5178894 5178915 5178899 5178894 -
gtaaagtagtatgacacatatt

SEQ ID NO: 151585 - DNA, 22 bp, Artificial Sequence
  Synthetic oligonucleotide; TTG chr11 5178893 5178914 5178898 5178893 -
taaagtagtatgacacatatta

SEQ ID NO: 151586 - DNA, 22 bp, Artificial Sequence
  Synthetic oligonucleotide; TTA chr11 5178871 5178892 5178876 5178871 -
agcagttattaaataatatcta

SEQ ID NO: 151587 - DNA, 22 bp, Artificial Sequence
  Synthetic oligonucleotide; TTA chr11 5178863 5178884 5178868 5178863 -
ttaaataatatctactaatttt

SEQ ID NO: 151588 - DNA, 22 bp, Artificial Sequence
  Synthetic oligonucleotide; TTA chr11 5178860 5178881 5178865 5178860 -
aataatatctactaatttttta

SEQ ID NO: 151589 - DNA, 22 bp, Artificial Sequence
  Synthetic oligonucleotide; CTA chr11 5178849 5178870 5178854 5178849 -
ctaattttttaaggtacaaaaa

SEQ ID NO: 151590 - DNA, 22 bp, Artificial Sequence
  Synthetic oligonucleotide; CTA chr11 5178846 5178867 5178851 5178846 -
attttttaaggtacaaaaaatt

SEQ ID NO: 151591 - DNA, 22 bp, Artificial Sequence
  Synthetic oligonucleotide; TTT chr11 5178842 5178863 5178847 5178842 -
tttaaggtacaaaaaattaatt

SEQ ID NO: 151592 - DNA, 22 bp, Artificial Sequence
  Synthetic oligonucleotide; TTT chr11 5178841 5178862 5178846 5178841 -
ttaaggtacaaaaaattaatta

SEQ ID NO: 151593 - DNA, 22 bp, Artificial Sequence
  Synthetic oligonucleotide; TTT chr11 5178840 5178861 5178845 5178840 -
taaggtacaaaaaattaattat

SEQ ID NO: 151594 - DNA, 22 bp, Artificial Sequence
  Synthetic oligonucleotide; TTT chr11 5178839 5178860 5178844 5178839 -
aaggtacaaaaaattaattatt

SEQ ID NO: 151595 - DNA, 22 bp, Artificial Sequence
  Synthetic oligonucleotide; TTA chr11 5178838 5178859 5178843 5178838 -
aggtacaaaaaattaattattt

SEQ ID NO: 151596 - DNA, 22 bp, Artificial Sequence
  Synthetic oligonucleotide; TTA chr11 5178823 5178844 5178828 5178823 -
attatttggtaggacttatata

SEQ ID NO: 151597 - DNA, 22 bp, Artificial Sequence
  Synthetic oligonucleotide; TTA chr11 5178819 5178840 5178824 5178819 -
tttggtaggacttatatattcg

SEQ ID NO: 151598 - DNA, 22 bp, Artificial Sequence
  Synthetic oligonucleotide; TTT chr11 5178816 5178837 5178821 5178816 -
ggtaggacttatatattcggtc

SEQ ID NO: 151599 - DNA, 22 bp, Artificial Sequence
  Synthetic oligonucleotide; TTG chr11 5178815 5178836 5178820 5178815 -
gtaggacttatatattcggtct

SEQ ID NO: 151600 - DNA, 22 bp, Artificial Sequence
  Synthetic oligonucleotide; CTT chr11 5178806 5178827 5178811 5178806 -
atatattcggtctattaaccca

SEQ ID NO: 151601 - DNA, 22 bp, Artificial Sequence
  Synthetic oligonucleotide; TTA chr11 5178805 5178826 5178810 5178805 -
tatattcggtctattaacccat

SEQ ID NO: 151602 - DNA, 22 bp, Artificial Sequence
  Synthetic oligonucleotide; TTC chr11 5178798 5178819 5178803 5178798 -
ggtctattaacccattttactc

SEQ ID NO: 151603 - DNA, 22 bp, Artificial Sequence
  Synthetic oligonucleotide; CTA chr11 5178792 5178813 5178797 5178792 -
ttaacccattttactctccttt

SEQ ID NO: 151604 - DNA, 22 bp, Artificial Sequence
  Synthetic oligonucleotide; TTA chr11 5178789 5178810 5178794 5178789 -
acccattttactctcctttccc

SEQ ID NO: 151605 - DNA, 22 bp, Artificial Sequence
  Synthetic oligonucleotide; TTT chr11 5178781 5178802 5178786 5178781 -
tactctcctttcccagagaaga

SEQ ID NO: 151606 - DNA, 22 bp, Artificial Sequence
  Synthetic oligonucleotide; TTT chr11 5178780 5178801 5178785 5178780 -
actctcctttcccagagaagaa

SEQ ID NO: 151607 - DNA, 22 bp, Artificial Sequence
  Synthetic oligonucleotide; TTA chr11 5178779 5178800 5178784 5178779 -
ctctcctttcccagagaagaaa

SEQ ID NO: 151608 - DNA, 22 bp, Artificial Sequence
  Synthetic oligonucleotide; CTC chr11 5178776 5178797 5178781 5178776 -
tcctttcccagagaagaaaaca

SEQ ID NO: 151609 - DNA, 22 bp, Artificial Sequence
  Synthetic oligonucleotide; CTC chr11 5178774 5178795 5178779 5178774 -
ctttcccagagaagaaaacatt

SEQ ID NO: 151610 - DNA, 22 bp, Artificial Sequence
  Synthetic oligonucleotide; CTT chr11 5178771 5178792 5178776 5178771 -
tcccagagaagaaaacattgga

SEQ ID NO: 151611 - DNA, 22 bp, Artificial Sequence
  Synthetic oligonucleotide; TTT chr11 5178770 5178791 5178775 5178770 -
cccagagaagaaaacattggaa

SEQ ID NO: 151612 - DNA, 22 bp, Artificial Sequence
  Synthetic oligonucleotide; TTC chr11 5178769 5178790 5178774 5178769 -
ccagagaagaaaacattggaaa

SEQ ID NO: 151613 - DNA, 22 bp, Artificial Sequence
  Synthetic oligonucleotide; TTG chr11 5178751 5178772 5178756 5178751 -
gaaagaaaacaaatctgatgag

SEQ ID NO: 151614 - DNA, 22 bp, Artificial Sequence
  Synthetic oligonucleotide; CTG chr11 5178734 5178755 5178739 5178734 -
atgagacctcattcagcctaag

SEQ ID NO: 151615 - DNA, 22 bp, Artificial Sequence
  Synthetic oligonucleotide; CTC chr11 5178724 5178745 5178729 5178724 -
attcagcctaaggtagtgtttc

SEQ ID NO: 151616 - DNA, 22 bp, Artificial Sequence
  Synthetic oligonucleotide; TTC chr11 5178720 5178741 5178725 5178720 -
agcctaaggtagtgtttctaaa

SEQ ID NO: 151617 - DNA, 22 bp, Artificial Sequence
  Synthetic oligonucleotide; CTA chr11 5178714 5178735 5178719 5178714 -
aggtagtgtttctaaatcctca

SEQ ID NO: 151618 - DNA, 22 bp, Artificial Sequence
  Synthetic oligonucleotide; TTT chr11 5178703 5178724 5178708 5178703 -
ctaaatcctcaactttgtagtc

SEQ ID NO: 151619 - DNA, 22 bp, Artificial Sequence
  Synthetic oligonucleotide; TTC chr11 5178702 5178723 5178707 5178702 -
taaatcctcaactttgtagtct

SEQ ID NO: 151620 - DNA, 22 bp, Artificial Sequence
  Synthetic oligonucleotide; CTA chr11 5178700 5178721 5178705 5178700 -
aatcctcaactttgtagtcttt

SEQ ID NO: 151621 - DNA, 22 bp, Artificial Sequence
  Synthetic oligonucleotide; CTC chr11 5178693 5178714 5178698 5178693 -
aactttgtagtctttcactaat

SEQ ID NO: 151622 - DNA, 22 bp, Artificial Sequence
  Synthetic oligonucleotide; CTT chr11 5178688 5178709 5178693 5178688 -
tgtagtctttcactaatggcac

SEQ ID NO: 151623 - DNA, 22 bp, Artificial Sequence
  Synthetic oligonucleotide; TTT chr11 5178687 5178708 5178692 5178687 -
gtagtctttcactaatggcact

SEQ ID NO: 151624 - DNA, 22 bp, Artificial Sequence
  Synthetic oligonucleotide; TTG chr11 5178686 5178707 5178691 5178686 -
tagtctttcactaatggcacta

SEQ ID NO: 151625 - DNA, 22 bp, Artificial Sequence
  Synthetic oligonucleotide; CTT chr11 5178679 5178700 5178684 5178679 -
tcactaatggcactaggcctgg

SEQ ID NO: 151626 - DNA, 22 bp, Artificial Sequence
  Synthetic oligonucleotide; TTT chr11 5178678 5178699 5178683 5178678 -
cactaatggcactaggcctgga

SEQ ID NO: 151627 - DNA, 22 bp, Artificial Sequence
  Synthetic oligonucleotide; TTC chr11 5178677 5178698 5178682 5178677 -
actaatggcactaggcctggaa

SEQ ID NO: 151628 - DNA, 22 bp, Artificial Sequence
  Synthetic oligonucleotide; CTA chr11 5178673 5178694 5178678 5178673 -
atggcactaggcctggaataaa

SEQ ID NO: 151629 - DNA, 22 bp, Artificial Sequence
  Synthetic oligonucleotide; CTA chr11 5178664 5178685 5178669 5178664 -
ggcctggaataaactgtacata

SEQ ID NO: 151630 - DNA, 22 bp, Artificial Sequence
  Synthetic oligonucleotide; CTG chr11 5178658 5178679 5178663 5178658 -
gaataaactgtacatacggctc

SEQ ID NO: 151631 - DNA, 22 bp, Artificial Sequence
  Synthetic oligonucleotide; CTG chr11 5178648 5178669 5178653 5178648 -
tacatacggctcctttctttcg

SEQ ID NO: 151632 - DNA, 22 bp, Artificial Sequence
  Synthetic oligonucleotide; CTC chr11 5178636 5178657 5178641 5178636 -
ctttctttcgcaatcacactaa

SEQ ID NO: 151633 - DNA, 22 bp, Artificial Sequence
  Synthetic oligonucleotide; CTT chr11 5178633 5178654 5178638 5178633 -
tctttcgcaatcacactaattc

SEQ ID NO: 151634 - DNA, 22 bp, Artificial Sequence
  Synthetic oligonucleotide; TTT chr11 5178632 5178653 5178637 5178632 -
ctttcgcaatcacactaattcc

SEQ ID NO: 151635 - DNA, 22 bp, Artificial Sequence
  Synthetic oligonucleotide; TTC chr11 5178631 5178652 5178636 5178631 -
tttcgcaatcacactaattccc

SEQ ID NO: 151636 - DNA, 22 bp, Artificial Sequence
  Synthetic oligonucleotide; CTT chr11 5178629 5178650 5178634 5178629 -
tcgcaatcacactaattcccag

SEQ ID NO: 151637 - DNA, 22 bp, Artificial Sequence
  Synthetic oligonucleotide; TTT chr11 5178628 5178649 5178633 5178628 -
cgcaatcacactaattcccagg

SEQ ID NO: 151638 - DNA, 22 bp, Artificial Sequence
  Synthetic oligonucleotide; TTC chr11 5178627 5178648 5178632 5178627 -
gcaatcacactaattcccagga

SEQ ID NO: 151639 - DNA, 22 bp, Artificial Sequence
  Synthetic oligonucleotide; CTA chr11 5178615 5178636 5178620 5178615 -
attcccaggatgtgtggtatgt

SEQ ID NO: 151640 - DNA, 22 bp, Artificial Sequence
  Synthetic oligonucleotide; TTC chr11 5178611 5178632 5178616 5178611 -
ccaggatgtgtggtatgtcctg

SEQ ID NO: 151641 - DNA, 22 bp, Artificial Sequence
  Synthetic oligonucleotide; CTG chr11 5178589 5178610 5178594 5178589 -
atgggaatcccagggctggaag

SEQ ID NO: 151642 - DNA, 22 bp, Artificial Sequence
  Synthetic oligonucleotide; CTG chr11 5178571 5178592 5178576 5178571 -
gaaggcttgcatacctggatct

SEQ ID NO: 151643 - DNA, 22 bp, Artificial Sequence
  Synthetic oligonucleotide; CTT chr11 5178563 5178584 5178568 5178563 -
gcatacctggatctccatccct

SEQ ID NO: 151644 - DNA, 22 bp, Artificial Sequence
  Synthetic oligonucleotide; TTG chr11 5178562 5178583 5178567 5178562 -
catacctggatctccatccctt

SEQ ID NO: 151645 - DNA, 22 bp, Artificial Sequence
  Synthetic oligonucleotide; CTG chr11 5178554 5178575 5178559 5178554 -
gatctccatccctttttctttt

SEQ ID NO: 151646 - DNA, 22 bp, Artificial Sequence
  Synthetic oligonucleotide; CTC chr11 5178548 5178569 5178553 5178548 -
catccctttttcttttatgtac

SEQ ID NO: 151647 - DNA, 22 bp, Artificial Sequence
  Synthetic oligonucleotide; CTT chr11 5178540 5178561 5178545 5178540 -
tttcttttatgtacattgtggc

SEQ ID NO: 151648 - DNA, 22 bp, Artificial Sequence
  Synthetic oligonucleotide; TTT chr11 5178539 5178560 5178544 5178539 -
ttcttttatgtacattgtggct

SEQ ID NO: 151649 - DNA, 22 bp, Artificial Sequence
  Synthetic oligonucleotide; TTT chr11 5178538 5178559 5178543 5178538 -
tcttttatgtacattgtggctg

SEQ ID NO: 151650 - DNA, 22 bp, Artificial Sequence
  Synthetic oligonucleotide; TTT chr11 5178537 5178558 5178542 5178537 -
cttttatgtacattgtggctgt

SEQ ID NO: 151651 - DNA, 22 bp, Artificial Sequence
  Synthetic oligonucleotide; TTC chr11 5178536 5178557 5178541 5178536 -
ttttatgtacattgtggctgtt

SEQ ID NO: 151652 - DNA, 22 bp, Artificial Sequence
  Synthetic oligonucleotide; CTT chr11 5178534 5178555 5178539 5178534 -
ttatgtacattgtggctgttgc

SEQ ID NO: 151653 - DNA, 22 bp, Artificial Sequence
  Synthetic oligonucleotide; TTT chr11 5178533 5178554 5178538 5178533 -
tatgtacattgtggctgttgca

SEQ ID NO: 151654 - DNA, 22 bp, Artificial Sequence
  Synthetic oligonucleotide; TTT chr11 5178532 5178553 5178537 5178532 -
atgtacattgtggctgttgcag

SEQ ID NO: 151655 - DNA, 22 bp, Artificial Sequence
  Synthetic oligonucleotide; TTA chr11 5178531 5178552 5178536 5178531 -
tgtacattgtggctgttgcagg

SEQ ID NO: 151656 - DNA, 22 bp, Artificial Sequence
  Synthetic oligonucleotide; TTG chr11 5178522 5178543 5178527 5178522 -
tggctgttgcaggcaatatctt

SEQ ID NO: 151657 - DNA, 22 bp, Artificial Sequence
  Synthetic oligonucleotide; CTG chr11 5178516 5178537 5178521 5178516 -
ttgcaggcaatatcttcttgat

SEQ ID NO: 151658 - DNA, 22 bp, Artificial Sequence
  Synthetic oligonucleotide; TTG chr11 5178513 5178534 5178518 5178513 -
caggcaatatcttcttgatctt

SEQ ID NO: 151659 - DNA, 22 bp, Artificial Sequence
  Synthetic oligonucleotide; CTT chr11 5178500 5178521 5178505 5178500 -
cttgatcttcctgatcatgact

SEQ ID NO: 151660 - DNA, 22 bp, Artificial Sequence
  Synthetic oligonucleotide; TTC chr11 5178499 5178520 5178504 5178499 -
ttgatcttcctgatcatgactg

SEQ ID NO: 151661 - DNA, 22 bp, Artificial Sequence
  Synthetic oligonucleotide; CTT chr11 5178497 5178518 5178502 5178497 -
gatcttcctgatcatgactgag

SEQ ID NO: 151662 - DNA, 22 bp, Artificial Sequence
  Synthetic oligonucleotide; TTG chr11 5178496 5178517 5178501 5178496 -
atcttcctgatcatgactgagc

SEQ ID NO: 151663 - DNA, 22 bp, Artificial Sequence
  Synthetic oligonucleotide; CTT chr11 5178491 5178512 5178496 5178491 -
cctgatcatgactgagcgcagt

SEQ ID NO: 151664 - DNA, 22 bp, Artificial Sequence
  Synthetic oligonucleotide; TTC chr11 5178490 5178511 5178495 5178490 -
ctgatcatgactgagcgcagtc

SEQ ID NO: 151665 - DNA, 22 bp, Artificial Sequence
  Synthetic oligonucleotide; CTG chr11 5178487 5178508 5178492 5178487 -
atcatgactgagcgcagtctcc

SEQ ID NO: 151666 - DNA, 22 bp, Artificial Sequence
  Synthetic oligonucleotide; CTG chr11 5178477 5178498 5178482 5178477 -
agcgcagtctccatgagcccat

SEQ ID NO: 151667 - DNA, 22 bp, Artificial Sequence
  Synthetic oligonucleotide; CTC chr11 5178466 5178487 5178471 5178466 -
catgagcccatgtatctcttcc

SEQ ID NO: 151668 - DNA, 22 bp, Artificial Sequence
  Synthetic oligonucleotide; CTC chr11 5178448 5178469 5178453 5178448 -
ttcctatccatgctggcctcag

SEQ ID NO: 151669 - DNA, 22 bp, Artificial Sequence
  Synthetic oligonucleotide; CTT chr11 5178446 5178467 5178451 5178446 -
cctatccatgctggcctcagcc

SEQ ID NO: 151670 - DNA, 22 bp, Artificial Sequence
  Synthetic oligonucleotide; TTC chr11 5178445 5178466 5178450 5178445 -
ctatccatgctggcctcagccg

SEQ ID NO: 151671 - DNA, 22 bp, Artificial Sequence
  Synthetic oligonucleotide; CTA chr11 5178442 5178463 5178447 5178442 -
tccatgctggcctcagccgact

SEQ ID NO: 151672 - DNA, 22 bp, Artificial Sequence
  Synthetic oligonucleotide; CTG chr11 5178433 5178454 5178438 5178433 -
gcctcagccgacttcctgctcg

SEQ ID NO: 151673 - DNA, 22 bp, Artificial Sequence
  Synthetic oligonucleotide; CTC chr11 5178428 5178449 5178433 5178428 -
agccgacttcctgctcgccact

SEQ ID NO: 151674 - DNA, 22 bp, Artificial Sequence
  Synthetic oligonucleotide; CTT chr11 5178419 5178440 5178424 5178419 -
cctgctcgccactgctgcagcc

SEQ ID NO: 151675 - DNA, 22 bp, Artificial Sequence
  Synthetic oligonucleotide; TTC chr11 5178418 5178439 5178423 5178418 -
ctgctcgccactgctgcagccc

SEQ ID NO: 151676 - DNA, 22 bp, Artificial Sequence
  Synthetic oligonucleotide; CTG chr11 5178415 5178436 5178420 5178415 -
ctcgccactgctgcagccccta

SEQ ID NO: 151677 - DNA, 22 bp, Artificial Sequence
  Synthetic oligonucleotide; CTC chr11 5178412 5178433 5178417 5178412 -
gccactgctgcagcccctaagg

SEQ ID NO: 151678 - DNA, 22 bp, Artificial Sequence
  Synthetic oligonucleotide; CTG chr11 5178405 5178426 5178410 5178405 -
ctgcagcccctaaggtgctggc

SEQ ID NO: 151679 - DNA, 22 bp, Artificial Sequence
  Synthetic oligonucleotide; CTG chr11 5178402 5178423 5178407 5178402 -
cagcccctaaggtgctggctat

SEQ ID NO: 151680 - DNA, 22 bp, Artificial Sequence
  Synthetic oligonucleotide; CTA chr11 5178393 5178414 5178398 5178393 -
aggtgctggctatcctctggtt

SEQ ID NO: 151681 - DNA, 22 bp, Artificial Sequence
  Synthetic oligonucleotide; CTG chr11 5178385 5178406 5178390 5178385 -
gctatcctctggttccactcca

SEQ ID NO: 151682 - DNA, 22 bp, Artificial Sequence
  Synthetic oligonucleotide; CTA chr11 5178381 5178402 5178386 5178381 -
tcctctggttccactccatgga

SEQ ID NO: 151683 - DNA, 22 bp, Artificial Sequence
  Synthetic oligonucleotide; CTC chr11 5178376 5178397 5178381 5178376 -
tggttccactccatggacatat

SEQ ID NO: 151684 - DNA, 22 bp, Artificial Sequence
  Synthetic oligonucleotide; CTG chr11 5178374 5178395 5178379 5178374 -
gttccactccatggacatatcc

SEQ ID NO: 151685 - DNA, 22 bp, Artificial Sequence
  Synthetic oligonucleotide; TTC chr11 5178370 5178391 5178375 5178370 -
cactccatggacatatcctttg

SEQ ID NO: 151686 - DNA, 22 bp, Artificial Sequence
  Synthetic oligonucleotide; CTC chr11 5178365 5178386 5178370 5178365 -
catggacatatcctttggtagt

SEQ ID NO: 151687 - DNA, 22 bp, Artificial Sequence
  Synthetic oligonucleotide; CTT chr11 5178350 5178371 5178355 5178350 -
tggtagttgtgtgtctcagatg

SEQ ID NO: 151688 - DNA, 22 bp, Artificial Sequence
  Synthetic oligonucleotide; TTT chr11 5178349 5178370 5178354 5178349 -
ggtagttgtgtgtctcagatgt

SEQ ID NO: 151689 - DNA, 22 bp, Artificial Sequence
  Synthetic oligonucleotide; TTG chr11 5178348 5178369 5178353 5178348 -
gtagttgtgtgtctcagatgtt

SEQ ID NO: 151690 - DNA, 22 bp, Artificial Sequence
  Synthetic oligonucleotide; TTG chr11 5178341 5178362 5178346 5178341 -
tgtgtctcagatgttcttcata

SEQ ID NO: 151691 - DNA, 22 bp, Artificial Sequence
  Synthetic oligonucleotide; CTC chr11 5178333 5178354 5178338 5178333 -
agatgttcttcatacatttcat

SEQ ID NO: 151692 - DNA, 22 bp, Artificial Sequence
  Synthetic oligonucleotide; TTC chr11 5178325 5178346 5178330 5178325 -
ttcatacatttcatctttgtgg

SEQ ID NO: 151693 - DNA, 22 bp, Artificial Sequence
  Synthetic oligonucleotide; CTT chr11 5178323 5178344 5178328 5178323 -
catacatttcatctttgtggca

SEQ ID NO: 151694 - DNA, 22 bp, Artificial Sequence
  Synthetic oligonucleotide; TTC chr11 5178322 5178343 5178327 5178322 -
atacatttcatctttgtggcag

SEQ ID NO: 151695 - DNA, 22 bp, Artificial Sequence
  Synthetic oligonucleotide; TTT chr11 5178314 5178335 5178319 5178314 -
catctttgtggcagaatctgct

SEQ ID NO: 151696 - DNA, 22 bp, Artificial Sequence
  Synthetic oligonucleotide; TTC chr11 5178313 5178334 5178318 5178313 -
atctttgtggcagaatctgcta

SEQ ID NO: 151697 - DNA, 22 bp, Artificial Sequence
  Synthetic oligonucleotide; CTT chr11 5178308 5178329 5178313 5178308 -
tgtggcagaatctgctattctc

SEQ ID NO: 151698 - DNA, 22 bp, Artificial Sequence
  Synthetic oligonucleotide; TTT chr11 5178307 5178328 5178312 5178307 -
gtggcagaatctgctattctcc

SEQ ID NO: 151699 - DNA, 22 bp, Artificial Sequence
  Synthetic oligonucleotide; TTG chr11 5178306 5178327 5178311 5178306 -
tggcagaatctgctattctcct

SEQ ID NO: 151700 - DNA, 22 bp, Artificial Sequence
  Synthetic oligonucleotide; CTG chr11 5178294 5178315 5178299 5178294 -
ctattctcctggcaatggcatt

SEQ ID NO: 151701 - DNA, 22 bp, Artificial Sequence
  Synthetic oligonucleotide; CTA chr11 5178291 5178312 5178296 5178291 -
ttctcctggcaatggcatttga

SEQ ID NO: 151702 - DNA, 22 bp, Artificial Sequence
  Synthetic oligonucleotide; TTC chr11 5178288 5178309 5178293 5178288 -
tcctggcaatggcatttgaccg

SEQ ID NO: 151703 - DNA, 22 bp, Artificial Sequence
  Synthetic oligonucleotide; CTC chr11 5178286 5178307 5178291 5178286 -
ctggcaatggcatttgaccgct

SEQ ID NO: 151704 - DNA, 22 bp, Artificial Sequence
  Synthetic oligonucleotide; CTG chr11 5178283 5178304 5178288 5178283 -
gcaatggcatttgaccgctatg

SEQ ID NO: 151705 - DNA, 22 bp, Artificial Sequence
  Synthetic oligonucleotide; TTT chr11 5178271 5178292 5178276 5178271 -
gaccgctatgtggccatctgtt

SEQ ID NO: 151706 - DNA, 22 bp, Artificial Sequence
  Synthetic oligonucleotide; TTG chr11 5178270 5178291 5178275 5178270 -
accgctatgtggccatctgtta

SEQ ID NO: 151707 - DNA, 22 bp, Artificial Sequence
  Synthetic oligonucleotide; CTA chr11 5178263 5178284 5178268 5178263 -
tgtggccatctgttacccactg

SEQ ID NO: 151708 - DNA, 22 bp, Artificial Sequence
  Synthetic oligonucleotide; CTG chr11 5178251 5178272 5178256 5178251 -
ttacccactgagatacaccatt

SEQ ID NO: 151709 - DNA, 22 bp, Artificial Sequence
  Synthetic oligonucleotide; TTA chr11 5178248 5178269 5178253 5178248 -
cccactgagatacaccatttta

SEQ ID NO: 151710 - DNA, 22 bp, Artificial Sequence
  Synthetic oligonucleotide; CTG chr11 5178241 5178262 5178246 5178241 -
agatacaccattttaacctcat

SEQ ID NO: 151711 - DNA, 22 bp, Artificial Sequence
  Synthetic oligonucleotide; TTT chr11 5178228 5178249 5178233 5178228 -
taacctcatcagccgtcaggaa

SEQ ID NO: 151712 - DNA, 22 bp, Artificial Sequence
  Synthetic oligonucleotide; TTT chr11 5178227 5178248 5178232 5178227 -
aacctcatcagccgtcaggaag

SEQ ID NO: 151713 - DNA, 22 bp, Artificial Sequence
  Synthetic oligonucleotide; TTA chr11 5178226 5178247 5178231 5178226 -
acctcatcagccgtcaggaaga

SEQ ID NO: 151714 - DNA, 22 bp, Artificial Sequence
  Synthetic oligonucleotide; CTC chr11 5178221 5178242 5178226 5178221 -
atcagccgtcaggaagattggc

SEQ ID NO: 151715 - DNA, 22 bp, Artificial Sequence
  Synthetic oligonucleotide; TTG chr11 5178201 5178222 5178206 5178201 -
gcatagcagctgtggtcaggag

SEQ ID NO: 151716 - DNA, 22 bp, Artificial Sequence
  Synthetic oligonucleotide; CTG chr11 5178189 5178210 5178194 5178189 -
tggtcaggagctttttcatctg

SEQ ID NO: 151717 - DNA, 22 bp, Artificial Sequence
  Synthetic oligonucleotide; CTT chr11 5178176 5178197 5178181 5178176 -
tttcatctgctgtccgttcatc

SEQ ID NO: 151718 - DNA, 22 bp, Artificial Sequence
  Synthetic oligonucleotide; TTT chr11 5178175 5178196 5178180 5178175 -
ttcatctgctgtccgttcatct

SEQ ID NO: 151719 - DNA, 22 bp, Artificial Sequence
  Synthetic oligonucleotide; TTT chr11 5178174 5178195 5178179 5178174 -
tcatctgctgtccgttcatctt

SEQ ID NO: 151720 - DNA, 22 bp, Artificial Sequence
  Synthetic oligonucleotide; TTT chr11 5178173 5178194 5178178 5178173 -
catctgctgtccgttcatcttc

SEQ ID NO: 151721 - DNA, 22 bp, Artificial Sequence
  Synthetic oligonucleotide; TTC chr11 5178172 5178193 5178177 5178172 -
atctgctgtccgttcatcttcc

SEQ ID NO: 151722 - DNA, 22 bp, Artificial Sequence
  Synthetic oligonucleotide; CTG chr11 5178167 5178188 5178172 5178167 -
ctgtccgttcatcttcctggta

SEQ ID NO: 151723 - DNA, 22 bp, Artificial Sequence
  Synthetic oligonucleotide; CTG chr11 5178164 5178185 5178169 5178164 -
tccgttcatcttcctggtatac

SEQ ID NO: 151724 - DNA, 22 bp, Artificial Sequence
  Synthetic oligonucleotide; TTC chr11 5178157 5178178 5178162 5178157 -
atcttcctggtataccgactta

SEQ ID NO: 151725 - DNA, 22 bp, Artificial Sequence
  Synthetic oligonucleotide; CTT chr11 5178152 5178173 5178157 5178152 -
cctggtataccgacttacatat

SEQ ID NO: 151726 - DNA, 22 bp, Artificial Sequence
  Synthetic oligonucleotide; TTC chr11 5178151 5178172 5178156 5178151 -
ctggtataccgacttacatatt

SEQ ID NO: 151727 - DNA, 22 bp, Artificial Sequence
  Synthetic oligonucleotide; CTG chr11 5178148 5178169 5178153 5178148 -
gtataccgacttacatattgtg

SEQ ID NO: 151728 - DNA, 22 bp, Artificial Sequence
  Synthetic oligonucleotide; CTT chr11 5178136 5178157 5178141 5178136 -
acatattgtgggagaaacatca

SEQ ID NO: 151729 - DNA, 22 bp, Artificial Sequence
  Synthetic oligonucleotide; TTA chr11 5178135 5178156 5178140 5178135 -
catattgtgggagaaacatcat

SEQ ID NO: 151730 - DNA, 22 bp, Artificial Sequence
  Synthetic oligonucleotide; TTG chr11 5178128 5178149 5178133 5178128 -
tgggagaaacatcattcctcat

SEQ ID NO: 151731 - DNA, 22 bp, Artificial Sequence
  Synthetic oligonucleotide; TTC chr11 5178111 5178132 5178116 5178111 -
ctcattcctactgtgagcacat

SEQ ID NO: 151732 - DNA, 22 bp, Artificial Sequence
  Synthetic oligonucleotide; CTC chr11 5178108 5178129 5178113 5178108 -
attcctactgtgagcacattgc

SEQ ID NO: 151733 - DNA, 22 bp, Artificial Sequence
  Synthetic oligonucleotide; TTC chr11 5178104 5178125 5178109 5178104 -
ctactgtgagcacattgccaga

SEQ ID NO: 151734 - DNA, 22 bp, Artificial Sequence
  Synthetic oligonucleotide; CTA chr11 5178101 5178122 5178106 5178101 -
ctgtgagcacattgccagattg

SEQ ID NO: 151735 - DNA, 22 bp, Artificial Sequence
  Synthetic oligonucleotide; CTG chr11 5178098 5178119 5178103 5178098 -
tgagcacattgccagattggct

SEQ ID NO: 151736 - DNA, 22 bp, Artificial Sequence
  Synthetic oligonucleotide; TTG chr11 5178087 5178108 5178092 5178087 -
ccagattggcttgtggcaatat

SEQ ID NO: 151737 - DNA, 22 bp, Artificial Sequence
  Synthetic oligonucleotide; TTG chr11 5178079 5178100 5178084 5178079 -
gcttgtggcaatatcaatgtca

SEQ ID NO: 151738 - DNA, 22 bp, Artificial Sequence
  Synthetic oligonucleotide; CTT chr11 5178075 5178096 5178080 5178075 -
gtggcaatatcaatgtcaatat

SEQ ID NO: 151739 - DNA, 22 bp, Artificial Sequence
  Synthetic oligonucleotide; TTG chr11 5178074 5178095 5178079 5178074 -
tggcaatatcaatgtcaatatc

SEQ ID NO: 151740 - DNA, 22 bp, Artificial Sequence
  Synthetic oligonucleotide; TTT chr11 5178048 5178069 5178053 5178048 -
atggcctcactgtggccctact

SEQ ID NO: 151741 - DNA, 22 bp, Artificial Sequence
  Synthetic oligonucleotide; TTA chr11 5178047 5178068 5178052 5178047 -
tggcctcactgtggccctactc

SEQ ID NO: 151742 - DNA, 22 bp, Artificial Sequence
  Synthetic oligonucleotide; CTC chr11 5178040 5178061 5178045 5178040 -
actgtggccctactctctacag

SEQ ID NO: 151743 - DNA, 22 bp, Artificial Sequence
  Synthetic oligonucleotide; CTG chr11 5178036 5178057 5178041 5178036 -
tggccctactctctacaggact

SEQ ID NO: 151744 - DNA, 22 bp, Artificial Sequence
  Synthetic oligonucleotide; CTA chr11 5178028 5178049 5178033 5178028 -
ctctctacaggactggatatag

SEQ ID NO: 151745 - DNA, 22 bp, Artificial Sequence
  Synthetic oligonucleotide; CTC chr11 5178025 5178046 5178030 5178025 -
tctacaggactggatatagtgc

SEQ ID NO: 151746 - DNA, 22 bp, Artificial Sequence
  Synthetic oligonucleotide; CTC chr11 5178023 5178044 5178028 5178023 -
tacaggactggatatagtgctt

SEQ ID NO: 151747 - DNA, 22 bp, Artificial Sequence
  Synthetic oligonucleotide; CTA chr11 5178021 5178042 5178026 5178021 -
caggactggatatagtgcttat

SEQ ID NO: 151748 - DNA, 22 bp, Artificial Sequence
  Synthetic oligonucleotide; CTG chr11 5178013 5178034 5178018 5178013 -
gatatagtgcttatcattatat

SEQ ID NO: 151749 - DNA, 22 bp, Artificial Sequence
  Synthetic oligonucleotide; CTT chr11 5178001 5178022 5178006 5178001 -
atcattatatcctacacaatga

SEQ ID NO: 151750 - DNA, 22 bp, Artificial Sequence
  Synthetic oligonucleotide; TTA chr11 5178000 5178021 5178005 5178000 -
tcattatatcctacacaatgat

SEQ ID NO: 151751 - DNA, 22 bp, Artificial Sequence
  Synthetic oligonucleotide; TTA chr11 5177994 5178015 5177999 5177994 -
tatcctacacaatgatccttca

SEQ ID NO: 151752 - DNA, 22 bp, Artificial Sequence
  Synthetic oligonucleotide; CTA chr11 5177987 5178008 5177992 5177987 -
cacaatgatccttcactcagtg

SEQ ID NO: 151753 - DNA, 22 bp, Artificial Sequence
  Synthetic oligonucleotide; CTT chr11 5177974 5177995 5177979 5177974 -
cactcagtgtttcagatatctt

SEQ ID NO: 151754 - DNA, 22 bp, Artificial Sequence
  Synthetic oligonucleotide; TTC chr11 5177973 5177994 5177978 5177973 -
actcagtgtttcagatatcttc

SEQ ID NO: 151755 - DNA, 22 bp, Artificial Sequence
  Synthetic oligonucleotide; CTC chr11 5177969 5177990 5177974 5177969 -
agtgtttcagatatcttcctgg

SEQ ID NO: 151756 - DNA, 22 bp, Artificial Sequence
  Synthetic oligonucleotide; TTT chr11 5177962 5177983 5177967 5177962 -
cagatatcttcctgggctgcca

SEQ ID NO: 151757 - DNA, 22 bp, Artificial Sequence
  Synthetic oligonucleotide; TTC chr11 5177961 5177982 5177966 5177961 -
agatatcttcctgggctgccag

SEQ ID NO: 151758 - DNA, 22 bp, Artificial Sequence
  Synthetic oligonucleotide; CTT chr11 5177952 5177973 5177957 5177952 -
cctgggctgccaggttcaaggc

SEQ ID NO: 151759 - DNA, 22 bp, Artificial Sequence
  Synthetic oligonucleotide; TTC chr11 5177951 5177972 5177956 5177951 -
ctgggctgccaggttcaaggcc

SEQ ID NO: 151760 - DNA, 22 bp, Artificial Sequence
  Synthetic oligonucleotide; CTG chr11 5177948 5177969 5177953 5177948 -
ggctgccaggttcaaggccctt

SEQ ID NO: 151761 - DNA, 22 bp, Artificial Sequence
  Synthetic oligonucleotide; CTG chr11 5177943 5177964 5177948 5177943 -
ccaggttcaaggcccttagtac

SEQ ID NO: 151762 - DNA, 22 bp, Artificial Sequence
  Synthetic oligonucleotide; TTC chr11 5177935 5177956 5177940 5177935 -
aaggcccttagtacgtgcggct

SEQ ID NO: 151763 - DNA, 22 bp, Artificial Sequence
  Synthetic oligonucleotide; CTT chr11 5177926 5177947 5177931 5177926 -
agtacgtgcggctctcatatct

SEQ ID NO: 151764 - DNA, 22 bp, Artificial Sequence
  Synthetic oligonucleotide; TTA chr11 5177925 5177946 5177930 5177925 -
gtacgtgcggctctcatatctg

SEQ ID NO: 151765 - DNA, 22 bp, Artificial Sequence
  Synthetic oligonucleotide; CTC chr11 5177912 5177933 5177917 5177912 -
tcatatctgtgtcatatttatg

SEQ ID NO: 151766 - DNA, 22 bp, Artificial Sequence
  Synthetic oligonucleotide; CTC chr11 5177910 5177931 5177915 5177910 -
atatctgtgtcatatttatgtt

SEQ ID NO: 151767 - DNA, 22 bp, Artificial Sequence
  Synthetic oligonucleotide; CTG chr11 5177903 5177924 5177908 5177903 -
tgtcatatttatgttctatacc

SEQ ID NO: 151768 - DNA, 22 bp, Artificial Sequence
  Synthetic oligonucleotide; TTT chr11 5177893 5177914 5177898 5177893 -
atgttctataccccagcattct

SEQ ID NO: 151769 - DNA, 22 bp, Artificial Sequence
  Synthetic oligonucleotide; TTA chr11 5177892 5177913 5177897 5177892 -
tgttctataccccagcattctt

SEQ ID NO: 151770 - DNA, 22 bp, Artificial Sequence
  Synthetic oligonucleotide; TTC chr11 5177887 5177908 5177892 5177887 -
tataccccagcattcttttcat

SEQ ID NO: 151771 - DNA, 22 bp, Artificial Sequence
  Synthetic oligonucleotide; CTA chr11 5177885 5177906 5177890 5177885 -
taccccagcattcttttcattt

SEQ ID NO: 151772 - DNA, 22 bp, Artificial Sequence
  Synthetic oligonucleotide; TTC chr11 5177872 5177893 5177877 5177872 -
ttttcatttcttgcccatcgct

SEQ ID NO: 151773 - DNA, 22 bp, Artificial Sequence
  Synthetic oligonucleotide; CTT chr11 5177870 5177891 5177875 5177870 -
ttcatttcttgcccatcgcttt

SEQ ID NO: 151774 - DNA, 22 bp, Artificial Sequence
  Synthetic oligonucleotide; TTT chr11 5177869 5177890 5177874 5177869 -
tcatttcttgcccatcgctttg

SEQ ID NO: 151775 - DNA, 22 bp, Artificial Sequence
  Synthetic oligonucleotide; TTT chr11 5177868 5177889 5177873 5177868 -
catttcttgcccatcgctttgg

SEQ ID NO: 151776 - DNA, 22 bp, Artificial Sequence
  Synthetic oligonucleotide; TTC chr11 5177867 5177888 5177872 5177867 -
atttcttgcccatcgctttgga

SEQ ID NO: 151777 - DNA, 22 bp, Artificial Sequence
  Synthetic oligonucleotide; TTT chr11 5177863 5177884 5177868 5177863 -
cttgcccatcgctttggaggta

SEQ ID NO: 151778 - DNA, 22 bp, Artificial Sequence
  Synthetic oligonucleotide; TTC chr11 5177862 5177883 5177867 5177862 -
ttgcccatcgctttggaggtaa

SEQ ID NO: 151779 - DNA, 22 bp, Artificial Sequence
  Synthetic oligonucleotide; CTT chr11 5177860 5177881 5177865 5177860 -
gcccatcgctttggaggtaaaa

SEQ ID NO: 151780 - DNA, 22 bp, Artificial Sequence
  Synthetic oligonucleotide; TTG chr11 5177859 5177880 5177864 5177859 -
cccatcgctttggaggtaaaac

SEQ ID NO: 151781 - DNA, 22 bp, Artificial Sequence
  Synthetic oligonucleotide; CTT chr11 5177849 5177870 5177854 5177849 -
tggaggtaaaaccatccctcac

SEQ ID NO: 151782 - DNA, 22 bp, Artificial Sequence
  Synthetic oligonucleotide; TTT chr11 5177848 5177869 5177853 5177848 -
ggaggtaaaaccatccctcacc

SEQ ID NO: 151783 - DNA, 22 bp, Artificial Sequence
  Synthetic oligonucleotide; TTG chr11 5177847 5177868 5177852 5177847 -
gaggtaaaaccatccctcacca

SEQ ID NO: 151784 - DNA, 22 bp, Artificial Sequence
  Synthetic oligonucleotide; CTC chr11 5177829 5177850 5177834 5177829 -
accacattcacatcctagtggg

SEQ ID NO: 151785 - DNA, 22 bp, Artificial Sequence
  Synthetic oligonucleotide; TTC chr11 5177820 5177841 5177825 5177820 -
acatcctagtgggcagtctcta

SEQ ID NO: 151786 - DNA, 22 bp, Artificial Sequence
  Synthetic oligonucleotide; CTA chr11 5177812 5177833 5177817 5177812 -
gtgggcagtctctatgtgttag

SEQ ID NO: 151787 - DNA, 22 bp, Artificial Sequence
  Synthetic oligonucleotide; CTC chr11 5177800 5177821 5177805 5177800 -
tatgtgttagtgccccctatgc

SEQ ID NO: 151788 - DNA, 22 bp, Artificial Sequence
  Synthetic oligonucleotide; CTA chr11 5177798 5177819 5177803 5177798 -
tgtgttagtgccccctatgcta

SEQ ID NO: 151789 - DNA, 22 bp, Artificial Sequence
  Synthetic oligonucleotide; TTA chr11 5177791 5177812 5177796 5177791 -
gtgccccctatgctaaacccca

SEQ ID NO: 151790 - DNA, 22 bp, Artificial Sequence
  Synthetic oligonucleotide; CTA chr11 5177781 5177802 5177786 5177781 -
tgctaaaccccatcatttatgg

SEQ ID NO: 151791 - DNA, 22 bp, Artificial Sequence
  Synthetic oligonucleotide; CTA chr11 5177776 5177797 5177781 5177776 -
aaccccatcatttatggggtga

SEQ ID NO: 151792 - DNA, 22 bp, Artificial Sequence
  Synthetic oligonucleotide; TTT chr11 5177763 5177784 5177768 5177763 -
atggggtgaagaccaaacaaat

SEQ ID NO: 151793 - DNA, 22 bp, Artificial Sequence
  Synthetic oligonucleotide; TTA chr11 5177762 5177783 5177767 5177762 -
tggggtgaagaccaaacaaatt

SEQ ID NO: 151794 - DNA, 22 bp, Artificial Sequence
  Synthetic oligonucleotide; TTA chr11 5177739 5177760 5177744 5177739 -
aagatcgagtgattttgctttt

SEQ ID NO: 151795 - DNA, 22 bp, Artificial Sequence
  Synthetic oligonucleotide; TTT chr11 5177724 5177745 5177729 5177724 -
tgcttttctctcctatcagtgt

SEQ ID NO: 151796 - DNA, 22 bp, Artificial Sequence
  Synthetic oligonucleotide; TTT chr11 5177723 5177744 5177728 5177723 -
gcttttctctcctatcagtgta

SEQ ID NO: 151797 - DNA, 22 bp, Artificial Sequence
  Synthetic oligonucleotide; TTG chr11 5177722 5177743 5177727 5177722 -
cttttctctcctatcagtgtat

SEQ ID NO: 151798 - DNA, 22 bp, Artificial Sequence
  Synthetic oligonucleotide; CTT chr11 5177719 5177740 5177724 5177719 -
ttctctcctatcagtgtatgct

SEQ ID NO: 151799 - DNA, 22 bp, Artificial Sequence
  Synthetic oligonucleotide; TTT chr11 5177718 5177739 5177723 5177718 -
tctctcctatcagtgtatgctg

SEQ ID NO: 151800 - DNA, 22 bp, Artificial Sequence
  Synthetic oligonucleotide; TTT chr11 5177717 5177738 5177722 5177717 -
ctctcctatcagtgtatgctgt

SEQ ID NO: 151801 - DNA, 22 bp, Artificial Sequence
  Synthetic oligonucleotide; TTC chr11 5177716 5177737 5177721 5177716 -
tctcctatcagtgtatgctgtt

SEQ ID NO: 151802 - DNA, 22 bp, Artificial Sequence
  Synthetic oligonucleotide; CTC chr11 5177714 5177735 5177719 5177714 -
tcctatcagtgtatgctgttaa

SEQ ID NO: 151803 - DNA, 22 bp, Artificial Sequence
  Synthetic oligonucleotide; CTC chr11 5177712 5177733 5177717 5177712 -
ctatcagtgtatgctgttaaga

SEQ ID NO: 151804 - DNA, 22 bp, Artificial Sequence
  Synthetic oligonucleotide; CTA chr11 5177709 5177730 5177714 5177709 -
tcagtgtatgctgttaagatta

SEQ ID NO: 151805 - DNA, 22 bp, Artificial Sequence
  Synthetic oligonucleotide; CTG chr11 5177696 5177717 5177701 5177696 -
ttaagattaaaaagtctgtttt

SEQ ID NO: 151806 - DNA, 22 bp, Artificial Sequence
  Synthetic oligonucleotide; TTA chr11 5177693 5177714 5177698 5177693 -
agattaaaaagtctgttttagg

SEQ ID NO: 151807 - DNA, 22 bp, Artificial Sequence
  Synthetic oligonucleotide; TTA chr11 5177687 5177708 5177692 5177687 -
aaaagtctgttttagggaatag

SEQ ID NO: 151808 - DNA, 22 bp, Artificial Sequence
  Synthetic oligonucleotide; CTG chr11 5177678 5177699 5177683 5177678 -
ttttagggaatagaataaatac

SEQ ID NO: 151809 - DNA, 22 bp, Artificial Sequence
  Synthetic oligonucleotide; TTT chr11 5177675 5177696 5177680 5177675 -
tagggaatagaataaatacaat

SEQ ID NO: 151810 - DNA, 22 bp, Artificial Sequence
  Synthetic oligonucleotide; TTT chr11 5177674 5177695 5177679 5177674 -
agggaatagaataaatacaatc

SEQ ID NO: 151811 - DNA, 22 bp, Artificial Sequence
  Synthetic oligonucleotide; TTA chr11 5177673 5177694 5177678 5177673 -
gggaatagaataaatacaatcc

SEQ ID NO: 151812 - DNA, 22 bp, Artificial Sequence
  Synthetic oligonucleotide; CTC chr11 5177639 5177660 5177644 5177639 -
aaacacacttaaaatgatggtg

SEQ ID NO: 151813 - DNA, 22 bp, Artificial Sequence
  Synthetic oligonucleotide; CTT chr11 5177629 5177650 5177634 5177629 -
aaaatgatggtgtctatcaaag

SEQ ID NO: 151814 - DNA, 22 bp, Artificial Sequence
  Synthetic oligonucleotide; TTA chr11 5177628 5177649 5177633 5177628 -
aaatgatggtgtctatcaaagt

SEQ ID NO: 151815 - DNA, 22 bp, Artificial Sequence
  Synthetic oligonucleotide; CTA chr11 5177613 5177634 5177618 5177613 -
tcaaagtgtccacggaattttg

SEQ ID NO: 151816 - DNA, 22 bp, Artificial Sequence
  Synthetic oligonucleotide; TTT chr11 5177593 5177614 5177598 5177593 -
tgctaaggcactcaaagatcaa

SEQ ID NO: 151817 - DNA, 22 bp, Artificial Sequence
  Synthetic oligonucleotide; TTT chr11 5177592 5177613 5177597 5177592 -
gctaaggcactcaaagatcaaa

SEQ ID NO: 151818 - DNA, 22 bp, Artificial Sequence
  Synthetic oligonucleotide; TTG chr11 5177591 5177612 5177596 5177591 -
ctaaggcactcaaagatcaaag

SEQ ID NO: 151819 - DNA, 22 bp, Artificial Sequence
  Synthetic oligonucleotide; CTA chr11 5177588 5177609 5177593 5177588 -
aggcactcaaagatcaaaggtt

SEQ ID NO: 151820 - DNA, 22 bp, Artificial Sequence
  Synthetic oligonucleotide; CTC chr11 5177580 5177601 5177585 5177580 -
aaagatcaaaggttttgaaaaa

SEQ ID NO: 151821 - DNA, 22 bp, Artificial Sequence
  Synthetic oligonucleotide; TTT chr11 5177565 5177586 5177570 5177565 -
tgaaaaaaaaaatactttaatg

SEQ ID NO: 151822 - DNA, 22 bp, Artificial Sequence
  Synthetic oligonucleotide; TTT chr11 5177564 5177585 5177569 5177564 -
gaaaaaaaaaatactttaatga

SEQ ID NO: 151823 - DNA, 22 bp, Artificial Sequence
  Synthetic oligonucleotide; TTG chr11 5177563 5177584 5177568 5177563 -
aaaaaaaaaatactttaatgaa

SEQ ID NO: 151824 - DNA, 22 bp, Artificial Sequence
  Synthetic oligonucleotide; CTT chr11 5177548 5177569 5177553 5177548 -
taatgaaattctccattttttc

SEQ ID NO: 151825 - DNA, 22 bp, Artificial Sequence
  Synthetic oligonucleotide; TTT chr11 5177547 5177568 5177552 5177547 -
aatgaaattctccattttttca

SEQ ID NO: 151826 - DNA, 22 bp, Artificial Sequence
  Synthetic oligonucleotide; TTA chr11 5177546 5177567 5177551 5177546 -
atgaaattctccattttttcag

SEQ ID NO: 151827 - DNA, 22 bp, Artificial Sequence
  Synthetic oligonucleotide; TTC chr11 5177537 5177558 5177542 5177537 -
tccattttttcagaaatactat

SEQ ID NO: 151828 - DNA, 22 bp, Artificial Sequence
  Synthetic oligonucleotide; CTC chr11 5177535 5177556 5177540 5177535 -
cattttttcagaaatactattt

SEQ ID NO: 151829 - DNA, 22 bp, Artificial Sequence
  Synthetic oligonucleotide; TTT chr11 5177530 5177551 5177535 5177530 -
tttcagaaatactattttcatg

SEQ ID NO: 151830 - DNA, 22 bp, Artificial Sequence
  Synthetic oligonucleotide; TTT chr11 5177529 5177550 5177534 5177529 -
ttcagaaatactattttcatga

SEQ ID NO: 151831 - DNA, 22 bp, Artificial Sequence
  Synthetic oligonucleotide; TTT chr11 5177528 5177549 5177533 5177528 -
tcagaaatactattttcatgaa

SEQ ID NO: 151832 - DNA, 22 bp, Artificial Sequence
  Synthetic oligonucleotide; TTT chr11 5177527 5177548 5177532 5177527 -
cagaaatactattttcatgaat

SEQ ID NO: 151833 - DNA, 22 bp, Artificial Sequence
  Synthetic oligonucleotide; TTC chr11 5177526 5177547 5177531 5177526 -
agaaatactattttcatgaatt

SEQ ID NO: 151834 - DNA, 22 bp, Artificial Sequence
  Synthetic oligonucleotide; CTA chr11 5177516 5177537 5177521 5177516 -
ttttcatgaattttaacttaaa

SEQ ID NO: 151835 - DNA, 22 bp, Artificial Sequence
  Synthetic oligonucleotide; TTT chr11 5177513 5177534 5177518 5177513 -
tcatgaattttaacttaaaaat

SEQ ID NO: 151836 - DNA, 22 bp, Artificial Sequence
  Synthetic oligonucleotide; TTT chr11 5177512 5177533 5177517 5177512 -
catgaattttaacttaaaaata

SEQ ID NO: 151837 - DNA, 22 bp, Artificial Sequence
  Synthetic oligonucleotide; TTC chr11 5177511 5177532 5177516 5177511 -
atgaattttaacttaaaaatat

SEQ ID NO: 151838 - DNA, 22 bp, Artificial Sequence
  Synthetic oligonucleotide; TTT chr11 5177503 5177524 5177508 5177503 -
taacttaaaaatatataaagat

SEQ ID NO: 151839 - DNA, 22 bp, Artificial Sequence
  Synthetic oligonucleotide; TTT chr11 5177502 5177523 5177507 5177502 -
aacttaaaaatatataaagata

SEQ ID NO: 151840 - DNA, 22 bp, Artificial Sequence
  Synthetic oligonucleotide; TTA chr11 5177501 5177522 5177506 5177501 -
acttaaaaatatataaagataa

SEQ ID NO: 151841 - DNA, 22 bp, Artificial Sequence
  Synthetic oligonucleotide; CTT chr11 5177497 5177518 5177502 5177497 -
aaaaatatataaagataatcga

SEQ ID NO: 151842 - DNA, 22 bp, Artificial Sequence
  Synthetic oligonucleotide; TTA chr11 5177496 5177517 5177501 5177496 -
aaaatatataaagataatcgag

SEQ ID NO: 151843 - DNA, 22 bp, Artificial Sequence
  Synthetic oligonucleotide; TTT chr11 5177457 5177478 5177462 5177457 -
tagggtttaatccagattgact

SEQ ID NO: 151844 - DNA, 22 bp, Artificial Sequence
  Synthetic oligonucleotide; TTT chr11 5177456 5177477 5177461 5177456 -
agggtttaatccagattgactt

SEQ ID NO: 151845 - DNA, 22 bp, Artificial Sequence
  Synthetic oligonucleotide; TTA chr11 5177455 5177476 5177460 5177455 -
gggtttaatccagattgacttt

SEQ ID NO: 151846 - DNA, 22 bp, Artificial Sequence
  Synthetic oligonucleotide; TTT chr11 5177449 5177470 5177454 5177449 -
aatccagattgacttttcctac

SEQ ID NO: 151847 - DNA, 22 bp, Artificial Sequence
  Synthetic oligonucleotide; TTA chr11 5177448 5177469 5177453 5177448 -
atccagattgacttttcctacg

SEQ ID NO: 151848 - DNA, 22 bp, Artificial Sequence
  Synthetic oligonucleotide; TTG chr11 5177438 5177459 5177443 5177438 -
acttttcctacgtagagctagg

SEQ ID NO: 151849 - DNA, 22 bp, Artificial Sequence
  Synthetic oligonucleotide; CTT chr11 5177434 5177455 5177439 5177434 -
ttcctacgtagagctaggaagt

SEQ ID NO: 151850 - DNA, 22 bp, Artificial Sequence
  Synthetic oligonucleotide; TTT chr11 5177433 5177454 5177438 5177433 -
tcctacgtagagctaggaagtg

SEQ ID NO: 151851 - DNA, 22 bp, Artificial Sequence
  Synthetic oligonucleotide; TTT chr11 5177432 5177453 5177437 5177432 -
cctacgtagagctaggaagtgg

SEQ ID NO: 151852 - DNA, 22 bp, Artificial Sequence
  Synthetic oligonucleotide; TTC chr11 5177431 5177452 5177436 5177431 -
ctacgtagagctaggaagtggg

SEQ ID NO: 151853 - DNA, 22 bp, Artificial Sequence
  Synthetic oligonucleotide; CTA chr11 5177428 5177449 5177433 5177428 -
cgtagagctaggaagtggggtt

SEQ ID NO: 151854 - DNA, 22 bp, Artificial Sequence
  Synthetic oligonucleotide; CTA chr11 5177418 5177439 5177423 5177418 -
ggaagtggggttttgagtcagt

SEQ ID NO: 151855 - DNA, 22 bp, Artificial Sequence
  Synthetic oligonucleotide; TTT chr11 5177405 5177426 5177410 5177405 -
tgagtcagtcactgggcttttt

SEQ ID NO: 151856 - DNA, 22 bp, Artificial Sequence
  Synthetic oligonucleotide; TTT chr11 5177404 5177425 5177409 5177404 -
gagtcagtcactgggcttttta

SEQ ID NO: 151857 - DNA, 22 bp, Artificial Sequence
  Synthetic oligonucleotide; TTG chr11 5177403 5177424 5177408 5177403 -
agtcagtcactgggctttttat

SEQ ID NO: 151858 - DNA, 22 bp, Artificial Sequence
  Synthetic oligonucleotide; CTG chr11 5177391 5177412 5177396 5177391 -
ggctttttatagtcagtctgaa

SEQ ID NO: 151859 - DNA, 22 bp, Artificial Sequence
  Synthetic oligonucleotide; CTT chr11 5177386 5177407 5177391 5177386 -
tttatagtcagtctgaaattct

SEQ ID NO: 151860 - DNA, 22 bp, Artificial Sequence
  Synthetic oligonucleotide; TTT chr11 5177385 5177406 5177390 5177385 -
ttatagtcagtctgaaattctg

SEQ ID NO: 151861 - DNA, 22 bp, Artificial Sequence
  Synthetic oligonucleotide; TTT chr11 5177384 5177405 5177389 5177384 -
tatagtcagtctgaaattctgc

SEQ ID NO: 151862 - DNA, 22 bp, Artificial Sequence
  Synthetic oligonucleotide; TTT chr11 5177383 5177404 5177388 5177383 -
atagtcagtctgaaattctgct

SEQ ID NO: 151863 - DNA, 22 bp, Artificial Sequence
  Synthetic oligonucleotide; TTA chr11 5177382 5177403 5177387 5177382 -
tagtcagtctgaaattctgctg

SEQ ID NO: 151864 - DNA, 22 bp, Artificial Sequence
  Synthetic oligonucleotide; CTG chr11 5177371 5177392 5177376 5177371 -
aaattctgctgaaatgtacaac

SEQ ID NO: 151865 - DNA, 22 bp, Artificial Sequence
  Synthetic oligonucleotide; TTC chr11 5177365 5177386 5177370 5177365 -
tgctgaaatgtacaacactccc

SEQ ID NO: 151866 - DNA, 22 bp, Artificial Sequence
  Synthetic oligonucleotide; CTG chr11 5177363 5177384 5177368 5177363 -
ctgaaatgtacaacactcccgc

SEQ ID NO: 151867 - DNA, 22 bp, Artificial Sequence
  Synthetic oligonucleotide; CTG chr11 5177360 5177381 5177365 5177360 -
aaatgtacaacactcccgctgt

SEQ ID NO: 151868 - DNA, 22 bp, Artificial Sequence
  Synthetic oligonucleotide; CTC chr11 5177345 5177366 5177350 5177345 -
ccgctgtactctgcagagactt

SEQ ID NO: 151869 - DNA, 22 bp, Artificial Sequence
  Synthetic oligonucleotide; CTG chr11 5177339 5177360 5177344 5177339 -
tactctgcagagacttgaacca

SEQ ID NO: 151870 - DNA, 22 bp, Artificial Sequence
  Synthetic oligonucleotide; CTC chr11 5177334 5177355 5177339 5177334 -
tgcagagacttgaaccaataac

SEQ ID NO: 151871 - DNA, 22 bp, Artificial Sequence
  Synthetic oligonucleotide; CTG chr11 5177332 5177353 5177337 5177332 -
cagagacttgaaccaataacat

SEQ ID NO: 151872 - DNA, 22 bp, Artificial Sequence
  Synthetic oligonucleotide; CTT chr11 5177323 5177344 5177328 5177323 -
gaaccaataacatgaagccata

SEQ ID NO: 151873 - DNA, 22 bp, Artificial Sequence
  Synthetic oligonucleotide; TTG chr11 5177322 5177343 5177327 5177322 -
aaccaataacatgaagccataa

SEQ ID NO: 151874 - DNA, 22 bp, Artificial Sequence
  Synthetic oligonucleotide; TTA chr11 5177295 5177316 5177300 5177295 -
tttttgtcaacacctgttactt

SEQ ID NO: 151875 - DNA, 22 bp, Artificial Sequence
  Synthetic oligonucleotide; TTT chr11 5177292 5177313 5177297 5177292 -
ttgtcaacacctgttacttaag

SEQ ID NO: 151876 - DNA, 22 bp, Artificial Sequence
  Synthetic oligonucleotide; TTT chr11 5177291 5177312 5177296 5177291 -
tgtcaacacctgttacttaagt

SEQ ID NO: 151877 - DNA, 22 bp, Artificial Sequence
  Synthetic oligonucleotide; TTT chr11 5177290 5177311 5177295 5177290 -
gtcaacacctgttacttaagtt

SEQ ID NO: 151878 - DNA, 22 bp, Artificial Sequence
  Synthetic oligonucleotide; TTG chr11 5177289 5177310 5177294 5177289 -
tcaacacctgttacttaagtta

SEQ ID NO: 151879 - DNA, 22 bp, Artificial Sequence
  Synthetic oligonucleotide; CTG chr11 5177279 5177300 5177284 5177279 -
ttacttaagttaaaatgttatc

SEQ ID NO: 151880 - DNA, 22 bp, Artificial Sequence
  Synthetic oligonucleotide; TTA chr11 5177276 5177297 5177281 5177276 -
cttaagttaaaatgttatccct

SEQ ID NO: 151881 - DNA, 22 bp, Artificial Sequence
  Synthetic oligonucleotide; CTT chr11 5177273 5177294 5177278 5177273 -
aagttaaaatgttatccctaga

SEQ ID NO: 151882 - DNA, 22 bp, Artificial Sequence
  Synthetic oligonucleotide; TTA chr11 5177272 5177293 5177277 5177272 -
agttaaaatgttatccctagaa

SEQ ID NO: 151883 - DNA, 22 bp, Artificial Sequence
  Synthetic oligonucleotide; TTA chr11 5177267 5177288 5177272 5177267 -
aaatgttatccctagaatattt

SEQ ID NO: 151884 - DNA, 22 bp, Artificial Sequence
  Synthetic oligonucleotide; TTA chr11 5177259 5177280 5177264 5177259 -
tccctagaatattttctaactc

SEQ ID NO: 151885 - DNA, 22 bp, Artificial Sequence
  Synthetic oligonucleotide; CTA chr11 5177253 5177274 5177258 5177253 -
gaatattttctaactcactgac

SEQ ID NO: 151886 - DNA, 22 bp, Artificial Sequence
  Synthetic oligonucleotide; TTT chr11 5177245 5177266 5177250 5177245 -
tctaactcactgacatctcaca

SEQ ID NO: 151887 - DNA, 22 bp, Artificial Sequence
  Synthetic oligonucleotide; TTT chr11 5177244 5177265 5177249 5177244 -
ctaactcactgacatctcacaa

SEQ ID NO: 151888 - DNA, 22 bp, Artificial Sequence
  Synthetic oligonucleotide; TTC chr11 5177243 5177264 5177248 5177243 -
taactcactgacatctcacaaa

SEQ ID NO: 151889 - DNA, 22 bp, Artificial Sequence
  Synthetic oligonucleotide; CTA chr11 5177241 5177262 5177246 5177241 -
actcactgacatctcacaaagt

SEQ ID NO: 151890 - DNA, 22 bp, Artificial Sequence
  Synthetic oligonucleotide; CTC chr11 5177237 5177258 5177242 5177237 -
actgacatctcacaaagtctct

SEQ ID NO: 151891 - DNA, 22 bp, Artificial Sequence
  Synthetic oligonucleotide; CTG chr11 5177233 5177254 5177238 5177233 -
acatctcacaaagtctcttgta

SEQ ID NO: 151892 - DNA, 22 bp, Artificial Sequence
  Synthetic oligonucleotide; CTC chr11 5177226 5177247 5177231 5177226 -
acaaagtctcttgtatggaata

SEQ ID NO: 151893 - DNA, 22 bp, Artificial Sequence
  Synthetic oligonucleotide; CTC chr11 5177216 5177237 5177221 5177216 -
ttgtatggaatagacacataat

SEQ ID NO: 151894 - DNA, 22 bp, Artificial Sequence
  Synthetic oligonucleotide; CTT chr11 5177214 5177235 5177219 5177214 -
gtatggaatagacacataatac

SEQ ID NO: 151895 - DNA, 22 bp, Artificial Sequence
  Synthetic oligonucleotide; TTG chr11 5177213 5177234 5177218 5177213 -
tatggaatagacacataataca

SEQ ID NO: 151896 - DNA, 22 bp, Artificial Sequence
  Synthetic oligonucleotide; TTC chr11 5177182 5177203 5177187 5177182 -
aacaagtgaataatagtgaatt

SEQ ID NO: 151897 - DNA, 22 bp, Artificial Sequence
  Synthetic oligonucleotide; TTA chr11 5177159 5177180 5177164 5177159 -
aagcaaataataaccaatatta

SEQ ID NO: 151898 - DNA, 22 bp, Artificial Sequence
  Synthetic oligonucleotide; TTA chr11 5177137 5177158 5177142 5177137 -
aattaacaaatatgagattgcc

SEQ ID NO: 151899 - DNA, 22 bp, Artificial Sequence
  Synthetic oligonucleotide; TTA chr11 5177132 5177153 5177137 5177132 -
acaaatatgagattgcctggat

SEQ ID NO: 151900 - DNA, 22 bp, Artificial Sequence
  Synthetic oligonucleotide; TTG chr11 5177117 5177138 5177122 5177117 -
cctggatgatgtaaaatctgat

SEQ ID NO: 151901 - DNA, 22 bp, Artificial Sequence
  Synthetic oligonucleotide; CTG chr11 5177113 5177134 5177118 5177113 -
gatgatgtaaaatctgatacac

SEQ ID NO: 151902 - DNA, 22 bp, Artificial Sequence
  Synthetic oligonucleotide; CTG chr11 5177097 5177118 5177102 5177097 -
atacacatttccccctatagtg

SEQ ID NO: 151903 - DNA, 22 bp, Artificial Sequence
  Synthetic oligonucleotide; TTT chr11 5177087 5177108 5177092 5177087 -
ccccctatagtggagattttag

SEQ ID NO: 151904 - DNA, 22 bp, Artificial Sequence
  Synthetic oligonucleotide; TTC chr11 5177086 5177107 5177091 5177086 -
cccctatagtggagattttaga

SEQ ID NO: 151905 - DNA, 22 bp, Artificial Sequence
  Synthetic oligonucleotide; CTA chr11 5177080 5177101 5177085 5177080 -
tagtggagattttagacccaag

SEQ ID NO: 151906 - DNA, 22 bp, Artificial Sequence
  Synthetic oligonucleotide; TTT chr11 5177068 5177089 5177073 5177068 -
tagacccaagtcatcaatggag

SEQ ID NO: 151907 - DNA, 22 bp, Artificial Sequence
  Synthetic oligonucleotide; TTT chr11 5177067 5177088 5177072 5177067 -
agacccaagtcatcaatggagc

SEQ ID NO: 151908 - DNA, 22 bp, Artificial Sequence
  Synthetic oligonucleotide; TTA chr11 5177066 5177087 5177071 5177066 -
gacccaagtcatcaatggagca

SEQ ID NO: 151909 - DNA, 22 bp, Artificial Sequence
  Synthetic oligonucleotide; CTG chr11 5177018 5177039 5177023 5177018 -
aagaagtaaaatgattgaaaat

SEQ ID NO: 151910 - DNA, 22 bp, Artificial Sequence
  Synthetic oligonucleotide; TTG chr11 5177001 5177022 5177006 5177001 -
aaaatttctatacctgggtgat

SEQ ID NO: 151911 - DNA, 22 bp, Artificial Sequence
  Synthetic oligonucleotide; TTT chr11 5176994 5177015 5176999 5176994 -
ctatacctgggtgataaataaa

SEQ ID NO: 151912 - DNA, 22 bp, Artificial Sequence
  Synthetic oligonucleotide; TTC chr11 5176993 5177014 5176998 5176993 -
tatacctgggtgataaataaat

SEQ ID NO: 151913 - DNA, 22 bp, Artificial Sequence
  Synthetic oligonucleotide; CTA chr11 5176991 5177012 5176996 5176991 -
tacctgggtgataaataaattt

SEQ ID NO: 151914 - DNA, 22 bp, Artificial Sequence
  Synthetic oligonucleotide; CTG chr11 5176985 5177006 5176990 5176985 -
ggtgataaataaatttttaaaa

SEQ ID NO: 151915 - DNA, 22 bp, Artificial Sequence
  Synthetic oligonucleotide; TTT chr11 5176969 5176990 5176974 5176969 -
ttaaaataaacattttttaaaa

SEQ ID NO: 151916 - DNA, 22 bp, Artificial Sequence
  Synthetic oligonucleotide; TTT chr11 5176968 5176989 5176973 5176968 -
taaaataaacattttttaaaaa

SEQ ID NO: 151917 - DNA, 22 bp, Artificial Sequence
  Synthetic oligonucleotide; TTT chr11 5176967 5176988 5176972 5176967 -
aaaataaacattttttaaaaag

SEQ ID NO: 151918 - DNA, 22 bp, Artificial Sequence
  Synthetic oligonucleotide; TTA chr11 5176966 5176987 5176971 5176966 -
aaataaacattttttaaaaagc

SEQ ID NO: 151919 - DNA, 22 bp, Artificial Sequence
  Synthetic oligonucleotide; TTT chr11 5176954 5176975 5176959 5176954 -
tttaaaaagctagagaagatta

SEQ ID NO: 151920 - DNA, 22 bp, Artificial Sequence
  Synthetic oligonucleotide; TTT chr11 5176953 5176974 5176958 5176953 -
ttaaaaagctagagaagattaa

SEQ ID NO: 151921 - DNA, 22 bp, Artificial Sequence
  Synthetic oligonucleotide; TTT chr11 5176952 5176973 5176957 5176952 -
taaaaagctagagaagattaag

SEQ ID NO: 151922 - DNA, 22 bp, Artificial Sequence
  Synthetic oligonucleotide; TTT chr11 5176951 5176972 5176956 5176951 -
aaaaagctagagaagattaagg

SEQ ID NO: 151923 - DNA, 22 bp, Artificial Sequence
  Synthetic oligonucleotide; TTA chr11 5176950 5176971 5176955 5176950 -
aaaagctagagaagattaagga

SEQ ID NO: 151924 - DNA, 22 bp, Artificial Sequence
  Synthetic oligonucleotide; CTA chr11 5176942 5176963 5176947 5176942 -
gagaagattaaggagaatattt

SEQ ID NO: 151925 - DNA, 22 bp, Artificial Sequence
  Synthetic oligonucleotide; TTA chr11 5176932 5176953 5176937 5176932 -
aggagaatattttccaagaaac

SEQ ID NO: 151926 - DNA, 22 bp, Artificial Sequence
  Synthetic oligonucleotide; TTT chr11 5176920 5176941 5176925 5176920 -
tccaagaaacttaaataaaaaa

SEQ ID NO: 151927 - DNA, 22 bp, Artificial Sequence
  Synthetic oligonucleotide; TTT chr11 5176919 5176940 5176924 5176919 -
ccaagaaacttaaataaaaaag

SEQ ID NO: 151928 - DNA, 22 bp, Artificial Sequence
  Synthetic oligonucleotide; TTC chr11 5176918 5176939 5176923 5176918 -
caagaaacttaaataaaaaaga

SEQ ID NO: 151929 - DNA, 22 bp, Artificial Sequence
  Synthetic oligonucleotide; CTT chr11 5176908 5176929 5176913 5176908 -
aaataaaaaagaatgtaatccc

SEQ ID NO: 151930 - DNA, 22 bp, Artificial Sequence
  Synthetic oligonucleotide; TTA chr11 5176907 5176928 5176912 5176907 -
aataaaaaagaatgtaatccca

SEQ ID NO: 151931 - DNA, 22 bp, Artificial Sequence
  Synthetic oligonucleotide; TTA chr11 5176872 5176893 5176877 5176872 -
tctatgatattatctacagact

SEQ ID NO: 151932 - DNA, 22 bp, Artificial Sequence
  Synthetic oligonucleotide; CTA chr11 5176868 5176889 5176873 5176868 -
tgatattatctacagactatac

SEQ ID NO: 151933 - DNA, 22 bp, Artificial Sequence
  Synthetic oligonucleotide; TTA chr11 5176860 5176881 5176865 5176860 -
tctacagactataccttaatcc

SEQ ID NO: 151934 - DNA, 22 bp, Artificial Sequence
  Synthetic oligonucleotide; CTA chr11 5176856 5176877 5176861 5176856 -
cagactataccttaatcccttc

SEQ ID NO: 151935 - DNA, 22 bp, Artificial Sequence
  Synthetic oligonucleotide; CTA chr11 5176849 5176870 5176854 5176849 -
taccttaatcccttcacatcaa

SEQ ID NO: 151936 - DNA, 22 bp, Artificial Sequence
  Synthetic oligonucleotide; CTT chr11 5176843 5176864 5176848 5176843 -
aatcccttcacatcaatacaaa

SEQ ID NO: 151937 - DNA, 22 bp, Artificial Sequence
  Synthetic oligonucleotide; TTA chr11 5176842 5176863 5176847 5176842 -
atcccttcacatcaatacaaat

SEQ ID NO: 151938 - DNA, 22 bp, Artificial Sequence
  Synthetic oligonucleotide; CTT chr11 5176835 5176856 5176840 5176835 -
cacatcaatacaaatttttaca

SEQ ID NO: 151939 - DNA, 22 bp, Artificial Sequence
  Synthetic oligonucleotide; TTC chr11 5176834 5176855 5176839 5176834 -
acatcaatacaaatttttacaa

SEQ ID NO: 151940 - DNA, 22 bp, Artificial Sequence
  Synthetic oligonucleotide; TTT chr11 5176818 5176839 5176823 5176818 -
ttacaatctctccttcttaaaa

SEQ ID NO: 151941 - DNA, 22 bp, Artificial Sequence
  Synthetic oligonucleotide; TTT chr11 5176817 5176838 5176822 5176817 -
tacaatctctccttcttaaaag

SEQ ID NO: 151942 - DNA, 22 bp, Artificial Sequence
  Synthetic oligonucleotide; TTT chr11 5176816 5176837 5176821 5176816 -
acaatctctccttcttaaaagc

SEQ ID NO: 151943 - DNA, 22 bp, Artificial Sequence
  Synthetic oligonucleotide; TTA chr11 5176815 5176836 5176820 5176815 -
caatctctccttcttaaaagcc

SEQ ID NO: 151944 - DNA, 22 bp, Artificial Sequence
  Synthetic oligonucleotide; CTC chr11 5176808 5176829 5176813 5176808 -
tccttcttaaaagcctagaaca

SEQ ID NO: 151945 - DNA, 22 bp, Artificial Sequence
  Synthetic oligonucleotide; CTC chr11 5176806 5176827 5176811 5176806 -
cttcttaaaagcctagaacaat

SEQ ID NO: 151946 - DNA, 22 bp, Artificial Sequence
  Synthetic oligonucleotide; CTT chr11 5176803 5176824 5176808 5176803 -
cttaaaagcctagaacaatgcc

SEQ ID NO: 151947 - DNA, 22 bp, Artificial Sequence
  Synthetic oligonucleotide; TTC chr11 5176802 5176823 5176807 5176802 -
ttaaaagcctagaacaatgcca

SEQ ID NO: 151948 - DNA, 22 bp, Artificial Sequence
  Synthetic oligonucleotide; CTT chr11 5176800 5176821 5176805 5176800 -
aaaagcctagaacaatgccatg

SEQ ID NO: 151949 - DNA, 22 bp, Artificial Sequence
  Synthetic oligonucleotide; TTA chr11 5176799 5176820 5176804 5176799 -
aaagcctagaacaatgccatga

SEQ ID NO: 151950 - DNA, 22 bp, Artificial Sequence
  Synthetic oligonucleotide; CTA chr11 5176791 5176812 5176796 5176791 -
gaacaatgccatgagaatgttt

SEQ ID NO: 151951 - DNA, 22 bp, Artificial Sequence
  Synthetic oligonucleotide; TTT chr11 5176769 5176790 5176774 5176769 -
aaaaaatgaccttatttacacc

SEQ ID NO: 151952 - DNA, 22 bp, Artificial Sequence
  Synthetic oligonucleotide; TTA chr11 5176768 5176789 5176773 5176768 -
aaaaatgaccttatttacacct

SEQ ID NO: 151953 - DNA, 22 bp, Artificial Sequence
  Synthetic oligonucleotide; CTT chr11 5176756 5176777 5176761 5176756 -
atttacacctaaagaaagacaa

SEQ ID NO: 151954 - DNA, 22 bp, Artificial Sequence
  Synthetic oligonucleotide; TTA chr11 5176755 5176776 5176760 5176755 -
tttacacctaaagaaagacaaa

SEQ ID NO: 151955 - DNA, 22 bp, Artificial Sequence
  Synthetic oligonucleotide; TTT chr11 5176752 5176773 5176757 5176752 -
acacctaaagaaagacaaaaaa

SEQ ID NO: 151956 - DNA, 22 bp, Artificial Sequence
  Synthetic oligonucleotide; TTA chr11 5176751 5176772 5176756 5176751 -
cacctaaagaaagacaaaaaaa

SEQ ID NO: 151957 - DNA, 22 bp, Artificial Sequence
  Synthetic oligonucleotide; CTA chr11 5176745 5176766 5176750 5176745 -
aagaaagacaaaaaaaaaactt

SEQ ID NO: 151958 - DNA, 22 bp, Artificial Sequence
  Synthetic oligonucleotide; CTT chr11 5176723 5176744 5176728 5176723 -
tgagaaatctgaggtactatct

SEQ ID NO: 151959 - DNA, 22 bp, Artificial Sequence
  Synthetic oligonucleotide; TTT chr11 5176722 5176743 5176727 5176722 -
gagaaatctgaggtactatctt

SEQ ID NO: 151960 - DNA, 22 bp, Artificial Sequence
  Synthetic oligonucleotide; TTG chr11 5176721 5176742 5176726 5176721 -
agaaatctgaggtactatctta

SEQ ID NO: 151961 - DNA, 22 bp, Artificial Sequence
  Synthetic oligonucleotide; CTG chr11 5176712 5176733 5176717 5176712 -
aggtactatcttaaacacttga

SEQ ID NO: 151962 - DNA, 22 bp, Artificial Sequence
  Synthetic oligonucleotide; CTA chr11 5176704 5176725 5176709 5176704 -
tcttaaacacttgaaatctact

SEQ ID NO: 151963 - DNA, 22 bp, Artificial Sequence
  Synthetic oligonucleotide; CTT chr11 5176700 5176721 5176705 5176700 -
aaacacttgaaatctactcatg

SEQ ID NO: 151964 - DNA, 22 bp, Artificial Sequence
  Synthetic oligonucleotide; TTA chr11 5176699 5176720 5176704 5176699 -
aacacttgaaatctactcatgc

SEQ ID NO: 151965 - DNA, 22 bp, Artificial Sequence
  Synthetic oligonucleotide; CTT chr11 5176692 5176713 5176697 5176692 -
gaaatctactcatgcttggctt

SEQ ID NO: 151966 - DNA, 22 bp, Artificial Sequence
  Synthetic oligonucleotide; TTG chr11 5176691 5176712 5176696 5176691 -
aaatctactcatgcttggctta

SEQ ID NO: 151967 - DNA, 22 bp, Artificial Sequence
  Synthetic oligonucleotide; CTA chr11 5176684 5176705 5176689 5176684 -
ctcatgcttggcttatgcttag

SEQ ID NO: 151968 - DNA, 22 bp, Artificial Sequence
  Synthetic oligonucleotide; CTC chr11 5176681 5176702 5176686 5176681 -
atgcttggcttatgcttagctt

SEQ ID NO: 151969 - DNA, 22 bp, Artificial Sequence
  Synthetic oligonucleotide; CTT chr11 5176675 5176696 5176680 5176675 -
ggcttatgcttagctttttctg

SEQ ID NO: 151970 - DNA, 22 bp, Artificial Sequence
  Synthetic oligonucleotide; TTG chr11 5176674 5176695 5176679 5176674 -
gcttatgcttagctttttctgt

SEQ ID NO: 151971 - DNA, 22 bp, Artificial Sequence
  Synthetic oligonucleotide; CTT chr11 5176670 5176691 5176675 5176670 -
atgcttagctttttctgtgatt

SEQ ID NO: 151972 - DNA, 22 bp, Artificial Sequence
  Synthetic oligonucleotide; TTA chr11 5176669 5176690 5176674 5176669 -
tgcttagctttttctgtgattt

SEQ ID NO: 151973 - DNA, 22 bp, Artificial Sequence
  Synthetic oligonucleotide; CTT chr11 5176664 5176685 5176669 5176664 -
agctttttctgtgatttttata

SEQ ID NO: 151974 - DNA, 22 bp, Artificial Sequence
  Synthetic oligonucleotide; TTA chr11 5176663 5176684 5176668 5176663 -
gctttttctgtgatttttatag

SEQ ID NO: 151975 - DNA, 22 bp, Artificial Sequence
  Synthetic oligonucleotide; CTT chr11 5176659 5176680 5176664 5176659 -
tttctgtgatttttatagaaat

SEQ ID NO: 151976 - DNA, 22 bp, Artificial Sequence
  Synthetic oligonucleotide; TTT chr11 5176658 5176679 5176663 5176658 -
ttctgtgatttttatagaaatt

SEQ ID NO: 151977 - DNA, 22 bp, Artificial Sequence
  Synthetic oligonucleotide; TTT chr11 5176657 5176678 5176662 5176657 -
tctgtgatttttatagaaattt

SEQ ID NO: 151978 - DNA, 22 bp, Artificial Sequence
  Synthetic oligonucleotide; TTT chr11 5176656 5176677 5176661 5176656 -
ctgtgatttttatagaaattta

SEQ ID NO: 151979 - DNA, 22 bp, Artificial Sequence
  Synthetic oligonucleotide; TTC chr11 5176655 5176676 5176660 5176655 -
tgtgatttttatagaaatttat

SEQ ID NO: 151980 - DNA, 22 bp, Artificial Sequence
  Synthetic oligonucleotide; CTG chr11 5176653 5176674 5176658 5176653 -
tgatttttatagaaatttatac

SEQ ID NO: 151981 - DNA, 22 bp, Artificial Sequence
  Synthetic oligonucleotide; TTT chr11 5176647 5176668 5176652 5176647 -
ttatagaaatttatacatgtat

SEQ ID NO: 151982 - DNA, 22 bp, Artificial Sequence
  Synthetic oligonucleotide; TTT chr11 5176646 5176667 5176651 5176646 -
tatagaaatttatacatgtatt

SEQ ID NO: 151983 - DNA, 22 bp, Artificial Sequence
  Synthetic oligonucleotide; TTT chr11 5176645 5176666 5176650 5176645 -
atagaaatttatacatgtatta

SEQ ID NO: 151984 - DNA, 22 bp, Artificial Sequence
  Synthetic oligonucleotide; TTA chr11 5176644 5176665 5176649 5176644 -
tagaaatttatacatgtattaa

SEQ ID NO: 151985 - DNA, 22 bp, Artificial Sequence
  Synthetic oligonucleotide; TTT chr11 5176635 5176656 5176640 5176635 -
atacatgtattaacacttagat

SEQ ID NO: 151986 - DNA, 22 bp, Artificial Sequence
  Synthetic oligonucleotide; TTA chr11 5176634 5176655 5176639 5176634 -
tacatgtattaacacttagatt

SEQ ID NO: 151987 - DNA, 22 bp, Artificial Sequence
  Synthetic oligonucleotide; TTA chr11 5176623 5176644 5176628 5176623 -
acacttagatttacatatacac

SEQ ID NO: 151988 - DNA, 22 bp, Artificial Sequence
  Synthetic oligonucleotide; CTT chr11 5176617 5176638 5176622 5176617 -
agatttacatatacacacactt

SEQ ID NO: 151989 - DNA, 22 bp, Artificial Sequence
  Synthetic oligonucleotide; TTA chr11 5176616 5176637 5176621 5176616 -
gatttacatatacacacactta

SEQ ID NO: 151990 - DNA, 22 bp, Artificial Sequence
  Synthetic oligonucleotide; TTT chr11 5176611 5176632 5176616 5176611 -
acatatacacacacttaattta

SEQ ID NO: 151991 - DNA, 22 bp, Artificial Sequence
  Synthetic oligonucleotide; TTA chr11 5176610 5176631 5176615 5176610 -
catatacacacacttaatttat

SEQ ID NO: 151992 - DNA, 22 bp, Artificial Sequence
  Synthetic oligonucleotide; CTT chr11 5176595 5176616 5176600 5176595 -
aatttatctacatttatatgtg

SEQ ID NO: 151993 - DNA, 22 bp, Artificial Sequence
  Synthetic oligonucleotide; TTA chr11 5176594 5176615 5176599 5176594 -
atttatctacatttatatgtgg

SEQ ID NO: 151994 - DNA, 22 bp, Artificial Sequence
  Synthetic oligonucleotide; TTT chr11 5176590 5176611 5176595 5176590 -
atctacatttatatgtggatgt

SEQ ID NO: 151995 - DNA, 22 bp, Artificial Sequence
  Synthetic oligonucleotide; TTA chr11 5176589 5176610 5176594 5176589 -
tctacatttatatgtggatgta

SEQ ID NO: 151996 - DNA, 22 bp, Artificial Sequence
  Synthetic oligonucleotide; CTA chr11 5176585 5176606 5176590 5176585 -
catttatatgtggatgtacctt

SEQ ID NO: 151997 - DNA, 22 bp, Artificial Sequence
  Synthetic oligonucleotide; TTT chr11 5176580 5176601 5176585 5176580 -
atatgtggatgtaccttcatat

SEQ ID NO: 151998 - DNA, 22 bp, Artificial Sequence
  Synthetic oligonucleotide; TTA chr11 5176579 5176600 5176584 5176579 -
tatgtggatgtaccttcatata

SEQ ID NO: 151999 - DNA, 22 bp, Artificial Sequence
  Synthetic oligonucleotide; CTT chr11 5176563 5176584 5176568 5176563 -
catatatatgtacacacacaca

SEQ ID NO: 152000 - DNA, 22 bp, Artificial Sequence
  Synthetic oligonucleotide; TTC chr11 5176562 5176583 5176567 5176562 -
atatatatgtacacacacacac

SEQ ID NO: 152001 - DNA, 22 bp, Artificial Sequence
  Synthetic oligonucleotide; TTT chr11 5176494 5176515 5176499 5176494 -
gtgcaccaaagaataagaaagt

SEQ ID NO: 152002 - DNA, 22 bp, Artificial Sequence
  Synthetic oligonucleotide; TTG chr11 5176493 5176514 5176498 5176493 -
tgcaccaaagaataagaaagtt

SEQ ID NO: 152003 - DNA, 22 bp, Artificial Sequence
  Synthetic oligonucleotide; TTA chr11 5176470 5176491 5176475 5176470 -
gaaatagacttcctacagtatt

SEQ ID NO: 152004 - DNA, 22 bp, Artificial Sequence
  Synthetic oligonucleotide; CTT chr11 5176459 5176480 5176464 5176459 -
cctacagtatttccattattgg

SEQ ID NO: 152005 - DNA, 22 bp, Artificial Sequence
  Synthetic oligonucleotide; TTC chr11 5176458 5176479 5176463 5176458 -
ctacagtatttccattattggg

SEQ ID NO: 152006 - DNA, 22 bp, Artificial Sequence
  Synthetic oligonucleotide; CTA chr11 5176455 5176476 5176460 5176455 -
cagtatttccattattgggaag

SEQ ID NO: 152007 - DNA, 22 bp, Artificial Sequence
  Synthetic oligonucleotide; TTT chr11 5176447 5176468 5176452 5176447 -
ccattattgggaagggagaata

SEQ ID NO: 152008 - DNA, 22 bp, Artificial Sequence
  Synthetic oligonucleotide; TTC chr11 5176446 5176467 5176451 5176446 -
cattattgggaagggagaatac

SEQ ID NO: 152009 - DNA, 22 bp, Artificial Sequence
  Synthetic oligonucleotide; TTA chr11 5176441 5176462 5176446 5176441 -
ttgggaagggagaatacataaa

SEQ ID NO: 152010 - DNA, 22 bp, Artificial Sequence
  Synthetic oligonucleotide; TTG chr11 5176438 5176459 5176443 5176438 -
ggaagggagaatacataaaaca

SEQ ID NO: 152011 - DNA, 22 bp, Artificial Sequence
  Synthetic oligonucleotide; TTC chr11 5176413 5176434 5176418 5176413 -
taaaaaatctaattaatttgtt

SEQ ID NO: 152012 - DNA, 22 bp, Artificial Sequence
  Synthetic oligonucleotide; CTA chr11 5176411 5176432 5176416 5176411 -
aaaaatctaattaatttgtttc

SEQ ID NO: 152013 - DNA, 22 bp, Artificial Sequence
  Synthetic oligonucleotide; CTA chr11 5176402 5176423 5176407 5176402 -
attaatttgtttctgctagtac

SEQ ID NO: 152014 - DNA, 22 bp, Artificial Sequence
  Synthetic oligonucleotide; TTA chr11 5176398 5176419 5176403 5176398 -
atttgtttctgctagtactaca

SEQ ID NO: 152015 - DNA, 22 bp, Artificial Sequence
  Synthetic oligonucleotide; TTT chr11 5176394 5176415 5176399 5176394 -
gtttctgctagtactacactaa

SEQ ID NO: 152016 - DNA, 22 bp, Artificial Sequence
  Synthetic oligonucleotide; TTG chr11 5176393 5176414 5176398 5176393 -
tttctgctagtactacactaaa

SEQ ID NO: 152017 - DNA, 22 bp, Artificial Sequence
  Synthetic oligonucleotide; TTT chr11 5176390 5176411 5176395 5176390 -
ctgctagtactacactaaatat

SEQ ID NO: 152018 - DNA, 22 bp, Artificial Sequence
  Synthetic oligonucleotide; TTC chr11 5176389 5176410 5176394 5176389 -
tgctagtactacactaaatatt

SEQ ID NO: 152019 - DNA, 22 bp, Artificial Sequence
  Synthetic oligonucleotide; CTG chr11 5176387 5176408 5176392 5176387 -
ctagtactacactaaatattta

SEQ ID NO: 152020 - DNA, 22 bp, Artificial Sequence
  Synthetic oligonucleotide; CTA chr11 5176384 5176405 5176389 5176384 -
gtactacactaaatatttaagt

SEQ ID NO: 152021 - DNA, 22 bp, Artificial Sequence
  Synthetic oligonucleotide; CTA chr11 5176378 5176399 5176383 5176378 -
cactaaatatttaagtgctatt

SEQ ID NO: 152022 - DNA, 22 bp, Artificial Sequence
  Synthetic oligonucleotide; CTA chr11 5176373 5176394 5176378 5176373 -
aatatttaagtgctattttgaa

SEQ ID NO: 152023 - DNA, 22 bp, Artificial Sequence
  Synthetic oligonucleotide; TTT chr11 5176366 5176387 5176371 5176366 -
aagtgctattttgaattgtctt

SEQ ID NO: 152024 - DNA, 22 bp, Artificial Sequence
  Synthetic oligonucleotide; TTA chr11 5176365 5176386 5176370 5176365 -
agtgctattttgaattgtcttc

SEQ ID NO: 152025 - DNA, 22 bp, Artificial Sequence
  Synthetic oligonucleotide; CTA chr11 5176358 5176379 5176363 5176358 -
ttttgaattgtcttcaaaatat

SEQ ID NO: 152026 - DNA, 22 bp, Artificial Sequence
  Synthetic oligonucleotide; TTT chr11 5176355 5176376 5176360 5176355 -
tgaattgtcttcaaaatatttg

SEQ ID NO: 152027 - DNA, 22 bp, Artificial Sequence
  Synthetic oligonucleotide; TTT chr11 5176354 5176375 5176359 5176354 -
gaattgtcttcaaaatatttgc

SEQ ID NO: 152028 - DNA, 22 bp, Artificial Sequence
  Synthetic oligonucleotide; TTG chr11 5176353 5176374 5176358 5176353 -
aattgtcttcaaaatatttgca

SEQ ID NO: 152029 - DNA, 22 bp, Artificial Sequence
  Synthetic oligonucleotide; TTG chr11 5176348 5176369 5176353 5176348 -
tcttcaaaatatttgcatttct

SEQ ID NO: 152030 - DNA, 22 bp, Artificial Sequence
  Synthetic oligonucleotide; CTT chr11 5176344 5176365 5176349 5176344 -
caaaatatttgcatttctcagt

SEQ ID NO: 152031 - DNA, 22 bp, Artificial Sequence
  Synthetic oligonucleotide; TTC chr11 5176343 5176364 5176348 5176343 -
aaaatatttgcatttctcagta

SEQ ID NO: 152032 - DNA, 22 bp, Artificial Sequence
  Synthetic oligonucleotide; TTT chr11 5176334 5176355 5176339 5176334 -
gcatttctcagtacatctgtta

SEQ ID NO: 152033 - DNA, 22 bp, Artificial Sequence
  Synthetic oligonucleotide; TTG chr11 5176333 5176354 5176338 5176333 -
catttctcagtacatctgttaa

SEQ ID NO: 152034 - DNA, 22 bp, Artificial Sequence
  Synthetic oligonucleotide; TTT chr11 5176328 5176349 5176333 5176328 -
ctcagtacatctgttaaacttc

SEQ ID NO: 152035 - DNA, 22 bp, Artificial Sequence
  Synthetic oligonucleotide; TTC chr11 5176327 5176348 5176332 5176327 -
tcagtacatctgttaaacttca

SEQ ID NO: 152036 - DNA, 22 bp, Artificial Sequence
  Synthetic oligonucleotide; CTC chr11 5176325 5176346 5176330 5176325 -
agtacatctgttaaacttcata

SEQ ID NO: 152037 - DNA, 22 bp, Artificial Sequence
  Synthetic oligonucleotide; CTG chr11 5176315 5176336 5176320 5176315 -
ttaaacttcatatagttttttt

SEQ ID NO: 152038 - DNA, 22 bp, Artificial Sequence
  Synthetic oligonucleotide; TTA chr11 5176312 5176333 5176317 5176312 -
aacttcatatagtttttttttc

SEQ ID NO: 152039 - DNA, 22 bp, Artificial Sequence
  Synthetic oligonucleotide; CTT chr11 5176307 5176328 5176312 5176307 -
catatagtttttttttctactc

SEQ ID NO: 152040 - DNA, 22 bp, Artificial Sequence
  Synthetic oligonucleotide; TTC chr11 5176306 5176327 5176311 5176306 -
atatagtttttttttctactct

SEQ ID NO: 152041 - DNA, 22 bp, Artificial Sequence
  Synthetic oligonucleotide; TTT chr11 5176297 5176318 5176302 5176297 -
ttttttctactctacacaatgt

SEQ ID NO: 152042 - DNA, 22 bp, Artificial Sequence
  Synthetic oligonucleotide; TTT chr11 5176296 5176317 5176301 5176296 -
tttttctactctacacaatgtt

SEQ ID NO: 152043 - DNA, 22 bp, Artificial Sequence
  Synthetic oligonucleotide; TTT chr11 5176295 5176316 5176300 5176295 -
ttttctactctacacaatgttt

SEQ ID NO: 152044 - DNA, 22 bp, Artificial Sequence
  Synthetic oligonucleotide; TTT chr11 5176294 5176315 5176299 5176294 -
tttctactctacacaatgtttt

SEQ ID NO: 152045 - DNA, 22 bp, Artificial Sequence
  Synthetic oligonucleotide; TTT chr11 5176293 5176314 5176298 5176293 -
ttctactctacacaatgttttg

SEQ ID NO: 152046 - DNA, 22 bp, Artificial Sequence
  Synthetic oligonucleotide; TTT chr11 5176292 5176313 5176297 5176292 -
tctactctacacaatgttttgg

SEQ ID NO: 152047 - DNA, 22 bp, Artificial Sequence
  Synthetic oligonucleotide; TTT chr11 5176291 5176312 5176296 5176291 -
ctactctacacaatgttttgga

SEQ ID NO: 152048 - DNA, 22 bp, Artificial Sequence
  Synthetic oligonucleotide; TTC chr11 5176290 5176311 5176295 5176290 -
tactctacacaatgttttggac

SEQ ID NO: 152049 - DNA, 22 bp, Artificial Sequence
  Synthetic oligonucleotide; CTA chr11 5176288 5176309 5176293 5176288 -
ctctacacaatgttttggacat

SEQ ID NO: 152050 - DNA, 22 bp, Artificial Sequence
  Synthetic oligonucleotide; CTC chr11 5176285 5176306 5176290 5176285 -
tacacaatgttttggacattct

SEQ ID NO: 152051 - DNA, 22 bp, Artificial Sequence
  Synthetic oligonucleotide; CTA chr11 5176283 5176304 5176288 5176283 -
cacaatgttttggacattctaa

SEQ ID NO: 152052 - DNA, 22 bp, Artificial Sequence
  Synthetic oligonucleotide; TTT chr11 5176273 5176294 5176278 5176273 -
tggacattctaatgtgaaattt

SEQ ID NO: 152053 - DNA, 22 bp, Artificial Sequence
  Synthetic oligonucleotide; TTT chr11 5176272 5176293 5176277 5176272 -
ggacattctaatgtgaaattta

SEQ ID NO: 152054 - DNA, 22 bp, Artificial Sequence
  Synthetic oligonucleotide; TTG chr11 5176271 5176292 5176276 5176271 -
gacattctaatgtgaaatttac

SEQ ID NO: 152055 - DNA, 22 bp, Artificial Sequence
  Synthetic oligonucleotide; TTC chr11 5176264 5176285 5176269 5176264 -
taatgtgaaatttacactcagc

SEQ ID NO: 152056 - DNA, 22 bp, Artificial Sequence
  Synthetic oligonucleotide; CTA chr11 5176262 5176283 5176267 5176262 -
atgtgaaatttacactcagcgt

SEQ ID NO: 152057 - DNA, 22 bp, Artificial Sequence
  Synthetic oligonucleotide; TTT chr11 5176251 5176272 5176256 5176251 -
acactcagcgttgcatttctcc

SEQ ID NO: 152058 - DNA, 22 bp, Artificial Sequence
  Synthetic oligonucleotide; TTA chr11 5176250 5176271 5176255 5176250 -
cactcagcgttgcatttctcca

SEQ ID NO: 152059 - DNA, 22 bp, Artificial Sequence
  Synthetic oligonucleotide; CTC chr11 5176245 5176266 5176250 5176245 -
agcgttgcatttctccataaaa

SEQ ID NO: 152060 - DNA, 22 bp, Artificial Sequence
  Synthetic oligonucleotide; TTG chr11 5176238 5176259 5176243 5176238 -
catttctccataaaagtaataa

SEQ ID NO: 152061 - DNA, 22 bp, Artificial Sequence
  Synthetic oligonucleotide; TTT chr11 5176233 5176254 5176238 5176233 -
ctccataaaagtaataatatga

SEQ ID NO: 152062 - DNA, 22 bp, Artificial Sequence
  Synthetic oligonucleotide; TTC chr11 5176232 5176253 5176237 5176232 -
tccataaaagtaataatatgat

SEQ ID NO: 152063 - DNA, 22 bp, Artificial Sequence
  Synthetic oligonucleotide; CTC chr11 5176230 5176251 5176235 5176230 -
cataaaagtaataatatgatgg

SEQ ID NO: 152064 - DNA, 22 bp, Artificial Sequence
  Synthetic oligonucleotide; TTG chr11 5176185 5176206 5176190 5176185 -
cagtatgatgacagaggatttg

SEQ ID NO: 152065 - DNA, 22 bp, Artificial Sequence
  Synthetic oligonucleotide; TTT chr11 5176164 5176185 5176169 5176164 -
gactgaaaggtaggaagatttt

SEQ ID NO: 152066 - DNA, 22 bp, Artificial Sequence
  Synthetic oligonucleotide; TTG chr11 5176163 5176184 5176168 5176163 -
actgaaaggtaggaagattttg

SEQ ID NO: 152067 - DNA, 22 bp, Artificial Sequence
  Synthetic oligonucleotide; CTG chr11 5176159 5176180 5176164 5176159 -
aaaggtaggaagattttgtata

SEQ ID NO: 152068 - DNA, 22 bp, Artificial Sequence
  Synthetic oligonucleotide; TTT chr11 5176143 5176164 5176148 5176143 -
tgtatacttgattttagcagtg

SEQ ID NO: 152069 - DNA, 22 bp, Artificial Sequence
  Synthetic oligonucleotide; TTT chr11 5176142 5176163 5176147 5176142 -
gtatacttgattttagcagtgg

SEQ ID NO: 152070 - DNA, 22 bp, Artificial Sequence
  Synthetic oligonucleotide; TTG chr11 5176141 5176162 5176146 5176141 -
tatacttgattttagcagtggg

SEQ ID NO: 152071 - DNA, 22 bp, Artificial Sequence
  Synthetic oligonucleotide; CTT chr11 5176134 5176155 5176139 5176134 -
gattttagcagtggggagctaa

SEQ ID NO: 152072 - DNA, 22 bp, Artificial Sequence
  Synthetic oligonucleotide; TTG chr11 5176133 5176154 5176138 5176133 -
attttagcagtggggagctaag

SEQ ID NO: 152073 - DNA, 22 bp, Artificial Sequence
  Synthetic oligonucleotide; TTT chr11 5176129 5176150 5176134 5176129 -
tagcagtggggagctaagaaaa

SEQ ID NO: 152074 - DNA, 22 bp, Artificial Sequence
  Synthetic oligonucleotide; TTT chr11 5176128 5176149 5176133 5176128 -
agcagtggggagctaagaaaat

SEQ ID NO: 152075 - DNA, 22 bp, Artificial Sequence
  Synthetic oligonucleotide; TTA chr11 5176127 5176148 5176132 5176127 -
gcagtggggagctaagaaaatg

SEQ ID NO: 152076 - DNA, 22 bp, Artificial Sequence
  Synthetic oligonucleotide; CTA chr11 5176113 5176134 5176118 5176113 -
agaaaatgccaatttcacatcc

SEQ ID NO: 152077 - DNA, 22 bp, Artificial Sequence
  Synthetic oligonucleotide; TTT chr11 5176098 5176119 5176103 5176098 -
cacatccaaaatgcatgcaaca

SEQ ID NO: 152078 - DNA, 22 bp, Artificial Sequence
  Synthetic oligonucleotide; TTC chr11 5176097 5176118 5176102 5176097 -
acatccaaaatgcatgcaacat

SEQ ID NO: 152079 - DNA, 22 bp, Artificial Sequence
  Synthetic oligonucleotide; CTT chr11 5176067 5176088 5176072 5176067 -
aaataggtatatgaatatatat

SEQ ID NO: 152080 - DNA, 22 bp, Artificial Sequence
  Synthetic oligonucleotide; TTA chr11 5176066 5176087 5176071 5176066 -
aataggtatatgaatatatata

SEQ ID NO: 152081 - DNA, 22 bp, Artificial Sequence
  Synthetic oligonucleotide; CTA chr11 5176022 5176043 5176027 5176022 -
cacagtaacatatacatgtcat

SEQ ID NO: 152082 - DNA, 22 bp, Artificial Sequence
  Synthetic oligonucleotide; TTT chr11 5175998 5176019 5176003 5175998 -
tgacagttaaaatggtagaagt

SEQ ID NO: 152083 - DNA, 22 bp, Artificial Sequence
  Synthetic oligonucleotide; TTT chr11 5175997 5176018 5176002 5175997 -
gacagttaaaatggtagaagta

SEQ ID NO: 152084 - DNA, 22 bp, Artificial Sequence
  Synthetic oligonucleotide; TTG chr11 5175996 5176017 5176001 5175996 -
acagttaaaatggtagaagtaa

SEQ ID NO: 152085 - DNA, 22 bp, Artificial Sequence
  Synthetic oligonucleotide; TTA chr11 5175989 5176010 5175994 5175989 -
aaatggtagaagtaaaaatgat

SEQ ID NO: 152086 - DNA, 22 bp, Artificial Sequence
  Synthetic oligonucleotide; TTG chr11 5175965 5175986 5175970 5175965 -
aatttacaatctctaaataaac

SEQ ID NO: 152087 - DNA, 22 bp, Artificial Sequence
  Synthetic oligonucleotide; TTT chr11 5175960 5175981 5175965 5175960 -
acaatctctaaataaactttca

SEQ ID NO: 152088 - DNA, 22 bp, Artificial Sequence
  Synthetic oligonucleotide; TTA chr11 5175959 5175980 5175964 5175959 -
caatctctaaataaactttcag

SEQ ID NO: 152089 - DNA, 22 bp, Artificial Sequence
  Synthetic oligonucleotide; CTC chr11 5175952 5175973 5175957 5175952 -
taaataaactttcagttgagca

SEQ ID NO: 152090 - DNA, 22 bp, Artificial Sequence
  Synthetic oligonucleotide; CTA chr11 5175950 5175971 5175955 5175950 -
aataaactttcagttgagcact

SEQ ID NO: 152091 - DNA, 22 bp, Artificial Sequence
  Synthetic oligonucleotide; CTT chr11 5175941 5175962 5175946 5175941 -
tcagttgagcactcagattctg

SEQ ID NO: 152092 - DNA, 22 bp, Artificial Sequence
  Synthetic oligonucleotide; TTT chr11 5175940 5175961 5175945 5175940 -
cagttgagcactcagattctga

SEQ ID NO: 152093 - DNA, 22 bp, Artificial Sequence
  Synthetic oligonucleotide; TTC chr11 5175939 5175960 5175944 5175939 -
agttgagcactcagattctgaa

SEQ ID NO: 152094 - DNA, 22 bp, Artificial Sequence
  Synthetic oligonucleotide; TTG chr11 5175934 5175955 5175939 5175934 -
agcactcagattctgaaaggat

SEQ ID NO: 152095 - DNA, 22 bp, Artificial Sequence
  Synthetic oligonucleotide; CTC chr11 5175927 5175948 5175932 5175927 -
agattctgaaaggatttaggaa

SEQ ID NO: 152096 - DNA, 22 bp, Artificial Sequence
  Synthetic oligonucleotide; TTC chr11 5175921 5175942 5175926 5175921 -
tgaaaggatttaggaaatggct

SEQ ID NO: 152097 - DNA, 22 bp, Artificial Sequence
  Synthetic oligonucleotide; CTG chr11 5175919 5175940 5175924 5175919 -
aaaggatttaggaaatggctgt

SEQ ID NO: 152098 - DNA, 22 bp, Artificial Sequence
  Synthetic oligonucleotide; TTT chr11 5175910 5175931 5175915 5175910 -
aggaaatggctgttgctatgca

SEQ ID NO: 152099 - DNA, 22 bp, Artificial Sequence
  Synthetic oligonucleotide; TTA chr11 5175909 5175930 5175914 5175909 -
ggaaatggctgttgctatgcag

SEQ ID NO: 152100 - DNA, 22 bp, Artificial Sequence
  Synthetic oligonucleotide; CTG chr11 5175898 5175919 5175903 5175898 -
ttgctatgcagctgctgaattt

SEQ ID NO: 152101 - DNA, 22 bp, Artificial Sequence
  Synthetic oligonucleotide; TTG chr11 5175895 5175916 5175900 5175895 -
ctatgcagctgctgaatttaac

SEQ ID NO: 152102 - DNA, 22 bp, Artificial Sequence
  Synthetic oligonucleotide; CTA chr11 5175892 5175913 5175897 5175892 -
tgcagctgctgaatttaacatt

SEQ ID NO: 152103 - DNA, 22 bp, Artificial Sequence
  Synthetic oligonucleotide; CTG chr11 5175884 5175905 5175889 5175884 -
ctgaatttaacattactgagcc

SEQ ID NO: 152104 - DNA, 22 bp, Artificial Sequence
  Synthetic oligonucleotide; CTG chr11 5175881 5175902 5175886 5175881 -
aatttaacattactgagccatt

SEQ ID NO: 152105 - DNA, 22 bp, Artificial Sequence
  Synthetic oligonucleotide; TTT chr11 5175876 5175897 5175881 5175876 -
aacattactgagccattgccct

SEQ ID NO: 152106 - DNA, 22 bp, Artificial Sequence
  Synthetic oligonucleotide; TTA chr11 5175875 5175896 5175880 5175875 -
acattactgagccattgccctg

SEQ ID NO: 152107 - DNA, 22 bp, Artificial Sequence
  Synthetic oligonucleotide; TTA chr11 5175869 5175890 5175874 5175869 -
ctgagccattgccctggacatg

SEQ ID NO: 152108 - DNA, 22 bp, Artificial Sequence
  Synthetic oligonucleotide; CTG chr11 5175866 5175887 5175871 5175866 -
agccattgccctggacatgaga

SEQ ID NO: 152109 - DNA, 22 bp, Artificial Sequence
  Synthetic oligonucleotide; TTG chr11 5175858 5175879 5175863 5175858 -
ccctggacatgagaagaagttt

SEQ ID NO: 152110 - DNA, 22 bp, Artificial Sequence
  Synthetic oligonucleotide; CTG chr11 5175853 5175874 5175858 5175853 -
gacatgagaagaagttttcatg

SEQ ID NO: 152111 - DNA, 22 bp, Artificial Sequence
  Synthetic oligonucleotide; TTT chr11 5175836 5175857 5175841 5175836 -
tcatgttctactgtctccttaa

SEQ ID NO: 152112 - DNA, 22 bp, Artificial Sequence
  Synthetic oligonucleotide; TTT chr11 5175835 5175856 5175840 5175835 -
catgttctactgtctccttaac

SEQ ID NO: 152113 - DNA, 22 bp, Artificial Sequence
  Synthetic oligonucleotide; TTC chr11 5175834 5175855 5175839 5175834 -
atgttctactgtctccttaacc

SEQ ID NO: 152114 - DNA, 22 bp, Artificial Sequence
  Synthetic oligonucleotide; TTC chr11 5175828 5175849 5175833 5175828 -
tactgtctccttaaccagtaat

SEQ ID NO: 152115 - DNA, 22 bp, Artificial Sequence
  Synthetic oligonucleotide; CTA chr11 5175826 5175847 5175831 5175826 -
ctgtctccttaaccagtaatcc

SEQ ID NO: 152116 - DNA, 22 bp, Artificial Sequence
  Synthetic oligonucleotide; CTG chr11 5175823 5175844 5175828 5175823 -
tctccttaaccagtaatccttc

SEQ ID NO: 152117 - DNA, 22 bp, Artificial Sequence
  Synthetic oligonucleotide; CTC chr11 5175819 5175840 5175824 5175819 -
cttaaccagtaatccttcagca

SEQ ID NO: 152118 - DNA, 22 bp, Artificial Sequence
  Synthetic oligonucleotide; CTT chr11 5175816 5175837 5175821 5175816 -
aaccagtaatccttcagcagga

SEQ ID NO: 152119 - DNA, 22 bp, Artificial Sequence
  Synthetic oligonucleotide; TTA chr11 5175815 5175836 5175820 5175815 -
accagtaatccttcagcaggaa

SEQ ID NO: 152120 - DNA, 22 bp, Artificial Sequence
  Synthetic oligonucleotide; CTT chr11 5175802 5175823 5175807 5175802 -
cagcaggaagggaaagggaaag

SEQ ID NO: 152121 - DNA, 22 bp, Artificial Sequence
  Synthetic oligonucleotide; TTC chr11 5175801 5175822 5175806 5175801 -
agcaggaagggaaagggaaagg

SEQ ID NO: 152122 - DNA, 22 bp, Artificial Sequence
  Synthetic oligonucleotide; TTT chr11 5175639 5175660 5175644 5175639 -
taaagcagggagttttggaagc

SEQ ID NO: 152123 - DNA, 22 bp, Artificial Sequence
  Synthetic oligonucleotide; TTT chr11 5175638 5175659 5175643 5175638 -
aaagcagggagttttggaagca

SEQ ID NO: 152124 - DNA, 22 bp, Artificial Sequence
  Synthetic oligonucleotide; TTA chr11 5175637 5175658 5175642 5175637 -
aagcagggagttttggaagcac

SEQ ID NO: 152125 - DNA, 22 bp, Artificial Sequence
  Synthetic oligonucleotide; TTT chr11 5175624 5175645 5175629 5175624 -
tggaagcacttagctaaaactg

SEQ ID NO: 152126 - DNA, 22 bp, Artificial Sequence
  Synthetic oligonucleotide; TTT chr11 5175623 5175644 5175628 5175623 -
ggaagcacttagctaaaactga

SEQ ID NO: 152127 - DNA, 22 bp, Artificial Sequence
  Synthetic oligonucleotide; TTG chr11 5175622 5175643 5175627 5175622 -
gaagcacttagctaaaactgat

SEQ ID NO: 152128 - DNA, 22 bp, Artificial Sequence
  Synthetic oligonucleotide; CTT chr11 5175613 5175634 5175618 5175613 -
agctaaaactgatatggtgttc

SEQ ID NO: 152129 - DNA, 22 bp, Artificial Sequence
  Synthetic oligonucleotide; TTA chr11 5175612 5175633 5175617 5175612 -
gctaaaactgatatggtgttct

SEQ ID NO: 152130 - DNA, 22 bp, Artificial Sequence
  Synthetic oligonucleotide; CTA chr11 5175608 5175629 5175613 5175608 -
aaactgatatggtgttctagac

SEQ ID NO: 152131 - DNA, 22 bp, Artificial Sequence
  Synthetic oligonucleotide; CTG chr11 5175602 5175623 5175607 5175602 -
atatggtgttctagacagaatt

SEQ ID NO: 152132 - DNA, 22 bp, Artificial Sequence
  Synthetic oligonucleotide; TTC chr11 5175591 5175612 5175596 5175591 -
tagacagaattagcaaaaacaa

SEQ ID NO: 152133 - DNA, 22 bp, Artificial Sequence
  Synthetic oligonucleotide; CTA chr11 5175589 5175610 5175594 5175589 -
gacagaattagcaaaaacaaaa

SEQ ID NO: 152134 - DNA, 22 bp, Artificial Sequence
  Synthetic oligonucleotide; TTA chr11 5175579 5175600 5175584 5175579 -
gcaaaaacaaaaaacaaaaggt

SEQ ID NO: 152135 - DNA, 22 bp, Artificial Sequence
  Synthetic oligonucleotide; CTA chr11 5175546 5175567 5175551 5175546 -
agtgattgataaggtgagaata

SEQ ID NO: 152136 - DNA, 22 bp, Artificial Sequence
  Synthetic oligonucleotide; TTG chr11 5175538 5175559 5175543 5175538 -
ataaggtgagaatagtatttca

SEQ ID NO: 152137 - DNA, 22 bp, Artificial Sequence
  Synthetic oligonucleotide; TTT chr11 5175518 5175539 5175523 5175518 -
caaatgagcaagagatccaaga

SEQ ID NO: 152138 - DNA, 22 bp, Artificial Sequence
  Synthetic oligonucleotide; TTC chr11 5175517 5175538 5175522 5175517 -
aaatgagcaagagatccaagac

SEQ ID NO: 152139 - DNA, 22 bp, Artificial Sequence
  Synthetic oligonucleotide; CTA chr11 5175484 5175505 5175489 5175484 -
cagactattgttttataactga

SEQ ID NO: 152140 - DNA, 22 bp, Artificial Sequence
  Synthetic oligonucleotide; CTA chr11 5175477 5175498 5175482 5175477 -
ttgttttataactgaggtctta

SEQ ID NO: 152141 - DNA, 22 bp, Artificial Sequence
  Synthetic oligonucleotide; TTG chr11 5175474 5175495 5175479 5175474 -
ttttataactgaggtcttagtt

SEQ ID NO: 152142 - DNA, 22 bp, Artificial Sequence
  Synthetic oligonucleotide; TTT chr11 5175471 5175492 5175476 5175471 -
tataactgaggtcttagttaat

SEQ ID NO: 152143 - DNA, 22 bp, Artificial Sequence
  Synthetic oligonucleotide; TTT chr11 5175470 5175491 5175475 5175470 -
ataactgaggtcttagttaata

SEQ ID NO: 152144 - DNA, 22 bp, Artificial Sequence
  Synthetic oligonucleotide; TTA chr11 5175469 5175490 5175474 5175469 -
taactgaggtcttagttaatat

SEQ ID NO: 152145 - DNA, 22 bp, Artificial Sequence
  Synthetic oligonucleotide; CTG chr11 5175463 5175484 5175468 5175463 -
aggtcttagttaatatcaatca

SEQ ID NO: 152146 - DNA, 22 bp, Artificial Sequence
  Synthetic oligonucleotide; CTT chr11 5175456 5175477 5175461 5175456 -
agttaatatcaatcaagcaaaa

SEQ ID NO: 152147 - DNA, 22 bp, Artificial Sequence
  Synthetic oligonucleotide; TTA chr11 5175455 5175476 5175460 5175455 -
gttaatatcaatcaagcaaaat

SEQ ID NO: 152148 - DNA, 22 bp, Artificial Sequence
  Synthetic oligonucleotide; TTA chr11 5175451 5175472 5175456 5175451 -
atatcaatcaagcaaaattttg

SEQ ID NO: 152149 - DNA, 22 bp, Artificial Sequence
  Synthetic oligonucleotide; TTT chr11 5175431 5175452 5175436 5175431 -
tgatttcggggggagaaaaaag

SEQ ID NO: 152150 - DNA, 22 bp, Artificial Sequence
  Synthetic oligonucleotide; TTT chr11 5175430 5175451 5175435 5175430 -
gatttcggggggagaaaaaaga

SEQ ID NO: 152151 - DNA, 22 bp, Artificial Sequence
  Synthetic oligonucleotide; TTG chr11 5175429 5175450 5175434 5175429 -
atttcggggggagaaaaaagac

SEQ ID NO: 152152 - DNA, 22 bp, Artificial Sequence
  Synthetic oligonucleotide; TTT chr11 5175425 5175446 5175430 5175425 -
cggggggagaaaaaagaccaaa

SEQ ID NO: 152153 - DNA, 22 bp, Artificial Sequence
  Synthetic oligonucleotide; TTC chr11 5175424 5175445 5175429 5175424 -
ggggggagaaaaaagaccaaat

SEQ ID NO: 152154 - DNA, 22 bp, Artificial Sequence
  Synthetic oligonucleotide; TTG chr11 5175400 5175421 5175405 5175400 -
taatctggggtgtatttcttta

SEQ ID NO: 152155 - DNA, 22 bp, Artificial Sequence
  Synthetic oligonucleotide; CTG chr11 5175393 5175414 5175398 5175393 -
gggtgtatttctttatttacat

SEQ ID NO: 152156 - DNA, 22 bp, Artificial Sequence
  Synthetic oligonucleotide; TTT chr11 5175383 5175404 5175388 5175383 -
ctttatttacatctttgccttt

SEQ ID NO: 152157 - DNA, 22 bp, Artificial Sequence
  Synthetic oligonucleotide; TTC chr11 5175382 5175403 5175387 5175382 -
tttatttacatctttgccttta

SEQ ID NO: 152158 - DNA, 22 bp, Artificial Sequence
  Synthetic oligonucleotide; CTT chr11 5175380 5175401 5175385 5175380 -
tatttacatctttgcctttatt

SEQ ID NO: 152159 - DNA, 22 bp, Artificial Sequence
  Synthetic oligonucleotide; TTT chr11 5175379 5175400 5175384 5175379 -
atttacatctttgcctttattt

SEQ ID NO: 152160 - DNA, 22 bp, Artificial Sequence
  Synthetic oligonucleotide; TTA chr11 5175378 5175399 5175383 5175378 -
tttacatctttgcctttatttt

SEQ ID NO: 152161 - DNA, 22 bp, Artificial Sequence
  Synthetic oligonucleotide; TTT chr11 5175375 5175396 5175380 5175375 -
acatctttgcctttatttttta

SEQ ID NO: 152162 - DNA, 22 bp, Artificial Sequence
  Synthetic oligonucleotide; TTA chr11 5175374 5175395 5175379 5175374 -
catctttgcctttattttttaa

SEQ ID NO: 152163 - DNA, 22 bp, Artificial Sequence
  Synthetic oligonucleotide; CTT chr11 5175368 5175389 5175373 5175368 -
tgcctttattttttaactttct

SEQ ID NO: 152164 - DNA, 22 bp, Artificial Sequence
  Synthetic oligonucleotide; TTT chr11 5175367 5175388 5175372 5175367 -
gcctttattttttaactttctt

SEQ ID NO: 152165 - DNA, 22 bp, Artificial Sequence
  Synthetic oligonucleotide; TTG chr11 5175366 5175387 5175371 5175366 -
cctttattttttaactttcttt

SEQ ID NO: 152166 - DNA, 22 bp, Artificial Sequence
  Synthetic oligonucleotide; CTT chr11 5175362 5175383 5175367 5175362 -
tattttttaactttcttttgta

SEQ ID NO: 152167 - DNA, 22 bp, Artificial Sequence
  Synthetic oligonucleotide; TTT chr11 5175361 5175382 5175366 5175361 -
attttttaactttcttttgtat

SEQ ID NO: 152168 - DNA, 22 bp, Artificial Sequence
  Synthetic oligonucleotide; TTA chr11 5175360 5175381 5175365 5175360 -
ttttttaactttcttttgtata

SEQ ID NO: 152169 - DNA, 22 bp, Artificial Sequence
  Synthetic oligonucleotide; TTT chr11 5175357 5175378 5175362 5175357 -
tttaactttcttttgtatatga

SEQ ID NO: 152170 - DNA, 22 bp, Artificial Sequence
  Synthetic oligonucleotide; TTT chr11 5175356 5175377 5175361 5175356 -
ttaactttcttttgtatatgat

SEQ ID NO: 152171 - DNA, 22 bp, Artificial Sequence
  Synthetic oligonucleotide; TTT chr11 5175355 5175376 5175360 5175355 -
taactttcttttgtatatgata

SEQ ID NO: 152172 - DNA, 22 bp, Artificial Sequence
  Synthetic oligonucleotide; TTT chr11 5175354 5175375 5175359 5175354 -
aactttcttttgtatatgatat

SEQ ID NO: 152173 - DNA, 22 bp, Artificial Sequence
  Synthetic oligonucleotide; TTA chr11 5175353 5175374 5175358 5175353 -
actttcttttgtatatgatatg

SEQ ID NO: 152174 - DNA, 22 bp, Artificial Sequence
  Synthetic oligonucleotide; CTT chr11 5175349 5175370 5175354 5175349 -
tcttttgtatatgatatgatca

SEQ ID NO: 152175 - DNA, 22 bp, Artificial Sequence
  Synthetic oligonucleotide; TTT chr11 5175348 5175369 5175353 5175348 -
cttttgtatatgatatgatcat

SEQ ID NO: 152176 - DNA, 22 bp, Artificial Sequence
  Synthetic oligonucleotide; TTC chr11 5175347 5175368 5175352 5175347 -
ttttgtatatgatatgatcatt

SEQ ID NO: 152177 - DNA, 22 bp, Artificial Sequence
  Synthetic oligonucleotide; CTT chr11 5175345 5175366 5175350 5175345 -
ttgtatatgatatgatcattta

SEQ ID NO: 152178 - DNA, 22 bp, Artificial Sequence
  Synthetic oligonucleotide; TTT chr11 5175344 5175365 5175349 5175344 -
tgtatatgatatgatcatttaa

SEQ ID NO: 152179 - DNA, 22 bp, Artificial Sequence
  Synthetic oligonucleotide; TTT chr11 5175343 5175364 5175348 5175343 -
gtatatgatatgatcatttaag

SEQ ID NO: 152180 - DNA, 22 bp, Artificial Sequence
  Synthetic oligonucleotide; TTG chr11 5175342 5175363 5175347 5175342 -
tatatgatatgatcatttaagt

SEQ ID NO: 152181 - DNA, 22 bp, Artificial Sequence
  Synthetic oligonucleotide; TTT chr11 5175324 5175345 5175329 5175324 -
aagtataagtcacctgaaagta

SEQ ID NO: 152182 - DNA, 22 bp, Artificial Sequence
  Synthetic oligonucleotide; TTA chr11 5175323 5175344 5175328 5175323 -
agtataagtcacctgaaagtaa

SEQ ID NO: 152183 - DNA, 22 bp, Artificial Sequence
  Synthetic oligonucleotide; CTG chr11 5175308 5175329 5175313 5175308 -
aaagtaaaaagagttatataag

SEQ ID NO: 152184 - DNA, 22 bp, Artificial Sequence
  Synthetic oligonucleotide; TTA chr11 5175292 5175313 5175297 5175292 -
tataaggacaacataaaaatca

SEQ ID NO: 152185 - DNA, 22 bp, Artificial Sequence
  Synthetic oligonucleotide; TTT chr11 5175261 5175282 5175266 5175261 -
tatgcaactgcaagaaccaata

SEQ ID NO: 152186 - DNA, 22 bp, Artificial Sequence
  Synthetic oligonucleotide; TTT chr11 5175260 5175281 5175265 5175260 -
atgcaactgcaagaaccaatag

SEQ ID NO: 152187 - DNA, 22 bp, Artificial Sequence
  Synthetic oligonucleotide; TTA chr11 5175259 5175280 5175264 5175259 -
tgcaactgcaagaaccaatagg

SEQ ID NO: 152188 - DNA, 22 bp, Artificial Sequence
  Synthetic oligonucleotide; CTG chr11 5175251 5175272 5175256 5175251 -
caagaaccaataggaaaataga

SEQ ID NO: 152189 - DNA, 22 bp, Artificial Sequence
  Synthetic oligonucleotide; TTC chr11 5175209 5175230 5175214 5175209 -
aaaatgatgatagaggccagac

SEQ ID NO: 152190 - DNA, 22 bp, Artificial Sequence
  Synthetic oligonucleotide; CTG chr11 5175170 5175191 5175175 5175170 -
taatcccagctacatgggaggc

SEQ ID NO: 152191 - DNA, 22 bp, Artificial Sequence
  Synthetic oligonucleotide; CTA chr11 5175158 5175179 5175163 5175158 -
catgggaggctgaggcaggaga

SEQ ID NO: 152192 - DNA, 22 bp, Artificial Sequence
  Synthetic oligonucleotide; CTG chr11 5175146 5175167 5175151 5175146 -
aggcaggagaatgatttgaatt

SEQ ID NO: 152193 - DNA, 22 bp, Artificial Sequence
  Synthetic oligonucleotide; TTT chr11 5175129 5175150 5175134 5175129 -
gaattctggaggcggaggttgc

SEQ ID NO: 152194 - DNA, 22 bp, Artificial Sequence
  Synthetic oligonucleotide; TTG chr11 5175128 5175149 5175133 5175128 -
aattctggaggcggaggttgca

SEQ ID NO: 152195 - DNA, 22 bp, Artificial Sequence
  Synthetic oligonucleotide; TTC chr11 5175123 5175144 5175128 5175123 -
tggaggcggaggttgcagtgag

SEQ ID NO: 152196 - DNA, 22 bp, Artificial Sequence
  Synthetic oligonucleotide; CTG chr11 5175121 5175142 5175126 5175121 -
gaggcggaggttgcagtgagcc

SEQ ID NO: 152197 - DNA, 22 bp, Artificial Sequence
  Synthetic oligonucleotide; TTG chr11 5175108 5175129 5175113 5175108 -
cagtgagccgagatcgcgtcac

SEQ ID NO: 152198 - DNA, 22 bp, Artificial Sequence
  Synthetic oligonucleotide; CTC chr11 5175083 5175104 5175088 5175083 -
actctagcctggaccacagaga

SEQ ID NO: 152199 - DNA, 22 bp, Artificial Sequence
  Synthetic oligonucleotide; CTC chr11 5175079 5175100 5175084 5175079 -
tagcctggaccacagagagaga

SEQ ID NO: 152200 - DNA, 22 bp, Artificial Sequence
  Synthetic oligonucleotide; CTA chr11 5175077 5175098 5175082 5175077 -
gcctggaccacagagagagact

SEQ ID NO: 152201 - DNA, 22 bp, Artificial Sequence
  Synthetic oligonucleotide; CTG chr11 5175072 5175093 5175077 5175072 -
gaccacagagagagactccatc

SEQ ID NO: 152202 - DNA, 22 bp, Artificial Sequence
  Synthetic oligonucleotide; CTC chr11 5175054 5175075 5175059 5175054 -
catctcaaaaaaaccaaaaata

SEQ ID NO: 152203 - DNA, 22 bp, Artificial Sequence
  Synthetic oligonucleotide; CTC chr11 5175048 5175069 5175053 5175048 -
aaaaaaaccaaaaatacgtaaa

SEQ ID NO: 152204 - DNA, 22 bp, Artificial Sequence
  Synthetic oligonucleotide; CTG chr11 5174974 5174995 5174979 5174974 -
tatatgtgcctaaaataaatga

SEQ ID NO: 152205 - DNA, 22 bp, Artificial Sequence
  Synthetic oligonucleotide; CTA chr11 5174962 5174983 5174967 5174962 -
aaataaatgaaataattgttta

SEQ ID NO: 152206 - DNA, 22 bp, Artificial Sequence
  Synthetic oligonucleotide; TTG chr11 5174944 5174965 5174949 5174944 -
tttattatacattgtttattgt

SEQ ID NO: 152207 - DNA, 22 bp, Artificial Sequence
  Synthetic oligonucleotide; TTT chr11 5174941 5174962 5174946 5174941 -
attatacattgtttattgtaac

SEQ ID NO: 152208 - DNA, 22 bp, Artificial Sequence
  Synthetic oligonucleotide; TTA chr11 5174940 5174961 5174945 5174940 -
ttatacattgtttattgtaaca

SEQ ID NO: 152209 - DNA, 22 bp, Artificial Sequence
  Synthetic oligonucleotide; TTA chr11 5174937 5174958 5174942 5174937 -
tacattgtttattgtaacaatt

SEQ ID NO: 152210 - DNA, 22 bp, Artificial Sequence
  Synthetic oligonucleotide; TTG chr11 5174930 5174951 5174935 5174930 -
tttattgtaacaattctctcag

SEQ ID NO: 152211 - DNA, 22 bp, Artificial Sequence
  Synthetic oligonucleotide; TTT chr11 5174927 5174948 5174932 5174927 -
attgtaacaattctctcagaaa

SEQ ID NO: 152212 - DNA, 22 bp, Artificial Sequence
  Synthetic oligonucleotide; TTA chr11 5174926 5174947 5174931 5174926 -
ttgtaacaattctctcagaaac

SEQ ID NO: 152213 - DNA, 22 bp, Artificial Sequence
  Synthetic oligonucleotide; TTG chr11 5174923 5174944 5174928 5174923 -
taacaattctctcagaaacaac

SEQ ID NO: 152214 - DNA, 22 bp, Artificial Sequence
  Synthetic oligonucleotide; TTC chr11 5174914 5174935 5174919 5174914 -
tctcagaaacaactcataataa

SEQ ID NO: 152215 - DNA, 22 bp, Artificial Sequence
  Synthetic oligonucleotide; CTC chr11 5174912 5174933 5174917 5174912 -
tcagaaacaactcataataaat

SEQ ID NO: 152216 - DNA, 22 bp, Artificial Sequence
  Synthetic oligonucleotide; CTC chr11 5174910 5174931 5174915 5174910 -
agaaacaactcataataaattc

SEQ ID NO: 152217 - DNA, 22 bp, Artificial Sequence
  Synthetic oligonucleotide; CTC chr11 5174899 5174920 5174904 5174899 -
ataataaattcaattcaaccct

SEQ ID NO: 152218 - DNA, 22 bp, Artificial Sequence
  Synthetic oligonucleotide; TTC chr11 5174888 5174909 5174893 5174888 -
aattcaaccctaatcaaaataa

SEQ ID NO: 152219 - DNA, 22 bp, Artificial Sequence
  Synthetic oligonucleotide; TTC chr11 5174883 5174904 5174888 5174883 -
aaccctaatcaaaataaaaatt

SEQ ID NO: 152220 - DNA, 22 bp, Artificial Sequence
  Synthetic oligonucleotide; CTA chr11 5174876 5174897 5174881 5174876 -
atcaaaataaaaatttgtcttg

SEQ ID NO: 152221 - DNA, 22 bp, Artificial Sequence
  Synthetic oligonucleotide; TTT chr11 5174860 5174881 5174865 5174860 -
gtcttgttttaaatttctttcc

SEQ ID NO: 152222 - DNA, 22 bp, Artificial Sequence
  Synthetic oligonucleotide; TTG chr11 5174859 5174880 5174864 5174859 -
tcttgttttaaatttctttcca

SEQ ID NO: 152223 - DNA, 22 bp, Artificial Sequence
  Synthetic oligonucleotide; CTT chr11 5174855 5174876 5174860 5174855 -
gttttaaatttctttccatttt

SEQ ID NO: 152224 - DNA, 22 bp, Artificial Sequence
  Synthetic oligonucleotide; TTG chr11 5174854 5174875 5174859 5174854 -
ttttaaatttctttccattttt

SEQ ID NO: 152225 - DNA, 22 bp, Artificial Sequence
  Synthetic oligonucleotide; TTT chr11 5174851 5174872 5174856 5174851 -
taaatttctttccatttttatt

SEQ ID NO: 152226 - DNA, 22 bp, Artificial Sequence
  Synthetic oligonucleotide; TTT chr11 5174850 5174871 5174855 5174850 -
aaatttctttccatttttattg

SEQ ID NO: 152227 - DNA, 22 bp, Artificial Sequence
  Synthetic oligonucleotide; TTA chr11 5174849 5174870 5174854 5174849 -
aatttctttccatttttattgt

SEQ ID NO: 152228 - DNA, 22 bp, Artificial Sequence
  Synthetic oligonucleotide; TTT chr11 5174844 5174865 5174849 5174844 -
ctttccatttttattgtgataa

SEQ ID NO: 152229 - DNA, 22 bp, Artificial Sequence
  Synthetic oligonucleotide; TTC chr11 5174843 5174864 5174848 5174843 -
tttccatttttattgtgataaa

SEQ ID NO: 152230 - DNA, 22 bp, Artificial Sequence
  Synthetic oligonucleotide; CTT chr11 5174841 5174862 5174846 5174841 -
tccatttttattgtgataaagt

SEQ ID NO: 152231 - DNA, 22 bp, Artificial Sequence
  Synthetic oligonucleotide; TTT chr11 5174840 5174861 5174845 5174840 -
ccatttttattgtgataaagtt

SEQ ID NO: 152232 - DNA, 22 bp, Artificial Sequence
  Synthetic oligonucleotide; TTC chr11 5174839 5174860 5174844 5174839 -
catttttattgtgataaagttt

SEQ ID NO: 152233 - DNA, 22 bp, Artificial Sequence
  Synthetic oligonucleotide; TTT chr11 5174834 5174855 5174839 5174834 -
ttattgtgataaagtttataaa

SEQ ID NO: 152234 - DNA, 22 bp, Artificial Sequence
  Synthetic oligonucleotide; TTT chr11 5174833 5174854 5174838 5174833 -
tattgtgataaagtttataaat

SEQ ID NO: 152235 - DNA, 22 bp, Artificial Sequence
  Synthetic oligonucleotide; TTT chr11 5174832 5174853 5174837 5174832 -
attgtgataaagtttataaata

SEQ ID NO: 152236 - DNA, 22 bp, Artificial Sequence
  Synthetic oligonucleotide; TTA chr11 5174831 5174852 5174836 5174831 -
ttgtgataaagtttataaatat

SEQ ID NO: 152237 - DNA, 22 bp, Artificial Sequence
  Synthetic oligonucleotide; TTG chr11 5174828 5174849 5174833 5174828 -
tgataaagtttataaatatgct

SEQ ID NO: 152238 - DNA, 22 bp, Artificial Sequence
  Synthetic oligonucleotide; TTT chr11 5174817 5174838 5174822 5174817 -
ataaatatgctacatataatac

SEQ ID NO: 152239 - DNA, 22 bp, Artificial Sequence
  Synthetic oligonucleotide; TTA chr11 5174816 5174837 5174821 5174816 -
taaatatgctacatataatacc

SEQ ID NO: 152240 - DNA, 22 bp, Artificial Sequence
  Synthetic oligonucleotide; CTA chr11 5174805 5174826 5174810 5174805 -
catataataccgtatatcatat

SEQ ID NO: 152241 - DNA, 22 bp, Artificial Sequence
  Synthetic oligonucleotide; CTC chr11 5174771 5174792 5174776 5174771 -
accatattaaccatttttaagt

SEQ ID NO: 152242 - DNA, 22 bp, Artificial Sequence
  Synthetic oligonucleotide; TTA chr11 5174762 5174783 5174767 5174762 -
accatttttaagtataattatg

SEQ ID NO: 152243 - DNA, 22 bp, Artificial Sequence
  Synthetic oligonucleotide; TTT chr11 5174755 5174776 5174760 5174755 -
ttaagtataattatgtggcatt

SEQ ID NO: 152244 - DNA, 22 bp, Artificial Sequence
  Synthetic oligonucleotide; TTT chr11 5174754 5174775 5174759 5174754 -
taagtataattatgtggcatta

SEQ ID NO: 152245 - DNA, 22 bp, Artificial Sequence
  Synthetic oligonucleotide; TTT chr11 5174753 5174774 5174758 5174753 -
aagtataattatgtggcattaa

SEQ ID NO: 152246 - DNA, 22 bp, Artificial Sequence
  Synthetic oligonucleotide; TTA chr11 5174752 5174773 5174757 5174752 -
agtataattatgtggcattaat

SEQ ID NO: 152247 - DNA, 22 bp, Artificial Sequence
  Synthetic oligonucleotide; TTA chr11 5174742 5174763 5174747 5174742 -
tgtggcattaattatattaaca

SEQ ID NO: 152248 - DNA, 22 bp, Artificial Sequence
  Synthetic oligonucleotide; TTA chr11 5174732 5174753 5174737 5174732 -
attatattaacaatattgtgcc

SEQ ID NO: 152249 - DNA, 22 bp, Artificial Sequence
  Synthetic oligonucleotide; TTA chr11 5174728 5174749 5174733 5174728 -
tattaacaatattgtgccgcta

SEQ ID NO: 152250 - DNA, 22 bp, Artificial Sequence
  Synthetic oligonucleotide; TTA chr11 5174723 5174744 5174728 5174723 -
acaatattgtgccgctatcacc

SEQ ID NO: 152251 - DNA, 22 bp, Artificial Sequence
  Synthetic oligonucleotide; TTG chr11 5174714 5174735 5174719 5174714 -
tgccgctatcaccatgatctca

SEQ ID NO: 152252 - DNA, 22 bp, Artificial Sequence
  Synthetic oligonucleotide; CTA chr11 5174706 5174727 5174711 5174706 -
tcaccatgatctcatgccaaaa

SEQ ID NO: 152253 - DNA, 22 bp, Artificial Sequence
  Synthetic oligonucleotide; CTC chr11 5174693 5174714 5174698 5174693 -
atgccaaaactttttcatcatc

SEQ ID NO: 152254 - DNA, 22 bp, Artificial Sequence
  Synthetic oligonucleotide; CTT chr11 5174681 5174702 5174686 5174681 -
tttcatcatccaagcagaaatg

SEQ ID NO: 152255 - DNA, 22 bp, Artificial Sequence
  Synthetic oligonucleotide; TTT chr11 5174680 5174701 5174685 5174680 -
ttcatcatccaagcagaaatgc

SEQ ID NO: 152256 - DNA, 22 bp, Artificial Sequence
  Synthetic oligonucleotide; TTT chr11 5174679 5174700 5174684 5174679 -
tcatcatccaagcagaaatgct

SEQ ID NO: 152257 - DNA, 22 bp, Artificial Sequence
  Synthetic oligonucleotide; TTT chr11 5174678 5174699 5174683 5174678 -
catcatccaagcagaaatgcta

SEQ ID NO: 152258 - DNA, 22 bp, Artificial Sequence
  Synthetic oligonucleotide; TTC chr11 5174677 5174698 5174682 5174677 -
atcatccaagcagaaatgctat

SEQ ID NO: 152259 - DNA, 22 bp, Artificial Sequence
  Synthetic oligonucleotide; CTA chr11 5174656 5174677 5174661 5174656 -
tacttgttaggcagtaactccc

SEQ ID NO: 152260 - DNA, 22 bp, Artificial Sequence
  Synthetic oligonucleotide; CTT chr11 5174651 5174672 5174656 5174651 -
gttaggcagtaactccccagtc

SEQ ID NO: 152261 - DNA, 22 bp, Artificial Sequence
  Synthetic oligonucleotide; TTG chr11 5174650 5174671 5174655 5174650 -
ttaggcagtaactccccagtcc

SEQ ID NO: 152262 - DNA, 22 bp, Artificial Sequence
  Synthetic oligonucleotide; TTA chr11 5174647 5174668 5174652 5174647 -
ggcagtaactccccagtcccat

SEQ ID NO: 152263 - DNA, 22 bp, Artificial Sequence
  Synthetic oligonucleotide; CTC chr11 5174636 5174657 5174641 5174636 -
cccagtcccatagtaacctcta

SEQ ID NO: 152264 - DNA, 22 bp, Artificial Sequence
  Synthetic oligonucleotide; CTC chr11 5174616 5174637 5174621 5174616 -
taatctactatatgtttctcta

SEQ ID NO: 152265 - DNA, 22 bp, Artificial Sequence
  Synthetic oligonucleotide; CTA chr11 5174614 5174635 5174619 5174614 -
atctactatatgtttctctaaa

SEQ ID NO: 152266 - DNA, 22 bp, Artificial Sequence
  Synthetic oligonucleotide; CTA chr11 5174609 5174630 5174614 5174609 -
ctatatgtttctctaaatcagt

SEQ ID NO: 152267 - DNA, 22 bp, Artificial Sequence
  Synthetic oligonucleotide; CTA chr11 5174606 5174627 5174611 5174606 -
tatgtttctctaaatcagtcta

SEQ ID NO: 152268 - DNA, 22 bp, Artificial Sequence
  Synthetic oligonucleotide; TTT chr11 5174599 5174620 5174604 5174599 -
ctctaaatcagtctattttaga

SEQ ID NO: 152269 - DNA, 22 bp, Artificial Sequence
  Synthetic oligonucleotide; TTC chr11 5174598 5174619 5174603 5174598 -
tctaaatcagtctattttagat

SEQ ID NO: 152270 - DNA, 22 bp, Artificial Sequence
  Synthetic oligonucleotide; CTC chr11 5174596 5174617 5174601 5174596 -
taaatcagtctattttagataa

SEQ ID NO: 152271 - DNA, 22 bp, Artificial Sequence
  Synthetic oligonucleotide; CTA chr11 5174594 5174615 5174599 5174594 -
aatcagtctattttagataatt

SEQ ID NO: 152272 - DNA, 22 bp, Artificial Sequence
  Synthetic oligonucleotide; CTA chr11 5174584 5174605 5174589 5174584 -
ttttagataattcatataaata

SEQ ID NO: 152273 - DNA, 22 bp, Artificial Sequence
  Synthetic oligonucleotide; TTT chr11 5174581 5174602 5174586 5174581 -
tagataattcatataaatagat

SEQ ID NO: 152274 - DNA, 22 bp, Artificial Sequence
  Synthetic oligonucleotide; TTT chr11 5174580 5174601 5174585 5174580 -
agataattcatataaatagatt

SEQ ID NO: 152275 - DNA, 22 bp, Artificial Sequence
  Synthetic oligonucleotide; TTA chr11 5174579 5174600 5174584 5174579 -
gataattcatataaatagattc

SEQ ID NO: 152276 - DNA, 22 bp, Artificial Sequence
  Synthetic oligonucleotide; TTC chr11 5174571 5174592 5174576 5174571 -
atataaatagattcatacaata

SEQ ID NO: 152277 - DNA, 22 bp, Artificial Sequence
  Synthetic oligonucleotide; TTC chr11 5174557 5174578 5174562 5174557 -
atacaatatttgttgttttgtg

SEQ ID NO: 152278 - DNA, 22 bp, Artificial Sequence
  Synthetic oligonucleotide; TTT chr11 5174546 5174567 5174551 5174546 -
gttgttttgtgtctggcttatt

SEQ ID NO: 152279 - DNA, 22 bp, Artificial Sequence
  Synthetic oligonucleotide; TTG chr11 5174545 5174566 5174550 5174545 -
ttgttttgtgtctggcttattt

SEQ ID NO: 152280 - DNA, 22 bp, Artificial Sequence
  Synthetic oligonucleotide; TTG chr11 5174542 5174563 5174547 5174542 -
ttttgtgtctggcttattttac

SEQ ID NO: 152281 - DNA, 22 bp, Artificial Sequence
  Synthetic oligonucleotide; TTT chr11 5174539 5174560 5174544 5174539 -
tgtgtctggcttattttaccca

SEQ ID NO: 152282 - DNA, 22 bp, Artificial Sequence
  Synthetic oligonucleotide; TTT chr11 5174538 5174559 5174543 5174538 -
gtgtctggcttattttacccaa

SEQ ID NO: 152283 - DNA, 22 bp, Artificial Sequence
  Synthetic oligonucleotide; TTG chr11 5174537 5174558 5174542 5174537 -
tgtctggcttattttacccaac

SEQ ID NO: 152284 - DNA, 22 bp, Artificial Sequence
  Synthetic oligonucleotide; CTG chr11 5174531 5174552 5174536 5174531 -
gcttattttacccaacataagg

SEQ ID NO: 152285 - DNA, 22 bp, Artificial Sequence
  Synthetic oligonucleotide; CTT chr11 5174527 5174548 5174532 5174527 -
attttacccaacataaggtttc

SEQ ID NO: 152286 - DNA, 22 bp, Artificial Sequence
  Synthetic oligonucleotide; TTA chr11 5174526 5174547 5174531 5174526 -
ttttacccaacataaggtttca

SEQ ID NO: 152287 - DNA, 22 bp, Artificial Sequence
  Synthetic oligonucleotide; TTT chr11 5174523 5174544 5174528 5174523 -
tacccaacataaggtttcaaag

SEQ ID NO: 152288 - DNA, 22 bp, Artificial Sequence
  Synthetic oligonucleotide; TTT chr11 5174522 5174543 5174527 5174522 -
acccaacataaggtttcaaagt

SEQ ID NO: 152289 - DNA, 22 bp, Artificial Sequence
  Synthetic oligonucleotide; TTA chr11 5174521 5174542 5174526 5174521 -
cccaacataaggtttcaaagtc

SEQ ID NO: 152290 - DNA, 22 bp, Artificial Sequence
  Synthetic oligonucleotide; TTT chr11 5174506 5174527 5174511 5174506 -
caaagtccatccatgccataac

SEQ ID NO: 152291 - DNA, 22 bp, Artificial Sequence
  Synthetic oligonucleotide; TTC chr11 5174505 5174526 5174510 5174505 -
aaagtccatccatgccataaca

SEQ ID NO: 152292 - DNA, 22 bp, Artificial Sequence
  Synthetic oligonucleotide; CTT chr11 5174465 5174486 5174470 5174465 -
tgcttaatgttgtccattcata

SEQ ID NO: 152293 - DNA, 22 bp, Artificial Sequence
  Synthetic oligonucleotide; TTT chr11 5174464 5174485 5174469 5174464 -
gcttaatgttgtccattcatag

SEQ ID NO: 152294 - DNA, 22 bp, Artificial Sequence
  Synthetic oligonucleotide; TTG chr11 5174463 5174484 5174468 5174463 -
cttaatgttgtccattcataga

SEQ ID NO: 152295 - DNA, 22 bp, Artificial Sequence
  Synthetic oligonucleotide; CTT chr11 5174460 5174481 5174465 5174460 -
aatgttgtccattcatagattc

SEQ ID NO: 152296 - DNA, 22 bp, Artificial Sequence
  Synthetic oligonucleotide; TTA chr11 5174459 5174480 5174464 5174459 -
atgttgtccattcatagattct

SEQ ID NO: 152297 - DNA, 22 bp, Artificial Sequence
  Synthetic oligonucleotide; TTG chr11 5174453 5174474 5174458 5174453 -
tccattcatagattcttggaaa

SEQ ID NO: 152298 - DNA, 22 bp, Artificial Sequence
  Synthetic oligonucleotide; TTC chr11 5174446 5174467 5174451 5174446 -
atagattcttggaaactgaaac

SEQ ID NO: 152299 - DNA, 22 bp, Artificial Sequence
  Synthetic oligonucleotide; TTC chr11 5174438 5174459 5174443 5174438 -
ttggaaactgaaactttaagcc

SEQ ID NO: 152300 - DNA, 22 bp, Artificial Sequence
  Synthetic oligonucleotide; CTT chr11 5174436 5174457 5174441 5174436 -
ggaaactgaaactttaagccaa

SEQ ID NO: 152301 - DNA, 22 bp, Artificial Sequence
  Synthetic oligonucleotide; TTG chr11 5174435 5174456 5174440 5174435 -
gaaactgaaactttaagccaag

SEQ ID NO: 152302 - DNA, 22 bp, Artificial Sequence
  Synthetic oligonucleotide; CTG chr11 5174428 5174449 5174433 5174428 -
aaactttaagccaagtgacata

SEQ ID NO: 152303 - DNA, 22 bp, Artificial Sequence
  Synthetic oligonucleotide; CTT chr11 5174422 5174443 5174427 5174422 -
taagccaagtgacatataatga

SEQ ID NO: 152304 - DNA, 22 bp, Artificial Sequence
  Synthetic oligonucleotide; TTT chr11 5174421 5174442 5174426 5174421 -
aagccaagtgacatataatgat

SEQ ID NO: 152305 - DNA, 22 bp, Artificial Sequence
  Synthetic oligonucleotide; TTA chr11 5174420 5174441 5174425 5174420 -
agccaagtgacatataatgata

SEQ ID NO: 152306 - DNA, 22 bp, Artificial Sequence
  Synthetic oligonucleotide; TTT chr11 5174391 5174412 5174396 5174391 -
tttttctcatctaacagtgttg

SEQ ID NO: 152307 - DNA, 22 bp, Artificial Sequence
  Synthetic oligonucleotide; TTT chr11 5174390 5174411 5174395 5174390 -
ttttctcatctaacagtgttgg

SEQ ID NO: 152308 - DNA, 22 bp, Artificial Sequence
  Synthetic oligonucleotide; TTT chr11 5174389 5174410 5174394 5174389 -
tttctcatctaacagtgttggc

SEQ ID NO: 152309 - DNA, 22 bp, Artificial Sequence
  Synthetic oligonucleotide; TTT chr11 5174388 5174409 5174393 5174388 -
ttctcatctaacagtgttggct

SEQ ID NO: 152310 - DNA, 22 bp, Artificial Sequence
  Synthetic oligonucleotide; TTT chr11 5174387 5174408 5174392 5174387 -
tctcatctaacagtgttggcta

SEQ ID NO: 152311 - DNA, 22 bp, Artificial Sequence
  Synthetic oligonucleotide; TTT chr11 5174386 5174407 5174391 5174386 -
ctcatctaacagtgttggctaa

SEQ ID NO: 152312 - DNA, 22 bp, Artificial Sequence
  Synthetic oligonucleotide; TTC chr11 5174385 5174406 5174390 5174385 -
tcatctaacagtgttggctaaa

SEQ ID NO: 152313 - DNA, 22 bp, Artificial Sequence
  Synthetic oligonucleotide; CTC chr11 5174383 5174404 5174388 5174383 -
atctaacagtgttggctaaaac

SEQ ID NO: 152314 - DNA, 22 bp, Artificial Sequence
  Synthetic oligonucleotide; CTA chr11 5174378 5174399 5174383 5174378 -
acagtgttggctaaaacagtgt

SEQ ID NO: 152315 - DNA, 22 bp, Artificial Sequence
  Synthetic oligonucleotide; TTG chr11 5174369 5174390 5174374 5174369 -
gctaaaacagtgttatttgagg

SEQ ID NO: 152316 - DNA, 22 bp, Artificial Sequence
  Synthetic oligonucleotide; CTA chr11 5174365 5174386 5174370 5174365 -
aaacagtgttatttgaggatct

SEQ ID NO: 152317 - DNA, 22 bp, Artificial Sequence
  Synthetic oligonucleotide; TTA chr11 5174354 5174375 5174359 5174354 -
tttgaggatctgttttacatca

SEQ ID NO: 152318 - DNA, 22 bp, Artificial Sequence
  Synthetic oligonucleotide; TTT chr11 5174351 5174372 5174356 5174351 -
gaggatctgttttacatcattt

SEQ ID NO: 152319 - DNA, 22 bp, Artificial Sequence
  Synthetic oligonucleotide; TTG chr11 5174350 5174371 5174355 5174350 -
aggatctgttttacatcatttc

SEQ ID NO: 152320 - DNA, 22 bp, Artificial Sequence
  Synthetic oligonucleotide; CTG chr11 5174342 5174363 5174347 5174342 -
ttttacatcatttcacttaaag

SEQ ID NO: 152321 - DNA, 22 bp, Artificial Sequence
  Synthetic oligonucleotide; TTT chr11 5174339 5174360 5174344 5174339 -
tacatcatttcacttaaagttg

SEQ ID NO: 152322 - DNA, 22 bp, Artificial Sequence
  Synthetic oligonucleotide; TTT chr11 5174338 5174359 5174343 5174338 -
acatcatttcacttaaagttgc

SEQ ID NO: 152323 - DNA, 22 bp, Artificial Sequence
  Synthetic oligonucleotide; TTA chr11 5174337 5174358 5174342 5174337 -
catcatttcacttaaagttgcc

SEQ ID NO: 152324 - DNA, 22 bp, Artificial Sequence
  Synthetic oligonucleotide; TTT chr11 5174329 5174350 5174334 5174329 -
cacttaaagttgccatttccaa

SEQ ID NO: 152325 - DNA, 22 bp, Artificial Sequence
  Synthetic oligonucleotide; TTC chr11 5174328 5174349 5174333 5174328 -
acttaaagttgccatttccaaa

SEQ ID NO: 152326 - DNA, 22 bp, Artificial Sequence
  Synthetic oligonucleotide; CTT chr11 5174324 5174345 5174329 5174324 -
aaagttgccatttccaaaaacc

SEQ ID NO: 152327 - DNA, 22 bp, Artificial Sequence
  Synthetic oligonucleotide; TTA chr11 5174323 5174344 5174328 5174323 -
aagttgccatttccaaaaacct

SEQ ID NO: 152328 - DNA, 22 bp, Artificial Sequence
  Synthetic oligonucleotide; TTG chr11 5174317 5174338 5174322 5174317 -
ccatttccaaaaacctattcat

SEQ ID NO: 152329 - DNA, 22 bp, Artificial Sequence
  Synthetic oligonucleotide; TTT chr11 5174311 5174332 5174316 5174311 -
ccaaaaacctattcatgacatt

SEQ ID NO: 152330 - DNA, 22 bp, Artificial Sequence
  Synthetic oligonucleotide; TTC chr11 5174310 5174331 5174315 5174310 -
caaaaacctattcatgacatta

SEQ ID NO: 152331 - DNA, 22 bp, Artificial Sequence
  Synthetic oligonucleotide; CTA chr11 5174300 5174321 5174305 5174300 -
ttcatgacattaaataaggact

SEQ ID NO: 152332 - DNA, 22 bp, Artificial Sequence
  Synthetic oligonucleotide; TTC chr11 5174297 5174318 5174302 5174297 -
atgacattaaataaggacttac

SEQ ID NO: 152333 - DNA, 22 bp, Artificial Sequence
  Synthetic oligonucleotide; TTA chr11 5174288 5174309 5174293 5174288 -
aataaggacttactgcatctgt

SEQ ID NO: 152334 - DNA, 22 bp, Artificial Sequence
  Synthetic oligonucleotide; CTT chr11 5174277 5174298 5174282 5174277 -
actgcatctgtacttcattctt

SEQ ID NO: 152335 - DNA, 22 bp, Artificial Sequence
  Synthetic oligonucleotide; TTA chr11 5174276 5174297 5174281 5174276 -
ctgcatctgtacttcattcttt

SEQ ID NO: 152336 - DNA, 22 bp, Artificial Sequence
  Synthetic oligonucleotide; CTG chr11 5174273 5174294 5174278 5174273 -
catctgtacttcattctttttt

SEQ ID NO: 152337 - DNA, 22 bp, Artificial Sequence
  Synthetic oligonucleotide; CTG chr11 5174267 5174288 5174272 5174267 -
tacttcattcttttttattgct

SEQ ID NO: 152338 - DNA, 22 bp, Artificial Sequence
  Synthetic oligonucleotide; CTT chr11 5174262 5174283 5174267 5174262 -
cattcttttttattgctacata

SEQ ID NO: 152339 - DNA, 22 bp, Artificial Sequence
  Synthetic oligonucleotide; TTC chr11 5174261 5174282 5174266 5174261 -
attcttttttattgctacataa

SEQ ID NO: 152340 - DNA, 22 bp, Artificial Sequence
  Synthetic oligonucleotide; TTC chr11 5174257 5174278 5174262 5174257 -
ttttttattgctacataatatt

SEQ ID NO: 152341 - DNA, 22 bp, Artificial Sequence
  Synthetic oligonucleotide; CTT chr11 5174255 5174276 5174260 5174255 -
ttttattgctacataatattcc

SEQ ID NO: 152342 - DNA, 22 bp, Artificial Sequence
  Synthetic oligonucleotide; TTT chr11 5174254 5174275 5174259 5174254 -
tttattgctacataatattcca

SEQ ID NO: 152343 - DNA, 22 bp, Artificial Sequence
  Synthetic oligonucleotide; TTT chr11 5174253 5174274 5174258 5174253 -
ttattgctacataatattccat

SEQ ID NO: 152344 - DNA, 22 bp, Artificial Sequence
  Synthetic oligonucleotide; TTT chr11 5174252 5174273 5174257 5174252 -
tattgctacataatattccatt

SEQ ID NO: 152345 - DNA, 22 bp, Artificial Sequence
  Synthetic oligonucleotide; TTT chr11 5174251 5174272 5174256 5174251 -
attgctacataatattccattg

SEQ ID NO: 152346 - DNA, 22 bp, Artificial Sequence
  Synthetic oligonucleotide; TTA chr11 5174250 5174271 5174255 5174250 -
ttgctacataatattccattgt

SEQ ID NO: 152347 - DNA, 22 bp, Artificial Sequence
  Synthetic oligonucleotide; TTG chr11 5174247 5174268 5174252 5174247 -
ctacataatattccattgtgtg

SEQ ID NO: 152348 - DNA, 22 bp, Artificial Sequence
  Synthetic oligonucleotide; CTA chr11 5174244 5174265 5174249 5174244 -
cataatattccattgtgtgtat

SEQ ID NO: 152349 - DNA, 22 bp, Artificial Sequence
  Synthetic oligonucleotide; TTC chr11 5174234 5174255 5174239 5174234 -
cattgtgtgtatatatcacatt

SEQ ID NO: 152350 - DNA, 22 bp, Artificial Sequence
  Synthetic oligonucleotide; TTG chr11 5174229 5174250 5174234 5174229 -
tgtgtatatatcacatttgttt

SEQ ID NO: 152351 - DNA, 22 bp, Artificial Sequence
  Synthetic oligonucleotide; TTT chr11 5174211 5174232 5174216 5174211 -
gtttattcattcatctgtttat

SEQ ID NO: 152352 - DNA, 22 bp, Artificial Sequence
  Synthetic oligonucleotide; TTG chr11 5174210 5174231 5174215 5174210 -
tttattcattcatctgtttatg

SEQ ID NO: 152353 - DNA, 22 bp, Artificial Sequence
  Synthetic oligonucleotide; TTT chr11 5174207 5174228 5174212 5174207 -
attcattcatctgtttatgtac

SEQ ID NO: 152354 - DNA, 22 bp, Artificial Sequence
  Synthetic oligonucleotide; TTA chr11 5174206 5174227 5174211 5174206 -
ttcattcatctgtttatgtaca

SEQ ID NO: 152355 - DNA, 22 bp, Artificial Sequence
  Synthetic oligonucleotide; TTC chr11 5174203 5174224 5174208 5174203 -
attcatctgtttatgtacattc

SEQ ID NO: 152356 - DNA, 22 bp, Artificial Sequence
  Synthetic oligonucleotide; TTC chr11 5174199 5174220 5174204 5174199 -
atctgtttatgtacattctggt

SEQ ID NO: 152357 - DNA, 22 bp, Artificial Sequence
  Synthetic oligonucleotide; CTG chr11 5174194 5174215 5174199 5174194 -
tttatgtacattctggttgttt

SEQ ID NO: 152358 - DNA, 22 bp, Artificial Sequence
  Synthetic oligonucleotide; TTT chr11 5174191 5174212 5174196 5174191 -
atgtacattctggttgtttcca

SEQ ID NO: 152359 - DNA, 22 bp, Artificial Sequence
  Synthetic oligonucleotide; TTA chr11 5174190 5174211 5174195 5174190 -
tgtacattctggttgtttccac

SEQ ID NO: 152360 - DNA, 22 bp, Artificial Sequence
  Synthetic oligonucleotide; TTC chr11 5174181 5174202 5174186 5174181 -
tggttgtttccaccttttggct

SEQ ID NO: 152361 - DNA, 22 bp, Artificial Sequence
  Synthetic oligonucleotide; CTG chr11 5174179 5174200 5174184 5174179 -
gttgtttccaccttttggctat

SEQ ID NO: 152362 - DNA, 22 bp, Artificial Sequence
  Synthetic oligonucleotide; TTG chr11 5174175 5174196 5174180 5174175 -
tttccaccttttggctattgtg

SEQ ID NO: 152363 - DNA, 22 bp, Artificial Sequence
  Synthetic oligonucleotide; TTT chr11 5174172 5174193 5174177 5174172 -
ccaccttttggctattgtgaat

SEQ ID NO: 152364 - DNA, 22 bp, Artificial Sequence
  Synthetic oligonucleotide; TTC chr11 5174171 5174192 5174176 5174171 -
caccttttggctattgtgaata

SEQ ID NO: 152365 - DNA, 22 bp, Artificial Sequence
  Synthetic oligonucleotide; CTT chr11 5174165 5174186 5174170 5174165 -
ttggctattgtgaataatgcta

SEQ ID NO: 152366 - DNA, 22 bp, Artificial Sequence
  Synthetic oligonucleotide; TTT chr11 5174164 5174185 5174169 5174164 -
tggctattgtgaataatgctac

SEQ ID NO: 152367 - DNA, 22 bp, Artificial Sequence
  Synthetic oligonucleotide; TTT chr11 5174163 5174184 5174168 5174163 -
ggctattgtgaataatgctaca

SEQ ID NO: 152368 - DNA, 22 bp, Artificial Sequence
  Synthetic oligonucleotide; TTG chr11 5174162 5174183 5174167 5174162 -
gctattgtgaataatgctacaa

SEQ ID NO: 152369 - DNA, 22 bp, Artificial Sequence
  Synthetic oligonucleotide; CTA chr11 5174158 5174179 5174163 5174158 -
ttgtgaataatgctacaatgaa

SEQ ID NO: 152370 - DNA, 22 bp, Artificial Sequence
  Synthetic oligonucleotide; TTG chr11 5174155 5174176 5174160 5174155 -
tgaataatgctacaatgaacat

SEQ ID NO: 152371 - DNA, 22 bp, Artificial Sequence
  Synthetic oligonucleotide; CTA chr11 5174143 5174164 5174148 5174143 -
caatgaacatttcagtacaagt

SEQ ID NO: 152372 - DNA, 22 bp, Artificial Sequence
  Synthetic oligonucleotide; TTT chr11 5174131 5174152 5174136 5174131 -
cagtacaagtacctgtttaaat

SEQ ID NO: 152373 - DNA, 22 bp, Artificial Sequence
  Synthetic oligonucleotide; TTC chr11 5174130 5174151 5174135 5174130 -
agtacaagtacctgtttaaatc

SEQ ID NO: 152374 - DNA, 22 bp, Artificial Sequence
  Synthetic oligonucleotide; CTG chr11 5174116 5174137 5174121 5174116 -
tttaaatctttatatatatttt

SEQ ID NO: 152375 - DNA, 22 bp, Artificial Sequence
  Synthetic oligonucleotide; TTT chr11 5174113 5174134 5174118 5174113 -
aaatctttatatatatttttaa

SEQ ID NO: 152376 - DNA, 22 bp, Artificial Sequence
  Synthetic oligonucleotide; TTA chr11 5174112 5174133 5174117 5174112 -
aatctttatatatatttttaat

SEQ ID NO: 152377 - DNA, 22 bp, Artificial Sequence
  Synthetic oligonucleotide; CTT chr11 5174106 5174127 5174111 5174106 -
tatatatatttttaatatatac

SEQ ID NO: 152378 - DNA, 22 bp, Artificial Sequence
  Synthetic oligonucleotide; TTT chr11 5174105 5174126 5174110 5174105 -
atatatatttttaatatatacc

SEQ ID NO: 152379 - DNA, 22 bp, Artificial Sequence
  Synthetic oligonucleotide; TTA chr11 5174104 5174125 5174109 5174104 -
tatatatttttaatatatacct

SEQ ID NO: 152380 - DNA, 22 bp, Artificial Sequence
  Synthetic oligonucleotide; TTT chr11 5174095 5174116 5174100 5174095 -
ttaatatatacctaggagagga

SEQ ID NO: 152381 - DNA, 22 bp, Artificial Sequence
  Synthetic oligonucleotide; TTT chr11 5174094 5174115 5174099 5174094 -
taatatatacctaggagaggaa

SEQ ID NO: 152382 - DNA, 22 bp, Artificial Sequence
  Synthetic oligonucleotide; TTT chr11 5174093 5174114 5174098 5174093 -
aatatatacctaggagaggaat

SEQ ID NO: 152383 - DNA, 22 bp, Artificial Sequence
  Synthetic oligonucleotide; TTA chr11 5174092 5174113 5174097 5174092 -
atatatacctaggagaggaatt

SEQ ID NO: 152384 - DNA, 22 bp, Artificial Sequence
  Synthetic oligonucleotide; CTA chr11 5174081 5174102 5174086 5174081 -
ggagaggaattttggggtcata

SEQ ID NO: 152385 - DNA, 22 bp, Artificial Sequence
  Synthetic oligonucleotide; TTT chr11 5174069 5174090 5174074 5174069 -
tggggtcatatgttattcagtg

SEQ ID NO: 152386 - DNA, 22 bp, Artificial Sequence
  Synthetic oligonucleotide; TTT chr11 5174068 5174089 5174073 5174068 -
ggggtcatatgttattcagtgc

SEQ ID NO: 152387 - DNA, 22 bp, Artificial Sequence
  Synthetic oligonucleotide; TTG chr11 5174067 5174088 5174072 5174067 -
gggtcatatgttattcagtgcc

SEQ ID NO: 152388 - DNA, 22 bp, Artificial Sequence
  Synthetic oligonucleotide; TTA chr11 5174054 5174075 5174059 5174054 -
ttcagtgcctaagtttttgaag

SEQ ID NO: 152389 - DNA, 22 bp, Artificial Sequence
  Synthetic oligonucleotide; TTC chr11 5174051 5174072 5174056 5174051 -
agtgcctaagtttttgaagaac

SEQ ID NO: 152390 - DNA, 22 bp, Artificial Sequence
  Synthetic oligonucleotide; CTA chr11 5174043 5174064 5174048 5174043 -
agtttttgaagaactgtcaaaa

SEQ ID NO: 152391 - DNA, 22 bp, Artificial Sequence
  Synthetic oligonucleotide; TTT chr11 5174038 5174059 5174043 5174038 -
ttgaagaactgtcaaaatattt

SEQ ID NO: 152392 - DNA, 22 bp, Artificial Sequence
  Synthetic oligonucleotide; TTT chr11 5174037 5174058 5174042 5174037 -
tgaagaactgtcaaaatatttt

SEQ ID NO: 152393 - DNA, 22 bp, Artificial Sequence
  Synthetic oligonucleotide; TTT chr11 5174036 5174057 5174041 5174036 -
gaagaactgtcaaaatattttc

SEQ ID NO: 152394 - DNA, 22 bp, Artificial Sequence
  Synthetic oligonucleotide; TTG chr11 5174035 5174056 5174040 5174035 -
aagaactgtcaaaatattttct

SEQ ID NO: 152395 - DNA, 22 bp, Artificial Sequence
  Synthetic oligonucleotide; CTG chr11 5174027 5174048 5174032 5174027 -
tcaaaatattttctacagaagt

SEQ ID NO: 152396 - DNA, 22 bp, Artificial Sequence
  Synthetic oligonucleotide; TTT chr11 5174016 5174037 5174021 5174016 -
tctacagaagttgcaccactta

SEQ ID NO: 152397 - DNA, 22 bp, Artificial Sequence
  Synthetic oligonucleotide; TTT chr11 5174015 5174036 5174020 5174015 -
ctacagaagttgcaccacttaa

SEQ ID NO: 152398 - DNA, 22 bp, Artificial Sequence
  Synthetic oligonucleotide; TTC chr11 5174014 5174035 5174019 5174014 -
tacagaagttgcaccacttaac

SEQ ID NO: 152399 - DNA, 22 bp, Artificial Sequence
  Synthetic oligonucleotide; CTA chr11 5174012 5174033 5174017 5174012 -
cagaagttgcaccacttaacat

SEQ ID NO: 152400 - DNA, 22 bp, Artificial Sequence
  Synthetic oligonucleotide; TTG chr11 5174003 5174024 5174008 5174003 -
caccacttaacatttttagcag

SEQ ID NO: 152401 - DNA, 22 bp, Artificial Sequence
  Synthetic oligonucleotide; CTT chr11 5173995 5174016 5174000 5173995 -
aacatttttagcagcaatatat

SEQ ID NO: 152402 - DNA, 22 bp, Artificial Sequence
  Synthetic oligonucleotide; TTA chr11 5173994 5174015 5173999 5173994 -
acatttttagcagcaatatatg

SEQ ID NO: 152403 - DNA, 22 bp, Artificial Sequence
  Synthetic oligonucleotide; TTT chr11 5173988 5174009 5173993 5173988 -
ttagcagcaatatatgaggatt

SEQ ID NO: 152404 - DNA, 22 bp, Artificial Sequence
  Synthetic oligonucleotide; TTT chr11 5173987 5174008 5173992 5173987 -
tagcagcaatatatgaggattc

SEQ ID NO: 152405 - DNA, 22 bp, Artificial Sequence
  Synthetic oligonucleotide; TTT chr11 5173986 5174007 5173991 5173986 -
agcagcaatatatgaggattcc

SEQ ID NO: 152406 - DNA, 22 bp, Artificial Sequence
  Synthetic oligonucleotide; TTA chr11 5173985 5174006 5173990 5173985 -
gcagcaatatatgaggattcca

SEQ ID NO: 152407 - DNA, 22 bp, Artificial Sequence
  Synthetic oligonucleotide; TTC chr11 5173965 5173986 5173970 5173965 -
caattttcttatatctttgtca

SEQ ID NO: 152408 - DNA, 22 bp, Artificial Sequence
  Synthetic oligonucleotide; TTT chr11 5173959 5173980 5173964 5173959 -
tcttatatctttgtcaacactt

SEQ ID NO: 152409 - DNA, 22 bp, Artificial Sequence
  Synthetic oligonucleotide; TTT chr11 5173958 5173979 5173963 5173958 -
cttatatctttgtcaacacttg

SEQ ID NO: 152410 - DNA, 22 bp, Artificial Sequence
  Synthetic oligonucleotide; TTC chr11 5173957 5173978 5173962 5173957 -
ttatatctttgtcaacacttgt

SEQ ID NO: 152411 - DNA, 22 bp, Artificial Sequence
  Synthetic oligonucleotide; CTT chr11 5173955 5173976 5173960 5173955 -
atatctttgtcaacacttgtta

SEQ ID NO: 152412 - DNA, 22 bp, Artificial Sequence
  Synthetic oligonucleotide; TTA chr11 5173954 5173975 5173959 5173954 -
tatctttgtcaacacttgttac

SEQ ID NO: 152413 - DNA, 22 bp, Artificial Sequence
  Synthetic oligonucleotide; CTT chr11 5173948 5173969 5173953 5173948 -
tgtcaacacttgttacttttca

SEQ ID NO: 152414 - DNA, 22 bp, Artificial Sequence
  Synthetic oligonucleotide; TTT chr11 5173947 5173968 5173952 5173947 -
gtcaacacttgttacttttcat

SEQ ID NO: 152415 - DNA, 22 bp, Artificial Sequence
  Synthetic oligonucleotide; TTG chr11 5173946 5173967 5173951 5173946 -
tcaacacttgttacttttcatt

SEQ ID NO: 152416 - DNA, 22 bp, Artificial Sequence
  Synthetic oligonucleotide; CTT chr11 5173937 5173958 5173942 5173937 -
gttacttttcatttgttttgtt

SEQ ID NO: 152417 - DNA, 22 bp, Artificial Sequence
  Synthetic oligonucleotide; TTG chr11 5173936 5173957 5173941 5173936 -
ttacttttcatttgttttgttt

SEQ ID NO: 152418 - DNA, 22 bp, Artificial Sequence
  Synthetic oligonucleotide; TTA chr11 5173933 5173954 5173938 5173933 -
cttttcatttgttttgtttctc

SEQ ID NO: 152419 - DNA, 22 bp, Artificial Sequence
  Synthetic oligonucleotide; CTT chr11 5173930 5173951 5173935 5173930 -
ttcatttgttttgtttctctta

SEQ ID NO: 152420 - DNA, 22 bp, Artificial Sequence
  Synthetic oligonucleotide; TTT chr11 5173929 5173950 5173934 5173929 -
tcatttgttttgtttctcttaa

SEQ ID NO: 152421 - DNA, 22 bp, Artificial Sequence
  Synthetic oligonucleotide; TTT chr11 5173928 5173949 5173933 5173928 -
catttgttttgtttctcttaaa

SEQ ID NO: 152422 - DNA, 22 bp, Artificial Sequence
  Synthetic oligonucleotide; TTC chr11 5173927 5173948 5173932 5173927 -
atttgttttgtttctcttaaag

SEQ ID NO: 152423 - DNA, 22 bp, Artificial Sequence
  Synthetic oligonucleotide; TTT chr11 5173923 5173944 5173928 5173923 -
gttttgtttctcttaaagtata

SEQ ID NO: 152424 - DNA, 22 bp, Artificial Sequence
  Synthetic oligonucleotide; TTG chr11 5173922 5173943 5173927 5173922 -
ttttgtttctcttaaagtatag

SEQ ID NO: 152425 - DNA, 22 bp, Artificial Sequence
  Synthetic oligonucleotide; TTT chr11 5173919 5173940 5173924 5173919 -
tgtttctcttaaagtatagaca

SEQ ID NO: 152426 - DNA, 22 bp, Artificial Sequence
  Synthetic oligonucleotide; TTT chr11 5173918 5173939 5173923 5173918 -
gtttctcttaaagtatagacat

SEQ ID NO: 152427 - DNA, 22 bp, Artificial Sequence
  Synthetic oligonucleotide; TTG chr11 5173917 5173938 5173922 5173917 -
tttctcttaaagtatagacatt

SEQ ID NO: 152428 - DNA, 22 bp, Artificial Sequence
  Synthetic oligonucleotide; TTT chr11 5173914 5173935 5173919 5173914 -
ctcttaaagtatagacattcta

SEQ ID NO: 152429 - DNA, 22 bp, Artificial Sequence
  Synthetic oligonucleotide; TTC chr11 5173913 5173934 5173918 5173913 -
tcttaaagtatagacattctag

SEQ ID NO: 152430 - DNA, 22 bp, Artificial Sequence
  Synthetic oligonucleotide; CTC chr11 5173911 5173932 5173916 5173911 -
ttaaagtatagacattctagta

SEQ ID NO: 152431 - DNA, 22 bp, Artificial Sequence
  Synthetic oligonucleotide; CTT chr11 5173909 5173930 5173914 5173909 -
aaagtatagacattctagtaag

SEQ ID NO: 152432 - DNA, 22 bp, Artificial Sequence
  Synthetic oligonucleotide; TTA chr11 5173908 5173929 5173913 5173908 -
aagtatagacattctagtaagt

SEQ ID NO: 152433 - DNA, 22 bp, Artificial Sequence
  Synthetic oligonucleotide; TTC chr11 5173894 5173915 5173899 5173894 -
tagtaagtttgaagtagtgtct

SEQ ID NO: 152434 - DNA, 22 bp, Artificial Sequence
  Synthetic oligonucleotide; CTA chr11 5173892 5173913 5173897 5173892 -
gtaagtttgaagtagtgtctta

SEQ ID NO: 152435 - DNA, 22 bp, Artificial Sequence
  Synthetic oligonucleotide; TTT chr11 5173884 5173905 5173889 5173884 -
gaagtagtgtcttattgtggtt

SEQ ID NO: 152436 - DNA, 22 bp, Artificial Sequence
  Synthetic oligonucleotide; TTG chr11 5173883 5173904 5173888 5173883 -
aagtagtgtcttattgtggttt

SEQ ID NO: 152437 - DNA, 22 bp, Artificial Sequence
  Synthetic oligonucleotide; CTT chr11 5173871 5173892 5173876 5173871 -
attgtggttttggtttgcattt

SEQ ID NO: 152438 - DNA, 22 bp, Artificial Sequence
  Synthetic oligonucleotide; TTA chr11 5173870 5173891 5173875 5173870 -
ttgtggttttggtttgcatttt

SEQ ID NO: 152439 - DNA, 22 bp, Artificial Sequence
  Synthetic oligonucleotide; TTG chr11 5173867 5173888 5173872 5173867 -
tggttttggtttgcattttatg

SEQ ID NO: 152440 - DNA, 22 bp, Artificial Sequence
  Synthetic oligonucleotide; TTT chr11 5173861 5173882 5173866 5173861 -
tggtttgcattttatgtgccaa

SEQ ID NO: 152441 - DNA, 22 bp, Artificial Sequence
  Synthetic oligonucleotide; TTT chr11 5173860 5173881 5173865 5173860 -
ggtttgcattttatgtgccaat

SEQ ID NO: 152442 - DNA, 22 bp, Artificial Sequence
  Synthetic oligonucleotide; TTG chr11 5173859 5173880 5173864 5173859 -
gtttgcattttatgtgccaatg

SEQ ID NO: 152443 - DNA, 22 bp, Artificial Sequence
  Synthetic oligonucleotide; TTT chr11 5173855 5173876 5173860 5173855 -
gcattttatgtgccaatgttca

SEQ ID NO: 152444 - DNA, 22 bp, Artificial Sequence
  Synthetic oligonucleotide; TTG chr11 5173854 5173875 5173859 5173854 -
cattttatgtgccaatgttcat

SEQ ID NO: 152445 - DNA, 22 bp, Artificial Sequence
  Synthetic oligonucleotide; TTT chr11 5173849 5173870 5173854 5173849 -
tatgtgccaatgttcatttgta

SEQ ID NO: 152446 - DNA, 22 bp, Artificial Sequence
  Synthetic oligonucleotide; TTT chr11 5173848 5173869 5173853 5173848 -
atgtgccaatgttcatttgtat

SEQ ID NO: 152447 - DNA, 22 bp, Artificial Sequence
  Synthetic oligonucleotide; TTA chr11 5173847 5173868 5173852 5173847 -
tgtgccaatgttcatttgtata

SEQ ID NO: 152448 - DNA, 22 bp, Artificial Sequence
  Synthetic oligonucleotide; TTC chr11 5173834 5173855 5173839 5173834 -
atttgtatatcttctttctaga

SEQ ID NO: 152449 - DNA, 22 bp, Artificial Sequence
  Synthetic oligonucleotide; TTT chr11 5173830 5173851 5173835 5173830 -
gtatatcttctttctagaaatt

SEQ ID NO: 152450 - DNA, 22 bp, Artificial Sequence
  Synthetic oligonucleotide; TTG chr11 5173829 5173850 5173834 5173829 -
tatatcttctttctagaaatta

SEQ ID NO: 152451 - DNA, 22 bp, Artificial Sequence
  Synthetic oligonucleotide; CTT chr11 5173821 5173842 5173826 5173821 -
ctttctagaaattactcattcc

SEQ ID NO: 152452 - DNA, 22 bp, Artificial Sequence
  Synthetic oligonucleotide; TTC chr11 5173820 5173841 5173825 5173820 -
tttctagaaattactcattccc

SEQ ID NO: 152453 - DNA, 22 bp, Artificial Sequence
  Synthetic oligonucleotide; CTT chr11 5173818 5173839 5173823 5173818 -
tctagaaattactcattcccat

SEQ ID NO: 152454 - DNA, 22 bp, Artificial Sequence
  Synthetic oligonucleotide; TTT chr11 5173817 5173838 5173822 5173817 -
ctagaaattactcattcccatc

SEQ ID NO: 152455 - DNA, 22 bp, Artificial Sequence
  Synthetic oligonucleotide; TTC chr11 5173816 5173837 5173821 5173816 -
tagaaattactcattcccatca

SEQ ID NO: 152456 - DNA, 22 bp, Artificial Sequence
  Synthetic oligonucleotide; CTA chr11 5173814 5173835 5173819 5173814 -
gaaattactcattcccatcatt

SEQ ID NO: 152457 - DNA, 22 bp, Artificial Sequence
  Synthetic oligonucleotide; TTA chr11 5173807 5173828 5173812 5173807 -
ctcattcccatcatttgcatat

SEQ ID NO: 152458 - DNA, 22 bp, Artificial Sequence
  Synthetic oligonucleotide; CTC chr11 5173804 5173825 5173809 5173804 -
attcccatcatttgcatatttt

SEQ ID NO: 152459 - DNA, 22 bp, Artificial Sequence
  Synthetic oligonucleotide; TTC chr11 5173800 5173821 5173805 5173800 -
ccatcatttgcatatttttaaa

SEQ ID NO: 152460 - DNA, 22 bp, Artificial Sequence
  Synthetic oligonucleotide; TTT chr11 5173791 5173812 5173796 5173791 -
gcatatttttaaattgagttgt

SEQ ID NO: 152461 - DNA, 22 bp, Artificial Sequence
  Synthetic oligonucleotide; TTG chr11 5173790 5173811 5173795 5173790 -
catatttttaaattgagttgtt

SEQ ID NO: 152462 - DNA, 22 bp, Artificial Sequence
  Synthetic oligonucleotide; TTT chr11 5173783 5173804 5173788 5173783 -
ttaaattgagttgtttgtcttt

SEQ ID NO: 152463 - DNA, 22 bp, Artificial Sequence
  Synthetic oligonucleotide; TTT chr11 5173782 5173803 5173787 5173782 -
taaattgagttgtttgtctttt

SEQ ID NO: 152464 - DNA, 22 bp, Artificial Sequence
  Synthetic oligonucleotide; TTT chr11 5173781 5173802 5173786 5173781 -
aaattgagttgtttgtcttttt

SEQ ID NO: 152465 - DNA, 22 bp, Artificial Sequence
  Synthetic oligonucleotide; TTA chr11 5173780 5173801 5173785 5173780 -
aattgagttgtttgtctttttg

SEQ ID NO: 152466 - DNA, 22 bp, Artificial Sequence
  Synthetic oligonucleotide; TTG chr11 5173775 5173796 5173780 5173775 -
agttgtttgtctttttgttttt

SEQ ID NO: 152467 - DNA, 22 bp, Artificial Sequence
  Synthetic oligonucleotide; TTG chr11 5173770 5173791 5173775 5173770 -
tttgtctttttgtttttgagtt

SEQ ID NO: 152468 - DNA, 22 bp, Artificial Sequence
  Synthetic oligonucleotide; TTT chr11 5173767 5173788 5173772 5173767 -
gtctttttgtttttgagttgta

SEQ ID NO: 152469 - DNA, 22 bp, Artificial Sequence
  Synthetic oligonucleotide; TTG chr11 5173766 5173787 5173771 5173766 -
tctttttgtttttgagttgtag

SEQ ID NO: 152470 - DNA, 22 bp, Artificial Sequence
  Synthetic oligonucleotide; CTT chr11 5173762 5173783 5173767 5173762 -
tttgtttttgagttgtaggact

SEQ ID NO: 152471 - DNA, 22 bp, Artificial Sequence
  Synthetic oligonucleotide; TTT chr11 5173761 5173782 5173766 5173761 -
ttgtttttgagttgtaggactt

SEQ ID NO: 152472 - DNA, 22 bp, Artificial Sequence
  Synthetic oligonucleotide; TTT chr11 5173760 5173781 5173765 5173760 -
tgtttttgagttgtaggacttt

SEQ ID NO: 152473 - DNA, 22 bp, Artificial Sequence
  Synthetic oligonucleotide; TTT chr11 5173759 5173780 5173764 5173759 -
gtttttgagttgtaggactttt

SEQ ID NO: 152474 - DNA, 22 bp, Artificial Sequence
  Synthetic oligonucleotide; TTG chr11 5173758 5173779 5173763 5173758 -
tttttgagttgtaggacttttt

SEQ ID NO: 152475 - DNA, 22 bp, Artificial Sequence
  Synthetic oligonucleotide; TTT chr11 5173755 5173776 5173760 5173755 -
ttgagttgtaggactttttcat

SEQ ID NO: 152476 - DNA, 22 bp, Artificial Sequence
  Synthetic oligonucleotide; TTT chr11 5173754 5173775 5173759 5173754 -
tgagttgtaggactttttcata

SEQ ID NO: 152477 - DNA, 22 bp, Artificial Sequence
  Synthetic oligonucleotide; TTT chr11 5173753 5173774 5173758 5173753 -
gagttgtaggactttttcatac

SEQ ID NO: 152478 - DNA, 22 bp, Artificial Sequence
  Synthetic oligonucleotide; TTG chr11 5173752 5173773 5173757 5173752 -
agttgtaggactttttcataca

SEQ ID NO: 152479 - DNA, 22 bp, Artificial Sequence
  Synthetic oligonucleotide; TTG chr11 5173747 5173768 5173752 5173747 -
taggactttttcatacattctg

SEQ ID NO: 152480 - DNA, 22 bp, Artificial Sequence
  Synthetic oligonucleotide; CTT chr11 5173739 5173760 5173744 5173739 -
tttcatacattctggatattaa

SEQ ID NO: 152481 - DNA, 22 bp, Artificial Sequence
  Synthetic oligonucleotide; TTT chr11 5173738 5173759 5173743 5173738 -
ttcatacattctggatattaaa

SEQ ID NO: 152482 - DNA, 22 bp, Artificial Sequence
  Synthetic oligonucleotide; TTT chr11 5173737 5173758 5173742 5173737 -
tcatacattctggatattaaac

SEQ ID NO: 152483 - DNA, 22 bp, Artificial Sequence
  Synthetic oligonucleotide; TTT chr11 5173736 5173757 5173741 5173736 -
catacattctggatattaaact

SEQ ID NO: 152484 - DNA, 22 bp, Artificial Sequence
  Synthetic oligonucleotide; TTC chr11 5173735 5173756 5173740 5173735 -
atacattctggatattaaactt

SEQ ID NO: 152485 - DNA, 22 bp, Artificial Sequence
  Synthetic oligonucleotide; TTC chr11 5173727 5173748 5173732 5173727 -
tggatattaaacttatgaaata

SEQ ID NO: 152486 - DNA, 22 bp, Artificial Sequence
  Synthetic oligonucleotide; CTG chr11 5173725 5173746 5173730 5173725 -
gatattaaacttatgaaataca

SEQ ID NO: 152487 - DNA, 22 bp, Artificial Sequence
  Synthetic oligonucleotide; TTA chr11 5173718 5173739 5173723 5173718 -
aacttatgaaatacataatttg

SEQ ID NO: 152488 - DNA, 22 bp, Artificial Sequence
  Synthetic oligonucleotide; CTT chr11 5173713 5173734 5173718 5173713 -
atgaaatacataatttgcaaag

SEQ ID NO: 152489 - DNA, 22 bp, Artificial Sequence
  Synthetic oligonucleotide; TTA chr11 5173712 5173733 5173717 5173712 -
tgaaatacataatttgcaaaga

SEQ ID NO: 152490 - DNA, 22 bp, Artificial Sequence
  Synthetic oligonucleotide; TTT chr11 5173697 5173718 5173702 5173697 -
gcaaagatgttctctcatctta

SEQ ID NO: 152491 - DNA, 22 bp, Artificial Sequence
  Synthetic oligonucleotide; TTG chr11 5173696 5173717 5173701 5173696 -
caaagatgttctctcatcttat

SEQ ID NO: 152492 - DNA, 22 bp, Artificial Sequence
  Synthetic oligonucleotide; TTC chr11 5173685 5173706 5173690 5173685 -
tctcatcttataggttgtcttt

SEQ ID NO: 152493 - DNA, 22 bp, Artificial Sequence
  Synthetic oligonucleotide; CTC chr11 5173683 5173704 5173688 5173683 -
tcatcttataggttgtcttttt

SEQ ID NO: 152494 - DNA, 22 bp, Artificial Sequence
  Synthetic oligonucleotide; CTC chr11 5173681 5173702 5173686 5173681 -
atcttataggttgtctttttac

SEQ ID NO: 152495 - DNA, 22 bp, Artificial Sequence
  Synthetic oligonucleotide; CTT chr11 5173676 5173697 5173681 5173676 -
ataggttgtctttttactttct

SEQ ID NO: 152496 - DNA, 22 bp, Artificial Sequence
  Synthetic oligonucleotide; TTA chr11 5173675 5173696 5173680 5173675 -
taggttgtctttttactttctt

SEQ ID NO: 152497 - DNA, 22 bp, Artificial Sequence
  Synthetic oligonucleotide; TTG chr11 5173668 5173689 5173673 5173668 -
tctttttactttcttaaagtcg

SEQ ID NO: 152498 - DNA, 22 bp, Artificial Sequence
  Synthetic oligonucleotide; CTT chr11 5173664 5173685 5173669 5173664 -
tttactttcttaaagtcgtttg

SEQ ID NO: 152499 - DNA, 22 bp, Artificial Sequence
  Synthetic oligonucleotide; TTT chr11 5173663 5173684 5173668 5173663 -
ttactttcttaaagtcgtttgt

SEQ ID NO: 152500 - DNA, 22 bp, Artificial Sequence
  Synthetic oligonucleotide; TTT chr11 5173662 5173683 5173667 5173662 -
tactttcttaaagtcgtttgtt

SEQ ID NO: 152501 - DNA, 22 bp, Artificial Sequence
  Synthetic oligonucleotide; TTT chr11 5173661 5173682 5173666 5173661 -
actttcttaaagtcgtttgttg

SEQ ID NO: 152502 - DNA, 22 bp, Artificial Sequence
  Synthetic oligonucleotide; TTA chr11 5173660 5173681 5173665 5173660 -
ctttcttaaagtcgtttgttgc

SEQ ID NO: 152503 - DNA, 22 bp, Artificial Sequence
  Synthetic oligonucleotide; CTT chr11 5173657 5173678 5173662 5173657 -
tcttaaagtcgtttgttgcatg

SEQ ID NO: 152504 - DNA, 22 bp, Artificial Sequence
  Synthetic oligonucleotide; TTT chr11 5173656 5173677 5173661 5173656 -
cttaaagtcgtttgttgcatga

SEQ ID NO: 152505 - DNA, 22 bp, Artificial Sequence
  Synthetic oligonucleotide; TTC chr11 5173655 5173676 5173660 5173655 -
ttaaagtcgtttgttgcatgaa

SEQ ID NO: 152506 - DNA, 22 bp, Artificial Sequence
  Synthetic oligonucleotide; CTT chr11 5173653 5173674 5173658 5173653 -
aaagtcgtttgttgcatgaact

SEQ ID NO: 152507 - DNA, 22 bp, Artificial Sequence
  Synthetic oligonucleotide; TTA chr11 5173652 5173673 5173657 5173652 -
aagtcgtttgttgcatgaactt

SEQ ID NO: 152508 - DNA, 22 bp, Artificial Sequence
  Synthetic oligonucleotide; TTT chr11 5173643 5173664 5173648 5173643 -
gttgcatgaactttttaaatga

SEQ ID NO: 152509 - DNA, 22 bp, Artificial Sequence
  Synthetic oligonucleotide; TTG chr11 5173642 5173663 5173647 5173642 -
ttgcatgaactttttaaatgaa

SEQ ID NO: 152510 - DNA, 22 bp, Artificial Sequence
  Synthetic oligonucleotide; TTG chr11 5173639 5173660 5173644 5173639 -
catgaactttttaaatgaaatc

SEQ ID NO: 152511 - DNA, 22 bp, Artificial Sequence
  Synthetic oligonucleotide; CTT chr11 5173630 5173651 5173635 5173630 -
tttaaatgaaatccaatttatg

SEQ ID NO: 152512 - DNA, 22 bp, Artificial Sequence
  Synthetic oligonucleotide; TTT chr11 5173629 5173650 5173634 5173629 -
ttaaatgaaatccaatttatgt

SEQ ID NO: 152513 - DNA, 22 bp, Artificial Sequence
  Synthetic oligonucleotide; TTT chr11 5173628 5173649 5173633 5173628 -
taaatgaaatccaatttatgta

SEQ ID NO: 152514 - DNA, 22 bp, Artificial Sequence
  Synthetic oligonucleotide; TTT chr11 5173627 5173648 5173632 5173627 -
aaatgaaatccaatttatgtat

SEQ ID NO: 152515 - DNA, 22 bp, Artificial Sequence
  Synthetic oligonucleotide; TTA chr11 5173626 5173647 5173631 5173626 -
aatgaaatccaatttatgtatt

SEQ ID NO: 152516 - DNA, 22 bp, Artificial Sequence
  Synthetic oligonucleotide; TTT chr11 5173611 5173632 5173616 5173611 -
atgtatttattttttgttactc

SEQ ID NO: 152517 - DNA, 22 bp, Artificial Sequence
  Synthetic oligonucleotide; TTA chr11 5173610 5173631 5173615 5173610 -
tgtatttattttttgttactca

SEQ ID NO: 152518 - DNA, 22 bp, Artificial Sequence
  Synthetic oligonucleotide; TTT chr11 5173603 5173624 5173608 5173603 -
attttttgttactcatactttt

SEQ ID NO: 152519 - DNA, 22 bp, Artificial Sequence
  Synthetic oligonucleotide; TTA chr11 5173602 5173623 5173607 5173602 -
ttttttgttactcatacttttt

SEQ ID NO: 152520 - DNA, 22 bp, Artificial Sequence
  Synthetic oligonucleotide; TTT chr11 5173599 5173620 5173604 5173599 -
tttgttactcatactttttgtg

SEQ ID NO: 152521 - DNA, 22 bp, Artificial Sequence
  Synthetic oligonucleotide; TTT chr11 5173598 5173619 5173603 5173598 -
ttgttactcatactttttgtgt

SEQ ID NO: 152522 - DNA, 22 bp, Artificial Sequence
  Synthetic oligonucleotide; TTT chr11 5173597 5173618 5173602 5173597 -
tgttactcatactttttgtgtc

SEQ ID NO: 152523 - DNA, 22 bp, Artificial Sequence
  Synthetic oligonucleotide; TTT chr11 5173596 5173617 5173601 5173596 -
gttactcatactttttgtgtca

SEQ ID NO: 152524 - DNA, 22 bp, Artificial Sequence
  Synthetic oligonucleotide; TTG chr11 5173595 5173616 5173600 5173595 -
ttactcatactttttgtgtcat

SEQ ID NO: 152525 - DNA, 22 bp, Artificial Sequence
  Synthetic oligonucleotide; TTA chr11 5173592 5173613 5173597 5173592 -
ctcatactttttgtgtcatatc

SEQ ID NO: 152526 - DNA, 22 bp, Artificial Sequence
  Synthetic oligonucleotide; CTC chr11 5173589 5173610 5173594 5173589 -
atactttttgtgtcatatctaa

SEQ ID NO: 152527 - DNA, 22 bp, Artificial Sequence
  Synthetic oligonucleotide; CTT chr11 5173583 5173604 5173588 5173583 -
tttgtgtcatatctaagaatct

SEQ ID NO: 152528 - DNA, 22 bp, Artificial Sequence
  Synthetic oligonucleotide; TTT chr11 5173582 5173603 5173587 5173582 -
ttgtgtcatatctaagaatcta

SEQ ID NO: 152529 - DNA, 22 bp, Artificial Sequence
  Synthetic oligonucleotide; TTT chr11 5173581 5173602 5173586 5173581 -
tgtgtcatatctaagaatctat

SEQ ID NO: 152530 - DNA, 22 bp, Artificial Sequence
  Synthetic oligonucleotide; TTT chr11 5173580 5173601 5173585 5173580 -
gtgtcatatctaagaatctatt

SEQ ID NO: 152531 - DNA, 22 bp, Artificial Sequence
  Synthetic oligonucleotide; TTG chr11 5173579 5173600 5173584 5173579 -
tgtcatatctaagaatctattg

SEQ ID NO: 152532 - DNA, 22 bp, Artificial Sequence
  Synthetic oligonucleotide; CTA chr11 5173568 5173589 5173573 5173568 -
agaatctattgtaaaatcaaag

SEQ ID NO: 152533 - DNA, 22 bp, Artificial Sequence
  Synthetic oligonucleotide; CTA chr11 5173560 5173581 5173565 5173560 -
ttgtaaaatcaaagttcatgaa

SEQ ID NO: 152534 - DNA, 22 bp, Artificial Sequence
  Synthetic oligonucleotide; TTG chr11 5173557 5173578 5173562 5173557 -
taaaatcaaagttcatgaagat

SEQ ID NO: 152535 - DNA, 22 bp, Artificial Sequence
  Synthetic oligonucleotide; TTC chr11 5173543 5173564 5173548 5173543 -
atgaagatttacccatgcttcc

SEQ ID NO: 152536 - DNA, 22 bp, Artificial Sequence
  Synthetic oligonucleotide; TTT chr11 5173533 5173554 5173538 5173533 -
acccatgcttccttccgagggt

SEQ ID NO: 152537 - DNA, 22 bp, Artificial Sequence
  Synthetic oligonucleotide; TTA chr11 5173532 5173553 5173537 5173532 -
cccatgcttccttccgagggtg

SEQ ID NO: 152538 - DNA, 22 bp, Artificial Sequence
  Synthetic oligonucleotide; CTT chr11 5173523 5173544 5173528 5173523 -
ccttccgagggtgttatggctt

SEQ ID NO: 152539 - DNA, 22 bp, Artificial Sequence
  Synthetic oligonucleotide; TTC chr11 5173522 5173543 5173527 5173522 -
cttccgagggtgttatggcttt

SEQ ID NO: 152540 - DNA, 22 bp, Artificial Sequence
  Synthetic oligonucleotide; CTT chr11 5173519 5173540 5173524 5173519 -
ccgagggtgttatggctttagt

SEQ ID NO: 152541 - DNA, 22 bp, Artificial Sequence
  Synthetic oligonucleotide; TTC chr11 5173518 5173539 5173523 5173518 -
cgagggtgttatggctttagtt

SEQ ID NO: 152542 - DNA, 22 bp, Artificial Sequence
  Synthetic oligonucleotide; TTA chr11 5173507 5173528 5173512 5173507 -
tggctttagttcaatttaggtc

SEQ ID NO: 152543 - DNA, 22 bp, Artificial Sequence
  Synthetic oligonucleotide; CTT chr11 5173501 5173522 5173506 5173501 -
tagttcaatttaggtcattaca

SEQ ID NO: 152544 - DNA, 22 bp, Artificial Sequence
  Synthetic oligonucleotide; TTT chr11 5173500 5173521 5173505 5173500 -
agttcaatttaggtcattacac

SEQ ID NO: 152545 - DNA, 22 bp, Artificial Sequence
  Synthetic oligonucleotide; TTA chr11 5173499 5173520 5173504 5173499 -
gttcaatttaggtcattacaca

SEQ ID NO: 152546 - DNA, 22 bp, Artificial Sequence
  Synthetic oligonucleotide; TTC chr11 5173495 5173516 5173500 5173495 -
aatttaggtcattacacaattt

SEQ ID NO: 152547 - DNA, 22 bp, Artificial Sequence
  Synthetic oligonucleotide; TTT chr11 5173490 5173511 5173495 5173490 -
aggtcattacacaatttttatg

SEQ ID NO: 152548 - DNA, 22 bp, Artificial Sequence
  Synthetic oligonucleotide; TTA chr11 5173489 5173510 5173494 5173489 -
ggtcattacacaatttttatgc

SEQ ID NO: 152549 - DNA, 22 bp, Artificial Sequence
  Synthetic oligonucleotide; TTA chr11 5173481 5173502 5173486 5173481 -
cacaatttttatgcatgctggc

SEQ ID NO: 152550 - DNA, 22 bp, Artificial Sequence
  Synthetic oligonucleotide; TTT chr11 5173473 5173494 5173478 5173473 -
ttatgcatgctggcttttaatc

SEQ ID NO: 152551 - DNA, 22 bp, Artificial Sequence
  Synthetic oligonucleotide; TTT chr11 5173472 5173493 5173477 5173472 -
tatgcatgctggcttttaatcc

SEQ ID NO: 152552 - DNA, 22 bp, Artificial Sequence
  Synthetic oligonucleotide; TTT chr11 5173471 5173492 5173476 5173471 -
atgcatgctggcttttaatcct

SEQ ID NO: 152553 - DNA, 22 bp, Artificial Sequence
  Synthetic oligonucleotide; TTA chr11 5173470 5173491 5173475 5173470 -
tgcatgctggcttttaatcctt

SEQ ID NO: 152554 - DNA, 22 bp, Artificial Sequence
  Synthetic oligonucleotide; CTG chr11 5173461 5173482 5173466 5173461 -
gcttttaatccttatttgaaag

SEQ ID NO: 152555 - DNA, 22 bp, Artificial Sequence
  Synthetic oligonucleotide; CTT chr11 5173457 5173478 5173462 5173457 -
ttaatccttatttgaaagaata

SEQ ID NO: 152556 - DNA, 22 bp, Artificial Sequence
  Synthetic oligonucleotide; TTT chr11 5173456 5173477 5173461 5173456 -
taatccttatttgaaagaatac

SEQ ID NO: 152557 - DNA, 22 bp, Artificial Sequence
  Synthetic oligonucleotide; TTT chr11 5173455 5173476 5173460 5173455 -
aatccttatttgaaagaataca

SEQ ID NO: 152558 - DNA, 22 bp, Artificial Sequence
  Synthetic oligonucleotide; TTA chr11 5173454 5173475 5173459 5173454 -
atccttatttgaaagaatacaa

SEQ ID NO: 152559 - DNA, 22 bp, Artificial Sequence
  Synthetic oligonucleotide; CTT chr11 5173448 5173469 5173453 5173448 -
atttgaaagaatacaaagttag

SEQ ID NO: 152560 - DNA, 22 bp, Artificial Sequence
  Synthetic oligonucleotide; TTA chr11 5173447 5173468 5173452 5173447 -
tttgaaagaatacaaagttagc

SEQ ID NO: 152561 - DNA, 22 bp, Artificial Sequence
  Synthetic oligonucleotide; TTT chr11 5173444 5173465 5173449 5173444 -
gaaagaatacaaagttagcatg

SEQ ID NO: 152562 - DNA, 22 bp, Artificial Sequence
  Synthetic oligonucleotide; TTG chr11 5173443 5173464 5173448 5173443 -
aaagaatacaaagttagcatga

SEQ ID NO: 152563 - DNA, 22 bp, Artificial Sequence
  Synthetic oligonucleotide; TTA chr11 5173427 5173448 5173432 5173427 -
gcatgacaacaaaaatatagct

SEQ ID NO: 152564 - DNA, 22 bp, Artificial Sequence
  Synthetic oligonucleotide; CTT chr11 5173404 5173425 5173409 5173404 -
gaccaattgaatatgaagttgt

SEQ ID NO: 152565 - DNA, 22 bp, Artificial Sequence
  Synthetic oligonucleotide; TTG chr11 5173403 5173424 5173408 5173403 -
accaattgaatatgaagttgta

SEQ ID NO: 152566 - DNA, 22 bp, Artificial Sequence
  Synthetic oligonucleotide; TTG chr11 5173395 5173416 5173400 5173395 -
aatatgaagttgtatataaaaa

SEQ ID NO: 152567 - DNA, 22 bp, Artificial Sequence
  Synthetic oligonucleotide; TTG chr11 5173383 5173404 5173388 5173383 -
tatataaaaacagaataagaac

SEQ ID NO: 152568 - DNA, 22 bp, Artificial Sequence
  Synthetic oligonucleotide; CTA chr11 5173306 5173327 5173311 5173306 -
gaattagatccatatttatata

SEQ ID NO: 152569 - DNA, 22 bp, Artificial Sequence
  Synthetic oligonucleotide; TTA chr11 5173300 5173321 5173305 5173300 -
gatccatatttatataaaaata

SEQ ID NO: 152570 - DNA, 22 bp, Artificial Sequence
  Synthetic oligonucleotide; TTT chr11 5173289 5173310 5173294 5173289 -
atataaaaatataaaataaaat

SEQ ID NO: 152571 - DNA, 22 bp, Artificial Sequence
  Synthetic oligonucleotide; TTA chr11 5173288 5173309 5173293 5173288 -
tataaaaatataaaataaaatg

SEQ ID NO: 152572 - DNA, 22 bp, Artificial Sequence
  Synthetic oligonucleotide; CTC chr11 5173253 5173274 5173258 5173253 -
atcatgcttggagaccaaccct

SEQ ID NO: 152573 - DNA, 22 bp, Artificial Sequence
  Synthetic oligonucleotide; CTT chr11 5173244 5173265 5173249 5173244 -
ggagaccaacccttgatcttat

SEQ ID NO: 152574 - DNA, 22 bp, Artificial Sequence
  Synthetic oligonucleotide; TTG chr11 5173243 5173264 5173248 5173243 -
gagaccaacccttgatcttata

SEQ ID NO: 152575 - DNA, 22 bp, Artificial Sequence
  Synthetic oligonucleotide; CTT chr11 5173230 5173251 5173235 5173230 -
gatcttatacttggtattagaa

SEQ ID NO: 152576 - DNA, 22 bp, Artificial Sequence
  Synthetic oligonucleotide; TTG chr11 5173229 5173250 5173234 5173229 -
atcttatacttggtattagaaa

SEQ ID NO: 152577 - DNA, 22 bp, Artificial Sequence
  Synthetic oligonucleotide; CTT chr11 5173224 5173245 5173229 5173224 -
atacttggtattagaaaaattg

SEQ ID NO: 152578 - DNA, 22 bp, Artificial Sequence
  Synthetic oligonucleotide; TTA chr11 5173223 5173244 5173228 5173223 -
tacttggtattagaaaaattgt

SEQ ID NO: 152579 - DNA, 22 bp, Artificial Sequence
  Synthetic oligonucleotide; CTT chr11 5173218 5173239 5173223 5173218 -
ggtattagaaaaattgtttata

SEQ ID NO: 152580 - DNA, 22 bp, Artificial Sequence
  Synthetic oligonucleotide; TTG chr11 5173217 5173238 5173222 5173217 -
gtattagaaaaattgtttatat

SEQ ID NO: 152581 - DNA, 22 bp, Artificial Sequence
  Synthetic oligonucleotide; TTA chr11 5173211 5173232 5173216 5173211 -
gaaaaattgtttatatgtttga

SEQ ID NO: 152582 - DNA, 22 bp, Artificial Sequence
  Synthetic oligonucleotide; TTG chr11 5173202 5173223 5173207 5173202 -
tttatatgtttgagaatactta

SEQ ID NO: 152583 - DNA, 22 bp, Artificial Sequence
  Synthetic oligonucleotide; TTT chr11 5173199 5173220 5173204 5173199 -
atatgtttgagaatacttaagt

SEQ ID NO: 152584 - DNA, 22 bp, Artificial Sequence
  Synthetic oligonucleotide; TTA chr11 5173198 5173219 5173203 5173198 -
tatgtttgagaatacttaagta

SEQ ID NO: 152585 - DNA, 22 bp, Artificial Sequence
  Synthetic oligonucleotide; TTT chr11 5173191 5173212 5173196 5173191 -
gagaatacttaagtaaaattct

SEQ ID NO: 152586 - DNA, 22 bp, Artificial Sequence
  Synthetic oligonucleotide; TTG chr11 5173190 5173211 5173195 5173190 -
agaatacttaagtaaaattcta

SEQ ID NO: 152587 - DNA, 22 bp, Artificial Sequence
  Synthetic oligonucleotide; CTT chr11 5173181 5173202 5173186 5173181 -
aagtaaaattctaattacccaa

SEQ ID NO: 152588 - DNA, 22 bp, Artificial Sequence
  Synthetic oligonucleotide; TTA chr11 5173180 5173201 5173185 5173180 -
agtaaaattctaattacccaag

SEQ ID NO: 152589 - DNA, 22 bp, Artificial Sequence
  Synthetic oligonucleotide; TTC chr11 5173170 5173191 5173175 5173170 -
taattacccaagtcccccaaac

SEQ ID NO: 152590 - DNA, 22 bp, Artificial Sequence
  Synthetic oligonucleotide; CTA chr11 5173168 5173189 5173173 5173168 -
attacccaagtcccccaaacaa

SEQ ID NO: 152591 - DNA, 22 bp, Artificial Sequence
  Synthetic oligonucleotide; TTA chr11 5173164 5173185 5173169 5173164 -
cccaagtcccccaaacaaattt

SEQ ID NO: 152592 - DNA, 22 bp, Artificial Sequence
  Synthetic oligonucleotide; TTT chr11 5173142 5173163 5173147 5173142 -
caggtggaatcaagaatctcta

SEQ ID NO: 152593 - DNA, 22 bp, Artificial Sequence
  Synthetic oligonucleotide; TTC chr11 5173141 5173162 5173146 5173141 -
aggtggaatcaagaatctctaa

SEQ ID NO: 152594 - DNA, 22 bp, Artificial Sequence
  Synthetic oligonucleotide; CTC chr11 5173122 5173143 5173127 5173122 -
taacactattattacctgtctt

SEQ ID NO: 152595 - DNA, 22 bp, Artificial Sequence
  Synthetic oligonucleotide; CTA chr11 5173120 5173141 5173125 5173120 -
acactattattacctgtcttta

SEQ ID NO: 152596 - DNA, 22 bp, Artificial Sequence
  Synthetic oligonucleotide; CTA chr11 5173114 5173135 5173119 5173114 -
ttattacctgtctttatcatga

SEQ ID NO: 152597 - DNA, 22 bp, Artificial Sequence
  Synthetic oligonucleotide; TTA chr11 5173111 5173132 5173116 5173111 -
ttacctgtctttatcatgatta

SEQ ID NO: 152598 - DNA, 22 bp, Artificial Sequence
  Synthetic oligonucleotide; TTA chr11 5173108 5173129 5173113 5173108 -
cctgtctttatcatgattactg

SEQ ID NO: 152599 - DNA, 22 bp, Artificial Sequence
  Synthetic oligonucleotide; CTG chr11 5173104 5173125 5173109 5173104 -
tctttatcatgattactgtctc

SEQ ID NO: 152600 - DNA, 22 bp, Artificial Sequence
  Synthetic oligonucleotide; CTT chr11 5173100 5173121 5173105 5173100 -
tatcatgattactgtctctatc

SEQ ID NO: 152601 - DNA, 22 bp, Artificial Sequence
  Synthetic oligonucleotide; TTT chr11 5173099 5173120 5173104 5173099 -
atcatgattactgtctctatcc

SEQ ID NO: 152602 - DNA, 22 bp, Artificial Sequence
  Synthetic oligonucleotide; TTA chr11 5173098 5173119 5173103 5173098 -
tcatgattactgtctctatccc

SEQ ID NO: 152603 - DNA, 22 bp, Artificial Sequence
  Synthetic oligonucleotide; TTA chr11 5173089 5173110 5173094 5173089 -
ctgtctctatccccctttatta

SEQ ID NO: 152604 - DNA, 22 bp, Artificial Sequence
  Synthetic oligonucleotide; CTG chr11 5173086 5173107 5173091 5173086 -
tctctatccccctttattacta

SEQ ID NO: 152605 - DNA, 22 bp, Artificial Sequence
  Synthetic oligonucleotide; CTC chr11 5173082 5173103 5173087 5173082 -
tatccccctttattactatcta

SEQ ID NO: 152606 - DNA, 22 bp, Artificial Sequence
  Synthetic oligonucleotide; CTA chr11 5173080 5173101 5173085 5173080 -
tccccctttattactatctaca

SEQ ID NO: 152607 - DNA, 22 bp, Artificial Sequence
  Synthetic oligonucleotide; CTT chr11 5173072 5173093 5173077 5173072 -
tattactatctacaccactatc

SEQ ID NO: 152608 - DNA, 22 bp, Artificial Sequence
  Synthetic oligonucleotide; TTT chr11 5173071 5173092 5173076 5173071 -
attactatctacaccactatcc

SEQ ID NO: 152609 - DNA, 22 bp, Artificial Sequence
  Synthetic oligonucleotide; TTA chr11 5173070 5173091 5173075 5173070 -
ttactatctacaccactatccc

SEQ ID NO: 152610 - DNA, 22 bp, Artificial Sequence
  Synthetic oligonucleotide; TTA chr11 5173067 5173088 5173072 5173067 -
ctatctacaccactatccctat

SEQ ID NO: 152611 - DNA, 22 bp, Artificial Sequence
  Synthetic oligonucleotide; CTA chr11 5173064 5173085 5173069 5173064 -
tctacaccactatccctatctg

SEQ ID NO: 152612 - DNA, 22 bp, Artificial Sequence
  Synthetic oligonucleotide; CTA chr11 5173060 5173081 5173065 5173060 -
caccactatccctatctgcagt

SEQ ID NO: 152613 - DNA, 22 bp, Artificial Sequence
  Synthetic oligonucleotide; CTA chr11 5173052 5173073 5173057 5173052 -
tccctatctgcagttccgtctc

SEQ ID NO: 152614 - DNA, 22 bp, Artificial Sequence
  Synthetic oligonucleotide; CTA chr11 5173046 5173067 5173051 5173046 -
tctgcagttccgtctctagctc

SEQ ID NO: 152615 - DNA, 22 bp, Artificial Sequence
  Synthetic oligonucleotide; CTG chr11 5173042 5173063 5173047 5173042 -
cagttccgtctctagctctaga

SEQ ID NO: 152616 - DNA, 22 bp, Artificial Sequence
  Synthetic oligonucleotide; TTC chr11 5173036 5173057 5173041 5173036 -
cgtctctagctctagatccaac

SEQ ID NO: 152617 - DNA, 22 bp, Artificial Sequence
  Synthetic oligonucleotide; CTC chr11 5173030 5173051 5173035 5173030 -
tagctctagatccaactctgca

SEQ ID NO: 152618 - DNA, 22 bp, Artificial Sequence
  Synthetic oligonucleotide; CTA chr11 5173028 5173049 5173033 5173028 -
gctctagatccaactctgcatc

SEQ ID NO: 152619 - DNA, 22 bp, Artificial Sequence
  Synthetic oligonucleotide; CTC chr11 5173024 5173045 5173029 5173024 -
tagatccaactctgcatctctc

SEQ ID NO: 152620 - DNA, 22 bp, Artificial Sequence
  Synthetic oligonucleotide; CTA chr11 5173022 5173043 5173027 5173022 -
gatccaactctgcatctctcca

SEQ ID NO: 152621 - DNA, 22 bp, Artificial Sequence
  Synthetic oligonucleotide; CTC chr11 5173012 5173033 5173017 5173012 -
tgcatctctccactttttactt

SEQ ID NO: 152622 - DNA, 22 bp, Artificial Sequence
  Synthetic oligonucleotide; CTG chr11 5173010 5173031 5173015 5173010 -
catctctccactttttactttg

SEQ ID NO: 152623 - DNA, 22 bp, Artificial Sequence
  Synthetic oligonucleotide; CTC chr11 5173004 5173025 5173009 5173004 -
tccactttttactttgtatatg

SEQ ID NO: 152624 - DNA, 22 bp, Artificial Sequence
  Synthetic oligonucleotide; CTC chr11 5173002 5173023 5173007 5173002 -
cactttttactttgtatatgga

SEQ ID NO: 152625 - DNA, 22 bp, Artificial Sequence
  Synthetic oligonucleotide; CTT chr11 5172997 5173018 5173002 5172997 -
tttactttgtatatggaatagc

SEQ ID NO: 152626 - DNA, 22 bp, Artificial Sequence
  Synthetic oligonucleotide; TTT chr11 5172996 5173017 5173001 5172996 -
ttactttgtatatggaatagct

SEQ ID NO: 152627 - DNA, 22 bp, Artificial Sequence
  Synthetic oligonucleotide; TTT chr11 5172995 5173016 5173000 5172995 -
tactttgtatatggaatagctt

SEQ ID NO: 152628 - DNA, 22 bp, Artificial Sequence
  Synthetic oligonucleotide; TTT chr11 5172994 5173015 5172999 5172994 -
actttgtatatggaatagcttc

SEQ ID NO: 152629 - DNA, 22 bp, Artificial Sequence
  Synthetic oligonucleotide; TTA chr11 5172993 5173014 5172998 5172993 -
ctttgtatatggaatagcttct

SEQ ID NO: 152630 - DNA, 22 bp, Artificial Sequence
  Synthetic oligonucleotide; CTT chr11 5172990 5173011 5172995 5172990 -
tgtatatggaatagcttcttaa

SEQ ID NO: 152631 - DNA, 22 bp, Artificial Sequence
  Synthetic oligonucleotide; TTT chr11 5172989 5173010 5172994 5172989 -
gtatatggaatagcttcttaag

SEQ ID NO: 152632 - DNA, 22 bp, Artificial Sequence
  Synthetic oligonucleotide; TTG chr11 5172988 5173009 5172993 5172988 -
tatatggaatagcttcttaaga

SEQ ID NO: 152633 - DNA, 22 bp, Artificial Sequence
  Synthetic oligonucleotide; CTT chr11 5172973 5172994 5172978 5172973 -
cttaagaatgaaaagtatataa

SEQ ID NO: 152634 - DNA, 22 bp, Artificial Sequence
  Synthetic oligonucleotide; TTC chr11 5172972 5172993 5172977 5172972 -
ttaagaatgaaaagtatataat

SEQ ID NO: 152635 - DNA, 22 bp, Artificial Sequence
  Synthetic oligonucleotide; CTT chr11 5172970 5172991 5172975 5172970 -
aagaatgaaaagtatataatat

SEQ ID NO: 152636 - DNA, 22 bp, Artificial Sequence
  Synthetic oligonucleotide; TTA chr11 5172969 5172990 5172974 5172969 -
agaatgaaaagtatataatatt

SEQ ID NO: 152637 - DNA, 22 bp, Artificial Sequence
  Synthetic oligonucleotide; TTA chr11 5172946 5172967 5172951 5172946 -
ataaaatgtatgttaacctgac

SEQ ID NO: 152638 - DNA, 22 bp, Artificial Sequence
  Synthetic oligonucleotide; TTA chr11 5172931 5172952 5172936 5172931 -
acctgactacataaaagttttg

SEQ ID NO: 152639 - DNA, 22 bp, Artificial Sequence
  Synthetic oligonucleotide; CTG chr11 5172926 5172947 5172931 5172926 -
actacataaaagttttgtaaat

SEQ ID NO: 152640 - DNA, 22 bp, Artificial Sequence
  Synthetic oligonucleotide; CTA chr11 5172922 5172943 5172927 5172922 -
cataaaagttttgtaaatgatt

SEQ ID NO: 152641 - DNA, 22 bp, Artificial Sequence
  Synthetic oligonucleotide; TTT chr11 5172911 5172932 5172916 5172911 -
tgtaaatgattgtgtatgaaaa

SEQ ID NO: 152642 - DNA, 22 bp, Artificial Sequence
  Synthetic oligonucleotide; TTT chr11 5172910 5172931 5172915 5172910 -
gtaaatgattgtgtatgaaaaa

SEQ ID NO: 152643 - DNA, 22 bp, Artificial Sequence
  Synthetic oligonucleotide; TTG chr11 5172909 5172930 5172914 5172909 -
taaatgattgtgtatgaaaaaa

SEQ ID NO: 152644 - DNA, 22 bp, Artificial Sequence
  Synthetic oligonucleotide; TTG chr11 5172899 5172920 5172904 5172899 -
tgtatgaaaaaattaatgaaga

SEQ ID NO: 152645 - DNA, 22 bp, Artificial Sequence
  Synthetic oligonucleotide; TTA chr11 5172884 5172905 5172889 5172884 -
atgaagataagatgcgggggaa

SEQ ID NO: 152646 - DNA, 22 bp, Artificial Sequence
  Synthetic oligonucleotide; CTT chr11 5172834 5172855 5172839 5172834 -
atatttaaattataattaatga

SEQ ID NO: 152647 - DNA, 22 bp, Artificial Sequence
  Synthetic oligonucleotide; TTA chr11 5172833 5172854 5172838 5172833 -
tatttaaattataattaatgat

SEQ ID NO: 152648 - DNA, 22 bp, Artificial Sequence
  Synthetic oligonucleotide; TTT chr11 5172828 5172849 5172833 5172828 -
aaattataattaatgatattgt

SEQ ID NO: 152649 - DNA, 22 bp, Artificial Sequence
  Synthetic oligonucleotide; TTA chr11 5172827 5172848 5172832 5172827 -
aattataattaatgatattgtg

SEQ ID NO: 152650 - DNA, 22 bp, Artificial Sequence
  Synthetic oligonucleotide; TTA chr11 5172822 5172843 5172827 5172822 -
taattaatgatattgtgtaact

SEQ ID NO: 152651 - DNA, 22 bp, Artificial Sequence
  Synthetic oligonucleotide; TTA chr11 5172816 5172837 5172821 5172816 -
atgatattgtgtaactatttta

SEQ ID NO: 152652 - DNA, 22 bp, Artificial Sequence
  Synthetic oligonucleotide; TTG chr11 5172807 5172828 5172812 5172807 -
tgtaactattttatgtttattt

SEQ ID NO: 152653 - DNA, 22 bp, Artificial Sequence
  Synthetic oligonucleotide; CTA chr11 5172799 5172820 5172804 5172799 -
ttttatgtttatttgggttttg

SEQ ID NO: 152654 - DNA, 22 bp, Artificial Sequence
  Synthetic oligonucleotide; TTT chr11 5172796 5172817 5172801 5172796 -
tatgtttatttgggttttgcat

SEQ ID NO: 152655 - DNA, 22 bp, Artificial Sequence
  Synthetic oligonucleotide; TTT chr11 5172795 5172816 5172800 5172795 -
atgtttatttgggttttgcatt

SEQ ID NO: 152656 - DNA, 22 bp, Artificial Sequence
  Synthetic oligonucleotide; TTA chr11 5172794 5172815 5172799 5172794 -
tgtttatttgggttttgcattg

SEQ ID NO: 152657 - DNA, 22 bp, Artificial Sequence
  Synthetic oligonucleotide; TTT chr11 5172789 5172810 5172794 5172789 -
atttgggttttgcattgacatt

SEQ ID NO: 152658 - DNA, 22 bp, Artificial Sequence
  Synthetic oligonucleotide; TTA chr11 5172788 5172809 5172793 5172788 -
tttgggttttgcattgacattg

SEQ ID NO: 152659 - DNA, 22 bp, Artificial Sequence
  Synthetic oligonucleotide; TTT chr11 5172785 5172806 5172790 5172785 -
gggttttgcattgacattggca

SEQ ID NO: 152660 - DNA, 22 bp, Artificial Sequence
  Synthetic oligonucleotide; TTG chr11 5172784 5172805 5172789 5172784 -
ggttttgcattgacattggcat

SEQ ID NO: 152661 - DNA, 22 bp, Artificial Sequence
  Synthetic oligonucleotide; TTT chr11 5172779 5172800 5172784 5172779 -
tgcattgacattggcatgttct

SEQ ID NO: 152662 - DNA, 22 bp, Artificial Sequence
  Synthetic oligonucleotide; TTT chr11 5172778 5172799 5172783 5172778 -
gcattgacattggcatgttctt

SEQ ID NO: 152663 - DNA, 22 bp, Artificial Sequence
  Synthetic oligonucleotide; TTG chr11 5172777 5172798 5172782 5172777 -
cattgacattggcatgttctta

SEQ ID NO: 152664 - DNA, 22 bp, Artificial Sequence
  Synthetic oligonucleotide; TTG chr11 5172772 5172793 5172777 5172772 -
acattggcatgttcttatgtat

SEQ ID NO: 152665 - DNA, 22 bp, Artificial Sequence
  Synthetic oligonucleotide; TTG chr11 5172766 5172787 5172771 5172766 -
gcatgttcttatgtatactctc

SEQ ID NO: 152666 - DNA, 22 bp, Artificial Sequence
  Synthetic oligonucleotide; TTC chr11 5172758 5172779 5172763 5172758 -
ttatgtatactctctccagcat

SEQ ID NO: 152667 - DNA, 22 bp, Artificial Sequence
  Synthetic oligonucleotide; CTT chr11 5172756 5172777 5172761 5172756 -
atgtatactctctccagcatgc

SEQ ID NO: 152668 - DNA, 22 bp, Artificial Sequence
  Synthetic oligonucleotide; TTA chr11 5172755 5172776 5172760 5172755 -
tgtatactctctccagcatgct

SEQ ID NO: 152669 - DNA, 22 bp, Artificial Sequence
  Synthetic oligonucleotide; CTC chr11 5172746 5172767 5172751 5172746 -
tctccagcatgcttctcaggaa

SEQ ID NO: 152670 - DNA, 22 bp, Artificial Sequence
  Synthetic oligonucleotide; CTC chr11 5172744 5172765 5172749 5172744 -
tccagcatgcttctcaggaact

SEQ ID NO: 152671 - DNA, 22 bp, Artificial Sequence
  Synthetic oligonucleotide; CTC chr11 5172742 5172763 5172747 5172742 -
cagcatgcttctcaggaactat

SEQ ID NO: 152672 - DNA, 22 bp, Artificial Sequence
  Synthetic oligonucleotide; CTT chr11 5172732 5172753 5172737 5172732 -
ctcaggaactattccccccttt

SEQ ID NO: 152673 - DNA, 22 bp, Artificial Sequence
  Synthetic oligonucleotide; TTC chr11 5172731 5172752 5172736 5172731 -
tcaggaactattcccccctttc

SEQ ID NO: 152674 - DNA, 22 bp, Artificial Sequence
  Synthetic oligonucleotide; CTC chr11 5172729 5172750 5172734 5172729 -
aggaactattcccccctttctc

SEQ ID NO: 152675 - DNA, 22 bp, Artificial Sequence
  Synthetic oligonucleotide; CTA chr11 5172721 5172742 5172726 5172721 -
ttcccccctttctctctaatac

SEQ ID NO: 152676 - DNA, 22 bp, Artificial Sequence
  Synthetic oligonucleotide; TTC chr11 5172718 5172739 5172723 5172718 -
ccccctttctctctaatacacc

SEQ ID NO: 152677 - DNA, 22 bp, Artificial Sequence
  Synthetic oligonucleotide; CTT chr11 5172711 5172732 5172716 5172711 -
tctctctaatacacccgaagtt

SEQ ID NO: 152678 - DNA, 22 bp, Artificial Sequence
  Synthetic oligonucleotide; TTT chr11 5172710 5172731 5172715 5172710 -
ctctctaatacacccgaagttt

SEQ ID NO: 152679 - DNA, 22 bp, Artificial Sequence
  Synthetic oligonucleotide; TTC chr11 5172709 5172730 5172714 5172709 -
tctctaatacacccgaagtttc

SEQ ID NO: 152680 - DNA, 22 bp, Artificial Sequence
  Synthetic oligonucleotide; CTC chr11 5172707 5172728 5172712 5172707 -
tctaatacacccgaagtttctg

SEQ ID NO: 152681 - DNA, 22 bp, Artificial Sequence
  Synthetic oligonucleotide; CTC chr11 5172705 5172726 5172710 5172705 -
taatacacccgaagtttctggg

SEQ ID NO: 152682 - DNA, 22 bp, Artificial Sequence
  Synthetic oligonucleotide; CTA chr11 5172703 5172724 5172708 5172703 -
atacacccgaagtttctgggaa

SEQ ID NO: 152683 - DNA, 22 bp, Artificial Sequence
  Synthetic oligonucleotide; TTT chr11 5172688 5172709 5172693 5172688 -
ctgggaataattattcttggtt

SEQ ID NO: 152684 - DNA, 22 bp, Artificial Sequence
  Synthetic oligonucleotide; TTC chr11 5172687 5172708 5172692 5172687 -
tgggaataattattcttggtta

SEQ ID NO: 152685 - DNA, 22 bp, Artificial Sequence
  Synthetic oligonucleotide; CTG chr11 5172685 5172706 5172690 5172685 -
ggaataattattcttggttaat

SEQ ID NO: 152686 - DNA, 22 bp, Artificial Sequence
  Synthetic oligonucleotide; TTA chr11 5172675 5172696 5172680 5172675 -
ttcttggttaattgcttcttga

SEQ ID NO: 152687 - DNA, 22 bp, Artificial Sequence
  Synthetic oligonucleotide; TTC chr11 5172672 5172693 5172677 5172672 -
ttggttaattgcttcttgaggg

SEQ ID NO: 152688 - DNA, 22 bp, Artificial Sequence
  Synthetic oligonucleotide; CTT chr11 5172670 5172691 5172675 5172670 -
ggttaattgcttcttgagggat

SEQ ID NO: 152689 - DNA, 22 bp, Artificial Sequence
  Synthetic oligonucleotide; TTG chr11 5172669 5172690 5172674 5172669 -
gttaattgcttcttgagggata

SEQ ID NO: 152690 - DNA, 22 bp, Artificial Sequence
  Synthetic oligonucleotide; TTA chr11 5172665 5172686 5172670 5172665 -
attgcttcttgagggatactga

SEQ ID NO: 152691 - DNA, 22 bp, Artificial Sequence
  Synthetic oligonucleotide; TTG chr11 5172661 5172682 5172666 5172661 -
cttcttgagggatactgaatca

SEQ ID NO: 152692 - DNA, 22 bp, Artificial Sequence
  Synthetic oligonucleotide; CTT chr11 5172658 5172679 5172663 5172658 -
cttgagggatactgaatcattc

SEQ ID NO: 152693 - DNA, 22 bp, Artificial Sequence
  Synthetic oligonucleotide; TTC chr11 5172657 5172678 5172662 5172657 -
ttgagggatactgaatcattct

SEQ ID NO: 152694 - DNA, 22 bp, Artificial Sequence
  Synthetic oligonucleotide; CTT chr11 5172655 5172676 5172660 5172655 -
gagggatactgaatcattctgt

SEQ ID NO: 152695 - DNA, 22 bp, Artificial Sequence
  Synthetic oligonucleotide; TTG chr11 5172654 5172675 5172659 5172654 -
agggatactgaatcattctgtc

SEQ ID NO: 152696 - DNA, 22 bp, Artificial Sequence
  Synthetic oligonucleotide; CTG chr11 5172644 5172665 5172649 5172644 -
aatcattctgtctctatgtcct

SEQ ID NO: 152697 - DNA, 22 bp, Artificial Sequence
  Synthetic oligonucleotide; TTC chr11 5172636 5172657 5172641 5172636 -
tgtctctatgtcctccagtcaa

SEQ ID NO: 152698 - DNA, 22 bp, Artificial Sequence
  Synthetic oligonucleotide; CTG chr11 5172634 5172655 5172639 5172634 -
tctctatgtcctccagtcaact

SEQ ID NO: 152699 - DNA, 22 bp, Artificial Sequence
  Synthetic oligonucleotide; CTC chr11 5172630 5172651 5172635 5172630 -
tatgtcctccagtcaactaagc

SEQ ID NO: 152700 - DNA, 22 bp, Artificial Sequence
  Synthetic oligonucleotide; CTA chr11 5172628 5172649 5172633 5172628 -
tgtcctccagtcaactaagcac

SEQ ID NO: 152701 - DNA, 22 bp, Artificial Sequence
  Synthetic oligonucleotide; CTC chr11 5172621 5172642 5172626 5172621 -
cagtcaactaagcacatataca

SEQ ID NO: 152702 - DNA, 22 bp, Artificial Sequence
  Synthetic oligonucleotide; CTA chr11 5172611 5172632 5172616 5172611 -
agcacatatacagggaggtagt

SEQ ID NO: 152703 - DNA, 22 bp, Artificial Sequence
  Synthetic oligonucleotide; CTA chr11 5172584 5172605 5172589 5172584 -
tgtccacagcccagttgaaagt

SEQ ID NO: 152704 - DNA, 22 bp, Artificial Sequence
  Synthetic oligonucleotide; TTG chr11 5172567 5172588 5172572 5172567 -
aaagtaaacagtaacaaatagt

SEQ ID NO: 152705 - DNA, 22 bp, Artificial Sequence
  Synthetic oligonucleotide; TTG chr11 5172533 5172554 5172538 5172533 -
atgtggtagctctcagttccac

SEQ ID NO: 152706 - DNA, 22 bp, Artificial Sequence
  Synthetic oligonucleotide; CTC chr11 5172521 5172542 5172526 5172521 -
tcagttccacctaggtaagtat

SEQ ID NO: 152707 - DNA, 22 bp, Artificial Sequence
  Synthetic oligonucleotide; CTC chr11 5172519 5172540 5172524 5172519 -
agttccacctaggtaagtatct

SEQ ID NO: 152708 - DNA, 22 bp, Artificial Sequence
  Synthetic oligonucleotide; TTC chr11 5172514 5172535 5172519 5172514 -
cacctaggtaagtatctgaggt

SEQ ID NO: 152709 - DNA, 22 bp, Artificial Sequence
  Synthetic oligonucleotide; CTA chr11 5172508 5172529 5172513 5172508 -
ggtaagtatctgaggtctagga

SEQ ID NO: 152710 - DNA, 22 bp, Artificial Sequence
  Synthetic oligonucleotide; CTG chr11 5172496 5172517 5172501 5172496 -
aggtctaggatcaactatagtt

SEQ ID NO: 152711 - DNA, 22 bp, Artificial Sequence
  Synthetic oligonucleotide; CTA chr11 5172489 5172510 5172494 5172489 -
ggatcaactatagttatgccta

SEQ ID NO: 152712 - DNA, 22 bp, Artificial Sequence
  Synthetic oligonucleotide; CTA chr11 5172479 5172500 5172484 5172479 -
tagttatgcctaatggtataat

SEQ ID NO: 152713 - DNA, 22 bp, Artificial Sequence
  Synthetic oligonucleotide; TTA chr11 5172473 5172494 5172478 5172473 -
tgcctaatggtataatgtgctg

SEQ ID NO: 152714 - DNA, 22 bp, Artificial Sequence
  Synthetic oligonucleotide; CTA chr11 5172467 5172488 5172472 5172467 -
atggtataatgtgctggcttgc

SEQ ID NO: 152715 - DNA, 22 bp, Artificial Sequence
  Synthetic oligonucleotide; CTG chr11 5172451 5172472 5172456 5172451 -
gcttgcaccagcttaggaaagc

SEQ ID NO: 152716 - DNA, 22 bp, Artificial Sequence
  Synthetic oligonucleotide; CTT chr11 5172447 5172468 5172452 5172447 -
gcaccagcttaggaaagctgat

SEQ ID NO: 152717 - DNA, 22 bp, Artificial Sequence
  Synthetic oligonucleotide; TTG chr11 5172446 5172467 5172451 5172446 -
caccagcttaggaaagctgatt

SEQ ID NO: 152718 - DNA, 22 bp, Artificial Sequence
  Synthetic oligonucleotide; CTT chr11 5172437 5172458 5172442 5172437 -
aggaaagctgattatgctcatc

SEQ ID NO: 152719 - DNA, 22 bp, Artificial Sequence
  Synthetic oligonucleotide; TTA chr11 5172436 5172457 5172441 5172436 -
ggaaagctgattatgctcatct

SEQ ID NO: 152720 - DNA, 22 bp, Artificial Sequence
  Synthetic oligonucleotide; CTG chr11 5172427 5172448 5172432 5172427 -
attatgctcatctcagctctgc

SEQ ID NO: 152721 - DNA, 22 bp, Artificial Sequence
  Synthetic oligonucleotide; TTA chr11 5172423 5172444 5172428 5172423 -
tgctcatctcagctctgcattt

SEQ ID NO: 152722 - DNA, 22 bp, Artificial Sequence
  Synthetic oligonucleotide; CTC chr11 5172418 5172439 5172423 5172418 -
atctcagctctgcatttaatag

SEQ ID NO: 152723 - DNA, 22 bp, Artificial Sequence
  Synthetic oligonucleotide; CTC chr11 5172413 5172434 5172418 5172413 -
agctctgcatttaatagcatct

SEQ ID NO: 152724 - DNA, 22 bp, Artificial Sequence
  Synthetic oligonucleotide; CTC chr11 5172408 5172429 5172413 5172408 -
tgcatttaatagcatctctttg

SEQ ID NO: 152725 - DNA, 22 bp, Artificial Sequence
  Synthetic oligonucleotide; CTG chr11 5172406 5172427 5172411 5172406 -
catttaatagcatctctttggt

SEQ ID NO: 152726 - DNA, 22 bp, Artificial Sequence
  Synthetic oligonucleotide; TTT chr11 5172401 5172422 5172406 5172401 -
aatagcatctctttggtagtct

SEQ ID NO: 152727 - DNA, 22 bp, Artificial Sequence
  Synthetic oligonucleotide; TTA chr11 5172400 5172421 5172405 5172400 -
atagcatctctttggtagtctg

SEQ ID NO: 152728 - DNA, 22 bp, Artificial Sequence
  Synthetic oligonucleotide; CTC chr11 5172390 5172411 5172395 5172390 -
tttggtagtctgaaattgatca

SEQ ID NO: 152729 - DNA, 22 bp, Artificial Sequence
  Synthetic oligonucleotide; CTT chr11 5172388 5172409 5172393 5172388 -
tggtagtctgaaattgatcatg

SEQ ID NO: 152730 - DNA, 22 bp, Artificial Sequence
  Synthetic oligonucleotide; TTT chr11 5172387 5172408 5172392 5172387 -
ggtagtctgaaattgatcatgg

SEQ ID NO: 152731 - DNA, 22 bp, Artificial Sequence
  Synthetic oligonucleotide; TTG chr11 5172386 5172407 5172391 5172386 -
gtagtctgaaattgatcatggt

SEQ ID NO: 152732 - DNA, 22 bp, Artificial Sequence
  Synthetic oligonucleotide; CTG chr11 5172378 5172399 5172383 5172378 -
aaattgatcatggtaggagtca

SEQ ID NO: 152733 - DNA, 22 bp, Artificial Sequence
  Synthetic oligonucleotide; TTG chr11 5172372 5172393 5172377 5172372 -
atcatggtaggagtcattaaaa

SEQ ID NO: 152734 - DNA, 22 bp, Artificial Sequence
  Synthetic oligonucleotide; TTA chr11 5172353 5172374 5172358 5172353 -
aaacacaaaaaatcggtaactg

SEQ ID NO: 152735 - DNA, 22 bp, Artificial Sequence
  Synthetic oligonucleotide; CTG chr11 5172331 5172352 5172336 5172331 -
gtaaaaatcagggcatttttat

SEQ ID NO: 152736 - DNA, 22 bp, Artificial Sequence
  Synthetic oligonucleotide; TTT chr11 5172313 5172334 5172318 5172313 -
ttatttggaaatatttattact

SEQ ID NO: 152737 - DNA, 22 bp, Artificial Sequence
  Synthetic oligonucleotide; TTT chr11 5172312 5172333 5172317 5172312 -
tatttggaaatatttattacta

SEQ ID NO: 152738 - DNA, 22 bp, Artificial Sequence
  Synthetic oligonucleotide; TTT chr11 5172311 5172332 5172316 5172311 -
atttggaaatatttattactat

SEQ ID NO: 152739 - DNA, 22 bp, Artificial Sequence
  Synthetic oligonucleotide; TTA chr11 5172310 5172331 5172315 5172310 -
tttggaaatatttattactatc

SEQ ID NO: 152740 - DNA, 22 bp, Artificial Sequence
  Synthetic oligonucleotide; TTT chr11 5172307 5172328 5172312 5172307 -
ggaaatatttattactatccca

SEQ ID NO: 152741 - DNA, 22 bp, Artificial Sequence
  Synthetic oligonucleotide; TTG chr11 5172306 5172327 5172311 5172306 -
gaaatatttattactatcccac

SEQ ID NO: 152742 - DNA, 22 bp, Artificial Sequence
  Synthetic oligonucleotide; TTT chr11 5172297 5172318 5172302 5172297 -
attactatcccactgattatgc

SEQ ID NO: 152743 - DNA, 22 bp, Artificial Sequence
  Synthetic oligonucleotide; TTA chr11 5172296 5172317 5172301 5172296 -
ttactatcccactgattatgcc

SEQ ID NO: 152744 - DNA, 22 bp, Artificial Sequence
  Synthetic oligonucleotide; TTA chr11 5172293 5172314 5172298 5172293 -
ctatcccactgattatgcctaa

SEQ ID NO: 152745 - DNA, 22 bp, Artificial Sequence
  Synthetic oligonucleotide; CTA chr11 5172290 5172311 5172295 5172290 -
tcccactgattatgcctaacga

SEQ ID NO: 152746 - DNA, 22 bp, Artificial Sequence
  Synthetic oligonucleotide; CTG chr11 5172282 5172303 5172287 5172282 -
attatgcctaacgaagagccct

SEQ ID NO: 152747 - DNA, 22 bp, Artificial Sequence
  Synthetic oligonucleotide; TTA chr11 5172278 5172299 5172283 5172278 -
tgcctaacgaagagccctggcc

SEQ ID NO: 152748 - DNA, 22 bp, Artificial Sequence
  Synthetic oligonucleotide; CTA chr11 5172272 5172293 5172277 5172272 -
acgaagagccctggcccaacac

SEQ ID NO: 152749 - DNA, 22 bp, Artificial Sequence
  Synthetic oligonucleotide; CTG chr11 5172259 5172280 5172264 5172259 -
gcccaacacgggaagaagagtt

SEQ ID NO: 152750 - DNA, 22 bp, Artificial Sequence
  Synthetic oligonucleotide; TTC chr11 5172236 5172257 5172241 5172236 -
agccttggtcacattcttattt

SEQ ID NO: 152751 - DNA, 22 bp, Artificial Sequence
  Synthetic oligonucleotide; CTT chr11 5172230 5172251 5172235 5172230 -
ggtcacattcttatttctgagc

SEQ ID NO: 152752 - DNA, 22 bp, Artificial Sequence
  Synthetic oligonucleotide; TTG chr11 5172229 5172250 5172234 5172229 -
gtcacattcttatttctgagcc

SEQ ID NO: 152753 - DNA, 22 bp, Artificial Sequence
  Synthetic oligonucleotide; TTC chr11 5172220 5172241 5172225 5172220 -
ttatttctgagccccatcctga

SEQ ID NO: 152754 - DNA, 22 bp, Artificial Sequence
  Synthetic oligonucleotide; CTT chr11 5172218 5172239 5172223 5172218 -
atttctgagccccatcctgaat

SEQ ID NO: 152755 - DNA, 22 bp, Artificial Sequence
  Synthetic oligonucleotide; TTA chr11 5172217 5172238 5172222 5172217 -
tttctgagccccatcctgaatt

SEQ ID NO: 152756 - DNA, 22 bp, Artificial Sequence
  Synthetic oligonucleotide; TTT chr11 5172214 5172235 5172219 5172214 -
ctgagccccatcctgaattcca

SEQ ID NO: 152757 - DNA, 22 bp, Artificial Sequence
  Synthetic oligonucleotide; TTC chr11 5172213 5172234 5172218 5172213 -
tgagccccatcctgaattccat

SEQ ID NO: 152758 - DNA, 22 bp, Artificial Sequence
  Synthetic oligonucleotide; CTG chr11 5172211 5172232 5172216 5172211 -
agccccatcctgaattccattt

SEQ ID NO: 152759 - DNA, 22 bp, Artificial Sequence
  Synthetic oligonucleotide; CTG chr11 5172199 5172220 5172204 5172199 -
aattccatttctggcctccaac

SEQ ID NO: 152760 - DNA, 22 bp, Artificial Sequence
  Synthetic oligonucleotide; TTC chr11 5172194 5172215 5172199 5172194 -
catttctggcctccaacgttaa

SEQ ID NO: 152761 - DNA, 22 bp, Artificial Sequence
  Synthetic oligonucleotide; TTT chr11 5172189 5172210 5172194 5172189 -
ctggcctccaacgttaatacct

SEQ ID NO: 152762 - DNA, 22 bp, Artificial Sequence
  Synthetic oligonucleotide; TTC chr11 5172188 5172209 5172193 5172188 -
tggcctccaacgttaataccta

SEQ ID NO: 152763 - DNA, 22 bp, Artificial Sequence
  Synthetic oligonucleotide; CTG chr11 5172186 5172207 5172191 5172186 -
gcctccaacgttaatacctaag

SEQ ID NO: 152764 - DNA, 22 bp, Artificial Sequence
  Synthetic oligonucleotide; CTC chr11 5172181 5172202 5172186 5172181 -
caacgttaatacctaaggctct

SEQ ID NO: 152765 - DNA, 22 bp, Artificial Sequence
  Synthetic oligonucleotide; TTA chr11 5172173 5172194 5172178 5172173 -
atacctaaggctctgctgcaga

SEQ ID NO: 152766 - DNA, 22 bp, Artificial Sequence
  Synthetic oligonucleotide; CTA chr11 5172166 5172187 5172171 5172166 -
aggctctgctgcagataagtgg

SEQ ID NO: 152767 - DNA, 22 bp, Artificial Sequence
  Synthetic oligonucleotide; CTC chr11 5172160 5172181 5172165 5172160 -
tgctgcagataagtggaacttt

SEQ ID NO: 152768 - DNA, 22 bp, Artificial Sequence
  Synthetic oligonucleotide; CTG chr11 5172158 5172179 5172163 5172158 -
ctgcagataagtggaactttag

SEQ ID NO: 152769 - DNA, 22 bp, Artificial Sequence
  Synthetic oligonucleotide; CTG chr11 5172155 5172176 5172160 5172155 -
cagataagtggaactttagtgt

SEQ ID NO: 152770 - DNA, 22 bp, Artificial Sequence
  Synthetic oligonucleotide; CTT chr11 5172139 5172160 5172144 5172139 -
tagtgttaataaacttgttccc

SEQ ID NO: 152771 - DNA, 22 bp, Artificial Sequence
  Synthetic oligonucleotide; TTT chr11 5172138 5172159 5172143 5172138 -
agtgttaataaacttgttccca

SEQ ID NO: 152772 - DNA, 22 bp, Artificial Sequence
  Synthetic oligonucleotide; TTA chr11 5172137 5172158 5172142 5172137 -
gtgttaataaacttgttcccag

SEQ ID NO: 152773 - DNA, 22 bp, Artificial Sequence
  Synthetic oligonucleotide; TTA chr11 5172131 5172152 5172136 5172131 -
ataaacttgttcccagataaat

SEQ ID NO: 152774 - DNA, 22 bp, Artificial Sequence
  Synthetic oligonucleotide; CTT chr11 5172123 5172144 5172128 5172123 -
gttcccagataaatatctctaa

SEQ ID NO: 152775 - DNA, 22 bp, Artificial Sequence
  Synthetic oligonucleotide; TTG chr11 5172122 5172143 5172127 5172122 -
ttcccagataaatatctctaag

SEQ ID NO: 152776 - DNA, 22 bp, Artificial Sequence
  Synthetic oligonucleotide; TTC chr11 5172119 5172140 5172124 5172119 -
ccagataaatatctctaagcct

SEQ ID NO: 152777 - DNA, 22 bp, Artificial Sequence
  Synthetic oligonucleotide; CTC chr11 5172104 5172125 5172109 5172104 -
taagcctgtaccctagccccac

SEQ ID NO: 152778 - DNA, 22 bp, Artificial Sequence
  Synthetic oligonucleotide; CTA chr11 5172102 5172123 5172107 5172102 -
agcctgtaccctagccccacca

SEQ ID NO: 152779 - DNA, 22 bp, Artificial Sequence
  Synthetic oligonucleotide; CTG chr11 5172096 5172117 5172101 5172096 -
taccctagccccaccatcacat

SEQ ID NO: 152780 - DNA, 22 bp, Artificial Sequence
  Synthetic oligonucleotide; CTA chr11 5172089 5172110 5172094 5172089 -
gccccaccatcacatgtgactt

SEQ ID NO: 152781 - DNA, 22 bp, Artificial Sequence
  Synthetic oligonucleotide; CTT chr11 5172067 5172088 5172072 5172067 -
gtgagatactgatgcttctgat

SEQ ID NO: 152782 - DNA, 22 bp, Artificial Sequence
  Synthetic oligonucleotide; TTG chr11 5172066 5172087 5172071 5172066 -
tgagatactgatgcttctgatc

SEQ ID NO: 152783 - DNA, 22 bp, Artificial Sequence
  Synthetic oligonucleotide; CTG chr11 5172056 5172077 5172061 5172056 -
atgcttctgatcttgctccctg

SEQ ID NO: 152784 - DNA, 22 bp, Artificial Sequence
  Synthetic oligonucleotide; CTT chr11 5172050 5172071 5172055 5172050 -
ctgatcttgctccctgacccgg

SEQ ID NO: 152785 - DNA, 22 bp, Artificial Sequence
  Synthetic oligonucleotide; TTC chr11 5172049 5172070 5172054 5172049 -
tgatcttgctccctgacccggt

SEQ ID NO: 152786 - DNA, 22 bp, Artificial Sequence
  Synthetic oligonucleotide; CTG chr11 5172047 5172068 5172052 5172047 -
atcttgctccctgacccggttc

SEQ ID NO: 152787 - DNA, 22 bp, Artificial Sequence
  Synthetic oligonucleotide; CTT chr11 5172042 5172063 5172047 5172042 -
gctccctgacccggttccagca

SEQ ID NO: 152788 - DNA, 22 bp, Artificial Sequence
  Synthetic oligonucleotide; TTG chr11 5172041 5172062 5172046 5172041 -
ctccctgacccggttccagcag

SEQ ID NO: 152789 - DNA, 22 bp, Artificial Sequence
  Synthetic oligonucleotide; CTC chr11 5172038 5172059 5172043 5172038 -
cctgacccggttccagcagaag

SEQ ID NO: 152790 - DNA, 22 bp, Artificial Sequence
  Synthetic oligonucleotide; CTG chr11 5172034 5172055 5172039 5172034 -
acccggttccagcagaagactg

SEQ ID NO: 152791 - DNA, 22 bp, Artificial Sequence
  Synthetic oligonucleotide; TTC chr11 5172025 5172046 5172030 5172025 -
cagcagaagactgacccttctg

SEQ ID NO: 152792 - DNA, 22 bp, Artificial Sequence
  Synthetic oligonucleotide; CTG chr11 5172012 5172033 5172017 5172012 -
acccttctgcaaaatacagagg

SEQ ID NO: 152793 - DNA, 22 bp, Artificial Sequence
  Synthetic oligonucleotide; CTT chr11 5172006 5172027 5172011 5172006 -
ctgcaaaatacagaggagcttt

SEQ ID NO: 152794 - DNA, 22 bp, Artificial Sequence
  Synthetic oligonucleotide; TTC chr11 5172005 5172026 5172010 5172005 -
tgcaaaatacagaggagctttt

SEQ ID NO: 152795 - DNA, 22 bp, Artificial Sequence
  Synthetic oligonucleotide; CTG chr11 5172003 5172024 5172008 5172003 -
caaaatacagaggagcttttct

SEQ ID NO: 152796 - DNA, 22 bp, Artificial Sequence
  Synthetic oligonucleotide; CTT chr11 5171985 5172006 5171990 5171985 -
ttctaatctatggatagcaggt

SEQ ID NO: 152797 - DNA, 22 bp, Artificial Sequence
  Synthetic oligonucleotide; TTT chr11 5171984 5172005 5171989 5171984 -
tctaatctatggatagcaggtg

SEQ ID NO: 152798 - DNA, 22 bp, Artificial Sequence
  Synthetic oligonucleotide; TTT chr11 5171983 5172004 5171988 5171983 -
ctaatctatggatagcaggtgg

SEQ ID NO: 152799 - DNA, 22 bp, Artificial Sequence
  Synthetic oligonucleotide; TTC chr11 5171982 5172003 5171987 5171982 -
taatctatggatagcaggtgga

SEQ ID NO: 152800 - DNA, 22 bp, Artificial Sequence
  Synthetic oligonucleotide; CTA chr11 5171980 5172001 5171985 5171980 -
atctatggatagcaggtggaga

SEQ ID NO: 152801 - DNA, 22 bp, Artificial Sequence
  Synthetic oligonucleotide; CTA chr11 5171975 5171996 5171980 5171975 -
tggatagcaggtggagaaagag

SEQ ID NO: 152802 - DNA, 22 bp, Artificial Sequence
  Synthetic oligonucleotide; CTG chr11 5171946 5171967 5171951 5171946 -
gtaagttaaagaaaaaaatgga

SEQ ID NO: 152803 - DNA, 22 bp, Artificial Sequence
  Synthetic oligonucleotide; TTA chr11 5171938 5171959 5171943 5171938 -
aagaaaaaaatggaaaatactt

SEQ ID NO: 152804 - DNA, 22 bp, Artificial Sequence
  Synthetic oligonucleotide; CTT chr11 5171916 5171937 5171921 5171916 -
tattctaggagaaactatcctt

SEQ ID NO: 152805 - DNA, 22 bp, Artificial Sequence
  Synthetic oligonucleotide; TTT chr11 5171915 5171936 5171920 5171915 -
attctaggagaaactatccttg

SEQ ID NO: 152806 - DNA, 22 bp, Artificial Sequence
  Synthetic oligonucleotide; TTA chr11 5171914 5171935 5171919 5171914 -
ttctaggagaaactatccttgt

SEQ ID NO: 152807 - DNA, 22 bp, Artificial Sequence
  Synthetic oligonucleotide; TTC chr11 5171911 5171932 5171916 5171911 -
taggagaaactatccttgtgtt

SEQ ID NO: 152808 - DNA, 22 bp, Artificial Sequence
  Synthetic oligonucleotide; CTA chr11 5171909 5171930 5171914 5171909 -
ggagaaactatccttgtgttct

SEQ ID NO: 152809 - DNA, 22 bp, Artificial Sequence
  Synthetic oligonucleotide; CTA chr11 5171899 5171920 5171904 5171899 -
tccttgtgttctaatatattaa

SEQ ID NO: 152810 - DNA, 22 bp, Artificial Sequence
  Synthetic oligonucleotide; CTT chr11 5171894 5171915 5171899 5171894 -
gtgttctaatatattaaattgt

SEQ ID NO: 152811 - DNA, 22 bp, Artificial Sequence
  Synthetic oligonucleotide; TTG chr11 5171893 5171914 5171898 5171893 -
tgttctaatatattaaattgtt

SEQ ID NO: 152812 - DNA, 22 bp, Artificial Sequence
  Synthetic oligonucleotide; TTC chr11 5171888 5171909 5171893 5171888 -
taatatattaaattgttctttt

SEQ ID NO: 152813 - DNA, 22 bp, Artificial Sequence
  Synthetic oligonucleotide; CTA chr11 5171886 5171907 5171891 5171886 -
atatattaaattgttcttttta

SEQ ID NO: 152814 - DNA, 22 bp, Artificial Sequence
  Synthetic oligonucleotide; TTA chr11 5171878 5171899 5171883 5171878 -
aattgttctttttattctatac

SEQ ID NO: 152815 - DNA, 22 bp, Artificial Sequence
  Synthetic oligonucleotide; TTG chr11 5171873 5171894 5171878 5171873 -
ttctttttattctatacattta

SEQ ID NO: 152816 - DNA, 22 bp, Artificial Sequence
  Synthetic oligonucleotide; TTC chr11 5171870 5171891 5171875 5171870 -
tttttattctatacatttaata

SEQ ID NO: 152817 - DNA, 22 bp, Artificial Sequence
  Synthetic oligonucleotide; CTT chr11 5171868 5171889 5171873 5171868 -
tttattctatacatttaatatt

SEQ ID NO: 152818 - DNA, 22 bp, Artificial Sequence
  Synthetic oligonucleotide; TTT chr11 5171867 5171888 5171872 5171867 -
ttattctatacatttaatattt

SEQ ID NO: 152819 - DNA, 22 bp, Artificial Sequence
  Synthetic oligonucleotide; TTT chr11 5171866 5171887 5171871 5171866 -
tattctatacatttaatattta

SEQ ID NO: 152820 - DNA, 22 bp, Artificial Sequence
  Synthetic oligonucleotide; TTT chr11 5171865 5171886 5171870 5171865 -
attctatacatttaatatttac

SEQ ID NO: 152821 - DNA, 22 bp, Artificial Sequence
  Synthetic oligonucleotide; TTA chr11 5171864 5171885 5171869 5171864 -
ttctatacatttaatatttact

SEQ ID NO: 152822 - DNA, 22 bp, Artificial Sequence
  Synthetic oligonucleotide; TTC chr11 5171861 5171882 5171866 5171861 -
tatacatttaatatttactata

SEQ ID NO: 152823 - DNA, 22 bp, Artificial Sequence
  Synthetic oligonucleotide; CTA chr11 5171859 5171880 5171864 5171859 -
tacatttaatatttactatatt

SEQ ID NO: 152824 - DNA, 22 bp, Artificial Sequence
  Synthetic oligonucleotide; TTT chr11 5171852 5171873 5171857 5171852 -
aatatttactatattccacata

SEQ ID NO: 152825 - DNA, 22 bp, Artificial Sequence
  Synthetic oligonucleotide; TTA chr11 5171851 5171872 5171856 5171851 -
atatttactatattccacatat

SEQ ID NO: 152826 - DNA, 22 bp, Artificial Sequence
  Synthetic oligonucleotide; TTT chr11 5171845 5171866 5171850 5171845 -
actatattccacatataatgat

SEQ ID NO: 152827 - DNA, 22 bp, Artificial Sequence
  Synthetic oligonucleotide; TTA chr11 5171844 5171865 5171849 5171844 -
ctatattccacatataatgata

SEQ ID NO: 152828 - DNA, 22 bp, Artificial Sequence
  Synthetic oligonucleotide; CTA chr11 5171841 5171862 5171846 5171841 -
tattccacatataatgataaac

SEQ ID NO: 152829 - DNA, 22 bp, Artificial Sequence
  Synthetic oligonucleotide; TTC chr11 5171836 5171857 5171841 5171836 -
cacatataatgataaacaatat

SEQ ID NO: 152830 - DNA, 22 bp, Artificial Sequence
  Synthetic oligonucleotide; TTA chr11 5171804 5171825 5171809 5171804 -
ctttaaaatactattattgtct

SEQ ID NO: 152831 - DNA, 22 bp, Artificial Sequence
  Synthetic oligonucleotide; CTT chr11 5171801 5171822 5171806 5171801 -
taaaatactattattgtcttta

SEQ ID NO: 152832 - DNA, 22 bp, Artificial Sequence
  Synthetic oligonucleotide; TTT chr11 5171800 5171821 5171805 5171800 -
aaaatactattattgtctttat

SEQ ID NO: 152833 - DNA, 22 bp, Artificial Sequence
  Synthetic oligonucleotide; TTA chr11 5171799 5171820 5171804 5171799 -
aaatactattattgtctttata

SEQ ID NO: 152834 - DNA, 22 bp, Artificial Sequence
  Synthetic oligonucleotide; CTA chr11 5171791 5171812 5171796 5171791 -
ttattgtctttatagcaaatat

SEQ ID NO: 152835 - DNA, 22 bp, Artificial Sequence
  Synthetic oligonucleotide; TTA chr11 5171788 5171809 5171793 5171788 -
ttgtctttatagcaaatatctg

SEQ ID NO: 152836 - DNA, 22 bp, Artificial Sequence
  Synthetic oligonucleotide; TTG chr11 5171785 5171806 5171790 5171785 -
tctttatagcaaatatctgggt

SEQ ID NO: 152837 - DNA, 22 bp, Artificial Sequence
  Synthetic oligonucleotide; CTT chr11 5171781 5171802 5171786 5171781 -
tatagcaaatatctgggtctca

SEQ ID NO: 152838 - DNA, 22 bp, Artificial Sequence
  Synthetic oligonucleotide; TTT chr11 5171780 5171801 5171785 5171780 -
atagcaaatatctgggtctcag

SEQ ID NO: 152839 - DNA, 22 bp, Artificial Sequence
  Synthetic oligonucleotide; TTA chr11 5171779 5171800 5171784 5171779 -
tagcaaatatctgggtctcaga

SEQ ID NO: 152840 - DNA, 22 bp, Artificial Sequence
  Synthetic oligonucleotide; CTG chr11 5171766 5171787 5171771 5171766 -
ggtctcagataacttgcaatat

SEQ ID NO: 152841 - DNA, 22 bp, Artificial Sequence
  Synthetic oligonucleotide; CTC chr11 5171760 5171781 5171765 5171760 -
agataacttgcaatataaatca

SEQ ID NO: 152842 - DNA, 22 bp, Artificial Sequence
  Synthetic oligonucleotide; CTT chr11 5171751 5171772 5171756 5171751 -
gcaatataaatcaactttaata

SEQ ID NO: 152843 - DNA, 22 bp, Artificial Sequence
  Synthetic oligonucleotide; TTG chr11 5171750 5171771 5171755 5171750 -
caatataaatcaactttaatat

SEQ ID NO: 152844 - DNA, 22 bp, Artificial Sequence
  Synthetic oligonucleotide; CTT chr11 5171734 5171755 5171739 5171734 -
taatataatcccaagattacac

SEQ ID NO: 152845 - DNA, 22 bp, Artificial Sequence
  Synthetic oligonucleotide; TTT chr11 5171733 5171754 5171738 5171733 -
aatataatcccaagattacacg

SEQ ID NO: 152846 - DNA, 22 bp, Artificial Sequence
  Synthetic oligonucleotide; TTA chr11 5171732 5171753 5171737 5171732 -
atataatcccaagattacacgt

SEQ ID NO: 152847 - DNA, 22 bp, Artificial Sequence
  Synthetic oligonucleotide; TTA chr11 5171715 5171736 5171720 5171715 -
cacgtcaattaaatgttagaac

SEQ ID NO: 152848 - DNA, 22 bp, Artificial Sequence
  Synthetic oligonucleotide; TTA chr11 5171704 5171725 5171709 5171704 -
aatgttagaaccatcaatactc

SEQ ID NO: 152849 - DNA, 22 bp, Artificial Sequence
  Synthetic oligonucleotide; TTA chr11 5171697 5171718 5171702 5171697 -
gaaccatcaatactctttatta

SEQ ID NO: 152850 - DNA, 22 bp, Artificial Sequence
  Synthetic oligonucleotide; CTC chr11 5171682 5171703 5171687 5171682 -
tttattagtgttatattacttt

SEQ ID NO: 152851 - DNA, 22 bp, Artificial Sequence
  Synthetic oligonucleotide; CTT chr11 5171680 5171701 5171685 5171680 -
tattagtgttatattactttag

SEQ ID NO: 152852 - DNA, 22 bp, Artificial Sequence
  Synthetic oligonucleotide; TTT chr11 5171679 5171700 5171684 5171679 -
attagtgttatattactttagc

SEQ ID NO: 152853 - DNA, 22 bp, Artificial Sequence
  Synthetic oligonucleotide; TTA chr11 5171678 5171699 5171683 5171678 -
ttagtgttatattactttagct

SEQ ID NO: 152854 - DNA, 22 bp, Artificial Sequence
  Synthetic oligonucleotide; TTA chr11 5171675 5171696 5171680 5171675 -
gtgttatattactttagctatt

SEQ ID NO: 152855 - DNA, 22 bp, Artificial Sequence
  Synthetic oligonucleotide; TTA chr11 5171669 5171690 5171674 5171669 -
tattactttagctattcatcta

SEQ ID NO: 152856 - DNA, 22 bp, Artificial Sequence
  Synthetic oligonucleotide; TTA chr11 5171664 5171685 5171669 5171664 -
ctttagctattcatctactctc

SEQ ID NO: 152857 - DNA, 22 bp, Artificial Sequence
  Synthetic oligonucleotide; CTT chr11 5171661 5171682 5171666 5171661 -
tagctattcatctactctcttt

SEQ ID NO: 152858 - DNA, 22 bp, Artificial Sequence
  Synthetic oligonucleotide; TTT chr11 5171660 5171681 5171665 5171660 -
agctattcatctactctcttta

SEQ ID NO: 152859 - DNA, 22 bp, Artificial Sequence
  Synthetic oligonucleotide; TTA chr11 5171659 5171680 5171664 5171659 -
gctattcatctactctctttat

SEQ ID NO: 152860 - DNA, 22 bp, Artificial Sequence
  Synthetic oligonucleotide; CTA chr11 5171655 5171676 5171660 5171655 -
ttcatctactctctttataaac

SEQ ID NO: 152861 - DNA, 22 bp, Artificial Sequence
  Synthetic oligonucleotide; TTC chr11 5171652 5171673 5171657 5171652 -
atctactctctttataaacact

SEQ ID NO: 152862 - DNA, 22 bp, Artificial Sequence
  Synthetic oligonucleotide; CTA chr11 5171647 5171668 5171652 5171647 -
ctctctttataaacactacaag

SEQ ID NO: 152863 - DNA, 22 bp, Artificial Sequence
  Synthetic oligonucleotide; CTC chr11 5171644 5171665 5171649 5171644 -
tctttataaacactacaagtta

SEQ ID NO: 152864 - DNA, 22 bp, Artificial Sequence
  Synthetic oligonucleotide; CTC chr11 5171642 5171663 5171647 5171642 -
tttataaacactacaagttagc

SEQ ID NO: 152865 - DNA, 22 bp, Artificial Sequence
  Synthetic oligonucleotide; CTT chr11 5171640 5171661 5171645 5171640 -
tataaacactacaagttagcag

SEQ ID NO: 152866 - DNA, 22 bp, Artificial Sequence
  Synthetic oligonucleotide; TTT chr11 5171639 5171660 5171644 5171639 -
ataaacactacaagttagcagt

SEQ ID NO: 152867 - DNA, 22 bp, Artificial Sequence
  Synthetic oligonucleotide; TTA chr11 5171638 5171659 5171643 5171638 -
taaacactacaagttagcagtt

SEQ ID NO: 152868 - DNA, 22 bp, Artificial Sequence
  Synthetic oligonucleotide; CTA chr11 5171629 5171650 5171634 5171629 -
caagttagcagtttcttcagtc

SEQ ID NO: 152869 - DNA, 22 bp, Artificial Sequence
  Synthetic oligonucleotide; TTA chr11 5171622 5171643 5171627 5171622 -
gcagtttcttcagtcataattt

SEQ ID NO: 152870 - DNA, 22 bp, Artificial Sequence
  Synthetic oligonucleotide; TTT chr11 5171615 5171636 5171620 5171615 -
cttcagtcataatttccatgtg

SEQ ID NO: 152871 - DNA, 22 bp, Artificial Sequence
  Synthetic oligonucleotide; TTC chr11 5171614 5171635 5171619 5171614 -
ttcagtcataatttccatgtga

SEQ ID NO: 152872 - DNA, 22 bp, Artificial Sequence
  Synthetic oligonucleotide; CTT chr11 5171612 5171633 5171617 5171612 -
cagtcataatttccatgtgaat

SEQ ID NO: 152873 - DNA, 22 bp, Artificial Sequence
  Synthetic oligonucleotide; TTC chr11 5171611 5171632 5171616 5171611 -
agtcataatttccatgtgaatc

SEQ ID NO: 152874 - DNA, 22 bp, Artificial Sequence
  Synthetic oligonucleotide; TTT chr11 5171600 5171621 5171605 5171600 -
ccatgtgaatctgtcatctcta

SEQ ID NO: 152875 - DNA, 22 bp, Artificial Sequence
  Synthetic oligonucleotide; TTC chr11 5171599 5171620 5171604 5171599 -
catgtgaatctgtcatctctat

SEQ ID NO: 152876 - DNA, 22 bp, Artificial Sequence
  Synthetic oligonucleotide; CTG chr11 5171587 5171608 5171592 5171587 -
tcatctctatgcttattttaac

SEQ ID NO: 152877 - DNA, 22 bp, Artificial Sequence
  Synthetic oligonucleotide; CTC chr11 5171580 5171601 5171585 5171580 -
tatgcttattttaactgttttt

SEQ ID NO: 152878 - DNA, 22 bp, Artificial Sequence
  Synthetic oligonucleotide; CTA chr11 5171578 5171599 5171583 5171578 -
tgcttattttaactgtttttca

SEQ ID NO: 152879 - DNA, 22 bp, Artificial Sequence
  Synthetic oligonucleotide; CTT chr11 5171573 5171594 5171578 5171573 -
attttaactgtttttcactgcc

SEQ ID NO: 152880 - DNA, 22 bp, Artificial Sequence
  Synthetic oligonucleotide; TTA chr11 5171572 5171593 5171577 5171572 -
ttttaactgtttttcactgcca

SEQ ID NO: 152881 - DNA, 22 bp, Artificial Sequence
  Synthetic oligonucleotide; TTT chr11 5171569 5171590 5171574 5171569 -
taactgtttttcactgccatag

SEQ ID NO: 152882 - DNA, 22 bp, Artificial Sequence
  Synthetic oligonucleotide; TTT chr11 5171568 5171589 5171573 5171568 -
aactgtttttcactgccataga

SEQ ID NO: 152883 - DNA, 22 bp, Artificial Sequence
  Synthetic oligonucleotide; TTA chr11 5171567 5171588 5171572 5171567 -
actgtttttcactgccatagat

SEQ ID NO: 152884 - DNA, 22 bp, Artificial Sequence
  Synthetic oligonucleotide; CTG chr11 5171563 5171584 5171568 5171563 -
tttttcactgccatagatgacc

SEQ ID NO: 152885 - DNA, 22 bp, Artificial Sequence
  Synthetic oligonucleotide; TTT chr11 5171560 5171581 5171565 5171560 -
ttcactgccatagatgacccaa

SEQ ID NO: 152886 - DNA, 22 bp, Artificial Sequence
  Synthetic oligonucleotide; TTT chr11 5171559 5171580 5171564 5171559 -
tcactgccatagatgacccaac

SEQ ID NO: 152887 - DNA, 22 bp, Artificial Sequence
  Synthetic oligonucleotide; TTT chr11 5171558 5171579 5171563 5171558 -
cactgccatagatgacccaact

SEQ ID NO: 152888 - DNA, 22 bp, Artificial Sequence
  Synthetic oligonucleotide; TTC chr11 5171557 5171578 5171562 5171557 -
actgccatagatgacccaactt

SEQ ID NO: 152889 - DNA, 22 bp, Artificial Sequence
  Synthetic oligonucleotide; CTG chr11 5171553 5171574 5171558 5171553 -
ccatagatgacccaacttgaga

SEQ ID NO: 152890 - DNA, 22 bp, Artificial Sequence
  Synthetic oligonucleotide; CTT chr11 5171535 5171556 5171540 5171535 -
gagatttctattaatgccttat

SEQ ID NO: 152891 - DNA, 22 bp, Artificial Sequence
  Synthetic oligonucleotide; TTG chr11 5171534 5171555 5171539 5171534 -
agatttctattaatgccttatc

SEQ ID NO: 152892 - DNA, 22 bp, Artificial Sequence
  Synthetic oligonucleotide; TTT chr11 5171528 5171549 5171533 5171528 -
ctattaatgccttatctggcat

SEQ ID NO: 152893 - DNA, 22 bp, Artificial Sequence
  Synthetic oligonucleotide; TTC chr11 5171527 5171548 5171532 5171527 -
tattaatgccttatctggcata

SEQ ID NO: 152894 - DNA, 22 bp, Artificial Sequence
  Synthetic oligonucleotide; CTA chr11 5171525 5171546 5171530 5171525 -
ttaatgccttatctggcatata

SEQ ID NO: 152895 - DNA, 22 bp, Artificial Sequence
  Synthetic oligonucleotide; TTA chr11 5171522 5171543 5171527 5171522 -
atgccttatctggcatataggc

SEQ ID NO: 152896 - DNA, 22 bp, Artificial Sequence
  Synthetic oligonucleotide; CTT chr11 5171515 5171536 5171520 5171515 -
atctggcatataggctatgttg

SEQ ID NO: 152897 - DNA, 22 bp, Artificial Sequence
  Synthetic oligonucleotide; TTA chr11 5171514 5171535 5171519 5171514 -
tctggcatataggctatgttgg

SEQ ID NO: 152898 - DNA, 22 bp, Artificial Sequence
  Synthetic oligonucleotide; CTG chr11 5171510 5171531 5171515 5171510 -
gcatataggctatgttggaata

SEQ ID NO: 152899 - DNA, 22 bp, Artificial Sequence
  Synthetic oligonucleotide; CTA chr11 5171498 5171519 5171503 5171498 -
tgttggaatacttttctgcatg

SEQ ID NO: 152900 - DNA, 22 bp, Artificial Sequence
  Synthetic oligonucleotide; TTG chr11 5171493 5171514 5171498 5171493 -
gaatacttttctgcatgaccca

SEQ ID NO: 152901 - DNA, 22 bp, Artificial Sequence
  Synthetic oligonucleotide; CTT chr11 5171485 5171506 5171490 5171485 -
ttctgcatgacccattaggttt

SEQ ID NO: 152902 - DNA, 22 bp, Artificial Sequence
  Synthetic oligonucleotide; TTT chr11 5171484 5171505 5171489 5171484 -
tctgcatgacccattaggtttc

SEQ ID NO: 152903 - DNA, 22 bp, Artificial Sequence
  Synthetic oligonucleotide; TTT chr11 5171483 5171504 5171488 5171483 -
ctgcatgacccattaggtttct

SEQ ID NO: 152904 - DNA, 22 bp, Artificial Sequence
  Synthetic oligonucleotide; TTC chr11 5171482 5171503 5171487 5171482 -
tgcatgacccattaggtttctc

SEQ ID NO: 152905 - DNA, 22 bp, Artificial Sequence
  Synthetic oligonucleotide; CTG chr11 5171480 5171501 5171485 5171480 -
catgacccattaggtttctctt

SEQ ID NO: 152906 - DNA, 22 bp, Artificial Sequence
  Synthetic oligonucleotide; TTA chr11 5171468 5171489 5171473 5171468 -
ggtttctcttccactcactgtg

SEQ ID NO: 152907 - DNA, 22 bp, Artificial Sequence
  Synthetic oligonucleotide; TTT chr11 5171463 5171484 5171468 5171463 -
ctcttccactcactgtggctta

SEQ ID NO: 152908 - DNA, 22 bp, Artificial Sequence
  Synthetic oligonucleotide; TTC chr11 5171462 5171483 5171467 5171462 -
tcttccactcactgtggcttac

SEQ ID NO: 152909 - DNA, 22 bp, Artificial Sequence
  Synthetic oligonucleotide; CTC chr11 5171460 5171481 5171465 5171460 -
ttccactcactgtggcttacct

SEQ ID NO: 152910 - DNA, 22 bp, Artificial Sequence
  Synthetic oligonucleotide; CTT chr11 5171458 5171479 5171463 5171458 -
ccactcactgtggcttacctgt

SEQ ID NO: 152911 - DNA, 22 bp, Artificial Sequence
  Synthetic oligonucleotide; TTC chr11 5171457 5171478 5171462 5171457 -
cactcactgtggcttacctgtg

SEQ ID NO: 152912 - DNA, 22 bp, Artificial Sequence
  Synthetic oligonucleotide; CTC chr11 5171452 5171473 5171457 5171452 -
actgtggcttacctgtgccctt

SEQ ID NO: 152913 - DNA, 22 bp, Artificial Sequence
  Synthetic oligonucleotide; CTG chr11 5171448 5171469 5171453 5171448 -
tggcttacctgtgcccttgttt

SEQ ID NO: 152914 - DNA, 22 bp, Artificial Sequence
  Synthetic oligonucleotide; CTT chr11 5171442 5171463 5171447 5171442 -
acctgtgcccttgtttcagaaa

SEQ ID NO: 152915 - DNA, 22 bp, Artificial Sequence
  Synthetic oligonucleotide; TTA chr11 5171441 5171462 5171446 5171441 -
cctgtgcccttgtttcagaaat

SEQ ID NO: 152916 - DNA, 22 bp, Artificial Sequence
  Synthetic oligonucleotide; CTG chr11 5171437 5171458 5171442 5171437 -
tgcccttgtttcagaaataaat

SEQ ID NO: 152917 - DNA, 22 bp, Artificial Sequence
  Synthetic oligonucleotide; CTT chr11 5171430 5171451 5171435 5171430 -
gtttcagaaataaattttttat

SEQ ID NO: 152918 - DNA, 22 bp, Artificial Sequence
  Synthetic oligonucleotide; TTG chr11 5171429 5171450 5171434 5171429 -
tttcagaaataaattttttatc

SEQ ID NO: 152919 - DNA, 22 bp, Artificial Sequence
  Synthetic oligonucleotide; TTT chr11 5171426 5171447 5171431 5171426 -
cagaaataaattttttatccct

SEQ ID NO: 152920 - DNA, 22 bp, Artificial Sequence
  Synthetic oligonucleotide; TTC chr11 5171425 5171446 5171430 5171425 -
agaaataaattttttatccctt

SEQ ID NO: 152921 - DNA, 22 bp, Artificial Sequence
  Synthetic oligonucleotide; TTT chr11 5171413 5171434 5171418 5171413 -
tttatccctttttctgaggaaa

SEQ ID NO: 152922 - DNA, 22 bp, Artificial Sequence
  Synthetic oligonucleotide; TTT chr11 5171412 5171433 5171417 5171412 -
ttatccctttttctgaggaaat

SEQ ID NO: 152923 - DNA, 22 bp, Artificial Sequence
  Synthetic oligonucleotide; TTT chr11 5171411 5171432 5171416 5171411 -
tatccctttttctgaggaaatg

SEQ ID NO: 152924 - DNA, 22 bp, Artificial Sequence
  Synthetic oligonucleotide; TTT chr11 5171410 5171431 5171415 5171410 -
atccctttttctgaggaaatgt

SEQ ID NO: 152925 - DNA, 22 bp, Artificial Sequence
  Synthetic oligonucleotide; TTA chr11 5171409 5171430 5171414 5171409 -
tccctttttctgaggaaatgtc

SEQ ID NO: 152926 - DNA, 22 bp, Artificial Sequence
  Synthetic oligonucleotide; CTT chr11 5171403 5171424 5171408 5171403 -
tttctgaggaaatgtcttagat

SEQ ID NO: 152927 - DNA, 22 bp, Artificial Sequence
  Synthetic oligonucleotide; TTT chr11 5171402 5171423 5171407 5171402 -
ttctgaggaaatgtcttagata

SEQ ID NO: 152928 - DNA, 22 bp, Artificial Sequence
  Synthetic oligonucleotide; TTT chr11 5171401 5171422 5171406 5171401 -
tctgaggaaatgtcttagatat

SEQ ID NO: 152929 - DNA, 22 bp, Artificial Sequence
  Synthetic oligonucleotide; TTT chr11 5171400 5171421 5171405 5171400 -
ctgaggaaatgtcttagatatg

SEQ ID NO: 152930 - DNA, 22 bp, Artificial Sequence
  Synthetic oligonucleotide; TTC chr11 5171399 5171420 5171404 5171399 -
tgaggaaatgtcttagatatga

SEQ ID NO: 152931 - DNA, 22 bp, Artificial Sequence
  Synthetic oligonucleotide; CTG chr11 5171397 5171418 5171402 5171397 -
aggaaatgtcttagatatgact

SEQ ID NO: 152932 - DNA, 22 bp, Artificial Sequence
  Synthetic oligonucleotide; CTT chr11 5171385 5171406 5171390 5171385 -
agatatgactgttagctcagaa

SEQ ID NO: 152933 - DNA, 22 bp, Artificial Sequence
  Synthetic oligonucleotide; TTA chr11 5171384 5171405 5171389 5171384 -
gatatgactgttagctcagaac

SEQ ID NO: 152934 - DNA, 22 bp, Artificial Sequence
  Synthetic oligonucleotide; CTG chr11 5171374 5171395 5171379 5171374 -
ttagctcagaacttgatgtgca

SEQ ID NO: 152935 - DNA, 22 bp, Artificial Sequence
  Synthetic oligonucleotide; TTA chr11 5171371 5171392 5171376 5171371 -
gctcagaacttgatgtgcaata

SEQ ID NO: 152936 - DNA, 22 bp, Artificial Sequence
  Synthetic oligonucleotide; CTC chr11 5171367 5171388 5171372 5171367 -
agaacttgatgtgcaataactg

SEQ ID NO: 152937 - DNA, 22 bp, Artificial Sequence
  Synthetic oligonucleotide; CTT chr11 5171360 5171381 5171365 5171360 -
gatgtgcaataactgagtagaa

SEQ ID NO: 152938 - DNA, 22 bp, Artificial Sequence
  Synthetic oligonucleotide; TTG chr11 5171359 5171380 5171364 5171359 -
atgtgcaataactgagtagaaa

SEQ ID NO: 152939 - DNA, 22 bp, Artificial Sequence
  Synthetic oligonucleotide; CTG chr11 5171345 5171366 5171350 5171345 -
agtagaaacttatatattccag

SEQ ID NO: 152940 - DNA, 22 bp, Artificial Sequence
  Synthetic oligonucleotide; CTT chr11 5171334 5171355 5171339 5171334 -
atatattccagtctccatgtgc

SEQ ID NO: 152941 - DNA, 22 bp, Artificial Sequence
  Synthetic oligonucleotide; TTA chr11 5171333 5171354 5171338 5171333 -
tatattccagtctccatgtgct

SEQ ID NO: 152942 - DNA, 22 bp, Artificial Sequence
  Synthetic oligonucleotide; TTC chr11 5171326 5171347 5171331 5171326 -
cagtctccatgtgcttctcaat

SEQ ID NO: 152943 - DNA, 22 bp, Artificial Sequence
  Synthetic oligonucleotide; CTC chr11 5171319 5171340 5171324 5171319 -
catgtgcttctcaatatcttca

SEQ ID NO: 152944 - DNA, 22 bp, Artificial Sequence
  Synthetic oligonucleotide; CTT chr11 5171310 5171331 5171315 5171310 -
ctcaatatcttcagaggaagta

SEQ ID NO: 152945 - DNA, 22 bp, Artificial Sequence
  Synthetic oligonucleotide; TTC chr11 5171309 5171330 5171314 5171309 -
tcaatatcttcagaggaagtat

SEQ ID NO: 152946 - DNA, 22 bp, Artificial Sequence
  Synthetic oligonucleotide; CTC chr11 5171307 5171328 5171312 5171307 -
aatatcttcagaggaagtatca

SEQ ID NO: 152947 - DNA, 22 bp, Artificial Sequence
  Synthetic oligonucleotide; CTT chr11 5171299 5171320 5171304 5171299 -
cagaggaagtatcaccatgacg

SEQ ID NO: 152948 - DNA, 22 bp, Artificial Sequence
  Synthetic oligonucleotide; TTC chr11 5171298 5171319 5171303 5171298 -
agaggaagtatcaccatgacgt

SEQ ID NO: 152949 - DNA, 22 bp, Artificial Sequence
  Synthetic oligonucleotide; TTT chr11 5171274 5171295 5171279 5171274 -
tcaaacgttccataacattcac

SEQ ID NO: 152950 - DNA, 22 bp, Artificial Sequence
  Synthetic oligonucleotide; TTT chr11 5171273 5171294 5171278 5171273 -
caaacgttccataacattcaca

SEQ ID NO: 152951 - DNA, 22 bp, Artificial Sequence
  Synthetic oligonucleotide; TTC chr11 5171272 5171293 5171277 5171272 -
aaacgttccataacattcacac

SEQ ID NO: 152952 - DNA, 22 bp, Artificial Sequence
  Synthetic oligonucleotide; TTC chr11 5171264 5171285 5171269 5171264 -
cataacattcacacctacaaca

SEQ ID NO: 152953 - DNA, 22 bp, Artificial Sequence
  Synthetic oligonucleotide; TTC chr11 5171254 5171275 5171259 5171254 -
acacctacaacattcactctcg

SEQ ID NO: 152954 - DNA, 22 bp, Artificial Sequence
  Synthetic oligonucleotide; CTA chr11 5171247 5171268 5171252 5171247 -
caacattcactctcgttggcat

SEQ ID NO: 152955 - DNA, 22 bp, Artificial Sequence
  Synthetic oligonucleotide; TTC chr11 5171239 5171260 5171244 5171239 -
actctcgttggcatcccgggac

SEQ ID NO: 152956 - DNA, 22 bp, Artificial Sequence
  Synthetic oligonucleotide; CTC chr11 5171235 5171256 5171240 5171235 -
tcgttggcatcccgggactgga

SEQ ID NO: 152957 - DNA, 22 bp, Artificial Sequence
  Synthetic oligonucleotide; CTC chr11 5171233 5171254 5171238 5171233 -
gttggcatcccgggactggagg

SEQ ID NO: 152958 - DNA, 22 bp, Artificial Sequence
  Synthetic oligonucleotide; TTG chr11 5171229 5171250 5171234 5171229 -
gcatcccgggactggaggcaga

SEQ ID NO: 152959 - DNA, 22 bp, Artificial Sequence
  Synthetic oligonucleotide; CTG chr11 5171215 5171236 5171220 5171215 -
gaggcagaacattatgtggata

SEQ ID NO: 152960 - DNA, 22 bp, Artificial Sequence
  Synthetic oligonucleotide; TTA chr11 5171201 5171222 5171206 5171201 -
tgtggatatccatccccttctg

SEQ ID NO: 152961 - DNA, 22 bp, Artificial Sequence
  Synthetic oligonucleotide; CTT chr11 5171182 5171203 5171187 5171182 -
ctgcctgatatacaccatcatc

SEQ ID NO: 152962 - DNA, 22 bp, Artificial Sequence
  Synthetic oligonucleotide; TTC chr11 5171181 5171202 5171186 5171181 -
tgcctgatatacaccatcatct

SEQ ID NO: 152963 - DNA, 22 bp, Artificial Sequence
  Synthetic oligonucleotide; CTG chr11 5171179 5171200 5171184 5171179 -
cctgatatacaccatcatcttt

SEQ ID NO: 152964 - DNA, 22 bp, Artificial Sequence
  Synthetic oligonucleotide; CTG chr11 5171175 5171196 5171180 5171175 -
atatacaccatcatctttccgg

SEQ ID NO: 152965 - DNA, 22 bp, Artificial Sequence
  Synthetic oligonucleotide; CTT chr11 5171158 5171179 5171163 5171158 -
tccgggaaatggcatcattctt

SEQ ID NO: 152966 - DNA, 22 bp, Artificial Sequence
  Synthetic oligonucleotide; TTT chr11 5171157 5171178 5171162 5171157 -
ccgggaaatggcatcattcttc

SEQ ID NO: 152967 - DNA, 22 bp, Artificial Sequence
  Synthetic oligonucleotide; TTC chr11 5171156 5171177 5171161 5171156 -
cgggaaatggcatcattcttca

SEQ ID NO: 152968 - DNA, 22 bp, Artificial Sequence
  Synthetic oligonucleotide; TTC chr11 5171138 5171159 5171143 5171138 -
ttcacatcatccgaattgactc

SEQ ID NO: 152969 - DNA, 22 bp, Artificial Sequence
  Synthetic oligonucleotide; CTT chr11 5171136 5171157 5171141 5171136 -
cacatcatccgaattgactctt

SEQ ID NO: 152970 - DNA, 22 bp, Artificial Sequence
  Synthetic oligonucleotide; TTC chr11 5171135 5171156 5171140 5171135 -
acatcatccgaattgactcttc

SEQ ID NO: 152971 - DNA, 22 bp, Artificial Sequence
  Synthetic oligonucleotide; TTG chr11 5171120 5171141 5171125 5171120 -
actcttccttgcaccaacccat

SEQ ID NO: 152972 - DNA, 22 bp, Artificial Sequence
  Synthetic oligonucleotide; CTC chr11 5171116 5171137 5171121 5171116 -
ttccttgcaccaacccatgtac

SEQ ID NO: 152973 - DNA, 22 bp, Artificial Sequence
  Synthetic oligonucleotide; CTT chr11 5171114 5171135 5171119 5171114 -
ccttgcaccaacccatgtacta

SEQ ID NO: 152974 - DNA, 22 bp, Artificial Sequence
  Synthetic oligonucleotide; TTC chr11 5171113 5171134 5171118 5171113 -
cttgcaccaacccatgtactat

SEQ ID NO: 152975 - DNA, 22 bp, Artificial Sequence
  Synthetic oligonucleotide; CTT chr11 5171110 5171131 5171115 5171110 -
gcaccaacccatgtactatttt

SEQ ID NO: 152976 - DNA, 22 bp, Artificial Sequence
  Synthetic oligonucleotide; TTG chr11 5171109 5171130 5171114 5171109 -
caccaacccatgtactattttc

SEQ ID NO: 152977 - DNA, 22 bp, Artificial Sequence
  Synthetic oligonucleotide; CTA chr11 5171092 5171113 5171097 5171092 -
ttttctggccatgccggccttt

SEQ ID NO: 152978 - DNA, 22 bp, Artificial Sequence
  Synthetic oligonucleotide; TTT chr11 5171089 5171110 5171094 5171089 -
tctggccatgccggcctttgtt

SEQ ID NO: 152979 - DNA, 22 bp, Artificial Sequence
  Synthetic oligonucleotide; TTT chr11 5171088 5171109 5171093 5171088 -
ctggccatgccggcctttgttg

SEQ ID NO: 152980 - DNA, 22 bp, Artificial Sequence
  Synthetic oligonucleotide; TTC chr11 5171087 5171108 5171092 5171087 -
tggccatgccggcctttgttga

SEQ ID NO: 152981 - DNA, 22 bp, Artificial Sequence
  Synthetic oligonucleotide; CTG chr11 5171085 5171106 5171090 5171085 -
gccatgccggcctttgttgaac

SEQ ID NO: 152982 - DNA, 22 bp, Artificial Sequence
  Synthetic oligonucleotide; CTT chr11 5171071 5171092 5171076 5171071 -
tgttgaacttggtgtctctgct

SEQ ID NO: 152983 - DNA, 22 bp, Artificial Sequence
  Synthetic oligonucleotide; TTT chr11 5171070 5171091 5171075 5171070 -
gttgaacttggtgtctctgctt

SEQ ID NO: 152984 - DNA, 22 bp, Artificial Sequence
  Synthetic oligonucleotide; TTG chr11 5171069 5171090 5171074 5171069 -
ttgaacttggtgtctctgcttc

SEQ ID NO: 152985 - DNA, 22 bp, Artificial Sequence
  Synthetic oligonucleotide; TTG chr11 5171066 5171087 5171071 5171066 -
aacttggtgtctctgcttccac

SEQ ID NO: 152986 - DNA, 22 bp, Artificial Sequence
  Synthetic oligonucleotide; CTT chr11 5171061 5171082 5171066 5171061 -
ggtgtctctgcttccaccatgc

SEQ ID NO: 152987 - DNA, 22 bp, Artificial Sequence
  Synthetic oligonucleotide; TTG chr11 5171060 5171081 5171065 5171060 -
gtgtctctgcttccaccatgcc

SEQ ID NO: 152988 - DNA, 22 bp, Artificial Sequence
  Synthetic oligonucleotide; CTC chr11 5171053 5171074 5171058 5171053 -
tgcttccaccatgcccactgtg

SEQ ID NO: 152989 - DNA, 22 bp, Artificial Sequence
  Synthetic oligonucleotide; CTG chr11 5171051 5171072 5171056 5171051 -
cttccaccatgcccactgtgtt

SEQ ID NO: 152990 - DNA, 22 bp, Artificial Sequence
  Synthetic oligonucleotide; CTT chr11 5171048 5171069 5171053 5171048 -
ccaccatgcccactgtgttaag

SEQ ID NO: 152991 - DNA, 22 bp, Artificial Sequence
  Synthetic oligonucleotide; TTC chr11 5171047 5171068 5171052 5171047 -
caccatgcccactgtgttaagc

SEQ ID NO: 152992 - DNA, 22 bp, Artificial Sequence
  Synthetic oligonucleotide; CTG chr11 5171033 5171054 5171038 5171033 -
tgttaagcatattcctctttgg

SEQ ID NO: 152993 - DNA, 22 bp, Artificial Sequence
  Synthetic oligonucleotide; TTA chr11 5171028 5171049 5171033 5171028 -
agcatattcctctttggcatta

SEQ ID NO: 152994 - DNA, 22 bp, Artificial Sequence
  Synthetic oligonucleotide; TTC chr11 5171019 5171040 5171024 5171019 -
ctctttggcattaacgatgtca

SEQ ID NO: 152995 - DNA, 22 bp, Artificial Sequence
  Synthetic oligonucleotide; CTC chr11 5171016 5171037 5171021 5171016 -
tttggcattaacgatgtcagtt

SEQ ID NO: 152996 - DNA, 22 bp, Artificial Sequence
  Synthetic oligonucleotide; CTT chr11 5171014 5171035 5171019 5171014 -
tggcattaacgatgtcagtttt

SEQ ID NO: 152997 - DNA, 22 bp, Artificial Sequence
  Synthetic oligonucleotide; TTT chr11 5171013 5171034 5171018 5171013 -
ggcattaacgatgtcagttttg

SEQ ID NO: 152998 - DNA, 22 bp, Artificial Sequence
  Synthetic oligonucleotide; TTG chr11 5171012 5171033 5171017 5171012 -
gcattaacgatgtcagttttgg

SEQ ID NO: 152999 - DNA, 22 bp, Artificial Sequence
  Synthetic oligonucleotide; TTA chr11 5171006 5171027 5171011 5171006 -
acgatgtcagttttggtggttg

SEQ ID NO: 153000 - DNA, 22 bp, Artificial Sequence
  Synthetic oligonucleotide; TTT chr11 5170993 5171014 5170998 5170993 -
tggtggttgcctgctccagatg

SEQ ID NO: 153001 - DNA, 22 bp, Artificial Sequence
  Synthetic oligonucleotide; TTT chr11 5170992 5171013 5170997 5170992 -
ggtggttgcctgctccagatgt

SEQ ID NO: 153002 - DNA, 22 bp, Artificial Sequence
  Synthetic oligonucleotide; TTG chr11 5170991 5171012 5170996 5170991 -
gtggttgcctgctccagatgtt

SEQ ID NO: 153003 - DNA, 22 bp, Artificial Sequence
  Synthetic oligonucleotide; TTG chr11 5170984 5171005 5170989 5170984 -
cctgctccagatgttttctatg

SEQ ID NO: 153004 - DNA, 22 bp, Artificial Sequence
  Synthetic oligonucleotide; CTG chr11 5170980 5171001 5170985 5170980 -
ctccagatgttttctatgcact

SEQ ID NO: 153005 - DNA, 22 bp, Artificial Sequence
  Synthetic oligonucleotide; CTC chr11 5170977 5170998 5170982 5170977 -
cagatgttttctatgcactctt

SEQ ID NO: 153006 - DNA, 22 bp, Artificial Sequence
  Synthetic oligonucleotide; TTT chr11 5170968 5170989 5170973 5170968 -
tctatgcactctttcactctta

SEQ ID NO: 153007 - DNA, 22 bp, Artificial Sequence
  Synthetic oligonucleotide; TTT chr11 5170967 5170988 5170972 5170967 -
ctatgcactctttcactcttat

SEQ ID NO: 153008 - DNA, 22 bp, Artificial Sequence
  Synthetic oligonucleotide; TTC chr11 5170966 5170987 5170971 5170966 -
tatgcactctttcactcttatg

SEQ ID NO: 153009 - DNA, 22 bp, Artificial Sequence
  Synthetic oligonucleotide; CTA chr11 5170964 5170985 5170969 5170964 -
tgcactctttcactcttatgga

SEQ ID NO: 153010 - DNA, 22 bp, Artificial Sequence
  Synthetic oligonucleotide; CTC chr11 5170957 5170978 5170962 5170957 -
tttcactcttatggagtcaggt

SEQ ID NO: 153011 - DNA, 22 bp, Artificial Sequence
  Synthetic oligonucleotide; CTT chr11 5170955 5170976 5170960 5170955 -
tcactcttatggagtcaggtgt

SEQ ID NO: 153012 - DNA, 22 bp, Artificial Sequence
  Synthetic oligonucleotide; TTT chr11 5170954 5170975 5170959 5170954 -
cactcttatggagtcaggtgtc

SEQ ID NO: 153013 - DNA, 22 bp, Artificial Sequence
  Synthetic oligonucleotide; TTC chr11 5170953 5170974 5170958 5170953 -
actcttatggagtcaggtgtcc

SEQ ID NO: 153014 - DNA, 22 bp, Artificial Sequence
  Synthetic oligonucleotide; CTC chr11 5170949 5170970 5170954 5170949 -
ttatggagtcaggtgtccttct

SEQ ID NO: 153015 - DNA, 22 bp, Artificial Sequence
  Synthetic oligonucleotide; CTT chr11 5170947 5170968 5170952 5170947 -
atggagtcaggtgtccttctgg

SEQ ID NO: 153016 - DNA, 22 bp, Artificial Sequence
  Synthetic oligonucleotide; TTA chr11 5170946 5170967 5170951 5170946 -
tggagtcaggtgtccttctggc

SEQ ID NO: 153017 - DNA, 22 bp, Artificial Sequence
  Synthetic oligonucleotide; CTT chr11 5170929 5170950 5170934 5170929 -
ctggcaatgtcagtggaccgct

SEQ ID NO: 153018 - DNA, 22 bp, Artificial Sequence
  Synthetic oligonucleotide; TTC chr11 5170928 5170949 5170933 5170928 -
tggcaatgtcagtggaccgctt

SEQ ID NO: 153019 - DNA, 22 bp, Artificial Sequence
  Synthetic oligonucleotide; CTG chr11 5170926 5170947 5170931 5170926 -
gcaatgtcagtggaccgctttg

SEQ ID NO: 153020 - DNA, 22 bp, Artificial Sequence
  Synthetic oligonucleotide; CTT chr11 5170906 5170927 5170911 5170906 -
tgtggccatctacagcccactg

SEQ ID NO: 153021 - DNA, 22 bp, Artificial Sequence
  Synthetic oligonucleotide; TTT chr11 5170905 5170926 5170910 5170905 -
gtggccatctacagcccactgc

SEQ ID NO: 153022 - DNA, 22 bp, Artificial Sequence
  Synthetic oligonucleotide; TTG chr11 5170904 5170925 5170909 5170904 -
tggccatctacagcccactgcg

SEQ ID NO: 153023 - DNA, 22 bp, Artificial Sequence
  Synthetic oligonucleotide; CTA chr11 5170894 5170915 5170899 5170894 -
cagcccactgcgctacacaacc

SEQ ID NO: 153024 - DNA, 22 bp, Artificial Sequence
  Synthetic oligonucleotide; CTG chr11 5170884 5170905 5170889 5170884 -
cgctacacaaccattctgacaa

SEQ ID NO: 153025 - DNA, 22 bp, Artificial Sequence
  Synthetic oligonucleotide; CTA chr11 5170879 5170900 5170884 5170879 -
cacaaccattctgacaattgcc

SEQ ID NO: 153026 - DNA, 22 bp, Artificial Sequence
  Synthetic oligonucleotide; TTC chr11 5170868 5170889 5170873 5170868 -
tgacaattgcctgcatttctgg

SEQ ID NO: 153027 - DNA, 22 bp, Artificial Sequence
  Synthetic oligonucleotide; CTG chr11 5170866 5170887 5170871 5170866 -
acaattgcctgcatttctggga

SEQ ID NO: 153028 - DNA, 22 bp, Artificial Sequence
  Synthetic oligonucleotide; TTG chr11 5170859 5170880 5170864 5170859 -
cctgcatttctgggacgggtgc

SEQ ID NO: 153029 - DNA, 22 bp, Artificial Sequence
  Synthetic oligonucleotide; CTG chr11 5170855 5170876 5170860 5170855 -
catttctgggacgggtgccgcc

SEQ ID NO: 153030 - DNA, 22 bp, Artificial Sequence
  Synthetic oligonucleotide; TTT chr11 5170850 5170871 5170855 5170850 -
ctgggacgggtgccgccattgc

SEQ ID NO: 153031 - DNA, 22 bp, Artificial Sequence
  Synthetic oligonucleotide; TTC chr11 5170849 5170870 5170854 5170849 -
tgggacgggtgccgccattgcc

SEQ ID NO: 153032 - DNA, 22 bp, Artificial Sequence
  Synthetic oligonucleotide; CTG chr11 5170847 5170868 5170852 5170847 -
ggacgggtgccgccattgcctt

SEQ ID NO: 153033 - DNA, 22 bp, Artificial Sequence
  Synthetic oligonucleotide; TTG chr11 5170829 5170850 5170834 5170829 -
ccttgcgcagtgtaatgcttat

SEQ ID NO: 153034 - DNA, 22 bp, Artificial Sequence
  Synthetic oligonucleotide; CTT chr11 5170825 5170846 5170830 5170825 -
gcgcagtgtaatgcttatgctc

SEQ ID NO: 153035 - DNA, 22 bp, Artificial Sequence
  Synthetic oligonucleotide; TTG chr11 5170824 5170845 5170829 5170824 -
cgcagtgtaatgcttatgctcc

SEQ ID NO: 153036 - DNA, 22 bp, Artificial Sequence
  Synthetic oligonucleotide; CTT chr11 5170809 5170830 5170814 5170809 -
atgctcccactgctctttctcc

SEQ ID NO: 153037 - DNA, 22 bp, Artificial Sequence
  Synthetic oligonucleotide; TTA chr11 5170808 5170829 5170813 5170808 -
tgctcccactgctctttctcct

SEQ ID NO: 153038 - DNA, 22 bp, Artificial Sequence
  Synthetic oligonucleotide; CTC chr11 5170803 5170824 5170808 5170803 -
ccactgctctttctcctgaggc

SEQ ID NO: 153039 - DNA, 22 bp, Artificial Sequence
  Synthetic oligonucleotide; CTG chr11 5170797 5170818 5170802 5170797 -
ctctttctcctgaggcgtctgc

SEQ ID NO: 153040 - DNA, 22 bp, Artificial Sequence
  Synthetic oligonucleotide; CTC chr11 5170794 5170815 5170799 5170794 -
tttctcctgaggcgtctgcctt

SEQ ID NO: 153041 - DNA, 22 bp, Artificial Sequence
  Synthetic oligonucleotide; CTT chr11 5170792 5170813 5170797 5170792 -
tctcctgaggcgtctgcctttc

SEQ ID NO: 153042 - DNA, 22 bp, Artificial Sequence
  Synthetic oligonucleotide; TTT chr11 5170791 5170812 5170796 5170791 -
ctcctgaggcgtctgcctttct

SEQ ID NO: 153043 - DNA, 22 bp, Artificial Sequence
  Synthetic oligonucleotide; TTC chr11 5170790 5170811 5170795 5170790 -
tcctgaggcgtctgcctttctg

SEQ ID NO: 153044 - DNA, 22 bp, Artificial Sequence
  Synthetic oligonucleotide; CTC chr11 5170788 5170809 5170793 5170788 -
ctgaggcgtctgcctttctgtg

SEQ ID NO: 153045 - DNA, 22 bp, Artificial Sequence
  Synthetic oligonucleotide; CTG chr11 5170785 5170806 5170790 5170785 -
aggcgtctgcctttctgtggcc

SEQ ID NO: 153046 - DNA, 22 bp, Artificial Sequence
  Synthetic oligonucleotide; CTG chr11 5170776 5170797 5170781 5170776 -
cctttctgtggccacaataccc

SEQ ID NO: 153047 - DNA, 22 bp, Artificial Sequence
  Synthetic oligonucleotide; CTT chr11 5170772 5170793 5170777 5170772 -
tctgtggccacaataccctcac

SEQ ID NO: 153048 - DNA, 22 bp, Artificial Sequence
  Synthetic oligonucleotide; TTT chr11 5170771 5170792 5170776 5170771 -
ctgtggccacaataccctcaca

SEQ ID NO: 153049 - DNA, 22 bp, Artificial Sequence
  Synthetic oligonucleotide; TTC chr11 5170770 5170791 5170775 5170770 -
tgtggccacaataccctcacac

SEQ ID NO: 153050 - DNA, 22 bp, Artificial Sequence
  Synthetic oligonucleotide; CTG chr11 5170768 5170789 5170773 5170768 -
tggccacaataccctcacacac

SEQ ID NO: 153051 - DNA, 22 bp, Artificial Sequence
  Synthetic oligonucleotide; CTC chr11 5170752 5170773 5170757 5170752 -
acacactcttattgcctccact

SEQ ID NO: 153052 - DNA, 22 bp, Artificial Sequence
  Synthetic oligonucleotide; CTC chr11 5170744 5170765 5170749 5170744 -
ttattgcctccactcagatctg

SEQ ID NO: 153053 - DNA, 22 bp, Artificial Sequence
  Synthetic oligonucleotide; CTT chr11 5170742 5170763 5170747 5170742 -
attgcctccactcagatctgat

SEQ ID NO: 153054 - DNA, 22 bp, Artificial Sequence
  Synthetic oligonucleotide; TTA chr11 5170741 5170762 5170746 5170741 -
ttgcctccactcagatctgatc

SEQ ID NO: 153055 - DNA, 22 bp, Artificial Sequence
  Synthetic oligonucleotide; TTG chr11 5170738 5170759 5170743 5170738 -
cctccactcagatctgatcaaa

SEQ ID NO: 153056 - DNA, 22 bp, Artificial Sequence
  Synthetic oligonucleotide; CTC chr11 5170734 5170755 5170739 5170734 -
cactcagatctgatcaaattgc

SEQ ID NO: 153057 - DNA, 22 bp, Artificial Sequence
  Synthetic oligonucleotide; CTC chr11 5170729 5170750 5170734 5170729 -
agatctgatcaaattgccctgt

SEQ ID NO: 153058 - DNA, 22 bp, Artificial Sequence
  Synthetic oligonucleotide; CTG chr11 5170722 5170743 5170727 5170722 -
atcaaattgccctgtggagaca

SEQ ID NO: 153059 - DNA, 22 bp, Artificial Sequence
  Synthetic oligonucleotide; TTG chr11 5170713 5170734 5170718 5170713 -
ccctgtggagacacacgtccca

SEQ ID NO: 153060 - DNA, 22 bp, Artificial Sequence
  Synthetic oligonucleotide; CTG chr11 5170708 5170729 5170713 5170708 -
tggagacacacgtcccaatagc

SEQ ID NO: 153061 - DNA, 22 bp, Artificial Sequence
  Synthetic oligonucleotide; CTG chr11 5170680 5170701 5170685 5170680 -
gctctatttgtcattaccttca

SEQ ID NO: 153062 - DNA, 22 bp, Artificial Sequence
  Synthetic oligonucleotide; CTC chr11 5170676 5170697 5170681 5170676 -
tatttgtcattaccttcacatt

SEQ ID NO: 153063 - DNA, 22 bp, Artificial Sequence
  Synthetic oligonucleotide; CTA chr11 5170674 5170695 5170679 5170674 -
tttgtcattaccttcacatttg

SEQ ID NO: 153064 - DNA, 22 bp, Artificial Sequence
  Synthetic oligonucleotide; TTT chr11 5170671 5170692 5170676 5170671 -
gtcattaccttcacatttggac

SEQ ID NO: 153065 - DNA, 22 bp, Artificial Sequence
  Synthetic oligonucleotide; TTG chr11 5170670 5170691 5170675 5170670 -
tcattaccttcacatttggact

SEQ ID NO: 153066 - DNA, 22 bp, Artificial Sequence
  Synthetic oligonucleotide; TTA chr11 5170664 5170685 5170669 5170664 -
ccttcacatttggactggactt

SEQ ID NO: 153067 - DNA, 22 bp, Artificial Sequence
  Synthetic oligonucleotide; CTT chr11 5170660 5170681 5170665 5170660 -
cacatttggactggacttattg

SEQ ID NO: 153068 - DNA, 22 bp, Artificial Sequence
  Synthetic oligonucleotide; TTC chr11 5170659 5170680 5170664 5170659 -
acatttggactggacttattgt

SEQ ID NO: 153069 - DNA, 22 bp, Artificial Sequence
  Synthetic oligonucleotide; TTT chr11 5170653 5170674 5170658 5170653 -
ggactggacttattgttcattg

SEQ ID NO: 153070 - DNA, 22 bp, Artificial Sequence
  Synthetic oligonucleotide; TTG chr11 5170652 5170673 5170657 5170652 -
gactggacttattgttcattgt

SEQ ID NO: 153071 - DNA, 22 bp, Artificial Sequence
  Synthetic oligonucleotide; CTG chr11 5170647 5170668 5170652 5170647 -
gacttattgttcattgtggttt

SEQ ID NO: 153072 - DNA, 22 bp, Artificial Sequence
  Synthetic oligonucleotide; CTT chr11 5170642 5170663 5170647 5170642 -
attgttcattgtggtttcttat

SEQ ID NO: 153073 - DNA, 22 bp, Artificial Sequence
  Synthetic oligonucleotide; TTA chr11 5170641 5170662 5170646 5170641 -
ttgttcattgtggtttcttatg

SEQ ID NO: 153074 - DNA, 22 bp, Artificial Sequence
  Synthetic oligonucleotide; TTG chr11 5170638 5170659 5170643 5170638 -
ttcattgtggtttcttatgtgc

SEQ ID NO: 153075 - DNA, 22 bp, Artificial Sequence
  Synthetic oligonucleotide; TTC chr11 5170635 5170656 5170640 5170635 -
attgtggtttcttatgtgctga

SEQ ID NO: 153076 - DNA, 22 bp, Artificial Sequence
  Synthetic oligonucleotide; TTG chr11 5170631 5170652 5170636 5170631 -
tggtttcttatgtgctgattct

SEQ ID NO: 153077 - DNA, 22 bp, Artificial Sequence
  Synthetic oligonucleotide; TTT chr11 5170625 5170646 5170630 5170625 -
cttatgtgctgattcttcatac

SEQ ID NO: 153078 - DNA, 22 bp, Artificial Sequence
  Synthetic oligonucleotide; TTC chr11 5170624 5170645 5170629 5170624 -
ttatgtgctgattcttcataca

SEQ ID NO: 153079 - DNA, 22 bp, Artificial Sequence
  Synthetic oligonucleotide; CTT chr11 5170622 5170643 5170627 5170622 -
atgtgctgattcttcatacagt

SEQ ID NO: 153080 - DNA, 22 bp, Artificial Sequence
  Synthetic oligonucleotide; TTA chr11 5170621 5170642 5170626 5170621 -
tgtgctgattcttcatacagta

SEQ ID NO: 153081 - DNA, 22 bp, Artificial Sequence
  Synthetic oligonucleotide; CTG chr11 5170614 5170635 5170619 5170614 -
attcttcatacagtactggaaa

SEQ ID NO: 153082 - DNA, 22 bp, Artificial Sequence
  Synthetic oligonucleotide; TTC chr11 5170610 5170631 5170615 5170610 -
ttcatacagtactggaaatagc

SEQ ID NO: 153083 - DNA, 22 bp, Artificial Sequence
  Synthetic oligonucleotide; CTT chr11 5170608 5170629 5170613 5170608 -
catacagtactggaaatagctt

SEQ ID NO: 153084 - DNA, 22 bp, Artificial Sequence
  Synthetic oligonucleotide; TTC chr11 5170607 5170628 5170612 5170607 -
atacagtactggaaatagcttc

SEQ ID NO: 153085 - DNA, 22 bp, Artificial Sequence
  Synthetic oligonucleotide; CTG chr11 5170596 5170617 5170601 5170596 -
gaaatagcttctggagcagggc

SEQ ID NO: 153086 - DNA, 22 bp, Artificial Sequence
  Synthetic oligonucleotide; CTT chr11 5170586 5170607 5170591 5170586 -
ctggagcagggcggtggcaggc

SEQ ID NO: 153087 - DNA, 22 bp, Artificial Sequence
  Synthetic oligonucleotide; TTC chr11 5170585 5170606 5170590 5170585 -
tggagcagggcggtggcaggca

SEQ ID NO: 153088 - DNA, 22 bp, Artificial Sequence
  Synthetic oligonucleotide; CTG chr11 5170583 5170604 5170588 5170583 -
gagcagggcggtggcaggcact

SEQ ID NO: 153089 - DNA, 22 bp, Artificial Sequence
  Synthetic oligonucleotide; CTC chr11 5170560 5170581 5170565 5170560 -
aacacatgtgtgtcgcacatat

SEQ ID NO: 153090 - DNA, 22 bp, Artificial Sequence
  Synthetic oligonucleotide; CTG chr11 5170532 5170553 5170537 5170532 -
tgcttgtgtactatgtgcccat

SEQ ID NO: 153091 - DNA, 22 bp, Artificial Sequence
  Synthetic oligonucleotide; CTT chr11 5170527 5170548 5170532 5170527 -
gtgtactatgtgcccatgatca

SEQ ID NO: 153092 - DNA, 22 bp, Artificial Sequence
  Synthetic oligonucleotide; TTG chr11 5170526 5170547 5170531 5170526 -
tgtactatgtgcccatgatcag

SEQ ID NO: 153093 - DNA, 22 bp, Artificial Sequence
  Synthetic oligonucleotide; CTA chr11 5170519 5170540 5170524 5170519 -
tgtgcccatgatcagcctctcc

SEQ ID NO: 153094 - DNA, 22 bp, Artificial Sequence
  Synthetic oligonucleotide; CTC chr11 5170500 5170521 5170505 5170500 -
tccctgatgcaccgctttggac

SEQ ID NO: 153095 - DNA, 22 bp, Artificial Sequence
  Synthetic oligonucleotide; CTC chr11 5170498 5170519 5170503 5170498 -
cctgatgcaccgctttggacgg

SEQ ID NO: 153096 - DNA, 22 bp, Artificial Sequence
  Synthetic oligonucleotide; CTG chr11 5170494 5170515 5170499 5170494 -
atgcaccgctttggacggcatt

SEQ ID NO: 153097 - DNA, 22 bp, Artificial Sequence
  Synthetic oligonucleotide; CTT chr11 5170483 5170504 5170488 5170483 -
tggacggcatttacctccactt

SEQ ID NO: 153098 - DNA, 22 bp, Artificial Sequence
  Synthetic oligonucleotide; TTT chr11 5170482 5170503 5170487 5170482 -
ggacggcatttacctccacttt

SEQ ID NO: 153099 - DNA, 22 bp, Artificial Sequence
  Synthetic oligonucleotide; TTG chr11 5170481 5170502 5170486 5170481 -
gacggcatttacctccactttt

SEQ ID NO: 153100 - DNA, 22 bp, Artificial Sequence
  Synthetic oligonucleotide; TTT chr11 5170471 5170492 5170476 5170471 -
acctccacttttccagactgtc

SEQ ID NO: 153101 - DNA, 22 bp, Artificial Sequence
  Synthetic oligonucleotide; TTA chr11 5170470 5170491 5170475 5170470 -
cctccacttttccagactgtca

SEQ ID NO: 153102 - DNA, 22 bp, Artificial Sequence
  Synthetic oligonucleotide; CTC chr11 5170466 5170487 5170471 5170466 -
cacttttccagactgtcacggc

SEQ ID NO: 153103 - DNA, 22 bp, Artificial Sequence
  Synthetic oligonucleotide; CTT chr11 5170461 5170482 5170466 5170461 -
ttccagactgtcacggccaatg

SEQ ID NO: 153104 - DNA, 22 bp, Artificial Sequence
  Synthetic oligonucleotide; TTT chr11 5170460 5170481 5170465 5170460 -
tccagactgtcacggccaatgc

SEQ ID NO: 153105 - DNA, 22 bp, Artificial Sequence
  Synthetic oligonucleotide; TTT chr11 5170459 5170480 5170464 5170459 -
ccagactgtcacggccaatgct

SEQ ID NO: 153106 - DNA, 22 bp, Artificial Sequence
  Synthetic oligonucleotide; TTC chr11 5170458 5170479 5170463 5170458 -
cagactgtcacggccaatgctt

SEQ ID NO: 153107 - DNA, 22 bp, Artificial Sequence
  Synthetic oligonucleotide; CTG chr11 5170451 5170472 5170456 5170451 -
tcacggccaatgcttacctctt

SEQ ID NO: 153108 - DNA, 22 bp, Artificial Sequence
  Synthetic oligonucleotide; CTT chr11 5170436 5170457 5170441 5170436 -
acctcttttttcctcctgtggt

SEQ ID NO: 153109 - DNA, 22 bp, Artificial Sequence
  Synthetic oligonucleotide; TTA chr11 5170435 5170456 5170440 5170435 -
cctcttttttcctcctgtggtc

SEQ ID NO: 153110 - DNA, 22 bp, Artificial Sequence
  Synthetic oligonucleotide; CTC chr11 5170431 5170452 5170436 5170431 -
ttttttcctcctgtggtcaacc

SEQ ID NO: 153111 - DNA, 22 bp, Artificial Sequence
  Synthetic oligonucleotide; CTT chr11 5170429 5170450 5170434 5170429 -
ttttcctcctgtggtcaacccc

SEQ ID NO: 153112 - DNA, 22 bp, Artificial Sequence
  Synthetic oligonucleotide; TTT chr11 5170428 5170449 5170433 5170428 -
tttcctcctgtggtcaacccca

SEQ ID NO: 153113 - DNA, 22 bp, Artificial Sequence
  Synthetic oligonucleotide; TTT chr11 5170427 5170448 5170432 5170427 -
ttcctcctgtggtcaaccccat

SEQ ID NO: 153114 - DNA, 22 bp, Artificial Sequence
  Synthetic oligonucleotide; TTT chr11 5170426 5170447 5170431 5170426 -
tcctcctgtggtcaaccccatt

SEQ ID NO: 153115 - DNA, 22 bp, Artificial Sequence
  Synthetic oligonucleotide; TTT chr11 5170425 5170446 5170430 5170425 -
cctcctgtggtcaaccccattg

SEQ ID NO: 153116 - DNA, 22 bp, Artificial Sequence
  Synthetic oligonucleotide; TTC chr11 5170424 5170445 5170429 5170424 -
ctcctgtggtcaaccccattgt

SEQ ID NO: 153117 - DNA, 22 bp, Artificial Sequence
  Synthetic oligonucleotide; CTC chr11 5170421 5170442 5170426 5170421 -
ctgtggtcaaccccattgtcta

SEQ ID NO: 153118 - DNA, 22 bp, Artificial Sequence
  Synthetic oligonucleotide; CTG chr11 5170418 5170439 5170423 5170418 -
tggtcaaccccattgtctatag

SEQ ID NO: 153119 - DNA, 22 bp, Artificial Sequence
  Synthetic oligonucleotide; TTG chr11 5170403 5170424 5170408 5170403 -
tctatagtatcaaaatcaaaga

SEQ ID NO: 153120 - DNA, 22 bp, Artificial Sequence
  Synthetic oligonucleotide; CTA chr11 5170399 5170420 5170404 5170399 -
tagtatcaaaatcaaagaaatt

SEQ ID NO: 153121 - DNA, 22 bp, Artificial Sequence
  Synthetic oligonucleotide; TTC chr11 5170376 5170397 5170381 5170376 -
gcaacagcgttgttcttacact

SEQ ID NO: 153122 - DNA, 22 bp, Artificial Sequence
  Synthetic oligonucleotide; TTG chr11 5170364 5170385 5170369 5170364 -
ttcttacactatccaggaagag

SEQ ID NO: 153123 - DNA, 22 bp, Artificial Sequence
  Synthetic oligonucleotide; TTC chr11 5170361 5170382 5170366 5170361 -
ttacactatccaggaagagggg

SEQ ID NO: 153124 - DNA, 22 bp, Artificial Sequence
  Synthetic oligonucleotide; CTT chr11 5170359 5170380 5170364 5170359 -
acactatccaggaagaggggtg

SEQ ID NO: 153125 - DNA, 22 bp, Artificial Sequence
  Synthetic oligonucleotide; TTA chr11 5170358 5170379 5170363 5170358 -
cactatccaggaagaggggtga

SEQ ID NO: 153126 - DNA, 22 bp, Artificial Sequence
  Synthetic oligonucleotide; CTA chr11 5170353 5170374 5170358 5170353 -
tccaggaagaggggtgagttct

SEQ ID NO: 153127 - DNA, 22 bp, Artificial Sequence
  Synthetic oligonucleotide; TTC chr11 5170332 5170353 5170337 5170332 -
taatggagactgaagataccct

SEQ ID NO: 153128 - DNA, 22 bp, Artificial Sequence
  Synthetic oligonucleotide; CTA chr11 5170330 5170351 5170335 5170330 -
atggagactgaagataccctga

SEQ ID NO: 153129 - DNA, 22 bp, Artificial Sequence
  Synthetic oligonucleotide; CTG chr11 5170320 5170341 5170325 5170320 -
aagataccctgacagcacaggc

SEQ ID NO: 153130 - DNA, 22 bp, Artificial Sequence
  Synthetic oligonucleotide; CTG chr11 5170309 5170330 5170314 5170309 -
acagcacaggcacttagatcag

SEQ ID NO: 153131 - DNA, 22 bp, Artificial Sequence
  Synthetic oligonucleotide; CTT chr11 5170294 5170315 5170299 5170294 -
agatcaggctttattacctgaa

SEQ ID NO: 153132 - DNA, 22 bp, Artificial Sequence
  Synthetic oligonucleotide; TTA chr11 5170293 5170314 5170298 5170293 -
gatcaggctttattacctgaat

SEQ ID NO: 153133 - DNA, 22 bp, Artificial Sequence
  Synthetic oligonucleotide; CTT chr11 5170283 5170304 5170288 5170283 -
tattacctgaatattagctttg

SEQ ID NO: 153134 - DNA, 22 bp, Artificial Sequence
  Synthetic oligonucleotide; TTT chr11 5170282 5170303 5170287 5170282 -
attacctgaatattagctttgc

SEQ ID NO: 153135 - DNA, 22 bp, Artificial Sequence
  Synthetic oligonucleotide; TTA chr11 5170281 5170302 5170286 5170281 -
ttacctgaatattagctttgca

SEQ ID NO: 153136 - DNA, 22 bp, Artificial Sequence
  Synthetic oligonucleotide; TTA chr11 5170278 5170299 5170283 5170278 -
cctgaatattagctttgcaaat

SEQ ID NO: 153137 - DNA, 22 bp, Artificial Sequence
  Synthetic oligonucleotide; CTG chr11 5170274 5170295 5170279 5170274 -
aatattagctttgcaaatatga

SEQ ID NO: 153138 - DNA, 22 bp, Artificial Sequence
  Synthetic oligonucleotide; TTA chr11 5170267 5170288 5170272 5170267 -
gctttgcaaatatgaaaaattc

SEQ ID NO: 153139 - DNA, 22 bp, Artificial Sequence
  Synthetic oligonucleotide; CTT chr11 5170263 5170284 5170268 5170263 -
tgcaaatatgaaaaattccatg

SEQ ID NO: 153140 - DNA, 22 bp, Artificial Sequence
  Synthetic oligonucleotide; TTT chr11 5170262 5170283 5170267 5170262 -
gcaaatatgaaaaattccatgg

SEQ ID NO: 153141 - DNA, 22 bp, Artificial Sequence
  Synthetic oligonucleotide; TTG chr11 5170261 5170282 5170266 5170261 -
caaatatgaaaaattccatggc

SEQ ID NO: 153142 - DNA, 22 bp, Artificial Sequence
  Synthetic oligonucleotide; TTC chr11 5170245 5170266 5170250 5170245 -
catggcttattattgcttgtta

SEQ ID NO: 153143 - DNA, 22 bp, Artificial Sequence
  Synthetic oligonucleotide; CTT chr11 5170237 5170258 5170242 5170237 -
attattgcttgttaatgagctt

SEQ ID NO: 153144 - DNA, 22 bp, Artificial Sequence
  Synthetic oligonucleotide; TTA chr11 5170236 5170257 5170241 5170236 -
ttattgcttgttaatgagcttt

SEQ ID NO: 153145 - DNA, 22 bp, Artificial Sequence
  Synthetic oligonucleotide; TTA chr11 5170233 5170254 5170238 5170233 -
ttgcttgttaatgagctttaac

SEQ ID NO: 153146 - DNA, 22 bp, Artificial Sequence
  Synthetic oligonucleotide; TTG chr11 5170230 5170251 5170235 5170230 -
cttgttaatgagctttaacatt

SEQ ID NO: 153147 - DNA, 22 bp, Artificial Sequence
  Synthetic oligonucleotide; CTT chr11 5170227 5170248 5170232 5170227 -
gttaatgagctttaacattttg

SEQ ID NO: 153148 - DNA, 22 bp, Artificial Sequence
  Synthetic oligonucleotide; TTG chr11 5170226 5170247 5170231 5170226 -
ttaatgagctttaacattttgt

SEQ ID NO: 153149 - DNA, 22 bp, Artificial Sequence
  Synthetic oligonucleotide; TTA chr11 5170223 5170244 5170228 5170223 -
atgagctttaacattttgtaga

SEQ ID NO: 153150 - DNA, 22 bp, Artificial Sequence
  Synthetic oligonucleotide; CTT chr11 5170215 5170236 5170220 5170215 -
taacattttgtagatgaagaaa

SEQ ID NO: 153151 - DNA, 22 bp, Artificial Sequence
  Synthetic oligonucleotide; TTT chr11 5170214 5170235 5170219 5170214 -
aacattttgtagatgaagaaaa

SEQ ID NO: 153152 - DNA, 22 bp, Artificial Sequence
  Synthetic oligonucleotide; TTA chr11 5170213 5170234 5170218 5170213 -
acattttgtagatgaagaaaaa

SEQ ID NO: 153153 - DNA, 22 bp, Artificial Sequence
  Synthetic oligonucleotide; TTT chr11 5170207 5170228 5170212 5170207 -
tgtagatgaagaaaaaaaacag

SEQ ID NO: 153154 - DNA, 22 bp, Artificial Sequence
  Synthetic oligonucleotide; TTT chr11 5170206 5170227 5170211 5170206 -
gtagatgaagaaaaaaaacagt

SEQ ID NO: 153155 - DNA, 22 bp, Artificial Sequence
  Synthetic oligonucleotide; TTG chr11 5170205 5170226 5170210 5170205 -
tagatgaagaaaaaaaacagtt

SEQ ID NO: 153156 - DNA, 22 bp, Artificial Sequence
  Synthetic oligonucleotide; TTT chr11 5170182 5170203 5170187 5170182 -
tatatatttccctgagaatagg

SEQ ID NO: 153157 - DNA, 22 bp, Artificial Sequence
  Synthetic oligonucleotide; TTT chr11 5170181 5170202 5170186 5170181 -
atatatttccctgagaatagga

SEQ ID NO: 153158 - DNA, 22 bp, Artificial Sequence
  Synthetic oligonucleotide; TTA chr11 5170180 5170201 5170185 5170180 -
tatatttccctgagaataggaa

SEQ ID NO: 153159 - DNA, 22 bp, Artificial Sequence
  Synthetic oligonucleotide; TTT chr11 5170173 5170194 5170178 5170173 -
ccctgagaataggaaatggcat

SEQ ID NO: 153160 - DNA, 22 bp, Artificial Sequence
  Synthetic oligonucleotide; TTC chr11 5170172 5170193 5170177 5170172 -
cctgagaataggaaatggcatt

SEQ ID NO: 153161 - DNA, 22 bp, Artificial Sequence
  Synthetic oligonucleotide; CTG chr11 5170168 5170189 5170173 5170168 -
agaataggaaatggcattactc

SEQ ID NO: 153162 - DNA, 22 bp, Artificial Sequence
  Synthetic oligonucleotide; TTA chr11 5170149 5170170 5170154 5170149 -
ctctgaaataaaattgtgggag

SEQ ID NO: 153163 - DNA, 22 bp, Artificial Sequence
  Synthetic oligonucleotide; CTC chr11 5170146 5170167 5170151 5170146 -
tgaaataaaattgtgggaggag

SEQ ID NO: 153164 - DNA, 22 bp, Artificial Sequence
  Synthetic oligonucleotide; CTG chr11 5170144 5170165 5170149 5170144 -
aaataaaattgtgggaggaggc

SEQ ID NO: 153165 - DNA, 22 bp, Artificial Sequence
  Synthetic oligonucleotide; TTG chr11 5170133 5170154 5170138 5170133 -
tgggaggaggcatagaacacag

SEQ ID NO: 153166 - DNA, 22 bp, Artificial Sequence
  Synthetic oligonucleotide; CTT chr11 5170107 5170128 5170112 5170107 -
tgtcctggtgatgacacacttt

SEQ ID NO: 153167 - DNA, 22 bp, Artificial Sequence
  Synthetic oligonucleotide; TTT chr11 5170106 5170127 5170111 5170106 -
gtcctggtgatgacacactttg

SEQ ID NO: 153168 - DNA, 22 bp, Artificial Sequence
  Synthetic oligonucleotide; TTG chr11 5170105 5170126 5170110 5170105 -
tcctggtgatgacacactttgt

SEQ ID NO: 153169 - DNA, 22 bp, Artificial Sequence
  Synthetic oligonucleotide; CTG chr11 5170100 5170121 5170105 5170100 -
gtgatgacacactttgtgtgct

SEQ ID NO: 153170 - DNA, 22 bp, Artificial Sequence
  Synthetic oligonucleotide; CTT chr11 5170086 5170107 5170091 5170086 -
tgtgtgctgaatccttgaatac

SEQ ID NO: 153171 - DNA, 22 bp, Artificial Sequence
  Synthetic oligonucleotide; TTT chr11 5170085 5170106 5170090 5170085 -
gtgtgctgaatccttgaatact

SEQ ID NO: 153172 - DNA, 22 bp, Artificial Sequence
  Synthetic oligonucleotide; TTG chr11 5170084 5170105 5170089 5170084 -
tgtgctgaatccttgaatactc

SEQ ID NO: 153173 - DNA, 22 bp, Artificial Sequence
  Synthetic oligonucleotide; CTG chr11 5170077 5170098 5170082 5170077 -
aatccttgaatactcaattcag

SEQ ID NO: 153174 - DNA, 22 bp, Artificial Sequence
  Synthetic oligonucleotide; CTT chr11 5170070 5170091 5170075 5170070 -
gaatactcaattcagtgacatt

SEQ ID NO: 153175 - DNA, 22 bp, Artificial Sequence
  Synthetic oligonucleotide; TTG chr11 5170069 5170090 5170074 5170069 -
aatactcaattcagtgacattt

SEQ ID NO: 153176 - DNA, 22 bp, Artificial Sequence
  Synthetic oligonucleotide; CTC chr11 5170062 5170083 5170067 5170062 -
aattcagtgacatttggttctg

SEQ ID NO: 153177 - DNA, 22 bp, Artificial Sequence
  Synthetic oligonucleotide; TTC chr11 5170057 5170078 5170062 5170057 -
agtgacatttggttctgggaat

SEQ ID NO: 153178 - DNA, 22 bp, Artificial Sequence
  Synthetic oligonucleotide; TTT chr11 5170047 5170068 5170052 5170047 -
ggttctgggaatatgtagaaag

SEQ ID NO: 153179 - DNA, 22 bp, Artificial Sequence
  Synthetic oligonucleotide; TTG chr11 5170046 5170067 5170051 5170046 -
gttctgggaatatgtagaaaga

SEQ ID NO: 153180 - DNA, 22 bp, Artificial Sequence
  Synthetic oligonucleotide; TTC chr11 5170042 5170063 5170047 5170042 -
tgggaatatgtagaaagagtct

SEQ ID NO: 153181 - DNA, 22 bp, Artificial Sequence
  Synthetic oligonucleotide; CTG chr11 5170040 5170061 5170045 5170040 -
ggaatatgtagaaagagtcttg

SEQ ID NO: 153182 - DNA, 22 bp, Artificial Sequence
  Synthetic oligonucleotide; CTT chr11 5170019 5170040 5170024 5170019 -
ggggaggtttaagtttctggtt

SEQ ID NO: 153183 - DNA, 22 bp, Artificial Sequence
  Synthetic oligonucleotide; TTG chr11 5170018 5170039 5170023 5170018 -
gggaggtttaagtttctggtta

SEQ ID NO: 153184 - DNA, 22 bp, Artificial Sequence
  Synthetic oligonucleotide; TTT chr11 5170009 5170030 5170014 5170009 -
aagtttctggttatattaaaat

SEQ ID NO: 153185 - DNA, 22 bp, Artificial Sequence
  Synthetic oligonucleotide; TTA chr11 5170008 5170029 5170013 5170008 -
agtttctggttatattaaaatt

SEQ ID NO: 153186 - DNA, 22 bp, Artificial Sequence
  Synthetic oligonucleotide; TTT chr11 5170003 5170024 5170008 5170003 -
ctggttatattaaaattagtga

SEQ ID NO: 153187 - DNA, 22 bp, Artificial Sequence
  Synthetic oligonucleotide; TTC chr11 5170002 5170023 5170007 5170002 -
tggttatattaaaattagtgat

SEQ ID NO: 153188 - DNA, 22 bp, Artificial Sequence
  Synthetic oligonucleotide; CTG chr11 5170000 5170021 5170005 5170000 -
gttatattaaaattagtgatac

SEQ ID NO: 153189 - DNA, 22 bp, Artificial Sequence
  Synthetic oligonucleotide; TTA chr11 5169996 5170017 5170001 5169996 -
tattaaaattagtgatacatac

SEQ ID NO: 153190 - DNA, 22 bp, Artificial Sequence
  Synthetic oligonucleotide; TTA chr11 5169991 5170012 5169996 5169991 -
aaattagtgatacatacttgtg

SEQ ID NO: 153191 - DNA, 22 bp, Artificial Sequence
  Synthetic oligonucleotide; TTA chr11 5169985 5170006 5169990 5169985 -
gtgatacatacttgtgaaggaa

SEQ ID NO: 153192 - DNA, 22 bp, Artificial Sequence
  Synthetic oligonucleotide; CTT chr11 5169972 5169993 5169977 5169972 -
gtgaaggaaaataatcaggaca

SEQ ID NO: 153193 - DNA, 22 bp, Artificial Sequence
  Synthetic oligonucleotide; TTG chr11 5169971 5169992 5169976 5169971 -
tgaaggaaaataatcaggacac

SEQ ID NO: 153194 - DNA, 22 bp, Artificial Sequence
  Synthetic oligonucleotide; TTG chr11 5169933 5169954 5169938 5169933 -
tattattttgtttgtatagttt

SEQ ID NO: 153195 - DNA, 22 bp, Artificial Sequence
  Synthetic oligonucleotide; TTA chr11 5169928 5169949 5169933 5169928 -
ttttgtttgtatagtttcagaa

SEQ ID NO: 153196 - DNA, 22 bp, Artificial Sequence
  Synthetic oligonucleotide; TTT chr11 5169925 5169946 5169930 5169925 -
tgtttgtatagtttcagaacat

SEQ ID NO: 153197 - DNA, 22 bp, Artificial Sequence
  Synthetic oligonucleotide; TTT chr11 5169924 5169945 5169929 5169924 -
gtttgtatagtttcagaacatg

SEQ ID NO: 153198 - DNA, 22 bp, Artificial Sequence
  Synthetic oligonucleotide; TTG chr11 5169923 5169944 5169928 5169923 -
tttgtatagtttcagaacatgt

SEQ ID NO: 153199 - DNA, 22 bp, Artificial Sequence
  Synthetic oligonucleotide; TTT chr11 5169920 5169941 5169925 5169920 -
gtatagtttcagaacatgtaca

SEQ ID NO: 153200 - DNA, 22 bp, Artificial Sequence
  Synthetic oligonucleotide; TTG chr11 5169919 5169940 5169924 5169919 -
tatagtttcagaacatgtacat

SEQ ID NO: 153201 - DNA, 22 bp, Artificial Sequence
  Synthetic oligonucleotide; TTT chr11 5169911 5169932 5169916 5169911 -
cagaacatgtacatctaattta

SEQ ID NO: 153202 - DNA, 22 bp, Artificial Sequence
  Synthetic oligonucleotide; TTC chr11 5169910 5169931 5169915 5169910 -
agaacatgtacatctaatttaa

SEQ ID NO: 153203 - DNA, 22 bp, Artificial Sequence
  Synthetic oligonucleotide; CTA chr11 5169894 5169915 5169899 5169894 -
atttaatgtcaaaaaatcagaa

SEQ ID NO: 153204 - DNA, 22 bp, Artificial Sequence
  Synthetic oligonucleotide; TTT chr11 5169890 5169911 5169895 5169890 -
aatgtcaaaaaatcagaaccct

SEQ ID NO: 153205 - DNA, 22 bp, Artificial Sequence
  Synthetic oligonucleotide; TTA chr11 5169889 5169910 5169894 5169889 -
atgtcaaaaaatcagaaccctg

SEQ ID NO: 153206 - DNA, 22 bp, Artificial Sequence
  Synthetic oligonucleotide; CTG chr11 5169867 5169888 5169872 5169867 -
cttacctctgatggatataaag

SEQ ID NO: 153207 - DNA, 22 bp, Artificial Sequence
  Synthetic oligonucleotide; CTT chr11 5169864 5169885 5169869 5169864 -
acctctgatggatataaagatg

SEQ ID NO: 153208 - DNA, 22 bp, Artificial Sequence
  Synthetic oligonucleotide; TTA chr11 5169863 5169884 5169868 5169863 -
cctctgatggatataaagatgg

SEQ ID NO: 153209 - DNA, 22 bp, Artificial Sequence
  Synthetic oligonucleotide; CTC chr11 5169859 5169880 5169864 5169859 -
tgatggatataaagatggaaga

SEQ ID NO: 153210 - DNA, 22 bp, Artificial Sequence
  Synthetic oligonucleotide; CTG chr11 5169857 5169878 5169862 5169857 -
atggatataaagatggaagaat

SEQ ID NO: 153211 - DNA, 22 bp, Artificial Sequence
  Synthetic oligonucleotide; TTT chr11 5169813 5169834 5169818 5169813 -
ctggggagatggaaatattttg

SEQ ID NO: 153212 - DNA, 22 bp, Artificial Sequence
  Synthetic oligonucleotide; TTC chr11 5169812 5169833 5169817 5169812 -
tggggagatggaaatattttgt

SEQ ID NO: 153213 - DNA, 22 bp, Artificial Sequence
  Synthetic oligonucleotide; CTG chr11 5169810 5169831 5169815 5169810 -
gggagatggaaatattttgttg

SEQ ID NO: 153214 - DNA, 22 bp, Artificial Sequence
  Synthetic oligonucleotide; TTT chr11 5169793 5169814 5169798 5169793 -
tgttgtgttagggatgtggtga

SEQ ID NO: 153215 - DNA, 22 bp, Artificial Sequence
  Synthetic oligonucleotide; TTT chr11 5169792 5169813 5169797 5169792 -
gttgtgttagggatgtggtgac

SEQ ID NO: 153216 - DNA, 22 bp, Artificial Sequence
  Synthetic oligonucleotide; TTG chr11 5169791 5169812 5169796 5169791 -
ttgtgttagggatgtggtgaca

SEQ ID NO: 153217 - DNA, 22 bp, Artificial Sequence
  Synthetic oligonucleotide; TTG chr11 5169788 5169809 5169793 5169788 -
tgttagggatgtggtgacattg

SEQ ID NO: 153218 - DNA, 22 bp, Artificial Sequence
  Synthetic oligonucleotide; TTA chr11 5169783 5169804 5169788 5169783 -
gggatgtggtgacattgttttg

SEQ ID NO: 153219 - DNA, 22 bp, Artificial Sequence
  Synthetic oligonucleotide; TTG chr11 5169766 5169787 5169771 5169766 -
ttttgtcaatttgtcaaaacgg

SEQ ID NO: 153220 - DNA, 22 bp, Artificial Sequence
  Synthetic oligonucleotide; TTT chr11 5169763 5169784 5169768 5169763 -
tgtcaatttgtcaaaacggtac

SEQ ID NO: 153221 - DNA, 22 bp, Artificial Sequence
  Synthetic oligonucleotide; TTT chr11 5169762 5169783 5169767 5169762 -
gtcaatttgtcaaaacggtaca

SEQ ID NO: 153222 - DNA, 22 bp, Artificial Sequence
  Synthetic oligonucleotide; TTG chr11 5169761 5169782 5169766 5169761 -
tcaatttgtcaaaacggtacag

SEQ ID NO: 153223 - DNA, 22 bp, Artificial Sequence
  Synthetic oligonucleotide; TTT chr11 5169754 5169775 5169759 5169754 -
gtcaaaacggtacagctaagat

SEQ ID NO: 153224 - DNA, 22 bp, Artificial Sequence
  Synthetic oligonucleotide; TTG chr11 5169753 5169774 5169758 5169753 -
tcaaaacggtacagctaagatt

SEQ ID NO: 153225 - DNA, 22 bp, Artificial Sequence
  Synthetic oligonucleotide; CTA chr11 5169736 5169757 5169741 5169736 -
agatttgcacatttctaggtac

SEQ ID NO: 153226 - DNA, 22 bp, Artificial Sequence
  Synthetic oligonucleotide; TTT chr11 5169730 5169751 5169735 5169730 -
gcacatttctaggtacatcaat

SEQ ID NO: 153227 - DNA, 22 bp, Artificial Sequence
  Synthetic oligonucleotide; TTG chr11 5169729 5169750 5169734 5169729 -
cacatttctaggtacatcaatt

SEQ ID NO: 153228 - DNA, 22 bp, Artificial Sequence
  Synthetic oligonucleotide; TTT chr11 5169722 5169743 5169727 5169722 -
ctaggtacatcaattttacatc

SEQ ID NO: 153229 - DNA, 22 bp, Artificial Sequence
  Synthetic oligonucleotide; TTC chr11 5169721 5169742 5169726 5169721 -
taggtacatcaattttacatca

SEQ ID NO: 153230 - DNA, 22 bp, Artificial Sequence
  Synthetic oligonucleotide; CTA chr11 5169719 5169740 5169724 5169719 -
ggtacatcaattttacatcaaa

SEQ ID NO: 153231 - DNA, 22 bp, Artificial Sequence
  Synthetic oligonucleotide; TTT chr11 5169706 5169727 5169711 5169706 -
tacatcaaaacttctgaatgat

SEQ ID NO: 153232 - DNA, 22 bp, Artificial Sequence
  Synthetic oligonucleotide; TTT chr11 5169705 5169726 5169710 5169705 -
acatcaaaacttctgaatgata

SEQ ID NO: 153233 - DNA, 22 bp, Artificial Sequence
  Synthetic oligonucleotide; TTA chr11 5169704 5169725 5169709 5169704 -
catcaaaacttctgaatgataa

SEQ ID NO: 153234 - DNA, 22 bp, Artificial Sequence
  Synthetic oligonucleotide; CTT chr11 5169693 5169714 5169698 5169693 -
ctgaatgataataataacaaaa

SEQ ID NO: 153235 - DNA, 22 bp, Artificial Sequence
  Synthetic oligonucleotide; TTC chr11 5169692 5169713 5169697 5169692 -
tgaatgataataataacaaaaa

SEQ ID NO: 153236 - DNA, 22 bp, Artificial Sequence
  Synthetic oligonucleotide; CTG chr11 5169690 5169711 5169695 5169690 -
aatgataataataacaaaaagg

SEQ ID NO: 153237 - DNA, 22 bp, Artificial Sequence
  Synthetic oligonucleotide; TTA chr11 5169640 5169661 5169645 5169640 -
gatttcatagtgaatacaagtg

SEQ ID NO: 153238 - DNA, 22 bp, Artificial Sequence
  Synthetic oligonucleotide; TTT chr11 5169635 5169656 5169640 5169635 -
catagtgaatacaagtgtggaa

SEQ ID NO: 153239 - DNA, 22 bp, Artificial Sequence
  Synthetic oligonucleotide; TTC chr11 5169634 5169655 5169639 5169634 -
atagtgaatacaagtgtggaaa

SEQ ID NO: 153240 - DNA, 22 bp, Artificial Sequence
  Synthetic oligonucleotide; TTG chr11 5169590 5169611 5169595 5169590 -
ataattgttgaagttgtgtcat

SEQ ID NO: 153241 - DNA, 22 bp, Artificial Sequence
  Synthetic oligonucleotide; TTG chr11 5169583 5169604 5169588 5169583 -
ttgaagttgtgtcatgggtgcc

SEQ ID NO: 153242 - DNA, 22 bp, Artificial Sequence
  Synthetic oligonucleotide; TTG chr11 5169580 5169601 5169585 5169580 -
aagttgtgtcatgggtgcctgg

SEQ ID NO: 153243 - DNA, 22 bp, Artificial Sequence
  Synthetic oligonucleotide; TTG chr11 5169574 5169595 5169579 5169574 -
tgtcatgggtgcctggaaatta

SEQ ID NO: 153244 - DNA, 22 bp, Artificial Sequence
  Synthetic oligonucleotide; CTG chr11 5169559 5169580 5169564 5169559 -
gaaattaattataatattctgt

SEQ ID NO: 153245 - DNA, 22 bp, Artificial Sequence
  Synthetic oligonucleotide; TTA chr11 5169552 5169573 5169557 5169552 -
attataatattctgtttacttt

SEQ ID NO: 153246 - DNA, 22 bp, Artificial Sequence
  Synthetic oligonucleotide; TTA chr11 5169548 5169569 5169553 5169548 -
taatattctgtttactttgtgt

SEQ ID NO: 153247 - DNA, 22 bp, Artificial Sequence
  Synthetic oligonucleotide; TTC chr11 5169540 5169561 5169545 5169540 -
tgtttactttgtgtagtttaca

SEQ ID NO: 153248 - DNA, 22 bp, Artificial Sequence
  Synthetic oligonucleotide; CTG chr11 5169538 5169559 5169543 5169538 -
tttactttgtgtagtttacaat

SEQ ID NO: 153249 - DNA, 22 bp, Artificial Sequence
  Synthetic oligonucleotide; TTT chr11 5169535 5169556 5169540 5169535 -
actttgtgtagtttacaatttc

SEQ ID NO: 153250 - DNA, 22 bp, Artificial Sequence
  Synthetic oligonucleotide; TTA chr11 5169534 5169555 5169539 5169534 -
ctttgtgtagtttacaatttct

SEQ ID NO: 153251 - DNA, 22 bp, Artificial Sequence
  Synthetic oligonucleotide; CTT chr11 5169531 5169552 5169536 5169531 -
tgtgtagtttacaatttctgta

SEQ ID NO: 153252 - DNA, 22 bp, Artificial Sequence
  Synthetic oligonucleotide; TTT chr11 5169530 5169551 5169535 5169530 -
gtgtagtttacaatttctgtaa

SEQ ID NO: 153253 - DNA, 22 bp, Artificial Sequence
  Synthetic oligonucleotide; TTG chr11 5169529 5169550 5169534 5169529 -
tgtagtttacaatttctgtaat

SEQ ID NO: 153254 - DNA, 22 bp, Artificial Sequence
  Synthetic oligonucleotide; TTT chr11 5169521 5169542 5169526 5169521 -
acaatttctgtaataaaaagat

SEQ ID NO: 153255 - DNA, 22 bp, Artificial Sequence
  Synthetic oligonucleotide; TTA chr11 5169520 5169541 5169525 5169520 -
caatttctgtaataaaaagatt

SEQ ID NO: 153256 - DNA, 22 bp, Artificial Sequence
  Synthetic oligonucleotide; TTT chr11 5169514 5169535 5169519 5169514 -
ctgtaataaaaagattcttaaa

SEQ ID NO: 153257 - DNA, 22 bp, Artificial Sequence
  Synthetic oligonucleotide; TTC chr11 5169513 5169534 5169518 5169513 -
tgtaataaaaagattcttaaaa

SEQ ID NO: 153258 - DNA, 22 bp, Artificial Sequence
  Synthetic oligonucleotide; CTG chr11 5169511 5169532 5169516 5169511 -
taataaaaagattcttaaaaaa

SEQ ID NO: 153259 - DNA, 22 bp, Artificial Sequence
  Synthetic oligonucleotide; TTC chr11 5169497 5169518 5169502 5169497 -
ttaaaaaaattatactcagtgt

SEQ ID NO: 153260 - DNA, 22 bp, Artificial Sequence
  Synthetic oligonucleotide; CTT chr11 5169495 5169516 5169500 5169495 -
aaaaaaattatactcagtgtgc

SEQ ID NO: 153261 - DNA, 22 bp, Artificial Sequence
  Synthetic oligonucleotide; TTA chr11 5169494 5169515 5169499 5169494 -
aaaaaattatactcagtgtgct

SEQ ID NO: 153262 - DNA, 22 bp, Artificial Sequence
  Synthetic oligonucleotide; TTA chr11 5169485 5169506 5169490 5169485 -
tactcagtgtgctaatgttaaa

SEQ ID NO: 153263 - DNA, 22 bp, Artificial Sequence
  Synthetic oligonucleotide; CTC chr11 5169480 5169501 5169485 5169480 -
agtgtgctaatgttaaatctta

SEQ ID NO: 153264 - DNA, 22 bp, Artificial Sequence
  Synthetic oligonucleotide; CTA chr11 5169471 5169492 5169476 5169471 -
atgttaaatcttaattgaatat

SEQ ID NO: 153265 - DNA, 22 bp, Artificial Sequence
  Synthetic oligonucleotide; TTA chr11 5169465 5169486 5169470 5169465 -
aatcttaattgaatatgcacca

SEQ ID NO: 153266 - DNA, 22 bp, Artificial Sequence
  Synthetic oligonucleotide; CTT chr11 5169459 5169480 5169464 5169459 -
aattgaatatgcaccatgaagc

SEQ ID NO: 153267 - DNA, 22 bp, Artificial Sequence
  Synthetic oligonucleotide; TTA chr11 5169458 5169479 5169463 5169458 -
attgaatatgcaccatgaagca

SEQ ID NO: 153268 - DNA, 22 bp, Artificial Sequence
  Synthetic oligonucleotide; TTG chr11 5169454 5169475 5169459 5169454 -
aatatgcaccatgaagcagaga

SEQ ID NO: 153269 - DNA, 22 bp, Artificial Sequence
  Synthetic oligonucleotide; CTT chr11 5169426 5169447 5169431 5169426 -
ttaactggtcaggaggaaactg

SEQ ID NO: 153270 - DNA, 22 bp, Artificial Sequence
  Synthetic oligonucleotide; TTT chr11 5169425 5169446 5169430 5169425 -
taactggtcaggaggaaactgt

SEQ ID NO: 153271 - DNA, 22 bp, Artificial Sequence
  Synthetic oligonucleotide; TTT chr11 5169424 5169445 5169429 5169424 -
aactggtcaggaggaaactgtt

SEQ ID NO: 153272 - DNA, 22 bp, Artificial Sequence
  Synthetic oligonucleotide; TTA chr11 5169423 5169444 5169428 5169423 -
actggtcaggaggaaactgttt

SEQ ID NO: 153273 - DNA, 22 bp, Artificial Sequence
  Synthetic oligonucleotide; CTG chr11 5169419 5169440 5169424 5169419 -
gtcaggaggaaactgtttggct

SEQ ID NO: 153274 - DNA, 22 bp, Artificial Sequence
  Synthetic oligonucleotide; CTG chr11 5169404 5169425 5169409 5169404 -
tttggctttagaaagctatttt

SEQ ID NO: 153275 - DNA, 22 bp, Artificial Sequence
  Synthetic oligonucleotide; TTT chr11 5169401 5169422 5169406 5169401 -
ggctttagaaagctattttatt

SEQ ID NO: 153276 - DNA, 22 bp, Artificial Sequence
  Synthetic oligonucleotide; TTG chr11 5169400 5169421 5169405 5169400 -
gctttagaaagctattttattt

SEQ ID NO: 153277 - DNA, 22 bp, Artificial Sequence
  Synthetic oligonucleotide; CTT chr11 5169396 5169417 5169401 5169396 -
tagaaagctattttatttttaa

SEQ ID NO: 153278 - DNA, 22 bp, Artificial Sequence
  Synthetic oligonucleotide; TTT chr11 5169395 5169416 5169400 5169395 -
agaaagctattttatttttaat

SEQ ID NO: 153279 - DNA, 22 bp, Artificial Sequence
  Synthetic oligonucleotide; TTA chr11 5169394 5169415 5169399 5169394 -
gaaagctattttatttttaatg

SEQ ID NO: 153280 - DNA, 22 bp, Artificial Sequence
  Synthetic oligonucleotide; CTA chr11 5169386 5169407 5169391 5169386 -
ttttatttttaatgagttcaat

SEQ ID NO: 153281 - DNA, 22 bp, Artificial Sequence
  Synthetic oligonucleotide; TTT chr11 5169383 5169404 5169388 5169383 -
tatttttaatgagttcaatact

SEQ ID NO: 153282 - DNA, 22 bp, Artificial Sequence
  Synthetic oligonucleotide; TTT chr11 5169382 5169403 5169387 5169382 -
atttttaatgagttcaatacta

SEQ ID NO: 153283 - DNA, 22 bp, Artificial Sequence
  Synthetic oligonucleotide; TTA chr11 5169381 5169402 5169386 5169381 -
tttttaatgagttcaatactag

SEQ ID NO: 153284 - DNA, 22 bp, Artificial Sequence
  Synthetic oligonucleotide; TTT chr11 5169378 5169399 5169383 5169378 -
ttaatgagttcaatactagaaa

SEQ ID NO: 153285 - DNA, 22 bp, Artificial Sequence
  Synthetic oligonucleotide; TTT chr11 5169377 5169398 5169382 5169377 -
taatgagttcaatactagaaag

SEQ ID NO: 153286 - DNA, 22 bp, Artificial Sequence
  Synthetic oligonucleotide; TTT chr11 5169376 5169397 5169381 5169376 -
aatgagttcaatactagaaaga

SEQ ID NO: 153287 - DNA, 22 bp, Artificial Sequence
  Synthetic oligonucleotide; TTA chr11 5169375 5169396 5169380 5169375 -
atgagttcaatactagaaagaa

SEQ ID NO: 153288 - DNA, 22 bp, Artificial Sequence
  Synthetic oligonucleotide; TTC chr11 5169367 5169388 5169372 5169367 -
aatactagaaagaaaaaaaacc

SEQ ID NO: 153289 - DNA, 22 bp, Artificial Sequence
  Synthetic oligonucleotide; CTA chr11 5169360 5169381 5169365 5169360 -
gaaagaaaaaaaaccacaacta

SEQ ID NO: 153290 - DNA, 22 bp, Artificial Sequence
  Synthetic oligonucleotide; CTA chr11 5169338 5169359 5169343 5169338 -
cttgaaaatactgttttagaag

SEQ ID NO: 153291 - DNA, 22 bp, Artificial Sequence
  Synthetic oligonucleotide; CTT chr11 5169335 5169356 5169340 5169335 -
gaaaatactgttttagaagaaa

SEQ ID NO: 153292 - DNA, 22 bp, Artificial Sequence
  Synthetic oligonucleotide; TTG chr11 5169334 5169355 5169339 5169334 -
aaaatactgttttagaagaaaa

SEQ ID NO: 153293 - DNA, 22 bp, Artificial Sequence
  Synthetic oligonucleotide; CTG chr11 5169325 5169346 5169330 5169325 -
ttttagaagaaaataactaaaa

SEQ ID NO: 153294 - DNA, 22 bp, Artificial Sequence
  Synthetic oligonucleotide; TTT chr11 5169322 5169343 5169327 5169322 -
tagaagaaaataactaaaaaac

SEQ ID NO: 153295 - DNA, 22 bp, Artificial Sequence
  Synthetic oligonucleotide; TTT chr11 5169321 5169342 5169326 5169321 -
agaagaaaataactaaaaaaca

SEQ ID NO: 153296 - DNA, 22 bp, Artificial Sequence
  Synthetic oligonucleotide; TTA chr11 5169320 5169341 5169325 5169320 -
gaagaaaataactaaaaaacag

SEQ ID NO: 153297 - DNA, 22 bp, Artificial Sequence
  Synthetic oligonucleotide; CTA chr11 5169306 5169327 5169311 5169306 -
aaaaacagaaaaagcaaggcct

SEQ ID NO: 153298 - DNA, 22 bp, Artificial Sequence
  Synthetic oligonucleotide; CTA chr11 5169283 5169304 5169288 5169283 -
ctcctgcaatagtctttggtga

SEQ ID NO: 153299 - DNA, 22 bp, Artificial Sequence
  Synthetic oligonucleotide; CTC chr11 5169280 5169301 5169285 5169280 -
ctgcaatagtctttggtgacat

SEQ ID NO: 153300 - DNA, 22 bp, Artificial Sequence
  Synthetic oligonucleotide; CTG chr11 5169277 5169298 5169282 5169277 -
caatagtctttggtgacatcaa

SEQ ID NO: 153301 - DNA, 22 bp, Artificial Sequence
  Synthetic oligonucleotide; CTT chr11 5169267 5169288 5169272 5169267 -
tggtgacatcaatcactcggta

SEQ ID NO: 153302 - DNA, 22 bp, Artificial Sequence
  Synthetic oligonucleotide; TTT chr11 5169266 5169287 5169271 5169266 -
ggtgacatcaatcactcggtag

SEQ ID NO: 153303 - DNA, 22 bp, Artificial Sequence
  Synthetic oligonucleotide; TTG chr11 5169265 5169286 5169270 5169265 -
gtgacatcaatcactcggtagt

SEQ ID NO: 153304 - DNA, 22 bp, Artificial Sequence
  Synthetic oligonucleotide; CTC chr11 5169249 5169270 5169254 5169249 -
ggtagtagacaagcttctgaca

SEQ ID NO: 153305 - DNA, 22 bp, Artificial Sequence
  Synthetic oligonucleotide; CTT chr11 5169233 5169254 5169238 5169233 -
ctgacaaacaaaaaggtaggga

SEQ ID NO: 153306 - DNA, 22 bp, Artificial Sequence
  Synthetic oligonucleotide; TTC chr11 5169232 5169253 5169237 5169232 -
tgacaaacaaaaaggtagggag

SEQ ID NO: 153307 - DNA, 22 bp, Artificial Sequence
  Synthetic oligonucleotide; CTG chr11 5169230 5169251 5169235 5169230 -
acaaacaaaaaggtagggagga

SEQ ID NO: 153308 - DNA, 22 bp, Artificial Sequence
  Synthetic oligonucleotide; TTC chr11 5169196 5169217 5169201 5169196 -
tagaaaatccctcagacaggga

SEQ ID NO: 153309 - DNA, 22 bp, Artificial Sequence
  Synthetic oligonucleotide; CTA chr11 5169194 5169215 5169199 5169194 -
gaaaatccctcagacagggatt

SEQ ID NO: 153310 - DNA, 22 bp, Artificial Sequence
  Synthetic oligonucleotide; CTC chr11 5169183 5169204 5169188 5169183 -
agacagggattgcagagcccaa

SEQ ID NO: 153311 - DNA, 22 bp, Artificial Sequence
  Synthetic oligonucleotide; TTG chr11 5169171 5169192 5169176 5169171 -
cagagcccaactttttgttttc

SEQ ID NO: 153312 - DNA, 22 bp, Artificial Sequence
  Synthetic oligonucleotide; CTT chr11 5169158 5169179 5169163 5169158 -
tttgttttcttcagataatttt

SEQ ID NO: 153313 - DNA, 22 bp, Artificial Sequence
  Synthetic oligonucleotide; TTT chr11 5169157 5169178 5169162 5169157 -
ttgttttcttcagataattttg

SEQ ID NO: 153314 - DNA, 22 bp, Artificial Sequence
  Synthetic oligonucleotide; TTT chr11 5169156 5169177 5169161 5169156 -
tgttttcttcagataattttga

SEQ ID NO: 153315 - DNA, 22 bp, Artificial Sequence
  Synthetic oligonucleotide; TTT chr11 5169155 5169176 5169160 5169155 -
gttttcttcagataattttgaa

SEQ ID NO: 153316 - DNA, 22 bp, Artificial Sequence
  Synthetic oligonucleotide; TTG chr11 5169154 5169175 5169159 5169154 -
ttttcttcagataattttgaat

SEQ ID NO: 153317 - DNA, 22 bp, Artificial Sequence
  Synthetic oligonucleotide; TTT chr11 5169151 5169172 5169156 5169151 -
tcttcagataattttgaatttc

SEQ ID NO: 153318 - DNA, 22 bp, Artificial Sequence
  Synthetic oligonucleotide; TTT chr11 5169150 5169171 5169155 5169150 -
cttcagataattttgaatttcc

SEQ ID NO: 153319 - DNA, 22 bp, Artificial Sequence
  Synthetic oligonucleotide; TTC chr11 5169149 5169170 5169154 5169149 -
ttcagataattttgaatttcca

SEQ ID NO: 153320 - DNA, 22 bp, Artificial Sequence
  Synthetic oligonucleotide; CTT chr11 5169147 5169168 5169152 5169147 -
cagataattttgaatttccatg

SEQ ID NO: 153321 - DNA, 22 bp, Artificial Sequence
  Synthetic oligonucleotide; TTC chr11 5169146 5169167 5169151 5169146 -
agataattttgaatttccatga

SEQ ID NO: 153322 - DNA, 22 bp, Artificial Sequence
  Synthetic oligonucleotide; TTT chr11 5169137 5169158 5169142 5169137 -
tgaatttccatgaaccacagtg

SEQ ID NO: 153323 - DNA, 22 bp, Artificial Sequence
  Synthetic oligonucleotide; TTT chr11 5169136 5169157 5169141 5169136 -
gaatttccatgaaccacagtga

SEQ ID NO: 153324 - DNA, 22 bp, Artificial Sequence
  Synthetic oligonucleotide; TTG chr11 5169135 5169156 5169140 5169135 -
aatttccatgaaccacagtgaa

SEQ ID NO: 153325 - DNA, 22 bp, Artificial Sequence
  Synthetic oligonucleotide; TTT chr11 5169130 5169151 5169135 5169130 -
ccatgaaccacagtgaatatcc

SEQ ID NO: 153326 - DNA, 22 bp, Artificial Sequence
  Synthetic oligonucleotide; TTC chr11 5169129 5169150 5169134 5169129 -
catgaaccacagtgaatatcct

SEQ ID NO: 153327 - DNA, 22 bp, Artificial Sequence
  Synthetic oligonucleotide; CTA chr11 5169106 5169127 5169111 5169106 -
ttaaaccacacagtcttgagtg

SEQ ID NO: 153328 - DNA, 22 bp, Artificial Sequence
  Synthetic oligonucleotide; TTA chr11 5169103 5169124 5169108 5169103 -
aaccacacagtcttgagtgatt

SEQ ID NO: 153329 - DNA, 22 bp, Artificial Sequence
  Synthetic oligonucleotide; CTT chr11 5169089 5169110 5169094 5169089 -
gagtgattatcagccaaccaag

SEQ ID NO: 153330 - DNA, 22 bp, Artificial Sequence
  Synthetic oligonucleotide; TTG chr11 5169088 5169109 5169093 5169088 -
agtgattatcagccaaccaagt

SEQ ID NO: 153331 - DNA, 22 bp, Artificial Sequence
  Synthetic oligonucleotide; TTA chr11 5169080 5169101 5169085 5169080 -
tcagccaaccaagtaactaata

SEQ ID NO: 153332 - DNA, 22 bp, Artificial Sequence
  Synthetic oligonucleotide; CTA chr11 5169061 5169082 5169066 5169061 -
atagaaggtttggtcaaataaa

SEQ ID NO: 153333 - DNA, 22 bp, Artificial Sequence
  Synthetic oligonucleotide; TTT chr11 5169050 5169071 5169055 5169050 -
ggtcaaataaaaatatgtatca

SEQ ID NO: 153334 - DNA, 22 bp, Artificial Sequence
  Synthetic oligonucleotide; TTG chr11 5169049 5169070 5169054 5169049 -
gtcaaataaaaatatgtatcaa

SEQ ID NO: 153335 - DNA, 22 bp, Artificial Sequence
  Synthetic oligonucleotide; TTT chr11 5169008 5169029 5169013 5169008 -
atatttttttctgttttcctcg

SEQ ID NO: 153336 - DNA, 22 bp, Artificial Sequence
  Synthetic oligonucleotide; TTA chr11 5169007 5169028 5169012 5169007 -
tatttttttctgttttcctcga

SEQ ID NO: 153337 - DNA, 22 bp, Artificial Sequence
  Synthetic oligonucleotide; TTT chr11 5169002 5169023 5169007 5169002 -
ttttctgttttcctcgaaatta

SEQ ID NO: 153338 - DNA, 22 bp, Artificial Sequence
  Synthetic oligonucleotide; TTT chr11 5169001 5169022 5169006 5169001 -
tttctgttttcctcgaaattaa

SEQ ID NO: 153339 - DNA, 22 bp, Artificial Sequence
  Synthetic oligonucleotide; TTT chr11 5169000 5169021 5169005 5169000 -
ttctgttttcctcgaaattaat

SEQ ID NO: 153340 - DNA, 22 bp, Artificial Sequence
  Synthetic oligonucleotide; TTT chr11 5168999 5169020 5169004 5168999 -
tctgttttcctcgaaattaatt

SEQ ID NO: 153341 - DNA, 22 bp, Artificial Sequence
  Synthetic oligonucleotide; TTT chr11 5168998 5169019 5169003 5168998 -
ctgttttcctcgaaattaattt

SEQ ID NO: 153342 - DNA, 22 bp, Artificial Sequence
  Synthetic oligonucleotide; TTC chr11 5168997 5169018 5169002 5168997 -
tgttttcctcgaaattaattta

SEQ ID NO: 153343 - DNA, 22 bp, Artificial Sequence
  Synthetic oligonucleotide; CTG chr11 5168995 5169016 5169000 5168995 -
ttttcctcgaaattaatttatg

SEQ ID NO: 153344 - DNA, 22 bp, Artificial Sequence
  Synthetic oligonucleotide; TTT chr11 5168992 5169013 5168997 5168992 -
tcctcgaaattaatttatggac

SEQ ID NO: 153345 - DNA, 22 bp, Artificial Sequence
  Synthetic oligonucleotide; TTT chr11 5168991 5169012 5168996 5168991 -
cctcgaaattaatttatggact

SEQ ID NO: 153346 - DNA, 22 bp, Artificial Sequence
  Synthetic oligonucleotide; TTC chr11 5168990 5169011 5168995 5168990 -
ctcgaaattaatttatggactt

SEQ ID NO: 153347 - DNA, 22 bp, Artificial Sequence
  Synthetic oligonucleotide; CTC chr11 5168987 5169008 5168992 5168987 -
gaaattaatttatggacttaaa

SEQ ID NO: 153348 - DNA, 22 bp, Artificial Sequence
  Synthetic oligonucleotide; TTA chr11 5168980 5169001 5168985 5168980 -
atttatggacttaaaaaatttt

SEQ ID NO: 153349 - DNA, 22 bp, Artificial Sequence
  Synthetic oligonucleotide; TTT chr11 5168976 5168997 5168981 5168976 -
atggacttaaaaaatttttaat

SEQ ID NO: 153350 - DNA, 22 bp, Artificial Sequence
  Synthetic oligonucleotide; TTA chr11 5168975 5168996 5168980 5168975 -
tggacttaaaaaatttttaatg

SEQ ID NO: 153351 - DNA, 22 bp, Artificial Sequence
  Synthetic oligonucleotide; CTT chr11 5168968 5168989 5168973 5168968 -
aaaaaatttttaatgtatgaaa

SEQ ID NO: 153352 - DNA, 22 bp, Artificial Sequence
  Synthetic oligonucleotide; TTA chr11 5168967 5168988 5168972 5168967 -
aaaaatttttaatgtatgaaac

SEQ ID NO: 153353 - DNA, 22 bp, Artificial Sequence
  Synthetic oligonucleotide; TTT chr11 5168959 5168980 5168964 5168959 -
ttaatgtatgaaacacctttga

SEQ ID NO: 153354 - DNA, 22 bp, Artificial Sequence
  Synthetic oligonucleotide; TTT chr11 5168958 5168979 5168963 5168958 -
taatgtatgaaacacctttgaa

SEQ ID NO: 153355 - DNA, 22 bp, Artificial Sequence
  Synthetic oligonucleotide; TTT chr11 5168957 5168978 5168962 5168957 -
aatgtatgaaacacctttgaaa

SEQ ID NO: 153356 - DNA, 22 bp, Artificial Sequence
  Synthetic oligonucleotide; TTA chr11 5168956 5168977 5168961 5168956 -
atgtatgaaacacctttgaaag

SEQ ID NO: 153357 - DNA, 22 bp, Artificial Sequence
  Synthetic oligonucleotide; CTT chr11 5168940 5168961 5168945 5168940 -
tgaaagtgttcaatgtagtgaa

SEQ ID NO: 153358 - DNA, 22 bp, Artificial Sequence
  Synthetic oligonucleotide; TTT chr11 5168939 5168960 5168944 5168939 -
gaaagtgttcaatgtagtgaag

SEQ ID NO: 153359 - DNA, 22 bp, Artificial Sequence
  Synthetic oligonucleotide; TTG chr11 5168938 5168959 5168943 5168938 -
aaagtgttcaatgtagtgaagt

SEQ ID NO: 153360 - DNA, 22 bp, Artificial Sequence
  Synthetic oligonucleotide; TTC chr11 5168929 5168950 5168934 5168929 -
aatgtagtgaagtcataaaaac

SEQ ID NO: 153361 - DNA, 22 bp, Artificial Sequence
  Synthetic oligonucleotide; TTT chr11 5168895 5168916 5168900 5168895 -
aaaaaaaaattctcaaaatttc

SEQ ID NO: 153362 - DNA, 22 bp, Artificial Sequence
  Synthetic oligonucleotide; TTA chr11 5168894 5168915 5168899 5168894 -
aaaaaaaattctcaaaatttca

SEQ ID NO: 153363 - DNA, 22 bp, Artificial Sequence
  Synthetic oligonucleotide; TTC chr11 5168883 5168904 5168888 5168883 -
tcaaaatttcagagtaatttag

SEQ ID NO: 153364 - DNA, 22 bp, Artificial Sequence
  Synthetic oligonucleotide; CTC chr11 5168881 5168902 5168886 5168881 -
aaaatttcagagtaatttagaa

SEQ ID NO: 153365 - DNA, 22 bp, Artificial Sequence
  Synthetic oligonucleotide; TTT chr11 5168874 5168895 5168879 5168874 -
cagagtaatttagaagcccttc

SEQ ID NO: 153366 - DNA, 22 bp, Artificial Sequence
  Synthetic oligonucleotide; TTC chr11 5168873 5168894 5168878 5168873 -
agagtaatttagaagcccttcc

SEQ ID NO: 153367 - DNA, 22 bp, Artificial Sequence
  Synthetic oligonucleotide; TTT chr11 5168863 5168884 5168868 5168863 -
agaagcccttccttaacaataa

SEQ ID NO: 153368 - DNA, 22 bp, Artificial Sequence
  Synthetic oligonucleotide; TTA chr11 5168862 5168883 5168867 5168862 -
gaagcccttccttaacaataat

SEQ ID NO: 153369 - DNA, 22 bp, Artificial Sequence
  Synthetic oligonucleotide; CTT chr11 5168853 5168874 5168858 5168853 -
ccttaacaataattattggtaa

SEQ ID NO: 153370 - DNA, 22 bp, Artificial Sequence
  Synthetic oligonucleotide; TTC chr11 5168852 5168873 5168857 5168852 -
cttaacaataattattggtaac

SEQ ID NO: 153371 - DNA, 22 bp, Artificial Sequence
  Synthetic oligonucleotide; CTT chr11 5168849 5168870 5168854 5168849 -
aacaataattattggtaacctc

SEQ ID NO: 153372 - DNA, 22 bp, Artificial Sequence
  Synthetic oligonucleotide; TTA chr11 5168848 5168869 5168853 5168848 -
acaataattattggtaacctcc

SEQ ID NO: 153373 - DNA, 22 bp, Artificial Sequence
  Synthetic oligonucleotide; TTA chr11 5168838 5168859 5168843 5168838 -
ttggtaacctccattacagtcc

SEQ ID NO: 153374 - DNA, 22 bp, Artificial Sequence
  Synthetic oligonucleotide; TTG chr11 5168835 5168856 5168840 5168835 -
gtaacctccattacagtcctgt

SEQ ID NO: 153375 - DNA, 22 bp, Artificial Sequence
  Synthetic oligonucleotide; CTC chr11 5168827 5168848 5168832 5168827 -
cattacagtcctgtattactat

SEQ ID NO: 153376 - DNA, 22 bp, Artificial Sequence
  Synthetic oligonucleotide; TTA chr11 5168822 5168843 5168827 5168822 -
cagtcctgtattactattctta

SEQ ID NO: 153377 - DNA, 22 bp, Artificial Sequence
  Synthetic oligonucleotide; CTG chr11 5168814 5168835 5168819 5168814 -
tattactattcttatggtatac

SEQ ID NO: 153378 - DNA, 22 bp, Artificial Sequence
  Synthetic oligonucleotide; TTA chr11 5168809 5168830 5168814 5168809 -
ctattcttatggtatacatgaa

SEQ ID NO: 153379 - DNA, 22 bp, Artificial Sequence
  Synthetic oligonucleotide; CTA chr11 5168806 5168827 5168811 5168806 -
ttcttatggtatacatgaaaaa

SEQ ID NO: 153380 - DNA, 22 bp, Artificial Sequence
  Synthetic oligonucleotide; TTC chr11 5168803 5168824 5168808 5168803 -
ttatggtatacatgaaaaaact

SEQ ID NO: 153381 - DNA, 22 bp, Artificial Sequence
  Synthetic oligonucleotide; CTT chr11 5168801 5168822 5168806 5168801 -
atggtatacatgaaaaaactaa

SEQ ID NO: 153382 - DNA, 22 bp, Artificial Sequence
  Synthetic oligonucleotide; TTA chr11 5168800 5168821 5168805 5168800 -
tggtatacatgaaaaaactaag

SEQ ID NO: 153383 - DNA, 22 bp, Artificial Sequence
  Synthetic oligonucleotide; CTA chr11 5168780 5168801 5168785 5168780 -
agagataatttttgtaacttta

SEQ ID NO: 153384 - DNA, 22 bp, Artificial Sequence
  Synthetic oligonucleotide; TTT chr11 5168769 5168790 5168774 5168769 -
ttgtaactttatcaagttcaca

SEQ ID NO: 153385 - DNA, 22 bp, Artificial Sequence
  Synthetic oligonucleotide; TTT chr11 5168768 5168789 5168773 5168768 -
tgtaactttatcaagttcacac

SEQ ID NO: 153386 - DNA, 22 bp, Artificial Sequence
  Synthetic oligonucleotide; TTT chr11 5168767 5168788 5168772 5168767 -
gtaactttatcaagttcacaca

SEQ ID NO: 153387 - DNA, 22 bp, Artificial Sequence
  Synthetic oligonucleotide; TTG chr11 5168766 5168787 5168771 5168766 -
taactttatcaagttcacacaa

SEQ ID NO: 153388 - DNA, 22 bp, Artificial Sequence
  Synthetic oligonucleotide; CTT chr11 5168760 5168781 5168765 5168760 -
tatcaagttcacacaatggaaa

SEQ ID NO: 153389 - DNA, 22 bp, Artificial Sequence
  Synthetic oligonucleotide; TTT chr11 5168759 5168780 5168764 5168759 -
atcaagttcacacaatggaaaa

SEQ ID NO: 153390 - DNA, 22 bp, Artificial Sequence
  Synthetic oligonucleotide; TTA chr11 5168758 5168779 5168763 5168758 -
tcaagttcacacaatggaaaac

SEQ ID NO: 153391 - DNA, 22 bp, Artificial Sequence
  Synthetic oligonucleotide; TTC chr11 5168750 5168771 5168755 5168750 -
acacaatggaaaacttgtacac

SEQ ID NO: 153392 - DNA, 22 bp, Artificial Sequence
  Synthetic oligonucleotide; CTT chr11 5168734 5168755 5168739 5168734 -
gtacacccaagagccaagtcct

SEQ ID NO: 153393 - DNA, 22 bp, Artificial Sequence
  Synthetic oligonucleotide; TTG chr11 5168733 5168754 5168738 5168733 -
tacacccaagagccaagtcctc

SEQ ID NO: 153394 - DNA, 22 bp, Artificial Sequence
  Synthetic oligonucleotide; CTC chr11 5168711 5168732 5168716 5168711 -
agtgtgatgttatacacttgaa

SEQ ID NO: 153395 - DNA, 22 bp, Artificial Sequence
  Synthetic oligonucleotide; TTA chr11 5168699 5168720 5168704 5168699 -
tacacttgaaccagatgtacct

SEQ ID NO: 153396 - DNA, 22 bp, Artificial Sequence
  Synthetic oligonucleotide; CTT chr11 5168692 5168713 5168697 5168692 -
gaaccagatgtacctaggttga

SEQ ID NO: 153397 - DNA, 22 bp, Artificial Sequence
  Synthetic oligonucleotide; TTG chr11 5168691 5168712 5168696 5168691 -
aaccagatgtacctaggttgaa

SEQ ID NO: 153398 - DNA, 22 bp, Artificial Sequence
  Synthetic oligonucleotide; CTA chr11 5168676 5168697 5168681 5168676 -
ggttgaaatcttagctatcttg

SEQ ID NO: 153399 - DNA, 22 bp, Artificial Sequence
  Synthetic oligonucleotide; TTG chr11 5168671 5168692 5168676 5168671 -
aaatcttagctatcttgctatt

SEQ ID NO: 153400 - DNA, 22 bp, Artificial Sequence
  Synthetic oligonucleotide; CTT chr11 5168664 5168685 5168669 5168664 -
agctatcttgctattagtaatt

SEQ ID NO: 153401 - DNA, 22 bp, Artificial Sequence
  Synthetic oligonucleotide; TTA chr11 5168663 5168684 5168668 5168663 -
gctatcttgctattagtaattg

SEQ ID NO: 153402 - DNA, 22 bp, Artificial Sequence
  Synthetic oligonucleotide; CTA chr11 5168659 5168680 5168664 5168659 -
tcttgctattagtaattgtggg

SEQ ID NO: 153403 - DNA, 22 bp, Artificial Sequence
  Synthetic oligonucleotide; CTT chr11 5168655 5168676 5168660 5168655 -
gctattagtaattgtgggatct

SEQ ID NO: 153404 - DNA, 22 bp, Artificial Sequence
  Synthetic oligonucleotide; TTG chr11 5168654 5168675 5168659 5168654 -
ctattagtaattgtgggatctt

SEQ ID NO: 153405 - DNA, 22 bp, Artificial Sequence
  Synthetic oligonucleotide; CTA chr11 5168651 5168672 5168656 5168651 -
ttagtaattgtgggatcttgct

SEQ ID NO: 153406 - DNA, 22 bp, Artificial Sequence
  Synthetic oligonucleotide; TTA chr11 5168648 5168669 5168653 5168648 -
gtaattgtgggatcttgctagt

SEQ ID NO: 153407 - DNA, 22 bp, Artificial Sequence
  Synthetic oligonucleotide; TTG chr11 5168641 5168662 5168646 5168641 -
tgggatcttgctagtagtatga

SEQ ID NO: 153408 - DNA, 22 bp, Artificial Sequence
  Synthetic oligonucleotide; CTT chr11 5168632 5168653 5168637 5168632 -
gctagtagtatgacctgtttga

SEQ ID NO: 153409 - DNA, 22 bp, Artificial Sequence
  Synthetic oligonucleotide; TTG chr11 5168631 5168652 5168636 5168631 -
ctagtagtatgacctgtttgaa

SEQ ID NO: 153410 - DNA, 22 bp, Artificial Sequence
  Synthetic oligonucleotide; CTA chr11 5168628 5168649 5168633 5168628 -
gtagtatgacctgtttgaatat

SEQ ID NO: 153411 - DNA, 22 bp, Artificial Sequence
  Synthetic oligonucleotide; CTG chr11 5168615 5168636 5168620 5168615 -
tttgaatataatttattcattt

SEQ ID NO: 153412 - DNA, 22 bp, Artificial Sequence
  Synthetic oligonucleotide; TTT chr11 5168612 5168633 5168617 5168612 -
gaatataatttattcatttata

SEQ ID NO: 153413 - DNA, 22 bp, Artificial Sequence
  Synthetic oligonucleotide; TTG chr11 5168611 5168632 5168616 5168611 -
aatataatttattcatttataa

SEQ ID NO: 153414 - DNA, 22 bp, Artificial Sequence
  Synthetic oligonucleotide; TTT chr11 5168601 5168622 5168606 5168601 -
attcatttataaatgaataaga

SEQ ID NO: 153415 - DNA, 22 bp, Artificial Sequence
  Synthetic oligonucleotide; TTA chr11 5168600 5168621 5168605 5168600 -
ttcatttataaatgaataagaa

SEQ ID NO: 153416 - DNA, 22 bp, Artificial Sequence
  Synthetic oligonucleotide; TTC chr11 5168597 5168618 5168602 5168597 -
atttataaatgaataagaaaat

SEQ ID NO: 153417 - DNA, 22 bp, Artificial Sequence
  Synthetic oligonucleotide; TTT chr11 5168593 5168614 5168598 5168593 -
ataaatgaataagaaaataaaa

SEQ ID NO: 153418 - DNA, 22 bp, Artificial Sequence
  Synthetic oligonucleotide; TTA chr11 5168592 5168613 5168597 5168592 -
taaatgaataagaaaataaaat

SEQ ID NO: 153419 - DNA, 22 bp, Artificial Sequence
  Synthetic oligonucleotide; CTT chr11 5168563 5168584 5168568 5168563 -
ttatgatcttgaagattaaatg

SEQ ID NO: 153420 - DNA, 22 bp, Artificial Sequence
  Synthetic oligonucleotide; TTT chr11 5168562 5168583 5168567 5168562 -
tatgatcttgaagattaaatga

SEQ ID NO: 153421 - DNA, 22 bp, Artificial Sequence
  Synthetic oligonucleotide; TTT chr11 5168561 5168582 5168566 5168561 -
atgatcttgaagattaaatgaa

SEQ ID NO: 153422 - DNA, 22 bp, Artificial Sequence
  Synthetic oligonucleotide; TTA chr11 5168560 5168581 5168565 5168560 -
tgatcttgaagattaaatgaaa

SEQ ID NO: 153423 - DNA, 22 bp, Artificial Sequence
  Synthetic oligonucleotide; CTT chr11 5168553 5168574 5168558 5168553 -
gaagattaaatgaaatggtgca

SEQ ID NO: 153424 - DNA, 22 bp, Artificial Sequence
  Synthetic oligonucleotide; TTG chr11 5168552 5168573 5168557 5168552 -
aagattaaatgaaatggtgcac

SEQ ID NO: 153425 - DNA, 22 bp, Artificial Sequence
  Synthetic oligonucleotide; TTA chr11 5168545 5168566 5168550 5168545 -
aatgaaatggtgcacattaagc

SEQ ID NO: 153426 - DNA, 22 bp, Artificial Sequence
  Synthetic oligonucleotide; TTA chr11 5168526 5168547 5168531 5168526 -
agcaattagcaaagttcctagt

SEQ ID NO: 153427 - DNA, 22 bp, Artificial Sequence
  Synthetic oligonucleotide; TTA chr11 5168518 5168539 5168523 5168518 -
gcaaagttcctagtaaaatttg

SEQ ID NO: 153428 - DNA, 22 bp, Artificial Sequence
  Synthetic oligonucleotide; TTC chr11 5168509 5168530 5168514 5168509 -
ctagtaaaatttgctcaataag

SEQ ID NO: 153429 - DNA, 22 bp, Artificial Sequence
  Synthetic oligonucleotide; CTA chr11 5168506 5168527 5168511 5168506 -
gtaaaatttgctcaataagtaa

SEQ ID NO: 153430 - DNA, 22 bp, Artificial Sequence
  Synthetic oligonucleotide; TTT chr11 5168497 5168518 5168502 5168497 -
gctcaataagtaattatatttt

SEQ ID NO: 153431 - DNA, 22 bp, Artificial Sequence
  Synthetic oligonucleotide; TTG chr11 5168496 5168517 5168501 5168496 -
ctcaataagtaattatatttta

SEQ ID NO: 153432 - DNA, 22 bp, Artificial Sequence
  Synthetic oligonucleotide; CTC chr11 5168493 5168514 5168498 5168493 -
aataagtaattatattttatta

SEQ ID NO: 153433 - DNA, 22 bp, Artificial Sequence
  Synthetic oligonucleotide; TTA chr11 5168481 5168502 5168486 5168481 -
tattttattaagtaattacttt

SEQ ID NO: 153434 - DNA, 22 bp, Artificial Sequence
  Synthetic oligonucleotide; TTT chr11 5168476 5168497 5168481 5168476 -
tattaagtaattactttttcac

SEQ ID NO: 153435 - DNA, 22 bp, Artificial Sequence
  Synthetic oligonucleotide; TTT chr11 5168475 5168496 5168480 5168475 -
attaagtaattactttttcacc

SEQ ID NO: 153436 - DNA, 22 bp, Artificial Sequence
  Synthetic oligonucleotide; TTA chr11 5168474 5168495 5168479 5168474 -
ttaagtaattactttttcacca

SEQ ID NO: 153437 - DNA, 22 bp, Artificial Sequence
  Synthetic oligonucleotide; TTA chr11 5168471 5168492 5168476 5168471 -
agtaattactttttcaccaaat

SEQ ID NO: 153438 - DNA, 22 bp, Artificial Sequence
  Synthetic oligonucleotide; TTA chr11 5168463 5168484 5168468 5168463 -
ctttttcaccaaatctgactac

SEQ ID NO: 153439 - DNA, 22 bp, Artificial Sequence
  Synthetic oligonucleotide; CTT chr11 5168460 5168481 5168465 5168460 -
tttcaccaaatctgactacaat

SEQ ID NO: 153440 - DNA, 22 bp, Artificial Sequence
  Synthetic oligonucleotide; TTT chr11 5168459 5168480 5168464 5168459 -
ttcaccaaatctgactacaata

SEQ ID NO: 153441 - DNA, 22 bp, Artificial Sequence
  Synthetic oligonucleotide; TTT chr11 5168458 5168479 5168463 5168458 -
tcaccaaatctgactacaatac

SEQ ID NO: 153442 - DNA, 22 bp, Artificial Sequence
  Synthetic oligonucleotide; TTT chr11 5168457 5168478 5168462 5168457 -
caccaaatctgactacaatacg

SEQ ID NO: 153443 - DNA, 22 bp, Artificial Sequence
  Synthetic oligonucleotide; TTC chr11 5168456 5168477 5168461 5168456 -
accaaatctgactacaatacgt

SEQ ID NO: 153444 - DNA, 22 bp, Artificial Sequence
  Synthetic oligonucleotide; CTG chr11 5168446 5168467 5168451 5168446 -
actacaatacgtgaatacacag

SEQ ID NO: 153445 - DNA, 22 bp, Artificial Sequence
  Synthetic oligonucleotide; CTA chr11 5168442 5168463 5168447 5168442 -
caatacgtgaatacacagtcaa

SEQ ID NO: 153446 - DNA, 22 bp, Artificial Sequence
  Synthetic oligonucleotide; TTT chr11 5168416 5168437 5168421 5168416 -
cacaattcctgacagtctctct

SEQ ID NO: 153447 - DNA, 22 bp, Artificial Sequence
  Synthetic oligonucleotide; TTC chr11 5168415 5168436 5168420 5168415 -
acaattcctgacagtctctcta

SEQ ID NO: 153448 - DNA, 22 bp, Artificial Sequence
  Synthetic oligonucleotide; TTC chr11 5168408 5168429 5168413 5168408 -
ctgacagtctctctaaatgcta

SEQ ID NO: 153449 - DNA, 22 bp, Artificial Sequence
  Synthetic oligonucleotide; CTG chr11 5168405 5168426 5168410 5168405 -
acagtctctctaaatgctaatt

SEQ ID NO: 153450 - DNA, 22 bp, Artificial Sequence
  Synthetic oligonucleotide; CTC chr11 5168397 5168418 5168402 5168397 -
tctaaatgctaattttaaactc

SEQ ID NO: 153451 - DNA, 22 bp, Artificial Sequence
  Synthetic oligonucleotide; CTC chr11 5168395 5168416 5168400 5168395 -
taaatgctaattttaaactcaa

SEQ ID NO: 153452 - DNA, 22 bp, Artificial Sequence
  Synthetic oligonucleotide; CTA chr11 5168393 5168414 5168398 5168393 -
aatgctaattttaaactcaagt

SEQ ID NO: 153453 - DNA, 22 bp, Artificial Sequence
  Synthetic oligonucleotide; CTA chr11 5168386 5168407 5168391 5168386 -
attttaaactcaagtacataaa

SEQ ID NO: 153454 - DNA, 22 bp, Artificial Sequence
  Synthetic oligonucleotide; TTT chr11 5168382 5168403 5168387 5168382 -
taaactcaagtacataaaaatt

SEQ ID NO: 153455 - DNA, 22 bp, Artificial Sequence
  Synthetic oligonucleotide; TTT chr11 5168381 5168402 5168386 5168381 -
aaactcaagtacataaaaatta

SEQ ID NO: 153456 - DNA, 22 bp, Artificial Sequence
  Synthetic oligonucleotide; TTA chr11 5168380 5168401 5168385 5168380 -
aactcaagtacataaaaattaa

SEQ ID NO: 153457 - DNA, 22 bp, Artificial Sequence
  Synthetic oligonucleotide; CTC chr11 5168375 5168396 5168380 5168375 -
aagtacataaaaattaaagtca

SEQ ID NO: 153458 - DNA, 22 bp, Artificial Sequence
  Synthetic oligonucleotide; TTA chr11 5168359 5168380 5168364 5168359 -
aagtcacaaatttctctgtcac

SEQ ID NO: 153459 - DNA, 22 bp, Artificial Sequence
  Synthetic oligonucleotide; TTT chr11 5168346 5168367 5168351 5168346 -
ctctgtcacgagctatagtgta

SEQ ID NO: 153460 - DNA, 22 bp, Artificial Sequence
  Synthetic oligonucleotide; TTC chr11 5168345 5168366 5168350 5168345 -
tctgtcacgagctatagtgtac

SEQ ID NO: 153461 - DNA, 22 bp, Artificial Sequence
  Synthetic oligonucleotide; CTC chr11 5168343 5168364 5168348 5168343 -
tgtcacgagctatagtgtacca

SEQ ID NO: 153462 - DNA, 22 bp, Artificial Sequence
  Synthetic oligonucleotide; CTG chr11 5168341 5168362 5168346 5168341 -
tcacgagctatagtgtaccata

SEQ ID NO: 153463 - DNA, 22 bp, Artificial Sequence
  Synthetic oligonucleotide; CTA chr11 5168331 5168352 5168336 5168331 -
tagtgtaccatactaagtgatt

SEQ ID NO: 153464 - DNA, 22 bp, Artificial Sequence
  Synthetic oligonucleotide; CTA chr11 5168316 5168337 5168321 5168316 -
agtgatttatatagattagttc

SEQ ID NO: 153465 - DNA, 22 bp, Artificial Sequence
  Synthetic oligonucleotide; TTT chr11 5168308 5168329 5168313 5168308 -
atatagattagttcatttaatc

SEQ ID NO: 153466 - DNA, 22 bp, Artificial Sequence
  Synthetic oligonucleotide; TTA chr11 5168307 5168328 5168312 5168307 -
tatagattagttcatttaatcc

SEQ ID NO: 153467 - DNA, 22 bp, Artificial Sequence
  Synthetic oligonucleotide; TTA chr11 5168298 5168319 5168303 5168298 -
gttcatttaatccacggaacaa

SEQ ID NO: 153468 - DNA, 22 bp, Artificial Sequence
  Synthetic oligonucleotide; TTC chr11 5168294 5168315 5168299 5168294 -
atttaatccacggaacaaatat

SEQ ID NO: 153469 - DNA, 22 bp, Artificial Sequence
  Synthetic oligonucleotide; TTT chr11 5168290 5168311 5168295 5168290 -
aatccacggaacaaatatatga

SEQ ID NO: 153470 - DNA, 22 bp, Artificial Sequence
  Synthetic oligonucleotide; TTA chr11 5168289 5168310 5168294 5168289 -
atccacggaacaaatatatgaa

SEQ ID NO: 153471 - DNA, 22 bp, Artificial Sequence
  Synthetic oligonucleotide; TTA chr11 5168260 5168281 5168265 5168260 -
tcagtttgtctacatgttacaa

SEQ ID NO: 153472 - DNA, 22 bp, Artificial Sequence
  Synthetic oligonucleotide; TTT chr11 5168253 5168274 5168258 5168253 -
gtctacatgttacaaatgtaga

SEQ ID NO: 153473 - DNA, 22 bp, Artificial Sequence
  Synthetic oligonucleotide; TTG chr11 5168252 5168273 5168257 5168252 -
tctacatgttacaaatgtagaa

SEQ ID NO: 153474 - DNA, 22 bp, Artificial Sequence
  Synthetic oligonucleotide; CTA chr11 5168248 5168269 5168253 5168248 -
catgttacaaatgtagaaacag

SEQ ID NO: 153475 - DNA, 22 bp, Artificial Sequence
  Synthetic oligonucleotide; TTA chr11 5168241 5168262 5168246 5168241 -
caaatgtagaaacagaaacata

SEQ ID NO: 153476 - DNA, 22 bp, Artificial Sequence
  Synthetic oligonucleotide; TTA chr11 5168182 5168203 5168187 5168182 -
ataagtggcagaatcacaactc

SEQ ID NO: 153477 - DNA, 22 bp, Artificial Sequence
  Synthetic oligonucleotide; CTC chr11 5168160 5168181 5168165 5168160 -
aaaaccagacaatccaactaaa

SEQ ID NO: 153478 - DNA, 22 bp, Artificial Sequence
  Synthetic oligonucleotide; CTA chr11 5168140 5168161 5168145 5168140 -
aaaacctgattctttagcccac

SEQ ID NO: 153479 - DNA, 22 bp, Artificial Sequence
  Synthetic oligonucleotide; CTG chr11 5168132 5168153 5168137 5168132 -
attctttagcccaccatattat

SEQ ID NO: 153480 - DNA, 22 bp, Artificial Sequence
  Synthetic oligonucleotide; TTC chr11 5168128 5168149 5168133 5168128 -
tttagcccaccatattatcagt

SEQ ID NO: 153481 - DNA, 22 bp, Artificial Sequence
  Synthetic oligonucleotide; CTT chr11 5168126 5168147 5168131 5168126 -
tagcccaccatattatcagtgg

SEQ ID NO: 153482 - DNA, 22 bp, Artificial Sequence
  Synthetic oligonucleotide; TTT chr11 5168125 5168146 5168130 5168125 -
agcccaccatattatcagtggt

SEQ ID NO: 153483 - DNA, 22 bp, Artificial Sequence
  Synthetic oligonucleotide; TTA chr11 5168124 5168145 5168129 5168124 -
gcccaccatattatcagtggtc

SEQ ID NO: 153484 - DNA, 22 bp, Artificial Sequence
  Synthetic oligonucleotide; TTA chr11 5168111 5168132 5168116 5168111 -
tcagtggtcccataacttaaaa

SEQ ID NO: 153485 - DNA, 22 bp, Artificial Sequence
  Synthetic oligonucleotide; CTT chr11 5168093 5168114 5168098 5168093 -
aaaattcagatttgactttaaa

SEQ ID NO: 153486 - DNA, 22 bp, Artificial Sequence
  Synthetic oligonucleotide; TTA chr11 5168092 5168113 5168097 5168092 -
aaattcagatttgactttaaaa

SEQ ID NO: 153487 - DNA, 22 bp, Artificial Sequence
  Synthetic oligonucleotide; TTC chr11 5168086 5168107 5168091 5168086 -
agatttgactttaaaattggaa

SEQ ID NO: 153488 - DNA, 22 bp, Artificial Sequence
  Synthetic oligonucleotide; TTT chr11 5168080 5168101 5168085 5168080 -
gactttaaaattggaatctgaa

SEQ ID NO: 153489 - DNA, 22 bp, Artificial Sequence
  Synthetic oligonucleotide; TTG chr11 5168079 5168100 5168084 5168079 -
actttaaaattggaatctgaag

SEQ ID NO: 153490 - DNA, 22 bp, Artificial Sequence
  Synthetic oligonucleotide; CTT chr11 5168075 5168096 5168080 5168075 -
taaaattggaatctgaagaaca

SEQ ID NO: 153491 - DNA, 22 bp, Artificial Sequence
  Synthetic oligonucleotide; TTT chr11 5168074 5168095 5168079 5168074 -
aaaattggaatctgaagaacac

SEQ ID NO: 153492 - DNA, 22 bp, Artificial Sequence
  Synthetic oligonucleotide; TTA chr11 5168073 5168094 5168078 5168073 -
aaattggaatctgaagaacacc

SEQ ID NO: 153493 - DNA, 22 bp, Artificial Sequence
  Synthetic oligonucleotide; TTG chr11 5168067 5168088 5168072 5168067 -
gaatctgaagaacaccaagcaa

SEQ ID NO: 153494 - DNA, 22 bp, Artificial Sequence
  Synthetic oligonucleotide; CTG chr11 5168060 5168081 5168065 5168060 -
aagaacaccaagcaattctgta

SEQ ID NO: 153495 - DNA, 22 bp, Artificial Sequence
  Synthetic oligonucleotide; TTC chr11 5168042 5168063 5168047 5168042 -
tgtaaaccattttctcctttga

SEQ ID NO: 153496 - DNA, 22 bp, Artificial Sequence
  Synthetic oligonucleotide; CTG chr11 5168040 5168061 5168045 5168040 -
taaaccattttctcctttgaga

SEQ ID NO: 153497 - DNA, 22 bp, Artificial Sequence
  Synthetic oligonucleotide; TTT chr11 5168030 5168051 5168035 5168030 -
tctcctttgagattcatgagga

SEQ ID NO: 153498 - DNA, 22 bp, Artificial Sequence
  Synthetic oligonucleotide; TTT chr11 5168029 5168050 5168034 5168029 -
ctcctttgagattcatgaggac

SEQ ID NO: 153499 - DNA, 22 bp, Artificial Sequence
  Synthetic oligonucleotide; TTC chr11 5168028 5168049 5168033 5168028 -
tcctttgagattcatgaggaca

SEQ ID NO: 153500 - DNA, 22 bp, Artificial Sequence
  Synthetic oligonucleotide; CTC chr11 5168026 5168047 5168031 5168026 -
ctttgagattcatgaggacaaa

SEQ ID NO: 153501 - DNA, 22 bp, Artificial Sequence
  Synthetic oligonucleotide; CTT chr11 5168023 5168044 5168028 5168023 -
tgagattcatgaggacaaaatt

SEQ ID NO: 153502 - DNA, 22 bp, Artificial Sequence
  Synthetic oligonucleotide; TTT chr11 5168022 5168043 5168027 5168022 -
gagattcatgaggacaaaattc

SEQ ID NO: 153503 - DNA, 22 bp, Artificial Sequence
  Synthetic oligonucleotide; TTG chr11 5168021 5168042 5168026 5168021 -
agattcatgaggacaaaattca

SEQ ID NO: 153504 - DNA, 22 bp, Artificial Sequence
  Synthetic oligonucleotide; TTC chr11 5168015 5168036 5168020 5168015 -
atgaggacaaaattcactcacc

SEQ ID NO: 153505 - DNA, 22 bp, Artificial Sequence
  Synthetic oligonucleotide; TTC chr11 5168000 5168021 5168005 5168000 -
actcacctctgtttcctctaat

SEQ ID NO: 153506 - DNA, 22 bp, Artificial Sequence
  Synthetic oligonucleotide; CTC chr11 5167996 5168017 5168001 5167996 -
acctctgtttcctctaattata

SEQ ID NO: 153507 - DNA, 22 bp, Artificial Sequence
  Synthetic oligonucleotide; CTC chr11 5167991 5168012 5167996 5167991 -
tgtttcctctaattatagtcat

SEQ ID NO: 153508 - DNA, 22 bp, Artificial Sequence
  Synthetic oligonucleotide; CTG chr11 5167989 5168010 5167994 5167989 -
tttcctctaattatagtcatat

SEQ ID NO: 153509 - DNA, 22 bp, Artificial Sequence
  Synthetic oligonucleotide; TTT chr11 5167986 5168007 5167991 5167986 -
cctctaattatagtcatatatt

SEQ ID NO: 153510 - DNA, 22 bp, Artificial Sequence
  Synthetic oligonucleotide; TTC chr11 5167985 5168006 5167990 5167985 -
ctctaattatagtcatatatta

SEQ ID NO: 153511 - DNA, 22 bp, Artificial Sequence
  Synthetic oligonucleotide; CTC chr11 5167982 5168003 5167987 5167982 -
taattatagtcatatattaata

SEQ ID NO: 153512 - DNA, 22 bp, Artificial Sequence
  Synthetic oligonucleotide; CTA chr11 5167980 5168001 5167985 5167980 -
attatagtcatatattaataat

SEQ ID NO: 153513 - DNA, 22 bp, Artificial Sequence
  Synthetic oligonucleotide; TTA chr11 5167976 5167997 5167981 5167976 -
tagtcatatattaataatgtat

SEQ ID NO: 153514 - DNA, 22 bp, Artificial Sequence
  Synthetic oligonucleotide; TTA chr11 5167963 5167984 5167968 5167963 -
ataatgtataaaggttttctca

SEQ ID NO: 153515 - DNA, 22 bp, Artificial Sequence
  Synthetic oligonucleotide; TTT chr11 5167946 5167967 5167951 5167946 -
tctcaagaggatctttataaaa

SEQ ID NO: 153516 - DNA, 22 bp, Artificial Sequence
  Synthetic oligonucleotide; TTT chr11 5167945 5167966 5167950 5167945 -
ctcaagaggatctttataaaag

SEQ ID NO: 153517 - DNA, 22 bp, Artificial Sequence
  Synthetic oligonucleotide; TTC chr11 5167944 5167965 5167949 5167944 -
tcaagaggatctttataaaagg

SEQ ID NO: 153518 - DNA, 22 bp, Artificial Sequence
  Synthetic oligonucleotide; CTC chr11 5167942 5167963 5167947 5167942 -
aagaggatctttataaaagggg

SEQ ID NO: 153519 - DNA, 22 bp, Artificial Sequence
  Synthetic oligonucleotide; CTT chr11 5167931 5167952 5167936 5167931 -
tataaaaggggccttcccacat

SEQ ID NO: 153520 - DNA, 22 bp, Artificial Sequence
  Synthetic oligonucleotide; TTT chr11 5167930 5167951 5167935 5167930 -
ataaaaggggccttcccacatt

SEQ ID NO: 153521 - DNA, 22 bp, Artificial Sequence
  Synthetic oligonucleotide; TTA chr11 5167929 5167950 5167934 5167929 -
taaaaggggccttcccacatta

SEQ ID NO: 153522 - DNA, 22 bp, Artificial Sequence
  Synthetic oligonucleotide; CTT chr11 5167916 5167937 5167921 5167916 -
cccacattagtttaactgctta

SEQ ID NO: 153523 - DNA, 22 bp, Artificial Sequence
  Synthetic oligonucleotide; TTC chr11 5167915 5167936 5167920 5167915 -
ccacattagtttaactgcttag

SEQ ID NO: 153524 - DNA, 22 bp, Artificial Sequence
  Synthetic oligonucleotide; TTA chr11 5167907 5167928 5167912 5167907 -
gtttaactgcttaggtactgat

SEQ ID NO: 153525 - DNA, 22 bp, Artificial Sequence
  Synthetic oligonucleotide; TTT chr11 5167903 5167924 5167908 5167903 -
aactgcttaggtactgattctc

SEQ ID NO: 153526 - DNA, 22 bp, Artificial Sequence
  Synthetic oligonucleotide; TTA chr11 5167902 5167923 5167907 5167902 -
actgcttaggtactgattctct

SEQ ID NO: 153527 - DNA, 22 bp, Artificial Sequence
  Synthetic oligonucleotide; CTG chr11 5167898 5167919 5167903 5167898 -
cttaggtactgattctcttcta

SEQ ID NO: 153528 - DNA, 22 bp, Artificial Sequence
  Synthetic oligonucleotide; CTT chr11 5167895 5167916 5167900 5167895 -
aggtactgattctcttctactt

SEQ ID NO: 153529 - DNA, 22 bp, Artificial Sequence
  Synthetic oligonucleotide; TTA chr11 5167894 5167915 5167899 5167894 -
ggtactgattctcttctacttc

SEQ ID NO: 153530 - DNA, 22 bp, Artificial Sequence
  Synthetic oligonucleotide; CTG chr11 5167887 5167908 5167892 5167887 -
attctcttctacttcctcaacc

SEQ ID NO: 153531 - DNA, 22 bp, Artificial Sequence
  Synthetic oligonucleotide; TTC chr11 5167883 5167904 5167888 5167883 -
tcttctacttcctcaaccaaca

SEQ ID NO: 153532 - DNA, 22 bp, Artificial Sequence
  Synthetic oligonucleotide; CTC chr11 5167881 5167902 5167886 5167881 -
ttctacttcctcaaccaacact

SEQ ID NO: 153533 - DNA, 22 bp, Artificial Sequence
  Synthetic oligonucleotide; CTT chr11 5167879 5167900 5167884 5167879 -
ctacttcctcaaccaacacttt

SEQ ID NO: 153534 - DNA, 22 bp, Artificial Sequence
  Synthetic oligonucleotide; TTC chr11 5167878 5167899 5167883 5167878 -
tacttcctcaaccaacactttt

SEQ ID NO: 153535 - DNA, 22 bp, Artificial Sequence
  Synthetic oligonucleotide; CTA chr11 5167876 5167897 5167881 5167876 -
cttcctcaaccaacacttttag

SEQ ID NO: 153536 - DNA, 22 bp, Artificial Sequence
  Synthetic oligonucleotide; CTT chr11 5167873 5167894 5167878 5167873 -
cctcaaccaacacttttagaac

SEQ ID NO: 153537 - DNA, 22 bp, Artificial Sequence
  Synthetic oligonucleotide; TTC chr11 5167872 5167893 5167877 5167872 -
ctcaaccaacacttttagaact

SEQ ID NO: 153538 - DNA, 22 bp, Artificial Sequence
  Synthetic oligonucleotide; CTC chr11 5167869 5167890 5167874 5167869 -
aaccaacacttttagaactatc

SEQ ID NO: 153539 - DNA, 22 bp, Artificial Sequence
  Synthetic oligonucleotide; CTT chr11 5167858 5167879 5167863 5167858 -
ttagaactatcatctaagatta

SEQ ID NO: 153540 - DNA, 22 bp, Artificial Sequence
  Synthetic oligonucleotide; TTT chr11 5167857 5167878 5167862 5167857 -
tagaactatcatctaagattac

SEQ ID NO: 153541 - DNA, 22 bp, Artificial Sequence
  Synthetic oligonucleotide; TTT chr11 5167856 5167877 5167861 5167856 -
agaactatcatctaagattaca

SEQ ID NO: 153542 - DNA, 22 bp, Artificial Sequence
  Synthetic oligonucleotide; TTA chr11 5167855 5167876 5167860 5167855 -
gaactatcatctaagattacat

SEQ ID NO: 153543 - DNA, 22 bp, Artificial Sequence
  Synthetic oligonucleotide; CTA chr11 5167849 5167870 5167854 5167849 -
tcatctaagattacatcggtca

SEQ ID NO: 153544 - DNA, 22 bp, Artificial Sequence
  Synthetic oligonucleotide; CTA chr11 5167842 5167863 5167847 5167842 -
agattacatcggtcaaattttc

SEQ ID NO: 153545 - DNA, 22 bp, Artificial Sequence
  Synthetic oligonucleotide; TTA chr11 5167836 5167857 5167841 5167836 -
catcggtcaaattttcttatgc

SEQ ID NO: 153546 - DNA, 22 bp, Artificial Sequence
  Synthetic oligonucleotide; TTT chr11 5167822 5167843 5167827 5167822 -
tcttatgcttacaataaataaa

SEQ ID NO: 153547 - DNA, 22 bp, Artificial Sequence
  Synthetic oligonucleotide; TTT chr11 5167821 5167842 5167826 5167821 -
cttatgcttacaataaataaat

SEQ ID NO: 153548 - DNA, 22 bp, Artificial Sequence
  Synthetic oligonucleotide; TTC chr11 5167820 5167841 5167825 5167820 -
ttatgcttacaataaataaata

SEQ ID NO: 153549 - DNA, 22 bp, Artificial Sequence
  Synthetic oligonucleotide; CTT chr11 5167818 5167839 5167823 5167818 -
atgcttacaataaataaatact

SEQ ID NO: 153550 - DNA, 22 bp, Artificial Sequence
  Synthetic oligonucleotide; TTA chr11 5167817 5167838 5167822 5167817 -
tgcttacaataaataaatactt

SEQ ID NO: 153551 - DNA, 22 bp, Artificial Sequence
  Synthetic oligonucleotide; CTT chr11 5167812 5167833 5167817 5167812 -
acaataaataaatactttttaa

SEQ ID NO: 153552 - DNA, 22 bp, Artificial Sequence
  Synthetic oligonucleotide; TTA chr11 5167811 5167832 5167816 5167811 -
caataaataaatactttttaag

SEQ ID NO: 153553 - DNA, 22 bp, Artificial Sequence
  Synthetic oligonucleotide; CTT chr11 5167795 5167816 5167800 5167795 -
tttaagccagcaacttcacttc

SEQ ID NO: 153554 - DNA, 22 bp, Artificial Sequence
  Synthetic oligonucleotide; TTT chr11 5167794 5167815 5167799 5167794 -
ttaagccagcaacttcacttca

SEQ ID NO: 153555 - DNA, 22 bp, Artificial Sequence
  Synthetic oligonucleotide; TTT chr11 5167793 5167814 5167798 5167793 -
taagccagcaacttcacttcac

SEQ ID NO: 153556 - DNA, 22 bp, Artificial Sequence
  Synthetic oligonucleotide; TTT chr11 5167792 5167813 5167797 5167792 -
aagccagcaacttcacttcact

SEQ ID NO: 153557 - DNA, 22 bp, Artificial Sequence
  Synthetic oligonucleotide; TTA chr11 5167791 5167812 5167796 5167791 -
agccagcaacttcacttcactt

SEQ ID NO: 153558 - DNA, 22 bp, Artificial Sequence
  Synthetic oligonucleotide; CTT chr11 5167779 5167800 5167784 5167779 -
cacttcacttactatgttttat

SEQ ID NO: 153559 - DNA, 22 bp, Artificial Sequence
  Synthetic oligonucleotide; TTC chr11 5167778 5167799 5167783 5167778 -
acttcacttactatgttttatt

SEQ ID NO: 153560 - DNA, 22 bp, Artificial Sequence
  Synthetic oligonucleotide; CTT chr11 5167774 5167795 5167779 5167774 -
cacttactatgttttattacat

SEQ ID NO: 153561 - DNA, 22 bp, Artificial Sequence
  Synthetic oligonucleotide; TTC chr11 5167773 5167794 5167778 5167773 -
acttactatgttttattacata

SEQ ID NO: 153562 - DNA, 22 bp, Artificial Sequence
  Synthetic oligonucleotide; CTT chr11 5167769 5167790 5167774 5167769 -
actatgttttattacatattat

SEQ ID NO: 153563 - DNA, 22 bp, Artificial Sequence
  Synthetic oligonucleotide; TTA chr11 5167768 5167789 5167773 5167768 -
ctatgttttattacatattatt

SEQ ID NO: 153564 - DNA, 22 bp, Artificial Sequence
  Synthetic oligonucleotide; CTA chr11 5167765 5167786 5167770 5167765 -
tgttttattacatattattcat

SEQ ID NO: 153565 - DNA, 22 bp, Artificial Sequence
  Synthetic oligonucleotide; TTT chr11 5167760 5167781 5167765 5167760 -
tattacatattattcattctaa

SEQ ID NO: 153566 - DNA, 22 bp, Artificial Sequence
  Synthetic oligonucleotide; TTT chr11 5167759 5167780 5167764 5167759 -
attacatattattcattctaag

SEQ ID NO: 153567 - DNA, 22 bp, Artificial Sequence
  Synthetic oligonucleotide; TTA chr11 5167758 5167779 5167763 5167758 -
ttacatattattcattctaagt

SEQ ID NO: 153568 - DNA, 22 bp, Artificial Sequence
  Synthetic oligonucleotide; TTA chr11 5167755 5167776 5167760 5167755 -
catattattcattctaagtgta

SEQ ID NO: 153569 - DNA, 22 bp, Artificial Sequence
  Synthetic oligonucleotide; TTA chr11 5167748 5167769 5167753 5167748 -
ttcattctaagtgtagtcctag

SEQ ID NO: 153570 - DNA, 22 bp, Artificial Sequence
  Synthetic oligonucleotide; TTC chr11 5167745 5167766 5167750 5167745 -
attctaagtgtagtcctagata

SEQ ID NO: 153571 - DNA, 22 bp, Artificial Sequence
  Synthetic oligonucleotide; TTC chr11 5167741 5167762 5167746 5167741 -
taagtgtagtcctagatatagt

SEQ ID NO: 153572 - DNA, 22 bp, Artificial Sequence
  Synthetic oligonucleotide; CTA chr11 5167739 5167760 5167744 5167739 -
agtgtagtcctagatatagtag

SEQ ID NO: 153573 - DNA, 22 bp, Artificial Sequence
  Synthetic oligonucleotide; CTA chr11 5167727 5167748 5167732 5167727 -
gatatagtagagtactacgcca

SEQ ID NO: 153574 - DNA, 22 bp, Artificial Sequence
  Synthetic oligonucleotide; CTA chr11 5167710 5167731 5167715 5167710 -
cgccaagacatcaggtcaagga

SEQ ID NO: 153575 - DNA, 22 bp, Artificial Sequence
  Synthetic oligonucleotide; CTA chr11 5167672 5167693 5167677 5167672 -
aaagcagaagagatgagaaaca

SEQ ID NO: 153576 - DNA, 22 bp, Artificial Sequence
  Synthetic oligonucleotide; CTC chr11 5167630 5167651 5167635 5167630 -
caaatcctgtgacaacaaacat

SEQ ID NO: 153577 - DNA, 22 bp, Artificial Sequence
  Synthetic oligonucleotide; CTG chr11 5167621 5167642 5167626 5167621 -
tgacaacaaacatctcaataga

SEQ ID NO: 153578 - DNA, 22 bp, Artificial Sequence
  Synthetic oligonucleotide; CTC chr11 5167605 5167626 5167610 5167605 -
aatagaaatcacacagtccaag

SEQ ID NO: 153579 - DNA, 22 bp, Artificial Sequence
  Synthetic oligonucleotide; TTT chr11 5167564 5167585 5167569 5167564 -
tcaaagcgctcagggataaaag

SEQ ID NO: 153580 - DNA, 22 bp, Artificial Sequence
  Synthetic oligonucleotide; TTT chr11 5167563 5167584 5167568 5167563 -
caaagcgctcagggataaaaga

SEQ ID NO: 153581 - DNA, 22 bp, Artificial Sequence
  Synthetic oligonucleotide; TTC chr11 5167562 5167583 5167567 5167562 -
aaagcgctcagggataaaagaa

SEQ ID NO: 153582 - DNA, 22 bp, Artificial Sequence
  Synthetic oligonucleotide; CTC chr11 5167553 5167574 5167558 5167553 -
agggataaaagaaaactgatat

SEQ ID NO: 153583 - DNA, 22 bp, Artificial Sequence
  Synthetic oligonucleotide; CTG chr11 5167535 5167556 5167540 5167535 -
atattcaagaatattttatagg

SEQ ID NO: 153584 - DNA, 22 bp, Artificial Sequence
  Synthetic oligonucleotide; TTC chr11 5167529 5167550 5167534 5167529 -
aagaatattttatagggtaaaa

SEQ ID NO: 153585 - DNA, 22 bp, Artificial Sequence
  Synthetic oligonucleotide; TTT chr11 5167519 5167540 5167524 5167519 -
tatagggtaaaactgttattca

SEQ ID NO: 153586 - DNA, 22 bp, Artificial Sequence
  Synthetic oligonucleotide; TTT chr11 5167518 5167539 5167523 5167518 -
atagggtaaaactgttattcaa

SEQ ID NO: 153587 - DNA, 22 bp, Artificial Sequence
  Synthetic oligonucleotide; TTA chr11 5167517 5167538 5167522 5167517 -
tagggtaaaactgttattcaaa

SEQ ID NO: 153588 - DNA, 22 bp, Artificial Sequence
  Synthetic oligonucleotide; CTG chr11 5167504 5167525 5167509 5167504 -
ttattcaaatataagcaatata

SEQ ID NO: 153589 - DNA, 22 bp, Artificial Sequence
  Synthetic oligonucleotide; TTA chr11 5167501 5167522 5167506 5167501 -
ttcaaatataagcaatatataa

SEQ ID NO: 153590 - DNA, 22 bp, Artificial Sequence
  Synthetic oligonucleotide; TTC chr11 5167498 5167519 5167503 5167498 -
aaatataagcaatatataaagt

SEQ ID NO: 153591 - DNA, 22 bp, Artificial Sequence
  Synthetic oligonucleotide; CTT chr11 5167473 5167494 5167478 5167473 -
tcccagacaaacaaaagttgag

SEQ ID NO: 153592 - DNA, 22 bp, Artificial Sequence
  Synthetic oligonucleotide; TTT chr11 5167472 5167493 5167477 5167472 -
cccagacaaacaaaagttgaga

SEQ ID NO: 153593 - DNA, 22 bp, Artificial Sequence
  Synthetic oligonucleotide; TTC chr11 5167471 5167492 5167476 5167471 -
ccagacaaacaaaagttgagag

SEQ ID NO: 153594 - DNA, 22 bp, Artificial Sequence
  Synthetic oligonucleotide; TTG chr11 5167453 5167474 5167458 5167453 -
agagaattcaccaacaccagac

SEQ ID NO: 153595 - DNA, 22 bp, Artificial Sequence
  Synthetic oligonucleotide; TTC chr11 5167444 5167465 5167449 5167444 -
accaacaccagaccatcttgca

SEQ ID NO: 153596 - DNA, 22 bp, Artificial Sequence
  Synthetic oligonucleotide; CTT chr11 5167425 5167446 5167430 5167425 -
gcaaaaaatgctaaagggagtt

SEQ ID NO: 153597 - DNA, 22 bp, Artificial Sequence
  Synthetic oligonucleotide; TTG chr11 5167424 5167445 5167429 5167424 -
caaaaaatgctaaagggagtta

SEQ ID NO: 153598 - DNA, 22 bp, Artificial Sequence
  Synthetic oligonucleotide; CTA chr11 5167412 5167433 5167417 5167412 -
aagggagttatgcaatctgaaa

SEQ ID NO: 153599 - DNA, 22 bp, Artificial Sequence
  Synthetic oligonucleotide; TTA chr11 5167402 5167423 5167407 5167402 -
tgcaatctgaaagaaaaaagac

SEQ ID NO: 153600 - DNA, 22 bp, Artificial Sequence
  Synthetic oligonucleotide; CTG chr11 5167393 5167414 5167398 5167393 -
aaagaaaaaagacattaacatg

SEQ ID NO: 153601 - DNA, 22 bp, Artificial Sequence
  Synthetic oligonucleotide; TTA chr11 5167376 5167397 5167381 5167376 -
acatgcaaaagaaaacttttca

SEQ ID NO: 153602 - DNA, 22 bp, Artificial Sequence
  Synthetic oligonucleotide; CTT chr11 5167358 5167379 5167363 5167358 -
ttcaaagtatgaaacccactgg

SEQ ID NO: 153603 - DNA, 22 bp, Artificial Sequence
  Synthetic oligonucleotide; TTT chr11 5167357 5167378 5167362 5167357 -
tcaaagtatgaaacccactggt

SEQ ID NO: 153604 - DNA, 22 bp, Artificial Sequence
  Synthetic oligonucleotide; TTT chr11 5167356 5167377 5167361 5167356 -
caaagtatgaaacccactggta

SEQ ID NO: 153605 - DNA, 22 bp, Artificial Sequence
  Synthetic oligonucleotide; TTC chr11 5167355 5167376 5167360 5167355 -
aaagtatgaaacccactggtaa

SEQ ID NO: 153606 - DNA, 22 bp, Artificial Sequence
  Synthetic oligonucleotide; CTG chr11 5167337 5167358 5167342 5167337 -
gtaaaattaagtacatagacaa

SEQ ID NO: 153607 - DNA, 22 bp, Artificial Sequence
  Synthetic oligonucleotide; TTA chr11 5167328 5167349 5167333 5167328 -
agtacatagacaaacctagaat

SEQ ID NO: 153608 - DNA, 22 bp, Artificial Sequence
  Synthetic oligonucleotide; CTA chr11 5167310 5167331 5167315 5167310 -
gaataccccattactgtatttt

SEQ ID NO: 153609 - DNA, 22 bp, Artificial Sequence
  Synthetic oligonucleotide; TTA chr11 5167297 5167318 5167302 5167297 -
ctgtattttttggtgtgcaatc

SEQ ID NO: 153610 - DNA, 22 bp, Artificial Sequence
  Synthetic oligonucleotide; CTG chr11 5167294 5167315 5167299 5167294 -
tattttttggtgtgcaatccac

SEQ ID NO: 153611 - DNA, 22 bp, Artificial Sequence
  Synthetic oligonucleotide; TTT chr11 5167289 5167310 5167294 5167289 -
tttggtgtgcaatccacacaga

SEQ ID NO: 153612 - DNA, 22 bp, Artificial Sequence
  Synthetic oligonucleotide; TTT chr11 5167288 5167309 5167293 5167288 -
ttggtgtgcaatccacacagaa

SEQ ID NO: 153613 - DNA, 22 bp, Artificial Sequence
  Synthetic oligonucleotide; TTT chr11 5167287 5167308 5167292 5167287 -
tggtgtgcaatccacacagaac

SEQ ID NO: 153614 - DNA, 22 bp, Artificial Sequence
  Synthetic oligonucleotide; TTT chr11 5167286 5167307 5167291 5167286 -
ggtgtgcaatccacacagaact

SEQ ID NO: 153615 - DNA, 22 bp, Artificial Sequence
  Synthetic oligonucleotide; TTG chr11 5167285 5167306 5167290 5167285 -
gtgtgcaatccacacagaactc

SEQ ID NO: 153616 - DNA, 22 bp, Artificial Sequence
  Synthetic oligonucleotide; CTC chr11 5167263 5167284 5167268 5167263 -
cagtatgaaacccaaaaaacaa

SEQ ID NO: 153617 - DNA, 22 bp, Artificial Sequence
  Synthetic oligonucleotide; CTT chr11 5167236 5167257 5167241 5167236 -
tcaaaaacagtaatagctatag

SEQ ID NO: 153618 - DNA, 22 bp, Artificial Sequence
  Synthetic oligonucleotide; TTT chr11 5167235 5167256 5167240 5167235 -
caaaaacagtaatagctatagc

SEQ ID NO: 153619 - DNA, 22 bp, Artificial Sequence
  Synthetic oligonucleotide; TTC chr11 5167234 5167255 5167239 5167234 -
aaaaacagtaatagctatagca

SEQ ID NO: 153620 - DNA, 22 bp, Artificial Sequence
  Synthetic oligonucleotide; CTA chr11 5167217 5167238 5167222 5167217 -
tagcaaccttttaagatgtagg

SEQ ID NO: 153621 - DNA, 22 bp, Artificial Sequence
  Synthetic oligonucleotide; CTT chr11 5167207 5167228 5167212 5167207 -
ttaagatgtaggtaatataaaa

SEQ ID NO: 153622 - DNA, 22 bp, Artificial Sequence
  Synthetic oligonucleotide; TTT chr11 5167206 5167227 5167211 5167206 -
taagatgtaggtaatataaaat

SEQ ID NO: 153623 - DNA, 22 bp, Artificial Sequence
  Synthetic oligonucleotide; TTT chr11 5167205 5167226 5167210 5167205 -
aagatgtaggtaatataaaata

SEQ ID NO: 153624 - DNA, 22 bp, Artificial Sequence
  Synthetic oligonucleotide; TTA chr11 5167204 5167225 5167209 5167204 -
agatgtaggtaatataaaatat

SEQ ID NO: 153625 - DNA, 22 bp, Artificial Sequence
  Synthetic oligonucleotide; TTA chr11 5167138 5167159 5167143 5167138 -
aagtgtagaatttttttgcctg

SEQ ID NO: 153626 - DNA, 22 bp, Artificial Sequence
  Synthetic oligonucleotide; TTT chr11 5167125 5167146 5167130 5167125 -
ttttgcctgtttttgcccttgt

SEQ ID NO: 153627 - DNA, 22 bp, Artificial Sequence
  Synthetic oligonucleotide; TTT chr11 5167124 5167145 5167129 5167124 -
tttgcctgtttttgcccttgtt

SEQ ID NO: 153628 - DNA, 22 bp, Artificial Sequence
  Synthetic oligonucleotide; TTT chr11 5167123 5167144 5167128 5167123 -
ttgcctgtttttgcccttgttt

SEQ ID NO: 153629 - DNA, 22 bp, Artificial Sequence
  Synthetic oligonucleotide; TTT chr11 5167122 5167143 5167127 5167122 -
tgcctgtttttgcccttgttta

SEQ ID NO: 153630 - DNA, 22 bp, Artificial Sequence
  Synthetic oligonucleotide; TTT chr11 5167121 5167142 5167126 5167121 -
gcctgtttttgcccttgtttat

SEQ ID NO: 153631 - DNA, 22 bp, Artificial Sequence
  Synthetic oligonucleotide; TTG chr11 5167120 5167141 5167125 5167120 -
cctgtttttgcccttgtttata

SEQ ID NO: 153632 - DNA, 22 bp, Artificial Sequence
  Synthetic oligonucleotide; CTG chr11 5167116 5167137 5167121 5167116 -
tttttgcccttgtttatattcc

SEQ ID NO: 153633 - DNA, 22 bp, Artificial Sequence
  Synthetic oligonucleotide; TTT chr11 5167113 5167134 5167118 5167113 -
ttgcccttgtttatattccttt

SEQ ID NO: 153634 - DNA, 22 bp, Artificial Sequence
  Synthetic oligonucleotide; TTT chr11 5167112 5167133 5167117 5167112 -
tgcccttgtttatattccttta

SEQ ID NO: 153635 - DNA, 22 bp, Artificial Sequence
  Synthetic oligonucleotide; TTT chr11 5167111 5167132 5167116 5167111 -
gcccttgtttatattcctttat

SEQ ID NO: 153636 - DNA, 22 bp, Artificial Sequence
  Synthetic oligonucleotide; TTG chr11 5167110 5167131 5167115 5167110 -
cccttgtttatattcctttatt

SEQ ID NO: 153637 - DNA, 22 bp, Artificial Sequence
  Synthetic oligonucleotide; CTT chr11 5167105 5167126 5167110 5167105 -
gtttatattcctttatttgcga

SEQ ID NO: 153638 - DNA, 22 bp, Artificial Sequence
  Synthetic oligonucleotide; TTG chr11 5167104 5167125 5167109 5167104 -
tttatattcctttatttgcgat

SEQ ID NO: 153639 - DNA, 22 bp, Artificial Sequence
  Synthetic oligonucleotide; TTT chr11 5167101 5167122 5167106 5167101 -
atattcctttatttgcgatcta

SEQ ID NO: 153640 - DNA, 22 bp, Artificial Sequence
  Synthetic oligonucleotide; TTA chr11 5167100 5167121 5167105 5167100 -
tattcctttatttgcgatctaa

SEQ ID NO: 153641 - DNA, 22 bp, Artificial Sequence
  Synthetic oligonucleotide; TTC chr11 5167095 5167116 5167100 5167095 -
ctttatttgcgatctaagataa

SEQ ID NO: 153642 - DNA, 22 bp, Artificial Sequence
  Synthetic oligonucleotide; CTT chr11 5167092 5167113 5167097 5167092 -
tatttgcgatctaagataattc

SEQ ID NO: 153643 - DNA, 22 bp, Artificial Sequence
  Synthetic oligonucleotide; TTT chr11 5167091 5167112 5167096 5167091 -
atttgcgatctaagataattcg

SEQ ID NO: 153644 - DNA, 22 bp, Artificial Sequence
  Synthetic oligonucleotide; TTA chr11 5167090 5167111 5167095 5167090 -
tttgcgatctaagataattcgt

SEQ ID NO: 153645 - DNA, 22 bp, Artificial Sequence
  Synthetic oligonucleotide; TTT chr11 5167087 5167108 5167092 5167087 -
gcgatctaagataattcgtcat

SEQ ID NO: 153646 - DNA, 22 bp, Artificial Sequence
  Synthetic oligonucleotide; TTG chr11 5167086 5167107 5167091 5167086 -
cgatctaagataattcgtcatc

SEQ ID NO: 153647 - DNA, 22 bp, Artificial Sequence
  Synthetic oligonucleotide; CTA chr11 5167079 5167100 5167084 5167079 -
agataattcgtcatcctttaaa

SEQ ID NO: 153648 - DNA, 22 bp, Artificial Sequence
  Synthetic oligonucleotide; TTC chr11 5167070 5167091 5167075 5167070 -
gtcatcctttaaaataacttgc

SEQ ID NO: 153649 - DNA, 22 bp, Artificial Sequence
  Synthetic oligonucleotide; CTT chr11 5167061 5167082 5167066 5167061 -
taaaataacttgctatatttat

SEQ ID NO: 153650 - DNA, 22 bp, Artificial Sequence
  Synthetic oligonucleotide; TTT chr11 5167060 5167081 5167065 5167060 -
aaaataacttgctatatttata

SEQ ID NO: 153651 - DNA, 22 bp, Artificial Sequence
  Synthetic oligonucleotide; TTA chr11 5167059 5167080 5167064 5167059 -
aaataacttgctatatttataa

SEQ ID NO: 153652 - DNA, 22 bp, Artificial Sequence
  Synthetic oligonucleotide; CTT chr11 5167050 5167071 5167055 5167050 -
gctatatttataagatgtttct

SEQ ID NO: 153653 - DNA, 22 bp, Artificial Sequence
  Synthetic oligonucleotide; TTG chr11 5167049 5167070 5167054 5167049 -
ctatatttataagatgtttctt

SEQ ID NO: 153654 - DNA, 22 bp, Artificial Sequence
  Synthetic oligonucleotide; CTA chr11 5167046 5167067 5167051 5167046 -
tatttataagatgtttcttgta

SEQ ID NO: 153655 - DNA, 22 bp, Artificial Sequence
  Synthetic oligonucleotide; TTT chr11 5167041 5167062 5167046 5167041 -
ataagatgtttcttgtaagccc

SEQ ID NO: 153656 - DNA, 22 bp, Artificial Sequence
  Synthetic oligonucleotide; TTA chr11 5167040 5167061 5167045 5167040 -
taagatgtttcttgtaagcccc

SEQ ID NO: 153657 - DNA, 22 bp, Artificial Sequence
  Synthetic oligonucleotide; TTT chr11 5167030 5167051 5167035 5167030 -
cttgtaagccccatggtaacca

SEQ ID NO: 153658 - DNA, 22 bp, Artificial Sequence
  Synthetic oligonucleotide; TTC chr11 5167029 5167050 5167034 5167029 -
ttgtaagccccatggtaaccac

SEQ ID NO: 153659 - DNA, 22 bp, Artificial Sequence
  Synthetic oligonucleotide; CTT chr11 5167027 5167048 5167032 5167027 -
gtaagccccatggtaaccacag

SEQ ID NO: 153660 - DNA, 22 bp, Artificial Sequence
  Synthetic oligonucleotide; TTG chr11 5167026 5167047 5167031 5167026 -
taagccccatggtaaccacagc

SEQ ID NO: 153661 - DNA, 22 bp, Artificial Sequence
  Synthetic oligonucleotide; CTA chr11 5166993 5167014 5166998 5166993 -
taatagatttactaaaaataaa

SEQ ID NO: 153662 - DNA, 22 bp, Artificial Sequence
  Synthetic oligonucleotide; TTT chr11 5166983 5167004 5166988 5166983 -
actaaaaataaaaagtaacaaa

SEQ ID NO: 153663 - DNA, 22 bp, Artificial Sequence
  Synthetic oligonucleotide; TTA chr11 5166982 5167003 5166987 5166982 -
ctaaaaataaaaagtaacaaat

SEQ ID NO: 153664 - DNA, 22 bp, Artificial Sequence
  Synthetic oligonucleotide; CTA chr11 5166979 5167000 5166984 5166979 -
aaaataaaaagtaacaaattaa

SEQ ID NO: 153665 - DNA, 22 bp, Artificial Sequence
  Synthetic oligonucleotide; TTA chr11 5166958 5166979 5166963 5166958 -
aaatatgctaccagagataatc

SEQ ID NO: 153666 - DNA, 22 bp, Artificial Sequence
  Synthetic oligonucleotide; CTA chr11 5166948 5166969 5166953 5166948 -
ccagagataatcacataaccat

SEQ ID NO: 153667 - DNA, 22 bp, Artificial Sequence
  Synthetic oligonucleotide; CTC chr11 5166897 5166918 5166902 5166897 -
catacagccaaaaataagcaaa

SEQ ID NO: 153668 - DNA, 22 bp, Artificial Sequence
  Synthetic oligonucleotide; CTT chr11 5166843 5166864 5166848 5166843 -
acttagtaactacactgagtgt

SEQ ID NO: 153669 - DNA, 22 bp, Artificial Sequence
  Synthetic oligonucleotide; TTA chr11 5166842 5166863 5166847 5166842 -
cttagtaactacactgagtgta

SEQ ID NO: 153670 - DNA, 22 bp, Artificial Sequence
  Synthetic oligonucleotide; CTT chr11 5166839 5166860 5166844 5166839 -
agtaactacactgagtgtaaat

SEQ ID NO: 153671 - DNA, 22 bp, Artificial Sequence
  Synthetic oligonucleotide; TTA chr11 5166838 5166859 5166843 5166838 -
gtaactacactgagtgtaaata

SEQ ID NO: 153672 - DNA, 22 bp, Artificial Sequence
  Synthetic oligonucleotide; CTA chr11 5166831 5166852 5166836 5166831 -
cactgagtgtaaatagtctcag

SEQ ID NO: 153673 - DNA, 22 bp, Artificial Sequence
  Synthetic oligonucleotide; CTG chr11 5166826 5166847 5166831 5166826 -
agtgtaaatagtctcagttccc

SEQ ID NO: 153674 - DNA, 22 bp, Artificial Sequence
  Synthetic oligonucleotide; CTC chr11 5166811 5166832 5166816 5166811 -
agttccccaattaaaagtaata

SEQ ID NO: 153675 - DNA, 22 bp, Artificial Sequence
  Synthetic oligonucleotide; TTC chr11 5166806 5166827 5166811 5166806 -
cccaattaaaagtaatagaatg

SEQ ID NO: 153676 - DNA, 22 bp, Artificial Sequence
  Synthetic oligonucleotide; TTA chr11 5166798 5166819 5166803 5166798 -
aaagtaatagaatggtaaatgg

SEQ ID NO: 153677 - DNA, 22 bp, Artificial Sequence
  Synthetic oligonucleotide; CTT chr11 5166754 5166775 5166759 5166754 -
tatgcgatcttcaagaaaccca

SEQ ID NO: 153678 - DNA, 22 bp, Artificial Sequence
  Synthetic oligonucleotide; TTT chr11 5166753 5166774 5166758 5166753 -
atgcgatcttcaagaaacccac

SEQ ID NO: 153679 - DNA, 22 bp, Artificial Sequence
  Synthetic oligonucleotide; TTA chr11 5166752 5166773 5166757 5166752 -
tgcgatcttcaagaaacccact

SEQ ID NO: 153680 - DNA, 22 bp, Artificial Sequence
  Synthetic oligonucleotide; CTT chr11 5166743 5166764 5166748 5166743 -
caagaaacccacttcacctata

SEQ ID NO: 153681 - DNA, 22 bp, Artificial Sequence
  Synthetic oligonucleotide; TTC chr11 5166742 5166763 5166747 5166742 -
aagaaacccacttcacctataa

SEQ ID NO: 153682 - DNA, 22 bp, Artificial Sequence
  Synthetic oligonucleotide; CTT chr11 5166729 5166750 5166734 5166729 -
cacctataaaggcacacataaa

SEQ ID NO: 153683 - DNA, 22 bp, Artificial Sequence
  Synthetic oligonucleotide; TTC chr11 5166728 5166749 5166733 5166728 -
acctataaaggcacacataaat

SEQ ID NO: 153684 - DNA, 22 bp, Artificial Sequence
  Synthetic oligonucleotide; CTA chr11 5166723 5166744 5166728 5166723 -
taaaggcacacataaatgaaag

SEQ ID NO: 153685 - DNA, 22 bp, Artificial Sequence
  Synthetic oligonucleotide; TTG chr11 5166691 5166712 5166696 5166691 -
gaaaaaaattccatgaactgga

SEQ ID NO: 153686 - DNA, 22 bp, Artificial Sequence
  Synthetic oligonucleotide; TTC chr11 5166680 5166701 5166685 5166680 -
catgaactggaaaccagaaaga

SEQ ID NO: 153687 - DNA, 22 bp, Artificial Sequence
  Synthetic oligonucleotide; CTG chr11 5166671 5166692 5166676 5166671 -
gaaaccagaaagagcagtagta

SEQ ID NO: 153688 - DNA, 22 bp, Artificial Sequence
  Synthetic oligonucleotide; TTG chr11 5166645 5166666 5166650 5166645 -
tacttaaatcagataaaataga

SEQ ID NO: 153689 - DNA, 22 bp, Artificial Sequence
  Synthetic oligonucleotide; CTT chr11 5166640 5166661 5166645 5166640 -
aaatcagataaaatagactaca

SEQ ID NO: 153690 - DNA, 22 bp, Artificial Sequence
  Synthetic oligonucleotide; TTA chr11 5166639 5166660 5166644 5166639 -
aatcagataaaatagactacaa

SEQ ID NO: 153691 - DNA, 22 bp, Artificial Sequence
  Synthetic oligonucleotide; CTA chr11 5166620 5166641 5166625 5166620 -
caaatttaaaaactgtaagaaa

SEQ ID NO: 153692 - DNA, 22 bp, Artificial Sequence
  Synthetic oligonucleotide; TTT chr11 5166613 5166634 5166618 5166613 -
aaaaactgtaagaaaagataag

SEQ ID NO: 153693 - DNA, 22 bp, Artificial Sequence
  Synthetic oligonucleotide; TTA chr11 5166612 5166633 5166617 5166612 -
aaaactgtaagaaaagataagg

SEQ ID NO: 153694 - DNA, 22 bp, Artificial Sequence
  Synthetic oligonucleotide; CTG chr11 5166605 5166626 5166610 5166605 -
taagaaaagataaggagggtca

SEQ ID NO: 153695 - DNA, 22 bp, Artificial Sequence
  Synthetic oligonucleotide; CTG chr11 5166580 5166601 5166585 5166580 -
tataataataaaggggtcaatt

SEQ ID NO: 153696 - DNA, 22 bp, Artificial Sequence
  Synthetic oligonucleotide; TTC chr11 5166557 5166578 5166562 5166557 -
agcaagaggatacaattataaa

SEQ ID NO: 153697 - DNA, 22 bp, Artificial Sequence
  Synthetic oligonucleotide; TTA chr11 5166539 5166560 5166544 5166539 -
taaatattgatgtatccaacat

SEQ ID NO: 153698 - DNA, 22 bp, Artificial Sequence
  Synthetic oligonucleotide; TTG chr11 5166530 5166551 5166535 5166530 -
atgtatccaacatcaaagttcc

SEQ ID NO: 153699 - DNA, 22 bp, Artificial Sequence
  Synthetic oligonucleotide; TTC chr11 5166509 5166530 5166514 5166509 -
ccaagtatataaggaaaacatt

SEQ ID NO: 153700 - DNA, 22 bp, Artificial Sequence
  Synthetic oligonucleotide; TTA chr11 5166486 5166507 5166491 5166486 -
atagtcctaaagggcgagacag

SEQ ID NO: 153701 - DNA, 22 bp, Artificial Sequence
  Synthetic oligonucleotide; CTA chr11 5166477 5166498 5166482 5166477 -
aagggcgagacagactgcaata

SEQ ID NO: 153702 - DNA, 22 bp, Artificial Sequence
  Synthetic oligonucleotide; CTG chr11 5166460 5166481 5166465 5166460 -
caatacaataatagtagggaac

SEQ ID NO: 153703 - DNA, 22 bp, Artificial Sequence
  Synthetic oligonucleotide; CTT chr11 5166436 5166457 5166441 5166436 -
taaacacttcagtctcagtaat

SEQ ID NO: 153704 - DNA, 22 bp, Artificial Sequence
  Synthetic oligonucleotide; TTT chr11 5166435 5166456 5166440 5166435 -
aaacacttcagtctcagtaatg

SEQ ID NO: 153705 - DNA, 22 bp, Artificial Sequence
  Synthetic oligonucleotide; TTA chr11 5166434 5166455 5166439 5166434 -
aacacttcagtctcagtaatga

SEQ ID NO: 153706 - DNA, 22 bp, Artificial Sequence
  Synthetic oligonucleotide; CTT chr11 5166427 5166448 5166432 5166427 -
cagtctcagtaatgaacagatc

SEQ ID NO: 153707 - DNA, 22 bp, Artificial Sequence
  Synthetic oligonucleotide; TTC chr11 5166426 5166447 5166431 5166426 -
agtctcagtaatgaacagatcg

SEQ ID NO: 153708 - DNA, 22 bp, Artificial Sequence
  Synthetic oligonucleotide; CTC chr11 5166420 5166441 5166425 5166420 -
agtaatgaacagatcggccaga

SEQ ID NO: 153709 - DNA, 22 bp, Artificial Sequence
  Synthetic oligonucleotide; CTA chr11 5166395 5166416 5166400 5166395 -
aaaatcaacaaatgaacaacac

SEQ ID NO: 153710 - DNA, 22 bp, Artificial Sequence
  Synthetic oligonucleotide; TTA chr11 5166368 5166389 5166373 5166368 -
atgtacccactatatctaatag

SEQ ID NO: 153711 - DNA, 22 bp, Artificial Sequence
  Synthetic oligonucleotide; CTA chr11 5166356 5166377 5166361 5166356 -
tatctaatagacccaactgaca

SEQ ID NO: 153712 - DNA, 22 bp, Artificial Sequence
  Synthetic oligonucleotide; CTA chr11 5166350 5166371 5166355 5166350 -
atagacccaactgacattaaca

SEQ ID NO: 153713 - DNA, 22 bp, Artificial Sequence
  Synthetic oligonucleotide; CTG chr11 5166337 5166358 5166342 5166337 -
acattaacagaacttgtccccc

SEQ ID NO: 153714 - DNA, 22 bp, Artificial Sequence
  Synthetic oligonucleotide; TTA chr11 5166331 5166352 5166336 5166331 -
acagaacttgtcccccaactgc

SEQ ID NO: 153715 - DNA, 22 bp, Artificial Sequence
  Synthetic oligonucleotide; CTT chr11 5166322 5166343 5166327 5166322 -
gtcccccaactgctgaagaaga

SEQ ID NO: 153716 - DNA, 22 bp, Artificial Sequence
  Synthetic oligonucleotide; TTG chr11 5166321 5166342 5166326 5166321 -
tcccccaactgctgaagaagat

SEQ ID NO: 153717 - DNA, 22 bp, Artificial Sequence
  Synthetic oligonucleotide; CTG chr11 5166310 5166331 5166315 5166310 -
ctgaagaagatacatttcttta

SEQ ID NO: 153718 - DNA, 22 bp, Artificial Sequence
  Synthetic oligonucleotide; CTG chr11 5166307 5166328 5166312 5166307 -
aagaagatacatttctttaaag

SEQ ID NO: 153719 - DNA, 22 bp, Artificial Sequence
  Synthetic oligonucleotide; TTT chr11 5166293 5166314 5166298 5166293 -
ctttaaagcagcatgtacaaca

SEQ ID NO: 153720 - DNA, 22 bp, Artificial Sequence
  Synthetic oligonucleotide; TTC chr11 5166292 5166313 5166297 5166292 -
tttaaagcagcatgtacaacat

SEQ ID NO: 153721 - DNA, 22 bp, Artificial Sequence
  Synthetic oligonucleotide; CTT chr11 5166290 5166311 5166295 5166290 -
taaagcagcatgtacaacattt

SEQ ID NO: 153722 - DNA, 22 bp, Artificial Sequence
  Synthetic oligonucleotide; TTT chr11 5166289 5166310 5166294 5166289 -
aaagcagcatgtacaacatttt

SEQ ID NO: 153723 - DNA, 22 bp, Artificial Sequence
  Synthetic oligonucleotide; TTA chr11 5166288 5166309 5166293 5166288 -
aagcagcatgtacaacattttc

SEQ ID NO: 153724 - DNA, 22 bp, Artificial Sequence
  Synthetic oligonucleotide; TTT chr11 5166268 5166289 5166273 5166268 -
tcctaaataaggccatatgtta

SEQ ID NO: 153725 - DNA, 22 bp, Artificial Sequence
  Synthetic oligonucleotide; TTT chr11 5166267 5166288 5166272 5166267 -
cctaaataaggccatatgttag

SEQ ID NO: 153726 - DNA, 22 bp, Artificial Sequence
  Synthetic oligonucleotide; TTC chr11 5166266 5166287 5166271 5166266 -
ctaaataaggccatatgttagg

SEQ ID NO: 153727 - DNA, 22 bp, Artificial Sequence
  Synthetic oligonucleotide; CTA chr11 5166263 5166284 5166268 5166263 -
aataaggccatatgttaggcca

SEQ ID NO: 153728 - DNA, 22 bp, Artificial Sequence
  Synthetic oligonucleotide; TTA chr11 5166246 5166267 5166251 5166246 -
ggccacaaggtaagtttgtaca

SEQ ID NO: 153729 - DNA, 22 bp, Artificial Sequence
  Synthetic oligonucleotide; TTT chr11 5166229 5166250 5166234 5166229 -
gtacaaatttttcagaagtaga

SEQ ID NO: 153730 - DNA, 22 bp, Artificial Sequence
  Synthetic oligonucleotide; TTG chr11 5166228 5166249 5166233 5166228 -
tacaaatttttcagaagtagaa

SEQ ID NO: 153731 - DNA, 22 bp, Artificial Sequence
  Synthetic oligonucleotide; TTT chr11 5166219 5166240 5166224 5166219 -
ttcagaagtagaaattttatca

SEQ ID NO: 153732 - DNA, 22 bp, Artificial Sequence
  Synthetic oligonucleotide; TTT chr11 5166218 5166239 5166223 5166218 -
tcagaagtagaaattttatcaa

SEQ ID NO: 153733 - DNA, 22 bp, Artificial Sequence
  Synthetic oligonucleotide; TTT chr11 5166217 5166238 5166222 5166217 -
cagaagtagaaattttatcaag

SEQ ID NO: 153734 - DNA, 22 bp, Artificial Sequence
  Synthetic oligonucleotide; TTC chr11 5166216 5166237 5166221 5166216 -
agaagtagaaattttatcaagt

SEQ ID NO: 153735 - DNA, 22 bp, Artificial Sequence
  Synthetic oligonucleotide; TTT chr11 5166202 5166223 5166207 5166202 -
tatcaagtatattttctgacca

SEQ ID NO: 153736 - DNA, 22 bp, Artificial Sequence
  Synthetic oligonucleotide; TTT chr11 5166201 5166222 5166206 5166201 -
atcaagtatattttctgaccac

SEQ ID NO: 153737 - DNA, 22 bp, Artificial Sequence
  Synthetic oligonucleotide; TTA chr11 5166200 5166221 5166205 5166200 -
tcaagtatattttctgaccaca

SEQ ID NO: 153738 - DNA, 22 bp, Artificial Sequence
  Synthetic oligonucleotide; TTT chr11 5166188 5166209 5166193 5166188 -
tctgaccacagtggaataaaac

SEQ ID NO: 153739 - DNA, 22 bp, Artificial Sequence
  Synthetic oligonucleotide; TTT chr11 5166187 5166208 5166192 5166187 -
ctgaccacagtggaataaaact

SEQ ID NO: 153740 - DNA, 22 bp, Artificial Sequence
  Synthetic oligonucleotide; TTC chr11 5166186 5166207 5166191 5166186 -
tgaccacagtggaataaaacta

SEQ ID NO: 153741 - DNA, 22 bp, Artificial Sequence
  Synthetic oligonucleotide; CTG chr11 5166184 5166205 5166189 5166184 -
accacagtggaataaaactaga

SEQ ID NO: 153742 - DNA, 22 bp, Artificial Sequence
  Synthetic oligonucleotide; CTA chr11 5166164 5166185 5166169 5166164 -
gaaatgaataacaagaagatca

SEQ ID NO: 153743 - DNA, 22 bp, Artificial Sequence
  Synthetic oligonucleotide; CTC chr11 5166101 5166122 5166106 5166101 -
ctgaatgtcaggcctctgagcc

SEQ ID NO: 153744 - DNA, 22 bp, Artificial Sequence
  Synthetic oligonucleotide; CTG chr11 5166098 5166119 5166103 5166098 -
aatgtcaggcctctgagcccaa

SEQ ID NO: 153745 - DNA, 22 bp, Artificial Sequence
  Synthetic oligonucleotide; CTC chr11 5166085 5166106 5166090 5166085 -
tgagcccaagctaagccatcat

SEQ ID NO: 153746 - DNA, 22 bp, Artificial Sequence
  Synthetic oligonucleotide; CTG chr11 5166083 5166104 5166088 5166083 -
agcccaagctaagccatcatgt

SEQ ID NO: 153747 - DNA, 22 bp, Artificial Sequence
  Synthetic oligonucleotide; CTA chr11 5166072 5166093 5166077 5166072 -
agccatcatgtcccctgtgacc

SEQ ID NO: 153748 - DNA, 22 bp, Artificial Sequence
  Synthetic oligonucleotide; CTG chr11 5166055 5166076 5166060 5166055 -
tgacctgcatatacacatacag

SEQ ID NO: 153749 - DNA, 22 bp, Artificial Sequence
  Synthetic oligonucleotide; CTG chr11 5166048 5166069 5166053 5166048 -
catatacacatacagatggcca

SEQ ID NO: 153750 - DNA, 22 bp, Artificial Sequence
  Synthetic oligonucleotide; TTT chr11 5166022 5166043 5166027 5166022 -
ctgccttaactgatgacattcc

SEQ ID NO: 153751 - DNA, 22 bp, Artificial Sequence
  Synthetic oligonucleotide; TTC chr11 5166021 5166042 5166026 5166021 -
tgccttaactgatgacattcca

SEQ ID NO: 153752 - DNA, 22 bp, Artificial Sequence
  Synthetic oligonucleotide; CTG chr11 5166019 5166040 5166024 5166019 -
ccttaactgatgacattccacc

SEQ ID NO: 153753 - DNA, 22 bp, Artificial Sequence
  Synthetic oligonucleotide; CTT chr11 5166015 5166036 5166020 5166015 -
aactgatgacattccaccacaa

SEQ ID NO: 153754 - DNA, 22 bp, Artificial Sequence
  Synthetic oligonucleotide; TTA chr11 5166014 5166035 5166019 5166014 -
actgatgacattccaccacaaa

SEQ ID NO: 153755 - DNA, 22 bp, Artificial Sequence
  Synthetic oligonucleotide; CTG chr11 5166010 5166031 5166015 5166010 -
atgacattccaccacaaaagaa

SEQ ID NO: 153756 - DNA, 22 bp, Artificial Sequence
  Synthetic oligonucleotide; TTC chr11 5166001 5166022 5166006 5166001 -
caccacaaaagaagtgaaaatg

SEQ ID NO: 153757 - DNA, 22 bp, Artificial Sequence
  Synthetic oligonucleotide; CTG chr11 5165974 5165995 5165979 5165974 -
ttcctgccttaactgatgacat

SEQ ID NO: 153758 - DNA, 22 bp, Artificial Sequence
  Synthetic oligonucleotide; TTC chr11 5165971 5165992 5165976 5165971 -
ctgccttaactgatgacattgt

SEQ ID NO: 153759 - DNA, 22 bp, Artificial Sequence
  Synthetic oligonucleotide; CTG chr11 5165968 5165989 5165973 5165968 -
ccttaactgatgacattgtctt

SEQ ID NO: 153760 - DNA, 22 bp, Artificial Sequence
  Synthetic oligonucleotide; CTT chr11 5165964 5165985 5165969 5165964 -
aactgatgacattgtcttgtga

SEQ ID NO: 153761 - DNA, 22 bp, Artificial Sequence
  Synthetic oligonucleotide; TTA chr11 5165963 5165984 5165968 5165963 -
actgatgacattgtcttgtgaa

SEQ ID NO: 153762 - DNA, 22 bp, Artificial Sequence
  Synthetic oligonucleotide; CTG chr11 5165959 5165980 5165964 5165959 -
atgacattgtcttgtgaaattc

SEQ ID NO: 153763 - DNA, 22 bp, Artificial Sequence
  Synthetic oligonucleotide; TTG chr11 5165950 5165971 5165955 5165950 -
tcttgtgaaattccttctcctg

SEQ ID NO: 153764 - DNA, 22 bp, Artificial Sequence
  Synthetic oligonucleotide; CTT chr11 5165946 5165967 5165951 5165946 -
gtgaaattccttctcctggctc

SEQ ID NO: 153765 - DNA, 22 bp, Artificial Sequence
  Synthetic oligonucleotide; TTG chr11 5165945 5165966 5165950 5165945 -
tgaaattccttctcctggctca

SEQ ID NO: 153766 - DNA, 22 bp, Artificial Sequence
  Synthetic oligonucleotide; TTC chr11 5165937 5165958 5165942 5165937 -
cttctcctggctcatcctggct

SEQ ID NO: 153767 - DNA, 22 bp, Artificial Sequence
  Synthetic oligonucleotide; CTT chr11 5165934 5165955 5165939 5165934 -
ctcctggctcatcctggctcaa

SEQ ID NO: 153768 - DNA, 22 bp, Artificial Sequence
  Synthetic oligonucleotide; TTC chr11 5165933 5165954 5165938 5165933 -
tcctggctcatcctggctcaaa

SEQ ID NO: 153769 - DNA, 22 bp, Artificial Sequence
  Synthetic oligonucleotide; CTC chr11 5165931 5165952 5165936 5165931 -
ctggctcatcctggctcaaaag

SEQ ID NO: 153770 - DNA, 22 bp, Artificial Sequence
  Synthetic oligonucleotide; CTG chr11 5165928 5165949 5165933 5165928 -
gctcatcctggctcaaaagctc

SEQ ID NO: 153771 - DNA, 22 bp, Artificial Sequence
  Synthetic oligonucleotide; CTC chr11 5165924 5165945 5165929 5165924 -
atcctggctcaaaagctcccct

SEQ ID NO: 153772 - DNA, 22 bp, Artificial Sequence
  Synthetic oligonucleotide; CTG chr11 5165918 5165939 5165923 5165918 -
gctcaaaagctcccctactgag

SEQ ID NO: 153773 - DNA, 22 bp, Artificial Sequence
  Synthetic oligonucleotide; CTC chr11 5165914 5165935 5165919 5165914 -
aaaagctcccctactgagcacc

SEQ ID NO: 153774 - DNA, 22 bp, Artificial Sequence
  Synthetic oligonucleotide; CTC chr11 5165906 5165927 5165911 5165906 -
ccctactgagcaccttgtgacc

SEQ ID NO: 153775 - DNA, 22 bp, Artificial Sequence
  Synthetic oligonucleotide; CTA chr11 5165901 5165922 5165906 5165901 -
ctgagcaccttgtgacccccac

SEQ ID NO: 153776 - DNA, 22 bp, Artificial Sequence
  Synthetic oligonucleotide; CTG chr11 5165898 5165919 5165903 5165898 -
agcaccttgtgacccccactcc

SEQ ID NO: 153777 - DNA, 22 bp, Artificial Sequence
  Synthetic oligonucleotide; CTT chr11 5165890 5165911 5165895 5165890 -
gtgacccccactcctgcccgcc

SEQ ID NO: 153778 - DNA, 22 bp, Artificial Sequence
  Synthetic oligonucleotide; TTG chr11 5165889 5165910 5165894 5165889 -
tgacccccactcctgcccgcca

SEQ ID NO: 153779 - DNA, 22 bp, Artificial Sequence
  Synthetic oligonucleotide; CTC chr11 5165877 5165898 5165882 5165877 -
ctgcccgccagagaacaacccc

SEQ ID NO: 153780 - DNA, 22 bp, Artificial Sequence
  Synthetic oligonucleotide; CTG chr11 5165874 5165895 5165879 5165874 -
cccgccagagaacaacccccct

SEQ ID NO: 153781 - DNA, 22 bp, Artificial Sequence
  Synthetic oligonucleotide; CTT chr11 5165851 5165872 5165856 5165851 -
tgactgtaattttcctttacct

SEQ ID NO: 153782 - DNA, 22 bp, Artificial Sequence
  Synthetic oligonucleotide; TTT chr11 5165850 5165871 5165855 5165850 -
gactgtaattttcctttaccta

SEQ ID NO: 153783 - DNA, 22 bp, Artificial Sequence
  Synthetic oligonucleotide; TTG chr11 5165849 5165870 5165854 5165849 -
actgtaattttcctttacctac

SEQ ID NO: 153784 - DNA, 22 bp, Artificial Sequence
  Synthetic oligonucleotide; CTG chr11 5165845 5165866 5165850 5165845 -
taattttcctttacctacccaa

SEQ ID NO: 153785 - DNA, 22 bp, Artificial Sequence
  Synthetic oligonucleotide; TTT chr11 5165839 5165860 5165844 5165839 -
tcctttacctacccaaatctta

SEQ ID NO: 153786 - DNA, 22 bp, Artificial Sequence
  Synthetic oligonucleotide; TTT chr11 5165838 5165859 5165843 5165838 -
cctttacctacccaaatcttat

SEQ ID NO: 153787 - DNA, 22 bp, Artificial Sequence
  Synthetic oligonucleotide; TTC chr11 5165837 5165858 5165842 5165837 -
ctttacctacccaaatcttata

SEQ ID NO: 153788 - DNA, 22 bp, Artificial Sequence
  Synthetic oligonucleotide; CTT chr11 5165834 5165855 5165839 5165834 -
tacctacccaaatcttataaaa

SEQ ID NO: 153789 - DNA, 22 bp, Artificial Sequence
  Synthetic oligonucleotide; TTT chr11 5165833 5165854 5165838 5165833 -
acctacccaaatcttataaaac

SEQ ID NO: 153790 - DNA, 22 bp, Artificial Sequence
  Synthetic oligonucleotide; TTA chr11 5165832 5165853 5165837 5165832 -
cctacccaaatcttataaaaca

SEQ ID NO: 153791 - DNA, 22 bp, Artificial Sequence
  Synthetic oligonucleotide; CTA chr11 5165828 5165849 5165833 5165828 -
cccaaatcttataaaacagccc

SEQ ID NO: 153792 - DNA, 22 bp, Artificial Sequence
  Synthetic oligonucleotide; CTT chr11 5165818 5165839 5165823 5165818 -
ataaaacagccccactcctatc

SEQ ID NO: 153793 - DNA, 22 bp, Artificial Sequence
  Synthetic oligonucleotide; TTA chr11 5165817 5165838 5165822 5165817 -
taaaacagccccactcctatct

SEQ ID NO: 153794 - DNA, 22 bp, Artificial Sequence
  Synthetic oligonucleotide; CTC chr11 5165801 5165822 5165806 5165801 -
ctatctccctttgctgactctc

SEQ ID NO: 153795 - DNA, 22 bp, Artificial Sequence
  Synthetic oligonucleotide; CTA chr11 5165798 5165819 5165803 5165798 -
tctccctttgctgactctcttt

SEQ ID NO: 153796 - DNA, 22 bp, Artificial Sequence
  Synthetic oligonucleotide; CTC chr11 5165794 5165815 5165799 5165794 -
cctttgctgactctctttttgg

SEQ ID NO: 153797 - DNA, 22 bp, Artificial Sequence
  Synthetic oligonucleotide; CTT chr11 5165790 5165811 5165795 5165790 -
tgctgactctctttttggactc

SEQ ID NO: 153798 - DNA, 22 bp, Artificial Sequence
  Synthetic oligonucleotide; TTT chr11 5165789 5165810 5165794 5165789 -
gctgactctctttttggactca

SEQ ID NO: 153799 - DNA, 22 bp, Artificial Sequence
  Synthetic oligonucleotide; TTG chr11 5165788 5165809 5165793 5165788 -
ctgactctctttttggactcag

SEQ ID NO: 153800 - DNA, 22 bp, Artificial Sequence
  Synthetic oligonucleotide; CTG chr11 5165785 5165806 5165790 5165785 -
actctctttttggactcagcct

SEQ ID NO: 153801 - DNA, 22 bp, Artificial Sequence
  Synthetic oligonucleotide; CTC chr11 5165781 5165802 5165786 5165781 -
tctttttggactcagcctgcct

SEQ ID NO: 153802 - DNA, 22 bp, Artificial Sequence
  Synthetic oligonucleotide; CTC chr11 5165779 5165800 5165784 5165779 -
tttttggactcagcctgcctgc

SEQ ID NO: 153803 - DNA, 22 bp, Artificial Sequence
  Synthetic oligonucleotide; CTT chr11 5165777 5165798 5165782 5165777 -
tttggactcagcctgcctgcac

SEQ ID NO: 153804 - DNA, 22 bp, Artificial Sequence
  Synthetic oligonucleotide; TTT chr11 5165776 5165797 5165781 5165776 -
ttggactcagcctgcctgcacc

SEQ ID NO: 153805 - DNA, 22 bp, Artificial Sequence
  Synthetic oligonucleotide; TTT chr11 5165775 5165796 5165780 5165775 -
tggactcagcctgcctgcaccc

SEQ ID NO: 153806 - DNA, 22 bp, Artificial Sequence
  Synthetic oligonucleotide; TTT chr11 5165774 5165795 5165779 5165774 -
ggactcagcctgcctgcaccca

SEQ ID NO: 153807 - DNA, 22 bp, Artificial Sequence
  Synthetic oligonucleotide; TTG chr11 5165773 5165794 5165778 5165773 -
gactcagcctgcctgcacccag

SEQ ID NO: 153808 - DNA, 22 bp, Artificial Sequence
  Synthetic oligonucleotide; CTC chr11 5165768 5165789 5165773 5165768 -
agcctgcctgcacccaggtgaa

SEQ ID NO: 153809 - DNA, 22 bp, Artificial Sequence
  Synthetic oligonucleotide; CTG chr11 5165762 5165783 5165767 5165762 -
cctgcacccaggtgaaataaac

SEQ ID NO: 153810 - DNA, 22 bp, Artificial Sequence
  Synthetic oligonucleotide; CTG chr11 5165758 5165779 5165763 5165758 -
cacccaggtgaaataaacagcc

SEQ ID NO: 153811 - DNA, 22 bp, Artificial Sequence
  Synthetic oligonucleotide; CTT chr11 5165734 5165755 5165739 5165734 -
gttgcttacacaaagcctgttt

SEQ ID NO: 153812 - DNA, 22 bp, Artificial Sequence
  Synthetic oligonucleotide; TTG chr11 5165733 5165754 5165738 5165733 -
ttgcttacacaaagcctgtttg

SEQ ID NO: 153813 - DNA, 22 bp, Artificial Sequence
  Synthetic oligonucleotide; TTG chr11 5165730 5165751 5165735 5165730 -
cttacacaaagcctgtttggta

SEQ ID NO: 153814 - DNA, 22 bp, Artificial Sequence
  Synthetic oligonucleotide; CTT chr11 5165727 5165748 5165732 5165727 -
acacaaagcctgtttggtagtc

SEQ ID NO: 153815 - DNA, 22 bp, Artificial Sequence
  Synthetic oligonucleotide; TTA chr11 5165726 5165747 5165731 5165726 -
cacaaagcctgtttggtagtct

SEQ ID NO: 153816 - DNA, 22 bp, Artificial Sequence
  Synthetic oligonucleotide; CTG chr11 5165715 5165736 5165720 5165715 -
tttggtagtctcttcatatgga

SEQ ID NO: 153817 - DNA, 22 bp, Artificial Sequence
  Synthetic oligonucleotide; TTT chr11 5165712 5165733 5165717 5165712 -
ggtagtctcttcatatggacgc

SEQ ID NO: 153818 - DNA, 22 bp, Artificial Sequence
  Synthetic oligonucleotide; TTG chr11 5165711 5165732 5165716 5165711 -
gtagtctcttcatatggacgcg

SEQ ID NO: 153819 - DNA, 22 bp, Artificial Sequence
  Synthetic oligonucleotide; CTC chr11 5165703 5165724 5165708 5165703 -
ttcatatggacgcgcatgaaat

SEQ ID NO: 153820 - DNA, 22 bp, Artificial Sequence
  Synthetic oligonucleotide; CTT chr11 5165701 5165722 5165706 5165701 -
catatggacgcgcatgaaattt

SEQ ID NO: 153821 - DNA, 22 bp, Artificial Sequence
  Synthetic oligonucleotide; TTC chr11 5165700 5165721 5165705 5165700 -
atatggacgcgcatgaaatttg

SEQ ID NO: 153822 - DNA, 22 bp, Artificial Sequence
  Synthetic oligonucleotide; TTT chr11 5165679 5165700 5165684 5165679 -
ggtgccgtgactcagattgggg

SEQ ID NO: 153823 - DNA, 22 bp, Artificial Sequence
  Synthetic oligonucleotide; TTG chr11 5165678 5165699 5165683 5165678 -
gtgccgtgactcagattggggg

SEQ ID NO: 153824 - DNA, 22 bp, Artificial Sequence
  Synthetic oligonucleotide; CTC chr11 5165666 5165687 5165671 5165666 -
agattgggggacctcccttggg

SEQ ID NO: 153825 - DNA, 22 bp, Artificial Sequence
  Synthetic oligonucleotide; TTG chr11 5165660 5165681 5165665 5165660 -
ggggacctcccttgggagatca

SEQ ID NO: 153826 - DNA, 22 bp, Artificial Sequence
  Synthetic oligonucleotide; CTC chr11 5165651 5165672 5165656 5165651 -
ccttgggagatcaatcccctgt

SEQ ID NO: 153827 - DNA, 22 bp, Artificial Sequence
  Synthetic oligonucleotide; CTT chr11 5165647 5165668 5165652 5165647 -
gggagatcaatcccctgtcctc

SEQ ID NO: 153828 - DNA, 22 bp, Artificial Sequence
  Synthetic oligonucleotide; TTG chr11 5165646 5165667 5165651 5165646 -
ggagatcaatcccctgtcctcc

SEQ ID NO: 153829 - DNA, 22 bp, Artificial Sequence
  Synthetic oligonucleotide; CTG chr11 5165630 5165651 5165635 5165630 -
tcctcctgctctttgctccgtg

SEQ ID NO: 153830 - DNA, 22 bp, Artificial Sequence
  Synthetic oligonucleotide; CTC chr11 5165625 5165646 5165630 5165625 -
ctgctctttgctccgtgagaaa

SEQ ID NO: 153831 - DNA, 22 bp, Artificial Sequence
  Synthetic oligonucleotide; CTG chr11 5165622 5165643 5165627 5165622 -
ctctttgctccgtgagaaagat

SEQ ID NO: 153832 - DNA, 22 bp, Artificial Sequence
  Synthetic oligonucleotide; CTC chr11 5165619 5165640 5165624 5165619 -
tttgctccgtgagaaagatcca

SEQ ID NO: 153833 - DNA, 22 bp, Artificial Sequence
  Synthetic oligonucleotide; CTT chr11 5165617 5165638 5165622 5165617 -
tgctccgtgagaaagatccacc

SEQ ID NO: 153834 - DNA, 22 bp, Artificial Sequence
  Synthetic oligonucleotide; TTT chr11 5165616 5165637 5165621 5165616 -
gctccgtgagaaagatccacct

SEQ ID NO: 153835 - DNA, 22 bp, Artificial Sequence
  Synthetic oligonucleotide; TTG chr11 5165615 5165636 5165620 5165615 -
ctccgtgagaaagatccaccta

SEQ ID NO: 153836 - DNA, 22 bp, Artificial Sequence
  Synthetic oligonucleotide; CTC chr11 5165612 5165633 5165617 5165612 -
cgtgagaaagatccacctacga

SEQ ID NO: 153837 - DNA, 22 bp, Artificial Sequence
  Synthetic oligonucleotide; CTA chr11 5165593 5165614 5165598 5165593 -
cgacctcaggtcctcaaactga

SEQ ID NO: 153838 - DNA, 22 bp, Artificial Sequence
  Synthetic oligonucleotide; CTC chr11 5165586 5165607 5165591 5165586 -
aggtcctcaaactgaccagccc

SEQ ID NO: 153839 - DNA, 22 bp, Artificial Sequence
  Synthetic oligonucleotide; CTC chr11 5165578 5165599 5165583 5165578 -
aaactgaccagcccaagaaaca

SEQ ID NO: 153840 - DNA, 22 bp, Artificial Sequence
  Synthetic oligonucleotide; CTG chr11 5165572 5165593 5165577 5165572 -
accagcccaagaaacatttcac

SEQ ID NO: 153841 - DNA, 22 bp, Artificial Sequence
  Synthetic oligonucleotide; TTT chr11 5165553 5165574 5165558 5165553 -
caccaatttcaaatccggtaag

SEQ ID NO: 153842 - DNA, 22 bp, Artificial Sequence
  Synthetic oligonucleotide; TTC chr11 5165552 5165573 5165557 5165552 -
accaatttcaaatccggtaagt

SEQ ID NO: 153843 - DNA, 22 bp, Artificial Sequence
  Synthetic oligonucleotide; TTT chr11 5165544 5165565 5165549 5165544 -
caaatccggtaagtggcctctt

SEQ ID NO: 153844 - DNA, 22 bp, Artificial Sequence
  Synthetic oligonucleotide; TTC chr11 5165543 5165564 5165548 5165543 -
aaatccggtaagtggcctcttt

SEQ ID NO: 153845 - DNA, 22 bp, Artificial Sequence
  Synthetic oligonucleotide; CTC chr11 5165524 5165545 5165529 5165524 -
tttttactgtcttctccaacct

SEQ ID NO: 153846 - DNA, 22 bp, Artificial Sequence
  Synthetic oligonucleotide; CTT chr11 5165522 5165543 5165527 5165522 -
tttactgtcttctccaacctcc

SEQ ID NO: 153847 - DNA, 22 bp, Artificial Sequence
  Synthetic oligonucleotide; TTT chr11 5165521 5165542 5165526 5165521 -
ttactgtcttctccaacctccc

SEQ ID NO: 153848 - DNA, 22 bp, Artificial Sequence
  Synthetic oligonucleotide; TTT chr11 5165520 5165541 5165525 5165520 -
tactgtcttctccaacctccct

SEQ ID NO: 153849 - DNA, 22 bp, Artificial Sequence
  Synthetic oligonucleotide; TTT chr11 5165519 5165540 5165524 5165519 -
actgtcttctccaacctccctc

SEQ ID NO: 153850 - DNA, 22 bp, Artificial Sequence
  Synthetic oligonucleotide; TTA chr11 5165518 5165539 5165523 5165518 -
ctgtcttctccaacctccctca

SEQ ID NO: 153851 - DNA, 22 bp, Artificial Sequence
  Synthetic oligonucleotide; CTG chr11 5165515 5165536 5165520 5165515 -
tcttctccaacctccctcacta

SEQ ID NO: 153852 - DNA, 22 bp, Artificial Sequence
  Synthetic oligonucleotide; CTT chr11 5165511 5165532 5165516 5165511 -
ctccaacctccctcactatccc

SEQ ID NO: 153853 - DNA, 22 bp, Artificial Sequence
  Synthetic oligonucleotide; TTC chr11 5165510 5165531 5165515 5165510 -
tccaacctccctcactatccct

SEQ ID NO: 153854 - DNA, 22 bp, Artificial Sequence
  Synthetic oligonucleotide; CTC chr11 5165508 5165529 5165513 5165508 -
caacctccctcactatccctca

SEQ ID NO: 153855 - DNA, 22 bp, Artificial Sequence
  Synthetic oligonucleotide; CTC chr11 5165501 5165522 5165506 5165501 -
cctcactatccctcaacttctt

SEQ ID NO: 153856 - DNA, 22 bp, Artificial Sequence
  Synthetic oligonucleotide; CTC chr11 5165497 5165518 5165502 5165497 -
actatccctcaacttctttctc

SEQ ID NO: 153857 - DNA, 22 bp, Artificial Sequence
  Synthetic oligonucleotide; CTA chr11 5165493 5165514 5165498 5165493 -
tccctcaacttctttctccttt

SEQ ID NO: 153858 - DNA, 22 bp, Artificial Sequence
  Synthetic oligonucleotide; CTC chr11 5165487 5165508 5165492 5165487 -
aacttctttctcctttcaatct

SEQ ID NO: 153859 - DNA, 22 bp, Artificial Sequence
  Synthetic oligonucleotide; CTT chr11 5165482 5165503 5165487 5165482 -
ctttctcctttcaatcttggca

SEQ ID NO: 153860 - DNA, 22 bp, Artificial Sequence
  Synthetic oligonucleotide; TTC chr11 5165481 5165502 5165486 5165481 -
tttctcctttcaatcttggcac

SEQ ID NO: 153861 - DNA, 22 bp, Artificial Sequence
  Synthetic oligonucleotide; CTT chr11 5165479 5165500 5165484 5165479 -
tctcctttcaatcttggcacca

SEQ ID NO: 153862 - DNA, 22 bp, Artificial Sequence
  Synthetic oligonucleotide; TTT chr11 5165478 5165499 5165483 5165478 -
ctcctttcaatcttggcaccac

SEQ ID NO: 153863 - DNA, 22 bp, Artificial Sequence
  Synthetic oligonucleotide; TTC chr11 5165477 5165498 5165482 5165477 -
tcctttcaatcttggcaccaca

SEQ ID NO: 153864 - DNA, 22 bp, Artificial Sequence
  Synthetic oligonucleotide; CTC chr11 5165475 5165496 5165480 5165475 -
ctttcaatcttggcaccacact

SEQ ID NO: 153865 - DNA, 22 bp, Artificial Sequence
  Synthetic oligonucleotide; CTT chr11 5165472 5165493 5165477 5165472 -
tcaatcttggcaccacacttca

SEQ ID NO: 153866 - DNA, 22 bp, Artificial Sequence
  Synthetic oligonucleotide; TTT chr11 5165471 5165492 5165476 5165471 -
caatcttggcaccacacttcaa

SEQ ID NO: 153867 - DNA, 22 bp, Artificial Sequence
  Synthetic oligonucleotide; TTC chr11 5165470 5165491 5165475 5165470 -
aatcttggcaccacacttcaat

SEQ ID NO: 153868 - DNA, 22 bp, Artificial Sequence
  Synthetic oligonucleotide; CTT chr11 5165464 5165485 5165469 5165464 -
ggcaccacacttcaatttctcc

SEQ ID NO: 153869 - DNA, 22 bp, Artificial Sequence
  Synthetic oligonucleotide; TTG chr11 5165463 5165484 5165468 5165463 -
gcaccacacttcaatttctccc

SEQ ID NO: 153870 - DNA, 22 bp, Artificial Sequence
  Synthetic oligonucleotide; CTT chr11 5165452 5165473 5165457 5165452 -
caatttctcccttctcttaatt

SEQ ID NO: 153871 - DNA, 22 bp, Artificial Sequence
  Synthetic oligonucleotide; TTC chr11 5165451 5165472 5165456 5165451 -
aatttctcccttctcttaattt

SEQ ID NO: 153872 - DNA, 22 bp, Artificial Sequence
  Synthetic oligonucleotide; TTT chr11 5165446 5165467 5165451 5165446 -
ctcccttctcttaatttcaatt

SEQ ID NO: 153873 - DNA, 22 bp, Artificial Sequence
  Synthetic oligonucleotide; TTC chr11 5165445 5165466 5165450 5165445 -
tcccttctcttaatttcaattc

SEQ ID NO: 153874 - DNA, 22 bp, Artificial Sequence
  Synthetic oligonucleotide; CTC chr11 5165443 5165464 5165448 5165443 -
ccttctcttaatttcaattcct

SEQ ID NO: 153875 - DNA, 22 bp, Artificial Sequence
  Synthetic oligonucleotide; CTT chr11 5165439 5165460 5165444 5165439 -
ctcttaatttcaattcctttca

SEQ ID NO: 153876 - DNA, 22 bp, Artificial Sequence
  Synthetic oligonucleotide; TTC chr11 5165438 5165459 5165443 5165438 -
tcttaatttcaattcctttcat

SEQ ID NO: 153877 - DNA, 22 bp, Artificial Sequence
  Synthetic oligonucleotide; CTC chr11 5165436 5165457 5165441 5165436 -
ttaatttcaattcctttcattt

SEQ ID NO: 153878 - DNA, 22 bp, Artificial Sequence
  Synthetic oligonucleotide; CTT chr11 5165434 5165455 5165439 5165434 -
aatttcaattcctttcattttc

SEQ ID NO: 153879 - DNA, 22 bp, Artificial Sequence
  Synthetic oligonucleotide; TTA chr11 5165433 5165454 5165438 5165433 -
atttcaattcctttcattttcc

SEQ ID NO: 153880 - DNA, 22 bp, Artificial Sequence
  Synthetic oligonucleotide; TTT chr11 5165429 5165450 5165434 5165429 -
caattcctttcattttccagta

SEQ ID NO: 153881 - DNA, 22 bp, Artificial Sequence
  Synthetic oligonucleotide; TTC chr11 5165428 5165449 5165433 5165428 -
aattcctttcattttccagtag

SEQ ID NO: 153882 - DNA, 22 bp, Artificial Sequence
  Synthetic oligonucleotide; TTC chr11 5165423 5165444 5165428 5165423 -
ctttcattttccagtagagaca

SEQ ID NO: 153883 - DNA, 22 bp, Artificial Sequence
  Synthetic oligonucleotide; CTT chr11 5165420 5165441 5165425 5165420 -
tcattttccagtagagacaaag

SEQ ID NO: 153884 - DNA, 22 bp, Artificial Sequence
  Synthetic oligonucleotide; TTT chr11 5165419 5165440 5165424 5165419 -
cattttccagtagagacaaagg

SEQ ID NO: 153885 - DNA, 22 bp, Artificial Sequence
  Synthetic oligonucleotide; TTC chr11 5165418 5165439 5165423 5165418 -
attttccagtagagacaaagga

SEQ ID NO: 153886 - DNA, 22 bp, Artificial Sequence
  Synthetic oligonucleotide; TTT chr11 5165414 5165435 5165419 5165414 -
tccagtagagacaaaggagaca

SEQ ID NO: 153887 - DNA, 22 bp, Artificial Sequence
  Synthetic oligonucleotide; TTT chr11 5165413 5165434 5165418 5165413 -
ccagtagagacaaaggagacat

SEQ ID NO: 153888 - DNA, 22 bp, Artificial Sequence
  Synthetic oligonucleotide; TTC chr11 5165412 5165433 5165417 5165412 -
cagtagagacaaaggagacatg

SEQ ID NO: 153889 - DNA, 22 bp, Artificial Sequence
  Synthetic oligonucleotide; TTT chr11 5165387 5165408 5165392 5165387 -
tatccgtggacccaaaactccg

SEQ ID NO: 153890 - DNA, 22 bp, Artificial Sequence
  Synthetic oligonucleotide; TTT chr11 5165386 5165407 5165391 5165386 -
atccgtggacccaaaactccgg

SEQ ID NO: 153891 - DNA, 22 bp, Artificial Sequence
  Synthetic oligonucleotide; TTA chr11 5165385 5165406 5165390 5165385 -
tccgtggacccaaaactccggt

SEQ ID NO: 153892 - DNA, 22 bp, Artificial Sequence
  Synthetic oligonucleotide; CTC chr11 5165367 5165388 5165372 5165367 -
cggtgccagtcacggactggga

SEQ ID NO: 153893 - DNA, 22 bp, Artificial Sequence
  Synthetic oligonucleotide; CTG chr11 5165348 5165369 5165353 5165348 -
ggaaggcagccttcccttggtg

SEQ ID NO: 153894 - DNA, 22 bp, Artificial Sequence
  Synthetic oligonucleotide; CTT chr11 5165335 5165356 5165340 5165335 -
cccttggtgtttaatcattgca

SEQ ID NO: 153895 - DNA, 22 bp, Artificial Sequence
  Synthetic oligonucleotide; TTC chr11 5165334 5165355 5165339 5165334 -
ccttggtgtttaatcattgcag

SEQ ID NO: 153896 - DNA, 22 bp, Artificial Sequence
  Synthetic oligonucleotide; CTT chr11 5165330 5165351 5165335 5165330 -
ggtgtttaatcattgcagggac

SEQ ID NO: 153897 - DNA, 22 bp, Artificial Sequence
  Synthetic oligonucleotide; TTG chr11 5165329 5165350 5165334 5165329 -
gtgtttaatcattgcagggaca

SEQ ID NO: 153898 - DNA, 22 bp, Artificial Sequence
  Synthetic oligonucleotide; TTT chr11 5165323 5165344 5165328 5165323 -
aatcattgcagggacacctctc

SEQ ID NO: 153899 - DNA, 22 bp, Artificial Sequence
  Synthetic oligonucleotide; TTA chr11 5165322 5165343 5165327 5165322 -
atcattgcagggacacctctct

SEQ ID NO: 153900 - DNA, 22 bp, Artificial Sequence
  Synthetic oligonucleotide; TTG chr11 5165315 5165336 5165320 5165315 -
cagggacacctctctgattatt

SEQ ID NO: 153901 - DNA, 22 bp, Artificial Sequence
  Synthetic oligonucleotide; CTC chr11 5165303 5165324 5165308 5165303 -
tctgattattaaaccatgtttc

SEQ ID NO: 153902 - DNA, 22 bp, Artificial Sequence
  Synthetic oligonucleotide; CTC chr11 5165301 5165322 5165306 5165301 -
tgattattaaaccatgtttcag

SEQ ID NO: 153903 - DNA, 22 bp, Artificial Sequence
  Synthetic oligonucleotide; CTG chr11 5165299 5165320 5165304 5165299 -
attattaaaccatgtttcagag

SEQ ID NO: 153904 - DNA, 22 bp, Artificial Sequence
  Synthetic oligonucleotide; TTA chr11 5165295 5165316 5165300 5165295 -
ttaaaccatgtttcagaggtgt

SEQ ID NO: 153905 - DNA, 22 bp, Artificial Sequence
  Synthetic oligonucleotide; TTA chr11 5165292 5165313 5165297 5165292 -
aaccatgtttcagaggtgtcag

SEQ ID NO: 153906 - DNA, 22 bp, Artificial Sequence
  Synthetic oligonucleotide; TTT chr11 5165282 5165303 5165287 5165282 -
cagaggtgtcagaccacgcagg

SEQ ID NO: 153907 - DNA, 22 bp, Artificial Sequence
  Synthetic oligonucleotide; TTC chr11 5165281 5165302 5165286 5165281 -
agaggtgtcagaccacgcaggg

SEQ ID NO: 153908 - DNA, 22 bp, Artificial Sequence
  Synthetic oligonucleotide; CTG chr11 5165252 5165273 5165257 5165252 -
ccttggtccttcacccttagcg

SEQ ID NO: 153909 - DNA, 22 bp, Artificial Sequence
  Synthetic oligonucleotide; CTT chr11 5165248 5165269 5165253 5165248 -
ggtccttcacccttagcggcaa

SEQ ID NO: 153910 - DNA, 22 bp, Artificial Sequence
  Synthetic oligonucleotide; TTG chr11 5165247 5165268 5165252 5165247 -
gtccttcacccttagcggcaaa

SEQ ID NO: 153911 - DNA, 22 bp, Artificial Sequence
  Synthetic oligonucleotide; CTT chr11 5165241 5165262 5165246 5165241 -
cacccttagcggcaaatcccac

SEQ ID NO: 153912 - DNA, 22 bp, Artificial Sequence
  Synthetic oligonucleotide; TTC chr11 5165240 5165261 5165245 5165240 -
acccttagcggcaaatcccact

SEQ ID NO: 153913 - DNA, 22 bp, Artificial Sequence
  Synthetic oligonucleotide; CTT chr11 5165234 5165255 5165239 5165234 -
agcggcaaatcccacttttctg

SEQ ID NO: 153914 - DNA, 22 bp, Artificial Sequence
  Synthetic oligonucleotide; TTA chr11 5165233 5165254 5165238 5165233 -
gcggcaaatcccacttttctgg

SEQ ID NO: 153915 - DNA, 22 bp, Artificial Sequence
  Synthetic oligonucleotide; CTT chr11 5165217 5165238 5165222 5165217 -
ttctggaggggggtaagtaccc

SEQ ID NO: 153916 - DNA, 22 bp, Artificial Sequence
  Synthetic oligonucleotide; TTT chr11 5165216 5165237 5165221 5165216 -
tctggaggggggtaagtacccc

SEQ ID NO: 153917 - DNA, 22 bp, Artificial Sequence
  Synthetic oligonucleotide; TTT chr11 5165215 5165236 5165220 5165215 -
ctggaggggggtaagtacccca

SEQ ID NO: 153918 - DNA, 22 bp, Artificial Sequence
  Synthetic oligonucleotide; TTC chr11 5165214 5165235 5165219 5165214 -
tggaggggggtaagtaccccaa

SEQ ID NO: 153919 - DNA, 22 bp, Artificial Sequence
  Synthetic oligonucleotide; CTG chr11 5165212 5165233 5165217 5165212 -
gaggggggtaagtaccccaacc

SEQ ID NO: 153920 - DNA, 22 bp, Artificial Sequence
  Synthetic oligonucleotide; CTT chr11 5165186 5165207 5165191 5165186 -
ctctccatgtctctgccccttc

SEQ ID NO: 153921 - DNA, 22 bp, Artificial Sequence
  Synthetic oligonucleotide; TTC chr11 5165185 5165206 5165190 5165185 -
tctccatgtctctgccccttca

SEQ ID NO: 153922 - DNA, 22 bp, Artificial Sequence
  Synthetic oligonucleotide; CTC chr11 5165183 5165204 5165188 5165183 -
tccatgtctctgccccttcact

SEQ ID NO: 153923 - DNA, 22 bp, Artificial Sequence
  Synthetic oligonucleotide; CTC chr11 5165181 5165202 5165186 5165181 -
catgtctctgccccttcactgc

SEQ ID NO: 153924 - DNA, 22 bp, Artificial Sequence
  Synthetic oligonucleotide; CTC chr11 5165173 5165194 5165178 5165173 -
tgccccttcactgcttttctgg

SEQ ID NO: 153925 - DNA, 22 bp, Artificial Sequence
  Synthetic oligonucleotide; CTG chr11 5165171 5165192 5165176 5165171 -
ccccttcactgcttttctgggg

SEQ ID NO: 153926 - DNA, 22 bp, Artificial Sequence
  Synthetic oligonucleotide; CTT chr11 5165165 5165186 5165170 5165165 -
cactgcttttctgggggcaaga

SEQ ID NO: 153927 - DNA, 22 bp, Artificial Sequence
  Synthetic oligonucleotide; TTC chr11 5165164 5165185 5165169 5165164 -
actgcttttctgggggcaagaa

SEQ ID NO: 153928 - DNA, 22 bp, Artificial Sequence
  Synthetic oligonucleotide; CTG chr11 5165160 5165181 5165165 5165160 -
cttttctgggggcaagaacccc

SEQ ID NO: 153929 - DNA, 22 bp, Artificial Sequence
  Synthetic oligonucleotide; CTT chr11 5165157 5165178 5165162 5165157 -
ttctgggggcaagaaccccaat

SEQ ID NO: 153930 - DNA, 22 bp, Artificial Sequence
  Synthetic oligonucleotide; TTT chr11 5165156 5165177 5165161 5165156 -
tctgggggcaagaaccccaatc

SEQ ID NO: 153931 - DNA, 22 bp, Artificial Sequence
  Synthetic oligonucleotide; TTT chr11 5165155 5165176 5165160 5165155 -
ctgggggcaagaaccccaatcc

SEQ ID NO: 153932 - DNA, 22 bp, Artificial Sequence
  Synthetic oligonucleotide; TTC chr11 5165154 5165175 5165159 5165154 -
tgggggcaagaaccccaatccc

SEQ ID NO: 153933 - DNA, 22 bp, Artificial Sequence
  Synthetic oligonucleotide; CTG chr11 5165152 5165173 5165157 5165152 -
ggggcaagaaccccaatccctt

SEQ ID NO: 153934 - DNA, 22 bp, Artificial Sequence
  Synthetic oligonucleotide; CTT chr11 5165130 5165151 5165135 5165130 -
atttctgtgccccaacctctta

SEQ ID NO: 153935 - DNA, 22 bp, Artificial Sequence
  Synthetic oligonucleotide; TTA chr11 5165129 5165150 5165134 5165129 -
tttctgtgccccaacctcttat

SEQ ID NO: 153936 - DNA, 22 bp, Artificial Sequence
  Synthetic oligonucleotide; TTT chr11 5165126 5165147 5165131 5165126 -
ctgtgccccaacctcttatctc

SEQ ID NO: 153937 - DNA, 22 bp, Artificial Sequence
  Synthetic oligonucleotide; TTC chr11 5165125 5165146 5165130 5165125 -
tgtgccccaacctcttatctca

SEQ ID NO: 153938 - DNA, 22 bp, Artificial Sequence
  Synthetic oligonucleotide; CTG chr11 5165123 5165144 5165128 5165123 -
tgccccaacctcttatctcagc

SEQ ID NO: 153939 - DNA, 22 bp, Artificial Sequence
  Synthetic oligonucleotide; CTC chr11 5165111 5165132 5165116 5165111 -
ttatctcagcaccccatccctt

SEQ ID NO: 153940 - DNA, 22 bp, Artificial Sequence
  Synthetic oligonucleotide; CTT chr11 5165109 5165130 5165114 5165109 -
atctcagcaccccatcccttat

SEQ ID NO: 153941 - DNA, 22 bp, Artificial Sequence
  Synthetic oligonucleotide; TTA chr11 5165108 5165129 5165113 5165108 -
tctcagcaccccatcccttatt

SEQ ID NO: 153942 - DNA, 22 bp, Artificial Sequence
  Synthetic oligonucleotide; CTC chr11 5165104 5165125 5165109 5165104 -
agcaccccatcccttatttcca

SEQ ID NO: 153943 - DNA, 22 bp, Artificial Sequence
  Synthetic oligonucleotide; CTT chr11 5165089 5165110 5165094 5165089 -
atttccacgccccatcctctta

SEQ ID NO: 153944 - DNA, 22 bp, Artificial Sequence
  Synthetic oligonucleotide; TTA chr11 5165088 5165109 5165093 5165088 -
tttccacgccccatcctcttat

SEQ ID NO: 153945 - DNA, 22 bp, Artificial Sequence
  Synthetic oligonucleotide; TTT chr11 5165085 5165106 5165090 5165085 -
ccacgccccatcctcttatctc

SEQ ID NO: 153946 - DNA, 22 bp, Artificial Sequence
  Synthetic oligonucleotide; TTC chr11 5165084 5165105 5165089 5165084 -
cacgccccatcctcttatctct

SEQ ID NO: 153947 - DNA, 22 bp, Artificial Sequence
  Synthetic oligonucleotide; CTC chr11 5165070 5165091 5165075 5165070 -
ttatctctgcaccccaatccct

SEQ ID NO: 153948 - DNA, 22 bp, Artificial Sequence
  Synthetic oligonucleotide; CTT chr11 5165068 5165089 5165073 5165068 -
atctctgcaccccaatccctta

SEQ ID NO: 153949 - DNA, 22 bp, Artificial Sequence
  Synthetic oligonucleotide; TTA chr11 5165067 5165088 5165072 5165067 -
tctctgcaccccaatcccttat

SEQ ID NO: 153950 - DNA, 22 bp, Artificial Sequence
  Synthetic oligonucleotide; CTC chr11 5165063 5165084 5165068 5165063 -
tgcaccccaatcccttatttct

SEQ ID NO: 153951 - DNA, 22 bp, Artificial Sequence
  Synthetic oligonucleotide; CTG chr11 5165061 5165082 5165066 5165061 -
caccccaatcccttatttctgc

SEQ ID NO: 153952 - DNA, 22 bp, Artificial Sequence
  Synthetic oligonucleotide; CTT chr11 5165047 5165068 5165052 5165047 -
atttctgcaccccgacctctta

SEQ ID NO: 153953 - DNA, 22 bp, Artificial Sequence
  Synthetic oligonucleotide; TTA chr11 5165046 5165067 5165051 5165046 -
tttctgcaccccgacctcttat

SEQ ID NO: 153954 - DNA, 22 bp, Artificial Sequence
  Synthetic oligonucleotide; TTT chr11 5165043 5165064 5165048 5165043 -
ctgcaccccgacctcttatctc

SEQ ID NO: 153955 - DNA, 22 bp, Artificial Sequence
  Synthetic oligonucleotide; TTC chr11 5165042 5165063 5165047 5165042 -
tgcaccccgacctcttatctct

SEQ ID NO: 153956 - DNA, 22 bp, Artificial Sequence
  Synthetic oligonucleotide; CTG chr11 5165040 5165061 5165045 5165040 -
caccccgacctcttatctctgc

SEQ ID NO: 153957 - DNA, 22 bp, Artificial Sequence
  Synthetic oligonucleotide; CTC chr11 5165028 5165049 5165033 5165028 -
ttatctctgcaccctgatccct

SEQ ID NO: 153958 - DNA, 22 bp, Artificial Sequence
  Synthetic oligonucleotide; CTT chr11 5165026 5165047 5165031 5165026 -
atctctgcaccctgatccctta

SEQ ID NO: 153959 - DNA, 22 bp, Artificial Sequence
  Synthetic oligonucleotide; TTA chr11 5165025 5165046 5165030 5165025 -
tctctgcaccctgatcccttat

SEQ ID NO: 153960 - DNA, 22 bp, Artificial Sequence
  Synthetic oligonucleotide; CTC chr11 5165021 5165042 5165026 5165021 -
tgcaccctgatcccttatttct

SEQ ID NO: 153961 - DNA, 22 bp, Artificial Sequence
  Synthetic oligonucleotide; CTG chr11 5165019 5165040 5165024 5165019 -
caccctgatcccttatttctgc

SEQ ID NO: 153962 - DNA, 22 bp, Artificial Sequence
  Synthetic oligonucleotide; CTG chr11 5165012 5165033 5165017 5165012 -
atcccttatttctgcaccccaa

SEQ ID NO: 153963 - DNA, 22 bp, Artificial Sequence
  Synthetic oligonucleotide; CTT chr11 5165005 5165026 5165010 5165005 -
atttctgcaccccaacctctta

SEQ ID NO: 153964 - DNA, 22 bp, Artificial Sequence
  Synthetic oligonucleotide; TTA chr11 5165004 5165025 5165009 5165004 -
tttctgcaccccaacctcttat

SEQ ID NO: 153965 - DNA, 22 bp, Artificial Sequence
  Synthetic oligonucleotide; TTT chr11 5165001 5165022 5165006 5165001 -
ctgcaccccaacctcttatctc

SEQ ID NO: 153966 - DNA, 22 bp, Artificial Sequence
  Synthetic oligonucleotide; TTC chr11 5165000 5165021 5165005 5165000 -
tgcaccccaacctcttatctct

SEQ ID NO: 153967 - DNA, 22 bp, Artificial Sequence
  Synthetic oligonucleotide; CTG chr11 5164998 5165019 5165003 5164998 -
caccccaacctcttatctctgc

SEQ ID NO: 153968 - DNA, 22 bp, Artificial Sequence
  Synthetic oligonucleotide; CTC chr11 5164986 5165007 5164991 5164986 -
ttatctctgcaccccgatccct

SEQ ID NO: 153969 - DNA, 22 bp, Artificial Sequence
  Synthetic oligonucleotide; CTT chr11 5164984 5165005 5164989 5164984 -
atctctgcaccccgatccctta

SEQ ID NO: 153970 - DNA, 22 bp, Artificial Sequence
  Synthetic oligonucleotide; TTA chr11 5164983 5165004 5164988 5164983 -
tctctgcaccccgatcccttat

SEQ ID NO: 153971 - DNA, 22 bp, Artificial Sequence
  Synthetic oligonucleotide; CTC chr11 5164979 5165000 5164984 5164979 -
tgcaccccgatcccttatttct

SEQ ID NO: 153972 - DNA, 22 bp, Artificial Sequence
  Synthetic oligonucleotide; CTG chr11 5164977 5164998 5164982 5164977 -
caccccgatcccttatttctgt

SEQ ID NO: 153973 - DNA, 22 bp, Artificial Sequence
  Synthetic oligonucleotide; CTT chr11 5164963 5164984 5164968 5164963 -
atttctgtgccccaacctctta

SEQ ID NO: 153974 - DNA, 22 bp, Artificial Sequence
  Synthetic oligonucleotide; TTA chr11 5164962 5164983 5164967 5164962 -
tttctgtgccccaacctcttat

SEQ ID NO: 153975 - DNA, 22 bp, Artificial Sequence
  Synthetic oligonucleotide; TTT chr11 5164959 5164980 5164964 5164959 -
ctgtgccccaacctcttatctc

SEQ ID NO: 153976 - DNA, 22 bp, Artificial Sequence
  Synthetic oligonucleotide; TTC chr11 5164958 5164979 5164963 5164958 -
tgtgccccaacctcttatctct

SEQ ID NO: 153977 - DNA, 22 bp, Artificial Sequence
  Synthetic oligonucleotide; CTG chr11 5164956 5164977 5164961 5164956 -
tgccccaacctcttatctctgc

SEQ ID NO: 153978 - DNA, 22 bp, Artificial Sequence
  Synthetic oligonucleotide; CTC chr11 5164944 5164965 5164949 5164944 -
ttatctctgcaccccaacccct

SEQ ID NO: 153979 - DNA, 22 bp, Artificial Sequence
  Synthetic oligonucleotide; CTT chr11 5164942 5164963 5164947 5164942 -
atctctgcaccccaacccctta

SEQ ID NO: 153980 - DNA, 22 bp, Artificial Sequence
  Synthetic oligonucleotide; TTA chr11 5164941 5164962 5164946 5164941 -
tctctgcaccccaaccccttat

SEQ ID NO: 153981 - DNA, 22 bp, Artificial Sequence
  Synthetic oligonucleotide; CTC chr11 5164937 5164958 5164942 5164937 -
tgcaccccaaccccttatttct

SEQ ID NO: 153982 - DNA, 22 bp, Artificial Sequence
  Synthetic oligonucleotide; CTG chr11 5164935 5164956 5164940 5164935 -
caccccaaccccttatttctgt

SEQ ID NO: 153983 - DNA, 22 bp, Artificial Sequence
  Synthetic oligonucleotide; CTT chr11 5164921 5164942 5164926 5164921 -
atttctgtgccctgacctctta

SEQ ID NO: 153984 - DNA, 22 bp, Artificial Sequence
  Synthetic oligonucleotide; TTA chr11 5164920 5164941 5164925 5164920 -
tttctgtgccctgacctcttat

SEQ ID NO: 153985 - DNA, 22 bp, Artificial Sequence
  Synthetic oligonucleotide; TTT chr11 5164917 5164938 5164922 5164917 -
ctgtgccctgacctcttatctc

SEQ ID NO: 153986 - DNA, 22 bp, Artificial Sequence
  Synthetic oligonucleotide; TTC chr11 5164916 5164937 5164921 5164916 -
tgtgccctgacctcttatctct

SEQ ID NO: 153987 - DNA, 22 bp, Artificial Sequence
  Synthetic oligonucleotide; CTG chr11 5164914 5164935 5164919 5164914 -
tgccctgacctcttatctctgc

SEQ ID NO: 153988 - DNA, 22 bp, Artificial Sequence
  Synthetic oligonucleotide; CTG chr11 5164907 5164928 5164912 5164907 -
acctcttatctctgcaccccaa

SEQ ID NO: 153989 - DNA, 22 bp, Artificial Sequence
  Synthetic oligonucleotide; CTC chr11 5164902 5164923 5164907 5164902 -
ttatctctgcaccccaacccct

SEQ ID NO: 153990 - DNA, 22 bp, Artificial Sequence
  Synthetic oligonucleotide; CTT chr11 5164900 5164921 5164905 5164900 -
atctctgcaccccaacccctta

SEQ ID NO: 153991 - DNA, 22 bp, Artificial Sequence
  Synthetic oligonucleotide; TTA chr11 5164899 5164920 5164904 5164899 -
tctctgcaccccaaccccttat

SEQ ID NO: 153992 - DNA, 22 bp, Artificial Sequence
  Synthetic oligonucleotide; CTC chr11 5164895 5164916 5164900 5164895 -
tgcaccccaaccccttatttcc

SEQ ID NO: 153993 - DNA, 22 bp, Artificial Sequence
  Synthetic oligonucleotide; CTG chr11 5164893 5164914 5164898 5164893 -
caccccaaccccttatttccgt

SEQ ID NO: 153994 - DNA, 22 bp, Artificial Sequence
  Synthetic oligonucleotide; CTT chr11 5164879 5164900 5164884 5164879 -
atttccgtgccccaaccccttg

SEQ ID NO: 153995 - DNA, 22 bp, Artificial Sequence
  Synthetic oligonucleotide; TTA chr11 5164878 5164899 5164883 5164878 -
tttccgtgccccaaccccttgc

SEQ ID NO: 153996 - DNA, 22 bp, Artificial Sequence
  Synthetic oligonucleotide; TTT chr11 5164875 5164896 5164880 5164875 -
ccgtgccccaaccccttgccca

SEQ ID NO: 153997 - DNA, 22 bp, Artificial Sequence
  Synthetic oligonucleotide; TTC chr11 5164874 5164895 5164879 5164874 -
cgtgccccaaccccttgcccat

SEQ ID NO: 153998 - DNA, 22 bp, Artificial Sequence
  Synthetic oligonucleotide; CTT chr11 5164858 5164879 5164863 5164858 -
gcccatttttctggtgagtaag

SEQ ID NO: 153999 - DNA, 22 bp, Artificial Sequence
  Synthetic oligonucleotide; TTG chr11 5164857 5164878 5164862 5164857 -
cccatttttctggtgagtaaga

SEQ ID NO: 154000 - DNA, 22 bp, Artificial Sequence
  Synthetic oligonucleotide; TTT chr11 5164850 5164871 5164855 5164850 -
ttctggtgagtaagaacccccg

SEQ ID NO: 154001 - DNA, 22 bp, Artificial Sequence
  Synthetic oligonucleotide; TTT chr11 5164849 5164870 5164854 5164849 -
tctggtgagtaagaacccccga

SEQ ID NO: 154002 - DNA, 22 bp, Artificial Sequence
  Synthetic oligonucleotide; TTT chr11 5164848 5164869 5164853 5164848 -
ctggtgagtaagaacccccgaa

SEQ ID NO: 154003 - DNA, 22 bp, Artificial Sequence
  Synthetic oligonucleotide; TTC chr11 5164847 5164868 5164852 5164847 -
tggtgagtaagaacccccgaac

SEQ ID NO: 154004 - DNA, 22 bp, Artificial Sequence
  Synthetic oligonucleotide; CTG chr11 5164845 5164866 5164850 5164845 -
gtgagtaagaacccccgaaccc

SEQ ID NO: 154005 - DNA, 22 bp, Artificial Sequence
  Synthetic oligonucleotide; CTT chr11 5164820 5164841 5164825 5164820 -
ccctccgtgtctgtactctttc

SEQ ID NO: 154006 - DNA, 22 bp, Artificial Sequence
  Synthetic oligonucleotide; TTC chr11 5164819 5164840 5164824 5164819 -
cctccgtgtctgtactctttct

SEQ ID NO: 154007 - DNA, 22 bp, Artificial Sequence
  Synthetic oligonucleotide; CTC chr11 5164815 5164836 5164820 5164815 -
cgtgtctgtactctttcttttc

SEQ ID NO: 154008 - DNA, 22 bp, Artificial Sequence
  Synthetic oligonucleotide; CTG chr11 5164807 5164828 5164812 5164807 -
tactctttcttttctctgggct

SEQ ID NO: 154009 - DNA, 22 bp, Artificial Sequence
  Synthetic oligonucleotide; CTC chr11 5164802 5164823 5164807 5164802 -
tttcttttctctgggcttgcct

SEQ ID NO: 154010 - DNA, 22 bp, Artificial Sequence
  Synthetic oligonucleotide; CTT chr11 5164800 5164821 5164805 5164800 -
tcttttctctgggcttgcctcc

SEQ ID NO: 154011 - DNA, 22 bp, Artificial Sequence
  Synthetic oligonucleotide; TTT chr11 5164799 5164820 5164804 5164799 -
cttttctctgggcttgcctcct

SEQ ID NO: 154012 - DNA, 22 bp, Artificial Sequence
  Synthetic oligonucleotide; TTC chr11 5164798 5164819 5164803 5164798 -
ttttctctgggcttgcctcctt

SEQ ID NO: 154013 - DNA, 22 bp, Artificial Sequence
  Synthetic oligonucleotide; CTT chr11 5164796 5164817 5164801 5164796 -
ttctctgggcttgcctccttca

SEQ ID NO: 154014 - DNA, 22 bp, Artificial Sequence
  Synthetic oligonucleotide; TTT chr11 5164795 5164816 5164800 5164795 -
tctctgggcttgcctccttcac

SEQ ID NO: 154015 - DNA, 22 bp, Artificial Sequence
  Synthetic oligonucleotide; TTT chr11 5164794 5164815 5164799 5164794 -
ctctgggcttgcctccttcact

SEQ ID NO: 154016 - DNA, 22 bp, Artificial Sequence
  Synthetic oligonucleotide; TTC chr11 5164793 5164814 5164798 5164793 -
tctgggcttgcctccttcacta

SEQ ID NO: 154017 - DNA, 22 bp, Artificial Sequence
  Synthetic oligonucleotide; CTC chr11 5164791 5164812 5164796 5164791 -
tgggcttgcctccttcactagg

SEQ ID NO: 154018 - DNA, 22 bp, Artificial Sequence
  Synthetic oligonucleotide; CTG chr11 5164789 5164810 5164794 5164789 -
ggcttgcctccttcactagggg

SEQ ID NO: 154019 - DNA, 22 bp, Artificial Sequence
  Synthetic oligonucleotide; CTT chr11 5164784 5164805 5164789 5164784 -
gcctccttcactaggggcaacc

SEQ ID NO: 154020 - DNA, 22 bp, Artificial Sequence
  Synthetic oligonucleotide; TTG chr11 5164783 5164804 5164788 5164783 -
cctccttcactaggggcaacct

SEQ ID NO: 154021 - DNA, 22 bp, Artificial Sequence
  Synthetic oligonucleotide; CTC chr11 5164779 5164800 5164784 5164779 -
cttcactaggggcaaccttcca

SEQ ID NO: 154022 - DNA, 22 bp, Artificial Sequence
  Synthetic oligonucleotide; CTT chr11 5164776 5164797 5164781 5164776 -
cactaggggcaaccttccaccc

SEQ ID NO: 154023 - DNA, 22 bp, Artificial Sequence
  Synthetic oligonucleotide; TTC chr11 5164775 5164796 5164780 5164775 -
actaggggcaaccttccaccct

SEQ ID NO: 154024 - DNA, 22 bp, Artificial Sequence
  Synthetic oligonucleotide; CTA chr11 5164771 5164792 5164776 5164771 -
ggggcaaccttccaccctccat

SEQ ID NO: 154025 - DNA, 22 bp, Artificial Sequence
  Synthetic oligonucleotide; CTT chr11 5164760 5164781 5164765 5164760 -
ccaccctccattcctccctctc

SEQ ID NO: 154026 - DNA, 22 bp, Artificial Sequence
  Synthetic oligonucleotide; TTC chr11 5164759 5164780 5164764 5164759 -
caccctccattcctccctctcc

SEQ ID NO: 154027 - DNA, 22 bp, Artificial Sequence
  Synthetic oligonucleotide; CTC chr11 5164752 5164773 5164757 5164752 -
cattcctccctctcccttagcc

SEQ ID NO: 154028 - DNA, 22 bp, Artificial Sequence
  Synthetic oligonucleotide; TTC chr11 5164747 5164768 5164752 5164747 -
ctccctctcccttagcctgtgc

SEQ ID NO: 154029 - DNA, 22 bp, Artificial Sequence
  Synthetic oligonucleotide; CTC chr11 5164744 5164765 5164749 5164744 -
cctctcccttagcctgtgctct

SEQ ID NO: 154030 - DNA, 22 bp, Artificial Sequence
  Synthetic oligonucleotide; CTC chr11 5164740 5164761 5164745 5164740 -
tcccttagcctgtgctctcaag

SEQ ID NO: 154031 - DNA, 22 bp, Artificial Sequence
  Synthetic oligonucleotide; CTC chr11 5164738 5164759 5164743 5164738 -
ccttagcctgtgctctcaagaa

SEQ ID NO: 154032 - DNA, 22 bp, Artificial Sequence
  Synthetic oligonucleotide; CTT chr11 5164734 5164755 5164739 5164734 -
agcctgtgctctcaagaactta

SEQ ID NO: 154033 - DNA, 22 bp, Artificial Sequence
  Synthetic oligonucleotide; TTA chr11 5164733 5164754 5164738 5164733 -
gcctgtgctctcaagaacttaa

SEQ ID NO: 154034 - DNA, 22 bp, Artificial Sequence
  Synthetic oligonucleotide; CTG chr11 5164728 5164749 5164733 5164728 -
tgctctcaagaacttaaaacct

SEQ ID NO: 154035 - DNA, 22 bp, Artificial Sequence
  Synthetic oligonucleotide; CTC chr11 5164723 5164744 5164728 5164723 -
tcaagaacttaaaacctcttca

SEQ ID NO: 154036 - DNA, 22 bp, Artificial Sequence
  Synthetic oligonucleotide; CTC chr11 5164721 5164742 5164726 5164721 -
aagaacttaaaacctcttcaac

SEQ ID NO: 154037 - DNA, 22 bp, Artificial Sequence
  Synthetic oligonucleotide; CTT chr11 5164713 5164734 5164718 5164713 -
aaaacctcttcaactcacacct

SEQ ID NO: 154038 - DNA, 22 bp, Artificial Sequence
  Synthetic oligonucleotide; TTA chr11 5164712 5164733 5164717 5164712 -
aaacctcttcaactcacacctg

SEQ ID NO: 154039 - DNA, 22 bp, Artificial Sequence
  Synthetic oligonucleotide; CTC chr11 5164705 5164726 5164710 5164705 -
ttcaactcacacctgacctaaa

SEQ ID NO: 154040 - DNA, 22 bp, Artificial Sequence
  Synthetic oligonucleotide; CTT chr11 5164703 5164724 5164708 5164703 -
caactcacacctgacctaaaac

SEQ ID NO: 154041 - DNA, 22 bp, Artificial Sequence
  Synthetic oligonucleotide; TTC chr11 5164702 5164723 5164707 5164702 -
aactcacacctgacctaaaacc

SEQ ID NO: 154042 - DNA, 22 bp, Artificial Sequence
  Synthetic oligonucleotide; CTC chr11 5164697 5164718 5164702 5164697 -
acacctgacctaaaacctaaat

SEQ ID NO: 154043 - DNA, 22 bp, Artificial Sequence
  Synthetic oligonucleotide; CTG chr11 5164690 5164711 5164695 5164690 -
acctaaaacctaaatgccttat

SEQ ID NO: 154044 - DNA, 22 bp, Artificial Sequence
  Synthetic oligonucleotide; CTA chr11 5164685 5164706 5164690 5164685 -
aaacctaaatgccttattttct

SEQ ID NO: 154045 - DNA, 22 bp, Artificial Sequence
  Synthetic oligonucleotide; CTA chr11 5164678 5164699 5164683 5164678 -
aatgccttattttcttctgcaa

SEQ ID NO: 154046 - DNA, 22 bp, Artificial Sequence
  Synthetic oligonucleotide; CTT chr11 5164670 5164691 5164675 5164670 -
attttcttctgcaaggccgctt

SEQ ID NO: 154047 - DNA, 22 bp, Artificial Sequence
  Synthetic oligonucleotide; TTA chr11 5164669 5164690 5164674 5164669 -
ttttcttctgcaaggccgcttg

SEQ ID NO: 154048 - DNA, 22 bp, Artificial Sequence
  Synthetic oligonucleotide; TTT chr11 5164666 5164687 5164671 5164666 -
tcttctgcaaggccgcttgact

SEQ ID NO: 154049 - DNA, 22 bp, Artificial Sequence
  Synthetic oligonucleotide; TTT chr11 5164665 5164686 5164670 5164665 -
cttctgcaaggccgcttgactc

SEQ ID NO: 154050 - DNA, 22 bp, Artificial Sequence
  Synthetic oligonucleotide; TTC chr11 5164664 5164685 5164669 5164664 -
ttctgcaaggccgcttgactcc

SEQ ID NO: 154051 - DNA, 22 bp, Artificial Sequence
  Synthetic oligonucleotide; CTT chr11 5164662 5164683 5164667 5164662 -
ctgcaaggccgcttgactccaa

SEQ ID NO: 154052 - DNA, 22 bp, Artificial Sequence
  Synthetic oligonucleotide; TTC chr11 5164661 5164682 5164666 5164661 -
tgcaaggccgcttgactccaat

SEQ ID NO: 154053 - DNA, 22 bp, Artificial Sequence
  Synthetic oligonucleotide; CTG chr11 5164659 5164680 5164664 5164659 -
caaggccgcttgactccaatac

SEQ ID NO: 154054 - DNA, 22 bp, Artificial Sequence
  Synthetic oligonucleotide; CTT chr11 5164648 5164669 5164653 5164648 -
gactccaatacaaactcgacag

SEQ ID NO: 154055 - DNA, 22 bp, Artificial Sequence
  Synthetic oligonucleotide; TTG chr11 5164647 5164668 5164652 5164647 -
actccaatacaaactcgacagt

SEQ ID NO: 154056 - DNA, 22 bp, Artificial Sequence
  Synthetic oligonucleotide; CTC chr11 5164643 5164664 5164648 5164643 -
caatacaaactcgacagtggtt

SEQ ID NO: 154057 - DNA, 22 bp, Artificial Sequence
  Synthetic oligonucleotide; CTC chr11 5164631 5164652 5164636 5164631 -
gacagtggttccaaatagccag

SEQ ID NO: 154058 - DNA, 22 bp, Artificial Sequence
  Synthetic oligonucleotide; TTC chr11 5164620 5164641 5164625 5164620 -
caaatagccagaaaatggcact

SEQ ID NO: 154059 - DNA, 22 bp, Artificial Sequence
  Synthetic oligonucleotide; CTT chr11 5164597 5164618 5164602 5164597 -
tcaatttttccattcttcaaga

SEQ ID NO: 154060 - DNA, 22 bp, Artificial Sequence
  Synthetic oligonucleotide; TTT chr11 5164596 5164617 5164601 5164596 -
caatttttccattcttcaagat

SEQ ID NO: 154061 - DNA, 22 bp, Artificial Sequence
  Synthetic oligonucleotide; TTC chr11 5164595 5164616 5164600 5164595 -
aatttttccattcttcaagatc

SEQ ID NO: 154062 - DNA, 22 bp, Artificial Sequence
  Synthetic oligonucleotide; TTT chr11 5164590 5164611 5164595 5164590 -
ttccattcttcaagatctaaat

SEQ ID NO: 154063 - DNA, 22 bp, Artificial Sequence
  Synthetic oligonucleotide; TTT chr11 5164589 5164610 5164594 5164589 -
tccattcttcaagatctaaata

SEQ ID NO: 154064 - DNA, 22 bp, Artificial Sequence
  Synthetic oligonucleotide; TTT chr11 5164588 5164609 5164593 5164588 -
ccattcttcaagatctaaataa

SEQ ID NO: 154065 - DNA, 22 bp, Artificial Sequence
  Synthetic oligonucleotide; TTC chr11 5164587 5164608 5164592 5164587 -
cattcttcaagatctaaataat

SEQ ID NO: 154066 - DNA, 22 bp, Artificial Sequence
  Synthetic oligonucleotide; TTC chr11 5164582 5164603 5164587 5164582 -
ttcaagatctaaataatttttg

SEQ ID NO: 154067 - DNA, 22 bp, Artificial Sequence
  Synthetic oligonucleotide; CTT chr11 5164580 5164601 5164585 5164580 -
caagatctaaataatttttgtc

SEQ ID NO: 154068 - DNA, 22 bp, Artificial Sequence
  Synthetic oligonucleotide; TTC chr11 5164579 5164600 5164584 5164579 -
aagatctaaataatttttgtcg

SEQ ID NO: 154069 - DNA, 22 bp, Artificial Sequence
  Synthetic oligonucleotide; CTA chr11 5164571 5164592 5164576 5164571 -
aataatttttgtcgtaaaacag

SEQ ID NO: 154070 - DNA, 22 bp, Artificial Sequence
  Synthetic oligonucleotide; TTT chr11 5164563 5164584 5164568 5164563 -
ttgtcgtaaaacaggcaaacag

SEQ ID NO: 154071 - DNA, 22 bp, Artificial Sequence
  Synthetic oligonucleotide; TTT chr11 5164562 5164583 5164567 5164562 -
tgtcgtaaaacaggcaaacagt

SEQ ID NO: 154072 - DNA, 22 bp, Artificial Sequence
  Synthetic oligonucleotide; TTT chr11 5164561 5164582 5164566 5164561 -
gtcgtaaaacaggcaaacagtc

SEQ ID NO: 154073 - DNA, 22 bp, Artificial Sequence
  Synthetic oligonucleotide; TTG chr11 5164560 5164581 5164565 5164560 -
tcgtaaaacaggcaaacagtct

SEQ ID NO: 154074 - DNA, 22 bp, Artificial Sequence
  Synthetic oligonucleotide; CTG chr11 5164537 5164558 5164542 5164537 -
aggtgcctgacgtccaggcatt

SEQ ID NO: 154075 - DNA, 22 bp, Artificial Sequence
  Synthetic oligonucleotide; CTG chr11 5164528 5164549 5164533 5164528 -
acgtccaggcattcttttacac

SEQ ID NO: 154076 - DNA, 22 bp, Artificial Sequence
  Synthetic oligonucleotide; TTC chr11 5164514 5164535 5164519 5164514 -
ttttacacattggtccctccct

SEQ ID NO: 154077 - DNA, 22 bp, Artificial Sequence
  Synthetic oligonucleotide; CTT chr11 5164512 5164533 5164517 5164512 -
ttacacattggtccctccctag

SEQ ID NO: 154078 - DNA, 22 bp, Artificial Sequence
  Synthetic oligonucleotide; TTT chr11 5164511 5164532 5164516 5164511 -
tacacattggtccctccctagt

SEQ ID NO: 154079 - DNA, 22 bp, Artificial Sequence
  Synthetic oligonucleotide; TTT chr11 5164510 5164531 5164515 5164510 -
acacattggtccctccctagtc

SEQ ID NO: 154080 - DNA, 22 bp, Artificial Sequence
  Synthetic oligonucleotide; TTA chr11 5164509 5164530 5164514 5164509 -
cacattggtccctccctagtct

SEQ ID NO: 154081 - DNA, 22 bp, Artificial Sequence
  Synthetic oligonucleotide; TTG chr11 5164502 5164523 5164507 5164502 -
gtccctccctagtctcttccca

SEQ ID NO: 154082 - DNA, 22 bp, Artificial Sequence
  Synthetic oligonucleotide; CTC chr11 5164495 5164516 5164500 5164495 -
cctagtctcttcccaatgcaac

SEQ ID NO: 154083 - DNA, 22 bp, Artificial Sequence
  Synthetic oligonucleotide; CTA chr11 5164491 5164512 5164496 5164491 -
gtctcttcccaatgcaacttgt

SEQ ID NO: 154084 - DNA, 22 bp, Artificial Sequence
  Synthetic oligonucleotide; CTC chr11 5164486 5164507 5164491 5164486 -
ttcccaatgcaacttgtcccaa

SEQ ID NO: 154085 - DNA, 22 bp, Artificial Sequence
  Synthetic oligonucleotide; CTT chr11 5164484 5164505 5164489 5164484 -
cccaatgcaacttgtcccaaat

SEQ ID NO: 154086 - DNA, 22 bp, Artificial Sequence
  Synthetic oligonucleotide; TTC chr11 5164483 5164504 5164488 5164483 -
ccaatgcaacttgtcccaaatc

SEQ ID NO: 154087 - DNA, 22 bp, Artificial Sequence
  Synthetic oligonucleotide; CTT chr11 5164471 5164492 5164476 5164471 -
gtcccaaatcttccttctttcc

SEQ ID NO: 154088 - DNA, 22 bp, Artificial Sequence
  Synthetic oligonucleotide; TTG chr11 5164470 5164491 5164475 5164470 -
tcccaaatcttccttctttccc

SEQ ID NO: 154089 - DNA, 22 bp, Artificial Sequence
  Synthetic oligonucleotide; CTT chr11 5164459 5164480 5164464 5164459 -
ccttctttccctcccgcctgtc

SEQ ID NO: 154090 - DNA, 22 bp, Artificial Sequence
  Synthetic oligonucleotide; TTC chr11 5164458 5164479 5164463 5164458 -
cttctttccctcccgcctgtcc

SEQ ID NO: 154091 - DNA, 22 bp, Artificial Sequence
  Synthetic oligonucleotide; CTT chr11 5164455 5164476 5164460 5164455 -
ctttccctcccgcctgtcccct

SEQ ID NO: 154092 - DNA, 22 bp, Artificial Sequence
  Synthetic oligonucleotide; TTC chr11 5164454 5164475 5164459 5164454 -
tttccctcccgcctgtcccctc

SEQ ID NO: 154093 - DNA, 22 bp, Artificial Sequence
  Synthetic oligonucleotide; CTT chr11 5164452 5164473 5164457 5164452 -
tccctcccgcctgtcccctcag

SEQ ID NO: 154094 - DNA, 22 bp, Artificial Sequence
  Synthetic oligonucleotide; TTT chr11 5164451 5164472 5164456 5164451 -
ccctcccgcctgtcccctcagt

SEQ ID NO: 154095 - DNA, 22 bp, Artificial Sequence
  Synthetic oligonucleotide; TTC chr11 5164450 5164471 5164455 5164450 -
cctcccgcctgtcccctcagtc

SEQ ID NO: 154096 - DNA, 22 bp, Artificial Sequence
  Synthetic oligonucleotide; CTC chr11 5164446 5164467 5164451 5164446 -
ccgcctgtcccctcagtcccaa

SEQ ID NO: 154097 - DNA, 22 bp, Artificial Sequence
  Synthetic oligonucleotide; CTG chr11 5164439 5164460 5164444 5164439 -
tcccctcagtcccaactccaag

SEQ ID NO: 154098 - DNA, 22 bp, Artificial Sequence
  Synthetic oligonucleotide; CTC chr11 5164432 5164453 5164437 5164432 -
agtcccaactccaagcgtcgct

SEQ ID NO: 154099 - DNA, 22 bp, Artificial Sequence
  Synthetic oligonucleotide; CTC chr11 5164421 5164442 5164426 5164421 -
caagcgtcgctgagtctttcta

SEQ ID NO: 154100 - DNA, 22 bp, Artificial Sequence
  Synthetic oligonucleotide; CTG chr11 5164409 5164430 5164414 5164409 -
agtctttctaatcttccttttc

SEQ ID NO: 154101 - DNA, 22 bp, Artificial Sequence
  Synthetic oligonucleotide; CTT chr11 5164403 5164424 5164408 5164403 -
tctaatcttccttttctacaga

SEQ ID NO: 154102 - DNA, 22 bp, Artificial Sequence
  Synthetic oligonucleotide; TTT chr11 5164402 5164423 5164407 5164402 -
ctaatcttccttttctacagac

SEQ ID NO: 154103 - DNA, 22 bp, Artificial Sequence
  Synthetic oligonucleotide; TTC chr11 5164401 5164422 5164406 5164401 -
taatcttccttttctacagacc

SEQ ID NO: 154104 - DNA, 22 bp, Artificial Sequence
  Synthetic oligonucleotide; CTA chr11 5164399 5164420 5164404 5164399 -
atcttccttttctacagaccca

SEQ ID NO: 154105 - DNA, 22 bp, Artificial Sequence
  Synthetic oligonucleotide; CTT chr11 5164394 5164415 5164399 5164394 -
ccttttctacagacccatctga

SEQ ID NO: 154106 - DNA, 22 bp, Artificial Sequence
  Synthetic oligonucleotide; TTC chr11 5164393 5164414 5164398 5164393 -
cttttctacagacccatctgac

SEQ ID NO: 154107 - DNA, 22 bp, Artificial Sequence
  Synthetic oligonucleotide; CTT chr11 5164390 5164411 5164395 5164390 -
ttctacagacccatctgacgtc

SEQ ID NO: 154108 - DNA, 22 bp, Artificial Sequence
  Synthetic oligonucleotide; TTT chr11 5164389 5164410 5164394 5164389 -
tctacagacccatctgacgtct

SEQ ID NO: 154109 - DNA, 22 bp, Artificial Sequence
  Synthetic oligonucleotide; TTT chr11 5164388 5164409 5164393 5164388 -
ctacagacccatctgacgtctc

SEQ ID NO: 154110 - DNA, 22 bp, Artificial Sequence
  Synthetic oligonucleotide; TTC chr11 5164387 5164408 5164392 5164387 -
tacagacccatctgacgtctcc

SEQ ID NO: 154111 - DNA, 22 bp, Artificial Sequence
  Synthetic oligonucleotide; CTA chr11 5164385 5164406 5164390 5164385 -
cagacccatctgacgtctcccc

SEQ ID NO: 154112 - DNA, 22 bp, Artificial Sequence
  Synthetic oligonucleotide; CTG chr11 5164373 5164394 5164378 5164373 -
acgtctcccctcctccccaggc

SEQ ID NO: 154113 - DNA, 22 bp, Artificial Sequence
  Synthetic oligonucleotide; CTC chr11 5164366 5164387 5164371 5164366 -
ccctcctccccaggctgctcct

SEQ ID NO: 154114 - DNA, 22 bp, Artificial Sequence
  Synthetic oligonucleotide; CTC chr11 5164361 5164382 5164366 5164361 -
ctccccaggctgctccttgcca

SEQ ID NO: 154115 - DNA, 22 bp, Artificial Sequence
  Synthetic oligonucleotide; CTC chr11 5164358 5164379 5164363 5164358 -
cccaggctgctccttgccaggc

SEQ ID NO: 154116 - DNA, 22 bp, Artificial Sequence
  Synthetic oligonucleotide; CTG chr11 5164349 5164370 5164354 5164349 -
ctccttgccaggccgagctagg

SEQ ID NO: 154117 - DNA, 22 bp, Artificial Sequence
  Synthetic oligonucleotide; CTC chr11 5164346 5164367 5164351 5164346 -
cttgccaggccgagctaggtcc

SEQ ID NO: 154118 - DNA, 22 bp, Artificial Sequence
  Synthetic oligonucleotide; CTT chr11 5164343 5164364 5164348 5164343 -
gccaggccgagctaggtcccaa

SEQ ID NO: 154119 - DNA, 22 bp, Artificial Sequence
  Synthetic oligonucleotide; TTG chr11 5164342 5164363 5164347 5164342 -
ccaggccgagctaggtcccaaa

SEQ ID NO: 154120 - DNA, 22 bp, Artificial Sequence
  Synthetic oligonucleotide; CTA chr11 5164329 5164350 5164334 5164329 -
ggtcccaaatcttcctcagcct

SEQ ID NO: 154121 - DNA, 22 bp, Artificial Sequence
  Synthetic oligonucleotide; CTT chr11 5164316 5164337 5164321 5164316 -
cctcagcctcagctcctccacc

SEQ ID NO: 154122 - DNA, 22 bp, Artificial Sequence
  Synthetic oligonucleotide; TTC chr11 5164315 5164336 5164320 5164315 -
ctcagcctcagctcctccaccc

SEQ ID NO: 154123 - DNA, 22 bp, Artificial Sequence
  Synthetic oligonucleotide; CTC chr11 5164312 5164333 5164317 5164312 -
agcctcagctcctccaccctgt

SEQ ID NO: 154124 - DNA, 22 bp, Artificial Sequence
  Synthetic oligonucleotide; CTC chr11 5164306 5164327 5164311 5164306 -
agctcctccaccctgtaatctt

SEQ ID NO: 154125 - DNA, 22 bp, Artificial Sequence
  Synthetic oligonucleotide; CTC chr11 5164301 5164322 5164306 5164301 -
ctccaccctgtaatctttttat

SEQ ID NO: 154126 - DNA, 22 bp, Artificial Sequence
  Synthetic oligonucleotide; CTC chr11 5164298 5164319 5164303 5164298 -
caccctgtaatctttttatcac

SEQ ID NO: 154127 - DNA, 22 bp, Artificial Sequence
  Synthetic oligonucleotide; CTG chr11 5164291 5164312 5164296 5164291 -
taatctttttatcacctcccct

SEQ ID NO: 154128 - DNA, 22 bp, Artificial Sequence
  Synthetic oligonucleotide; CTT chr11 5164284 5164305 5164289 5164284 -
tttatcacctcccctcctcaca

SEQ ID NO: 154129 - DNA, 22 bp, Artificial Sequence
  Synthetic oligonucleotide; TTT chr11 5164283 5164304 5164288 5164283 -
ttatcacctcccctcctcacac

SEQ ID NO: 154130 - DNA, 22 bp, Artificial Sequence
  Synthetic oligonucleotide; TTT chr11 5164282 5164303 5164287 5164282 -
tatcacctcccctcctcacacc

SEQ ID NO: 154131 - DNA, 22 bp, Artificial Sequence
  Synthetic oligonucleotide; TTT chr11 5164281 5164302 5164286 5164281 -
atcacctcccctcctcacaccc

SEQ ID NO: 154132 - DNA, 22 bp, Artificial Sequence
  Synthetic oligonucleotide; TTA chr11 5164280 5164301 5164285 5164280 -
tcacctcccctcctcacacccg

SEQ ID NO: 154133 - DNA, 22 bp, Artificial Sequence
  Synthetic oligonucleotide; CTC chr11 5164273 5164294 5164278 5164273 -
ccctcctcacacccggtccggt

SEQ ID NO: 154134 - DNA, 22 bp, Artificial Sequence
  Synthetic oligonucleotide; CTC chr11 5164268 5164289 5164273 5164268 -
ctcacacccggtccggtttaca

SEQ ID NO: 154135 - DNA, 22 bp, Artificial Sequence
  Synthetic oligonucleotide; CTC chr11 5164265 5164286 5164270 5164265 -
acacccggtccggtttacagtt

SEQ ID NO: 154136 - DNA, 22 bp, Artificial Sequence
  Synthetic oligonucleotide; TTT chr11 5164249 5164270 5164254 5164249 -
acagtttcattccgtgactagc

SEQ ID NO: 154137 - DNA, 22 bp, Artificial Sequence
  Synthetic oligonucleotide; TTA chr11 5164248 5164269 5164253 5164248 -
cagtttcattccgtgactagcc

SEQ ID NO: 154138 - DNA, 22 bp, Artificial Sequence
  Synthetic oligonucleotide; TTT chr11 5164242 5164263 5164247 5164242 -
cattccgtgactagccctcccc

SEQ ID NO: 154139 - DNA, 22 bp, Artificial Sequence
  Synthetic oligonucleotide; TTC chr11 5164241 5164262 5164246 5164241 -
attccgtgactagccctcccca

SEQ ID NO: 154140 - DNA, 22 bp, Artificial Sequence
  Synthetic oligonucleotide; TTC chr11 5164237 5164258 5164242 5164237 -
cgtgactagccctccccaacct

SEQ ID NO: 154141 - DNA, 22 bp, Artificial Sequence
  Synthetic oligonucleotide; CTA chr11 5164229 5164250 5164234 5164229 -
gccctccccaacctgcccagca

SEQ ID NO: 154142 - DNA, 22 bp, Artificial Sequence
  Synthetic oligonucleotide; CTC chr11 5164223 5164244 5164228 5164223 -
cccaacctgcccagcaatttcc

SEQ ID NO: 154143 - DNA, 22 bp, Artificial Sequence
  Synthetic oligonucleotide; CTG chr11 5164214 5164235 5164219 5164214 -
cccagcaatttcctattaagaa

SEQ ID NO: 154144 - DNA, 22 bp, Artificial Sequence
  Synthetic oligonucleotide; TTT chr11 5164203 5164224 5164208 5164203 -
cctattaagaaggtggctgaag

SEQ ID NO: 154145 - DNA, 22 bp, Artificial Sequence
  Synthetic oligonucleotide; TTC chr11 5164202 5164223 5164207 5164202 -
ctattaagaaggtggctgaagc

SEQ ID NO: 154146 - DNA, 22 bp, Artificial Sequence
  Synthetic oligonucleotide; CTA chr11 5164199 5164220 5164204 5164199 -
ttaagaaggtggctgaagctaa

SEQ ID NO: 154147 - DNA, 22 bp, Artificial Sequence
  Synthetic oligonucleotide; TTA chr11 5164196 5164217 5164201 5164196 -
agaaggtggctgaagctaaagg

SEQ ID NO: 154148 - DNA, 22 bp, Artificial Sequence
  Synthetic oligonucleotide; CTG chr11 5164184 5164205 5164189 5164184 -
aagctaaaggcgtagtcaaggt

SEQ ID NO: 154149 - DNA, 22 bp, Artificial Sequence
  Synthetic oligonucleotide; CTA chr11 5164178 5164199 5164183 5164178 -
aaggcgtagtcaaggttaatgc

SEQ ID NO: 154150 - DNA, 22 bp, Artificial Sequence
  Synthetic oligonucleotide; TTA chr11 5164160 5164181 5164165 5164160 -
atgctcctttttctttatccga

SEQ ID NO: 154151 - DNA, 22 bp, Artificial Sequence
  Synthetic oligonucleotide; CTC chr11 5164154 5164175 5164159 5164154 -
ctttttctttatccgacctctc

SEQ ID NO: 154152 - DNA, 22 bp, Artificial Sequence
  Synthetic oligonucleotide; CTT chr11 5164151 5164172 5164156 5164151 -
tttctttatccgacctctcccg

SEQ ID NO: 154153 - DNA, 22 bp, Artificial Sequence
  Synthetic oligonucleotide; TTT chr11 5164150 5164171 5164155 5164150 -
ttctttatccgacctctcccga

SEQ ID NO: 154154 - DNA, 22 bp, Artificial Sequence
  Synthetic oligonucleotide; TTT chr11 5164149 5164170 5164154 5164149 -
tctttatccgacctctcccgaa

SEQ ID NO: 154155 - DNA, 22 bp, Artificial Sequence
  Synthetic oligonucleotide; TTT chr11 5164148 5164169 5164153 5164148 -
ctttatccgacctctcccgaat

SEQ ID NO: 154156 - DNA, 22 bp, Artificial Sequence
  Synthetic oligonucleotide; TTC chr11 5164147 5164168 5164152 5164147 -
tttatccgacctctcccgaatc

SEQ ID NO: 154157 - DNA, 22 bp, Artificial Sequence
  Synthetic oligonucleotide; CTT chr11 5164145 5164166 5164150 5164145 -
tatccgacctctcccgaatcag

SEQ ID NO: 154158 - DNA, 22 bp, Artificial Sequence
  Synthetic oligonucleotide; TTT chr11 5164144 5164165 5164149 5164144 -
atccgacctctcccgaatcaga

SEQ ID NO: 154159 - DNA, 22 bp, Artificial Sequence
  Synthetic oligonucleotide; TTA chr11 5164143 5164164 5164148 5164143 -
tccgacctctcccgaatcagag

SEQ ID NO: 154160 - DNA, 22 bp, Artificial Sequence
  Synthetic oligonucleotide; CTC chr11 5164134 5164155 5164139 5164134 -
tcccgaatcagagcgtttaggc

SEQ ID NO: 154161 - DNA, 22 bp, Artificial Sequence
  Synthetic oligonucleotide; CTC chr11 5164132 5164153 5164137 5164132 -
ccgaatcagagcgtttaggctc

SEQ ID NO: 154162 - DNA, 22 bp, Artificial Sequence
  Synthetic oligonucleotide; TTT chr11 5164116 5164137 5164121 5164116 -
aggctctttcatcaaatatgaa

SEQ ID NO: 154163 - DNA, 22 bp, Artificial Sequence
  Synthetic oligonucleotide; TTA chr11 5164115 5164136 5164120 5164115 -
ggctctttcatcaaatatgaaa

SEQ ID NO: 154164 - DNA, 22 bp, Artificial Sequence
  Synthetic oligonucleotide; CTC chr11 5164110 5164131 5164115 5164110 -
tttcatcaaatatgaaaaaccc

SEQ ID NO: 154165 - DNA, 22 bp, Artificial Sequence
  Synthetic oligonucleotide; CTT chr11 5164108 5164129 5164113 5164108 -
tcatcaaatatgaaaaacccag

SEQ ID NO: 154166 - DNA, 22 bp, Artificial Sequence
  Synthetic oligonucleotide; TTT chr11 5164107 5164128 5164112 5164107 -
catcaaatatgaaaaacccagc

SEQ ID NO: 154167 - DNA, 22 bp, Artificial Sequence
  Synthetic oligonucleotide; TTC chr11 5164106 5164127 5164111 5164106 -
atcaaatatgaaaaacccagcc

SEQ ID NO: 154168 - DNA, 22 bp, Artificial Sequence
  Synthetic oligonucleotide; TTC chr11 5164078 5164099 5164083 5164078 -
atggctcgttcggcagcaaccc

SEQ ID NO: 154169 - DNA, 22 bp, Artificial Sequence
  Synthetic oligonucleotide; CTC chr11 5164071 5164092 5164076 5164071 -
gttcggcagcaaccctgagacg

SEQ ID NO: 154170 - DNA, 22 bp, Artificial Sequence
  Synthetic oligonucleotide; TTC chr11 5164067 5164088 5164072 5164067 -
ggcagcaaccctgagacgcttt

SEQ ID NO: 154171 - DNA, 22 bp, Artificial Sequence
  Synthetic oligonucleotide; CTG chr11 5164054 5164075 5164059 5164054 -
agacgctttacagccctagacc

SEQ ID NO: 154172 - DNA, 22 bp, Artificial Sequence
  Synthetic oligonucleotide; CTT chr11 5164046 5164067 5164051 5164046 -
tacagccctagaccctaaaagg

SEQ ID NO: 154173 - DNA, 22 bp, Artificial Sequence
  Synthetic oligonucleotide; TTT chr11 5164045 5164066 5164050 5164045 -
acagccctagaccctaaaagga

SEQ ID NO: 154174 - DNA, 22 bp, Artificial Sequence
  Synthetic oligonucleotide; TTA chr11 5164044 5164065 5164049 5164044 -
cagccctagaccctaaaaggac

SEQ ID NO: 154175 - DNA, 22 bp, Artificial Sequence
  Synthetic oligonucleotide; CTA chr11 5164036 5164057 5164041 5164036 -
gaccctaaaaggacaaaaggcc

SEQ ID NO: 154176 - DNA, 22 bp, Artificial Sequence
  Synthetic oligonucleotide; CTA chr11 5164029 5164050 5164034 5164029 -
aaaggacaaaaggccactttat

SEQ ID NO: 154177 - DNA, 22 bp, Artificial Sequence
  Synthetic oligonucleotide; CTT chr11 5164010 5164031 5164015 5164010 -
tattctcaatatacattttatt

SEQ ID NO: 154178 - DNA, 22 bp, Artificial Sequence
  Synthetic oligonucleotide; TTT chr11 5164009 5164030 5164014 5164009 -
attctcaatatacattttatta

SEQ ID NO: 154179 - DNA, 22 bp, Artificial Sequence
  Synthetic oligonucleotide; TTA chr11 5164008 5164029 5164013 5164008 -
ttctcaatatacattttattac

SEQ ID NO: 154180 - DNA, 22 bp, Artificial Sequence
  Synthetic oligonucleotide; TTC chr11 5164005 5164026 5164010 5164005 -
tcaatatacattttattaccca

SEQ ID NO: 154181 - DNA, 22 bp, Artificial Sequence
  Synthetic oligonucleotide; CTC chr11 5164003 5164024 5164008 5164003 -
aatatacattttattacccaat

SEQ ID NO: 154182 - DNA, 22 bp, Artificial Sequence
  Synthetic oligonucleotide; TTT chr11 5163992 5164013 5163997 5163992 -
tattacccaatctgctcctgac

SEQ ID NO: 154183 - DNA, 22 bp, Artificial Sequence
  Synthetic oligonucleotide; TTT chr11 5163991 5164012 5163996 5163991 -
attacccaatctgctcctgaca

SEQ ID NO: 154184 - DNA, 22 bp, Artificial Sequence
  Synthetic oligonucleotide; TTA chr11 5163990 5164011 5163995 5163990 -
ttacccaatctgctcctgacat

SEQ ID NO: 154185 - DNA, 22 bp, Artificial Sequence
  Synthetic oligonucleotide; TTA chr11 5163987 5164008 5163992 5163987 -
cccaatctgctcctgacattaa

SEQ ID NO: 154186 - DNA, 22 bp, Artificial Sequence
  Synthetic oligonucleotide; CTG chr11 5163978 5163999 5163983 5163978 -
ctcctgacattaaataaaactc

SEQ ID NO: 154187 - DNA, 22 bp, Artificial Sequence
  Synthetic oligonucleotide; CTC chr11 5163975 5163996 5163980 5163975 -
ctgacattaaataaaactccaa

SEQ ID NO: 154188 - DNA, 22 bp, Artificial Sequence
  Synthetic oligonucleotide; CTG chr11 5163972 5163993 5163977 5163972 -
acattaaataaaactccaaaaa

SEQ ID NO: 154189 - DNA, 22 bp, Artificial Sequence
  Synthetic oligonucleotide; TTA chr11 5163966 5163987 5163971 5163966 -
aataaaactccaaaaattaaat

SEQ ID NO: 154190 - DNA, 22 bp, Artificial Sequence
  Synthetic oligonucleotide; CTC chr11 5163956 5163977 5163961 5163956 -
caaaaattaaattctggacctc

SEQ ID NO: 154191 - DNA, 22 bp, Artificial Sequence
  Synthetic oligonucleotide; TTA chr11 5163947 5163968 5163952 5163947 -
aattctggacctcaaaccccac

SEQ ID NO: 154192 - DNA, 22 bp, Artificial Sequence
  Synthetic oligonucleotide; TTC chr11 5163942 5163963 5163947 5163942 -
tggacctcaaaccccacaacag

SEQ ID NO: 154193 - DNA, 22 bp, Artificial Sequence
  Synthetic oligonucleotide; CTG chr11 5163940 5163961 5163945 5163940 -
gacctcaaaccccacaacagga

SEQ ID NO: 154194 - DNA, 22 bp, Artificial Sequence
  Synthetic oligonucleotide; CTC chr11 5163934 5163955 5163939 5163934 -
aaaccccacaacaggactcaat

SEQ ID NO: 154195 - DNA, 22 bp, Artificial Sequence
  Synthetic oligonucleotide; CTC chr11 5163915 5163936 5163920 5163915 -
aattaacctcaccttcaaggtg

SEQ ID NO: 154196 - DNA, 22 bp, Artificial Sequence
  Synthetic oligonucleotide; TTA chr11 5163910 5163931 5163915 5163910 -
acctcaccttcaaggtgtacaa

SEQ ID NO: 154197 - DNA, 22 bp, Artificial Sequence
  Synthetic oligonucleotide; CTC chr11 5163905 5163926 5163910 5163905 -
accttcaaggtgtacaataata

SEQ ID NO: 154198 - DNA, 22 bp, Artificial Sequence
  Synthetic oligonucleotide; CTT chr11 5163900 5163921 5163905 5163900 -
caaggtgtacaataatagagta

SEQ ID NO: 154199 - DNA, 22 bp, Artificial Sequence
  Synthetic oligonucleotide; TTC chr11 5163899 5163920 5163904 5163899 -
aaggtgtacaataatagagtag

SEQ ID NO: 154200 - DNA, 22 bp, Artificial Sequence
  Synthetic oligonucleotide; TTT chr11 5163853 5163874 5163858 5163853 -
ttgagttgcaattccttgcctc

SEQ ID NO: 154201 - DNA, 22 bp, Artificial Sequence
  Synthetic oligonucleotide; TTT chr11 5163852 5163873 5163857 5163852 -
tgagttgcaattccttgcctcc

SEQ ID NO: 154202 - DNA, 22 bp, Artificial Sequence
  Synthetic oligonucleotide; TTT chr11 5163851 5163872 5163856 5163851 -
gagttgcaattccttgcctcca

SEQ ID NO: 154203 - DNA, 22 bp, Artificial Sequence
  Synthetic oligonucleotide; TTG chr11 5163850 5163871 5163855 5163850 -
agttgcaattccttgcctccac

SEQ ID NO: 154204 - DNA, 22 bp, Artificial Sequence
  Synthetic oligonucleotide; TTG chr11 5163845 5163866 5163850 5163845 -
caattccttgcctccactgtga

SEQ ID NO: 154205 - DNA, 22 bp, Artificial Sequence
  Synthetic oligonucleotide; TTC chr11 5163839 5163860 5163844 5163839 -
cttgcctccactgtgagacaaa

SEQ ID NO: 154206 - DNA, 22 bp, Artificial Sequence
  Synthetic oligonucleotide; CTT chr11 5163836 5163857 5163841 5163836 -
gcctccactgtgagacaaaccc

SEQ ID NO: 154207 - DNA, 22 bp, Artificial Sequence
  Synthetic oligonucleotide; TTG chr11 5163835 5163856 5163840 5163835 -
cctccactgtgagacaaacccc

SEQ ID NO: 154208 - DNA, 22 bp, Artificial Sequence
  Synthetic oligonucleotide; CTC chr11 5163831 5163852 5163836 5163831 -
cactgtgagacaaaccccagcc

SEQ ID NO: 154209 - DNA, 22 bp, Artificial Sequence
  Synthetic oligonucleotide; CTG chr11 5163826 5163847 5163831 5163826 -
tgagacaaaccccagccacatc

SEQ ID NO: 154210 - DNA, 22 bp, Artificial Sequence
  Synthetic oligonucleotide; CTC chr11 5163802 5163823 5163807 5163802 -
cagcacacaagaacttccaaat

SEQ ID NO: 154211 - DNA, 22 bp, Artificial Sequence
  Synthetic oligonucleotide; CTT chr11 5163786 5163807 5163791 5163786 -
ccaaatgcctaaaccgcagtgg

SEQ ID NO: 154212 - DNA, 22 bp, Artificial Sequence
  Synthetic oligonucleotide; TTC chr11 5163785 5163806 5163790 5163785 -
caaatgcctaaaccgcagtggc

SEQ ID NO: 154213 - DNA, 22 bp, Artificial Sequence
  Synthetic oligonucleotide; CTA chr11 5163775 5163796 5163780 5163775 -
aaccgcagtggccaggcgttcc

SEQ ID NO: 154214 - DNA, 22 bp, Artificial Sequence
  Synthetic oligonucleotide; TTC chr11 5163754 5163775 5163759 5163754 -
ctccggaaccacctcccccagg

SEQ ID NO: 154215 - DNA, 22 bp, Artificial Sequence
  Synthetic oligonucleotide; CTC chr11 5163751 5163772 5163756 5163751 -
cggaaccacctcccccaggagc

SEQ ID NO: 154216 - DNA, 22 bp, Artificial Sequence
  Synthetic oligonucleotide; CTC chr11 5163739 5163760 5163744 5163739 -
ccccaggagcttgctacaagtg

SEQ ID NO: 154217 - DNA, 22 bp, Artificial Sequence
  Synthetic oligonucleotide; CTT chr11 5163727 5163748 5163732 5163727 -
gctacaagtgccagaaatctgg

SEQ ID NO: 154218 - DNA, 22 bp, Artificial Sequence
  Synthetic oligonucleotide; TTG chr11 5163726 5163747 5163731 5163726 -
ctacaagtgccagaaatctggc

SEQ ID NO: 154219 - DNA, 22 bp, Artificial Sequence
  Synthetic oligonucleotide; CTA chr11 5163723 5163744 5163728 5163723 -
caagtgccagaaatctggccac

SEQ ID NO: 154220 - DNA, 22 bp, Artificial Sequence
  Synthetic oligonucleotide; CTG chr11 5163706 5163727 5163711 5163706 -
gccaccaggccaaggaatgccc

SEQ ID NO: 154221 - DNA, 22 bp, Artificial Sequence
  Synthetic oligonucleotide; TTC chr11 5163670 5163691 5163675 5163670 -
ctcctaagccgtgtcccatctg

SEQ ID NO: 154222 - DNA, 22 bp, Artificial Sequence
  Synthetic oligonucleotide; CTC chr11 5163667 5163688 5163672 5163667 -
ctaagccgtgtcccatctgtgc

SEQ ID NO: 154223 - DNA, 22 bp, Artificial Sequence
  Synthetic oligonucleotide; CTA chr11 5163664 5163685 5163669 5163664 -
agccgtgtcccatctgtgcagg

SEQ ID NO: 154224 - DNA, 22 bp, Artificial Sequence
  Synthetic oligonucleotide; CTG chr11 5163648 5163669 5163653 5163648 -
tgcaggaccccactagaaatcg

SEQ ID NO: 154225 - DNA, 22 bp, Artificial Sequence
  Synthetic oligonucleotide; CTA chr11 5163633 5163654 5163638 5163633 -
gaaatcggactgttcaactcac

SEQ ID NO: 154226 - DNA, 22 bp, Artificial Sequence
  Synthetic oligonucleotide; CTG chr11 5163621 5163642 5163626 5163621 -
ttcaactcacctggcagccact

SEQ ID NO: 154227 - DNA, 22 bp, Artificial Sequence
  Synthetic oligonucleotide; TTC chr11 5163618 5163639 5163623 5163618 -
aactcacctggcagccactcct

SEQ ID NO: 154228 - DNA, 22 bp, Artificial Sequence
  Synthetic oligonucleotide; CTC chr11 5163613 5163634 5163618 5163613 -
acctggcagccactcctagagc

SEQ ID NO: 154229 - DNA, 22 bp, Artificial Sequence
  Synthetic oligonucleotide; CTG chr11 5163608 5163629 5163613 5163608 -
gcagccactcctagagcccctg

SEQ ID NO: 154230 - DNA, 22 bp, Artificial Sequence
  Synthetic oligonucleotide; CTC chr11 5163598 5163619 5163603 5163598 -
ctagagcccctggaactctggc

SEQ ID NO: 154231 - DNA, 22 bp, Artificial Sequence
  Synthetic oligonucleotide; CTA chr11 5163595 5163616 5163600 5163595 -
gagcccctggaactctggccca

SEQ ID NO: 154232 - DNA, 22 bp, Artificial Sequence
  Synthetic oligonucleotide; CTG chr11 5163586 5163607 5163591 5163586 -
gaactctggcccaaggctccct

SEQ ID NO: 154233 - DNA, 22 bp, Artificial Sequence
  Synthetic oligonucleotide; CTC chr11 5163580 5163601 5163585 5163580 -
tggcccaaggctccctgactga

SEQ ID NO: 154234 - DNA, 22 bp, Artificial Sequence
  Synthetic oligonucleotide; CTG chr11 5163578 5163599 5163583 5163578 -
gcccaaggctccctgactgact

SEQ ID NO: 154235 - DNA, 22 bp, Artificial Sequence
  Synthetic oligonucleotide; CTC chr11 5163567 5163588 5163572 5163567 -
cctgactgactccttcccagat

SEQ ID NO: 154236 - DNA, 22 bp, Artificial Sequence
  Synthetic oligonucleotide; CTG chr11 5163563 5163584 5163568 5163563 -
actgactccttcccagatcttc

SEQ ID NO: 154237 - DNA, 22 bp, Artificial Sequence
  Synthetic oligonucleotide; CTG chr11 5163559 5163580 5163564 5163559 -
actccttcccagatcttctcgg

SEQ ID NO: 154238 - DNA, 22 bp, Artificial Sequence
  Synthetic oligonucleotide; CTC chr11 5163555 5163576 5163560 5163555 -
cttcccagatcttctcggcttt

SEQ ID NO: 154239 - DNA, 22 bp, Artificial Sequence
  Synthetic oligonucleotide; CTT chr11 5163552 5163573 5163557 5163552 -
cccagatcttctcggctttgca

SEQ ID NO: 154240 - DNA, 22 bp, Artificial Sequence
  Synthetic oligonucleotide; TTC chr11 5163551 5163572 5163556 5163551 -
ccagatcttctcggctttgcag

SEQ ID NO: 154241 - DNA, 22 bp, Artificial Sequence
  Synthetic oligonucleotide; CTT chr11 5163542 5163563 5163547 5163542 -
ctcggctttgcagctgaagact

SEQ ID NO: 154242 - DNA, 22 bp, Artificial Sequence
  Synthetic oligonucleotide; TTC chr11 5163541 5163562 5163546 5163541 -
tcggctttgcagctgaagactg

SEQ ID NO: 154243 - DNA, 22 bp, Artificial Sequence
  Synthetic oligonucleotide; CTC chr11 5163539 5163560 5163544 5163539 -
ggctttgcagctgaagactgcc

SEQ ID NO: 154244 - DNA, 22 bp, Artificial Sequence
  Synthetic oligonucleotide; CTT chr11 5163534 5163555 5163539 5163534 -
tgcagctgaagactgccactgc

SEQ ID NO: 154245 - DNA, 22 bp, Artificial Sequence
  Synthetic oligonucleotide; TTT chr11 5163533 5163554 5163538 5163533 -
gcagctgaagactgccactgcc

SEQ ID NO: 154246 - DNA, 22 bp, Artificial Sequence
  Synthetic oligonucleotide; TTG chr11 5163532 5163553 5163537 5163532 -
cagctgaagactgccactgcct

SEQ ID NO: 154247 - DNA, 22 bp, Artificial Sequence
  Synthetic oligonucleotide; CTG chr11 5163526 5163547 5163531 5163526 -
aagactgccactgcctgatcgc

SEQ ID NO: 154248 - DNA, 22 bp, Artificial Sequence
  Synthetic oligonucleotide; CTG chr11 5163519 5163540 5163524 5163519 -
ccactgcctgatcgcctcggaa

SEQ ID NO: 154249 - DNA, 22 bp, Artificial Sequence
  Synthetic oligonucleotide; CTG chr11 5163513 5163534 5163518 5163513 -
cctgatcgcctcggaagccctg

SEQ ID NO: 154250 - DNA, 22 bp, Artificial Sequence
  Synthetic oligonucleotide; CTG chr11 5163509 5163530 5163514 5163509 -
atcgcctcggaagccctgtaga

SEQ ID NO: 154251 - DNA, 22 bp, Artificial Sequence
  Synthetic oligonucleotide; CTC chr11 5163501 5163522 5163506 5163501 -
ggaagccctgtagaccatcaca

SEQ ID NO: 154252 - DNA, 22 bp, Artificial Sequence
  Synthetic oligonucleotide; CTG chr11 5163491 5163512 5163496 5163491 -
tagaccatcacagacaccgagc

SEQ ID NO: 154253 - DNA, 22 bp, Artificial Sequence
  Synthetic oligonucleotide; CTT chr11 5163467 5163488 5163472 5163467 -
taggtaattctcacagtggagg

SEQ ID NO: 154254 - DNA, 22 bp, Artificial Sequence
  Synthetic oligonucleotide; TTT chr11 5163466 5163487 5163471 5163466 -
aggtaattctcacagtggaggg

SEQ ID NO: 154255 - DNA, 22 bp, Artificial Sequence
  Synthetic oligonucleotide; TTA chr11 5163465 5163486 5163470 5163465 -
ggtaattctcacagtggagggt

SEQ ID NO: 154256 - DNA, 22 bp, Artificial Sequence
  Synthetic oligonucleotide; TTC chr11 5163457 5163478 5163462 5163457 -
tcacagtggagggtaagtctgt

SEQ ID NO: 154257 - DNA, 22 bp, Artificial Sequence
  Synthetic oligonucleotide; CTC chr11 5163455 5163476 5163460 5163455 -
acagtggagggtaagtctgtac

SEQ ID NO: 154258 - DNA, 22 bp, Artificial Sequence
  Synthetic oligonucleotide; CTG chr11 5163436 5163457 5163441 5163436 -
tacccttcttaatcagtatgga

SEQ ID NO: 154259 - DNA, 22 bp, Artificial Sequence
  Synthetic oligonucleotide; CTT chr11 5163429 5163450 5163434 5163429 -
cttaatcagtatggaggctacc

SEQ ID NO: 154260 - DNA, 22 bp, Artificial Sequence
  Synthetic oligonucleotide; TTC chr11 5163428 5163449 5163433 5163428 -
ttaatcagtatggaggctaccc

SEQ ID NO: 154261 - DNA, 22 bp, Artificial Sequence
  Synthetic oligonucleotide; CTT chr11 5163426 5163447 5163431 5163426 -
aatcagtatggaggctacccac

SEQ ID NO: 154262 - DNA, 22 bp, Artificial Sequence
  Synthetic oligonucleotide; TTA chr11 5163425 5163446 5163430 5163425 -
atcagtatggaggctacccact

SEQ ID NO: 154263 - DNA, 22 bp, Artificial Sequence
  Synthetic oligonucleotide; CTA chr11 5163409 5163430 5163414 5163409 -
cccactccacattaccttcttt

SEQ ID NO: 154264 - DNA, 22 bp, Artificial Sequence
  Synthetic oligonucleotide; CTC chr11 5163402 5163423 5163407 5163402 -
cacattaccttcttttcaaagg

SEQ ID NO: 154265 - DNA, 22 bp, Artificial Sequence
  Synthetic oligonucleotide; TTA chr11 5163395 5163416 5163400 5163395 -
ccttcttttcaaaggcctgttt

SEQ ID NO: 154266 - DNA, 22 bp, Artificial Sequence
  Synthetic oligonucleotide; CTT chr11 5163391 5163412 5163396 5163391 -
cttttcaaaggcctgtttccct

SEQ ID NO: 154267 - DNA, 22 bp, Artificial Sequence
  Synthetic oligonucleotide; TTC chr11 5163390 5163411 5163395 5163390 -
ttttcaaaggcctgtttccctt

SEQ ID NO: 154268 - DNA, 22 bp, Artificial Sequence
  Synthetic oligonucleotide; CTT chr11 5163388 5163409 5163393 5163388 -
ttcaaaggcctgtttcccttgc

SEQ ID NO: 154269 - DNA, 22 bp, Artificial Sequence
  Synthetic oligonucleotide; TTT chr11 5163387 5163408 5163392 5163387 -
tcaaaggcctgtttcccttgcc

SEQ ID NO: 154270 - DNA, 22 bp, Artificial Sequence
  Synthetic oligonucleotide; TTT chr11 5163386 5163407 5163391 5163386 -
caaaggcctgtttcccttgcct

SEQ ID NO: 154271 - DNA, 22 bp, Artificial Sequence
  Synthetic oligonucleotide; TTC chr11 5163385 5163406 5163390 5163385 -
aaaggcctgtttcccttgcctc

SEQ ID NO: 154272 - DNA, 22 bp, Artificial Sequence
  Synthetic oligonucleotide; CTG chr11 5163376 5163397 5163381 5163376 -
tttcccttgcctccataactgt

SEQ ID NO: 154273 - DNA, 22 bp, Artificial Sequence
  Synthetic oligonucleotide; TTT chr11 5163373 5163394 5163378 5163373 -
cccttgcctccataactgttgt

SEQ ID NO: 154274 - DNA, 22 bp, Artificial Sequence
  Synthetic oligonucleotide; TTC chr11 5163372 5163393 5163377 5163372 -
ccttgcctccataactgttgta

SEQ ID NO: 154275 - DNA, 22 bp, Artificial Sequence
  Synthetic oligonucleotide; CTT chr11 5163368 5163389 5163373 5163368 -
gcctccataactgttgtaggta

SEQ ID NO: 154276 - DNA, 22 bp, Artificial Sequence
  Synthetic oligonucleotide; TTG chr11 5163367 5163388 5163372 5163367 -
cctccataactgttgtaggtat

SEQ ID NO: 154277 - DNA, 22 bp, Artificial Sequence
  Synthetic oligonucleotide; CTC chr11 5163363 5163384 5163368 5163363 -
cataactgttgtaggtattgat

SEQ ID NO: 154278 - DNA, 22 bp, Artificial Sequence
  Synthetic oligonucleotide; CTG chr11 5163355 5163376 5163360 5163355 -
ttgtaggtattgatggccaggc

SEQ ID NO: 154279 - DNA, 22 bp, Artificial Sequence
  Synthetic oligonucleotide; TTG chr11 5163352 5163373 5163357 5163352 -
taggtattgatggccaggcttc

SEQ ID NO: 154280 - DNA, 22 bp, Artificial Sequence
  Synthetic oligonucleotide; TTG chr11 5163343 5163364 5163348 5163343 -
atggccaggcttctaaacctct

SEQ ID NO: 154281 - DNA, 22 bp, Artificial Sequence
  Synthetic oligonucleotide; CTT chr11 5163331 5163352 5163336 5163331 -
ctaaacctcttaaaattcccca

SEQ ID NO: 154282 - DNA, 22 bp, Artificial Sequence
  Synthetic oligonucleotide; TTC chr11 5163330 5163351 5163335 5163330 -
taaacctcttaaaattccccaa

SEQ ID NO: 154283 - DNA, 22 bp, Artificial Sequence
  Synthetic oligonucleotide; CTA chr11 5163328 5163349 5163333 5163328 -
aacctcttaaaattccccaact

SEQ ID NO: 154284 - DNA, 22 bp, Artificial Sequence
  Synthetic oligonucleotide; CTC chr11 5163322 5163343 5163327 5163322 -
ttaaaattccccaactctggtg

SEQ ID NO: 154285 - DNA, 22 bp, Artificial Sequence
  Synthetic oligonucleotide; CTT chr11 5163320 5163341 5163325 5163320 -
aaaattccccaactctggtgct

SEQ ID NO: 154286 - DNA, 22 bp, Artificial Sequence
  Synthetic oligonucleotide; TTA chr11 5163319 5163340 5163324 5163319 -
aaattccccaactctggtgcta

SEQ ID NO: 154287 - DNA, 22 bp, Artificial Sequence
  Synthetic oligonucleotide; TTC chr11 5163313 5163334 5163318 5163313 -
cccaactctggtgctaaccgag

SEQ ID NO: 154288 - DNA, 22 bp, Artificial Sequence
  Synthetic oligonucleotide; CTC chr11 5163305 5163326 5163310 5163305 -
tggtgctaaccgagacgatact

SEQ ID NO: 154289 - DNA, 22 bp, Artificial Sequence
  Synthetic oligonucleotide; CTG chr11 5163303 5163324 5163308 5163303 -
gtgctaaccgagacgatactct

SEQ ID NO: 154290 - DNA, 22 bp, Artificial Sequence
  Synthetic oligonucleotide; CTA chr11 5163297 5163318 5163302 5163297 -
accgagacgatactcttttaag

SEQ ID NO: 154291 - DNA, 22 bp, Artificial Sequence
  Synthetic oligonucleotide; CTC chr11 5163282 5163303 5163287 5163282 -
ttttaagcactcctttttcatt

SEQ ID NO: 154292 - DNA, 22 bp, Artificial Sequence
  Synthetic oligonucleotide; CTT chr11 5163280 5163301 5163285 5163280 -
ttaagcactcctttttcattat

SEQ ID NO: 154293 - DNA, 22 bp, Artificial Sequence
  Synthetic oligonucleotide; TTT chr11 5163279 5163300 5163284 5163279 -
taagcactcctttttcattatc

SEQ ID NO: 154294 - DNA, 22 bp, Artificial Sequence
  Synthetic oligonucleotide; TTT chr11 5163278 5163299 5163283 5163278 -
aagcactcctttttcattatcc

SEQ ID NO: 154295 - DNA, 22 bp, Artificial Sequence
  Synthetic oligonucleotide; TTA chr11 5163277 5163298 5163282 5163277 -
agcactcctttttcattatccc

SEQ ID NO: 154296 - DNA, 22 bp, Artificial Sequence
  Synthetic oligonucleotide; CTC chr11 5163270 5163291 5163275 5163270 -
ctttttcattatccccacctgc

SEQ ID NO: 154297 - DNA, 22 bp, Artificial Sequence
  Synthetic oligonucleotide; CTT chr11 5163267 5163288 5163272 5163267 -
tttcattatccccacctgccag

SEQ ID NO: 154298 - DNA, 22 bp, Artificial Sequence
  Synthetic oligonucleotide; TTT chr11 5163266 5163287 5163271 5163266 -
ttcattatccccacctgccagt

SEQ ID NO: 154299 - DNA, 22 bp, Artificial Sequence
  Synthetic oligonucleotide; TTT chr11 5163265 5163286 5163270 5163265 -
tcattatccccacctgccagtt

SEQ ID NO: 154300 - DNA, 22 bp, Artificial Sequence
  Synthetic oligonucleotide; TTT chr11 5163264 5163285 5163269 5163264 -
cattatccccacctgccagttc

SEQ ID NO: 154301 - DNA, 22 bp, Artificial Sequence
  Synthetic oligonucleotide; TTC chr11 5163263 5163284 5163268 5163263 -
attatccccacctgccagttcc

SEQ ID NO: 154302 - DNA, 22 bp, Artificial Sequence
  Synthetic oligonucleotide; TTA chr11 5163259 5163280 5163264 5163259 -
tccccacctgccagttccctta

SEQ ID NO: 154303 - DNA, 22 bp, Artificial Sequence
  Synthetic oligonucleotide; CTG chr11 5163249 5163270 5163254 5163249 -
ccagttcccttattaggccgag

SEQ ID NO: 154304 - DNA, 22 bp, Artificial Sequence
  Synthetic oligonucleotide; TTC chr11 5163242 5163263 5163247 5163242 -
ccttattaggccgagacacttt

SEQ ID NO: 154305 - DNA, 22 bp, Artificial Sequence
  Synthetic oligonucleotide; CTT chr11 5163238 5163259 5163243 5163238 -
attaggccgagacactttaact

SEQ ID NO: 154306 - DNA, 22 bp, Artificial Sequence
  Synthetic oligonucleotide; TTA chr11 5163237 5163258 5163242 5163237 -
ttaggccgagacactttaacta

SEQ ID NO: 154307 - DNA, 22 bp, Artificial Sequence
  Synthetic oligonucleotide; TTA chr11 5163234 5163255 5163239 5163234 -
ggccgagacactttaactaaat

SEQ ID NO: 154308 - DNA, 22 bp, Artificial Sequence
  Synthetic oligonucleotide; CTT chr11 5163221 5163242 5163226 5163221 -
taactaaattatctgcttccct

SEQ ID NO: 154309 - DNA, 22 bp, Artificial Sequence
  Synthetic oligonucleotide; TTT chr11 5163220 5163241 5163225 5163220 -
aactaaattatctgcttccctg

SEQ ID NO: 154310 - DNA, 22 bp, Artificial Sequence
  Synthetic oligonucleotide; TTA chr11 5163219 5163240 5163224 5163219 -
actaaattatctgcttccctga

SEQ ID NO: 154311 - DNA, 22 bp, Artificial Sequence
  Synthetic oligonucleotide; CTA chr11 5163215 5163236 5163220 5163215 -
aattatctgcttccctgactat

SEQ ID NO: 154312 - DNA, 22 bp, Artificial Sequence
  Synthetic oligonucleotide; TTA chr11 5163210 5163231 5163215 5163210 -
tctgcttccctgactattcctg

SEQ ID NO: 154313 - DNA, 22 bp, Artificial Sequence
  Synthetic oligonucleotide; CTG chr11 5163206 5163227 5163211 5163206 -
cttccctgactattcctgggct

SEQ ID NO: 154314 - DNA, 22 bp, Artificial Sequence
  Synthetic oligonucleotide; CTT chr11 5163203 5163224 5163208 5163203 -
ccctgactattcctgggctaca

SEQ ID NO: 154315 - DNA, 22 bp, Artificial Sequence
  Synthetic oligonucleotide; TTC chr11 5163202 5163223 5163207 5163202 -
cctgactattcctgggctacag

SEQ ID NO: 154316 - DNA, 22 bp, Artificial Sequence
  Synthetic oligonucleotide; CTG chr11 5163198 5163219 5163203 5163198 -
actattcctgggctacagccat

SEQ ID NO: 154317 - DNA, 22 bp, Artificial Sequence
  Synthetic oligonucleotide; CTA chr11 5163194 5163215 5163199 5163194 -
ttcctgggctacagccatacct

SEQ ID NO: 154318 - DNA, 22 bp, Artificial Sequence
  Synthetic oligonucleotide; TTC chr11 5163191 5163212 5163196 5163191 -
ctgggctacagccatacctcat

SEQ ID NO: 154319 - DNA, 22 bp, Artificial Sequence
  Synthetic oligonucleotide; CTG chr11 5163188 5163209 5163193 5163188 -
ggctacagccatacctcattgc

SEQ ID NO: 154320 - DNA, 22 bp, Artificial Sequence
  Synthetic oligonucleotide; CTA chr11 5163183 5163204 5163188 5163183 -
cagccatacctcattgccatgt

SEQ ID NO: 154321 - DNA, 22 bp, Artificial Sequence
  Synthetic oligonucleotide; CTC chr11 5163171 5163192 5163176 5163171 -
attgccatgttttcccccagtt

SEQ ID NO: 154322 - DNA, 22 bp, Artificial Sequence
  Synthetic oligonucleotide; TTG chr11 5163167 5163188 5163172 5163167 -
ccatgttttcccccagttcaaa

SEQ ID NO: 154323 - DNA, 22 bp, Artificial Sequence
  Synthetic oligonucleotide; TTT chr11 5163159 5163180 5163164 5163159 -
tcccccagttcaaagcctcctt

SEQ ID NO: 154324 - DNA, 22 bp, Artificial Sequence
  Synthetic oligonucleotide; TTT chr11 5163158 5163179 5163163 5163158 -
cccccagttcaaagcctccttc

SEQ ID NO: 154325 - DNA, 22 bp, Artificial Sequence
  Synthetic oligonucleotide; TTC chr11 5163157 5163178 5163162 5163157 -
ccccagttcaaagcctccttca

SEQ ID NO: 154326 - DNA, 22 bp, Artificial Sequence
  Synthetic oligonucleotide; TTC chr11 5163148 5163169 5163153 5163148 -
aaagcctccttcacatcctccc

SEQ ID NO: 154327 - DNA, 22 bp, Artificial Sequence
  Synthetic oligonucleotide; CTC chr11 5163140 5163161 5163145 5163140 -
cttcacatcctccccttgtatc

SEQ ID NO: 154328 - DNA, 22 bp, Artificial Sequence
  Synthetic oligonucleotide; CTT chr11 5163137 5163158 5163142 5163137 -
cacatcctccccttgtatctcc

SEQ ID NO: 154329 - DNA, 22 bp, Artificial Sequence
  Synthetic oligonucleotide; TTC chr11 5163136 5163157 5163141 5163136 -
acatcctccccttgtatctccc

SEQ ID NO: 154330 - DNA, 22 bp, Artificial Sequence
  Synthetic oligonucleotide; CTC chr11 5163128 5163149 5163133 5163128 -
cccttgtatctccccaccttaa

SEQ ID NO: 154331 - DNA, 22 bp, Artificial Sequence
  Synthetic oligonucleotide; CTT chr11 5163123 5163144 5163128 5163123 -
gtatctccccaccttaatccac

SEQ ID NO: 154332 - DNA, 22 bp, Artificial Sequence
  Synthetic oligonucleotide; TTG chr11 5163122 5163143 5163127 5163122 -
tatctccccaccttaatccaca

SEQ ID NO: 154333 - DNA, 22 bp, Artificial Sequence
  Synthetic oligonucleotide; CTC chr11 5163116 5163137 5163121 5163116 -
cccaccttaatccacaagtata

SEQ ID NO: 154334 - DNA, 22 bp, Artificial Sequence
  Synthetic oligonucleotide; CTT chr11 5163108 5163129 5163113 5163108 -
aatccacaagtataagacacct

SEQ ID NO: 154335 - DNA, 22 bp, Artificial Sequence
  Synthetic oligonucleotide; TTA chr11 5163107 5163128 5163112 5163107 -
atccacaagtataagacacctc

SEQ ID NO: 154336 - DNA, 22 bp, Artificial Sequence
  Synthetic oligonucleotide; CTC chr11 5163085 5163106 5163090 5163085 -
tacttcctccttcgcgaccgat

SEQ ID NO: 154337 - DNA, 22 bp, Artificial Sequence
  Synthetic oligonucleotide; CTA chr11 5163083 5163104 5163088 5163083 -
cttcctccttcgcgaccgatca

SEQ ID NO: 154338 - DNA, 22 bp, Artificial Sequence
  Synthetic oligonucleotide; CTT chr11 5163080 5163101 5163085 5163080 -
cctccttcgcgaccgatcatgc

SEQ ID NO: 154339 - DNA, 22 bp, Artificial Sequence
  Synthetic oligonucleotide; TTC chr11 5163079 5163100 5163084 5163079 -
ctccttcgcgaccgatcatgcg

SEQ ID NO: 154340 - DNA, 22 bp, Artificial Sequence
  Synthetic oligonucleotide; CTC chr11 5163076 5163097 5163081 5163076 -
cttcgcgaccgatcatgcgccc

SEQ ID NO: 154341 - DNA, 22 bp, Artificial Sequence
  Synthetic oligonucleotide; CTT chr11 5163073 5163094 5163078 5163073 -
cgcgaccgatcatgcgcccctt

SEQ ID NO: 154342 - DNA, 22 bp, Artificial Sequence
  Synthetic oligonucleotide; TTC chr11 5163072 5163093 5163077 5163072 -
gcgaccgatcatgcgcccctta

SEQ ID NO: 154343 - DNA, 22 bp, Artificial Sequence
  Synthetic oligonucleotide; CTT chr11 5163051 5163072 5163056 5163051 -
accatcccattaaaacctaatc

SEQ ID NO: 154344 - DNA, 22 bp, Artificial Sequence
  Synthetic oligonucleotide; TTA chr11 5163050 5163071 5163055 5163050 -
ccatcccattaaaacctaatca

SEQ ID NO: 154345 - DNA, 22 bp, Artificial Sequence
  Synthetic oligonucleotide; TTA chr11 5163039 5163060 5163044 5163039 -
aaacctaatcactcttaccccg

SEQ ID NO: 154346 - DNA, 22 bp, Artificial Sequence
  Synthetic oligonucleotide; CTA chr11 5163032 5163053 5163037 5163032 -
atcactcttaccccgctcaatg

SEQ ID NO: 154347 - DNA, 22 bp, Artificial Sequence
  Synthetic oligonucleotide; CTC chr11 5163025 5163046 5163030 5163025 -
ttaccccgctcaatgccagtat

SEQ ID NO: 154348 - DNA, 22 bp, Artificial Sequence
  Synthetic oligonucleotide; CTT chr11 5163023 5163044 5163028 5163023 -
accccgctcaatgccagtatcc

SEQ ID NO: 154349 - DNA, 22 bp, Artificial Sequence
  Synthetic oligonucleotide; TTA chr11 5163022 5163043 5163027 5163022 -
ccccgctcaatgccagtatccc

SEQ ID NO: 154350 - DNA, 22 bp, Artificial Sequence
  Synthetic oligonucleotide; CTC chr11 5163014 5163035 5163019 5163014 -
aatgccagtatcccatcccaca

SEQ ID NO: 154351 - DNA, 22 bp, Artificial Sequence
  Synthetic oligonucleotide; CTT chr11 5162984 5163005 5162989 5162984 -
tgaaaggattaaagcctgttat

SEQ ID NO: 154352 - DNA, 22 bp, Artificial Sequence
  Synthetic oligonucleotide; TTT chr11 5162983 5163004 5162988 5162983 -
gaaaggattaaagcctgttatt

SEQ ID NO: 154353 - DNA, 22 bp, Artificial Sequence
  Synthetic oligonucleotide; TTG chr11 5162982 5163003 5162987 5162982 -
aaaggattaaagcctgttatta

SEQ ID NO: 154354 - DNA, 22 bp, Artificial Sequence
  Synthetic oligonucleotide; TTA chr11 5162973 5162994 5162978 5162973 -
aagcctgttattacttgcctgt

SEQ ID NO: 154355 - DNA, 22 bp, Artificial Sequence
  Synthetic oligonucleotide; CTG chr11 5162966 5162987 5162971 5162966 -
ttattacttgcctgttacagca

SEQ ID NO: 154356 - DNA, 22 bp, Artificial Sequence
  Synthetic oligonucleotide; TTA chr11 5162963 5162984 5162968 5162963 -
ttacttgcctgttacagcatgg

SEQ ID NO: 154357 - DNA, 22 bp, Artificial Sequence
  Synthetic oligonucleotide; TTA chr11 5162960 5162981 5162965 5162960 -
cttgcctgttacagcatggcct

SEQ ID NO: 154358 - DNA, 22 bp, Artificial Sequence
  Synthetic oligonucleotide; CTT chr11 5162957 5162978 5162962 5162957 -
gcctgttacagcatggcctttt

SEQ ID NO: 154359 - DNA, 22 bp, Artificial Sequence
  Synthetic oligonucleotide; TTG chr11 5162956 5162977 5162961 5162956 -
cctgttacagcatggcctttta

SEQ ID NO: 154360 - DNA, 22 bp, Artificial Sequence
  Synthetic oligonucleotide; CTG chr11 5162952 5162973 5162957 5162952 -
ttacagcatggccttttaaagc

SEQ ID NO: 154361 - DNA, 22 bp, Artificial Sequence
  Synthetic oligonucleotide; TTA chr11 5162949 5162970 5162954 5162949 -
cagcatggccttttaaagccta

SEQ ID NO: 154362 - DNA, 22 bp, Artificial Sequence
  Synthetic oligonucleotide; CTT chr11 5162937 5162958 5162942 5162937 -
ttaaagcctataaactctcctt

SEQ ID NO: 154363 - DNA, 22 bp, Artificial Sequence
  Synthetic oligonucleotide; TTT chr11 5162936 5162957 5162941 5162936 -
taaagcctataaactctcctta

SEQ ID NO: 154364 - DNA, 22 bp, Artificial Sequence
  Synthetic oligonucleotide; TTT chr11 5162935 5162956 5162940 5162935 -
aaagcctataaactctccttac

SEQ ID NO: 154365 - DNA, 22 bp, Artificial Sequence
  Synthetic oligonucleotide; TTA chr11 5162934 5162955 5162939 5162934 -
aagcctataaactctccttacc

SEQ ID NO: 154366 - DNA, 22 bp, Artificial Sequence
  Synthetic oligonucleotide; CTA chr11 5162927 5162948 5162932 5162927 -
taaactctccttaccattcccc

SEQ ID NO: 154367 - DNA, 22 bp, Artificial Sequence
  Synthetic oligonucleotide; CTC chr11 5162920 5162941 5162925 5162920 -
tccttaccattcccccatttta

SEQ ID NO: 154368 - DNA, 22 bp, Artificial Sequence
  Synthetic oligonucleotide; CTC chr11 5162918 5162939 5162923 5162918 -
cttaccattcccccattttacc

SEQ ID NO: 154369 - DNA, 22 bp, Artificial Sequence
  Synthetic oligonucleotide; CTT chr11 5162915 5162936 5162920 5162915 -
accattcccccattttacctgt

SEQ ID NO: 154370 - DNA, 22 bp, Artificial Sequence
  Synthetic oligonucleotide; TTA chr11 5162914 5162935 5162919 5162914 -
ccattcccccattttacctgtc

SEQ ID NO: 154371 - DNA, 22 bp, Artificial Sequence
  Synthetic oligonucleotide; TTC chr11 5162908 5162929 5162913 5162908 -
ccccattttacctgtcctaaaa

SEQ ID NO: 154372 - DNA, 22 bp, Artificial Sequence
  Synthetic oligonucleotide; TTT chr11 5162900 5162921 5162905 5162900 -
tacctgtcctaaaaccagacaa

SEQ ID NO: 154373 - DNA, 22 bp, Artificial Sequence
  Synthetic oligonucleotide; TTT chr11 5162899 5162920 5162904 5162899 -
acctgtcctaaaaccagacaag

SEQ ID NO: 154374 - DNA, 22 bp, Artificial Sequence
  Synthetic oligonucleotide; TTA chr11 5162898 5162919 5162903 5162898 -
cctgtcctaaaaccagacaagc

SEQ ID NO: 154375 - DNA, 22 bp, Artificial Sequence
  Synthetic oligonucleotide; CTG chr11 5162894 5162915 5162899 5162894 -
tcctaaaaccagacaagcctta

SEQ ID NO: 154376 - DNA, 22 bp, Artificial Sequence
  Synthetic oligonucleotide; CTA chr11 5162889 5162910 5162894 5162889 -
aaaccagacaagccttacaggt

SEQ ID NO: 154377 - DNA, 22 bp, Artificial Sequence
  Synthetic oligonucleotide; CTT chr11 5162873 5162894 5162878 5162873 -
acaggttagttcagaatctgca

SEQ ID NO: 154378 - DNA, 22 bp, Artificial Sequence
  Synthetic oligonucleotide; TTA chr11 5162872 5162893 5162877 5162872 -
caggttagttcagaatctgcat

SEQ ID NO: 154379 - DNA, 22 bp, Artificial Sequence
  Synthetic oligonucleotide; TTA chr11 5162865 5162886 5162870 5162865 -
gttcagaatctgcatcttatca

SEQ ID NO: 154380 - DNA, 22 bp, Artificial Sequence
  Synthetic oligonucleotide; TTC chr11 5162861 5162882 5162866 5162861 -
agaatctgcatcttatcaacca

SEQ ID NO: 154381 - DNA, 22 bp, Artificial Sequence
  Synthetic oligonucleotide; CTG chr11 5162853 5162874 5162858 5162853 -
catcttatcaaccaaattgttt

SEQ ID NO: 154382 - DNA, 22 bp, Artificial Sequence
  Synthetic oligonucleotide; CTT chr11 5162847 5162868 5162852 5162847 -
atcaaccaaattgttttgccta

SEQ ID NO: 154383 - DNA, 22 bp, Artificial Sequence
  Synthetic oligonucleotide; TTA chr11 5162846 5162867 5162851 5162846 -
tcaaccaaattgttttgcctat

SEQ ID NO: 154384 - DNA, 22 bp, Artificial Sequence
  Synthetic oligonucleotide; TTG chr11 5162834 5162855 5162839 5162834 -
ttttgcctatccaccccatggt

SEQ ID NO: 154385 - DNA, 22 bp, Artificial Sequence
  Synthetic oligonucleotide; TTT chr11 5162831 5162852 5162836 5162831 -
tgcctatccaccccatggtgcc

SEQ ID NO: 154386 - DNA, 22 bp, Artificial Sequence
  Synthetic oligonucleotide; TTT chr11 5162830 5162851 5162835 5162830 -
gcctatccaccccatggtgcca

SEQ ID NO: 154387 - DNA, 22 bp, Artificial Sequence
  Synthetic oligonucleotide; TTG chr11 5162829 5162850 5162834 5162829 -
cctatccaccccatggtgccaa

SEQ ID NO: 154388 - DNA, 22 bp, Artificial Sequence
  Synthetic oligonucleotide; CTA chr11 5162825 5162846 5162830 5162825 -
tccaccccatggtgccaaaccc

SEQ ID NO: 154389 - DNA, 22 bp, Artificial Sequence
  Synthetic oligonucleotide; CTC chr11 5162795 5162816 5162800 5162795 -
tcctatcctcaatacctccatc

SEQ ID NO: 154390 - DNA, 22 bp, Artificial Sequence
  Synthetic oligonucleotide; CTC chr11 5162793 5162814 5162798 5162793 -
ctatcctcaatacctccatcta

SEQ ID NO: 154391 - DNA, 22 bp, Artificial Sequence
  Synthetic oligonucleotide; CTA chr11 5162790 5162811 5162795 5162790 -
tcctcaatacctccatctataa

SEQ ID NO: 154392 - DNA, 22 bp, Artificial Sequence
  Synthetic oligonucleotide; CTC chr11 5162785 5162806 5162790 5162785 -
aatacctccatctataacccat

SEQ ID NO: 154393 - DNA, 22 bp, Artificial Sequence
  Synthetic oligonucleotide; CTC chr11 5162777 5162798 5162782 5162777 -
catctataacccattattctgt

SEQ ID NO: 154394 - DNA, 22 bp, Artificial Sequence
  Synthetic oligonucleotide; CTA chr11 5162771 5162792 5162776 5162771 -
taacccattattctgttctgga

SEQ ID NO: 154395 - DNA, 22 bp, Artificial Sequence
  Synthetic oligonucleotide; TTA chr11 5162761 5162782 5162766 5162761 -
ttctgttctggatctcaaacat

SEQ ID NO: 154396 - DNA, 22 bp, Artificial Sequence
  Synthetic oligonucleotide; TTC chr11 5162758 5162779 5162763 5162758 -
tgttctggatctcaaacatgct

SEQ ID NO: 154397 - DNA, 22 bp, Artificial Sequence
  Synthetic oligonucleotide; CTG chr11 5162756 5162777 5162761 5162756 -
ttctggatctcaaacatgcttt

SEQ ID NO: 154398 - DNA, 22 bp, Artificial Sequence
  Synthetic oligonucleotide; TTC chr11 5162753 5162774 5162758 5162753 -
tggatctcaaacatgctttctt

SEQ ID NO: 154399 - DNA, 22 bp, Artificial Sequence
  Synthetic oligonucleotide; CTG chr11 5162751 5162772 5162756 5162751 -
gatctcaaacatgctttcttta

SEQ ID NO: 154400 - DNA, 22 bp, Artificial Sequence
  Synthetic oligonucleotide; CTC chr11 5162745 5162766 5162750 5162745 -
aaacatgctttctttactattc

SEQ ID NO: 154401 - DNA, 22 bp, Artificial Sequence
  Synthetic oligonucleotide; CTT chr11 5162735 5162756 5162740 5162735 -
tctttactattcctttgcaccc

SEQ ID NO: 154402 - DNA, 22 bp, Artificial Sequence
  Synthetic oligonucleotide; TTT chr11 5162734 5162755 5162739 5162734 -
ctttactattcctttgcaccct

SEQ ID NO: 154403 - DNA, 22 bp, Artificial Sequence
  Synthetic oligonucleotide; TTC chr11 5162733 5162754 5162738 5162733 -
tttactattcctttgcaccctt

SEQ ID NO: 154404 - DNA, 22 bp, Artificial Sequence
  Synthetic oligonucleotide; CTT chr11 5162731 5162752 5162736 5162731 -
tactattcctttgcacccttca

SEQ ID NO: 154405 - DNA, 22 bp, Artificial Sequence
  Synthetic oligonucleotide; TTT chr11 5162730 5162751 5162735 5162730 -
actattcctttgcacccttcat

SEQ ID NO: 154406 - DNA, 22 bp, Artificial Sequence
  Synthetic oligonucleotide; TTA chr11 5162729 5162750 5162734 5162729 -
ctattcctttgcacccttcatt

SEQ ID NO: 154407 - DNA, 22 bp, Artificial Sequence
  Synthetic oligonucleotide; CTA chr11 5162726 5162747 5162731 5162726 -
ttcctttgcacccttcattcca

SEQ ID NO: 154408 - DNA, 22 bp, Artificial Sequence
  Synthetic oligonucleotide; TTC chr11 5162723 5162744 5162728 5162723 -
ctttgcacccttcattccagcc

SEQ ID NO: 154409 - DNA, 22 bp, Artificial Sequence
  Synthetic oligonucleotide; CTT chr11 5162720 5162741 5162725 5162720 -
tgcacccttcattccagcctct

SEQ ID NO: 154410 - DNA, 22 bp, Artificial Sequence
  Synthetic oligonucleotide; TTT chr11 5162719 5162740 5162724 5162719 -
gcacccttcattccagcctctc

SEQ ID NO: 154411 - DNA, 22 bp, Artificial Sequence
  Synthetic oligonucleotide; TTG chr11 5162718 5162739 5162723 5162718 -
cacccttcattccagcctctct

SEQ ID NO: 154412 - DNA, 22 bp, Artificial Sequence
  Synthetic oligonucleotide; CTT chr11 5162711 5162732 5162716 5162711 -
cattccagcctctcttcgcttt

SEQ ID NO: 154413 - DNA, 22 bp, Artificial Sequence
  Synthetic oligonucleotide; TTC chr11 5162710 5162731 5162715 5162710 -
attccagcctctcttcgctttc

SEQ ID NO: 154414 - DNA, 22 bp, Artificial Sequence
  Synthetic oligonucleotide; TTC chr11 5162706 5162727 5162711 5162706 -
cagcctctcttcgctttcactt

SEQ ID NO: 154415 - DNA, 22 bp, Artificial Sequence
  Synthetic oligonucleotide; CTC chr11 5162699 5162720 5162704 5162699 -
tcttcgctttcacttggactga

SEQ ID NO: 154416 - DNA, 22 bp, Artificial Sequence
  Synthetic oligonucleotide; CTC chr11 5162697 5162718 5162702 5162697 -
ttcgctttcacttggactgaca

SEQ ID NO: 154417 - DNA, 22 bp, Artificial Sequence
  Synthetic oligonucleotide; CTT chr11 5162695 5162716 5162700 5162695 -
cgctttcacttggactgacact

SEQ ID NO: 154418 - DNA, 22 bp, Artificial Sequence
  Synthetic oligonucleotide; TTC chr11 5162694 5162715 5162699 5162694 -
gctttcacttggactgacactg

SEQ ID NO: 154419 - DNA, 22 bp, Artificial Sequence
  Synthetic oligonucleotide; CTT chr11 5162690 5162711 5162695 5162690 -
tcacttggactgacactgacac

SEQ ID NO: 154420 - DNA, 22 bp, Artificial Sequence
  Synthetic oligonucleotide; TTT chr11 5162689 5162710 5162694 5162689 -
cacttggactgacactgacacc

SEQ ID NO: 154421 - DNA, 22 bp, Artificial Sequence
  Synthetic oligonucleotide; TTC chr11 5162688 5162709 5162693 5162688 -
acttggactgacactgacaccc

SEQ ID NO: 154422 - DNA, 22 bp, Artificial Sequence
  Synthetic oligonucleotide; CTT chr11 5162684 5162705 5162689 5162684 -
ggactgacactgacacccatta

SEQ ID NO: 154423 - DNA, 22 bp, Artificial Sequence
  Synthetic oligonucleotide; TTG chr11 5162683 5162704 5162688 5162683 -
gactgacactgacacccattag

SEQ ID NO: 154424 - DNA, 22 bp, Artificial Sequence
  Synthetic oligonucleotide; CTG chr11 5162678 5162699 5162683 5162678 -
acactgacacccattaggctca

SEQ ID NO: 154425 - DNA, 22 bp, Artificial Sequence
  Synthetic oligonucleotide; CTG chr11 5162672 5162693 5162677 5162672 -
acacccattaggctcagcaaat

SEQ ID NO: 154426 - DNA, 22 bp, Artificial Sequence
  Synthetic oligonucleotide; TTA chr11 5162662 5162683 5162667 5162662 -
ggctcagcaaattacctgggct

SEQ ID NO: 154427 - DNA, 22 bp, Artificial Sequence
  Synthetic oligonucleotide; CTC chr11 5162657 5162678 5162662 5162657 -
agcaaattacctgggctgtact

SEQ ID NO: 154428 - DNA, 22 bp, Artificial Sequence
  Synthetic oligonucleotide; TTA chr11 5162648 5162669 5162653 5162648 -
cctgggctgtactgctgcaagg

SEQ ID NO: 154429 - DNA, 22 bp, Artificial Sequence
  Synthetic oligonucleotide; CTG chr11 5162644 5162665 5162649 5162644 -
ggctgtactgctgcaaggcttc

SEQ ID NO: 154430 - DNA, 22 bp, Artificial Sequence
  Synthetic oligonucleotide; CTG chr11 5162639 5162660 5162644 5162639 -
tactgctgcaaggcttcacaga

SEQ ID NO: 154431 - DNA, 22 bp, Artificial Sequence
  Synthetic oligonucleotide; CTG chr11 5162634 5162655 5162639 5162634 -
ctgcaaggcttcacagacagac

SEQ ID NO: 154432 - DNA, 22 bp, Artificial Sequence
  Synthetic oligonucleotide; CTG chr11 5162631 5162652 5162636 5162631 -
caaggcttcacagacagacccc

SEQ ID NO: 154433 - DNA, 22 bp, Artificial Sequence
  Synthetic oligonucleotide; CTT chr11 5162623 5162644 5162628 5162623 -
cacagacagaccccattacttc

SEQ ID NO: 154434 - DNA, 22 bp, Artificial Sequence
  Synthetic oligonucleotide; TTC chr11 5162622 5162643 5162627 5162622 -
acagacagaccccattacttca

SEQ ID NO: 154435 - DNA, 22 bp, Artificial Sequence
  Synthetic oligonucleotide; TTA chr11 5162605 5162626 5162610 5162605 -
cttcagtcaagcccaaatttca

SEQ ID NO: 154436 - DNA, 22 bp, Artificial Sequence
  Synthetic oligonucleotide; CTT chr11 5162602 5162623 5162607 5162602 -
cagtcaagcccaaatttcatcc

SEQ ID NO: 154437 - DNA, 22 bp, Artificial Sequence
  Synthetic oligonucleotide; TTC chr11 5162601 5162622 5162606 5162601 -
agtcaagcccaaatttcatcct

SEQ ID NO: 154438 - DNA, 22 bp, Artificial Sequence
  Synthetic oligonucleotide; TTT chr11 5162585 5162606 5162590 5162585 -
catcctcatgtgttacctatct

SEQ ID NO: 154439 - DNA, 22 bp, Artificial Sequence
  Synthetic oligonucleotide; TTC chr11 5162584 5162605 5162589 5162584 -
atcctcatgtgttacctatctc

SEQ ID NO: 154440 - DNA, 22 bp, Artificial Sequence
  Synthetic oligonucleotide; CTC chr11 5162578 5162599 5162583 5162578 -
atgtgttacctatctcggcata

SEQ ID NO: 154441 - DNA, 22 bp, Artificial Sequence
  Synthetic oligonucleotide; TTA chr11 5162570 5162591 5162575 5162570 -
cctatctcggcataattctcat

SEQ ID NO: 154442 - DNA, 22 bp, Artificial Sequence
  Synthetic oligonucleotide; CTA chr11 5162566 5162587 5162571 5162566 -
tctcggcataattctcataaaa

SEQ ID NO: 154443 - DNA, 22 bp, Artificial Sequence
  Synthetic oligonucleotide; CTC chr11 5162562 5162583 5162567 5162562 -
ggcataattctcataaaaacac

SEQ ID NO: 154444 - DNA, 22 bp, Artificial Sequence
  Synthetic oligonucleotide; TTC chr11 5162552 5162573 5162557 5162552 -
tcataaaaacacacgtgctctc

SEQ ID NO: 154445 - DNA, 22 bp, Artificial Sequence
  Synthetic oligonucleotide; CTC chr11 5162550 5162571 5162555 5162550 -
ataaaaacacacgtgctctccc

SEQ ID NO: 154446 - DNA, 22 bp, Artificial Sequence
  Synthetic oligonucleotide; CTC chr11 5162532 5162553 5162537 5162532 -
tccctgctgattgtgtccgatt

SEQ ID NO: 154447 - DNA, 22 bp, Artificial Sequence
  Synthetic oligonucleotide; CTC chr11 5162530 5162551 5162535 5162530 -
cctgctgattgtgtccgattaa

SEQ ID NO: 154448 - DNA, 22 bp, Artificial Sequence
  Synthetic oligonucleotide; CTG chr11 5162526 5162547 5162531 5162526 -
ctgattgtgtccgattaatctc

SEQ ID NO: 154449 - DNA, 22 bp, Artificial Sequence
  Synthetic oligonucleotide; CTG chr11 5162523 5162544 5162528 5162523 -
attgtgtccgattaatctccca

SEQ ID NO: 154450 - DNA, 22 bp, Artificial Sequence
  Synthetic oligonucleotide; TTG chr11 5162519 5162540 5162524 5162519 -
tgtccgattaatctcccaaacc

SEQ ID NO: 154451 - DNA, 22 bp, Artificial Sequence
  Synthetic oligonucleotide; TTA chr11 5162509 5162530 5162514 5162509 -
atctcccaaacctcaatccctt

SEQ ID NO: 154452 - DNA, 22 bp, Artificial Sequence
  Synthetic oligonucleotide; CTC chr11 5162504 5162525 5162509 5162504 -
ccaaacctcaatcccttctaca

SEQ ID NO: 154453 - DNA, 22 bp, Artificial Sequence
  Synthetic oligonucleotide; CTC chr11 5162495 5162516 5162500 5162495 -
aatcccttctacaaaacaacaa

SEQ ID NO: 154454 - DNA, 22 bp, Artificial Sequence
  Synthetic oligonucleotide; CTT chr11 5162487 5162508 5162492 5162487 -
ctacaaaacaacaactcctttc

SEQ ID NO: 154455 - DNA, 22 bp, Artificial Sequence
  Synthetic oligonucleotide; TTC chr11 5162486 5162507 5162491 5162486 -
tacaaaacaacaactcctttcc

SEQ ID NO: 154456 - DNA, 22 bp, Artificial Sequence
  Synthetic oligonucleotide; CTA chr11 5162484 5162505 5162489 5162484 -
caaaacaacaactcctttcctt

SEQ ID NO: 154457 - DNA, 22 bp, Artificial Sequence
  Synthetic oligonucleotide; CTC chr11 5162470 5162491 5162475 5162470 -
ctttccttcctaggcatagtta

SEQ ID NO: 154458 - DNA, 22 bp, Artificial Sequence
  Synthetic oligonucleotide; CTT chr11 5162467 5162488 5162472 5162467 -
tccttcctaggcatagttagtg

SEQ ID NO: 154459 - DNA, 22 bp, Artificial Sequence
  Synthetic oligonucleotide; TTT chr11 5162466 5162487 5162471 5162466 -
ccttcctaggcatagttagtgc

SEQ ID NO: 154460 - DNA, 22 bp, Artificial Sequence
  Synthetic oligonucleotide; TTC chr11 5162465 5162486 5162470 5162465 -
cttcctaggcatagttagtgcg

SEQ ID NO: 154461 - DNA, 22 bp, Artificial Sequence
  Synthetic oligonucleotide; CTT chr11 5162462 5162483 5162467 5162462 -
cctaggcatagttagtgcggtc

SEQ ID NO: 154462 - DNA, 22 bp, Artificial Sequence
  Synthetic oligonucleotide; TTC chr11 5162461 5162482 5162466 5162461 -
ctaggcatagttagtgcggtca

SEQ ID NO: 154463 - DNA, 22 bp, Artificial Sequence
  Synthetic oligonucleotide; CTA chr11 5162458 5162479 5162463 5162458 -
ggcatagttagtgcggtcagaa

SEQ ID NO: 154464 - DNA, 22 bp, Artificial Sequence
  Synthetic oligonucleotide; TTA chr11 5162448 5162469 5162453 5162448 -
gtgcggtcagaattcttacaca

SEQ ID NO: 154465 - DNA, 22 bp, Artificial Sequence
  Synthetic oligonucleotide; TTC chr11 5162433 5162454 5162438 5162433 -
ttacacaagatccaggactgca

SEQ ID NO: 154466 - DNA, 22 bp, Artificial Sequence
  Synthetic oligonucleotide; CTT chr11 5162431 5162452 5162436 5162431 -
acacaagatccaggactgcacc

SEQ ID NO: 154467 - DNA, 22 bp, Artificial Sequence
  Synthetic oligonucleotide; TTA chr11 5162430 5162451 5162435 5162430 -
cacaagatccaggactgcaccc

SEQ ID NO: 154468 - DNA, 22 bp, Artificial Sequence
  Synthetic oligonucleotide; CTG chr11 5162413 5162434 5162418 5162413 -
caccctgtagcctttctgtcca

SEQ ID NO: 154469 - DNA, 22 bp, Artificial Sequence
  Synthetic oligonucleotide; CTG chr11 5162406 5162427 5162411 5162406 -
tagcctttctgtccaaataact

SEQ ID NO: 154470 - DNA, 22 bp, Artificial Sequence
  Synthetic oligonucleotide; CTT chr11 5162399 5162420 5162404 5162399 -
tctgtccaaataacttgacctt

SEQ ID NO: 154471 - DNA, 22 bp, Artificial Sequence
  Synthetic oligonucleotide; TTT chr11 5162398 5162419 5162403 5162398 -
ctgtccaaataacttgacctta

SEQ ID NO: 154472 - DNA, 22 bp, Artificial Sequence
  Synthetic oligonucleotide; TTC chr11 5162397 5162418 5162402 5162397 -
tgtccaaataacttgaccttac

SEQ ID NO: 154473 - DNA, 22 bp, Artificial Sequence
  Synthetic oligonucleotide; CTG chr11 5162395 5162416 5162400 5162395 -
tccaaataacttgaccttactg

SEQ ID NO: 154474 - DNA, 22 bp, Artificial Sequence
  Synthetic oligonucleotide; CTT chr11 5162383 5162404 5162388 5162383 -
gaccttactgttttagcctagc

SEQ ID NO: 154475 - DNA, 22 bp, Artificial Sequence
  Synthetic oligonucleotide; TTG chr11 5162382 5162403 5162387 5162382 -
accttactgttttagcctagcc

SEQ ID NO: 154476 - DNA, 22 bp, Artificial Sequence
  Synthetic oligonucleotide; CTT chr11 5162377 5162398 5162382 5162377 -
actgttttagcctagccctcag

SEQ ID NO: 154477 - DNA, 22 bp, Artificial Sequence
  Synthetic oligonucleotide; TTA chr11 5162376 5162397 5162381 5162376 -
ctgttttagcctagccctcagg

SEQ ID NO: 154478 - DNA, 22 bp, Artificial Sequence
  Synthetic oligonucleotide; CTG chr11 5162373 5162394 5162378 5162373 -
ttttagcctagccctcaggtct

SEQ ID NO: 154479 - DNA, 22 bp, Artificial Sequence
  Synthetic oligonucleotide; TTT chr11 5162370 5162391 5162375 5162370 -
tagcctagccctcaggtctgca

SEQ ID NO: 154480 - DNA, 22 bp, Artificial Sequence
  Synthetic oligonucleotide; TTT chr11 5162369 5162390 5162374 5162369 -
agcctagccctcaggtctgcat

SEQ ID NO: 154481 - DNA, 22 bp, Artificial Sequence
  Synthetic oligonucleotide; TTA chr11 5162368 5162389 5162373 5162368 -
gcctagccctcaggtctgcatg

SEQ ID NO: 154482 - DNA, 22 bp, Artificial Sequence
  Synthetic oligonucleotide; CTA chr11 5162363 5162384 5162368 5162363 -
gccctcaggtctgcatgcagtg

SEQ ID NO: 154483 - DNA, 22 bp, Artificial Sequence
  Synthetic oligonucleotide; CTC chr11 5162357 5162378 5162362 5162357 -
aggtctgcatgcagtggctgcc

SEQ ID NO: 154484 - DNA, 22 bp, Artificial Sequence
  Synthetic oligonucleotide; CTG chr11 5162350 5162371 5162355 5162350 -
catgcagtggctgccgctgctt

SEQ ID NO: 154485 - DNA, 22 bp, Artificial Sequence
  Synthetic oligonucleotide; CTG chr11 5162337 5162358 5162342 5162337 -
ccgctgctttaatacttttaga

SEQ ID NO: 154486 - DNA, 22 bp, Artificial Sequence
  Synthetic oligonucleotide; CTG chr11 5162331 5162352 5162336 5162331 -
ctttaatacttttagaggccct

SEQ ID NO: 154487 - DNA, 22 bp, Artificial Sequence
  Synthetic oligonucleotide; CTT chr11 5162328 5162349 5162333 5162328 -
taatacttttagaggccctaaa

SEQ ID NO: 154488 - DNA, 22 bp, Artificial Sequence
  Synthetic oligonucleotide; TTT chr11 5162327 5162348 5162332 5162327 -
aatacttttagaggccctaaaa

SEQ ID NO: 154489 - DNA, 22 bp, Artificial Sequence
  Synthetic oligonucleotide; TTA chr11 5162326 5162347 5162331 5162326 -
atacttttagaggccctaaaaa

SEQ ID NO: 154490 - DNA, 22 bp, Artificial Sequence
  Synthetic oligonucleotide; CTT chr11 5162320 5162341 5162325 5162320 -
ttagaggccctaaaaatcacaa

SEQ ID NO: 154491 - DNA, 22 bp, Artificial Sequence
  Synthetic oligonucleotide; TTT chr11 5162319 5162340 5162324 5162319 -
tagaggccctaaaaatcacaaa

SEQ ID NO: 154492 - DNA, 22 bp, Artificial Sequence
  Synthetic oligonucleotide; TTT chr11 5162318 5162339 5162323 5162318 -
agaggccctaaaaatcacaaac

SEQ ID NO: 154493 - DNA, 22 bp, Artificial Sequence
  Synthetic oligonucleotide; TTA chr11 5162317 5162338 5162322 5162317 -
gaggccctaaaaatcacaaact

SEQ ID NO: 154494 - DNA, 22 bp, Artificial Sequence
  Synthetic oligonucleotide; CTA chr11 5162308 5162329 5162313 5162308 -
aaaatcacaaactatgcttagc

SEQ ID NO: 154495 - DNA, 22 bp, Artificial Sequence
  Synthetic oligonucleotide; CTA chr11 5162294 5162315 5162299 5162294 -
tgcttagctcactcttcacatt

SEQ ID NO: 154496 - DNA, 22 bp, Artificial Sequence
  Synthetic oligonucleotide; CTT chr11 5162289 5162310 5162294 5162289 -
agctcactcttcacatttctca

SEQ ID NO: 154497 - DNA, 22 bp, Artificial Sequence
  Synthetic oligonucleotide; TTA chr11 5162288 5162309 5162293 5162288 -
gctcactcttcacatttctcat

SEQ ID NO: 154498 - DNA, 22 bp, Artificial Sequence
  Synthetic oligonucleotide; CTC chr11 5162284 5162305 5162289 5162284 -
actcttcacatttctcataact

SEQ ID NO: 154499 - DNA, 22 bp, Artificial Sequence
  Synthetic oligonucleotide; CTC chr11 5162280 5162301 5162285 5162280 -
ttcacatttctcataacttcta

SEQ ID NO: 154500 - DNA, 22 bp, Artificial Sequence
  Synthetic oligonucleotide; CTT chr11 5162278 5162299 5162283 5162278 -
cacatttctcataacttctaaa

SEQ ID NO: 154501 - DNA, 22 bp, Artificial Sequence
  Synthetic oligonucleotide; TTC chr11 5162277 5162298 5162282 5162277 -
acatttctcataacttctaaaa

SEQ ID NO: 154502 - DNA, 22 bp, Artificial Sequence
  Synthetic oligonucleotide; TTT chr11 5162271 5162292 5162276 5162271 -
ctcataacttctaaaatctatt

SEQ ID NO: 154503 - DNA, 22 bp, Artificial Sequence
  Synthetic oligonucleotide; TTC chr11 5162270 5162291 5162275 5162270 -
tcataacttctaaaatctattt

SEQ ID NO: 154504 - DNA, 22 bp, Artificial Sequence
  Synthetic oligonucleotide; CTC chr11 5162268 5162289 5162273 5162268 -
ataacttctaaaatctattttc

SEQ ID NO: 154505 - DNA, 22 bp, Artificial Sequence
  Synthetic oligonucleotide; CTT chr11 5162261 5162282 5162266 5162261 -
ctaaaatctattttcttcctca

SEQ ID NO: 154506 - DNA, 22 bp, Artificial Sequence
  Synthetic oligonucleotide; TTC chr11 5162260 5162281 5162265 5162260 -
taaaatctattttcttcctcat

SEQ ID NO: 154507 - DNA, 22 bp, Artificial Sequence
  Synthetic oligonucleotide; CTA chr11 5162258 5162279 5162263 5162258 -
aaatctattttcttcctcatac

SEQ ID NO: 154508 - DNA, 22 bp, Artificial Sequence
  Synthetic oligonucleotide; CTA chr11 5162251 5162272 5162256 5162251 -
ttttcttcctcatacctgatgc

SEQ ID NO: 154509 - DNA, 22 bp, Artificial Sequence
  Synthetic oligonucleotide; TTT chr11 5162248 5162269 5162253 5162248 -
tcttcctcatacctgatgcata

SEQ ID NO: 154510 - DNA, 22 bp, Artificial Sequence
  Synthetic oligonucleotide; TTT chr11 5162247 5162268 5162252 5162247 -
cttcctcatacctgatgcatat

SEQ ID NO: 154511 - DNA, 22 bp, Artificial Sequence
  Synthetic oligonucleotide; TTC chr11 5162246 5162267 5162251 5162246 -
ttcctcatacctgatgcatata

SEQ ID NO: 154512 - DNA, 22 bp, Artificial Sequence
  Synthetic oligonucleotide; CTT chr11 5162244 5162265 5162249 5162244 -
cctcatacctgatgcatatact

SEQ ID NO: 154513 - DNA, 22 bp, Artificial Sequence
  Synthetic oligonucleotide; TTC chr11 5162243 5162264 5162248 5162243 -
ctcatacctgatgcatatactt

SEQ ID NO: 154514 - DNA, 22 bp, Artificial Sequence
  Synthetic oligonucleotide; CTC chr11 5162240 5162261 5162245 5162240 -
atacctgatgcatatactttct

SEQ ID NO: 154515 - DNA, 22 bp, Artificial Sequence
  Synthetic oligonucleotide; CTG chr11 5162233 5162254 5162238 5162233 -
atgcatatactttctgatcccc

SEQ ID NO: 154516 - DNA, 22 bp, Artificial Sequence
  Synthetic oligonucleotide; CTT chr11 5162221 5162242 5162226 5162221 -
tctgatccccggctccttcagc

SEQ ID NO: 154517 - DNA, 22 bp, Artificial Sequence
  Synthetic oligonucleotide; TTT chr11 5162220 5162241 5162225 5162220 -
ctgatccccggctccttcagct

SEQ ID NO: 154518 - DNA, 22 bp, Artificial Sequence
  Synthetic oligonucleotide; TTC chr11 5162219 5162240 5162224 5162219 -
tgatccccggctccttcagctg

SEQ ID NO: 154519 - DNA, 22 bp, Artificial Sequence
  Synthetic oligonucleotide; CTG chr11 5162217 5162238 5162222 5162217 -
atccccggctccttcagctgta

SEQ ID NO: 154520 - DNA, 22 bp, Artificial Sequence
  Synthetic oligonucleotide; CTC chr11 5162206 5162227 5162211 5162206 -
cttcagctgtactcactctttg

SEQ ID NO: 154521 - DNA, 22 bp, Artificial Sequence
  Synthetic oligonucleotide; CTT chr11 5162203 5162224 5162208 5162203 -
cagctgtactcactctttgtta

SEQ ID NO: 154522 - DNA, 22 bp, Artificial Sequence
  Synthetic oligonucleotide; TTC chr11 5162202 5162223 5162207 5162202 -
agctgtactcactctttgttaa

SEQ ID NO: 154523 - DNA, 22 bp, Artificial Sequence
  Synthetic oligonucleotide; CTG chr11 5162197 5162218 5162202 5162197 -
tactcactctttgttaagtccc

SEQ ID NO: 154524 - DNA, 22 bp, Artificial Sequence
  Synthetic oligonucleotide; CTC chr11 5162192 5162213 5162197 5162192 -
actctttgttaagtcccacaat

SEQ ID NO: 154525 - DNA, 22 bp, Artificial Sequence
  Synthetic oligonucleotide; CTC chr11 5162188 5162209 5162193 5162188 -
tttgttaagtcccacaattacc

SEQ ID NO: 154526 - DNA, 22 bp, Artificial Sequence
  Synthetic oligonucleotide; CTT chr11 5162186 5162207 5162191 5162186 -
tgttaagtcccacaattaccat

SEQ ID NO: 154527 - DNA, 22 bp, Artificial Sequence
  Synthetic oligonucleotide; TTT chr11 5162185 5162206 5162190 5162185 -
gttaagtcccacaattaccatt

SEQ ID NO: 154528 - DNA, 22 bp, Artificial Sequence
  Synthetic oligonucleotide; TTG chr11 5162184 5162205 5162189 5162184 -
ttaagtcccacaattaccattg

SEQ ID NO: 154529 - DNA, 22 bp, Artificial Sequence
  Synthetic oligonucleotide; TTA chr11 5162181 5162202 5162186 5162181 -
agtcccacaattaccattggtc

SEQ ID NO: 154530 - DNA, 22 bp, Artificial Sequence
  Synthetic oligonucleotide; TTA chr11 5162168 5162189 5162173 5162168 -
ccattggtcctggcccggactt

SEQ ID NO: 154531 - DNA, 22 bp, Artificial Sequence
  Synthetic oligonucleotide; TTG chr11 5162162 5162183 5162167 5162162 -
gtcctggcccggacttcaatcc

SEQ ID NO: 154532 - DNA, 22 bp, Artificial Sequence
  Synthetic oligonucleotide; CTG chr11 5162156 5162177 5162161 5162156 -
gcccggacttcaatccggcctc

SEQ ID NO: 154533 - DNA, 22 bp, Artificial Sequence
  Synthetic oligonucleotide; CTT chr11 5162146 5162167 5162151 5162146 -
caatccggcctcccacattatt

SEQ ID NO: 154534 - DNA, 22 bp, Artificial Sequence
  Synthetic oligonucleotide; TTC chr11 5162145 5162166 5162150 5162145 -
aatccggcctcccacattattc

SEQ ID NO: 154535 - DNA, 22 bp, Artificial Sequence
  Synthetic oligonucleotide; CTC chr11 5162134 5162155 5162139 5162134 -
ccacattattcctgataccaca

SEQ ID NO: 154536 - DNA, 22 bp, Artificial Sequence
  Synthetic oligonucleotide; TTA chr11 5162126 5162147 5162131 5162126 -
ttcctgataccacacctgaccc

SEQ ID NO: 154537 - DNA, 22 bp, Artificial Sequence
  Synthetic oligonucleotide; TTC chr11 5162123 5162144 5162128 5162123 -
ctgataccacacctgaccccca

SEQ ID NO: 154538 - DNA, 22 bp, Artificial Sequence
  Synthetic oligonucleotide; CTG chr11 5162120 5162141 5162125 5162120 -
ataccacacctgacccccatga

SEQ ID NO: 154539 - DNA, 22 bp, Artificial Sequence
  Synthetic oligonucleotide; CTG chr11 5162108 5162129 5162113 5162108 -
acccccatgattgtatctctct

SEQ ID NO: 154540 - DNA, 22 bp, Artificial Sequence
  Synthetic oligonucleotide; TTG chr11 5162095 5162116 5162100 5162095 -
tatctctctgatccacctgaca

SEQ ID NO: 154541 - DNA, 22 bp, Artificial Sequence
  Synthetic oligonucleotide; CTC chr11 5162089 5162110 5162094 5162089 -
tctgatccacctgacattcacc

SEQ ID NO: 154542 - DNA, 22 bp, Artificial Sequence
  Synthetic oligonucleotide; CTC chr11 5162087 5162108 5162092 5162087 -
tgatccacctgacattcacccc

SEQ ID NO: 154543 - DNA, 22 bp, Artificial Sequence
  Synthetic oligonucleotide; CTG chr11 5162085 5162106 5162090 5162085 -
atccacctgacattcaccccat

SEQ ID NO: 154544 - DNA, 22 bp, Artificial Sequence
  Synthetic oligonucleotide; CTG chr11 5162076 5162097 5162081 5162076 -
acattcaccccatttccccata

SEQ ID NO: 154545 - DNA, 22 bp, Artificial Sequence
  Synthetic oligonucleotide; TTC chr11 5162070 5162091 5162075 5162070 -
accccatttccccatatttcct

SEQ ID NO: 154546 - DNA, 22 bp, Artificial Sequence
  Synthetic oligonucleotide; TTT chr11 5162061 5162082 5162066 5162061 -
ccccatatttccttctttcctt

SEQ ID NO: 154547 - DNA, 22 bp, Artificial Sequence
  Synthetic oligonucleotide; TTC chr11 5162060 5162081 5162065 5162060 -
cccatatttccttctttccttc

SEQ ID NO: 154548 - DNA, 22 bp, Artificial Sequence
  Synthetic oligonucleotide; TTT chr11 5162051 5162072 5162056 5162051 -
ccttctttccttctttcctgtt

SEQ ID NO: 154549 - DNA, 22 bp, Artificial Sequence
  Synthetic oligonucleotide; TTC chr11 5162050 5162071 5162055 5162050 -
cttctttccttctttcctgttc

SEQ ID NO: 154550 - DNA, 22 bp, Artificial Sequence
  Synthetic oligonucleotide; CTT chr11 5162047 5162068 5162052 5162047 -
ctttccttctttcctgttcctc

SEQ ID NO: 154551 - DNA, 22 bp, Artificial Sequence
  Synthetic oligonucleotide; TTC chr11 5162046 5162067 5162051 5162046 -
tttccttctttcctgttcctca

SEQ ID NO: 154552 - DNA, 22 bp, Artificial Sequence
  Synthetic oligonucleotide; CTT chr11 5162044 5162065 5162049 5162044 -
tccttctttcctgttcctcacc

SEQ ID NO: 154553 - DNA, 22 bp, Artificial Sequence
  Synthetic oligonucleotide; TTT chr11 5162043 5162064 5162048 5162043 -
ccttctttcctgttcctcaccc

SEQ ID NO: 154554 - DNA, 22 bp, Artificial Sequence
  Synthetic oligonucleotide; TTC chr11 5162042 5162063 5162047 5162042 -
cttctttcctgttcctcaccct

SEQ ID NO: 154555 - DNA, 22 bp, Artificial Sequence
  Synthetic oligonucleotide; CTT chr11 5162039 5162060 5162044 5162039 -
ctttcctgttcctcaccctgat

SEQ ID NO: 154556 - DNA, 22 bp, Artificial Sequence
  Synthetic oligonucleotide; TTC chr11 5162038 5162059 5162043 5162038 -
tttcctgttcctcaccctgatc

SEQ ID NO: 154557 - DNA, 22 bp, Artificial Sequence
  Synthetic oligonucleotide; CTT chr11 5162036 5162057 5162041 5162036 -
tcctgttcctcaccctgatcac

SEQ ID NO: 154558 - DNA, 22 bp, Artificial Sequence
  Synthetic oligonucleotide; TTT chr11 5162035 5162056 5162040 5162035 -
cctgttcctcaccctgatcaca

SEQ ID NO: 154559 - DNA, 22 bp, Artificial Sequence
  Synthetic oligonucleotide; TTC chr11 5162034 5162055 5162039 5162034 -
ctgttcctcaccctgatcacac

SEQ ID NO: 154560 - DNA, 22 bp, Artificial Sequence
  Synthetic oligonucleotide; CTG chr11 5162031 5162052 5162036 5162031 -
ttcctcaccctgatcacacttg

SEQ ID NO: 154561 - DNA, 22 bp, Artificial Sequence
  Synthetic oligonucleotide; TTC chr11 5162028 5162049 5162033 5162028 -
ctcaccctgatcacacttgatt

SEQ ID NO: 154562 - DNA, 22 bp, Artificial Sequence
  Synthetic oligonucleotide; CTC chr11 5162025 5162046 5162030 5162025 -
accctgatcacacttgatttat

SEQ ID NO: 154563 - DNA, 22 bp, Artificial Sequence
  Synthetic oligonucleotide; CTG chr11 5162019 5162040 5162024 5162019 -
atcacacttgatttattgatgg

SEQ ID NO: 154564 - DNA, 22 bp, Artificial Sequence
  Synthetic oligonucleotide; CTT chr11 5162010 5162031 5162015 5162010 -
gatttattgatggccgttccac

SEQ ID NO: 154565 - DNA, 22 bp, Artificial Sequence
  Synthetic oligonucleotide; TTG chr11 5162009 5162030 5162014 5162009 -
atttattgatggccgttccacc

SEQ ID NO: 154566 - DNA, 22 bp, Artificial Sequence
  Synthetic oligonucleotide; TTT chr11 5162005 5162026 5162010 5162005 -
attgatggccgttccaccaggc

SEQ ID NO: 154567 - DNA, 22 bp, Artificial Sequence
  Synthetic oligonucleotide; TTA chr11 5162004 5162025 5162009 5162004 -
ttgatggccgttccaccaggcc

SEQ ID NO: 154568 - DNA, 22 bp, Artificial Sequence
  Synthetic oligonucleotide; TTG chr11 5162001 5162022 5162006 5162001 -
atggccgttccaccaggcctaa

SEQ ID NO: 154569 - DNA, 22 bp, Artificial Sequence
  Synthetic oligonucleotide; TTC chr11 5161991 5162012 5161996 5161991 -
caccaggcctaatagccacaca

SEQ ID NO: 154570 - DNA, 22 bp, Artificial Sequence
  Synthetic oligonucleotide; CTA chr11 5161980 5162001 5161985 5161980 -
atagccacacaccagcaaaggc

SEQ ID NO: 154571 - DNA, 22 bp, Artificial Sequence
  Synthetic oligonucleotide; CTA chr11 5161952 5161973 5161957 5161952 -
tgctatagtacaaaccactagc

SEQ ID NO: 154572 - DNA, 22 bp, Artificial Sequence
  Synthetic oligonucleotide; CTA chr11 5161947 5161968 5161952 5161947 -
tagtacaaaccactagcctgcc

SEQ ID NO: 154573 - DNA, 22 bp, Artificial Sequence
  Synthetic oligonucleotide; CTA chr11 5161932 5161953 5161937 5161932 -
gcctgcctcttcgaacctctca

SEQ ID NO: 154574 - DNA, 22 bp, Artificial Sequence
  Synthetic oligonucleotide; CTG chr11 5161927 5161948 5161932 5161927 -
cctcttcgaacctctcatttcc

SEQ ID NO: 154575 - DNA, 22 bp, Artificial Sequence
  Synthetic oligonucleotide; CTC chr11 5161923 5161944 5161928 5161923 -
ttcgaacctctcatttcctttc

SEQ ID NO: 154576 - DNA, 22 bp, Artificial Sequence
  Synthetic oligonucleotide; CTT chr11 5161921 5161942 5161926 5161921 -
cgaacctctcatttcctttcca

SEQ ID NO: 154577 - DNA, 22 bp, Artificial Sequence
  Synthetic oligonucleotide; TTC chr11 5161920 5161941 5161925 5161920 -
gaacctctcatttcctttccat

SEQ ID NO: 154578 - DNA, 22 bp, Artificial Sequence
  Synthetic oligonucleotide; CTC chr11 5161913 5161934 5161918 5161913 -
tcatttcctttccatcgtagaa

SEQ ID NO: 154579 - DNA, 22 bp, Artificial Sequence
  Synthetic oligonucleotide; CTC chr11 5161911 5161932 5161916 5161911 -
atttcctttccatcgtagaaat

SEQ ID NO: 154580 - DNA, 22 bp, Artificial Sequence
  Synthetic oligonucleotide; TTT chr11 5161907 5161928 5161912 5161907 -
cctttccatcgtagaaatctat

SEQ ID NO: 154581 - DNA, 22 bp, Artificial Sequence
  Synthetic oligonucleotide; TTC chr11 5161906 5161927 5161911 5161906 -
ctttccatcgtagaaatctatc

SEQ ID NO: 154582 - DNA, 22 bp, Artificial Sequence
  Synthetic oligonucleotide; CTT chr11 5161903 5161924 5161908 5161903 -
tccatcgtagaaatctatcctc

SEQ ID NO: 154583 - DNA, 22 bp, Artificial Sequence
  Synthetic oligonucleotide; TTT chr11 5161902 5161923 5161907 5161902 -
ccatcgtagaaatctatcctca

SEQ ID NO: 154584 - DNA, 22 bp, Artificial Sequence
  Synthetic oligonucleotide; TTC chr11 5161901 5161922 5161906 5161901 -
catcgtagaaatctatcctcaa

SEQ ID NO: 154585 - DNA, 22 bp, Artificial Sequence
  Synthetic oligonucleotide; CTA chr11 5161886 5161907 5161891 5161886 -
tcctcaaagaaataacttctca

SEQ ID NO: 154586 - DNA, 22 bp, Artificial Sequence
  Synthetic oligonucleotide; CTC chr11 5161881 5161902 5161886 5161881 -
aaagaaataacttctcagtgtt

SEQ ID NO: 154587 - DNA, 22 bp, Artificial Sequence
  Synthetic oligonucleotide; CTT chr11 5161868 5161889 5161873 5161868 -
ctcagtgttccatctgctattc

SEQ ID NO: 154588 - DNA, 22 bp, Artificial Sequence
  Synthetic oligonucleotide; TTC chr11 5161867 5161888 5161872 5161867 -
tcagtgttccatctgctattct

SEQ ID NO: 154589 - DNA, 22 bp, Artificial Sequence
  Synthetic oligonucleotide; CTC chr11 5161865 5161886 5161870 5161865 -
agtgttccatctgctattctgc

SEQ ID NO: 154590 - DNA, 22 bp, Artificial Sequence
  Synthetic oligonucleotide; TTC chr11 5161858 5161879 5161863 5161858 -
catctgctattctgctactcct

SEQ ID NO: 154591 - DNA, 22 bp, Artificial Sequence
  Synthetic oligonucleotide; CTG chr11 5161852 5161873 5161857 5161852 -
ctattctgctactcctcaggga

SEQ ID NO: 154592 - DNA, 22 bp, Artificial Sequence
  Synthetic oligonucleotide; CTA chr11 5161849 5161870 5161854 5161849 -
ttctgctactcctcagggatta

SEQ ID NO: 154593 - DNA, 22 bp, Artificial Sequence
  Synthetic oligonucleotide; TTC chr11 5161846 5161867 5161851 5161846 -
tgctactcctcagggattattc

SEQ ID NO: 154594 - DNA, 22 bp, Artificial Sequence
  Synthetic oligonucleotide; CTG chr11 5161844 5161865 5161849 5161844 -
ctactcctcagggattattcag

SEQ ID NO: 154595 - DNA, 22 bp, Artificial Sequence
  Synthetic oligonucleotide; CTA chr11 5161841 5161862 5161846 5161841 -
ctcctcagggattattcaggcc

SEQ ID NO: 154596 - DNA, 22 bp, Artificial Sequence
  Synthetic oligonucleotide; CTC chr11 5161838 5161859 5161843 5161838 -
ctcagggattattcaggccccc

SEQ ID NO: 154597 - DNA, 22 bp, Artificial Sequence
  Synthetic oligonucleotide; CTC chr11 5161835 5161856 5161840 5161835 -
agggattattcaggccccctcc

SEQ ID NO: 154598 - DNA, 22 bp, Artificial Sequence
  Synthetic oligonucleotide; TTA chr11 5161827 5161848 5161832 5161827 -
ttcaggccccctcccttcccta

SEQ ID NO: 154599 - DNA, 22 bp, Artificial Sequence
  Synthetic oligonucleotide; TTC chr11 5161824 5161845 5161829 5161824 -
aggccccctcccttccctacac

SEQ ID NO: 154600 - DNA, 22 bp, Artificial Sequence
  Synthetic oligonucleotide; CTC chr11 5161814 5161835 5161819 5161814 -
ccttccctacacatcaagctcg

SEQ ID NO: 154601 - DNA, 22 bp, Artificial Sequence
  Synthetic oligonucleotide; CTT chr11 5161810 5161831 5161815 5161810 -
ccctacacatcaagctcgagga

SEQ ID NO: 154602 - DNA, 22 bp, Artificial Sequence
  Synthetic oligonucleotide; TTC chr11 5161809 5161830 5161814 5161809 -
cctacacatcaagctcgaggat

SEQ ID NO: 154603 - DNA, 22 bp, Artificial Sequence
  Synthetic oligonucleotide; CTA chr11 5161805 5161826 5161810 5161805 -
cacatcaagctcgaggatttgc

SEQ ID NO: 154604 - DNA, 22 bp, Artificial Sequence
  Synthetic oligonucleotide; CTC chr11 5161793 5161814 5161798 5161793 -
gaggatttgcccccacccagga

SEQ ID NO: 154605 - DNA, 22 bp, Artificial Sequence
  Synthetic oligonucleotide; TTT chr11 5161785 5161806 5161790 5161785 -
gcccccacccaggactggcaaa

SEQ ID NO: 154606 - DNA, 22 bp, Artificial Sequence
  Synthetic oligonucleotide; TTG chr11 5161784 5161805 5161789 5161784 -
cccccacccaggactggcaaat

SEQ ID NO: 154607 - DNA, 22 bp, Artificial Sequence
  Synthetic oligonucleotide; CTG chr11 5161768 5161789 5161773 5161768 -
gcaaattagatttactcaacat

SEQ ID NO: 154608 - DNA, 22 bp, Artificial Sequence
  Synthetic oligonucleotide; TTA chr11 5161760 5161781 5161765 5161760 -
gatttactcaacatgccctgag

SEQ ID NO: 154609 - DNA, 22 bp, Artificial Sequence
  Synthetic oligonucleotide; TTT chr11 5161755 5161776 5161760 5161755 -
actcaacatgccctgagtcaga

SEQ ID NO: 154610 - DNA, 22 bp, Artificial Sequence
  Synthetic oligonucleotide; TTA chr11 5161754 5161775 5161759 5161754 -
ctcaacatgccctgagtcagat

SEQ ID NO: 154611 - DNA, 22 bp, Artificial Sequence
  Synthetic oligonucleotide; CTC chr11 5161751 5161772 5161756 5161751 -
aacatgccctgagtcagataac

SEQ ID NO: 154612 - DNA, 22 bp, Artificial Sequence
  Synthetic oligonucleotide; CTG chr11 5161740 5161761 5161745 5161740 -
agtcagataactaaaatacctc

SEQ ID NO: 154613 - DNA, 22 bp, Artificial Sequence
  Synthetic oligonucleotide; CTA chr11 5161727 5161748 5161732 5161727 -
aaatacctcttagtctaggtag

SEQ ID NO: 154614 - DNA, 22 bp, Artificial Sequence
  Synthetic oligonucleotide; CTC chr11 5161718 5161739 5161723 5161718 -
ttagtctaggtagacactttca

SEQ ID NO: 154615 - DNA, 22 bp, Artificial Sequence
  Synthetic oligonucleotide; CTT chr11 5161716 5161737 5161721 5161716 -
agtctaggtagacactttcact

SEQ ID NO: 154616 - DNA, 22 bp, Artificial Sequence
  Synthetic oligonucleotide; TTA chr11 5161715 5161736 5161720 5161715 -
gtctaggtagacactttcactg

SEQ ID NO: 154617 - DNA, 22 bp, Artificial Sequence
  Synthetic oligonucleotide; CTA chr11 5161710 5161731 5161715 5161710 -
ggtagacactttcactggataa

SEQ ID NO: 154618 - DNA, 22 bp, Artificial Sequence
  Synthetic oligonucleotide; CTT chr11 5161699 5161720 5161704 5161699 -
tcactggataagtagaggtctt

SEQ ID NO: 154619 - DNA, 22 bp, Artificial Sequence
  Synthetic oligonucleotide; TTT chr11 5161698 5161719 5161703 5161698 -
cactggataagtagaggtcttt

SEQ ID NO: 154620 - DNA, 22 bp, Artificial Sequence
  Synthetic oligonucleotide; TTC chr11 5161697 5161718 5161702 5161697 -
actggataagtagaggtctttc

SEQ ID NO: 154621 - DNA, 22 bp, Artificial Sequence
  Synthetic oligonucleotide; CTG chr11 5161693 5161714 5161698 5161693 -
gataagtagaggtctttcctac

SEQ ID NO: 154622 - DNA, 22 bp, Artificial Sequence
  Synthetic oligonucleotide; CTT chr11 5161677 5161698 5161682 5161677 -
tcctacagggtctgagaaggcc

SEQ ID NO: 154623 - DNA, 22 bp, Artificial Sequence
  Synthetic oligonucleotide; TTT chr11 5161676 5161697 5161681 5161676 -
cctacagggtctgagaaggcca

SEQ ID NO: 154624 - DNA, 22 bp, Artificial Sequence
  Synthetic oligonucleotide; TTC chr11 5161675 5161696 5161680 5161675 -
ctacagggtctgagaaggccac

SEQ ID NO: 154625 - DNA, 22 bp, Artificial Sequence
  Synthetic oligonucleotide; CTA chr11 5161672 5161693 5161677 5161672 -
cagggtctgagaaggccaccgc

SEQ ID NO: 154626 - DNA, 22 bp, Artificial Sequence
  Synthetic oligonucleotide; CTG chr11 5161663 5161684 5161668 5161663 -
agaaggccaccgcagtcatttc

SEQ ID NO: 154627 - DNA, 22 bp, Artificial Sequence
  Synthetic oligonucleotide; TTT chr11 5161642 5161663 5161647 5161642 -
cttcccttctgtcagacataat

SEQ ID NO: 154628 - DNA, 22 bp, Artificial Sequence
  Synthetic oligonucleotide; TTC chr11 5161641 5161662 5161646 5161641 -
ttcccttctgtcagacataatt

SEQ ID NO: 154629 - DNA, 22 bp, Artificial Sequence
  Synthetic oligonucleotide; CTT chr11 5161639 5161660 5161644 5161639 -
cccttctgtcagacataattcc

SEQ ID NO: 154630 - DNA, 22 bp, Artificial Sequence
  Synthetic oligonucleotide; TTC chr11 5161638 5161659 5161643 5161638 -
ccttctgtcagacataattcct

SEQ ID NO: 154631 - DNA, 22 bp, Artificial Sequence
  Synthetic oligonucleotide; CTT chr11 5161634 5161655 5161639 5161634 -
ctgtcagacataattcctcagt

SEQ ID NO: 154632 - DNA, 22 bp, Artificial Sequence
  Synthetic oligonucleotide; TTC chr11 5161633 5161654 5161638 5161633 -
tgtcagacataattcctcagtt

SEQ ID NO: 154633 - DNA, 22 bp, Artificial Sequence
  Synthetic oligonucleotide; CTG chr11 5161631 5161652 5161636 5161631 -
tcagacataattcctcagttta

SEQ ID NO: 154634 - DNA, 22 bp, Artificial Sequence
  Synthetic oligonucleotide; TTC chr11 5161618 5161639 5161623 5161618 -
ctcagtttagccttcctacctc

SEQ ID NO: 154635 - DNA, 22 bp, Artificial Sequence
  Synthetic oligonucleotide; CTC chr11 5161615 5161636 5161620 5161615 -
agtttagccttcctacctctat

SEQ ID NO: 154636 - DNA, 22 bp, Artificial Sequence
  Synthetic oligonucleotide; TTT chr11 5161610 5161631 5161615 5161610 -
agccttcctacctctatacagt

SEQ ID NO: 154637 - DNA, 22 bp, Artificial Sequence
  Synthetic oligonucleotide; TTA chr11 5161609 5161630 5161614 5161609 -
gccttcctacctctatacagtc

SEQ ID NO: 154638 - DNA, 22 bp, Artificial Sequence
  Synthetic oligonucleotide; CTT chr11 5161604 5161625 5161609 5161604 -
cctacctctatacagtctgata

SEQ ID NO: 154639 - DNA, 22 bp, Artificial Sequence
  Synthetic oligonucleotide; TTC chr11 5161603 5161624 5161608 5161603 -
ctacctctatacagtctgataa

SEQ ID NO: 154640 - DNA, 22 bp, Artificial Sequence
  Synthetic oligonucleotide; CTA chr11 5161600 5161621 5161605 5161600 -
cctctatacagtctgataacag

SEQ ID NO: 154641 - DNA, 22 bp, Artificial Sequence
  Synthetic oligonucleotide; CTC chr11 5161596 5161617 5161601 5161596 -
tatacagtctgataacagacca

SEQ ID NO: 154642 - DNA, 22 bp, Artificial Sequence
  Synthetic oligonucleotide; CTA chr11 5161594 5161615 5161599 5161594 -
tacagtctgataacagaccagc

SEQ ID NO: 154643 - DNA, 22 bp, Artificial Sequence
  Synthetic oligonucleotide; CTG chr11 5161585 5161606 5161590 5161585 -
ataacagaccagcctttattag

SEQ ID NO: 154644 - DNA, 22 bp, Artificial Sequence
  Synthetic oligonucleotide; CTT chr11 5161569 5161590 5161574 5161569 -
tattagtcaaatcagccaagca

SEQ ID NO: 154645 - DNA, 22 bp, Artificial Sequence
  Synthetic oligonucleotide; TTT chr11 5161568 5161589 5161573 5161568 -
attagtcaaatcagccaagcag

SEQ ID NO: 154646 - DNA, 22 bp, Artificial Sequence
  Synthetic oligonucleotide; TTA chr11 5161567 5161588 5161572 5161567 -
ttagtcaaatcagccaagcagt

SEQ ID NO: 154647 - DNA, 22 bp, Artificial Sequence
  Synthetic oligonucleotide; TTA chr11 5161564 5161585 5161569 5161564 -
gtcaaatcagccaagcagtttt

SEQ ID NO: 154648 - DNA, 22 bp, Artificial Sequence
  Synthetic oligonucleotide; TTT chr11 5161543 5161564 5161548 5161543 -
ttcaggctcttagtattcagta

SEQ ID NO: 154649 - DNA, 22 bp, Artificial Sequence
  Synthetic oligonucleotide; TTT chr11 5161542 5161563 5161547 5161542 -
tcaggctcttagtattcagtaa

SEQ ID NO: 154650 - DNA, 22 bp, Artificial Sequence
  Synthetic oligonucleotide; TTT chr11 5161541 5161562 5161546 5161541 -
caggctcttagtattcagtaaa

SEQ ID NO: 154651 - DNA, 22 bp, Artificial Sequence
  Synthetic oligonucleotide; TTC chr11 5161540 5161561 5161545 5161540 -
aggctcttagtattcagtaaaa

SEQ ID NO: 154652 - DNA, 22 bp, Artificial Sequence
  Synthetic oligonucleotide; CTC chr11 5161534 5161555 5161539 5161534 -
ttagtattcagtaaaaccttta

SEQ ID NO: 154653 - DNA, 22 bp, Artificial Sequence
  Synthetic oligonucleotide; CTT chr11 5161532 5161553 5161537 5161532 -
agtattcagtaaaacctttata

SEQ ID NO: 154654 - DNA, 22 bp, Artificial Sequence
  Synthetic oligonucleotide; TTA chr11 5161531 5161552 5161536 5161531 -
gtattcagtaaaacctttatat

SEQ ID NO: 154655 - DNA, 22 bp, Artificial Sequence
  Synthetic oligonucleotide; TTC chr11 5161525 5161546 5161530 5161525 -
agtaaaacctttatatccctta

SEQ ID NO: 154656 - DNA, 22 bp, Artificial Sequence
  Synthetic oligonucleotide; CTT chr11 5161514 5161535 5161519 5161514 -
tatatcccttacggtcctccgt

SEQ ID NO: 154657 - DNA, 22 bp, Artificial Sequence
  Synthetic oligonucleotide; TTT chr11 5161513 5161534 5161518 5161513 -
atatcccttacggtcctccgtc

SEQ ID NO: 154658 - DNA, 22 bp, Artificial Sequence
  Synthetic oligonucleotide; TTA chr11 5161512 5161533 5161517 5161512 -
tatcccttacggtcctccgtct

SEQ ID NO: 154659 - DNA, 22 bp, Artificial Sequence
  Synthetic oligonucleotide; CTT chr11 5161504 5161525 5161509 5161504 -
acggtcctccgtcttcaggaaa

SEQ ID NO: 154660 - DNA, 22 bp, Artificial Sequence
  Synthetic oligonucleotide; TTA chr11 5161503 5161524 5161508 5161503 -
cggtcctccgtcttcaggaaaa

SEQ ID NO: 154661 - DNA, 22 bp, Artificial Sequence
  Synthetic oligonucleotide; CTC chr11 5161495 5161516 5161500 5161495 -
cgtcttcaggaaaagtagaacg

SEQ ID NO: 154662 - DNA, 22 bp, Artificial Sequence
  Synthetic oligonucleotide; CTT chr11 5161489 5161510 5161494 5161489 -
caggaaaagtagaacggactaa

SEQ ID NO: 154663 - DNA, 22 bp, Artificial Sequence
  Synthetic oligonucleotide; TTC chr11 5161488 5161509 5161493 5161488 -
aggaaaagtagaacggactaaa

SEQ ID NO: 154664 - DNA, 22 bp, Artificial Sequence
  Synthetic oligonucleotide; CTA chr11 5161468 5161489 5161473 5161468 -
aatgtcttttaaaaacacacct

SEQ ID NO: 154665 - DNA, 22 bp, Artificial Sequence
  Synthetic oligonucleotide; CTT chr11 5161460 5161481 5161465 5161460 -
ttaaaaacacacctcaccaagc

SEQ ID NO: 154666 - DNA, 22 bp, Artificial Sequence
  Synthetic oligonucleotide; TTT chr11 5161459 5161480 5161464 5161459 -
taaaaacacacctcaccaagct

SEQ ID NO: 154667 - DNA, 22 bp, Artificial Sequence
  Synthetic oligonucleotide; TTT chr11 5161458 5161479 5161463 5161458 -
aaaaacacacctcaccaagctc

SEQ ID NO: 154668 - DNA, 22 bp, Artificial Sequence
  Synthetic oligonucleotide; TTA chr11 5161457 5161478 5161462 5161457 -
aaaacacacctcaccaagctca

SEQ ID NO: 154669 - DNA, 22 bp, Artificial Sequence
  Synthetic oligonucleotide; CTC chr11 5161445 5161466 5161450 5161445 -
accaagctcagccaccaactta

SEQ ID NO: 154670 - DNA, 22 bp, Artificial Sequence
  Synthetic oligonucleotide; CTC chr11 5161436 5161457 5161441 5161436 -
agccaccaacttaaaaaggact

SEQ ID NO: 154671 - DNA, 22 bp, Artificial Sequence
  Synthetic oligonucleotide; CTT chr11 5161424 5161445 5161429 5161424 -
aaaaaggactggacaatacttt

SEQ ID NO: 154672 - DNA, 22 bp, Artificial Sequence
  Synthetic oligonucleotide; TTA chr11 5161423 5161444 5161428 5161423 -
aaaaggactggacaatactttt

SEQ ID NO: 154673 - DNA, 22 bp, Artificial Sequence
  Synthetic oligonucleotide; CTG chr11 5161413 5161434 5161418 5161413 -
gacaatacttttaccacttttc

SEQ ID NO: 154674 - DNA, 22 bp, Artificial Sequence
  Synthetic oligonucleotide; CTT chr11 5161403 5161424 5161408 5161403 -
ttaccacttttctttctcagaa

SEQ ID NO: 154675 - DNA, 22 bp, Artificial Sequence
  Synthetic oligonucleotide; TTT chr11 5161402 5161423 5161407 5161402 -
taccacttttctttctcagaag

SEQ ID NO: 154676 - DNA, 22 bp, Artificial Sequence
  Synthetic oligonucleotide; TTT chr11 5161401 5161422 5161406 5161401 -
accacttttctttctcagaagt

SEQ ID NO: 154677 - DNA, 22 bp, Artificial Sequence
  Synthetic oligonucleotide; TTA chr11 5161400 5161421 5161405 5161400 -
ccacttttctttctcagaagtc

SEQ ID NO: 154678 - DNA, 22 bp, Artificial Sequence
  Synthetic oligonucleotide; CTT chr11 5161394 5161415 5161399 5161394 -
ttctttctcagaagtcagacct

SEQ ID NO: 154679 - DNA, 22 bp, Artificial Sequence
  Synthetic oligonucleotide; TTT chr11 5161393 5161414 5161398 5161393 -
tctttctcagaagtcagacctg

SEQ ID NO: 154680 - DNA, 22 bp, Artificial Sequence
  Synthetic oligonucleotide; TTT chr11 5161392 5161413 5161397 5161392 -
ctttctcagaagtcagacctgt

SEQ ID NO: 154681 - DNA, 22 bp, Artificial Sequence
  Synthetic oligonucleotide; TTC chr11 5161391 5161412 5161396 5161391 -
tttctcagaagtcagacctgtc

SEQ ID NO: 154682 - DNA, 22 bp, Artificial Sequence
  Synthetic oligonucleotide; CTT chr11 5161389 5161410 5161394 5161389 -
tctcagaagtcagacctgtcct

SEQ ID NO: 154683 - DNA, 22 bp, Artificial Sequence
  Synthetic oligonucleotide; TTT chr11 5161388 5161409 5161393 5161388 -
ctcagaagtcagacctgtcctc

SEQ ID NO: 154684 - DNA, 22 bp, Artificial Sequence
  Synthetic oligonucleotide; TTC chr11 5161387 5161408 5161392 5161387 -
tcagaagtcagacctgtcctca

SEQ ID NO: 154685 - DNA, 22 bp, Artificial Sequence
  Synthetic oligonucleotide; CTC chr11 5161385 5161406 5161390 5161385 -
agaagtcagacctgtcctcaga

SEQ ID NO: 154686 - DNA, 22 bp, Artificial Sequence
  Synthetic oligonucleotide; CTG chr11 5161371 5161392 5161376 5161371 -
tcctcagaatgctacagggtac

SEQ ID NO: 154687 - DNA, 22 bp, Artificial Sequence
  Synthetic oligonucleotide; CTC chr11 5161366 5161387 5161371 5161366 -
agaatgctacagggtacagccc

SEQ ID NO: 154688 - DNA, 22 bp, Artificial Sequence
  Synthetic oligonucleotide; CTA chr11 5161357 5161378 5161362 5161357 -
cagggtacagcccatttgagct

SEQ ID NO: 154689 - DNA, 22 bp, Artificial Sequence
  Synthetic oligonucleotide; TTT chr11 5161340 5161361 5161345 5161340 -
gagctcctgtatagatttgcct

SEQ ID NO: 154690 - DNA, 22 bp, Artificial Sequence
  Synthetic oligonucleotide; TTG chr11 5161339 5161360 5161344 5161339 -
agctcctgtatagatttgcctt

SEQ ID NO: 154691 - DNA, 22 bp, Artificial Sequence
  Synthetic oligonucleotide; CTC chr11 5161334 5161355 5161339 5161334 -
ctgtatagatttgcctttttat

SEQ ID NO: 154692 - DNA, 22 bp, Artificial Sequence
  Synthetic oligonucleotide; CTG chr11 5161331 5161352 5161336 5161331 -
tatagatttgcctttttattag

SEQ ID NO: 154693 - DNA, 22 bp, Artificial Sequence
  Synthetic oligonucleotide; TTT chr11 5161322 5161343 5161327 5161322 -
gcctttttattaggccccagtc

SEQ ID NO: 154694 - DNA, 22 bp, Artificial Sequence
  Synthetic oligonucleotide; TTG chr11 5161321 5161342 5161326 5161321 -
cctttttattaggccccagtct

SEQ ID NO: 154695 - DNA, 22 bp, Artificial Sequence
  Synthetic oligonucleotide; CTT chr11 5161317 5161338 5161322 5161317 -
tttattaggccccagtctaatt

SEQ ID NO: 154696 - DNA, 22 bp, Artificial Sequence
  Synthetic oligonucleotide; TTT chr11 5161316 5161337 5161321 5161316 -
ttattaggccccagtctaattc

SEQ ID NO: 154697 - DNA, 22 bp, Artificial Sequence
  Synthetic oligonucleotide; TTT chr11 5161315 5161336 5161320 5161315 -
tattaggccccagtctaattcc

SEQ ID NO: 154698 - DNA, 22 bp, Artificial Sequence
  Synthetic oligonucleotide; TTT chr11 5161314 5161335 5161319 5161314 -
attaggccccagtctaattcca

SEQ ID NO: 154699 - DNA, 22 bp, Artificial Sequence
  Synthetic oligonucleotide; TTA chr11 5161313 5161334 5161318 5161313 -
ttaggccccagtctaattccag

SEQ ID NO: 154700 - DNA, 22 bp, Artificial Sequence
  Synthetic oligonucleotide; TTA chr11 5161310 5161331 5161315 5161310 -
ggccccagtctaattccagaca

SEQ ID NO: 154701 - DNA, 22 bp, Artificial Sequence
  Synthetic oligonucleotide; CTA chr11 5161298 5161319 5161303 5161298 -
attccagacaccagaccaactt

SEQ ID NO: 154702 - DNA, 22 bp, Artificial Sequence
  Synthetic oligonucleotide; TTC chr11 5161294 5161315 5161299 5161294 -
cagacaccagaccaacttagaa

SEQ ID NO: 154703 - DNA, 22 bp, Artificial Sequence
  Synthetic oligonucleotide; CTT chr11 5161276 5161297 5161281 5161276 -
agaatgtgccccaaaaaaactt

SEQ ID NO: 154704 - DNA, 22 bp, Artificial Sequence
  Synthetic oligonucleotide; TTA chr11 5161275 5161296 5161280 5161275 -
gaatgtgccccaaaaaaacttg

SEQ ID NO: 154705 - DNA, 22 bp, Artificial Sequence
  Synthetic oligonucleotide; CTT chr11 5161254 5161275 5161259 5161254 -
gtcatccctgctatcttctgtc

SEQ ID NO: 154706 - DNA, 22 bp, Artificial Sequence
  Synthetic oligonucleotide; TTG chr11 5161253 5161274 5161258 5161253 -
tcatccctgctatcttctgtct

SEQ ID NO: 154707 - DNA, 22 bp, Artificial Sequence
  Synthetic oligonucleotide; CTG chr11 5161244 5161265 5161249 5161244 -
ctatcttctgtctagtcatact

SEQ ID NO: 154708 - DNA, 22 bp, Artificial Sequence
  Synthetic oligonucleotide; CTA chr11 5161241 5161262 5161246 5161241 -
tcttctgtctagtcatactcct

SEQ ID NO: 154709 - DNA, 22 bp, Artificial Sequence
  Synthetic oligonucleotide; CTT chr11 5161237 5161258 5161242 5161237 -
ctgtctagtcatactcctattc

SEQ ID NO: 154710 - DNA, 22 bp, Artificial Sequence
  Synthetic oligonucleotide; TTC chr11 5161236 5161257 5161241 5161236 -
tgtctagtcatactcctattca

SEQ ID NO: 154711 - DNA, 22 bp, Artificial Sequence
  Synthetic oligonucleotide; CTG chr11 5161234 5161255 5161239 5161234 -
tctagtcatactcctattcacc

SEQ ID NO: 154712 - DNA, 22 bp, Artificial Sequence
  Synthetic oligonucleotide; CTA chr11 5161230 5161251 5161235 5161230 -
gtcatactcctattcaccattc

SEQ ID NO: 154713 - DNA, 22 bp, Artificial Sequence
  Synthetic oligonucleotide; CTC chr11 5161221 5161242 5161226 5161221 -
ctattcaccattctcaactact

SEQ ID NO: 154714 - DNA, 22 bp, Artificial Sequence
  Synthetic oligonucleotide; CTA chr11 5161218 5161239 5161223 5161218 -
ttcaccattctcaactactcat

SEQ ID NO: 154715 - DNA, 22 bp, Artificial Sequence
  Synthetic oligonucleotide; TTC chr11 5161215 5161236 5161220 5161215 -
accattctcaactactcataca

SEQ ID NO: 154716 - DNA, 22 bp, Artificial Sequence
  Synthetic oligonucleotide; TTC chr11 5161208 5161229 5161213 5161208 -
tcaactactcatacatgccctg

SEQ ID NO: 154717 - DNA, 22 bp, Artificial Sequence
  Synthetic oligonucleotide; CTC chr11 5161206 5161227 5161211 5161206 -
aactactcatacatgccctgct

SEQ ID NO: 154718 - DNA, 22 bp, Artificial Sequence
  Synthetic oligonucleotide; CTA chr11 5161201 5161222 5161206 5161201 -
ctcatacatgccctgctcttgt

SEQ ID NO: 154719 - DNA, 22 bp, Artificial Sequence
  Synthetic oligonucleotide; CTC chr11 5161198 5161219 5161203 5161198 -
atacatgccctgctcttgttta

SEQ ID NO: 154720 - DNA, 22 bp, Artificial Sequence
  Synthetic oligonucleotide; CTG chr11 5161186 5161207 5161191 5161186 -
ctcttgtttacactgccggttt

SEQ ID NO: 154721 - DNA, 22 bp, Artificial Sequence
  Synthetic oligonucleotide; CTC chr11 5161183 5161204 5161188 5161183 -
ttgtttacactgccggtttaca

SEQ ID NO: 154722 - DNA, 22 bp, Artificial Sequence
  Synthetic oligonucleotide; CTT chr11 5161181 5161202 5161186 5161181 -
gtttacactgccggtttacact

SEQ ID NO: 154723 - DNA, 22 bp, Artificial Sequence
  Synthetic oligonucleotide; TTG chr11 5161180 5161201 5161185 5161180 -
tttacactgccggtttacactg

SEQ ID NO: 154724 - DNA, 22 bp, Artificial Sequence
  Synthetic oligonucleotide; TTT chr11 5161177 5161198 5161182 5161177 -
acactgccggtttacactgttt

SEQ ID NO: 154725 - DNA, 22 bp, Artificial Sequence
  Synthetic oligonucleotide; TTA chr11 5161176 5161197 5161181 5161176 -
cactgccggtttacactgtttt

SEQ ID NO: 154726 - DNA, 22 bp, Artificial Sequence
  Synthetic oligonucleotide; CTG chr11 5161171 5161192 5161176 5161171 -
ccggtttacactgtttttccaa

SEQ ID NO: 154727 - DNA, 22 bp, Artificial Sequence
  Synthetic oligonucleotide; TTT chr11 5161164 5161185 5161169 5161164 -
acactgtttttccaagccatca

SEQ ID NO: 154728 - DNA, 22 bp, Artificial Sequence
  Synthetic oligonucleotide; TTA chr11 5161163 5161184 5161168 5161163 -
cactgtttttccaagccatcac

SEQ ID NO: 154729 - DNA, 22 bp, Artificial Sequence
  Synthetic oligonucleotide; CTG chr11 5161158 5161179 5161163 5161158 -
tttttccaagccatcacagctg

SEQ ID NO: 154730 - DNA, 22 bp, Artificial Sequence
  Synthetic oligonucleotide; TTT chr11 5161155 5161176 5161160 5161155 -
ttccaagccatcacagctgata

SEQ ID NO: 154731 - DNA, 22 bp, Artificial Sequence
  Synthetic oligonucleotide; TTT chr11 5161154 5161175 5161159 5161154 -
tccaagccatcacagctgatat

SEQ ID NO: 154732 - DNA, 22 bp, Artificial Sequence
  Synthetic oligonucleotide; TTT chr11 5161153 5161174 5161158 5161153 -
ccaagccatcacagctgatatc

SEQ ID NO: 154733 - DNA, 22 bp, Artificial Sequence
  Synthetic oligonucleotide; TTC chr11 5161152 5161173 5161157 5161152 -
caagccatcacagctgatatct

SEQ ID NO: 154734 - DNA, 22 bp, Artificial Sequence
  Synthetic oligonucleotide; CTG chr11 5161136 5161157 5161141 5161136 -
atatctcctggtgctatcccca

SEQ ID NO: 154735 - DNA, 22 bp, Artificial Sequence
  Synthetic oligonucleotide; CTC chr11 5161129 5161150 5161134 5161129 -
ctggtgctatccccaaactgcc

SEQ ID NO: 154736 - DNA, 22 bp, Artificial Sequence
  Synthetic oligonucleotide; CTG chr11 5161126 5161147 5161131 5161126 -
gtgctatccccaaactgccact

SEQ ID NO: 154737 - DNA, 22 bp, Artificial Sequence
  Synthetic oligonucleotide; CTA chr11 5161120 5161141 5161125 5161120 -
tccccaaactgccactcttaac

SEQ ID NO: 154738 - DNA, 22 bp, Artificial Sequence
  Synthetic oligonucleotide; CTG chr11 5161109 5161130 5161114 5161109 -
ccactcttaactcttgaagtaa

SEQ ID NO: 154739 - DNA, 22 bp, Artificial Sequence
  Synthetic oligonucleotide; CTC chr11 5161103 5161124 5161108 5161103 -
ttaactcttgaagtaaataaat

SEQ ID NO: 154740 - DNA, 22 bp, Artificial Sequence
  Synthetic oligonucleotide; CTT chr11 5161101 5161122 5161106 5161101 -
aactcttgaagtaaataaataa

SEQ ID NO: 154741 - DNA, 22 bp, Artificial Sequence
  Synthetic oligonucleotide; TTA chr11 5161100 5161121 5161105 5161100 -
actcttgaagtaaataaataat

SEQ ID NO: 154742 - DNA, 22 bp, Artificial Sequence
  Synthetic oligonucleotide; CTC chr11 5161096 5161117 5161101 5161096 -
ttgaagtaaataaataatcttt

SEQ ID NO: 154743 - DNA, 22 bp, Artificial Sequence
  Synthetic oligonucleotide; CTT chr11 5161094 5161115 5161099 5161094 -
gaagtaaataaataatctttgc

SEQ ID NO: 154744 - DNA, 22 bp, Artificial Sequence
  Synthetic oligonucleotide; TTG chr11 5161093 5161114 5161098 5161093 -
aagtaaataaataatctttgct

SEQ ID NO: 154745 - DNA, 22 bp, Artificial Sequence
  Synthetic oligonucleotide; CTT chr11 5161075 5161096 5161080 5161075 -
tgctggcaggactatgttgaat

SEQ ID NO: 154746 - DNA, 22 bp, Artificial Sequence
  Synthetic oligonucleotide; TTT chr11 5161074 5161095 5161079 5161074 -
gctggcaggactatgttgaatc

SEQ ID NO: 154747 - DNA, 22 bp, Artificial Sequence
  Synthetic oligonucleotide; TTG chr11 5161073 5161094 5161078 5161073 -
ctggcaggactatgttgaatct

SEQ ID NO: 154748 - DNA, 22 bp, Artificial Sequence
  Synthetic oligonucleotide; CTG chr11 5161070 5161091 5161075 5161070 -
gcaggactatgttgaatctcct

SEQ ID NO: 154749 - DNA, 22 bp, Artificial Sequence
  Synthetic oligonucleotide; CTA chr11 5161061 5161082 5161066 5161061 -
tgttgaatctccttaggcactc

SEQ ID NO: 154750 - DNA, 22 bp, Artificial Sequence
  Synthetic oligonucleotide; TTG chr11 5161056 5161077 5161061 5161056 -
aatctccttaggcactctttaa

SEQ ID NO: 154751 - DNA, 22 bp, Artificial Sequence
  Synthetic oligonucleotide; CTC chr11 5161050 5161071 5161055 5161050 -
cttaggcactctttaatcagat

SEQ ID NO: 154752 - DNA, 22 bp, Artificial Sequence
  Synthetic oligonucleotide; CTT chr11 5161047 5161068 5161052 5161047 -
aggcactctttaatcagatgtc

SEQ ID NO: 154753 - DNA, 22 bp, Artificial Sequence
  Synthetic oligonucleotide; TTA chr11 5161046 5161067 5161051 5161046 -
ggcactctttaatcagatgtcc

SEQ ID NO: 154754 - DNA, 22 bp, Artificial Sequence
  Synthetic oligonucleotide; CTC chr11 5161039 5161060 5161044 5161039 -
tttaatcagatgtcctaggtcc

SEQ ID NO: 154755 - DNA, 22 bp, Artificial Sequence
  Synthetic oligonucleotide; CTT chr11 5161037 5161058 5161042 5161037 -
taatcagatgtcctaggtcctc

SEQ ID NO: 154756 - DNA, 22 bp, Artificial Sequence
  Synthetic oligonucleotide; TTT chr11 5161036 5161057 5161041 5161036 -
aatcagatgtcctaggtcctcc

SEQ ID NO: 154757 - DNA, 22 bp, Artificial Sequence
  Synthetic oligonucleotide; TTA chr11 5161035 5161056 5161040 5161035 -
atcagatgtcctaggtcctccc

SEQ ID NO: 154758 - DNA, 22 bp, Artificial Sequence
  Synthetic oligonucleotide; CTA chr11 5161022 5161043 5161027 5161022 -
ggtcctcccacttcttagtcct

SEQ ID NO: 154759 - DNA, 22 bp, Artificial Sequence
  Synthetic oligonucleotide; CTC chr11 5161015 5161036 5161020 5161015 -
ccacttcttagtcctttaatac

SEQ ID NO: 154760 - DNA, 22 bp, Artificial Sequence
  Synthetic oligonucleotide; CTT chr11 5161009 5161030 5161014 5161009 -
cttagtcctttaatacctgttt

SEQ ID NO: 154761 - DNA, 22 bp, Artificial Sequence
  Synthetic oligonucleotide; TTC chr11 5161008 5161029 5161013 5161008 -
ttagtcctttaatacctgtttt

SEQ ID NO: 154762 - DNA, 22 bp, Artificial Sequence
  Synthetic oligonucleotide; CTT chr11 5161006 5161027 5161011 5161006 -
agtcctttaatacctgtttttc

SEQ ID NO: 154763 - DNA, 22 bp, Artificial Sequence
  Synthetic oligonucleotide; TTA chr11 5161005 5161026 5161010 5161005 -
gtcctttaatacctgtttttct

SEQ ID NO: 154764 - DNA, 22 bp, Artificial Sequence
  Synthetic oligonucleotide; CTT chr11 5160999 5161020 5161004 5160999 -
taatacctgtttttctccttct

SEQ ID NO: 154765 - DNA, 22 bp, Artificial Sequence
  Synthetic oligonucleotide; TTT chr11 5160998 5161019 5161003 5160998 -
aatacctgtttttctccttctc

SEQ ID NO: 154766 - DNA, 22 bp, Artificial Sequence
  Synthetic oligonucleotide; TTA chr11 5160997 5161018 5161002 5160997 -
atacctgtttttctccttctct

SEQ ID NO: 154767 - DNA, 22 bp, Artificial Sequence
  Synthetic oligonucleotide; CTG chr11 5160990 5161011 5160995 5160990 -
tttttctccttctcttattcca

SEQ ID NO: 154768 - DNA, 22 bp, Artificial Sequence
  Synthetic oligonucleotide; TTT chr11 5160987 5161008 5160992 5160987 -
ttctccttctcttattccattt

SEQ ID NO: 154769 - DNA, 22 bp, Artificial Sequence
  Synthetic oligonucleotide; TTT chr11 5160986 5161007 5160991 5160986 -
tctccttctcttattccatttg

SEQ ID NO: 154770 - DNA, 22 bp, Artificial Sequence
  Synthetic oligonucleotide; TTT chr11 5160985 5161006 5160990 5160985 -
ctccttctcttattccatttgg

SEQ ID NO: 154771 - DNA, 22 bp, Artificial Sequence
  Synthetic oligonucleotide; TTC chr11 5160984 5161005 5160989 5160984 -
tccttctcttattccatttggt

SEQ ID NO: 154772 - DNA, 22 bp, Artificial Sequence
  Synthetic oligonucleotide; CTC chr11 5160982 5161003 5160987 5160982 -
cttctcttattccatttggttt

SEQ ID NO: 154773 - DNA, 22 bp, Artificial Sequence
  Synthetic oligonucleotide; CTT chr11 5160979 5161000 5160984 5160979 -
ctcttattccatttggtttttc

SEQ ID NO: 154774 - DNA, 22 bp, Artificial Sequence
  Synthetic oligonucleotide; TTC chr11 5160978 5160999 5160983 5160978 -
tcttattccatttggtttttca

SEQ ID NO: 154775 - DNA, 22 bp, Artificial Sequence
  Synthetic oligonucleotide; CTC chr11 5160976 5160997 5160981 5160976 -
ttattccatttggtttttcaat

SEQ ID NO: 154776 - DNA, 22 bp, Artificial Sequence
  Synthetic oligonucleotide; CTT chr11 5160974 5160995 5160979 5160974 -
attccatttggtttttcaatcc

SEQ ID NO: 154777 - DNA, 22 bp, Artificial Sequence
  Synthetic oligonucleotide; TTA chr11 5160973 5160994 5160978 5160973 -
ttccatttggtttttcaatcca

SEQ ID NO: 154778 - DNA, 22 bp, Artificial Sequence
  Synthetic oligonucleotide; TTC chr11 5160970 5160991 5160975 5160970 -
catttggtttttcaatccatac

SEQ ID NO: 154779 - DNA, 22 bp, Artificial Sequence
  Synthetic oligonucleotide; TTT chr11 5160965 5160986 5160970 5160965 -
ggtttttcaatccatacaaaac

SEQ ID NO: 154780 - DNA, 22 bp, Artificial Sequence
  Synthetic oligonucleotide; TTG chr11 5160964 5160985 5160969 5160964 -
gtttttcaatccatacaaaacc

SEQ ID NO: 154781 - DNA, 22 bp, Artificial Sequence
  Synthetic oligonucleotide; TTT chr11 5160960 5160981 5160965 5160960 -
ttcaatccatacaaaaccgtat

SEQ ID NO: 154782 - DNA, 22 bp, Artificial Sequence
  Synthetic oligonucleotide; TTT chr11 5160959 5160980 5160964 5160959 -
tcaatccatacaaaaccgtatc

SEQ ID NO: 154783 - DNA, 22 bp, Artificial Sequence
  Synthetic oligonucleotide; TTT chr11 5160958 5160979 5160963 5160958 -
caatccatacaaaaccgtatcc

SEQ ID NO: 154784 - DNA, 22 bp, Artificial Sequence
  Synthetic oligonucleotide; TTC chr11 5160957 5160978 5160962 5160957 -
aatccatacaaaaccgtatcca

SEQ ID NO: 154785 - DNA, 22 bp, Artificial Sequence
  Synthetic oligonucleotide; TTC chr11 5160917 5160938 5160922 5160917 -
tacatgacaaatgtttcttcta

SEQ ID NO: 154786 - DNA, 22 bp, Artificial Sequence
  Synthetic oligonucleotide; CTA chr11 5160915 5160936 5160920 5160915 -
catgacaaatgtttcttctaac

SEQ ID NO: 154787 - DNA, 22 bp, Artificial Sequence
  Synthetic oligonucleotide; TTT chr11 5160901 5160922 5160906 5160901 -
cttctaacaaccccacaatatc

SEQ ID NO: 154788 - DNA, 22 bp, Artificial Sequence
  Synthetic oligonucleotide; TTC chr11 5160900 5160921 5160905 5160900 -
ttctaacaaccccacaatatca

SEQ ID NO: 154789 - DNA, 22 bp, Artificial Sequence
  Synthetic oligonucleotide; CTT chr11 5160898 5160919 5160903 5160898 -
ctaacaaccccacaatatcacc

SEQ ID NO: 154790 - DNA, 22 bp, Artificial Sequence
  Synthetic oligonucleotide; TTC chr11 5160897 5160918 5160902 5160897 -
taacaaccccacaatatcaccc

SEQ ID NO: 154791 - DNA, 22 bp, Artificial Sequence
  Synthetic oligonucleotide; CTA chr11 5160895 5160916 5160900 5160895 -
acaaccccacaatatcacccct

SEQ ID NO: 154792 - DNA, 22 bp, Artificial Sequence
  Synthetic oligonucleotide; CTT chr11 5160872 5160893 5160877 5160872 -
accacaaaatcttccttcagct

SEQ ID NO: 154793 - DNA, 22 bp, Artificial Sequence
  Synthetic oligonucleotide; TTA chr11 5160871 5160892 5160876 5160871 -
ccacaaaatcttccttcagctt

SEQ ID NO: 154794 - DNA, 22 bp, Artificial Sequence
  Synthetic oligonucleotide; CTT chr11 5160859 5160880 5160864 5160859 -
ccttcagcttaatctctcccac

SEQ ID NO: 154795 - DNA, 22 bp, Artificial Sequence
  Synthetic oligonucleotide; TTC chr11 5160858 5160879 5160863 5160858 -
cttcagcttaatctctcccact

SEQ ID NO: 154796 - DNA, 22 bp, Artificial Sequence
  Synthetic oligonucleotide; CTT chr11 5160855 5160876 5160860 5160855 -
cagcttaatctctcccactcta

SEQ ID NO: 154797 - DNA, 22 bp, Artificial Sequence
  Synthetic oligonucleotide; TTC chr11 5160854 5160875 5160859 5160854 -
agcttaatctctcccactctag

SEQ ID NO: 154798 - DNA, 22 bp, Artificial Sequence
  Synthetic oligonucleotide; CTT chr11 5160849 5160870 5160854 5160849 -
aatctctcccactctaggttcc

SEQ ID NO: 154799 - DNA, 22 bp, Artificial Sequence
  Synthetic oligonucleotide; TTA chr11 5160848 5160869 5160853 5160848 -
atctctcccactctaggttccc

SEQ ID NO: 154800 - DNA, 22 bp, Artificial Sequence
  Synthetic oligonucleotide; CTC chr11 5160843 5160864 5160848 5160843 -
tcccactctaggttcccacgcc

SEQ ID NO: 154801 - DNA, 22 bp, Artificial Sequence
  Synthetic oligonucleotide; CTC chr11 5160841 5160862 5160846 5160841 -
ccactctaggttcccacgccgc

SEQ ID NO: 154802 - DNA, 22 bp, Artificial Sequence
  Synthetic oligonucleotide; CTC chr11 5160835 5160856 5160840 5160835 -
taggttcccacgccgcccctaa

SEQ ID NO: 154803 - DNA, 22 bp, Artificial Sequence
  Synthetic oligonucleotide; CTA chr11 5160833 5160854 5160838 5160833 -
ggttcccacgccgcccctaatc

SEQ ID NO: 154804 - DNA, 22 bp, Artificial Sequence
  Synthetic oligonucleotide; TTC chr11 5160828 5160849 5160833 5160828 -
ccacgccgcccctaatcccgct

SEQ ID NO: 154805 - DNA, 22 bp, Artificial Sequence
  Synthetic oligonucleotide; CTA chr11 5160814 5160835 5160819 5160814 -
atcccgctcgaagcagccctga

SEQ ID NO: 154806 - DNA, 22 bp, Artificial Sequence
  Synthetic oligonucleotide; CTC chr11 5160805 5160826 5160810 5160805 -
gaagcagccctgagaaatatcg

SEQ ID NO: 154807 - DNA, 22 bp, Artificial Sequence
  Synthetic oligonucleotide; CTG chr11 5160793 5160814 5160798 5160793 -
agaaatatcgcccattatctct

SEQ ID NO: 154808 - DNA, 22 bp, Artificial Sequence
  Synthetic oligonucleotide; TTA chr11 5160776 5160797 5160781 5160776 -
tctctccataccatcccccaaa

SEQ ID NO: 154809 - DNA, 22 bp, Artificial Sequence
  Synthetic oligonucleotide; CTC chr11 5160772 5160793 5160777 5160772 -
tccataccatcccccaaaattt

SEQ ID NO: 154810 - DNA, 22 bp, Artificial Sequence
  Synthetic oligonucleotide; CTC chr11 5160770 5160791 5160775 5160770 -
cataccatcccccaaaattttc

SEQ ID NO: 154811 - DNA, 22 bp, Artificial Sequence
  Synthetic oligonucleotide; TTT chr11 5160750 5160771 5160755 5160750 -
tcgctgccccaacacttcaaca

SEQ ID NO: 154812 - DNA, 22 bp, Artificial Sequence
  Synthetic oligonucleotide; TTT chr11 5160749 5160770 5160754 5160749 -
cgctgccccaacacttcaacac

SEQ ID NO: 154813 - DNA, 22 bp, Artificial Sequence
  Synthetic oligonucleotide; TTC chr11 5160748 5160769 5160753 5160748 -
gctgccccaacacttcaacact

SEQ ID NO: 154814 - DNA, 22 bp, Artificial Sequence
  Synthetic oligonucleotide; CTG chr11 5160744 5160765 5160749 5160744 -
ccccaacacttcaacactatta

SEQ ID NO: 154815 - DNA, 22 bp, Artificial Sequence
  Synthetic oligonucleotide; CTT chr11 5160733 5160754 5160738 5160733 -
caacactattatgttttatttt

SEQ ID NO: 154816 - DNA, 22 bp, Artificial Sequence
  Synthetic oligonucleotide; TTC chr11 5160732 5160753 5160737 5160732 -
aacactattatgttttattttt

SEQ ID NO: 154817 - DNA, 22 bp, Artificial Sequence
  Synthetic oligonucleotide; CTA chr11 5160725 5160746 5160730 5160725 -
ttatgttttatttttcttatta

SEQ ID NO: 154818 - DNA, 22 bp, Artificial Sequence
  Synthetic oligonucleotide; TTA chr11 5160722 5160743 5160727 5160722 -
tgttttatttttcttattaata

SEQ ID NO: 154819 - DNA, 22 bp, Artificial Sequence
  Synthetic oligonucleotide; TTT chr11 5160717 5160738 5160722 5160717 -
tatttttcttattaatataaga

SEQ ID NO: 154820 - DNA, 22 bp, Artificial Sequence
  Synthetic oligonucleotide; TTT chr11 5160716 5160737 5160721 5160716 -
atttttcttattaatataagaa

SEQ ID NO: 154821 - DNA, 22 bp, Artificial Sequence
  Synthetic oligonucleotide; TTA chr11 5160715 5160736 5160720 5160715 -
tttttcttattaatataagaag

SEQ ID NO: 154822 - DNA, 22 bp, Artificial Sequence
  Synthetic oligonucleotide; TTT chr11 5160712 5160733 5160717 5160712 -
ttcttattaatataagaagaca

SEQ ID NO: 154823 - DNA, 22 bp, Artificial Sequence
  Synthetic oligonucleotide; TTT chr11 5160711 5160732 5160716 5160711 -
tcttattaatataagaagacag

SEQ ID NO: 154824 - DNA, 22 bp, Artificial Sequence
  Synthetic oligonucleotide; TTT chr11 5160710 5160731 5160715 5160710 -
cttattaatataagaagacagg

SEQ ID NO: 154825 - DNA, 22 bp, Artificial Sequence
  Synthetic oligonucleotide; TTC chr11 5160709 5160730 5160714 5160709 -
ttattaatataagaagacagga

SEQ ID NO: 154826 - DNA, 22 bp, Artificial Sequence
  Synthetic oligonucleotide; CTT chr11 5160707 5160728 5160712 5160707 -
attaatataagaagacaggaat

SEQ ID NO: 154827 - DNA, 22 bp, Artificial Sequence
  Synthetic oligonucleotide; TTA chr11 5160706 5160727 5160711 5160706 -
ttaatataagaagacaggaatg

SEQ ID NO: 154828 - DNA, 22 bp, Artificial Sequence
  Synthetic oligonucleotide; TTA chr11 5160703 5160724 5160708 5160703 -
atataagaagacaggaatgtca

SEQ ID NO: 154829 - DNA, 22 bp, Artificial Sequence
  Synthetic oligonucleotide; CTC chr11 5160675 5160696 5160680 5160675 -
tgagcccaagctaagccatcat

SEQ ID NO: 154830 - DNA, 22 bp, Artificial Sequence
  Synthetic oligonucleotide; CTG chr11 5160673 5160694 5160678 5160673 -
agcccaagctaagccatcatgt

SEQ ID NO: 154831 - DNA, 22 bp, Artificial Sequence
  Synthetic oligonucleotide; CTA chr11 5160662 5160683 5160667 5160662 -
agccatcatgtcccctgtgacc

SEQ ID NO: 154832 - DNA, 22 bp, Artificial Sequence
  Synthetic oligonucleotide; CTG chr11 5160645 5160666 5160650 5160645 -
tgacctgcaggtacacatacag

SEQ ID NO: 154833 - DNA, 22 bp, Artificial Sequence
  Synthetic oligonucleotide; CTG chr11 5160638 5160659 5160643 5160638 -
caggtacacatacagatggcca

SEQ ID NO: 154834 - DNA, 22 bp, Artificial Sequence
  Synthetic oligonucleotide; TTC chr11 5160612 5160633 5160617 5160612 -
ctgccttaactgatgacattcc

SEQ ID NO: 154835 - DNA, 22 bp, Artificial Sequence
  Synthetic oligonucleotide; CTG chr11 5160609 5160630 5160614 5160609 -
ccttaactgatgacattccacc

SEQ ID NO: 154836 - DNA, 22 bp, Artificial Sequence
  Synthetic oligonucleotide; CTT chr11 5160605 5160626 5160610 5160605 -
aactgatgacattccaccacaa

SEQ ID NO: 154837 - DNA, 22 bp, Artificial Sequence
  Synthetic oligonucleotide; TTA chr11 5160604 5160625 5160609 5160604 -
actgatgacattccaccacaaa

SEQ ID NO: 154838 - DNA, 22 bp, Artificial Sequence
  Synthetic oligonucleotide; CTG chr11 5160600 5160621 5160605 5160600 -
atgacattccaccacaaaagaa

SEQ ID NO: 154839 - DNA, 22 bp, Artificial Sequence
  Synthetic oligonucleotide; TTC chr11 5160591 5160612 5160596 5160591 -
caccacaaaagaagtgaaaatg

SEQ ID NO: 154840 - DNA, 22 bp, Artificial Sequence
  Synthetic oligonucleotide; CTG chr11 5160564 5160585 5160569 5160564 -
ttcctgccttaactgatgacat

SEQ ID NO: 154841 - DNA, 22 bp, Artificial Sequence
  Synthetic oligonucleotide; TTC chr11 5160561 5160582 5160566 5160561 -
ctgccttaactgatgacattgt

SEQ ID NO: 154842 - DNA, 22 bp, Artificial Sequence
  Synthetic oligonucleotide; CTG chr11 5160558 5160579 5160563 5160558 -
ccttaactgatgacattgtctt

SEQ ID NO: 154843 - DNA, 22 bp, Artificial Sequence
  Synthetic oligonucleotide; CTT chr11 5160554 5160575 5160559 5160554 -
aactgatgacattgtcttgtga

SEQ ID NO: 154844 - DNA, 22 bp, Artificial Sequence
  Synthetic oligonucleotide; TTA chr11 5160553 5160574 5160558 5160553 -
actgatgacattgtcttgtgaa

SEQ ID NO: 154845 - DNA, 22 bp, Artificial Sequence
  Synthetic oligonucleotide; CTG chr11 5160549 5160570 5160554 5160549 -
atgacattgtcttgtgaaagtc

SEQ ID NO: 154846 - DNA, 22 bp, Artificial Sequence
  Synthetic oligonucleotide; TTG chr11 5160540 5160561 5160545 5160540 -
tcttgtgaaagtccttctcctg

SEQ ID NO: 154847 - DNA, 22 bp, Artificial Sequence
  Synthetic oligonucleotide; CTT chr11 5160536 5160557 5160541 5160536 -
gtgaaagtccttctcctggctc

SEQ ID NO: 154848 - DNA, 22 bp, Artificial Sequence
  Synthetic oligonucleotide; TTG chr11 5160535 5160556 5160540 5160535 -
tgaaagtccttctcctggctca

SEQ ID NO: 154849 - DNA, 22 bp, Artificial Sequence
  Synthetic oligonucleotide; CTT chr11 5160524 5160545 5160529 5160524 -
ctcctggctcatcctggctcaa

SEQ ID NO: 154850 - DNA, 22 bp, Artificial Sequence
  Synthetic oligonucleotide; TTC chr11 5160523 5160544 5160528 5160523 -
tcctggctcatcctggctcaaa

SEQ ID NO: 154851 - DNA, 22 bp, Artificial Sequence
  Synthetic oligonucleotide; CTC chr11 5160521 5160542 5160526 5160521 -
ctggctcatcctggctcaaaag

SEQ ID NO: 154852 - DNA, 22 bp, Artificial Sequence
  Synthetic oligonucleotide; CTG chr11 5160518 5160539 5160523 5160518 -
gctcatcctggctcaaaagctc

SEQ ID NO: 154853 - DNA, 22 bp, Artificial Sequence
  Synthetic oligonucleotide; CTC chr11 5160514 5160535 5160519 5160514 -
atcctggctcaaaagctcccct

SEQ ID NO: 154854 - DNA, 22 bp, Artificial Sequence
  Synthetic oligonucleotide; CTG chr11 5160508 5160529 5160513 5160508 -
gctcaaaagctcccctactgag

SEQ ID NO: 154855 - DNA, 22 bp, Artificial Sequence
  Synthetic oligonucleotide; CTC chr11 5160504 5160525 5160509 5160504 -
aaaagctcccctactgagcacc

SEQ ID NO: 154856 - DNA, 22 bp, Artificial Sequence
  Synthetic oligonucleotide; CTC chr11 5160496 5160517 5160501 5160496 -
ccctactgagcaccttgtgacc

SEQ ID NO: 154857 - DNA, 22 bp, Artificial Sequence
  Synthetic oligonucleotide; CTA chr11 5160491 5160512 5160496 5160491 -
ctgagcaccttgtgacccccca

SEQ ID NO: 154858 - DNA, 22 bp, Artificial Sequence
  Synthetic oligonucleotide; CTG chr11 5160488 5160509 5160493 5160488 -
agcaccttgtgaccccccactc

SEQ ID NO: 154859 - DNA, 22 bp, Artificial Sequence
  Synthetic oligonucleotide; CTT chr11 5160480 5160501 5160485 5160480 -
gtgaccccccactcctgcccgc

SEQ ID NO: 154860 - DNA, 22 bp, Artificial Sequence
  Synthetic oligonucleotide; TTG chr11 5160479 5160500 5160484 5160479 -
tgaccccccactcctgcccgcc

SEQ ID NO: 154861 - DNA, 22 bp, Artificial Sequence
  Synthetic oligonucleotide; CTC chr11 5160466 5160487 5160471 5160466 -
ctgcccgccagagaacaacccc

SEQ ID NO: 154862 - DNA, 22 bp, Artificial Sequence
  Synthetic oligonucleotide; CTG chr11 5160463 5160484 5160468 5160463 -
cccgccagagaacaacccccct

SEQ ID NO: 154863 - DNA, 22 bp, Artificial Sequence
  Synthetic oligonucleotide; CTT chr11 5160440 5160461 5160445 5160440 -
tgactgtaattttcctttacct

SEQ ID NO: 154864 - DNA, 22 bp, Artificial Sequence
  Synthetic oligonucleotide; TTT chr11 5160439 5160460 5160444 5160439 -
gactgtaattttcctttaccta

SEQ ID NO: 154865 - DNA, 22 bp, Artificial Sequence
  Synthetic oligonucleotide; TTG chr11 5160438 5160459 5160443 5160438 -
actgtaattttcctttacctac

SEQ ID NO: 154866 - DNA, 22 bp, Artificial Sequence
  Synthetic oligonucleotide; CTG chr11 5160434 5160455 5160439 5160434 -
taattttcctttacctacccaa

SEQ ID NO: 154867 - DNA, 22 bp, Artificial Sequence
  Synthetic oligonucleotide; TTT chr11 5160428 5160449 5160433 5160428 -
tcctttacctacccaaatctta

SEQ ID NO: 154868 - DNA, 22 bp, Artificial Sequence
  Synthetic oligonucleotide; TTT chr11 5160427 5160448 5160432 5160427 -
cctttacctacccaaatcttat

SEQ ID NO: 154869 - DNA, 22 bp, Artificial Sequence
  Synthetic oligonucleotide; TTC chr11 5160426 5160447 5160431 5160426 -
ctttacctacccaaatcttata

SEQ ID NO: 154870 - DNA, 22 bp, Artificial Sequence
  Synthetic oligonucleotide; CTT chr11 5160423 5160444 5160428 5160423 -
tacctacccaaatcttataaaa

SEQ ID NO: 154871 - DNA, 22 bp, Artificial Sequence
  Synthetic oligonucleotide; TTT chr11 5160422 5160443 5160427 5160422 -
acctacccaaatcttataaaac

SEQ ID NO: 154872 - DNA, 22 bp, Artificial Sequence
  Synthetic oligonucleotide; TTA chr11 5160421 5160442 5160426 5160421 -
cctacccaaatcttataaaaca

SEQ ID NO: 154873 - DNA, 22 bp, Artificial Sequence
  Synthetic oligonucleotide; CTA chr11 5160417 5160438 5160422 5160417 -
cccaaatcttataaaacagccc

SEQ ID NO: 154874 - DNA, 22 bp, Artificial Sequence
  Synthetic oligonucleotide; CTT chr11 5160407 5160428 5160412 5160407 -
ataaaacagccccactcctatc

SEQ ID NO: 154875 - DNA, 22 bp, Artificial Sequence
  Synthetic oligonucleotide; TTA chr11 5160406 5160427 5160411 5160406 -
taaaacagccccactcctatct

SEQ ID NO: 154876 - DNA, 22 bp, Artificial Sequence
  Synthetic oligonucleotide; CTC chr11 5160390 5160411 5160395 5160390 -
ctatctccctttgctgactctc

SEQ ID NO: 154877 - DNA, 22 bp, Artificial Sequence
  Synthetic oligonucleotide; CTA chr11 5160387 5160408 5160392 5160387 -
tctccctttgctgactctcttt

SEQ ID NO: 154878 - DNA, 22 bp, Artificial Sequence
  Synthetic oligonucleotide; CTC chr11 5160383 5160404 5160388 5160383 -
cctttgctgactctcttttcgg

SEQ ID NO: 154879 - DNA, 22 bp, Artificial Sequence
  Synthetic oligonucleotide; CTT chr11 5160379 5160400 5160384 5160379 -
tgctgactctcttttcggactc

SEQ ID NO: 154880 - DNA, 22 bp, Artificial Sequence
  Synthetic oligonucleotide; TTT chr11 5160378 5160399 5160383 5160378 -
gctgactctcttttcggactca

SEQ ID NO: 154881 - DNA, 22 bp, Artificial Sequence
  Synthetic oligonucleotide; TTG chr11 5160377 5160398 5160382 5160377 -
ctgactctcttttcggactcag

SEQ ID NO: 154882 - DNA, 22 bp, Artificial Sequence
  Synthetic oligonucleotide; CTG chr11 5160374 5160395 5160379 5160374 -
actctcttttcggactcagccc

SEQ ID NO: 154883 - DNA, 22 bp, Artificial Sequence
  Synthetic oligonucleotide; CTC chr11 5160370 5160391 5160375 5160370 -
tcttttcggactcagcccgcct

SEQ ID NO: 154884 - DNA, 22 bp, Artificial Sequence
  Synthetic oligonucleotide; CTC chr11 5160368 5160389 5160373 5160368 -
ttttcggactcagcccgcctgc

SEQ ID NO: 154885 - DNA, 22 bp, Artificial Sequence
  Synthetic oligonucleotide; CTT chr11 5160366 5160387 5160371 5160366 -
ttcggactcagcccgcctgcac

SEQ ID NO: 154886 - DNA, 22 bp, Artificial Sequence
  Synthetic oligonucleotide; TTT chr11 5160365 5160386 5160370 5160365 -
tcggactcagcccgcctgcacc

SEQ ID NO: 154887 - DNA, 22 bp, Artificial Sequence
  Synthetic oligonucleotide; TTT chr11 5160364 5160385 5160369 5160364 -
cggactcagcccgcctgcaccc

SEQ ID NO: 154888 - DNA, 22 bp, Artificial Sequence
  Synthetic oligonucleotide; TTC chr11 5160363 5160384 5160368 5160363 -
ggactcagcccgcctgcaccca

SEQ ID NO: 154889 - DNA, 22 bp, Artificial Sequence
  Synthetic oligonucleotide; CTC chr11 5160357 5160378 5160362 5160357 -
agcccgcctgcacccaggtgat

SEQ ID NO: 154890 - DNA, 22 bp, Artificial Sequence
  Synthetic oligonucleotide; CTG chr11 5160347 5160368 5160352 5160347 -
cacccaggtgataaaaagcttt

SEQ ID NO: 154891 - DNA, 22 bp, Artificial Sequence
  Synthetic oligonucleotide; CTT chr11 5160326 5160347 5160331 5160326 -
tattgctcacacaaagcctgtt

SEQ ID NO: 154892 - DNA, 22 bp, Artificial Sequence
  Synthetic oligonucleotide; TTT chr11 5160325 5160346 5160330 5160325 -
attgctcacacaaagcctgttt

SEQ ID NO: 154893 - DNA, 22 bp, Artificial Sequence
  Synthetic oligonucleotide; TTA chr11 5160324 5160345 5160329 5160324 -
ttgctcacacaaagcctgtttg

SEQ ID NO: 154894 - DNA, 22 bp, Artificial Sequence
  Synthetic oligonucleotide; TTG chr11 5160321 5160342 5160326 5160321 -
ctcacacaaagcctgtttggta

SEQ ID NO: 154895 - DNA, 22 bp, Artificial Sequence
  Synthetic oligonucleotide; CTC chr11 5160318 5160339 5160323 5160318 -
acacaaagcctgtttggtagtc

SEQ ID NO: 154896 - DNA, 22 bp, Artificial Sequence
  Synthetic oligonucleotide; CTG chr11 5160306 5160327 5160311 5160306 -
tttggtagtctcctcacaggga

SEQ ID NO: 154897 - DNA, 22 bp, Artificial Sequence
  Synthetic oligonucleotide; TTT chr11 5160303 5160324 5160308 5160303 -
ggtagtctcctcacagggatgc

SEQ ID NO: 154898 - DNA, 22 bp, Artificial Sequence
  Synthetic oligonucleotide; TTG chr11 5160302 5160323 5160307 5160302 -
gtagtctcctcacagggatgcg

SEQ ID NO: 154899 - DNA, 22 bp, Artificial Sequence
  Synthetic oligonucleotide; CTC chr11 5160294 5160315 5160299 5160294 -
ctcacagggatgcgcatgaaac

SEQ ID NO: 154900 - DNA, 22 bp, Artificial Sequence
  Synthetic oligonucleotide; CTC chr11 5160291 5160312 5160296 5160291 -
acagggatgcgcatgaaactga

SEQ ID NO: 154901 - DNA, 22 bp, Artificial Sequence
  Synthetic oligonucleotide; CTG chr11 5160270 5160291 5160275 5160270 -
aataaccaatgagtcactaaag

SEQ ID NO: 154902 - DNA, 22 bp, Artificial Sequence
  Synthetic oligonucleotide; CTA chr11 5160251 5160272 5160256 5160251 -
aagaaattaagaaggaaatttt

SEQ ID NO: 154903 - DNA, 22 bp, Artificial Sequence
  Synthetic oligonucleotide; TTA chr11 5160242 5160263 5160247 5160242 -
agaaggaaattttaaaacttct

SEQ ID NO: 154904 - DNA, 22 bp, Artificial Sequence
  Synthetic oligonucleotide; TTT chr11 5160230 5160251 5160235 5160230 -
taaaacttcttgaaacaagtga

SEQ ID NO: 154905 - DNA, 22 bp, Artificial Sequence
  Synthetic oligonucleotide; TTT chr11 5160229 5160250 5160234 5160229 -
aaaacttcttgaaacaagtgaa

SEQ ID NO: 154906 - DNA, 22 bp, Artificial Sequence
  Synthetic oligonucleotide; TTA chr11 5160228 5160249 5160233 5160228 -
aaacttcttgaaacaagtgaaa

SEQ ID NO: 154907 - DNA, 22 bp, Artificial Sequence
  Synthetic oligonucleotide; CTT chr11 5160222 5160243 5160227 5160222 -
cttgaaacaagtgaaaatggaa

SEQ ID NO: 154908 - DNA, 22 bp, Artificial Sequence
  Synthetic oligonucleotide; TTC chr11 5160221 5160242 5160226 5160221 -
ttgaaacaagtgaaaatggaaa

SEQ ID NO: 154909 - DNA, 22 bp, Artificial Sequence
  Synthetic oligonucleotide; CTT chr11 5160219 5160240 5160224 5160219 -
gaaacaagtgaaaatggaaata

SEQ ID NO: 154910 - DNA, 22 bp, Artificial Sequence
  Synthetic oligonucleotide; TTG chr11 5160218 5160239 5160223 5160218 -
aaacaagtgaaaatggaaatac

SEQ ID NO: 154911 - DNA, 22 bp, Artificial Sequence
  Synthetic oligonucleotide; CTA chr11 5160180 5160201 5160185 5160180 -
caggatatggcaaaagcagtac

SEQ ID NO: 154912 - DNA, 22 bp, Artificial Sequence
  Synthetic oligonucleotide; CTT chr11 5160156 5160177 5160161 5160156 -
agagggaagttcatagcaataa

SEQ ID NO: 154913 - DNA, 22 bp, Artificial Sequence
  Synthetic oligonucleotide; TTA chr11 5160155 5160176 5160160 5160155 -
gagggaagttcatagcaataaa

SEQ ID NO: 154914 - DNA, 22 bp, Artificial Sequence
  Synthetic oligonucleotide; TTC chr11 5160144 5160165 5160149 5160144 -
atagcaataaacacctatatcc

SEQ ID NO: 154915 - DNA, 22 bp, Artificial Sequence
  Synthetic oligonucleotide; CTA chr11 5160127 5160148 5160132 5160127 -
tatccaaaaaagtagaaaggct

SEQ ID NO: 154916 - DNA, 22 bp, Artificial Sequence
  Synthetic oligonucleotide; CTT chr11 5160104 5160125 5160109 5160104 -
caactaagcaaccaaacaatgt

SEQ ID NO: 154917 - DNA, 22 bp, Artificial Sequence
  Synthetic oligonucleotide; TTC chr11 5160103 5160124 5160108 5160103 -
aactaagcaaccaaacaatgta

SEQ ID NO: 154918 - DNA, 22 bp, Artificial Sequence
  Synthetic oligonucleotide; CTA chr11 5160098 5160119 5160103 5160098 -
agcaaccaaacaatgtacctca

SEQ ID NO: 154919 - DNA, 22 bp, Artificial Sequence
  Synthetic oligonucleotide; CTC chr11 5160077 5160098 5160082 5160077 -
aaggaaataggaaagcaagaac

SEQ ID NO: 154920 - DNA, 22 bp, Artificial Sequence
  Synthetic oligonucleotide; TTA chr11 5160037 5160058 5160042 5160037 -
atagaaggggagaaataagaaa

SEQ ID NO: 154921 - DNA, 22 bp, Artificial Sequence
  Synthetic oligonucleotide; TTG chr11 5159989 5160010 5159994 5159989 -
agaccaaaaaatacagaaaatc

SEQ ID NO: 154922 - DNA, 22 bp, Artificial Sequence
  Synthetic oligonucleotide; TTA chr11 5159963 5159984 5159968 5159963 -
aaaacaaacagttgctttcttg

SEQ ID NO: 154923 - DNA, 22 bp, Artificial Sequence
  Synthetic oligonucleotide; TTG chr11 5159949 5159970 5159954 5159949 -
ctttcttggaaaggtaaacaaa

SEQ ID NO: 154924 - DNA, 22 bp, Artificial Sequence
  Synthetic oligonucleotide; CTT chr11 5159946 5159967 5159951 5159946 -
tcttggaaaggtaaacaaaatc

SEQ ID NO: 154925 - DNA, 22 bp, Artificial Sequence
  Synthetic oligonucleotide; TTT chr11 5159945 5159966 5159950 5159945 -
cttggaaaggtaaacaaaatca

SEQ ID NO: 154926 - DNA, 22 bp, Artificial Sequence
  Synthetic oligonucleotide; TTC chr11 5159944 5159965 5159949 5159944 -
ttggaaaggtaaacaaaatcaa

SEQ ID NO: 154927 - DNA, 22 bp, Artificial Sequence
  Synthetic oligonucleotide; CTT chr11 5159942 5159963 5159947 5159942 -
ggaaaggtaaacaaaatcaaca

SEQ ID NO: 154928 - DNA, 22 bp, Artificial Sequence
  Synthetic oligonucleotide; TTG chr11 5159941 5159962 5159946 5159941 -
gaaaggtaaacaaaatcaacaa

SEQ ID NO: 154929 - DNA, 22 bp, Artificial Sequence
  Synthetic oligonucleotide; CTT chr11 5159914 5159935 5159919 5159914 -
taagaaaaaagagtcaaataaa

SEQ ID NO: 154930 - DNA, 22 bp, Artificial Sequence
  Synthetic oligonucleotide; TTT chr11 5159913 5159934 5159918 5159913 -
aagaaaaaagagtcaaataaaa

SEQ ID NO: 154931 - DNA, 22 bp, Artificial Sequence
  Synthetic oligonucleotide; TTA chr11 5159912 5159933 5159917 5159912 -
agaaaaaagagtcaaataaaat

SEQ ID NO: 154932 - DNA, 22 bp, Artificial Sequence
  Synthetic oligonucleotide; TTA chr11 5159888 5159909 5159893 5159888 -
gaaaatgaaaaagaggatataa

SEQ ID NO: 154933 - DNA, 22 bp, Artificial Sequence
  Synthetic oligonucleotide; TTG chr11 5159860 5159881 5159865 5159860 -
agacctcagcaacacaaagact

SEQ ID NO: 154934 - DNA, 22 bp, Artificial Sequence
  Synthetic oligonucleotide; CTC chr11 5159853 5159874 5159858 5159853 -
agcaacacaaagactcattaga

SEQ ID NO: 154935 - DNA, 22 bp, Artificial Sequence
  Synthetic oligonucleotide; CTC chr11 5159837 5159858 5159842 5159837 -
attagatactattatgaacaac

SEQ ID NO: 154936 - DNA, 22 bp, Artificial Sequence
  Synthetic oligonucleotide; TTA chr11 5159833 5159854 5159838 5159833 -
gatactattatgaacaactgta

SEQ ID NO: 154937 - DNA, 22 bp, Artificial Sequence
  Synthetic oligonucleotide; CTA chr11 5159826 5159847 5159831 5159826 -
ttatgaacaactgtattccaac

SEQ ID NO: 154938 - DNA, 22 bp, Artificial Sequence
  Synthetic oligonucleotide; TTA chr11 5159823 5159844 5159828 5159823 -
tgaacaactgtattccaacaaa

SEQ ID NO: 154939 - DNA, 22 bp, Artificial Sequence
  Synthetic oligonucleotide; CTG chr11 5159813 5159834 5159818 5159813 -
tattccaacaaattggaaaatc

SEQ ID NO: 154940 - DNA, 22 bp, Artificial Sequence
  Synthetic oligonucleotide; TTC chr11 5159808 5159829 5159813 5159808 -
caacaaattggaaaatctagaa

SEQ ID NO: 154941 - DNA, 22 bp, Artificial Sequence
  Synthetic oligonucleotide; TTG chr11 5159798 5159819 5159803 5159798 -
gaaaatctagaataaatggata

SEQ ID NO: 154942 - DNA, 22 bp, Artificial Sequence
  Synthetic oligonucleotide; CTA chr11 5159789 5159810 5159794 5159789 -
gaataaatggataaattcctgg

SEQ ID NO: 154943 - DNA, 22 bp, Artificial Sequence
  Synthetic oligonucleotide; TTC chr11 5159771 5159792 5159776 5159771 -
ctggacacatacagcctagcaa

SEQ ID NO: 154944 - DNA, 22 bp, Artificial Sequence
  Synthetic oligonucleotide; CTG chr11 5159768 5159789 5159773 5159768 -
gacacatacagcctagcaagac

SEQ ID NO: 154945 - DNA, 22 bp, Artificial Sequence
  Synthetic oligonucleotide; CTA chr11 5159753 5159774 5159758 5159753 -
gcaagactgaagcatgtagaaa

SEQ ID NO: 154946 - DNA, 22 bp, Artificial Sequence
  Synthetic oligonucleotide; CTG chr11 5159744 5159765 5159749 5159744 -
aagcatgtagaaacagaaaacc

SEQ ID NO: 154947 - DNA, 22 bp, Artificial Sequence
  Synthetic oligonucleotide; CTC chr11 5159720 5159741 5159725 5159720 -
aatagaacaataatgaataaca

SEQ ID NO: 154948 - DNA, 22 bp, Artificial Sequence
  Synthetic oligonucleotide; TTA chr11 5159692 5159713 5159697 5159692 -
aagttgtaatataaagtttcct

SEQ ID NO: 154949 - DNA, 22 bp, Artificial Sequence
  Synthetic oligonucleotide; TTG chr11 5159686 5159707 5159691 5159686 -
taatataaagtttcctattaaa

SEQ ID NO: 154950 - DNA, 22 bp, Artificial Sequence
  Synthetic oligonucleotide; TTT chr11 5159673 5159694 5159678 5159673 -
cctattaaagaaaagcccagga

SEQ ID NO: 154951 - DNA, 22 bp, Artificial Sequence
  Synthetic oligonucleotide; TTC chr11 5159672 5159693 5159677 5159672 -
ctattaaagaaaagcccaggac

SEQ ID NO: 154952 - DNA, 22 bp, Artificial Sequence
  Synthetic oligonucleotide; CTA chr11 5159669 5159690 5159674 5159669 -
ttaaagaaaagcccaggactcg

SEQ ID NO: 154953 - DNA, 22 bp, Artificial Sequence
  Synthetic oligonucleotide; TTA chr11 5159666 5159687 5159671 5159666 -
aagaaaagcccaggactcgatg

SEQ ID NO: 154954 - DNA, 22 bp, Artificial Sequence
  Synthetic oligonucleotide; CTC chr11 5159648 5159669 5159653 5159648 -
gatgggctaccaaacatttcaa

SEQ ID NO: 154955 - DNA, 22 bp, Artificial Sequence
  Synthetic oligonucleotide; CTA chr11 5159639 5159660 5159644 5159639 -
ccaaacatttcaagtagaacta

SEQ ID NO: 154956 - DNA, 22 bp, Artificial Sequence
  Synthetic oligonucleotide; TTT chr11 5159629 5159650 5159634 5159629 -
caagtagaactaatactaatcg

SEQ ID NO: 154957 - DNA, 22 bp, Artificial Sequence
  Synthetic oligonucleotide; TTC chr11 5159628 5159649 5159633 5159628 -
aagtagaactaatactaatcgt

SEQ ID NO: 154958 - DNA, 22 bp, Artificial Sequence
  Synthetic oligonucleotide; CTA chr11 5159617 5159638 5159622 5159617 -
atactaatcgtactcaaattcc

SEQ ID NO: 154959 - DNA, 22 bp, Artificial Sequence
  Synthetic oligonucleotide; CTA chr11 5159611 5159632 5159616 5159611 -
atcgtactcaaattcctcaaac

SEQ ID NO: 154960 - DNA, 22 bp, Artificial Sequence
  Synthetic oligonucleotide; CTC chr11 5159602 5159623 5159607 5159602 -
aaattcctcaaacaaacaaaca

SEQ ID NO: 154961 - DNA, 22 bp, Artificial Sequence
  Synthetic oligonucleotide; TTC chr11 5159596 5159617 5159601 5159596 -
ctcaaacaaacaaacaaataaa

SEQ ID NO: 154962 - DNA, 22 bp, Artificial Sequence
  Synthetic oligonucleotide; CTC chr11 5159593 5159614 5159598 5159593 -
aaacaaacaaacaaataaaaac

SEQ ID NO: 154963 - DNA, 22 bp, Artificial Sequence
  Synthetic oligonucleotide; CTG chr11 5159569 5159590 5159574 5159569 -
aaaagaagggcctacttctaaa

SEQ ID NO: 154964 - DNA, 22 bp, Artificial Sequence
  Synthetic oligonucleotide; CTA chr11 5159555 5159576 5159560 5159555 -
cttctaaacttattctatgagg

SEQ ID NO: 154965 - DNA, 22 bp, Artificial Sequence
  Synthetic oligonucleotide; CTT chr11 5159552 5159573 5159557 5159552 -
ctaaacttattctatgaggcaa

SEQ ID NO: 154966 - DNA, 22 bp, Artificial Sequence
  Synthetic oligonucleotide; TTC chr11 5159551 5159572 5159556 5159551 -
taaacttattctatgaggcaag

SEQ ID NO: 154967 - DNA, 22 bp, Artificial Sequence
  Synthetic oligonucleotide; CTA chr11 5159549 5159570 5159554 5159549 -
aacttattctatgaggcaagca

SEQ ID NO: 154968 - DNA, 22 bp, Artificial Sequence
  Synthetic oligonucleotide; CTT chr11 5159544 5159565 5159549 5159544 -
attctatgaggcaagcattact

SEQ ID NO: 154969 - DNA, 22 bp, Artificial Sequence
  Synthetic oligonucleotide; TTA chr11 5159543 5159564 5159548 5159543 -
ttctatgaggcaagcattactc

SEQ ID NO: 154970 - DNA, 22 bp, Artificial Sequence
  Synthetic oligonucleotide; TTC chr11 5159540 5159561 5159545 5159540 -
tatgaggcaagcattactctaa

SEQ ID NO: 154971 - DNA, 22 bp, Artificial Sequence
  Synthetic oligonucleotide; CTA chr11 5159538 5159559 5159543 5159538 -
tgaggcaagcattactctaata

SEQ ID NO: 154972 - DNA, 22 bp, Artificial Sequence
  Synthetic oligonucleotide; TTA chr11 5159524 5159545 5159529 5159524 -
ctctaatatacccaaaccagac

SEQ ID NO: 154973 - DNA, 22 bp, Artificial Sequence
  Synthetic oligonucleotide; CTC chr11 5159521 5159542 5159526 5159521 -
taatatacccaaaccagaccag

SEQ ID NO: 154974 - DNA, 22 bp, Artificial Sequence
  Synthetic oligonucleotide; CTA chr11 5159519 5159540 5159524 5159519 -
atatacccaaaccagaccagga

SEQ ID NO: 154975 - DNA, 22 bp, Artificial Sequence
  Synthetic oligonucleotide; CTC chr11 5159477 5159498 5159482 5159477 -
aaaggaggtacagtaggaacat

SEQ ID NO: 154976 - DNA, 22 bp, Artificial Sequence
  Synthetic oligonucleotide; CTC chr11 5159450 5159471 5159455 5159450 -
aaaataataaaaaccatatagg

SEQ ID NO: 154977 - DNA, 22 bp, Artificial Sequence
  Synthetic oligonucleotide; CTA chr11 5159413 5159434 5159418 5159413 -
acattatgctgaacagagaaac

SEQ ID NO: 154978 - DNA, 22 bp, Artificial Sequence
  Synthetic oligonucleotide; TTA chr11 5159407 5159428 5159412 5159407 -
tgctgaacagagaaacattgaa

SEQ ID NO: 154979 - DNA, 22 bp, Artificial Sequence
  Synthetic oligonucleotide; CTG chr11 5159402 5159423 5159407 5159402 -
aacagagaaacattgaaggcct

SEQ ID NO: 154980 - DNA, 22 bp, Artificial Sequence
  Synthetic oligonucleotide; TTG chr11 5159387 5159408 5159392 5159387 -
aaggcctttcctctaaggactg

SEQ ID NO: 154981 - DNA, 22 bp, Artificial Sequence
  Synthetic oligonucleotide; CTT chr11 5159379 5159400 5159384 5159379 -
tcctctaaggactgaaataagg

SEQ ID NO: 154982 - DNA, 22 bp, Artificial Sequence
  Synthetic oligonucleotide; TTT chr11 5159378 5159399 5159383 5159378 -
cctctaaggactgaaataaggc

SEQ ID NO: 154983 - DNA, 22 bp, Artificial Sequence
  Synthetic oligonucleotide; TTC chr11 5159377 5159398 5159382 5159377 -
ctctaaggactgaaataaggca

SEQ ID NO: 154984 - DNA, 22 bp, Artificial Sequence
  Synthetic oligonucleotide; CTC chr11 5159374 5159395 5159379 5159374 -
taaggactgaaataaggcaaga

SEQ ID NO: 154985 - DNA, 22 bp, Artificial Sequence
  Synthetic oligonucleotide; CTA chr11 5159372 5159393 5159377 5159372 -
aggactgaaataaggcaagaat

SEQ ID NO: 154986 - DNA, 22 bp, Artificial Sequence
  Synthetic oligonucleotide; CTG chr11 5159365 5159386 5159370 5159365 -
aaataaggcaagaatgctcact

SEQ ID NO: 154987 - DNA, 22 bp, Artificial Sequence
  Synthetic oligonucleotide; CTC chr11 5159346 5159367 5159351 5159346 -
actttcattgccattatttaac

SEQ ID NO: 154988 - DNA, 22 bp, Artificial Sequence
  Synthetic oligonucleotide; CTT chr11 5159342 5159363 5159347 5159342 -
tcattgccattatttaacataa

SEQ ID NO: 154989 - DNA, 22 bp, Artificial Sequence
  Synthetic oligonucleotide; TTT chr11 5159341 5159362 5159346 5159341 -
cattgccattatttaacataat

SEQ ID NO: 154990 - DNA, 22 bp, Artificial Sequence
  Synthetic oligonucleotide; TTC chr11 5159340 5159361 5159345 5159340 -
attgccattatttaacataata

SEQ ID NO: 154991 - DNA, 22 bp, Artificial Sequence
  Synthetic oligonucleotide; TTG chr11 5159336 5159357 5159341 5159336 -
ccattatttaacataatattgg

SEQ ID NO: 154992 - DNA, 22 bp, Artificial Sequence
  Synthetic oligonucleotide; TTA chr11 5159330 5159351 5159335 5159330 -
tttaacataatattggaagtct

SEQ ID NO: 154993 - DNA, 22 bp, Artificial Sequence
  Synthetic oligonucleotide; TTT chr11 5159327 5159348 5159332 5159327 -
aacataatattggaagtcttgg

SEQ ID NO: 154994 - DNA, 22 bp, Artificial Sequence
  Synthetic oligonucleotide; TTA chr11 5159326 5159347 5159331 5159326 -
acataatattggaagtcttgga

SEQ ID NO: 154995 - DNA, 22 bp, Artificial Sequence
  Synthetic oligonucleotide; TTG chr11 5159315 5159336 5159320 5159315 -
gaagtcttggaaagagaaattc

SEQ ID NO: 154996 - DNA, 22 bp, Artificial Sequence
  Synthetic oligonucleotide; CTT chr11 5159307 5159328 5159312 5159307 -
ggaaagagaaattcaggaagag

SEQ ID NO: 154997 - DNA, 22 bp, Artificial Sequence
  Synthetic oligonucleotide; TTG chr11 5159306 5159327 5159311 5159306 -
gaaagagaaattcaggaagaga

SEQ ID NO: 154998 - DNA, 22 bp, Artificial Sequence
  Synthetic oligonucleotide; TTC chr11 5159293 5159314 5159298 5159293 -
aggaagagaaagaaagtgcatc

SEQ ID NO: 154999 - DNA, 22 bp, Artificial Sequence
  Synthetic oligonucleotide; TTG chr11 5159264 5159285 5159269 5159264 -
gaaaggaagaagttaaattagc

SEQ ID NO: 155000 - DNA, 22 bp, Artificial Sequence
  Synthetic oligonucleotide; TTA chr11 5159249 5159270 5159254 5159249 -
aattagcctagtttgtagatga

SEQ ID NO: 155001 - DNA, 22 bp, Artificial Sequence
  Synthetic oligonucleotide; TTA chr11 5159244 5159265 5159249 5159244 -
gcctagtttgtagatgacatga

SEQ ID NO: 155002 - DNA, 22 bp, Artificial Sequence
  Synthetic oligonucleotide; CTA chr11 5159239 5159260 5159244 5159239 -
gtttgtagatgacatgatctta

SEQ ID NO: 155003 - DNA, 22 bp, Artificial Sequence
  Synthetic oligonucleotide; TTT chr11 5159235 5159256 5159240 5159235 -
gtagatgacatgatcttatact

SEQ ID NO: 155004 - DNA, 22 bp, Artificial Sequence
  Synthetic oligonucleotide; TTG chr11 5159234 5159255 5159239 5159234 -
tagatgacatgatcttatactt

SEQ ID NO: 155005 - DNA, 22 bp, Artificial Sequence
  Synthetic oligonucleotide; CTT chr11 5159218 5159239 5159223 5159218 -
atacttagaaaaaacctaaaaa

SEQ ID NO: 155006 - DNA, 22 bp, Artificial Sequence
  Synthetic oligonucleotide; TTA chr11 5159217 5159238 5159222 5159217 -
tacttagaaaaaacctaaaaac

SEQ ID NO: 155007 - DNA, 22 bp, Artificial Sequence
  Synthetic oligonucleotide; CTT chr11 5159212 5159233 5159217 5159212 -
agaaaaaacctaaaaacttcac

SEQ ID NO: 155008 - DNA, 22 bp, Artificial Sequence
  Synthetic oligonucleotide; TTA chr11 5159211 5159232 5159216 5159211 -
gaaaaaacctaaaaacttcact

SEQ ID NO: 155009 - DNA, 22 bp, Artificial Sequence
  Synthetic oligonucleotide; CTA chr11 5159200 5159221 5159205 5159200 -
aaaacttcactaaatactatta

SEQ ID NO: 155010 - DNA, 22 bp, Artificial Sequence
  Synthetic oligonucleotide; CTT chr11 5159193 5159214 5159198 5159193 -
cactaaatactattaaaacgat

SEQ ID NO: 155011 - DNA, 22 bp, Artificial Sequence
  Synthetic oligonucleotide; TTC chr11 5159192 5159213 5159197 5159192 -
actaaatactattaaaacgatt

SEQ ID NO: 155012 - DNA, 22 bp, Artificial Sequence
  Synthetic oligonucleotide; CTA chr11 5159188 5159209 5159193 5159188 -
aatactattaaaacgatttaaa

SEQ ID NO: 155013 - DNA, 22 bp, Artificial Sequence
  Synthetic oligonucleotide; CTA chr11 5159181 5159202 5159186 5159181 -
ttaaaacgatttaaaaaaatca

SEQ ID NO: 155014 - DNA, 22 bp, Artificial Sequence
  Synthetic oligonucleotide; TTA chr11 5159178 5159199 5159183 5159178 -
aaacgatttaaaaaaatcaata

SEQ ID NO: 155015 - DNA, 22 bp, Artificial Sequence
  Synthetic oligonucleotide; TTT chr11 5159169 5159190 5159174 5159169 -
aaaaaaatcaataaagttacag

SEQ ID NO: 155016 - DNA, 22 bp, Artificial Sequence
  Synthetic oligonucleotide; TTA chr11 5159168 5159189 5159173 5159168 -
aaaaaatcaataaagttacagg

SEQ ID NO: 155017 - DNA, 22 bp, Artificial Sequence
  Synthetic oligonucleotide; TTA chr11 5159150 5159171 5159155 5159150 -
caggatatgaaataaaaataca

SEQ ID NO: 155018 - DNA, 22 bp, Artificial Sequence
  Synthetic oligonucleotide; TTT chr11 5159113 5159134 5159118 5159113 -
catatataaaaagttatcaatc

SEQ ID NO: 155019 - DNA, 22 bp, Artificial Sequence
  Synthetic oligonucleotide; TTC chr11 5159112 5159133 5159117 5159112 -
atatataaaaagttatcaatct

SEQ ID NO: 155020 - DNA, 22 bp, Artificial Sequence
  Synthetic oligonucleotide; TTA chr11 5159097 5159118 5159102 5159097 -
tcaatctgcaaaaaaaatcaat

SEQ ID NO: 155021 - DNA, 22 bp, Artificial Sequence
  Synthetic oligonucleotide; CTG chr11 5159089 5159110 5159094 5159089 -
caaaaaaaatcaataaaacaat

SEQ ID NO: 155022 - DNA, 22 bp, Artificial Sequence
  Synthetic oligonucleotide; CTT chr11 5159064 5159085 5159069 5159064 -
atttacaatagcaataaaaata

SEQ ID NO: 155023 - DNA, 22 bp, Artificial Sequence
  Synthetic oligonucleotide; TTA chr11 5159063 5159084 5159068 5159063 -
tttacaatagcaataaaaatat

SEQ ID NO: 155024 - DNA, 22 bp, Artificial Sequence
  Synthetic oligonucleotide; TTT chr11 5159060 5159081 5159065 5159060 -
acaatagcaataaaaatataaa

SEQ ID NO: 155025 - DNA, 22 bp, Artificial Sequence
  Synthetic oligonucleotide; TTA chr11 5159059 5159080 5159064 5159059 -
caatagcaataaaaatataaaa

SEQ ID NO: 155026 - DNA, 22 bp, Artificial Sequence
  Synthetic oligonucleotide; CTA chr11 5159019 5159040 5159024 5159019 -
acccaagaagtaaaagatctct

SEQ ID NO: 155027 - DNA, 22 bp, Artificial Sequence
  Synthetic oligonucleotide; CTC chr11 5158998 5159019 5159003 5158998 -
tataagaaaaattataaaactc

SEQ ID NO: 155028 - DNA, 22 bp, Artificial Sequence
  Synthetic oligonucleotide; CTA chr11 5158996 5159017 5159001 5158996 -
taagaaaaattataaaactctg

SEQ ID NO: 155029 - DNA, 22 bp, Artificial Sequence
  Synthetic oligonucleotide; TTA chr11 5158984 5159005 5158989 5158984 -
taaaactctggtgaaagaaata

SEQ ID NO: 155030 - DNA, 22 bp, Artificial Sequence
  Synthetic oligonucleotide; CTC chr11 5158976 5158997 5158981 5158976 -
tggtgaaagaaatagaagaggg

SEQ ID NO: 155031 - DNA, 22 bp, Artificial Sequence
  Synthetic oligonucleotide; CTG chr11 5158974 5158995 5158979 5158974 -
gtgaaagaaatagaagagggca

SEQ ID NO: 155032 - DNA, 22 bp, Artificial Sequence
  Synthetic oligonucleotide; TTC chr11 5158928 5158949 5158933 5158928 -
catgctcatgaactagaagaat

SEQ ID NO: 155033 - DNA, 22 bp, Artificial Sequence
  Synthetic oligonucleotide; CTC chr11 5158921 5158942 5158926 5158921 -
atgaactagaagaattaatatt

SEQ ID NO: 155034 - DNA, 22 bp, Artificial Sequence
  Synthetic oligonucleotide; CTA chr11 5158913 5158934 5158918 5158913 -
gaagaattaatattaaaatgac

SEQ ID NO: 155035 - DNA, 22 bp, Artificial Sequence
  Synthetic oligonucleotide; TTA chr11 5158904 5158925 5158909 5158904 -
atattaaaatgacaatactacc

SEQ ID NO: 155036 - DNA, 22 bp, Artificial Sequence
  Synthetic oligonucleotide; TTA chr11 5158898 5158919 5158903 5158898 -
aaatgacaatactacccaaagc

SEQ ID NO: 155037 - DNA, 22 bp, Artificial Sequence
  Synthetic oligonucleotide; CTA chr11 5158884 5158905 5158889 5158884 -
cccaaagcaatgtacagattca

SEQ ID NO: 155038 - DNA, 22 bp, Artificial Sequence
  Synthetic oligonucleotide; TTC chr11 5158863 5158884 5158868 5158863 -
agtgcaatttctgtcaaaatac

SEQ ID NO: 155039 - DNA, 22 bp, Artificial Sequence
  Synthetic oligonucleotide; TTT chr11 5158853 5158874 5158858 5158853 -
ctgtcaaaataccaatggcatt

SEQ ID NO: 155040 - DNA, 22 bp, Artificial Sequence
  Synthetic oligonucleotide; TTC chr11 5158852 5158873 5158857 5158852 -
tgtcaaaataccaatggcattc

SEQ ID NO: 155041 - DNA, 22 bp, Artificial Sequence
  Synthetic oligonucleotide; CTG chr11 5158850 5158871 5158855 5158850 -
tcaaaataccaatggcattcac

SEQ ID NO: 155042 - DNA, 22 bp, Artificial Sequence
  Synthetic oligonucleotide; TTC chr11 5158830 5158851 5158835 5158830 -
acagaaatagaaaaacaatcct

SEQ ID NO: 155043 - DNA, 22 bp, Artificial Sequence
  Synthetic oligonucleotide; CTA chr11 5158807 5158828 5158812 5158807 -
atatttatatggaaccacaaaa

SEQ ID NO: 155044 - DNA, 22 bp, Artificial Sequence
  Synthetic oligonucleotide; TTT chr11 5158801 5158822 5158806 5158801 -
atatggaaccacaaaagatccc

SEQ ID NO: 155045 - DNA, 22 bp, Artificial Sequence
  Synthetic oligonucleotide; TTA chr11 5158800 5158821 5158805 5158800 -
tatggaaccacaaaagatcccc

SEQ ID NO: 155046 - DNA, 22 bp, Artificial Sequence
  Synthetic oligonucleotide; CTA chr11 5158770 5158791 5158775 5158770 -
aagcaatcctgagcaaaaagaa

SEQ ID NO: 155047 - DNA, 22 bp, Artificial Sequence
  Synthetic oligonucleotide; CTG chr11 5158759 5158780 5158764 5158759 -
agcaaaaagaacaaaaccaaag

SEQ ID NO: 155048 - DNA, 22 bp, Artificial Sequence
  Synthetic oligonucleotide; CTA chr11 5158734 5158755 5158739 5158734 -
tcacactatatgacttcaaaat

SEQ ID NO: 155049 - DNA, 22 bp, Artificial Sequence
  Synthetic oligonucleotide; CTA chr11 5158726 5158747 5158731 5158726 -
tatgacttcaaaatctactaca

SEQ ID NO: 155050 - DNA, 22 bp, Artificial Sequence
  Synthetic oligonucleotide; CTT chr11 5158718 5158739 5158723 5158718 -
caaaatctactacaaagctaca

SEQ ID NO: 155051 - DNA, 22 bp, Artificial Sequence
  Synthetic oligonucleotide; TTC chr11 5158717 5158738 5158722 5158717 -
aaaatctactacaaagctacag

SEQ ID NO: 155052 - DNA, 22 bp, Artificial Sequence
  Synthetic oligonucleotide; CTA chr11 5158709 5158730 5158714 5158709 -
ctacaaagctacagtagccaaa

SEQ ID NO: 155053 - DNA, 22 bp, Artificial Sequence
  Synthetic oligonucleotide; CTA chr11 5158706 5158727 5158711 5158706 -
caaagctacagtagccaaacag

SEQ ID NO: 155054 - DNA, 22 bp, Artificial Sequence
  Synthetic oligonucleotide; CTA chr11 5158698 5158719 5158703 5158698 -
cagtagccaaacagcacagtac

SEQ ID NO: 155055 - DNA, 22 bp, Artificial Sequence
  Synthetic oligonucleotide; CTG chr11 5158674 5158695 5158679 5158674 -
cataaagacagacatacagccc

SEQ ID NO: 155056 - DNA, 22 bp, Artificial Sequence
  Synthetic oligonucleotide; CTT chr11 5158610 5158631 5158615 5158610 -
aacaaccaagtcatctttaaca

SEQ ID NO: 155057 - DNA, 22 bp, Artificial Sequence
  Synthetic oligonucleotide; TTA chr11 5158609 5158630 5158614 5158609 -
acaaccaagtcatctttaacaa

SEQ ID NO: 155058 - DNA, 22 bp, Artificial Sequence
  Synthetic oligonucleotide; CTT chr11 5158593 5158614 5158598 5158593 -
taacaaaggcatcaagaacata

SEQ ID NO: 155059 - DNA, 22 bp, Artificial Sequence
  Synthetic oligonucleotide; TTT chr11 5158592 5158613 5158597 5158592 -
aacaaaggcatcaagaacataa

SEQ ID NO: 155060 - DNA, 22 bp, Artificial Sequence
  Synthetic oligonucleotide; TTA chr11 5158591 5158612 5158596 5158591 -
acaaaggcatcaagaacataaa

SEQ ID NO: 155061 - DNA, 22 bp, Artificial Sequence
  Synthetic oligonucleotide; CTC chr11 5158537 5158558 5158542 5158537 -
acacctgtaatcccagcacttt

SEQ ID NO: 155062 - DNA, 22 bp, Artificial Sequence
  Synthetic oligonucleotide; CTG chr11 5158530 5158551 5158535 5158530 -
taatcccagcactttgtgaggc

SEQ ID NO: 155063 - DNA, 22 bp, Artificial Sequence
  Synthetic oligonucleotide; CTT chr11 5158516 5158537 5158521 5158516 -
tgtgaggctgaggtggggggat

SEQ ID NO: 155064 - DNA, 22 bp, Artificial Sequence
  Synthetic oligonucleotide; TTT chr11 5158515 5158536 5158520 5158515 -
gtgaggctgaggtggggggatc

SEQ ID NO: 155065 - DNA, 22 bp, Artificial Sequence
  Synthetic oligonucleotide; TTG chr11 5158514 5158535 5158519 5158514 -
tgaggctgaggtggggggatca

SEQ ID NO: 155066 - DNA, 22 bp, Artificial Sequence
  Synthetic oligonucleotide; CTG chr11 5158506 5158527 5158511 5158506 -
aggtggggggatcacgaggtca

SEQ ID NO: 155067 - DNA, 22 bp, Artificial Sequence
  Synthetic oligonucleotide; TTC chr11 5158477 5158498 5158482 5158477 -
aagaccagcctgaccaacgtgg

SEQ ID NO: 155068 - DNA, 22 bp, Artificial Sequence
  Synthetic oligonucleotide; CTG chr11 5158465 5158486 5158470 5158465 -
accaacgtggtgacactccgtc

SEQ ID NO: 155069 - DNA, 22 bp, Artificial Sequence
  Synthetic oligonucleotide; CTC chr11 5158447 5158468 5158452 5158447 -
cgtctctactaaaaatacaaaa

SEQ ID NO: 155070 - DNA, 22 bp, Artificial Sequence
  Synthetic oligonucleotide; CTC chr11 5158441 5158462 5158446 5158441 -
tactaaaaatacaaaaattagc

SEQ ID NO: 155071 - DNA, 22 bp, Artificial Sequence
  Synthetic oligonucleotide; CTA chr11 5158439 5158460 5158444 5158439 -
ctaaaaatacaaaaattagcca

SEQ ID NO: 155072 - DNA, 22 bp, Artificial Sequence
  Synthetic oligonucleotide; CTA chr11 5158436 5158457 5158441 5158436 -
aaaatacaaaaattagccaggc

SEQ ID NO: 155073 - DNA, 22 bp, Artificial Sequence
  Synthetic oligonucleotide; TTA chr11 5158421 5158442 5158426 5158421 -
gccaggcatggtggggcgctcc

SEQ ID NO: 155074 - DNA, 22 bp, Artificial Sequence
  Synthetic oligonucleotide; CTC chr11 5158400 5158421 5158405 5158400 -
ctgtaatcccagatactcagga

SEQ ID NO: 155075 - DNA, 22 bp, Artificial Sequence
  Synthetic oligonucleotide; CTG chr11 5158397 5158418 5158402 5158397 -
taatcccagatactcaggaggc

SEQ ID NO: 155076 - DNA, 22 bp, Artificial Sequence
  Synthetic oligonucleotide; CTC chr11 5158382 5158403 5158387 5158382 -
aggaggctgaggcaggagaatc

SEQ ID NO: 155077 - DNA, 22 bp, Artificial Sequence
  Synthetic oligonucleotide; CTG chr11 5158373 5158394 5158378 5158373 -
aggcaggagaatcgcttgaacc

SEQ ID NO: 155078 - DNA, 22 bp, Artificial Sequence
  Synthetic oligonucleotide; CTT chr11 5158356 5158377 5158361 5158356 -
gaacctgggaggcagaagttgc

SEQ ID NO: 155079 - DNA, 22 bp, Artificial Sequence
  Synthetic oligonucleotide; TTG chr11 5158355 5158376 5158360 5158355 -
aacctgggaggcagaagttgca

SEQ ID NO: 155080 - DNA, 22 bp, Artificial Sequence
  Synthetic oligonucleotide; CTG chr11 5158349 5158370 5158354 5158349 -
ggaggcagaagttgcagtgatc

SEQ ID NO: 155081 - DNA, 22 bp, Artificial Sequence
  Synthetic oligonucleotide; TTG chr11 5158335 5158356 5158340 5158335 -
cagtgatccaagattgtgctgc

SEQ ID NO: 155082 - DNA, 22 bp, Artificial Sequence
  Synthetic oligonucleotide; TTG chr11 5158319 5158340 5158324 5158319 -
tgctgccactgcactccagcct

SEQ ID NO: 155083 - DNA, 22 bp, Artificial Sequence
  Synthetic oligonucleotide; CTG chr11 5158314 5158335 5158319 5158314 -
ccactgcactccagcctgggca

SEQ ID NO: 155084 - DNA, 22 bp, Artificial Sequence
  Synthetic oligonucleotide; CTG chr11 5158308 5158329 5158313 5158308 -
cactccagcctgggcaacagtg

SEQ ID NO: 155085 - DNA, 22 bp, Artificial Sequence
  Synthetic oligonucleotide; CTC chr11 5158303 5158324 5158308 5158303 -
cagcctgggcaacagtgagact

SEQ ID NO: 155086 - DNA, 22 bp, Artificial Sequence
  Synthetic oligonucleotide; CTG chr11 5158296 5158317 5158301 5158296 -
ggcaacagtgagactccatctc

SEQ ID NO: 155087 - DNA, 22 bp, Artificial Sequence
  Synthetic oligonucleotide; CTC chr11 5158280 5158301 5158285 5158280 -
catctcaaaaaaaaaaaaaaaa

SEQ ID NO: 155088 - DNA, 22 bp, Artificial Sequence
  Synthetic oligonucleotide; CTC chr11 5158274 5158295 5158279 5158274 -
aaaaaaaaaaaaaaaaaaggta

SEQ ID NO: 155089 - DNA, 22 bp, Artificial Sequence
  Synthetic oligonucleotide; CTT chr11 5158241 5158262 5158246 5158241 -
ttcaagaaacagtgctaggaaa

SEQ ID NO: 155090 - DNA, 22 bp, Artificial Sequence
  Synthetic oligonucleotide; TTT chr11 5158240 5158261 5158245 5158240 -
tcaagaaacagtgctaggaaaa

SEQ ID NO: 155091 - DNA, 22 bp, Artificial Sequence
  Synthetic oligonucleotide; TTT chr11 5158239 5158260 5158244 5158239 -
caagaaacagtgctaggaaaac

SEQ ID NO: 155092 - DNA, 22 bp, Artificial Sequence
  Synthetic oligonucleotide; TTC chr11 5158238 5158259 5158243 5158238 -
aagaaacagtgctaggaaaact

SEQ ID NO: 155093 - DNA, 22 bp, Artificial Sequence
  Synthetic oligonucleotide; CTA chr11 5158224 5158245 5158229 5158224 -
ggaaaactggatatccatttgc

SEQ ID NO: 155094 - DNA, 22 bp, Artificial Sequence
  Synthetic oligonucleotide; CTG chr11 5158215 5158236 5158220 5158215 -
gatatccatttgcaaaagagta

SEQ ID NO: 155095 - DNA, 22 bp, Artificial Sequence
  Synthetic oligonucleotide; TTT chr11 5158204 5158225 5158209 5158204 -
gcaaaagagtaaaatcggaccc

SEQ ID NO: 155096 - DNA, 22 bp, Artificial Sequence
  Synthetic oligonucleotide; TTG chr11 5158203 5158224 5158208 5158203 -
caaaagagtaaaatcggacccc

SEQ ID NO: 155097 - DNA, 22 bp, Artificial Sequence
  Synthetic oligonucleotide; CTA chr11 5158179 5158200 5158184 5158179 -
tctctcactatatacaaaaatc

SEQ ID NO: 155098 - DNA, 22 bp, Artificial Sequence
  Synthetic oligonucleotide; CTC chr11 5158175 5158196 5158180 5158175 -
tcactatatacaaaaatcaaat

SEQ ID NO: 155099 - DNA, 22 bp, Artificial Sequence
  Synthetic oligonucleotide; CTC chr11 5158173 5158194 5158178 5158173 -
actatatacaaaaatcaaatca

SEQ ID NO: 155100 - DNA, 22 bp, Artificial Sequence
  Synthetic oligonucleotide; CTA chr11 5158169 5158190 5158174 5158169 -
tatacaaaaatcaaatcaagat

SEQ ID NO: 155101 - DNA, 22 bp, Artificial Sequence
  Synthetic oligonucleotide; TTA chr11 5158141 5158162 5158146 5158141 -
aagacttgaatccaatacctga

SEQ ID NO: 155102 - DNA, 22 bp, Artificial Sequence
  Synthetic oligonucleotide; CTT chr11 5158134 5158155 5158139 5158134 -
gaatccaatacctgaaattatg

SEQ ID NO: 155103 - DNA, 22 bp, Artificial Sequence
  Synthetic oligonucleotide; TTG chr11 5158133 5158154 5158138 5158133 -
aatccaatacctgaaattatga

SEQ ID NO: 155104 - DNA, 22 bp, Artificial Sequence
  Synthetic oligonucleotide; CTG chr11 5158120 5158141 5158125 5158120 -
aaattatgaaactactggaaga

SEQ ID NO: 155105 - DNA, 22 bp, Artificial Sequence
  Synthetic oligonucleotide; TTA chr11 5158114 5158135 5158119 5158114 -
tgaaactactggaagaaaacag

SEQ ID NO: 155106 - DNA, 22 bp, Artificial Sequence
  Synthetic oligonucleotide; CTA chr11 5158106 5158127 5158111 5158106 -
ctggaagaaaacagtggggaaa

SEQ ID NO: 155107 - DNA, 22 bp, Artificial Sequence
  Synthetic oligonucleotide; CTG chr11 5158103 5158124 5158108 5158103 -
gaagaaaacagtggggaaaccc

SEQ ID NO: 155108 - DNA, 22 bp, Artificial Sequence
  Synthetic oligonucleotide; CTC chr11 5158079 5158100 5158084 5158079 -
cagggcattcattgatttgggc

SEQ ID NO: 155109 - DNA, 22 bp, Artificial Sequence
  Synthetic oligonucleotide; TTC chr11 5158069 5158090 5158074 5158069 -
attgatttgggcaaatactgtc

SEQ ID NO: 155110 - DNA, 22 bp, Artificial Sequence
  Synthetic oligonucleotide; TTG chr11 5158065 5158086 5158070 5158065 -
atttgggcaaatactgtctatg

SEQ ID NO: 155111 - DNA, 22 bp, Artificial Sequence
  Synthetic oligonucleotide; TTT chr11 5158061 5158082 5158066 5158061 -
gggcaaatactgtctatgagac

SEQ ID NO: 155112 - DNA, 22 bp, Artificial Sequence
  Synthetic oligonucleotide; TTG chr11 5158060 5158081 5158065 5158060 -
ggcaaatactgtctatgagact

SEQ ID NO: 155113 - DNA, 22 bp, Artificial Sequence
  Synthetic oligonucleotide; CTG chr11 5158049 5158070 5158054 5158049 -
tctatgagacttcaaaagcaca

SEQ ID NO: 155114 - DNA, 22 bp, Artificial Sequence
  Synthetic oligonucleotide; CTA chr11 5158045 5158066 5158050 5158045 -
tgagacttcaaaagcacaaata

SEQ ID NO: 155115 - DNA, 22 bp, Artificial Sequence
  Synthetic oligonucleotide; CTT chr11 5158037 5158058 5158042 5158037 -
caaaagcacaaataaccaaaac

SEQ ID NO: 155116 - DNA, 22 bp, Artificial Sequence
  Synthetic oligonucleotide; TTC chr11 5158036 5158057 5158041 5158036 -
aaaagcacaaataaccaaaaca

SEQ ID NO: 155117 - DNA, 22 bp, Artificial Sequence
  Synthetic oligonucleotide; TTG chr11 5158000 5158021 5158005 5158000 -
ggattgtttgaagctctgcaca

SEQ ID NO: 155118 - DNA, 22 bp, Artificial Sequence
  Synthetic oligonucleotide; TTG chr11 5157994 5158015 5157999 5157994 -
tttgaagctctgcacagcaaag

SEQ ID NO: 155119 - DNA, 22 bp, Artificial Sequence
  Synthetic oligonucleotide; TTT chr11 5157991 5158012 5157996 5157991 -
gaagctctgcacagcaaagaaa

SEQ ID NO: 155120 - DNA, 22 bp, Artificial Sequence
  Synthetic oligonucleotide; TTG chr11 5157990 5158011 5157995 5157990 -
aagctctgcacagcaaagaaaa

SEQ ID NO: 155121 - DNA, 22 bp, Artificial Sequence
  Synthetic oligonucleotide; CTC chr11 5157984 5158005 5157989 5157984 -
tgcacagcaaagaaaataataa

SEQ ID NO: 155122 - DNA, 22 bp, Artificial Sequence
  Synthetic oligonucleotide; CTG chr11 5157982 5158003 5157987 5157982 -
cacagcaaagaaaataataaag

SEQ ID NO: 155123 - DNA, 22 bp, Artificial Sequence
  Synthetic oligonucleotide; TTT chr11 5157925 5157946 5157930 5157925 -
gcaaactatatattttacaagg

SEQ ID NO: 155124 - DNA, 22 bp, Artificial Sequence
  Synthetic oligonucleotide; TTG chr11 5157924 5157945 5157929 5157924 -
caaactatatattttacaagga

SEQ ID NO: 155125 - DNA, 22 bp, Artificial Sequence
  Synthetic oligonucleotide; CTA chr11 5157917 5157938 5157922 5157917 -
tatattttacaaggaattgata

SEQ ID NO: 155126 - DNA, 22 bp, Artificial Sequence
  Synthetic oligonucleotide; TTT chr11 5157910 5157931 5157915 5157910 -
tacaaggaattgataaccagaa

SEQ ID NO: 155127 - DNA, 22 bp, Artificial Sequence
  Synthetic oligonucleotide; TTT chr11 5157909 5157930 5157914 5157909 -
acaaggaattgataaccagaat

SEQ ID NO: 155128 - DNA, 22 bp, Artificial Sequence
  Synthetic oligonucleotide; TTA chr11 5157908 5157929 5157913 5157908 -
caaggaattgataaccagaata

SEQ ID NO: 155129 - DNA, 22 bp, Artificial Sequence
  Synthetic oligonucleotide; TTG chr11 5157898 5157919 5157903 5157898 -
ataaccagaatatgcaagaaac

SEQ ID NO: 155130 - DNA, 22 bp, Artificial Sequence
  Synthetic oligonucleotide; CTC chr11 5157874 5157895 5157879 5157874 -
aagcaactcaacagaaaataaa

SEQ ID NO: 155131 - DNA, 22 bp, Artificial Sequence
  Synthetic oligonucleotide; CTC chr11 5157865 5157886 5157870 5157865 -
aacagaaaataaataaataaat

SEQ ID NO: 155132 - DNA, 22 bp, Artificial Sequence
  Synthetic oligonucleotide; CTG chr11 5157822 5157843 5157827 5157822 -
aatagatatttctcaaaagaag

SEQ ID NO: 155133 - DNA, 22 bp, Artificial Sequence
  Synthetic oligonucleotide; TTT chr11 5157811 5157832 5157816 5157811 -
ctcaaaagaagccatacaaatg

SEQ ID NO: 155134 - DNA, 22 bp, Artificial Sequence
  Synthetic oligonucleotide; TTC chr11 5157810 5157831 5157815 5157810 -
tcaaaagaagccatacaaatgg

SEQ ID NO: 155135 - DNA, 22 bp, Artificial Sequence
  Synthetic oligonucleotide; CTC chr11 5157808 5157829 5157813 5157808 -
aaaagaagccatacaaatggcc

SEQ ID NO: 155136 - DNA, 22 bp, Artificial Sequence
  Synthetic oligonucleotide; TTT chr11 5157775 5157796 5157780 5157775 -
gaaaaaatgttcaatatcacta

SEQ ID NO: 155137 - DNA, 22 bp, Artificial Sequence
  Synthetic oligonucleotide; TTG chr11 5157774 5157795 5157779 5157774 -
aaaaaatgttcaatatcactaa

SEQ ID NO: 155138 - DNA, 22 bp, Artificial Sequence
  Synthetic oligonucleotide; TTC chr11 5157763 5157784 5157768 5157763 -
aatatcactaatcaccagataa

SEQ ID NO: 155139 - DNA, 22 bp, Artificial Sequence
  Synthetic oligonucleotide; CTA chr11 5157753 5157774 5157758 5157753 -
atcaccagataaatcaaaacca

SEQ ID NO: 155140 - DNA, 22 bp, Artificial Sequence
  Synthetic oligonucleotide; CTC chr11 5157714 5157735 5157719 5157714 -
accttagttaaaatagcttata

SEQ ID NO: 155141 - DNA, 22 bp, Artificial Sequence
  Synthetic oligonucleotide; CTT chr11 5157709 5157730 5157714 5157709 -
agttaaaatagcttataacaaa

SEQ ID NO: 155142 - DNA, 22 bp, Artificial Sequence
  Synthetic oligonucleotide; TTA chr11 5157708 5157729 5157713 5157708 -
gttaaaatagcttataacaaaa

SEQ ID NO: 155143 - DNA, 22 bp, Artificial Sequence
  Synthetic oligonucleotide; TTA chr11 5157704 5157725 5157709 5157704 -
aaatagcttataacaaaacaaa

SEQ ID NO: 155144 - DNA, 22 bp, Artificial Sequence
  Synthetic oligonucleotide; CTT chr11 5157695 5157716 5157700 5157695 -
ataacaaaacaaaaggaaataa

SEQ ID NO: 155145 - DNA, 22 bp, Artificial Sequence
  Synthetic oligonucleotide; TTA chr11 5157694 5157715 5157699 5157694 -
taacaaaacaaaaggaaataac

SEQ ID NO: 155146 - DNA, 22 bp, Artificial Sequence
  Synthetic oligonucleotide; CTT chr11 5157664 5157685 5157669 5157664 -
gtgtggatgtggacaaagggaa

SEQ ID NO: 155147 - DNA, 22 bp, Artificial Sequence
  Synthetic oligonucleotide; TTG chr11 5157663 5157684 5157668 5157663 -
tgtggatgtggacaaagggaaa

SEQ ID NO: 155148 - DNA, 22 bp, Artificial Sequence
  Synthetic oligonucleotide; CTC chr11 5157636 5157657 5157641 5157636 -
ttacactgttggtgggagtaca

SEQ ID NO: 155149 - DNA, 22 bp, Artificial Sequence
  Synthetic oligonucleotide; CTT chr11 5157634 5157655 5157639 5157634 -
acactgttggtgggagtacaaa

SEQ ID NO: 155150 - DNA, 22 bp, Artificial Sequence
  Synthetic oligonucleotide; TTA chr11 5157633 5157654 5157638 5157633 -
cactgttggtgggagtacaaat

SEQ ID NO: 155151 - DNA, 22 bp, Artificial Sequence
  Synthetic oligonucleotide; CTG chr11 5157628 5157649 5157633 5157628 -
ttggtgggagtacaaattggta

SEQ ID NO: 155152 - DNA, 22 bp, Artificial Sequence
  Synthetic oligonucleotide; TTG chr11 5157625 5157646 5157630 5157625 -
gtgggagtacaaattggtacag

SEQ ID NO: 155153 - DNA, 22 bp, Artificial Sequence
  Synthetic oligonucleotide; TTG chr11 5157609 5157630 5157614 5157609 -
gtacagcaattatgaaggacag

SEQ ID NO: 155154 - DNA, 22 bp, Artificial Sequence
  Synthetic oligonucleotide; TTA chr11 5157597 5157618 5157602 5157597 -
tgaaggacagtatggagatttg

SEQ ID NO: 155155 - DNA, 22 bp, Artificial Sequence
  Synthetic oligonucleotide; TTT chr11 5157576 5157597 5157581 5157576 -
gtcaaaaatgtaaagtagaact

SEQ ID NO: 155156 - DNA, 22 bp, Artificial Sequence
  Synthetic oligonucleotide; TTG chr11 5157575 5157596 5157580 5157575 -
tcaaaaatgtaaagtagaacta

SEQ ID NO: 155157 - DNA, 22 bp, Artificial Sequence
  Synthetic oligonucleotide; CTA chr11 5157553 5157574 5157558 5157553 -
ccatatgatccagcaatatcac

SEQ ID NO: 155158 - DNA, 22 bp, Artificial Sequence
  Synthetic oligonucleotide; CTC chr11 5157529 5157550 5157534 5157529 -
ctaggtatatacccttaaaaga

SEQ ID NO: 155159 - DNA, 22 bp, Artificial Sequence
  Synthetic oligonucleotide; CTA chr11 5157526 5157547 5157531 5157526 -
ggtatatacccttaaaagaata

SEQ ID NO: 155160 - DNA, 22 bp, Artificial Sequence
  Synthetic oligonucleotide; CTT chr11 5157513 5157534 5157518 5157513 -
aaaagaataaattagtatgtcg

SEQ ID NO: 155161 - DNA, 22 bp, Artificial Sequence
  Synthetic oligonucleotide; TTA chr11 5157512 5157533 5157517 5157512 -
aaagaataaattagtatgtcga

SEQ ID NO: 155162 - DNA, 22 bp, Artificial Sequence
  Synthetic oligonucleotide; TTA chr11 5157499 5157520 5157504 5157499 -
gtatgtcgaagatatatcagta

SEQ ID NO: 155163 - DNA, 22 bp, Artificial Sequence
  Synthetic oligonucleotide; CTC chr11 5157474 5157495 5157479 5157474 -
ccatctttattatagcactatt

SEQ ID NO: 155164 - DNA, 22 bp, Artificial Sequence
  Synthetic oligonucleotide; CTT chr11 5157467 5157488 5157472 5157467 -
tattatagcactattcacaaac

SEQ ID NO: 155165 - DNA, 22 bp, Artificial Sequence
  Synthetic oligonucleotide; TTT chr11 5157466 5157487 5157471 5157466 -
attatagcactattcacaaacg

SEQ ID NO: 155166 - DNA, 22 bp, Artificial Sequence
  Synthetic oligonucleotide; TTA chr11 5157465 5157486 5157470 5157465 -
ttatagcactattcacaaacgc

SEQ ID NO: 155167 - DNA, 22 bp, Artificial Sequence
  Synthetic oligonucleotide; TTA chr11 5157462 5157483 5157467 5157462 -
tagcactattcacaaacgccaa

SEQ ID NO: 155168 - DNA, 22 bp, Artificial Sequence
  Synthetic oligonucleotide; CTA chr11 5157454 5157475 5157459 5157454 -
ttcacaaacgccaagatttgaa

SEQ ID NO: 155169 - DNA, 22 bp, Artificial Sequence
  Synthetic oligonucleotide; TTC chr11 5157451 5157472 5157456 5157451 -
acaaacgccaagatttgaaatc

SEQ ID NO: 155170 - DNA, 22 bp, Artificial Sequence
  Synthetic oligonucleotide; TTT chr11 5157435 5157456 5157440 5157435 -
gaaatcaactgatgtattcgtc

SEQ ID NO: 155171 - DNA, 22 bp, Artificial Sequence
  Synthetic oligonucleotide; TTG chr11 5157434 5157455 5157439 5157434 -
aaatcaactgatgtattcgtca

SEQ ID NO: 155172 - DNA, 22 bp, Artificial Sequence
  Synthetic oligonucleotide; CTG chr11 5157424 5157445 5157429 5157424 -
atgtattcgtcaacagataaat

SEQ ID NO: 155173 - DNA, 22 bp, Artificial Sequence
  Synthetic oligonucleotide; TTC chr11 5157416 5157437 5157421 5157416 -
gtcaacagataaatggataaag

SEQ ID NO: 155174 - DNA, 22 bp, Artificial Sequence
  Synthetic oligonucleotide; TTA chr11 5157346 5157367 5157351 5157346 -
ttcaaccataaaaaagaatgaa

SEQ ID NO: 155175 - DNA, 22 bp, Artificial Sequence
  Synthetic oligonucleotide; TTC chr11 5157343 5157364 5157348 5157343 -
aaccataaaaaagaatgaaata

SEQ ID NO: 155176 - DNA, 22 bp, Artificial Sequence
  Synthetic oligonucleotide; TTA chr11 5157318 5157339 5157323 5157318 -
tcaattacagtaacataaatgg

SEQ ID NO: 155177 - DNA, 22 bp, Artificial Sequence
  Synthetic oligonucleotide; TTA chr11 5157311 5157332 5157316 5157311 -
cagtaacataaatggtactgaa

SEQ ID NO: 155178 - DNA, 22 bp, Artificial Sequence
  Synthetic oligonucleotide; CTG chr11 5157291 5157312 5157296 5157291 -
aaagcaattacgttaagtgaaa

SEQ ID NO: 155179 - DNA, 22 bp, Artificial Sequence
  Synthetic oligonucleotide; TTA chr11 5157281 5157302 5157286 5157281 -
cgttaagtgaaataagccaagc

SEQ ID NO: 155180 - DNA, 22 bp, Artificial Sequence
  Synthetic oligonucleotide; TTA chr11 5157276 5157297 5157281 5157276 -
agtgaaataagccaagcacaga

SEQ ID NO: 155181 - DNA, 22 bp, Artificial Sequence
  Synthetic oligonucleotide; TTC chr11 5157234 5157255 5157239 5157234 -
taactcgtgtggaagttaaaaa

SEQ ID NO: 155182 - DNA, 22 bp, Artificial Sequence
  Synthetic oligonucleotide; CTA chr11 5157232 5157253 5157237 5157232 -
actcgtgtggaagttaaaaacg

SEQ ID NO: 155183 - DNA, 22 bp, Artificial Sequence
  Synthetic oligonucleotide; CTC chr11 5157228 5157249 5157233 5157228 -
gtgtggaagttaaaaacgtgga

SEQ ID NO: 155184 - DNA, 22 bp, Artificial Sequence
  Synthetic oligonucleotide; TTA chr11 5157216 5157237 5157221 5157216 -
aaaacgtggatcttatgaagac

SEQ ID NO: 155185 - DNA, 22 bp, Artificial Sequence
  Synthetic oligonucleotide; CTT chr11 5157202 5157223 5157207 5157202 -
atgaagacagagagtagattgg

SEQ ID NO: 155186 - DNA, 22 bp, Artificial Sequence
  Synthetic oligonucleotide; TTA chr11 5157201 5157222 5157206 5157201 -
tgaagacagagagtagattggt

SEQ ID NO: 155187 - DNA, 22 bp, Artificial Sequence
  Synthetic oligonucleotide; TTG chr11 5157181 5157202 5157186 5157181 -
gtagttaccggcggcgggaggg

SEQ ID NO: 155188 - DNA, 22 bp, Artificial Sequence
  Synthetic oligonucleotide; TTA chr11 5157174 5157195 5157179 5157174 -
ccggcggcgggagggaagaaag

SEQ ID NO: 155189 - DNA, 22 bp, Artificial Sequence
  Synthetic oligonucleotide; CTC chr11 5157124 5157145 5157129 5157124 -
ccactctctctctctccctctg

SEQ ID NO: 155190 - DNA, 22 bp, Artificial Sequence
  Synthetic oligonucleotide; CTC chr11 5157118 5157139 5157123 5157118 -
tctctctctccctctgtgtgta

SEQ ID NO: 155191 - DNA, 22 bp, Artificial Sequence
  Synthetic oligonucleotide; CTC chr11 5157116 5157137 5157121 5157116 -
tctctctccctctgtgtgtatg

SEQ ID NO: 155192 - DNA, 22 bp, Artificial Sequence
  Synthetic oligonucleotide; CTC chr11 5157114 5157135 5157119 5157114 -
tctctccctctgtgtgtatgtg

SEQ ID NO: 155193 - DNA, 22 bp, Artificial Sequence
  Synthetic oligonucleotide; CTC chr11 5157112 5157133 5157117 5157112 -
tctccctctgtgtgtatgtgtg

SEQ ID NO: 155194 - DNA, 22 bp, Artificial Sequence
  Synthetic oligonucleotide; CTC chr11 5157110 5157131 5157115 5157110 -
tccctctgtgtgtatgtgtgca

SEQ ID NO: 155195 - DNA, 22 bp, Artificial Sequence
  Synthetic oligonucleotide; CTC chr11 5157108 5157129 5157113 5157108 -
cctctgtgtgtatgtgtgcata

SEQ ID NO: 155196 - DNA, 22 bp, Artificial Sequence
  Synthetic oligonucleotide; CTC chr11 5157104 5157125 5157109 5157104 -
tgtgtgtatgtgtgcatatgta

SEQ ID NO: 155197 - DNA, 22 bp, Artificial Sequence
  Synthetic oligonucleotide; CTG chr11 5157102 5157123 5157107 5157102 -
tgtgtatgtgtgcatatgtatg

SEQ ID NO: 155198 - DNA, 22 bp, Artificial Sequence
  Synthetic oligonucleotide; TTT chr11 5157029 5157050 5157034 5157029 -
gtatatatatgtatgtatgtat

SEQ ID NO: 155199 - DNA, 22 bp, Artificial Sequence
  Synthetic oligonucleotide; TTG chr11 5157028 5157049 5157033 5157028 -
tatatatatgtatgtatgtatt

SEQ ID NO: 155200 - DNA, 22 bp, Artificial Sequence
  Synthetic oligonucleotide; TTA chr11 5157005 5157026 5157010 5157005 -
ccactgaaccgtacactcaaaa

SEQ ID NO: 155201 - DNA, 22 bp, Artificial Sequence
  Synthetic oligonucleotide; CTG chr11 5156999 5157020 5157004 5156999 -
aaccgtacactcaaaaatggta

SEQ ID NO: 155202 - DNA, 22 bp, Artificial Sequence
  Synthetic oligonucleotide; CTC chr11 5156987 5157008 5156992 5156987 -
aaaaatggtaaagatgggctgg

SEQ ID NO: 155203 - DNA, 22 bp, Artificial Sequence
  Synthetic oligonucleotide; CTG chr11 5156966 5156987 5156971 5156966 -
ggtgcggtggccaatgcctgta

SEQ ID NO: 155204 - DNA, 22 bp, Artificial Sequence
  Synthetic oligonucleotide; CTG chr11 5156946 5156967 5156951 5156946 -
taatctcagcactttgggaggc

SEQ ID NO: 155205 - DNA, 22 bp, Artificial Sequence
  Synthetic oligonucleotide; CTC chr11 5156939 5156960 5156944 5156939 -
agcactttgggaggccaaggca

SEQ ID NO: 155206 - DNA, 22 bp, Artificial Sequence
  Synthetic oligonucleotide; CTT chr11 5156932 5156953 5156937 5156932 -
tgggaggccaaggcaggtggat

SEQ ID NO: 155207 - DNA, 22 bp, Artificial Sequence
  Synthetic oligonucleotide; TTT chr11 5156931 5156952 5156936 5156931 -
gggaggccaaggcaggtggatc

SEQ ID NO: 155208 - DNA, 22 bp, Artificial Sequence
  Synthetic oligonucleotide; TTG chr11 5156930 5156951 5156935 5156930 -
ggaggccaaggcaggtggatca

SEQ ID NO: 155209 - DNA, 22 bp, Artificial Sequence
  Synthetic oligonucleotide; CTG chr11 5156881 5156902 5156886 5156881 -
accaacatggtgaaaccctgtc

SEQ ID NO: 155210 - DNA, 22 bp, Artificial Sequence
  Synthetic oligonucleotide; CTG chr11 5156861 5156882 5156866 5156861 -
tctctactaaaaatacaaaaaa

SEQ ID NO: 155211 - DNA, 22 bp, Artificial Sequence
  Synthetic oligonucleotide; CTC chr11 5156857 5156878 5156862 5156857 -
tactaaaaatacaaaaaattag

SEQ ID NO: 155212 - DNA, 22 bp, Artificial Sequence
  Synthetic oligonucleotide; CTA chr11 5156855 5156876 5156860 5156855 -
ctaaaaatacaaaaaattagcc

SEQ ID NO: 155213 - DNA, 22 bp, Artificial Sequence
  Synthetic oligonucleotide; CTA chr11 5156852 5156873 5156857 5156852 -
aaaatacaaaaaattagccagg

SEQ ID NO: 155214 - DNA, 22 bp, Artificial Sequence
  Synthetic oligonucleotide; TTA chr11 5156836 5156857 5156841 5156836 -
gccaggcgtggtggcaggcgcc

SEQ ID NO: 155215 - DNA, 22 bp, Artificial Sequence
  Synthetic oligonucleotide; CTG chr11 5156812 5156833 5156817 5156812 -
taatcccacctacttgggaggc

SEQ ID NO: 155216 - DNA, 22 bp, Artificial Sequence
  Synthetic oligonucleotide; CTA chr11 5156800 5156821 5156805 5156800 -
cttgggaggcttgggcaggaga

SEQ ID NO: 155217 - DNA, 22 bp, Artificial Sequence
  Synthetic oligonucleotide; CTT chr11 5156797 5156818 5156802 5156797 -
gggaggcttgggcaggagaatc

SEQ ID NO: 155218 - DNA, 22 bp, Artificial Sequence
  Synthetic oligonucleotide; TTG chr11 5156796 5156817 5156801 5156796 -
ggaggcttgggcaggagaatcg

SEQ ID NO: 155219 - DNA, 22 bp, Artificial Sequence
  Synthetic oligonucleotide; CTT chr11 5156788 5156809 5156793 5156788 -
gggcaggagaatcgcttgaacc

SEQ ID NO: 155220 - DNA, 22 bp, Artificial Sequence
  Synthetic oligonucleotide; TTG chr11 5156787 5156808 5156792 5156787 -
ggcaggagaatcgcttgaacct

SEQ ID NO: 155221 - DNA, 22 bp, Artificial Sequence
  Synthetic oligonucleotide; CTT chr11 5156771 5156792 5156776 5156771 -
gaacctggtgggggcggaggtt

SEQ ID NO: 155222 - DNA, 22 bp, Artificial Sequence
  Synthetic oligonucleotide; TTG chr11 5156770 5156791 5156775 5156770 -
aacctggtgggggcggaggttg

SEQ ID NO: 155223 - DNA, 22 bp, Artificial Sequence
  Synthetic oligonucleotide; CTG chr11 5156764 5156785 5156769 5156764 -
gtgggggcggaggttgcagtga

SEQ ID NO: 155224 - DNA, 22 bp, Artificial Sequence
  Synthetic oligonucleotide; TTG chr11 5156748 5156769 5156753 5156748 -
cagtgagccaagatcctaccac

SEQ ID NO: 155225 - DNA, 22 bp, Artificial Sequence
  Synthetic oligonucleotide; CTA chr11 5156730 5156751 5156735 5156730 -
ccactgcactccagcctggatg

SEQ ID NO: 155226 - DNA, 22 bp, Artificial Sequence
  Synthetic oligonucleotide; CTG chr11 5156724 5156745 5156729 5156724 -
cactccagcctggatgacggag

SEQ ID NO: 155227 - DNA, 22 bp, Artificial Sequence
  Synthetic oligonucleotide; CTC chr11 5156719 5156740 5156724 5156719 -
cagcctggatgacggagcgaga

SEQ ID NO: 155228 - DNA, 22 bp, Artificial Sequence
  Synthetic oligonucleotide; CTG chr11 5156712 5156733 5156717 5156712 -
gatgacggagcgagactccgtc

SEQ ID NO: 155229 - DNA, 22 bp, Artificial Sequence
  Synthetic oligonucleotide; CTC chr11 5156694 5156715 5156699 5156694 -
cgtctcaaggaaaaaaaaaaag

SEQ ID NO: 155230 - DNA, 22 bp, Artificial Sequence
  Synthetic oligonucleotide; CTC chr11 5156688 5156709 5156693 5156688 -
aaggaaaaaaaaaaagtaaaga

SEQ ID NO: 155231 - DNA, 22 bp, Artificial Sequence
  Synthetic oligonucleotide; TTA chr11 5156656 5156677 5156661 5156656 -
cgtatgtatattttaccttaat

SEQ ID NO: 155232 - DNA, 22 bp, Artificial Sequence
  Synthetic oligonucleotide; TTT chr11 5156643 5156664 5156648 5156643 -
taccttaataaaaataaattta

SEQ ID NO: 155233 - DNA, 22 bp, Artificial Sequence
  Synthetic oligonucleotide; TTT chr11 5156642 5156663 5156647 5156642 -
accttaataaaaataaatttaa

SEQ ID NO: 155234 - DNA, 22 bp, Artificial Sequence
  Synthetic oligonucleotide; TTA chr11 5156641 5156662 5156646 5156641 -
ccttaataaaaataaatttaaa

SEQ ID NO: 155235 - DNA, 22 bp, Artificial Sequence
  Synthetic oligonucleotide; CTT chr11 5156637 5156658 5156642 5156637 -
aataaaaataaatttaaaaaat

SEQ ID NO: 155236 - DNA, 22 bp, Artificial Sequence
  Synthetic oligonucleotide; TTA chr11 5156636 5156657 5156641 5156636 -
ataaaaataaatttaaaaaata

SEQ ID NO: 155237 - DNA, 22 bp, Artificial Sequence
  Synthetic oligonucleotide; TTT chr11 5156622 5156643 5156627 5156622 -
aaaaaatattcagtaggccggg

SEQ ID NO: 155238 - DNA, 22 bp, Artificial Sequence
  Synthetic oligonucleotide; TTA chr11 5156621 5156642 5156626 5156621 -
aaaaatattcagtaggccgggt

SEQ ID NO: 155239 - DNA, 22 bp, Artificial Sequence
  Synthetic oligonucleotide; TTC chr11 5156611 5156632 5156616 5156611 -
agtaggccgggtgcagtggctc

SEQ ID NO: 155240 - DNA, 22 bp, Artificial Sequence
  Synthetic oligonucleotide; CTC chr11 5156589 5156610 5156594 5156589 -
acgcctgtgatcccagcacttt

SEQ ID NO: 155241 - DNA, 22 bp, Artificial Sequence
  Synthetic oligonucleotide; CTG chr11 5156582 5156603 5156587 5156582 -
tgatcccagcactttgggaggc

SEQ ID NO: 155242 - DNA, 22 bp, Artificial Sequence
  Synthetic oligonucleotide; CTT chr11 5156568 5156589 5156573 5156568 -
tgggaggcggaggcgggtggat

SEQ ID NO: 155243 - DNA, 22 bp, Artificial Sequence
  Synthetic oligonucleotide; TTT chr11 5156567 5156588 5156572 5156567 -
gggaggcggaggcgggtggatc

SEQ ID NO: 155244 - DNA, 22 bp, Artificial Sequence
  Synthetic oligonucleotide; TTG chr11 5156566 5156587 5156571 5156566 -
ggaggcggaggcgggtggatca

SEQ ID NO: 155245 - DNA, 22 bp, Artificial Sequence
  Synthetic oligonucleotide; CTG chr11 5156517 5156538 5156522 5156517 -
gctaacacagtgaaaccccgtc

SEQ ID NO: 155246 - DNA, 22 bp, Artificial Sequence
  Synthetic oligonucleotide; CTA chr11 5156513 5156534 5156518 5156513 -
acacagtgaaaccccgtctcta

SEQ ID NO: 155247 - DNA, 22 bp, Artificial Sequence
  Synthetic oligonucleotide; CTC chr11 5156493 5156514 5156498 5156493 -
tactaaaaaaatacaaaaaatt

SEQ ID NO: 155248 - DNA, 22 bp, Artificial Sequence
  Synthetic oligonucleotide; CTA chr11 5156491 5156512 5156496 5156491 -
ctaaaaaaatacaaaaaattag

SEQ ID NO: 155249 - DNA, 22 bp, Artificial Sequence
  Synthetic oligonucleotide; CTA chr11 5156488 5156509 5156493 5156488 -
aaaaaatacaaaaaattagccg

SEQ ID NO: 155250 - DNA, 22 bp, Artificial Sequence
  Synthetic oligonucleotide; TTA chr11 5156470 5156491 5156475 5156470 -
gccgggcttggtggcgggtgcc

SEQ ID NO: 155251 - DNA, 22 bp, Artificial Sequence
  Synthetic oligonucleotide; CTT chr11 5156461 5156482 5156466 5156461 -
ggtggcgggtgcctgtagtccc

SEQ ID NO: 155252 - DNA, 22 bp, Artificial Sequence
  Synthetic oligonucleotide; TTG chr11 5156460 5156481 5156465 5156460 -
gtggcgggtgcctgtagtccca

SEQ ID NO: 155253 - DNA, 22 bp, Artificial Sequence
  Synthetic oligonucleotide; CTG chr11 5156446 5156467 5156451 5156446 -
tagtcccagctactatggaggc

SEQ ID NO: 155254 - DNA, 22 bp, Artificial Sequence
  Synthetic oligonucleotide; CTA chr11 5156434 5156455 5156439 5156434 -
ctatggaggctgaggcgggaga

SEQ ID NO: 155255 - DNA, 22 bp, Artificial Sequence
  Synthetic oligonucleotide; CTA chr11 5156431 5156452 5156436 5156431 -
tggaggctgaggcgggagaatg

SEQ ID NO: 155256 - DNA, 22 bp, Artificial Sequence
  Synthetic oligonucleotide; CTG chr11 5156422 5156443 5156427 5156422 -
aggcgggagaatggcgtgaacg

SEQ ID NO: 155257 - DNA, 22 bp, Artificial Sequence
  Synthetic oligonucleotide; CTT chr11 5156385 5156406 5156390 5156385 -
gcagtgagcagagatcaggggc

SEQ ID NO: 155258 - DNA, 22 bp, Artificial Sequence
  Synthetic oligonucleotide; TTG chr11 5156384 5156405 5156389 5156384 -
cagtgagcagagatcaggggcc

SEQ ID NO: 155259 - DNA, 22 bp, Artificial Sequence
  Synthetic oligonucleotide; CTG chr11 5156358 5156379 5156363 5156358 -
cactccagcctgggcgacagag

SEQ ID NO: 155260 - DNA, 22 bp, Artificial Sequence
  Synthetic oligonucleotide; CTC chr11 5156353 5156374 5156358 5156353 -
cagcctgggcgacagagagaga

SEQ ID NO: 155261 - DNA, 22 bp, Artificial Sequence
  Synthetic oligonucleotide; CTG chr11 5156346 5156367 5156351 5156346 -
ggcgacagagagagactctgtc

SEQ ID NO: 155262 - DNA, 22 bp, Artificial Sequence
  Synthetic oligonucleotide; CTC chr11 5156328 5156349 5156333 5156328 -
tgtctcaaaaaaaagaaaaaaa

SEQ ID NO: 155263 - DNA, 22 bp, Artificial Sequence
  Synthetic oligonucleotide; CTG chr11 5156326 5156347 5156331 5156326 -
tctcaaaaaaaagaaaaaaaaa

SEQ ID NO: 155264 - DNA, 22 bp, Artificial Sequence
  Synthetic oligonucleotide; CTC chr11 5156322 5156343 5156327 5156322 -
aaaaaaaagaaaaaaaaaattt

SEQ ID NO: 155265 - DNA, 22 bp, Artificial Sequence
  Synthetic oligonucleotide; TTT chr11 5156300 5156321 5156305 5156300 -
agtagactagctaaaaaaatcc

SEQ ID NO: 155266 - DNA, 22 bp, Artificial Sequence
  Synthetic oligonucleotide; TTA chr11 5156299 5156320 5156304 5156299 -
gtagactagctaaaaaaatcca

SEQ ID NO: 155267 - DNA, 22 bp, Artificial Sequence
  Synthetic oligonucleotide; CTA chr11 5156291 5156312 5156296 5156291 -
gctaaaaaaatccagagatagt

SEQ ID NO: 155268 - DNA, 22 bp, Artificial Sequence
  Synthetic oligonucleotide; CTA chr11 5156287 5156308 5156292 5156287 -
aaaaaatccagagatagttatt

SEQ ID NO: 155269 - DNA, 22 bp, Artificial Sequence
  Synthetic oligonucleotide; TTA chr11 5156267 5156288 5156272 5156267 -
ttgatgcatatgtaaaagtctt

SEQ ID NO: 155270 - DNA, 22 bp, Artificial Sequence
  Synthetic oligonucleotide; TTG chr11 5156264 5156285 5156269 5156264 -
atgcatatgtaaaagtcttcca

SEQ ID NO: 155271 - DNA, 22 bp, Artificial Sequence
  Synthetic oligonucleotide; CTT chr11 5156245 5156266 5156250 5156245 -
ccaatatttacaagtacaatga

SEQ ID NO: 155272 - DNA, 22 bp, Artificial Sequence
  Synthetic oligonucleotide; TTC chr11 5156244 5156265 5156249 5156244 -
caatatttacaagtacaatgaa

SEQ ID NO: 155273 - DNA, 22 bp, Artificial Sequence
  Synthetic oligonucleotide; TTT chr11 5156236 5156257 5156241 5156236 -
acaagtacaatgaaaaaaaaat

SEQ ID NO: 155274 - DNA, 22 bp, Artificial Sequence
  Synthetic oligonucleotide; TTA chr11 5156235 5156256 5156240 5156235 -
caagtacaatgaaaaaaaaata

SEQ ID NO: 155275 - DNA, 22 bp, Artificial Sequence
  Synthetic oligonucleotide; CTT chr11 5156208 5156229 5156213 5156208 -
gaattaagtgtagaactcattg

SEQ ID NO: 155276 - DNA, 22 bp, Artificial Sequence
  Synthetic oligonucleotide; TTG chr11 5156207 5156228 5156212 5156207 -
aattaagtgtagaactcattga

SEQ ID NO: 155277 - DNA, 22 bp, Artificial Sequence
  Synthetic oligonucleotide; TTA chr11 5156202 5156223 5156207 5156202 -
agtgtagaactcattgacaatg

SEQ ID NO: 155278 - DNA, 22 bp, Artificial Sequence
  Synthetic oligonucleotide; CTC chr11 5156190 5156211 5156195 5156190 -
attgacaatgtttcaaaggatg

SEQ ID NO: 155279 - DNA, 22 bp, Artificial Sequence
  Synthetic oligonucleotide; TTG chr11 5156186 5156207 5156191 5156186 -
acaatgtttcaaaggatgtgag

SEQ ID NO: 155280 - DNA, 22 bp, Artificial Sequence
  Synthetic oligonucleotide; TTT chr11 5156177 5156198 5156182 5156177 -
caaaggatgtgagggataaact

SEQ ID NO: 155281 - DNA, 22 bp, Artificial Sequence
  Synthetic oligonucleotide; TTC chr11 5156176 5156197 5156181 5156176 -
aaaggatgtgagggataaacta

SEQ ID NO: 155282 - DNA, 22 bp, Artificial Sequence
  Synthetic oligonucleotide; CTA chr11 5156154 5156175 5156159 5156154 -
aaatttgggcagtacatgctgt

SEQ ID NO: 155283 - DNA, 22 bp, Artificial Sequence
  Synthetic oligonucleotide; TTT chr11 5156148 5156169 5156153 5156148 -
gggcagtacatgctgttcctgt

SEQ ID NO: 155284 - DNA, 22 bp, Artificial Sequence
  Synthetic oligonucleotide; TTG chr11 5156147 5156168 5156152 5156147 -
ggcagtacatgctgttcctgtg

SEQ ID NO: 155285 - DNA, 22 bp, Artificial Sequence
  Synthetic oligonucleotide; CTG chr11 5156133 5156154 5156138 5156133 -
ttcctgtgtacttggaacagag

SEQ ID NO: 155286 - DNA, 22 bp, Artificial Sequence
  Synthetic oligonucleotide; TTC chr11 5156130 5156151 5156135 5156130 -
ctgtgtacttggaacagaggga

SEQ ID NO: 155287 - DNA, 22 bp, Artificial Sequence
  Synthetic oligonucleotide; CTG chr11 5156127 5156148 5156132 5156127 -
tgtacttggaacagagggagaa

SEQ ID NO: 155288 - DNA, 22 bp, Artificial Sequence
  Synthetic oligonucleotide; CTT chr11 5156120 5156141 5156125 5156120 -
ggaacagagggagaaaatctgg

SEQ ID NO: 155289 - DNA, 22 bp, Artificial Sequence
  Synthetic oligonucleotide; TTG chr11 5156119 5156140 5156124 5156119 -
gaacagagggagaaaatctggg

SEQ ID NO: 155290 - DNA, 22 bp, Artificial Sequence
  Synthetic oligonucleotide; CTG chr11 5156099 5156120 5156104 5156099 -
ggctggaaatattgttatagga

SEQ ID NO: 155291 - DNA, 22 bp, Artificial Sequence
  Synthetic oligonucleotide; CTG chr11 5156094 5156115 5156099 5156094 -
gaaatattgttataggagttag

SEQ ID NO: 155292 - DNA, 22 bp, Artificial Sequence
  Synthetic oligonucleotide; TTG chr11 5156085 5156106 5156090 5156085 -
ttataggagttagcacatgaag

SEQ ID NO: 155293 - DNA, 22 bp, Artificial Sequence
  Synthetic oligonucleotide; TTA chr11 5156082 5156103 5156087 5156082 -
taggagttagcacatgaaggtg

SEQ ID NO: 155294 - DNA, 22 bp, Artificial Sequence
  Synthetic oligonucleotide; TTA chr11 5156073 5156094 5156078 5156073 -
gcacatgaaggtgacaactaaa

SEQ ID NO: 155295 - DNA, 22 bp, Artificial Sequence
  Synthetic oligonucleotide; CTA chr11 5156053 5156074 5156058 5156053 -
aattatttggagtagatggagt

SEQ ID NO: 155296 - DNA, 22 bp, Artificial Sequence
  Synthetic oligonucleotide; TTA chr11 5156048 5156069 5156053 5156048 -
tttggagtagatggagtcacca

SEQ ID NO: 155297 - DNA, 22 bp, Artificial Sequence
  Synthetic oligonucleotide; TTT chr11 5156045 5156066 5156050 5156045 -
ggagtagatggagtcaccagca

SEQ ID NO: 155298 - DNA, 22 bp, Artificial Sequence
  Synthetic oligonucleotide; TTG chr11 5156044 5156065 5156049 5156044 -
gagtagatggagtcaccagcac

SEQ ID NO: 155299 - DNA, 22 bp, Artificial Sequence
  Synthetic oligonucleotide; TTT chr11 5156009 5156030 5156014 5156009 -
tagaatgaaatgacccaagata

SEQ ID NO: 155300 - DNA, 22 bp, Artificial Sequence
  Synthetic oligonucleotide; TTT chr11 5156008 5156029 5156013 5156008 -
agaatgaaatgacccaagatag

SEQ ID NO: 155301 - DNA, 22 bp, Artificial Sequence
  Synthetic oligonucleotide; TTA chr11 5156007 5156028 5156012 5156007 -
gaatgaaatgacccaagataga

SEQ ID NO: 155302 - DNA, 22 bp, Artificial Sequence
  Synthetic oligonucleotide; CTT chr11 5155981 5156002 5155986 5155981 -
tggagagcccccaaatttaaat

SEQ ID NO: 155303 - DNA, 22 bp, Artificial Sequence
  Synthetic oligonucleotide; TTT chr11 5155980 5156001 5155985 5155980 -
ggagagcccccaaatttaaata

SEQ ID NO: 155304 - DNA, 22 bp, Artificial Sequence
  Synthetic oligonucleotide; TTG chr11 5155979 5156000 5155984 5155979 -
gagagcccccaaatttaaataa

SEQ ID NO: 155305 - DNA, 22 bp, Artificial Sequence
  Synthetic oligonucleotide; TTT chr11 5155963 5155984 5155968 5155963 -
aaataaaatcagtataagagaa

SEQ ID NO: 155306 - DNA, 22 bp, Artificial Sequence
  Synthetic oligonucleotide; TTA chr11 5155962 5155983 5155967 5155962 -
aataaaatcagtataagagaag

SEQ ID NO: 155307 - DNA, 22 bp, Artificial Sequence
  Synthetic oligonucleotide; CTA chr11 5155916 5155937 5155921 5155916 -
gtctaaattgtttcttagtgac

SEQ ID NO: 155308 - DNA, 22 bp, Artificial Sequence
  Synthetic oligonucleotide; CTA chr11 5155911 5155932 5155916 5155911 -
aattgtttcttagtgacaaaag

SEQ ID NO: 155309 - DNA, 22 bp, Artificial Sequence
  Synthetic oligonucleotide; TTG chr11 5155906 5155927 5155911 5155906 -
tttcttagtgacaaaagaataa

SEQ ID NO: 155310 - DNA, 22 bp, Artificial Sequence
  Synthetic oligonucleotide; TTT chr11 5155903 5155924 5155908 5155903 -
cttagtgacaaaagaataacct

SEQ ID NO: 155311 - DNA, 22 bp, Artificial Sequence
  Synthetic oligonucleotide; TTC chr11 5155902 5155923 5155907 5155902 -
ttagtgacaaaagaataacctg

SEQ ID NO: 155312 - DNA, 22 bp, Artificial Sequence
  Synthetic oligonucleotide; CTT chr11 5155900 5155921 5155905 5155900 -
agtgacaaaagaataacctgaa

SEQ ID NO: 155313 - DNA, 22 bp, Artificial Sequence
  Synthetic oligonucleotide; TTA chr11 5155899 5155920 5155904 5155899 -
gtgacaaaagaataacctgaat

SEQ ID NO: 155314 - DNA, 22 bp, Artificial Sequence
  Synthetic oligonucleotide; CTG chr11 5155880 5155901 5155885 5155880 -
aatattagattagctgcctata

SEQ ID NO: 155315 - DNA, 22 bp, Artificial Sequence
  Synthetic oligonucleotide; TTA chr11 5155873 5155894 5155878 5155873 -
gattagctgcctatatgctctc

SEQ ID NO: 155316 - DNA, 22 bp, Artificial Sequence
  Synthetic oligonucleotide; TTA chr11 5155868 5155889 5155873 5155868 -
gctgcctatatgctctctgaat

SEQ ID NO: 155317 - DNA, 22 bp, Artificial Sequence
  Synthetic oligonucleotide; CTG chr11 5155864 5155885 5155869 5155864 -
cctatatgctctctgaatcaat

SEQ ID NO: 155318 - DNA, 22 bp, Artificial Sequence
  Synthetic oligonucleotide; CTA chr11 5155860 5155881 5155865 5155860 -
tatgctctctgaatcaatttca

SEQ ID NO: 155319 - DNA, 22 bp, Artificial Sequence
  Synthetic oligonucleotide; CTC chr11 5155853 5155874 5155858 5155853 -
tctgaatcaatttcattcaaca

SEQ ID NO: 155320 - DNA, 22 bp, Artificial Sequence
  Synthetic oligonucleotide; CTC chr11 5155851 5155872 5155856 5155851 -
tgaatcaatttcattcaacatg

SEQ ID NO: 155321 - DNA, 22 bp, Artificial Sequence
  Synthetic oligonucleotide; CTG chr11 5155849 5155870 5155854 5155849 -
aatcaatttcattcaacatgca

SEQ ID NO: 155322 - DNA, 22 bp, Artificial Sequence
  Synthetic oligonucleotide; TTT chr11 5155840 5155861 5155845 5155840 -
cattcaacatgcaacagtacta

SEQ ID NO: 155323 - DNA, 22 bp, Artificial Sequence
  Synthetic oligonucleotide; TTC chr11 5155839 5155860 5155844 5155839 -
attcaacatgcaacagtactat

SEQ ID NO: 155324 - DNA, 22 bp, Artificial Sequence
  Synthetic oligonucleotide; TTC chr11 5155835 5155856 5155840 5155835 -
aacatgcaacagtactattgtt

SEQ ID NO: 155325 - DNA, 22 bp, Artificial Sequence
  Synthetic oligonucleotide; CTA chr11 5155818 5155839 5155823 5155818 -
ttgttttatgctccttcacaga

SEQ ID NO: 155326 - DNA, 22 bp, Artificial Sequence
  Synthetic oligonucleotide; TTG chr11 5155815 5155836 5155820 5155815 -
ttttatgctccttcacagagga

SEQ ID NO: 155327 - DNA, 22 bp, Artificial Sequence
  Synthetic oligonucleotide; TTT chr11 5155812 5155833 5155817 5155812 -
tatgctccttcacagaggaaat

SEQ ID NO: 155328 - DNA, 22 bp, Artificial Sequence
  Synthetic oligonucleotide; TTT chr11 5155811 5155832 5155816 5155811 -
atgctccttcacagaggaaatt

SEQ ID NO: 155329 - DNA, 22 bp, Artificial Sequence
  Synthetic oligonucleotide; TTA chr11 5155810 5155831 5155815 5155810 -
tgctccttcacagaggaaattc

SEQ ID NO: 155330 - DNA, 22 bp, Artificial Sequence
  Synthetic oligonucleotide; CTC chr11 5155805 5155826 5155810 5155805 -
cttcacagaggaaattctggaa

SEQ ID NO: 155331 - DNA, 22 bp, Artificial Sequence
  Synthetic oligonucleotide; CTT chr11 5155802 5155823 5155807 5155802 -
cacagaggaaattctggaaaga

SEQ ID NO: 155332 - DNA, 22 bp, Artificial Sequence
  Synthetic oligonucleotide; TTC chr11 5155801 5155822 5155806 5155801 -
acagaggaaattctggaaagag

SEQ ID NO: 155333 - DNA, 22 bp, Artificial Sequence
  Synthetic oligonucleotide; TTC chr11 5155788 5155809 5155793 5155788 -
tggaaagagcacatggggttcc

SEQ ID NO: 155334 - DNA, 22 bp, Artificial Sequence
  Synthetic oligonucleotide; CTG chr11 5155786 5155807 5155791 5155786 -
gaaagagcacatggggttcctt

SEQ ID NO: 155335 - DNA, 22 bp, Artificial Sequence
  Synthetic oligonucleotide; TTC chr11 5155767 5155788 5155772 5155767 -
cttgccttttcatctgtattcc

SEQ ID NO: 155336 - DNA, 22 bp, Artificial Sequence
  Synthetic oligonucleotide; CTT chr11 5155764 5155785 5155769 5155764 -
gccttttcatctgtattccttg

SEQ ID NO: 155337 - DNA, 22 bp, Artificial Sequence
  Synthetic oligonucleotide; TTG chr11 5155763 5155784 5155768 5155763 -
ccttttcatctgtattccttgt

SEQ ID NO: 155338 - DNA, 22 bp, Artificial Sequence
  Synthetic oligonucleotide; CTT chr11 5155759 5155780 5155764 5155759 -
ttcatctgtattccttgttctc

SEQ ID NO: 155339 - DNA, 22 bp, Artificial Sequence
  Synthetic oligonucleotide; TTT chr11 5155758 5155779 5155763 5155758 -
tcatctgtattccttgttctcc

SEQ ID NO: 155340 - DNA, 22 bp, Artificial Sequence
  Synthetic oligonucleotide; TTT chr11 5155757 5155778 5155762 5155757 -
catctgtattccttgttctcct

SEQ ID NO: 155341 - DNA, 22 bp, Artificial Sequence
  Synthetic oligonucleotide; TTC chr11 5155756 5155777 5155761 5155756 -
atctgtattccttgttctcctg

SEQ ID NO: 155342 - DNA, 22 bp, Artificial Sequence
  Synthetic oligonucleotide; CTG chr11 5155751 5155772 5155756 5155751 -
tattccttgttctcctggaaat

SEQ ID NO: 155343 - DNA, 22 bp, Artificial Sequence
  Synthetic oligonucleotide; TTC chr11 5155746 5155767 5155751 5155746 -
cttgttctcctggaaatccatt

SEQ ID NO: 155344 - DNA, 22 bp, Artificial Sequence
  Synthetic oligonucleotide; CTT chr11 5155743 5155764 5155748 5155743 -
gttctcctggaaatccattata

SEQ ID NO: 155345 - DNA, 22 bp, Artificial Sequence
  Synthetic oligonucleotide; TTG chr11 5155742 5155763 5155747 5155742 -
ttctcctggaaatccattataa

SEQ ID NO: 155346 - DNA, 22 bp, Artificial Sequence
  Synthetic oligonucleotide; TTC chr11 5155739 5155760 5155744 5155739 -
tcctggaaatccattataaata

SEQ ID NO: 155347 - DNA, 22 bp, Artificial Sequence
  Synthetic oligonucleotide; CTC chr11 5155737 5155758 5155742 5155737 -
ctggaaatccattataaatatt

SEQ ID NO: 155348 - DNA, 22 bp, Artificial Sequence
  Synthetic oligonucleotide; CTG chr11 5155734 5155755 5155739 5155734 -
gaaatccattataaatattctc

SEQ ID NO: 155349 - DNA, 22 bp, Artificial Sequence
  Synthetic oligonucleotide; TTA chr11 5155723 5155744 5155728 5155723 -
taaatattctccaccattagta

SEQ ID NO: 155350 - DNA, 22 bp, Artificial Sequence
  Synthetic oligonucleotide; TTC chr11 5155714 5155735 5155719 5155714 -
tccaccattagtatgcttccta

SEQ ID NO: 155351 - DNA, 22 bp, Artificial Sequence
  Synthetic oligonucleotide; CTC chr11 5155712 5155733 5155717 5155712 -
caccattagtatgcttcctaaa

SEQ ID NO: 155352 - DNA, 22 bp, Artificial Sequence
  Synthetic oligonucleotide; TTA chr11 5155704 5155725 5155709 5155704 -
gtatgcttcctaaatttgccaa

SEQ ID NO: 155353 - DNA, 22 bp, Artificial Sequence
  Synthetic oligonucleotide; CTT chr11 5155696 5155717 5155701 5155696 -
cctaaatttgccaatgtctaaa

SEQ ID NO: 155354 - DNA, 22 bp, Artificial Sequence
  Synthetic oligonucleotide; TTC chr11 5155695 5155716 5155700 5155695 -
ctaaatttgccaatgtctaaac

SEQ ID NO: 155355 - DNA, 22 bp, Artificial Sequence
  Synthetic oligonucleotide; CTA chr11 5155692 5155713 5155697 5155692 -
aatttgccaatgtctaaacatt

SEQ ID NO: 155356 - DNA, 22 bp, Artificial Sequence
  Synthetic oligonucleotide; TTT chr11 5155687 5155708 5155692 5155687 -
gccaatgtctaaacattatatc

SEQ ID NO: 155357 - DNA, 22 bp, Artificial Sequence
  Synthetic oligonucleotide; TTG chr11 5155686 5155707 5155691 5155686 -
ccaatgtctaaacattatatca

SEQ ID NO: 155358 - DNA, 22 bp, Artificial Sequence
  Synthetic oligonucleotide; CTA chr11 5155676 5155697 5155681 5155676 -
aacattatatcaagtgtctctt

SEQ ID NO: 155359 - DNA, 22 bp, Artificial Sequence
  Synthetic oligonucleotide; TTA chr11 5155669 5155690 5155674 5155669 -
tatcaagtgtctcttagctaca

SEQ ID NO: 155360 - DNA, 22 bp, Artificial Sequence
  Synthetic oligonucleotide; CTC chr11 5155656 5155677 5155661 5155656 -
ttagctacattcaagaaagcct

SEQ ID NO: 155361 - DNA, 22 bp, Artificial Sequence
  Synthetic oligonucleotide; CTT chr11 5155654 5155675 5155659 5155654 -
agctacattcaagaaagcctag

SEQ ID NO: 155362 - DNA, 22 bp, Artificial Sequence
  Synthetic oligonucleotide; TTA chr11 5155653 5155674 5155658 5155653 -
gctacattcaagaaagcctaga

SEQ ID NO: 155363 - DNA, 22 bp, Artificial Sequence
  Synthetic oligonucleotide; CTA chr11 5155649 5155670 5155654 5155649 -
cattcaagaaagcctagaaacc

SEQ ID NO: 155364 - DNA, 22 bp, Artificial Sequence
  Synthetic oligonucleotide; TTC chr11 5155644 5155665 5155649 5155644 -
aagaaagcctagaaaccagctg
